United States Patent 7,341,835 (METHODS OF ANALYSIS OF ALTERNATIVE SPLICING IN MOUSE) - sequence listing, part 24

SEQ ID NO: 917920 - DNA, 25 bp, Mus musculus
ctgagggacagtaccttctgaattc

SEQ ID NO: 917921 - DNA, 25 bp, Mus musculus
ctgagggcaaatccgtcatcgtagg

SEQ ID NO: 917922 - DNA, 25 bp, Mus musculus
ctgagggcaattccgtcatcgtagg

SEQ ID NO: 917923 - DNA, 25 bp, Mus musculus
ctgagggccacaaggattcccagtc

SEQ ID NO: 917924 - DNA, 25 bp, Mus musculus
ctgagggccagaaggattcccagtc

SEQ ID NO: 917925 - DNA, 25 bp, Mus musculus
ctgaggggaagacatgcaattcgaa

SEQ ID NO: 917926 - DNA, 25 bp, Mus musculus
ctgaggggaagagatgcaattcgaa

SEQ ID NO: 917927 - DNA, 25 bp, Mus musculus
ctgaggggagacgtcgtactcagtt

SEQ ID NO: 917928 - DNA, 25 bp, Mus musculus
ctgaggggagacgtggtactcagtt

SEQ ID NO: 917929 - DNA, 25 bp, Mus musculus
ctgagggtctctgactggaggtgaa

SEQ ID NO: 917930 - DNA, 25 bp, Mus musculus
ctgagggtctctgagtggaggtgaa

SEQ ID NO: 917931 - DNA, 25 bp, Mus musculus
ctgaggtgaaacttcttgattttgg

SEQ ID NO: 917932 - DNA, 25 bp, Mus musculus
ctgaggtgaaacttgttgattttgg

SEQ ID NO: 917933 - DNA, 25 bp, Mus musculus
ctgaggtgcacgccaggaaagatgg

SEQ ID NO: 917934 - DNA, 25 bp, Mus musculus
ctgaggtgcacgcctgtgtttggat

SEQ ID NO: 917935 - DNA, 25 bp, Mus musculus
ctgaggtgcacgcgaaagatggtcc

SEQ ID NO: 917936 - DNA, 25 bp, Mus musculus
ctgaggtgcacggcaggaaagatgg

SEQ ID NO: 917937 - DNA, 25 bp, Mus musculus
ctgaggtgcacggctgtgtttggat

SEQ ID NO: 917938 - DNA, 25 bp, Mus musculus
ctgaggtgcacgggaaagatggtcc

SEQ ID NO: 917939 - DNA, 25 bp, Mus musculus
ctgaggtggatgagtgggtgcaggt

SEQ ID NO: 917940 - DNA, 25 bp, Mus musculus
ctgaggtggatgtgtgggtgcaggt

SEQ ID NO: 917941 - DNA, 25 bp, Mus musculus
ctgaggtgtccccacggatcttgaa

SEQ ID NO: 917942 - DNA, 25 bp, Mus musculus
ctgaggtgtcccgacggatcttgaa

SEQ ID NO: 917943 - DNA, 25 bp, Mus musculus
ctgagtaaagctgaacgacgactgt

SEQ ID NO: 917944 - DNA, 25 bp, Mus musculus
ctgagtaaaggtgaacgacgactgt

SEQ ID NO: 917945 - DNA, 25 bp, Mus musculus
ctgagtacacggcggccaacaagta

SEQ ID NO: 917946 - DNA, 25 bp, Mus musculus
ctgagtacacgggggccaacaagta

SEQ ID NO: 917947 - DNA, 25 bp, Mus musculus
ctgagtacagcgcctcagagggaaa

SEQ ID NO: 917948 - DNA, 25 bp, Mus musculus
ctgagtacagggcctcagagggaaa

SEQ ID NO: 917949 - DNA, 25 bp, Mus musculus
ctgagtatagagctgctccagacca

SEQ ID NO: 917950 - DNA, 25 bp, Mus musculus
ctgagtatagaggtgctccagacca

SEQ ID NO: 917951 - DNA, 25 bp, Mus musculus
ctgagtcaagagcttggattctgaa

SEQ ID NO: 917952 - DNA, 25 bp, Mus musculus
ctgagtcaagtgcttggattctgaa

SEQ ID NO: 917953 - DNA, 25 bp, Mus musculus
ctgagtccaggtccagctgctggac

SEQ ID NO: 917954 - DNA, 25 bp, Mus musculus
ctgagtccaggtcttttggttcatc

SEQ ID NO: 917955 - DNA, 25 bp, Mus musculus
ctgagtccaggtgcagctgctggac

SEQ ID NO: 917956 - DNA, 25 bp, Mus musculus
ctgagtccaggtgttttggttcatc

SEQ ID NO: 917957 - DNA, 25 bp, Mus musculus
ctgagtccggctagcgttgttcctg

SEQ ID NO: 917958 - DNA, 25 bp, Mus musculus
ctgagtccggctagggttgttcctg

SEQ ID NO: 917959 - DNA, 25 bp, Mus musculus
ctgagtctctcccaataccagaagg

SEQ ID NO: 917960 - DNA, 25 bp, Mus musculus
ctgagtctctccgaataccagaagg

SEQ ID NO: 917961 - DNA, 25 bp, Mus musculus
ctgagtctctggccacggaggtgcc

SEQ ID NO: 917962 - DNA, 25 bp, Mus musculus
ctgagtctctgggcacggaggtgcc

SEQ ID NO: 917963 - DNA, 25 bp, Mus musculus
ctgagtctgacaaacccttcatgtc

SEQ ID NO: 917964 - DNA, 25 bp, Mus musculus
ctgagtctgacaaagccttcatgtc

SEQ ID NO: 917965 - DNA, 25 bp, Mus musculus
ctgagtgtatcgcacaagaagataa

SEQ ID NO: 917966 - DNA, 25 bp, Mus musculus
ctgagtgtatcggacaagaagataa

SEQ ID NO: 917967 - DNA, 25 bp, Mus musculus
ctgagtgtcaagagcatgtctccaa

SEQ ID NO: 917968 - DNA, 25 bp, Mus musculus
ctgagtgtcaagaggatgtctccaa

SEQ ID NO: 917969 - DNA, 25 bp, Mus musculus
ctgagtgtggtggacgtcaccagtc

SEQ ID NO: 917970 - DNA, 25 bp, Mus musculus
ctgagtgtggtggaggtcaccagtc

SEQ ID NO: 917971 - DNA, 25 bp, Mus musculus
ctgagtttacaatccaagagaaaag

SEQ ID NO: 917972 - DNA, 25 bp, Mus musculus
ctgagtttacaattttctaatgatg

SEQ ID NO: 917973 - DNA, 25 bp, Mus musculus
ctgagtttactatccaagagaaaag

SEQ ID NO: 917974 - DNA, 25 bp, Mus musculus
ctgagtttactattttctaatgatg

SEQ ID NO: 917975 - DNA, 25 bp, Mus musculus
ctgataaataagagggcaatgcgag

SEQ ID NO: 917976 - DNA, 25 bp, Mus musculus
ctgataaataagtgggcaatgcgag

SEQ ID NO: 917977 - DNA, 25 bp, Mus musculus
ctgataacacagcccatggcgcagg

SEQ ID NO: 917978 - DNA, 25 bp, Mus musculus
ctgataacacagctgccttcttcac

SEQ ID NO: 917979 - DNA, 25 bp, Mus musculus
ctgataacacaggccatggcgcagg

SEQ ID NO: 917980 - DNA, 25 bp, Mus musculus
ctgataacacaggtgccttcttcac

SEQ ID NO: 917981 - DNA, 25 bp, Mus musculus
ctgataacagctacctgtatgtgaa

SEQ ID NO: 917982 - DNA, 25 bp, Mus musculus
ctgataacaggtacctgtatgtgaa

SEQ ID NO: 917983 - DNA, 25 bp, Mus musculus
ctgataaccacgactctgggtcctt

SEQ ID NO: 917984 - DNA, 25 bp, Mus musculus
ctgataaccacgcctctgaagcgtc

SEQ ID NO: 917985 - DNA, 25 bp, Mus musculus
ctgataaccacggctctgaagcgtc

SEQ ID NO: 917986 - DNA, 25 bp, Mus musculus
ctgataaccacgtctctgggtcctt

SEQ ID NO: 917987 - DNA, 25 bp, Mus musculus
ctgataagagactatggtggttaaa

SEQ ID NO: 917988 - DNA, 25 bp, Mus musculus
ctgataagagccaagtgtcaattga

SEQ ID NO: 917989 - DNA, 25 bp, Mus musculus
ctgataagaggcaagtgtcaattga

SEQ ID NO: 917990 - DNA, 25 bp, Mus musculus
ctgataagagtctatggtggttaaa

SEQ ID NO: 917991 - DNA, 25 bp, Mus musculus
ctgataccagccctcgtggctgcaa

SEQ ID NO: 917992 - DNA, 25 bp, Mus musculus
ctgataccagccctggtggctgcaa

SEQ ID NO: 917993 - DNA, 25 bp, Mus musculus
ctgatacccaagcgcacagatgtca

SEQ ID NO: 917994 - DNA, 25 bp, Mus musculus
ctgatacccaagggcacagatgtca

SEQ ID NO: 917995 - DNA, 25 bp, Mus musculus
ctgatactctacatgaacttggaga

SEQ ID NO: 917996 - DNA, 25 bp, Mus musculus
ctgatactctacttgaacttggaga

SEQ ID NO: 917997 - DNA, 25 bp, Mus musculus
ctgatagagttgcaacatctcggat

SEQ ID NO: 917998 - DNA, 25 bp, Mus musculus
ctgatagagttggaacatctcggat

SEQ ID NO: 917999 - DNA, 25 bp, Mus musculus
ctgatagcagctgtgagtaccagag

SEQ ID NO: 918000 - DNA, 25 bp, Mus musculus
ctgatagcaggtgtgagtaccagag

SEQ ID NO: 918001 - DNA, 25 bp, Mus musculus
ctgatagcccagcacatgatgccag

SEQ ID NO: 918002 - DNA, 25 bp, Mus musculus
ctgatagcccagcagatgatgccag

SEQ ID NO: 918003 - DNA, 25 bp, Mus musculus
ctgatagttgccttatcttccgtaa

SEQ ID NO: 918004 - DNA, 25 bp, Mus musculus
ctgatagttgcggatgacggaggct

SEQ ID NO: 918005 - DNA, 25 bp, Mus musculus
ctgatagttggcttatcttccgtaa

SEQ ID NO: 918006 - DNA, 25 bp, Mus musculus
ctgatagttggggatgacggaggct

SEQ ID NO: 918007 - DNA, 25 bp, Mus musculus
ctgatatacccacttccagacttca

SEQ ID NO: 918008 - DNA, 25 bp, Mus musculus
ctgatatacccagttccagacttca

SEQ ID NO: 918009 - DNA, 25 bp, Mus musculus
ctgatatcagcaggagccatgggag

SEQ ID NO: 918010 - DNA, 25 bp, Mus musculus
ctgatatcaggaggagccatgggag

SEQ ID NO: 918011 - DNA, 25 bp, Mus musculus
ctgatatgagcacccatcctctgtc

SEQ ID NO: 918012 - DNA, 25 bp, Mus musculus
ctgatatgaggacccatcctctgtc

SEQ ID NO: 918013 - DNA, 25 bp, Mus musculus
ctgatattagcgaggtgcccctgaa

SEQ ID NO: 918014 - DNA, 25 bp, Mus musculus
ctgatattagggaggtgcccctgaa

SEQ ID NO: 918015 - DNA, 25 bp, Mus musculus
ctgatcaacactggacctccatata

SEQ ID NO: 918016 - DNA, 25 bp, Mus musculus
ctgatcaacagtggacctccatata

SEQ ID NO: 918017 - DNA, 25 bp, Mus musculus
ctgatcaaggaaccttctgtggatg

SEQ ID NO: 918018 - DNA, 25 bp, Mus musculus
ctgatcaaggaagcttctgtggatg

SEQ ID NO: 918019 - DNA, 25 bp, Mus musculus
ctgatcaatgctcctgaaatcatga

SEQ ID NO: 918020 - DNA, 25 bp, Mus musculus
ctgatcaatggtcctgaaatcatga

SEQ ID NO: 918021 - DNA, 25 bp, Mus musculus
ctgatcacaaagcagacccaggaga

SEQ ID NO: 918022 - DNA, 25 bp, Mus musculus
ctgatcacaatgcagacccaggaga

SEQ ID NO: 918023 - DNA, 25 bp, Mus musculus
ctgatcacagcacagctccctctca

SEQ ID NO: 918024 - DNA, 25 bp, Mus musculus
ctgatcacaggacagctccctctca

SEQ ID NO: 918025 - DNA, 25 bp, Mus musculus
ctgatcaccattcacctctttgttg

SEQ ID NO: 918026 - DNA, 25 bp, Mus musculus
ctgatcaccattcagctctttgttg

SEQ ID NO: 918027 - DNA, 25 bp, Mus musculus
ctgatcacccagatgttttggagaa

SEQ ID NO: 918028 - DNA, 25 bp, Mus musculus
ctgatcacccagttgttttggagaa

SEQ ID NO: 918029 - DNA, 25 bp, Mus musculus
ctgatcattaaaaacatcctggaaa

SEQ ID NO: 918030 - DNA, 25 bp, Mus musculus
ctgatcattaaaaagatcctggaaa

SEQ ID NO: 918031 - DNA, 25 bp, Mus musculus
ctgatccccacacgagaaatgctct

SEQ ID NO: 918032 - DNA, 25 bp, Mus musculus
ctgatccccacacgtgatggacaga

SEQ ID NO: 918033 - DNA, 25 bp, Mus musculus
ctgatccccacaggagaaatgctct

SEQ ID NO: 918034 - DNA, 25 bp, Mus musculus
ctgatccccacaggtgatggacaga

SEQ ID NO: 918035 - DNA, 25 bp, Mus musculus
ctgatcctagagtcaaaggtcccca

SEQ ID NO: 918036 - DNA, 25 bp, Mus musculus
ctgatcctagtgtcaaaggtcccca

SEQ ID NO: 918037 - DNA, 25 bp, Mus musculus
ctgatcctggagcctgttcatcagc

SEQ ID NO: 918038 - DNA, 25 bp, Mus musculus
ctgatcctggaggctgttcatcagc

SEQ ID NO: 918039 - DNA, 25 bp, Mus musculus
ctgatcctggtgaacctggagccat

SEQ ID NO: 918040 - DNA, 25 bp, Mus musculus
ctgatcctggtgaagctggagccat

SEQ ID NO: 918041 - DNA, 25 bp, Mus musculus
ctgatcgacctgctccccagtctgt

SEQ ID NO: 918042 - DNA, 25 bp, Mus musculus
ctgatcgacctggtccccagtctgt

SEQ ID NO: 918043 - DNA, 25 bp, Mus musculus
ctgatcgagaagaaacttggcctcc

SEQ ID NO: 918044 - DNA, 25 bp, Mus musculus
ctgatcgagaagtaacttggcctcc

SEQ ID NO: 918045 - DNA, 25 bp, Mus musculus
ctgatcggatggcgcatccccagtg

SEQ ID NO: 918046 - DNA, 25 bp, Mus musculus
ctgatcggatggggcatccccagtg

SEQ ID NO: 918047 - DNA, 25 bp, Mus musculus
ctgatcggtcccaacggtgacagag

SEQ ID NO: 918048 - DNA, 25 bp, Mus musculus
ctgatcggtcccaagggtgacagag

SEQ ID NO: 918049 - DNA, 25 bp, Mus musculus
ctgatctaagcagattacctggagc

SEQ ID NO: 918050 - DNA, 25 bp, Mus musculus
ctgatctaaggagattacctggagc

SEQ ID NO: 918051 - DNA, 25 bp, Mus musculus
ctgatctcagatgctgtttccgtgg

SEQ ID NO: 918052 - DNA, 25 bp, Mus musculus
ctgatctcagttgctgtttccgtgg

SEQ ID NO: 918053 - DNA, 25 bp, Mus musculus
ctgatctccatacagaaaacacgag

SEQ ID NO: 918054 - DNA, 25 bp, Mus musculus
ctgatctccatagagaaaacacgag

SEQ ID NO: 918055 - DNA, 25 bp, Mus musculus
ctgatctctcagagtaccccgaagg

SEQ ID NO: 918056 - DNA, 25 bp, Mus musculus
ctgatctctcagtgtaccccgaagg

SEQ ID NO: 918057 - DNA, 25 bp, Mus musculus
ctgatctcttacaacgtacactttc

SEQ ID NO: 918058 - DNA, 25 bp, Mus musculus
ctgatctcttacaaggtacactttc

SEQ ID NO: 918059 - DNA, 25 bp, Mus musculus
ctgatctgagagaaactgacagtga

SEQ ID NO: 918060 - DNA, 25 bp, Mus musculus
ctgatctgagagatagaaactgaca

SEQ ID NO: 918061 - DNA, 25 bp, Mus musculus
ctgatctgagagccctctcctgcag

SEQ ID NO: 918062 - DNA, 25 bp, Mus musculus
ctgatctgagaggcctctcctgcag

SEQ ID NO: 918063 - DNA, 25 bp, Mus musculus
ctgatctgagagtaactgacagtga

SEQ ID NO: 918064 - DNA, 25 bp, Mus musculus
ctgatctgagagttagaaactgaca

SEQ ID NO: 918065 - DNA, 25 bp, Mus musculus
ctgatctttatgctacagaaccatg

SEQ ID NO: 918066 - DNA, 25 bp, Mus musculus
ctgatctttatggtacagaaccatg

SEQ ID NO: 918067 - DNA, 25 bp, Mus musculus
ctgatgaacacacactatggcttag

SEQ ID NO: 918068 - DNA, 25 bp, Mus musculus
ctgatgaacacacagtatggcttag

SEQ ID NO: 918069 - DNA, 25 bp, Mus musculus
ctgatgaacccaatcgttatgatga

SEQ ID NO: 918070 - DNA, 25 bp, Mus musculus
ctgatgaacccaatggttatgatga

SEQ ID NO: 918071 - DNA, 25 bp, Mus musculus
ctgatgaagaacctgaaagtcatgc

SEQ ID NO: 918072 - DNA, 25 bp, Mus musculus
ctgatgaagaacgtgaaagtcatgc

SEQ ID NO: 918073 - DNA, 25 bp, Mus musculus
ctgatgaagcaaccacactgggtgc

SEQ ID NO: 918074 - DNA, 25 bp, Mus musculus
ctgatgaagcaagcacactgggtgc

SEQ ID NO: 918075 - DNA, 25 bp, Mus musculus
ctgatgaatgtgccttccgacaagg

SEQ ID NO: 918076 - DNA, 25 bp, Mus musculus
ctgatgaatgtggcttccgacaagg

SEQ ID NO: 918077 - DNA, 25 bp, Mus musculus
ctgatgagtaaccggccggtttcag

SEQ ID NO: 918078 - DNA, 25 bp, Mus musculus
ctgatgagtaacgggccggtttcag

SEQ ID NO: 918079 - DNA, 25 bp, Mus musculus
ctgatgattaacctcgtgctggatt

SEQ ID NO: 918080 - DNA, 25 bp, Mus musculus
ctgatgattaacctggtgctggatt

SEQ ID NO: 918081 - DNA, 25 bp, Mus musculus
ctgatgcacgggaacgaagtgggca

SEQ ID NO: 918082 - DNA, 25 bp, Mus musculus
ctgatgcacgggaaggaagtgggca

SEQ ID NO: 918083 - DNA, 25 bp, Mus musculus
ctgatgcagacgcagaagcagttct

SEQ ID NO: 918084 - DNA, 25 bp, Mus musculus
ctgatgcagacggagaagcagttct

SEQ ID NO: 918085 - DNA, 25 bp, Mus musculus
ctgatgcagcagctgagaggtacca

SEQ ID NO: 918086 - DNA, 25 bp, Mus musculus
ctgatgcagcctgagaggtaccagc

SEQ ID NO: 918087 - DNA, 25 bp, Mus musculus
ctgatgcagcgtgagaggtaccagc

SEQ ID NO: 918088 - DNA, 25 bp, Mus musculus
ctgatgcagctgctgagaggtacca

SEQ ID NO: 918089 - DNA, 25 bp, Mus musculus
ctgatgccaagtttcagcatgccac

SEQ ID NO: 918090 - DNA, 25 bp, Mus musculus
ctgatgccaagtttcagtctggaga

SEQ ID NO: 918091 - DNA, 25 bp, Mus musculus
ctgatgccaagtttgagcatgccac

SEQ ID NO: 918092 - DNA, 25 bp, Mus musculus
ctgatgccaagtttgagtctggaga

SEQ ID NO: 918093 - DNA, 25 bp, Mus musculus
ctgatggacacactgatatttatcc

SEQ ID NO: 918094 - DNA, 25 bp, Mus musculus
ctgatggacacagtgatatttatcc

SEQ ID NO: 918095 - DNA, 25 bp, Mus musculus
ctgatggactgcatcgagggccgtg

SEQ ID NO: 918096 - DNA, 25 bp, Mus musculus
ctgatggactgcatggagggccgtg

SEQ ID NO: 918097 - DNA, 25 bp, Mus musculus
ctgatggagttggacattggtgccc

SEQ ID NO: 918098 - DNA, 25 bp, Mus musculus
ctgatggagttggagattggtgccc

SEQ ID NO: 918099 - DNA, 25 bp, Mus musculus
ctgatggcaaagcaaaagagaagaa

SEQ ID NO: 918100 - DNA, 25 bp, Mus musculus
ctgatggcaaaggaaaagagaagaa

SEQ ID NO: 918101 - DNA, 25 bp, Mus musculus
ctgatggcaagacctacagcagcgg

SEQ ID NO: 918102 - DNA, 25 bp, Mus musculus
ctgatggcaagagctacagcagcgg

SEQ ID NO: 918103 - DNA, 25 bp, Mus musculus
ctgatggctgtgcttcacctgccag

SEQ ID NO: 918104 - DNA, 25 bp, Mus musculus
ctgatggctgtggttcacctgccag

SEQ ID NO: 918105 - DNA, 25 bp, Mus musculus
ctgatggtgcagaacaaaagaaaaa

SEQ ID NO: 918106 - DNA, 25 bp, Mus musculus
ctgatggtgcagtacaaaagaaaaa

SEQ ID NO: 918107 - DNA, 25 bp, Mus musculus
ctgatgtaccaggacctgaaggtgc

SEQ ID NO: 918108 - DNA, 25 bp, Mus musculus
ctgatgtaccaggagctgaaggtgc

SEQ ID NO: 918109 - DNA, 25 bp, Mus musculus
ctgatgtatgagccttcctgcgggc

SEQ ID NO: 918110 - DNA, 25 bp, Mus musculus
ctgatgtatgaggcttcctgcgggc

SEQ ID NO: 918111 - DNA, 25 bp, Mus musculus
ctgatgtatgcatcggaacgtcaat

SEQ ID NO: 918112 - DNA, 25 bp, Mus musculus
ctgatgtatggatcggaacgtcaat

SEQ ID NO: 918113 - DNA, 25 bp, Mus musculus
ctgatgtcaatgctgagctggccca

SEQ ID NO: 918114 - DNA, 25 bp, Mus musculus
ctgatgtcaatggtgagctggccca

SEQ ID NO: 918115 - DNA, 25 bp, Mus musculus
ctgatgtcgcagcgacactgggttc

SEQ ID NO: 918116 - DNA, 25 bp, Mus musculus
ctgatgtcgcagggacactgggttc

SEQ ID NO: 918117 - DNA, 25 bp, Mus musculus
ctgatgtctggacgcatctgccctg

SEQ ID NO: 918118 - DNA, 25 bp, Mus musculus
ctgatgtctggaggcatctgccctg

SEQ ID NO: 918119 - DNA, 25 bp, Mus musculus
ctgattatccaactctctccaaaag

SEQ ID NO: 918120 - DNA, 25 bp, Mus musculus
ctgattatccaagtctctccaaaag

SEQ ID NO: 918121 - DNA, 25 bp, Mus musculus
ctgattccacccttcttgccacctg

SEQ ID NO: 918122 - DNA, 25 bp, Mus musculus
ctgattccacgcttcttgccacctg

SEQ ID NO: 918123 - DNA, 25 bp, Mus musculus
ctgattccagatacttcctgccttg

SEQ ID NO: 918124 - DNA, 25 bp, Mus musculus
ctgattccagttacttcctgccttg

SEQ ID NO: 918125 - DNA, 25 bp, Mus musculus
ctgattcctcagcgcatcgtgaagc

SEQ ID NO: 918126 - DNA, 25 bp, Mus musculus
ctgattcctcagggcatcgtgaagc

SEQ ID NO: 918127 - DNA, 25 bp, Mus musculus
ctgattcgagagcttccgtgaggag

SEQ ID NO: 918128 - DNA, 25 bp, Mus musculus
ctgattcgagaggttccgtgaggag

SEQ ID NO: 918129 - DNA, 25 bp, Mus musculus
ctgattctcgccgagctgcttgtct

SEQ ID NO: 918130 - DNA, 25 bp, Mus musculus
ctgattctcggcgagctgcttgtct

SEQ ID NO: 918131 - DNA, 25 bp, Mus musculus
ctgattgaagcctgctgcaaaaatg

SEQ ID NO: 918132 - DNA, 25 bp, Mus musculus
ctgattgaaggctgctgcaaaaatg

SEQ ID NO: 918133 - DNA, 25 bp, Mus musculus
ctgattgacaatatcctggaagagt

SEQ ID NO: 918134 - DNA, 25 bp, Mus musculus
ctgattgacaatttcctggaagagt

SEQ ID NO: 918135 - DNA, 25 bp, Mus musculus
ctgattgatgggatccacacacctc

SEQ ID NO: 918136 - DNA, 25 bp, Mus musculus
ctgattgatgggatgcacacacctc

SEQ ID NO: 918137 - DNA, 25 bp, Mus musculus
ctgattgcatctaaaggctcgttgt

SEQ ID NO: 918138 - DNA, 25 bp, Mus musculus
ctgattgcatctaatggctcgttgt

SEQ ID NO: 918139 - DNA, 25 bp, Mus musculus
ctgattggaaaagaagtaacaagag

SEQ ID NO: 918140 - DNA, 25 bp, Mus musculus
ctgattggaaaagatgtaacaagag

SEQ ID NO: 918141 - DNA, 25 bp, Mus musculus
ctgattggagctcggtgagctggta

SEQ ID NO: 918142 - DNA, 25 bp, Mus musculus
ctgattggaggtcggtgagctggta

SEQ ID NO: 918143 - DNA, 25 bp, Mus musculus
ctgattttagctctgatctcactct

SEQ ID NO: 918144 - DNA, 25 bp, Mus musculus
ctgattttaggtctgatctcactct

SEQ ID NO: 918145 - DNA, 25 bp, Mus musculus
ctgattttgaccaccgcatgccccg

SEQ ID NO: 918146 - DNA, 25 bp, Mus musculus
ctgattttgagcaccgcatgccccg

SEQ ID NO: 918147 - DNA, 25 bp, Mus musculus
ctgcaaaaacaaagctcctgggctc

SEQ ID NO: 918148 - DNA, 25 bp, Mus musculus
ctgcaaaaacaatgctcctgggctc

SEQ ID NO: 918149 - DNA, 25 bp, Mus musculus
ctgcaaaaacagatgtggaaagagc

SEQ ID NO: 918150 - DNA, 25 bp, Mus musculus
ctgcaaaaacagttgtggaaagagc

SEQ ID NO: 918151 - DNA, 25 bp, Mus musculus
ctgcaaaaagcacaactgccccaac

SEQ ID NO: 918152 - DNA, 25 bp, Mus musculus
ctgcaaaaaggacaactgccccaac

SEQ ID NO: 918153 - DNA, 25 bp, Mus musculus
ctgcaaaaccagatccaagtggaga

SEQ ID NO: 918154 - DNA, 25 bp, Mus musculus
ctgcaaaaccagttccaagtggaga

SEQ ID NO: 918155 - DNA, 25 bp, Mus musculus
ctgcaaaacccaaagccctttgcca

SEQ ID NO: 918156 - DNA, 25 bp, Mus musculus
ctgcaaaacccatagccctttgcca

SEQ ID NO: 918157 - DNA, 25 bp, Mus musculus
ctgcaaaagaataatccaagggtga

SEQ ID NO: 918158 - DNA, 25 bp, Mus musculus
ctgcaaaagaattatccaagggtga

SEQ ID NO: 918159 - DNA, 25 bp, Mus musculus
ctgcaaacagatcattgccaaccat

SEQ ID NO: 918160 - DNA, 25 bp, Mus musculus
ctgcaaacagttcattgccaaccat

SEQ ID NO: 918161 - DNA, 25 bp, Mus musculus
ctgcaaaccatgatctcaagaccag

SEQ ID NO: 918162 - DNA, 25 bp, Mus musculus
ctgcaaaccatgcctcaatctaggt

SEQ ID NO: 918163 - DNA, 25 bp, Mus musculus
ctgcaaaccatggctcaatctaggt

SEQ ID NO: 918164 - DNA, 25 bp, Mus musculus
ctgcaaaccatgttctcaagaccag

SEQ ID NO: 918165 - DNA, 25 bp, Mus musculus
ctgcaaactgccacgtcctccccga

SEQ ID NO: 918166 - DNA, 25 bp, Mus musculus
ctgcaaactggcacgtcctccccga

SEQ ID NO: 918167 - DNA, 25 bp, Mus musculus
ctgcaaagctctcatcctgggcatc

SEQ ID NO: 918168 - DNA, 25 bp, Mus musculus
ctgcaaagctctgatcctgggcatc

SEQ ID NO: 918169 - DNA, 25 bp, Mus musculus
ctgcaaaggaagctcaatgacagtc

SEQ ID NO: 918170 - DNA, 25 bp, Mus musculus
ctgcaaaggaaggtcaatgacagtc

SEQ ID NO: 918171 - DNA, 25 bp, Mus musculus
ctgcaaatggcacccgaacccatct

SEQ ID NO: 918172 - DNA, 25 bp, Mus musculus
ctgcaaatggcagccgaacccatct

SEQ ID NO: 918173 - DNA, 25 bp, Mus musculus
ctgcaaatggcgaaagtcctaggtg

SEQ ID NO: 918174 - DNA, 25 bp, Mus musculus
ctgcaaatggcgtaagtcctaggtg

SEQ ID NO: 918175 - DNA, 25 bp, Mus musculus
ctgcaacaagctgtcagctgatggt

SEQ ID NO: 918176 - DNA, 25 bp, Mus musculus
ctgcaacaaggtgtcagctgatggt

SEQ ID NO: 918177 - DNA, 25 bp, Mus musculus
ctgcaacacgccaggcgtcctctcc

SEQ ID NO: 918178 - DNA, 25 bp, Mus musculus
ctgcaacacgcctggcgtcctctcc

SEQ ID NO: 918179 - DNA, 25 bp, Mus musculus
ctgcaaccagatcttcattaacaat

SEQ ID NO: 918180 - DNA, 25 bp, Mus musculus
ctgcaaccagatctttgtcttggat

SEQ ID NO: 918181 - DNA, 25 bp, Mus musculus
ctgcaaccagttcttcattaacaat

SEQ ID NO: 918182 - DNA, 25 bp, Mus musculus
ctgcaaccagttctttgtcttggat

SEQ ID NO: 918183 - DNA, 25 bp, Mus musculus
ctgcaactcaagcatggatgccctg

SEQ ID NO: 918184 - DNA, 25 bp, Mus musculus
ctgcaactcaagctctaaggtacaa

SEQ ID NO: 918185 - DNA, 25 bp, Mus musculus
ctgcaactcaaggatggatgccctg

SEQ ID NO: 918186 - DNA, 25 bp, Mus musculus
ctgcaactcaaggtctaaggtacaa

SEQ ID NO: 918187 - DNA, 25 bp, Mus musculus
ctgcaactcgctcataaagcagctg

SEQ ID NO: 918188 - DNA, 25 bp, Mus musculus
ctgcaactcggtcataaagcagctg

SEQ ID NO: 918189 - DNA, 25 bp, Mus musculus
ctgcaacttcctaaagttgtatcta

SEQ ID NO: 918190 - DNA, 25 bp, Mus musculus
ctgcaacttcctaatgttgtatcta

SEQ ID NO: 918191 - DNA, 25 bp, Mus musculus
ctgcaactttaacatggagccagat

SEQ ID NO: 918192 - DNA, 25 bp, Mus musculus
ctgcaactttaagatggagccagat

SEQ ID NO: 918193 - DNA, 25 bp, Mus musculus
ctgcaagaagagatgacgccttcgt

SEQ ID NO: 918194 - DNA, 25 bp, Mus musculus
ctgcaagaagagttgacgccttcgt

SEQ ID NO: 918195 - DNA, 25 bp, Mus musculus
ctgcaagaattgactgacagaaatg

SEQ ID NO: 918196 - DNA, 25 bp, Mus musculus
ctgcaagaattgtctgacagaaatg

SEQ ID NO: 918197 - DNA, 25 bp, Mus musculus
ctgcaagatattcacctggatccag

SEQ ID NO: 918198 - DNA, 25 bp, Mus musculus
ctgcaagatattcagctggatccag

SEQ ID NO: 918199 - DNA, 25 bp, Mus musculus
ctgcaagatcctcttccaagactac

SEQ ID NO: 918200 - DNA, 25 bp, Mus musculus
ctgcaagatcctgttccaagactac

SEQ ID NO: 918201 - DNA, 25 bp, Mus musculus
ctgcaagccaagcagtctctggtcc

SEQ ID NO: 918202 - DNA, 25 bp, Mus musculus
ctgcaagccaaggagtctctggtcc

SEQ ID NO: 918203 - DNA, 25 bp, Mus musculus
ctgcaaggctgtctatacagttttg

SEQ ID NO: 918204 - DNA, 25 bp, Mus musculus
ctgcaaggctgtgtatacagttttg

SEQ ID NO: 918205 - DNA, 25 bp, Mus musculus
ctgcaagtgggtcgaatccatgtgg

SEQ ID NO: 918206 - DNA, 25 bp, Mus musculus
ctgcaagtgggtggaatccatgtgg

SEQ ID NO: 918207 - DNA, 25 bp, Mus musculus
ctgcaatataagccacaatggaagg

SEQ ID NO: 918208 - DNA, 25 bp, Mus musculus
ctgcaatataaggcacaatggaagg

SEQ ID NO: 918209 - DNA, 25 bp, Mus musculus
ctgcaatcagagattttgcgtggga

SEQ ID NO: 918210 - DNA, 25 bp, Mus musculus
ctgcaatcagagtttttgcgtggga

SEQ ID NO: 918211 - DNA, 25 bp, Mus musculus
ctgcaatggtgacgtgcaggcagag

SEQ ID NO: 918212 - DNA, 25 bp, Mus musculus
ctgcaatggtgaggtgcaggcagag

SEQ ID NO: 918213 - DNA, 25 bp, Mus musculus
ctgcaatgtagacgcagtcagagcg

SEQ ID NO: 918214 - DNA, 25 bp, Mus musculus
ctgcaatgtagaggcagtcagagcg

SEQ ID NO: 918215 - DNA, 25 bp, Mus musculus
ctgcacaaacgacctccttatgtct

SEQ ID NO: 918216 - DNA, 25 bp, Mus musculus
ctgcacaaacgagctccttatgtct

SEQ ID NO: 918217 - DNA, 25 bp, Mus musculus
ctgcacaagaacagaccaaatctcg

SEQ ID NO: 918218 - DNA, 25 bp, Mus musculus
ctgcacaagaacagtccaaatctcg

SEQ ID NO: 918219 - DNA, 25 bp, Mus musculus
ctgcacaagaagcgtgcaggtagct

SEQ ID NO: 918220 - DNA, 25 bp, Mus musculus
ctgcacaagaagggtgcaggtagct

SEQ ID NO: 918221 - DNA, 25 bp, Mus musculus
ctgcacaagatcaactgtcggatgg

SEQ ID NO: 918222 - DNA, 25 bp, Mus musculus
ctgcacaagatcaagtgtcggatgg

SEQ ID NO: 918223 - DNA, 25 bp, Mus musculus
ctgcacaagcagctgttgcagcggc

SEQ ID NO: 918224 - DNA, 25 bp, Mus musculus
ctgcacaagcaggtgttgcagcggc

SEQ ID NO: 918225 - DNA, 25 bp, Mus musculus
ctgcacaagcggctcactgagctgg

SEQ ID NO: 918226 - DNA, 25 bp, Mus musculus
ctgcacaagcgggtcactgagctgg

SEQ ID NO: 918227 - DNA, 25 bp, Mus musculus
ctgcacaatttcaccgtattagaaa

SEQ ID NO: 918228 - DNA, 25 bp, Mus musculus
ctgcacaatttcacggtattagaaa

SEQ ID NO: 918229 - DNA, 25 bp, Mus musculus
ctgcacacagcacccaacataatgg

SEQ ID NO: 918230 - DNA, 25 bp, Mus musculus
ctgcacacagcagagcctgtctcgg

SEQ ID NO: 918231 - DNA, 25 bp, Mus musculus
ctgcacacagcagccaacataatgg

SEQ ID NO: 918232 - DNA, 25 bp, Mus musculus
ctgcacacaggagagcctgtctcgg

SEQ ID NO: 918233 - DNA, 25 bp, Mus musculus
ctgcacacatgaccagtacatgatc

SEQ ID NO: 918234 - DNA, 25 bp, Mus musculus
ctgcacacatgacctgtacatgatc

SEQ ID NO: 918235 - DNA, 25 bp, Mus musculus
ctgcacagaagcgacgcattgacgt

SEQ ID NO: 918236 - DNA, 25 bp, Mus musculus
ctgcacagaagcgaggcattgacgt

SEQ ID NO: 918237 - DNA, 25 bp, Mus musculus
ctgcacagacagcagcatgcaaaac

SEQ ID NO: 918238 - DNA, 25 bp, Mus musculus
ctgcacagacaggagcatgcaaaac

SEQ ID NO: 918239 - DNA, 25 bp, Mus musculus
ctgcacaggacacatcaagactggt

SEQ ID NO: 918240 - DNA, 25 bp, Mus musculus
ctgcacaggacagatcaagactggt

SEQ ID NO: 918241 - DNA, 25 bp, Mus musculus
ctgcacagttatcgtgtgggagatc

SEQ ID NO: 918242 - DNA, 25 bp, Mus musculus
ctgcacagttatggtgtgggagatc

SEQ ID NO: 918243 - DNA, 25 bp, Mus musculus
ctgcacatcaagacctgtgttcctg

SEQ ID NO: 918244 - DNA, 25 bp, Mus musculus
ctgcacatcaagctccctttgtgtg

SEQ ID NO: 918245 - DNA, 25 bp, Mus musculus
ctgcacatcaaggtccctttgtgtg

SEQ ID NO: 918246 - DNA, 25 bp, Mus musculus
ctgcacatcaagtcctgtgttcctg

SEQ ID NO: 918247 - DNA, 25 bp, Mus musculus
ctgcacatcctgacggatgcagatc

SEQ ID NO: 918248 - DNA, 25 bp, Mus musculus
ctgcacatcctgtcggatgcagatc

SEQ ID NO: 918249 - DNA, 25 bp, Mus musculus
ctgcacatgcttcaacgggaccatc

SEQ ID NO: 918250 - DNA, 25 bp, Mus musculus
ctgcacatgcttgaacgggaccatc

SEQ ID NO: 918251 - DNA, 25 bp, Mus musculus
ctgcaccaagcttccgctgcttccc

SEQ ID NO: 918252 - DNA, 25 bp, Mus musculus
ctgcaccaaggttccgctgcttccc

SEQ ID NO: 918253 - DNA, 25 bp, Mus musculus
ctgcaccaatgaacagtacatgatg

SEQ ID NO: 918254 - DNA, 25 bp, Mus musculus
ctgcaccaatgaactgtacatgatg

SEQ ID NO: 918255 - DNA, 25 bp, Mus musculus
ctgcaccccaagcctccatgatgtt

SEQ ID NO: 918256 - DNA, 25 bp, Mus musculus
ctgcaccccaaggctccatgatgtt

SEQ ID NO: 918257 - DNA, 25 bp, Mus musculus
ctgcacctgacacctcctgagcaga

SEQ ID NO: 918258 - DNA, 25 bp, Mus musculus
ctgcacctgacagctcctgagcaga

SEQ ID NO: 918259 - DNA, 25 bp, Mus musculus
ctgcacctggatccaccctgctctt

SEQ ID NO: 918260 - DNA, 25 bp, Mus musculus
ctgcacctggatccattttgttccc

SEQ ID NO: 918261 - DNA, 25 bp, Mus musculus
ctgcacctggatgcaccctgctctt

SEQ ID NO: 918262 - DNA, 25 bp, Mus musculus
ctgcacctggatgcattttgttccc

SEQ ID NO: 918263 - DNA, 25 bp, Mus musculus
ctgcacctgtacaatgctgacagcc

SEQ ID NO: 918264 - DNA, 25 bp, Mus musculus
ctgcacctgttcaatgctgacagcc

SEQ ID NO: 918265 - DNA, 25 bp, Mus musculus
ctgcacctgttcttccctcactgtc

SEQ ID NO: 918266 - DNA, 25 bp, Mus musculus
ctgcacctgttcttgcctcactgtc

SEQ ID NO: 918267 - DNA, 25 bp, Mus musculus
ctgcaccttcagcctggagccagac

SEQ ID NO: 918268 - DNA, 25 bp, Mus musculus
ctgcaccttcaggctggagccagac

SEQ ID NO: 918269 - DNA, 25 bp, Mus musculus
ctgcacgcagaaagatgacaggaaa

SEQ ID NO: 918270 - DNA, 25 bp, Mus musculus
ctgcacgcagtaagatgacaggaaa

SEQ ID NO: 918271 - DNA, 25 bp, Mus musculus
ctgcacggtgaacatctggaacaac

SEQ ID NO: 918272 - DNA, 25 bp, Mus musculus
ctgcacggtgaagatctggaacaac

SEQ ID NO: 918273 - DNA, 25 bp, Mus musculus
ctgcacgtgacactgggctccctgc

SEQ ID NO: 918274 - DNA, 25 bp, Mus musculus
ctgcacgtgacagtgggctccctgc

SEQ ID NO: 918275 - DNA, 25 bp, Mus musculus
ctgcactcaccaagtagagcccatg

SEQ ID NO: 918276 - DNA, 25 bp, Mus musculus
ctgcactcacgaagtagagcccatg

SEQ ID NO: 918277 - DNA, 25 bp, Mus musculus
ctgcactctacacgtgagctccacc

SEQ ID NO: 918278 - DNA, 25 bp, Mus musculus
ctgcactctacaggtgagctccacc

SEQ ID NO: 918279 - DNA, 25 bp, Mus musculus
ctgcactctgagagagaagctggac

SEQ ID NO: 918280 - DNA, 25 bp, Mus musculus
ctgcactctgagtgagaagctggac

SEQ ID NO: 918281 - DNA, 25 bp, Mus musculus
ctgcactgccagcacggggtctgga

SEQ ID NO: 918282 - DNA, 25 bp, Mus musculus
ctgcactgccaggacggggtctgga

SEQ ID NO: 918283 - DNA, 25 bp, Mus musculus
ctgcactgccggccttggtgaatat

SEQ ID NO: 918284 - DNA, 25 bp, Mus musculus
ctgcactgccgggcttggtgaatat

SEQ ID NO: 918285 - DNA, 25 bp, Mus musculus
ctgcactgctgaaacgtactaatgc

SEQ ID NO: 918286 - DNA, 25 bp, Mus musculus
ctgcactgctgaaaggtactaatgc

SEQ ID NO: 918287 - DNA, 25 bp, Mus musculus
ctgcactggaagctcaatgagagtc

SEQ ID NO: 918288 - DNA, 25 bp, Mus musculus
ctgcactggaaggtcaatgagagtc

SEQ ID NO: 918289 - DNA, 25 bp, Mus musculus
ctgcactgggaaatatggctttgta

SEQ ID NO: 918290 - DNA, 25 bp, Mus musculus
ctgcactgggaacgcttgtcgctta

SEQ ID NO: 918291 - DNA, 25 bp, Mus musculus
ctgcactgggaaggcttgtcgctta

SEQ ID NO: 918292 - DNA, 25 bp, Mus musculus
ctgcactgggaattatggctttgta

SEQ ID NO: 918293 - DNA, 25 bp, Mus musculus
ctgcactgtcatcgtatggcagatt

SEQ ID NO: 918294 - DNA, 25 bp, Mus musculus
ctgcactgtcatggtatggcagatt

SEQ ID NO: 918295 - DNA, 25 bp, Mus musculus
ctgcacttagagaaagcacaatggg

SEQ ID NO: 918296 - DNA, 25 bp, Mus musculus
ctgcacttagagtaagcacaatggg

SEQ ID NO: 918297 - DNA, 25 bp, Mus musculus
ctgcactttacacgtggctttgcag

SEQ ID NO: 918298 - DNA, 25 bp, Mus musculus
ctgcactttacaggtggctttgcag

SEQ ID NO: 918299 - DNA, 25 bp, Mus musculus
ctgcactttgaggaggaagagatca

SEQ ID NO: 918300 - DNA, 25 bp, Mus musculus
ctgcactttgtggaggaagagatca

SEQ ID NO: 918301 - DNA, 25 bp, Mus musculus
ctgcagaaactgattgaagccgaca

SEQ ID NO: 918302 - DNA, 25 bp, Mus musculus
ctgcagaaactgtttgaagccgaca

SEQ ID NO: 918303 - DNA, 25 bp, Mus musculus
ctgcagaacacaagcgcaagatcat

SEQ ID NO: 918304 - DNA, 25 bp, Mus musculus
ctgcagaacacaagggcaagatcat

SEQ ID NO: 918305 - DNA, 25 bp, Mus musculus
ctgcagaacattcgcctccgggagt

SEQ ID NO: 918306 - DNA, 25 bp, Mus musculus
ctgcagaacattcggctccgggagt

SEQ ID NO: 918307 - DNA, 25 bp, Mus musculus
ctgcagaatgacagatttgaccagt

SEQ ID NO: 918308 - DNA, 25 bp, Mus musculus
ctgcagaatgtcagatttgaccagt

SEQ ID NO: 918309 - DNA, 25 bp, Mus musculus
ctgcagacagaccctgctgcagtta

SEQ ID NO: 918310 - DNA, 25 bp, Mus musculus
ctgcagacagtccctgctgcagtta

SEQ ID NO: 918311 - DNA, 25 bp, Mus musculus
ctgcagacctctcacaaggatgaga

SEQ ID NO: 918312 - DNA, 25 bp, Mus musculus
ctgcagacctctcagcgaacatccc

SEQ ID NO: 918313 - DNA, 25 bp, Mus musculus
ctgcagacctctgacaaggatgaga

SEQ ID NO: 918314 - DNA, 25 bp, Mus musculus
ctgcagacctctgagcgaacatccc

SEQ ID NO: 918315 - DNA, 25 bp, Mus musculus
ctgcagactaacaacattcttgtat

SEQ ID NO: 918316 - DNA, 25 bp, Mus musculus
ctgcagactaacaagattcttgtat

SEQ ID NO: 918317 - DNA, 25 bp, Mus musculus
ctgcagagagaatagtgtgaacttt

SEQ ID NO: 918318 - DNA, 25 bp, Mus musculus
ctgcagagagtatagtgtgaacttt

SEQ ID NO: 918319 - DNA, 25 bp, Mus musculus
ctgcagagatgactcaaggaatgag

SEQ ID NO: 918320 - DNA, 25 bp, Mus musculus
ctgcagagatgagtcaaggaatgag

SEQ ID NO: 918321 - DNA, 25 bp, Mus musculus
ctgcagagatttattctccgaatga

SEQ ID NO: 918322 - DNA, 25 bp, Mus musculus
ctgcagagattttttctccgaatga

SEQ ID NO: 918323 - DNA, 25 bp, Mus musculus
ctgcagagccaccgtcaagatgctg

SEQ ID NO: 918324 - DNA, 25 bp, Mus musculus
ctgcagagccacggtcaagatgctg

SEQ ID NO: 918325 - DNA, 25 bp, Mus musculus
ctgcagagccctactttcagggagg

SEQ ID NO: 918326 - DNA, 25 bp, Mus musculus
ctgcagagccctccctttcgggaag

SEQ ID NO: 918327 - DNA, 25 bp, Mus musculus
ctgcagagccctgcctttcgggaag

SEQ ID NO: 918328 - DNA, 25 bp, Mus musculus
ctgcagagcccttctttcagggagg

SEQ ID NO: 918329 - DNA, 25 bp, Mus musculus
ctgcagagctacatctcagaaatcg

SEQ ID NO: 918330 - DNA, 25 bp, Mus musculus
ctgcagagcttcatctcagaaatcg

SEQ ID NO: 918331 - DNA, 25 bp, Mus musculus
ctgcagaggccacagctattaagaa

SEQ ID NO: 918332 - DNA, 25 bp, Mus musculus
ctgcagaggccagagctattaagaa

SEQ ID NO: 918333 - DNA, 25 bp, Mus musculus
ctgcagagtgagcacccccacagtg

SEQ ID NO: 918334 - DNA, 25 bp, Mus musculus
ctgcagagtgagcagccccacagtg

SEQ ID NO: 918335 - DNA, 25 bp, Mus musculus
ctgcagatttggcacacagcaggcc

SEQ ID NO: 918336 - DNA, 25 bp, Mus musculus
ctgcagatttgggacacagcaggcc

SEQ ID NO: 918337 - DNA, 25 bp, Mus musculus
ctgcagcaagagatccactgttgtg

SEQ ID NO: 918338 - DNA, 25 bp, Mus musculus
ctgcagcaagagttccactgttgtg

SEQ ID NO: 918339 - DNA, 25 bp, Mus musculus
ctgcagcactgtttcagctggcttt

SEQ ID NO: 918340 - DNA, 25 bp, Mus musculus
ctgcagcactgtttgagctggcttt

SEQ ID NO: 918341 - DNA, 25 bp, Mus musculus
ctgcagcagaagattctctgtggca

SEQ ID NO: 918342 - DNA, 25 bp, Mus musculus
ctgcagcagaagtttctctgtggca

SEQ ID NO: 918343 - DNA, 25 bp, Mus musculus
ctgcagcatccacgtcacctacttc

SEQ ID NO: 918344 - DNA, 25 bp, Mus musculus
ctgcagcatccaggtcacctacttc

SEQ ID NO: 918345 - DNA, 25 bp, Mus musculus
ctgcagcatcctcgtgccgtgttaa

SEQ ID NO: 918346 - DNA, 25 bp, Mus musculus
ctgcagcatcctggtgccgtgttaa

SEQ ID NO: 918347 - DNA, 25 bp, Mus musculus
ctgcagcatgagggcgtctctggat

SEQ ID NO: 918348 - DNA, 25 bp, Mus musculus
ctgcagcatgtgggcgtctctggat

SEQ ID NO: 918349 - DNA, 25 bp, Mus musculus
ctgcagcattgtcactttcttagca

SEQ ID NO: 918350 - DNA, 25 bp, Mus musculus
ctgcagcattgtcagtttcttagca

SEQ ID NO: 918351 - DNA, 25 bp, Mus musculus
ctgcagccaaaaaacgggaagagga

SEQ ID NO: 918352 - DNA, 25 bp, Mus musculus
ctgcagccaacagacgcagtaagcc

SEQ ID NO: 918353 - DNA, 25 bp, Mus musculus
ctgcagccaacagactaagcccaga

SEQ ID NO: 918354 - DNA, 25 bp, Mus musculus
ctgcagccaacagaggcagtaagcc

SEQ ID NO: 918355 - DNA, 25 bp, Mus musculus
ctgcagccaacagagtaagcccaga

SEQ ID NO: 918356 - DNA, 25 bp, Mus musculus
ctgcagccaataaacgggaagagga

SEQ ID NO: 918357 - DNA, 25 bp, Mus musculus
ctgcagccagaacaatatccagtta

SEQ ID NO: 918358 - DNA, 25 bp, Mus musculus
ctgcagccagaaccagcgtttgacg

SEQ ID NO: 918359 - DNA, 25 bp, Mus musculus
ctgcagccagaaccgtttgacgtca

SEQ ID NO: 918360 - DNA, 25 bp, Mus musculus
ctgcagccagaagaatatccagtta

SEQ ID NO: 918361 - DNA, 25 bp, Mus musculus
ctgcagccagaagcagcgtttgacg

SEQ ID NO: 918362 - DNA, 25 bp, Mus musculus
ctgcagccagaagcgtttgacgtca

SEQ ID NO: 918363 - DNA, 25 bp, Mus musculus
ctgcagccgccccgccatctgcttc

SEQ ID NO: 918364 - DNA, 25 bp, Mus musculus
ctgcagccgccccggacaggccatc

SEQ ID NO: 918365 - DNA, 25 bp, Mus musculus
ctgcagccgcccggccatctgcttc

SEQ ID NO: 918366 - DNA, 25 bp, Mus musculus
ctgcagccgcccgggacaggccatc

SEQ ID NO: 918367 - DNA, 25 bp, Mus musculus
ctgcagccgtctctttgtgaagacc

SEQ ID NO: 918368 - DNA, 25 bp, Mus musculus
ctgcagccgtctgtttgtgaagacc

SEQ ID NO: 918369 - DNA, 25 bp, Mus musculus
ctgcagcctgtctacgtggggtgac

SEQ ID NO: 918370 - DNA, 25 bp, Mus musculus
ctgcagcctgtctaggtggggtgac

SEQ ID NO: 918371 - DNA, 25 bp, Mus musculus
ctgcagcgagagcccttcgcattgc

SEQ ID NO: 918372 - DNA, 25 bp, Mus musculus
ctgcagcgagagctggaggtagagg

SEQ ID NO: 918373 - DNA, 25 bp, Mus musculus
ctgcagcgagaggtggaggtagagg

SEQ ID NO: 918374 - DNA, 25 bp, Mus musculus
ctgcagcgagattggccaaggagca

SEQ ID NO: 918375 - DNA, 25 bp, Mus musculus
ctgcagcgagcctatagtttggcca

SEQ ID NO: 918376 - DNA, 25 bp, Mus musculus
ctgcagcgaggctatagtttggcca

SEQ ID NO: 918377 - DNA, 25 bp, Mus musculus
ctgcagcgagtgcccttcgcattgc

SEQ ID NO: 918378 - DNA, 25 bp, Mus musculus
ctgcagcgagtttggccaaggagca

SEQ ID NO: 918379 - DNA, 25 bp, Mus musculus
ctgcagctcaagcaccccctcaaca

SEQ ID NO: 918380 - DNA, 25 bp, Mus musculus
ctgcagctcaagcagcccctcaaca

SEQ ID NO: 918381 - DNA, 25 bp, Mus musculus
ctgcagctcattaacgtcacacggc

SEQ ID NO: 918382 - DNA, 25 bp, Mus musculus
ctgcagctcattaaggtcacacggc

SEQ ID NO: 918383 - DNA, 25 bp, Mus musculus
ctgcagctgactctgtacagcagcc

SEQ ID NO: 918384 - DNA, 25 bp, Mus musculus
ctgcagctgactgtgtacagcagcc

SEQ ID NO: 918385 - DNA, 25 bp, Mus musculus
ctgcagctggagctgtggaacacca

SEQ ID NO: 918386 - DNA, 25 bp, Mus musculus
ctgcagctggaggtgtggaacacca

SEQ ID NO: 918387 - DNA, 25 bp, Mus musculus
ctgcagctggtgaagaacacaagta

SEQ ID NO: 918388 - DNA, 25 bp, Mus musculus
ctgcagctggtgtagaacacaagta

SEQ ID NO: 918389 - DNA, 25 bp, Mus musculus
ctgcagctgtcacaactcctagctg

SEQ ID NO: 918390 - DNA, 25 bp, Mus musculus
ctgcagctgtgacaactcctagctg

SEQ ID NO: 918391 - DNA, 25 bp, Mus musculus
ctgcagcttccctcttgtggacaaa

SEQ ID NO: 918392 - DNA, 25 bp, Mus musculus
ctgcagcttcgctcttgtggacaaa

SEQ ID NO: 918393 - DNA, 25 bp, Mus musculus
ctgcaggaaccaatcagacaccatg

SEQ ID NO: 918394 - DNA, 25 bp, Mus musculus
ctgcaggaaccaatcgagccattcc

SEQ ID NO: 918395 - DNA, 25 bp, Mus musculus
ctgcaggaaccaatgagacaccatg

SEQ ID NO: 918396 - DNA, 25 bp, Mus musculus
ctgcaggaaccaatggagccattcc

SEQ ID NO: 918397 - DNA, 25 bp, Mus musculus
ctgcaggaatggcttccagacctcc

SEQ ID NO: 918398 - DNA, 25 bp, Mus musculus
ctgcaggaatgggttccagacctcc

SEQ ID NO: 918399 - DNA, 25 bp, Mus musculus
ctgcaggagcagcccaacgagggca

SEQ ID NO: 918400 - DNA, 25 bp, Mus musculus
ctgcaggagcagcttcgggcagttc

SEQ ID NO: 918401 - DNA, 25 bp, Mus musculus
ctgcaggagcaggccaacgagggca

SEQ ID NO: 918402 - DNA, 25 bp, Mus musculus
ctgcaggagcaggttcgggcagttc

SEQ ID NO: 918403 - DNA, 25 bp, Mus musculus
ctgcaggcatgccacgctatcaagt

SEQ ID NO: 918404 - DNA, 25 bp, Mus musculus
ctgcaggcatgccaggctatcaagt

SEQ ID NO: 918405 - DNA, 25 bp, Mus musculus
ctgcaggcgcgacgttctgcagacc

SEQ ID NO: 918406 - DNA, 25 bp, Mus musculus
ctgcaggcgcgaggttctgcagacc

SEQ ID NO: 918407 - DNA, 25 bp, Mus musculus
ctgcaggctacatgcggttgacctg

SEQ ID NO: 918408 - DNA, 25 bp, Mus musculus
ctgcaggctacatggggttgacctg

SEQ ID NO: 918409 - DNA, 25 bp, Mus musculus
ctgcagggcaagatccggactcttc

SEQ ID NO: 918410 - DNA, 25 bp, Mus musculus
ctgcagggcaagttccggactcttc

SEQ ID NO: 918411 - DNA, 25 bp, Mus musculus
ctgcagggcccacgaattgcattgg

SEQ ID NO: 918412 - DNA, 25 bp, Mus musculus
ctgcagggcccaggaattgcattgg

SEQ ID NO: 918413 - DNA, 25 bp, Mus musculus
ctgcaggggaggcacgtatggatgt

SEQ ID NO: 918414 - DNA, 25 bp, Mus musculus
ctgcaggggaggcaggtatggatgt

SEQ ID NO: 918415 - DNA, 25 bp, Mus musculus
ctgcaggtatgccacgttatccagt

SEQ ID NO: 918416 - DNA, 25 bp, Mus musculus
ctgcaggtatgccaggttatccagt

SEQ ID NO: 918417 - DNA, 25 bp, Mus musculus
ctgcaggtcaatctccccgtccgtg

SEQ ID NO: 918418 - DNA, 25 bp, Mus musculus
ctgcaggtcaatgtccccgtccgtg

SEQ ID NO: 918419 - DNA, 25 bp, Mus musculus
ctgcaggtgttcgacgactctgccg

SEQ ID NO: 918420 - DNA, 25 bp, Mus musculus
ctgcaggtgttcgaggactctgccg

SEQ ID NO: 918421 - DNA, 25 bp, Mus musculus
ctgcaggtgttggacactgaatgcc

SEQ ID NO: 918422 - DNA, 25 bp, Mus musculus
ctgcaggtgttggaccagactgaat

SEQ ID NO: 918423 - DNA, 25 bp, Mus musculus
ctgcaggtgttggagactgaatgcc

SEQ ID NO: 918424 - DNA, 25 bp, Mus musculus
ctgcaggtgttggagcagactgaat

SEQ ID NO: 918425 - DNA, 25 bp, Mus musculus
ctgcagtacctgaactccaaggcac

SEQ ID NO: 918426 - DNA, 25 bp, Mus musculus
ctgcagtacctgaagtccaaggcac

SEQ ID NO: 918427 - DNA, 25 bp, Mus musculus
ctgcagtatggaagatcccagaaat

SEQ ID NO: 918428 - DNA, 25 bp, Mus musculus
ctgcagtatggaagttcccagaaat

SEQ ID NO: 918429 - DNA, 25 bp, Mus musculus
ctgcagtcaagaaaccctgtacccc

SEQ ID NO: 918430 - DNA, 25 bp, Mus musculus
ctgcagtcaagaaacgacatctgat

SEQ ID NO: 918431 - DNA, 25 bp, Mus musculus
ctgcagtcaagaaagcctgtacccc

SEQ ID NO: 918432 - DNA, 25 bp, Mus musculus
ctgcagtcaagaaaggacatctgat

SEQ ID NO: 918433 - DNA, 25 bp, Mus musculus
ctgcagtcgtgacgtaccgaaagaa

SEQ ID NO: 918434 - DNA, 25 bp, Mus musculus
ctgcagtcgtgaggtaccgaaagaa

SEQ ID NO: 918435 - DNA, 25 bp, Mus musculus
ctgcagtctgatggcgcagcagcag

SEQ ID NO: 918436 - DNA, 25 bp, Mus musculus
ctgcagtctgatggggcagcagcag

SEQ ID NO: 918437 - DNA, 25 bp, Mus musculus
ctgcagtgattggacgtctgatagc

SEQ ID NO: 918438 - DNA, 25 bp, Mus musculus
ctgcagtgattggaggtctgatagc

SEQ ID NO: 918439 - DNA, 25 bp, Mus musculus
ctgcagtgtcagagctgccctagga

SEQ ID NO: 918440 - DNA, 25 bp, Mus musculus
ctgcagtgtcagatcctttctagat

SEQ ID NO: 918441 - DNA, 25 bp, Mus musculus
ctgcagtgtcagtgctgccctagga

SEQ ID NO: 918442 - DNA, 25 bp, Mus musculus
ctgcagtgtcagttcctttctagat

SEQ ID NO: 918443 - DNA, 25 bp, Mus musculus
ctgcagtgtgcccacgaccctgagc

SEQ ID NO: 918444 - DNA, 25 bp, Mus musculus
ctgcagtgtgcccaggaccctgagc

SEQ ID NO: 918445 - DNA, 25 bp, Mus musculus
ctgcagttaattccccgggaagagt

SEQ ID NO: 918446 - DNA, 25 bp, Mus musculus
ctgcagttaattgcccgggaagagt

SEQ ID NO: 918447 - DNA, 25 bp, Mus musculus
ctgcagttttgacgcaagaaatctc

SEQ ID NO: 918448 - DNA, 25 bp, Mus musculus
ctgcagttttgaggcaagaaatctc

SEQ ID NO: 918449 - DNA, 25 bp, Mus musculus
ctgcataacaaacgcatcgcccaca

SEQ ID NO: 918450 - DNA, 25 bp, Mus musculus
ctgcataacaaaggcatcgcccaca

SEQ ID NO: 918451 - DNA, 25 bp, Mus musculus
ctgcatacactgagccctctcacat

SEQ ID NO: 918452 - DNA, 25 bp, Mus musculus
ctgcatacactgtgccctctcacat

SEQ ID NO: 918453 - DNA, 25 bp, Mus musculus
ctgcatagagctagttcctaatatt

SEQ ID NO: 918454 - DNA, 25 bp, Mus musculus
ctgcatagagctgtgaaattgaaac

SEQ ID NO: 918455 - DNA, 25 bp, Mus musculus
ctgcatagaggtagttcctaatatt

SEQ ID NO: 918456 - DNA, 25 bp, Mus musculus
ctgcatagaggtgtgaaattgaaac

SEQ ID NO: 918457 - DNA, 25 bp, Mus musculus
ctgcatataaactgccgagatgtcc

SEQ ID NO: 918458 - DNA, 25 bp, Mus musculus
ctgcatataaactggcgagatgtcc

SEQ ID NO: 918459 - DNA, 25 bp, Mus musculus
ctgcatcaagcagcttgtgtcagat

SEQ ID NO: 918460 - DNA, 25 bp, Mus musculus
ctgcatcaaggagcttgtgtcagat

SEQ ID NO: 918461 - DNA, 25 bp, Mus musculus
ctgcatcaaggtacttgtgtcagat

SEQ ID NO: 918462 - DNA, 25 bp, Mus musculus
ctgcatcaaggttcttgtgtcagat

SEQ ID NO: 918463 - DNA, 25 bp, Mus musculus
ctgcatcaatctgttgtctgaggtc

SEQ ID NO: 918464 - DNA, 25 bp, Mus musculus
ctgcatcaatgtgttgtctgaggtc

SEQ ID NO: 918465 - DNA, 25 bp, Mus musculus
ctgcatcacgctaacgattctgagg

SEQ ID NO: 918466 - DNA, 25 bp, Mus musculus
ctgcatcacgctaaggattctgagg

SEQ ID NO: 918467 - DNA, 25 bp, Mus musculus
ctgcatccagagctctggtagcagc

SEQ ID NO: 918468 - DNA, 25 bp, Mus musculus
ctgcatccagaggtctggtagcagc

SEQ ID NO: 918469 - DNA, 25 bp, Mus musculus
ctgcatccagctctgttcctaacca

SEQ ID NO: 918470 - DNA, 25 bp, Mus musculus
ctgcatccaggtctgttcctaacca

SEQ ID NO: 918471 - DNA, 25 bp, Mus musculus
ctgcatcccaaccacgcagaactca

SEQ ID NO: 918472 - DNA, 25 bp, Mus musculus
ctgcatcccaaccaggcagaactca

SEQ ID NO: 918473 - DNA, 25 bp, Mus musculus
ctgcatcgcctgcacggcatggaac

SEQ ID NO: 918474 - DNA, 25 bp, Mus musculus
ctgcatcgcctgcagggcatggaac

SEQ ID NO: 918475 - DNA, 25 bp, Mus musculus
ctgcatctgaagaggtggccatggc

SEQ ID NO: 918476 - DNA, 25 bp, Mus musculus
ctgcatctgaagtggtggccatggc

SEQ ID NO: 918477 - DNA, 25 bp, Mus musculus
ctgcatctgccacacgctgggtccg

SEQ ID NO: 918478 - DNA, 25 bp, Mus musculus
ctgcatctgccagacgctgggtccg

SEQ ID NO: 918479 - DNA, 25 bp, Mus musculus
ctgcatgaagaacgatgcgggcgca

SEQ ID NO: 918480 - DNA, 25 bp, Mus musculus
ctgcatgaagaaggatgcgggcgca

SEQ ID NO: 918481 - DNA, 25 bp, Mus musculus
ctgcatgaagctggtctacatagct

SEQ ID NO: 918482 - DNA, 25 bp, Mus musculus
ctgcatgaaggtggtctacatagct

SEQ ID NO: 918483 - DNA, 25 bp, Mus musculus
ctgcatgaccagagtagtccatgga

SEQ ID NO: 918484 - DNA, 25 bp, Mus musculus
ctgcatgaccagtgtagtccatgga

SEQ ID NO: 918485 - DNA, 25 bp, Mus musculus
ctgcatgcagaacccttaccagttt

SEQ ID NO: 918486 - DNA, 25 bp, Mus musculus
ctgcatgcagctggtgcagaaccct

SEQ ID NO: 918487 - DNA, 25 bp, Mus musculus
ctgcatgcaggtggtgcagaaccct

SEQ ID NO: 918488 - DNA, 25 bp, Mus musculus
ctgcatgcagtacccttaccagttt

SEQ ID NO: 918489 - DNA, 25 bp, Mus musculus
ctgcatgccgcagagtggccatgtt

SEQ ID NO: 918490 - DNA, 25 bp, Mus musculus
ctgcatgccggagagtggccatgtt

SEQ ID NO: 918491 - DNA, 25 bp, Mus musculus
ctgcatgctcatcgtgggcagcaat

SEQ ID NO: 918492 - DNA, 25 bp, Mus musculus
ctgcatgctcatggtgggcagcaat

SEQ ID NO: 918493 - DNA, 25 bp, Mus musculus
ctgcatggatggagagacggatgac

SEQ ID NO: 918494 - DNA, 25 bp, Mus musculus
ctgcatggatggagtgacggatgac

SEQ ID NO: 918495 - DNA, 25 bp, Mus musculus
ctgcatggtaggctaagcacacgga

SEQ ID NO: 918496 - DNA, 25 bp, Mus musculus
ctgcatggtagggtaagcacacgga

SEQ ID NO: 918497 - DNA, 25 bp, Mus musculus
ctgcatgtcctgcacaccctggaga

SEQ ID NO: 918498 - DNA, 25 bp, Mus musculus
ctgcatgtcctggacaccctggaga

SEQ ID NO: 918499 - DNA, 25 bp, Mus musculus
ctgcatgtggcctggccaggatagc

SEQ ID NO: 918500 - DNA, 25 bp, Mus musculus
ctgcatgtgggctggccaggatagc

SEQ ID NO: 918501 - DNA, 25 bp, Mus musculus
ctgcattacacacgactcccctctc

SEQ ID NO: 918502 - DNA, 25 bp, Mus musculus
ctgcattacacaggactcccctctc

SEQ ID NO: 918503 - DNA, 25 bp, Mus musculus
ctgcattaggagcgatctgacaggc

SEQ ID NO: 918504 - DNA, 25 bp, Mus musculus
ctgcattaggagcgttctgacaggc

SEQ ID NO: 918505 - DNA, 25 bp, Mus musculus
ctgcattcacagcgacctggctgca

SEQ ID NO: 918506 - DNA, 25 bp, Mus musculus
ctgcattcacagggacctggctgca

SEQ ID NO: 918507 - DNA, 25 bp, Mus musculus
ctgcattcagcacaggggtccgaat

SEQ ID NO: 918508 - DNA, 25 bp, Mus musculus
ctgcattcaggacaggggtccgaat

SEQ ID NO: 918509 - DNA, 25 bp, Mus musculus
ctgccaaaagatgtggagctcctgg

SEQ ID NO: 918510 - DNA, 25 bp, Mus musculus
ctgccaaaagttgtggagctcctgg

SEQ ID NO: 918511 - DNA, 25 bp, Mus musculus
ctgccaaagtcacccaagctgaccc

SEQ ID NO: 918512 - DNA, 25 bp, Mus musculus
ctgccaaagtcagccaagctgaccc

SEQ ID NO: 918513 - DNA, 25 bp, Mus musculus
ctgccaaatactacctggacagcct

SEQ ID NO: 918514 - DNA, 25 bp, Mus musculus
ctgccaaatagtacctggacagcct

SEQ ID NO: 918515 - DNA, 25 bp, Mus musculus
ctgccaaatatacgaggcactgagg

SEQ ID NO: 918516 - DNA, 25 bp, Mus musculus
ctgccaaatataggaggcactgagg

SEQ ID NO: 918517 - DNA, 25 bp, Mus musculus
ctgccaacacccagcgtacatatgg

SEQ ID NO: 918518 - DNA, 25 bp, Mus musculus
ctgccaacacccagggtacatatgg

SEQ ID NO: 918519 - DNA, 25 bp, Mus musculus
ctgccaacagatctacacacaatga

SEQ ID NO: 918520 - DNA, 25 bp, Mus musculus
ctgccaacagcgtgcatcgctttcc

SEQ ID NO: 918521 - DNA, 25 bp, Mus musculus
ctgccaacagggtgcatcgctttcc

SEQ ID NO: 918522 - DNA, 25 bp, Mus musculus
ctgccaacagttctacacacaatga

SEQ ID NO: 918523 - DNA, 25 bp, Mus musculus
ctgccaactccgatttctcctcctc

SEQ ID NO: 918524 - DNA, 25 bp, Mus musculus
ctgccaactccgttttctcctcctc

SEQ ID NO: 918525 - DNA, 25 bp, Mus musculus
ctgccaagaccactgaggtctggta

SEQ ID NO: 918526 - DNA, 25 bp, Mus musculus
ctgccaagaccagtgaggtctggta

SEQ ID NO: 918527 - DNA, 25 bp, Mus musculus
ctgccaagctctatcgtcgggagcc

SEQ ID NO: 918528 - DNA, 25 bp, Mus musculus
ctgccaagctctatggtcgggagcc

SEQ ID NO: 918529 - DNA, 25 bp, Mus musculus
ctgccaatgaagagaacaagtatga

SEQ ID NO: 918530 - DNA, 25 bp, Mus musculus
ctgccaatgaagtgaacaagtatga

SEQ ID NO: 918531 - DNA, 25 bp, Mus musculus
ctgccacacggacagctgcccagac

SEQ ID NO: 918532 - DNA, 25 bp, Mus musculus
ctgccacacggagagctgcccagac

SEQ ID NO: 918533 - DNA, 25 bp, Mus musculus
ctgccacagacacggccactgccgg

SEQ ID NO: 918534 - DNA, 25 bp, Mus musculus
ctgccacagacagggccactgccgg

SEQ ID NO: 918535 - DNA, 25 bp, Mus musculus
ctgccaccagcttacgtctggaccg

SEQ ID NO: 918536 - DNA, 25 bp, Mus musculus
ctgccaccaggttacgtctggaccg

SEQ ID NO: 918537 - DNA, 25 bp, Mus musculus
ctgccaccatgagccaccaagatca

SEQ ID NO: 918538 - DNA, 25 bp, Mus musculus
ctgccaccatgagcgaccaagatca

SEQ ID NO: 918539 - DNA, 25 bp, Mus musculus
ctgccaccgcacacgaagttgggag

SEQ ID NO: 918540 - DNA, 25 bp, Mus musculus
ctgccaccgccttcacattctctaa

SEQ ID NO: 918541 - DNA, 25 bp, Mus musculus
ctgccaccgcgttcacattctctaa

SEQ ID NO: 918542 - DNA, 25 bp, Mus musculus
ctgccaccgctcacgaagttgggag

SEQ ID NO: 918543 - DNA, 25 bp, Mus musculus
ctgccacctccaagtcagcctccaa

SEQ ID NO: 918544 - DNA, 25 bp, Mus musculus
ctgccacctccatgtcagcctccaa

SEQ ID NO: 918545 - DNA, 25 bp, Mus musculus
ctgccacggaacaacgtagatgcca

SEQ ID NO: 918546 - DNA, 25 bp, Mus musculus
ctgccacggaacaaggtagatgcca

SEQ ID NO: 918547 - DNA, 25 bp, Mus musculus
ctgccagaagactacattgaggagg

SEQ ID NO: 918548 - DNA, 25 bp, Mus musculus
ctgccagaagactacccgccgtgcc

SEQ ID NO: 918549 - DNA, 25 bp, Mus musculus
ctgccagaagactagattgaggagg

SEQ ID NO: 918550 - DNA, 25 bp, Mus musculus
ctgccagaagactagccgccgtgcc

SEQ ID NO: 918551 - DNA, 25 bp, Mus musculus
ctgccagaccagaacgtctgctgag

SEQ ID NO: 918552 - DNA, 25 bp, Mus musculus
ctgccagaccagaaggtctgctgag

SEQ ID NO: 918553 - DNA, 25 bp, Mus musculus
ctgccagaggccctgtttgctgagc

SEQ ID NO: 918554 - DNA, 25 bp, Mus musculus
ctgccagagggcctgtttgctgagc

SEQ ID NO: 918555 - DNA, 25 bp, Mus musculus
ctgccagcagaatggcattgtaccc

SEQ ID NO: 918556 - DNA, 25 bp, Mus musculus
ctgccagcagctagatcatgatcca

SEQ ID NO: 918557 - DNA, 25 bp, Mus musculus
ctgccagcagctctccccctcctct

SEQ ID NO: 918558 - DNA, 25 bp, Mus musculus
ctgccagcagcttggtgtcagccca

SEQ ID NO: 918559 - DNA, 25 bp, Mus musculus
ctgccagcaggtagatcatgatcca

SEQ ID NO: 918560 - DNA, 25 bp, Mus musculus
ctgccagcaggtctccccctcctct

SEQ ID NO: 918561 - DNA, 25 bp, Mus musculus
ctgccagcaggttggtgtcagccca

SEQ ID NO: 918562 - DNA, 25 bp, Mus musculus
ctgccagcagtatggcattgtaccc

SEQ ID NO: 918563 - DNA, 25 bp, Mus musculus
ctgccagccaggattttgtggacgt

SEQ ID NO: 918564 - DNA, 25 bp, Mus musculus
ctgccagccaggtttttgtggacgt

SEQ ID NO: 918565 - DNA, 25 bp, Mus musculus
ctgccaggaaggatttatcttagtt

SEQ ID NO: 918566 - DNA, 25 bp, Mus musculus
ctgccaggaaggttttatcttagtt

SEQ ID NO: 918567 - DNA, 25 bp, Mus musculus
ctgccagtgcaacaatggccatttg

SEQ ID NO: 918568 - DNA, 25 bp, Mus musculus
ctgccagtgcaagaatggccatttg

SEQ ID NO: 918569 - DNA, 25 bp, Mus musculus
ctgccagtgcccccaccggatgcag

SEQ ID NO: 918570 - DNA, 25 bp, Mus musculus
ctgccagtgccccctccggatgcag

SEQ ID NO: 918571 - DNA, 25 bp, Mus musculus
ctgccagtgtcattttgacattgct

SEQ ID NO: 918572 - DNA, 25 bp, Mus musculus
ctgccagtgtgattttgacattgct

SEQ ID NO: 918573 - DNA, 25 bp, Mus musculus
ctgccagttcaactttatccaccgc

SEQ ID NO: 918574 - DNA, 25 bp, Mus musculus
ctgccagttcaagtttatccaccgc

SEQ ID NO: 918575 - DNA, 25 bp, Mus musculus
ctgccagttcttcactgctgagcct

SEQ ID NO: 918576 - DNA, 25 bp, Mus musculus
ctgccagttcttcagtgctgagcct

SEQ ID NO: 918577 - DNA, 25 bp, Mus musculus
ctgccataatgacaagtaccaggtg

SEQ ID NO: 918578 - DNA, 25 bp, Mus musculus
ctgccataatgagaagtaccaggtg

SEQ ID NO: 918579 - DNA, 25 bp, Mus musculus
ctgccataggccaacaaatccgaga

SEQ ID NO: 918580 - DNA, 25 bp, Mus musculus
ctgccatagggcaacaaatccgaga

SEQ ID NO: 918581 - DNA, 25 bp, Mus musculus
ctgccatatacacgagccacgtgtg

SEQ ID NO: 918582 - DNA, 25 bp, Mus musculus
ctgccatatacaggagccacgtgtg

SEQ ID NO: 918583 - DNA, 25 bp, Mus musculus
ctgccatatttaccattcccgtcaa

SEQ ID NO: 918584 - DNA, 25 bp, Mus musculus
ctgccatatttagcattcccgtcaa

SEQ ID NO: 918585 - DNA, 25 bp, Mus musculus
ctgccatctagcactaagagcggcg

SEQ ID NO: 918586 - DNA, 25 bp, Mus musculus
ctgccatctagctctaagagcggcg

SEQ ID NO: 918587 - DNA, 25 bp, Mus musculus
ctgccatgagacgaaagtaggtggg

SEQ ID NO: 918588 - DNA, 25 bp, Mus musculus
ctgccatgagcaattcttctacttt

SEQ ID NO: 918589 - DNA, 25 bp, Mus musculus
ctgccatgaggaattcttctacttt

SEQ ID NO: 918590 - DNA, 25 bp, Mus musculus
ctgccatgagtcgaaagtaggtggg

SEQ ID NO: 918591 - DNA, 25 bp, Mus musculus
ctgccatgtcagccagtataatgtt

SEQ ID NO: 918592 - DNA, 25 bp, Mus musculus
ctgccatgtcaggcagtataatgtt

SEQ ID NO: 918593 - DNA, 25 bp, Mus musculus
ctgccatgttggatgccgccttgga

SEQ ID NO: 918594 - DNA, 25 bp, Mus musculus
ctgccatgttggttgccgccttgga

SEQ ID NO: 918595 - DNA, 25 bp, Mus musculus
ctgccattcaagaggcagccacagc

SEQ ID NO: 918596 - DNA, 25 bp, Mus musculus
ctgccattcaagtggcagccacagc

SEQ ID NO: 918597 - DNA, 25 bp, Mus musculus
ctgccattcttaacaatacaaaggg

SEQ ID NO: 918598 - DNA, 25 bp, Mus musculus
ctgccattcttaactatacaaaggg

SEQ ID NO: 918599 - DNA, 25 bp, Mus musculus
ctgcccaaagacaccagaggacctt

SEQ ID NO: 918600 - DNA, 25 bp, Mus musculus
ctgcccaaagagcatgccaccagcc

SEQ ID NO: 918601 - DNA, 25 bp, Mus musculus
ctgcccaaagagccccctcagagct

SEQ ID NO: 918602 - DNA, 25 bp, Mus musculus
ctgcccaaagcctgagacccacccc

SEQ ID NO: 918603 - DNA, 25 bp, Mus musculus
ctgcccaaaggacacaataatcctc

SEQ ID NO: 918604 - DNA, 25 bp, Mus musculus
ctgcccaaaggacacctggctgtat

SEQ ID NO: 918605 - DNA, 25 bp, Mus musculus
ctgcccaaaggacagaataatcctc

SEQ ID NO: 918606 - DNA, 25 bp, Mus musculus
ctgcccaaaggacagctggctgtat

SEQ ID NO: 918607 - DNA, 25 bp, Mus musculus
ctgcccaaaggctgagacccacccc

SEQ ID NO: 918608 - DNA, 25 bp, Mus musculus
ctgcccaaagtcaccagaggacctt

SEQ ID NO: 918609 - DNA, 25 bp, Mus musculus
ctgcccaaagtgcatgccaccagcc

SEQ ID NO: 918610 - DNA, 25 bp, Mus musculus
ctgcccaaagtgccccctcagagct

SEQ ID NO: 918611 - DNA, 25 bp, Mus musculus
ctgcccaagccaaacggctcatcca

SEQ ID NO: 918612 - DNA, 25 bp, Mus musculus
ctgcccaagccaaagggctcatcca

SEQ ID NO: 918613 - DNA, 25 bp, Mus musculus
ctgcccacacagcgtgtgtccccag

SEQ ID NO: 918614 - DNA, 25 bp, Mus musculus
ctgcccacacagcttctgcagtaca

SEQ ID NO: 918615 - DNA, 25 bp, Mus musculus
ctgcccacacagggtgtgtccccag

SEQ ID NO: 918616 - DNA, 25 bp, Mus musculus
ctgcccacacaggttctgcagtaca

SEQ ID NO: 918617 - DNA, 25 bp, Mus musculus
ctgcccaccggacggtcagtactgt

SEQ ID NO: 918618 - DNA, 25 bp, Mus musculus
ctgcccaccggagggtcagtactgt

SEQ ID NO: 918619 - DNA, 25 bp, Mus musculus
ctgcccaccgtgacatcgacgaatg

SEQ ID NO: 918620 - DNA, 25 bp, Mus musculus
ctgcccaccgtgtcatcgacgaatg

SEQ ID NO: 918621 - DNA, 25 bp, Mus musculus
ctgcccacttggcaggcagaggcca

SEQ ID NO: 918622 - DNA, 25 bp, Mus musculus
ctgcccacttgggaggcagaggcca

SEQ ID NO: 918623 - DNA, 25 bp, Mus musculus
ctgcccagcagacggcagacaccaa

SEQ ID NO: 918624 - DNA, 25 bp, Mus musculus
ctgcccagcagagggcagacaccaa

SEQ ID NO: 918625 - DNA, 25 bp, Mus musculus
ctgcccagccaggacctatcctctg

SEQ ID NO: 918626 - DNA, 25 bp, Mus musculus
ctgcccagccaggagctatcctctg

SEQ ID NO: 918627 - DNA, 25 bp, Mus musculus
ctgcccagttgccggcctaacctgc

SEQ ID NO: 918628 - DNA, 25 bp, Mus musculus
ctgcccagttgcgggcctaacctgc

SEQ ID NO: 918629 - DNA, 25 bp, Mus musculus
ctgcccatttccgacggcagattta

SEQ ID NO: 918630 - DNA, 25 bp, Mus musculus
ctgcccatttccgagggcagattta

SEQ ID NO: 918631 - DNA, 25 bp, Mus musculus
ctgccccaagcctgacttccccacc

SEQ ID NO: 918632 - DNA, 25 bp, Mus musculus
ctgccccaagcgtctgaatccgggg

SEQ ID NO: 918633 - DNA, 25 bp, Mus musculus
ctgccccaaggctgacttccccacc

SEQ ID NO: 918634 - DNA, 25 bp, Mus musculus
ctgccccaagggtctgaatccgggg

SEQ ID NO: 918635 - DNA, 25 bp, Mus musculus
ctgccccaggccgtcaatgaccagt

SEQ ID NO: 918636 - DNA, 25 bp, Mus musculus
ctgccccaggccgtcgactaaagac

SEQ ID NO: 918637 - DNA, 25 bp, Mus musculus
ctgccccaggccgtgaatgaccagt

SEQ ID NO: 918638 - DNA, 25 bp, Mus musculus
ctgccccaggccgtggactaaagac

SEQ ID NO: 918639 - DNA, 25 bp, Mus musculus
ctgcccccccagcgctaccacctaa

SEQ ID NO: 918640 - DNA, 25 bp, Mus musculus
ctgcccccccagggctaccacctaa

SEQ ID NO: 918641 - DNA, 25 bp, Mus musculus
ctgccccgccggccaatgggcccag

SEQ ID NO: 918642 - DNA, 25 bp, Mus musculus
ctgccccgccggcctatgggcccag

SEQ ID NO: 918643 - DNA, 25 bp, Mus musculus
ctgccccgcgagctaaaatgggtac

SEQ ID NO: 918644 - DNA, 25 bp, Mus musculus
ctgccccgcgaggtaaaatgggtac

SEQ ID NO: 918645 - DNA, 25 bp, Mus musculus
ctgccccgctatcagcttgaggagg

SEQ ID NO: 918646 - DNA, 25 bp, Mus musculus
ctgccccgctatgagcttgaggagg

SEQ ID NO: 918647 - DNA, 25 bp, Mus musculus
ctgccccggccacctgactgctgtc

SEQ ID NO: 918648 - DNA, 25 bp, Mus musculus
ctgccccggccagctgactgctgtc

SEQ ID NO: 918649 - DNA, 25 bp, Mus musculus
ctgcccctcaccgacgaggagaatg

SEQ ID NO: 918650 - DNA, 25 bp, Mus musculus
ctgcccctcaccgaggaggagaatg

SEQ ID NO: 918651 - DNA, 25 bp, Mus musculus
ctgcccctcagagcagtatgggcta

SEQ ID NO: 918652 - DNA, 25 bp, Mus musculus
ctgcccctcagagctgtatgggcta

SEQ ID NO: 918653 - DNA, 25 bp, Mus musculus
ctgcccctgcctgaccaaggggacc

SEQ ID NO: 918654 - DNA, 25 bp, Mus musculus
ctgcccctgcctgagcaaggggacc

SEQ ID NO: 918655 - DNA, 25 bp, Mus musculus
ctgcccctgctgcacggcccagata

SEQ ID NO: 918656 - DNA, 25 bp, Mus musculus
ctgcccctgctgcagggcccagata

SEQ ID NO: 918657 - DNA, 25 bp, Mus musculus
ctgcccctggggagtcttctgagct

SEQ ID NO: 918658 - DNA, 25 bp, Mus musculus
ctgcccctggggtgtcttctgagct

SEQ ID NO: 918659 - DNA, 25 bp, Mus musculus
ctgcccgaaagactctaaagcgcct

SEQ ID NO: 918660 - DNA, 25 bp, Mus musculus
ctgcccgaaagagtctaaagcgcct

SEQ ID NO: 918661 - DNA, 25 bp, Mus musculus
ctgcccgatgatcattggccgtggt

SEQ ID NO: 918662 - DNA, 25 bp, Mus musculus
ctgcccgatgttcattggccgtggt

SEQ ID NO: 918663 - DNA, 25 bp, Mus musculus
ctgcccgcaccgcatcttctgttga

SEQ ID NO: 918664 - DNA, 25 bp, Mus musculus
ctgcccgcaccggatcttctgttga

SEQ ID NO: 918665 - DNA, 25 bp, Mus musculus
ctgcccgcactggaccgtgctcttc

SEQ ID NO: 918666 - DNA, 25 bp, Mus musculus
ctgcccgcactggagcgtgctcttc

SEQ ID NO: 918667 - DNA, 25 bp, Mus musculus
ctgcccgccgccaatatgcctgaag

SEQ ID NO: 918668 - DNA, 25 bp, Mus musculus
ctgcccgccggcaatatgcctgaag

SEQ ID NO: 918669 - DNA, 25 bp, Mus musculus
ctgcccggacaaaacatgaagagct

SEQ ID NO: 918670 - DNA, 25 bp, Mus musculus
ctgcccggacaatacatgaagagct

SEQ ID NO: 918671 - DNA, 25 bp, Mus musculus
ctgcccgttctacctactttgaggc

SEQ ID NO: 918672 - DNA, 25 bp, Mus musculus
ctgcccgttctagctactttgaggc

SEQ ID NO: 918673 - DNA, 25 bp, Mus musculus
ctgccctacccacctggaatggaac

SEQ ID NO: 918674 - DNA, 25 bp, Mus musculus
ctgccctacccagctggaatggaac

SEQ ID NO: 918675 - DNA, 25 bp, Mus musculus
ctgccctagcttggcggctttcagg

SEQ ID NO: 918676 - DNA, 25 bp, Mus musculus
ctgccctagcttgggggctttcagg

SEQ ID NO: 918677 - DNA, 25 bp, Mus musculus
ctgccctcagcccctgcagttcaga

SEQ ID NO: 918678 - DNA, 25 bp, Mus musculus
ctgccctcaggccctgcagttcaga

SEQ ID NO: 918679 - DNA, 25 bp, Mus musculus
ctgccctcatagcagttgctgcaat

SEQ ID NO: 918680 - DNA, 25 bp, Mus musculus
ctgccctcataggagttgctgcaat

SEQ ID NO: 918681 - DNA, 25 bp, Mus musculus
ctgccctgtgagattcaggtgccat

SEQ ID NO: 918682 - DNA, 25 bp, Mus musculus
ctgccctgtgagtttcaggtgccat

SEQ ID NO: 918683 - DNA, 25 bp, Mus musculus
ctgcccttcagagacgtctatctcc

SEQ ID NO: 918684 - DNA, 25 bp, Mus musculus
ctgcccttcagagaggtctatctcc

SEQ ID NO: 918685 - DNA, 25 bp, Mus musculus
ctgcccttcttcaacaaaggtacac

SEQ ID NO: 918686 - DNA, 25 bp, Mus musculus
ctgcccttcttcaagaaaggtacac

SEQ ID NO: 918687 - DNA, 25 bp, Mus musculus
ctgcccttgcagctaaaatttgcta

SEQ ID NO: 918688 - DNA, 25 bp, Mus musculus
ctgcccttgcaggtaaaatttgcta

SEQ ID NO: 918689 - DNA, 25 bp, Mus musculus
ctgccctttttgagccgtggtgaga

SEQ ID NO: 918690 - DNA, 25 bp, Mus musculus
ctgccctttttgcctgcagagatac

SEQ ID NO: 918691 - DNA, 25 bp, Mus musculus
ctgccctttttggctgcagagatac

SEQ ID NO: 918692 - DNA, 25 bp, Mus musculus
ctgccctttttgtgccgtggtgaga

SEQ ID NO: 918693 - DNA, 25 bp, Mus musculus
ctgccgaatcagaggaggtcctgac

SEQ ID NO: 918694 - DNA, 25 bp, Mus musculus
ctgccgaatcagtggaggtcctgac

SEQ ID NO: 918695 - DNA, 25 bp, Mus musculus
ctgccgaatgctccaagatggaaag

SEQ ID NO: 918696 - DNA, 25 bp, Mus musculus
ctgccgaatggtccaagatggaaag

SEQ ID NO: 918697 - DNA, 25 bp, Mus musculus
ctgccgagagcggtcccacagaggc

SEQ ID NO: 918698 - DNA, 25 bp, Mus musculus
ctgccgagaggggtcccacagaggc

SEQ ID NO: 918699 - DNA, 25 bp, Mus musculus
ctgccgatctcagtctctggtccca

SEQ ID NO: 918700 - DNA, 25 bp, Mus musculus
ctgccgatctgagtctctggtccca

SEQ ID NO: 918701 - DNA, 25 bp, Mus musculus
ctgccgcatgagctgtggtactagc

SEQ ID NO: 918702 - DNA, 25 bp, Mus musculus
ctgccgcatgaggtgtggtactagc

SEQ ID NO: 918703 - DNA, 25 bp, Mus musculus
ctgccgccagctcctcagatgaccg

SEQ ID NO: 918704 - DNA, 25 bp, Mus musculus
ctgccgccaggtcctcagatgaccg

SEQ ID NO: 918705 - DNA, 25 bp, Mus musculus
ctgccgcccgagcagttgccccaga

SEQ ID NO: 918706 - DNA, 25 bp, Mus musculus
ctgccgcccgaggagttgccccaga

SEQ ID NO: 918707 - DNA, 25 bp, Mus musculus
ctgccgccgttgcgctggctgccgt

SEQ ID NO: 918708 - DNA, 25 bp, Mus musculus
ctgccgccgttgggctggctgccgt

SEQ ID NO: 918709 - DNA, 25 bp, Mus musculus
ctgccgctgctgcgtggctgcgttg

SEQ ID NO: 918710 - DNA, 25 bp, Mus musculus
ctgccgctgctgggtggctgcgttg

SEQ ID NO: 918711 - DNA, 25 bp, Mus musculus
ctgccggagttgcacaagactcatg

SEQ ID NO: 918712 - DNA, 25 bp, Mus musculus
ctgccggagttgcacagaagactca

SEQ ID NO: 918713 - DNA, 25 bp, Mus musculus
ctgccggagttgcaccagaagactc

SEQ ID NO: 918714 - DNA, 25 bp, Mus musculus
ctgccggagttgcagaagactcatg

SEQ ID NO: 918715 - DNA, 25 bp, Mus musculus
ctgccggagttgcagagaagactca

SEQ ID NO: 918716 - DNA, 25 bp, Mus musculus
ctgccggagttgcagcagaagactc

SEQ ID NO: 918717 - DNA, 25 bp, Mus musculus
ctgccggctgagcagaaacaacaaa

SEQ ID NO: 918718 - DNA, 25 bp, Mus musculus
ctgccggctgaggagaaacaacaaa

SEQ ID NO: 918719 - DNA, 25 bp, Mus musculus
ctgccgggagatggctcagcggctc

SEQ ID NO: 918720 - DNA, 25 bp, Mus musculus
ctgccgggagttggctcagcggctc

SEQ ID NO: 918721 - DNA, 25 bp, Mus musculus
ctgccgggcagccacgcaccaccta

SEQ ID NO: 918722 - DNA, 25 bp, Mus musculus
ctgccgggcagccaggcaccaccta

SEQ ID NO: 918723 - DNA, 25 bp, Mus musculus
ctgccgggcccacgaactgcatagg

SEQ ID NO: 918724 - DNA, 25 bp, Mus musculus
ctgccgggcccaggaactgcatagg

SEQ ID NO: 918725 - DNA, 25 bp, Mus musculus
ctgccgtaagaaattcatcctatct

SEQ ID NO: 918726 - DNA, 25 bp, Mus musculus
ctgccgtaagaatttcatcctatct

SEQ ID NO: 918727 - DNA, 25 bp, Mus musculus
ctgcctacggctatcataccaggtt

SEQ ID NO: 918728 - DNA, 25 bp, Mus musculus
ctgcctacgggtatcataccaggtt

SEQ ID NO: 918729 - DNA, 25 bp, Mus musculus
ctgcctactgctgtcgatttccagc

SEQ ID NO: 918730 - DNA, 25 bp, Mus musculus
ctgcctactgctgtggatttccagc

SEQ ID NO: 918731 - DNA, 25 bp, Mus musculus
ctgcctagcgccgacagatagtgct

SEQ ID NO: 918732 - DNA, 25 bp, Mus musculus
ctgcctagcgccgacagattggaga

SEQ ID NO: 918733 - DNA, 25 bp, Mus musculus
ctgcctagcgccgagagatagtgct

SEQ ID NO: 918734 - DNA, 25 bp, Mus musculus
ctgcctagcgccgagagattggaga

SEQ ID NO: 918735 - DNA, 25 bp, Mus musculus
ctgcctatgcaacccccagtcccca

SEQ ID NO: 918736 - DNA, 25 bp, Mus musculus
ctgcctatgcaagccccagtcccca

SEQ ID NO: 918737 - DNA, 25 bp, Mus musculus
ctgcctcaagaaatttgtcaagcct

SEQ ID NO: 918738 - DNA, 25 bp, Mus musculus
ctgcctcaagtaatttgtcaagcct

SEQ ID NO: 918739 - DNA, 25 bp, Mus musculus
ctgcctcacatgcatccaatcaatg

SEQ ID NO: 918740 - DNA, 25 bp, Mus musculus
ctgcctcacatggatccaatcaatg

SEQ ID NO: 918741 - DNA, 25 bp, Mus musculus
ctgcctcacgctccgctatgtttca

SEQ ID NO: 918742 - DNA, 25 bp, Mus musculus
ctgcctcacggtccgctatgtttca

SEQ ID NO: 918743 - DNA, 25 bp, Mus musculus
ctgcctcagcagcgcttccccatca

SEQ ID NO: 918744 - DNA, 25 bp, Mus musculus
ctgcctcagcagggcttccccatca

SEQ ID NO: 918745 - DNA, 25 bp, Mus musculus
ctgcctcagcctaccatttcttttg

SEQ ID NO: 918746 - DNA, 25 bp, Mus musculus
ctgcctcagcctacgatttcttttg

SEQ ID NO: 918747 - DNA, 25 bp, Mus musculus
ctgcctcataaacgaggtggacatc

SEQ ID NO: 918748 - DNA, 25 bp, Mus musculus
ctgcctcataaaggaggtggacatc

SEQ ID NO: 918749 - DNA, 25 bp, Mus musculus
ctgcctccctccctcgcagggggag

SEQ ID NO: 918750 - DNA, 25 bp, Mus musculus
ctgcctccctccctggcagggggag

SEQ ID NO: 918751 - DNA, 25 bp, Mus musculus
ctgcctccttcacatgacggattcc

SEQ ID NO: 918752 - DNA, 25 bp, Mus musculus
ctgcctccttcagatgacggattcc

SEQ ID NO: 918753 - DNA, 25 bp, Mus musculus
ctgcctcgagagcccactattcagt

SEQ ID NO: 918754 - DNA, 25 bp, Mus musculus
ctgcctcgagagccgactattcagt

SEQ ID NO: 918755 - DNA, 25 bp, Mus musculus
ctgcctcggacgcaattctatcgcc

SEQ ID NO: 918756 - DNA, 25 bp, Mus musculus
ctgcctcggacggaattctatcgcc

SEQ ID NO: 918757 - DNA, 25 bp, Mus musculus
ctgcctcgtcatccacaccaagatg

SEQ ID NO: 918758 - DNA, 25 bp, Mus musculus
ctgcctcgtcatctgggagggcatt

SEQ ID NO: 918759 - DNA, 25 bp, Mus musculus
ctgcctcgtcatgcacaccaagatg

SEQ ID NO: 918760 - DNA, 25 bp, Mus musculus
ctgcctcgtcatgtgggagggcatt

SEQ ID NO: 918761 - DNA, 25 bp, Mus musculus
ctgcctctacagaacgctgaggagc

SEQ ID NO: 918762 - DNA, 25 bp, Mus musculus
ctgcctctacagaaggctgaggagc

SEQ ID NO: 918763 - DNA, 25 bp, Mus musculus
ctgcctctggccggaaaaactgatg

SEQ ID NO: 918764 - DNA, 25 bp, Mus musculus
ctgcctctggccttcctcggtgaag

SEQ ID NO: 918765 - DNA, 25 bp, Mus musculus
ctgcctctggcttaacaatcaagat

SEQ ID NO: 918766 - DNA, 25 bp, Mus musculus
ctgcctctgggcggaaaaactgatg

SEQ ID NO: 918767 - DNA, 25 bp, Mus musculus
ctgcctctgggcttcctcggtgaag

SEQ ID NO: 918768 - DNA, 25 bp, Mus musculus
ctgcctctgggttaacaatcaagat

SEQ ID NO: 918769 - DNA, 25 bp, Mus musculus
ctgcctcttcagcaagctgcactgc

SEQ ID NO: 918770 - DNA, 25 bp, Mus musculus
ctgcctcttcaggaagctgcactgc

SEQ ID NO: 918771 - DNA, 25 bp, Mus musculus
ctgcctcttgggagcccttgcaatc

SEQ ID NO: 918772 - DNA, 25 bp, Mus musculus
ctgcctcttgggtgcccttgcaatc

SEQ ID NO: 918773 - DNA, 25 bp, Mus musculus
ctgcctgacccgccttcaacacctc

SEQ ID NO: 918774 - DNA, 25 bp, Mus musculus
ctgcctgaccggccttcaacacctc

SEQ ID NO: 918775 - DNA, 25 bp, Mus musculus
ctgcctgcagaatccgccagcgccc

SEQ ID NO: 918776 - DNA, 25 bp, Mus musculus
ctgcctgcagaatcggccagcgccc

SEQ ID NO: 918777 - DNA, 25 bp, Mus musculus
ctgcctgcagctcgtggctgcactc

SEQ ID NO: 918778 - DNA, 25 bp, Mus musculus
ctgcctgcagctggtggctgcactc

SEQ ID NO: 918779 - DNA, 25 bp, Mus musculus
ctgcctgcaggacaactcctggcag

SEQ ID NO: 918780 - DNA, 25 bp, Mus musculus
ctgcctgcaggacatctcctggcag

SEQ ID NO: 918781 - DNA, 25 bp, Mus musculus
ctgcctgcatctacctttgcagatc

SEQ ID NO: 918782 - DNA, 25 bp, Mus musculus
ctgcctgcatctctctcttaacctt

SEQ ID NO: 918783 - DNA, 25 bp, Mus musculus
ctgcctgcatctgtctcttaacctt

SEQ ID NO: 918784 - DNA, 25 bp, Mus musculus
ctgcctgcatcttcctttgcagatc

SEQ ID NO: 918785 - DNA, 25 bp, Mus musculus
ctgcctgccaggattttaccggaag

SEQ ID NO: 918786 - DNA, 25 bp, Mus musculus
ctgcctgccaggtttttaccggaag

SEQ ID NO: 918787 - DNA, 25 bp, Mus musculus
ctgcctggagaaaagctcctgtatc

SEQ ID NO: 918788 - DNA, 25 bp, Mus musculus
ctgcctggagaatagctcctgtatc

SEQ ID NO: 918789 - DNA, 25 bp, Mus musculus
ctgcctggagcggacatgatgactt

SEQ ID NO: 918790 - DNA, 25 bp, Mus musculus
ctgcctggaggggacatgatgactt

SEQ ID NO: 918791 - DNA, 25 bp, Mus musculus
ctgcctggcacacaagccttcaggg

SEQ ID NO: 918792 - DNA, 25 bp, Mus musculus
ctgcctggcacagaagccttcaggg

SEQ ID NO: 918793 - DNA, 25 bp, Mus musculus
ctgcctggccagatcagcatatagg

SEQ ID NO: 918794 - DNA, 25 bp, Mus musculus
ctgcctggccagttcagcatatagg

SEQ ID NO: 918795 - DNA, 25 bp, Mus musculus
ctgcctgtatgaccgaggcaaccag

SEQ ID NO: 918796 - DNA, 25 bp, Mus musculus
ctgcctgtatgagcgaggcaaccag

SEQ ID NO: 918797 - DNA, 25 bp, Mus musculus
ctgcctgtctgagccgctacagaac

SEQ ID NO: 918798 - DNA, 25 bp, Mus musculus
ctgcctgtctgagcggctacagaac

SEQ ID NO: 918799 - DNA, 25 bp, Mus musculus
ctgcctgtgaagacttggatgaatg

SEQ ID NO: 918800 - DNA, 25 bp, Mus musculus
ctgcctgtgaagtcttggatgaatg

SEQ ID NO: 918801 - DNA, 25 bp, Mus musculus
ctgcctgtgctaatccatacttttt

SEQ ID NO: 918802 - DNA, 25 bp, Mus musculus
ctgcctgtgctattccatacttttt

SEQ ID NO: 918803 - DNA, 25 bp, Mus musculus
ctgcctgtgtatcacgagctgagac

SEQ ID NO: 918804 - DNA, 25 bp, Mus musculus
ctgcctgtgtatcaggagctgagac

SEQ ID NO: 918805 - DNA, 25 bp, Mus musculus
ctgcctgttctgctttcagtgtctg

SEQ ID NO: 918806 - DNA, 25 bp, Mus musculus
ctgcctgttctggtttcagtgtctg

SEQ ID NO: 918807 - DNA, 25 bp, Mus musculus
ctgcctgtttatgagccacgtggtg

SEQ ID NO: 918808 - DNA, 25 bp, Mus musculus
ctgcctgtttttgagccacgtggtg

SEQ ID NO: 918809 - DNA, 25 bp, Mus musculus
ctgccttacctccacaacccgctca

SEQ ID NO: 918810 - DNA, 25 bp, Mus musculus
ctgccttacctccagaacccgctca

SEQ ID NO: 918811 - DNA, 25 bp, Mus musculus
ctgccttacttgctgacattggtgg

SEQ ID NO: 918812 - DNA, 25 bp, Mus musculus
ctgccttacttggtgacattggtgg

SEQ ID NO: 918813 - DNA, 25 bp, Mus musculus
ctgccttatgggcagtgaacttgct

SEQ ID NO: 918814 - DNA, 25 bp, Mus musculus
ctgccttatggggagtgaacttgct

SEQ ID NO: 918815 - DNA, 25 bp, Mus musculus
ctgccttcagagcccttctacatga

SEQ ID NO: 918816 - DNA, 25 bp, Mus musculus
ctgccttcagaggccttctacatga

SEQ ID NO: 918817 - DNA, 25 bp, Mus musculus
ctgccttgacatgtcgggagttggc

SEQ ID NO: 918818 - DNA, 25 bp, Mus musculus
ctgccttgacatgtggggagttggc

SEQ ID NO: 918819 - DNA, 25 bp, Mus musculus
ctgccttgctcaaacgaaccaacgc

SEQ ID NO: 918820 - DNA, 25 bp, Mus musculus
ctgccttgctcaaaggaaccaacgc

SEQ ID NO: 918821 - DNA, 25 bp, Mus musculus
ctgccttggacaccctccactgccg

SEQ ID NO: 918822 - DNA, 25 bp, Mus musculus
ctgccttggacagcctccactgccg

SEQ ID NO: 918823 - DNA, 25 bp, Mus musculus
ctgccttgtgcgaggtgttctgccg

SEQ ID NO: 918824 - DNA, 25 bp, Mus musculus
ctgccttgtgggaggtgttctgccg

SEQ ID NO: 918825 - DNA, 25 bp, Mus musculus
ctgcctttgctgcacgaatcctgga

SEQ ID NO: 918826 - DNA, 25 bp, Mus musculus
ctgcctttgctgcaggaatcctgga

SEQ ID NO: 918827 - DNA, 25 bp, Mus musculus
ctgcctttggggatgtcgtcaccgt

SEQ ID NO: 918828 - DNA, 25 bp, Mus musculus
ctgcctttggggttgtcgtcaccgt

SEQ ID NO: 918829 - DNA, 25 bp, Mus musculus
ctgccttttacacgaagtatgagct

SEQ ID NO: 918830 - DNA, 25 bp, Mus musculus
ctgccttttacaggaagtatgagct

SEQ ID NO: 918831 - DNA, 25 bp, Mus musculus
ctgcgaaaaaggcatgactgagtgg

SEQ ID NO: 918832 - DNA, 25 bp, Mus musculus
ctgcgaaaaagggatgactgagtgg

SEQ ID NO: 918833 - DNA, 25 bp, Mus musculus
ctgcgaaccaaacacactgggttct

SEQ ID NO: 918834 - DNA, 25 bp, Mus musculus
ctgcgaaccaactgccaggggacag

SEQ ID NO: 918835 - DNA, 25 bp, Mus musculus
ctgcgaaccatacacactgggttct

SEQ ID NO: 918836 - DNA, 25 bp, Mus musculus
ctgcgaaccatctgccaggggacag

SEQ ID NO: 918837 - DNA, 25 bp, Mus musculus
ctgcgaaggcagttcaattgtttga

SEQ ID NO: 918838 - DNA, 25 bp, Mus musculus
ctgcgaaggcagttgaattgtttga

SEQ ID NO: 918839 - DNA, 25 bp, Mus musculus
ctgcgacaagccccttggactggac

SEQ ID NO: 918840 - DNA, 25 bp, Mus musculus
ctgcgacaaggcccttggactggac

SEQ ID NO: 918841 - DNA, 25 bp, Mus musculus
ctgcgacagattcgttctaggtctt

SEQ ID NO: 918842 - DNA, 25 bp, Mus musculus
ctgcgacagattggttctaggtctt

SEQ ID NO: 918843 - DNA, 25 bp, Mus musculus
ctgcgaccagagattataaagctgt

SEQ ID NO: 918844 - DNA, 25 bp, Mus musculus
ctgcgaccagagtttataaagctgt

SEQ ID NO: 918845 - DNA, 25 bp, Mus musculus
ctgcgaccagcggagccccagaaat

SEQ ID NO: 918846 - DNA, 25 bp, Mus musculus
ctgcgaccaggggagccccagaaat

SEQ ID NO: 918847 - DNA, 25 bp, Mus musculus
ctgcgaccctgcaacagttcttttt

SEQ ID NO: 918848 - DNA, 25 bp, Mus musculus
ctgcgaccctgcaacatggaggggg

SEQ ID NO: 918849 - DNA, 25 bp, Mus musculus
ctgcgaccctgcaagagttcttttt

SEQ ID NO: 918850 - DNA, 25 bp, Mus musculus
ctgcgaccctgcaagatggaggggg

SEQ ID NO: 918851 - DNA, 25 bp, Mus musculus
ctgcgacgaaggagcagtcataaac

SEQ ID NO: 918852 - DNA, 25 bp, Mus musculus
ctgcgacgaaggaggagtcataaac

SEQ ID NO: 918853 - DNA, 25 bp, Mus musculus
ctgcgactctgacagcagaggggca

SEQ ID NO: 918854 - DNA, 25 bp, Mus musculus
ctgcgactctgagagcagaggggca

SEQ ID NO: 918855 - DNA, 25 bp, Mus musculus
ctgcgactgatcaacgaactggcta

SEQ ID NO: 918856 - DNA, 25 bp, Mus musculus
ctgcgactgatcaaggaactggcta

SEQ ID NO: 918857 - DNA, 25 bp, Mus musculus
ctgcgactgcaacgacttgtcctac

SEQ ID NO: 918858 - DNA, 25 bp, Mus musculus
ctgcgactgcaaggacttgtcctac

SEQ ID NO: 918859 - DNA, 25 bp, Mus musculus
ctgcgagaggagccctcccaccttg

SEQ ID NO: 918860 - DNA, 25 bp, Mus musculus
ctgcgagaggaggcctcccaccttg

SEQ ID NO: 918861 - DNA, 25 bp, Mus musculus
ctgcgagccgcactggttttatgaa

SEQ ID NO: 918862 - DNA, 25 bp, Mus musculus
ctgcgagccgcagtggttttatgaa

SEQ ID NO: 918863 - DNA, 25 bp, Mus musculus
ctgcgaggccgcaatctgtcgcttt

SEQ ID NO: 918864 - DNA, 25 bp, Mus musculus
ctgcgaggccgctatctgtcgcttt

SEQ ID NO: 918865 - DNA, 25 bp, Mus musculus
ctgcgagtagaggacgtggaggatg

SEQ ID NO: 918866 - DNA, 25 bp, Mus musculus
ctgcgagtagaggaggtggaggatg

SEQ ID NO: 918867 - DNA, 25 bp, Mus musculus
ctgcgagtcttcggcgccctctgtc

SEQ ID NO: 918868 - DNA, 25 bp, Mus musculus
ctgcgagtcttcggggccctctgtc

SEQ ID NO: 918869 - DNA, 25 bp, Mus musculus
ctgcgatccctcaacgtctgcctac

SEQ ID NO: 918870 - DNA, 25 bp, Mus musculus
ctgcgatccctcaaggtctgcctac

SEQ ID NO: 918871 - DNA, 25 bp, Mus musculus
ctgcgatgaatgcgtgtatgcccag

SEQ ID NO: 918872 - DNA, 25 bp, Mus musculus
ctgcgatgaatgggtgtatgcccag

SEQ ID NO: 918873 - DNA, 25 bp, Mus musculus
ctgcgatgagcttaaaagatgatga

SEQ ID NO: 918874 - DNA, 25 bp, Mus musculus
ctgcgatgagcttggcttcaatgct

SEQ ID NO: 918875 - DNA, 25 bp, Mus musculus
ctgcgatgaggttaaaagatgatga

SEQ ID NO: 918876 - DNA, 25 bp, Mus musculus
ctgcgatgaggttggcttcaatgct

SEQ ID NO: 918877 - DNA, 25 bp, Mus musculus
ctgcgcaaagcgatcagtggcgact

SEQ ID NO: 918878 - DNA, 25 bp, Mus musculus
ctgcgcaaagggatcagtggcgact

SEQ ID NO: 918879 - DNA, 25 bp, Mus musculus
ctgcgcaaggagatcctgtggggcc

SEQ ID NO: 918880 - DNA, 25 bp, Mus musculus
ctgcgcaaggagatcgtggggctgc

SEQ ID NO: 918881 - DNA, 25 bp, Mus musculus
ctgcgcaaggagatcttgtctgtag

SEQ ID NO: 918882 - DNA, 25 bp, Mus musculus
ctgcgcaaggagatgctgtggggcc

SEQ ID NO: 918883 - DNA, 25 bp, Mus musculus
ctgcgcaaggagatggtggggctgc

SEQ ID NO: 918884 - DNA, 25 bp, Mus musculus
ctgcgcaaggagatgttgtctgtag

SEQ ID NO: 918885 - DNA, 25 bp, Mus musculus
ctgcgcaaggctgagcacctcagcg

SEQ ID NO: 918886 - DNA, 25 bp, Mus musculus
ctgcgcaagggtgagcacctcagcg

SEQ ID NO: 918887 - DNA, 25 bp, Mus musculus
ctgcgcactaaacggggctgcctgc

SEQ ID NO: 918888 - DNA, 25 bp, Mus musculus
ctgcgcactaaagggggctgcctgc

SEQ ID NO: 918889 - DNA, 25 bp, Mus musculus
ctgcgcagacagctgtcagctgact

SEQ ID NO: 918890 - DNA, 25 bp, Mus musculus
ctgcgcagacaggtgtcagctgact

SEQ ID NO: 918891 - DNA, 25 bp, Mus musculus
ctgcgcagctcgccatttcagtcga

SEQ ID NO: 918892 - DNA, 25 bp, Mus musculus
ctgcgcagctcggcatttcagtcga

SEQ ID NO: 918893 - DNA, 25 bp, Mus musculus
ctgcgcagggagcgactataggcgt

SEQ ID NO: 918894 - DNA, 25 bp, Mus musculus
ctgcgcagggagggactataggcgt

SEQ ID NO: 918895 - DNA, 25 bp, Mus musculus
ctgcgcagtgtgcacccgttcccct

SEQ ID NO: 918896 - DNA, 25 bp, Mus musculus
ctgcgcagtgtggacccgttcccct

SEQ ID NO: 918897 - DNA, 25 bp, Mus musculus
ctgcgccagcacaacgtgtggcgaa

SEQ ID NO: 918898 - DNA, 25 bp, Mus musculus
ctgcgccagcacaaggtgtggcgaa

SEQ ID NO: 918899 - DNA, 25 bp, Mus musculus
ctgcgccaggatccgcctctgatct

SEQ ID NO: 918900 - DNA, 25 bp, Mus musculus
ctgcgccaggttccgcctctgatct

SEQ ID NO: 918901 - DNA, 25 bp, Mus musculus
ctgcgccctcagcatgactgagtgg

SEQ ID NO: 918902 - DNA, 25 bp, Mus musculus
ctgcgccctcaggatgactgagtgg

SEQ ID NO: 918903 - DNA, 25 bp, Mus musculus
ctgcgcctgcgccttgtagatcatg

SEQ ID NO: 918904 - DNA, 25 bp, Mus musculus
ctgcgcctgcgcgttgtagatcatg

SEQ ID NO: 918905 - DNA, 25 bp, Mus musculus
ctgcgccttaagcaggaagagctga

SEQ ID NO: 918906 - DNA, 25 bp, Mus musculus
ctgcgccttaaggaggaagagctga

SEQ ID NO: 918907 - DNA, 25 bp, Mus musculus
ctgcgcgtggaacctttgaaccaga

SEQ ID NO: 918908 - DNA, 25 bp, Mus musculus
ctgcgcgtggaagctttgaaccaga

SEQ ID NO: 918909 - DNA, 25 bp, Mus musculus
ctgcgctattggcccttctatgtgg

SEQ ID NO: 918910 - DNA, 25 bp, Mus musculus
ctgcgctattgggccttctatgtgg

SEQ ID NO: 918911 - DNA, 25 bp, Mus musculus
ctgcgctcagaccctccaaaggcac

SEQ ID NO: 918912 - DNA, 25 bp, Mus musculus
ctgcgctcagtccctccaaaggcac

SEQ ID NO: 918913 - DNA, 25 bp, Mus musculus
ctgcgctcatgccacgttttttatt

SEQ ID NO: 918914 - DNA, 25 bp, Mus musculus
ctgcgctcatgccaggttttttatt

SEQ ID NO: 918915 - DNA, 25 bp, Mus musculus
ctgcgctgactgacatctactgccg

SEQ ID NO: 918916 - DNA, 25 bp, Mus musculus
ctgcgctgactgtcatctactgccg

SEQ ID NO: 918917 - DNA, 25 bp, Mus musculus
ctgcgctgagcctccagccttcccc

SEQ ID NO: 918918 - DNA, 25 bp, Mus musculus
ctgcgctgaggctccagccttcccc

SEQ ID NO: 918919 - DNA, 25 bp, Mus musculus
ctgcgctgcgagagaggaagacgac

SEQ ID NO: 918920 - DNA, 25 bp, Mus musculus
ctgcgctgcgagtgaggaagacgac

SEQ ID NO: 918921 - DNA, 25 bp, Mus musculus
ctgcgctgcgctaattgtaaattca

SEQ ID NO: 918922 - DNA, 25 bp, Mus musculus
ctgcgctgcgcttattgtaaattca

SEQ ID NO: 918923 - DNA, 25 bp, Mus musculus
ctgcgctggcagcttgtagataccc

SEQ ID NO: 918924 - DNA, 25 bp, Mus musculus
ctgcgctggcaggttgtagataccc

SEQ ID NO: 918925 - DNA, 25 bp, Mus musculus
ctgcgcttatttgacgagaatgaga

SEQ ID NO: 918926 - DNA, 25 bp, Mus musculus
ctgcgcttatttgaggagaatgaga

SEQ ID NO: 918927 - DNA, 25 bp, Mus musculus
ctgcggaagcacaacgacctgtacc

SEQ ID NO: 918928 - DNA, 25 bp, Mus musculus
ctgcggaagcacaaggacctgtacc

SEQ ID NO: 918929 - DNA, 25 bp, Mus musculus
ctgcggaaggcaaacaacctgatca

SEQ ID NO: 918930 - DNA, 25 bp, Mus musculus
ctgcggaagggaaacaacctgatca

SEQ ID NO: 918931 - DNA, 25 bp, Mus musculus
ctgcggacacgtatcatcctatcta

SEQ ID NO: 918932 - DNA, 25 bp, Mus musculus
ctgcggacacgtcaatgtctgaagc

SEQ ID NO: 918933 - DNA, 25 bp, Mus musculus
ctgcggacacgtcttttgctctgca

SEQ ID NO: 918934 - DNA, 25 bp, Mus musculus
ctgcggacacgtgaatgtctgaagc

SEQ ID NO: 918935 - DNA, 25 bp, Mus musculus
ctgcggacacgtgttttgctctgca

SEQ ID NO: 918936 - DNA, 25 bp, Mus musculus
ctgcggacacgtttcatcctatcta

SEQ ID NO: 918937 - DNA, 25 bp, Mus musculus
ctgcggacacttgtcaagcagcagg

SEQ ID NO: 918938 - DNA, 25 bp, Mus musculus
ctgcggacacttgtcgagcattctg

SEQ ID NO: 918939 - DNA, 25 bp, Mus musculus
ctgcggacacttgtgaagcagcagg

SEQ ID NO: 918940 - DNA, 25 bp, Mus musculus
ctgcggacacttgtggagcattctg

SEQ ID NO: 918941 - DNA, 25 bp, Mus musculus
ctgcggagacagcgggctcacccta

SEQ ID NO: 918942 - DNA, 25 bp, Mus musculus
ctgcggagacagcttgcagaattca

SEQ ID NO: 918943 - DNA, 25 bp, Mus musculus
ctgcggagacagctttcggccgagt

SEQ ID NO: 918944 - DNA, 25 bp, Mus musculus
ctgcggagacagggggctcacccta

SEQ ID NO: 918945 - DNA, 25 bp, Mus musculus
ctgcggagacaggttgcagaattca

SEQ ID NO: 918946 - DNA, 25 bp, Mus musculus
ctgcggagacaggtttcggccgagt

SEQ ID NO: 918947 - DNA, 25 bp, Mus musculus
ctgcggagactccacgtgctgaagt

SEQ ID NO: 918948 - DNA, 25 bp, Mus musculus
ctgcggagactccaggtgctgaagt

SEQ ID NO: 918949 - DNA, 25 bp, Mus musculus
ctgcggagagattttgagtcacttt

SEQ ID NO: 918950 - DNA, 25 bp, Mus musculus
ctgcggagagtttttgagtcacttt

SEQ ID NO: 918951 - DNA, 25 bp, Mus musculus
ctgcggagcagaatcatttccagag

SEQ ID NO: 918952 - DNA, 25 bp, Mus musculus
ctgcggagcagaatgatttccagag

SEQ ID NO: 918953 - DNA, 25 bp, Mus musculus
ctgcggatccaacctcagtttgccc

SEQ ID NO: 918954 - DNA, 25 bp, Mus musculus
ctgcggatccaagctcagtttgccc

SEQ ID NO: 918955 - DNA, 25 bp, Mus musculus
ctgcggcaaagacgcattctggaat

SEQ ID NO: 918956 - DNA, 25 bp, Mus musculus
ctgcggcaaagaggcattctggaat

SEQ ID NO: 918957 - DNA, 25 bp, Mus musculus
ctgcggcggttgagacttctccatt

SEQ ID NO: 918958 - DNA, 25 bp, Mus musculus
ctgcggcggttgagtcttctccatt

SEQ ID NO: 918959 - DNA, 25 bp, Mus musculus
ctgcggctggagagcccacgatggc

SEQ ID NO: 918960 - DNA, 25 bp, Mus musculus
ctgcggctggagcttttcccgctca

SEQ ID NO: 918961 - DNA, 25 bp, Mus musculus
ctgcggctggaggttttcccgctca

SEQ ID NO: 918962 - DNA, 25 bp, Mus musculus
ctgcggctggagtgcccacgatggc

SEQ ID NO: 918963 - DNA, 25 bp, Mus musculus
ctgcgggaaacccctgaagctgacg

SEQ ID NO: 918964 - DNA, 25 bp, Mus musculus
ctgcgggaaaccgctgaagctgacg

SEQ ID NO: 918965 - DNA, 25 bp, Mus musculus
ctgcgggcacagctggacgaccccc

SEQ ID NO: 918966 - DNA, 25 bp, Mus musculus
ctgcgggcacaggtggacgaccccc

SEQ ID NO: 918967 - DNA, 25 bp, Mus musculus
ctgcgggcacggcaatcgtacaagt

SEQ ID NO: 918968 - DNA, 25 bp, Mus musculus
ctgcgggcacgggaatcgtacaagt

SEQ ID NO: 918969 - DNA, 25 bp, Mus musculus
ctgcgggcagctggtgctgatcgga

SEQ ID NO: 918970 - DNA, 25 bp, Mus musculus
ctgcgggcaggtggtgctgatcgga

SEQ ID NO: 918971 - DNA, 25 bp, Mus musculus
ctgcgggcccagatgctgatagccc

SEQ ID NO: 918972 - DNA, 25 bp, Mus musculus
ctgcgggcccagcagcccctggcgc

SEQ ID NO: 918973 - DNA, 25 bp, Mus musculus
ctgcgggcccagcccctggcgcagc

SEQ ID NO: 918974 - DNA, 25 bp, Mus musculus
ctgcgggcccaggagcccctggcgc

SEQ ID NO: 918975 - DNA, 25 bp, Mus musculus
ctgcgggcccaggccctggcgcagc

SEQ ID NO: 918976 - DNA, 25 bp, Mus musculus
ctgcgggcccagttgctgatagccc

SEQ ID NO: 918977 - DNA, 25 bp, Mus musculus
ctgcgggcccggaaatgcacttagc

SEQ ID NO: 918978 - DNA, 25 bp, Mus musculus
ctgcgggcccggcactgtgcagcat

SEQ ID NO: 918979 - DNA, 25 bp, Mus musculus
ctgcgggcccgggactgtgcagcat

SEQ ID NO: 918980 - DNA, 25 bp, Mus musculus
ctgcgggcccggtaatgcacttagc

SEQ ID NO: 918981 - DNA, 25 bp, Mus musculus
ctgcgggccggccaaatggcaaaat

SEQ ID NO: 918982 - DNA, 25 bp, Mus musculus
ctgcgggccggcgaaatggcaaaat

SEQ ID NO: 918983 - DNA, 25 bp, Mus musculus
ctgcgggcgcggattgtgccttctg

SEQ ID NO: 918984 - DNA, 25 bp, Mus musculus
ctgcgggcgcggtttgtgccttctg

SEQ ID NO: 918985 - DNA, 25 bp, Mus musculus
ctgcgggctttgcgaatgtcaacct

SEQ ID NO: 918986 - DNA, 25 bp, Mus musculus
ctgcgggctttgggaatgtcaacct

SEQ ID NO: 918987 - DNA, 25 bp, Mus musculus
ctgcggggtgagacgatcctcctgc

SEQ ID NO: 918988 - DNA, 25 bp, Mus musculus
ctgcggggtgagtcgatcctcctgc

SEQ ID NO: 918989 - DNA, 25 bp, Mus musculus
ctgcgtcactgtaacattctgattt

SEQ ID NO: 918990 - DNA, 25 bp, Mus musculus
ctgcgtcactgtaagattctgattt

SEQ ID NO: 918991 - DNA, 25 bp, Mus musculus
ctgcgtcattcacagaggaatgcga

SEQ ID NO: 918992 - DNA, 25 bp, Mus musculus
ctgcgtcattcagagaggaatgcga

SEQ ID NO: 918993 - DNA, 25 bp, Mus musculus
ctgcgtccaccaagaacgccagctg

SEQ ID NO: 918994 - DNA, 25 bp, Mus musculus
ctgcgtccaccatgaacgccagctg

SEQ ID NO: 918995 - DNA, 25 bp, Mus musculus
ctgcgtcgggagcctccatcatggc

SEQ ID NO: 918996 - DNA, 25 bp, Mus musculus
ctgcgtcgggaggctccatcatggc

SEQ ID NO: 918997 - DNA, 25 bp, Mus musculus
ctgcgtctaaagccttcgagtacct

SEQ ID NO: 918998 - DNA, 25 bp, Mus musculus
ctgcgtctaaaggcttcgagtacct

SEQ ID NO: 918999 - DNA, 25 bp, Mus musculus
ctgcgtctcgagacaagaccataaa

SEQ ID NO: 919000 - DNA, 25 bp, Mus musculus
ctgcgtctcgagacaagaccatcat

SEQ ID NO: 919001 - DNA, 25 bp, Mus musculus
ctgcgtctcgagtcaagaccataaa

SEQ ID NO: 919002 - DNA, 25 bp, Mus musculus
ctgcgtctcgagtcaagaccatcat

SEQ ID NO: 919003 - DNA, 25 bp, Mus musculus
ctgcgtctgctgctcatatcccctt

SEQ ID NO: 919004 - DNA, 25 bp, Mus musculus
ctgcgtctgctgctgatatcccctt

SEQ ID NO: 919005 - DNA, 25 bp, Mus musculus
ctgcgtctgtttcctttgagcgctg

SEQ ID NO: 919006 - DNA, 25 bp, Mus musculus
ctgcgtctgtttgctttgagcgctg

SEQ ID NO: 919007 - DNA, 25 bp, Mus musculus
ctgcgtgacgagtcacgatgtctga

SEQ ID NO: 919008 - DNA, 25 bp, Mus musculus
ctgcgtgacgtgtcacgatgtctga

SEQ ID NO: 919009 - DNA, 25 bp, Mus musculus
ctgcgtgatcaatgcttctccctgc

SEQ ID NO: 919010 - DNA, 25 bp, Mus musculus
ctgcgtgatcaatggttctccctgc

SEQ ID NO: 919011 - DNA, 25 bp, Mus musculus
ctgcgtgccaaacaaggactccatg

SEQ ID NO: 919012 - DNA, 25 bp, Mus musculus
ctgcgtgccaaacgactccatgaaa

SEQ ID NO: 919013 - DNA, 25 bp, Mus musculus
ctgcgtgccaaagaaggactccatg

SEQ ID NO: 919014 - DNA, 25 bp, Mus musculus
ctgcgtgccaaaggactccatgaaa

SEQ ID NO: 919015 - DNA, 25 bp, Mus musculus
ctgcgtgcccagcgtcctgtgggca

SEQ ID NO: 919016 - DNA, 25 bp, Mus musculus
ctgcgtgcccagggtcctgtgggca

SEQ ID NO: 919017 - DNA, 25 bp, Mus musculus
ctgcgtgcttagctggtgtgacaag

SEQ ID NO: 919018 - DNA, 25 bp, Mus musculus
ctgcgtgcttaggtggtgtgacaag

SEQ ID NO: 919019 - DNA, 25 bp, Mus musculus
ctgcgtggatagcctttccctgagc

SEQ ID NO: 919020 - DNA, 25 bp, Mus musculus
ctgcgtggataggctttccctgagc

SEQ ID NO: 919021 - DNA, 25 bp, Mus musculus
ctgcgtggggctaaatgaacaggtc

SEQ ID NO: 919022 - DNA, 25 bp, Mus musculus
ctgcgtggggctaattgaacaggtc

SEQ ID NO: 919023 - DNA, 25 bp, Mus musculus
ctgcgtgtgtgtgacaaccgtcgtc

SEQ ID NO: 919024 - DNA, 25 bp, Mus musculus
ctgcgtgtgtgtgacaccagaaccg

SEQ ID NO: 919025 - DNA, 25 bp, Mus musculus
ctgcgtgtgtgtgagaaccgtcgtc

SEQ ID NO: 919026 - DNA, 25 bp, Mus musculus
ctgcgtgtgtgtgagaccagaaccg

SEQ ID NO: 919027 - DNA, 25 bp, Mus musculus
ctgcgttcagaccccccaaaggcac

SEQ ID NO: 919028 - DNA, 25 bp, Mus musculus
ctgcgttcagaccctccaaaggcac

SEQ ID NO: 919029 - DNA, 25 bp, Mus musculus
ctgcgttcagtccccccaaaggcac

SEQ ID NO: 919030 - DNA, 25 bp, Mus musculus
ctgcgttcagtccctccaaaggcac

SEQ ID NO: 919031 - DNA, 25 bp, Mus musculus
ctgctaaaaagccaatgactaagat

SEQ ID NO: 919032 - DNA, 25 bp, Mus musculus
ctgctaaaaagccattgactaagat

SEQ ID NO: 919033 - DNA, 25 bp, Mus musculus
ctgctaaaggggaacaaaagacatg

SEQ ID NO: 919034 - DNA, 25 bp, Mus musculus
ctgctaaaggggaagaaaagacatg

SEQ ID NO: 919035 - DNA, 25 bp, Mus musculus
ctgctaagcgagaaaggcaaacagc

SEQ ID NO: 919036 - DNA, 25 bp, Mus musculus
ctgctaagcgagtaaggcaaacagc

SEQ ID NO: 919037 - DNA, 25 bp, Mus musculus
ctgctaagggacaacgctgtccctt

SEQ ID NO: 919038 - DNA, 25 bp, Mus musculus
ctgctaagggacaaggctgtccctt

SEQ ID NO: 919039 - DNA, 25 bp, Mus musculus
ctgctacaacagtccctccaatgtg

SEQ ID NO: 919040 - DNA, 25 bp, Mus musculus
ctgctacaactgtccctccaatgtg

SEQ ID NO: 919041 - DNA, 25 bp, Mus musculus
ctgctacaagctgcagcagaaagat

SEQ ID NO: 919042 - DNA, 25 bp, Mus musculus
ctgctacaaggtgcagcagaaagat

SEQ ID NO: 919043 - DNA, 25 bp, Mus musculus
ctgctacagagtcgtgcccaggtcc

SEQ ID NO: 919044 - DNA, 25 bp, Mus musculus
ctgctacagagtggtgcccaggtcc

SEQ ID NO: 919045 - DNA, 25 bp, Mus musculus
ctgctacaggcttagcattctatcc

SEQ ID NO: 919046 - DNA, 25 bp, Mus musculus
ctgctacagggttagcattctatcc

SEQ ID NO: 919047 - DNA, 25 bp, Mus musculus
ctgctaccatagcagactacacgga

SEQ ID NO: 919048 - DNA, 25 bp, Mus musculus
ctgctaccatagcctccacttacct

SEQ ID NO: 919049 - DNA, 25 bp, Mus musculus
ctgctaccataggagactacacgga

SEQ ID NO: 919050 - DNA, 25 bp, Mus musculus
ctgctaccataggctccacttacct

SEQ ID NO: 919051 - DNA, 25 bp, Mus musculus
ctgctacggccgcactcggaaccca

SEQ ID NO: 919052 - DNA, 25 bp, Mus musculus
ctgctacggccggactcggaaccca

SEQ ID NO: 919053 - DNA, 25 bp, Mus musculus
ctgctacgggcacgctggaacgagc

SEQ ID NO: 919054 - DNA, 25 bp, Mus musculus
ctgctacgggcaggctggaacgagc

SEQ ID NO: 919055 - DNA, 25 bp, Mus musculus
ctgctactcccagacgagagacgga

SEQ ID NO: 919056 - DNA, 25 bp, Mus musculus
ctgctactcccagaggagagacgga

SEQ ID NO: 919057 - DNA, 25 bp, Mus musculus
ctgctagaagctggctcgctgggtc

SEQ ID NO: 919058 - DNA, 25 bp, Mus musculus
ctgctagaaggtggctcgctgggtc

SEQ ID NO: 919059 - DNA, 25 bp, Mus musculus
ctgctagaatcgctctttggtcctt

SEQ ID NO: 919060 - DNA, 25 bp, Mus musculus
ctgctagaatcggtctttggtcctt

SEQ ID NO: 919061 - DNA, 25 bp, Mus musculus
ctgctagactggcgtgctgaccccc

SEQ ID NO: 919062 - DNA, 25 bp, Mus musculus
ctgctagactggggtgctgaccccc

SEQ ID NO: 919063 - DNA, 25 bp, Mus musculus
ctgctagagcatcgcccacccctgg

SEQ ID NO: 919064 - DNA, 25 bp, Mus musculus
ctgctagagcatggcccacccctgg

SEQ ID NO: 919065 - DNA, 25 bp, Mus musculus
ctgctagagcgtgtcggcatcgttc

SEQ ID NO: 919066 - DNA, 25 bp, Mus musculus
ctgctagagcgtgtgggcatcgttc

SEQ ID NO: 919067 - DNA, 25 bp, Mus musculus
ctgctagccaagatatcaacctgaa

SEQ ID NO: 919068 - DNA, 25 bp, Mus musculus
ctgctagccaagctgctggattaaa

SEQ ID NO: 919069 - DNA, 25 bp, Mus musculus
ctgctagccaaggtgctggattaaa

SEQ ID NO: 919070 - DNA, 25 bp, Mus musculus
ctgctagccaagttatcaacctgaa

SEQ ID NO: 919071 - DNA, 25 bp, Mus musculus
ctgctaggcaagaacaagttcaggg

SEQ ID NO: 919072 - DNA, 25 bp, Mus musculus
ctgctaggcaagtacaagttcaggg

SEQ ID NO: 919073 - DNA, 25 bp, Mus musculus
ctgctagtgcaacaacttttacatc

SEQ ID NO: 919074 - DNA, 25 bp, Mus musculus
ctgctagtgcaagaacttttacatc

SEQ ID NO: 919075 - DNA, 25 bp, Mus musculus
ctgctatcggaattgcaaatgccac

SEQ ID NO: 919076 - DNA, 25 bp, Mus musculus
ctgctatcggtattgcaaatgccac

SEQ ID NO: 919077 - DNA, 25 bp, Mus musculus
ctgctatggcaaccagtataatgtt

SEQ ID NO: 919078 - DNA, 25 bp, Mus musculus
ctgctatggcaagcagtataatgtt

SEQ ID NO: 919079 - DNA, 25 bp, Mus musculus
ctgctattcaaaacagcgtggaaga

SEQ ID NO: 919080 - DNA, 25 bp, Mus musculus
ctgctattcaaatcagcgtggaaga

SEQ ID NO: 919081 - DNA, 25 bp, Mus musculus
ctgctattgcagaggtggcttttgc

SEQ ID NO: 919082 - DNA, 25 bp, Mus musculus
ctgctattgcagctttcctggcaga

SEQ ID NO: 919083 - DNA, 25 bp, Mus musculus
ctgctattgcaggtttcctggcaga

SEQ ID NO: 919084 - DNA, 25 bp, Mus musculus
ctgctattgcagtggtggcttttgc

SEQ ID NO: 919085 - DNA, 25 bp, Mus musculus
ctgctcaacaagctgaatgaccttc

SEQ ID NO: 919086 - DNA, 25 bp, Mus musculus
ctgctcaacaaggtgaatgaccttc

SEQ ID NO: 919087 - DNA, 25 bp, Mus musculus
ctgctcaaccagacgcacctctagt

SEQ ID NO: 919088 - DNA, 25 bp, Mus musculus
ctgctcaaccagaggacatatcagg

SEQ ID NO: 919089 - DNA, 25 bp, Mus musculus
ctgctcaaccagtcgcacctctagt

SEQ ID NO: 919090 - DNA, 25 bp, Mus musculus
ctgctcaaccagtggacatatcagg

SEQ ID NO: 919091 - DNA, 25 bp, Mus musculus
ctgctcaactggctgaatgccctgg

SEQ ID NO: 919092 - DNA, 25 bp, Mus musculus
ctgctcaactgggtgaatgccctgg

SEQ ID NO: 919093 - DNA, 25 bp, Mus musculus
ctgctcaagctccgtggcagggtaa

SEQ ID NO: 919094 - DNA, 25 bp, Mus musculus
ctgctcaagctcggtggcagggtaa

SEQ ID NO: 919095 - DNA, 25 bp, Mus musculus
ctgctcacagagtcagtccgaccgc

SEQ ID NO: 919096 - DNA, 25 bp, Mus musculus
ctgctcacagtgtcagtccgaccgc

SEQ ID NO: 919097 - DNA, 25 bp, Mus musculus
ctgctcacccagagtgtcctgagag

SEQ ID NO: 919098 - DNA, 25 bp, Mus musculus
ctgctcacccagtgtgtcctgagag

SEQ ID NO: 919099 - DNA, 25 bp, Mus musculus
ctgctcaccccgagtgggtcagctg

SEQ ID NO: 919100 - DNA, 25 bp, Mus musculus
ctgctcaccccgtgtgggtcagctg

SEQ ID NO: 919101 - DNA, 25 bp, Mus musculus
ctgctcaccctggacgttcctggtg

SEQ ID NO: 919102 - DNA, 25 bp, Mus musculus
ctgctcaccctggaggttcctggtg

SEQ ID NO: 919103 - DNA, 25 bp, Mus musculus
ctgctcactgaaccctctgcaggtc

SEQ ID NO: 919104 - DNA, 25 bp, Mus musculus
ctgctcactgcattgctggttttag

SEQ ID NO: 919105 - DNA, 25 bp, Mus musculus
ctgctcactggattgctggttttag

SEQ ID NO: 919106 - DNA, 25 bp, Mus musculus
ctgctcactggtgacaaccctctgc

SEQ ID NO: 919107 - DNA, 25 bp, Mus musculus
ctgctcactggtgactggcccccga

SEQ ID NO: 919108 - DNA, 25 bp, Mus musculus
ctgctcactggtgagaaccctctgc

SEQ ID NO: 919109 - DNA, 25 bp, Mus musculus
ctgctcactggtgagtggcccccga

SEQ ID NO: 919110 - DNA, 25 bp, Mus musculus
ctgctcactgtaccctctgcaggtc

SEQ ID NO: 919111 - DNA, 25 bp, Mus musculus
ctgctcagaacgaaccaagaattgt

SEQ ID NO: 919112 - DNA, 25 bp, Mus musculus
ctgctcagaacgcatcaataagcca

SEQ ID NO: 919113 - DNA, 25 bp, Mus musculus
ctgctcagaacggatcaataagcca

SEQ ID NO: 919114 - DNA, 25 bp, Mus musculus
ctgctcagaacgtaccaagaattgt

SEQ ID NO: 919115 - DNA, 25 bp, Mus musculus
ctgctcagagagtccgcgtccctac

SEQ ID NO: 919116 - DNA, 25 bp, Mus musculus
ctgctcagagagtccggtctgagtg

SEQ ID NO: 919117 - DNA, 25 bp, Mus musculus
ctgctcagagagtcggcgtccctac

SEQ ID NO: 919118 - DNA, 25 bp, Mus musculus
ctgctcagagagtcgggtctgagtg

SEQ ID NO: 919119 - DNA, 25 bp, Mus musculus
ctgctcagagccaccagaggacctt

SEQ ID NO: 919120 - DNA, 25 bp, Mus musculus
ctgctcagaggcaccagaggacctt

SEQ ID NO: 919121 - DNA, 25 bp, Mus musculus
ctgctcagagtacacgagctggaga

SEQ ID NO: 919122 - DNA, 25 bp, Mus musculus
ctgctcagagtacaggagctggaga

SEQ ID NO: 919123 - DNA, 25 bp, Mus musculus
ctgctcagcgtggaccccttggatg

SEQ ID NO: 919124 - DNA, 25 bp, Mus musculus
ctgctcagcgtggacctgcagccct

SEQ ID NO: 919125 - DNA, 25 bp, Mus musculus
ctgctcagcgtggagcccttggatg

SEQ ID NO: 919126 - DNA, 25 bp, Mus musculus
ctgctcagcgtggagctgcagccct

SEQ ID NO: 919127 - DNA, 25 bp, Mus musculus
ctgctcaggggccacgagctgaagt

SEQ ID NO: 919128 - DNA, 25 bp, Mus musculus
ctgctcaggggccaggagctgaagt

SEQ ID NO: 919129 - DNA, 25 bp, Mus musculus
ctgctcagttcacacaaataccaga

SEQ ID NO: 919130 - DNA, 25 bp, Mus musculus
ctgctcagttcacagaaataccaga

SEQ ID NO: 919131 - DNA, 25 bp, Mus musculus
ctgctcatggaaacgtgtgccgtca

SEQ ID NO: 919132 - DNA, 25 bp, Mus musculus
ctgctcatggaatttgacatctggt

SEQ ID NO: 919133 - DNA, 25 bp, Mus musculus
ctgctcatggtaacgtgtgccgtca

SEQ ID NO: 919134 - DNA, 25 bp, Mus musculus
ctgctcatggtatttgacatctggt

SEQ ID NO: 919135 - DNA, 25 bp, Mus musculus
ctgctcattcgccctgtggacagag

SEQ ID NO: 919136 - DNA, 25 bp, Mus musculus
ctgctcattcgcgctgtggacagag

SEQ ID NO: 919137 - DNA, 25 bp, Mus musculus
ctgctcattgcacgccagattaaca

SEQ ID NO: 919138 - DNA, 25 bp, Mus musculus
ctgctcattgcaggccagattaaca

SEQ ID NO: 919139 - DNA, 25 bp, Mus musculus
ctgctccaagccccacagctggcag

SEQ ID NO: 919140 - DNA, 25 bp, Mus musculus
ctgctccaaggcccacagctggcag

SEQ ID NO: 919141 - DNA, 25 bp, Mus musculus
ctgctccacgagtttgatgaataca

SEQ ID NO: 919142 - DNA, 25 bp, Mus musculus
ctgctccacgctaaccatgtgcgac

SEQ ID NO: 919143 - DNA, 25 bp, Mus musculus
ctgctccacggtaaccatgtgcgac

SEQ ID NO: 919144 - DNA, 25 bp, Mus musculus
ctgctccacgtgtttgatgaataca

SEQ ID NO: 919145 - DNA, 25 bp, Mus musculus
ctgctccatgaacgtccacctgctc

SEQ ID NO: 919146 - DNA, 25 bp, Mus musculus
ctgctccatgaaggtccacctgctc

SEQ ID NO: 919147 - DNA, 25 bp, Mus musculus
ctgctcccaagctgcaatccccaaa

SEQ ID NO: 919148 - DNA, 25 bp, Mus musculus
ctgctcccaagctggaatccccaaa

SEQ ID NO: 919149 - DNA, 25 bp, Mus musculus
ctgctcccacagagagccaacccac

SEQ ID NO: 919150 - DNA, 25 bp, Mus musculus
ctgctcccacagtgagccaacccac

SEQ ID NO: 919151 - DNA, 25 bp, Mus musculus
ctgctcccagcatggcggacaagga

SEQ ID NO: 919152 - DNA, 25 bp, Mus musculus
ctgctcccaggatggcggacaagga

SEQ ID NO: 919153 - DNA, 25 bp, Mus musculus
ctgctccgtatagacgaagcccagc

SEQ ID NO: 919154 - DNA, 25 bp, Mus musculus
ctgctccgtatagaggaagcccagc

SEQ ID NO: 919155 - DNA, 25 bp, Mus musculus
ctgctcctagccaatgactacatcg

SEQ ID NO: 919156 - DNA, 25 bp, Mus musculus
ctgctcctaggcaatgactacatcg

SEQ ID NO: 919157 - DNA, 25 bp, Mus musculus
ctgctcctcacacaggaaggaaaga

SEQ ID NO: 919158 - DNA, 25 bp, Mus musculus
ctgctcctcacagaggaaggaaaga

SEQ ID NO: 919159 - DNA, 25 bp, Mus musculus
ctgctcctcgcagactttcagagat

SEQ ID NO: 919160 - DNA, 25 bp, Mus musculus
ctgctcctcgcagagtttcagagat

SEQ ID NO: 919161 - DNA, 25 bp, Mus musculus
ctgctcctcggaccggagctgatcc

SEQ ID NO: 919162 - DNA, 25 bp, Mus musculus
ctgctcctcggagcggagctgatcc

SEQ ID NO: 919163 - DNA, 25 bp, Mus musculus
ctgctcctgcagctcctaagcagcg

SEQ ID NO: 919164 - DNA, 25 bp, Mus musculus
ctgctcctgcaggtcctaagcagcg

SEQ ID NO: 919165 - DNA, 25 bp, Mus musculus
ctgctcctggagcgaggtgtggacg

SEQ ID NO: 919166 - DNA, 25 bp, Mus musculus
ctgctcctggagggaggtgtggacg

SEQ ID NO: 919167 - DNA, 25 bp, Mus musculus
ctgctcctgggggacctctcagata

SEQ ID NO: 919168 - DNA, 25 bp, Mus musculus
ctgctcctgggggagctctcagata

SEQ ID NO: 919169 - DNA, 25 bp, Mus musculus
ctgctcgacaaccacgttggcttca

SEQ ID NO: 919170 - DNA, 25 bp, Mus musculus
ctgctcgacaaccaggttggcttca

SEQ ID NO: 919171 - DNA, 25 bp, Mus musculus
ctgctcgtaccacgcacagaagaat

SEQ ID NO: 919172 - DNA, 25 bp, Mus musculus
ctgctcgtaccaggcacagaagaat

SEQ ID NO: 919173 - DNA, 25 bp, Mus musculus
ctgctctcaatgcaggtcaatggcc

SEQ ID NO: 919174 - DNA, 25 bp, Mus musculus
ctgctctcaatggaggtcaatggcc

SEQ ID NO: 919175 - DNA, 25 bp, Mus musculus
ctgctctcacagaacatacccagct

SEQ ID NO: 919176 - DNA, 25 bp, Mus musculus
ctgctctcacagaagatacccagct

SEQ ID NO: 919177 - DNA, 25 bp, Mus musculus
ctgctctcagaattccggctgacag

SEQ ID NO: 919178 - DNA, 25 bp, Mus musculus
ctgctctcagcaggccaagctcctt

SEQ ID NO: 919179 - DNA, 25 bp, Mus musculus
ctgctctcagcccaagctcctttgc

SEQ ID NO: 919180 - DNA, 25 bp, Mus musculus
ctgctctcaggaggccaagctcctt

SEQ ID NO: 919181 - DNA, 25 bp, Mus musculus
ctgctctcaggccaagctcctttgc

SEQ ID NO: 919182 - DNA, 25 bp, Mus musculus
ctgctctcagtattccggctgacag

SEQ ID NO: 919183 - DNA, 25 bp, Mus musculus
ctgctctcgactgggcagtatcaaa

SEQ ID NO: 919184 - DNA, 25 bp, Mus musculus
ctgctctcgagtgggcagtatcaaa

SEQ ID NO: 919185 - DNA, 25 bp, Mus musculus
ctgctctctattacacgctgccccc

SEQ ID NO: 919186 - DNA, 25 bp, Mus musculus
ctgctctctattaggagagaaatac

SEQ ID NO: 919187 - DNA, 25 bp, Mus musculus
ctgctctctatttcacgctgccccc

SEQ ID NO: 919188 - DNA, 25 bp, Mus musculus
ctgctctctatttggagagaaatac

SEQ ID NO: 919189 - DNA, 25 bp, Mus musculus
ctgctctgacagccgggagtgggag

SEQ ID NO: 919190 - DNA, 25 bp, Mus musculus
ctgctctgacaggcgggagtgggag

SEQ ID NO: 919191 - DNA, 25 bp, Mus musculus
ctgctctgcagtcacacctgctggc

SEQ ID NO: 919192 - DNA, 25 bp, Mus musculus
ctgctctgcagtgacacctgctggc

SEQ ID NO: 919193 - DNA, 25 bp, Mus musculus
ctgctctgggatcacggggctcatt

SEQ ID NO: 919194 - DNA, 25 bp, Mus musculus
ctgctctgggatcagggggctcatt

SEQ ID NO: 919195 - DNA, 25 bp, Mus musculus
ctgctctgggcgaggcggctggagc

SEQ ID NO: 919196 - DNA, 25 bp, Mus musculus
ctgctctgggggaggcggctggagc

SEQ ID NO: 919197 - DNA, 25 bp, Mus musculus
ctgctctggtcttacgttcttgatt

SEQ ID NO: 919198 - DNA, 25 bp, Mus musculus
ctgctctggtcttaggttcttgatt

SEQ ID NO: 919199 - DNA, 25 bp, Mus musculus
ctgctctgtaagcaccctaggatgt

SEQ ID NO: 919200 - DNA, 25 bp, Mus musculus
ctgctctgtaagcagcctaggatgt

SEQ ID NO: 919201 - DNA, 25 bp, Mus musculus
ctgctctgtcttcgactgactctga

SEQ ID NO: 919202 - DNA, 25 bp, Mus musculus
ctgctctgtcttggactgactctga

SEQ ID NO: 919203 - DNA, 25 bp, Mus musculus
ctgctctgttgtcacttcctgatac

SEQ ID NO: 919204 - DNA, 25 bp, Mus musculus
ctgctctgttgtgacttcctgatac

SEQ ID NO: 919205 - DNA, 25 bp, Mus musculus
ctgctcttaaagactttaatctgtt

SEQ ID NO: 919206 - DNA, 25 bp, Mus musculus
ctgctcttaaagctagctcggaaca

SEQ ID NO: 919207 - DNA, 25 bp, Mus musculus
ctgctcttaaagctcggaacacacg

SEQ ID NO: 919208 - DNA, 25 bp, Mus musculus
ctgctcttaaaggtagctcggaaca

SEQ ID NO: 919209 - DNA, 25 bp, Mus musculus
ctgctcttaaaggtcggaacacacg

SEQ ID NO: 919210 - DNA, 25 bp, Mus musculus
ctgctcttaaagtctttaatctgtt

SEQ ID NO: 919211 - DNA, 25 bp, Mus musculus
ctgctcttcacctgcttcctggcag

SEQ ID NO: 919212 - DNA, 25 bp, Mus musculus
ctgctcttcacctggttcctggcag

SEQ ID NO: 919213 - DNA, 25 bp, Mus musculus
ctgctcttcgtgcgtgagaagatgt

SEQ ID NO: 919214 - DNA, 25 bp, Mus musculus
ctgctcttcgtgggtgagaagatgt

SEQ ID NO: 919215 - DNA, 25 bp, Mus musculus
ctgctcttctttaatatgatcatcc

SEQ ID NO: 919216 - DNA, 25 bp, Mus musculus
ctgctcttcttttatatgatcatcc

SEQ ID NO: 919217 - DNA, 25 bp, Mus musculus
ctgctgaaagctactaatgcatctg

SEQ ID NO: 919218 - DNA, 25 bp, Mus musculus
ctgctgaaaggtactaatgcatctg

SEQ ID NO: 919219 - DNA, 25 bp, Mus musculus
ctgctgaaattgctgaattatgtaa

SEQ ID NO: 919220 - DNA, 25 bp, Mus musculus
ctgctgaaattggtgaattatgtaa

SEQ ID NO: 919221 - DNA, 25 bp, Mus musculus
ctgctgacagacactgtcctgttgg

SEQ ID NO: 919222 - DNA, 25 bp, Mus musculus
ctgctgacagcgcgcgtgtatgaag

SEQ ID NO: 919223 - DNA, 25 bp, Mus musculus
ctgctgacagggcgcgtgtatgaag

SEQ ID NO: 919224 - DNA, 25 bp, Mus musculus
ctgctgacagtcactgtcctgttgg

SEQ ID NO: 919225 - DNA, 25 bp, Mus musculus
ctgctgactgcagacctgtatctcc

SEQ ID NO: 919226 - DNA, 25 bp, Mus musculus
ctgctgactgcagagctgtatctcc

SEQ ID NO: 919227 - DNA, 25 bp, Mus musculus
ctgctgagacagcaagcgggaaaac

SEQ ID NO: 919228 - DNA, 25 bp, Mus musculus
ctgctgagacaggaagcgggaaaac

SEQ ID NO: 919229 - DNA, 25 bp, Mus musculus
ctgctgagcaaacatgaagcggcag

SEQ ID NO: 919230 - DNA, 25 bp, Mus musculus
ctgctgagcaaagatgaagcggcag

SEQ ID NO: 919231 - DNA, 25 bp, Mus musculus
ctgctgagcaagcatgaacatggaa

SEQ ID NO: 919232 - DNA, 25 bp, Mus musculus
ctgctgagcaaggatgaacatggaa

SEQ ID NO: 919233 - DNA, 25 bp, Mus musculus
ctgctgagcacacactcagaaactt

SEQ ID NO: 919234 - DNA, 25 bp, Mus musculus
ctgctgagcacacgacaaggtgtgg

SEQ ID NO: 919235 - DNA, 25 bp, Mus musculus
ctgctgagcacagactcagaaactt

SEQ ID NO: 919236 - DNA, 25 bp, Mus musculus
ctgctgagcacaggacaaggtgtgg

SEQ ID NO: 919237 - DNA, 25 bp, Mus musculus
ctgctgataacacacgccatggcgc

SEQ ID NO: 919238 - DNA, 25 bp, Mus musculus
ctgctgataacacacgtgccttctt

SEQ ID NO: 919239 - DNA, 25 bp, Mus musculus
ctgctgataacacaggccatggcgc

SEQ ID NO: 919240 - DNA, 25 bp, Mus musculus
ctgctgataacacaggtgccttctt

SEQ ID NO: 919241 - DNA, 25 bp, Mus musculus
ctgctgatgcagcagctgagaggta

SEQ ID NO: 919242 - DNA, 25 bp, Mus musculus
ctgctgatgcagcctgagaggtacc

SEQ ID NO: 919243 - DNA, 25 bp, Mus musculus
ctgctgatgcaggagctgagaggta

SEQ ID NO: 919244 - DNA, 25 bp, Mus musculus
ctgctgatgcaggctgagaggtacc

SEQ ID NO: 919245 - DNA, 25 bp, Mus musculus
ctgctgattcgagacgttccgtgag

SEQ ID NO: 919246 - DNA, 25 bp, Mus musculus
ctgctgattcgagaggttccgtgag

SEQ ID NO: 919247 - DNA, 25 bp, Mus musculus
ctgctgcaaccacttctttgtcttg

SEQ ID NO: 919248 - DNA, 25 bp, Mus musculus
ctgctgcaaccagttctttgtcttg

SEQ ID NO: 919249 - DNA, 25 bp, Mus musculus
ctgctgcaagaagacatgacgcctt

SEQ ID NO: 919250 - DNA, 25 bp, Mus musculus
ctgctgcaagaagagatgacgcctt

SEQ ID NO: 919251 - DNA, 25 bp, Mus musculus
ctgctgcaagccattgctgactaca

SEQ ID NO: 919252 - DNA, 25 bp, Mus musculus
ctgctgcaaggcattgctgactaca

SEQ ID NO: 919253 - DNA, 25 bp, Mus musculus
ctgctgcacatcctcacggatgcag

SEQ ID NO: 919254 - DNA, 25 bp, Mus musculus
ctgctgcacatcctgacggatgcag

SEQ ID NO: 919255 - DNA, 25 bp, Mus musculus
ctgctgcagaaccagtttgttgtat

SEQ ID NO: 919256 - DNA, 25 bp, Mus musculus
ctgctgcagaacgagtttgttgtat

SEQ ID NO: 919257 - DNA, 25 bp, Mus musculus
ctgctgcagaagagacccaagccag

SEQ ID NO: 919258 - DNA, 25 bp, Mus musculus
ctgctgcagaagtgacccaagccag

SEQ ID NO: 919259 - DNA, 25 bp, Mus musculus
ctgctgcagctgacacaactcctag

SEQ ID NO: 919260 - DNA, 25 bp, Mus musculus
ctgctgcagctgtcacaactcctag

SEQ ID NO: 919261 - DNA, 25 bp, Mus musculus
ctgctgcagcttcgctcttgtggac

SEQ ID NO: 919262 - DNA, 25 bp, Mus musculus
ctgctgcagcttggctcttgtggac

SEQ ID NO: 919263 - DNA, 25 bp, Mus musculus
ctgctgcaggagcaaactgtgccag

SEQ ID NO: 919264 - DNA, 25 bp, Mus musculus
ctgctgcaggaggaaactgtgccag

SEQ ID NO: 919265 - DNA, 25 bp, Mus musculus
ctgctgcatactgttcttcgtgtcc

SEQ ID NO: 919266 - DNA, 25 bp, Mus musculus
ctgctgcatagtgttcttcgtgtcc

SEQ ID NO: 919267 - DNA, 25 bp, Mus musculus
ctgctgcatcagaacctcttacata

SEQ ID NO: 919268 - DNA, 25 bp, Mus musculus
ctgctgcatcagcccagcactatgg

SEQ ID NO: 919269 - DNA, 25 bp, Mus musculus
ctgctgcatcagctaccaccagctt

SEQ ID NO: 919270 - DNA, 25 bp, Mus musculus
ctgctgcatcaggccagcactatgg

SEQ ID NO: 919271 - DNA, 25 bp, Mus musculus
ctgctgcatcaggtaccaccagctt

SEQ ID NO: 919272 - DNA, 25 bp, Mus musculus
ctgctgcatcagtacctcttacata

SEQ ID NO: 919273 - DNA, 25 bp, Mus musculus
ctgctgcatgcacaacccttaccag

SEQ ID NO: 919274 - DNA, 25 bp, Mus musculus
ctgctgcatgcacctggtgcagaac

SEQ ID NO: 919275 - DNA, 25 bp, Mus musculus
ctgctgcatgcagaacccttaccag

SEQ ID NO: 919276 - DNA, 25 bp, Mus musculus
ctgctgcatgcagctggtgcagaac

SEQ ID NO: 919277 - DNA, 25 bp, Mus musculus
ctgctgccagataaagatagagaaa

SEQ ID NO: 919278 - DNA, 25 bp, Mus musculus
ctgctgccagttaaagatagagaaa

SEQ ID NO: 919279 - DNA, 25 bp, Mus musculus
ctgctgcccctgggctgtcttctga

SEQ ID NO: 919280 - DNA, 25 bp, Mus musculus
ctgctgcccctggggtgtcttctga

SEQ ID NO: 919281 - DNA, 25 bp, Mus musculus
ctgctgccctagcagggtcggagct

SEQ ID NO: 919282 - DNA, 25 bp, Mus musculus
ctgctgccctagcgtcggagcttcc

SEQ ID NO: 919283 - DNA, 25 bp, Mus musculus
ctgctgccctaggagggtcggagct

SEQ ID NO: 919284 - DNA, 25 bp, Mus musculus
ctgctgccctagggtcggagcttcc

SEQ ID NO: 919285 - DNA, 25 bp, Mus musculus
ctgctgccgatcacagtctctggtc

SEQ ID NO: 919286 - DNA, 25 bp, Mus musculus
ctgctgccgatctcagtctctggtc

SEQ ID NO: 919287 - DNA, 25 bp, Mus musculus
ctgctgccggctcagcacctcggca

SEQ ID NO: 919288 - DNA, 25 bp, Mus musculus
ctgctgccggcttttctcctgaact

SEQ ID NO: 919289 - DNA, 25 bp, Mus musculus
ctgctgccgggtcagcacctcggca

SEQ ID NO: 919290 - DNA, 25 bp, Mus musculus
ctgctgccgggttttctcctgaact

SEQ ID NO: 919291 - DNA, 25 bp, Mus musculus
ctgctgcctatgcctattgctatgc

SEQ ID NO: 919292 - DNA, 25 bp, Mus musculus
ctgctgcctatggctattgctatgc

SEQ ID NO: 919293 - DNA, 25 bp, Mus musculus
ctgctgcgctcacaccctccaaagg

SEQ ID NO: 919294 - DNA, 25 bp, Mus musculus
ctgctgcgctcagaccctccaaagg

SEQ ID NO: 919295 - DNA, 25 bp, Mus musculus
ctgctgcggagacattttgagtcac

SEQ ID NO: 919296 - DNA, 25 bp, Mus musculus
ctgctgcggagagattttgagtcac

SEQ ID NO: 919297 - DNA, 25 bp, Mus musculus
ctgctgcgtgcttacgtggtgtgac

SEQ ID NO: 919298 - DNA, 25 bp, Mus musculus
ctgctgcgtgcttaggtggtgtgac

SEQ ID NO: 919299 - DNA, 25 bp, Mus musculus
ctgctgcgttcacaccccccaaagg

SEQ ID NO: 919300 - DNA, 25 bp, Mus musculus
ctgctgcgttcacaccctccaaagg

SEQ ID NO: 919301 - DNA, 25 bp, Mus musculus
ctgctgcgttcagaccccccaaagg

SEQ ID NO: 919302 - DNA, 25 bp, Mus musculus
ctgctgcgttcagaccctccaaagg

SEQ ID NO: 919303 - DNA, 25 bp, Mus musculus
ctgctgctatcgcaattgcaaatgc

SEQ ID NO: 919304 - DNA, 25 bp, Mus musculus
ctgctgctatcggaattgcaaatgc

SEQ ID NO: 919305 - DNA, 25 bp, Mus musculus
ctgctgctcctgcacgtcctaagca

SEQ ID NO: 919306 - DNA, 25 bp, Mus musculus
ctgctgctcctgcaggtcctaagca

SEQ ID NO: 919307 - DNA, 25 bp, Mus musculus
ctgctgctcgcagagcgggactacg

SEQ ID NO: 919308 - DNA, 25 bp, Mus musculus
ctgctgctcggagagcgggactacg

SEQ ID NO: 919309 - DNA, 25 bp, Mus musculus
ctgctgctctcgattaatgaaaatc

SEQ ID NO: 919310 - DNA, 25 bp, Mus musculus
ctgctgctctggattaatgaaaatc

SEQ ID NO: 919311 - DNA, 25 bp, Mus musculus
ctgctgctgagcaacgatgaacatg

SEQ ID NO: 919312 - DNA, 25 bp, Mus musculus
ctgctgctgagcaaggatgaacatg

SEQ ID NO: 919313 - DNA, 25 bp, Mus musculus
ctgctgctgccacataaagatagag

SEQ ID NO: 919314 - DNA, 25 bp, Mus musculus
ctgctgctgccagataaagatagag

SEQ ID NO: 919315 - DNA, 25 bp, Mus musculus
ctgctgctgctgaacaatgttaact

SEQ ID NO: 919316 - DNA, 25 bp, Mus musculus
ctgctgctgctgcaacgggttccag

SEQ ID NO: 919317 - DNA, 25 bp, Mus musculus
ctgctgctgctgccctctccggagt

SEQ ID NO: 919318 - DNA, 25 bp, Mus musculus
ctgctgctgctggaacgggttccag

SEQ ID NO: 919319 - DNA, 25 bp, Mus musculus
ctgctgctgctggcctctccggagt

SEQ ID NO: 919320 - DNA, 25 bp, Mus musculus
ctgctgctgctgtacaatgttaact

SEQ ID NO: 919321 - DNA, 25 bp, Mus musculus
ctgctgctggcctctccggagtccc

SEQ ID NO: 919322 - DNA, 25 bp, Mus musculus
ctgctgctgggccctgtctcagcct

SEQ ID NO: 919323 - DNA, 25 bp, Mus musculus
ctgctgctgggcgctgtctcagcct

SEQ ID NO: 919324 - DNA, 25 bp, Mus musculus
ctgctgctgggctctccggagtccc

SEQ ID NO: 919325 - DNA, 25 bp, Mus musculus
ctgctgctgggcttcgttcctgcct

SEQ ID NO: 919326 - DNA, 25 bp, Mus musculus
ctgctgctgggcttggttcctgcct

SEQ ID NO: 919327 - DNA, 25 bp, Mus musculus
ctgctgctgtacaatgttaactgcc

SEQ ID NO: 919328 - DNA, 25 bp, Mus musculus
ctgctgctgtcactcgtgctcctgg

SEQ ID NO: 919329 - DNA, 25 bp, Mus musculus
ctgctgctgtcactggtgctcctgg

SEQ ID NO: 919330 - DNA, 25 bp, Mus musculus
ctgctgctgtggaacggactccccg

SEQ ID NO: 919331 - DNA, 25 bp, Mus musculus
ctgctgctgtggaagggactccccg

SEQ ID NO: 919332 - DNA, 25 bp, Mus musculus
ctgctgctgttcaatgttaactgcc

SEQ ID NO: 919333 - DNA, 25 bp, Mus musculus
ctgctgctgtttccttttgcagaca

SEQ ID NO: 919334 - DNA, 25 bp, Mus musculus
ctgctgctgtttgcttttgcagaca

SEQ ID NO: 919335 - DNA, 25 bp, Mus musculus
ctgctgcttaaacgacttggactcg

SEQ ID NO: 919336 - DNA, 25 bp, Mus musculus
ctgctgcttaaaggacttggactcg

SEQ ID NO: 919337 - DNA, 25 bp, Mus musculus
ctgctgcttctgcatttatttatta

SEQ ID NO: 919338 - DNA, 25 bp, Mus musculus
ctgctgcttctgcctggccggcctg

SEQ ID NO: 919339 - DNA, 25 bp, Mus musculus
ctgctgcttctgcgtgccggtgaat

SEQ ID NO: 919340 - DNA, 25 bp, Mus musculus
ctgctgcttctggatttatttatta

SEQ ID NO: 919341 - DNA, 25 bp, Mus musculus
ctgctgcttctggctggccggcctg

SEQ ID NO: 919342 - DNA, 25 bp, Mus musculus
ctgctgcttctgggtgccggtgaat

SEQ ID NO: 919343 - DNA, 25 bp, Mus musculus
ctgctggaaaagaaactaagtgttg

SEQ ID NO: 919344 - DNA, 25 bp, Mus musculus
ctgctggaaaagactcagttttcag

SEQ ID NO: 919345 - DNA, 25 bp, Mus musculus
ctgctggaaaagctgaagtggtatt

SEQ ID NO: 919346 - DNA, 25 bp, Mus musculus
ctgctggaaaagtaactaagtgttg

SEQ ID NO: 919347 - DNA, 25 bp, Mus musculus
ctgctggaaaagtctcagttttcag

SEQ ID NO: 919348 - DNA, 25 bp, Mus musculus
ctgctggaaatgctgaagtggtatt

SEQ ID NO: 919349 - DNA, 25 bp, Mus musculus
ctgctggaagcagcagcggtcagca

SEQ ID NO: 919350 - DNA, 25 bp, Mus musculus
ctgctggaagctgtgaccccacaac

SEQ ID NO: 919351 - DNA, 25 bp, Mus musculus
ctgctggaaggagcagcggtcagca

SEQ ID NO: 919352 - DNA, 25 bp, Mus musculus
ctgctggaaggtgtgaccccacaac

SEQ ID NO: 919353 - DNA, 25 bp, Mus musculus
ctgctggacagacgagccaaccccc

SEQ ID NO: 919354 - DNA, 25 bp, Mus musculus
ctgctggacagaggagccaaccccc

SEQ ID NO: 919355 - DNA, 25 bp, Mus musculus
ctgctggacatccagtgccaggagg

SEQ ID NO: 919356 - DNA, 25 bp, Mus musculus
ctgctggacatcgagtgccaggagg

SEQ ID NO: 919357 - DNA, 25 bp, Mus musculus
ctgctggaccaggacgtggtgccca

SEQ ID NO: 919358 - DNA, 25 bp, Mus musculus
ctgctggaccaggaggtggtgccca

SEQ ID NO: 919359 - DNA, 25 bp, Mus musculus
ctgctggactttcgttcagaaaatg

SEQ ID NO: 919360 - DNA, 25 bp, Mus musculus
ctgctggactttggttcagaaaatg

SEQ ID NO: 919361 - DNA, 25 bp, Mus musculus
ctgctggatggggcccagccttgag

SEQ ID NO: 919362 - DNA, 25 bp, Mus musculus
ctgctggatggggcgcagccttgag

SEQ ID NO: 919363 - DNA, 25 bp, Mus musculus
ctgctggcagagaaccaacatggct

SEQ ID NO: 919364 - DNA, 25 bp, Mus musculus
ctgctggcagagaaccaataccaca

SEQ ID NO: 919365 - DNA, 25 bp, Mus musculus
ctgctggcagagaagcaacatggct

SEQ ID NO: 919366 - DNA, 25 bp, Mus musculus
ctgctggcagagaagcaataccaca

SEQ ID NO: 919367 - DNA, 25 bp, Mus musculus
ctgctggcagctaccttggctggag

SEQ ID NO: 919368 - DNA, 25 bp, Mus musculus
ctgctggcaggtaccttggctggag

SEQ ID NO: 919369 - DNA, 25 bp, Mus musculus
ctgctggccgagtccggtctttcat

SEQ ID NO: 919370 - DNA, 25 bp, Mus musculus
ctgctggccgagtcgggtctttcat

SEQ ID NO: 919371 - DNA, 25 bp, Mus musculus
ctgctggccgccattgaatgtccca

SEQ ID NO: 919372 - DNA, 25 bp, Mus musculus
ctgctggccggcattgaatgtccca

SEQ ID NO: 919373 - DNA, 25 bp, Mus musculus
ctgctggcctggagacagtgggaca

SEQ ID NO: 919374 - DNA, 25 bp, Mus musculus
ctgctggcctggatgggacactatg

SEQ ID NO: 919375 - DNA, 25 bp, Mus musculus
ctgctggcctggtgacagtgggaca

SEQ ID NO: 919376 - DNA, 25 bp, Mus musculus
ctgctggcctggttgggacactatg

SEQ ID NO: 919377 - DNA, 25 bp, Mus musculus
ctgctggctcttaacgttcgctatc

SEQ ID NO: 919378 - DNA, 25 bp, Mus musculus
ctgctggctcttaaggttcgctatc

SEQ ID NO: 919379 - DNA, 25 bp, Mus musculus
ctgctggcttctaagtgtgttacag

SEQ ID NO: 919380 - DNA, 25 bp, Mus musculus
ctgctggcttctagtgttacagaag

SEQ ID NO: 919381 - DNA, 25 bp, Mus musculus
ctgctggcttcttagtgtgttacag

SEQ ID NO: 919382 - DNA, 25 bp, Mus musculus
ctgctggcttcttgtgttacagaag

SEQ ID NO: 919383 - DNA, 25 bp, Mus musculus
ctgctgggactcatcatcttccaaa

SEQ ID NO: 919384 - DNA, 25 bp, Mus musculus
ctgctgggactcatgatcttccaaa

SEQ ID NO: 919385 - DNA, 25 bp, Mus musculus
ctgctgggcgctgtctcagcctctc

SEQ ID NO: 919386 - DNA, 25 bp, Mus musculus
ctgctgggcggtgtctcagcctctc

SEQ ID NO: 919387 - DNA, 25 bp, Mus musculus
ctgctgggcttgagtcttccaaaat

SEQ ID NO: 919388 - DNA, 25 bp, Mus musculus
ctgctgggcttgcttcctgcctcaa

SEQ ID NO: 919389 - DNA, 25 bp, Mus musculus
ctgctgggcttggttcctgcctcaa

SEQ ID NO: 919390 - DNA, 25 bp, Mus musculus
ctgctgggcttgtgtcttccaaaat

SEQ ID NO: 919391 - DNA, 25 bp, Mus musculus
ctgctggggacgatcttcacctgcc

SEQ ID NO: 919392 - DNA, 25 bp, Mus musculus
ctgctggggacgttcttcacctgcc

SEQ ID NO: 919393 - DNA, 25 bp, Mus musculus
ctgctgggtgagcccggagccaaag

SEQ ID NO: 919394 - DNA, 25 bp, Mus musculus
ctgctgggtgagccgggagccaaag

SEQ ID NO: 919395 - DNA, 25 bp, Mus musculus
ctgctggtgaacaatgtgtctgatg

SEQ ID NO: 919396 - DNA, 25 bp, Mus musculus
ctgctggtgaactatgtgtctgatg

SEQ ID NO: 919397 - DNA, 25 bp, Mus musculus
ctgctggtgagacgaagctttgtct

SEQ ID NO: 919398 - DNA, 25 bp, Mus musculus
ctgctggtgagaggaagctttgtct

SEQ ID NO: 919399 - DNA, 25 bp, Mus musculus
ctgctggtgcagccttatggagaat

SEQ ID NO: 919400 - DNA, 25 bp, Mus musculus
ctgctggtgcaggcttatggagaat

SEQ ID NO: 919401 - DNA, 25 bp, Mus musculus
ctgctggttgagcccttgagtgcca

SEQ ID NO: 919402 - DNA, 25 bp, Mus musculus
ctgctggttgaggccttgagtgcca

SEQ ID NO: 919403 - DNA, 25 bp, Mus musculus
ctgctgtaccggccagtgcagtctg

SEQ ID NO: 919404 - DNA, 25 bp, Mus musculus
ctgctgtaccgggcagtgcagtctg

SEQ ID NO: 919405 - DNA, 25 bp, Mus musculus
ctgctgtacctaccagtgagaggtc

SEQ ID NO: 919406 - DNA, 25 bp, Mus musculus
ctgctgtacctacctgtgagaggtc

SEQ ID NO: 919407 - DNA, 25 bp, Mus musculus
ctgctgtatacccgtcagctgctgg

SEQ ID NO: 919408 - DNA, 25 bp, Mus musculus
ctgctgtataccctggtcagcctgc

SEQ ID NO: 919409 - DNA, 25 bp, Mus musculus
ctgctgtataccggtcagctgctgg

SEQ ID NO: 919410 - DNA, 25 bp, Mus musculus
ctgctgtataccgtggtcagcctgc

SEQ ID NO: 919411 - DNA, 25 bp, Mus musculus
ctgctgtatgagatggcagctctcc

SEQ ID NO: 919412 - DNA, 25 bp, Mus musculus
ctgctgtatgagttggcagctctcc

SEQ ID NO: 919413 - DNA, 25 bp, Mus musculus
ctgctgtattacccacaggtttttg

SEQ ID NO: 919414 - DNA, 25 bp, Mus musculus
ctgctgtattactcacagatctttg

SEQ ID NO: 919415 - DNA, 25 bp, Mus musculus
ctgctgtatttcccacaggtttttg

SEQ ID NO: 919416 - DNA, 25 bp, Mus musculus
ctgctgtatttctcacagatctttg

SEQ ID NO: 919417 - DNA, 25 bp, Mus musculus
ctgctgtcaaagggagccggtgaag

SEQ ID NO: 919418 - DNA, 25 bp, Mus musculus
ctgctgtcaatgggagccggtgaag

SEQ ID NO: 919419 - DNA, 25 bp, Mus musculus
ctgctgtcactgcggtcactttcct

SEQ ID NO: 919420 - DNA, 25 bp, Mus musculus
ctgctgtcactgctgctcctggctc

SEQ ID NO: 919421 - DNA, 25 bp, Mus musculus
ctgctgtcactggggtcactttcct

SEQ ID NO: 919422 - DNA, 25 bp, Mus musculus
ctgctgtcactggtgctcctggctc

SEQ ID NO: 919423 - DNA, 25 bp, Mus musculus
ctgctgtccacacgtccacggtgtg

SEQ ID NO: 919424 - DNA, 25 bp, Mus musculus
ctgctgtccacaggtccacggtgtg

SEQ ID NO: 919425 - DNA, 25 bp, Mus musculus
ctgctgtcccagctgctcctggtca

SEQ ID NO: 919426 - DNA, 25 bp, Mus musculus
ctgctgtcccaggtgctcctggtca

SEQ ID NO: 919427 - DNA, 25 bp, Mus musculus
ctgctgtcctgacgattcggccctt

SEQ ID NO: 919428 - DNA, 25 bp, Mus musculus
ctgctgtcctgaggattcggccctt

SEQ ID NO: 919429 - DNA, 25 bp, Mus musculus
ctgctgtctcagatcttcaactttt

SEQ ID NO: 919430 - DNA, 25 bp, Mus musculus
ctgctgtctcagttcttcaactttt

SEQ ID NO: 919431 - DNA, 25 bp, Mus musculus
ctgctgtgaaatcttctattccaag

SEQ ID NO: 919432 - DNA, 25 bp, Mus musculus
ctgctgtgaaatgttctattccaag

SEQ ID NO: 919433 - DNA, 25 bp, Mus musculus
ctgctgtggaagcgactccccggag

SEQ ID NO: 919434 - DNA, 25 bp, Mus musculus
ctgctgtggaagggactccccggag

SEQ ID NO: 919435 - DNA, 25 bp, Mus musculus
ctgctgtgtgcacgtgtgcggcgct

SEQ ID NO: 919436 - DNA, 25 bp, Mus musculus
ctgctgtgtgcaggtgtgcggcgct

SEQ ID NO: 919437 - DNA, 25 bp, Mus musculus
ctgctgtgttatctttttctactcg

SEQ ID NO: 919438 - DNA, 25 bp, Mus musculus
ctgctgtgttatgtttttctactcg

SEQ ID NO: 919439 - DNA, 25 bp, Mus musculus
ctgctgttgctccgtgcgggcgagt

SEQ ID NO: 919440 - DNA, 25 bp, Mus musculus
ctgctgttgctcggtgcgggcgagt

SEQ ID NO: 919441 - DNA, 25 bp, Mus musculus
ctgctgtttgcttttgcagacaggc

SEQ ID NO: 919442 - DNA, 25 bp, Mus musculus
ctgctgtttggttttgcagacaggc

SEQ ID NO: 919443 - DNA, 25 bp, Mus musculus
ctgcttaaacaacgtgattctgctg

SEQ ID NO: 919444 - DNA, 25 bp, Mus musculus
ctgcttaaacaaggtgattctgctg

SEQ ID NO: 919445 - DNA, 25 bp, Mus musculus
ctgcttaaagcacttggactcgagt

SEQ ID NO: 919446 - DNA, 25 bp, Mus musculus
ctgcttaaaggacttggactcgagt

SEQ ID NO: 919447 - DNA, 25 bp, Mus musculus
ctgcttaatccgatcagtgtcttta

SEQ ID NO: 919448 - DNA, 25 bp, Mus musculus
ctgcttaatccgttcagtgtcttta

SEQ ID NO: 919449 - DNA, 25 bp, Mus musculus
ctgcttacagcaagccgagataccc

SEQ ID NO: 919450 - DNA, 25 bp, Mus musculus
ctgcttacaggaagccgagataccc

SEQ ID NO: 919451 - DNA, 25 bp, Mus musculus
ctgcttaccgctatgacccatatgg

SEQ ID NO: 919452 - DNA, 25 bp, Mus musculus
ctgcttaccggtatgacccatatgg

SEQ ID NO: 919453 - DNA, 25 bp, Mus musculus
ctgcttactgagaaactcaagccag

SEQ ID NO: 919454 - DNA, 25 bp, Mus musculus
ctgcttactgagtaactcaagccag

SEQ ID NO: 919455 - DNA, 25 bp, Mus musculus
ctgcttagagccctcgaggcgcgga

SEQ ID NO: 919456 - DNA, 25 bp, Mus musculus
ctgcttagagccctggaggcgcgga

SEQ ID NO: 919457 - DNA, 25 bp, Mus musculus
ctgcttcaagagccttggctttctg

SEQ ID NO: 919458 - DNA, 25 bp, Mus musculus
ctgcttcaagaggcttggctttctg

SEQ ID NO: 919459 - DNA, 25 bp, Mus musculus
ctgcttcaagcacaccacccccgac

SEQ ID NO: 919460 - DNA, 25 bp, Mus musculus
ctgcttcaagcaccatgattgggct

SEQ ID NO: 919461 - DNA, 25 bp, Mus musculus
ctgcttcaagcaccgttccacgcct

SEQ ID NO: 919462 - DNA, 25 bp, Mus musculus
ctgcttcaagcactgtggcattgtc

SEQ ID NO: 919463 - DNA, 25 bp, Mus musculus
ctgcttcaagcagcatgattgggct

SEQ ID NO: 919464 - DNA, 25 bp, Mus musculus
ctgcttcaagcagcgttccacgcct

SEQ ID NO: 919465 - DNA, 25 bp, Mus musculus
ctgcttcaagcagtgtggcattgtc

SEQ ID NO: 919466 - DNA, 25 bp, Mus musculus
ctgcttcaaggacaccacccccgac

SEQ ID NO: 919467 - DNA, 25 bp, Mus musculus
ctgcttcatgagatccaaattcaac

SEQ ID NO: 919468 - DNA, 25 bp, Mus musculus
ctgcttcatgagatgcaaattcaac

SEQ ID NO: 919469 - DNA, 25 bp, Mus musculus
ctgcttccaattagccaataataaa

SEQ ID NO: 919470 - DNA, 25 bp, Mus musculus
ctgcttccaatttgccaataataaa

SEQ ID NO: 919471 - DNA, 25 bp, Mus musculus
ctgcttccacagcccgagagtcaaa

SEQ ID NO: 919472 - DNA, 25 bp, Mus musculus
ctgcttccacagccggagagtcaaa

SEQ ID NO: 919473 - DNA, 25 bp, Mus musculus
ctgcttccagccttttatttgtggg

SEQ ID NO: 919474 - DNA, 25 bp, Mus musculus
ctgcttccaggcttttatttgtggg

SEQ ID NO: 919475 - DNA, 25 bp, Mus musculus
ctgcttctcccacgtgccgtggagt

SEQ ID NO: 919476 - DNA, 25 bp, Mus musculus
ctgcttctcccaggtgccgtggagt

SEQ ID NO: 919477 - DNA, 25 bp, Mus musculus
ctgcttctcgcttcagcatgggctc

SEQ ID NO: 919478 - DNA, 25 bp, Mus musculus
ctgcttctcggttcagcatgggctc

SEQ ID NO: 919479 - DNA, 25 bp, Mus musculus
ctgcttctgctcccctccccattca

SEQ ID NO: 919480 - DNA, 25 bp, Mus musculus
ctgcttctgctcgcctccccattca

SEQ ID NO: 919481 - DNA, 25 bp, Mus musculus
ctgcttctggatttatttattatta

SEQ ID NO: 919482 - DNA, 25 bp, Mus musculus
ctgcttctggctgccggtgaatccg

SEQ ID NO: 919483 - DNA, 25 bp, Mus musculus
ctgcttctggctggccggcctggct

SEQ ID NO: 919484 - DNA, 25 bp, Mus musculus
ctgcttctgggtgccggtgaatccg

SEQ ID NO: 919485 - DNA, 25 bp, Mus musculus
ctgcttctgggtggccggcctggct

SEQ ID NO: 919486 - DNA, 25 bp, Mus musculus
ctgcttctggttttatttattatta

SEQ ID NO: 919487 - DNA, 25 bp, Mus musculus
ctgcttcttcagagctctgcagtcc

SEQ ID NO: 919488 - DNA, 25 bp, Mus musculus
ctgcttcttcagtgctctgcagtcc

SEQ ID NO: 919489 - DNA, 25 bp, Mus musculus
ctgcttgaaaagacactgagtcctc

SEQ ID NO: 919490 - DNA, 25 bp, Mus musculus
ctgcttgaaaagtcactgagtcctc

SEQ ID NO: 919491 - DNA, 25 bp, Mus musculus
ctgcttgaccagctgttcttccagg

SEQ ID NO: 919492 - DNA, 25 bp, Mus musculus
ctgcttgaccaggtgttcttccagg

SEQ ID NO: 919493 - DNA, 25 bp, Mus musculus
ctgcttggattacacgtgaccagga

SEQ ID NO: 919494 - DNA, 25 bp, Mus musculus
ctgcttggattacacgtggtgctct

SEQ ID NO: 919495 - DNA, 25 bp, Mus musculus
ctgcttggattacaggtgaccagga

SEQ ID NO: 919496 - DNA, 25 bp, Mus musculus
ctgcttggattacaggtggtgctct

SEQ ID NO: 919497 - DNA, 25 bp, Mus musculus
ctgcttgtagcagacttatgacgcc

SEQ ID NO: 919498 - DNA, 25 bp, Mus musculus
ctgcttgtaggagacttatgacgcc

SEQ ID NO: 919499 - DNA, 25 bp, Mus musculus
ctgctttacgagctgctgaatgggc

SEQ ID NO: 919500 - DNA, 25 bp, Mus musculus
ctgctttacgaggtgctgaatgggc

SEQ ID NO: 919501 - DNA, 25 bp, Mus musculus
ctgctttcagatcacaacctgcaag

SEQ ID NO: 919502 - DNA, 25 bp, Mus musculus
ctgctttcagatcagaacctgcaag

SEQ ID NO: 919503 - DNA, 25 bp, Mus musculus
ctgctttcctggaaaattgttgtgt

SEQ ID NO: 919504 - DNA, 25 bp, Mus musculus
ctgctttcctggaatattgttgtgt

SEQ ID NO: 919505 - DNA, 25 bp, Mus musculus
ctgctttctgctcccaccagcagag

SEQ ID NO: 919506 - DNA, 25 bp, Mus musculus
ctgctttctggtcccaccagcagag

SEQ ID NO: 919507 - DNA, 25 bp, Mus musculus
ctgcttttagcccacatagtcgcca

SEQ ID NO: 919508 - DNA, 25 bp, Mus musculus
ctgcttttagcccagatagtcgcca

SEQ ID NO: 919509 - DNA, 25 bp, Mus musculus
ctgctttttgcagaggacgacctag

SEQ ID NO: 919510 - DNA, 25 bp, Mus musculus
ctgctttttggagaggacgacctag

SEQ ID NO: 919511 - DNA, 25 bp, Mus musculus
ctggaaaaagcacaggtgcagtcag

SEQ ID NO: 919512 - DNA, 25 bp, Mus musculus
ctggaaaaagcataggtgcggtcag

SEQ ID NO: 919513 - DNA, 25 bp, Mus musculus
ctggaaaaaggacaggtgcagtcag

SEQ ID NO: 919514 - DNA, 25 bp, Mus musculus
ctggaaaaaggataggtgcggtcag

SEQ ID NO: 919515 - DNA, 25 bp, Mus musculus
ctggaaaagcatatcttttccagtt

SEQ ID NO: 919516 - DNA, 25 bp, Mus musculus
ctggaaaagcatttcttttccagtt

SEQ ID NO: 919517 - DNA, 25 bp, Mus musculus
ctggaaaagcgacctgggagaacag

SEQ ID NO: 919518 - DNA, 25 bp, Mus musculus
ctggaaaagcgacgccttggaacag

SEQ ID NO: 919519 - DNA, 25 bp, Mus musculus
ctggaaaagcgagctgggagaacag

SEQ ID NO: 919520 - DNA, 25 bp, Mus musculus
ctggaaaagcgaggccttggaacag

SEQ ID NO: 919521 - DNA, 25 bp, Mus musculus
ctggaaaatccacacagtttatcag

SEQ ID NO: 919522 - DNA, 25 bp, Mus musculus
ctggaaaatccacagagtttatcag

SEQ ID NO: 919523 - DNA, 25 bp, Mus musculus
ctggaaacggatttaggcaagtcaa

SEQ ID NO: 919524 - DNA, 25 bp, Mus musculus
ctggaaacggattttggcaagtcaa

SEQ ID NO: 919525 - DNA, 25 bp, Mus musculus
ctggaaaggaagaggagccgctgct

SEQ ID NO: 919526 - DNA, 25 bp, Mus musculus
ctggaaaggaagtggagccgctgct

SEQ ID NO: 919527 - DNA, 25 bp, Mus musculus
ctggaaagtgagatacatgaacatg

SEQ ID NO: 919528 - DNA, 25 bp, Mus musculus
ctggaaagtgagttacatgaacatg

SEQ ID NO: 919529 - DNA, 25 bp, Mus musculus
ctggaaataccgtacatgggtacag

SEQ ID NO: 919530 - DNA, 25 bp, Mus musculus
ctggaaataccgtagatgggtacag

SEQ ID NO: 919531 - DNA, 25 bp, Mus musculus
ctggaaattaaacgatgaaggtctt

SEQ ID NO: 919532 - DNA, 25 bp, Mus musculus
ctggaaattaaaggatgaaggtctt

SEQ ID NO: 919533 - DNA, 25 bp, Mus musculus
ctggaaatttcacgatcattgggac

SEQ ID NO: 919534 - DNA, 25 bp, Mus musculus
ctggaaatttcaggatcattgggac

SEQ ID NO: 919535 - DNA, 25 bp, Mus musculus
ctggaacaacccccaatactggagt

SEQ ID NO: 919536 - DNA, 25 bp, Mus musculus
ctggaacaacccgcaatactggagt

SEQ ID NO: 919537 - DNA, 25 bp, Mus musculus
ctggaacaagaacgtcaacatttat

SEQ ID NO: 919538 - DNA, 25 bp, Mus musculus
ctggaacaagagctagtatggctct

SEQ ID NO: 919539 - DNA, 25 bp, Mus musculus
ctggaacaagaggtagtatggctct

SEQ ID NO: 919540 - DNA, 25 bp, Mus musculus
ctggaacaagtacgtcaacatttat

SEQ ID NO: 919541 - DNA, 25 bp, Mus musculus
ctggaacatgagagcgccaagggtg

SEQ ID NO: 919542 - DNA, 25 bp, Mus musculus
ctggaacatgagtgcgccaagggtg

SEQ ID NO: 919543 - DNA, 25 bp, Mus musculus
ctggaacgtgcctgacgtggttatc

SEQ ID NO: 919544 - DNA, 25 bp, Mus musculus
ctggaacgtggctgacgtggttatc

SEQ ID NO: 919545 - DNA, 25 bp, Mus musculus
ctggaagaagcggaaagctatgtct

SEQ ID NO: 919546 - DNA, 25 bp, Mus musculus
ctggaagaaggggaaagctatgtct

SEQ ID NO: 919547 - DNA, 25 bp, Mus musculus
ctggaagacaagctggttccatcaa

SEQ ID NO: 919548 - DNA, 25 bp, Mus musculus
ctggaagacaaggtggttccatcaa

SEQ ID NO: 919549 - DNA, 25 bp, Mus musculus
ctggaagatcttgtcgtcaagagca

SEQ ID NO: 919550 - DNA, 25 bp, Mus musculus
ctggaagatcttgtggtcaagagca

SEQ ID NO: 919551 - DNA, 25 bp, Mus musculus
ctggaagcaagacgttgcagaattc

SEQ ID NO: 919552 - DNA, 25 bp, Mus musculus
ctggaagcaagaggttgcagaattc

SEQ ID NO: 919553 - DNA, 25 bp, Mus musculus
ctggaagcaccaccactattgtcaa

SEQ ID NO: 919554 - DNA, 25 bp, Mus musculus
ctggaagcaccacctctattgtcaa

SEQ ID NO: 919555 - DNA, 25 bp, Mus musculus
ctggaagcagcacaacaatcctctc

SEQ ID NO: 919556 - DNA, 25 bp, Mus musculus
ctggaagcaggacaacaatcctctc

SEQ ID NO: 919557 - DNA, 25 bp, Mus musculus
ctggaagccctccatgccaattctc

SEQ ID NO: 919558 - DNA, 25 bp, Mus musculus
ctggaagccctcgatgccaattctc

SEQ ID NO: 919559 - DNA, 25 bp, Mus musculus
ctggaagctctggaccttttgggca

SEQ ID NO: 919560 - DNA, 25 bp, Mus musculus
ctggaagctctggagcttttgggca

SEQ ID NO: 919561 - DNA, 25 bp, Mus musculus
ctggaaggaactatgctgttggctg

SEQ ID NO: 919562 - DNA, 25 bp, Mus musculus
ctggaaggaactttgctgttggctg

SEQ ID NO: 919563 - DNA, 25 bp, Mus musculus
ctggaaggacagccctcagttcctg

SEQ ID NO: 919564 - DNA, 25 bp, Mus musculus
ctggaaggacaggcctcagttcctg

SEQ ID NO: 919565 - DNA, 25 bp, Mus musculus
ctggaaggagcaagatgggctcctg

SEQ ID NO: 919566 - DNA, 25 bp, Mus musculus
ctggaaggaggaagatgggctcctg

SEQ ID NO: 919567 - DNA, 25 bp, Mus musculus
ctggaaggagtgagaaggaagaggc

SEQ ID NO: 919568 - DNA, 25 bp, Mus musculus
ctggaaggagtgtgaaggaagaggc

SEQ ID NO: 919569 - DNA, 25 bp, Mus musculus
ctggaagggaagcatgcacaggcca

SEQ ID NO: 919570 - DNA, 25 bp, Mus musculus
ctggaagggaaggatgcacaggcca

SEQ ID NO: 919571 - DNA, 25 bp, Mus musculus
ctggaaggtccacagaaggcaagct

SEQ ID NO: 919572 - DNA, 25 bp, Mus musculus
ctggaaggtccacgacctcagacaa

SEQ ID NO: 919573 - DNA, 25 bp, Mus musculus
ctggaaggtccagagaaggcaagct

SEQ ID NO: 919574 - DNA, 25 bp, Mus musculus
ctggaaggtccaggacctcagacaa

SEQ ID NO: 919575 - DNA, 25 bp, Mus musculus
ctggaaggtccccgagcatgcaaaa

SEQ ID NO: 919576 - DNA, 25 bp, Mus musculus
ctggaaggtccccgattgaaaagat

SEQ ID NO: 919577 - DNA, 25 bp, Mus musculus
ctggaaggtcccggagcatgcaaaa

SEQ ID NO: 919578 - DNA, 25 bp, Mus musculus
ctggaaggtcccggattgaaaagat

SEQ ID NO: 919579 - DNA, 25 bp, Mus musculus
ctggaaggttctcgccctaaagagc

SEQ ID NO: 919580 - DNA, 25 bp, Mus musculus
ctggaaggttctggccctaaagagc

SEQ ID NO: 919581 - DNA, 25 bp, Mus musculus
ctggaagtctgccacatctctggct

SEQ ID NO: 919582 - DNA, 25 bp, Mus musculus
ctggaagtctgccagatctctggct

SEQ ID NO: 919583 - DNA, 25 bp, Mus musculus
ctggaagtgaagaacccagattcca

SEQ ID NO: 919584 - DNA, 25 bp, Mus musculus
ctggaagtgaagccctgaaccaaaa

SEQ ID NO: 919585 - DNA, 25 bp, Mus musculus
ctggaagtgaaggcctgaaccaaaa

SEQ ID NO: 919586 - DNA, 25 bp, Mus musculus
ctggaagtgaagtacccagattcca

SEQ ID NO: 919587 - DNA, 25 bp, Mus musculus
ctggaagtggagctttttgcaagaa

SEQ ID NO: 919588 - DNA, 25 bp, Mus musculus
ctggaagtggaggtttttgcaagaa

SEQ ID NO: 919589 - DNA, 25 bp, Mus musculus
ctggaatcacagcccaactactgta

SEQ ID NO: 919590 - DNA, 25 bp, Mus musculus
ctggaatcacaggccaactactgta

SEQ ID NO: 919591 - DNA, 25 bp, Mus musculus
ctggaatcacctggtagatgcaaga

SEQ ID NO: 919592 - DNA, 25 bp, Mus musculus
ctggaatcacgtggtagatgcaaga

SEQ ID NO: 919593 - DNA, 25 bp, Mus musculus
ctggaatcactgcgttatcattgtg

SEQ ID NO: 919594 - DNA, 25 bp, Mus musculus
ctggaatcactgggttatcattgtg

SEQ ID NO: 919595 - DNA, 25 bp, Mus musculus
ctggaatcggaacgcaggagagtat

SEQ ID NO: 919596 - DNA, 25 bp, Mus musculus
ctggaatcggaaggcaggagagtat

SEQ ID NO: 919597 - DNA, 25 bp, Mus musculus
ctggaatgatggcgctatcctgggt

SEQ ID NO: 919598 - DNA, 25 bp, Mus musculus
ctggaatgatggggctatcctgggt

SEQ ID NO: 919599 - DNA, 25 bp, Mus musculus
ctggaattacagcgatcgcttacac

SEQ ID NO: 919600 - DNA, 25 bp, Mus musculus
ctggaattacagggatcgcttacac

SEQ ID NO: 919601 - DNA, 25 bp, Mus musculus
ctggacaacgagcgagtggtgacgt

SEQ ID NO: 919602 - DNA, 25 bp, Mus musculus
ctggacaacgagcgagttgggatgg

SEQ ID NO: 919603 - DNA, 25 bp, Mus musculus
ctggacaacgagcgtgtggtgacgt

SEQ ID NO: 919604 - DNA, 25 bp, Mus musculus
ctggacaacgagcgtgttgggatgg

SEQ ID NO: 919605 - DNA, 25 bp, Mus musculus
ctggacaacttgcgctacagaacag

SEQ ID NO: 919606 - DNA, 25 bp, Mus musculus
ctggacaacttgggctacagaacag

SEQ ID NO: 919607 - DNA, 25 bp, Mus musculus
ctggacaagatgctggaccagacta

SEQ ID NO: 919608 - DNA, 25 bp, Mus musculus
ctggacaagatggtggaccagacta

SEQ ID NO: 919609 - DNA, 25 bp, Mus musculus
ctggacaatcagagggcactgctgg

SEQ ID NO: 919610 - DNA, 25 bp, Mus musculus
ctggacaatcagtgggcactgctgg

SEQ ID NO: 919611 - DNA, 25 bp, Mus musculus
ctggacaatgaaaacgtatccaacg

SEQ ID NO: 919612 - DNA, 25 bp, Mus musculus
ctggacaatgaaaaggtatccaacg

SEQ ID NO: 919613 - DNA, 25 bp, Mus musculus
ctggacaattaccgtgcccgagggc

SEQ ID NO: 919614 - DNA, 25 bp, Mus musculus
ctggacaattacggtgcccgagggc

SEQ ID NO: 919615 - DNA, 25 bp, Mus musculus
ctggacaatttacgctacagaacag

SEQ ID NO: 919616 - DNA, 25 bp, Mus musculus
ctggacaatttaggctacagaacag

SEQ ID NO: 919617 - DNA, 25 bp, Mus musculus
ctggacaccacacagctccttggta

SEQ ID NO: 919618 - DNA, 25 bp, Mus musculus
ctggacaccacacgaaagaatgttt

SEQ ID NO: 919619 - DNA, 25 bp, Mus musculus
ctggacaccacagagctccttggta

SEQ ID NO: 919620 - DNA, 25 bp, Mus musculus
ctggacaccacaggaaagaatgttt

SEQ ID NO: 919621 - DNA, 25 bp, Mus musculus
ctggacactggtcacgtgaagtaaa

SEQ ID NO: 919622 - DNA, 25 bp, Mus musculus
ctggacactggtcaggtgaagtaaa

SEQ ID NO: 919623 - DNA, 25 bp, Mus musculus
ctggacagagagataattgacaagt

SEQ ID NO: 919624 - DNA, 25 bp, Mus musculus
ctggacagagagttaattgacaagt

SEQ ID NO: 919625 - DNA, 25 bp, Mus musculus
ctggacagagcagccaacccccttc

SEQ ID NO: 919626 - DNA, 25 bp, Mus musculus
ctggacagagcagtgtgacaatctc

SEQ ID NO: 919627 - DNA, 25 bp, Mus musculus
ctggacagagctcttacagaacatt

SEQ ID NO: 919628 - DNA, 25 bp, Mus musculus
ctggacagagctgttacagaacatt

SEQ ID NO: 919629 - DNA, 25 bp, Mus musculus
ctggacagaggagccaacccccttc

SEQ ID NO: 919630 - DNA, 25 bp, Mus musculus
ctggacagaggagtgtgacaatctc

SEQ ID NO: 919631 - DNA, 25 bp, Mus musculus
ctggacagccagattgttgaagtcg

SEQ ID NO: 919632 - DNA, 25 bp, Mus musculus
ctggacagccagtttgttgaagtcg

SEQ ID NO: 919633 - DNA, 25 bp, Mus musculus
ctggacatcgtacgagtgccaggag

SEQ ID NO: 919634 - DNA, 25 bp, Mus musculus
ctggacatcgtaggagtgccaggag

SEQ ID NO: 919635 - DNA, 25 bp, Mus musculus
ctggacattgagacactgacatgga

SEQ ID NO: 919636 - DNA, 25 bp, Mus musculus
ctggacattgtgacactgacatgga

SEQ ID NO: 919637 - DNA, 25 bp, Mus musculus
ctggaccaacctatagaggaccagt

SEQ ID NO: 919638 - DNA, 25 bp, Mus musculus
ctggaccaacgtatagaggaccagt

SEQ ID NO: 919639 - DNA, 25 bp, Mus musculus
ctggaccaagctgcttcacctgggg

SEQ ID NO: 919640 - DNA, 25 bp, Mus musculus
ctggaccaaggtgcttcacctgggg

SEQ ID NO: 919641 - DNA, 25 bp, Mus musculus
ctggaccacgagagtctcgggaatg

SEQ ID NO: 919642 - DNA, 25 bp, Mus musculus
ctggaccacgagtgtctcgggaatg

SEQ ID NO: 919643 - DNA, 25 bp, Mus musculus
ctggaccaggagctggtgcccacag

SEQ ID NO: 919644 - DNA, 25 bp, Mus musculus
ctggaccaggaggtggtgcccacag

SEQ ID NO: 919645 - DNA, 25 bp, Mus musculus
ctggaccagggacacactcactctg

SEQ ID NO: 919646 - DNA, 25 bp, Mus musculus
ctggaccagggacagactcactctg

SEQ ID NO: 919647 - DNA, 25 bp, Mus musculus
ctggaccccccacaccaggtggtgt

SEQ ID NO: 919648 - DNA, 25 bp, Mus musculus
ctggaccccccagaccaggtggtgt

SEQ ID NO: 919649 - DNA, 25 bp, Mus musculus
ctggacctacaacaccacctctgca

SEQ ID NO: 919650 - DNA, 25 bp, Mus musculus
ctggacctacaagaccacctctgca

SEQ ID NO: 919651 - DNA, 25 bp, Mus musculus
ctggacctagcacgcttacagttcc

SEQ ID NO: 919652 - DNA, 25 bp, Mus musculus
ctggacctagcaggcttacagttcc

SEQ ID NO: 919653 - DNA, 25 bp, Mus musculus
ctggacctcggacaacttccaggtc

SEQ ID NO: 919654 - DNA, 25 bp, Mus musculus
ctggacctcggacccacagagatcc

SEQ ID NO: 919655 - DNA, 25 bp, Mus musculus
ctggacctcggacctgcccagaccc

SEQ ID NO: 919656 - DNA, 25 bp, Mus musculus
ctggacctcggacggatgactcgag

SEQ ID NO: 919657 - DNA, 25 bp, Mus musculus
ctggacctcggagaacttccaggtc

SEQ ID NO: 919658 - DNA, 25 bp, Mus musculus
ctggacctcggagccacagagatcc

SEQ ID NO: 919659 - DNA, 25 bp, Mus musculus
ctggacctcggagctgcccagaccc

SEQ ID NO: 919660 - DNA, 25 bp, Mus musculus
ctggacctcggagggatgactcgag

SEQ ID NO: 919661 - DNA, 25 bp, Mus musculus
ctggacctgcccagcggtggagctg

SEQ ID NO: 919662 - DNA, 25 bp, Mus musculus
ctggacctgcccaggggtggagctg

SEQ ID NO: 919663 - DNA, 25 bp, Mus musculus
ctggacctggctgcaggtcctggtg

SEQ ID NO: 919664 - DNA, 25 bp, Mus musculus
ctggacctgggaaacaatatctatc

SEQ ID NO: 919665 - DNA, 25 bp, Mus musculus
ctggacctgggaaagaatatctatc

SEQ ID NO: 919666 - DNA, 25 bp, Mus musculus
ctggacctgggtgcaggtcctggtg

SEQ ID NO: 919667 - DNA, 25 bp, Mus musculus
ctggacgagattgacataatcaatc

SEQ ID NO: 919668 - DNA, 25 bp, Mus musculus
ctggacgagattgagataatcaatc

SEQ ID NO: 919669 - DNA, 25 bp, Mus musculus
ctggacgatgaccccagcgcagcac

SEQ ID NO: 919670 - DNA, 25 bp, Mus musculus
ctggacgatgtccccagcgcagcac

SEQ ID NO: 919671 - DNA, 25 bp, Mus musculus
ctggacgcacagccctcctgtgcca

SEQ ID NO: 919672 - DNA, 25 bp, Mus musculus
ctggacgcacaggcctcctgtgcca

SEQ ID NO: 919673 - DNA, 25 bp, Mus musculus
ctggacgccaagcgtcatggagtcc

SEQ ID NO: 919674 - DNA, 25 bp, Mus musculus
ctggacgccaagggtcatggagtcc

SEQ ID NO: 919675 - DNA, 25 bp, Mus musculus
ctggacgtgctgcagcaacgactgc

SEQ ID NO: 919676 - DNA, 25 bp, Mus musculus
ctggacgtgctggagcaacgactgc

SEQ ID NO: 919677 - DNA, 25 bp, Mus musculus
ctggacgttgagtgtggaaaatgct

SEQ ID NO: 919678 - DNA, 25 bp, Mus musculus
ctggacgttgtgtgtggaaaatgct

SEQ ID NO: 919679 - DNA, 25 bp, Mus musculus
ctggactaaggaacaccactacttt

SEQ ID NO: 919680 - DNA, 25 bp, Mus musculus
ctggactaaggatcaccactacttt

SEQ ID NO: 919681 - DNA, 25 bp, Mus musculus
ctggactctcagaacctcagtgcat

SEQ ID NO: 919682 - DNA, 25 bp, Mus musculus
ctggactctcagtacctcagtgcat

SEQ ID NO: 919683 - DNA, 25 bp, Mus musculus
ctggactgctgtcaatgggagccgg

SEQ ID NO: 919684 - DNA, 25 bp, Mus musculus
ctggactgctgtcattgggagccgg

SEQ ID NO: 919685 - DNA, 25 bp, Mus musculus
ctggactggaagaggcatctgtggt

SEQ ID NO: 919686 - DNA, 25 bp, Mus musculus
ctggactggaagtggcatctgtggt

SEQ ID NO: 919687 - DNA, 25 bp, Mus musculus
ctggacttcaagcagaatccggagc

SEQ ID NO: 919688 - DNA, 25 bp, Mus musculus
ctggacttcaaggagaatccggagc

SEQ ID NO: 919689 - DNA, 25 bp, Mus musculus
ctggacttgctgtacgttatgatga

SEQ ID NO: 919690 - DNA, 25 bp, Mus musculus
ctggacttgctgtaggttatgatga

SEQ ID NO: 919691 - DNA, 25 bp, Mus musculus
ctggacttggggcgacgtatgtgat

SEQ ID NO: 919692 - DNA, 25 bp, Mus musculus
ctggacttggggggacgtatgtgat

SEQ ID NO: 919693 - DNA, 25 bp, Mus musculus
ctggactttcccaaactgccctact

SEQ ID NO: 919694 - DNA, 25 bp, Mus musculus
ctggactttcccaatctgccctact

SEQ ID NO: 919695 - DNA, 25 bp, Mus musculus
ctggactttcccttagagaaggaga

SEQ ID NO: 919696 - DNA, 25 bp, Mus musculus
ctggactttcctaacctgccctact

SEQ ID NO: 919697 - DNA, 25 bp, Mus musculus
ctggactttcctaagctgccctact

SEQ ID NO: 919698 - DNA, 25 bp, Mus musculus
ctggactttcgcttagagaaggaga

SEQ ID NO: 919699 - DNA, 25 bp, Mus musculus
ctggactttgcttcagaaaatgcct

SEQ ID NO: 919700 - DNA, 25 bp, Mus musculus
ctggactttggttcagaaaatgcct

SEQ ID NO: 919701 - DNA, 25 bp, Mus musculus
ctggagaaagagcctgccactcgct

SEQ ID NO: 919702 - DNA, 25 bp, Mus musculus
ctggagaaagagctggaggtgattg

SEQ ID NO: 919703 - DNA, 25 bp, Mus musculus
ctggagaaagaggctgccactcgct

SEQ ID NO: 919704 - DNA, 25 bp, Mus musculus
ctggagaaagaggtggaggtgattg

SEQ ID NO: 919705 - DNA, 25 bp, Mus musculus
ctggagaaagagtttgagaggaccc

SEQ ID NO: 919706 - DNA, 25 bp, Mus musculus
ctggagaaagtgtttgagaggaccc

SEQ ID NO: 919707 - DNA, 25 bp, Mus musculus
ctggagaataagctttgtgagatga

SEQ ID NO: 919708 - DNA, 25 bp, Mus musculus
ctggagaataaggtttgtgagatga

SEQ ID NO: 919709 - DNA, 25 bp, Mus musculus
ctggagaatgatgtctctaatggat

SEQ ID NO: 919710 - DNA, 25 bp, Mus musculus
ctggagaatgatgtgtctaatggat

SEQ ID NO: 919711 - DNA, 25 bp, Mus musculus
ctggagacaaaacgcatggagtacc

SEQ ID NO: 919712 - DNA, 25 bp, Mus musculus
ctggagacaatacgcatggagtacc

SEQ ID NO: 919713 - DNA, 25 bp, Mus musculus
ctggagacagcacgcacaccaagat

SEQ ID NO: 919714 - DNA, 25 bp, Mus musculus
ctggagacagcaggcacaccaagat

SEQ ID NO: 919715 - DNA, 25 bp, Mus musculus
ctggagacggaaaactgtcattggt

SEQ ID NO: 919716 - DNA, 25 bp, Mus musculus
ctggagacggaaaagtgtcattggt

SEQ ID NO: 919717 - DNA, 25 bp, Mus musculus
ctggagagactgctcactcgatacc

SEQ ID NO: 919718 - DNA, 25 bp, Mus musculus
ctggagagactgctgactcgatacc

SEQ ID NO: 919719 - DNA, 25 bp, Mus musculus
ctggagagatcacttgagacccagg

SEQ ID NO: 919720 - DNA, 25 bp, Mus musculus
ctggagagatcagttgagacccagg

SEQ ID NO: 919721 - DNA, 25 bp, Mus musculus
ctggagagcgctcacgtgcagagat

SEQ ID NO: 919722 - DNA, 25 bp, Mus musculus
ctggagagcgctcaggtgcagagat

SEQ ID NO: 919723 - DNA, 25 bp, Mus musculus
ctggagatagaactgtttctcaaca

SEQ ID NO: 919724 - DNA, 25 bp, Mus musculus
ctggagatagtactgtttctcaaca

SEQ ID NO: 919725 - DNA, 25 bp, Mus musculus
ctggagatcaaaatcgctcgcgctg

SEQ ID NO: 919726 - DNA, 25 bp, Mus musculus
ctggagatcaaaatggctcgcgctg

SEQ ID NO: 919727 - DNA, 25 bp, Mus musculus
ctggagatcaggaggcgccagctga

SEQ ID NO: 919728 - DNA, 25 bp, Mus musculus
ctggagatcaggatcaatgctccct

SEQ ID NO: 919729 - DNA, 25 bp, Mus musculus
ctggagatcaggtggcgccagctga

SEQ ID NO: 919730 - DNA, 25 bp, Mus musculus
ctggagatcaggttcaatgctccct

SEQ ID NO: 919731 - DNA, 25 bp, Mus musculus
ctggagcaacaactgaagaagaagc

SEQ ID NO: 919732 - DNA, 25 bp, Mus musculus
ctggagcaacaagtgaagaagaagc

SEQ ID NO: 919733 - DNA, 25 bp, Mus musculus
ctggagcagaagacaaaagaaattg

SEQ ID NO: 919734 - DNA, 25 bp, Mus musculus
ctggagcagaagcttatgttcttgc

SEQ ID NO: 919735 - DNA, 25 bp, Mus musculus
ctggagcagaaggttatgttcttgc

SEQ ID NO: 919736 - DNA, 25 bp, Mus musculus
ctggagcagaagtcaaaagaaattg

SEQ ID NO: 919737 - DNA, 25 bp, Mus musculus
ctggagcagtgggacaaagatgatg

SEQ ID NO: 919738 - DNA, 25 bp, Mus musculus
ctggagcagtgggagaaagatgatg

SEQ ID NO: 919739 - DNA, 25 bp, Mus musculus
ctggagccacaaactcctgcttcct

SEQ ID NO: 919740 - DNA, 25 bp, Mus musculus
ctggagccacaaattgcggttgcca

SEQ ID NO: 919741 - DNA, 25 bp, Mus musculus
ctggagccacaatctcctgcttcct

SEQ ID NO: 919742 - DNA, 25 bp, Mus musculus
ctggagccacaatttgcggttgcca

SEQ ID NO: 919743 - DNA, 25 bp, Mus musculus
ctggagccaccccaaatctgccatc

SEQ ID NO: 919744 - DNA, 25 bp, Mus musculus
ctggagccacgccaaatctgccatc

SEQ ID NO: 919745 - DNA, 25 bp, Mus musculus
ctggagcccaatcaagtccgactgg

SEQ ID NO: 919746 - DNA, 25 bp, Mus musculus
ctggagcccaatgaagtccgactgg

SEQ ID NO: 919747 - DNA, 25 bp, Mus musculus
ctggagccccgaccaggacaggtga

SEQ ID NO: 919748 - DNA, 25 bp, Mus musculus
ctggagccccgaccccttccagcag

SEQ ID NO: 919749 - DNA, 25 bp, Mus musculus
ctggagccccgacctcctctaattt

SEQ ID NO: 919750 - DNA, 25 bp, Mus musculus
ctggagccccgacgacaggtgagcc

SEQ ID NO: 919751 - DNA, 25 bp, Mus musculus
ctggagccccgagcaggacaggtga

SEQ ID NO: 919752 - DNA, 25 bp, Mus musculus
ctggagccccgagcccttccagcag

SEQ ID NO: 919753 - DNA, 25 bp, Mus musculus
ctggagccccgagctcctctaattt

SEQ ID NO: 919754 - DNA, 25 bp, Mus musculus
ctggagccccgaggacaggtgagcc

SEQ ID NO: 919755 - DNA, 25 bp, Mus musculus
ctggagcccgagtggcaccagcttc

SEQ ID NO: 919756 - DNA, 25 bp, Mus musculus
ctggagcccgatggttttcggaagg

SEQ ID NO: 919757 - DNA, 25 bp, Mus musculus
ctggagcccgtgtggcaccagcttc

SEQ ID NO: 919758 - DNA, 25 bp, Mus musculus
ctggagcccgttggttttcggaagg

SEQ ID NO: 919759 - DNA, 25 bp, Mus musculus
ctggagccgaatcaaaaggtgatga

SEQ ID NO: 919760 - DNA, 25 bp, Mus musculus
ctggagccgattcaaaaggtgatga

SEQ ID NO: 919761 - DNA, 25 bp, Mus musculus
ctggagccggagccagaggaagaga

SEQ ID NO: 919762 - DNA, 25 bp, Mus musculus
ctggagccggtgccagaggaagaga

SEQ ID NO: 919763 - DNA, 25 bp, Mus musculus
ctggagcgacaccacgagcatcacg

SEQ ID NO: 919764 - DNA, 25 bp, Mus musculus
ctggagcgacaccaggagcatcacg

SEQ ID NO: 919765 - DNA, 25 bp, Mus musculus
ctggagcgtctgctgctacaagtgt

SEQ ID NO: 919766 - DNA, 25 bp, Mus musculus
ctggagcgtctggtgctacaagtgt

SEQ ID NO: 919767 - DNA, 25 bp, Mus musculus
ctggagctactacacgaactgaacc

SEQ ID NO: 919768 - DNA, 25 bp, Mus musculus
ctggagctactacaggaactgaacc

SEQ ID NO: 919769 - DNA, 25 bp, Mus musculus
ctggagctggcacaggcacctcggt

SEQ ID NO: 919770 - DNA, 25 bp, Mus musculus
ctggagctggcagaggcacctcggt

SEQ ID NO: 919771 - DNA, 25 bp, Mus musculus
ctggaggacaaacgtcaagcaggta

SEQ ID NO: 919772 - DNA, 25 bp, Mus musculus
ctggaggacaaaggtcaagcaggta

SEQ ID NO: 919773 - DNA, 25 bp, Mus musculus
ctggaggactgacgtggtgaaaaac

SEQ ID NO: 919774 - DNA, 25 bp, Mus musculus
ctggaggactgaggtggtgaaaaac

SEQ ID NO: 919775 - DNA, 25 bp, Mus musculus
ctggaggagcagctgtccatcaatg

SEQ ID NO: 919776 - DNA, 25 bp, Mus musculus
ctggaggagcaggtgtccatcaatg

SEQ ID NO: 919777 - DNA, 25 bp, Mus musculus
ctggaggaggagagtggcaacatgg

SEQ ID NO: 919778 - DNA, 25 bp, Mus musculus
ctggaggaggagtgtggcaacatgg

SEQ ID NO: 919779 - DNA, 25 bp, Mus musculus
ctggaggatacgacctctgccagag

SEQ ID NO: 919780 - DNA, 25 bp, Mus musculus
ctggaggatacgtcctctgccagag

SEQ ID NO: 919781 - DNA, 25 bp, Mus musculus
ctggaggcagagtaaaagacatcca

SEQ ID NO: 919782 - DNA, 25 bp, Mus musculus
ctggaggcagtgtaaaagacatcca

SEQ ID NO: 919783 - DNA, 25 bp, Mus musculus
ctggaggccagcaacgtgatggatg

SEQ ID NO: 919784 - DNA, 25 bp, Mus musculus
ctggaggccagcaaggtgatggatg

SEQ ID NO: 919785 - DNA, 25 bp, Mus musculus
ctggagggagcttcctccatggagc

SEQ ID NO: 919786 - DNA, 25 bp, Mus musculus
ctggagggaggttcctccatggagc

SEQ ID NO: 919787 - DNA, 25 bp, Mus musculus
ctggagggcgtgctcagtatcgacg

SEQ ID NO: 919788 - DNA, 25 bp, Mus musculus
ctggagggcgtggtcagtatcgacg

SEQ ID NO: 919789 - DNA, 25 bp, Mus musculus
ctggaggggctaagattggagggca

SEQ ID NO: 919790 - DNA, 25 bp, Mus musculus
ctggaggggctaagtttggagggca

SEQ ID NO: 919791 - DNA, 25 bp, Mus musculus
ctggagggtggctccgaaaaggcag

SEQ ID NO: 919792 - DNA, 25 bp, Mus musculus
ctggagggtggctcggaaaaggcag

SEQ ID NO: 919793 - DNA, 25 bp, Mus musculus
ctggaggtagaggacaaatgtgcac

SEQ ID NO: 919794 - DNA, 25 bp, Mus musculus
ctggaggtagaggagaaatgtgcac

SEQ ID NO: 919795 - DNA, 25 bp, Mus musculus
ctggaggtcagacactcggagactg

SEQ ID NO: 919796 - DNA, 25 bp, Mus musculus
ctggaggtcagagactcggagactg

SEQ ID NO: 919797 - DNA, 25 bp, Mus musculus
ctggaggtccgaccacaccctgaaa

SEQ ID NO: 919798 - DNA, 25 bp, Mus musculus
ctggaggtccgacgcgagtgagctc

SEQ ID NO: 919799 - DNA, 25 bp, Mus musculus
ctggaggtccgagcacaccctgaaa

SEQ ID NO: 919800 - DNA, 25 bp, Mus musculus
ctggaggtccgaggcgagtgagctc

SEQ ID NO: 919801 - DNA, 25 bp, Mus musculus
ctggaggtggcacgcttctcagggc

SEQ ID NO: 919802 - DNA, 25 bp, Mus musculus
ctggaggtggcaggcttctcagggc

SEQ ID NO: 919803 - DNA, 25 bp, Mus musculus
ctggagtaagctaccgcactcgaga

SEQ ID NO: 919804 - DNA, 25 bp, Mus musculus
ctggagtaaggtaccgcactcgaga

SEQ ID NO: 919805 - DNA, 25 bp, Mus musculus
ctggagtagcagcaccttctgaccc

SEQ ID NO: 919806 - DNA, 25 bp, Mus musculus
ctggagtagcaggaccttctgaccc

SEQ ID NO: 919807 - DNA, 25 bp, Mus musculus
ctggagtcagagcagtttgacaaga

SEQ ID NO: 919808 - DNA, 25 bp, Mus musculus
ctggagtcagaggagtttgacaaga

SEQ ID NO: 919809 - DNA, 25 bp, Mus musculus
ctggagtcatcacacgtgtgacacc

SEQ ID NO: 919810 - DNA, 25 bp, Mus musculus
ctggagtcatcacaggtgtgacacc

SEQ ID NO: 919811 - DNA, 25 bp, Mus musculus
ctggagtccatgagtaaagagctgg

SEQ ID NO: 919812 - DNA, 25 bp, Mus musculus
ctggagtccatgtgtaaagagctgg

SEQ ID NO: 919813 - DNA, 25 bp, Mus musculus
ctggagtcccagaaggaacggctgc

SEQ ID NO: 919814 - DNA, 25 bp, Mus musculus
ctggagtcccagtaggaacggctgc

SEQ ID NO: 919815 - DNA, 25 bp, Mus musculus
ctggagtccggcaacgagatgaagt

SEQ ID NO: 919816 - DNA, 25 bp, Mus musculus
ctggagtccggcaaggagatgaagt

SEQ ID NO: 919817 - DNA, 25 bp, Mus musculus
ctggagtcgactaccagacaaaccc

SEQ ID NO: 919818 - DNA, 25 bp, Mus musculus
ctggagtcgactacgagacaaaccc

SEQ ID NO: 919819 - DNA, 25 bp, Mus musculus
ctggagtctcggaactgcatccacc

SEQ ID NO: 919820 - DNA, 25 bp, Mus musculus
ctggagtctcggaagtgcatccacc

SEQ ID NO: 919821 - DNA, 25 bp, Mus musculus
ctggagtctgtgaacagccacaatc

SEQ ID NO: 919822 - DNA, 25 bp, Mus musculus
ctggagtctgtgaacgagaagtttg

SEQ ID NO: 919823 - DNA, 25 bp, Mus musculus
ctggagtctgtgaagagccacaatc

SEQ ID NO: 919824 - DNA, 25 bp, Mus musculus
ctggagtctgtgaaggagaagtttg

SEQ ID NO: 919825 - DNA, 25 bp, Mus musculus
ctggagtgagagagcctgtgctgtg

SEQ ID NO: 919826 - DNA, 25 bp, Mus musculus
ctggagtgagagaggaggagcgctt

SEQ ID NO: 919827 - DNA, 25 bp, Mus musculus
ctggagtgagagctgggaagtcatc

SEQ ID NO: 919828 - DNA, 25 bp, Mus musculus
ctggagtgagaggtgggaagtcatc

SEQ ID NO: 919829 - DNA, 25 bp, Mus musculus
ctggagtgagagtgcctgtgctgtg

SEQ ID NO: 919830 - DNA, 25 bp, Mus musculus
ctggagtgagagtggaggagcgctt

SEQ ID NO: 919831 - DNA, 25 bp, Mus musculus
ctggagtgcgtgcacgtggatgagt

SEQ ID NO: 919832 - DNA, 25 bp, Mus musculus
ctggagtgcgtggacgtggatgagt

SEQ ID NO: 919833 - DNA, 25 bp, Mus musculus
ctggagtgtgggaaaatccacctag

SEQ ID NO: 919834 - DNA, 25 bp, Mus musculus
ctggagtgtgggtaaatccacctag

SEQ ID NO: 919835 - DNA, 25 bp, Mus musculus
ctggagttagagctgaccatttgaa

SEQ ID NO: 919836 - DNA, 25 bp, Mus musculus
ctggagttagaggtgaccatttgaa

SEQ ID NO: 919837 - DNA, 25 bp, Mus musculus
ctggagttcatcaacgagattggat

SEQ ID NO: 919838 - DNA, 25 bp, Mus musculus
ctggagttcatcaaggagattggat

SEQ ID NO: 919839 - DNA, 25 bp, Mus musculus
ctggagttcatgcctcctgagatgg

SEQ ID NO: 919840 - DNA, 25 bp, Mus musculus
ctggagttcatggctcctgagatgg

SEQ ID NO: 919841 - DNA, 25 bp, Mus musculus
ctggagttgcagcacctgaaacagt

SEQ ID NO: 919842 - DNA, 25 bp, Mus musculus
ctggagttgcagcagctgaaacagt

SEQ ID NO: 919843 - DNA, 25 bp, Mus musculus
ctggagtttcagcaactaatgacca

SEQ ID NO: 919844 - DNA, 25 bp, Mus musculus
ctggagtttcaggaactaatgacca

SEQ ID NO: 919845 - DNA, 25 bp, Mus musculus
ctggagttttaggaaagatataccg

SEQ ID NO: 919846 - DNA, 25 bp, Mus musculus
ctggagttttaggatagatataccg

SEQ ID NO: 919847 - DNA, 25 bp, Mus musculus
ctggataaagagttcaggaaggagt

SEQ ID NO: 919848 - DNA, 25 bp, Mus musculus
ctggataaagtgttcaggaaggagt

SEQ ID NO: 919849 - DNA, 25 bp, Mus musculus
ctggataacaagcatctgttcagca

SEQ ID NO: 919850 - DNA, 25 bp, Mus musculus
ctggataacaaggatctgttcagca

SEQ ID NO: 919851 - DNA, 25 bp, Mus musculus
ctggatacccagattgcagatggcg

SEQ ID NO: 919852 - DNA, 25 bp, Mus musculus
ctggatacccagtttgcagatggcg

SEQ ID NO: 919853 - DNA, 25 bp, Mus musculus
ctggatactaaactgtcttgtcctg

SEQ ID NO: 919854 - DNA, 25 bp, Mus musculus
ctggatactaaagtgtcttgtcctg

SEQ ID NO: 919855 - DNA, 25 bp, Mus musculus
ctggatagtaagctgaacatcattc

SEQ ID NO: 919856 - DNA, 25 bp, Mus musculus
ctggatagtaaggtgaacatcattc

SEQ ID NO: 919857 - DNA, 25 bp, Mus musculus
ctggatatgaagcggctgaagagga

SEQ ID NO: 919858 - DNA, 25 bp, Mus musculus
ctggatatgaaggggctgaagagga

SEQ ID NO: 919859 - DNA, 25 bp, Mus musculus
ctggatcaagctgcgcaggcgcgag

SEQ ID NO: 919860 - DNA, 25 bp, Mus musculus
ctggatcaaggtgcgcaggcgcgag

SEQ ID NO: 919861 - DNA, 25 bp, Mus musculus
ctggatcaataaagaagagatgatc

SEQ ID NO: 919862 - DNA, 25 bp, Mus musculus
ctggatcaataatgaagagatgatc

SEQ ID NO: 919863 - DNA, 25 bp, Mus musculus
ctggatcacactcgatgcagcctac

SEQ ID NO: 919864 - DNA, 25 bp, Mus musculus
ctggatcacactggatgcagcctac

SEQ ID NO: 919865 - DNA, 25 bp, Mus musculus
ctggatccagcacgtggaccagagc

SEQ ID NO: 919866 - DNA, 25 bp, Mus musculus
ctggatccagcaggtggaccagagc

SEQ ID NO: 919867 - DNA, 25 bp, Mus musculus
ctggatcctgagccacgctgttgcg

SEQ ID NO: 919868 - DNA, 25 bp, Mus musculus
ctggatcctgaggcacgctgttgcg

SEQ ID NO: 919869 - DNA, 25 bp, Mus musculus
ctggatcctgatgatgaggacagtg

SEQ ID NO: 919870 - DNA, 25 bp, Mus musculus
ctggatcctgattagatgatgagga

SEQ ID NO: 919871 - DNA, 25 bp, Mus musculus
ctggatcctgcgctttttgtagaaa

SEQ ID NO: 919872 - DNA, 25 bp, Mus musculus
ctggatcctgggctttttgtagaaa

SEQ ID NO: 919873 - DNA, 25 bp, Mus musculus
ctggatcctgttgatgaggacagtg

SEQ ID NO: 919874 - DNA, 25 bp, Mus musculus
ctggatcctgtttagatgatgagga

SEQ ID NO: 919875 - DNA, 25 bp, Mus musculus
ctggatcgagagaaagtgcaacagt

SEQ ID NO: 919876 - DNA, 25 bp, Mus musculus
ctggatcgagagcgtctgtcctgtg

SEQ ID NO: 919877 - DNA, 25 bp, Mus musculus
ctggatcgagagggtctgtcctgtg

SEQ ID NO: 919878 - DNA, 25 bp, Mus musculus
ctggatcgagagtaagtgcaacagt

SEQ ID NO: 919879 - DNA, 25 bp, Mus musculus
ctggatcgatgcaaatcccaggagg

SEQ ID NO: 919880 - DNA, 25 bp, Mus musculus
ctggatcgatgcaattcccaggagg

SEQ ID NO: 919881 - DNA, 25 bp, Mus musculus
ctggatcggttacacacactgacca

SEQ ID NO: 919882 - DNA, 25 bp, Mus musculus
ctggatcggttacagacactgacca

SEQ ID NO: 919883 - DNA, 25 bp, Mus musculus
ctggatctagaaaactcaagagaag

SEQ ID NO: 919884 - DNA, 25 bp, Mus musculus
ctggatctagaaaagtcaagagaag

SEQ ID NO: 919885 - DNA, 25 bp, Mus musculus
ctggatcttgcaacaccatctcgga

SEQ ID NO: 919886 - DNA, 25 bp, Mus musculus
ctggatcttgcaacagaatctgcct

SEQ ID NO: 919887 - DNA, 25 bp, Mus musculus
ctggatcttgcaactccatctcgga

SEQ ID NO: 919888 - DNA, 25 bp, Mus musculus
ctggatcttgcaactgaatctgcct

SEQ ID NO: 919889 - DNA, 25 bp, Mus musculus
ctggatgaagtgctcgattatggct

SEQ ID NO: 919890 - DNA, 25 bp, Mus musculus
ctggatgaagtgctggattatggct

SEQ ID NO: 919891 - DNA, 25 bp, Mus musculus
ctggatgaccagctggcgctgctca

SEQ ID NO: 919892 - DNA, 25 bp, Mus musculus
ctggatgaccaggtggcgctgctca

SEQ ID NO: 919893 - DNA, 25 bp, Mus musculus
ctggatgataccaggaaaaatggtg

SEQ ID NO: 919894 - DNA, 25 bp, Mus musculus
ctggatgatacctggaaaaatggtg

SEQ ID NO: 919895 - DNA, 25 bp, Mus musculus
ctggatgatgcactaaaaagaatct

SEQ ID NO: 919896 - DNA, 25 bp, Mus musculus
ctggatgatgcagtaaaaagaatct

SEQ ID NO: 919897 - DNA, 25 bp, Mus musculus
ctggatgcagccctgccaggcagcc

SEQ ID NO: 919898 - DNA, 25 bp, Mus musculus
ctggatgcaggcctgccaggcagcc

SEQ ID NO: 919899 - DNA, 25 bp, Mus musculus
ctggatgcagtgctgaatgtgatgc

SEQ ID NO: 919900 - DNA, 25 bp, Mus musculus
ctggatgcagtggtgaatgtgatgc

SEQ ID NO: 919901 - DNA, 25 bp, Mus musculus
ctggatgccactcgtaagaccacac

SEQ ID NO: 919902 - DNA, 25 bp, Mus musculus
ctggatgccactcgtactggcatag

SEQ ID NO: 919903 - DNA, 25 bp, Mus musculus
ctggatgccactggtaagaccacac

SEQ ID NO: 919904 - DNA, 25 bp, Mus musculus
ctggatgccactggtactggcatag

SEQ ID NO: 919905 - DNA, 25 bp, Mus musculus
ctggatgccccacgaactggatgcc

SEQ ID NO: 919906 - DNA, 25 bp, Mus musculus
ctggatgccccacttttataggcaa

SEQ ID NO: 919907 - DNA, 25 bp, Mus musculus
ctggatgccccaggaactggatgcc

SEQ ID NO: 919908 - DNA, 25 bp, Mus musculus
ctggatgccccagttttataggcaa

SEQ ID NO: 919909 - DNA, 25 bp, Mus musculus
ctggatggggcgcagccttgaggac

SEQ ID NO: 919910 - DNA, 25 bp, Mus musculus
ctggatggggcggagccttgaggac

SEQ ID NO: 919911 - DNA, 25 bp, Mus musculus
ctggatgtcaagccggagaacctgc

SEQ ID NO: 919912 - DNA, 25 bp, Mus musculus
ctggatgtcaaggcggagaacctgc

SEQ ID NO: 919913 - DNA, 25 bp, Mus musculus
ctggatgtgctgcagcgctccccac

SEQ ID NO: 919914 - DNA, 25 bp, Mus musculus
ctggatgtgctgcagcggtccccgc

SEQ ID NO: 919915 - DNA, 25 bp, Mus musculus
ctggatgtgctggagcgctccccac

SEQ ID NO: 919916 - DNA, 25 bp, Mus musculus
ctggatgtgctggagcggtccccgc

SEQ ID NO: 919917 - DNA, 25 bp, Mus musculus
ctggatgttgtgcgataccccttca

SEQ ID NO: 919918 - DNA, 25 bp, Mus musculus
ctggatgttgtgggataccccttca

SEQ ID NO: 919919 - DNA, 25 bp, Mus musculus
ctggattctgccattaatgtggact

SEQ ID NO: 919920 - DNA, 25 bp, Mus musculus
ctggattctggcattaatgtggact

SEQ ID NO: 919921 - DNA, 25 bp, Mus musculus
ctggatttatcacaaacatacaaga

SEQ ID NO: 919922 - DNA, 25 bp, Mus musculus
ctggatttatcagaaacatacaaga

SEQ ID NO: 919923 - DNA, 25 bp, Mus musculus
ctggcaaaatccgtgcccacacttt

SEQ ID NO: 919924 - DNA, 25 bp, Mus musculus
ctggcaaaatgcgtgcccacacttt

SEQ ID NO: 919925 - DNA, 25 bp, Mus musculus
ctggcaaactgttcagcggtggagg

SEQ ID NO: 919926 - DNA, 25 bp, Mus musculus
ctggcaaactgttctgcggtggagg

SEQ ID NO: 919927 - DNA, 25 bp, Mus musculus
ctggcaaagcaagacattcgagtaa

SEQ ID NO: 919928 - DNA, 25 bp, Mus musculus
ctggcaaagcaagagattcgagtaa

SEQ ID NO: 919929 - DNA, 25 bp, Mus musculus
ctggcaaaggcacgatctattccca

SEQ ID NO: 919930 - DNA, 25 bp, Mus musculus
ctggcaaaggcaggatctattccca

SEQ ID NO: 919931 - DNA, 25 bp, Mus musculus
ctggcaaaggctatacctggccttg

SEQ ID NO: 919932 - DNA, 25 bp, Mus musculus
ctggcaaagggtatacctggccttg

SEQ ID NO: 919933 - DNA, 25 bp, Mus musculus
ctggcaaatgatcagagttctagaa

SEQ ID NO: 919934 - DNA, 25 bp, Mus musculus
ctggcaaatgatgagagttctagaa

SEQ ID NO: 919935 - DNA, 25 bp, Mus musculus
ctggcaacacagatcgaggaagagc

SEQ ID NO: 919936 - DNA, 25 bp, Mus musculus
ctggcaacacagatggaggaagagc

SEQ ID NO: 919937 - DNA, 25 bp, Mus musculus
ctggcaacctgtcacccctgctgtc

SEQ ID NO: 919938 - DNA, 25 bp, Mus musculus
ctggcaacctgtcagccctgctgtc

SEQ ID NO: 919939 - DNA, 25 bp, Mus musculus
ctggcaagcaagaacaaggatgaga

SEQ ID NO: 919940 - DNA, 25 bp, Mus musculus
ctggcaagcaagtacaaggatgaga

SEQ ID NO: 919941 - DNA, 25 bp, Mus musculus
ctggcaatctagcttctttggtttc

SEQ ID NO: 919942 - DNA, 25 bp, Mus musculus
ctggcaatctaggttctttggtttc

SEQ ID NO: 919943 - DNA, 25 bp, Mus musculus
ctggcaatctgtcgcgggtggaggg

SEQ ID NO: 919944 - DNA, 25 bp, Mus musculus
ctggcaatctgtcgggggtggaggg

SEQ ID NO: 919945 - DNA, 25 bp, Mus musculus
ctggcaattgcgcttatcaatgtca

SEQ ID NO: 919946 - DNA, 25 bp, Mus musculus
ctggcaattgcggttatcaatgtca

SEQ ID NO: 919947 - DNA, 25 bp, Mus musculus
ctggcacaacagcacatcccagcat

SEQ ID NO: 919948 - DNA, 25 bp, Mus musculus
ctggcacaacagcagatcccagcat

SEQ ID NO: 919949 - DNA, 25 bp, Mus musculus
ctggcacacgccccaaggaaagtat

SEQ ID NO: 919950 - DNA, 25 bp, Mus musculus
ctggcacacggcccaaggaaagtat

SEQ ID NO: 919951 - DNA, 25 bp, Mus musculus
ctggcacaggagagggaggcctgga

SEQ ID NO: 919952 - DNA, 25 bp, Mus musculus
ctggcacaggagccctggaggagct

SEQ ID NO: 919953 - DNA, 25 bp, Mus musculus
ctggcacaggaggcctggaggagct

SEQ ID NO: 919954 - DNA, 25 bp, Mus musculus
ctggcacaggagtgggaggcctgga

SEQ ID NO: 919955 - DNA, 25 bp, Mus musculus
ctggcaccagctagaaaatctctcc

SEQ ID NO: 919956 - DNA, 25 bp, Mus musculus
ctggcaccagctgaggatggttccc

SEQ ID NO: 919957 - DNA, 25 bp, Mus musculus
ctggcaccaggtagaaaatctctcc

SEQ ID NO: 919958 - DNA, 25 bp, Mus musculus
ctggcaccaggtgaggatggttccc

SEQ ID NO: 919959 - DNA, 25 bp, Mus musculus
ctggcaccccaccagcaggatgaat

SEQ ID NO: 919960 - DNA, 25 bp, Mus musculus
ctggcacccctccagcaggatgaat

SEQ ID NO: 919961 - DNA, 25 bp, Mus musculus
ctggcaccgcgaagtcagtacacaa

SEQ ID NO: 919962 - DNA, 25 bp, Mus musculus
ctggcaccgcgatgtcagtacacaa

SEQ ID NO: 919963 - DNA, 25 bp, Mus musculus
ctggcacctctgcacgttcaggtct

SEQ ID NO: 919964 - DNA, 25 bp, Mus musculus
ctggcacctctgcaggttcaggtct

SEQ ID NO: 919965 - DNA, 25 bp, Mus musculus
ctggcactaacacaacctttagaag

SEQ ID NO: 919966 - DNA, 25 bp, Mus musculus
ctggcactaacagaacctttagaag

SEQ ID NO: 919967 - DNA, 25 bp, Mus musculus
ctggcactacagatgctcatgacat

SEQ ID NO: 919968 - DNA, 25 bp, Mus musculus
ctggcactacagttgctcatgacat

SEQ ID NO: 919969 - DNA, 25 bp, Mus musculus
ctggcactgcttaacctagatagac

SEQ ID NO: 919970 - DNA, 25 bp, Mus musculus
ctggcactgcttaagctagatagac

SEQ ID NO: 919971 - DNA, 25 bp, Mus musculus
ctggcactgtgtcgatcaactgcta

SEQ ID NO: 919972 - DNA, 25 bp, Mus musculus
ctggcactgtgtggatcaactgcta

SEQ ID NO: 919973 - DNA, 25 bp, Mus musculus
ctggcagagaagcaacatggcttct

SEQ ID NO: 919974 - DNA, 25 bp, Mus musculus
ctggcagagaagcaataccacatca

SEQ ID NO: 919975 - DNA, 25 bp, Mus musculus
ctggcagagaaggaacatggcttct

SEQ ID NO: 919976 - DNA, 25 bp, Mus musculus
ctggcagagaaggaataccacatca

SEQ ID NO: 919977 - DNA, 25 bp, Mus musculus
ctggcagagacgcagggcatgctca

SEQ ID NO: 919978 - DNA, 25 bp, Mus musculus
ctggcagagacggagggcatgctca

SEQ ID NO: 919979 - DNA, 25 bp, Mus musculus
ctggcagagcaccgcattgattttg

SEQ ID NO: 919980 - DNA, 25 bp, Mus musculus
ctggcagagcaccggattgattttg

SEQ ID NO: 919981 - DNA, 25 bp, Mus musculus
ctggcagaggagctttccaagctag

SEQ ID NO: 919982 - DNA, 25 bp, Mus musculus
ctggcagaggaggtttccaagctag

SEQ ID NO: 919983 - DNA, 25 bp, Mus musculus
ctggcagatttccgtctggcaagag

SEQ ID NO: 919984 - DNA, 25 bp, Mus musculus
ctggcagatttcggtctggcaagag

SEQ ID NO: 919985 - DNA, 25 bp, Mus musculus
ctggcagcccctcagactgaagttg

SEQ ID NO: 919986 - DNA, 25 bp, Mus musculus
ctggcagcccctcagcagactgaag

SEQ ID NO: 919987 - DNA, 25 bp, Mus musculus
ctggcagcccctgagactgaagttg

SEQ ID NO: 919988 - DNA, 25 bp, Mus musculus
ctggcagcccctgagcagactgaag

SEQ ID NO: 919989 - DNA, 25 bp, Mus musculus
ctggcaggaatgaaccttggctcca

SEQ ID NO: 919990 - DNA, 25 bp, Mus musculus
ctggcaggaatgtaccttggctcca

SEQ ID NO: 919991 - DNA, 25 bp, Mus musculus
ctggcaggagacaacaacttcatca

SEQ ID NO: 919992 - DNA, 25 bp, Mus musculus
ctggcaggagacaagaacttcatca

SEQ ID NO: 919993 - DNA, 25 bp, Mus musculus
ctggcagtaactcgcaagaagacag

SEQ ID NO: 919994 - DNA, 25 bp, Mus musculus
ctggcagtaactggcaagaagacag

SEQ ID NO: 919995 - DNA, 25 bp, Mus musculus
ctggcagtggcaagtcagagtccaa

SEQ ID NO: 919996 - DNA, 25 bp, Mus musculus
ctggcagtggcaggccagagtccaa

SEQ ID NO: 919997 - DNA, 25 bp, Mus musculus
ctggcagtgggaagtcagagtccaa

SEQ ID NO: 919998 - DNA, 25 bp, Mus musculus
ctggcagtgggaggccagagtccaa

SEQ ID NO: 919999 - DNA, 25 bp, Mus musculus
ctggcataagcccactcagaagggt

SEQ ID NO: 920000 - DNA, 25 bp, Mus musculus
ctggcataaggccactcagaagggt

SEQ ID NO: 920001 - DNA, 25 bp, Mus musculus
ctggcatcagagctgcccagcggga

SEQ ID NO: 920002 - DNA, 25 bp, Mus musculus
ctggcatcagaggtgcccagcggga

SEQ ID NO: 920003 - DNA, 25 bp, Mus musculus
ctggcatcagcggcactagctggat

SEQ ID NO: 920004 - DNA, 25 bp, Mus musculus
ctggcatcaggggcactagctggat

SEQ ID NO: 920005 - DNA, 25 bp, Mus musculus
ctggcatccccaaacatctccctga

SEQ ID NO: 920006 - DNA, 25 bp, Mus musculus
ctggcatccccaaagatctccctga

SEQ ID NO: 920007 - DNA, 25 bp, Mus musculus
ctggcatcctatctgaaaaggctaa

SEQ ID NO: 920008 - DNA, 25 bp, Mus musculus
ctggcatcctcagggaactctccta

SEQ ID NO: 920009 - DNA, 25 bp, Mus musculus
ctggcatcctctctgaaatgcctaa

SEQ ID NO: 920010 - DNA, 25 bp, Mus musculus
ctggcatcctgagggaactctccta

SEQ ID NO: 920011 - DNA, 25 bp, Mus musculus
ctggcatcctgtctgaaatgcctaa

SEQ ID NO: 920012 - DNA, 25 bp, Mus musculus
ctggcatcctttctgaaaaggctaa

SEQ ID NO: 920013 - DNA, 25 bp, Mus musculus
ctggcatctgcccgagctgaagagg

SEQ ID NO: 920014 - DNA, 25 bp, Mus musculus
ctggcatctgccggagctgaagagg

SEQ ID NO: 920015 - DNA, 25 bp, Mus musculus
ctggcatctgttgtcctcaacttca

SEQ ID NO: 920016 - DNA, 25 bp, Mus musculus
ctggcatctgttgtgctcaacttca

SEQ ID NO: 920017 - DNA, 25 bp, Mus musculus
ctggcatgaaatcctggggcagagt

SEQ ID NO: 920018 - DNA, 25 bp, Mus musculus
ctggcatgaattcctggggcagagt

SEQ ID NO: 920019 - DNA, 25 bp, Mus musculus
ctggcatgagagccctaaaggccgt

SEQ ID NO: 920020 - DNA, 25 bp, Mus musculus
ctggcatgagtgccctaaaggccgt

SEQ ID NO: 920021 - DNA, 25 bp, Mus musculus
ctggcatggaagatgaaagagaaga

SEQ ID NO: 920022 - DNA, 25 bp, Mus musculus
ctggcatggaagttgaaagagaaga

SEQ ID NO: 920023 - DNA, 25 bp, Mus musculus
ctggcattagaacactgtagctgtc

SEQ ID NO: 920024 - DNA, 25 bp, Mus musculus
ctggcattagcgcaggctggatata

SEQ ID NO: 920025 - DNA, 25 bp, Mus musculus
ctggcattagggcaggctggatata

SEQ ID NO: 920026 - DNA, 25 bp, Mus musculus
ctggcattagtacactgtagctgtc

SEQ ID NO: 920027 - DNA, 25 bp, Mus musculus
ctggccaaaacgccatttgatgagg

SEQ ID NO: 920028 - DNA, 25 bp, Mus musculus
ctggccaaaacggcatttgatgagg

SEQ ID NO: 920029 - DNA, 25 bp, Mus musculus
ctggccaaaattaatgagaagatct

SEQ ID NO: 920030 - DNA, 25 bp, Mus musculus
ctggccaaaattacctctgtgaagc

SEQ ID NO: 920031 - DNA, 25 bp, Mus musculus
ctggccaaaatttatgagaagatct

SEQ ID NO: 920032 - DNA, 25 bp, Mus musculus
ctggccaaaatttcctctgtgaagc

SEQ ID NO: 920033 - DNA, 25 bp, Mus musculus
ctggccaaagcgtcattatcgttat

SEQ ID NO: 920034 - DNA, 25 bp, Mus musculus
ctggccaaagctcagcctccaagac

SEQ ID NO: 920035 - DNA, 25 bp, Mus musculus
ctggccaaagctcggacatcaaata

SEQ ID NO: 920036 - DNA, 25 bp, Mus musculus
ctggccaaagggtcattatcgttat

SEQ ID NO: 920037 - DNA, 25 bp, Mus musculus
ctggccaaaggtcagcctccaagac

SEQ ID NO: 920038 - DNA, 25 bp, Mus musculus
ctggccaaaggtcggacatcaaata

SEQ ID NO: 920039 - DNA, 25 bp, Mus musculus
ctggccacaccacgcttgatgattc

SEQ ID NO: 920040 - DNA, 25 bp, Mus musculus
ctggccacaccaggcttgatgattc

SEQ ID NO: 920041 - DNA, 25 bp, Mus musculus
ctggccacactgcacgccgctgtga

SEQ ID NO: 920042 - DNA, 25 bp, Mus musculus
ctggccacactggacgccgctgtga

SEQ ID NO: 920043 - DNA, 25 bp, Mus musculus
ctggccacagcaccagctgccaata

SEQ ID NO: 920044 - DNA, 25 bp, Mus musculus
ctggccacaggaccagctgccaata

SEQ ID NO: 920045 - DNA, 25 bp, Mus musculus
ctggccactgccaacgccaccacat

SEQ ID NO: 920046 - DNA, 25 bp, Mus musculus
ctggccactgccaaggccaccacat

SEQ ID NO: 920047 - DNA, 25 bp, Mus musculus
ctggccagagcctcagattcccaac

SEQ ID NO: 920048 - DNA, 25 bp, Mus musculus
ctggccagaggctcagattcccaac

SEQ ID NO: 920049 - DNA, 25 bp, Mus musculus
ctggccagtacacggtctgatccga

SEQ ID NO: 920050 - DNA, 25 bp, Mus musculus
ctggccagtacagggtctgatccga

SEQ ID NO: 920051 - DNA, 25 bp, Mus musculus
ctggccagtcaacatagccagccct

SEQ ID NO: 920052 - DNA, 25 bp, Mus musculus
ctggccagtcaagatagccagccct

SEQ ID NO: 920053 - DNA, 25 bp, Mus musculus
ctggccagtgatcttctagagtgga

SEQ ID NO: 920054 - DNA, 25 bp, Mus musculus
ctggccagtgatgttctagagtgga

SEQ ID NO: 920055 - DNA, 25 bp, Mus musculus
ctggccatagcctggtgcctgagga

SEQ ID NO: 920056 - DNA, 25 bp, Mus musculus
ctggccataggctggtgcctgagga

SEQ ID NO: 920057 - DNA, 25 bp, Mus musculus
ctggccatgcacccccaggaccccc

SEQ ID NO: 920058 - DNA, 25 bp, Mus musculus
ctggccatgcacgcccaggaccccc

SEQ ID NO: 920059 - DNA, 25 bp, Mus musculus
ctggccatgtcgaaagataacatgg

SEQ ID NO: 920060 - DNA, 25 bp, Mus musculus
ctggccatgtcgtaagataacatgg

SEQ ID NO: 920061 - DNA, 25 bp, Mus musculus
ctggccattaagctgctggagtatg

SEQ ID NO: 920062 - DNA, 25 bp, Mus musculus
ctggccattaaggtgctggagtatg

SEQ ID NO: 920063 - DNA, 25 bp, Mus musculus
ctggccattgaacagtggcagaaaa

SEQ ID NO: 920064 - DNA, 25 bp, Mus musculus
ctggccattgaagagtggcagaaaa

SEQ ID NO: 920065 - DNA, 25 bp, Mus musculus
ctggcccaatcactcagaagacctc

SEQ ID NO: 920066 - DNA, 25 bp, Mus musculus
ctggcccaatcagtcagaagacctc

SEQ ID NO: 920067 - DNA, 25 bp, Mus musculus
ctggcccacgcacagctctctgaag

SEQ ID NO: 920068 - DNA, 25 bp, Mus musculus
ctggcccacgcagagctctctgaag

SEQ ID NO: 920069 - DNA, 25 bp, Mus musculus
ctggcccagctctgcgatgggttga

SEQ ID NO: 920070 - DNA, 25 bp, Mus musculus
ctggcccagctctgcggagaactct

SEQ ID NO: 920071 - DNA, 25 bp, Mus musculus
ctggcccagctctgggatgggttga

SEQ ID NO: 920072 - DNA, 25 bp, Mus musculus
ctggcccagctctggggagaactct

SEQ ID NO: 920073 - DNA, 25 bp, Mus musculus
ctggcccagggacacgtggtggagt

SEQ ID NO: 920074 - DNA, 25 bp, Mus musculus
ctggcccagggacaggtggtggagt

SEQ ID NO: 920075 - DNA, 25 bp, Mus musculus
ctggcccagtgcaccgtggaaaaag

SEQ ID NO: 920076 - DNA, 25 bp, Mus musculus
ctggcccagtgcacggtggaaaaag

SEQ ID NO: 920077 - DNA, 25 bp, Mus musculus
ctggcccatgatcgacttcctgcgc

SEQ ID NO: 920078 - DNA, 25 bp, Mus musculus
ctggcccatgatggacttcctgcgc

SEQ ID NO: 920079 - DNA, 25 bp, Mus musculus
ctggccccagctcgaagctggagaa

SEQ ID NO: 920080 - DNA, 25 bp, Mus musculus
ctggccccaggtcgaagctggagaa

SEQ ID NO: 920081 - DNA, 25 bp, Mus musculus
ctggccccagtgcacattaaggttg

SEQ ID NO: 920082 - DNA, 25 bp, Mus musculus
ctggccccagtgcagattaaggttg

SEQ ID NO: 920083 - DNA, 25 bp, Mus musculus
ctggcccccaagcccatgaagaaga

SEQ ID NO: 920084 - DNA, 25 bp, Mus musculus
ctggcccccaaggccatgaagaaga

SEQ ID NO: 920085 - DNA, 25 bp, Mus musculus
ctggcccctacaaaaaatggttcct

SEQ ID NO: 920086 - DNA, 25 bp, Mus musculus
ctggcccctacataaaatggttcct

SEQ ID NO: 920087 - DNA, 25 bp, Mus musculus
ctggcccctgagctgctggaggaca

SEQ ID NO: 920088 - DNA, 25 bp, Mus musculus
ctggcccctgaggtgctggaggaca

SEQ ID NO: 920089 - DNA, 25 bp, Mus musculus
ctggccctcacgctatatgctatga

SEQ ID NO: 920090 - DNA, 25 bp, Mus musculus
ctggccctcacggtatatgctatga

SEQ ID NO: 920091 - DNA, 25 bp, Mus musculus
ctggccctgcccagagcctgacccc

SEQ ID NO: 920092 - DNA, 25 bp, Mus musculus
ctggccctgcccagatactcccccc

SEQ ID NO: 920093 - DNA, 25 bp, Mus musculus
ctggccctgcccagtgcctgacccc

SEQ ID NO: 920094 - DNA, 25 bp, Mus musculus
ctggccctgcccagttactcccccc

SEQ ID NO: 920095 - DNA, 25 bp, Mus musculus
ctggccctggatcttttctcagagt

SEQ ID NO: 920096 - DNA, 25 bp, Mus musculus
ctggccctggttcttttctcagagt

SEQ ID NO: 920097 - DNA, 25 bp, Mus musculus
ctggcccttacgacctgggctgacg

SEQ ID NO: 920098 - DNA, 25 bp, Mus musculus
ctggcccttacgctcttggaaacat

SEQ ID NO: 920099 - DNA, 25 bp, Mus musculus
ctggcccttacggtcttggaaacat

SEQ ID NO: 920100 - DNA, 25 bp, Mus musculus
ctggcccttacgtcctgggctgacg

SEQ ID NO: 920101 - DNA, 25 bp, Mus musculus
ctggccgaagcatgacccgccggga

SEQ ID NO: 920102 - DNA, 25 bp, Mus musculus
ctggccgaaggatgacccgccggga

SEQ ID NO: 920103 - DNA, 25 bp, Mus musculus
ctggccgagatcgacgcatggtgga

SEQ ID NO: 920104 - DNA, 25 bp, Mus musculus
ctggccgagatcgaggcatggtgga

SEQ ID NO: 920105 - DNA, 25 bp, Mus musculus
ctggccgagtaccacagcccacaga

SEQ ID NO: 920106 - DNA, 25 bp, Mus musculus
ctggccgagtaccacgacctgacgt

SEQ ID NO: 920107 - DNA, 25 bp, Mus musculus
ctggccgagtaccagagcccacaga

SEQ ID NO: 920108 - DNA, 25 bp, Mus musculus
ctggccgagtaccaggacctgacgt

SEQ ID NO: 920109 - DNA, 25 bp, Mus musculus
ctggccgagtcgcgtctttcattca

SEQ ID NO: 920110 - DNA, 25 bp, Mus musculus
ctggccgagtcgggtctttcattca

SEQ ID NO: 920111 - DNA, 25 bp, Mus musculus
ctggccgccatcatctctgccacaa

SEQ ID NO: 920112 - DNA, 25 bp, Mus musculus
ctggccgccatcatgtctgccacaa

SEQ ID NO: 920113 - DNA, 25 bp, Mus musculus
ctggccgcttgcggaggtttggatt

SEQ ID NO: 920114 - DNA, 25 bp, Mus musculus
ctggccgcttgcggtggtttggatt

SEQ ID NO: 920115 - DNA, 25 bp, Mus musculus
ctggccgtaaatcgttcagactggg

SEQ ID NO: 920116 - DNA, 25 bp, Mus musculus
ctggccgtaaatggttcagactggg

SEQ ID NO: 920117 - DNA, 25 bp, Mus musculus
ctggccgtcgcggctggactgtact

SEQ ID NO: 920118 - DNA, 25 bp, Mus musculus
ctggccgtcggggctggactgtact

SEQ ID NO: 920119 - DNA, 25 bp, Mus musculus
ctggccgtgctgacctataccagat

SEQ ID NO: 920120 - DNA, 25 bp, Mus musculus
ctggccgtgctgtcctataccagat

SEQ ID NO: 920121 - DNA, 25 bp, Mus musculus
ctggcctacctagccagtgcacccc

SEQ ID NO: 920122 - DNA, 25 bp, Mus musculus
ctggcctacctagcgagtgcacccc

SEQ ID NO: 920123 - DNA, 25 bp, Mus musculus
ctggcctacgcggccaaggaggggc

SEQ ID NO: 920124 - DNA, 25 bp, Mus musculus
ctggcctacggggccaaggaggggc

SEQ ID NO: 920125 - DNA, 25 bp, Mus musculus
ctggcctactatccctatcagaagt

SEQ ID NO: 920126 - DNA, 25 bp, Mus musculus
ctggcctactatgcctatcagaagt

SEQ ID NO: 920127 - DNA, 25 bp, Mus musculus
ctggcctcagcagacaacaatcgca

SEQ ID NO: 920128 - DNA, 25 bp, Mus musculus
ctggcctcagctgacaaccagggca

SEQ ID NO: 920129 - DNA, 25 bp, Mus musculus
ctggcctcaggagacaacaatcgca

SEQ ID NO: 920130 - DNA, 25 bp, Mus musculus
ctggcctcaggtgacaaccagggca

SEQ ID NO: 920131 - DNA, 25 bp, Mus musculus
ctggcctccgctcacgaacgagttc

SEQ ID NO: 920132 - DNA, 25 bp, Mus musculus
ctggcctccgctcacgtaaacagaa

SEQ ID NO: 920133 - DNA, 25 bp, Mus musculus
ctggcctccgctcaggaacgagttc

SEQ ID NO: 920134 - DNA, 25 bp, Mus musculus
ctggcctccgctcaggtaaacagaa

SEQ ID NO: 920135 - DNA, 25 bp, Mus musculus
ctggcctcgctgcgattcccattta

SEQ ID NO: 920136 - DNA, 25 bp, Mus musculus
ctggcctcgctgggattcccattta

SEQ ID NO: 920137 - DNA, 25 bp, Mus musculus
ctggcctgccggaatgtttcagaag

SEQ ID NO: 920138 - DNA, 25 bp, Mus musculus
ctggcctgccggtatgtttcagaag

SEQ ID NO: 920139 - DNA, 25 bp, Mus musculus
ctggcctggaagggacactatgaag

SEQ ID NO: 920140 - DNA, 25 bp, Mus musculus
ctggcctggacacagtgggacacta

SEQ ID NO: 920141 - DNA, 25 bp, Mus musculus
ctggcctggagacagtgggacacta

SEQ ID NO: 920142 - DNA, 25 bp, Mus musculus
ctggcctggatgggacactatgaag

SEQ ID NO: 920143 - DNA, 25 bp, Mus musculus
ctggcctggctgtgcgttacacagc

SEQ ID NO: 920144 - DNA, 25 bp, Mus musculus
ctggcctggctgtgggttacacagc

SEQ ID NO: 920145 - DNA, 25 bp, Mus musculus
ctggccttccagctgaaagaggccc

SEQ ID NO: 920146 - DNA, 25 bp, Mus musculus
ctggccttccaggtgaaagaggccc

SEQ ID NO: 920147 - DNA, 25 bp, Mus musculus
ctggcgaaagcgattggagcgcagt

SEQ ID NO: 920148 - DNA, 25 bp, Mus musculus
ctggcgaaagcgtttggagcgcagt

SEQ ID NO: 920149 - DNA, 25 bp, Mus musculus
ctggcgacagccccacatgcaggcc

SEQ ID NO: 920150 - DNA, 25 bp, Mus musculus
ctggcgacagcctctgatgggcgcc

SEQ ID NO: 920151 - DNA, 25 bp, Mus musculus
ctggcgacaggcccacatgcaggcc

SEQ ID NO: 920152 - DNA, 25 bp, Mus musculus
ctggcgacaggctctgatgggcgcc

SEQ ID NO: 920153 - DNA, 25 bp, Mus musculus
ctggcgcaggagctagtatgttcaa

SEQ ID NO: 920154 - DNA, 25 bp, Mus musculus
ctggcgcaggaggtagtatgttcaa

SEQ ID NO: 920155 - DNA, 25 bp, Mus musculus
ctggcgccccacagcttgaggaggc

SEQ ID NO: 920156 - DNA, 25 bp, Mus musculus
ctggcgccccactgcttgaggaggc

SEQ ID NO: 920157 - DNA, 25 bp, Mus musculus
ctggcggagagacctgagatggtgg

SEQ ID NO: 920158 - DNA, 25 bp, Mus musculus
ctggcggagagagctgagatggtgg

SEQ ID NO: 920159 - DNA, 25 bp, Mus musculus
ctggcggcaccacgcccgggtggaa

SEQ ID NO: 920160 - DNA, 25 bp, Mus musculus
ctggcggcaccaggcccgggtggaa

SEQ ID NO: 920161 - DNA, 25 bp, Mus musculus
ctggcgggtcctgccttcttggccc

SEQ ID NO: 920162 - DNA, 25 bp, Mus musculus
ctggcgggtcctgcgttcttggccc

SEQ ID NO: 920163 - DNA, 25 bp, Mus musculus
ctggcggtaacacagtactgtttgg

SEQ ID NO: 920164 - DNA, 25 bp, Mus musculus
ctggcggtaacagagtactgtttgg

SEQ ID NO: 920165 - DNA, 25 bp, Mus musculus
ctggcgttacagccttcagtctaga

SEQ ID NO: 920166 - DNA, 25 bp, Mus musculus
ctggcgttacaggcttcagtctaga

SEQ ID NO: 920167 - DNA, 25 bp, Mus musculus
ctggcgttggatcgttacatccagg

SEQ ID NO: 920168 - DNA, 25 bp, Mus musculus
ctggcgttggatggttacatccagg

SEQ ID NO: 920169 - DNA, 25 bp, Mus musculus
ctggctagcctgctctggaagagtg

SEQ ID NO: 920170 - DNA, 25 bp, Mus musculus
ctggctagcctgctgtggaagagtg

SEQ ID NO: 920171 - DNA, 25 bp, Mus musculus
ctggctattgacaagaaggcttggg

SEQ ID NO: 920172 - DNA, 25 bp, Mus musculus
ctggctattgactccacggctgacc

SEQ ID NO: 920173 - DNA, 25 bp, Mus musculus
ctggctattggcagttatgttggcg

SEQ ID NO: 920174 - DNA, 25 bp, Mus musculus
ctggctattggctgttatgttggcg

SEQ ID NO: 920175 - DNA, 25 bp, Mus musculus
ctggctattgtcaagaaggcttggg

SEQ ID NO: 920176 - DNA, 25 bp, Mus musculus
ctggctattgtctccacggctgacc

SEQ ID NO: 920177 - DNA, 25 bp, Mus musculus
ctggctcacacagaaggacttgatc

SEQ ID NO: 920178 - DNA, 25 bp, Mus musculus
ctggctcacagagaaggacttgatc

SEQ ID NO: 920179 - DNA, 25 bp, Mus musculus
ctggctccaactcgcgtccctacag

SEQ ID NO: 920180 - DNA, 25 bp, Mus musculus
ctggctccaactggcgtccctacag

SEQ ID NO: 920181 - DNA, 25 bp, Mus musculus
ctggctccctgaggcgtacctcgga

SEQ ID NO: 920182 - DNA, 25 bp, Mus musculus
ctggctccctgaggggtacctcgga

SEQ ID NO: 920183 - DNA, 25 bp, Mus musculus
ctggctcgaacaccagaagatgatg

SEQ ID NO: 920184 - DNA, 25 bp, Mus musculus
ctggctcgaacagcagaagatgatg

SEQ ID NO: 920185 - DNA, 25 bp, Mus musculus
ctggctcgatactccatcctgcatg

SEQ ID NO: 920186 - DNA, 25 bp, Mus musculus
ctggctcgatactcgatcctgcatg

SEQ ID NO: 920187 - DNA, 25 bp, Mus musculus
ctggctcggaatcgtgatatcgata

SEQ ID NO: 920188 - DNA, 25 bp, Mus musculus
ctggctcggaatggtgatatcgata

SEQ ID NO: 920189 - DNA, 25 bp, Mus musculus
ctggctctcttcttcgtgcccgtgg

SEQ ID NO: 920190 - DNA, 25 bp, Mus musculus
ctggctctcttcttggtgcccgtgg

SEQ ID NO: 920191 - DNA, 25 bp, Mus musculus
ctggctctggcacacccggagagaa

SEQ ID NO: 920192 - DNA, 25 bp, Mus musculus
ctggctctggcacacgtgctttgcc

SEQ ID NO: 920193 - DNA, 25 bp, Mus musculus
ctggctctggcacagccggagagaa

SEQ ID NO: 920194 - DNA, 25 bp, Mus musculus
ctggctctggcacaggtgctttgcc

SEQ ID NO: 920195 - DNA, 25 bp, Mus musculus
ctggctcttaagcttcgctatcctg

SEQ ID NO: 920196 - DNA, 25 bp, Mus musculus
ctggctcttaaggttcgctatcctg

SEQ ID NO: 920197 - DNA, 25 bp, Mus musculus
ctggctcttgccgacaactggccaa

SEQ ID NO: 920198 - DNA, 25 bp, Mus musculus
ctggctcttggcgacaactggccaa

SEQ ID NO: 920199 - DNA, 25 bp, Mus musculus
ctggctgaaatgcggtggcaactca

SEQ ID NO: 920200 - DNA, 25 bp, Mus musculus
ctggctgaaatggggtggcaactca

SEQ ID NO: 920201 - DNA, 25 bp, Mus musculus
ctggctgacactcgcaccactcgcc

SEQ ID NO: 920202 - DNA, 25 bp, Mus musculus
ctggctgacactggcaccactcgcc

SEQ ID NO: 920203 - DNA, 25 bp, Mus musculus
ctggctgacatccacaggctaaagg

SEQ ID NO: 920204 - DNA, 25 bp, Mus musculus
ctggctgacatccagaggctaaagg

SEQ ID NO: 920205 - DNA, 25 bp, Mus musculus
ctggctgaccaacagtcatgcaagg

SEQ ID NO: 920206 - DNA, 25 bp, Mus musculus
ctggctgaccaagagtcatgcaagg

SEQ ID NO: 920207 - DNA, 25 bp, Mus musculus
ctggctgacccgagcggtgctcgcc

SEQ ID NO: 920208 - DNA, 25 bp, Mus musculus
ctggctgacccgtgcggtgctcgcc

SEQ ID NO: 920209 - DNA, 25 bp, Mus musculus
ctggctgaggacctcctttcttatt

SEQ ID NO: 920210 - DNA, 25 bp, Mus musculus
ctggctgaggacctcggatgggtcc

SEQ ID NO: 920211 - DNA, 25 bp, Mus musculus
ctggctgaggacgtcctttcttatt

SEQ ID NO: 920212 - DNA, 25 bp, Mus musculus
ctggctgaggacgtcggatgggtcc

SEQ ID NO: 920213 - DNA, 25 bp, Mus musculus
ctggctgaggagctggaggtccagg

SEQ ID NO: 920214 - DNA, 25 bp, Mus musculus
ctggctgaggaggtggaggtccagg

SEQ ID NO: 920215 - DNA, 25 bp, Mus musculus
ctggctgcagcaattgttggggacc

SEQ ID NO: 920216 - DNA, 25 bp, Mus musculus
ctggctgcaggaattgttggggacc

SEQ ID NO: 920217 - DNA, 25 bp, Mus musculus
ctggctgccaagaactaccatgagg

SEQ ID NO: 920218 - DNA, 25 bp, Mus musculus
ctggctgccaagaagtaccatgagg

SEQ ID NO: 920219 - DNA, 25 bp, Mus musculus
ctggctgccttccgaacgtaagctc

SEQ ID NO: 920220 - DNA, 25 bp, Mus musculus
ctggctgccttcggaacgtaagctc

SEQ ID NO: 920221 - DNA, 25 bp, Mus musculus
ctggctgctactcacagtttgctaa

SEQ ID NO: 920222 - DNA, 25 bp, Mus musculus
ctggctgctactcagagtttgctaa

SEQ ID NO: 920223 - DNA, 25 bp, Mus musculus
ctggctggaaagcccaagaccaagg

SEQ ID NO: 920224 - DNA, 25 bp, Mus musculus
ctggctggaaaggccaagaccaagg

SEQ ID NO: 920225 - DNA, 25 bp, Mus musculus
ctggctggacagctaggtgtggaat

SEQ ID NO: 920226 - DNA, 25 bp, Mus musculus
ctggctggacagcttggtgtggaat

SEQ ID NO: 920227 - DNA, 25 bp, Mus musculus
ctggctgtcaagagcttacgactcc

SEQ ID NO: 920228 - DNA, 25 bp, Mus musculus
ctggctgtcaagtgcttacgactcc

SEQ ID NO: 920229 - DNA, 25 bp, Mus musculus
ctggctgtggcttacacagccttca

SEQ ID NO: 920230 - DNA, 25 bp, Mus musculus
ctggctgtgggttacacagccttca

SEQ ID NO: 920231 - DNA, 25 bp, Mus musculus
ctggctgtgtgccgtctgttcctgc

SEQ ID NO: 920232 - DNA, 25 bp, Mus musculus
ctggctgtgtgcggtctgttcctgc

SEQ ID NO: 920233 - DNA, 25 bp, Mus musculus
ctggcttcagaaagttccggctctc

SEQ ID NO: 920234 - DNA, 25 bp, Mus musculus
ctggcttcagtaagttccggctctc

SEQ ID NO: 920235 - DNA, 25 bp, Mus musculus
ctggcttccgtatcaatttctgcca

SEQ ID NO: 920236 - DNA, 25 bp, Mus musculus
ctggcttccgtatctatttctgcca

SEQ ID NO: 920237 - DNA, 25 bp, Mus musculus
ctggcttcctcacgaacctcagctc

SEQ ID NO: 920238 - DNA, 25 bp, Mus musculus
ctggcttcctcaggaacctcagctc

SEQ ID NO: 920239 - DNA, 25 bp, Mus musculus
ctggcttcctgcctcgcacggcgca

SEQ ID NO: 920240 - DNA, 25 bp, Mus musculus
ctggcttcctgcctggcacggcgca

SEQ ID NO: 920241 - DNA, 25 bp, Mus musculus
ctggcttgcacaccggggccctggg

SEQ ID NO: 920242 - DNA, 25 bp, Mus musculus
ctggcttgcactgtgcctgcagtcc

SEQ ID NO: 920243 - DNA, 25 bp, Mus musculus
ctggcttgcagaccggggccctggg

SEQ ID NO: 920244 - DNA, 25 bp, Mus musculus
ctggcttgcagtgtgcctgcagtcc

SEQ ID NO: 920245 - DNA, 25 bp, Mus musculus
ctggctttcaagatgtggagctcct

SEQ ID NO: 920246 - DNA, 25 bp, Mus musculus
ctggctttcaagcgaacaaagaatc

SEQ ID NO: 920247 - DNA, 25 bp, Mus musculus
ctggctttcaagggaacaaagaatc

SEQ ID NO: 920248 - DNA, 25 bp, Mus musculus
ctggctttcaagttgtggagctcct

SEQ ID NO: 920249 - DNA, 25 bp, Mus musculus
ctggctttcagacgcagaaggcttg

SEQ ID NO: 920250 - DNA, 25 bp, Mus musculus
ctggctttcagaggcagaaggcttg

SEQ ID NO: 920251 - DNA, 25 bp, Mus musculus
ctggcttttagacgtttgtgaagta

SEQ ID NO: 920252 - DNA, 25 bp, Mus musculus
ctggcttttagaggtttgtgaagta

SEQ ID NO: 920253 - DNA, 25 bp, Mus musculus
ctgggaaaagcacaggatggtagca

SEQ ID NO: 920254 - DNA, 25 bp, Mus musculus
ctgggaaaagcagaggatggtagca

SEQ ID NO: 920255 - DNA, 25 bp, Mus musculus
ctgggaaaagcgtcaatgctaggtg

SEQ ID NO: 920256 - DNA, 25 bp, Mus musculus
ctgggaaaagggtcaatgctaggtg

SEQ ID NO: 920257 - DNA, 25 bp, Mus musculus
ctgggaaagaagatgaaagcagaag

SEQ ID NO: 920258 - DNA, 25 bp, Mus musculus
ctgggaaagaagttgaaagcagaag

SEQ ID NO: 920259 - DNA, 25 bp, Mus musculus
ctgggaacacatcacggagagacca

SEQ ID NO: 920260 - DNA, 25 bp, Mus musculus
ctgggaacacatcagggagagacca

SEQ ID NO: 920261 - DNA, 25 bp, Mus musculus
ctgggaacagcgtcttcttcaggag

SEQ ID NO: 920262 - DNA, 25 bp, Mus musculus
ctgggaacagggtcttcttcaggag

SEQ ID NO: 920263 - DNA, 25 bp, Mus musculus
ctgggaagagctccgtgagcgcttt

SEQ ID NO: 920264 - DNA, 25 bp, Mus musculus
ctgggaagagcttggcctgtggcat

SEQ ID NO: 920265 - DNA, 25 bp, Mus musculus
ctgggaagaggtccgtgagcgcttt

SEQ ID NO: 920266 - DNA, 25 bp, Mus musculus
ctgggaagaggttggcctgtggcat

SEQ ID NO: 920267 - DNA, 25 bp, Mus musculus
ctgggaagcacacctggctttggcc

SEQ ID NO: 920268 - DNA, 25 bp, Mus musculus
ctgggaagcacagctggctttggcc

SEQ ID NO: 920269 - DNA, 25 bp, Mus musculus
ctgggaagctgtcaccattctgcct

SEQ ID NO: 920270 - DNA, 25 bp, Mus musculus
ctgggaagctgtcacttctgagaag

SEQ ID NO: 920271 - DNA, 25 bp, Mus musculus
ctgggaagctgtcagcattctgcct

SEQ ID NO: 920272 - DNA, 25 bp, Mus musculus
ctgggaagctgtcagttctgagaag

SEQ ID NO: 920273 - DNA, 25 bp, Mus musculus
ctgggaagtgtccccagagaaacaa

SEQ ID NO: 920274 - DNA, 25 bp, Mus musculus
ctgggaagtgtcccttccaacagtg

SEQ ID NO: 920275 - DNA, 25 bp, Mus musculus
ctgggaagtgtcgccagagaaacaa

SEQ ID NO: 920276 - DNA, 25 bp, Mus musculus
ctgggaagtgtcgcttccaacagtg

SEQ ID NO: 920277 - DNA, 25 bp, Mus musculus
ctgggaattcatatgactgtgatga

SEQ ID NO: 920278 - DNA, 25 bp, Mus musculus
ctgggaattcatctctgcccggaca

SEQ ID NO: 920279 - DNA, 25 bp, Mus musculus
ctgggaattcatgtctgcccggaca

SEQ ID NO: 920280 - DNA, 25 bp, Mus musculus
ctgggaattcatttgactgtgatga

SEQ ID NO: 920281 - DNA, 25 bp, Mus musculus
ctgggaatttgcaaagcagctactg

SEQ ID NO: 920282 - DNA, 25 bp, Mus musculus
ctgggaatttgcaatgcagctactg

SEQ ID NO: 920283 - DNA, 25 bp, Mus musculus
ctgggacaaatagacgctacgagaa

SEQ ID NO: 920284 - DNA, 25 bp, Mus musculus
ctgggacaaatagaggctacgagaa

SEQ ID NO: 920285 - DNA, 25 bp, Mus musculus
ctgggacaattgaacaattgcctat

SEQ ID NO: 920286 - DNA, 25 bp, Mus musculus
ctgggacaattgactggctgtgttt

SEQ ID NO: 920287 - DNA, 25 bp, Mus musculus
ctgggacaattgtacaattgcctat

SEQ ID NO: 920288 - DNA, 25 bp, Mus musculus
ctgggacaattgtctggctgtgttt

SEQ ID NO: 920289 - DNA, 25 bp, Mus musculus
ctgggacagcaactgcctactttgg

SEQ ID NO: 920290 - DNA, 25 bp, Mus musculus
ctgggacagcaagtgcctactttgg

SEQ ID NO: 920291 - DNA, 25 bp, Mus musculus
ctgggacatgagtaactacttggtg

SEQ ID NO: 920292 - DNA, 25 bp, Mus musculus
ctgggacatgatctgattaagacgc

SEQ ID NO: 920293 - DNA, 25 bp, Mus musculus
ctgggacatgatgtgattaagacgc

SEQ ID NO: 920294 - DNA, 25 bp, Mus musculus
ctgggacatgtgcaacttcttggtg

SEQ ID NO: 920295 - DNA, 25 bp, Mus musculus
ctgggacatgtgcatcttcttggtg

SEQ ID NO: 920296 - DNA, 25 bp, Mus musculus
ctgggacatgtgtaactacttggtg

SEQ ID NO: 920297 - DNA, 25 bp, Mus musculus
ctgggaccagctctttgtctgggtt

SEQ ID NO: 920298 - DNA, 25 bp, Mus musculus
ctgggaccagctgttcttgtggata

SEQ ID NO: 920299 - DNA, 25 bp, Mus musculus
ctgggaccaggtctttgtctgggtt

SEQ ID NO: 920300 - DNA, 25 bp, Mus musculus
ctgggaccaggtgttcttgtggata

SEQ ID NO: 920301 - DNA, 25 bp, Mus musculus
ctgggaccatcccgtccaagctctc

SEQ ID NO: 920302 - DNA, 25 bp, Mus musculus
ctgggaccatccggtccaagctctc

SEQ ID NO: 920303 - DNA, 25 bp, Mus musculus
ctgggacccacaaaaccttgaggag

SEQ ID NO: 920304 - DNA, 25 bp, Mus musculus
ctgggacccagaaaaccttgaggag

SEQ ID NO: 920305 - DNA, 25 bp, Mus musculus
ctgggacccatccgagcaaatggct

SEQ ID NO: 920306 - DNA, 25 bp, Mus musculus
ctgggacccatcggagcaaatggct

SEQ ID NO: 920307 - DNA, 25 bp, Mus musculus
ctgggacctcaacactgggcagctg

SEQ ID NO: 920308 - DNA, 25 bp, Mus musculus
ctgggacctcaacagtgggcagctg

SEQ ID NO: 920309 - DNA, 25 bp, Mus musculus
ctgggacctcagctcccggaacttg

SEQ ID NO: 920310 - DNA, 25 bp, Mus musculus
ctgggacctcaggtcccggaacttg

SEQ ID NO: 920311 - DNA, 25 bp, Mus musculus
ctgggacgtgaacagcctggagtca

SEQ ID NO: 920312 - DNA, 25 bp, Mus musculus
ctgggacgtgaagagcctggagtca

SEQ ID NO: 920313 - DNA, 25 bp, Mus musculus
ctgggactaaagcggacagctgttg

SEQ ID NO: 920314 - DNA, 25 bp, Mus musculus
ctgggactaaaggggacagctgttg

SEQ ID NO: 920315 - DNA, 25 bp, Mus musculus
ctgggactcatgatcttccaaaggc

SEQ ID NO: 920316 - DNA, 25 bp, Mus musculus
ctgggactcatgttcttccaaaggc

SEQ ID NO: 920317 - DNA, 25 bp, Mus musculus
ctgggactgctgcgcccgctgctca

SEQ ID NO: 920318 - DNA, 25 bp, Mus musculus
ctgggactgctgggcccgctgctca

SEQ ID NO: 920319 - DNA, 25 bp, Mus musculus
ctgggagaacagatacaaaggatgg

SEQ ID NO: 920320 - DNA, 25 bp, Mus musculus
ctgggagaacagttacaaaggatgg

SEQ ID NO: 920321 - DNA, 25 bp, Mus musculus
ctgggagaagagcgctcacagccct

SEQ ID NO: 920322 - DNA, 25 bp, Mus musculus
ctgggagaagagcggtcacagccct

SEQ ID NO: 920323 - DNA, 25 bp, Mus musculus
ctgggagaccacaatttccatccag

SEQ ID NO: 920324 - DNA, 25 bp, Mus musculus
ctgggagaccactatttccatccag

SEQ ID NO: 920325 - DNA, 25 bp, Mus musculus
ctgggagagcagcaggtgtaaagaa

SEQ ID NO: 920326 - DNA, 25 bp, Mus musculus
ctgggagagcagcgggaacttcatt

SEQ ID NO: 920327 - DNA, 25 bp, Mus musculus
ctgggagagcaggaggtgtaaagaa

SEQ ID NO: 920328 - DNA, 25 bp, Mus musculus
ctgggagagcagggggaacttcatt

SEQ ID NO: 920329 - DNA, 25 bp, Mus musculus
ctgggagatgctatgggcgtctcca

SEQ ID NO: 920330 - DNA, 25 bp, Mus musculus
ctgggagatggtatgggcgtctcca

SEQ ID NO: 920331 - DNA, 25 bp, Mus musculus
ctgggagctttgaacatgggaaacc

SEQ ID NO: 920332 - DNA, 25 bp, Mus musculus
ctgggagctttgaagatgggaaacc

SEQ ID NO: 920333 - DNA, 25 bp, Mus musculus
ctgggaggagaacgtcctgttgagt

SEQ ID NO: 920334 - DNA, 25 bp, Mus musculus
ctgggaggagaaggtcctgttgagt

SEQ ID NO: 920335 - DNA, 25 bp, Mus musculus
ctgggaggagagcgacatgtttgtg

SEQ ID NO: 920336 - DNA, 25 bp, Mus musculus
ctgggaggagcacatattcagtgaa

SEQ ID NO: 920337 - DNA, 25 bp, Mus musculus
ctgggaggagcagatattcagtgaa

SEQ ID NO: 920338 - DNA, 25 bp, Mus musculus
ctgggaggagctggcccagagtggt

SEQ ID NO: 920339 - DNA, 25 bp, Mus musculus
ctgggaggaggtggcccagagtggt

SEQ ID NO: 920340 - DNA, 25 bp, Mus musculus
ctgggaggagtgcgacatgtttgtg

SEQ ID NO: 920341 - DNA, 25 bp, Mus musculus
ctgggaggtacacagagtgcaaacg

SEQ ID NO: 920342 - DNA, 25 bp, Mus musculus
ctgggaggtacagagagtgcaaacg

SEQ ID NO: 920343 - DNA, 25 bp, Mus musculus
ctgggagtgatccgcctgtggtcag

SEQ ID NO: 920344 - DNA, 25 bp, Mus musculus
ctgggagtgatcggcctgtggtcag

SEQ ID NO: 920345 - DNA, 25 bp, Mus musculus
ctgggagttcagcttcatgtggaca

SEQ ID NO: 920346 - DNA, 25 bp, Mus musculus
ctgggagttcaggttcatgtggaca

SEQ ID NO: 920347 - DNA, 25 bp, Mus musculus
ctgggagttgcccaagaaggaagag

SEQ ID NO: 920348 - DNA, 25 bp, Mus musculus
ctgggagttggccaagaaggaagag

SEQ ID NO: 920349 - DNA, 25 bp, Mus musculus
ctgggataagcacgacccacctgca

SEQ ID NO: 920350 - DNA, 25 bp, Mus musculus
ctgggataaggacgacccacctgca

SEQ ID NO: 920351 - DNA, 25 bp, Mus musculus
ctgggatacagtccactgccatttt

SEQ ID NO: 920352 - DNA, 25 bp, Mus musculus
ctgggatacagtgcactgccatttt

SEQ ID NO: 920353 - DNA, 25 bp, Mus musculus
ctgggatcagcgggctcattgtcct

SEQ ID NO: 920354 - DNA, 25 bp, Mus musculus
ctgggatcagggggctcattgtcct

SEQ ID NO: 920355 - DNA, 25 bp, Mus musculus
ctgggatcggcaggcacacaccata

SEQ ID NO: 920356 - DNA, 25 bp, Mus musculus
ctgggatcgggaggcacacaccata

SEQ ID NO: 920357 - DNA, 25 bp, Mus musculus
ctgggatctcacaacgggcaccacc

SEQ ID NO: 920358 - DNA, 25 bp, Mus musculus
ctgggatctcacaaggggcaccacc

SEQ ID NO: 920359 - DNA, 25 bp, Mus musculus
ctgggatgctgaagagattcagccc

SEQ ID NO: 920360 - DNA, 25 bp, Mus musculus
ctgggatgctgaagtgattcagccc

SEQ ID NO: 920361 - DNA, 25 bp, Mus musculus
ctgggatgtcaccaagttaaagtct

SEQ ID NO: 920362 - DNA, 25 bp, Mus musculus
ctgggatgtcacgaagttaaagtct

SEQ ID NO: 920363 - DNA, 25 bp, Mus musculus
ctgggatgttaacgtgcatggcggc

SEQ ID NO: 920364 - DNA, 25 bp, Mus musculus
ctgggatgttaaggtgcatggcggc

SEQ ID NO: 920365 - DNA, 25 bp, Mus musculus
ctgggattaaagatggcagactttc

SEQ ID NO: 920366 - DNA, 25 bp, Mus musculus
ctgggattaaagttggcagactttc

SEQ ID NO: 920367 - DNA, 25 bp, Mus musculus
ctgggattacagcggctgagattta

SEQ ID NO: 920368 - DNA, 25 bp, Mus musculus
ctgggattacagcttggcttcctga

SEQ ID NO: 920369 - DNA, 25 bp, Mus musculus
ctgggattacaggggctgagattta

SEQ ID NO: 920370 - DNA, 25 bp, Mus musculus
ctgggattacaggttggcttcctga

SEQ ID NO: 920371 - DNA, 25 bp, Mus musculus
ctgggattagagcagttggaaccct

SEQ ID NO: 920372 - DNA, 25 bp, Mus musculus
ctgggattagaggagttggaaccct

SEQ ID NO: 920373 - DNA, 25 bp, Mus musculus
ctgggattagcagtgccaggaggta

SEQ ID NO: 920374 - DNA, 25 bp, Mus musculus
ctgggattaggagtgccaggaggta

SEQ ID NO: 920375 - DNA, 25 bp, Mus musculus
ctgggattcctctacgagagattat

SEQ ID NO: 920376 - DNA, 25 bp, Mus musculus
ctgggattcctctaggagagattat

SEQ ID NO: 920377 - DNA, 25 bp, Mus musculus
ctgggattgcagatttcaaagatac

SEQ ID NO: 920378 - DNA, 25 bp, Mus musculus
ctgggattgcagttttcaaagatac

SEQ ID NO: 920379 - DNA, 25 bp, Mus musculus
ctgggatttagtctcgcgtgtgcag

SEQ ID NO: 920380 - DNA, 25 bp, Mus musculus
ctgggatttagtctggcgtgtgcag

SEQ ID NO: 920381 - DNA, 25 bp, Mus musculus
ctgggatttgtccccagagagacaa

SEQ ID NO: 920382 - DNA, 25 bp, Mus musculus
ctgggatttgtcgccagagagacaa

SEQ ID NO: 920383 - DNA, 25 bp, Mus musculus
ctgggcaaagagctgcgtgagcaca

SEQ ID NO: 920384 - DNA, 25 bp, Mus musculus
ctgggcaaagaggtgcgtgagcaca

SEQ ID NO: 920385 - DNA, 25 bp, Mus musculus
ctgggcaagcttcaaggacatccac

SEQ ID NO: 920386 - DNA, 25 bp, Mus musculus
ctgggcaagcttcatggacatccac

SEQ ID NO: 920387 - DNA, 25 bp, Mus musculus
ctgggcacacagcccagcggtgtga

SEQ ID NO: 920388 - DNA, 25 bp, Mus musculus
ctgggcacacaggccagcggtgtga

SEQ ID NO: 920389 - DNA, 25 bp, Mus musculus
ctgggcacagaccgcgggacagtgc

SEQ ID NO: 920390 - DNA, 25 bp, Mus musculus
ctgggcacagtccgcgggacagtgc

SEQ ID NO: 920391 - DNA, 25 bp, Mus musculus
ctgggcacctggtccgatacatcat

SEQ ID NO: 920392 - DNA, 25 bp, Mus musculus
ctgggcacctggtcggatacatcat

SEQ ID NO: 920393 - DNA, 25 bp, Mus musculus
ctgggcacgggaccctatgggaagg

SEQ ID NO: 920394 - DNA, 25 bp, Mus musculus
ctgggcacgggactccgggtttgca

SEQ ID NO: 920395 - DNA, 25 bp, Mus musculus
ctgggcacgggagcctatgggaagg

SEQ ID NO: 920396 - DNA, 25 bp, Mus musculus
ctgggcacgggagtccgggtttgca

SEQ ID NO: 920397 - DNA, 25 bp, Mus musculus
ctgggcactttccactcaaccaagg

SEQ ID NO: 920398 - DNA, 25 bp, Mus musculus
ctgggcactttccagtcaaccaagg

SEQ ID NO: 920399 - DNA, 25 bp, Mus musculus
ctgggcagaggtcgtgctctctgat

SEQ ID NO: 920400 - DNA, 25 bp, Mus musculus
ctgggcagaggtggtgctctctgat

SEQ ID NO: 920401 - DNA, 25 bp, Mus musculus
ctgggcatctcactccaatgcctgt

SEQ ID NO: 920402 - DNA, 25 bp, Mus musculus
ctgggcatctcactcgtggagctgg

SEQ ID NO: 920403 - DNA, 25 bp, Mus musculus
ctgggcatctcactgcaatgcctgt

SEQ ID NO: 920404 - DNA, 25 bp, Mus musculus
ctgggcatctcactggtggagctgg

SEQ ID NO: 920405 - DNA, 25 bp, Mus musculus
ctgggcatgaagctcagtgaagatg

SEQ ID NO: 920406 - DNA, 25 bp, Mus musculus
ctgggcatgaagctgagtgaagatg

SEQ ID NO: 920407 - DNA, 25 bp, Mus musculus
ctgggcatttggcacacagcaggtt

SEQ ID NO: 920408 - DNA, 25 bp, Mus musculus
ctgggcatttgggacacagcaggtt

SEQ ID NO: 920409 - DNA, 25 bp, Mus musculus
ctgggccaagagagccaagcagagg

SEQ ID NO: 920410 - DNA, 25 bp, Mus musculus
ctgggccaagagtgccaagcagagg

SEQ ID NO: 920411 - DNA, 25 bp, Mus musculus
ctgggccaatcaaaaccaactctac

SEQ ID NO: 920412 - DNA, 25 bp, Mus musculus
ctgggccaatgaaaaccaactctac

SEQ ID NO: 920413 - DNA, 25 bp, Mus musculus
ctgggccaattctgcaccaccaagg

SEQ ID NO: 920414 - DNA, 25 bp, Mus musculus
ctgggccaattctggaccaccaagg

SEQ ID NO: 920415 - DNA, 25 bp, Mus musculus
ctgggccacacacgggaatatgggt

SEQ ID NO: 920416 - DNA, 25 bp, Mus musculus
ctgggccacacaggggaatatgggt

SEQ ID NO: 920417 - DNA, 25 bp, Mus musculus
ctgggccacgaaagaaaatgaacag

SEQ ID NO: 920418 - DNA, 25 bp, Mus musculus
ctgggccacgcagcagctgaaggcc

SEQ ID NO: 920419 - DNA, 25 bp, Mus musculus
ctgggccacggagcagctgaaggcc

SEQ ID NO: 920420 - DNA, 25 bp, Mus musculus
ctgggccacgtaagaaaatgaacag

SEQ ID NO: 920421 - DNA, 25 bp, Mus musculus
ctgggccagccgcgctctactcctt

SEQ ID NO: 920422 - DNA, 25 bp, Mus musculus
ctgggccagccgggctctactcctt

SEQ ID NO: 920423 - DNA, 25 bp, Mus musculus
ctgggccagctcaacgagcattgcc

SEQ ID NO: 920424 - DNA, 25 bp, Mus musculus
ctgggccagctcaaggagcattgcc

SEQ ID NO: 920425 - DNA, 25 bp, Mus musculus
ctgggccatgcgccgggagggtgtg

SEQ ID NO: 920426 - DNA, 25 bp, Mus musculus
ctgggccatggacggaggcacagac

SEQ ID NO: 920427 - DNA, 25 bp, Mus musculus
ctgggccatggagggaggcacagac

SEQ ID NO: 920428 - DNA, 25 bp, Mus musculus
ctgggccatgggccgggagggtgtg

SEQ ID NO: 920429 - DNA, 25 bp, Mus musculus
ctgggcccagcaactgcataggaca

SEQ ID NO: 920430 - DNA, 25 bp, Mus musculus
ctgggcccaggaactgcataggaca

SEQ ID NO: 920431 - DNA, 25 bp, Mus musculus
ctgggccccgctgaaagctatgaac

SEQ ID NO: 920432 - DNA, 25 bp, Mus musculus
ctgggccccggtgaaagctatgaac

SEQ ID NO: 920433 - DNA, 25 bp, Mus musculus
ctgggcctccctctcatcgatgagg

SEQ ID NO: 920434 - DNA, 25 bp, Mus musculus
ctgggcctccctctgatcgatgagg

SEQ ID NO: 920435 - DNA, 25 bp, Mus musculus
ctgggccttcagatttgatgagatg

SEQ ID NO: 920436 - DNA, 25 bp, Mus musculus
ctgggccttcagttttgatgagatg

SEQ ID NO: 920437 - DNA, 25 bp, Mus musculus
ctgggccttctacacagcgtgggtt

SEQ ID NO: 920438 - DNA, 25 bp, Mus musculus
ctgggccttctagacagcgtgggtt

SEQ ID NO: 920439 - DNA, 25 bp, Mus musculus
ctgggccttgggcgcctgggctggt

SEQ ID NO: 920440 - DNA, 25 bp, Mus musculus
ctgggccttgggggcctgggctggt

SEQ ID NO: 920441 - DNA, 25 bp, Mus musculus
ctgggcgatgggccactggctccag

SEQ ID NO: 920442 - DNA, 25 bp, Mus musculus
ctgggcgatggggcactggctccag

SEQ ID NO: 920443 - DNA, 25 bp, Mus musculus
ctgggcgattctgacgcactcctcc

SEQ ID NO: 920444 - DNA, 25 bp, Mus musculus
ctgggcgattctgaggcactcctcc

SEQ ID NO: 920445 - DNA, 25 bp, Mus musculus
ctgggcgcaccgcgaaagatgaagc

SEQ ID NO: 920446 - DNA, 25 bp, Mus musculus
ctgggcgcacggcgaaagatgaagc

SEQ ID NO: 920447 - DNA, 25 bp, Mus musculus
ctgggcgcgcagcatgcacctggcc

SEQ ID NO: 920448 - DNA, 25 bp, Mus musculus
ctgggcgcgcaggatgcacctggcc

SEQ ID NO: 920449 - DNA, 25 bp, Mus musculus
ctgggcggcggggacgacttgcact

SEQ ID NO: 920450 - DNA, 25 bp, Mus musculus
ctgggcggcggggaggacttgcact

SEQ ID NO: 920451 - DNA, 25 bp, Mus musculus
ctgggctactggagacatggaagct

SEQ ID NO: 920452 - DNA, 25 bp, Mus musculus
ctgggctactggtgacatggaagct

SEQ ID NO: 920453 - DNA, 25 bp, Mus musculus
ctgggctatctagacatgttcgttc

SEQ ID NO: 920454 - DNA, 25 bp, Mus musculus
ctgggctatctagagatgttcgttc

SEQ ID NO: 920455 - DNA, 25 bp, Mus musculus
ctgggctccttccacggctttgtgg

SEQ ID NO: 920456 - DNA, 25 bp, Mus musculus
ctgggctccttccagggctttgtgg

SEQ ID NO: 920457 - DNA, 25 bp, Mus musculus
ctgggctctacgcgtgacaccaggt

SEQ ID NO: 920458 - DNA, 25 bp, Mus musculus
ctgggctctacgggtgacaccaggt

SEQ ID NO: 920459 - DNA, 25 bp, Mus musculus
ctgggctctggacgcttcattggtt

SEQ ID NO: 920460 - DNA, 25 bp, Mus musculus
ctgggctctggaggcttcattggtt

SEQ ID NO: 920461 - DNA, 25 bp, Mus musculus
ctgggctctgtgcgggcagctggca

SEQ ID NO: 920462 - DNA, 25 bp, Mus musculus
ctgggctctgtgggggcagctggca

SEQ ID NO: 920463 - DNA, 25 bp, Mus musculus
ctgggctgagatgaggtgccacttc

SEQ ID NO: 920464 - DNA, 25 bp, Mus musculus
ctgggctgagcaaattcaagctggt

SEQ ID NO: 920465 - DNA, 25 bp, Mus musculus
ctgggctgaggaaattcaagctggt

SEQ ID NO: 920466 - DNA, 25 bp, Mus musculus
ctgggctgagttgaggtgccacttc

SEQ ID NO: 920467 - DNA, 25 bp, Mus musculus
ctgggctgcaagagggtgctgtacc

SEQ ID NO: 920468 - DNA, 25 bp, Mus musculus
ctgggctgcaagtgggtgctgtacc

SEQ ID NO: 920469 - DNA, 25 bp, Mus musculus
ctgggcttccagatcacacctgcca

SEQ ID NO: 920470 - DNA, 25 bp, Mus musculus
ctgggcttccagttcacacctgcca

SEQ ID NO: 920471 - DNA, 25 bp, Mus musculus
ctggggaaagcagtgctgaaggctg

SEQ ID NO: 920472 - DNA, 25 bp, Mus musculus
ctggggaaagcctactcaaaaagag

SEQ ID NO: 920473 - DNA, 25 bp, Mus musculus
ctggggaaaggagtgctgaaggctg

SEQ ID NO: 920474 - DNA, 25 bp, Mus musculus
ctggggaaaggctactcaaaaagag

SEQ ID NO: 920475 - DNA, 25 bp, Mus musculus
ctggggaaggagcgagtcaccacct

SEQ ID NO: 920476 - DNA, 25 bp, Mus musculus
ctggggaaggagggagtcaccacct

SEQ ID NO: 920477 - DNA, 25 bp, Mus musculus
ctggggacaaagctggaaatggtgt

SEQ ID NO: 920478 - DNA, 25 bp, Mus musculus
ctggggacaaaggtggaaatggtgt

SEQ ID NO: 920479 - DNA, 25 bp, Mus musculus
ctggggacagaattgccctagaagg

SEQ ID NO: 920480 - DNA, 25 bp, Mus musculus
ctggggacagatgtggctggtggct

SEQ ID NO: 920481 - DNA, 25 bp, Mus musculus
ctggggacagtattgccctagaagg

SEQ ID NO: 920482 - DNA, 25 bp, Mus musculus
ctggggacagttgtggctggtggct

SEQ ID NO: 920483 - DNA, 25 bp, Mus musculus
ctggggacttggcgacggctgttct

SEQ ID NO: 920484 - DNA, 25 bp, Mus musculus
ctggggacttggggacggctgttct

SEQ ID NO: 920485 - DNA, 25 bp, Mus musculus
ctggggagagagctcagttacatgc

SEQ ID NO: 920486 - DNA, 25 bp, Mus musculus
ctggggagagtgctcagttacatgc

SEQ ID NO: 920487 - DNA, 25 bp, Mus musculus
ctggggaggaagctgacctggctgc

SEQ ID NO: 920488 - DNA, 25 bp, Mus musculus
ctggggaggaaggtgacctggctgc

SEQ ID NO: 920489 - DNA, 25 bp, Mus musculus
ctggggatcatgacggtcacacagc

SEQ ID NO: 920490 - DNA, 25 bp, Mus musculus
ctggggatcatgtcggtcacacagc

SEQ ID NO: 920491 - DNA, 25 bp, Mus musculus
ctggggattcttcaccacaggggat

SEQ ID NO: 920492 - DNA, 25 bp, Mus musculus
ctggggattcttcagcacaggggat

SEQ ID NO: 920493 - DNA, 25 bp, Mus musculus
ctggggccagctcatcgccaccatc

SEQ ID NO: 920494 - DNA, 25 bp, Mus musculus
ctggggccaggtcatcgccaccatc

SEQ ID NO: 920495 - DNA, 25 bp, Mus musculus
ctggggcgcatgaggttggctggca

SEQ ID NO: 920496 - DNA, 25 bp, Mus musculus
ctggggcgcatgtggttggctggca

SEQ ID NO: 920497 - DNA, 25 bp, Mus musculus
ctggggctggagctcaggagattat

SEQ ID NO: 920498 - DNA, 25 bp, Mus musculus
ctggggctggagctgaggagattat

SEQ ID NO: 920499 - DNA, 25 bp, Mus musculus
ctggggcttactcacgatgtcaatg

SEQ ID NO: 920500 - DNA, 25 bp, Mus musculus
ctggggcttactcaggatgtcaatg

SEQ ID NO: 920501 - DNA, 25 bp, Mus musculus
ctggggcttgcaacatgggtgacct

SEQ ID NO: 920502 - DNA, 25 bp, Mus musculus
ctggggcttggaacatgggtgacct

SEQ ID NO: 920503 - DNA, 25 bp, Mus musculus
ctgggggacctcagaaggtctatat

SEQ ID NO: 920504 - DNA, 25 bp, Mus musculus
ctgggggacctctgaaggtctatat

SEQ ID NO: 920505 - DNA, 25 bp, Mus musculus
ctgggggccaagagctcaccgagtc

SEQ ID NO: 920506 - DNA, 25 bp, Mus musculus
ctgggggccaagtgctcaccgagtc

SEQ ID NO: 920507 - DNA, 25 bp, Mus musculus
ctggggtcactgccaatggagaggc

SEQ ID NO: 920508 - DNA, 25 bp, Mus musculus
ctggggtcactgcctatggagaggc

SEQ ID NO: 920509 - DNA, 25 bp, Mus musculus
ctggggtgaacccatacactgggac

SEQ ID NO: 920510 - DNA, 25 bp, Mus musculus
ctggggtgaaccgatacactgggac

SEQ ID NO: 920511 - DNA, 25 bp, Mus musculus
ctggggtggaaaagcggagactgag

SEQ ID NO: 920512 - DNA, 25 bp, Mus musculus
ctggggtggaaatgcggagactgag

SEQ ID NO: 920513 - DNA, 25 bp, Mus musculus
ctggggtgtctgcggctggattgcc

SEQ ID NO: 920514 - DNA, 25 bp, Mus musculus
ctggggtgtctggggctggattgcc

SEQ ID NO: 920515 - DNA, 25 bp, Mus musculus
ctgggtatcaaaatatgaaaaatac

SEQ ID NO: 920516 - DNA, 25 bp, Mus musculus
ctgggtatcaaattatgaaaaatac

SEQ ID NO: 920517 - DNA, 25 bp, Mus musculus
ctgggtcgcaggaggcatgcactat

SEQ ID NO: 920518 - DNA, 25 bp, Mus musculus
ctgggtcgcaggtggcatgcactat

SEQ ID NO: 920519 - DNA, 25 bp, Mus musculus
ctgggtcggaagatttaggcccgca

SEQ ID NO: 920520 - DNA, 25 bp, Mus musculus
ctgggtcggaagttttaggcccgca

SEQ ID NO: 920521 - DNA, 25 bp, Mus musculus
ctgggtctcgcaactgcctacattc

SEQ ID NO: 920522 - DNA, 25 bp, Mus musculus
ctgggtctcggaactgcctacattc

SEQ ID NO: 920523 - DNA, 25 bp, Mus musculus
ctgggtctctgcagagctatggggc

SEQ ID NO: 920524 - DNA, 25 bp, Mus musculus
ctgggtctctgcagtgctatggggc

SEQ ID NO: 920525 - DNA, 25 bp, Mus musculus
ctgggtgagccgcgagccaaaggtg

SEQ ID NO: 920526 - DNA, 25 bp, Mus musculus
ctgggtgagccgggagccaaaggtg

SEQ ID NO: 920527 - DNA, 25 bp, Mus musculus
ctgggtgataataacgacaaccgga

SEQ ID NO: 920528 - DNA, 25 bp, Mus musculus
ctgggtgataataactttctgaggg

SEQ ID NO: 920529 - DNA, 25 bp, Mus musculus
ctgggtgataataaggacaaccgga

SEQ ID NO: 920530 - DNA, 25 bp, Mus musculus
ctgggtgataataagtttctgaggg

SEQ ID NO: 920531 - DNA, 25 bp, Mus musculus
ctgggtgcagggcgaacagctgtgc

SEQ ID NO: 920532 - DNA, 25 bp, Mus musculus
ctgggtgcagggctgtgccccagag

SEQ ID NO: 920533 - DNA, 25 bp, Mus musculus
ctgggtgcagggggaacagctgtgc

SEQ ID NO: 920534 - DNA, 25 bp, Mus musculus
ctgggtgcaggggtgtgccccagag

SEQ ID NO: 920535 - DNA, 25 bp, Mus musculus
ctgggtgcccggcatgaaagtggga

SEQ ID NO: 920536 - DNA, 25 bp, Mus musculus
ctgggtgcccgggatgaaagtggga

SEQ ID NO: 920537 - DNA, 25 bp, Mus musculus
ctgggtggacagctgagcaatgcca

SEQ ID NO: 920538 - DNA, 25 bp, Mus musculus
ctgggtggacaggtgagcaatgcca

SEQ ID NO: 920539 - DNA, 25 bp, Mus musculus
ctgggtggtaaagactgacatcctg

SEQ ID NO: 920540 - DNA, 25 bp, Mus musculus
ctgggtggtaaagagtgacatcctg

SEQ ID NO: 920541 - DNA, 25 bp, Mus musculus
ctgggtgtcattctctacatgatgc

SEQ ID NO: 920542 - DNA, 25 bp, Mus musculus
ctgggtgtcattctgtacatgatgc

SEQ ID NO: 920543 - DNA, 25 bp, Mus musculus
ctgggtgtccagacgctgcggccag

SEQ ID NO: 920544 - DNA, 25 bp, Mus musculus
ctgggtgtccagtcgctgcggccag

SEQ ID NO: 920545 - DNA, 25 bp, Mus musculus
ctgggttcctctcggcttcgtgctg

SEQ ID NO: 920546 - DNA, 25 bp, Mus musculus
ctgggttcctctgggcttcgtgctg

SEQ ID NO: 920547 - DNA, 25 bp, Mus musculus
ctgggttcggacccagcaatgtccc

SEQ ID NO: 920548 - DNA, 25 bp, Mus musculus
ctgggttcggtcccagcaatgtccc

SEQ ID NO: 920549 - DNA, 25 bp, Mus musculus
ctgggtttgccgcattatcacaaaa

SEQ ID NO: 920550 - DNA, 25 bp, Mus musculus
ctgggtttgccggattatcacaaaa

SEQ ID NO: 920551 - DNA, 25 bp, Mus musculus
ctggtaaagagaagagaattaattt

SEQ ID NO: 920552 - DNA, 25 bp, Mus musculus
ctggtaaagagaagtgaattaattt

SEQ ID NO: 920553 - DNA, 25 bp, Mus musculus
ctggtaacagcacttaccagctctt

SEQ ID NO: 920554 - DNA, 25 bp, Mus musculus
ctggtaacagcagttaccagctctt

SEQ ID NO: 920555 - DNA, 25 bp, Mus musculus
ctggtaaccagtccggcggtggaga

SEQ ID NO: 920556 - DNA, 25 bp, Mus musculus
ctggtaaccagtgcggcggtggaga

SEQ ID NO: 920557 - DNA, 25 bp, Mus musculus
ctggtacagaccatattaaccagct

SEQ ID NO: 920558 - DNA, 25 bp, Mus musculus
ctggtacagaccatattgatcagtt

SEQ ID NO: 920559 - DNA, 25 bp, Mus musculus
ctggtacagaccttattaaccagct

SEQ ID NO: 920560 - DNA, 25 bp, Mus musculus
ctggtacagaccttattgatcagtt

SEQ ID NO: 920561 - DNA, 25 bp, Mus musculus
ctggtacagtatgctgtgtcccaca

SEQ ID NO: 920562 - DNA, 25 bp, Mus musculus
ctggtacagtttgctgtgtcccaca

SEQ ID NO: 920563 - DNA, 25 bp, Mus musculus
ctggtaccagcaccagcgagcacat

SEQ ID NO: 920564 - DNA, 25 bp, Mus musculus
ctggtaccaggaccagcgagcacat

SEQ ID NO: 920565 - DNA, 25 bp, Mus musculus
ctggtacccgagctgatgtacctca

SEQ ID NO: 920566 - DNA, 25 bp, Mus musculus
ctggtacccgtgctgatgtacctca

SEQ ID NO: 920567 - DNA, 25 bp, Mus musculus
ctggtacctgatcatcaatgctgtg

SEQ ID NO: 920568 - DNA, 25 bp, Mus musculus
ctggtacctgttcatcaatgctgtg

SEQ ID NO: 920569 - DNA, 25 bp, Mus musculus
ctggtactcacaccgcatgactaca

SEQ ID NO: 920570 - DNA, 25 bp, Mus musculus
ctggtactcacactgcggtccaacc

SEQ ID NO: 920571 - DNA, 25 bp, Mus musculus
ctggtactcacagcgcatgactaca

SEQ ID NO: 920572 - DNA, 25 bp, Mus musculus
ctggtactcacagtgcggtccaacc

SEQ ID NO: 920573 - DNA, 25 bp, Mus musculus
ctggtagaaggcaacgacctgagca

SEQ ID NO: 920574 - DNA, 25 bp, Mus musculus
ctggtagaaggcaaggacctgagca

SEQ ID NO: 920575 - DNA, 25 bp, Mus musculus
ctggtagcccagcccaccatggcag

SEQ ID NO: 920576 - DNA, 25 bp, Mus musculus
ctggtagcccaggccaccatggcag

SEQ ID NO: 920577 - DNA, 25 bp, Mus musculus
ctggtagctcagatctttggtttgg

SEQ ID NO: 920578 - DNA, 25 bp, Mus musculus
ctggtagctcagttctttggtttgg

SEQ ID NO: 920579 - DNA, 25 bp, Mus musculus
ctggtaggcaaagacggacaactga

SEQ ID NO: 920580 - DNA, 25 bp, Mus musculus
ctggtaggcaaagagggacaactga

SEQ ID NO: 920581 - DNA, 25 bp, Mus musculus
ctggtataagctcatattaagcatt

SEQ ID NO: 920582 - DNA, 25 bp, Mus musculus
ctggtataaggtcatattaagcatt

SEQ ID NO: 920583 - DNA, 25 bp, Mus musculus
ctggtataccccacaagccaagcgt

SEQ ID NO: 920584 - DNA, 25 bp, Mus musculus
ctggtataccccactagccaagcgt

SEQ ID NO: 920585 - DNA, 25 bp, Mus musculus
ctggtataggaagcagcctgatgca

SEQ ID NO: 920586 - DNA, 25 bp, Mus musculus
ctggtataggaagctgcctgatgca

SEQ ID NO: 920587 - DNA, 25 bp, Mus musculus
ctggtatcaactctgtaaggagaag

SEQ ID NO: 920588 - DNA, 25 bp, Mus musculus
ctggtatcaactgtgtaaggagaag

SEQ ID NO: 920589 - DNA, 25 bp, Mus musculus
ctggtatcagcatcagcgatcccat

SEQ ID NO: 920590 - DNA, 25 bp, Mus musculus
ctggtatcaggatcagcgatcccat

SEQ ID NO: 920591 - DNA, 25 bp, Mus musculus
ctggtatctgaacacgctcatgatc

SEQ ID NO: 920592 - DNA, 25 bp, Mus musculus
ctggtatctgaagacgctcatgatc

SEQ ID NO: 920593 - DNA, 25 bp, Mus musculus
ctggtatgagcacggcatccttgag

SEQ ID NO: 920594 - DNA, 25 bp, Mus musculus
ctggtatgagcagggcatccttgag

SEQ ID NO: 920595 - DNA, 25 bp, Mus musculus
ctggtatttgagagctagtgattta

SEQ ID NO: 920596 - DNA, 25 bp, Mus musculus
ctggtatttgagaggtagtgattta

SEQ ID NO: 920597 - DNA, 25 bp, Mus musculus
ctggtcaaagccatcatcgacagta

SEQ ID NO: 920598 - DNA, 25 bp, Mus musculus
ctggtcaaaggcatcatcgacagta

SEQ ID NO: 920599 - DNA, 25 bp, Mus musculus
ctggtcaacacaaaacacagatact

SEQ ID NO: 920600 - DNA, 25 bp, Mus musculus
ctggtcaacacataacacagatact

SEQ ID NO: 920601 - DNA, 25 bp, Mus musculus
ctggtcaatgagaaacctttgaagg

SEQ ID NO: 920602 - DNA, 25 bp, Mus musculus
ctggtcaatgagtaacctttgaagg

SEQ ID NO: 920603 - DNA, 25 bp, Mus musculus
ctggtcacagagatctttcagaaac

SEQ ID NO: 920604 - DNA, 25 bp, Mus musculus
ctggtcacagagttctttcagaaac

SEQ ID NO: 920605 - DNA, 25 bp, Mus musculus
ctggtcactgaacacgttgctccag

SEQ ID NO: 920606 - DNA, 25 bp, Mus musculus
ctggtcactgaacaggttgctccag

SEQ ID NO: 920607 - DNA, 25 bp, Mus musculus
ctggtcagcaagaatgcctttgtgt

SEQ ID NO: 920608 - DNA, 25 bp, Mus musculus
ctggtcagcaagtatgcctttgtgt

SEQ ID NO: 920609 - DNA, 25 bp, Mus musculus
ctggtcagccagagccaagctgtgg

SEQ ID NO: 920610 - DNA, 25 bp, Mus musculus
ctggtcagccagtgccaagctgtgg

SEQ ID NO: 920611 - DNA, 25 bp, Mus musculus
ctggtcagtgcgagctcaaccttgt

SEQ ID NO: 920612 - DNA, 25 bp, Mus musculus
ctggtcagtgggagctcaaccttgt

SEQ ID NO: 920613 - DNA, 25 bp, Mus musculus
ctggtcatcgagctcctcagtcagg

SEQ ID NO: 920614 - DNA, 25 bp, Mus musculus
ctggtcatcgaggtcctcagtcagg

SEQ ID NO: 920615 - DNA, 25 bp, Mus musculus
ctggtcattagacgtttggccaagt

SEQ ID NO: 920616 - DNA, 25 bp, Mus musculus
ctggtcattagaggtttggccaagt

SEQ ID NO: 920617 - DNA, 25 bp, Mus musculus
ctggtccagatgcggaaagatgcca

SEQ ID NO: 920618 - DNA, 25 bp, Mus musculus
ctggtccagatggggaaagatgcca

SEQ ID NO: 920619 - DNA, 25 bp, Mus musculus
ctggtccgagaacgtgagattgcca

SEQ ID NO: 920620 - DNA, 25 bp, Mus musculus
ctggtccgagaaggtgagattgcca

SEQ ID NO: 920621 - DNA, 25 bp, Mus musculus
ctggtccgagcgctactgacagtcg

SEQ ID NO: 920622 - DNA, 25 bp, Mus musculus
ctggtccgagggctactgacagtcg

SEQ ID NO: 920623 - DNA, 25 bp, Mus musculus
ctggtccgcaaaggcatgccattcc

SEQ ID NO: 920624 - DNA, 25 bp, Mus musculus
ctggtccgcaaagggatgccattcc

SEQ ID NO: 920625 - DNA, 25 bp, Mus musculus
ctggtcctcaaacgtggccagagcc

SEQ ID NO: 920626 - DNA, 25 bp, Mus musculus
ctggtcctcaaaggtggccagagcc

SEQ ID NO: 920627 - DNA, 25 bp, Mus musculus
ctggtccttcagcgcttgtaccagc

SEQ ID NO: 920628 - DNA, 25 bp, Mus musculus
ctggtccttcagggcttgtaccagc

SEQ ID NO: 920629 - DNA, 25 bp, Mus musculus
ctggtctaaagaatcagaagtactc

SEQ ID NO: 920630 - DNA, 25 bp, Mus musculus
ctggtctaaagattcagaagtactc

SEQ ID NO: 920631 - DNA, 25 bp, Mus musculus
ctggtctcagctaatctccaaaaaa

SEQ ID NO: 920632 - DNA, 25 bp, Mus musculus
ctggtctcaggtaatctccaaaaaa

SEQ ID NO: 920633 - DNA, 25 bp, Mus musculus
ctggtctctgtgcctctttctcatc

SEQ ID NO: 920634 - DNA, 25 bp, Mus musculus
ctggtctctgtggctctttctcatc

SEQ ID NO: 920635 - DNA, 25 bp, Mus musculus
ctggtctcttccttacacatgatga

SEQ ID NO: 920636 - DNA, 25 bp, Mus musculus
ctggtctcttcctttcacatgatga

SEQ ID NO: 920637 - DNA, 25 bp, Mus musculus
ctggtcttagcttcttgattgtcta

SEQ ID NO: 920638 - DNA, 25 bp, Mus musculus
ctggtcttaggttcttgattgtcta

SEQ ID NO: 920639 - DNA, 25 bp, Mus musculus
ctggtctttgagcacgtcagattgc

SEQ ID NO: 920640 - DNA, 25 bp, Mus musculus
ctggtctttgagcaggtcagattgc

SEQ ID NO: 920641 - DNA, 25 bp, Mus musculus
ctggtgaactatgtgtctgatgttc

SEQ ID NO: 920642 - DNA, 25 bp, Mus musculus
ctggtgaactttgtgtctgatgttc

SEQ ID NO: 920643 - DNA, 25 bp, Mus musculus
ctggtgaaggaacgcaagatctcag

SEQ ID NO: 920644 - DNA, 25 bp, Mus musculus
ctggtgaaggaaggcaagatctcag

SEQ ID NO: 920645 - DNA, 25 bp, Mus musculus
ctggtgacaaaatacgaatgatcga

SEQ ID NO: 920646 - DNA, 25 bp, Mus musculus
ctggtgacaaaataggaatgatcga

SEQ ID NO: 920647 - DNA, 25 bp, Mus musculus
ctggtgagagcaagctttgtctcct

SEQ ID NO: 920648 - DNA, 25 bp, Mus musculus
ctggtgagaggaagctttgtctcct

SEQ ID NO: 920649 - DNA, 25 bp, Mus musculus
ctggtgcaagagaactgaacatcgt

SEQ ID NO: 920650 - DNA, 25 bp, Mus musculus
ctggtgcaagagagtgtccaagcac

SEQ ID NO: 920651 - DNA, 25 bp, Mus musculus
ctggtgcaagagcgatacccctgaa

SEQ ID NO: 920652 - DNA, 25 bp, Mus musculus
ctggtgcaagagctagaactgaaca

SEQ ID NO: 920653 - DNA, 25 bp, Mus musculus
ctggtgcaagagggatacccctgaa

SEQ ID NO: 920654 - DNA, 25 bp, Mus musculus
ctggtgcaagaggtagaactgaaca

SEQ ID NO: 920655 - DNA, 25 bp, Mus musculus
ctggtgcaagagtactgaacatcgt

SEQ ID NO: 920656 - DNA, 25 bp, Mus musculus
ctggtgcaagagtgtgtccaagcac

SEQ ID NO: 920657 - DNA, 25 bp, Mus musculus
ctggtgccagagcgatgctaccacg

SEQ ID NO: 920658 - DNA, 25 bp, Mus musculus
ctggtgccagagggatgctaccacg

SEQ ID NO: 920659 - DNA, 25 bp, Mus musculus
ctggtgccagccccagattagatct

SEQ ID NO: 920660 - DNA, 25 bp, Mus musculus
ctggtgccagctctaggaatgattc

SEQ ID NO: 920661 - DNA, 25 bp, Mus musculus
ctggtgccaggcccagattagatct

SEQ ID NO: 920662 - DNA, 25 bp, Mus musculus
ctggtgccaggtctaggaatgattc

SEQ ID NO: 920663 - DNA, 25 bp, Mus musculus
ctggtgcctcatcagtggacaactg

SEQ ID NO: 920664 - DNA, 25 bp, Mus musculus
ctggtgcctcatgagtggacaactg

SEQ ID NO: 920665 - DNA, 25 bp, Mus musculus
ctggtgcgagtcctaaggaaccaga

SEQ ID NO: 920666 - DNA, 25 bp, Mus musculus
ctggtgcgagtcctagaaccagact

SEQ ID NO: 920667 - DNA, 25 bp, Mus musculus
ctggtgcgagtccttaggaaccaga

SEQ ID NO: 920668 - DNA, 25 bp, Mus musculus
ctggtgcgagtccttgaaccagact

SEQ ID NO: 920669 - DNA, 25 bp, Mus musculus
ctggtgctagcacaggttagtgtct

SEQ ID NO: 920670 - DNA, 25 bp, Mus musculus
ctggtgctagcagtggcctgcagtg

SEQ ID NO: 920671 - DNA, 25 bp, Mus musculus
ctggtgctagctggtgaagacacac

SEQ ID NO: 920672 - DNA, 25 bp, Mus musculus
ctggtgctaggacaggttagtgtct

SEQ ID NO: 920673 - DNA, 25 bp, Mus musculus
ctggtgctaggagtggcctgcagtg

SEQ ID NO: 920674 - DNA, 25 bp, Mus musculus
ctggtgctaggtggtgaagacacac

SEQ ID NO: 920675 - DNA, 25 bp, Mus musculus
ctggtgctgcccatcgcactggagc

SEQ ID NO: 920676 - DNA, 25 bp, Mus musculus
ctggtgctgcccatggcactggagc

SEQ ID NO: 920677 - DNA, 25 bp, Mus musculus
ctggtggaagcaggcaggattgacc

SEQ ID NO: 920678 - DNA, 25 bp, Mus musculus
ctggtggaaggaggcaggattgacc

SEQ ID NO: 920679 - DNA, 25 bp, Mus musculus
ctggtggaagtccccctgttatgag

SEQ ID NO: 920680 - DNA, 25 bp, Mus musculus
ctggtggaagtcgccctgttatgag

SEQ ID NO: 920681 - DNA, 25 bp, Mus musculus
ctggtggagacgccttgtccggatg

SEQ ID NO: 920682 - DNA, 25 bp, Mus musculus
ctggtggagacggcttgtccggatg

SEQ ID NO: 920683 - DNA, 25 bp, Mus musculus
ctggtggagcaacgtggccctgtct

SEQ ID NO: 920684 - DNA, 25 bp, Mus musculus
ctggtggagcaaggtggccctgtct

SEQ ID NO: 920685 - DNA, 25 bp, Mus musculus
ctggtggagctgcacggatacaaac

SEQ ID NO: 920686 - DNA, 25 bp, Mus musculus
ctggtggagctgcagggatacaaac

SEQ ID NO: 920687 - DNA, 25 bp, Mus musculus
ctggtggcaacacgtccctcgttgc

SEQ ID NO: 920688 - DNA, 25 bp, Mus musculus
ctggtggcaacaggtccctcgttgc

SEQ ID NO: 920689 - DNA, 25 bp, Mus musculus
ctggtggctgtgaacacgctgaagg

SEQ ID NO: 920690 - DNA, 25 bp, Mus musculus
ctggtggctgtgaagacgctgaagg

SEQ ID NO: 920691 - DNA, 25 bp, Mus musculus
ctggtgggaccaatggatcatggac

SEQ ID NO: 920692 - DNA, 25 bp, Mus musculus
ctggtgggaccattggatcatggac

SEQ ID NO: 920693 - DNA, 25 bp, Mus musculus
ctggtgggcaggcttcattctgaca

SEQ ID NO: 920694 - DNA, 25 bp, Mus musculus
ctggtgggcagggttcattctgaca

SEQ ID NO: 920695 - DNA, 25 bp, Mus musculus
ctggtggtctcacgaggctgttgtg

SEQ ID NO: 920696 - DNA, 25 bp, Mus musculus
ctggtggtctcaggaggctgttgtg

SEQ ID NO: 920697 - DNA, 25 bp, Mus musculus
ctggtggtgaagctcattgcacagc

SEQ ID NO: 920698 - DNA, 25 bp, Mus musculus
ctggtggtgaaggtcattgcacagc

SEQ ID NO: 920699 - DNA, 25 bp, Mus musculus
ctggtggtgacacgaatctatgaat

SEQ ID NO: 920700 - DNA, 25 bp, Mus musculus
ctggtggtgacaggaatctatgaat

SEQ ID NO: 920701 - DNA, 25 bp, Mus musculus
ctggtggttggtcgcgcagtccagg

SEQ ID NO: 920702 - DNA, 25 bp, Mus musculus
ctggtggttggtggcgcagtccagg

SEQ ID NO: 920703 - DNA, 25 bp, Mus musculus
ctggtgtccagagacttgtgtggcc

SEQ ID NO: 920704 - DNA, 25 bp, Mus musculus
ctggtgtccagagagttgtgtggcc

SEQ ID NO: 920705 - DNA, 25 bp, Mus musculus
ctggtgtccgagagtcctgcaggtc

SEQ ID NO: 920706 - DNA, 25 bp, Mus musculus
ctggtgtccgagatgcatgctgttc

SEQ ID NO: 920707 - DNA, 25 bp, Mus musculus
ctggtgtccgagctcttcagattac

SEQ ID NO: 920708 - DNA, 25 bp, Mus musculus
ctggtgtccgaggtcttcagattac

SEQ ID NO: 920709 - DNA, 25 bp, Mus musculus
ctggtgtccgagtgtcctgcaggtc

SEQ ID NO: 920710 - DNA, 25 bp, Mus musculus
ctggtgtccgagttgcatgctgttc

SEQ ID NO: 920711 - DNA, 25 bp, Mus musculus
ctggtgtcctagcccacagaaggac

SEQ ID NO: 920712 - DNA, 25 bp, Mus musculus
ctggtgtcctaggccacagaaggac

SEQ ID NO: 920713 - DNA, 25 bp, Mus musculus
ctggtgtcgctccagttcctgagga

SEQ ID NO: 920714 - DNA, 25 bp, Mus musculus
ctggtgtcgctccggtatcaagtct

SEQ ID NO: 920715 - DNA, 25 bp, Mus musculus
ctggtgtcgctcgagttcctgagga

SEQ ID NO: 920716 - DNA, 25 bp, Mus musculus
ctggtgtcgctcgggtatcaagtct

SEQ ID NO: 920717 - DNA, 25 bp, Mus musculus
ctggtgttattgcaccattcatggc

SEQ ID NO: 920718 - DNA, 25 bp, Mus musculus
ctggtgttattgcagcattcatggc

SEQ ID NO: 920719 - DNA, 25 bp, Mus musculus
ctggtgttggagcaagtaaagctct

SEQ ID NO: 920720 - DNA, 25 bp, Mus musculus
ctggtgttggagcccctgggaacaa

SEQ ID NO: 920721 - DNA, 25 bp, Mus musculus
ctggtgttggagctctgtgatacat

SEQ ID NO: 920722 - DNA, 25 bp, Mus musculus
ctggtgttggaggaagtaaagctct

SEQ ID NO: 920723 - DNA, 25 bp, Mus musculus
ctggtgttggaggccctgggaacaa

SEQ ID NO: 920724 - DNA, 25 bp, Mus musculus
ctggtgttggaggtctgtgatacat

SEQ ID NO: 920725 - DNA, 25 bp, Mus musculus
ctggttacaaattctgttgacagaa

SEQ ID NO: 920726 - DNA, 25 bp, Mus musculus
ctggttacaatttctgttgacagaa

SEQ ID NO: 920727 - DNA, 25 bp, Mus musculus
ctggttatgaagctccccggatccc

SEQ ID NO: 920728 - DNA, 25 bp, Mus musculus
ctggttatgaaggtccccggatccc

SEQ ID NO: 920729 - DNA, 25 bp, Mus musculus
ctggttcccaatgaactgattggct

SEQ ID NO: 920730 - DNA, 25 bp, Mus musculus
ctggttcccaatgaaggcagcaaga

SEQ ID NO: 920731 - DNA, 25 bp, Mus musculus
ctggttcccaatgatctgattggct

SEQ ID NO: 920732 - DNA, 25 bp, Mus musculus
ctggttcccaatgatggcagcaaga

SEQ ID NO: 920733 - DNA, 25 bp, Mus musculus
ctggttcctagacaggcaacctttc

SEQ ID NO: 920734 - DNA, 25 bp, Mus musculus
ctggttcctagagaggcaacctttc

SEQ ID NO: 920735 - DNA, 25 bp, Mus musculus
ctggttcctggacggatcaatgtga

SEQ ID NO: 920736 - DNA, 25 bp, Mus musculus
ctggttcctggagggatcaatgtga

SEQ ID NO: 920737 - DNA, 25 bp, Mus musculus
ctggttcctgtgcacttctgtggcc

SEQ ID NO: 920738 - DNA, 25 bp, Mus musculus
ctggttcctgtgcagttctgtggcc

SEQ ID NO: 920739 - DNA, 25 bp, Mus musculus
ctggttgagcaacaaaatcttgcta

SEQ ID NO: 920740 - DNA, 25 bp, Mus musculus
ctggttgagcaagaaaatcttgcta

SEQ ID NO: 920741 - DNA, 25 bp, Mus musculus
ctggttgcccagctgctgggcttgg

SEQ ID NO: 920742 - DNA, 25 bp, Mus musculus
ctggttgcccaggtgctgggcttgg

SEQ ID NO: 920743 - DNA, 25 bp, Mus musculus
ctggttggcggagacagtacccagt

SEQ ID NO: 920744 - DNA, 25 bp, Mus musculus
ctggttggcggagagagtacccagt

SEQ ID NO: 920745 - DNA, 25 bp, Mus musculus
ctggttggtgcttttgggctgtgtg

SEQ ID NO: 920746 - DNA, 25 bp, Mus musculus
ctggttggtggttttgggctgtgtg

SEQ ID NO: 920747 - DNA, 25 bp, Mus musculus
ctggtttaacacattggcatattta

SEQ ID NO: 920748 - DNA, 25 bp, Mus musculus
ctggtttaacactttggcatattta

SEQ ID NO: 920749 - DNA, 25 bp, Mus musculus
ctggtttcacagctcaactttgtga

SEQ ID NO: 920750 - DNA, 25 bp, Mus musculus
ctggtttcacaggtcaactttgtga

SEQ ID NO: 920751 - DNA, 25 bp, Mus musculus
ctggtttcagagcaggcctttccca

SEQ ID NO: 920752 - DNA, 25 bp, Mus musculus
ctggtttcagaggaggcctttccca

SEQ ID NO: 920753 - DNA, 25 bp, Mus musculus
ctggtttccactcagtccttagcca

SEQ ID NO: 920754 - DNA, 25 bp, Mus musculus
ctggtttccactccacctcctggcc

SEQ ID NO: 920755 - DNA, 25 bp, Mus musculus
ctggtttccactgagtccttagcca

SEQ ID NO: 920756 - DNA, 25 bp, Mus musculus
ctggtttccactgcacctcctggcc

SEQ ID NO: 920757 - DNA, 25 bp, Mus musculus
ctggtttcccggctatgcatggacc

SEQ ID NO: 920758 - DNA, 25 bp, Mus musculus
ctggtttcccgggtatgcatggacc

SEQ ID NO: 920759 - DNA, 25 bp, Mus musculus
ctggtttctcagacccctatgtgaa

SEQ ID NO: 920760 - DNA, 25 bp, Mus musculus
ctggtttctcagtcccctatgtgaa

SEQ ID NO: 920761 - DNA, 25 bp, Mus musculus
ctggtttgcgctccctccaacatgc

SEQ ID NO: 920762 - DNA, 25 bp, Mus musculus
ctggtttgcggtccctccaacatgc

SEQ ID NO: 920763 - DNA, 25 bp, Mus musculus
ctggtttggagtcgtgtttgtggtg

SEQ ID NO: 920764 - DNA, 25 bp, Mus musculus
ctggtttggagtggtgtttgtggtg

SEQ ID NO: 920765 - DNA, 25 bp, Mus musculus
ctggttttagctatcaaaagtggga

SEQ ID NO: 920766 - DNA, 25 bp, Mus musculus
ctggttttagctatgaaaagtggga

SEQ ID NO: 920767 - DNA, 25 bp, Mus musculus
ctggttttcctgcgtctcggtcttg

SEQ ID NO: 920768 - DNA, 25 bp, Mus musculus
ctggttttcctgggtctcggtcttg

SEQ ID NO: 920769 - DNA, 25 bp, Mus musculus
ctggttttggagcctgataagctgg

SEQ ID NO: 920770 - DNA, 25 bp, Mus musculus
ctggttttggaggctgataagctgg

SEQ ID NO: 920771 - DNA, 25 bp, Mus musculus
ctggtttttgattcacaaggagagg

SEQ ID NO: 920772 - DNA, 25 bp, Mus musculus
ctggtttttgtttcacaaggagagg

SEQ ID NO: 920773 - DNA, 25 bp, Mus musculus
ctgtaaagagccccttcctaggtgc

SEQ ID NO: 920774 - DNA, 25 bp, Mus musculus
ctgtaaagaggcccttcctaggtgc

SEQ ID NO: 920775 - DNA, 25 bp, Mus musculus
ctgtaaatggcttgctgaaagggca

SEQ ID NO: 920776 - DNA, 25 bp, Mus musculus
ctgtaaatgggttgctgaaagggca

SEQ ID NO: 920777 - DNA, 25 bp, Mus musculus
ctgtaagaagaatgtctgcaccaag

SEQ ID NO: 920778 - DNA, 25 bp, Mus musculus
ctgtaagaagtatgtctgcaccaag

SEQ ID NO: 920779 - DNA, 25 bp, Mus musculus
ctgtaagacatacacgctggacgaa

SEQ ID NO: 920780 - DNA, 25 bp, Mus musculus
ctgtaagacatacaggctggacgaa

SEQ ID NO: 920781 - DNA, 25 bp, Mus musculus
ctgtaagcagcctaggatgtcaggc

SEQ ID NO: 920782 - DNA, 25 bp, Mus musculus
ctgtaagcaggctaggatgtcaggc

SEQ ID NO: 920783 - DNA, 25 bp, Mus musculus
ctgtaatgaaggaaaatatctgcag

SEQ ID NO: 920784 - DNA, 25 bp, Mus musculus
ctgtaatgaaggtaaatatctgcag

SEQ ID NO: 920785 - DNA, 25 bp, Mus musculus
ctgtacaaagcggcagccacagaac

SEQ ID NO: 920786 - DNA, 25 bp, Mus musculus
ctgtacaaaggggcagccacagaac

SEQ ID NO: 920787 - DNA, 25 bp, Mus musculus
ctgtacaagattcggcagcccagac

SEQ ID NO: 920788 - DNA, 25 bp, Mus musculus
ctgtacaagattcgtcaactcagat

SEQ ID NO: 920789 - DNA, 25 bp, Mus musculus
ctgtacaagattgggcagcccagac

SEQ ID NO: 920790 - DNA, 25 bp, Mus musculus
ctgtacaagattggtcaactcagat

SEQ ID NO: 920791 - DNA, 25 bp, Mus musculus
ctgtacaagcagcccacagaaggac

SEQ ID NO: 920792 - DNA, 25 bp, Mus musculus
ctgtacaagcaggccacagaaggac

SEQ ID NO: 920793 - DNA, 25 bp, Mus musculus
ctgtacatccagagccatataagtg

SEQ ID NO: 920794 - DNA, 25 bp, Mus musculus
ctgtacatccagtgccatataagtg

SEQ ID NO: 920795 - DNA, 25 bp, Mus musculus
ctgtacatgaaacgtggcttaatga

SEQ ID NO: 920796 - DNA, 25 bp, Mus musculus
ctgtacatgaaaggtggcttaatga

SEQ ID NO: 920797 - DNA, 25 bp, Mus musculus
ctgtaccaatgagcagtacatgatg

SEQ ID NO: 920798 - DNA, 25 bp, Mus musculus
ctgtaccaatgagctgtacatgatg

SEQ ID NO: 920799 - DNA, 25 bp, Mus musculus
ctgtaccacaagcctggacactttt

SEQ ID NO: 920800 - DNA, 25 bp, Mus musculus
ctgtaccacaaggctggacactttt

SEQ ID NO: 920801 - DNA, 25 bp, Mus musculus
ctgtaccagcagatggcccccagca

SEQ ID NO: 920802 - DNA, 25 bp, Mus musculus
ctgtaccagcagttggcccccagca

SEQ ID NO: 920803 - DNA, 25 bp, Mus musculus
ctgtaccaggagaacgatgccctgc

SEQ ID NO: 920804 - DNA, 25 bp, Mus musculus
ctgtaccaggagaaggatgccctgc

SEQ ID NO: 920805 - DNA, 25 bp, Mus musculus
ctgtaccaggctgtacattggtgaa

SEQ ID NO: 920806 - DNA, 25 bp, Mus musculus
ctgtaccagggtgtacattggtgaa

SEQ ID NO: 920807 - DNA, 25 bp, Mus musculus
ctgtacctaccactgagaggtcgtg

SEQ ID NO: 920808 - DNA, 25 bp, Mus musculus
ctgtacctaccagtgagaggtcgtg

SEQ ID NO: 920809 - DNA, 25 bp, Mus musculus
ctgtacctccacgacgcgagcctgt

SEQ ID NO: 920810 - DNA, 25 bp, Mus musculus
ctgtacctccacgaggcgagcctgt

SEQ ID NO: 920811 - DNA, 25 bp, Mus musculus
ctgtacggtgttcacggactgctga

SEQ ID NO: 920812 - DNA, 25 bp, Mus musculus
ctgtacggtgttcacgtcactgcaa

SEQ ID NO: 920813 - DNA, 25 bp, Mus musculus
ctgtacggtgttcagggactgctga

SEQ ID NO: 920814 - DNA, 25 bp, Mus musculus
ctgtacggtgttcaggtcactgcaa

SEQ ID NO: 920815 - DNA, 25 bp, Mus musculus
ctgtactcaaggagaatctgggagc

SEQ ID NO: 920816 - DNA, 25 bp, Mus musculus
ctgtactcaaggtgaatctgggagc

SEQ ID NO: 920817 - DNA, 25 bp, Mus musculus
ctgtactctggacacaaaggaattc

SEQ ID NO: 920818 - DNA, 25 bp, Mus musculus
ctgtactctggacagaaaggaattc

SEQ ID NO: 920819 - DNA, 25 bp, Mus musculus
ctgtactgagagctcctgcttcaat

SEQ ID NO: 920820 - DNA, 25 bp, Mus musculus
ctgtactgagaggtcctgcttcaat

SEQ ID NO: 920821 - DNA, 25 bp, Mus musculus
ctgtactttgtgcacgtcccagcca

SEQ ID NO: 920822 - DNA, 25 bp, Mus musculus
ctgtactttgtgcactggctcgtgg

SEQ ID NO: 920823 - DNA, 25 bp, Mus musculus
ctgtactttgtgcaggtcccagcca

SEQ ID NO: 920824 - DNA, 25 bp, Mus musculus
ctgtactttgtgcagtggctcgtgg

SEQ ID NO: 920825 - DNA, 25 bp, Mus musculus
ctgtagcccgcacaccatggggctt

SEQ ID NO: 920826 - DNA, 25 bp, Mus musculus
ctgtagcccgcacatcaccttgaag

SEQ ID NO: 920827 - DNA, 25 bp, Mus musculus
ctgtagcccggacaccatggggctt

SEQ ID NO: 920828 - DNA, 25 bp, Mus musculus
ctgtagcccggacatcaccttgaag

SEQ ID NO: 920829 - DNA, 25 bp, Mus musculus
ctgtagcctgaacctcaaggcctgc

SEQ ID NO: 920830 - DNA, 25 bp, Mus musculus
ctgtagcctgtacctcaaggcctgc

SEQ ID NO: 920831 - DNA, 25 bp, Mus musculus
ctgtagctaaagcagttcatactgt

SEQ ID NO: 920832 - DNA, 25 bp, Mus musculus
ctgtagctaaaggagttcatactgt

SEQ ID NO: 920833 - DNA, 25 bp, Mus musculus
ctgtaggactttcagctgaggctgc

SEQ ID NO: 920834 - DNA, 25 bp, Mus musculus
ctgtaggactttgagctgaggctgc

SEQ ID NO: 920835 - DNA, 25 bp, Mus musculus
ctgtagtgaaagctgccgaggatgt

SEQ ID NO: 920836 - DNA, 25 bp, Mus musculus
ctgtagtgaaaggtgccgaggatgt

SEQ ID NO: 920837 - DNA, 25 bp, Mus musculus
ctgtagtgcgctgtgcaaaactaag

SEQ ID NO: 920838 - DNA, 25 bp, Mus musculus
ctgtagtgcggtgtgcaaaactaag

SEQ ID NO: 920839 - DNA, 25 bp, Mus musculus
ctgtagtggaagaagaatgactgtc

SEQ ID NO: 920840 - DNA, 25 bp, Mus musculus
ctgtagtggaagagaaatcactgtc

SEQ ID NO: 920841 - DNA, 25 bp, Mus musculus
ctgtagtggaagtagaatgactgtc

SEQ ID NO: 920842 - DNA, 25 bp, Mus musculus
ctgtagtggaagtgaaatcactgtc

SEQ ID NO: 920843 - DNA, 25 bp, Mus musculus
ctgtagtgtgcagctgaccccagac

SEQ ID NO: 920844 - DNA, 25 bp, Mus musculus
ctgtagtgtggagctgaccccagac

SEQ ID NO: 920845 - DNA, 25 bp, Mus musculus
ctgtatcaactgcaagtttcaggaa

SEQ ID NO: 920846 - DNA, 25 bp, Mus musculus
ctgtatcaactgcatgtttcaggaa

SEQ ID NO: 920847 - DNA, 25 bp, Mus musculus
ctgtatcatgaactcagcctcagca

SEQ ID NO: 920848 - DNA, 25 bp, Mus musculus
ctgtatcatgaactgagcctcagca

SEQ ID NO: 920849 - DNA, 25 bp, Mus musculus
ctgtatctctctctctggaggtgaa

SEQ ID NO: 920850 - DNA, 25 bp, Mus musculus
ctgtatctctctctgtggaggtgaa

SEQ ID NO: 920851 - DNA, 25 bp, Mus musculus
ctgtatctctttcacgtagagcttg

SEQ ID NO: 920852 - DNA, 25 bp, Mus musculus
ctgtatctctttcactatcctgtgc

SEQ ID NO: 920853 - DNA, 25 bp, Mus musculus
ctgtatctctttcaggtagagcttg

SEQ ID NO: 920854 - DNA, 25 bp, Mus musculus
ctgtatctctttcagtatcctgtgc

SEQ ID NO: 920855 - DNA, 25 bp, Mus musculus
ctgtatctggtgctctaccttcagg

SEQ ID NO: 920856 - DNA, 25 bp, Mus musculus
ctgtatctggtggtctaccttcagg

SEQ ID NO: 920857 - DNA, 25 bp, Mus musculus
ctgtatgaccagaattatcccatcc

SEQ ID NO: 920858 - DNA, 25 bp, Mus musculus
ctgtatgaccagtattatcccatcc

SEQ ID NO: 920859 - DNA, 25 bp, Mus musculus
ctgtatgccccgagcacagatatgg

SEQ ID NO: 920860 - DNA, 25 bp, Mus musculus
ctgtatgcccggagcacagatatgg

SEQ ID NO: 920861 - DNA, 25 bp, Mus musculus
ctgtatgctccacgcaaggaggact

SEQ ID NO: 920862 - DNA, 25 bp, Mus musculus
ctgtatgctccaggcaaggaggact

SEQ ID NO: 920863 - DNA, 25 bp, Mus musculus
ctgtatggaaagatggcctctgcac

SEQ ID NO: 920864 - DNA, 25 bp, Mus musculus
ctgtatggaaagttggcctctgcac

SEQ ID NO: 920865 - DNA, 25 bp, Mus musculus
ctgtatggatcacaaaaactaacac

SEQ ID NO: 920866 - DNA, 25 bp, Mus musculus
ctgtatggatcagaaaaactaacac

SEQ ID NO: 920867 - DNA, 25 bp, Mus musculus
ctgtatggcacgaatgaggaagagt

SEQ ID NO: 920868 - DNA, 25 bp, Mus musculus
ctgtatggcacgtatgaggaagagt

SEQ ID NO: 920869 - DNA, 25 bp, Mus musculus
ctgtatggcgatgagaatgaagttg

SEQ ID NO: 920870 - DNA, 25 bp, Mus musculus
ctgtatggcgccccgtgggacgtgc

SEQ ID NO: 920871 - DNA, 25 bp, Mus musculus
ctgtatggcggcccgtgggacgtgc

SEQ ID NO: 920872 - DNA, 25 bp, Mus musculus
ctgtatggcgttgagaatgaagttg

SEQ ID NO: 920873 - DNA, 25 bp, Mus musculus
ctgtatgtataccacaccacggcga

SEQ ID NO: 920874 - DNA, 25 bp, Mus musculus
ctgtatgtataccatccccccacaa

SEQ ID NO: 920875 - DNA, 25 bp, Mus musculus
ctgtatgtatacgacaccacggcga

SEQ ID NO: 920876 - DNA, 25 bp, Mus musculus
ctgtatgtatacgatccccccacaa

SEQ ID NO: 920877 - DNA, 25 bp, Mus musculus
ctgtattatcgtaatgagtattgga

SEQ ID NO: 920878 - DNA, 25 bp, Mus musculus
ctgtattatcgttatgagtattgga

SEQ ID NO: 920879 - DNA, 25 bp, Mus musculus
ctgtatttatcgcctgagcagcaga

SEQ ID NO: 920880 - DNA, 25 bp, Mus musculus
ctgtatttatcggctgagcagcaga

SEQ ID NO: 920881 - DNA, 25 bp, Mus musculus
ctgtcaacagcctcaagtacatgcc

SEQ ID NO: 920882 - DNA, 25 bp, Mus musculus
ctgtcaacaggctcaagtacatgcc

SEQ ID NO: 920883 - DNA, 25 bp, Mus musculus
ctgtcaaccctgaacatattgtgaa

SEQ ID NO: 920884 - DNA, 25 bp, Mus musculus
ctgtcaaccctgaagatattgtgaa

SEQ ID NO: 920885 - DNA, 25 bp, Mus musculus
ctgtcaccaactcacctctctgctc

SEQ ID NO: 920886 - DNA, 25 bp, Mus musculus
ctgtcaccaactcagctctctgctc

SEQ ID NO: 920887 - DNA, 25 bp, Mus musculus
ctgtcacccctgaatatcaacctga

SEQ ID NO: 920888 - DNA, 25 bp, Mus musculus
ctgtcacccctgtatatcaacctga

SEQ ID NO: 920889 - DNA, 25 bp, Mus musculus
ctgtcaccgccagaagttttggcca

SEQ ID NO: 920890 - DNA, 25 bp, Mus musculus
ctgtcaccgccagatgttttggcca

SEQ ID NO: 920891 - DNA, 25 bp, Mus musculus
ctgtcacctccactgaccacctggg

SEQ ID NO: 920892 - DNA, 25 bp, Mus musculus
ctgtcacctccagtgaccacctggg

SEQ ID NO: 920893 - DNA, 25 bp, Mus musculus
ctgtcaccttctcgcgcagtgttct

SEQ ID NO: 920894 - DNA, 25 bp, Mus musculus
ctgtcaccttctcgggcagtgttct

SEQ ID NO: 920895 - DNA, 25 bp, Mus musculus
ctgtcacgccggcgactgaccagct

SEQ ID NO: 920896 - DNA, 25 bp, Mus musculus
ctgtcacgccggggactgaccagct

SEQ ID NO: 920897 - DNA, 25 bp, Mus musculus
ctgtcactgcagcccacagccccat

SEQ ID NO: 920898 - DNA, 25 bp, Mus musculus
ctgtcactgcaggccacagccccat

SEQ ID NO: 920899 - DNA, 25 bp, Mus musculus
ctgtcagagctgctgctgtgagtgc

SEQ ID NO: 920900 - DNA, 25 bp, Mus musculus
ctgtcagagctggtgctgtgagtgc

SEQ ID NO: 920901 - DNA, 25 bp, Mus musculus
ctgtcagataatcactccaaacctc

SEQ ID NO: 920902 - DNA, 25 bp, Mus musculus
ctgtcagataatcagtccaaacctc

SEQ ID NO: 920903 - DNA, 25 bp, Mus musculus
ctgtcagcatagcacagtaagtcac

SEQ ID NO: 920904 - DNA, 25 bp, Mus musculus
ctgtcagcatagcagagtaagtcac

SEQ ID NO: 920905 - DNA, 25 bp, Mus musculus
ctgtcagtatcagacgtaatatcgg

SEQ ID NO: 920906 - DNA, 25 bp, Mus musculus
ctgtcagtatcagaggtaatatcgg

SEQ ID NO: 920907 - DNA, 25 bp, Mus musculus
ctgtcagtcatgatttctttcaaca

SEQ ID NO: 920908 - DNA, 25 bp, Mus musculus
ctgtcagtcatgttttctttcaaca

SEQ ID NO: 920909 - DNA, 25 bp, Mus musculus
ctgtcagtgatccccaacttcagtg

SEQ ID NO: 920910 - DNA, 25 bp, Mus musculus
ctgtcagtgatcgccaacttcagtg

SEQ ID NO: 920911 - DNA, 25 bp, Mus musculus
ctgtcatagccacgttgcaaaggca

SEQ ID NO: 920912 - DNA, 25 bp, Mus musculus
ctgtcatagccaggttgcaaaggca

SEQ ID NO: 920913 - DNA, 25 bp, Mus musculus
ctgtcatcacagacaccctctctcc

SEQ ID NO: 920914 - DNA, 25 bp, Mus musculus
ctgtcatcacagattctttaagatt

SEQ ID NO: 920915 - DNA, 25 bp, Mus musculus
ctgtcatcacagtcaccctctctcc

SEQ ID NO: 920916 - DNA, 25 bp, Mus musculus
ctgtcatcacagtttctttaagatt

SEQ ID NO: 920917 - DNA, 25 bp, Mus musculus
ctgtcatcagattgatcttttcaag

SEQ ID NO: 920918 - DNA, 25 bp, Mus musculus
ctgtcatcagcttacactccttcgc

SEQ ID NO: 920919 - DNA, 25 bp, Mus musculus
ctgtcatcagcttagactccttcgc

SEQ ID NO: 920920 - DNA, 25 bp, Mus musculus
ctgtcatcagtttgatcttttcaag

SEQ ID NO: 920921 - DNA, 25 bp, Mus musculus
ctgtcatcctcgaagccaagctgga

SEQ ID NO: 920922 - DNA, 25 bp, Mus musculus
ctgtcatcctcgagcctggctgctt

SEQ ID NO: 920923 - DNA, 25 bp, Mus musculus
ctgtcatcctcgtagccaagctgga

SEQ ID NO: 920924 - DNA, 25 bp, Mus musculus
ctgtcatcctcgtgcctggctgctt

SEQ ID NO: 920925 - DNA, 25 bp, Mus musculus
ctgtcatgagcaactcagccacctt

SEQ ID NO: 920926 - DNA, 25 bp, Mus musculus
ctgtcatgaggaactcagccacctt

SEQ ID NO: 920927 - DNA, 25 bp, Mus musculus
ctgtcatgcgcgctagtggtggtga

SEQ ID NO: 920928 - DNA, 25 bp, Mus musculus
ctgtcatgcgggctagtggtggtga

SEQ ID NO: 920929 - DNA, 25 bp, Mus musculus
ctgtcatgtatgtacgactcacaga

SEQ ID NO: 920930 - DNA, 25 bp, Mus musculus
ctgtcatgtatgtaggactcacaga

SEQ ID NO: 920931 - DNA, 25 bp, Mus musculus
ctgtcattaatccacgatccacagg

SEQ ID NO: 920932 - DNA, 25 bp, Mus musculus
ctgtcattaatccaggatccacagg

SEQ ID NO: 920933 - DNA, 25 bp, Mus musculus
ctgtcattcaaacaacttaaggcca

SEQ ID NO: 920934 - DNA, 25 bp, Mus musculus
ctgtcattcaaagaacttaaggcca

SEQ ID NO: 920935 - DNA, 25 bp, Mus musculus
ctgtcattcgcaaacgacccatttc

SEQ ID NO: 920936 - DNA, 25 bp, Mus musculus
ctgtcattcgcaaaggacccatttc

SEQ ID NO: 920937 - DNA, 25 bp, Mus musculus
ctgtccaaagcgccagaagggggag

SEQ ID NO: 920938 - DNA, 25 bp, Mus musculus
ctgtccaaagggccagaagggggag

SEQ ID NO: 920939 - DNA, 25 bp, Mus musculus
ctgtccaagtctcacgtggaggacc

SEQ ID NO: 920940 - DNA, 25 bp, Mus musculus
ctgtccaagtctcaggtggaggacc

SEQ ID NO: 920941 - DNA, 25 bp, Mus musculus
ctgtccacacagctttatgaagctg

SEQ ID NO: 920942 - DNA, 25 bp, Mus musculus
ctgtccacacaggtttatgaagctg

SEQ ID NO: 920943 - DNA, 25 bp, Mus musculus
ctgtccacactacacgctccttcct

SEQ ID NO: 920944 - DNA, 25 bp, Mus musculus
ctgtccacactacacgtctgtaact

SEQ ID NO: 920945 - DNA, 25 bp, Mus musculus
ctgtccacactacaggctccttcct

SEQ ID NO: 920946 - DNA, 25 bp, Mus musculus
ctgtccacactacaggtctgtaact

SEQ ID NO: 920947 - DNA, 25 bp, Mus musculus
ctgtccacagatgtcgggaacagtg

SEQ ID NO: 920948 - DNA, 25 bp, Mus musculus
ctgtccacagatgtggggaacagtg

SEQ ID NO: 920949 - DNA, 25 bp, Mus musculus
ctgtccacagctccacggtgtggtg

SEQ ID NO: 920950 - DNA, 25 bp, Mus musculus
ctgtccacaggtccacggtgtggtg

SEQ ID NO: 920951 - DNA, 25 bp, Mus musculus
ctgtccacatgcccctgtgatgcca

SEQ ID NO: 920952 - DNA, 25 bp, Mus musculus
ctgtccacatgcgcctgtgatgcca

SEQ ID NO: 920953 - DNA, 25 bp, Mus musculus
ctgtccagctagctgtgctaaaagt

SEQ ID NO: 920954 - DNA, 25 bp, Mus musculus
ctgtccagcttgctgtgctaaaagt

SEQ ID NO: 920955 - DNA, 25 bp, Mus musculus
ctgtccaggacacacaatgtaagcc

SEQ ID NO: 920956 - DNA, 25 bp, Mus musculus
ctgtccaggagacacaatgtaagcc

SEQ ID NO: 920957 - DNA, 25 bp, Mus musculus
ctgtccatcccagcagcagcatgtt

SEQ ID NO: 920958 - DNA, 25 bp, Mus musculus
ctgtccatccgagcagcagcatgtt

SEQ ID NO: 920959 - DNA, 25 bp, Mus musculus
ctgtccattgcaaacgctgggatca

SEQ ID NO: 920960 - DNA, 25 bp, Mus musculus
ctgtccattgcaaaggctgggatca

SEQ ID NO: 920961 - DNA, 25 bp, Mus musculus
ctgtccccaacacacatgatgagga

SEQ ID NO: 920962 - DNA, 25 bp, Mus musculus
ctgtccccaacacagatgatgagga

SEQ ID NO: 920963 - DNA, 25 bp, Mus musculus
ctgtccccagcgaacagactgcttt

SEQ ID NO: 920964 - DNA, 25 bp, Mus musculus
ctgtccccagggaacagactgcttt

SEQ ID NO: 920965 - DNA, 25 bp, Mus musculus
ctgtccccagtcaacacttcagctg

SEQ ID NO: 920966 - DNA, 25 bp, Mus musculus
ctgtccccagtcaagacttcagctg

SEQ ID NO: 920967 - DNA, 25 bp, Mus musculus
ctgtcccctgcccgcaattctgatc

SEQ ID NO: 920968 - DNA, 25 bp, Mus musculus
ctgtcccctgcccggaattctgatc

SEQ ID NO: 920969 - DNA, 25 bp, Mus musculus
ctgtccctcaatccaaaaaggccag

SEQ ID NO: 920970 - DNA, 25 bp, Mus musculus
ctgtccctcaatgcaaaaaggccag

SEQ ID NO: 920971 - DNA, 25 bp, Mus musculus
ctgtccctctatcccaaaaggccag

SEQ ID NO: 920972 - DNA, 25 bp, Mus musculus
ctgtccctctatgccaaaaggccag

SEQ ID NO: 920973 - DNA, 25 bp, Mus musculus
ctgtccctggagcgtggctataacc

SEQ ID NO: 920974 - DNA, 25 bp, Mus musculus
ctgtccctggagggtggctataacc

SEQ ID NO: 920975 - DNA, 25 bp, Mus musculus
ctgtccctgttttcaaccctgcaga

SEQ ID NO: 920976 - DNA, 25 bp, Mus musculus
ctgtccctgttttctaccctgcaga

SEQ ID NO: 920977 - DNA, 25 bp, Mus musculus
ctgtccgcgcgccgggagctgccat

SEQ ID NO: 920978 - DNA, 25 bp, Mus musculus
ctgtccgcgcgcggggagctgccat

SEQ ID NO: 920979 - DNA, 25 bp, Mus musculus
ctgtccgcggaggtgcctaggcagc

SEQ ID NO: 920980 - DNA, 25 bp, Mus musculus
ctgtccgcggtggtgcctaggcagc

SEQ ID NO: 920981 - DNA, 25 bp, Mus musculus
ctgtcctaaactagaccttcaatga

SEQ ID NO: 920982 - DNA, 25 bp, Mus musculus
ctgtcctaaacttgaccttcaatga

SEQ ID NO: 920983 - DNA, 25 bp, Mus musculus
ctgtcctcaaagagatctttgcaaa

SEQ ID NO: 920984 - DNA, 25 bp, Mus musculus
ctgtcctcaaagtgatctttgcaaa

SEQ ID NO: 920985 - DNA, 25 bp, Mus musculus
ctgtcctcagcgaccgcagcagcca

SEQ ID NO: 920986 - DNA, 25 bp, Mus musculus
ctgtcctcagcgccttcagggaccg

SEQ ID NO: 920987 - DNA, 25 bp, Mus musculus
ctgtcctcagggaccgcagcagcca

SEQ ID NO: 920988 - DNA, 25 bp, Mus musculus
ctgtcctcagggccttcagggaccg

SEQ ID NO: 920989 - DNA, 25 bp, Mus musculus
ctgtcctctcaacgctcaaactcag

SEQ ID NO: 920990 - DNA, 25 bp, Mus musculus
ctgtcctctcaaggctcaaactcag

SEQ ID NO: 920991 - DNA, 25 bp, Mus musculus
ctgtcctcttatagctccttccagt

SEQ ID NO: 920992 - DNA, 25 bp, Mus musculus
ctgtcctcttttagctccttccagt

SEQ ID NO: 920993 - DNA, 25 bp, Mus musculus
ctgtcctgaaagaaggcttctttgg

SEQ ID NO: 920994 - DNA, 25 bp, Mus musculus
ctgtcctgaaagactcagaggagca

SEQ ID NO: 920995 - DNA, 25 bp, Mus musculus
ctgtcctgaaagccagagacccgcc

SEQ ID NO: 920996 - DNA, 25 bp, Mus musculus
ctgtcctgaaaggcagagacccgcc

SEQ ID NO: 920997 - DNA, 25 bp, Mus musculus
ctgtcctgaaagtaggcttctttgg

SEQ ID NO: 920998 - DNA, 25 bp, Mus musculus
ctgtcctgaaagtctcagaggagca

SEQ ID NO: 920999 - DNA, 25 bp, Mus musculus
ctgtcctgacaccacgctcaggaca

SEQ ID NO: 921000 - DNA, 25 bp, Mus musculus
ctgtcctgacaccaggctcaggaca

SEQ ID NO: 921001 - DNA, 25 bp, Mus musculus
ctgtcctgagagtactatctgctga

SEQ ID NO: 921002 - DNA, 25 bp, Mus musculus
ctgtcctgagcacgtgaaactggtt

SEQ ID NO: 921003 - DNA, 25 bp, Mus musculus
ctgtcctgagcaggtgaaactggtt

SEQ ID NO: 921004 - DNA, 25 bp, Mus musculus
ctgtcctgagcagtgtgcagccaca

SEQ ID NO: 921005 - DNA, 25 bp, Mus musculus
ctgtcctgagcattcggcccttttg

SEQ ID NO: 921006 - DNA, 25 bp, Mus musculus
ctgtcctgaggagtgtgcagccaca

SEQ ID NO: 921007 - DNA, 25 bp, Mus musculus
ctgtcctgaggattcggcccttttg

SEQ ID NO: 921008 - DNA, 25 bp, Mus musculus
ctgtcctgagtgtactatctgctga

SEQ ID NO: 921009 - DNA, 25 bp, Mus musculus
ctgtcctgcgatccatgatgtactc

SEQ ID NO: 921010 - DNA, 25 bp, Mus musculus
ctgtcctgcgttccatgatgtactc

SEQ ID NO: 921011 - DNA, 25 bp, Mus musculus
ctgtcctgtgcaggtgtaaagaaac

SEQ ID NO: 921012 - DNA, 25 bp, Mus musculus
ctgtcctgtggaggtgtaaagaaac

SEQ ID NO: 921013 - DNA, 25 bp, Mus musculus
ctgtccttcctgctgactctgaaca

SEQ ID NO: 921014 - DNA, 25 bp, Mus musculus
ctgtccttcctggtgactctgaaca

SEQ ID NO: 921015 - DNA, 25 bp, Mus musculus
ctgtcctttggtgtcccatattccc

SEQ ID NO: 921016 - DNA, 25 bp, Mus musculus
ctgtcctttggtgtgccatattccc

SEQ ID NO: 921017 - DNA, 25 bp, Mus musculus
ctgtcgaacacacagacagatctgc

SEQ ID NO: 921018 - DNA, 25 bp, Mus musculus
ctgtcgaacacagagacagatctgc

SEQ ID NO: 921019 - DNA, 25 bp, Mus musculus
ctgtcgcatccaagtcattgaccac

SEQ ID NO: 921020 - DNA, 25 bp, Mus musculus
ctgtcgcatccatgtcattgaccac

SEQ ID NO: 921021 - DNA, 25 bp, Mus musculus
ctgtcgccattgcatcatctgtccc

SEQ ID NO: 921022 - DNA, 25 bp, Mus musculus
ctgtcgccattggatcatctgtccc

SEQ ID NO: 921023 - DNA, 25 bp, Mus musculus
ctgtcgcctgactgccacaacttct

SEQ ID NO: 921024 - DNA, 25 bp, Mus musculus
ctgtcgcctgtctgccacaacttct

SEQ ID NO: 921025 - DNA, 25 bp, Mus musculus
ctgtcgcgatatgcactgaaccacc

SEQ ID NO: 921026 - DNA, 25 bp, Mus musculus
ctgtcgcgatatgctctgaaccacc

SEQ ID NO: 921027 - DNA, 25 bp, Mus musculus
ctgtcgtccctgcgcgaccctgctg

SEQ ID NO: 921028 - DNA, 25 bp, Mus musculus
ctgtcgtccctgcgggaccctgctg

SEQ ID NO: 921029 - DNA, 25 bp, Mus musculus
ctgtctaaaaacctcttctgaaact

SEQ ID NO: 921030 - DNA, 25 bp, Mus musculus
ctgtctaaaaacgtcttctgaaact

SEQ ID NO: 921031 - DNA, 25 bp, Mus musculus
ctgtctaccccacgtggcagccttg

SEQ ID NO: 921032 - DNA, 25 bp, Mus musculus
ctgtctaccccaggtggcagccttg

SEQ ID NO: 921033 - DNA, 25 bp, Mus musculus
ctgtctcacccacgatgagtttcat

SEQ ID NO: 921034 - DNA, 25 bp, Mus musculus
ctgtctcacccaggatgagtttcat

SEQ ID NO: 921035 - DNA, 25 bp, Mus musculus
ctgtctcagacaaatacaacaacag

SEQ ID NO: 921036 - DNA, 25 bp, Mus musculus
ctgtctcagagaaatacaacaacag

SEQ ID NO: 921037 - DNA, 25 bp, Mus musculus
ctgtctcaggctgaaacgcaaatcg

SEQ ID NO: 921038 - DNA, 25 bp, Mus musculus
ctgtctcagggtgaaacgcaaatcg

SEQ ID NO: 921039 - DNA, 25 bp, Mus musculus
ctgtctcctccaaaacctcaggctg

SEQ ID NO: 921040 - DNA, 25 bp, Mus musculus
ctgtctcctccaaatcctcaggctg

SEQ ID NO: 921041 - DNA, 25 bp, Mus musculus
ctgtctcctgtgccaaaaaacattg

SEQ ID NO: 921042 - DNA, 25 bp, Mus musculus
ctgtctcctgtgcctaaaaacattg

SEQ ID NO: 921043 - DNA, 25 bp, Mus musculus
ctgtctctagggctgacccagatat

SEQ ID NO: 921044 - DNA, 25 bp, Mus musculus
ctgtctctaggggtgacccagatat

SEQ ID NO: 921045 - DNA, 25 bp, Mus musculus
ctgtctctgcagagtctgcgagaaa

SEQ ID NO: 921046 - DNA, 25 bp, Mus musculus
ctgtctctgcagtgtctgcgagaaa

SEQ ID NO: 921047 - DNA, 25 bp, Mus musculus
ctgtctctttgaaacgagaaggaat

SEQ ID NO: 921048 - DNA, 25 bp, Mus musculus
ctgtctctttgaaaggagaaggaat

SEQ ID NO: 921049 - DNA, 25 bp, Mus musculus
ctgtctgaaaaccatgatggagctg

SEQ ID NO: 921050 - DNA, 25 bp, Mus musculus
ctgtctgaaaacgatgatggagctg

SEQ ID NO: 921051 - DNA, 25 bp, Mus musculus
ctgtctgagtctcaagaagacaaag

SEQ ID NO: 921052 - DNA, 25 bp, Mus musculus
ctgtctgagtctgaagaagacaaag

SEQ ID NO: 921053 - DNA, 25 bp, Mus musculus
ctgtctgcagtaggcgctgctgaat

SEQ ID NO: 921054 - DNA, 25 bp, Mus musculus
ctgtctgcagtaggggctgctgaat

SEQ ID NO: 921055 - DNA, 25 bp, Mus musculus
ctgtctgcccagcagccctatccgg

SEQ ID NO: 921056 - DNA, 25 bp, Mus musculus
ctgtctgcccagccctatccggatg

SEQ ID NO: 921057 - DNA, 25 bp, Mus musculus
ctgtctgcccaggagccctatccgg

SEQ ID NO: 921058 - DNA, 25 bp, Mus musculus
ctgtctgcccaggcctatccggatg

SEQ ID NO: 921059 - DNA, 25 bp, Mus musculus
ctgtctgctgccaccccttgagtca

SEQ ID NO: 921060 - DNA, 25 bp, Mus musculus
ctgtctgctggcaccccttgagtca

SEQ ID NO: 921061 - DNA, 25 bp, Mus musculus
ctgtctggcaaacacacagagcaga

SEQ ID NO: 921062 - DNA, 25 bp, Mus musculus
ctgtctggcaaagacacagagcaga

SEQ ID NO: 921063 - DNA, 25 bp, Mus musculus
ctgtctgtgactcgattggccgcag

SEQ ID NO: 921064 - DNA, 25 bp, Mus musculus
ctgtctgtgactcgtttgtggacag

SEQ ID NO: 921065 - DNA, 25 bp, Mus musculus
ctgtctgtgactggattggccgcag

SEQ ID NO: 921066 - DNA, 25 bp, Mus musculus
ctgtctgtgactggtttgtggacag

SEQ ID NO: 921067 - DNA, 25 bp, Mus musculus
ctgtctgtgagccatggcatgggca

SEQ ID NO: 921068 - DNA, 25 bp, Mus musculus
ctgtctgtgagcgatggcatgggca

SEQ ID NO: 921069 - DNA, 25 bp, Mus musculus
ctgtcttaagaccttcacagcctgg

SEQ ID NO: 921070 - DNA, 25 bp, Mus musculus
ctgtcttaagtccttcacagcctgg

SEQ ID NO: 921071 - DNA, 25 bp, Mus musculus
ctgtcttgagagtctagctgccagc

SEQ ID NO: 921072 - DNA, 25 bp, Mus musculus
ctgtcttgagtgtctagctgccagc

SEQ ID NO: 921073 - DNA, 25 bp, Mus musculus
ctgtctttacagaatgtaggccatg

SEQ ID NO: 921074 - DNA, 25 bp, Mus musculus
ctgtctttacagtatgtaggccatg

SEQ ID NO: 921075 - DNA, 25 bp, Mus musculus
ctgtgaaaaagacgcattttataag

SEQ ID NO: 921076 - DNA, 25 bp, Mus musculus
ctgtgaaaaagaggcattttataag

SEQ ID NO: 921077 - DNA, 25 bp, Mus musculus
ctgtgaaaagcgtcaagcagtgtaa

SEQ ID NO: 921078 - DNA, 25 bp, Mus musculus
ctgtgaaaagggtcaagcagtgtaa

SEQ ID NO: 921079 - DNA, 25 bp, Mus musculus
ctgtgaacagttaaaagcatgctag

SEQ ID NO: 921080 - DNA, 25 bp, Mus musculus
ctgtgaacagttcaaattccatcaa

SEQ ID NO: 921081 - DNA, 25 bp, Mus musculus
ctgtgaacagttgaaattccatcaa

SEQ ID NO: 921082 - DNA, 25 bp, Mus musculus
ctgtgaacagtttaaagcatgctag

SEQ ID NO: 921083 - DNA, 25 bp, Mus musculus
ctgtgaacatcatgccctggcaggg

SEQ ID NO: 921084 - DNA, 25 bp, Mus musculus
ctgtgaacatgatgccctggcaggg

SEQ ID NO: 921085 - DNA, 25 bp, Mus musculus
ctgtgaagaagtggcgtgccgccat

SEQ ID NO: 921086 - DNA, 25 bp, Mus musculus
ctgtgaagaagtggggtgccgccat

SEQ ID NO: 921087 - DNA, 25 bp, Mus musculus
ctgtgaagccacccttgcctctcca

SEQ ID NO: 921088 - DNA, 25 bp, Mus musculus
ctgtgaagccaccttgtgggaccta

SEQ ID NO: 921089 - DNA, 25 bp, Mus musculus
ctgtgaagccacgcttgcctctcca

SEQ ID NO: 921090 - DNA, 25 bp, Mus musculus
ctgtgaagccacgttgtgggaccta

SEQ ID NO: 921091 - DNA, 25 bp, Mus musculus
ctgtgaagtcattcaattctggaac

SEQ ID NO: 921092 - DNA, 25 bp, Mus musculus
ctgtgaagtcattctattctggaac

SEQ ID NO: 921093 - DNA, 25 bp, Mus musculus
ctgtgaatatctctgttgtgaattc

SEQ ID NO: 921094 - DNA, 25 bp, Mus musculus
ctgtgaatatctgtgttgtgaattc

SEQ ID NO: 921095 - DNA, 25 bp, Mus musculus
ctgtgaatcagagaccctgccatat

SEQ ID NO: 921096 - DNA, 25 bp, Mus musculus
ctgtgaatcagagagcctgccatat

SEQ ID NO: 921097 - DNA, 25 bp, Mus musculus
ctgtgaatctgtatcccatgctgag

SEQ ID NO: 921098 - DNA, 25 bp, Mus musculus
ctgtgaatctgtttcccatgctgag

SEQ ID NO: 921099 - DNA, 25 bp, Mus musculus
ctgtgacaagccctgaagaaacacg

SEQ ID NO: 921100 - DNA, 25 bp, Mus musculus
ctgtgacaaggcctgaagaaacacg

SEQ ID NO: 921101 - DNA, 25 bp, Mus musculus
ctgtgaccctgcctactgatgacac

SEQ ID NO: 921102 - DNA, 25 bp, Mus musculus
ctgtgaccctgccttctgatgacac

SEQ ID NO: 921103 - DNA, 25 bp, Mus musculus
ctgtgacgagctgatattcagcaat

SEQ ID NO: 921104 - DNA, 25 bp, Mus musculus
ctgtgacgaggtgatattcagcaat

SEQ ID NO: 921105 - DNA, 25 bp, Mus musculus
ctgtgactttgcagtttcaccaaac

SEQ ID NO: 921106 - DNA, 25 bp, Mus musculus
ctgtgactttgctgtttcaccaaac

SEQ ID NO: 921107 - DNA, 25 bp, Mus musculus
ctgtgagacctgccggctccacatc

SEQ ID NO: 921108 - DNA, 25 bp, Mus musculus
ctgtgagacctggcggctccacatc

SEQ ID NO: 921109 - DNA, 25 bp, Mus musculus
ctgtgagaggcacggcttgtcaatg

SEQ ID NO: 921110 - DNA, 25 bp, Mus musculus
ctgtgagaggcagggcttgtcaatg

SEQ ID NO: 921111 - DNA, 25 bp, Mus musculus
ctgtgagatccacgtgcaggcagta

SEQ ID NO: 921112 - DNA, 25 bp, Mus musculus
ctgtgagatccaggtgcaggcagta

SEQ ID NO: 921113 - DNA, 25 bp, Mus musculus
ctgtgagatgccggcgcccctggat

SEQ ID NO: 921114 - DNA, 25 bp, Mus musculus
ctgtgagatggcggcgcccctggat

SEQ ID NO: 921115 - DNA, 25 bp, Mus musculus
ctgtgagcagcagccagaggaagag

SEQ ID NO: 921116 - DNA, 25 bp, Mus musculus
ctgtgagcaggagccagaggaagag

SEQ ID NO: 921117 - DNA, 25 bp, Mus musculus
ctgtgagccacacactctacgagag

SEQ ID NO: 921118 - DNA, 25 bp, Mus musculus
ctgtgagccacagactctacgagag

SEQ ID NO: 921119 - DNA, 25 bp, Mus musculus
ctgtgagcccagactcgtcccagct

SEQ ID NO: 921120 - DNA, 25 bp, Mus musculus
ctgtgagcccagtctcgtcccagct

SEQ ID NO: 921121 - DNA, 25 bp, Mus musculus
ctgtgagctcaacattctggatttt

SEQ ID NO: 921122 - DNA, 25 bp, Mus musculus
ctgtgagctcaagattctggatttt

SEQ ID NO: 921123 - DNA, 25 bp, Mus musculus
ctgtgagctgaacatcctagacttt

SEQ ID NO: 921124 - DNA, 25 bp, Mus musculus
ctgtgagctgaagatcctagacttt

SEQ ID NO: 921125 - DNA, 25 bp, Mus musculus
ctgtgagctgccccagtcctcctct

SEQ ID NO: 921126 - DNA, 25 bp, Mus musculus
ctgtgagctgcttcacccacccatc

SEQ ID NO: 921127 - DNA, 25 bp, Mus musculus
ctgtgagctggcccagtcctcctct

SEQ ID NO: 921128 - DNA, 25 bp, Mus musculus
ctgtgagctggttcacccacccatc

SEQ ID NO: 921129 - DNA, 25 bp, Mus musculus
ctgtgaggagacgaagacaggtgtt

SEQ ID NO: 921130 - DNA, 25 bp, Mus musculus
ctgtgaggagtcgaagacaggtgtt

SEQ ID NO: 921131 - DNA, 25 bp, Mus musculus
ctgtgaggcctttgcctggcacacc

SEQ ID NO: 921132 - DNA, 25 bp, Mus musculus
ctgtgaggcctttggctggcacacc

SEQ ID NO: 921133 - DNA, 25 bp, Mus musculus
ctgtgataccagaccctgaagaaga

SEQ ID NO: 921134 - DNA, 25 bp, Mus musculus
ctgtgataccagtccctgaagaaga

SEQ ID NO: 921135 - DNA, 25 bp, Mus musculus
ctgtgatccccgcacaactggggca

SEQ ID NO: 921136 - DNA, 25 bp, Mus musculus
ctgtgatccccggacaactggggca

SEQ ID NO: 921137 - DNA, 25 bp, Mus musculus
ctgtgatctactctacagagctatc

SEQ ID NO: 921138 - DNA, 25 bp, Mus musculus
ctgtgatctactgtacagagctatc

SEQ ID NO: 921139 - DNA, 25 bp, Mus musculus
ctgtgatgagctggacttatatggt

SEQ ID NO: 921140 - DNA, 25 bp, Mus musculus
ctgtgatgaggtggacttatatggt

SEQ ID NO: 921141 - DNA, 25 bp, Mus musculus
ctgtgatgccatcattaacaacaac

SEQ ID NO: 921142 - DNA, 25 bp, Mus musculus
ctgtgatgccatgattaacaacaac

SEQ ID NO: 921143 - DNA, 25 bp, Mus musculus
ctgtgatgtatcagcgtaagacata

SEQ ID NO: 921144 - DNA, 25 bp, Mus musculus
ctgtgatgtatcagggtaagacata

SEQ ID NO: 921145 - DNA, 25 bp, Mus musculus
ctgtgattctaaacctgatatcttg

SEQ ID NO: 921146 - DNA, 25 bp, Mus musculus
ctgtgattctaaacgtgatatcttg

SEQ ID NO: 921147 - DNA, 25 bp, Mus musculus
ctgtgcaaacagctcgccagtaagg

SEQ ID NO: 921148 - DNA, 25 bp, Mus musculus
ctgtgcaaacaggtcgccagtaagg

SEQ ID NO: 921149 - DNA, 25 bp, Mus musculus
ctgtgcaagcaacactgaaatacag

SEQ ID NO: 921150 - DNA, 25 bp, Mus musculus
ctgtgcaagcaagactgaaatacag

SEQ ID NO: 921151 - DNA, 25 bp, Mus musculus
ctgtgcaccaagctgcagagtggca

SEQ ID NO: 921152 - DNA, 25 bp, Mus musculus
ctgtgcaccaaggtgcagagtggca

SEQ ID NO: 921153 - DNA, 25 bp, Mus musculus
ctgtgcaccgacacgttctcaatgt

SEQ ID NO: 921154 - DNA, 25 bp, Mus musculus
ctgtgcaccgtcacgttctcaatgt

SEQ ID NO: 921155 - DNA, 25 bp, Mus musculus
ctgtgcacctcaaagtctaagaaat

SEQ ID NO: 921156 - DNA, 25 bp, Mus musculus
ctgtgcacctcatagtctaagaaat

SEQ ID NO: 921157 - DNA, 25 bp, Mus musculus
ctgtgcagacagcccctgcaggaac

SEQ ID NO: 921158 - DNA, 25 bp, Mus musculus
ctgtgcagacaggccctgcaggaac

SEQ ID NO: 921159 - DNA, 25 bp, Mus musculus
ctgtgcagagcacatctggtggccc

SEQ ID NO: 921160 - DNA, 25 bp, Mus musculus
ctgtgcagagcagatctggtggccc

SEQ ID NO: 921161 - DNA, 25 bp, Mus musculus
ctgtgcagctgcgacgctctacaca

SEQ ID NO: 921162 - DNA, 25 bp, Mus musculus
ctgtgcagctgcgaggctctacaca

SEQ ID NO: 921163 - DNA, 25 bp, Mus musculus
ctgtgcaggaacaacgatatcaata

SEQ ID NO: 921164 - DNA, 25 bp, Mus musculus
ctgtgcaggaacaaggatatcaata

SEQ ID NO: 921165 - DNA, 25 bp, Mus musculus
ctgtgcagtaacctcgcatccctga

SEQ ID NO: 921166 - DNA, 25 bp, Mus musculus
ctgtgcagtacggacggaggcaatg

SEQ ID NO: 921167 - DNA, 25 bp, Mus musculus
ctgtgcagtagggacggaggcaatg

SEQ ID NO: 921168 - DNA, 25 bp, Mus musculus
ctgtgcagtatcctcgcatccctga

SEQ ID NO: 921169 - DNA, 25 bp, Mus musculus
ctgtgcagtgagtgcaagatgacct

SEQ ID NO: 921170 - DNA, 25 bp, Mus musculus
ctgtgcagtgtgtgcaagatgacct

SEQ ID NO: 921171 - DNA, 25 bp, Mus musculus
ctgtgcatcggacgtcaccttcgtc

SEQ ID NO: 921172 - DNA, 25 bp, Mus musculus
ctgtgcatcggaggtcaccttcgtc

SEQ ID NO: 921173 - DNA, 25 bp, Mus musculus
ctgtgcatggcttcatgtactggac

SEQ ID NO: 921174 - DNA, 25 bp, Mus musculus
ctgtgcatgggttcatgtactggac

SEQ ID NO: 921175 - DNA, 25 bp, Mus musculus
ctgtgccaagctcgagtatgcctac

SEQ ID NO: 921176 - DNA, 25 bp, Mus musculus
ctgtgccaaggtcgagtatgcctac

SEQ ID NO: 921177 - DNA, 25 bp, Mus musculus
ctgtgccaatctgcaaatggccttt

SEQ ID NO: 921178 - DNA, 25 bp, Mus musculus
ctgtgccaatctgctaatggccttt

SEQ ID NO: 921179 - DNA, 25 bp, Mus musculus
ctgtgccagaagcggaccgagagac

SEQ ID NO: 921180 - DNA, 25 bp, Mus musculus
ctgtgccagaaggggaccgagagac

SEQ ID NO: 921181 - DNA, 25 bp, Mus musculus
ctgtgcccagatcaaatcgtgtcca

SEQ ID NO: 921182 - DNA, 25 bp, Mus musculus
ctgtgcccagatcaactattagaca

SEQ ID NO: 921183 - DNA, 25 bp, Mus musculus
ctgtgcccagatcatatcgtgtcca

SEQ ID NO: 921184 - DNA, 25 bp, Mus musculus
ctgtgcccagatcatctattagaca

SEQ ID NO: 921185 - DNA, 25 bp, Mus musculus
ctgtgcccagctggagattgacgaa

SEQ ID NO: 921186 - DNA, 25 bp, Mus musculus
ctgtgcccaggtggagattgacgaa

SEQ ID NO: 921187 - DNA, 25 bp, Mus musculus
ctgtgccctgcacgcattgattgat

SEQ ID NO: 921188 - DNA, 25 bp, Mus musculus
ctgtgccctgcaggcattgattgat

SEQ ID NO: 921189 - DNA, 25 bp, Mus musculus
ctgtgccgactacgtggaggagccc

SEQ ID NO: 921190 - DNA, 25 bp, Mus musculus
ctgtgccgactaggtggaggagccc

SEQ ID NO: 921191 - DNA, 25 bp, Mus musculus
ctgtgccgagagttcccagcatcat

SEQ ID NO: 921192 - DNA, 25 bp, Mus musculus
ctgtgccgagtgttcccagcatcat

SEQ ID NO: 921193 - DNA, 25 bp, Mus musculus
ctgtgccggatcagcagggccagga

SEQ ID NO: 921194 - DNA, 25 bp, Mus musculus
ctgtgccggatcaggagggccagga

SEQ ID NO: 921195 - DNA, 25 bp, Mus musculus
ctgtgccttgcacggctgttctcag

SEQ ID NO: 921196 - DNA, 25 bp, Mus musculus
ctgtgccttggacggctgttctcag

SEQ ID NO: 921197 - DNA, 25 bp, Mus musculus
ctgtgcgcatagcttttggctcctt

SEQ ID NO: 921198 - DNA, 25 bp, Mus musculus
ctgtgcgcataggttttggctcctt

SEQ ID NO: 921199 - DNA, 25 bp, Mus musculus
ctgtgcgctccacacgacctgctaa

SEQ ID NO: 921200 - DNA, 25 bp, Mus musculus
ctgtgcgctccacaggacctgctaa

SEQ ID NO: 921201 - DNA, 25 bp, Mus musculus
ctgtgcggcgagacacaccagaaga

SEQ ID NO: 921202 - DNA, 25 bp, Mus musculus
ctgtgcggcgagatcccacgggttc

SEQ ID NO: 921203 - DNA, 25 bp, Mus musculus
ctgtgcggcgagtcacaccagaaga

SEQ ID NO: 921204 - DNA, 25 bp, Mus musculus
ctgtgcggcgagttcccacgggttc

SEQ ID NO: 921205 - DNA, 25 bp, Mus musculus
ctgtgcgtggcggagacaggtttgg

SEQ ID NO: 921206 - DNA, 25 bp, Mus musculus
ctgtgcgtgggggagacaggtttgg

SEQ ID NO: 921207 - DNA, 25 bp, Mus musculus
ctgtgctagcaacggtccaggctct

SEQ ID NO: 921208 - DNA, 25 bp, Mus musculus
ctgtgctagctacggtccaggctct

SEQ ID NO: 921209 - DNA, 25 bp, Mus musculus
ctgtgctctgcactgtgcaatttta

SEQ ID NO: 921210 - DNA, 25 bp, Mus musculus
ctgtgctctgcagtgtgcaatttta

SEQ ID NO: 921211 - DNA, 25 bp, Mus musculus
ctgtgctgcccacatcttggtgacc

SEQ ID NO: 921212 - DNA, 25 bp, Mus musculus
ctgtgctgcccagatcttggtgacc

SEQ ID NO: 921213 - DNA, 25 bp, Mus musculus
ctgtgcttatgacacgattgtggtt

SEQ ID NO: 921214 - DNA, 25 bp, Mus musculus
ctgtgcttatgacacgctgaagcca

SEQ ID NO: 921215 - DNA, 25 bp, Mus musculus
ctgtgcttatgacaggattgtggtt

SEQ ID NO: 921216 - DNA, 25 bp, Mus musculus
ctgtgcttatgacaggctgaagcca

SEQ ID NO: 921217 - DNA, 25 bp, Mus musculus
ctgtgctttcagctcagacagccat

SEQ ID NO: 921218 - DNA, 25 bp, Mus musculus
ctgtgctttcaggtcagacagccat

SEQ ID NO: 921219 - DNA, 25 bp, Mus musculus
ctgtggaaaggaagtgtacccagct

SEQ ID NO: 921220 - DNA, 25 bp, Mus musculus
ctgtggaaaggatgtgtacccagct

SEQ ID NO: 921221 - DNA, 25 bp, Mus musculus
ctgtggaaggtccacctatccttga

SEQ ID NO: 921222 - DNA, 25 bp, Mus musculus
ctgtggaaggtccagctatccttga

SEQ ID NO: 921223 - DNA, 25 bp, Mus musculus
ctgtggacaacagggtcctgtcaga

SEQ ID NO: 921224 - DNA, 25 bp, Mus musculus
ctgtggacaacgtcctgtcagaagt

SEQ ID NO: 921225 - DNA, 25 bp, Mus musculus
ctgtggacaagagggtcctgtcaga

SEQ ID NO: 921226 - DNA, 25 bp, Mus musculus
ctgtggacaaggtcctgtcagaagt

SEQ ID NO: 921227 - DNA, 25 bp, Mus musculus
ctgtggacattgccacatctctgat

SEQ ID NO: 921228 - DNA, 25 bp, Mus musculus
ctgtggacattggcacatctctgat

SEQ ID NO: 921229 - DNA, 25 bp, Mus musculus
ctgtggaccaagccaccaagggaat

SEQ ID NO: 921230 - DNA, 25 bp, Mus musculus
ctgtggaccaaggcaccaagggaat

SEQ ID NO: 921231 - DNA, 25 bp, Mus musculus
ctgtggagaaggctcaactgctgct

SEQ ID NO: 921232 - DNA, 25 bp, Mus musculus
ctgtggagaaggctttcaaagctga

SEQ ID NO: 921233 - DNA, 25 bp, Mus musculus
ctgtggagaagggtcaactgctgct

SEQ ID NO: 921234 - DNA, 25 bp, Mus musculus
ctgtggagaagggtttcaaagctga

SEQ ID NO: 921235 - DNA, 25 bp, Mus musculus
ctgtggagattccaccaattcctgg

SEQ ID NO: 921236 - DNA, 25 bp, Mus musculus
ctgtggagattccacgaagcccctg

SEQ ID NO: 921237 - DNA, 25 bp, Mus musculus
ctgtggagattccagcaattcctgg

SEQ ID NO: 921238 - DNA, 25 bp, Mus musculus
ctgtggagattccaggaagcccctg

SEQ ID NO: 921239 - DNA, 25 bp, Mus musculus
ctgtggagccacagcactgtgagtc

SEQ ID NO: 921240 - DNA, 25 bp, Mus musculus
ctgtggagccacaggactgtgagtc

SEQ ID NO: 921241 - DNA, 25 bp, Mus musculus
ctgtggatgtattactgtgccactc

SEQ ID NO: 921242 - DNA, 25 bp, Mus musculus
ctgtggatgtctgacttctggggga

SEQ ID NO: 921243 - DNA, 25 bp, Mus musculus
ctgtggatgtgtgacttctggggga

SEQ ID NO: 921244 - DNA, 25 bp, Mus musculus
ctgtggatgttttactgtgccactc

SEQ ID NO: 921245 - DNA, 25 bp, Mus musculus
ctgtggattccacatgagaagactg

SEQ ID NO: 921246 - DNA, 25 bp, Mus musculus
ctgtggattccagatgagaagactg

SEQ ID NO: 921247 - DNA, 25 bp, Mus musculus
ctgtggcaaaagactgctggagtta

SEQ ID NO: 921248 - DNA, 25 bp, Mus musculus
ctgtggcaaaagccctggaagagag

SEQ ID NO: 921249 - DNA, 25 bp, Mus musculus
ctgtggcaaaaggcctggaagagag

SEQ ID NO: 921250 - DNA, 25 bp, Mus musculus
ctgtggcaaaagtctgctggagtta

SEQ ID NO: 921251 - DNA, 25 bp, Mus musculus
ctgtggcaagaccaagatgaagaga

SEQ ID NO: 921252 - DNA, 25 bp, Mus musculus
ctgtggcaagagcggatcactattt

SEQ ID NO: 921253 - DNA, 25 bp, Mus musculus
ctgtggcaagaggggatcactattt

SEQ ID NO: 921254 - DNA, 25 bp, Mus musculus
ctgtggcaagcgcgattccagcatc

SEQ ID NO: 921255 - DNA, 25 bp, Mus musculus
ctgtggcaagcgtgacagctctatc

SEQ ID NO: 921256 - DNA, 25 bp, Mus musculus
ctgtggcaagggcgattccagcatc

SEQ ID NO: 921257 - DNA, 25 bp, Mus musculus
ctgtggcaagggtgacagctctatc

SEQ ID NO: 921258 - DNA, 25 bp, Mus musculus
ctgtggcaagtccaagatgaagaga

SEQ ID NO: 921259 - DNA, 25 bp, Mus musculus
ctgtggcacaggagtggactccatc

SEQ ID NO: 921260 - DNA, 25 bp, Mus musculus
ctgtggcacaggtgtggactccatc

SEQ ID NO: 921261 - DNA, 25 bp, Mus musculus
ctgtggcactaacgctggtgttccc

SEQ ID NO: 921262 - DNA, 25 bp, Mus musculus
ctgtggcactaaggctggtgttccc

SEQ ID NO: 921263 - DNA, 25 bp, Mus musculus
ctgtggcactggccctagcgaccgt

SEQ ID NO: 921264 - DNA, 25 bp, Mus musculus
ctgtggcactgggcctagcgaccgt

SEQ ID NO: 921265 - DNA, 25 bp, Mus musculus
ctgtggcagaagaagccacgctatg

SEQ ID NO: 921266 - DNA, 25 bp, Mus musculus
ctgtggcagaagtagccacgctatg

SEQ ID NO: 921267 - DNA, 25 bp, Mus musculus
ctgtggcataagctgatgttccctg

SEQ ID NO: 921268 - DNA, 25 bp, Mus musculus
ctgtggcataaggtgatgttccctg

SEQ ID NO: 921269 - DNA, 25 bp, Mus musculus
ctgtggcatatgcgtgccgggtgga

SEQ ID NO: 921270 - DNA, 25 bp, Mus musculus
ctgtggcatatgggtgccgggtgga

SEQ ID NO: 921271 - DNA, 25 bp, Mus musculus
ctgtggcatgttcgaatgaatgatg

SEQ ID NO: 921272 - DNA, 25 bp, Mus musculus
ctgtggcatgttggaatgaatgatg

SEQ ID NO: 921273 - DNA, 25 bp, Mus musculus
ctgtggcattaaccactgaatgcac

SEQ ID NO: 921274 - DNA, 25 bp, Mus musculus
ctgtggcattaagcactgaatgcac

SEQ ID NO: 921275 - DNA, 25 bp, Mus musculus
ctgtggccagcatcgacgtgtctca

SEQ ID NO: 921276 - DNA, 25 bp, Mus musculus
ctgtggccaggatcgacgtgtctca

SEQ ID NO: 921277 - DNA, 25 bp, Mus musculus
ctgtggccctcagacggtctttgga

SEQ ID NO: 921278 - DNA, 25 bp, Mus musculus
ctgtggccctcagagggtctttgga

SEQ ID NO: 921279 - DNA, 25 bp, Mus musculus
ctgtggccgtggcccgcattccagg

SEQ ID NO: 921280 - DNA, 25 bp, Mus musculus
ctgtggccgtggccggcattccagg

SEQ ID NO: 921281 - DNA, 25 bp, Mus musculus
ctgtggccttttcacaactcaagct

SEQ ID NO: 921282 - DNA, 25 bp, Mus musculus
ctgtggccttttcacggctacagtg

SEQ ID NO: 921283 - DNA, 25 bp, Mus musculus
ctgtggccttttcagaactcaagct

SEQ ID NO: 921284 - DNA, 25 bp, Mus musculus
ctgtggccttttcagggctacagtg

SEQ ID NO: 921285 - DNA, 25 bp, Mus musculus
ctgtggcgaggacaaagcggtggag

SEQ ID NO: 921286 - DNA, 25 bp, Mus musculus
ctgtggcgaggagaaagcggtggag

SEQ ID NO: 921287 - DNA, 25 bp, Mus musculus
ctgtggctttgtcggccctgtcgtc

SEQ ID NO: 921288 - DNA, 25 bp, Mus musculus
ctgtggctttgtgggccctgtcgtc

SEQ ID NO: 921289 - DNA, 25 bp, Mus musculus
ctgtgggaaactacattgagcatta

SEQ ID NO: 921290 - DNA, 25 bp, Mus musculus
ctgtgggaaagtacattgagcatta

SEQ ID NO: 921291 - DNA, 25 bp, Mus musculus
ctgtgggaacagcaacagaatggaa

SEQ ID NO: 921292 - DNA, 25 bp, Mus musculus
ctgtgggaacagctattgaagcccc

SEQ ID NO: 921293 - DNA, 25 bp, Mus musculus
ctgtgggaacaggaacagaatggaa

SEQ ID NO: 921294 - DNA, 25 bp, Mus musculus
ctgtgggaacaggtattgaagcccc

SEQ ID NO: 921295 - DNA, 25 bp, Mus musculus
ctgtgggaagagcagcaagctgctg

SEQ ID NO: 921296 - DNA, 25 bp, Mus musculus
ctgtgggaagtgcagcaagctgctg

SEQ ID NO: 921297 - DNA, 25 bp, Mus musculus
ctgtgggacacaaagcacctggagg

SEQ ID NO: 921298 - DNA, 25 bp, Mus musculus
ctgtgggacacacacctggaggagc

SEQ ID NO: 921299 - DNA, 25 bp, Mus musculus
ctgtgggacacagacctggaggagc

SEQ ID NO: 921300 - DNA, 25 bp, Mus musculus
ctgtgggacacatagcacctggagg

SEQ ID NO: 921301 - DNA, 25 bp, Mus musculus
ctgtgggcagaggtctaggttacat

SEQ ID NO: 921302 - DNA, 25 bp, Mus musculus
ctgtgggcagcaggcaacagatttg

SEQ ID NO: 921303 - DNA, 25 bp, Mus musculus
ctgtgggcaggaggcaacagatttg

SEQ ID NO: 921304 - DNA, 25 bp, Mus musculus
ctgtgggcagtggtctaggttacat

SEQ ID NO: 921305 - DNA, 25 bp, Mus musculus
ctgtggggcaaacgtggtagagaaa

SEQ ID NO: 921306 - DNA, 25 bp, Mus musculus
ctgtggggcaaaggtggtagagaaa

SEQ ID NO: 921307 - DNA, 25 bp, Mus musculus
ctgtggggcgcacacccctgtgaag

SEQ ID NO: 921308 - DNA, 25 bp, Mus musculus
ctgtggggcgcacagccctgtgaag

SEQ ID NO: 921309 - DNA, 25 bp, Mus musculus
ctgtgggtaacacacaagccaccat

SEQ ID NO: 921310 - DNA, 25 bp, Mus musculus
ctgtgggtaacacagaagccaccat

SEQ ID NO: 921311 - DNA, 25 bp, Mus musculus
ctgtgggtgatgacacagcttctaa

SEQ ID NO: 921312 - DNA, 25 bp, Mus musculus
ctgtgggtgatgacagttgctttca

SEQ ID NO: 921313 - DNA, 25 bp, Mus musculus
ctgtgggtgatgactcagcttctaa

SEQ ID NO: 921314 - DNA, 25 bp, Mus musculus
ctgtgggtgatgactgttgctttca

SEQ ID NO: 921315 - DNA, 25 bp, Mus musculus
ctgtggtaagctggaagggactcag

SEQ ID NO: 921316 - DNA, 25 bp, Mus musculus
ctgtggtaaggtggaagggactcag

SEQ ID NO: 921317 - DNA, 25 bp, Mus musculus
ctgtggtggagaaactttgctatga

SEQ ID NO: 921318 - DNA, 25 bp, Mus musculus
ctgtggtggagaaagtttgctatga

SEQ ID NO: 921319 - DNA, 25 bp, Mus musculus
ctgtggtggccacgggctggatgga

SEQ ID NO: 921320 - DNA, 25 bp, Mus musculus
ctgtggtggccaggggctggatgga

SEQ ID NO: 921321 - DNA, 25 bp, Mus musculus
ctgtggtttcctcgctgaggaatcg

SEQ ID NO: 921322 - DNA, 25 bp, Mus musculus
ctgtggtttcctggctgaggaatcg

SEQ ID NO: 921323 - DNA, 25 bp, Mus musculus
ctgtgtactgcccgcaacccagaca

SEQ ID NO: 921324 - DNA, 25 bp, Mus musculus
ctgtgtactgcccggaacccagaca

SEQ ID NO: 921325 - DNA, 25 bp, Mus musculus
ctgtgtagaagccaaccgttctcgt

SEQ ID NO: 921326 - DNA, 25 bp, Mus musculus
ctgtgtagaagccatccgttctcgt

SEQ ID NO: 921327 - DNA, 25 bp, Mus musculus
ctgtgtcaagagagaaaggcactat

SEQ ID NO: 921328 - DNA, 25 bp, Mus musculus
ctgtgtcaagtgagaaaggcactat

SEQ ID NO: 921329 - DNA, 25 bp, Mus musculus
ctgtgtcctgagaatcccaggcgcg

SEQ ID NO: 921330 - DNA, 25 bp, Mus musculus
ctgtgtcctgagcatctttccaacc

SEQ ID NO: 921331 - DNA, 25 bp, Mus musculus
ctgtgtcctgaggatctttccaacc

SEQ ID NO: 921332 - DNA, 25 bp, Mus musculus
ctgtgtcctgagtatcccaggcgcg

SEQ ID NO: 921333 - DNA, 25 bp, Mus musculus
ctgtgtcctgcatcaaccttagctt

SEQ ID NO: 921334 - DNA, 25 bp, Mus musculus
ctgtgtcctggatcaaccttagctt

SEQ ID NO: 921335 - DNA, 25 bp, Mus musculus
ctgtgtctaaagcgcttctctgcct

SEQ ID NO: 921336 - DNA, 25 bp, Mus musculus
ctgtgtctaaagctaaaacagacta

SEQ ID NO: 921337 - DNA, 25 bp, Mus musculus
ctgtgtctaaagggcttctctgcct

SEQ ID NO: 921338 - DNA, 25 bp, Mus musculus
ctgtgtctaaaggtaaaacagacta

SEQ ID NO: 921339 - DNA, 25 bp, Mus musculus
ctgtgtctgcacggaaggagtaacg

SEQ ID NO: 921340 - DNA, 25 bp, Mus musculus
ctgtgtctgctcggaaggagtaacg

SEQ ID NO: 921341 - DNA, 25 bp, Mus musculus
ctgtgtgagctgcaaatgaagcatc

SEQ ID NO: 921342 - DNA, 25 bp, Mus musculus
ctgtgtgagctggaaatgaagcatc

SEQ ID NO: 921343 - DNA, 25 bp, Mus musculus
ctgtgtgcagctaccgacactactg

SEQ ID NO: 921344 - DNA, 25 bp, Mus musculus
ctgtgtgcagctacggacactactg

SEQ ID NO: 921345 - DNA, 25 bp, Mus musculus
ctgtgtgcagctgtgcggcgctggc

SEQ ID NO: 921346 - DNA, 25 bp, Mus musculus
ctgtgtgcaggtgtgcggcgctggc

SEQ ID NO: 921347 - DNA, 25 bp, Mus musculus
ctgtgtgcccagcccagtatggaat

SEQ ID NO: 921348 - DNA, 25 bp, Mus musculus
ctgtgtgcccaggccagtatggaat

SEQ ID NO: 921349 - DNA, 25 bp, Mus musculus
ctgtgtgcctctctgctaggtttat

SEQ ID NO: 921350 - DNA, 25 bp, Mus musculus
ctgtgtgcctctgtgctaggtttat

SEQ ID NO: 921351 - DNA, 25 bp, Mus musculus
ctgtgtggaagaacccctcagcagc

SEQ ID NO: 921352 - DNA, 25 bp, Mus musculus
ctgtgtggaagatcccctcagcagc

SEQ ID NO: 921353 - DNA, 25 bp, Mus musculus
ctgtgtggagctactacaagcctgg

SEQ ID NO: 921354 - DNA, 25 bp, Mus musculus
ctgtgtggaggtactacaagcctgg

SEQ ID NO: 921355 - DNA, 25 bp, Mus musculus
ctgtgtggcaagcttggtgctctct

SEQ ID NO: 921356 - DNA, 25 bp, Mus musculus
ctgtgtggcaaggttggtgctctct

SEQ ID NO: 921357 - DNA, 25 bp, Mus musculus
ctgtgtgggagagacgcaccatgac

SEQ ID NO: 921358 - DNA, 25 bp, Mus musculus
ctgtgtgggagagaggcaccatgac

SEQ ID NO: 921359 - DNA, 25 bp, Mus musculus
ctgtgtgtcgagcagatggtgtcta

SEQ ID NO: 921360 - DNA, 25 bp, Mus musculus
ctgtgtgtcgaggagatggtgtcta

SEQ ID NO: 921361 - DNA, 25 bp, Mus musculus
ctgtgtgtcggacaggctggtccag

SEQ ID NO: 921362 - DNA, 25 bp, Mus musculus
ctgtgtgtcggaccctccgaagtag

SEQ ID NO: 921363 - DNA, 25 bp, Mus musculus
ctgtgtgtcggagaggctggtccag

SEQ ID NO: 921364 - DNA, 25 bp, Mus musculus
ctgtgtgtcggagcctccgaagtag

SEQ ID NO: 921365 - DNA, 25 bp, Mus musculus
ctgtgtgtgattaaccctctggact

SEQ ID NO: 921366 - DNA, 25 bp, Mus musculus
ctgtgtgtgattaagcctctggact

SEQ ID NO: 921367 - DNA, 25 bp, Mus musculus
ctgtgtgttctgtacattcgagtaa

SEQ ID NO: 921368 - DNA, 25 bp, Mus musculus
ctgtgtgttctgtagattcgagtaa

SEQ ID NO: 921369 - DNA, 25 bp, Mus musculus
ctgtgttactgacggactttgtaaa

SEQ ID NO: 921370 - DNA, 25 bp, Mus musculus
ctgtgttactgagggactttgtaaa

SEQ ID NO: 921371 - DNA, 25 bp, Mus musculus
ctgtgttcttcccaccctcctggtg

SEQ ID NO: 921372 - DNA, 25 bp, Mus musculus
ctgtgttcttcccagcctcctggtg

SEQ ID NO: 921373 - DNA, 25 bp, Mus musculus
ctgtgttgagcacatcgagtcacgt

SEQ ID NO: 921374 - DNA, 25 bp, Mus musculus
ctgtgttgagctcctgagttcaatt

SEQ ID NO: 921375 - DNA, 25 bp, Mus musculus
ctgtgttgaggacatcgagtcacgt

SEQ ID NO: 921376 - DNA, 25 bp, Mus musculus
ctgtgttgaggtcctgagttcaatt

SEQ ID NO: 921377 - DNA, 25 bp, Mus musculus
ctgtgttgtctccgttcctagtttc

SEQ ID NO: 921378 - DNA, 25 bp, Mus musculus
ctgtgttgtctcggttcctagtttc

SEQ ID NO: 921379 - DNA, 25 bp, Mus musculus
ctgtgtttgctacagggcaatgcga

SEQ ID NO: 921380 - DNA, 25 bp, Mus musculus
ctgtgtttgctagagggcaatgcga

SEQ ID NO: 921381 - DNA, 25 bp, Mus musculus
ctgtgtttggctttccacaggcatc

SEQ ID NO: 921382 - DNA, 25 bp, Mus musculus
ctgtgtttgggtttccacaggcatc

SEQ ID NO: 921383 - DNA, 25 bp, Mus musculus
ctgtgttttgtgaacagtacccagt

SEQ ID NO: 921384 - DNA, 25 bp, Mus musculus
ctgtgttttgtgaaccctggatggt

SEQ ID NO: 921385 - DNA, 25 bp, Mus musculus
ctgtgttttgtgaagagtacccagt

SEQ ID NO: 921386 - DNA, 25 bp, Mus musculus
ctgtgttttgtgaagcctggatggt

SEQ ID NO: 921387 - DNA, 25 bp, Mus musculus
ctgttaacaggccaaggatgcccgg

SEQ ID NO: 921388 - DNA, 25 bp, Mus musculus
ctgttaacaggccatggatgcccgg

SEQ ID NO: 921389 - DNA, 25 bp, Mus musculus
ctgttacacgaaacaattcaagatc

SEQ ID NO: 921390 - DNA, 25 bp, Mus musculus
ctgttacacgtaacaattcaagatc

SEQ ID NO: 921391 - DNA, 25 bp, Mus musculus
ctgttacctgcgcccccagattgcg

SEQ ID NO: 921392 - DNA, 25 bp, Mus musculus
ctgttacctgggcccccagattgcg

SEQ ID NO: 921393 - DNA, 25 bp, Mus musculus
ctgttacgcttgaacttcatcctgc

SEQ ID NO: 921394 - DNA, 25 bp, Mus musculus
ctgttacgcttgtacttcatcctgc

SEQ ID NO: 921395 - DNA, 25 bp, Mus musculus
ctgttactaaagcatgactatgaag

SEQ ID NO: 921396 - DNA, 25 bp, Mus musculus
ctgttactaaaggatgactatgaag

SEQ ID NO: 921397 - DNA, 25 bp, Mus musculus
ctgttagcaaatactctgtctgctc

SEQ ID NO: 921398 - DNA, 25 bp, Mus musculus
ctgttagcaaattctctgtctgctc

SEQ ID NO: 921399 - DNA, 25 bp, Mus musculus
ctgttatcaatgcacattttccctt

SEQ ID NO: 921400 - DNA, 25 bp, Mus musculus
ctgttatcaatgcagattttccctt

SEQ ID NO: 921401 - DNA, 25 bp, Mus musculus
ctgttatgattactgcaattgagaa

SEQ ID NO: 921402 - DNA, 25 bp, Mus musculus
ctgttatgattagtgcaattgagaa

SEQ ID NO: 921403 - DNA, 25 bp, Mus musculus
ctgttattgaaacgtgacattccca

SEQ ID NO: 921404 - DNA, 25 bp, Mus musculus
ctgttattgaaaggtgacattccca

SEQ ID NO: 921405 - DNA, 25 bp, Mus musculus
ctgttcaaccctcactctaaggggc

SEQ ID NO: 921406 - DNA, 25 bp, Mus musculus
ctgttcaaccctgactctaaggggc

SEQ ID NO: 921407 - DNA, 25 bp, Mus musculus
ctgttcacctcacatgcctgtggtc

SEQ ID NO: 921408 - DNA, 25 bp, Mus musculus
ctgttcacctcagatgcctgtggtc

SEQ ID NO: 921409 - DNA, 25 bp, Mus musculus
ctgttcagagcataccacgggcccc

SEQ ID NO: 921410 - DNA, 25 bp, Mus musculus
ctgttcagaggataccacgggcccc

SEQ ID NO: 921411 - DNA, 25 bp, Mus musculus
ctgttcatggccttgtgaacccaac

SEQ ID NO: 921412 - DNA, 25 bp, Mus musculus
ctgttcatgggcttgtgaacccaac

SEQ ID NO: 921413 - DNA, 25 bp, Mus musculus
ctgttcccatcagaacccctgagcc

SEQ ID NO: 921414 - DNA, 25 bp, Mus musculus
ctgttcccatcgaatcattggtctg

SEQ ID NO: 921415 - DNA, 25 bp, Mus musculus
ctgttcccatgagaacccctgagcc

SEQ ID NO: 921416 - DNA, 25 bp, Mus musculus
ctgttcccatggaatcattggtctg

SEQ ID NO: 921417 - DNA, 25 bp, Mus musculus
ctgttcctagcagccgttcagtcca

SEQ ID NO: 921418 - DNA, 25 bp, Mus musculus
ctgttcctaggagccgttcagtcca

SEQ ID NO: 921419 - DNA, 25 bp, Mus musculus
ctgttcgaaaccaacaatcttgtgg

SEQ ID NO: 921420 - DNA, 25 bp, Mus musculus
ctgttcgaaaccaagaatcttgtgg

SEQ ID NO: 921421 - DNA, 25 bp, Mus musculus
ctgttcgccagcaacatctccagca

SEQ ID NO: 921422 - DNA, 25 bp, Mus musculus
ctgttcgccagcaagatctccagca

SEQ ID NO: 921423 - DNA, 25 bp, Mus musculus
ctgttcgcgaagaatcgagatccga

SEQ ID NO: 921424 - DNA, 25 bp, Mus musculus
ctgttcgcgaagagcgtccccacgc

SEQ ID NO: 921425 - DNA, 25 bp, Mus musculus
ctgttcgcgaagtatcgagatccga

SEQ ID NO: 921426 - DNA, 25 bp, Mus musculus
ctgttcgcgaagtgcgtccccacgc

SEQ ID NO: 921427 - DNA, 25 bp, Mus musculus
ctgttcggagctctcatcggctcgg

SEQ ID NO: 921428 - DNA, 25 bp, Mus musculus
ctgttcggaggtctcatcggctcgg

SEQ ID NO: 921429 - DNA, 25 bp, Mus musculus
ctgttctaagacccacctgcctggg

SEQ ID NO: 921430 - DNA, 25 bp, Mus musculus
ctgttctaagtcccacctgcctggg

SEQ ID NO: 921431 - DNA, 25 bp, Mus musculus
ctgttctcttggagttctgacggga

SEQ ID NO: 921432 - DNA, 25 bp, Mus musculus
ctgttctcttggtgttctgacggga

SEQ ID NO: 921433 - DNA, 25 bp, Mus musculus
ctgttcttgccgctaatatttgcta

SEQ ID NO: 921434 - DNA, 25 bp, Mus musculus
ctgttcttgccggtaatatttgcta

SEQ ID NO: 921435 - DNA, 25 bp, Mus musculus
ctgttcttggagcagggcaatgcga

SEQ ID NO: 921436 - DNA, 25 bp, Mus musculus
ctgttcttggaggagggcaatgcga

SEQ ID NO: 921437 - DNA, 25 bp, Mus musculus
ctgttcttggcgcactgcaaaacca

SEQ ID NO: 921438 - DNA, 25 bp, Mus musculus
ctgttcttggggcactgcaaaacca

SEQ ID NO: 921439 - DNA, 25 bp, Mus musculus
ctgttgaaagctttcctgcagttag

SEQ ID NO: 921440 - DNA, 25 bp, Mus musculus
ctgttgaaaggtttcctgcagttag

SEQ ID NO: 921441 - DNA, 25 bp, Mus musculus
ctgttgacccttgccatccttgcac

SEQ ID NO: 921442 - DNA, 25 bp, Mus musculus
ctgttgacccttgcgatccttgcac

SEQ ID NO: 921443 - DNA, 25 bp, Mus musculus
ctgttgatctgatactttatctgcg

SEQ ID NO: 921444 - DNA, 25 bp, Mus musculus
ctgttgatctgatagtttatctgcg

SEQ ID NO: 921445 - DNA, 25 bp, Mus musculus
ctgttgatggaggacgctatggggg

SEQ ID NO: 921446 - DNA, 25 bp, Mus musculus
ctgttgatggaggaggctatggggg

SEQ ID NO: 921447 - DNA, 25 bp, Mus musculus
ctgttgcaagagcgtgaagaagctg

SEQ ID NO: 921448 - DNA, 25 bp, Mus musculus
ctgttgcaagagggtgaagaagctg

SEQ ID NO: 921449 - DNA, 25 bp, Mus musculus
ctgttgcaagcctacttctccctac

SEQ ID NO: 921450 - DNA, 25 bp, Mus musculus
ctgttgcaagctgatctctgcacga

SEQ ID NO: 921451 - DNA, 25 bp, Mus musculus
ctgttgcaaggctacttctccctac

SEQ ID NO: 921452 - DNA, 25 bp, Mus musculus
ctgttgcaaggtgatctctgcacga

SEQ ID NO: 921453 - DNA, 25 bp, Mus musculus
ctgttgcgacagcacgtcaaggaga

SEQ ID NO: 921454 - DNA, 25 bp, Mus musculus
ctgttgcgacagcaggtcaaggaga

SEQ ID NO: 921455 - DNA, 25 bp, Mus musculus
ctgttgctcgctgcgggcgagtcag

SEQ ID NO: 921456 - DNA, 25 bp, Mus musculus
ctgttgctcggtgcgggcgagtcag

SEQ ID NO: 921457 - DNA, 25 bp, Mus musculus
ctgttgctgctgatatttccgagag

SEQ ID NO: 921458 - DNA, 25 bp, Mus musculus
ctgttgctgctgttatttccgagag

SEQ ID NO: 921459 - DNA, 25 bp, Mus musculus
ctgttgctgtgaacatgctccttac

SEQ ID NO: 921460 - DNA, 25 bp, Mus musculus
ctgttgctgtgatcatgctccttac

SEQ ID NO: 921461 - DNA, 25 bp, Mus musculus
ctgttggcagaggacagcctgaaca

SEQ ID NO: 921462 - DNA, 25 bp, Mus musculus
ctgttggcagaggagagcctgaaca

SEQ ID NO: 921463 - DNA, 25 bp, Mus musculus
ctgttggcagatctggcaggtgatc

SEQ ID NO: 921464 - DNA, 25 bp, Mus musculus
ctgttggcagttctggcaggtgatc

SEQ ID NO: 921465 - DNA, 25 bp, Mus musculus
ctgttggcccagctgacaagctaca

SEQ ID NO: 921466 - DNA, 25 bp, Mus musculus
ctgttggcccaggtgacaagctaca

SEQ ID NO: 921467 - DNA, 25 bp, Mus musculus
ctgttggctatactgaagtgcatgc

SEQ ID NO: 921468 - DNA, 25 bp, Mus musculus
ctgttggctatagtgaagtgcatgc

SEQ ID NO: 921469 - DNA, 25 bp, Mus musculus
ctgttggtgctacgaccccctgtca

SEQ ID NO: 921470 - DNA, 25 bp, Mus musculus
ctgttggtgctaggaccccctgtca

SEQ ID NO: 921471 - DNA, 25 bp, Mus musculus
ctgtttactcccaaaatgaagactc

SEQ ID NO: 921472 - DNA, 25 bp, Mus musculus
ctgtttactcccaatatgaagactc

SEQ ID NO: 921473 - DNA, 25 bp, Mus musculus
ctgtttagaaaggcactggaactga

SEQ ID NO: 921474 - DNA, 25 bp, Mus musculus
ctgtttagaaaggctctggaactga

SEQ ID NO: 921475 - DNA, 25 bp, Mus musculus
ctgtttatcaacaaccctcttattg

SEQ ID NO: 921476 - DNA, 25 bp, Mus musculus
ctgtttatcaacaagcctcttattg

SEQ ID NO: 921477 - DNA, 25 bp, Mus musculus
ctgtttatcgaggacgcagcgggcc

SEQ ID NO: 921478 - DNA, 25 bp, Mus musculus
ctgtttatcgaggaggcagcgggcc

SEQ ID NO: 921479 - DNA, 25 bp, Mus musculus
ctgtttcagaaacgaaaaccacatt

SEQ ID NO: 921480 - DNA, 25 bp, Mus musculus
ctgtttcagaaaggaaaaccacatt

SEQ ID NO: 921481 - DNA, 25 bp, Mus musculus
ctgtttcccgcgcgcaaggcacgag

SEQ ID NO: 921482 - DNA, 25 bp, Mus musculus
ctgtttcccgcgcgtgtcctggctg

SEQ ID NO: 921483 - DNA, 25 bp, Mus musculus
ctgtttcccgcgggcaaggcacgag

SEQ ID NO: 921484 - DNA, 25 bp, Mus musculus
ctgtttcccgcgggtgtcctggctg

SEQ ID NO: 921485 - DNA, 25 bp, Mus musculus
ctgtttccggctgccatgcagaagg

SEQ ID NO: 921486 - DNA, 25 bp, Mus musculus
ctgtttccgggtgccatgcagaagg

SEQ ID NO: 921487 - DNA, 25 bp, Mus musculus
ctgtttgaagcgatcgcccgaattg

SEQ ID NO: 921488 - DNA, 25 bp, Mus musculus
ctgtttgaagggatcgcccgaattg

SEQ ID NO: 921489 - DNA, 25 bp, Mus musculus
ctgtttgagcagcaccaaaaagatg

SEQ ID NO: 921490 - DNA, 25 bp, Mus musculus
ctgtttgagcagcagcaaaaagatg

SEQ ID NO: 921491 - DNA, 25 bp, Mus musculus
ctgtttgagtcatgagccggcaggt

SEQ ID NO: 921492 - DNA, 25 bp, Mus musculus
ctgtttgagtgatgagccggcaggt

SEQ ID NO: 921493 - DNA, 25 bp, Mus musculus
ctgtttgatgagcgccgcctgacag

SEQ ID NO: 921494 - DNA, 25 bp, Mus musculus
ctgtttgatgagggccgcctgacag

SEQ ID NO: 921495 - DNA, 25 bp, Mus musculus
ctgtttgcacagcttgtgttgcctg

SEQ ID NO: 921496 - DNA, 25 bp, Mus musculus
ctgtttgcacaggttgtgttgcctg

SEQ ID NO: 921497 - DNA, 25 bp, Mus musculus
ctgtttgcagtcactcaagctttta

SEQ ID NO: 921498 - DNA, 25 bp, Mus musculus
ctgtttgcagtctctcaagctttta

SEQ ID NO: 921499 - DNA, 25 bp, Mus musculus
ctgtttgctgtgcgaatcaagaatg

SEQ ID NO: 921500 - DNA, 25 bp, Mus musculus
ctgtttgctgtgggaatcaagaatg

SEQ ID NO: 921501 - DNA, 25 bp, Mus musculus
ctgtttggagagacatcatttcagc

SEQ ID NO: 921502 - DNA, 25 bp, Mus musculus
ctgtttggagagagacatcatttca

SEQ ID NO: 921503 - DNA, 25 bp, Mus musculus
ctgtttggagagtcatcatttcagc

SEQ ID NO: 921504 - DNA, 25 bp, Mus musculus
ctgtttggagagtgacatcatttca

SEQ ID NO: 921505 - DNA, 25 bp, Mus musculus
ctgtttggcgttcaactgaacatag

SEQ ID NO: 921506 - DNA, 25 bp, Mus musculus
ctgtttggcgttcatctgaacatag

SEQ ID NO: 921507 - DNA, 25 bp, Mus musculus
ctgtttggtcagctggtacgtgggc

SEQ ID NO: 921508 - DNA, 25 bp, Mus musculus
ctgtttggtcaggtggtacgtgggc

SEQ ID NO: 921509 - DNA, 25 bp, Mus musculus
ctgtttgtcgcactttatcttcaag

SEQ ID NO: 921510 - DNA, 25 bp, Mus musculus
ctgtttgtcgcagtttatcttcaag

SEQ ID NO: 921511 - DNA, 25 bp, Mus musculus
ctgtttgtgacctgtgttttgtgaa

SEQ ID NO: 921512 - DNA, 25 bp, Mus musculus
ctgtttgtgagctgtgttttgtgaa

SEQ ID NO: 921513 - DNA, 25 bp, Mus musculus
ctgttttatcctcgtctctaataaa

SEQ ID NO: 921514 - DNA, 25 bp, Mus musculus
ctgttttatcctggtctctaataaa

SEQ ID NO: 921515 - DNA, 25 bp, Mus musculus
ctgttttatgagatgtccagctcgc

SEQ ID NO: 921516 - DNA, 25 bp, Mus musculus
ctgttttatgagttgtccagctcgc

SEQ ID NO: 921517 - DNA, 25 bp, Mus musculus
ctgttttcacagcaactggtgacta

SEQ ID NO: 921518 - DNA, 25 bp, Mus musculus
ctgttttcacaggaactggtgacta

SEQ ID NO: 921519 - DNA, 25 bp, Mus musculus
ctgttttctatgcaaggcagtattg

SEQ ID NO: 921520 - DNA, 25 bp, Mus musculus
ctgttttctatggaaggcagtattg

SEQ ID NO: 921521 - DNA, 25 bp, Mus musculus
ctgttttgccagatagctgatttgg

SEQ ID NO: 921522 - DNA, 25 bp, Mus musculus
ctgttttgccagttagctgatttgg

SEQ ID NO: 921523 - DNA, 25 bp, Mus musculus
ctgttttgcgcaaaacacggcatgt

SEQ ID NO: 921524 - DNA, 25 bp, Mus musculus
ctgttttgcggaaaacacggcatgt

SEQ ID NO: 921525 - DNA, 25 bp, Mus musculus
ctgttttgttgcttacccagcacta

SEQ ID NO: 921526 - DNA, 25 bp, Mus musculus
ctgttttgttgctttcccagcacta

SEQ ID NO: 921527 - DNA, 25 bp, Mus musculus
ctgtttttacaacgcgaggagaaga

SEQ ID NO: 921528 - DNA, 25 bp, Mus musculus
ctgtttttacaaggcgaggagaaga

SEQ ID NO: 921529 - DNA, 25 bp, Mus musculus
ctgttttttaccacaatggaaggtc

SEQ ID NO: 921530 - DNA, 25 bp, Mus musculus
ctgttttttagcacaatggaaggtc

SEQ ID NO: 921531 - DNA, 25 bp, Mus musculus
cttaaaaatgcaccaacaattctct

SEQ ID NO: 921532 - DNA, 25 bp, Mus musculus
cttaaaaatgcagcaacaattctct

SEQ ID NO: 921533 - DNA, 25 bp, Mus musculus
cttaaacttccacatttgaagagga

SEQ ID NO: 921534 - DNA, 25 bp, Mus musculus
cttaaacttccagatttgaagagga

SEQ ID NO: 921535 - DNA, 25 bp, Mus musculus
cttaaagaaaagctgaaagcaatgg

SEQ ID NO: 921536 - DNA, 25 bp, Mus musculus
cttaaagaaaaggtgaaagcaatgg

SEQ ID NO: 921537 - DNA, 25 bp, Mus musculus
cttaaagaggccttggggcatatct

SEQ ID NO: 921538 - DNA, 25 bp, Mus musculus
cttaaagagggcttggggcatatct

SEQ ID NO: 921539 - DNA, 25 bp, Mus musculus
cttaaagatgaggtcctgtaataaa

SEQ ID NO: 921540 - DNA, 25 bp, Mus musculus
cttaaagatgcaggcgccgaggaga

SEQ ID NO: 921541 - DNA, 25 bp, Mus musculus
cttaaagatgccttgtccatgcgat

SEQ ID NO: 921542 - DNA, 25 bp, Mus musculus
cttaaagatgcgggctgaggcgatg

SEQ ID NO: 921543 - DNA, 25 bp, Mus musculus
cttaaagatggaggcgccgaggaga

SEQ ID NO: 921544 - DNA, 25 bp, Mus musculus
cttaaagatggcttgtccatgcgat

SEQ ID NO: 921545 - DNA, 25 bp, Mus musculus
cttaaagatgggggctgaggcgatg

SEQ ID NO: 921546 - DNA, 25 bp, Mus musculus
cttaaagatgtggtcctgtaataaa

SEQ ID NO: 921547 - DNA, 25 bp, Mus musculus
cttaaagattcagacggctctggaa

SEQ ID NO: 921548 - DNA, 25 bp, Mus musculus
cttaaagattcagagggctctggaa

SEQ ID NO: 921549 - DNA, 25 bp, Mus musculus
cttaaagcagcgagaattaccaaga

SEQ ID NO: 921550 - DNA, 25 bp, Mus musculus
cttaaagcagggagaattaccaaga

SEQ ID NO: 921551 - DNA, 25 bp, Mus musculus
cttaaagcatgtcatgtctaacaca

SEQ ID NO: 921552 - DNA, 25 bp, Mus musculus
cttaaagcatgtgatgtctaacaca

SEQ ID NO: 921553 - DNA, 25 bp, Mus musculus
cttaaatgtaagaatgttgctgaag

SEQ ID NO: 921554 - DNA, 25 bp, Mus musculus
cttaaatgtaagtatgttgctgaag

SEQ ID NO: 921555 - DNA, 25 bp, Mus musculus
cttaaatgtagaccttgtggtgtga

SEQ ID NO: 921556 - DNA, 25 bp, Mus musculus
cttaaatgtagagcttgtggtgtga

SEQ ID NO: 921557 - DNA, 25 bp, Mus musculus
cttaaattgctcaacagacatttta

SEQ ID NO: 921558 - DNA, 25 bp, Mus musculus
cttaaattgctcaacagtcctaaac

SEQ ID NO: 921559 - DNA, 25 bp, Mus musculus
cttaaattgctcaagagacatttta

SEQ ID NO: 921560 - DNA, 25 bp, Mus musculus
cttaaattgctcaagagtcctaaac

SEQ ID NO: 921561 - DNA, 25 bp, Mus musculus
cttaaatttgaagacatcaccagtg

SEQ ID NO: 921562 - DNA, 25 bp, Mus musculus
cttaaatttgaagagatcaccagtg

SEQ ID NO: 921563 - DNA, 25 bp, Mus musculus
cttaacaaatgtcgacctaagaggg

SEQ ID NO: 921564 - DNA, 25 bp, Mus musculus
cttaacaaatgtggacctaagaggg

SEQ ID NO: 921565 - DNA, 25 bp, Mus musculus
cttaacaagcacaatgggtgtgttt

SEQ ID NO: 921566 - DNA, 25 bp, Mus musculus
cttaacaagcactatgggtgtgttt

SEQ ID NO: 921567 - DNA, 25 bp, Mus musculus
cttaacagaaaacgagtgtgtgagg

SEQ ID NO: 921568 - DNA, 25 bp, Mus musculus
cttaacagaaaaggagtgtgtgagg

SEQ ID NO: 921569 - DNA, 25 bp, Mus musculus
cttaacagaacaggagtgtgtgagg

SEQ ID NO: 921570 - DNA, 25 bp, Mus musculus
cttaacagaagaggagtgtgtgagg

SEQ ID NO: 921571 - DNA, 25 bp, Mus musculus
cttaacctagagcgcgtgactgaga

SEQ ID NO: 921572 - DNA, 25 bp, Mus musculus
cttaacctagagcgggtgactgaga

SEQ ID NO: 921573 - DNA, 25 bp, Mus musculus
cttaactgatctgccggtgaatccg

SEQ ID NO: 921574 - DNA, 25 bp, Mus musculus
cttaactgatgtgccggtgaatccg

SEQ ID NO: 921575 - DNA, 25 bp, Mus musculus
cttaactgcttgcgttctccatata

SEQ ID NO: 921576 - DNA, 25 bp, Mus musculus
cttaactgcttgggttctccatata

SEQ ID NO: 921577 - DNA, 25 bp, Mus musculus
cttaagaaccccaacaggttcaatg

SEQ ID NO: 921578 - DNA, 25 bp, Mus musculus
cttaagaaccccaagaggttcaatg

SEQ ID NO: 921579 - DNA, 25 bp, Mus musculus
cttaagaagaaaccagcacacacag

SEQ ID NO: 921580 - DNA, 25 bp, Mus musculus
cttaagaagaaacgactgacagacg

SEQ ID NO: 921581 - DNA, 25 bp, Mus musculus
cttaagaagaaagcagcacacacag

SEQ ID NO: 921582 - DNA, 25 bp, Mus musculus
cttaagaagaaaggactgacagacg

SEQ ID NO: 921583 - DNA, 25 bp, Mus musculus
cttaagacctattactgacagtcct

SEQ ID NO: 921584 - DNA, 25 bp, Mus musculus
cttaagaccttttactgacagtcct

SEQ ID NO: 921585 - DNA, 25 bp, Mus musculus
cttaagcccacactgaccacaagta

SEQ ID NO: 921586 - DNA, 25 bp, Mus musculus
cttaagcccacagtgaccacaagta

SEQ ID NO: 921587 - DNA, 25 bp, Mus musculus
cttaagcgacagctgtccttggaat

SEQ ID NO: 921588 - DNA, 25 bp, Mus musculus
cttaagcgacaggtgtccttggaat

SEQ ID NO: 921589 - DNA, 25 bp, Mus musculus
cttaaggaagcccaagattgtatgc

SEQ ID NO: 921590 - DNA, 25 bp, Mus musculus
cttaaggaaggccaagattgtatgc

SEQ ID NO: 921591 - DNA, 25 bp, Mus musculus
cttaagtacaagaaaggaggtgtgg

SEQ ID NO: 921592 - DNA, 25 bp, Mus musculus
cttaagtacaagtaaggaggtgtgg

SEQ ID NO: 921593 - DNA, 25 bp, Mus musculus
cttaagtaccagctgctggacggag

SEQ ID NO: 921594 - DNA, 25 bp, Mus musculus
cttaagtaccaggtgctggacggag

SEQ ID NO: 921595 - DNA, 25 bp, Mus musculus
cttaagtatcttaacgtttcaggca

SEQ ID NO: 921596 - DNA, 25 bp, Mus musculus
cttaagtatcttaaggtttcaggca

SEQ ID NO: 921597 - DNA, 25 bp, Mus musculus
cttaagtatttgatgctggagaagc

SEQ ID NO: 921598 - DNA, 25 bp, Mus musculus
cttaagtatttgcctcagtgtttag

SEQ ID NO: 921599 - DNA, 25 bp, Mus musculus
cttaagtatttggctcagtgtttag

SEQ ID NO: 921600 - DNA, 25 bp, Mus musculus
cttaagtatttgttgctggagaagc

SEQ ID NO: 921601 - DNA, 25 bp, Mus musculus
cttaagtgaagacggcattcaagga

SEQ ID NO: 921602 - DNA, 25 bp, Mus musculus
cttaagtgaagagggcattcaagga

SEQ ID NO: 921603 - DNA, 25 bp, Mus musculus
cttaagtgaggacacgcttttgatt

SEQ ID NO: 921604 - DNA, 25 bp, Mus musculus
cttaagtgaggacaggcttttgatt

SEQ ID NO: 921605 - DNA, 25 bp, Mus musculus
cttaagtttatgaattcctcagaga

SEQ ID NO: 921606 - DNA, 25 bp, Mus musculus
cttaagtttatgagctctatgccca

SEQ ID NO: 921607 - DNA, 25 bp, Mus musculus
cttaagtttatgcctgcagttccgg

SEQ ID NO: 921608 - DNA, 25 bp, Mus musculus
cttaagtttatggctgcagttccgg

SEQ ID NO: 921609 - DNA, 25 bp, Mus musculus
cttaagtttatgtattcctcagaga

SEQ ID NO: 921610 - DNA, 25 bp, Mus musculus
cttaagtttatgtgctctatgccca

SEQ ID NO: 921611 - DNA, 25 bp, Mus musculus
cttaatatgcatcttacttggagtg

SEQ ID NO: 921612 - DNA, 25 bp, Mus musculus
cttaatatgcatgttacttggagtg

SEQ ID NO: 921613 - DNA, 25 bp, Mus musculus
cttaatcaaaaaaactaaggctcgt

SEQ ID NO: 921614 - DNA, 25 bp, Mus musculus
cttaatcaaaaatactaaggctcgt

SEQ ID NO: 921615 - DNA, 25 bp, Mus musculus
cttaatgacagacatacttggtcgt

SEQ ID NO: 921616 - DNA, 25 bp, Mus musculus
cttaatgacagagatacttggtcgt

SEQ ID NO: 921617 - DNA, 25 bp, Mus musculus
cttaatgagatcctcacattagctt

SEQ ID NO: 921618 - DNA, 25 bp, Mus musculus
cttaatgagatcgtcacattagctt

SEQ ID NO: 921619 - DNA, 25 bp, Mus musculus
cttaattatgcgagatacagttctg

SEQ ID NO: 921620 - DNA, 25 bp, Mus musculus
cttaattatgggagatacagttctg

SEQ ID NO: 921621 - DNA, 25 bp, Mus musculus
cttacaaaactgattcggaagacaa

SEQ ID NO: 921622 - DNA, 25 bp, Mus musculus
cttacaaaactgtttcggaagacaa

SEQ ID NO: 921623 - DNA, 25 bp, Mus musculus
cttacaagtacattctgacctgtgc

SEQ ID NO: 921624 - DNA, 25 bp, Mus musculus
cttacaagtacattgtgacctgtgc

SEQ ID NO: 921625 - DNA, 25 bp, Mus musculus
cttacaataatgaccaatggacatt

SEQ ID NO: 921626 - DNA, 25 bp, Mus musculus
cttacaataatgtccaatggacatt

SEQ ID NO: 921627 - DNA, 25 bp, Mus musculus
cttacaatcaagatttctgaccgag

SEQ ID NO: 921628 - DNA, 25 bp, Mus musculus
cttacaatcaagttttctgaccgag

SEQ ID NO: 921629 - DNA, 25 bp, Mus musculus
cttacactccagcaacactatggct

SEQ ID NO: 921630 - DNA, 25 bp, Mus musculus
cttacactccaggaacactatggct

SEQ ID NO: 921631 - DNA, 25 bp, Mus musculus
cttacacttcaacatgtttgatgtg

SEQ ID NO: 921632 - DNA, 25 bp, Mus musculus
cttacacttcaacggtctgagcgca

SEQ ID NO: 921633 - DNA, 25 bp, Mus musculus
cttacacttcaagatgtttgatgtg

SEQ ID NO: 921634 - DNA, 25 bp, Mus musculus
cttacacttcaagggtctgagcgca

SEQ ID NO: 921635 - DNA, 25 bp, Mus musculus
cttacagaagaggacatctcagcaa

SEQ ID NO: 921636 - DNA, 25 bp, Mus musculus
cttacagaagaggagatctcagcaa

SEQ ID NO: 921637 - DNA, 25 bp, Mus musculus
cttacagacacaagttatccaagtg

SEQ ID NO: 921638 - DNA, 25 bp, Mus musculus
cttacagacacatgttatccaagtg

SEQ ID NO: 921639 - DNA, 25 bp, Mus musculus
cttacagatccacggagcatggcac

SEQ ID NO: 921640 - DNA, 25 bp, Mus musculus
cttacagatccagggagcatggcac

SEQ ID NO: 921641 - DNA, 25 bp, Mus musculus
cttacagcagattcgctcagcacaa

SEQ ID NO: 921642 - DNA, 25 bp, Mus musculus
cttacagcagctggccccttctgcc

SEQ ID NO: 921643 - DNA, 25 bp, Mus musculus
cttacagcagcttattgcaagtgtt

SEQ ID NO: 921644 - DNA, 25 bp, Mus musculus
cttacagcaggtggccccttctgcc

SEQ ID NO: 921645 - DNA, 25 bp, Mus musculus
cttacagcaggttattgcaagtgtt

SEQ ID NO: 921646 - DNA, 25 bp, Mus musculus
cttacagcagtttcgctcagcacaa

SEQ ID NO: 921647 - DNA, 25 bp, Mus musculus
cttacagcccaaccagccacctaga

SEQ ID NO: 921648 - DNA, 25 bp, Mus musculus
cttacagcccaagcagccacctaga

SEQ ID NO: 921649 - DNA, 25 bp, Mus musculus
cttacagctcagcaaatggagacag

SEQ ID NO: 921650 - DNA, 25 bp, Mus musculus
cttacagctcagcaacaagaagaaa

SEQ ID NO: 921651 - DNA, 25 bp, Mus musculus
cttacagctcaggaaatggagacag

SEQ ID NO: 921652 - DNA, 25 bp, Mus musculus
cttacagctcaggaacaagaagaaa

SEQ ID NO: 921653 - DNA, 25 bp, Mus musculus
cttacagctgcttgaggaagctgcc

SEQ ID NO: 921654 - DNA, 25 bp, Mus musculus
cttacagctggttgaggaagctgcc

SEQ ID NO: 921655 - DNA, 25 bp, Mus musculus
cttacaggataacatagtgaaagaa

SEQ ID NO: 921656 - DNA, 25 bp, Mus musculus
cttacaggataagatagtgaaagaa

SEQ ID NO: 921657 - DNA, 25 bp, Mus musculus
cttacagtgcctcacagaccatgat

SEQ ID NO: 921658 - DNA, 25 bp, Mus musculus
cttacagtgcctcagagaccatgat

SEQ ID NO: 921659 - DNA, 25 bp, Mus musculus
cttacagtggaatgggcctgctccg

SEQ ID NO: 921660 - DNA, 25 bp, Mus musculus
cttacagtggcaagacatgggatct

SEQ ID NO: 921661 - DNA, 25 bp, Mus musculus
cttacagtgggaagacatgggatct

SEQ ID NO: 921662 - DNA, 25 bp, Mus musculus
cttacagtggtatgggcctgctccg

SEQ ID NO: 921663 - DNA, 25 bp, Mus musculus
cttacagttaagcaagctgtgctga

SEQ ID NO: 921664 - DNA, 25 bp, Mus musculus
cttacagttaaggaagctgtgctga

SEQ ID NO: 921665 - DNA, 25 bp, Mus musculus
cttacagttagactactcgtacctg

SEQ ID NO: 921666 - DNA, 25 bp, Mus musculus
cttacagttagagtactcgtacctg

SEQ ID NO: 921667 - DNA, 25 bp, Mus musculus
cttacagtttcagactttctaagct

SEQ ID NO: 921668 - DNA, 25 bp, Mus musculus
cttacagtttcagagtttctaagct

SEQ ID NO: 921669 - DNA, 25 bp, Mus musculus
cttacatccagcctttcatagaaac

SEQ ID NO: 921670 - DNA, 25 bp, Mus musculus
cttacatccagcgtttcatagaaac

SEQ ID NO: 921671 - DNA, 25 bp, Mus musculus
cttaccaagcctcgaatctggtgac

SEQ ID NO: 921672 - DNA, 25 bp, Mus musculus
cttaccaagcctggaatctggtgac

SEQ ID NO: 921673 - DNA, 25 bp, Mus musculus
cttaccaagtagacagcattttcaa

SEQ ID NO: 921674 - DNA, 25 bp, Mus musculus
cttaccaagtagactgcattttcaa

SEQ ID NO: 921675 - DNA, 25 bp, Mus musculus
cttaccacctgtcgtggactggtga

SEQ ID NO: 921676 - DNA, 25 bp, Mus musculus
cttaccacctgtggtggactggtga

SEQ ID NO: 921677 - DNA, 25 bp, Mus musculus
cttaccacgcagccctgaaggcatc

SEQ ID NO: 921678 - DNA, 25 bp, Mus musculus
cttaccacgcaggcctgaaggcatc

SEQ ID NO: 921679 - DNA, 25 bp, Mus musculus
cttaccagctagaaacgagatgtcc

SEQ ID NO: 921680 - DNA, 25 bp, Mus musculus
cttaccagctagaaacttctcctct

SEQ ID NO: 921681 - DNA, 25 bp, Mus musculus
cttaccagctagaatcgagatgtcc

SEQ ID NO: 921682 - DNA, 25 bp, Mus musculus
cttaccagctagaatcttctcctct

SEQ ID NO: 921683 - DNA, 25 bp, Mus musculus
cttaccctaaatcacgtactacttg

SEQ ID NO: 921684 - DNA, 25 bp, Mus musculus
cttaccctaaatcaggtactacttg

SEQ ID NO: 921685 - DNA, 25 bp, Mus musculus
cttacccttggctgacctatatgaa

SEQ ID NO: 921686 - DNA, 25 bp, Mus musculus
cttacccttggctgtcctatatgaa

SEQ ID NO: 921687 - DNA, 25 bp, Mus musculus
cttacgaacggacacacagttcgat

SEQ ID NO: 921688 - DNA, 25 bp, Mus musculus
cttacgaacggagacacagttcgat

SEQ ID NO: 921689 - DNA, 25 bp, Mus musculus
cttacgacttggctttgtggctggt

SEQ ID NO: 921690 - DNA, 25 bp, Mus musculus
cttacgacttgggtttgtggctggt

SEQ ID NO: 921691 - DNA, 25 bp, Mus musculus
cttacgatgaacaggtagctgcaca

SEQ ID NO: 921692 - DNA, 25 bp, Mus musculus
cttacgatgaactggtagctgcaca

SEQ ID NO: 921693 - DNA, 25 bp, Mus musculus
cttacgccaaggccttcaccattat

SEQ ID NO: 921694 - DNA, 25 bp, Mus musculus
cttacgccaagggcttcaccattat

SEQ ID NO: 921695 - DNA, 25 bp, Mus musculus
cttacgctgggcagtacgtcggtga

SEQ ID NO: 921696 - DNA, 25 bp, Mus musculus
cttacgctgggctgtacgtcggtga

SEQ ID NO: 921697 - DNA, 25 bp, Mus musculus
cttacggactagcccagcaggtggc

SEQ ID NO: 921698 - DNA, 25 bp, Mus musculus
cttacggactagcgccctgcacaca

SEQ ID NO: 921699 - DNA, 25 bp, Mus musculus
cttacggactaggccagcaggtggc

SEQ ID NO: 921700 - DNA, 25 bp, Mus musculus
cttacggactagggccctgcacaca

SEQ ID NO: 921701 - DNA, 25 bp, Mus musculus
cttacgtcagttgtaggatcgaaat

SEQ ID NO: 921702 - DNA, 25 bp, Mus musculus
cttacgtcagttgttggatcgaaat

SEQ ID NO: 921703 - DNA, 25 bp, Mus musculus
cttactacagcaatgagtgccactt

SEQ ID NO: 921704 - DNA, 25 bp, Mus musculus
cttactacagctggctgcggcttcc

SEQ ID NO: 921705 - DNA, 25 bp, Mus musculus
cttactacagctgggcatggcagac

SEQ ID NO: 921706 - DNA, 25 bp, Mus musculus
cttactacaggaatgagtgccactt

SEQ ID NO: 921707 - DNA, 25 bp, Mus musculus
cttactacaggtggctgcggcttcc

SEQ ID NO: 921708 - DNA, 25 bp, Mus musculus
cttactacaggtgggcatggcagac

SEQ ID NO: 921709 - DNA, 25 bp, Mus musculus
cttactcaaccacggtgaacacttc

SEQ ID NO: 921710 - DNA, 25 bp, Mus musculus
cttactcaaccagggtgaacacttc

SEQ ID NO: 921711 - DNA, 25 bp, Mus musculus
cttactgcacttcacaccatggtat

SEQ ID NO: 921712 - DNA, 25 bp, Mus musculus
cttactgcacttgacaccatggtat

SEQ ID NO: 921713 - DNA, 25 bp, Mus musculus
cttactgccgcaacccagacaagga

SEQ ID NO: 921714 - DNA, 25 bp, Mus musculus
cttactgccggaacccagacaagga

SEQ ID NO: 921715 - DNA, 25 bp, Mus musculus
cttactgtgctgctgccccccagtc

SEQ ID NO: 921716 - DNA, 25 bp, Mus musculus
cttactgtgctggtgccccccagtc

SEQ ID NO: 921717 - DNA, 25 bp, Mus musculus
cttactgttcttgaaatacatgata

SEQ ID NO: 921718 - DNA, 25 bp, Mus musculus
cttactgttcttgaaccataacaaa

SEQ ID NO: 921719 - DNA, 25 bp, Mus musculus
cttactgttcttgatatacatgata

SEQ ID NO: 921720 - DNA, 25 bp, Mus musculus
cttactgttcttgatccataacaaa

SEQ ID NO: 921721 - DNA, 25 bp, Mus musculus
cttacttatacaccaggcctgatgg

SEQ ID NO: 921722 - DNA, 25 bp, Mus musculus
cttacttatacacgcctgatggaat

SEQ ID NO: 921723 - DNA, 25 bp, Mus musculus
cttacttatacagcaggcctgatgg

SEQ ID NO: 921724 - DNA, 25 bp, Mus musculus
cttacttatacaggcctgatggaat

SEQ ID NO: 921725 - DNA, 25 bp, Mus musculus
cttagaaaaaaacgtggacatgagc

SEQ ID NO: 921726 - DNA, 25 bp, Mus musculus
cttagaaaaaaaggtggacatgagc

SEQ ID NO: 921727 - DNA, 25 bp, Mus musculus
cttagaaatctatgaatggtaccac

SEQ ID NO: 921728 - DNA, 25 bp, Mus musculus
cttagaaatctatgtatggtaccac

SEQ ID NO: 921729 - DNA, 25 bp, Mus musculus
cttagaactgcacttattccgagga

SEQ ID NO: 921730 - DNA, 25 bp, Mus musculus
cttagaactgcagttattccgagga

SEQ ID NO: 921731 - DNA, 25 bp, Mus musculus
cttagaactgtggactatcacggtg

SEQ ID NO: 921732 - DNA, 25 bp, Mus musculus
cttagaactgtggagtatcacggtg

SEQ ID NO: 921733 - DNA, 25 bp, Mus musculus
cttagaagaaattcagacctgcctg

SEQ ID NO: 921734 - DNA, 25 bp, Mus musculus
cttagaagaatttcagacctgcctg

SEQ ID NO: 921735 - DNA, 25 bp, Mus musculus
cttagaagatttagatctttcaagc

SEQ ID NO: 921736 - DNA, 25 bp, Mus musculus
cttagaagattttgatctttcaagc

SEQ ID NO: 921737 - DNA, 25 bp, Mus musculus
cttagaccagcacctgtatgcgatt

SEQ ID NO: 921738 - DNA, 25 bp, Mus musculus
cttagaccaggacctgtatgcgatt

SEQ ID NO: 921739 - DNA, 25 bp, Mus musculus
cttagacctgcaagagaaacaaata

SEQ ID NO: 921740 - DNA, 25 bp, Mus musculus
cttagacctgcagtggaccgactac

SEQ ID NO: 921741 - DNA, 25 bp, Mus musculus
cttagacctggaagagaaacaaata

SEQ ID NO: 921742 - DNA, 25 bp, Mus musculus
cttagacctggagtggaccgactac

SEQ ID NO: 921743 - DNA, 25 bp, Mus musculus
cttagagccctgcaggcgcggatcc

SEQ ID NO: 921744 - DNA, 25 bp, Mus musculus
cttagagccctggaggcgcggatcc

SEQ ID NO: 921745 - DNA, 25 bp, Mus musculus
cttagaggaacagtacatccctaaa

SEQ ID NO: 921746 - DNA, 25 bp, Mus musculus
cttagaggaacagttcatccctaaa

SEQ ID NO: 921747 - DNA, 25 bp, Mus musculus
cttagaggagagccaagttgaagtt

SEQ ID NO: 921748 - DNA, 25 bp, Mus musculus
cttagaggagaggcaagttgaagtt

SEQ ID NO: 921749 - DNA, 25 bp, Mus musculus
cttagcaaagcgatattatggttta

SEQ ID NO: 921750 - DNA, 25 bp, Mus musculus
cttagcaaagggatattatggttta

SEQ ID NO: 921751 - DNA, 25 bp, Mus musculus
cttagcacaaatatcggcgctagcg

SEQ ID NO: 921752 - DNA, 25 bp, Mus musculus
cttagcacaaatatgggcgctagcg

SEQ ID NO: 921753 - DNA, 25 bp, Mus musculus
cttagcagaacacgtgtttggattt

SEQ ID NO: 921754 - DNA, 25 bp, Mus musculus
cttagcagaacaggtgtttggattt

SEQ ID NO: 921755 - DNA, 25 bp, Mus musculus
cttagcatggcacatgaaccggaca

SEQ ID NO: 921756 - DNA, 25 bp, Mus musculus
cttagcatggcagatgaaccggaca

SEQ ID NO: 921757 - DNA, 25 bp, Mus musculus
cttagcgagcagcgcgtaagaacaa

SEQ ID NO: 921758 - DNA, 25 bp, Mus musculus
cttagcgagcagggcgtaagaacaa

SEQ ID NO: 921759 - DNA, 25 bp, Mus musculus
cttagctcagcgaaccatggaagat

SEQ ID NO: 921760 - DNA, 25 bp, Mus musculus
cttagctcagggaaccatggaagat

SEQ ID NO: 921761 - DNA, 25 bp, Mus musculus
cttagctgcgagcctgctgtcccct

SEQ ID NO: 921762 - DNA, 25 bp, Mus musculus
cttagctgcgtgcctgctgtcccct

SEQ ID NO: 921763 - DNA, 25 bp, Mus musculus
cttaggagccagaagctgactgctg

SEQ ID NO: 921764 - DNA, 25 bp, Mus musculus
cttaggagccagaaggaggctggca

SEQ ID NO: 921765 - DNA, 25 bp, Mus musculus
cttaggagccagaggaagtcacaga

SEQ ID NO: 921766 - DNA, 25 bp, Mus musculus
cttaggagccagtagctgactgctg

SEQ ID NO: 921767 - DNA, 25 bp, Mus musculus
cttaggagccagtaggaggctggca

SEQ ID NO: 921768 - DNA, 25 bp, Mus musculus
cttaggagccagtggaagtcacaga

SEQ ID NO: 921769 - DNA, 25 bp, Mus musculus
cttagggtgcagcaagccggggagc

SEQ ID NO: 921770 - DNA, 25 bp, Mus musculus
cttagggtgcaggaagccggggagc

SEQ ID NO: 921771 - DNA, 25 bp, Mus musculus
cttaggtttgcaagggacacagcag

SEQ ID NO: 921772 - DNA, 25 bp, Mus musculus
cttaggtttgcacatgatacgtata

SEQ ID NO: 921773 - DNA, 25 bp, Mus musculus
cttaggtttgcagatgatacgtata

SEQ ID NO: 921774 - DNA, 25 bp, Mus musculus
cttaggtttgcatgggacacagcag

SEQ ID NO: 921775 - DNA, 25 bp, Mus musculus
cttagtagcttccacgtggtggtcc

SEQ ID NO: 921776 - DNA, 25 bp, Mus musculus
cttagtagcttccaggtggtggtcc

SEQ ID NO: 921777 - DNA, 25 bp, Mus musculus
cttagtattgcataaagtcctgatg

SEQ ID NO: 921778 - DNA, 25 bp, Mus musculus
cttagtattgcatatagtcctgatg

SEQ ID NO: 921779 - DNA, 25 bp, Mus musculus
cttagtcaagcgtctcatgtactcc

SEQ ID NO: 921780 - DNA, 25 bp, Mus musculus
cttagtcaagcttggcttcctgaag

SEQ ID NO: 921781 - DNA, 25 bp, Mus musculus
cttagtcaagggtctcatgtactcc

SEQ ID NO: 921782 - DNA, 25 bp, Mus musculus
cttagtcaaggttggcttcctgaag

SEQ ID NO: 921783 - DNA, 25 bp, Mus musculus
cttataagaagccacatgtgaactg

SEQ ID NO: 921784 - DNA, 25 bp, Mus musculus
cttataagaagccagatgtgaactg

SEQ ID NO: 921785 - DNA, 25 bp, Mus musculus
cttataagtaaacagaacccatctt

SEQ ID NO: 921786 - DNA, 25 bp, Mus musculus
cttataagtaaagagaacccatctt

SEQ ID NO: 921787 - DNA, 25 bp, Mus musculus
cttataatgaaggaaaaagatggaa

SEQ ID NO: 921788 - DNA, 25 bp, Mus musculus
cttataatgatggaaaaagatggaa

SEQ ID NO: 921789 - DNA, 25 bp, Mus musculus
cttatacccgcagagagaagcgctt

SEQ ID NO: 921790 - DNA, 25 bp, Mus musculus
cttatacccggagagagaagcgctt

SEQ ID NO: 921791 - DNA, 25 bp, Mus musculus
cttatactggaacaagaaacagtca

SEQ ID NO: 921792 - DNA, 25 bp, Mus musculus
cttatactggaagaagaaacagtca

SEQ ID NO: 921793 - DNA, 25 bp, Mus musculus
cttatatcagaaaagagagatgaag

SEQ ID NO: 921794 - DNA, 25 bp, Mus musculus
cttatatcagtaaagagagatgaag

SEQ ID NO: 921795 - DNA, 25 bp, Mus musculus
cttatcagctgaacgctccctggct

SEQ ID NO: 921796 - DNA, 25 bp, Mus musculus
cttatcagctgatcgctccctggct

SEQ ID NO: 921797 - DNA, 25 bp, Mus musculus
cttatcatccttagcaagagatgtc

SEQ ID NO: 921798 - DNA, 25 bp, Mus musculus
cttatcatcctttgcaagagatgtc

SEQ ID NO: 921799 - DNA, 25 bp, Mus musculus
cttatccaggaatatgattccttgt

SEQ ID NO: 921800 - DNA, 25 bp, Mus musculus
cttatccagggtgactatatgattc

SEQ ID NO: 921801 - DNA, 25 bp, Mus musculus
cttatccagggtgagtatatgattc

SEQ ID NO: 921802 - DNA, 25 bp, Mus musculus
cttatccaggtatatgattccttgt

SEQ ID NO: 921803 - DNA, 25 bp, Mus musculus
cttatctgagctggggaaagatcaa

SEQ ID NO: 921804 - DNA, 25 bp, Mus musculus
cttatctgaggtggggaaagatcaa

SEQ ID NO: 921805 - DNA, 25 bp, Mus musculus
cttatctgtaagaactgctttaagt

SEQ ID NO: 921806 - DNA, 25 bp, Mus musculus
cttatctgtaagtactgctttaagt

SEQ ID NO: 921807 - DNA, 25 bp, Mus musculus
cttatgacaaacatttttcagtatg

SEQ ID NO: 921808 - DNA, 25 bp, Mus musculus
cttatgacaaacttttttcagtatg

SEQ ID NO: 921809 - DNA, 25 bp, Mus musculus
cttatgacagcattgtggttgctgg

SEQ ID NO: 921810 - DNA, 25 bp, Mus musculus
cttatgacagcctgaagccatcagt

SEQ ID NO: 921811 - DNA, 25 bp, Mus musculus
cttatgacaggattgtggttgctgg

SEQ ID NO: 921812 - DNA, 25 bp, Mus musculus
cttatgacaggctgaagccatcagt

SEQ ID NO: 921813 - DNA, 25 bp, Mus musculus
cttatgcctttgagcggggagacaa

SEQ ID NO: 921814 - DNA, 25 bp, Mus musculus
cttatgcctttgtgcggggagacaa

SEQ ID NO: 921815 - DNA, 25 bp, Mus musculus
cttatggaatcttaagtaaaacatc

SEQ ID NO: 921816 - DNA, 25 bp, Mus musculus
cttatggaatcttatgtaaaacatc

SEQ ID NO: 921817 - DNA, 25 bp, Mus musculus
cttatggatgactccttaacctcca

SEQ ID NO: 921818 - DNA, 25 bp, Mus musculus
cttatggatgtctccttaacctcca

SEQ ID NO: 921819 - DNA, 25 bp, Mus musculus
cttatggccaatctgggtggatttc

SEQ ID NO: 921820 - DNA, 25 bp, Mus musculus
cttatggccaatgtgggtggatttc

SEQ ID NO: 921821 - DNA, 25 bp, Mus musculus
cttatgtccaccagatctccaagat

SEQ ID NO: 921822 - DNA, 25 bp, Mus musculus
cttatgtccacctgatctccaagat

SEQ ID NO: 921823 - DNA, 25 bp, Mus musculus
cttatgtctctggcattctccttcc

SEQ ID NO: 921824 - DNA, 25 bp, Mus musculus
cttatgtctctggctttctccttcc

SEQ ID NO: 921825 - DNA, 25 bp, Mus musculus
cttattaaagctggagcacgagtag

SEQ ID NO: 921826 - DNA, 25 bp, Mus musculus
cttattaaaggtggagcacgagtag

SEQ ID NO: 921827 - DNA, 25 bp, Mus musculus
cttattaattcacgtgatgctagac

SEQ ID NO: 921828 - DNA, 25 bp, Mus musculus
cttattaattcaggtgatgctagac

SEQ ID NO: 921829 - DNA, 25 bp, Mus musculus
cttattacagatcctggagggtcag

SEQ ID NO: 921830 - DNA, 25 bp, Mus musculus
cttattacagttcctggagggtcag

SEQ ID NO: 921831 - DNA, 25 bp, Mus musculus
cttattaccacaccgtttatgtttg

SEQ ID NO: 921832 - DNA, 25 bp, Mus musculus
cttattaccacacgaactgcatgag

SEQ ID NO: 921833 - DNA, 25 bp, Mus musculus
cttattaccacagcgtttatgtttg

SEQ ID NO: 921834 - DNA, 25 bp, Mus musculus
cttattaccacaggaactgcatgag

SEQ ID NO: 921835 - DNA, 25 bp, Mus musculus
cttattagcaaacgtgccaatgtga

SEQ ID NO: 921836 - DNA, 25 bp, Mus musculus
cttattagcaaaggtgccaatgtga

SEQ ID NO: 921837 - DNA, 25 bp, Mus musculus
cttattctagagcgtggatacaatt

SEQ ID NO: 921838 - DNA, 25 bp, Mus musculus
cttattctagagggtggatacaatt

SEQ ID NO: 921839 - DNA, 25 bp, Mus musculus
cttattgatgaacgtgtagaagtgt

SEQ ID NO: 921840 - DNA, 25 bp, Mus musculus
cttattgatgaaggtgtagaagtgt

SEQ ID NO: 921841 - DNA, 25 bp, Mus musculus
cttatttgagcagaatgagatcaac

SEQ ID NO: 921842 - DNA, 25 bp, Mus musculus
cttatttgaggagaatgagatcaac

SEQ ID NO: 921843 - DNA, 25 bp, Mus musculus
cttattttacagagaaaatgtgcta

SEQ ID NO: 921844 - DNA, 25 bp, Mus musculus
cttattttacagtgaaaatgtgcta

SEQ ID NO: 921845 - DNA, 25 bp, Mus musculus
cttcaaaaacaacgaggagccgagg

SEQ ID NO: 921846 - DNA, 25 bp, Mus musculus
cttcaaaaacaaggaggagccgagg

SEQ ID NO: 921847 - DNA, 25 bp, Mus musculus
cttcaaaaccagcagagaaaaataa

SEQ ID NO: 921848 - DNA, 25 bp, Mus musculus
cttcaaaaccaggagagaaaaataa

SEQ ID NO: 921849 - DNA, 25 bp, Mus musculus
cttcaaaacgcgcagcatcctcaag

SEQ ID NO: 921850 - DNA, 25 bp, Mus musculus
cttcaaaacgggcagcatcctcaag

SEQ ID NO: 921851 - DNA, 25 bp, Mus musculus
cttcaaactgaaaaccagcaccgag

SEQ ID NO: 921852 - DNA, 25 bp, Mus musculus
cttcaaactgaataccagcaccgag

SEQ ID NO: 921853 - DNA, 25 bp, Mus musculus
cttcaaagaattctgcaaaaatact

SEQ ID NO: 921854 - DNA, 25 bp, Mus musculus
cttcaaagaattgtgcaaaaatact

SEQ ID NO: 921855 - DNA, 25 bp, Mus musculus
cttcaaagacaacctcaaacatgtc

SEQ ID NO: 921856 - DNA, 25 bp, Mus musculus
cttcaaagacaacgtgagggtggtg

SEQ ID NO: 921857 - DNA, 25 bp, Mus musculus
cttcaaagacaagctcaaacatgtc

SEQ ID NO: 921858 - DNA, 25 bp, Mus musculus
cttcaaagacaaggtgagggtggtg

SEQ ID NO: 921859 - DNA, 25 bp, Mus musculus
cttcaaagcagaagcctcctgccaa

SEQ ID NO: 921860 - DNA, 25 bp, Mus musculus
cttcaaagcagatgcctcctgccaa

SEQ ID NO: 921861 - DNA, 25 bp, Mus musculus
cttcaaagtcagaagtaaagccatc

SEQ ID NO: 921862 - DNA, 25 bp, Mus musculus
cttcaaagtcagtagtaaagccatc

SEQ ID NO: 921863 - DNA, 25 bp, Mus musculus
cttcaaatactgaactgtccctgat

SEQ ID NO: 921864 - DNA, 25 bp, Mus musculus
cttcaaatactgtactgtccctgat

SEQ ID NO: 921865 - DNA, 25 bp, Mus musculus
cttcaaatgcagagtgttctctgcc

SEQ ID NO: 921866 - DNA, 25 bp, Mus musculus
cttcaaatgcagtgtgttctctgcc

SEQ ID NO: 921867 - DNA, 25 bp, Mus musculus
cttcaaatggatagtcacatgctgg

SEQ ID NO: 921868 - DNA, 25 bp, Mus musculus
cttcaaatggttagtcacatgctgg

SEQ ID NO: 921869 - DNA, 25 bp, Mus musculus
cttcaacaagccattgtgaaatccc

SEQ ID NO: 921870 - DNA, 25 bp, Mus musculus
cttcaacaaggcattgtgaaatccc

SEQ ID NO: 921871 - DNA, 25 bp, Mus musculus
cttcaacaccagataatgtgtcttg

SEQ ID NO: 921872 - DNA, 25 bp, Mus musculus
cttcaacaccagttaatgtgtcttg

SEQ ID NO: 921873 - DNA, 25 bp, Mus musculus
cttcaacaggcgacctgggccccac

SEQ ID NO: 921874 - DNA, 25 bp, Mus musculus
cttcaacaggcgtcctgggccccac

SEQ ID NO: 921875 - DNA, 25 bp, Mus musculus
cttcaacaggctgggcggtctgcag

SEQ ID NO: 921876 - DNA, 25 bp, Mus musculus
cttcaacagggtgggcggtctgcag

SEQ ID NO: 921877 - DNA, 25 bp, Mus musculus
cttcaacatctacacttatttacag

SEQ ID NO: 921878 - DNA, 25 bp, Mus musculus
cttcaacatctacagttatttacag

SEQ ID NO: 921879 - DNA, 25 bp, Mus musculus
cttcaacattgacgatcataaagac

SEQ ID NO: 921880 - DNA, 25 bp, Mus musculus
cttcaacattgaggatcataaagac

SEQ ID NO: 921881 - DNA, 25 bp, Mus musculus
cttcaaccatcacgggctggtgtca

SEQ ID NO: 921882 - DNA, 25 bp, Mus musculus
cttcaaccatcacgtctaggtggct

SEQ ID NO: 921883 - DNA, 25 bp, Mus musculus
cttcaaccatcaggggctggtgtca

SEQ ID NO: 921884 - DNA, 25 bp, Mus musculus
cttcaaccatcaggtctaggtggct

SEQ ID NO: 921885 - DNA, 25 bp, Mus musculus
cttcaacctgtacggaactgtgcac

SEQ ID NO: 921886 - DNA, 25 bp, Mus musculus
cttcaacctgtagggaactgtgcac

SEQ ID NO: 921887 - DNA, 25 bp, Mus musculus
cttcaacggaggaactgtattggca

SEQ ID NO: 921888 - DNA, 25 bp, Mus musculus
cttcaacggaggtactgtattggca

SEQ ID NO: 921889 - DNA, 25 bp, Mus musculus
cttcaactagcgaaaagccttgaag

SEQ ID NO: 921890 - DNA, 25 bp, Mus musculus
cttcaactagggaaaagccttgaag

SEQ ID NO: 921891 - DNA, 25 bp, Mus musculus
cttcaagaagctgtgtggcccttct

SEQ ID NO: 921892 - DNA, 25 bp, Mus musculus
cttcaagaaggtgtgtggcccttct

SEQ ID NO: 921893 - DNA, 25 bp, Mus musculus
cttcaagagaaacccttgtttgcag

SEQ ID NO: 921894 - DNA, 25 bp, Mus musculus
cttcaagagaaacgttcaattttat

SEQ ID NO: 921895 - DNA, 25 bp, Mus musculus
cttcaagagaaagccttgtttgcag

SEQ ID NO: 921896 - DNA, 25 bp, Mus musculus
cttcaagagaaaggttcaattttat

SEQ ID NO: 921897 - DNA, 25 bp, Mus musculus
cttcaagagacacgcagagatgcag

SEQ ID NO: 921898 - DNA, 25 bp, Mus musculus
cttcaagagacaggcagagatgcag

SEQ ID NO: 921899 - DNA, 25 bp, Mus musculus
cttcaagcagagtggcattgtcctg

SEQ ID NO: 921900 - DNA, 25 bp, Mus musculus
cttcaagcagcatgattgggctgat

SEQ ID NO: 921901 - DNA, 25 bp, Mus musculus
cttcaagcagcgttccacgcctacg

SEQ ID NO: 921902 - DNA, 25 bp, Mus musculus
cttcaagcaggatgattgggctgat

SEQ ID NO: 921903 - DNA, 25 bp, Mus musculus
cttcaagcagggttccacgcctacg

SEQ ID NO: 921904 - DNA, 25 bp, Mus musculus
cttcaagcagtgtggcattgtcctg

SEQ ID NO: 921905 - DNA, 25 bp, Mus musculus
cttcaagccatcgcagagaagcgta

SEQ ID NO: 921906 - DNA, 25 bp, Mus musculus
cttcaagccatcgctgagaagcgta

SEQ ID NO: 921907 - DNA, 25 bp, Mus musculus
cttcaagcccagacttgcctccagc

SEQ ID NO: 921908 - DNA, 25 bp, Mus musculus
cttcaagcccagctatgggacccct

SEQ ID NO: 921909 - DNA, 25 bp, Mus musculus
cttcaagcccaggtatgggacccct

SEQ ID NO: 921910 - DNA, 25 bp, Mus musculus
cttcaagcccagtcttgcctccagc

SEQ ID NO: 921911 - DNA, 25 bp, Mus musculus
cttcaaggaccctgccccctctgca

SEQ ID NO: 921912 - DNA, 25 bp, Mus musculus
cttcaaggacgctgccccctctgca

SEQ ID NO: 921913 - DNA, 25 bp, Mus musculus
cttcaaggacggatggtactggaag

SEQ ID NO: 921914 - DNA, 25 bp, Mus musculus
cttcaaggacggttggtactggaag

SEQ ID NO: 921915 - DNA, 25 bp, Mus musculus
cttcaaggagatcctctgctggtgt

SEQ ID NO: 921916 - DNA, 25 bp, Mus musculus
cttcaaggagatgctctgctggtgt

SEQ ID NO: 921917 - DNA, 25 bp, Mus musculus
cttcaaggccagcttgatggaaacc

SEQ ID NO: 921918 - DNA, 25 bp, Mus musculus
cttcaaggccaggttgatggaaacc

SEQ ID NO: 921919 - DNA, 25 bp, Mus musculus
cttcaagtacagagatgaactcaag

SEQ ID NO: 921920 - DNA, 25 bp, Mus musculus
cttcaagtacagtgatgaactcaag

SEQ ID NO: 921921 - DNA, 25 bp, Mus musculus
cttcaagtgcagcatcttctctgcc

SEQ ID NO: 921922 - DNA, 25 bp, Mus musculus
cttcaagtgcaggatcttctctgcc

SEQ ID NO: 921923 - DNA, 25 bp, Mus musculus
cttcaataagcaacctactgaactt

SEQ ID NO: 921924 - DNA, 25 bp, Mus musculus
cttcaataagcatcctactgaactt

SEQ ID NO: 921925 - DNA, 25 bp, Mus musculus
cttcaatagtctgctggaaaaagca

SEQ ID NO: 921926 - DNA, 25 bp, Mus musculus
cttcaatagtgtgctggaaaaagca

SEQ ID NO: 921927 - DNA, 25 bp, Mus musculus
cttcaatatgcaatctttctgacat

SEQ ID NO: 921928 - DNA, 25 bp, Mus musculus
cttcaatatggaatctttctgacat

SEQ ID NO: 921929 - DNA, 25 bp, Mus musculus
cttcaatcagctccatcagctgaaa

SEQ ID NO: 921930 - DNA, 25 bp, Mus musculus
cttcaatcaggtccatcagctgaaa

SEQ ID NO: 921931 - DNA, 25 bp, Mus musculus
cttcaatgacttcacagaatacctg

SEQ ID NO: 921932 - DNA, 25 bp, Mus musculus
cttcaatgacttcacctgctgacct

SEQ ID NO: 921933 - DNA, 25 bp, Mus musculus
cttcaatgacttcagagaatacctg

SEQ ID NO: 921934 - DNA, 25 bp, Mus musculus
cttcaatgacttcagctgctgacct

SEQ ID NO: 921935 - DNA, 25 bp, Mus musculus
cttcaatgccagctacaagatgctc

SEQ ID NO: 921936 - DNA, 25 bp, Mus musculus
cttcaatgccaggtacaagatgctc

SEQ ID NO: 921937 - DNA, 25 bp, Mus musculus
cttcacacagacttccgtgtttaaa

SEQ ID NO: 921938 - DNA, 25 bp, Mus musculus
cttcacacagtcttccgtgtttaaa

SEQ ID NO: 921939 - DNA, 25 bp, Mus musculus
cttcacagacttctacctggtgatg

SEQ ID NO: 921940 - DNA, 25 bp, Mus musculus
cttcacagacttgtacctggtgatg

SEQ ID NO: 921941 - DNA, 25 bp, Mus musculus
cttcacatacagcagcgacagtttt

SEQ ID NO: 921942 - DNA, 25 bp, Mus musculus
cttcacatacaggagcgacagtttt

SEQ ID NO: 921943 - DNA, 25 bp, Mus musculus
cttcaccaaacacaaatatccagag

SEQ ID NO: 921944 - DNA, 25 bp, Mus musculus
cttcaccaaacagaaatatccagag

SEQ ID NO: 921945 - DNA, 25 bp, Mus musculus
cttcaccaatatatcaaaagtttat

SEQ ID NO: 921946 - DNA, 25 bp, Mus musculus
cttcaccaatttatcaaaagtttat

SEQ ID NO: 921947 - DNA, 25 bp, Mus musculus
cttcaccacaaacgtgggcctttgt

SEQ ID NO: 921948 - DNA, 25 bp, Mus musculus
cttcaccacaaaggtgggcctttgt

SEQ ID NO: 921949 - DNA, 25 bp, Mus musculus
cttcaccacactgtttacaaaatat

SEQ ID NO: 921950 - DNA, 25 bp, Mus musculus
cttcaccacagtgtttacaaaatat

SEQ ID NO: 921951 - DNA, 25 bp, Mus musculus
cttcaccactaacgactctgacacc

SEQ ID NO: 921952 - DNA, 25 bp, Mus musculus
cttcaccactaacgggactcagaag

SEQ ID NO: 921953 - DNA, 25 bp, Mus musculus
cttcaccactaaggactctgacacc

SEQ ID NO: 921954 - DNA, 25 bp, Mus musculus
cttcaccactaaggggactcagaag

SEQ ID NO: 921955 - DNA, 25 bp, Mus musculus
cttcaccaggtggacagcatatccg

SEQ ID NO: 921956 - DNA, 25 bp, Mus musculus
cttcaccaggtggacataagtcatt

SEQ ID NO: 921957 - DNA, 25 bp, Mus musculus
cttcaccaggtggagagcatatccg

SEQ ID NO: 921958 - DNA, 25 bp, Mus musculus
cttcaccaggtggagataagtcatt

SEQ ID NO: 921959 - DNA, 25 bp, Mus musculus
cttcaccatcaacgatgtttatgac

SEQ ID NO: 921960 - DNA, 25 bp, Mus musculus
cttcaccatcaaggatgtttatgac

SEQ ID NO: 921961 - DNA, 25 bp, Mus musculus
cttcacccggagaaggcttctttgg

SEQ ID NO: 921962 - DNA, 25 bp, Mus musculus
cttcacccggagccttctttggctt

SEQ ID NO: 921963 - DNA, 25 bp, Mus musculus
cttcacccggaggcttctttggctt

SEQ ID NO: 921964 - DNA, 25 bp, Mus musculus
cttcacccggagtaggcttctttgg

SEQ ID NO: 921965 - DNA, 25 bp, Mus musculus
cttcacctgcatcctggcagtggac

SEQ ID NO: 921966 - DNA, 25 bp, Mus musculus
cttcacctgcttcctggcagtggac

SEQ ID NO: 921967 - DNA, 25 bp, Mus musculus
cttcacctttggagtcctgtgcatg

SEQ ID NO: 921968 - DNA, 25 bp, Mus musculus
cttcacctttggtgtcctgtgcatg

SEQ ID NO: 921969 - DNA, 25 bp, Mus musculus
cttcacgagacacagttagcagagc

SEQ ID NO: 921970 - DNA, 25 bp, Mus musculus
cttcacgagacagagttagcagagc

SEQ ID NO: 921971 - DNA, 25 bp, Mus musculus
cttcacgataggcaaggggaagtca

SEQ ID NO: 921972 - DNA, 25 bp, Mus musculus
cttcacgatagggaaggggaagtca

SEQ ID NO: 921973 - DNA, 25 bp, Mus musculus
cttcactccccacatatacaaaaag

SEQ ID NO: 921974 - DNA, 25 bp, Mus musculus
cttcactccccagatatacaaaaag

SEQ ID NO: 921975 - DNA, 25 bp, Mus musculus
cttcactctgcacttcagtcaaaga

SEQ ID NO: 921976 - DNA, 25 bp, Mus musculus
cttcactctgcagttcagtcaaaga

SEQ ID NO: 921977 - DNA, 25 bp, Mus musculus
cttcactttaagctgcctgctgttc

SEQ ID NO: 921978 - DNA, 25 bp, Mus musculus
cttcactttaaggtgcctgctgttc

SEQ ID NO: 921979 - DNA, 25 bp, Mus musculus
cttcagaaacatctccctgaaacga

SEQ ID NO: 921980 - DNA, 25 bp, Mus musculus
cttcagaaacatgtccctgaaacga

SEQ ID NO: 921981 - DNA, 25 bp, Mus musculus
cttcagaaactccactagtggccac

SEQ ID NO: 921982 - DNA, 25 bp, Mus musculus
cttcagaaactccactggccacaga

SEQ ID NO: 921983 - DNA, 25 bp, Mus musculus
cttcagaaactccagtagtggccac

SEQ ID NO: 921984 - DNA, 25 bp, Mus musculus
cttcagaaactccagtggccacaga

SEQ ID NO: 921985 - DNA, 25 bp, Mus musculus
cttcagaaagcacacatggacagct

SEQ ID NO: 921986 - DNA, 25 bp, Mus musculus
cttcagaaagcacagatggacagct

SEQ ID NO: 921987 - DNA, 25 bp, Mus musculus
cttcagaacattcacgtatttgatt

SEQ ID NO: 921988 - DNA, 25 bp, Mus musculus
cttcagaacattcaggtatttgatt

SEQ ID NO: 921989 - DNA, 25 bp, Mus musculus
cttcagaactatgacgtagcctacc

SEQ ID NO: 921990 - DNA, 25 bp, Mus musculus
cttcagaactatgaggtagcctacc

SEQ ID NO: 921991 - DNA, 25 bp, Mus musculus
cttcagaatctatgcgtgaggaaga

SEQ ID NO: 921992 - DNA, 25 bp, Mus musculus
cttcagaatctatgggtgaggaaga

SEQ ID NO: 921993 - DNA, 25 bp, Mus musculus
cttcagacaccacgaagcccctgag

SEQ ID NO: 921994 - DNA, 25 bp, Mus musculus
cttcagacaccaggaagcccctgag

SEQ ID NO: 921995 - DNA, 25 bp, Mus musculus
cttcagacctctcctgagatggggg

SEQ ID NO: 921996 - DNA, 25 bp, Mus musculus
cttcagacctctgctgagatggggg

SEQ ID NO: 921997 - DNA, 25 bp, Mus musculus
cttcagagagagactttctgcaggt

SEQ ID NO: 921998 - DNA, 25 bp, Mus musculus
cttcagagagagctaccgacccttg

SEQ ID NO: 921999 - DNA, 25 bp, Mus musculus
cttcagagagaggtaccgacccttg

SEQ ID NO: 922000 - DNA, 25 bp, Mus musculus
cttcagagagagtctttctgcaggt

SEQ ID NO: 922001 - DNA, 25 bp, Mus musculus
cttcagagagagtttaattccttcc

SEQ ID NO: 922002 - DNA, 25 bp, Mus musculus
cttcagagagatggtgtcttgtcaa

SEQ ID NO: 922003 - DNA, 25 bp, Mus musculus
cttcagagagctctatctccatgca

SEQ ID NO: 922004 - DNA, 25 bp, Mus musculus
cttcagagagctgccaggccgcaag

SEQ ID NO: 922005 - DNA, 25 bp, Mus musculus
cttcagagaggtctatctccatgca

SEQ ID NO: 922006 - DNA, 25 bp, Mus musculus
cttcagagaggtgccaggccgcaag

SEQ ID NO: 922007 - DNA, 25 bp, Mus musculus
cttcagagagtgtttaattccttcc

SEQ ID NO: 922008 - DNA, 25 bp, Mus musculus
cttcagagagttggtgtcttgtcaa

SEQ ID NO: 922009 - DNA, 25 bp, Mus musculus
cttcagagcaaaggcgggctctact

SEQ ID NO: 922010 - DNA, 25 bp, Mus musculus
cttcagagcaaaggggggctctact

SEQ ID NO: 922011 - DNA, 25 bp, Mus musculus
cttcagaggagaagcggaagctggc

SEQ ID NO: 922012 - DNA, 25 bp, Mus musculus
cttcagaggagatgcggaagctggc

SEQ ID NO: 922013 - DNA, 25 bp, Mus musculus
cttcagatttggcacacagcaggcc

SEQ ID NO: 922014 - DNA, 25 bp, Mus musculus
cttcagatttgggacacagcaggcc

SEQ ID NO: 922015 - DNA, 25 bp, Mus musculus
cttcagcaagatgaggatgtgttgg

SEQ ID NO: 922016 - DNA, 25 bp, Mus musculus
cttcagcaagttgaggatgtgttgg

SEQ ID NO: 922017 - DNA, 25 bp, Mus musculus
cttcagcacattcaagtccatacaa

SEQ ID NO: 922018 - DNA, 25 bp, Mus musculus
cttcagcacattcatgtccatacaa

SEQ ID NO: 922019 - DNA, 25 bp, Mus musculus
cttcagcaccagatccctgctgtct

SEQ ID NO: 922020 - DNA, 25 bp, Mus musculus
cttcagcaccagttccctgctgtct

SEQ ID NO: 922021 - DNA, 25 bp, Mus musculus
cttcagcagatattagaaagtgaaa

SEQ ID NO: 922022 - DNA, 25 bp, Mus musculus
cttcagcagatatttgaaagtgaaa

SEQ ID NO: 922023 - DNA, 25 bp, Mus musculus
cttcagcatgtccacagggatggac

SEQ ID NO: 922024 - DNA, 25 bp, Mus musculus
cttcagcatgtccagagggatggac

SEQ ID NO: 922025 - DNA, 25 bp, Mus musculus
cttcagccaacacgactcctgagct

SEQ ID NO: 922026 - DNA, 25 bp, Mus musculus
cttcagccaacaggactcctgagct

SEQ ID NO: 922027 - DNA, 25 bp, Mus musculus
cttcagccctctaatggaccaatta

SEQ ID NO: 922028 - DNA, 25 bp, Mus musculus
cttcagccctcttatggaccaatta

SEQ ID NO: 922029 - DNA, 25 bp, Mus musculus
cttcagccgagtcagtgaattagat

SEQ ID NO: 922030 - DNA, 25 bp, Mus musculus
cttcagccgagtgagtgaattagat

SEQ ID NO: 922031 - DNA, 25 bp, Mus musculus
cttcagcctaaagccggaccagtcc

SEQ ID NO: 922032 - DNA, 25 bp, Mus musculus
cttcagcctaaagcgggaccagtcc

SEQ ID NO: 922033 - DNA, 25 bp, Mus musculus
cttcagctctgagacgatgtgcccg

SEQ ID NO: 922034 - DNA, 25 bp, Mus musculus
cttcagctctgagaggatgtgcccg

SEQ ID NO: 922035 - DNA, 25 bp, Mus musculus
cttcagcttcaaatcagtaccacac

SEQ ID NO: 922036 - DNA, 25 bp, Mus musculus
cttcagcttcaacgtttggattcag

SEQ ID NO: 922037 - DNA, 25 bp, Mus musculus
cttcagcttcaaggtttggattcag

SEQ ID NO: 922038 - DNA, 25 bp, Mus musculus
cttcagcttcaattcagtaccacac

SEQ ID NO: 922039 - DNA, 25 bp, Mus musculus
cttcagcttcagcaatgcactggaa

SEQ ID NO: 922040 - DNA, 25 bp, Mus musculus
cttcagcttcaggaatgcactggaa

SEQ ID NO: 922041 - DNA, 25 bp, Mus musculus
cttcaggaccaactatgagacagag

SEQ ID NO: 922042 - DNA, 25 bp, Mus musculus
cttcaggaccaactatgagtcagag

SEQ ID NO: 922043 - DNA, 25 bp, Mus musculus
cttcaggaccaagtatgagacagag

SEQ ID NO: 922044 - DNA, 25 bp, Mus musculus
cttcaggaccaagtatgagtcagag

SEQ ID NO: 922045 - DNA, 25 bp, Mus musculus
cttcaggaccccaaggtcatgatgc

SEQ ID NO: 922046 - DNA, 25 bp, Mus musculus
cttcaggacccctaggtcatgatgc

SEQ ID NO: 922047 - DNA, 25 bp, Mus musculus
cttcaggagaatcagctatgctaac

SEQ ID NO: 922048 - DNA, 25 bp, Mus musculus
cttcaggagaatgagctatgctaac

SEQ ID NO: 922049 - DNA, 25 bp, Mus musculus
cttcaggagcggcactctcagagag

SEQ ID NO: 922050 - DNA, 25 bp, Mus musculus
cttcaggagcggcagtctcagagag

SEQ ID NO: 922051 - DNA, 25 bp, Mus musculus
cttcaggcgggatacgtctggagcc

SEQ ID NO: 922052 - DNA, 25 bp, Mus musculus
cttcaggcgggataggtctggagcc

SEQ ID NO: 922053 - DNA, 25 bp, Mus musculus
cttcaggctcaactatgagaatgag

SEQ ID NO: 922054 - DNA, 25 bp, Mus musculus
cttcaggctcaagtatgagaatgag

SEQ ID NO: 922055 - DNA, 25 bp, Mus musculus
cttcagggacttcacctttgaagga

SEQ ID NO: 922056 - DNA, 25 bp, Mus musculus
cttcagggacttcagctttgaagga

SEQ ID NO: 922057 - DNA, 25 bp, Mus musculus
cttcagggggtaaaagtgattagtg

SEQ ID NO: 922058 - DNA, 25 bp, Mus musculus
cttcagggggtaaatgtgattagtg

SEQ ID NO: 922059 - DNA, 25 bp, Mus musculus
cttcagggtcagaacggtgagcgag

SEQ ID NO: 922060 - DNA, 25 bp, Mus musculus
cttcagggtcagaagggtgagcgag

SEQ ID NO: 922061 - DNA, 25 bp, Mus musculus
cttcaggtcttcaaagccccagagg

SEQ ID NO: 922062 - DNA, 25 bp, Mus musculus
cttcaggtcttctaagccccagagg

SEQ ID NO: 922063 - DNA, 25 bp, Mus musculus
cttcaggtgaggcctttaccctccg

SEQ ID NO: 922064 - DNA, 25 bp, Mus musculus
cttcaggtgagggctttaccctccg

SEQ ID NO: 922065 - DNA, 25 bp, Mus musculus
cttcagtaagactgaagagctgaac

SEQ ID NO: 922066 - DNA, 25 bp, Mus musculus
cttcagtaagtctgaagagctgaac

SEQ ID NO: 922067 - DNA, 25 bp, Mus musculus
cttcagtatcctcatcacatttgac

SEQ ID NO: 922068 - DNA, 25 bp, Mus musculus
cttcagtatcctgatcacatttgac

SEQ ID NO: 922069 - DNA, 25 bp, Mus musculus
cttcagtcagcattttacagttttt

SEQ ID NO: 922070 - DNA, 25 bp, Mus musculus
cttcagtcaggattttacagttttt

SEQ ID NO: 922071 - DNA, 25 bp, Mus musculus
cttcagtcctggcccccaagttgaa

SEQ ID NO: 922072 - DNA, 25 bp, Mus musculus
cttcagtcctggccgccaagttgaa

SEQ ID NO: 922073 - DNA, 25 bp, Mus musculus
cttcagtctctcagtgcctgtgctg

SEQ ID NO: 922074 - DNA, 25 bp, Mus musculus
cttcagtctctctgtgcctgtgctg

SEQ ID NO: 922075 - DNA, 25 bp, Mus musculus
cttcagtctgctcgcccggttgcga

SEQ ID NO: 922076 - DNA, 25 bp, Mus musculus
cttcagtctgctggcccggttgcga

SEQ ID NO: 922077 - DNA, 25 bp, Mus musculus
cttcagtgagattaaagattttttg

SEQ ID NO: 922078 - DNA, 25 bp, Mus musculus
cttcagtgagtttaaagattttttg

SEQ ID NO: 922079 - DNA, 25 bp, Mus musculus
cttcagtgatatcacgaaggaggat

SEQ ID NO: 922080 - DNA, 25 bp, Mus musculus
cttcagtgatatcaggaaggaggat

SEQ ID NO: 922081 - DNA, 25 bp, Mus musculus
cttcagtgcaagcatggaaggaccc

SEQ ID NO: 922082 - DNA, 25 bp, Mus musculus
cttcagtgcaagcttatcctgctcg

SEQ ID NO: 922083 - DNA, 25 bp, Mus musculus
cttcagtgcaaggatggaaggaccc

SEQ ID NO: 922084 - DNA, 25 bp, Mus musculus
cttcagtgcaaggttatcctgctcg

SEQ ID NO: 922085 - DNA, 25 bp, Mus musculus
cttcagtggaagctaaacagaatct

SEQ ID NO: 922086 - DNA, 25 bp, Mus musculus
cttcagtggaaggtaaacagaatct

SEQ ID NO: 922087 - DNA, 25 bp, Mus musculus
cttcagtggaccaaattttcaggat

SEQ ID NO: 922088 - DNA, 25 bp, Mus musculus
cttcagtggacctaattttcaggat

SEQ ID NO: 922089 - DNA, 25 bp, Mus musculus
cttcagttccacctggcccagcagc

SEQ ID NO: 922090 - DNA, 25 bp, Mus musculus
cttcagttccacgtggcccagcagc

SEQ ID NO: 922091 - DNA, 25 bp, Mus musculus
cttcagtttccacacaatggactcg

SEQ ID NO: 922092 - DNA, 25 bp, Mus musculus
cttcagtttccacagaatggactcg

SEQ ID NO: 922093 - DNA, 25 bp, Mus musculus
cttcataacttccacagaatctcag

SEQ ID NO: 922094 - DNA, 25 bp, Mus musculus
cttcataacttccacatccaggcct

SEQ ID NO: 922095 - DNA, 25 bp, Mus musculus
cttcataacttccagagaatctcag

SEQ ID NO: 922096 - DNA, 25 bp, Mus musculus
cttcataacttccagatccaggcct

SEQ ID NO: 922097 - DNA, 25 bp, Mus musculus
cttcataggaaaagacatcaccaac

SEQ ID NO: 922098 - DNA, 25 bp, Mus musculus
cttcataggaaaagtcatcaccaac

SEQ ID NO: 922099 - DNA, 25 bp, Mus musculus
cttcatataccgttcctttagaaag

SEQ ID NO: 922100 - DNA, 25 bp, Mus musculus
cttcatatacggttcctttagaaag

SEQ ID NO: 922101 - DNA, 25 bp, Mus musculus
cttcatatcagcaccgacgattccg

SEQ ID NO: 922102 - DNA, 25 bp, Mus musculus
cttcatatcagcaccggtcacccag

SEQ ID NO: 922103 - DNA, 25 bp, Mus musculus
cttcatatcagcacggacgattccg

SEQ ID NO: 922104 - DNA, 25 bp, Mus musculus
cttcatatcagcacgggtcacccag

SEQ ID NO: 922105 - DNA, 25 bp, Mus musculus
cttcatcaacaacgtgacaagagca

SEQ ID NO: 922106 - DNA, 25 bp, Mus musculus
cttcatcaacaaggtgacaagagca

SEQ ID NO: 922107 - DNA, 25 bp, Mus musculus
cttcatcaccaacacagacgtcttt

SEQ ID NO: 922108 - DNA, 25 bp, Mus musculus
cttcatcaccaacacgtctttattg

SEQ ID NO: 922109 - DNA, 25 bp, Mus musculus
cttcatcaccaagacagacgtcttt

SEQ ID NO: 922110 - DNA, 25 bp, Mus musculus
cttcatcaccaagacgtctttattg

SEQ ID NO: 922111 - DNA, 25 bp, Mus musculus
cttcatcaccagctatcacgtatgg

SEQ ID NO: 922112 - DNA, 25 bp, Mus musculus
cttcatcaccaggtatcacgtatgg

SEQ ID NO: 922113 - DNA, 25 bp, Mus musculus
cttcatcaggatgctgcacaacaag

SEQ ID NO: 922114 - DNA, 25 bp, Mus musculus
cttcatcaggttgctgcacaacaag

SEQ ID NO: 922115 - DNA, 25 bp, Mus musculus
cttcatcagtacaacattgtcggct

SEQ ID NO: 922116 - DNA, 25 bp, Mus musculus
cttcatcagtacaagattgtcggct

SEQ ID NO: 922117 - DNA, 25 bp, Mus musculus
cttcatcattttctgcaatgctgcc

SEQ ID NO: 922118 - DNA, 25 bp, Mus musculus
cttcatcattttgtgcaatgctgcc

SEQ ID NO: 922119 - DNA, 25 bp, Mus musculus
cttcatccccaacgggacaaatgta

SEQ ID NO: 922120 - DNA, 25 bp, Mus musculus
cttcatccccaacgggacgacactc

SEQ ID NO: 922121 - DNA, 25 bp, Mus musculus
cttcatccccaaggggacaaatgta

SEQ ID NO: 922122 - DNA, 25 bp, Mus musculus
cttcatccccaaggggacgacactc

SEQ ID NO: 922123 - DNA, 25 bp, Mus musculus
cttcatcctcagaaacaaaggaaga

SEQ ID NO: 922124 - DNA, 25 bp, Mus musculus
cttcatcctcagtaacaaaggaaga

SEQ ID NO: 922125 - DNA, 25 bp, Mus musculus
cttcatcgacaacgtacgcttcctg

SEQ ID NO: 922126 - DNA, 25 bp, Mus musculus
cttcatcgacaaggtacgcttcctg

SEQ ID NO: 922127 - DNA, 25 bp, Mus musculus
cttcatctactcttcgttcttcatt

SEQ ID NO: 922128 - DNA, 25 bp, Mus musculus
cttcatctactcttggttcttcatt

SEQ ID NO: 922129 - DNA, 25 bp, Mus musculus
cttcatctgctgcgaccagagtgag

SEQ ID NO: 922130 - DNA, 25 bp, Mus musculus
cttcatctgctgggaccagagtgag

SEQ ID NO: 922131 - DNA, 25 bp, Mus musculus
cttcatgaccagctacacacttacc

SEQ ID NO: 922132 - DNA, 25 bp, Mus musculus
cttcatgaccaggtacacacttacc

SEQ ID NO: 922133 - DNA, 25 bp, Mus musculus
cttcatgagatgcaaattcaacacc

SEQ ID NO: 922134 - DNA, 25 bp, Mus musculus
cttcatgagatggaaattcaacacc

SEQ ID NO: 922135 - DNA, 25 bp, Mus musculus
cttcatgagcctcaataaggatggc

SEQ ID NO: 922136 - DNA, 25 bp, Mus musculus
cttcatgagcctgaataaggatggc

SEQ ID NO: 922137 - DNA, 25 bp, Mus musculus
cttcatggagcatgatcgggtgtac

SEQ ID NO: 922138 - DNA, 25 bp, Mus musculus
cttcatggaggatgatcgggtgtac

SEQ ID NO: 922139 - DNA, 25 bp, Mus musculus
cttcatggatgaatagaagccccac

SEQ ID NO: 922140 - DNA, 25 bp, Mus musculus
cttcatggatgaatatgctggactc

SEQ ID NO: 922141 - DNA, 25 bp, Mus musculus
cttcatggatgaattgaagccccac

SEQ ID NO: 922142 - DNA, 25 bp, Mus musculus
cttcatggatgaatttgctggactc

SEQ ID NO: 922143 - DNA, 25 bp, Mus musculus
cttcatggctgtgtcattgatcctg

SEQ ID NO: 922144 - DNA, 25 bp, Mus musculus
cttcatggctgtgtgattgatcctg

SEQ ID NO: 922145 - DNA, 25 bp, Mus musculus
cttcatgtgccacgctggcgacttc

SEQ ID NO: 922146 - DNA, 25 bp, Mus musculus
cttcatgtgccaggctggcgacttc

SEQ ID NO: 922147 - DNA, 25 bp, Mus musculus
cttcatgtgtagcacgtttcaaagc

SEQ ID NO: 922148 - DNA, 25 bp, Mus musculus
cttcatgtgtagcaggtttcaaagc

SEQ ID NO: 922149 - DNA, 25 bp, Mus musculus
cttcatgttcgtcattgtgctgtcc

SEQ ID NO: 922150 - DNA, 25 bp, Mus musculus
cttcatgttcgtgattgtgctgtcc

SEQ ID NO: 922151 - DNA, 25 bp, Mus musculus
cttcattaatgacggccttaaagct

SEQ ID NO: 922152 - DNA, 25 bp, Mus musculus
cttcattaatgagggccttaaagct

SEQ ID NO: 922153 - DNA, 25 bp, Mus musculus
cttcattattctatcgctagaaaat

SEQ ID NO: 922154 - DNA, 25 bp, Mus musculus
cttcattattctatggctagaaaat

SEQ ID NO: 922155 - DNA, 25 bp, Mus musculus
cttcattcagcttttggcaagcccg

SEQ ID NO: 922156 - DNA, 25 bp, Mus musculus
cttcattcaggttttggcaagcccg

SEQ ID NO: 922157 - DNA, 25 bp, Mus musculus
cttcattcgaaacaaggatcgggtg

SEQ ID NO: 922158 - DNA, 25 bp, Mus musculus
cttcattcgaaagaaggatcgggtg

SEQ ID NO: 922159 - DNA, 25 bp, Mus musculus
cttcattgatctcgttatccaggcc

SEQ ID NO: 922160 - DNA, 25 bp, Mus musculus
cttcattgatctggttatccaggcc

SEQ ID NO: 922161 - DNA, 25 bp, Mus musculus
cttcattgatggccagacacgcacc

SEQ ID NO: 922162 - DNA, 25 bp, Mus musculus
cttcattgatgggcagacacgcacc

SEQ ID NO: 922163 - DNA, 25 bp, Mus musculus
cttcattgcagaaacacattagtac

SEQ ID NO: 922164 - DNA, 25 bp, Mus musculus
cttcattgcagaaagacattagtac

SEQ ID NO: 922165 - DNA, 25 bp, Mus musculus
cttccaaaagcccctgtcatcacca

SEQ ID NO: 922166 - DNA, 25 bp, Mus musculus
cttccaaaaggacactttctgcact

SEQ ID NO: 922167 - DNA, 25 bp, Mus musculus
cttccaaaaggagactttctgcact

SEQ ID NO: 922168 - DNA, 25 bp, Mus musculus
cttccaaaaggccctgtcatcacca

SEQ ID NO: 922169 - DNA, 25 bp, Mus musculus
cttccaacatactgcagggttgtgt

SEQ ID NO: 922170 - DNA, 25 bp, Mus musculus
cttccaacattctgcagggttgtgt

SEQ ID NO: 922171 - DNA, 25 bp, Mus musculus
cttccaagcaagcgcccctggcttg

SEQ ID NO: 922172 - DNA, 25 bp, Mus musculus
cttccaagcaagggcccctggcttg

SEQ ID NO: 922173 - DNA, 25 bp, Mus musculus
cttccaatacaaccacaggggagta

SEQ ID NO: 922174 - DNA, 25 bp, Mus musculus
cttccaatacaagcacaggggagta

SEQ ID NO: 922175 - DNA, 25 bp, Mus musculus
cttccaatgcagcctgtggcatctc

SEQ ID NO: 922176 - DNA, 25 bp, Mus musculus
cttccaatgcaggctgtggcatctc

SEQ ID NO: 922177 - DNA, 25 bp, Mus musculus
cttccaattgctctgattgttggag

SEQ ID NO: 922178 - DNA, 25 bp, Mus musculus
cttccaattggtctgattgttggag

SEQ ID NO: 922179 - DNA, 25 bp, Mus musculus
cttccaatttcccaataataaacct

SEQ ID NO: 922180 - DNA, 25 bp, Mus musculus
cttccaatttgccaataataaacct

SEQ ID NO: 922181 - DNA, 25 bp, Mus musculus
cttccacaagaatcacctatgtaca

SEQ ID NO: 922182 - DNA, 25 bp, Mus musculus
cttccacaagcaggtgtgtgagtca

SEQ ID NO: 922183 - DNA, 25 bp, Mus musculus
cttccacaaggaggtgtgtgagtca

SEQ ID NO: 922184 - DNA, 25 bp, Mus musculus
cttccacaagtatcacctatgtaca

SEQ ID NO: 922185 - DNA, 25 bp, Mus musculus
cttccacagccgcagagtcaaacac

SEQ ID NO: 922186 - DNA, 25 bp, Mus musculus
cttccacagccggagagtcaaacac

SEQ ID NO: 922187 - DNA, 25 bp, Mus musculus
cttccacaggagtgctcccgtaggc

SEQ ID NO: 922188 - DNA, 25 bp, Mus musculus
cttccacaggagtggtcccgtaggc

SEQ ID NO: 922189 - DNA, 25 bp, Mus musculus
cttccacatctgccacagcggacag

SEQ ID NO: 922190 - DNA, 25 bp, Mus musculus
cttccacatctggcacagcggacag

SEQ ID NO: 922191 - DNA, 25 bp, Mus musculus
cttccacattagagactggctctga

SEQ ID NO: 922192 - DNA, 25 bp, Mus musculus
cttccacattagtgactggctctga

SEQ ID NO: 922193 - DNA, 25 bp, Mus musculus
cttccaccggcaggatcagctgggc

SEQ ID NO: 922194 - DNA, 25 bp, Mus musculus
cttccaccgggaggatcagctgggc

SEQ ID NO: 922195 - DNA, 25 bp, Mus musculus
cttccacctaggcactgccgcttcg

SEQ ID NO: 922196 - DNA, 25 bp, Mus musculus
cttccacctagggactgccgcttcg

SEQ ID NO: 922197 - DNA, 25 bp, Mus musculus
cttccacctccacaccacaagagca

SEQ ID NO: 922198 - DNA, 25 bp, Mus musculus
cttccacctccacagcacaagagca

SEQ ID NO: 922199 - DNA, 25 bp, Mus musculus
cttccacctccgaacccgcaacaga

SEQ ID NO: 922200 - DNA, 25 bp, Mus musculus
cttccacctccgaagccgcaacaga

SEQ ID NO: 922201 - DNA, 25 bp, Mus musculus
cttccaccttgtcaaagtggccctg

SEQ ID NO: 922202 - DNA, 25 bp, Mus musculus
cttccaccttgtcatagtggccctg

SEQ ID NO: 922203 - DNA, 25 bp, Mus musculus
cttccacgagcaggaaagaagaaat

SEQ ID NO: 922204 - DNA, 25 bp, Mus musculus
cttccacgaggaggaaagaagaaat

SEQ ID NO: 922205 - DNA, 25 bp, Mus musculus
cttccacggtcggatacttatctgc

SEQ ID NO: 922206 - DNA, 25 bp, Mus musculus
cttccacggtgggatacttatctgc

SEQ ID NO: 922207 - DNA, 25 bp, Mus musculus
cttccactactgctttgtggagtcg

SEQ ID NO: 922208 - DNA, 25 bp, Mus musculus
cttccactactggtttgtggagtcg

SEQ ID NO: 922209 - DNA, 25 bp, Mus musculus
cttccactcatcttcgaaaggactt

SEQ ID NO: 922210 - DNA, 25 bp, Mus musculus
cttccactcatcttggaaaggactt

SEQ ID NO: 922211 - DNA, 25 bp, Mus musculus
cttccactggcgtgtgtctgcagca

SEQ ID NO: 922212 - DNA, 25 bp, Mus musculus
cttccactggggtgtgtctgcagca

SEQ ID NO: 922213 - DNA, 25 bp, Mus musculus
cttccacttccactgcttctgcttt

SEQ ID NO: 922214 - DNA, 25 bp, Mus musculus
cttccacttccagtgcttctgcttt

SEQ ID NO: 922215 - DNA, 25 bp, Mus musculus
cttccagaccaacgaccacctgttc

SEQ ID NO: 922216 - DNA, 25 bp, Mus musculus
cttccagaccaaggaccacctgttc

SEQ ID NO: 922217 - DNA, 25 bp, Mus musculus
cttccagaggaacgctttcggcagc

SEQ ID NO: 922218 - DNA, 25 bp, Mus musculus
cttccagaggaaggctttcggcagc

SEQ ID NO: 922219 - DNA, 25 bp, Mus musculus
cttccaggactaaagcgcagcagca

SEQ ID NO: 922220 - DNA, 25 bp, Mus musculus
cttccaggactatagcgcagcagca

SEQ ID NO: 922221 - DNA, 25 bp, Mus musculus
cttccaggcaagctcagggtatggt

SEQ ID NO: 922222 - DNA, 25 bp, Mus musculus
cttccaggcatgctcagggtatggt

SEQ ID NO: 922223 - DNA, 25 bp, Mus musculus
cttccagttcagcaccctgcagcag

SEQ ID NO: 922224 - DNA, 25 bp, Mus musculus
cttccagttcagcacggcacctacg

SEQ ID NO: 922225 - DNA, 25 bp, Mus musculus
cttccagttcagcagcctgcagcag

SEQ ID NO: 922226 - DNA, 25 bp, Mus musculus
cttccagttcagcagggcacctacg

SEQ ID NO: 922227 - DNA, 25 bp, Mus musculus
cttccagttgagtcacctgatatga

SEQ ID NO: 922228 - DNA, 25 bp, Mus musculus
cttccagttgcagagtcacctgata

SEQ ID NO: 922229 - DNA, 25 bp, Mus musculus
cttccagttggagagtcacctgata

SEQ ID NO: 922230 - DNA, 25 bp, Mus musculus
cttccagttgtgtcacctgatatga

SEQ ID NO: 922231 - DNA, 25 bp, Mus musculus
cttccagtttgcaaagaagtttgtg

SEQ ID NO: 922232 - DNA, 25 bp, Mus musculus
cttccagtttgcaatgaagtttgtg

SEQ ID NO: 922233 - DNA, 25 bp, Mus musculus
cttccatatcagccgcttacagtct

SEQ ID NO: 922234 - DNA, 25 bp, Mus musculus
cttccatatcagctggaaggacggg

SEQ ID NO: 922235 - DNA, 25 bp, Mus musculus
cttccatatcaggcgcttacagtct

SEQ ID NO: 922236 - DNA, 25 bp, Mus musculus
cttccatatcaggtggaaggacggg

SEQ ID NO: 922237 - DNA, 25 bp, Mus musculus
cttccatcaccaccatccatgtctt

SEQ ID NO: 922238 - DNA, 25 bp, Mus musculus
cttccatcaccacgtgcgtgatgac

SEQ ID NO: 922239 - DNA, 25 bp, Mus musculus
cttccatcaccagcatccatgtctt

SEQ ID NO: 922240 - DNA, 25 bp, Mus musculus
cttccatcaccaggtgcgtgatgac

SEQ ID NO: 922241 - DNA, 25 bp, Mus musculus
cttccatcctatatagtctacatgg

SEQ ID NO: 922242 - DNA, 25 bp, Mus musculus
cttccatcctatttagtctacatgg

SEQ ID NO: 922243 - DNA, 25 bp, Mus musculus
cttccatcgtgatccgcaagaagcc

SEQ ID NO: 922244 - DNA, 25 bp, Mus musculus
cttccatcgtgatccgtgagaagga

SEQ ID NO: 922245 - DNA, 25 bp, Mus musculus
cttccatcgtgatcggcaagaagcc

SEQ ID NO: 922246 - DNA, 25 bp, Mus musculus
cttccatcgtgatcggtgagaagga

SEQ ID NO: 922247 - DNA, 25 bp, Mus musculus
cttccatggaagatctcatggacac

SEQ ID NO: 922248 - DNA, 25 bp, Mus musculus
cttccatggaagttctcatggacac

SEQ ID NO: 922249 - DNA, 25 bp, Mus musculus
cttcccaactctgctcctgacatca

SEQ ID NO: 922250 - DNA, 25 bp, Mus musculus
cttcccaactgtgctcctgacatca

SEQ ID NO: 922251 - DNA, 25 bp, Mus musculus
cttcccacagagcttgaaatgggca

SEQ ID NO: 922252 - DNA, 25 bp, Mus musculus
cttcccacagaggttgaaatgggca

SEQ ID NO: 922253 - DNA, 25 bp, Mus musculus
cttcccacagcgacgactgctgcct

SEQ ID NO: 922254 - DNA, 25 bp, Mus musculus
cttcccacagctcggcgctcagtat

SEQ ID NO: 922255 - DNA, 25 bp, Mus musculus
cttcccacagctgggcgctcagtat

SEQ ID NO: 922256 - DNA, 25 bp, Mus musculus
cttcccacagggacgactgctgcct

SEQ ID NO: 922257 - DNA, 25 bp, Mus musculus
cttcccacggctgcagacctcctgc

SEQ ID NO: 922258 - DNA, 25 bp, Mus musculus
cttcccacggctgctgacctcctgc

SEQ ID NO: 922259 - DNA, 25 bp, Mus musculus
cttcccactctcctcaacttccagg

SEQ ID NO: 922260 - DNA, 25 bp, Mus musculus
cttcccactctcctcgtcctgagtc

SEQ ID NO: 922261 - DNA, 25 bp, Mus musculus
cttcccactctcctgaacttccagg

SEQ ID NO: 922262 - DNA, 25 bp, Mus musculus
cttcccactctcctggtcctgagtc

SEQ ID NO: 922263 - DNA, 25 bp, Mus musculus
cttcccagatcaatgcactgatccc

SEQ ID NO: 922264 - DNA, 25 bp, Mus musculus
cttcccagatgaatgcactgatccc

SEQ ID NO: 922265 - DNA, 25 bp, Mus musculus
cttcccagggagctcagcacctcgg

SEQ ID NO: 922266 - DNA, 25 bp, Mus musculus
cttcccagggaggtcagcacctcgg

SEQ ID NO: 922267 - DNA, 25 bp, Mus musculus
cttcccccagatgcctgtcggtgcc

SEQ ID NO: 922268 - DNA, 25 bp, Mus musculus
cttcccccagttgcctgtcggtgcc

SEQ ID NO: 922269 - DNA, 25 bp, Mus musculus
cttcccccgagctccagtcctcaga

SEQ ID NO: 922270 - DNA, 25 bp, Mus musculus
cttcccccgagctcgagtcctcaga

SEQ ID NO: 922271 - DNA, 25 bp, Mus musculus
cttcccccttggatgcctctctgca

SEQ ID NO: 922272 - DNA, 25 bp, Mus musculus
cttcccccttggttgcctctctgca

SEQ ID NO: 922273 - DNA, 25 bp, Mus musculus
cttcccctcctgaagctgattggcg

SEQ ID NO: 922274 - DNA, 25 bp, Mus musculus
cttcccctcctgtagctgattggcg

SEQ ID NO: 922275 - DNA, 25 bp, Mus musculus
cttcccctcgcatgcagatgggaaa

SEQ ID NO: 922276 - DNA, 25 bp, Mus musculus
cttcccctcggatgcagatgggaaa

SEQ ID NO: 922277 - DNA, 25 bp, Mus musculus
cttcccgccgcgcaggagaatggcg

SEQ ID NO: 922278 - DNA, 25 bp, Mus musculus
cttcccgccgcggaggagaatggcg

SEQ ID NO: 922279 - DNA, 25 bp, Mus musculus
cttcccgctcctcgtagagcaatga

SEQ ID NO: 922280 - DNA, 25 bp, Mus musculus
cttcccgctcctggtagagcaatga

SEQ ID NO: 922281 - DNA, 25 bp, Mus musculus
cttcccgctgcacgtgcaatggaat

SEQ ID NO: 922282 - DNA, 25 bp, Mus musculus
cttcccgctgctggtcccgtactgg

SEQ ID NO: 922283 - DNA, 25 bp, Mus musculus
cttcccgctggacgtgcaatggaat

SEQ ID NO: 922284 - DNA, 25 bp, Mus musculus
cttcccgctggtggtcccgtactgg

SEQ ID NO: 922285 - DNA, 25 bp, Mus musculus
cttccctatagtcaatacttcgagt

SEQ ID NO: 922286 - DNA, 25 bp, Mus musculus
cttccctatagtgaatacttcgagt

SEQ ID NO: 922287 - DNA, 25 bp, Mus musculus
cttccctcagactccgggtcgcatc

SEQ ID NO: 922288 - DNA, 25 bp, Mus musculus
cttccctcagactccgtacctcgga

SEQ ID NO: 922289 - DNA, 25 bp, Mus musculus
cttccctcagactccgtcccccaga

SEQ ID NO: 922290 - DNA, 25 bp, Mus musculus
cttccctcagactcggggtcgcatc

SEQ ID NO: 922291 - DNA, 25 bp, Mus musculus
cttccctcagactcggtacctcgga

SEQ ID NO: 922292 - DNA, 25 bp, Mus musculus
cttccctcagactcggtcccccaga

SEQ ID NO: 922293 - DNA, 25 bp, Mus musculus
cttccctccgactcctctgcaagcc

SEQ ID NO: 922294 - DNA, 25 bp, Mus musculus
cttccctccgtctcctctgcaagcc

SEQ ID NO: 922295 - DNA, 25 bp, Mus musculus
cttccctgctttttcgagaggacga

SEQ ID NO: 922296 - DNA, 25 bp, Mus musculus
cttccctgctttttggagaggacga

SEQ ID NO: 922297 - DNA, 25 bp, Mus musculus
cttcccttcctccctctcgccggtg

SEQ ID NO: 922298 - DNA, 25 bp, Mus musculus
cttcccttcctcgctctcgccggtg

SEQ ID NO: 922299 - DNA, 25 bp, Mus musculus
cttccctttgcacgggaactcattc

SEQ ID NO: 922300 - DNA, 25 bp, Mus musculus
cttccctttgcaggggaactcattc

SEQ ID NO: 922301 - DNA, 25 bp, Mus musculus
cttccgactcagaacatctcttcca

SEQ ID NO: 922302 - DNA, 25 bp, Mus musculus
cttccgactcagaagatctcttcca

SEQ ID NO: 922303 - DNA, 25 bp, Mus musculus
cttccgagcccacgtaaactgcagc

SEQ ID NO: 922304 - DNA, 25 bp, Mus musculus
cttccgagcccaggtaaactgcagc

SEQ ID NO: 922305 - DNA, 25 bp, Mus musculus
cttccgccagattcgtgatcctgag

SEQ ID NO: 922306 - DNA, 25 bp, Mus musculus
cttccgccagtttcgtgatcctgag

SEQ ID NO: 922307 - DNA, 25 bp, Mus musculus
cttccggaaaccaatttcctgccac

SEQ ID NO: 922308 - DNA, 25 bp, Mus musculus
cttccggaaagcaatttcctgccac

SEQ ID NO: 922309 - DNA, 25 bp, Mus musculus
cttccggaacggcctatggagtcaa

SEQ ID NO: 922310 - DNA, 25 bp, Mus musculus
cttccggaacgggctatggagtcaa

SEQ ID NO: 922311 - DNA, 25 bp, Mus musculus
cttccggaagcaactggtgagcaga

SEQ ID NO: 922312 - DNA, 25 bp, Mus musculus
cttccggaagccctctggattctcc

SEQ ID NO: 922313 - DNA, 25 bp, Mus musculus
cttccggaaggaactggtgagcaga

SEQ ID NO: 922314 - DNA, 25 bp, Mus musculus
cttccggaaggcctctggattctcc

SEQ ID NO: 922315 - DNA, 25 bp, Mus musculus
cttccggcagccagttcctccatca

SEQ ID NO: 922316 - DNA, 25 bp, Mus musculus
cttccggcaggcagttcctccatca

SEQ ID NO: 922317 - DNA, 25 bp, Mus musculus
cttccgggagatcctgctcattttc

SEQ ID NO: 922318 - DNA, 25 bp, Mus musculus
cttccgggagttcctgctcattttc

SEQ ID NO: 922319 - DNA, 25 bp, Mus musculus
cttccggtcagactcggcccagtca

SEQ ID NO: 922320 - DNA, 25 bp, Mus musculus
cttccggtcagagtcggcccagtca

SEQ ID NO: 922321 - DNA, 25 bp, Mus musculus
cttcctagctctgttcggcttcgtg

SEQ ID NO: 922322 - DNA, 25 bp, Mus musculus
cttcctagctgtgttcggcttcgtg

SEQ ID NO: 922323 - DNA, 25 bp, Mus musculus
cttcctagtcttcctgctgggcctc

SEQ ID NO: 922324 - DNA, 25 bp, Mus musculus
cttcctagtcttgctgctgggcctc

SEQ ID NO: 922325 - DNA, 25 bp, Mus musculus
cttcctatcaaacaagattaaatgc

SEQ ID NO: 922326 - DNA, 25 bp, Mus musculus
cttcctatcatacaagattaaatgc

SEQ ID NO: 922327 - DNA, 25 bp, Mus musculus
cttcctattgcccaacacatctacc

SEQ ID NO: 922328 - DNA, 25 bp, Mus musculus
cttcctattggccaacacatctacc

SEQ ID NO: 922329 - DNA, 25 bp, Mus musculus
cttcctcaacagagtctacattggg

SEQ ID NO: 922330 - DNA, 25 bp, Mus musculus
cttcctcaacagtgtctacattggg

SEQ ID NO: 922331 - DNA, 25 bp, Mus musculus
cttcctcaagcctaacttaggagac

SEQ ID NO: 922332 - DNA, 25 bp, Mus musculus
cttcctcaagctgagtcctgagagc

SEQ ID NO: 922333 - DNA, 25 bp, Mus musculus
cttcctcaaggctaacttaggagac

SEQ ID NO: 922334 - DNA, 25 bp, Mus musculus
cttcctcaaggtgagtcctgagagc

SEQ ID NO: 922335 - DNA, 25 bp, Mus musculus
cttcctcaggaggtccctagtatac

SEQ ID NO: 922336 - DNA, 25 bp, Mus musculus
cttcctcaggtggtccctagtatac

SEQ ID NO: 922337 - DNA, 25 bp, Mus musculus
cttcctccgaaggctacagatgtct

SEQ ID NO: 922338 - DNA, 25 bp, Mus musculus
cttcctccgatggctacagatgtct

SEQ ID NO: 922339 - DNA, 25 bp, Mus musculus
cttcctcctccgagcgggatgtgct

SEQ ID NO: 922340 - DNA, 25 bp, Mus musculus
cttcctcctccgagggggatgtgct

SEQ ID NO: 922341 - DNA, 25 bp, Mus musculus
cttcctcgagccctacaattcaaag

SEQ ID NO: 922342 - DNA, 25 bp, Mus musculus
cttcctcgaggcctacaattcaaag

SEQ ID NO: 922343 - DNA, 25 bp, Mus musculus
cttcctctaaacaacacgggccgca

SEQ ID NO: 922344 - DNA, 25 bp, Mus musculus
cttcctctaaacaagacgggccgca

SEQ ID NO: 922345 - DNA, 25 bp, Mus musculus
cttcctctctagctcttagtgatgg

SEQ ID NO: 922346 - DNA, 25 bp, Mus musculus
cttcctctcttgctcttagtgatgg

SEQ ID NO: 922347 - DNA, 25 bp, Mus musculus
cttcctctgacactctcatctttgg

SEQ ID NO: 922348 - DNA, 25 bp, Mus musculus
cttcctctgacagtctcatctttgg

SEQ ID NO: 922349 - DNA, 25 bp, Mus musculus
cttcctcttggaacaaattctgcat

SEQ ID NO: 922350 - DNA, 25 bp, Mus musculus
cttcctcttggaactaattctgcat

SEQ ID NO: 922351 - DNA, 25 bp, Mus musculus
cttcctgaagcgtgcccacgtgacc

SEQ ID NO: 922352 - DNA, 25 bp, Mus musculus
cttcctgaagggtgcccacgtgacc

SEQ ID NO: 922353 - DNA, 25 bp, Mus musculus
cttcctgaagtcagaactggaaaac

SEQ ID NO: 922354 - DNA, 25 bp, Mus musculus
cttcctgaagtcagtactggaaaac

SEQ ID NO: 922355 - DNA, 25 bp, Mus musculus
cttcctgatcattgcgtattctacc

SEQ ID NO: 922356 - DNA, 25 bp, Mus musculus
cttcctgatcattgggtattctacc

SEQ ID NO: 922357 - DNA, 25 bp, Mus musculus
cttcctgatgaaagtcattggtctc

SEQ ID NO: 922358 - DNA, 25 bp, Mus musculus
cttcctgatgaacttatagtgcctc

SEQ ID NO: 922359 - DNA, 25 bp, Mus musculus
cttcctgatgaagttatagtgcctc

SEQ ID NO: 922360 - DNA, 25 bp, Mus musculus
cttcctgatgaatgtcattggtctc

SEQ ID NO: 922361 - DNA, 25 bp, Mus musculus
cttcctgcagcaatatgtcaccaac

SEQ ID NO: 922362 - DNA, 25 bp, Mus musculus
cttcctgcaggaatatgtcaccaac

SEQ ID NO: 922363 - DNA, 25 bp, Mus musculus
cttcctgccccacaaaacatcggac

SEQ ID NO: 922364 - DNA, 25 bp, Mus musculus
cttcctgccccagaaaacatcggac

SEQ ID NO: 922365 - DNA, 25 bp, Mus musculus
cttcctggacagcctgcgaaggccc

SEQ ID NO: 922366 - DNA, 25 bp, Mus musculus
cttcctggacaggctgcgaaggccc

SEQ ID NO: 922367 - DNA, 25 bp, Mus musculus
cttcctggagcatgtggacgatgcc

SEQ ID NO: 922368 - DNA, 25 bp, Mus musculus
cttcctggaggatgtggacgatgcc

SEQ ID NO: 922369 - DNA, 25 bp, Mus musculus
cttcctggaggtcacggtggcagtg

SEQ ID NO: 922370 - DNA, 25 bp, Mus musculus
cttcctggaggtcagggtggcagtg

SEQ ID NO: 922371 - DNA, 25 bp, Mus musculus
cttcctggatctccagaaggatgca

SEQ ID NO: 922372 - DNA, 25 bp, Mus musculus
cttcctggatgacgcattcgtgact

SEQ ID NO: 922373 - DNA, 25 bp, Mus musculus
cttcctggatgaggcattcgtgact

SEQ ID NO: 922374 - DNA, 25 bp, Mus musculus
cttcctggatgtccagaaggatgca

SEQ ID NO: 922375 - DNA, 25 bp, Mus musculus
cttcctgtaccactcaccaggtgga

SEQ ID NO: 922376 - DNA, 25 bp, Mus musculus
cttcctgtaccactgaccaggtgga

SEQ ID NO: 922377 - DNA, 25 bp, Mus musculus
cttcctgtcaggaacgagtcacacc

SEQ ID NO: 922378 - DNA, 25 bp, Mus musculus
cttcctgtcaggaaggagtcacacc

SEQ ID NO: 922379 - DNA, 25 bp, Mus musculus
cttcctgtccagagagaacattata

SEQ ID NO: 922380 - DNA, 25 bp, Mus musculus
cttcctgtccagcagagaacacaag

SEQ ID NO: 922381 - DNA, 25 bp, Mus musculus
cttcctgtccaggagagaacacaag

SEQ ID NO: 922382 - DNA, 25 bp, Mus musculus
cttcctgtccagtgagaacattata

SEQ ID NO: 922383 - DNA, 25 bp, Mus musculus
cttcctgtctgacatccgttgggaa

SEQ ID NO: 922384 - DNA, 25 bp, Mus musculus
cttcctgtctgagatccgttgggaa

SEQ ID NO: 922385 - DNA, 25 bp, Mus musculus
cttccttaagcatcatgggaaaatc

SEQ ID NO: 922386 - DNA, 25 bp, Mus musculus
cttccttaaggatcatgggaaaatc

SEQ ID NO: 922387 - DNA, 25 bp, Mus musculus
cttccttcagaagagttcgctccgg

SEQ ID NO: 922388 - DNA, 25 bp, Mus musculus
cttccttcagagtgtactgcagtcg

SEQ ID NO: 922389 - DNA, 25 bp, Mus musculus
cttccttcagtagagttcgctccgg

SEQ ID NO: 922390 - DNA, 25 bp, Mus musculus
cttccttcagtgtgtactgcagtcg

SEQ ID NO: 922391 - DNA, 25 bp, Mus musculus
cttccttccagtgaccttgcttccc

SEQ ID NO: 922392 - DNA, 25 bp, Mus musculus
cttccttccagtgagcttgcttccc

SEQ ID NO: 922393 - DNA, 25 bp, Mus musculus
cttcgaaaagcctcgggatgtgtat

SEQ ID NO: 922394 - DNA, 25 bp, Mus musculus
cttcgaaaaggctcgggatgtgtat

SEQ ID NO: 922395 - DNA, 25 bp, Mus musculus
cttcgaaaatatgttttggccagcc

SEQ ID NO: 922396 - DNA, 25 bp, Mus musculus
cttcgaaaatttgttttggccagcc

SEQ ID NO: 922397 - DNA, 25 bp, Mus musculus
cttcgaaaccagcacaccttctctg

SEQ ID NO: 922398 - DNA, 25 bp, Mus musculus
cttcgaaaccaggacaccttctctg

SEQ ID NO: 922399 - DNA, 25 bp, Mus musculus
cttcgaagccaacgcccaggccttg

SEQ ID NO: 922400 - DNA, 25 bp, Mus musculus
cttcgaagccaaggcccaggccttg

SEQ ID NO: 922401 - DNA, 25 bp, Mus musculus
cttcgaagtaagacgaccaccagag

SEQ ID NO: 922402 - DNA, 25 bp, Mus musculus
cttcgaagtaagtcgaccaccagag

SEQ ID NO: 922403 - DNA, 25 bp, Mus musculus
cttcgaatctcacgctcaggtccct

SEQ ID NO: 922404 - DNA, 25 bp, Mus musculus
cttcgaatctcaggctcaggtccct

SEQ ID NO: 922405 - DNA, 25 bp, Mus musculus
cttcgaatggatatacccctcctac

SEQ ID NO: 922406 - DNA, 25 bp, Mus musculus
cttcgaatggatttacccctcctac

SEQ ID NO: 922407 - DNA, 25 bp, Mus musculus
cttcgacccacaaacgagaatgtgg

SEQ ID NO: 922408 - DNA, 25 bp, Mus musculus
cttcgacccacaaaggagaatgtgg

SEQ ID NO: 922409 - DNA, 25 bp, Mus musculus
cttcgacgggagctggcccaggcaa

SEQ ID NO: 922410 - DNA, 25 bp, Mus musculus
cttcgacgggaggtggcccaggcaa

SEQ ID NO: 922411 - DNA, 25 bp, Mus musculus
cttcgagaagcccaaagaatcttgg

SEQ ID NO: 922412 - DNA, 25 bp, Mus musculus
cttcgagaaggccaaagaatcttgg

SEQ ID NO: 922413 - DNA, 25 bp, Mus musculus
cttcgagatgatcgaggttttgaat

SEQ ID NO: 922414 - DNA, 25 bp, Mus musculus
cttcgagatgatggaggttttgaat

SEQ ID NO: 922415 - DNA, 25 bp, Mus musculus
cttcgagcacatccccttaggccca

SEQ ID NO: 922416 - DNA, 25 bp, Mus musculus
cttcgagcacatcggagtgttgtga

SEQ ID NO: 922417 - DNA, 25 bp, Mus musculus
cttcgagcacatgcccttaggccca

SEQ ID NO: 922418 - DNA, 25 bp, Mus musculus
cttcgagcacatgggagtgttgtga

SEQ ID NO: 922419 - DNA, 25 bp, Mus musculus
cttcgaggacccgccagatgctgag

SEQ ID NO: 922420 - DNA, 25 bp, Mus musculus
cttcgaggacccgcgagatgctgag

SEQ ID NO: 922421 - DNA, 25 bp, Mus musculus
cttcgaggcgaggtgcaagatttgc

SEQ ID NO: 922422 - DNA, 25 bp, Mus musculus
cttcgaggcgtggtgcaagatttgc

SEQ ID NO: 922423 - DNA, 25 bp, Mus musculus
cttcgaggctatctcgggcgctgtc

SEQ ID NO: 922424 - DNA, 25 bp, Mus musculus
cttcgaggctatctggggcgctgtc

SEQ ID NO: 922425 - DNA, 25 bp, Mus musculus
cttcgagtcacacggggtgacatgg

SEQ ID NO: 922426 - DNA, 25 bp, Mus musculus
cttcgagtcacagggggtgacatgg

SEQ ID NO: 922427 - DNA, 25 bp, Mus musculus
cttcgatgagacaactctcaataac

SEQ ID NO: 922428 - DNA, 25 bp, Mus musculus
cttcgatgagcgcgccttctccatg

SEQ ID NO: 922429 - DNA, 25 bp, Mus musculus
cttcgatgagggcgccttctccatg

SEQ ID NO: 922430 - DNA, 25 bp, Mus musculus
cttcgatgagtcaactctcaataac

SEQ ID NO: 922431 - DNA, 25 bp, Mus musculus
cttcgcaatgcgcatcgcaggcaca

SEQ ID NO: 922432 - DNA, 25 bp, Mus musculus
cttcgcaatgggcatcgcaggcaca

SEQ ID NO: 922433 - DNA, 25 bp, Mus musculus
cttcgcagttcacgttgctctcatc

SEQ ID NO: 922434 - DNA, 25 bp, Mus musculus
cttcgcagttcaggttgctctcatc

SEQ ID NO: 922435 - DNA, 25 bp, Mus musculus
cttcgcccagaacgtagccgttgcc

SEQ ID NO: 922436 - DNA, 25 bp, Mus musculus
cttcgcccagaaggtagccgttgcc

SEQ ID NO: 922437 - DNA, 25 bp, Mus musculus
cttcgccctctgcatgaggaactgc

SEQ ID NO: 922438 - DNA, 25 bp, Mus musculus
cttcgccctctggatgaggaactgc

SEQ ID NO: 922439 - DNA, 25 bp, Mus musculus
cttcgccgaccacttccttcgagtc

SEQ ID NO: 922440 - DNA, 25 bp, Mus musculus
cttcgccgaccagttccttcgagtc

SEQ ID NO: 922441 - DNA, 25 bp, Mus musculus
cttcgcctagcaaagaatctgtata

SEQ ID NO: 922442 - DNA, 25 bp, Mus musculus
cttcgcctaggaaagaatctgtata

SEQ ID NO: 922443 - DNA, 25 bp, Mus musculus
cttcgcctcagacgtcgagcccagt

SEQ ID NO: 922444 - DNA, 25 bp, Mus musculus
cttcgcctcagacgtggcatgcaga

SEQ ID NO: 922445 - DNA, 25 bp, Mus musculus
cttcgcctcagaggtcgagcccagt

SEQ ID NO: 922446 - DNA, 25 bp, Mus musculus
cttcgcctcagaggtggcatgcaga

SEQ ID NO: 922447 - DNA, 25 bp, Mus musculus
cttcgccttcaccacggatgactct

SEQ ID NO: 922448 - DNA, 25 bp, Mus musculus
cttcgccttcaccagggatgactct

SEQ ID NO: 922449 - DNA, 25 bp, Mus musculus
cttcgcgattatcacaatccctctg

SEQ ID NO: 922450 - DNA, 25 bp, Mus musculus
cttcgcgattatcacagtccagtag

SEQ ID NO: 922451 - DNA, 25 bp, Mus musculus
cttcgcgattatcagaatccctctg

SEQ ID NO: 922452 - DNA, 25 bp, Mus musculus
cttcgcgattatcagagtccagtag

SEQ ID NO: 922453 - DNA, 25 bp, Mus musculus
cttcgcgcaccaccattctcgtgtg

SEQ ID NO: 922454 - DNA, 25 bp, Mus musculus
cttcgcgcaccagcattctcgtgtg

SEQ ID NO: 922455 - DNA, 25 bp, Mus musculus
cttcgcgggcttcacgtagaagcca

SEQ ID NO: 922456 - DNA, 25 bp, Mus musculus
cttcgcgggcttcacgtgaggatcc

SEQ ID NO: 922457 - DNA, 25 bp, Mus musculus
cttcgcgggcttcactgctggagga

SEQ ID NO: 922458 - DNA, 25 bp, Mus musculus
cttcgcgggcttcaggtagaagcca

SEQ ID NO: 922459 - DNA, 25 bp, Mus musculus
cttcgcgggcttcaggtgaggatcc

SEQ ID NO: 922460 - DNA, 25 bp, Mus musculus
cttcgcgggcttcagtgctggagga

SEQ ID NO: 922461 - DNA, 25 bp, Mus musculus
cttcgcgtcacgctcttgttgcagc

SEQ ID NO: 922462 - DNA, 25 bp, Mus musculus
cttcgcgtcacggtcttgttgcagc

SEQ ID NO: 922463 - DNA, 25 bp, Mus musculus
cttcgctgctgacgtcgtacaccct

SEQ ID NO: 922464 - DNA, 25 bp, Mus musculus
cttcgctgctgaggtcgtacaccct

SEQ ID NO: 922465 - DNA, 25 bp, Mus musculus
cttcgctgtaaagacgcccttccta

SEQ ID NO: 922466 - DNA, 25 bp, Mus musculus
cttcgctgtaaagaggcccttccta

SEQ ID NO: 922467 - DNA, 25 bp, Mus musculus
cttcggaaagaccttcaggctcccg

SEQ ID NO: 922468 - DNA, 25 bp, Mus musculus
cttcggaaagtccttcaggctcccg

SEQ ID NO: 922469 - DNA, 25 bp, Mus musculus
cttcggacaggacatgattatgttg

SEQ ID NO: 922470 - DNA, 25 bp, Mus musculus
cttcggacaggagatgattatgttg

SEQ ID NO: 922471 - DNA, 25 bp, Mus musculus
cttcggagagtgcaacagtggtccc

SEQ ID NO: 922472 - DNA, 25 bp, Mus musculus
cttcggagagtggaacagtggtccc

SEQ ID NO: 922473 - DNA, 25 bp, Mus musculus
cttcggcatggcgacgtatgttttg

SEQ ID NO: 922474 - DNA, 25 bp, Mus musculus
cttcggcatggcgaggtatgttttg

SEQ ID NO: 922475 - DNA, 25 bp, Mus musculus
cttcggcccaaagacatgaagttgg

SEQ ID NO: 922476 - DNA, 25 bp, Mus musculus
cttcggcccaaagagatgaagttgg

SEQ ID NO: 922477 - DNA, 25 bp, Mus musculus
cttcgggaagagcgccaccaggagt

SEQ ID NO: 922478 - DNA, 25 bp, Mus musculus
cttcgggaagagggccaccaggagt

SEQ ID NO: 922479 - DNA, 25 bp, Mus musculus
cttcgggacctcacctccaactctt

SEQ ID NO: 922480 - DNA, 25 bp, Mus musculus
cttcgggacctctcctccaactctt

SEQ ID NO: 922481 - DNA, 25 bp, Mus musculus
cttcgggactagctccccgggatgc

SEQ ID NO: 922482 - DNA, 25 bp, Mus musculus
cttcgggactaggtccccgggatgc

SEQ ID NO: 922483 - DNA, 25 bp, Mus musculus
cttcgggagcagctgatatatcccc

SEQ ID NO: 922484 - DNA, 25 bp, Mus musculus
cttcgggagcaggtgatatatcccc

SEQ ID NO: 922485 - DNA, 25 bp, Mus musculus
cttcgggatgtcaacatggtgaaga

SEQ ID NO: 922486 - DNA, 25 bp, Mus musculus
cttcgggatgtcaagatggtgaaga

SEQ ID NO: 922487 - DNA, 25 bp, Mus musculus
cttcgggcactgagcaccagttttg

SEQ ID NO: 922488 - DNA, 25 bp, Mus musculus
cttcgggcactgtgcaccagttttg

SEQ ID NO: 922489 - DNA, 25 bp, Mus musculus
cttcgggcccagctctccagtctaa

SEQ ID NO: 922490 - DNA, 25 bp, Mus musculus
cttcgggcccaggtctccagtctaa

SEQ ID NO: 922491 - DNA, 25 bp, Mus musculus
cttcggggagctggccaagcaggag

SEQ ID NO: 922492 - DNA, 25 bp, Mus musculus
cttcggggaggtggccaagcaggag

SEQ ID NO: 922493 - DNA, 25 bp, Mus musculus
cttcggggctgacacatcaacttat

SEQ ID NO: 922494 - DNA, 25 bp, Mus musculus
cttcggggctgacagatcaacttat

SEQ ID NO: 922495 - DNA, 25 bp, Mus musculus
cttcggtctccacattcgcctctaa

SEQ ID NO: 922496 - DNA, 25 bp, Mus musculus
cttcggtctccagattcgcctctaa

SEQ ID NO: 922497 - DNA, 25 bp, Mus musculus
cttcggtgacatcaccaatgaggaa

SEQ ID NO: 922498 - DNA, 25 bp, Mus musculus
cttcggtgacatgaccaatgaggaa

SEQ ID NO: 922499 - DNA, 25 bp, Mus musculus
cttcgtaaagagaagtataatgccg

SEQ ID NO: 922500 - DNA, 25 bp, Mus musculus
cttcgtaaagagaataatgccgact

SEQ ID NO: 922501 - DNA, 25 bp, Mus musculus
cttcgtaaagagtagtataatgccg

SEQ ID NO: 922502 - DNA, 25 bp, Mus musculus
cttcgtaaagagtataatgccgact

SEQ ID NO: 922503 - DNA, 25 bp, Mus musculus
cttcgtaaagattgcacttgggtcg

SEQ ID NO: 922504 - DNA, 25 bp, Mus musculus
cttcgtaaagtttgcacttgggtcg

SEQ ID NO: 922505 - DNA, 25 bp, Mus musculus
cttcgtcaagcaaacctgcagatct

SEQ ID NO: 922506 - DNA, 25 bp, Mus musculus
cttcgtcaagcccggaagtgatggt

SEQ ID NO: 922507 - DNA, 25 bp, Mus musculus
cttcgtcaagcgcacactgagagcc

SEQ ID NO: 922508 - DNA, 25 bp, Mus musculus
cttcgtcaaggaaacctgcagatct

SEQ ID NO: 922509 - DNA, 25 bp, Mus musculus
cttcgtcaaggccggaagtgatggt

SEQ ID NO: 922510 - DNA, 25 bp, Mus musculus
cttcgtcaagggcacactgagagcc

SEQ ID NO: 922511 - DNA, 25 bp, Mus musculus
cttcgtcaggaacgcctctctgctc

SEQ ID NO: 922512 - DNA, 25 bp, Mus musculus
cttcgtcaggaaggcctctctgctc

SEQ ID NO: 922513 - DNA, 25 bp, Mus musculus
cttcgtcggagacgtgctgaatgcc

SEQ ID NO: 922514 - DNA, 25 bp, Mus musculus
cttcgtcggagaggtgctgaatgcc

SEQ ID NO: 922515 - DNA, 25 bp, Mus musculus
cttcgtcttctgcatcactggggtg

SEQ ID NO: 922516 - DNA, 25 bp, Mus musculus
cttcgtcttctggatcactggggtg

SEQ ID NO: 922517 - DNA, 25 bp, Mus musculus
cttcgtggagattgatgagaataca

SEQ ID NO: 922518 - DNA, 25 bp, Mus musculus
cttcgtggagtttgatgagaataca

SEQ ID NO: 922519 - DNA, 25 bp, Mus musculus
cttcgtggtttactcttctcttact

SEQ ID NO: 922520 - DNA, 25 bp, Mus musculus
cttcgtggtttactgttctcttact

SEQ ID NO: 922521 - DNA, 25 bp, Mus musculus
cttcgttgacagatatgacgtggtg

SEQ ID NO: 922522 - DNA, 25 bp, Mus musculus
cttcgttgacagttatgacgtggtg

SEQ ID NO: 922523 - DNA, 25 bp, Mus musculus
cttcgtttccaccgtggaatgcaaa

SEQ ID NO: 922524 - DNA, 25 bp, Mus musculus
cttcgtttccacggtggaatgcaaa

SEQ ID NO: 922525 - DNA, 25 bp, Mus musculus
cttctaaatgataacaatggcacac

SEQ ID NO: 922526 - DNA, 25 bp, Mus musculus
cttctaaatgataacgaacatgaca

SEQ ID NO: 922527 - DNA, 25 bp, Mus musculus
cttctaaatgataagaatggcacac

SEQ ID NO: 922528 - DNA, 25 bp, Mus musculus
cttctaaatgataaggaacatgaca

SEQ ID NO: 922529 - DNA, 25 bp, Mus musculus
cttctaaccagacgcaccaggatca

SEQ ID NO: 922530 - DNA, 25 bp, Mus musculus
cttctaaccagaggcaccaggatca

SEQ ID NO: 922531 - DNA, 25 bp, Mus musculus
cttctaagccagatccttccacaca

SEQ ID NO: 922532 - DNA, 25 bp, Mus musculus
cttctaagccagttccttccacaca

SEQ ID NO: 922533 - DNA, 25 bp, Mus musculus
cttctaatcctaaaactccacagtt

SEQ ID NO: 922534 - DNA, 25 bp, Mus musculus
cttctaatcctaaatctccacagtt

SEQ ID NO: 922535 - DNA, 25 bp, Mus musculus
cttctacatcctcgtgtttgtggta

SEQ ID NO: 922536 - DNA, 25 bp, Mus musculus
cttctacatcctggtgtttgtggta

SEQ ID NO: 922537 - DNA, 25 bp, Mus musculus
cttctaccagctcagtcatttccta

SEQ ID NO: 922538 - DNA, 25 bp, Mus musculus
cttctaccagctgagtcatttccta

SEQ ID NO: 922539 - DNA, 25 bp, Mus musculus
cttctaccccacataatatttcttg

SEQ ID NO: 922540 - DNA, 25 bp, Mus musculus
cttctaccccacttaatatttcttg

SEQ ID NO: 922541 - DNA, 25 bp, Mus musculus
cttctaccccagagctgtgatctca

SEQ ID NO: 922542 - DNA, 25 bp, Mus musculus
cttctaccccagtgctgtgatctca

SEQ ID NO: 922543 - DNA, 25 bp, Mus musculus
cttctacctgaacacggacccagaa

SEQ ID NO: 922544 - DNA, 25 bp, Mus musculus
cttctacctgaacagggacccagaa

SEQ ID NO: 922545 - DNA, 25 bp, Mus musculus
cttctagaactacgagccagtgttg

SEQ ID NO: 922546 - DNA, 25 bp, Mus musculus
cttctagaactaggagccagtgttg

SEQ ID NO: 922547 - DNA, 25 bp, Mus musculus
cttctagacaagccaggttcaccgg

SEQ ID NO: 922548 - DNA, 25 bp, Mus musculus
cttctagacaaggcaggttcaccgg

SEQ ID NO: 922549 - DNA, 25 bp, Mus musculus
cttctagacccacgagttttgctct

SEQ ID NO: 922550 - DNA, 25 bp, Mus musculus
cttctagacccaggagttttgctct

SEQ ID NO: 922551 - DNA, 25 bp, Mus musculus
cttctagactttgacgaggaagaag

SEQ ID NO: 922552 - DNA, 25 bp, Mus musculus
cttctagactttgaggaggaagaag

SEQ ID NO: 922553 - DNA, 25 bp, Mus musculus
cttctagatgagatcaccgaagtgg

SEQ ID NO: 922554 - DNA, 25 bp, Mus musculus
cttctagatgagttcaccgaagtgg

SEQ ID NO: 922555 - DNA, 25 bp, Mus musculus
cttctagcagccctgcctactttgg

SEQ ID NO: 922556 - DNA, 25 bp, Mus musculus
cttctagcaggcctgcctactttgg

SEQ ID NO: 922557 - DNA, 25 bp, Mus musculus
cttctaggcaacaacgccgatgtaa

SEQ ID NO: 922558 - DNA, 25 bp, Mus musculus
cttctaggcaacaaggccgatgtaa

SEQ ID NO: 922559 - DNA, 25 bp, Mus musculus
cttctataaaatacaaggagtgctg

SEQ ID NO: 922560 - DNA, 25 bp, Mus musculus
cttctataaattacaaggagtgctg

SEQ ID NO: 922561 - DNA, 25 bp, Mus musculus
cttctatattcacacataccggaaa

SEQ ID NO: 922562 - DNA, 25 bp, Mus musculus
cttctatattcagacataccggaaa

SEQ ID NO: 922563 - DNA, 25 bp, Mus musculus
cttctatcaaagctgttcctgagca

SEQ ID NO: 922564 - DNA, 25 bp, Mus musculus
cttctatcaaaggtgttcctgagca

SEQ ID NO: 922565 - DNA, 25 bp, Mus musculus
cttctatcacaactattttaattac

SEQ ID NO: 922566 - DNA, 25 bp, Mus musculus
cttctatcacaagtattttaattac

SEQ ID NO: 922567 - DNA, 25 bp, Mus musculus
cttctatgagcaatttgacatccat

SEQ ID NO: 922568 - DNA, 25 bp, Mus musculus
cttctatgaggaatttgacatccat

SEQ ID NO: 922569 - DNA, 25 bp, Mus musculus
cttctatgtcatcgtggggtttttt

SEQ ID NO: 922570 - DNA, 25 bp, Mus musculus
cttctatgtcatggtggggtttttt

SEQ ID NO: 922571 - DNA, 25 bp, Mus musculus
cttctattcccacatctgtggggaa

SEQ ID NO: 922572 - DNA, 25 bp, Mus musculus
cttctattcccagatctgtggggaa

SEQ ID NO: 922573 - DNA, 25 bp, Mus musculus
cttctatttctgcgttctgccagaa

SEQ ID NO: 922574 - DNA, 25 bp, Mus musculus
cttctatttctgggttctgccagaa

SEQ ID NO: 922575 - DNA, 25 bp, Mus musculus
cttctcaatgagaaattcagcaact

SEQ ID NO: 922576 - DNA, 25 bp, Mus musculus
cttctcaatgtgaaattcagcaact

SEQ ID NO: 922577 - DNA, 25 bp, Mus musculus
cttctcacagccacagcggaagcag

SEQ ID NO: 922578 - DNA, 25 bp, Mus musculus
cttctcacaggcacagcggaagcag

SEQ ID NO: 922579 - DNA, 25 bp, Mus musculus
cttctcagcattagccctggttccc

SEQ ID NO: 922580 - DNA, 25 bp, Mus musculus
cttctcagcatttgccctggttccc

SEQ ID NO: 922581 - DNA, 25 bp, Mus musculus
cttctcagcgcacgttgtgacaatg

SEQ ID NO: 922582 - DNA, 25 bp, Mus musculus
cttctcagcgcaggttgtgacaatg

SEQ ID NO: 922583 - DNA, 25 bp, Mus musculus
cttctcagtgaagactcacatactc

SEQ ID NO: 922584 - DNA, 25 bp, Mus musculus
cttctcagtgaagagtcacatactc

SEQ ID NO: 922585 - DNA, 25 bp, Mus musculus
cttctcagtgcacgttgtgacaatg

SEQ ID NO: 922586 - DNA, 25 bp, Mus musculus
cttctcagtgcaggttgtgacaatg

SEQ ID NO: 922587 - DNA, 25 bp, Mus musculus
cttctcatcccacgagaaaagcccg

SEQ ID NO: 922588 - DNA, 25 bp, Mus musculus
cttctcatcccaggagaaaagcccg

SEQ ID NO: 922589 - DNA, 25 bp, Mus musculus
cttctcatccgctgagacccatgcg

SEQ ID NO: 922590 - DNA, 25 bp, Mus musculus
cttctcatccgctgagatgctggtg

SEQ ID NO: 922591 - DNA, 25 bp, Mus musculus
cttctcatccgctgtgacccatgcg

SEQ ID NO: 922592 - DNA, 25 bp, Mus musculus
cttctcatccgctgtgatgctggtg

SEQ ID NO: 922593 - DNA, 25 bp, Mus musculus
cttctcatcgaaccctttctgggtg

SEQ ID NO: 922594 - DNA, 25 bp, Mus musculus
cttctcatcgaagcctttctgggtg

SEQ ID NO: 922595 - DNA, 25 bp, Mus musculus
cttctccacctccactggtgtcttc

SEQ ID NO: 922596 - DNA, 25 bp, Mus musculus
cttctccacctccagtggtgtcttc

SEQ ID NO: 922597 - DNA, 25 bp, Mus musculus
cttctccacgatctaccacgcctgt

SEQ ID NO: 922598 - DNA, 25 bp, Mus musculus
cttctccacgctactacttgtcctc

SEQ ID NO: 922599 - DNA, 25 bp, Mus musculus
cttctccacggtactacttgtcctc

SEQ ID NO: 922600 - DNA, 25 bp, Mus musculus
cttctccacgttctaccacgcctgt

SEQ ID NO: 922601 - DNA, 25 bp, Mus musculus
cttctccagcagcaagagccagagg

SEQ ID NO: 922602 - DNA, 25 bp, Mus musculus
cttctccagcagcacccaacctcct

SEQ ID NO: 922603 - DNA, 25 bp, Mus musculus
cttctccagcaggaagagccagagg

SEQ ID NO: 922604 - DNA, 25 bp, Mus musculus
cttctccagcaggacccaacctcct

SEQ ID NO: 922605 - DNA, 25 bp, Mus musculus
cttctccatcagaatccaagagaaa

SEQ ID NO: 922606 - DNA, 25 bp, Mus musculus
cttctccatcagcgcatccagagac

SEQ ID NO: 922607 - DNA, 25 bp, Mus musculus
cttctccatcagggcatccagagac

SEQ ID NO: 922608 - DNA, 25 bp, Mus musculus
cttctccatcagtatccaagagaaa

SEQ ID NO: 922609 - DNA, 25 bp, Mus musculus
cttctccatgcacacccgctatgac

SEQ ID NO: 922610 - DNA, 25 bp, Mus musculus
cttctccatgcagacccgctatgac

SEQ ID NO: 922611 - DNA, 25 bp, Mus musculus
cttctcccaccgagatatgaatcaa

SEQ ID NO: 922612 - DNA, 25 bp, Mus musculus
cttctcccaccgtgatatgaatcaa

SEQ ID NO: 922613 - DNA, 25 bp, Mus musculus
cttctcccagattacctccctagtg

SEQ ID NO: 922614 - DNA, 25 bp, Mus musculus
cttctcccagcagatgagctgtatg

SEQ ID NO: 922615 - DNA, 25 bp, Mus musculus
cttctcccagccaccaggtgcagcc

SEQ ID NO: 922616 - DNA, 25 bp, Mus musculus
cttctcccagctgccgtggagtctc

SEQ ID NO: 922617 - DNA, 25 bp, Mus musculus
cttctcccaggagatgagctgtatg

SEQ ID NO: 922618 - DNA, 25 bp, Mus musculus
cttctcccaggcaccaggtgcagcc

SEQ ID NO: 922619 - DNA, 25 bp, Mus musculus
cttctcccaggtgccgtggagtctc

SEQ ID NO: 922620 - DNA, 25 bp, Mus musculus
cttctcccagtttacctccctagtg

SEQ ID NO: 922621 - DNA, 25 bp, Mus musculus
cttctccccgagattctgaagtatg

SEQ ID NO: 922622 - DNA, 25 bp, Mus musculus
cttctccccgagtttctgaagtatg

SEQ ID NO: 922623 - DNA, 25 bp, Mus musculus
cttctccctgcatttgagctcatgg

SEQ ID NO: 922624 - DNA, 25 bp, Mus musculus
cttctccctggatttgagctcatgg

SEQ ID NO: 922625 - DNA, 25 bp, Mus musculus
cttctccgagagagcaatcaactat

SEQ ID NO: 922626 - DNA, 25 bp, Mus musculus
cttctccgagagtgcaatcaactat

SEQ ID NO: 922627 - DNA, 25 bp, Mus musculus
cttctccggctgccccaccttggga

SEQ ID NO: 922628 - DNA, 25 bp, Mus musculus
cttctccggctggcccaccttggga

SEQ ID NO: 922629 - DNA, 25 bp, Mus musculus
cttctcctcactgtttacaaaatat

SEQ ID NO: 922630 - DNA, 25 bp, Mus musculus
cttctcctcagtgtttacaaaatat

SEQ ID NO: 922631 - DNA, 25 bp, Mus musculus
cttctcctccagctaaaccggacag

SEQ ID NO: 922632 - DNA, 25 bp, Mus musculus
cttctcctccaggtaaaccggacag

SEQ ID NO: 922633 - DNA, 25 bp, Mus musculus
cttctcctggacgtgcgaccgcatt

SEQ ID NO: 922634 - DNA, 25 bp, Mus musculus
cttctcctggagcaatgtggcctgc

SEQ ID NO: 922635 - DNA, 25 bp, Mus musculus
cttctcctggaggaatgtggcctgc

SEQ ID NO: 922636 - DNA, 25 bp, Mus musculus
cttctcctggcaacgatatccctgg

SEQ ID NO: 922637 - DNA, 25 bp, Mus musculus
cttctcctggcccaccaaccttccc

SEQ ID NO: 922638 - DNA, 25 bp, Mus musculus
cttctcctggcccaccaagcttccc

SEQ ID NO: 922639 - DNA, 25 bp, Mus musculus
cttctcctggcccaccttccctggc

SEQ ID NO: 922640 - DNA, 25 bp, Mus musculus
cttctcctggcccagcaaccttccc

SEQ ID NO: 922641 - DNA, 25 bp, Mus musculus
cttctcctggcccagcaagcttccc

SEQ ID NO: 922642 - DNA, 25 bp, Mus musculus
cttctcctggcccagcttccctggc

SEQ ID NO: 922643 - DNA, 25 bp, Mus musculus
cttctcctgggaacgatatccctgg

SEQ ID NO: 922644 - DNA, 25 bp, Mus musculus
cttctcctggtcgtgcgaccgcatt

SEQ ID NO: 922645 - DNA, 25 bp, Mus musculus
cttctcggactcatcttctctgcgg

SEQ ID NO: 922646 - DNA, 25 bp, Mus musculus
cttctcggactcttcttctctgcgg

SEQ ID NO: 922647 - DNA, 25 bp, Mus musculus
cttctcggagcgtctgccagtgatg

SEQ ID NO: 922648 - DNA, 25 bp, Mus musculus
cttctcggagggtctgccagtgatg

SEQ ID NO: 922649 - DNA, 25 bp, Mus musculus
cttctcggatgccaccggctgagct

SEQ ID NO: 922650 - DNA, 25 bp, Mus musculus
cttctcggatgccagcggctgagct

SEQ ID NO: 922651 - DNA, 25 bp, Mus musculus
cttctctcactgatgattccttcag

SEQ ID NO: 922652 - DNA, 25 bp, Mus musculus
cttctctcactgttgattccttcag

SEQ ID NO: 922653 - DNA, 25 bp, Mus musculus
cttctctccgtgcaacctgacgacc

SEQ ID NO: 922654 - DNA, 25 bp, Mus musculus
cttctctccgtggaacctgacgacc

SEQ ID NO: 922655 - DNA, 25 bp, Mus musculus
cttctgacaaacaacacagtaatgg

SEQ ID NO: 922656 - DNA, 25 bp, Mus musculus
cttctgacaaacaagacagtaatgg

SEQ ID NO: 922657 - DNA, 25 bp, Mus musculus
cttctgacaatgcaatcccgcctat

SEQ ID NO: 922658 - DNA, 25 bp, Mus musculus
cttctgacaatggaatcccgcctat

SEQ ID NO: 922659 - DNA, 25 bp, Mus musculus
cttctgaccaccaccgcatcacggc

SEQ ID NO: 922660 - DNA, 25 bp, Mus musculus
cttctgaccaccacggcatcacggc

SEQ ID NO: 922661 - DNA, 25 bp, Mus musculus
cttctgacccagactaccttgtagc

SEQ ID NO: 922662 - DNA, 25 bp, Mus musculus
cttctgacccagtctaccttgtagc

SEQ ID NO: 922663 - DNA, 25 bp, Mus musculus
cttctgagtaaacgtgaacgacgac

SEQ ID NO: 922664 - DNA, 25 bp, Mus musculus
cttctgagtaaaggtgaacgacgac

SEQ ID NO: 922665 - DNA, 25 bp, Mus musculus
cttctgagtcaacagcttggattct

SEQ ID NO: 922666 - DNA, 25 bp, Mus musculus
cttctgagtcaagagcttggattct

SEQ ID NO: 922667 - DNA, 25 bp, Mus musculus
cttctgagtcagcccacatactccc

SEQ ID NO: 922668 - DNA, 25 bp, Mus musculus
cttctgagtcaggccacatactccc

SEQ ID NO: 922669 - DNA, 25 bp, Mus musculus
cttctgatatgacgacccatcctct

SEQ ID NO: 922670 - DNA, 25 bp, Mus musculus
cttctgatatgaggacccatcctct

SEQ ID NO: 922671 - DNA, 25 bp, Mus musculus
cttctgattctccccgagctgcttg

SEQ ID NO: 922672 - DNA, 25 bp, Mus musculus
cttctgattctcgccgagctgcttg

SEQ ID NO: 922673 - DNA, 25 bp, Mus musculus
cttctgcaaccacatcttcattaac

SEQ ID NO: 922674 - DNA, 25 bp, Mus musculus
cttctgcaaccagatcttcattaac

SEQ ID NO: 922675 - DNA, 25 bp, Mus musculus
cttctgcactcacgaagtagagccc

SEQ ID NO: 922676 - DNA, 25 bp, Mus musculus
cttctgcactcaggaagtagagccc

SEQ ID NO: 922677 - DNA, 25 bp, Mus musculus
cttctgcagcaaatctcccggaaat

SEQ ID NO: 922678 - DNA, 25 bp, Mus musculus
cttctgcagctaatctcccggaaat

SEQ ID NO: 922679 - DNA, 25 bp, Mus musculus
cttctgcaggatgtcattgcaacgg

SEQ ID NO: 922680 - DNA, 25 bp, Mus musculus
cttctgcaggttgtcattgcaacgg

SEQ ID NO: 922681 - DNA, 25 bp, Mus musculus
cttctgcatcaaagtgttgtctgag

SEQ ID NO: 922682 - DNA, 25 bp, Mus musculus
cttctgcatcaatgtgttgtctgag

SEQ ID NO: 922683 - DNA, 25 bp, Mus musculus
cttctgccaacaatgacgggatttc

SEQ ID NO: 922684 - DNA, 25 bp, Mus musculus
cttctgccaacattgacgggatttc

SEQ ID NO: 922685 - DNA, 25 bp, Mus musculus
cttctgccagttcaactttatccac

SEQ ID NO: 922686 - DNA, 25 bp, Mus musculus
cttctgccagttcatctttatccac

SEQ ID NO: 922687 - DNA, 25 bp, Mus musculus
cttctgccatacccgcaaaacagct

SEQ ID NO: 922688 - DNA, 25 bp, Mus musculus
cttctgccattcccgcaaaacagct

SEQ ID NO: 922689 - DNA, 25 bp, Mus musculus
cttctgccgaatcacaggaggtcct

SEQ ID NO: 922690 - DNA, 25 bp, Mus musculus
cttctgccgaatcagaggaggtcct

SEQ ID NO: 922691 - DNA, 25 bp, Mus musculus
cttctgcctgacagtgaagatgaag

SEQ ID NO: 922692 - DNA, 25 bp, Mus musculus
cttctgcctgcagacagtgaagatg

SEQ ID NO: 922693 - DNA, 25 bp, Mus musculus
cttctgcctggagacagtgaagatg

SEQ ID NO: 922694 - DNA, 25 bp, Mus musculus
cttctgcctgtcagtgaagatgaag

SEQ ID NO: 922695 - DNA, 25 bp, Mus musculus
cttctgctcccctccccattcacac

SEQ ID NO: 922696 - DNA, 25 bp, Mus musculus
cttctgctccgctccccattcacac

SEQ ID NO: 922697 - DNA, 25 bp, Mus musculus
cttctggaccaacctatagaggacc

SEQ ID NO: 922698 - DNA, 25 bp, Mus musculus
cttctggaccaagctatagaggacc

SEQ ID NO: 922699 - DNA, 25 bp, Mus musculus
cttctggagtgtggcaaaatccacc

SEQ ID NO: 922700 - DNA, 25 bp, Mus musculus
cttctggagtgtgggaaaatccacc

SEQ ID NO: 922701 - DNA, 25 bp, Mus musculus
cttctggatgaccacgtggcgctgc

SEQ ID NO: 922702 - DNA, 25 bp, Mus musculus
cttctggatgaccaggtggcgctgc

SEQ ID NO: 922703 - DNA, 25 bp, Mus musculus
cttctggcagcgtccctgcatgtgg

SEQ ID NO: 922704 - DNA, 25 bp, Mus musculus
cttctggcagggtccctgcatgtgg

SEQ ID NO: 922705 - DNA, 25 bp, Mus musculus
cttctggcctcccatggtgacatta

SEQ ID NO: 922706 - DNA, 25 bp, Mus musculus
cttctggcctccgatggtgacatta

SEQ ID NO: 922707 - DNA, 25 bp, Mus musculus
cttctggctcacagagaaggacttg

SEQ ID NO: 922708 - DNA, 25 bp, Mus musculus
cttctggctcactgagaaggacttg

SEQ ID NO: 922709 - DNA, 25 bp, Mus musculus
cttctgggccatcggccgggagggt

SEQ ID NO: 922710 - DNA, 25 bp, Mus musculus
cttctgggccatgggccgggagggt

SEQ ID NO: 922711 - DNA, 25 bp, Mus musculus
cttctggggtggaaaagcggagact

SEQ ID NO: 922712 - DNA, 25 bp, Mus musculus
cttctggggtggaatagcggagact

SEQ ID NO: 922713 - DNA, 25 bp, Mus musculus
cttctggtgccacctctaggaatga

SEQ ID NO: 922714 - DNA, 25 bp, Mus musculus
cttctggtgccagctctaggaatga

SEQ ID NO: 922715 - DNA, 25 bp, Mus musculus
cttctggtgtagcgaaagaccacac

SEQ ID NO: 922716 - DNA, 25 bp, Mus musculus
cttctggtgtagggaaagaccacac

SEQ ID NO: 922717 - DNA, 25 bp, Mus musculus
cttctggttgagcaacaaaatcttg

SEQ ID NO: 922718 - DNA, 25 bp, Mus musculus
cttctggttgagcatcaaaatcttg

SEQ ID NO: 922719 - DNA, 25 bp, Mus musculus
cttctgtcagtgaccccatgaatgc

SEQ ID NO: 922720 - DNA, 25 bp, Mus musculus
cttctgtcagtgtccccatgaatgc

SEQ ID NO: 922721 - DNA, 25 bp, Mus musculus
cttctgtgagctgagtgtagtacaa

SEQ ID NO: 922722 - DNA, 25 bp, Mus musculus
cttctgtgaggtgagtgtagtacaa

SEQ ID NO: 922723 - DNA, 25 bp, Mus musculus
cttctgtggcaacaccaagatgaag

SEQ ID NO: 922724 - DNA, 25 bp, Mus musculus
cttctgtggcaagaccaagatgaag

SEQ ID NO: 922725 - DNA, 25 bp, Mus musculus
cttctgttagctgctggagagtcag

SEQ ID NO: 922726 - DNA, 25 bp, Mus musculus
cttctgttaggtgctggagagtcag

SEQ ID NO: 922727 - DNA, 25 bp, Mus musculus
cttctgttggagataccttcctatc

SEQ ID NO: 922728 - DNA, 25 bp, Mus musculus
cttctgttggagttaccttcctatc

SEQ ID NO: 922729 - DNA, 25 bp, Mus musculus
cttctgtttccgcgtgccatgcaga

SEQ ID NO: 922730 - DNA, 25 bp, Mus musculus
cttctgtttccgggtgccatgcaga

SEQ ID NO: 922731 - DNA, 25 bp, Mus musculus
cttcttactgagtcctactgaaacc

SEQ ID NO: 922732 - DNA, 25 bp, Mus musculus
cttcttactgtgtcctactgaaacc

SEQ ID NO: 922733 - DNA, 25 bp, Mus musculus
cttcttagtcaacggtctcatgtac

SEQ ID NO: 922734 - DNA, 25 bp, Mus musculus
cttcttagtcaacgttggcttcctg

SEQ ID NO: 922735 - DNA, 25 bp, Mus musculus
cttcttagtcaagggtctcatgtac

SEQ ID NO: 922736 - DNA, 25 bp, Mus musculus
cttcttagtcaaggttggcttcctg

SEQ ID NO: 922737 - DNA, 25 bp, Mus musculus
cttcttatggctaccatcggttctt

SEQ ID NO: 922738 - DNA, 25 bp, Mus musculus
cttcttatgggtaccatcggttctt

SEQ ID NO: 922739 - DNA, 25 bp, Mus musculus
cttcttcaagaaaggtacactgtgg

SEQ ID NO: 922740 - DNA, 25 bp, Mus musculus
cttcttcaagtaaggtacactgtgg

SEQ ID NO: 922741 - DNA, 25 bp, Mus musculus
cttcttcaataaacctactgaactt

SEQ ID NO: 922742 - DNA, 25 bp, Mus musculus
cttcttcaataagcaacctactgaa

SEQ ID NO: 922743 - DNA, 25 bp, Mus musculus
cttcttcaataagctacctactgaa

SEQ ID NO: 922744 - DNA, 25 bp, Mus musculus
cttcttcaataatcctactgaactt

SEQ ID NO: 922745 - DNA, 25 bp, Mus musculus
cttcttcacctttgctgtcctgtgc

SEQ ID NO: 922746 - DNA, 25 bp, Mus musculus
cttcttcacctttggtgtcctgtgc

SEQ ID NO: 922747 - DNA, 25 bp, Mus musculus
cttcttcacgctgccttggagcact

SEQ ID NO: 922748 - DNA, 25 bp, Mus musculus
cttcttcacggtgccttggagcact

SEQ ID NO: 922749 - DNA, 25 bp, Mus musculus
cttcttcagaatcgtgcagatcccc

SEQ ID NO: 922750 - DNA, 25 bp, Mus musculus
cttcttcagaatggtgcagatcccc

SEQ ID NO: 922751 - DNA, 25 bp, Mus musculus
cttcttcagacctctgcagtcctgt

SEQ ID NO: 922752 - DNA, 25 bp, Mus musculus
cttcttcagagctctgcagtcctgt

SEQ ID NO: 922753 - DNA, 25 bp, Mus musculus
cttcttcatgcatgaggatgaagaa

SEQ ID NO: 922754 - DNA, 25 bp, Mus musculus
cttcttcatggatgaggatgaagaa

SEQ ID NO: 922755 - DNA, 25 bp, Mus musculus
cttcttccagcccttcatgtcacca

SEQ ID NO: 922756 - DNA, 25 bp, Mus musculus
cttcttccagcgtctggactgggtg

SEQ ID NO: 922757 - DNA, 25 bp, Mus musculus
cttcttccaggccttcatgtcacca

SEQ ID NO: 922758 - DNA, 25 bp, Mus musculus
cttcttccagggtctggactgggtg

SEQ ID NO: 922759 - DNA, 25 bp, Mus musculus
cttcttccatgaacttctccatgat

SEQ ID NO: 922760 - DNA, 25 bp, Mus musculus
cttcttccatgatcttctccatgat

SEQ ID NO: 922761 - DNA, 25 bp, Mus musculus
cttcttcctgcgcgacatcaccatg

SEQ ID NO: 922762 - DNA, 25 bp, Mus musculus
cttcttcctgcgggacatcaccatg

SEQ ID NO: 922763 - DNA, 25 bp, Mus musculus
cttcttcgaaaaaatgttttggcca

SEQ ID NO: 922764 - DNA, 25 bp, Mus musculus
cttcttcgaaaatatgttttggcca

SEQ ID NO: 922765 - DNA, 25 bp, Mus musculus
cttcttctatttctcggttctgcca

SEQ ID NO: 922766 - DNA, 25 bp, Mus musculus
cttcttctatttctgggttctgcca

SEQ ID NO: 922767 - DNA, 25 bp, Mus musculus
cttcttctccatcacaatccaagag

SEQ ID NO: 922768 - DNA, 25 bp, Mus musculus
cttcttctccatcagaatccaagag

SEQ ID NO: 922769 - DNA, 25 bp, Mus musculus
cttcttctcccacccagatatgaat

SEQ ID NO: 922770 - DNA, 25 bp, Mus musculus
cttcttctcccaccgagatatgaat

SEQ ID NO: 922771 - DNA, 25 bp, Mus musculus
cttcttgcagcgggaataccagcca

SEQ ID NO: 922772 - DNA, 25 bp, Mus musculus
cttcttgcagggggaataccagcca

SEQ ID NO: 922773 - DNA, 25 bp, Mus musculus
cttcttggccagactgaacacttgc

SEQ ID NO: 922774 - DNA, 25 bp, Mus musculus
cttcttggccagtctgaacacttgc

SEQ ID NO: 922775 - DNA, 25 bp, Mus musculus
cttcttgggtcacatcatggtcttc

SEQ ID NO: 922776 - DNA, 25 bp, Mus musculus
cttcttgggtcagatcatggtcttc

SEQ ID NO: 922777 - DNA, 25 bp, Mus musculus
cttctttaatgcattttacagtgtg

SEQ ID NO: 922778 - DNA, 25 bp, Mus musculus
cttctttaatgctttttacagtgtg

SEQ ID NO: 922779 - DNA, 25 bp, Mus musculus
cttctttcctggagtaggtgacatg

SEQ ID NO: 922780 - DNA, 25 bp, Mus musculus
cttctttcctggtgtaggtgacatg

SEQ ID NO: 922781 - DNA, 25 bp, Mus musculus
cttctttgaaccttaggtcagaaag

SEQ ID NO: 922782 - DNA, 25 bp, Mus musculus
cttctttgaacctttggtcagaaag

SEQ ID NO: 922783 - DNA, 25 bp, Mus musculus
cttctttggggatgcccctgcctcc

SEQ ID NO: 922784 - DNA, 25 bp, Mus musculus
cttctttggggatggccctgcctcc

SEQ ID NO: 922785 - DNA, 25 bp, Mus musculus
cttctttgtgagcagtgatgcatcc

SEQ ID NO: 922786 - DNA, 25 bp, Mus musculus
cttctttgtgaggagtgatgcatcc

SEQ ID NO: 922787 - DNA, 25 bp, Mus musculus
cttctttgtgtgcccttcaccacgt

SEQ ID NO: 922788 - DNA, 25 bp, Mus musculus
cttctttgtgtggccttcaccacgt

SEQ ID NO: 922789 - DNA, 25 bp, Mus musculus
cttcttttcacaatgctcatgatct

SEQ ID NO: 922790 - DNA, 25 bp, Mus musculus
cttcttttcacattgctcatgatct

SEQ ID NO: 922791 - DNA, 25 bp, Mus musculus
cttcttttctatcatccagaacatt

SEQ ID NO: 922792 - DNA, 25 bp, Mus musculus
cttcttttctttcatccagaacatt

SEQ ID NO: 922793 - DNA, 25 bp, Mus musculus
cttgaaaaacagatagaagaagtga

SEQ ID NO: 922794 - DNA, 25 bp, Mus musculus
cttgaaaaacagttagaagaagtga

SEQ ID NO: 922795 - DNA, 25 bp, Mus musculus
cttgaaatcttacagattgatgacc

SEQ ID NO: 922796 - DNA, 25 bp, Mus musculus
cttgaaatcttagagattgatgacc

SEQ ID NO: 922797 - DNA, 25 bp, Mus musculus
cttgaacaagtcaacttactggcag

SEQ ID NO: 922798 - DNA, 25 bp, Mus musculus
cttgaacaagtcaagttactggcag

SEQ ID NO: 922799 - DNA, 25 bp, Mus musculus
cttgaacagctccacatgcgtcggg

SEQ ID NO: 922800 - DNA, 25 bp, Mus musculus
cttgaacagctcgacatgcgtcggg

SEQ ID NO: 922801 - DNA, 25 bp, Mus musculus
cttgaacattgacgcactgcagtgt

SEQ ID NO: 922802 - DNA, 25 bp, Mus musculus
cttgaacattgaggcactgcagtgt

SEQ ID NO: 922803 - DNA, 25 bp, Mus musculus
cttgaaccagaatgtctgtaaggca

SEQ ID NO: 922804 - DNA, 25 bp, Mus musculus
cttgaaccagtatgtctgtaaggca

SEQ ID NO: 922805 - DNA, 25 bp, Mus musculus
cttgaaccccagagtgcctactcca

SEQ ID NO: 922806 - DNA, 25 bp, Mus musculus
cttgaaccccagtgtgcctactcca

SEQ ID NO: 922807 - DNA, 25 bp, Mus musculus
cttgaagaaatgcagcgccttatgg

SEQ ID NO: 922808 - DNA, 25 bp, Mus musculus
cttgaagaaatggagcgccttatgg

SEQ ID NO: 922809 - DNA, 25 bp, Mus musculus
cttgaagaaccaccgtgccaagtta

SEQ ID NO: 922810 - DNA, 25 bp, Mus musculus
cttgaagaaccagcgtgccaagtta

SEQ ID NO: 922811 - DNA, 25 bp, Mus musculus
cttgaagagctaagtgaagacccca

SEQ ID NO: 922812 - DNA, 25 bp, Mus musculus
cttgaagagctatgtgaagacccca

SEQ ID NO: 922813 - DNA, 25 bp, Mus musculus
cttgaagcaaataaaaggaaacaga

SEQ ID NO: 922814 - DNA, 25 bp, Mus musculus
cttgaagcaaataataggaaacaga

SEQ ID NO: 922815 - DNA, 25 bp, Mus musculus
cttgaagcagctggactcccctaac

SEQ ID NO: 922816 - DNA, 25 bp, Mus musculus
cttgaagcaggtggactcccctaac

SEQ ID NO: 922817 - DNA, 25 bp, Mus musculus
cttgaagcctactctgttagaagga

SEQ ID NO: 922818 - DNA, 25 bp, Mus musculus
cttgaagccttctctgttagaagga

SEQ ID NO: 922819 - DNA, 25 bp, Mus musculus
cttgaaggcccacgcggatatctac

SEQ ID NO: 922820 - DNA, 25 bp, Mus musculus
cttgaaggcccaggcggatatctac

SEQ ID NO: 922821 - DNA, 25 bp, Mus musculus
cttgaatcagagaaaccattcgcaa

SEQ ID NO: 922822 - DNA, 25 bp, Mus musculus
cttgaatcagtgaaaccattcgcaa

SEQ ID NO: 922823 - DNA, 25 bp, Mus musculus
cttgaatctgaacaggtagaagatg

SEQ ID NO: 922824 - DNA, 25 bp, Mus musculus
cttgaatctgaagaggtagaagatg

SEQ ID NO: 922825 - DNA, 25 bp, Mus musculus
cttgaattccagcatgagaacagca

SEQ ID NO: 922826 - DNA, 25 bp, Mus musculus
cttgaattccaggatgagaacagca

SEQ ID NO: 922827 - DNA, 25 bp, Mus musculus
cttgacacttgggacgccatggagg

SEQ ID NO: 922828 - DNA, 25 bp, Mus musculus
cttgacacttgggaggccatggagg

SEQ ID NO: 922829 - DNA, 25 bp, Mus musculus
cttgaccaagatccaggaagacagc

SEQ ID NO: 922830 - DNA, 25 bp, Mus musculus
cttgaccaagttccaggaagacagc

SEQ ID NO: 922831 - DNA, 25 bp, Mus musculus
cttgaccagactcgcgctctccacc

SEQ ID NO: 922832 - DNA, 25 bp, Mus musculus
cttgaccagactggcgctctccacc

SEQ ID NO: 922833 - DNA, 25 bp, Mus musculus
cttgaccattacagcaactcaacag

SEQ ID NO: 922834 - DNA, 25 bp, Mus musculus
cttgaccattacaggaactcaacag

SEQ ID NO: 922835 - DNA, 25 bp, Mus musculus
cttgacccatggagccagtttggtt

SEQ ID NO: 922836 - DNA, 25 bp, Mus musculus
cttgacccatggtgccagtttggtt

SEQ ID NO: 922837 - DNA, 25 bp, Mus musculus
cttgacctggccaacaaccgcctct

SEQ ID NO: 922838 - DNA, 25 bp, Mus musculus
cttgacctggccaagaaccgcctct

SEQ ID NO: 922839 - DNA, 25 bp, Mus musculus
cttgacgtcgtgcaacgatctccgc

SEQ ID NO: 922840 - DNA, 25 bp, Mus musculus
cttgacgtcgtggaacgatctccgc

SEQ ID NO: 922841 - DNA, 25 bp, Mus musculus
cttgactacatgcccacctggaaca

SEQ ID NO: 922842 - DNA, 25 bp, Mus musculus
cttgactacatggccacctggaaca

SEQ ID NO: 922843 - DNA, 25 bp, Mus musculus
cttgactcggaggaagacgatgatc

SEQ ID NO: 922844 - DNA, 25 bp, Mus musculus
cttgactcggaggacaccatgatta

SEQ ID NO: 922845 - DNA, 25 bp, Mus musculus
cttgactcggtggaagacgatgatc

SEQ ID NO: 922846 - DNA, 25 bp, Mus musculus
cttgactcggtggacaccatgatta

SEQ ID NO: 922847 - DNA, 25 bp, Mus musculus
cttgacttacaacgagtgggagaaa

SEQ ID NO: 922848 - DNA, 25 bp, Mus musculus
cttgacttacaaggagtgggagaaa

SEQ ID NO: 922849 - DNA, 25 bp, Mus musculus
cttgactttgaacgttgtcttgaca

SEQ ID NO: 922850 - DNA, 25 bp, Mus musculus
cttgactttgaaggttgtcttgaca

SEQ ID NO: 922851 - DNA, 25 bp, Mus musculus
cttgagaaaaaccatggtgaatccg

SEQ ID NO: 922852 - DNA, 25 bp, Mus musculus
cttgagaaaatccatggtgaatccg

SEQ ID NO: 922853 - DNA, 25 bp, Mus musculus
cttgagaaagctggggatccaaagc

SEQ ID NO: 922854 - DNA, 25 bp, Mus musculus
cttgagaaaggtggggatccaaagc

SEQ ID NO: 922855 - DNA, 25 bp, Mus musculus
cttgagaccatgcttgatgccctct

SEQ ID NO: 922856 - DNA, 25 bp, Mus musculus
cttgagaccatggttgatgccctct

SEQ ID NO: 922857 - DNA, 25 bp, Mus musculus
cttgagagagaacaaattttccacc

SEQ ID NO: 922858 - DNA, 25 bp, Mus musculus
cttgagagagaagaaattttccacc

SEQ ID NO: 922859 - DNA, 25 bp, Mus musculus
cttgagagctatggatatacaaccg

SEQ ID NO: 922860 - DNA, 25 bp, Mus musculus
cttgagagctttggatatacaaccg

SEQ ID NO: 922861 - DNA, 25 bp, Mus musculus
cttgagagtctaacaccactacttt

SEQ ID NO: 922862 - DNA, 25 bp, Mus musculus
cttgagagtctatcaccactacttt

SEQ ID NO: 922863 - DNA, 25 bp, Mus musculus
cttgagcagagagacgtctggaagc

SEQ ID NO: 922864 - DNA, 25 bp, Mus musculus
cttgagcagagagaggtctggaagc

SEQ ID NO: 922865 - DNA, 25 bp, Mus musculus
cttgagcaggagaacagtatcgatg

SEQ ID NO: 922866 - DNA, 25 bp, Mus musculus
cttgagcaggagaagagtatcgatg

SEQ ID NO: 922867 - DNA, 25 bp, Mus musculus
cttgagcagggacatggcggtaaat

SEQ ID NO: 922868 - DNA, 25 bp, Mus musculus
cttgagcagggagatggcggtaaat

SEQ ID NO: 922869 - DNA, 25 bp, Mus musculus
cttgaggaacagcaatggtaatgct

SEQ ID NO: 922870 - DNA, 25 bp, Mus musculus
cttgaggaacaggaatggtaatgct

SEQ ID NO: 922871 - DNA, 25 bp, Mus musculus
cttgaggaatctttcggaagaactg

SEQ ID NO: 922872 - DNA, 25 bp, Mus musculus
cttgaggaatctttgggaagaactg

SEQ ID NO: 922873 - DNA, 25 bp, Mus musculus
cttgaggacaatcgttccttggatt

SEQ ID NO: 922874 - DNA, 25 bp, Mus musculus
cttgaggacaatggttccttggatt

SEQ ID NO: 922875 - DNA, 25 bp, Mus musculus
cttgagggagcacaaggacaggcag

SEQ ID NO: 922876 - DNA, 25 bp, Mus musculus
cttgagggagcagaaggacaggcag

SEQ ID NO: 922877 - DNA, 25 bp, Mus musculus
cttgagtgcaagaggcaagtgcagg

SEQ ID NO: 922878 - DNA, 25 bp, Mus musculus
cttgagtgcaagccaccccggctgg

SEQ ID NO: 922879 - DNA, 25 bp, Mus musculus
cttgagtgcaaggcaccccggctgg

SEQ ID NO: 922880 - DNA, 25 bp, Mus musculus
cttgagtgcaagtggcaagtgcagg

SEQ ID NO: 922881 - DNA, 25 bp, Mus musculus
cttgagtgggcactgtcagggcagg

SEQ ID NO: 922882 - DNA, 25 bp, Mus musculus
cttgagtggggactgtcagggcagg

SEQ ID NO: 922883 - DNA, 25 bp, Mus musculus
cttgatagtgagattggcagactca

SEQ ID NO: 922884 - DNA, 25 bp, Mus musculus
cttgatagtgatctttccagaacat

SEQ ID NO: 922885 - DNA, 25 bp, Mus musculus
cttgatagtgtgattggcagactca

SEQ ID NO: 922886 - DNA, 25 bp, Mus musculus
cttgatagtgttctttccagaacat

SEQ ID NO: 922887 - DNA, 25 bp, Mus musculus
cttgatcaaggacgcaggctttccc

SEQ ID NO: 922888 - DNA, 25 bp, Mus musculus
cttgatcaaggaggcaggctttccc

SEQ ID NO: 922889 - DNA, 25 bp, Mus musculus
cttgatcctgaacatgttgctacca

SEQ ID NO: 922890 - DNA, 25 bp, Mus musculus
cttgatcctgaagatgttgctacca

SEQ ID NO: 922891 - DNA, 25 bp, Mus musculus
cttgatcctgacgacggcatccgtt

SEQ ID NO: 922892 - DNA, 25 bp, Mus musculus
cttgatcctgacgagggcatccgtt

SEQ ID NO: 922893 - DNA, 25 bp, Mus musculus
cttgatgaagaacgaaagggagctg

SEQ ID NO: 922894 - DNA, 25 bp, Mus musculus
cttgatgaagaaggaaagggagctg

SEQ ID NO: 922895 - DNA, 25 bp, Mus musculus
cttgatgatacactgcatgtggtga

SEQ ID NO: 922896 - DNA, 25 bp, Mus musculus
cttgatgatacagtgcatgtggtga

SEQ ID NO: 922897 - DNA, 25 bp, Mus musculus
cttgatggaaagcacgtcacctgtc

SEQ ID NO: 922898 - DNA, 25 bp, Mus musculus
cttgatggaaagcaggtcacctgtc

SEQ ID NO: 922899 - DNA, 25 bp, Mus musculus
cttgatggaagaacaggagaagctg

SEQ ID NO: 922900 - DNA, 25 bp, Mus musculus
cttgatggaagaactggagaagctg

SEQ ID NO: 922901 - DNA, 25 bp, Mus musculus
cttgatggagcagagttctcccgcc

SEQ ID NO: 922902 - DNA, 25 bp, Mus musculus
cttgatggaggagagttctcccgcc

SEQ ID NO: 922903 - DNA, 25 bp, Mus musculus
cttgatgtaaaacgaaaagaacata

SEQ ID NO: 922904 - DNA, 25 bp, Mus musculus
cttgatgtaaaaggaaaagaacata

SEQ ID NO: 922905 - DNA, 25 bp, Mus musculus
cttgatgtgacgccgtgtgtggact

SEQ ID NO: 922906 - DNA, 25 bp, Mus musculus
cttgatgtgacgcgtgtgtggactg

SEQ ID NO: 922907 - DNA, 25 bp, Mus musculus
cttgatgtgacggcgtgtgtggact

SEQ ID NO: 922908 - DNA, 25 bp, Mus musculus
cttgatgtgaggcgtgtgtggactg

SEQ ID NO: 922909 - DNA, 25 bp, Mus musculus
cttgattactttaacacagagcaca

SEQ ID NO: 922910 - DNA, 25 bp, Mus musculus
cttgattactttaacagcacaaatt

SEQ ID NO: 922911 - DNA, 25 bp, Mus musculus
cttgattactttaaccacaaattgg

SEQ ID NO: 922912 - DNA, 25 bp, Mus musculus
cttgattactttaagacagagcaca

SEQ ID NO: 922913 - DNA, 25 bp, Mus musculus
cttgattactttaagagcacaaatt

SEQ ID NO: 922914 - DNA, 25 bp, Mus musculus
cttgattactttaagcacaaattgg

SEQ ID NO: 922915 - DNA, 25 bp, Mus musculus
cttgattatgagatcagctttggag

SEQ ID NO: 922916 - DNA, 25 bp, Mus musculus
cttgattatgagttcagctttggag

SEQ ID NO: 922917 - DNA, 25 bp, Mus musculus
cttgattatgatgttccagaagaac

SEQ ID NO: 922918 - DNA, 25 bp, Mus musculus
cttgattatgttgttccagaagaac

SEQ ID NO: 922919 - DNA, 25 bp, Mus musculus
cttgattcagcaccaggtagaccat

SEQ ID NO: 922920 - DNA, 25 bp, Mus musculus
cttgattcaggaccaggtagaccat

SEQ ID NO: 922921 - DNA, 25 bp, Mus musculus
cttgattgagtccgaccctgatgct

SEQ ID NO: 922922 - DNA, 25 bp, Mus musculus
cttgattgagtcggaccctgatgct

SEQ ID NO: 922923 - DNA, 25 bp, Mus musculus
cttgattgttgaagatataattgac

SEQ ID NO: 922924 - DNA, 25 bp, Mus musculus
cttgattgttgatgatataattgac

SEQ ID NO: 922925 - DNA, 25 bp, Mus musculus
cttgcaaaaacacctttcgatgaag

SEQ ID NO: 922926 - DNA, 25 bp, Mus musculus
cttgcaaaaacagctttcgatgaag

SEQ ID NO: 922927 - DNA, 25 bp, Mus musculus
cttgcaaatcatcaggtggcctaga

SEQ ID NO: 922928 - DNA, 25 bp, Mus musculus
cttgcaaatcatgaggtggcctaga

SEQ ID NO: 922929 - DNA, 25 bp, Mus musculus
cttgcaatatgacactgctgtccat

SEQ ID NO: 922930 - DNA, 25 bp, Mus musculus
cttgcaatatgacagtgctgtccat

SEQ ID NO: 922931 - DNA, 25 bp, Mus musculus
cttgcaattggaaacacagtgatgt

SEQ ID NO: 922932 - DNA, 25 bp, Mus musculus
cttgcaattggaaacgtatctggcc

SEQ ID NO: 922933 - DNA, 25 bp, Mus musculus
cttgcaattggaaagacagtgatgt

SEQ ID NO: 922934 - DNA, 25 bp, Mus musculus
cttgcaattggaaaggtatctggcc

SEQ ID NO: 922935 - DNA, 25 bp, Mus musculus
cttgcagcagcgtggtgctccaacc

SEQ ID NO: 922936 - DNA, 25 bp, Mus musculus
cttgcagcagggtggtgctccaacc

SEQ ID NO: 922937 - DNA, 25 bp, Mus musculus
cttgcagccacacgttaggggataa

SEQ ID NO: 922938 - DNA, 25 bp, Mus musculus
cttgcagccactgcaagaaaaatga

SEQ ID NO: 922939 - DNA, 25 bp, Mus musculus
cttgcagccagacgttaggggataa

SEQ ID NO: 922940 - DNA, 25 bp, Mus musculus
cttgcagccagtgcaagaaaaatga

SEQ ID NO: 922941 - DNA, 25 bp, Mus musculus
cttgcagctcaaaacggaaattatc

SEQ ID NO: 922942 - DNA, 25 bp, Mus musculus
cttgcagctcaaaagggaaattatc

SEQ ID NO: 922943 - DNA, 25 bp, Mus musculus
cttgcaggagccacgcatattcaac

SEQ ID NO: 922944 - DNA, 25 bp, Mus musculus
cttgcaggaggcacgcatattcaac

SEQ ID NO: 922945 - DNA, 25 bp, Mus musculus
cttgcataactaaaccttatgaaat

SEQ ID NO: 922946 - DNA, 25 bp, Mus musculus
cttgcataactaaagcttatgaaat

SEQ ID NO: 922947 - DNA, 25 bp, Mus musculus
cttgcatatgtacacgcagaccgaa

SEQ ID NO: 922948 - DNA, 25 bp, Mus musculus
cttgcatatgtacactcccagaagt

SEQ ID NO: 922949 - DNA, 25 bp, Mus musculus
cttgcatatgtacaggcagaccgaa

SEQ ID NO: 922950 - DNA, 25 bp, Mus musculus
cttgcatatgtacagtcccagaagt

SEQ ID NO: 922951 - DNA, 25 bp, Mus musculus
cttgcatgagtgctgtgacggctgt

SEQ ID NO: 922952 - DNA, 25 bp, Mus musculus
cttgcatgagtggtgtgacggctgt

SEQ ID NO: 922953 - DNA, 25 bp, Mus musculus
cttgcattcacactacttgggatgc

SEQ ID NO: 922954 - DNA, 25 bp, Mus musculus
cttgcattcacagtacttgggatgc

SEQ ID NO: 922955 - DNA, 25 bp, Mus musculus
cttgcattggattgccattttcagc

SEQ ID NO: 922956 - DNA, 25 bp, Mus musculus
cttgcattggtttgccattttcagc

SEQ ID NO: 922957 - DNA, 25 bp, Mus musculus
cttgccaaaaagattctgaagcgga

SEQ ID NO: 922958 - DNA, 25 bp, Mus musculus
cttgccaaaaagtttctgaagcgga

SEQ ID NO: 922959 - DNA, 25 bp, Mus musculus
cttgccaacacacggtgtgggcctg

SEQ ID NO: 922960 - DNA, 25 bp, Mus musculus
cttgccaacacagggtgtgggcctg

SEQ ID NO: 922961 - DNA, 25 bp, Mus musculus
cttgccacaacctgaagtgattcac

SEQ ID NO: 922962 - DNA, 25 bp, Mus musculus
cttgccacaagctgaagtgattcac

SEQ ID NO: 922963 - DNA, 25 bp, Mus musculus
cttgccacagcagccgtgtcctcca

SEQ ID NO: 922964 - DNA, 25 bp, Mus musculus
cttgccacagcagcggtgtcctcca

SEQ ID NO: 922965 - DNA, 25 bp, Mus musculus
cttgccacagcattttgcagactct

SEQ ID NO: 922966 - DNA, 25 bp, Mus musculus
cttgccacaggattttgcagactct

SEQ ID NO: 922967 - DNA, 25 bp, Mus musculus
cttgccactggggactggggccatt

SEQ ID NO: 922968 - DNA, 25 bp, Mus musculus
cttgccactggggagtggggccatt

SEQ ID NO: 922969 - DNA, 25 bp, Mus musculus
cttgccagagtcaacatagagtcag

SEQ ID NO: 922970 - DNA, 25 bp, Mus musculus
cttgccagagtcaagatagagtcag

SEQ ID NO: 922971 - DNA, 25 bp, Mus musculus
cttgccattcaacgtggttgaaaag

SEQ ID NO: 922972 - DNA, 25 bp, Mus musculus
cttgccattcaaggtggttgaaaag

SEQ ID NO: 922973 - DNA, 25 bp, Mus musculus
cttgcccaggagctcctgacactgc

SEQ ID NO: 922974 - DNA, 25 bp, Mus musculus
cttgcccaggaggtcctgacactgc

SEQ ID NO: 922975 - DNA, 25 bp, Mus musculus
cttgccgcctatctttctatggcac

SEQ ID NO: 922976 - DNA, 25 bp, Mus musculus
cttgccgcctatgtttctatggcac

SEQ ID NO: 922977 - DNA, 25 bp, Mus musculus
cttgccgcctcctccgagcctgaag

SEQ ID NO: 922978 - DNA, 25 bp, Mus musculus
cttgccgcctcctcggagcctgaag

SEQ ID NO: 922979 - DNA, 25 bp, Mus musculus
cttgccgctcagattttggcagtgc

SEQ ID NO: 922980 - DNA, 25 bp, Mus musculus
cttgccgctcagtttttggcagtgc

SEQ ID NO: 922981 - DNA, 25 bp, Mus musculus
cttgcctcagcgaaaatgggctgga

SEQ ID NO: 922982 - DNA, 25 bp, Mus musculus
cttgcctcagggaaaatgggctgga

SEQ ID NO: 922983 - DNA, 25 bp, Mus musculus
cttgcctctaagaactgtatacacc

SEQ ID NO: 922984 - DNA, 25 bp, Mus musculus
cttgcctctaagaagtgtatacacc

SEQ ID NO: 922985 - DNA, 25 bp, Mus musculus
cttgcctgccaacgtcctcttctgt

SEQ ID NO: 922986 - DNA, 25 bp, Mus musculus
cttgcctgccaaggtcctcttctgt

SEQ ID NO: 922987 - DNA, 25 bp, Mus musculus
cttgcctggcggccgaaaagcatgc

SEQ ID NO: 922988 - DNA, 25 bp, Mus musculus
cttgcctggcgggcgaaaagcatgc

SEQ ID NO: 922989 - DNA, 25 bp, Mus musculus
cttgcctgtgccctgttcactgcct

SEQ ID NO: 922990 - DNA, 25 bp, Mus musculus
cttgcctgtggcctgttcactgcct

SEQ ID NO: 922991 - DNA, 25 bp, Mus musculus
cttgccttaaagctaatgctgccat

SEQ ID NO: 922992 - DNA, 25 bp, Mus musculus
cttgccttaaaggtaatgctgccat

SEQ ID NO: 922993 - DNA, 25 bp, Mus musculus
cttgcctttgctcacctagagagca

SEQ ID NO: 922994 - DNA, 25 bp, Mus musculus
cttgcctttggtcacctagagagca

SEQ ID NO: 922995 - DNA, 25 bp, Mus musculus
cttgcgacaacacatggagaagtct

SEQ ID NO: 922996 - DNA, 25 bp, Mus musculus
cttgcgacaacagatggagaagtct

SEQ ID NO: 922997 - DNA, 25 bp, Mus musculus
cttgcgacagagagaagaagccacg

SEQ ID NO: 922998 - DNA, 25 bp, Mus musculus
cttgcgacagtgagaagaagccacg

SEQ ID NO: 922999 - DNA, 25 bp, Mus musculus
cttgcgatggcgctacagagactca

SEQ ID NO: 923000 - DNA, 25 bp, Mus musculus
cttgcgatggcggtacagagactca

SEQ ID NO: 923001 - DNA, 25 bp, Mus musculus
cttgcggaatcgacagggccagcat

SEQ ID NO: 923002 - DNA, 25 bp, Mus musculus
cttgcggaatcgtcagggccagcat

SEQ ID NO: 923003 - DNA, 25 bp, Mus musculus
cttgcggcagccttccgggctgctg

SEQ ID NO: 923004 - DNA, 25 bp, Mus musculus
cttgcggcaggcttccgggctgctg

SEQ ID NO: 923005 - DNA, 25 bp, Mus musculus
cttgctactcagctgatcggaagag

SEQ ID NO: 923006 - DNA, 25 bp, Mus musculus
cttgctactcaggtgatcggaagag

SEQ ID NO: 923007 - DNA, 25 bp, Mus musculus
cttgctattgctcctgggcctgctc

SEQ ID NO: 923008 - DNA, 25 bp, Mus musculus
cttgctattggtcctgggcctgctc

SEQ ID NO: 923009 - DNA, 25 bp, Mus musculus
cttgctcaaccacatccttgcatga

SEQ ID NO: 923010 - DNA, 25 bp, Mus musculus
cttgctcaaccacggcatcgttctg

SEQ ID NO: 923011 - DNA, 25 bp, Mus musculus
cttgctcaaccagatccttgcatga

SEQ ID NO: 923012 - DNA, 25 bp, Mus musculus
cttgctcaaccagggcatcgttctg

SEQ ID NO: 923013 - DNA, 25 bp, Mus musculus
cttgctcacgcgaattccaggaagc

SEQ ID NO: 923014 - DNA, 25 bp, Mus musculus
cttgctcacgggaattccaggaagc

SEQ ID NO: 923015 - DNA, 25 bp, Mus musculus
cttgctccctcgcttagcgctctgt

SEQ ID NO: 923016 - DNA, 25 bp, Mus musculus
cttgctccctcggttagcgctctgt

SEQ ID NO: 923017 - DNA, 25 bp, Mus musculus
cttgctccgtcctgcatactccatg

SEQ ID NO: 923018 - DNA, 25 bp, Mus musculus
cttgctccgtcctggatactccatg

SEQ ID NO: 923019 - DNA, 25 bp, Mus musculus
cttgctcctgcaggcagtgacattc

SEQ ID NO: 923020 - DNA, 25 bp, Mus musculus
cttgctcctgcttgcttcccagagc

SEQ ID NO: 923021 - DNA, 25 bp, Mus musculus
cttgctcctggaggcagtgacattc

SEQ ID NO: 923022 - DNA, 25 bp, Mus musculus
cttgctcctggttgcttcccagagc

SEQ ID NO: 923023 - DNA, 25 bp, Mus musculus
cttgctctggcacacgtcccattcc

SEQ ID NO: 923024 - DNA, 25 bp, Mus musculus
cttgctctggcagacgtcccattcc

SEQ ID NO: 923025 - DNA, 25 bp, Mus musculus
cttgctgaaaaacacaactggcctg

SEQ ID NO: 923026 - DNA, 25 bp, Mus musculus
cttgctgaaaaagacaactggcctg

SEQ ID NO: 923027 - DNA, 25 bp, Mus musculus
cttgctgcagagcgcccgtggggcc

SEQ ID NO: 923028 - DNA, 25 bp, Mus musculus
cttgctgcagagggcccgtggggcc

SEQ ID NO: 923029 - DNA, 25 bp, Mus musculus
cttgctgccttacaccccccgggtg

SEQ ID NO: 923030 - DNA, 25 bp, Mus musculus
cttgctgccttacagcccccgggtg

SEQ ID NO: 923031 - DNA, 25 bp, Mus musculus
cttgctgcgcagatgatgctgaata

SEQ ID NO: 923032 - DNA, 25 bp, Mus musculus
cttgctgcgcagatgcagaaccccg

SEQ ID NO: 923033 - DNA, 25 bp, Mus musculus
cttgctgcgcagttgatgctgaata

SEQ ID NO: 923034 - DNA, 25 bp, Mus musculus
cttgctgcgcagttgcagaaccccg

SEQ ID NO: 923035 - DNA, 25 bp, Mus musculus
cttgctgctcagaggcctgcctgga

SEQ ID NO: 923036 - DNA, 25 bp, Mus musculus
cttgctgctcagcagaggcctgcct

SEQ ID NO: 923037 - DNA, 25 bp, Mus musculus
cttgctgctcaggagaggcctgcct

SEQ ID NO: 923038 - DNA, 25 bp, Mus musculus
cttgctgctcagtggcctgcctgga

SEQ ID NO: 923039 - DNA, 25 bp, Mus musculus
cttgctggggctggagaagctggga

SEQ ID NO: 923040 - DNA, 25 bp, Mus musculus
cttgctggggctggtgaagctggga

SEQ ID NO: 923041 - DNA, 25 bp, Mus musculus
cttgctgggtctctactttgtcttc

SEQ ID NO: 923042 - DNA, 25 bp, Mus musculus
cttgctgggtctgtactttgtcttc

SEQ ID NO: 923043 - DNA, 25 bp, Mus musculus
cttgctgtagcttatgatgagttta

SEQ ID NO: 923044 - DNA, 25 bp, Mus musculus
cttgctgtaggttatgatgagttta

SEQ ID NO: 923045 - DNA, 25 bp, Mus musculus
cttgctgtccgagcagtccactccc

SEQ ID NO: 923046 - DNA, 25 bp, Mus musculus
cttgctgtccgagctgtccactccc

SEQ ID NO: 923047 - DNA, 25 bp, Mus musculus
cttgctgtgcagccatttttgcaga

SEQ ID NO: 923048 - DNA, 25 bp, Mus musculus
cttgctgtgcaggcatttttgcaga

SEQ ID NO: 923049 - DNA, 25 bp, Mus musculus
cttgctgtgcctcacggcttagtca

SEQ ID NO: 923050 - DNA, 25 bp, Mus musculus
cttgctgtgcctcagggcttagtca

SEQ ID NO: 923051 - DNA, 25 bp, Mus musculus
cttgctgttcagcactatattcaac

SEQ ID NO: 923052 - DNA, 25 bp, Mus musculus
cttgctgttcagcagtatattcaac

SEQ ID NO: 923053 - DNA, 25 bp, Mus musculus
cttgctgttcttaatcctgggtgct

SEQ ID NO: 923054 - DNA, 25 bp, Mus musculus
cttgctgttctttatcctgggtgct

SEQ ID NO: 923055 - DNA, 25 bp, Mus musculus
cttgcttactaatgcagactacacc

SEQ ID NO: 923056 - DNA, 25 bp, Mus musculus
cttgcttacttatgcagactacacc

SEQ ID NO: 923057 - DNA, 25 bp, Mus musculus
cttgcttcagccagagtaacagttg

SEQ ID NO: 923058 - DNA, 25 bp, Mus musculus
cttgcttcagccgtctgtggaggct

SEQ ID NO: 923059 - DNA, 25 bp, Mus musculus
cttgcttcagctacgccaggatctg

SEQ ID NO: 923060 - DNA, 25 bp, Mus musculus
cttgcttcaggcagagtaacagttg

SEQ ID NO: 923061 - DNA, 25 bp, Mus musculus
cttgcttcaggcgtctgtggaggct

SEQ ID NO: 923062 - DNA, 25 bp, Mus musculus
cttgcttcaggtacgccaggatctg

SEQ ID NO: 923063 - DNA, 25 bp, Mus musculus
cttggaaatgcatgagacctcatca

SEQ ID NO: 923064 - DNA, 25 bp, Mus musculus
cttggaaatggatgagacctcatca

SEQ ID NO: 923065 - DNA, 25 bp, Mus musculus
cttggaacagctagccaatgagact

SEQ ID NO: 923066 - DNA, 25 bp, Mus musculus
cttggaacaggtagccaatgagact

SEQ ID NO: 923067 - DNA, 25 bp, Mus musculus
cttggaacatggctaatgcaccccc

SEQ ID NO: 923068 - DNA, 25 bp, Mus musculus
cttggaacatgggtaatgcaccccc

SEQ ID NO: 923069 - DNA, 25 bp, Mus musculus
cttggaagaatcagactttagcatg

SEQ ID NO: 923070 - DNA, 25 bp, Mus musculus
cttggaagaatctgactttagcatg

SEQ ID NO: 923071 - DNA, 25 bp, Mus musculus
cttggaagagagcacatcctttatt

SEQ ID NO: 923072 - DNA, 25 bp, Mus musculus
cttggaagagtgcacatcctttatt

SEQ ID NO: 923073 - DNA, 25 bp, Mus musculus
cttggaatcacagcagaaacgaccc

SEQ ID NO: 923074 - DNA, 25 bp, Mus musculus
cttggaatcacagcagcagaaacga

SEQ ID NO: 923075 - DNA, 25 bp, Mus musculus
cttggaatcagagcagaaacgaccc

SEQ ID NO: 923076 - DNA, 25 bp, Mus musculus
cttggaatcagagcagcagaaacga

SEQ ID NO: 923077 - DNA, 25 bp, Mus musculus
cttggaatcccacaacaggagtaca

SEQ ID NO: 923078 - DNA, 25 bp, Mus musculus
cttggaatcccagaacaggagtaca

SEQ ID NO: 923079 - DNA, 25 bp, Mus musculus
cttggaatcctacgtcctgtcattt

SEQ ID NO: 923080 - DNA, 25 bp, Mus musculus
cttggaatcctaggtcctgtcattt

SEQ ID NO: 923081 - DNA, 25 bp, Mus musculus
cttggacaacaccatcaagaaactg

SEQ ID NO: 923082 - DNA, 25 bp, Mus musculus
cttggacaactccatcaagaaactg

SEQ ID NO: 923083 - DNA, 25 bp, Mus musculus
cttggacaagcaagccacatgctct

SEQ ID NO: 923084 - DNA, 25 bp, Mus musculus
cttggacaagcaaggcacatgctct

SEQ ID NO: 923085 - DNA, 25 bp, Mus musculus
cttggacagagccggaacggccaca

SEQ ID NO: 923086 - DNA, 25 bp, Mus musculus
cttggacagagcgggaacggccaca

SEQ ID NO: 923087 - DNA, 25 bp, Mus musculus
cttggacagcaacggccatgtgaaa

SEQ ID NO: 923088 - DNA, 25 bp, Mus musculus
cttggacagcaagggccatgtgaaa

SEQ ID NO: 923089 - DNA, 25 bp, Mus musculus
cttggaccacaccaccattcggagg

SEQ ID NO: 923090 - DNA, 25 bp, Mus musculus
cttggaccacaccacttcctctaat

SEQ ID NO: 923091 - DNA, 25 bp, Mus musculus
cttggaccacaccagcattcggagg

SEQ ID NO: 923092 - DNA, 25 bp, Mus musculus
cttggaccacaccagttcctctaat

SEQ ID NO: 923093 - DNA, 25 bp, Mus musculus
cttggactgaagctacgcagggaat

SEQ ID NO: 923094 - DNA, 25 bp, Mus musculus
cttggactgaaggtacgcagggaat

SEQ ID NO: 923095 - DNA, 25 bp, Mus musculus
cttggactgccaccaagtctcaggt

SEQ ID NO: 923096 - DNA, 25 bp, Mus musculus
cttggactgccacggtcacgtggta

SEQ ID NO: 923097 - DNA, 25 bp, Mus musculus
cttggactgccactacttggctcca

SEQ ID NO: 923098 - DNA, 25 bp, Mus musculus
cttggactgccagcaagtctcaggt

SEQ ID NO: 923099 - DNA, 25 bp, Mus musculus
cttggactgccagggtcacgtggta

SEQ ID NO: 923100 - DNA, 25 bp, Mus musculus
cttggactgccagtacttggctcca

SEQ ID NO: 923101 - DNA, 25 bp, Mus musculus
cttggactgtgacgcttctttggct

SEQ ID NO: 923102 - DNA, 25 bp, Mus musculus
cttggactgtgactaggcttctttg

SEQ ID NO: 923103 - DNA, 25 bp, Mus musculus
cttggactgtgaggcttctttggct

SEQ ID NO: 923104 - DNA, 25 bp, Mus musculus
cttggactgtgagtaggcttctttg

SEQ ID NO: 923105 - DNA, 25 bp, Mus musculus
cttggagaagataaaaatatatacc

SEQ ID NO: 923106 - DNA, 25 bp, Mus musculus
cttggagaagatcatcagtggtgct

SEQ ID NO: 923107 - DNA, 25 bp, Mus musculus
cttggagaagttaaaaatatatacc

SEQ ID NO: 923108 - DNA, 25 bp, Mus musculus
cttggagaagttcatcagtggtgct

SEQ ID NO: 923109 - DNA, 25 bp, Mus musculus
cttggagacgccctcacagagttgg

SEQ ID NO: 923110 - DNA, 25 bp, Mus musculus
cttggagacggcctcacagagttgg

SEQ ID NO: 923111 - DNA, 25 bp, Mus musculus
cttggagcagctcaaagctgcaata

SEQ ID NO: 923112 - DNA, 25 bp, Mus musculus
cttggagcaggtcaaagctgcaata

SEQ ID NO: 923113 - DNA, 25 bp, Mus musculus
cttggagcggattgggggcttggtg

SEQ ID NO: 923114 - DNA, 25 bp, Mus musculus
cttggagcggtttgggggcttggtg

SEQ ID NO: 923115 - DNA, 25 bp, Mus musculus
cttggagcttttagaccacaacgaa

SEQ ID NO: 923116 - DNA, 25 bp, Mus musculus
cttggagcttttagtccacaacgaa

SEQ ID NO: 923117 - DNA, 25 bp, Mus musculus
cttggaggagaaattaaaagaagat

SEQ ID NO: 923118 - DNA, 25 bp, Mus musculus
cttggaggagaatttaaaagaagat

SEQ ID NO: 923119 - DNA, 25 bp, Mus musculus
cttggaggagcttagctattatttt

SEQ ID NO: 923120 - DNA, 25 bp, Mus musculus
cttggaggaggttagctattatttt

SEQ ID NO: 923121 - DNA, 25 bp, Mus musculus
cttggaggcaagcaaggagcacgaa

SEQ ID NO: 923122 - DNA, 25 bp, Mus musculus
cttggaggcaaggaaggagcacgaa

SEQ ID NO: 923123 - DNA, 25 bp, Mus musculus
cttggaggtcaacaagtggctggaa

SEQ ID NO: 923124 - DNA, 25 bp, Mus musculus
cttggaggtcaacatgtggctggaa

SEQ ID NO: 923125 - DNA, 25 bp, Mus musculus
cttggagtcaggcgaaatgagcatc

SEQ ID NO: 923126 - DNA, 25 bp, Mus musculus
cttggagtcaggcgtcactaggatt

SEQ ID NO: 923127 - DNA, 25 bp, Mus musculus
cttggagtcaggggaaatgagcatc

SEQ ID NO: 923128 - DNA, 25 bp, Mus musculus
cttggagtcaggggtcactaggatt

SEQ ID NO: 923129 - DNA, 25 bp, Mus musculus
cttggataaacaattgctgtgtcta

SEQ ID NO: 923130 - DNA, 25 bp, Mus musculus
cttggataaacatttgctgtgtcta

SEQ ID NO: 923131 - DNA, 25 bp, Mus musculus
cttggatcacagctacctggaactg

SEQ ID NO: 923132 - DNA, 25 bp, Mus musculus
cttggatcacaggtacctggaactg

SEQ ID NO: 923133 - DNA, 25 bp, Mus musculus
cttggatcgaagccacggagggagt

SEQ ID NO: 923134 - DNA, 25 bp, Mus musculus
cttggatcgaaggcacggagggagt

SEQ ID NO: 923135 - DNA, 25 bp, Mus musculus
cttggatctactcgttctgcagtac

SEQ ID NO: 923136 - DNA, 25 bp, Mus musculus
cttggatctactctgggcccagcca

SEQ ID NO: 923137 - DNA, 25 bp, Mus musculus
cttggatctactggttctgcagtac

SEQ ID NO: 923138 - DNA, 25 bp, Mus musculus
cttggatctactgtgggcccagcca

SEQ ID NO: 923139 - DNA, 25 bp, Mus musculus
cttggattacagctgaccaggactg

SEQ ID NO: 923140 - DNA, 25 bp, Mus musculus
cttggattacagctggtgctctggg

SEQ ID NO: 923141 - DNA, 25 bp, Mus musculus
cttggattacaggtgaccaggactg

SEQ ID NO: 923142 - DNA, 25 bp, Mus musculus
cttggattacaggtggtgctctggg

SEQ ID NO: 923143 - DNA, 25 bp, Mus musculus
cttggattcactcacggtgatgttg

SEQ ID NO: 923144 - DNA, 25 bp, Mus musculus
cttggattcactcagggtgatgttg

SEQ ID NO: 923145 - DNA, 25 bp, Mus musculus
cttggcaaacggcagagcaaacgaa

SEQ ID NO: 923146 - DNA, 25 bp, Mus musculus
cttggcaaacgggagagcaaacgaa

SEQ ID NO: 923147 - DNA, 25 bp, Mus musculus
cttggcaacaggctctctgtgatga

SEQ ID NO: 923148 - DNA, 25 bp, Mus musculus
cttggcaacagggtctctgtgatga

SEQ ID NO: 923149 - DNA, 25 bp, Mus musculus
cttggccaacactgcgtgctgggac

SEQ ID NO: 923150 - DNA, 25 bp, Mus musculus
cttggccaacactgggtgctgggac

SEQ ID NO: 923151 - DNA, 25 bp, Mus musculus
cttggccaagcccaggttatcaaag

SEQ ID NO: 923152 - DNA, 25 bp, Mus musculus
cttggccaaggccaggttatcaaag

SEQ ID NO: 923153 - DNA, 25 bp, Mus musculus
cttggccaggcagccacagctaact

SEQ ID NO: 923154 - DNA, 25 bp, Mus musculus
cttggccagggagccacagctaact

SEQ ID NO: 923155 - DNA, 25 bp, Mus musculus
cttggcctcactcggcacattccag

SEQ ID NO: 923156 - DNA, 25 bp, Mus musculus
cttggcctcactgggcacattccag

SEQ ID NO: 923157 - DNA, 25 bp, Mus musculus
cttggccttcctgacgattatttgt

SEQ ID NO: 923158 - DNA, 25 bp, Mus musculus
cttggccttcctgaggattatttgt

SEQ ID NO: 923159 - DNA, 25 bp, Mus musculus
cttggcgaagctaccagctcaggaa

SEQ ID NO: 923160 - DNA, 25 bp, Mus musculus
cttggcgaaggtaccagctcaggaa

SEQ ID NO: 923161 - DNA, 25 bp, Mus musculus
cttggctcctactttctgcactggc

SEQ ID NO: 923162 - DNA, 25 bp, Mus musculus
cttggctcctccctgaggagcgatg

SEQ ID NO: 923163 - DNA, 25 bp, Mus musculus
cttggctcctgcctgaggagcgatg

SEQ ID NO: 923164 - DNA, 25 bp, Mus musculus
cttggctccttctttctgcactggc

SEQ ID NO: 923165 - DNA, 25 bp, Mus musculus
cttggctgaccacgatattttcaat

SEQ ID NO: 923166 - DNA, 25 bp, Mus musculus
cttggctgaccaggatattttcaat

SEQ ID NO: 923167 - DNA, 25 bp, Mus musculus
cttggctggaagctcaggccctgga

SEQ ID NO: 923168 - DNA, 25 bp, Mus musculus
cttggctggactcaggccctggagc

SEQ ID NO: 923169 - DNA, 25 bp, Mus musculus
cttggctggagtcaggccctggagc

SEQ ID NO: 923170 - DNA, 25 bp, Mus musculus
cttggctggatgctcaggccctgga

SEQ ID NO: 923171 - DNA, 25 bp, Mus musculus
cttggctggcgtaaaaatggctaca

SEQ ID NO: 923172 - DNA, 25 bp, Mus musculus
cttggctggcgtcagaaaaatggct

SEQ ID NO: 923173 - DNA, 25 bp, Mus musculus
cttggctggcgtgagaaaaatggct

SEQ ID NO: 923174 - DNA, 25 bp, Mus musculus
cttggctggcgttaaaatggctaca

SEQ ID NO: 923175 - DNA, 25 bp, Mus musculus
cttggcttgcagataaaaatatata

SEQ ID NO: 923176 - DNA, 25 bp, Mus musculus
cttggcttgcagttaaaaatatata

SEQ ID NO: 923177 - DNA, 25 bp, Mus musculus
cttggctttggacctcctgatggtt

SEQ ID NO: 923178 - DNA, 25 bp, Mus musculus
cttggctttggacgtcggtgagctg

SEQ ID NO: 923179 - DNA, 25 bp, Mus musculus
cttggctttggagctcctgatggtt

SEQ ID NO: 923180 - DNA, 25 bp, Mus musculus
cttggctttggaggtcggtgagctg

SEQ ID NO: 923181 - DNA, 25 bp, Mus musculus
cttgggagatgcctatgctgccaga

SEQ ID NO: 923182 - DNA, 25 bp, Mus musculus
cttgggagatgcgtatgctgccaga

SEQ ID NO: 923183 - DNA, 25 bp, Mus musculus
cttgggagccaacaactcatcctgc

SEQ ID NO: 923184 - DNA, 25 bp, Mus musculus
cttgggagccaagaactcatcctgc

SEQ ID NO: 923185 - DNA, 25 bp, Mus musculus
cttgggagtttgatactatttgcaa

SEQ ID NO: 923186 - DNA, 25 bp, Mus musculus
cttgggagtttgttactatttgcaa

SEQ ID NO: 923187 - DNA, 25 bp, Mus musculus
cttgggcatatgctgcccaaccctg

SEQ ID NO: 923188 - DNA, 25 bp, Mus musculus
cttgggcatatggtgcccaaccctg

SEQ ID NO: 923189 - DNA, 25 bp, Mus musculus
cttgggcatgatccagagcaatgag

SEQ ID NO: 923190 - DNA, 25 bp, Mus musculus
cttgggcatgctttggtggccccaa

SEQ ID NO: 923191 - DNA, 25 bp, Mus musculus
cttgggcatggtttggtggccccaa

SEQ ID NO: 923192 - DNA, 25 bp, Mus musculus
cttgggcatgttccagagcaatgag

SEQ ID NO: 923193 - DNA, 25 bp, Mus musculus
cttgggccagattgtgtcacaaacc

SEQ ID NO: 923194 - DNA, 25 bp, Mus musculus
cttgggccagtttgtgtcacaaacc

SEQ ID NO: 923195 - DNA, 25 bp, Mus musculus
cttgggcctgcgcccatacccactg

SEQ ID NO: 923196 - DNA, 25 bp, Mus musculus
cttgggcctgggcccatacccactg

SEQ ID NO: 923197 - DNA, 25 bp, Mus musculus
cttggggaagcacatggagttccag

SEQ ID NO: 923198 - DNA, 25 bp, Mus musculus
cttggggaagcagatggagttccag

SEQ ID NO: 923199 - DNA, 25 bp, Mus musculus
cttggggaagcctgagatgggggtt

SEQ ID NO: 923200 - DNA, 25 bp, Mus musculus
cttggggaaggctgagatgggggtt

SEQ ID NO: 923201 - DNA, 25 bp, Mus musculus
cttggggacccacacgtgtggatcg

SEQ ID NO: 923202 - DNA, 25 bp, Mus musculus
cttggggacccacaggtgtggatcg

SEQ ID NO: 923203 - DNA, 25 bp, Mus musculus
cttggggaggcacactgtggcctgc

SEQ ID NO: 923204 - DNA, 25 bp, Mus musculus
cttggggaggcagactgtggcctgc

SEQ ID NO: 923205 - DNA, 25 bp, Mus musculus
cttgggtcagagctttatcttcatg

SEQ ID NO: 923206 - DNA, 25 bp, Mus musculus
cttgggtcagatcatggtcttcgga

SEQ ID NO: 923207 - DNA, 25 bp, Mus musculus
cttgggtcagtgctttatcttcatg

SEQ ID NO: 923208 - DNA, 25 bp, Mus musculus
cttgggtcagttcatggtcttcgga

SEQ ID NO: 923209 - DNA, 25 bp, Mus musculus
cttgggttcaagatcttggcaacca

SEQ ID NO: 923210 - DNA, 25 bp, Mus musculus
cttgggttcaagttcttggcaacca

SEQ ID NO: 923211 - DNA, 25 bp, Mus musculus
cttgggttcctccgctcccaggagc

SEQ ID NO: 923212 - DNA, 25 bp, Mus musculus
cttgggttcctcggctcccaggagc

SEQ ID NO: 923213 - DNA, 25 bp, Mus musculus
cttggtccagcatctttctcaagtg

SEQ ID NO: 923214 - DNA, 25 bp, Mus musculus
cttggtccagctcatcccagtggtg

SEQ ID NO: 923215 - DNA, 25 bp, Mus musculus
cttggtccaggatctttctcaagtg

SEQ ID NO: 923216 - DNA, 25 bp, Mus musculus
cttggtccaggtcatcccagtggtg

SEQ ID NO: 923217 - DNA, 25 bp, Mus musculus
cttggtctgagcagcactcggaacc

SEQ ID NO: 923218 - DNA, 25 bp, Mus musculus
cttggtctgagcaggactcggaacc

SEQ ID NO: 923219 - DNA, 25 bp, Mus musculus
cttggtctgctgcacgcctttagaa

SEQ ID NO: 923220 - DNA, 25 bp, Mus musculus
cttggtctgctgcgaagcggaacag

SEQ ID NO: 923221 - DNA, 25 bp, Mus musculus
cttggtctgctggacgcctttagaa

SEQ ID NO: 923222 - DNA, 25 bp, Mus musculus
cttggtctgctgggaagcggaacag

SEQ ID NO: 923223 - DNA, 25 bp, Mus musculus
cttggtgctgcgatcctgtttactg

SEQ ID NO: 923224 - DNA, 25 bp, Mus musculus
cttggtgctgggatcctgtttactg

SEQ ID NO: 923225 - DNA, 25 bp, Mus musculus
cttggtggacaaagttgctaaagat

SEQ ID NO: 923226 - DNA, 25 bp, Mus musculus
cttggtggacaatgttgctaaagat

SEQ ID NO: 923227 - DNA, 25 bp, Mus musculus
cttggtggccaccatgctgtatact

SEQ ID NO: 923228 - DNA, 25 bp, Mus musculus
cttggtggccacgatgctgtatact

SEQ ID NO: 923229 - DNA, 25 bp, Mus musculus
cttggtgtggacacttcccgagtgg

SEQ ID NO: 923230 - DNA, 25 bp, Mus musculus
cttggtgtggagctgagccctaccc

SEQ ID NO: 923231 - DNA, 25 bp, Mus musculus
cttggtgtggtcacttcccgagtgg

SEQ ID NO: 923232 - DNA, 25 bp, Mus musculus
cttggtgtggtgctgagccctaccc

SEQ ID NO: 923233 - DNA, 25 bp, Mus musculus
cttggttcggaacatgggctgtgtg

SEQ ID NO: 923234 - DNA, 25 bp, Mus musculus
cttggttcggtacatgggctgtgtg

SEQ ID NO: 923235 - DNA, 25 bp, Mus musculus
cttggttctgcagacgaacagctgt

SEQ ID NO: 923236 - DNA, 25 bp, Mus musculus
cttggttctgcagaggaacagctgt

SEQ ID NO: 923237 - DNA, 25 bp, Mus musculus
cttgtaagtaccgactgctgctttt

SEQ ID NO: 923238 - DNA, 25 bp, Mus musculus
cttgtaagtaccgagtgctgctttt

SEQ ID NO: 923239 - DNA, 25 bp, Mus musculus
cttgtaataaagctgcgaagctggg

SEQ ID NO: 923240 - DNA, 25 bp, Mus musculus
cttgtaataaaggtgcgaagctggg

SEQ ID NO: 923241 - DNA, 25 bp, Mus musculus
cttgtacaggcaccctcatgtggac

SEQ ID NO: 923242 - DNA, 25 bp, Mus musculus
cttgtacagggaccctcatgtggac

SEQ ID NO: 923243 - DNA, 25 bp, Mus musculus
cttgtagagaagccatctgtggctc

SEQ ID NO: 923244 - DNA, 25 bp, Mus musculus
cttgtagagaaggcatctgtggctc

SEQ ID NO: 923245 - DNA, 25 bp, Mus musculus
cttgtatacagacgagcattccggc

SEQ ID NO: 923246 - DNA, 25 bp, Mus musculus
cttgtatacagaggagcattccggc

SEQ ID NO: 923247 - DNA, 25 bp, Mus musculus
cttgtatgaatatacatttttaaat

SEQ ID NO: 923248 - DNA, 25 bp, Mus musculus
cttgtatgaatatagatttttaaat

SEQ ID NO: 923249 - DNA, 25 bp, Mus musculus
cttgtcaaagactacaaaataccca

SEQ ID NO: 923250 - DNA, 25 bp, Mus musculus
cttgtcaaagatcgactgtgccgct

SEQ ID NO: 923251 - DNA, 25 bp, Mus musculus
cttgtcaaagtctacaaaataccca

SEQ ID NO: 923252 - DNA, 25 bp, Mus musculus
cttgtcaaagttcgactgtgccgct

SEQ ID NO: 923253 - DNA, 25 bp, Mus musculus
cttgtcaatgagccagaattccacc

SEQ ID NO: 923254 - DNA, 25 bp, Mus musculus
cttgtcaatgaggcagaattccacc

SEQ ID NO: 923255 - DNA, 25 bp, Mus musculus
cttgtcacagctctgtctatgagca

SEQ ID NO: 923256 - DNA, 25 bp, Mus musculus
cttgtcacagctgtgtctatgagca

SEQ ID NO: 923257 - DNA, 25 bp, Mus musculus
cttgtcagaaagaacaggaaaccag

SEQ ID NO: 923258 - DNA, 25 bp, Mus musculus
cttgtcagaaagaagaggaaaccag

SEQ ID NO: 923259 - DNA, 25 bp, Mus musculus
cttgtcagaaccaggcaccaccgag

SEQ ID NO: 923260 - DNA, 25 bp, Mus musculus
cttgtcagaacctggcaccaccgag

SEQ ID NO: 923261 - DNA, 25 bp, Mus musculus
cttgtcaggttctacatatgtgctg

SEQ ID NO: 923262 - DNA, 25 bp, Mus musculus
cttgtcaggttctagatatgtgctg

SEQ ID NO: 923263 - DNA, 25 bp, Mus musculus
cttgtcatagaactgggcggcaacc

SEQ ID NO: 923264 - DNA, 25 bp, Mus musculus
cttgtcatagtactgggcggcaacc

SEQ ID NO: 923265 - DNA, 25 bp, Mus musculus
cttgtcatctcccacggactgcgca

SEQ ID NO: 923266 - DNA, 25 bp, Mus musculus
cttgtcatctcccagggactgcgca

SEQ ID NO: 923267 - DNA, 25 bp, Mus musculus
cttgtcatgacacacactagaggaa

SEQ ID NO: 923268 - DNA, 25 bp, Mus musculus
cttgtcatgacacagactagaggaa

SEQ ID NO: 923269 - DNA, 25 bp, Mus musculus
cttgtcccagcccaagatggatgaa

SEQ ID NO: 923270 - DNA, 25 bp, Mus musculus
cttgtcccaggccaagatggatgaa

SEQ ID NO: 923271 - DNA, 25 bp, Mus musculus
cttgtcccccatcagcaagcagagt

SEQ ID NO: 923272 - DNA, 25 bp, Mus musculus
cttgtcccccatgagcaagcagagt

SEQ ID NO: 923273 - DNA, 25 bp, Mus musculus
cttgtcccctgggactgcttacttt

SEQ ID NO: 923274 - DNA, 25 bp, Mus musculus
cttgtcccctgggagtgcttacttt

SEQ ID NO: 923275 - DNA, 25 bp, Mus musculus
cttgtccctccccaccaatctactc

SEQ ID NO: 923276 - DNA, 25 bp, Mus musculus
cttgtccctccccacgaacattgac

SEQ ID NO: 923277 - DNA, 25 bp, Mus musculus
cttgtccctccccagcaatctactc

SEQ ID NO: 923278 - DNA, 25 bp, Mus musculus
cttgtccctccccaggaacattgac

SEQ ID NO: 923279 - DNA, 25 bp, Mus musculus
cttgtcctcagggactgcctgcact

SEQ ID NO: 923280 - DNA, 25 bp, Mus musculus
cttgtcctcagggagtgcctgcact

SEQ ID NO: 923281 - DNA, 25 bp, Mus musculus
cttgtcctgtaacgtggtctgtgat

SEQ ID NO: 923282 - DNA, 25 bp, Mus musculus
cttgtcctgtaaggtggtctgtgat

SEQ ID NO: 923283 - DNA, 25 bp, Mus musculus
cttgtctcaacctgcataccatggc

SEQ ID NO: 923284 - DNA, 25 bp, Mus musculus
cttgtctcaacctggataccatggc

SEQ ID NO: 923285 - DNA, 25 bp, Mus musculus
cttgtctgacctcatcctgacgggt

SEQ ID NO: 923286 - DNA, 25 bp, Mus musculus
cttgtctgacctgatcctgacgggt

SEQ ID NO: 923287 - DNA, 25 bp, Mus musculus
cttgtctgagaggaacccttctctg

SEQ ID NO: 923288 - DNA, 25 bp, Mus musculus
cttgtctgagaggaagttttatctg

SEQ ID NO: 923289 - DNA, 25 bp, Mus musculus
cttgtctgagaggatcccttctctg

SEQ ID NO: 923290 - DNA, 25 bp, Mus musculus
cttgtctgagaggatgttttatctg

SEQ ID NO: 923291 - DNA, 25 bp, Mus musculus
cttgtgaaagcctgcaagagccaca

SEQ ID NO: 923292 - DNA, 25 bp, Mus musculus
cttgtgaaaggctgcaagagccaca

SEQ ID NO: 923293 - DNA, 25 bp, Mus musculus
cttgtgagaaccgacaaatggcaaa

SEQ ID NO: 923294 - DNA, 25 bp, Mus musculus
cttgtgagaaccgagaaatggcaaa

SEQ ID NO: 923295 - DNA, 25 bp, Mus musculus
cttgtgagttcgactgtgatttacc

SEQ ID NO: 923296 - DNA, 25 bp, Mus musculus
cttgtgagttcgtctgtgatttacc

SEQ ID NO: 923297 - DNA, 25 bp, Mus musculus
cttgtgcaagcgcccagacttccat

SEQ ID NO: 923298 - DNA, 25 bp, Mus musculus
cttgtgcaagggcccagacttccat

SEQ ID NO: 923299 - DNA, 25 bp, Mus musculus
cttgtgcatctccacgtcccacctg

SEQ ID NO: 923300 - DNA, 25 bp, Mus musculus
cttgtgcatctccaggtcccacctg

SEQ ID NO: 923301 - DNA, 25 bp, Mus musculus
cttgtgcccatcacagcagtcaccc

SEQ ID NO: 923302 - DNA, 25 bp, Mus musculus
cttgtgcccatctcagcagtcaccc

SEQ ID NO: 923303 - DNA, 25 bp, Mus musculus
cttgtgcccctacagatgtcatgtg

SEQ ID NO: 923304 - DNA, 25 bp, Mus musculus
cttgtgcccctagagatgtcatgtg

SEQ ID NO: 923305 - DNA, 25 bp, Mus musculus
cttgtgccgcttcccgaagctgcac

SEQ ID NO: 923306 - DNA, 25 bp, Mus musculus
cttgtgccgcttccggaagctgcac

SEQ ID NO: 923307 - DNA, 25 bp, Mus musculus
cttgtggcagctatcggaaagagat

SEQ ID NO: 923308 - DNA, 25 bp, Mus musculus
cttgtggcagctatgggaaagagat

SEQ ID NO: 923309 - DNA, 25 bp, Mus musculus
cttgtggctgctcccgcaggctggc

SEQ ID NO: 923310 - DNA, 25 bp, Mus musculus
cttgtggctgctgccgcaggctggc

SEQ ID NO: 923311 - DNA, 25 bp, Mus musculus
cttgtggtcaaaccttctttggacc

SEQ ID NO: 923312 - DNA, 25 bp, Mus musculus
cttgtggtcaaagcttctttggacc

SEQ ID NO: 923313 - DNA, 25 bp, Mus musculus
cttgtgtcaaaaccctatgtcccca

SEQ ID NO: 923314 - DNA, 25 bp, Mus musculus
cttgtgtcaaaacggaagatggaag

SEQ ID NO: 923315 - DNA, 25 bp, Mus musculus
cttgtgtcaaaagcctatgtcccca

SEQ ID NO: 923316 - DNA, 25 bp, Mus musculus
cttgtgtcaaaagggaagatggaag

SEQ ID NO: 923317 - DNA, 25 bp, Mus musculus
cttgtgtcagcaactagtggctggg

SEQ ID NO: 923318 - DNA, 25 bp, Mus musculus
cttgtgtcaggaactagtggctggg

SEQ ID NO: 923319 - DNA, 25 bp, Mus musculus
cttgtgttcctgcgtcttgctttct

SEQ ID NO: 923320 - DNA, 25 bp, Mus musculus
cttgtgttcctgggtcttgctttct

SEQ ID NO: 923321 - DNA, 25 bp, Mus musculus
cttgttcaagcgtagtcagtactgg

SEQ ID NO: 923322 - DNA, 25 bp, Mus musculus
cttgttcaagggtagtcagtactgg

SEQ ID NO: 923323 - DNA, 25 bp, Mus musculus
cttgttctggcacgcactcttggct

SEQ ID NO: 923324 - DNA, 25 bp, Mus musculus
cttgttctgggacgcactcttggct

SEQ ID NO: 923325 - DNA, 25 bp, Mus musculus
cttgttgcaagacaaccatccttcc

SEQ ID NO: 923326 - DNA, 25 bp, Mus musculus
cttgttgcaagagaaccatccttcc

SEQ ID NO: 923327 - DNA, 25 bp, Mus musculus
cttgttgctctgacgatcctgaccg

SEQ ID NO: 923328 - DNA, 25 bp, Mus musculus
cttgttgctctgtcgatcctgaccg

SEQ ID NO: 923329 - DNA, 25 bp, Mus musculus
cttgttggccaacgatgaacatgga

SEQ ID NO: 923330 - DNA, 25 bp, Mus musculus
cttgttggccaaggatgaacatgga

SEQ ID NO: 923331 - DNA, 25 bp, Mus musculus
cttgttgggagagaagtggttgctc

SEQ ID NO: 923332 - DNA, 25 bp, Mus musculus
cttgttgggagagatgtggttgctc

SEQ ID NO: 923333 - DNA, 25 bp, Mus musculus
cttgttgtaccccacgcattgggca

SEQ ID NO: 923334 - DNA, 25 bp, Mus musculus
cttgttgtaccccaggcattgggca

SEQ ID NO: 923335 - DNA, 25 bp, Mus musculus
cttgttgtcctgctgggtaccagag

SEQ ID NO: 923336 - DNA, 25 bp, Mus musculus
cttgttgtcctggtgggtaccagag

SEQ ID NO: 923337 - DNA, 25 bp, Mus musculus
cttgtttaagattgacgagtatgcc

SEQ ID NO: 923338 - DNA, 25 bp, Mus musculus
cttgtttaagtttgacgagtatgcc

SEQ ID NO: 923339 - DNA, 25 bp, Mus musculus
cttgtttcagcaaatggctgcagtc

SEQ ID NO: 923340 - DNA, 25 bp, Mus musculus
cttgtttcagcacttcctccatcag

SEQ ID NO: 923341 - DNA, 25 bp, Mus musculus
cttgtttcaggaaatggctgcagtc

SEQ ID NO: 923342 - DNA, 25 bp, Mus musculus
cttgtttcaggacttcctccatcag

SEQ ID NO: 923343 - DNA, 25 bp, Mus musculus
cttgtttgcactcatctgtttaccc

SEQ ID NO: 923344 - DNA, 25 bp, Mus musculus
cttgtttgcactgatctgtttaccc

SEQ ID NO: 923345 - DNA, 25 bp, Mus musculus
cttgtttgctatcatctctttcatt

SEQ ID NO: 923346 - DNA, 25 bp, Mus musculus
cttgtttgctatgatctctttcatt

SEQ ID NO: 923347 - DNA, 25 bp, Mus musculus
cttgttttcgggcggctgctgaatt

SEQ ID NO: 923348 - DNA, 25 bp, Mus musculus
cttgttttcggggggctgctgaatt

SEQ ID NO: 923349 - DNA, 25 bp, Mus musculus
ctttaaacaacaggctcaagatgtg

SEQ ID NO: 923350 - DNA, 25 bp, Mus musculus
ctttaaacaacgggcgcagagaaga

SEQ ID NO: 923351 - DNA, 25 bp, Mus musculus
ctttaaacaagaggctcaagatgtg

SEQ ID NO: 923352 - DNA, 25 bp, Mus musculus
ctttaaacaaggggcgcagagaaga

SEQ ID NO: 923353 - DNA, 25 bp, Mus musculus
ctttaaagaccaccagtcttgccag

SEQ ID NO: 923354 - DNA, 25 bp, Mus musculus
ctttaaagaccagcagtcttgccag

SEQ ID NO: 923355 - DNA, 25 bp, Mus musculus
ctttaaatgacaacaattgacatat

SEQ ID NO: 923356 - DNA, 25 bp, Mus musculus
ctttaaatgacatcaattgacatat

SEQ ID NO: 923357 - DNA, 25 bp, Mus musculus
ctttaagaacaacgacaacatccac

SEQ ID NO: 923358 - DNA, 25 bp, Mus musculus
ctttaagaacaactactgaaagtgc

SEQ ID NO: 923359 - DNA, 25 bp, Mus musculus
ctttaagaacaaggacaacatccac

SEQ ID NO: 923360 - DNA, 25 bp, Mus musculus
ctttaagaacaagtactgaaagtgc

SEQ ID NO: 923361 - DNA, 25 bp, Mus musculus
ctttaagcagctgctgctggtgagt

SEQ ID NO: 923362 - DNA, 25 bp, Mus musculus
ctttaagcaggtgctgctggtgagt

SEQ ID NO: 923363 - DNA, 25 bp, Mus musculus
ctttaaggattcctagatctcgagg

SEQ ID NO: 923364 - DNA, 25 bp, Mus musculus
ctttaaggattccttgatctcgagg

SEQ ID NO: 923365 - DNA, 25 bp, Mus musculus
ctttaagtcccacgcagagtggcgg

SEQ ID NO: 923366 - DNA, 25 bp, Mus musculus
ctttaagtcccaggcagagtggcgg

SEQ ID NO: 923367 - DNA, 25 bp, Mus musculus
ctttaatacccacgatgtattttat

SEQ ID NO: 923368 - DNA, 25 bp, Mus musculus
ctttaatacccaggatgtattttat

SEQ ID NO: 923369 - DNA, 25 bp, Mus musculus
ctttaatgctatttacagtgtggtt

SEQ ID NO: 923370 - DNA, 25 bp, Mus musculus
ctttaatgctttttacagtgtggtt

SEQ ID NO: 923371 - DNA, 25 bp, Mus musculus
ctttaattgacacattagctttatt

SEQ ID NO: 923372 - DNA, 25 bp, Mus musculus
ctttaattgacagattagctttatt

SEQ ID NO: 923373 - DNA, 25 bp, Mus musculus
ctttacaataagattacatctcgct

SEQ ID NO: 923374 - DNA, 25 bp, Mus musculus
ctttacaataagtttacatctcgct

SEQ ID NO: 923375 - DNA, 25 bp, Mus musculus
ctttacaatgctcacccctttggct

SEQ ID NO: 923376 - DNA, 25 bp, Mus musculus
ctttacaatgctcagccctttggct

SEQ ID NO: 923377 - DNA, 25 bp, Mus musculus
ctttacaggcgacatgatttttgat

SEQ ID NO: 923378 - DNA, 25 bp, Mus musculus
ctttacaggcgagatgatttttgat

SEQ ID NO: 923379 - DNA, 25 bp, Mus musculus
ctttacatttctagggcctgcaccc

SEQ ID NO: 923380 - DNA, 25 bp, Mus musculus
ctttacatttctgacggcctgcacc

SEQ ID NO: 923381 - DNA, 25 bp, Mus musculus
ctttacatttctgagggcctgcacc

SEQ ID NO: 923382 - DNA, 25 bp, Mus musculus
ctttacatttcttgggcctgcaccc

SEQ ID NO: 923383 - DNA, 25 bp, Mus musculus
ctttaccaagagctgggtcgacgag

SEQ ID NO: 923384 - DNA, 25 bp, Mus musculus
ctttaccaagtgctgggtcgacgag

SEQ ID NO: 923385 - DNA, 25 bp, Mus musculus
ctttacctcttcagcctctgtgttc

SEQ ID NO: 923386 - DNA, 25 bp, Mus musculus
ctttacctcttcaggctctgtgttc

SEQ ID NO: 923387 - DNA, 25 bp, Mus musculus
ctttactgacagcttttgcctacca

SEQ ID NO: 923388 - DNA, 25 bp, Mus musculus
ctttactgacaggttttgcctacca

SEQ ID NO: 923389 - DNA, 25 bp, Mus musculus
ctttacttctctggagtcaattgag

SEQ ID NO: 923390 - DNA, 25 bp, Mus musculus
ctttacttctgtggagtcaattgag

SEQ ID NO: 923391 - DNA, 25 bp, Mus musculus
ctttactttcaacatcaaagtggct

SEQ ID NO: 923392 - DNA, 25 bp, Mus musculus
ctttactttcaagatcaaagtggct

SEQ ID NO: 923393 - DNA, 25 bp, Mus musculus
ctttagaaagaaccatgtctgctgt

SEQ ID NO: 923394 - DNA, 25 bp, Mus musculus
ctttagaaagaagcatgtctgctgt

SEQ ID NO: 923395 - DNA, 25 bp, Mus musculus
ctttagaaccagaacagccaccaac

SEQ ID NO: 923396 - DNA, 25 bp, Mus musculus
ctttagaaccagaacatgccatctc

SEQ ID NO: 923397 - DNA, 25 bp, Mus musculus
ctttagaaccagaacgagcaccgta

SEQ ID NO: 923398 - DNA, 25 bp, Mus musculus
ctttagaaccagaagagccaccaac

SEQ ID NO: 923399 - DNA, 25 bp, Mus musculus
ctttagaaccagaagatgccatctc

SEQ ID NO: 923400 - DNA, 25 bp, Mus musculus
ctttagaaccagaaggagcaccgta

SEQ ID NO: 923401 - DNA, 25 bp, Mus musculus
ctttagaagaagagctctggatgtt

SEQ ID NO: 923402 - DNA, 25 bp, Mus musculus
ctttagaagaagtgctctggatgtt

SEQ ID NO: 923403 - DNA, 25 bp, Mus musculus
ctttagacagcgtgacagagaagca

SEQ ID NO: 923404 - DNA, 25 bp, Mus musculus
ctttagacagggtgacagagaagca

SEQ ID NO: 923405 - DNA, 25 bp, Mus musculus
ctttagagggaacgattcgagcagt

SEQ ID NO: 923406 - DNA, 25 bp, Mus musculus
ctttagagggaaggattcgagcagt

SEQ ID NO: 923407 - DNA, 25 bp, Mus musculus
ctttagcaagagcatggtcaatacc

SEQ ID NO: 923408 - DNA, 25 bp, Mus musculus
ctttagcaagccccgcggccatgcc

SEQ ID NO: 923409 - DNA, 25 bp, Mus musculus
ctttagcaaggcccgcggccatgcc

SEQ ID NO: 923410 - DNA, 25 bp, Mus musculus
ctttagcaagtgcatggtcaatacc

SEQ ID NO: 923411 - DNA, 25 bp, Mus musculus
ctttagcactcggctaaagtatcct

SEQ ID NO: 923412 - DNA, 25 bp, Mus musculus
ctttagcactgggctaaagtatcct

SEQ ID NO: 923413 - DNA, 25 bp, Mus musculus
ctttagctccggcactgtggaggcg

SEQ ID NO: 923414 - DNA, 25 bp, Mus musculus
ctttagctccgggactgtggaggcg

SEQ ID NO: 923415 - DNA, 25 bp, Mus musculus
ctttaggtaaatgacatcatgattc

SEQ ID NO: 923416 - DNA, 25 bp, Mus musculus
ctttaggtaaatgagatcatgattc

SEQ ID NO: 923417 - DNA, 25 bp, Mus musculus
ctttagtcctcagacgccagttgtt

SEQ ID NO: 923418 - DNA, 25 bp, Mus musculus
ctttagtcctcagaggccagttgtt

SEQ ID NO: 923419 - DNA, 25 bp, Mus musculus
ctttagtgagaaccagaatggggag

SEQ ID NO: 923420 - DNA, 25 bp, Mus musculus
ctttagtgagcagtaccagaatggg

SEQ ID NO: 923421 - DNA, 25 bp, Mus musculus
ctttagtgaggagtaccagaatggg

SEQ ID NO: 923422 - DNA, 25 bp, Mus musculus
ctttagtgagtaccagaatggggag

SEQ ID NO: 923423 - DNA, 25 bp, Mus musculus
ctttagttgacccacgccctgattt

SEQ ID NO: 923424 - DNA, 25 bp, Mus musculus
ctttagttgacccaggccctgattt

SEQ ID NO: 923425 - DNA, 25 bp, Mus musculus
ctttataaaaatctgctgtatcttg

SEQ ID NO: 923426 - DNA, 25 bp, Mus musculus
ctttataaaaatgtgctgtatcttg

SEQ ID NO: 923427 - DNA, 25 bp, Mus musculus
ctttataatgatagtccttggatgt

SEQ ID NO: 923428 - DNA, 25 bp, Mus musculus
ctttataatgattgtccttggatgt

SEQ ID NO: 923429 - DNA, 25 bp, Mus musculus
ctttatatatgacggttaccaaggc

SEQ ID NO: 923430 - DNA, 25 bp, Mus musculus
ctttatatatgagggttaccaaggc

SEQ ID NO: 923431 - DNA, 25 bp, Mus musculus
ctttatcaaccagaagaaataccac

SEQ ID NO: 923432 - DNA, 25 bp, Mus musculus
ctttatcaacgagaagaaataccac

SEQ ID NO: 923433 - DNA, 25 bp, Mus musculus
ctttatcaatctgctggagaacttc

SEQ ID NO: 923434 - DNA, 25 bp, Mus musculus
ctttatcaatgtgctggagaacttc

SEQ ID NO: 923435 - DNA, 25 bp, Mus musculus
ctttatcagaaacgtgttcctggtg

SEQ ID NO: 923436 - DNA, 25 bp, Mus musculus
ctttatcagaaaggtgttcctggtg

SEQ ID NO: 923437 - DNA, 25 bp, Mus musculus
ctttatccagtcccccctcccagag

SEQ ID NO: 923438 - DNA, 25 bp, Mus musculus
ctttatccagtccccttctccttgc

SEQ ID NO: 923439 - DNA, 25 bp, Mus musculus
ctttatccagtcgcccctcccagag

SEQ ID NO: 923440 - DNA, 25 bp, Mus musculus
ctttatccagtcgccttctccttgc

SEQ ID NO: 923441 - DNA, 25 bp, Mus musculus
ctttatctagcagacgaccgaaata

SEQ ID NO: 923442 - DNA, 25 bp, Mus musculus
ctttatctaggagacgaccgaaata

SEQ ID NO: 923443 - DNA, 25 bp, Mus musculus
ctttatgaggatctatgatgcctat

SEQ ID NO: 923444 - DNA, 25 bp, Mus musculus
ctttatgaggatgtatgatgcctat

SEQ ID NO: 923445 - DNA, 25 bp, Mus musculus
ctttatgcttcacatcgccttgaag

SEQ ID NO: 923446 - DNA, 25 bp, Mus musculus
ctttatgcttcagatcgccttgaag

SEQ ID NO: 923447 - DNA, 25 bp, Mus musculus
ctttatgtcaaccttgcccccaagg

SEQ ID NO: 923448 - DNA, 25 bp, Mus musculus
ctttatgtcaacgttgcccccaagg

SEQ ID NO: 923449 - DNA, 25 bp, Mus musculus
ctttattacaagcgcgaactttcct

SEQ ID NO: 923450 - DNA, 25 bp, Mus musculus
ctttattacaagggcgaactttcct

SEQ ID NO: 923451 - DNA, 25 bp, Mus musculus
ctttattcagcctgacgtgtttcag

SEQ ID NO: 923452 - DNA, 25 bp, Mus musculus
ctttattcaggctgacgtgtttcag

SEQ ID NO: 923453 - DNA, 25 bp, Mus musculus
ctttatttgtctctctcttctcaca

SEQ ID NO: 923454 - DNA, 25 bp, Mus musculus
ctttatttgtctgtctcttctcaca

SEQ ID NO: 923455 - DNA, 25 bp, Mus musculus
ctttcaacagctcgtttccttctcc

SEQ ID NO: 923456 - DNA, 25 bp, Mus musculus
ctttcaacagctggtttccttctcc

SEQ ID NO: 923457 - DNA, 25 bp, Mus musculus
ctttcaagccctaattgctggcttt

SEQ ID NO: 923458 - DNA, 25 bp, Mus musculus
ctttcaagccgtaattgctggcttt

SEQ ID NO: 923459 - DNA, 25 bp, Mus musculus
ctttcaagtcaacaccttgtcgctc

SEQ ID NO: 923460 - DNA, 25 bp, Mus musculus
ctttcaagtcaagaccttgtcgctc

SEQ ID NO: 923461 - DNA, 25 bp, Mus musculus
ctttcaatggagagccgtgcagcgt

SEQ ID NO: 923462 - DNA, 25 bp, Mus musculus
ctttcaatggagtgccgtgcagcgt

SEQ ID NO: 923463 - DNA, 25 bp, Mus musculus
ctttcacagttgttccactctgata

SEQ ID NO: 923464 - DNA, 25 bp, Mus musculus
ctttcacagttgttgcactctgata

SEQ ID NO: 923465 - DNA, 25 bp, Mus musculus
ctttcaccagaaatacactgtgagc

SEQ ID NO: 923466 - DNA, 25 bp, Mus musculus
ctttcaccagtaatacactgtgagc

SEQ ID NO: 923467 - DNA, 25 bp, Mus musculus
ctttcaccatagagccaatcatcac

SEQ ID NO: 923468 - DNA, 25 bp, Mus musculus
ctttcaccatagtgccaatcatcac

SEQ ID NO: 923469 - DNA, 25 bp, Mus musculus
ctttcacgacagcgctgagtacctt

SEQ ID NO: 923470 - DNA, 25 bp, Mus musculus
ctttcacgacagggctgagtacctt

SEQ ID NO: 923471 - DNA, 25 bp, Mus musculus
ctttcagaaaaaagtctgctccagc

SEQ ID NO: 923472 - DNA, 25 bp, Mus musculus
ctttcagaaaaatgtctgctccagc

SEQ ID NO: 923473 - DNA, 25 bp, Mus musculus
ctttcagaacagagtggaagtcgga

SEQ ID NO: 923474 - DNA, 25 bp, Mus musculus
ctttcagaacagtgtggaagtcgga

SEQ ID NO: 923475 - DNA, 25 bp, Mus musculus
ctttcagaccaggcagcgagtacta

SEQ ID NO: 923476 - DNA, 25 bp, Mus musculus
ctttcagaccaggctgcgagtacta

SEQ ID NO: 923477 - DNA, 25 bp, Mus musculus
ctttcagaccagtgagccacagggt

SEQ ID NO: 923478 - DNA, 25 bp, Mus musculus
ctttcagaccagtgtgccacagggt

SEQ ID NO: 923479 - DNA, 25 bp, Mus musculus
ctttcagataagcttccgagaagtg

SEQ ID NO: 923480 - DNA, 25 bp, Mus musculus
ctttcagataaggttccgagaagtg

SEQ ID NO: 923481 - DNA, 25 bp, Mus musculus
ctttcagatcagaacctgcaagaag

SEQ ID NO: 923482 - DNA, 25 bp, Mus musculus
ctttcagatcagtacctgcaagaag

SEQ ID NO: 923483 - DNA, 25 bp, Mus musculus
ctttcagatcctcaccaagaacctg

SEQ ID NO: 923484 - DNA, 25 bp, Mus musculus
ctttcagatcctcagcaagaacctg

SEQ ID NO: 923485 - DNA, 25 bp, Mus musculus
ctttcagcagctggtgaaattaaaa

SEQ ID NO: 923486 - DNA, 25 bp, Mus musculus
ctttcagcaggtggtgaaattaaaa

SEQ ID NO: 923487 - DNA, 25 bp, Mus musculus
ctttcataagcccaattatacagat

SEQ ID NO: 923488 - DNA, 25 bp, Mus musculus
ctttcataaggccaattatacagat

SEQ ID NO: 923489 - DNA, 25 bp, Mus musculus
ctttcatcgacaaacacaacactgc

SEQ ID NO: 923490 - DNA, 25 bp, Mus musculus
ctttcatcgacaaagacaacactgc

SEQ ID NO: 923491 - DNA, 25 bp, Mus musculus
ctttcatctcagatgcctgcaaaac

SEQ ID NO: 923492 - DNA, 25 bp, Mus musculus
ctttcatctcagttgcctgcaaaac

SEQ ID NO: 923493 - DNA, 25 bp, Mus musculus
ctttcatgacaccacgacttcctcc

SEQ ID NO: 923494 - DNA, 25 bp, Mus musculus
ctttcatgacaccaggacttcctcc

SEQ ID NO: 923495 - DNA, 25 bp, Mus musculus
ctttcatgagaaaacgtattgttgg

SEQ ID NO: 923496 - DNA, 25 bp, Mus musculus
ctttcatgagaaaaggtattgttgg

SEQ ID NO: 923497 - DNA, 25 bp, Mus musculus
ctttcatgcacactggtgtggcccc

SEQ ID NO: 923498 - DNA, 25 bp, Mus musculus
ctttcatgcacagtggtgtggcccc

SEQ ID NO: 923499 - DNA, 25 bp, Mus musculus
ctttcatgtaagctggtttgtgatg

SEQ ID NO: 923500 - DNA, 25 bp, Mus musculus
ctttcatgtaaggtggtttgtgatg

SEQ ID NO: 923501 - DNA, 25 bp, Mus musculus
ctttccaaccagctcgctgaagcca

SEQ ID NO: 923502 - DNA, 25 bp, Mus musculus
ctttccaaccagctggctgaagcca

SEQ ID NO: 923503 - DNA, 25 bp, Mus musculus
ctttccactgctctcgctcgacttc

SEQ ID NO: 923504 - DNA, 25 bp, Mus musculus
ctttccactgctctggctcgacttc

SEQ ID NO: 923505 - DNA, 25 bp, Mus musculus
ctttccagaggccgccagcaggtgg

SEQ ID NO: 923506 - DNA, 25 bp, Mus musculus
ctttccagaggcggccagcaggtgg

SEQ ID NO: 923507 - DNA, 25 bp, Mus musculus
ctttccagctttgacatggctatga

SEQ ID NO: 923508 - DNA, 25 bp, Mus musculus
ctttccagctttgagatggctatga

SEQ ID NO: 923509 - DNA, 25 bp, Mus musculus
ctttcccaatctgccctacttaatt

SEQ ID NO: 923510 - DNA, 25 bp, Mus musculus
ctttcccaatgtgccctacttaatt

SEQ ID NO: 923511 - DNA, 25 bp, Mus musculus
ctttcccaggaccatagccagccct

SEQ ID NO: 923512 - DNA, 25 bp, Mus musculus
ctttcccaggaccgctactggcagg

SEQ ID NO: 923513 - DNA, 25 bp, Mus musculus
ctttcccaggacgatagccagccct

SEQ ID NO: 923514 - DNA, 25 bp, Mus musculus
ctttcccaggacggctactggcagg

SEQ ID NO: 923515 - DNA, 25 bp, Mus musculus
ctttcccatccacctggtgaagaca

SEQ ID NO: 923516 - DNA, 25 bp, Mus musculus
ctttcccatccagctggtgaagaca

SEQ ID NO: 923517 - DNA, 25 bp, Mus musculus
ctttccccagcccctccatgatgaa

SEQ ID NO: 923518 - DNA, 25 bp, Mus musculus
ctttccccaggccctccatgatgaa

SEQ ID NO: 923519 - DNA, 25 bp, Mus musculus
ctttcccgagaggtggatgtgttca

SEQ ID NO: 923520 - DNA, 25 bp, Mus musculus
ctttcccgagtggtggatgtgttca

SEQ ID NO: 923521 - DNA, 25 bp, Mus musculus
ctttcccgcaagagtgagtgtgtca

SEQ ID NO: 923522 - DNA, 25 bp, Mus musculus
ctttcccgcaagtgtgagtgtgtca

SEQ ID NO: 923523 - DNA, 25 bp, Mus musculus
ctttcccggaagcatattgaccagt

SEQ ID NO: 923524 - DNA, 25 bp, Mus musculus
ctttcccggaaggatattgaccagt

SEQ ID NO: 923525 - DNA, 25 bp, Mus musculus
ctttccctcaccagacacgcacccc

SEQ ID NO: 923526 - DNA, 25 bp, Mus musculus
ctttccctcagcagacacgcacccc

SEQ ID NO: 923527 - DNA, 25 bp, Mus musculus
ctttccgtttgcaacgtgacacgct

SEQ ID NO: 923528 - DNA, 25 bp, Mus musculus
ctttccgtttgcaaggtgacacgct

SEQ ID NO: 923529 - DNA, 25 bp, Mus musculus
ctttcctaacctgccctacttgatc

SEQ ID NO: 923530 - DNA, 25 bp, Mus musculus
ctttcctaacgtgccctacttgatc

SEQ ID NO: 923531 - DNA, 25 bp, Mus musculus
ctttcctggaaaattgttgtgtctg

SEQ ID NO: 923532 - DNA, 25 bp, Mus musculus
ctttcctggaaatttgttgtgtctg

SEQ ID NO: 923533 - DNA, 25 bp, Mus musculus
ctttcctggactaggtgacatgtat

SEQ ID NO: 923534 - DNA, 25 bp, Mus musculus
ctttcctggagtaggtgacatgtat

SEQ ID NO: 923535 - DNA, 25 bp, Mus musculus
ctttcctttcagccctcagggctgg

SEQ ID NO: 923536 - DNA, 25 bp, Mus musculus
ctttcctttcaggcctcagggctgg

SEQ ID NO: 923537 - DNA, 25 bp, Mus musculus
ctttctactatgattggtacagcct

SEQ ID NO: 923538 - DNA, 25 bp, Mus musculus
ctttctactatgtttggtacagcct

SEQ ID NO: 923539 - DNA, 25 bp, Mus musculus
ctttctactccgcccatggtgcgag

SEQ ID NO: 923540 - DNA, 25 bp, Mus musculus
ctttctactccggccatggtgcgag

SEQ ID NO: 923541 - DNA, 25 bp, Mus musculus
ctttctatagagctgggctcgtcga

SEQ ID NO: 923542 - DNA, 25 bp, Mus musculus
ctttctatagtgctgggctcgtcga

SEQ ID NO: 923543 - DNA, 25 bp, Mus musculus
ctttctcattaacgtaaatgaccgt

SEQ ID NO: 923544 - DNA, 25 bp, Mus musculus
ctttctcattaaggtaaatgaccgt

SEQ ID NO: 923545 - DNA, 25 bp, Mus musculus
ctttctcttacgatactgggagcag

SEQ ID NO: 923546 - DNA, 25 bp, Mus musculus
ctttctcttacgttactgggagcag

SEQ ID NO: 923547 - DNA, 25 bp, Mus musculus
ctttctgatcagctgttgtttgtgg

SEQ ID NO: 923548 - DNA, 25 bp, Mus musculus
ctttctgatcaggtgttgtttgtgg

SEQ ID NO: 923549 - DNA, 25 bp, Mus musculus
ctttctgatgctctgtcagacacac

SEQ ID NO: 923550 - DNA, 25 bp, Mus musculus
ctttctgatggtctgtcagacacac

SEQ ID NO: 923551 - DNA, 25 bp, Mus musculus
ctttctgcacttcacaaatgctacc

SEQ ID NO: 923552 - DNA, 25 bp, Mus musculus
ctttctgcacttcagaaatgctacc

SEQ ID NO: 923553 - DNA, 25 bp, Mus musculus
ctttctgctccaccaaggtgcagag

SEQ ID NO: 923554 - DNA, 25 bp, Mus musculus
ctttctgctccagcaaggtgcagag

SEQ ID NO: 923555 - DNA, 25 bp, Mus musculus
ctttctggaaagaatatccagttat

SEQ ID NO: 923556 - DNA, 25 bp, Mus musculus
ctttctggaaagtatatccagttat

SEQ ID NO: 923557 - DNA, 25 bp, Mus musculus
ctttctggagcgagttggtggaatg

SEQ ID NO: 923558 - DNA, 25 bp, Mus musculus
ctttctggagggagttggtggaatg

SEQ ID NO: 923559 - DNA, 25 bp, Mus musculus
ctttctggtacacgaccctgacgag

SEQ ID NO: 923560 - DNA, 25 bp, Mus musculus
ctttctggtacaggaccctgacgag

SEQ ID NO: 923561 - DNA, 25 bp, Mus musculus
ctttctgtccagactggaagaccag

SEQ ID NO: 923562 - DNA, 25 bp, Mus musculus
ctttctgtccagtctggaagaccag

SEQ ID NO: 923563 - DNA, 25 bp, Mus musculus
ctttctgtgaagaaaagacatgctc

SEQ ID NO: 923564 - DNA, 25 bp, Mus musculus
ctttctgtgaagtaaagacatgctc

SEQ ID NO: 923565 - DNA, 25 bp, Mus musculus
ctttcttaggcagcgagagggccag

SEQ ID NO: 923566 - DNA, 25 bp, Mus musculus
ctttcttagggagcgagagggccag

SEQ ID NO: 923567 - DNA, 25 bp, Mus musculus
ctttcttcacaacatctcccctaac

SEQ ID NO: 923568 - DNA, 25 bp, Mus musculus
ctttcttcacaagatctcccctaac

SEQ ID NO: 923569 - DNA, 25 bp, Mus musculus
ctttcttccgagaactggaggagtt

SEQ ID NO: 923570 - DNA, 25 bp, Mus musculus
ctttcttccgagtactggaggagtt

SEQ ID NO: 923571 - DNA, 25 bp, Mus musculus
ctttcttggacagaaagcagcaaaa

SEQ ID NO: 923572 - DNA, 25 bp, Mus musculus
ctttcttggagagaaagcagcaaaa

SEQ ID NO: 923573 - DNA, 25 bp, Mus musculus
ctttgaaaagctgttgaagagccat

SEQ ID NO: 923574 - DNA, 25 bp, Mus musculus
ctttgaaaaggtgttgaagagccat

SEQ ID NO: 923575 - DNA, 25 bp, Mus musculus
ctttgaaaccaacgcattctctgac

SEQ ID NO: 923576 - DNA, 25 bp, Mus musculus
ctttgaaaccaaggcattctctgac

SEQ ID NO: 923577 - DNA, 25 bp, Mus musculus
ctttgaacctttcgtcagaaagcat

SEQ ID NO: 923578 - DNA, 25 bp, Mus musculus
ctttgaacctttggtcagaaagcat

SEQ ID NO: 923579 - DNA, 25 bp, Mus musculus
ctttgaactgaaacaggcaccgctc

SEQ ID NO: 923580 - DNA, 25 bp, Mus musculus
ctttgaactgaaagcaccgctcctc

SEQ ID NO: 923581 - DNA, 25 bp, Mus musculus
ctttgaactgaatcaggcaccgctc

SEQ ID NO: 923582 - DNA, 25 bp, Mus musculus
ctttgaactgaatgcaccgctcctc

SEQ ID NO: 923583 - DNA, 25 bp, Mus musculus
ctttgaagagaattgttgtgtgatg

SEQ ID NO: 923584 - DNA, 25 bp, Mus musculus
ctttgaagagcacatggcccagtga

SEQ ID NO: 923585 - DNA, 25 bp, Mus musculus
ctttgaagagcacgttgcttccata

SEQ ID NO: 923586 - DNA, 25 bp, Mus musculus
ctttgaagagcagatggcccagtga

SEQ ID NO: 923587 - DNA, 25 bp, Mus musculus
ctttgaagagcaggttgcttccata

SEQ ID NO: 923588 - DNA, 25 bp, Mus musculus
ctttgaagagctgtgagtgttgagt

SEQ ID NO: 923589 - DNA, 25 bp, Mus musculus
ctttgaagaggtgtgagtgttgagt

SEQ ID NO: 923590 - DNA, 25 bp, Mus musculus
ctttgaagagtattgttgtgtgatg

SEQ ID NO: 923591 - DNA, 25 bp, Mus musculus
ctttgaagccagctgtttggccttg

SEQ ID NO: 923592 - DNA, 25 bp, Mus musculus
ctttgaagccaggtgtttggccttg

SEQ ID NO: 923593 - DNA, 25 bp, Mus musculus
ctttgaatacgtccacactgattta

SEQ ID NO: 923594 - DNA, 25 bp, Mus musculus
ctttgaatacgtgcacactgattta

SEQ ID NO: 923595 - DNA, 25 bp, Mus musculus
ctttgaatttttcaccccgtttgct

SEQ ID NO: 923596 - DNA, 25 bp, Mus musculus
ctttgaatttttcagcccgtttgct

SEQ ID NO: 923597 - DNA, 25 bp, Mus musculus
ctttgacaaagccacctaccgagtc

SEQ ID NO: 923598 - DNA, 25 bp, Mus musculus
ctttgacaaagccagctaccgagtc

SEQ ID NO: 923599 - DNA, 25 bp, Mus musculus
ctttgacaagcatgggaatggctat

SEQ ID NO: 923600 - DNA, 25 bp, Mus musculus
ctttgacaaggatgggaatggctat

SEQ ID NO: 923601 - DNA, 25 bp, Mus musculus
ctttgaccatgccgatccttccatt

SEQ ID NO: 923602 - DNA, 25 bp, Mus musculus
ctttgaccatgcggatccttccatt

SEQ ID NO: 923603 - DNA, 25 bp, Mus musculus
ctttgacctgaaccccgagaacatc

SEQ ID NO: 923604 - DNA, 25 bp, Mus musculus
ctttgacctgaagcccgagaacatc

SEQ ID NO: 923605 - DNA, 25 bp, Mus musculus
ctttgactgtcacgaacatgacatt

SEQ ID NO: 923606 - DNA, 25 bp, Mus musculus
ctttgactgtcaggaacatgacatt

SEQ ID NO: 923607 - DNA, 25 bp, Mus musculus
ctttgagcagctcagattgctgatg

SEQ ID NO: 923608 - DNA, 25 bp, Mus musculus
ctttgagcaggtcagattgctgatg

SEQ ID NO: 923609 - DNA, 25 bp, Mus musculus
ctttgagtacaagaagaatcgcggc

SEQ ID NO: 923610 - DNA, 25 bp, Mus musculus
ctttgagtacaagatgaatcgcggc

SEQ ID NO: 923611 - DNA, 25 bp, Mus musculus
ctttgagtacagctgatttgaactg

SEQ ID NO: 923612 - DNA, 25 bp, Mus musculus
ctttgagtacaggtgatttgaactg

SEQ ID NO: 923613 - DNA, 25 bp, Mus musculus
ctttgatcagctggtaaagacgatt

SEQ ID NO: 923614 - DNA, 25 bp, Mus musculus
ctttgatcaggtggtaaagacgatt

SEQ ID NO: 923615 - DNA, 25 bp, Mus musculus
ctttgatgagatatgtgtcacaaag

SEQ ID NO: 923616 - DNA, 25 bp, Mus musculus
ctttgatgagttatgtgtcacaaag

SEQ ID NO: 923617 - DNA, 25 bp, Mus musculus
ctttgatgatctattggatgataca

SEQ ID NO: 923618 - DNA, 25 bp, Mus musculus
ctttgatgatcttttggatgataca

SEQ ID NO: 923619 - DNA, 25 bp, Mus musculus
ctttgatgatgcggcatgctgggat

SEQ ID NO: 923620 - DNA, 25 bp, Mus musculus
ctttgatgatgcgggatgctgggat

SEQ ID NO: 923621 - DNA, 25 bp, Mus musculus
ctttgatgtggactgcaaagaaggc

SEQ ID NO: 923622 - DNA, 25 bp, Mus musculus
ctttgatgtggagtgcaaagaaggc

SEQ ID NO: 923623 - DNA, 25 bp, Mus musculus
ctttgatgtggcatcgttcctgacg

SEQ ID NO: 923624 - DNA, 25 bp, Mus musculus
ctttgatgtggcatggttcctgacg

SEQ ID NO: 923625 - DNA, 25 bp, Mus musculus
ctttgattagcacgcattacagcga

SEQ ID NO: 923626 - DNA, 25 bp, Mus musculus
ctttgattagcaggcattacagcga

SEQ ID NO: 923627 - DNA, 25 bp, Mus musculus
ctttgattcactagagtcttgcaaa

SEQ ID NO: 923628 - DNA, 25 bp, Mus musculus
ctttgattcacttgagtcttgcaaa

SEQ ID NO: 923629 - DNA, 25 bp, Mus musculus
ctttgattccagctttgatgttcac

SEQ ID NO: 923630 - DNA, 25 bp, Mus musculus
ctttgattccaggtttgatgttcac

SEQ ID NO: 923631 - DNA, 25 bp, Mus musculus
ctttgcaagtcacgccgtctactgt

SEQ ID NO: 923632 - DNA, 25 bp, Mus musculus
ctttgcaagtcaggccgtctactgt

SEQ ID NO: 923633 - DNA, 25 bp, Mus musculus
ctttgcacaaatacacactctccat

SEQ ID NO: 923634 - DNA, 25 bp, Mus musculus
ctttgcacaaattcacactctccat

SEQ ID NO: 923635 - DNA, 25 bp, Mus musculus
ctttgcacagaactggtgcatcaag

SEQ ID NO: 923636 - DNA, 25 bp, Mus musculus
ctttgcacagtactggtgcatcaag

SEQ ID NO: 923637 - DNA, 25 bp, Mus musculus
ctttgcagagaactatcttcctgca

SEQ ID NO: 923638 - DNA, 25 bp, Mus musculus
ctttgcagagaagtatcttcctgca

SEQ ID NO: 923639 - DNA, 25 bp, Mus musculus
ctttgcagagccaggcagggtgcca

SEQ ID NO: 923640 - DNA, 25 bp, Mus musculus
ctttgcagagcctggcagggtgcca

SEQ ID NO: 923641 - DNA, 25 bp, Mus musculus
ctttgcagatggaaagatgacatcg

SEQ ID NO: 923642 - DNA, 25 bp, Mus musculus
ctttgcagatggaatgatgacatcg

SEQ ID NO: 923643 - DNA, 25 bp, Mus musculus
ctttgccaaccactccgagaaagat

SEQ ID NO: 923644 - DNA, 25 bp, Mus musculus
ctttgccaaccagtccgagaaagat

SEQ ID NO: 923645 - DNA, 25 bp, Mus musculus
ctttgccaagcctgaactcacggat

SEQ ID NO: 923646 - DNA, 25 bp, Mus musculus
ctttgccaaggctgaactcacggat

SEQ ID NO: 923647 - DNA, 25 bp, Mus musculus
ctttgccatatctccgctgatatac

SEQ ID NO: 923648 - DNA, 25 bp, Mus musculus
ctttgccatatctcggctgatatac

SEQ ID NO: 923649 - DNA, 25 bp, Mus musculus
ctttgcccagctcctgggctgtttg

SEQ ID NO: 923650 - DNA, 25 bp, Mus musculus
ctttgcccagctgtggtgtgggacc

SEQ ID NO: 923651 - DNA, 25 bp, Mus musculus
ctttgcccaggtcctgggctgtttg

SEQ ID NO: 923652 - DNA, 25 bp, Mus musculus
ctttgcccaggtgtggtgtgggacc

SEQ ID NO: 923653 - DNA, 25 bp, Mus musculus
ctttgccgcccaccaggtgcccacc

SEQ ID NO: 923654 - DNA, 25 bp, Mus musculus
ctttgccgcccagcaggtgcccacc

SEQ ID NO: 923655 - DNA, 25 bp, Mus musculus
ctttgcctctctggagcagttctgg

SEQ ID NO: 923656 - DNA, 25 bp, Mus musculus
ctttgcctctgtggagcagttctgg

SEQ ID NO: 923657 - DNA, 25 bp, Mus musculus
ctttgcctgtcagtcccaggtcctg

SEQ ID NO: 923658 - DNA, 25 bp, Mus musculus
ctttgcctgtcagtgccaggtcctg

SEQ ID NO: 923659 - DNA, 25 bp, Mus musculus
ctttgcgattctaccaagacttcca

SEQ ID NO: 923660 - DNA, 25 bp, Mus musculus
ctttgcgattgtaccaagacttcca

SEQ ID NO: 923661 - DNA, 25 bp, Mus musculus
ctttgcgctgtatacaatgcggggt

SEQ ID NO: 923662 - DNA, 25 bp, Mus musculus
ctttgcgctgtatagaatgcggggt

SEQ ID NO: 923663 - DNA, 25 bp, Mus musculus
ctttgctcggaatgcgaaccctaat

SEQ ID NO: 923664 - DNA, 25 bp, Mus musculus
ctttgctcggaatgggaaccctaat

SEQ ID NO: 923665 - DNA, 25 bp, Mus musculus
ctttgctgacaaccggtttgctcgg

SEQ ID NO: 923666 - DNA, 25 bp, Mus musculus
ctttgctgacaagcggtttgctcgg

SEQ ID NO: 923667 - DNA, 25 bp, Mus musculus
ctttgctgagcaccggtactatggg

SEQ ID NO: 923668 - DNA, 25 bp, Mus musculus
ctttgctgagcagcggtactatggg

SEQ ID NO: 923669 - DNA, 25 bp, Mus musculus
ctttgctgtgaaaaatgaaaaacgg

SEQ ID NO: 923670 - DNA, 25 bp, Mus musculus
ctttgctgtggacgcagtggagcgg

SEQ ID NO: 923671 - DNA, 25 bp, Mus musculus
ctttgctgtggaggcagtggagcgg

SEQ ID NO: 923672 - DNA, 25 bp, Mus musculus
ctttgctgtgtaaaatgaaaaacgg

SEQ ID NO: 923673 - DNA, 25 bp, Mus musculus
ctttgcttgaatcggcctgtgtttt

SEQ ID NO: 923674 - DNA, 25 bp, Mus musculus
ctttgcttgaatgggcctgtgtttt

SEQ ID NO: 923675 - DNA, 25 bp, Mus musculus
ctttggaaaacttgctgtggttcca

SEQ ID NO: 923676 - DNA, 25 bp, Mus musculus
ctttggaaaagttgctgtggttcca

SEQ ID NO: 923677 - DNA, 25 bp, Mus musculus
ctttggacagaaaatcaccgtgctg

SEQ ID NO: 923678 - DNA, 25 bp, Mus musculus
ctttggacagcatattgactagact

SEQ ID NO: 923679 - DNA, 25 bp, Mus musculus
ctttggacaggatattgactagact

SEQ ID NO: 923680 - DNA, 25 bp, Mus musculus
ctttggacagtaaatcaccgtgctg

SEQ ID NO: 923681 - DNA, 25 bp, Mus musculus
ctttggagagatagaaaatattgag

SEQ ID NO: 923682 - DNA, 25 bp, Mus musculus
ctttggagagctcaaagagaagcac

SEQ ID NO: 923683 - DNA, 25 bp, Mus musculus
ctttggagaggtcaaagagaagcac

SEQ ID NO: 923684 - DNA, 25 bp, Mus musculus
ctttggagagttagaaaatattgag

SEQ ID NO: 923685 - DNA, 25 bp, Mus musculus
ctttggaggttcagggacagcaact

SEQ ID NO: 923686 - DNA, 25 bp, Mus musculus
ctttggaggttctgggacagcaact

SEQ ID NO: 923687 - DNA, 25 bp, Mus musculus
ctttggcaagctgctgctggcagag

SEQ ID NO: 923688 - DNA, 25 bp, Mus musculus
ctttggcaaggtgctgctggcagag

SEQ ID NO: 923689 - DNA, 25 bp, Mus musculus
ctttggcatcaaggagacatcaaca

SEQ ID NO: 923690 - DNA, 25 bp, Mus musculus
ctttggcatcaaggtgacatcaaca

SEQ ID NO: 923691 - DNA, 25 bp, Mus musculus
ctttggcatgaacattccctcaggt

SEQ ID NO: 923692 - DNA, 25 bp, Mus musculus
ctttggcatgaagattccctcaggt

SEQ ID NO: 923693 - DNA, 25 bp, Mus musculus
ctttggccagcaggagttgcaggcc

SEQ ID NO: 923694 - DNA, 25 bp, Mus musculus
ctttggccagccttacagttcctcc

SEQ ID NO: 923695 - DNA, 25 bp, Mus musculus
ctttggccaggaggagttgcaggcc

SEQ ID NO: 923696 - DNA, 25 bp, Mus musculus
ctttggccaggcttacagttcctcc

SEQ ID NO: 923697 - DNA, 25 bp, Mus musculus
ctttggcttgcccactgtgtgcatt

SEQ ID NO: 923698 - DNA, 25 bp, Mus musculus
ctttggcttgcgctttattgcagcc

SEQ ID NO: 923699 - DNA, 25 bp, Mus musculus
ctttggcttgcggtttattgcagcc

SEQ ID NO: 923700 - DNA, 25 bp, Mus musculus
ctttggcttggccactgtgtgcatt

SEQ ID NO: 923701 - DNA, 25 bp, Mus musculus
ctttggcttttaatcatctagtgaa

SEQ ID NO: 923702 - DNA, 25 bp, Mus musculus
ctttggcttttaatgatctagtgaa

SEQ ID NO: 923703 - DNA, 25 bp, Mus musculus
ctttgggaagccgacagacttatta

SEQ ID NO: 923704 - DNA, 25 bp, Mus musculus
ctttgggaagcgcctgctgaacgag

SEQ ID NO: 923705 - DNA, 25 bp, Mus musculus
ctttgggaaggcgacagacttatta

SEQ ID NO: 923706 - DNA, 25 bp, Mus musculus
ctttgggaagggcctgctgaacgag

SEQ ID NO: 923707 - DNA, 25 bp, Mus musculus
ctttgggcttctagtgtccattgtc

SEQ ID NO: 923708 - DNA, 25 bp, Mus musculus
ctttgggcttcttgtgtccattgtc

SEQ ID NO: 923709 - DNA, 25 bp, Mus musculus
ctttggggatgcccctgcctccctg

SEQ ID NO: 923710 - DNA, 25 bp, Mus musculus
ctttggggatgcgcctgcctccctg

SEQ ID NO: 923711 - DNA, 25 bp, Mus musculus
ctttggtaaaatatcggatgcccgg

SEQ ID NO: 923712 - DNA, 25 bp, Mus musculus
ctttggtaaaatatgggatgcccgg

SEQ ID NO: 923713 - DNA, 25 bp, Mus musculus
ctttggtagactctggctggaggcg

SEQ ID NO: 923714 - DNA, 25 bp, Mus musculus
ctttggtagactgtggctggaggcg

SEQ ID NO: 923715 - DNA, 25 bp, Mus musculus
ctttggtgacatcacacttgaagaa

SEQ ID NO: 923716 - DNA, 25 bp, Mus musculus
ctttggtgacatgacacttgaagaa

SEQ ID NO: 923717 - DNA, 25 bp, Mus musculus
ctttggtgtgccatattcccacatg

SEQ ID NO: 923718 - DNA, 25 bp, Mus musculus
ctttggtgtggcatattcccacatg

SEQ ID NO: 923719 - DNA, 25 bp, Mus musculus
ctttgtaacaccactgagggtggac

SEQ ID NO: 923720 - DNA, 25 bp, Mus musculus
ctttgtaacagcactgagggtggac

SEQ ID NO: 923721 - DNA, 25 bp, Mus musculus
ctttgtacagcatgagaaaggtgct

SEQ ID NO: 923722 - DNA, 25 bp, Mus musculus
ctttgtacaggatgagaaaggtgct

SEQ ID NO: 923723 - DNA, 25 bp, Mus musculus
ctttgtagaccaaagcccatggcct

SEQ ID NO: 923724 - DNA, 25 bp, Mus musculus
ctttgtagaccaagtggtgtctacc

SEQ ID NO: 923725 - DNA, 25 bp, Mus musculus
ctttgtagaccatagcccatggcct

SEQ ID NO: 923726 - DNA, 25 bp, Mus musculus
ctttgtagaccatgtggtgtctacc

SEQ ID NO: 923727 - DNA, 25 bp, Mus musculus
ctttgtagtgaaggcagaggtacag

SEQ ID NO: 923728 - DNA, 25 bp, Mus musculus
ctttgtagtgaagggagaggtacag

SEQ ID NO: 923729 - DNA, 25 bp, Mus musculus
ctttgtatctctcctggaaagaaat

SEQ ID NO: 923730 - DNA, 25 bp, Mus musculus
ctttgtatctgtcctggaaagaaat

SEQ ID NO: 923731 - DNA, 25 bp, Mus musculus
ctttgtcaagaacctacatggacgc

SEQ ID NO: 923732 - DNA, 25 bp, Mus musculus
ctttgtcaagatgagctcagggacc

SEQ ID NO: 923733 - DNA, 25 bp, Mus musculus
ctttgtcaagcgctggggagcagag

SEQ ID NO: 923734 - DNA, 25 bp, Mus musculus
ctttgtcaagctctggctgaaaccg

SEQ ID NO: 923735 - DNA, 25 bp, Mus musculus
ctttgtcaagctgtggctgaaaccg

SEQ ID NO: 923736 - DNA, 25 bp, Mus musculus
ctttgtcaagggctggggagcagag

SEQ ID NO: 923737 - DNA, 25 bp, Mus musculus
ctttgtcaagtacctacatggacgc

SEQ ID NO: 923738 - DNA, 25 bp, Mus musculus
ctttgtcaagttgagctcagggacc

SEQ ID NO: 923739 - DNA, 25 bp, Mus musculus
ctttgtcaggcatgccaaagccctg

SEQ ID NO: 923740 - DNA, 25 bp, Mus musculus
ctttgtcagggatgccaaagccctg

SEQ ID NO: 923741 - DNA, 25 bp, Mus musculus
ctttgtcatagccacgtttagtccc

SEQ ID NO: 923742 - DNA, 25 bp, Mus musculus
ctttgtcatagccaggtttagtccc

SEQ ID NO: 923743 - DNA, 25 bp, Mus musculus
ctttgtccagctggacactctttcc

SEQ ID NO: 923744 - DNA, 25 bp, Mus musculus
ctttgtccaggtggacactctttcc

SEQ ID NO: 923745 - DNA, 25 bp, Mus musculus
ctttgtcctaagattagcctcacag

SEQ ID NO: 923746 - DNA, 25 bp, Mus musculus
ctttgtcctaagtttagcctcacag

SEQ ID NO: 923747 - DNA, 25 bp, Mus musculus
ctttgtcgctatgtagatgccggac

SEQ ID NO: 923748 - DNA, 25 bp, Mus musculus
ctttgtcgctcaagatgtagatgcc

SEQ ID NO: 923749 - DNA, 25 bp, Mus musculus
ctttgtcgctgaagatgtagatgcc

SEQ ID NO: 923750 - DNA, 25 bp, Mus musculus
ctttgtcgctttgtagatgccggac

SEQ ID NO: 923751 - DNA, 25 bp, Mus musculus
ctttgtctcaagattgccagcgagc

SEQ ID NO: 923752 - DNA, 25 bp, Mus musculus
ctttgtctcaagtttgccagcgagc

SEQ ID NO: 923753 - DNA, 25 bp, Mus musculus
ctttgtctccagatcatctgacaaa

SEQ ID NO: 923754 - DNA, 25 bp, Mus musculus
ctttgtctccagttcatctgacaaa

SEQ ID NO: 923755 - DNA, 25 bp, Mus musculus
ctttgtctggaagcggcctctggag

SEQ ID NO: 923756 - DNA, 25 bp, Mus musculus
ctttgtctggtagcggcctctggag

SEQ ID NO: 923757 - DNA, 25 bp, Mus musculus
ctttgtgaaaatcctgagtcgctat

SEQ ID NO: 923758 - DNA, 25 bp, Mus musculus
ctttgtgaaattcctgagtcgctat

SEQ ID NO: 923759 - DNA, 25 bp, Mus musculus
ctttgtgacgaactctacagtagag

SEQ ID NO: 923760 - DNA, 25 bp, Mus musculus
ctttgtgacgtactctacagtagag

SEQ ID NO: 923761 - DNA, 25 bp, Mus musculus
ctttgtgagtcgtttgtacacctta

SEQ ID NO: 923762 - DNA, 25 bp, Mus musculus
ctttgtgagtggtttgtacacctta

SEQ ID NO: 923763 - DNA, 25 bp, Mus musculus
ctttgtgcagaggctcgtgggtttc

SEQ ID NO: 923764 - DNA, 25 bp, Mus musculus
ctttgtgcagagtgtcatgccatac

SEQ ID NO: 923765 - DNA, 25 bp, Mus musculus
ctttgtgcagctcccagccagctca

SEQ ID NO: 923766 - DNA, 25 bp, Mus musculus
ctttgtgcaggtcccagccagctca

SEQ ID NO: 923767 - DNA, 25 bp, Mus musculus
ctttgtgcagtggctcgtgggtttc

SEQ ID NO: 923768 - DNA, 25 bp, Mus musculus
ctttgtgcagtgtgtcatgccatac

SEQ ID NO: 923769 - DNA, 25 bp, Mus musculus
ctttgtgctgagcatgaacaaggca

SEQ ID NO: 923770 - DNA, 25 bp, Mus musculus
ctttgtgctgaggatgaacaaggca

SEQ ID NO: 923771 - DNA, 25 bp, Mus musculus
ctttgtgttgaacgtgcaggaccag

SEQ ID NO: 923772 - DNA, 25 bp, Mus musculus
ctttgtgttgaaggtgcaggaccag

SEQ ID NO: 923773 - DNA, 25 bp, Mus musculus
ctttgttcgaataaatgctgctcat

SEQ ID NO: 923774 - DNA, 25 bp, Mus musculus
ctttgttcgaattaatgctgctcat

SEQ ID NO: 923775 - DNA, 25 bp, Mus musculus
ctttgttctctgccattggctacgc

SEQ ID NO: 923776 - DNA, 25 bp, Mus musculus
ctttgttctctggcattggctacgc

SEQ ID NO: 923777 - DNA, 25 bp, Mus musculus
ctttgtttacagctgatgttgccaa

SEQ ID NO: 923778 - DNA, 25 bp, Mus musculus
ctttgtttacaggtgatgttgccaa

SEQ ID NO: 923779 - DNA, 25 bp, Mus musculus
ctttgtttttagcctgcagccggaa

SEQ ID NO: 923780 - DNA, 25 bp, Mus musculus
ctttgtttttaggctgcagccggaa

SEQ ID NO: 923781 - DNA, 25 bp, Mus musculus
cttttaaagtttgacgtgggatgtg

SEQ ID NO: 923782 - DNA, 25 bp, Mus musculus
cttttaaagtttgaggtgggatgtg

SEQ ID NO: 923783 - DNA, 25 bp, Mus musculus
cttttaaatcactagtttggtgcct

SEQ ID NO: 923784 - DNA, 25 bp, Mus musculus
cttttaaatctctagtttggtgcct

SEQ ID NO: 923785 - DNA, 25 bp, Mus musculus
cttttaaccagaaacgtgatctgta

SEQ ID NO: 923786 - DNA, 25 bp, Mus musculus
cttttaaccagaaaggtgatctgta

SEQ ID NO: 923787 - DNA, 25 bp, Mus musculus
cttttacaagcttcaaaaccgctat

SEQ ID NO: 923788 - DNA, 25 bp, Mus musculus
cttttacaaggttcaaaaccgctat

SEQ ID NO: 923789 - DNA, 25 bp, Mus musculus
cttttacatgtgatctgagttctac

SEQ ID NO: 923790 - DNA, 25 bp, Mus musculus
cttttacatgtgatgtgagttctac

SEQ ID NO: 923791 - DNA, 25 bp, Mus musculus
cttttagcccagatagtcgccacat

SEQ ID NO: 923792 - DNA, 25 bp, Mus musculus
cttttagcccagttagtcgccacat

SEQ ID NO: 923793 - DNA, 25 bp, Mus musculus
cttttatacggctcccagacaccaa

SEQ ID NO: 923794 - DNA, 25 bp, Mus musculus
cttttatacggctcgcagacaccaa

SEQ ID NO: 923795 - DNA, 25 bp, Mus musculus
cttttatcctgtcgtgtgagtgttg

SEQ ID NO: 923796 - DNA, 25 bp, Mus musculus
cttttatcctgtggtgtgagtgttg

SEQ ID NO: 923797 - DNA, 25 bp, Mus musculus
cttttatgagcacgctataactact

SEQ ID NO: 923798 - DNA, 25 bp, Mus musculus
cttttatgagcaggctataactact

SEQ ID NO: 923799 - DNA, 25 bp, Mus musculus
cttttcacaaagctcatgatctcac

SEQ ID NO: 923800 - DNA, 25 bp, Mus musculus
cttttcacaatgctcatgatctcac

SEQ ID NO: 923801 - DNA, 25 bp, Mus musculus
cttttcagccagcaagagctttctg

SEQ ID NO: 923802 - DNA, 25 bp, Mus musculus
cttttcagccaggaagagctttctg

SEQ ID NO: 923803 - DNA, 25 bp, Mus musculus
cttttcataatgaatggtagccgaa

SEQ ID NO: 923804 - DNA, 25 bp, Mus musculus
cttttcataatgtatggtagccgaa

SEQ ID NO: 923805 - DNA, 25 bp, Mus musculus
cttttcccctgaagcattgaaaaag

SEQ ID NO: 923806 - DNA, 25 bp, Mus musculus
cttttcccctgaagccaatcatctg

SEQ ID NO: 923807 - DNA, 25 bp, Mus musculus
cttttcccctgaaggattgaaaaag

SEQ ID NO: 923808 - DNA, 25 bp, Mus musculus
cttttcccctgaaggcaatcatctg

SEQ ID NO: 923809 - DNA, 25 bp, Mus musculus
cttttcctacattacctttgctttg

SEQ ID NO: 923810 - DNA, 25 bp, Mus musculus
cttttcctacattagctttgctttg

SEQ ID NO: 923811 - DNA, 25 bp, Mus musculus
cttttcctgcaactgtgtggctggc

SEQ ID NO: 923812 - DNA, 25 bp, Mus musculus
cttttcctgcaagtgtgtggctggc

SEQ ID NO: 923813 - DNA, 25 bp, Mus musculus
cttttccttattcacgggatgtttg

SEQ ID NO: 923814 - DNA, 25 bp, Mus musculus
cttttccttattcaggggatgtttg

SEQ ID NO: 923815 - DNA, 25 bp, Mus musculus
cttttccttcaacacatccagtctg

SEQ ID NO: 923816 - DNA, 25 bp, Mus musculus
cttttccttcaacagatccagtctg

SEQ ID NO: 923817 - DNA, 25 bp, Mus musculus
cttttcgatgtgaacagttgttgga

SEQ ID NO: 923818 - DNA, 25 bp, Mus musculus
cttttcgatgtgaagagttgttgga

SEQ ID NO: 923819 - DNA, 25 bp, Mus musculus
cttttcgcagaagccacagaagagg

SEQ ID NO: 923820 - DNA, 25 bp, Mus musculus
cttttcgcagtagccacagaagagg

SEQ ID NO: 923821 - DNA, 25 bp, Mus musculus
cttttctacaagcctcctgagccga

SEQ ID NO: 923822 - DNA, 25 bp, Mus musculus
cttttctacaaggctcctgagccga

SEQ ID NO: 923823 - DNA, 25 bp, Mus musculus
cttttctccaggcttcagataaacc

SEQ ID NO: 923824 - DNA, 25 bp, Mus musculus
cttttctccagggttcagataaacc

SEQ ID NO: 923825 - DNA, 25 bp, Mus musculus
cttttctgcgcttgatccaaaagat

SEQ ID NO: 923826 - DNA, 25 bp, Mus musculus
cttttctgcggttgatccaaaagat

SEQ ID NO: 923827 - DNA, 25 bp, Mus musculus
cttttgaaagagtggagcagatgag

SEQ ID NO: 923828 - DNA, 25 bp, Mus musculus
cttttgaaagtgtggagcagatgag

SEQ ID NO: 923829 - DNA, 25 bp, Mus musculus
cttttgaaggtgaattcttcaaaga

SEQ ID NO: 923830 - DNA, 25 bp, Mus musculus
cttttgaaggtgtattcttcaaaga

SEQ ID NO: 923831 - DNA, 25 bp, Mus musculus
cttttgacacttaacggctacttga

SEQ ID NO: 923832 - DNA, 25 bp, Mus musculus
cttttgacacttaagggctacttga

SEQ ID NO: 923833 - DNA, 25 bp, Mus musculus
cttttgccaaagagataccgatggc

SEQ ID NO: 923834 - DNA, 25 bp, Mus musculus
cttttgccaaagtgataccgatggc

SEQ ID NO: 923835 - DNA, 25 bp, Mus musculus
cttttgccaaagttcataccgatgg

SEQ ID NO: 923836 - DNA, 25 bp, Mus musculus
cttttgccaaagttgataccgatgg

SEQ ID NO: 923837 - DNA, 25 bp, Mus musculus
cttttgccagacaagcagtgaaacc

SEQ ID NO: 923838 - DNA, 25 bp, Mus musculus
cttttgccagctgatggaaaacgtg

SEQ ID NO: 923839 - DNA, 25 bp, Mus musculus
cttttgccaggtgatggaaaacgtg

SEQ ID NO: 923840 - DNA, 25 bp, Mus musculus
cttttgccagtcaagcagtgaaacc

SEQ ID NO: 923841 - DNA, 25 bp, Mus musculus
cttttggaacaaaaaagatcgtggc

SEQ ID NO: 923842 - DNA, 25 bp, Mus musculus
cttttggaacaaaatagatcgtggc

SEQ ID NO: 923843 - DNA, 25 bp, Mus musculus
cttttggagattcgggcctgtgttt

SEQ ID NO: 923844 - DNA, 25 bp, Mus musculus
cttttggagattggggcctgtgttt

SEQ ID NO: 923845 - DNA, 25 bp, Mus musculus
cttttggcaaggcttacaggagtaa

SEQ ID NO: 923846 - DNA, 25 bp, Mus musculus
cttttggcaagggttacaggagtaa

SEQ ID NO: 923847 - DNA, 25 bp, Mus musculus
cttttggtcatgaacaagcagaatt

SEQ ID NO: 923848 - DNA, 25 bp, Mus musculus
cttttggtcatgaacacatgtttaa

SEQ ID NO: 923849 - DNA, 25 bp, Mus musculus
cttttggtcatgaagaagcagaatt

SEQ ID NO: 923850 - DNA, 25 bp, Mus musculus
cttttggtcatgaagacatgtttaa

SEQ ID NO: 923851 - DNA, 25 bp, Mus musculus
cttttggtgtctctcggggccacat

SEQ ID NO: 923852 - DNA, 25 bp, Mus musculus
cttttggtgtctctgggggccacat

SEQ ID NO: 923853 - DNA, 25 bp, Mus musculus
cttttgtcagcgattcgataaacac

SEQ ID NO: 923854 - DNA, 25 bp, Mus musculus
cttttgtcagggattcgataaacac

SEQ ID NO: 923855 - DNA, 25 bp, Mus musculus
cttttgtgccagagaaagagagaga

SEQ ID NO: 923856 - DNA, 25 bp, Mus musculus
cttttgtgccagtgaaagagagaga

SEQ ID NO: 923857 - DNA, 25 bp, Mus musculus
cttttgtggaagcgatggtgaatga

SEQ ID NO: 923858 - DNA, 25 bp, Mus musculus
cttttgtggaagcgttggtgaatga

SEQ ID NO: 923859 - DNA, 25 bp, Mus musculus
cttttgtggacacgttggtttaatg

SEQ ID NO: 923860 - DNA, 25 bp, Mus musculus
cttttgtggacactatttttgaaca

SEQ ID NO: 923861 - DNA, 25 bp, Mus musculus
cttttgtggacaggttggtttaatg

SEQ ID NO: 923862 - DNA, 25 bp, Mus musculus
cttttgtggacagtatttttgaaca

SEQ ID NO: 923863 - DNA, 25 bp, Mus musculus
cttttgtgggcccacttggctttgg

SEQ ID NO: 923864 - DNA, 25 bp, Mus musculus
cttttgtgggcccagttggctttgg

SEQ ID NO: 923865 - DNA, 25 bp, Mus musculus
ctttttaacaagctgaactgaagat

SEQ ID NO: 923866 - DNA, 25 bp, Mus musculus
ctttttaacaaggtgaactgaagat

SEQ ID NO: 923867 - DNA, 25 bp, Mus musculus
ctttttacataaaccccagatgcag

SEQ ID NO: 923868 - DNA, 25 bp, Mus musculus
ctttttacataatccccagatgcag

SEQ ID NO: 923869 - DNA, 25 bp, Mus musculus
ctttttattcagcccacgcaacggg

SEQ ID NO: 923870 - DNA, 25 bp, Mus musculus
ctttttattcagcgatgtgaaatga

SEQ ID NO: 923871 - DNA, 25 bp, Mus musculus
ctttttattcaggccacgcaacggg

SEQ ID NO: 923872 - DNA, 25 bp, Mus musculus
ctttttattcagggatgtgaaatga

SEQ ID NO: 923873 - DNA, 25 bp, Mus musculus
ctttttccagcagttggaattgatc

SEQ ID NO: 923874 - DNA, 25 bp, Mus musculus
ctttttccaggagttggaattgatc

SEQ ID NO: 923875 - DNA, 25 bp, Mus musculus
ctttttcttcctcgtctactcactg

SEQ ID NO: 923876 - DNA, 25 bp, Mus musculus
ctttttcttcctggtctactcactg

SEQ ID NO: 923877 - DNA, 25 bp, Mus musculus
ctttttgacatgaagccctttgaag

SEQ ID NO: 923878 - DNA, 25 bp, Mus musculus
ctttttgacatgtagccctttgaag

SEQ ID NO: 923879 - DNA, 25 bp, Mus musculus
ctttttgctaatctacctgtttcct

SEQ ID NO: 923880 - DNA, 25 bp, Mus musculus
ctttttgctaatgtacctgtttcct

SEQ ID NO: 923881 - DNA, 25 bp, Mus musculus
cttttttgagattgagctccttgat

SEQ ID NO: 923882 - DNA, 25 bp, Mus musculus
cttttttgagtttgagctccttgat

SEQ ID NO: 923883 - DNA, 25 bp, Mus musculus
ctttttttggcccgacgagcaatgg

SEQ ID NO: 923884 - DNA, 25 bp, Mus musculus
ctttttttggccggacgagcaatgg

SEQ ID NO: 923885 - DNA, 25 bp, Mus musculus
gaaaaaacagacagtgatgtgactc

SEQ ID NO: 923886 - DNA, 25 bp, Mus musculus
gaaaaaacagtcagtgatgtgactc

SEQ ID NO: 923887 - DNA, 25 bp, Mus musculus
gaaaaaagcagtcgtttgtattgag

SEQ ID NO: 923888 - DNA, 25 bp, Mus musculus
gaaaaaagcagtggtttgtattgag

SEQ ID NO: 923889 - DNA, 25 bp, Mus musculus
gaaaaaatcagcccccgactctcag

SEQ ID NO: 923890 - DNA, 25 bp, Mus musculus
gaaaaaatcagcgcccgactctcag

SEQ ID NO: 923891 - DNA, 25 bp, Mus musculus
gaaaaacagacacgcactcctagga

SEQ ID NO: 923892 - DNA, 25 bp, Mus musculus
gaaaaacagacaggcactcctagga

SEQ ID NO: 923893 - DNA, 25 bp, Mus musculus
gaaaaacagagacacgttcacccag

SEQ ID NO: 923894 - DNA, 25 bp, Mus musculus
gaaaaacagagacaggttcacccag

SEQ ID NO: 923895 - DNA, 25 bp, Mus musculus
gaaaaacataaaattacaagatctt

SEQ ID NO: 923896 - DNA, 25 bp, Mus musculus
gaaaaacataaacaagatcttattg

SEQ ID NO: 923897 - DNA, 25 bp, Mus musculus
gaaaaacataaagaagatcttattg

SEQ ID NO: 923898 - DNA, 25 bp, Mus musculus
gaaaaacataaatttacaagatctt

SEQ ID NO: 923899 - DNA, 25 bp, Mus musculus
gaaaaactaagacaccttgaagaag

SEQ ID NO: 923900 - DNA, 25 bp, Mus musculus
gaaaaactaagacagcttgaagaag

SEQ ID NO: 923901 - DNA, 25 bp, Mus musculus
gaaaaactgcaacatgatgatcatg

SEQ ID NO: 923902 - DNA, 25 bp, Mus musculus
gaaaaactgcaagatgatgatcatg

SEQ ID NO: 923903 - DNA, 25 bp, Mus musculus
gaaaaacttcagaccccagtgcatt

SEQ ID NO: 923904 - DNA, 25 bp, Mus musculus
gaaaaacttcagtccccagtgcatt

SEQ ID NO: 923905 - DNA, 25 bp, Mus musculus
gaaaaacttgagctatctgagttag

SEQ ID NO: 923906 - DNA, 25 bp, Mus musculus
gaaaaacttgaggtatctgagttag

SEQ ID NO: 923907 - DNA, 25 bp, Mus musculus
gaaaaagaacagatttctcgaagct

SEQ ID NO: 923908 - DNA, 25 bp, Mus musculus
gaaaaagaacagttttctcgaagct

SEQ ID NO: 923909 - DNA, 25 bp, Mus musculus
gaaaaagaatgccgctggcgcattg

SEQ ID NO: 923910 - DNA, 25 bp, Mus musculus
gaaaaagaatgcggctggcgcattg

SEQ ID NO: 923911 - DNA, 25 bp, Mus musculus
gaaaaagacgaacctttagaagatg

SEQ ID NO: 923912 - DNA, 25 bp, Mus musculus
gaaaaagacgaagctttagaagatg

SEQ ID NO: 923913 - DNA, 25 bp, Mus musculus
gaaaaagagtctgtcctgcaggctg

SEQ ID NO: 923914 - DNA, 25 bp, Mus musculus
gaaaaagagtctgtgctgcaggctg

SEQ ID NO: 923915 - DNA, 25 bp, Mus musculus
gaaaaagccagtgacagagcagggc

SEQ ID NO: 923916 - DNA, 25 bp, Mus musculus
gaaaaagccagtgagagagcagggc

SEQ ID NO: 923917 - DNA, 25 bp, Mus musculus
gaaaaaggttcacgtgttcttagca

SEQ ID NO: 923918 - DNA, 25 bp, Mus musculus
gaaaaaggttcaggtgttcttagca

SEQ ID NO: 923919 - DNA, 25 bp, Mus musculus
gaaaaagtcaagctgatgttagaga

SEQ ID NO: 923920 - DNA, 25 bp, Mus musculus
gaaaaagtcaaggtgatgttagaga

SEQ ID NO: 923921 - DNA, 25 bp, Mus musculus
gaaaaagtcaatcccatagcacgag

SEQ ID NO: 923922 - DNA, 25 bp, Mus musculus
gaaaaagtcaatgccatagcacgag

SEQ ID NO: 923923 - DNA, 25 bp, Mus musculus
gaaaaagtccgtgacgtcttcatgt

SEQ ID NO: 923924 - DNA, 25 bp, Mus musculus
gaaaaagtccgtgaggtcttcatgt

SEQ ID NO: 923925 - DNA, 25 bp, Mus musculus
gaaaaagtggaaccacgaacagggc

SEQ ID NO: 923926 - DNA, 25 bp, Mus musculus
gaaaaagtggaagcacgaacagggc

SEQ ID NO: 923927 - DNA, 25 bp, Mus musculus
gaaaaagttgctgatggcatgaatg

SEQ ID NO: 923928 - DNA, 25 bp, Mus musculus
gaaaaagttggtgatggcatgaatg

SEQ ID NO: 923929 - DNA, 25 bp, Mus musculus
gaaaaataatcttgatttagtgaat

SEQ ID NO: 923930 - DNA, 25 bp, Mus musculus
gaaaaataatgttgatttagtgaat

SEQ ID NO: 923931 - DNA, 25 bp, Mus musculus
gaaaaatacctcaacggtgaggatc

SEQ ID NO: 923932 - DNA, 25 bp, Mus musculus
gaaaaatacctcaagggtgaggatc

SEQ ID NO: 923933 - DNA, 25 bp, Mus musculus
gaaaaatgaaaaagtggatagacac

SEQ ID NO: 923934 - DNA, 25 bp, Mus musculus
gaaaaatgaaaatgtggatagacac

SEQ ID NO: 923935 - DNA, 25 bp, Mus musculus
gaaaaatgcgagcaagatatgtgaa

SEQ ID NO: 923936 - DNA, 25 bp, Mus musculus
gaaaaatgcgtgcaagatatgtgaa

SEQ ID NO: 923937 - DNA, 25 bp, Mus musculus
gaaaaatttgaacgagacatcaagc

SEQ ID NO: 923938 - DNA, 25 bp, Mus musculus
gaaaaatttgaaggagacatcaagc

SEQ ID NO: 923939 - DNA, 25 bp, Mus musculus
gaaaacagaattataacaattgaaa

SEQ ID NO: 923940 - DNA, 25 bp, Mus musculus
gaaaacagaattttaacaattgaaa

SEQ ID NO: 923941 - DNA, 25 bp, Mus musculus
gaaaacaggccacacgaaagcacag

SEQ ID NO: 923942 - DNA, 25 bp, Mus musculus
gaaaacaggccacaggaaagcacag

SEQ ID NO: 923943 - DNA, 25 bp, Mus musculus
gaaaacatacatcttgccaggatgc

SEQ ID NO: 923944 - DNA, 25 bp, Mus musculus
gaaaacatacatgttgccaggatgc

SEQ ID NO: 923945 - DNA, 25 bp, Mus musculus
gaaaaccaacagcgcatgaaagaag

SEQ ID NO: 923946 - DNA, 25 bp, Mus musculus
gaaaaccaacagggcatgaaagaag

SEQ ID NO: 923947 - DNA, 25 bp, Mus musculus
gaaaaccaagatctcgcctggctgg

SEQ ID NO: 923948 - DNA, 25 bp, Mus musculus
gaaaaccaagatgtcgcctggctgg

SEQ ID NO: 923949 - DNA, 25 bp, Mus musculus
gaaaaccagaaagacaccagcagca

SEQ ID NO: 923950 - DNA, 25 bp, Mus musculus
gaaaaccagaaagagaccagcagca

SEQ ID NO: 923951 - DNA, 25 bp, Mus musculus
gaaaaccagcaacggccgcctgcca

SEQ ID NO: 923952 - DNA, 25 bp, Mus musculus
gaaaaccagcaagggccgcctgcca

SEQ ID NO: 923953 - DNA, 25 bp, Mus musculus
gaaaacccagagagatgagtcagaa

SEQ ID NO: 923954 - DNA, 25 bp, Mus musculus
gaaaacccagtgagatgagtcagaa

SEQ ID NO: 923955 - DNA, 25 bp, Mus musculus
gaaaaccttgcggatgtccagatga

SEQ ID NO: 923956 - DNA, 25 bp, Mus musculus
gaaaaccttggggatgtccagatga

SEQ ID NO: 923957 - DNA, 25 bp, Mus musculus
gaaaacgagtagaacatgaaagtct

SEQ ID NO: 923958 - DNA, 25 bp, Mus musculus
gaaaacgagtagaagatgaaagtct

SEQ ID NO: 923959 - DNA, 25 bp, Mus musculus
gaaaacggaaatgcagtttcttcag

SEQ ID NO: 923960 - DNA, 25 bp, Mus musculus
gaaaacggaaatgctgtttcttcag

SEQ ID NO: 923961 - DNA, 25 bp, Mus musculus
gaaaacggcacacacagtggacttg

SEQ ID NO: 923962 - DNA, 25 bp, Mus musculus
gaaaacggcacacagagtggacttg

SEQ ID NO: 923963 - DNA, 25 bp, Mus musculus
gaaaacggtgcacaagtcaatgccc

SEQ ID NO: 923964 - DNA, 25 bp, Mus musculus
gaaaacggtgcacatgtcaatgccc

SEQ ID NO: 923965 - DNA, 25 bp, Mus musculus
gaaaacgtctggccgatgacaacct

SEQ ID NO: 923966 - DNA, 25 bp, Mus musculus
gaaaacgtctgggcgatgacaacct

SEQ ID NO: 923967 - DNA, 25 bp, Mus musculus
gaaaactatgcacgtgtgcattgga

SEQ ID NO: 923968 - DNA, 25 bp, Mus musculus
gaaaactatgcaggtgtgcattgga

SEQ ID NO: 923969 - DNA, 25 bp, Mus musculus
gaaaactccaccaagtatgcggttg

SEQ ID NO: 923970 - DNA, 25 bp, Mus musculus
gaaaactccacctagtatgcggttg

SEQ ID NO: 923971 - DNA, 25 bp, Mus musculus
gaaaactgagatctgtctacattgg

SEQ ID NO: 923972 - DNA, 25 bp, Mus musculus
gaaaactgagatgtgtctacattgg

SEQ ID NO: 923973 - DNA, 25 bp, Mus musculus
gaaaactggtctctacttggctctg

SEQ ID NO: 923974 - DNA, 25 bp, Mus musculus
gaaaactggtctgtacttggctctg

SEQ ID NO: 923975 - DNA, 25 bp, Mus musculus
gaaaactgtgccaacataacatgta

SEQ ID NO: 923976 - DNA, 25 bp, Mus musculus
gaaaactgtggcaacataacatgta

SEQ ID NO: 923977 - DNA, 25 bp, Mus musculus
gaaaactttagacctgccgcatgcc

SEQ ID NO: 923978 - DNA, 25 bp, Mus musculus
gaaaactttagagctgccgcatgcc

SEQ ID NO: 923979 - DNA, 25 bp, Mus musculus
gaaaagaaagaagcgagatatccct

SEQ ID NO: 923980 - DNA, 25 bp, Mus musculus
gaaaagaaagagagttcgatgccca

SEQ ID NO: 923981 - DNA, 25 bp, Mus musculus
gaaaagaaagagtgttcgatgccca

SEQ ID NO: 923982 - DNA, 25 bp, Mus musculus
gaaaagaaagcagatcactatgttc

SEQ ID NO: 923983 - DNA, 25 bp, Mus musculus
gaaaagaaagcgagatatccctgac

SEQ ID NO: 923984 - DNA, 25 bp, Mus musculus
gaaaagaaaggagatcactatgttc

SEQ ID NO: 923985 - DNA, 25 bp, Mus musculus
gaaaagaaagggagatatccctgac

SEQ ID NO: 923986 - DNA, 25 bp, Mus musculus
gaaaagaaagtagcgagatatccct

SEQ ID NO: 923987 - DNA, 25 bp, Mus musculus
gaaaagaaatacaaagatgactcaa

SEQ ID NO: 923988 - DNA, 25 bp, Mus musculus
gaaaagaaattcaaagatgactcaa

SEQ ID NO: 923989 - DNA, 25 bp, Mus musculus
gaaaagaacaagaccatcattaagt

SEQ ID NO: 923990 - DNA, 25 bp, Mus musculus
gaaaagaacaagtccatcattaagt

SEQ ID NO: 923991 - DNA, 25 bp, Mus musculus
gaaaagaagcagcgcggaaggcaag

SEQ ID NO: 923992 - DNA, 25 bp, Mus musculus
gaaaagaagcagcggggaaggcaag

SEQ ID NO: 923993 - DNA, 25 bp, Mus musculus
gaaaagactgacattactaagaagt

SEQ ID NO: 923994 - DNA, 25 bp, Mus musculus
gaaaagactgtcattactaagaagt

SEQ ID NO: 923995 - DNA, 25 bp, Mus musculus
gaaaagagaatgcctgtactccatg

SEQ ID NO: 923996 - DNA, 25 bp, Mus musculus
gaaaagagaatggctgtactccatg

SEQ ID NO: 923997 - DNA, 25 bp, Mus musculus
gaaaagatacttcactgagggggat

SEQ ID NO: 923998 - DNA, 25 bp, Mus musculus
gaaaagatacttcagtgagggggat

SEQ ID NO: 923999 - DNA, 25 bp, Mus musculus
gaaaagatcataaccttggatgaga

SEQ ID NO: 924000 - DNA, 25 bp, Mus musculus
gaaaagatcatatccttggatgaga

SEQ ID NO: 924001 - DNA, 25 bp, Mus musculus
gaaaagatgcctcgacaaaaacaag

SEQ ID NO: 924002 - DNA, 25 bp, Mus musculus
gaaaagatgcctggacaaaaacaag

SEQ ID NO: 924003 - DNA, 25 bp, Mus musculus
gaaaagcaagagctgtcttcctgct

SEQ ID NO: 924004 - DNA, 25 bp, Mus musculus
gaaaagcaagtgctgtcttcctgct

SEQ ID NO: 924005 - DNA, 25 bp, Mus musculus
gaaaagcataacttttccagttgcg

SEQ ID NO: 924006 - DNA, 25 bp, Mus musculus
gaaaagcatatcttttccagttgcg

SEQ ID NO: 924007 - DNA, 25 bp, Mus musculus
gaaaagcgagcccttggaacagcgc

SEQ ID NO: 924008 - DNA, 25 bp, Mus musculus
gaaaagcgagctgggagaacagctg

SEQ ID NO: 924009 - DNA, 25 bp, Mus musculus
gaaaagcgaggccttggaacagcgc

SEQ ID NO: 924010 - DNA, 25 bp, Mus musculus
gaaaagcgaggtgggagaacagctg

SEQ ID NO: 924011 - DNA, 25 bp, Mus musculus
gaaaagctgaccaacggactgcaca

SEQ ID NO: 924012 - DNA, 25 bp, Mus musculus
gaaaagctgaccaagggactgcaca

SEQ ID NO: 924013 - DNA, 25 bp, Mus musculus
gaaaagctgagacaaacgaagtgag

SEQ ID NO: 924014 - DNA, 25 bp, Mus musculus
gaaaagctgagagaaacgaagtgag

SEQ ID NO: 924015 - DNA, 25 bp, Mus musculus
gaaaagggcgtgcacagtggtaaaa

SEQ ID NO: 924016 - DNA, 25 bp, Mus musculus
gaaaagggcgtggacagtggtaaaa

SEQ ID NO: 924017 - DNA, 25 bp, Mus musculus
gaaaaggtgcagatcctggggcaga

SEQ ID NO: 924018 - DNA, 25 bp, Mus musculus
gaaaaggtgcagcaactgctttgct

SEQ ID NO: 924019 - DNA, 25 bp, Mus musculus
gaaaaggtgcaggaactgctttgct

SEQ ID NO: 924020 - DNA, 25 bp, Mus musculus
gaaaaggtgcagttcctggggcaga

SEQ ID NO: 924021 - DNA, 25 bp, Mus musculus
gaaaagtaaaggcattgcttatatt

SEQ ID NO: 924022 - DNA, 25 bp, Mus musculus
gaaaagtaaagggattgcttatatt

SEQ ID NO: 924023 - DNA, 25 bp, Mus musculus
gaaaagtgtgagaccatccatgtgg

SEQ ID NO: 924024 - DNA, 25 bp, Mus musculus
gaaaagtgtgagtccatccatgtgg

SEQ ID NO: 924025 - DNA, 25 bp, Mus musculus
gaaaataaagcaattgaacctggcc

SEQ ID NO: 924026 - DNA, 25 bp, Mus musculus
gaaaataaaggaattgaacctggcc

SEQ ID NO: 924027 - DNA, 25 bp, Mus musculus
gaaaatactgaattttctcagcgtg

SEQ ID NO: 924028 - DNA, 25 bp, Mus musculus
gaaaatactgtattttctcagcgtg

SEQ ID NO: 924029 - DNA, 25 bp, Mus musculus
gaaaatatttagattgaggatgggt

SEQ ID NO: 924030 - DNA, 25 bp, Mus musculus
gaaaatatttagtttgaggatgggt

SEQ ID NO: 924031 - DNA, 25 bp, Mus musculus
gaaaatcaaggaccttgtagtgaag

SEQ ID NO: 924032 - DNA, 25 bp, Mus musculus
gaaaatcaaggagcttgtagtgaag

SEQ ID NO: 924033 - DNA, 25 bp, Mus musculus
gaaaatccaatacacttttcttaca

SEQ ID NO: 924034 - DNA, 25 bp, Mus musculus
gaaaatccaatagacttttcttaca

SEQ ID NO: 924035 - DNA, 25 bp, Mus musculus
gaaaatccacagagtttatcagacc

SEQ ID NO: 924036 - DNA, 25 bp, Mus musculus
gaaaatccacagtgtttatcagacc

SEQ ID NO: 924037 - DNA, 25 bp, Mus musculus
gaaaatccagcaactcagcaaaaga

SEQ ID NO: 924038 - DNA, 25 bp, Mus musculus
gaaaatccaggaactcagcaaaaga

SEQ ID NO: 924039 - DNA, 25 bp, Mus musculus
gaaaatcctacacaccatggaccgc

SEQ ID NO: 924040 - DNA, 25 bp, Mus musculus
gaaaatcctacacagcatggaccgc

SEQ ID NO: 924041 - DNA, 25 bp, Mus musculus
gaaaatcctgcacgactacaaatct

SEQ ID NO: 924042 - DNA, 25 bp, Mus musculus
gaaaatcctgcaggactacaaatct

SEQ ID NO: 924043 - DNA, 25 bp, Mus musculus
gaaaatccttcagacatttatccaa

SEQ ID NO: 924044 - DNA, 25 bp, Mus musculus
gaaaatccttcagagatttatccaa

SEQ ID NO: 924045 - DNA, 25 bp, Mus musculus
gaaaatctatgaaagccctggtttg

SEQ ID NO: 924046 - DNA, 25 bp, Mus musculus
gaaaatctatgaaatcagcaaccgc

SEQ ID NO: 924047 - DNA, 25 bp, Mus musculus
gaaaatctatgatagccctggtttg

SEQ ID NO: 924048 - DNA, 25 bp, Mus musculus
gaaaatctatgatatcagcaaccgc

SEQ ID NO: 924049 - DNA, 25 bp, Mus musculus
gaaaatctgtgaagcgttccgagcc

SEQ ID NO: 924050 - DNA, 25 bp, Mus musculus
gaaaatctgtgaagggttccgagcc

SEQ ID NO: 924051 - DNA, 25 bp, Mus musculus
gaaaatcttactcttcagttcaagc

SEQ ID NO: 924052 - DNA, 25 bp, Mus musculus
gaaaatcttagtcttcagttcaagc

SEQ ID NO: 924053 - DNA, 25 bp, Mus musculus
gaaaatctttgaactcattggattg

SEQ ID NO: 924054 - DNA, 25 bp, Mus musculus
gaaaatctttgatctcattggattg

SEQ ID NO: 924055 - DNA, 25 bp, Mus musculus
gaaaatgaatttcaaggggctgagg

SEQ ID NO: 924056 - DNA, 25 bp, Mus musculus
gaaaatgaatttcatggggctgagg

SEQ ID NO: 924057 - DNA, 25 bp, Mus musculus
gaaaatgacttcaacgcatttttca

SEQ ID NO: 924058 - DNA, 25 bp, Mus musculus
gaaaatgacttcaaggcatttttca

SEQ ID NO: 924059 - DNA, 25 bp, Mus musculus
gaaaatgataagctcaatgatatgg

SEQ ID NO: 924060 - DNA, 25 bp, Mus musculus
gaaaatgataagctcggtaaaactc

SEQ ID NO: 924061 - DNA, 25 bp, Mus musculus
gaaaatgataagctgaatgatatgg

SEQ ID NO: 924062 - DNA, 25 bp, Mus musculus
gaaaatgataagctgggtaaaactc

SEQ ID NO: 924063 - DNA, 25 bp, Mus musculus
gaaaatgatgcgctaaccattcaag

SEQ ID NO: 924064 - DNA, 25 bp, Mus musculus
gaaaatgatgcggtaaccattcaag

SEQ ID NO: 924065 - DNA, 25 bp, Mus musculus
gaaaatgccaaacacgttggccgcc

SEQ ID NO: 924066 - DNA, 25 bp, Mus musculus
gaaaatgccaaacaggttggccgcc

SEQ ID NO: 924067 - DNA, 25 bp, Mus musculus
gaaaatgcctctcgacttgactacc

SEQ ID NO: 924068 - DNA, 25 bp, Mus musculus
gaaaatgcctctggacttgactacc

SEQ ID NO: 924069 - DNA, 25 bp, Mus musculus
gaaaatgcttggctcaccagtggat

SEQ ID NO: 924070 - DNA, 25 bp, Mus musculus
gaaaatgcttgggtcaccagtggat

SEQ ID NO: 924071 - DNA, 25 bp, Mus musculus
gaaaatggctcacggggagcaccgt

SEQ ID NO: 924072 - DNA, 25 bp, Mus musculus
gaaaatggctcagggggagcaccgt

SEQ ID NO: 924073 - DNA, 25 bp, Mus musculus
gaaaatgggacgcgaaaatgctcaa

SEQ ID NO: 924074 - DNA, 25 bp, Mus musculus
gaaaatgggacgggaaaatgctcaa

SEQ ID NO: 924075 - DNA, 25 bp, Mus musculus
gaaaatgttgcctaaaaccatgaat

SEQ ID NO: 924076 - DNA, 25 bp, Mus musculus
gaaaatgttgcctataaccatgaat

SEQ ID NO: 924077 - DNA, 25 bp, Mus musculus
gaaacaaaacagagctgaacttggt

SEQ ID NO: 924078 - DNA, 25 bp, Mus musculus
gaaacaaaacagtgctgaacttggt

SEQ ID NO: 924079 - DNA, 25 bp, Mus musculus
gaaacaaaagaggtccatgccgtgg

SEQ ID NO: 924080 - DNA, 25 bp, Mus musculus
gaaacaaaagtggtccatgccgtgg

SEQ ID NO: 924081 - DNA, 25 bp, Mus musculus
gaaacaaatgcgatggaagactgtg

SEQ ID NO: 924082 - DNA, 25 bp, Mus musculus
gaaacaaatgctgaagaagatggca

SEQ ID NO: 924083 - DNA, 25 bp, Mus musculus
gaaacaaatgggatggaagactgtg

SEQ ID NO: 924084 - DNA, 25 bp, Mus musculus
gaaacaaatggtgaagaagatggca

SEQ ID NO: 924085 - DNA, 25 bp, Mus musculus
gaaacaactgcacttgctcttgctt

SEQ ID NO: 924086 - DNA, 25 bp, Mus musculus
gaaacaactgcagttgctcttgctt

SEQ ID NO: 924087 - DNA, 25 bp, Mus musculus
gaaacaagagaacatcctgatctac

SEQ ID NO: 924088 - DNA, 25 bp, Mus musculus
gaaacaagagaagatcctgatctac

SEQ ID NO: 924089 - DNA, 25 bp, Mus musculus
gaaacaagagatggagcagatggtg

SEQ ID NO: 924090 - DNA, 25 bp, Mus musculus
gaaacaagagttggagcagatggtg

SEQ ID NO: 924091 - DNA, 25 bp, Mus musculus
gaaacaatggcaatactagctatgg

SEQ ID NO: 924092 - DNA, 25 bp, Mus musculus
gaaacaatggcattactagctatgg

SEQ ID NO: 924093 - DNA, 25 bp, Mus musculus
gaaacaatggccactttatcgccgc

SEQ ID NO: 924094 - DNA, 25 bp, Mus musculus
gaaacaatgggcactttatcgccgc

SEQ ID NO: 924095 - DNA, 25 bp, Mus musculus
gaaacacaatcacatgtcgtttggt

SEQ ID NO: 924096 - DNA, 25 bp, Mus musculus
gaaacacaatcacccgcataactca

SEQ ID NO: 924097 - DNA, 25 bp, Mus musculus
gaaacacaatcacccgtcattcagt

SEQ ID NO: 924098 - DNA, 25 bp, Mus musculus
gaaacacaatcactcgaagggggca

SEQ ID NO: 924099 - DNA, 25 bp, Mus musculus
gaaacacaatcagatgtcgtttggt

SEQ ID NO: 924100 - DNA, 25 bp, Mus musculus
gaaacacaatcagccgcataactca

SEQ ID NO: 924101 - DNA, 25 bp, Mus musculus
gaaacacaatcagccgtcattcagt

SEQ ID NO: 924102 - DNA, 25 bp, Mus musculus
gaaacacaatcagtcgaagggggca

SEQ ID NO: 924103 - DNA, 25 bp, Mus musculus
gaaacacacacgcatgctgaaggag

SEQ ID NO: 924104 - DNA, 25 bp, Mus musculus
gaaacacacacggatgctgaaggag

SEQ ID NO: 924105 - DNA, 25 bp, Mus musculus
gaaacacactggaacgatttgccag

SEQ ID NO: 924106 - DNA, 25 bp, Mus musculus
gaaacacactggaactatttttgaa

SEQ ID NO: 924107 - DNA, 25 bp, Mus musculus
gaaacacactggaaggatttgccag

SEQ ID NO: 924108 - DNA, 25 bp, Mus musculus
gaaacacactggaagtatttttgaa

SEQ ID NO: 924109 - DNA, 25 bp, Mus musculus
gaaacacgaaaaagtgattggtctg

SEQ ID NO: 924110 - DNA, 25 bp, Mus musculus
gaaacacgaaaatgtgattggtctg

SEQ ID NO: 924111 - DNA, 25 bp, Mus musculus
gaaacagaacagccttagaaacagc

SEQ ID NO: 924112 - DNA, 25 bp, Mus musculus
gaaacagaacaggcttagaaacagc

SEQ ID NO: 924113 - DNA, 25 bp, Mus musculus
gaaacagcacaacgtttggcggaaa

SEQ ID NO: 924114 - DNA, 25 bp, Mus musculus
gaaacagcacaaggtttggcggaaa

SEQ ID NO: 924115 - DNA, 25 bp, Mus musculus
gaaacagcagattcctcagacaaaa

SEQ ID NO: 924116 - DNA, 25 bp, Mus musculus
gaaacagcagcgaaggatctgtcct

SEQ ID NO: 924117 - DNA, 25 bp, Mus musculus
gaaacagcagggaaggatctgtcct

SEQ ID NO: 924118 - DNA, 25 bp, Mus musculus
gaaacagcagtttcctcagacaaaa

SEQ ID NO: 924119 - DNA, 25 bp, Mus musculus
gaaacagctgaacgatgctattgat

SEQ ID NO: 924120 - DNA, 25 bp, Mus musculus
gaaacagctgaaggatgctattgat

SEQ ID NO: 924121 - DNA, 25 bp, Mus musculus
gaaacagtacagagtgagataatcc

SEQ ID NO: 924122 - DNA, 25 bp, Mus musculus
gaaacagtacagtgtgagataatcc

SEQ ID NO: 924123 - DNA, 25 bp, Mus musculus
gaaacagtgtagcatacactttgaa

SEQ ID NO: 924124 - DNA, 25 bp, Mus musculus
gaaacagtgtaggatacactttgaa

SEQ ID NO: 924125 - DNA, 25 bp, Mus musculus
gaaacataagcaggaagctcctagc

SEQ ID NO: 924126 - DNA, 25 bp, Mus musculus
gaaacataaggaggaagctcctagc

SEQ ID NO: 924127 - DNA, 25 bp, Mus musculus
gaaacatagagacgaactacaagaa

SEQ ID NO: 924128 - DNA, 25 bp, Mus musculus
gaaacatagagaggaactacaagaa

SEQ ID NO: 924129 - DNA, 25 bp, Mus musculus
gaaacatcagaatcagcagcgtcgc

SEQ ID NO: 924130 - DNA, 25 bp, Mus musculus
gaaacatcagtatcagcagcgtcgc

SEQ ID NO: 924131 - DNA, 25 bp, Mus musculus
gaaaccaaaagaaggcctggcactc

SEQ ID NO: 924132 - DNA, 25 bp, Mus musculus
gaaaccaaaagatggcctggcactc

SEQ ID NO: 924133 - DNA, 25 bp, Mus musculus
gaaaccaaagactgtgatgcttgga

SEQ ID NO: 924134 - DNA, 25 bp, Mus musculus
gaaaccaaagtctgtgatgcttgga

SEQ ID NO: 924135 - DNA, 25 bp, Mus musculus
gaaaccaccaaacgtgcctactcac

SEQ ID NO: 924136 - DNA, 25 bp, Mus musculus
gaaaccaccaaaggtgcctactcac

SEQ ID NO: 924137 - DNA, 25 bp, Mus musculus
gaaaccacctcacgagtgaagcgtg

SEQ ID NO: 924138 - DNA, 25 bp, Mus musculus
gaaaccacctcaggagtgaagcgtg

SEQ ID NO: 924139 - DNA, 25 bp, Mus musculus
gaaaccagcacaaacggtgctgaat

SEQ ID NO: 924140 - DNA, 25 bp, Mus musculus
gaaaccagcacaaagggtgctgaat

SEQ ID NO: 924141 - DNA, 25 bp, Mus musculus
gaaaccaggacacgattccccctct

SEQ ID NO: 924142 - DNA, 25 bp, Mus musculus
gaaaccaggacaggattccccctct

SEQ ID NO: 924143 - DNA, 25 bp, Mus musculus
gaaaccagggttcacggggcagaca

SEQ ID NO: 924144 - DNA, 25 bp, Mus musculus
gaaaccagggttcagggggcagaca

SEQ ID NO: 924145 - DNA, 25 bp, Mus musculus
gaaaccatagcggattctggctttg

SEQ ID NO: 924146 - DNA, 25 bp, Mus musculus
gaaaccataggggattctggctttg

SEQ ID NO: 924147 - DNA, 25 bp, Mus musculus
gaaaccatggcaagatctccaagga

SEQ ID NO: 924148 - DNA, 25 bp, Mus musculus
gaaaccatggcacaacaaaaatcag

SEQ ID NO: 924149 - DNA, 25 bp, Mus musculus
gaaaccatggcacgtacagagctat

SEQ ID NO: 924150 - DNA, 25 bp, Mus musculus
gaaaccatggcagaacaaaaatcag

SEQ ID NO: 924151 - DNA, 25 bp, Mus musculus
gaaaccatggcaggtacagagctat

SEQ ID NO: 924152 - DNA, 25 bp, Mus musculus
gaaaccatggcatgatctccaagga

SEQ ID NO: 924153 - DNA, 25 bp, Mus musculus
gaaacccaactgatagtttatattg

SEQ ID NO: 924154 - DNA, 25 bp, Mus musculus
gaaacccaactgattgtttatattg

SEQ ID NO: 924155 - DNA, 25 bp, Mus musculus
gaaacccaagcccacgacaccgtgc

SEQ ID NO: 924156 - DNA, 25 bp, Mus musculus
gaaacccaagcccaggacaccgtgc

SEQ ID NO: 924157 - DNA, 25 bp, Mus musculus
gaaacccagatggtcactgaggcaa

SEQ ID NO: 924158 - DNA, 25 bp, Mus musculus
gaaacccagatggtgactgaggcaa

SEQ ID NO: 924159 - DNA, 25 bp, Mus musculus
gaaacccgagaacatcttgtacgcg

SEQ ID NO: 924160 - DNA, 25 bp, Mus musculus
gaaacccgagatcaatgctcgcctg

SEQ ID NO: 924161 - DNA, 25 bp, Mus musculus
gaaacccgagtacatcttgtacgcg

SEQ ID NO: 924162 - DNA, 25 bp, Mus musculus
gaaacccgagttcaatgctcgcctg

SEQ ID NO: 924163 - DNA, 25 bp, Mus musculus
gaaaccgcgatgagcctgcccggac

SEQ ID NO: 924164 - DNA, 25 bp, Mus musculus
gaaaccgcgatgaggctgcccggac

SEQ ID NO: 924165 - DNA, 25 bp, Mus musculus
gaaacctaaacacacggctgtgagt

SEQ ID NO: 924166 - DNA, 25 bp, Mus musculus
gaaacctaaacacagggctgtgagt

SEQ ID NO: 924167 - DNA, 25 bp, Mus musculus
gaaacctccacacggcacagaatcc

SEQ ID NO: 924168 - DNA, 25 bp, Mus musculus
gaaacctccacagggcacagaatcc

SEQ ID NO: 924169 - DNA, 25 bp, Mus musculus
gaaacctcggaacacgatggttcga

SEQ ID NO: 924170 - DNA, 25 bp, Mus musculus
gaaacctcggaacaggatggttcga

SEQ ID NO: 924171 - DNA, 25 bp, Mus musculus
gaaacgagaaagctgagatctcaat

SEQ ID NO: 924172 - DNA, 25 bp, Mus musculus
gaaacgagaaaggtgagatctcaat

SEQ ID NO: 924173 - DNA, 25 bp, Mus musculus
gaaacgccatggctcacaagatcct

SEQ ID NO: 924174 - DNA, 25 bp, Mus musculus
gaaacgccatggctgacaagatcct

SEQ ID NO: 924175 - DNA, 25 bp, Mus musculus
gaaacgctgccgccaagttgaagtt

SEQ ID NO: 924176 - DNA, 25 bp, Mus musculus
gaaacgctgccggcaagttgaagtt

SEQ ID NO: 924177 - DNA, 25 bp, Mus musculus
gaaacggaagccatgaaagaagtga

SEQ ID NO: 924178 - DNA, 25 bp, Mus musculus
gaaacggaaggcatgaaagaagtga

SEQ ID NO: 924179 - DNA, 25 bp, Mus musculus
gaaacggattttcgcaagtcaagca

SEQ ID NO: 924180 - DNA, 25 bp, Mus musculus
gaaacggattttggcaagtcaagca

SEQ ID NO: 924181 - DNA, 25 bp, Mus musculus
gaaactaaaaaaagtgacgagatgt

SEQ ID NO: 924182 - DNA, 25 bp, Mus musculus
gaaactaaaataagtgacgagatgt

SEQ ID NO: 924183 - DNA, 25 bp, Mus musculus
gaaactaagcagaacaagccatcca

SEQ ID NO: 924184 - DNA, 25 bp, Mus musculus
gaaactaagcagcaagcagaacaag

SEQ ID NO: 924185 - DNA, 25 bp, Mus musculus
gaaactaagcaggaagcagaacaag

SEQ ID NO: 924186 - DNA, 25 bp, Mus musculus
gaaactaagcagtacaagccatcca

SEQ ID NO: 924187 - DNA, 25 bp, Mus musculus
gaaactacagcaagttgaaattcga

SEQ ID NO: 924188 - DNA, 25 bp, Mus musculus
gaaactacaggaagttgaaattcga

SEQ ID NO: 924189 - DNA, 25 bp, Mus musculus
gaaactaccatgcacgttactccat

SEQ ID NO: 924190 - DNA, 25 bp, Mus musculus
gaaactaccatgcaggttactccat

SEQ ID NO: 924191 - DNA, 25 bp, Mus musculus
gaaactcaaccacaaactgaagaat

SEQ ID NO: 924192 - DNA, 25 bp, Mus musculus
gaaactcaaccagaaactgaagaat

SEQ ID NO: 924193 - DNA, 25 bp, Mus musculus
gaaactcaagcacgtgttctttggc

SEQ ID NO: 924194 - DNA, 25 bp, Mus musculus
gaaactcaagcaggtgttctttggc

SEQ ID NO: 924195 - DNA, 25 bp, Mus musculus
gaaactcagccacagcccccttagc

SEQ ID NO: 924196 - DNA, 25 bp, Mus musculus
gaaactcagccagagcccccttagc

SEQ ID NO: 924197 - DNA, 25 bp, Mus musculus
gaaactccagaagtggccacagagg

SEQ ID NO: 924198 - DNA, 25 bp, Mus musculus
gaaactccagaggccacagaggaag

SEQ ID NO: 924199 - DNA, 25 bp, Mus musculus
gaaactccagcctgcgctggctgac

SEQ ID NO: 924200 - DNA, 25 bp, Mus musculus
gaaactccaggctgcgctggctgac

SEQ ID NO: 924201 - DNA, 25 bp, Mus musculus
gaaactccagtagtggccacagagg

SEQ ID NO: 924202 - DNA, 25 bp, Mus musculus
gaaactccagtggccacagaggaag

SEQ ID NO: 924203 - DNA, 25 bp, Mus musculus
gaaactgagacacgccttgcaagga

SEQ ID NO: 924204 - DNA, 25 bp, Mus musculus
gaaactgagacaggccttgcaagga

SEQ ID NO: 924205 - DNA, 25 bp, Mus musculus
gaaactgaggagaactgtgagaaac

SEQ ID NO: 924206 - DNA, 25 bp, Mus musculus
gaaactgaggagaagtgtgagaaac

SEQ ID NO: 924207 - DNA, 25 bp, Mus musculus
gaaactgccccacgtggcagaagag

SEQ ID NO: 924208 - DNA, 25 bp, Mus musculus
gaaactgccccaggtggcagaagag

SEQ ID NO: 924209 - DNA, 25 bp, Mus musculus
gaaactgctccactactatcagcaa

SEQ ID NO: 924210 - DNA, 25 bp, Mus musculus
gaaactgctccacttctatcagcaa

SEQ ID NO: 924211 - DNA, 25 bp, Mus musculus
gaaactgggaccctgcctgcaggtg

SEQ ID NO: 924212 - DNA, 25 bp, Mus musculus
gaaactgggaccgtgcctgcaggtg

SEQ ID NO: 924213 - DNA, 25 bp, Mus musculus
gaaactggggcccgtgattccctct

SEQ ID NO: 924214 - DNA, 25 bp, Mus musculus
gaaactggggccggtgattccctct

SEQ ID NO: 924215 - DNA, 25 bp, Mus musculus
gaaactggtacactacaatatctcc

SEQ ID NO: 924216 - DNA, 25 bp, Mus musculus
gaaactggtacagtacaatatctcc

SEQ ID NO: 924217 - DNA, 25 bp, Mus musculus
gaaactgtagcttctttgttacaga

SEQ ID NO: 924218 - DNA, 25 bp, Mus musculus
gaaactgtaggttctttgttacaga

SEQ ID NO: 924219 - DNA, 25 bp, Mus musculus
gaaacttaatgtcacccataacaaa

SEQ ID NO: 924220 - DNA, 25 bp, Mus musculus
gaaacttaatgtcagccataacaaa

SEQ ID NO: 924221 - DNA, 25 bp, Mus musculus
gaaacttatgagacggtacatagcc

SEQ ID NO: 924222 - DNA, 25 bp, Mus musculus
gaaacttatgagtcggtacatagcc

SEQ ID NO: 924223 - DNA, 25 bp, Mus musculus
gaaacttatgatatgggacaccaga

SEQ ID NO: 924224 - DNA, 25 bp, Mus musculus
gaaacttatgatttgggacaccaga

SEQ ID NO: 924225 - DNA, 25 bp, Mus musculus
gaaacttcagctggccacagccgtg

SEQ ID NO: 924226 - DNA, 25 bp, Mus musculus
gaaacttcaggtggccacagccgtg

SEQ ID NO: 924227 - DNA, 25 bp, Mus musculus
gaaagaaaacagagacaacataaga

SEQ ID NO: 924228 - DNA, 25 bp, Mus musculus
gaaagaaaacagtgacaacataaga

SEQ ID NO: 924229 - DNA, 25 bp, Mus musculus
gaaagaaaagagggtgcctgagata

SEQ ID NO: 924230 - DNA, 25 bp, Mus musculus
gaaagaaaagtgggtgcctgagata

SEQ ID NO: 924231 - DNA, 25 bp, Mus musculus
gaaagaaaattaaacatgaactaat

SEQ ID NO: 924232 - DNA, 25 bp, Mus musculus
gaaagaaaattaaagatgaactaat

SEQ ID NO: 924233 - DNA, 25 bp, Mus musculus
gaaagaaatgccaaaagatgtgatt

SEQ ID NO: 924234 - DNA, 25 bp, Mus musculus
gaaagaaatggcaaaagatgtgatt

SEQ ID NO: 924235 - DNA, 25 bp, Mus musculus
gaaagaaatgtcatccaaacttgac

SEQ ID NO: 924236 - DNA, 25 bp, Mus musculus
gaaagaaatgtcatgcaaacttgac

SEQ ID NO: 924237 - DNA, 25 bp, Mus musculus
gaaagaacagagcatccagtggtaa

SEQ ID NO: 924238 - DNA, 25 bp, Mus musculus
gaaagaacagatgtttatggcatca

SEQ ID NO: 924239 - DNA, 25 bp, Mus musculus
gaaagaacagcttcagcaaagagca

SEQ ID NO: 924240 - DNA, 25 bp, Mus musculus
gaaagaacaggttcagcaaagagca

SEQ ID NO: 924241 - DNA, 25 bp, Mus musculus
gaaagaacagtgcatccagtggtaa

SEQ ID NO: 924242 - DNA, 25 bp, Mus musculus
gaaagaacagttgtttatggcatca

SEQ ID NO: 924243 - DNA, 25 bp, Mus musculus
gaaagaactcctcactgtgtttcgg

SEQ ID NO: 924244 - DNA, 25 bp, Mus musculus
gaaagaactcgtcactgtgtttcgg

SEQ ID NO: 924245 - DNA, 25 bp, Mus musculus
gaaagaagagcaagagaaactgggt

SEQ ID NO: 924246 - DNA, 25 bp, Mus musculus
gaaagaagaggaagagaaactgggt

SEQ ID NO: 924247 - DNA, 25 bp, Mus musculus
gaaagaagcaagcacctagaggatg

SEQ ID NO: 924248 - DNA, 25 bp, Mus musculus
gaaagaagcaagcagctagaggatg

SEQ ID NO: 924249 - DNA, 25 bp, Mus musculus
gaaagaagcggcctccatgacccgc

SEQ ID NO: 924250 - DNA, 25 bp, Mus musculus
gaaagaagcggcctgcatgacccgc

SEQ ID NO: 924251 - DNA, 25 bp, Mus musculus
gaaagaagctcccccacctgcactc

SEQ ID NO: 924252 - DNA, 25 bp, Mus musculus
gaaagaagctccccgacctgcactc

SEQ ID NO: 924253 - DNA, 25 bp, Mus musculus
gaaagaagttcacacgagaaaacat

SEQ ID NO: 924254 - DNA, 25 bp, Mus musculus
gaaagaagttcacaggagaaaacat

SEQ ID NO: 924255 - DNA, 25 bp, Mus musculus
gaaagaatatgacaatgctcttttc

SEQ ID NO: 924256 - DNA, 25 bp, Mus musculus
gaaagaatatgagaatgctcttttc

SEQ ID NO: 924257 - DNA, 25 bp, Mus musculus
gaaagaatccagagaggaagacgac

SEQ ID NO: 924258 - DNA, 25 bp, Mus musculus
gaaagaatccagtgaggaagacgac

SEQ ID NO: 924259 - DNA, 25 bp, Mus musculus
gaaagaatttgctgaagacatttta

SEQ ID NO: 924260 - DNA, 25 bp, Mus musculus
gaaagaatttgctgtagacatttta

SEQ ID NO: 924261 - DNA, 25 bp, Mus musculus
gaaagacaagaaaacagaaatattt

SEQ ID NO: 924262 - DNA, 25 bp, Mus musculus
gaaagacaagtaaacagaaatattt

SEQ ID NO: 924263 - DNA, 25 bp, Mus musculus
gaaagacacaacagagcaggttagg

SEQ ID NO: 924264 - DNA, 25 bp, Mus musculus
gaaagacacaacagtgcaggttagg

SEQ ID NO: 924265 - DNA, 25 bp, Mus musculus
gaaagacatgcaaacacatcaacga

SEQ ID NO: 924266 - DNA, 25 bp, Mus musculus
gaaagacatgcaaagacatcaacga

SEQ ID NO: 924267 - DNA, 25 bp, Mus musculus
gaaagaccagccaacaattctcttg

SEQ ID NO: 924268 - DNA, 25 bp, Mus musculus
gaaagaccagcccatcattcttgtg

SEQ ID NO: 924269 - DNA, 25 bp, Mus musculus
gaaagaccaggcaacaattctcttg

SEQ ID NO: 924270 - DNA, 25 bp, Mus musculus
gaaagaccaggccatcattcttgtg

SEQ ID NO: 924271 - DNA, 25 bp, Mus musculus
gaaagacgaagacaaacgactcaga

SEQ ID NO: 924272 - DNA, 25 bp, Mus musculus
gaaagacgaagagaaacgactcaga

SEQ ID NO: 924273 - DNA, 25 bp, Mus musculus
gaaagactatcaagttccaagatgc

SEQ ID NO: 924274 - DNA, 25 bp, Mus musculus
gaaagactatcaattatttccgaga

SEQ ID NO: 924275 - DNA, 25 bp, Mus musculus
gaaagactatcatgttccaagatgc

SEQ ID NO: 924276 - DNA, 25 bp, Mus musculus
gaaagactatcatttatttccgaga

SEQ ID NO: 924277 - DNA, 25 bp, Mus musculus
gaaagactggagagaagctgaagaa

SEQ ID NO: 924278 - DNA, 25 bp, Mus musculus
gaaagactggagtgaagctgaagaa

SEQ ID NO: 924279 - DNA, 25 bp, Mus musculus
gaaagactgtaccacgcccagtctg

SEQ ID NO: 924280 - DNA, 25 bp, Mus musculus
gaaagactgtaccacggccacaccc

SEQ ID NO: 924281 - DNA, 25 bp, Mus musculus
gaaagactgtaccactgacttcaat

SEQ ID NO: 924282 - DNA, 25 bp, Mus musculus
gaaagactgtaccaggcccagtctg

SEQ ID NO: 924283 - DNA, 25 bp, Mus musculus
gaaagactgtaccagggccacaccc

SEQ ID NO: 924284 - DNA, 25 bp, Mus musculus
gaaagactgtaccagtgacttcaat

SEQ ID NO: 924285 - DNA, 25 bp, Mus musculus
gaaagagaaaatatcgctttattga

SEQ ID NO: 924286 - DNA, 25 bp, Mus musculus
gaaagagaaaatatggctttattga

SEQ ID NO: 924287 - DNA, 25 bp, Mus musculus
gaaagagaactccacagactcactg

SEQ ID NO: 924288 - DNA, 25 bp, Mus musculus
gaaagagaactccagagactcactg

SEQ ID NO: 924289 - DNA, 25 bp, Mus musculus
gaaagagaagctctgggcccactat

SEQ ID NO: 924290 - DNA, 25 bp, Mus musculus
gaaagagaaggtctgggcccactat

SEQ ID NO: 924291 - DNA, 25 bp, Mus musculus
gaaagagaggatcagacagaaaaca

SEQ ID NO: 924292 - DNA, 25 bp, Mus musculus
gaaagagaggatgagacagaaaaca

SEQ ID NO: 924293 - DNA, 25 bp, Mus musculus
gaaagagatcagatccctgaatccc

SEQ ID NO: 924294 - DNA, 25 bp, Mus musculus
gaaagagatcagttccctgaatccc

SEQ ID NO: 924295 - DNA, 25 bp, Mus musculus
gaaagagctgagcatcatctgtccc

SEQ ID NO: 924296 - DNA, 25 bp, Mus musculus
gaaagagctgaggatcatctgtccc

SEQ ID NO: 924297 - DNA, 25 bp, Mus musculus
gaaagaggctgtcgatgaagatgtg

SEQ ID NO: 924298 - DNA, 25 bp, Mus musculus
gaaagaggctgtggatgaagatgtg

SEQ ID NO: 924299 - DNA, 25 bp, Mus musculus
gaaagataagaaagactgtacattt

SEQ ID NO: 924300 - DNA, 25 bp, Mus musculus
gaaagataagaatgactgtacattt

SEQ ID NO: 924301 - DNA, 25 bp, Mus musculus
gaaagataatcacattataccgaaa

SEQ ID NO: 924302 - DNA, 25 bp, Mus musculus
gaaagataatcacccgtggggccaa

SEQ ID NO: 924303 - DNA, 25 bp, Mus musculus
gaaagataatcagattataccgaaa

SEQ ID NO: 924304 - DNA, 25 bp, Mus musculus
gaaagataatcagccgtggggccaa

SEQ ID NO: 924305 - DNA, 25 bp, Mus musculus
gaaagatattgactcatataaaagc

SEQ ID NO: 924306 - DNA, 25 bp, Mus musculus
gaaagatattgagtcatataaaagc

SEQ ID NO: 924307 - DNA, 25 bp, Mus musculus
gaaagatcaatgcgcagcagcaatg

SEQ ID NO: 924308 - DNA, 25 bp, Mus musculus
gaaagatcaatgggcagcagcaatg

SEQ ID NO: 924309 - DNA, 25 bp, Mus musculus
gaaagatcagcaaaagactgatacc

SEQ ID NO: 924310 - DNA, 25 bp, Mus musculus
gaaagatcagccgagtactaacagt

SEQ ID NO: 924311 - DNA, 25 bp, Mus musculus
gaaagatcaggaaaagactgatacc

SEQ ID NO: 924312 - DNA, 25 bp, Mus musculus
gaaagatcaggcgagtactaacagt

SEQ ID NO: 924313 - DNA, 25 bp, Mus musculus
gaaagatgacaacttgaccccaaag

SEQ ID NO: 924314 - DNA, 25 bp, Mus musculus
gaaagatgacaagttgaccccaaag

SEQ ID NO: 924315 - DNA, 25 bp, Mus musculus
gaaagatggaaagtcttaagaaaga

SEQ ID NO: 924316 - DNA, 25 bp, Mus musculus
gaaagatggaaagtgttaagaaaga

SEQ ID NO: 924317 - DNA, 25 bp, Mus musculus
gaaagatgttgtcaatgtttatgaa

SEQ ID NO: 924318 - DNA, 25 bp, Mus musculus
gaaagatgttgtcattgtttatgaa

SEQ ID NO: 924319 - DNA, 25 bp, Mus musculus
gaaagattacagccagagtggcatg

SEQ ID NO: 924320 - DNA, 25 bp, Mus musculus
gaaagattacaggcagagtggcatg

SEQ ID NO: 924321 - DNA, 25 bp, Mus musculus
gaaagcaacaggcatgaagtacaac

SEQ ID NO: 924322 - DNA, 25 bp, Mus musculus
gaaagcaacagggatgaagtacaac

SEQ ID NO: 924323 - DNA, 25 bp, Mus musculus
gaaagcaatgagcattctgatcatg

SEQ ID NO: 924324 - DNA, 25 bp, Mus musculus
gaaagcaatgaggattctgatcatg

SEQ ID NO: 924325 - DNA, 25 bp, Mus musculus
gaaagcacagatggacagctcccag

SEQ ID NO: 924326 - DNA, 25 bp, Mus musculus
gaaagcacagttggacagctcccag

SEQ ID NO: 924327 - DNA, 25 bp, Mus musculus
gaaagcaccaggaccccggcgctac

SEQ ID NO: 924328 - DNA, 25 bp, Mus musculus
gaaagcaccaggtccccggcgctac

SEQ ID NO: 924329 - DNA, 25 bp, Mus musculus
gaaagcaccgcacgtatcagcctag

SEQ ID NO: 924330 - DNA, 25 bp, Mus musculus
gaaagcaccgcaggtatcagcctag

SEQ ID NO: 924331 - DNA, 25 bp, Mus musculus
gaaagcaccgtgcgcgcagagtgtg

SEQ ID NO: 924332 - DNA, 25 bp, Mus musculus
gaaagcaccgtgggcgcagagtgtg

SEQ ID NO: 924333 - DNA, 25 bp, Mus musculus
gaaagcagcctccgagacaggagct

SEQ ID NO: 924334 - DNA, 25 bp, Mus musculus
gaaagcagcctcggagacaggagct

SEQ ID NO: 924335 - DNA, 25 bp, Mus musculus
gaaagcatcaaccacctggtgtaca

SEQ ID NO: 924336 - DNA, 25 bp, Mus musculus
gaaagcatcaaccagctggtgtaca

SEQ ID NO: 924337 - DNA, 25 bp, Mus musculus
gaaagcatcaccctaatgactcggg

SEQ ID NO: 924338 - DNA, 25 bp, Mus musculus
gaaagcatcacccttatgactcggg

SEQ ID NO: 924339 - DNA, 25 bp, Mus musculus
gaaagcattaagccacaaacaaaag

SEQ ID NO: 924340 - DNA, 25 bp, Mus musculus
gaaagcattaaggcacaaacaaaag

SEQ ID NO: 924341 - DNA, 25 bp, Mus musculus
gaaagccaagatgccagaccagttt

SEQ ID NO: 924342 - DNA, 25 bp, Mus musculus
gaaagccaagcgcgctgatggcaaa

SEQ ID NO: 924343 - DNA, 25 bp, Mus musculus
gaaagccaagggcgctgatggcaaa

SEQ ID NO: 924344 - DNA, 25 bp, Mus musculus
gaaagccaagtgaaacacccataga

SEQ ID NO: 924345 - DNA, 25 bp, Mus musculus
gaaagccaagtgtaacacccataga

SEQ ID NO: 924346 - DNA, 25 bp, Mus musculus
gaaagccaagttgccagaccagttt

SEQ ID NO: 924347 - DNA, 25 bp, Mus musculus
gaaagccagtgtctcagttgcaggg

SEQ ID NO: 924348 - DNA, 25 bp, Mus musculus
gaaagccagtgtcttgcagggctgg

SEQ ID NO: 924349 - DNA, 25 bp, Mus musculus
gaaagccagtgtgtcagttgcaggg

SEQ ID NO: 924350 - DNA, 25 bp, Mus musculus
gaaagccagtgtgttgcagggctgg

SEQ ID NO: 924351 - DNA, 25 bp, Mus musculus
gaaagccatcaacgacctagacaga

SEQ ID NO: 924352 - DNA, 25 bp, Mus musculus
gaaagccatcaacttgcctgcagga

SEQ ID NO: 924353 - DNA, 25 bp, Mus musculus
gaaagccatcaaggacctagacaga

SEQ ID NO: 924354 - DNA, 25 bp, Mus musculus
gaaagccatcaagttgcctgcagga

SEQ ID NO: 924355 - DNA, 25 bp, Mus musculus
gaaagccatgcgccagagaccgctg

SEQ ID NO: 924356 - DNA, 25 bp, Mus musculus
gaaagccatgcggcagagaccgctg

SEQ ID NO: 924357 - DNA, 25 bp, Mus musculus
gaaagcccagagaaaggaatccaag

SEQ ID NO: 924358 - DNA, 25 bp, Mus musculus
gaaagcccagcagagaaaggaatcc

SEQ ID NO: 924359 - DNA, 25 bp, Mus musculus
gaaagcccaggagagaaaggaatcc

SEQ ID NO: 924360 - DNA, 25 bp, Mus musculus
gaaagcccagtgaaaggaatccaag

SEQ ID NO: 924361 - DNA, 25 bp, Mus musculus
gaaagccctgtcagagtttgtagac

SEQ ID NO: 924362 - DNA, 25 bp, Mus musculus
gaaagccctgtcagtgtttgtagac

SEQ ID NO: 924363 - DNA, 25 bp, Mus musculus
gaaagcctatatgcttcagtggagg

SEQ ID NO: 924364 - DNA, 25 bp, Mus musculus
gaaagcctatttgcttcagtggagg

SEQ ID NO: 924365 - DNA, 25 bp, Mus musculus
gaaagcgaagagcccgtctctgggg

SEQ ID NO: 924366 - DNA, 25 bp, Mus musculus
gaaagcgaagagccggtctctgggg

SEQ ID NO: 924367 - DNA, 25 bp, Mus musculus
gaaagcgacagaaacatgtccgacc

SEQ ID NO: 924368 - DNA, 25 bp, Mus musculus
gaaagcgacagaaagatgtccgacc

SEQ ID NO: 924369 - DNA, 25 bp, Mus musculus
gaaagctaagccttatgcagccaac

SEQ ID NO: 924370 - DNA, 25 bp, Mus musculus
gaaagctaaggcttatgcagccaac

SEQ ID NO: 924371 - DNA, 25 bp, Mus musculus
gaaagctactctcgtggagagctct

SEQ ID NO: 924372 - DNA, 25 bp, Mus musculus
gaaagctactctggtggagagctct

SEQ ID NO: 924373 - DNA, 25 bp, Mus musculus
gaaagctcagagctgccgagagcag

SEQ ID NO: 924374 - DNA, 25 bp, Mus musculus
gaaagctcagaggtgccgagagcag

SEQ ID NO: 924375 - DNA, 25 bp, Mus musculus
gaaagctcagatcacgtaagggagc

SEQ ID NO: 924376 - DNA, 25 bp, Mus musculus
gaaagctcagatcaggtaagggagc

SEQ ID NO: 924377 - DNA, 25 bp, Mus musculus
gaaagctcatggccggactggacat

SEQ ID NO: 924378 - DNA, 25 bp, Mus musculus
gaaagctcatgggcggactggacat

SEQ ID NO: 924379 - DNA, 25 bp, Mus musculus
gaaagcttatttcgtatgctaacag

SEQ ID NO: 924380 - DNA, 25 bp, Mus musculus
gaaagcttatttggtatgctaacag

SEQ ID NO: 924381 - DNA, 25 bp, Mus musculus
gaaagcttgcagccctttctcatag

SEQ ID NO: 924382 - DNA, 25 bp, Mus musculus
gaaagcttgcaggcctttctcatag

SEQ ID NO: 924383 - DNA, 25 bp, Mus musculus
gaaagctttaaacaagaggctcaag

SEQ ID NO: 924384 - DNA, 25 bp, Mus musculus
gaaagctttaaacaaggggcgcaga

SEQ ID NO: 924385 - DNA, 25 bp, Mus musculus
gaaagctttaaacatgaggctcaag

SEQ ID NO: 924386 - DNA, 25 bp, Mus musculus
gaaagctttaaacatggggcgcaga

SEQ ID NO: 924387 - DNA, 25 bp, Mus musculus
gaaaggaaatatcggtgtttgcttt

SEQ ID NO: 924388 - DNA, 25 bp, Mus musculus
gaaaggaaatatgggtgtttgcttt

SEQ ID NO: 924389 - DNA, 25 bp, Mus musculus
gaaaggaacagactgacttaaccac

SEQ ID NO: 924390 - DNA, 25 bp, Mus musculus
gaaaggaacagagtgacttaaccac

SEQ ID NO: 924391 - DNA, 25 bp, Mus musculus
gaaaggaaggctcacaccagccaac

SEQ ID NO: 924392 - DNA, 25 bp, Mus musculus
gaaaggaaggctcagaccagccaac

SEQ ID NO: 924393 - DNA, 25 bp, Mus musculus
gaaaggagaaaatttacctttattg

SEQ ID NO: 924394 - DNA, 25 bp, Mus musculus
gaaaggagaatatttacctttattg

SEQ ID NO: 924395 - DNA, 25 bp, Mus musculus
gaaaggagacagcggtgtatttggt

SEQ ID NO: 924396 - DNA, 25 bp, Mus musculus
gaaaggagacaggggtgtatttggt

SEQ ID NO: 924397 - DNA, 25 bp, Mus musculus
gaaaggagacatcggggagcctggt

SEQ ID NO: 924398 - DNA, 25 bp, Mus musculus
gaaaggagacatgggggagcctggt

SEQ ID NO: 924399 - DNA, 25 bp, Mus musculus
gaaaggagatccacatgaaatgaag

SEQ ID NO: 924400 - DNA, 25 bp, Mus musculus
gaaaggagatgcacatgaaatgaag

SEQ ID NO: 924401 - DNA, 25 bp, Mus musculus
gaaaggatgcagagtgtggctgcat

SEQ ID NO: 924402 - DNA, 25 bp, Mus musculus
gaaaggatgcagcaccatcagcacg

SEQ ID NO: 924403 - DNA, 25 bp, Mus musculus
gaaaggatgcaggaccatcagcacg

SEQ ID NO: 924404 - DNA, 25 bp, Mus musculus
gaaaggatgcagtgtgtggctgcat

SEQ ID NO: 924405 - DNA, 25 bp, Mus musculus
gaaaggattaggcatcttggcaacc

SEQ ID NO: 924406 - DNA, 25 bp, Mus musculus
gaaaggattagggatcttggcaacc

SEQ ID NO: 924407 - DNA, 25 bp, Mus musculus
gaaaggcaagcgacccacatcactg

SEQ ID NO: 924408 - DNA, 25 bp, Mus musculus
gaaaggcaagggacccacatcactg

SEQ ID NO: 924409 - DNA, 25 bp, Mus musculus
gaaaggcacagacgcatcaacagta

SEQ ID NO: 924410 - DNA, 25 bp, Mus musculus
gaaaggcacagacggatcaacagta

SEQ ID NO: 924411 - DNA, 25 bp, Mus musculus
gaaaggccaagcatgccctgcttgt

SEQ ID NO: 924412 - DNA, 25 bp, Mus musculus
gaaaggccaagcttgccctgcttgt

SEQ ID NO: 924413 - DNA, 25 bp, Mus musculus
gaaaggccccatgaacgtgttggtg

SEQ ID NO: 924414 - DNA, 25 bp, Mus musculus
gaaaggccccatgatcgtgttggtg

SEQ ID NO: 924415 - DNA, 25 bp, Mus musculus
gaaaggcgagatttatgtcattgaa

SEQ ID NO: 924416 - DNA, 25 bp, Mus musculus
gaaaggcgagttttatgtcattgaa

SEQ ID NO: 924417 - DNA, 25 bp, Mus musculus
gaaaggctgaagcaaacagagaaga

SEQ ID NO: 924418 - DNA, 25 bp, Mus musculus
gaaaggctgaaggaaacagagaaga

SEQ ID NO: 924419 - DNA, 25 bp, Mus musculus
gaaagggcaaaagacatatatccag

SEQ ID NO: 924420 - DNA, 25 bp, Mus musculus
gaaagggcaaaagagatatatccag

SEQ ID NO: 924421 - DNA, 25 bp, Mus musculus
gaaagggcccatcatctccatcttt

SEQ ID NO: 924422 - DNA, 25 bp, Mus musculus
gaaagggcccatgatctccatcttt

SEQ ID NO: 924423 - DNA, 25 bp, Mus musculus
gaaagggggccacgatgacgatgat

SEQ ID NO: 924424 - DNA, 25 bp, Mus musculus
gaaagggggccaggatgacgatgat

SEQ ID NO: 924425 - DNA, 25 bp, Mus musculus
gaaaggtaaaaaccttggctcatac

SEQ ID NO: 924426 - DNA, 25 bp, Mus musculus
gaaaggtaaaaagcttggctcatac

SEQ ID NO: 924427 - DNA, 25 bp, Mus musculus
gaaaggtatcccagtacagcttctt

SEQ ID NO: 924428 - DNA, 25 bp, Mus musculus
gaaaggtatccctgtacagcttctt

SEQ ID NO: 924429 - DNA, 25 bp, Mus musculus
gaaaggtgtgctcgtgcgatgcatg

SEQ ID NO: 924430 - DNA, 25 bp, Mus musculus
gaaaggtgtgctggtgcgatgcatg

SEQ ID NO: 924431 - DNA, 25 bp, Mus musculus
gaaaggttacaacagtgaaacatct

SEQ ID NO: 924432 - DNA, 25 bp, Mus musculus
gaaaggttacaagagtgaaacatct

SEQ ID NO: 924433 - DNA, 25 bp, Mus musculus
gaaagtaaatgcttagtcattgaga

SEQ ID NO: 924434 - DNA, 25 bp, Mus musculus
gaaagtaaatgctttgtcattgaga

SEQ ID NO: 924435 - DNA, 25 bp, Mus musculus
gaaagtaaatggaacgcatacgatg

SEQ ID NO: 924436 - DNA, 25 bp, Mus musculus
gaaagtaaatggaaggcatacgatg

SEQ ID NO: 924437 - DNA, 25 bp, Mus musculus
gaaagtcatcttcactcgaagtgaa

SEQ ID NO: 924438 - DNA, 25 bp, Mus musculus
gaaagtcatcttgactcgaagtgaa

SEQ ID NO: 924439 - DNA, 25 bp, Mus musculus
gaaagtccacaacacgaaacacact

SEQ ID NO: 924440 - DNA, 25 bp, Mus musculus
gaaagtccacaacaggaaacacact

SEQ ID NO: 924441 - DNA, 25 bp, Mus musculus
gaaagtcggacacaggcttccgcca

SEQ ID NO: 924442 - DNA, 25 bp, Mus musculus
gaaagtcggacacgcttccgccaca

SEQ ID NO: 924443 - DNA, 25 bp, Mus musculus
gaaagtcggacagaggcttccgcca

SEQ ID NO: 924444 - DNA, 25 bp, Mus musculus
gaaagtcggacaggcttccgccaca

SEQ ID NO: 924445 - DNA, 25 bp, Mus musculus
gaaagtcttcagatgaatggcggcg

SEQ ID NO: 924446 - DNA, 25 bp, Mus musculus
gaaagtcttcagttgaatggcggcg

SEQ ID NO: 924447 - DNA, 25 bp, Mus musculus
gaaagtgaagcactttctcagattt

SEQ ID NO: 924448 - DNA, 25 bp, Mus musculus
gaaagtgaaggactttctcagattt

SEQ ID NO: 924449 - DNA, 25 bp, Mus musculus
gaaagtgagaacagaaaccttgagg

SEQ ID NO: 924450 - DNA, 25 bp, Mus musculus
gaaagtgagaacagtaaccttgagg

SEQ ID NO: 924451 - DNA, 25 bp, Mus musculus
gaaagtgatgagatcctaagggaag

SEQ ID NO: 924452 - DNA, 25 bp, Mus musculus
gaaagtgatgagttcctaagggaag

SEQ ID NO: 924453 - DNA, 25 bp, Mus musculus
gaaagtgcggaaatcggagaagaaa

SEQ ID NO: 924454 - DNA, 25 bp, Mus musculus
gaaagtgcggaaatgggagaagaaa

SEQ ID NO: 924455 - DNA, 25 bp, Mus musculus
gaaagtggcaagacagtacaggcta

SEQ ID NO: 924456 - DNA, 25 bp, Mus musculus
gaaagtggcaagatcttagggttgg

SEQ ID NO: 924457 - DNA, 25 bp, Mus musculus
gaaagtggcaagtcagtacaggcta

SEQ ID NO: 924458 - DNA, 25 bp, Mus musculus
gaaagtggcaagttcttagggttgg

SEQ ID NO: 924459 - DNA, 25 bp, Mus musculus
gaaagtggctcactggttgattcag

SEQ ID NO: 924460 - DNA, 25 bp, Mus musculus
gaaagtggctcagtggttgattcag

SEQ ID NO: 924461 - DNA, 25 bp, Mus musculus
gaaagtggctttatctgtaacatca

SEQ ID NO: 924462 - DNA, 25 bp, Mus musculus
gaaagtggctttttctgtaacatca

SEQ ID NO: 924463 - DNA, 25 bp, Mus musculus
gaaagtgtatcaaagcaaagtcctg

SEQ ID NO: 924464 - DNA, 25 bp, Mus musculus
gaaagtgtatcacaaagtcctgtga

SEQ ID NO: 924465 - DNA, 25 bp, Mus musculus
gaaagtgtatcagaaagtcctgtga

SEQ ID NO: 924466 - DNA, 25 bp, Mus musculus
gaaagtgtatcatagcaaagtcctg

SEQ ID NO: 924467 - DNA, 25 bp, Mus musculus
gaaagttctaagagtctcctgtttc

SEQ ID NO: 924468 - DNA, 25 bp, Mus musculus
gaaagttctaagtgtctcctgtttc

SEQ ID NO: 924469 - DNA, 25 bp, Mus musculus
gaaagttgcaaaaatcttggcaatg

SEQ ID NO: 924470 - DNA, 25 bp, Mus musculus
gaaagttgcaaatgattcattcctt

SEQ ID NO: 924471 - DNA, 25 bp, Mus musculus
gaaagttgcataaatcttggcaatg

SEQ ID NO: 924472 - DNA, 25 bp, Mus musculus
gaaagttgcatatgattcattcctt

SEQ ID NO: 924473 - DNA, 25 bp, Mus musculus
gaaagttgccaaaaagatgaaaaca

SEQ ID NO: 924474 - DNA, 25 bp, Mus musculus
gaaagttgccaaaatgatgaaaaca

SEQ ID NO: 924475 - DNA, 25 bp, Mus musculus
gaaagttttcacagctattgcagac

SEQ ID NO: 924476 - DNA, 25 bp, Mus musculus
gaaagttttcactgctattgcagac

SEQ ID NO: 924477 - DNA, 25 bp, Mus musculus
gaaataaccgatgacgaacagtttg

SEQ ID NO: 924478 - DNA, 25 bp, Mus musculus
gaaataaccgttgacgaacagtttg

SEQ ID NO: 924479 - DNA, 25 bp, Mus musculus
gaaatacagtggaacgttacagtgc

SEQ ID NO: 924480 - DNA, 25 bp, Mus musculus
gaaatacagtggaaggttacagtgc

SEQ ID NO: 924481 - DNA, 25 bp, Mus musculus
gaaatacatgctgtctgtgcttcat

SEQ ID NO: 924482 - DNA, 25 bp, Mus musculus
gaaatacatggtgtctgtgcttcat

SEQ ID NO: 924483 - DNA, 25 bp, Mus musculus
gaaatacattttcacggacaagccc

SEQ ID NO: 924484 - DNA, 25 bp, Mus musculus
gaaatacattttcagggacaagccc

SEQ ID NO: 924485 - DNA, 25 bp, Mus musculus
gaaataccaaatcacttcaccttga

SEQ ID NO: 924486 - DNA, 25 bp, Mus musculus
gaaataccaaatgacttcaccttga

SEQ ID NO: 924487 - DNA, 25 bp, Mus musculus
gaaataccagaacagaaagtttcac

SEQ ID NO: 924488 - DNA, 25 bp, Mus musculus
gaaataccagaagagaaagtttcac

SEQ ID NO: 924489 - DNA, 25 bp, Mus musculus
gaaataccagaccctggcctacagc

SEQ ID NO: 924490 - DNA, 25 bp, Mus musculus
gaaataccagtccctggcctacagc

SEQ ID NO: 924491 - DNA, 25 bp, Mus musculus
gaaataccgtagatgggtacagtag

SEQ ID NO: 924492 - DNA, 25 bp, Mus musculus
gaaataccgtagttgggtacagtag

SEQ ID NO: 924493 - DNA, 25 bp, Mus musculus
gaaatacgttcgcaactcacggatg

SEQ ID NO: 924494 - DNA, 25 bp, Mus musculus
gaaatacgttcgcatctcacggatg

SEQ ID NO: 924495 - DNA, 25 bp, Mus musculus
gaaatactgaagcataagaaactga

SEQ ID NO: 924496 - DNA, 25 bp, Mus musculus
gaaatactgaaggataagaaactga

SEQ ID NO: 924497 - DNA, 25 bp, Mus musculus
gaaatagaaggaagctgagcagtga

SEQ ID NO: 924498 - DNA, 25 bp, Mus musculus
gaaatagaaggaaggtgagcagtga

SEQ ID NO: 924499 - DNA, 25 bp, Mus musculus
gaaatagatgcaaacgcagaagaag

SEQ ID NO: 924500 - DNA, 25 bp, Mus musculus
gaaatagatgcaaaggcagaagaag

SEQ ID NO: 924501 - DNA, 25 bp, Mus musculus
gaaatatcatatctcgccatcagac

SEQ ID NO: 924502 - DNA, 25 bp, Mus musculus
gaaatatcatatctggccatcagac

SEQ ID NO: 924503 - DNA, 25 bp, Mus musculus
gaaatatgaacacgcatgtaatgaa

SEQ ID NO: 924504 - DNA, 25 bp, Mus musculus
gaaatatgaacaggcatgtaatgaa

SEQ ID NO: 924505 - DNA, 25 bp, Mus musculus
gaaatatgacaactcttggctggct

SEQ ID NO: 924506 - DNA, 25 bp, Mus musculus
gaaatatgacaactgttggctggct

SEQ ID NO: 924507 - DNA, 25 bp, Mus musculus
gaaatatgcttgcaaggaccttcgt

SEQ ID NO: 924508 - DNA, 25 bp, Mus musculus
gaaatatgcttgcatggaccttcgt

SEQ ID NO: 924509 - DNA, 25 bp, Mus musculus
gaaatatttgagcataacagcttcg

SEQ ID NO: 924510 - DNA, 25 bp, Mus musculus
gaaatatttgaggataacagcttcg

SEQ ID NO: 924511 - DNA, 25 bp, Mus musculus
gaaatcaaccaacctgctcttctca

SEQ ID NO: 924512 - DNA, 25 bp, Mus musculus
gaaatcaaccaagctgctcttctca

SEQ ID NO: 924513 - DNA, 25 bp, Mus musculus
gaaatcacagaactagacaccctga

SEQ ID NO: 924514 - DNA, 25 bp, Mus musculus
gaaatcacagtactagacaccctga

SEQ ID NO: 924515 - DNA, 25 bp, Mus musculus
gaaatcacgaagatagcctgtattc

SEQ ID NO: 924516 - DNA, 25 bp, Mus musculus
gaaatcacgaagttagcctgtattc

SEQ ID NO: 924517 - DNA, 25 bp, Mus musculus
gaaatcagatagacttccccgctgg

SEQ ID NO: 924518 - DNA, 25 bp, Mus musculus
gaaatcagatagtcttccccgctgg

SEQ ID NO: 924519 - DNA, 25 bp, Mus musculus
gaaatcagttaacgtcattgttgtg

SEQ ID NO: 924520 - DNA, 25 bp, Mus musculus
gaaatcagttaaggtcattgttgtg

SEQ ID NO: 924521 - DNA, 25 bp, Mus musculus
gaaatcattattttagacacagaat

SEQ ID NO: 924522 - DNA, 25 bp, Mus musculus
gaaatcattatttttgacacagaat

SEQ ID NO: 924523 - DNA, 25 bp, Mus musculus
gaaatccaagaaaatgtacaggcgg

SEQ ID NO: 924524 - DNA, 25 bp, Mus musculus
gaaatccaagtaaatgtacaggcgg

SEQ ID NO: 924525 - DNA, 25 bp, Mus musculus
gaaatccacaagcatcgatactggc

SEQ ID NO: 924526 - DNA, 25 bp, Mus musculus
gaaatccacaaggatcgatactggc

SEQ ID NO: 924527 - DNA, 25 bp, Mus musculus
gaaatccataatgacgtggagtttg

SEQ ID NO: 924528 - DNA, 25 bp, Mus musculus
gaaatccataatgaggtggagtttg

SEQ ID NO: 924529 - DNA, 25 bp, Mus musculus
gaaatccgacagcgcttcttcacag

SEQ ID NO: 924530 - DNA, 25 bp, Mus musculus
gaaatccgacagggcttcttcacag

SEQ ID NO: 924531 - DNA, 25 bp, Mus musculus
gaaatcctcaaacctgtaccgccga

SEQ ID NO: 924532 - DNA, 25 bp, Mus musculus
gaaatcctcaaagctgtaccgccga

SEQ ID NO: 924533 - DNA, 25 bp, Mus musculus
gaaatcctcaggcgattggcacatc

SEQ ID NO: 924534 - DNA, 25 bp, Mus musculus
gaaatcctcaggggattggcacatc

SEQ ID NO: 924535 - DNA, 25 bp, Mus musculus
gaaatccttcctcgaaggccggatg

SEQ ID NO: 924536 - DNA, 25 bp, Mus musculus
gaaatccttcctggaaggccggatg

SEQ ID NO: 924537 - DNA, 25 bp, Mus musculus
gaaatcgaagcacaaaatgaacagg

SEQ ID NO: 924538 - DNA, 25 bp, Mus musculus
gaaatcgaagcagaaaatgaacagg

SEQ ID NO: 924539 - DNA, 25 bp, Mus musculus
gaaatcgcagaaagccacaggttct

SEQ ID NO: 924540 - DNA, 25 bp, Mus musculus
gaaatcgcagtaagccacaggttct

SEQ ID NO: 924541 - DNA, 25 bp, Mus musculus
gaaatctcaagaaacgatggatgat

SEQ ID NO: 924542 - DNA, 25 bp, Mus musculus
gaaatctcaagaaaggatggatgat

SEQ ID NO: 924543 - DNA, 25 bp, Mus musculus
gaaatctctataaaattcaacttac

SEQ ID NO: 924544 - DNA, 25 bp, Mus musculus
gaaatctctatataattcaacttac

SEQ ID NO: 924545 - DNA, 25 bp, Mus musculus
gaaatctctccgcgcttgtcaggac

SEQ ID NO: 924546 - DNA, 25 bp, Mus musculus
gaaatctctcggcgcttgtcaggac

SEQ ID NO: 924547 - DNA, 25 bp, Mus musculus
gaaatctgaagaaggcgccagcctc

SEQ ID NO: 924548 - DNA, 25 bp, Mus musculus
gaaatctgaagatggcgccagcctc

SEQ ID NO: 924549 - DNA, 25 bp, Mus musculus
gaaatctgcagacctggacgctagt

SEQ ID NO: 924550 - DNA, 25 bp, Mus musculus
gaaatctgcagagctggacgctagt

SEQ ID NO: 924551 - DNA, 25 bp, Mus musculus
gaaatcttagagattgatgacctgg

SEQ ID NO: 924552 - DNA, 25 bp, Mus musculus
gaaatcttagtgattgatgacctgg

SEQ ID NO: 924553 - DNA, 25 bp, Mus musculus
gaaatctttctgctatacattgtcc

SEQ ID NO: 924554 - DNA, 25 bp, Mus musculus
gaaatctttctggtatacattgtcc

SEQ ID NO: 924555 - DNA, 25 bp, Mus musculus
gaaatgaaaactcagggagatgaga

SEQ ID NO: 924556 - DNA, 25 bp, Mus musculus
gaaatgaaaactgagggagatgaga

SEQ ID NO: 924557 - DNA, 25 bp, Mus musculus
gaaatgaaagatccagcaatgacat

SEQ ID NO: 924558 - DNA, 25 bp, Mus musculus
gaaatgaaagttccagcaatgacat

SEQ ID NO: 924559 - DNA, 25 bp, Mus musculus
gaaatgacagcagatattgatgaaa

SEQ ID NO: 924560 - DNA, 25 bp, Mus musculus
gaaatgacaggagatattgatgaaa

SEQ ID NO: 924561 - DNA, 25 bp, Mus musculus
gaaatgaccaaccactacagtattc

SEQ ID NO: 924562 - DNA, 25 bp, Mus musculus
gaaatgaccaaccactattctcttc

SEQ ID NO: 924563 - DNA, 25 bp, Mus musculus
gaaatgaccaaccagtacagtattc

SEQ ID NO: 924564 - DNA, 25 bp, Mus musculus
gaaatgaccaaccagtattctcttc

SEQ ID NO: 924565 - DNA, 25 bp, Mus musculus
gaaatgatccagctactgcagggtg

SEQ ID NO: 924566 - DNA, 25 bp, Mus musculus
gaaatgatccaggtactgcagggtg

SEQ ID NO: 924567 - DNA, 25 bp, Mus musculus
gaaatgatccttaacgtggtgatgg

SEQ ID NO: 924568 - DNA, 25 bp, Mus musculus
gaaatgatccttaaggtggtgatgg

SEQ ID NO: 924569 - DNA, 25 bp, Mus musculus
gaaatgcaaaagcaccctgatagaa

SEQ ID NO: 924570 - DNA, 25 bp, Mus musculus
gaaatgcaaaaggaccctgatagaa

SEQ ID NO: 924571 - DNA, 25 bp, Mus musculus
gaaatgcaaacaacagatgtaattg

SEQ ID NO: 924572 - DNA, 25 bp, Mus musculus
gaaatgcaaacatcagatgtaattg

SEQ ID NO: 924573 - DNA, 25 bp, Mus musculus
gaaatgcagcttaacgtcttacatt

SEQ ID NO: 924574 - DNA, 25 bp, Mus musculus
gaaatgcagcttaaggtcttacatt

SEQ ID NO: 924575 - DNA, 25 bp, Mus musculus
gaaatgccaacacatggctgaggac

SEQ ID NO: 924576 - DNA, 25 bp, Mus musculus
gaaatgccaacaccagatggctgag

SEQ ID NO: 924577 - DNA, 25 bp, Mus musculus
gaaatgccaacagatggctgaggac

SEQ ID NO: 924578 - DNA, 25 bp, Mus musculus
gaaatgccaacagcagatggctgag

SEQ ID NO: 924579 - DNA, 25 bp, Mus musculus
gaaatgcgccagatgatgaaggttg

SEQ ID NO: 924580 - DNA, 25 bp, Mus musculus
gaaatgcgccagttgatgaaggttg

SEQ ID NO: 924581 - DNA, 25 bp, Mus musculus
gaaatgctcccgctaagtcgtcagc

SEQ ID NO: 924582 - DNA, 25 bp, Mus musculus
gaaatgctcccgctagtgttgcaga

SEQ ID NO: 924583 - DNA, 25 bp, Mus musculus
gaaatgctcccgcttagtcgtcagc

SEQ ID NO: 924584 - DNA, 25 bp, Mus musculus
gaaatgctcccgcttgtgttgcaga

SEQ ID NO: 924585 - DNA, 25 bp, Mus musculus
gaaatggagatatccatattatgtc

SEQ ID NO: 924586 - DNA, 25 bp, Mus musculus
gaaatggagatatcgatattatgtc

SEQ ID NO: 924587 - DNA, 25 bp, Mus musculus
gaaatggagcagcagccctgcctag

SEQ ID NO: 924588 - DNA, 25 bp, Mus musculus
gaaatggagcaggagccctgcctag

SEQ ID NO: 924589 - DNA, 25 bp, Mus musculus
gaaatggatcgacaagtgcaatgaa

SEQ ID NO: 924590 - DNA, 25 bp, Mus musculus
gaaatggatcgacatgtgcaatgaa

SEQ ID NO: 924591 - DNA, 25 bp, Mus musculus
gaaatggattatgacgaggcagaca

SEQ ID NO: 924592 - DNA, 25 bp, Mus musculus
gaaatggattatgaggaggcagaca

SEQ ID NO: 924593 - DNA, 25 bp, Mus musculus
gaaatggattctagtcctgttgttg

SEQ ID NO: 924594 - DNA, 25 bp, Mus musculus
gaaatggattcttgtcctgttgttg

SEQ ID NO: 924595 - DNA, 25 bp, Mus musculus
gaaatggcagcaaaggagaacaact

SEQ ID NO: 924596 - DNA, 25 bp, Mus musculus
gaaatggcaggaaaggagaacaact

SEQ ID NO: 924597 - DNA, 25 bp, Mus musculus
gaaatggcccatagaaaagagtcat

SEQ ID NO: 924598 - DNA, 25 bp, Mus musculus
gaaatggcccatcattttgttcttt

SEQ ID NO: 924599 - DNA, 25 bp, Mus musculus
gaaatggcccatctgctctgtaaca

SEQ ID NO: 924600 - DNA, 25 bp, Mus musculus
gaaatggcccatgattttgttcttt

SEQ ID NO: 924601 - DNA, 25 bp, Mus musculus
gaaatggcccatgtgctctgtaaca

SEQ ID NO: 924602 - DNA, 25 bp, Mus musculus
gaaatggcccattgaaaagagtcat

SEQ ID NO: 924603 - DNA, 25 bp, Mus musculus
gaaatgtctccgctattacgctggc

SEQ ID NO: 924604 - DNA, 25 bp, Mus musculus
gaaatgtctccggtattacgctggc

SEQ ID NO: 924605 - DNA, 25 bp, Mus musculus
gaaatgtgggctggctgctgaatct

SEQ ID NO: 924606 - DNA, 25 bp, Mus musculus
gaaatgtggggtggctgctgaatct

SEQ ID NO: 924607 - DNA, 25 bp, Mus musculus
gaaatgtgtgccttcagggaaaatg

SEQ ID NO: 924608 - DNA, 25 bp, Mus musculus
gaaatgtgtggcttcagggaaaatg

SEQ ID NO: 924609 - DNA, 25 bp, Mus musculus
gaaatgtgttaaaacacatcactca

SEQ ID NO: 924610 - DNA, 25 bp, Mus musculus
gaaatgtgttaaaagacatcactca

SEQ ID NO: 924611 - DNA, 25 bp, Mus musculus
gaaatgttccagaatgttaaaggat

SEQ ID NO: 924612 - DNA, 25 bp, Mus musculus
gaaatgttccagcctagagaagtta

SEQ ID NO: 924613 - DNA, 25 bp, Mus musculus
gaaatgttccaggctagagaagtta

SEQ ID NO: 924614 - DNA, 25 bp, Mus musculus
gaaatgttccagtatgttaaaggat

SEQ ID NO: 924615 - DNA, 25 bp, Mus musculus
gaaattaaagcatgaaggtcttctc

SEQ ID NO: 924616 - DNA, 25 bp, Mus musculus
gaaattaaagcgtacacttgatgcc

SEQ ID NO: 924617 - DNA, 25 bp, Mus musculus
gaaattaaaggatgaaggtcttctc

SEQ ID NO: 924618 - DNA, 25 bp, Mus musculus
gaaattaaagggtacacttgatgcc

SEQ ID NO: 924619 - DNA, 25 bp, Mus musculus
gaaattaacagacgatattttgccc

SEQ ID NO: 924620 - DNA, 25 bp, Mus musculus
gaaattaacagaggatattttgccc

SEQ ID NO: 924621 - DNA, 25 bp, Mus musculus
gaaattaatcaaccagacacaactc

SEQ ID NO: 924622 - DNA, 25 bp, Mus musculus
gaaattaatcaagcagacacaactc

SEQ ID NO: 924623 - DNA, 25 bp, Mus musculus
gaaattacagataaatttgggcagc

SEQ ID NO: 924624 - DNA, 25 bp, Mus musculus
gaaattacagcctctgcaaagttct

SEQ ID NO: 924625 - DNA, 25 bp, Mus musculus
gaaattacaggctctgcaaagttct

SEQ ID NO: 924626 - DNA, 25 bp, Mus musculus
gaaattacagttaaatttgggcagc

SEQ ID NO: 924627 - DNA, 25 bp, Mus musculus
gaaattaccctaagttatacattga

SEQ ID NO: 924628 - DNA, 25 bp, Mus musculus
gaaattaccctatgttatacattga

SEQ ID NO: 924629 - DNA, 25 bp, Mus musculus
gaaattacctggctttcctaatagg

SEQ ID NO: 924630 - DNA, 25 bp, Mus musculus
gaaattacctgggtttcctaatagg

SEQ ID NO: 924631 - DNA, 25 bp, Mus musculus
gaaattagggcaagagccagaggga

SEQ ID NO: 924632 - DNA, 25 bp, Mus musculus
gaaattaggggaagagccagaggga

SEQ ID NO: 924633 - DNA, 25 bp, Mus musculus
gaaattatagctaaaggaactcaag

SEQ ID NO: 924634 - DNA, 25 bp, Mus musculus
gaaattatagcttaaggaactcaag

SEQ ID NO: 924635 - DNA, 25 bp, Mus musculus
gaaattcaagatggttatattaaaa

SEQ ID NO: 924636 - DNA, 25 bp, Mus musculus
gaaattcaagttggttatattaaaa

SEQ ID NO: 924637 - DNA, 25 bp, Mus musculus
gaaattccacaacctgatcaacgtc

SEQ ID NO: 924638 - DNA, 25 bp, Mus musculus
gaaattccacaagctgatcaacgtc

SEQ ID NO: 924639 - DNA, 25 bp, Mus musculus
gaaattccaccaccagtatgagccc

SEQ ID NO: 924640 - DNA, 25 bp, Mus musculus
gaaattccaccagcagtatgagccc

SEQ ID NO: 924641 - DNA, 25 bp, Mus musculus
gaaattccagcatgtctgtgttaga

SEQ ID NO: 924642 - DNA, 25 bp, Mus musculus
gaaattccagcattgctgtgtctac

SEQ ID NO: 924643 - DNA, 25 bp, Mus musculus
gaaattccaggatgtctgtgttaga

SEQ ID NO: 924644 - DNA, 25 bp, Mus musculus
gaaattccaggattgctgtgtctac

SEQ ID NO: 924645 - DNA, 25 bp, Mus musculus
gaaattcgaactcgtgttgatcagt

SEQ ID NO: 924646 - DNA, 25 bp, Mus musculus
gaaattcgaactggtgttgatcagt

SEQ ID NO: 924647 - DNA, 25 bp, Mus musculus
gaaattcgagagaacatgacaatac

SEQ ID NO: 924648 - DNA, 25 bp, Mus musculus
gaaattcgagagaagatgacaatac

SEQ ID NO: 924649 - DNA, 25 bp, Mus musculus
gaaattgaagagcgcaaactggttg

SEQ ID NO: 924650 - DNA, 25 bp, Mus musculus
gaaattgaagagggcaaactggttg

SEQ ID NO: 924651 - DNA, 25 bp, Mus musculus
gaaattgagagacgtgatagaaatt

SEQ ID NO: 924652 - DNA, 25 bp, Mus musculus
gaaattgagagaggtgatagaaatt

SEQ ID NO: 924653 - DNA, 25 bp, Mus musculus
gaaattgatgaggctcgtgtgaact

SEQ ID NO: 924654 - DNA, 25 bp, Mus musculus
gaaattgatgagtgtgcaaatgact

SEQ ID NO: 924655 - DNA, 25 bp, Mus musculus
gaaattgatgtggctcgtgtgaact

SEQ ID NO: 924656 - DNA, 25 bp, Mus musculus
gaaattgatgtgtgtgcaaatgact

SEQ ID NO: 924657 - DNA, 25 bp, Mus musculus
gaaattgccaatcctacaactaaac

SEQ ID NO: 924658 - DNA, 25 bp, Mus musculus
gaaattgccaatgctacaactaaac

SEQ ID NO: 924659 - DNA, 25 bp, Mus musculus
gaaattgctgatggtgacaaagttc

SEQ ID NO: 924660 - DNA, 25 bp, Mus musculus
gaaattgctgttggtgacaaagttc

SEQ ID NO: 924661 - DNA, 25 bp, Mus musculus
gaaattggacagctccttcattttg

SEQ ID NO: 924662 - DNA, 25 bp, Mus musculus
gaaattggacaggtccttcattttg

SEQ ID NO: 924663 - DNA, 25 bp, Mus musculus
gaaattgggggaagctggattcagc

SEQ ID NO: 924664 - DNA, 25 bp, Mus musculus
gaaattgggggaaggtggattcagc

SEQ ID NO: 924665 - DNA, 25 bp, Mus musculus
gaaattgtgaaacaggtcctgtaat

SEQ ID NO: 924666 - DNA, 25 bp, Mus musculus
gaaattgtgaaagaggtcctgtaat

SEQ ID NO: 924667 - DNA, 25 bp, Mus musculus
gaaatttcagcatcattgggacttt

SEQ ID NO: 924668 - DNA, 25 bp, Mus musculus
gaaatttcaggatcattgggacttt

SEQ ID NO: 924669 - DNA, 25 bp, Mus musculus
gaaatttgagccctctggcttctgc

SEQ ID NO: 924670 - DNA, 25 bp, Mus musculus
gaaatttgaggcctctggcttctgc

SEQ ID NO: 924671 - DNA, 25 bp, Mus musculus
gaaattttccagctccactggtctc

SEQ ID NO: 924672 - DNA, 25 bp, Mus musculus
gaaattttccaggtccactggtctc

SEQ ID NO: 924673 - DNA, 25 bp, Mus musculus
gaaatttttattcgcctcaacagag

SEQ ID NO: 924674 - DNA, 25 bp, Mus musculus
gaaatttttattcggctcaacagag

SEQ ID NO: 924675 - DNA, 25 bp, Mus musculus
gaaatttttgacaacgcacggcaag

SEQ ID NO: 924676 - DNA, 25 bp, Mus musculus
gaaatttttgacaaggcacggcaag

SEQ ID NO: 924677 - DNA, 25 bp, Mus musculus
gaacaaaaatccaagctgggcgtgg

SEQ ID NO: 924678 - DNA, 25 bp, Mus musculus
gaacaaaaatgcaagctgggcgtgg

SEQ ID NO: 924679 - DNA, 25 bp, Mus musculus
gaacaaaccgatccttccatcatga

SEQ ID NO: 924680 - DNA, 25 bp, Mus musculus
gaacaaaccgttccttccatcatga

SEQ ID NO: 924681 - DNA, 25 bp, Mus musculus
gaacaaactcaacatgggaagtcat

SEQ ID NO: 924682 - DNA, 25 bp, Mus musculus
gaacaaactcaagatgggaagtcat

SEQ ID NO: 924683 - DNA, 25 bp, Mus musculus
gaacaaagagcagaaccacatcatg

SEQ ID NO: 924684 - DNA, 25 bp, Mus musculus
gaacaaagaggagaaccacatcatg

SEQ ID NO: 924685 - DNA, 25 bp, Mus musculus
gaacaacaagaacctatatgtggct

SEQ ID NO: 924686 - DNA, 25 bp, Mus musculus
gaacaacaagaagctatatgtggct

SEQ ID NO: 924687 - DNA, 25 bp, Mus musculus
gaacaacaagcacgcttttgatggc

SEQ ID NO: 924688 - DNA, 25 bp, Mus musculus
gaacaacaagcaggagactcccctg

SEQ ID NO: 924689 - DNA, 25 bp, Mus musculus
gaacaacaagcaggcttttgatggc

SEQ ID NO: 924690 - DNA, 25 bp, Mus musculus
gaacaacaaggaggagactcccctg

SEQ ID NO: 924691 - DNA, 25 bp, Mus musculus
gaacaacattccgacgtacctgaat

SEQ ID NO: 924692 - DNA, 25 bp, Mus musculus
gaacaacattccgaggtacctgaat

SEQ ID NO: 924693 - DNA, 25 bp, Mus musculus
gaacaacccgcaatactggagtaac

SEQ ID NO: 924694 - DNA, 25 bp, Mus musculus
gaacaacccggaatactggagtaac

SEQ ID NO: 924695 - DNA, 25 bp, Mus musculus
gaacaacttaagctactgggagatc

SEQ ID NO: 924696 - DNA, 25 bp, Mus musculus
gaacaacttaaggtactgggagatc

SEQ ID NO: 924697 - DNA, 25 bp, Mus musculus
gaacaagacgataacagaagatgaa

SEQ ID NO: 924698 - DNA, 25 bp, Mus musculus
gaacaagacgttaacagaagatgaa

SEQ ID NO: 924699 - DNA, 25 bp, Mus musculus
gaacaagactcacaataagcctgca

SEQ ID NO: 924700 - DNA, 25 bp, Mus musculus
gaacaagactcagaataagcctgca

SEQ ID NO: 924701 - DNA, 25 bp, Mus musculus
gaacaagaggcacatgggcatatca

SEQ ID NO: 924702 - DNA, 25 bp, Mus musculus
gaacaagaggcacctgtactaccaa

SEQ ID NO: 924703 - DNA, 25 bp, Mus musculus
gaacaagaggcagatgggcatatca

SEQ ID NO: 924704 - DNA, 25 bp, Mus musculus
gaacaagaggcagctgtactaccaa

SEQ ID NO: 924705 - DNA, 25 bp, Mus musculus
gaacaagcagcgatcacactaatcc

SEQ ID NO: 924706 - DNA, 25 bp, Mus musculus
gaacaagcagcgttcacactaatcc

SEQ ID NO: 924707 - DNA, 25 bp, Mus musculus
gaacaagcccagcagacaatcaggc

SEQ ID NO: 924708 - DNA, 25 bp, Mus musculus
gaacaagcccaggagacaatcaggc

SEQ ID NO: 924709 - DNA, 25 bp, Mus musculus
gaacaagctaaacgccatgagagca

SEQ ID NO: 924710 - DNA, 25 bp, Mus musculus
gaacaagctaaaggccatgagagca

SEQ ID NO: 924711 - DNA, 25 bp, Mus musculus
gaacaaggccagcactgtggcggcc

SEQ ID NO: 924712 - DNA, 25 bp, Mus musculus
gaacaaggccaggactgtggcggcc

SEQ ID NO: 924713 - DNA, 25 bp, Mus musculus
gaacaagtcaagatactggcagaag

SEQ ID NO: 924714 - DNA, 25 bp, Mus musculus
gaacaagtcaagttactggcagaag

SEQ ID NO: 924715 - DNA, 25 bp, Mus musculus
gaacaagtcagcagtggagatgcgg

SEQ ID NO: 924716 - DNA, 25 bp, Mus musculus
gaacaagtcagctgtggagatgcgg

SEQ ID NO: 924717 - DNA, 25 bp, Mus musculus
gaacaagtgcaacatgatttacctt

SEQ ID NO: 924718 - DNA, 25 bp, Mus musculus
gaacaagtgcaagatgatttacctt

SEQ ID NO: 924719 - DNA, 25 bp, Mus musculus
gaacaatcacaccagcgagcacttt

SEQ ID NO: 924720 - DNA, 25 bp, Mus musculus
gaacaatcacacgagcgagcacttt

SEQ ID NO: 924721 - DNA, 25 bp, Mus musculus
gaacaatcacagacagcttacctct

SEQ ID NO: 924722 - DNA, 25 bp, Mus musculus
gaacaatcacagaggccagaagaga

SEQ ID NO: 924723 - DNA, 25 bp, Mus musculus
gaacaatcacagctgtagatgtcag

SEQ ID NO: 924724 - DNA, 25 bp, Mus musculus
gaacaatcacaggtgtagatgtcag

SEQ ID NO: 924725 - DNA, 25 bp, Mus musculus
gaacaatcacagtcagcttacctct

SEQ ID NO: 924726 - DNA, 25 bp, Mus musculus
gaacaatcacagtggccagaagaga

SEQ ID NO: 924727 - DNA, 25 bp, Mus musculus
gaacaatgagctgatagagtgcatc

SEQ ID NO: 924728 - DNA, 25 bp, Mus musculus
gaacaatgaggagacgtacacaccc

SEQ ID NO: 924729 - DNA, 25 bp, Mus musculus
gaacaatgaggagaggtacacaccc

SEQ ID NO: 924730 - DNA, 25 bp, Mus musculus
gaacaatgaggtgatagagtgcatc

SEQ ID NO: 924731 - DNA, 25 bp, Mus musculus
gaacaatggaaaaatacctgaatca

SEQ ID NO: 924732 - DNA, 25 bp, Mus musculus
gaacaatggaaatatacctgaatca

SEQ ID NO: 924733 - DNA, 25 bp, Mus musculus
gaacaattaaagctttttgatgaca

SEQ ID NO: 924734 - DNA, 25 bp, Mus musculus
gaacaattaaaggtttttgatgaca

SEQ ID NO: 924735 - DNA, 25 bp, Mus musculus
gaacaattgatgcgtgctgttgtga

SEQ ID NO: 924736 - DNA, 25 bp, Mus musculus
gaacaattgatgggtgctgttgtga

SEQ ID NO: 924737 - DNA, 25 bp, Mus musculus
gaacaatttccacgtcatgagcatg

SEQ ID NO: 924738 - DNA, 25 bp, Mus musculus
gaacaatttccaggtcatgagcatg

SEQ ID NO: 924739 - DNA, 25 bp, Mus musculus
gaacacaaaaggcttttgtgcatcc

SEQ ID NO: 924740 - DNA, 25 bp, Mus musculus
gaacacaaaagggttttgtgcatcc

SEQ ID NO: 924741 - DNA, 25 bp, Mus musculus
gaacacaaggccaagatcatcatgc

SEQ ID NO: 924742 - DNA, 25 bp, Mus musculus
gaacacaagggcaagatcatcatgc

SEQ ID NO: 924743 - DNA, 25 bp, Mus musculus
gaacacaatcaaccccccactgtgt

SEQ ID NO: 924744 - DNA, 25 bp, Mus musculus
gaacacaatcaacgcacttcggagg

SEQ ID NO: 924745 - DNA, 25 bp, Mus musculus
gaacacaatcaacgtccacaggatg

SEQ ID NO: 924746 - DNA, 25 bp, Mus musculus
gaacacaatcaagcccccactgtgt

SEQ ID NO: 924747 - DNA, 25 bp, Mus musculus
gaacacaatcaaggcacttcggagg

SEQ ID NO: 924748 - DNA, 25 bp, Mus musculus
gaacacaatcaaggtccacaggatg

SEQ ID NO: 924749 - DNA, 25 bp, Mus musculus
gaacacacagaatggcttagaaagg

SEQ ID NO: 924750 - DNA, 25 bp, Mus musculus
gaacacacagtatggcttagaaagg

SEQ ID NO: 924751 - DNA, 25 bp, Mus musculus
gaacacactcttcactgggcccggg

SEQ ID NO: 924752 - DNA, 25 bp, Mus musculus
gaacacactcttcagtgggcccggg

SEQ ID NO: 924753 - DNA, 25 bp, Mus musculus
gaacacagggcaaacactggtctta

SEQ ID NO: 924754 - DNA, 25 bp, Mus musculus
gaacacagggcaaagactggtctta

SEQ ID NO: 924755 - DNA, 25 bp, Mus musculus
gaacacatacagccgagaaaccttt

SEQ ID NO: 924756 - DNA, 25 bp, Mus musculus
gaacacatacaggcgagaaaccttt

SEQ ID NO: 924757 - DNA, 25 bp, Mus musculus
gaacacatagcacataaacttctgc

SEQ ID NO: 924758 - DNA, 25 bp, Mus musculus
gaacacatagcagataaacttctgc

SEQ ID NO: 924759 - DNA, 25 bp, Mus musculus
gaacacccgcaaagattacagcggc

SEQ ID NO: 924760 - DNA, 25 bp, Mus musculus
gaacacccgcaatgattacagcggc

SEQ ID NO: 924761 - DNA, 25 bp, Mus musculus
gaacacctgcacaacctgggtatca

SEQ ID NO: 924762 - DNA, 25 bp, Mus musculus
gaacacctgcacaagctgggtatca

SEQ ID NO: 924763 - DNA, 25 bp, Mus musculus
gaacacctgcagagagaagggtcgc

SEQ ID NO: 924764 - DNA, 25 bp, Mus musculus
gaacacctgcagtgagaagggtcgc

SEQ ID NO: 924765 - DNA, 25 bp, Mus musculus
gaacacgcgcaacccctgaggtgcg

SEQ ID NO: 924766 - DNA, 25 bp, Mus musculus
gaacacgcgcaagccctgaggtgcg

SEQ ID NO: 924767 - DNA, 25 bp, Mus musculus
gaacactgagcgctgcatggagaag

SEQ ID NO: 924768 - DNA, 25 bp, Mus musculus
gaacactgagggctgcatggagaag

SEQ ID NO: 924769 - DNA, 25 bp, Mus musculus
gaacactgatcacatgctgtttctg

SEQ ID NO: 924770 - DNA, 25 bp, Mus musculus
gaacactgatgacatgctgtttctg

SEQ ID NO: 924771 - DNA, 25 bp, Mus musculus
gaacactgccaacgtggagcctggt

SEQ ID NO: 924772 - DNA, 25 bp, Mus musculus
gaacactgccaaggtggagcctggt

SEQ ID NO: 924773 - DNA, 25 bp, Mus musculus
gaacactggccgcagaagctggagg

SEQ ID NO: 924774 - DNA, 25 bp, Mus musculus
gaacactggccgccacaatatgacg

SEQ ID NO: 924775 - DNA, 25 bp, Mus musculus
gaacactggccggagaagctggagg

SEQ ID NO: 924776 - DNA, 25 bp, Mus musculus
gaacactggccggcacaatatgacg

SEQ ID NO: 924777 - DNA, 25 bp, Mus musculus
gaacactttgtaacagcactgaggg

SEQ ID NO: 924778 - DNA, 25 bp, Mus musculus
gaacactttgtaactgcactgaggg

SEQ ID NO: 924779 - DNA, 25 bp, Mus musculus
gaacagaagatgaacatgtctggtg

SEQ ID NO: 924780 - DNA, 25 bp, Mus musculus
gaacagaagatgaagatgtctggtg

SEQ ID NO: 924781 - DNA, 25 bp, Mus musculus
gaacagaagtcacaaagaaaaatga

SEQ ID NO: 924782 - DNA, 25 bp, Mus musculus
gaacagaagtcacaaagcacaatgt

SEQ ID NO: 924783 - DNA, 25 bp, Mus musculus
gaacagaagtcagaaagaaaaatga

SEQ ID NO: 924784 - DNA, 25 bp, Mus musculus
gaacagaagtcagaaagcacaatgt

SEQ ID NO: 924785 - DNA, 25 bp, Mus musculus
gaacagacaaccagacagatcgtta

SEQ ID NO: 924786 - DNA, 25 bp, Mus musculus
gaacagacaacctgacagatcgtta

SEQ ID NO: 924787 - DNA, 25 bp, Mus musculus
gaacagagaaagaaagttgaaactc

SEQ ID NO: 924788 - DNA, 25 bp, Mus musculus
gaacagagaaagtaagttgaaactc

SEQ ID NO: 924789 - DNA, 25 bp, Mus musculus
gaacagataggaaaagcatatatat

SEQ ID NO: 924790 - DNA, 25 bp, Mus musculus
gaacagataggaaatgcatatatat

SEQ ID NO: 924791 - DNA, 25 bp, Mus musculus
gaacagatgcagcaatgggcttggc

SEQ ID NO: 924792 - DNA, 25 bp, Mus musculus
gaacagatgcaggaatgggcttggc

SEQ ID NO: 924793 - DNA, 25 bp, Mus musculus
gaacagatggcttgcaaacatgtta

SEQ ID NO: 924794 - DNA, 25 bp, Mus musculus
gaacagatgggttgcaaacatgtta

SEQ ID NO: 924795 - DNA, 25 bp, Mus musculus
gaacagattaagcacattttctacg

SEQ ID NO: 924796 - DNA, 25 bp, Mus musculus
gaacagattaaggacattttctacg

SEQ ID NO: 924797 - DNA, 25 bp, Mus musculus
gaacagattcagagcctctctccca

SEQ ID NO: 924798 - DNA, 25 bp, Mus musculus
gaacagattcagcagcagcaacagc

SEQ ID NO: 924799 - DNA, 25 bp, Mus musculus
gaacagattcaggagcagcaacagc

SEQ ID NO: 924800 - DNA, 25 bp, Mus musculus
gaacagattcagtgcctctctccca

SEQ ID NO: 924801 - DNA, 25 bp, Mus musculus
gaacagattgcacagttcaaggaag

SEQ ID NO: 924802 - DNA, 25 bp, Mus musculus
gaacagattgcagagttcaaggaag

SEQ ID NO: 924803 - DNA, 25 bp, Mus musculus
gaacagcaaacacacaagctcatct

SEQ ID NO: 924804 - DNA, 25 bp, Mus musculus
gaacagcaaacagacaagctcatct

SEQ ID NO: 924805 - DNA, 25 bp, Mus musculus
gaacagcagaagactagagagactg

SEQ ID NO: 924806 - DNA, 25 bp, Mus musculus
gaacagcagaagtctagagagactg

SEQ ID NO: 924807 - DNA, 25 bp, Mus musculus
gaacagcatcacacaagtgtctatt

SEQ ID NO: 924808 - DNA, 25 bp, Mus musculus
gaacagcatcactcaagtgtctatt

SEQ ID NO: 924809 - DNA, 25 bp, Mus musculus
gaacagcctcaacatctggttcaac

SEQ ID NO: 924810 - DNA, 25 bp, Mus musculus
gaacagcctcaagatctggttcaac

SEQ ID NO: 924811 - DNA, 25 bp, Mus musculus
gaacagctccagcgtagccccagtg

SEQ ID NO: 924812 - DNA, 25 bp, Mus musculus
gaacagctccagggtagccccagtg

SEQ ID NO: 924813 - DNA, 25 bp, Mus musculus
gaacagctcgacatgcgtcgggatg

SEQ ID NO: 924814 - DNA, 25 bp, Mus musculus
gaacagctcgcggactttctctagt

SEQ ID NO: 924815 - DNA, 25 bp, Mus musculus
gaacagctcgcgtttgagttttttg

SEQ ID NO: 924816 - DNA, 25 bp, Mus musculus
gaacagctcggggactttctctagt

SEQ ID NO: 924817 - DNA, 25 bp, Mus musculus
gaacagctcgggtttgagttttttg

SEQ ID NO: 924818 - DNA, 25 bp, Mus musculus
gaacagctcgtcatgcgtcgggatg

SEQ ID NO: 924819 - DNA, 25 bp, Mus musculus
gaacagctggacaccacctgaggaa

SEQ ID NO: 924820 - DNA, 25 bp, Mus musculus
gaacagctggtcaccacctgaggaa

SEQ ID NO: 924821 - DNA, 25 bp, Mus musculus
gaacaggaggcaaacagaactctgg

SEQ ID NO: 924822 - DNA, 25 bp, Mus musculus
gaacaggaggcaaagagaactctgg

SEQ ID NO: 924823 - DNA, 25 bp, Mus musculus
gaacaggcgtcacaaagaaaaatga

SEQ ID NO: 924824 - DNA, 25 bp, Mus musculus
gaacaggcgtcagaaagaaaaatga

SEQ ID NO: 924825 - DNA, 25 bp, Mus musculus
gaacagggtcagcgaagtcctcttt

SEQ ID NO: 924826 - DNA, 25 bp, Mus musculus
gaacagggtcagggaagtcctcttt

SEQ ID NO: 924827 - DNA, 25 bp, Mus musculus
gaacagggtccacaacatggctctt

SEQ ID NO: 924828 - DNA, 25 bp, Mus musculus
gaacagggtccagaacatggctctt

SEQ ID NO: 924829 - DNA, 25 bp, Mus musculus
gaacagtaccttagaaagctttgga

SEQ ID NO: 924830 - DNA, 25 bp, Mus musculus
gaacagtacctttgaaagctttgga

SEQ ID NO: 924831 - DNA, 25 bp, Mus musculus
gaacagtgagctacagtgtgaactg

SEQ ID NO: 924832 - DNA, 25 bp, Mus musculus
gaacagtgaggtacagtgtgaactg

SEQ ID NO: 924833 - DNA, 25 bp, Mus musculus
gaacagtgccatatgagaacatgcc

SEQ ID NO: 924834 - DNA, 25 bp, Mus musculus
gaacagtgccccaacataacatgta

SEQ ID NO: 924835 - DNA, 25 bp, Mus musculus
gaacagtgccgcaacataacatgta

SEQ ID NO: 924836 - DNA, 25 bp, Mus musculus
gaacagtgccttatgagaacatgcc

SEQ ID NO: 924837 - DNA, 25 bp, Mus musculus
gaacagtgtcagccaaatctcggtg

SEQ ID NO: 924838 - DNA, 25 bp, Mus musculus
gaacagtgtcaggcaaatctcggtg

SEQ ID NO: 924839 - DNA, 25 bp, Mus musculus
gaacagttcatgaaatcttttgagc

SEQ ID NO: 924840 - DNA, 25 bp, Mus musculus
gaacagttcatgaggttacgtcccc

SEQ ID NO: 924841 - DNA, 25 bp, Mus musculus
gaacagttcatgtaatcttttgagc

SEQ ID NO: 924842 - DNA, 25 bp, Mus musculus
gaacagttcatgtggttacgtcccc

SEQ ID NO: 924843 - DNA, 25 bp, Mus musculus
gaacagttggtacacgatcagtatg

SEQ ID NO: 924844 - DNA, 25 bp, Mus musculus
gaacagttggtacaggatcagtatg

SEQ ID NO: 924845 - DNA, 25 bp, Mus musculus
gaacagtttctcaacggttgagctc

SEQ ID NO: 924846 - DNA, 25 bp, Mus musculus
gaacagtttctcaagggttgagctc

SEQ ID NO: 924847 - DNA, 25 bp, Mus musculus
gaacagtttggacgacgtaccatgc

SEQ ID NO: 924848 - DNA, 25 bp, Mus musculus
gaacagtttggacgctcacccgggt

SEQ ID NO: 924849 - DNA, 25 bp, Mus musculus
gaacagtttggaggacgtaccatgc

SEQ ID NO: 924850 - DNA, 25 bp, Mus musculus
gaacagtttggaggctcacccgggt

SEQ ID NO: 924851 - DNA, 25 bp, Mus musculus
gaacatcaagctgggaagacccagc

SEQ ID NO: 924852 - DNA, 25 bp, Mus musculus
gaacatcaaggtgggaagacccagc

SEQ ID NO: 924853 - DNA, 25 bp, Mus musculus
gaacatcacggaaaatctcattgca

SEQ ID NO: 924854 - DNA, 25 bp, Mus musculus
gaacatcacggaaattctcattgca

SEQ ID NO: 924855 - DNA, 25 bp, Mus musculus
gaacatcatgcacgccaagtggaag

SEQ ID NO: 924856 - DNA, 25 bp, Mus musculus
gaacatcatgcaggccaagtggaag

SEQ ID NO: 924857 - DNA, 25 bp, Mus musculus
gaacatccactgcattcgaatgaga

SEQ ID NO: 924858 - DNA, 25 bp, Mus musculus
gaacatccactggattcgaatgaga

SEQ ID NO: 924859 - DNA, 25 bp, Mus musculus
gaacatccagaacaactggcggggc

SEQ ID NO: 924860 - DNA, 25 bp, Mus musculus
gaacatccagcacaaggacagcatc

SEQ ID NO: 924861 - DNA, 25 bp, Mus musculus
gaacatccagctcctgcctggcagc

SEQ ID NO: 924862 - DNA, 25 bp, Mus musculus
gaacatccaggacaaggacagcatc

SEQ ID NO: 924863 - DNA, 25 bp, Mus musculus
gaacatccaggtcctgcctggcagc

SEQ ID NO: 924864 - DNA, 25 bp, Mus musculus
gaacatccagtacaactggcggggc

SEQ ID NO: 924865 - DNA, 25 bp, Mus musculus
gaacatctagacagttcgaacctca

SEQ ID NO: 924866 - DNA, 25 bp, Mus musculus
gaacatctagactgttcgaacctca

SEQ ID NO: 924867 - DNA, 25 bp, Mus musculus
gaacatctctagccctgaggctgtc

SEQ ID NO: 924868 - DNA, 25 bp, Mus musculus
gaacatctctaggcctgaggctgtc

SEQ ID NO: 924869 - DNA, 25 bp, Mus musculus
gaacatgaagcccgtgtgcccaaga

SEQ ID NO: 924870 - DNA, 25 bp, Mus musculus
gaacatgaaggccgtgtgcccaaga

SEQ ID NO: 924871 - DNA, 25 bp, Mus musculus
gaacatgaagttcgtgagcccgagt

SEQ ID NO: 924872 - DNA, 25 bp, Mus musculus
gaacatgaagttggtgagcccgagt

SEQ ID NO: 924873 - DNA, 25 bp, Mus musculus
gaacatgatgatcaacttgttccta

SEQ ID NO: 924874 - DNA, 25 bp, Mus musculus
gaacatgatgatgaacttgttccta

SEQ ID NO: 924875 - DNA, 25 bp, Mus musculus
gaacatgatggacgatgtggagaac

SEQ ID NO: 924876 - DNA, 25 bp, Mus musculus
gaacatgatggaggatgtggagaac

SEQ ID NO: 924877 - DNA, 25 bp, Mus musculus
gaacatgatgtcagcgtcaatacta

SEQ ID NO: 924878 - DNA, 25 bp, Mus musculus
gaacatgatgtcagggtcaatacta

SEQ ID NO: 924879 - DNA, 25 bp, Mus musculus
gaacatgcagaaagaaatcctgagc

SEQ ID NO: 924880 - DNA, 25 bp, Mus musculus
gaacatgcagcagcaactggacaag

SEQ ID NO: 924881 - DNA, 25 bp, Mus musculus
gaacatgcaggagcaactggacaag

SEQ ID NO: 924882 - DNA, 25 bp, Mus musculus
gaacatgcagtaagaaatcctgagc

SEQ ID NO: 924883 - DNA, 25 bp, Mus musculus
gaacatgggccgaatgaagctgttg

SEQ ID NO: 924884 - DNA, 25 bp, Mus musculus
gaacatgggccgtatgaagctgttg

SEQ ID NO: 924885 - DNA, 25 bp, Mus musculus
gaacatgggcgcagacctgtgccgt

SEQ ID NO: 924886 - DNA, 25 bp, Mus musculus
gaacatgggcgctgacctgtgccgt

SEQ ID NO: 924887 - DNA, 25 bp, Mus musculus
gaacatggtggacgcctgtctgctg

SEQ ID NO: 924888 - DNA, 25 bp, Mus musculus
gaacatggtggaggcctgtctgctg

SEQ ID NO: 924889 - DNA, 25 bp, Mus musculus
gaacatgtacagagcttggaaaccc

SEQ ID NO: 924890 - DNA, 25 bp, Mus musculus
gaacatgtacagtgcttggaaaccc

SEQ ID NO: 924891 - DNA, 25 bp, Mus musculus
gaacatgtagaacgtccactgccat

SEQ ID NO: 924892 - DNA, 25 bp, Mus musculus
gaacatgtagaaggtccactgccat

SEQ ID NO: 924893 - DNA, 25 bp, Mus musculus
gaacattaaatgctcttgcttctcc

SEQ ID NO: 924894 - DNA, 25 bp, Mus musculus
gaacattaaatggtcttgcttctcc

SEQ ID NO: 924895 - DNA, 25 bp, Mus musculus
gaacattagttgataatgcttacag

SEQ ID NO: 924896 - DNA, 25 bp, Mus musculus
gaacattagttgttaatgcttacag

SEQ ID NO: 924897 - DNA, 25 bp, Mus musculus
gaacattcagctatttgatttcacc

SEQ ID NO: 924898 - DNA, 25 bp, Mus musculus
gaacattcaggtatttgatttcacc

SEQ ID NO: 924899 - DNA, 25 bp, Mus musculus
gaacattcggctccgggagtgtgaa

SEQ ID NO: 924900 - DNA, 25 bp, Mus musculus
gaacattcgggtccgggagtgtgaa

SEQ ID NO: 924901 - DNA, 25 bp, Mus musculus
gaacattgacccactgcagtgtgac

SEQ ID NO: 924902 - DNA, 25 bp, Mus musculus
gaacattgacgcactgcagtgtgac

SEQ ID NO: 924903 - DNA, 25 bp, Mus musculus
gaacattgcaagaaatttgaaaaag

SEQ ID NO: 924904 - DNA, 25 bp, Mus musculus
gaacattgcaagaattttgaaaaag

SEQ ID NO: 924905 - DNA, 25 bp, Mus musculus
gaacattttgacttacccagcgcag

SEQ ID NO: 924906 - DNA, 25 bp, Mus musculus
gaacattttgactttcccagcgcag

SEQ ID NO: 924907 - DNA, 25 bp, Mus musculus
gaaccaaatctaaacctacatcggc

SEQ ID NO: 924908 - DNA, 25 bp, Mus musculus
gaaccaaatctatacctacatcggc

SEQ ID NO: 924909 - DNA, 25 bp, Mus musculus
gaaccaaattagagatgctcgtaaa

SEQ ID NO: 924910 - DNA, 25 bp, Mus musculus
gaaccaaattagtgatgctcgtaaa

SEQ ID NO: 924911 - DNA, 25 bp, Mus musculus
gaaccacactctaccagcaaggtga

SEQ ID NO: 924912 - DNA, 25 bp, Mus musculus
gaaccacactgtaccagcaaggtga

SEQ ID NO: 924913 - DNA, 25 bp, Mus musculus
gaaccaccactgctacagcagcaag

SEQ ID NO: 924914 - DNA, 25 bp, Mus musculus
gaaccaccactggtacagcagcaag

SEQ ID NO: 924915 - DNA, 25 bp, Mus musculus
gaaccacgatcactgctacatcctg

SEQ ID NO: 924916 - DNA, 25 bp, Mus musculus
gaaccacgatgactgctacatcctg

SEQ ID NO: 924917 - DNA, 25 bp, Mus musculus
gaaccacgtgcaaacctttctgcaa

SEQ ID NO: 924918 - DNA, 25 bp, Mus musculus
gaaccacgtgcaaagctttctgcaa

SEQ ID NO: 924919 - DNA, 25 bp, Mus musculus
gaaccactgcagcatttctggcacc

SEQ ID NO: 924920 - DNA, 25 bp, Mus musculus
gaaccactgcaggatttctggcacc

SEQ ID NO: 924921 - DNA, 25 bp, Mus musculus
gaaccagaagagccaccaaccaaat

SEQ ID NO: 924922 - DNA, 25 bp, Mus musculus
gaaccagaagatgccatctcatctg

SEQ ID NO: 924923 - DNA, 25 bp, Mus musculus
gaaccagaagcagcaccgtactgga

SEQ ID NO: 924924 - DNA, 25 bp, Mus musculus
gaaccagaaggagcaccgtactgga

SEQ ID NO: 924925 - DNA, 25 bp, Mus musculus
gaaccagaagtgccaccaaccaaat

SEQ ID NO: 924926 - DNA, 25 bp, Mus musculus
gaaccagaagttgccatctcatctg

SEQ ID NO: 924927 - DNA, 25 bp, Mus musculus
gaaccagacattgacgcaccaccta

SEQ ID NO: 924928 - DNA, 25 bp, Mus musculus
gaaccagacattgaggcaccaccta

SEQ ID NO: 924929 - DNA, 25 bp, Mus musculus
gaaccataaaaacattattagctta

SEQ ID NO: 924930 - DNA, 25 bp, Mus musculus
gaaccataaaaagattattagctta

SEQ ID NO: 924931 - DNA, 25 bp, Mus musculus
gaaccatactatatgcttttgccaa

SEQ ID NO: 924932 - DNA, 25 bp, Mus musculus
gaaccatactatccattatccaatt

SEQ ID NO: 924933 - DNA, 25 bp, Mus musculus
gaaccatactatgcattatccaatt

SEQ ID NO: 924934 - DNA, 25 bp, Mus musculus
gaaccatactatttgcttttgccaa

SEQ ID NO: 924935 - DNA, 25 bp, Mus musculus
gaaccatcatggcgcgtttgagcag

SEQ ID NO: 924936 - DNA, 25 bp, Mus musculus
gaaccatcatggcgggtttgagcag

SEQ ID NO: 924937 - DNA, 25 bp, Mus musculus
gaaccatcccatccactacaagggc

SEQ ID NO: 924938 - DNA, 25 bp, Mus musculus
gaaccatcccatgcactacaagggc

SEQ ID NO: 924939 - DNA, 25 bp, Mus musculus
gaaccatcctgacgcctgactacca

SEQ ID NO: 924940 - DNA, 25 bp, Mus musculus
gaaccatcctgaggcctgactacca

SEQ ID NO: 924941 - DNA, 25 bp, Mus musculus
gaaccatgaaaacaagagatgagac

SEQ ID NO: 924942 - DNA, 25 bp, Mus musculus
gaaccatgaaaagaagagatgagac

SEQ ID NO: 924943 - DNA, 25 bp, Mus musculus
gaaccatgaagacgaagtcaacacc

SEQ ID NO: 924944 - DNA, 25 bp, Mus musculus
gaaccatgaagaggaagtcaacacc

SEQ ID NO: 924945 - DNA, 25 bp, Mus musculus
gaaccatgaggacgagatgaaggaa

SEQ ID NO: 924946 - DNA, 25 bp, Mus musculus
gaaccatgaggaggagatgaaggaa

SEQ ID NO: 924947 - DNA, 25 bp, Mus musculus
gaaccatgctgtcgtgtgtcaagga

SEQ ID NO: 924948 - DNA, 25 bp, Mus musculus
gaaccatgctgtggtgtgtcaagga

SEQ ID NO: 924949 - DNA, 25 bp, Mus musculus
gaaccatggaatccacacaacggtt

SEQ ID NO: 924950 - DNA, 25 bp, Mus musculus
gaaccatggaatgcacacaacggtt

SEQ ID NO: 924951 - DNA, 25 bp, Mus musculus
gaaccattcaagccaacatcgagta

SEQ ID NO: 924952 - DNA, 25 bp, Mus musculus
gaaccattcaaggcaacatcgagta

SEQ ID NO: 924953 - DNA, 25 bp, Mus musculus
gaacccaagaggctggggtctcaga

SEQ ID NO: 924954 - DNA, 25 bp, Mus musculus
gaacccaagagggtggggtctcaga

SEQ ID NO: 924955 - DNA, 25 bp, Mus musculus
gaacccaagccgacgttgaagtatg

SEQ ID NO: 924956 - DNA, 25 bp, Mus musculus
gaacccaagccgtcgttgaagtatg

SEQ ID NO: 924957 - DNA, 25 bp, Mus musculus
gaacccaatgcttatgatgatggtt

SEQ ID NO: 924958 - DNA, 25 bp, Mus musculus
gaacccaatggttatgatgatggtt

SEQ ID NO: 924959 - DNA, 25 bp, Mus musculus
gaacccacagacaacgtggagcgaa

SEQ ID NO: 924960 - DNA, 25 bp, Mus musculus
gaacccacagacaaggtggagcgaa

SEQ ID NO: 924961 - DNA, 25 bp, Mus musculus
gaacccacagagatataaactacac

SEQ ID NO: 924962 - DNA, 25 bp, Mus musculus
gaacccacagagttataaactacac

SEQ ID NO: 924963 - DNA, 25 bp, Mus musculus
gaacccaccgcgcacgcagctgaaa

SEQ ID NO: 924964 - DNA, 25 bp, Mus musculus
gaacccaccgcgcaggcagctgaaa

SEQ ID NO: 924965 - DNA, 25 bp, Mus musculus
gaacccaggcaccacaaacctcatc

SEQ ID NO: 924966 - DNA, 25 bp, Mus musculus
gaacccaggcaccacccagtaagtg

SEQ ID NO: 924967 - DNA, 25 bp, Mus musculus
gaacccaggcaccacgttgctccag

SEQ ID NO: 924968 - DNA, 25 bp, Mus musculus
gaacccaggcaccactgtgtccatt

SEQ ID NO: 924969 - DNA, 25 bp, Mus musculus
gaacccaggcaccagaaacctcatc

SEQ ID NO: 924970 - DNA, 25 bp, Mus musculus
gaacccaggcaccagccagtaagtg

SEQ ID NO: 924971 - DNA, 25 bp, Mus musculus
gaacccaggcaccaggttgctccag

SEQ ID NO: 924972 - DNA, 25 bp, Mus musculus
gaacccaggcaccagtgtgtccatt

SEQ ID NO: 924973 - DNA, 25 bp, Mus musculus
gaacccatgagactgcttttttagg

SEQ ID NO: 924974 - DNA, 25 bp, Mus musculus
gaacccatgagagtgcttttttagg

SEQ ID NO: 924975 - DNA, 25 bp, Mus musculus
gaaccccaagaggttcaatgttgct

SEQ ID NO: 924976 - DNA, 25 bp, Mus musculus
gaaccccaagtggttcaatgttgct

SEQ ID NO: 924977 - DNA, 25 bp, Mus musculus
gaaccccagactgcctactccagcc

SEQ ID NO: 924978 - DNA, 25 bp, Mus musculus
gaaccccagagtgcctactccagcc

SEQ ID NO: 924979 - DNA, 25 bp, Mus musculus
gaaccccagctcaccaaatgaccct

SEQ ID NO: 924980 - DNA, 25 bp, Mus musculus
gaaccccagctctccaaatgaccct

SEQ ID NO: 924981 - DNA, 25 bp, Mus musculus
gaaccccaggctccattcacacagc

SEQ ID NO: 924982 - DNA, 25 bp, Mus musculus
gaaccccagggtccattcacacagc

SEQ ID NO: 924983 - DNA, 25 bp, Mus musculus
gaaccctcaaccctgttaggagtgg

SEQ ID NO: 924984 - DNA, 25 bp, Mus musculus
gaaccctcaaccgtgttaggagtgg

SEQ ID NO: 924985 - DNA, 25 bp, Mus musculus
gaaccctgtgtcctccatcaacctt

SEQ ID NO: 924986 - DNA, 25 bp, Mus musculus
gaaccctgtgtcctgcatcaacctt

SEQ ID NO: 924987 - DNA, 25 bp, Mus musculus
gaacccttctacagaatttatcagt

SEQ ID NO: 924988 - DNA, 25 bp, Mus musculus
gaacccttctactgaatttatcagt

SEQ ID NO: 924989 - DNA, 25 bp, Mus musculus
gaaccgaaagactaagcatcccaat

SEQ ID NO: 924990 - DNA, 25 bp, Mus musculus
gaaccgaaagtctaagcatcccaat

SEQ ID NO: 924991 - DNA, 25 bp, Mus musculus
gaaccgatcagtatatacacttctg

SEQ ID NO: 924992 - DNA, 25 bp, Mus musculus
gaaccgatcagtttatacacttctg

SEQ ID NO: 924993 - DNA, 25 bp, Mus musculus
gaaccgcaagatatttcttctagcc

SEQ ID NO: 924994 - DNA, 25 bp, Mus musculus
gaaccgcaagttatttcttctagcc

SEQ ID NO: 924995 - DNA, 25 bp, Mus musculus
gaaccggcattgatgtccagctcgc

SEQ ID NO: 924996 - DNA, 25 bp, Mus musculus
gaaccggcattgttgtccagctcgc

SEQ ID NO: 924997 - DNA, 25 bp, Mus musculus
gaaccggcctgcagatgtgtattcc

SEQ ID NO: 924998 - DNA, 25 bp, Mus musculus
gaaccggcctgctgatgtgtattcc

SEQ ID NO: 924999 - DNA, 25 bp, Mus musculus
gaaccggcggcacgatgtgtgaccg

SEQ ID NO: 925000 - DNA, 25 bp, Mus musculus
gaaccggcggcaggatgtgtgaccg

SEQ ID NO: 925001 - DNA, 25 bp, Mus musculus
gaaccgggaccagacaattggagtt

SEQ ID NO: 925002 - DNA, 25 bp, Mus musculus
gaaccgggaccagagaattggagtt

SEQ ID NO: 925003 - DNA, 25 bp, Mus musculus
gaaccgtcagctgcgtgtggaaggc

SEQ ID NO: 925004 - DNA, 25 bp, Mus musculus
gaaccgtcaggtgcgtgtggaaggc

SEQ ID NO: 925005 - DNA, 25 bp, Mus musculus
gaacctcaagcagctgcgggaacgg

SEQ ID NO: 925006 - DNA, 25 bp, Mus musculus
gaacctcaagctagaccagctcttc

SEQ ID NO: 925007 - DNA, 25 bp, Mus musculus
gaacctcaaggagctgcgggaacgg

SEQ ID NO: 925008 - DNA, 25 bp, Mus musculus
gaacctcaaggtagaccagctcttc

SEQ ID NO: 925009 - DNA, 25 bp, Mus musculus
gaacctcaccagcatgtccaaaatt

SEQ ID NO: 925010 - DNA, 25 bp, Mus musculus
gaacctcaccaggatgtccaaaatt

SEQ ID NO: 925011 - DNA, 25 bp, Mus musculus
gaacctcatccactcctgggctgac

SEQ ID NO: 925012 - DNA, 25 bp, Mus musculus
gaacctcatccagtcctgggctgac

SEQ ID NO: 925013 - DNA, 25 bp, Mus musculus
gaacctccacttcacgctgtttgac

SEQ ID NO: 925014 - DNA, 25 bp, Mus musculus
gaacctccacttcaggctgtttgac

SEQ ID NO: 925015 - DNA, 25 bp, Mus musculus
gaacctcctcagaatccgtatattc

SEQ ID NO: 925016 - DNA, 25 bp, Mus musculus
gaacctcctcagtatccgtatattc

SEQ ID NO: 925017 - DNA, 25 bp, Mus musculus
gaacctgaagagcttgccaggctct

SEQ ID NO: 925018 - DNA, 25 bp, Mus musculus
gaacctgaagaggttgccaggctct

SEQ ID NO: 925019 - DNA, 25 bp, Mus musculus
gaacctgacgagaccgtaaaggtgc

SEQ ID NO: 925020 - DNA, 25 bp, Mus musculus
gaacctgacgagacggtaaaggtgc

SEQ ID NO: 925021 - DNA, 25 bp, Mus musculus
gaacctgagaagcacgctgtgcagc

SEQ ID NO: 925022 - DNA, 25 bp, Mus musculus
gaacctgagaagcacgtctgttctc

SEQ ID NO: 925023 - DNA, 25 bp, Mus musculus
gaacctgagaagcaggctgtgcagc

SEQ ID NO: 925024 - DNA, 25 bp, Mus musculus
gaacctgagaagcaggtctgttctc

SEQ ID NO: 925025 - DNA, 25 bp, Mus musculus
gaacctgagacagttctggaaacag

SEQ ID NO: 925026 - DNA, 25 bp, Mus musculus
gaacctgagagagttctggaaacag

SEQ ID NO: 925027 - DNA, 25 bp, Mus musculus
gaacctgcaacttgcttgtatgcag

SEQ ID NO: 925028 - DNA, 25 bp, Mus musculus
gaacctgcaagttgcttgtatgcag

SEQ ID NO: 925029 - DNA, 25 bp, Mus musculus
gaacctgcagcaggttctaggggaa

SEQ ID NO: 925030 - DNA, 25 bp, Mus musculus
gaacctgcaggaggttctaggggaa

SEQ ID NO: 925031 - DNA, 25 bp, Mus musculus
gaacctgctgtccacaatgtgctgg

SEQ ID NO: 925032 - DNA, 25 bp, Mus musculus
gaacctgctgtccagaatgtgctgg

SEQ ID NO: 925033 - DNA, 25 bp, Mus musculus
gaacctggacaactctgtgcacctg

SEQ ID NO: 925034 - DNA, 25 bp, Mus musculus
gaacctggacaagtctgtgcacctg

SEQ ID NO: 925035 - DNA, 25 bp, Mus musculus
gaacctggatcataaaatagagaag

SEQ ID NO: 925036 - DNA, 25 bp, Mus musculus
gaacctggatcatataatagagaag

SEQ ID NO: 925037 - DNA, 25 bp, Mus musculus
gaacctgtgggaagtatctcatggt

SEQ ID NO: 925038 - DNA, 25 bp, Mus musculus
gaacctgtgggatgtatctcatggt

SEQ ID NO: 925039 - DNA, 25 bp, Mus musculus
gaaccttaaagacaaactagagcag

SEQ ID NO: 925040 - DNA, 25 bp, Mus musculus
gaaccttaaagagaaactagagcag

SEQ ID NO: 925041 - DNA, 25 bp, Mus musculus
gaacctttgccgctcattttccaga

SEQ ID NO: 925042 - DNA, 25 bp, Mus musculus
gaacctttgccggtcattttccaga

SEQ ID NO: 925043 - DNA, 25 bp, Mus musculus
gaacctttgtggcactcttcccagg

SEQ ID NO: 925044 - DNA, 25 bp, Mus musculus
gaacctttgtggcactctttcagcc

SEQ ID NO: 925045 - DNA, 25 bp, Mus musculus
gaacctttgtggcagtcttcccagg

SEQ ID NO: 925046 - DNA, 25 bp, Mus musculus
gaacctttgtggcagtctttcagcc

SEQ ID NO: 925047 - DNA, 25 bp, Mus musculus
gaacgaatcacacgattagtcgtat

SEQ ID NO: 925048 - DNA, 25 bp, Mus musculus
gaacgaatcacaggattagtcgtat

SEQ ID NO: 925049 - DNA, 25 bp, Mus musculus
gaacgagactgaggaccagtattca

SEQ ID NO: 925050 - DNA, 25 bp, Mus musculus
gaacgagactgaggtccagtattca

SEQ ID NO: 925051 - DNA, 25 bp, Mus musculus
gaacgagcaggacgtactaaatgca

SEQ ID NO: 925052 - DNA, 25 bp, Mus musculus
gaacgagcaggaggtactaaatgca

SEQ ID NO: 925053 - DNA, 25 bp, Mus musculus
gaacgagcctctgacatttgtctag

SEQ ID NO: 925054 - DNA, 25 bp, Mus musculus
gaacgagcctctgagatttgtctag

SEQ ID NO: 925055 - DNA, 25 bp, Mus musculus
gaacgcaatgacaacgtgttctttg

SEQ ID NO: 925056 - DNA, 25 bp, Mus musculus
gaacgcaatgacaaggtgttctttg

SEQ ID NO: 925057 - DNA, 25 bp, Mus musculus
gaacgccgagatggcccgaatgctg

SEQ ID NO: 925058 - DNA, 25 bp, Mus musculus
gaacgccgagttggcccgaatgctg

SEQ ID NO: 925059 - DNA, 25 bp, Mus musculus
gaacgcggagggccccaacaccaag

SEQ ID NO: 925060 - DNA, 25 bp, Mus musculus
gaacgcggagggccgcaacaccaag

SEQ ID NO: 925061 - DNA, 25 bp, Mus musculus
gaacgcggggatcacggcagagatg

SEQ ID NO: 925062 - DNA, 25 bp, Mus musculus
gaacgcggggatcagggcagagatg

SEQ ID NO: 925063 - DNA, 25 bp, Mus musculus
gaacgctcagcacactccgttgggt

SEQ ID NO: 925064 - DNA, 25 bp, Mus musculus
gaacgctcagcagactccgttgggt

SEQ ID NO: 925065 - DNA, 25 bp, Mus musculus
gaacgctcagccactgccctctgcc

SEQ ID NO: 925066 - DNA, 25 bp, Mus musculus
gaacgctcaggcactgccctctgcc

SEQ ID NO: 925067 - DNA, 25 bp, Mus musculus
gaacgctgctagtgaatggctgctg

SEQ ID NO: 925068 - DNA, 25 bp, Mus musculus
gaacgctgctcatttgaagacatgc

SEQ ID NO: 925069 - DNA, 25 bp, Mus musculus
gaacgctgctgatttgaagacatgc

SEQ ID NO: 925070 - DNA, 25 bp, Mus musculus
gaacgctgcttgtgaatggctgctg

SEQ ID NO: 925071 - DNA, 25 bp, Mus musculus
gaacggaaatagccaaatactgtgg

SEQ ID NO: 925072 - DNA, 25 bp, Mus musculus
gaacggaaataggcaaatactgtgg

SEQ ID NO: 925073 - DNA, 25 bp, Mus musculus
gaacggagacatcggcggtatggcc

SEQ ID NO: 925074 - DNA, 25 bp, Mus musculus
gaacggagacatgggcggtatggcc

SEQ ID NO: 925075 - DNA, 25 bp, Mus musculus
gaacggaggcagaacacagttcgat

SEQ ID NO: 925076 - DNA, 25 bp, Mus musculus
gaacggaggcagtacacagttcgat

SEQ ID NO: 925077 - DNA, 25 bp, Mus musculus
gaacggatatttctcgttcttggaa

SEQ ID NO: 925078 - DNA, 25 bp, Mus musculus
gaacggatatttctggttcttggaa

SEQ ID NO: 925079 - DNA, 25 bp, Mus musculus
gaacggcacgagcttgggaaagtcg

SEQ ID NO: 925080 - DNA, 25 bp, Mus musculus
gaacggcacgtgcttgggaaagtcg

SEQ ID NO: 925081 - DNA, 25 bp, Mus musculus
gaacggcagatgaggtacacggatg

SEQ ID NO: 925082 - DNA, 25 bp, Mus musculus
gaacggcagatgataatgttcactt

SEQ ID NO: 925083 - DNA, 25 bp, Mus musculus
gaacggcagatgtggtacacggatg

SEQ ID NO: 925084 - DNA, 25 bp, Mus musculus
gaacggcagatgttaatgttcactt

SEQ ID NO: 925085 - DNA, 25 bp, Mus musculus
gaacggcatcagccgcagatagatc

SEQ ID NO: 925086 - DNA, 25 bp, Mus musculus
gaacggcatcaggcgcagatagatc

SEQ ID NO: 925087 - DNA, 25 bp, Mus musculus
gaacggccagctgtcgtgattaaat

SEQ ID NO: 925088 - DNA, 25 bp, Mus musculus
gaacggccaggtgtcgtgattaaat

SEQ ID NO: 925089 - DNA, 25 bp, Mus musculus
gaacggggctgtctatggagtcaaa

SEQ ID NO: 925090 - DNA, 25 bp, Mus musculus
gaacggggctgtgtatggagtcaaa

SEQ ID NO: 925091 - DNA, 25 bp, Mus musculus
gaacgggtatgagtcgcccaggatg

SEQ ID NO: 925092 - DNA, 25 bp, Mus musculus
gaacgggtatgagtggcccaggatg

SEQ ID NO: 925093 - DNA, 25 bp, Mus musculus
gaacggtttgaacgtccctgcatag

SEQ ID NO: 925094 - DNA, 25 bp, Mus musculus
gaacggtttgaaggtccctgcatag

SEQ ID NO: 925095 - DNA, 25 bp, Mus musculus
gaacgtactaaaactgtgcagggct

SEQ ID NO: 925096 - DNA, 25 bp, Mus musculus
gaacgtactaaatctgtgcagggct

SEQ ID NO: 925097 - DNA, 25 bp, Mus musculus
gaacgtatgatgcaaatttctatgg

SEQ ID NO: 925098 - DNA, 25 bp, Mus musculus
gaacgtatgatggaaatttctatgg

SEQ ID NO: 925099 - DNA, 25 bp, Mus musculus
gaacgtccaggataaactcttcgta

SEQ ID NO: 925100 - DNA, 25 bp, Mus musculus
gaacgtccaggatatactcttcgta

SEQ ID NO: 925101 - DNA, 25 bp, Mus musculus
gaacgtcgtgctggacggactgttc

SEQ ID NO: 925102 - DNA, 25 bp, Mus musculus
gaacgtcgtggtggacggactgttc

SEQ ID NO: 925103 - DNA, 25 bp, Mus musculus
gaacgtctcaagcctatgcttctgg

SEQ ID NO: 925104 - DNA, 25 bp, Mus musculus
gaacgtctcaaggctatgcttctgg

SEQ ID NO: 925105 - DNA, 25 bp, Mus musculus
gaacgtcttccagccggttgataaa

SEQ ID NO: 925106 - DNA, 25 bp, Mus musculus
gaacgtcttccagcgggttgataaa

SEQ ID NO: 925107 - DNA, 25 bp, Mus musculus
gaacgtgaacagctggttggactgg

SEQ ID NO: 925108 - DNA, 25 bp, Mus musculus
gaacgtgaacaggtggttggactgg

SEQ ID NO: 925109 - DNA, 25 bp, Mus musculus
gaacgtgccacggtcagggaaactg

SEQ ID NO: 925110 - DNA, 25 bp, Mus musculus
gaacgtgccagggtcagggaaactg

SEQ ID NO: 925111 - DNA, 25 bp, Mus musculus
gaacgtgctcgccaccaagtagcat

SEQ ID NO: 925112 - DNA, 25 bp, Mus musculus
gaacgtgctcgccagcaagtagcat

SEQ ID NO: 925113 - DNA, 25 bp, Mus musculus
gaacgtggcccaagttttcttggaa

SEQ ID NO: 925114 - DNA, 25 bp, Mus musculus
gaacgtggcccatgttttcttggaa

SEQ ID NO: 925115 - DNA, 25 bp, Mus musculus
gaacgttacaaacacattgttctaa

SEQ ID NO: 925116 - DNA, 25 bp, Mus musculus
gaacgttacaaacagattgttctaa

SEQ ID NO: 925117 - DNA, 25 bp, Mus musculus
gaactaaatattaactcatgttcgt

SEQ ID NO: 925118 - DNA, 25 bp, Mus musculus
gaactaaatattaagtcatgttcgt

SEQ ID NO: 925119 - DNA, 25 bp, Mus musculus
gaactacaataactgtttcctcaat

SEQ ID NO: 925120 - DNA, 25 bp, Mus musculus
gaactacaataagtgtttcctcaat

SEQ ID NO: 925121 - DNA, 25 bp, Mus musculus
gaactacagcagcccagaagcaccc

SEQ ID NO: 925122 - DNA, 25 bp, Mus musculus
gaactacagcaggccagaagcaccc

SEQ ID NO: 925123 - DNA, 25 bp, Mus musculus
gaactacatcagctgcatcaagcca

SEQ ID NO: 925124 - DNA, 25 bp, Mus musculus
gaactacatcaggtgcatcaagcca

SEQ ID NO: 925125 - DNA, 25 bp, Mus musculus
gaactacatgaagacgctgtgagga

SEQ ID NO: 925126 - DNA, 25 bp, Mus musculus
gaactacatgaagaggctgtgagga

SEQ ID NO: 925127 - DNA, 25 bp, Mus musculus
gaactaccagacggttctatgactc

SEQ ID NO: 925128 - DNA, 25 bp, Mus musculus
gaactaccagtcggttctatgactc

SEQ ID NO: 925129 - DNA, 25 bp, Mus musculus
gaactactggccctcctctctgctc

SEQ ID NO: 925130 - DNA, 25 bp, Mus musculus
gaactactggccctgctctctgctc

SEQ ID NO: 925131 - DNA, 25 bp, Mus musculus
gaactagaaaaagacctataccaag

SEQ ID NO: 925132 - DNA, 25 bp, Mus musculus
gaactagaaaaagagctataccaag

SEQ ID NO: 925133 - DNA, 25 bp, Mus musculus
gaactagcagctgacttaagagaga

SEQ ID NO: 925134 - DNA, 25 bp, Mus musculus
gaactagcaggtgacttaagagaga

SEQ ID NO: 925135 - DNA, 25 bp, Mus musculus
gaactagctaagcctcaaactcaga

SEQ ID NO: 925136 - DNA, 25 bp, Mus musculus
gaactagctaaggctcaaactcaga

SEQ ID NO: 925137 - DNA, 25 bp, Mus musculus
gaactatcttgtaaccgtggggatg

SEQ ID NO: 925138 - DNA, 25 bp, Mus musculus
gaactatcttgtaagcgtggggatg

SEQ ID NO: 925139 - DNA, 25 bp, Mus musculus
gaactatgaatacaggcaaattttt

SEQ ID NO: 925140 - DNA, 25 bp, Mus musculus
gaactatgaatagaggcaaattttt

SEQ ID NO: 925141 - DNA, 25 bp, Mus musculus
gaactatgagcctctcctgaacctg

SEQ ID NO: 925142 - DNA, 25 bp, Mus musculus
gaactatgagctagcctacccggac

SEQ ID NO: 925143 - DNA, 25 bp, Mus musculus
gaactatgaggctctcctgaacctg

SEQ ID NO: 925144 - DNA, 25 bp, Mus musculus
gaactatgaggtagcctacccggac

SEQ ID NO: 925145 - DNA, 25 bp, Mus musculus
gaactatggtcactttgaccatggg

SEQ ID NO: 925146 - DNA, 25 bp, Mus musculus
gaactatggtcagtttgaccatggg

SEQ ID NO: 925147 - DNA, 25 bp, Mus musculus
gaactcaaagaagtcacagtaaaga

SEQ ID NO: 925148 - DNA, 25 bp, Mus musculus
gaactcaaagccaaatcagaggtgg

SEQ ID NO: 925149 - DNA, 25 bp, Mus musculus
gaactcaaaggcaaatcagaggtgg

SEQ ID NO: 925150 - DNA, 25 bp, Mus musculus
gaactcaaagtagtcacagtaaaga

SEQ ID NO: 925151 - DNA, 25 bp, Mus musculus
gaactcaacaagcagatggcttcag

SEQ ID NO: 925152 - DNA, 25 bp, Mus musculus
gaactcaacaaggagatggcttcag

SEQ ID NO: 925153 - DNA, 25 bp, Mus musculus
gaactcacagctccattacttacca

SEQ ID NO: 925154 - DNA, 25 bp, Mus musculus
gaactcacaggtccattacttacca

SEQ ID NO: 925155 - DNA, 25 bp, Mus musculus
gaactcacccaactgcaaaacatgt

SEQ ID NO: 925156 - DNA, 25 bp, Mus musculus
gaactcacccaactgttgcccacca

SEQ ID NO: 925157 - DNA, 25 bp, Mus musculus
gaactcacccaagtgcaaaacatgt

SEQ ID NO: 925158 - DNA, 25 bp, Mus musculus
gaactcacccaagtgttgcccacca

SEQ ID NO: 925159 - DNA, 25 bp, Mus musculus
gaactcacgccactatctggaccag

SEQ ID NO: 925160 - DNA, 25 bp, Mus musculus
gaactcacgccagtatctggaccag

SEQ ID NO: 925161 - DNA, 25 bp, Mus musculus
gaactcagacacctcctcaacatgg

SEQ ID NO: 925162 - DNA, 25 bp, Mus musculus
gaactcagacacctcgcagtgctta

SEQ ID NO: 925163 - DNA, 25 bp, Mus musculus
gaactcagacacctgctcaacatgg

SEQ ID NO: 925164 - DNA, 25 bp, Mus musculus
gaactcagacacctggcagtgctta

SEQ ID NO: 925165 - DNA, 25 bp, Mus musculus
gaactcagacagcattatggcttca

SEQ ID NO: 925166 - DNA, 25 bp, Mus musculus
gaactcagacaggattatggcttca

SEQ ID NO: 925167 - DNA, 25 bp, Mus musculus
gaactcagctactacgagccctaaa

SEQ ID NO: 925168 - DNA, 25 bp, Mus musculus
gaactcagctactaggagccctaaa

SEQ ID NO: 925169 - DNA, 25 bp, Mus musculus
gaactcatacagcagaaaagccgta

SEQ ID NO: 925170 - DNA, 25 bp, Mus musculus
gaactcatacaggagaaaagccgta

SEQ ID NO: 925171 - DNA, 25 bp, Mus musculus
gaactccgacagctttgtcaagggc

SEQ ID NO: 925172 - DNA, 25 bp, Mus musculus
gaactccgacaggtttgtcaagggc

SEQ ID NO: 925173 - DNA, 25 bp, Mus musculus
gaactccttgaacctgctaaggaaa

SEQ ID NO: 925174 - DNA, 25 bp, Mus musculus
gaactccttgaagctgctaaggaaa

SEQ ID NO: 925175 - DNA, 25 bp, Mus musculus
gaactcgcacagaaccctctctgga

SEQ ID NO: 925176 - DNA, 25 bp, Mus musculus
gaactcgcacagaagcctctctgga

SEQ ID NO: 925177 - DNA, 25 bp, Mus musculus
gaactcgcactaaggtccacgcttc

SEQ ID NO: 925178 - DNA, 25 bp, Mus musculus
gaactcgcactatggtccacgcttc

SEQ ID NO: 925179 - DNA, 25 bp, Mus musculus
gaactcgcggcgcaagactgctagc

SEQ ID NO: 925180 - DNA, 25 bp, Mus musculus
gaactcgcggcggaagactgctagc

SEQ ID NO: 925181 - DNA, 25 bp, Mus musculus
gaactcggagcacctggagctgatc

SEQ ID NO: 925182 - DNA, 25 bp, Mus musculus
gaactcggagcagctggagctgatc

SEQ ID NO: 925183 - DNA, 25 bp, Mus musculus
gaactcgtgcaacagctggaatcac

SEQ ID NO: 925184 - DNA, 25 bp, Mus musculus
gaactcgtgcaagagctggaatcac

SEQ ID NO: 925185 - DNA, 25 bp, Mus musculus
gaactctaccaggactgcaggcctt

SEQ ID NO: 925186 - DNA, 25 bp, Mus musculus
gaactctaccaggagtgcaggcctt

SEQ ID NO: 925187 - DNA, 25 bp, Mus musculus
gaactctcagatagtcaccacagaa

SEQ ID NO: 925188 - DNA, 25 bp, Mus musculus
gaactctcagttagtcaccacagaa

SEQ ID NO: 925189 - DNA, 25 bp, Mus musculus
gaactctctctggcagagtgactgg

SEQ ID NO: 925190 - DNA, 25 bp, Mus musculus
gaactctctctggctgagtgactgg

SEQ ID NO: 925191 - DNA, 25 bp, Mus musculus
gaactctgaaccactatgaagtctt

SEQ ID NO: 925192 - DNA, 25 bp, Mus musculus
gaactctgaacctctatgaagtctt

SEQ ID NO: 925193 - DNA, 25 bp, Mus musculus
gaactctggaagatgggtgtgtttt

SEQ ID NO: 925194 - DNA, 25 bp, Mus musculus
gaactctggaagttgggtgtgtttt

SEQ ID NO: 925195 - DNA, 25 bp, Mus musculus
gaactcttcaagaatgccatgaggg

SEQ ID NO: 925196 - DNA, 25 bp, Mus musculus
gaactcttcaagtatgccatgaggg

SEQ ID NO: 925197 - DNA, 25 bp, Mus musculus
gaactgacccagatggtttctggcc

SEQ ID NO: 925198 - DNA, 25 bp, Mus musculus
gaactgacccagttggtttctggcc

SEQ ID NO: 925199 - DNA, 25 bp, Mus musculus
gaactgactctacacccactacgaa

SEQ ID NO: 925200 - DNA, 25 bp, Mus musculus
gaactgactctacacgcattgggca

SEQ ID NO: 925201 - DNA, 25 bp, Mus musculus
gaactgactctacagccactacgaa

SEQ ID NO: 925202 - DNA, 25 bp, Mus musculus
gaactgactctacaggcattgggca

SEQ ID NO: 925203 - DNA, 25 bp, Mus musculus
gaactgagagcttatgggccaggga

SEQ ID NO: 925204 - DNA, 25 bp, Mus musculus
gaactgagaggttatgggccaggga

SEQ ID NO: 925205 - DNA, 25 bp, Mus musculus
gaactgcagaagcgagaactttctg

SEQ ID NO: 925206 - DNA, 25 bp, Mus musculus
gaactgcagaagctgctgatggaat

SEQ ID NO: 925207 - DNA, 25 bp, Mus musculus
gaactgcagaagggagaactttctg

SEQ ID NO: 925208 - DNA, 25 bp, Mus musculus
gaactgcagaaggtgctgatggaat

SEQ ID NO: 925209 - DNA, 25 bp, Mus musculus
gaactgcagaattgagctccttgat

SEQ ID NO: 925210 - DNA, 25 bp, Mus musculus
gaactgcagatttgagctccttgat

SEQ ID NO: 925211 - DNA, 25 bp, Mus musculus
gaactgcattcacacggacctggct

SEQ ID NO: 925212 - DNA, 25 bp, Mus musculus
gaactgcattcacagggacctggct

SEQ ID NO: 925213 - DNA, 25 bp, Mus musculus
gaactgcattcacgacaggggtccg

SEQ ID NO: 925214 - DNA, 25 bp, Mus musculus
gaactgcattcaggacaggggtccg

SEQ ID NO: 925215 - DNA, 25 bp, Mus musculus
gaactgcctcgtcaactgggagggc

SEQ ID NO: 925216 - DNA, 25 bp, Mus musculus
gaactgcctcgtcaagcacaccaag

SEQ ID NO: 925217 - DNA, 25 bp, Mus musculus
gaactgcctcgtcatctgggagggc

SEQ ID NO: 925218 - DNA, 25 bp, Mus musculus
gaactgcctcgtcatgcacaccaag

SEQ ID NO: 925219 - DNA, 25 bp, Mus musculus
gaactgctagaacgtggctcgctgg

SEQ ID NO: 925220 - DNA, 25 bp, Mus musculus
gaactgctagaaggtggctcgctgg

SEQ ID NO: 925221 - DNA, 25 bp, Mus musculus
gaactgctggttgacgccttgagtg

SEQ ID NO: 925222 - DNA, 25 bp, Mus musculus
gaactgctggttgaggccttgagtg

SEQ ID NO: 925223 - DNA, 25 bp, Mus musculus
gaactggaagaacgggaaagctatg

SEQ ID NO: 925224 - DNA, 25 bp, Mus musculus
gaactggaagaaggggaaagctatg

SEQ ID NO: 925225 - DNA, 25 bp, Mus musculus
gaactggaagctgattatcgagatg

SEQ ID NO: 925226 - DNA, 25 bp, Mus musculus
gaactggaaggtgattatcgagatg

SEQ ID NO: 925227 - DNA, 25 bp, Mus musculus
gaactggacagacgagtgtgacaat

SEQ ID NO: 925228 - DNA, 25 bp, Mus musculus
gaactggacagaggagtgtgacaat

SEQ ID NO: 925229 - DNA, 25 bp, Mus musculus
gaactggagttagacgtgaccattt

SEQ ID NO: 925230 - DNA, 25 bp, Mus musculus
gaactggagttagaggtgaccattt

SEQ ID NO: 925231 - DNA, 25 bp, Mus musculus
gaactggcaccacctagaaaatctc

SEQ ID NO: 925232 - DNA, 25 bp, Mus musculus
gaactggcaccagctagaaaatctc

SEQ ID NO: 925233 - DNA, 25 bp, Mus musculus
gaactggccaggaagtgccgagggc

SEQ ID NO: 925234 - DNA, 25 bp, Mus musculus
gaactggccaggtagtgccgagggc

SEQ ID NO: 925235 - DNA, 25 bp, Mus musculus
gaactggccattaacctgctggagt

SEQ ID NO: 925236 - DNA, 25 bp, Mus musculus
gaactggccattaagctgctggagt

SEQ ID NO: 925237 - DNA, 25 bp, Mus musculus
gaactggctacactctcaacagcga

SEQ ID NO: 925238 - DNA, 25 bp, Mus musculus
gaactggctacagtctcaacagcga

SEQ ID NO: 925239 - DNA, 25 bp, Mus musculus
gaactggtcagccacagccaagctg

SEQ ID NO: 925240 - DNA, 25 bp, Mus musculus
gaactggtcagccagagccaagctg

SEQ ID NO: 925241 - DNA, 25 bp, Mus musculus
gaactgtagtgtcgagctgacccca

SEQ ID NO: 925242 - DNA, 25 bp, Mus musculus
gaactgtagtgtggagctgacccca

SEQ ID NO: 925243 - DNA, 25 bp, Mus musculus
gaactgtatgaccacaattatccca

SEQ ID NO: 925244 - DNA, 25 bp, Mus musculus
gaactgtatgaccagaattatccca

SEQ ID NO: 925245 - DNA, 25 bp, Mus musculus
gaactgtcagatgtccaacatcaca

SEQ ID NO: 925246 - DNA, 25 bp, Mus musculus
gaactgtcagttgtccaacatcaca

SEQ ID NO: 925247 - DNA, 25 bp, Mus musculus
gaactgtccatccgagcagcagcat

SEQ ID NO: 925248 - DNA, 25 bp, Mus musculus
gaactgtccatcggagcagcagcat

SEQ ID NO: 925249 - DNA, 25 bp, Mus musculus
gaactgtctttgcaatcaccactgt

SEQ ID NO: 925250 - DNA, 25 bp, Mus musculus
gaactgtctttggaatcaccactgt

SEQ ID NO: 925251 - DNA, 25 bp, Mus musculus
gaactgtggagaagcgtcaactgct

SEQ ID NO: 925252 - DNA, 25 bp, Mus musculus
gaactgtggagaagcgtttcaaagc

SEQ ID NO: 925253 - DNA, 25 bp, Mus musculus
gaactgtggagaagggtcaactgct

SEQ ID NO: 925254 - DNA, 25 bp, Mus musculus
gaactgtggagaagggtttcaaagc

SEQ ID NO: 925255 - DNA, 25 bp, Mus musculus
gaactgttatctaatgatactcctg

SEQ ID NO: 925256 - DNA, 25 bp, Mus musculus
gaactgttatcttatgatactcctg

SEQ ID NO: 925257 - DNA, 25 bp, Mus musculus
gaacttaaagaaaacctgaaagcaa

SEQ ID NO: 925258 - DNA, 25 bp, Mus musculus
gaacttaaagaaaagctgaaagcaa

SEQ ID NO: 925259 - DNA, 25 bp, Mus musculus
gaacttaaagctgacaacatgtaca

SEQ ID NO: 925260 - DNA, 25 bp, Mus musculus
gaacttaaaggtgacaacatgtaca

SEQ ID NO: 925261 - DNA, 25 bp, Mus musculus
gaacttagaggagacccaagttgaa

SEQ ID NO: 925262 - DNA, 25 bp, Mus musculus
gaacttagaggagagccaagttgaa

SEQ ID NO: 925263 - DNA, 25 bp, Mus musculus
gaacttcaaaaccaccagagaaaaa

SEQ ID NO: 925264 - DNA, 25 bp, Mus musculus
gaacttcaaaaccagcagagaaaaa

SEQ ID NO: 925265 - DNA, 25 bp, Mus musculus
gaacttcaggctcctgggcaatatg

SEQ ID NO: 925266 - DNA, 25 bp, Mus musculus
gaacttcagggtcctgggcaatatg

SEQ ID NO: 925267 - DNA, 25 bp, Mus musculus
gaacttccatatcacctggaaggac

SEQ ID NO: 925268 - DNA, 25 bp, Mus musculus
gaacttccatatcagctggaaggac

SEQ ID NO: 925269 - DNA, 25 bp, Mus musculus
gaacttgaagaaatcgagcgcctta

SEQ ID NO: 925270 - DNA, 25 bp, Mus musculus
gaacttgaagaaatggagcgcctta

SEQ ID NO: 925271 - DNA, 25 bp, Mus musculus
gaacttggtgtgcagctgagcccta

SEQ ID NO: 925272 - DNA, 25 bp, Mus musculus
gaacttggtgtggagctgagcccta

SEQ ID NO: 925273 - DNA, 25 bp, Mus musculus
gaacttggttagaattatcttctgt

SEQ ID NO: 925274 - DNA, 25 bp, Mus musculus
gaacttggttagtattatcttctgt

SEQ ID NO: 925275 - DNA, 25 bp, Mus musculus
gaactttgcccacgtcctgggctgt

SEQ ID NO: 925276 - DNA, 25 bp, Mus musculus
gaactttgcccacgtgtggtgtggg

SEQ ID NO: 925277 - DNA, 25 bp, Mus musculus
gaactttgcccaggtcctgggctgt

SEQ ID NO: 925278 - DNA, 25 bp, Mus musculus
gaactttgcccaggtgtggtgtggg

SEQ ID NO: 925279 - DNA, 25 bp, Mus musculus
gaagaaaaacataaaattacaagat

SEQ ID NO: 925280 - DNA, 25 bp, Mus musculus
gaagaaaaacataaacaagatctta

SEQ ID NO: 925281 - DNA, 25 bp, Mus musculus
gaagaaaaacataatattacaagat

SEQ ID NO: 925282 - DNA, 25 bp, Mus musculus
gaagaaaaacataatcaagatctta

SEQ ID NO: 925283 - DNA, 25 bp, Mus musculus
gaagaaaaagatgagtgtgttgaga

SEQ ID NO: 925284 - DNA, 25 bp, Mus musculus
gaagaaaaagttgagtgtgttgaga

SEQ ID NO: 925285 - DNA, 25 bp, Mus musculus
gaagaaaaatacatcgttaaagcaa

SEQ ID NO: 925286 - DNA, 25 bp, Mus musculus
gaagaaaaattcatcgttaaagcaa

SEQ ID NO: 925287 - DNA, 25 bp, Mus musculus
gaagaaaactgtcgcaacataacat

SEQ ID NO: 925288 - DNA, 25 bp, Mus musculus
gaagaaaactgtggcaacataacat

SEQ ID NO: 925289 - DNA, 25 bp, Mus musculus
gaagaaaagatcataaccttggatg

SEQ ID NO: 925290 - DNA, 25 bp, Mus musculus
gaagaaaagatcattaccttggatg

SEQ ID NO: 925291 - DNA, 25 bp, Mus musculus
gaagaaaagcagagtaagcttcttg

SEQ ID NO: 925292 - DNA, 25 bp, Mus musculus
gaagaaaagcagtgtaagcttcttg

SEQ ID NO: 925293 - DNA, 25 bp, Mus musculus
gaagaaaatgaagaccatcaaatga

SEQ ID NO: 925294 - DNA, 25 bp, Mus musculus
gaagaaaatgaccatcaaatgagtt

SEQ ID NO: 925295 - DNA, 25 bp, Mus musculus
gaagaaaatgtagaccatcaaatga

SEQ ID NO: 925296 - DNA, 25 bp, Mus musculus
gaagaaaatgtccatcaaatgagtt

SEQ ID NO: 925297 - DNA, 25 bp, Mus musculus
gaagaaacggaacgcatgaaagaag

SEQ ID NO: 925298 - DNA, 25 bp, Mus musculus
gaagaaacggaaggcatgaaagaag

SEQ ID NO: 925299 - DNA, 25 bp, Mus musculus
gaagaaagaactcgtcactgtgttt

SEQ ID NO: 925300 - DNA, 25 bp, Mus musculus
gaagaaagaactggtcactgtgttt

SEQ ID NO: 925301 - DNA, 25 bp, Mus musculus
gaagaaagccaacggcgctgatggc

SEQ ID NO: 925302 - DNA, 25 bp, Mus musculus
gaagaaagccaagggcgctgatggc

SEQ ID NO: 925303 - DNA, 25 bp, Mus musculus
gaagaaagccatcaacgacctagac

SEQ ID NO: 925304 - DNA, 25 bp, Mus musculus
gaagaaagccatcaagttgcctgca

SEQ ID NO: 925305 - DNA, 25 bp, Mus musculus
gaagaaagccatcatcgacctagac

SEQ ID NO: 925306 - DNA, 25 bp, Mus musculus
gaagaaagccatcatgttgcctgca

SEQ ID NO: 925307 - DNA, 25 bp, Mus musculus
gaagaaagcctaaatgcttcagtgg

SEQ ID NO: 925308 - DNA, 25 bp, Mus musculus
gaagaaagcctatatgcttcagtgg

SEQ ID NO: 925309 - DNA, 25 bp, Mus musculus
gaagaaagcgctcaagaatttcact

SEQ ID NO: 925310 - DNA, 25 bp, Mus musculus
gaagaaagcggtcaagaatttcact

SEQ ID NO: 925311 - DNA, 25 bp, Mus musculus
gaagaaaggagaaccacatgaaatg

SEQ ID NO: 925312 - DNA, 25 bp, Mus musculus
gaagaaaggagatccacatgaaatg

SEQ ID NO: 925313 - DNA, 25 bp, Mus musculus
gaagaaagtgatgacttcctaaggg

SEQ ID NO: 925314 - DNA, 25 bp, Mus musculus
gaagaaagtgatgagttcctaaggg

SEQ ID NO: 925315 - DNA, 25 bp, Mus musculus
gaagaaatacagagtgcttggtata

SEQ ID NO: 925316 - DNA, 25 bp, Mus musculus
gaagaaatacagtgtgcttggtata

SEQ ID NO: 925317 - DNA, 25 bp, Mus musculus
gaagaaatgaagagagctaaagaag

SEQ ID NO: 925318 - DNA, 25 bp, Mus musculus
gaagaaatgaagtgagctaaagaag

SEQ ID NO: 925319 - DNA, 25 bp, Mus musculus
gaagaaattcaacatggttatatta

SEQ ID NO: 925320 - DNA, 25 bp, Mus musculus
gaagaaattcaagatggttatatta

SEQ ID NO: 925321 - DNA, 25 bp, Mus musculus
gaagaacaaaaaagcaagctgggcg

SEQ ID NO: 925322 - DNA, 25 bp, Mus musculus
gaagaacaaaaatgcaagctgggcg

SEQ ID NO: 925323 - DNA, 25 bp, Mus musculus
gaagaacaacttaacgtactgggag

SEQ ID NO: 925324 - DNA, 25 bp, Mus musculus
gaagaacaacttaaggtactgggag

SEQ ID NO: 925325 - DNA, 25 bp, Mus musculus
gaagaacaccaaagagtgagtaaag

SEQ ID NO: 925326 - DNA, 25 bp, Mus musculus
gaagaacaccaatgagtgagtaaag

SEQ ID NO: 925327 - DNA, 25 bp, Mus musculus
gaagaaccagcgccagtgcgggtct

SEQ ID NO: 925328 - DNA, 25 bp, Mus musculus
gaagaaccagcgtgccaagttagag

SEQ ID NO: 925329 - DNA, 25 bp, Mus musculus
gaagaaccagggccagtgcgggtct

SEQ ID NO: 925330 - DNA, 25 bp, Mus musculus
gaagaaccagggtgccaagttagag

SEQ ID NO: 925331 - DNA, 25 bp, Mus musculus
gaagaacctggacaactctgtgcac

SEQ ID NO: 925332 - DNA, 25 bp, Mus musculus
gaagaacctggacatctctgtgcac

SEQ ID NO: 925333 - DNA, 25 bp, Mus musculus
gaagaactcatacacgagaaaagcc

SEQ ID NO: 925334 - DNA, 25 bp, Mus musculus
gaagaactcatacaggagaaaagcc

SEQ ID NO: 925335 - DNA, 25 bp, Mus musculus
gaagaactgcagaacggagaacttt

SEQ ID NO: 925336 - DNA, 25 bp, Mus musculus
gaagaactgcagaacgtgctgatgg

SEQ ID NO: 925337 - DNA, 25 bp, Mus musculus
gaagaactgcagaagggagaacttt

SEQ ID NO: 925338 - DNA, 25 bp, Mus musculus
gaagaactgcagaaggtgctgatgg

SEQ ID NO: 925339 - DNA, 25 bp, Mus musculus
gaagaactggagcttgtcgaggcca

SEQ ID NO: 925340 - DNA, 25 bp, Mus musculus
gaagaactggaggttgtcgaggcca

SEQ ID NO: 925341 - DNA, 25 bp, Mus musculus
gaagaactggcgctatcccattatc

SEQ ID NO: 925342 - DNA, 25 bp, Mus musculus
gaagaactggcggtatcccattatc

SEQ ID NO: 925343 - DNA, 25 bp, Mus musculus
gaagaacttctgcaaaatctcagtt

SEQ ID NO: 925344 - DNA, 25 bp, Mus musculus
gaagaacttctggaaaatctcagtt

SEQ ID NO: 925345 - DNA, 25 bp, Mus musculus
gaagaagaaaatcaagaccatcaaa

SEQ ID NO: 925346 - DNA, 25 bp, Mus musculus
gaagaagaaaatcaccatcaaatga

SEQ ID NO: 925347 - DNA, 25 bp, Mus musculus
gaagaagaaaatgaagaccatcaaa

SEQ ID NO: 925348 - DNA, 25 bp, Mus musculus
gaagaagaaaatgaccatcaaatga

SEQ ID NO: 925349 - DNA, 25 bp, Mus musculus
gaagaagaaatacacagtgcttggt

SEQ ID NO: 925350 - DNA, 25 bp, Mus musculus
gaagaagaaatacagagtgcttggt

SEQ ID NO: 925351 - DNA, 25 bp, Mus musculus
gaagaagaagcacatcaaatttgag

SEQ ID NO: 925352 - DNA, 25 bp, Mus musculus
gaagaagaagcagatcaaatttgag

SEQ ID NO: 925353 - DNA, 25 bp, Mus musculus
gaagaagaagctagctacatcaagc

SEQ ID NO: 925354 - DNA, 25 bp, Mus musculus
gaagaagaaggtagctacatcaagc

SEQ ID NO: 925355 - DNA, 25 bp, Mus musculus
gaagaagacaacaacaagcagataa

SEQ ID NO: 925356 - DNA, 25 bp, Mus musculus
gaagaagacatcaacaagcagataa

SEQ ID NO: 925357 - DNA, 25 bp, Mus musculus
gaagaagactcacctctcatccgcc

SEQ ID NO: 925358 - DNA, 25 bp, Mus musculus
gaagaagactcagctctcatccgcc

SEQ ID NO: 925359 - DNA, 25 bp, Mus musculus
gaagaagaggaggaagagggtcttc

SEQ ID NO: 925360 - DNA, 25 bp, Mus musculus
gaagaagaggcagcgagatcttgag

SEQ ID NO: 925361 - DNA, 25 bp, Mus musculus
gaagaagagggagcgagatcttgag

SEQ ID NO: 925362 - DNA, 25 bp, Mus musculus
gaagaagaggtggaagagggtcttc

SEQ ID NO: 925363 - DNA, 25 bp, Mus musculus
gaagaagagtaccacgcattcctgg

SEQ ID NO: 925364 - DNA, 25 bp, Mus musculus
gaagaagagtaccaggcattcctgg

SEQ ID NO: 925365 - DNA, 25 bp, Mus musculus
gaagaagataaacacatacagacag

SEQ ID NO: 925366 - DNA, 25 bp, Mus musculus
gaagaagataaacagatacagacag

SEQ ID NO: 925367 - DNA, 25 bp, Mus musculus
gaagaagatcagaaaatatttctag

SEQ ID NO: 925368 - DNA, 25 bp, Mus musculus
gaagaagatcagtaaatatttctag

SEQ ID NO: 925369 - DNA, 25 bp, Mus musculus
gaagaagcagatcaaatttgagaaa

SEQ ID NO: 925370 - DNA, 25 bp, Mus musculus
gaagaagcagcagtacctggaggtg

SEQ ID NO: 925371 - DNA, 25 bp, Mus musculus
gaagaagcagctggcgcccttctca

SEQ ID NO: 925372 - DNA, 25 bp, Mus musculus
gaagaagcagctggggcccttctca

SEQ ID NO: 925373 - DNA, 25 bp, Mus musculus
gaagaagcaggagtacctggaggtg

SEQ ID NO: 925374 - DNA, 25 bp, Mus musculus
gaagaagcagttcaaatttgagaaa

SEQ ID NO: 925375 - DNA, 25 bp, Mus musculus
gaagaagcatttcggaactctcaac

SEQ ID NO: 925376 - DNA, 25 bp, Mus musculus
gaagaagcatttgggaactctcaac

SEQ ID NO: 925377 - DNA, 25 bp, Mus musculus
gaagaagctataaacgatgttaaga

SEQ ID NO: 925378 - DNA, 25 bp, Mus musculus
gaagaagctataaaggatgttaaga

SEQ ID NO: 925379 - DNA, 25 bp, Mus musculus
gaagaagctgagcaacttatgactc

SEQ ID NO: 925380 - DNA, 25 bp, Mus musculus
gaagaagctgtgcaacttatgactc

SEQ ID NO: 925381 - DNA, 25 bp, Mus musculus
gaagaaggagataaccccgatgtgg

SEQ ID NO: 925382 - DNA, 25 bp, Mus musculus
gaagaaggagataagcccgatgtgg

SEQ ID NO: 925383 - DNA, 25 bp, Mus musculus
gaagaagggatggacacggtccagc

SEQ ID NO: 925384 - DNA, 25 bp, Mus musculus
gaagaagggatggagacggtccagc

SEQ ID NO: 925385 - DNA, 25 bp, Mus musculus
gaagaagggttaatgcacgttgaag

SEQ ID NO: 925386 - DNA, 25 bp, Mus musculus
gaagaagggttattgcacgttgaag

SEQ ID NO: 925387 - DNA, 25 bp, Mus musculus
gaagaaggtgaccgtgaggaggagg

SEQ ID NO: 925388 - DNA, 25 bp, Mus musculus
gaagaaggtgacggtgaggaggagg

SEQ ID NO: 925389 - DNA, 25 bp, Mus musculus
gaagaaggtgcacatctttgagatg

SEQ ID NO: 925390 - DNA, 25 bp, Mus musculus
gaagaaggtgcagatctttgagatg

SEQ ID NO: 925391 - DNA, 25 bp, Mus musculus
gaagaagtgtctagcctttgcttca

SEQ ID NO: 925392 - DNA, 25 bp, Mus musculus
gaagaagtgtcttgcctttgcttca

SEQ ID NO: 925393 - DNA, 25 bp, Mus musculus
gaagaatatgaaaacgcttctgaga

SEQ ID NO: 925394 - DNA, 25 bp, Mus musculus
gaagaatatgaaaaggcttctgaga

SEQ ID NO: 925395 - DNA, 25 bp, Mus musculus
gaagaatattctcacgtctttgaaa

SEQ ID NO: 925396 - DNA, 25 bp, Mus musculus
gaagaatattctcaggtctttgaaa

SEQ ID NO: 925397 - DNA, 25 bp, Mus musculus
gaagaatggaaacaacttatctaca

SEQ ID NO: 925398 - DNA, 25 bp, Mus musculus
gaagaatggaaagaacttatctaca

SEQ ID NO: 925399 - DNA, 25 bp, Mus musculus
gaagaattaaagcagattgatgtgg

SEQ ID NO: 925400 - DNA, 25 bp, Mus musculus
gaagaattaaaggagattgatgtgg

SEQ ID NO: 925401 - DNA, 25 bp, Mus musculus
gaagaattcaggggcgaggatgact

SEQ ID NO: 925402 - DNA, 25 bp, Mus musculus
gaagaattcaggggggaggatgact

SEQ ID NO: 925403 - DNA, 25 bp, Mus musculus
gaagaattccaaatagcatagcttg

SEQ ID NO: 925404 - DNA, 25 bp, Mus musculus
gaagaattccaaatgcttacttttc

SEQ ID NO: 925405 - DNA, 25 bp, Mus musculus
gaagaattccaattagcatagcttg

SEQ ID NO: 925406 - DNA, 25 bp, Mus musculus
gaagaattccaattgcttacttttc

SEQ ID NO: 925407 - DNA, 25 bp, Mus musculus
gaagaattgtagataatttattaga

SEQ ID NO: 925408 - DNA, 25 bp, Mus musculus
gaagaattgtagattatttattaga

SEQ ID NO: 925409 - DNA, 25 bp, Mus musculus
gaagaatttcaacactgcgagtgct

SEQ ID NO: 925410 - DNA, 25 bp, Mus musculus
gaagaatttcaagactgcgagtgct

SEQ ID NO: 925411 - DNA, 25 bp, Mus musculus
gaagaatttcagatgcccgtgtggt

SEQ ID NO: 925412 - DNA, 25 bp, Mus musculus
gaagaatttcagtgtctctgaagaa

SEQ ID NO: 925413 - DNA, 25 bp, Mus musculus
gaagaatttctgatgcccgtgtggt

SEQ ID NO: 925414 - DNA, 25 bp, Mus musculus
gaagaatttctgtgtctctgaagaa

SEQ ID NO: 925415 - DNA, 25 bp, Mus musculus
gaagaatttgatgacgacagtggtg

SEQ ID NO: 925416 - DNA, 25 bp, Mus musculus
gaagaatttgatgaggacagtggtg

SEQ ID NO: 925417 - DNA, 25 bp, Mus musculus
gaagacacacagcaccacctcccag

SEQ ID NO: 925418 - DNA, 25 bp, Mus musculus
gaagacacacaggaccacctcccag

SEQ ID NO: 925419 - DNA, 25 bp, Mus musculus
gaagacacagcggctccttattgga

SEQ ID NO: 925420 - DNA, 25 bp, Mus musculus
gaagacacagctacaagctctgaag

SEQ ID NO: 925421 - DNA, 25 bp, Mus musculus
gaagacacaggggctccttattgga

SEQ ID NO: 925422 - DNA, 25 bp, Mus musculus
gaagacacaggtacaagctctgaag

SEQ ID NO: 925423 - DNA, 25 bp, Mus musculus
gaagacaccatgctgcttgcacctg

SEQ ID NO: 925424 - DNA, 25 bp, Mus musculus
gaagacaccatggtgcttgcacctg

SEQ ID NO: 925425 - DNA, 25 bp, Mus musculus
gaagacactaagcatctccgtgtgt

SEQ ID NO: 925426 - DNA, 25 bp, Mus musculus
gaagacactaaggatctccgtgtgt

SEQ ID NO: 925427 - DNA, 25 bp, Mus musculus
gaagacactgaaaaccgccatggct

SEQ ID NO: 925428 - DNA, 25 bp, Mus musculus
gaagacactgaaaagcgccatggct

SEQ ID NO: 925429 - DNA, 25 bp, Mus musculus
gaagacagcagacaagacgaaaatg

SEQ ID NO: 925430 - DNA, 25 bp, Mus musculus
gaagacagcagagaagacgaaaatg

SEQ ID NO: 925431 - DNA, 25 bp, Mus musculus
gaagacagcatctgcggattttctg

SEQ ID NO: 925432 - DNA, 25 bp, Mus musculus
gaagacagcatctggggattttctg

SEQ ID NO: 925433 - DNA, 25 bp, Mus musculus
gaagacaggcaggccaccttcggac

SEQ ID NO: 925434 - DNA, 25 bp, Mus musculus
gaagacaggcaggcgaccttcggac

SEQ ID NO: 925435 - DNA, 25 bp, Mus musculus
gaagacatctacaaaaccgcccaga

SEQ ID NO: 925436 - DNA, 25 bp, Mus musculus
gaagacatctactaaaccgcccaga

SEQ ID NO: 925437 - DNA, 25 bp, Mus musculus
gaagacatgtcaccttctctgtcca

SEQ ID NO: 925438 - DNA, 25 bp, Mus musculus
gaagacatgtcagcttctctgtcca

SEQ ID NO: 925439 - DNA, 25 bp, Mus musculus
gaagacattcttaaccgtttaaagg

SEQ ID NO: 925440 - DNA, 25 bp, Mus musculus
gaagacattcttaagcgtttaaagg

SEQ ID NO: 925441 - DNA, 25 bp, Mus musculus
gaagaccaagcgcatctctttcctg

SEQ ID NO: 925442 - DNA, 25 bp, Mus musculus
gaagaccaagcgctggaaggtaggc

SEQ ID NO: 925443 - DNA, 25 bp, Mus musculus
gaagaccaagcggatctctttcctg

SEQ ID NO: 925444 - DNA, 25 bp, Mus musculus
gaagaccaagcggtggaaggtaggc

SEQ ID NO: 925445 - DNA, 25 bp, Mus musculus
gaagaccacaaaaggccggctacct

SEQ ID NO: 925446 - DNA, 25 bp, Mus musculus
gaagaccacaaatggccggctacct

SEQ ID NO: 925447 - DNA, 25 bp, Mus musculus
gaagacccagacatggctgacatca

SEQ ID NO: 925448 - DNA, 25 bp, Mus musculus
gaagacccagtaatcctgttactgc

SEQ ID NO: 925449 - DNA, 25 bp, Mus musculus
gaagacccagtattcctgttactgc

SEQ ID NO: 925450 - DNA, 25 bp, Mus musculus
gaagacccagtcatggctgacatca

SEQ ID NO: 925451 - DNA, 25 bp, Mus musculus
gaagaccccacccagcatgcgtctt

SEQ ID NO: 925452 - DNA, 25 bp, Mus musculus
gaagaccccaccgagcatgcgtctt

SEQ ID NO: 925453 - DNA, 25 bp, Mus musculus
gaagaccgtgctcacgatcaaggag

SEQ ID NO: 925454 - DNA, 25 bp, Mus musculus
gaagaccgtgctcaggatcaaggag

SEQ ID NO: 925455 - DNA, 25 bp, Mus musculus
gaagacctacaacgtcggacatcaa

SEQ ID NO: 925456 - DNA, 25 bp, Mus musculus
gaagacctacaaggtcggacatcaa

SEQ ID NO: 925457 - DNA, 25 bp, Mus musculus
gaagacctcatgcgtcaaactgaag

SEQ ID NO: 925458 - DNA, 25 bp, Mus musculus
gaagacctcatgggtcaaactgaag

SEQ ID NO: 925459 - DNA, 25 bp, Mus musculus
gaagacctgcaacgacccagagcag

SEQ ID NO: 925460 - DNA, 25 bp, Mus musculus
gaagacctgcaaggacccagagcag

SEQ ID NO: 925461 - DNA, 25 bp, Mus musculus
gaagaccttatgaacctctttgaac

SEQ ID NO: 925462 - DNA, 25 bp, Mus musculus
gaagaccttatgaagctctttgaac

SEQ ID NO: 925463 - DNA, 25 bp, Mus musculus
gaagaccttgctgacgctacagaat

SEQ ID NO: 925464 - DNA, 25 bp, Mus musculus
gaagaccttgctgaggctacagaat

SEQ ID NO: 925465 - DNA, 25 bp, Mus musculus
gaagacgatgtgaatttttgggttc

SEQ ID NO: 925466 - DNA, 25 bp, Mus musculus
gaagacgatgtgtatttttgggttc

SEQ ID NO: 925467 - DNA, 25 bp, Mus musculus
gaagacgcaattcactcaggatggc

SEQ ID NO: 925468 - DNA, 25 bp, Mus musculus
gaagacgcaattcagtcaggatggc

SEQ ID NO: 925469 - DNA, 25 bp, Mus musculus
gaagacgcccctgacgtgtgtgagc

SEQ ID NO: 925470 - DNA, 25 bp, Mus musculus
gaagacgcccctgaggtgtgtgagc

SEQ ID NO: 925471 - DNA, 25 bp, Mus musculus
gaagacggacggaaaggcagccctg

SEQ ID NO: 925472 - DNA, 25 bp, Mus musculus
gaagacggacggaatggcagccctg

SEQ ID NO: 925473 - DNA, 25 bp, Mus musculus
gaagactactcagacacaaaggtga

SEQ ID NO: 925474 - DNA, 25 bp, Mus musculus
gaagactactgagacacaaaggtga

SEQ ID NO: 925475 - DNA, 25 bp, Mus musculus
gaagactcagctctcatccgccatg

SEQ ID NO: 925476 - DNA, 25 bp, Mus musculus
gaagactcaggtctcatccgccatg

SEQ ID NO: 925477 - DNA, 25 bp, Mus musculus
gaagactccaattcattgcttcttt

SEQ ID NO: 925478 - DNA, 25 bp, Mus musculus
gaagactccatttcattgcttcttt

SEQ ID NO: 925479 - DNA, 25 bp, Mus musculus
gaagactctggacagtgactgcacc

SEQ ID NO: 925480 - DNA, 25 bp, Mus musculus
gaagactctggagagtgactgcacc

SEQ ID NO: 925481 - DNA, 25 bp, Mus musculus
gaagactgaactaacacagaaagac

SEQ ID NO: 925482 - DNA, 25 bp, Mus musculus
gaagactgaactaagacagaaagac

SEQ ID NO: 925483 - DNA, 25 bp, Mus musculus
gaagactgtaagaacaatgtctgca

SEQ ID NO: 925484 - DNA, 25 bp, Mus musculus
gaagactgtaagaagaatgtctgca

SEQ ID NO: 925485 - DNA, 25 bp, Mus musculus
gaagactgtgcaagtgctccaagtg

SEQ ID NO: 925486 - DNA, 25 bp, Mus musculus
gaagactgtgcatgtgctccaagtg

SEQ ID NO: 925487 - DNA, 25 bp, Mus musculus
gaagacttacagcacgttattgcaa

SEQ ID NO: 925488 - DNA, 25 bp, Mus musculus
gaagacttacagcaggttattgcaa

SEQ ID NO: 925489 - DNA, 25 bp, Mus musculus
gaagacttcaagaggacgctggtag

SEQ ID NO: 925490 - DNA, 25 bp, Mus musculus
gaagacttcaagtggacgctggtag

SEQ ID NO: 925491 - DNA, 25 bp, Mus musculus
gaagagaacatgcacgagcaactgg

SEQ ID NO: 925492 - DNA, 25 bp, Mus musculus
gaagagaacatgcaggagcaactgg

SEQ ID NO: 925493 - DNA, 25 bp, Mus musculus
gaagagaacgcacagctcgtttcag

SEQ ID NO: 925494 - DNA, 25 bp, Mus musculus
gaagagaacgcagagctcgtttcag

SEQ ID NO: 925495 - DNA, 25 bp, Mus musculus
gaagagaagcccaacgagggtgtga

SEQ ID NO: 925496 - DNA, 25 bp, Mus musculus
gaagagaagcccaaggagggtgtga

SEQ ID NO: 925497 - DNA, 25 bp, Mus musculus
gaagagaatccacatatttttgcag

SEQ ID NO: 925498 - DNA, 25 bp, Mus musculus
gaagagaatccagatatttttgcag

SEQ ID NO: 925499 - DNA, 25 bp, Mus musculus
gaagagaatgcgcacgctgaagcgc

SEQ ID NO: 925500 - DNA, 25 bp, Mus musculus
gaagagaatgcgcaggctgaagcgc

SEQ ID NO: 925501 - DNA, 25 bp, Mus musculus
gaagagaattgaccgtttatcactc

SEQ ID NO: 925502 - DNA, 25 bp, Mus musculus
gaagagaattgagcgtttatcactc

SEQ ID NO: 925503 - DNA, 25 bp, Mus musculus
gaagagacaggcctccaacggttcc

SEQ ID NO: 925504 - DNA, 25 bp, Mus musculus
gaagagacaggcctgcaacggttcc

SEQ ID NO: 925505 - DNA, 25 bp, Mus musculus
gaagagagagcagtgaccatggatc

SEQ ID NO: 925506 - DNA, 25 bp, Mus musculus
gaagagagaggagtgaccatggatc

SEQ ID NO: 925507 - DNA, 25 bp, Mus musculus
gaagagatacccatcgaagtattta

SEQ ID NO: 925508 - DNA, 25 bp, Mus musculus
gaagagatacccatggaagtattta

SEQ ID NO: 925509 - DNA, 25 bp, Mus musculus
gaagagatctacagcggtggatgcg

SEQ ID NO: 925510 - DNA, 25 bp, Mus musculus
gaagagatctacaggggtggatgcg

SEQ ID NO: 925511 - DNA, 25 bp, Mus musculus
gaagagatggagatttttggaccat

SEQ ID NO: 925512 - DNA, 25 bp, Mus musculus
gaagagatggagttttttggaccat

SEQ ID NO: 925513 - DNA, 25 bp, Mus musculus
gaagagattacacgtgaagcagaac

SEQ ID NO: 925514 - DNA, 25 bp, Mus musculus
gaagagattacaggtgaagcagaac

SEQ ID NO: 925515 - DNA, 25 bp, Mus musculus
gaagagattcaaagcagaataccag

SEQ ID NO: 925516 - DNA, 25 bp, Mus musculus
gaagagattcaatgcagaataccag

SEQ ID NO: 925517 - DNA, 25 bp, Mus musculus
gaagagcatctcagccaactttata

SEQ ID NO: 925518 - DNA, 25 bp, Mus musculus
gaagagcatctcaggcaactttata

SEQ ID NO: 925519 - DNA, 25 bp, Mus musculus
gaagagccagaacaaacctcagaca

SEQ ID NO: 925520 - DNA, 25 bp, Mus musculus
gaagagccagaagaaacctcagaca

SEQ ID NO: 925521 - DNA, 25 bp, Mus musculus
gaagagccagcggagaagtgcagac

SEQ ID NO: 925522 - DNA, 25 bp, Mus musculus
gaagagccagcttgggcctggatcc

SEQ ID NO: 925523 - DNA, 25 bp, Mus musculus
gaagagccaggggagaagtgcagac

SEQ ID NO: 925524 - DNA, 25 bp, Mus musculus
gaagagccaggttgggcctggatcc

SEQ ID NO: 925525 - DNA, 25 bp, Mus musculus
gaagagccatgtctactttccgcct

SEQ ID NO: 925526 - DNA, 25 bp, Mus musculus
gaagagccatgtcttctttccgcct

SEQ ID NO: 925527 - DNA, 25 bp, Mus musculus
gaagagcgaggacacgagcaaaaat

SEQ ID NO: 925528 - DNA, 25 bp, Mus musculus
gaagagcgaggacgtggaagatatc

SEQ ID NO: 925529 - DNA, 25 bp, Mus musculus
gaagagcgaggagacgagcaaaaat

SEQ ID NO: 925530 - DNA, 25 bp, Mus musculus
gaagagcgaggaggtggaagatatc

SEQ ID NO: 925531 - DNA, 25 bp, Mus musculus
gaagagctactgaaatgatcagtca

SEQ ID NO: 925532 - DNA, 25 bp, Mus musculus
gaagagctactgtaatgatcagtca

SEQ ID NO: 925533 - DNA, 25 bp, Mus musculus
gaagagctagagatatgtgtcacaa

SEQ ID NO: 925534 - DNA, 25 bp, Mus musculus
gaagagctagagttatgtgtcacaa

SEQ ID NO: 925535 - DNA, 25 bp, Mus musculus
gaagagctgaacatcgacctgttcc

SEQ ID NO: 925536 - DNA, 25 bp, Mus musculus
gaagagctgaacatggacctgttcc

SEQ ID NO: 925537 - DNA, 25 bp, Mus musculus
gaagagctggagcacgttcgggagg

SEQ ID NO: 925538 - DNA, 25 bp, Mus musculus
gaagagctggagcaggttcgggagg

SEQ ID NO: 925539 - DNA, 25 bp, Mus musculus
gaagaggaagacttcccttctttga

SEQ ID NO: 925540 - DNA, 25 bp, Mus musculus
gaagaggaagacttgccttctttga

SEQ ID NO: 925541 - DNA, 25 bp, Mus musculus
gaagaggaagagctccagagaatgc

SEQ ID NO: 925542 - DNA, 25 bp, Mus musculus
gaagaggaagaggtccagagaatgc

SEQ ID NO: 925543 - DNA, 25 bp, Mus musculus
gaagaggaagattgtagctgatggc

SEQ ID NO: 925544 - DNA, 25 bp, Mus musculus
gaagaggaagtttgtagctgatggc

SEQ ID NO: 925545 - DNA, 25 bp, Mus musculus
gaagaggacagcattgatttcattg

SEQ ID NO: 925546 - DNA, 25 bp, Mus musculus
gaagaggacagctttgatttcattg

SEQ ID NO: 925547 - DNA, 25 bp, Mus musculus
gaagaggacctccaagcgctcatcg

SEQ ID NO: 925548 - DNA, 25 bp, Mus musculus
gaagaggacctccatgcgctcatcg

SEQ ID NO: 925549 - DNA, 25 bp, Mus musculus
gaagaggagaatgacgatgctcgca

SEQ ID NO: 925550 - DNA, 25 bp, Mus musculus
gaagaggagaatgaggatgctcgca

SEQ ID NO: 925551 - DNA, 25 bp, Mus musculus
gaagaggagcagcattttctgcaat

SEQ ID NO: 925552 - DNA, 25 bp, Mus musculus
gaagaggagcaggattttctgcaat

SEQ ID NO: 925553 - DNA, 25 bp, Mus musculus
gaagaggaggaacagcagccttcca

SEQ ID NO: 925554 - DNA, 25 bp, Mus musculus
gaagaggaggaagagcagccttcca

SEQ ID NO: 925555 - DNA, 25 bp, Mus musculus
gaagaggaggagcaggctccgcccc

SEQ ID NO: 925556 - DNA, 25 bp, Mus musculus
gaagaggaggaggaggctccgcccc

SEQ ID NO: 925557 - DNA, 25 bp, Mus musculus
gaagaggatgcctgctcccaggcaa

SEQ ID NO: 925558 - DNA, 25 bp, Mus musculus
gaagaggatgctcgatccatccatt

SEQ ID NO: 925559 - DNA, 25 bp, Mus musculus
gaagaggatgctggatccatccatt

SEQ ID NO: 925560 - DNA, 25 bp, Mus musculus
gaagaggatggctgctcccaggcaa

SEQ ID NO: 925561 - DNA, 25 bp, Mus musculus
gaagaggattgcgacgatcgccacg

SEQ ID NO: 925562 - DNA, 25 bp, Mus musculus
gaagaggattgcgaggatcgccacg

SEQ ID NO: 925563 - DNA, 25 bp, Mus musculus
gaagaggcacccaacaggctctggg

SEQ ID NO: 925564 - DNA, 25 bp, Mus musculus
gaagaggcacccaagaggctctggg

SEQ ID NO: 925565 - DNA, 25 bp, Mus musculus
gaagaggccccactgaaggggcaga

SEQ ID NO: 925566 - DNA, 25 bp, Mus musculus
gaagaggccccagtgaaggggcaga

SEQ ID NO: 925567 - DNA, 25 bp, Mus musculus
gaagaggctgtttcctgcttgtcca

SEQ ID NO: 925568 - DNA, 25 bp, Mus musculus
gaagaggctgtttcgtgcttgtcca

SEQ ID NO: 925569 - DNA, 25 bp, Mus musculus
gaagagggagagcctgaagaaacag

SEQ ID NO: 925570 - DNA, 25 bp, Mus musculus
gaagagggagaggctgaagaaacag

SEQ ID NO: 925571 - DNA, 25 bp, Mus musculus
gaagagggaggaggaacgctatcaa

SEQ ID NO: 925572 - DNA, 25 bp, Mus musculus
gaagagggaggaggtacgctatcaa

SEQ ID NO: 925573 - DNA, 25 bp, Mus musculus
gaagagggatagccccgacagtgag

SEQ ID NO: 925574 - DNA, 25 bp, Mus musculus
gaagagggataggcccgacagtgag

SEQ ID NO: 925575 - DNA, 25 bp, Mus musculus
gaagagggcaaaaatggttatgtcc

SEQ ID NO: 925576 - DNA, 25 bp, Mus musculus
gaagagggcaaatatggttatgtcc

SEQ ID NO: 925577 - DNA, 25 bp, Mus musculus
gaagagggtatccacattgcaagaa

SEQ ID NO: 925578 - DNA, 25 bp, Mus musculus
gaagagggtatccagattgcaagaa

SEQ ID NO: 925579 - DNA, 25 bp, Mus musculus
gaagaggtcaaacaggcgccagctg

SEQ ID NO: 925580 - DNA, 25 bp, Mus musculus
gaagaggtcaaagaggcgccagctg

SEQ ID NO: 925581 - DNA, 25 bp, Mus musculus
gaagaggttctgagtcttaggtcct

SEQ ID NO: 925582 - DNA, 25 bp, Mus musculus
gaagaggttctgtgtcttaggtcct

SEQ ID NO: 925583 - DNA, 25 bp, Mus musculus
gaagagtaccagccattcctggtct

SEQ ID NO: 925584 - DNA, 25 bp, Mus musculus
gaagagtaccaggcattcctggtct

SEQ ID NO: 925585 - DNA, 25 bp, Mus musculus
gaagagtatgagcagcgagactcct

SEQ ID NO: 925586 - DNA, 25 bp, Mus musculus
gaagagtatgaggagcgagactcct

SEQ ID NO: 925587 - DNA, 25 bp, Mus musculus
gaagagtgtcaacactgtgaaccaa

SEQ ID NO: 925588 - DNA, 25 bp, Mus musculus
gaagagtgtcaagactgtgaaccaa

SEQ ID NO: 925589 - DNA, 25 bp, Mus musculus
gaagagtttaaacgttgacatgaca

SEQ ID NO: 925590 - DNA, 25 bp, Mus musculus
gaagagtttaaaggttgacatgaca

SEQ ID NO: 925591 - DNA, 25 bp, Mus musculus
gaagagtttgagacgctccagcaac

SEQ ID NO: 925592 - DNA, 25 bp, Mus musculus
gaagagtttgagtcgctccagcaac

SEQ ID NO: 925593 - DNA, 25 bp, Mus musculus
gaagataaacagatacagacagaag

SEQ ID NO: 925594 - DNA, 25 bp, Mus musculus
gaagataaacagttacagacagaag

SEQ ID NO: 925595 - DNA, 25 bp, Mus musculus
gaagataaaccaccaaacaccaaag

SEQ ID NO: 925596 - DNA, 25 bp, Mus musculus
gaagataaacgaccaaacaccaaag

SEQ ID NO: 925597 - DNA, 25 bp, Mus musculus
gaagataacctaagtaccagcagtg

SEQ ID NO: 925598 - DNA, 25 bp, Mus musculus
gaagataacctatgtaccagcagtg

SEQ ID NO: 925599 - DNA, 25 bp, Mus musculus
gaagataatgaaagagaactatgag

SEQ ID NO: 925600 - DNA, 25 bp, Mus musculus
gaagataatgaaagtgaactatgag

SEQ ID NO: 925601 - DNA, 25 bp, Mus musculus
gaagatagctgacgaggaggctaag

SEQ ID NO: 925602 - DNA, 25 bp, Mus musculus
gaagatagctgaggaggaggctaag

SEQ ID NO: 925603 - DNA, 25 bp, Mus musculus
gaagatagtagaatcacagataaat

SEQ ID NO: 925604 - DNA, 25 bp, Mus musculus
gaagatagtagattcacagataaat

SEQ ID NO: 925605 - DNA, 25 bp, Mus musculus
gaagatatatcaaggaatatgtcac

SEQ ID NO: 925606 - DNA, 25 bp, Mus musculus
gaagatatatcatggaatatgtcac

SEQ ID NO: 925607 - DNA, 25 bp, Mus musculus
gaagatatcaaaaacggaatcttac

SEQ ID NO: 925608 - DNA, 25 bp, Mus musculus
gaagatatcaaaaagggaatcttac

SEQ ID NO: 925609 - DNA, 25 bp, Mus musculus
gaagatattgctgtgatccgaaact

SEQ ID NO: 925610 - DNA, 25 bp, Mus musculus
gaagatattggtgtgatccgaaact

SEQ ID NO: 925611 - DNA, 25 bp, Mus musculus
gaagatcaaaagaatcctcgcaagg

SEQ ID NO: 925612 - DNA, 25 bp, Mus musculus
gaagatcaaaagctcattgagttgg

SEQ ID NO: 925613 - DNA, 25 bp, Mus musculus
gaagatcaaaaggtcattgagttgg

SEQ ID NO: 925614 - DNA, 25 bp, Mus musculus
gaagatcaaaagtatcctcgcaagg

SEQ ID NO: 925615 - DNA, 25 bp, Mus musculus
gaagatcaccacctgtgtggagatg

SEQ ID NO: 925616 - DNA, 25 bp, Mus musculus
gaagatcaccacgtgtgtggagatg

SEQ ID NO: 925617 - DNA, 25 bp, Mus musculus
gaagatccagaacccaggtgttgcc

SEQ ID NO: 925618 - DNA, 25 bp, Mus musculus
gaagatccagctcggtcaccagggc

SEQ ID NO: 925619 - DNA, 25 bp, Mus musculus
gaagatccaggtcggtcaccagggc

SEQ ID NO: 925620 - DNA, 25 bp, Mus musculus
gaagatccagtacccaggtgttgcc

SEQ ID NO: 925621 - DNA, 25 bp, Mus musculus
gaagatccatgaaaagcaagatggg

SEQ ID NO: 925622 - DNA, 25 bp, Mus musculus
gaagatccatgaaatgcaagatggg

SEQ ID NO: 925623 - DNA, 25 bp, Mus musculus
gaagatccctattaaggcaatgact

SEQ ID NO: 925624 - DNA, 25 bp, Mus musculus
gaagatccctattatggcaatgact

SEQ ID NO: 925625 - DNA, 25 bp, Mus musculus
gaagatcctgggcgcagtgtatggg

SEQ ID NO: 925626 - DNA, 25 bp, Mus musculus
gaagatcctgggggcagtgtatggg

SEQ ID NO: 925627 - DNA, 25 bp, Mus musculus
gaagatcttgtgctcaagagcaatc

SEQ ID NO: 925628 - DNA, 25 bp, Mus musculus
gaagatcttgtggtcaagagcaatc

SEQ ID NO: 925629 - DNA, 25 bp, Mus musculus
gaagatgaagagctgcctagagttc

SEQ ID NO: 925630 - DNA, 25 bp, Mus musculus
gaagatgaagatcttttcacgaagt

SEQ ID NO: 925631 - DNA, 25 bp, Mus musculus
gaagatgaagatgtctggtgagaag

SEQ ID NO: 925632 - DNA, 25 bp, Mus musculus
gaagatgaagatgttttcacgaagt

SEQ ID NO: 925633 - DNA, 25 bp, Mus musculus
gaagatgaagctcaaactgggctca

SEQ ID NO: 925634 - DNA, 25 bp, Mus musculus
gaagatgaaggtcaaactgggctca

SEQ ID NO: 925635 - DNA, 25 bp, Mus musculus
gaagatgaagtgctgcctagagttc

SEQ ID NO: 925636 - DNA, 25 bp, Mus musculus
gaagatgaagttgtctggtgagaag

SEQ ID NO: 925637 - DNA, 25 bp, Mus musculus
gaagatgaatgtcactcctgatgtg

SEQ ID NO: 925638 - DNA, 25 bp, Mus musculus
gaagatgaatgtcagtcctgatgtg

SEQ ID NO: 925639 - DNA, 25 bp, Mus musculus
gaagatgacaatcaaactggattat

SEQ ID NO: 925640 - DNA, 25 bp, Mus musculus
gaagatgacaatcatactggattat

SEQ ID NO: 925641 - DNA, 25 bp, Mus musculus
gaagatgagaaacgtcatttactac

SEQ ID NO: 925642 - DNA, 25 bp, Mus musculus
gaagatgagaaaggtcatttactac

SEQ ID NO: 925643 - DNA, 25 bp, Mus musculus
gaagatgataacacctgctctcatc

SEQ ID NO: 925644 - DNA, 25 bp, Mus musculus
gaagatgataactcctgctctcatc

SEQ ID NO: 925645 - DNA, 25 bp, Mus musculus
gaagatgatccccagtgtttccagg

SEQ ID NO: 925646 - DNA, 25 bp, Mus musculus
gaagatgatcctcttcaagccttac

SEQ ID NO: 925647 - DNA, 25 bp, Mus musculus
gaagatgatcgccagtgtttccagg

SEQ ID NO: 925648 - DNA, 25 bp, Mus musculus
gaagatgatcgtcttcaagccttac

SEQ ID NO: 925649 - DNA, 25 bp, Mus musculus
gaagatgatgcaagatatgaattta

SEQ ID NO: 925650 - DNA, 25 bp, Mus musculus
gaagatgatgcactctttccagagg

SEQ ID NO: 925651 - DNA, 25 bp, Mus musculus
gaagatgatgcagtctttccagagg

SEQ ID NO: 925652 - DNA, 25 bp, Mus musculus
gaagatgatggaagatatgaattta

SEQ ID NO: 925653 - DNA, 25 bp, Mus musculus
gaagatgattcacgatttggaatgc

SEQ ID NO: 925654 - DNA, 25 bp, Mus musculus
gaagatgattcaggatttggaatgc

SEQ ID NO: 925655 - DNA, 25 bp, Mus musculus
gaagatgattttcgaagttgcttta

SEQ ID NO: 925656 - DNA, 25 bp, Mus musculus
gaagatgattttggaagttgcttta

SEQ ID NO: 925657 - DNA, 25 bp, Mus musculus
gaagatgcccagagagcactggaca

SEQ ID NO: 925658 - DNA, 25 bp, Mus musculus
gaagatgcccagtgagcactggaca

SEQ ID NO: 925659 - DNA, 25 bp, Mus musculus
gaagatgccgtgctggaatgtaact

SEQ ID NO: 925660 - DNA, 25 bp, Mus musculus
gaagatgccgtggtggaatgtaact

SEQ ID NO: 925661 - DNA, 25 bp, Mus musculus
gaagatgcgcagaaagctgtggatg

SEQ ID NO: 925662 - DNA, 25 bp, Mus musculus
gaagatgcgcagaatgctgtggatg

SEQ ID NO: 925663 - DNA, 25 bp, Mus musculus
gaagatgctacgcatgccttccgtg

SEQ ID NO: 925664 - DNA, 25 bp, Mus musculus
gaagatgctacggatgccttccgtg

SEQ ID NO: 925665 - DNA, 25 bp, Mus musculus
gaagatgctgcacgcaccagaaagc

SEQ ID NO: 925666 - DNA, 25 bp, Mus musculus
gaagatgctgcacgtctgggaaggc

SEQ ID NO: 925667 - DNA, 25 bp, Mus musculus
gaagatgctgcaggcaccagaaagc

SEQ ID NO: 925668 - DNA, 25 bp, Mus musculus
gaagatgctgcaggtctgggaaggc

SEQ ID NO: 925669 - DNA, 25 bp, Mus musculus
gaagatggaaaacacgctgagaatg

SEQ ID NO: 925670 - DNA, 25 bp, Mus musculus
gaagatggaaaacaggctgagaatg

SEQ ID NO: 925671 - DNA, 25 bp, Mus musculus
gaagatggagagcttccctatggct

SEQ ID NO: 925672 - DNA, 25 bp, Mus musculus
gaagatggagcataccataaaggct

SEQ ID NO: 925673 - DNA, 25 bp, Mus musculus
gaagatggaggataccataaaggct

SEQ ID NO: 925674 - DNA, 25 bp, Mus musculus
gaagatggagtgcttccctatggct

SEQ ID NO: 925675 - DNA, 25 bp, Mus musculus
gaagatggcaaacattactactttg

SEQ ID NO: 925676 - DNA, 25 bp, Mus musculus
gaagatggcaaagattactactttg

SEQ ID NO: 925677 - DNA, 25 bp, Mus musculus
gaagatggtggactctgtgttccgg

SEQ ID NO: 925678 - DNA, 25 bp, Mus musculus
gaagatggtggagtctgtgttccgg

SEQ ID NO: 925679 - DNA, 25 bp, Mus musculus
gaagatgtcaccacgcacaggcgac

SEQ ID NO: 925680 - DNA, 25 bp, Mus musculus
gaagatgtcacctcgcacaggcgac

SEQ ID NO: 925681 - DNA, 25 bp, Mus musculus
gaagatgttcaaaacgtatgatgct

SEQ ID NO: 925682 - DNA, 25 bp, Mus musculus
gaagatgttcaaaaggtatgatgct

SEQ ID NO: 925683 - DNA, 25 bp, Mus musculus
gaagattaaactgtggagacatgat

SEQ ID NO: 925684 - DNA, 25 bp, Mus musculus
gaagattaaagtgtggagacatgat

SEQ ID NO: 925685 - DNA, 25 bp, Mus musculus
gaagattaggaacgaagaatatgaa

SEQ ID NO: 925686 - DNA, 25 bp, Mus musculus
gaagattaggaaggaagaatatgaa

SEQ ID NO: 925687 - DNA, 25 bp, Mus musculus
gaagattatgagcgcggaggttgcc

SEQ ID NO: 925688 - DNA, 25 bp, Mus musculus
gaagattatgagggcggaggttgcc

SEQ ID NO: 925689 - DNA, 25 bp, Mus musculus
gaagattcagccttgttccccctgt

SEQ ID NO: 925690 - DNA, 25 bp, Mus musculus
gaagattcaggcttgttccccctgt

SEQ ID NO: 925691 - DNA, 25 bp, Mus musculus
gaagattccttaacacatgcagatg

SEQ ID NO: 925692 - DNA, 25 bp, Mus musculus
gaagattccttaacagcaacaagtt

SEQ ID NO: 925693 - DNA, 25 bp, Mus musculus
gaagattccttaactcatgcagatg

SEQ ID NO: 925694 - DNA, 25 bp, Mus musculus
gaagattccttaactgcaacaagtt

SEQ ID NO: 925695 - DNA, 25 bp, Mus musculus
gaagattcggatccctaccgtggtt

SEQ ID NO: 925696 - DNA, 25 bp, Mus musculus
gaagattcggcacatgtgggggagc

SEQ ID NO: 925697 - DNA, 25 bp, Mus musculus
gaagattcggcagatgtgggggagc

SEQ ID NO: 925698 - DNA, 25 bp, Mus musculus
gaagattcggttccctaccgtggtt

SEQ ID NO: 925699 - DNA, 25 bp, Mus musculus
gaagattctgccacttcaccaaggg

SEQ ID NO: 925700 - DNA, 25 bp, Mus musculus
gaagattctggcacttcaccaaggg

SEQ ID NO: 925701 - DNA, 25 bp, Mus musculus
gaagattgaagggacgttgcctgtt

SEQ ID NO: 925702 - DNA, 25 bp, Mus musculus
gaagattgaagggaggttgcctgtt

SEQ ID NO: 925703 - DNA, 25 bp, Mus musculus
gaagattgatctcggcagctctgct

SEQ ID NO: 925704 - DNA, 25 bp, Mus musculus
gaagattgatgtcggcagctctgct

SEQ ID NO: 925705 - DNA, 25 bp, Mus musculus
gaagattggccatgagttcaagcgc

SEQ ID NO: 925706 - DNA, 25 bp, Mus musculus
gaagattggccatgtgttcaagcgc

SEQ ID NO: 925707 - DNA, 25 bp, Mus musculus
gaagattgtcaacagcaactgcaat

SEQ ID NO: 925708 - DNA, 25 bp, Mus musculus
gaagattgtcaagagcaactgcaat

SEQ ID NO: 925709 - DNA, 25 bp, Mus musculus
gaagcaaaaccacaccccgcaggat

SEQ ID NO: 925710 - DNA, 25 bp, Mus musculus
gaagcaaaaccagaccccgcaggat

SEQ ID NO: 925711 - DNA, 25 bp, Mus musculus
gaagcaaataaaaggaaacagaagg

SEQ ID NO: 925712 - DNA, 25 bp, Mus musculus
gaagcaaataaatggaaacagaagg

SEQ ID NO: 925713 - DNA, 25 bp, Mus musculus
gaagcaagaatacacgtatggtttt

SEQ ID NO: 925714 - DNA, 25 bp, Mus musculus
gaagcaagaatacaggtatggtttt

SEQ ID NO: 925715 - DNA, 25 bp, Mus musculus
gaagcaagagagagaaccacgtatt

SEQ ID NO: 925716 - DNA, 25 bp, Mus musculus
gaagcaagagagtgaaccacgtatt

SEQ ID NO: 925717 - DNA, 25 bp, Mus musculus
gaagcaagagcttgcagaattcagc

SEQ ID NO: 925718 - DNA, 25 bp, Mus musculus
gaagcaagaggttgcagaattcagc

SEQ ID NO: 925719 - DNA, 25 bp, Mus musculus
gaagcaagataaaagagcagaggaa

SEQ ID NO: 925720 - DNA, 25 bp, Mus musculus
gaagcaagataaagaagagcagagg

SEQ ID NO: 925721 - DNA, 25 bp, Mus musculus
gaagcaagataaagaagcagaggaa

SEQ ID NO: 925722 - DNA, 25 bp, Mus musculus
gaagcaagataaagtagagcagagg

SEQ ID NO: 925723 - DNA, 25 bp, Mus musculus
gaagcaagataaagtagcagaggaa

SEQ ID NO: 925724 - DNA, 25 bp, Mus musculus
gaagcaagataatagagcagaggaa

SEQ ID NO: 925725 - DNA, 25 bp, Mus musculus
gaagcaagattaaacatgtacaagc

SEQ ID NO: 925726 - DNA, 25 bp, Mus musculus
gaagcaagattaaagatgtacaagc

SEQ ID NO: 925727 - DNA, 25 bp, Mus musculus
gaagcaaggactctcagcgtgagac

SEQ ID NO: 925728 - DNA, 25 bp, Mus musculus
gaagcaaggactgtcagcgtgagac

SEQ ID NO: 925729 - DNA, 25 bp, Mus musculus
gaagcacaagcacctgtacctgccg

SEQ ID NO: 925730 - DNA, 25 bp, Mus musculus
gaagcacaaggacctgtacctgccg

SEQ ID NO: 925731 - DNA, 25 bp, Mus musculus
gaagcacatccacaaggagcttgtg

SEQ ID NO: 925732 - DNA, 25 bp, Mus musculus
gaagcacatccagaaggagcttgtg

SEQ ID NO: 925733 - DNA, 25 bp, Mus musculus
gaagcaccaaatcaagagaaagttt

SEQ ID NO: 925734 - DNA, 25 bp, Mus musculus
gaagcaccaattcaagagaaagttt

SEQ ID NO: 925735 - DNA, 25 bp, Mus musculus
gaagcaccaccactattgtcaaccc

SEQ ID NO: 925736 - DNA, 25 bp, Mus musculus
gaagcaccaccagtattgtcaaccc

SEQ ID NO: 925737 - DNA, 25 bp, Mus musculus
gaagcacctcaaccagcagcaggag

SEQ ID NO: 925738 - DNA, 25 bp, Mus musculus
gaagcacctcaagcagcagcaggag

SEQ ID NO: 925739 - DNA, 25 bp, Mus musculus
gaagcacctcagcacgctcaagcaa

SEQ ID NO: 925740 - DNA, 25 bp, Mus musculus
gaagcacctcagcaggctcaagcaa

SEQ ID NO: 925741 - DNA, 25 bp, Mus musculus
gaagcacctgatgttcattcagatt

SEQ ID NO: 925742 - DNA, 25 bp, Mus musculus
gaagcacctgttgttcattcagatt

SEQ ID NO: 925743 - DNA, 25 bp, Mus musculus
gaagcactccataaactaaagctgc

SEQ ID NO: 925744 - DNA, 25 bp, Mus musculus
gaagcactccatctgtgtctgaaga

SEQ ID NO: 925745 - DNA, 25 bp, Mus musculus
gaagcactccatgtgtgtctgaaga

SEQ ID NO: 925746 - DNA, 25 bp, Mus musculus
gaagcactccattaactaaagctgc

SEQ ID NO: 925747 - DNA, 25 bp, Mus musculus
gaagcactggaggaggcagatgagc

SEQ ID NO: 925748 - DNA, 25 bp, Mus musculus
gaagcactggcaaggggaccaggat

SEQ ID NO: 925749 - DNA, 25 bp, Mus musculus
gaagcactgggaaggggaccaggat

SEQ ID NO: 925750 - DNA, 25 bp, Mus musculus
gaagcactggtggaggcagatgagc

SEQ ID NO: 925751 - DNA, 25 bp, Mus musculus
gaagcacttcggatggttcgagtgg

SEQ ID NO: 925752 - DNA, 25 bp, Mus musculus
gaagcacttcggttggttcgagtgg

SEQ ID NO: 925753 - DNA, 25 bp, Mus musculus
gaagcagaaaaaaacgtttatgaag

SEQ ID NO: 925754 - DNA, 25 bp, Mus musculus
gaagcagaaaaaaaggtttatgaag

SEQ ID NO: 925755 - DNA, 25 bp, Mus musculus
gaagcagaaaagaacggactgacca

SEQ ID NO: 925756 - DNA, 25 bp, Mus musculus
gaagcagaaaagaagggactgacca

SEQ ID NO: 925757 - DNA, 25 bp, Mus musculus
gaagcagaagccccaccaccaaaga

SEQ ID NO: 925758 - DNA, 25 bp, Mus musculus
gaagcagaagccgcaccaccaaaga

SEQ ID NO: 925759 - DNA, 25 bp, Mus musculus
gaagcagacattttatataattttg

SEQ ID NO: 925760 - DNA, 25 bp, Mus musculus
gaagcagacattttttataattttg

SEQ ID NO: 925761 - DNA, 25 bp, Mus musculus
gaagcagaccaacgtggaattccca

SEQ ID NO: 925762 - DNA, 25 bp, Mus musculus
gaagcagaccaaggtggaattccca

SEQ ID NO: 925763 - DNA, 25 bp, Mus musculus
gaagcagagaagacatgattgacat

SEQ ID NO: 925764 - DNA, 25 bp, Mus musculus
gaagcagagaagacttgattgacat

SEQ ID NO: 925765 - DNA, 25 bp, Mus musculus
gaagcagatccccatggctatgagt

SEQ ID NO: 925766 - DNA, 25 bp, Mus musculus
gaagcagatcccgatggctatgagt

SEQ ID NO: 925767 - DNA, 25 bp, Mus musculus
gaagcagatgaacatcatccatgaa

SEQ ID NO: 925768 - DNA, 25 bp, Mus musculus
gaagcagatgaagatcatccatgaa

SEQ ID NO: 925769 - DNA, 25 bp, Mus musculus
gaagcagatggtctcgtgtagccgt

SEQ ID NO: 925770 - DNA, 25 bp, Mus musculus
gaagcagatggtctggtgtagccgt

SEQ ID NO: 925771 - DNA, 25 bp, Mus musculus
gaagcagcaaccatccgtgagtgca

SEQ ID NO: 925772 - DNA, 25 bp, Mus musculus
gaagcagcaaccatgcgtgagtgca

SEQ ID NO: 925773 - DNA, 25 bp, Mus musculus
gaagcagcagcgcacacatatgacc

SEQ ID NO: 925774 - DNA, 25 bp, Mus musculus
gaagcagcagggcacacatatgacc

SEQ ID NO: 925775 - DNA, 25 bp, Mus musculus
gaagcagcgatgcgccagggctttg

SEQ ID NO: 925776 - DNA, 25 bp, Mus musculus
gaagcagcgatgggccagggctttg

SEQ ID NO: 925777 - DNA, 25 bp, Mus musculus
gaagcagcggcgaaggcaaggaaga

SEQ ID NO: 925778 - DNA, 25 bp, Mus musculus
gaagcagcggggaaggcaaggaaga

SEQ ID NO: 925779 - DNA, 25 bp, Mus musculus
gaagcagctagagccacagcagttg

SEQ ID NO: 925780 - DNA, 25 bp, Mus musculus
gaagcagctagagcgacagcagttg

SEQ ID NO: 925781 - DNA, 25 bp, Mus musculus
gaagcagctggacgtggtcaagctg

SEQ ID NO: 925782 - DNA, 25 bp, Mus musculus
gaagcagctggacttgaactttcta

SEQ ID NO: 925783 - DNA, 25 bp, Mus musculus
gaagcagctggaggtggtcaagctg

SEQ ID NO: 925784 - DNA, 25 bp, Mus musculus
gaagcagctggagttgaactttcta

SEQ ID NO: 925785 - DNA, 25 bp, Mus musculus
gaagcagctgggccccttctcaaga

SEQ ID NO: 925786 - DNA, 25 bp, Mus musculus
gaagcagctggggcccttctcaaga

SEQ ID NO: 925787 - DNA, 25 bp, Mus musculus
gaagcaggcaagctatacttgaagg

SEQ ID NO: 925788 - DNA, 25 bp, Mus musculus
gaagcaggcaaggtatacttgaagg

SEQ ID NO: 925789 - DNA, 25 bp, Mus musculus
gaagcaggccgtagcacagtataca

SEQ ID NO: 925790 - DNA, 25 bp, Mus musculus
gaagcaggccgtaggacagtataca

SEQ ID NO: 925791 - DNA, 25 bp, Mus musculus
gaagcagtattccaatgattttggc

SEQ ID NO: 925792 - DNA, 25 bp, Mus musculus
gaagcagtattccattgattttggc

SEQ ID NO: 925793 - DNA, 25 bp, Mus musculus
gaagcataagcgctttgccttcgtg

SEQ ID NO: 925794 - DNA, 25 bp, Mus musculus
gaagcataagggctttgccttcgtg

SEQ ID NO: 925795 - DNA, 25 bp, Mus musculus
gaagcatctagttgagaggagttta

SEQ ID NO: 925796 - DNA, 25 bp, Mus musculus
gaagcatctagttgtgaggagttta

SEQ ID NO: 925797 - DNA, 25 bp, Mus musculus
gaagcatgagaacacaagcaatcat

SEQ ID NO: 925798 - DNA, 25 bp, Mus musculus
gaagcatgagaagacaagcaatcat

SEQ ID NO: 925799 - DNA, 25 bp, Mus musculus
gaagcattctacagtcctggacatc

SEQ ID NO: 925800 - DNA, 25 bp, Mus musculus
gaagcattctactgtcctggacatc

SEQ ID NO: 925801 - DNA, 25 bp, Mus musculus
gaagcattctggcggtcaaccggat

SEQ ID NO: 925802 - DNA, 25 bp, Mus musculus
gaagcattctgggggtcaaccggat

SEQ ID NO: 925803 - DNA, 25 bp, Mus musculus
gaagcatttaatccctcctgcctgt

SEQ ID NO: 925804 - DNA, 25 bp, Mus musculus
gaagcatttaatgcctcctgcctgt

SEQ ID NO: 925805 - DNA, 25 bp, Mus musculus
gaagcatttgcgaactctcaacttt

SEQ ID NO: 925806 - DNA, 25 bp, Mus musculus
gaagcatttgggaactctcaacttt

SEQ ID NO: 925807 - DNA, 25 bp, Mus musculus
gaagccaaaaagaagaagcacttaa

SEQ ID NO: 925808 - DNA, 25 bp, Mus musculus
gaagccaaaaagagcaagaagcgga

SEQ ID NO: 925809 - DNA, 25 bp, Mus musculus
gaagccaaaaagtagaagcacttaa

SEQ ID NO: 925810 - DNA, 25 bp, Mus musculus
gaagccaaaaagtgcaagaagcgga

SEQ ID NO: 925811 - DNA, 25 bp, Mus musculus
gaagccaaagaaaaccaaagacaag

SEQ ID NO: 925812 - DNA, 25 bp, Mus musculus
gaagccaaagaaaagcaaagacaag

SEQ ID NO: 925813 - DNA, 25 bp, Mus musculus
gaagccaacaaccgcagctctccag

SEQ ID NO: 925814 - DNA, 25 bp, Mus musculus
gaagccaacaacggcagctctccag

SEQ ID NO: 925815 - DNA, 25 bp, Mus musculus
gaagccacagcaatcctgacctctg

SEQ ID NO: 925816 - DNA, 25 bp, Mus musculus
gaagccacaggaatcctgacctctg

SEQ ID NO: 925817 - DNA, 25 bp, Mus musculus
gaagccaccaagacccatctgaagc

SEQ ID NO: 925818 - DNA, 25 bp, Mus musculus
gaagccaccaagtcccatctgaagc

SEQ ID NO: 925819 - DNA, 25 bp, Mus musculus
gaagccagaaatcgggctggtgtca

SEQ ID NO: 925820 - DNA, 25 bp, Mus musculus
gaagccagaaatggggctggtgtca

SEQ ID NO: 925821 - DNA, 25 bp, Mus musculus
gaagccagagagcgtctgcgagctt

SEQ ID NO: 925822 - DNA, 25 bp, Mus musculus
gaagccagagagggtctgcgagctt

SEQ ID NO: 925823 - DNA, 25 bp, Mus musculus
gaagccagcccactggaaccccaac

SEQ ID NO: 925824 - DNA, 25 bp, Mus musculus
gaagccagcccagtggaaccccaac

SEQ ID NO: 925825 - DNA, 25 bp, Mus musculus
gaagccagcctgagcgagccagagg

SEQ ID NO: 925826 - DNA, 25 bp, Mus musculus
gaagccagcctgagggagccagagg

SEQ ID NO: 925827 - DNA, 25 bp, Mus musculus
gaagccaggctagacatcctgcagc

SEQ ID NO: 925828 - DNA, 25 bp, Mus musculus
gaagccaggctagagatcctgcagc

SEQ ID NO: 925829 - DNA, 25 bp, Mus musculus
gaagccatactccgacccactcgct

SEQ ID NO: 925830 - DNA, 25 bp, Mus musculus
gaagccatactcggacccactcgct

SEQ ID NO: 925831 - DNA, 25 bp, Mus musculus
gaagccatctccaacgaactggctt

SEQ ID NO: 925832 - DNA, 25 bp, Mus musculus
gaagccatctccaaggaactggctt

SEQ ID NO: 925833 - DNA, 25 bp, Mus musculus
gaagccatgctgcacgtgctgggcc

SEQ ID NO: 925834 - DNA, 25 bp, Mus musculus
gaagccatgctgcaggtgctgggcc

SEQ ID NO: 925835 - DNA, 25 bp, Mus musculus
gaagccattacaatgtgagatctgt

SEQ ID NO: 925836 - DNA, 25 bp, Mus musculus
gaagccattacattgtgagatctgt

SEQ ID NO: 925837 - DNA, 25 bp, Mus musculus
gaagccatttcacacgctaatgttt

SEQ ID NO: 925838 - DNA, 25 bp, Mus musculus
gaagccatttcagacgctaatgttt

SEQ ID NO: 925839 - DNA, 25 bp, Mus musculus
gaagcccaagcagggtgtgaagaca

SEQ ID NO: 925840 - DNA, 25 bp, Mus musculus
gaagcccaagcctccagaacccgaa

SEQ ID NO: 925841 - DNA, 25 bp, Mus musculus
gaagcccaaggagggtgtgaagaca

SEQ ID NO: 925842 - DNA, 25 bp, Mus musculus
gaagcccaaggctccagaacccgaa

SEQ ID NO: 925843 - DNA, 25 bp, Mus musculus
gaagcccagaagccctacccatgtc

SEQ ID NO: 925844 - DNA, 25 bp, Mus musculus
gaagcccagaagctgtgattggact

SEQ ID NO: 925845 - DNA, 25 bp, Mus musculus
gaagcccagaaggcctacccatgtc

SEQ ID NO: 925846 - DNA, 25 bp, Mus musculus
gaagcccagaaggtgtgattggact

SEQ ID NO: 925847 - DNA, 25 bp, Mus musculus
gaagcccagcagatttggcctggca

SEQ ID NO: 925848 - DNA, 25 bp, Mus musculus
gaagcccagcagcccagtgtgcttt

SEQ ID NO: 925849 - DNA, 25 bp, Mus musculus
gaagcccagcaggccagtgtgcttt

SEQ ID NO: 925850 - DNA, 25 bp, Mus musculus
gaagcccagcagttttggcctggca

SEQ ID NO: 925851 - DNA, 25 bp, Mus musculus
gaagccccaactcaggaatggatac

SEQ ID NO: 925852 - DNA, 25 bp, Mus musculus
gaagccccaactgaggaatggatac

SEQ ID NO: 925853 - DNA, 25 bp, Mus musculus
gaagccccagatgtaccgagctgtg

SEQ ID NO: 925854 - DNA, 25 bp, Mus musculus
gaagccccagttgtaccgagctgtg

SEQ ID NO: 925855 - DNA, 25 bp, Mus musculus
gaagcccctgccgcagactccgcac

SEQ ID NO: 925856 - DNA, 25 bp, Mus musculus
gaagcccctggcgcagactccgcac

SEQ ID NO: 925857 - DNA, 25 bp, Mus musculus
gaagcccgacctcacatgccttcca

SEQ ID NO: 925858 - DNA, 25 bp, Mus musculus
gaagcccgacctgacatgccttcca

SEQ ID NO: 925859 - DNA, 25 bp, Mus musculus
gaagcccgagatctgcggcaggaat

SEQ ID NO: 925860 - DNA, 25 bp, Mus musculus
gaagcccgagttctgcggcaggaat

SEQ ID NO: 925861 - DNA, 25 bp, Mus musculus
gaagcccgcacacgtcccaggaagg

SEQ ID NO: 925862 - DNA, 25 bp, Mus musculus
gaagcccgcacaggtcccaggaagg

SEQ ID NO: 925863 - DNA, 25 bp, Mus musculus
gaagcccgtgcccgtcagcttctag

SEQ ID NO: 925864 - DNA, 25 bp, Mus musculus
gaagcccgtgccggtcagcttctag

SEQ ID NO: 925865 - DNA, 25 bp, Mus musculus
gaagccctcgatgccaattctcgga

SEQ ID NO: 925866 - DNA, 25 bp, Mus musculus
gaagccctcgttgccaattctcgga

SEQ ID NO: 925867 - DNA, 25 bp, Mus musculus
gaagcccttagacatgcaacaagga

SEQ ID NO: 925868 - DNA, 25 bp, Mus musculus
gaagcccttagagatgcaacaagga

SEQ ID NO: 925869 - DNA, 25 bp, Mus musculus
gaagcctaagaacgcaattcacacc

SEQ ID NO: 925870 - DNA, 25 bp, Mus musculus
gaagcctaagcatgatgctgttgaa

SEQ ID NO: 925871 - DNA, 25 bp, Mus musculus
gaagcctaaggatgatgctgttgaa

SEQ ID NO: 925872 - DNA, 25 bp, Mus musculus
gaagcctaagtacgcaattcacacc

SEQ ID NO: 925873 - DNA, 25 bp, Mus musculus
gaagcctcagcaacaaagtgagaaa

SEQ ID NO: 925874 - DNA, 25 bp, Mus musculus
gaagcctcaggaacaaagtgagaaa

SEQ ID NO: 925875 - DNA, 25 bp, Mus musculus
gaagcctggcaacggctactgacag

SEQ ID NO: 925876 - DNA, 25 bp, Mus musculus
gaagcctggcaagggctactgacag

SEQ ID NO: 925877 - DNA, 25 bp, Mus musculus
gaagccttcaagccgccccccacag

SEQ ID NO: 925878 - DNA, 25 bp, Mus musculus
gaagccttcaagctgaagtacatgg

SEQ ID NO: 925879 - DNA, 25 bp, Mus musculus
gaagccttcaaggcgccccccacag

SEQ ID NO: 925880 - DNA, 25 bp, Mus musculus
gaagccttcaaggtgaagtacatgg

SEQ ID NO: 925881 - DNA, 25 bp, Mus musculus
gaagccttggagaaaacagagaaac

SEQ ID NO: 925882 - DNA, 25 bp, Mus musculus
gaagccttggagtaaacagagaaac

SEQ ID NO: 925883 - DNA, 25 bp, Mus musculus
gaagcctttgccaagattgtggctg

SEQ ID NO: 925884 - DNA, 25 bp, Mus musculus
gaagcctttggcaagattgtggctg

SEQ ID NO: 925885 - DNA, 25 bp, Mus musculus
gaagcgaggcaactttgtgaaggtg

SEQ ID NO: 925886 - DNA, 25 bp, Mus musculus
gaagcgaggcaagtttgtgaaggtg

SEQ ID NO: 925887 - DNA, 25 bp, Mus musculus
gaagcgagttgcagtggagaactcg

SEQ ID NO: 925888 - DNA, 25 bp, Mus musculus
gaagcgagttgctgtggagaactcg

SEQ ID NO: 925889 - DNA, 25 bp, Mus musculus
gaagcgcaacagctcacctggagga

SEQ ID NO: 925890 - DNA, 25 bp, Mus musculus
gaagcgcaacaggtcacctggagga

SEQ ID NO: 925891 - DNA, 25 bp, Mus musculus
gaagcggacatcatcgagtatgctg

SEQ ID NO: 925892 - DNA, 25 bp, Mus musculus
gaagcggacatcatggagtatgctg

SEQ ID NO: 925893 - DNA, 25 bp, Mus musculus
gaagcgggaattcgtctcggtgtga

SEQ ID NO: 925894 - DNA, 25 bp, Mus musculus
gaagcgggaattcgtctgggcgtca

SEQ ID NO: 925895 - DNA, 25 bp, Mus musculus
gaagcgggaattcgtcttggagttc

SEQ ID NO: 925896 - DNA, 25 bp, Mus musculus
gaagcgggaattggtctcggtgtga

SEQ ID NO: 925897 - DNA, 25 bp, Mus musculus
gaagcgggaattggtctgggcgtca

SEQ ID NO: 925898 - DNA, 25 bp, Mus musculus
gaagcgggaattggtcttggagttc

SEQ ID NO: 925899 - DNA, 25 bp, Mus musculus
gaagcgtgcacaccgaagaatagcc

SEQ ID NO: 925900 - DNA, 25 bp, Mus musculus
gaagcgtgcacagcgaagaatagcc

SEQ ID NO: 925901 - DNA, 25 bp, Mus musculus
gaagcgtttgatgactccggaaagg

SEQ ID NO: 925902 - DNA, 25 bp, Mus musculus
gaagcgtttgcaatcccggaaggac

SEQ ID NO: 925903 - DNA, 25 bp, Mus musculus
gaagcgtttgcctccttccgctcca

SEQ ID NO: 925904 - DNA, 25 bp, Mus musculus
gaagcgtttggaatcccggaaggac

SEQ ID NO: 925905 - DNA, 25 bp, Mus musculus
gaagcgtttggctccttccgctcca

SEQ ID NO: 925906 - DNA, 25 bp, Mus musculus
gaagcgtttgttgactccggaaagg

SEQ ID NO: 925907 - DNA, 25 bp, Mus musculus
gaagctaaaattaacgagctgacaa

SEQ ID NO: 925908 - DNA, 25 bp, Mus musculus
gaagctaaaattaaggagctgacaa

SEQ ID NO: 925909 - DNA, 25 bp, Mus musculus
gaagctacagcgttgaaaaatacag

SEQ ID NO: 925910 - DNA, 25 bp, Mus musculus
gaagctacagggttgaaaaatacag

SEQ ID NO: 925911 - DNA, 25 bp, Mus musculus
gaagctacttagcctactcagttgg

SEQ ID NO: 925912 - DNA, 25 bp, Mus musculus
gaagctacttaggctactcagttgg

SEQ ID NO: 925913 - DNA, 25 bp, Mus musculus
gaagctagagcaggagcagaggccg

SEQ ID NO: 925914 - DNA, 25 bp, Mus musculus
gaagctagaggaggagcagaggccg

SEQ ID NO: 925915 - DNA, 25 bp, Mus musculus
gaagctataaagcatgttaagattg

SEQ ID NO: 925916 - DNA, 25 bp, Mus musculus
gaagctataaaggatgttaagattg

SEQ ID NO: 925917 - DNA, 25 bp, Mus musculus
gaagctatggcacaaagccctgcag

SEQ ID NO: 925918 - DNA, 25 bp, Mus musculus
gaagctatggcacagtgctgggatt

SEQ ID NO: 925919 - DNA, 25 bp, Mus musculus
gaagctatggcacctacttaaaatt

SEQ ID NO: 925920 - DNA, 25 bp, Mus musculus
gaagctatggcacgtgattggagtt

SEQ ID NO: 925921 - DNA, 25 bp, Mus musculus
gaagctatggcactggttttatgaa

SEQ ID NO: 925922 - DNA, 25 bp, Mus musculus
gaagctatggcagaaagccctgcag

SEQ ID NO: 925923 - DNA, 25 bp, Mus musculus
gaagctatggcagagtgctgggatt

SEQ ID NO: 925924 - DNA, 25 bp, Mus musculus
gaagctatggcagctacttaaaatt

SEQ ID NO: 925925 - DNA, 25 bp, Mus musculus
gaagctatggcaggtgattggagtt

SEQ ID NO: 925926 - DNA, 25 bp, Mus musculus
gaagctatggcagtggttttatgaa

SEQ ID NO: 925927 - DNA, 25 bp, Mus musculus
gaagctcagaaacacgcggaaaaac

SEQ ID NO: 925928 - DNA, 25 bp, Mus musculus
gaagctcagaaacaggcggaaaaac

SEQ ID NO: 925929 - DNA, 25 bp, Mus musculus
gaagctcagaggcatcagaaacatc

SEQ ID NO: 925930 - DNA, 25 bp, Mus musculus
gaagctcagagggatcagaaacatc

SEQ ID NO: 925931 - DNA, 25 bp, Mus musculus
gaagctcagcagaacgttccagatg

SEQ ID NO: 925932 - DNA, 25 bp, Mus musculus
gaagctcagcagaaggttccagatg

SEQ ID NO: 925933 - DNA, 25 bp, Mus musculus
gaagctccatggcgttcccaggcct

SEQ ID NO: 925934 - DNA, 25 bp, Mus musculus
gaagctccatggggttcccaggcct

SEQ ID NO: 925935 - DNA, 25 bp, Mus musculus
gaagctccatgtcgctagttgatct

SEQ ID NO: 925936 - DNA, 25 bp, Mus musculus
gaagctccatgtcgcttgatcttga

SEQ ID NO: 925937 - DNA, 25 bp, Mus musculus
gaagctccatgtcggtagttgatct

SEQ ID NO: 925938 - DNA, 25 bp, Mus musculus
gaagctccatgtcggttgatcttga

SEQ ID NO: 925939 - DNA, 25 bp, Mus musculus
gaagctcccacacggaagccctgcc

SEQ ID NO: 925940 - DNA, 25 bp, Mus musculus
gaagctcccacagggaagccctgcc

SEQ ID NO: 925941 - DNA, 25 bp, Mus musculus
gaagctcgcaaacgctggcaaaacc

SEQ ID NO: 925942 - DNA, 25 bp, Mus musculus
gaagctcgcaaaggctggcaaaacc

SEQ ID NO: 925943 - DNA, 25 bp, Mus musculus
gaagctcgtgagatttttgatgaaa

SEQ ID NO: 925944 - DNA, 25 bp, Mus musculus
gaagctcgtgagttttttgatgaaa

SEQ ID NO: 925945 - DNA, 25 bp, Mus musculus
gaagctctagaaccgtacaggcggg

SEQ ID NO: 925946 - DNA, 25 bp, Mus musculus
gaagctctagaagcgtacaggcggg

SEQ ID NO: 925947 - DNA, 25 bp, Mus musculus
gaagctctgccaaccatatgggaag

SEQ ID NO: 925948 - DNA, 25 bp, Mus musculus
gaagctctgccaacgatatgggaag

SEQ ID NO: 925949 - DNA, 25 bp, Mus musculus
gaagctctggagcttttgggcaact

SEQ ID NO: 925950 - DNA, 25 bp, Mus musculus
gaagctctggaggttttgggcaact

SEQ ID NO: 925951 - DNA, 25 bp, Mus musculus
gaagctctttgaaacggctgctgaa

SEQ ID NO: 925952 - DNA, 25 bp, Mus musculus
gaagctctttgaaagggctgctgaa

SEQ ID NO: 925953 - DNA, 25 bp, Mus musculus
gaagctgaaaaacaccgagcctgcc

SEQ ID NO: 925954 - DNA, 25 bp, Mus musculus
gaagctgaaaaaccctgtagatttt

SEQ ID NO: 925955 - DNA, 25 bp, Mus musculus
gaagctgaaaaagaccgagcctgcc

SEQ ID NO: 925956 - DNA, 25 bp, Mus musculus
gaagctgaaaaagcctgtagatttt

SEQ ID NO: 925957 - DNA, 25 bp, Mus musculus
gaagctgatcaacgtcttggataaa

SEQ ID NO: 925958 - DNA, 25 bp, Mus musculus
gaagctgatcaaggtcttggataaa

SEQ ID NO: 925959 - DNA, 25 bp, Mus musculus
gaagctgatgagccatgaccccttg

SEQ ID NO: 925960 - DNA, 25 bp, Mus musculus
gaagctgatgaggcatgaccccttg

SEQ ID NO: 925961 - DNA, 25 bp, Mus musculus
gaagctgcagcccgactttaaaatt

SEQ ID NO: 925962 - DNA, 25 bp, Mus musculus
gaagctgcagctcacggggtgatag

SEQ ID NO: 925963 - DNA, 25 bp, Mus musculus
gaagctgcagctcagggggtgatag

SEQ ID NO: 925964 - DNA, 25 bp, Mus musculus
gaagctgcaggccgactttaaaatt

SEQ ID NO: 925965 - DNA, 25 bp, Mus musculus
gaagctgccaggatatcaatgaatg

SEQ ID NO: 925966 - DNA, 25 bp, Mus musculus
gaagctgccaggttatcaatgaatg

SEQ ID NO: 925967 - DNA, 25 bp, Mus musculus
gaagctgcccagaacgagtcgaaag

SEQ ID NO: 925968 - DNA, 25 bp, Mus musculus
gaagctgcccagaaggagtcgaaag

SEQ ID NO: 925969 - DNA, 25 bp, Mus musculus
gaagctgcctagagcaagagggcac

SEQ ID NO: 925970 - DNA, 25 bp, Mus musculus
gaagctgcctagtgcaagagggcac

SEQ ID NO: 925971 - DNA, 25 bp, Mus musculus
gaagctgcgctgacagaggatgaca

SEQ ID NO: 925972 - DNA, 25 bp, Mus musculus
gaagctgcgctgactgaggatgaca

SEQ ID NO: 925973 - DNA, 25 bp, Mus musculus
gaagctgcgtctgaagaagatccat

SEQ ID NO: 925974 - DNA, 25 bp, Mus musculus
gaagctgcgtgtgaagaagatccat

SEQ ID NO: 925975 - DNA, 25 bp, Mus musculus
gaagctgctagaccactgggaaaac

SEQ ID NO: 925976 - DNA, 25 bp, Mus musculus
gaagctgctagagcactgggaaaac

SEQ ID NO: 925977 - DNA, 25 bp, Mus musculus
gaagctggaaatcgaaccagtgacc

SEQ ID NO: 925978 - DNA, 25 bp, Mus musculus
gaagctggaaatggaaccagtgacc

SEQ ID NO: 925979 - DNA, 25 bp, Mus musculus
gaagctggagcaccttgaacttgag

SEQ ID NO: 925980 - DNA, 25 bp, Mus musculus
gaagctggagcacgaaagatctata

SEQ ID NO: 925981 - DNA, 25 bp, Mus musculus
gaagctggagcagcttgaacttgag

SEQ ID NO: 925982 - DNA, 25 bp, Mus musculus
gaagctggagcaggaaagatctata

SEQ ID NO: 925983 - DNA, 25 bp, Mus musculus
gaagctggaggacgccaagcacatt

SEQ ID NO: 925984 - DNA, 25 bp, Mus musculus
gaagctggaggacgtcattcagatt

SEQ ID NO: 925985 - DNA, 25 bp, Mus musculus
gaagctggaggaggccaagcacatt

SEQ ID NO: 925986 - DNA, 25 bp, Mus musculus
gaagctggaggaggtcattcagatt

SEQ ID NO: 925987 - DNA, 25 bp, Mus musculus
gaagctggcagccaaccgaatctat

SEQ ID NO: 925988 - DNA, 25 bp, Mus musculus
gaagctggcagccatccgaatctat

SEQ ID NO: 925989 - DNA, 25 bp, Mus musculus
gaagctggtcaacggtctagagaca

SEQ ID NO: 925990 - DNA, 25 bp, Mus musculus
gaagctggtcaagggtctagagaca

SEQ ID NO: 925991 - DNA, 25 bp, Mus musculus
gaagctggtgagaacaacagcagtg

SEQ ID NO: 925992 - DNA, 25 bp, Mus musculus
gaagctggtgagaagaacagcagtg

SEQ ID NO: 925993 - DNA, 25 bp, Mus musculus
gaagctgtcgggacagggacttctg

SEQ ID NO: 925994 - DNA, 25 bp, Mus musculus
gaagctgtcgggtcagggacttctg

SEQ ID NO: 925995 - DNA, 25 bp, Mus musculus
gaagcttcagatctgggacactgca

SEQ ID NO: 925996 - DNA, 25 bp, Mus musculus
gaagcttcagattataccgaaaaga

SEQ ID NO: 925997 - DNA, 25 bp, Mus musculus
gaagcttcagcctatgtctttcaga

SEQ ID NO: 925998 - DNA, 25 bp, Mus musculus
gaagcttcaggctatgtctttcaga

SEQ ID NO: 925999 - DNA, 25 bp, Mus musculus
gaagcttcagttctgggacactgca

SEQ ID NO: 926000 - DNA, 25 bp, Mus musculus
gaagcttcagtttataccgaaaaga

SEQ ID NO: 926001 - DNA, 25 bp, Mus musculus
gaagcttgctcacgatggctgcagc

SEQ ID NO: 926002 - DNA, 25 bp, Mus musculus
gaagcttgctcacgctcctcggatt

SEQ ID NO: 926003 - DNA, 25 bp, Mus musculus
gaagcttgctcaggatggctgcagc

SEQ ID NO: 926004 - DNA, 25 bp, Mus musculus
gaagcttgctcaggctcctcggatt

SEQ ID NO: 926005 - DNA, 25 bp, Mus musculus
gaagcttggagaggcgtcttatggc

SEQ ID NO: 926006 - DNA, 25 bp, Mus musculus
gaagcttggagaggggtcttatggc

SEQ ID NO: 926007 - DNA, 25 bp, Mus musculus
gaagcttgttgcctcgtacgacaac

SEQ ID NO: 926008 - DNA, 25 bp, Mus musculus
gaagcttgttgcctggtacgacaac

SEQ ID NO: 926009 - DNA, 25 bp, Mus musculus
gaagctttcaaacccattggcacag

SEQ ID NO: 926010 - DNA, 25 bp, Mus musculus
gaagctttcaaagccattggcacag

SEQ ID NO: 926011 - DNA, 25 bp, Mus musculus
gaaggaacggatcgctctggaggaa

SEQ ID NO: 926012 - DNA, 25 bp, Mus musculus
gaaggaacggatggctctggaggaa

SEQ ID NO: 926013 - DNA, 25 bp, Mus musculus
gaaggaagagagattgctgctgaag

SEQ ID NO: 926014 - DNA, 25 bp, Mus musculus
gaaggaagagagtttgctgctgaag

SEQ ID NO: 926015 - DNA, 25 bp, Mus musculus
gaaggaagagccagagaagttgggt

SEQ ID NO: 926016 - DNA, 25 bp, Mus musculus
gaaggaagagctgggagagttcaga

SEQ ID NO: 926017 - DNA, 25 bp, Mus musculus
gaaggaagagctttatgggactgtc

SEQ ID NO: 926018 - DNA, 25 bp, Mus musculus
gaaggaagaggcagagaagttgggt

SEQ ID NO: 926019 - DNA, 25 bp, Mus musculus
gaaggaagaggtgggagagttcaga

SEQ ID NO: 926020 - DNA, 25 bp, Mus musculus
gaaggaagaggtttatgggactgtc

SEQ ID NO: 926021 - DNA, 25 bp, Mus musculus
gaaggaaggatgctctgttttcaca

SEQ ID NO: 926022 - DNA, 25 bp, Mus musculus
gaaggaaggatggtctgttttcaca

SEQ ID NO: 926023 - DNA, 25 bp, Mus musculus
gaaggaagtcggcgagatcctgtct

SEQ ID NO: 926024 - DNA, 25 bp, Mus musculus
gaaggaagtcggggagatcctgtct

SEQ ID NO: 926025 - DNA, 25 bp, Mus musculus
gaaggaatatgacaaagagagccag

SEQ ID NO: 926026 - DNA, 25 bp, Mus musculus
gaaggaatatgagaaagagagccag

SEQ ID NO: 926027 - DNA, 25 bp, Mus musculus
gaaggaatggactcaattggtcaaa

SEQ ID NO: 926028 - DNA, 25 bp, Mus musculus
gaaggaatggactctattggtcaaa

SEQ ID NO: 926029 - DNA, 25 bp, Mus musculus
gaaggaatgtattgcccagctacct

SEQ ID NO: 926030 - DNA, 25 bp, Mus musculus
gaaggaatgttttgcccagctacct

SEQ ID NO: 926031 - DNA, 25 bp, Mus musculus
gaaggaattacacccgaagaagcag

SEQ ID NO: 926032 - DNA, 25 bp, Mus musculus
gaaggaattacagccgaagaagcag

SEQ ID NO: 926033 - DNA, 25 bp, Mus musculus
gaaggacaagcaccccgagctcccc

SEQ ID NO: 926034 - DNA, 25 bp, Mus musculus
gaaggacaaggaccccgagctcccc

SEQ ID NO: 926035 - DNA, 25 bp, Mus musculus
gaaggacaatgacgatggcagtacc

SEQ ID NO: 926036 - DNA, 25 bp, Mus musculus
gaaggacaatgaggatggcagtacc

SEQ ID NO: 926037 - DNA, 25 bp, Mus musculus
gaaggacattggaaccgagtgcatg

SEQ ID NO: 926038 - DNA, 25 bp, Mus musculus
gaaggacattggtaccgagtgcatg

SEQ ID NO: 926039 - DNA, 25 bp, Mus musculus
gaaggaccagttcacctcctcagca

SEQ ID NO: 926040 - DNA, 25 bp, Mus musculus
gaaggaccagttcagctcctcagca

SEQ ID NO: 926041 - DNA, 25 bp, Mus musculus
gaaggacgcgctatgaagtcttaca

SEQ ID NO: 926042 - DNA, 25 bp, Mus musculus
gaaggacgcggtatgaagtcttaca

SEQ ID NO: 926043 - DNA, 25 bp, Mus musculus
gaaggacgtgccaaccccagcacta

SEQ ID NO: 926044 - DNA, 25 bp, Mus musculus
gaaggacgtgccaagcccagcacta

SEQ ID NO: 926045 - DNA, 25 bp, Mus musculus
gaaggacttgcaaaccttgatcctt

SEQ ID NO: 926046 - DNA, 25 bp, Mus musculus
gaaggacttgcataccttgatcctt

SEQ ID NO: 926047 - DNA, 25 bp, Mus musculus
gaaggagaactgcaagctcgaggga

SEQ ID NO: 926048 - DNA, 25 bp, Mus musculus
gaaggagaactgcatgctcgaggga

SEQ ID NO: 926049 - DNA, 25 bp, Mus musculus
gaaggagaagacaggctgggacacg

SEQ ID NO: 926050 - DNA, 25 bp, Mus musculus
gaaggagaagcaacaagccaagcag

SEQ ID NO: 926051 - DNA, 25 bp, Mus musculus
gaaggagaaggaacaagccaagcag

SEQ ID NO: 926052 - DNA, 25 bp, Mus musculus
gaaggagaagtcaggctgggacacg

SEQ ID NO: 926053 - DNA, 25 bp, Mus musculus
gaaggagaccagaaggactccatga

SEQ ID NO: 926054 - DNA, 25 bp, Mus musculus
gaaggagaccagtaggactccatga

SEQ ID NO: 926055 - DNA, 25 bp, Mus musculus
gaaggagagagccaacattgacatg

SEQ ID NO: 926056 - DNA, 25 bp, Mus musculus
gaaggagagagccatcattgacatg

SEQ ID NO: 926057 - DNA, 25 bp, Mus musculus
gaaggagataagcccgatgtggaca

SEQ ID NO: 926058 - DNA, 25 bp, Mus musculus
gaaggagataaggccgatgtggaca

SEQ ID NO: 926059 - DNA, 25 bp, Mus musculus
gaaggagatgcagacgatcctgctg

SEQ ID NO: 926060 - DNA, 25 bp, Mus musculus
gaaggagatgcagaggatcctgctg

SEQ ID NO: 926061 - DNA, 25 bp, Mus musculus
gaaggagatgccaattccggtctta

SEQ ID NO: 926062 - DNA, 25 bp, Mus musculus
gaaggagatggcaattccggtctta

SEQ ID NO: 926063 - DNA, 25 bp, Mus musculus
gaaggagcactgaagcacatgctga

SEQ ID NO: 926064 - DNA, 25 bp, Mus musculus
gaaggagcactgtagcacatgctga

SEQ ID NO: 926065 - DNA, 25 bp, Mus musculus
gaaggagcagcagccgctcccgttc

SEQ ID NO: 926066 - DNA, 25 bp, Mus musculus
gaaggagcagcttggccacattcgt

SEQ ID NO: 926067 - DNA, 25 bp, Mus musculus
gaaggagcaggagccgctcccgttc

SEQ ID NO: 926068 - DNA, 25 bp, Mus musculus
gaaggagcaggttggccacattcgt

SEQ ID NO: 926069 - DNA, 25 bp, Mus musculus
gaaggagccaaacttggcaagcttc

SEQ ID NO: 926070 - DNA, 25 bp, Mus musculus
gaaggagccaaagttggcaagcttc

SEQ ID NO: 926071 - DNA, 25 bp, Mus musculus
gaaggagctgactggccaatcacaa

SEQ ID NO: 926072 - DNA, 25 bp, Mus musculus
gaaggagctgatcgaagcgttgcaa

SEQ ID NO: 926073 - DNA, 25 bp, Mus musculus
gaaggagctgccaaggcggcaactt

SEQ ID NO: 926074 - DNA, 25 bp, Mus musculus
gaaggagctggcaaggcggcaactt

SEQ ID NO: 926075 - DNA, 25 bp, Mus musculus
gaaggagctgtctggccaatcacaa

SEQ ID NO: 926076 - DNA, 25 bp, Mus musculus
gaaggagctgttcgaagcgttgcaa

SEQ ID NO: 926077 - DNA, 25 bp, Mus musculus
gaaggaggggatccccatcacagcc

SEQ ID NO: 926078 - DNA, 25 bp, Mus musculus
gaaggaggggcagctcaactaagca

SEQ ID NO: 926079 - DNA, 25 bp, Mus musculus
gaaggagggggagctcaactaagca

SEQ ID NO: 926080 - DNA, 25 bp, Mus musculus
gaaggaggggttccccatcacagcc

SEQ ID NO: 926081 - DNA, 25 bp, Mus musculus
gaaggagttagaaacaggtgagaac

SEQ ID NO: 926082 - DNA, 25 bp, Mus musculus
gaaggagttagatacaggtgagaac

SEQ ID NO: 926083 - DNA, 25 bp, Mus musculus
gaaggatactacctcattactatag

SEQ ID NO: 926084 - DNA, 25 bp, Mus musculus
gaaggatactacctgattactatag

SEQ ID NO: 926085 - DNA, 25 bp, Mus musculus
gaaggatcagcatgacgatgctgaa

SEQ ID NO: 926086 - DNA, 25 bp, Mus musculus
gaaggatcagccccttaaggatgac

SEQ ID NO: 926087 - DNA, 25 bp, Mus musculus
gaaggatcaggatgacgatgctgaa

SEQ ID NO: 926088 - DNA, 25 bp, Mus musculus
gaaggatcaggcccttaaggatgac

SEQ ID NO: 926089 - DNA, 25 bp, Mus musculus
gaaggatgagagtcctgaagtccga

SEQ ID NO: 926090 - DNA, 25 bp, Mus musculus
gaaggatgagcgcaactaccatgtg

SEQ ID NO: 926091 - DNA, 25 bp, Mus musculus
gaaggatgagcggaactaccatgtg

SEQ ID NO: 926092 - DNA, 25 bp, Mus musculus
gaaggatgagtgtcctgaagtccga

SEQ ID NO: 926093 - DNA, 25 bp, Mus musculus
gaaggatgccagcccaaaccaggtg

SEQ ID NO: 926094 - DNA, 25 bp, Mus musculus
gaaggatgccagccctccagggcca

SEQ ID NO: 926095 - DNA, 25 bp, Mus musculus
gaaggatgccaggccaaaccaggtg

SEQ ID NO: 926096 - DNA, 25 bp, Mus musculus
gaaggatgccaggcctccagggcca

SEQ ID NO: 926097 - DNA, 25 bp, Mus musculus
gaaggatgctgtcgatccttagcaa

SEQ ID NO: 926098 - DNA, 25 bp, Mus musculus
gaaggatgctgtggatccttagcaa

SEQ ID NO: 926099 - DNA, 25 bp, Mus musculus
gaaggcaaagaatcctgtagagcca

SEQ ID NO: 926100 - DNA, 25 bp, Mus musculus
gaaggcaaagtatcctgtagagcca

SEQ ID NO: 926101 - DNA, 25 bp, Mus musculus
gaaggcaacatccctgtgggcaaat

SEQ ID NO: 926102 - DNA, 25 bp, Mus musculus
gaaggcaacatccgatggcacttcc

SEQ ID NO: 926103 - DNA, 25 bp, Mus musculus
gaaggcaacatcgctgtgggcaaat

SEQ ID NO: 926104 - DNA, 25 bp, Mus musculus
gaaggcaacatcggatggcacttcc

SEQ ID NO: 926105 - DNA, 25 bp, Mus musculus
gaaggcaatcagcacgtaaagtata

SEQ ID NO: 926106 - DNA, 25 bp, Mus musculus
gaaggcaatcaggacgtaaagtata

SEQ ID NO: 926107 - DNA, 25 bp, Mus musculus
gaaggcacagatggacagatggatg

SEQ ID NO: 926108 - DNA, 25 bp, Mus musculus
gaaggcacagctgaaggagacaaac

SEQ ID NO: 926109 - DNA, 25 bp, Mus musculus
gaaggcacaggtgaaggagacaaac

SEQ ID NO: 926110 - DNA, 25 bp, Mus musculus
gaaggcacagttggacagatggatg

SEQ ID NO: 926111 - DNA, 25 bp, Mus musculus
gaaggcacctcactttgtgttctac

SEQ ID NO: 926112 - DNA, 25 bp, Mus musculus
gaaggcacctgactttgtgttctac

SEQ ID NO: 926113 - DNA, 25 bp, Mus musculus
gaaggcactgtgagcttctttaact

SEQ ID NO: 926114 - DNA, 25 bp, Mus musculus
gaaggcactgtgaggttctttaact

SEQ ID NO: 926115 - DNA, 25 bp, Mus musculus
gaaggcagccgacgctgaagctgag

SEQ ID NO: 926116 - DNA, 25 bp, Mus musculus
gaaggcagccgaggctgaagctgag

SEQ ID NO: 926117 - DNA, 25 bp, Mus musculus
gaaggcagcgtagacctttatgcag

SEQ ID NO: 926118 - DNA, 25 bp, Mus musculus
gaaggcagcgtagagctttatgcag

SEQ ID NO: 926119 - DNA, 25 bp, Mus musculus
gaaggcagtgtgaacacattgacga

SEQ ID NO: 926120 - DNA, 25 bp, Mus musculus
gaaggcagtgtgaagacattgacga

SEQ ID NO: 926121 - DNA, 25 bp, Mus musculus
gaaggccatcttcactgcctcaatt

SEQ ID NO: 926122 - DNA, 25 bp, Mus musculus
gaaggccatcttcagtgcctcaatt

SEQ ID NO: 926123 - DNA, 25 bp, Mus musculus
gaaggccattgacgtgctgtctgat

SEQ ID NO: 926124 - DNA, 25 bp, Mus musculus
gaaggccattgaggtgctgtctgat

SEQ ID NO: 926125 - DNA, 25 bp, Mus musculus
gaaggcccagccggatatctacaag

SEQ ID NO: 926126 - DNA, 25 bp, Mus musculus
gaaggcccagctcctgccccctctg

SEQ ID NO: 926127 - DNA, 25 bp, Mus musculus
gaaggcccaggcggatatctacaag

SEQ ID NO: 926128 - DNA, 25 bp, Mus musculus
gaaggcccaggtcctgccccctctg

SEQ ID NO: 926129 - DNA, 25 bp, Mus musculus
gaaggccccgcgccgccttctgctc

SEQ ID NO: 926130 - DNA, 25 bp, Mus musculus
gaaggccccgggccgccttctgctc

SEQ ID NO: 926131 - DNA, 25 bp, Mus musculus
gaaggccgggaactgactcgtgttc

SEQ ID NO: 926132 - DNA, 25 bp, Mus musculus
gaaggccgggaagtgactcgtgttc

SEQ ID NO: 926133 - DNA, 25 bp, Mus musculus
gaaggcctggatctgcataagcagc

SEQ ID NO: 926134 - DNA, 25 bp, Mus musculus
gaaggcctggttctgcataagcagc

SEQ ID NO: 926135 - DNA, 25 bp, Mus musculus
gaaggcctttctgaccaactggtgt

SEQ ID NO: 926136 - DNA, 25 bp, Mus musculus
gaaggcctttctgagcaactggtgt

SEQ ID NO: 926137 - DNA, 25 bp, Mus musculus
gaaggcgaagatttgcagtcctgct

SEQ ID NO: 926138 - DNA, 25 bp, Mus musculus
gaaggcgaagttttgcagtcctgct

SEQ ID NO: 926139 - DNA, 25 bp, Mus musculus
gaaggcgagttacacgagggaatct

SEQ ID NO: 926140 - DNA, 25 bp, Mus musculus
gaaggcgagttacaggagggaatct

SEQ ID NO: 926141 - DNA, 25 bp, Mus musculus
gaaggcgataaccgcgtctggtaca

SEQ ID NO: 926142 - DNA, 25 bp, Mus musculus
gaaggcgataaccgggtctggtaca

SEQ ID NO: 926143 - DNA, 25 bp, Mus musculus
gaaggcgtgcgggtctgaacaacgt

SEQ ID NO: 926144 - DNA, 25 bp, Mus musculus
gaaggcgtgcgggtgtgaacaacgt

SEQ ID NO: 926145 - DNA, 25 bp, Mus musculus
gaaggcgtggcaacatacgcagctg

SEQ ID NO: 926146 - DNA, 25 bp, Mus musculus
gaaggcgtgggaacatacgcagctg

SEQ ID NO: 926147 - DNA, 25 bp, Mus musculus
gaaggctacaagatggtaatcttca

SEQ ID NO: 926148 - DNA, 25 bp, Mus musculus
gaaggctacaagttggtaatcttca

SEQ ID NO: 926149 - DNA, 25 bp, Mus musculus
gaaggctaccagaacaatgaagagt

SEQ ID NO: 926150 - DNA, 25 bp, Mus musculus
gaaggctaccagaagaatgaagagt

SEQ ID NO: 926151 - DNA, 25 bp, Mus musculus
gaaggctataaaaacaagtaccagc

SEQ ID NO: 926152 - DNA, 25 bp, Mus musculus
gaaggctataaaaagaagtaccagc

SEQ ID NO: 926153 - DNA, 25 bp, Mus musculus
gaaggctcagaccagccaactctaa

SEQ ID NO: 926154 - DNA, 25 bp, Mus musculus
gaaggctcagagccatggagaaggg

SEQ ID NO: 926155 - DNA, 25 bp, Mus musculus
gaaggctcagagctgtatgccatgc

SEQ ID NO: 926156 - DNA, 25 bp, Mus musculus
gaaggctcagtccagccaactctaa

SEQ ID NO: 926157 - DNA, 25 bp, Mus musculus
gaaggctcagtgccatggagaaggg

SEQ ID NO: 926158 - DNA, 25 bp, Mus musculus
gaaggctcagtgctgtatgccatgc

SEQ ID NO: 926159 - DNA, 25 bp, Mus musculus
gaaggctcatcacgtgaaaaatcac

SEQ ID NO: 926160 - DNA, 25 bp, Mus musculus
gaaggctcatcaggtgaaaaatcac

SEQ ID NO: 926161 - DNA, 25 bp, Mus musculus
gaaggctctggacatggcaggttca

SEQ ID NO: 926162 - DNA, 25 bp, Mus musculus
gaaggctctggagatggcaggttca

SEQ ID NO: 926163 - DNA, 25 bp, Mus musculus
gaaggctggctgcctttgcggggcc

SEQ ID NO: 926164 - DNA, 25 bp, Mus musculus
gaaggctggctggctttgcggggcc

SEQ ID NO: 926165 - DNA, 25 bp, Mus musculus
gaaggctgtaagcgcttctttcggc

SEQ ID NO: 926166 - DNA, 25 bp, Mus musculus
gaaggctgtaagggcttctttcggc

SEQ ID NO: 926167 - DNA, 25 bp, Mus musculus
gaaggctgtttaaggatgaccagga

SEQ ID NO: 926168 - DNA, 25 bp, Mus musculus
gaaggctgtttatggatgaccagga

SEQ ID NO: 926169 - DNA, 25 bp, Mus musculus
gaaggcttcagtcgccctaattgcc

SEQ ID NO: 926170 - DNA, 25 bp, Mus musculus
gaaggcttcagtggccctaattgcc

SEQ ID NO: 926171 - DNA, 25 bp, Mus musculus
gaaggcttcttatgcgtaccatcgg

SEQ ID NO: 926172 - DNA, 25 bp, Mus musculus
gaaggcttcttatgggtaccatcgg

SEQ ID NO: 926173 - DNA, 25 bp, Mus musculus
gaaggctttccacccatggccatgc

SEQ ID NO: 926174 - DNA, 25 bp, Mus musculus
gaaggctttccacctccagcacctg

SEQ ID NO: 926175 - DNA, 25 bp, Mus musculus
gaaggctttccagccatggccatgc

SEQ ID NO: 926176 - DNA, 25 bp, Mus musculus
gaaggctttccagctccagcacctg

SEQ ID NO: 926177 - DNA, 25 bp, Mus musculus
gaagggaagattcgcatccctaccg

SEQ ID NO: 926178 - DNA, 25 bp, Mus musculus
gaagggaagattcggatccctaccg

SEQ ID NO: 926179 - DNA, 25 bp, Mus musculus
gaagggaagtctcacgtgtcggtga

SEQ ID NO: 926180 - DNA, 25 bp, Mus musculus
gaagggaagtctcaggtgtcggtga

SEQ ID NO: 926181 - DNA, 25 bp, Mus musculus
gaagggacaactccttcggcccaca

SEQ ID NO: 926182 - DNA, 25 bp, Mus musculus
gaagggacaactgcttcggcccaca

SEQ ID NO: 926183 - DNA, 25 bp, Mus musculus
gaagggaccagcaacgtctggcgtg

SEQ ID NO: 926184 - DNA, 25 bp, Mus musculus
gaagggaccagcaaggtctggcgtg

SEQ ID NO: 926185 - DNA, 25 bp, Mus musculus
gaagggacggagtcagtgtgctggt

SEQ ID NO: 926186 - DNA, 25 bp, Mus musculus
gaagggacggtgtcagtgtgctggt

SEQ ID NO: 926187 - DNA, 25 bp, Mus musculus
gaagggactgacaactcttgtctct

SEQ ID NO: 926188 - DNA, 25 bp, Mus musculus
gaagggactgcacccatacaatatg

SEQ ID NO: 926189 - DNA, 25 bp, Mus musculus
gaagggactggacccatacaatatg

SEQ ID NO: 926190 - DNA, 25 bp, Mus musculus
gaagggactgtcaactcttgtctct

SEQ ID NO: 926191 - DNA, 25 bp, Mus musculus
gaagggagaaaacggtgactgtgag

SEQ ID NO: 926192 - DNA, 25 bp, Mus musculus
gaagggagaaaagggtgactgtgag

SEQ ID NO: 926193 - DNA, 25 bp, Mus musculus
gaagggagaactttggagctgtctt

SEQ ID NO: 926194 - DNA, 25 bp, Mus musculus
gaagggagaagtttggagctgtctt

SEQ ID NO: 926195 - DNA, 25 bp, Mus musculus
gaagggatggagacggtccagcctt

SEQ ID NO: 926196 - DNA, 25 bp, Mus musculus
gaagggatggagtcggtccagcctt

SEQ ID NO: 926197 - DNA, 25 bp, Mus musculus
gaagggcataggcagccacctagat

SEQ ID NO: 926198 - DNA, 25 bp, Mus musculus
gaagggcatagggagccacctagat

SEQ ID NO: 926199 - DNA, 25 bp, Mus musculus
gaagggctaatgaccacagtccatt

SEQ ID NO: 926200 - DNA, 25 bp, Mus musculus
gaagggctaatgtccacagtccatt

SEQ ID NO: 926201 - DNA, 25 bp, Mus musculus
gaaggggccccccctctctgtgaca

SEQ ID NO: 926202 - DNA, 25 bp, Mus musculus
gaaggggcccccgctctctgtgaca

SEQ ID NO: 926203 - DNA, 25 bp, Mus musculus
gaaggggctgaactatatccatgcg

SEQ ID NO: 926204 - DNA, 25 bp, Mus musculus
gaaggggctgaagtatatccatgcg

SEQ ID NO: 926205 - DNA, 25 bp, Mus musculus
gaagggggagattgagcaggagcgg

SEQ ID NO: 926206 - DNA, 25 bp, Mus musculus
gaagggggagtttgagcaggagcgg

SEQ ID NO: 926207 - DNA, 25 bp, Mus musculus
gaagggggtgagctgggcctgcgct

SEQ ID NO: 926208 - DNA, 25 bp, Mus musculus
gaagggggtgaggtgggcctgcgct

SEQ ID NO: 926209 - DNA, 25 bp, Mus musculus
gaagggttagcatgatgctgttgaa

SEQ ID NO: 926210 - DNA, 25 bp, Mus musculus
gaagggttaggatgatgctgttgaa

SEQ ID NO: 926211 - DNA, 25 bp, Mus musculus
gaagggttatagcacgttgaagata

SEQ ID NO: 926212 - DNA, 25 bp, Mus musculus
gaagggttatagcatgatgacctgc

SEQ ID NO: 926213 - DNA, 25 bp, Mus musculus
gaagggttataggatgatgacctgc

SEQ ID NO: 926214 - DNA, 25 bp, Mus musculus
gaagggttattgcacgttgaagata

SEQ ID NO: 926215 - DNA, 25 bp, Mus musculus
gaagggtttgagagaatcgcacgtc

SEQ ID NO: 926216 - DNA, 25 bp, Mus musculus
gaagggtttgagtgaatcgcacgtc

SEQ ID NO: 926217 - DNA, 25 bp, Mus musculus
gaaggtcaagaagtttgagcaaggc

SEQ ID NO: 926218 - DNA, 25 bp, Mus musculus
gaaggtcaagtagtttgagcaaggc

SEQ ID NO: 926219 - DNA, 25 bp, Mus musculus
gaaggtcacaagaactaaaagaagt

SEQ ID NO: 926220 - DNA, 25 bp, Mus musculus
gaaggtcacaagtactaaaagaagt

SEQ ID NO: 926221 - DNA, 25 bp, Mus musculus
gaaggtcataagttcgcatatgtct

SEQ ID NO: 926222 - DNA, 25 bp, Mus musculus
gaaggtcataagttggcatatgtct

SEQ ID NO: 926223 - DNA, 25 bp, Mus musculus
gaaggtcatgagatcagcccttgag

SEQ ID NO: 926224 - DNA, 25 bp, Mus musculus
gaaggtcatgtgatcagcccttgag

SEQ ID NO: 926225 - DNA, 25 bp, Mus musculus
gaaggtccagagaaggcaagctgga

SEQ ID NO: 926226 - DNA, 25 bp, Mus musculus
gaaggtccagcacctcagacaagat

SEQ ID NO: 926227 - DNA, 25 bp, Mus musculus
gaaggtccagctatccttgaccctt

SEQ ID NO: 926228 - DNA, 25 bp, Mus musculus
gaaggtccaggacctcagacaagat

SEQ ID NO: 926229 - DNA, 25 bp, Mus musculus
gaaggtccaggtatccttgaccctt

SEQ ID NO: 926230 - DNA, 25 bp, Mus musculus
gaaggtccagtgaaggcaagctgga

SEQ ID NO: 926231 - DNA, 25 bp, Mus musculus
gaaggtcccgcagcatgcaaaacaa

SEQ ID NO: 926232 - DNA, 25 bp, Mus musculus
gaaggtcccgcattgaaaagatgaa

SEQ ID NO: 926233 - DNA, 25 bp, Mus musculus
gaaggtcccggagcatgcaaaacaa

SEQ ID NO: 926234 - DNA, 25 bp, Mus musculus
gaaggtcccggattgaaaagatgaa

SEQ ID NO: 926235 - DNA, 25 bp, Mus musculus
gaaggtcgatgtcggcccagaccct

SEQ ID NO: 926236 - DNA, 25 bp, Mus musculus
gaaggtcgatgtgggcccagaccct

SEQ ID NO: 926237 - DNA, 25 bp, Mus musculus
gaaggtctccagaacgtagtgtctc

SEQ ID NO: 926238 - DNA, 25 bp, Mus musculus
gaaggtctccagaaggtagtgtctc

SEQ ID NO: 926239 - DNA, 25 bp, Mus musculus
gaaggtctggaaatcgcgtgatgag

SEQ ID NO: 926240 - DNA, 25 bp, Mus musculus
gaaggtctggaaatggcgtgatgag

SEQ ID NO: 926241 - DNA, 25 bp, Mus musculus
gaaggtctggagaacattgggactt

SEQ ID NO: 926242 - DNA, 25 bp, Mus musculus
gaaggtctggagaagattgggactt

SEQ ID NO: 926243 - DNA, 25 bp, Mus musculus
gaaggtcttgccaacatgtgaacga

SEQ ID NO: 926244 - DNA, 25 bp, Mus musculus
gaaggtcttgccaagatgtgaacga

SEQ ID NO: 926245 - DNA, 25 bp, Mus musculus
gaaggtcttgctagtacctgtggtg

SEQ ID NO: 926246 - DNA, 25 bp, Mus musculus
gaaggtcttgcttgtacctgtggtg

SEQ ID NO: 926247 - DNA, 25 bp, Mus musculus
gaaggtgaagaagcttggacaggtg

SEQ ID NO: 926248 - DNA, 25 bp, Mus musculus
gaaggtgaagtagcttggacaggtg

SEQ ID NO: 926249 - DNA, 25 bp, Mus musculus
gaaggtgacgctgaggaggaggatg

SEQ ID NO: 926250 - DNA, 25 bp, Mus musculus
gaaggtgacggtgaggaggaggatg

SEQ ID NO: 926251 - DNA, 25 bp, Mus musculus
gaaggtgatgtccgcgtagccaagg

SEQ ID NO: 926252 - DNA, 25 bp, Mus musculus
gaaggtgatgtccgggtagccaagg

SEQ ID NO: 926253 - DNA, 25 bp, Mus musculus
gaaggtgcagatctttgagatgatg

SEQ ID NO: 926254 - DNA, 25 bp, Mus musculus
gaaggtgcagttctttgagatgatg

SEQ ID NO: 926255 - DNA, 25 bp, Mus musculus
gaaggtgtacaatgaaaatcttgtt

SEQ ID NO: 926256 - DNA, 25 bp, Mus musculus
gaaggtgtacaatgagaaacatatt

SEQ ID NO: 926257 - DNA, 25 bp, Mus musculus
gaaggtgtacaatgtaaatcttgtt

SEQ ID NO: 926258 - DNA, 25 bp, Mus musculus
gaaggtgtacaatgtgaaacatatt

SEQ ID NO: 926259 - DNA, 25 bp, Mus musculus
gaaggtgtgcaacgaggggtggctg

SEQ ID NO: 926260 - DNA, 25 bp, Mus musculus
gaaggtgtgcaaggaggggtggctg

SEQ ID NO: 926261 - DNA, 25 bp, Mus musculus
gaaggtgttcaaagtcaccagggac

SEQ ID NO: 926262 - DNA, 25 bp, Mus musculus
gaaggtgttcaatgtcaccagggac

SEQ ID NO: 926263 - DNA, 25 bp, Mus musculus
gaaggttcagcgagccccatgcccg

SEQ ID NO: 926264 - DNA, 25 bp, Mus musculus
gaaggttcagggagccccatgcccg

SEQ ID NO: 926265 - DNA, 25 bp, Mus musculus
gaaggttctccccctaaagagctaa

SEQ ID NO: 926266 - DNA, 25 bp, Mus musculus
gaaggttctcgccctaaagagctaa

SEQ ID NO: 926267 - DNA, 25 bp, Mus musculus
gaaggttgacatctcgtcctttggg

SEQ ID NO: 926268 - DNA, 25 bp, Mus musculus
gaaggttgacatctggtcctttggg

SEQ ID NO: 926269 - DNA, 25 bp, Mus musculus
gaaggttgctcaatcatgtgaggaa

SEQ ID NO: 926270 - DNA, 25 bp, Mus musculus
gaaggttgctcattcatgtgaggaa

SEQ ID NO: 926271 - DNA, 25 bp, Mus musculus
gaaggttgtagacgtagagctgagt

SEQ ID NO: 926272 - DNA, 25 bp, Mus musculus
gaaggttgtagaggtagagctgagt

SEQ ID NO: 926273 - DNA, 25 bp, Mus musculus
gaagtaaagcaacagcaccagaagt

SEQ ID NO: 926274 - DNA, 25 bp, Mus musculus
gaagtaaagcaacgctgtggctctg

SEQ ID NO: 926275 - DNA, 25 bp, Mus musculus
gaagtaaagcaagagcaccagaagt

SEQ ID NO: 926276 - DNA, 25 bp, Mus musculus
gaagtaaagcaaggctgtggctctg

SEQ ID NO: 926277 - DNA, 25 bp, Mus musculus
gaagtaccaagacgcatgcgagaat

SEQ ID NO: 926278 - DNA, 25 bp, Mus musculus
gaagtaccaagaggcatgcgagaat

SEQ ID NO: 926279 - DNA, 25 bp, Mus musculus
gaagtacctgaacgtgctggccaaa

SEQ ID NO: 926280 - DNA, 25 bp, Mus musculus
gaagtacctgtacgtgctggccaaa

SEQ ID NO: 926281 - DNA, 25 bp, Mus musculus
gaagtacttggacgacagcaagatc

SEQ ID NO: 926282 - DNA, 25 bp, Mus musculus
gaagtacttggaggacagcaagatc

SEQ ID NO: 926283 - DNA, 25 bp, Mus musculus
gaagtagagccaccaagtccacatg

SEQ ID NO: 926284 - DNA, 25 bp, Mus musculus
gaagtagagccacgcttgccatctc

SEQ ID NO: 926285 - DNA, 25 bp, Mus musculus
gaagtagagccagcaagtccacatg

SEQ ID NO: 926286 - DNA, 25 bp, Mus musculus
gaagtagagccaggcttgccatctc

SEQ ID NO: 926287 - DNA, 25 bp, Mus musculus
gaagtagcaacaagctacctaaaaa

SEQ ID NO: 926288 - DNA, 25 bp, Mus musculus
gaagtagcaacatgctacctaaaaa

SEQ ID NO: 926289 - DNA, 25 bp, Mus musculus
gaagtataagacacagattgaccac

SEQ ID NO: 926290 - DNA, 25 bp, Mus musculus
gaagtataagtcacagattgaccac

SEQ ID NO: 926291 - DNA, 25 bp, Mus musculus
gaagtatcatctaccggagctttct

SEQ ID NO: 926292 - DNA, 25 bp, Mus musculus
gaagtatcatgtaccggagctttct

SEQ ID NO: 926293 - DNA, 25 bp, Mus musculus
gaagtatccatcatcagaagtactc

SEQ ID NO: 926294 - DNA, 25 bp, Mus musculus
gaagtatccatcatctgtatctcag

SEQ ID NO: 926295 - DNA, 25 bp, Mus musculus
gaagtatccatcttcagaagtactc

SEQ ID NO: 926296 - DNA, 25 bp, Mus musculus
gaagtatccatcttctgtatctcag

SEQ ID NO: 926297 - DNA, 25 bp, Mus musculus
gaagtatcggaaccttgtgtcggca

SEQ ID NO: 926298 - DNA, 25 bp, Mus musculus
gaagtatcggaagcttgtgtcggca

SEQ ID NO: 926299 - DNA, 25 bp, Mus musculus
gaagtatgaagacgtggcccgtaag

SEQ ID NO: 926300 - DNA, 25 bp, Mus musculus
gaagtatgaagacgtggctcgtaag

SEQ ID NO: 926301 - DNA, 25 bp, Mus musculus
gaagtatgaagaggtggcccgtaag

SEQ ID NO: 926302 - DNA, 25 bp, Mus musculus
gaagtatgaagaggtggctcgtaag

SEQ ID NO: 926303 - DNA, 25 bp, Mus musculus
gaagtatgagaacgatattgctgcc

SEQ ID NO: 926304 - DNA, 25 bp, Mus musculus
gaagtatgagaacgatgttgctgac

SEQ ID NO: 926305 - DNA, 25 bp, Mus musculus
gaagtatgagaaggatattgctgcc

SEQ ID NO: 926306 - DNA, 25 bp, Mus musculus
gaagtatgagaaggatgttgctgac

SEQ ID NO: 926307 - DNA, 25 bp, Mus musculus
gaagtatggaaacgacccaacagta

SEQ ID NO: 926308 - DNA, 25 bp, Mus musculus
gaagtatggaaaggacccaacagta

SEQ ID NO: 926309 - DNA, 25 bp, Mus musculus
gaagtatggatgcgtacctggaatg

SEQ ID NO: 926310 - DNA, 25 bp, Mus musculus
gaagtatggatgggtacctggaatg

SEQ ID NO: 926311 - DNA, 25 bp, Mus musculus
gaagtatttctgccctcggattaca

SEQ ID NO: 926312 - DNA, 25 bp, Mus musculus
gaagtatttctggcctcggattaca

SEQ ID NO: 926313 - DNA, 25 bp, Mus musculus
gaagtcaaagggcaaggatgtgaac

SEQ ID NO: 926314 - DNA, 25 bp, Mus musculus
gaagtcaaaggggaaggatgtgaac

SEQ ID NO: 926315 - DNA, 25 bp, Mus musculus
gaagtcaacatcaacacagctgagg

SEQ ID NO: 926316 - DNA, 25 bp, Mus musculus
gaagtcaacatcaagacagctgagg

SEQ ID NO: 926317 - DNA, 25 bp, Mus musculus
gaagtcaagagcaacaagaagcaga

SEQ ID NO: 926318 - DNA, 25 bp, Mus musculus
gaagtcaagagcaactttggcgccg

SEQ ID NO: 926319 - DNA, 25 bp, Mus musculus
gaagtcaagagcaagaagaagcaga

SEQ ID NO: 926320 - DNA, 25 bp, Mus musculus
gaagtcaagagcaagtttggcgccg

SEQ ID NO: 926321 - DNA, 25 bp, Mus musculus
gaagtcacagaaaccccgagactcc

SEQ ID NO: 926322 - DNA, 25 bp, Mus musculus
gaagtcacagtaaccccgagactcc

SEQ ID NO: 926323 - DNA, 25 bp, Mus musculus
gaagtcacccaacatgctaatcaca

SEQ ID NO: 926324 - DNA, 25 bp, Mus musculus
gaagtcacccaagatgctaatcaca

SEQ ID NO: 926325 - DNA, 25 bp, Mus musculus
gaagtcaggctcacactctgctcct

SEQ ID NO: 926326 - DNA, 25 bp, Mus musculus
gaagtcaggctcactctctgctcct

SEQ ID NO: 926327 - DNA, 25 bp, Mus musculus
gaagtcatgaagccctgctctggaa

SEQ ID NO: 926328 - DNA, 25 bp, Mus musculus
gaagtcatgaaggcctgctctggaa

SEQ ID NO: 926329 - DNA, 25 bp, Mus musculus
gaagtcattcagatctttaaagaag

SEQ ID NO: 926330 - DNA, 25 bp, Mus musculus
gaagtcattcagatgtttaaagaag

SEQ ID NO: 926331 - DNA, 25 bp, Mus musculus
gaagtccaagctggaggcattccat

SEQ ID NO: 926332 - DNA, 25 bp, Mus musculus
gaagtccaaggtggaggcattccat

SEQ ID NO: 926333 - DNA, 25 bp, Mus musculus
gaagtccacaccggcacaaccatca

SEQ ID NO: 926334 - DNA, 25 bp, Mus musculus
gaagtccacaccgggacaaccatca

SEQ ID NO: 926335 - DNA, 25 bp, Mus musculus
gaagtccagagcaacgttgctcttc

SEQ ID NO: 926336 - DNA, 25 bp, Mus musculus
gaagtccagagcaaggttgctcttc

SEQ ID NO: 926337 - DNA, 25 bp, Mus musculus
gaagtcccagaggccagtgaagaga

SEQ ID NO: 926338 - DNA, 25 bp, Mus musculus
gaagtcccagtggccagtgaagaga

SEQ ID NO: 926339 - DNA, 25 bp, Mus musculus
gaagtcccgacctgaagaggttgca

SEQ ID NO: 926340 - DNA, 25 bp, Mus musculus
gaagtcccgagctgaagaggttgca

SEQ ID NO: 926341 - DNA, 25 bp, Mus musculus
gaagtcccgaggatgagccccacat

SEQ ID NO: 926342 - DNA, 25 bp, Mus musculus
gaagtcccgaggccaaccgcgtagc

SEQ ID NO: 926343 - DNA, 25 bp, Mus musculus
gaagtcccgagggcaaccgcgtagc

SEQ ID NO: 926344 - DNA, 25 bp, Mus musculus
gaagtcccgaggttgagccccacat

SEQ ID NO: 926345 - DNA, 25 bp, Mus musculus
gaagtccgtgttaacattttggcca

SEQ ID NO: 926346 - DNA, 25 bp, Mus musculus
gaagtccgtgttaagattttggcca

SEQ ID NO: 926347 - DNA, 25 bp, Mus musculus
gaagtcctggcacacagaacctgtg

SEQ ID NO: 926348 - DNA, 25 bp, Mus musculus
gaagtcctggcacacgtacaaagtg

SEQ ID NO: 926349 - DNA, 25 bp, Mus musculus
gaagtcctggcacagagaacctgtg

SEQ ID NO: 926350 - DNA, 25 bp, Mus musculus
gaagtcctggcacaggtacaaagtg

SEQ ID NO: 926351 - DNA, 25 bp, Mus musculus
gaagtccttaagctgcagacccacc

SEQ ID NO: 926352 - DNA, 25 bp, Mus musculus
gaagtccttaaggtgcagacccacc

SEQ ID NO: 926353 - DNA, 25 bp, Mus musculus
gaagtccttatggactctctgacac

SEQ ID NO: 926354 - DNA, 25 bp, Mus musculus
gaagtccttatggagtctctgacac

SEQ ID NO: 926355 - DNA, 25 bp, Mus musculus
gaagtcgcgcagcacgatggctgac

SEQ ID NO: 926356 - DNA, 25 bp, Mus musculus
gaagtcgcgcagcaggatggctgac

SEQ ID NO: 926357 - DNA, 25 bp, Mus musculus
gaagtcggctgacattaacagcagc

SEQ ID NO: 926358 - DNA, 25 bp, Mus musculus
gaagtcggctgagattaacagcagc

SEQ ID NO: 926359 - DNA, 25 bp, Mus musculus
gaagtctattataaactgatttcat

SEQ ID NO: 926360 - DNA, 25 bp, Mus musculus
gaagtctattataatctgatttcat

SEQ ID NO: 926361 - DNA, 25 bp, Mus musculus
gaagtctcagctgtcggtgacgttt

SEQ ID NO: 926362 - DNA, 25 bp, Mus musculus
gaagtctcaggtgtcggtgacgttt

SEQ ID NO: 926363 - DNA, 25 bp, Mus musculus
gaagtctcctcccactgccctgggg

SEQ ID NO: 926364 - DNA, 25 bp, Mus musculus
gaagtctcctcccagtgccctgggg

SEQ ID NO: 926365 - DNA, 25 bp, Mus musculus
gaagtctcttcctcagacgataagg

SEQ ID NO: 926366 - DNA, 25 bp, Mus musculus
gaagtctcttcctctgacgataagg

SEQ ID NO: 926367 - DNA, 25 bp, Mus musculus
gaagtctgcagcatcagggcgtctc

SEQ ID NO: 926368 - DNA, 25 bp, Mus musculus
gaagtctgcagcatgagggcgtctc

SEQ ID NO: 926369 - DNA, 25 bp, Mus musculus
gaagtctgccagatctctggctccc

SEQ ID NO: 926370 - DNA, 25 bp, Mus musculus
gaagtctgccagcaacagcaggcag

SEQ ID NO: 926371 - DNA, 25 bp, Mus musculus
gaagtctgccaggaacagcaggcag

SEQ ID NO: 926372 - DNA, 25 bp, Mus musculus
gaagtctgccagttctctggctccc

SEQ ID NO: 926373 - DNA, 25 bp, Mus musculus
gaagtctgctctggcggaggcggct

SEQ ID NO: 926374 - DNA, 25 bp, Mus musculus
gaagtctgctctgggggaggcggct

SEQ ID NO: 926375 - DNA, 25 bp, Mus musculus
gaagtctgtgattcgtaagacagaa

SEQ ID NO: 926376 - DNA, 25 bp, Mus musculus
gaagtctgtgtttcgtaagacagaa

SEQ ID NO: 926377 - DNA, 25 bp, Mus musculus
gaagtcttcgtgcgacctcgcaagc

SEQ ID NO: 926378 - DNA, 25 bp, Mus musculus
gaagtcttcgtgggacctcgcaagc

SEQ ID NO: 926379 - DNA, 25 bp, Mus musculus
gaagtgaaagcagatttctaatagc

SEQ ID NO: 926380 - DNA, 25 bp, Mus musculus
gaagtgaaagctgctcctgacatca

SEQ ID NO: 926381 - DNA, 25 bp, Mus musculus
gaagtgaaaggagatttctaatagc

SEQ ID NO: 926382 - DNA, 25 bp, Mus musculus
gaagtgaaaggtgctcctgacatca

SEQ ID NO: 926383 - DNA, 25 bp, Mus musculus
gaagtgaaatcgccttgctatcttc

SEQ ID NO: 926384 - DNA, 25 bp, Mus musculus
gaagtgaaatcggcttgctatcttc

SEQ ID NO: 926385 - DNA, 25 bp, Mus musculus
gaagtgaagacgcttactgtcaaag

SEQ ID NO: 926386 - DNA, 25 bp, Mus musculus
gaagtgaagacggttactgtcaaag

SEQ ID NO: 926387 - DNA, 25 bp, Mus musculus
gaagtgacagaatgaatcgcaccgc

SEQ ID NO: 926388 - DNA, 25 bp, Mus musculus
gaagtgacagtatgaatcgcaccgc

SEQ ID NO: 926389 - DNA, 25 bp, Mus musculus
gaagtgagggccttgcagatgggtc

SEQ ID NO: 926390 - DNA, 25 bp, Mus musculus
gaagtgaggggcttgcagatgggtc

SEQ ID NO: 926391 - DNA, 25 bp, Mus musculus
gaagtgattactcgaaccctgtgga

SEQ ID NO: 926392 - DNA, 25 bp, Mus musculus
gaagtgattactggaaccctgtgga

SEQ ID NO: 926393 - DNA, 25 bp, Mus musculus
gaagtgcaatatcgatcaggctggg

SEQ ID NO: 926394 - DNA, 25 bp, Mus musculus
gaagtgcaatatggatcaggctggg

SEQ ID NO: 926395 - DNA, 25 bp, Mus musculus
gaagtgcacccgcagcgtgcttccg

SEQ ID NO: 926396 - DNA, 25 bp, Mus musculus
gaagtgcacccgcgtgcttccggct

SEQ ID NO: 926397 - DNA, 25 bp, Mus musculus
gaagtgcacccggagcgtgcttccg

SEQ ID NO: 926398 - DNA, 25 bp, Mus musculus
gaagtgcacccgggtgcttccggct

SEQ ID NO: 926399 - DNA, 25 bp, Mus musculus
gaagtgcagtataaaccgcaagtgc

SEQ ID NO: 926400 - DNA, 25 bp, Mus musculus
gaagtgcagtttaaaccgcaagtgc

SEQ ID NO: 926401 - DNA, 25 bp, Mus musculus
gaagtgcattgacaaagaagtcaac

SEQ ID NO: 926402 - DNA, 25 bp, Mus musculus
gaagtgcattgacagctgtctgtct

SEQ ID NO: 926403 - DNA, 25 bp, Mus musculus
gaagtgcattgagaaagaagtcaac

SEQ ID NO: 926404 - DNA, 25 bp, Mus musculus
gaagtgcattgagagctgtctgtct

SEQ ID NO: 926405 - DNA, 25 bp, Mus musculus
gaagtgccactgaatggaactctga

SEQ ID NO: 926406 - DNA, 25 bp, Mus musculus
gaagtgccactgtatggaactctga

SEQ ID NO: 926407 - DNA, 25 bp, Mus musculus
gaagtgcctcccacgtcagaaccgt

SEQ ID NO: 926408 - DNA, 25 bp, Mus musculus
gaagtgcctccctcgtcagaaccgt

SEQ ID NO: 926409 - DNA, 25 bp, Mus musculus
gaagtgcctgacagaggagggcgcg

SEQ ID NO: 926410 - DNA, 25 bp, Mus musculus
gaagtgcctgcacggtccagtgcct

SEQ ID NO: 926411 - DNA, 25 bp, Mus musculus
gaagtgcctgcagggtccagtgcct

SEQ ID NO: 926412 - DNA, 25 bp, Mus musculus
gaagtgcctgctcttgctcccagcg

SEQ ID NO: 926413 - DNA, 25 bp, Mus musculus
gaagtgcctggtcttgctcccagcg

SEQ ID NO: 926414 - DNA, 25 bp, Mus musculus
gaagtgcctgtcagaggagggcgcg

SEQ ID NO: 926415 - DNA, 25 bp, Mus musculus
gaagtgcgttatcacagtgaagcca

SEQ ID NO: 926416 - DNA, 25 bp, Mus musculus
gaagtgcgttatcagagtgaagcca

SEQ ID NO: 926417 - DNA, 25 bp, Mus musculus
gaagtgctagaaactcttgaaaatc

SEQ ID NO: 926418 - DNA, 25 bp, Mus musculus
gaagtgctagaatctcttgaaaatc

SEQ ID NO: 926419 - DNA, 25 bp, Mus musculus
gaagtgctgaagccagggaagcggc

SEQ ID NO: 926420 - DNA, 25 bp, Mus musculus
gaagtgctgaaggcagggaagcggc

SEQ ID NO: 926421 - DNA, 25 bp, Mus musculus
gaagtgctgcagcaaaagccaaatt

SEQ ID NO: 926422 - DNA, 25 bp, Mus musculus
gaagtgctgcaggaaaagccaaatt

SEQ ID NO: 926423 - DNA, 25 bp, Mus musculus
gaagtgctgggacgtgtcattgccg

SEQ ID NO: 926424 - DNA, 25 bp, Mus musculus
gaagtgctgggaggtgtcattgccg

SEQ ID NO: 926425 - DNA, 25 bp, Mus musculus
gaagtgcttactctcttcttctcta

SEQ ID NO: 926426 - DNA, 25 bp, Mus musculus
gaagtgcttactgtcttcttctcta

SEQ ID NO: 926427 - DNA, 25 bp, Mus musculus
gaagtgcttttcaccgaaggagttc

SEQ ID NO: 926428 - DNA, 25 bp, Mus musculus
gaagtgcttttcacggaaggagttc

SEQ ID NO: 926429 - DNA, 25 bp, Mus musculus
gaagtggaaagccgagaagggtgac

SEQ ID NO: 926430 - DNA, 25 bp, Mus musculus
gaagtggaaagccgtgaagggtgac

SEQ ID NO: 926431 - DNA, 25 bp, Mus musculus
gaagtggaaaggcacgtgtccacag

SEQ ID NO: 926432 - DNA, 25 bp, Mus musculus
gaagtggaaaggcaggtgtccacag

SEQ ID NO: 926433 - DNA, 25 bp, Mus musculus
gaagtggaaatacgaaaaccagcaa

SEQ ID NO: 926434 - DNA, 25 bp, Mus musculus
gaagtggaaataggaaaaccagcaa

SEQ ID NO: 926435 - DNA, 25 bp, Mus musculus
gaagtggaactgctaagcaataaca

SEQ ID NO: 926436 - DNA, 25 bp, Mus musculus
gaagtggaactggtaagcaataaca

SEQ ID NO: 926437 - DNA, 25 bp, Mus musculus
gaagtggacttgatccctgctgtct

SEQ ID NO: 926438 - DNA, 25 bp, Mus musculus
gaagtggacttgttccctgctgtct

SEQ ID NO: 926439 - DNA, 25 bp, Mus musculus
gaagtggaggattttgcaagaatcc

SEQ ID NO: 926440 - DNA, 25 bp, Mus musculus
gaagtggaggcactgaacttttgaa

SEQ ID NO: 926441 - DNA, 25 bp, Mus musculus
gaagtggaggcgcctccgcctcaga

SEQ ID NO: 926442 - DNA, 25 bp, Mus musculus
gaagtggaggcggctccgcctcaga

SEQ ID NO: 926443 - DNA, 25 bp, Mus musculus
gaagtggagggactgaacttttgaa

SEQ ID NO: 926444 - DNA, 25 bp, Mus musculus
gaagtggaggtttttgcaagaatcc

SEQ ID NO: 926445 - DNA, 25 bp, Mus musculus
gaagtggcagcttgtttttccgggc

SEQ ID NO: 926446 - DNA, 25 bp, Mus musculus
gaagtggcaggttgtttttccgggc

SEQ ID NO: 926447 - DNA, 25 bp, Mus musculus
gaagtggccaagatggctgtcagat

SEQ ID NO: 926448 - DNA, 25 bp, Mus musculus
gaagtggccaagctgtcagatataa

SEQ ID NO: 926449 - DNA, 25 bp, Mus musculus
gaagtggccaaggtgtcagatataa

SEQ ID NO: 926450 - DNA, 25 bp, Mus musculus
gaagtggccaagttggctgtcagat

SEQ ID NO: 926451 - DNA, 25 bp, Mus musculus
gaagtgggctgccgtatcagcctag

SEQ ID NO: 926452 - DNA, 25 bp, Mus musculus
gaagtgggctgcggtatcagcctag

SEQ ID NO: 926453 - DNA, 25 bp, Mus musculus
gaagtggtaaaagtcatatagtcat

SEQ ID NO: 926454 - DNA, 25 bp, Mus musculus
gaagtggtaaaagtgatatagtcat

SEQ ID NO: 926455 - DNA, 25 bp, Mus musculus
gaagtggtacccagcgtgcaaatac

SEQ ID NO: 926456 - DNA, 25 bp, Mus musculus
gaagtggtacccagggtgcaaatac

SEQ ID NO: 926457 - DNA, 25 bp, Mus musculus
gaagtggtagaaatggacctaccaa

SEQ ID NO: 926458 - DNA, 25 bp, Mus musculus
gaagtggtagtaatggacctaccaa

SEQ ID NO: 926459 - DNA, 25 bp, Mus musculus
gaagtggtggagatccacgacagtg

SEQ ID NO: 926460 - DNA, 25 bp, Mus musculus
gaagtggtggagatgcacgacagtg

SEQ ID NO: 926461 - DNA, 25 bp, Mus musculus
gaagtgtatgaagacgctggagtca

SEQ ID NO: 926462 - DNA, 25 bp, Mus musculus
gaagtgtatgaagaggctggagtca

SEQ ID NO: 926463 - DNA, 25 bp, Mus musculus
gaagtgtgcggacgcaggagctaac

SEQ ID NO: 926464 - DNA, 25 bp, Mus musculus
gaagtgtgcggaggcaggagctaac

SEQ ID NO: 926465 - DNA, 25 bp, Mus musculus
gaagtgtgcggcaacgtgttcaatg

SEQ ID NO: 926466 - DNA, 25 bp, Mus musculus
gaagtgtgcggcaaggtgttcaatg

SEQ ID NO: 926467 - DNA, 25 bp, Mus musculus
gaagtgtggcttcgtacctggaatg

SEQ ID NO: 926468 - DNA, 25 bp, Mus musculus
gaagtgtggcttggtacctggaatg

SEQ ID NO: 926469 - DNA, 25 bp, Mus musculus
gaagtgttacaacagacttgcagca

SEQ ID NO: 926470 - DNA, 25 bp, Mus musculus
gaagtgttacaaccagagacttgca

SEQ ID NO: 926471 - DNA, 25 bp, Mus musculus
gaagtgttacaagagacttgcagca

SEQ ID NO: 926472 - DNA, 25 bp, Mus musculus
gaagtgttacaagcagagacttgca

SEQ ID NO: 926473 - DNA, 25 bp, Mus musculus
gaagtgttatacacaccaacagcca

SEQ ID NO: 926474 - DNA, 25 bp, Mus musculus
gaagtgttattcacaccaacagcca

SEQ ID NO: 926475 - DNA, 25 bp, Mus musculus
gaagtgttcaagcctgctgctgtcc

SEQ ID NO: 926476 - DNA, 25 bp, Mus musculus
gaagtgttcaaggctgctgctgtcc

SEQ ID NO: 926477 - DNA, 25 bp, Mus musculus
gaagttaaaaagaggaatgcagtgg

SEQ ID NO: 926478 - DNA, 25 bp, Mus musculus
gaagttaaaaagtggaatgcagtgg

SEQ ID NO: 926479 - DNA, 25 bp, Mus musculus
gaagttcacaagataaccaacaacc

SEQ ID NO: 926480 - DNA, 25 bp, Mus musculus
gaagttcacaagcaatgtatcattg

SEQ ID NO: 926481 - DNA, 25 bp, Mus musculus
gaagttcacaagctggttcatggga

SEQ ID NO: 926482 - DNA, 25 bp, Mus musculus
gaagttcacaaggaatgtatcattg

SEQ ID NO: 926483 - DNA, 25 bp, Mus musculus
gaagttcacaaggtggttcatggga

SEQ ID NO: 926484 - DNA, 25 bp, Mus musculus
gaagttcacaagttaaccaacaacc

SEQ ID NO: 926485 - DNA, 25 bp, Mus musculus
gaagttcatgatggcttgtgccaac

SEQ ID NO: 926486 - DNA, 25 bp, Mus musculus
gaagttcatgttggcttgtgccaac

SEQ ID NO: 926487 - DNA, 25 bp, Mus musculus
gaagttccggcctctggccgacgga

SEQ ID NO: 926488 - DNA, 25 bp, Mus musculus
gaagttccgggctctggccgacgga

SEQ ID NO: 926489 - DNA, 25 bp, Mus musculus
gaagttcggattaacatccttgcca

SEQ ID NO: 926490 - DNA, 25 bp, Mus musculus
gaagttcggattaagatccttgcca

SEQ ID NO: 926491 - DNA, 25 bp, Mus musculus
gaagttctttcgatgcggaatataa

SEQ ID NO: 926492 - DNA, 25 bp, Mus musculus
gaagttctttcgttgcggaatataa

SEQ ID NO: 926493 - DNA, 25 bp, Mus musculus
gaagttgagaaaaacattgaagacc

SEQ ID NO: 926494 - DNA, 25 bp, Mus musculus
gaagttgagaaaaagattgaagacc

SEQ ID NO: 926495 - DNA, 25 bp, Mus musculus
gaagttgatgagcaagatgctgccc

SEQ ID NO: 926496 - DNA, 25 bp, Mus musculus
gaagttgatgaggaagatgctgccc

SEQ ID NO: 926497 - DNA, 25 bp, Mus musculus
gaagttgatgcgttcgaccccagca

SEQ ID NO: 926498 - DNA, 25 bp, Mus musculus
gaagttgatgcgttggaccccagca

SEQ ID NO: 926499 - DNA, 25 bp, Mus musculus
gaagttggcttgccttgagattttt

SEQ ID NO: 926500 - DNA, 25 bp, Mus musculus
gaagttggcttggcttgagattttt

SEQ ID NO: 926501 - DNA, 25 bp, Mus musculus
gaagtttatgatttgattcgaacta

SEQ ID NO: 926502 - DNA, 25 bp, Mus musculus
gaagtttatgttttgattcgaacta

SEQ ID NO: 926503 - DNA, 25 bp, Mus musculus
gaagtttattcacattgatatctgt

SEQ ID NO: 926504 - DNA, 25 bp, Mus musculus
gaagtttattcagattgatatctgt

SEQ ID NO: 926505 - DNA, 25 bp, Mus musculus
gaagtttcctgacattttgtgtatc

SEQ ID NO: 926506 - DNA, 25 bp, Mus musculus
gaagtttcctgagattttgtgtatc

SEQ ID NO: 926507 - DNA, 25 bp, Mus musculus
gaagtttctcatgacgaacctggct

SEQ ID NO: 926508 - DNA, 25 bp, Mus musculus
gaagtttctcatgaggaacctggct

SEQ ID NO: 926509 - DNA, 25 bp, Mus musculus
gaagtttggcaacgaagcagaacaa

SEQ ID NO: 926510 - DNA, 25 bp, Mus musculus
gaagtttggcaaggaagcagaacaa

SEQ ID NO: 926511 - DNA, 25 bp, Mus musculus
gaagttttgcttaaccatggtgctg

SEQ ID NO: 926512 - DNA, 25 bp, Mus musculus
gaagttttgcttaagcatggtgctg

SEQ ID NO: 926513 - DNA, 25 bp, Mus musculus
gaagttttttgaatttggcagtcat

SEQ ID NO: 926514 - DNA, 25 bp, Mus musculus
gaagttttttgattttggcagtcat

SEQ ID NO: 926515 - DNA, 25 bp, Mus musculus
gaataaaaggtgccacaggcaccat

SEQ ID NO: 926516 - DNA, 25 bp, Mus musculus
gaataaaaggtggcacaggcaccat

SEQ ID NO: 926517 - DNA, 25 bp, Mus musculus
gaataaacagactgtgacagagcct

SEQ ID NO: 926518 - DNA, 25 bp, Mus musculus
gaataaacagtctgtgacagagcct

SEQ ID NO: 926519 - DNA, 25 bp, Mus musculus
gaataaagaaagctgaccagaatgg

SEQ ID NO: 926520 - DNA, 25 bp, Mus musculus
gaataaagaaaggtgaccagaatgg

SEQ ID NO: 926521 - DNA, 25 bp, Mus musculus
gaataaccagctgctggtgggaatc

SEQ ID NO: 926522 - DNA, 25 bp, Mus musculus
gaataaccaggtgctggtgggaatc

SEQ ID NO: 926523 - DNA, 25 bp, Mus musculus
gaataacctgccttcctgctaccta

SEQ ID NO: 926524 - DNA, 25 bp, Mus musculus
gaataacctggcttcctgctaccta

SEQ ID NO: 926525 - DNA, 25 bp, Mus musculus
gaataagaatatcacgtgttgaact

SEQ ID NO: 926526 - DNA, 25 bp, Mus musculus
gaataagaatatcaggtgttgaact

SEQ ID NO: 926527 - DNA, 25 bp, Mus musculus
gaataagaccagatcatctttagat

SEQ ID NO: 926528 - DNA, 25 bp, Mus musculus
gaataagaccagttcatctttagat

SEQ ID NO: 926529 - DNA, 25 bp, Mus musculus
gaataagatgagctcctccaccttc

SEQ ID NO: 926530 - DNA, 25 bp, Mus musculus
gaataagatgaggtcctccaccttc

SEQ ID NO: 926531 - DNA, 25 bp, Mus musculus
gaataagcagatccgggcttgcatt

SEQ ID NO: 926532 - DNA, 25 bp, Mus musculus
gaataagcagttccgggcttgcatt

SEQ ID NO: 926533 - DNA, 25 bp, Mus musculus
gaataagcccacctccagcttctgt

SEQ ID NO: 926534 - DNA, 25 bp, Mus musculus
gaataagcccacctccttctgtcag

SEQ ID NO: 926535 - DNA, 25 bp, Mus musculus
gaataagcccacctgcagcttctgt

SEQ ID NO: 926536 - DNA, 25 bp, Mus musculus
gaataagcccacctgcttctgtcag

SEQ ID NO: 926537 - DNA, 25 bp, Mus musculus
gaataagcgacatacatcaagatga

SEQ ID NO: 926538 - DNA, 25 bp, Mus musculus
gaataagcgacatagatcaagatga

SEQ ID NO: 926539 - DNA, 25 bp, Mus musculus
gaataaggagaacgtatacatcata

SEQ ID NO: 926540 - DNA, 25 bp, Mus musculus
gaataaggagaaggtatacatcata

SEQ ID NO: 926541 - DNA, 25 bp, Mus musculus
gaataataaaaactgctctatgccc

SEQ ID NO: 926542 - DNA, 25 bp, Mus musculus
gaataataaaaagtgctctatgccc

SEQ ID NO: 926543 - DNA, 25 bp, Mus musculus
gaataatcctgtttagatggaagga

SEQ ID NO: 926544 - DNA, 25 bp, Mus musculus
gaataatcctgttttgatggaagga

SEQ ID NO: 926545 - DNA, 25 bp, Mus musculus
gaataatgtgctttatgctgaggca

SEQ ID NO: 926546 - DNA, 25 bp, Mus musculus
gaataatgtgctttttgctgaggca

SEQ ID NO: 926547 - DNA, 25 bp, Mus musculus
gaataattcctcacagacacactgg

SEQ ID NO: 926548 - DNA, 25 bp, Mus musculus
gaataattcctcactgacacactgg

SEQ ID NO: 926549 - DNA, 25 bp, Mus musculus
gaatacacagagccatcaatgacaa

SEQ ID NO: 926550 - DNA, 25 bp, Mus musculus
gaatacacagagccttcaatgacaa

SEQ ID NO: 926551 - DNA, 25 bp, Mus musculus
gaatacacagcccccagtgccttca

SEQ ID NO: 926552 - DNA, 25 bp, Mus musculus
gaatacacaggccccagtgccttca

SEQ ID NO: 926553 - DNA, 25 bp, Mus musculus
gaatacaccacgcacaaagagcccc

SEQ ID NO: 926554 - DNA, 25 bp, Mus musculus
gaatacaccacggacaaagagcccc

SEQ ID NO: 926555 - DNA, 25 bp, Mus musculus
gaatacagccaggaactgagtgttc

SEQ ID NO: 926556 - DNA, 25 bp, Mus musculus
gaatacagccaggaagaggtagatg

SEQ ID NO: 926557 - DNA, 25 bp, Mus musculus
gaatacagccaggatctgagtgttc

SEQ ID NO: 926558 - DNA, 25 bp, Mus musculus
gaatacagccaggatgaggtagatg

SEQ ID NO: 926559 - DNA, 25 bp, Mus musculus
gaatacatggagcaggccatcatga

SEQ ID NO: 926560 - DNA, 25 bp, Mus musculus
gaatacatggaggaggccatcatga

SEQ ID NO: 926561 - DNA, 25 bp, Mus musculus
gaataccagatgccctataagtatc

SEQ ID NO: 926562 - DNA, 25 bp, Mus musculus
gaataccagatggcctataagtatc

SEQ ID NO: 926563 - DNA, 25 bp, Mus musculus
gaatacccagccaaagccctggact

SEQ ID NO: 926564 - DNA, 25 bp, Mus musculus
gaatacccagccaatgccctggact

SEQ ID NO: 926565 - DNA, 25 bp, Mus musculus
gaatacccagcctccaacacctatg

SEQ ID NO: 926566 - DNA, 25 bp, Mus musculus
gaatacccaggctccaacacctatg

SEQ ID NO: 926567 - DNA, 25 bp, Mus musculus
gaatacccctctataaaactggtgg

SEQ ID NO: 926568 - DNA, 25 bp, Mus musculus
gaatacccctctctggtggtggagc

SEQ ID NO: 926569 - DNA, 25 bp, Mus musculus
gaatacccctctgtggtggtggagc

SEQ ID NO: 926570 - DNA, 25 bp, Mus musculus
gaatacccctctttaaaactggtgg

SEQ ID NO: 926571 - DNA, 25 bp, Mus musculus
gaatactaccagcagagcaatggtc

SEQ ID NO: 926572 - DNA, 25 bp, Mus musculus
gaatactaccaggagagcaatggtc

SEQ ID NO: 926573 - DNA, 25 bp, Mus musculus
gaatagaactggccgtgcggcctca

SEQ ID NO: 926574 - DNA, 25 bp, Mus musculus
gaatagaactgggcgtgcggcctca

SEQ ID NO: 926575 - DNA, 25 bp, Mus musculus
gaatagaattacgcacacccacaac

SEQ ID NO: 926576 - DNA, 25 bp, Mus musculus
gaatagaattacgctcacccacaac

SEQ ID NO: 926577 - DNA, 25 bp, Mus musculus
gaatagagggaaacaggccaccatc

SEQ ID NO: 926578 - DNA, 25 bp, Mus musculus
gaatagagggtaacaggccaccatc

SEQ ID NO: 926579 - DNA, 25 bp, Mus musculus
gaatagcgtgcctcaggagccgtac

SEQ ID NO: 926580 - DNA, 25 bp, Mus musculus
gaatagcgtggctcaggagccgtac

SEQ ID NO: 926581 - DNA, 25 bp, Mus musculus
gaatagctacaacaaccgccgagac

SEQ ID NO: 926582 - DNA, 25 bp, Mus musculus
gaatagctacaacatccgccgagac

SEQ ID NO: 926583 - DNA, 25 bp, Mus musculus
gaataggaggcgctaaccatagaga

SEQ ID NO: 926584 - DNA, 25 bp, Mus musculus
gaataggaggcggtaaccatagaga

SEQ ID NO: 926585 - DNA, 25 bp, Mus musculus
gaataggcatgacattgctgttatg

SEQ ID NO: 926586 - DNA, 25 bp, Mus musculus
gaataggcatgagattgctgttatg

SEQ ID NO: 926587 - DNA, 25 bp, Mus musculus
gaatagtctgagctgcgtacgacgc

SEQ ID NO: 926588 - DNA, 25 bp, Mus musculus
gaatagtctgtgctgcgtacgacgc

SEQ ID NO: 926589 - DNA, 25 bp, Mus musculus
gaatagtgtgagcagcttatgatgc

SEQ ID NO: 926590 - DNA, 25 bp, Mus musculus
gaatagtgtgataattggccttttg

SEQ ID NO: 926591 - DNA, 25 bp, Mus musculus
gaatagtgtgtgcagcttatgatgc

SEQ ID NO: 926592 - DNA, 25 bp, Mus musculus
gaatagtgtgttaattggccttttg

SEQ ID NO: 926593 - DNA, 25 bp, Mus musculus
gaatagtgttctgtagttattttcc

SEQ ID NO: 926594 - DNA, 25 bp, Mus musculus
gaatagtgttctgttgttattttcc

SEQ ID NO: 926595 - DNA, 25 bp, Mus musculus
gaatataacatgcacatattcagtg

SEQ ID NO: 926596 - DNA, 25 bp, Mus musculus
gaatataacatgcagatattcagtg

SEQ ID NO: 926597 - DNA, 25 bp, Mus musculus
gaatataatcccaaccgatttgctg

SEQ ID NO: 926598 - DNA, 25 bp, Mus musculus
gaatataatcccaagcgatttgctg

SEQ ID NO: 926599 - DNA, 25 bp, Mus musculus
gaatatattcgggacgacatagaat

SEQ ID NO: 926600 - DNA, 25 bp, Mus musculus
gaatatattcgggaggacatagaat

SEQ ID NO: 926601 - DNA, 25 bp, Mus musculus
gaatatccagaaggtgactccaaga

SEQ ID NO: 926602 - DNA, 25 bp, Mus musculus
gaatatccagagactaagtctggct

SEQ ID NO: 926603 - DNA, 25 bp, Mus musculus
gaatatccagctatttgattttgaa

SEQ ID NO: 926604 - DNA, 25 bp, Mus musculus
gaatatccaggtatttgattttgaa

SEQ ID NO: 926605 - DNA, 25 bp, Mus musculus
gaatatccagtaggtgactccaaga

SEQ ID NO: 926606 - DNA, 25 bp, Mus musculus
gaatatccagtgactaagtctggct

SEQ ID NO: 926607 - DNA, 25 bp, Mus musculus
gaatatctcaacaacgcacggcagc

SEQ ID NO: 926608 - DNA, 25 bp, Mus musculus
gaatatctcaacaaggcacggcagc

SEQ ID NO: 926609 - DNA, 25 bp, Mus musculus
gaatatgaaaagccttctgagaact

SEQ ID NO: 926610 - DNA, 25 bp, Mus musculus
gaatatgaaaaggcttctgagaact

SEQ ID NO: 926611 - DNA, 25 bp, Mus musculus
gaatatgaagatgttgtagaagatg

SEQ ID NO: 926612 - DNA, 25 bp, Mus musculus
gaatatgaagcacaatcagttaaca

SEQ ID NO: 926613 - DNA, 25 bp, Mus musculus
gaatatgaaggacaatcagttaaca

SEQ ID NO: 926614 - DNA, 25 bp, Mus musculus
gaatatgaagttgttgtagaagatg

SEQ ID NO: 926615 - DNA, 25 bp, Mus musculus
gaatatgcagctttttgaatttcag

SEQ ID NO: 926616 - DNA, 25 bp, Mus musculus
gaatatgcaggtttttgaatttcag

SEQ ID NO: 926617 - DNA, 25 bp, Mus musculus
gaatatgctgtcaacatcattgaga

SEQ ID NO: 926618 - DNA, 25 bp, Mus musculus
gaatatgctgtcaagatcattgaga

SEQ ID NO: 926619 - DNA, 25 bp, Mus musculus
gaatatgtaccaacagtttttgaca

SEQ ID NO: 926620 - DNA, 25 bp, Mus musculus
gaatatgtaccaactgtttttgaca

SEQ ID NO: 926621 - DNA, 25 bp, Mus musculus
gaatatgttggagacgtgatcacaa

SEQ ID NO: 926622 - DNA, 25 bp, Mus musculus
gaatatgttggagaggtgatcacaa

SEQ ID NO: 926623 - DNA, 25 bp, Mus musculus
gaatattcagattgaagaaattgca

SEQ ID NO: 926624 - DNA, 25 bp, Mus musculus
gaatattcagtttgaagaaattgca

SEQ ID NO: 926625 - DNA, 25 bp, Mus musculus
gaatattctaagatgctcctgccag

SEQ ID NO: 926626 - DNA, 25 bp, Mus musculus
gaatattctaagttgctcctgccag

SEQ ID NO: 926627 - DNA, 25 bp, Mus musculus
gaatattctcagctctttgaaatgc

SEQ ID NO: 926628 - DNA, 25 bp, Mus musculus
gaatattctcaggtctttgaaatgc

SEQ ID NO: 926629 - DNA, 25 bp, Mus musculus
gaatattgagcacattctcgactat

SEQ ID NO: 926630 - DNA, 25 bp, Mus musculus
gaatattgagcagattctcgactat

SEQ ID NO: 926631 - DNA, 25 bp, Mus musculus
gaatatttcttgcgtggaatataaa

SEQ ID NO: 926632 - DNA, 25 bp, Mus musculus
gaatatttcttgggtggaatataaa

SEQ ID NO: 926633 - DNA, 25 bp, Mus musculus
gaatcaaaagctggcagatgaggct

SEQ ID NO: 926634 - DNA, 25 bp, Mus musculus
gaatcaaaaggtggcagatgaggct

SEQ ID NO: 926635 - DNA, 25 bp, Mus musculus
gaatcacagagtgtcgaaaagaaca

SEQ ID NO: 926636 - DNA, 25 bp, Mus musculus
gaatcacagagtgtcggaaaagaac

SEQ ID NO: 926637 - DNA, 25 bp, Mus musculus
gaatcacagagtgtggaaaagaaca

SEQ ID NO: 926638 - DNA, 25 bp, Mus musculus
gaatcacagagtgtgggaaaagaac

SEQ ID NO: 926639 - DNA, 25 bp, Mus musculus
gaatcactggcttatcattgtgaat

SEQ ID NO: 926640 - DNA, 25 bp, Mus musculus
gaatcactgggttatcattgtgaat

SEQ ID NO: 926641 - DNA, 25 bp, Mus musculus
gaatcacttcaacgtggacctggtg

SEQ ID NO: 926642 - DNA, 25 bp, Mus musculus
gaatcacttcaaggtggacctggtg

SEQ ID NO: 926643 - DNA, 25 bp, Mus musculus
gaatcagaaaagaggtcttgcccct

SEQ ID NO: 926644 - DNA, 25 bp, Mus musculus
gaatcagaaaagctcttgcccctca

SEQ ID NO: 926645 - DNA, 25 bp, Mus musculus
gaatcagaaaaggtcttgcccctca

SEQ ID NO: 926646 - DNA, 25 bp, Mus musculus
gaatcagaaaagtggtcttgcccct

SEQ ID NO: 926647 - DNA, 25 bp, Mus musculus
gaatcagatccacgatgctcggaag

SEQ ID NO: 926648 - DNA, 25 bp, Mus musculus
gaatcagatccaggatgctcggaag

SEQ ID NO: 926649 - DNA, 25 bp, Mus musculus
gaatcagcctagcacgcccagcaac

SEQ ID NO: 926650 - DNA, 25 bp, Mus musculus
gaatcagcctagcaggcccagcaac

SEQ ID NO: 926651 - DNA, 25 bp, Mus musculus
gaatcagctaaagaaaagtggagac

SEQ ID NO: 926652 - DNA, 25 bp, Mus musculus
gaatcagctaaagataagtggagac

SEQ ID NO: 926653 - DNA, 25 bp, Mus musculus
gaatcagtggggcgccccctgcccg

SEQ ID NO: 926654 - DNA, 25 bp, Mus musculus
gaatcagtggggcggcccctgcccg

SEQ ID NO: 926655 - DNA, 25 bp, Mus musculus
gaatcatacaagacgcctttgactt

SEQ ID NO: 926656 - DNA, 25 bp, Mus musculus
gaatcatacatgacgcctttgactt

SEQ ID NO: 926657 - DNA, 25 bp, Mus musculus
gaatcatagtagtgacccaaatctt

SEQ ID NO: 926658 - DNA, 25 bp, Mus musculus
gaatcatagttgtgacccaaatctt

SEQ ID NO: 926659 - DNA, 25 bp, Mus musculus
gaatccacacagccgacaagccaca

SEQ ID NO: 926660 - DNA, 25 bp, Mus musculus
gaatccacacaggcgacaagccaca

SEQ ID NO: 926661 - DNA, 25 bp, Mus musculus
gaatccaccacacataactctcttc

SEQ ID NO: 926662 - DNA, 25 bp, Mus musculus
gaatccaccacagataactctcttc

SEQ ID NO: 926663 - DNA, 25 bp, Mus musculus
gaatccagagacaacggagagcctg

SEQ ID NO: 926664 - DNA, 25 bp, Mus musculus
gaatccagagacaagggagagcctg

SEQ ID NO: 926665 - DNA, 25 bp, Mus musculus
gaatccatcgctacaagcaataaca

SEQ ID NO: 926666 - DNA, 25 bp, Mus musculus
gaatccatcggtacaagcaataaca

SEQ ID NO: 926667 - DNA, 25 bp, Mus musculus
gaatccatgcatgtcatctggcagt

SEQ ID NO: 926668 - DNA, 25 bp, Mus musculus
gaatccatgcatgtgatctggcagt

SEQ ID NO: 926669 - DNA, 25 bp, Mus musculus
gaatcccgaataagattatttattc

SEQ ID NO: 926670 - DNA, 25 bp, Mus musculus
gaatcccgaatatgattatttattc

SEQ ID NO: 926671 - DNA, 25 bp, Mus musculus
gaatcccggctgcacggtctgtcac

SEQ ID NO: 926672 - DNA, 25 bp, Mus musculus
gaatcccggctgcagggtctgtcac

SEQ ID NO: 926673 - DNA, 25 bp, Mus musculus
gaatccctgcctgacgagctgcaga

SEQ ID NO: 926674 - DNA, 25 bp, Mus musculus
gaatccctgcctgaggagctgcaga

SEQ ID NO: 926675 - DNA, 25 bp, Mus musculus
gaatcctcagctgcagagtccagaa

SEQ ID NO: 926676 - DNA, 25 bp, Mus musculus
gaatcctcaggtgcagagtccagaa

SEQ ID NO: 926677 - DNA, 25 bp, Mus musculus
gaatcctccacaaaccctgtggtga

SEQ ID NO: 926678 - DNA, 25 bp, Mus musculus
gaatcctccacaaagcctgtggtga

SEQ ID NO: 926679 - DNA, 25 bp, Mus musculus
gaatcctggatacgtgagaaagaag

SEQ ID NO: 926680 - DNA, 25 bp, Mus musculus
gaatcctggataggtgagaaagaag

SEQ ID NO: 926681 - DNA, 25 bp, Mus musculus
gaatcctgtgaacatattgacgaat

SEQ ID NO: 926682 - DNA, 25 bp, Mus musculus
gaatcctgtgaagatattgacgaat

SEQ ID NO: 926683 - DNA, 25 bp, Mus musculus
gaatccttgaaacccctctgggcgt

SEQ ID NO: 926684 - DNA, 25 bp, Mus musculus
gaatccttgaaagccctctgggcgt

SEQ ID NO: 926685 - DNA, 25 bp, Mus musculus
gaatcgactactcgaaagcctacaa

SEQ ID NO: 926686 - DNA, 25 bp, Mus musculus
gaatcgactactggaaagcctacaa

SEQ ID NO: 926687 - DNA, 25 bp, Mus musculus
gaatcgccacagagcctacagagtg

SEQ ID NO: 926688 - DNA, 25 bp, Mus musculus
gaatcgccacagtgcctacagagtg

SEQ ID NO: 926689 - DNA, 25 bp, Mus musculus
gaatcggaagccaggagagtatggc

SEQ ID NO: 926690 - DNA, 25 bp, Mus musculus
gaatcggaaggcaggagagtatggc

SEQ ID NO: 926691 - DNA, 25 bp, Mus musculus
gaatcggatgcaaggtttgaagaaa

SEQ ID NO: 926692 - DNA, 25 bp, Mus musculus
gaatcggatgcatggtttgaagaaa

SEQ ID NO: 926693 - DNA, 25 bp, Mus musculus
gaatcgtacgacaaagcagacgtca

SEQ ID NO: 926694 - DNA, 25 bp, Mus musculus
gaatcgtacgacaatgcagacgtca

SEQ ID NO: 926695 - DNA, 25 bp, Mus musculus
gaatcgtggcagcccccatgaatga

SEQ ID NO: 926696 - DNA, 25 bp, Mus musculus
gaatcgtggcaggccccatgaatga

SEQ ID NO: 926697 - DNA, 25 bp, Mus musculus
gaatctaagccacgttgccatgaag

SEQ ID NO: 926698 - DNA, 25 bp, Mus musculus
gaatctaagccaggttgccatgaag

SEQ ID NO: 926699 - DNA, 25 bp, Mus musculus
gaatctacagcggccgggctagagc

SEQ ID NO: 926700 - DNA, 25 bp, Mus musculus
gaatctacaggggccgggctagagc

SEQ ID NO: 926701 - DNA, 25 bp, Mus musculus
gaatctactggcaacgtggtctact

SEQ ID NO: 926702 - DNA, 25 bp, Mus musculus
gaatctactggcaacgtggtctatt

SEQ ID NO: 926703 - DNA, 25 bp, Mus musculus
gaatctactggcaaggtggtctact

SEQ ID NO: 926704 - DNA, 25 bp, Mus musculus
gaatctactggcaaggtggtctatt

SEQ ID NO: 926705 - DNA, 25 bp, Mus musculus
gaatctagagcgtgagaaagtccgg

SEQ ID NO: 926706 - DNA, 25 bp, Mus musculus
gaatctagagggtgagaaagtccgg

SEQ ID NO: 926707 - DNA, 25 bp, Mus musculus
gaatctatggctgaggaagatcttc

SEQ ID NO: 926708 - DNA, 25 bp, Mus musculus
gaatctatgggtgaggaagatcttc

SEQ ID NO: 926709 - DNA, 25 bp, Mus musculus
gaatctcctgcacctcccagagaga

SEQ ID NO: 926710 - DNA, 25 bp, Mus musculus
gaatctcctgcagctcccagagaga

SEQ ID NO: 926711 - DNA, 25 bp, Mus musculus
gaatctgaagaggtagaagatgatg

SEQ ID NO: 926712 - DNA, 25 bp, Mus musculus
gaatctgaagtggtagaagatgatg

SEQ ID NO: 926713 - DNA, 25 bp, Mus musculus
gaatcttaacaacggataactctct

SEQ ID NO: 926714 - DNA, 25 bp, Mus musculus
gaatcttaacaagggataactctct

SEQ ID NO: 926715 - DNA, 25 bp, Mus musculus
gaatcttcagcggctggctgtgggc

SEQ ID NO: 926716 - DNA, 25 bp, Mus musculus
gaatcttcaggggctggctgtgggc

SEQ ID NO: 926717 - DNA, 25 bp, Mus musculus
gaatcttgaaagcctcacccttgct

SEQ ID NO: 926718 - DNA, 25 bp, Mus musculus
gaatcttgaaaggctcacccttgct

SEQ ID NO: 926719 - DNA, 25 bp, Mus musculus
gaatgaaaagcaaagtgctttgaaa

SEQ ID NO: 926720 - DNA, 25 bp, Mus musculus
gaatgaaaaggaaagtgctttgaaa

SEQ ID NO: 926721 - DNA, 25 bp, Mus musculus
gaatgaaatatttactttatcctta

SEQ ID NO: 926722 - DNA, 25 bp, Mus musculus
gaatgaaatatttagtttatcctta

SEQ ID NO: 926723 - DNA, 25 bp, Mus musculus
gaatgacagactagacgagctttta

SEQ ID NO: 926724 - DNA, 25 bp, Mus musculus
gaatgacagagtagacgagctttta

SEQ ID NO: 926725 - DNA, 25 bp, Mus musculus
gaatgacattattgccattggctct

SEQ ID NO: 926726 - DNA, 25 bp, Mus musculus
gaatgacattcgctcgtgagctgag

SEQ ID NO: 926727 - DNA, 25 bp, Mus musculus
gaatgacattggctcgtgagctgag

SEQ ID NO: 926728 - DNA, 25 bp, Mus musculus
gaatgacatttttgccattggctct

SEQ ID NO: 926729 - DNA, 25 bp, Mus musculus
gaatgaccagctttgtgggcattgc

SEQ ID NO: 926730 - DNA, 25 bp, Mus musculus
gaatgaccaggtttgtgggcattgc

SEQ ID NO: 926731 - DNA, 25 bp, Mus musculus
gaatgaccggcacggtgatgctgag

SEQ ID NO: 926732 - DNA, 25 bp, Mus musculus
gaatgaccggcagggtgatgctgag

SEQ ID NO: 926733 - DNA, 25 bp, Mus musculus
gaatgagaaacttcataaagaaatt

SEQ ID NO: 926734 - DNA, 25 bp, Mus musculus
gaatgagaaagttcataaagaaatt

SEQ ID NO: 926735 - DNA, 25 bp, Mus musculus
gaatgagcaagccgcccttgattgt

SEQ ID NO: 926736 - DNA, 25 bp, Mus musculus
gaatgagcaagccgcttgttatgct

SEQ ID NO: 926737 - DNA, 25 bp, Mus musculus
gaatgagcaagcggcccttgattgt

SEQ ID NO: 926738 - DNA, 25 bp, Mus musculus
gaatgagcaagcggcttgttatgct

SEQ ID NO: 926739 - DNA, 25 bp, Mus musculus
gaatgagcacagcctggtgatcgat

SEQ ID NO: 926740 - DNA, 25 bp, Mus musculus
gaatgagcacaggctggtgatcgat

SEQ ID NO: 926741 - DNA, 25 bp, Mus musculus
gaatgagccaagcaccagagtgagg

SEQ ID NO: 926742 - DNA, 25 bp, Mus musculus
gaatgagccaaggaccagagtgagg

SEQ ID NO: 926743 - DNA, 25 bp, Mus musculus
gaatgatccacctacatcaaaatag

SEQ ID NO: 926744 - DNA, 25 bp, Mus musculus
gaatgatccagctacatcaaaatag

SEQ ID NO: 926745 - DNA, 25 bp, Mus musculus
gaatgatgaatgaccaataggtgaa

SEQ ID NO: 926746 - DNA, 25 bp, Mus musculus
gaatgatgaatgacgaataggtgaa

SEQ ID NO: 926747 - DNA, 25 bp, Mus musculus
gaatgatgtgactaatggatgggac

SEQ ID NO: 926748 - DNA, 25 bp, Mus musculus
gaatgatgtgtctaatggatgggac

SEQ ID NO: 926749 - DNA, 25 bp, Mus musculus
gaatgattttagcttacagccaagc

SEQ ID NO: 926750 - DNA, 25 bp, Mus musculus
gaatgattttaggttacagccaagc

SEQ ID NO: 926751 - DNA, 25 bp, Mus musculus
gaatgcacagacgtggacgaatgtg

SEQ ID NO: 926752 - DNA, 25 bp, Mus musculus
gaatgcacagcaacgactaaggcgg

SEQ ID NO: 926753 - DNA, 25 bp, Mus musculus
gaatgcacagcagagaaatgtcagc

SEQ ID NO: 926754 - DNA, 25 bp, Mus musculus
gaatgcacagcagcagtgcacaaac

SEQ ID NO: 926755 - DNA, 25 bp, Mus musculus
gaatgcacagcagtgcacaaacggc

SEQ ID NO: 926756 - DNA, 25 bp, Mus musculus
gaatgcacaggaacgactaaggcgg

SEQ ID NO: 926757 - DNA, 25 bp, Mus musculus
gaatgcacaggagagaaatgtcagc

SEQ ID NO: 926758 - DNA, 25 bp, Mus musculus
gaatgcacaggagcagtgcacaaac

SEQ ID NO: 926759 - DNA, 25 bp, Mus musculus
gaatgcacaggagtgcacaaacggc

SEQ ID NO: 926760 - DNA, 25 bp, Mus musculus
gaatgcacagtcgtggacgaatgtg

SEQ ID NO: 926761 - DNA, 25 bp, Mus musculus
gaatgcaggactctctccttagtgc

SEQ ID NO: 926762 - DNA, 25 bp, Mus musculus
gaatgcaggactgtctccttagtgc

SEQ ID NO: 926763 - DNA, 25 bp, Mus musculus
gaatgcaggcccaaccctccattga

SEQ ID NO: 926764 - DNA, 25 bp, Mus musculus
gaatgcaggcccaacgtctccatgg

SEQ ID NO: 926765 - DNA, 25 bp, Mus musculus
gaatgcaggcccaagcctccattga

SEQ ID NO: 926766 - DNA, 25 bp, Mus musculus
gaatgcaggcccaaggtctccatgg

SEQ ID NO: 926767 - DNA, 25 bp, Mus musculus
gaatgccaaactccgtgtcgaccag

SEQ ID NO: 926768 - DNA, 25 bp, Mus musculus
gaatgccaaactgcgtgtcgaccag

SEQ ID NO: 926769 - DNA, 25 bp, Mus musculus
gaatgccaagccttacaatggaaac

SEQ ID NO: 926770 - DNA, 25 bp, Mus musculus
gaatgccaaggcttacaatggaaac

SEQ ID NO: 926771 - DNA, 25 bp, Mus musculus
gaatgccacactggccacagagacc

SEQ ID NO: 926772 - DNA, 25 bp, Mus musculus
gaatgccacagtggccacagagacc

SEQ ID NO: 926773 - DNA, 25 bp, Mus musculus
gaatgcctgaaaagaagaaaggctg

SEQ ID NO: 926774 - DNA, 25 bp, Mus musculus
gaatgcctgataagaagaaaggctg

SEQ ID NO: 926775 - DNA, 25 bp, Mus musculus
gaatgcgcagcctgaagcgcaagag

SEQ ID NO: 926776 - DNA, 25 bp, Mus musculus
gaatgcgcaggctgaagcgcaagag

SEQ ID NO: 926777 - DNA, 25 bp, Mus musculus
gaatgctatccagaagtacgtgccc

SEQ ID NO: 926778 - DNA, 25 bp, Mus musculus
gaatgctatccagatgtacgtgccc

SEQ ID NO: 926779 - DNA, 25 bp, Mus musculus
gaatgctgtgcgcacactggatgtc

SEQ ID NO: 926780 - DNA, 25 bp, Mus musculus
gaatgctgtgggcacactggatgtc

SEQ ID NO: 926781 - DNA, 25 bp, Mus musculus
gaatggaaagaacttatctacaagg

SEQ ID NO: 926782 - DNA, 25 bp, Mus musculus
gaatggaaagtacttatctacaagg

SEQ ID NO: 926783 - DNA, 25 bp, Mus musculus
gaatggaagcctgtgacttacaagg

SEQ ID NO: 926784 - DNA, 25 bp, Mus musculus
gaatggaagcgtgtgacttacaagg

SEQ ID NO: 926785 - DNA, 25 bp, Mus musculus
gaatggcagagaacaaggagaatat

SEQ ID NO: 926786 - DNA, 25 bp, Mus musculus
gaatggcagagaactaggagaatat

SEQ ID NO: 926787 - DNA, 25 bp, Mus musculus
gaatggcgccgccgcgttcaagcgc

SEQ ID NO: 926788 - DNA, 25 bp, Mus musculus
gaatggcgccgccgggttcaagcgc

SEQ ID NO: 926789 - DNA, 25 bp, Mus musculus
gaatgggactccagccattgtaatg

SEQ ID NO: 926790 - DNA, 25 bp, Mus musculus
gaatgggactccaggcattgtaatg

SEQ ID NO: 926791 - DNA, 25 bp, Mus musculus
gaatgggatgaacgttggccttgcc

SEQ ID NO: 926792 - DNA, 25 bp, Mus musculus
gaatgggatgaaggttggccttgcc

SEQ ID NO: 926793 - DNA, 25 bp, Mus musculus
gaatgggcacaacgcgacccaagct

SEQ ID NO: 926794 - DNA, 25 bp, Mus musculus
gaatgggcacaacggtgtggactgc

SEQ ID NO: 926795 - DNA, 25 bp, Mus musculus
gaatgggcacaaggcgacccaagct

SEQ ID NO: 926796 - DNA, 25 bp, Mus musculus
gaatgggcacaagggtgtggactgc

SEQ ID NO: 926797 - DNA, 25 bp, Mus musculus
gaatgggcagatgttacaggtggca

SEQ ID NO: 926798 - DNA, 25 bp, Mus musculus
gaatgggcagctggcactgatggaa

SEQ ID NO: 926799 - DNA, 25 bp, Mus musculus
gaatgggcaggtggcactgatggaa

SEQ ID NO: 926800 - DNA, 25 bp, Mus musculus
gaatgggcagttgttacaggtggca

SEQ ID NO: 926801 - DNA, 25 bp, Mus musculus
gaatgggccaagcagaaaagaaatg

SEQ ID NO: 926802 - DNA, 25 bp, Mus musculus
gaatgggccaaggagaaaagaaatg

SEQ ID NO: 926803 - DNA, 25 bp, Mus musculus
gaatgggctacaaaccatctgccag

SEQ ID NO: 926804 - DNA, 25 bp, Mus musculus
gaatgggctacaacccgtatgtgca

SEQ ID NO: 926805 - DNA, 25 bp, Mus musculus
gaatgggctacataccatctgccag

SEQ ID NO: 926806 - DNA, 25 bp, Mus musculus
gaatgggctacatcccgtatgtgca

SEQ ID NO: 926807 - DNA, 25 bp, Mus musculus
gaatggggagctacaggcagagatt

SEQ ID NO: 926808 - DNA, 25 bp, Mus musculus
gaatggggaggtacaggcagagatt

SEQ ID NO: 926809 - DNA, 25 bp, Mus musculus
gaatgggggccacgtgatgtacagg

SEQ ID NO: 926810 - DNA, 25 bp, Mus musculus
gaatgggggccaggtgatgtacagg

SEQ ID NO: 926811 - DNA, 25 bp, Mus musculus
gaatggtaaagacaccacagccccc

SEQ ID NO: 926812 - DNA, 25 bp, Mus musculus
gaatggtaaagacaccctaaccatg

SEQ ID NO: 926813 - DNA, 25 bp, Mus musculus
gaatggtaaagacagcacagccccc

SEQ ID NO: 926814 - DNA, 25 bp, Mus musculus
gaatggtaaagacagcctaaccatg

SEQ ID NO: 926815 - DNA, 25 bp, Mus musculus
gaatggtcttggcagtcccaaagag

SEQ ID NO: 926816 - DNA, 25 bp, Mus musculus
gaatggtcttgggagtcccaaagag

SEQ ID NO: 926817 - DNA, 25 bp, Mus musculus
gaatggttatacaaatggaattgct

SEQ ID NO: 926818 - DNA, 25 bp, Mus musculus
gaatggttatacagccttaacatgg

SEQ ID NO: 926819 - DNA, 25 bp, Mus musculus
gaatggttatactaatggaattgct

SEQ ID NO: 926820 - DNA, 25 bp, Mus musculus
gaatggttatactgccttaacatgg

SEQ ID NO: 926821 - DNA, 25 bp, Mus musculus
gaatggttcacagacatcccagaaa

SEQ ID NO: 926822 - DNA, 25 bp, Mus musculus
gaatggttcacagagatcccagaaa

SEQ ID NO: 926823 - DNA, 25 bp, Mus musculus
gaatggtttttgctctcagtgtgtt

SEQ ID NO: 926824 - DNA, 25 bp, Mus musculus
gaatggtttttggtctcagtgtgtt

SEQ ID NO: 926825 - DNA, 25 bp, Mus musculus
gaatgtactgaacgatttctggtag

SEQ ID NO: 926826 - DNA, 25 bp, Mus musculus
gaatgtactgaaggatttctggtag

SEQ ID NO: 926827 - DNA, 25 bp, Mus musculus
gaatgtattcaacatgctggagact

SEQ ID NO: 926828 - DNA, 25 bp, Mus musculus
gaatgtattcaacgtctgcgacgag

SEQ ID NO: 926829 - DNA, 25 bp, Mus musculus
gaatgtattcaagatgctggagact

SEQ ID NO: 926830 - DNA, 25 bp, Mus musculus
gaatgtattcaaggtctgcgacgag

SEQ ID NO: 926831 - DNA, 25 bp, Mus musculus
gaatgtcaagctggcagtgtttttt

SEQ ID NO: 926832 - DNA, 25 bp, Mus musculus
gaatgtcaaggtggcagtgtttttt

SEQ ID NO: 926833 - DNA, 25 bp, Mus musculus
gaatgtcgaagaaacttactgcagc

SEQ ID NO: 926834 - DNA, 25 bp, Mus musculus
gaatgtcgaagaaagttactgcagc

SEQ ID NO: 926835 - DNA, 25 bp, Mus musculus
gaatgtgaagaatagtcctgtccca

SEQ ID NO: 926836 - DNA, 25 bp, Mus musculus
gaatgtgaagagatctcaggggtca

SEQ ID NO: 926837 - DNA, 25 bp, Mus musculus
gaatgtgaagtatagtcctgtccca

SEQ ID NO: 926838 - DNA, 25 bp, Mus musculus
gaatgtgaagtgatctcaggggtca

SEQ ID NO: 926839 - DNA, 25 bp, Mus musculus
gaatgtgacatgaaagtggattttg

SEQ ID NO: 926840 - DNA, 25 bp, Mus musculus
gaatgtgacatgaatgtggattttg

SEQ ID NO: 926841 - DNA, 25 bp, Mus musculus
gaatgtgctgcacattctggaggcg

SEQ ID NO: 926842 - DNA, 25 bp, Mus musculus
gaatgtgctgcagattctggaggcg

SEQ ID NO: 926843 - DNA, 25 bp, Mus musculus
gaatgtggagccactgtatggcttc

SEQ ID NO: 926844 - DNA, 25 bp, Mus musculus
gaatgtggagcccagtgctctccag

SEQ ID NO: 926845 - DNA, 25 bp, Mus musculus
gaatgtggaggcactgtatggcttc

SEQ ID NO: 926846 - DNA, 25 bp, Mus musculus
gaatgtggaggccagtgctctccag

SEQ ID NO: 926847 - DNA, 25 bp, Mus musculus
gaatgtggctcacgcttattatgcc

SEQ ID NO: 926848 - DNA, 25 bp, Mus musculus
gaatgtggctcaggcttattatgcc

SEQ ID NO: 926849 - DNA, 25 bp, Mus musculus
gaatgtgtaaatgtaaagtgtgggc

SEQ ID NO: 926850 - DNA, 25 bp, Mus musculus
gaatgtgtaattgtaaagtgtgggc

SEQ ID NO: 926851 - DNA, 25 bp, Mus musculus
gaatgtgtggatgtgaatgagtgtg

SEQ ID NO: 926852 - DNA, 25 bp, Mus musculus
gaatgtgtggttgtgaatgagtgtg

SEQ ID NO: 926853 - DNA, 25 bp, Mus musculus
gaatgtgttaagcaagtgataagta

SEQ ID NO: 926854 - DNA, 25 bp, Mus musculus
gaatgtgttaaggaagtgataagta

SEQ ID NO: 926855 - DNA, 25 bp, Mus musculus
gaatgtgttagaccttcgaagccga

SEQ ID NO: 926856 - DNA, 25 bp, Mus musculus
gaatgtgttagagcttcgaagccga

SEQ ID NO: 926857 - DNA, 25 bp, Mus musculus
gaatgttcacctatcgctgcacgtg

SEQ ID NO: 926858 - DNA, 25 bp, Mus musculus
gaatgttcacctatggctgcacgtg

SEQ ID NO: 926859 - DNA, 25 bp, Mus musculus
gaatgttcagacgtcgtctggacag

SEQ ID NO: 926860 - DNA, 25 bp, Mus musculus
gaatgttcagacgtggtctggacag

SEQ ID NO: 926861 - DNA, 25 bp, Mus musculus
gaatgtttggatattgatgagtgtg

SEQ ID NO: 926862 - DNA, 25 bp, Mus musculus
gaatgtttggttattgatgagtgtg

SEQ ID NO: 926863 - DNA, 25 bp, Mus musculus
gaattaaactagccctgaggagcga

SEQ ID NO: 926864 - DNA, 25 bp, Mus musculus
gaattaaactaggcctgaggagcga

SEQ ID NO: 926865 - DNA, 25 bp, Mus musculus
gaattacactcgaccttgtcaaaag

SEQ ID NO: 926866 - DNA, 25 bp, Mus musculus
gaattacactcgtccttgtcaaaag

SEQ ID NO: 926867 - DNA, 25 bp, Mus musculus
gaattaccgatgcatctggtggccc

SEQ ID NO: 926868 - DNA, 25 bp, Mus musculus
gaattaccgatggatctggtggccc

SEQ ID NO: 926869 - DNA, 25 bp, Mus musculus
gaattacgctcacccacaacagtca

SEQ ID NO: 926870 - DNA, 25 bp, Mus musculus
gaattacgctgacccacaacagtca

SEQ ID NO: 926871 - DNA, 25 bp, Mus musculus
gaattagctgcacactcaagtgcga

SEQ ID NO: 926872 - DNA, 25 bp, Mus musculus
gaattagctggacactcaagtgcga

SEQ ID NO: 926873 - DNA, 25 bp, Mus musculus
gaattataaaaacgcacagaagaat

SEQ ID NO: 926874 - DNA, 25 bp, Mus musculus
gaattataaaaaggcacagaagaat

SEQ ID NO: 926875 - DNA, 25 bp, Mus musculus
gaattatctgagcaaggctacctgg

SEQ ID NO: 926876 - DNA, 25 bp, Mus musculus
gaattatctgaggaaggctacctgg

SEQ ID NO: 926877 - DNA, 25 bp, Mus musculus
gaattatgagcacgatcagtatgag

SEQ ID NO: 926878 - DNA, 25 bp, Mus musculus
gaattatgagcaggatcagtatgag

SEQ ID NO: 926879 - DNA, 25 bp, Mus musculus
gaattatggaagcccctgcattcaa

SEQ ID NO: 926880 - DNA, 25 bp, Mus musculus
gaattatggaaggccctgcattcaa

SEQ ID NO: 926881 - DNA, 25 bp, Mus musculus
gaattcaacagacaaaagaggagtt

SEQ ID NO: 926882 - DNA, 25 bp, Mus musculus
gaattcaacagacaaatagaagagg

SEQ ID NO: 926883 - DNA, 25 bp, Mus musculus
gaattcaacagacaagtcaagagca

SEQ ID NO: 926884 - DNA, 25 bp, Mus musculus
gaattcaacagacataagaggagtt

SEQ ID NO: 926885 - DNA, 25 bp, Mus musculus
gaattcaacagacatatagaagagg

SEQ ID NO: 926886 - DNA, 25 bp, Mus musculus
gaattcaacagacatgtcaagagca

SEQ ID NO: 926887 - DNA, 25 bp, Mus musculus
gaattcacagaagtccctgaagtac

SEQ ID NO: 926888 - DNA, 25 bp, Mus musculus
gaattcacagaagtgcctgaagtac

SEQ ID NO: 926889 - DNA, 25 bp, Mus musculus
gaattcagagtgagcgtctggtcaa

SEQ ID NO: 926890 - DNA, 25 bp, Mus musculus
gaattcagagtgagggtctggtcaa

SEQ ID NO: 926891 - DNA, 25 bp, Mus musculus
gaattcagggggcaggatgacttgt

SEQ ID NO: 926892 - DNA, 25 bp, Mus musculus
gaattcaggggggaggatgacttgt

SEQ ID NO: 926893 - DNA, 25 bp, Mus musculus
gaattcatgctacaattgggcaagg

SEQ ID NO: 926894 - DNA, 25 bp, Mus musculus
gaattcatgctagaattgggcaagg

SEQ ID NO: 926895 - DNA, 25 bp, Mus musculus
gaattccaaaaagcatagcttgtgt

SEQ ID NO: 926896 - DNA, 25 bp, Mus musculus
gaattccaaaagcttacttttctgg

SEQ ID NO: 926897 - DNA, 25 bp, Mus musculus
gaattccaaatagcatagcttgtgt

SEQ ID NO: 926898 - DNA, 25 bp, Mus musculus
gaattccaaatgcttacttttctgg

SEQ ID NO: 926899 - DNA, 25 bp, Mus musculus
gaattccaggatgagaacagcaacc

SEQ ID NO: 926900 - DNA, 25 bp, Mus musculus
gaattccaggttgagaacagcaacc

SEQ ID NO: 926901 - DNA, 25 bp, Mus musculus
gaattcccaaatcgatgacaagtgg

SEQ ID NO: 926902 - DNA, 25 bp, Mus musculus
gaattcccaaatggatgacaagtgg

SEQ ID NO: 926903 - DNA, 25 bp, Mus musculus
gaattcctcaagccttttcatgagg

SEQ ID NO: 926904 - DNA, 25 bp, Mus musculus
gaattcctcaaggcttttcatgagg

SEQ ID NO: 926905 - DNA, 25 bp, Mus musculus
gaattcctccagcagtacatcataa

SEQ ID NO: 926906 - DNA, 25 bp, Mus musculus
gaattcctccaggagtacatcataa

SEQ ID NO: 926907 - DNA, 25 bp, Mus musculus
gaattcgaaagagtcgtatctctga

SEQ ID NO: 926908 - DNA, 25 bp, Mus musculus
gaattcgaaagagtggtatctctga

SEQ ID NO: 926909 - DNA, 25 bp, Mus musculus
gaattctatgctaaaaacatgtacc

SEQ ID NO: 926910 - DNA, 25 bp, Mus musculus
gaattctatgctaataacatgtacc

SEQ ID NO: 926911 - DNA, 25 bp, Mus musculus
gaattctccagaaacctccaatcac

SEQ ID NO: 926912 - DNA, 25 bp, Mus musculus
gaattctccagaaagctccaatcac

SEQ ID NO: 926913 - DNA, 25 bp, Mus musculus
gaattctccttcaacgacaactcaa

SEQ ID NO: 926914 - DNA, 25 bp, Mus musculus
gaattctccttcaaggacaactcaa

SEQ ID NO: 926915 - DNA, 25 bp, Mus musculus
gaattctgggaagacgttggcctgt

SEQ ID NO: 926916 - DNA, 25 bp, Mus musculus
gaattctgggaagaggttggcctgt

SEQ ID NO: 926917 - DNA, 25 bp, Mus musculus
gaattctgtgaaataccacggatag

SEQ ID NO: 926918 - DNA, 25 bp, Mus musculus
gaattctgtgtaataccacggatag

SEQ ID NO: 926919 - DNA, 25 bp, Mus musculus
gaattcttagccaccagagccccag

SEQ ID NO: 926920 - DNA, 25 bp, Mus musculus
gaattcttaggcaccagagccccag

SEQ ID NO: 926921 - DNA, 25 bp, Mus musculus
gaattcttgcagacacctttgtcct

SEQ ID NO: 926922 - DNA, 25 bp, Mus musculus
gaattcttgcagatccgtctacctt

SEQ ID NO: 926923 - DNA, 25 bp, Mus musculus
gaattcttgcagtcacctttgtcct

SEQ ID NO: 926924 - DNA, 25 bp, Mus musculus
gaattcttgcagttccgtctacctt

SEQ ID NO: 926925 - DNA, 25 bp, Mus musculus
gaattgattgagcactctcaaagaa

SEQ ID NO: 926926 - DNA, 25 bp, Mus musculus
gaattgattgaggactctcaaagaa

SEQ ID NO: 926927 - DNA, 25 bp, Mus musculus
gaattgctacagaccacaagaattg

SEQ ID NO: 926928 - DNA, 25 bp, Mus musculus
gaattgctacagctcggctgggagg

SEQ ID NO: 926929 - DNA, 25 bp, Mus musculus
gaattgctacagctgggctgggagg

SEQ ID NO: 926930 - DNA, 25 bp, Mus musculus
gaattgctacagtccacaagaattg

SEQ ID NO: 926931 - DNA, 25 bp, Mus musculus
gaattgctcaggaggctttagaaag

SEQ ID NO: 926932 - DNA, 25 bp, Mus musculus
gaattgctcaggtggctttagaaag

SEQ ID NO: 926933 - DNA, 25 bp, Mus musculus
gaattggatgcacacgagtatgagt

SEQ ID NO: 926934 - DNA, 25 bp, Mus musculus
gaattggatgcacaggagtatgagt

SEQ ID NO: 926935 - DNA, 25 bp, Mus musculus
gaattggcaggcctctccagcttgg

SEQ ID NO: 926936 - DNA, 25 bp, Mus musculus
gaattggcaggcctgtccagcttgg

SEQ ID NO: 926937 - DNA, 25 bp, Mus musculus
gaattggtcctgcctctgtctgtac

SEQ ID NO: 926938 - DNA, 25 bp, Mus musculus
gaattggtcctggctctgtctgtac

SEQ ID NO: 926939 - DNA, 25 bp, Mus musculus
gaattggttaaacatcggaccaaat

SEQ ID NO: 926940 - DNA, 25 bp, Mus musculus
gaattggttaaagatcggaccaaat

SEQ ID NO: 926941 - DNA, 25 bp, Mus musculus
gaattgtagattatttattagaaaa

SEQ ID NO: 926942 - DNA, 25 bp, Mus musculus
gaattgtagattttttattagaaaa

SEQ ID NO: 926943 - DNA, 25 bp, Mus musculus
gaattgtggagttccgtgcgtgctt

SEQ ID NO: 926944 - DNA, 25 bp, Mus musculus
gaattgtggagttcggtgcgtgctt

SEQ ID NO: 926945 - DNA, 25 bp, Mus musculus
gaattgtgtttgtacacccatccct

SEQ ID NO: 926946 - DNA, 25 bp, Mus musculus
gaattgtgtttgtagacccatccct

SEQ ID NO: 926947 - DNA, 25 bp, Mus musculus
gaatttaaatatctctagagtggat

SEQ ID NO: 926948 - DNA, 25 bp, Mus musculus
gaatttaaatatgtctagagtggat

SEQ ID NO: 926949 - DNA, 25 bp, Mus musculus
gaatttatcgacagatacagagttc

SEQ ID NO: 926950 - DNA, 25 bp, Mus musculus
gaatttatcgtcagatacagagttc

SEQ ID NO: 926951 - DNA, 25 bp, Mus musculus
gaatttatgtcccacgcattttctc

SEQ ID NO: 926952 - DNA, 25 bp, Mus musculus
gaatttatgtcccaggcattttctc

SEQ ID NO: 926953 - DNA, 25 bp, Mus musculus
gaatttcaagactgcgagtgctacg

SEQ ID NO: 926954 - DNA, 25 bp, Mus musculus
gaatttcaagtctgcgagtgctacg

SEQ ID NO: 926955 - DNA, 25 bp, Mus musculus
gaatttcaggccagcgaccgagaac

SEQ ID NO: 926956 - DNA, 25 bp, Mus musculus
gaatttcaggccagggaccgagaac

SEQ ID NO: 926957 - DNA, 25 bp, Mus musculus
gaatttccaggcaggctcatggcag

SEQ ID NO: 926958 - DNA, 25 bp, Mus musculus
gaatttccaggctggctcatggcag

SEQ ID NO: 926959 - DNA, 25 bp, Mus musculus
gaatttgaacagaacattggacagc

SEQ ID NO: 926960 - DNA, 25 bp, Mus musculus
gaatttgaacagaagattggacagc

SEQ ID NO: 926961 - DNA, 25 bp, Mus musculus
gaatttgatgagcacagtggtgact

SEQ ID NO: 926962 - DNA, 25 bp, Mus musculus
gaatttgatgaggacagtggtgact

SEQ ID NO: 926963 - DNA, 25 bp, Mus musculus
gaatttgcagccaacgccacagagg

SEQ ID NO: 926964 - DNA, 25 bp, Mus musculus
gaatttgcagccaaggccacagagg

SEQ ID NO: 926965 - DNA, 25 bp, Mus musculus
gaatttgggtacatcgaatatgccc

SEQ ID NO: 926966 - DNA, 25 bp, Mus musculus
gaatttgggtacatggaatatgccc

SEQ ID NO: 926967 - DNA, 25 bp, Mus musculus
gaattttcagagattccttcagtgt

SEQ ID NO: 926968 - DNA, 25 bp, Mus musculus
gaattttcagtgattccttcagtgt

SEQ ID NO: 926969 - DNA, 25 bp, Mus musculus
gaattttgcacgcactcacctgttg

SEQ ID NO: 926970 - DNA, 25 bp, Mus musculus
gaattttgcacggactcacctgttg

SEQ ID NO: 926971 - DNA, 25 bp, Mus musculus
gacaaaaaagccaagcagcaggatg

SEQ ID NO: 926972 - DNA, 25 bp, Mus musculus
gacaaaaaaggcaagcagcaggatg

SEQ ID NO: 926973 - DNA, 25 bp, Mus musculus
gacaaaaacaagcaaacagctctgc

SEQ ID NO: 926974 - DNA, 25 bp, Mus musculus
gacaaaaacaaggaaacagctctgc

SEQ ID NO: 926975 - DNA, 25 bp, Mus musculus
gacaaaaacccaatgccagctcctg

SEQ ID NO: 926976 - DNA, 25 bp, Mus musculus
gacaaaaacccattgccagctcctg

SEQ ID NO: 926977 - DNA, 25 bp, Mus musculus
gacaaaaaggagctggcaatcgttg

SEQ ID NO: 926978 - DNA, 25 bp, Mus musculus
gacaaaaaggaggtggcaatcgttg

SEQ ID NO: 926979 - DNA, 25 bp, Mus musculus
gacaaaacagagaccaagaagaaga

SEQ ID NO: 926980 - DNA, 25 bp, Mus musculus
gacaaaacagcaatggaagccctaa

SEQ ID NO: 926981 - DNA, 25 bp, Mus musculus
gacaaaacaggaatggaagccctaa

SEQ ID NO: 926982 - DNA, 25 bp, Mus musculus
gacaaaacagtgaccaagaagaaga

SEQ ID NO: 926983 - DNA, 25 bp, Mus musculus
gacaaaaccaagcatgtggagtaca

SEQ ID NO: 926984 - DNA, 25 bp, Mus musculus
gacaaaaccaaggatgtggagtaca

SEQ ID NO: 926985 - DNA, 25 bp, Mus musculus
gacaaaagatataaacaggatggtg

SEQ ID NO: 926986 - DNA, 25 bp, Mus musculus
gacaaaagatttaaacaggatggtg

SEQ ID NO: 926987 - DNA, 25 bp, Mus musculus
gacaaaatagcaatgatcgagattg

SEQ ID NO: 926988 - DNA, 25 bp, Mus musculus
gacaaaataggaatgatcgagattg

SEQ ID NO: 926989 - DNA, 25 bp, Mus musculus
gacaaaatcatacagcccatccagt

SEQ ID NO: 926990 - DNA, 25 bp, Mus musculus
gacaaaatcatagagcccatccagt

SEQ ID NO: 926991 - DNA, 25 bp, Mus musculus
gacaaaatgcttcacggccgccttt

SEQ ID NO: 926992 - DNA, 25 bp, Mus musculus
gacaaaatgcttcagggccgccttt

SEQ ID NO: 926993 - DNA, 25 bp, Mus musculus
gacaaacaagacagtaatggcacat

SEQ ID NO: 926994 - DNA, 25 bp, Mus musculus
gacaaacaagtcagtaatggcacat

SEQ ID NO: 926995 - DNA, 25 bp, Mus musculus
gacaaacagccccatttgaccgcaa

SEQ ID NO: 926996 - DNA, 25 bp, Mus musculus
gacaaacagcccgatttgaccgcaa

SEQ ID NO: 926997 - DNA, 25 bp, Mus musculus
gacaaactagacaacatgtcttggg

SEQ ID NO: 926998 - DNA, 25 bp, Mus musculus
gacaaactagacaagatgtcttggg

SEQ ID NO: 926999 - DNA, 25 bp, Mus musculus
gacaaagaaagagacaccagaggga

SEQ ID NO: 927000 - DNA, 25 bp, Mus musculus
gacaaagaaagagacatggcagcag

SEQ ID NO: 927001 - DNA, 25 bp, Mus musculus
gacaaagaaagagagaccagaggga

SEQ ID NO: 927002 - DNA, 25 bp, Mus musculus
gacaaagaaagagagatggcagcag

SEQ ID NO: 927003 - DNA, 25 bp, Mus musculus
gacaaagaacaacgctccgactgtg

SEQ ID NO: 927004 - DNA, 25 bp, Mus musculus
gacaaagaacaaggctccgactgtg

SEQ ID NO: 927005 - DNA, 25 bp, Mus musculus
gacaaagaagcagcaccctccagcc

SEQ ID NO: 927006 - DNA, 25 bp, Mus musculus
gacaaagaagcctggattctcatag

SEQ ID NO: 927007 - DNA, 25 bp, Mus musculus
gacaaagaaggagcaccctccagcc

SEQ ID NO: 927008 - DNA, 25 bp, Mus musculus
gacaaagaaggctggattctcatag

SEQ ID NO: 927009 - DNA, 25 bp, Mus musculus
gacaaagaatatgacttcgaggtcc

SEQ ID NO: 927010 - DNA, 25 bp, Mus musculus
gacaaagaatatgagttcgaggtcc

SEQ ID NO: 927011 - DNA, 25 bp, Mus musculus
gacaaagcagagaatgaggaacaat

SEQ ID NO: 927012 - DNA, 25 bp, Mus musculus
gacaaagcagagtatgaggaacaat

SEQ ID NO: 927013 - DNA, 25 bp, Mus musculus
gacaaaggctttaacctctggtgca

SEQ ID NO: 927014 - DNA, 25 bp, Mus musculus
gacaaaggctttaagctctggtgca

SEQ ID NO: 927015 - DNA, 25 bp, Mus musculus
gacaaagtaattcacgctcaaactg

SEQ ID NO: 927016 - DNA, 25 bp, Mus musculus
gacaaagtaattcaggctcaaactg

SEQ ID NO: 927017 - DNA, 25 bp, Mus musculus
gacaaagtgagaccacgtatagctg

SEQ ID NO: 927018 - DNA, 25 bp, Mus musculus
gacaaagtgagacctcgtatagctg

SEQ ID NO: 927019 - DNA, 25 bp, Mus musculus
gacaaagtttcacgggagctctttg

SEQ ID NO: 927020 - DNA, 25 bp, Mus musculus
gacaaagtttcaggggagctctttg

SEQ ID NO: 927021 - DNA, 25 bp, Mus musculus
gacaaataagatgcacgccatccct

SEQ ID NO: 927022 - DNA, 25 bp, Mus musculus
gacaaataagttgcacgccatccct

SEQ ID NO: 927023 - DNA, 25 bp, Mus musculus
gacaaatctaagcagttgccgttat

SEQ ID NO: 927024 - DNA, 25 bp, Mus musculus
gacaaatctaaggagttgccgttat

SEQ ID NO: 927025 - DNA, 25 bp, Mus musculus
gacaaatctgtccctagtggtggtt

SEQ ID NO: 927026 - DNA, 25 bp, Mus musculus
gacaaatctgtcgctagtggtggtt

SEQ ID NO: 927027 - DNA, 25 bp, Mus musculus
gacaaatgtgaacgccgaggtggta

SEQ ID NO: 927028 - DNA, 25 bp, Mus musculus
gacaaatgtgaaggccgaggtggta

SEQ ID NO: 927029 - DNA, 25 bp, Mus musculus
gacaacaaagacaatgggacatgga

SEQ ID NO: 927030 - DNA, 25 bp, Mus musculus
gacaacaaagctatgtcaccagttg

SEQ ID NO: 927031 - DNA, 25 bp, Mus musculus
gacaacaaaggtatgtcaccagttg

SEQ ID NO: 927032 - DNA, 25 bp, Mus musculus
gacaacaaagtcaatgggacatgga

SEQ ID NO: 927033 - DNA, 25 bp, Mus musculus
gacaacaactcataccaccgaccat

SEQ ID NO: 927034 - DNA, 25 bp, Mus musculus
gacaacaactcatagcaccgaccat

SEQ ID NO: 927035 - DNA, 25 bp, Mus musculus
gacaacaatgcactatagagttaac

SEQ ID NO: 927036 - DNA, 25 bp, Mus musculus
gacaacaatggactatagagttaac

SEQ ID NO: 927037 - DNA, 25 bp, Mus musculus
gacaacacagctaacctcttcgact

SEQ ID NO: 927038 - DNA, 25 bp, Mus musculus
gacaacacagctaagctcttcgact

SEQ ID NO: 927039 - DNA, 25 bp, Mus musculus
gacaacaccatcaacatctgggata

SEQ ID NO: 927040 - DNA, 25 bp, Mus musculus
gacaacaccatcaagatctgggata

SEQ ID NO: 927041 - DNA, 25 bp, Mus musculus
gacaacaccctaatttataggcaat

SEQ ID NO: 927042 - DNA, 25 bp, Mus musculus
gacaacaccctattttataggcaat

SEQ ID NO: 927043 - DNA, 25 bp, Mus musculus
gacaacacctatcacgcaacaattg

SEQ ID NO: 927044 - DNA, 25 bp, Mus musculus
gacaacacctatcaggcaacaattg

SEQ ID NO: 927045 - DNA, 25 bp, Mus musculus
gacaacagagataacactgcaggag

SEQ ID NO: 927046 - DNA, 25 bp, Mus musculus
gacaacagagttaacactgcaggag

SEQ ID NO: 927047 - DNA, 25 bp, Mus musculus
gacaacagggagaaccatgtgctgc

SEQ ID NO: 927048 - DNA, 25 bp, Mus musculus
gacaacagggagaagcatgtgctgc

SEQ ID NO: 927049 - DNA, 25 bp, Mus musculus
gacaacagtctcagccctgcctgct

SEQ ID NO: 927050 - DNA, 25 bp, Mus musculus
gacaacagtctctgccctgcctgct

SEQ ID NO: 927051 - DNA, 25 bp, Mus musculus
gacaacatacagcataagaacaaga

SEQ ID NO: 927052 - DNA, 25 bp, Mus musculus
gacaacatacaggataagaacaaga

SEQ ID NO: 927053 - DNA, 25 bp, Mus musculus
gacaacatcaagctgtctttggact

SEQ ID NO: 927054 - DNA, 25 bp, Mus musculus
gacaacatcaaggtgtctttggact

SEQ ID NO: 927055 - DNA, 25 bp, Mus musculus
gacaacatcaggccctggctcacag

SEQ ID NO: 927056 - DNA, 25 bp, Mus musculus
gacaacatcagggcctggctcacag

SEQ ID NO: 927057 - DNA, 25 bp, Mus musculus
gacaacatctggagagagacttgcc

SEQ ID NO: 927058 - DNA, 25 bp, Mus musculus
gacaacatctggtgagagacttgcc

SEQ ID NO: 927059 - DNA, 25 bp, Mus musculus
gacaacattacacgcacgtccactg

SEQ ID NO: 927060 - DNA, 25 bp, Mus musculus
gacaacattacaggcacgtccactg

SEQ ID NO: 927061 - DNA, 25 bp, Mus musculus
gacaaccacactctccattttgagt

SEQ ID NO: 927062 - DNA, 25 bp, Mus musculus
gacaaccacactgtccattttgagt

SEQ ID NO: 927063 - DNA, 25 bp, Mus musculus
gacaaccaggctggtgcccccaact

SEQ ID NO: 927064 - DNA, 25 bp, Mus musculus
gacaaccagggtgaaggcgggctag

SEQ ID NO: 927065 - DNA, 25 bp, Mus musculus
gacaaccagggtgatggcgggctag

SEQ ID NO: 927066 - DNA, 25 bp, Mus musculus
gacaaccagggtggtgcccccaact

SEQ ID NO: 927067 - DNA, 25 bp, Mus musculus
gacaacccagccgctaagcgagtgc

SEQ ID NO: 927068 - DNA, 25 bp, Mus musculus
gacaacccaggcgctaagcgagtgc

SEQ ID NO: 927069 - DNA, 25 bp, Mus musculus
gacaacgaagctgaccccatctctg

SEQ ID NO: 927070 - DNA, 25 bp, Mus musculus
gacaacgaaggtgaccccatctctg

SEQ ID NO: 927071 - DNA, 25 bp, Mus musculus
gacaacgagcgactggtgacgtatg

SEQ ID NO: 927072 - DNA, 25 bp, Mus musculus
gacaacgagcgacttgggatggcta

SEQ ID NO: 927073 - DNA, 25 bp, Mus musculus
gacaacgagcgagtggtgacgtatg

SEQ ID NO: 927074 - DNA, 25 bp, Mus musculus
gacaacgagcgagttgggatggcta

SEQ ID NO: 927075 - DNA, 25 bp, Mus musculus
gacaacgatcagcaaatcatcccca

SEQ ID NO: 927076 - DNA, 25 bp, Mus musculus
gacaacgatcaggaaatcatcccca

SEQ ID NO: 927077 - DNA, 25 bp, Mus musculus
gacaacggatcgagaaagctacaga

SEQ ID NO: 927078 - DNA, 25 bp, Mus musculus
gacaacggatcgctcttggaaacat

SEQ ID NO: 927079 - DNA, 25 bp, Mus musculus
gacaacggatcggtcttggaaacat

SEQ ID NO: 927080 - DNA, 25 bp, Mus musculus
gacaacggatcgtgaaagctacaga

SEQ ID NO: 927081 - DNA, 25 bp, Mus musculus
gacaactacggaaacaatgatgaag

SEQ ID NO: 927082 - DNA, 25 bp, Mus musculus
gacaactacggaaacatcagaaaca

SEQ ID NO: 927083 - DNA, 25 bp, Mus musculus
gacaactacggaaacgtgactcaga

SEQ ID NO: 927084 - DNA, 25 bp, Mus musculus
gacaactacggaaagaatgatgaag

SEQ ID NO: 927085 - DNA, 25 bp, Mus musculus
gacaactacggaaagatcagaaaca

SEQ ID NO: 927086 - DNA, 25 bp, Mus musculus
gacaactacggaaaggtgactcaga

SEQ ID NO: 927087 - DNA, 25 bp, Mus musculus
gacaactgaaagctctctcggcgta

SEQ ID NO: 927088 - DNA, 25 bp, Mus musculus
gacaactgaaaggtctctcggcgta

SEQ ID NO: 927089 - DNA, 25 bp, Mus musculus
gacaactgccagcttatctgtgcga

SEQ ID NO: 927090 - DNA, 25 bp, Mus musculus
gacaactgccaggttatctgtgcga

SEQ ID NO: 927091 - DNA, 25 bp, Mus musculus
gacaacttaacaatgtggacatcgg

SEQ ID NO: 927092 - DNA, 25 bp, Mus musculus
gacaacttaacattgtggacatcgg

SEQ ID NO: 927093 - DNA, 25 bp, Mus musculus
gacaagaaaaatatcgctgtagtgc

SEQ ID NO: 927094 - DNA, 25 bp, Mus musculus
gacaagaaaaatttcgctgtagtgc

SEQ ID NO: 927095 - DNA, 25 bp, Mus musculus
gacaagaaaattcagcccagagtgc

SEQ ID NO: 927096 - DNA, 25 bp, Mus musculus
gacaagaaaattctgcccagggatt

SEQ ID NO: 927097 - DNA, 25 bp, Mus musculus
gacaagaaaattgagcccagagtgc

SEQ ID NO: 927098 - DNA, 25 bp, Mus musculus
gacaagaaaattgtgcccagggatt

SEQ ID NO: 927099 - DNA, 25 bp, Mus musculus
gacaagaaagcaattgtggaccagt

SEQ ID NO: 927100 - DNA, 25 bp, Mus musculus
gacaagaaaggaattgtggaccagt

SEQ ID NO: 927101 - DNA, 25 bp, Mus musculus
gacaagaagccacacgaatcctgac

SEQ ID NO: 927102 - DNA, 25 bp, Mus musculus
gacaagaagccacaggaatcctgac

SEQ ID NO: 927103 - DNA, 25 bp, Mus musculus
gacaagaaggcaagcaagcctggct

SEQ ID NO: 927104 - DNA, 25 bp, Mus musculus
gacaagaaggcaagcctggctgtag

SEQ ID NO: 927105 - DNA, 25 bp, Mus musculus
gacaagaaggcaccagactttgtgt

SEQ ID NO: 927106 - DNA, 25 bp, Mus musculus
gacaagaaggcacctgactttgtgt

SEQ ID NO: 927107 - DNA, 25 bp, Mus musculus
gacaagaagggaagcaagcctggct

SEQ ID NO: 927108 - DNA, 25 bp, Mus musculus
gacaagaagggaagcctggctgtag

SEQ ID NO: 927109 - DNA, 25 bp, Mus musculus
gacaagaatacacggaaaatggaga

SEQ ID NO: 927110 - DNA, 25 bp, Mus musculus
gacaagaatacagggaaaatggaga

SEQ ID NO: 927111 - DNA, 25 bp, Mus musculus
gacaagaatgaacacagaaaaaagg

SEQ ID NO: 927112 - DNA, 25 bp, Mus musculus
gacaagaatgaagacagaaaaaagg

SEQ ID NO: 927113 - DNA, 25 bp, Mus musculus
gacaagaatgacataggctcgtgag

SEQ ID NO: 927114 - DNA, 25 bp, Mus musculus
gacaagaatgacatatttgccattg

SEQ ID NO: 927115 - DNA, 25 bp, Mus musculus
gacaagaatgacattggctcgtgag

SEQ ID NO: 927116 - DNA, 25 bp, Mus musculus
gacaagaatgacatttttgccattg

SEQ ID NO: 927117 - DNA, 25 bp, Mus musculus
gacaagacagcaaccctgacccaga

SEQ ID NO: 927118 - DNA, 25 bp, Mus musculus
gacaagacaggaaccctgacccaga

SEQ ID NO: 927119 - DNA, 25 bp, Mus musculus
gacaagaggttccacgagacctttg

SEQ ID NO: 927120 - DNA, 25 bp, Mus musculus
gacaagaggttccaggagacctttg

SEQ ID NO: 927121 - DNA, 25 bp, Mus musculus
gacaagagtgcacaggagatgccat

SEQ ID NO: 927122 - DNA, 25 bp, Mus musculus
gacaagagtgcagaggagatgccat

SEQ ID NO: 927123 - DNA, 25 bp, Mus musculus
gacaagatgaacacaaaaacccagc

SEQ ID NO: 927124 - DNA, 25 bp, Mus musculus
gacaagatgaacactaaaacccagc

SEQ ID NO: 927125 - DNA, 25 bp, Mus musculus
gacaagcaaatgatcaaacttcaag

SEQ ID NO: 927126 - DNA, 25 bp, Mus musculus
gacaagcaaatgttcaaacttcaag

SEQ ID NO: 927127 - DNA, 25 bp, Mus musculus
gacaagcagaagctggtgaagctaa

SEQ ID NO: 927128 - DNA, 25 bp, Mus musculus
gacaagcagaaggtggtgaagctaa

SEQ ID NO: 927129 - DNA, 25 bp, Mus musculus
gacaagccgccttccaccatgcagt

SEQ ID NO: 927130 - DNA, 25 bp, Mus musculus
gacaagccgccttcgaccatgcagt

SEQ ID NO: 927131 - DNA, 25 bp, Mus musculus
gacaagctcattcttcagtttggaa

SEQ ID NO: 927132 - DNA, 25 bp, Mus musculus
gacaagctcattgttcagtttggaa

SEQ ID NO: 927133 - DNA, 25 bp, Mus musculus
gacaagctgaaggacgctgaaactc

SEQ ID NO: 927134 - DNA, 25 bp, Mus musculus
gacaagctgaaggaggctgaaactc

SEQ ID NO: 927135 - DNA, 25 bp, Mus musculus
gacaagctgcggaacgatgatccag

SEQ ID NO: 927136 - DNA, 25 bp, Mus musculus
gacaagctgcggaaggatgatccag

SEQ ID NO: 927137 - DNA, 25 bp, Mus musculus
gacaagctggatcacgatgcgggct

SEQ ID NO: 927138 - DNA, 25 bp, Mus musculus
gacaagctggatcaggatgcgggct

SEQ ID NO: 927139 - DNA, 25 bp, Mus musculus
gacaagctggtcaacgtgtggaatc

SEQ ID NO: 927140 - DNA, 25 bp, Mus musculus
gacaagctggtcaaggtgtggaatc

SEQ ID NO: 927141 - DNA, 25 bp, Mus musculus
gacaaggaagactttctctgtgtag

SEQ ID NO: 927142 - DNA, 25 bp, Mus musculus
gacaaggaagcttctgagcctggat

SEQ ID NO: 927143 - DNA, 25 bp, Mus musculus
gacaaggaaggttctgagcctggat

SEQ ID NO: 927144 - DNA, 25 bp, Mus musculus
gacaaggaagtctttctctgtgtag

SEQ ID NO: 927145 - DNA, 25 bp, Mus musculus
gacaaggagaggaacacggactcca

SEQ ID NO: 927146 - DNA, 25 bp, Mus musculus
gacaaggagaggaagacggactcca

SEQ ID NO: 927147 - DNA, 25 bp, Mus musculus
gacaaggaggaccgtgtgccgatgc

SEQ ID NO: 927148 - DNA, 25 bp, Mus musculus
gacaaggaggacggtgtgccgatgc

SEQ ID NO: 927149 - DNA, 25 bp, Mus musculus
gacaaggcaaagaacgaagcatgat

SEQ ID NO: 927150 - DNA, 25 bp, Mus musculus
gacaaggcaaagaaggaagcatgat

SEQ ID NO: 927151 - DNA, 25 bp, Mus musculus
gacaaggcggcacactttctgcact

SEQ ID NO: 927152 - DNA, 25 bp, Mus musculus
gacaaggcggcagactttctgcact

SEQ ID NO: 927153 - DNA, 25 bp, Mus musculus
gacaagggagaattcggtggctttg

SEQ ID NO: 927154 - DNA, 25 bp, Mus musculus
gacaagggagcgaaaattgaatgtg

SEQ ID NO: 927155 - DNA, 25 bp, Mus musculus
gacaagggagggaaaattgaatgtg

SEQ ID NO: 927156 - DNA, 25 bp, Mus musculus
gacaagggagtattcggtggctttg

SEQ ID NO: 927157 - DNA, 25 bp, Mus musculus
gacaaggtggttctcaaacgaagtg

SEQ ID NO: 927158 - DNA, 25 bp, Mus musculus
gacaaggtggttctgaaacgaagtg

SEQ ID NO: 927159 - DNA, 25 bp, Mus musculus
gacaagtacagaaaccttttcaagc

SEQ ID NO: 927160 - DNA, 25 bp, Mus musculus
gacaagtacagataccttttcaagc

SEQ ID NO: 927161 - DNA, 25 bp, Mus musculus
gacaagtggctgccacccgatggcc

SEQ ID NO: 927162 - DNA, 25 bp, Mus musculus
gacaagtggctggcacccgatggcc

SEQ ID NO: 927163 - DNA, 25 bp, Mus musculus
gacaagttcacagacctccagaaag

SEQ ID NO: 927164 - DNA, 25 bp, Mus musculus
gacaagttcacagagctccagaaag

SEQ ID NO: 927165 - DNA, 25 bp, Mus musculus
gacaatattcaaccaatggtgattg

SEQ ID NO: 927166 - DNA, 25 bp, Mus musculus
gacaatattcaagcaatggtgattg

SEQ ID NO: 927167 - DNA, 25 bp, Mus musculus
gacaatcatgcctgtcatggtatcc

SEQ ID NO: 927168 - DNA, 25 bp, Mus musculus
gacaatcatggctgtcatggtatcc

SEQ ID NO: 927169 - DNA, 25 bp, Mus musculus
gacaatctcaccctgtggacgtcag

SEQ ID NO: 927170 - DNA, 25 bp, Mus musculus
gacaatctcaccgtgtggacgtcag

SEQ ID NO: 927171 - DNA, 25 bp, Mus musculus
gacaatgaaaacctatccaacggtt

SEQ ID NO: 927172 - DNA, 25 bp, Mus musculus
gacaatgaaaacgtatccaacggtt

SEQ ID NO: 927173 - DNA, 25 bp, Mus musculus
gacaatgaaacccagaaaattagcc

SEQ ID NO: 927174 - DNA, 25 bp, Mus musculus
gacaatgaaagccagaaaattagcc

SEQ ID NO: 927175 - DNA, 25 bp, Mus musculus
gacaatgaagagctggggtcagaga

SEQ ID NO: 927176 - DNA, 25 bp, Mus musculus
gacaatgaagaggtggggtcagaga

SEQ ID NO: 927177 - DNA, 25 bp, Mus musculus
gacaatgacccggatggcgtgggtg

SEQ ID NO: 927178 - DNA, 25 bp, Mus musculus
gacaatgaccgggatggcgtgggtg

SEQ ID NO: 927179 - DNA, 25 bp, Mus musculus
gacaatgcagagctgaaaggaggac

SEQ ID NO: 927180 - DNA, 25 bp, Mus musculus
gacaatgcagcacatttctgccagc

SEQ ID NO: 927181 - DNA, 25 bp, Mus musculus
gacaatgcagcagatttctgccagc

SEQ ID NO: 927182 - DNA, 25 bp, Mus musculus
gacaatgcagcttcacttggttcac

SEQ ID NO: 927183 - DNA, 25 bp, Mus musculus
gacaatgcaggttcacttggttcac

SEQ ID NO: 927184 - DNA, 25 bp, Mus musculus
gacaatgcagtgctgaaaggaggac

SEQ ID NO: 927185 - DNA, 25 bp, Mus musculus
gacaatgcctagaacagtggttctt

SEQ ID NO: 927186 - DNA, 25 bp, Mus musculus
gacaatgcctagaacgggcaatgtc

SEQ ID NO: 927187 - DNA, 25 bp, Mus musculus
gacaatgcctagaagagtggttctt

SEQ ID NO: 927188 - DNA, 25 bp, Mus musculus
gacaatgcctagaaggggcaatgtc

SEQ ID NO: 927189 - DNA, 25 bp, Mus musculus
gacaatgctctcagcgaaaattcca

SEQ ID NO: 927190 - DNA, 25 bp, Mus musculus
gacaatgctctcagggaaaattcca

SEQ ID NO: 927191 - DNA, 25 bp, Mus musculus
gacaatggaagaccacatagataca

SEQ ID NO: 927192 - DNA, 25 bp, Mus musculus
gacaatggaagagcacatagataca

SEQ ID NO: 927193 - DNA, 25 bp, Mus musculus
gacaatggggcacgtaaaattgtac

SEQ ID NO: 927194 - DNA, 25 bp, Mus musculus
gacaatggggcacgtgctgatactg

SEQ ID NO: 927195 - DNA, 25 bp, Mus musculus
gacaatggggcaggtaaaattgtac

SEQ ID NO: 927196 - DNA, 25 bp, Mus musculus
gacaatggggcaggtgctgatactg

SEQ ID NO: 927197 - DNA, 25 bp, Mus musculus
gacaatgtcactcacgtgcggacat

SEQ ID NO: 927198 - DNA, 25 bp, Mus musculus
gacaatgtcactcaggtgcggacat

SEQ ID NO: 927199 - DNA, 25 bp, Mus musculus
gacaatgtcccacatccagatcaaa

SEQ ID NO: 927200 - DNA, 25 bp, Mus musculus
gacaatgtcccagatccagatcaaa

SEQ ID NO: 927201 - DNA, 25 bp, Mus musculus
gacaattaagattgatcctgaattg

SEQ ID NO: 927202 - DNA, 25 bp, Mus musculus
gacaattaagtttgatcctgaattg

SEQ ID NO: 927203 - DNA, 25 bp, Mus musculus
gacaattacgctgcccgagggccag

SEQ ID NO: 927204 - DNA, 25 bp, Mus musculus
gacaattacggtgcccgagggccag

SEQ ID NO: 927205 - DNA, 25 bp, Mus musculus
gacaattgggacattgaagaagcca

SEQ ID NO: 927206 - DNA, 25 bp, Mus musculus
gacaattgggtcattgaagaagcca

SEQ ID NO: 927207 - DNA, 25 bp, Mus musculus
gacaattttcagcgggtgctgcaga

SEQ ID NO: 927208 - DNA, 25 bp, Mus musculus
gacaattttcagggggtgctgcaga

SEQ ID NO: 927209 - DNA, 25 bp, Mus musculus
gacacaaacgagctataagtattgt

SEQ ID NO: 927210 - DNA, 25 bp, Mus musculus
gacacaaacgaggtataagtattgt

SEQ ID NO: 927211 - DNA, 25 bp, Mus musculus
gacacaacaaatagcatggtagaat

SEQ ID NO: 927212 - DNA, 25 bp, Mus musculus
gacacaacaaattgcatggtagaat

SEQ ID NO: 927213 - DNA, 25 bp, Mus musculus
gacacaacagagccttccacttcta

SEQ ID NO: 927214 - DNA, 25 bp, Mus musculus
gacacaacagaggcttccacttcta

SEQ ID NO: 927215 - DNA, 25 bp, Mus musculus
gacacaactgcctgcatgtagatga

SEQ ID NO: 927216 - DNA, 25 bp, Mus musculus
gacacaactgcctggatgtagatga

SEQ ID NO: 927217 - DNA, 25 bp, Mus musculus
gacacacaattgcgccggcggcggc

SEQ ID NO: 927218 - DNA, 25 bp, Mus musculus
gacacacaattgctggacgcagacg

SEQ ID NO: 927219 - DNA, 25 bp, Mus musculus
gacacacaattgggccggcggcggc

SEQ ID NO: 927220 - DNA, 25 bp, Mus musculus
gacacacaattggtggacgcagacg

SEQ ID NO: 927221 - DNA, 25 bp, Mus musculus
gacacaccagagataccatgatggc

SEQ ID NO: 927222 - DNA, 25 bp, Mus musculus
gacacaccagagcagataccatgat

SEQ ID NO: 927223 - DNA, 25 bp, Mus musculus
gacacaccagaggagataccatgat

SEQ ID NO: 927224 - DNA, 25 bp, Mus musculus
gacacaccagagttaccatgatggc

SEQ ID NO: 927225 - DNA, 25 bp, Mus musculus
gacacactagccctcggaaagacgc

SEQ ID NO: 927226 - DNA, 25 bp, Mus musculus
gacacactaggcctcggaaagacgc

SEQ ID NO: 927227 - DNA, 25 bp, Mus musculus
gacacactccatcacttctcatcgc

SEQ ID NO: 927228 - DNA, 25 bp, Mus musculus
gacacactccatcagttctcatcgc

SEQ ID NO: 927229 - DNA, 25 bp, Mus musculus
gacacagaagactttgttgctggcg

SEQ ID NO: 927230 - DNA, 25 bp, Mus musculus
gacacagaagagtatatggttgtcc

SEQ ID NO: 927231 - DNA, 25 bp, Mus musculus
gacacagaagtctttgttgctggcg

SEQ ID NO: 927232 - DNA, 25 bp, Mus musculus
gacacagaagtgtatatggttgtcc

SEQ ID NO: 927233 - DNA, 25 bp, Mus musculus
gacacagaccagctgggagcatgcc

SEQ ID NO: 927234 - DNA, 25 bp, Mus musculus
gacacagaccaggtgggagcatgcc

SEQ ID NO: 927235 - DNA, 25 bp, Mus musculus
gacacagacttctccgtgaaggagg

SEQ ID NO: 927236 - DNA, 25 bp, Mus musculus
gacacagacttctcggtgaaggagg

SEQ ID NO: 927237 - DNA, 25 bp, Mus musculus
gacacagcagctcgaactcattata

SEQ ID NO: 927238 - DNA, 25 bp, Mus musculus
gacacagcagctggaactcattata

SEQ ID NO: 927239 - DNA, 25 bp, Mus musculus
gacacagcaggacacgcagagttta

SEQ ID NO: 927240 - DNA, 25 bp, Mus musculus
gacacagcaggacaggcagagttta

SEQ ID NO: 927241 - DNA, 25 bp, Mus musculus
gacacagctaagatcacagccatga

SEQ ID NO: 927242 - DNA, 25 bp, Mus musculus
gacacagctaagttcacagccatga

SEQ ID NO: 927243 - DNA, 25 bp, Mus musculus
gacacagctagacctttggatgatg

SEQ ID NO: 927244 - DNA, 25 bp, Mus musculus
gacacagctagagctttggatgatg

SEQ ID NO: 927245 - DNA, 25 bp, Mus musculus
gacacagctctgatgtacgacaaca

SEQ ID NO: 927246 - DNA, 25 bp, Mus musculus
gacacagctctgttgtacgacaaca

SEQ ID NO: 927247 - DNA, 25 bp, Mus musculus
gacacaggtgagtatccagagtgtg

SEQ ID NO: 927248 - DNA, 25 bp, Mus musculus
gacacaggtgcagaatataaatatt

SEQ ID NO: 927249 - DNA, 25 bp, Mus musculus
gacacaggtggagaatataaatatt

SEQ ID NO: 927250 - DNA, 25 bp, Mus musculus
gacacaggtgtgtatccagagtgtg

SEQ ID NO: 927251 - DNA, 25 bp, Mus musculus
gacacagtgactgacataacagcct

SEQ ID NO: 927252 - DNA, 25 bp, Mus musculus
gacacagtgactgagataacagcct

SEQ ID NO: 927253 - DNA, 25 bp, Mus musculus
gacacataatctggacgattgtggc

SEQ ID NO: 927254 - DNA, 25 bp, Mus musculus
gacacataatgtggacgattgtggc

SEQ ID NO: 927255 - DNA, 25 bp, Mus musculus
gacacatacaagagaggtgactacg

SEQ ID NO: 927256 - DNA, 25 bp, Mus musculus
gacacatacaagagtggtgactacg

SEQ ID NO: 927257 - DNA, 25 bp, Mus musculus
gacacatggggagacagggcaatgc

SEQ ID NO: 927258 - DNA, 25 bp, Mus musculus
gacacatggggagagagggcaatgc

SEQ ID NO: 927259 - DNA, 25 bp, Mus musculus
gacacattattacgtccaggacgcc

SEQ ID NO: 927260 - DNA, 25 bp, Mus musculus
gacacattattaggtccaggacgcc

SEQ ID NO: 927261 - DNA, 25 bp, Mus musculus
gacaccaagctcaacatacccctga

SEQ ID NO: 927262 - DNA, 25 bp, Mus musculus
gacaccaagctcaagatacccctga

SEQ ID NO: 927263 - DNA, 25 bp, Mus musculus
gacaccaaggagtcagtccgaccgc

SEQ ID NO: 927264 - DNA, 25 bp, Mus musculus
gacaccaaggtgtcagtccgaccgc

SEQ ID NO: 927265 - DNA, 25 bp, Mus musculus
gacaccacagagctccttggtagat

SEQ ID NO: 927266 - DNA, 25 bp, Mus musculus
gacaccacagcaaagaatgtttcca

SEQ ID NO: 927267 - DNA, 25 bp, Mus musculus
gacaccacaggaaagaatgtttcca

SEQ ID NO: 927268 - DNA, 25 bp, Mus musculus
gacaccacagtgctccttggtagat

SEQ ID NO: 927269 - DNA, 25 bp, Mus musculus
gacaccaccaagatcccatggtttc

SEQ ID NO: 927270 - DNA, 25 bp, Mus musculus
gacaccaccaagttcccatggtttc

SEQ ID NO: 927271 - DNA, 25 bp, Mus musculus
gacaccatcaagcacccaggaggta

SEQ ID NO: 927272 - DNA, 25 bp, Mus musculus
gacaccatcaagctctgggaaggtc

SEQ ID NO: 927273 - DNA, 25 bp, Mus musculus
gacaccatcaaggacccaggaggta

SEQ ID NO: 927274 - DNA, 25 bp, Mus musculus
gacaccatcaaggtctgggaaggtc

SEQ ID NO: 927275 - DNA, 25 bp, Mus musculus
gacaccatgaaacgtctatcatgac

SEQ ID NO: 927276 - DNA, 25 bp, Mus musculus
gacaccatgaaaggtctatcatgac

SEQ ID NO: 927277 - DNA, 25 bp, Mus musculus
gacacccagcctgcagtcctgggtg

SEQ ID NO: 927278 - DNA, 25 bp, Mus musculus
gacacccagcctgctgtcctgggtg

SEQ ID NO: 927279 - DNA, 25 bp, Mus musculus
gacaccccaatctccatatgtttga

SEQ ID NO: 927280 - DNA, 25 bp, Mus musculus
gacaccccaatctcctagatatgtt

SEQ ID NO: 927281 - DNA, 25 bp, Mus musculus
gacaccccaatctcgatatgtttga

SEQ ID NO: 927282 - DNA, 25 bp, Mus musculus
gacaccccaatctcgtagatatgtt

SEQ ID NO: 927283 - DNA, 25 bp, Mus musculus
gacaccccggatgacccctgggcat

SEQ ID NO: 927284 - DNA, 25 bp, Mus musculus
gacaccccggatgagccctgggcat

SEQ ID NO: 927285 - DNA, 25 bp, Mus musculus
gacaccctgagacaatgttggctca

SEQ ID NO: 927286 - DNA, 25 bp, Mus musculus
gacaccctgagagaatgttggctca

SEQ ID NO: 927287 - DNA, 25 bp, Mus musculus
gacaccctttcagttgaaacttcac

SEQ ID NO: 927288 - DNA, 25 bp, Mus musculus
gacaccctttgagttgaaacttcac

SEQ ID NO: 927289 - DNA, 25 bp, Mus musculus
gacaccgagaatctctcctcccacg

SEQ ID NO: 927290 - DNA, 25 bp, Mus musculus
gacaccgagaatctgtcctcccacg

SEQ ID NO: 927291 - DNA, 25 bp, Mus musculus
gacaccgcagccagtgtccttgtcc

SEQ ID NO: 927292 - DNA, 25 bp, Mus musculus
gacaccgcaggcagtgtccttgtcc

SEQ ID NO: 927293 - DNA, 25 bp, Mus musculus
gacaccgccagcactgctgtggctg

SEQ ID NO: 927294 - DNA, 25 bp, Mus musculus
gacaccgccagctctgctgtggctg

SEQ ID NO: 927295 - DNA, 25 bp, Mus musculus
gacaccgcgcagatctcaagcatac

SEQ ID NO: 927296 - DNA, 25 bp, Mus musculus
gacaccgcgcagttctcaagcatac

SEQ ID NO: 927297 - DNA, 25 bp, Mus musculus
gacaccgtacgacgcagctgtggcc

SEQ ID NO: 927298 - DNA, 25 bp, Mus musculus
gacaccgtacgaggcagctgtggcc

SEQ ID NO: 927299 - DNA, 25 bp, Mus musculus
gacacctaagctgaaggcgataaag

SEQ ID NO: 927300 - DNA, 25 bp, Mus musculus
gacacctaaggtgaaggcgataaag

SEQ ID NO: 927301 - DNA, 25 bp, Mus musculus
gacacctacgtcaccctgagagtga

SEQ ID NO: 927302 - DNA, 25 bp, Mus musculus
gacacctacgtcacgctgagagtga

SEQ ID NO: 927303 - DNA, 25 bp, Mus musculus
gacacctatgaacttgcgatgtagc

SEQ ID NO: 927304 - DNA, 25 bp, Mus musculus
gacacctatgatttcaaagatacat

SEQ ID NO: 927305 - DNA, 25 bp, Mus musculus
gacacctatgtacttgcgatgtagc

SEQ ID NO: 927306 - DNA, 25 bp, Mus musculus
gacacctatgttttcaaagatacat

SEQ ID NO: 927307 - DNA, 25 bp, Mus musculus
gacacctcagcgcacacttgccgag

SEQ ID NO: 927308 - DNA, 25 bp, Mus musculus
gacacctcagggcacacttgccgag

SEQ ID NO: 927309 - DNA, 25 bp, Mus musculus
gacacctgagcatttgacggccatt

SEQ ID NO: 927310 - DNA, 25 bp, Mus musculus
gacacctgaggatttgacggccatt

SEQ ID NO: 927311 - DNA, 25 bp, Mus musculus
gacacctggcataacgccactcaga

SEQ ID NO: 927312 - DNA, 25 bp, Mus musculus
gacacctggcataaggccactcaga

SEQ ID NO: 927313 - DNA, 25 bp, Mus musculus
gacacctgggaacccatggagaaat

SEQ ID NO: 927314 - DNA, 25 bp, Mus musculus
gacacctgggaagccatggagaaat

SEQ ID NO: 927315 - DNA, 25 bp, Mus musculus
gacacctgggaccacgtctttgtct

SEQ ID NO: 927316 - DNA, 25 bp, Mus musculus
gacacctgggaccacgtgttcttgt

SEQ ID NO: 927317 - DNA, 25 bp, Mus musculus
gacacctgggaccaggtctttgtct

SEQ ID NO: 927318 - DNA, 25 bp, Mus musculus
gacacctgggaccaggtgttcttgt

SEQ ID NO: 927319 - DNA, 25 bp, Mus musculus
gacacctgtccagcaagctgtgcta

SEQ ID NO: 927320 - DNA, 25 bp, Mus musculus
gacacctgtccagctagctgtgcta

SEQ ID NO: 927321 - DNA, 25 bp, Mus musculus
gacacgatcgctcagatgtcctgta

SEQ ID NO: 927322 - DNA, 25 bp, Mus musculus
gacacgatcggtcagatgtcctgta

SEQ ID NO: 927323 - DNA, 25 bp, Mus musculus
gacacgattcaccaggtcctgtaat

SEQ ID NO: 927324 - DNA, 25 bp, Mus musculus
gacacgattcacgaggtcctgtaat

SEQ ID NO: 927325 - DNA, 25 bp, Mus musculus
gacacgcaccagaggtatgtgtgca

SEQ ID NO: 927326 - DNA, 25 bp, Mus musculus
gacacgcaccagtggtatgtgtgca

SEQ ID NO: 927327 - DNA, 25 bp, Mus musculus
gacacgcaggaccaccagaagctct

SEQ ID NO: 927328 - DNA, 25 bp, Mus musculus
gacacgcaggtccaccagaagctct

SEQ ID NO: 927329 - DNA, 25 bp, Mus musculus
gacacggagcagcccaccttgggac

SEQ ID NO: 927330 - DNA, 25 bp, Mus musculus
gacacggagcaggccaccttgggac

SEQ ID NO: 927331 - DNA, 25 bp, Mus musculus
gacacggagtggcagacttcttggg

SEQ ID NO: 927332 - DNA, 25 bp, Mus musculus
gacacggagtgggagacttcttggg

SEQ ID NO: 927333 - DNA, 25 bp, Mus musculus
gacacggcagaggacattaacaaca

SEQ ID NO: 927334 - DNA, 25 bp, Mus musculus
gacacggcagaggagattaacaaca

SEQ ID NO: 927335 - DNA, 25 bp, Mus musculus
gacacggggctgcacgtcacagcgg

SEQ ID NO: 927336 - DNA, 25 bp, Mus musculus
gacacggggctgcaggtcacagcgg

SEQ ID NO: 927337 - DNA, 25 bp, Mus musculus
gacacgtacacgctttatgtcatcc

SEQ ID NO: 927338 - DNA, 25 bp, Mus musculus
gacacgtacacggtttatgtcatcc

SEQ ID NO: 927339 - DNA, 25 bp, Mus musculus
gacacgtacctcaggccaagtgctt

SEQ ID NO: 927340 - DNA, 25 bp, Mus musculus
gacacgtacctctggccaagtgctt

SEQ ID NO: 927341 - DNA, 25 bp, Mus musculus
gacactacaaagctcgagtatgaac

SEQ ID NO: 927342 - DNA, 25 bp, Mus musculus
gacactacaaagctggagtatgaac

SEQ ID NO: 927343 - DNA, 25 bp, Mus musculus
gacactattattcccggtgtggaat

SEQ ID NO: 927344 - DNA, 25 bp, Mus musculus
gacactattattccgggtgtggaat

SEQ ID NO: 927345 - DNA, 25 bp, Mus musculus
gacactattgctaacgtgacaagca

SEQ ID NO: 927346 - DNA, 25 bp, Mus musculus
gacactattgctaaggtgacaagca

SEQ ID NO: 927347 - DNA, 25 bp, Mus musculus
gacactccacacgacaggctcacaa

SEQ ID NO: 927348 - DNA, 25 bp, Mus musculus
gacactccacacgacgagccagatg

SEQ ID NO: 927349 - DNA, 25 bp, Mus musculus
gacactccacacgagaggctcacaa

SEQ ID NO: 927350 - DNA, 25 bp, Mus musculus
gacactccacacgaggagccagatg

SEQ ID NO: 927351 - DNA, 25 bp, Mus musculus
gacactccagcccacaattaaccct

SEQ ID NO: 927352 - DNA, 25 bp, Mus musculus
gacactccagcccacatggaggatg

SEQ ID NO: 927353 - DNA, 25 bp, Mus musculus
gacactccagcccaccagacaggag

SEQ ID NO: 927354 - DNA, 25 bp, Mus musculus
gacactccagcccacctggagatgg

SEQ ID NO: 927355 - DNA, 25 bp, Mus musculus
gacactccagcccagaattaaccct

SEQ ID NO: 927356 - DNA, 25 bp, Mus musculus
gacactccagcccagatggaggatg

SEQ ID NO: 927357 - DNA, 25 bp, Mus musculus
gacactccagcccagcagacaggag

SEQ ID NO: 927358 - DNA, 25 bp, Mus musculus
gacactccagcccagctggagatgg

SEQ ID NO: 927359 - DNA, 25 bp, Mus musculus
gacactctgaggatcctggccatga

SEQ ID NO: 927360 - DNA, 25 bp, Mus musculus
gacactctgaggttcctggccatga

SEQ ID NO: 927361 - DNA, 25 bp, Mus musculus
gacactgaaaaccacatttcacatg

SEQ ID NO: 927362 - DNA, 25 bp, Mus musculus
gacactgaaaacgacatttcacatg

SEQ ID NO: 927363 - DNA, 25 bp, Mus musculus
gacactgaaaagcgccatggctact

SEQ ID NO: 927364 - DNA, 25 bp, Mus musculus
gacactgaaaagggccatggctact

SEQ ID NO: 927365 - DNA, 25 bp, Mus musculus
gacactgacctgctgttgctgcacc

SEQ ID NO: 927366 - DNA, 25 bp, Mus musculus
gacactgacctgctgtttacagtgt

SEQ ID NO: 927367 - DNA, 25 bp, Mus musculus
gacactgacctggtgttgctgcacc

SEQ ID NO: 927368 - DNA, 25 bp, Mus musculus
gacactgacctggtgtttacagtgt

SEQ ID NO: 927369 - DNA, 25 bp, Mus musculus
gacactgatcggcaccggggagatc

SEQ ID NO: 927370 - DNA, 25 bp, Mus musculus
gacactgatcgggaccggggagatc

SEQ ID NO: 927371 - DNA, 25 bp, Mus musculus
gacactgcaggacacgaggattaca

SEQ ID NO: 927372 - DNA, 25 bp, Mus musculus
gacactgcaggacaggaggattaca

SEQ ID NO: 927373 - DNA, 25 bp, Mus musculus
gacactgctggtcacctctgcaatc

SEQ ID NO: 927374 - DNA, 25 bp, Mus musculus
gacactgctggtcacgcagagttca

SEQ ID NO: 927375 - DNA, 25 bp, Mus musculus
gacactgctggtcagctctgcaatc

SEQ ID NO: 927376 - DNA, 25 bp, Mus musculus
gacactgctggtcaggcagagttca

SEQ ID NO: 927377 - DNA, 25 bp, Mus musculus
gacactggagagctctacgtctggg

SEQ ID NO: 927378 - DNA, 25 bp, Mus musculus
gacactggagaggtctacgtctggg

SEQ ID NO: 927379 - DNA, 25 bp, Mus musculus
gacactggccagaacgatgtcaatg

SEQ ID NO: 927380 - DNA, 25 bp, Mus musculus
gacactggccagaaggatgtcaatg

SEQ ID NO: 927381 - DNA, 25 bp, Mus musculus
gacactggccagcgaatatggtgtt

SEQ ID NO: 927382 - DNA, 25 bp, Mus musculus
gacactggccagggaatatggtgtt

SEQ ID NO: 927383 - DNA, 25 bp, Mus musculus
gacactggtcagctgaagtaaatga

SEQ ID NO: 927384 - DNA, 25 bp, Mus musculus
gacactggtcaggtgaagtaaatga

SEQ ID NO: 927385 - DNA, 25 bp, Mus musculus
gacactgtatcgcttccatgtaagt

SEQ ID NO: 927386 - DNA, 25 bp, Mus musculus
gacactgtatcggttccatgtaagt

SEQ ID NO: 927387 - DNA, 25 bp, Mus musculus
gacactgtcaagcgcagggtcaaag

SEQ ID NO: 927388 - DNA, 25 bp, Mus musculus
gacactgtcaagggcagggtcaaag

SEQ ID NO: 927389 - DNA, 25 bp, Mus musculus
gacactgtggatacttggccttggt

SEQ ID NO: 927390 - DNA, 25 bp, Mus musculus
gacactgtggcctgtgctctgaatg

SEQ ID NO: 927391 - DNA, 25 bp, Mus musculus
gacactgtgggctgtgctctgaatg

SEQ ID NO: 927392 - DNA, 25 bp, Mus musculus
gacactgtggttacttggccttggt

SEQ ID NO: 927393 - DNA, 25 bp, Mus musculus
gacacttaacagctccccaggcaag

SEQ ID NO: 927394 - DNA, 25 bp, Mus musculus
gacacttaacaggtccccaggcaag

SEQ ID NO: 927395 - DNA, 25 bp, Mus musculus
gacacttaagcgctacttgattagc

SEQ ID NO: 927396 - DNA, 25 bp, Mus musculus
gacacttaagggctacttgattagc

SEQ ID NO: 927397 - DNA, 25 bp, Mus musculus
gacacttcgggccaagtttctcttg

SEQ ID NO: 927398 - DNA, 25 bp, Mus musculus
gacacttcgggccatgtttctcttg

SEQ ID NO: 927399 - DNA, 25 bp, Mus musculus
gacacttctgaccatcttgaccggc

SEQ ID NO: 927400 - DNA, 25 bp, Mus musculus
gacacttctgacgatcttgaccggc

SEQ ID NO: 927401 - DNA, 25 bp, Mus musculus
gacacttgcaggcgagactccggca

SEQ ID NO: 927402 - DNA, 25 bp, Mus musculus
gacacttgcaggggagactccggca

SEQ ID NO: 927403 - DNA, 25 bp, Mus musculus
gacacttgggagcccatggaggacc

SEQ ID NO: 927404 - DNA, 25 bp, Mus musculus
gacacttgggaggccatggaggacc

SEQ ID NO: 927405 - DNA, 25 bp, Mus musculus
gacacttgtgaagcagcaggaagca

SEQ ID NO: 927406 - DNA, 25 bp, Mus musculus
gacacttgtgcaaggaatctgctat

SEQ ID NO: 927407 - DNA, 25 bp, Mus musculus
gacacttgtgcagcattctggaaga

SEQ ID NO: 927408 - DNA, 25 bp, Mus musculus
gacacttgtgcgcaggcccactgat

SEQ ID NO: 927409 - DNA, 25 bp, Mus musculus
gacacttgtgcgcgtgactcaggag

SEQ ID NO: 927410 - DNA, 25 bp, Mus musculus
gacacttgtgcggaggcccactgat

SEQ ID NO: 927411 - DNA, 25 bp, Mus musculus
gacacttgtgcgggtgactcaggag

SEQ ID NO: 927412 - DNA, 25 bp, Mus musculus
gacacttgtggaaggaatctgctat

SEQ ID NO: 927413 - DNA, 25 bp, Mus musculus
gacacttgtggagcattctggaaga

SEQ ID NO: 927414 - DNA, 25 bp, Mus musculus
gacacttgtgtagcagcaggaagca

SEQ ID NO: 927415 - DNA, 25 bp, Mus musculus
gacactttcgcctccaccatggaaa

SEQ ID NO: 927416 - DNA, 25 bp, Mus musculus
gacactttcggctccaccatggaaa

SEQ ID NO: 927417 - DNA, 25 bp, Mus musculus
gacacttttgtgcattacgatgttg

SEQ ID NO: 927418 - DNA, 25 bp, Mus musculus
gacacttttgtggattacgatgttg

SEQ ID NO: 927419 - DNA, 25 bp, Mus musculus
gacagaaacccactcaccgcccagg

SEQ ID NO: 927420 - DNA, 25 bp, Mus musculus
gacagaaacccagtcaccgcccagg

SEQ ID NO: 927421 - DNA, 25 bp, Mus musculus
gacagaaactaaaaataagtgacga

SEQ ID NO: 927422 - DNA, 25 bp, Mus musculus
gacagaaactaaaattaagtgacga

SEQ ID NO: 927423 - DNA, 25 bp, Mus musculus
gacagaacgcagatgtgaactttca

SEQ ID NO: 927424 - DNA, 25 bp, Mus musculus
gacagaacgcagttgtgaactttca

SEQ ID NO: 927425 - DNA, 25 bp, Mus musculus
gacagacaccggcacgtgggtaatg

SEQ ID NO: 927426 - DNA, 25 bp, Mus musculus
gacagacaccggcaggtgggtaatg

SEQ ID NO: 927427 - DNA, 25 bp, Mus musculus
gacagacagctacgacccagaggcc

SEQ ID NO: 927428 - DNA, 25 bp, Mus musculus
gacagacagctaggacccagaggcc

SEQ ID NO: 927429 - DNA, 25 bp, Mus musculus
gacagacataggaacatcaccagca

SEQ ID NO: 927430 - DNA, 25 bp, Mus musculus
gacagacataggaagatcaccagca

SEQ ID NO: 927431 - DNA, 25 bp, Mus musculus
gacagaccggccatcctccttcagc

SEQ ID NO: 927432 - DNA, 25 bp, Mus musculus
gacagaccgggcatcctccttcagc

SEQ ID NO: 927433 - DNA, 25 bp, Mus musculus
gacagactgatgcaactaacagaca

SEQ ID NO: 927434 - DNA, 25 bp, Mus musculus
gacagactgatgcatctaacagaca

SEQ ID NO: 927435 - DNA, 25 bp, Mus musculus
gacagactggagccattctggaatt

SEQ ID NO: 927436 - DNA, 25 bp, Mus musculus
gacagactggaggcattctggaatt

SEQ ID NO: 927437 - DNA, 25 bp, Mus musculus
gacagagaatcgtgcataccatcga

SEQ ID NO: 927438 - DNA, 25 bp, Mus musculus
gacagagaatcgtggataccatcga

SEQ ID NO: 927439 - DNA, 25 bp, Mus musculus
gacagagcagaatttgatactagcg

SEQ ID NO: 927440 - DNA, 25 bp, Mus musculus
gacagagcagcggtgctcttctctc

SEQ ID NO: 927441 - DNA, 25 bp, Mus musculus
gacagagcagctgtcttagctggac

SEQ ID NO: 927442 - DNA, 25 bp, Mus musculus
gacagagcaggggtgctcttctctc

SEQ ID NO: 927443 - DNA, 25 bp, Mus musculus
gacagagcaggtgtcttagctggac

SEQ ID NO: 927444 - DNA, 25 bp, Mus musculus
gacagagcagtatttgatactagcg

SEQ ID NO: 927445 - DNA, 25 bp, Mus musculus
gacagagctcgggacgtacagtggt

SEQ ID NO: 927446 - DNA, 25 bp, Mus musculus
gacagagctcgggacgttcccgtga

SEQ ID NO: 927447 - DNA, 25 bp, Mus musculus
gacagagctcgggaggtacagtggt

SEQ ID NO: 927448 - DNA, 25 bp, Mus musculus
gacagagctcgggaggttcccgtga

SEQ ID NO: 927449 - DNA, 25 bp, Mus musculus
gacagagctgatacagaacattgct

SEQ ID NO: 927450 - DNA, 25 bp, Mus musculus
gacagagctgttacagaacattgct

SEQ ID NO: 927451 - DNA, 25 bp, Mus musculus
gacagaggaaggagcaaatcttcct

SEQ ID NO: 927452 - DNA, 25 bp, Mus musculus
gacagaggaaggaggaaatcttcct

SEQ ID NO: 927453 - DNA, 25 bp, Mus musculus
gacagagggtcacagagatggcaca

SEQ ID NO: 927454 - DNA, 25 bp, Mus musculus
gacagagggtcacttccaggaagac

SEQ ID NO: 927455 - DNA, 25 bp, Mus musculus
gacagagggtcagagagatggcaca

SEQ ID NO: 927456 - DNA, 25 bp, Mus musculus
gacagagggtcagttccaggaagac

SEQ ID NO: 927457 - DNA, 25 bp, Mus musculus
gacagagttaaaatgcttaaagcaa

SEQ ID NO: 927458 - DNA, 25 bp, Mus musculus
gacagagttaaattgcttaaagcaa

SEQ ID NO: 927459 - DNA, 25 bp, Mus musculus
gacagataagcagcgtgcttccggc

SEQ ID NO: 927460 - DNA, 25 bp, Mus musculus
gacagataaggagcgtgcttccggc

SEQ ID NO: 927461 - DNA, 25 bp, Mus musculus
gacagataccagatcgattccatga

SEQ ID NO: 927462 - DNA, 25 bp, Mus musculus
gacagataccagttcgattccatga

SEQ ID NO: 927463 - DNA, 25 bp, Mus musculus
gacagatatcctcactgtttgtgcc

SEQ ID NO: 927464 - DNA, 25 bp, Mus musculus
gacagatatcctcagtgtttgtgcc

SEQ ID NO: 927465 - DNA, 25 bp, Mus musculus
gacagatcagaaccacaattatatg

SEQ ID NO: 927466 - DNA, 25 bp, Mus musculus
gacagatcagaacgcttatggtagc

SEQ ID NO: 927467 - DNA, 25 bp, Mus musculus
gacagatcagaagcacaattatatg

SEQ ID NO: 927468 - DNA, 25 bp, Mus musculus
gacagatcagaaggcttatggtagc

SEQ ID NO: 927469 - DNA, 25 bp, Mus musculus
gacagatcagcaccaagatggttcc

SEQ ID NO: 927470 - DNA, 25 bp, Mus musculus
gacagatcagcagtccttcaataac

SEQ ID NO: 927471 - DNA, 25 bp, Mus musculus
gacagatcaggaccaagatggttcc

SEQ ID NO: 927472 - DNA, 25 bp, Mus musculus
gacagatcaggagtccttcaataac

SEQ ID NO: 927473 - DNA, 25 bp, Mus musculus
gacagatgatatcctggacaaattt

SEQ ID NO: 927474 - DNA, 25 bp, Mus musculus
gacagatgatatgctggacaaattt

SEQ ID NO: 927475 - DNA, 25 bp, Mus musculus
gacagattgctcagccatcacctgt

SEQ ID NO: 927476 - DNA, 25 bp, Mus musculus
gacagattgctctgccatcacctgt

SEQ ID NO: 927477 - DNA, 25 bp, Mus musculus
gacagatttaagagtttgtttctaa

SEQ ID NO: 927478 - DNA, 25 bp, Mus musculus
gacagatttaagcttccttccactg

SEQ ID NO: 927479 - DNA, 25 bp, Mus musculus
gacagatttaaggttccttccactg

SEQ ID NO: 927480 - DNA, 25 bp, Mus musculus
gacagatttaagtgtttgtttctaa

SEQ ID NO: 927481 - DNA, 25 bp, Mus musculus
gacagcaaagcctcccggattctgg

SEQ ID NO: 927482 - DNA, 25 bp, Mus musculus
gacagcaaaggctcccggattctgg

SEQ ID NO: 927483 - DNA, 25 bp, Mus musculus
gacagcaatgccatgcgccccctac

SEQ ID NO: 927484 - DNA, 25 bp, Mus musculus
gacagcaatggcatgcgccccctac

SEQ ID NO: 927485 - DNA, 25 bp, Mus musculus
gacagcacccagcttgatgggggta

SEQ ID NO: 927486 - DNA, 25 bp, Mus musculus
gacagcacccaggttgatgggggta

SEQ ID NO: 927487 - DNA, 25 bp, Mus musculus
gacagcactgctctcattcgcttgc

SEQ ID NO: 927488 - DNA, 25 bp, Mus musculus
gacagcactggtctcattcgcttgc

SEQ ID NO: 927489 - DNA, 25 bp, Mus musculus
gacagcagagcaaatggctagtgat

SEQ ID NO: 927490 - DNA, 25 bp, Mus musculus
gacagcagaggaaatggctagtgat

SEQ ID NO: 927491 - DNA, 25 bp, Mus musculus
gacagcaggaagacaggaagatctg

SEQ ID NO: 927492 - DNA, 25 bp, Mus musculus
gacagcaggaagcaaagaaaggaga

SEQ ID NO: 927493 - DNA, 25 bp, Mus musculus
gacagcaggaaggaaagaaaggaga

SEQ ID NO: 927494 - DNA, 25 bp, Mus musculus
gacagcaggaagtcaggaagatctg

SEQ ID NO: 927495 - DNA, 25 bp, Mus musculus
gacagcagtgcacgtgccaacagga

SEQ ID NO: 927496 - DNA, 25 bp, Mus musculus
gacagcagtgcaggtgccaacagga

SEQ ID NO: 927497 - DNA, 25 bp, Mus musculus
gacagcatcaggattgctgaaagac

SEQ ID NO: 927498 - DNA, 25 bp, Mus musculus
gacagcatcaggtttgctgaaagac

SEQ ID NO: 927499 - DNA, 25 bp, Mus musculus
gacagcatctggcgattttctggga

SEQ ID NO: 927500 - DNA, 25 bp, Mus musculus
gacagcatctggcttttctgggaac

SEQ ID NO: 927501 - DNA, 25 bp, Mus musculus
gacagcatctggggattttctggga

SEQ ID NO: 927502 - DNA, 25 bp, Mus musculus
gacagcatctgggttttctgggaac

SEQ ID NO: 927503 - DNA, 25 bp, Mus musculus
gacagccaattgcgtctctgaatac

SEQ ID NO: 927504 - DNA, 25 bp, Mus musculus
gacagccaattgggtctctgaatac

SEQ ID NO: 927505 - DNA, 25 bp, Mus musculus
gacagccagaagaattggctggacc

SEQ ID NO: 927506 - DNA, 25 bp, Mus musculus
gacagccagaagctagcccctggaa

SEQ ID NO: 927507 - DNA, 25 bp, Mus musculus
gacagccagaaggtagcccctggaa

SEQ ID NO: 927508 - DNA, 25 bp, Mus musculus
gacagccagaagtattggctggacc

SEQ ID NO: 927509 - DNA, 25 bp, Mus musculus
gacagccccccacaagtgtcaacca

SEQ ID NO: 927510 - DNA, 25 bp, Mus musculus
gacagccccccagaagtgtcaacca

SEQ ID NO: 927511 - DNA, 25 bp, Mus musculus
gacagccctcagaggagacccaaga

SEQ ID NO: 927512 - DNA, 25 bp, Mus musculus
gacagccctcagtggagacccaaga

SEQ ID NO: 927513 - DNA, 25 bp, Mus musculus
gacagccctcgacgggacattggga

SEQ ID NO: 927514 - DNA, 25 bp, Mus musculus
gacagccctcgaggggacattggga

SEQ ID NO: 927515 - DNA, 25 bp, Mus musculus
gacagcctgatgaaaatgcctttga

SEQ ID NO: 927516 - DNA, 25 bp, Mus musculus
gacagcctgatgaaagcatctgtgg

SEQ ID NO: 927517 - DNA, 25 bp, Mus musculus
gacagcctgatgaatatgcctttga

SEQ ID NO: 927518 - DNA, 25 bp, Mus musculus
gacagcctgatgaatgcatctgtgg

SEQ ID NO: 927519 - DNA, 25 bp, Mus musculus
gacagccttcagcacagtggtgatg

SEQ ID NO: 927520 - DNA, 25 bp, Mus musculus
gacagccttcaggacagtggtgatg

SEQ ID NO: 927521 - DNA, 25 bp, Mus musculus
gacagcctttcacttccagagacac

SEQ ID NO: 927522 - DNA, 25 bp, Mus musculus
gacagcctttcagttccagagacac

SEQ ID NO: 927523 - DNA, 25 bp, Mus musculus
gacagcgagatcaacatcatgaaga

SEQ ID NO: 927524 - DNA, 25 bp, Mus musculus
gacagcgagatcaagatcatgaaga

SEQ ID NO: 927525 - DNA, 25 bp, Mus musculus
gacagcgagtcctcccccagtgact

SEQ ID NO: 927526 - DNA, 25 bp, Mus musculus
gacagcgagtcctcgcccagtgact

SEQ ID NO: 927527 - DNA, 25 bp, Mus musculus
gacagcggcaaaatagtgtttctag

SEQ ID NO: 927528 - DNA, 25 bp, Mus musculus
gacagcggcaaattagtgtttctag

SEQ ID NO: 927529 - DNA, 25 bp, Mus musculus
gacagcgtgaatggcggcaatggca

SEQ ID NO: 927530 - DNA, 25 bp, Mus musculus
gacagcgtgaatgggggcaatggca

SEQ ID NO: 927531 - DNA, 25 bp, Mus musculus
gacagctacttgcgatactctgtgg

SEQ ID NO: 927532 - DNA, 25 bp, Mus musculus
gacagctacttgggatactctgtgg

SEQ ID NO: 927533 - DNA, 25 bp, Mus musculus
gacagctatgaccccagtgacctga

SEQ ID NO: 927534 - DNA, 25 bp, Mus musculus
gacagctatgtccccagtgacctga

SEQ ID NO: 927535 - DNA, 25 bp, Mus musculus
gacagctcttcctgtttccaaattc

SEQ ID NO: 927536 - DNA, 25 bp, Mus musculus
gacagctcttgctgtttccaaattc

SEQ ID NO: 927537 - DNA, 25 bp, Mus musculus
gacagctgcactgcttacagacaca

SEQ ID NO: 927538 - DNA, 25 bp, Mus musculus
gacagctgcagtgcttacagacaca

SEQ ID NO: 927539 - DNA, 25 bp, Mus musculus
gacagcttccaggcatgctcagggt

SEQ ID NO: 927540 - DNA, 25 bp, Mus musculus
gacagcttccaggcttgctcagggt

SEQ ID NO: 927541 - DNA, 25 bp, Mus musculus
gacagcttcgtaaactttgcacttg

SEQ ID NO: 927542 - DNA, 25 bp, Mus musculus
gacagcttcgtaaagtttgcacttg

SEQ ID NO: 927543 - DNA, 25 bp, Mus musculus
gacagctttcagcacgtggtgaaat

SEQ ID NO: 927544 - DNA, 25 bp, Mus musculus
gacagctttcagcaggtggtgaaat

SEQ ID NO: 927545 - DNA, 25 bp, Mus musculus
gacagctttcttagccagcgagagg

SEQ ID NO: 927546 - DNA, 25 bp, Mus musculus
gacagctttcttaggcagcgagagg

SEQ ID NO: 927547 - DNA, 25 bp, Mus musculus
gacaggacatagaacttgccttgta

SEQ ID NO: 927548 - DNA, 25 bp, Mus musculus
gacaggacatagaagttgccttgta

SEQ ID NO: 927549 - DNA, 25 bp, Mus musculus
gacaggagagctatcctggtggtga

SEQ ID NO: 927550 - DNA, 25 bp, Mus musculus
gacaggagagctatgctggtggtga

SEQ ID NO: 927551 - DNA, 25 bp, Mus musculus
gacaggagtagcaaactggctgaca

SEQ ID NO: 927552 - DNA, 25 bp, Mus musculus
gacaggagtagctaactggctgaca

SEQ ID NO: 927553 - DNA, 25 bp, Mus musculus
gacaggattttgcccagccgtatgg

SEQ ID NO: 927554 - DNA, 25 bp, Mus musculus
gacaggattttggccagccgtatgg

SEQ ID NO: 927555 - DNA, 25 bp, Mus musculus
gacaggcaagaacccgagacaatca

SEQ ID NO: 927556 - DNA, 25 bp, Mus musculus
gacaggcaagaaccggagacaatca

SEQ ID NO: 927557 - DNA, 25 bp, Mus musculus
gacaggcacgagctgcaggtcctgg

SEQ ID NO: 927558 - DNA, 25 bp, Mus musculus
gacaggcacgaggtgcaggtcctgg

SEQ ID NO: 927559 - DNA, 25 bp, Mus musculus
gacaggcagagtccagctcttccga

SEQ ID NO: 927560 - DNA, 25 bp, Mus musculus
gacaggcagagtcctcttccgaagg

SEQ ID NO: 927561 - DNA, 25 bp, Mus musculus
gacaggcagagtgcagctcttccga

SEQ ID NO: 927562 - DNA, 25 bp, Mus musculus
gacaggcagagtgctcttccgaagg

SEQ ID NO: 927563 - DNA, 25 bp, Mus musculus
gacaggcaggcgaccttcggacagt

SEQ ID NO: 927564 - DNA, 25 bp, Mus musculus
gacaggcaggcgtccttcggacagt

SEQ ID NO: 927565 - DNA, 25 bp, Mus musculus
gacaggcctgcaacggttccaggac

SEQ ID NO: 927566 - DNA, 25 bp, Mus musculus
gacaggcctggaacggttccaggac

SEQ ID NO: 927567 - DNA, 25 bp, Mus musculus
gacagtaaccagcttgctccgggct

SEQ ID NO: 927568 - DNA, 25 bp, Mus musculus
gacagtaaccaggttgctccgggct

SEQ ID NO: 927569 - DNA, 25 bp, Mus musculus
gacagtacagagcctttttcagggc

SEQ ID NO: 927570 - DNA, 25 bp, Mus musculus
gacagtacagagctctatggccagc

SEQ ID NO: 927571 - DNA, 25 bp, Mus musculus
gacagtacagaggctttttcagggc

SEQ ID NO: 927572 - DNA, 25 bp, Mus musculus
gacagtacagaggtctatggccagc

SEQ ID NO: 927573 - DNA, 25 bp, Mus musculus
gacagtattctacaccccaggagtg

SEQ ID NO: 927574 - DNA, 25 bp, Mus musculus
gacagtattctacacctcaagactg

SEQ ID NO: 927575 - DNA, 25 bp, Mus musculus
gacagtattctacacctgaggaatg

SEQ ID NO: 927576 - DNA, 25 bp, Mus musculus
gacagtattctacagcccaggagtg

SEQ ID NO: 927577 - DNA, 25 bp, Mus musculus
gacagtattctacagctcaagactg

SEQ ID NO: 927578 - DNA, 25 bp, Mus musculus
gacagtattctacagctgaggaatg

SEQ ID NO: 927579 - DNA, 25 bp, Mus musculus
gacagtcactcacgtagtacccgca

SEQ ID NO: 927580 - DNA, 25 bp, Mus musculus
gacagtcactcaggtagtacccgca

SEQ ID NO: 927581 - DNA, 25 bp, Mus musculus
gacagtcagatactcatgatgctgg

SEQ ID NO: 927582 - DNA, 25 bp, Mus musculus
gacagtcagatactgatgatgctgg

SEQ ID NO: 927583 - DNA, 25 bp, Mus musculus
gacagtcagcaaaacgaggaacacc

SEQ ID NO: 927584 - DNA, 25 bp, Mus musculus
gacagtcagcaaaaggaggaacacc

SEQ ID NO: 927585 - DNA, 25 bp, Mus musculus
gacagtcagccagtcgctgcagacc

SEQ ID NO: 927586 - DNA, 25 bp, Mus musculus
gacagtcagccagtggctgcagacc

SEQ ID NO: 927587 - DNA, 25 bp, Mus musculus
gacagtccagcaggtgacaggaata

SEQ ID NO: 927588 - DNA, 25 bp, Mus musculus
gacagtccaggaggtgacaggaata

SEQ ID NO: 927589 - DNA, 25 bp, Mus musculus
gacagtgaaaagaatccatcgaagg

SEQ ID NO: 927590 - DNA, 25 bp, Mus musculus
gacagtgaaaagtatccatcgaagg

SEQ ID NO: 927591 - DNA, 25 bp, Mus musculus
gacagtgaagcgccagaatgaagac

SEQ ID NO: 927592 - DNA, 25 bp, Mus musculus
gacagtgaaggacagtcttgatgaa

SEQ ID NO: 927593 - DNA, 25 bp, Mus musculus
gacagtgaaggactagagtcttgat

SEQ ID NO: 927594 - DNA, 25 bp, Mus musculus
gacagtgaaggactcttgatgaagt

SEQ ID NO: 927595 - DNA, 25 bp, Mus musculus
gacagtgaaggagagtcttgatgaa

SEQ ID NO: 927596 - DNA, 25 bp, Mus musculus
gacagtgaaggagtagagtcttgat

SEQ ID NO: 927597 - DNA, 25 bp, Mus musculus
gacagtgaaggagtcttgatgaagt

SEQ ID NO: 927598 - DNA, 25 bp, Mus musculus
gacagtgaagggccagaatgaagac

SEQ ID NO: 927599 - DNA, 25 bp, Mus musculus
gacagtgaattggaacgggtatttc

SEQ ID NO: 927600 - DNA, 25 bp, Mus musculus
gacagtgaattggatcgggtatttc

SEQ ID NO: 927601 - DNA, 25 bp, Mus musculus
gacagtgacaccatcacggctgcgg

SEQ ID NO: 927602 - DNA, 25 bp, Mus musculus
gacagtgacagcatcacggctgcgg

SEQ ID NO: 927603 - DNA, 25 bp, Mus musculus
gacagtgcaaccccctgtatgacca

SEQ ID NO: 927604 - DNA, 25 bp, Mus musculus
gacagtgcaagcccctgtatgacca

SEQ ID NO: 927605 - DNA, 25 bp, Mus musculus
gacagtgccaacatttaaacgagtg

SEQ ID NO: 927606 - DNA, 25 bp, Mus musculus
gacagtgccaacctgtgtgtcaacc

SEQ ID NO: 927607 - DNA, 25 bp, Mus musculus
gacagtgccaacctttctacgtctt

SEQ ID NO: 927608 - DNA, 25 bp, Mus musculus
gacagtgccaacgtgtgtgtcaacc

SEQ ID NO: 927609 - DNA, 25 bp, Mus musculus
gacagtgccaacgtttctacgtctt

SEQ ID NO: 927610 - DNA, 25 bp, Mus musculus
gacagtgccaacttttaaacgagtg

SEQ ID NO: 927611 - DNA, 25 bp, Mus musculus
gacagtgcccatagctggcggtccc

SEQ ID NO: 927612 - DNA, 25 bp, Mus musculus
gacagtgcccattgctggcggtccc

SEQ ID NO: 927613 - DNA, 25 bp, Mus musculus
gacagtgccggtcctgtaagaggaa

SEQ ID NO: 927614 - DNA, 25 bp, Mus musculus
gacagtgccggtgctgtaagaggaa

SEQ ID NO: 927615 - DNA, 25 bp, Mus musculus
gacagtgggcaacgctctggagggc

SEQ ID NO: 927616 - DNA, 25 bp, Mus musculus
gacagtgggcaaggctctggagggc

SEQ ID NO: 927617 - DNA, 25 bp, Mus musculus
gacagtgtctagatattgatgaatg

SEQ ID NO: 927618 - DNA, 25 bp, Mus musculus
gacagtgtctagttattgatgaatg

SEQ ID NO: 927619 - DNA, 25 bp, Mus musculus
gacagtgtgaccctaccgacccttg

SEQ ID NO: 927620 - DNA, 25 bp, Mus musculus
gacagtgtgaccgtaccgacccttg

SEQ ID NO: 927621 - DNA, 25 bp, Mus musculus
gacagtgtggagcggcagtctctgg

SEQ ID NO: 927622 - DNA, 25 bp, Mus musculus
gacagtgtggaggggcagtctctgg

SEQ ID NO: 927623 - DNA, 25 bp, Mus musculus
gacagtgttcaacggtctcttgtgg

SEQ ID NO: 927624 - DNA, 25 bp, Mus musculus
gacagtgttcaagggtctcttgtgg

SEQ ID NO: 927625 - DNA, 25 bp, Mus musculus
gacagttcatcacaggagaaatggg

SEQ ID NO: 927626 - DNA, 25 bp, Mus musculus
gacagttcatcagaggagaaatggg

SEQ ID NO: 927627 - DNA, 25 bp, Mus musculus
gacagtttggaaaacattcctgaga

SEQ ID NO: 927628 - DNA, 25 bp, Mus musculus
gacagtttggtaaacattcctgaga

SEQ ID NO: 927629 - DNA, 25 bp, Mus musculus
gacataactccaccactgtcaccgt

SEQ ID NO: 927630 - DNA, 25 bp, Mus musculus
gacataactccagcactgtcaccgt

SEQ ID NO: 927631 - DNA, 25 bp, Mus musculus
gacataattcacagcgacctaaagc

SEQ ID NO: 927632 - DNA, 25 bp, Mus musculus
gacataattcacagggacctaaagc

SEQ ID NO: 927633 - DNA, 25 bp, Mus musculus
gacatacagtatgctcctgaagttt

SEQ ID NO: 927634 - DNA, 25 bp, Mus musculus
gacatacagtttgctcctgaagttt

SEQ ID NO: 927635 - DNA, 25 bp, Mus musculus
gacataccccagcacacccagcatc

SEQ ID NO: 927636 - DNA, 25 bp, Mus musculus
gacataccccaggacacccagcatc

SEQ ID NO: 927637 - DNA, 25 bp, Mus musculus
gacatactaacagacgctgtggtgg

SEQ ID NO: 927638 - DNA, 25 bp, Mus musculus
gacatactaacagaggctgtggtgg

SEQ ID NO: 927639 - DNA, 25 bp, Mus musculus
gacatactccagaagctgtccggca

SEQ ID NO: 927640 - DNA, 25 bp, Mus musculus
gacatactccagtagctgtccggca

SEQ ID NO: 927641 - DNA, 25 bp, Mus musculus
gacatagaagatgccttgtattcgt

SEQ ID NO: 927642 - DNA, 25 bp, Mus musculus
gacatagaagttgccttgtattcgt

SEQ ID NO: 927643 - DNA, 25 bp, Mus musculus
gacatagacccccacccaggaagtt

SEQ ID NO: 927644 - DNA, 25 bp, Mus musculus
gacatagacccccagccaggaagtt

SEQ ID NO: 927645 - DNA, 25 bp, Mus musculus
gacatagcctgcagggtccaccata

SEQ ID NO: 927646 - DNA, 25 bp, Mus musculus
gacatagcctgctgggtccaccata

SEQ ID NO: 927647 - DNA, 25 bp, Mus musculus
gacatatccaaacggctacaaacct

SEQ ID NO: 927648 - DNA, 25 bp, Mus musculus
gacatatccaaagggctacaaacct

SEQ ID NO: 927649 - DNA, 25 bp, Mus musculus
gacatatttactctgctggtggggg

SEQ ID NO: 927650 - DNA, 25 bp, Mus musculus
gacatatttactgtgctggtggggg

SEQ ID NO: 927651 - DNA, 25 bp, Mus musculus
gacatcaaaccgacaaacttcgcca

SEQ ID NO: 927652 - DNA, 25 bp, Mus musculus
gacatcaaaccgtcaaacttcgcca

SEQ ID NO: 927653 - DNA, 25 bp, Mus musculus
gacatcaaccgacgagtacttggac

SEQ ID NO: 927654 - DNA, 25 bp, Mus musculus
gacatcaaccgaggagtacttggac

SEQ ID NO: 927655 - DNA, 25 bp, Mus musculus
gacatcaagaagcgagaagaaatgg

SEQ ID NO: 927656 - DNA, 25 bp, Mus musculus
gacatcaagaagggagaagaaatgg

SEQ ID NO: 927657 - DNA, 25 bp, Mus musculus
gacatcaatgctttcaatttaaaat

SEQ ID NO: 927658 - DNA, 25 bp, Mus musculus
gacatcaatgctttcttcacagagg

SEQ ID NO: 927659 - DNA, 25 bp, Mus musculus
gacatcaatgctttgaatttaaaat

SEQ ID NO: 927660 - DNA, 25 bp, Mus musculus
gacatcaatgctttgttcacagagg

SEQ ID NO: 927661 - DNA, 25 bp, Mus musculus
gacatcacagcacgtgcaggcttag

SEQ ID NO: 927662 - DNA, 25 bp, Mus musculus
gacatcacagcaggtgcaggcttag

SEQ ID NO: 927663 - DNA, 25 bp, Mus musculus
gacatcacagctggtgaatgagcaa

SEQ ID NO: 927664 - DNA, 25 bp, Mus musculus
gacatcacaggtggtgaatgagcaa

SEQ ID NO: 927665 - DNA, 25 bp, Mus musculus
gacatcactaagcacgattcatttc

SEQ ID NO: 927666 - DNA, 25 bp, Mus musculus
gacatcactaagcaggattcatttc

SEQ ID NO: 927667 - DNA, 25 bp, Mus musculus
gacatcactcggaacgattcctttc

SEQ ID NO: 927668 - DNA, 25 bp, Mus musculus
gacatcactcggaaggattcctttc

SEQ ID NO: 927669 - DNA, 25 bp, Mus musculus
gacatcagaacccacgccacacact

SEQ ID NO: 927670 - DNA, 25 bp, Mus musculus
gacatcagaacccaggccacacact

SEQ ID NO: 927671 - DNA, 25 bp, Mus musculus
gacatcagaccacgtctctacggca

SEQ ID NO: 927672 - DNA, 25 bp, Mus musculus
gacatcagaccaggtctctacggca

SEQ ID NO: 927673 - DNA, 25 bp, Mus musculus
gacatcatcaagcaaagggaacagg

SEQ ID NO: 927674 - DNA, 25 bp, Mus musculus
gacatcatcaaggaaagggaacagg

SEQ ID NO: 927675 - DNA, 25 bp, Mus musculus
gacatcatcacgatcatttcccaga

SEQ ID NO: 927676 - DNA, 25 bp, Mus musculus
gacatcatcacgttcatttcccaga

SEQ ID NO: 927677 - DNA, 25 bp, Mus musculus
gacatcatccacgcagtgattgacg

SEQ ID NO: 927678 - DNA, 25 bp, Mus musculus
gacatcatccacgctgtgattgacg

SEQ ID NO: 927679 - DNA, 25 bp, Mus musculus
gacatcatgaacaaatgtacttccc

SEQ ID NO: 927680 - DNA, 25 bp, Mus musculus
gacatcatgaacaattgtacttccc

SEQ ID NO: 927681 - DNA, 25 bp, Mus musculus
gacatcatggagaacctattcgaga

SEQ ID NO: 927682 - DNA, 25 bp, Mus musculus
gacatcatggagaagctattcgaga

SEQ ID NO: 927683 - DNA, 25 bp, Mus musculus
gacatcattcagaaatggcaaaatg

SEQ ID NO: 927684 - DNA, 25 bp, Mus musculus
gacatcattcagcgctgcaaaataa

SEQ ID NO: 927685 - DNA, 25 bp, Mus musculus
gacatcattcagggctgcaaaataa

SEQ ID NO: 927686 - DNA, 25 bp, Mus musculus
gacatcattcagtaatggcaaaatg

SEQ ID NO: 927687 - DNA, 25 bp, Mus musculus
gacatccagaatgtcgatcggtcat

SEQ ID NO: 927688 - DNA, 25 bp, Mus musculus
gacatccagaatgtggatcggtcat

SEQ ID NO: 927689 - DNA, 25 bp, Mus musculus
gacatccagctacattacaaaaaca

SEQ ID NO: 927690 - DNA, 25 bp, Mus musculus
gacatccagctagattacaaaaaca

SEQ ID NO: 927691 - DNA, 25 bp, Mus musculus
gacatccaggtgaaactgtttgtgg

SEQ ID NO: 927692 - DNA, 25 bp, Mus musculus
gacatccaggtgtaactgtttgtgg

SEQ ID NO: 927693 - DNA, 25 bp, Mus musculus
gacatccatccgcgaggaaatctca

SEQ ID NO: 927694 - DNA, 25 bp, Mus musculus
gacatccatccgggaggaaatctca

SEQ ID NO: 927695 - DNA, 25 bp, Mus musculus
gacatccattcaaggcctacttgga

SEQ ID NO: 927696 - DNA, 25 bp, Mus musculus
gacatccattcatggcctacttgga

SEQ ID NO: 927697 - DNA, 25 bp, Mus musculus
gacatccggaatcacatctgctttc

SEQ ID NO: 927698 - DNA, 25 bp, Mus musculus
gacatccggaatcagatctgctttc

SEQ ID NO: 927699 - DNA, 25 bp, Mus musculus
gacatccggacacccagcgatgggg

SEQ ID NO: 927700 - DNA, 25 bp, Mus musculus
gacatccggacacgctgacgatgct

SEQ ID NO: 927701 - DNA, 25 bp, Mus musculus
gacatccggacagccagcgatgggg

SEQ ID NO: 927702 - DNA, 25 bp, Mus musculus
gacatccggacaggctgacgatgct

SEQ ID NO: 927703 - DNA, 25 bp, Mus musculus
gacatccgtgggctagcccatgcca

SEQ ID NO: 927704 - DNA, 25 bp, Mus musculus
gacatccgtggggtagcccatgcca

SEQ ID NO: 927705 - DNA, 25 bp, Mus musculus
gacatcctagacaacaacgggacct

SEQ ID NO: 927706 - DNA, 25 bp, Mus musculus
gacatcctagtcaacaacgggacct

SEQ ID NO: 927707 - DNA, 25 bp, Mus musculus
gacatcctcagaaaacaagatgagt

SEQ ID NO: 927708 - DNA, 25 bp, Mus musculus
gacatcctcagaaatcaagatgagt

SEQ ID NO: 927709 - DNA, 25 bp, Mus musculus
gacatcctgttgaacgtggtgatcc

SEQ ID NO: 927710 - DNA, 25 bp, Mus musculus
gacatcctgttgtacgtggtgatcc

SEQ ID NO: 927711 - DNA, 25 bp, Mus musculus
gacatcgaccctgaccttgcaagat

SEQ ID NO: 927712 - DNA, 25 bp, Mus musculus
gacatcgaccctgagcttgcaagat

SEQ ID NO: 927713 - DNA, 25 bp, Mus musculus
gacatcgacgtggacatcacaggac

SEQ ID NO: 927714 - DNA, 25 bp, Mus musculus
gacatcgacgtggagatcacaggac

SEQ ID NO: 927715 - DNA, 25 bp, Mus musculus
gacatcgagtttgaaattcctatca

SEQ ID NO: 927716 - DNA, 25 bp, Mus musculus
gacatcgagtttgatattcctatca

SEQ ID NO: 927717 - DNA, 25 bp, Mus musculus
gacatcgcggagatggtttcacccc

SEQ ID NO: 927718 - DNA, 25 bp, Mus musculus
gacatcgcggagttggtttcacccc

SEQ ID NO: 927719 - DNA, 25 bp, Mus musculus
gacatcgctgatcgttgcatctatg

SEQ ID NO: 927720 - DNA, 25 bp, Mus musculus
gacatcgctgatggttgcatctatg

SEQ ID NO: 927721 - DNA, 25 bp, Mus musculus
gacatcgtagcagtgccaggaggta

SEQ ID NO: 927722 - DNA, 25 bp, Mus musculus
gacatcgtaggagtgccaggaggta

SEQ ID NO: 927723 - DNA, 25 bp, Mus musculus
gacatcgtggaggacgaacagaagc

SEQ ID NO: 927724 - DNA, 25 bp, Mus musculus
gacatcgtggaggaggaacagaagc

SEQ ID NO: 927725 - DNA, 25 bp, Mus musculus
gacatctactaaaccgcccagaata

SEQ ID NO: 927726 - DNA, 25 bp, Mus musculus
gacatctactctttccccaaggatc

SEQ ID NO: 927727 - DNA, 25 bp, Mus musculus
gacatctactgtttccccaaggatc

SEQ ID NO: 927728 - DNA, 25 bp, Mus musculus
gacatctacttaaccgcccagaata

SEQ ID NO: 927729 - DNA, 25 bp, Mus musculus
gacatctatgagcacgtggggacca

SEQ ID NO: 927730 - DNA, 25 bp, Mus musculus
gacatctatgagcaggtggggacca

SEQ ID NO: 927731 - DNA, 25 bp, Mus musculus
gacatctcacaaaaaacatcggacc

SEQ ID NO: 927732 - DNA, 25 bp, Mus musculus
gacatctcacaataaacatcggacc

SEQ ID NO: 927733 - DNA, 25 bp, Mus musculus
gacatctccaagatgcacatgatcc

SEQ ID NO: 927734 - DNA, 25 bp, Mus musculus
gacatctccaagttgcacatgatcc

SEQ ID NO: 927735 - DNA, 25 bp, Mus musculus
gacatctccgtgcgcaatgtgcttc

SEQ ID NO: 927736 - DNA, 25 bp, Mus musculus
gacatctccgtgggcaatgtgcttc

SEQ ID NO: 927737 - DNA, 25 bp, Mus musculus
gacatctgcctcaacaaatttgtca

SEQ ID NO: 927738 - DNA, 25 bp, Mus musculus
gacatctgcctcaagaaatttgtca

SEQ ID NO: 927739 - DNA, 25 bp, Mus musculus
gacatctgttttttagcacaatgga

SEQ ID NO: 927740 - DNA, 25 bp, Mus musculus
gacatctgtttttttgcacaatgga

SEQ ID NO: 927741 - DNA, 25 bp, Mus musculus
gacatcttcagacacaataaaatcg

SEQ ID NO: 927742 - DNA, 25 bp, Mus musculus
gacatcttcagagacaataaaatcg

SEQ ID NO: 927743 - DNA, 25 bp, Mus musculus
gacatcttcctgaggaatgtcacag

SEQ ID NO: 927744 - DNA, 25 bp, Mus musculus
gacatcttcctgcacacatcttacc

SEQ ID NO: 927745 - DNA, 25 bp, Mus musculus
gacatcttcctggacacatcttacc

SEQ ID NO: 927746 - DNA, 25 bp, Mus musculus
gacatcttcctgtggaatgtcacag

SEQ ID NO: 927747 - DNA, 25 bp, Mus musculus
gacatgaaacagcctctcaccccgg

SEQ ID NO: 927748 - DNA, 25 bp, Mus musculus
gacatgaaacaggctctcaccccgg

SEQ ID NO: 927749 - DNA, 25 bp, Mus musculus
gacatgaaagaggccgaggtcctgt

SEQ ID NO: 927750 - DNA, 25 bp, Mus musculus
gacatgaaagtggccgaggtcctgt

SEQ ID NO: 927751 - DNA, 25 bp, Mus musculus
gacatgacagcagggcttcgtttct

SEQ ID NO: 927752 - DNA, 25 bp, Mus musculus
gacatgacaggagggcttcgtttct

SEQ ID NO: 927753 - DNA, 25 bp, Mus musculus
gacatgagacggcagatggagcagt

SEQ ID NO: 927754 - DNA, 25 bp, Mus musculus
gacatgagacgggagatggagcagt

SEQ ID NO: 927755 - DNA, 25 bp, Mus musculus
gacatgaggaacaacattcgagagc

SEQ ID NO: 927756 - DNA, 25 bp, Mus musculus
gacatgaggaacaagattcgagagc

SEQ ID NO: 927757 - DNA, 25 bp, Mus musculus
gacatgagggcatgaaggtctttgt

SEQ ID NO: 927758 - DNA, 25 bp, Mus musculus
gacatgaggggatgaaggtctttgt

SEQ ID NO: 927759 - DNA, 25 bp, Mus musculus
gacatgagtgaccaccatcggcagg

SEQ ID NO: 927760 - DNA, 25 bp, Mus musculus
gacatgagtgaccagcatcggcagg

SEQ ID NO: 927761 - DNA, 25 bp, Mus musculus
gacatgatagacggcttgaagcccc

SEQ ID NO: 927762 - DNA, 25 bp, Mus musculus
gacatgatagtcggcttgaagcccc

SEQ ID NO: 927763 - DNA, 25 bp, Mus musculus
gacatgatccgcaacggccagggca

SEQ ID NO: 927764 - DNA, 25 bp, Mus musculus
gacatgatccgcaagggccagggca

SEQ ID NO: 927765 - DNA, 25 bp, Mus musculus
gacatgatgcccaacgttcactggt

SEQ ID NO: 927766 - DNA, 25 bp, Mus musculus
gacatgatgcccaaggttcactggt

SEQ ID NO: 927767 - DNA, 25 bp, Mus musculus
gacatgcgccagccactgaacaacc

SEQ ID NO: 927768 - DNA, 25 bp, Mus musculus
gacatgcgccaggcactgaacaacc

SEQ ID NO: 927769 - DNA, 25 bp, Mus musculus
gacatgcttgttaacgtgaatgccc

SEQ ID NO: 927770 - DNA, 25 bp, Mus musculus
gacatgcttgttaaggtgaatgccc

SEQ ID NO: 927771 - DNA, 25 bp, Mus musculus
gacatggacatcctcaactactttg

SEQ ID NO: 927772 - DNA, 25 bp, Mus musculus
gacatggacatcctccctccttcct

SEQ ID NO: 927773 - DNA, 25 bp, Mus musculus
gacatggacatcctgaactactttg

SEQ ID NO: 927774 - DNA, 25 bp, Mus musculus
gacatggacatcctgcctccttcct

SEQ ID NO: 927775 - DNA, 25 bp, Mus musculus
gacatggacatggactctcgccttt

SEQ ID NO: 927776 - DNA, 25 bp, Mus musculus
gacatggacatggagtctcgccttt

SEQ ID NO: 927777 - DNA, 25 bp, Mus musculus
gacatggagagcagcaaggagcctg

SEQ ID NO: 927778 - DNA, 25 bp, Mus musculus
gacatggagagctgcaaggagcctg

SEQ ID NO: 927779 - DNA, 25 bp, Mus musculus
gacatggatctgctgtgagtgttga

SEQ ID NO: 927780 - DNA, 25 bp, Mus musculus
gacatggatctggtgtgagtgttga

SEQ ID NO: 927781 - DNA, 25 bp, Mus musculus
gacatggatgaactggatgtgcggc

SEQ ID NO: 927782 - DNA, 25 bp, Mus musculus
gacatggatgaagtggatgtgcggc

SEQ ID NO: 927783 - DNA, 25 bp, Mus musculus
gacatggatgcctcccgtcattttt

SEQ ID NO: 927784 - DNA, 25 bp, Mus musculus
gacatggatggctcccgtcattttt

SEQ ID NO: 927785 - DNA, 25 bp, Mus musculus
gacatggcagtgcccacacccccac

SEQ ID NO: 927786 - DNA, 25 bp, Mus musculus
gacatggcagtggccacacccccac

SEQ ID NO: 927787 - DNA, 25 bp, Mus musculus
gacatggcggcacacgttgctgcag

SEQ ID NO: 927788 - DNA, 25 bp, Mus musculus
gacatggcggcacaggttgctgcag

SEQ ID NO: 927789 - DNA, 25 bp, Mus musculus
gacatggctattcacccagattccc

SEQ ID NO: 927790 - DNA, 25 bp, Mus musculus
gacatggctattgacccagattccc

SEQ ID NO: 927791 - DNA, 25 bp, Mus musculus
gacatgggactacgatgatgtctac

SEQ ID NO: 927792 - DNA, 25 bp, Mus musculus
gacatgggactaggatgatgtctac

SEQ ID NO: 927793 - DNA, 25 bp, Mus musculus
gacatgtcagcttctctgtccactt

SEQ ID NO: 927794 - DNA, 25 bp, Mus musculus
gacatgtcaggttctctgtccactt

SEQ ID NO: 927795 - DNA, 25 bp, Mus musculus
gacatgtgcaacctccaccatgggc

SEQ ID NO: 927796 - DNA, 25 bp, Mus musculus
gacatgtgcaacctgcaccatgggc

SEQ ID NO: 927797 - DNA, 25 bp, Mus musculus
gacatgttgctgcacgtgaacgatg

SEQ ID NO: 927798 - DNA, 25 bp, Mus musculus
gacatgttgctgcaggtgaacgatg

SEQ ID NO: 927799 - DNA, 25 bp, Mus musculus
gacatgtttcagctgggcaggtcaa

SEQ ID NO: 927800 - DNA, 25 bp, Mus musculus
gacatgtttcaggtgggcaggtcaa

SEQ ID NO: 927801 - DNA, 25 bp, Mus musculus
gacattaaacgaagaatccagttca

SEQ ID NO: 927802 - DNA, 25 bp, Mus musculus
gacattaaacgatgaatccagttca

SEQ ID NO: 927803 - DNA, 25 bp, Mus musculus
gacattccacaacattgtgaaatgg

SEQ ID NO: 927804 - DNA, 25 bp, Mus musculus
gacattccacaagattgtgaaatgg

SEQ ID NO: 927805 - DNA, 25 bp, Mus musculus
gacattccgcagaggtatcagaagc

SEQ ID NO: 927806 - DNA, 25 bp, Mus musculus
gacattccgcagtggtatcagaagc

SEQ ID NO: 927807 - DNA, 25 bp, Mus musculus
gacattcgcccgcgtctctatggca

SEQ ID NO: 927808 - DNA, 25 bp, Mus musculus
gacattcgcccgggtctctatggca

SEQ ID NO: 927809 - DNA, 25 bp, Mus musculus
gacattctgcagcattatacacacg

SEQ ID NO: 927810 - DNA, 25 bp, Mus musculus
gacattctgcaggattatacacacg

SEQ ID NO: 927811 - DNA, 25 bp, Mus musculus
gacattcttaagcgtttaaaggctg

SEQ ID NO: 927812 - DNA, 25 bp, Mus musculus
gacattcttaagggtttaaaggctg

SEQ ID NO: 927813 - DNA, 25 bp, Mus musculus
gacattcttaataacgaagaaactc

SEQ ID NO: 927814 - DNA, 25 bp, Mus musculus
gacattcttaataaggaagaaactc

SEQ ID NO: 927815 - DNA, 25 bp, Mus musculus
gacattgacaggcacataacagatc

SEQ ID NO: 927816 - DNA, 25 bp, Mus musculus
gacattgacagggacataacagatc

SEQ ID NO: 927817 - DNA, 25 bp, Mus musculus
gacattgatcagctggtgactgcag

SEQ ID NO: 927818 - DNA, 25 bp, Mus musculus
gacattgatcaggtggtgactgcag

SEQ ID NO: 927819 - DNA, 25 bp, Mus musculus
gacattgatgcacaaacggaaagca

SEQ ID NO: 927820 - DNA, 25 bp, Mus musculus
gacattgatgcacatacggaaagca

SEQ ID NO: 927821 - DNA, 25 bp, Mus musculus
gacattgatgtacacgagggcacga

SEQ ID NO: 927822 - DNA, 25 bp, Mus musculus
gacattgatgtacaggagggcacga

SEQ ID NO: 927823 - DNA, 25 bp, Mus musculus
gacattgcagctctaccaatggaag

SEQ ID NO: 927824 - DNA, 25 bp, Mus musculus
gacattgcaggtctaccaatggaag

SEQ ID NO: 927825 - DNA, 25 bp, Mus musculus
gacattgctacacctgcacagagca

SEQ ID NO: 927826 - DNA, 25 bp, Mus musculus
gacattgctacagctgcacagagca

SEQ ID NO: 927827 - DNA, 25 bp, Mus musculus
gacatttaaaacagttgccatccac

SEQ ID NO: 927828 - DNA, 25 bp, Mus musculus
gacatttaaaactgttgccatccac

SEQ ID NO: 927829 - DNA, 25 bp, Mus musculus
gacatttcagcaacctcaagtattt

SEQ ID NO: 927830 - DNA, 25 bp, Mus musculus
gacatttcaggaacctcaagtattt

SEQ ID NO: 927831 - DNA, 25 bp, Mus musculus
gacatttctgggcacacccagaaag

SEQ ID NO: 927832 - DNA, 25 bp, Mus musculus
gacatttctggggacacccagaaag

SEQ ID NO: 927833 - DNA, 25 bp, Mus musculus
gacatttgagaacggccacatccgg

SEQ ID NO: 927834 - DNA, 25 bp, Mus musculus
gacatttgagaagggccacatccgg

SEQ ID NO: 927835 - DNA, 25 bp, Mus musculus
gacatttgggaacacgatgggggct

SEQ ID NO: 927836 - DNA, 25 bp, Mus musculus
gacatttgggaacaggatgggggct

SEQ ID NO: 927837 - DNA, 25 bp, Mus musculus
gacattttagcaaataattttgaaa

SEQ ID NO: 927838 - DNA, 25 bp, Mus musculus
gacattttagcacgttttctgatta

SEQ ID NO: 927839 - DNA, 25 bp, Mus musculus
gacattttagcaggttttctgatta

SEQ ID NO: 927840 - DNA, 25 bp, Mus musculus
gacattttagcatataattttgaaa

SEQ ID NO: 927841 - DNA, 25 bp, Mus musculus
gacattttcagaaacgttcgatttt

SEQ ID NO: 927842 - DNA, 25 bp, Mus musculus
gacattttcagaaaggttcgatttt

SEQ ID NO: 927843 - DNA, 25 bp, Mus musculus
gacattttccaacaacagttagctg

SEQ ID NO: 927844 - DNA, 25 bp, Mus musculus
gacattttccaagaacagttagctg

SEQ ID NO: 927845 - DNA, 25 bp, Mus musculus
gacattttcttgcggagcaagagtg

SEQ ID NO: 927846 - DNA, 25 bp, Mus musculus
gacattttcttggggagcaagagtg

SEQ ID NO: 927847 - DNA, 25 bp, Mus musculus
gacatttttgctgtgggaagccagt

SEQ ID NO: 927848 - DNA, 25 bp, Mus musculus
gacatttttggtgtgggaagccagt

SEQ ID NO: 927849 - DNA, 25 bp, Mus musculus
gaccaaaacaaaccacgcgaggcag

SEQ ID NO: 927850 - DNA, 25 bp, Mus musculus
gaccaaaacaaagcacgcgaggcag

SEQ ID NO: 927851 - DNA, 25 bp, Mus musculus
gaccaaaatcacctggatgaaagca

SEQ ID NO: 927852 - DNA, 25 bp, Mus musculus
gaccaaaatcacgtggatgaaagca

SEQ ID NO: 927853 - DNA, 25 bp, Mus musculus
gaccaaacttcaaacgcattcctgt

SEQ ID NO: 927854 - DNA, 25 bp, Mus musculus
gaccaaacttcaaaggcattcctgt

SEQ ID NO: 927855 - DNA, 25 bp, Mus musculus
gaccaaagagatataccattggccg

SEQ ID NO: 927856 - DNA, 25 bp, Mus musculus
gaccaaagagatattccattggccg

SEQ ID NO: 927857 - DNA, 25 bp, Mus musculus
gaccaaatggccatcataacagcta

SEQ ID NO: 927858 - DNA, 25 bp, Mus musculus
gaccaaatggccatgataacagcta

SEQ ID NO: 927859 - DNA, 25 bp, Mus musculus
gaccaacatcagctcgtacgtgcgg

SEQ ID NO: 927860 - DNA, 25 bp, Mus musculus
gaccaacatcagctggtacgtgcgg

SEQ ID NO: 927861 - DNA, 25 bp, Mus musculus
gaccaaccagaacagtattctcttc

SEQ ID NO: 927862 - DNA, 25 bp, Mus musculus
gaccaaccagaattctcttcaagca

SEQ ID NO: 927863 - DNA, 25 bp, Mus musculus
gaccaaccagtacagtattctcttc

SEQ ID NO: 927864 - DNA, 25 bp, Mus musculus
gaccaaccagtattctcttcaagca

SEQ ID NO: 927865 - DNA, 25 bp, Mus musculus
gaccaactcgctacctgagcccaag

SEQ ID NO: 927866 - DNA, 25 bp, Mus musculus
gaccaactcggtacctgagcccaag

SEQ ID NO: 927867 - DNA, 25 bp, Mus musculus
gaccaactctggcttgttatggagt

SEQ ID NO: 927868 - DNA, 25 bp, Mus musculus
gaccaactctgggttgttatggagt

SEQ ID NO: 927869 - DNA, 25 bp, Mus musculus
gaccaactgaaacaggttggcatgg

SEQ ID NO: 927870 - DNA, 25 bp, Mus musculus
gaccaactgaaagaggttggcatgg

SEQ ID NO: 927871 - DNA, 25 bp, Mus musculus
gaccaacttcaggatgttttccttc

SEQ ID NO: 927872 - DNA, 25 bp, Mus musculus
gaccaacttctggatgttttccttc

SEQ ID NO: 927873 - DNA, 25 bp, Mus musculus
gaccaagaaatgaagcgctggctga

SEQ ID NO: 927874 - DNA, 25 bp, Mus musculus
gaccaagaaatgtagcgctggctga

SEQ ID NO: 927875 - DNA, 25 bp, Mus musculus
gaccaagaagaactcagattcctac

SEQ ID NO: 927876 - DNA, 25 bp, Mus musculus
gaccaagaagaactgagattcctac

SEQ ID NO: 927877 - DNA, 25 bp, Mus musculus
gaccaagacccacatctggcaagtt

SEQ ID NO: 927878 - DNA, 25 bp, Mus musculus
gaccaagacccagatctggcaagtt

SEQ ID NO: 927879 - DNA, 25 bp, Mus musculus
gaccaagacgcaaatggaacttcca

SEQ ID NO: 927880 - DNA, 25 bp, Mus musculus
gaccaagacggaaatggaacttcca

SEQ ID NO: 927881 - DNA, 25 bp, Mus musculus
gaccaagaggaccgtgtgccgatgc

SEQ ID NO: 927882 - DNA, 25 bp, Mus musculus
gaccaagaggacggtgtgccgatgc

SEQ ID NO: 927883 - DNA, 25 bp, Mus musculus
gaccaagatggacgagatcgggcgc

SEQ ID NO: 927884 - DNA, 25 bp, Mus musculus
gaccaagatggaggagatcgggcgc

SEQ ID NO: 927885 - DNA, 25 bp, Mus musculus
gaccaaggaacacatcctgaagctg

SEQ ID NO: 927886 - DNA, 25 bp, Mus musculus
gaccaaggaacagatcctgaagctg

SEQ ID NO: 927887 - DNA, 25 bp, Mus musculus
gaccaaggagaacgagttctttgat

SEQ ID NO: 927888 - DNA, 25 bp, Mus musculus
gaccaaggagaaggagttctttgat

SEQ ID NO: 927889 - DNA, 25 bp, Mus musculus
gaccaagtgtttaacccactggaac

SEQ ID NO: 927890 - DNA, 25 bp, Mus musculus
gaccaagtgtttaagccactggaac

SEQ ID NO: 927891 - DNA, 25 bp, Mus musculus
gaccaagttacacgaggcagtgaca

SEQ ID NO: 927892 - DNA, 25 bp, Mus musculus
gaccaagttacacgaggcagtgacg

SEQ ID NO: 927893 - DNA, 25 bp, Mus musculus
gaccaagttacacgtctcctgtttc

SEQ ID NO: 927894 - DNA, 25 bp, Mus musculus
gaccaagttacaggaggcagtgaca

SEQ ID NO: 927895 - DNA, 25 bp, Mus musculus
gaccaagttacaggaggcagtgacg

SEQ ID NO: 927896 - DNA, 25 bp, Mus musculus
gaccaagttacaggtctcctgtttc

SEQ ID NO: 927897 - DNA, 25 bp, Mus musculus
gaccaataagcaggtccccagcaca

SEQ ID NO: 927898 - DNA, 25 bp, Mus musculus
gaccaataaggaggtccccagcaca

SEQ ID NO: 927899 - DNA, 25 bp, Mus musculus
gaccacaaatcgccggctacctgtg

SEQ ID NO: 927900 - DNA, 25 bp, Mus musculus
gaccacaaatggccggctacctgtg

SEQ ID NO: 927901 - DNA, 25 bp, Mus musculus
gaccacaacctgcactatcttcagg

SEQ ID NO: 927902 - DNA, 25 bp, Mus musculus
gaccacaacctgcagtatcttcagg

SEQ ID NO: 927903 - DNA, 25 bp, Mus musculus
gaccacaaggaacaccatatgaagg

SEQ ID NO: 927904 - DNA, 25 bp, Mus musculus
gaccacaaggaagaccatatgaagg

SEQ ID NO: 927905 - DNA, 25 bp, Mus musculus
gaccacactgcttcggagtgccggt

SEQ ID NO: 927906 - DNA, 25 bp, Mus musculus
gaccacactggttcggagtgccggt

SEQ ID NO: 927907 - DNA, 25 bp, Mus musculus
gaccacagaagacacgcaccacggc

SEQ ID NO: 927908 - DNA, 25 bp, Mus musculus
gaccacagaagacaggcaccacggc

SEQ ID NO: 927909 - DNA, 25 bp, Mus musculus
gaccacaggaatcggtgccatctat

SEQ ID NO: 927910 - DNA, 25 bp, Mus musculus
gaccacaggaatgggtgccatctat

SEQ ID NO: 927911 - DNA, 25 bp, Mus musculus
gaccacatgaagctctgctttggag

SEQ ID NO: 927912 - DNA, 25 bp, Mus musculus
gaccacatgaaggtctgctttggag

SEQ ID NO: 927913 - DNA, 25 bp, Mus musculus
gaccaccacacgcgcttgctgaata

SEQ ID NO: 927914 - DNA, 25 bp, Mus musculus
gaccaccacacgggcttgctgaata

SEQ ID NO: 927915 - DNA, 25 bp, Mus musculus
gaccaccacgccatcacggctgcgg

SEQ ID NO: 927916 - DNA, 25 bp, Mus musculus
gaccaccacggcatcacggctgcgg

SEQ ID NO: 927917 - DNA, 25 bp, Mus musculus
gaccacccagccctggctgccacac

SEQ ID NO: 927918 - DNA, 25 bp, Mus musculus
gaccacccagccgtggctgccacac

SEQ ID NO: 927919 - DNA, 25 bp, Mus musculus
gaccacctacaaccataggtacttc

SEQ ID NO: 927920 - DNA, 25 bp, Mus musculus
gaccacctacaaccttaggtacttc

SEQ ID NO: 927921 - DNA, 25 bp, Mus musculus
gaccacctattcctccgtcggtgtg

SEQ ID NO: 927922 - DNA, 25 bp, Mus musculus
gaccacctattcctgcgtcggtgtg

SEQ ID NO: 927923 - DNA, 25 bp, Mus musculus
gaccacgacgcactgaaggaggact

SEQ ID NO: 927924 - DNA, 25 bp, Mus musculus
gaccacgacgcagtgaaggaggact

SEQ ID NO: 927925 - DNA, 25 bp, Mus musculus
gaccacgactgcctacaagaaaacg

SEQ ID NO: 927926 - DNA, 25 bp, Mus musculus
gaccacgactgcgtacaagaaaacg

SEQ ID NO: 927927 - DNA, 25 bp, Mus musculus
gaccacgagtctctcgggaatgctg

SEQ ID NO: 927928 - DNA, 25 bp, Mus musculus
gaccacgagtgtctcgggaatgctg

SEQ ID NO: 927929 - DNA, 25 bp, Mus musculus
gaccacgcagagcaaagatggtcca

SEQ ID NO: 927930 - DNA, 25 bp, Mus musculus
gaccacgcagagcgaaggtgtgaac

SEQ ID NO: 927931 - DNA, 25 bp, Mus musculus
gaccacgcagaggaaagatggtcca

SEQ ID NO: 927932 - DNA, 25 bp, Mus musculus
gaccacgcagagggaaggtgtgaac

SEQ ID NO: 927933 - DNA, 25 bp, Mus musculus
gaccactaccaaccaccagcaccca

SEQ ID NO: 927934 - DNA, 25 bp, Mus musculus
gaccactaccaagcaccagcaccca

SEQ ID NO: 927935 - DNA, 25 bp, Mus musculus
gaccactacgcacgaggattacaac

SEQ ID NO: 927936 - DNA, 25 bp, Mus musculus
gaccactacgcacttaccgtgacgg

SEQ ID NO: 927937 - DNA, 25 bp, Mus musculus
gaccactacgcaggaggattacaac

SEQ ID NO: 927938 - DNA, 25 bp, Mus musculus
gaccactacgcagttaccgtgacgg

SEQ ID NO: 927939 - DNA, 25 bp, Mus musculus
gaccactcagaacaacctactcagc

SEQ ID NO: 927940 - DNA, 25 bp, Mus musculus
gaccactcagtacaacctactcagc

SEQ ID NO: 927941 - DNA, 25 bp, Mus musculus
gaccactgagaggcctacgtgaaga

SEQ ID NO: 927942 - DNA, 25 bp, Mus musculus
gaccactgagcctgagcagatgggg

SEQ ID NO: 927943 - DNA, 25 bp, Mus musculus
gaccactgaggctgagcagatgggg

SEQ ID NO: 927944 - DNA, 25 bp, Mus musculus
gaccactgagtggcctacgtgaaga

SEQ ID NO: 927945 - DNA, 25 bp, Mus musculus
gaccactgatgacagaggtcctccg

SEQ ID NO: 927946 - DNA, 25 bp, Mus musculus
gaccactgatgagagaggtcctccg

SEQ ID NO: 927947 - DNA, 25 bp, Mus musculus
gaccactgctcagacccaccagagg

SEQ ID NO: 927948 - DNA, 25 bp, Mus musculus
gaccactgctcagagccaccagagg

SEQ ID NO: 927949 - DNA, 25 bp, Mus musculus
gaccagaagcagcgaaaaggctcta

SEQ ID NO: 927950 - DNA, 25 bp, Mus musculus
gaccagaagcagctggtgaatgagc

SEQ ID NO: 927951 - DNA, 25 bp, Mus musculus
gaccagaagcagggaaaaggctcta

SEQ ID NO: 927952 - DNA, 25 bp, Mus musculus
gaccagaagcaggtggtgaatgagc

SEQ ID NO: 927953 - DNA, 25 bp, Mus musculus
gaccagaagtcacacaaaccccgag

SEQ ID NO: 927954 - DNA, 25 bp, Mus musculus
gaccagaagtcacagaaaccccgag

SEQ ID NO: 927955 - DNA, 25 bp, Mus musculus
gaccagaccgcacacgaaatgcaag

SEQ ID NO: 927956 - DNA, 25 bp, Mus musculus
gaccagaccgcacaggaaatgcaag

SEQ ID NO: 927957 - DNA, 25 bp, Mus musculus
gaccagactgagcctgtgtttcaaa

SEQ ID NO: 927958 - DNA, 25 bp, Mus musculus
gaccagactgaggctgtgtttcaaa

SEQ ID NO: 927959 - DNA, 25 bp, Mus musculus
gaccagactgccgctctccacctgc

SEQ ID NO: 927960 - DNA, 25 bp, Mus musculus
gaccagactggcgctctccacctgc

SEQ ID NO: 927961 - DNA, 25 bp, Mus musculus
gaccagaggcagagtgaagaaatcg

SEQ ID NO: 927962 - DNA, 25 bp, Mus musculus
gaccagaggcagtgtgaagaaatcg

SEQ ID NO: 927963 - DNA, 25 bp, Mus musculus
gaccagattctccacgtcaacaact

SEQ ID NO: 927964 - DNA, 25 bp, Mus musculus
gaccagattctccaggtcaacaact

SEQ ID NO: 927965 - DNA, 25 bp, Mus musculus
gaccagcaagctctggcgtggaggt

SEQ ID NO: 927966 - DNA, 25 bp, Mus musculus
gaccagcaaggtctggcgtggaggt

SEQ ID NO: 927967 - DNA, 25 bp, Mus musculus
gaccagcacaatcagctgcagctca

SEQ ID NO: 927968 - DNA, 25 bp, Mus musculus
gaccagcacattcagctgcagctca

SEQ ID NO: 927969 - DNA, 25 bp, Mus musculus
gaccagcactaccacagaggcacag

SEQ ID NO: 927970 - DNA, 25 bp, Mus musculus
gaccagcactaccagagaggcacag

SEQ ID NO: 927971 - DNA, 25 bp, Mus musculus
gaccagcagactatctcctgtctat

SEQ ID NO: 927972 - DNA, 25 bp, Mus musculus
gaccagcagactctaaaacagacta

SEQ ID NO: 927973 - DNA, 25 bp, Mus musculus
gaccagcagactgtaaaacagacta

SEQ ID NO: 927974 - DNA, 25 bp, Mus musculus
gaccagcagactttctcctgtctat

SEQ ID NO: 927975 - DNA, 25 bp, Mus musculus
gaccagcagatgctatgcacccgag

SEQ ID NO: 927976 - DNA, 25 bp, Mus musculus
gaccagcagatggtatgcacccgag

SEQ ID NO: 927977 - DNA, 25 bp, Mus musculus
gaccagcaggtaataaacgagatgg

SEQ ID NO: 927978 - DNA, 25 bp, Mus musculus
gaccagcaggtaattaacgagatgg

SEQ ID NO: 927979 - DNA, 25 bp, Mus musculus
gaccagcagtatttcattttgaata

SEQ ID NO: 927980 - DNA, 25 bp, Mus musculus
gaccagcagtatttgattttgaata

SEQ ID NO: 927981 - DNA, 25 bp, Mus musculus
gaccagcctacaccactgggaattt

SEQ ID NO: 927982 - DNA, 25 bp, Mus musculus
gaccagcctacagcactgggaattt

SEQ ID NO: 927983 - DNA, 25 bp, Mus musculus
gaccagcctgggcacatggggctcc

SEQ ID NO: 927984 - DNA, 25 bp, Mus musculus
gaccagcctggggacatggggctcc

SEQ ID NO: 927985 - DNA, 25 bp, Mus musculus
gaccagcctttacaggacgcctttg

SEQ ID NO: 927986 - DNA, 25 bp, Mus musculus
gaccagcctttagaggacgcctttg

SEQ ID NO: 927987 - DNA, 25 bp, Mus musculus
gaccagcgagattcataggacccaa

SEQ ID NO: 927988 - DNA, 25 bp, Mus musculus
gaccagcgagtttcataggacccaa

SEQ ID NO: 927989 - DNA, 25 bp, Mus musculus
gaccagcgattatcaatactacatt

SEQ ID NO: 927990 - DNA, 25 bp, Mus musculus
gaccagcgattatctatactacatt

SEQ ID NO: 927991 - DNA, 25 bp, Mus musculus
gaccagcggcaaccctgagactggt

SEQ ID NO: 927992 - DNA, 25 bp, Mus musculus
gaccagcggcaagcctgagactggt

SEQ ID NO: 927993 - DNA, 25 bp, Mus musculus
gaccagcgggagaacatggttggta

SEQ ID NO: 927994 - DNA, 25 bp, Mus musculus
gaccagcgggagaacgctctgcacc

SEQ ID NO: 927995 - DNA, 25 bp, Mus musculus
gaccagcgggagaacgttgatccaa

SEQ ID NO: 927996 - DNA, 25 bp, Mus musculus
gaccagcgggagaagatggttggta

SEQ ID NO: 927997 - DNA, 25 bp, Mus musculus
gaccagcgggagaaggctctgcacc

SEQ ID NO: 927998 - DNA, 25 bp, Mus musculus
gaccagcgggagaaggttgatccaa

SEQ ID NO: 927999 - DNA, 25 bp, Mus musculus
gaccagctaaaggacgctgtgaggg

SEQ ID NO: 928000 - DNA, 25 bp, Mus musculus
gaccagctaaaggaggctgtgaggg

SEQ ID NO: 928001 - DNA, 25 bp, Mus musculus
gaccaggacaagatatttcaaggaa

SEQ ID NO: 928002 - DNA, 25 bp, Mus musculus
gaccaggacaagcacgtcccatgca

SEQ ID NO: 928003 - DNA, 25 bp, Mus musculus
gaccaggacaagcaggtcccatgca

SEQ ID NO: 928004 - DNA, 25 bp, Mus musculus
gaccaggacaagttatttcaaggaa

SEQ ID NO: 928005 - DNA, 25 bp, Mus musculus
gaccaggacgccaacggcttaagtc

SEQ ID NO: 928006 - DNA, 25 bp, Mus musculus
gaccaggacgccaagggcttaagtc

SEQ ID NO: 928007 - DNA, 25 bp, Mus musculus
gaccaggcacccagagttttgctct

SEQ ID NO: 928008 - DNA, 25 bp, Mus musculus
gaccaggcaccctgagttttgctct

SEQ ID NO: 928009 - DNA, 25 bp, Mus musculus
gaccaggcagaacacctatggcggt

SEQ ID NO: 928010 - DNA, 25 bp, Mus musculus
gaccaggcagaacctgggaagtcat

SEQ ID NO: 928011 - DNA, 25 bp, Mus musculus
gaccaggcagaagctgggaagtcat

SEQ ID NO: 928012 - DNA, 25 bp, Mus musculus
gaccaggcagcagtacctggagttc

SEQ ID NO: 928013 - DNA, 25 bp, Mus musculus
gaccaggcaggagtacctggagttc

SEQ ID NO: 928014 - DNA, 25 bp, Mus musculus
gaccaggcagtacacctatggcggt

SEQ ID NO: 928015 - DNA, 25 bp, Mus musculus
gaccaggctacaaacaacccaagag

SEQ ID NO: 928016 - DNA, 25 bp, Mus musculus
gaccaggctacaaagaacccaagag

SEQ ID NO: 928017 - DNA, 25 bp, Mus musculus
gaccagggacagactcactctgtgg

SEQ ID NO: 928018 - DNA, 25 bp, Mus musculus
gaccagggacagtctcactctgtgg

SEQ ID NO: 928019 - DNA, 25 bp, Mus musculus
gaccaggtttcacgcccacccagtg

SEQ ID NO: 928020 - DNA, 25 bp, Mus musculus
gaccaggtttcaggcccacccagtg

SEQ ID NO: 928021 - DNA, 25 bp, Mus musculus
gaccagtcactaagtgctgtgagtg

SEQ ID NO: 928022 - DNA, 25 bp, Mus musculus
gaccagtcactatgtgctgtgagtg

SEQ ID NO: 928023 - DNA, 25 bp, Mus musculus
gaccagtgtagaacaatttttttga

SEQ ID NO: 928024 - DNA, 25 bp, Mus musculus
gaccagtgtagaactatttttttga

SEQ ID NO: 928025 - DNA, 25 bp, Mus musculus
gaccataaagactaaggttgtgggt

SEQ ID NO: 928026 - DNA, 25 bp, Mus musculus
gaccataaagtctaaggttgtgggt

SEQ ID NO: 928027 - DNA, 25 bp, Mus musculus
gaccatacagatcatgtcatcaggc

SEQ ID NO: 928028 - DNA, 25 bp, Mus musculus
gaccatacagttcatgtcatcaggc

SEQ ID NO: 928029 - DNA, 25 bp, Mus musculus
gaccatagagccgcaaacagggcct

SEQ ID NO: 928030 - DNA, 25 bp, Mus musculus
gaccatagaggcgcaaacagggcct

SEQ ID NO: 928031 - DNA, 25 bp, Mus musculus
gaccatatctgcaacgacatgagcc

SEQ ID NO: 928032 - DNA, 25 bp, Mus musculus
gaccatatctgcaaggacatgagcc

SEQ ID NO: 928033 - DNA, 25 bp, Mus musculus
gaccatcacaagatctgatactctt

SEQ ID NO: 928034 - DNA, 25 bp, Mus musculus
gaccatcacaagttctgatactctt

SEQ ID NO: 928035 - DNA, 25 bp, Mus musculus
gaccatccccaactcatcaagcctc

SEQ ID NO: 928036 - DNA, 25 bp, Mus musculus
gaccatccccaagtcatcaagcctc

SEQ ID NO: 928037 - DNA, 25 bp, Mus musculus
gaccatccccgaccttctcaagtgg

SEQ ID NO: 928038 - DNA, 25 bp, Mus musculus
gaccatccccgagcttctcaagtgg

SEQ ID NO: 928039 - DNA, 25 bp, Mus musculus
gaccatctgcagctacaacttgcca

SEQ ID NO: 928040 - DNA, 25 bp, Mus musculus
gaccatctgcaggtacaacttgcca

SEQ ID NO: 928041 - DNA, 25 bp, Mus musculus
gaccatgaagacaccgtggaaggtt

SEQ ID NO: 928042 - DNA, 25 bp, Mus musculus
gaccatgaagatgaagcggcagctg

SEQ ID NO: 928043 - DNA, 25 bp, Mus musculus
gaccatgaagtcaccgtggaaggtt

SEQ ID NO: 928044 - DNA, 25 bp, Mus musculus
gaccatgaagttgaagcggcagctg

SEQ ID NO: 928045 - DNA, 25 bp, Mus musculus
gaccatgcaaatacatcgccccctg

SEQ ID NO: 928046 - DNA, 25 bp, Mus musculus
gaccatgcaaattcatcgccccctg

SEQ ID NO: 928047 - DNA, 25 bp, Mus musculus
gaccatggacgacgacattgtgatt

SEQ ID NO: 928048 - DNA, 25 bp, Mus musculus
gaccatggacgaggacattgtgatt

SEQ ID NO: 928049 - DNA, 25 bp, Mus musculus
gaccatggatccaccagtgagtgag

SEQ ID NO: 928050 - DNA, 25 bp, Mus musculus
gaccatggatcctccagtgagtgag

SEQ ID NO: 928051 - DNA, 25 bp, Mus musculus
gaccatggccaacatggagttccag

SEQ ID NO: 928052 - DNA, 25 bp, Mus musculus
gaccatggccaagatggagttccag

SEQ ID NO: 928053 - DNA, 25 bp, Mus musculus
gaccatgtgcagcctgagctgctgt

SEQ ID NO: 928054 - DNA, 25 bp, Mus musculus
gaccatgtgcaggctgagctgctgt

SEQ ID NO: 928055 - DNA, 25 bp, Mus musculus
gaccattaagcatctaatgcgtcag

SEQ ID NO: 928056 - DNA, 25 bp, Mus musculus
gaccattaaggatctaatgcgtcag

SEQ ID NO: 928057 - DNA, 25 bp, Mus musculus
gaccattacaggaactcaacagtca

SEQ ID NO: 928058 - DNA, 25 bp, Mus musculus
gaccattacaggtactcaacagtca

SEQ ID NO: 928059 - DNA, 25 bp, Mus musculus
gaccattacattgacgtggtgaagg

SEQ ID NO: 928060 - DNA, 25 bp, Mus musculus
gaccattacattgaggtggtgaagg

SEQ ID NO: 928061 - DNA, 25 bp, Mus musculus
gaccattagtatagcaagaagccag

SEQ ID NO: 928062 - DNA, 25 bp, Mus musculus
gaccattagtattgcaagaagccag

SEQ ID NO: 928063 - DNA, 25 bp, Mus musculus
gaccattcaagccattatttgaaat

SEQ ID NO: 928064 - DNA, 25 bp, Mus musculus
gaccattcaagcgattatttgaaat

SEQ ID NO: 928065 - DNA, 25 bp, Mus musculus
gaccattgagcaagaactatgtcat

SEQ ID NO: 928066 - DNA, 25 bp, Mus musculus
gaccattgagcttatctggctgttt

SEQ ID NO: 928067 - DNA, 25 bp, Mus musculus
gaccattgaggaagaactatgtcat

SEQ ID NO: 928068 - DNA, 25 bp, Mus musculus
gaccattgaggttatctggctgttt

SEQ ID NO: 928069 - DNA, 25 bp, Mus musculus
gaccattgtcagcaatgcatcctgt

SEQ ID NO: 928070 - DNA, 25 bp, Mus musculus
gaccattgtcaggaatgcatcctgt

SEQ ID NO: 928071 - DNA, 25 bp, Mus musculus
gacccacacgacaaactacaactcc

SEQ ID NO: 928072 - DNA, 25 bp, Mus musculus
gacccacacgtcaaactacaactcc

SEQ ID NO: 928073 - DNA, 25 bp, Mus musculus
gacccacatgcaatggacctgtcag

SEQ ID NO: 928074 - DNA, 25 bp, Mus musculus
gacccacatggaatggacctgtcag

SEQ ID NO: 928075 - DNA, 25 bp, Mus musculus
gacccacgaggacgacgagcagttg

SEQ ID NO: 928076 - DNA, 25 bp, Mus musculus
gacccacgaggaggacgagcagttg

SEQ ID NO: 928077 - DNA, 25 bp, Mus musculus
gacccacgattccgacccactgcca

SEQ ID NO: 928078 - DNA, 25 bp, Mus musculus
gacccacgattcggacccactgcca

SEQ ID NO: 928079 - DNA, 25 bp, Mus musculus
gacccacgcaaactacagctgaatc

SEQ ID NO: 928080 - DNA, 25 bp, Mus musculus
gacccacgcatactacagctgaatc

SEQ ID NO: 928081 - DNA, 25 bp, Mus musculus
gacccagaagatgatttttgatcct

SEQ ID NO: 928082 - DNA, 25 bp, Mus musculus
gacccagaagttgatttttgatcct

SEQ ID NO: 928083 - DNA, 25 bp, Mus musculus
gacccagacatgatagtgatcggca

SEQ ID NO: 928084 - DNA, 25 bp, Mus musculus
gacccagacatgttagtgatcggca

SEQ ID NO: 928085 - DNA, 25 bp, Mus musculus
gacccagagacacgtgtattcactg

SEQ ID NO: 928086 - DNA, 25 bp, Mus musculus
gacccagagacaggtgtattcactg

SEQ ID NO: 928087 - DNA, 25 bp, Mus musculus
gacccagcagctggacagtatctca

SEQ ID NO: 928088 - DNA, 25 bp, Mus musculus
gacccagcaggtggacagtatctca

SEQ ID NO: 928089 - DNA, 25 bp, Mus musculus
gacccagcccagaacaagcctgcca

SEQ ID NO: 928090 - DNA, 25 bp, Mus musculus
gacccagcccagcttccgagtccga

SEQ ID NO: 928091 - DNA, 25 bp, Mus musculus
gacccagcccaggttccgagtccga

SEQ ID NO: 928092 - DNA, 25 bp, Mus musculus
gacccagcccagtacaagcctgcca

SEQ ID NO: 928093 - DNA, 25 bp, Mus musculus
gacccagctgcacgaagctgagcag

SEQ ID NO: 928094 - DNA, 25 bp, Mus musculus
gacccagctgcaggaagctgagcag

SEQ ID NO: 928095 - DNA, 25 bp, Mus musculus
gacccaggacagacagctgcagcac

SEQ ID NO: 928096 - DNA, 25 bp, Mus musculus
gacccaggacagtcagctgcagcac

SEQ ID NO: 928097 - DNA, 25 bp, Mus musculus
gacccaggtcaacacatacaagctg

SEQ ID NO: 928098 - DNA, 25 bp, Mus musculus
gacccaggtcaacagatacaagctg

SEQ ID NO: 928099 - DNA, 25 bp, Mus musculus
gacccagtacatgaccatcccatcc

SEQ ID NO: 928100 - DNA, 25 bp, Mus musculus
gacccagtacatgagcatcccatcc

SEQ ID NO: 928101 - DNA, 25 bp, Mus musculus
gacccagtatacctgttactgctgc

SEQ ID NO: 928102 - DNA, 25 bp, Mus musculus
gacccagtattcctgttactgctgc

SEQ ID NO: 928103 - DNA, 25 bp, Mus musculus
gacccagttgcttcatctggctcat

SEQ ID NO: 928104 - DNA, 25 bp, Mus musculus
gacccagttggttcatctggctcat

SEQ ID NO: 928105 - DNA, 25 bp, Mus musculus
gacccatcagaactcctaggtactg

SEQ ID NO: 928106 - DNA, 25 bp, Mus musculus
gacccatcagaagtcctaggtactg

SEQ ID NO: 928107 - DNA, 25 bp, Mus musculus
gacccatggatggacggatcgctta

SEQ ID NO: 928108 - DNA, 25 bp, Mus musculus
gacccatggatggagggatcgctta

SEQ ID NO: 928109 - DNA, 25 bp, Mus musculus
gaccccaaagcccatgaagaagatg

SEQ ID NO: 928110 - DNA, 25 bp, Mus musculus
gaccccaaaggccatgaagaagatg

SEQ ID NO: 928111 - DNA, 25 bp, Mus musculus
gaccccaagagaagggagtggatca

SEQ ID NO: 928112 - DNA, 25 bp, Mus musculus
gaccccaagagacacaacaatcctc

SEQ ID NO: 928113 - DNA, 25 bp, Mus musculus
gaccccaagagagacaacaatcctc

SEQ ID NO: 928114 - DNA, 25 bp, Mus musculus
gaccccaagagatgggagtggatca

SEQ ID NO: 928115 - DNA, 25 bp, Mus musculus
gaccccacaatccaagatgcttata

SEQ ID NO: 928116 - DNA, 25 bp, Mus musculus
gaccccacaatccgcagagttcacg

SEQ ID NO: 928117 - DNA, 25 bp, Mus musculus
gaccccacaatcgaagatgcttata

SEQ ID NO: 928118 - DNA, 25 bp, Mus musculus
gaccccacaatcggcagagttcacg

SEQ ID NO: 928119 - DNA, 25 bp, Mus musculus
gaccccaccattcaagatgcttata

SEQ ID NO: 928120 - DNA, 25 bp, Mus musculus
gaccccaccattgaagatgcttata

SEQ ID NO: 928121 - DNA, 25 bp, Mus musculus
gaccccaccccgctcgcaaatctca

SEQ ID NO: 928122 - DNA, 25 bp, Mus musculus
gaccccaccccgctggcaaatctca

SEQ ID NO: 928123 - DNA, 25 bp, Mus musculus
gaccccaccgagcatgcgtcttaag

SEQ ID NO: 928124 - DNA, 25 bp, Mus musculus
gaccccaccgtgcatgcgtcttaag

SEQ ID NO: 928125 - DNA, 25 bp, Mus musculus
gaccccagaaaactcgtaccactgc

SEQ ID NO: 928126 - DNA, 25 bp, Mus musculus
gaccccagaaaactggtaccactgc

SEQ ID NO: 928127 - DNA, 25 bp, Mus musculus
gaccccagaagtaacattggcctgt

SEQ ID NO: 928128 - DNA, 25 bp, Mus musculus
gaccccagaagtaagattggcctgt

SEQ ID NO: 928129 - DNA, 25 bp, Mus musculus
gaccccagagaccccagactcggag

SEQ ID NO: 928130 - DNA, 25 bp, Mus musculus
gaccccagagtccccagactcggag

SEQ ID NO: 928131 - DNA, 25 bp, Mus musculus
gaccccatgtggccacagtacacga

SEQ ID NO: 928132 - DNA, 25 bp, Mus musculus
gaccccatgtgggcacagtacacga

SEQ ID NO: 928133 - DNA, 25 bp, Mus musculus
gacccccaagaggccattaactgtc

SEQ ID NO: 928134 - DNA, 25 bp, Mus musculus
gacccccaagcccatcgcccactat

SEQ ID NO: 928135 - DNA, 25 bp, Mus musculus
gacccccaaggccatcgcccactat

SEQ ID NO: 928136 - DNA, 25 bp, Mus musculus
gacccccaagtggccattaactgtc

SEQ ID NO: 928137 - DNA, 25 bp, Mus musculus
gacccccaggcccacgcgtgctggt

SEQ ID NO: 928138 - DNA, 25 bp, Mus musculus
gacccccaggcccaggcgtgctggt

SEQ ID NO: 928139 - DNA, 25 bp, Mus musculus
gaccccccagaccaggtggtgtttg

SEQ ID NO: 928140 - DNA, 25 bp, Mus musculus
gaccccccagtccaggtggtgtttg

SEQ ID NO: 928141 - DNA, 25 bp, Mus musculus
gacccccgtcaggacgcaagctgct

SEQ ID NO: 928142 - DNA, 25 bp, Mus musculus
gacccccgtcaggaggcaagctgct

SEQ ID NO: 928143 - DNA, 25 bp, Mus musculus
gaccccctggcaggacactactgga

SEQ ID NO: 928144 - DNA, 25 bp, Mus musculus
gaccccctgggaggacactactgga

SEQ ID NO: 928145 - DNA, 25 bp, Mus musculus
gaccccgaagcacaggatgaaggac

SEQ ID NO: 928146 - DNA, 25 bp, Mus musculus
gaccccgaagcagaggatgaaggac

SEQ ID NO: 928147 - DNA, 25 bp, Mus musculus
gacccctaccagcagcccaagagaa

SEQ ID NO: 928148 - DNA, 25 bp, Mus musculus
gacccctaccaggagcccaagagaa

SEQ ID NO: 928149 - DNA, 25 bp, Mus musculus
gacccctctataaaccattgaggcc

SEQ ID NO: 928150 - DNA, 25 bp, Mus musculus
gacccctctataaagcattgaggcc

SEQ ID NO: 928151 - DNA, 25 bp, Mus musculus
gacccctgcagacgtcaccaagctc

SEQ ID NO: 928152 - DNA, 25 bp, Mus musculus
gacccctgcagaggtcaccaagctc

SEQ ID NO: 928153 - DNA, 25 bp, Mus musculus
gacccctgccttgtccgaggtgttc

SEQ ID NO: 928154 - DNA, 25 bp, Mus musculus
gacccctgccttgtgcgaggtgttc

SEQ ID NO: 928155 - DNA, 25 bp, Mus musculus
gaccccttctcacaatacagcccag

SEQ ID NO: 928156 - DNA, 25 bp, Mus musculus
gaccccttctcagaatacagcccag

SEQ ID NO: 928157 - DNA, 25 bp, Mus musculus
gacccgcaagcatcactgccgagca

SEQ ID NO: 928158 - DNA, 25 bp, Mus musculus
gacccgcaaggatcactgccgagca

SEQ ID NO: 928159 - DNA, 25 bp, Mus musculus
gacccggcagcgcgtggaggatgcc

SEQ ID NO: 928160 - DNA, 25 bp, Mus musculus
gacccggcagggcgtggaggatgcc

SEQ ID NO: 928161 - DNA, 25 bp, Mus musculus
gacccggggagagaaggacttccag

SEQ ID NO: 928162 - DNA, 25 bp, Mus musculus
gacccggggagagatggacttccag

SEQ ID NO: 928163 - DNA, 25 bp, Mus musculus
gaccctaatacacgtctagccctgg

SEQ ID NO: 928164 - DNA, 25 bp, Mus musculus
gaccctaatacaggtctagccctgg

SEQ ID NO: 928165 - DNA, 25 bp, Mus musculus
gaccctagagccaaagctggtgaaa

SEQ ID NO: 928166 - DNA, 25 bp, Mus musculus
gaccctagaggcaaagctggtgaaa

SEQ ID NO: 928167 - DNA, 25 bp, Mus musculus
gaccctagcttaagtatacctggcc

SEQ ID NO: 928168 - DNA, 25 bp, Mus musculus
gaccctagcttatgtatacctggcc

SEQ ID NO: 928169 - DNA, 25 bp, Mus musculus
gaccctatgaagatgaaaacacagc

SEQ ID NO: 928170 - DNA, 25 bp, Mus musculus
gaccctatgaagttgaaaacacagc

SEQ ID NO: 928171 - DNA, 25 bp, Mus musculus
gaccctcaagctgccctatgagaca

SEQ ID NO: 928172 - DNA, 25 bp, Mus musculus
gaccctcaaggtgccctatgagaca

SEQ ID NO: 928173 - DNA, 25 bp, Mus musculus
gaccctcctgctgtcaagtgggcta

SEQ ID NO: 928174 - DNA, 25 bp, Mus musculus
gaccctcctgctgtgaagtgggcta

SEQ ID NO: 928175 - DNA, 25 bp, Mus musculus
gaccctctctggcacaacccctgtg

SEQ ID NO: 928176 - DNA, 25 bp, Mus musculus
gaccctctctggcagaacccctgtg

SEQ ID NO: 928177 - DNA, 25 bp, Mus musculus
gaccctcttctcaacgacatgtttg

SEQ ID NO: 928178 - DNA, 25 bp, Mus musculus
gaccctcttctcaaggacatgtttg

SEQ ID NO: 928179 - DNA, 25 bp, Mus musculus
gaccctgaaaataaaaatgatcctt

SEQ ID NO: 928180 - DNA, 25 bp, Mus musculus
gaccctgaaattaaaaatgatcctt

SEQ ID NO: 928181 - DNA, 25 bp, Mus musculus
gaccctgaacaacgtggcaatgaag

SEQ ID NO: 928182 - DNA, 25 bp, Mus musculus
gaccctgaacaaggtggcaatgaag

SEQ ID NO: 928183 - DNA, 25 bp, Mus musculus
gaccctgaagacacaacaggctggg

SEQ ID NO: 928184 - DNA, 25 bp, Mus musculus
gaccctgaaggtgtcgttcggacaa

SEQ ID NO: 928185 - DNA, 25 bp, Mus musculus
gaccctgaaggtgtggttcggacaa

SEQ ID NO: 928186 - DNA, 25 bp, Mus musculus
gaccctgaagtcacaacaggctggg

SEQ ID NO: 928187 - DNA, 25 bp, Mus musculus
gaccctgacacagtcatgtggctgg

SEQ ID NO: 928188 - DNA, 25 bp, Mus musculus
gaccctgacagagtcatgtggctgg

SEQ ID NO: 928189 - DNA, 25 bp, Mus musculus
gaccctgagctgcccaaaaggccag

SEQ ID NO: 928190 - DNA, 25 bp, Mus musculus
gaccctgagctgcctctctgacaaa

SEQ ID NO: 928191 - DNA, 25 bp, Mus musculus
gaccctgagctggccaaaaggccag

SEQ ID NO: 928192 - DNA, 25 bp, Mus musculus
gaccctgagctggctctctgacaaa

SEQ ID NO: 928193 - DNA, 25 bp, Mus musculus
gaccctgatctgcgccggtcaggga

SEQ ID NO: 928194 - DNA, 25 bp, Mus musculus
gaccctgatctgcggcggtcaggga

SEQ ID NO: 928195 - DNA, 25 bp, Mus musculus
gaccctgcaagagtcgtgcgtgggc

SEQ ID NO: 928196 - DNA, 25 bp, Mus musculus
gaccctgcaagagtggtgcgtgggc

SEQ ID NO: 928197 - DNA, 25 bp, Mus musculus
gaccctgcagggcagagaatcaatg

SEQ ID NO: 928198 - DNA, 25 bp, Mus musculus
gaccctgcaggggagagaatcaatg

SEQ ID NO: 928199 - DNA, 25 bp, Mus musculus
gaccctggacgaactgctctctaga

SEQ ID NO: 928200 - DNA, 25 bp, Mus musculus
gaccctggacgatctgctctctaga

SEQ ID NO: 928201 - DNA, 25 bp, Mus musculus
gaccctggagacagcggtcccattg

SEQ ID NO: 928202 - DNA, 25 bp, Mus musculus
gaccctggagacaggggtcccattg

SEQ ID NO: 928203 - DNA, 25 bp, Mus musculus
gaccctggcctgcctgagggatctg

SEQ ID NO: 928204 - DNA, 25 bp, Mus musculus
gaccctggcctggctgagggatctg

SEQ ID NO: 928205 - DNA, 25 bp, Mus musculus
gaccctggctcacctcagcatggga

SEQ ID NO: 928206 - DNA, 25 bp, Mus musculus
gaccctggctgacctcagcatggga

SEQ ID NO: 928207 - DNA, 25 bp, Mus musculus
gaccctggtaagctgccagagccag

SEQ ID NO: 928208 - DNA, 25 bp, Mus musculus
gaccctggtaaggtgccagagccag

SEQ ID NO: 928209 - DNA, 25 bp, Mus musculus
gaccctggtcagcccgtttctctcc

SEQ ID NO: 928210 - DNA, 25 bp, Mus musculus
gaccctggtcagccggtttctctcc

SEQ ID NO: 928211 - DNA, 25 bp, Mus musculus
gaccctgtctcggtcctcttcaaat

SEQ ID NO: 928212 - DNA, 25 bp, Mus musculus
gaccctgtctcggtctccttcccgt

SEQ ID NO: 928213 - DNA, 25 bp, Mus musculus
gaccctgtctcggtgctcttcaaat

SEQ ID NO: 928214 - DNA, 25 bp, Mus musculus
gaccctgtctcggtgtccttcccgt

SEQ ID NO: 928215 - DNA, 25 bp, Mus musculus
gaccctgtgtttgtcgtcctccact

SEQ ID NO: 928216 - DNA, 25 bp, Mus musculus
gaccctgtgtttgtcgtctttgctg

SEQ ID NO: 928217 - DNA, 25 bp, Mus musculus
gaccctgtgtttgtggtcctccact

SEQ ID NO: 928218 - DNA, 25 bp, Mus musculus
gaccctgtgtttgtggtctttgctg

SEQ ID NO: 928219 - DNA, 25 bp, Mus musculus
gacccttgaactcaggaacgggcat

SEQ ID NO: 928220 - DNA, 25 bp, Mus musculus
gacccttgaactgaggaacgggcat

SEQ ID NO: 928221 - DNA, 25 bp, Mus musculus
gacccttgcgatccttgcacttgcc

SEQ ID NO: 928222 - DNA, 25 bp, Mus musculus
gacccttgcgttccttgcacttgcc

SEQ ID NO: 928223 - DNA, 25 bp, Mus musculus
gacccttggcagacagggtcccttg

SEQ ID NO: 928224 - DNA, 25 bp, Mus musculus
gacccttggcagtcagggtcccttg

SEQ ID NO: 928225 - DNA, 25 bp, Mus musculus
gacccttgggtcaacgtcgagtatg

SEQ ID NO: 928226 - DNA, 25 bp, Mus musculus
gacccttgggtcaaggtcgagtatg

SEQ ID NO: 928227 - DNA, 25 bp, Mus musculus
gaccctttctttcatatgcacatga

SEQ ID NO: 928228 - DNA, 25 bp, Mus musculus
gaccctttctttgatatgcacatga

SEQ ID NO: 928229 - DNA, 25 bp, Mus musculus
gaccgaatcctgagtagcaagatgg

SEQ ID NO: 928230 - DNA, 25 bp, Mus musculus
gaccgaatcctgtgtagcaagatgg

SEQ ID NO: 928231 - DNA, 25 bp, Mus musculus
gaccgacacaagagcaagctgattg

SEQ ID NO: 928232 - DNA, 25 bp, Mus musculus
gaccgacacaagtgcaagctgattg

SEQ ID NO: 928233 - DNA, 25 bp, Mus musculus
gaccgagcagcgaacagttgaatag

SEQ ID NO: 928234 - DNA, 25 bp, Mus musculus
gaccgagcagcgtacagttgaatag

SEQ ID NO: 928235 - DNA, 25 bp, Mus musculus
gaccgagtgacacgtggtcaagatg

SEQ ID NO: 928236 - DNA, 25 bp, Mus musculus
gaccgagtgacaggtggtcaagatg

SEQ ID NO: 928237 - DNA, 25 bp, Mus musculus
gaccgcacagcaaatgcaagagaaa

SEQ ID NO: 928238 - DNA, 25 bp, Mus musculus
gaccgcacagctactgagacagagg

SEQ ID NO: 928239 - DNA, 25 bp, Mus musculus
gaccgcacaggaaatgcaagagaaa

SEQ ID NO: 928240 - DNA, 25 bp, Mus musculus
gaccgcacaggtactgagacagagg

SEQ ID NO: 928241 - DNA, 25 bp, Mus musculus
gaccgcagagcgactatacaactcc

SEQ ID NO: 928242 - DNA, 25 bp, Mus musculus
gaccgcagagcggactatacaactc

SEQ ID NO: 928243 - DNA, 25 bp, Mus musculus
gaccgcagagggactatacaactcc

SEQ ID NO: 928244 - DNA, 25 bp, Mus musculus
gaccgcagaggggactatacaactc

SEQ ID NO: 928245 - DNA, 25 bp, Mus musculus
gaccgcagcaccggcgtgttgccca

SEQ ID NO: 928246 - DNA, 25 bp, Mus musculus
gaccgcagcaccggggtgttgccca

SEQ ID NO: 928247 - DNA, 25 bp, Mus musculus
gaccgcaggacgcggaaccatgtgc

SEQ ID NO: 928248 - DNA, 25 bp, Mus musculus
gaccgcaggacggggaaccatgtgc

SEQ ID NO: 928249 - DNA, 25 bp, Mus musculus
gaccgccaagattgaggatgagacg

SEQ ID NO: 928250 - DNA, 25 bp, Mus musculus
gaccgccaagtttgaggatgagacg

SEQ ID NO: 928251 - DNA, 25 bp, Mus musculus
gaccgccgccaacgctgaagctgac

SEQ ID NO: 928252 - DNA, 25 bp, Mus musculus
gaccgccgccaaggctgaagctgac

SEQ ID NO: 928253 - DNA, 25 bp, Mus musculus
gaccgctcctcacgcaaacactatg

SEQ ID NO: 928254 - DNA, 25 bp, Mus musculus
gaccgctcctcaggcaaacactatg

SEQ ID NO: 928255 - DNA, 25 bp, Mus musculus
gaccgctgccagccctcctctgaca

SEQ ID NO: 928256 - DNA, 25 bp, Mus musculus
gaccgctgccaggcctcctctgaca

SEQ ID NO: 928257 - DNA, 25 bp, Mus musculus
gaccgcttatagcccaaggaacaga

SEQ ID NO: 928258 - DNA, 25 bp, Mus musculus
gaccgcttatagccttggggcatat

SEQ ID NO: 928259 - DNA, 25 bp, Mus musculus
gaccgcttataggccaaggaacaga

SEQ ID NO: 928260 - DNA, 25 bp, Mus musculus
gaccgcttataggcttggggcatat

SEQ ID NO: 928261 - DNA, 25 bp, Mus musculus
gaccggagcaagcacctcgaggagg

SEQ ID NO: 928262 - DNA, 25 bp, Mus musculus
gaccggagcaagcacctggaagatg

SEQ ID NO: 928263 - DNA, 25 bp, Mus musculus
gaccggagcaagcagctcgaggagg

SEQ ID NO: 928264 - DNA, 25 bp, Mus musculus
gaccggagcaagcagctggaagatg

SEQ ID NO: 928265 - DNA, 25 bp, Mus musculus
gaccggatccgacgtgccgccgccg

SEQ ID NO: 928266 - DNA, 25 bp, Mus musculus
gaccggatccgaggtgccgccgccg

SEQ ID NO: 928267 - DNA, 25 bp, Mus musculus
gaccgggagaagagagctctggctg

SEQ ID NO: 928268 - DNA, 25 bp, Mus musculus
gaccgggagaagctcgacgggctgt

SEQ ID NO: 928269 - DNA, 25 bp, Mus musculus
gaccgggagaagctctggctgcaga

SEQ ID NO: 928270 - DNA, 25 bp, Mus musculus
gaccgggagaagctggacgggctgt

SEQ ID NO: 928271 - DNA, 25 bp, Mus musculus
gaccgggagaaggtctggctgcaga

SEQ ID NO: 928272 - DNA, 25 bp, Mus musculus
gaccgggagaagtgagctctggctg

SEQ ID NO: 928273 - DNA, 25 bp, Mus musculus
gaccgggtgccgctcatcgtggaga

SEQ ID NO: 928274 - DNA, 25 bp, Mus musculus
gaccgggtgccggtcatcgtggaga

SEQ ID NO: 928275 - DNA, 25 bp, Mus musculus
gaccggttatatcacagtggtgatg

SEQ ID NO: 928276 - DNA, 25 bp, Mus musculus
gaccggttatatcagagtggtgatg

SEQ ID NO: 928277 - DNA, 25 bp, Mus musculus
gaccgtacacagatcgccatctgcc

SEQ ID NO: 928278 - DNA, 25 bp, Mus musculus
gaccgtacactgatcgccatctgcc

SEQ ID NO: 928279 - DNA, 25 bp, Mus musculus
gaccgtaccaagcgatagcccacct

SEQ ID NO: 928280 - DNA, 25 bp, Mus musculus
gaccgtaccaagggatagcccacct

SEQ ID NO: 928281 - DNA, 25 bp, Mus musculus
gaccgtgcacagcacggtgtctcct

SEQ ID NO: 928282 - DNA, 25 bp, Mus musculus
gaccgtgcacagcagggtgtctcct

SEQ ID NO: 928283 - DNA, 25 bp, Mus musculus
gaccgtgccgaacgtgctggccaaa

SEQ ID NO: 928284 - DNA, 25 bp, Mus musculus
gaccgtgccgtacgtgctggccaaa

SEQ ID NO: 928285 - DNA, 25 bp, Mus musculus
gaccgtgctcagcatcaaggagacg

SEQ ID NO: 928286 - DNA, 25 bp, Mus musculus
gaccgtgctcaggatcaaggagacg

SEQ ID NO: 928287 - DNA, 25 bp, Mus musculus
gaccgtgctcaggtcactgattctt

SEQ ID NO: 928288 - DNA, 25 bp, Mus musculus
gaccgtgctcaggtgactgattctt

SEQ ID NO: 928289 - DNA, 25 bp, Mus musculus
gaccgtggcaaaagctctcagatca

SEQ ID NO: 928290 - DNA, 25 bp, Mus musculus
gaccgtggcaaaaggtctcagatca

SEQ ID NO: 928291 - DNA, 25 bp, Mus musculus
gaccgttgtagactgtgtaatgctg

SEQ ID NO: 928292 - DNA, 25 bp, Mus musculus
gaccgttgtagagtgtgtaatgctg

SEQ ID NO: 928293 - DNA, 25 bp, Mus musculus
gacctaatagaaaaaaacacaaatg

SEQ ID NO: 928294 - DNA, 25 bp, Mus musculus
gacctaatagaaaataacacaaatg

SEQ ID NO: 928295 - DNA, 25 bp, Mus musculus
gacctacaaacagacggcagagaat

SEQ ID NO: 928296 - DNA, 25 bp, Mus musculus
gacctacaaacagagggcagagaat

SEQ ID NO: 928297 - DNA, 25 bp, Mus musculus
gacctacaagctcggacatcaaata

SEQ ID NO: 928298 - DNA, 25 bp, Mus musculus
gacctacaaggtcggacatcaaata

SEQ ID NO: 928299 - DNA, 25 bp, Mus musculus
gacctacatgaaaaccttgtggcag

SEQ ID NO: 928300 - DNA, 25 bp, Mus musculus
gacctacatgaaaagcttgtggcag

SEQ ID NO: 928301 - DNA, 25 bp, Mus musculus
gacctaccagccaatccagtctccc

SEQ ID NO: 928302 - DNA, 25 bp, Mus musculus
gacctaccagcctatccagtctccc

SEQ ID NO: 928303 - DNA, 25 bp, Mus musculus
gacctactcccactgaccttcagaa

SEQ ID NO: 928304 - DNA, 25 bp, Mus musculus
gacctactcccagtgaccttcagaa

SEQ ID NO: 928305 - DNA, 25 bp, Mus musculus
gacctagcagccttacagttcctcc

SEQ ID NO: 928306 - DNA, 25 bp, Mus musculus
gacctagcaggcttacagttcctcc

SEQ ID NO: 928307 - DNA, 25 bp, Mus musculus
gacctcacaaagctagttcttccaa

SEQ ID NO: 928308 - DNA, 25 bp, Mus musculus
gacctcacaaaggtagttcttccaa

SEQ ID NO: 928309 - DNA, 25 bp, Mus musculus
gacctcacagatgccacgcccaccg

SEQ ID NO: 928310 - DNA, 25 bp, Mus musculus
gacctcacagttgccacgcccaccg

SEQ ID NO: 928311 - DNA, 25 bp, Mus musculus
gacctcaccagcaacctggttctag

SEQ ID NO: 928312 - DNA, 25 bp, Mus musculus
gacctcaccagcaagctggttctag

SEQ ID NO: 928313 - DNA, 25 bp, Mus musculus
gacctcactgatggccagttctact

SEQ ID NO: 928314 - DNA, 25 bp, Mus musculus
gacctcactgttggccagttctact

SEQ ID NO: 928315 - DNA, 25 bp, Mus musculus
gacctcagattccacaatggctcat

SEQ ID NO: 928316 - DNA, 25 bp, Mus musculus
gacctcagattccagaatggctcat

SEQ ID NO: 928317 - DNA, 25 bp, Mus musculus
gacctcaggtctttagcatgagctt

SEQ ID NO: 928318 - DNA, 25 bp, Mus musculus
gacctcaggtgtttagcatgagctt

SEQ ID NO: 928319 - DNA, 25 bp, Mus musculus
gacctcatcactcatctgctaaatg

SEQ ID NO: 928320 - DNA, 25 bp, Mus musculus
gacctcatcactgatctgctaaatg

SEQ ID NO: 928321 - DNA, 25 bp, Mus musculus
gacctcatccagaccagagggcctg

SEQ ID NO: 928322 - DNA, 25 bp, Mus musculus
gacctcatccagcttactggcggtt

SEQ ID NO: 928323 - DNA, 25 bp, Mus musculus
gacctcatccaggttactggcggtt

SEQ ID NO: 928324 - DNA, 25 bp, Mus musculus
gacctcatccagtccagagggcctg

SEQ ID NO: 928325 - DNA, 25 bp, Mus musculus
gacctcatctagctacgtaggtgcc

SEQ ID NO: 928326 - DNA, 25 bp, Mus musculus
gacctcatctaggtacgtaggtgcc

SEQ ID NO: 928327 - DNA, 25 bp, Mus musculus
gacctcatgccacctatgaacctga

SEQ ID NO: 928328 - DNA, 25 bp, Mus musculus
gacctcatgccagctatgaacctga

SEQ ID NO: 928329 - DNA, 25 bp, Mus musculus
gacctccaaatgcttctgaatcaga

SEQ ID NO: 928330 - DNA, 25 bp, Mus musculus
gacctccaaatggttctgaatcaga

SEQ ID NO: 928331 - DNA, 25 bp, Mus musculus
gacctccaaccacgagtatctggac

SEQ ID NO: 928332 - DNA, 25 bp, Mus musculus
gacctccaaccaggagtatctggac

SEQ ID NO: 928333 - DNA, 25 bp, Mus musculus
gacctccaagccaagatcacttcac

SEQ ID NO: 928334 - DNA, 25 bp, Mus musculus
gacctccaagcgcccaatgtaaagg

SEQ ID NO: 928335 - DNA, 25 bp, Mus musculus
gacctccaaggcaagatcacttcac

SEQ ID NO: 928336 - DNA, 25 bp, Mus musculus
gacctccaagggcccaatgtaaagg

SEQ ID NO: 928337 - DNA, 25 bp, Mus musculus
gacctcccacagtttactgactgct

SEQ ID NO: 928338 - DNA, 25 bp, Mus musculus
gacctcccacattactgactgctgg

SEQ ID NO: 928339 - DNA, 25 bp, Mus musculus
gacctcccactgtttactgactgct

SEQ ID NO: 928340 - DNA, 25 bp, Mus musculus
gacctcccactttactgactgctgg

SEQ ID NO: 928341 - DNA, 25 bp, Mus musculus
gacctcccagcagctgcagatgaag

SEQ ID NO: 928342 - DNA, 25 bp, Mus musculus
gacctcccaggagctgcagatgaag

SEQ ID NO: 928343 - DNA, 25 bp, Mus musculus
gacctccgagcacgggactcgtggg

SEQ ID NO: 928344 - DNA, 25 bp, Mus musculus
gacctccgagcaggggactcgtggg

SEQ ID NO: 928345 - DNA, 25 bp, Mus musculus
gacctcctcaagctcaaggacttcg

SEQ ID NO: 928346 - DNA, 25 bp, Mus musculus
gacctcctcaagctgaaggacttcg

SEQ ID NO: 928347 - DNA, 25 bp, Mus musculus
gacctcggagaacttccaggtcctg

SEQ ID NO: 928348 - DNA, 25 bp, Mus musculus
gacctcggagccacagagatccttt

SEQ ID NO: 928349 - DNA, 25 bp, Mus musculus
gacctcggagcgatgactcgagatg

SEQ ID NO: 928350 - DNA, 25 bp, Mus musculus
gacctcggagctgcccagacccctc

SEQ ID NO: 928351 - DNA, 25 bp, Mus musculus
gacctcggaggcacagagatccttt

SEQ ID NO: 928352 - DNA, 25 bp, Mus musculus
gacctcggagggatgactcgagatg

SEQ ID NO: 928353 - DNA, 25 bp, Mus musculus
gacctcggaggtgcccagacccctc

SEQ ID NO: 928354 - DNA, 25 bp, Mus musculus
gacctcggagtacttccaggtcctg

SEQ ID NO: 928355 - DNA, 25 bp, Mus musculus
gacctctaccagcacgcttccccac

SEQ ID NO: 928356 - DNA, 25 bp, Mus musculus
gacctctaccagcaggcttccccac

SEQ ID NO: 928357 - DNA, 25 bp, Mus musculus
gacctctacgccgacggctgtgagg

SEQ ID NO: 928358 - DNA, 25 bp, Mus musculus
gacctctacgccgagggctgtgagg

SEQ ID NO: 928359 - DNA, 25 bp, Mus musculus
gacctctatcagactcgacacaata

SEQ ID NO: 928360 - DNA, 25 bp, Mus musculus
gacctctatcagtctcgacacaata

SEQ ID NO: 928361 - DNA, 25 bp, Mus musculus
gacctctcccaccaacccaaattta

SEQ ID NO: 928362 - DNA, 25 bp, Mus musculus
gacctctcccaccaagaaacaaaag

SEQ ID NO: 928363 - DNA, 25 bp, Mus musculus
gacctctcccaccatcccaaattta

SEQ ID NO: 928364 - DNA, 25 bp, Mus musculus
gacctctcccaccatgaaacaaaag

SEQ ID NO: 928365 - DNA, 25 bp, Mus musculus
gacctctgcgaaccaaacacactgg

SEQ ID NO: 928366 - DNA, 25 bp, Mus musculus
gacctctgcgaaccaactgccaggg

SEQ ID NO: 928367 - DNA, 25 bp, Mus musculus
gacctctgcgaacctaacacactgg

SEQ ID NO: 928368 - DNA, 25 bp, Mus musculus
gacctctgcgaacctactgccaggg

SEQ ID NO: 928369 - DNA, 25 bp, Mus musculus
gacctcttgcagcaagggttggcgg

SEQ ID NO: 928370 - DNA, 25 bp, Mus musculus
gacctcttgcaggaagggttggcgg

SEQ ID NO: 928371 - DNA, 25 bp, Mus musculus
gacctgaaacccgacaacatcttgt

SEQ ID NO: 928372 - DNA, 25 bp, Mus musculus
gacctgaaacccgagaacatcttgt

SEQ ID NO: 928373 - DNA, 25 bp, Mus musculus
gacctgaacacacgggagccgatgg

SEQ ID NO: 928374 - DNA, 25 bp, Mus musculus
gacctgaacacaggggagccgatgg

SEQ ID NO: 928375 - DNA, 25 bp, Mus musculus
gacctgaatagcgtccctcaggagc

SEQ ID NO: 928376 - DNA, 25 bp, Mus musculus
gacctgaatagcgtgcctcaggagc

SEQ ID NO: 928377 - DNA, 25 bp, Mus musculus
gacctgactcagagaggaagaacct

SEQ ID NO: 928378 - DNA, 25 bp, Mus musculus
gacctgactcagtgaggaagaacct

SEQ ID NO: 928379 - DNA, 25 bp, Mus musculus
gacctgactgagattggagagcgag

SEQ ID NO: 928380 - DNA, 25 bp, Mus musculus
gacctgactgagtttggagagcgag

SEQ ID NO: 928381 - DNA, 25 bp, Mus musculus
gacctgagagaactgtgctaatgaa

SEQ ID NO: 928382 - DNA, 25 bp, Mus musculus
gacctgagagaagtgtgctaatgaa

SEQ ID NO: 928383 - DNA, 25 bp, Mus musculus
gacctgagcaaaagtgaactcaatg

SEQ ID NO: 928384 - DNA, 25 bp, Mus musculus
gacctgagcaaatgtgaactcaatg

SEQ ID NO: 928385 - DNA, 25 bp, Mus musculus
gacctgataactcaaagcctcctgt

SEQ ID NO: 928386 - DNA, 25 bp, Mus musculus
gacctgataactgaaagcctcctgt

SEQ ID NO: 928387 - DNA, 25 bp, Mus musculus
gacctgatagcacctgtgagtacca

SEQ ID NO: 928388 - DNA, 25 bp, Mus musculus
gacctgatagcagctgtgagtacca

SEQ ID NO: 928389 - DNA, 25 bp, Mus musculus
gacctgatcgagaacaaacttggcc

SEQ ID NO: 928390 - DNA, 25 bp, Mus musculus
gacctgatcgagaagaaacttggcc

SEQ ID NO: 928391 - DNA, 25 bp, Mus musculus
gacctgatctttatcgtacagaacc

SEQ ID NO: 928392 - DNA, 25 bp, Mus musculus
gacctgatctttatggtacagaacc

SEQ ID NO: 928393 - DNA, 25 bp, Mus musculus
gacctgcaagagctaggattgggcc

SEQ ID NO: 928394 - DNA, 25 bp, Mus musculus
gacctgcaagcaatctccggttcca

SEQ ID NO: 928395 - DNA, 25 bp, Mus musculus
gacctgcaagcacccagagcagagg

SEQ ID NO: 928396 - DNA, 25 bp, Mus musculus
gacctgcaagcagagctaggattgg

SEQ ID NO: 928397 - DNA, 25 bp, Mus musculus
gacctgcaagccctacctgacctga

SEQ ID NO: 928398 - DNA, 25 bp, Mus musculus
gacctgcaaggaatctccggttcca

SEQ ID NO: 928399 - DNA, 25 bp, Mus musculus
gacctgcaaggacccagagcagagg

SEQ ID NO: 928400 - DNA, 25 bp, Mus musculus
gacctgcaaggagagctaggattgg

SEQ ID NO: 928401 - DNA, 25 bp, Mus musculus
gacctgcaaggcctacctgacctga

SEQ ID NO: 928402 - DNA, 25 bp, Mus musculus
gacctgcaagtgctaggattgggcc

SEQ ID NO: 928403 - DNA, 25 bp, Mus musculus
gacctgcactctcacgcggtgttta

SEQ ID NO: 928404 - DNA, 25 bp, Mus musculus
gacctgcactgggaaatatggcttt

SEQ ID NO: 928405 - DNA, 25 bp, Mus musculus
gacctgcactgggaaggcttgtcgc

SEQ ID NO: 928406 - DNA, 25 bp, Mus musculus
gacctgcactgggatatatggcttt

SEQ ID NO: 928407 - DNA, 25 bp, Mus musculus
gacctgcactgggatggcttgtcgc

SEQ ID NO: 928408 - DNA, 25 bp, Mus musculus
gacctgcactgtcacgcggtgttta

SEQ ID NO: 928409 - DNA, 25 bp, Mus musculus
gacctgcatgtcctcgacaccctgg

SEQ ID NO: 928410 - DNA, 25 bp, Mus musculus
gacctgcatgtcctggacaccctgg

SEQ ID NO: 928411 - DNA, 25 bp, Mus musculus
gacctgccaaaacttgtggagctcc

SEQ ID NO: 928412 - DNA, 25 bp, Mus musculus
gacctgccaaaagttgtggagctcc

SEQ ID NO: 928413 - DNA, 25 bp, Mus musculus
gacctgcccaggcgtggagctgccc

SEQ ID NO: 928414 - DNA, 25 bp, Mus musculus
gacctgcccaggggtggagctgccc

SEQ ID NO: 928415 - DNA, 25 bp, Mus musculus
gacctgccccaacggtctgaatccg

SEQ ID NO: 928416 - DNA, 25 bp, Mus musculus
gacctgccccaagggtctgaatccg

SEQ ID NO: 928417 - DNA, 25 bp, Mus musculus
gacctgctgggcttctgtcttccaa

SEQ ID NO: 928418 - DNA, 25 bp, Mus musculus
gacctgctgggcttgtgtcttccaa

SEQ ID NO: 928419 - DNA, 25 bp, Mus musculus
gacctgcttgcaatgatggaggtcc

SEQ ID NO: 928420 - DNA, 25 bp, Mus musculus
gacctgcttgcccattcaaatatca

SEQ ID NO: 928421 - DNA, 25 bp, Mus musculus
gacctgcttgcttcaactggagagc

SEQ ID NO: 928422 - DNA, 25 bp, Mus musculus
gacctgcttggaatgatggaggtcc

SEQ ID NO: 928423 - DNA, 25 bp, Mus musculus
gacctgcttggccattcaaatatca

SEQ ID NO: 928424 - DNA, 25 bp, Mus musculus
gacctgcttggttcaactggagagc

SEQ ID NO: 928425 - DNA, 25 bp, Mus musculus
gacctggaagacgagctctatgccc

SEQ ID NO: 928426 - DNA, 25 bp, Mus musculus
gacctggaagataaactgaagtgca

SEQ ID NO: 928427 - DNA, 25 bp, Mus musculus
gacctggaagccctcgtcaaacaag

SEQ ID NO: 928428 - DNA, 25 bp, Mus musculus
gacctggaaggcctcgtcaaacaag

SEQ ID NO: 928429 - DNA, 25 bp, Mus musculus
gacctggaagtcgagctctatgccc

SEQ ID NO: 928430 - DNA, 25 bp, Mus musculus
gacctggaagttaaactgaagtgca

SEQ ID NO: 928431 - DNA, 25 bp, Mus musculus
gacctggatgcagtcgtgaatgtga

SEQ ID NO: 928432 - DNA, 25 bp, Mus musculus
gacctggatgcagtggtgaatgtga

SEQ ID NO: 928433 - DNA, 25 bp, Mus musculus
gacctggcagcggactgtcaaacaa

SEQ ID NO: 928434 - DNA, 25 bp, Mus musculus
gacctggcaggggactgtcaaacaa

SEQ ID NO: 928435 - DNA, 25 bp, Mus musculus
gacctggccaagaaccgcctctatc

SEQ ID NO: 928436 - DNA, 25 bp, Mus musculus
gacctggccaagtaccgcctctatc

SEQ ID NO: 928437 - DNA, 25 bp, Mus musculus
gacctggccgaaccatgacccgccg

SEQ ID NO: 928438 - DNA, 25 bp, Mus musculus
gacctggccgaagcatgacccgccg

SEQ ID NO: 928439 - DNA, 25 bp, Mus musculus
gacctggccttccacgtgaaagagg

SEQ ID NO: 928440 - DNA, 25 bp, Mus musculus
gacctggccttccaggtgaaagagg

SEQ ID NO: 928441 - DNA, 25 bp, Mus musculus
gacctggctccaatccatgaggcgc

SEQ ID NO: 928442 - DNA, 25 bp, Mus musculus
gacctggctccactctgttctcctg

SEQ ID NO: 928443 - DNA, 25 bp, Mus musculus
gacctggctccagtctgttctcctg

SEQ ID NO: 928444 - DNA, 25 bp, Mus musculus
gacctggctccattccatgaggcgc

SEQ ID NO: 928445 - DNA, 25 bp, Mus musculus
gacctggctgaggacctcctttctt

SEQ ID NO: 928446 - DNA, 25 bp, Mus musculus
gacctggctgaggacctcggatggg

SEQ ID NO: 928447 - DNA, 25 bp, Mus musculus
gacctggctgaggagctcctttctt

SEQ ID NO: 928448 - DNA, 25 bp, Mus musculus
gacctggctgaggagctcggatggg

SEQ ID NO: 928449 - DNA, 25 bp, Mus musculus
gacctgggaaacaatatctatcagt

SEQ ID NO: 928450 - DNA, 25 bp, Mus musculus
gacctgggaaactatatctatcagt

SEQ ID NO: 928451 - DNA, 25 bp, Mus musculus
gacctgtgaatatcactgttgtgaa

SEQ ID NO: 928452 - DNA, 25 bp, Mus musculus
gacctgtgaatatctctgttgtgaa

SEQ ID NO: 928453 - DNA, 25 bp, Mus musculus
gacctgtgcaacctcgcatccctga

SEQ ID NO: 928454 - DNA, 25 bp, Mus musculus
gacctgtgcaccaacgtgcagagtg

SEQ ID NO: 928455 - DNA, 25 bp, Mus musculus
gacctgtgcaccaaggtgcagagtg

SEQ ID NO: 928456 - DNA, 25 bp, Mus musculus
gacctgtgcagtaacctcgcatccc

SEQ ID NO: 928457 - DNA, 25 bp, Mus musculus
gacctgtgcagttacctcgcatccc

SEQ ID NO: 928458 - DNA, 25 bp, Mus musculus
gacctgtgcatcctcgcatccctga

SEQ ID NO: 928459 - DNA, 25 bp, Mus musculus
gacctgtggcaaaacactgctggag

SEQ ID NO: 928460 - DNA, 25 bp, Mus musculus
gacctgtggcaaaacccctggaaga

SEQ ID NO: 928461 - DNA, 25 bp, Mus musculus
gacctgtggcaaaagactgctggag

SEQ ID NO: 928462 - DNA, 25 bp, Mus musculus
gacctgtggcaaaagccctggaaga

SEQ ID NO: 928463 - DNA, 25 bp, Mus musculus
gacctgttccacatcgggcacgtgg

SEQ ID NO: 928464 - DNA, 25 bp, Mus musculus
gacctgttcctcatcgggcacgtgg

SEQ ID NO: 928465 - DNA, 25 bp, Mus musculus
gacctgttgcaagacggtgaagaag

SEQ ID NO: 928466 - DNA, 25 bp, Mus musculus
gacctgttgcaagagggtgaagaag

SEQ ID NO: 928467 - DNA, 25 bp, Mus musculus
gaccttacaatcaacatttctgacc

SEQ ID NO: 928468 - DNA, 25 bp, Mus musculus
gaccttacaatcaagatttctgacc

SEQ ID NO: 928469 - DNA, 25 bp, Mus musculus
gaccttatgaagctctttgaacagt

SEQ ID NO: 928470 - DNA, 25 bp, Mus musculus
gaccttatgaaggtctttgaacagt

SEQ ID NO: 928471 - DNA, 25 bp, Mus musculus
gaccttcaaaaccggcagcatcctc

SEQ ID NO: 928472 - DNA, 25 bp, Mus musculus
gaccttcaaaacgggcagcatcctc

SEQ ID NO: 928473 - DNA, 25 bp, Mus musculus
gaccttcaatagactgctggaaaaa

SEQ ID NO: 928474 - DNA, 25 bp, Mus musculus
gaccttcaatagtctgctggaaaaa

SEQ ID NO: 928475 - DNA, 25 bp, Mus musculus
gaccttccagcagcagcatgaagcg

SEQ ID NO: 928476 - DNA, 25 bp, Mus musculus
gaccttccaggagcagcatgaagcg

SEQ ID NO: 928477 - DNA, 25 bp, Mus musculus
gaccttcccaacactgctcctgaca

SEQ ID NO: 928478 - DNA, 25 bp, Mus musculus
gaccttcccaactctgctcctgaca

SEQ ID NO: 928479 - DNA, 25 bp, Mus musculus
gaccttccggcacgcagttcctcca

SEQ ID NO: 928480 - DNA, 25 bp, Mus musculus
gaccttccggcaggcagttcctcca

SEQ ID NO: 928481 - DNA, 25 bp, Mus musculus
gaccttctagacaacgcaggttcac

SEQ ID NO: 928482 - DNA, 25 bp, Mus musculus
gaccttctagacaaggcaggttcac

SEQ ID NO: 928483 - DNA, 25 bp, Mus musculus
gaccttctcagcagcgggcttcgca

SEQ ID NO: 928484 - DNA, 25 bp, Mus musculus
gaccttctcagccacagtgcgggct

SEQ ID NO: 928485 - DNA, 25 bp, Mus musculus
gaccttctcagcgacagtgcgggct

SEQ ID NO: 928486 - DNA, 25 bp, Mus musculus
gaccttctcagctgcgggcttcgca

SEQ ID NO: 928487 - DNA, 25 bp, Mus musculus
gaccttcttgcaccgggaataccag

SEQ ID NO: 928488 - DNA, 25 bp, Mus musculus
gaccttcttgcagcgggaataccag

SEQ ID NO: 928489 - DNA, 25 bp, Mus musculus
gaccttcttggccacactgaacact

SEQ ID NO: 928490 - DNA, 25 bp, Mus musculus
gaccttcttggccagactgaacact

SEQ ID NO: 928491 - DNA, 25 bp, Mus musculus
gaccttgaagcggactcagaagaag

SEQ ID NO: 928492 - DNA, 25 bp, Mus musculus
gaccttgaaggggactcagaagaag

SEQ ID NO: 928493 - DNA, 25 bp, Mus musculus
gaccttgagcagcaggcttctcaga

SEQ ID NO: 928494 - DNA, 25 bp, Mus musculus
gaccttgagcagcccaaagaagtgc

SEQ ID NO: 928495 - DNA, 25 bp, Mus musculus
gaccttgagcaggaggcttctcaga

SEQ ID NO: 928496 - DNA, 25 bp, Mus musculus
gaccttgagcaggccaaagaagtgc

SEQ ID NO: 928497 - DNA, 25 bp, Mus musculus
gaccttgcatgagtcgtgtgacggc

SEQ ID NO: 928498 - DNA, 25 bp, Mus musculus
gaccttgcatgagtggtgtgacggc

SEQ ID NO: 928499 - DNA, 25 bp, Mus musculus
gaccttgccaaaaactttctgaagc

SEQ ID NO: 928500 - DNA, 25 bp, Mus musculus
gaccttgccaaaaagtttctgaagc

SEQ ID NO: 928501 - DNA, 25 bp, Mus musculus
gaccttgctgagcctacagaatccc

SEQ ID NO: 928502 - DNA, 25 bp, Mus musculus
gaccttgctgaggctacagaatccc

SEQ ID NO: 928503 - DNA, 25 bp, Mus musculus
gaccttgctgcgcacatgatgctga

SEQ ID NO: 928504 - DNA, 25 bp, Mus musculus
gaccttgctgcgcacatgcagaacc

SEQ ID NO: 928505 - DNA, 25 bp, Mus musculus
gaccttgctgcgcagatgatgctga

SEQ ID NO: 928506 - DNA, 25 bp, Mus musculus
gaccttgctgcgcagatgcagaacc

SEQ ID NO: 928507 - DNA, 25 bp, Mus musculus
gaccttggcaggcgaatcaaagact

SEQ ID NO: 928508 - DNA, 25 bp, Mus musculus
gaccttggcaggggaatcaaagact

SEQ ID NO: 928509 - DNA, 25 bp, Mus musculus
gaccttgtacagcgaccctcatgtg

SEQ ID NO: 928510 - DNA, 25 bp, Mus musculus
gaccttgtacagggaccctcatgtg

SEQ ID NO: 928511 - DNA, 25 bp, Mus musculus
gaccttgttgcaagtgggcacatca

SEQ ID NO: 928512 - DNA, 25 bp, Mus musculus
gaccttgttggaagtgggcacatca

SEQ ID NO: 928513 - DNA, 25 bp, Mus musculus
gacctttaccaacagctgggtcgac

SEQ ID NO: 928514 - DNA, 25 bp, Mus musculus
gacctttaccaagagctgggtcgac

SEQ ID NO: 928515 - DNA, 25 bp, Mus musculus
gacctttcaaagatacccctgatca

SEQ ID NO: 928516 - DNA, 25 bp, Mus musculus
gacctttcaaagttacccctgatca

SEQ ID NO: 928517 - DNA, 25 bp, Mus musculus
gacctttctcttaccttactgggag

SEQ ID NO: 928518 - DNA, 25 bp, Mus musculus
gacctttctcttacgttactgggag

SEQ ID NO: 928519 - DNA, 25 bp, Mus musculus
gacctttctgtccacactggaagac

SEQ ID NO: 928520 - DNA, 25 bp, Mus musculus
gacctttctgtccagactggaagac

SEQ ID NO: 928521 - DNA, 25 bp, Mus musculus
gacctttggccacgcttacagttcc

SEQ ID NO: 928522 - DNA, 25 bp, Mus musculus
gacctttggccaggcttacagttcc

SEQ ID NO: 928523 - DNA, 25 bp, Mus musculus
gaccttttggctattgcagttgggc

SEQ ID NO: 928524 - DNA, 25 bp, Mus musculus
gaccttttgggtattgcagttgggc

SEQ ID NO: 928525 - DNA, 25 bp, Mus musculus
gacgaaacaaaactggtccatgccg

SEQ ID NO: 928526 - DNA, 25 bp, Mus musculus
gacgaaacaaaagtggtccatgccg

SEQ ID NO: 928527 - DNA, 25 bp, Mus musculus
gacgaaaccacgaaccgcatgcacg

SEQ ID NO: 928528 - DNA, 25 bp, Mus musculus
gacgaaaccacgtaccgcatgcacg

SEQ ID NO: 928529 - DNA, 25 bp, Mus musculus
gacgaaattcagcatgaagaggacg

SEQ ID NO: 928530 - DNA, 25 bp, Mus musculus
gacgaaattcaggatgaagaggacg

SEQ ID NO: 928531 - DNA, 25 bp, Mus musculus
gacgaacagggtcacggaagtcctc

SEQ ID NO: 928532 - DNA, 25 bp, Mus musculus
gacgaacagggtcagggaagtcctc

SEQ ID NO: 928533 - DNA, 25 bp, Mus musculus
gacgaactagctcctgtgccattga

SEQ ID NO: 928534 - DNA, 25 bp, Mus musculus
gacgaactaggtcctgtgccattga

SEQ ID NO: 928535 - DNA, 25 bp, Mus musculus
gacgaactccaggatgtgtttgtcc

SEQ ID NO: 928536 - DNA, 25 bp, Mus musculus
gacgaactcctggatgtgtttgtcc

SEQ ID NO: 928537 - DNA, 25 bp, Mus musculus
gacgaagacctcatccgtcaaactg

SEQ ID NO: 928538 - DNA, 25 bp, Mus musculus
gacgaagacctcatgcgtcaaactg

SEQ ID NO: 928539 - DNA, 25 bp, Mus musculus
gacgaagatgaacgtcaaactgggc

SEQ ID NO: 928540 - DNA, 25 bp, Mus musculus
gacgaagatgaaggtcaaactgggc

SEQ ID NO: 928541 - DNA, 25 bp, Mus musculus
gacgaaggaagacgtgggagagttc

SEQ ID NO: 928542 - DNA, 25 bp, Mus musculus
gacgaaggaagaggtgggagagttc

SEQ ID NO: 928543 - DNA, 25 bp, Mus musculus
gacgaatctgtgaaactgatcccaa

SEQ ID NO: 928544 - DNA, 25 bp, Mus musculus
gacgaatctgtgtaactgatcccaa

SEQ ID NO: 928545 - DNA, 25 bp, Mus musculus
gacgaattacctattgaagtggacc

SEQ ID NO: 928546 - DNA, 25 bp, Mus musculus
gacgaattaccttttgaagtggacc

SEQ ID NO: 928547 - DNA, 25 bp, Mus musculus
gacgacaccaagcagtcagtccgac

SEQ ID NO: 928548 - DNA, 25 bp, Mus musculus
gacgacaccaaggagtcagtccgac

SEQ ID NO: 928549 - DNA, 25 bp, Mus musculus
gacgacagcactcgtctcattcgct

SEQ ID NO: 928550 - DNA, 25 bp, Mus musculus
gacgacagcactggtctcattcgct

SEQ ID NO: 928551 - DNA, 25 bp, Mus musculus
gacgacccagctattctcatacaca

SEQ ID NO: 928552 - DNA, 25 bp, Mus musculus
gacgacccaggtattctcatacaca

SEQ ID NO: 928553 - DNA, 25 bp, Mus musculus
gacgaccctcaactgccctgtgatg

SEQ ID NO: 928554 - DNA, 25 bp, Mus musculus
gacgaccctcaagtgccctgtgatg

SEQ ID NO: 928555 - DNA, 25 bp, Mus musculus
gacgacctccaaatcgttctgaatc

SEQ ID NO: 928556 - DNA, 25 bp, Mus musculus
gacgacctccaaatggttctgaatc

SEQ ID NO: 928557 - DNA, 25 bp, Mus musculus
gacgacctgcagctactgaagtcaa

SEQ ID NO: 928558 - DNA, 25 bp, Mus musculus
gacgacctgcaggtactgaagtcaa

SEQ ID NO: 928559 - DNA, 25 bp, Mus musculus
gacgacgaagtgaaccgaatgcacg

SEQ ID NO: 928560 - DNA, 25 bp, Mus musculus
gacgacgaagtgtaccgaatgcacg

SEQ ID NO: 928561 - DNA, 25 bp, Mus musculus
gacgacgacgagcatggagatgaag

SEQ ID NO: 928562 - DNA, 25 bp, Mus musculus
gacgacgacgaggatggagatgaag

SEQ ID NO: 928563 - DNA, 25 bp, Mus musculus
gacgacgaggatggagatgaagatg

SEQ ID NO: 928564 - DNA, 25 bp, Mus musculus
gacgacgaggttggagatgaagatg

SEQ ID NO: 928565 - DNA, 25 bp, Mus musculus
gacgacgcctcacgagctatgaaga

SEQ ID NO: 928566 - DNA, 25 bp, Mus musculus
gacgacgcctcaggagctatgaaga

SEQ ID NO: 928567 - DNA, 25 bp, Mus musculus
gacgacgtggtcaacacccagagaa

SEQ ID NO: 928568 - DNA, 25 bp, Mus musculus
gacgacgtggtcaacattgactttg

SEQ ID NO: 928569 - DNA, 25 bp, Mus musculus
gacgacgtggtcaagacccagagaa

SEQ ID NO: 928570 - DNA, 25 bp, Mus musculus
gacgacgtggtcaagattgactttg

SEQ ID NO: 928571 - DNA, 25 bp, Mus musculus
gacgactacttgcggctcgtgagct

SEQ ID NO: 928572 - DNA, 25 bp, Mus musculus
gacgactacttggggctcgtgagct

SEQ ID NO: 928573 - DNA, 25 bp, Mus musculus
gacgactgaaagatatcgatgaaga

SEQ ID NO: 928574 - DNA, 25 bp, Mus musculus
gacgactgaaagttatcgatgaaga

SEQ ID NO: 928575 - DNA, 25 bp, Mus musculus
gacgactgggcgggacagtatgacc

SEQ ID NO: 928576 - DNA, 25 bp, Mus musculus
gacgactgggggggacagtatgacc

SEQ ID NO: 928577 - DNA, 25 bp, Mus musculus
gacgagaaaaagctggagagatgtc

SEQ ID NO: 928578 - DNA, 25 bp, Mus musculus
gacgagaaaaaggtggagagatgtc

SEQ ID NO: 928579 - DNA, 25 bp, Mus musculus
gacgagaaaagaaacaagcgagata

SEQ ID NO: 928580 - DNA, 25 bp, Mus musculus
gacgagaaaagaaaccgagatatcc

SEQ ID NO: 928581 - DNA, 25 bp, Mus musculus
gacgagaaaagaaagaagcgagata

SEQ ID NO: 928582 - DNA, 25 bp, Mus musculus
gacgagaaaagaaagcgagatatcc

SEQ ID NO: 928583 - DNA, 25 bp, Mus musculus
gacgagaactacatggagttcctcg

SEQ ID NO: 928584 - DNA, 25 bp, Mus musculus
gacgagaacttcatggagttcctcg

SEQ ID NO: 928585 - DNA, 25 bp, Mus musculus
gacgagacaacatcccattagctgc

SEQ ID NO: 928586 - DNA, 25 bp, Mus musculus
gacgagacaagatcccattagctgc

SEQ ID NO: 928587 - DNA, 25 bp, Mus musculus
gacgagaggctgcacgctacagaac

SEQ ID NO: 928588 - DNA, 25 bp, Mus musculus
gacgagaggctgcaggctacagaac

SEQ ID NO: 928589 - DNA, 25 bp, Mus musculus
gacgagagtgtcaaaggatcaatgt

SEQ ID NO: 928590 - DNA, 25 bp, Mus musculus
gacgagagtgtcaaagtacttcaac

SEQ ID NO: 928591 - DNA, 25 bp, Mus musculus
gacgagagtgtcaatggatcaatgt

SEQ ID NO: 928592 - DNA, 25 bp, Mus musculus
gacgagagtgtcaatgtacttcaac

SEQ ID NO: 928593 - DNA, 25 bp, Mus musculus
gacgagatgtccacaaaggtagtga

SEQ ID NO: 928594 - DNA, 25 bp, Mus musculus
gacgagatgtgcacaaaggtagtga

SEQ ID NO: 928595 - DNA, 25 bp, Mus musculus
gacgagattgacataatcaatctaa

SEQ ID NO: 928596 - DNA, 25 bp, Mus musculus
gacgagattgacttaatcaatctaa

SEQ ID NO: 928597 - DNA, 25 bp, Mus musculus
gacgagcttacaaacaatggaattg

SEQ ID NO: 928598 - DNA, 25 bp, Mus musculus
gacgagcttacaaagaatggaattg

SEQ ID NO: 928599 - DNA, 25 bp, Mus musculus
gacgaggagaactcagaggaggatg

SEQ ID NO: 928600 - DNA, 25 bp, Mus musculus
gacgaggagaactctgaggaggatg

SEQ ID NO: 928601 - DNA, 25 bp, Mus musculus
gacgaggatgagagcgaggagaaga

SEQ ID NO: 928602 - DNA, 25 bp, Mus musculus
gacgaggatgagagggaggagaaga

SEQ ID NO: 928603 - DNA, 25 bp, Mus musculus
gacgaggcctataacattcttgctc

SEQ ID NO: 928604 - DNA, 25 bp, Mus musculus
gacgaggcctataagattcttgctc

SEQ ID NO: 928605 - DNA, 25 bp, Mus musculus
gacgaggggatccccggtgagccag

SEQ ID NO: 928606 - DNA, 25 bp, Mus musculus
gacgaggggatcccgggtgagccag

SEQ ID NO: 928607 - DNA, 25 bp, Mus musculus
gacgagtcctatcgtgaaggctgca

SEQ ID NO: 928608 - DNA, 25 bp, Mus musculus
gacgagtcctatggtgaaggctgca

SEQ ID NO: 928609 - DNA, 25 bp, Mus musculus
gacgagtgagctggtggatgtggcc

SEQ ID NO: 928610 - DNA, 25 bp, Mus musculus
gacgagtgaggtggtggatgtggcc

SEQ ID NO: 928611 - DNA, 25 bp, Mus musculus
gacgagttcatgaacgaagcgggtg

SEQ ID NO: 928612 - DNA, 25 bp, Mus musculus
gacgagttcatgaacgaggatttcg

SEQ ID NO: 928613 - DNA, 25 bp, Mus musculus
gacgagttcatgaaggaagcgggtg

SEQ ID NO: 928614 - DNA, 25 bp, Mus musculus
gacgagttcatgaaggaggatttcg

SEQ ID NO: 928615 - DNA, 25 bp, Mus musculus
gacgagttccagagcgatctaaaga

SEQ ID NO: 928616 - DNA, 25 bp, Mus musculus
gacgagttccagagggatctaaaga

SEQ ID NO: 928617 - DNA, 25 bp, Mus musculus
gacgatccgtgacacactcaaacta

SEQ ID NO: 928618 - DNA, 25 bp, Mus musculus
gacgatccgtgacacgccctttgaa

SEQ ID NO: 928619 - DNA, 25 bp, Mus musculus
gacgatccgtgacagactcaaacta

SEQ ID NO: 928620 - DNA, 25 bp, Mus musculus
gacgatccgtgacaggccctttgaa

SEQ ID NO: 928621 - DNA, 25 bp, Mus musculus
gacgatgatgccttgtggaggctca

SEQ ID NO: 928622 - DNA, 25 bp, Mus musculus
gacgatgatggcttgtggaggctca

SEQ ID NO: 928623 - DNA, 25 bp, Mus musculus
gacgatgcacagcccatagaagcca

SEQ ID NO: 928624 - DNA, 25 bp, Mus musculus
gacgatgcacaggccatagaagcca

SEQ ID NO: 928625 - DNA, 25 bp, Mus musculus
gacgatgccctgaacgttctcctca

SEQ ID NO: 928626 - DNA, 25 bp, Mus musculus
gacgatgccctgaaggttctcctca

SEQ ID NO: 928627 - DNA, 25 bp, Mus musculus
gacgattacaagcatgtgcagaact

SEQ ID NO: 928628 - DNA, 25 bp, Mus musculus
gacgattacaaggatgtgcagaact

SEQ ID NO: 928629 - DNA, 25 bp, Mus musculus
gacgatttggcgctcatcacaagca

SEQ ID NO: 928630 - DNA, 25 bp, Mus musculus
gacgatttggctgtcctgctccctg

SEQ ID NO: 928631 - DNA, 25 bp, Mus musculus
gacgatttggggctcatcacaagca

SEQ ID NO: 928632 - DNA, 25 bp, Mus musculus
gacgatttgggtgtcctgctccctg

SEQ ID NO: 928633 - DNA, 25 bp, Mus musculus
gacgcaaaagcccaaatcatggatg

SEQ ID NO: 928634 - DNA, 25 bp, Mus musculus
gacgcaaaaggccaaatcatggatg

SEQ ID NO: 928635 - DNA, 25 bp, Mus musculus
gacgcaattcagacaggatggctaa

SEQ ID NO: 928636 - DNA, 25 bp, Mus musculus
gacgcaattcagtcaggatggctaa

SEQ ID NO: 928637 - DNA, 25 bp, Mus musculus
gacgcagaagagactgagaggaatc

SEQ ID NO: 928638 - DNA, 25 bp, Mus musculus
gacgcagaagagattgactttggcg

SEQ ID NO: 928639 - DNA, 25 bp, Mus musculus
gacgcagaagagcctaccgaggacg

SEQ ID NO: 928640 - DNA, 25 bp, Mus musculus
gacgcagaagaggctaccgaggacg

SEQ ID NO: 928641 - DNA, 25 bp, Mus musculus
gacgcagaagagtctgagaggaatc

SEQ ID NO: 928642 - DNA, 25 bp, Mus musculus
gacgcagaagagtttgactttggcg

SEQ ID NO: 928643 - DNA, 25 bp, Mus musculus
gacgcagcaaacgtgcattttggcc

SEQ ID NO: 928644 - DNA, 25 bp, Mus musculus
gacgcagcaacaaacgctgtacttt

SEQ ID NO: 928645 - DNA, 25 bp, Mus musculus
gacgcagcaacaaaggctgtacttt

SEQ ID NO: 928646 - DNA, 25 bp, Mus musculus
gacgcagcaatcgtgcattttggcc

SEQ ID NO: 928647 - DNA, 25 bp, Mus musculus
gacgcagcacgccatcaatgatgat

SEQ ID NO: 928648 - DNA, 25 bp, Mus musculus
gacgcagcacgccgtatgtgcagga

SEQ ID NO: 928649 - DNA, 25 bp, Mus musculus
gacgcagcacgcgatcaatgatgat

SEQ ID NO: 928650 - DNA, 25 bp, Mus musculus
gacgcagcacgcggtatgtgcagga

SEQ ID NO: 928651 - DNA, 25 bp, Mus musculus
gacgcagccagacagggaaactgag

SEQ ID NO: 928652 - DNA, 25 bp, Mus musculus
gacgcagccagaccttgtccaggtg

SEQ ID NO: 928653 - DNA, 25 bp, Mus musculus
gacgcagccagagagggaaactgag

SEQ ID NO: 928654 - DNA, 25 bp, Mus musculus
gacgcagccagagcttgtccaggtg

SEQ ID NO: 928655 - DNA, 25 bp, Mus musculus
gacgcagcgacactagtccttcaca

SEQ ID NO: 928656 - DNA, 25 bp, Mus musculus
gacgcagcgacacttgtccttcaca

SEQ ID NO: 928657 - DNA, 25 bp, Mus musculus
gacgcaggcatccgcgaagctgaat

SEQ ID NO: 928658 - DNA, 25 bp, Mus musculus
gacgcaggcatccgggaagctgaat

SEQ ID NO: 928659 - DNA, 25 bp, Mus musculus
gacgcagtccatccagggttccagt

SEQ ID NO: 928660 - DNA, 25 bp, Mus musculus
gacgcagtccatgcagggttccagt

SEQ ID NO: 928661 - DNA, 25 bp, Mus musculus
gacgcagtctgaccactacaagaag

SEQ ID NO: 928662 - DNA, 25 bp, Mus musculus
gacgcagtctgacctctacaagaag

SEQ ID NO: 928663 - DNA, 25 bp, Mus musculus
gacgcatcaccacgtggtacagagg

SEQ ID NO: 928664 - DNA, 25 bp, Mus musculus
gacgcatcaccaggtggtacagagg

SEQ ID NO: 928665 - DNA, 25 bp, Mus musculus
gacgcatgacacagaacagggacat

SEQ ID NO: 928666 - DNA, 25 bp, Mus musculus
gacgcatgacacagtacagggacat

SEQ ID NO: 928667 - DNA, 25 bp, Mus musculus
gacgcatttggatgaggatggaaga

SEQ ID NO: 928668 - DNA, 25 bp, Mus musculus
gacgcatttggatgtggatggaaga

SEQ ID NO: 928669 - DNA, 25 bp, Mus musculus
gacgccataaagagcaacgggagaa

SEQ ID NO: 928670 - DNA, 25 bp, Mus musculus
gacgccataaagtgcaacgggagaa

SEQ ID NO: 928671 - DNA, 25 bp, Mus musculus
gacgcccaggcccgtcccggatgtt

SEQ ID NO: 928672 - DNA, 25 bp, Mus musculus
gacgcccaggccggtcccggatgtt

SEQ ID NO: 928673 - DNA, 25 bp, Mus musculus
gacgccccagctggaagtccgtatt

SEQ ID NO: 928674 - DNA, 25 bp, Mus musculus
gacgccccaggtggaagtccgtatt

SEQ ID NO: 928675 - DNA, 25 bp, Mus musculus
gacgcccctgagctgtgtgagccat

SEQ ID NO: 928676 - DNA, 25 bp, Mus musculus
gacgcccctgaggtgtgtgagccat

SEQ ID NO: 928677 - DNA, 25 bp, Mus musculus
gacgcctcagcagctatgaagacat

SEQ ID NO: 928678 - DNA, 25 bp, Mus musculus
gacgcctcagctccacactgcccca

SEQ ID NO: 928679 - DNA, 25 bp, Mus musculus
gacgcctcagctgcacactgcccca

SEQ ID NO: 928680 - DNA, 25 bp, Mus musculus
gacgcctcaggagctatgaagacat

SEQ ID NO: 928681 - DNA, 25 bp, Mus musculus
gacgcctgagagctgactctgtcct

SEQ ID NO: 928682 - DNA, 25 bp, Mus musculus
gacgcctgagaggtgactctgtcct

SEQ ID NO: 928683 - DNA, 25 bp, Mus musculus
gacgcctgcccaattaatggaggct

SEQ ID NO: 928684 - DNA, 25 bp, Mus musculus
gacgcctgcccatttaatggaggct

SEQ ID NO: 928685 - DNA, 25 bp, Mus musculus
gacgcctttcaccacaaatacactg

SEQ ID NO: 928686 - DNA, 25 bp, Mus musculus
gacgcctttcaccagaaatacactg

SEQ ID NO: 928687 - DNA, 25 bp, Mus musculus
gacgcgacagaaaccgcccagaata

SEQ ID NO: 928688 - DNA, 25 bp, Mus musculus
gacgcgacagcacaccacatgtatt

SEQ ID NO: 928689 - DNA, 25 bp, Mus musculus
gacgcgacaggacaccacatgtatt

SEQ ID NO: 928690 - DNA, 25 bp, Mus musculus
gacgcgacagtaaccgcccagaata

SEQ ID NO: 928691 - DNA, 25 bp, Mus musculus
gacgcgatagatctgacacaacacc

SEQ ID NO: 928692 - DNA, 25 bp, Mus musculus
gacgcgatagttctgacacaacacc

SEQ ID NO: 928693 - DNA, 25 bp, Mus musculus
gacgcggccctgcacatcaccagca

SEQ ID NO: 928694 - DNA, 25 bp, Mus musculus
gacgcggccctgcacgagtgactag

SEQ ID NO: 928695 - DNA, 25 bp, Mus musculus
gacgcggccctgcagatcaccagca

SEQ ID NO: 928696 - DNA, 25 bp, Mus musculus
gacgcggccctgcaggagtgactag

SEQ ID NO: 928697 - DNA, 25 bp, Mus musculus
gacgcggcctgtgacggtcaaagct

SEQ ID NO: 928698 - DNA, 25 bp, Mus musculus
gacgcggcctgtgagggtcaaagct

SEQ ID NO: 928699 - DNA, 25 bp, Mus musculus
gacgcggcgacacgtcttctactta

SEQ ID NO: 928700 - DNA, 25 bp, Mus musculus
gacgcggcgacaggtcttctactta

SEQ ID NO: 928701 - DNA, 25 bp, Mus musculus
gacgcgtgtgtgcagttcaccttcc

SEQ ID NO: 928702 - DNA, 25 bp, Mus musculus
gacgcgtgtgtggagttcaccttcc

SEQ ID NO: 928703 - DNA, 25 bp, Mus musculus
gacgctaacccacgagaacgtcagc

SEQ ID NO: 928704 - DNA, 25 bp, Mus musculus
gacgctaacccaggagaacgtcagc

SEQ ID NO: 928705 - DNA, 25 bp, Mus musculus
gacgctcaaacacacctcaaagatt

SEQ ID NO: 928706 - DNA, 25 bp, Mus musculus
gacgctcaaacacagctcaaagatt

SEQ ID NO: 928707 - DNA, 25 bp, Mus musculus
gacgctcacacccatggcgacgccg

SEQ ID NO: 928708 - DNA, 25 bp, Mus musculus
gacgctcacaccctaaagatggcga

SEQ ID NO: 928709 - DNA, 25 bp, Mus musculus
gacgctcacaccgatggcgacgccg

SEQ ID NO: 928710 - DNA, 25 bp, Mus musculus
gacgctcacaccgtaaagatggcga

SEQ ID NO: 928711 - DNA, 25 bp, Mus musculus
gacgctctacaccatgcggccgaaa

SEQ ID NO: 928712 - DNA, 25 bp, Mus musculus
gacgctctacacgatgcggccgaaa

SEQ ID NO: 928713 - DNA, 25 bp, Mus musculus
gacgctgaagaggtcctgggcccaa

SEQ ID NO: 928714 - DNA, 25 bp, Mus musculus
gacgctgaagtggtcctgggcccaa

SEQ ID NO: 928715 - DNA, 25 bp, Mus musculus
gacgctgacaaggactgggctgtgg

SEQ ID NO: 928716 - DNA, 25 bp, Mus musculus
gacgctgacatggactgggctgtgg

SEQ ID NO: 928717 - DNA, 25 bp, Mus musculus
gacgctgacattcacagttgaaact

SEQ ID NO: 928718 - DNA, 25 bp, Mus musculus
gacgctgacattcacgtgcagtctt

SEQ ID NO: 928719 - DNA, 25 bp, Mus musculus
gacgctgacattcagagttgaaact

SEQ ID NO: 928720 - DNA, 25 bp, Mus musculus
gacgctgacattcaggtgcagtctt

SEQ ID NO: 928721 - DNA, 25 bp, Mus musculus
gacgctgttgccgtcacctttgcag

SEQ ID NO: 928722 - DNA, 25 bp, Mus musculus
gacgctgttgccgtgacctttgcag

SEQ ID NO: 928723 - DNA, 25 bp, Mus musculus
gacgcttgcaaacgtgtgccaatat

SEQ ID NO: 928724 - DNA, 25 bp, Mus musculus
gacgcttgcaaaggtgtgccaatat

SEQ ID NO: 928725 - DNA, 25 bp, Mus musculus
gacgctttggatcagtgtgaactgg

SEQ ID NO: 928726 - DNA, 25 bp, Mus musculus
gacgctttggatcgctcccggacct

SEQ ID NO: 928727 - DNA, 25 bp, Mus musculus
gacgctttggatcgtgatgatgaag

SEQ ID NO: 928728 - DNA, 25 bp, Mus musculus
gacgctttggatctgccttcggagg

SEQ ID NO: 928729 - DNA, 25 bp, Mus musculus
gacgctttggatgagtgtgaactgg

SEQ ID NO: 928730 - DNA, 25 bp, Mus musculus
gacgctttggatggctcccggacct

SEQ ID NO: 928731 - DNA, 25 bp, Mus musculus
gacgctttggatggtgatgatgaag

SEQ ID NO: 928732 - DNA, 25 bp, Mus musculus
gacgctttggatgtgccttcggagg

SEQ ID NO: 928733 - DNA, 25 bp, Mus musculus
gacggaaaaccacagtccagcctct

SEQ ID NO: 928734 - DNA, 25 bp, Mus musculus
gacggaaaaccagagtccagcctct

SEQ ID NO: 928735 - DNA, 25 bp, Mus musculus
gacggaaaagagtcattggtctcag

SEQ ID NO: 928736 - DNA, 25 bp, Mus musculus
gacggaaaagtgtcattggtctcag

SEQ ID NO: 928737 - DNA, 25 bp, Mus musculus
gacggaagacaccgagtatatatcc

SEQ ID NO: 928738 - DNA, 25 bp, Mus musculus
gacggaagacacggagtatatatcc

SEQ ID NO: 928739 - DNA, 25 bp, Mus musculus
gacggacggaatcgcagccctggat

SEQ ID NO: 928740 - DNA, 25 bp, Mus musculus
gacggacggaatggcagccctggat

SEQ ID NO: 928741 - DNA, 25 bp, Mus musculus
gacggagaaacacacgtccttcacc

SEQ ID NO: 928742 - DNA, 25 bp, Mus musculus
gacggagaaacacaggtccttcacc

SEQ ID NO: 928743 - DNA, 25 bp, Mus musculus
gacggagactgacgatgaggctgta

SEQ ID NO: 928744 - DNA, 25 bp, Mus musculus
gacggagactgaggatgaggctgta

SEQ ID NO: 928745 - DNA, 25 bp, Mus musculus
gacggagcagaagacccagcatgga

SEQ ID NO: 928746 - DNA, 25 bp, Mus musculus
gacggagcagacccagcatggagtt

SEQ ID NO: 928747 - DNA, 25 bp, Mus musculus
gacggagcagccctgtctcgtcatg

SEQ ID NO: 928748 - DNA, 25 bp, Mus musculus
gacggagcaggcctgtctcgtcatg

SEQ ID NO: 928749 - DNA, 25 bp, Mus musculus
gacggagcagtagacccagcatgga

SEQ ID NO: 928750 - DNA, 25 bp, Mus musculus
gacggagcagtcccagcatggagtt

SEQ ID NO: 928751 - DNA, 25 bp, Mus musculus
gacggaggaaggccccaaagatgcc

SEQ ID NO: 928752 - DNA, 25 bp, Mus musculus
gacggaggaagggcccaaagatgcc

SEQ ID NO: 928753 - DNA, 25 bp, Mus musculus
gacggaggagaaagagcggaccttc

SEQ ID NO: 928754 - DNA, 25 bp, Mus musculus
gacggaggagtaagagcggaccttc

SEQ ID NO: 928755 - DNA, 25 bp, Mus musculus
gacggaggctgacatcactggagat

SEQ ID NO: 928756 - DNA, 25 bp, Mus musculus
gacggaggctgagatcactggagat

SEQ ID NO: 928757 - DNA, 25 bp, Mus musculus
gacggagtctgccgagtggttggct

SEQ ID NO: 928758 - DNA, 25 bp, Mus musculus
gacggagtctgccgtgtggttggct

SEQ ID NO: 928759 - DNA, 25 bp, Mus musculus
gacggagtgctgaacatctgtgact

SEQ ID NO: 928760 - DNA, 25 bp, Mus musculus
gacggagtgctgaagatctgtgact

SEQ ID NO: 928761 - DNA, 25 bp, Mus musculus
gacggcaagcagaatgtcatcaaaa

SEQ ID NO: 928762 - DNA, 25 bp, Mus musculus
gacggcaagcagtatgtcatcaaaa

SEQ ID NO: 928763 - DNA, 25 bp, Mus musculus
gacggcaagtgtctaccgtgtgctc

SEQ ID NO: 928764 - DNA, 25 bp, Mus musculus
gacggcaagtgtgtaccgtgtgctc

SEQ ID NO: 928765 - DNA, 25 bp, Mus musculus
gacggcacactgaaaagatccgctt

SEQ ID NO: 928766 - DNA, 25 bp, Mus musculus
gacggcacactgatgagcgccccta

SEQ ID NO: 928767 - DNA, 25 bp, Mus musculus
gacggcacactgtaaagatccgctt

SEQ ID NO: 928768 - DNA, 25 bp, Mus musculus
gacggcacactgttgagcgccccta

SEQ ID NO: 928769 - DNA, 25 bp, Mus musculus
gacggcaccatgccgtttatgtttg

SEQ ID NO: 928770 - DNA, 25 bp, Mus musculus
gacggcaccatggcgtttatgtttg

SEQ ID NO: 928771 - DNA, 25 bp, Mus musculus
gacggcactgcgcgtacctggcgct

SEQ ID NO: 928772 - DNA, 25 bp, Mus musculus
gacggcactgcgggtacctggcgct

SEQ ID NO: 928773 - DNA, 25 bp, Mus musculus
gacggcaggattcacgttggtgacc

SEQ ID NO: 928774 - DNA, 25 bp, Mus musculus
gacggcaggattcaggttggtgacc

SEQ ID NO: 928775 - DNA, 25 bp, Mus musculus
gacggcatccggctgggccatgcag

SEQ ID NO: 928776 - DNA, 25 bp, Mus musculus
gacggcatccgggtgggccatgcag

SEQ ID NO: 928777 - DNA, 25 bp, Mus musculus
gacggcatgtaccctaacttgggta

SEQ ID NO: 928778 - DNA, 25 bp, Mus musculus
gacggcatgtacgctaacttgggta

SEQ ID NO: 928779 - DNA, 25 bp, Mus musculus
gacggccacattcattttcctcgca

SEQ ID NO: 928780 - DNA, 25 bp, Mus musculus
gacggccacattcccctgtcagcct

SEQ ID NO: 928781 - DNA, 25 bp, Mus musculus
gacggccacattgattttcctcgca

SEQ ID NO: 928782 - DNA, 25 bp, Mus musculus
gacggccacattgccctgtcagcct

SEQ ID NO: 928783 - DNA, 25 bp, Mus musculus
gacggccacggcatcgaggagaagg

SEQ ID NO: 928784 - DNA, 25 bp, Mus musculus
gacggccacggcatggaggagaagg

SEQ ID NO: 928785 - DNA, 25 bp, Mus musculus
gacggcccaagtcacgacttgccca

SEQ ID NO: 928786 - DNA, 25 bp, Mus musculus
gacggcccaagtcaggacttgccca

SEQ ID NO: 928787 - DNA, 25 bp, Mus musculus
gacggccctaagagggagccggtga

SEQ ID NO: 928788 - DNA, 25 bp, Mus musculus
gacggccctaagctttgaggattgc

SEQ ID NO: 928789 - DNA, 25 bp, Mus musculus
gacggccctaaggtttgaggattgc

SEQ ID NO: 928790 - DNA, 25 bp, Mus musculus
gacggccctaagtgggagccggtga

SEQ ID NO: 928791 - DNA, 25 bp, Mus musculus
gacggcgctaaggtggattgtccag

SEQ ID NO: 928792 - DNA, 25 bp, Mus musculus
gacggcgctatggtggattgtccag

SEQ ID NO: 928793 - DNA, 25 bp, Mus musculus
gacggctacaatcatgtcgccattg

SEQ ID NO: 928794 - DNA, 25 bp, Mus musculus
gacggctacaatgatgtcgccattg

SEQ ID NO: 928795 - DNA, 25 bp, Mus musculus
gacggctttgaacatattgctattg

SEQ ID NO: 928796 - DNA, 25 bp, Mus musculus
gacggctttgaagatattgctattg

SEQ ID NO: 928797 - DNA, 25 bp, Mus musculus
gacggggaaagacgtagctgtgaag

SEQ ID NO: 928798 - DNA, 25 bp, Mus musculus
gacggggaaagaggtagctgtgaag

SEQ ID NO: 928799 - DNA, 25 bp, Mus musculus
gacggtcaataacgctgtggctctg

SEQ ID NO: 928800 - DNA, 25 bp, Mus musculus
gacggtcaataaggctgtggctctg

SEQ ID NO: 928801 - DNA, 25 bp, Mus musculus
gacggtcaggcctggattttgatga

SEQ ID NO: 928802 - DNA, 25 bp, Mus musculus
gacggtcagggctggattttgatga

SEQ ID NO: 928803 - DNA, 25 bp, Mus musculus
gacggtgatgaccatggcacctgtg

SEQ ID NO: 928804 - DNA, 25 bp, Mus musculus
gacggtgatgacgatggcacctgtg

SEQ ID NO: 928805 - DNA, 25 bp, Mus musculus
gacggtgcatacaacgttagcagag

SEQ ID NO: 928806 - DNA, 25 bp, Mus musculus
gacggtgcatacaaggttagcagag

SEQ ID NO: 928807 - DNA, 25 bp, Mus musculus
gacggtgtgcaaccattcctgacca

SEQ ID NO: 928808 - DNA, 25 bp, Mus musculus
gacggtgtgcaagcattcctgacca

SEQ ID NO: 928809 - DNA, 25 bp, Mus musculus
gacggtgttcgtgccgtcttttgat

SEQ ID NO: 928810 - DNA, 25 bp, Mus musculus
gacggtgttcgtgcggtcttttgat

SEQ ID NO: 928811 - DNA, 25 bp, Mus musculus
gacgtacaagattttttatgctgaa

SEQ ID NO: 928812 - DNA, 25 bp, Mus musculus
gacgtacaagtttttttatgctgaa

SEQ ID NO: 928813 - DNA, 25 bp, Mus musculus
gacgtagaagccctctttgacagcc

SEQ ID NO: 928814 - DNA, 25 bp, Mus musculus
gacgtagaaggcctctttgacagcc

SEQ ID NO: 928815 - DNA, 25 bp, Mus musculus
gacgtagccaaacggatgcattact

SEQ ID NO: 928816 - DNA, 25 bp, Mus musculus
gacgtagccaaagggatgcattact

SEQ ID NO: 928817 - DNA, 25 bp, Mus musculus
gacgtagtgaagctggccctatgaa

SEQ ID NO: 928818 - DNA, 25 bp, Mus musculus
gacgtagtgaaggtggccctatgaa

SEQ ID NO: 928819 - DNA, 25 bp, Mus musculus
gacgtcaaaagcctcatcttcaaag

SEQ ID NO: 928820 - DNA, 25 bp, Mus musculus
gacgtcaaaagcgtcatcttcaaag

SEQ ID NO: 928821 - DNA, 25 bp, Mus musculus
gacgtcaccgagcatgaagaggaag

SEQ ID NO: 928822 - DNA, 25 bp, Mus musculus
gacgtcaccgaggatgaagaggaag

SEQ ID NO: 928823 - DNA, 25 bp, Mus musculus
gacgtcagaccacctcgtgctgtgg

SEQ ID NO: 928824 - DNA, 25 bp, Mus musculus
gacgtcagaccagctcgtgctgtgg

SEQ ID NO: 928825 - DNA, 25 bp, Mus musculus
gacgtcagccaacttgtccagagct

SEQ ID NO: 928826 - DNA, 25 bp, Mus musculus
gacgtcagccaagttgtccagagct

SEQ ID NO: 928827 - DNA, 25 bp, Mus musculus
gacgtcatagtacaggattcatccc

SEQ ID NO: 928828 - DNA, 25 bp, Mus musculus
gacgtcatagtactagattcatccc

SEQ ID NO: 928829 - DNA, 25 bp, Mus musculus
gacgtcatagtacttgattcatccc

SEQ ID NO: 928830 - DNA, 25 bp, Mus musculus
gacgtcatagtagaggattcatccc

SEQ ID NO: 928831 - DNA, 25 bp, Mus musculus
gacgtcatcggcaacatctacctgt

SEQ ID NO: 928832 - DNA, 25 bp, Mus musculus
gacgtcatcggcaagatctacctgt

SEQ ID NO: 928833 - DNA, 25 bp, Mus musculus
gacgtccaccagagaaaatgtgcta

SEQ ID NO: 928834 - DNA, 25 bp, Mus musculus
gacgtccaccagtgaaaatgtgcta

SEQ ID NO: 928835 - DNA, 25 bp, Mus musculus
gacgtcgatgagagcaaagaagtgc

SEQ ID NO: 928836 - DNA, 25 bp, Mus musculus
gacgtcgatgagtgcaaagaagtgc

SEQ ID NO: 928837 - DNA, 25 bp, Mus musculus
gacgtcgcggccccatggcggacaa

SEQ ID NO: 928838 - DNA, 25 bp, Mus musculus
gacgtcgcggccgcatggcggacaa

SEQ ID NO: 928839 - DNA, 25 bp, Mus musculus
gacgtcgtggaacgatctccgcacc

SEQ ID NO: 928840 - DNA, 25 bp, Mus musculus
gacgtcgtggtacgatctccgcacc

SEQ ID NO: 928841 - DNA, 25 bp, Mus musculus
gacgtcttggctcatgctgcctgat

SEQ ID NO: 928842 - DNA, 25 bp, Mus musculus
gacgtcttgggtcatgctgcctgat

SEQ ID NO: 928843 - DNA, 25 bp, Mus musculus
gacgtgaaaaagaatcttggaagat

SEQ ID NO: 928844 - DNA, 25 bp, Mus musculus
gacgtgaaaaagtatcttggaagat

SEQ ID NO: 928845 - DNA, 25 bp, Mus musculus
gacgtgccctgccgatcctaatcgt

SEQ ID NO: 928846 - DNA, 25 bp, Mus musculus
gacgtgccctgcggatcctaatcgt

SEQ ID NO: 928847 - DNA, 25 bp, Mus musculus
gacgtgcgatagcgtgtctataacc

SEQ ID NO: 928848 - DNA, 25 bp, Mus musculus
gacgtgcgatagggataaccctcga

SEQ ID NO: 928849 - DNA, 25 bp, Mus musculus
gacgtgcgatagggtgtctataacc

SEQ ID NO: 928850 - DNA, 25 bp, Mus musculus
gacgtgcgatagggttaaccctcga

SEQ ID NO: 928851 - DNA, 25 bp, Mus musculus
gacgtgctggtacgcccacagaaca

SEQ ID NO: 928852 - DNA, 25 bp, Mus musculus
gacgtgctggtaggcccacagaaca

SEQ ID NO: 928853 - DNA, 25 bp, Mus musculus
gacgtgcttcagactggtttacctg

SEQ ID NO: 928854 - DNA, 25 bp, Mus musculus
gacgtgcttcagtctggtttacctg

SEQ ID NO: 928855 - DNA, 25 bp, Mus musculus
gacgtggaatggaactcctgtgact

SEQ ID NO: 928856 - DNA, 25 bp, Mus musculus
gacgtggaatggaagtcctgtgact

SEQ ID NO: 928857 - DNA, 25 bp, Mus musculus
gacgtggcgctgaatactccatgtt

SEQ ID NO: 928858 - DNA, 25 bp, Mus musculus
gacgtggcgctgtatactccatgtt

SEQ ID NO: 928859 - DNA, 25 bp, Mus musculus
gacgtggtcaagacccagagaacat

SEQ ID NO: 928860 - DNA, 25 bp, Mus musculus
gacgtggtcaagattgactttgaag

SEQ ID NO: 928861 - DNA, 25 bp, Mus musculus
gacgtggtcaagtcccagagaacat

SEQ ID NO: 928862 - DNA, 25 bp, Mus musculus
gacgtggtcaagtttgactttgaag

SEQ ID NO: 928863 - DNA, 25 bp, Mus musculus
gacgtggtcctccacatcatggagc

SEQ ID NO: 928864 - DNA, 25 bp, Mus musculus
gacgtggtcctccagatcatggagc

SEQ ID NO: 928865 - DNA, 25 bp, Mus musculus
gacgtgtcgccacgtcagccatgtc

SEQ ID NO: 928866 - DNA, 25 bp, Mus musculus
gacgtgtcgccactgtggaagggga

SEQ ID NO: 928867 - DNA, 25 bp, Mus musculus
gacgtgtcgccaggtcagccatgtc

SEQ ID NO: 928868 - DNA, 25 bp, Mus musculus
gacgtgtcgccagtgtggaagggga

SEQ ID NO: 928869 - DNA, 25 bp, Mus musculus
gacgttaatgagagcaatgctcacc

SEQ ID NO: 928870 - DNA, 25 bp, Mus musculus
gacgttaatgagtgcaatgctcacc

SEQ ID NO: 928871 - DNA, 25 bp, Mus musculus
gacgttatagatgttatcccactga

SEQ ID NO: 928872 - DNA, 25 bp, Mus musculus
gacgttatagttgttatcccactga

SEQ ID NO: 928873 - DNA, 25 bp, Mus musculus
gacgttccggaacctgcagcttcaa

SEQ ID NO: 928874 - DNA, 25 bp, Mus musculus
gacgttccggaagctgcagcttcaa

SEQ ID NO: 928875 - DNA, 25 bp, Mus musculus
gacgttctctgacgcgcagtaacag

SEQ ID NO: 928876 - DNA, 25 bp, Mus musculus
gacgttctctgaggcgcagtaacag

SEQ ID NO: 928877 - DNA, 25 bp, Mus musculus
gacgttcttccacaagatggacaaa

SEQ ID NO: 928878 - DNA, 25 bp, Mus musculus
gacgttcttccagaagatggacaaa

SEQ ID NO: 928879 - DNA, 25 bp, Mus musculus
gacgtttcccagatctgtctcgaga

SEQ ID NO: 928880 - DNA, 25 bp, Mus musculus
gacgtttcccagttctgtctcgaga

SEQ ID NO: 928881 - DNA, 25 bp, Mus musculus
gacgtttgtcctcctgtgtttcaaa

SEQ ID NO: 928882 - DNA, 25 bp, Mus musculus
gacgtttgtcctgctgtgtttcaaa

SEQ ID NO: 928883 - DNA, 25 bp, Mus musculus
gactaacaagacagaggtcacaaat

SEQ ID NO: 928884 - DNA, 25 bp, Mus musculus
gactaacaagattcttgtattctac

SEQ ID NO: 928885 - DNA, 25 bp, Mus musculus
gactaacaagtcagaggtcacaaat

SEQ ID NO: 928886 - DNA, 25 bp, Mus musculus
gactaacaagtttcttgtattctac

SEQ ID NO: 928887 - DNA, 25 bp, Mus musculus
gactaagcagcaagggatggaaggc

SEQ ID NO: 928888 - DNA, 25 bp, Mus musculus
gactaagcaggaagggatggaaggc

SEQ ID NO: 928889 - DNA, 25 bp, Mus musculus
gactaagcctttcgttcacagcagc

SEQ ID NO: 928890 - DNA, 25 bp, Mus musculus
gactaagcctttggttcacagcagc

SEQ ID NO: 928891 - DNA, 25 bp, Mus musculus
gactaatgagaactttcaagttgtg

SEQ ID NO: 928892 - DNA, 25 bp, Mus musculus
gactaatgagaagtttcaagttgtg

SEQ ID NO: 928893 - DNA, 25 bp, Mus musculus
gactaatttagacatgaaatccttc

SEQ ID NO: 928894 - DNA, 25 bp, Mus musculus
gactaatttagacgggctccataga

SEQ ID NO: 928895 - DNA, 25 bp, Mus musculus
gactaatttagagatgaaatccttc

SEQ ID NO: 928896 - DNA, 25 bp, Mus musculus
gactaatttagaggggctccataga

SEQ ID NO: 928897 - DNA, 25 bp, Mus musculus
gactacaaggacccccagagttgat

SEQ ID NO: 928898 - DNA, 25 bp, Mus musculus
gactacaaggacccgcagagttgat

SEQ ID NO: 928899 - DNA, 25 bp, Mus musculus
gactacacagccagcagtcctgtct

SEQ ID NO: 928900 - DNA, 25 bp, Mus musculus
gactacacagccaggagtcctgtct

SEQ ID NO: 928901 - DNA, 25 bp, Mus musculus
gactacagcgctcagcagagcactt

SEQ ID NO: 928902 - DNA, 25 bp, Mus musculus
gactacagcggtcagcagagcactt

SEQ ID NO: 928903 - DNA, 25 bp, Mus musculus
gactacatctctccaaacatttggc

SEQ ID NO: 928904 - DNA, 25 bp, Mus musculus
gactacatctgtccaaacatttggc

SEQ ID NO: 928905 - DNA, 25 bp, Mus musculus
gactaccaccagcactttcggctcg

SEQ ID NO: 928906 - DNA, 25 bp, Mus musculus
gactaccaccagcagtttcggctcg

SEQ ID NO: 928907 - DNA, 25 bp, Mus musculus
gactaccagctgaacacttgattgc

SEQ ID NO: 928908 - DNA, 25 bp, Mus musculus
gactaccagctgaagacttgattgc

SEQ ID NO: 928909 - DNA, 25 bp, Mus musculus
gactaccaggcacctgatgacaccg

SEQ ID NO: 928910 - DNA, 25 bp, Mus musculus
gactaccaggcagctgatgacaccg

SEQ ID NO: 928911 - DNA, 25 bp, Mus musculus
gactacctcctttcccttcaagcac

SEQ ID NO: 928912 - DNA, 25 bp, Mus musculus
gactacctcctttcgcttcaagcac

SEQ ID NO: 928913 - DNA, 25 bp, Mus musculus
gactacctcttacgtctctttgagc

SEQ ID NO: 928914 - DNA, 25 bp, Mus musculus
gactacctcttaggtctctttgagc

SEQ ID NO: 928915 - DNA, 25 bp, Mus musculus
gactacgatgcacctaacacttacg

SEQ ID NO: 928916 - DNA, 25 bp, Mus musculus
gactacgatggacctaacacttacg

SEQ ID NO: 928917 - DNA, 25 bp, Mus musculus
gactacggcaacagagagatcctgc

SEQ ID NO: 928918 - DNA, 25 bp, Mus musculus
gactacggcaactgagagatcctgc

SEQ ID NO: 928919 - DNA, 25 bp, Mus musculus
gactacgtggcacgtggatcagaca

SEQ ID NO: 928920 - DNA, 25 bp, Mus musculus
gactacgtggcaggtggatcagaca

SEQ ID NO: 928921 - DNA, 25 bp, Mus musculus
gactactggccacacgaccagctgc

SEQ ID NO: 928922 - DNA, 25 bp, Mus musculus
gactactggccacaggaccagctgc

SEQ ID NO: 928923 - DNA, 25 bp, Mus musculus
gactacttagctgaagccaggaatc

SEQ ID NO: 928924 - DNA, 25 bp, Mus musculus
gactacttaggtgaagccaggaatc

SEQ ID NO: 928925 - DNA, 25 bp, Mus musculus
gactacttcaagcataaaagagtac

SEQ ID NO: 928926 - DNA, 25 bp, Mus musculus
gactacttcaaggataaaagagtac

SEQ ID NO: 928927 - DNA, 25 bp, Mus musculus
gactacttggcgctcgtgagctgag

SEQ ID NO: 928928 - DNA, 25 bp, Mus musculus
gactacttggggctcgtgagctgag

SEQ ID NO: 928929 - DNA, 25 bp, Mus musculus
gactagattttaccaggtcaatggc

SEQ ID NO: 928930 - DNA, 25 bp, Mus musculus
gactagattttagcaggtcaatggc

SEQ ID NO: 928931 - DNA, 25 bp, Mus musculus
gactagcaatcacaacccaagagat

SEQ ID NO: 928932 - DNA, 25 bp, Mus musculus
gactagcaatcagaacccaagagat

SEQ ID NO: 928933 - DNA, 25 bp, Mus musculus
gactagccggcttattcgcaggtgt

SEQ ID NO: 928934 - DNA, 25 bp, Mus musculus
gactagccgggttattcgcaggtgt

SEQ ID NO: 928935 - DNA, 25 bp, Mus musculus
gactatagcatacgaaaccttcaaa

SEQ ID NO: 928936 - DNA, 25 bp, Mus musculus
gactatagcataggaaaccttcaaa

SEQ ID NO: 928937 - DNA, 25 bp, Mus musculus
gactatagctctccaggtcaatggc

SEQ ID NO: 928938 - DNA, 25 bp, Mus musculus
gactatagctctctgctcagtacaa

SEQ ID NO: 928939 - DNA, 25 bp, Mus musculus
gactatagctctgcaggtcaatggc

SEQ ID NO: 928940 - DNA, 25 bp, Mus musculus
gactatagctctgtgctcagtacaa

SEQ ID NO: 928941 - DNA, 25 bp, Mus musculus
gactatatcaatgacacacacaccg

SEQ ID NO: 928942 - DNA, 25 bp, Mus musculus
gactatatcaatgagacacacaccg

SEQ ID NO: 928943 - DNA, 25 bp, Mus musculus
gactatgaacaaataggagacagct

SEQ ID NO: 928944 - DNA, 25 bp, Mus musculus
gactatgaacaattaggagacagct

SEQ ID NO: 928945 - DNA, 25 bp, Mus musculus
gactatgaagacagcagtcttttat

SEQ ID NO: 928946 - DNA, 25 bp, Mus musculus
gactatgaagacaggagtcttttat

SEQ ID NO: 928947 - DNA, 25 bp, Mus musculus
gactatgagtttctcaagagctgga

SEQ ID NO: 928948 - DNA, 25 bp, Mus musculus
gactatgagtttgtcaagagctgga

SEQ ID NO: 928949 - DNA, 25 bp, Mus musculus
gactatgccgataatatcaaagccc

SEQ ID NO: 928950 - DNA, 25 bp, Mus musculus
gactatgccgattatatcaaagccc

SEQ ID NO: 928951 - DNA, 25 bp, Mus musculus
gactatgctggacataattatgtcc

SEQ ID NO: 928952 - DNA, 25 bp, Mus musculus
gactatgctggagataattatgtcc

SEQ ID NO: 928953 - DNA, 25 bp, Mus musculus
gactatgggcagctgttcacctaca

SEQ ID NO: 928954 - DNA, 25 bp, Mus musculus
gactatgggcaggtattcacctaca

SEQ ID NO: 928955 - DNA, 25 bp, Mus musculus
gactatgggcaggtgttcacctaca

SEQ ID NO: 928956 - DNA, 25 bp, Mus musculus
gactatgggcaggttttcacctaca

SEQ ID NO: 928957 - DNA, 25 bp, Mus musculus
gactattgaaattaatcccaagcgt

SEQ ID NO: 928958 - DNA, 25 bp, Mus musculus
gactattgaatttaatcccaagcgt

SEQ ID NO: 928959 - DNA, 25 bp, Mus musculus
gactcacccaagatctggatcctgg

SEQ ID NO: 928960 - DNA, 25 bp, Mus musculus
gactcacccaagttctggatcctgg

SEQ ID NO: 928961 - DNA, 25 bp, Mus musculus
gactcactagcgaagctatgcgaaa

SEQ ID NO: 928962 - DNA, 25 bp, Mus musculus
gactcactagggaagctatgcgaaa

SEQ ID NO: 928963 - DNA, 25 bp, Mus musculus
gactcactgcctgaaaaatacaaca

SEQ ID NO: 928964 - DNA, 25 bp, Mus musculus
gactcactgcctgaagttgtccagg

SEQ ID NO: 928965 - DNA, 25 bp, Mus musculus
gactcactgcctgataaatacaaca

SEQ ID NO: 928966 - DNA, 25 bp, Mus musculus
gactcactgcctgatgttgtccagg

SEQ ID NO: 928967 - DNA, 25 bp, Mus musculus
gactcagaaaaaatagaagaatggc

SEQ ID NO: 928968 - DNA, 25 bp, Mus musculus
gactcagaaaaattagaagaatggc

SEQ ID NO: 928969 - DNA, 25 bp, Mus musculus
gactcagaagatctcttccaggacc

SEQ ID NO: 928970 - DNA, 25 bp, Mus musculus
gactcagaagttctcttccaggacc

SEQ ID NO: 928971 - DNA, 25 bp, Mus musculus
gactcagacaatcatgaaggcactg

SEQ ID NO: 928972 - DNA, 25 bp, Mus musculus
gactcagacaatgatgaaggcactg

SEQ ID NO: 928973 - DNA, 25 bp, Mus musculus
gactcagacacgccttgatggtgaa

SEQ ID NO: 928974 - DNA, 25 bp, Mus musculus
gactcagacacggcttgatggtgaa

SEQ ID NO: 928975 - DNA, 25 bp, Mus musculus
gactcagactggccccagtcttctg

SEQ ID NO: 928976 - DNA, 25 bp, Mus musculus
gactcagactgggcccagtcttctg

SEQ ID NO: 928977 - DNA, 25 bp, Mus musculus
gactcagagcaacaggtggatatag

SEQ ID NO: 928978 - DNA, 25 bp, Mus musculus
gactcagagcaagaggtggatatag

SEQ ID NO: 928979 - DNA, 25 bp, Mus musculus
gactcagagcattacaaagcctacg

SEQ ID NO: 928980 - DNA, 25 bp, Mus musculus
gactcagagctttacaaagcctacg

SEQ ID NO: 928981 - DNA, 25 bp, Mus musculus
gactcaggatgacacgcccttcttc

SEQ ID NO: 928982 - DNA, 25 bp, Mus musculus
gactcaggatgacaggcccttcttc

SEQ ID NO: 928983 - DNA, 25 bp, Mus musculus
gactcagggaacaaccccaggactg

SEQ ID NO: 928984 - DNA, 25 bp, Mus musculus
gactcagggaacaagcccaggactg

SEQ ID NO: 928985 - DNA, 25 bp, Mus musculus
gactcagggagaaacagcctggccc

SEQ ID NO: 928986 - DNA, 25 bp, Mus musculus
gactcagggagaaagagcctggccc

SEQ ID NO: 928987 - DNA, 25 bp, Mus musculus
gactcaggtcaccacggaggccatc

SEQ ID NO: 928988 - DNA, 25 bp, Mus musculus
gactcaggtcaccagggaggccatc

SEQ ID NO: 928989 - DNA, 25 bp, Mus musculus
gactcagtgcaactacagagactca

SEQ ID NO: 928990 - DNA, 25 bp, Mus musculus
gactcagtgcaagtacagagactca

SEQ ID NO: 928991 - DNA, 25 bp, Mus musculus
gactcatcacactgatgaagagaag

SEQ ID NO: 928992 - DNA, 25 bp, Mus musculus
gactcatcacactgttgaagagaag

SEQ ID NO: 928993 - DNA, 25 bp, Mus musculus
gactcattaaagcaaaaggatataa

SEQ ID NO: 928994 - DNA, 25 bp, Mus musculus
gactcattaaaggaaaaggatataa

SEQ ID NO: 928995 - DNA, 25 bp, Mus musculus
gactcattgttgcaaactctgctct

SEQ ID NO: 928996 - DNA, 25 bp, Mus musculus
gactcattgttggaaactctgctct

SEQ ID NO: 928997 - DNA, 25 bp, Mus musculus
gactccaaaaagcccaactgctttg

SEQ ID NO: 928998 - DNA, 25 bp, Mus musculus
gactccaaaaagccgaactgctttg

SEQ ID NO: 928999 - DNA, 25 bp, Mus musculus
gactccaagcagatgacccggaagt

SEQ ID NO: 929000 - DNA, 25 bp, Mus musculus
gactccaagcagttgacccggaagt

SEQ ID NO: 929001 - DNA, 25 bp, Mus musculus
gactccagaccatggtttttggaat

SEQ ID NO: 929002 - DNA, 25 bp, Mus musculus
gactccagaccgtttttggaatact

SEQ ID NO: 929003 - DNA, 25 bp, Mus musculus
gactccagacgatggtttttggaat

SEQ ID NO: 929004 - DNA, 25 bp, Mus musculus
gactccagacggtttttggaatact

SEQ ID NO: 929005 - DNA, 25 bp, Mus musculus
gactccattaatagtgaggttggaa

SEQ ID NO: 929006 - DNA, 25 bp, Mus musculus
gactccattaattgtgaggttggaa

SEQ ID NO: 929007 - DNA, 25 bp, Mus musculus
gactccatttacaacttcagggtca

SEQ ID NO: 929008 - DNA, 25 bp, Mus musculus
gactccattttcaacttcagggtca

SEQ ID NO: 929009 - DNA, 25 bp, Mus musculus
gactcccaagaacagtgactggccg

SEQ ID NO: 929010 - DNA, 25 bp, Mus musculus
gactcccaagaagagtgactggccg

SEQ ID NO: 929011 - DNA, 25 bp, Mus musculus
gactcccacagacgagaggcgcatc

SEQ ID NO: 929012 - DNA, 25 bp, Mus musculus
gactcccacagaggagaggcgcatc

SEQ ID NO: 929013 - DNA, 25 bp, Mus musculus
gactcccagaagatagtcacatgct

SEQ ID NO: 929014 - DNA, 25 bp, Mus musculus
gactcccagaagttagtcacatgct

SEQ ID NO: 929015 - DNA, 25 bp, Mus musculus
gactccccacaacctccctggggaa

SEQ ID NO: 929016 - DNA, 25 bp, Mus musculus
gactccccacaagctccctggggaa

SEQ ID NO: 929017 - DNA, 25 bp, Mus musculus
gactccccagattctcaagggagga

SEQ ID NO: 929018 - DNA, 25 bp, Mus musculus
gactccccagtttctcaagggagga

SEQ ID NO: 929019 - DNA, 25 bp, Mus musculus
gactccctcaagaacaaagtcacaa

SEQ ID NO: 929020 - DNA, 25 bp, Mus musculus
gactccctcaagattcaaacagaca

SEQ ID NO: 929021 - DNA, 25 bp, Mus musculus
gactccctcaagtacaaagtcacaa

SEQ ID NO: 929022 - DNA, 25 bp, Mus musculus
gactccctcaagtttcaaacagaca

SEQ ID NO: 929023 - DNA, 25 bp, Mus musculus
gactccctggagctttgcctcaaat

SEQ ID NO: 929024 - DNA, 25 bp, Mus musculus
gactccctggaggtttgcctcaaat

SEQ ID NO: 929025 - DNA, 25 bp, Mus musculus
gactccggagcaacctggctcaccg

SEQ ID NO: 929026 - DNA, 25 bp, Mus musculus
gactccggaggaacctggctcaccg

SEQ ID NO: 929027 - DNA, 25 bp, Mus musculus
gactccgtagcggctgaggatgcct

SEQ ID NO: 929028 - DNA, 25 bp, Mus musculus
gactccgtaggggctgaggatgcct

SEQ ID NO: 929029 - DNA, 25 bp, Mus musculus
gactccgtgaagacacggatgcaga

SEQ ID NO: 929030 - DNA, 25 bp, Mus musculus
gactccgtgaagtcacggatgcaga

SEQ ID NO: 929031 - DNA, 25 bp, Mus musculus
gactcctgagcacattgggaagctg

SEQ ID NO: 929032 - DNA, 25 bp, Mus musculus
gactcctgagcagattgggaagctg

SEQ ID NO: 929033 - DNA, 25 bp, Mus musculus
gactcctgcattagtcttccttagt

SEQ ID NO: 929034 - DNA, 25 bp, Mus musculus
gactcctgcatttgtcttccttagt

SEQ ID NO: 929035 - DNA, 25 bp, Mus musculus
gactcctgggatcctcatcagaaca

SEQ ID NO: 929036 - DNA, 25 bp, Mus musculus
gactcctgggatgctcatcagaaca

SEQ ID NO: 929037 - DNA, 25 bp, Mus musculus
gactcctggtcacgtcaaagagctg

SEQ ID NO: 929038 - DNA, 25 bp, Mus musculus
gactcctggtcaggtcaaagagctg

SEQ ID NO: 929039 - DNA, 25 bp, Mus musculus
gactccttgaagctggctgtcttca

SEQ ID NO: 929040 - DNA, 25 bp, Mus musculus
gactccttgaaggtggctgtcttca

SEQ ID NO: 929041 - DNA, 25 bp, Mus musculus
gactcgaagtcacaaacgtggtatc

SEQ ID NO: 929042 - DNA, 25 bp, Mus musculus
gactcgaagtcagaaacgtggtatc

SEQ ID NO: 929043 - DNA, 25 bp, Mus musculus
gactcgccagtcacagtatgcggtg

SEQ ID NO: 929044 - DNA, 25 bp, Mus musculus
gactcgccagtcactgtatgcggtg

SEQ ID NO: 929045 - DNA, 25 bp, Mus musculus
gactcggctgaggacgccaccatgg

SEQ ID NO: 929046 - DNA, 25 bp, Mus musculus
gactcggctgaggaggccaccatgg

SEQ ID NO: 929047 - DNA, 25 bp, Mus musculus
gactcgggtcggaacctccagctct

SEQ ID NO: 929048 - DNA, 25 bp, Mus musculus
gactcgggtcggtacctccagctct

SEQ ID NO: 929049 - DNA, 25 bp, Mus musculus
gactctacagccactacgaaggttt

SEQ ID NO: 929050 - DNA, 25 bp, Mus musculus
gactctacagccattgggcatggag

SEQ ID NO: 929051 - DNA, 25 bp, Mus musculus
gactctacaggcactacgaaggttt

SEQ ID NO: 929052 - DNA, 25 bp, Mus musculus
gactctacaggcattgggcatggag

SEQ ID NO: 929053 - DNA, 25 bp, Mus musculus
gactctactactgaataccccaagt

SEQ ID NO: 929054 - DNA, 25 bp, Mus musculus
gactctactactgattaccccaagt

SEQ ID NO: 929055 - DNA, 25 bp, Mus musculus
gactctactgtgaacgtgtggtccg

SEQ ID NO: 929056 - DNA, 25 bp, Mus musculus
gactctactgtgaaggtgtggtccg

SEQ ID NO: 929057 - DNA, 25 bp, Mus musculus
gactctagctggccgaggacccgtg

SEQ ID NO: 929058 - DNA, 25 bp, Mus musculus
gactctagctgggcgaggacccgtg

SEQ ID NO: 929059 - DNA, 25 bp, Mus musculus
gactctcagagcagtggcagctcag

SEQ ID NO: 929060 - DNA, 25 bp, Mus musculus
gactctcagagctgtggcagctcag

SEQ ID NO: 929061 - DNA, 25 bp, Mus musculus
gactctgaagaacgtggcctttcag

SEQ ID NO: 929062 - DNA, 25 bp, Mus musculus
gactctgaagaaggtggcctttcag

SEQ ID NO: 929063 - DNA, 25 bp, Mus musculus
gactctgaagtgcatggtgctctcg

SEQ ID NO: 929064 - DNA, 25 bp, Mus musculus
gactctgaagtggatggtgctctcg

SEQ ID NO: 929065 - DNA, 25 bp, Mus musculus
gactctgacgtgcacgctgtgatgt

SEQ ID NO: 929066 - DNA, 25 bp, Mus musculus
gactctgacgtgcaggctgtgatgt

SEQ ID NO: 929067 - DNA, 25 bp, Mus musculus
gactctgatgatgttcttggtcaaa

SEQ ID NO: 929068 - DNA, 25 bp, Mus musculus
gactctgatgctgatggccgaggtg

SEQ ID NO: 929069 - DNA, 25 bp, Mus musculus
gactctgatgggcaccacagcgact

SEQ ID NO: 929070 - DNA, 25 bp, Mus musculus
gactctgatgggcagcacagcgact

SEQ ID NO: 929071 - DNA, 25 bp, Mus musculus
gactctgatggtgatggccgaggtg

SEQ ID NO: 929072 - DNA, 25 bp, Mus musculus
gactctgatgttgttcttggtcaaa

SEQ ID NO: 929073 - DNA, 25 bp, Mus musculus
gactctgcaaacagtgccaccaaaa

SEQ ID NO: 929074 - DNA, 25 bp, Mus musculus
gactctgcaaactgtgccaccaaaa

SEQ ID NO: 929075 - DNA, 25 bp, Mus musculus
gactctgcagaatatgcacagcccc

SEQ ID NO: 929076 - DNA, 25 bp, Mus musculus
gactctgcagcgacctctagtgcct

SEQ ID NO: 929077 - DNA, 25 bp, Mus musculus
gactctgcagggacctctagtgcct

SEQ ID NO: 929078 - DNA, 25 bp, Mus musculus
gactctgcagtatatgcacagcccc

SEQ ID NO: 929079 - DNA, 25 bp, Mus musculus
gactctggaccacgtcttagaagat

SEQ ID NO: 929080 - DNA, 25 bp, Mus musculus
gactctggaccaggtcttagaagat

SEQ ID NO: 929081 - DNA, 25 bp, Mus musculus
gactctggagagtgactgcaccaag

SEQ ID NO: 929082 - DNA, 25 bp, Mus musculus
gactctggagtgtgactgcaccaag

SEQ ID NO: 929083 - DNA, 25 bp, Mus musculus
gactctgtatgaatatttctctcag

SEQ ID NO: 929084 - DNA, 25 bp, Mus musculus
gactctgtatgattatttctctcag

SEQ ID NO: 929085 - DNA, 25 bp, Mus musculus
gactcttccatgccagttcccaccc

SEQ ID NO: 929086 - DNA, 25 bp, Mus musculus
gactcttccatgcctgttcccaccc

SEQ ID NO: 929087 - DNA, 25 bp, Mus musculus
gactcttcccaacctaaagcccatt

SEQ ID NO: 929088 - DNA, 25 bp, Mus musculus
gactcttcccaagctaaagcccatt

SEQ ID NO: 929089 - DNA, 25 bp, Mus musculus
gactcttgccagcgagacagtggag

SEQ ID NO: 929090 - DNA, 25 bp, Mus musculus
gactcttgccagggagacagtggag

SEQ ID NO: 929091 - DNA, 25 bp, Mus musculus
gactctttctcacatcacaaacaat

SEQ ID NO: 929092 - DNA, 25 bp, Mus musculus
gactctttctcagatcacaaacaat

SEQ ID NO: 929093 - DNA, 25 bp, Mus musculus
gactgaaaataacgagactggatga

SEQ ID NO: 929094 - DNA, 25 bp, Mus musculus
gactgaaaataaggagactggatga

SEQ ID NO: 929095 - DNA, 25 bp, Mus musculus
gactgaaaatagaacccagttatga

SEQ ID NO: 929096 - DNA, 25 bp, Mus musculus
gactgaaaatagaagccagttatga

SEQ ID NO: 929097 - DNA, 25 bp, Mus musculus
gactgaactaagacagaaagacatg

SEQ ID NO: 929098 - DNA, 25 bp, Mus musculus
gactgaactaagtcagaaagacatg

SEQ ID NO: 929099 - DNA, 25 bp, Mus musculus
gactgaactgtgtgaatatccccaa

SEQ ID NO: 929100 - DNA, 25 bp, Mus musculus
gactgaactgtgtgtatatccccaa

SEQ ID NO: 929101 - DNA, 25 bp, Mus musculus
gactgaatagttttcgcttggatgc

SEQ ID NO: 929102 - DNA, 25 bp, Mus musculus
gactgaatagttttggcttggatgc

SEQ ID NO: 929103 - DNA, 25 bp, Mus musculus
gactgacctgagtccgcagaacgct

SEQ ID NO: 929104 - DNA, 25 bp, Mus musculus
gactgacctgagtcggcagaacgct

SEQ ID NO: 929105 - DNA, 25 bp, Mus musculus
gactgacttcagcgcttttgcaggg

SEQ ID NO: 929106 - DNA, 25 bp, Mus musculus
gactgacttcaggccggcttttgca

SEQ ID NO: 929107 - DNA, 25 bp, Mus musculus
gactgacttcaggcgggcttttgca

SEQ ID NO: 929108 - DNA, 25 bp, Mus musculus
gactgacttcagggcttttgcaggg

SEQ ID NO: 929109 - DNA, 25 bp, Mus musculus
gactgagaacctcccctgcagttaa

SEQ ID NO: 929110 - DNA, 25 bp, Mus musculus
gactgagaacctgccctgcagttaa

SEQ ID NO: 929111 - DNA, 25 bp, Mus musculus
gactgagagccaaattgttcagaag

SEQ ID NO: 929112 - DNA, 25 bp, Mus musculus
gactgagagccatattgttcagaag

SEQ ID NO: 929113 - DNA, 25 bp, Mus musculus
gactgagcacactctgcagaggacg

SEQ ID NO: 929114 - DNA, 25 bp, Mus musculus
gactgagcacccggtggagggagac

SEQ ID NO: 929115 - DNA, 25 bp, Mus musculus
gactgagcacgcggtggagggagac

SEQ ID NO: 929116 - DNA, 25 bp, Mus musculus
gactgagcactctctgcagaggacg

SEQ ID NO: 929117 - DNA, 25 bp, Mus musculus
gactgaggccagatcatggccctcc

SEQ ID NO: 929118 - DNA, 25 bp, Mus musculus
gactgaggccagttcatggccctcc

SEQ ID NO: 929119 - DNA, 25 bp, Mus musculus
gactgatgtctgctccctaggctgt

SEQ ID NO: 929120 - DNA, 25 bp, Mus musculus
gactgatgtctggtccctaggctgt

SEQ ID NO: 929121 - DNA, 25 bp, Mus musculus
gactgatttaagccttttgcctacc

SEQ ID NO: 929122 - DNA, 25 bp, Mus musculus
gactgatttaagcgcagcagggaac

SEQ ID NO: 929123 - DNA, 25 bp, Mus musculus
gactgatttaaggcttttgcctacc

SEQ ID NO: 929124 - DNA, 25 bp, Mus musculus
gactgatttaagggcagcagggaac

SEQ ID NO: 929125 - DNA, 25 bp, Mus musculus
gactgattttgaccaccgcatgccc

SEQ ID NO: 929126 - DNA, 25 bp, Mus musculus
gactgattttgagcaccgcatgccc

SEQ ID NO: 929127 - DNA, 25 bp, Mus musculus
gactgcaaacagatcattgccaacc

SEQ ID NO: 929128 - DNA, 25 bp, Mus musculus
gactgcaaacagttcattgccaacc

SEQ ID NO: 929129 - DNA, 25 bp, Mus musculus
gactgcaaagcacaggctgtgcgcc

SEQ ID NO: 929130 - DNA, 25 bp, Mus musculus
gactgcaaagcctgtgcgcccccgg

SEQ ID NO: 929131 - DNA, 25 bp, Mus musculus
gactgcaaagctgaccagagcgagc

SEQ ID NO: 929132 - DNA, 25 bp, Mus musculus
gactgcaaaggacaggctgtgcgcc

SEQ ID NO: 929133 - DNA, 25 bp, Mus musculus
gactgcaaaggctgtgcgcccccgg

SEQ ID NO: 929134 - DNA, 25 bp, Mus musculus
gactgcaaaggtgaccagagcgagc

SEQ ID NO: 929135 - DNA, 25 bp, Mus musculus
gactgcacacaaacctgtaactatg

SEQ ID NO: 929136 - DNA, 25 bp, Mus musculus
gactgcacactaacctgtaactatg

SEQ ID NO: 929137 - DNA, 25 bp, Mus musculus
gactgcacagttatcgtgtgggaga

SEQ ID NO: 929138 - DNA, 25 bp, Mus musculus
gactgcacagttatggtgtgggaga

SEQ ID NO: 929139 - DNA, 25 bp, Mus musculus
gactgcaccctgcggtaaaacattc

SEQ ID NO: 929140 - DNA, 25 bp, Mus musculus
gactgcaccctggggtaaaacattc

SEQ ID NO: 929141 - DNA, 25 bp, Mus musculus
gactgcacgcagaaagatgacagga

SEQ ID NO: 929142 - DNA, 25 bp, Mus musculus
gactgcacgcagtaagatgacagga

SEQ ID NO: 929143 - DNA, 25 bp, Mus musculus
gactgcacggtgaacatctggaaca

SEQ ID NO: 929144 - DNA, 25 bp, Mus musculus
gactgcacggtgaagatctggaaca

SEQ ID NO: 929145 - DNA, 25 bp, Mus musculus
gactgcactgtcatcgtatggcaga

SEQ ID NO: 929146 - DNA, 25 bp, Mus musculus
gactgcactgtcatggtatggcaga

SEQ ID NO: 929147 - DNA, 25 bp, Mus musculus
gactgcagaatgacagatttgacca

SEQ ID NO: 929148 - DNA, 25 bp, Mus musculus
gactgcagaatgtcagatttgacca

SEQ ID NO: 929149 - DNA, 25 bp, Mus musculus
gactgcagagctgtatctccagtgg

SEQ ID NO: 929150 - DNA, 25 bp, Mus musculus
gactgcagaggtgtatctccagtgg

SEQ ID NO: 929151 - DNA, 25 bp, Mus musculus
gactgcatcgatcagttttcctgct

SEQ ID NO: 929152 - DNA, 25 bp, Mus musculus
gactgcatcgcgaagatcagttttc

SEQ ID NO: 929153 - DNA, 25 bp, Mus musculus
gactgcatcgggaagatcagttttc

SEQ ID NO: 929154 - DNA, 25 bp, Mus musculus
gactgcatcgttcagttttcctgct

SEQ ID NO: 929155 - DNA, 25 bp, Mus musculus
gactgcatctagacttgtaaccatg

SEQ ID NO: 929156 - DNA, 25 bp, Mus musculus
gactgcatcttgacttgtaaccatg

SEQ ID NO: 929157 - DNA, 25 bp, Mus musculus
gactgcattgacatagatgaatgtg

SEQ ID NO: 929158 - DNA, 25 bp, Mus musculus
gactgcattgtcatagatgaatgtg

SEQ ID NO: 929159 - DNA, 25 bp, Mus musculus
gactgccaagactcactctgtggag

SEQ ID NO: 929160 - DNA, 25 bp, Mus musculus
gactgccaagcaggccgagttagct

SEQ ID NO: 929161 - DNA, 25 bp, Mus musculus
gactgccaaggaggccgagttagct

SEQ ID NO: 929162 - DNA, 25 bp, Mus musculus
gactgccaagtctcactctgtggag

SEQ ID NO: 929163 - DNA, 25 bp, Mus musculus
gactgccatatttaccattcccgtc

SEQ ID NO: 929164 - DNA, 25 bp, Mus musculus
gactgccatatttagcattcccgtc

SEQ ID NO: 929165 - DNA, 25 bp, Mus musculus
gactgccatgcactgagctgctggt

SEQ ID NO: 929166 - DNA, 25 bp, Mus musculus
gactgccatgcagtgagctgctggt

SEQ ID NO: 929167 - DNA, 25 bp, Mus musculus
gactgcccaattcatggatgcctgt

SEQ ID NO: 929168 - DNA, 25 bp, Mus musculus
gactgcccaattgatggatgcctgt

SEQ ID NO: 929169 - DNA, 25 bp, Mus musculus
gactgccccaagcctgacttcccca

SEQ ID NO: 929170 - DNA, 25 bp, Mus musculus
gactgccccaaggctgacttcccca

SEQ ID NO: 929171 - DNA, 25 bp, Mus musculus
gactgccccggccacctgactgctg

SEQ ID NO: 929172 - DNA, 25 bp, Mus musculus
gactgccccggccagctgactgctg

SEQ ID NO: 929173 - DNA, 25 bp, Mus musculus
gactgccctgcacgacaagaaagac

SEQ ID NO: 929174 - DNA, 25 bp, Mus musculus
gactgccctgcaggacaagaaagac

SEQ ID NO: 929175 - DNA, 25 bp, Mus musculus
gactgccgccccaacccgtgtcaca

SEQ ID NO: 929176 - DNA, 25 bp, Mus musculus
gactgccgcccctacccgtgtcaca

SEQ ID NO: 929177 - DNA, 25 bp, Mus musculus
gactgcctgactcgaaagccaccat

SEQ ID NO: 929178 - DNA, 25 bp, Mus musculus
gactgcctgactggaaagccaccat

SEQ ID NO: 929179 - DNA, 25 bp, Mus musculus
gactgcgcctgcgccttgtagatca

SEQ ID NO: 929180 - DNA, 25 bp, Mus musculus
gactgcgcctgcgcgttgtagatca

SEQ ID NO: 929181 - DNA, 25 bp, Mus musculus
gactgcggcaaagacgcattctgga

SEQ ID NO: 929182 - DNA, 25 bp, Mus musculus
gactgcggcaaagaggcattctgga

SEQ ID NO: 929183 - DNA, 25 bp, Mus musculus
gactgcggcacacgccttcacagtg

SEQ ID NO: 929184 - DNA, 25 bp, Mus musculus
gactgcggcacaggccttcacagtg

SEQ ID NO: 929185 - DNA, 25 bp, Mus musculus
gactgcggcgcaaccatgaaggtga

SEQ ID NO: 929186 - DNA, 25 bp, Mus musculus
gactgcggcggaaccatgaaggtga

SEQ ID NO: 929187 - DNA, 25 bp, Mus musculus
gactgctaagccctccagtgaagct

SEQ ID NO: 929188 - DNA, 25 bp, Mus musculus
gactgctaaggcctccagtgaagct

SEQ ID NO: 929189 - DNA, 25 bp, Mus musculus
gactgctcgtcacaatcaggtggac

SEQ ID NO: 929190 - DNA, 25 bp, Mus musculus
gactgctcgtcagaatcaggtggac

SEQ ID NO: 929191 - DNA, 25 bp, Mus musculus
gactgctgtcaaagggagccggtga

SEQ ID NO: 929192 - DNA, 25 bp, Mus musculus
gactgctgtcaatgggagccggtga

SEQ ID NO: 929193 - DNA, 25 bp, Mus musculus
gactgctttttactggtgatcatgt

SEQ ID NO: 929194 - DNA, 25 bp, Mus musculus
gactgctttttagtggtgatcatgt

SEQ ID NO: 929195 - DNA, 25 bp, Mus musculus
gactggaaaaagcacaggtgcagtc

SEQ ID NO: 929196 - DNA, 25 bp, Mus musculus
gactggaaaaagcataggtgcggtc

SEQ ID NO: 929197 - DNA, 25 bp, Mus musculus
gactggaaaaaggacaggtgcagtc

SEQ ID NO: 929198 - DNA, 25 bp, Mus musculus
gactggaaaaaggataggtgcggtc

SEQ ID NO: 929199 - DNA, 25 bp, Mus musculus
gactggaaagatggagccagcactg

SEQ ID NO: 929200 - DNA, 25 bp, Mus musculus
gactggaaagccctccattcctttg

SEQ ID NO: 929201 - DNA, 25 bp, Mus musculus
gactggaaaggcctccattcctttg

SEQ ID NO: 929202 - DNA, 25 bp, Mus musculus
gactggaaagttggagccagcactg

SEQ ID NO: 929203 - DNA, 25 bp, Mus musculus
gactggaagacgcatctgtggtcgt

SEQ ID NO: 929204 - DNA, 25 bp, Mus musculus
gactggaagaggcatctgtggtcgt

SEQ ID NO: 929205 - DNA, 25 bp, Mus musculus
gactggacagaacgattccgggatt

SEQ ID NO: 929206 - DNA, 25 bp, Mus musculus
gactggacagtacgattccgggatt

SEQ ID NO: 929207 - DNA, 25 bp, Mus musculus
gactggacggcacgccatgttggag

SEQ ID NO: 929208 - DNA, 25 bp, Mus musculus
gactggacggcaggccatgttggag

SEQ ID NO: 929209 - DNA, 25 bp, Mus musculus
gactggagcgcacgagacatccagc

SEQ ID NO: 929210 - DNA, 25 bp, Mus musculus
gactggagcggacgagacatccagc

SEQ ID NO: 929211 - DNA, 25 bp, Mus musculus
gactggagtgagcaaaatggcacac

SEQ ID NO: 929212 - DNA, 25 bp, Mus musculus
gactggagtgagcagaagaaacact

SEQ ID NO: 929213 - DNA, 25 bp, Mus musculus
gactggagtgagctcaagggtcttc

SEQ ID NO: 929214 - DNA, 25 bp, Mus musculus
gactggagtgaggaaaatggcacac

SEQ ID NO: 929215 - DNA, 25 bp, Mus musculus
gactggagtgaggagaagaaacact

SEQ ID NO: 929216 - DNA, 25 bp, Mus musculus
gactggagtgaggtcaagggtcttc

SEQ ID NO: 929217 - DNA, 25 bp, Mus musculus
gactggatgccactcgtaagaccac

SEQ ID NO: 929218 - DNA, 25 bp, Mus musculus
gactggatgccactcgtactggcat

SEQ ID NO: 929219 - DNA, 25 bp, Mus musculus
gactggatgccactggtaagaccac

SEQ ID NO: 929220 - DNA, 25 bp, Mus musculus
gactggatgccactggtactggcat

SEQ ID NO: 929221 - DNA, 25 bp, Mus musculus
gactggatggggcgtgtgccagcct

SEQ ID NO: 929222 - DNA, 25 bp, Mus musculus
gactggatggggggtgtgccagcct

SEQ ID NO: 929223 - DNA, 25 bp, Mus musculus
gactggcatcagcggcactagctgg

SEQ ID NO: 929224 - DNA, 25 bp, Mus musculus
gactggcatcaggggcactagctgg

SEQ ID NO: 929225 - DNA, 25 bp, Mus musculus
gactggccacaccacgcttgatgat

SEQ ID NO: 929226 - DNA, 25 bp, Mus musculus
gactggccacaccaggcttgatgat

SEQ ID NO: 929227 - DNA, 25 bp, Mus musculus
gactggccagagcctcagattccca

SEQ ID NO: 929228 - DNA, 25 bp, Mus musculus
gactggccagaggctcagattccca

SEQ ID NO: 929229 - DNA, 25 bp, Mus musculus
gactggctcttgccgacaactggcc

SEQ ID NO: 929230 - DNA, 25 bp, Mus musculus
gactggctcttggcgacaactggcc

SEQ ID NO: 929231 - DNA, 25 bp, Mus musculus
gactggcttttagacgtttgtgaag

SEQ ID NO: 929232 - DNA, 25 bp, Mus musculus
gactggcttttagaggtttgtgaag

SEQ ID NO: 929233 - DNA, 25 bp, Mus musculus
gactgggaggagaacgtcctgttga

SEQ ID NO: 929234 - DNA, 25 bp, Mus musculus
gactgggaggagaaggtcctgttga

SEQ ID NO: 929235 - DNA, 25 bp, Mus musculus
gactgggataaacgattccagcaga

SEQ ID NO: 929236 - DNA, 25 bp, Mus musculus
gactgggataaaggattccagcaga

SEQ ID NO: 929237 - DNA, 25 bp, Mus musculus
gactggggaacacatccagagctgg

SEQ ID NO: 929238 - DNA, 25 bp, Mus musculus
gactggggaacagatccagagctgg

SEQ ID NO: 929239 - DNA, 25 bp, Mus musculus
gactggggtactcctgcaggtcctg

SEQ ID NO: 929240 - DNA, 25 bp, Mus musculus
gactggggtactgctgcaggtcctg

SEQ ID NO: 929241 - DNA, 25 bp, Mus musculus
gactggtcctcacgcattaacaagt

SEQ ID NO: 929242 - DNA, 25 bp, Mus musculus
gactggtcctcaggcattaacaagt

SEQ ID NO: 929243 - DNA, 25 bp, Mus musculus
gactggtgctcccgaacgagaagtg

SEQ ID NO: 929244 - DNA, 25 bp, Mus musculus
gactggtgctccggaacgagaagtg

SEQ ID NO: 929245 - DNA, 25 bp, Mus musculus
gactggtgggcaccttcatgttgtg

SEQ ID NO: 929246 - DNA, 25 bp, Mus musculus
gactggtgggcacggccttcgtata

SEQ ID NO: 929247 - DNA, 25 bp, Mus musculus
gactggtgggcagcttcatgttgtg

SEQ ID NO: 929248 - DNA, 25 bp, Mus musculus
gactggtgggcagggccttcgtata

SEQ ID NO: 929249 - DNA, 25 bp, Mus musculus
gactggtgtcaaccctgagggatct

SEQ ID NO: 929250 - DNA, 25 bp, Mus musculus
gactggtgtcaacctcccagactcc

SEQ ID NO: 929251 - DNA, 25 bp, Mus musculus
gactggtgtcaagcctgagggatct

SEQ ID NO: 929252 - DNA, 25 bp, Mus musculus
gactggtgtcaagctcccagactcc

SEQ ID NO: 929253 - DNA, 25 bp, Mus musculus
gactggttcctggacggatcaatgt

SEQ ID NO: 929254 - DNA, 25 bp, Mus musculus
gactggttcctggagggatcaatgt

SEQ ID NO: 929255 - DNA, 25 bp, Mus musculus
gactggtttttgattcacaaggaga

SEQ ID NO: 929256 - DNA, 25 bp, Mus musculus
gactggtttttgtttcacaaggaga

SEQ ID NO: 929257 - DNA, 25 bp, Mus musculus
gactgtaagaagaatgtctgcacca

SEQ ID NO: 929258 - DNA, 25 bp, Mus musculus
gactgtaagaagtatgtctgcacca

SEQ ID NO: 929259 - DNA, 25 bp, Mus musculus
gactgtagcccgcacatcaccttga

SEQ ID NO: 929260 - DNA, 25 bp, Mus musculus
gactgtagcccggacatcaccttga

SEQ ID NO: 929261 - DNA, 25 bp, Mus musculus
gactgtcaagaacgtaatatcttat

SEQ ID NO: 929262 - DNA, 25 bp, Mus musculus
gactgtcaagaaggtaatatcttat

SEQ ID NO: 929263 - DNA, 25 bp, Mus musculus
gactgtcattcaaacaacttaaggc

SEQ ID NO: 929264 - DNA, 25 bp, Mus musculus
gactgtcattcaaagaacttaaggc

SEQ ID NO: 929265 - DNA, 25 bp, Mus musculus
gactgtccctcaagttgcctgcagg

SEQ ID NO: 929266 - DNA, 25 bp, Mus musculus
gactgtccctcaatccaaaaaggcc

SEQ ID NO: 929267 - DNA, 25 bp, Mus musculus
gactgtccctcaatgcaaaaaggcc

SEQ ID NO: 929268 - DNA, 25 bp, Mus musculus
gactgtccctcaatggcacgctcct

SEQ ID NO: 929269 - DNA, 25 bp, Mus musculus
gactgtccctcaatttcgaggactc

SEQ ID NO: 929270 - DNA, 25 bp, Mus musculus
gactgtccctcatgttgcctgcagg

SEQ ID NO: 929271 - DNA, 25 bp, Mus musculus
gactgtccctcattggcacgctcct

SEQ ID NO: 929272 - DNA, 25 bp, Mus musculus
gactgtccctcattttcgaggactc

SEQ ID NO: 929273 - DNA, 25 bp, Mus musculus
gactgtccctctatcccaaaaggcc

SEQ ID NO: 929274 - DNA, 25 bp, Mus musculus
gactgtccctctatgccaaaaggcc

SEQ ID NO: 929275 - DNA, 25 bp, Mus musculus
gactgtctaccccacgtggcagcct

SEQ ID NO: 929276 - DNA, 25 bp, Mus musculus
gactgtctaccccaggtggcagcct

SEQ ID NO: 929277 - DNA, 25 bp, Mus musculus
gactgtctggaacgtcgctgtgcta

SEQ ID NO: 929278 - DNA, 25 bp, Mus musculus
gactgtctggaaggtcgctgtgcta

SEQ ID NO: 929279 - DNA, 25 bp, Mus musculus
gactgtcttgagagtctagctgcca

SEQ ID NO: 929280 - DNA, 25 bp, Mus musculus
gactgtcttgagtgtctagctgcca

SEQ ID NO: 929281 - DNA, 25 bp, Mus musculus
gactgtgaaacacacaagcagatgg

SEQ ID NO: 929282 - DNA, 25 bp, Mus musculus
gactgtgaaacacggaagcagctgg

SEQ ID NO: 929283 - DNA, 25 bp, Mus musculus
gactgtgaaacagacaagcagatgg

SEQ ID NO: 929284 - DNA, 25 bp, Mus musculus
gactgtgaaacagggaagcagctgg

SEQ ID NO: 929285 - DNA, 25 bp, Mus musculus
gactgtgaagaggctgccctggatg

SEQ ID NO: 929286 - DNA, 25 bp, Mus musculus
gactgtgaagtggctgccctggatg

SEQ ID NO: 929287 - DNA, 25 bp, Mus musculus
gactgtgagatgccggcgcccctgg

SEQ ID NO: 929288 - DNA, 25 bp, Mus musculus
gactgtgagatggcggcgcccctgg

SEQ ID NO: 929289 - DNA, 25 bp, Mus musculus
gactgtgagctcaacattctggatt

SEQ ID NO: 929290 - DNA, 25 bp, Mus musculus
gactgtgagctcaagattctggatt

SEQ ID NO: 929291 - DNA, 25 bp, Mus musculus
gactgtgagctgaacatcctagact

SEQ ID NO: 929292 - DNA, 25 bp, Mus musculus
gactgtgagctgaagatcctagact

SEQ ID NO: 929293 - DNA, 25 bp, Mus musculus
gactgtgatgcccagcagatacgca

SEQ ID NO: 929294 - DNA, 25 bp, Mus musculus
gactgtgatggccagcagatacgca

SEQ ID NO: 929295 - DNA, 25 bp, Mus musculus
gactgtgcaagcaacactgaaatac

SEQ ID NO: 929296 - DNA, 25 bp, Mus musculus
gactgtgcaagcaagactgaaatac

SEQ ID NO: 929297 - DNA, 25 bp, Mus musculus
gactgtgcatctgctccaagtgacc

SEQ ID NO: 929298 - DNA, 25 bp, Mus musculus
gactgtgcatgtgctccaagtgacc

SEQ ID NO: 929299 - DNA, 25 bp, Mus musculus
gactgtgctagcaacggtccaggct

SEQ ID NO: 929300 - DNA, 25 bp, Mus musculus
gactgtgctagctacggtccaggct

SEQ ID NO: 929301 - DNA, 25 bp, Mus musculus
gactgtggagcagatctataaggat

SEQ ID NO: 929302 - DNA, 25 bp, Mus musculus
gactgtggagccctttgtcagccag

SEQ ID NO: 929303 - DNA, 25 bp, Mus musculus
gactgtggaggagatctataaggat

SEQ ID NO: 929304 - DNA, 25 bp, Mus musculus
gactgtggaggcctttgtcagccag

SEQ ID NO: 929305 - DNA, 25 bp, Mus musculus
gactgtggcacacagaaatgctttg

SEQ ID NO: 929306 - DNA, 25 bp, Mus musculus
gactgtggcacagagaaatgctttg

SEQ ID NO: 929307 - DNA, 25 bp, Mus musculus
gactgtggcgattgtgaaagcactg

SEQ ID NO: 929308 - DNA, 25 bp, Mus musculus
gactgtggcgtttgtgaaagcactg

SEQ ID NO: 929309 - DNA, 25 bp, Mus musculus
gactgtggggcaaacgtggtagaga

SEQ ID NO: 929310 - DNA, 25 bp, Mus musculus
gactgtggggcaaaggtggtagaga

SEQ ID NO: 929311 - DNA, 25 bp, Mus musculus
gactgtgtatatagttctggataaa

SEQ ID NO: 929312 - DNA, 25 bp, Mus musculus
gactgtgtatattgttctggataaa

SEQ ID NO: 929313 - DNA, 25 bp, Mus musculus
gactgtgtggaagtgaagggcttcc

SEQ ID NO: 929314 - DNA, 25 bp, Mus musculus
gactgtgtggagatgaacgggtgcc

SEQ ID NO: 929315 - DNA, 25 bp, Mus musculus
gactgtgtggtagtgaagggcttcc

SEQ ID NO: 929316 - DNA, 25 bp, Mus musculus
gactgtgtggtgatgaacgggtgcc

SEQ ID NO: 929317 - DNA, 25 bp, Mus musculus
gactgtgtgtgccttggagtttgca

SEQ ID NO: 929318 - DNA, 25 bp, Mus musculus
gactgtgtgtgcgttggagtttgca

SEQ ID NO: 929319 - DNA, 25 bp, Mus musculus
gactgtgttctacactcaagaatga

SEQ ID NO: 929320 - DNA, 25 bp, Mus musculus
gactgtgttctagactcaagaatga

SEQ ID NO: 929321 - DNA, 25 bp, Mus musculus
gactgtgttgtctccgttcctagtt

SEQ ID NO: 929322 - DNA, 25 bp, Mus musculus
gactgtgttgtctcggttcctagtt

SEQ ID NO: 929323 - DNA, 25 bp, Mus musculus
gactgtgtttggctttccacaggca

SEQ ID NO: 929324 - DNA, 25 bp, Mus musculus
gactgtgtttgggtttccacaggca

SEQ ID NO: 929325 - DNA, 25 bp, Mus musculus
gactgttcagcacgtccagtgtccc

SEQ ID NO: 929326 - DNA, 25 bp, Mus musculus
gactgttcagcaggtccagtgtccc

SEQ ID NO: 929327 - DNA, 25 bp, Mus musculus
gactgttcatggccttgtgaaccca

SEQ ID NO: 929328 - DNA, 25 bp, Mus musculus
gactgttcatgggcttgtgaaccca

SEQ ID NO: 929329 - DNA, 25 bp, Mus musculus
gacttacaagcagtgggagaaaact

SEQ ID NO: 929330 - DNA, 25 bp, Mus musculus
gacttacaaggagtgggagaaaact

SEQ ID NO: 929331 - DNA, 25 bp, Mus musculus
gacttacagacacaagttatccaag

SEQ ID NO: 929332 - DNA, 25 bp, Mus musculus
gacttacagacacatgttatccaag

SEQ ID NO: 929333 - DNA, 25 bp, Mus musculus
gacttacagcagcttattgcaagtg

SEQ ID NO: 929334 - DNA, 25 bp, Mus musculus
gacttacagcaggttattgcaagtg

SEQ ID NO: 929335 - DNA, 25 bp, Mus musculus
gacttaccagcgtttgacctgattt

SEQ ID NO: 929336 - DNA, 25 bp, Mus musculus
gacttaccagggtttgacctgattt

SEQ ID NO: 929337 - DNA, 25 bp, Mus musculus
gacttacgctgggcagtacgtcggt

SEQ ID NO: 929338 - DNA, 25 bp, Mus musculus
gacttacgctgggctgtacgtcggt

SEQ ID NO: 929339 - DNA, 25 bp, Mus musculus
gacttactacagctggctgcggctt

SEQ ID NO: 929340 - DNA, 25 bp, Mus musculus
gacttactacagctgggcatggcag

SEQ ID NO: 929341 - DNA, 25 bp, Mus musculus
gacttactacaggtggctgcggctt

SEQ ID NO: 929342 - DNA, 25 bp, Mus musculus
gacttactacaggtgggcatggcag

SEQ ID NO: 929343 - DNA, 25 bp, Mus musculus
gacttactgcacttcacaccatggt

SEQ ID NO: 929344 - DNA, 25 bp, Mus musculus
gacttactgcacttgacaccatggt

SEQ ID NO: 929345 - DNA, 25 bp, Mus musculus
gacttagaagaaattcagacctgcc

SEQ ID NO: 929346 - DNA, 25 bp, Mus musculus
gacttagaagaatttcagacctgcc

SEQ ID NO: 929347 - DNA, 25 bp, Mus musculus
gacttagaagacgagctgtatgctc

SEQ ID NO: 929348 - DNA, 25 bp, Mus musculus
gacttagaagagaaagtggcccatg

SEQ ID NO: 929349 - DNA, 25 bp, Mus musculus
gacttagaagataagtttctttgct

SEQ ID NO: 929350 - DNA, 25 bp, Mus musculus
gacttagaagatcaactctaccatc

SEQ ID NO: 929351 - DNA, 25 bp, Mus musculus
gacttagaagtcgagctgtatgctc

SEQ ID NO: 929352 - DNA, 25 bp, Mus musculus
gacttagaagtgaaagtggcccatg

SEQ ID NO: 929353 - DNA, 25 bp, Mus musculus
gacttagaagttaagtttctttgct

SEQ ID NO: 929354 - DNA, 25 bp, Mus musculus
gacttagaagttcaactctaccatc

SEQ ID NO: 929355 - DNA, 25 bp, Mus musculus
gacttagcatggcacatgaaccgga

SEQ ID NO: 929356 - DNA, 25 bp, Mus musculus
gacttagcatggcagatgaaccgga

SEQ ID NO: 929357 - DNA, 25 bp, Mus musculus
gacttaggagaacagagactcagcc

SEQ ID NO: 929358 - DNA, 25 bp, Mus musculus
gacttaggagtacagagactcagcc

SEQ ID NO: 929359 - DNA, 25 bp, Mus musculus
gacttataatgaaggaaaaagatgg

SEQ ID NO: 929360 - DNA, 25 bp, Mus musculus
gacttataatgatggaaaaagatgg

SEQ ID NO: 929361 - DNA, 25 bp, Mus musculus
gacttatatcagaaaagagagatga

SEQ ID NO: 929362 - DNA, 25 bp, Mus musculus
gacttatatcagtaaagagagatga

SEQ ID NO: 929363 - DNA, 25 bp, Mus musculus
gacttatggccaatctgggtggatt

SEQ ID NO: 929364 - DNA, 25 bp, Mus musculus
gacttatggccaatgtgggtggatt

SEQ ID NO: 929365 - DNA, 25 bp, Mus musculus
gacttcaaggaccctgccccctctg

SEQ ID NO: 929366 - DNA, 25 bp, Mus musculus
gacttcaaggacgctgccccctctg

SEQ ID NO: 929367 - DNA, 25 bp, Mus musculus
gacttcaccaaacacaaatatccag

SEQ ID NO: 929368 - DNA, 25 bp, Mus musculus
gacttcaccaaacagaaatatccag

SEQ ID NO: 929369 - DNA, 25 bp, Mus musculus
gacttcaccacactgtttacaaaat

SEQ ID NO: 929370 - DNA, 25 bp, Mus musculus
gacttcaccacagtgtttacaaaat

SEQ ID NO: 929371 - DNA, 25 bp, Mus musculus
gacttcactgcaccttcaggcaagg

SEQ ID NO: 929372 - DNA, 25 bp, Mus musculus
gacttcactggaccttcaggcaagg

SEQ ID NO: 929373 - DNA, 25 bp, Mus musculus
gacttcagacagcactctagcaagg

SEQ ID NO: 929374 - DNA, 25 bp, Mus musculus
gacttcagacaggactctagcaagg

SEQ ID NO: 929375 - DNA, 25 bp, Mus musculus
gacttcagagaatctgttaaaaccc

SEQ ID NO: 929376 - DNA, 25 bp, Mus musculus
gacttcagagtatctgttaaaaccc

SEQ ID NO: 929377 - DNA, 25 bp, Mus musculus
gacttcagccaacacgactcctgag

SEQ ID NO: 929378 - DNA, 25 bp, Mus musculus
gacttcagccaacaggactcctgag

SEQ ID NO: 929379 - DNA, 25 bp, Mus musculus
gacttcaggcctttgaaggacagca

SEQ ID NO: 929380 - DNA, 25 bp, Mus musculus
gacttcaggcgtttgaaggacagca

SEQ ID NO: 929381 - DNA, 25 bp, Mus musculus
gacttcatggaccccctggttgctg

SEQ ID NO: 929382 - DNA, 25 bp, Mus musculus
gacttcatggacgccctggttgctg

SEQ ID NO: 929383 - DNA, 25 bp, Mus musculus
gacttcattaatgacggccttaaag

SEQ ID NO: 929384 - DNA, 25 bp, Mus musculus
gacttcattaatgagggccttaaag

SEQ ID NO: 929385 - DNA, 25 bp, Mus musculus
gacttcccctcgcatgcagatggga

SEQ ID NO: 929386 - DNA, 25 bp, Mus musculus
gacttcccctcggatgcagatggga

SEQ ID NO: 929387 - DNA, 25 bp, Mus musculus
gacttcccgctgctggtcccgtact

SEQ ID NO: 929388 - DNA, 25 bp, Mus musculus
gacttcccgctggtggtcccgtact

SEQ ID NO: 929389 - DNA, 25 bp, Mus musculus
gacttcctgcagcaatatgtcacca

SEQ ID NO: 929390 - DNA, 25 bp, Mus musculus
gacttcctgcaggaatatgtcacca

SEQ ID NO: 929391 - DNA, 25 bp, Mus musculus
gacttcctttgaaattccagctaca

SEQ ID NO: 929392 - DNA, 25 bp, Mus musculus
gacttcctttgatattccagctaca

SEQ ID NO: 929393 - DNA, 25 bp, Mus musculus
gacttcgccgaccacttccttcgag

SEQ ID NO: 929394 - DNA, 25 bp, Mus musculus
gacttcgccgaccagttccttcgag

SEQ ID NO: 929395 - DNA, 25 bp, Mus musculus
gacttcgccggcatctctgaggaac

SEQ ID NO: 929396 - DNA, 25 bp, Mus musculus
gacttcgccggcttctctgaggaac

SEQ ID NO: 929397 - DNA, 25 bp, Mus musculus
gacttcgctgctgacgtcgtacacc

SEQ ID NO: 929398 - DNA, 25 bp, Mus musculus
gacttcgctgctgaggtcgtacacc

SEQ ID NO: 929399 - DNA, 25 bp, Mus musculus
gacttctaagccctctcctgcagcc

SEQ ID NO: 929400 - DNA, 25 bp, Mus musculus
gacttctaagcgcggcagacatgtc

SEQ ID NO: 929401 - DNA, 25 bp, Mus musculus
gacttctaaggcctctcctgcagcc

SEQ ID NO: 929402 - DNA, 25 bp, Mus musculus
gacttctaagggcggcagacatgtc

SEQ ID NO: 929403 - DNA, 25 bp, Mus musculus
gacttctataaaatacaaggagtgc

SEQ ID NO: 929404 - DNA, 25 bp, Mus musculus
gacttctataaattacaaggagtgc

SEQ ID NO: 929405 - DNA, 25 bp, Mus musculus
gacttctatgagcggcaaggccgtc

SEQ ID NO: 929406 - DNA, 25 bp, Mus musculus
gacttctatgaggggcaaggccgtc

SEQ ID NO: 929407 - DNA, 25 bp, Mus musculus
gacttctgcaaattcatcaattgcc

SEQ ID NO: 929408 - DNA, 25 bp, Mus musculus
gacttctgcactcacgaagtagagc

SEQ ID NO: 929409 - DNA, 25 bp, Mus musculus
gacttctgcactcaggaagtagagc

SEQ ID NO: 929410 - DNA, 25 bp, Mus musculus
gacttctgcatattcatcaattgcc

SEQ ID NO: 929411 - DNA, 25 bp, Mus musculus
gacttctggctcacagagaaggact

SEQ ID NO: 929412 - DNA, 25 bp, Mus musculus
gacttctggctcactgagaaggact

SEQ ID NO: 929413 - DNA, 25 bp, Mus musculus
gacttgacaatacctctggtgcaag

SEQ ID NO: 929414 - DNA, 25 bp, Mus musculus
gacttgacaatagctctggtgcaag

SEQ ID NO: 929415 - DNA, 25 bp, Mus musculus
gacttgagaaagctggggatccaaa

SEQ ID NO: 929416 - DNA, 25 bp, Mus musculus
gacttgagaaaggtggggatccaaa

SEQ ID NO: 929417 - DNA, 25 bp, Mus musculus
gacttgagagccccaggatgggtga

SEQ ID NO: 929418 - DNA, 25 bp, Mus musculus
gacttgagaggcccaggatgggtga

SEQ ID NO: 929419 - DNA, 25 bp, Mus musculus
gacttgatgaagaacgaaagggagc

SEQ ID NO: 929420 - DNA, 25 bp, Mus musculus
gacttgatgaagaaggaaagggagc

SEQ ID NO: 929421 - DNA, 25 bp, Mus musculus
gacttgattgagtccgaccctgatg

SEQ ID NO: 929422 - DNA, 25 bp, Mus musculus
gacttgattgagtcggaccctgatg

SEQ ID NO: 929423 - DNA, 25 bp, Mus musculus
gacttgcaagactctttacagaaaa

SEQ ID NO: 929424 - DNA, 25 bp, Mus musculus
gacttgcaagtctctttacagaaaa

SEQ ID NO: 929425 - DNA, 25 bp, Mus musculus
gacttgcattggattgccattttca

SEQ ID NO: 929426 - DNA, 25 bp, Mus musculus
gacttgcattggtttgccattttca

SEQ ID NO: 929427 - DNA, 25 bp, Mus musculus
gacttgccagcgaaaatcatagtga

SEQ ID NO: 929428 - DNA, 25 bp, Mus musculus
gacttgccagggaaaatcatagtga

SEQ ID NO: 929429 - DNA, 25 bp, Mus musculus
gacttgctagcaggtcttttctcaa

SEQ ID NO: 929430 - DNA, 25 bp, Mus musculus
gacttgctaggaggtcttttctcaa

SEQ ID NO: 929431 - DNA, 25 bp, Mus musculus
gacttgctatcacgtgtactgcagt

SEQ ID NO: 929432 - DNA, 25 bp, Mus musculus
gacttgctatcaggtgtactgcagt

SEQ ID NO: 929433 - DNA, 25 bp, Mus musculus
gacttgctccaacggccccgccgtc

SEQ ID NO: 929434 - DNA, 25 bp, Mus musculus
gacttgctccaagggccccgccgtc

SEQ ID NO: 929435 - DNA, 25 bp, Mus musculus
gacttgctgtagcttatgatgagtt

SEQ ID NO: 929436 - DNA, 25 bp, Mus musculus
gacttgctgtaggttatgatgagtt

SEQ ID NO: 929437 - DNA, 25 bp, Mus musculus
gacttggaacagctagccaatgaga

SEQ ID NO: 929438 - DNA, 25 bp, Mus musculus
gacttggaacaggtagccaatgaga

SEQ ID NO: 929439 - DNA, 25 bp, Mus musculus
gacttggacaacaccatcaagaaac

SEQ ID NO: 929440 - DNA, 25 bp, Mus musculus
gacttggacaactccatcaagaaac

SEQ ID NO: 929441 - DNA, 25 bp, Mus musculus
gacttggaggagaaattaaaagaag

SEQ ID NO: 929442 - DNA, 25 bp, Mus musculus
gacttggaggagaatttaaaagaag

SEQ ID NO: 929443 - DNA, 25 bp, Mus musculus
gacttggatccttgggatgctgttc

SEQ ID NO: 929444 - DNA, 25 bp, Mus musculus
gacttggatcgttgggatgctgttc

SEQ ID NO: 929445 - DNA, 25 bp, Mus musculus
gacttggccaggcagccacagctaa

SEQ ID NO: 929446 - DNA, 25 bp, Mus musculus
gacttggccagggagccacagctaa

SEQ ID NO: 929447 - DNA, 25 bp, Mus musculus
gacttggctcctactttctgcactg

SEQ ID NO: 929448 - DNA, 25 bp, Mus musculus
gacttggctcctccctgaggagcga

SEQ ID NO: 929449 - DNA, 25 bp, Mus musculus
gacttggctcctgcctgaggagcga

SEQ ID NO: 929450 - DNA, 25 bp, Mus musculus
gacttggctccttctttctgcactg

SEQ ID NO: 929451 - DNA, 25 bp, Mus musculus
gacttggctgaccggcaccaacccc

SEQ ID NO: 929452 - DNA, 25 bp, Mus musculus
gacttggctgacgggcaccaacccc

SEQ ID NO: 929453 - DNA, 25 bp, Mus musculus
gacttgggttcctccgctcccagga

SEQ ID NO: 929454 - DNA, 25 bp, Mus musculus
gacttgggttcctcggctcccagga

SEQ ID NO: 929455 - DNA, 25 bp, Mus musculus
gactttaagcagctgctgctggtga

SEQ ID NO: 929456 - DNA, 25 bp, Mus musculus
gactttaagcaggtgctgctggtga

SEQ ID NO: 929457 - DNA, 25 bp, Mus musculus
gactttaatacccacgatgtatttt

SEQ ID NO: 929458 - DNA, 25 bp, Mus musculus
gactttaatacccaggatgtatttt

SEQ ID NO: 929459 - DNA, 25 bp, Mus musculus
gactttacttctctggagtcaattg

SEQ ID NO: 929460 - DNA, 25 bp, Mus musculus
gactttacttctgtggagtcaattg

SEQ ID NO: 929461 - DNA, 25 bp, Mus musculus
gactttcaccagcgaagacagtgac

SEQ ID NO: 929462 - DNA, 25 bp, Mus musculus
gactttcaccagggaagacagtgac

SEQ ID NO: 929463 - DNA, 25 bp, Mus musculus
gactttcccaatctgccctacttaa

SEQ ID NO: 929464 - DNA, 25 bp, Mus musculus
gactttcccaatgtgccctacttaa

SEQ ID NO: 929465 - DNA, 25 bp, Mus musculus
gactttcctaacctgccctacttga

SEQ ID NO: 929466 - DNA, 25 bp, Mus musculus
gactttcctaacgtgccctacttga

SEQ ID NO: 929467 - DNA, 25 bp, Mus musculus
gactttcctccacattgttggtgtc

SEQ ID NO: 929468 - DNA, 25 bp, Mus musculus
gactttcctccagattgttggtgtc

SEQ ID NO: 929469 - DNA, 25 bp, Mus musculus
gactttctcattaacgtaaatgacc

SEQ ID NO: 929470 - DNA, 25 bp, Mus musculus
gactttctcattaaggtaaatgacc

SEQ ID NO: 929471 - DNA, 25 bp, Mus musculus
gactttgaagagtttgtccggatga

SEQ ID NO: 929472 - DNA, 25 bp, Mus musculus
gactttgaagcttgtcttgacaccc

SEQ ID NO: 929473 - DNA, 25 bp, Mus musculus
gactttgaaggttgtcttgacaccc

SEQ ID NO: 929474 - DNA, 25 bp, Mus musculus
gactttgaagtgtttgtccggatga

SEQ ID NO: 929475 - DNA, 25 bp, Mus musculus
gactttgactgtcacgaacatgaca

SEQ ID NO: 929476 - DNA, 25 bp, Mus musculus
gactttgactgtcaggaacatgaca

SEQ ID NO: 929477 - DNA, 25 bp, Mus musculus
gactttgatgagctacagtatcaga

SEQ ID NO: 929478 - DNA, 25 bp, Mus musculus
gactttgatgaggtacagtatcaga

SEQ ID NO: 929479 - DNA, 25 bp, Mus musculus
gactttgattagcacgcattacagc

SEQ ID NO: 929480 - DNA, 25 bp, Mus musculus
gactttgattagcaggcattacagc

SEQ ID NO: 929481 - DNA, 25 bp, Mus musculus
gactttggaccaaagacccagccat

SEQ ID NO: 929482 - DNA, 25 bp, Mus musculus
gactttggaccaactgttctcagtt

SEQ ID NO: 929483 - DNA, 25 bp, Mus musculus
gactttggaccatagacccagccat

SEQ ID NO: 929484 - DNA, 25 bp, Mus musculus
gactttggaccatctgttctcagtt

SEQ ID NO: 929485 - DNA, 25 bp, Mus musculus
gactttgtcaagatgagctcaggga

SEQ ID NO: 929486 - DNA, 25 bp, Mus musculus
gactttgtcaagttgagctcaggga

SEQ ID NO: 929487 - DNA, 25 bp, Mus musculus
gactttgtcaggcatgccaaagccc

SEQ ID NO: 929488 - DNA, 25 bp, Mus musculus
gactttgtcagggatgccaaagccc

SEQ ID NO: 929489 - DNA, 25 bp, Mus musculus
gactttgtgagtcgtttgtacacct

SEQ ID NO: 929490 - DNA, 25 bp, Mus musculus
gactttgtgagtggtttgtacacct

SEQ ID NO: 929491 - DNA, 25 bp, Mus musculus
gactttgtggccctgctgtcccttc

SEQ ID NO: 929492 - DNA, 25 bp, Mus musculus
gactttgtggctgagttcctgtttt

SEQ ID NO: 929493 - DNA, 25 bp, Mus musculus
gactttgtgggcctgctgtcccttc

SEQ ID NO: 929494 - DNA, 25 bp, Mus musculus
gactttgtgggtgagttcctgtttt

SEQ ID NO: 929495 - DNA, 25 bp, Mus musculus
gacttttatacacgactgacagacg

SEQ ID NO: 929496 - DNA, 25 bp, Mus musculus
gacttttatacaggactgacagacg

SEQ ID NO: 929497 - DNA, 25 bp, Mus musculus
gacttttatcctgtcgtgtgagtgt

SEQ ID NO: 929498 - DNA, 25 bp, Mus musculus
gacttttatcctgtggtgtgagtgt

SEQ ID NO: 929499 - DNA, 25 bp, Mus musculus
gacttttcagagccactcagcacgc

SEQ ID NO: 929500 - DNA, 25 bp, Mus musculus
gacttttcagcgttcagactgggca

SEQ ID NO: 929501 - DNA, 25 bp, Mus musculus
gacttttcagggttcagactgggca

SEQ ID NO: 929502 - DNA, 25 bp, Mus musculus
gacttttcagtgccactcagcacgc

SEQ ID NO: 929503 - DNA, 25 bp, Mus musculus
gactttttacaaagtgattggagtt

SEQ ID NO: 929504 - DNA, 25 bp, Mus musculus
gactttttacaatgtgattggagtt

SEQ ID NO: 929505 - DNA, 25 bp, Mus musculus
gagaaaaaagcagtcgtttgtattg

SEQ ID NO: 929506 - DNA, 25 bp, Mus musculus
gagaaaaaagcagtggtttgtattg

SEQ ID NO: 929507 - DNA, 25 bp, Mus musculus
gagaaaaacgcctcttgcttcttgc

SEQ ID NO: 929508 - DNA, 25 bp, Mus musculus
gagaaaaacggctcttgcttcttgc

SEQ ID NO: 929509 - DNA, 25 bp, Mus musculus
gagaaaaagtggaaccacgaacagg

SEQ ID NO: 929510 - DNA, 25 bp, Mus musculus
gagaaaaagtggaagcacgaacagg

SEQ ID NO: 929511 - DNA, 25 bp, Mus musculus
gagaaaaatttacaatatgacatct

SEQ ID NO: 929512 - DNA, 25 bp, Mus musculus
gagaaaaatttagaatatgacatct

SEQ ID NO: 929513 - DNA, 25 bp, Mus musculus
gagaaaacagccatgtaatgaattc

SEQ ID NO: 929514 - DNA, 25 bp, Mus musculus
gagaaaacagctctcagcatcagag

SEQ ID NO: 929515 - DNA, 25 bp, Mus musculus
gagaaaacaggcatgtaatgaattc

SEQ ID NO: 929516 - DNA, 25 bp, Mus musculus
gagaaaacaggtctcagcatcagag

SEQ ID NO: 929517 - DNA, 25 bp, Mus musculus
gagaaaactgagatctgtctacatt

SEQ ID NO: 929518 - DNA, 25 bp, Mus musculus
gagaaaactgagatgtgtctacatt

SEQ ID NO: 929519 - DNA, 25 bp, Mus musculus
gagaaaagaaagaagcgagatatcc

SEQ ID NO: 929520 - DNA, 25 bp, Mus musculus
gagaaaagaaagcgagatatccctg

SEQ ID NO: 929521 - DNA, 25 bp, Mus musculus
gagaaaagaaagggagatatccctg

SEQ ID NO: 929522 - DNA, 25 bp, Mus musculus
gagaaaagaaagtagcgagatatcc

SEQ ID NO: 929523 - DNA, 25 bp, Mus musculus
gagaaaagcaagagctgtcttcctg

SEQ ID NO: 929524 - DNA, 25 bp, Mus musculus
gagaaaagcaagtgctgtcttcctg

SEQ ID NO: 929525 - DNA, 25 bp, Mus musculus
gagaaaatcaaggaccttgtagtga

SEQ ID NO: 929526 - DNA, 25 bp, Mus musculus
gagaaaatcaaggagcttgtagtga

SEQ ID NO: 929527 - DNA, 25 bp, Mus musculus
gagaaacatgctcgtggctgggaca

SEQ ID NO: 929528 - DNA, 25 bp, Mus musculus
gagaaacatgctcgtggtgtcacag

SEQ ID NO: 929529 - DNA, 25 bp, Mus musculus
gagaaacatgctggtggctgggaca

SEQ ID NO: 929530 - DNA, 25 bp, Mus musculus
gagaaacatgctggtggtgtcacag

SEQ ID NO: 929531 - DNA, 25 bp, Mus musculus
gagaaaccaaagactgtgatgcttg

SEQ ID NO: 929532 - DNA, 25 bp, Mus musculus
gagaaaccaaagtctgtgatgcttg

SEQ ID NO: 929533 - DNA, 25 bp, Mus musculus
gagaaaccacctcacgagtgaagcg

SEQ ID NO: 929534 - DNA, 25 bp, Mus musculus
gagaaaccacctcaggagtgaagcg

SEQ ID NO: 929535 - DNA, 25 bp, Mus musculus
gagaaactgccccacgtggcagaag

SEQ ID NO: 929536 - DNA, 25 bp, Mus musculus
gagaaactgccccaggtggcagaag

SEQ ID NO: 929537 - DNA, 25 bp, Mus musculus
gagaaactgtgtcactacttctcca

SEQ ID NO: 929538 - DNA, 25 bp, Mus musculus
gagaaactgtgtgactacttctcca

SEQ ID NO: 929539 - DNA, 25 bp, Mus musculus
gagaaagaagagcaagagaaactgg

SEQ ID NO: 929540 - DNA, 25 bp, Mus musculus
gagaaagaagaggaagagaaactgg

SEQ ID NO: 929541 - DNA, 25 bp, Mus musculus
gagaaagaagccatgtcatgttgcc

SEQ ID NO: 929542 - DNA, 25 bp, Mus musculus
gagaaagaaggcatgtcatgttgcc

SEQ ID NO: 929543 - DNA, 25 bp, Mus musculus
gagaaagagaggatcagacagaaaa

SEQ ID NO: 929544 - DNA, 25 bp, Mus musculus
gagaaagagaggatgagacagaaaa

SEQ ID NO: 929545 - DNA, 25 bp, Mus musculus
gagaaagcataacaatgttttgagt

SEQ ID NO: 929546 - DNA, 25 bp, Mus musculus
gagaaagcataacgtgactcatatt

SEQ ID NO: 929547 - DNA, 25 bp, Mus musculus
gagaaagcataagaatgttttgagt

SEQ ID NO: 929548 - DNA, 25 bp, Mus musculus
gagaaagcataaggtgactcatatt

SEQ ID NO: 929549 - DNA, 25 bp, Mus musculus
gagaaagcctggcctgcggcgaagc

SEQ ID NO: 929550 - DNA, 25 bp, Mus musculus
gagaaagcctgggctgcggcgaagc

SEQ ID NO: 929551 - DNA, 25 bp, Mus musculus
gagaaagctaagccttatgcagcca

SEQ ID NO: 929552 - DNA, 25 bp, Mus musculus
gagaaagctaaggcttatgcagcca

SEQ ID NO: 929553 - DNA, 25 bp, Mus musculus
gagaaaggattaggcatcttggcaa

SEQ ID NO: 929554 - DNA, 25 bp, Mus musculus
gagaaaggattagggatcttggcaa

SEQ ID NO: 929555 - DNA, 25 bp, Mus musculus
gagaaaggccaagcatgccctgctt

SEQ ID NO: 929556 - DNA, 25 bp, Mus musculus
gagaaaggccaagcttgccctgctt

SEQ ID NO: 929557 - DNA, 25 bp, Mus musculus
gagaaagtcatcttcactcgaagtg

SEQ ID NO: 929558 - DNA, 25 bp, Mus musculus
gagaaagtcatcttgactcgaagtg

SEQ ID NO: 929559 - DNA, 25 bp, Mus musculus
gagaaagttcagatgtaccgcatcc

SEQ ID NO: 929560 - DNA, 25 bp, Mus musculus
gagaaagttcagttgtaccgcatcc

SEQ ID NO: 929561 - DNA, 25 bp, Mus musculus
gagaaataccagaccctggcctaca

SEQ ID NO: 929562 - DNA, 25 bp, Mus musculus
gagaaataccagtccctggcctaca

SEQ ID NO: 929563 - DNA, 25 bp, Mus musculus
gagaaatatgaacacgcatgtaatg

SEQ ID NO: 929564 - DNA, 25 bp, Mus musculus
gagaaatatgaacaggcatgtaatg

SEQ ID NO: 929565 - DNA, 25 bp, Mus musculus
gagaaatgagacaaaagaagttaga

SEQ ID NO: 929566 - DNA, 25 bp, Mus musculus
gagaaatgagacctctctgggagat

SEQ ID NO: 929567 - DNA, 25 bp, Mus musculus
gagaaatgagtcaaaagaagttaga

SEQ ID NO: 929568 - DNA, 25 bp, Mus musculus
gagaaatgagtcctctctgggagat

SEQ ID NO: 929569 - DNA, 25 bp, Mus musculus
gagaaatgtgtgccttcagggaaaa

SEQ ID NO: 929570 - DNA, 25 bp, Mus musculus
gagaaatgtgtggcttcagggaaaa

SEQ ID NO: 929571 - DNA, 25 bp, Mus musculus
gagaaattccaccaccagtatgagc

SEQ ID NO: 929572 - DNA, 25 bp, Mus musculus
gagaaattccaccagcagtatgagc

SEQ ID NO: 929573 - DNA, 25 bp, Mus musculus
gagaaattgagagacgtgatagaaa

SEQ ID NO: 929574 - DNA, 25 bp, Mus musculus
gagaaattgagagaggtgatagaaa

SEQ ID NO: 929575 - DNA, 25 bp, Mus musculus
gagaacaagactcacaataagcctg

SEQ ID NO: 929576 - DNA, 25 bp, Mus musculus
gagaacaagactcagaataagcctg

SEQ ID NO: 929577 - DNA, 25 bp, Mus musculus
gagaacaagatccgttctctttgta

SEQ ID NO: 929578 - DNA, 25 bp, Mus musculus
gagaacaagatccttggaatgccaa

SEQ ID NO: 929579 - DNA, 25 bp, Mus musculus
gagaacaagatcggttctctttgta

SEQ ID NO: 929580 - DNA, 25 bp, Mus musculus
gagaacaagatcgttggaatgccaa

SEQ ID NO: 929581 - DNA, 25 bp, Mus musculus
gagaacaagtcagcagtggagatgc

SEQ ID NO: 929582 - DNA, 25 bp, Mus musculus
gagaacaagtcagctgtggagatgc

SEQ ID NO: 929583 - DNA, 25 bp, Mus musculus
gagaacaagtgcaacatgatttacc

SEQ ID NO: 929584 - DNA, 25 bp, Mus musculus
gagaacaagtgcaagatgatttacc

SEQ ID NO: 929585 - DNA, 25 bp, Mus musculus
gagaacaatgagcccctggagctgc

SEQ ID NO: 929586 - DNA, 25 bp, Mus musculus
gagaacaatgaggccctggagctgc

SEQ ID NO: 929587 - DNA, 25 bp, Mus musculus
gagaacagacaaccagacagatcgt

SEQ ID NO: 929588 - DNA, 25 bp, Mus musculus
gagaacagacaacctgacagatcgt

SEQ ID NO: 929589 - DNA, 25 bp, Mus musculus
gagaacagagcacctacgaagaaat

SEQ ID NO: 929590 - DNA, 25 bp, Mus musculus
gagaacagagcagctacgaagaaat

SEQ ID NO: 929591 - DNA, 25 bp, Mus musculus
gagaacagctcgcggactttctcta

SEQ ID NO: 929592 - DNA, 25 bp, Mus musculus
gagaacagctcgcgtttgagttttt

SEQ ID NO: 929593 - DNA, 25 bp, Mus musculus
gagaacagctcggggactttctcta

SEQ ID NO: 929594 - DNA, 25 bp, Mus musculus
gagaacagctcgggtttgagttttt

SEQ ID NO: 929595 - DNA, 25 bp, Mus musculus
gagaacagtaccttagaaagctttg

SEQ ID NO: 929596 - DNA, 25 bp, Mus musculus
gagaacagtacctttgaaagctttg

SEQ ID NO: 929597 - DNA, 25 bp, Mus musculus
gagaacatctagacagttcgaacct

SEQ ID NO: 929598 - DNA, 25 bp, Mus musculus
gagaacatctagactgttcgaacct

SEQ ID NO: 929599 - DNA, 25 bp, Mus musculus
gagaacatgcagcagcaactggaca

SEQ ID NO: 929600 - DNA, 25 bp, Mus musculus
gagaacatgcaggagcaactggaca

SEQ ID NO: 929601 - DNA, 25 bp, Mus musculus
gagaacattgcacggccgtgcaggc

SEQ ID NO: 929602 - DNA, 25 bp, Mus musculus
gagaacattgcacgtaaagatgagc

SEQ ID NO: 929603 - DNA, 25 bp, Mus musculus
gagaacattgcagggccgtgcaggc

SEQ ID NO: 929604 - DNA, 25 bp, Mus musculus
gagaacattgcaggtaaagatgagc

SEQ ID NO: 929605 - DNA, 25 bp, Mus musculus
gagaaccccaggctccattcacaca

SEQ ID NO: 929606 - DNA, 25 bp, Mus musculus
gagaaccccagggtccattcacaca

SEQ ID NO: 929607 - DNA, 25 bp, Mus musculus
gagaaccgagaaatggcaaaatgtc

SEQ ID NO: 929608 - DNA, 25 bp, Mus musculus
gagaaccgagtaatggcaaaatgtc

SEQ ID NO: 929609 - DNA, 25 bp, Mus musculus
gagaaccgcaagatatttcttctag

SEQ ID NO: 929610 - DNA, 25 bp, Mus musculus
gagaaccgcaagttatttcttctag

SEQ ID NO: 929611 - DNA, 25 bp, Mus musculus
gagaacctgtgggaagtatctcatg

SEQ ID NO: 929612 - DNA, 25 bp, Mus musculus
gagaacctgtgggatgtatctcatg

SEQ ID NO: 929613 - DNA, 25 bp, Mus musculus
gagaaccttacacgtcactgcaggg

SEQ ID NO: 929614 - DNA, 25 bp, Mus musculus
gagaaccttacaggtcactgcaggg

SEQ ID NO: 929615 - DNA, 25 bp, Mus musculus
gagaacgaatcacacgattagtcgt

SEQ ID NO: 929616 - DNA, 25 bp, Mus musculus
gagaacgaatcacaggattagtcgt

SEQ ID NO: 929617 - DNA, 25 bp, Mus musculus
gagaacgctcagccactgccctctg

SEQ ID NO: 929618 - DNA, 25 bp, Mus musculus
gagaacgctcaggcactgccctctg

SEQ ID NO: 929619 - DNA, 25 bp, Mus musculus
gagaacgtggcccaagttttcttgg

SEQ ID NO: 929620 - DNA, 25 bp, Mus musculus
gagaacgtggcccatgttttcttgg

SEQ ID NO: 929621 - DNA, 25 bp, Mus musculus
gagaactagcagctgacttaagaga

SEQ ID NO: 929622 - DNA, 25 bp, Mus musculus
gagaactagcaggtgacttaagaga

SEQ ID NO: 929623 - DNA, 25 bp, Mus musculus
gagaactatgagcctctcctgaacc

SEQ ID NO: 929624 - DNA, 25 bp, Mus musculus
gagaactatgaggctctcctgaacc

SEQ ID NO: 929625 - DNA, 25 bp, Mus musculus
gagaactcaaagaaccaccacgagg

SEQ ID NO: 929626 - DNA, 25 bp, Mus musculus
gagaactcaatgaaccaccacgagg

SEQ ID NO: 929627 - DNA, 25 bp, Mus musculus
gagaactcgcactaaggtccacgct

SEQ ID NO: 929628 - DNA, 25 bp, Mus musculus
gagaactcgcactatggtccacgct

SEQ ID NO: 929629 - DNA, 25 bp, Mus musculus
gagaactcggagcacctggagctga

SEQ ID NO: 929630 - DNA, 25 bp, Mus musculus
gagaactcggagcagctggagctga

SEQ ID NO: 929631 - DNA, 25 bp, Mus musculus
gagaacttcaggctcctgggcaata

SEQ ID NO: 929632 - DNA, 25 bp, Mus musculus
gagaacttcagggtcctgggcaata

SEQ ID NO: 929633 - DNA, 25 bp, Mus musculus
gagaactttccacgtgtctcctggg

SEQ ID NO: 929634 - DNA, 25 bp, Mus musculus
gagaactttccaggtgtctcctggg

SEQ ID NO: 929635 - DNA, 25 bp, Mus musculus
gagaagaaagaagttccagcagcaa

SEQ ID NO: 929636 - DNA, 25 bp, Mus musculus
gagaagaaagatccagcagcaatgt

SEQ ID NO: 929637 - DNA, 25 bp, Mus musculus
gagaagaaagatgtaagtggcgcca

SEQ ID NO: 929638 - DNA, 25 bp, Mus musculus
gagaagaaagccaacggcgctgatg

SEQ ID NO: 929639 - DNA, 25 bp, Mus musculus
gagaagaaagccaagggcgctgatg

SEQ ID NO: 929640 - DNA, 25 bp, Mus musculus
gagaagaaagcgctgaaggactggg

SEQ ID NO: 929641 - DNA, 25 bp, Mus musculus
gagaagaaagggctgaaggactggg

SEQ ID NO: 929642 - DNA, 25 bp, Mus musculus
gagaagaaagtagttccagcagcaa

SEQ ID NO: 929643 - DNA, 25 bp, Mus musculus
gagaagaaagttccagcagcaatgt

SEQ ID NO: 929644 - DNA, 25 bp, Mus musculus
gagaagaaagttgtaagtggcgcca

SEQ ID NO: 929645 - DNA, 25 bp, Mus musculus
gagaagaacaatcgtaccatcacct

SEQ ID NO: 929646 - DNA, 25 bp, Mus musculus
gagaagaacaatggtaccatcacct

SEQ ID NO: 929647 - DNA, 25 bp, Mus musculus
gagaagaactgtctaaagaagacgt

SEQ ID NO: 929648 - DNA, 25 bp, Mus musculus
gagaagaactgtgtaaagaagacgt

SEQ ID NO: 929649 - DNA, 25 bp, Mus musculus
gagaagaagaagctagctacatcaa

SEQ ID NO: 929650 - DNA, 25 bp, Mus musculus
gagaagaagaaggtagctacatcaa

SEQ ID NO: 929651 - DNA, 25 bp, Mus musculus
gagaagaagcgacaaacatcaatgg

SEQ ID NO: 929652 - DNA, 25 bp, Mus musculus
gagaagaagcgagaaacatcaatgg

SEQ ID NO: 929653 - DNA, 25 bp, Mus musculus
gagaagaaggcgctagtcccctgga

SEQ ID NO: 929654 - DNA, 25 bp, Mus musculus
gagaagaaggcggtagtcccctgga

SEQ ID NO: 929655 - DNA, 25 bp, Mus musculus
gagaagagaattgaccgtttatcac

SEQ ID NO: 929656 - DNA, 25 bp, Mus musculus
gagaagagaattgagcgtttatcac

SEQ ID NO: 929657 - DNA, 25 bp, Mus musculus
gagaagagagcccttcgagataatc

SEQ ID NO: 929658 - DNA, 25 bp, Mus musculus
gagaagagaggccttcgagataatc

SEQ ID NO: 929659 - DNA, 25 bp, Mus musculus
gagaagagattacacgtgaagcaga

SEQ ID NO: 929660 - DNA, 25 bp, Mus musculus
gagaagagattacaggtgaagcaga

SEQ ID NO: 929661 - DNA, 25 bp, Mus musculus
gagaagagccccagtcacgcggtgt

SEQ ID NO: 929662 - DNA, 25 bp, Mus musculus
gagaagagcccctgtcacgcggtgt

SEQ ID NO: 929663 - DNA, 25 bp, Mus musculus
gagaagagctatctgtatggcccca

SEQ ID NO: 929664 - DNA, 25 bp, Mus musculus
gagaagagctatgtgtatggcccca

SEQ ID NO: 929665 - DNA, 25 bp, Mus musculus
gagaagaggatgcctgctcccaggc

SEQ ID NO: 929666 - DNA, 25 bp, Mus musculus
gagaagaggatgctcgatccatcca

SEQ ID NO: 929667 - DNA, 25 bp, Mus musculus
gagaagaggatgctggatccatcca

SEQ ID NO: 929668 - DNA, 25 bp, Mus musculus
gagaagaggatggctgctcccaggc

SEQ ID NO: 929669 - DNA, 25 bp, Mus musculus
gagaagatattgctgtgatccgaaa

SEQ ID NO: 929670 - DNA, 25 bp, Mus musculus
gagaagatattggtgtgatccgaaa

SEQ ID NO: 929671 - DNA, 25 bp, Mus musculus
gagaagatgatgcaagatatgaatt

SEQ ID NO: 929672 - DNA, 25 bp, Mus musculus
gagaagatgatggaagatatgaatt

SEQ ID NO: 929673 - DNA, 25 bp, Mus musculus
gagaagatggtggactctgtgttcc

SEQ ID NO: 929674 - DNA, 25 bp, Mus musculus
gagaagatggtggagtctgtgttcc

SEQ ID NO: 929675 - DNA, 25 bp, Mus musculus
gagaagattaggaacgaagaatatg

SEQ ID NO: 929676 - DNA, 25 bp, Mus musculus
gagaagattaggaaggaagaatatg

SEQ ID NO: 929677 - DNA, 25 bp, Mus musculus
gagaagattgtcaacagcaactgca

SEQ ID NO: 929678 - DNA, 25 bp, Mus musculus
gagaagattgtcaagagcaactgca

SEQ ID NO: 929679 - DNA, 25 bp, Mus musculus
gagaagcaagcagagtacgagaaca

SEQ ID NO: 929680 - DNA, 25 bp, Mus musculus
gagaagcaaggagagtacgagaaca

SEQ ID NO: 929681 - DNA, 25 bp, Mus musculus
gagaagcacctgatgttcattcaga

SEQ ID NO: 929682 - DNA, 25 bp, Mus musculus
gagaagcacctgttgttcattcaga

SEQ ID NO: 929683 - DNA, 25 bp, Mus musculus
gagaagcagcagaaggaaggcttgc

SEQ ID NO: 929684 - DNA, 25 bp, Mus musculus
gagaagcagcagtaggaaggcttgc

SEQ ID NO: 929685 - DNA, 25 bp, Mus musculus
gagaagccagcagaaactacaactc

SEQ ID NO: 929686 - DNA, 25 bp, Mus musculus
gagaagccagctggtgaccatagaa

SEQ ID NO: 929687 - DNA, 25 bp, Mus musculus
gagaagccagcttacaaactacctg

SEQ ID NO: 929688 - DNA, 25 bp, Mus musculus
gagaagccaggagaaactacaactc

SEQ ID NO: 929689 - DNA, 25 bp, Mus musculus
gagaagccaggtggtgaccatagaa

SEQ ID NO: 929690 - DNA, 25 bp, Mus musculus
gagaagccaggttacaaactacctg

SEQ ID NO: 929691 - DNA, 25 bp, Mus musculus
gagaagcccaagcagggtgtgaaga

SEQ ID NO: 929692 - DNA, 25 bp, Mus musculus
gagaagcccaaggagggtgtgaaga

SEQ ID NO: 929693 - DNA, 25 bp, Mus musculus
gagaagcccgcacacgtcccaggaa

SEQ ID NO: 929694 - DNA, 25 bp, Mus musculus
gagaagcccgcacaggtcccaggaa

SEQ ID NO: 929695 - DNA, 25 bp, Mus musculus
gagaagcctaagaacgcaattcaca

SEQ ID NO: 929696 - DNA, 25 bp, Mus musculus
gagaagcctaagtacgcaattcaca

SEQ ID NO: 929697 - DNA, 25 bp, Mus musculus
gagaagcgggaattcgtctcggtgt

SEQ ID NO: 929698 - DNA, 25 bp, Mus musculus
gagaagcgggaattcgtctgggcgt

SEQ ID NO: 929699 - DNA, 25 bp, Mus musculus
gagaagcgggaattcgtcttggagt

SEQ ID NO: 929700 - DNA, 25 bp, Mus musculus
gagaagcgggaattggtctcggtgt

SEQ ID NO: 929701 - DNA, 25 bp, Mus musculus
gagaagcgggaattggtctgggcgt

SEQ ID NO: 929702 - DNA, 25 bp, Mus musculus
gagaagcgggaattggtcttggagt

SEQ ID NO: 929703 - DNA, 25 bp, Mus musculus
gagaagcgtgcacaccgaagaatag

SEQ ID NO: 929704 - DNA, 25 bp, Mus musculus
gagaagcgtgcacagcgaagaatag

SEQ ID NO: 929705 - DNA, 25 bp, Mus musculus
gagaagctctatcactttgtgaaga

SEQ ID NO: 929706 - DNA, 25 bp, Mus musculus
gagaagctctatgactttgtgaaga

SEQ ID NO: 929707 - DNA, 25 bp, Mus musculus
gagaagctgatcaacgtcttggata

SEQ ID NO: 929708 - DNA, 25 bp, Mus musculus
gagaagctgatcaaggtcttggata

SEQ ID NO: 929709 - DNA, 25 bp, Mus musculus
gagaagctgcagcccgactttaaaa

SEQ ID NO: 929710 - DNA, 25 bp, Mus musculus
gagaagctgcaggccgactttaaaa

SEQ ID NO: 929711 - DNA, 25 bp, Mus musculus
gagaagctggagcacgaaagatcta

SEQ ID NO: 929712 - DNA, 25 bp, Mus musculus
gagaagctggagcaggaaagatcta

SEQ ID NO: 929713 - DNA, 25 bp, Mus musculus
gagaagctggctatcagtaccatta

SEQ ID NO: 929714 - DNA, 25 bp, Mus musculus
gagaagctgggtatcagtaccatta

SEQ ID NO: 929715 - DNA, 25 bp, Mus musculus
gagaaggaacatctttccagagtgt

SEQ ID NO: 929716 - DNA, 25 bp, Mus musculus
gagaaggaacatgtttccagagtgt

SEQ ID NO: 929717 - DNA, 25 bp, Mus musculus
gagaaggaagagccagagaagttgg

SEQ ID NO: 929718 - DNA, 25 bp, Mus musculus
gagaaggaagaggcagagaagttgg

SEQ ID NO: 929719 - DNA, 25 bp, Mus musculus
gagaaggacaatgacgatggcagta

SEQ ID NO: 929720 - DNA, 25 bp, Mus musculus
gagaaggacaatgaggatggcagta

SEQ ID NO: 929721 - DNA, 25 bp, Mus musculus
gagaaggagacacaggccattctca

SEQ ID NO: 929722 - DNA, 25 bp, Mus musculus
gagaaggagacagaggccattctca

SEQ ID NO: 929723 - DNA, 25 bp, Mus musculus
gagaaggagcagcttggccacattc

SEQ ID NO: 929724 - DNA, 25 bp, Mus musculus
gagaaggagcaggttggccacattc

SEQ ID NO: 929725 - DNA, 25 bp, Mus musculus
gagaaggagctgatcgaagcgttgc

SEQ ID NO: 929726 - DNA, 25 bp, Mus musculus
gagaaggagctgccaaggcggcaac

SEQ ID NO: 929727 - DNA, 25 bp, Mus musculus
gagaaggagctggcaaggcggcaac

SEQ ID NO: 929728 - DNA, 25 bp, Mus musculus
gagaaggagctgttcgaagcgttgc

SEQ ID NO: 929729 - DNA, 25 bp, Mus musculus
gagaaggaggggatccccatcacag

SEQ ID NO: 929730 - DNA, 25 bp, Mus musculus
gagaaggaggggcagctcaactaag

SEQ ID NO: 929731 - DNA, 25 bp, Mus musculus
gagaaggagggggagctcaactaag

SEQ ID NO: 929732 - DNA, 25 bp, Mus musculus
gagaaggaggggttccccatcacag

SEQ ID NO: 929733 - DNA, 25 bp, Mus musculus
gagaaggataaacggctgcagacaa

SEQ ID NO: 929734 - DNA, 25 bp, Mus musculus
gagaaggataaagggctgcagacaa

SEQ ID NO: 929735 - DNA, 25 bp, Mus musculus
gagaaggcagcacgtataagtagcc

SEQ ID NO: 929736 - DNA, 25 bp, Mus musculus
gagaaggcagcaggtataagtagcc

SEQ ID NO: 929737 - DNA, 25 bp, Mus musculus
gagaaggctcagagccatggagaag

SEQ ID NO: 929738 - DNA, 25 bp, Mus musculus
gagaaggctcagagctgtatgccat

SEQ ID NO: 929739 - DNA, 25 bp, Mus musculus
gagaaggctcagtgccatggagaag

SEQ ID NO: 929740 - DNA, 25 bp, Mus musculus
gagaaggctcagtgctgtatgccat

SEQ ID NO: 929741 - DNA, 25 bp, Mus musculus
gagaaggcttcagtcgccctaattg

SEQ ID NO: 929742 - DNA, 25 bp, Mus musculus
gagaaggcttcagtggccctaattg

SEQ ID NO: 929743 - DNA, 25 bp, Mus musculus
gagaagggagaaaacggtgactgtg

SEQ ID NO: 929744 - DNA, 25 bp, Mus musculus
gagaagggagaaaagggtgactgtg

SEQ ID NO: 929745 - DNA, 25 bp, Mus musculus
gagaagggggagattgagcaggagc

SEQ ID NO: 929746 - DNA, 25 bp, Mus musculus
gagaagggggagtttgagcaggagc

SEQ ID NO: 929747 - DNA, 25 bp, Mus musculus
gagaaggttgctcaatcatgtgagg

SEQ ID NO: 929748 - DNA, 25 bp, Mus musculus
gagaaggttgctcattcatgtgagg

SEQ ID NO: 929749 - DNA, 25 bp, Mus musculus
gagaagtaccaagacgcatgcgaga

SEQ ID NO: 929750 - DNA, 25 bp, Mus musculus
gagaagtaccaagaggcatgcgaga

SEQ ID NO: 929751 - DNA, 25 bp, Mus musculus
gagaagtataagacacagattgacc

SEQ ID NO: 929752 - DNA, 25 bp, Mus musculus
gagaagtataagtcacagattgacc

SEQ ID NO: 929753 - DNA, 25 bp, Mus musculus
gagaagtatcggaaccttgtgtcgg

SEQ ID NO: 929754 - DNA, 25 bp, Mus musculus
gagaagtatcggaagcttgtgtcgg

SEQ ID NO: 929755 - DNA, 25 bp, Mus musculus
gagaagtatgagaacgatattgctg

SEQ ID NO: 929756 - DNA, 25 bp, Mus musculus
gagaagtatgagaacgatgttgctg

SEQ ID NO: 929757 - DNA, 25 bp, Mus musculus
gagaagtatgagaaggatattgctg

SEQ ID NO: 929758 - DNA, 25 bp, Mus musculus
gagaagtatgagaaggatgttgctg

SEQ ID NO: 929759 - DNA, 25 bp, Mus musculus
gagaagtatgagtcaactgtcagtc

SEQ ID NO: 929760 - DNA, 25 bp, Mus musculus
gagaagtatgtgtcaactgtcagtc

SEQ ID NO: 929761 - DNA, 25 bp, Mus musculus
gagaagtcatcacgcagctcttgaa

SEQ ID NO: 929762 - DNA, 25 bp, Mus musculus
gagaagtcatcaggcagctcttgaa

SEQ ID NO: 929763 - DNA, 25 bp, Mus musculus
gagaagtcccgacctgaagaggttg

SEQ ID NO: 929764 - DNA, 25 bp, Mus musculus
gagaagtcccgagctgaagaggttg

SEQ ID NO: 929765 - DNA, 25 bp, Mus musculus
gagaagtgcctcccacgtcagaacc

SEQ ID NO: 929766 - DNA, 25 bp, Mus musculus
gagaagtgcctccctcgtcagaacc

SEQ ID NO: 929767 - DNA, 25 bp, Mus musculus
gagaataatttacgggctgctgtgt

SEQ ID NO: 929768 - DNA, 25 bp, Mus musculus
gagaataatttaggggctgctgtgt

SEQ ID NO: 929769 - DNA, 25 bp, Mus musculus
gagaatatccagctatttgattttg

SEQ ID NO: 929770 - DNA, 25 bp, Mus musculus
gagaatatccaggtatttgattttg

SEQ ID NO: 929771 - DNA, 25 bp, Mus musculus
gagaatatgcagctttttgaatttc

SEQ ID NO: 929772 - DNA, 25 bp, Mus musculus
gagaatatgcaggtttttgaatttc

SEQ ID NO: 929773 - DNA, 25 bp, Mus musculus
gagaatattgagcacattctcgact

SEQ ID NO: 929774 - DNA, 25 bp, Mus musculus
gagaatattgagcagattctcgact

SEQ ID NO: 929775 - DNA, 25 bp, Mus musculus
gagaatcagagaccctgcagcggtg

SEQ ID NO: 929776 - DNA, 25 bp, Mus musculus
gagaatcagagagcctgcagcggtg

SEQ ID NO: 929777 - DNA, 25 bp, Mus musculus
gagaatccagatatttttgcagttt

SEQ ID NO: 929778 - DNA, 25 bp, Mus musculus
gagaatccagttatttttgcagttt

SEQ ID NO: 929779 - DNA, 25 bp, Mus musculus
gagaatcctgtgaacatattgacga

SEQ ID NO: 929780 - DNA, 25 bp, Mus musculus
gagaatcctgtgaagatattgacga

SEQ ID NO: 929781 - DNA, 25 bp, Mus musculus
gagaatgaagcccgcagagaaggaa

SEQ ID NO: 929782 - DNA, 25 bp, Mus musculus
gagaatgaaggccgcagagaaggaa

SEQ ID NO: 929783 - DNA, 25 bp, Mus musculus
gagaatgaccggcacggtgatgctg

SEQ ID NO: 929784 - DNA, 25 bp, Mus musculus
gagaatgaccggcagggtgatgctg

SEQ ID NO: 929785 - DNA, 25 bp, Mus musculus
gagaatgagaaacttcataaagaaa

SEQ ID NO: 929786 - DNA, 25 bp, Mus musculus
gagaatgagaaagttcataaagaaa

SEQ ID NO: 929787 - DNA, 25 bp, Mus musculus
gagaatgatccacctacatcaaaat

SEQ ID NO: 929788 - DNA, 25 bp, Mus musculus
gagaatgatccagctacatcaaaat

SEQ ID NO: 929789 - DNA, 25 bp, Mus musculus
gagaatgatgtgactaatggatggg

SEQ ID NO: 929790 - DNA, 25 bp, Mus musculus
gagaatgatgtgtctaatggatggg

SEQ ID NO: 929791 - DNA, 25 bp, Mus musculus
gagaatgccacactggccacagaga

SEQ ID NO: 929792 - DNA, 25 bp, Mus musculus
gagaatgccacagtggccacagaga

SEQ ID NO: 929793 - DNA, 25 bp, Mus musculus
gagaatgcgcagcctgaagcgcaag

SEQ ID NO: 929794 - DNA, 25 bp, Mus musculus
gagaatgcgcaggctgaagcgcaag

SEQ ID NO: 929795 - DNA, 25 bp, Mus musculus
gagaatggagcaagaagctttgcaa

SEQ ID NO: 929796 - DNA, 25 bp, Mus musculus
gagaatggaggaagaagctttgcaa

SEQ ID NO: 929797 - DNA, 25 bp, Mus musculus
gagaatgggatgaacgttggccttg

SEQ ID NO: 929798 - DNA, 25 bp, Mus musculus
gagaatgggatgaaggttggccttg

SEQ ID NO: 929799 - DNA, 25 bp, Mus musculus
gagaatgggcagatgttacaggtgg

SEQ ID NO: 929800 - DNA, 25 bp, Mus musculus
gagaatgggcagctggcactgatgg

SEQ ID NO: 929801 - DNA, 25 bp, Mus musculus
gagaatgggcaggtggcactgatgg

SEQ ID NO: 929802 - DNA, 25 bp, Mus musculus
gagaatgggcagttgttacaggtgg

SEQ ID NO: 929803 - DNA, 25 bp, Mus musculus
gagaatgggctacgcaaaagatgtg

SEQ ID NO: 929804 - DNA, 25 bp, Mus musculus
gagaatgggctactcacagttgcag

SEQ ID NO: 929805 - DNA, 25 bp, Mus musculus
gagaatgggctaggcaaaagatgtg

SEQ ID NO: 929806 - DNA, 25 bp, Mus musculus
gagaatgggctagtcacagttgcag

SEQ ID NO: 929807 - DNA, 25 bp, Mus musculus
gagaatgggggccacgtgatgtaca

SEQ ID NO: 929808 - DNA, 25 bp, Mus musculus
gagaatgggggccaggtgatgtaca

SEQ ID NO: 929809 - DNA, 25 bp, Mus musculus
gagaatggttatacaaatggaattg

SEQ ID NO: 929810 - DNA, 25 bp, Mus musculus
gagaatggttatacagccttaacat

SEQ ID NO: 929811 - DNA, 25 bp, Mus musculus
gagaatggttatactaatggaattg

SEQ ID NO: 929812 - DNA, 25 bp, Mus musculus
gagaatggttatactgccttaacat

SEQ ID NO: 929813 - DNA, 25 bp, Mus musculus
gagaatgtattcaacatgctggaga

SEQ ID NO: 929814 - DNA, 25 bp, Mus musculus
gagaatgtattcaacgtctgcgacg

SEQ ID NO: 929815 - DNA, 25 bp, Mus musculus
gagaatgtattcaagatgctggaga

SEQ ID NO: 929816 - DNA, 25 bp, Mus musculus
gagaatgtattcaaggtctgcgacg

SEQ ID NO: 929817 - DNA, 25 bp, Mus musculus
gagaatgtgaagaatagtcctgtcc

SEQ ID NO: 929818 - DNA, 25 bp, Mus musculus
gagaatgtgaagtatagtcctgtcc

SEQ ID NO: 929819 - DNA, 25 bp, Mus musculus
gagaatgtttggatattgatgagtg

SEQ ID NO: 929820 - DNA, 25 bp, Mus musculus
gagaatgtttggttattgatgagtg

SEQ ID NO: 929821 - DNA, 25 bp, Mus musculus
gagaattcaactctgtcacctaaag

SEQ ID NO: 929822 - DNA, 25 bp, Mus musculus
gagaattcaagtctgtcacctaaag

SEQ ID NO: 929823 - DNA, 25 bp, Mus musculus
gagaattcccaaatcgatgacaagt

SEQ ID NO: 929824 - DNA, 25 bp, Mus musculus
gagaattcccaaatggatgacaagt

SEQ ID NO: 929825 - DNA, 25 bp, Mus musculus
gagaattgagaaaatggagctggcg

SEQ ID NO: 929826 - DNA, 25 bp, Mus musculus
gagaattgagcgtttatcactccga

SEQ ID NO: 929827 - DNA, 25 bp, Mus musculus
gagaattgagggtttatcactccga

SEQ ID NO: 929828 - DNA, 25 bp, Mus musculus
gagaattgagtaaatggagctggcg

SEQ ID NO: 929829 - DNA, 25 bp, Mus musculus
gagaatttccaggcaggctcatggc

SEQ ID NO: 929830 - DNA, 25 bp, Mus musculus
gagaatttccaggctggctcatggc

SEQ ID NO: 929831 - DNA, 25 bp, Mus musculus
gagaattttcagagattccttcagt

SEQ ID NO: 929832 - DNA, 25 bp, Mus musculus
gagaattttcagtgattccttcagt

SEQ ID NO: 929833 - DNA, 25 bp, Mus musculus
gagacaacaatgcactatagagtta

SEQ ID NO: 929834 - DNA, 25 bp, Mus musculus
gagacaacaatggactatagagtta

SEQ ID NO: 929835 - DNA, 25 bp, Mus musculus
gagacaacagagataacactgcagg

SEQ ID NO: 929836 - DNA, 25 bp, Mus musculus
gagacaacagagttaacactgcagg

SEQ ID NO: 929837 - DNA, 25 bp, Mus musculus
gagacaaccgatccaactactagtg

SEQ ID NO: 929838 - DNA, 25 bp, Mus musculus
gagacaaccgttccaactactagtg

SEQ ID NO: 929839 - DNA, 25 bp, Mus musculus
gagacaacggaaagacgatgctcaa

SEQ ID NO: 929840 - DNA, 25 bp, Mus musculus
gagacaacggtaagacgatgctcaa

SEQ ID NO: 929841 - DNA, 25 bp, Mus musculus
gagacacattattacgtccaggacg

SEQ ID NO: 929842 - DNA, 25 bp, Mus musculus
gagacacattattaggtccaggacg

SEQ ID NO: 929843 - DNA, 25 bp, Mus musculus
gagacaccacatctgccctgtggga

SEQ ID NO: 929844 - DNA, 25 bp, Mus musculus
gagacaccacatgtgccctgtggga

SEQ ID NO: 929845 - DNA, 25 bp, Mus musculus
gagacaccctgagacaatgttggct

SEQ ID NO: 929846 - DNA, 25 bp, Mus musculus
gagacaccctgagagaatgttggct

SEQ ID NO: 929847 - DNA, 25 bp, Mus musculus
gagacacgacttctgctttgtggga

SEQ ID NO: 929848 - DNA, 25 bp, Mus musculus
gagacacgacttgtgctttgtggga

SEQ ID NO: 929849 - DNA, 25 bp, Mus musculus
gagacactgacctgctgttgctgca

SEQ ID NO: 929850 - DNA, 25 bp, Mus musculus
gagacactgacctgctgtttacagt

SEQ ID NO: 929851 - DNA, 25 bp, Mus musculus
gagacactgacctggtgttgctgca

SEQ ID NO: 929852 - DNA, 25 bp, Mus musculus
gagacactgacctggtgtttacagt

SEQ ID NO: 929853 - DNA, 25 bp, Mus musculus
gagacactggccagcgaatatggtg

SEQ ID NO: 929854 - DNA, 25 bp, Mus musculus
gagacactggccagggaatatggtg

SEQ ID NO: 929855 - DNA, 25 bp, Mus musculus
gagacactgtggatacttggccttg

SEQ ID NO: 929856 - DNA, 25 bp, Mus musculus
gagacactgtggttacttggccttg

SEQ ID NO: 929857 - DNA, 25 bp, Mus musculus
gagacagaagccaataaccccaaga

SEQ ID NO: 929858 - DNA, 25 bp, Mus musculus
gagacagaagctcatcagaacaagc

SEQ ID NO: 929859 - DNA, 25 bp, Mus musculus
gagacagaagctggtggagactcct

SEQ ID NO: 929860 - DNA, 25 bp, Mus musculus
gagacagaaggcaataaccccaaga

SEQ ID NO: 929861 - DNA, 25 bp, Mus musculus
gagacagaaggtcatcagaacaagc

SEQ ID NO: 929862 - DNA, 25 bp, Mus musculus
gagacagaaggtggtggagactcct

SEQ ID NO: 929863 - DNA, 25 bp, Mus musculus
gagacagcagcacatagccaccaag

SEQ ID NO: 929864 - DNA, 25 bp, Mus musculus
gagacagcagccacaccaagatgaa

SEQ ID NO: 929865 - DNA, 25 bp, Mus musculus
gagacagcagccttcccagtccacc

SEQ ID NO: 929866 - DNA, 25 bp, Mus musculus
gagacagcagcggactcggaactct

SEQ ID NO: 929867 - DNA, 25 bp, Mus musculus
gagacagcagcgtccaccaacagca

SEQ ID NO: 929868 - DNA, 25 bp, Mus musculus
gagacagcaggacatagccaccaag

SEQ ID NO: 929869 - DNA, 25 bp, Mus musculus
gagacagcaggcacaccaagatgaa

SEQ ID NO: 929870 - DNA, 25 bp, Mus musculus
gagacagcaggcttcccagtccacc

SEQ ID NO: 929871 - DNA, 25 bp, Mus musculus
gagacagcaggggactcggaactct

SEQ ID NO: 929872 - DNA, 25 bp, Mus musculus
gagacagcagggtccaccaacagca

SEQ ID NO: 929873 - DNA, 25 bp, Mus musculus
gagacaggcctcagtgtgaccgcca

SEQ ID NO: 929874 - DNA, 25 bp, Mus musculus
gagacaggcctctgtgtgaccgcca

SEQ ID NO: 929875 - DNA, 25 bp, Mus musculus
gagacaggcctgcaacggttccagg

SEQ ID NO: 929876 - DNA, 25 bp, Mus musculus
gagacaggcctggaacggttccagg

SEQ ID NO: 929877 - DNA, 25 bp, Mus musculus
gagacatcaaaacaggaattcctaa

SEQ ID NO: 929878 - DNA, 25 bp, Mus musculus
gagacatcaaaagaggaattcctaa

SEQ ID NO: 929879 - DNA, 25 bp, Mus musculus
gagacatctccgtgcgcaatgtgct

SEQ ID NO: 929880 - DNA, 25 bp, Mus musculus
gagacatctccgtgggcaatgtgct

SEQ ID NO: 929881 - DNA, 25 bp, Mus musculus
gagacatgagactaaggttgtgggt

SEQ ID NO: 929882 - DNA, 25 bp, Mus musculus
gagacatgagcaactcagccacctt

SEQ ID NO: 929883 - DNA, 25 bp, Mus musculus
gagacatgagcagctactccatccg

SEQ ID NO: 929884 - DNA, 25 bp, Mus musculus
gagacatgagcgctcatccgctctc

SEQ ID NO: 929885 - DNA, 25 bp, Mus musculus
gagacatgaggaactcagccacctt

SEQ ID NO: 929886 - DNA, 25 bp, Mus musculus
gagacatgaggagctactccatccg

SEQ ID NO: 929887 - DNA, 25 bp, Mus musculus
gagacatgagggctcatccgctctc

SEQ ID NO: 929888 - DNA, 25 bp, Mus musculus
gagacatgagtctaaggttgtgggt

SEQ ID NO: 929889 - DNA, 25 bp, Mus musculus
gagacatgcaagtctgtcacctgtc

SEQ ID NO: 929890 - DNA, 25 bp, Mus musculus
gagacatgcatgtctgtcacctgtc

SEQ ID NO: 929891 - DNA, 25 bp, Mus musculus
gagacattgctacacctgcacagag

SEQ ID NO: 929892 - DNA, 25 bp, Mus musculus
gagacattgctacagctgcacagag

SEQ ID NO: 929893 - DNA, 25 bp, Mus musculus
gagaccaagacccacatctggcaag

SEQ ID NO: 929894 - DNA, 25 bp, Mus musculus
gagaccaagacccagatctggcaag

SEQ ID NO: 929895 - DNA, 25 bp, Mus musculus
gagaccaaggaacacatcctgaagc

SEQ ID NO: 929896 - DNA, 25 bp, Mus musculus
gagaccaaggaacagatcctgaagc

SEQ ID NO: 929897 - DNA, 25 bp, Mus musculus
gagaccagcagtcgcatcttctgct

SEQ ID NO: 929898 - DNA, 25 bp, Mus musculus
gagaccagcagtggcatcttctgct

SEQ ID NO: 929899 - DNA, 25 bp, Mus musculus
gagaccattaagcatctaatgcgtc

SEQ ID NO: 929900 - DNA, 25 bp, Mus musculus
gagaccattaaggatctaatgcgtc

SEQ ID NO: 929901 - DNA, 25 bp, Mus musculus
gagacccacaccacgactactgtga

SEQ ID NO: 929902 - DNA, 25 bp, Mus musculus
gagacccacacctcgactactgtga

SEQ ID NO: 929903 - DNA, 25 bp, Mus musculus
gagacccacatgcaatggacctgtc

SEQ ID NO: 929904 - DNA, 25 bp, Mus musculus
gagacccacatggaatggacctgtc

SEQ ID NO: 929905 - DNA, 25 bp, Mus musculus
gagacccagctgcacgaagctgagc

SEQ ID NO: 929906 - DNA, 25 bp, Mus musculus
gagacccagctgcaggaagctgagc

SEQ ID NO: 929907 - DNA, 25 bp, Mus musculus
gagacccatcagaactcctaggtac

SEQ ID NO: 929908 - DNA, 25 bp, Mus musculus
gagacccatcagaagtcctaggtac

SEQ ID NO: 929909 - DNA, 25 bp, Mus musculus
gagaccccttctcacaatacagccc

SEQ ID NO: 929910 - DNA, 25 bp, Mus musculus
gagaccccttctcagaatacagccc

SEQ ID NO: 929911 - DNA, 25 bp, Mus musculus
gagacccgagccccaggagacaagt

SEQ ID NO: 929912 - DNA, 25 bp, Mus musculus
gagacccgaggcccaggagacaagt

SEQ ID NO: 929913 - DNA, 25 bp, Mus musculus
gagaccctgagctgcccaaaaggcc

SEQ ID NO: 929914 - DNA, 25 bp, Mus musculus
gagaccctgagctgcctctctgaca

SEQ ID NO: 929915 - DNA, 25 bp, Mus musculus
gagaccctgagctggccaaaaggcc

SEQ ID NO: 929916 - DNA, 25 bp, Mus musculus
gagaccctgagctggctctctgaca

SEQ ID NO: 929917 - DNA, 25 bp, Mus musculus
gagaccgccgccaacgctgaagctg

SEQ ID NO: 929918 - DNA, 25 bp, Mus musculus
gagaccgccgccaaggctgaagctg

SEQ ID NO: 929919 - DNA, 25 bp, Mus musculus
gagaccgcggcacgatgggtccctc

SEQ ID NO: 929920 - DNA, 25 bp, Mus musculus
gagaccgcggcaggatgggtccctc

SEQ ID NO: 929921 - DNA, 25 bp, Mus musculus
gagaccgctgcacatacgaacacag

SEQ ID NO: 929922 - DNA, 25 bp, Mus musculus
gagaccgctgcagatacgaacacag

SEQ ID NO: 929923 - DNA, 25 bp, Mus musculus
gagaccgcttcgcgaatgaaggctt

SEQ ID NO: 929924 - DNA, 25 bp, Mus musculus
gagaccgcttcgggaatgaaggctt

SEQ ID NO: 929925 - DNA, 25 bp, Mus musculus
gagaccggatccgacgtgccgccgc

SEQ ID NO: 929926 - DNA, 25 bp, Mus musculus
gagaccggatccgaggtgccgccgc

SEQ ID NO: 929927 - DNA, 25 bp, Mus musculus
gagaccgttgtagactgtgtaatgc

SEQ ID NO: 929928 - DNA, 25 bp, Mus musculus
gagaccgttgtagagtgtgtaatgc

SEQ ID NO: 929929 - DNA, 25 bp, Mus musculus
gagacctaccagccaatccagtctc

SEQ ID NO: 929930 - DNA, 25 bp, Mus musculus
gagacctaccagcctatccagtctc

SEQ ID NO: 929931 - DNA, 25 bp, Mus musculus
gagacctcccctcgaagagccagca

SEQ ID NO: 929932 - DNA, 25 bp, Mus musculus
gagacctcccctggaagagccagca

SEQ ID NO: 929933 - DNA, 25 bp, Mus musculus
gagacctcttaggcctctctgttct

SEQ ID NO: 929934 - DNA, 25 bp, Mus musculus
gagacctctttggcctctctgttct

SEQ ID NO: 929935 - DNA, 25 bp, Mus musculus
gagacgaaacagcttggattctgaa

SEQ ID NO: 929936 - DNA, 25 bp, Mus musculus
gagacgaaactgcttggattctgaa

SEQ ID NO: 929937 - DNA, 25 bp, Mus musculus
gagacgacaccaagcagtcagtccg

SEQ ID NO: 929938 - DNA, 25 bp, Mus musculus
gagacgacaccaaggagtcagtccg

SEQ ID NO: 929939 - DNA, 25 bp, Mus musculus
gagacgagtgagctggtggatgtgg

SEQ ID NO: 929940 - DNA, 25 bp, Mus musculus
gagacgagtgaggtggtggatgtgg

SEQ ID NO: 929941 - DNA, 25 bp, Mus musculus
gagacgcatcaccacgtggtacaga

SEQ ID NO: 929942 - DNA, 25 bp, Mus musculus
gagacgcatcaccaggtggtacaga

SEQ ID NO: 929943 - DNA, 25 bp, Mus musculus
gagacgccagatctacctccagtgt

SEQ ID NO: 929944 - DNA, 25 bp, Mus musculus
gagacgccagttctacctccagtgt

SEQ ID NO: 929945 - DNA, 25 bp, Mus musculus
gagacgctgaagaggtcctgggccc

SEQ ID NO: 929946 - DNA, 25 bp, Mus musculus
gagacgctgaagtggtcctgggccc

SEQ ID NO: 929947 - DNA, 25 bp, Mus musculus
gagacggaaaaccacagtccagcct

SEQ ID NO: 929948 - DNA, 25 bp, Mus musculus
gagacggaaaaccagagtccagcct

SEQ ID NO: 929949 - DNA, 25 bp, Mus musculus
gagacggaaaagagtcattggtctc

SEQ ID NO: 929950 - DNA, 25 bp, Mus musculus
gagacggaaaagtgtcattggtctc

SEQ ID NO: 929951 - DNA, 25 bp, Mus musculus
gagacggtcaataacgctgtggctc

SEQ ID NO: 929952 - DNA, 25 bp, Mus musculus
gagacggtcaataaggctgtggctc

SEQ ID NO: 929953 - DNA, 25 bp, Mus musculus
gagacggttctacatccctttcagc

SEQ ID NO: 929954 - DNA, 25 bp, Mus musculus
gagacggttctagatccctttcagc

SEQ ID NO: 929955 - DNA, 25 bp, Mus musculus
gagacgtacaagattttttatgctg

SEQ ID NO: 929956 - DNA, 25 bp, Mus musculus
gagacgtacaagtttttttatgctg

SEQ ID NO: 929957 - DNA, 25 bp, Mus musculus
gagacgtcgcaacctcatcaaacag

SEQ ID NO: 929958 - DNA, 25 bp, Mus musculus
gagacgtcgcaagctcatcaaacag

SEQ ID NO: 929959 - DNA, 25 bp, Mus musculus
gagacgtggcgctgaatactccatg

SEQ ID NO: 929960 - DNA, 25 bp, Mus musculus
gagacgtggcgctgtatactccatg

SEQ ID NO: 929961 - DNA, 25 bp, Mus musculus
gagacgttctctgacgcgcagtaac

SEQ ID NO: 929962 - DNA, 25 bp, Mus musculus
gagacgttctctgaggcgcagtaac

SEQ ID NO: 929963 - DNA, 25 bp, Mus musculus
gagacgttcttccacaagatggaca

SEQ ID NO: 929964 - DNA, 25 bp, Mus musculus
gagacgttcttccagaagatggaca

SEQ ID NO: 929965 - DNA, 25 bp, Mus musculus
gagactacgtggcacgtggatcaga

SEQ ID NO: 929966 - DNA, 25 bp, Mus musculus
gagactacgtggcaggtggatcaga

SEQ ID NO: 929967 - DNA, 25 bp, Mus musculus
gagactagcaatcacaacccaagag

SEQ ID NO: 929968 - DNA, 25 bp, Mus musculus
gagactagcaatcagaacccaagag

SEQ ID NO: 929969 - DNA, 25 bp, Mus musculus
gagactattgaaattaatcccaagc

SEQ ID NO: 929970 - DNA, 25 bp, Mus musculus
gagactattgaatttaatcccaagc

SEQ ID NO: 929971 - DNA, 25 bp, Mus musculus
gagactcaagctcactggagacctg

SEQ ID NO: 929972 - DNA, 25 bp, Mus musculus
gagactcaaggtcactggagacctg

SEQ ID NO: 929973 - DNA, 25 bp, Mus musculus
gagactcagcagctgatgaggaatt

SEQ ID NO: 929974 - DNA, 25 bp, Mus musculus
gagactcagcaggtgatgaggaatt

SEQ ID NO: 929975 - DNA, 25 bp, Mus musculus
gagactccagaccatggtttttgga

SEQ ID NO: 929976 - DNA, 25 bp, Mus musculus
gagactccagaccgtttttggaata

SEQ ID NO: 929977 - DNA, 25 bp, Mus musculus
gagactccagacgatggtttttgga

SEQ ID NO: 929978 - DNA, 25 bp, Mus musculus
gagactccagacggtttttggaata

SEQ ID NO: 929979 - DNA, 25 bp, Mus musculus
gagactccagatgaggacgatgtgc

SEQ ID NO: 929980 - DNA, 25 bp, Mus musculus
gagactccagcccacaatggagaat

SEQ ID NO: 929981 - DNA, 25 bp, Mus musculus
gagactccagctgctgaagtccacg

SEQ ID NO: 929982 - DNA, 25 bp, Mus musculus
gagactccaggccacaatggagaat

SEQ ID NO: 929983 - DNA, 25 bp, Mus musculus
gagactccaggtgctgaagtccacg

SEQ ID NO: 929984 - DNA, 25 bp, Mus musculus
gagactccagttgaggacgatgtgc

SEQ ID NO: 929985 - DNA, 25 bp, Mus musculus
gagactcctgaattgcatgaaagct

SEQ ID NO: 929986 - DNA, 25 bp, Mus musculus
gagactcctgggatcctcatcagaa

SEQ ID NO: 929987 - DNA, 25 bp, Mus musculus
gagactcctgggatgctcatcagaa

SEQ ID NO: 929988 - DNA, 25 bp, Mus musculus
gagactcctgtattgcatgaaagct

SEQ ID NO: 929989 - DNA, 25 bp, Mus musculus
gagactctgaagtgcatggtgctct

SEQ ID NO: 929990 - DNA, 25 bp, Mus musculus
gagactctgaagtggatggtgctct

SEQ ID NO: 929991 - DNA, 25 bp, Mus musculus
gagactcttcccaacctaaagccca

SEQ ID NO: 929992 - DNA, 25 bp, Mus musculus
gagactcttcccaagctaaagccca

SEQ ID NO: 929993 - DNA, 25 bp, Mus musculus
gagactgagaacctcccctgcagtt

SEQ ID NO: 929994 - DNA, 25 bp, Mus musculus
gagactgagaacctgccctgcagtt

SEQ ID NO: 929995 - DNA, 25 bp, Mus musculus
gagactgcattgacatagatgaatg

SEQ ID NO: 929996 - DNA, 25 bp, Mus musculus
gagactgcattgtcatagatgaatg

SEQ ID NO: 929997 - DNA, 25 bp, Mus musculus
gagactgccaagactcactctgtgg

SEQ ID NO: 929998 - DNA, 25 bp, Mus musculus
gagactgccaagcaggccgagttag

SEQ ID NO: 929999 - DNA, 25 bp, Mus musculus
gagactgccaaggaggccgagttag

SEQ ID NO: 930000 - DNA, 25 bp, Mus musculus
gagactgccaagtctcactctgtgg

SEQ ID NO: 930001 - DNA, 25 bp, Mus musculus
gagactgctgactcgataccaggaa

SEQ ID NO: 930002 - DNA, 25 bp, Mus musculus
gagactgctgtctcgataccaggaa

SEQ ID NO: 930003 - DNA, 25 bp, Mus musculus
gagactggacagaacgattccggga

SEQ ID NO: 930004 - DNA, 25 bp, Mus musculus
gagactggacagtacgattccggga

SEQ ID NO: 930005 - DNA, 25 bp, Mus musculus
gagactggacggcacgccatgttgg

SEQ ID NO: 930006 - DNA, 25 bp, Mus musculus
gagactggacggcaggccatgttgg

SEQ ID NO: 930007 - DNA, 25 bp, Mus musculus
gagactggatggggcgtgtgccagc

SEQ ID NO: 930008 - DNA, 25 bp, Mus musculus
gagactggatggggggtgtgccagc

SEQ ID NO: 930009 - DNA, 25 bp, Mus musculus
gagactggggaacacatccagagct

SEQ ID NO: 930010 - DNA, 25 bp, Mus musculus
gagactggggaacagatccagagct

SEQ ID NO: 930011 - DNA, 25 bp, Mus musculus
gagactggtggacgaagaaatagta

SEQ ID NO: 930012 - DNA, 25 bp, Mus musculus
gagactggtggaggaagaaatagta

SEQ ID NO: 930013 - DNA, 25 bp, Mus musculus
gagactgttctgcaacctgatgttg

SEQ ID NO: 930014 - DNA, 25 bp, Mus musculus
gagactgttctggaacctgatgttg

SEQ ID NO: 930015 - DNA, 25 bp, Mus musculus
gagacttgacaatacctctggtgca

SEQ ID NO: 930016 - DNA, 25 bp, Mus musculus
gagacttgacaatagctctggtgca

SEQ ID NO: 930017 - DNA, 25 bp, Mus musculus
gagacttgcaaaaggtgctggatca

SEQ ID NO: 930018 - DNA, 25 bp, Mus musculus
gagacttgcataaggtgctggatca

SEQ ID NO: 930019 - DNA, 25 bp, Mus musculus
gagacttgccagcgaaaatcatagt

SEQ ID NO: 930020 - DNA, 25 bp, Mus musculus
gagacttgccagggaaaatcatagt

SEQ ID NO: 930021 - DNA, 25 bp, Mus musculus
gagactttgtggccctgctgtccct

SEQ ID NO: 930022 - DNA, 25 bp, Mus musculus
gagactttgtggctgagttcctgtt

SEQ ID NO: 930023 - DNA, 25 bp, Mus musculus
gagactttgtgggcctgctgtccct

SEQ ID NO: 930024 - DNA, 25 bp, Mus musculus
gagactttgtgggtgagttcctgtt

SEQ ID NO: 930025 - DNA, 25 bp, Mus musculus
gagagaaaaacaagcccgtgcctct

SEQ ID NO: 930026 - DNA, 25 bp, Mus musculus
gagagaaaaagaagcccgtgcctct

SEQ ID NO: 930027 - DNA, 25 bp, Mus musculus
gagagaaaagcaggttggaaatctg

SEQ ID NO: 930028 - DNA, 25 bp, Mus musculus
gagagaaaagcgagctgtgattggt

SEQ ID NO: 930029 - DNA, 25 bp, Mus musculus
gagagaaaaggaggttggaaatctg

SEQ ID NO: 930030 - DNA, 25 bp, Mus musculus
gagagaaaagggagctgtgattggt

SEQ ID NO: 930031 - DNA, 25 bp, Mus musculus
gagagaagaaggcgctagtcccctg

SEQ ID NO: 930032 - DNA, 25 bp, Mus musculus
gagagaagaaggcggtagtcccctg

SEQ ID NO: 930033 - DNA, 25 bp, Mus musculus
gagagaatatcacctgcaagaaaaa

SEQ ID NO: 930034 - DNA, 25 bp, Mus musculus
gagagaatatcagctgcaagaaaaa

SEQ ID NO: 930035 - DNA, 25 bp, Mus musculus
gagagacaagacaggccagctgctg

SEQ ID NO: 930036 - DNA, 25 bp, Mus musculus
gagagacaagtcaggccagctgctg

SEQ ID NO: 930037 - DNA, 25 bp, Mus musculus
gagagacagaagccaataaccccaa

SEQ ID NO: 930038 - DNA, 25 bp, Mus musculus
gagagacagaaggcaataaccccaa

SEQ ID NO: 930039 - DNA, 25 bp, Mus musculus
gagagacagcagccttcccagtcca

SEQ ID NO: 930040 - DNA, 25 bp, Mus musculus
gagagacagcagcgtccaccaacag

SEQ ID NO: 930041 - DNA, 25 bp, Mus musculus
gagagacagcaggcttcccagtcca

SEQ ID NO: 930042 - DNA, 25 bp, Mus musculus
gagagacagcagggtccaccaacag

SEQ ID NO: 930043 - DNA, 25 bp, Mus musculus
gagagacatgcacgagatgctgcag

SEQ ID NO: 930044 - DNA, 25 bp, Mus musculus
gagagacatgcaggagatgctgcag

SEQ ID NO: 930045 - DNA, 25 bp, Mus musculus
gagagaccagaacattcgtaagaca

SEQ ID NO: 930046 - DNA, 25 bp, Mus musculus
gagagaccagaagattcgtaagaca

SEQ ID NO: 930047 - DNA, 25 bp, Mus musculus
gagagaccagcataagaaacgcaga

SEQ ID NO: 930048 - DNA, 25 bp, Mus musculus
gagagaccaggataagaaacgcaga

SEQ ID NO: 930049 - DNA, 25 bp, Mus musculus
gagagactgctgactcgataccagg

SEQ ID NO: 930050 - DNA, 25 bp, Mus musculus
gagagactgctgtctcgataccagg

SEQ ID NO: 930051 - DNA, 25 bp, Mus musculus
gagagagaaaaacaagcccgtgcct

SEQ ID NO: 930052 - DNA, 25 bp, Mus musculus
gagagagaaaaagaagcccgtgcct

SEQ ID NO: 930053 - DNA, 25 bp, Mus musculus
gagagagaagaaattttccaccaag

SEQ ID NO: 930054 - DNA, 25 bp, Mus musculus
gagagagaagtaattttccaccaag

SEQ ID NO: 930055 - DNA, 25 bp, Mus musculus
gagagagacatgcacgagatgctgc

SEQ ID NO: 930056 - DNA, 25 bp, Mus musculus
gagagagacatgcaggagatgctgc

SEQ ID NO: 930057 - DNA, 25 bp, Mus musculus
gagagagaccagcataagaaacgca

SEQ ID NO: 930058 - DNA, 25 bp, Mus musculus
gagagagaccaggataagaaacgca

SEQ ID NO: 930059 - DNA, 25 bp, Mus musculus
gagagagagagacaacaggcagttt

SEQ ID NO: 930060 - DNA, 25 bp, Mus musculus
gagagagagagagaacaggcagttt

SEQ ID NO: 930061 - DNA, 25 bp, Mus musculus
gagagagagagagacaacaggcagt

SEQ ID NO: 930062 - DNA, 25 bp, Mus musculus
gagagagagagagagaacaggcagt

SEQ ID NO: 930063 - DNA, 25 bp, Mus musculus
gagagagaggcgtggaagatgtcta

SEQ ID NO: 930064 - DNA, 25 bp, Mus musculus
gagagagaggggtggaagatgtcta

SEQ ID NO: 930065 - DNA, 25 bp, Mus musculus
gagagagcaatgaacgatgtgccac

SEQ ID NO: 930066 - DNA, 25 bp, Mus musculus
gagagagcaatgaaggatgtgccac

SEQ ID NO: 930067 - DNA, 25 bp, Mus musculus
gagagagccgaagccgaaagcggta

SEQ ID NO: 930068 - DNA, 25 bp, Mus musculus
gagagagccgaatattaattaaccc

SEQ ID NO: 930069 - DNA, 25 bp, Mus musculus
gagagagccgtagccgaaagcggta

SEQ ID NO: 930070 - DNA, 25 bp, Mus musculus
gagagagccgtatattaattaaccc

SEQ ID NO: 930071 - DNA, 25 bp, Mus musculus
gagagagccgtcaaccagaagaaga

SEQ ID NO: 930072 - DNA, 25 bp, Mus musculus
gagagagccgtcaagcagaagaaga

SEQ ID NO: 930073 - DNA, 25 bp, Mus musculus
gagagagctgcaagcaggggtagag

SEQ ID NO: 930074 - DNA, 25 bp, Mus musculus
gagagagctgcatgcaggggtagag

SEQ ID NO: 930075 - DNA, 25 bp, Mus musculus
gagagaggaaaacgcatttatatgt

SEQ ID NO: 930076 - DNA, 25 bp, Mus musculus
gagagaggaaaaggcatttatatgt

SEQ ID NO: 930077 - DNA, 25 bp, Mus musculus
gagagaggaagtacgtcctactccc

SEQ ID NO: 930078 - DNA, 25 bp, Mus musculus
gagagaggaagttcgtcctactccc

SEQ ID NO: 930079 - DNA, 25 bp, Mus musculus
gagagaggagagcacggacgaccag

SEQ ID NO: 930080 - DNA, 25 bp, Mus musculus
gagagaggagagcagggacgaccag

SEQ ID NO: 930081 - DNA, 25 bp, Mus musculus
gagagaggagataacggagaagctg

SEQ ID NO: 930082 - DNA, 25 bp, Mus musculus
gagagaggagataagggagaagctg

SEQ ID NO: 930083 - DNA, 25 bp, Mus musculus
gagagagggaagagcaaatgtgtca

SEQ ID NO: 930084 - DNA, 25 bp, Mus musculus
gagagagggaagtgcaaatgtgtca

SEQ ID NO: 930085 - DNA, 25 bp, Mus musculus
gagagagtcccgaacgggacagctt

SEQ ID NO: 930086 - DNA, 25 bp, Mus musculus
gagagagtcccgaaggggacagctt

SEQ ID NO: 930087 - DNA, 25 bp, Mus musculus
gagagagtggcagacggataccaca

SEQ ID NO: 930088 - DNA, 25 bp, Mus musculus
gagagagtggcagagggataccaca

SEQ ID NO: 930089 - DNA, 25 bp, Mus musculus
gagagagttagtgacgacatgtgca

SEQ ID NO: 930090 - DNA, 25 bp, Mus musculus
gagagagttagtgaggacatgtgca

SEQ ID NO: 930091 - DNA, 25 bp, Mus musculus
gagagataagccacctccaagtgga

SEQ ID NO: 930092 - DNA, 25 bp, Mus musculus
gagagataaggcacctccaagtgga

SEQ ID NO: 930093 - DNA, 25 bp, Mus musculus
gagagatcaccaaacatgcattttt

SEQ ID NO: 930094 - DNA, 25 bp, Mus musculus
gagagatcaccaaagatgcattttt

SEQ ID NO: 930095 - DNA, 25 bp, Mus musculus
gagagatcagatgagacccaggagg

SEQ ID NO: 930096 - DNA, 25 bp, Mus musculus
gagagatcagttgagacccaggagg

SEQ ID NO: 930097 - DNA, 25 bp, Mus musculus
gagagatcccagcatatcaatgagt

SEQ ID NO: 930098 - DNA, 25 bp, Mus musculus
gagagatcccaggatatcaatgagt

SEQ ID NO: 930099 - DNA, 25 bp, Mus musculus
gagagatcctcaagttcaaagagcg

SEQ ID NO: 930100 - DNA, 25 bp, Mus musculus
gagagatcctcatgttcaaagagcg

SEQ ID NO: 930101 - DNA, 25 bp, Mus musculus
gagagatctgaagcagataaagaaa

SEQ ID NO: 930102 - DNA, 25 bp, Mus musculus
gagagatctgtagcagataaagaaa

SEQ ID NO: 930103 - DNA, 25 bp, Mus musculus
gagagatgaaggatgatgaggaatt

SEQ ID NO: 930104 - DNA, 25 bp, Mus musculus
gagagatgaaggcgcagcagaaaac

SEQ ID NO: 930105 - DNA, 25 bp, Mus musculus
gagagatgaaggggcagcagaaaac

SEQ ID NO: 930106 - DNA, 25 bp, Mus musculus
gagagatgaaggttgatgaggaatt

SEQ ID NO: 930107 - DNA, 25 bp, Mus musculus
gagagatgaatgcgaagtatgtggg

SEQ ID NO: 930108 - DNA, 25 bp, Mus musculus
gagagatgaatgggaagtatgtggg

SEQ ID NO: 930109 - DNA, 25 bp, Mus musculus
gagagatgagcaagttctatagtcc

SEQ ID NO: 930110 - DNA, 25 bp, Mus musculus
gagagatgagcatgttctatagtcc

SEQ ID NO: 930111 - DNA, 25 bp, Mus musculus
gagagatgataacgagagaccccct

SEQ ID NO: 930112 - DNA, 25 bp, Mus musculus
gagagatgataacgtccagagttca

SEQ ID NO: 930113 - DNA, 25 bp, Mus musculus
gagagatgataaggagagaccccct

SEQ ID NO: 930114 - DNA, 25 bp, Mus musculus
gagagatgataaggtccagagttca

SEQ ID NO: 930115 - DNA, 25 bp, Mus musculus
gagagatgcaagctgataggagcat

SEQ ID NO: 930116 - DNA, 25 bp, Mus musculus
gagagatgcaaggtgataggagcat

SEQ ID NO: 930117 - DNA, 25 bp, Mus musculus
gagagattaacccacctccgtacac

SEQ ID NO: 930118 - DNA, 25 bp, Mus musculus
gagagattaacccagctccgtacac

SEQ ID NO: 930119 - DNA, 25 bp, Mus musculus
gagagattagaacaaaaccacgagc

SEQ ID NO: 930120 - DNA, 25 bp, Mus musculus
gagagattagaagaaaaccacgagc

SEQ ID NO: 930121 - DNA, 25 bp, Mus musculus
gagagcaaaaagaatcgggttgaga

SEQ ID NO: 930122 - DNA, 25 bp, Mus musculus
gagagcaaaaagactcagtttgaag

SEQ ID NO: 930123 - DNA, 25 bp, Mus musculus
gagagcaaaaagattcgtgaacaga

SEQ ID NO: 930124 - DNA, 25 bp, Mus musculus
gagagcaaaaagtatcgggttgaga

SEQ ID NO: 930125 - DNA, 25 bp, Mus musculus
gagagcaaaaagtctcagtttgaag

SEQ ID NO: 930126 - DNA, 25 bp, Mus musculus
gagagcaaaaagtttcgtgaacaga

SEQ ID NO: 930127 - DNA, 25 bp, Mus musculus
gagagcaaagctgtcattctgtgct

SEQ ID NO: 930128 - DNA, 25 bp, Mus musculus
gagagcaaaggtgtcattctgtgct

SEQ ID NO: 930129 - DNA, 25 bp, Mus musculus
gagagcaagaggatattatcaggag

SEQ ID NO: 930130 - DNA, 25 bp, Mus musculus
gagagcaagaggctttgttccttac

SEQ ID NO: 930131 - DNA, 25 bp, Mus musculus
gagagcaagagggtttgttccttac

SEQ ID NO: 930132 - DNA, 25 bp, Mus musculus
gagagcaagaggttattatcaggag

SEQ ID NO: 930133 - DNA, 25 bp, Mus musculus
gagagcaagcacgtcgttgaagact

SEQ ID NO: 930134 - DNA, 25 bp, Mus musculus
gagagcaagcacgtggttgaagact

SEQ ID NO: 930135 - DNA, 25 bp, Mus musculus
gagagcaaggacgaagaggatgacg

SEQ ID NO: 930136 - DNA, 25 bp, Mus musculus
gagagcaaggtcgaagaggatgacg

SEQ ID NO: 930137 - DNA, 25 bp, Mus musculus
gagagcaatgaacgatgtgccacgg

SEQ ID NO: 930138 - DNA, 25 bp, Mus musculus
gagagcaatgaaggatgtgccacgg

SEQ ID NO: 930139 - DNA, 25 bp, Mus musculus
gagagcaatgagagggaagtggtgg

SEQ ID NO: 930140 - DNA, 25 bp, Mus musculus
gagagcaatgagtgggaagtggtgg

SEQ ID NO: 930141 - DNA, 25 bp, Mus musculus
gagagcacagcattaagttgtcatc

SEQ ID NO: 930142 - DNA, 25 bp, Mus musculus
gagagcacaggattaagttgtcatc

SEQ ID NO: 930143 - DNA, 25 bp, Mus musculus
gagagcacgcgaggagcatgtcatg

SEQ ID NO: 930144 - DNA, 25 bp, Mus musculus
gagagcacgcgaggtgcatgtcatg

SEQ ID NO: 930145 - DNA, 25 bp, Mus musculus
gagagcacggggaacgtgatctact

SEQ ID NO: 930146 - DNA, 25 bp, Mus musculus
gagagcacggggaaggtgatctact

SEQ ID NO: 930147 - DNA, 25 bp, Mus musculus
gagagcagagcgatggaaagacgtc

SEQ ID NO: 930148 - DNA, 25 bp, Mus musculus
gagagcagagcgttggaaagacgtc

SEQ ID NO: 930149 - DNA, 25 bp, Mus musculus
gagagcagttagccgtgaatcaagt

SEQ ID NO: 930150 - DNA, 25 bp, Mus musculus
gagagcagttaggcgtgaatcaagt

SEQ ID NO: 930151 - DNA, 25 bp, Mus musculus
gagagcatcgagcgcctgtaccaca

SEQ ID NO: 930152 - DNA, 25 bp, Mus musculus
gagagcatcgagggcctgtaccaca

SEQ ID NO: 930153 - DNA, 25 bp, Mus musculus
gagagcatgaagactccgtggtttc

SEQ ID NO: 930154 - DNA, 25 bp, Mus musculus
gagagcatgaagagggccaatccga

SEQ ID NO: 930155 - DNA, 25 bp, Mus musculus
gagagcatgaagcgcgttttttcta

SEQ ID NO: 930156 - DNA, 25 bp, Mus musculus
gagagcatgaagggcgttttttcta

SEQ ID NO: 930157 - DNA, 25 bp, Mus musculus
gagagcatgaagtctccgtggtttc

SEQ ID NO: 930158 - DNA, 25 bp, Mus musculus
gagagcatgaagtgggccaatccga

SEQ ID NO: 930159 - DNA, 25 bp, Mus musculus
gagagccaacaacccagagcagaac

SEQ ID NO: 930160 - DNA, 25 bp, Mus musculus
gagagccaacaagccagagcagaac

SEQ ID NO: 930161 - DNA, 25 bp, Mus musculus
gagagccaacagatgaagaaacaac

SEQ ID NO: 930162 - DNA, 25 bp, Mus musculus
gagagccaacagttgaagaaacaac

SEQ ID NO: 930163 - DNA, 25 bp, Mus musculus
gagagccaagatccatcgtcaatgt

SEQ ID NO: 930164 - DNA, 25 bp, Mus musculus
gagagccaagttccatcgtcaatgt

SEQ ID NO: 930165 - DNA, 25 bp, Mus musculus
gagagccagcctcgcgacccagtgg

SEQ ID NO: 930166 - DNA, 25 bp, Mus musculus
gagagccagcctggcgacccagtgg

SEQ ID NO: 930167 - DNA, 25 bp, Mus musculus
gagagccagctgcgtggccttggga

SEQ ID NO: 930168 - DNA, 25 bp, Mus musculus
gagagccagctgggtggccttggga

SEQ ID NO: 930169 - DNA, 25 bp, Mus musculus
gagagccaggcgcagcacgccccag

SEQ ID NO: 930170 - DNA, 25 bp, Mus musculus
gagagccaggcggagcacgccccag

SEQ ID NO: 930171 - DNA, 25 bp, Mus musculus
gagagcccctggcacgtgacggctt

SEQ ID NO: 930172 - DNA, 25 bp, Mus musculus
gagagcccctggcaggtgacggctt

SEQ ID NO: 930173 - DNA, 25 bp, Mus musculus
gagagccggattcacgaggtggatg

SEQ ID NO: 930174 - DNA, 25 bp, Mus musculus
gagagccggattcaggaggtggatg

SEQ ID NO: 930175 - DNA, 25 bp, Mus musculus
gagagccgtcaaccagaagaagatc

SEQ ID NO: 930176 - DNA, 25 bp, Mus musculus
gagagccgtcaagcagaagaagatc

SEQ ID NO: 930177 - DNA, 25 bp, Mus musculus
gagagccttcgagacgtgctgagct

SEQ ID NO: 930178 - DNA, 25 bp, Mus musculus
gagagccttcgagaggtgctgagct

SEQ ID NO: 930179 - DNA, 25 bp, Mus musculus
gagagcgaagaggcggaagaagaga

SEQ ID NO: 930180 - DNA, 25 bp, Mus musculus
gagagcgaagtggcggaagaagaga

SEQ ID NO: 930181 - DNA, 25 bp, Mus musculus
gagagcgatgctcgtgggaaggcgg

SEQ ID NO: 930182 - DNA, 25 bp, Mus musculus
gagagcgatgctggtgggaaggcgg

SEQ ID NO: 930183 - DNA, 25 bp, Mus musculus
gagagcgcacagattccagagtatg

SEQ ID NO: 930184 - DNA, 25 bp, Mus musculus
gagagcgcacagtttccagagtatg

SEQ ID NO: 930185 - DNA, 25 bp, Mus musculus
gagagcgcatcacctgcagttaaag

SEQ ID NO: 930186 - DNA, 25 bp, Mus musculus
gagagcgcatcagctgcagttaaag

SEQ ID NO: 930187 - DNA, 25 bp, Mus musculus
gagagcgccagacgcatgcccagag

SEQ ID NO: 930188 - DNA, 25 bp, Mus musculus
gagagcgccagaggcatgcccagag

SEQ ID NO: 930189 - DNA, 25 bp, Mus musculus
gagagcgctcagctgcagagatcgg

SEQ ID NO: 930190 - DNA, 25 bp, Mus musculus
gagagcgctcaggtgcagagatcgg

SEQ ID NO: 930191 - DNA, 25 bp, Mus musculus
gagagcggagctctccggccaaaca

SEQ ID NO: 930192 - DNA, 25 bp, Mus musculus
gagagcggaggtctccggccaaaca

SEQ ID NO: 930193 - DNA, 25 bp, Mus musculus
gagagcgttcagagtgcagagaaca

SEQ ID NO: 930194 - DNA, 25 bp, Mus musculus
gagagcgttcagtgtgcagagaaca

SEQ ID NO: 930195 - DNA, 25 bp, Mus musculus
gagagctagcagacatctctgtgag

SEQ ID NO: 930196 - DNA, 25 bp, Mus musculus
gagagctagcagatccagtgcagac

SEQ ID NO: 930197 - DNA, 25 bp, Mus musculus
gagagctagcagtcatctctgtgag

SEQ ID NO: 930198 - DNA, 25 bp, Mus musculus
gagagctagcagttccagtgcagac

SEQ ID NO: 930199 - DNA, 25 bp, Mus musculus
gagagctatgctggtggtgaggcgg

SEQ ID NO: 930200 - DNA, 25 bp, Mus musculus
gagagctatggtggtggtgaggcgg

SEQ ID NO: 930201 - DNA, 25 bp, Mus musculus
gagagctgagccacctccaagtgga

SEQ ID NO: 930202 - DNA, 25 bp, Mus musculus
gagagctgaggcacctccaagtgga

SEQ ID NO: 930203 - DNA, 25 bp, Mus musculus
gagagctgtgaacacatcaacgagt

SEQ ID NO: 930204 - DNA, 25 bp, Mus musculus
gagagctgtgaagacatcaacgagt

SEQ ID NO: 930205 - DNA, 25 bp, Mus musculus
gagagcttcaagccatatgagcgtg

SEQ ID NO: 930206 - DNA, 25 bp, Mus musculus
gagagcttcaaggcatatgagcgtg

SEQ ID NO: 930207 - DNA, 25 bp, Mus musculus
gagagcttcccgcaggagatggcca

SEQ ID NO: 930208 - DNA, 25 bp, Mus musculus
gagagcttcccggaggagatggcca

SEQ ID NO: 930209 - DNA, 25 bp, Mus musculus
gagaggaacgccgcgagaaccaact

SEQ ID NO: 930210 - DNA, 25 bp, Mus musculus
gagaggaacggcgcgagaaccaact

SEQ ID NO: 930211 - DNA, 25 bp, Mus musculus
gagaggaagactctgcagcttcaac

SEQ ID NO: 930212 - DNA, 25 bp, Mus musculus
gagaggaagactgtgcagcttcaac

SEQ ID NO: 930213 - DNA, 25 bp, Mus musculus
gagaggaagcactgcaggaggcaga

SEQ ID NO: 930214 - DNA, 25 bp, Mus musculus
gagaggaagcactgccaaggggacc

SEQ ID NO: 930215 - DNA, 25 bp, Mus musculus
gagaggaagcactggaggaggcaga

SEQ ID NO: 930216 - DNA, 25 bp, Mus musculus
gagaggaagcactggcaaggggacc

SEQ ID NO: 930217 - DNA, 25 bp, Mus musculus
gagaggaagtacgtcctactcccag

SEQ ID NO: 930218 - DNA, 25 bp, Mus musculus
gagaggaagttcgtcctactcccag

SEQ ID NO: 930219 - DNA, 25 bp, Mus musculus
gagaggacaacgatgtcattgaagc

SEQ ID NO: 930220 - DNA, 25 bp, Mus musculus
gagaggacaacgttgtcattgaagc

SEQ ID NO: 930221 - DNA, 25 bp, Mus musculus
gagaggacagaacggaccttagaag

SEQ ID NO: 930222 - DNA, 25 bp, Mus musculus
gagaggacagaagggaccttagaag

SEQ ID NO: 930223 - DNA, 25 bp, Mus musculus
gagaggaccaagccaatacagtgtt

SEQ ID NO: 930224 - DNA, 25 bp, Mus musculus
gagaggaccaaggcaatacagtgtt

SEQ ID NO: 930225 - DNA, 25 bp, Mus musculus
gagaggacgcctgagcatgccaact

SEQ ID NO: 930226 - DNA, 25 bp, Mus musculus
gagaggacgcgtgagcatgccaact

SEQ ID NO: 930227 - DNA, 25 bp, Mus musculus
gagaggagagcacggacgaccagga

SEQ ID NO: 930228 - DNA, 25 bp, Mus musculus
gagaggagagcagggacgaccagga

SEQ ID NO: 930229 - DNA, 25 bp, Mus musculus
gagaggagataacggagaagctggt

SEQ ID NO: 930230 - DNA, 25 bp, Mus musculus
gagaggagataagggagaagctggt

SEQ ID NO: 930231 - DNA, 25 bp, Mus musculus
gagaggataaaacatgaagaagatg

SEQ ID NO: 930232 - DNA, 25 bp, Mus musculus
gagaggataaaagatgaagaagatg

SEQ ID NO: 930233 - DNA, 25 bp, Mus musculus
gagaggcagtttgacgagtgcattt

SEQ ID NO: 930234 - DNA, 25 bp, Mus musculus
gagaggcagtttgaggagtgcattt

SEQ ID NO: 930235 - DNA, 25 bp, Mus musculus
gagaggccctcgaaagtgccgttct

SEQ ID NO: 930236 - DNA, 25 bp, Mus musculus
gagaggccctcgaatgtgccgttct

SEQ ID NO: 930237 - DNA, 25 bp, Mus musculus
gagaggcgagcgttgtgagccccgg

SEQ ID NO: 930238 - DNA, 25 bp, Mus musculus
gagaggcgagggttgtgagccccgg

SEQ ID NO: 930239 - DNA, 25 bp, Mus musculus
gagaggcgcaggcggaggtcagacc

SEQ ID NO: 930240 - DNA, 25 bp, Mus musculus
gagaggcgcagggggaggtcagacc

SEQ ID NO: 930241 - DNA, 25 bp, Mus musculus
gagaggcgcgagcccgcaaaacggg

SEQ ID NO: 930242 - DNA, 25 bp, Mus musculus
gagaggcgcgaggccgcaaaacggg

SEQ ID NO: 930243 - DNA, 25 bp, Mus musculus
gagaggctgcagcctacagaacctg

SEQ ID NO: 930244 - DNA, 25 bp, Mus musculus
gagaggctgcaggctacagaacctg

SEQ ID NO: 930245 - DNA, 25 bp, Mus musculus
gagaggctgctccattatgtcccca

SEQ ID NO: 930246 - DNA, 25 bp, Mus musculus
gagaggctgctcgattatgtcccca

SEQ ID NO: 930247 - DNA, 25 bp, Mus musculus
gagaggctggagcctgagtttggta

SEQ ID NO: 930248 - DNA, 25 bp, Mus musculus
gagaggctggaggctgagtttggta

SEQ ID NO: 930249 - DNA, 25 bp, Mus musculus
gagaggctgggcgacactcggagcc

SEQ ID NO: 930250 - DNA, 25 bp, Mus musculus
gagaggctgggcgagactcggagcc

SEQ ID NO: 930251 - DNA, 25 bp, Mus musculus
gagaggcttcaaacaaaattggatg

SEQ ID NO: 930252 - DNA, 25 bp, Mus musculus
gagaggcttcaaactaaattggatg

SEQ ID NO: 930253 - DNA, 25 bp, Mus musculus
gagagggaacagcagtacatcaggc

SEQ ID NO: 930254 - DNA, 25 bp, Mus musculus
gagagggaacaggagtacatcaggc

SEQ ID NO: 930255 - DNA, 25 bp, Mus musculus
gagagggaagagcaaatgtgtcaag

SEQ ID NO: 930256 - DNA, 25 bp, Mus musculus
gagagggaagtgcaaatgtgtcaag

SEQ ID NO: 930257 - DNA, 25 bp, Mus musculus
gagagggacatgatgctagccaaac

SEQ ID NO: 930258 - DNA, 25 bp, Mus musculus
gagagggacatgttgctagccaaac

SEQ ID NO: 930259 - DNA, 25 bp, Mus musculus
gagagggctgcgatactggttgtat

SEQ ID NO: 930260 - DNA, 25 bp, Mus musculus
gagagggctgcgttactggttgtat

SEQ ID NO: 930261 - DNA, 25 bp, Mus musculus
gagagggggaggcatttgcaggccc

SEQ ID NO: 930262 - DNA, 25 bp, Mus musculus
gagagggggagggatttgcaggccc

SEQ ID NO: 930263 - DNA, 25 bp, Mus musculus
gagaggggggctcatcctgggctca

SEQ ID NO: 930264 - DNA, 25 bp, Mus musculus
gagaggggggctgatcctgggctca

SEQ ID NO: 930265 - DNA, 25 bp, Mus musculus
gagagggtggagctaacaacttata

SEQ ID NO: 930266 - DNA, 25 bp, Mus musculus
gagagggtggaggtaacaacttata

SEQ ID NO: 930267 - DNA, 25 bp, Mus musculus
gagaggtcagagcatgcaaagaagg

SEQ ID NO: 930268 - DNA, 25 bp, Mus musculus
gagaggtcagagcctgtcaaaatac

SEQ ID NO: 930269 - DNA, 25 bp, Mus musculus
gagaggtcagaggatgcaaagaagg

SEQ ID NO: 930270 - DNA, 25 bp, Mus musculus
gagaggtcagaggctgtcaaaatac

SEQ ID NO: 930271 - DNA, 25 bp, Mus musculus
gagaggtggaagaccatgtctagca

SEQ ID NO: 930272 - DNA, 25 bp, Mus musculus
gagaggtggaagaccatgtctgcta

SEQ ID NO: 930273 - DNA, 25 bp, Mus musculus
gagaggtggaagtccatgtctagca

SEQ ID NO: 930274 - DNA, 25 bp, Mus musculus
gagaggtggaagtccatgtctgcta

SEQ ID NO: 930275 - DNA, 25 bp, Mus musculus
gagaggttcgactgctttgccttga

SEQ ID NO: 930276 - DNA, 25 bp, Mus musculus
gagaggttcgtctgctttgccttga

SEQ ID NO: 930277 - DNA, 25 bp, Mus musculus
gagagtaactagctttgcatcatgc

SEQ ID NO: 930278 - DNA, 25 bp, Mus musculus
gagagtaactaggtttgcatcatgc

SEQ ID NO: 930279 - DNA, 25 bp, Mus musculus
gagagtaagaactgtgccaagtggt

SEQ ID NO: 930280 - DNA, 25 bp, Mus musculus
gagagtaagatctgtgccaagtggt

SEQ ID NO: 930281 - DNA, 25 bp, Mus musculus
gagagtcaaacagcgtgcttccggc

SEQ ID NO: 930282 - DNA, 25 bp, Mus musculus
gagagtcaaacgtgcttccggctgt

SEQ ID NO: 930283 - DNA, 25 bp, Mus musculus
gagagtcaaagagcgtgcttccggc

SEQ ID NO: 930284 - DNA, 25 bp, Mus musculus
gagagtcaaaggtgcttccggctgt

SEQ ID NO: 930285 - DNA, 25 bp, Mus musculus
gagagtcagaagagttcgctataaa

SEQ ID NO: 930286 - DNA, 25 bp, Mus musculus
gagagtcagaagtgttcgctataaa

SEQ ID NO: 930287 - DNA, 25 bp, Mus musculus
gagagtccagacttacctccagtat

SEQ ID NO: 930288 - DNA, 25 bp, Mus musculus
gagagtccagtcttacctccagtat

SEQ ID NO: 930289 - DNA, 25 bp, Mus musculus
gagagtcccgaacgggacagcttcg

SEQ ID NO: 930290 - DNA, 25 bp, Mus musculus
gagagtcccgaaggggacagcttcg

SEQ ID NO: 930291 - DNA, 25 bp, Mus musculus
gagagtccgaaaacagtgtgcctta

SEQ ID NO: 930292 - DNA, 25 bp, Mus musculus
gagagtccgaaatcagtgtgcctta

SEQ ID NO: 930293 - DNA, 25 bp, Mus musculus
gagagtcctcagaatggcaatgttc

SEQ ID NO: 930294 - DNA, 25 bp, Mus musculus
gagagtcctcagccacctccaagtg

SEQ ID NO: 930295 - DNA, 25 bp, Mus musculus
gagagtcctcaggcacctccaagtg

SEQ ID NO: 930296 - DNA, 25 bp, Mus musculus
gagagtcctcagtatggcaatgttc

SEQ ID NO: 930297 - DNA, 25 bp, Mus musculus
gagagtcgggccctgtctccaacac

SEQ ID NO: 930298 - DNA, 25 bp, Mus musculus
gagagtcgggcgcctggtgtacacc

SEQ ID NO: 930299 - DNA, 25 bp, Mus musculus
gagagtcggggcctgtctccaacac

SEQ ID NO: 930300 - DNA, 25 bp, Mus musculus
gagagtcgggggcctggtgtacacc

SEQ ID NO: 930301 - DNA, 25 bp, Mus musculus
gagagtgagaagatcttggctgcat

SEQ ID NO: 930302 - DNA, 25 bp, Mus musculus
gagagtgagaagcatttcttcactt

SEQ ID NO: 930303 - DNA, 25 bp, Mus musculus
gagagtgagaaggatttcttcactt

SEQ ID NO: 930304 - DNA, 25 bp, Mus musculus
gagagtgagaagttcttggctgcat

SEQ ID NO: 930305 - DNA, 25 bp, Mus musculus
gagagtggaacacatcgctgtagtg

SEQ ID NO: 930306 - DNA, 25 bp, Mus musculus
gagagtggaacagatcgctgtagtg

SEQ ID NO: 930307 - DNA, 25 bp, Mus musculus
gagagtggcagacggataccacact

SEQ ID NO: 930308 - DNA, 25 bp, Mus musculus
gagagtggcagagggataccacact

SEQ ID NO: 930309 - DNA, 25 bp, Mus musculus
gagagtgtcaaacgatcaatgtgac

SEQ ID NO: 930310 - DNA, 25 bp, Mus musculus
gagagtgtcaaactacttcaactcc

SEQ ID NO: 930311 - DNA, 25 bp, Mus musculus
gagagtgtcaaaggatcaatgtgac

SEQ ID NO: 930312 - DNA, 25 bp, Mus musculus
gagagtgtcaaagtacttcaactcc

SEQ ID NO: 930313 - DNA, 25 bp, Mus musculus
gagagttagtgacgacatgtgcatg

SEQ ID NO: 930314 - DNA, 25 bp, Mus musculus
gagagttagtgaggacatgtgcatg

SEQ ID NO: 930315 - DNA, 25 bp, Mus musculus
gagagttatgatgacgccaagcacg

SEQ ID NO: 930316 - DNA, 25 bp, Mus musculus
gagagttatgatgaggccaagcacg

SEQ ID NO: 930317 - DNA, 25 bp, Mus musculus
gagagttgtgagcagatcccccaag

SEQ ID NO: 930318 - DNA, 25 bp, Mus musculus
gagagttgtgaggagatcccccaag

SEQ ID NO: 930319 - DNA, 25 bp, Mus musculus
gagagtttgaagccttcgtggccat

SEQ ID NO: 930320 - DNA, 25 bp, Mus musculus
gagagtttgaaggcttcgtggccat

SEQ ID NO: 930321 - DNA, 25 bp, Mus musculus
gagataagagagagggaggcgaaag

SEQ ID NO: 930322 - DNA, 25 bp, Mus musculus
gagataagagagtgggaggcgaaag

SEQ ID NO: 930323 - DNA, 25 bp, Mus musculus
gagataagatctccatcatgtgtat

SEQ ID NO: 930324 - DNA, 25 bp, Mus musculus
gagataagatgtccatcatgtgtat

SEQ ID NO: 930325 - DNA, 25 bp, Mus musculus
gagatacaagcaaagaaaggagagg

SEQ ID NO: 930326 - DNA, 25 bp, Mus musculus
gagatacaagcgtcaatatagacct

SEQ ID NO: 930327 - DNA, 25 bp, Mus musculus
gagatacaagctgtagtggctggca

SEQ ID NO: 930328 - DNA, 25 bp, Mus musculus
gagatacaaggaaagaaaggagagg

SEQ ID NO: 930329 - DNA, 25 bp, Mus musculus
gagatacaagggtcaatatagacct

SEQ ID NO: 930330 - DNA, 25 bp, Mus musculus
gagatacaaggtgtagtggctggca

SEQ ID NO: 930331 - DNA, 25 bp, Mus musculus
gagatacaggccatggatgggcaga

SEQ ID NO: 930332 - DNA, 25 bp, Mus musculus
gagatacagggcatggatgggcaga

SEQ ID NO: 930333 - DNA, 25 bp, Mus musculus
gagatacccagacccctgcaactcc

SEQ ID NO: 930334 - DNA, 25 bp, Mus musculus
gagatacccagagccctgcaactcc

SEQ ID NO: 930335 - DNA, 25 bp, Mus musculus
gagatacccatgcaagtatttaaag

SEQ ID NO: 930336 - DNA, 25 bp, Mus musculus
gagatacccatggaagtatttaaag

SEQ ID NO: 930337 - DNA, 25 bp, Mus musculus
gagatactacagaaggttaagcata

SEQ ID NO: 930338 - DNA, 25 bp, Mus musculus
gagatactactgaaggttaagcata

SEQ ID NO: 930339 - DNA, 25 bp, Mus musculus
gagatagcagcttgcgtcttgacga

SEQ ID NO: 930340 - DNA, 25 bp, Mus musculus
gagatagcagcttgggtcttgacga

SEQ ID NO: 930341 - DNA, 25 bp, Mus musculus
gagatagcgctgctctcctagatcc

SEQ ID NO: 930342 - DNA, 25 bp, Mus musculus
gagatagcgctggtctcctagatcc

SEQ ID NO: 930343 - DNA, 25 bp, Mus musculus
gagatagtaagaaacttcgagctgc

SEQ ID NO: 930344 - DNA, 25 bp, Mus musculus
gagatagtaagaaagttcgagctgc

SEQ ID NO: 930345 - DNA, 25 bp, Mus musculus
gagatatatttgagcaacaggacat

SEQ ID NO: 930346 - DNA, 25 bp, Mus musculus
gagatatatttgtgcaacaggacat

SEQ ID NO: 930347 - DNA, 25 bp, Mus musculus
gagatatcaaagctgccaacgtgct

SEQ ID NO: 930348 - DNA, 25 bp, Mus musculus
gagatatcaaaggtgccaacgtgct

SEQ ID NO: 930349 - DNA, 25 bp, Mus musculus
gagatatgagacgaaagtaggtggg

SEQ ID NO: 930350 - DNA, 25 bp, Mus musculus
gagatatgagctactccatccgcca

SEQ ID NO: 930351 - DNA, 25 bp, Mus musculus
gagatatgaggtactccatccgcca

SEQ ID NO: 930352 - DNA, 25 bp, Mus musculus
gagatatgagtcgaaagtaggtggg

SEQ ID NO: 930353 - DNA, 25 bp, Mus musculus
gagatatgcgcaacaaaagcggtac

SEQ ID NO: 930354 - DNA, 25 bp, Mus musculus
gagatatgcggaacaaaagcggtac

SEQ ID NO: 930355 - DNA, 25 bp, Mus musculus
gagatattacagattgctatgcaga

SEQ ID NO: 930356 - DNA, 25 bp, Mus musculus
gagatattacagtttgctatgcaga

SEQ ID NO: 930357 - DNA, 25 bp, Mus musculus
gagatattgccaaacttaaagggca

SEQ ID NO: 930358 - DNA, 25 bp, Mus musculus
gagatattgccatacttaaagggca

SEQ ID NO: 930359 - DNA, 25 bp, Mus musculus
gagatcaaaatgcctcgcgctgtat

SEQ ID NO: 930360 - DNA, 25 bp, Mus musculus
gagatcaaaatggctcgcgctgtat

SEQ ID NO: 930361 - DNA, 25 bp, Mus musculus
gagatcaacgctgaccatttgaaga

SEQ ID NO: 930362 - DNA, 25 bp, Mus musculus
gagatcaacggtgaccatttgaaga

SEQ ID NO: 930363 - DNA, 25 bp, Mus musculus
gagatcacagacatgggggtcgtgg

SEQ ID NO: 930364 - DNA, 25 bp, Mus musculus
gagatcacagctatcactggtgatg

SEQ ID NO: 930365 - DNA, 25 bp, Mus musculus
gagatcacagctatgactggtgatg

SEQ ID NO: 930366 - DNA, 25 bp, Mus musculus
gagatcacagtcatgggggtcgtgg

SEQ ID NO: 930367 - DNA, 25 bp, Mus musculus
gagatcaccaaacatgcatttttgg

SEQ ID NO: 930368 - DNA, 25 bp, Mus musculus
gagatcaccaaagatgcatttttgg

SEQ ID NO: 930369 - DNA, 25 bp, Mus musculus
gagatcaccaccaacgacttgaagg

SEQ ID NO: 930370 - DNA, 25 bp, Mus musculus
gagatcaccaccaaggacttgaagg

SEQ ID NO: 930371 - DNA, 25 bp, Mus musculus
gagatcacccacgaccagcctcaaa

SEQ ID NO: 930372 - DNA, 25 bp, Mus musculus
gagatcacccacgaccctcaaagcc

SEQ ID NO: 930373 - DNA, 25 bp, Mus musculus
gagatcacccacgagcagcctcaaa

SEQ ID NO: 930374 - DNA, 25 bp, Mus musculus
gagatcacccacgagcctcaaagcc

SEQ ID NO: 930375 - DNA, 25 bp, Mus musculus
gagatcatcaagcgcatgggttatc

SEQ ID NO: 930376 - DNA, 25 bp, Mus musculus
gagatcatcaagggcatgggttatc

SEQ ID NO: 930377 - DNA, 25 bp, Mus musculus
gagatcatgcaacaaaagtctttcg

SEQ ID NO: 930378 - DNA, 25 bp, Mus musculus
gagatcatgcaagaaaagtctttcg

SEQ ID NO: 930379 - DNA, 25 bp, Mus musculus
gagatcatttctctttgtaaacgat

SEQ ID NO: 930380 - DNA, 25 bp, Mus musculus
gagatcatttctgtttgtaaacgat

SEQ ID NO: 930381 - DNA, 25 bp, Mus musculus
gagatccagaccaaacactggagct

SEQ ID NO: 930382 - DNA, 25 bp, Mus musculus
gagatccagagcaaacactggagct

SEQ ID NO: 930383 - DNA, 25 bp, Mus musculus
gagatccagctgatggtagaagaga

SEQ ID NO: 930384 - DNA, 25 bp, Mus musculus
gagatccagctgttggtagaagaga

SEQ ID NO: 930385 - DNA, 25 bp, Mus musculus
gagatccgagagaacgtcttgggca

SEQ ID NO: 930386 - DNA, 25 bp, Mus musculus
gagatccgagagaaggtcttgggca

SEQ ID NO: 930387 - DNA, 25 bp, Mus musculus
gagatccgagagactacaggagccc

SEQ ID NO: 930388 - DNA, 25 bp, Mus musculus
gagatccgagagtctacaggagccc

SEQ ID NO: 930389 - DNA, 25 bp, Mus musculus
gagatccgcagtatgttccggaagc

SEQ ID NO: 930390 - DNA, 25 bp, Mus musculus
gagatccgcagtcgtttctctgtat

SEQ ID NO: 930391 - DNA, 25 bp, Mus musculus
gagatccgcagtggtttctctgtat

SEQ ID NO: 930392 - DNA, 25 bp, Mus musculus
gagatccgcagtttgttccggaagc

SEQ ID NO: 930393 - DNA, 25 bp, Mus musculus
gagatccgggacaaaattctggctg

SEQ ID NO: 930394 - DNA, 25 bp, Mus musculus
gagatccgggacaatattctggctg

SEQ ID NO: 930395 - DNA, 25 bp, Mus musculus
gagatcctccgacagttcaaccaga

SEQ ID NO: 930396 - DNA, 25 bp, Mus musculus
gagatcctccgagagttcaaccaga

SEQ ID NO: 930397 - DNA, 25 bp, Mus musculus
gagatcctggagcaaccttcgctgc

SEQ ID NO: 930398 - DNA, 25 bp, Mus musculus
gagatcctggaggaaccttcgctgc

SEQ ID NO: 930399 - DNA, 25 bp, Mus musculus
gagatcgagcagctgaatgagcgag

SEQ ID NO: 930400 - DNA, 25 bp, Mus musculus
gagatcgagcagcttcctcatgagg

SEQ ID NO: 930401 - DNA, 25 bp, Mus musculus
gagatcgagcaggtgaatgagcgag

SEQ ID NO: 930402 - DNA, 25 bp, Mus musculus
gagatcgagcaggttcctcatgagg

SEQ ID NO: 930403 - DNA, 25 bp, Mus musculus
gagatcgatgctcgtgtgtgtgagg

SEQ ID NO: 930404 - DNA, 25 bp, Mus musculus
gagatcgatgctggtgtgtgtgagg

SEQ ID NO: 930405 - DNA, 25 bp, Mus musculus
gagatcgtgctcaacgttaactaca

SEQ ID NO: 930406 - DNA, 25 bp, Mus musculus
gagatcgtgctcaaggttaactaca

SEQ ID NO: 930407 - DNA, 25 bp, Mus musculus
gagatctacaggcgtggatgcgtag

SEQ ID NO: 930408 - DNA, 25 bp, Mus musculus
gagatctacaggggtggatgcgtag

SEQ ID NO: 930409 - DNA, 25 bp, Mus musculus
gagatctctgggaacattgctacag

SEQ ID NO: 930410 - DNA, 25 bp, Mus musculus
gagatctctgggaagattgctacag

SEQ ID NO: 930411 - DNA, 25 bp, Mus musculus
gagatcttaaagcttgccaggatgc

SEQ ID NO: 930412 - DNA, 25 bp, Mus musculus
gagatcttaaaggttgccaggatgc

SEQ ID NO: 930413 - DNA, 25 bp, Mus musculus
gagatcttcctgacctacatctctc

SEQ ID NO: 930414 - DNA, 25 bp, Mus musculus
gagatcttcctgtcctacatctctc

SEQ ID NO: 930415 - DNA, 25 bp, Mus musculus
gagatcttcgatgaccgcgccttct

SEQ ID NO: 930416 - DNA, 25 bp, Mus musculus
gagatcttcgatgagcgcgccttct

SEQ ID NO: 930417 - DNA, 25 bp, Mus musculus
gagatgaaatcacacaactagacac

SEQ ID NO: 930418 - DNA, 25 bp, Mus musculus
gagatgaaatcacagaactagacac

SEQ ID NO: 930419 - DNA, 25 bp, Mus musculus
gagatgaacttaaacgtgacaacat

SEQ ID NO: 930420 - DNA, 25 bp, Mus musculus
gagatgaacttaaaggtgacaacat

SEQ ID NO: 930421 - DNA, 25 bp, Mus musculus
gagatgaagaaacggtccatcttca

SEQ ID NO: 930422 - DNA, 25 bp, Mus musculus
gagatgaagaaagggtccatcttca

SEQ ID NO: 930423 - DNA, 25 bp, Mus musculus
gagatgaagaagatattgcctcacg

SEQ ID NO: 930424 - DNA, 25 bp, Mus musculus
gagatgaagaagttattgcctcacg

SEQ ID NO: 930425 - DNA, 25 bp, Mus musculus
gagatgaatgcgaagtatgtgggct

SEQ ID NO: 930426 - DNA, 25 bp, Mus musculus
gagatgaatgggaagtatgtgggct

SEQ ID NO: 930427 - DNA, 25 bp, Mus musculus
gagatgacacataaagtggacgatt

SEQ ID NO: 930428 - DNA, 25 bp, Mus musculus
gagatgacacataatgtggacgatt

SEQ ID NO: 930429 - DNA, 25 bp, Mus musculus
gagatgacagctttgtggtggcatg

SEQ ID NO: 930430 - DNA, 25 bp, Mus musculus
gagatgacaggtttgtggtggcatg

SEQ ID NO: 930431 - DNA, 25 bp, Mus musculus
gagatgagcaggagccggccccgtg

SEQ ID NO: 930432 - DNA, 25 bp, Mus musculus
gagatgagcaggtgccggccccgtg

SEQ ID NO: 930433 - DNA, 25 bp, Mus musculus
gagatgagttagaggctaacggcca

SEQ ID NO: 930434 - DNA, 25 bp, Mus musculus
gagatgagttagattagaggctaac

SEQ ID NO: 930435 - DNA, 25 bp, Mus musculus
gagatgagttagcctaacggccaga

SEQ ID NO: 930436 - DNA, 25 bp, Mus musculus
gagatgagttaggctaacggccaga

SEQ ID NO: 930437 - DNA, 25 bp, Mus musculus
gagatgagttagtggctaacggcca

SEQ ID NO: 930438 - DNA, 25 bp, Mus musculus
gagatgagttagtttagaggctaac

SEQ ID NO: 930439 - DNA, 25 bp, Mus musculus
gagatgatcaagctcacaaagacag

SEQ ID NO: 930440 - DNA, 25 bp, Mus musculus
gagatgatcaaggtcacaaagacag

SEQ ID NO: 930441 - DNA, 25 bp, Mus musculus
gagatgatccgagacgccttggaag

SEQ ID NO: 930442 - DNA, 25 bp, Mus musculus
gagatgatccgagaggccttggaag

SEQ ID NO: 930443 - DNA, 25 bp, Mus musculus
gagatgattttacactgtgctacca

SEQ ID NO: 930444 - DNA, 25 bp, Mus musculus
gagatgattttacagtgtgctacca

SEQ ID NO: 930445 - DNA, 25 bp, Mus musculus
gagatgcaagctgataggagcatga

SEQ ID NO: 930446 - DNA, 25 bp, Mus musculus
gagatgcaaggtgataggagcatga

SEQ ID NO: 930447 - DNA, 25 bp, Mus musculus
gagatgcacaaacacgcggaaattg

SEQ ID NO: 930448 - DNA, 25 bp, Mus musculus
gagatgcacaaacactgccccaggt

SEQ ID NO: 930449 - DNA, 25 bp, Mus musculus
gagatgcacaaacaggcggaaattg

SEQ ID NO: 930450 - DNA, 25 bp, Mus musculus
gagatgcacaaacagtgccccaggt

SEQ ID NO: 930451 - DNA, 25 bp, Mus musculus
gagatgcagagacacgcacggtggt

SEQ ID NO: 930452 - DNA, 25 bp, Mus musculus
gagatgcagagacaggcacggtggt

SEQ ID NO: 930453 - DNA, 25 bp, Mus musculus
gagatgccctacaactgttcctcct

SEQ ID NO: 930454 - DNA, 25 bp, Mus musculus
gagatgccctacaagtgttcctcct

SEQ ID NO: 930455 - DNA, 25 bp, Mus musculus
gagatgcctgatcaacatgacacac

SEQ ID NO: 930456 - DNA, 25 bp, Mus musculus
gagatgcctgttcaacatgacacac

SEQ ID NO: 930457 - DNA, 25 bp, Mus musculus
gagatgctcaggctttgctcctgtt

SEQ ID NO: 930458 - DNA, 25 bp, Mus musculus
gagatgctcagggtttgctcctgtt

SEQ ID NO: 930459 - DNA, 25 bp, Mus musculus
gagatgctcatccgctacccaccat

SEQ ID NO: 930460 - DNA, 25 bp, Mus musculus
gagatgctcatcggctacccaccat

SEQ ID NO: 930461 - DNA, 25 bp, Mus musculus
gagatgctcatgctctccccgggtt

SEQ ID NO: 930462 - DNA, 25 bp, Mus musculus
gagatgctcatggtctccccgggtt

SEQ ID NO: 930463 - DNA, 25 bp, Mus musculus
gagatgctgaagattgccgtggtcc

SEQ ID NO: 930464 - DNA, 25 bp, Mus musculus
gagatgctgaagtttgccgtggtcc

SEQ ID NO: 930465 - DNA, 25 bp, Mus musculus
gagatgctgaatcgcaagagctacg

SEQ ID NO: 930466 - DNA, 25 bp, Mus musculus
gagatgctgaatggcaagagctacg

SEQ ID NO: 930467 - DNA, 25 bp, Mus musculus
gagatggaagaggtccagtccccgg

SEQ ID NO: 930468 - DNA, 25 bp, Mus musculus
gagatggaagtggtccagtccccgg

SEQ ID NO: 930469 - DNA, 25 bp, Mus musculus
gagatggatcctacaggacagttga

SEQ ID NO: 930470 - DNA, 25 bp, Mus musculus
gagatggatccttcaggacagttga

SEQ ID NO: 930471 - DNA, 25 bp, Mus musculus
gagatggcagcgccggtggcggagg

SEQ ID NO: 930472 - DNA, 25 bp, Mus musculus
gagatggcagcggcggtggcggagg

SEQ ID NO: 930473 - DNA, 25 bp, Mus musculus
gagatggcagtgcagcaaataagag

SEQ ID NO: 930474 - DNA, 25 bp, Mus musculus
gagatggcagtggagcaaataagag

SEQ ID NO: 930475 - DNA, 25 bp, Mus musculus
gagatggcccccatcgttcagcatg

SEQ ID NO: 930476 - DNA, 25 bp, Mus musculus
gagatggcccccatggttcagcatg

SEQ ID NO: 930477 - DNA, 25 bp, Mus musculus
gagatggtgacacgtttctccatat

SEQ ID NO: 930478 - DNA, 25 bp, Mus musculus
gagatggtgacaggtttctccatat

SEQ ID NO: 930479 - DNA, 25 bp, Mus musculus
gagatgtacaaacgaggaaaagctg

SEQ ID NO: 930480 - DNA, 25 bp, Mus musculus
gagatgtacaaaggaggaaaagctg

SEQ ID NO: 930481 - DNA, 25 bp, Mus musculus
gagatgtatcctcgacgctgccccg

SEQ ID NO: 930482 - DNA, 25 bp, Mus musculus
gagatgtatcctggacgctgccccg

SEQ ID NO: 930483 - DNA, 25 bp, Mus musculus
gagatgtcatcaccatccagccatg

SEQ ID NO: 930484 - DNA, 25 bp, Mus musculus
gagatgtcatcagcatccagccatg

SEQ ID NO: 930485 - DNA, 25 bp, Mus musculus
gagatgtccctgcacatggatcctg

SEQ ID NO: 930486 - DNA, 25 bp, Mus musculus
gagatgtccctgcagatggatcctg

SEQ ID NO: 930487 - DNA, 25 bp, Mus musculus
gagatgtgttcaatccacggcagcc

SEQ ID NO: 930488 - DNA, 25 bp, Mus musculus
gagatgtgttcattccacggcagcc

SEQ ID NO: 930489 - DNA, 25 bp, Mus musculus
gagattaaagacagctgcagcacga

SEQ ID NO: 930490 - DNA, 25 bp, Mus musculus
gagattaaagtcagctgcagcacga

SEQ ID NO: 930491 - DNA, 25 bp, Mus musculus
gagattaacccacctccgtacactg

SEQ ID NO: 930492 - DNA, 25 bp, Mus musculus
gagattaacccagctccgtacactg

SEQ ID NO: 930493 - DNA, 25 bp, Mus musculus
gagattaaggctgccacctaggctg

SEQ ID NO: 930494 - DNA, 25 bp, Mus musculus
gagattaagggtgccacctaggctg

SEQ ID NO: 930495 - DNA, 25 bp, Mus musculus
gagattacagaggcctcattcacat

SEQ ID NO: 930496 - DNA, 25 bp, Mus musculus
gagattacagcgtttcctgaggccc

SEQ ID NO: 930497 - DNA, 25 bp, Mus musculus
gagattacagctgaagcagaaccag

SEQ ID NO: 930498 - DNA, 25 bp, Mus musculus
gagattacagggtttcctgaggccc

SEQ ID NO: 930499 - DNA, 25 bp, Mus musculus
gagattacaggtgaagcagaaccag

SEQ ID NO: 930500 - DNA, 25 bp, Mus musculus
gagattacagtggcctcattcacat

SEQ ID NO: 930501 - DNA, 25 bp, Mus musculus
gagattatatcacgttgtacgggat

SEQ ID NO: 930502 - DNA, 25 bp, Mus musculus
gagattatatcaggttgtacgggat

SEQ ID NO: 930503 - DNA, 25 bp, Mus musculus
gagattcaaaccagaataccagagt

SEQ ID NO: 930504 - DNA, 25 bp, Mus musculus
gagattcaaagcagaataccagagt

SEQ ID NO: 930505 - DNA, 25 bp, Mus musculus
gagattccagcaagcccctgaggaa

SEQ ID NO: 930506 - DNA, 25 bp, Mus musculus
gagattccagcaattcctggagtgg

SEQ ID NO: 930507 - DNA, 25 bp, Mus musculus
gagattccaggaagcccctgaggaa

SEQ ID NO: 930508 - DNA, 25 bp, Mus musculus
gagattccaggaattcctggagtgg

SEQ ID NO: 930509 - DNA, 25 bp, Mus musculus
gagattcgcacaccgcaacctccgc

SEQ ID NO: 930510 - DNA, 25 bp, Mus musculus
gagattcgcacagcgcaacctccgc

SEQ ID NO: 930511 - DNA, 25 bp, Mus musculus
gagattctagataatgctgctgata

SEQ ID NO: 930512 - DNA, 25 bp, Mus musculus
gagattctagttaatgctgctgata

SEQ ID NO: 930513 - DNA, 25 bp, Mus musculus
gagattgaagagctccgagaggcct

SEQ ID NO: 930514 - DNA, 25 bp, Mus musculus
gagattgaagtgctccgagaggcct

SEQ ID NO: 930515 - DNA, 25 bp, Mus musculus
gagattgacacaatcgtcctaccag

SEQ ID NO: 930516 - DNA, 25 bp, Mus musculus
gagattgacacaatggtcctaccag

SEQ ID NO: 930517 - DNA, 25 bp, Mus musculus
gagattgagaagctcatagaagagc

SEQ ID NO: 930518 - DNA, 25 bp, Mus musculus
gagattgagaaggtcatagaagagc

SEQ ID NO: 930519 - DNA, 25 bp, Mus musculus
gagattgcccagcatgccctgaagt

SEQ ID NO: 930520 - DNA, 25 bp, Mus musculus
gagattgcccaggatgccctgaagt

SEQ ID NO: 930521 - DNA, 25 bp, Mus musculus
gagattgttgtgcattctgactcca

SEQ ID NO: 930522 - DNA, 25 bp, Mus musculus
gagattgttgtggattctgactcca

SEQ ID NO: 930523 - DNA, 25 bp, Mus musculus
gagatttcaaaagctgatgtggaag

SEQ ID NO: 930524 - DNA, 25 bp, Mus musculus
gagatttcaatagctgatgtggaag

SEQ ID NO: 930525 - DNA, 25 bp, Mus musculus
gagatttcctgacgcactgatgcgt

SEQ ID NO: 930526 - DNA, 25 bp, Mus musculus
gagatttcctgaggcactgatgcgt

SEQ ID NO: 930527 - DNA, 25 bp, Mus musculus
gagattttgaaacacaagaagctga

SEQ ID NO: 930528 - DNA, 25 bp, Mus musculus
gagattttgaaagacaagaagctga

SEQ ID NO: 930529 - DNA, 25 bp, Mus musculus
gagatttttgaggacagcacatggg

SEQ ID NO: 930530 - DNA, 25 bp, Mus musculus
gagatttttgtggacagcacatggg

SEQ ID NO: 930531 - DNA, 25 bp, Mus musculus
gagcaaaaagaatcgggttgagatt

SEQ ID NO: 930532 - DNA, 25 bp, Mus musculus
gagcaaaaagactcagtttgaagag

SEQ ID NO: 930533 - DNA, 25 bp, Mus musculus
gagcaaaaagattcgtgaacagaca

SEQ ID NO: 930534 - DNA, 25 bp, Mus musculus
gagcaaaaagtatcgggttgagatt

SEQ ID NO: 930535 - DNA, 25 bp, Mus musculus
gagcaaaaagtctcagtttgaagag

SEQ ID NO: 930536 - DNA, 25 bp, Mus musculus
gagcaaaaagtttcgtgaacagaca

SEQ ID NO: 930537 - DNA, 25 bp, Mus musculus
gagcaaaacatgctgagcattgccg

SEQ ID NO: 930538 - DNA, 25 bp, Mus musculus
gagcaaaacatggtgagcattgccg

SEQ ID NO: 930539 - DNA, 25 bp, Mus musculus
gagcaaaagccacagcccaggctgt

SEQ ID NO: 930540 - DNA, 25 bp, Mus musculus
gagcaaaagccactgttggaggtga

SEQ ID NO: 930541 - DNA, 25 bp, Mus musculus
gagcaaaagccagagcccaggctgt

SEQ ID NO: 930542 - DNA, 25 bp, Mus musculus
gagcaaaagccagtgttggaggtga

SEQ ID NO: 930543 - DNA, 25 bp, Mus musculus
gagcaaacagctgcccgggaggagg

SEQ ID NO: 930544 - DNA, 25 bp, Mus musculus
gagcaaacaggtgcccgggaggagg

SEQ ID NO: 930545 - DNA, 25 bp, Mus musculus
gagcaaagaagtcagcaaaagccaa

SEQ ID NO: 930546 - DNA, 25 bp, Mus musculus
gagcaaagaagtgagcaaaagccaa

SEQ ID NO: 930547 - DNA, 25 bp, Mus musculus
gagcaaagagcagagctgtcggggc

SEQ ID NO: 930548 - DNA, 25 bp, Mus musculus
gagcaaagagcataaaggagaagga

SEQ ID NO: 930549 - DNA, 25 bp, Mus musculus
gagcaaagaggagagctgtcggggc

SEQ ID NO: 930550 - DNA, 25 bp, Mus musculus
gagcaaagaggataaaggagaagga

SEQ ID NO: 930551 - DNA, 25 bp, Mus musculus
gagcaaaggaggcttggtgctaaca

SEQ ID NO: 930552 - DNA, 25 bp, Mus musculus
gagcaaaggagggttggtgctaaca

SEQ ID NO: 930553 - DNA, 25 bp, Mus musculus
gagcaaagggcggctctactacatg

SEQ ID NO: 930554 - DNA, 25 bp, Mus musculus
gagcaaaggggggctctactacatg

SEQ ID NO: 930555 - DNA, 25 bp, Mus musculus
gagcaaatccagaaagtgcaagtgg

SEQ ID NO: 930556 - DNA, 25 bp, Mus musculus
gagcaaatccagtaagtgcaagtgg

SEQ ID NO: 930557 - DNA, 25 bp, Mus musculus
gagcaaatgtgaaacgctaccttgg

SEQ ID NO: 930558 - DNA, 25 bp, Mus musculus
gagcaaatgtgaaacgctggcacag

SEQ ID NO: 930559 - DNA, 25 bp, Mus musculus
gagcaaatgtgaaaggctaccttgg

SEQ ID NO: 930560 - DNA, 25 bp, Mus musculus
gagcaaatgtgaaaggctggcacag

SEQ ID NO: 930561 - DNA, 25 bp, Mus musculus
gagcaaattcagatataaaaagatc

SEQ ID NO: 930562 - DNA, 25 bp, Mus musculus
gagcaaattcagctaataattttca

SEQ ID NO: 930563 - DNA, 25 bp, Mus musculus
gagcaaattcaggtaataattttca

SEQ ID NO: 930564 - DNA, 25 bp, Mus musculus
gagcaaattcagttataaaaagatc

SEQ ID NO: 930565 - DNA, 25 bp, Mus musculus
gagcaacaagagaagaagaagctaa

SEQ ID NO: 930566 - DNA, 25 bp, Mus musculus
gagcaacaagtgaagaagaagctaa

SEQ ID NO: 930567 - DNA, 25 bp, Mus musculus
gagcaaccaagactgtcacttgtac

SEQ ID NO: 930568 - DNA, 25 bp, Mus musculus
gagcaaccaagagtgtcacttgtac

SEQ ID NO: 930569 - DNA, 25 bp, Mus musculus
gagcaagaagcagagcgtggcaaac

SEQ ID NO: 930570 - DNA, 25 bp, Mus musculus
gagcaagaaggagagcgtggcaaac

SEQ ID NO: 930571 - DNA, 25 bp, Mus musculus
gagcaagaggatattatcaggagaa

SEQ ID NO: 930572 - DNA, 25 bp, Mus musculus
gagcaagaggctttgttccttacat

SEQ ID NO: 930573 - DNA, 25 bp, Mus musculus
gagcaagagggtttgttccttacat

SEQ ID NO: 930574 - DNA, 25 bp, Mus musculus
gagcaagaggttattatcaggagaa

SEQ ID NO: 930575 - DNA, 25 bp, Mus musculus
gagcaagatcataaagtcctgcccc

SEQ ID NO: 930576 - DNA, 25 bp, Mus musculus
gagcaagatcataatgtcctgcccc

SEQ ID NO: 930577 - DNA, 25 bp, Mus musculus
gagcaagatgagctggactatcacc

SEQ ID NO: 930578 - DNA, 25 bp, Mus musculus
gagcaagatgaggtggactatcacc

SEQ ID NO: 930579 - DNA, 25 bp, Mus musculus
gagcaagcacgtcgttgaagacttg

SEQ ID NO: 930580 - DNA, 25 bp, Mus musculus
gagcaagcacgtggttgaagacttg

SEQ ID NO: 930581 - DNA, 25 bp, Mus musculus
gagcaagcagagctggacagtgaat

SEQ ID NO: 930582 - DNA, 25 bp, Mus musculus
gagcaagcagctcgaggaggacatc

SEQ ID NO: 930583 - DNA, 25 bp, Mus musculus
gagcaagcagctggaagatgagctg

SEQ ID NO: 930584 - DNA, 25 bp, Mus musculus
gagcaagcaggtcgaggaggacatc

SEQ ID NO: 930585 - DNA, 25 bp, Mus musculus
gagcaagcaggtggaagatgagctg

SEQ ID NO: 930586 - DNA, 25 bp, Mus musculus
gagcaagcagtgctggacagtgaat

SEQ ID NO: 930587 - DNA, 25 bp, Mus musculus
gagcaagctatgcatctggtgaaaa

SEQ ID NO: 930588 - DNA, 25 bp, Mus musculus
gagcaagctatggatctggtgaaaa

SEQ ID NO: 930589 - DNA, 25 bp, Mus musculus
gagcaaggagagaacggcgctgctg

SEQ ID NO: 930590 - DNA, 25 bp, Mus musculus
gagcaaggagagaagggcgctgctg

SEQ ID NO: 930591 - DNA, 25 bp, Mus musculus
gagcaaggctttgacactaaagaca

SEQ ID NO: 930592 - DNA, 25 bp, Mus musculus
gagcaaggctttgagactaaagaca

SEQ ID NO: 930593 - DNA, 25 bp, Mus musculus
gagcaaggtgaccatgctgcttgtt

SEQ ID NO: 930594 - DNA, 25 bp, Mus musculus
gagcaaggtgacgatgctgcttgtt

SEQ ID NO: 930595 - DNA, 25 bp, Mus musculus
gagcaagtagctcatattgacgggc

SEQ ID NO: 930596 - DNA, 25 bp, Mus musculus
gagcaagtagctgatattgacgggc

SEQ ID NO: 930597 - DNA, 25 bp, Mus musculus
gagcaatccaagttaaagaaagaag

SEQ ID NO: 930598 - DNA, 25 bp, Mus musculus
gagcaatccaataaagaaagaagat

SEQ ID NO: 930599 - DNA, 25 bp, Mus musculus
gagcaatccatgttaaagaaagaag

SEQ ID NO: 930600 - DNA, 25 bp, Mus musculus
gagcaatccattaaagaaagaagat

SEQ ID NO: 930601 - DNA, 25 bp, Mus musculus
gagcaatgagagggaagtggtggtc

SEQ ID NO: 930602 - DNA, 25 bp, Mus musculus
gagcaatgagtgggaagtggtggtc

SEQ ID NO: 930603 - DNA, 25 bp, Mus musculus
gagcacaaagcaaccctttgctcca

SEQ ID NO: 930604 - DNA, 25 bp, Mus musculus
gagcacaaaggaaccctttgctcca

SEQ ID NO: 930605 - DNA, 25 bp, Mus musculus
gagcacaatggacacagtgcctttc

SEQ ID NO: 930606 - DNA, 25 bp, Mus musculus
gagcacaatggacagagtgcctttc

SEQ ID NO: 930607 - DNA, 25 bp, Mus musculus
gagcaccaagcacccttctctccgt

SEQ ID NO: 930608 - DNA, 25 bp, Mus musculus
gagcaccaagcagccttctctccgt

SEQ ID NO: 930609 - DNA, 25 bp, Mus musculus
gagcaccaccacagcgcctgaagct

SEQ ID NO: 930610 - DNA, 25 bp, Mus musculus
gagcaccaccacagggcctgaagct

SEQ ID NO: 930611 - DNA, 25 bp, Mus musculus
gagcacccagccttccactgctgga

SEQ ID NO: 930612 - DNA, 25 bp, Mus musculus
gagcacccaggcttccactgctgga

SEQ ID NO: 930613 - DNA, 25 bp, Mus musculus
gagcaccccaaccacgtctcgccag

SEQ ID NO: 930614 - DNA, 25 bp, Mus musculus
gagcaccccaaccaggtctcgccag

SEQ ID NO: 930615 - DNA, 25 bp, Mus musculus
gagcaccctgcactacattgcagaa

SEQ ID NO: 930616 - DNA, 25 bp, Mus musculus
gagcaccctggactacattgcagaa

SEQ ID NO: 930617 - DNA, 25 bp, Mus musculus
gagcaccggagccatcccagccact

SEQ ID NO: 930618 - DNA, 25 bp, Mus musculus
gagcaccggagcgatcccagccact

SEQ ID NO: 930619 - DNA, 25 bp, Mus musculus
gagcaccggcttctcccccccactg

SEQ ID NO: 930620 - DNA, 25 bp, Mus musculus
gagcaccggcttctcgaagtcacct

SEQ ID NO: 930621 - DNA, 25 bp, Mus musculus
gagcaccggcttctgccccccactg

SEQ ID NO: 930622 - DNA, 25 bp, Mus musculus
gagcaccggcttctggaagtcacct

SEQ ID NO: 930623 - DNA, 25 bp, Mus musculus
gagcacctgcagcgtgtgggccact

SEQ ID NO: 930624 - DNA, 25 bp, Mus musculus
gagcacctgcagggtgtgggccact

SEQ ID NO: 930625 - DNA, 25 bp, Mus musculus
gagcacgacattcagctgtctctta

SEQ ID NO: 930626 - DNA, 25 bp, Mus musculus
gagcacgacattgagctgtctctta

SEQ ID NO: 930627 - DNA, 25 bp, Mus musculus
gagcacgcgaggagcatgtcatgtt

SEQ ID NO: 930628 - DNA, 25 bp, Mus musculus
gagcacgcgaggtgcatgtcatgtt

SEQ ID NO: 930629 - DNA, 25 bp, Mus musculus
gagcacggggaacgtgatctacttt

SEQ ID NO: 930630 - DNA, 25 bp, Mus musculus
gagcacggggaaggtgatctacttt

SEQ ID NO: 930631 - DNA, 25 bp, Mus musculus
gagcactaccagcaagacatgggat

SEQ ID NO: 930632 - DNA, 25 bp, Mus musculus
gagcactaccaggaagacatgggat

SEQ ID NO: 930633 - DNA, 25 bp, Mus musculus
gagcactctgcgaacggaaatgctc

SEQ ID NO: 930634 - DNA, 25 bp, Mus musculus
gagcactctgcgaagggaaatgctc

SEQ ID NO: 930635 - DNA, 25 bp, Mus musculus
gagcactgcgcggtggccacctgcc

SEQ ID NO: 930636 - DNA, 25 bp, Mus musculus
gagcactgcggggtggccacctgcc

SEQ ID NO: 930637 - DNA, 25 bp, Mus musculus
gagcacttacagctccttgaggaag

SEQ ID NO: 930638 - DNA, 25 bp, Mus musculus
gagcacttacagctgcttgaggaag

SEQ ID NO: 930639 - DNA, 25 bp, Mus musculus
gagcacttggaatcacagcagaaac

SEQ ID NO: 930640 - DNA, 25 bp, Mus musculus
gagcacttggaatcacagcagcaga

SEQ ID NO: 930641 - DNA, 25 bp, Mus musculus
gagcacttggaatctcagcagaaac

SEQ ID NO: 930642 - DNA, 25 bp, Mus musculus
gagcacttggaatctcagcagcaga

SEQ ID NO: 930643 - DNA, 25 bp, Mus musculus
gagcactttgaagacaattgttgtg

SEQ ID NO: 930644 - DNA, 25 bp, Mus musculus
gagcactttgaagacgtgtgagtgt

SEQ ID NO: 930645 - DNA, 25 bp, Mus musculus
gagcactttgaagagaattgttgtg

SEQ ID NO: 930646 - DNA, 25 bp, Mus musculus
gagcactttgaagaggtgtgagtgt

SEQ ID NO: 930647 - DNA, 25 bp, Mus musculus
gagcagaaagctcgaattactttta

SEQ ID NO: 930648 - DNA, 25 bp, Mus musculus
gagcagaaagctggaattactttta

SEQ ID NO: 930649 - DNA, 25 bp, Mus musculus
gagcagaagcagcttcgtcatacta

SEQ ID NO: 930650 - DNA, 25 bp, Mus musculus
gagcagaagcaggttcgtcatacta

SEQ ID NO: 930651 - DNA, 25 bp, Mus musculus
gagcagaagtcacaaattacacttg

SEQ ID NO: 930652 - DNA, 25 bp, Mus musculus
gagcagaagtcagaaattacacttg

SEQ ID NO: 930653 - DNA, 25 bp, Mus musculus
gagcagaatgatttccagagcagga

SEQ ID NO: 930654 - DNA, 25 bp, Mus musculus
gagcagaatgttttccagagcagga

SEQ ID NO: 930655 - DNA, 25 bp, Mus musculus
gagcagacaagacgctttcctggaa

SEQ ID NO: 930656 - DNA, 25 bp, Mus musculus
gagcagacaagaggctttcctggaa

SEQ ID NO: 930657 - DNA, 25 bp, Mus musculus
gagcagacagagagctgcagaaatc

SEQ ID NO: 930658 - DNA, 25 bp, Mus musculus
gagcagacagagtgctgcagaaatc

SEQ ID NO: 930659 - DNA, 25 bp, Mus musculus
gagcagacatcacaaaccttacaat

SEQ ID NO: 930660 - DNA, 25 bp, Mus musculus
gagcagacatcacaaagcacaatgg

SEQ ID NO: 930661 - DNA, 25 bp, Mus musculus
gagcagacatcacataatggaggtg

SEQ ID NO: 930662 - DNA, 25 bp, Mus musculus
gagcagacatcagaaaccttacaat

SEQ ID NO: 930663 - DNA, 25 bp, Mus musculus
gagcagacatcagaaagcacaatgg

SEQ ID NO: 930664 - DNA, 25 bp, Mus musculus
gagcagacatcagataatggaggtg

SEQ ID NO: 930665 - DNA, 25 bp, Mus musculus
gagcagagaatgaacgccgcagaga

SEQ ID NO: 930666 - DNA, 25 bp, Mus musculus
gagcagagaatgaaggccgcagaga

SEQ ID NO: 930667 - DNA, 25 bp, Mus musculus
gagcagagagagctctggaagcgct

SEQ ID NO: 930668 - DNA, 25 bp, Mus musculus
gagcagagagaggtctggaagcgct

SEQ ID NO: 930669 - DNA, 25 bp, Mus musculus
gagcagagcacacaggctcctccaa

SEQ ID NO: 930670 - DNA, 25 bp, Mus musculus
gagcagagcacagaggctcctccaa

SEQ ID NO: 930671 - DNA, 25 bp, Mus musculus
gagcagagcgatggaaagacgtcct

SEQ ID NO: 930672 - DNA, 25 bp, Mus musculus
gagcagagcgttggaaagacgtcct

SEQ ID NO: 930673 - DNA, 25 bp, Mus musculus
gagcagagtacacgagacagacagt

SEQ ID NO: 930674 - DNA, 25 bp, Mus musculus
gagcagagtacaggagacagacagt

SEQ ID NO: 930675 - DNA, 25 bp, Mus musculus
gagcagatagagacacaggtggcca

SEQ ID NO: 930676 - DNA, 25 bp, Mus musculus
gagcagatagagactcaggtggcca

SEQ ID NO: 930677 - DNA, 25 bp, Mus musculus
gagcagatcaatcaaattggagatc

SEQ ID NO: 930678 - DNA, 25 bp, Mus musculus
gagcagatcaatgaaattggagatc

SEQ ID NO: 930679 - DNA, 25 bp, Mus musculus
gagcagatcagaaacgattacacca

SEQ ID NO: 930680 - DNA, 25 bp, Mus musculus
gagcagatcagaaaggattacacca

SEQ ID NO: 930681 - DNA, 25 bp, Mus musculus
gagcagatccagaaagtccaggtgg

SEQ ID NO: 930682 - DNA, 25 bp, Mus musculus
gagcagatccagtaagtccaggtgg

SEQ ID NO: 930683 - DNA, 25 bp, Mus musculus
gagcagatctcagacatttcattgt

SEQ ID NO: 930684 - DNA, 25 bp, Mus musculus
gagcagatctcagagatttcattgt

SEQ ID NO: 930685 - DNA, 25 bp, Mus musculus
gagcagatggcatgagccggcaggt

SEQ ID NO: 930686 - DNA, 25 bp, Mus musculus
gagcagatgggatgagccggcaggt

SEQ ID NO: 930687 - DNA, 25 bp, Mus musculus
gagcagatgtagatcatcctatcta

SEQ ID NO: 930688 - DNA, 25 bp, Mus musculus
gagcagatgtagttcatcctatcta

SEQ ID NO: 930689 - DNA, 25 bp, Mus musculus
gagcagattgctcaattcaaggaag

SEQ ID NO: 930690 - DNA, 25 bp, Mus musculus
gagcagattgctgaattcaaggaag

SEQ ID NO: 930691 - DNA, 25 bp, Mus musculus
gagcagcaagagaacaaactcacag

SEQ ID NO: 930692 - DNA, 25 bp, Mus musculus
gagcagcaagagtacaaactcacag

SEQ ID NO: 930693 - DNA, 25 bp, Mus musculus
gagcagcaagcgcatgcagctggaa

SEQ ID NO: 930694 - DNA, 25 bp, Mus musculus
gagcagcaagggcatgcagctggaa

SEQ ID NO: 930695 - DNA, 25 bp, Mus musculus
gagcagcagaggctcgactatgaga

SEQ ID NO: 930696 - DNA, 25 bp, Mus musculus
gagcagcagaggctggactatgaga

SEQ ID NO: 930697 - DNA, 25 bp, Mus musculus
gagcagcccaagcaggctccgcccc

SEQ ID NO: 930698 - DNA, 25 bp, Mus musculus
gagcagcccaaggaggctccgcccc

SEQ ID NO: 930699 - DNA, 25 bp, Mus musculus
gagcagccgaaccacccaagctctc

SEQ ID NO: 930700 - DNA, 25 bp, Mus musculus
gagcagccgaaccagccaagctctc

SEQ ID NO: 930701 - DNA, 25 bp, Mus musculus
gagcagcctgcggaatctatataac

SEQ ID NO: 930702 - DNA, 25 bp, Mus musculus
gagcagcctggggaatctatataac

SEQ ID NO: 930703 - DNA, 25 bp, Mus musculus
gagcagctcctgacaaacgtcctgg

SEQ ID NO: 930704 - DNA, 25 bp, Mus musculus
gagcagctcctgtcaaacgtcctgg

SEQ ID NO: 930705 - DNA, 25 bp, Mus musculus
gagcagctctgtcctgtattttcat

SEQ ID NO: 930706 - DNA, 25 bp, Mus musculus
gagcagctctgtcgtttgggctcag

SEQ ID NO: 930707 - DNA, 25 bp, Mus musculus
gagcagctctgtgctgtattttcat

SEQ ID NO: 930708 - DNA, 25 bp, Mus musculus
gagcagctctgtggtttgggctcag

SEQ ID NO: 930709 - DNA, 25 bp, Mus musculus
gagcagctgacacacctgaagagtg

SEQ ID NO: 930710 - DNA, 25 bp, Mus musculus
gagcagctgacacgattcagtttgc

SEQ ID NO: 930711 - DNA, 25 bp, Mus musculus
gagcagctgacagacctgaagagtg

SEQ ID NO: 930712 - DNA, 25 bp, Mus musculus
gagcagctgacaggattcagtttgc

SEQ ID NO: 930713 - DNA, 25 bp, Mus musculus
gagcagctgcagcacggctcatggc

SEQ ID NO: 930714 - DNA, 25 bp, Mus musculus
gagcagctgcagcagggctcatggc

SEQ ID NO: 930715 - DNA, 25 bp, Mus musculus
gagcagctggctaacaatgtgactg

SEQ ID NO: 930716 - DNA, 25 bp, Mus musculus
gagcagctggctaagaatgtgactg

SEQ ID NO: 930717 - DNA, 25 bp, Mus musculus
gagcagcttgcctatattgtcttca

SEQ ID NO: 930718 - DNA, 25 bp, Mus musculus
gagcagcttggctatattgtcttca

SEQ ID NO: 930719 - DNA, 25 bp, Mus musculus
gagcagcttgtgcacgatcagtatg

SEQ ID NO: 930720 - DNA, 25 bp, Mus musculus
gagcagcttgtgcaggatcagtatg

SEQ ID NO: 930721 - DNA, 25 bp, Mus musculus
gagcaggaaaaacacaggccagcaa

SEQ ID NO: 930722 - DNA, 25 bp, Mus musculus
gagcaggaaaaacagaggccagcaa

SEQ ID NO: 930723 - DNA, 25 bp, Mus musculus
gagcaggaacagcgtcaagtcctcc

SEQ ID NO: 930724 - DNA, 25 bp, Mus musculus
gagcaggaacagcgtttaatgtgga

SEQ ID NO: 930725 - DNA, 25 bp, Mus musculus
gagcaggaacagggtcaagtcctcc

SEQ ID NO: 930726 - DNA, 25 bp, Mus musculus
gagcaggaacagggtttaatgtgga

SEQ ID NO: 930727 - DNA, 25 bp, Mus musculus
gagcaggaagcggagaaggacatag

SEQ ID NO: 930728 - DNA, 25 bp, Mus musculus
gagcaggaaggggagaaggacatag

SEQ ID NO: 930729 - DNA, 25 bp, Mus musculus
gagcaggacaaacgcgtgtggctgg

SEQ ID NO: 930730 - DNA, 25 bp, Mus musculus
gagcaggacaaacgggtgtggctgg

SEQ ID NO: 930731 - DNA, 25 bp, Mus musculus
gagcaggagaagagtatcgatgatg

SEQ ID NO: 930732 - DNA, 25 bp, Mus musculus
gagcaggagaagtgtatcgatgatg

SEQ ID NO: 930733 - DNA, 25 bp, Mus musculus
gagcaggagagcctgaaagagttcc

SEQ ID NO: 930734 - DNA, 25 bp, Mus musculus
gagcaggagagcgtgaaagagttcc

SEQ ID NO: 930735 - DNA, 25 bp, Mus musculus
gagcaggaggacgacgtgctgctgg

SEQ ID NO: 930736 - DNA, 25 bp, Mus musculus
gagcaggaggacgaggtgctgctgg

SEQ ID NO: 930737 - DNA, 25 bp, Mus musculus
gagcaggccatgcacctcgtgaaga

SEQ ID NO: 930738 - DNA, 25 bp, Mus musculus
gagcaggccatggacctcgtgaaga

SEQ ID NO: 930739 - DNA, 25 bp, Mus musculus
gagcaggcggcactgtcctgtgcag

SEQ ID NO: 930740 - DNA, 25 bp, Mus musculus
gagcaggcgggactgtcctgtgcag

SEQ ID NO: 930741 - DNA, 25 bp, Mus musculus
gagcaggctggacgtctttgcaaga

SEQ ID NO: 930742 - DNA, 25 bp, Mus musculus
gagcaggctggaggtctttgcaaga

SEQ ID NO: 930743 - DNA, 25 bp, Mus musculus
gagcaggctgtatgcgtctgacaga

SEQ ID NO: 930744 - DNA, 25 bp, Mus musculus
gagcaggctgtatgggtctgacaga

SEQ ID NO: 930745 - DNA, 25 bp, Mus musculus
gagcagggaaagcacatgatgctgc

SEQ ID NO: 930746 - DNA, 25 bp, Mus musculus
gagcagggaaagcagatgatgctgc

SEQ ID NO: 930747 - DNA, 25 bp, Mus musculus
gagcagggagatggcggtaaatgat

SEQ ID NO: 930748 - DNA, 25 bp, Mus musculus
gagcagggagttggcggtaaatgat

SEQ ID NO: 930749 - DNA, 25 bp, Mus musculus
gagcagggccagagctgagcagcgg

SEQ ID NO: 930750 - DNA, 25 bp, Mus musculus
gagcagggccagatgtagtgctgag

SEQ ID NO: 930751 - DNA, 25 bp, Mus musculus
gagcagggccagtgctgagcagcgg

SEQ ID NO: 930752 - DNA, 25 bp, Mus musculus
gagcagggccagttgtagtgctgag

SEQ ID NO: 930753 - DNA, 25 bp, Mus musculus
gagcaggggcctcacatcgaccaaa

SEQ ID NO: 930754 - DNA, 25 bp, Mus musculus
gagcaggggcctcacgtggatgaaa

SEQ ID NO: 930755 - DNA, 25 bp, Mus musculus
gagcaggggcctcagatcgaccaaa

SEQ ID NO: 930756 - DNA, 25 bp, Mus musculus
gagcaggggcctcaggtggatgaaa

SEQ ID NO: 930757 - DNA, 25 bp, Mus musculus
gagcaggggggacatcgcatttttg

SEQ ID NO: 930758 - DNA, 25 bp, Mus musculus
gagcaggggggagatcgcatttttg

SEQ ID NO: 930759 - DNA, 25 bp, Mus musculus
gagcaggtaaagaaccaaatatgcc

SEQ ID NO: 930760 - DNA, 25 bp, Mus musculus
gagcaggtaaagtaccaaatatgcc

SEQ ID NO: 930761 - DNA, 25 bp, Mus musculus
gagcagtccgcacgtctttggccag

SEQ ID NO: 930762 - DNA, 25 bp, Mus musculus
gagcagtccgcaggtctttggccag

SEQ ID NO: 930763 - DNA, 25 bp, Mus musculus
gagcagtctcatggagccagatcct

SEQ ID NO: 930764 - DNA, 25 bp, Mus musculus
gagcagtctcttggagccagatcct

SEQ ID NO: 930765 - DNA, 25 bp, Mus musculus
gagcagtcttctctcgaaacccagg

SEQ ID NO: 930766 - DNA, 25 bp, Mus musculus
gagcagtcttctctggaaacccagg

SEQ ID NO: 930767 - DNA, 25 bp, Mus musculus
gagcagtgagcagtgggagacattt

SEQ ID NO: 930768 - DNA, 25 bp, Mus musculus
gagcagtgagcataccgctattgtg

SEQ ID NO: 930769 - DNA, 25 bp, Mus musculus
gagcagtgaggagtgggagacattt

SEQ ID NO: 930770 - DNA, 25 bp, Mus musculus
gagcagtgaggataccgctattgtg

SEQ ID NO: 930771 - DNA, 25 bp, Mus musculus
gagcagtgggagaaagatgatgaca

SEQ ID NO: 930772 - DNA, 25 bp, Mus musculus
gagcagtgggagtaagatgatgaca

SEQ ID NO: 930773 - DNA, 25 bp, Mus musculus
gagcagtgggtggacgtggaacgca

SEQ ID NO: 930774 - DNA, 25 bp, Mus musculus
gagcagtgggtggaggtggaacgca

SEQ ID NO: 930775 - DNA, 25 bp, Mus musculus
gagcagttagccgtgaatcaagtca

SEQ ID NO: 930776 - DNA, 25 bp, Mus musculus
gagcagttaggcgtgaatcaagtca

SEQ ID NO: 930777 - DNA, 25 bp, Mus musculus
gagcagttcaaacacctctatgaac

SEQ ID NO: 930778 - DNA, 25 bp, Mus musculus
gagcagttcaaacagctctatgaac

SEQ ID NO: 930779 - DNA, 25 bp, Mus musculus
gagcagttccgtcacgtatctacag

SEQ ID NO: 930780 - DNA, 25 bp, Mus musculus
gagcagttccgtcaggtatctacag

SEQ ID NO: 930781 - DNA, 25 bp, Mus musculus
gagcagttctctgaagccagccagc

SEQ ID NO: 930782 - DNA, 25 bp, Mus musculus
gagcagttctgtgaagccagccagc

SEQ ID NO: 930783 - DNA, 25 bp, Mus musculus
gagcagtttatccccagccggcgat

SEQ ID NO: 930784 - DNA, 25 bp, Mus musculus
gagcagtttatcccgagccggcgat

SEQ ID NO: 930785 - DNA, 25 bp, Mus musculus
gagcataaatgagacgactgcctgg

SEQ ID NO: 930786 - DNA, 25 bp, Mus musculus
gagcataaatgagaggactgcctgg

SEQ ID NO: 930787 - DNA, 25 bp, Mus musculus
gagcatatgctgatcctgggcataa

SEQ ID NO: 930788 - DNA, 25 bp, Mus musculus
gagcatatgctgttcctgggcataa

SEQ ID NO: 930789 - DNA, 25 bp, Mus musculus
gagcatcacgaaagccactttccaa

SEQ ID NO: 930790 - DNA, 25 bp, Mus musculus
gagcatcacgaaatagatatgattg

SEQ ID NO: 930791 - DNA, 25 bp, Mus musculus
gagcatcacgaatgccactttccaa

SEQ ID NO: 930792 - DNA, 25 bp, Mus musculus
gagcatcacgccagtagaaatagat

SEQ ID NO: 930793 - DNA, 25 bp, Mus musculus
gagcatcacggcagtagaaatagat

SEQ ID NO: 930794 - DNA, 25 bp, Mus musculus
gagcatcacgtaatagatatgattg

SEQ ID NO: 930795 - DNA, 25 bp, Mus musculus
gagcatccagagtatccagagtgtg

SEQ ID NO: 930796 - DNA, 25 bp, Mus musculus
gagcatccagtgtatccagagtgtg

SEQ ID NO: 930797 - DNA, 25 bp, Mus musculus
gagcatccgtgacgtatttgaatat

SEQ ID NO: 930798 - DNA, 25 bp, Mus musculus
gagcatccgtgaggtatttgaatat

SEQ ID NO: 930799 - DNA, 25 bp, Mus musculus
gagcatcgagcgcctgtaccacaca

SEQ ID NO: 930800 - DNA, 25 bp, Mus musculus
gagcatcgagggcctgtaccacaca

SEQ ID NO: 930801 - DNA, 25 bp, Mus musculus
gagcatctacttacggctggcccgc

SEQ ID NO: 930802 - DNA, 25 bp, Mus musculus
gagcatctacttcagctgcgtgcag

SEQ ID NO: 930803 - DNA, 25 bp, Mus musculus
gagcatctacttgagctgcgtgcag

SEQ ID NO: 930804 - DNA, 25 bp, Mus musculus
gagcatctactttcggctggcccgc

SEQ ID NO: 930805 - DNA, 25 bp, Mus musculus
gagcatctcaagcaaaacgaagaga

SEQ ID NO: 930806 - DNA, 25 bp, Mus musculus
gagcatctcaagcccaagcagtagc

SEQ ID NO: 930807 - DNA, 25 bp, Mus musculus
gagcatctcaaggaaaacgaagaga

SEQ ID NO: 930808 - DNA, 25 bp, Mus musculus
gagcatctcaaggccaagcagtagc

SEQ ID NO: 930809 - DNA, 25 bp, Mus musculus
gagcatctcaggcaactttataaaa

SEQ ID NO: 930810 - DNA, 25 bp, Mus musculus
gagcatctcagggaactttataaaa

SEQ ID NO: 930811 - DNA, 25 bp, Mus musculus
gagcatctctcgctctatgccgtgg

SEQ ID NO: 930812 - DNA, 25 bp, Mus musculus
gagcatctctcggtctatgccgtgg

SEQ ID NO: 930813 - DNA, 25 bp, Mus musculus
gagcatgaagactccgtggtttccg

SEQ ID NO: 930814 - DNA, 25 bp, Mus musculus
gagcatgaagagggccaatccgagc

SEQ ID NO: 930815 - DNA, 25 bp, Mus musculus
gagcatgaagcgcgttttttctatc

SEQ ID NO: 930816 - DNA, 25 bp, Mus musculus
gagcatgaagggcgttttttctatc

SEQ ID NO: 930817 - DNA, 25 bp, Mus musculus
gagcatgaagtctccgtggtttccg

SEQ ID NO: 930818 - DNA, 25 bp, Mus musculus
gagcatgaagtgggccaatccgagc

SEQ ID NO: 930819 - DNA, 25 bp, Mus musculus
gagcatgagcggcacgagcgagagg

SEQ ID NO: 930820 - DNA, 25 bp, Mus musculus
gagcatgagcggcaggagcgagagg

SEQ ID NO: 930821 - DNA, 25 bp, Mus musculus
gagcatgcgttgccatctctgggga

SEQ ID NO: 930822 - DNA, 25 bp, Mus musculus
gagcatgcgttggcatctctgggga

SEQ ID NO: 930823 - DNA, 25 bp, Mus musculus
gagcatgggtcacgttttctactat

SEQ ID NO: 930824 - DNA, 25 bp, Mus musculus
gagcatgggtcaggttttctactat

SEQ ID NO: 930825 - DNA, 25 bp, Mus musculus
gagcatggtccacgattgaggctaa

SEQ ID NO: 930826 - DNA, 25 bp, Mus musculus
gagcatggtccaggattgaggctaa

SEQ ID NO: 930827 - DNA, 25 bp, Mus musculus
gagcatggtgtggtcgttggagcct

SEQ ID NO: 930828 - DNA, 25 bp, Mus musculus
gagcatggtgtggtggttggagcct

SEQ ID NO: 930829 - DNA, 25 bp, Mus musculus
gagcattgacatagcctcgttcagg

SEQ ID NO: 930830 - DNA, 25 bp, Mus musculus
gagcattgacatagcgaacgtctag

SEQ ID NO: 930831 - DNA, 25 bp, Mus musculus
gagcattgacataggctcgttcagg

SEQ ID NO: 930832 - DNA, 25 bp, Mus musculus
gagcattgacatagggaacgtctag

SEQ ID NO: 930833 - DNA, 25 bp, Mus musculus
gagcatttgagacacttccgacgag

SEQ ID NO: 930834 - DNA, 25 bp, Mus musculus
gagcatttgagacagttccgacgag

SEQ ID NO: 930835 - DNA, 25 bp, Mus musculus
gagcatttgtggcacacagagatag

SEQ ID NO: 930836 - DNA, 25 bp, Mus musculus
gagcatttgtgggacacagagatag

SEQ ID NO: 930837 - DNA, 25 bp, Mus musculus
gagcattttaataagaagatagaaa

SEQ ID NO: 930838 - DNA, 25 bp, Mus musculus
gagcattttattaagaagatagaaa

SEQ ID NO: 930839 - DNA, 25 bp, Mus musculus
gagcattttgagaaagcaattgagc

SEQ ID NO: 930840 - DNA, 25 bp, Mus musculus
gagcattttgagcttttctctgtgt

SEQ ID NO: 930841 - DNA, 25 bp, Mus musculus
gagcattttgaggttttctctgtgt

SEQ ID NO: 930842 - DNA, 25 bp, Mus musculus
gagcattttgagtaagcaattgagc

SEQ ID NO: 930843 - DNA, 25 bp, Mus musculus
gagccaaacgagccacaatcatgtc

SEQ ID NO: 930844 - DNA, 25 bp, Mus musculus
gagccaaacgtgccacaatcatgtc

SEQ ID NO: 930845 - DNA, 25 bp, Mus musculus
gagccaacaacccagagcagaaccg

SEQ ID NO: 930846 - DNA, 25 bp, Mus musculus
gagccaacaagccagagcagaaccg

SEQ ID NO: 930847 - DNA, 25 bp, Mus musculus
gagccaagagagaagaacaatccag

SEQ ID NO: 930848 - DNA, 25 bp, Mus musculus
gagccaagagctatgagccagaatt

SEQ ID NO: 930849 - DNA, 25 bp, Mus musculus
gagccaagaggtatgagccagaatt

SEQ ID NO: 930850 - DNA, 25 bp, Mus musculus
gagccaagagtgaagaacaatccag

SEQ ID NO: 930851 - DNA, 25 bp, Mus musculus
gagccaagctgtgccgatgccggga

SEQ ID NO: 930852 - DNA, 25 bp, Mus musculus
gagccaagctgtgcggatgccggga

SEQ ID NO: 930853 - DNA, 25 bp, Mus musculus
gagccacaaaatgcggttgccaata

SEQ ID NO: 930854 - DNA, 25 bp, Mus musculus
gagccacaaactcctgcttcctgac

SEQ ID NO: 930855 - DNA, 25 bp, Mus musculus
gagccacaaagtcctgcttcctgac

SEQ ID NO: 930856 - DNA, 25 bp, Mus musculus
gagccacaaatgctcgctaaaacgc

SEQ ID NO: 930857 - DNA, 25 bp, Mus musculus
gagccacaaatgctggctaaaacgc

SEQ ID NO: 930858 - DNA, 25 bp, Mus musculus
gagccacaaattgcggttgccaata

SEQ ID NO: 930859 - DNA, 25 bp, Mus musculus
gagccacacatgcatatcacaactc

SEQ ID NO: 930860 - DNA, 25 bp, Mus musculus
gagccacacatggatatcacaactc

SEQ ID NO: 930861 - DNA, 25 bp, Mus musculus
gagccacaggactgtgagtcacatt

SEQ ID NO: 930862 - DNA, 25 bp, Mus musculus
gagccacaggatcaaataacagtta

SEQ ID NO: 930863 - DNA, 25 bp, Mus musculus
gagccacaggatcatggcagtgaaa

SEQ ID NO: 930864 - DNA, 25 bp, Mus musculus
gagccacaggatgaaataacagtta

SEQ ID NO: 930865 - DNA, 25 bp, Mus musculus
gagccacaggatgatggcagtgaaa

SEQ ID NO: 930866 - DNA, 25 bp, Mus musculus
gagccacaggtctgtgagtcacatt

SEQ ID NO: 930867 - DNA, 25 bp, Mus musculus
gagccaccacagcttggcactgaat

SEQ ID NO: 930868 - DNA, 25 bp, Mus musculus
gagccaccacaggttggcactgaat

SEQ ID NO: 930869 - DNA, 25 bp, Mus musculus
gagccacgtaaacatggagaaatgg

SEQ ID NO: 930870 - DNA, 25 bp, Mus musculus
gagccacgtaaagatggagaaatgg

SEQ ID NO: 930871 - DNA, 25 bp, Mus musculus
gagccactgacgcaccagagtgagg

SEQ ID NO: 930872 - DNA, 25 bp, Mus musculus
gagccactgacggaccagagtgagg

SEQ ID NO: 930873 - DNA, 25 bp, Mus musculus
gagccagaaacatgaaggcctcatt

SEQ ID NO: 930874 - DNA, 25 bp, Mus musculus
gagccagaaacatgtaggcctcatt

SEQ ID NO: 930875 - DNA, 25 bp, Mus musculus
gagccagaagaaacctcagacagtg

SEQ ID NO: 930876 - DNA, 25 bp, Mus musculus
gagccagaagtaacctcagacagtg

SEQ ID NO: 930877 - DNA, 25 bp, Mus musculus
gagccagagttacacgaacgtcatc

SEQ ID NO: 930878 - DNA, 25 bp, Mus musculus
gagccagagttacaggaacgtcatc

SEQ ID NO: 930879 - DNA, 25 bp, Mus musculus
gagccagagttacgtgtcaagactc

SEQ ID NO: 930880 - DNA, 25 bp, Mus musculus
gagccagagttaggtgtcaagactc

SEQ ID NO: 930881 - DNA, 25 bp, Mus musculus
gagccagcaacgctatagaaaatga

SEQ ID NO: 930882 - DNA, 25 bp, Mus musculus
gagccagcaacggtatagaaaatga

SEQ ID NO: 930883 - DNA, 25 bp, Mus musculus
gagccagccctccgcttactggcag

SEQ ID NO: 930884 - DNA, 25 bp, Mus musculus
gagccagccctcggcttactggcag

SEQ ID NO: 930885 - DNA, 25 bp, Mus musculus
gagccagcggatgaagctacccagc

SEQ ID NO: 930886 - DNA, 25 bp, Mus musculus
gagccagcggttgaagctacccagc

SEQ ID NO: 930887 - DNA, 25 bp, Mus musculus
gagccagggaagggcaatgcgagca

SEQ ID NO: 930888 - DNA, 25 bp, Mus musculus
gagccagggatgggcaatgcgagca

SEQ ID NO: 930889 - DNA, 25 bp, Mus musculus
gagccaggtgtccgcggtgaagatg

SEQ ID NO: 930890 - DNA, 25 bp, Mus musculus
gagccaggtgtccggggtgaagatg

SEQ ID NO: 930891 - DNA, 25 bp, Mus musculus
gagccagtcagacggcgccagcgct

SEQ ID NO: 930892 - DNA, 25 bp, Mus musculus
gagccagtcagagggcgccagcgct

SEQ ID NO: 930893 - DNA, 25 bp, Mus musculus
gagccagttcaaccacatcatccat

SEQ ID NO: 930894 - DNA, 25 bp, Mus musculus
gagccagttctaccacatcatccat

SEQ ID NO: 930895 - DNA, 25 bp, Mus musculus
gagccataacctcaatgtagagtac

SEQ ID NO: 930896 - DNA, 25 bp, Mus musculus
gagccataacctgaatgtagagtac

SEQ ID NO: 930897 - DNA, 25 bp, Mus musculus
gagccatcaccccaaacaggccacc

SEQ ID NO: 930898 - DNA, 25 bp, Mus musculus
gagccatcacccgaaacaggccacc

SEQ ID NO: 930899 - DNA, 25 bp, Mus musculus
gagccatcccagcacccccaaaagg

SEQ ID NO: 930900 - DNA, 25 bp, Mus musculus
gagccatcccagcagccccaaaagg

SEQ ID NO: 930901 - DNA, 25 bp, Mus musculus
gagccatgagctattactacaaacg

SEQ ID NO: 930902 - DNA, 25 bp, Mus musculus
gagccatgaggtattactacaaacg

SEQ ID NO: 930903 - DNA, 25 bp, Mus musculus
gagccatgtacaaccaggcccaaca

SEQ ID NO: 930904 - DNA, 25 bp, Mus musculus
gagccatgtagaaccaggcccaaca

SEQ ID NO: 930905 - DNA, 25 bp, Mus musculus
gagccatgtctactttccgcctggc

SEQ ID NO: 930906 - DNA, 25 bp, Mus musculus
gagccatgtctagtttccgcctggc

SEQ ID NO: 930907 - DNA, 25 bp, Mus musculus
gagccatgtgaacacgaagatgaca

SEQ ID NO: 930908 - DNA, 25 bp, Mus musculus
gagccatgtgaacaggaagatgaca

SEQ ID NO: 930909 - DNA, 25 bp, Mus musculus
gagccattgctgcacgaaatgctgc

SEQ ID NO: 930910 - DNA, 25 bp, Mus musculus
gagccattgctgcaggaaatgctgc

SEQ ID NO: 930911 - DNA, 25 bp, Mus musculus
gagccatttcctcacgtgaagctgt

SEQ ID NO: 930912 - DNA, 25 bp, Mus musculus
gagccatttcctcaggtgaagctgt

SEQ ID NO: 930913 - DNA, 25 bp, Mus musculus
gagcccaatgaagtccgactggaac

SEQ ID NO: 930914 - DNA, 25 bp, Mus musculus
gagcccaatgtagtccgactggaac

SEQ ID NO: 930915 - DNA, 25 bp, Mus musculus
gagcccacacagcttcactatctgc

SEQ ID NO: 930916 - DNA, 25 bp, Mus musculus
gagcccacacaggttcactatctgc

SEQ ID NO: 930917 - DNA, 25 bp, Mus musculus
gagcccacatcaataagagcccggc

SEQ ID NO: 930918 - DNA, 25 bp, Mus musculus
gagcccacatcaattagagcccggc

SEQ ID NO: 930919 - DNA, 25 bp, Mus musculus
gagcccacgccgcgcttaagcgaca

SEQ ID NO: 930920 - DNA, 25 bp, Mus musculus
gagcccacgccgggcttaagcgaca

SEQ ID NO: 930921 - DNA, 25 bp, Mus musculus
gagcccagaagtagtttggaatgat

SEQ ID NO: 930922 - DNA, 25 bp, Mus musculus
gagcccagaagttgtttggaatgat

SEQ ID NO: 930923 - DNA, 25 bp, Mus musculus
gagcccagagaactgcctcctgaag

SEQ ID NO: 930924 - DNA, 25 bp, Mus musculus
gagcccagagtactgcctcctgaag

SEQ ID NO: 930925 - DNA, 25 bp, Mus musculus
gagcccaggaagcagactgagagtg

SEQ ID NO: 930926 - DNA, 25 bp, Mus musculus
gagcccaggaaggagactgagagtg

SEQ ID NO: 930927 - DNA, 25 bp, Mus musculus
gagcccagggaactggctacagatg

SEQ ID NO: 930928 - DNA, 25 bp, Mus musculus
gagcccagggaagtggctacagatg

SEQ ID NO: 930929 - DNA, 25 bp, Mus musculus
gagcccagtgaccaccctggcagcg

SEQ ID NO: 930930 - DNA, 25 bp, Mus musculus
gagcccagtgaccagcctggcagcg

SEQ ID NO: 930931 - DNA, 25 bp, Mus musculus
gagcccatggaaaagacgaagagag

SEQ ID NO: 930932 - DNA, 25 bp, Mus musculus
gagcccatggaatagacgaagagag

SEQ ID NO: 930933 - DNA, 25 bp, Mus musculus
gagcccatggagatcgtggaagggc

SEQ ID NO: 930934 - DNA, 25 bp, Mus musculus
gagcccatggagatggtggaagggc

SEQ ID NO: 930935 - DNA, 25 bp, Mus musculus
gagcccccaccaccttcccttcagg

SEQ ID NO: 930936 - DNA, 25 bp, Mus musculus
gagcccccaccagcttcccttcagg

SEQ ID NO: 930937 - DNA, 25 bp, Mus musculus
gagccccgagcacaggtgagccaga

SEQ ID NO: 930938 - DNA, 25 bp, Mus musculus
gagccccgagcaggacaggtgagcc

SEQ ID NO: 930939 - DNA, 25 bp, Mus musculus
gagccccgagcccttccagcaggac

SEQ ID NO: 930940 - DNA, 25 bp, Mus musculus
gagccccgagctcctctaatttcag

SEQ ID NO: 930941 - DNA, 25 bp, Mus musculus
gagccccgaggacaggtgagccaga

SEQ ID NO: 930942 - DNA, 25 bp, Mus musculus
gagccccgaggaggacaggtgagcc

SEQ ID NO: 930943 - DNA, 25 bp, Mus musculus
gagccccgaggccttccagcaggac

SEQ ID NO: 930944 - DNA, 25 bp, Mus musculus
gagccccgaggtcctctaatttcag

SEQ ID NO: 930945 - DNA, 25 bp, Mus musculus
gagccccggtacaggctccgtgttg

SEQ ID NO: 930946 - DNA, 25 bp, Mus musculus
gagccccggttcaggctccgtgttg

SEQ ID NO: 930947 - DNA, 25 bp, Mus musculus
gagcccctacccatcctcccaagtt

SEQ ID NO: 930948 - DNA, 25 bp, Mus musculus
gagcccctacccatgctcccaagtt

SEQ ID NO: 930949 - DNA, 25 bp, Mus musculus
gagcccctcctccacgtatgatggg

SEQ ID NO: 930950 - DNA, 25 bp, Mus musculus
gagcccctcctccaggtatgatggg

SEQ ID NO: 930951 - DNA, 25 bp, Mus musculus
gagcccctcgctcttcaaagcttca

SEQ ID NO: 930952 - DNA, 25 bp, Mus musculus
gagcccctcggtcttcaaagcttca

SEQ ID NO: 930953 - DNA, 25 bp, Mus musculus
gagcccctggcacgtgacggcttct

SEQ ID NO: 930954 - DNA, 25 bp, Mus musculus
gagcccctggcaggtgacggcttct

SEQ ID NO: 930955 - DNA, 25 bp, Mus musculus
gagccccttattatccattgggcag

SEQ ID NO: 930956 - DNA, 25 bp, Mus musculus
gagccccttattttccattgggcag

SEQ ID NO: 930957 - DNA, 25 bp, Mus musculus
gagcccgagaccctcagtgggccac

SEQ ID NO: 930958 - DNA, 25 bp, Mus musculus
gagcccgagaccgtcagtgggccac

SEQ ID NO: 930959 - DNA, 25 bp, Mus musculus
gagcccgcaactccgaaagcagctg

SEQ ID NO: 930960 - DNA, 25 bp, Mus musculus
gagcccgcaactgcgaaagcagctg

SEQ ID NO: 930961 - DNA, 25 bp, Mus musculus
gagcccgcctctcttgacagcattt

SEQ ID NO: 930962 - DNA, 25 bp, Mus musculus
gagcccgcctctgttgacagcattt

SEQ ID NO: 930963 - DNA, 25 bp, Mus musculus
gagccctcacatctttgctttgtcg

SEQ ID NO: 930964 - DNA, 25 bp, Mus musculus
gagccctcacatgtttgctttgtcg

SEQ ID NO: 930965 - DNA, 25 bp, Mus musculus
gagccctcagagagctcctggaagg

SEQ ID NO: 930966 - DNA, 25 bp, Mus musculus
gagccctcagagtgctcctggaagg

SEQ ID NO: 930967 - DNA, 25 bp, Mus musculus
gagccctccatgcacatagtcttga

SEQ ID NO: 930968 - DNA, 25 bp, Mus musculus
gagccctccatggacatagtcttga

SEQ ID NO: 930969 - DNA, 25 bp, Mus musculus
gagccctgagaaacagggtgctctt

SEQ ID NO: 930970 - DNA, 25 bp, Mus musculus
gagccctgagaaactgggtgctctt

SEQ ID NO: 930971 - DNA, 25 bp, Mus musculus
gagccctggacacgtttgcgcagtt

SEQ ID NO: 930972 - DNA, 25 bp, Mus musculus
gagccctggacaggtttgcgcagtt

SEQ ID NO: 930973 - DNA, 25 bp, Mus musculus
gagccctggggagactgctcagtta

SEQ ID NO: 930974 - DNA, 25 bp, Mus musculus
gagccctggggagagtgctcagtta

SEQ ID NO: 930975 - DNA, 25 bp, Mus musculus
gagccctgtgaacaagatgccctgg

SEQ ID NO: 930976 - DNA, 25 bp, Mus musculus
gagccctgtgaacatgatgccctgg

SEQ ID NO: 930977 - DNA, 25 bp, Mus musculus
gagccctgtgcacatttccctcagg

SEQ ID NO: 930978 - DNA, 25 bp, Mus musculus
gagccctgtgcacccttgtgacaga

SEQ ID NO: 930979 - DNA, 25 bp, Mus musculus
gagccctgtgcagatttccctcagg

SEQ ID NO: 930980 - DNA, 25 bp, Mus musculus
gagccctgtgcagccttgtgacaga

SEQ ID NO: 930981 - DNA, 25 bp, Mus musculus
gagccgacccagctctgtgcagacg

SEQ ID NO: 930982 - DNA, 25 bp, Mus musculus
gagccgacccaggtctgtgcagacg

SEQ ID NO: 930983 - DNA, 25 bp, Mus musculus
gagccgagccatgacgtattactac

SEQ ID NO: 930984 - DNA, 25 bp, Mus musculus
gagccgagccatgaggtattactac

SEQ ID NO: 930985 - DNA, 25 bp, Mus musculus
gagccgcaagccagcacccacctgc

SEQ ID NO: 930986 - DNA, 25 bp, Mus musculus
gagccgcaagccaggacccacctgc

SEQ ID NO: 930987 - DNA, 25 bp, Mus musculus
gagccgcagcggcgatgccgttctg

SEQ ID NO: 930988 - DNA, 25 bp, Mus musculus
gagccgcagcggggatgccgttctg

SEQ ID NO: 930989 - DNA, 25 bp, Mus musculus
gagccgcaggctagaggcagtcatg

SEQ ID NO: 930990 - DNA, 25 bp, Mus musculus
gagccgcagggtagaggcagtcatg

SEQ ID NO: 930991 - DNA, 25 bp, Mus musculus
gagccgccagcgccctccgtgacct

SEQ ID NO: 930992 - DNA, 25 bp, Mus musculus
gagccgccagcgccgtccgtgacct

SEQ ID NO: 930993 - DNA, 25 bp, Mus musculus
gagccgcccggacgtgcttgaggcg

SEQ ID NO: 930994 - DNA, 25 bp, Mus musculus
gagccgcccggaggtgcttgaggcg

SEQ ID NO: 930995 - DNA, 25 bp, Mus musculus
gagccgccgggacatgctgttgacg

SEQ ID NO: 930996 - DNA, 25 bp, Mus musculus
gagccgccgggagatgctgttgacg

SEQ ID NO: 930997 - DNA, 25 bp, Mus musculus
gagccgcgcgtgactccacagaggc

SEQ ID NO: 930998 - DNA, 25 bp, Mus musculus
gagccgcgcgtgtctccacagaggc

SEQ ID NO: 930999 - DNA, 25 bp, Mus musculus
gagccggagtccctctacagagagc

SEQ ID NO: 931000 - DNA, 25 bp, Mus musculus
gagccggagtccgtctacagagagc

SEQ ID NO: 931001 - DNA, 25 bp, Mus musculus
gagccggattcacgaggtggatgcc

SEQ ID NO: 931002 - DNA, 25 bp, Mus musculus
gagccggattcaggaggtggatgcc

SEQ ID NO: 931003 - DNA, 25 bp, Mus musculus
gagccggcgagacgttaattctcaa

SEQ ID NO: 931004 - DNA, 25 bp, Mus musculus
gagccggcgagaggttaattctcaa

SEQ ID NO: 931005 - DNA, 25 bp, Mus musculus
gagcctaaagaacatcaaactgaag

SEQ ID NO: 931006 - DNA, 25 bp, Mus musculus
gagcctaaagtacatcaaactgaag

SEQ ID NO: 931007 - DNA, 25 bp, Mus musculus
gagcctacccgacacgaaggtctat

SEQ ID NO: 931008 - DNA, 25 bp, Mus musculus
gagcctacccgacaggaaggtctat

SEQ ID NO: 931009 - DNA, 25 bp, Mus musculus
gagcctatgaagcaaccacatgaaa

SEQ ID NO: 931010 - DNA, 25 bp, Mus musculus
gagcctatgaaggaaccacatgaaa

SEQ ID NO: 931011 - DNA, 25 bp, Mus musculus
gagcctatgatgcgaaaattaaagt

SEQ ID NO: 931012 - DNA, 25 bp, Mus musculus
gagcctatgatgggaaaattaaagt

SEQ ID NO: 931013 - DNA, 25 bp, Mus musculus
gagcctccttcacgcctcaggcttg

SEQ ID NO: 931014 - DNA, 25 bp, Mus musculus
gagcctccttcaggcctcaggcttg

SEQ ID NO: 931015 - DNA, 25 bp, Mus musculus
gagcctctacagaaatgatgggctc

SEQ ID NO: 931016 - DNA, 25 bp, Mus musculus
gagcctctacagtaatgatgggctc

SEQ ID NO: 931017 - DNA, 25 bp, Mus musculus
gagcctcttaagctcattttcttgg

SEQ ID NO: 931018 - DNA, 25 bp, Mus musculus
gagcctcttaaggtcattttcttgg

SEQ ID NO: 931019 - DNA, 25 bp, Mus musculus
gagcctgaaaaaaacattgccctag

SEQ ID NO: 931020 - DNA, 25 bp, Mus musculus
gagcctgaaaaatacattgccctag

SEQ ID NO: 931021 - DNA, 25 bp, Mus musculus
gagcctgaacagagagctgaaatta

SEQ ID NO: 931022 - DNA, 25 bp, Mus musculus
gagcctgaacagtgagctgaaatta

SEQ ID NO: 931023 - DNA, 25 bp, Mus musculus
gagcctgcgaagatctgctcacaaa

SEQ ID NO: 931024 - DNA, 25 bp, Mus musculus
gagcctgcgaagttctgctcacaaa

SEQ ID NO: 931025 - DNA, 25 bp, Mus musculus
gagcctgcgcaacggcaaagagccc

SEQ ID NO: 931026 - DNA, 25 bp, Mus musculus
gagcctgcgcaagggcaaagagccc

SEQ ID NO: 931027 - DNA, 25 bp, Mus musculus
gagcctgctcaccgtgtccctggat

SEQ ID NO: 931028 - DNA, 25 bp, Mus musculus
gagcctgctcacggtgtccctggat

SEQ ID NO: 931029 - DNA, 25 bp, Mus musculus
gagcctggagtaaccggactgcaag

SEQ ID NO: 931030 - DNA, 25 bp, Mus musculus
gagcctggagtaacgggactgcaag

SEQ ID NO: 931031 - DNA, 25 bp, Mus musculus
gagcctggtcagccagtccctcgag

SEQ ID NO: 931032 - DNA, 25 bp, Mus musculus
gagcctggtcagctgaaagcagcca

SEQ ID NO: 931033 - DNA, 25 bp, Mus musculus
gagcctggtcaggcagtccctcgag

SEQ ID NO: 931034 - DNA, 25 bp, Mus musculus
gagcctggtcaggtgaaagcagcca

SEQ ID NO: 931035 - DNA, 25 bp, Mus musculus
gagcctgtgacccacagcagagggg

SEQ ID NO: 931036 - DNA, 25 bp, Mus musculus
gagcctgtgacccacaggggcaggc

SEQ ID NO: 931037 - DNA, 25 bp, Mus musculus
gagcctgtgacccagagcagagggg

SEQ ID NO: 931038 - DNA, 25 bp, Mus musculus
gagcctgtgacccagaggggcaggc

SEQ ID NO: 931039 - DNA, 25 bp, Mus musculus
gagccttcagcacgatttattctgc

SEQ ID NO: 931040 - DNA, 25 bp, Mus musculus
gagccttcaggacgatttattctgc

SEQ ID NO: 931041 - DNA, 25 bp, Mus musculus
gagccttccagatacattgacatca

SEQ ID NO: 931042 - DNA, 25 bp, Mus musculus
gagccttccagatacgtcttccaag

SEQ ID NO: 931043 - DNA, 25 bp, Mus musculus
gagccttccagatagattgacatca

SEQ ID NO: 931044 - DNA, 25 bp, Mus musculus
gagccttccagataggtcttccaag

SEQ ID NO: 931045 - DNA, 25 bp, Mus musculus
gagccttcgagacgtgctgagcttg

SEQ ID NO: 931046 - DNA, 25 bp, Mus musculus
gagccttcgagaggtgctgagcttg

SEQ ID NO: 931047 - DNA, 25 bp, Mus musculus
gagccttctcctcaaacactgtgcc

SEQ ID NO: 931048 - DNA, 25 bp, Mus musculus
gagccttctcctgaaacactgtgcc

SEQ ID NO: 931049 - DNA, 25 bp, Mus musculus
gagcctttcctgaacatgatccatg

SEQ ID NO: 931050 - DNA, 25 bp, Mus musculus
gagcctttcctgaagatgatccatg

SEQ ID NO: 931051 - DNA, 25 bp, Mus musculus
gagcgaagcaaagactactccattg

SEQ ID NO: 931052 - DNA, 25 bp, Mus musculus
gagcgaagcaaagagtactccattg

SEQ ID NO: 931053 - DNA, 25 bp, Mus musculus
gagcgacaagctaaaagaagaaatg

SEQ ID NO: 931054 - DNA, 25 bp, Mus musculus
gagcgacaaggtaaaagaagaaatg

SEQ ID NO: 931055 - DNA, 25 bp, Mus musculus
gagcgacaccagcagcatcacgatg

SEQ ID NO: 931056 - DNA, 25 bp, Mus musculus
gagcgacaccaggagcatcacgatg

SEQ ID NO: 931057 - DNA, 25 bp, Mus musculus
gagcgacaggagctgaacatcccgg

SEQ ID NO: 931058 - DNA, 25 bp, Mus musculus
gagcgacaggaggtgaacatcccgg

SEQ ID NO: 931059 - DNA, 25 bp, Mus musculus
gagcgacatgagctagccaagttta

SEQ ID NO: 931060 - DNA, 25 bp, Mus musculus
gagcgacatgaggtagccaagttta

SEQ ID NO: 931061 - DNA, 25 bp, Mus musculus
gagcgaccggctcatgtaggaaatt

SEQ ID NO: 931062 - DNA, 25 bp, Mus musculus
gagcgaccgggtcatgtaggaaatt

SEQ ID NO: 931063 - DNA, 25 bp, Mus musculus
gagcgactccagcaaactaatcact

SEQ ID NO: 931064 - DNA, 25 bp, Mus musculus
gagcgactccaggaaactaatcact

SEQ ID NO: 931065 - DNA, 25 bp, Mus musculus
gagcgactgcatcgtcaacgtgtgg

SEQ ID NO: 931066 - DNA, 25 bp, Mus musculus
gagcgactgcttcgtcaacgtgtgg

SEQ ID NO: 931067 - DNA, 25 bp, Mus musculus
gagcgagacagggacgcacagctgg

SEQ ID NO: 931068 - DNA, 25 bp, Mus musculus
gagcgagacagggaggcacagctgg

SEQ ID NO: 931069 - DNA, 25 bp, Mus musculus
gagcgagcccagcaggaagatgcat

SEQ ID NO: 931070 - DNA, 25 bp, Mus musculus
gagcgagcccagccaagaagacagc

SEQ ID NO: 931071 - DNA, 25 bp, Mus musculus
gagcgagcccaggaggaagatgcat

SEQ ID NO: 931072 - DNA, 25 bp, Mus musculus
gagcgagcccaggcaagaagacagc

SEQ ID NO: 931073 - DNA, 25 bp, Mus musculus
gagcgaggactgcaagctaccttgc

SEQ ID NO: 931074 - DNA, 25 bp, Mus musculus
gagcgaggactgcaagctgccctgc

SEQ ID NO: 931075 - DNA, 25 bp, Mus musculus
gagcgaggactgcatgctaccttgc

SEQ ID NO: 931076 - DNA, 25 bp, Mus musculus
gagcgaggactgcatgctgccctgc

SEQ ID NO: 931077 - DNA, 25 bp, Mus musculus
gagcgaggagacgagcaaaaatcaa

SEQ ID NO: 931078 - DNA, 25 bp, Mus musculus
gagcgaggagacgccaatggctgca

SEQ ID NO: 931079 - DNA, 25 bp, Mus musculus
gagcgaggagagacgccaatggctg

SEQ ID NO: 931080 - DNA, 25 bp, Mus musculus
gagcgaggagctggaagatatcaac

SEQ ID NO: 931081 - DNA, 25 bp, Mus musculus
gagcgaggaggtggaagatatcaac

SEQ ID NO: 931082 - DNA, 25 bp, Mus musculus
gagcgaggagtcgagcaaaaatcaa

SEQ ID NO: 931083 - DNA, 25 bp, Mus musculus
gagcgaggagtcgccaatggctgca

SEQ ID NO: 931084 - DNA, 25 bp, Mus musculus
gagcgaggagtgacgccaatggctg

SEQ ID NO: 931085 - DNA, 25 bp, Mus musculus
gagcgaggcccacgtgatgctggcg

SEQ ID NO: 931086 - DNA, 25 bp, Mus musculus
gagcgaggcccaggtgatgctggcg

SEQ ID NO: 931087 - DNA, 25 bp, Mus musculus
gagcgaggcgagccaccatgacaac

SEQ ID NO: 931088 - DNA, 25 bp, Mus musculus
gagcgaggcgagcgtgcacagtgct

SEQ ID NO: 931089 - DNA, 25 bp, Mus musculus
gagcgaggcgaggcaccatgacaac

SEQ ID NO: 931090 - DNA, 25 bp, Mus musculus
gagcgaggcgagggtgcacagtgct

SEQ ID NO: 931091 - DNA, 25 bp, Mus musculus
gagcgatatctgaacggcgagaatc

SEQ ID NO: 931092 - DNA, 25 bp, Mus musculus
gagcgatatctgaagggcgagaatc

SEQ ID NO: 931093 - DNA, 25 bp, Mus musculus
gagcgcacagattccagagtatgat

SEQ ID NO: 931094 - DNA, 25 bp, Mus musculus
gagcgcacagtttccagagtatgat

SEQ ID NO: 931095 - DNA, 25 bp, Mus musculus
gagcgcaggcagtactacgagggcc

SEQ ID NO: 931096 - DNA, 25 bp, Mus musculus
gagcgcaggctgtactacgagggcc

SEQ ID NO: 931097 - DNA, 25 bp, Mus musculus
gagcgcatacagagcaagacctatg

SEQ ID NO: 931098 - DNA, 25 bp, Mus musculus
gagcgcatacagtgcaagacctatg

SEQ ID NO: 931099 - DNA, 25 bp, Mus musculus
gagcgccctcagttgagccccacat

SEQ ID NO: 931100 - DNA, 25 bp, Mus musculus
gagcgccctctgttgagccccacat

SEQ ID NO: 931101 - DNA, 25 bp, Mus musculus
gagcgccctgccaacattttcacct

SEQ ID NO: 931102 - DNA, 25 bp, Mus musculus
gagcgccctgccaagattttcacct

SEQ ID NO: 931103 - DNA, 25 bp, Mus musculus
gagcgcgtgcgggtctggtacaagc

SEQ ID NO: 931104 - DNA, 25 bp, Mus musculus
gagcgcgtgcgggtgtggtacaagc

SEQ ID NO: 931105 - DNA, 25 bp, Mus musculus
gagcgctcagctgcagagatcggcc

SEQ ID NO: 931106 - DNA, 25 bp, Mus musculus
gagcgctcaggtgcagagatcggcc

SEQ ID NO: 931107 - DNA, 25 bp, Mus musculus
gagcgcttagcagacaagcaatttc

SEQ ID NO: 931108 - DNA, 25 bp, Mus musculus
gagcgcttaggagacaagcaatttc

SEQ ID NO: 931109 - DNA, 25 bp, Mus musculus
gagcggaatagaggcaaacaggcca

SEQ ID NO: 931110 - DNA, 25 bp, Mus musculus
gagcggaatagagggaaacaggcca

SEQ ID NO: 931111 - DNA, 25 bp, Mus musculus
gagcggagagcgacatgtccttccg

SEQ ID NO: 931112 - DNA, 25 bp, Mus musculus
gagcggagagcgtcatgtccttccg

SEQ ID NO: 931113 - DNA, 25 bp, Mus musculus
gagcggagatatcgaaggagatggc

SEQ ID NO: 931114 - DNA, 25 bp, Mus musculus
gagcggagatatggaaggagatggc

SEQ ID NO: 931115 - DNA, 25 bp, Mus musculus
gagcggcaaaagagctttatggatt

SEQ ID NO: 931116 - DNA, 25 bp, Mus musculus
gagcggcaaaagagtgatagaagga

SEQ ID NO: 931117 - DNA, 25 bp, Mus musculus
gagcggcaaaagtgctttatggatt

SEQ ID NO: 931118 - DNA, 25 bp, Mus musculus
gagcggcaaaagtgtgatagaagga

SEQ ID NO: 931119 - DNA, 25 bp, Mus musculus
gagcggcatgagcgtcgagagggca

SEQ ID NO: 931120 - DNA, 25 bp, Mus musculus
gagcggcatgagggtcgagagggca

SEQ ID NO: 931121 - DNA, 25 bp, Mus musculus
gagcggccggaacatggcagacttt

SEQ ID NO: 931122 - DNA, 25 bp, Mus musculus
gagcggccggaacgagtggaatgtg

SEQ ID NO: 931123 - DNA, 25 bp, Mus musculus
gagcggccggaactgttactgtgac

SEQ ID NO: 931124 - DNA, 25 bp, Mus musculus
gagcggccggaagatggcagacttt

SEQ ID NO: 931125 - DNA, 25 bp, Mus musculus
gagcggccggaaggagtggaatgtg

SEQ ID NO: 931126 - DNA, 25 bp, Mus musculus
gagcggccggaagtgttactgtgac

SEQ ID NO: 931127 - DNA, 25 bp, Mus musculus
gagcggcgcctgaacgaactcatcg

SEQ ID NO: 931128 - DNA, 25 bp, Mus musculus
gagcggcgcctgaaggaactcatcg

SEQ ID NO: 931129 - DNA, 25 bp, Mus musculus
gagcggctgtatgtccacagccccg

SEQ ID NO: 931130 - DNA, 25 bp, Mus musculus
gagcggctgtatgtccagcacagcc

SEQ ID NO: 931131 - DNA, 25 bp, Mus musculus
gagcggctgtatgtcgacggatgac

SEQ ID NO: 931132 - DNA, 25 bp, Mus musculus
gagcggctgtatgtgcacagccccg

SEQ ID NO: 931133 - DNA, 25 bp, Mus musculus
gagcggctgtatgtgcagcacagcc

SEQ ID NO: 931134 - DNA, 25 bp, Mus musculus
gagcggctgtatgtggacggatgac

SEQ ID NO: 931135 - DNA, 25 bp, Mus musculus
gagcggcttccgccagctgtgccaa

SEQ ID NO: 931136 - DNA, 25 bp, Mus musculus
gagcggcttccggcagctgtgccaa

SEQ ID NO: 931137 - DNA, 25 bp, Mus musculus
gagcgggaagctaacaaactgaggc

SEQ ID NO: 931138 - DNA, 25 bp, Mus musculus
gagcgggaagctaagaaactgaggc

SEQ ID NO: 931139 - DNA, 25 bp, Mus musculus
gagcgggacgcaaacgaggaagcca

SEQ ID NO: 931140 - DNA, 25 bp, Mus musculus
gagcgggacgcaaaggaggaagcca

SEQ ID NO: 931141 - DNA, 25 bp, Mus musculus
gagcgggagagagacgcccagctga

SEQ ID NO: 931142 - DNA, 25 bp, Mus musculus
gagcgggagagagaggcccagctga

SEQ ID NO: 931143 - DNA, 25 bp, Mus musculus
gagcgggatgtgcatattctgaacc

SEQ ID NO: 931144 - DNA, 25 bp, Mus musculus
gagcgggatgtggatattctgaacc

SEQ ID NO: 931145 - DNA, 25 bp, Mus musculus
gagcgggccaagagcaaagcccaga

SEQ ID NO: 931146 - DNA, 25 bp, Mus musculus
gagcgggccaagcagagcaaagccc

SEQ ID NO: 931147 - DNA, 25 bp, Mus musculus
gagcgggccaaggagagcaaagccc

SEQ ID NO: 931148 - DNA, 25 bp, Mus musculus
gagcgggccaagtgcaaagcccaga

SEQ ID NO: 931149 - DNA, 25 bp, Mus musculus
gagcgggtgatccccatgaagagag

SEQ ID NO: 931150 - DNA, 25 bp, Mus musculus
gagcgggtgatcccgatgaagagag

SEQ ID NO: 931151 - DNA, 25 bp, Mus musculus
gagcggtcggggctcgtcaggacaa

SEQ ID NO: 931152 - DNA, 25 bp, Mus musculus
gagcggtcggggctggtcaggacaa

SEQ ID NO: 931153 - DNA, 25 bp, Mus musculus
gagcggtgagcgacatgtccttccg

SEQ ID NO: 931154 - DNA, 25 bp, Mus musculus
gagcggtgagcgtcatgtccttccg

SEQ ID NO: 931155 - DNA, 25 bp, Mus musculus
gagcggtttgccagcgcgacggaac

SEQ ID NO: 931156 - DNA, 25 bp, Mus musculus
gagcggtttgccagggcgacggaac

SEQ ID NO: 931157 - DNA, 25 bp, Mus musculus
gagcgtctcatgatggagagaagag

SEQ ID NO: 931158 - DNA, 25 bp, Mus musculus
gagcgtctcatgttggagagaagag

SEQ ID NO: 931159 - DNA, 25 bp, Mus musculus
gagcgtctcctacacaaagccacca

SEQ ID NO: 931160 - DNA, 25 bp, Mus musculus
gagcgtctcctagacaaagccacca

SEQ ID NO: 931161 - DNA, 25 bp, Mus musculus
gagcgtctggcacgtccaagggtag

SEQ ID NO: 931162 - DNA, 25 bp, Mus musculus
gagcgtctggcaggtccaagggtag

SEQ ID NO: 931163 - DNA, 25 bp, Mus musculus
gagcgtgatctccgagtcctccggg

SEQ ID NO: 931164 - DNA, 25 bp, Mus musculus
gagcgtgatctccggcaatggcagc

SEQ ID NO: 931165 - DNA, 25 bp, Mus musculus
gagcgtgatctcggagtcctccggg

SEQ ID NO: 931166 - DNA, 25 bp, Mus musculus
gagcgtgatctcgggcaatggcagc

SEQ ID NO: 931167 - DNA, 25 bp, Mus musculus
gagcgtgcagaacccgggaacctgg

SEQ ID NO: 931168 - DNA, 25 bp, Mus musculus
gagcgtgcagtacccgggaacctgg

SEQ ID NO: 931169 - DNA, 25 bp, Mus musculus
gagcgtgttctccccgacgagggat

SEQ ID NO: 931170 - DNA, 25 bp, Mus musculus
gagcgtgttctcccggacgagggat

SEQ ID NO: 931171 - DNA, 25 bp, Mus musculus
gagcgttcagagtgcagagaacacc

SEQ ID NO: 931172 - DNA, 25 bp, Mus musculus
gagcgttcagtgtgcagagaacacc

SEQ ID NO: 931173 - DNA, 25 bp, Mus musculus
gagcgttccagtggcgatggagaag

SEQ ID NO: 931174 - DNA, 25 bp, Mus musculus
gagcgttccagtggggatggagaag

SEQ ID NO: 931175 - DNA, 25 bp, Mus musculus
gagctaacagcacgaagaggaggtt

SEQ ID NO: 931176 - DNA, 25 bp, Mus musculus
gagctaacaggacgaagaggaggtt

SEQ ID NO: 931177 - DNA, 25 bp, Mus musculus
gagctaagccagtgcgagtgtgcag

SEQ ID NO: 931178 - DNA, 25 bp, Mus musculus
gagctaagccagtgggagtgtgcag

SEQ ID NO: 931179 - DNA, 25 bp, Mus musculus
gagctaaggagccacagccagtcct

SEQ ID NO: 931180 - DNA, 25 bp, Mus musculus
gagctaaggagccagagccagtcct

SEQ ID NO: 931181 - DNA, 25 bp, Mus musculus
gagctaatcctggacgtcctagaag

SEQ ID NO: 931182 - DNA, 25 bp, Mus musculus
gagctaatcctggacttagcagccc

SEQ ID NO: 931183 - DNA, 25 bp, Mus musculus
gagctaatcctggaggtcctagaag

SEQ ID NO: 931184 - DNA, 25 bp, Mus musculus
gagctaatcctggagttagcagccc

SEQ ID NO: 931185 - DNA, 25 bp, Mus musculus
gagctaattgatcaaaaagctgacc

SEQ ID NO: 931186 - DNA, 25 bp, Mus musculus
gagctaattgatcataaagctgacc

SEQ ID NO: 931187 - DNA, 25 bp, Mus musculus
gagctacagacaatttttgacactt

SEQ ID NO: 931188 - DNA, 25 bp, Mus musculus
gagctacagacattttttgacactt

SEQ ID NO: 931189 - DNA, 25 bp, Mus musculus
gagctacagcatcgaagccaaagga

SEQ ID NO: 931190 - DNA, 25 bp, Mus musculus
gagctacagcatggaagccaaagga

SEQ ID NO: 931191 - DNA, 25 bp, Mus musculus
gagctaccccagctcccgatccctg

SEQ ID NO: 931192 - DNA, 25 bp, Mus musculus
gagctaccccaggtcccgatccctg

SEQ ID NO: 931193 - DNA, 25 bp, Mus musculus
gagctacctcagacgccaagagtgg

SEQ ID NO: 931194 - DNA, 25 bp, Mus musculus
gagctacctcagtcgccaagagtgg

SEQ ID NO: 931195 - DNA, 25 bp, Mus musculus
gagctactacagcaactgaaccgca

SEQ ID NO: 931196 - DNA, 25 bp, Mus musculus
gagctactacaggaactgaaccgca

SEQ ID NO: 931197 - DNA, 25 bp, Mus musculus
gagctactgtaatgatcagtcaacg

SEQ ID NO: 931198 - DNA, 25 bp, Mus musculus
gagctactgttatgatcagtcaacg

SEQ ID NO: 931199 - DNA, 25 bp, Mus musculus
gagctacttgaaaagtaaagaacaa

SEQ ID NO: 931200 - DNA, 25 bp, Mus musculus
gagctacttgtaaagtaaagaacaa

SEQ ID NO: 931201 - DNA, 25 bp, Mus musculus
gagctactttcacgtgctgtgcagc

SEQ ID NO: 931202 - DNA, 25 bp, Mus musculus
gagctactttcaggtgctgtgcagc

SEQ ID NO: 931203 - DNA, 25 bp, Mus musculus
gagctagcagacatctctgtgagtg

SEQ ID NO: 931204 - DNA, 25 bp, Mus musculus
gagctagcagatccagtgcagactc

SEQ ID NO: 931205 - DNA, 25 bp, Mus musculus
gagctagcagtcatctctgtgagtg

SEQ ID NO: 931206 - DNA, 25 bp, Mus musculus
gagctagcagttccagtgcagactc

SEQ ID NO: 931207 - DNA, 25 bp, Mus musculus
gagctaggaagacgtcagccatgtc

SEQ ID NO: 931208 - DNA, 25 bp, Mus musculus
gagctaggaagaggtcagccatgtc

SEQ ID NO: 931209 - DNA, 25 bp, Mus musculus
gagctagtgccactcgacacggtgc

SEQ ID NO: 931210 - DNA, 25 bp, Mus musculus
gagctagtgccactggacacggtgc

SEQ ID NO: 931211 - DNA, 25 bp, Mus musculus
gagctagtgtaaaacaaagatgatg

SEQ ID NO: 931212 - DNA, 25 bp, Mus musculus
gagctagtgtaaaagaaagatgatg

SEQ ID NO: 931213 - DNA, 25 bp, Mus musculus
gagctagttgtgcgtcgcatccgaa

SEQ ID NO: 931214 - DNA, 25 bp, Mus musculus
gagctagttgtgggtcgcatccgaa

SEQ ID NO: 931215 - DNA, 25 bp, Mus musculus
gagctatacaacaccagactgggcc

SEQ ID NO: 931216 - DNA, 25 bp, Mus musculus
gagctatacaacacgagactgggcc

SEQ ID NO: 931217 - DNA, 25 bp, Mus musculus
gagctatcttataatctggaggctg

SEQ ID NO: 931218 - DNA, 25 bp, Mus musculus
gagctatcttttaatctggaggctg

SEQ ID NO: 931219 - DNA, 25 bp, Mus musculus
gagctattgcaccgatggtgaactt

SEQ ID NO: 931220 - DNA, 25 bp, Mus musculus
gagctattgcacggatggtgaactt

SEQ ID NO: 931221 - DNA, 25 bp, Mus musculus
gagctatttaagctggccaccactg

SEQ ID NO: 931222 - DNA, 25 bp, Mus musculus
gagctatttaaggtggccaccactg

SEQ ID NO: 931223 - DNA, 25 bp, Mus musculus
gagctcacagatcgccactttgagg

SEQ ID NO: 931224 - DNA, 25 bp, Mus musculus
gagctcacagatggccactttgagg

SEQ ID NO: 931225 - DNA, 25 bp, Mus musculus
gagctcacagcagagaaggagatgg

SEQ ID NO: 931226 - DNA, 25 bp, Mus musculus
gagctcacagcgtgtattttcccca

SEQ ID NO: 931227 - DNA, 25 bp, Mus musculus
gagctcacaggagagaaggagatgg

SEQ ID NO: 931228 - DNA, 25 bp, Mus musculus
gagctcacagggtgtattttcccca

SEQ ID NO: 931229 - DNA, 25 bp, Mus musculus
gagctcagacagtgcgtgtccaccc

SEQ ID NO: 931230 - DNA, 25 bp, Mus musculus
gagctcagacagtgggtgtccaccc

SEQ ID NO: 931231 - DNA, 25 bp, Mus musculus
gagctcagcaaacaagttgggatat

SEQ ID NO: 931232 - DNA, 25 bp, Mus musculus
gagctcagcaaagaagttgggatat

SEQ ID NO: 931233 - DNA, 25 bp, Mus musculus
gagctcagggagcttgctacctgtg

SEQ ID NO: 931234 - DNA, 25 bp, Mus musculus
gagctcagggaggttgctacctgtg

SEQ ID NO: 931235 - DNA, 25 bp, Mus musculus
gagctcatccagcccaaagggggca

SEQ ID NO: 931236 - DNA, 25 bp, Mus musculus
gagctcatccaggccaaagggggca

SEQ ID NO: 931237 - DNA, 25 bp, Mus musculus
gagctcatcctgcaccaaattgcct

SEQ ID NO: 931238 - DNA, 25 bp, Mus musculus
gagctcatcctgcagcaaattgcct

SEQ ID NO: 931239 - DNA, 25 bp, Mus musculus
gagctcatggagagagcagtagaga

SEQ ID NO: 931240 - DNA, 25 bp, Mus musculus
gagctcatggagcttgagatcttct

SEQ ID NO: 931241 - DNA, 25 bp, Mus musculus
gagctcatggaggttgagatcttct

SEQ ID NO: 931242 - DNA, 25 bp, Mus musculus
gagctcatggagtgagcagtagaga

SEQ ID NO: 931243 - DNA, 25 bp, Mus musculus
gagctcatgggacacgtgaacacct

SEQ ID NO: 931244 - DNA, 25 bp, Mus musculus
gagctcatgggacaggtgaacacct

SEQ ID NO: 931245 - DNA, 25 bp, Mus musculus
gagctccgagacgctatccggcaga

SEQ ID NO: 931246 - DNA, 25 bp, Mus musculus
gagctccgagtcgctatccggcaga

SEQ ID NO: 931247 - DNA, 25 bp, Mus musculus
gagctccgggactgaagtgtcctgg

SEQ ID NO: 931248 - DNA, 25 bp, Mus musculus
gagctccgggtctgaagtgtcctgg

SEQ ID NO: 931249 - DNA, 25 bp, Mus musculus
gagctcctcattcgaagcaatccgg

SEQ ID NO: 931250 - DNA, 25 bp, Mus musculus
gagctcctcattggaagcaatccgg

SEQ ID NO: 931251 - DNA, 25 bp, Mus musculus
gagctcctctacaagcttaagctgg

SEQ ID NO: 931252 - DNA, 25 bp, Mus musculus
gagctcctcttcaagcttaagctgg

SEQ ID NO: 931253 - DNA, 25 bp, Mus musculus
gagctcctgaaccacctggtccctg

SEQ ID NO: 931254 - DNA, 25 bp, Mus musculus
gagctcctgaaccagctggtccctg

SEQ ID NO: 931255 - DNA, 25 bp, Mus musculus
gagctcctggatgacatgaagttct

SEQ ID NO: 931256 - DNA, 25 bp, Mus musculus
gagctcctggatgagatgaagttct

SEQ ID NO: 931257 - DNA, 25 bp, Mus musculus
gagctcgaagccatacacagtcttc

SEQ ID NO: 931258 - DNA, 25 bp, Mus musculus
gagctcgaaggcatacacagtcttc

SEQ ID NO: 931259 - DNA, 25 bp, Mus musculus
gagctctcacagataaaggaatcca

SEQ ID NO: 931260 - DNA, 25 bp, Mus musculus
gagctctcacagttaaaggaatcca

SEQ ID NO: 931261 - DNA, 25 bp, Mus musculus
gagctctctttcaacgctggagacg

SEQ ID NO: 931262 - DNA, 25 bp, Mus musculus
gagctctctttcaaggctggagacg

SEQ ID NO: 931263 - DNA, 25 bp, Mus musculus
gagctctgagctggaaggtgatacc

SEQ ID NO: 931264 - DNA, 25 bp, Mus musculus
gagctctgaggtggaaggtgatacc

SEQ ID NO: 931265 - DNA, 25 bp, Mus musculus
gagctcttccaacacttcgacaaaa

SEQ ID NO: 931266 - DNA, 25 bp, Mus musculus
gagctcttccaagacttcgacaaaa

SEQ ID NO: 931267 - DNA, 25 bp, Mus musculus
gagctcttcgtcaacgaaacctgca

SEQ ID NO: 931268 - DNA, 25 bp, Mus musculus
gagctcttcgtcaacgccggaagtg

SEQ ID NO: 931269 - DNA, 25 bp, Mus musculus
gagctcttcgtcaaggaaacctgca

SEQ ID NO: 931270 - DNA, 25 bp, Mus musculus
gagctcttcgtcaaggccggaagtg

SEQ ID NO: 931271 - DNA, 25 bp, Mus musculus
gagctcttgaccaacttccaggaag

SEQ ID NO: 931272 - DNA, 25 bp, Mus musculus
gagctcttgaccaagttccaggaag

SEQ ID NO: 931273 - DNA, 25 bp, Mus musculus
gagctcttggtgtgcacacttcccg

SEQ ID NO: 931274 - DNA, 25 bp, Mus musculus
gagctcttggtgtggacacttcccg

SEQ ID NO: 931275 - DNA, 25 bp, Mus musculus
gagctctttgatgacttgggtgtct

SEQ ID NO: 931276 - DNA, 25 bp, Mus musculus
gagctctttgttgacttgggtgtct

SEQ ID NO: 931277 - DNA, 25 bp, Mus musculus
gagctgaaagagctgacagtgaaaa

SEQ ID NO: 931278 - DNA, 25 bp, Mus musculus
gagctgaaagaggtgacagtgaaaa

SEQ ID NO: 931279 - DNA, 25 bp, Mus musculus
gagctgaaagcacggcctgtgcagg

SEQ ID NO: 931280 - DNA, 25 bp, Mus musculus
gagctgaaagcagggcctgtgcagg

SEQ ID NO: 931281 - DNA, 25 bp, Mus musculus
gagctgaacagctgcacaccacctg

SEQ ID NO: 931282 - DNA, 25 bp, Mus musculus
gagctgaacagctggacaccacctg

SEQ ID NO: 931283 - DNA, 25 bp, Mus musculus
gagctgaacatgcacctgttccgct

SEQ ID NO: 931284 - DNA, 25 bp, Mus musculus
gagctgaacatggacctgttccgct

SEQ ID NO: 931285 - DNA, 25 bp, Mus musculus
gagctgaacttgatgaagcatctga

SEQ ID NO: 931286 - DNA, 25 bp, Mus musculus
gagctgaacttgttgaagcatctga

SEQ ID NO: 931287 - DNA, 25 bp, Mus musculus
gagctgacacctcacggcacacttg

SEQ ID NO: 931288 - DNA, 25 bp, Mus musculus
gagctgacacctcagggcacacttg

SEQ ID NO: 931289 - DNA, 25 bp, Mus musculus
gagctgacactgaccaaatcttatt

SEQ ID NO: 931290 - DNA, 25 bp, Mus musculus
gagctgacactgtccaaatcttatt

SEQ ID NO: 931291 - DNA, 25 bp, Mus musculus
gagctgacagagcttttcttcatgc

SEQ ID NO: 931292 - DNA, 25 bp, Mus musculus
gagctgacagaggttttcttcatgc

SEQ ID NO: 931293 - DNA, 25 bp, Mus musculus
gagctgaccatgagacaaaacccct

SEQ ID NO: 931294 - DNA, 25 bp, Mus musculus
gagctgaccatgtgacaaaacccct

SEQ ID NO: 931295 - DNA, 25 bp, Mus musculus
gagctgactgatatgtcttctattt

SEQ ID NO: 931296 - DNA, 25 bp, Mus musculus
gagctgactgatttgtcttctattt

SEQ ID NO: 931297 - DNA, 25 bp, Mus musculus
gagctgagattaaacacagctgcag

SEQ ID NO: 931298 - DNA, 25 bp, Mus musculus
gagctgagattaaagacagctgcag

SEQ ID NO: 931299 - DNA, 25 bp, Mus musculus
gagctgaggctgcgcaggtactgcc

SEQ ID NO: 931300 - DNA, 25 bp, Mus musculus
gagctgaggctgcggaggtactgcc

SEQ ID NO: 931301 - DNA, 25 bp, Mus musculus
gagctgagggccacaaggattccca

SEQ ID NO: 931302 - DNA, 25 bp, Mus musculus
gagctgagggcctcaaggattccca

SEQ ID NO: 931303 - DNA, 25 bp, Mus musculus
gagctgatcaacactggacctccat

SEQ ID NO: 931304 - DNA, 25 bp, Mus musculus
gagctgatcaactctggacctccat

SEQ ID NO: 931305 - DNA, 25 bp, Mus musculus
gagctgatcaaggaaccttctgtgg

SEQ ID NO: 931306 - DNA, 25 bp, Mus musculus
gagctgatcaaggatccttctgtgg

SEQ ID NO: 931307 - DNA, 25 bp, Mus musculus
gagctgatgcagcccatgctggagt

SEQ ID NO: 931308 - DNA, 25 bp, Mus musculus
gagctgatgcaggccatgctggagt

SEQ ID NO: 931309 - DNA, 25 bp, Mus musculus
gagctgatgcatcctgtaggtggtg

SEQ ID NO: 931310 - DNA, 25 bp, Mus musculus
gagctgatgcatgctgtaggtggtg

SEQ ID NO: 931311 - DNA, 25 bp, Mus musculus
gagctgatggacacagtgatattta

SEQ ID NO: 931312 - DNA, 25 bp, Mus musculus
gagctgatggacactgtgatattta

SEQ ID NO: 931313 - DNA, 25 bp, Mus musculus
gagctgcaagataagcagacagcta

SEQ ID NO: 931314 - DNA, 25 bp, Mus musculus
gagctgcaagcaactcattatacaa

SEQ ID NO: 931315 - DNA, 25 bp, Mus musculus
gagctgcaaggaactcattatacaa

SEQ ID NO: 931316 - DNA, 25 bp, Mus musculus
gagctgcaagttaagcagacagcta

SEQ ID NO: 931317 - DNA, 25 bp, Mus musculus
gagctgcacaagacacgggtcacag

SEQ ID NO: 931318 - DNA, 25 bp, Mus musculus
gagctgcacaagtcacgggtcacag

SEQ ID NO: 931319 - DNA, 25 bp, Mus musculus
gagctgcagaaactcattgaagccg

SEQ ID NO: 931320 - DNA, 25 bp, Mus musculus
gagctgcagaaactgattgaagccg

SEQ ID NO: 931321 - DNA, 25 bp, Mus musculus
gagctgcagcagaacattctctgtg

SEQ ID NO: 931322 - DNA, 25 bp, Mus musculus
gagctgcagcagaagattctctgtg

SEQ ID NO: 931323 - DNA, 25 bp, Mus musculus
gagctgcagcagcacctgcgaggct

SEQ ID NO: 931324 - DNA, 25 bp, Mus musculus
gagctgcagcaggacctgcgaggct

SEQ ID NO: 931325 - DNA, 25 bp, Mus musculus
gagctgcaggagcaccttcgggcag

SEQ ID NO: 931326 - DNA, 25 bp, Mus musculus
gagctgcaggagcagcttcgggcag

SEQ ID NO: 931327 - DNA, 25 bp, Mus musculus
gagctgccaaagtcacccaagctga

SEQ ID NO: 931328 - DNA, 25 bp, Mus musculus
gagctgccaaagtctcccaagctga

SEQ ID NO: 931329 - DNA, 25 bp, Mus musculus
gagctgcccacttgcgaggcagagg

SEQ ID NO: 931330 - DNA, 25 bp, Mus musculus
gagctgcccacttgggaggcagagg

SEQ ID NO: 931331 - DNA, 25 bp, Mus musculus
gagctgcctacgcgtatcataccag

SEQ ID NO: 931332 - DNA, 25 bp, Mus musculus
gagctgcctacgggtatcataccag

SEQ ID NO: 931333 - DNA, 25 bp, Mus musculus
gagctgcgcaagcgtgagcacctca

SEQ ID NO: 931334 - DNA, 25 bp, Mus musculus
gagctgcgcaagggtgagcacctca

SEQ ID NO: 931335 - DNA, 25 bp, Mus musculus
gagctgcgggagagggtctgctgac

SEQ ID NO: 931336 - DNA, 25 bp, Mus musculus
gagctgcgggagtgggtctgctgac

SEQ ID NO: 931337 - DNA, 25 bp, Mus musculus
gagctgctagcccttctctgaggat

SEQ ID NO: 931338 - DNA, 25 bp, Mus musculus
gagctgctaggccttctctgaggat

SEQ ID NO: 931339 - DNA, 25 bp, Mus musculus
gagctgctcaactgcgtgaatgccc

SEQ ID NO: 931340 - DNA, 25 bp, Mus musculus
gagctgctcaactgggtgaatgccc

SEQ ID NO: 931341 - DNA, 25 bp, Mus musculus
gagctgctcaccccctgtgggtcag

SEQ ID NO: 931342 - DNA, 25 bp, Mus musculus
gagctgctcaccccgtgtgggtcag

SEQ ID NO: 931343 - DNA, 25 bp, Mus musculus
gagctgctccagcagcctgaagcta

SEQ ID NO: 931344 - DNA, 25 bp, Mus musculus
gagctgctccaggagcctgaagcta

SEQ ID NO: 931345 - DNA, 25 bp, Mus musculus
gagctgctccggaatctctatgaga

SEQ ID NO: 931346 - DNA, 25 bp, Mus musculus
gagctgctccggtatctctatgaga

SEQ ID NO: 931347 - DNA, 25 bp, Mus musculus
gagctgctgaagaggcaagtggaag

SEQ ID NO: 931348 - DNA, 25 bp, Mus musculus
gagctgctgaagtggcaagtggaag

SEQ ID NO: 931349 - DNA, 25 bp, Mus musculus
gagctgctgagacacgaagcgggaa

SEQ ID NO: 931350 - DNA, 25 bp, Mus musculus
gagctgctgagacaggaagcgggaa

SEQ ID NO: 931351 - DNA, 25 bp, Mus musculus
gagctgctgcaggacgaaactgtgc

SEQ ID NO: 931352 - DNA, 25 bp, Mus musculus
gagctgctgcaggaggaaactgtgc

SEQ ID NO: 931353 - DNA, 25 bp, Mus musculus
gagctgctgctccgagagcgggact

SEQ ID NO: 931354 - DNA, 25 bp, Mus musculus
gagctgctgctcggagagcgggact

SEQ ID NO: 931355 - DNA, 25 bp, Mus musculus
gagctgctggacatcgagtgccagg

SEQ ID NO: 931356 - DNA, 25 bp, Mus musculus
gagctgctggacatggagtgccagg

SEQ ID NO: 931357 - DNA, 25 bp, Mus musculus
gagctgctggcaagatgctaccaag

SEQ ID NO: 931358 - DNA, 25 bp, Mus musculus
gagctgctgggaagatgctaccaag

SEQ ID NO: 931359 - DNA, 25 bp, Mus musculus
gagctgctggtgcacgcttatggag

SEQ ID NO: 931360 - DNA, 25 bp, Mus musculus
gagctgctggtgcaggcttatggag

SEQ ID NO: 931361 - DNA, 25 bp, Mus musculus
gagctgctgtaccgcgcagtgcagt

SEQ ID NO: 931362 - DNA, 25 bp, Mus musculus
gagctgctgtaccgggcagtgcagt

SEQ ID NO: 931363 - DNA, 25 bp, Mus musculus
gagctggaagctcttgttgcagcat

SEQ ID NO: 931364 - DNA, 25 bp, Mus musculus
gagctggaaggtcttgttgcagcat

SEQ ID NO: 931365 - DNA, 25 bp, Mus musculus
gagctggacacgcctgtccagggca

SEQ ID NO: 931366 - DNA, 25 bp, Mus musculus
gagctggacacggctgtccagggca

SEQ ID NO: 931367 - DNA, 25 bp, Mus musculus
gagctggagatcagcaggcgccagc

SEQ ID NO: 931368 - DNA, 25 bp, Mus musculus
gagctggagatcagcttcaatgctc

SEQ ID NO: 931369 - DNA, 25 bp, Mus musculus
gagctggagatcaggaggcgccagc

SEQ ID NO: 931370 - DNA, 25 bp, Mus musculus
gagctggagatcaggttcaatgctc

SEQ ID NO: 931371 - DNA, 25 bp, Mus musculus
gagctggagcagaggagataatcgg

SEQ ID NO: 931372 - DNA, 25 bp, Mus musculus
gagctggagcagaggagatcatcgg

SEQ ID NO: 931373 - DNA, 25 bp, Mus musculus
gagctggagcagcttcgggaggcct

SEQ ID NO: 931374 - DNA, 25 bp, Mus musculus
gagctggagcaggttcgggaggcct

SEQ ID NO: 931375 - DNA, 25 bp, Mus musculus
gagctggagcagtggagataatcgg

SEQ ID NO: 931376 - DNA, 25 bp, Mus musculus
gagctggagcagtggagatcatcgg

SEQ ID NO: 931377 - DNA, 25 bp, Mus musculus
gagctggaggcctaaaaccgactct

SEQ ID NO: 931378 - DNA, 25 bp, Mus musculus
gagctggagggctaaaaccgactct

SEQ ID NO: 931379 - DNA, 25 bp, Mus musculus
gagctggcaccacctgaggatggtt

SEQ ID NO: 931380 - DNA, 25 bp, Mus musculus
gagctggcaccagctgaggatggtt

SEQ ID NO: 931381 - DNA, 25 bp, Mus musculus
gagctggcagaggcacctcggtttg

SEQ ID NO: 931382 - DNA, 25 bp, Mus musculus
gagctggcagtggcacctcggtttg

SEQ ID NO: 931383 - DNA, 25 bp, Mus musculus
gagctggctgtcaactgcttacgac

SEQ ID NO: 931384 - DNA, 25 bp, Mus musculus
gagctggctgtcaagtgcttacgac

SEQ ID NO: 931385 - DNA, 25 bp, Mus musculus
gagctgggacatgaagtgattaaga

SEQ ID NO: 931386 - DNA, 25 bp, Mus musculus
gagctgggacatgatgtgattaaga

SEQ ID NO: 931387 - DNA, 25 bp, Mus musculus
gagctgggagttcacgttcatgtgg

SEQ ID NO: 931388 - DNA, 25 bp, Mus musculus
gagctgggagttcaggttcatgtgg

SEQ ID NO: 931389 - DNA, 25 bp, Mus musculus
gagctgggttcgctcccagcaatgt

SEQ ID NO: 931390 - DNA, 25 bp, Mus musculus
gagctgggttcggtcccagcaatgt

SEQ ID NO: 931391 - DNA, 25 bp, Mus musculus
gagctggtacagaatgctgtgtccc

SEQ ID NO: 931392 - DNA, 25 bp, Mus musculus
gagctggtacagtatgctgtgtccc

SEQ ID NO: 931393 - DNA, 25 bp, Mus musculus
gagctggtccgacggctactgacag

SEQ ID NO: 931394 - DNA, 25 bp, Mus musculus
gagctggtccgagggctactgacag

SEQ ID NO: 931395 - DNA, 25 bp, Mus musculus
gagctggtgccacgcccagattaga

SEQ ID NO: 931396 - DNA, 25 bp, Mus musculus
gagctggtgccaggcccagattaga

SEQ ID NO: 931397 - DNA, 25 bp, Mus musculus
gagctgtagcctcaacctcaaggcc

SEQ ID NO: 931398 - DNA, 25 bp, Mus musculus
gagctgtagcctgaacctcaaggcc

SEQ ID NO: 931399 - DNA, 25 bp, Mus musculus
gagctgtataagctacatttgaaga

SEQ ID NO: 931400 - DNA, 25 bp, Mus musculus
gagctgtataaggtacatttgaaga

SEQ ID NO: 931401 - DNA, 25 bp, Mus musculus
gagctgtatgagcaagtaaagctct

SEQ ID NO: 931402 - DNA, 25 bp, Mus musculus
gagctgtatgaggaagtaaagctct

SEQ ID NO: 931403 - DNA, 25 bp, Mus musculus
gagctgtatggaaacatggcctctg

SEQ ID NO: 931404 - DNA, 25 bp, Mus musculus
gagctgtatggaaagatggcctctg

SEQ ID NO: 931405 - DNA, 25 bp, Mus musculus
gagctgtatggatcagaaaaactaa

SEQ ID NO: 931406 - DNA, 25 bp, Mus musculus
gagctgtatggatctgaaaaactaa

SEQ ID NO: 931407 - DNA, 25 bp, Mus musculus
gagctgtgagcccttgagagtgatg

SEQ ID NO: 931408 - DNA, 25 bp, Mus musculus
gagctgtgagccgcagcaagcacac

SEQ ID NO: 931409 - DNA, 25 bp, Mus musculus
gagctgtgaggccttgagagtgatg

SEQ ID NO: 931410 - DNA, 25 bp, Mus musculus
gagctgtgaggcgcagcaagcacac

SEQ ID NO: 931411 - DNA, 25 bp, Mus musculus
gagctgtgtcaactgagaaaggcac

SEQ ID NO: 931412 - DNA, 25 bp, Mus musculus
gagctgtgtcaagtgagaaaggcac

SEQ ID NO: 931413 - DNA, 25 bp, Mus musculus
gagctgttatgattagtgcaattga

SEQ ID NO: 931414 - DNA, 25 bp, Mus musculus
gagctgttatgatttgtgcaattga

SEQ ID NO: 931415 - DNA, 25 bp, Mus musculus
gagctgttcagactaggtggcgatg

SEQ ID NO: 931416 - DNA, 25 bp, Mus musculus
gagctgttcagagtaggtggcgatg

SEQ ID NO: 931417 - DNA, 25 bp, Mus musculus
gagctgttttggcttgcatgagact

SEQ ID NO: 931418 - DNA, 25 bp, Mus musculus
gagctgttttgggttgcatgagact

SEQ ID NO: 931419 - DNA, 25 bp, Mus musculus
gagcttacaaagaatggaattgcta

SEQ ID NO: 931420 - DNA, 25 bp, Mus musculus
gagcttacaaagtatggaattgcta

SEQ ID NO: 931421 - DNA, 25 bp, Mus musculus
gagcttcaagccatatgagcgtggc

SEQ ID NO: 931422 - DNA, 25 bp, Mus musculus
gagcttcaaggcatatgagcgtggc

SEQ ID NO: 931423 - DNA, 25 bp, Mus musculus
gagcttcaaggccacgttgatggaa

SEQ ID NO: 931424 - DNA, 25 bp, Mus musculus
gagcttcaaggccaggttgatggaa

SEQ ID NO: 931425 - DNA, 25 bp, Mus musculus
gagcttcaatcacctccatcagctg

SEQ ID NO: 931426 - DNA, 25 bp, Mus musculus
gagcttcaatcagctccatcagctg

SEQ ID NO: 931427 - DNA, 25 bp, Mus musculus
gagcttccacctagcgactgccgct

SEQ ID NO: 931428 - DNA, 25 bp, Mus musculus
gagcttccacctagggactgccgct

SEQ ID NO: 931429 - DNA, 25 bp, Mus musculus
gagcttccacgacgaggaaagaaga

SEQ ID NO: 931430 - DNA, 25 bp, Mus musculus
gagcttccacgaggaggaaagaaga

SEQ ID NO: 931431 - DNA, 25 bp, Mus musculus
gagcttcctgatgaagttatagtgc

SEQ ID NO: 931432 - DNA, 25 bp, Mus musculus
gagcttcctgatgaatgtcattggt

SEQ ID NO: 931433 - DNA, 25 bp, Mus musculus
gagcttcctgatgatgttatagtgc

SEQ ID NO: 931434 - DNA, 25 bp, Mus musculus
gagcttcctgatgattgtcattggt

SEQ ID NO: 931435 - DNA, 25 bp, Mus musculus
gagcttcgagaacgccaaagaatct

SEQ ID NO: 931436 - DNA, 25 bp, Mus musculus
gagcttcgagaaggccaaagaatct

SEQ ID NO: 931437 - DNA, 25 bp, Mus musculus
gagcttcgcctacgaaagaatctgt

SEQ ID NO: 931438 - DNA, 25 bp, Mus musculus
gagcttcgcctaggaaagaatctgt

SEQ ID NO: 931439 - DNA, 25 bp, Mus musculus
gagcttctccgagactgcaatcaac

SEQ ID NO: 931440 - DNA, 25 bp, Mus musculus
gagcttctccgagagtgcaatcaac

SEQ ID NO: 931441 - DNA, 25 bp, Mus musculus
gagcttctcgctgtggatcatatgt

SEQ ID NO: 931442 - DNA, 25 bp, Mus musculus
gagcttctcggtgtggatcatatgt

SEQ ID NO: 931443 - DNA, 25 bp, Mus musculus
gagcttctgcaacgttctgtccccc

SEQ ID NO: 931444 - DNA, 25 bp, Mus musculus
gagcttctgcaaggttctgtccccc

SEQ ID NO: 931445 - DNA, 25 bp, Mus musculus
gagcttcttctgctcatgtctctga

SEQ ID NO: 931446 - DNA, 25 bp, Mus musculus
gagcttcttctggtcatgtctctga

SEQ ID NO: 931447 - DNA, 25 bp, Mus musculus
gagcttgaggcgggcagggagctaa

SEQ ID NO: 931448 - DNA, 25 bp, Mus musculus
gagcttgaggggggcagggagctaa

SEQ ID NO: 931449 - DNA, 25 bp, Mus musculus
gagcttgcagccatctagtcttgct

SEQ ID NO: 931450 - DNA, 25 bp, Mus musculus
gagcttgcaggcatctagtcttgct

SEQ ID NO: 931451 - DNA, 25 bp, Mus musculus
gagcttgccaaacgcggagcgtttg

SEQ ID NO: 931452 - DNA, 25 bp, Mus musculus
gagcttgccatacgcggagcgtttg

SEQ ID NO: 931453 - DNA, 25 bp, Mus musculus
gagcttgccctgctcaggcagcagt

SEQ ID NO: 931454 - DNA, 25 bp, Mus musculus
gagcttgccctggtcaggcagcagt

SEQ ID NO: 931455 - DNA, 25 bp, Mus musculus
gagcttgctaagctacaagaagact

SEQ ID NO: 931456 - DNA, 25 bp, Mus musculus
gagcttgctaagctggaagaagaaa

SEQ ID NO: 931457 - DNA, 25 bp, Mus musculus
gagcttgctaaggtacaagaagact

SEQ ID NO: 931458 - DNA, 25 bp, Mus musculus
gagcttgctaaggtggaagaagaaa

SEQ ID NO: 931459 - DNA, 25 bp, Mus musculus
gagcttggcgaacctaccagctcag

SEQ ID NO: 931460 - DNA, 25 bp, Mus musculus
gagcttggcgaagctaccagctcag

SEQ ID NO: 931461 - DNA, 25 bp, Mus musculus
gagcttgtcagaatcaggtctgata

SEQ ID NO: 931462 - DNA, 25 bp, Mus musculus
gagcttgtcagattcaggtctgata

SEQ ID NO: 931463 - DNA, 25 bp, Mus musculus
gagctttgagatgctggttgttgga

SEQ ID NO: 931464 - DNA, 25 bp, Mus musculus
gagctttgagcatttcatcaaaggt

SEQ ID NO: 931465 - DNA, 25 bp, Mus musculus
gagctttgaggatttcatcaaaggt

SEQ ID NO: 931466 - DNA, 25 bp, Mus musculus
gagctttgagttgctggttgttgga

SEQ ID NO: 931467 - DNA, 25 bp, Mus musculus
gagctttgccagcaatctggtctgt

SEQ ID NO: 931468 - DNA, 25 bp, Mus musculus
gagctttgccaggaatctggtctgt

SEQ ID NO: 931469 - DNA, 25 bp, Mus musculus
gagctttgtcaacaacctacatgga

SEQ ID NO: 931470 - DNA, 25 bp, Mus musculus
gagctttgtcaacggctggggagca

SEQ ID NO: 931471 - DNA, 25 bp, Mus musculus
gagctttgtcaagaacctacatgga

SEQ ID NO: 931472 - DNA, 25 bp, Mus musculus
gagctttgtcaagggctggggagca

SEQ ID NO: 931473 - DNA, 25 bp, Mus musculus
gagcttttctacaaccctcctgagc

SEQ ID NO: 931474 - DNA, 25 bp, Mus musculus
gagcttttctacaagcctcctgagc

SEQ ID NO: 931475 - DNA, 25 bp, Mus musculus
gagcttttgcagagaagaatggttt

SEQ ID NO: 931476 - DNA, 25 bp, Mus musculus
gagcttttgcagctggctttgcagc

SEQ ID NO: 931477 - DNA, 25 bp, Mus musculus
gagcttttgcaggtggctttgcagc

SEQ ID NO: 931478 - DNA, 25 bp, Mus musculus
gagcttttgcagtgaagaatggttt

SEQ ID NO: 931479 - DNA, 25 bp, Mus musculus
gaggaaaacaagatctcaaagacgg

SEQ ID NO: 931480 - DNA, 25 bp, Mus musculus
gaggaaaacaagttctcaaagacgg

SEQ ID NO: 931481 - DNA, 25 bp, Mus musculus
gaggaaaagaaagacagttcgatgc

SEQ ID NO: 931482 - DNA, 25 bp, Mus musculus
gaggaaaagaaagagagttcgatgc

SEQ ID NO: 931483 - DNA, 25 bp, Mus musculus
gaggaaaagcagccatatattcagc

SEQ ID NO: 931484 - DNA, 25 bp, Mus musculus
gaggaaaagcaggcatatattcagc

SEQ ID NO: 931485 - DNA, 25 bp, Mus musculus
gaggaaaatccacgaactcagcaaa

SEQ ID NO: 931486 - DNA, 25 bp, Mus musculus
gaggaaaatccaggaactcagcaaa

SEQ ID NO: 931487 - DNA, 25 bp, Mus musculus
gaggaaacagatgcaatacctggac

SEQ ID NO: 931488 - DNA, 25 bp, Mus musculus
gaggaaacagccactctcgatttgg

SEQ ID NO: 931489 - DNA, 25 bp, Mus musculus
gaggaaacaggcactctcgatttgg

SEQ ID NO: 931490 - DNA, 25 bp, Mus musculus
gaggaaacagttgcaatacctggac

SEQ ID NO: 931491 - DNA, 25 bp, Mus musculus
gaggaaagagaacgtctgggcccac

SEQ ID NO: 931492 - DNA, 25 bp, Mus musculus
gaggaaagagaaggtctgggcccac

SEQ ID NO: 931493 - DNA, 25 bp, Mus musculus
gaggaaatccgacacggcttcttca

SEQ ID NO: 931494 - DNA, 25 bp, Mus musculus
gaggaaatccgacagggcttcttca

SEQ ID NO: 931495 - DNA, 25 bp, Mus musculus
gaggaaatggagccaagaagacagc

SEQ ID NO: 931496 - DNA, 25 bp, Mus musculus
gaggaaatggaggcaagaagacagc

SEQ ID NO: 931497 - DNA, 25 bp, Mus musculus
gaggaacaagattcgagagcaaaac

SEQ ID NO: 931498 - DNA, 25 bp, Mus musculus
gaggaacaagtttcgagagcaaaac

SEQ ID NO: 931499 - DNA, 25 bp, Mus musculus
gaggaacagatgcacgaatgggctt

SEQ ID NO: 931500 - DNA, 25 bp, Mus musculus
gaggaacagatgcaggaatgggctt

SEQ ID NO: 931501 - DNA, 25 bp, Mus musculus
gaggaacagattaacgacattttct

SEQ ID NO: 931502 - DNA, 25 bp, Mus musculus
gaggaacagattaaggacattttct

SEQ ID NO: 931503 - DNA, 25 bp, Mus musculus
gaggaacattaaatcgtcttgcttc

SEQ ID NO: 931504 - DNA, 25 bp, Mus musculus
gaggaacattaaatggtcttgcttc

SEQ ID NO: 931505 - DNA, 25 bp, Mus musculus
gaggaaccaccactcgtacagcagc

SEQ ID NO: 931506 - DNA, 25 bp, Mus musculus
gaggaaccaccactggtacagcagc

SEQ ID NO: 931507 - DNA, 25 bp, Mus musculus
gaggaaccgaaactctaagcatccc

SEQ ID NO: 931508 - DNA, 25 bp, Mus musculus
gaggaaccgaaagtctaagcatccc

SEQ ID NO: 931509 - DNA, 25 bp, Mus musculus
gaggaactagacacagtgattggca

SEQ ID NO: 931510 - DNA, 25 bp, Mus musculus
gaggaactagtcacagtgattggca

SEQ ID NO: 931511 - DNA, 25 bp, Mus musculus
gaggaactggccagcaagtgccgag

SEQ ID NO: 931512 - DNA, 25 bp, Mus musculus
gaggaactggccaggaagtgccgag

SEQ ID NO: 931513 - DNA, 25 bp, Mus musculus
gaggaactggggctttgaaccagaa

SEQ ID NO: 931514 - DNA, 25 bp, Mus musculus
gaggaactgggggtttgaaccagaa

SEQ ID NO: 931515 - DNA, 25 bp, Mus musculus
gaggaagaagagcaggaagagggtc

SEQ ID NO: 931516 - DNA, 25 bp, Mus musculus
gaggaagaagaggaggaagagggtc

SEQ ID NO: 931517 - DNA, 25 bp, Mus musculus
gaggaagacaagcacctgtatatcc

SEQ ID NO: 931518 - DNA, 25 bp, Mus musculus
gaggaagacaaggacctgtatatcc

SEQ ID NO: 931519 - DNA, 25 bp, Mus musculus
gaggaagacactaacgatctccgtg

SEQ ID NO: 931520 - DNA, 25 bp, Mus musculus
gaggaagacactaaggatctccgtg

SEQ ID NO: 931521 - DNA, 25 bp, Mus musculus
gaggaagactctgcagcttcaacca

SEQ ID NO: 931522 - DNA, 25 bp, Mus musculus
gaggaagactgtgcagcttcaacca

SEQ ID NO: 931523 - DNA, 25 bp, Mus musculus
gaggaagacttcccttctttgaatc

SEQ ID NO: 931524 - DNA, 25 bp, Mus musculus
gaggaagacttcgcttctttgaatc

SEQ ID NO: 931525 - DNA, 25 bp, Mus musculus
gaggaagagagacgagtgaccatgg

SEQ ID NO: 931526 - DNA, 25 bp, Mus musculus
gaggaagagagaggagtgaccatgg

SEQ ID NO: 931527 - DNA, 25 bp, Mus musculus
gaggaagaggaagacctccagagaa

SEQ ID NO: 931528 - DNA, 25 bp, Mus musculus
gaggaagaggaagagctccagagaa

SEQ ID NO: 931529 - DNA, 25 bp, Mus musculus
gaggaagaggagctccctgtgctgg

SEQ ID NO: 931530 - DNA, 25 bp, Mus musculus
gaggaagaggaggacgaggctccgc

SEQ ID NO: 931531 - DNA, 25 bp, Mus musculus
gaggaagaggaggaggaggctccgc

SEQ ID NO: 931532 - DNA, 25 bp, Mus musculus
gaggaagaggaggtccctgtgctgg

SEQ ID NO: 931533 - DNA, 25 bp, Mus musculus
gaggaagatcaaaacgtcattgagt

SEQ ID NO: 931534 - DNA, 25 bp, Mus musculus
gaggaagatcaaaaggtcattgagt

SEQ ID NO: 931535 - DNA, 25 bp, Mus musculus
gaggaagatgactctgaggaagaag

SEQ ID NO: 931536 - DNA, 25 bp, Mus musculus
gaggaagatgagaaaattccagtgc

SEQ ID NO: 931537 - DNA, 25 bp, Mus musculus
gaggaagatgagtaaattccagtgc

SEQ ID NO: 931538 - DNA, 25 bp, Mus musculus
gaggaagatgtctctgaggaagaag

SEQ ID NO: 931539 - DNA, 25 bp, Mus musculus
gaggaagcactgcaggaggcagatg

SEQ ID NO: 931540 - DNA, 25 bp, Mus musculus
gaggaagcactgccaaggggaccag

SEQ ID NO: 931541 - DNA, 25 bp, Mus musculus
gaggaagcactggaggaggcagatg

SEQ ID NO: 931542 - DNA, 25 bp, Mus musculus
gaggaagcactggcaaggggaccag

SEQ ID NO: 931543 - DNA, 25 bp, Mus musculus
gaggaagccaagccctggggcttga

SEQ ID NO: 931544 - DNA, 25 bp, Mus musculus
gaggaagccaaggcctggggcttga

SEQ ID NO: 931545 - DNA, 25 bp, Mus musculus
gaggaagcctaacgatgatgctgtt

SEQ ID NO: 931546 - DNA, 25 bp, Mus musculus
gaggaagcctaaggatgatgctgtt

SEQ ID NO: 931547 - DNA, 25 bp, Mus musculus
gaggaagcgctgctgcaggcagagg

SEQ ID NO: 931548 - DNA, 25 bp, Mus musculus
gaggaagcgctggtgcaggcagagg

SEQ ID NO: 931549 - DNA, 25 bp, Mus musculus
gaggaaggaagacgtttatgggact

SEQ ID NO: 931550 - DNA, 25 bp, Mus musculus
gaggaaggaagaggtttatgggact

SEQ ID NO: 931551 - DNA, 25 bp, Mus musculus
gaggaaggcgaacatttgcagtcct

SEQ ID NO: 931552 - DNA, 25 bp, Mus musculus
gaggaaggcgaagatttgcagtcct

SEQ ID NO: 931553 - DNA, 25 bp, Mus musculus
gaggaagtagacaatcctcctgatc

SEQ ID NO: 931554 - DNA, 25 bp, Mus musculus
gaggaagtagtcaatcctcctgatc

SEQ ID NO: 931555 - DNA, 25 bp, Mus musculus
gaggaagtggagcgactgaactttt

SEQ ID NO: 931556 - DNA, 25 bp, Mus musculus
gaggaagtggagggactgaactttt

SEQ ID NO: 931557 - DNA, 25 bp, Mus musculus
gaggaataaagaaacgtgaccagaa

SEQ ID NO: 931558 - DNA, 25 bp, Mus musculus
gaggaataaagaaaggtgaccagaa

SEQ ID NO: 931559 - DNA, 25 bp, Mus musculus
gaggaataagaccacatcatcttta

SEQ ID NO: 931560 - DNA, 25 bp, Mus musculus
gaggaataagaccagatcatcttta

SEQ ID NO: 931561 - DNA, 25 bp, Mus musculus
gaggaataagatgacgtcctccacc

SEQ ID NO: 931562 - DNA, 25 bp, Mus musculus
gaggaataagatgaggtcctccacc

SEQ ID NO: 931563 - DNA, 25 bp, Mus musculus
gaggaataccagatcgcctataagt

SEQ ID NO: 931564 - DNA, 25 bp, Mus musculus
gaggaataccagatggcctataagt

SEQ ID NO: 931565 - DNA, 25 bp, Mus musculus
gaggaatctttgcgaagaactgctg

SEQ ID NO: 931566 - DNA, 25 bp, Mus musculus
gaggaatctttgggaagaactgctg

SEQ ID NO: 931567 - DNA, 25 bp, Mus musculus
gaggaatggaagcgtgtgacttaca

SEQ ID NO: 931568 - DNA, 25 bp, Mus musculus
gaggaatggaagggtgtgacttaca

SEQ ID NO: 931569 - DNA, 25 bp, Mus musculus
gaggaatggcctactcagttcgtgt

SEQ ID NO: 931570 - DNA, 25 bp, Mus musculus
gaggaatggcgtactcagttcgtgt

SEQ ID NO: 931571 - DNA, 25 bp, Mus musculus
gaggaattatctgacgaaggctacc

SEQ ID NO: 931572 - DNA, 25 bp, Mus musculus
gaggaattatctgaggaaggctacc

SEQ ID NO: 931573 - DNA, 25 bp, Mus musculus
gaggacaaaacacgaatggaagccc

SEQ ID NO: 931574 - DNA, 25 bp, Mus musculus
gaggacaaaacactgaccaagaaga

SEQ ID NO: 931575 - DNA, 25 bp, Mus musculus
gaggacaaaacaggaatggaagccc

SEQ ID NO: 931576 - DNA, 25 bp, Mus musculus
gaggacaaaacagtgaccaagaaga

SEQ ID NO: 931577 - DNA, 25 bp, Mus musculus
gaggacaaaaccaacgatgtggagt

SEQ ID NO: 931578 - DNA, 25 bp, Mus musculus
gaggacaaaaccaaggatgtggagt

SEQ ID NO: 931579 - DNA, 25 bp, Mus musculus
gaggacaaagatcttgactcccagg

SEQ ID NO: 931580 - DNA, 25 bp, Mus musculus
gaggacaaagctcaagcaggtagag

SEQ ID NO: 931581 - DNA, 25 bp, Mus musculus
gaggacaaaggtcaagcaggtagag

SEQ ID NO: 931582 - DNA, 25 bp, Mus musculus
gaggacaaagttcttgactcccagg

SEQ ID NO: 931583 - DNA, 25 bp, Mus musculus
gaggacaacatcaacgtgtctttgg

SEQ ID NO: 931584 - DNA, 25 bp, Mus musculus
gaggacaacatcaaggtgtctttgg

SEQ ID NO: 931585 - DNA, 25 bp, Mus musculus
gaggacaacgatgtcattgaagcag

SEQ ID NO: 931586 - DNA, 25 bp, Mus musculus
gaggacaacgttgtcattgaagcag

SEQ ID NO: 931587 - DNA, 25 bp, Mus musculus
gaggacaatgaccgggatggcgtgg

SEQ ID NO: 931588 - DNA, 25 bp, Mus musculus
gaggacaatgacggggatggcgtgg

SEQ ID NO: 931589 - DNA, 25 bp, Mus musculus
gaggacaatgcttccttggattcat

SEQ ID NO: 931590 - DNA, 25 bp, Mus musculus
gaggacaatggttccttggattcat

SEQ ID NO: 931591 - DNA, 25 bp, Mus musculus
gaggacaccaagcgtccaccaacag

SEQ ID NO: 931592 - DNA, 25 bp, Mus musculus
gaggacaccaagggtccaccaacag

SEQ ID NO: 931593 - DNA, 25 bp, Mus musculus
gaggacaccgcgcacatctcaagca

SEQ ID NO: 931594 - DNA, 25 bp, Mus musculus
gaggacaccgcgcagatctcaagca

SEQ ID NO: 931595 - DNA, 25 bp, Mus musculus
gaggacactgaaagtgtcatgtcac

SEQ ID NO: 931596 - DNA, 25 bp, Mus musculus
gaggacactgaactcctacctggac

SEQ ID NO: 931597 - DNA, 25 bp, Mus musculus
gaggacactgaagaaagtgtcatgt

SEQ ID NO: 931598 - DNA, 25 bp, Mus musculus
gaggacactgtaagtgtcatgtcac

SEQ ID NO: 931599 - DNA, 25 bp, Mus musculus
gaggacactgtactcctacctggac

SEQ ID NO: 931600 - DNA, 25 bp, Mus musculus
gaggacactgtagaaagtgtcatgt

SEQ ID NO: 931601 - DNA, 25 bp, Mus musculus
gaggacagactggacgcattctgga

SEQ ID NO: 931602 - DNA, 25 bp, Mus musculus
gaggacagactggaggcattctgga

SEQ ID NO: 931603 - DNA, 25 bp, Mus musculus
gaggacagctatgacttcatcggtg

SEQ ID NO: 931604 - DNA, 25 bp, Mus musculus
gaggacagctatgatttcattggtg

SEQ ID NO: 931605 - DNA, 25 bp, Mus musculus
gaggacagctttgacttcatcggtg

SEQ ID NO: 931606 - DNA, 25 bp, Mus musculus
gaggacagctttgatttcattggtg

SEQ ID NO: 931607 - DNA, 25 bp, Mus musculus
gaggacaggaagagactcgcaaagc

SEQ ID NO: 931608 - DNA, 25 bp, Mus musculus
gaggacaggaagtgactcgcaaagc

SEQ ID NO: 931609 - DNA, 25 bp, Mus musculus
gaggacagtgtgaccgtaccgaccc

SEQ ID NO: 931610 - DNA, 25 bp, Mus musculus
gaggacagtgtgacggtaccgaccc

SEQ ID NO: 931611 - DNA, 25 bp, Mus musculus
gaggacatcattcacaaatggcaaa

SEQ ID NO: 931612 - DNA, 25 bp, Mus musculus
gaggacatcattcacggctgcaaaa

SEQ ID NO: 931613 - DNA, 25 bp, Mus musculus
gaggacatcattcagaaatggcaaa

SEQ ID NO: 931614 - DNA, 25 bp, Mus musculus
gaggacatcattcagggctgcaaaa

SEQ ID NO: 931615 - DNA, 25 bp, Mus musculus
gaggacatctcacaaaaaacatcgg

SEQ ID NO: 931616 - DNA, 25 bp, Mus musculus
gaggacatctcacataaaacatcgg

SEQ ID NO: 931617 - DNA, 25 bp, Mus musculus
gaggacatgaaacacgctctcaccc

SEQ ID NO: 931618 - DNA, 25 bp, Mus musculus
gaggacatgaaacaggctctcaccc

SEQ ID NO: 931619 - DNA, 25 bp, Mus musculus
gaggacatggcgaatgtgttgaata

SEQ ID NO: 931620 - DNA, 25 bp, Mus musculus
gaggacatggggaatgtgttgaata

SEQ ID NO: 931621 - DNA, 25 bp, Mus musculus
gaggacattaagacctgctgtaact

SEQ ID NO: 931622 - DNA, 25 bp, Mus musculus
gaggacattaagtcctgctgtaact

SEQ ID NO: 931623 - DNA, 25 bp, Mus musculus
gaggaccaagccaatacagtgttgg

SEQ ID NO: 931624 - DNA, 25 bp, Mus musculus
gaggaccaaggcaatacagtgttgg

SEQ ID NO: 931625 - DNA, 25 bp, Mus musculus
gaggaccacgacgcactgaaggagg

SEQ ID NO: 931626 - DNA, 25 bp, Mus musculus
gaggaccacgacgctctgaaggagg

SEQ ID NO: 931627 - DNA, 25 bp, Mus musculus
gaggaccagcgacattcataggacc

SEQ ID NO: 931628 - DNA, 25 bp, Mus musculus
gaggaccagcgagattcataggacc

SEQ ID NO: 931629 - DNA, 25 bp, Mus musculus
gaggaccctcagctttgatgaagat

SEQ ID NO: 931630 - DNA, 25 bp, Mus musculus
gaggaccctcaggtttgatgaagat

SEQ ID NO: 931631 - DNA, 25 bp, Mus musculus
gaggacctccaaccgctcatcgaca

SEQ ID NO: 931632 - DNA, 25 bp, Mus musculus
gaggacctccaagcgctcatcgaca

SEQ ID NO: 931633 - DNA, 25 bp, Mus musculus
gaggacctgagagaagtgtgctaat

SEQ ID NO: 931634 - DNA, 25 bp, Mus musculus
gaggacctgagagatgtgtgctaat

SEQ ID NO: 931635 - DNA, 25 bp, Mus musculus
gaggaccttcggcgctgggcttcaa

SEQ ID NO: 931636 - DNA, 25 bp, Mus musculus
gaggaccttcggggctgggcttcaa

SEQ ID NO: 931637 - DNA, 25 bp, Mus musculus
gaggaccttgagcaccccaaagaag

SEQ ID NO: 931638 - DNA, 25 bp, Mus musculus
gaggaccttgagcacgaggcttctc

SEQ ID NO: 931639 - DNA, 25 bp, Mus musculus
gaggaccttgagcagcccaaagaag

SEQ ID NO: 931640 - DNA, 25 bp, Mus musculus
gaggaccttgagcaggaggcttctc

SEQ ID NO: 931641 - DNA, 25 bp, Mus musculus
gaggacgaaaccaccaaccgcatgc

SEQ ID NO: 931642 - DNA, 25 bp, Mus musculus
gaggacgaaaccacgaaccgcatgc

SEQ ID NO: 931643 - DNA, 25 bp, Mus musculus
gaggacgaagtgattgactttggcg

SEQ ID NO: 931644 - DNA, 25 bp, Mus musculus
gaggacgaagtgtttgactttggcg

SEQ ID NO: 931645 - DNA, 25 bp, Mus musculus
gaggacgacctgcacctactgaagt

SEQ ID NO: 931646 - DNA, 25 bp, Mus musculus
gaggacgacctgcagctactgaagt

SEQ ID NO: 931647 - DNA, 25 bp, Mus musculus
gaggacgacgaagtcaaccgaatgc

SEQ ID NO: 931648 - DNA, 25 bp, Mus musculus
gaggacgacgaagtgaaccgaatgc

SEQ ID NO: 931649 - DNA, 25 bp, Mus musculus
gaggacgatgatcgcttgtggaggc

SEQ ID NO: 931650 - DNA, 25 bp, Mus musculus
gaggacgatgatggcttgtggaggc

SEQ ID NO: 931651 - DNA, 25 bp, Mus musculus
gaggacgcagaagacactgagagga

SEQ ID NO: 931652 - DNA, 25 bp, Mus musculus
gaggacgcagaagaccctaccgagg

SEQ ID NO: 931653 - DNA, 25 bp, Mus musculus
gaggacgcagaagactttgactttg

SEQ ID NO: 931654 - DNA, 25 bp, Mus musculus
gaggacgcagaagagactgagagga

SEQ ID NO: 931655 - DNA, 25 bp, Mus musculus
gaggacgcagaagagcctaccgagg

SEQ ID NO: 931656 - DNA, 25 bp, Mus musculus
gaggacgcagaagagtttgactttg

SEQ ID NO: 931657 - DNA, 25 bp, Mus musculus
gaggacgccccacctggaagtccgt

SEQ ID NO: 931658 - DNA, 25 bp, Mus musculus
gaggacgccccagctggaagtccgt

SEQ ID NO: 931659 - DNA, 25 bp, Mus musculus
gaggacgcgatacttctgacacaac

SEQ ID NO: 931660 - DNA, 25 bp, Mus musculus
gaggacgcgatagttctgacacaac

SEQ ID NO: 931661 - DNA, 25 bp, Mus musculus
gaggacgttcagcttcgtctcaata

SEQ ID NO: 931662 - DNA, 25 bp, Mus musculus
gaggacgttcaggttcgtctcaata

SEQ ID NO: 931663 - DNA, 25 bp, Mus musculus
gaggactaacaacacagaggtcaca

SEQ ID NO: 931664 - DNA, 25 bp, Mus musculus
gaggactaacaagacagaggtcaca

SEQ ID NO: 931665 - DNA, 25 bp, Mus musculus
gaggactatgccaggttcaccggac

SEQ ID NO: 931666 - DNA, 25 bp, Mus musculus
gaggactatggcaggttcaccggac

SEQ ID NO: 931667 - DNA, 25 bp, Mus musculus
gaggactgagctggtgaaaaacaac

SEQ ID NO: 931668 - DNA, 25 bp, Mus musculus
gaggactgaggtggtgaaaaacaac

SEQ ID NO: 931669 - DNA, 25 bp, Mus musculus
gaggactgccccaacgctgacttcc

SEQ ID NO: 931670 - DNA, 25 bp, Mus musculus
gaggactgccccaaggctgacttcc

SEQ ID NO: 931671 - DNA, 25 bp, Mus musculus
gaggactgttatgaaagagaagatg

SEQ ID NO: 931672 - DNA, 25 bp, Mus musculus
gaggactgttttgaaagagaagatg

SEQ ID NO: 931673 - DNA, 25 bp, Mus musculus
gaggacttccagaaaagccagtaag

SEQ ID NO: 931674 - DNA, 25 bp, Mus musculus
gaggacttccagtaaagccagtaag

SEQ ID NO: 931675 - DNA, 25 bp, Mus musculus
gaggagaaagccttgtagccgccca

SEQ ID NO: 931676 - DNA, 25 bp, Mus musculus
gaggagaaaggcttgtagccgccca

SEQ ID NO: 931677 - DNA, 25 bp, Mus musculus
gaggagaacccagttcatatccagt

SEQ ID NO: 931678 - DNA, 25 bp, Mus musculus
gaggagaaccgagttcatatccagt

SEQ ID NO: 931679 - DNA, 25 bp, Mus musculus
gaggagaaccgcaacatatttcttc

SEQ ID NO: 931680 - DNA, 25 bp, Mus musculus
gaggagaaccgcaagatatttcttc

SEQ ID NO: 931681 - DNA, 25 bp, Mus musculus
gaggagaactcacaggaggatgaaa

SEQ ID NO: 931682 - DNA, 25 bp, Mus musculus
gaggagaactcagaggaggatgaaa

SEQ ID NO: 931683 - DNA, 25 bp, Mus musculus
gaggagaagaagaacgtagctacat

SEQ ID NO: 931684 - DNA, 25 bp, Mus musculus
gaggagaagaagaaggtagctacat

SEQ ID NO: 931685 - DNA, 25 bp, Mus musculus
gaggagaatgacccagaaatcctgg

SEQ ID NO: 931686 - DNA, 25 bp, Mus musculus
gaggagaatgagcatgctcgcacca

SEQ ID NO: 931687 - DNA, 25 bp, Mus musculus
gaggagaatgaggatgctcgcacca

SEQ ID NO: 931688 - DNA, 25 bp, Mus musculus
gaggagaatgtcccagaaatcctgg

SEQ ID NO: 931689 - DNA, 25 bp, Mus musculus
gaggagacagagctattgacctcat

SEQ ID NO: 931690 - DNA, 25 bp, Mus musculus
gaggagacagaggtattgacctcat

SEQ ID NO: 931691 - DNA, 25 bp, Mus musculus
gaggagacagatgtgaggtgagatg

SEQ ID NO: 931692 - DNA, 25 bp, Mus musculus
gaggagacagcaaggcgtagggaat

SEQ ID NO: 931693 - DNA, 25 bp, Mus musculus
gaggagacaggaaggcgtagggaat

SEQ ID NO: 931694 - DNA, 25 bp, Mus musculus
gaggagacagggctacctgtgggtg

SEQ ID NO: 931695 - DNA, 25 bp, Mus musculus
gaggagacaggggtacctgtgggtg

SEQ ID NO: 931696 - DNA, 25 bp, Mus musculus
gaggagacagttgtgaggtgagatg

SEQ ID NO: 931697 - DNA, 25 bp, Mus musculus
gaggagacccgacgcccaggagaca

SEQ ID NO: 931698 - DNA, 25 bp, Mus musculus
gaggagacccgaggcccaggagaca

SEQ ID NO: 931699 - DNA, 25 bp, Mus musculus
gaggagacgaaacagcttggattct

SEQ ID NO: 931700 - DNA, 25 bp, Mus musculus
gaggagacgaaagagcttggattct

SEQ ID NO: 931701 - DNA, 25 bp, Mus musculus
gaggagacgctgaacaggtcctggg

SEQ ID NO: 931702 - DNA, 25 bp, Mus musculus
gaggagacgctgaagaggtcctggg

SEQ ID NO: 931703 - DNA, 25 bp, Mus musculus
gaggagacttggcttgggggcatgt

SEQ ID NO: 931704 - DNA, 25 bp, Mus musculus
gaggagacttgggttgggggcatgt

SEQ ID NO: 931705 - DNA, 25 bp, Mus musculus
gaggagagaaaacggagctgtgatt

SEQ ID NO: 931706 - DNA, 25 bp, Mus musculus
gaggagagaaaagggagctgtgatt

SEQ ID NO: 931707 - DNA, 25 bp, Mus musculus
gaggagagagaatgactctgtggtg

SEQ ID NO: 931708 - DNA, 25 bp, Mus musculus
gaggagagagaccacgataagaaac

SEQ ID NO: 931709 - DNA, 25 bp, Mus musculus
gaggagagagaccaggataagaaac

SEQ ID NO: 931710 - DNA, 25 bp, Mus musculus
gaggagagagctacaatttcttcac

SEQ ID NO: 931711 - DNA, 25 bp, Mus musculus
gaggagagaggtacaatttcttcac

SEQ ID NO: 931712 - DNA, 25 bp, Mus musculus
gaggagagagtatgactctgtggtg

SEQ ID NO: 931713 - DNA, 25 bp, Mus musculus
gaggagagcaaaaacaatcgggttg

SEQ ID NO: 931714 - DNA, 25 bp, Mus musculus
gaggagagcaaaaactttcgtgaac

SEQ ID NO: 931715 - DNA, 25 bp, Mus musculus
gaggagagcaaaaagaatcgggttg

SEQ ID NO: 931716 - DNA, 25 bp, Mus musculus
gaggagagcaaaaagtttcgtgaac

SEQ ID NO: 931717 - DNA, 25 bp, Mus musculus
gaggagagctgacgcacctccaagt

SEQ ID NO: 931718 - DNA, 25 bp, Mus musculus
gaggagagctgaggcacctccaagt

SEQ ID NO: 931719 - DNA, 25 bp, Mus musculus
gaggagagcttcaacgcatatgagc

SEQ ID NO: 931720 - DNA, 25 bp, Mus musculus
gaggagagcttcaaggcatatgagc

SEQ ID NO: 931721 - DNA, 25 bp, Mus musculus
gaggagaggctggacgctgagtttg

SEQ ID NO: 931722 - DNA, 25 bp, Mus musculus
gaggagaggctggaggctgagtttg

SEQ ID NO: 931723 - DNA, 25 bp, Mus musculus
gaggagagggacatcatgctagcca

SEQ ID NO: 931724 - DNA, 25 bp, Mus musculus
gaggagagggacatgatgctagcca

SEQ ID NO: 931725 - DNA, 25 bp, Mus musculus
gaggagagggggagccatttgcagg

SEQ ID NO: 931726 - DNA, 25 bp, Mus musculus
gaggagagggggaggcatttgcagg

SEQ ID NO: 931727 - DNA, 25 bp, Mus musculus
gaggagagtgagaacatcttggctg

SEQ ID NO: 931728 - DNA, 25 bp, Mus musculus
gaggagagtgagaagatcttggctg

SEQ ID NO: 931729 - DNA, 25 bp, Mus musculus
gaggagagtttgaacgcttcgtggc

SEQ ID NO: 931730 - DNA, 25 bp, Mus musculus
gaggagagtttgaaggcttcgtggc

SEQ ID NO: 931731 - DNA, 25 bp, Mus musculus
gaggagatcaagaggatagataggt

SEQ ID NO: 931732 - DNA, 25 bp, Mus musculus
gaggagatcaagattgaacagcatc

SEQ ID NO: 931733 - DNA, 25 bp, Mus musculus
gaggagatcaagcacttgcaccaga

SEQ ID NO: 931734 - DNA, 25 bp, Mus musculus
gaggagatcaaggacttgcaccaga

SEQ ID NO: 931735 - DNA, 25 bp, Mus musculus
gaggagatcaagtggatagataggt

SEQ ID NO: 931736 - DNA, 25 bp, Mus musculus
gaggagatcaagtttgaacagcatc

SEQ ID NO: 931737 - DNA, 25 bp, Mus musculus
gaggagatcgagcgcctgatctcag

SEQ ID NO: 931738 - DNA, 25 bp, Mus musculus
gaggagatcgagggcctgatctcag

SEQ ID NO: 931739 - DNA, 25 bp, Mus musculus
gaggagatgagcagcagccggcccc

SEQ ID NO: 931740 - DNA, 25 bp, Mus musculus
gaggagatgagcaggagccggcccc

SEQ ID NO: 931741 - DNA, 25 bp, Mus musculus
gaggagatggacgtggatgagtgcc

SEQ ID NO: 931742 - DNA, 25 bp, Mus musculus
gaggagatggagacatctcaagctg

SEQ ID NO: 931743 - DNA, 25 bp, Mus musculus
gaggagatggagcacgccccagaga

SEQ ID NO: 931744 - DNA, 25 bp, Mus musculus
gaggagatggagtcatctcaagctg

SEQ ID NO: 931745 - DNA, 25 bp, Mus musculus
gaggagatggtcgtggatgagtgcc

SEQ ID NO: 931746 - DNA, 25 bp, Mus musculus
gaggagatggtgcacgccccagaga

SEQ ID NO: 931747 - DNA, 25 bp, Mus musculus
gaggagatgtgttcattccacggca

SEQ ID NO: 931748 - DNA, 25 bp, Mus musculus
gaggagatgtgttctttccacggca

SEQ ID NO: 931749 - DNA, 25 bp, Mus musculus
gaggagattgaacagctccgagagg

SEQ ID NO: 931750 - DNA, 25 bp, Mus musculus
gaggagattgaagagctccgagagg

SEQ ID NO: 931751 - DNA, 25 bp, Mus musculus
gaggagattgagcaccttgttgctc

SEQ ID NO: 931752 - DNA, 25 bp, Mus musculus
gaggagattgaggaccttgttgctc

SEQ ID NO: 931753 - DNA, 25 bp, Mus musculus
gaggagatttcaaaagctgatgtgg

SEQ ID NO: 931754 - DNA, 25 bp, Mus musculus
gaggagatttcataagctgatgtgg

SEQ ID NO: 931755 - DNA, 25 bp, Mus musculus
gaggagcaaacgcaagcgagaaaac

SEQ ID NO: 931756 - DNA, 25 bp, Mus musculus
gaggagcaaacggaagcgagaaaac

SEQ ID NO: 931757 - DNA, 25 bp, Mus musculus
gaggagcaaaggagccttggtgcta

SEQ ID NO: 931758 - DNA, 25 bp, Mus musculus
gaggagcaaaggaggcttggtgcta

SEQ ID NO: 931759 - DNA, 25 bp, Mus musculus
gaggagcacctgcaccgtgtgggcc

SEQ ID NO: 931760 - DNA, 25 bp, Mus musculus
gaggagcacctgcagcgtgtgggcc

SEQ ID NO: 931761 - DNA, 25 bp, Mus musculus
gaggagcactgcccggtggccacct

SEQ ID NO: 931762 - DNA, 25 bp, Mus musculus
gaggagcactgcgcggtggccacct

SEQ ID NO: 931763 - DNA, 25 bp, Mus musculus
gaggagcagaagcaccttcgtcata

SEQ ID NO: 931764 - DNA, 25 bp, Mus musculus
gaggagcagaagcagcttcgtcata

SEQ ID NO: 931765 - DNA, 25 bp, Mus musculus
gaggagcagccgctgtatcttcgag

SEQ ID NO: 931766 - DNA, 25 bp, Mus musculus
gaggagcagccggtgtatcttcgag

SEQ ID NO: 931767 - DNA, 25 bp, Mus musculus
gaggagccagcaaggtggtcagtgg

SEQ ID NO: 931768 - DNA, 25 bp, Mus musculus
gaggagccaggaaggtggtcagtgg

SEQ ID NO: 931769 - DNA, 25 bp, Mus musculus
gaggagccatcaatgtatcattgat

SEQ ID NO: 931770 - DNA, 25 bp, Mus musculus
gaggagccatgaatgtatcattgat

SEQ ID NO: 931771 - DNA, 25 bp, Mus musculus
gaggagcctatgaacgaaccacatg

SEQ ID NO: 931772 - DNA, 25 bp, Mus musculus
gaggagcctatgaaggaaccacatg

SEQ ID NO: 931773 - DNA, 25 bp, Mus musculus
gaggagcgagcccaccaggaagatg

SEQ ID NO: 931774 - DNA, 25 bp, Mus musculus
gaggagcgagcccacgcaagaagac

SEQ ID NO: 931775 - DNA, 25 bp, Mus musculus
gaggagcgagcccagcaggaagatg

SEQ ID NO: 931776 - DNA, 25 bp, Mus musculus
gaggagcgagcccaggcaagaagac

SEQ ID NO: 931777 - DNA, 25 bp, Mus musculus
gaggagctaaacagtgagatgattc

SEQ ID NO: 931778 - DNA, 25 bp, Mus musculus
gaggagctaaatctgaagtccctac

SEQ ID NO: 931779 - DNA, 25 bp, Mus musculus
gaggagctaatcagtgagatgattc

SEQ ID NO: 931780 - DNA, 25 bp, Mus musculus
gaggagctaattctgaagtccctac

SEQ ID NO: 931781 - DNA, 25 bp, Mus musculus
gaggagctcctcaacaagcttaagc

SEQ ID NO: 931782 - DNA, 25 bp, Mus musculus
gaggagctcctctacaagcttaagc

SEQ ID NO: 931783 - DNA, 25 bp, Mus musculus
gaggagctgaagctcacatgtcaaa

SEQ ID NO: 931784 - DNA, 25 bp, Mus musculus
gaggagctgaaggtcacatgtcaaa

SEQ ID NO: 931785 - DNA, 25 bp, Mus musculus
gaggagctgcacaactcacgggtca

SEQ ID NO: 931786 - DNA, 25 bp, Mus musculus
gaggagctgcacaagtcacgggtca

SEQ ID NO: 931787 - DNA, 25 bp, Mus musculus
gaggagctgcagcacgacctgcgag

SEQ ID NO: 931788 - DNA, 25 bp, Mus musculus
gaggagctgcagcaggacctgcgag

SEQ ID NO: 931789 - DNA, 25 bp, Mus musculus
gaggagctgctccgcaatctctatg

SEQ ID NO: 931790 - DNA, 25 bp, Mus musculus
gaggagctgctccggaatctctatg

SEQ ID NO: 931791 - DNA, 25 bp, Mus musculus
gaggagctggagatggaagcaaaaa

SEQ ID NO: 931792 - DNA, 25 bp, Mus musculus
gaggagctggatggaagcaaaaaag

SEQ ID NO: 931793 - DNA, 25 bp, Mus musculus
gaggagctggtgatggaagcaaaaa

SEQ ID NO: 931794 - DNA, 25 bp, Mus musculus
gaggagctggttggaagcaaaaaag

SEQ ID NO: 931795 - DNA, 25 bp, Mus musculus
gaggagcttgagccgggcagggagc

SEQ ID NO: 931796 - DNA, 25 bp, Mus musculus
gaggagcttgaggcgggcagggagc

SEQ ID NO: 931797 - DNA, 25 bp, Mus musculus
gaggagctttgccacgaatctggtc

SEQ ID NO: 931798 - DNA, 25 bp, Mus musculus
gaggagctttgccaggaatctggtc

SEQ ID NO: 931799 - DNA, 25 bp, Mus musculus
gaggaggaagacaacgacctgtata

SEQ ID NO: 931800 - DNA, 25 bp, Mus musculus
gaggaggaagacaaggacctgtata

SEQ ID NO: 931801 - DNA, 25 bp, Mus musculus
gaggaggaagagcagccttccaaac

SEQ ID NO: 931802 - DNA, 25 bp, Mus musculus
gaggaggaagatcactctgaggaag

SEQ ID NO: 931803 - DNA, 25 bp, Mus musculus
gaggaggaagatgactctgaggaag

SEQ ID NO: 931804 - DNA, 25 bp, Mus musculus
gaggaggaagcccaggtgccccctg

SEQ ID NO: 931805 - DNA, 25 bp, Mus musculus
gaggaggaaggccaggtgccccctg

SEQ ID NO: 931806 - DNA, 25 bp, Mus musculus
gaggaggaagtgcagccttccaaac

SEQ ID NO: 931807 - DNA, 25 bp, Mus musculus
gaggaggacactcaaagtgtcatgt

SEQ ID NO: 931808 - DNA, 25 bp, Mus musculus
gaggaggacactcaactcctacctg

SEQ ID NO: 931809 - DNA, 25 bp, Mus musculus
gaggaggacactctagaaagtgtca

SEQ ID NO: 931810 - DNA, 25 bp, Mus musculus
gaggaggacactgaaagtgtcatgt

SEQ ID NO: 931811 - DNA, 25 bp, Mus musculus
gaggaggacactgaactcctacctg

SEQ ID NO: 931812 - DNA, 25 bp, Mus musculus
gaggaggacactgtagaaagtgtca

SEQ ID NO: 931813 - DNA, 25 bp, Mus musculus
gaggaggacagcattgacttcatcg

SEQ ID NO: 931814 - DNA, 25 bp, Mus musculus
gaggaggacagctttgacttcatcg

SEQ ID NO: 931815 - DNA, 25 bp, Mus musculus
gaggaggagaaccgagttcatatcc

SEQ ID NO: 931816 - DNA, 25 bp, Mus musculus
gaggaggagaacggagttcatatcc

SEQ ID NO: 931817 - DNA, 25 bp, Mus musculus
gaggaggagacacatgtgaggtgag

SEQ ID NO: 931818 - DNA, 25 bp, Mus musculus
gaggaggagacacgaaggcgtaggg

SEQ ID NO: 931819 - DNA, 25 bp, Mus musculus
gaggaggagacagatgtgaggtgag

SEQ ID NO: 931820 - DNA, 25 bp, Mus musculus
gaggaggagacaggaaggcgtaggg

SEQ ID NO: 931821 - DNA, 25 bp, Mus musculus
gaggaggagcaaaccgaagcgagaa

SEQ ID NO: 931822 - DNA, 25 bp, Mus musculus
gaggaggagcaaacggaagcgagaa

SEQ ID NO: 931823 - DNA, 25 bp, Mus musculus
gaggaggagcagaaaagcaaaagaa

SEQ ID NO: 931824 - DNA, 25 bp, Mus musculus
gaggaggagcagtaaagcaaaagaa

SEQ ID NO: 931825 - DNA, 25 bp, Mus musculus
gaggaggaggacgatgtggacctag

SEQ ID NO: 931826 - DNA, 25 bp, Mus musculus
gaggaggaggcccacgcccttctca

SEQ ID NO: 931827 - DNA, 25 bp, Mus musculus
gaggaggaggcccaggcccttctca

SEQ ID NO: 931828 - DNA, 25 bp, Mus musculus
gaggaggaggtcgatgtggacctag

SEQ ID NO: 931829 - DNA, 25 bp, Mus musculus
gaggaggagtcacatgatctagcac

SEQ ID NO: 931830 - DNA, 25 bp, Mus musculus
gaggaggagtcactgcaagggccat

SEQ ID NO: 931831 - DNA, 25 bp, Mus musculus
gaggaggagtcagatgatctagcac

SEQ ID NO: 931832 - DNA, 25 bp, Mus musculus
gaggaggagtcagtgcaagggccat

SEQ ID NO: 931833 - DNA, 25 bp, Mus musculus
gaggaggatgagcatggtgggcatt

SEQ ID NO: 931834 - DNA, 25 bp, Mus musculus
gaggaggatgagcattttgattggg

SEQ ID NO: 931835 - DNA, 25 bp, Mus musculus
gaggaggatgaggatggtgggcatt

SEQ ID NO: 931836 - DNA, 25 bp, Mus musculus
gaggaggatgaggattttgattggg

SEQ ID NO: 931837 - DNA, 25 bp, Mus musculus
gaggaggattacctgaacatgtttg

SEQ ID NO: 931838 - DNA, 25 bp, Mus musculus
gaggaggattacgtgaacatgtttg

SEQ ID NO: 931839 - DNA, 25 bp, Mus musculus
gaggaggcagagcgaagacttgcca

SEQ ID NO: 931840 - DNA, 25 bp, Mus musculus
gaggaggcagagggaagacttgcca

SEQ ID NO: 931841 - DNA, 25 bp, Mus musculus
gaggaggcagtacggttgctagatc

SEQ ID NO: 931842 - DNA, 25 bp, Mus musculus
gaggaggcagtagggttgctagatc

SEQ ID NO: 931843 - DNA, 25 bp, Mus musculus
gaggaggcccagccccttctcagtg

SEQ ID NO: 931844 - DNA, 25 bp, Mus musculus
gaggaggcccaggcccttctcagtg

SEQ ID NO: 931845 - DNA, 25 bp, Mus musculus
gaggaggccccagcccctggtatta

SEQ ID NO: 931846 - DNA, 25 bp, Mus musculus
gaggaggccccagcgcctggtatta

SEQ ID NO: 931847 - DNA, 25 bp, Mus musculus
gaggaggccgaagaagcacttaaag

SEQ ID NO: 931848 - DNA, 25 bp, Mus musculus
gaggaggccgagaactactctcaga

SEQ ID NO: 931849 - DNA, 25 bp, Mus musculus
gaggaggccgagaagtactctcaga

SEQ ID NO: 931850 - DNA, 25 bp, Mus musculus
gaggaggccgtagaagcacttaaag

SEQ ID NO: 931851 - DNA, 25 bp, Mus musculus
gaggaggcggacgagcaaaaatcaa

SEQ ID NO: 931852 - DNA, 25 bp, Mus musculus
gaggaggcggagaacctgtggtgac

SEQ ID NO: 931853 - DNA, 25 bp, Mus musculus
gaggaggcggagaagctgtggtgac

SEQ ID NO: 931854 - DNA, 25 bp, Mus musculus
gaggaggcggtcgagcaaaaatcaa

SEQ ID NO: 931855 - DNA, 25 bp, Mus musculus
gaggagggacagcagtgacactgtt

SEQ ID NO: 931856 - DNA, 25 bp, Mus musculus
gaggagggacaggagtgacactgtt

SEQ ID NO: 931857 - DNA, 25 bp, Mus musculus
gaggaggtgcagaatgtggacgacg

SEQ ID NO: 931858 - DNA, 25 bp, Mus musculus
gaggaggtgcagtatgtggacgacg

SEQ ID NO: 931859 - DNA, 25 bp, Mus musculus
gaggaggtgccacacccaccatgcc

SEQ ID NO: 931860 - DNA, 25 bp, Mus musculus
gaggaggtgccacagccaccatgcc

SEQ ID NO: 931861 - DNA, 25 bp, Mus musculus
gaggaggtgctgcacttacctaagt

SEQ ID NO: 931862 - DNA, 25 bp, Mus musculus
gaggaggtgctggacttacctaagt

SEQ ID NO: 931863 - DNA, 25 bp, Mus musculus
gaggaggtggcaccgctctcaaatc

SEQ ID NO: 931864 - DNA, 25 bp, Mus musculus
gaggaggtggcagcgctctcaaatc

SEQ ID NO: 931865 - DNA, 25 bp, Mus musculus
gaggagtaccagcagaccctgagca

SEQ ID NO: 931866 - DNA, 25 bp, Mus musculus
gaggagtaccagcaggagctggagt

SEQ ID NO: 931867 - DNA, 25 bp, Mus musculus
gaggagtaccaggagaccctgagca

SEQ ID NO: 931868 - DNA, 25 bp, Mus musculus
gaggagtaccaggaggagctggagt

SEQ ID NO: 931869 - DNA, 25 bp, Mus musculus
gaggagtcaatacacgtgtggcaaa

SEQ ID NO: 931870 - DNA, 25 bp, Mus musculus
gaggagtcaatacagggagaagctg

SEQ ID NO: 931871 - DNA, 25 bp, Mus musculus
gaggagtcaatacaggtgtggcaaa

SEQ ID NO: 931872 - DNA, 25 bp, Mus musculus
gaggagtcaatagagggagaagctg

SEQ ID NO: 931873 - DNA, 25 bp, Mus musculus
gaggagtcagagcaagggccatcac

SEQ ID NO: 931874 - DNA, 25 bp, Mus musculus
gaggagtcagatgatctagcactaa

SEQ ID NO: 931875 - DNA, 25 bp, Mus musculus
gaggagtcagtgcaagggccatcac

SEQ ID NO: 931876 - DNA, 25 bp, Mus musculus
gaggagtcagttgatctagcactaa

SEQ ID NO: 931877 - DNA, 25 bp, Mus musculus
gaggagtctcttaacaatataaaag

SEQ ID NO: 931878 - DNA, 25 bp, Mus musculus
gaggagtctcttaagaatataaaag

SEQ ID NO: 931879 - DNA, 25 bp, Mus musculus
gaggagtggaaacaactgatataca

SEQ ID NO: 931880 - DNA, 25 bp, Mus musculus
gaggagtggaaagaactgatataca

SEQ ID NO: 931881 - DNA, 25 bp, Mus musculus
gaggagttgatgcaccccgtggctc

SEQ ID NO: 931882 - DNA, 25 bp, Mus musculus
gaggagttgatgcagcccgtggctc

SEQ ID NO: 931883 - DNA, 25 bp, Mus musculus
gaggataaaacatgaagaagatgat

SEQ ID NO: 931884 - DNA, 25 bp, Mus musculus
gaggataaaagatgaagaagatgat

SEQ ID NO: 931885 - DNA, 25 bp, Mus musculus
gaggataactacaaagttcagctgg

SEQ ID NO: 931886 - DNA, 25 bp, Mus musculus
gaggataactacaatgttcagctgg

SEQ ID NO: 931887 - DNA, 25 bp, Mus musculus
gaggatagaaccatcaggctgcagc

SEQ ID NO: 931888 - DNA, 25 bp, Mus musculus
gaggatagaaccctgcgattgcaat

SEQ ID NO: 931889 - DNA, 25 bp, Mus musculus
gaggatagaaccgtgcgattgcaat

SEQ ID NO: 931890 - DNA, 25 bp, Mus musculus
gaggatagaaccttcaggctgcagc

SEQ ID NO: 931891 - DNA, 25 bp, Mus musculus
gaggatcctgtgacaggcgactacg

SEQ ID NO: 931892 - DNA, 25 bp, Mus musculus
gaggatcctgtgactggcgactacg

SEQ ID NO: 931893 - DNA, 25 bp, Mus musculus
gaggatgaactgaagttccttcagc

SEQ ID NO: 931894 - DNA, 25 bp, Mus musculus
gaggatgaactgtagttccttcagc

SEQ ID NO: 931895 - DNA, 25 bp, Mus musculus
gaggatgaagaccaatggacagaac

SEQ ID NO: 931896 - DNA, 25 bp, Mus musculus
gaggatgaagagatcgagtgcctgg

SEQ ID NO: 931897 - DNA, 25 bp, Mus musculus
gaggatgaagtccaatggacagaac

SEQ ID NO: 931898 - DNA, 25 bp, Mus musculus
gaggatgaagtgatcgagtgcctgg

SEQ ID NO: 931899 - DNA, 25 bp, Mus musculus
gaggatgacgaagtcaatcgcatgc

SEQ ID NO: 931900 - DNA, 25 bp, Mus musculus
gaggatgacgaagtgaatcgcatgc

SEQ ID NO: 931901 - DNA, 25 bp, Mus musculus
gaggatgagaggcaggagaagagac

SEQ ID NO: 931902 - DNA, 25 bp, Mus musculus
gaggatgagagggaggagaagagac

SEQ ID NO: 931903 - DNA, 25 bp, Mus musculus
gaggatgagagtaacatctcgtttt

SEQ ID NO: 931904 - DNA, 25 bp, Mus musculus
gaggatgagagtaagatctcgtttt

SEQ ID NO: 931905 - DNA, 25 bp, Mus musculus
gaggatgaggagaacaacgagaacg

SEQ ID NO: 931906 - DNA, 25 bp, Mus musculus
gaggatgaggagatcaaccgcatgc

SEQ ID NO: 931907 - DNA, 25 bp, Mus musculus
gaggatgaggagatgaaccgcatgc

SEQ ID NO: 931908 - DNA, 25 bp, Mus musculus
gaggatgaggagtacaacgagaacg

SEQ ID NO: 931909 - DNA, 25 bp, Mus musculus
gaggatgaggatggtgggcattggg

SEQ ID NO: 931910 - DNA, 25 bp, Mus musculus
gaggatgaggattttgattgggtct

SEQ ID NO: 931911 - DNA, 25 bp, Mus musculus
gaggatgaggttggtgggcattggg

SEQ ID NO: 931912 - DNA, 25 bp, Mus musculus
gaggatgaggtttttgattgggtct

SEQ ID NO: 931913 - DNA, 25 bp, Mus musculus
gaggatgatgagcatgacgatgtgg

SEQ ID NO: 931914 - DNA, 25 bp, Mus musculus
gaggatgatgaggatgacgatgtgg

SEQ ID NO: 931915 - DNA, 25 bp, Mus musculus
gaggatgccaataacgctgtggaag

SEQ ID NO: 931916 - DNA, 25 bp, Mus musculus
gaggatgccaataaggctgtggaag

SEQ ID NO: 931917 - DNA, 25 bp, Mus musculus
gaggatgctgcatccatccattaag

SEQ ID NO: 931918 - DNA, 25 bp, Mus musculus
gaggatgctggatccatccattaag

SEQ ID NO: 931919 - DNA, 25 bp, Mus musculus
gaggatggacagcaacacccaagga

SEQ ID NO: 931920 - DNA, 25 bp, Mus musculus
gaggatggacagcagcaacacccaa

SEQ ID NO: 931921 - DNA, 25 bp, Mus musculus
gaggatggacaggaacacccaagga

SEQ ID NO: 931922 - DNA, 25 bp, Mus musculus
gaggatggacaggagcaacacccaa

SEQ ID NO: 931923 - DNA, 25 bp, Mus musculus
gaggatggagaacaagtgggaaata

SEQ ID NO: 931924 - DNA, 25 bp, Mus musculus
gaggatggagaagaagtgggaaata

SEQ ID NO: 931925 - DNA, 25 bp, Mus musculus
gaggatggatcacacagaaagtgtg

SEQ ID NO: 931926 - DNA, 25 bp, Mus musculus
gaggatggatcagacagaaagtgtg

SEQ ID NO: 931927 - DNA, 25 bp, Mus musculus
gaggatggcaggctatttatgagcc

SEQ ID NO: 931928 - DNA, 25 bp, Mus musculus
gaggatggcagggtatttatgagcc

SEQ ID NO: 931929 - DNA, 25 bp, Mus musculus
gaggatggggattgcaaacagtcta

SEQ ID NO: 931930 - DNA, 25 bp, Mus musculus
gaggatggggtttgcaaacagtcta

SEQ ID NO: 931931 - DNA, 25 bp, Mus musculus
gaggatggtgtagcacatttccttc

SEQ ID NO: 931932 - DNA, 25 bp, Mus musculus
gaggatggtgtagctcatttccttc

SEQ ID NO: 931933 - DNA, 25 bp, Mus musculus
gaggatgtcgtcaacgctattgtgg

SEQ ID NO: 931934 - DNA, 25 bp, Mus musculus
gaggatgtcgtcaaggctattgtgg

SEQ ID NO: 931935 - DNA, 25 bp, Mus musculus
gaggattcacctatgggacccaggc

SEQ ID NO: 931936 - DNA, 25 bp, Mus musculus
gaggattcacgtatgggacccaggc

SEQ ID NO: 931937 - DNA, 25 bp, Mus musculus
gaggattctgagagggaggagaccg

SEQ ID NO: 931938 - DNA, 25 bp, Mus musculus
gaggattctgagtgggaggagaccg

SEQ ID NO: 931939 - DNA, 25 bp, Mus musculus
gaggattgcgagcatcgccacgact

SEQ ID NO: 931940 - DNA, 25 bp, Mus musculus
gaggattgcgaggatcgccacgact

SEQ ID NO: 931941 - DNA, 25 bp, Mus musculus
gaggcaacaaataggagaggggtca

SEQ ID NO: 931942 - DNA, 25 bp, Mus musculus
gaggcaacaaattggagaggggtca

SEQ ID NO: 931943 - DNA, 25 bp, Mus musculus
gaggcaagagcctaaagaaggtgcc

SEQ ID NO: 931944 - DNA, 25 bp, Mus musculus
gaggcaagaggctaaagaaggtgcc

SEQ ID NO: 931945 - DNA, 25 bp, Mus musculus
gaggcaataaataggagagaggtca

SEQ ID NO: 931946 - DNA, 25 bp, Mus musculus
gaggcaataaattggagagaggtca

SEQ ID NO: 931947 - DNA, 25 bp, Mus musculus
gaggcacccaagaggctctgggctc

SEQ ID NO: 931948 - DNA, 25 bp, Mus musculus
gaggcacccaagtggctctgggctc

SEQ ID NO: 931949 - DNA, 25 bp, Mus musculus
gaggcacctactcaagctctcagaa

SEQ ID NO: 931950 - DNA, 25 bp, Mus musculus
gaggcacctactcatgctctcagaa

SEQ ID NO: 931951 - DNA, 25 bp, Mus musculus
gaggcacggagacccttccatatga

SEQ ID NO: 931952 - DNA, 25 bp, Mus musculus
gaggcacggagagccttccatatga

SEQ ID NO: 931953 - DNA, 25 bp, Mus musculus
gaggcactccagattctcctgctca

SEQ ID NO: 931954 - DNA, 25 bp, Mus musculus
gaggcactccagtttctcctgctca

SEQ ID NO: 931955 - DNA, 25 bp, Mus musculus
gaggcactggacaacgacagcggcc

SEQ ID NO: 931956 - DNA, 25 bp, Mus musculus
gaggcactggacaaggacagcggcc

SEQ ID NO: 931957 - DNA, 25 bp, Mus musculus
gaggcagaatgcaatcaaaagcccc

SEQ ID NO: 931958 - DNA, 25 bp, Mus musculus
gaggcagaatgctatcaaaagcccc

SEQ ID NO: 931959 - DNA, 25 bp, Mus musculus
gaggcagagcctgacatctggtggc

SEQ ID NO: 931960 - DNA, 25 bp, Mus musculus
gaggcagagcctgacgcccaggatg

SEQ ID NO: 931961 - DNA, 25 bp, Mus musculus
gaggcagagcctgagatctggtggc

SEQ ID NO: 931962 - DNA, 25 bp, Mus musculus
gaggcagagcctgaggcccaggatg

SEQ ID NO: 931963 - DNA, 25 bp, Mus musculus
gaggcagaggagctagaggaggctt

SEQ ID NO: 931964 - DNA, 25 bp, Mus musculus
gaggcagaggaggtagaggaggctt

SEQ ID NO: 931965 - DNA, 25 bp, Mus musculus
gaggcagaggcaagacttgccagcc

SEQ ID NO: 931966 - DNA, 25 bp, Mus musculus
gaggcagagggaagacttgccagcc

SEQ ID NO: 931967 - DNA, 25 bp, Mus musculus
gaggcagataaacataatggaggtg

SEQ ID NO: 931968 - DNA, 25 bp, Mus musculus
gaggcagataaagataatggaggtg

SEQ ID NO: 931969 - DNA, 25 bp, Mus musculus
gaggcagctcgacacatgccaaagt

SEQ ID NO: 931970 - DNA, 25 bp, Mus musculus
gaggcagctcgacacgtgcagggcc

SEQ ID NO: 931971 - DNA, 25 bp, Mus musculus
gaggcagctcgacagatgccaaagt

SEQ ID NO: 931972 - DNA, 25 bp, Mus musculus
gaggcagctcgacaggtgcagggcc

SEQ ID NO: 931973 - DNA, 25 bp, Mus musculus
gaggcagcttcgccacatatttcat

SEQ ID NO: 931974 - DNA, 25 bp, Mus musculus
gaggcagcttcggcacatatttcat

SEQ ID NO: 931975 - DNA, 25 bp, Mus musculus
gaggcaggagcagtttcggacgtgg

SEQ ID NO: 931976 - DNA, 25 bp, Mus musculus
gaggcaggaggagtttcggacgtgg

SEQ ID NO: 931977 - DNA, 25 bp, Mus musculus
gaggcagggactggcctgcaggtcc

SEQ ID NO: 931978 - DNA, 25 bp, Mus musculus
gaggcagggactgggctgcaggtcc

SEQ ID NO: 931979 - DNA, 25 bp, Mus musculus
gaggcaggtgcagggagctctccta

SEQ ID NO: 931980 - DNA, 25 bp, Mus musculus
gaggcaggtggagggagctctccta

SEQ ID NO: 931981 - DNA, 25 bp, Mus musculus
gaggcagtagcgttgctagatctgg

SEQ ID NO: 931982 - DNA, 25 bp, Mus musculus
gaggcagtagggttgctagatctgg

SEQ ID NO: 931983 - DNA, 25 bp, Mus musculus
gaggcagtggtggacgtcagagtca

SEQ ID NO: 931984 - DNA, 25 bp, Mus musculus
gaggcagtggtggacgtcagggtag

SEQ ID NO: 931985 - DNA, 25 bp, Mus musculus
gaggcagtggtggaggtcagagtca

SEQ ID NO: 931986 - DNA, 25 bp, Mus musculus
gaggcagtggtggaggtcagggtag

SEQ ID NO: 931987 - DNA, 25 bp, Mus musculus
gaggcagtttgacgagtgcatttcc

SEQ ID NO: 931988 - DNA, 25 bp, Mus musculus
gaggcagtttgaggagtgcatttcc

SEQ ID NO: 931989 - DNA, 25 bp, Mus musculus
gaggcatagctgctctgaagagcca

SEQ ID NO: 931990 - DNA, 25 bp, Mus musculus
gaggcatagctggtctgaagagcca

SEQ ID NO: 931991 - DNA, 25 bp, Mus musculus
gaggcattgctgagttacatagtaa

SEQ ID NO: 931992 - DNA, 25 bp, Mus musculus
gaggcattgctgtgttacatagtaa

SEQ ID NO: 931993 - DNA, 25 bp, Mus musculus
gaggccaaagagcattgctctcccg

SEQ ID NO: 931994 - DNA, 25 bp, Mus musculus
gaggccaaagcaaaaatgaggagtg

SEQ ID NO: 931995 - DNA, 25 bp, Mus musculus
gaggccaaagcaaatatgaggagtg

SEQ ID NO: 931996 - DNA, 25 bp, Mus musculus
gaggccaaagtgcattgctctcccg

SEQ ID NO: 931997 - DNA, 25 bp, Mus musculus
gaggccaaccctccagaaggatgca

SEQ ID NO: 931998 - DNA, 25 bp, Mus musculus
gaggccaaccctgtgctgctgaaat

SEQ ID NO: 931999 - DNA, 25 bp, Mus musculus
gaggccaaccgtccagaaggatgca

SEQ ID NO: 932000 - DNA, 25 bp, Mus musculus
gaggccaaccgtgtgctgctgaaat

SEQ ID NO: 932001 - DNA, 25 bp, Mus musculus
gaggccaagagagccgaagctctgc

SEQ ID NO: 932002 - DNA, 25 bp, Mus musculus
gaggccaagagagcggaagctctgc

SEQ ID NO: 932003 - DNA, 25 bp, Mus musculus
gaggccaagcaccataaatacatgg

SEQ ID NO: 932004 - DNA, 25 bp, Mus musculus
gaggccaagcacctggacgagaaaa

SEQ ID NO: 932005 - DNA, 25 bp, Mus musculus
gaggccaagcacgataaatacatgg

SEQ ID NO: 932006 - DNA, 25 bp, Mus musculus
gaggccaagcacgtggacgagaaaa

SEQ ID NO: 932007 - DNA, 25 bp, Mus musculus
gaggccacagatgtggatgcggctc

SEQ ID NO: 932008 - DNA, 25 bp, Mus musculus
gaggccacagttgtggatgcggctc

SEQ ID NO: 932009 - DNA, 25 bp, Mus musculus
gaggccacggcaatgacgtgccaag

SEQ ID NO: 932010 - DNA, 25 bp, Mus musculus
gaggccacgggaatgacgtgccaag

SEQ ID NO: 932011 - DNA, 25 bp, Mus musculus
gaggccagagaactccttgaacaga

SEQ ID NO: 932012 - DNA, 25 bp, Mus musculus
gaggccagagaactgcttgaacaga

SEQ ID NO: 932013 - DNA, 25 bp, Mus musculus
gaggccagagtgcacgtgtggtttc

SEQ ID NO: 932014 - DNA, 25 bp, Mus musculus
gaggccagagtgcaggtgtggtttc

SEQ ID NO: 932015 - DNA, 25 bp, Mus musculus
gaggccagattgctggaggttactg

SEQ ID NO: 932016 - DNA, 25 bp, Mus musculus
gaggccagattggtggaggttactg

SEQ ID NO: 932017 - DNA, 25 bp, Mus musculus
gaggccagcaagctgatggatgtgg

SEQ ID NO: 932018 - DNA, 25 bp, Mus musculus
gaggccagcaaggtgatggatgtgg

SEQ ID NO: 932019 - DNA, 25 bp, Mus musculus
gaggccagttccagagggcagtggc

SEQ ID NO: 932020 - DNA, 25 bp, Mus musculus
gaggccagttcctgagggcagtggc

SEQ ID NO: 932021 - DNA, 25 bp, Mus musculus
gaggccatacagctcgtaaacacca

SEQ ID NO: 932022 - DNA, 25 bp, Mus musculus
gaggccatacagctggtaaacacca

SEQ ID NO: 932023 - DNA, 25 bp, Mus musculus
gaggccatcaaacacgtagtgaagc

SEQ ID NO: 932024 - DNA, 25 bp, Mus musculus
gaggccatcaaacaggtagtgaagc

SEQ ID NO: 932025 - DNA, 25 bp, Mus musculus
gaggccatgagagacatcccatggt

SEQ ID NO: 932026 - DNA, 25 bp, Mus musculus
gaggccatgagagacgactgcctcc

SEQ ID NO: 932027 - DNA, 25 bp, Mus musculus
gaggccatgagagacgtatatgcta

SEQ ID NO: 932028 - DNA, 25 bp, Mus musculus
gaggccatgagagagatcccatggt

SEQ ID NO: 932029 - DNA, 25 bp, Mus musculus
gaggccatgagagaggactgcctcc

SEQ ID NO: 932030 - DNA, 25 bp, Mus musculus
gaggccatgagagaggtatatgcta

SEQ ID NO: 932031 - DNA, 25 bp, Mus musculus
gaggccatggaacacgaggaagtga

SEQ ID NO: 932032 - DNA, 25 bp, Mus musculus
gaggccatggaacaggaggaagtga

SEQ ID NO: 932033 - DNA, 25 bp, Mus musculus
gaggccatttcacgtttggtatgcc

SEQ ID NO: 932034 - DNA, 25 bp, Mus musculus
gaggccatttcaggtttggtatgcc

SEQ ID NO: 932035 - DNA, 25 bp, Mus musculus
gaggcccaaacacgtatcatcagga

SEQ ID NO: 932036 - DNA, 25 bp, Mus musculus
gaggcccaaacaggtatcatcagga

SEQ ID NO: 932037 - DNA, 25 bp, Mus musculus
gaggccccagagaaggggcagagct

SEQ ID NO: 932038 - DNA, 25 bp, Mus musculus
gaggccccagcgcctggtattaatc

SEQ ID NO: 932039 - DNA, 25 bp, Mus musculus
gaggccccagcggctggtattaatc

SEQ ID NO: 932040 - DNA, 25 bp, Mus musculus
gaggccccagtgaaggggcagagct

SEQ ID NO: 932041 - DNA, 25 bp, Mus musculus
gaggcccccagtcacatctgtctcg

SEQ ID NO: 932042 - DNA, 25 bp, Mus musculus
gaggcccccagtcacgccggggctg

SEQ ID NO: 932043 - DNA, 25 bp, Mus musculus
gaggcccccagtcagatctgtctcg

SEQ ID NO: 932044 - DNA, 25 bp, Mus musculus
gaggcccccagtcaggccggggctg

SEQ ID NO: 932045 - DNA, 25 bp, Mus musculus
gaggccccccagccagtgtgacccc

SEQ ID NO: 932046 - DNA, 25 bp, Mus musculus
gaggccccccagcctgtgtgacccc

SEQ ID NO: 932047 - DNA, 25 bp, Mus musculus
gaggcccctaaagacgtgaacattg

SEQ ID NO: 932048 - DNA, 25 bp, Mus musculus
gaggcccctaaagaggtgaacattg

SEQ ID NO: 932049 - DNA, 25 bp, Mus musculus
gaggcccctcggcaatcaggggaca

SEQ ID NO: 932050 - DNA, 25 bp, Mus musculus
gaggcccctcgggaatcaggggaca

SEQ ID NO: 932051 - DNA, 25 bp, Mus musculus
gaggcccgaccgagccaagggctat

SEQ ID NO: 932052 - DNA, 25 bp, Mus musculus
gaggcccgaccgtgccaagggctat

SEQ ID NO: 932053 - DNA, 25 bp, Mus musculus
gaggcccgggcgctggatattgatg

SEQ ID NO: 932054 - DNA, 25 bp, Mus musculus
gaggcccgggggctggatattgatg

SEQ ID NO: 932055 - DNA, 25 bp, Mus musculus
gaggccctccagaacgccaagaaat

SEQ ID NO: 932056 - DNA, 25 bp, Mus musculus
gaggccctccagaaggccaagaaat

SEQ ID NO: 932057 - DNA, 25 bp, Mus musculus
gaggccctcgaaagtgccgttctct

SEQ ID NO: 932058 - DNA, 25 bp, Mus musculus
gaggccctcgaatgtgccgttctct

SEQ ID NO: 932059 - DNA, 25 bp, Mus musculus
gaggccctgacccattcacaatgac

SEQ ID NO: 932060 - DNA, 25 bp, Mus musculus
gaggccctgaccgattcacaatgac

SEQ ID NO: 932061 - DNA, 25 bp, Mus musculus
gaggccctgccccacattgctgcca

SEQ ID NO: 932062 - DNA, 25 bp, Mus musculus
gaggccctgccccagattgctgcca

SEQ ID NO: 932063 - DNA, 25 bp, Mus musculus
gaggccctggagagtggaacctgaa

SEQ ID NO: 932064 - DNA, 25 bp, Mus musculus
gaggccctggagtgtggaacctgaa

SEQ ID NO: 932065 - DNA, 25 bp, Mus musculus
gaggccgagaagaactctcagaagg

SEQ ID NO: 932066 - DNA, 25 bp, Mus musculus
gaggccgagaagtactctcagaagg

SEQ ID NO: 932067 - DNA, 25 bp, Mus musculus
gaggccgagcagaaggagggagagt

SEQ ID NO: 932068 - DNA, 25 bp, Mus musculus
gaggccgagcagtaggagggagagt

SEQ ID NO: 932069 - DNA, 25 bp, Mus musculus
gaggccggagaggagccgctgctgc

SEQ ID NO: 932070 - DNA, 25 bp, Mus musculus
gaggccggagtggagccgctgctgc

SEQ ID NO: 932071 - DNA, 25 bp, Mus musculus
gaggccggcgggaacgttggctgct

SEQ ID NO: 932072 - DNA, 25 bp, Mus musculus
gaggccggcgggaaggttggctgct

SEQ ID NO: 932073 - DNA, 25 bp, Mus musculus
gaggccggtcagctgtccttgctgg

SEQ ID NO: 932074 - DNA, 25 bp, Mus musculus
gaggccggtcaggtgtccttgctgg

SEQ ID NO: 932075 - DNA, 25 bp, Mus musculus
gaggccgtgaagagtgagccggtgg

SEQ ID NO: 932076 - DNA, 25 bp, Mus musculus
gaggccgtgaagtgtgagccggtgg

SEQ ID NO: 932077 - DNA, 25 bp, Mus musculus
gaggcctataagattcttgctcacc

SEQ ID NO: 932078 - DNA, 25 bp, Mus musculus
gaggcctataagtttcttgctcacc

SEQ ID NO: 932079 - DNA, 25 bp, Mus musculus
gaggcctcagccacctgcgaagcag

SEQ ID NO: 932080 - DNA, 25 bp, Mus musculus
gaggcctcaggcacctgcgaagcag

SEQ ID NO: 932081 - DNA, 25 bp, Mus musculus
gaggcctggagacgaagttctccct

SEQ ID NO: 932082 - DNA, 25 bp, Mus musculus
gaggcctggagaggaagttctccct

SEQ ID NO: 932083 - DNA, 25 bp, Mus musculus
gaggccttactgccccggggtgctg

SEQ ID NO: 932084 - DNA, 25 bp, Mus musculus
gaggccttactggcccggggtgctg

SEQ ID NO: 932085 - DNA, 25 bp, Mus musculus
gaggccttgcaaccaaggtgcagag

SEQ ID NO: 932086 - DNA, 25 bp, Mus musculus
gaggccttgcaacctatgtctgagc

SEQ ID NO: 932087 - DNA, 25 bp, Mus musculus
gaggccttgcaacgggagagttaga

SEQ ID NO: 932088 - DNA, 25 bp, Mus musculus
gaggccttgcaagcaaggtgcagag

SEQ ID NO: 932089 - DNA, 25 bp, Mus musculus
gaggccttgcaagctatgtctgagc

SEQ ID NO: 932090 - DNA, 25 bp, Mus musculus
gaggccttgcaaggggagagttaga

SEQ ID NO: 932091 - DNA, 25 bp, Mus musculus
gaggcctttcagagcttcctggacg

SEQ ID NO: 932092 - DNA, 25 bp, Mus musculus
gaggcctttcagtgcttcctggacg

SEQ ID NO: 932093 - DNA, 25 bp, Mus musculus
gaggcgagaaagatgagacggagta

SEQ ID NO: 932094 - DNA, 25 bp, Mus musculus
gaggcgagaaagttgagacggagta

SEQ ID NO: 932095 - DNA, 25 bp, Mus musculus
gaggcgagacctctatggcctctct

SEQ ID NO: 932096 - DNA, 25 bp, Mus musculus
gaggcgagacctctttggcctctct

SEQ ID NO: 932097 - DNA, 25 bp, Mus musculus
gaggcgagagcccccacgcatgggc

SEQ ID NO: 932098 - DNA, 25 bp, Mus musculus
gaggcgagaggccccacgcatgggc

SEQ ID NO: 932099 - DNA, 25 bp, Mus musculus
gaggcgatacaacgaacttgtggag

SEQ ID NO: 932100 - DNA, 25 bp, Mus musculus
gaggcgatacaaggaacttgtggag

SEQ ID NO: 932101 - DNA, 25 bp, Mus musculus
gaggcgcacagccgggactcgaggc

SEQ ID NO: 932102 - DNA, 25 bp, Mus musculus
gaggcgcacagccgtaaaatgtcgg

SEQ ID NO: 932103 - DNA, 25 bp, Mus musculus
gaggcgcacagcggggactcgaggc

SEQ ID NO: 932104 - DNA, 25 bp, Mus musculus
gaggcgcacagcggtaaaatgtcgg

SEQ ID NO: 932105 - DNA, 25 bp, Mus musculus
gaggcgcagaggcacataaaggaga

SEQ ID NO: 932106 - DNA, 25 bp, Mus musculus
gaggcgcagaggcagataaaggaga

SEQ ID NO: 932107 - DNA, 25 bp, Mus musculus
gaggcgcccaaactctcaggggcct

SEQ ID NO: 932108 - DNA, 25 bp, Mus musculus
gaggcgcccaaagtctcaggggcct

SEQ ID NO: 932109 - DNA, 25 bp, Mus musculus
gaggcgcccatgcacatggcctctg

SEQ ID NO: 932110 - DNA, 25 bp, Mus musculus
gaggcgcccatgcagatggcctctg

SEQ ID NO: 932111 - DNA, 25 bp, Mus musculus
gaggcgcgagcccgcaaaacgggaa

SEQ ID NO: 932112 - DNA, 25 bp, Mus musculus
gaggcgcgaggccgcaaaacgggaa

SEQ ID NO: 932113 - DNA, 25 bp, Mus musculus
gaggcgcgtgagacgcagaggcagg

SEQ ID NO: 932114 - DNA, 25 bp, Mus musculus
gaggcgcgtgagatgcccggaaccg

SEQ ID NO: 932115 - DNA, 25 bp, Mus musculus
gaggcgcgtgagtcgcagaggcagg

SEQ ID NO: 932116 - DNA, 25 bp, Mus musculus
gaggcgcgtgagttgcccggaaccg

SEQ ID NO: 932117 - DNA, 25 bp, Mus musculus
gaggcggagaagctgtggtgaccct

SEQ ID NO: 932118 - DNA, 25 bp, Mus musculus
gaggcggagaaggtgtggtgaccct

SEQ ID NO: 932119 - DNA, 25 bp, Mus musculus
gaggcggcggagcacaaatagatga

SEQ ID NO: 932120 - DNA, 25 bp, Mus musculus
gaggcggcggagcacattcggaggc

SEQ ID NO: 932121 - DNA, 25 bp, Mus musculus
gaggcggcggagcagaaatagatga

SEQ ID NO: 932122 - DNA, 25 bp, Mus musculus
gaggcggcggagcagattcggaggc

SEQ ID NO: 932123 - DNA, 25 bp, Mus musculus
gaggcggctcagctgttatagactg

SEQ ID NO: 932124 - DNA, 25 bp, Mus musculus
gaggcggctcagctttctcccattt

SEQ ID NO: 932125 - DNA, 25 bp, Mus musculus
gaggcggctcaggtgttatagactg

SEQ ID NO: 932126 - DNA, 25 bp, Mus musculus
gaggcggctcaggtttctcccattt

SEQ ID NO: 932127 - DNA, 25 bp, Mus musculus
gaggcgtgagctgctttcagctgca

SEQ ID NO: 932128 - DNA, 25 bp, Mus musculus
gaggcgtgaggtgctttcagctgca

SEQ ID NO: 932129 - DNA, 25 bp, Mus musculus
gaggctaatgaaccgctggagaggg

SEQ ID NO: 932130 - DNA, 25 bp, Mus musculus
gaggctaatgaagcgctggagaggg

SEQ ID NO: 932131 - DNA, 25 bp, Mus musculus
gaggctatagaaagcctgaaggcac

SEQ ID NO: 932132 - DNA, 25 bp, Mus musculus
gaggctatagaaagcgcgctttcgt

SEQ ID NO: 932133 - DNA, 25 bp, Mus musculus
gaggctatagaaaggctgaaggcac

SEQ ID NO: 932134 - DNA, 25 bp, Mus musculus
gaggctatagaaagggcgctttcgt

SEQ ID NO: 932135 - DNA, 25 bp, Mus musculus
gaggctcagcagtgcctttgatgac

SEQ ID NO: 932136 - DNA, 25 bp, Mus musculus
gaggctcagcagtggctttgatgac

SEQ ID NO: 932137 - DNA, 25 bp, Mus musculus
gaggctcgcagacgcaggggtagag

SEQ ID NO: 932138 - DNA, 25 bp, Mus musculus
gaggctcgcagaggcaggggtagag

SEQ ID NO: 932139 - DNA, 25 bp, Mus musculus
gaggctctgactcttctctctcttg

SEQ ID NO: 932140 - DNA, 25 bp, Mus musculus
gaggctctgactgttctctctcttg

SEQ ID NO: 932141 - DNA, 25 bp, Mus musculus
gaggctgaaaaagacctgcatgaga

SEQ ID NO: 932142 - DNA, 25 bp, Mus musculus
gaggctgaaaaagagctgcatgaga

SEQ ID NO: 932143 - DNA, 25 bp, Mus musculus
gaggctgagaagcccgctgtccctg

SEQ ID NO: 932144 - DNA, 25 bp, Mus musculus
gaggctgagaagccggctgtccctg

SEQ ID NO: 932145 - DNA, 25 bp, Mus musculus
gaggctgagccgagagaagagccct

SEQ ID NO: 932146 - DNA, 25 bp, Mus musculus
gaggctgagccgagtgaagagccct

SEQ ID NO: 932147 - DNA, 25 bp, Mus musculus
gaggctgatgccaacaaacggccat

SEQ ID NO: 932148 - DNA, 25 bp, Mus musculus
gaggctgatgccaagaaacggccat

SEQ ID NO: 932149 - DNA, 25 bp, Mus musculus
gaggctgcagacagcagctttggct

SEQ ID NO: 932150 - DNA, 25 bp, Mus musculus
gaggctgcagcctacagaacctgaa

SEQ ID NO: 932151 - DNA, 25 bp, Mus musculus
gaggctgcaggctacagaacctgaa

SEQ ID NO: 932152 - DNA, 25 bp, Mus musculus
gaggctgcagtcagcagctttggct

SEQ ID NO: 932153 - DNA, 25 bp, Mus musculus
gaggctgccatgctcactacgtcca

SEQ ID NO: 932154 - DNA, 25 bp, Mus musculus
gaggctgccatggtcactacgtcca

SEQ ID NO: 932155 - DNA, 25 bp, Mus musculus
gaggctgcggaggtactgccatccc

SEQ ID NO: 932156 - DNA, 25 bp, Mus musculus
gaggctgcggtggtactgccatccc

SEQ ID NO: 932157 - DNA, 25 bp, Mus musculus
gaggctgctcggctggagaaagtgc

SEQ ID NO: 932158 - DNA, 25 bp, Mus musculus
gaggctgctcgggtggagaaagtgc

SEQ ID NO: 932159 - DNA, 25 bp, Mus musculus
gaggctgcttcggaaccaacagagg

SEQ ID NO: 932160 - DNA, 25 bp, Mus musculus
gaggctgcttctttttaaagatgat

SEQ ID NO: 932161 - DNA, 25 bp, Mus musculus
gaggctgcttgggaaccaacagagg

SEQ ID NO: 932162 - DNA, 25 bp, Mus musculus
gaggctgcttgtttttaaagatgat

SEQ ID NO: 932163 - DNA, 25 bp, Mus musculus
gaggctggagagtccttagccagga

SEQ ID NO: 932164 - DNA, 25 bp, Mus musculus
gaggctggagccaccatgagccagg

SEQ ID NO: 932165 - DNA, 25 bp, Mus musculus
gaggctggagcctgagtttggtaag

SEQ ID NO: 932166 - DNA, 25 bp, Mus musculus
gaggctggaggcaccatgagccagg

SEQ ID NO: 932167 - DNA, 25 bp, Mus musculus
gaggctggaggctgagtttggtaag

SEQ ID NO: 932168 - DNA, 25 bp, Mus musculus
gaggctggagtgtccttagccagga

SEQ ID NO: 932169 - DNA, 25 bp, Mus musculus
gaggctggccaaaatctctgtgtca

SEQ ID NO: 932170 - DNA, 25 bp, Mus musculus
gaggctggccaatatctctgtgtca

SEQ ID NO: 932171 - DNA, 25 bp, Mus musculus
gaggctggccgccgcgccgtgtata

SEQ ID NO: 932172 - DNA, 25 bp, Mus musculus
gaggctggccgccgggccgtgtata

SEQ ID NO: 932173 - DNA, 25 bp, Mus musculus
gaggctgggcgacactcggagccga

SEQ ID NO: 932174 - DNA, 25 bp, Mus musculus
gaggctgggcgagactcggagccga

SEQ ID NO: 932175 - DNA, 25 bp, Mus musculus
gaggctggggtgcacaatttctgaa

SEQ ID NO: 932176 - DNA, 25 bp, Mus musculus
gaggctggggtgcagaatttctgaa

SEQ ID NO: 932177 - DNA, 25 bp, Mus musculus
gaggctgtcggccaagcccgcccct

SEQ ID NO: 932178 - DNA, 25 bp, Mus musculus
gaggctgtcggcgaagcccgcccct

SEQ ID NO: 932179 - DNA, 25 bp, Mus musculus
gaggctgtgaaacgcgtgttggaac

SEQ ID NO: 932180 - DNA, 25 bp, Mus musculus
gaggctgtgaaaggcgtgttggaac

SEQ ID NO: 932181 - DNA, 25 bp, Mus musculus
gaggctgtttccagcttgtccattg

SEQ ID NO: 932182 - DNA, 25 bp, Mus musculus
gaggctgtttcctgcttgtccattg

SEQ ID NO: 932183 - DNA, 25 bp, Mus musculus
gaggcttcaaacaaaattggatgaa

SEQ ID NO: 932184 - DNA, 25 bp, Mus musculus
gaggcttcaaactaaattggatgaa

SEQ ID NO: 932185 - DNA, 25 bp, Mus musculus
gaggcttcgcctggcgatggaacaa

SEQ ID NO: 932186 - DNA, 25 bp, Mus musculus
gaggcttcgcctggggatggaacaa

SEQ ID NO: 932187 - DNA, 25 bp, Mus musculus
gaggcttcgggtgacaaggaagagg

SEQ ID NO: 932188 - DNA, 25 bp, Mus musculus
gaggcttcgggtgagaaggaagagg

SEQ ID NO: 932189 - DNA, 25 bp, Mus musculus
gaggcttctacacgtggctgtggag

SEQ ID NO: 932190 - DNA, 25 bp, Mus musculus
gaggcttctacaggtggctgtggag

SEQ ID NO: 932191 - DNA, 25 bp, Mus musculus
gaggcttgagctgaaggagcatccc

SEQ ID NO: 932192 - DNA, 25 bp, Mus musculus
gaggcttgaggtgaaggagcatccc

SEQ ID NO: 932193 - DNA, 25 bp, Mus musculus
gaggctttggagctagaggaggctt

SEQ ID NO: 932194 - DNA, 25 bp, Mus musculus
gaggctttggaggtagaggaggctt

SEQ ID NO: 932195 - DNA, 25 bp, Mus musculus
gaggcttttggaagagaagtttggt

SEQ ID NO: 932196 - DNA, 25 bp, Mus musculus
gaggcttttggaagtgaagtttggt

SEQ ID NO: 932197 - DNA, 25 bp, Mus musculus
gagggaacagcagtacatcaggcgg

SEQ ID NO: 932198 - DNA, 25 bp, Mus musculus
gagggaacaggagtacatcaggcgg

SEQ ID NO: 932199 - DNA, 25 bp, Mus musculus
gagggaagacaacgtgatgatgagc

SEQ ID NO: 932200 - DNA, 25 bp, Mus musculus
gagggaagacaaggtgatgatgagc

SEQ ID NO: 932201 - DNA, 25 bp, Mus musculus
gagggaattgctcacgcgagagcag

SEQ ID NO: 932202 - DNA, 25 bp, Mus musculus
gagggaattgctcaggcgagagcag

SEQ ID NO: 932203 - DNA, 25 bp, Mus musculus
gagggacatgatgctagccaaacat

SEQ ID NO: 932204 - DNA, 25 bp, Mus musculus
gagggacatgttgctagccaaacat

SEQ ID NO: 932205 - DNA, 25 bp, Mus musculus
gagggactacagaggacaaggcgtt

SEQ ID NO: 932206 - DNA, 25 bp, Mus musculus
gagggactacagtggacaaggcgtt

SEQ ID NO: 932207 - DNA, 25 bp, Mus musculus
gagggactcaaccctgcagccccag

SEQ ID NO: 932208 - DNA, 25 bp, Mus musculus
gagggactcaacgctgcagccccag

SEQ ID NO: 932209 - DNA, 25 bp, Mus musculus
gagggactgcaatacctgtggggac

SEQ ID NO: 932210 - DNA, 25 bp, Mus musculus
gagggactgcaatagctgtggggac

SEQ ID NO: 932211 - DNA, 25 bp, Mus musculus
gagggagacagacgcattcaaggtt

SEQ ID NO: 932212 - DNA, 25 bp, Mus musculus
gagggagacagaggcattcaaggtt

SEQ ID NO: 932213 - DNA, 25 bp, Mus musculus
gagggagaggagcgtctggtcagct

SEQ ID NO: 932214 - DNA, 25 bp, Mus musculus
gagggagaggagggtctggtcagct

SEQ ID NO: 932215 - DNA, 25 bp, Mus musculus
gagggagcagaaggacaggcagagg

SEQ ID NO: 932216 - DNA, 25 bp, Mus musculus
gagggagcagtaggacaggcagagg

SEQ ID NO: 932217 - DNA, 25 bp, Mus musculus
gagggagcgcccgacgccctgggac

SEQ ID NO: 932218 - DNA, 25 bp, Mus musculus
gagggagcgcccgaggccctgggac

SEQ ID NO: 932219 - DNA, 25 bp, Mus musculus
gagggaggaccaccatttaagaaga

SEQ ID NO: 932220 - DNA, 25 bp, Mus musculus
gagggaggaccacgagggcactcct

SEQ ID NO: 932221 - DNA, 25 bp, Mus musculus
gagggaggaccagcatttaagaaga

SEQ ID NO: 932222 - DNA, 25 bp, Mus musculus
gagggaggaccaggagggcactcct

SEQ ID NO: 932223 - DNA, 25 bp, Mus musculus
gagggaggaggaacgctatcaagca

SEQ ID NO: 932224 - DNA, 25 bp, Mus musculus
gagggaggaggatcgctatcaagca

SEQ ID NO: 932225 - DNA, 25 bp, Mus musculus
gagggagtagagcaacattgaccat

SEQ ID NO: 932226 - DNA, 25 bp, Mus musculus
gagggagtagaggaacattgaccat

SEQ ID NO: 932227 - DNA, 25 bp, Mus musculus
gagggatcacagcgattgaagacaa

SEQ ID NO: 932228 - DNA, 25 bp, Mus musculus
gagggatcacagggattgaagacaa

SEQ ID NO: 932229 - DNA, 25 bp, Mus musculus
gagggatccccacttctggaatgga

SEQ ID NO: 932230 - DNA, 25 bp, Mus musculus
gagggatccccagttctggaatgga

SEQ ID NO: 932231 - DNA, 25 bp, Mus musculus
gagggatcggcaatgcctgcaggtg

SEQ ID NO: 932232 - DNA, 25 bp, Mus musculus
gagggatcggcattgcctgcaggtg

SEQ ID NO: 932233 - DNA, 25 bp, Mus musculus
gagggatgctcaaggacagtgctat

SEQ ID NO: 932234 - DNA, 25 bp, Mus musculus
gagggatgctcatggacagtgctat

SEQ ID NO: 932235 - DNA, 25 bp, Mus musculus
gagggatggcagcctcaaagacttg

SEQ ID NO: 932236 - DNA, 25 bp, Mus musculus
gagggatggcaggctcaaagacttg

SEQ ID NO: 932237 - DNA, 25 bp, Mus musculus
gagggcaaaatcagtgagaaggacc

SEQ ID NO: 932238 - DNA, 25 bp, Mus musculus
gagggcaaaatctgtgagaaggacc

SEQ ID NO: 932239 - DNA, 25 bp, Mus musculus
gagggcaaatatggttatgtccttc

SEQ ID NO: 932240 - DNA, 25 bp, Mus musculus
gagggcaaatttggttatgtccttc

SEQ ID NO: 932241 - DNA, 25 bp, Mus musculus
gagggcagaaactgcccagcaagcc

SEQ ID NO: 932242 - DNA, 25 bp, Mus musculus
gagggcagaaactggccagcaagcc

SEQ ID NO: 932243 - DNA, 25 bp, Mus musculus
gagggcagctgagacgtttgccaag

SEQ ID NO: 932244 - DNA, 25 bp, Mus musculus
gagggcagctgagaggtttgccaag

SEQ ID NO: 932245 - DNA, 25 bp, Mus musculus
gagggcatgaaacgctcagtgcaga

SEQ ID NO: 932246 - DNA, 25 bp, Mus musculus
gagggcatgaaaggctcagtgcaga

SEQ ID NO: 932247 - DNA, 25 bp, Mus musculus
gagggcattgcccacaccgtgttcc

SEQ ID NO: 932248 - DNA, 25 bp, Mus musculus
gagggcattgcccagaccgtgttcc

SEQ ID NO: 932249 - DNA, 25 bp, Mus musculus
gagggccatcaacaatgactctgtg

SEQ ID NO: 932250 - DNA, 25 bp, Mus musculus
gagggccatcaagaatgactctgtg

SEQ ID NO: 932251 - DNA, 25 bp, Mus musculus
gagggccatgaacggagctggcacg

SEQ ID NO: 932252 - DNA, 25 bp, Mus musculus
gagggccatgaagggagctggcacg

SEQ ID NO: 932253 - DNA, 25 bp, Mus musculus
gagggcccaatgaggaatcctgtgg

SEQ ID NO: 932254 - DNA, 25 bp, Mus musculus
gagggcccaatgtggaatcctgtgg

SEQ ID NO: 932255 - DNA, 25 bp, Mus musculus
gagggccctgcacgcctcggtgtct

SEQ ID NO: 932256 - DNA, 25 bp, Mus musculus
gagggccctgcaggcctcggtgtct

SEQ ID NO: 932257 - DNA, 25 bp, Mus musculus
gagggccgccgccacgtgtgcaaca

SEQ ID NO: 932258 - DNA, 25 bp, Mus musculus
gagggccgccgccaggtgtgcaaca

SEQ ID NO: 932259 - DNA, 25 bp, Mus musculus
gagggcctcgagaatggctctgaag

SEQ ID NO: 932260 - DNA, 25 bp, Mus musculus
gagggcctcgtgaatggctctgaag

SEQ ID NO: 932261 - DNA, 25 bp, Mus musculus
gagggccttcagcaagatgctacca

SEQ ID NO: 932262 - DNA, 25 bp, Mus musculus
gagggccttcaggaagatgctacca

SEQ ID NO: 932263 - DNA, 25 bp, Mus musculus
gagggcgaatagtggagccccgggt

SEQ ID NO: 932264 - DNA, 25 bp, Mus musculus
gagggcgaatattcgcctcccacct

SEQ ID NO: 932265 - DNA, 25 bp, Mus musculus
gagggcgaattgtggagccccgggt

SEQ ID NO: 932266 - DNA, 25 bp, Mus musculus
gagggcgaattttcgcctcccacct

SEQ ID NO: 932267 - DNA, 25 bp, Mus musculus
gagggcgcggagtggacaaatgtcg

SEQ ID NO: 932268 - DNA, 25 bp, Mus musculus
gagggcgcggtgtggacaaatgtcg

SEQ ID NO: 932269 - DNA, 25 bp, Mus musculus
gagggctacagtctagaaaactgct

SEQ ID NO: 932270 - DNA, 25 bp, Mus musculus
gagggctacagtcttgaaaactgct

SEQ ID NO: 932271 - DNA, 25 bp, Mus musculus
gagggctgaagacaatatccggtct

SEQ ID NO: 932272 - DNA, 25 bp, Mus musculus
gagggctgaagactgatgacattac

SEQ ID NO: 932273 - DNA, 25 bp, Mus musculus
gagggctgaagagaatatccggtct

SEQ ID NO: 932274 - DNA, 25 bp, Mus musculus
gagggctgaagagtgatgacattac

SEQ ID NO: 932275 - DNA, 25 bp, Mus musculus
gagggctgagctacagtcatgtcgg

SEQ ID NO: 932276 - DNA, 25 bp, Mus musculus
gagggctgaggtacagtcatgtcgg

SEQ ID NO: 932277 - DNA, 25 bp, Mus musculus
gagggctgcaaacgtttcttccgaa

SEQ ID NO: 932278 - DNA, 25 bp, Mus musculus
gagggctgcaaaggtttcttccgaa

SEQ ID NO: 932279 - DNA, 25 bp, Mus musculus
gagggctgcgatactggttgtatgg

SEQ ID NO: 932280 - DNA, 25 bp, Mus musculus
gagggctgcgttactggttgtatgg

SEQ ID NO: 932281 - DNA, 25 bp, Mus musculus
gagggctggccgcattggtggaggt

SEQ ID NO: 932282 - DNA, 25 bp, Mus musculus
gagggctggccggattggtggaggt

SEQ ID NO: 932283 - DNA, 25 bp, Mus musculus
gagggcttgaagccaactctgttag

SEQ ID NO: 932284 - DNA, 25 bp, Mus musculus
gagggcttgaagcctactctgttag

SEQ ID NO: 932285 - DNA, 25 bp, Mus musculus
gaggggaaagctcgtggaaagtgag

SEQ ID NO: 932286 - DNA, 25 bp, Mus musculus
gaggggaaagctggtggaaagtgag

SEQ ID NO: 932287 - DNA, 25 bp, Mus musculus
gaggggaagaagctggctgtgttct

SEQ ID NO: 932288 - DNA, 25 bp, Mus musculus
gaggggaagaaggtggctgtgttct

SEQ ID NO: 932289 - DNA, 25 bp, Mus musculus
gaggggaagacatgcaattcgaagt

SEQ ID NO: 932290 - DNA, 25 bp, Mus musculus
gaggggaagagatgcaattcgaagt

SEQ ID NO: 932291 - DNA, 25 bp, Mus musculus
gaggggacctgcacagtcacgcggt

SEQ ID NO: 932292 - DNA, 25 bp, Mus musculus
gaggggacctgcactgtcacgcggt

SEQ ID NO: 932293 - DNA, 25 bp, Mus musculus
gaggggagacgtcgtactcagttcg

SEQ ID NO: 932294 - DNA, 25 bp, Mus musculus
gaggggagacgtggtactcagttcg

SEQ ID NO: 932295 - DNA, 25 bp, Mus musculus
gaggggatcaacaaccaattcctcg

SEQ ID NO: 932296 - DNA, 25 bp, Mus musculus
gaggggatcaacaagcaattcctcg

SEQ ID NO: 932297 - DNA, 25 bp, Mus musculus
gaggggatcccgcgtgagccaggtt

SEQ ID NO: 932298 - DNA, 25 bp, Mus musculus
gaggggatcccgggtgagccaggtt

SEQ ID NO: 932299 - DNA, 25 bp, Mus musculus
gaggggcagtttattcctgacattg

SEQ ID NO: 932300 - DNA, 25 bp, Mus musculus
gaggggcagttttttcctgacattg

SEQ ID NO: 932301 - DNA, 25 bp, Mus musculus
gaggggctaagaatggagggcagcc

SEQ ID NO: 932302 - DNA, 25 bp, Mus musculus
gaggggctaagattggagggcagcc

SEQ ID NO: 932303 - DNA, 25 bp, Mus musculus
gagggggaggcatttgcaggcccaa

SEQ ID NO: 932304 - DNA, 25 bp, Mus musculus
gagggggagggatttgcaggcccaa

SEQ ID NO: 932305 - DNA, 25 bp, Mus musculus
gaggggggacagctatatggaacca

SEQ ID NO: 932306 - DNA, 25 bp, Mus musculus
gaggggggacaggtatatggaacca

SEQ ID NO: 932307 - DNA, 25 bp, Mus musculus
gagggggtaccacatcctacagtca

SEQ ID NO: 932308 - DNA, 25 bp, Mus musculus
gagggggtaccagatcctacagtca

SEQ ID NO: 932309 - DNA, 25 bp, Mus musculus
gaggggtcatcaccctgtctcagga

SEQ ID NO: 932310 - DNA, 25 bp, Mus musculus
gaggggtcatcagcctgtctcagga

SEQ ID NO: 932311 - DNA, 25 bp, Mus musculus
gaggggttggtgatggattcatggg

SEQ ID NO: 932312 - DNA, 25 bp, Mus musculus
gaggggttggtgttggattcatggg

SEQ ID NO: 932313 - DNA, 25 bp, Mus musculus
gagggtatccagattgcaagaaggt

SEQ ID NO: 932314 - DNA, 25 bp, Mus musculus
gagggtatccagtttgcaagaaggt

SEQ ID NO: 932315 - DNA, 25 bp, Mus musculus
gagggtctctgactggaggtgaagc

SEQ ID NO: 932316 - DNA, 25 bp, Mus musculus
gagggtctctgagtggaggtgaagc

SEQ ID NO: 932317 - DNA, 25 bp, Mus musculus
gagggtgaagaaactgaaggctcag

SEQ ID NO: 932318 - DNA, 25 bp, Mus musculus
gagggtgaagtaactgaaggctcag

SEQ ID NO: 932319 - DNA, 25 bp, Mus musculus
gagggtgatgacacagctcccagca

SEQ ID NO: 932320 - DNA, 25 bp, Mus musculus
gagggtgatgtcacagctcccagca

SEQ ID NO: 932321 - DNA, 25 bp, Mus musculus
gagggtggagctaacaacttatacg

SEQ ID NO: 932322 - DNA, 25 bp, Mus musculus
gagggtggaggtaacaacttatacg

SEQ ID NO: 932323 - DNA, 25 bp, Mus musculus
gagggtggctcgcaaaaggcagatc

SEQ ID NO: 932324 - DNA, 25 bp, Mus musculus
gagggtggctcggaaaaggcagatc

SEQ ID NO: 932325 - DNA, 25 bp, Mus musculus
gagggtgtcaaccacgaacctggct

SEQ ID NO: 932326 - DNA, 25 bp, Mus musculus
gagggtgtcaaccaggaacctggct

SEQ ID NO: 932327 - DNA, 25 bp, Mus musculus
gaggtaatcgagaggctgagtaatg

SEQ ID NO: 932328 - DNA, 25 bp, Mus musculus
gaggtaatcgagtggctgagtaatg

SEQ ID NO: 932329 - DNA, 25 bp, Mus musculus
gaggtaatgattcacatatcctgtt

SEQ ID NO: 932330 - DNA, 25 bp, Mus musculus
gaggtaatgattcagatatcctgtt

SEQ ID NO: 932331 - DNA, 25 bp, Mus musculus
gaggtacagacacgcctcctgcttc

SEQ ID NO: 932332 - DNA, 25 bp, Mus musculus
gaggtacagacaggcctcctgcttc

SEQ ID NO: 932333 - DNA, 25 bp, Mus musculus
gaggtacagcacaaaaaaacccaag

SEQ ID NO: 932334 - DNA, 25 bp, Mus musculus
gaggtacagcacaataaaacccaag

SEQ ID NO: 932335 - DNA, 25 bp, Mus musculus
gaggtacaggctcacgaggcctttc

SEQ ID NO: 932336 - DNA, 25 bp, Mus musculus
gaggtacaggctcaggaggcctttc

SEQ ID NO: 932337 - DNA, 25 bp, Mus musculus
gaggtagaggagaaatgtgcactga

SEQ ID NO: 932338 - DNA, 25 bp, Mus musculus
gaggtagaggagtaatgtgcactga

SEQ ID NO: 932339 - DNA, 25 bp, Mus musculus
gaggtagatgcacgagatcccccaa

SEQ ID NO: 932340 - DNA, 25 bp, Mus musculus
gaggtagatgcaggagatcccccaa

SEQ ID NO: 932341 - DNA, 25 bp, Mus musculus
gaggtcaaagaggcgccagctgaca

SEQ ID NO: 932342 - DNA, 25 bp, Mus musculus
gaggtcaaagtggcgccagctgaca

SEQ ID NO: 932343 - DNA, 25 bp, Mus musculus
gaggtcaacaagctggctggaaact

SEQ ID NO: 932344 - DNA, 25 bp, Mus musculus
gaggtcaacaaggtggctggaaact

SEQ ID NO: 932345 - DNA, 25 bp, Mus musculus
gaggtcaactgcccttctcgaacct

SEQ ID NO: 932346 - DNA, 25 bp, Mus musculus
gaggtcaactgcgcttctcgaacct

SEQ ID NO: 932347 - DNA, 25 bp, Mus musculus
gaggtcaagaaccgcctcctgtcca

SEQ ID NO: 932348 - DNA, 25 bp, Mus musculus
gaggtcaagaaccggctcctgtcca

SEQ ID NO: 932349 - DNA, 25 bp, Mus musculus
gaggtcaatgggaactcattcagct

SEQ ID NO: 932350 - DNA, 25 bp, Mus musculus
gaggtcaatgggaagtcattcagct

SEQ ID NO: 932351 - DNA, 25 bp, Mus musculus
gaggtcacagatgaaattatggata

SEQ ID NO: 932352 - DNA, 25 bp, Mus musculus
gaggtcacagttgaaattatggata

SEQ ID NO: 932353 - DNA, 25 bp, Mus musculus
gaggtcacatagcgccgaggccgtt

SEQ ID NO: 932354 - DNA, 25 bp, Mus musculus
gaggtcacatagggccgaggccgtt

SEQ ID NO: 932355 - DNA, 25 bp, Mus musculus
gaggtcacttcaacacacacagctt

SEQ ID NO: 932356 - DNA, 25 bp, Mus musculus
gaggtcacttcatcacacacagctt

SEQ ID NO: 932357 - DNA, 25 bp, Mus musculus
gaggtcagagactcggagactgccg

SEQ ID NO: 932358 - DNA, 25 bp, Mus musculus
gaggtcagagcatgcaaagaaggga

SEQ ID NO: 932359 - DNA, 25 bp, Mus musculus
gaggtcagagcctgtcaaaatacaa

SEQ ID NO: 932360 - DNA, 25 bp, Mus musculus
gaggtcagaggatgcaaagaaggga

SEQ ID NO: 932361 - DNA, 25 bp, Mus musculus
gaggtcagaggctgtcaaaatacaa

SEQ ID NO: 932362 - DNA, 25 bp, Mus musculus
gaggtcagagtctcggagactgccg

SEQ ID NO: 932363 - DNA, 25 bp, Mus musculus
gaggtcatcctgcagttgggctggt

SEQ ID NO: 932364 - DNA, 25 bp, Mus musculus
gaggtcatcctggagttgggctggt

SEQ ID NO: 932365 - DNA, 25 bp, Mus musculus
gaggtcatgactcccatttgcttca

SEQ ID NO: 932366 - DNA, 25 bp, Mus musculus
gaggtcatgactcgggtgatctgct

SEQ ID NO: 932367 - DNA, 25 bp, Mus musculus
gaggtcatgactgccatttgcttca

SEQ ID NO: 932368 - DNA, 25 bp, Mus musculus
gaggtcatgactggggtgatctgct

SEQ ID NO: 932369 - DNA, 25 bp, Mus musculus
gaggtcatttcacgggagcgtttgc

SEQ ID NO: 932370 - DNA, 25 bp, Mus musculus
gaggtcatttcaggggagcgtttgc

SEQ ID NO: 932371 - DNA, 25 bp, Mus musculus
gaggtccgagcacaccctgaaagcc

SEQ ID NO: 932372 - DNA, 25 bp, Mus musculus
gaggtccgagccgagtgagctcagg

SEQ ID NO: 932373 - DNA, 25 bp, Mus musculus
gaggtccgaggacaccctgaaagcc

SEQ ID NO: 932374 - DNA, 25 bp, Mus musculus
gaggtccgaggcgagtgagctcagg

SEQ ID NO: 932375 - DNA, 25 bp, Mus musculus
gaggtccttttaaacgctgcttcca

SEQ ID NO: 932376 - DNA, 25 bp, Mus musculus
gaggtccttttaaaggctgcttcca

SEQ ID NO: 932377 - DNA, 25 bp, Mus musculus
gaggtcggccagctggttgcatttt

SEQ ID NO: 932378 - DNA, 25 bp, Mus musculus
gaggtcggccaggtggttgcatttt

SEQ ID NO: 932379 - DNA, 25 bp, Mus musculus
gaggtcgggtggctgtttgcagaca

SEQ ID NO: 932380 - DNA, 25 bp, Mus musculus
gaggtcgggtgggtgtttgcagaca

SEQ ID NO: 932381 - DNA, 25 bp, Mus musculus
gaggtctactcattccctgaagatc

SEQ ID NO: 932382 - DNA, 25 bp, Mus musculus
gaggtctactgattccctgaagatc

SEQ ID NO: 932383 - DNA, 25 bp, Mus musculus
gaggtctcacgcgacacgaagacag

SEQ ID NO: 932384 - DNA, 25 bp, Mus musculus
gaggtctcacgcgagacgaagacag

SEQ ID NO: 932385 - DNA, 25 bp, Mus musculus
gaggtcttcaagcaaccagcacctg

SEQ ID NO: 932386 - DNA, 25 bp, Mus musculus
gaggtcttcaaggaaccagcacctg

SEQ ID NO: 932387 - DNA, 25 bp, Mus musculus
gaggtcttcgaaagaaccaagcagc

SEQ ID NO: 932388 - DNA, 25 bp, Mus musculus
gaggtcttcgcccttcccaggacag

SEQ ID NO: 932389 - DNA, 25 bp, Mus musculus
gaggtcttcggccttcccaggacag

SEQ ID NO: 932390 - DNA, 25 bp, Mus musculus
gaggtcttcgtaagaaccaagcagc

SEQ ID NO: 932391 - DNA, 25 bp, Mus musculus
gaggtcttgccacctgagaaagctt

SEQ ID NO: 932392 - DNA, 25 bp, Mus musculus
gaggtcttgccagctgagaaagctt

SEQ ID NO: 932393 - DNA, 25 bp, Mus musculus
gaggtcttgcgtctgtgcagttggc

SEQ ID NO: 932394 - DNA, 25 bp, Mus musculus
gaggtcttgcgtgtgtgcagttggc

SEQ ID NO: 932395 - DNA, 25 bp, Mus musculus
gaggtctttcaacaaatgctgtcca

SEQ ID NO: 932396 - DNA, 25 bp, Mus musculus
gaggtctttcaagaaatgctgtcca

SEQ ID NO: 932397 - DNA, 25 bp, Mus musculus
gaggtgaaacttcttgattttggtg

SEQ ID NO: 932398 - DNA, 25 bp, Mus musculus
gaggtgaaacttgttgattttggtg

SEQ ID NO: 932399 - DNA, 25 bp, Mus musculus
gaggtgaagcagaatgatatggaac

SEQ ID NO: 932400 - DNA, 25 bp, Mus musculus
gaggtgaagcagtatgatatggaac

SEQ ID NO: 932401 - DNA, 25 bp, Mus musculus
gaggtgaaggacaaccaccccgagc

SEQ ID NO: 932402 - DNA, 25 bp, Mus musculus
gaggtgaaggacaagcaccccgagc

SEQ ID NO: 932403 - DNA, 25 bp, Mus musculus
gaggtgacaacgaaaatatctgcag

SEQ ID NO: 932404 - DNA, 25 bp, Mus musculus
gaggtgacaacgtaaatatctgcag

SEQ ID NO: 932405 - DNA, 25 bp, Mus musculus
gaggtgacagcttcctgcaatctga

SEQ ID NO: 932406 - DNA, 25 bp, Mus musculus
gaggtgacaggttcctgcaatctga

SEQ ID NO: 932407 - DNA, 25 bp, Mus musculus
gaggtgactgcggcccaaccatgaa

SEQ ID NO: 932408 - DNA, 25 bp, Mus musculus
gaggtgactgcggcgcaaccatgaa

SEQ ID NO: 932409 - DNA, 25 bp, Mus musculus
gaggtgagtgctccagtaagcccag

SEQ ID NO: 932410 - DNA, 25 bp, Mus musculus
gaggtgagtgctgcagtaagcccag

SEQ ID NO: 932411 - DNA, 25 bp, Mus musculus
gaggtgatcttgatcgctccaccaa

SEQ ID NO: 932412 - DNA, 25 bp, Mus musculus
gaggtgatcttgatggctccaccaa

SEQ ID NO: 932413 - DNA, 25 bp, Mus musculus
gaggtgattcttcacgctgaaaaag

SEQ ID NO: 932414 - DNA, 25 bp, Mus musculus
gaggtgattcttcaggctgaaaaag

SEQ ID NO: 932415 - DNA, 25 bp, Mus musculus
gaggtgccaaagcacttagttggtc

SEQ ID NO: 932416 - DNA, 25 bp, Mus musculus
gaggtgccaaaggacttagttggtc

SEQ ID NO: 932417 - DNA, 25 bp, Mus musculus
gaggtgccacagccaccatgccaat

SEQ ID NO: 932418 - DNA, 25 bp, Mus musculus
gaggtgccacaggcaccatgccaat

SEQ ID NO: 932419 - DNA, 25 bp, Mus musculus
gaggtgccagctctgcaaagtgcac

SEQ ID NO: 932420 - DNA, 25 bp, Mus musculus
gaggtgccaggtatgcaaagtgcac

SEQ ID NO: 932421 - DNA, 25 bp, Mus musculus
gaggtgccaggtctgcaaagtgcac

SEQ ID NO: 932422 - DNA, 25 bp, Mus musculus
gaggtgccaggtttgcaaagtgcac

SEQ ID NO: 932423 - DNA, 25 bp, Mus musculus
gaggtgcctccaagcgttcccgtga

SEQ ID NO: 932424 - DNA, 25 bp, Mus musculus
gaggtgcctccaagggttcccgtga

SEQ ID NO: 932425 - DNA, 25 bp, Mus musculus
gaggtgctgcagcaggctgtgcctg

SEQ ID NO: 932426 - DNA, 25 bp, Mus musculus
gaggtgctgcaggaggctgtgcctg

SEQ ID NO: 932427 - DNA, 25 bp, Mus musculus
gaggtgctgtcgactctggccaaca

SEQ ID NO: 932428 - DNA, 25 bp, Mus musculus
gaggtgctgtcgtctctggccaaca

SEQ ID NO: 932429 - DNA, 25 bp, Mus musculus
gaggtggaagaccatgtctagcaaa

SEQ ID NO: 932430 - DNA, 25 bp, Mus musculus
gaggtggaagaccatgtctgctaaa

SEQ ID NO: 932431 - DNA, 25 bp, Mus musculus
gaggtggaagtccatgtctagcaaa

SEQ ID NO: 932432 - DNA, 25 bp, Mus musculus
gaggtggaagtccatgtctgctaaa

SEQ ID NO: 932433 - DNA, 25 bp, Mus musculus
gaggtggacaaatccaggtggctcc

SEQ ID NO: 932434 - DNA, 25 bp, Mus musculus
gaggtggacaaatcgaggtggctcc

SEQ ID NO: 932435 - DNA, 25 bp, Mus musculus
gaggtggagaagcccaaggggaatc

SEQ ID NO: 932436 - DNA, 25 bp, Mus musculus
gaggtggagaaggccaaggggaatc

SEQ ID NO: 932437 - DNA, 25 bp, Mus musculus
gaggtggatgtgcacgcaatgaaga

SEQ ID NO: 932438 - DNA, 25 bp, Mus musculus
gaggtggatgtgcaggcaatgaaga

SEQ ID NO: 932439 - DNA, 25 bp, Mus musculus
gaggtggcacgtgacgtggtgatgg

SEQ ID NO: 932440 - DNA, 25 bp, Mus musculus
gaggtggcacgtgaggtggtgatgg

SEQ ID NO: 932441 - DNA, 25 bp, Mus musculus
gaggtggcagccttctcagggccct

SEQ ID NO: 932442 - DNA, 25 bp, Mus musculus
gaggtggcagcgctctcaaatcagc

SEQ ID NO: 932443 - DNA, 25 bp, Mus musculus
gaggtggcaggcttctcagggccct

SEQ ID NO: 932444 - DNA, 25 bp, Mus musculus
gaggtggcagggataaggcagcttc

SEQ ID NO: 932445 - DNA, 25 bp, Mus musculus
gaggtggcagggctctcaaatcagc

SEQ ID NO: 932446 - DNA, 25 bp, Mus musculus
gaggtggcagggttaaggcagcttc

SEQ ID NO: 932447 - DNA, 25 bp, Mus musculus
gaggtggcagttcacggaggaatca

SEQ ID NO: 932448 - DNA, 25 bp, Mus musculus
gaggtggcagttcagggaggaatca

SEQ ID NO: 932449 - DNA, 25 bp, Mus musculus
gaggtgggcttccgagccttctctg

SEQ ID NO: 932450 - DNA, 25 bp, Mus musculus
gaggtgggcttccgtgccttctctg

SEQ ID NO: 932451 - DNA, 25 bp, Mus musculus
gaggtggtgcagcagatcccccaag

SEQ ID NO: 932452 - DNA, 25 bp, Mus musculus
gaggtggtgcaggagatcccccaag

SEQ ID NO: 932453 - DNA, 25 bp, Mus musculus
gaggtggtggagaacgcttactgct

SEQ ID NO: 932454 - DNA, 25 bp, Mus musculus
gaggtggtggagaaggcttactgct

SEQ ID NO: 932455 - DNA, 25 bp, Mus musculus
gaggtggtggagatcgttgaaaatg

SEQ ID NO: 932456 - DNA, 25 bp, Mus musculus
gaggtggtggagatggttgaaaatg

SEQ ID NO: 932457 - DNA, 25 bp, Mus musculus
gaggtgtccatttccacttctctac

SEQ ID NO: 932458 - DNA, 25 bp, Mus musculus
gaggtgtccatttcgacttctctac

SEQ ID NO: 932459 - DNA, 25 bp, Mus musculus
gaggtgtgggacaacgttttgagca

SEQ ID NO: 932460 - DNA, 25 bp, Mus musculus
gaggtgtgggacaaggttttgagca

SEQ ID NO: 932461 - DNA, 25 bp, Mus musculus
gaggtgttgtcctgccagatggaag

SEQ ID NO: 932462 - DNA, 25 bp, Mus musculus
gaggtgttgtcctggcagatggaag

SEQ ID NO: 932463 - DNA, 25 bp, Mus musculus
gaggttccagcagacctttgaggac

SEQ ID NO: 932464 - DNA, 25 bp, Mus musculus
gaggttccaggagacctttgaggac

SEQ ID NO: 932465 - DNA, 25 bp, Mus musculus
gaggttcctgatcatgatgaaccag

SEQ ID NO: 932466 - DNA, 25 bp, Mus musculus
gaggttcctgatcgaaaaccaactc

SEQ ID NO: 932467 - DNA, 25 bp, Mus musculus
gaggttcctgatgatgatgaaccag

SEQ ID NO: 932468 - DNA, 25 bp, Mus musculus
gaggttcctgatggaaaaccaactc

SEQ ID NO: 932469 - DNA, 25 bp, Mus musculus
gaggttgaggagcgtttcagcgaga

SEQ ID NO: 932470 - DNA, 25 bp, Mus musculus
gaggttgaggagggtttcagcgaga

SEQ ID NO: 932471 - DNA, 25 bp, Mus musculus
gaggttggcaataacctgagccagc

SEQ ID NO: 932472 - DNA, 25 bp, Mus musculus
gaggttggcaataagctgagccagc

SEQ ID NO: 932473 - DNA, 25 bp, Mus musculus
gaggttggcggacctcactctttga

SEQ ID NO: 932474 - DNA, 25 bp, Mus musculus
gaggttggcggagctcactctttga

SEQ ID NO: 932475 - DNA, 25 bp, Mus musculus
gaggttgttaagactactgggaatc

SEQ ID NO: 932476 - DNA, 25 bp, Mus musculus
gaggttgttaagatcctggaccgct

SEQ ID NO: 932477 - DNA, 25 bp, Mus musculus
gaggttgttaagtctactgggaatc

SEQ ID NO: 932478 - DNA, 25 bp, Mus musculus
gaggttgttaagttcctggaccgct

SEQ ID NO: 932479 - DNA, 25 bp, Mus musculus
gaggtttaaactgtctcatgcggat

SEQ ID NO: 932480 - DNA, 25 bp, Mus musculus
gaggtttaaagtgtctcatgcggat

SEQ ID NO: 932481 - DNA, 25 bp, Mus musculus
gaggtttgccagctcctattggcca

SEQ ID NO: 932482 - DNA, 25 bp, Mus musculus
gaggtttgccaggtcctattggcca

SEQ ID NO: 932483 - DNA, 25 bp, Mus musculus
gaggttttgttgctgtgcaacagaa

SEQ ID NO: 932484 - DNA, 25 bp, Mus musculus
gaggttttgttggtgtgcaacagaa

SEQ ID NO: 932485 - DNA, 25 bp, Mus musculus
gagtaactagctttgcatcatgcct

SEQ ID NO: 932486 - DNA, 25 bp, Mus musculus
gagtaactaggtttgcatcatgcct

SEQ ID NO: 932487 - DNA, 25 bp, Mus musculus
gagtaactttgcagaaacggtcaaa

SEQ ID NO: 932488 - DNA, 25 bp, Mus musculus
gagtaactttgctgaaacggtcaaa

SEQ ID NO: 932489 - DNA, 25 bp, Mus musculus
gagtaagcagagcagacctgccagg

SEQ ID NO: 932490 - DNA, 25 bp, Mus musculus
gagtaagcagaggagacctgccagg

SEQ ID NO: 932491 - DNA, 25 bp, Mus musculus
gagtaagccgagatctctagcctcc

SEQ ID NO: 932492 - DNA, 25 bp, Mus musculus
gagtaagccgagttctctagcctcc

SEQ ID NO: 932493 - DNA, 25 bp, Mus musculus
gagtaagtccagatctgatttgtac

SEQ ID NO: 932494 - DNA, 25 bp, Mus musculus
gagtaagtccagttctgatttgtac

SEQ ID NO: 932495 - DNA, 25 bp, Mus musculus
gagtaattagccaacaggttccaga

SEQ ID NO: 932496 - DNA, 25 bp, Mus musculus
gagtaattaggcaacaggttccaga

SEQ ID NO: 932497 - DNA, 25 bp, Mus musculus
gagtacaaaaagctgcatccaagca

SEQ ID NO: 932498 - DNA, 25 bp, Mus musculus
gagtacaaaaagctgtgagtaccag

SEQ ID NO: 932499 - DNA, 25 bp, Mus musculus
gagtacaaaaaggtgcatccaagca

SEQ ID NO: 932500 - DNA, 25 bp, Mus musculus
gagtacaaaaaggtgtgagtaccag

SEQ ID NO: 932501 - DNA, 25 bp, Mus musculus
gagtacaaagcatacgaggaaacta

SEQ ID NO: 932502 - DNA, 25 bp, Mus musculus
gagtacaaaggatacgaggaaacta

SEQ ID NO: 932503 - DNA, 25 bp, Mus musculus
gagtacacggcggccaacaagtacg

SEQ ID NO: 932504 - DNA, 25 bp, Mus musculus
gagtacacgggggccaacaagtacg

SEQ ID NO: 932505 - DNA, 25 bp, Mus musculus
gagtacaggtctgtaccacaacacg

SEQ ID NO: 932506 - DNA, 25 bp, Mus musculus
gagtacaggtgtgtaccacaacacg

SEQ ID NO: 932507 - DNA, 25 bp, Mus musculus
gagtacatcaagcgcgccaacagcc

SEQ ID NO: 932508 - DNA, 25 bp, Mus musculus
gagtacatcaagcgggccaacagcc

SEQ ID NO: 932509 - DNA, 25 bp, Mus musculus
gagtacatggaggacgtgcggcggc

SEQ ID NO: 932510 - DNA, 25 bp, Mus musculus
gagtacatggaggaggtgcggcggc

SEQ ID NO: 932511 - DNA, 25 bp, Mus musculus
gagtacatggccaacgggagtttgg

SEQ ID NO: 932512 - DNA, 25 bp, Mus musculus
gagtacatggccaaggggagtttgg

SEQ ID NO: 932513 - DNA, 25 bp, Mus musculus
gagtacatgtggattctcctgtact

SEQ ID NO: 932514 - DNA, 25 bp, Mus musculus
gagtacatgtggtttctcctgtact

SEQ ID NO: 932515 - DNA, 25 bp, Mus musculus
gagtacattattgacgccactgcag

SEQ ID NO: 932516 - DNA, 25 bp, Mus musculus
gagtacattattgaggccactgcag

SEQ ID NO: 932517 - DNA, 25 bp, Mus musculus
gagtaccaggccaacgagaacgatt

SEQ ID NO: 932518 - DNA, 25 bp, Mus musculus
gagtaccaggccaaggagaacgatt

SEQ ID NO: 932519 - DNA, 25 bp, Mus musculus
gagtacctctggccatcttctccgt

SEQ ID NO: 932520 - DNA, 25 bp, Mus musculus
gagtacctctgggcatcttctccgt

SEQ ID NO: 932521 - DNA, 25 bp, Mus musculus
gagtacgcattgcgtgaagaaaagt

SEQ ID NO: 932522 - DNA, 25 bp, Mus musculus
gagtacgcattgggtgaagaaaagt

SEQ ID NO: 932523 - DNA, 25 bp, Mus musculus
gagtactatgactcagtgtacacag

SEQ ID NO: 932524 - DNA, 25 bp, Mus musculus
gagtactatgtctcagtgtacacag

SEQ ID NO: 932525 - DNA, 25 bp, Mus musculus
gagtactgggatacccggcgcagca

SEQ ID NO: 932526 - DNA, 25 bp, Mus musculus
gagtactgggattcccggcgcagca

SEQ ID NO: 932527 - DNA, 25 bp, Mus musculus
gagtacttgctcaccggaattccag

SEQ ID NO: 932528 - DNA, 25 bp, Mus musculus
gagtacttgctcacgggaattccag

SEQ ID NO: 932529 - DNA, 25 bp, Mus musculus
gagtagaaaaatatgacttctgcta

SEQ ID NO: 932530 - DNA, 25 bp, Mus musculus
gagtagaaaacaaggaataggaaag

SEQ ID NO: 932531 - DNA, 25 bp, Mus musculus
gagtagaaaacaataggaaagcatt

SEQ ID NO: 932532 - DNA, 25 bp, Mus musculus
gagtagaaaagaaggaataggaaag

SEQ ID NO: 932533 - DNA, 25 bp, Mus musculus
gagtagaaaagaataggaaagcatt

SEQ ID NO: 932534 - DNA, 25 bp, Mus musculus
gagtagaaaattatgacttctgcta

SEQ ID NO: 932535 - DNA, 25 bp, Mus musculus
gagtagacacttgtcgaaggaatct

SEQ ID NO: 932536 - DNA, 25 bp, Mus musculus
gagtagacacttgtggaaggaatct

SEQ ID NO: 932537 - DNA, 25 bp, Mus musculus
gagtagagacgccacttctacctcc

SEQ ID NO: 932538 - DNA, 25 bp, Mus musculus
gagtagagacgccagttctacctcc

SEQ ID NO: 932539 - DNA, 25 bp, Mus musculus
gagtagagaggcgacggttgtgagc

SEQ ID NO: 932540 - DNA, 25 bp, Mus musculus
gagtagagaggcgagggttgtgagc

SEQ ID NO: 932541 - DNA, 25 bp, Mus musculus
gagtagatttagatgccagcacctg

SEQ ID NO: 932542 - DNA, 25 bp, Mus musculus
gagtagatttagttgccagcacctg

SEQ ID NO: 932543 - DNA, 25 bp, Mus musculus
gagtagcaacaaaacgctgccgtcc

SEQ ID NO: 932544 - DNA, 25 bp, Mus musculus
gagtagcaacaaagagcagcggtca

SEQ ID NO: 932545 - DNA, 25 bp, Mus musculus
gagtagcaacaatacgctgccgtcc

SEQ ID NO: 932546 - DNA, 25 bp, Mus musculus
gagtagcaacaatgagcagcggtca

SEQ ID NO: 932547 - DNA, 25 bp, Mus musculus
gagtagcaggaggcgtccggtcgca

SEQ ID NO: 932548 - DNA, 25 bp, Mus musculus
gagtagcaggtggcgtccggtcgca

SEQ ID NO: 932549 - DNA, 25 bp, Mus musculus
gagtagtgaggccattggtcaaaga

SEQ ID NO: 932550 - DNA, 25 bp, Mus musculus
gagtagtgaggcgattggtcaaaga

SEQ ID NO: 932551 - DNA, 25 bp, Mus musculus
gagtagttaatggacgtgttccctg

SEQ ID NO: 932552 - DNA, 25 bp, Mus musculus
gagtagttaatggaggtgttccctg

SEQ ID NO: 932553 - DNA, 25 bp, Mus musculus
gagtataagcaattaaccctgaatc

SEQ ID NO: 932554 - DNA, 25 bp, Mus musculus
gagtataagctattaaccctgaatc

SEQ ID NO: 932555 - DNA, 25 bp, Mus musculus
gagtataatggacgctcactttgtt

SEQ ID NO: 932556 - DNA, 25 bp, Mus musculus
gagtataatggaggctcactttgtt

SEQ ID NO: 932557 - DNA, 25 bp, Mus musculus
gagtatagagctgctccagaccagc

SEQ ID NO: 932558 - DNA, 25 bp, Mus musculus
gagtatagaggtgctccagaccagc

SEQ ID NO: 932559 - DNA, 25 bp, Mus musculus
gagtatcttgagatgaactacaggg

SEQ ID NO: 932560 - DNA, 25 bp, Mus musculus
gagtatcttgagttgaactacaggg

SEQ ID NO: 932561 - DNA, 25 bp, Mus musculus
gagtatgaagttcacgaaggatttg

SEQ ID NO: 932562 - DNA, 25 bp, Mus musculus
gagtatgaagttcaggaaggatttg

SEQ ID NO: 932563 - DNA, 25 bp, Mus musculus
gagtatgacgcaaacaactcctatg

SEQ ID NO: 932564 - DNA, 25 bp, Mus musculus
gagtatgacggaaacaactcctatg

SEQ ID NO: 932565 - DNA, 25 bp, Mus musculus
gagtatgaggcagccgtctaccctg

SEQ ID NO: 932566 - DNA, 25 bp, Mus musculus
gagtatgagggagccgtctaccctg

SEQ ID NO: 932567 - DNA, 25 bp, Mus musculus
gagtatgatgatcgcaccccagcta

SEQ ID NO: 932568 - DNA, 25 bp, Mus musculus
gagtatgatgatggcaccccagcta

SEQ ID NO: 932569 - DNA, 25 bp, Mus musculus
gagtattgcactcccactacatccg

SEQ ID NO: 932570 - DNA, 25 bp, Mus musculus
gagtattgcactccgactacatccg

SEQ ID NO: 932571 - DNA, 25 bp, Mus musculus
gagtattgggaatattacagccaag

SEQ ID NO: 932572 - DNA, 25 bp, Mus musculus
gagtattgggtatattacagccaag

SEQ ID NO: 932573 - DNA, 25 bp, Mus musculus
gagtattttaagccatacattaaaa

SEQ ID NO: 932574 - DNA, 25 bp, Mus musculus
gagtattttaaggcatacattaaaa

SEQ ID NO: 932575 - DNA, 25 bp, Mus musculus
gagtcaaagccacggtctcttgtgg

SEQ ID NO: 932576 - DNA, 25 bp, Mus musculus
gagtcaaagccacgtgccagctggg

SEQ ID NO: 932577 - DNA, 25 bp, Mus musculus
gagtcaaagccagggtctcttgtgg

SEQ ID NO: 932578 - DNA, 25 bp, Mus musculus
gagtcaaagccaggtgccagctggg

SEQ ID NO: 932579 - DNA, 25 bp, Mus musculus
gagtcaatacagctgtggcaaaaca

SEQ ID NO: 932580 - DNA, 25 bp, Mus musculus
gagtcaatacaggtgtggcaaaaca

SEQ ID NO: 932581 - DNA, 25 bp, Mus musculus
gagtcacaggcctgagggccagccg

SEQ ID NO: 932582 - DNA, 25 bp, Mus musculus
gagtcacagggctgagggccagccg

SEQ ID NO: 932583 - DNA, 25 bp, Mus musculus
gagtcacctgtacaatggtgccctc

SEQ ID NO: 932584 - DNA, 25 bp, Mus musculus
gagtcacctgtagaatggtgccctc

SEQ ID NO: 932585 - DNA, 25 bp, Mus musculus
gagtcactcaagagcctcatccccg

SEQ ID NO: 932586 - DNA, 25 bp, Mus musculus
gagtcactcaagctctcgctctcga

SEQ ID NO: 932587 - DNA, 25 bp, Mus musculus
gagtcactcaaggtctcgctctcga

SEQ ID NO: 932588 - DNA, 25 bp, Mus musculus
gagtcactcaagtgcctcatccccg

SEQ ID NO: 932589 - DNA, 25 bp, Mus musculus
gagtcagaggccaacgatgctgggg

SEQ ID NO: 932590 - DNA, 25 bp, Mus musculus
gagtcagaggccaaggatgctgggg

SEQ ID NO: 932591 - DNA, 25 bp, Mus musculus
gagtcagagtatgacaaaataaagg

SEQ ID NO: 932592 - DNA, 25 bp, Mus musculus
gagtcagagtatgacaggctgttat

SEQ ID NO: 932593 - DNA, 25 bp, Mus musculus
gagtcagagtatgacgaagaagatt

SEQ ID NO: 932594 - DNA, 25 bp, Mus musculus
gagtcagagtatgactttctcctca

SEQ ID NO: 932595 - DNA, 25 bp, Mus musculus
gagtcagagtatgagaaaataaagg

SEQ ID NO: 932596 - DNA, 25 bp, Mus musculus
gagtcagagtatgagaggctgttat

SEQ ID NO: 932597 - DNA, 25 bp, Mus musculus
gagtcagagtatgaggaagaagatt

SEQ ID NO: 932598 - DNA, 25 bp, Mus musculus
gagtcagagtatgagtttctcctca

SEQ ID NO: 932599 - DNA, 25 bp, Mus musculus
gagtcagtttataacgtcccctttg

SEQ ID NO: 932600 - DNA, 25 bp, Mus musculus
gagtcagtttataaggtcccctttg

SEQ ID NO: 932601 - DNA, 25 bp, Mus musculus
gagtcatcacagctgtgacaccagc

SEQ ID NO: 932602 - DNA, 25 bp, Mus musculus
gagtcatcacaggtgtgacaccagc

SEQ ID NO: 932603 - DNA, 25 bp, Mus musculus
gagtcatccttcgacgatgtctcgg

SEQ ID NO: 932604 - DNA, 25 bp, Mus musculus
gagtcatccttcgacgcttgctttg

SEQ ID NO: 932605 - DNA, 25 bp, Mus musculus
gagtcatccttcgaggatgtctcgg

SEQ ID NO: 932606 - DNA, 25 bp, Mus musculus
gagtcatccttcgaggcttgctttg

SEQ ID NO: 932607 - DNA, 25 bp, Mus musculus
gagtcatgagtccaaggagtctctc

SEQ ID NO: 932608 - DNA, 25 bp, Mus musculus
gagtcatgagtcgaaggagtctctc

SEQ ID NO: 932609 - DNA, 25 bp, Mus musculus
gagtccaagagtgacgccaggcccg

SEQ ID NO: 932610 - DNA, 25 bp, Mus musculus
gagtccaagagtgaggccaggcccg

SEQ ID NO: 932611 - DNA, 25 bp, Mus musculus
gagtccaccgcaagcattgccaagc

SEQ ID NO: 932612 - DNA, 25 bp, Mus musculus
gagtccaccggaagcattgccaagc

SEQ ID NO: 932613 - DNA, 25 bp, Mus musculus
gagtccatgactttacaggaacaga

SEQ ID NO: 932614 - DNA, 25 bp, Mus musculus
gagtccatgagtttacaggaacaga

SEQ ID NO: 932615 - DNA, 25 bp, Mus musculus
gagtccatgattcacaacttaataa

SEQ ID NO: 932616 - DNA, 25 bp, Mus musculus
gagtccatgattcagaacttaataa

SEQ ID NO: 932617 - DNA, 25 bp, Mus musculus
gagtcccaaaggagtcctgcaggtc

SEQ ID NO: 932618 - DNA, 25 bp, Mus musculus
gagtcccaaaggatgcatgctgttc

SEQ ID NO: 932619 - DNA, 25 bp, Mus musculus
gagtcccaaaggctcttcagattac

SEQ ID NO: 932620 - DNA, 25 bp, Mus musculus
gagtcccaaagggtcttcagattac

SEQ ID NO: 932621 - DNA, 25 bp, Mus musculus
gagtcccaaaggtgtcctgcaggtc

SEQ ID NO: 932622 - DNA, 25 bp, Mus musculus
gagtcccaaaggttgcatgctgttc

SEQ ID NO: 932623 - DNA, 25 bp, Mus musculus
gagtccctagagctgttggtggaat

SEQ ID NO: 932624 - DNA, 25 bp, Mus musculus
gagtccctagaggtgttggtggaat

SEQ ID NO: 932625 - DNA, 25 bp, Mus musculus
gagtccctgggtgtcaaaccggact

SEQ ID NO: 932626 - DNA, 25 bp, Mus musculus
gagtccctgggtgtgaaaccggact

SEQ ID NO: 932627 - DNA, 25 bp, Mus musculus
gagtccctggtgatcggtacgagga

SEQ ID NO: 932628 - DNA, 25 bp, Mus musculus
gagtccctggtgatgggtacgagga

SEQ ID NO: 932629 - DNA, 25 bp, Mus musculus
gagtccgaaaacagtgtgccttagc

SEQ ID NO: 932630 - DNA, 25 bp, Mus musculus
gagtccgaaatcagtgtgccttagc

SEQ ID NO: 932631 - DNA, 25 bp, Mus musculus
gagtccgcgactccagtgtatagaa

SEQ ID NO: 932632 - DNA, 25 bp, Mus musculus
gagtccgcgactcctgtgtatagaa

SEQ ID NO: 932633 - DNA, 25 bp, Mus musculus
gagtccggcaagcagatgaagtctc

SEQ ID NO: 932634 - DNA, 25 bp, Mus musculus
gagtccggcaaggagatgaagtctc

SEQ ID NO: 932635 - DNA, 25 bp, Mus musculus
gagtccggctagcgttgttcctgct

SEQ ID NO: 932636 - DNA, 25 bp, Mus musculus
gagtccggctagggttgttcctgct

SEQ ID NO: 932637 - DNA, 25 bp, Mus musculus
gagtcctatgctgaaggctgcattg

SEQ ID NO: 932638 - DNA, 25 bp, Mus musculus
gagtcctatggtgaaggctgcattg

SEQ ID NO: 932639 - DNA, 25 bp, Mus musculus
gagtcctcagaatggcaatgttcct

SEQ ID NO: 932640 - DNA, 25 bp, Mus musculus
gagtcctcagccacctccaagtgga

SEQ ID NO: 932641 - DNA, 25 bp, Mus musculus
gagtcctcagcccaatgtgctttgt

SEQ ID NO: 932642 - DNA, 25 bp, Mus musculus
gagtcctcaggcacctccaagtgga

SEQ ID NO: 932643 - DNA, 25 bp, Mus musculus
gagtcctcaggccaatgtgctttgt

SEQ ID NO: 932644 - DNA, 25 bp, Mus musculus
gagtcctcagtatggcaatgttcct

SEQ ID NO: 932645 - DNA, 25 bp, Mus musculus
gagtcctggcaacttttgcctcctg

SEQ ID NO: 932646 - DNA, 25 bp, Mus musculus
gagtcctggcaagttttgcctcctg

SEQ ID NO: 932647 - DNA, 25 bp, Mus musculus
gagtccttcacaagcttatccatca

SEQ ID NO: 932648 - DNA, 25 bp, Mus musculus
gagtccttcagaagcttatccatca

SEQ ID NO: 932649 - DNA, 25 bp, Mus musculus
gagtcctttgagctgactgcatttg

SEQ ID NO: 932650 - DNA, 25 bp, Mus musculus
gagtcctttgaggtgactgcatttg

SEQ ID NO: 932651 - DNA, 25 bp, Mus musculus
gagtcgactacgagacaaacccaaa

SEQ ID NO: 932652 - DNA, 25 bp, Mus musculus
gagtcgactacgtgacaaacccaaa

SEQ ID NO: 932653 - DNA, 25 bp, Mus musculus
gagtcgccggagcacacagagctgc

SEQ ID NO: 932654 - DNA, 25 bp, Mus musculus
gagtcgccggaggacacagagctgc

SEQ ID NO: 932655 - DNA, 25 bp, Mus musculus
gagtcggcagatgaaagtgggggtg

SEQ ID NO: 932656 - DNA, 25 bp, Mus musculus
gagtcggcagcgctctgagtcagat

SEQ ID NO: 932657 - DNA, 25 bp, Mus musculus
gagtcggcagggctctgagtcagat

SEQ ID NO: 932658 - DNA, 25 bp, Mus musculus
gagtcggcagttgaaagtgggggtg

SEQ ID NO: 932659 - DNA, 25 bp, Mus musculus
gagtcgtgcaagagcattttgcgga

SEQ ID NO: 932660 - DNA, 25 bp, Mus musculus
gagtcgtgcaagtgcattttgcgga

SEQ ID NO: 932661 - DNA, 25 bp, Mus musculus
gagtcgttagcgagagcacaaacat

SEQ ID NO: 932662 - DNA, 25 bp, Mus musculus
gagtcgttagcgtgagcacaaacat

SEQ ID NO: 932663 - DNA, 25 bp, Mus musculus
gagtctaaggaggacaacatttcag

SEQ ID NO: 932664 - DNA, 25 bp, Mus musculus
gagtctaaggaggagaacatttcag

SEQ ID NO: 932665 - DNA, 25 bp, Mus musculus
gagtctacagctttgtacagcgcaa

SEQ ID NO: 932666 - DNA, 25 bp, Mus musculus
gagtctacaggtttgtacagcgcaa

SEQ ID NO: 932667 - DNA, 25 bp, Mus musculus
gagtctataaatttccaagagccag

SEQ ID NO: 932668 - DNA, 25 bp, Mus musculus
gagtctataaatttgcaagagccag

SEQ ID NO: 932669 - DNA, 25 bp, Mus musculus
gagtctatgtcacacagggaacaac

SEQ ID NO: 932670 - DNA, 25 bp, Mus musculus
gagtctatgtcagacagggaacaac

SEQ ID NO: 932671 - DNA, 25 bp, Mus musculus
gagtctcaagcggatattgtgtttg

SEQ ID NO: 932672 - DNA, 25 bp, Mus musculus
gagtctcaaggcaacataggaaaaa

SEQ ID NO: 932673 - DNA, 25 bp, Mus musculus
gagtctcaaggcaagataggaaaaa

SEQ ID NO: 932674 - DNA, 25 bp, Mus musculus
gagtctcaaggggatattgtgtttg

SEQ ID NO: 932675 - DNA, 25 bp, Mus musculus
gagtctccttcacttaatgtatcca

SEQ ID NO: 932676 - DNA, 25 bp, Mus musculus
gagtctccttcagttaatgtatcca

SEQ ID NO: 932677 - DNA, 25 bp, Mus musculus
gagtctcggaagagcatccaccggg

SEQ ID NO: 932678 - DNA, 25 bp, Mus musculus
gagtctcggaagtgcatccaccggg

SEQ ID NO: 932679 - DNA, 25 bp, Mus musculus
gagtctctccatcacgtttctttct

SEQ ID NO: 932680 - DNA, 25 bp, Mus musculus
gagtctctccatcaggtttctttct

SEQ ID NO: 932681 - DNA, 25 bp, Mus musculus
gagtctctccctgtagctgtactac

SEQ ID NO: 932682 - DNA, 25 bp, Mus musculus
gagtctctccgtgtagctgtactac

SEQ ID NO: 932683 - DNA, 25 bp, Mus musculus
gagtctctggccacggaggtgccaa

SEQ ID NO: 932684 - DNA, 25 bp, Mus musculus
gagtctctgggcacggaggtgccaa

SEQ ID NO: 932685 - DNA, 25 bp, Mus musculus
gagtctcttaagaatataaaagaca

SEQ ID NO: 932686 - DNA, 25 bp, Mus musculus
gagtctcttaagtatataaaagaca

SEQ ID NO: 932687 - DNA, 25 bp, Mus musculus
gagtctgacaaacccttcatgtcca

SEQ ID NO: 932688 - DNA, 25 bp, Mus musculus
gagtctgacaaagccttcatgtcca

SEQ ID NO: 932689 - DNA, 25 bp, Mus musculus
gagtctgcagaaccagtgtgcagac

SEQ ID NO: 932690 - DNA, 25 bp, Mus musculus
gagtctgcagtaccagtgtgcagac

SEQ ID NO: 932691 - DNA, 25 bp, Mus musculus
gagtctgctcagcgcggcttcattt

SEQ ID NO: 932692 - DNA, 25 bp, Mus musculus
gagtctgctcagggcggcttcattt

SEQ ID NO: 932693 - DNA, 25 bp, Mus musculus
gagtctggggatcacgattattact

SEQ ID NO: 932694 - DNA, 25 bp, Mus musculus
gagtctggggatcaggattattact

SEQ ID NO: 932695 - DNA, 25 bp, Mus musculus
gagtctgtgaagagccacaatcatg

SEQ ID NO: 932696 - DNA, 25 bp, Mus musculus
gagtctgtgaagcagaagtttgaga

SEQ ID NO: 932697 - DNA, 25 bp, Mus musculus
gagtctgtgaaggagaagtttgaga

SEQ ID NO: 932698 - DNA, 25 bp, Mus musculus
gagtctgtgaagtgccacaatcatg

SEQ ID NO: 932699 - DNA, 25 bp, Mus musculus
gagtctgtgcggatgcgaggggaag

SEQ ID NO: 932700 - DNA, 25 bp, Mus musculus
gagtctgtgcggttgcgaggggaag

SEQ ID NO: 932701 - DNA, 25 bp, Mus musculus
gagtcttccccacgttgccctggca

SEQ ID NO: 932702 - DNA, 25 bp, Mus musculus
gagtcttccccaggttgccctggca

SEQ ID NO: 932703 - DNA, 25 bp, Mus musculus
gagtgaacgtcacacgcatatatcg

SEQ ID NO: 932704 - DNA, 25 bp, Mus musculus
gagtgaacgtcacaggcatatatcg

SEQ ID NO: 932705 - DNA, 25 bp, Mus musculus
gagtgaactcagagtgaccacatct

SEQ ID NO: 932706 - DNA, 25 bp, Mus musculus
gagtgaactcagtgtgaccacatct

SEQ ID NO: 932707 - DNA, 25 bp, Mus musculus
gagtgaagatagtttaggtcaaccc

SEQ ID NO: 932708 - DNA, 25 bp, Mus musculus
gagtgaagatcatcgtaatactttt

SEQ ID NO: 932709 - DNA, 25 bp, Mus musculus
gagtgaagatgatcgtaatactttt

SEQ ID NO: 932710 - DNA, 25 bp, Mus musculus
gagtgaagattgtttaggtcaaccc

SEQ ID NO: 932711 - DNA, 25 bp, Mus musculus
gagtgaaggcaaggctagtgacagt

SEQ ID NO: 932712 - DNA, 25 bp, Mus musculus
gagtgaaggcaagggtagtgacagt

SEQ ID NO: 932713 - DNA, 25 bp, Mus musculus
gagtgaattagaaataatgtttaat

SEQ ID NO: 932714 - DNA, 25 bp, Mus musculus
gagtgaattagatataatgtttaat

SEQ ID NO: 932715 - DNA, 25 bp, Mus musculus
gagtgacatctgtacgatagcccag

SEQ ID NO: 932716 - DNA, 25 bp, Mus musculus
gagtgacatctgtaggatagcccag

SEQ ID NO: 932717 - DNA, 25 bp, Mus musculus
gagtgaccagcatcggcaggttttg

SEQ ID NO: 932718 - DNA, 25 bp, Mus musculus
gagtgaccagccgtgggaatggtgt

SEQ ID NO: 932719 - DNA, 25 bp, Mus musculus
gagtgaccaggatcggcaggttttg

SEQ ID NO: 932720 - DNA, 25 bp, Mus musculus
gagtgaccaggcgtgggaatggtgt

SEQ ID NO: 932721 - DNA, 25 bp, Mus musculus
gagtgagaagatcttggctgcatac

SEQ ID NO: 932722 - DNA, 25 bp, Mus musculus
gagtgagaagcatttcttcacttcc

SEQ ID NO: 932723 - DNA, 25 bp, Mus musculus
gagtgagaaggatttcttcacttcc

SEQ ID NO: 932724 - DNA, 25 bp, Mus musculus
gagtgagaagttcttggctgcatac

SEQ ID NO: 932725 - DNA, 25 bp, Mus musculus
gagtgagcacggatgaaaatttttc

SEQ ID NO: 932726 - DNA, 25 bp, Mus musculus
gagtgagcacggttgaaaatttttc

SEQ ID NO: 932727 - DNA, 25 bp, Mus musculus
gagtgagcagccccacagtgaacac

SEQ ID NO: 932728 - DNA, 25 bp, Mus musculus
gagtgagcaggcccacagtgaacac

SEQ ID NO: 932729 - DNA, 25 bp, Mus musculus
gagtgagccccacaccacctcatcc

SEQ ID NO: 932730 - DNA, 25 bp, Mus musculus
gagtgagccccacgtctgtctccgt

SEQ ID NO: 932731 - DNA, 25 bp, Mus musculus
gagtgagccccagaccacctcatcc

SEQ ID NO: 932732 - DNA, 25 bp, Mus musculus
gagtgagccccaggtctgtctccgt

SEQ ID NO: 932733 - DNA, 25 bp, Mus musculus
gagtgaggagacaccactactttaa

SEQ ID NO: 932734 - DNA, 25 bp, Mus musculus
gagtgaggagtcaccactactttaa

SEQ ID NO: 932735 - DNA, 25 bp, Mus musculus
gagtgataagtaacaatcttttaga

SEQ ID NO: 932736 - DNA, 25 bp, Mus musculus
gagtgataagtaactatcttttaga

SEQ ID NO: 932737 - DNA, 25 bp, Mus musculus
gagtgatttctgactggctgctgct

SEQ ID NO: 932738 - DNA, 25 bp, Mus musculus
gagtgatttctgtctggctgctgct

SEQ ID NO: 932739 - DNA, 25 bp, Mus musculus
gagtgcaaatcaacctgccagttcc

SEQ ID NO: 932740 - DNA, 25 bp, Mus musculus
gagtgcaaatgaacctgccagttcc

SEQ ID NO: 932741 - DNA, 25 bp, Mus musculus
gagtgcaatgcacgacagtggtgac

SEQ ID NO: 932742 - DNA, 25 bp, Mus musculus
gagtgcaatgcactccgtggtggat

SEQ ID NO: 932743 - DNA, 25 bp, Mus musculus
gagtgcaatgcaggacagtggtgac

SEQ ID NO: 932744 - DNA, 25 bp, Mus musculus
gagtgcaatgcagtccgtggtggat

SEQ ID NO: 932745 - DNA, 25 bp, Mus musculus
gagtgcagagcccaagaactacatg

SEQ ID NO: 932746 - DNA, 25 bp, Mus musculus
gagtgcagaggccaagaactacatg

SEQ ID NO: 932747 - DNA, 25 bp, Mus musculus
gagtgcagcaatattgattgtggcc

SEQ ID NO: 932748 - DNA, 25 bp, Mus musculus
gagtgcagcattattgattgtggcc

SEQ ID NO: 932749 - DNA, 25 bp, Mus musculus
gagtgcatcattcacgtttttcctg

SEQ ID NO: 932750 - DNA, 25 bp, Mus musculus
gagtgcatcattcaggtttttcctg

SEQ ID NO: 932751 - DNA, 25 bp, Mus musculus
gagtgccaaatgccccagcaaggac

SEQ ID NO: 932752 - DNA, 25 bp, Mus musculus
gagtgccaaatggcccagcaaggac

SEQ ID NO: 932753 - DNA, 25 bp, Mus musculus
gagtgccaagatatcgatgagtgtg

SEQ ID NO: 932754 - DNA, 25 bp, Mus musculus
gagtgccaagttatcgatgagtgtg

SEQ ID NO: 932755 - DNA, 25 bp, Mus musculus
gagtgccaggctgaacctgtggcgc

SEQ ID NO: 932756 - DNA, 25 bp, Mus musculus
gagtgccagggtgaacctgtggcgc

SEQ ID NO: 932757 - DNA, 25 bp, Mus musculus
gagtgccatacccacgcatgaacaa

SEQ ID NO: 932758 - DNA, 25 bp, Mus musculus
gagtgccatacccaggcatgaacaa

SEQ ID NO: 932759 - DNA, 25 bp, Mus musculus
gagtgccattaacggagaaatcaaa

SEQ ID NO: 932760 - DNA, 25 bp, Mus musculus
gagtgccattaagggagaaatcaaa

SEQ ID NO: 932761 - DNA, 25 bp, Mus musculus
gagtgccgagagaaggacccgaagc

SEQ ID NO: 932762 - DNA, 25 bp, Mus musculus
gagtgccgagtgaaggacccgaagc

SEQ ID NO: 932763 - DNA, 25 bp, Mus musculus
gagtgcctcagtcaagaaactgacg

SEQ ID NO: 932764 - DNA, 25 bp, Mus musculus
gagtgcctcagtcgtggtgagctct

SEQ ID NO: 932765 - DNA, 25 bp, Mus musculus
gagtgcctcagtgaagaaactgacg

SEQ ID NO: 932766 - DNA, 25 bp, Mus musculus
gagtgcctcagtggtggtgagctct

SEQ ID NO: 932767 - DNA, 25 bp, Mus musculus
gagtgcctgcagcatcggaacgtca

SEQ ID NO: 932768 - DNA, 25 bp, Mus musculus
gagtgcctgcaggatcggaacgtca

SEQ ID NO: 932769 - DNA, 25 bp, Mus musculus
gagtgcgagcggcttgctgttctgg

SEQ ID NO: 932770 - DNA, 25 bp, Mus musculus
gagtgcgagcgggttgctgttctgg

SEQ ID NO: 932771 - DNA, 25 bp, Mus musculus
gagtgcgcacagccatcattgggaa

SEQ ID NO: 932772 - DNA, 25 bp, Mus musculus
gagtgcgcacaggcatcattgggaa

SEQ ID NO: 932773 - DNA, 25 bp, Mus musculus
gagtgcgtggacgtggatgagtgct

SEQ ID NO: 932774 - DNA, 25 bp, Mus musculus
gagtgcgtggtcgtggatgagtgct

SEQ ID NO: 932775 - DNA, 25 bp, Mus musculus
gagtgctgcgacaacgcccttggac

SEQ ID NO: 932776 - DNA, 25 bp, Mus musculus
gagtgctgcgacaaggcccttggac

SEQ ID NO: 932777 - DNA, 25 bp, Mus musculus
gagtgctggacacgccggggcccgc

SEQ ID NO: 932778 - DNA, 25 bp, Mus musculus
gagtgctggacaggccggggcccgc

SEQ ID NO: 932779 - DNA, 25 bp, Mus musculus
gagtggaaagaactgatatacaagg

SEQ ID NO: 932780 - DNA, 25 bp, Mus musculus
gagtggaaagtactgatatacaagg

SEQ ID NO: 932781 - DNA, 25 bp, Mus musculus
gagtggaagaccctgacctatgatg

SEQ ID NO: 932782 - DNA, 25 bp, Mus musculus
gagtggaagagcctgacctatgatg

SEQ ID NO: 932783 - DNA, 25 bp, Mus musculus
gagtggaagtctgatcaggtgtaag

SEQ ID NO: 932784 - DNA, 25 bp, Mus musculus
gagtggaagtgtgatcaggtgtaag

SEQ ID NO: 932785 - DNA, 25 bp, Mus musculus
gagtggactttgaacagtttgtccg

SEQ ID NO: 932786 - DNA, 25 bp, Mus musculus
gagtggactttgaagagtttgtccg

SEQ ID NO: 932787 - DNA, 25 bp, Mus musculus
gagtggagagtccactcttacctcc

SEQ ID NO: 932788 - DNA, 25 bp, Mus musculus
gagtggagagtccagtcttacctcc

SEQ ID NO: 932789 - DNA, 25 bp, Mus musculus
gagtggcaactcagcattgcagcag

SEQ ID NO: 932790 - DNA, 25 bp, Mus musculus
gagtggcaactcaggattgcagcag

SEQ ID NO: 932791 - DNA, 25 bp, Mus musculus
gagtggcagcaccgcgctaaagaag

SEQ ID NO: 932792 - DNA, 25 bp, Mus musculus
gagtggcagcaccgggctaaagaag

SEQ ID NO: 932793 - DNA, 25 bp, Mus musculus
gagtggcatcgacgaccttgtgaat

SEQ ID NO: 932794 - DNA, 25 bp, Mus musculus
gagtggcatcgaggaccttgtgaat

SEQ ID NO: 932795 - DNA, 25 bp, Mus musculus
gagtggccagctatggcgtaaacca

SEQ ID NO: 932796 - DNA, 25 bp, Mus musculus
gagtggccaggtatggcgtaaacca

SEQ ID NO: 932797 - DNA, 25 bp, Mus musculus
gagtggccagttcaagagccccaaa

SEQ ID NO: 932798 - DNA, 25 bp, Mus musculus
gagtggccagttcatgagccccaaa

SEQ ID NO: 932799 - DNA, 25 bp, Mus musculus
gagtggctggcccacaagctagagg

SEQ ID NO: 932800 - DNA, 25 bp, Mus musculus
gagtggctggcccagaagctagagg

SEQ ID NO: 932801 - DNA, 25 bp, Mus musculus
gagtgggaagcaaacgctcaagtca

SEQ ID NO: 932802 - DNA, 25 bp, Mus musculus
gagtgggaagcaaaggctcaagtca

SEQ ID NO: 932803 - DNA, 25 bp, Mus musculus
gagtgggacatgcggggcttacctg

SEQ ID NO: 932804 - DNA, 25 bp, Mus musculus
gagtgggacatggggggcttacctg

SEQ ID NO: 932805 - DNA, 25 bp, Mus musculus
gagtgggatgcccatgacttccgga

SEQ ID NO: 932806 - DNA, 25 bp, Mus musculus
gagtgggatgccgatgacttccgga

SEQ ID NO: 932807 - DNA, 25 bp, Mus musculus
gagtggtcagggcatggcagtggca

SEQ ID NO: 932808 - DNA, 25 bp, Mus musculus
gagtggtcaggggatggcagtggca

SEQ ID NO: 932809 - DNA, 25 bp, Mus musculus
gagtggtgccagctgggggctcata

SEQ ID NO: 932810 - DNA, 25 bp, Mus musculus
gagtggtgccaggtgggggctcata

SEQ ID NO: 932811 - DNA, 25 bp, Mus musculus
gagtggtgcgaggacgtggagccta

SEQ ID NO: 932812 - DNA, 25 bp, Mus musculus
gagtggtgcgaggaggtggagccta

SEQ ID NO: 932813 - DNA, 25 bp, Mus musculus
gagtggttggagcgctacctcagcg

SEQ ID NO: 932814 - DNA, 25 bp, Mus musculus
gagtggttggagggctacctcagcg

SEQ ID NO: 932815 - DNA, 25 bp, Mus musculus
gagtgtacagcgaccctagggtatg

SEQ ID NO: 932816 - DNA, 25 bp, Mus musculus
gagtgtacagggaccctagggtatg

SEQ ID NO: 932817 - DNA, 25 bp, Mus musculus
gagtgtaccatgcctggctgtttga

SEQ ID NO: 932818 - DNA, 25 bp, Mus musculus
gagtgtaccatggctggctgtttga

SEQ ID NO: 932819 - DNA, 25 bp, Mus musculus
gagtgtatcgcacaagaagataatg

SEQ ID NO: 932820 - DNA, 25 bp, Mus musculus
gagtgtatcggacaagaagataatg

SEQ ID NO: 932821 - DNA, 25 bp, Mus musculus
gagtgtcaaacgatcaatgtgacca

SEQ ID NO: 932822 - DNA, 25 bp, Mus musculus
gagtgtcaaactacttcaactcctg

SEQ ID NO: 932823 - DNA, 25 bp, Mus musculus
gagtgtcaaaggatcaatgtgacca

SEQ ID NO: 932824 - DNA, 25 bp, Mus musculus
gagtgtcaaagtacttcaactcctg

SEQ ID NO: 932825 - DNA, 25 bp, Mus musculus
gagtgtcaagactgtgaaccaactg

SEQ ID NO: 932826 - DNA, 25 bp, Mus musculus
gagtgtcaagactgtgatttaccgc

SEQ ID NO: 932827 - DNA, 25 bp, Mus musculus
gagtgtcaagagcatgtctccaaga

SEQ ID NO: 932828 - DNA, 25 bp, Mus musculus
gagtgtcaagaggatgtctccaaga

SEQ ID NO: 932829 - DNA, 25 bp, Mus musculus
gagtgtcaagtctgtgaaccaactg

SEQ ID NO: 932830 - DNA, 25 bp, Mus musculus
gagtgtcaagtctgtgatttaccgc

SEQ ID NO: 932831 - DNA, 25 bp, Mus musculus
gagtgtcacaaacaccaatagctgc

SEQ ID NO: 932832 - DNA, 25 bp, Mus musculus
gagtgtcacaaagaccaatagctgc

SEQ ID NO: 932833 - DNA, 25 bp, Mus musculus
gagtgtcactgccacaactcggtta

SEQ ID NO: 932834 - DNA, 25 bp, Mus musculus
gagtgtcactgccagaactcggtta

SEQ ID NO: 932835 - DNA, 25 bp, Mus musculus
gagtgtcgagattcctaatcatcag

SEQ ID NO: 932836 - DNA, 25 bp, Mus musculus
gagtgtcgagtttcctaatcatcag

SEQ ID NO: 932837 - DNA, 25 bp, Mus musculus
gagtgtctcccacgctttgaagggc

SEQ ID NO: 932838 - DNA, 25 bp, Mus musculus
gagtgtctcccaggctttgaagggc

SEQ ID NO: 932839 - DNA, 25 bp, Mus musculus
gagtgtgaagtggacaagcacggcc

SEQ ID NO: 932840 - DNA, 25 bp, Mus musculus
gagtgtgaagtggagaagcacggcc

SEQ ID NO: 932841 - DNA, 25 bp, Mus musculus
gagtgtgcccagcagaaacatccta

SEQ ID NO: 932842 - DNA, 25 bp, Mus musculus
gagtgtgcccaggagaaacatccta

SEQ ID NO: 932843 - DNA, 25 bp, Mus musculus
gagtgtgcgcctctgcccgtccagg

SEQ ID NO: 932844 - DNA, 25 bp, Mus musculus
gagtgtgcgcctgtgcccgtccagg

SEQ ID NO: 932845 - DNA, 25 bp, Mus musculus
gagtgtgctctgcgtgccaaccctt

SEQ ID NO: 932846 - DNA, 25 bp, Mus musculus
gagtgtgctctgggtgccaaccctt

SEQ ID NO: 932847 - DNA, 25 bp, Mus musculus
gagtgtgggctgctaccctctgccc

SEQ ID NO: 932848 - DNA, 25 bp, Mus musculus
gagtgtgggctggtaccctctgccc

SEQ ID NO: 932849 - DNA, 25 bp, Mus musculus
gagtgtggtggacgtcaccagtccc

SEQ ID NO: 932850 - DNA, 25 bp, Mus musculus
gagtgtggtggaggtcaccagtccc

SEQ ID NO: 932851 - DNA, 25 bp, Mus musculus
gagtgtgtaaacaaactcctggaag

SEQ ID NO: 932852 - DNA, 25 bp, Mus musculus
gagtgtgtaaacaatctcctggaag

SEQ ID NO: 932853 - DNA, 25 bp, Mus musculus
gagtgtgtgcaaatcacccaggatg

SEQ ID NO: 932854 - DNA, 25 bp, Mus musculus
gagtgtgtgcaaatgacccaggatg

SEQ ID NO: 932855 - DNA, 25 bp, Mus musculus
gagtgtgtgcagcctatttcaggtt

SEQ ID NO: 932856 - DNA, 25 bp, Mus musculus
gagtgtgtgcaggctatttcaggtt

SEQ ID NO: 932857 - DNA, 25 bp, Mus musculus
gagtgtgttgatgtgaacgagtgtg

SEQ ID NO: 932858 - DNA, 25 bp, Mus musculus
gagtgtgttgttgtgaacgagtgtg

SEQ ID NO: 932859 - DNA, 25 bp, Mus musculus
gagtgttgtgagcagtccatgaaga

SEQ ID NO: 932860 - DNA, 25 bp, Mus musculus
gagtgttgtgaggagtccatgaaga

SEQ ID NO: 932861 - DNA, 25 bp, Mus musculus
gagttaagagagctaatagaattgc

SEQ ID NO: 932862 - DNA, 25 bp, Mus musculus
gagttaagagaggtaatagaattgc

SEQ ID NO: 932863 - DNA, 25 bp, Mus musculus
gagttaattcagctagaagacgaaa

SEQ ID NO: 932864 - DNA, 25 bp, Mus musculus
gagttaattcaggtagaagacgaaa

SEQ ID NO: 932865 - DNA, 25 bp, Mus musculus
gagttacaccaactttctgggctaa

SEQ ID NO: 932866 - DNA, 25 bp, Mus musculus
gagttacaccaagtttctgggctaa

SEQ ID NO: 932867 - DNA, 25 bp, Mus musculus
gagttacttagtcgagagaacagat

SEQ ID NO: 932868 - DNA, 25 bp, Mus musculus
gagttacttagtcgtgagacgtgga

SEQ ID NO: 932869 - DNA, 25 bp, Mus musculus
gagttacttagtggagagaacagat

SEQ ID NO: 932870 - DNA, 25 bp, Mus musculus
gagttacttagtggtgagacgtgga

SEQ ID NO: 932871 - DNA, 25 bp, Mus musculus
gagttagaagctctcaatgacaaaa

SEQ ID NO: 932872 - DNA, 25 bp, Mus musculus
gagttagaagctctgaatgacaaaa

SEQ ID NO: 932873 - DNA, 25 bp, Mus musculus
gagttagagcaaccgaagaagccca

SEQ ID NO: 932874 - DNA, 25 bp, Mus musculus
gagttagagcaagcgaagaagccca

SEQ ID NO: 932875 - DNA, 25 bp, Mus musculus
gagttaggaaagcaaagcactgcca

SEQ ID NO: 932876 - DNA, 25 bp, Mus musculus
gagttaggaaaggaaagcactgcca

SEQ ID NO: 932877 - DNA, 25 bp, Mus musculus
gagttagtgacccaccaaatgtggg

SEQ ID NO: 932878 - DNA, 25 bp, Mus musculus
gagttagtgacccagcaaatgtggg

SEQ ID NO: 932879 - DNA, 25 bp, Mus musculus
gagttatgatgacgccaagcacgtg

SEQ ID NO: 932880 - DNA, 25 bp, Mus musculus
gagttatgatgaggccaagcacgtg

SEQ ID NO: 932881 - DNA, 25 bp, Mus musculus
gagttatgcagatacgtagccgaga

SEQ ID NO: 932882 - DNA, 25 bp, Mus musculus
gagttatgcagataggtagccgaga

SEQ ID NO: 932883 - DNA, 25 bp, Mus musculus
gagttattagcatgcctggtgtgca

SEQ ID NO: 932884 - DNA, 25 bp, Mus musculus
gagttattagccacatgactcaggg

SEQ ID NO: 932885 - DNA, 25 bp, Mus musculus
gagttattaggatgcctggtgtgca

SEQ ID NO: 932886 - DNA, 25 bp, Mus musculus
gagttattaggcacatgactcaggg

SEQ ID NO: 932887 - DNA, 25 bp, Mus musculus
gagttcaaccagctggtgatctttg

SEQ ID NO: 932888 - DNA, 25 bp, Mus musculus
gagttcaaccaggtggtgatctttg

SEQ ID NO: 932889 - DNA, 25 bp, Mus musculus
gagttcaagcgacgcaagtcccacc

SEQ ID NO: 932890 - DNA, 25 bp, Mus musculus
gagttcaagcgaggcaagtcccacc

SEQ ID NO: 932891 - DNA, 25 bp, Mus musculus
gagttcaatgagcgacagattgccc

SEQ ID NO: 932892 - DNA, 25 bp, Mus musculus
gagttcaatgagggacagattgccc

SEQ ID NO: 932893 - DNA, 25 bp, Mus musculus
gagttcaccaagactggccgtgtgg

SEQ ID NO: 932894 - DNA, 25 bp, Mus musculus
gagttcaccaagtctggccgtgtgg

SEQ ID NO: 932895 - DNA, 25 bp, Mus musculus
gagttcagaagacgatgactgagtg

SEQ ID NO: 932896 - DNA, 25 bp, Mus musculus
gagttcagaagaggatgactgagtg

SEQ ID NO: 932897 - DNA, 25 bp, Mus musculus
gagttcagaccacaaatgctccagg

SEQ ID NO: 932898 - DNA, 25 bp, Mus musculus
gagttcagaccagaaatgctccagg

SEQ ID NO: 932899 - DNA, 25 bp, Mus musculus
gagttcagcacaaatttcacaggct

SEQ ID NO: 932900 - DNA, 25 bp, Mus musculus
gagttcagcacatatttcacaggct

SEQ ID NO: 932901 - DNA, 25 bp, Mus musculus
gagttcagccctgccgacgtgtgtc

SEQ ID NO: 932902 - DNA, 25 bp, Mus musculus
gagttcagccctgcggacgtgtgtc

SEQ ID NO: 932903 - DNA, 25 bp, Mus musculus
gagttcatcaagcagattggataca

SEQ ID NO: 932904 - DNA, 25 bp, Mus musculus
gagttcatcaaggagattggataca

SEQ ID NO: 932905 - DNA, 25 bp, Mus musculus
gagttcatcacgactgtgcaacagc

SEQ ID NO: 932906 - DNA, 25 bp, Mus musculus
gagttcatcacgtctgtgcaacagc

SEQ ID NO: 932907 - DNA, 25 bp, Mus musculus
gagttcatcgatggctaaagtaaaa

SEQ ID NO: 932908 - DNA, 25 bp, Mus musculus
gagttcatcgatgtctacttcattg

SEQ ID NO: 932909 - DNA, 25 bp, Mus musculus
gagttcatcgttggctaaagtaaaa

SEQ ID NO: 932910 - DNA, 25 bp, Mus musculus
gagttcatcgttgtctacttcattg

SEQ ID NO: 932911 - DNA, 25 bp, Mus musculus
gagttcatgaagcaagcgggtgcag

SEQ ID NO: 932912 - DNA, 25 bp, Mus musculus
gagttcatgaagcaggatttcgatg

SEQ ID NO: 932913 - DNA, 25 bp, Mus musculus
gagttcatgaaggaagcgggtgcag

SEQ ID NO: 932914 - DNA, 25 bp, Mus musculus
gagttcatgaaggaggatttcgatg

SEQ ID NO: 932915 - DNA, 25 bp, Mus musculus
gagttcatggctcctgagatggtga

SEQ ID NO: 932916 - DNA, 25 bp, Mus musculus
gagttcatgggtcctgagatggtga

SEQ ID NO: 932917 - DNA, 25 bp, Mus musculus
gagttccagaggcatctaaagagta

SEQ ID NO: 932918 - DNA, 25 bp, Mus musculus
gagttccagagggatctaaagagta

SEQ ID NO: 932919 - DNA, 25 bp, Mus musculus
gagttcccagatgaagaaactgaaa

SEQ ID NO: 932920 - DNA, 25 bp, Mus musculus
gagttcccagttgaagaaactgaaa

SEQ ID NO: 932921 - DNA, 25 bp, Mus musculus
gagttcgtcaaaagactggcaatgg

SEQ ID NO: 932922 - DNA, 25 bp, Mus musculus
gagttcgtcaaatgactggcaatgg

SEQ ID NO: 932923 - DNA, 25 bp, Mus musculus
gagttctaccgcagtggctgggcac

SEQ ID NO: 932924 - DNA, 25 bp, Mus musculus
gagttctaccgctgtggctgggcac

SEQ ID NO: 932925 - DNA, 25 bp, Mus musculus
gagttctatatgcgccaaacagggc

SEQ ID NO: 932926 - DNA, 25 bp, Mus musculus
gagttctatatgcggcaaacagggc

SEQ ID NO: 932927 - DNA, 25 bp, Mus musculus
gagttctatcagcactggcagctga

SEQ ID NO: 932928 - DNA, 25 bp, Mus musculus
gagttctatcagcagtggcagctga

SEQ ID NO: 932929 - DNA, 25 bp, Mus musculus
gagttctctctaaacctttgacatg

SEQ ID NO: 932930 - DNA, 25 bp, Mus musculus
gagttctctctatacctttgacatg

SEQ ID NO: 932931 - DNA, 25 bp, Mus musculus
gagttctgccagtgagattttgaca

SEQ ID NO: 932932 - DNA, 25 bp, Mus musculus
gagttctgccagtgtgattttgaca

SEQ ID NO: 932933 - DNA, 25 bp, Mus musculus
gagttctgttgcaaccctacttctc

SEQ ID NO: 932934 - DNA, 25 bp, Mus musculus
gagttctgttgcaacgtgatctctg

SEQ ID NO: 932935 - DNA, 25 bp, Mus musculus
gagttctgttgcaagcctacttctc

SEQ ID NO: 932936 - DNA, 25 bp, Mus musculus
gagttctgttgcaaggtgatctctg

SEQ ID NO: 932937 - DNA, 25 bp, Mus musculus
gagttcttgtttcacgaaatggctg

SEQ ID NO: 932938 - DNA, 25 bp, Mus musculus
gagttcttgtttcacgacttcctcc

SEQ ID NO: 932939 - DNA, 25 bp, Mus musculus
gagttcttgtttcaggaaatggctg

SEQ ID NO: 932940 - DNA, 25 bp, Mus musculus
gagttcttgtttcaggacttcctcc

SEQ ID NO: 932941 - DNA, 25 bp, Mus musculus
gagttctttagacacggtgacagag

SEQ ID NO: 932942 - DNA, 25 bp, Mus musculus
gagttctttagacagggtgacagag

SEQ ID NO: 932943 - DNA, 25 bp, Mus musculus
gagttctttctgaggtgtcagatgc

SEQ ID NO: 932944 - DNA, 25 bp, Mus musculus
gagttctttctgtggtgtcagatgc

SEQ ID NO: 932945 - DNA, 25 bp, Mus musculus
gagttgaccacactccttcggagtg

SEQ ID NO: 932946 - DNA, 25 bp, Mus musculus
gagttgaccacactgcttcggagtg

SEQ ID NO: 932947 - DNA, 25 bp, Mus musculus
gagttgatgcagcccgtggctcttg

SEQ ID NO: 932948 - DNA, 25 bp, Mus musculus
gagttgatgcaggccgtggctcttg

SEQ ID NO: 932949 - DNA, 25 bp, Mus musculus
gagttgattcagaacatgcagaatg

SEQ ID NO: 932950 - DNA, 25 bp, Mus musculus
gagttgattcagaagatgcagaatg

SEQ ID NO: 932951 - DNA, 25 bp, Mus musculus
gagttgcagcagaacatcctgtgca

SEQ ID NO: 932952 - DNA, 25 bp, Mus musculus
gagttgcagcagaagatcctgtgca

SEQ ID NO: 932953 - DNA, 25 bp, Mus musculus
gagttgcagcagctgaaacagtttg

SEQ ID NO: 932954 - DNA, 25 bp, Mus musculus
gagttgcagcaggtgaaacagtttg

SEQ ID NO: 932955 - DNA, 25 bp, Mus musculus
gagttggaaatgcctttcttcgtag

SEQ ID NO: 932956 - DNA, 25 bp, Mus musculus
gagttggaaatggctttcttcgtag

SEQ ID NO: 932957 - DNA, 25 bp, Mus musculus
gagttggagagagacgcacgattac

SEQ ID NO: 932958 - DNA, 25 bp, Mus musculus
gagttggagagagaggcacgattac

SEQ ID NO: 932959 - DNA, 25 bp, Mus musculus
gagttggcgattagactctgccttc

SEQ ID NO: 932960 - DNA, 25 bp, Mus musculus
gagttggcgattagaggtctgacat

SEQ ID NO: 932961 - DNA, 25 bp, Mus musculus
gagttggcgattagtctctgccttc

SEQ ID NO: 932962 - DNA, 25 bp, Mus musculus
gagttggcgattagtggtctgacat

SEQ ID NO: 932963 - DNA, 25 bp, Mus musculus
gagttgggaagagtcccatgacaat

SEQ ID NO: 932964 - DNA, 25 bp, Mus musculus
gagttgggaagagtctgtcctgagt

SEQ ID NO: 932965 - DNA, 25 bp, Mus musculus
gagttgggaagagtgccatgacaat

SEQ ID NO: 932966 - DNA, 25 bp, Mus musculus
gagttgggaagagtgtgtcctgagt

SEQ ID NO: 932967 - DNA, 25 bp, Mus musculus
gagttgggtgcgaacgtaacagaga

SEQ ID NO: 932968 - DNA, 25 bp, Mus musculus
gagttgggtgcgaaggtaacagaga

SEQ ID NO: 932969 - DNA, 25 bp, Mus musculus
gagttggtaaatctttatggagccg

SEQ ID NO: 932970 - DNA, 25 bp, Mus musculus
gagttggtaaatgtttatggagccg

SEQ ID NO: 932971 - DNA, 25 bp, Mus musculus
gagttggttcagaatcctgtggaac

SEQ ID NO: 932972 - DNA, 25 bp, Mus musculus
gagttggttcagctggaacatccag

SEQ ID NO: 932973 - DNA, 25 bp, Mus musculus
gagttggttcaggtggaacatccag

SEQ ID NO: 932974 - DNA, 25 bp, Mus musculus
gagttggttcagtatcctgtggaac

SEQ ID NO: 932975 - DNA, 25 bp, Mus musculus
gagttgtcagctaaagatgagcctt

SEQ ID NO: 932976 - DNA, 25 bp, Mus musculus
gagttgtcaggtaaagatgagcctt

SEQ ID NO: 932977 - DNA, 25 bp, Mus musculus
gagttgtccaagcaatgtggcttcg

SEQ ID NO: 932978 - DNA, 25 bp, Mus musculus
gagttgtccaaggaatgtggcttcg

SEQ ID NO: 932979 - DNA, 25 bp, Mus musculus
gagttgtctctgatgcagcccttgg

SEQ ID NO: 932980 - DNA, 25 bp, Mus musculus
gagttgtctctgttgcagcccttgg

SEQ ID NO: 932981 - DNA, 25 bp, Mus musculus
gagttgtgagcagatcccccaagag

SEQ ID NO: 932982 - DNA, 25 bp, Mus musculus
gagttgtgaggagatcccccaagag

SEQ ID NO: 932983 - DNA, 25 bp, Mus musculus
gagtttaaagcttgacatgacaact

SEQ ID NO: 932984 - DNA, 25 bp, Mus musculus
gagtttaaaggttgacatgacaact

SEQ ID NO: 932985 - DNA, 25 bp, Mus musculus
gagtttatcaagctcttccatggct

SEQ ID NO: 932986 - DNA, 25 bp, Mus musculus
gagtttatcaaggtcttccatggct

SEQ ID NO: 932987 - DNA, 25 bp, Mus musculus
gagtttcaagccaaacgaatgcacg

SEQ ID NO: 932988 - DNA, 25 bp, Mus musculus
gagtttcaagctgggatgtgtgtgg

SEQ ID NO: 932989 - DNA, 25 bp, Mus musculus
gagtttcaaggcaaacgaatgcacg

SEQ ID NO: 932990 - DNA, 25 bp, Mus musculus
gagtttcaaggtgggatgtgtgtgg

SEQ ID NO: 932991 - DNA, 25 bp, Mus musculus
gagtttcatggacaatcaaaagcct

SEQ ID NO: 932992 - DNA, 25 bp, Mus musculus
gagtttcatggagaatcaaaagcct

SEQ ID NO: 932993 - DNA, 25 bp, Mus musculus
gagtttccacagcttgaagcttgca

SEQ ID NO: 932994 - DNA, 25 bp, Mus musculus
gagtttccacaggttgaagcttgca

SEQ ID NO: 932995 - DNA, 25 bp, Mus musculus
gagtttctgcacaacactccagtgg

SEQ ID NO: 932996 - DNA, 25 bp, Mus musculus
gagtttctgcacaagactccagtgg

SEQ ID NO: 932997 - DNA, 25 bp, Mus musculus
gagtttctgcttgaagtcctagaag

SEQ ID NO: 932998 - DNA, 25 bp, Mus musculus
gagtttctgcttgatgtcctagaag

SEQ ID NO: 932999 - DNA, 25 bp, Mus musculus
gagtttgaagccttcgtggccatgg

SEQ ID NO: 933000 - DNA, 25 bp, Mus musculus
gagtttgaaggcttcgtggccatgg

SEQ ID NO: 933001 - DNA, 25 bp, Mus musculus
gagtttgacaagatgcgggaagatg

SEQ ID NO: 933002 - DNA, 25 bp, Mus musculus
gagtttgacaagttgcgggaagatg

SEQ ID NO: 933003 - DNA, 25 bp, Mus musculus
gagtttgagaagctatgcagcaatg

SEQ ID NO: 933004 - DNA, 25 bp, Mus musculus
gagtttgagaaggtatgcagcaatg

SEQ ID NO: 933005 - DNA, 25 bp, Mus musculus
gagtttgaggagcctcaacgcacag

SEQ ID NO: 933006 - DNA, 25 bp, Mus musculus
gagtttgaggaggctcaacgcacag

SEQ ID NO: 933007 - DNA, 25 bp, Mus musculus
gagtttggagatgtgatgctggggg

SEQ ID NO: 933008 - DNA, 25 bp, Mus musculus
gagtttggagttgtgatgctggggg

SEQ ID NO: 933009 - DNA, 25 bp, Mus musculus
gagtttgtcgcccccgagatcgtga

SEQ ID NO: 933010 - DNA, 25 bp, Mus musculus
gagtttgtcggccccgagatcgtga

SEQ ID NO: 933011 - DNA, 25 bp, Mus musculus
gagttttaggaaagatataccgcat

SEQ ID NO: 933012 - DNA, 25 bp, Mus musculus
gagttttaggaatgatataccgcat

SEQ ID NO: 933013 - DNA, 25 bp, Mus musculus
gagttttcctatacagcaaataccg

SEQ ID NO: 933014 - DNA, 25 bp, Mus musculus
gagttttcctttacagcaaataccg

SEQ ID NO: 933015 - DNA, 25 bp, Mus musculus
gagttttgcacaaacgtttgtggtg

SEQ ID NO: 933016 - DNA, 25 bp, Mus musculus
gagttttgcacaaaggtttgtggtg

SEQ ID NO: 933017 - DNA, 25 bp, Mus musculus
gagttttgtgcagacattaagcaca

SEQ ID NO: 933018 - DNA, 25 bp, Mus musculus
gagttttgtgcagagattaagcaca

SEQ ID NO: 933019 - DNA, 25 bp, Mus musculus
gagttttgttttcttatgaatgcag

SEQ ID NO: 933020 - DNA, 25 bp, Mus musculus
gagttttgttttgttatgaatgcag

SEQ ID NO: 933021 - DNA, 25 bp, Mus musculus
gataaaaacaatccccactatgcag

SEQ ID NO: 933022 - DNA, 25 bp, Mus musculus
gataaaaacaatgcccactatgcag

SEQ ID NO: 933023 - DNA, 25 bp, Mus musculus
gataaaaacgcgaatccactcaatt

SEQ ID NO: 933024 - DNA, 25 bp, Mus musculus
gataaaaacgggaatccactcaatt

SEQ ID NO: 933025 - DNA, 25 bp, Mus musculus
gataaaagcactaaaaggtatattt

SEQ ID NO: 933026 - DNA, 25 bp, Mus musculus
gataaaagcacttaaaggtatattt

SEQ ID NO: 933027 - DNA, 25 bp, Mus musculus
gataaaattattcacgctaatggct

SEQ ID NO: 933028 - DNA, 25 bp, Mus musculus
gataaaattattcaggctaatggct

SEQ ID NO: 933029 - DNA, 25 bp, Mus musculus
gataaaattcaacacgctaaaccgg

SEQ ID NO: 933030 - DNA, 25 bp, Mus musculus
gataaaattcaacaggctaaaccgg

SEQ ID NO: 933031 - DNA, 25 bp, Mus musculus
gataaaattgacaacgattttctac

SEQ ID NO: 933032 - DNA, 25 bp, Mus musculus
gataaaattgacaaggattttctac

SEQ ID NO: 933033 - DNA, 25 bp, Mus musculus
gataaacactatatttatgtggttc

SEQ ID NO: 933034 - DNA, 25 bp, Mus musculus
gataaacactatttttatgtggttc

SEQ ID NO: 933035 - DNA, 25 bp, Mus musculus
gataaacagctgaacgtgtgggatg

SEQ ID NO: 933036 - DNA, 25 bp, Mus musculus
gataaacagctgaaggtgtgggatg

SEQ ID NO: 933037 - DNA, 25 bp, Mus musculus
gataaactcaaggacgcagagaccc

SEQ ID NO: 933038 - DNA, 25 bp, Mus musculus
gataaactcaaggaggcagagaccc

SEQ ID NO: 933039 - DNA, 25 bp, Mus musculus
gataaagaaacgactggtatagtga

SEQ ID NO: 933040 - DNA, 25 bp, Mus musculus
gataaagaaacgtctggtatagtga

SEQ ID NO: 933041 - DNA, 25 bp, Mus musculus
gataaagaagatttaatcacttgtt

SEQ ID NO: 933042 - DNA, 25 bp, Mus musculus
gataaagaagttttaatcacttgtt

SEQ ID NO: 933043 - DNA, 25 bp, Mus musculus
gataaagacagactcgctagatggc

SEQ ID NO: 933044 - DNA, 25 bp, Mus musculus
gataaagacagactggctagatggc

SEQ ID NO: 933045 - DNA, 25 bp, Mus musculus
gataaagatgacccaggttggtctc

SEQ ID NO: 933046 - DNA, 25 bp, Mus musculus
gataaagatgacgcaggttggtctc

SEQ ID NO: 933047 - DNA, 25 bp, Mus musculus
gataaagatgtccagcttcgttatc

SEQ ID NO: 933048 - DNA, 25 bp, Mus musculus
gataaagatgtcgagcttcgttatc

SEQ ID NO: 933049 - DNA, 25 bp, Mus musculus
gataaagcagaggacactctaacac

SEQ ID NO: 933050 - DNA, 25 bp, Mus musculus
gataaagcagaggagactctaacac

SEQ ID NO: 933051 - DNA, 25 bp, Mus musculus
gataaagggtcacaaaacgcttgga

SEQ ID NO: 933052 - DNA, 25 bp, Mus musculus
gataaagggtcagaaaacgcttgga

SEQ ID NO: 933053 - DNA, 25 bp, Mus musculus
gataaagtagcacgacacagcttgg

SEQ ID NO: 933054 - DNA, 25 bp, Mus musculus
gataaagtagcaggacacagcttgg

SEQ ID NO: 933055 - DNA, 25 bp, Mus musculus
gataaagtgctaaacgactgttgtg

SEQ ID NO: 933056 - DNA, 25 bp, Mus musculus
gataaagtgctaaaggactgttgtg

SEQ ID NO: 933057 - DNA, 25 bp, Mus musculus
gataaagttcacctcctggctatta

SEQ ID NO: 933058 - DNA, 25 bp, Mus musculus
gataaagttcacgtcctggctatta

SEQ ID NO: 933059 - DNA, 25 bp, Mus musculus
gataaataagagggcaatgcgagca

SEQ ID NO: 933060 - DNA, 25 bp, Mus musculus
gataaataagtgggcaatgcgagca

SEQ ID NO: 933061 - DNA, 25 bp, Mus musculus
gataaatgagcacatagcattgttg

SEQ ID NO: 933062 - DNA, 25 bp, Mus musculus
gataaatgaggacatagcattgttg

SEQ ID NO: 933063 - DNA, 25 bp, Mus musculus
gataacacagcccatggcgcaggct

SEQ ID NO: 933064 - DNA, 25 bp, Mus musculus
gataacacagctgccttcttcacaa

SEQ ID NO: 933065 - DNA, 25 bp, Mus musculus
gataacacaggccatggcgcaggct

SEQ ID NO: 933066 - DNA, 25 bp, Mus musculus
gataacacaggtgccttcttcacaa

SEQ ID NO: 933067 - DNA, 25 bp, Mus musculus
gataacagagacaatccccttctgc

SEQ ID NO: 933068 - DNA, 25 bp, Mus musculus
gataacagagcaacccgatagcaga

SEQ ID NO: 933069 - DNA, 25 bp, Mus musculus
gataacagagcatacaagcaatgac

SEQ ID NO: 933070 - DNA, 25 bp, Mus musculus
gataacagagctgcacgaaaccacg

SEQ ID NO: 933071 - DNA, 25 bp, Mus musculus
gataacagaggaacccgatagcaga

SEQ ID NO: 933072 - DNA, 25 bp, Mus musculus
gataacagaggatacaagcaatgac

SEQ ID NO: 933073 - DNA, 25 bp, Mus musculus
gataacagaggtgcacgaaaccacg

SEQ ID NO: 933074 - DNA, 25 bp, Mus musculus
gataacagagtcaatccccttctgc

SEQ ID NO: 933075 - DNA, 25 bp, Mus musculus
gataacagtgcccacccttcttgct

SEQ ID NO: 933076 - DNA, 25 bp, Mus musculus
gataacagtggccacccttcttgct

SEQ ID NO: 933077 - DNA, 25 bp, Mus musculus
gataacatacccagagccttgccat

SEQ ID NO: 933078 - DNA, 25 bp, Mus musculus
gataacatacccagagtgtcatcaa

SEQ ID NO: 933079 - DNA, 25 bp, Mus musculus
gataacatacccagtgccttgccat

SEQ ID NO: 933080 - DNA, 25 bp, Mus musculus
gataacatacccagtgtgtcatcaa

SEQ ID NO: 933081 - DNA, 25 bp, Mus musculus
gataaccacgactctgggtccttac

SEQ ID NO: 933082 - DNA, 25 bp, Mus musculus
gataaccacgcctctgaagcgtcac

SEQ ID NO: 933083 - DNA, 25 bp, Mus musculus
gataaccacggctctgaagcgtcac

SEQ ID NO: 933084 - DNA, 25 bp, Mus musculus
gataaccacgtctctgggtccttac

SEQ ID NO: 933085 - DNA, 25 bp, Mus musculus
gataacccagaccacagggatgtgg

SEQ ID NO: 933086 - DNA, 25 bp, Mus musculus
gataacccagaccagagggatgtgg

SEQ ID NO: 933087 - DNA, 25 bp, Mus musculus
gataacccggcactgaatgcacagg

SEQ ID NO: 933088 - DNA, 25 bp, Mus musculus
gataacccgggactgaatgcacagg

SEQ ID NO: 933089 - DNA, 25 bp, Mus musculus
gataacctaactaccagcagtgctg

SEQ ID NO: 933090 - DNA, 25 bp, Mus musculus
gataacctaagtaccagcagtgctg

SEQ ID NO: 933091 - DNA, 25 bp, Mus musculus
gataacctgcagcacctatacaacc

SEQ ID NO: 933092 - DNA, 25 bp, Mus musculus
gataacctgcaggacctatacaacc

SEQ ID NO: 933093 - DNA, 25 bp, Mus musculus
gataactaaccacattgaatgtcac

SEQ ID NO: 933094 - DNA, 25 bp, Mus musculus
gataactaaccagattgaatgtcac

SEQ ID NO: 933095 - DNA, 25 bp, Mus musculus
gataactacaaacttcagctggcgg

SEQ ID NO: 933096 - DNA, 25 bp, Mus musculus
gataactacaaagttcagctggcgg

SEQ ID NO: 933097 - DNA, 25 bp, Mus musculus
gataactgggagcatgagccccaag

SEQ ID NO: 933098 - DNA, 25 bp, Mus musculus
gataactgggaggatgagccccaag

SEQ ID NO: 933099 - DNA, 25 bp, Mus musculus
gataactgggctcacgttgacccca

SEQ ID NO: 933100 - DNA, 25 bp, Mus musculus
gataactggggtcacgttgacccca

SEQ ID NO: 933101 - DNA, 25 bp, Mus musculus
gataagaaagatggcttgccagtag

SEQ ID NO: 933102 - DNA, 25 bp, Mus musculus
gataagaaagttggcttgccagtag

SEQ ID NO: 933103 - DNA, 25 bp, Mus musculus
gataagaataagattcccggagata

SEQ ID NO: 933104 - DNA, 25 bp, Mus musculus
gataagaataagtttcccggagata

SEQ ID NO: 933105 - DNA, 25 bp, Mus musculus
gataagaatgagtatgttctgggga

SEQ ID NO: 933106 - DNA, 25 bp, Mus musculus
gataagaatgtgtatgttctgggga

SEQ ID NO: 933107 - DNA, 25 bp, Mus musculus
gataagacgaagcttcttcagtggg

SEQ ID NO: 933108 - DNA, 25 bp, Mus musculus
gataagacgaaggttcttcagtggg

SEQ ID NO: 933109 - DNA, 25 bp, Mus musculus
gataagagactcctctattgcatga

SEQ ID NO: 933110 - DNA, 25 bp, Mus musculus
gataagagactcctgtattgcatga

SEQ ID NO: 933111 - DNA, 25 bp, Mus musculus
gataagagagagggaggcgaaagta

SEQ ID NO: 933112 - DNA, 25 bp, Mus musculus
gataagagagtgggaggcgaaagta

SEQ ID NO: 933113 - DNA, 25 bp, Mus musculus
gataagagatatgccagaatttcag

SEQ ID NO: 933114 - DNA, 25 bp, Mus musculus
gataagagatttgccagaatttcag

SEQ ID NO: 933115 - DNA, 25 bp, Mus musculus
gataagagcgttctctggtgcaagt

SEQ ID NO: 933116 - DNA, 25 bp, Mus musculus
gataagagcgttgtctggtgcaagt

SEQ ID NO: 933117 - DNA, 25 bp, Mus musculus
gataagatcctctccgtaaatggcc

SEQ ID NO: 933118 - DNA, 25 bp, Mus musculus
gataagatcctctcggtaaatggcc

SEQ ID NO: 933119 - DNA, 25 bp, Mus musculus
gataagattgagaacctagctagca

SEQ ID NO: 933120 - DNA, 25 bp, Mus musculus
gataagattgagtacctagctagca

SEQ ID NO: 933121 - DNA, 25 bp, Mus musculus
gataagattgttattcagaaatacc

SEQ ID NO: 933122 - DNA, 25 bp, Mus musculus
gataagattgtttttcagaaatacc

SEQ ID NO: 933123 - DNA, 25 bp, Mus musculus
gataagggaagaccgcatagataca

SEQ ID NO: 933124 - DNA, 25 bp, Mus musculus
gataagggaagagcgcatagataca

SEQ ID NO: 933125 - DNA, 25 bp, Mus musculus
gataataacccactggtaatgctag

SEQ ID NO: 933126 - DNA, 25 bp, Mus musculus
gataataacccagtggtaatgctag

SEQ ID NO: 933127 - DNA, 25 bp, Mus musculus
gataatactaagagcttcttatttc

SEQ ID NO: 933128 - DNA, 25 bp, Mus musculus
gataatactaagaggttcttatttc

SEQ ID NO: 933129 - DNA, 25 bp, Mus musculus
gataatccacagaacctgccttcag

SEQ ID NO: 933130 - DNA, 25 bp, Mus musculus
gataatccacagtacctgccttcag

SEQ ID NO: 933131 - DNA, 25 bp, Mus musculus
gataatgaaagtcaactatgagcaa

SEQ ID NO: 933132 - DNA, 25 bp, Mus musculus
gataatgaaagtgaactatgagcaa

SEQ ID NO: 933133 - DNA, 25 bp, Mus musculus
gataatgggtaacgaagtgaaagtg

SEQ ID NO: 933134 - DNA, 25 bp, Mus musculus
gataatgggtaaggaagtgaaagtg

SEQ ID NO: 933135 - DNA, 25 bp, Mus musculus
gataatgtagatcaaactgaaggct

SEQ ID NO: 933136 - DNA, 25 bp, Mus musculus
gataatgtagatcaggaagcaaggg

SEQ ID NO: 933137 - DNA, 25 bp, Mus musculus
gataatgtagatgaaactgaaggct

SEQ ID NO: 933138 - DNA, 25 bp, Mus musculus
gataatgtagatgaggaagcaaggg

SEQ ID NO: 933139 - DNA, 25 bp, Mus musculus
gataatgtgaagatgtttttatttc

SEQ ID NO: 933140 - DNA, 25 bp, Mus musculus
gataatgtgaagttgtttttatttc

SEQ ID NO: 933141 - DNA, 25 bp, Mus musculus
gataattcagagctcagaaataccc

SEQ ID NO: 933142 - DNA, 25 bp, Mus musculus
gataattcagaggtcagaaataccc

SEQ ID NO: 933143 - DNA, 25 bp, Mus musculus
gataattccaatcatgttgcaaaat

SEQ ID NO: 933144 - DNA, 25 bp, Mus musculus
gataattccaatgatgttgcaaaat

SEQ ID NO: 933145 - DNA, 25 bp, Mus musculus
gataattgataacgagccaagcatt

SEQ ID NO: 933146 - DNA, 25 bp, Mus musculus
gataattgataaggagccaagcatt

SEQ ID NO: 933147 - DNA, 25 bp, Mus musculus
gatacaatagcaaacctgtccagtt

SEQ ID NO: 933148 - DNA, 25 bp, Mus musculus
gatacaataggaaacctgtccagtt

SEQ ID NO: 933149 - DNA, 25 bp, Mus musculus
gatacacagagaacaaaggctcctt

SEQ ID NO: 933150 - DNA, 25 bp, Mus musculus
gatacacagagaagtatagaagaag

SEQ ID NO: 933151 - DNA, 25 bp, Mus musculus
gatacacagagatcaaaggctcctt

SEQ ID NO: 933152 - DNA, 25 bp, Mus musculus
gatacacagagatgtatagaagaag

SEQ ID NO: 933153 - DNA, 25 bp, Mus musculus
gatacactataacgtttgctatgcg

SEQ ID NO: 933154 - DNA, 25 bp, Mus musculus
gatacactataaggtttgctatgcg

SEQ ID NO: 933155 - DNA, 25 bp, Mus musculus
gatacaggccagacattgttggatt

SEQ ID NO: 933156 - DNA, 25 bp, Mus musculus
gatacaggccagactttgttggatt

SEQ ID NO: 933157 - DNA, 25 bp, Mus musculus
gataccaaaaatagcgaccagttcg

SEQ ID NO: 933158 - DNA, 25 bp, Mus musculus
gataccaaaaattgcgaccagttcg

SEQ ID NO: 933159 - DNA, 25 bp, Mus musculus
gataccaagccatgctacactgtgg

SEQ ID NO: 933160 - DNA, 25 bp, Mus musculus
gataccaagccatggtacactgtgg

SEQ ID NO: 933161 - DNA, 25 bp, Mus musculus
gataccaagtctgtcgtttgtccca

SEQ ID NO: 933162 - DNA, 25 bp, Mus musculus
gataccaagtctgtggtttgtccca

SEQ ID NO: 933163 - DNA, 25 bp, Mus musculus
gataccacagccaccttcaagatcc

SEQ ID NO: 933164 - DNA, 25 bp, Mus musculus
gataccacaggcaccttcaagatcc

SEQ ID NO: 933165 - DNA, 25 bp, Mus musculus
gataccagccctcgtggctgcaata

SEQ ID NO: 933166 - DNA, 25 bp, Mus musculus
gataccagccctggtggctgcaata

SEQ ID NO: 933167 - DNA, 25 bp, Mus musculus
gatacccaagcgcacagatgtcatc

SEQ ID NO: 933168 - DNA, 25 bp, Mus musculus
gatacccaagggcacagatgtcatc

SEQ ID NO: 933169 - DNA, 25 bp, Mus musculus
gatacccatgcaagtatttaaagaa

SEQ ID NO: 933170 - DNA, 25 bp, Mus musculus
gatacccatggaagtatttaaagaa

SEQ ID NO: 933171 - DNA, 25 bp, Mus musculus
gataccgcaaagagcaacaggtgat

SEQ ID NO: 933172 - DNA, 25 bp, Mus musculus
gataccgcaaagtgcaacaggtgat

SEQ ID NO: 933173 - DNA, 25 bp, Mus musculus
gatacctggggaaacgagtgctgaa

SEQ ID NO: 933174 - DNA, 25 bp, Mus musculus
gatacctggggaaaggagtgctgaa

SEQ ID NO: 933175 - DNA, 25 bp, Mus musculus
gataccttccagctgtgaaccccaa

SEQ ID NO: 933176 - DNA, 25 bp, Mus musculus
gataccttccaggtgtgaaccccaa

SEQ ID NO: 933177 - DNA, 25 bp, Mus musculus
gatacgaacgtgcatgaggctgtag

SEQ ID NO: 933178 - DNA, 25 bp, Mus musculus
gatacgaacgtggatgaggctgtag

SEQ ID NO: 933179 - DNA, 25 bp, Mus musculus
gatacgagcaatcatttccatgtgt

SEQ ID NO: 933180 - DNA, 25 bp, Mus musculus
gatacgagcactagtaccgttgtca

SEQ ID NO: 933181 - DNA, 25 bp, Mus musculus
gatacgagcagtagtaccgttgtca

SEQ ID NO: 933182 - DNA, 25 bp, Mus musculus
gatacgagcattcatttccatgtgt

SEQ ID NO: 933183 - DNA, 25 bp, Mus musculus
gatacggagttatacgtatcagaag

SEQ ID NO: 933184 - DNA, 25 bp, Mus musculus
gatacggagttataggtatcagaag

SEQ ID NO: 933185 - DNA, 25 bp, Mus musculus
gatactaaagagtcttgtcctgttt

SEQ ID NO: 933186 - DNA, 25 bp, Mus musculus
gatactaaagtgtcttgtcctgttt

SEQ ID NO: 933187 - DNA, 25 bp, Mus musculus
gatactcataagaatggctatgctc

SEQ ID NO: 933188 - DNA, 25 bp, Mus musculus
gatactcataagtatggctatgctc

SEQ ID NO: 933189 - DNA, 25 bp, Mus musculus
gatactgcagcgcaagaggattatg

SEQ ID NO: 933190 - DNA, 25 bp, Mus musculus
gatactgcagggcaagaggattatg

SEQ ID NO: 933191 - DNA, 25 bp, Mus musculus
gatactggagcttgcctctccacct

SEQ ID NO: 933192 - DNA, 25 bp, Mus musculus
gatactggaggttgcctctccacct

SEQ ID NO: 933193 - DNA, 25 bp, Mus musculus
gatactggtgccatttcccccacag

SEQ ID NO: 933194 - DNA, 25 bp, Mus musculus
gatactggtgccttttcccccacag

SEQ ID NO: 933195 - DNA, 25 bp, Mus musculus
gatacttcagagagggggataaggt

SEQ ID NO: 933196 - DNA, 25 bp, Mus musculus
gatacttcagtgagggggataaggt

SEQ ID NO: 933197 - DNA, 25 bp, Mus musculus
gatacttccaatcacttccatgtgt

SEQ ID NO: 933198 - DNA, 25 bp, Mus musculus
gatacttccattcacttccatgtgt

SEQ ID NO: 933199 - DNA, 25 bp, Mus musculus
gatacttctgagagtgcaaagagct

SEQ ID NO: 933200 - DNA, 25 bp, Mus musculus
gatacttctgtgagtgcaaagagct

SEQ ID NO: 933201 - DNA, 25 bp, Mus musculus
gatacttgcaagcgtgactcaggag

SEQ ID NO: 933202 - DNA, 25 bp, Mus musculus
gatacttgcaagggtgactcaggag

SEQ ID NO: 933203 - DNA, 25 bp, Mus musculus
gatagaaaaatacatatcgatttac

SEQ ID NO: 933204 - DNA, 25 bp, Mus musculus
gatagaaaaatagatatcgatttac

SEQ ID NO: 933205 - DNA, 25 bp, Mus musculus
gatagaaccataaacgtgtggaaca

SEQ ID NO: 933206 - DNA, 25 bp, Mus musculus
gatagaaccataaaggtgtggaaca

SEQ ID NO: 933207 - DNA, 25 bp, Mus musculus
gatagaagtgctcacgacaacatca

SEQ ID NO: 933208 - DNA, 25 bp, Mus musculus
gatagaagtgctcaggacaacatca

SEQ ID NO: 933209 - DNA, 25 bp, Mus musculus
gatagagacacaggtggccagtgag

SEQ ID NO: 933210 - DNA, 25 bp, Mus musculus
gatagagacagaggtggccagtgag

SEQ ID NO: 933211 - DNA, 25 bp, Mus musculus
gatagagcggcgaaaaatggagtat

SEQ ID NO: 933212 - DNA, 25 bp, Mus musculus
gatagagcggggaaaaatggagtat

SEQ ID NO: 933213 - DNA, 25 bp, Mus musculus
gatagaggacaacgcccagatcttg

SEQ ID NO: 933214 - DNA, 25 bp, Mus musculus
gatagaggacaaggcccagatcttg

SEQ ID NO: 933215 - DNA, 25 bp, Mus musculus
gatagagttgcaacatctcggatca

SEQ ID NO: 933216 - DNA, 25 bp, Mus musculus
gatagagttggaacatctcggatca

SEQ ID NO: 933217 - DNA, 25 bp, Mus musculus
gatagataataaaacagagtctgtt

SEQ ID NO: 933218 - DNA, 25 bp, Mus musculus
gatagataataaaagagagtctgtt

SEQ ID NO: 933219 - DNA, 25 bp, Mus musculus
gatagatccccacagactttgcaat

SEQ ID NO: 933220 - DNA, 25 bp, Mus musculus
gatagatccccagagactttgcaat

SEQ ID NO: 933221 - DNA, 25 bp, Mus musculus
gatagcaaggagaaagaaaagtcaa

SEQ ID NO: 933222 - DNA, 25 bp, Mus musculus
gatagcaaggagcgattttgaactt

SEQ ID NO: 933223 - DNA, 25 bp, Mus musculus
gatagcaaggagggattttgaactt

SEQ ID NO: 933224 - DNA, 25 bp, Mus musculus
gatagcaaggagtaagaaaagtcaa

SEQ ID NO: 933225 - DNA, 25 bp, Mus musculus
gatagcagcttgcgtcttgacgaag

SEQ ID NO: 933226 - DNA, 25 bp, Mus musculus
gatagcagcttgggtcttgacgaag

SEQ ID NO: 933227 - DNA, 25 bp, Mus musculus
gatagcccagcacatgatgccagaa

SEQ ID NO: 933228 - DNA, 25 bp, Mus musculus
gatagcccagcagatgatgccagaa

SEQ ID NO: 933229 - DNA, 25 bp, Mus musculus
gatagcgctgctctcctagatcctg

SEQ ID NO: 933230 - DNA, 25 bp, Mus musculus
gatagcgctggtctcctagatcctg

SEQ ID NO: 933231 - DNA, 25 bp, Mus musculus
gatagctcagcttttagatctgtgc

SEQ ID NO: 933232 - DNA, 25 bp, Mus musculus
gatagctcaggttttagatctgtgc

SEQ ID NO: 933233 - DNA, 25 bp, Mus musculus
gatagctgagcaggaggctaaggcc

SEQ ID NO: 933234 - DNA, 25 bp, Mus musculus
gatagctgaggaggaggctaaggcc

SEQ ID NO: 933235 - DNA, 25 bp, Mus musculus
gataggaaaaccatatatatttagc

SEQ ID NO: 933236 - DNA, 25 bp, Mus musculus
gataggaaaagcatatatatttagc

SEQ ID NO: 933237 - DNA, 25 bp, Mus musculus
gataggaagtatgaacatcatctca

SEQ ID NO: 933238 - DNA, 25 bp, Mus musculus
gataggaagtttgaacatcatctca

SEQ ID NO: 933239 - DNA, 25 bp, Mus musculus
gataggaggcaccctgctatgtgga

SEQ ID NO: 933240 - DNA, 25 bp, Mus musculus
gataggaggctccctgctatgtgga

SEQ ID NO: 933241 - DNA, 25 bp, Mus musculus
gatagtaagaaacttcgagctgcaa

SEQ ID NO: 933242 - DNA, 25 bp, Mus musculus
gatagtaagaaagttcgagctgcaa

SEQ ID NO: 933243 - DNA, 25 bp, Mus musculus
gatagtagaaacacagataaatttc

SEQ ID NO: 933244 - DNA, 25 bp, Mus musculus
gatagtagaatcacagataaatttc

SEQ ID NO: 933245 - DNA, 25 bp, Mus musculus
gatagtgctgaaccggcatctgaac

SEQ ID NO: 933246 - DNA, 25 bp, Mus musculus
gatagtgctgaagcggcatctgaac

SEQ ID NO: 933247 - DNA, 25 bp, Mus musculus
gatataaaatcaatggcagggaata

SEQ ID NO: 933248 - DNA, 25 bp, Mus musculus
gatataaaatgaatggcagggaata

SEQ ID NO: 933249 - DNA, 25 bp, Mus musculus
gatataatgagacaaacactggaac

SEQ ID NO: 933250 - DNA, 25 bp, Mus musculus
gatataatgagacatacactggaac

SEQ ID NO: 933251 - DNA, 25 bp, Mus musculus
gatataatggacagccgatgcactg

SEQ ID NO: 933252 - DNA, 25 bp, Mus musculus
gatataatggtcagccgatgcactg

SEQ ID NO: 933253 - DNA, 25 bp, Mus musculus
gatatacataggcccttcaagaggg

SEQ ID NO: 933254 - DNA, 25 bp, Mus musculus
gatatacatagggccttcaagaggg

SEQ ID NO: 933255 - DNA, 25 bp, Mus musculus
gatataccagaagtctacaaccctg

SEQ ID NO: 933256 - DNA, 25 bp, Mus musculus
gatataccagtagtctacaaccctg

SEQ ID NO: 933257 - DNA, 25 bp, Mus musculus
gatatactcaaacggcagcacatga

SEQ ID NO: 933258 - DNA, 25 bp, Mus musculus
gatatactcaaacgtgttggggcca

SEQ ID NO: 933259 - DNA, 25 bp, Mus musculus
gatatactcaaagggcagcacatga

SEQ ID NO: 933260 - DNA, 25 bp, Mus musculus
gatatactcaaaggtgttggggcca

SEQ ID NO: 933261 - DNA, 25 bp, Mus musculus
gatatagctcgccacggcgaagatt

SEQ ID NO: 933262 - DNA, 25 bp, Mus musculus
gatatagctcgccagggcgaagatt

SEQ ID NO: 933263 - DNA, 25 bp, Mus musculus
gatatagtcatgctggatgaaagcc

SEQ ID NO: 933264 - DNA, 25 bp, Mus musculus
gatatagtcatggtggatgaaagcc

SEQ ID NO: 933265 - DNA, 25 bp, Mus musculus
gatatatcacacaaaaattccagag

SEQ ID NO: 933266 - DNA, 25 bp, Mus musculus
gatatatcacacaaagacccacagt

SEQ ID NO: 933267 - DNA, 25 bp, Mus musculus
gatatatcacacaataattccagag

SEQ ID NO: 933268 - DNA, 25 bp, Mus musculus
gatatatcacacaatgacccacagt

SEQ ID NO: 933269 - DNA, 25 bp, Mus musculus
gatatatttgagcaacaggacatta

SEQ ID NO: 933270 - DNA, 25 bp, Mus musculus
gatatatttgtgcaacaggacatta

SEQ ID NO: 933271 - DNA, 25 bp, Mus musculus
gatatatttttacacggaggagcct

SEQ ID NO: 933272 - DNA, 25 bp, Mus musculus
gatatatttttacagggaggagcct

SEQ ID NO: 933273 - DNA, 25 bp, Mus musculus
gatatcaaaaagcgaatcttacttc

SEQ ID NO: 933274 - DNA, 25 bp, Mus musculus
gatatcaaaaagggaatcttacttc

SEQ ID NO: 933275 - DNA, 25 bp, Mus musculus
gatatcaaaccaccatttggcacca

SEQ ID NO: 933276 - DNA, 25 bp, Mus musculus
gatatcaaaccacttggcaccaacc

SEQ ID NO: 933277 - DNA, 25 bp, Mus musculus
gatatcaaaccagcatttggcacca

SEQ ID NO: 933278 - DNA, 25 bp, Mus musculus
gatatcaaaccagttggcaccaacc

SEQ ID NO: 933279 - DNA, 25 bp, Mus musculus
gatatcaaagctgccaacgtgctgc

SEQ ID NO: 933280 - DNA, 25 bp, Mus musculus
gatatcaaaggtgccaacgtgctgc

SEQ ID NO: 933281 - DNA, 25 bp, Mus musculus
gatatcaacaagcttgtgctgtgtg

SEQ ID NO: 933282 - DNA, 25 bp, Mus musculus
gatatcaacaaggttgtgctgtgtg

SEQ ID NO: 933283 - DNA, 25 bp, Mus musculus
gatatcacaaatgttaactcattcc

SEQ ID NO: 933284 - DNA, 25 bp, Mus musculus
gatatcacaattgttaactcattcc

SEQ ID NO: 933285 - DNA, 25 bp, Mus musculus
gatatcactgacatgaccaatgccc

SEQ ID NO: 933286 - DNA, 25 bp, Mus musculus
gatatcactgacttgaccaatgccc

SEQ ID NO: 933287 - DNA, 25 bp, Mus musculus
gatatcagcccacctgccctccctg

SEQ ID NO: 933288 - DNA, 25 bp, Mus musculus
gatatcagcccagctgccctccctg

SEQ ID NO: 933289 - DNA, 25 bp, Mus musculus
gatatccggtgtaacgatgatgaat

SEQ ID NO: 933290 - DNA, 25 bp, Mus musculus
gatatccggtgtaaggatgatgaat

SEQ ID NO: 933291 - DNA, 25 bp, Mus musculus
gatatccgtggactgggtcacgcca

SEQ ID NO: 933292 - DNA, 25 bp, Mus musculus
gatatccgtggagtgggtcacgcca

SEQ ID NO: 933293 - DNA, 25 bp, Mus musculus
gatatccttaagcatcggggcttct

SEQ ID NO: 933294 - DNA, 25 bp, Mus musculus
gatatccttaaggatcggggcttct

SEQ ID NO: 933295 - DNA, 25 bp, Mus musculus
gatatcgatgcccgccctgtcaaag

SEQ ID NO: 933296 - DNA, 25 bp, Mus musculus
gatatcgatggccgccctgtcaaag

SEQ ID NO: 933297 - DNA, 25 bp, Mus musculus
gatatcgccaggatcatcccagcta

SEQ ID NO: 933298 - DNA, 25 bp, Mus musculus
gatatcgccaggatgatcccagcta

SEQ ID NO: 933299 - DNA, 25 bp, Mus musculus
gatatcgtgaagcttatcaagaaaa

SEQ ID NO: 933300 - DNA, 25 bp, Mus musculus
gatatcgtgaaggttatcaagaaaa

SEQ ID NO: 933301 - DNA, 25 bp, Mus musculus
gatatctcttagcaaagatggtcca

SEQ ID NO: 933302 - DNA, 25 bp, Mus musculus
gatatctcttagcaggaaagatggt

SEQ ID NO: 933303 - DNA, 25 bp, Mus musculus
gatatctcttaggaaagatggtcca

SEQ ID NO: 933304 - DNA, 25 bp, Mus musculus
gatatctcttaggaggaaagatggt

SEQ ID NO: 933305 - DNA, 25 bp, Mus musculus
gatatgacagaactctgcgtggtgg

SEQ ID NO: 933306 - DNA, 25 bp, Mus musculus
gatatgacagaagtctgcgtggtgg

SEQ ID NO: 933307 - DNA, 25 bp, Mus musculus
gatatgacgatgccaagcggtactg

SEQ ID NO: 933308 - DNA, 25 bp, Mus musculus
gatatgacgatggcaagcggtactg

SEQ ID NO: 933309 - DNA, 25 bp, Mus musculus
gatatgagcaaacgtatgcagagat

SEQ ID NO: 933310 - DNA, 25 bp, Mus musculus
gatatgagcaaaggtatgcagagat

SEQ ID NO: 933311 - DNA, 25 bp, Mus musculus
gatatgagcatccactgtatccaga

SEQ ID NO: 933312 - DNA, 25 bp, Mus musculus
gatatgagcatccagtgtatccaga

SEQ ID NO: 933313 - DNA, 25 bp, Mus musculus
gatatgatcaacgaagcaatggcac

SEQ ID NO: 933314 - DNA, 25 bp, Mus musculus
gatatgatcaacgatgcaatggcac

SEQ ID NO: 933315 - DNA, 25 bp, Mus musculus
gatatgatggatgagatggatagtc

SEQ ID NO: 933316 - DNA, 25 bp, Mus musculus
gatatgatggttgagatggatagtc

SEQ ID NO: 933317 - DNA, 25 bp, Mus musculus
gatatgattccacatgcacgccatc

SEQ ID NO: 933318 - DNA, 25 bp, Mus musculus
gatatgattccacgctactagtcag

SEQ ID NO: 933319 - DNA, 25 bp, Mus musculus
gatatgattccagatgcacgccatc

SEQ ID NO: 933320 - DNA, 25 bp, Mus musculus
gatatgattccaggctactagtcag

SEQ ID NO: 933321 - DNA, 25 bp, Mus musculus
gatatggaagctgtctggaaagaag

SEQ ID NO: 933322 - DNA, 25 bp, Mus musculus
gatatggaagctgtgtggaaagaag

SEQ ID NO: 933323 - DNA, 25 bp, Mus musculus
gatatggacaggcgatagcccacct

SEQ ID NO: 933324 - DNA, 25 bp, Mus musculus
gatatggacaggggatagcccacct

SEQ ID NO: 933325 - DNA, 25 bp, Mus musculus
gatatggcagatcgctgaaaatatt

SEQ ID NO: 933326 - DNA, 25 bp, Mus musculus
gatatggcagatggctgaaaatatt

SEQ ID NO: 933327 - DNA, 25 bp, Mus musculus
gatatggtcaaggccgagccagatg

SEQ ID NO: 933328 - DNA, 25 bp, Mus musculus
gatatggtcaaggcggagccagatg

SEQ ID NO: 933329 - DNA, 25 bp, Mus musculus
gatatgtcagaggacgtggagccta

SEQ ID NO: 933330 - DNA, 25 bp, Mus musculus
gatatgtcagaggaggtggagccta

SEQ ID NO: 933331 - DNA, 25 bp, Mus musculus
gatattacagattgctatgcagaac

SEQ ID NO: 933332 - DNA, 25 bp, Mus musculus
gatattacagtttgctatgcagaac

SEQ ID NO: 933333 - DNA, 25 bp, Mus musculus
gatattagaaatgctacaaagctca

SEQ ID NO: 933334 - DNA, 25 bp, Mus musculus
gatattagaattgctacaaagctca

SEQ ID NO: 933335 - DNA, 25 bp, Mus musculus
gatattattcctcgaggtgtcccaa

SEQ ID NO: 933336 - DNA, 25 bp, Mus musculus
gatattattcctggaggtgtcccaa

SEQ ID NO: 933337 - DNA, 25 bp, Mus musculus
gatattcaagcaacagcgtctgttg

SEQ ID NO: 933338 - DNA, 25 bp, Mus musculus
gatattcaagcgtctgttgcggttg

SEQ ID NO: 933339 - DNA, 25 bp, Mus musculus
gatattcaaggaacagcgtctgttg

SEQ ID NO: 933340 - DNA, 25 bp, Mus musculus
gatattcaagggtctgttgcggttg

SEQ ID NO: 933341 - DNA, 25 bp, Mus musculus
gatattgccaaacttaaagggcatt

SEQ ID NO: 933342 - DNA, 25 bp, Mus musculus
gatattgccatacttaaagggcatt

SEQ ID NO: 933343 - DNA, 25 bp, Mus musculus
gatatttaccttctttaccattaat

SEQ ID NO: 933344 - DNA, 25 bp, Mus musculus
gatatttaccttgtttaccattaat

SEQ ID NO: 933345 - DNA, 25 bp, Mus musculus
gatatttctctgcacgattacattg

SEQ ID NO: 933346 - DNA, 25 bp, Mus musculus
gatatttctctgcaggattacattg

SEQ ID NO: 933347 - DNA, 25 bp, Mus musculus
gatatttctgagcctgttatccaga

SEQ ID NO: 933348 - DNA, 25 bp, Mus musculus
gatatttctgaggctgttatccaga

SEQ ID NO: 933349 - DNA, 25 bp, Mus musculus
gatatttctgcttcttggaacaccg

SEQ ID NO: 933350 - DNA, 25 bp, Mus musculus
gatatttctggttcttggaacaccg

SEQ ID NO: 933351 - DNA, 25 bp, Mus musculus
gatatttgtggaaacaatgtacaga

SEQ ID NO: 933352 - DNA, 25 bp, Mus musculus
gatatttgtggaaagaatgtacaga

SEQ ID NO: 933353 - DNA, 25 bp, Mus musculus
gatattttagttaacggagtggatg

SEQ ID NO: 933354 - DNA, 25 bp, Mus musculus
gatattttagttaagggagtggatg

SEQ ID NO: 933355 - DNA, 25 bp, Mus musculus
gatcaaaaaagccacgcctctgatc

SEQ ID NO: 933356 - DNA, 25 bp, Mus musculus
gatcaaaaaagccaggcctctgatc

SEQ ID NO: 933357 - DNA, 25 bp, Mus musculus
gatcaaaagctgcctggtatgattg

SEQ ID NO: 933358 - DNA, 25 bp, Mus musculus
gatcaaaagctggctggtatgattg

SEQ ID NO: 933359 - DNA, 25 bp, Mus musculus
gatcaaaatgcctcgcgctgtatgt

SEQ ID NO: 933360 - DNA, 25 bp, Mus musculus
gatcaaaatggctcgcgctgtatgt

SEQ ID NO: 933361 - DNA, 25 bp, Mus musculus
gatcaaacatatcctgagaaatcca

SEQ ID NO: 933362 - DNA, 25 bp, Mus musculus
gatcaaacatatcgcacttcttgga

SEQ ID NO: 933363 - DNA, 25 bp, Mus musculus
gatcaaacatatgctgagaaatcca

SEQ ID NO: 933364 - DNA, 25 bp, Mus musculus
gatcaaacatatggcacttcttgga

SEQ ID NO: 933365 - DNA, 25 bp, Mus musculus
gatcaaagcctgcgacgtatgtgat

SEQ ID NO: 933366 - DNA, 25 bp, Mus musculus
gatcaaagcctgggacgtatgtgat

SEQ ID NO: 933367 - DNA, 25 bp, Mus musculus
gatcaaatgcatcaaggctgccatc

SEQ ID NO: 933368 - DNA, 25 bp, Mus musculus
gatcaaatgcatcatggctgccatc

SEQ ID NO: 933369 - DNA, 25 bp, Mus musculus
gatcaacaagcaattcctcgatgat

SEQ ID NO: 933370 - DNA, 25 bp, Mus musculus
gatcaacaaggaattcctcgatgat

SEQ ID NO: 933371 - DNA, 25 bp, Mus musculus
gatcaacagcccatacccatgatgg

SEQ ID NO: 933372 - DNA, 25 bp, Mus musculus
gatcaacagcccattcccatgatgg

SEQ ID NO: 933373 - DNA, 25 bp, Mus musculus
gatcaacctgatggactttgaccct

SEQ ID NO: 933374 - DNA, 25 bp, Mus musculus
gatcaacctgatggtctttgaccct

SEQ ID NO: 933375 - DNA, 25 bp, Mus musculus
gatcaacgaaccaatggcaccattg

SEQ ID NO: 933376 - DNA, 25 bp, Mus musculus
gatcaacgaagcaatggcaccattg

SEQ ID NO: 933377 - DNA, 25 bp, Mus musculus
gatcaacgggacaaatgggcctgct

SEQ ID NO: 933378 - DNA, 25 bp, Mus musculus
gatcaacgggactaatgggcctgct

SEQ ID NO: 933379 - DNA, 25 bp, Mus musculus
gatcaactcaataaagccgttgtga

SEQ ID NO: 933380 - DNA, 25 bp, Mus musculus
gatcaactcacccggctcaacatta

SEQ ID NO: 933381 - DNA, 25 bp, Mus musculus
gatcaactcagccggctcaacatta

SEQ ID NO: 933382 - DNA, 25 bp, Mus musculus
gatcaactcattaaagccgttgtga

SEQ ID NO: 933383 - DNA, 25 bp, Mus musculus
gatcaagaccagcccctggctttgg

SEQ ID NO: 933384 - DNA, 25 bp, Mus musculus
gatcaagaccaggccctggctttgg

SEQ ID NO: 933385 - DNA, 25 bp, Mus musculus
gatcaagagcaacgtcaacaagcat

SEQ ID NO: 933386 - DNA, 25 bp, Mus musculus
gatcaagagcaaggtcaacaagcat

SEQ ID NO: 933387 - DNA, 25 bp, Mus musculus
gatcaaggaaccttctgtggatgag

SEQ ID NO: 933388 - DNA, 25 bp, Mus musculus
gatcaaggaagcttctgtggatgag

SEQ ID NO: 933389 - DNA, 25 bp, Mus musculus
gatcaaggacctccaggacctcagg

SEQ ID NO: 933390 - DNA, 25 bp, Mus musculus
gatcaaggacctcctggacctcagg

SEQ ID NO: 933391 - DNA, 25 bp, Mus musculus
gatcaaggagacctggggtctgcaa

SEQ ID NO: 933392 - DNA, 25 bp, Mus musculus
gatcaaggagccaggctttccccct

SEQ ID NO: 933393 - DNA, 25 bp, Mus musculus
gatcaaggaggcaggctttccccct

SEQ ID NO: 933394 - DNA, 25 bp, Mus musculus
gatcaaggagtcctggggtctgcaa

SEQ ID NO: 933395 - DNA, 25 bp, Mus musculus
gatcaataaacaagagatgatcttc

SEQ ID NO: 933396 - DNA, 25 bp, Mus musculus
gatcaataaagaagagatgatcttc

SEQ ID NO: 933397 - DNA, 25 bp, Mus musculus
gatcaatgctctgttctattactca

SEQ ID NO: 933398 - DNA, 25 bp, Mus musculus
gatcaatgctgtgttctattactca

SEQ ID NO: 933399 - DNA, 25 bp, Mus musculus
gatcaatgttaacggatcgcttaca

SEQ ID NO: 933400 - DNA, 25 bp, Mus musculus
gatcaatgttaagggatcgcttaca

SEQ ID NO: 933401 - DNA, 25 bp, Mus musculus
gatcacactgcatgcagcctaccac

SEQ ID NO: 933402 - DNA, 25 bp, Mus musculus
gatcacactggatgcagcctaccac

SEQ ID NO: 933403 - DNA, 25 bp, Mus musculus
gatcacagctatcactggtgatggt

SEQ ID NO: 933404 - DNA, 25 bp, Mus musculus
gatcacagctatgactggtgatggt

SEQ ID NO: 933405 - DNA, 25 bp, Mus musculus
gatcacagctgccacgttatagtaa

SEQ ID NO: 933406 - DNA, 25 bp, Mus musculus
gatcacagctgccaggttatagtaa

SEQ ID NO: 933407 - DNA, 25 bp, Mus musculus
gatcacatggagggcctagagcatg

SEQ ID NO: 933408 - DNA, 25 bp, Mus musculus
gatcacatggtgggcctagagcatg

SEQ ID NO: 933409 - DNA, 25 bp, Mus musculus
gatcaccaccaacgacttgaaggag

SEQ ID NO: 933410 - DNA, 25 bp, Mus musculus
gatcaccaccaaggacttgaaggag

SEQ ID NO: 933411 - DNA, 25 bp, Mus musculus
gatcaccattcacctctttgttgct

SEQ ID NO: 933412 - DNA, 25 bp, Mus musculus
gatcaccattcagctctttgttgct

SEQ ID NO: 933413 - DNA, 25 bp, Mus musculus
gatcacccacgaccagcctcaaagc

SEQ ID NO: 933414 - DNA, 25 bp, Mus musculus
gatcacccacgaccctcaaagccct

SEQ ID NO: 933415 - DNA, 25 bp, Mus musculus
gatcacccacgagcagcctcaaagc

SEQ ID NO: 933416 - DNA, 25 bp, Mus musculus
gatcacccacgagcctcaaagccct

SEQ ID NO: 933417 - DNA, 25 bp, Mus musculus
gatcacccagatgttttggagaatc

SEQ ID NO: 933418 - DNA, 25 bp, Mus musculus
gatcacccagttgttttggagaatc

SEQ ID NO: 933419 - DNA, 25 bp, Mus musculus
gatcacccttcttactgggtcctgt

SEQ ID NO: 933420 - DNA, 25 bp, Mus musculus
gatcacccttcttagtgggtcctgt

SEQ ID NO: 933421 - DNA, 25 bp, Mus musculus
gatcaccgtgtgcacgttctctgtg

SEQ ID NO: 933422 - DNA, 25 bp, Mus musculus
gatcaccgtgtgcaggttctctgtg

SEQ ID NO: 933423 - DNA, 25 bp, Mus musculus
gatcacgattacttcgtgtccctta

SEQ ID NO: 933424 - DNA, 25 bp, Mus musculus
gatcacgattacttggtgtccctta

SEQ ID NO: 933425 - DNA, 25 bp, Mus musculus
gatcacggatgacatggcagagcac

SEQ ID NO: 933426 - DNA, 25 bp, Mus musculus
gatcacggatgagatggcagagcac

SEQ ID NO: 933427 - DNA, 25 bp, Mus musculus
gatcacggcctaccctggatgagcg

SEQ ID NO: 933428 - DNA, 25 bp, Mus musculus
gatcacggcctagcctggatgagcg

SEQ ID NO: 933429 - DNA, 25 bp, Mus musculus
gatcactcaggacaagccctcgaag

SEQ ID NO: 933430 - DNA, 25 bp, Mus musculus
gatcactcaggacgttctgacggga

SEQ ID NO: 933431 - DNA, 25 bp, Mus musculus
gatcactcaggagaagccctcgaag

SEQ ID NO: 933432 - DNA, 25 bp, Mus musculus
gatcactcaggaggttctgacggga

SEQ ID NO: 933433 - DNA, 25 bp, Mus musculus
gatcacttaacacgtgtgggcaata

SEQ ID NO: 933434 - DNA, 25 bp, Mus musculus
gatcacttaacaggtgtgggcaata

SEQ ID NO: 933435 - DNA, 25 bp, Mus musculus
gatcagaaagacaacaaaacagaaa

SEQ ID NO: 933436 - DNA, 25 bp, Mus musculus
gatcagaaagacaagaaaacagaaa

SEQ ID NO: 933437 - DNA, 25 bp, Mus musculus
gatcagaaagcattacaccagcgga

SEQ ID NO: 933438 - DNA, 25 bp, Mus musculus
gatcagaaagccagtttgtgcactt

SEQ ID NO: 933439 - DNA, 25 bp, Mus musculus
gatcagaaagcctaggacctgcctt

SEQ ID NO: 933440 - DNA, 25 bp, Mus musculus
gatcagaaagcgtgtgtgggatgac

SEQ ID NO: 933441 - DNA, 25 bp, Mus musculus
gatcagaaaggattacaccagcgga

SEQ ID NO: 933442 - DNA, 25 bp, Mus musculus
gatcagaaaggcagtttgtgcactt

SEQ ID NO: 933443 - DNA, 25 bp, Mus musculus
gatcagaaaggctaggacctgcctt

SEQ ID NO: 933444 - DNA, 25 bp, Mus musculus
gatcagaaagggtgtgtgggatgac

SEQ ID NO: 933445 - DNA, 25 bp, Mus musculus
gatcagaatcaaaacgtggcagatg

SEQ ID NO: 933446 - DNA, 25 bp, Mus musculus
gatcagaatcaaaaggtggcagatg

SEQ ID NO: 933447 - DNA, 25 bp, Mus musculus
gatcagaccacacgttctcccctat

SEQ ID NO: 933448 - DNA, 25 bp, Mus musculus
gatcagaccacacgtttgtccagag

SEQ ID NO: 933449 - DNA, 25 bp, Mus musculus
gatcagaccacaggttctcccctat

SEQ ID NO: 933450 - DNA, 25 bp, Mus musculus
gatcagaccacaggtttgtccagag

SEQ ID NO: 933451 - DNA, 25 bp, Mus musculus
gatcagacccagcctcttgccatca

SEQ ID NO: 933452 - DNA, 25 bp, Mus musculus
gatcagacccaggctcttgccatca

SEQ ID NO: 933453 - DNA, 25 bp, Mus musculus
gatcagaggaatggcgtactcagtt

SEQ ID NO: 933454 - DNA, 25 bp, Mus musculus
gatcagaggaatggggtactcagtt

SEQ ID NO: 933455 - DNA, 25 bp, Mus musculus
gatcagattgattccctgtctacaa

SEQ ID NO: 933456 - DNA, 25 bp, Mus musculus
gatcagattgattcgctgtctacaa

SEQ ID NO: 933457 - DNA, 25 bp, Mus musculus
gatcagcaggtaataagtgaaatgg

SEQ ID NO: 933458 - DNA, 25 bp, Mus musculus
gatcagcaggtaattagtgaaatgg

SEQ ID NO: 933459 - DNA, 25 bp, Mus musculus
gatcagccagattttggatttggta

SEQ ID NO: 933460 - DNA, 25 bp, Mus musculus
gatcagccagtttttggatttggta

SEQ ID NO: 933461 - DNA, 25 bp, Mus musculus
gatcagccctcccacttatgcccgc

SEQ ID NO: 933462 - DNA, 25 bp, Mus musculus
gatcagccctcccagttatgcccgc

SEQ ID NO: 933463 - DNA, 25 bp, Mus musculus
gatcagcctgccctttagtaaaaaa

SEQ ID NO: 933464 - DNA, 25 bp, Mus musculus
gatcagcctggcctttagtaaaaaa

SEQ ID NO: 933465 - DNA, 25 bp, Mus musculus
gatcagcgtgcgagctccgctttgg

SEQ ID NO: 933466 - DNA, 25 bp, Mus musculus
gatcagcgtgggagctccgctttgg

SEQ ID NO: 933467 - DNA, 25 bp, Mus musculus
gatcagcttcaccgtggctatcgac

SEQ ID NO: 933468 - DNA, 25 bp, Mus musculus
gatcagcttcacggtggctatcgac

SEQ ID NO: 933469 - DNA, 25 bp, Mus musculus
gatcaggacacacacacactgtcct

SEQ ID NO: 933470 - DNA, 25 bp, Mus musculus
gatcaggacacacagacactgtcct

SEQ ID NO: 933471 - DNA, 25 bp, Mus musculus
gatcaggagtataaggctcactttg

SEQ ID NO: 933472 - DNA, 25 bp, Mus musculus
gatcaggagtattaggctcactttg

SEQ ID NO: 933473 - DNA, 25 bp, Mus musculus
gatcaggatacacgtgatctggtac

SEQ ID NO: 933474 - DNA, 25 bp, Mus musculus
gatcaggatacaggtgatctggtac

SEQ ID NO: 933475 - DNA, 25 bp, Mus musculus
gatcaggtccagcgcaatggcagca

SEQ ID NO: 933476 - DNA, 25 bp, Mus musculus
gatcaggtccagggcaatggcagca

SEQ ID NO: 933477 - DNA, 25 bp, Mus musculus
gatcaggtgctacgttaaagatcga

SEQ ID NO: 933478 - DNA, 25 bp, Mus musculus
gatcaggtgctaggttaaagatcga

SEQ ID NO: 933479 - DNA, 25 bp, Mus musculus
gatcagtgaaaaccagcttgtttct

SEQ ID NO: 933480 - DNA, 25 bp, Mus musculus
gatcagtgaaaacctgcttgtttct

SEQ ID NO: 933481 - DNA, 25 bp, Mus musculus
gatcagtgtgagaatatacacttct

SEQ ID NO: 933482 - DNA, 25 bp, Mus musculus
gatcagtgtgagtatatacacttct

SEQ ID NO: 933483 - DNA, 25 bp, Mus musculus
gatcagttatcagacttcagactgg

SEQ ID NO: 933484 - DNA, 25 bp, Mus musculus
gatcagttatcgcagtaatggaact

SEQ ID NO: 933485 - DNA, 25 bp, Mus musculus
gatcagttatctttttatttcaggg

SEQ ID NO: 933486 - DNA, 25 bp, Mus musculus
gatcagttatgagacttcagactgg

SEQ ID NO: 933487 - DNA, 25 bp, Mus musculus
gatcagttatggcagtaatggaact

SEQ ID NO: 933488 - DNA, 25 bp, Mus musculus
gatcagttatgtttttatttcaggg

SEQ ID NO: 933489 - DNA, 25 bp, Mus musculus
gatcataaagagctgcgagtcctgg

SEQ ID NO: 933490 - DNA, 25 bp, Mus musculus
gatcataaagtgctgcgagtcctgg

SEQ ID NO: 933491 - DNA, 25 bp, Mus musculus
gatcatatacagcagcagtacagtg

SEQ ID NO: 933492 - DNA, 25 bp, Mus musculus
gatcatatacaggagcagtacagtg

SEQ ID NO: 933493 - DNA, 25 bp, Mus musculus
gatcatatggcactgactgagttga

SEQ ID NO: 933494 - DNA, 25 bp, Mus musculus
gatcatatggcacttgactgagttg

SEQ ID NO: 933495 - DNA, 25 bp, Mus musculus
gatcatatggcagtgactgagttga

SEQ ID NO: 933496 - DNA, 25 bp, Mus musculus
gatcatatggcagttgactgagttg

SEQ ID NO: 933497 - DNA, 25 bp, Mus musculus
gatcatcaagaacacgctggagtat

SEQ ID NO: 933498 - DNA, 25 bp, Mus musculus
gatcatcaagaacaggctggagtat

SEQ ID NO: 933499 - DNA, 25 bp, Mus musculus
gatcatcaagcgcatgggttatctt

SEQ ID NO: 933500 - DNA, 25 bp, Mus musculus
gatcatcaagggcatgggttatctt

SEQ ID NO: 933501 - DNA, 25 bp, Mus musculus
gatcatcaatgagcctacagcagct

SEQ ID NO: 933502 - DNA, 25 bp, Mus musculus
gatcatcaatgagcgtacagcagct

SEQ ID NO: 933503 - DNA, 25 bp, Mus musculus
gatcatcaccatcggaaatgcctcc

SEQ ID NO: 933504 - DNA, 25 bp, Mus musculus
gatcatcaccatgggaaatgcctcc

SEQ ID NO: 933505 - DNA, 25 bp, Mus musculus
gatcatcactgcccctggctaaaca

SEQ ID NO: 933506 - DNA, 25 bp, Mus musculus
gatcatcactgcgcctggctaaaca

SEQ ID NO: 933507 - DNA, 25 bp, Mus musculus
gatcatcatcgacgcaaacgaccgg

SEQ ID NO: 933508 - DNA, 25 bp, Mus musculus
gatcatcatcgaggcaaacgaccgg

SEQ ID NO: 933509 - DNA, 25 bp, Mus musculus
gatcatccaaagctgcagctagtga

SEQ ID NO: 933510 - DNA, 25 bp, Mus musculus
gatcatccaaaggtgcagctagtga

SEQ ID NO: 933511 - DNA, 25 bp, Mus musculus
gatcatccacagcgacttaaaaccc

SEQ ID NO: 933512 - DNA, 25 bp, Mus musculus
gatcatccacagggacttaaaaccc

SEQ ID NO: 933513 - DNA, 25 bp, Mus musculus
gatcatcccccaattgcagtggaag

SEQ ID NO: 933514 - DNA, 25 bp, Mus musculus
gatcatcccccatttgcagtggaag

SEQ ID NO: 933515 - DNA, 25 bp, Mus musculus
gatcatcgaaatcaagattggataa

SEQ ID NO: 933516 - DNA, 25 bp, Mus musculus
gatcatcgaaatcatgccagaattt

SEQ ID NO: 933517 - DNA, 25 bp, Mus musculus
gatcatcgaaatcgaaatcagagat

SEQ ID NO: 933518 - DNA, 25 bp, Mus musculus
gatcatcgaaatgaagattggataa

SEQ ID NO: 933519 - DNA, 25 bp, Mus musculus
gatcatcgaaatgatgccagaattt

SEQ ID NO: 933520 - DNA, 25 bp, Mus musculus
gatcatcgaaatggaaatcagagat

SEQ ID NO: 933521 - DNA, 25 bp, Mus musculus
gatcatctacaactcgcagggtgcc

SEQ ID NO: 933522 - DNA, 25 bp, Mus musculus
gatcatctacaactggcagggtgcc

SEQ ID NO: 933523 - DNA, 25 bp, Mus musculus
gatcatgcaacaaaagtctttcgga

SEQ ID NO: 933524 - DNA, 25 bp, Mus musculus
gatcatgcaagaaaagtctttcgga

SEQ ID NO: 933525 - DNA, 25 bp, Mus musculus
gatcattaaaaacatcctggaaaac

SEQ ID NO: 933526 - DNA, 25 bp, Mus musculus
gatcattaaaaagatcctggaaaac

SEQ ID NO: 933527 - DNA, 25 bp, Mus musculus
gatcattccaagaagaagcccggga

SEQ ID NO: 933528 - DNA, 25 bp, Mus musculus
gatcattccaagtagaagcccggga

SEQ ID NO: 933529 - DNA, 25 bp, Mus musculus
gatcattcccaacaacctgctggac

SEQ ID NO: 933530 - DNA, 25 bp, Mus musculus
gatcattcccaagaacctgctggac

SEQ ID NO: 933531 - DNA, 25 bp, Mus musculus
gatcattccgaggaacttcccgctc

SEQ ID NO: 933532 - DNA, 25 bp, Mus musculus
gatcattccgtggaacttcccgctc

SEQ ID NO: 933533 - DNA, 25 bp, Mus musculus
gatcatttctctttgtaaacgatac

SEQ ID NO: 933534 - DNA, 25 bp, Mus musculus
gatcatttctgtttgtaaacgatac

SEQ ID NO: 933535 - DNA, 25 bp, Mus musculus
gatccaaatgctaactcacctcagt

SEQ ID NO: 933536 - DNA, 25 bp, Mus musculus
gatccaaatggtaactcacctcagt

SEQ ID NO: 933537 - DNA, 25 bp, Mus musculus
gatccaacagaccctcaggacttgt

SEQ ID NO: 933538 - DNA, 25 bp, Mus musculus
gatccaacagtccctcaggacttgt

SEQ ID NO: 933539 - DNA, 25 bp, Mus musculus
gatccaacgacaatcagcgccttgc

SEQ ID NO: 933540 - DNA, 25 bp, Mus musculus
gatccaacgacaatgatacactaaa

SEQ ID NO: 933541 - DNA, 25 bp, Mus musculus
gatccaacgacattcagcgccttgc

SEQ ID NO: 933542 - DNA, 25 bp, Mus musculus
gatccaacgacattgatacactaaa

SEQ ID NO: 933543 - DNA, 25 bp, Mus musculus
gatccaagacaaccaacagaccctt

SEQ ID NO: 933544 - DNA, 25 bp, Mus musculus
gatccaagacaagcaacagaccctt

SEQ ID NO: 933545 - DNA, 25 bp, Mus musculus
gatccacaaagacgcggttacaggg

SEQ ID NO: 933546 - DNA, 25 bp, Mus musculus
gatccacaaagaggcggttacaggg

SEQ ID NO: 933547 - DNA, 25 bp, Mus musculus
gatccacaactgcacgctgtttggt

SEQ ID NO: 933548 - DNA, 25 bp, Mus musculus
gatccacaactgcaggctgtttggt

SEQ ID NO: 933549 - DNA, 25 bp, Mus musculus
gatccacattgacggccggaatgca

SEQ ID NO: 933550 - DNA, 25 bp, Mus musculus
gatccacattgagggccggaatgca

SEQ ID NO: 933551 - DNA, 25 bp, Mus musculus
gatccactcggacagcctgcgagct

SEQ ID NO: 933552 - DNA, 25 bp, Mus musculus
gatccactcggagagcctgcgagct

SEQ ID NO: 933553 - DNA, 25 bp, Mus musculus
gatccagaagcaactgactgattac

SEQ ID NO: 933554 - DNA, 25 bp, Mus musculus
gatccagaagcttgctttcactacc

SEQ ID NO: 933555 - DNA, 25 bp, Mus musculus
gatccagaaggaactgactgattac

SEQ ID NO: 933556 - DNA, 25 bp, Mus musculus
gatccagaaggttgctttcactacc

SEQ ID NO: 933557 - DNA, 25 bp, Mus musculus
gatccagaatacatcgtttacatgt

SEQ ID NO: 933558 - DNA, 25 bp, Mus musculus
gatccagaatacatggtttacatgt

SEQ ID NO: 933559 - DNA, 25 bp, Mus musculus
gatccagacacacatccgcgtcgtg

SEQ ID NO: 933560 - DNA, 25 bp, Mus musculus
gatccagacacagatccgcgtcgtg

SEQ ID NO: 933561 - DNA, 25 bp, Mus musculus
gatccagcaactggaccagagttgg

SEQ ID NO: 933562 - DNA, 25 bp, Mus musculus
gatccagcaagtggaccagagttgg

SEQ ID NO: 933563 - DNA, 25 bp, Mus musculus
gatccagcacagaaggcagggagtg

SEQ ID NO: 933564 - DNA, 25 bp, Mus musculus
gatccagcacagccagggagtgtgt

SEQ ID NO: 933565 - DNA, 25 bp, Mus musculus
gatccagcacaggcagggagtgtgt

SEQ ID NO: 933566 - DNA, 25 bp, Mus musculus
gatccagcacagtaggcagggagtg

SEQ ID NO: 933567 - DNA, 25 bp, Mus musculus
gatccagcagatgctgtccacggtg

SEQ ID NO: 933568 - DNA, 25 bp, Mus musculus
gatccagcagctggaccagagctgg

SEQ ID NO: 933569 - DNA, 25 bp, Mus musculus
gatccagcaggtggaccagagctgg

SEQ ID NO: 933570 - DNA, 25 bp, Mus musculus
gatccagcagttgctgtccacggtg

SEQ ID NO: 933571 - DNA, 25 bp, Mus musculus
gatccagccgctggtcccaaacggg

SEQ ID NO: 933572 - DNA, 25 bp, Mus musculus
gatccagccggtggtcccaaacggg

SEQ ID NO: 933573 - DNA, 25 bp, Mus musculus
gatccagctgatggtagaagagagt

SEQ ID NO: 933574 - DNA, 25 bp, Mus musculus
gatccagctgttggtagaagagagt

SEQ ID NO: 933575 - DNA, 25 bp, Mus musculus
gatccaggagaccacggcctatttt

SEQ ID NO: 933576 - DNA, 25 bp, Mus musculus
gatccaggagaccagggcctatttt

SEQ ID NO: 933577 - DNA, 25 bp, Mus musculus
gatccaggagcacttcttcctggca

SEQ ID NO: 933578 - DNA, 25 bp, Mus musculus
gatccaggagctggtggaagccatt

SEQ ID NO: 933579 - DNA, 25 bp, Mus musculus
gatccaggaggacttcttcctggca

SEQ ID NO: 933580 - DNA, 25 bp, Mus musculus
gatccaggaggtggtggaagccatt

SEQ ID NO: 933581 - DNA, 25 bp, Mus musculus
gatccagtctccaacgaagaactag

SEQ ID NO: 933582 - DNA, 25 bp, Mus musculus
gatccagtctccaaggaagaactag

SEQ ID NO: 933583 - DNA, 25 bp, Mus musculus
gatccatcatggcgcagaaagtgaa

SEQ ID NO: 933584 - DNA, 25 bp, Mus musculus
gatccatcatggcggagaaagtgaa

SEQ ID NO: 933585 - DNA, 25 bp, Mus musculus
gatccatgaaaaccaagatgggcat

SEQ ID NO: 933586 - DNA, 25 bp, Mus musculus
gatccatgaaaagcaagatgggcat

SEQ ID NO: 933587 - DNA, 25 bp, Mus musculus
gatccatgtcccacaattctcgact

SEQ ID NO: 933588 - DNA, 25 bp, Mus musculus
gatccatgtcccacagtaacccctc

SEQ ID NO: 933589 - DNA, 25 bp, Mus musculus
gatccatgtcccactattctcgact

SEQ ID NO: 933590 - DNA, 25 bp, Mus musculus
gatccatgtcccactgtaacccctc

SEQ ID NO: 933591 - DNA, 25 bp, Mus musculus
gatccattcaaacgcattggccagg

SEQ ID NO: 933592 - DNA, 25 bp, Mus musculus
gatccattcaaaggcattggccagg

SEQ ID NO: 933593 - DNA, 25 bp, Mus musculus
gatcccaaggatctggtggaagagc

SEQ ID NO: 933594 - DNA, 25 bp, Mus musculus
gatcccaaggttctggtggaagagc

SEQ ID NO: 933595 - DNA, 25 bp, Mus musculus
gatcccaagtcgagagcagtgtttg

SEQ ID NO: 933596 - DNA, 25 bp, Mus musculus
gatcccaagtcgtgagcagtgtttg

SEQ ID NO: 933597 - DNA, 25 bp, Mus musculus
gatcccactatagacgactcctacc

SEQ ID NO: 933598 - DNA, 25 bp, Mus musculus
gatcccactatagaggactcctacc

SEQ ID NO: 933599 - DNA, 25 bp, Mus musculus
gatcccagcgaaaagcccattggaa

SEQ ID NO: 933600 - DNA, 25 bp, Mus musculus
gatcccagcgaatagcccattggaa

SEQ ID NO: 933601 - DNA, 25 bp, Mus musculus
gatcccaggaagctcgagaaggggt

SEQ ID NO: 933602 - DNA, 25 bp, Mus musculus
gatcccaggaagctcgtccagctca

SEQ ID NO: 933603 - DNA, 25 bp, Mus musculus
gatcccaggaagctggagaaggggt

SEQ ID NO: 933604 - DNA, 25 bp, Mus musculus
gatcccaggaagctggtccagctca

SEQ ID NO: 933605 - DNA, 25 bp, Mus musculus
gatccccagcgtgccgatgatgcca

SEQ ID NO: 933606 - DNA, 25 bp, Mus musculus
gatccccagcgtgcggatgatgcca

SEQ ID NO: 933607 - DNA, 25 bp, Mus musculus
gatcccccagagaggccaggctggg

SEQ ID NO: 933608 - DNA, 25 bp, Mus musculus
gatcccccagagagtcatggaccaa

SEQ ID NO: 933609 - DNA, 25 bp, Mus musculus
gatcccccagagtggccaggctggg

SEQ ID NO: 933610 - DNA, 25 bp, Mus musculus
gatcccccagagtgtcatggaccaa

SEQ ID NO: 933611 - DNA, 25 bp, Mus musculus
gatcccctagagccccagaaacttc

SEQ ID NO: 933612 - DNA, 25 bp, Mus musculus
gatcccctagaggcccagaaacttc

SEQ ID NO: 933613 - DNA, 25 bp, Mus musculus
gatcccgaagatcaactcaccaaag

SEQ ID NO: 933614 - DNA, 25 bp, Mus musculus
gatcccgaagttcaactcaccaaag

SEQ ID NO: 933615 - DNA, 25 bp, Mus musculus
gatcccgatcaacatcatactctcc

SEQ ID NO: 933616 - DNA, 25 bp, Mus musculus
gatcccgatcaagatcatactctcc

SEQ ID NO: 933617 - DNA, 25 bp, Mus musculus
gatccctaagcaccagccatcctcg

SEQ ID NO: 933618 - DNA, 25 bp, Mus musculus
gatccctaagcacccatcctcggct

SEQ ID NO: 933619 - DNA, 25 bp, Mus musculus
gatccctaagcagcagccatcctcg

SEQ ID NO: 933620 - DNA, 25 bp, Mus musculus
gatccctaagcagccatcctcggct

SEQ ID NO: 933621 - DNA, 25 bp, Mus musculus
gatccctagataagaaagtctggat

SEQ ID NO: 933622 - DNA, 25 bp, Mus musculus
gatccctagatatgaaagtctggat

SEQ ID NO: 933623 - DNA, 25 bp, Mus musculus
gatccctattatcgcaatgactctg

SEQ ID NO: 933624 - DNA, 25 bp, Mus musculus
gatccctattatggcaatgactctg

SEQ ID NO: 933625 - DNA, 25 bp, Mus musculus
gatccctctgctagactccttgaac

SEQ ID NO: 933626 - DNA, 25 bp, Mus musculus
gatccctctgctagtctccttgaac

SEQ ID NO: 933627 - DNA, 25 bp, Mus musculus
gatccgaatgaacgagcgagagcgg

SEQ ID NO: 933628 - DNA, 25 bp, Mus musculus
gatccgaatgaaggagcgagagcgg

SEQ ID NO: 933629 - DNA, 25 bp, Mus musculus
gatccgaattagctcgacactcaag

SEQ ID NO: 933630 - DNA, 25 bp, Mus musculus
gatccgaattagctggacactcaag

SEQ ID NO: 933631 - DNA, 25 bp, Mus musculus
gatccgactccactgcggactgcca

SEQ ID NO: 933632 - DNA, 25 bp, Mus musculus
gatccgactccagtgcggactgcca

SEQ ID NO: 933633 - DNA, 25 bp, Mus musculus
gatccgagagaacgtcttgggcact

SEQ ID NO: 933634 - DNA, 25 bp, Mus musculus
gatccgagagaaggtcttgggcact

SEQ ID NO: 933635 - DNA, 25 bp, Mus musculus
gatccgagagactacaggagcccag

SEQ ID NO: 933636 - DNA, 25 bp, Mus musculus
gatccgagagcagtatgaggagcgc

SEQ ID NO: 933637 - DNA, 25 bp, Mus musculus
gatccgagagcccttggaagctaac

SEQ ID NO: 933638 - DNA, 25 bp, Mus musculus
gatccgagaggagtatgaggagcgc

SEQ ID NO: 933639 - DNA, 25 bp, Mus musculus
gatccgagaggccttggaagctaac

SEQ ID NO: 933640 - DNA, 25 bp, Mus musculus
gatccgagagtctacaggagcccag

SEQ ID NO: 933641 - DNA, 25 bp, Mus musculus
gatccgagtcagcccaatcgtctcc

SEQ ID NO: 933642 - DNA, 25 bp, Mus musculus
gatccgagtcaggccaatcgtctcc

SEQ ID NO: 933643 - DNA, 25 bp, Mus musculus
gatccgcaacagagcgtggtgatga

SEQ ID NO: 933644 - DNA, 25 bp, Mus musculus
gatccgcaacagcgtggtgatgaga

SEQ ID NO: 933645 - DNA, 25 bp, Mus musculus
gatccgcaacagggtggtgatgaga

SEQ ID NO: 933646 - DNA, 25 bp, Mus musculus
gatccgcaacagtgcgtggtgatga

SEQ ID NO: 933647 - DNA, 25 bp, Mus musculus
gatccgcaagcacttcttatacttg

SEQ ID NO: 933648 - DNA, 25 bp, Mus musculus
gatccgcaagcgccagggcaacaag

SEQ ID NO: 933649 - DNA, 25 bp, Mus musculus
gatccgcaagctcccccccaagtgt

SEQ ID NO: 933650 - DNA, 25 bp, Mus musculus
gatccgcaagctctctgatcagtgc

SEQ ID NO: 933651 - DNA, 25 bp, Mus musculus
gatccgcaagctgccccccaagtgt

SEQ ID NO: 933652 - DNA, 25 bp, Mus musculus
gatccgcaagctgtctgatcagtgc

SEQ ID NO: 933653 - DNA, 25 bp, Mus musculus
gatccgcaaggacttcttatacttg

SEQ ID NO: 933654 - DNA, 25 bp, Mus musculus
gatccgcaagggccagggcaacaag

SEQ ID NO: 933655 - DNA, 25 bp, Mus musculus
gatccgcacctgcaacaggagagag

SEQ ID NO: 933656 - DNA, 25 bp, Mus musculus
gatccgcacctgcaagagagagttg

SEQ ID NO: 933657 - DNA, 25 bp, Mus musculus
gatccgcacctgcatcaggagagag

SEQ ID NO: 933658 - DNA, 25 bp, Mus musculus
gatccgcacctgcatgagagagttg

SEQ ID NO: 933659 - DNA, 25 bp, Mus musculus
gatccgcagtatgttccggaagctg

SEQ ID NO: 933660 - DNA, 25 bp, Mus musculus
gatccgcagtcgtttctctgtatag

SEQ ID NO: 933661 - DNA, 25 bp, Mus musculus
gatccgcagtggtttctctgtatag

SEQ ID NO: 933662 - DNA, 25 bp, Mus musculus
gatccgcagtttgttccggaagctg

SEQ ID NO: 933663 - DNA, 25 bp, Mus musculus
gatccgcccaagagctcaaagccca

SEQ ID NO: 933664 - DNA, 25 bp, Mus musculus
gatccgcccaagtgctcaaagccca

SEQ ID NO: 933665 - DNA, 25 bp, Mus musculus
gatccgctgtcacgagctgaaatac

SEQ ID NO: 933666 - DNA, 25 bp, Mus musculus
gatccgctgtcaggagctgaaatac

SEQ ID NO: 933667 - DNA, 25 bp, Mus musculus
gatccggaagtaaaagccggaagag

SEQ ID NO: 933668 - DNA, 25 bp, Mus musculus
gatccggaagtataagccggaagag

SEQ ID NO: 933669 - DNA, 25 bp, Mus musculus
gatccggaagtcatcgaagtcctgc

SEQ ID NO: 933670 - DNA, 25 bp, Mus musculus
gatccggaagtcatggaagtcctgc

SEQ ID NO: 933671 - DNA, 25 bp, Mus musculus
gatccggaatgccacgtcatcctcc

SEQ ID NO: 933672 - DNA, 25 bp, Mus musculus
gatccggaatgccaggtcatcctcc

SEQ ID NO: 933673 - DNA, 25 bp, Mus musculus
gatccgggacaaaattctggctgcc

SEQ ID NO: 933674 - DNA, 25 bp, Mus musculus
gatccgggacaatattctggctgcc

SEQ ID NO: 933675 - DNA, 25 bp, Mus musculus
gatccgtaggaagaagtccctctcg

SEQ ID NO: 933676 - DNA, 25 bp, Mus musculus
gatccgtaggaagatgtccctctcg

SEQ ID NO: 933677 - DNA, 25 bp, Mus musculus
gatccgtgacagactcaaactagaa

SEQ ID NO: 933678 - DNA, 25 bp, Mus musculus
gatccgtgacagcccctttgaacgg

SEQ ID NO: 933679 - DNA, 25 bp, Mus musculus
gatccgtgacaggccctttgaacgg

SEQ ID NO: 933680 - DNA, 25 bp, Mus musculus
gatccgtgacagtctcaaactagaa

SEQ ID NO: 933681 - DNA, 25 bp, Mus musculus
gatcctaaccagctaagatggaaac

SEQ ID NO: 933682 - DNA, 25 bp, Mus musculus
gatcctaaccaggtaagatggaaac

SEQ ID NO: 933683 - DNA, 25 bp, Mus musculus
gatcctcagccgcacgctggaggag

SEQ ID NO: 933684 - DNA, 25 bp, Mus musculus
gatcctcagccgcaggctggaggag

SEQ ID NO: 933685 - DNA, 25 bp, Mus musculus
gatcctccatcttcagtatcagata

SEQ ID NO: 933686 - DNA, 25 bp, Mus musculus
gatcctccatgttcagtatcagata

SEQ ID NO: 933687 - DNA, 25 bp, Mus musculus
gatcctcccccaacactacaggcgc

SEQ ID NO: 933688 - DNA, 25 bp, Mus musculus
gatcctcccccatcactacaggcgc

SEQ ID NO: 933689 - DNA, 25 bp, Mus musculus
gatcctctcaatcaattcctggagg

SEQ ID NO: 933690 - DNA, 25 bp, Mus musculus
gatcctctcaatgaattcctggagg

SEQ ID NO: 933691 - DNA, 25 bp, Mus musculus
gatcctctcgctaaatggccaagat

SEQ ID NO: 933692 - DNA, 25 bp, Mus musculus
gatcctctcggtaaatggccaagat

SEQ ID NO: 933693 - DNA, 25 bp, Mus musculus
gatcctctgatacacggcggagttc

SEQ ID NO: 933694 - DNA, 25 bp, Mus musculus
gatcctctgatacagggcggagttc

SEQ ID NO: 933695 - DNA, 25 bp, Mus musculus
gatcctgaagactgctggagttaat

SEQ ID NO: 933696 - DNA, 25 bp, Mus musculus
gatcctgaagatgttgctaccactt

SEQ ID NO: 933697 - DNA, 25 bp, Mus musculus
gatcctgaagcattcgggaattaat

SEQ ID NO: 933698 - DNA, 25 bp, Mus musculus
gatcctgaaggattcgggaattaat

SEQ ID NO: 933699 - DNA, 25 bp, Mus musculus
gatcctgaagtctgctggagttaat

SEQ ID NO: 933700 - DNA, 25 bp, Mus musculus
gatcctgaagttgttgctaccactt

SEQ ID NO: 933701 - DNA, 25 bp, Mus musculus
gatcctgacgagcgcatccgtttcc

SEQ ID NO: 933702 - DNA, 25 bp, Mus musculus
gatcctgacgagggcatccgtttcc

SEQ ID NO: 933703 - DNA, 25 bp, Mus musculus
gatcctgaggaactggtttgagcca

SEQ ID NO: 933704 - DNA, 25 bp, Mus musculus
gatcctgaggaagtggtttgagcca

SEQ ID NO: 933705 - DNA, 25 bp, Mus musculus
gatcctgcaaagcgcatccctggat

SEQ ID NO: 933706 - DNA, 25 bp, Mus musculus
gatcctgcaaagggcatccctggat

SEQ ID NO: 933707 - DNA, 25 bp, Mus musculus
gatcctgcagtgcgtcctggtggtg

SEQ ID NO: 933708 - DNA, 25 bp, Mus musculus
gatcctgcagtgggtcctggtggtg

SEQ ID NO: 933709 - DNA, 25 bp, Mus musculus
gatcctgcccagagttgaagaaatt

SEQ ID NO: 933710 - DNA, 25 bp, Mus musculus
gatcctgcccagtgttgaagaaatt

SEQ ID NO: 933711 - DNA, 25 bp, Mus musculus
gatcctgctagccctcctgggtttt

SEQ ID NO: 933712 - DNA, 25 bp, Mus musculus
gatcctgctagcgctcctgggtttt

SEQ ID NO: 933713 - DNA, 25 bp, Mus musculus
gatcctgctatacctcagttctcag

SEQ ID NO: 933714 - DNA, 25 bp, Mus musculus
gatcctgctatagctcagttctcag

SEQ ID NO: 933715 - DNA, 25 bp, Mus musculus
gatcctggagcacttggaatctcag

SEQ ID NO: 933716 - DNA, 25 bp, Mus musculus
gatcctggagcctgttcatcagcag

SEQ ID NO: 933717 - DNA, 25 bp, Mus musculus
gatcctggaggacttggaatctcag

SEQ ID NO: 933718 - DNA, 25 bp, Mus musculus
gatcctggaggctgttcatcagcag

SEQ ID NO: 933719 - DNA, 25 bp, Mus musculus
gatcctggctactctggagaccatg

SEQ ID NO: 933720 - DNA, 25 bp, Mus musculus
gatcctggcttctctggagaccatg

SEQ ID NO: 933721 - DNA, 25 bp, Mus musculus
gatcctggtgaacctggagccatgg

SEQ ID NO: 933722 - DNA, 25 bp, Mus musculus
gatcctggtgaagctggagccatgg

SEQ ID NO: 933723 - DNA, 25 bp, Mus musculus
gatcctgtgactcgcgactacgtgc

SEQ ID NO: 933724 - DNA, 25 bp, Mus musculus
gatcctgtgactggcgactacgtgc

SEQ ID NO: 933725 - DNA, 25 bp, Mus musculus
gatccttaagctggtgatggcccct

SEQ ID NO: 933726 - DNA, 25 bp, Mus musculus
gatccttaaggtggtgatggcccct

SEQ ID NO: 933727 - DNA, 25 bp, Mus musculus
gatccttggcagaacctctgcagat

SEQ ID NO: 933728 - DNA, 25 bp, Mus musculus
gatccttggcagaacgtagcacggc

SEQ ID NO: 933729 - DNA, 25 bp, Mus musculus
gatccttggcagaagctctgcagat

SEQ ID NO: 933730 - DNA, 25 bp, Mus musculus
gatccttggcagaaggtagcacggc

SEQ ID NO: 933731 - DNA, 25 bp, Mus musculus
gatcctttcctaaccctgctgcatt

SEQ ID NO: 933732 - DNA, 25 bp, Mus musculus
gatcctttcctaacgctgctgcatt

SEQ ID NO: 933733 - DNA, 25 bp, Mus musculus
gatcgaaaactccgatttgttgaga

SEQ ID NO: 933734 - DNA, 25 bp, Mus musculus
gatcgaaaactcggatttgttgaga

SEQ ID NO: 933735 - DNA, 25 bp, Mus musculus
gatcgaaagtgacgttgccaacctt

SEQ ID NO: 933736 - DNA, 25 bp, Mus musculus
gatcgaaagtgaggttgccaacctt

SEQ ID NO: 933737 - DNA, 25 bp, Mus musculus
gatcgacaacagcttcctacacgaa

SEQ ID NO: 933738 - DNA, 25 bp, Mus musculus
gatcgacaacaggttcctacacgaa

SEQ ID NO: 933739 - DNA, 25 bp, Mus musculus
gatcgacattgtgacttcactgaag

SEQ ID NO: 933740 - DNA, 25 bp, Mus musculus
gatcgacattgtgagttcactgaag

SEQ ID NO: 933741 - DNA, 25 bp, Mus musculus
gatcgacctgctccccagtctgtgt

SEQ ID NO: 933742 - DNA, 25 bp, Mus musculus
gatcgacctggtccccagtctgtgt

SEQ ID NO: 933743 - DNA, 25 bp, Mus musculus
gatcgacggcctcgtagtattaaag

SEQ ID NO: 933744 - DNA, 25 bp, Mus musculus
gatcgacggcctggtagtattaaag

SEQ ID NO: 933745 - DNA, 25 bp, Mus musculus
gatcgacttagacgccaatttcgag

SEQ ID NO: 933746 - DNA, 25 bp, Mus musculus
gatcgacttagaggccaatttcgag

SEQ ID NO: 933747 - DNA, 25 bp, Mus musculus
gatcgacttagtcacgtgtcaaaag

SEQ ID NO: 933748 - DNA, 25 bp, Mus musculus
gatcgacttagtcaggtgtcaaaag

SEQ ID NO: 933749 - DNA, 25 bp, Mus musculus
gatcgagaagaaacttggcctcctc

SEQ ID NO: 933750 - DNA, 25 bp, Mus musculus
gatcgagaagtaacttggcctcctc

SEQ ID NO: 933751 - DNA, 25 bp, Mus musculus
gatcgagcagctgaatgagcgagtc

SEQ ID NO: 933752 - DNA, 25 bp, Mus musculus
gatcgagcagcttcctcatgagggt

SEQ ID NO: 933753 - DNA, 25 bp, Mus musculus
gatcgagcaggtgaatgagcgagtc

SEQ ID NO: 933754 - DNA, 25 bp, Mus musculus
gatcgagcaggttcctcatgagggt

SEQ ID NO: 933755 - DNA, 25 bp, Mus musculus
gatcgagttaagcatctctatagtg

SEQ ID NO: 933756 - DNA, 25 bp, Mus musculus
gatcgagttaaggatctctatagtg

SEQ ID NO: 933757 - DNA, 25 bp, Mus musculus
gatcgatgcaaaacccaggaggcac

SEQ ID NO: 933758 - DNA, 25 bp, Mus musculus
gatcgatgcaaatcccaggaggcac

SEQ ID NO: 933759 - DNA, 25 bp, Mus musculus
gatcgatgctcgtgtgtgtgaggaa

SEQ ID NO: 933760 - DNA, 25 bp, Mus musculus
gatcgatgctggtgtgtgtgaggaa

SEQ ID NO: 933761 - DNA, 25 bp, Mus musculus
gatcgccaaggacaattaccctctg

SEQ ID NO: 933762 - DNA, 25 bp, Mus musculus
gatcgccaaggagaattaccctctg

SEQ ID NO: 933763 - DNA, 25 bp, Mus musculus
gatcgccatgttcacctacacattc

SEQ ID NO: 933764 - DNA, 25 bp, Mus musculus
gatcgccatgttcagctacacattc

SEQ ID NO: 933765 - DNA, 25 bp, Mus musculus
gatcgcctccagcccagcagcaaca

SEQ ID NO: 933766 - DNA, 25 bp, Mus musculus
gatcgcctccagcctatttaagagt

SEQ ID NO: 933767 - DNA, 25 bp, Mus musculus
gatcgcctccaggccagcagcaaca

SEQ ID NO: 933768 - DNA, 25 bp, Mus musculus
gatcgcctccaggctatttaagagt

SEQ ID NO: 933769 - DNA, 25 bp, Mus musculus
gatcgcctctcaagcatagacatta

SEQ ID NO: 933770 - DNA, 25 bp, Mus musculus
gatcgcctctcaaggatagacatta

SEQ ID NO: 933771 - DNA, 25 bp, Mus musculus
gatcgcctgcagagaggaagacgac

SEQ ID NO: 933772 - DNA, 25 bp, Mus musculus
gatcgcctgcagcgtgagttggtga

SEQ ID NO: 933773 - DNA, 25 bp, Mus musculus
gatcgcctgcagggtgagttggtga

SEQ ID NO: 933774 - DNA, 25 bp, Mus musculus
gatcgcctgcagtgaggaagacgac

SEQ ID NO: 933775 - DNA, 25 bp, Mus musculus
gatcgccttcagcttgcaggaaccc

SEQ ID NO: 933776 - DNA, 25 bp, Mus musculus
gatcgccttcaggttgcaggaaccc

SEQ ID NO: 933777 - DNA, 25 bp, Mus musculus
gatcgctgtccacctcgtagtgcat

SEQ ID NO: 933778 - DNA, 25 bp, Mus musculus
gatcgctgtccacgagctggagaag

SEQ ID NO: 933779 - DNA, 25 bp, Mus musculus
gatcgctgtccagctcgtagtgcat

SEQ ID NO: 933780 - DNA, 25 bp, Mus musculus
gatcgctgtccaggagctggagaag

SEQ ID NO: 933781 - DNA, 25 bp, Mus musculus
gatcggatccagcccctggggcttc

SEQ ID NO: 933782 - DNA, 25 bp, Mus musculus
gatcggatccaggccctggggcttc

SEQ ID NO: 933783 - DNA, 25 bp, Mus musculus
gatcggcgccgtgacattcgcgcag

SEQ ID NO: 933784 - DNA, 25 bp, Mus musculus
gatcggcgccgtgagattcgcgcag

SEQ ID NO: 933785 - DNA, 25 bp, Mus musculus
gatcggctcattgacgtgaatgggc

SEQ ID NO: 933786 - DNA, 25 bp, Mus musculus
gatcggctcattgaggtgaatgggc

SEQ ID NO: 933787 - DNA, 25 bp, Mus musculus
gatcggctctgacgatggggaaccc

SEQ ID NO: 933788 - DNA, 25 bp, Mus musculus
gatcggctctgaggatggggaaccc

SEQ ID NO: 933789 - DNA, 25 bp, Mus musculus
gatcggctgggaaacgttgcagact

SEQ ID NO: 933790 - DNA, 25 bp, Mus musculus
gatcggctgggaaaggttgcagact

SEQ ID NO: 933791 - DNA, 25 bp, Mus musculus
gatcgggcagcttggtggaaaggaa

SEQ ID NO: 933792 - DNA, 25 bp, Mus musculus
gatcgggcaggttggtggaaaggaa

SEQ ID NO: 933793 - DNA, 25 bp, Mus musculus
gatcggtcccaacggtgacagaggc

SEQ ID NO: 933794 - DNA, 25 bp, Mus musculus
gatcggtcccaagggtgacagaggc

SEQ ID NO: 933795 - DNA, 25 bp, Mus musculus
gatcggttacagacactgaccagag

SEQ ID NO: 933796 - DNA, 25 bp, Mus musculus
gatcggttacagtcactgaccagag

SEQ ID NO: 933797 - DNA, 25 bp, Mus musculus
gatcgtacccagatcgccctgagcc

SEQ ID NO: 933798 - DNA, 25 bp, Mus musculus
gatcgtaccctgatcgccctgagcc

SEQ ID NO: 933799 - DNA, 25 bp, Mus musculus
gatcgtaggcagagggctcattggt

SEQ ID NO: 933800 - DNA, 25 bp, Mus musculus
gatcgtaggcagtgggctcattggt

SEQ ID NO: 933801 - DNA, 25 bp, Mus musculus
gatcgtcgtccaccaatgaaaagag

SEQ ID NO: 933802 - DNA, 25 bp, Mus musculus
gatcgtcgtcgaccaatgaaaagag

SEQ ID NO: 933803 - DNA, 25 bp, Mus musculus
gatcgtcgtcgtcgaccaatgaaaa

SEQ ID NO: 933804 - DNA, 25 bp, Mus musculus
gatcgtcgtcgtggaccaatgaaaa

SEQ ID NO: 933805 - DNA, 25 bp, Mus musculus
gatcgtctggaatacggaaaaccga

SEQ ID NO: 933806 - DNA, 25 bp, Mus musculus
gatcgtctggaatagggaaaaccga

SEQ ID NO: 933807 - DNA, 25 bp, Mus musculus
gatcgtgctcaacgttaactacatc

SEQ ID NO: 933808 - DNA, 25 bp, Mus musculus
gatcgtgctcaaggttaactacatc

SEQ ID NO: 933809 - DNA, 25 bp, Mus musculus
gatcgtgtacagcgtgaagttgatt

SEQ ID NO: 933810 - DNA, 25 bp, Mus musculus
gatcgtgtacagggtgaagttgatt

SEQ ID NO: 933811 - DNA, 25 bp, Mus musculus
gatcgtgtgcggccatttcagggaa

SEQ ID NO: 933812 - DNA, 25 bp, Mus musculus
gatcgtgtgcgggcatttcagggaa

SEQ ID NO: 933813 - DNA, 25 bp, Mus musculus
gatctaatgaagctatttaatgatc

SEQ ID NO: 933814 - DNA, 25 bp, Mus musculus
gatctaatgaaggtatttaatgatc

SEQ ID NO: 933815 - DNA, 25 bp, Mus musculus
gatctacaggcgtggatgcgtagac

SEQ ID NO: 933816 - DNA, 25 bp, Mus musculus
gatctacaggggtggatgcgtagac

SEQ ID NO: 933817 - DNA, 25 bp, Mus musculus
gatctacctcagcaatgaatcagaa

SEQ ID NO: 933818 - DNA, 25 bp, Mus musculus
gatctacctcaggaatgaatcagaa

SEQ ID NO: 933819 - DNA, 25 bp, Mus musculus
gatctacttcattgatcataatacg

SEQ ID NO: 933820 - DNA, 25 bp, Mus musculus
gatctacttcattgttcataatacg

SEQ ID NO: 933821 - DNA, 25 bp, Mus musculus
gatctagaaaagacaagagaagaga

SEQ ID NO: 933822 - DNA, 25 bp, Mus musculus
gatctagaaaagtcaagagaagaga

SEQ ID NO: 933823 - DNA, 25 bp, Mus musculus
gatctagtccctcatttgagtaact

SEQ ID NO: 933824 - DNA, 25 bp, Mus musculus
gatctagtccctgatttgagtaact

SEQ ID NO: 933825 - DNA, 25 bp, Mus musculus
gatctatgatgtacaacatgccaat

SEQ ID NO: 933826 - DNA, 25 bp, Mus musculus
gatctatgatgttcaacatgccaat

SEQ ID NO: 933827 - DNA, 25 bp, Mus musculus
gatctcaccggcaacgtgatgcttc

SEQ ID NO: 933828 - DNA, 25 bp, Mus musculus
gatctcaccggcaaggtgatgcttc

SEQ ID NO: 933829 - DNA, 25 bp, Mus musculus
gatctcagagatttcattgtttttg

SEQ ID NO: 933830 - DNA, 25 bp, Mus musculus
gatctcagagcgatttgacccattc

SEQ ID NO: 933831 - DNA, 25 bp, Mus musculus
gatctcagagggatttgacccattc

SEQ ID NO: 933832 - DNA, 25 bp, Mus musculus
gatctcagagttttcattgtttttg

SEQ ID NO: 933833 - DNA, 25 bp, Mus musculus
gatctcagataataaccaaagagtg

SEQ ID NO: 933834 - DNA, 25 bp, Mus musculus
gatctcagattataaccaaagagtg

SEQ ID NO: 933835 - DNA, 25 bp, Mus musculus
gatctcagcagacgctacaaccaaa

SEQ ID NO: 933836 - DNA, 25 bp, Mus musculus
gatctcagcagaggctacaaccaaa

SEQ ID NO: 933837 - DNA, 25 bp, Mus musculus
gatctcataacagaggagccaaaag

SEQ ID NO: 933838 - DNA, 25 bp, Mus musculus
gatctcataagagaggagccaaaag

SEQ ID NO: 933839 - DNA, 25 bp, Mus musculus
gatctccaagcgctcgaacttcccc

SEQ ID NO: 933840 - DNA, 25 bp, Mus musculus
gatctccaagcgctggaacttcccc

SEQ ID NO: 933841 - DNA, 25 bp, Mus musculus
gatctccacgaacaagtgcaccagg

SEQ ID NO: 933842 - DNA, 25 bp, Mus musculus
gatctccacgaacatgtgcaccagg

SEQ ID NO: 933843 - DNA, 25 bp, Mus musculus
gatctcgctcaagaagtcctgacat

SEQ ID NO: 933844 - DNA, 25 bp, Mus musculus
gatctcgctctagaagtcctgacat

SEQ ID NO: 933845 - DNA, 25 bp, Mus musculus
gatctctcagagtaccccgaaggtt

SEQ ID NO: 933846 - DNA, 25 bp, Mus musculus
gatctctcagcggagacccagcggc

SEQ ID NO: 933847 - DNA, 25 bp, Mus musculus
gatctctcagcggatcatgagggac

SEQ ID NO: 933848 - DNA, 25 bp, Mus musculus
gatctctcaggggagacccagcggc

SEQ ID NO: 933849 - DNA, 25 bp, Mus musculus
gatctctcaggggatcatgagggac

SEQ ID NO: 933850 - DNA, 25 bp, Mus musculus
gatctctcagtgtaccccgaaggtt

SEQ ID NO: 933851 - DNA, 25 bp, Mus musculus
gatctctgccagctttgtttactag

SEQ ID NO: 933852 - DNA, 25 bp, Mus musculus
gatctctgccaggtttgtttactag

SEQ ID NO: 933853 - DNA, 25 bp, Mus musculus
gatctctggcagctcaagtccggga

SEQ ID NO: 933854 - DNA, 25 bp, Mus musculus
gatctctggcaggtcaagtccggga

SEQ ID NO: 933855 - DNA, 25 bp, Mus musculus
gatctctgggaacattgctacagaa

SEQ ID NO: 933856 - DNA, 25 bp, Mus musculus
gatctctgggaagattgctacagaa

SEQ ID NO: 933857 - DNA, 25 bp, Mus musculus
gatctcttacaacgtacactttctt

SEQ ID NO: 933858 - DNA, 25 bp, Mus musculus
gatctcttacaaggtacactttctt

SEQ ID NO: 933859 - DNA, 25 bp, Mus musculus
gatctgacacaacccaaggttgaag

SEQ ID NO: 933860 - DNA, 25 bp, Mus musculus
gatctgacactacccaaggttgaag

SEQ ID NO: 933861 - DNA, 25 bp, Mus musculus
gatctgacactttccgctccaccat

SEQ ID NO: 933862 - DNA, 25 bp, Mus musculus
gatctgacactttcggctccaccat

SEQ ID NO: 933863 - DNA, 25 bp, Mus musculus
gatctgaccaagctttggcctcaca

SEQ ID NO: 933864 - DNA, 25 bp, Mus musculus
gatctgaccaaggtttggcctcaca

SEQ ID NO: 933865 - DNA, 25 bp, Mus musculus
gatctgacccaacagattgctatgg

SEQ ID NO: 933866 - DNA, 25 bp, Mus musculus
gatctgacccaaccttatgatggag

SEQ ID NO: 933867 - DNA, 25 bp, Mus musculus
gatctgacccaagagattgctatgg

SEQ ID NO: 933868 - DNA, 25 bp, Mus musculus
gatctgacccaagcttatgatggag

SEQ ID NO: 933869 - DNA, 25 bp, Mus musculus
gatctgagagaaactgacagtgagc

SEQ ID NO: 933870 - DNA, 25 bp, Mus musculus
gatctgagagataacgcacctccaa

SEQ ID NO: 933871 - DNA, 25 bp, Mus musculus
gatctgagagataaggcacctccaa

SEQ ID NO: 933872 - DNA, 25 bp, Mus musculus
gatctgagagatagaaactgacagt

SEQ ID NO: 933873 - DNA, 25 bp, Mus musculus
gatctgagagccctctcctgcagcc

SEQ ID NO: 933874 - DNA, 25 bp, Mus musculus
gatctgagaggcctctcctgcagcc

SEQ ID NO: 933875 - DNA, 25 bp, Mus musculus
gatctgagagtaactgacagtgagc

SEQ ID NO: 933876 - DNA, 25 bp, Mus musculus
gatctgagagttagaaactgacagt

SEQ ID NO: 933877 - DNA, 25 bp, Mus musculus
gatctgatagattatctgcgaacca

SEQ ID NO: 933878 - DNA, 25 bp, Mus musculus
gatctgatagtttatctgcgaacca

SEQ ID NO: 933879 - DNA, 25 bp, Mus musculus
gatctgatcgacctcgtccccagtc

SEQ ID NO: 933880 - DNA, 25 bp, Mus musculus
gatctgatcgacctggtccccagtc

SEQ ID NO: 933881 - DNA, 25 bp, Mus musculus
gatctgcaaaatcatggaccaggcc

SEQ ID NO: 933882 - DNA, 25 bp, Mus musculus
gatctgcaaattcatggaccaggcc

SEQ ID NO: 933883 - DNA, 25 bp, Mus musculus
gatctgcacttagacaaagcacaat

SEQ ID NO: 933884 - DNA, 25 bp, Mus musculus
gatctgcacttagagaaagcacaat

SEQ ID NO: 933885 - DNA, 25 bp, Mus musculus
gatctgcaggaatgacctgggtggc

SEQ ID NO: 933886 - DNA, 25 bp, Mus musculus
gatctgcaggtatgacctgggtggc

SEQ ID NO: 933887 - DNA, 25 bp, Mus musculus
gatctgctccaacgcccacagctgg

SEQ ID NO: 933888 - DNA, 25 bp, Mus musculus
gatctgctccaaggcccacagctgg

SEQ ID NO: 933889 - DNA, 25 bp, Mus musculus
gatctggataaacagttcaggaagg

SEQ ID NO: 933890 - DNA, 25 bp, Mus musculus
gatctggataaagagttcaggaagg

SEQ ID NO: 933891 - DNA, 25 bp, Mus musculus
gatctggcactaacagaacctttag

SEQ ID NO: 933892 - DNA, 25 bp, Mus musculus
gatctggcactaactgaacctttag

SEQ ID NO: 933893 - DNA, 25 bp, Mus musculus
gatctggcggatatcgtcagattct

SEQ ID NO: 933894 - DNA, 25 bp, Mus musculus
gatctggcggttatcgtcagattct

SEQ ID NO: 933895 - DNA, 25 bp, Mus musculus
gatctgtacatccacagccatataa

SEQ ID NO: 933896 - DNA, 25 bp, Mus musculus
gatctgtacatccagagccatataa

SEQ ID NO: 933897 - DNA, 25 bp, Mus musculus
gatctgtcagaagctccagtttggt

SEQ ID NO: 933898 - DNA, 25 bp, Mus musculus
gatctgtcagaggaagaagctccag

SEQ ID NO: 933899 - DNA, 25 bp, Mus musculus
gatctgtcagcaagaagctccagtt

SEQ ID NO: 933900 - DNA, 25 bp, Mus musculus
gatctgtcaggaagaagctccagtt

SEQ ID NO: 933901 - DNA, 25 bp, Mus musculus
gatctgtcagtagctccagtttggt

SEQ ID NO: 933902 - DNA, 25 bp, Mus musculus
gatctgtcagtggaagaagctccag

SEQ ID NO: 933903 - DNA, 25 bp, Mus musculus
gatcttaaagcttgccaggatgcat

SEQ ID NO: 933904 - DNA, 25 bp, Mus musculus
gatcttaaaggttgccaggatgcat

SEQ ID NO: 933905 - DNA, 25 bp, Mus musculus
gatcttaatcaaaaatactaaggct

SEQ ID NO: 933906 - DNA, 25 bp, Mus musculus
gatcttaatcaaaattactaaggct

SEQ ID NO: 933907 - DNA, 25 bp, Mus musculus
gatcttagacctcgaagagaaacaa

SEQ ID NO: 933908 - DNA, 25 bp, Mus musculus
gatcttagacctggaagagaaacaa

SEQ ID NO: 933909 - DNA, 25 bp, Mus musculus
gatcttaggaagagtctctcttaaa

SEQ ID NO: 933910 - DNA, 25 bp, Mus musculus
gatcttaggaagtgtctctcttaaa

SEQ ID NO: 933911 - DNA, 25 bp, Mus musculus
gatcttcaagccctgggctgtggcc

SEQ ID NO: 933912 - DNA, 25 bp, Mus musculus
gatcttcaaggcctgggctgtggcc

SEQ ID NO: 933913 - DNA, 25 bp, Mus musculus
gatcttcagaaatactgggacttaa

SEQ ID NO: 933914 - DNA, 25 bp, Mus musculus
gatcttcagatatactgggacttaa

SEQ ID NO: 933915 - DNA, 25 bp, Mus musculus
gatcttcaggggctgattagtgtta

SEQ ID NO: 933916 - DNA, 25 bp, Mus musculus
gatcttcagggggtgattagtgtta

SEQ ID NO: 933917 - DNA, 25 bp, Mus musculus
gatcttcagtgcaacgatggaagga

SEQ ID NO: 933918 - DNA, 25 bp, Mus musculus
gatcttcagtgcaacgttatcctgc

SEQ ID NO: 933919 - DNA, 25 bp, Mus musculus
gatcttcagtgcaaggatggaagga

SEQ ID NO: 933920 - DNA, 25 bp, Mus musculus
gatcttcagtgcaaggttatcctgc

SEQ ID NO: 933921 - DNA, 25 bp, Mus musculus
gatcttcctagcactgttcggcttc

SEQ ID NO: 933922 - DNA, 25 bp, Mus musculus
gatcttcctagctctgttcggcttc

SEQ ID NO: 933923 - DNA, 25 bp, Mus musculus
gatcttcctgacctacatctctcca

SEQ ID NO: 933924 - DNA, 25 bp, Mus musculus
gatcttcctgtcctacatctctcca

SEQ ID NO: 933925 - DNA, 25 bp, Mus musculus
gatcttcgatgaccgcgccttctcc

SEQ ID NO: 933926 - DNA, 25 bp, Mus musculus
gatcttcgatgagcgcgccttctcc

SEQ ID NO: 933927 - DNA, 25 bp, Mus musculus
gatcttctagagaacagcgtcacgc

SEQ ID NO: 933928 - DNA, 25 bp, Mus musculus
gatcttctagtgaacagcgtcacgc

SEQ ID NO: 933929 - DNA, 25 bp, Mus musculus
gatcttctgagtcacgccacatact

SEQ ID NO: 933930 - DNA, 25 bp, Mus musculus
gatcttctgagtcaggccacatact

SEQ ID NO: 933931 - DNA, 25 bp, Mus musculus
gatcttctgccaaacccgcaaaaca

SEQ ID NO: 933932 - DNA, 25 bp, Mus musculus
gatcttctgccatacccgcaaaaca

SEQ ID NO: 933933 - DNA, 25 bp, Mus musculus
gatcttcttaagcagagcgattcaa

SEQ ID NO: 933934 - DNA, 25 bp, Mus musculus
gatcttcttaaggagagcgattcaa

SEQ ID NO: 933935 - DNA, 25 bp, Mus musculus
gatcttctttgtgacgagtgatgca

SEQ ID NO: 933936 - DNA, 25 bp, Mus musculus
gatcttctttgtgaggagtgatgca

SEQ ID NO: 933937 - DNA, 25 bp, Mus musculus
gatcttgatgcctccaccaaggacc

SEQ ID NO: 933938 - DNA, 25 bp, Mus musculus
gatcttgatggctccaccaaggacc

SEQ ID NO: 933939 - DNA, 25 bp, Mus musculus
gatcttgattatgacatcagctttg

SEQ ID NO: 933940 - DNA, 25 bp, Mus musculus
gatcttgattatgagatcagctttg

SEQ ID NO: 933941 - DNA, 25 bp, Mus musculus
gatcttgcaactcaatctgcctgta

SEQ ID NO: 933942 - DNA, 25 bp, Mus musculus
gatcttgcaactccatctcggaaga

SEQ ID NO: 933943 - DNA, 25 bp, Mus musculus
gatcttgcaactgaatctgcctgta

SEQ ID NO: 933944 - DNA, 25 bp, Mus musculus
gatcttgcaactgcatctcggaaga

SEQ ID NO: 933945 - DNA, 25 bp, Mus musculus
gatcttgcagattctacgcatcatg

SEQ ID NO: 933946 - DNA, 25 bp, Mus musculus
gatcttgcagtttctacgcatcatg

SEQ ID NO: 933947 - DNA, 25 bp, Mus musculus
gatcttgcccaggacctcctgacac

SEQ ID NO: 933948 - DNA, 25 bp, Mus musculus
gatcttgcccaggagctcctgacac

SEQ ID NO: 933949 - DNA, 25 bp, Mus musculus
gatcttgcttagatggcaggttcag

SEQ ID NO: 933950 - DNA, 25 bp, Mus musculus
gatcttgcttagttggcaggttcag

SEQ ID NO: 933951 - DNA, 25 bp, Mus musculus
gatcttgtagagaacgcatctgtgg

SEQ ID NO: 933952 - DNA, 25 bp, Mus musculus
gatcttgtagagaaggcatctgtgg

SEQ ID NO: 933953 - DNA, 25 bp, Mus musculus
gatctttacatttcaagggcctgca

SEQ ID NO: 933954 - DNA, 25 bp, Mus musculus
gatctttacatttctagggcctgca

SEQ ID NO: 933955 - DNA, 25 bp, Mus musculus
gatctttatgctacagaaccatggt

SEQ ID NO: 933956 - DNA, 25 bp, Mus musculus
gatctttatggtacagaaccatggt

SEQ ID NO: 933957 - DNA, 25 bp, Mus musculus
gatctttcacgacacggctgagtac

SEQ ID NO: 933958 - DNA, 25 bp, Mus musculus
gatctttcacgacagggctgagtac

SEQ ID NO: 933959 - DNA, 25 bp, Mus musculus
gatctttcagcgatactccttcgtg

SEQ ID NO: 933960 - DNA, 25 bp, Mus musculus
gatctttcagggatactccttcgtg

SEQ ID NO: 933961 - DNA, 25 bp, Mus musculus
gatcttttcgcacaagccacagaag

SEQ ID NO: 933962 - DNA, 25 bp, Mus musculus
gatcttttcgcagaagccacagaag

SEQ ID NO: 933963 - DNA, 25 bp, Mus musculus
gatgaaaacccactgagatgagtca

SEQ ID NO: 933964 - DNA, 25 bp, Mus musculus
gatgaaaacccagtgagatgagtca

SEQ ID NO: 933965 - DNA, 25 bp, Mus musculus
gatgaaaactacatggaatttctag

SEQ ID NO: 933966 - DNA, 25 bp, Mus musculus
gatgaaaacttcatggaatttctag

SEQ ID NO: 933967 - DNA, 25 bp, Mus musculus
gatgaaaagaacaacaccatcatta

SEQ ID NO: 933968 - DNA, 25 bp, Mus musculus
gatgaaaagaacaagaccatcatta

SEQ ID NO: 933969 - DNA, 25 bp, Mus musculus
gatgaaacagcagccggttcgatct

SEQ ID NO: 933970 - DNA, 25 bp, Mus musculus
gatgaaacaggagccggttcgatct

SEQ ID NO: 933971 - DNA, 25 bp, Mus musculus
gatgaaagacgtctagacatggatg

SEQ ID NO: 933972 - DNA, 25 bp, Mus musculus
gatgaaagacgtgtagacatggatg

SEQ ID NO: 933973 - DNA, 25 bp, Mus musculus
gatgaaaggcgacttttatgtcatt

SEQ ID NO: 933974 - DNA, 25 bp, Mus musculus
gatgaaaggcgagttttatgtcatt

SEQ ID NO: 933975 - DNA, 25 bp, Mus musculus
gatgaaatagactctttcctacgaa

SEQ ID NO: 933976 - DNA, 25 bp, Mus musculus
gatgaaatagtctctttcctacgaa

SEQ ID NO: 933977 - DNA, 25 bp, Mus musculus
gatgaaatcaagcaacaagcaatgg

SEQ ID NO: 933978 - DNA, 25 bp, Mus musculus
gatgaaatcaagctaactatggatg

SEQ ID NO: 933979 - DNA, 25 bp, Mus musculus
gatgaaatcaaggaacaagcaatgg

SEQ ID NO: 933980 - DNA, 25 bp, Mus musculus
gatgaaatcaaggtaactatggatg

SEQ ID NO: 933981 - DNA, 25 bp, Mus musculus
gatgaaatcacacaactagacaccc

SEQ ID NO: 933982 - DNA, 25 bp, Mus musculus
gatgaaatcacagaactagacaccc

SEQ ID NO: 933983 - DNA, 25 bp, Mus musculus
gatgaaatgccgattggttgtatca

SEQ ID NO: 933984 - DNA, 25 bp, Mus musculus
gatgaaatgccgtttggttgtatca

SEQ ID NO: 933985 - DNA, 25 bp, Mus musculus
gatgaaattgatcaggctcgtgtga

SEQ ID NO: 933986 - DNA, 25 bp, Mus musculus
gatgaaattgatgaggctcgtgtga

SEQ ID NO: 933987 - DNA, 25 bp, Mus musculus
gatgaaattttccacgtccactggt

SEQ ID NO: 933988 - DNA, 25 bp, Mus musculus
gatgaaattttccaggtccactggt

SEQ ID NO: 933989 - DNA, 25 bp, Mus musculus
gatgaacaagagctgtactaccaag

SEQ ID NO: 933990 - DNA, 25 bp, Mus musculus
gatgaacaagaggtgtactaccaag

SEQ ID NO: 933991 - DNA, 25 bp, Mus musculus
gatgaacacacactatggcttagaa

SEQ ID NO: 933992 - DNA, 25 bp, Mus musculus
gatgaacacacagtatggcttagaa

SEQ ID NO: 933993 - DNA, 25 bp, Mus musculus
gatgaacactaaaacccagcaccag

SEQ ID NO: 933994 - DNA, 25 bp, Mus musculus
gatgaacacttaaacccagcaccag

SEQ ID NO: 933995 - DNA, 25 bp, Mus musculus
gatgaacagagaaacaaagttgaaa

SEQ ID NO: 933996 - DNA, 25 bp, Mus musculus
gatgaacagagaaagaaagttgaaa

SEQ ID NO: 933997 - DNA, 25 bp, Mus musculus
gatgaacccaatcgttatgatgatg

SEQ ID NO: 933998 - DNA, 25 bp, Mus musculus
gatgaacccaatggttatgatgatg

SEQ ID NO: 933999 - DNA, 25 bp, Mus musculus
gatgaacttaaacgtgacaacatgt

SEQ ID NO: 934000 - DNA, 25 bp, Mus musculus
gatgaacttaaaggtgacaacatgt

SEQ ID NO: 934001 - DNA, 25 bp, Mus musculus
gatgaagaagatattgcctcacgct

SEQ ID NO: 934002 - DNA, 25 bp, Mus musculus
gatgaagaagcaaagggagctgtgt

SEQ ID NO: 934003 - DNA, 25 bp, Mus musculus
gatgaagaagctgctgtgtttggcc

SEQ ID NO: 934004 - DNA, 25 bp, Mus musculus
gatgaagaaggaaagggagctgtgt

SEQ ID NO: 934005 - DNA, 25 bp, Mus musculus
gatgaagaaggtgctgtgtttggcc

SEQ ID NO: 934006 - DNA, 25 bp, Mus musculus
gatgaagaagttattgcctcacgct

SEQ ID NO: 934007 - DNA, 25 bp, Mus musculus
gatgaagagcagaactttctacaac

SEQ ID NO: 934008 - DNA, 25 bp, Mus musculus
gatgaagagcagtactttctacaac

SEQ ID NO: 934009 - DNA, 25 bp, Mus musculus
gatgaagatatgctaaccgagatcc

SEQ ID NO: 934010 - DNA, 25 bp, Mus musculus
gatgaagatatggtaaccgagatcc

SEQ ID NO: 934011 - DNA, 25 bp, Mus musculus
gatgaagatgaggagcaagaaattc

SEQ ID NO: 934012 - DNA, 25 bp, Mus musculus
gatgaagatgtggagcaagaaattc

SEQ ID NO: 934013 - DNA, 25 bp, Mus musculus
gatgaagcaaccacactgggtgccc

SEQ ID NO: 934014 - DNA, 25 bp, Mus musculus
gatgaagcaagcacactgggtgccc

SEQ ID NO: 934015 - DNA, 25 bp, Mus musculus
gatgaagcccgacatctgcggcagg

SEQ ID NO: 934016 - DNA, 25 bp, Mus musculus
gatgaagcccgagatctgcggcagg

SEQ ID NO: 934017 - DNA, 25 bp, Mus musculus
gatgaagcgaagatgcaacagacag

SEQ ID NO: 934018 - DNA, 25 bp, Mus musculus
gatgaagcgaagttgcaacagacag

SEQ ID NO: 934019 - DNA, 25 bp, Mus musculus
gatgaagctcgtgacatttttgatg

SEQ ID NO: 934020 - DNA, 25 bp, Mus musculus
gatgaagctcgtgagatttttgatg

SEQ ID NO: 934021 - DNA, 25 bp, Mus musculus
gatgaagctgagcaagatggcattg

SEQ ID NO: 934022 - DNA, 25 bp, Mus musculus
gatgaagctgaggaagatggcattg

SEQ ID NO: 934023 - DNA, 25 bp, Mus musculus
gatgaaggacaacaccctctggaga

SEQ ID NO: 934024 - DNA, 25 bp, Mus musculus
gatgaaggacaagaccctctggaga

SEQ ID NO: 934025 - DNA, 25 bp, Mus musculus
gatgaaggctagctacagtttctct

SEQ ID NO: 934026 - DNA, 25 bp, Mus musculus
gatgaaggcttgctacagtttctct

SEQ ID NO: 934027 - DNA, 25 bp, Mus musculus
gatgaagtagagctatattcaagag

SEQ ID NO: 934028 - DNA, 25 bp, Mus musculus
gatgaagtagaggtatattcaagag

SEQ ID NO: 934029 - DNA, 25 bp, Mus musculus
gatgaagtgctgcattatggctatg

SEQ ID NO: 934030 - DNA, 25 bp, Mus musculus
gatgaagtgctggattatggctatg

SEQ ID NO: 934031 - DNA, 25 bp, Mus musculus
gatgaatatccacagactaagtctg

SEQ ID NO: 934032 - DNA, 25 bp, Mus musculus
gatgaatatccagagactaagtctg

SEQ ID NO: 934033 - DNA, 25 bp, Mus musculus
gatgaatatgaaaaggtggacaagt

SEQ ID NO: 934034 - DNA, 25 bp, Mus musculus
gatgaatatgaaaatgaaacatttt

SEQ ID NO: 934035 - DNA, 25 bp, Mus musculus
gatgaatatgaacatgttgtagaag

SEQ ID NO: 934036 - DNA, 25 bp, Mus musculus
gatgaatatgaagatgttgtagaag

SEQ ID NO: 934037 - DNA, 25 bp, Mus musculus
gatgaatatgaatatgaaacatttt

SEQ ID NO: 934038 - DNA, 25 bp, Mus musculus
gatgaatatgtaaaggtggacaagt

SEQ ID NO: 934039 - DNA, 25 bp, Mus musculus
gatgaatgcaggacagtctccttag

SEQ ID NO: 934040 - DNA, 25 bp, Mus musculus
gatgaatgcaggactgtctccttag

SEQ ID NO: 934041 - DNA, 25 bp, Mus musculus
gatgaatgtcagacctgatgtgaac

SEQ ID NO: 934042 - DNA, 25 bp, Mus musculus
gatgaatgtcagtcctgatgtgaac

SEQ ID NO: 934043 - DNA, 25 bp, Mus musculus
gatgaatgtgccttccgacaaggac

SEQ ID NO: 934044 - DNA, 25 bp, Mus musculus
gatgaatgtggcttccgacaaggac

SEQ ID NO: 934045 - DNA, 25 bp, Mus musculus
gatgacaaagcagacaatgaggaac

SEQ ID NO: 934046 - DNA, 25 bp, Mus musculus
gatgacaaagcagagaatgaggaac

SEQ ID NO: 934047 - DNA, 25 bp, Mus musculus
gatgacaaagccaccatttgtaatg

SEQ ID NO: 934048 - DNA, 25 bp, Mus musculus
gatgacaaaggcaccatttgtaatg

SEQ ID NO: 934049 - DNA, 25 bp, Mus musculus
gatgacaaagttaattccacaaacg

SEQ ID NO: 934050 - DNA, 25 bp, Mus musculus
gatgacaaagtttattccacaaacg

SEQ ID NO: 934051 - DNA, 25 bp, Mus musculus
gatgacaagaaacgaattgtggacc

SEQ ID NO: 934052 - DNA, 25 bp, Mus musculus
gatgacaagaaaggaattgtggacc

SEQ ID NO: 934053 - DNA, 25 bp, Mus musculus
gatgacaatcaaactggattatgga

SEQ ID NO: 934054 - DNA, 25 bp, Mus musculus
gatgacaatcaatctggattatgga

SEQ ID NO: 934055 - DNA, 25 bp, Mus musculus
gatgacaatgcaagaaatttcaata

SEQ ID NO: 934056 - DNA, 25 bp, Mus musculus
gatgacaatggaagaaatttcaata

SEQ ID NO: 934057 - DNA, 25 bp, Mus musculus
gatgacacagaacactttgttgctg

SEQ ID NO: 934058 - DNA, 25 bp, Mus musculus
gatgacacagaagactttgttgctg

SEQ ID NO: 934059 - DNA, 25 bp, Mus musculus
gatgacacataaagtggacgattgt

SEQ ID NO: 934060 - DNA, 25 bp, Mus musculus
gatgacacataatgtggacgattgt

SEQ ID NO: 934061 - DNA, 25 bp, Mus musculus
gatgacacctgacgatttgacggcc

SEQ ID NO: 934062 - DNA, 25 bp, Mus musculus
gatgacacctgaggatttgacggcc

SEQ ID NO: 934063 - DNA, 25 bp, Mus musculus
gatgacagctatctccccagtgacc

SEQ ID NO: 934064 - DNA, 25 bp, Mus musculus
gatgacagctatgtccccagtgacc

SEQ ID NO: 934065 - DNA, 25 bp, Mus musculus
gatgacagtgaaaacaatccatcga

SEQ ID NO: 934066 - DNA, 25 bp, Mus musculus
gatgacagtgaaaagaatccatcga

SEQ ID NO: 934067 - DNA, 25 bp, Mus musculus
gatgacatcaagaacggagaagaaa

SEQ ID NO: 934068 - DNA, 25 bp, Mus musculus
gatgacatcaagaagggagaagaaa

SEQ ID NO: 934069 - DNA, 25 bp, Mus musculus
gatgacattgcacctctaccaatgg

SEQ ID NO: 934070 - DNA, 25 bp, Mus musculus
gatgacattgcagctctaccaatgg

SEQ ID NO: 934071 - DNA, 25 bp, Mus musculus
gatgaccaactctgccttgttatgg

SEQ ID NO: 934072 - DNA, 25 bp, Mus musculus
gatgaccaactctggcttgttatgg

SEQ ID NO: 934073 - DNA, 25 bp, Mus musculus
gatgaccagacttacaagcaccttt

SEQ ID NO: 934074 - DNA, 25 bp, Mus musculus
gatgaccagagttacaagcaccttt

SEQ ID NO: 934075 - DNA, 25 bp, Mus musculus
gatgaccatgagacgcttgccctgg

SEQ ID NO: 934076 - DNA, 25 bp, Mus musculus
gatgaccatgagtcgcttgccctgg

SEQ ID NO: 934077 - DNA, 25 bp, Mus musculus
gatgaccgtaccaacggatagccca

SEQ ID NO: 934078 - DNA, 25 bp, Mus musculus
gatgaccgtaccaagggatagccca

SEQ ID NO: 934079 - DNA, 25 bp, Mus musculus
gatgaccgtgcccaacgtgctggcc

SEQ ID NO: 934080 - DNA, 25 bp, Mus musculus
gatgaccgtgccgaacgtgctggcc

SEQ ID NO: 934081 - DNA, 25 bp, Mus musculus
gatgacctagccaagtcggctttgc

SEQ ID NO: 934082 - DNA, 25 bp, Mus musculus
gatgacctaggcaagtcggctttgc

SEQ ID NO: 934083 - DNA, 25 bp, Mus musculus
gatgacctcatcacagatctgctaa

SEQ ID NO: 934084 - DNA, 25 bp, Mus musculus
gatgacctcatcactgatctgctaa

SEQ ID NO: 934085 - DNA, 25 bp, Mus musculus
gatgacctccaacggcccaatgtaa

SEQ ID NO: 934086 - DNA, 25 bp, Mus musculus
gatgacctccaagggcccaatgtaa

SEQ ID NO: 934087 - DNA, 25 bp, Mus musculus
gatgacctggaacacgagctctatg

SEQ ID NO: 934088 - DNA, 25 bp, Mus musculus
gatgacctggaacataaactgaagt

SEQ ID NO: 934089 - DNA, 25 bp, Mus musculus
gatgacctggaacccctcgtcaaac

SEQ ID NO: 934090 - DNA, 25 bp, Mus musculus
gatgacctggaagacgagctctatg

SEQ ID NO: 934091 - DNA, 25 bp, Mus musculus
gatgacctggaagataaactgaagt

SEQ ID NO: 934092 - DNA, 25 bp, Mus musculus
gatgacctggaagccctcgtcaaac

SEQ ID NO: 934093 - DNA, 25 bp, Mus musculus
gatgacgaagtgaatcgcatgcacg

SEQ ID NO: 934094 - DNA, 25 bp, Mus musculus
gatgacgaagtgtatcgcatgcacg

SEQ ID NO: 934095 - DNA, 25 bp, Mus musculus
gatgacgattacaacgatgtgcaga

SEQ ID NO: 934096 - DNA, 25 bp, Mus musculus
gatgacgattacaaggatgtgcaga

SEQ ID NO: 934097 - DNA, 25 bp, Mus musculus
gatgacgtcttgcctcatgctgcct

SEQ ID NO: 934098 - DNA, 25 bp, Mus musculus
gatgacgtcttggctcatgctgcct

SEQ ID NO: 934099 - DNA, 25 bp, Mus musculus
gatgactaagatgctaaaaggattc

SEQ ID NO: 934100 - DNA, 25 bp, Mus musculus
gatgactaagttgctaaaaggattc

SEQ ID NO: 934101 - DNA, 25 bp, Mus musculus
gatgactacttcaacgataaaagag

SEQ ID NO: 934102 - DNA, 25 bp, Mus musculus
gatgactacttcaaggataaaagag

SEQ ID NO: 934103 - DNA, 25 bp, Mus musculus
gatgactgaaatctacttaaaattc

SEQ ID NO: 934104 - DNA, 25 bp, Mus musculus
gatgactgaaatgtacttaaaattc

SEQ ID NO: 934105 - DNA, 25 bp, Mus musculus
gatgactgtggccattgtgaaagca

SEQ ID NO: 934106 - DNA, 25 bp, Mus musculus
gatgactgtggcgattgtgaaagca

SEQ ID NO: 934107 - DNA, 25 bp, Mus musculus
gatgacttaccacggtttgacctga

SEQ ID NO: 934108 - DNA, 25 bp, Mus musculus
gatgacttaccagggtttgacctga

SEQ ID NO: 934109 - DNA, 25 bp, Mus musculus
gatgacttagaacacgagctgtatg

SEQ ID NO: 934110 - DNA, 25 bp, Mus musculus
gatgacttagaacagaaagtggccc

SEQ ID NO: 934111 - DNA, 25 bp, Mus musculus
gatgacttagaacataagtttcttt

SEQ ID NO: 934112 - DNA, 25 bp, Mus musculus
gatgacttagaacatcaactctacc

SEQ ID NO: 934113 - DNA, 25 bp, Mus musculus
gatgacttagaagacgagctgtatg

SEQ ID NO: 934114 - DNA, 25 bp, Mus musculus
gatgacttagaagagaaagtggccc

SEQ ID NO: 934115 - DNA, 25 bp, Mus musculus
gatgacttagaagataagtttcttt

SEQ ID NO: 934116 - DNA, 25 bp, Mus musculus
gatgacttagaagatcaactctacc

SEQ ID NO: 934117 - DNA, 25 bp, Mus musculus
gatgacttcccgctcctggtcccgt

SEQ ID NO: 934118 - DNA, 25 bp, Mus musculus
gatgacttcccgctgctggtcccgt

SEQ ID NO: 934119 - DNA, 25 bp, Mus musculus
gatgacttccggagggctttgagtc

SEQ ID NO: 934120 - DNA, 25 bp, Mus musculus
gatgacttccggtgggctttgagtc

SEQ ID NO: 934121 - DNA, 25 bp, Mus musculus
gatgagaaagctcatttactacatg

SEQ ID NO: 934122 - DNA, 25 bp, Mus musculus
gatgagaaaggtcatttactacatg

SEQ ID NO: 934123 - DNA, 25 bp, Mus musculus
gatgagaacatgagcacctgcgaca

SEQ ID NO: 934124 - DNA, 25 bp, Mus musculus
gatgagaacatgtgcacctgcgaca

SEQ ID NO: 934125 - DNA, 25 bp, Mus musculus
gatgagaatgaatgcagagtcatga

SEQ ID NO: 934126 - DNA, 25 bp, Mus musculus
gatgagaatgtatgcagagtcatga

SEQ ID NO: 934127 - DNA, 25 bp, Mus musculus
gatgagacagcagacaatcaggctc

SEQ ID NO: 934128 - DNA, 25 bp, Mus musculus
gatgagacaggagacaatcaggctc

SEQ ID NO: 934129 - DNA, 25 bp, Mus musculus
gatgagacccacatcgaatggacct

SEQ ID NO: 934130 - DNA, 25 bp, Mus musculus
gatgagacccacatggaatggacct

SEQ ID NO: 934131 - DNA, 25 bp, Mus musculus
gatgagagtaagatctcgttttata

SEQ ID NO: 934132 - DNA, 25 bp, Mus musculus
gatgagagtaagttctcgttttata

SEQ ID NO: 934133 - DNA, 25 bp, Mus musculus
gatgagagttgtgacgagatccccc

SEQ ID NO: 934134 - DNA, 25 bp, Mus musculus
gatgagagttgtgaggagatccccc

SEQ ID NO: 934135 - DNA, 25 bp, Mus musculus
gatgagatacaacggtcaatataga

SEQ ID NO: 934136 - DNA, 25 bp, Mus musculus
gatgagatacaacgtgtagtggctg

SEQ ID NO: 934137 - DNA, 25 bp, Mus musculus
gatgagatacaagggtcaatataga

SEQ ID NO: 934138 - DNA, 25 bp, Mus musculus
gatgagatacaaggtgtagtggctg

SEQ ID NO: 934139 - DNA, 25 bp, Mus musculus
gatgagattctacttaatgctgctg

SEQ ID NO: 934140 - DNA, 25 bp, Mus musculus
gatgagattctagttaatgctgctg

SEQ ID NO: 934141 - DNA, 25 bp, Mus musculus
gatgagcaggagccggccccgtgac

SEQ ID NO: 934142 - DNA, 25 bp, Mus musculus
gatgagcaggtgccggccccgtgac

SEQ ID NO: 934143 - DNA, 25 bp, Mus musculus
gatgagcctgccacagctgcttgtc

SEQ ID NO: 934144 - DNA, 25 bp, Mus musculus
gatgagcctggcacagctgcttgtc

SEQ ID NO: 934145 - DNA, 25 bp, Mus musculus
gatgagcgcaggctgtactacgagg

SEQ ID NO: 934146 - DNA, 25 bp, Mus musculus
gatgagcgcagggtgtactacgagg

SEQ ID NO: 934147 - DNA, 25 bp, Mus musculus
gatgagctacttcaaaagtaaagaa

SEQ ID NO: 934148 - DNA, 25 bp, Mus musculus
gatgagctacttgaaaagtaaagaa

SEQ ID NO: 934149 - DNA, 25 bp, Mus musculus
gatgagctcaagactgaagtgtcct

SEQ ID NO: 934150 - DNA, 25 bp, Mus musculus
gatgagctcaagcgtttagcctggt

SEQ ID NO: 934151 - DNA, 25 bp, Mus musculus
gatgagctcaagggtttagcctggt

SEQ ID NO: 934152 - DNA, 25 bp, Mus musculus
gatgagctcaagtctgaagtgtcct

SEQ ID NO: 934153 - DNA, 25 bp, Mus musculus
gatgagctcatggacagagcagtag

SEQ ID NO: 934154 - DNA, 25 bp, Mus musculus
gatgagctcatggaccttgagatct

SEQ ID NO: 934155 - DNA, 25 bp, Mus musculus
gatgagctcatggagagagcagtag

SEQ ID NO: 934156 - DNA, 25 bp, Mus musculus
gatgagctcatggagcttgagatct

SEQ ID NO: 934157 - DNA, 25 bp, Mus musculus
gatgagctctcacacttaaaggaat

SEQ ID NO: 934158 - DNA, 25 bp, Mus musculus
gatgagctctcacagttaaaggaat

SEQ ID NO: 934159 - DNA, 25 bp, Mus musculus
gatgagcttgccctcgtcaggcagc

SEQ ID NO: 934160 - DNA, 25 bp, Mus musculus
gatgagcttgccctggtcaggcagc

SEQ ID NO: 934161 - DNA, 25 bp, Mus musculus
gatgaggaagaggacctccctgtgc

SEQ ID NO: 934162 - DNA, 25 bp, Mus musculus
gatgaggaagaggagctccctgtgc

SEQ ID NO: 934163 - DNA, 25 bp, Mus musculus
gatgaggaccagctggtagttaata

SEQ ID NO: 934164 - DNA, 25 bp, Mus musculus
gatgaggaccaggtggtagttaata

SEQ ID NO: 934165 - DNA, 25 bp, Mus musculus
gatgaggagatcaacaggatagata

SEQ ID NO: 934166 - DNA, 25 bp, Mus musculus
gatgaggagatcaacgacttgcacc

SEQ ID NO: 934167 - DNA, 25 bp, Mus musculus
gatgaggagatcaagaggatagata

SEQ ID NO: 934168 - DNA, 25 bp, Mus musculus
gatgaggagatcaaggacttgcacc

SEQ ID NO: 934169 - DNA, 25 bp, Mus musculus
gatgaggagatgaaccgcatgcatg

SEQ ID NO: 934170 - DNA, 25 bp, Mus musculus
gatgaggagatgtaccgcatgcatg

SEQ ID NO: 934171 - DNA, 25 bp, Mus musculus
gatgaggagcagactttcctgcagc

SEQ ID NO: 934172 - DNA, 25 bp, Mus musculus
gatgaggagcagtctttcctgcagc

SEQ ID NO: 934173 - DNA, 25 bp, Mus musculus
gatgaggatgaactcaagttccttc

SEQ ID NO: 934174 - DNA, 25 bp, Mus musculus
gatgaggatgaactgaagttccttc

SEQ ID NO: 934175 - DNA, 25 bp, Mus musculus
gatgaggcctcacgcacctgcgaag

SEQ ID NO: 934176 - DNA, 25 bp, Mus musculus
gatgaggcctcaggcacctgcgaag

SEQ ID NO: 934177 - DNA, 25 bp, Mus musculus
gatgaggcgaagcaaagctcacaac

SEQ ID NO: 934178 - DNA, 25 bp, Mus musculus
gatgaggcgaaggaaagctcacaac

SEQ ID NO: 934179 - DNA, 25 bp, Mus musculus
gatgaggggcagttatttcctgaca

SEQ ID NO: 934180 - DNA, 25 bp, Mus musculus
gatgaggggcagttttttcctgaca

SEQ ID NO: 934181 - DNA, 25 bp, Mus musculus
gatgagggtaagaatcagatggaga

SEQ ID NO: 934182 - DNA, 25 bp, Mus musculus
gatgagggtaagtatcagatggaga

SEQ ID NO: 934183 - DNA, 25 bp, Mus musculus
gatgagtacaaaccatacgaggaaa

SEQ ID NO: 934184 - DNA, 25 bp, Mus musculus
gatgagtacaaagcatacgaggaaa

SEQ ID NO: 934185 - DNA, 25 bp, Mus musculus
gatgagtccacccgaagcattgcca

SEQ ID NO: 934186 - DNA, 25 bp, Mus musculus
gatgagtccaccggaagcattgcca

SEQ ID NO: 934187 - DNA, 25 bp, Mus musculus
gatgagtctcagcaacctgacagaa

SEQ ID NO: 934188 - DNA, 25 bp, Mus musculus
gatgagtctcagcttccacgagtac

SEQ ID NO: 934189 - DNA, 25 bp, Mus musculus
gatgagtctcaggaacctgacagaa

SEQ ID NO: 934190 - DNA, 25 bp, Mus musculus
gatgagtctcaggttccacgagtac

SEQ ID NO: 934191 - DNA, 25 bp, Mus musculus
gatgagtggaagagcctgacctatg

SEQ ID NO: 934192 - DNA, 25 bp, Mus musculus
gatgagtggaagtgcctgacctatg

SEQ ID NO: 934193 - DNA, 25 bp, Mus musculus
gatgagtgggagatccacttcacag

SEQ ID NO: 934194 - DNA, 25 bp, Mus musculus
gatgagtgggagttccacttcacag

SEQ ID NO: 934195 - DNA, 25 bp, Mus musculus
gatgagttagaggctaacggccaga

SEQ ID NO: 934196 - DNA, 25 bp, Mus musculus
gatgagttagattagaggctaacgg

SEQ ID NO: 934197 - DNA, 25 bp, Mus musculus
gatgagttagcctaacggccagaga

SEQ ID NO: 934198 - DNA, 25 bp, Mus musculus
gatgagttaggctaacggccagaga

SEQ ID NO: 934199 - DNA, 25 bp, Mus musculus
gatgagttagtggctaacggccaga

SEQ ID NO: 934200 - DNA, 25 bp, Mus musculus
gatgagttagtttagaggctaacgg

SEQ ID NO: 934201 - DNA, 25 bp, Mus musculus
gatgagttcaagcccttgctgtatc

SEQ ID NO: 934202 - DNA, 25 bp, Mus musculus
gatgagttcaagctggtggtcgtgc

SEQ ID NO: 934203 - DNA, 25 bp, Mus musculus
gatgagttcaaggccttgctgtatc

SEQ ID NO: 934204 - DNA, 25 bp, Mus musculus
gatgagttcaaggtggtggtcgtgc

SEQ ID NO: 934205 - DNA, 25 bp, Mus musculus
gatgagtttaagacacagagtgtga

SEQ ID NO: 934206 - DNA, 25 bp, Mus musculus
gatgagtttaagtcacagagtgtga

SEQ ID NO: 934207 - DNA, 25 bp, Mus musculus
gatgagtttatcaacgtcttccatg

SEQ ID NO: 934208 - DNA, 25 bp, Mus musculus
gatgagtttatcaaggtcttccatg

SEQ ID NO: 934209 - DNA, 25 bp, Mus musculus
gatgagtttgacaacatgcgggaag

SEQ ID NO: 934210 - DNA, 25 bp, Mus musculus
gatgagtttgacaagatgcgggaag

SEQ ID NO: 934211 - DNA, 25 bp, Mus musculus
gatgataaaaacaaagcccactatg

SEQ ID NO: 934212 - DNA, 25 bp, Mus musculus
gatgataaaaacaatgcccactatg

SEQ ID NO: 934213 - DNA, 25 bp, Mus musculus
gatgataacacctgctctcatcgct

SEQ ID NO: 934214 - DNA, 25 bp, Mus musculus
gatgataacactcaagtaatccctc

SEQ ID NO: 934215 - DNA, 25 bp, Mus musculus
gatgataacactgaagtaatccctc

SEQ ID NO: 934216 - DNA, 25 bp, Mus musculus
gatgataacagctgctctcatcgct

SEQ ID NO: 934217 - DNA, 25 bp, Mus musculus
gatgataagaatctgtatgttctgg

SEQ ID NO: 934218 - DNA, 25 bp, Mus musculus
gatgataagaatgtgtatgttctgg

SEQ ID NO: 934219 - DNA, 25 bp, Mus musculus
gatgatacagagcatgtggtgatcg

SEQ ID NO: 934220 - DNA, 25 bp, Mus musculus
gatgatacagtgcatgtggtgatcg

SEQ ID NO: 934221 - DNA, 25 bp, Mus musculus
gatgatacctcgaaaaatggtgaaa

SEQ ID NO: 934222 - DNA, 25 bp, Mus musculus
gatgatacctggaaaaatggtgaaa

SEQ ID NO: 934223 - DNA, 25 bp, Mus musculus
gatgatatcaacaacgttgtgctgt

SEQ ID NO: 934224 - DNA, 25 bp, Mus musculus
gatgatatcaacaaggttgtgctgt

SEQ ID NO: 934225 - DNA, 25 bp, Mus musculus
gatgatattcaaccgtctgttgcgg

SEQ ID NO: 934226 - DNA, 25 bp, Mus musculus
gatgatattcaacgaacagcgtctg

SEQ ID NO: 934227 - DNA, 25 bp, Mus musculus
gatgatattcaagcgtctgttgcgg

SEQ ID NO: 934228 - DNA, 25 bp, Mus musculus
gatgatattcaaggaacagcgtctg

SEQ ID NO: 934229 - DNA, 25 bp, Mus musculus
gatgatattggtcatgtaaccatta

SEQ ID NO: 934230 - DNA, 25 bp, Mus musculus
gatgatattggtgatgtaaccatta

SEQ ID NO: 934231 - DNA, 25 bp, Mus musculus
gatgatcaagaatttcaagaagcag

SEQ ID NO: 934232 - DNA, 25 bp, Mus musculus
gatgatcaagctcacaaagacagaa

SEQ ID NO: 934233 - DNA, 25 bp, Mus musculus
gatgatcaaggtcacaaagacagaa

SEQ ID NO: 934234 - DNA, 25 bp, Mus musculus
gatgatcaagtatttcaagaagcag

SEQ ID NO: 934235 - DNA, 25 bp, Mus musculus
gatgatcacggcctaccctggatga

SEQ ID NO: 934236 - DNA, 25 bp, Mus musculus
gatgatcacggccttccctggatga

SEQ ID NO: 934237 - DNA, 25 bp, Mus musculus
gatgatccgagacgccttggaagct

SEQ ID NO: 934238 - DNA, 25 bp, Mus musculus
gatgatccgagaggccttggaagct

SEQ ID NO: 934239 - DNA, 25 bp, Mus musculus
gatgatcgtcgtcgaccaatgaaaa

SEQ ID NO: 934240 - DNA, 25 bp, Mus musculus
gatgatcgtcgtggaccaatgaaaa

SEQ ID NO: 934241 - DNA, 25 bp, Mus musculus
gatgatcgtgcaccctgccatcagc

SEQ ID NO: 934242 - DNA, 25 bp, Mus musculus
gatgatcgtgccgggatccgcagaa

SEQ ID NO: 934243 - DNA, 25 bp, Mus musculus
gatgatcgtgctttggcctggaacc

SEQ ID NO: 934244 - DNA, 25 bp, Mus musculus
gatgatcgtggaccctgccatcagc

SEQ ID NO: 934245 - DNA, 25 bp, Mus musculus
gatgatcgtggcgggatccgcagaa

SEQ ID NO: 934246 - DNA, 25 bp, Mus musculus
gatgatcgtggtttggcctggaacc

SEQ ID NO: 934247 - DNA, 25 bp, Mus musculus
gatgatctacagaactcgttatggg

SEQ ID NO: 934248 - DNA, 25 bp, Mus musculus
gatgatctacagtactcgttatggg

SEQ ID NO: 934249 - DNA, 25 bp, Mus musculus
gatgatcttgcttttgagttctttg

SEQ ID NO: 934250 - DNA, 25 bp, Mus musculus
gatgatcttggttttgagttctttg

SEQ ID NO: 934251 - DNA, 25 bp, Mus musculus
gatgatgcagactttccagagggat

SEQ ID NO: 934252 - DNA, 25 bp, Mus musculus
gatgatgcagtctttccagagggat

SEQ ID NO: 934253 - DNA, 25 bp, Mus musculus
gatgatgccaacatgtgcattgcta

SEQ ID NO: 934254 - DNA, 25 bp, Mus musculus
gatgatgccatcatgtgcattgcta

SEQ ID NO: 934255 - DNA, 25 bp, Mus musculus
gatgatgtcattcctgatgacagct

SEQ ID NO: 934256 - DNA, 25 bp, Mus musculus
gatgatgtcattgctgatgacagct

SEQ ID NO: 934257 - DNA, 25 bp, Mus musculus
gatgatgtccctccaccagatggaa

SEQ ID NO: 934258 - DNA, 25 bp, Mus musculus
gatgatgtccctgcaccagatggaa

SEQ ID NO: 934259 - DNA, 25 bp, Mus musculus
gatgatgttggtcatctgaaaacat

SEQ ID NO: 934260 - DNA, 25 bp, Mus musculus
gatgatgttggtgatctgaaaacat

SEQ ID NO: 934261 - DNA, 25 bp, Mus musculus
gatgatgtttttgacgaatctgaag

SEQ ID NO: 934262 - DNA, 25 bp, Mus musculus
gatgatgtttttgaggaatctgaag

SEQ ID NO: 934263 - DNA, 25 bp, Mus musculus
gatgattaacctcgtgctggatttc

SEQ ID NO: 934264 - DNA, 25 bp, Mus musculus
gatgattaacctggtgctggatttc

SEQ ID NO: 934265 - DNA, 25 bp, Mus musculus
gatgattcggctcacggaaaattga

SEQ ID NO: 934266 - DNA, 25 bp, Mus musculus
gatgattcggctcagggaaaattga

SEQ ID NO: 934267 - DNA, 25 bp, Mus musculus
gatgattgagcatgcaattcgaagt

SEQ ID NO: 934268 - DNA, 25 bp, Mus musculus
gatgattgaggatgcaattcgaagt

SEQ ID NO: 934269 - DNA, 25 bp, Mus musculus
gatgattttacactgtgctaccagt

SEQ ID NO: 934270 - DNA, 25 bp, Mus musculus
gatgattttacagtgtgctaccagt

SEQ ID NO: 934271 - DNA, 25 bp, Mus musculus
gatgattttgcaagttgctttaaag

SEQ ID NO: 934272 - DNA, 25 bp, Mus musculus
gatgattttggaagttgctttaaag

SEQ ID NO: 934273 - DNA, 25 bp, Mus musculus
gatgcaaggtgtaggggaataataa

SEQ ID NO: 934274 - DNA, 25 bp, Mus musculus
gatgcaaggtgttggggaataataa

SEQ ID NO: 934275 - DNA, 25 bp, Mus musculus
gatgcaatcaaacttgtcctgggga

SEQ ID NO: 934276 - DNA, 25 bp, Mus musculus
gatgcaatcaaagttgtcctgggga

SEQ ID NO: 934277 - DNA, 25 bp, Mus musculus
gatgcaattctacacataaatggaa

SEQ ID NO: 934278 - DNA, 25 bp, Mus musculus
gatgcaattctacagataaatggaa

SEQ ID NO: 934279 - DNA, 25 bp, Mus musculus
gatgcacaaacacgcggaaattgtg

SEQ ID NO: 934280 - DNA, 25 bp, Mus musculus
gatgcacaaacactgccccaggtac

SEQ ID NO: 934281 - DNA, 25 bp, Mus musculus
gatgcacaaacaggcggaaattgtg

SEQ ID NO: 934282 - DNA, 25 bp, Mus musculus
gatgcacaaacagtgccccaggtac

SEQ ID NO: 934283 - DNA, 25 bp, Mus musculus
gatgcacaagcacgctcctctgctg

SEQ ID NO: 934284 - DNA, 25 bp, Mus musculus
gatgcacaagcaggctcctctgctg

SEQ ID NO: 934285 - DNA, 25 bp, Mus musculus
gatgcacatcaacaaactggaggag

SEQ ID NO: 934286 - DNA, 25 bp, Mus musculus
gatgcacatcaagaaactggaggag

SEQ ID NO: 934287 - DNA, 25 bp, Mus musculus
gatgcacgggaacgaagtgggcagc

SEQ ID NO: 934288 - DNA, 25 bp, Mus musculus
gatgcacgggaaggaagtgggcagc

SEQ ID NO: 934289 - DNA, 25 bp, Mus musculus
gatgcactggtgcacgtgtatccag

SEQ ID NO: 934290 - DNA, 25 bp, Mus musculus
gatgcactggtgcaggtgtatccag

SEQ ID NO: 934291 - DNA, 25 bp, Mus musculus
gatgcactgtcacaacaagcctgcc

SEQ ID NO: 934292 - DNA, 25 bp, Mus musculus
gatgcactgtcacgttccgagtccg

SEQ ID NO: 934293 - DNA, 25 bp, Mus musculus
gatgcactgtcagaacaagcctgcc

SEQ ID NO: 934294 - DNA, 25 bp, Mus musculus
gatgcactgtcaggttccgagtccg

SEQ ID NO: 934295 - DNA, 25 bp, Mus musculus
gatgcagaagaaacacatggtgatg

SEQ ID NO: 934296 - DNA, 25 bp, Mus musculus
gatgcagaagaaactcatggtgatg

SEQ ID NO: 934297 - DNA, 25 bp, Mus musculus
gatgcagaccacccaggctttaaag

SEQ ID NO: 934298 - DNA, 25 bp, Mus musculus
gatgcagaccaccctggctttaaag

SEQ ID NO: 934299 - DNA, 25 bp, Mus musculus
gatgcagaccatggcgccgaggagg

SEQ ID NO: 934300 - DNA, 25 bp, Mus musculus
gatgcagaccatggggccgaggagg

SEQ ID NO: 934301 - DNA, 25 bp, Mus musculus
gatgcagacgcagaagcagttcttc

SEQ ID NO: 934302 - DNA, 25 bp, Mus musculus
gatgcagacggagaagcagttcttc

SEQ ID NO: 934303 - DNA, 25 bp, Mus musculus
gatgcagagacacgcacggtggttc

SEQ ID NO: 934304 - DNA, 25 bp, Mus musculus
gatgcagagacaggcacggtggttc

SEQ ID NO: 934305 - DNA, 25 bp, Mus musculus
gatgcagaggaacctccgggcagca

SEQ ID NO: 934306 - DNA, 25 bp, Mus musculus
gatgcagaggaagctccgggcagca

SEQ ID NO: 934307 - DNA, 25 bp, Mus musculus
gatgcagcatctgacgaacaagcaa

SEQ ID NO: 934308 - DNA, 25 bp, Mus musculus
gatgcagcatctgacgaagactctt

SEQ ID NO: 934309 - DNA, 25 bp, Mus musculus
gatgcagcatctgaggaacaagcaa

SEQ ID NO: 934310 - DNA, 25 bp, Mus musculus
gatgcagcatctgaggaagactctt

SEQ ID NO: 934311 - DNA, 25 bp, Mus musculus
gatgcagctcagaagcagatccaga

SEQ ID NO: 934312 - DNA, 25 bp, Mus musculus
gatgcagctcagtagcagatccaga

SEQ ID NO: 934313 - DNA, 25 bp, Mus musculus
gatgcagctgcaaacgagggctgct

SEQ ID NO: 934314 - DNA, 25 bp, Mus musculus
gatgcagctgcaaaggagggctgct

SEQ ID NO: 934315 - DNA, 25 bp, Mus musculus
gatgcaggaccactggatgcctgga

SEQ ID NO: 934316 - DNA, 25 bp, Mus musculus
gatgcaggaccagtggatgcctgga

SEQ ID NO: 934317 - DNA, 25 bp, Mus musculus
gatgcaggccaagaaacagactgca

SEQ ID NO: 934318 - DNA, 25 bp, Mus musculus
gatgcaggccaagatacagactgca

SEQ ID NO: 934319 - DNA, 25 bp, Mus musculus
gatgcagtgcagccaatacagagtg

SEQ ID NO: 934320 - DNA, 25 bp, Mus musculus
gatgcagtgcaggcaatacagagtg

SEQ ID NO: 934321 - DNA, 25 bp, Mus musculus
gatgcatctcggaaatactgctgac

SEQ ID NO: 934322 - DNA, 25 bp, Mus musculus
gatgcatctcggtaatactgctgac

SEQ ID NO: 934323 - DNA, 25 bp, Mus musculus
gatgcattgaagcatgtggatacgt

SEQ ID NO: 934324 - DNA, 25 bp, Mus musculus
gatgcattgaaggatgtggatacgt

SEQ ID NO: 934325 - DNA, 25 bp, Mus musculus
gatgccaaaaagcgcttcatccggc

SEQ ID NO: 934326 - DNA, 25 bp, Mus musculus
gatgccaaaaagggcttcatccggc

SEQ ID NO: 934327 - DNA, 25 bp, Mus musculus
gatgccaaggtgcctcatgtgcctg

SEQ ID NO: 934328 - DNA, 25 bp, Mus musculus
gatgccaaggtggctcatgtgcctg

SEQ ID NO: 934329 - DNA, 25 bp, Mus musculus
gatgccaagtttcagcatgccacca

SEQ ID NO: 934330 - DNA, 25 bp, Mus musculus
gatgccaagtttcagtctggagacg

SEQ ID NO: 934331 - DNA, 25 bp, Mus musculus
gatgccaagtttgagcatgccacca

SEQ ID NO: 934332 - DNA, 25 bp, Mus musculus
gatgccaagtttgagtctggagacg

SEQ ID NO: 934333 - DNA, 25 bp, Mus musculus
gatgccaataagcctgtggaagaaa

SEQ ID NO: 934334 - DNA, 25 bp, Mus musculus
gatgccaataaggctgtggaagaaa

SEQ ID NO: 934335 - DNA, 25 bp, Mus musculus
gatgccactgctaagaccacactga

SEQ ID NO: 934336 - DNA, 25 bp, Mus musculus
gatgccactgctactggcatagcac

SEQ ID NO: 934337 - DNA, 25 bp, Mus musculus
gatgccactggtaagaccacactga

SEQ ID NO: 934338 - DNA, 25 bp, Mus musculus
gatgccactggtactggcatagcac

SEQ ID NO: 934339 - DNA, 25 bp, Mus musculus
gatgccacttccaacgtagcgttgg

SEQ ID NO: 934340 - DNA, 25 bp, Mus musculus
gatgccacttccaaggtagcgttgg

SEQ ID NO: 934341 - DNA, 25 bp, Mus musculus
gatgccagatgacgatcatggctgc

SEQ ID NO: 934342 - DNA, 25 bp, Mus musculus
gatgccagatgaggatcatggctgc

SEQ ID NO: 934343 - DNA, 25 bp, Mus musculus
gatgccagcacacgcacacaaacca

SEQ ID NO: 934344 - DNA, 25 bp, Mus musculus
gatgccagcacaggcacacaaacca

SEQ ID NO: 934345 - DNA, 25 bp, Mus musculus
gatgccaggccaccctcctgtgggc

SEQ ID NO: 934346 - DNA, 25 bp, Mus musculus
gatgccaggccagcctcctgtgggc

SEQ ID NO: 934347 - DNA, 25 bp, Mus musculus
gatgccatattgattccatccttta

SEQ ID NO: 934348 - DNA, 25 bp, Mus musculus
gatgccatattgtttccatccttta

SEQ ID NO: 934349 - DNA, 25 bp, Mus musculus
gatgccatttcgatcttccactatg

SEQ ID NO: 934350 - DNA, 25 bp, Mus musculus
gatgccatttcgttcttccactatg

SEQ ID NO: 934351 - DNA, 25 bp, Mus musculus
gatgcccaagccaacttaagggcta

SEQ ID NO: 934352 - DNA, 25 bp, Mus musculus
gatgcccaagccaatcaacgtccgg

SEQ ID NO: 934353 - DNA, 25 bp, Mus musculus
gatgcccaagccatgaatgctgctg

SEQ ID NO: 934354 - DNA, 25 bp, Mus musculus
gatgcccaagcctatcaacgtccgg

SEQ ID NO: 934355 - DNA, 25 bp, Mus musculus
gatgcccaagcttcactggttgagg

SEQ ID NO: 934356 - DNA, 25 bp, Mus musculus
gatgcccaaggcaacttaagggcta

SEQ ID NO: 934357 - DNA, 25 bp, Mus musculus
gatgcccaaggcatgaatgctgctg

SEQ ID NO: 934358 - DNA, 25 bp, Mus musculus
gatgcccaaggttcactggttgagg

SEQ ID NO: 934359 - DNA, 25 bp, Mus musculus
gatgcccagacagcactggacatga

SEQ ID NO: 934360 - DNA, 25 bp, Mus musculus
gatgcccagagagcactggacatga

SEQ ID NO: 934361 - DNA, 25 bp, Mus musculus
gatgcccatgaaggtttctcggaca

SEQ ID NO: 934362 - DNA, 25 bp, Mus musculus
gatgcccatgtaggtttctcggaca

SEQ ID NO: 934363 - DNA, 25 bp, Mus musculus
gatgccccagatttataggcaatgc

SEQ ID NO: 934364 - DNA, 25 bp, Mus musculus
gatgccccagcaactggatgccttc

SEQ ID NO: 934365 - DNA, 25 bp, Mus musculus
gatgccccaggaactggatgccttc

SEQ ID NO: 934366 - DNA, 25 bp, Mus musculus
gatgccccagttttataggcaatgc

SEQ ID NO: 934367 - DNA, 25 bp, Mus musculus
gatgccctacaactgttcctcctgc

SEQ ID NO: 934368 - DNA, 25 bp, Mus musculus
gatgccctacaagtgttcctcctgc

SEQ ID NO: 934369 - DNA, 25 bp, Mus musculus
gatgccctgaagcttctcctcagca

SEQ ID NO: 934370 - DNA, 25 bp, Mus musculus
gatgccctgaaggttctcctcagca

SEQ ID NO: 934371 - DNA, 25 bp, Mus musculus
gatgccgcccttaatgtatccccca

SEQ ID NO: 934372 - DNA, 25 bp, Mus musculus
gatgccgccctttatgtatccccca

SEQ ID NO: 934373 - DNA, 25 bp, Mus musculus
gatgccgggatacgcgaggctaagg

SEQ ID NO: 934374 - DNA, 25 bp, Mus musculus
gatgccgggatacgggaggctaagg

SEQ ID NO: 934375 - DNA, 25 bp, Mus musculus
gatgccgggatcaacgcagagatgc

SEQ ID NO: 934376 - DNA, 25 bp, Mus musculus
gatgccgggatcaaggcagagatgc

SEQ ID NO: 934377 - DNA, 25 bp, Mus musculus
gatgcctcggcgctgttcacctaca

SEQ ID NO: 934378 - DNA, 25 bp, Mus musculus
gatgcctcggcggtgttcacctaca

SEQ ID NO: 934379 - DNA, 25 bp, Mus musculus
gatgcctgccagcgggactcaggtg

SEQ ID NO: 934380 - DNA, 25 bp, Mus musculus
gatgcctgccagcgtgactccgggg

SEQ ID NO: 934381 - DNA, 25 bp, Mus musculus
gatgcctgccagggggactcaggtg

SEQ ID NO: 934382 - DNA, 25 bp, Mus musculus
gatgcctgccagggtgactccgggg

SEQ ID NO: 934383 - DNA, 25 bp, Mus musculus
gatgcctgctagatcccagcacaga

SEQ ID NO: 934384 - DNA, 25 bp, Mus musculus
gatgcctgctagttcccagcacaga

SEQ ID NO: 934385 - DNA, 25 bp, Mus musculus
gatgcctgtgcccacgtggagattg

SEQ ID NO: 934386 - DNA, 25 bp, Mus musculus
gatgcctgtgcccaggtggagattg

SEQ ID NO: 934387 - DNA, 25 bp, Mus musculus
gatgcgcaagcgctacgagggcctt

SEQ ID NO: 934388 - DNA, 25 bp, Mus musculus
gatgcgcaagctatgaatgctgctg

SEQ ID NO: 934389 - DNA, 25 bp, Mus musculus
gatgcgcaagggctacgagggcctt

SEQ ID NO: 934390 - DNA, 25 bp, Mus musculus
gatgcgcaaggtatgaatgctgctg

SEQ ID NO: 934391 - DNA, 25 bp, Mus musculus
gatgcgcagaaacctgtggatgaga

SEQ ID NO: 934392 - DNA, 25 bp, Mus musculus
gatgcgcagaaagctgtggatgaga

SEQ ID NO: 934393 - DNA, 25 bp, Mus musculus
gatgcgtaggaaggctggtgctgat

SEQ ID NO: 934394 - DNA, 25 bp, Mus musculus
gatgcgtaggaagggtggtgctgat

SEQ ID NO: 934395 - DNA, 25 bp, Mus musculus
gatgctaaatatcttctagaagccc

SEQ ID NO: 934396 - DNA, 25 bp, Mus musculus
gatgctaaatatgttctagaagccc

SEQ ID NO: 934397 - DNA, 25 bp, Mus musculus
gatgctaaccagagctgcactagct

SEQ ID NO: 934398 - DNA, 25 bp, Mus musculus
gatgctaaccagtgctgcactagct

SEQ ID NO: 934399 - DNA, 25 bp, Mus musculus
gatgctaccagggacgacggacaat

SEQ ID NO: 934400 - DNA, 25 bp, Mus musculus
gatgctaccagggaggacggacaat

SEQ ID NO: 934401 - DNA, 25 bp, Mus musculus
gatgctacggagctgccttagctgg

SEQ ID NO: 934402 - DNA, 25 bp, Mus musculus
gatgctacggaggtgccttagctgg

SEQ ID NO: 934403 - DNA, 25 bp, Mus musculus
gatgctactcagcgccacgtggtga

SEQ ID NO: 934404 - DNA, 25 bp, Mus musculus
gatgctactcagcggcagttggtga

SEQ ID NO: 934405 - DNA, 25 bp, Mus musculus
gatgctactcagggccacgtggtga

SEQ ID NO: 934406 - DNA, 25 bp, Mus musculus
gatgctactcaggggcagttggtga

SEQ ID NO: 934407 - DNA, 25 bp, Mus musculus
gatgctagagcgacttagagaacta

SEQ ID NO: 934408 - DNA, 25 bp, Mus musculus
gatgctagagggacttagagaacta

SEQ ID NO: 934409 - DNA, 25 bp, Mus musculus
gatgctagcagacgcggcggaagca

SEQ ID NO: 934410 - DNA, 25 bp, Mus musculus
gatgctagcagaggcggcggaagca

SEQ ID NO: 934411 - DNA, 25 bp, Mus musculus
gatgctattaagagaggctatgatg

SEQ ID NO: 934412 - DNA, 25 bp, Mus musculus
gatgctattaagtgaggctatgatg

SEQ ID NO: 934413 - DNA, 25 bp, Mus musculus
gatgctattgctggccgtcggtttt

SEQ ID NO: 934414 - DNA, 25 bp, Mus musculus
gatgctattggtggccgtcggtttt

SEQ ID NO: 934415 - DNA, 25 bp, Mus musculus
gatgctcaggctttgctcctgttgt

SEQ ID NO: 934416 - DNA, 25 bp, Mus musculus
gatgctcagggtttgctcctgttgt

SEQ ID NO: 934417 - DNA, 25 bp, Mus musculus
gatgctcatgctctccccgggttct

SEQ ID NO: 934418 - DNA, 25 bp, Mus musculus
gatgctcatggtctccccgggttct

SEQ ID NO: 934419 - DNA, 25 bp, Mus musculus
gatgctcccctcttcgatgtcacgg

SEQ ID NO: 934420 - DNA, 25 bp, Mus musculus
gatgctcccctcttggatgtcacgg

SEQ ID NO: 934421 - DNA, 25 bp, Mus musculus
gatgctcctgaacgctgggtggtca

SEQ ID NO: 934422 - DNA, 25 bp, Mus musculus
gatgctcctgaaggctgggtggtca

SEQ ID NO: 934423 - DNA, 25 bp, Mus musculus
gatgctctgtatgaagggggatact

SEQ ID NO: 934424 - DNA, 25 bp, Mus musculus
gatgctctgtttgaagggggatact

SEQ ID NO: 934425 - DNA, 25 bp, Mus musculus
gatgctgaaactctatgccatgttc

SEQ ID NO: 934426 - DNA, 25 bp, Mus musculus
gatgctgaaactgtatgccatgttc

SEQ ID NO: 934427 - DNA, 25 bp, Mus musculus
gatgctgaagattgccgtggtccag

SEQ ID NO: 934428 - DNA, 25 bp, Mus musculus
gatgctgaagtttgccgtggtccag

SEQ ID NO: 934429 - DNA, 25 bp, Mus musculus
gatgctgactaggacttggccgtcg

SEQ ID NO: 934430 - DNA, 25 bp, Mus musculus
gatgctgactcggacaccaagcatg

SEQ ID NO: 934431 - DNA, 25 bp, Mus musculus
gatgctgactgggacaccaagcatg

SEQ ID NO: 934432 - DNA, 25 bp, Mus musculus
gatgctgacttggacttggccgtcg

SEQ ID NO: 934433 - DNA, 25 bp, Mus musculus
gatgctgaggacatcgtgaacacag

SEQ ID NO: 934434 - DNA, 25 bp, Mus musculus
gatgctgaggatattgtaggcactc

SEQ ID NO: 934435 - DNA, 25 bp, Mus musculus
gatgctgaggccactctgaggccag

SEQ ID NO: 934436 - DNA, 25 bp, Mus musculus
gatgctgagggcactctgaggccag

SEQ ID NO: 934437 - DNA, 25 bp, Mus musculus
gatgctgaggtcatcgtgaacacag

SEQ ID NO: 934438 - DNA, 25 bp, Mus musculus
gatgctgaggttattgtaggcactc

SEQ ID NO: 934439 - DNA, 25 bp, Mus musculus
gatgctgatgagttcttgaccatga

SEQ ID NO: 934440 - DNA, 25 bp, Mus musculus
gatgctgatgccaatggcaccattg

SEQ ID NO: 934441 - DNA, 25 bp, Mus musculus
gatgctgatgccaatgggaccattg

SEQ ID NO: 934442 - DNA, 25 bp, Mus musculus
gatgctgatggcaatggcaccattg

SEQ ID NO: 934443 - DNA, 25 bp, Mus musculus
gatgctgatggcaatgggaccattg

SEQ ID NO: 934444 - DNA, 25 bp, Mus musculus
gatgctgatgtgttcttgaccatga

SEQ ID NO: 934445 - DNA, 25 bp, Mus musculus
gatgctgcagccaccagaaagcatc

SEQ ID NO: 934446 - DNA, 25 bp, Mus musculus
gatgctgcagctctgggaaggcccc

SEQ ID NO: 934447 - DNA, 25 bp, Mus musculus
gatgctgcaggcaccagaaagcatc

SEQ ID NO: 934448 - DNA, 25 bp, Mus musculus
gatgctgcaggtctgggaaggcccc

SEQ ID NO: 934449 - DNA, 25 bp, Mus musculus
gatgctgcgaagaatcatccagaac

SEQ ID NO: 934450 - DNA, 25 bp, Mus musculus
gatgctgcgaagtatcatccagaac

SEQ ID NO: 934451 - DNA, 25 bp, Mus musculus
gatgctggtcacgacctcttctgat

SEQ ID NO: 934452 - DNA, 25 bp, Mus musculus
gatgctggtcacgacgtaaccatct

SEQ ID NO: 934453 - DNA, 25 bp, Mus musculus
gatgctggtcacgagctcttctgat

SEQ ID NO: 934454 - DNA, 25 bp, Mus musculus
gatgctggtcacgaggtaaccatct

SEQ ID NO: 934455 - DNA, 25 bp, Mus musculus
gatgctgtacagaagagtgtggaaa

SEQ ID NO: 934456 - DNA, 25 bp, Mus musculus
gatgctgtacagagtgtggaaacag

SEQ ID NO: 934457 - DNA, 25 bp, Mus musculus
gatgctgtacagtagagtgtggaaa

SEQ ID NO: 934458 - DNA, 25 bp, Mus musculus
gatgctgtacagtgtgtggaaacag

SEQ ID NO: 934459 - DNA, 25 bp, Mus musculus
gatgcttatgatagcctgtcatcca

SEQ ID NO: 934460 - DNA, 25 bp, Mus musculus
gatgcttatgattgcctgtcatcca

SEQ ID NO: 934461 - DNA, 25 bp, Mus musculus
gatgcttgagcccctcgatgggttc

SEQ ID NO: 934462 - DNA, 25 bp, Mus musculus
gatgcttgaggccctcgatgggttc

SEQ ID NO: 934463 - DNA, 25 bp, Mus musculus
gatgcttgcgagcaatgctcacccc

SEQ ID NO: 934464 - DNA, 25 bp, Mus musculus
gatgcttgcgcaatgcagcccgcac

SEQ ID NO: 934465 - DNA, 25 bp, Mus musculus
gatgcttgcggaatgcagcccgcac

SEQ ID NO: 934466 - DNA, 25 bp, Mus musculus
gatgcttgcgtgcaatgctcacccc

SEQ ID NO: 934467 - DNA, 25 bp, Mus musculus
gatgcttgctgaacccccacagaac

SEQ ID NO: 934468 - DNA, 25 bp, Mus musculus
gatgcttgctgaacgcccacagaac

SEQ ID NO: 934469 - DNA, 25 bp, Mus musculus
gatgctttcagacctttacaggtgg

SEQ ID NO: 934470 - DNA, 25 bp, Mus musculus
gatgctttcagagctttacaggtgg

SEQ ID NO: 934471 - DNA, 25 bp, Mus musculus
gatggaaaacagcctgagaatgaca

SEQ ID NO: 934472 - DNA, 25 bp, Mus musculus
gatggaaaacaggctgagaatgaca

SEQ ID NO: 934473 - DNA, 25 bp, Mus musculus
gatggaaaagcacctggatgcttta

SEQ ID NO: 934474 - DNA, 25 bp, Mus musculus
gatggaaaagcgagcaggcggctca

SEQ ID NO: 934475 - DNA, 25 bp, Mus musculus
gatggaaaagcgaggaggcggctca

SEQ ID NO: 934476 - DNA, 25 bp, Mus musculus
gatggaaaaggacctggatgcttta

SEQ ID NO: 934477 - DNA, 25 bp, Mus musculus
gatggaaagcagctcacctgtctcc

SEQ ID NO: 934478 - DNA, 25 bp, Mus musculus
gatggaaagcaggtcacctgtctcc

SEQ ID NO: 934479 - DNA, 25 bp, Mus musculus
gatggaaccctgaaaaagctggagt

SEQ ID NO: 934480 - DNA, 25 bp, Mus musculus
gatggaaccctgtaaaagctggagt

SEQ ID NO: 934481 - DNA, 25 bp, Mus musculus
gatggaaccgcgcgcagcgcgttta

SEQ ID NO: 934482 - DNA, 25 bp, Mus musculus
gatggaaccgggcgcagcgcgttta

SEQ ID NO: 934483 - DNA, 25 bp, Mus musculus
gatggaagaacacgagaagctgcag

SEQ ID NO: 934484 - DNA, 25 bp, Mus musculus
gatggaagaacaggagaagctgcag

SEQ ID NO: 934485 - DNA, 25 bp, Mus musculus
gatggaagaacccctctgggcgtgg

SEQ ID NO: 934486 - DNA, 25 bp, Mus musculus
gatggaagaagccctctgggcgtgg

SEQ ID NO: 934487 - DNA, 25 bp, Mus musculus
gatggaaggcaaccacttgaagagg

SEQ ID NO: 934488 - DNA, 25 bp, Mus musculus
gatggaaggcaagcacttgaagagg

SEQ ID NO: 934489 - DNA, 25 bp, Mus musculus
gatggaattataagtactattaatc

SEQ ID NO: 934490 - DNA, 25 bp, Mus musculus
gatggaattatatgtactattaatc

SEQ ID NO: 934491 - DNA, 25 bp, Mus musculus
gatggacaacatcacagactggtgc

SEQ ID NO: 934492 - DNA, 25 bp, Mus musculus
gatggacaacatcagagactggtgc

SEQ ID NO: 934493 - DNA, 25 bp, Mus musculus
gatggacaagagctcttccagaaac

SEQ ID NO: 934494 - DNA, 25 bp, Mus musculus
gatggacaagtgctcttccagaaac

SEQ ID NO: 934495 - DNA, 25 bp, Mus musculus
gatggacaatcaccgcctgttggtc

SEQ ID NO: 934496 - DNA, 25 bp, Mus musculus
gatggacaatcagcgcctgttggtc

SEQ ID NO: 934497 - DNA, 25 bp, Mus musculus
gatggacacactgatatttatcctc

SEQ ID NO: 934498 - DNA, 25 bp, Mus musculus
gatggacacagtgatatttatcctc

SEQ ID NO: 934499 - DNA, 25 bp, Mus musculus
gatggacagcaactattgacagtac

SEQ ID NO: 934500 - DNA, 25 bp, Mus musculus
gatggacagcaagtattgacagtac

SEQ ID NO: 934501 - DNA, 25 bp, Mus musculus
gatggacatatcaattactgggatt

SEQ ID NO: 934502 - DNA, 25 bp, Mus musculus
gatggacatatctattactgggatt

SEQ ID NO: 934503 - DNA, 25 bp, Mus musculus
gatggaccccagatccaccatgggc

SEQ ID NO: 934504 - DNA, 25 bp, Mus musculus
gatggaccccagatgcaccatgggc

SEQ ID NO: 934505 - DNA, 25 bp, Mus musculus
gatggactctgaaagcagagcgttt

SEQ ID NO: 934506 - DNA, 25 bp, Mus musculus
gatggactctgatagcagagcgttt

SEQ ID NO: 934507 - DNA, 25 bp, Mus musculus
gatggactgcatcgagggccgtgta

SEQ ID NO: 934508 - DNA, 25 bp, Mus musculus
gatggactgcatggagggccgtgta

SEQ ID NO: 934509 - DNA, 25 bp, Mus musculus
gatggagaagaagtgggaaatatgt

SEQ ID NO: 934510 - DNA, 25 bp, Mus musculus
gatggagaagtagtgggaaatatgt

SEQ ID NO: 934511 - DNA, 25 bp, Mus musculus
gatggagacccattctgccccaatt

SEQ ID NO: 934512 - DNA, 25 bp, Mus musculus
gatggagacccattgtgccccaatt

SEQ ID NO: 934513 - DNA, 25 bp, Mus musculus
gatggagagcatcacaaatgcggtg

SEQ ID NO: 934514 - DNA, 25 bp, Mus musculus
gatggagagcatgacaaatgcggtg

SEQ ID NO: 934515 - DNA, 25 bp, Mus musculus
gatggagaggaaggaggagaggtac

SEQ ID NO: 934516 - DNA, 25 bp, Mus musculus
gatggagaggtaggaggagaggtac

SEQ ID NO: 934517 - DNA, 25 bp, Mus musculus
gatggagatgcaatcctcaatgaac

SEQ ID NO: 934518 - DNA, 25 bp, Mus musculus
gatggagatggaatcctcaatgaac

SEQ ID NO: 934519 - DNA, 25 bp, Mus musculus
gatggagcagagcctccaggagttg

SEQ ID NO: 934520 - DNA, 25 bp, Mus musculus
gatggagcagaggctccaggagttg

SEQ ID NO: 934521 - DNA, 25 bp, Mus musculus
gatggagccaaacaatgaataaaat

SEQ ID NO: 934522 - DNA, 25 bp, Mus musculus
gatggagccaaacatttctcgggat

SEQ ID NO: 934523 - DNA, 25 bp, Mus musculus
gatggagccaaagaatgaataaaat

SEQ ID NO: 934524 - DNA, 25 bp, Mus musculus
gatggagccaaagatttctcgggat

SEQ ID NO: 934525 - DNA, 25 bp, Mus musculus
gatggagccttgcatgaagttgtgc

SEQ ID NO: 934526 - DNA, 25 bp, Mus musculus
gatggagccttggatgaagttgtgc

SEQ ID NO: 934527 - DNA, 25 bp, Mus musculus
gatggaggagcctatgggggaagac

SEQ ID NO: 934528 - DNA, 25 bp, Mus musculus
gatggaggaggctatgggggaagac

SEQ ID NO: 934529 - DNA, 25 bp, Mus musculus
gatggagtgatgcgttatggctatg

SEQ ID NO: 934530 - DNA, 25 bp, Mus musculus
gatggagtgatgggttatggctatg

SEQ ID NO: 934531 - DNA, 25 bp, Mus musculus
gatggagtgtaactggcggcccctg

SEQ ID NO: 934532 - DNA, 25 bp, Mus musculus
gatggagtgtaagtggcggcccctg

SEQ ID NO: 934533 - DNA, 25 bp, Mus musculus
gatggagttggacattggtgcccag

SEQ ID NO: 934534 - DNA, 25 bp, Mus musculus
gatggagttggagattggtgcccag

SEQ ID NO: 934535 - DNA, 25 bp, Mus musculus
gatggatcagacagaaagtgtggag

SEQ ID NO: 934536 - DNA, 25 bp, Mus musculus
gatggatcagtcagaaagtgtggag

SEQ ID NO: 934537 - DNA, 25 bp, Mus musculus
gatggatcctacaggacagttgaat

SEQ ID NO: 934538 - DNA, 25 bp, Mus musculus
gatggatccttcaggacagttgaat

SEQ ID NO: 934539 - DNA, 25 bp, Mus musculus
gatggatggaagcacaactcttcct

SEQ ID NO: 934540 - DNA, 25 bp, Mus musculus
gatggatggaagcagaactcttcct

SEQ ID NO: 934541 - DNA, 25 bp, Mus musculus
gatggatttatgaccactgatgctg

SEQ ID NO: 934542 - DNA, 25 bp, Mus musculus
gatggatttatgacgactgatgctg

SEQ ID NO: 934543 - DNA, 25 bp, Mus musculus
gatggattttaacgtgagactgtgg

SEQ ID NO: 934544 - DNA, 25 bp, Mus musculus
gatggattttaaggtgagactgtgg

SEQ ID NO: 934545 - DNA, 25 bp, Mus musculus
gatggcaaagattactactttgtga

SEQ ID NO: 934546 - DNA, 25 bp, Mus musculus
gatggcaaagcaaaagagaagaagg

SEQ ID NO: 934547 - DNA, 25 bp, Mus musculus
gatggcaaagcaacaggaacaagat

SEQ ID NO: 934548 - DNA, 25 bp, Mus musculus
gatggcaaaggaaaagagaagaagg

SEQ ID NO: 934549 - DNA, 25 bp, Mus musculus
gatggcaaaggaacaggaacaagat

SEQ ID NO: 934550 - DNA, 25 bp, Mus musculus
gatggcaaagtttactactttgtga

SEQ ID NO: 934551 - DNA, 25 bp, Mus musculus
gatggcaacccacgtctcccgggag

SEQ ID NO: 934552 - DNA, 25 bp, Mus musculus
gatggcaacccaggtctcccgggag

SEQ ID NO: 934553 - DNA, 25 bp, Mus musculus
gatggcaagcagctggagctggctc

SEQ ID NO: 934554 - DNA, 25 bp, Mus musculus
gatggcaagcaggtggagctggctc

SEQ ID NO: 934555 - DNA, 25 bp, Mus musculus
gatggcacagcgcttactctcagaa

SEQ ID NO: 934556 - DNA, 25 bp, Mus musculus
gatggcacagggcttactctcagaa

SEQ ID NO: 934557 - DNA, 25 bp, Mus musculus
gatggcagtgcagcaaataagaggg

SEQ ID NO: 934558 - DNA, 25 bp, Mus musculus
gatggcagtggagcaaataagaggg

SEQ ID NO: 934559 - DNA, 25 bp, Mus musculus
gatggcatgtggctcgacatgaacg

SEQ ID NO: 934560 - DNA, 25 bp, Mus musculus
gatggcatgtggctggacatgaacg

SEQ ID NO: 934561 - DNA, 25 bp, Mus musculus
gatggcattgatcgtgaccgaggtc

SEQ ID NO: 934562 - DNA, 25 bp, Mus musculus
gatggcattgatggtgaccgaggtc

SEQ ID NO: 934563 - DNA, 25 bp, Mus musculus
gatggcccccatcgttcagcatggg

SEQ ID NO: 934564 - DNA, 25 bp, Mus musculus
gatggcccccatggttcagcatggg

SEQ ID NO: 934565 - DNA, 25 bp, Mus musculus
gatggccgagccaaagcaacaatat

SEQ ID NO: 934566 - DNA, 25 bp, Mus musculus
gatggccgaggcaaagcaacaatat

SEQ ID NO: 934567 - DNA, 25 bp, Mus musculus
gatggccggggcgacgttctctcca

SEQ ID NO: 934568 - DNA, 25 bp, Mus musculus
gatggccggggcgaggttctctcca

SEQ ID NO: 934569 - DNA, 25 bp, Mus musculus
gatggcgacccaatacgaaatgtag

SEQ ID NO: 934570 - DNA, 25 bp, Mus musculus
gatggcgaccgaatacgaaatgtag

SEQ ID NO: 934571 - DNA, 25 bp, Mus musculus
gatggcgacgatttccagagcagga

SEQ ID NO: 934572 - DNA, 25 bp, Mus musculus
gatggcgacgttttccagagcagga

SEQ ID NO: 934573 - DNA, 25 bp, Mus musculus
gatggcgggccgcactatgcaagct

SEQ ID NO: 934574 - DNA, 25 bp, Mus musculus
gatggcgggccgcgtttctgttgat

SEQ ID NO: 934575 - DNA, 25 bp, Mus musculus
gatggcgggccggactatgcaagct

SEQ ID NO: 934576 - DNA, 25 bp, Mus musculus
gatggcgggccgggtttctgttgat

SEQ ID NO: 934577 - DNA, 25 bp, Mus musculus
gatggctattcgcagaataatgttt

SEQ ID NO: 934578 - DNA, 25 bp, Mus musculus
gatggctattcggagaataatgttt

SEQ ID NO: 934579 - DNA, 25 bp, Mus musculus
gatggctcaaagccaataataaata

SEQ ID NO: 934580 - DNA, 25 bp, Mus musculus
gatggctcaaaggcaataataaata

SEQ ID NO: 934581 - DNA, 25 bp, Mus musculus
gatggctctgacagccgcaagtcta

SEQ ID NO: 934582 - DNA, 25 bp, Mus musculus
gatggctctgactgccgcaagtcta

SEQ ID NO: 934583 - DNA, 25 bp, Mus musculus
gatggctctgcccgaagctttgctg

SEQ ID NO: 934584 - DNA, 25 bp, Mus musculus
gatggctctggccgaagctttgctg

SEQ ID NO: 934585 - DNA, 25 bp, Mus musculus
gatggctgagcaaatggtagaagca

SEQ ID NO: 934586 - DNA, 25 bp, Mus musculus
gatggctgaggaaatggtagaagca

SEQ ID NO: 934587 - DNA, 25 bp, Mus musculus
gatggctgtgcttcacctgccagct

SEQ ID NO: 934588 - DNA, 25 bp, Mus musculus
gatggctgtggttcacctgccagct

SEQ ID NO: 934589 - DNA, 25 bp, Mus musculus
gatggcttaacagaacaggagtgtg

SEQ ID NO: 934590 - DNA, 25 bp, Mus musculus
gatggcttaacagatcaggagtgtg

SEQ ID NO: 934591 - DNA, 25 bp, Mus musculus
gatggcttgcagcggtcaagtcatg

SEQ ID NO: 934592 - DNA, 25 bp, Mus musculus
gatggcttgcaggggtcaagtcatg

SEQ ID NO: 934593 - DNA, 25 bp, Mus musculus
gatggctttagcaacagcatggtca

SEQ ID NO: 934594 - DNA, 25 bp, Mus musculus
gatggctttagcaacgcccgcggcc

SEQ ID NO: 934595 - DNA, 25 bp, Mus musculus
gatggctttagcaagagcatggtca

SEQ ID NO: 934596 - DNA, 25 bp, Mus musculus
gatggctttagcaaggcccgcggcc

SEQ ID NO: 934597 - DNA, 25 bp, Mus musculus
gatgggagacagaaagatgtagaca

SEQ ID NO: 934598 - DNA, 25 bp, Mus musculus
gatgggagacagtaagatgtagaca

SEQ ID NO: 934599 - DNA, 25 bp, Mus musculus
gatgggattcagaagataattggag

SEQ ID NO: 934600 - DNA, 25 bp, Mus musculus
gatgggattcagtagataattggag

SEQ ID NO: 934601 - DNA, 25 bp, Mus musculus
gatgggctctgaagcgtacaccatg

SEQ ID NO: 934602 - DNA, 25 bp, Mus musculus
gatgggctctgaagcgtggaataag

SEQ ID NO: 934603 - DNA, 25 bp, Mus musculus
gatgggctctgaagggtacaccatg

SEQ ID NO: 934604 - DNA, 25 bp, Mus musculus
gatgggctctgaagggtggaataag

SEQ ID NO: 934605 - DNA, 25 bp, Mus musculus
gatgggctggcccttggccgatctt

SEQ ID NO: 934606 - DNA, 25 bp, Mus musculus
gatgggctgggccttggccgatctt

SEQ ID NO: 934607 - DNA, 25 bp, Mus musculus
gatgggctgtggctcttaggcaggc

SEQ ID NO: 934608 - DNA, 25 bp, Mus musculus
gatgggctgtgggtcttaggcaggc

SEQ ID NO: 934609 - DNA, 25 bp, Mus musculus
gatggggctccaaccaattgccggc

SEQ ID NO: 934610 - DNA, 25 bp, Mus musculus
gatggggctccaacgaattgccggc

SEQ ID NO: 934611 - DNA, 25 bp, Mus musculus
gatggggtatgtcactgctgtgatg

SEQ ID NO: 934612 - DNA, 25 bp, Mus musculus
gatggggtatgtgactgctgtgatg

SEQ ID NO: 934613 - DNA, 25 bp, Mus musculus
gatggggtcaaacctgaccgccagt

SEQ ID NO: 934614 - DNA, 25 bp, Mus musculus
gatggggtcaaagctgaccgccagt

SEQ ID NO: 934615 - DNA, 25 bp, Mus musculus
gatgggtacaatcgtaccatcatgt

SEQ ID NO: 934616 - DNA, 25 bp, Mus musculus
gatgggtacaatggtaccatcatgt

SEQ ID NO: 934617 - DNA, 25 bp, Mus musculus
gatggtacagcagccttcaaggaga

SEQ ID NO: 934618 - DNA, 25 bp, Mus musculus
gatggtacaggagccttcaaggaga

SEQ ID NO: 934619 - DNA, 25 bp, Mus musculus
gatggtcgagcacttgcactaagaa

SEQ ID NO: 934620 - DNA, 25 bp, Mus musculus
gatggtcgaggacttgcactaagaa

SEQ ID NO: 934621 - DNA, 25 bp, Mus musculus
gatggtctcccacatcaacaatgga

SEQ ID NO: 934622 - DNA, 25 bp, Mus musculus
gatggtctccgacatcaacaatgga

SEQ ID NO: 934623 - DNA, 25 bp, Mus musculus
gatggtgacccgcacaaggtgcagc

SEQ ID NO: 934624 - DNA, 25 bp, Mus musculus
gatggtgacccggacaaggtgcagc

SEQ ID NO: 934625 - DNA, 25 bp, Mus musculus
gatggtgacggacggtggcatgtat

SEQ ID NO: 934626 - DNA, 25 bp, Mus musculus
gatggtgacggagggtggcatgtat

SEQ ID NO: 934627 - DNA, 25 bp, Mus musculus
gatggtgcagaacaaaagaaaaaag

SEQ ID NO: 934628 - DNA, 25 bp, Mus musculus
gatggtgcagtacaaaagaaaaaag

SEQ ID NO: 934629 - DNA, 25 bp, Mus musculus
gatggtgcccaaccacgtgaaaggt

SEQ ID NO: 934630 - DNA, 25 bp, Mus musculus
gatggtgcccaagcacgtgaaaggt

SEQ ID NO: 934631 - DNA, 25 bp, Mus musculus
gatggtggagactgtgttccggaac

SEQ ID NO: 934632 - DNA, 25 bp, Mus musculus
gatggtggagtctgtgttccggaac

SEQ ID NO: 934633 - DNA, 25 bp, Mus musculus
gatggtgtagcacatttccttctgg

SEQ ID NO: 934634 - DNA, 25 bp, Mus musculus
gatggtgtagcagatttccttctgg

SEQ ID NO: 934635 - DNA, 25 bp, Mus musculus
gatggtgtgactgacttggccgccc

SEQ ID NO: 934636 - DNA, 25 bp, Mus musculus
gatggtgtgactgagttggccgccc

SEQ ID NO: 934637 - DNA, 25 bp, Mus musculus
gatggttgggcacgggcccatgaag

SEQ ID NO: 934638 - DNA, 25 bp, Mus musculus
gatggttgggcaggggcccatgaag

SEQ ID NO: 934639 - DNA, 25 bp, Mus musculus
gatgtaaaagcaaaagaacataaca

SEQ ID NO: 934640 - DNA, 25 bp, Mus musculus
gatgtaaaaggaaaagaacataaca

SEQ ID NO: 934641 - DNA, 25 bp, Mus musculus
gatgtaaagaagagcaaccttccac

SEQ ID NO: 934642 - DNA, 25 bp, Mus musculus
gatgtaaagaagtgcaaccttccac

SEQ ID NO: 934643 - DNA, 25 bp, Mus musculus
gatgtacagaagcacattaagcaca

SEQ ID NO: 934644 - DNA, 25 bp, Mus musculus
gatgtacagaagcagattaagcaca

SEQ ID NO: 934645 - DNA, 25 bp, Mus musculus
gatgtaccaggacctgaaggtgcct

SEQ ID NO: 934646 - DNA, 25 bp, Mus musculus
gatgtaccaggagctgaaggtgcct

SEQ ID NO: 934647 - DNA, 25 bp, Mus musculus
gatgtagagaagcccatcgcccact

SEQ ID NO: 934648 - DNA, 25 bp, Mus musculus
gatgtagagaaggccatcgcccact

SEQ ID NO: 934649 - DNA, 25 bp, Mus musculus
gatgtagatgcacaccgtccagact

SEQ ID NO: 934650 - DNA, 25 bp, Mus musculus
gatgtagatgcagaccgtccagact

SEQ ID NO: 934651 - DNA, 25 bp, Mus musculus
gatgtagcagagagtgatcttgttt

SEQ ID NO: 934652 - DNA, 25 bp, Mus musculus
gatgtagcagagtgtgatcttgttt

SEQ ID NO: 934653 - DNA, 25 bp, Mus musculus
gatgtatgagccttcctgcgggcac

SEQ ID NO: 934654 - DNA, 25 bp, Mus musculus
gatgtatgaggcttcctgcgggcac

SEQ ID NO: 934655 - DNA, 25 bp, Mus musculus
gatgtatggcgcccgcgggaaggga

SEQ ID NO: 934656 - DNA, 25 bp, Mus musculus
gatgtatggcgcgcgcgggaaggga

SEQ ID NO: 934657 - DNA, 25 bp, Mus musculus
gatgtatgtgagcacattttctcct

SEQ ID NO: 934658 - DNA, 25 bp, Mus musculus
gatgtatgtgagcagattttctcct

SEQ ID NO: 934659 - DNA, 25 bp, Mus musculus
gatgtcaaagcgacccaagagagcc

SEQ ID NO: 934660 - DNA, 25 bp, Mus musculus
gatgtcaaagctgacaacgtgctcc

SEQ ID NO: 934661 - DNA, 25 bp, Mus musculus
gatgtcaaagggacccaagagagcc

SEQ ID NO: 934662 - DNA, 25 bp, Mus musculus
gatgtcaaaggtgacaacgtgctcc

SEQ ID NO: 934663 - DNA, 25 bp, Mus musculus
gatgtcaagcagcgtaatctccccc

SEQ ID NO: 934664 - DNA, 25 bp, Mus musculus
gatgtcaagcagggtaatctccccc

SEQ ID NO: 934665 - DNA, 25 bp, Mus musculus
gatgtcaatgctgagctggcccagg

SEQ ID NO: 934666 - DNA, 25 bp, Mus musculus
gatgtcaatggtgagctggcccagg

SEQ ID NO: 934667 - DNA, 25 bp, Mus musculus
gatgtcacagcgcacttttatggcc

SEQ ID NO: 934668 - DNA, 25 bp, Mus musculus
gatgtcacagcggacttttatggcc

SEQ ID NO: 934669 - DNA, 25 bp, Mus musculus
gatgtcacctcgcacaggcgacacc

SEQ ID NO: 934670 - DNA, 25 bp, Mus musculus
gatgtcacctggcacaggcgacacc

SEQ ID NO: 934671 - DNA, 25 bp, Mus musculus
gatgtcagagagagttgcccacctc

SEQ ID NO: 934672 - DNA, 25 bp, Mus musculus
gatgtcagagagtgttgcccacctc

SEQ ID NO: 934673 - DNA, 25 bp, Mus musculus
gatgtcagtcagcggacgtggaaca

SEQ ID NO: 934674 - DNA, 25 bp, Mus musculus
gatgtcagtcaggggacgtggaaca

SEQ ID NO: 934675 - DNA, 25 bp, Mus musculus
gatgtcatcacgctgctcgaacagc

SEQ ID NO: 934676 - DNA, 25 bp, Mus musculus
gatgtcatcacggtgctcgaacagc

SEQ ID NO: 934677 - DNA, 25 bp, Mus musculus
gatgtcatcatgagcaactcagcca

SEQ ID NO: 934678 - DNA, 25 bp, Mus musculus
gatgtcatcatgaggaactcagcca

SEQ ID NO: 934679 - DNA, 25 bp, Mus musculus
gatgtcatctatcagctgatccaga

SEQ ID NO: 934680 - DNA, 25 bp, Mus musculus
gatgtcatctatgagctgatccaga

SEQ ID NO: 934681 - DNA, 25 bp, Mus musculus
gatgtcattgctgatgacagctttg

SEQ ID NO: 934682 - DNA, 25 bp, Mus musculus
gatgtcattggtgatgacagctttg

SEQ ID NO: 934683 - DNA, 25 bp, Mus musculus
gatgtccctgcacatggatcctgag

SEQ ID NO: 934684 - DNA, 25 bp, Mus musculus
gatgtccctgcagatggatcctgag

SEQ ID NO: 934685 - DNA, 25 bp, Mus musculus
gatgtcctatatgaactgagaaaca

SEQ ID NO: 934686 - DNA, 25 bp, Mus musculus
gatgtcctatttgaactgagaaaca

SEQ ID NO: 934687 - DNA, 25 bp, Mus musculus
gatgtcgccatgcatgagccttccc

SEQ ID NO: 934688 - DNA, 25 bp, Mus musculus
gatgtcgccatggatgagccttccc

SEQ ID NO: 934689 - DNA, 25 bp, Mus musculus
gatgtcggcaagctagtcgatagcg

SEQ ID NO: 934690 - DNA, 25 bp, Mus musculus
gatgtcggcaaggtagtcgatagcg

SEQ ID NO: 934691 - DNA, 25 bp, Mus musculus
gatgtcgtcaagcctattgtggtaa

SEQ ID NO: 934692 - DNA, 25 bp, Mus musculus
gatgtcgtcaaggctattgtggtaa

SEQ ID NO: 934693 - DNA, 25 bp, Mus musculus
gatgtcgtcattgaaacttgccgag

SEQ ID NO: 934694 - DNA, 25 bp, Mus musculus
gatgtcgtcattgatacttgccgag

SEQ ID NO: 934695 - DNA, 25 bp, Mus musculus
gatgtcgttgaacggtcaccacacc

SEQ ID NO: 934696 - DNA, 25 bp, Mus musculus
gatgtcgttgtacggtcaccacacc

SEQ ID NO: 934697 - DNA, 25 bp, Mus musculus
gatgtctagaagctctaggaatgat

SEQ ID NO: 934698 - DNA, 25 bp, Mus musculus
gatgtctagaaggtctaggaatgat

SEQ ID NO: 934699 - DNA, 25 bp, Mus musculus
gatgtctatttgcagtgtctaaaac

SEQ ID NO: 934700 - DNA, 25 bp, Mus musculus
gatgtctatttggagtgtctaaaac

SEQ ID NO: 934701 - DNA, 25 bp, Mus musculus
gatgtgacagatcacgagtccttca

SEQ ID NO: 934702 - DNA, 25 bp, Mus musculus
gatgtgacagatcaggagtccttca

SEQ ID NO: 934703 - DNA, 25 bp, Mus musculus
gatgtgattctcaacctgggaagtc

SEQ ID NO: 934704 - DNA, 25 bp, Mus musculus
gatgtgattctcaagctgggaagtc

SEQ ID NO: 934705 - DNA, 25 bp, Mus musculus
gatgtgcagccccgtgtccaccagg

SEQ ID NO: 934706 - DNA, 25 bp, Mus musculus
gatgtgcagcgccgtgtccaccagg

SEQ ID NO: 934707 - DNA, 25 bp, Mus musculus
gatgtgcagttacgtatctctggag

SEQ ID NO: 934708 - DNA, 25 bp, Mus musculus
gatgtgcagttaggtatctctggag

SEQ ID NO: 934709 - DNA, 25 bp, Mus musculus
gatgtgccccttcttgtagagtata

SEQ ID NO: 934710 - DNA, 25 bp, Mus musculus
gatgtgccccttgttgtagagtata

SEQ ID NO: 934711 - DNA, 25 bp, Mus musculus
gatgtgccgccgaggacagaagatt

SEQ ID NO: 934712 - DNA, 25 bp, Mus musculus
gatgtgccgccgtggacagaagatt

SEQ ID NO: 934713 - DNA, 25 bp, Mus musculus
gatgtgcgagattgtgaagggaagg

SEQ ID NO: 934714 - DNA, 25 bp, Mus musculus
gatgtgcgagcgaaggttgtgaaga

SEQ ID NO: 934715 - DNA, 25 bp, Mus musculus
gatgtgcgagggaaggttgtgaaga

SEQ ID NO: 934716 - DNA, 25 bp, Mus musculus
gatgtgcgagtttgtgaagggaagg

SEQ ID NO: 934717 - DNA, 25 bp, Mus musculus
gatgtgctggagcgctccccacacc

SEQ ID NO: 934718 - DNA, 25 bp, Mus musculus
gatgtgctggagcggtccccgcacc

SEQ ID NO: 934719 - DNA, 25 bp, Mus musculus
gatgtgctggtgcgctccccacacc

SEQ ID NO: 934720 - DNA, 25 bp, Mus musculus
gatgtgctggtgcggtccccgcacc

SEQ ID NO: 934721 - DNA, 25 bp, Mus musculus
gatgtggaagctcaagatgtagtgg

SEQ ID NO: 934722 - DNA, 25 bp, Mus musculus
gatgtggaaggtcaagatgtagtgg

SEQ ID NO: 934723 - DNA, 25 bp, Mus musculus
gatgtggaccaacggtggatgcgag

SEQ ID NO: 934724 - DNA, 25 bp, Mus musculus
gatgtggaccaagggtggatgcgag

SEQ ID NO: 934725 - DNA, 25 bp, Mus musculus
gatgtggagactcgcacccagctgg

SEQ ID NO: 934726 - DNA, 25 bp, Mus musculus
gatgtggagactggcacccagctgg

SEQ ID NO: 934727 - DNA, 25 bp, Mus musculus
gatgtggagatgacttggactgatg

SEQ ID NO: 934728 - DNA, 25 bp, Mus musculus
gatgtggagatgcagtatacaatgg

SEQ ID NO: 934729 - DNA, 25 bp, Mus musculus
gatgtggagatggagtatacaatgg

SEQ ID NO: 934730 - DNA, 25 bp, Mus musculus
gatgtggagatgtcttggactgatg

SEQ ID NO: 934731 - DNA, 25 bp, Mus musculus
gatgtggcacttctcatgttcagca

SEQ ID NO: 934732 - DNA, 25 bp, Mus musculus
gatgtggcacttctgatgttcagca

SEQ ID NO: 934733 - DNA, 25 bp, Mus musculus
gatgtggcagagagtccccacttca

SEQ ID NO: 934734 - DNA, 25 bp, Mus musculus
gatgtggcagagtgtccccacttca

SEQ ID NO: 934735 - DNA, 25 bp, Mus musculus
gatgtggccaaacatatgcttccat

SEQ ID NO: 934736 - DNA, 25 bp, Mus musculus
gatgtggccaaagatatgcttccat

SEQ ID NO: 934737 - DNA, 25 bp, Mus musculus
gatgtggtcaagcagcggatccgtc

SEQ ID NO: 934738 - DNA, 25 bp, Mus musculus
gatgtggtcaaggagcggatccgtc

SEQ ID NO: 934739 - DNA, 25 bp, Mus musculus
gatgtggtgatgactgacagtgaag

SEQ ID NO: 934740 - DNA, 25 bp, Mus musculus
gatgtggtgatgtctgacagtgaag

SEQ ID NO: 934741 - DNA, 25 bp, Mus musculus
gatgtgtctcagctgatccgcaaca

SEQ ID NO: 934742 - DNA, 25 bp, Mus musculus
gatgtgtctcaggtgatccgcaaca

SEQ ID NO: 934743 - DNA, 25 bp, Mus musculus
gatgtgttcaatccacggcagccga

SEQ ID NO: 934744 - DNA, 25 bp, Mus musculus
gatgtgttcattccacggcagccga

SEQ ID NO: 934745 - DNA, 25 bp, Mus musculus
gatgtgttggagctcctggatgaca

SEQ ID NO: 934746 - DNA, 25 bp, Mus musculus
gatgtgttggaggtcctggatgaca

SEQ ID NO: 934747 - DNA, 25 bp, Mus musculus
gatgttaaacctagggatgatgaga

SEQ ID NO: 934748 - DNA, 25 bp, Mus musculus
gatgttaaaccttgggatgatgaga

SEQ ID NO: 934749 - DNA, 25 bp, Mus musculus
gatgttaacaatacattgcatctgg

SEQ ID NO: 934750 - DNA, 25 bp, Mus musculus
gatgttaacaattcattgcatctgg

SEQ ID NO: 934751 - DNA, 25 bp, Mus musculus
gatgttacggagcacccgagtcaga

SEQ ID NO: 934752 - DNA, 25 bp, Mus musculus
gatgttacggaggacccgagtcaga

SEQ ID NO: 934753 - DNA, 25 bp, Mus musculus
gatgttcaaaacctatgatgctgga

SEQ ID NO: 934754 - DNA, 25 bp, Mus musculus
gatgttcaaaacgtatgatgctgga

SEQ ID NO: 934755 - DNA, 25 bp, Mus musculus
gatgttcatgataggagacaaattc

SEQ ID NO: 934756 - DNA, 25 bp, Mus musculus
gatgttcatgcgactttcagttacc

SEQ ID NO: 934757 - DNA, 25 bp, Mus musculus
gatgttcatgggactttcagttacc

SEQ ID NO: 934758 - DNA, 25 bp, Mus musculus
gatgttcatgttaggagacaaattc

SEQ ID NO: 934759 - DNA, 25 bp, Mus musculus
gatgttccactccctctttgccatt

SEQ ID NO: 934760 - DNA, 25 bp, Mus musculus
gatgttccactccgatcaagtttgt

SEQ ID NO: 934761 - DNA, 25 bp, Mus musculus
gatgttccactcgctctttgccatt

SEQ ID NO: 934762 - DNA, 25 bp, Mus musculus
gatgttccactcggatcaagtttgt

SEQ ID NO: 934763 - DNA, 25 bp, Mus musculus
gatgttccagaggacgtactacaag

SEQ ID NO: 934764 - DNA, 25 bp, Mus musculus
gatgttccagaggaggtactacaag

SEQ ID NO: 934765 - DNA, 25 bp, Mus musculus
gatgttccgtcggaagcctctcttc

SEQ ID NO: 934766 - DNA, 25 bp, Mus musculus
gatgttccgtcggatgcctctcttc

SEQ ID NO: 934767 - DNA, 25 bp, Mus musculus
gatgttcgacagaatttttggacaa

SEQ ID NO: 934768 - DNA, 25 bp, Mus musculus
gatgttcgacagtatttttggacaa

SEQ ID NO: 934769 - DNA, 25 bp, Mus musculus
gatgttcgaggacacgtgtcctttt

SEQ ID NO: 934770 - DNA, 25 bp, Mus musculus
gatgttcgaggacaggtgtcctttt

SEQ ID NO: 934771 - DNA, 25 bp, Mus musculus
gatgttctaccgcgactggtggaac

SEQ ID NO: 934772 - DNA, 25 bp, Mus musculus
gatgttctaccgggactggtggaac

SEQ ID NO: 934773 - DNA, 25 bp, Mus musculus
gatgttctctactcctggaatccct

SEQ ID NO: 934774 - DNA, 25 bp, Mus musculus
gatgttctcttctcctggaatccct

SEQ ID NO: 934775 - DNA, 25 bp, Mus musculus
gatgttgagacccacgtactaaatc

SEQ ID NO: 934776 - DNA, 25 bp, Mus musculus
gatgttgagacccaggtactaaatc

SEQ ID NO: 934777 - DNA, 25 bp, Mus musculus
gatgttgcacagaaaaaattacaag

SEQ ID NO: 934778 - DNA, 25 bp, Mus musculus
gatgttgcacagtaaaaattacaag

SEQ ID NO: 934779 - DNA, 25 bp, Mus musculus
gatgttgccaacaacgctacgctgt

SEQ ID NO: 934780 - DNA, 25 bp, Mus musculus
gatgttgccaacaaggctacgctgt

SEQ ID NO: 934781 - DNA, 25 bp, Mus musculus
gatgttggttcacaccctggaatac

SEQ ID NO: 934782 - DNA, 25 bp, Mus musculus
gatgttggttcacagcctggaatac

SEQ ID NO: 934783 - DNA, 25 bp, Mus musculus
gatgttgtccctcacaggtttggcc

SEQ ID NO: 934784 - DNA, 25 bp, Mus musculus
gatgttgtccctgacaggtttggcc

SEQ ID NO: 934785 - DNA, 25 bp, Mus musculus
gatgttgtggcataccccttcatgc

SEQ ID NO: 934786 - DNA, 25 bp, Mus musculus
gatgttgtgggataccccttcatgc

SEQ ID NO: 934787 - DNA, 25 bp, Mus musculus
gatgttgttgctggagacaaccgga

SEQ ID NO: 934788 - DNA, 25 bp, Mus musculus
gatgttgttgctggtgacaaccgga

SEQ ID NO: 934789 - DNA, 25 bp, Mus musculus
gatgttgtttcgctcttcattacag

SEQ ID NO: 934790 - DNA, 25 bp, Mus musculus
gatgttgtttcggtcttcattacag

SEQ ID NO: 934791 - DNA, 25 bp, Mus musculus
gatgtttaacagaattgcagaaacg

SEQ ID NO: 934792 - DNA, 25 bp, Mus musculus
gatgtttaacagtattgcagaaacg

SEQ ID NO: 934793 - DNA, 25 bp, Mus musculus
gatgtttcacagcgaagcagatgat

SEQ ID NO: 934794 - DNA, 25 bp, Mus musculus
gatgtttcacagggaagcagatgat

SEQ ID NO: 934795 - DNA, 25 bp, Mus musculus
gatgtttgagaactatgacatcagc

SEQ ID NO: 934796 - DNA, 25 bp, Mus musculus
gatgtttgagaagtatgacatcagc

SEQ ID NO: 934797 - DNA, 25 bp, Mus musculus
gatgtttgtgaacggggctccagaa

SEQ ID NO: 934798 - DNA, 25 bp, Mus musculus
gatgtttgtgaagggggctccagaa

SEQ ID NO: 934799 - DNA, 25 bp, Mus musculus
gatgttttatcacatttccctggag

SEQ ID NO: 934800 - DNA, 25 bp, Mus musculus
gatgttttatcagatttccctggag

SEQ ID NO: 934801 - DNA, 25 bp, Mus musculus
gatgtttttgagcaatctgaagaac

SEQ ID NO: 934802 - DNA, 25 bp, Mus musculus
gatgtttttgaggaatctgaagaac

SEQ ID NO: 934803 - DNA, 25 bp, Mus musculus
gattaaaaagcatactcactgttac

SEQ ID NO: 934804 - DNA, 25 bp, Mus musculus
gattaaaaaggatactcactgttac

SEQ ID NO: 934805 - DNA, 25 bp, Mus musculus
gattaaaatgtgaacgctgtggatt

SEQ ID NO: 934806 - DNA, 25 bp, Mus musculus
gattaaaatgtgaaggctgtggatt

SEQ ID NO: 934807 - DNA, 25 bp, Mus musculus
gattaaagtgtgaacattgtggcat

SEQ ID NO: 934808 - DNA, 25 bp, Mus musculus
gattaaagtgtgaagattgtggcat

SEQ ID NO: 934809 - DNA, 25 bp, Mus musculus
gattaacctgctgctggatttctag

SEQ ID NO: 934810 - DNA, 25 bp, Mus musculus
gattaacctggtgctggatttctag

SEQ ID NO: 934811 - DNA, 25 bp, Mus musculus
gattaatttgtctaaactgggattg

SEQ ID NO: 934812 - DNA, 25 bp, Mus musculus
gattaatttgtctatactgggattg

SEQ ID NO: 934813 - DNA, 25 bp, Mus musculus
gattacaataagcggtggtacagaa

SEQ ID NO: 934814 - DNA, 25 bp, Mus musculus
gattacaataaggggtggtacagaa

SEQ ID NO: 934815 - DNA, 25 bp, Mus musculus
gattacaatcaacggctcagtgcac

SEQ ID NO: 934816 - DNA, 25 bp, Mus musculus
gattacaatcaagggctcagtgcac

SEQ ID NO: 934817 - DNA, 25 bp, Mus musculus
gattacacattgctcgacatggtgc

SEQ ID NO: 934818 - DNA, 25 bp, Mus musculus
gattacacattgctggacatggtgc

SEQ ID NO: 934819 - DNA, 25 bp, Mus musculus
gattacagagaattgtatttctttc

SEQ ID NO: 934820 - DNA, 25 bp, Mus musculus
gattacagagcctttggtataggat

SEQ ID NO: 934821 - DNA, 25 bp, Mus musculus
gattacagagcttgccatgaagtgt

SEQ ID NO: 934822 - DNA, 25 bp, Mus musculus
gattacagaggctttggtataggat

SEQ ID NO: 934823 - DNA, 25 bp, Mus musculus
gattacagaggttgccatgaagtgt

SEQ ID NO: 934824 - DNA, 25 bp, Mus musculus
gattacagagtattgtatttctttc

SEQ ID NO: 934825 - DNA, 25 bp, Mus musculus
gattacagctcacgaagcagtggct

SEQ ID NO: 934826 - DNA, 25 bp, Mus musculus
gattacagctcaggaagcagtggct

SEQ ID NO: 934827 - DNA, 25 bp, Mus musculus
gattacatagagtatcccctactct

SEQ ID NO: 934828 - DNA, 25 bp, Mus musculus
gattacatagccaacaaggagagcc

SEQ ID NO: 934829 - DNA, 25 bp, Mus musculus
gattacataggcaacaaggagagcc

SEQ ID NO: 934830 - DNA, 25 bp, Mus musculus
gattacatagtgtatcccctactct

SEQ ID NO: 934831 - DNA, 25 bp, Mus musculus
gattacatcgcaggctgccagctgg

SEQ ID NO: 934832 - DNA, 25 bp, Mus musculus
gattacatcggaggctgccagctgg

SEQ ID NO: 934833 - DNA, 25 bp, Mus musculus
gattacatttacgacctgatcaaag

SEQ ID NO: 934834 - DNA, 25 bp, Mus musculus
gattacatttacgagctgatcaaag

SEQ ID NO: 934835 - DNA, 25 bp, Mus musculus
gattaccaagctgggcagccgaaga

SEQ ID NO: 934836 - DNA, 25 bp, Mus musculus
gattaccaaggtgggcagccgaaga

SEQ ID NO: 934837 - DNA, 25 bp, Mus musculus
gattactttaagacagagcacaaat

SEQ ID NO: 934838 - DNA, 25 bp, Mus musculus
gattactttaagagcacaaattgga

SEQ ID NO: 934839 - DNA, 25 bp, Mus musculus
gattactttaagcacaaattggaga

SEQ ID NO: 934840 - DNA, 25 bp, Mus musculus
gattactttaaggacaaattggaga

SEQ ID NO: 934841 - DNA, 25 bp, Mus musculus
gattactttaagtcagagcacaaat

SEQ ID NO: 934842 - DNA, 25 bp, Mus musculus
gattactttaagtgcacaaattgga

SEQ ID NO: 934843 - DNA, 25 bp, Mus musculus
gattaggaagcaagaatatgaacgg

SEQ ID NO: 934844 - DNA, 25 bp, Mus musculus
gattaggaaggaagaatatgaacgg

SEQ ID NO: 934845 - DNA, 25 bp, Mus musculus
gattaggccgcggacgtcacaggct

SEQ ID NO: 934846 - DNA, 25 bp, Mus musculus
gattaggccgcggaggtcacaggct

SEQ ID NO: 934847 - DNA, 25 bp, Mus musculus
gattataatgagccaaagggtgtgt

SEQ ID NO: 934848 - DNA, 25 bp, Mus musculus
gattataatgaggcaaagggtgtgt

SEQ ID NO: 934849 - DNA, 25 bp, Mus musculus
gattatcatgcgtgccccttccgtc

SEQ ID NO: 934850 - DNA, 25 bp, Mus musculus
gattatcatgggtgccccttccgtc

SEQ ID NO: 934851 - DNA, 25 bp, Mus musculus
gattatggacagcactgaaagactt

SEQ ID NO: 934852 - DNA, 25 bp, Mus musculus
gattatggacaggactgaaagactt

SEQ ID NO: 934853 - DNA, 25 bp, Mus musculus
gattatggatacagcaggaaatgac

SEQ ID NO: 934854 - DNA, 25 bp, Mus musculus
gattatggattcagcaggaaatgac

SEQ ID NO: 934855 - DNA, 25 bp, Mus musculus
gattattatgctttctcccagatgg

SEQ ID NO: 934856 - DNA, 25 bp, Mus musculus
gattattatggtttctcccagatgg

SEQ ID NO: 934857 - DNA, 25 bp, Mus musculus
gattattcagcccagtggagagagg

SEQ ID NO: 934858 - DNA, 25 bp, Mus musculus
gattattcaggccagtggagagagg

SEQ ID NO: 934859 - DNA, 25 bp, Mus musculus
gattatttagcacaggtgatgaaca

SEQ ID NO: 934860 - DNA, 25 bp, Mus musculus
gattatttaggacaggtgatgaaca

SEQ ID NO: 934861 - DNA, 25 bp, Mus musculus
gattcaaccacaatgacggattcca

SEQ ID NO: 934862 - DNA, 25 bp, Mus musculus
gattcaaccacattgacggattcca

SEQ ID NO: 934863 - DNA, 25 bp, Mus musculus
gattcaagagcaaagtgaccaagtt

SEQ ID NO: 934864 - DNA, 25 bp, Mus musculus
gattcaagagcatagtgaccaagtt

SEQ ID NO: 934865 - DNA, 25 bp, Mus musculus
gattcaagcatgctggaagggactg

SEQ ID NO: 934866 - DNA, 25 bp, Mus musculus
gattcaagcatggtggaagggactg

SEQ ID NO: 934867 - DNA, 25 bp, Mus musculus
gattcaagccaaagacaccataggt

SEQ ID NO: 934868 - DNA, 25 bp, Mus musculus
gattcaagccaatgacaccataggt

SEQ ID NO: 934869 - DNA, 25 bp, Mus musculus
gattcagaagatgcagaatgagcgg

SEQ ID NO: 934870 - DNA, 25 bp, Mus musculus
gattcagaagttgcagaatgagcgg

SEQ ID NO: 934871 - DNA, 25 bp, Mus musculus
gattcagacagtaaccttgtggaga

SEQ ID NO: 934872 - DNA, 25 bp, Mus musculus
gattcagacagtaagcttgtggaga

SEQ ID NO: 934873 - DNA, 25 bp, Mus musculus
gattcagagcgacaggagattgaag

SEQ ID NO: 934874 - DNA, 25 bp, Mus musculus
gattcagagcgagaggagattgaag

SEQ ID NO: 934875 - DNA, 25 bp, Mus musculus
gattcagcccggcacgatgatgccc

SEQ ID NO: 934876 - DNA, 25 bp, Mus musculus
gattcagcccggcaggatgatgccc

SEQ ID NO: 934877 - DNA, 25 bp, Mus musculus
gattcagctcaacgctgtcaagtcc

SEQ ID NO: 934878 - DNA, 25 bp, Mus musculus
gattcagctcaaggctgtcaagtcc

SEQ ID NO: 934879 - DNA, 25 bp, Mus musculus
gattcaggttcagacgagtcggatt

SEQ ID NO: 934880 - DNA, 25 bp, Mus musculus
gattcaggttcagaggagtcggatt

SEQ ID NO: 934881 - DNA, 25 bp, Mus musculus
gattccaacaagccatttgtatccc

SEQ ID NO: 934882 - DNA, 25 bp, Mus musculus
gattccaacaaggcatttgtatccc

SEQ ID NO: 934883 - DNA, 25 bp, Mus musculus
gattccaagcctgacgactgggaca

SEQ ID NO: 934884 - DNA, 25 bp, Mus musculus
gattccaagcctgacgactgggatg

SEQ ID NO: 934885 - DNA, 25 bp, Mus musculus
gattccaagcctgaggactgggaca

SEQ ID NO: 934886 - DNA, 25 bp, Mus musculus
gattccaagcctgaggactgggatg

SEQ ID NO: 934887 - DNA, 25 bp, Mus musculus
gattccacaaagcattgttgagctg

SEQ ID NO: 934888 - DNA, 25 bp, Mus musculus
gattccacaaaggattgttgagctg

SEQ ID NO: 934889 - DNA, 25 bp, Mus musculus
gattccaccaagcacgcatctcgga

SEQ ID NO: 934890 - DNA, 25 bp, Mus musculus
gattccaccaagcaggcatctcgga

SEQ ID NO: 934891 - DNA, 25 bp, Mus musculus
gattccagccagaacgatcggaatg

SEQ ID NO: 934892 - DNA, 25 bp, Mus musculus
gattccagccagaaggatcggaatg

SEQ ID NO: 934893 - DNA, 25 bp, Mus musculus
gattccagccagaccagcggagtcg

SEQ ID NO: 934894 - DNA, 25 bp, Mus musculus
gattccagccagtccagcggagtcg

SEQ ID NO: 934895 - DNA, 25 bp, Mus musculus
gattccaggcctcacgcatctgttg

SEQ ID NO: 934896 - DNA, 25 bp, Mus musculus
gattccaggcctcaggcatctgttg

SEQ ID NO: 934897 - DNA, 25 bp, Mus musculus
gattccccaggacgtcttggtgcgc

SEQ ID NO: 934898 - DNA, 25 bp, Mus musculus
gattccccaggaggtcttggtgcgc

SEQ ID NO: 934899 - DNA, 25 bp, Mus musculus
gattccctgaagattgcagtgttga

SEQ ID NO: 934900 - DNA, 25 bp, Mus musculus
gattccctgaagtttgcagtgttga

SEQ ID NO: 934901 - DNA, 25 bp, Mus musculus
gattccctggggccggcaagtccac

SEQ ID NO: 934902 - DNA, 25 bp, Mus musculus
gattccctgggggcggcaagtccac

SEQ ID NO: 934903 - DNA, 25 bp, Mus musculus
gattcctatgggcataacttcggag

SEQ ID NO: 934904 - DNA, 25 bp, Mus musculus
gattcctatggggataacttcggag

SEQ ID NO: 934905 - DNA, 25 bp, Mus musculus
gattcctcagcgcatcgtgaagctg

SEQ ID NO: 934906 - DNA, 25 bp, Mus musculus
gattcctcagggcatcgtgaagctg

SEQ ID NO: 934907 - DNA, 25 bp, Mus musculus
gattcctgtggatgagtgacttctg

SEQ ID NO: 934908 - DNA, 25 bp, Mus musculus
gattcctgtggatgtgtgacttctg

SEQ ID NO: 934909 - DNA, 25 bp, Mus musculus
gattccttaactcatgcagatgtca

SEQ ID NO: 934910 - DNA, 25 bp, Mus musculus
gattccttaactccaacaagttttt

SEQ ID NO: 934911 - DNA, 25 bp, Mus musculus
gattccttaactgatgcagatgtca

SEQ ID NO: 934912 - DNA, 25 bp, Mus musculus
gattccttaactgcaacaagttttt

SEQ ID NO: 934913 - DNA, 25 bp, Mus musculus
gattcgagagcttccgtgaggagga

SEQ ID NO: 934914 - DNA, 25 bp, Mus musculus
gattcgagaggttccgtgaggagga

SEQ ID NO: 934915 - DNA, 25 bp, Mus musculus
gattcgcaagctcgctgaccagtgc

SEQ ID NO: 934916 - DNA, 25 bp, Mus musculus
gattcgcaagctggctgaccagtgc

SEQ ID NO: 934917 - DNA, 25 bp, Mus musculus
gattcggcagatgtgggggagcagc

SEQ ID NO: 934918 - DNA, 25 bp, Mus musculus
gattcggcagttgtgggggagcagc

SEQ ID NO: 934919 - DNA, 25 bp, Mus musculus
gattcggctcagcgaaaattgaagc

SEQ ID NO: 934920 - DNA, 25 bp, Mus musculus
gattcggctcagggaaaattgaagc

SEQ ID NO: 934921 - DNA, 25 bp, Mus musculus
gattcgtcccctcacgatcgccacg

SEQ ID NO: 934922 - DNA, 25 bp, Mus musculus
gattcgtcccctcaggatcgccacg

SEQ ID NO: 934923 - DNA, 25 bp, Mus musculus
gattctacaagcaacgagttacacc

SEQ ID NO: 934924 - DNA, 25 bp, Mus musculus
gattctacaagcaaggagttacacc

SEQ ID NO: 934925 - DNA, 25 bp, Mus musculus
gattctcaagctgggaagtcatcaa

SEQ ID NO: 934926 - DNA, 25 bp, Mus musculus
gattctcaaggtgggaagtcatcaa

SEQ ID NO: 934927 - DNA, 25 bp, Mus musculus
gattctccacagtcactggagagtc

SEQ ID NO: 934928 - DNA, 25 bp, Mus musculus
gattctccacagtctctggagagtc

SEQ ID NO: 934929 - DNA, 25 bp, Mus musculus
gattctccagctcaacaactatgac

SEQ ID NO: 934930 - DNA, 25 bp, Mus musculus
gattctccaggtcaacaactatgac

SEQ ID NO: 934931 - DNA, 25 bp, Mus musculus
gattctcttgcattgttcatcacct

SEQ ID NO: 934932 - DNA, 25 bp, Mus musculus
gattctcttgccattcattgacagc

SEQ ID NO: 934933 - DNA, 25 bp, Mus musculus
gattctcttggattgttcatcacct

SEQ ID NO: 934934 - DNA, 25 bp, Mus musculus
gattctcttggcattcattgacagc

SEQ ID NO: 934935 - DNA, 25 bp, Mus musculus
gattctgaagacagacatgatgtca

SEQ ID NO: 934936 - DNA, 25 bp, Mus musculus
gattctgaagtcagacatgatgtca

SEQ ID NO: 934937 - DNA, 25 bp, Mus musculus
gattctgagacggaggagaccgact

SEQ ID NO: 934938 - DNA, 25 bp, Mus musculus
gattctgagagggaggagaccgact

SEQ ID NO: 934939 - DNA, 25 bp, Mus musculus
gattctgatcaacacgtctccattt

SEQ ID NO: 934940 - DNA, 25 bp, Mus musculus
gattctgatcaacaggtctccattt

SEQ ID NO: 934941 - DNA, 25 bp, Mus musculus
gattctgtgccccgtggcgtgtgct

SEQ ID NO: 934942 - DNA, 25 bp, Mus musculus
gattctgtgcccggtggcgtgtgct

SEQ ID NO: 934943 - DNA, 25 bp, Mus musculus
gattcttagcaacggtctgtcaccg

SEQ ID NO: 934944 - DNA, 25 bp, Mus musculus
gattcttagcaagggtctgtcaccg

SEQ ID NO: 934945 - DNA, 25 bp, Mus musculus
gattcttcagcacaggggatgaaca

SEQ ID NO: 934946 - DNA, 25 bp, Mus musculus
gattcttcagcctgaaaaagaacta

SEQ ID NO: 934947 - DNA, 25 bp, Mus musculus
gattcttcaggacaggggatgaaca

SEQ ID NO: 934948 - DNA, 25 bp, Mus musculus
gattcttcaggctgaaaaagaacta

SEQ ID NO: 934949 - DNA, 25 bp, Mus musculus
gattgaaaaacaccaggaggaagca

SEQ ID NO: 934950 - DNA, 25 bp, Mus musculus
gattgaaaaacagcaggaggaagca

SEQ ID NO: 934951 - DNA, 25 bp, Mus musculus
gattgaacaaaacaagaatgtcatt

SEQ ID NO: 934952 - DNA, 25 bp, Mus musculus
gattgaacaaaacatgaatgtcatt

SEQ ID NO: 934953 - DNA, 25 bp, Mus musculus
gattgaagaaaacgctaaagatcgc

SEQ ID NO: 934954 - DNA, 25 bp, Mus musculus
gattgaagaaaaggctaaagatcgc

SEQ ID NO: 934955 - DNA, 25 bp, Mus musculus
gattgaagagacttttcacagagcc

SEQ ID NO: 934956 - DNA, 25 bp, Mus musculus
gattgaagagtcttttcacagagcc

SEQ ID NO: 934957 - DNA, 25 bp, Mus musculus
gattgaagcaaacgagttggaattt

SEQ ID NO: 934958 - DNA, 25 bp, Mus musculus
gattgaagcaaaggagttggaattt

SEQ ID NO: 934959 - DNA, 25 bp, Mus musculus
gattgaagggagcttgcctgttgcc

SEQ ID NO: 934960 - DNA, 25 bp, Mus musculus
gattgaagggaggttgcctgttgcc

SEQ ID NO: 934961 - DNA, 25 bp, Mus musculus
gattgacaatatcacgctggtttac

SEQ ID NO: 934962 - DNA, 25 bp, Mus musculus
gattgacaatatcaggctggtttac

SEQ ID NO: 934963 - DNA, 25 bp, Mus musculus
gattgacaatatcctggaagagtca

SEQ ID NO: 934964 - DNA, 25 bp, Mus musculus
gattgacaatttcctggaagagtca

SEQ ID NO: 934965 - DNA, 25 bp, Mus musculus
gattgacacaatcgtcctaccagaa

SEQ ID NO: 934966 - DNA, 25 bp, Mus musculus
gattgacacaatggtcctaccagaa

SEQ ID NO: 934967 - DNA, 25 bp, Mus musculus
gattgagaagctcatagaagagctt

SEQ ID NO: 934968 - DNA, 25 bp, Mus musculus
gattgagaaggtcatagaagagctt

SEQ ID NO: 934969 - DNA, 25 bp, Mus musculus
gattgagcaccacctcttccccact

SEQ ID NO: 934970 - DNA, 25 bp, Mus musculus
gattgagcaccagctcttccccact

SEQ ID NO: 934971 - DNA, 25 bp, Mus musculus
gattgagcagatggatgaggtcaag

SEQ ID NO: 934972 - DNA, 25 bp, Mus musculus
gattgagcagttggatgaggtcaag

SEQ ID NO: 934973 - DNA, 25 bp, Mus musculus
gattgagtcgcaccctgatgcttgg

SEQ ID NO: 934974 - DNA, 25 bp, Mus musculus
gattgagtcggaccctgatgcttgg

SEQ ID NO: 934975 - DNA, 25 bp, Mus musculus
gattgataataccacgattgtctac

SEQ ID NO: 934976 - DNA, 25 bp, Mus musculus
gattgataataccaggattgtctac

SEQ ID NO: 934977 - DNA, 25 bp, Mus musculus
gattgatgggatccacacacctctg

SEQ ID NO: 934978 - DNA, 25 bp, Mus musculus
gattgatgggatgcacacacctctg

SEQ ID NO: 934979 - DNA, 25 bp, Mus musculus
gattgattcgctgtctacaaaatcc

SEQ ID NO: 934980 - DNA, 25 bp, Mus musculus
gattgattcggtgtctacaaaatcc

SEQ ID NO: 934981 - DNA, 25 bp, Mus musculus
gattgcacagcatcttcaacaattg

SEQ ID NO: 934982 - DNA, 25 bp, Mus musculus
gattgcacaggatcttcaacaattg

SEQ ID NO: 934983 - DNA, 25 bp, Mus musculus
gattgcagagcgagcaaagaagatg

SEQ ID NO: 934984 - DNA, 25 bp, Mus musculus
gattgcagagggagcaaagaagatg

SEQ ID NO: 934985 - DNA, 25 bp, Mus musculus
gattgcagccaacgagcctgtacgg

SEQ ID NO: 934986 - DNA, 25 bp, Mus musculus
gattgcagccaaggagcctgtacgg

SEQ ID NO: 934987 - DNA, 25 bp, Mus musculus
gattgcagccagctatggtgtggag

SEQ ID NO: 934988 - DNA, 25 bp, Mus musculus
gattgcagccaggtatggtgtggag

SEQ ID NO: 934989 - DNA, 25 bp, Mus musculus
gattgcatcaaaagaggctgttcga

SEQ ID NO: 934990 - DNA, 25 bp, Mus musculus
gattgcatcaaatgaggctgttcga

SEQ ID NO: 934991 - DNA, 25 bp, Mus musculus
gattgcatctaaaggctcgttgttg

SEQ ID NO: 934992 - DNA, 25 bp, Mus musculus
gattgcatctaatggctcgttgttg

SEQ ID NO: 934993 - DNA, 25 bp, Mus musculus
gattgccaaccacacgtaccaccag

SEQ ID NO: 934994 - DNA, 25 bp, Mus musculus
gattgccaaccagacgtaccaccag

SEQ ID NO: 934995 - DNA, 25 bp, Mus musculus
gattgcccagcatgccctgaagttc

SEQ ID NO: 934996 - DNA, 25 bp, Mus musculus
gattgcccaggatgccctgaagttc

SEQ ID NO: 934997 - DNA, 25 bp, Mus musculus
gattgccctcaccatcaacaaggca

SEQ ID NO: 934998 - DNA, 25 bp, Mus musculus
gattgccctcacccataaaaataag

SEQ ID NO: 934999 - DNA, 25 bp, Mus musculus
gattgccctcacgatcaacaaggca

SEQ ID NO: 935000 - DNA, 25 bp, Mus musculus
gattgccctcacgcataaaaataag

SEQ ID NO: 935001 - DNA, 25 bp, Mus musculus
gattgcctggagagtgtgaaggatt

SEQ ID NO: 935002 - DNA, 25 bp, Mus musculus
gattgcctggtgagtgtgaaggatt

SEQ ID NO: 935003 - DNA, 25 bp, Mus musculus
gattgccttagccaagagctgtccc

SEQ ID NO: 935004 - DNA, 25 bp, Mus musculus
gattgccttagccatgagctgtccc

SEQ ID NO: 935005 - DNA, 25 bp, Mus musculus
gattgcgcagcccttcagaagtatt

SEQ ID NO: 935006 - DNA, 25 bp, Mus musculus
gattgcgcaggccttcagaagtatt

SEQ ID NO: 935007 - DNA, 25 bp, Mus musculus
gattgctaaaagtactattaatcct

SEQ ID NO: 935008 - DNA, 25 bp, Mus musculus
gattgctaaacaccagagtaatgcg

SEQ ID NO: 935009 - DNA, 25 bp, Mus musculus
gattgctaaagaccagagtaatgcg

SEQ ID NO: 935010 - DNA, 25 bp, Mus musculus
gattgctaaatgtactattaatcct

SEQ ID NO: 935011 - DNA, 25 bp, Mus musculus
gattggaaaaatcgtggccaatatg

SEQ ID NO: 935012 - DNA, 25 bp, Mus musculus
gattggaaaaatggtggccaatatg

SEQ ID NO: 935013 - DNA, 25 bp, Mus musculus
gattggaaaagaagtaacaagagtc

SEQ ID NO: 935014 - DNA, 25 bp, Mus musculus
gattggaaaagatgtaacaagagtc

SEQ ID NO: 935015 - DNA, 25 bp, Mus musculus
gattggaaggttcaccgagccccat

SEQ ID NO: 935016 - DNA, 25 bp, Mus musculus
gattggaaggttcagcgagccccat

SEQ ID NO: 935017 - DNA, 25 bp, Mus musculus
gattggatcagccgatgacagagat

SEQ ID NO: 935018 - DNA, 25 bp, Mus musculus
gattggatcagcggatgacagagat

SEQ ID NO: 935019 - DNA, 25 bp, Mus musculus
gattggcaagcactggtgacgtatg

SEQ ID NO: 935020 - DNA, 25 bp, Mus musculus
gattggcaagcagtggtgacgtatg

SEQ ID NO: 935021 - DNA, 25 bp, Mus musculus
gattggccatgtcttcaagcgctgt

SEQ ID NO: 935022 - DNA, 25 bp, Mus musculus
gattggccatgtgttcaagcgctgt

SEQ ID NO: 935023 - DNA, 25 bp, Mus musculus
gattggctttcacgatgcggtacac

SEQ ID NO: 935024 - DNA, 25 bp, Mus musculus
gattggctttcaggatgcggtacac

SEQ ID NO: 935025 - DNA, 25 bp, Mus musculus
gattggtgaaaaccgctgtatgtgt

SEQ ID NO: 935026 - DNA, 25 bp, Mus musculus
gattggtgaaaagcgctgtatgtgt

SEQ ID NO: 935027 - DNA, 25 bp, Mus musculus
gattggtgctcattcgtattgctaa

SEQ ID NO: 935028 - DNA, 25 bp, Mus musculus
gattggtgctcattggtattgctaa

SEQ ID NO: 935029 - DNA, 25 bp, Mus musculus
gattggttacctcccctttgtagag

SEQ ID NO: 935030 - DNA, 25 bp, Mus musculus
gattggttacctgccctttgtagag

SEQ ID NO: 935031 - DNA, 25 bp, Mus musculus
gattggttatgtcacaaacataaac

SEQ ID NO: 935032 - DNA, 25 bp, Mus musculus
gattggttatgtcgcagcagaagaa

SEQ ID NO: 935033 - DNA, 25 bp, Mus musculus
gattggttatgtgacaaacataaac

SEQ ID NO: 935034 - DNA, 25 bp, Mus musculus
gattggttatgtggcagcagaagaa

SEQ ID NO: 935035 - DNA, 25 bp, Mus musculus
gattgtcaagagcaactgcaatgta

SEQ ID NO: 935036 - DNA, 25 bp, Mus musculus
gattgtcaagcatcagctgtaatga

SEQ ID NO: 935037 - DNA, 25 bp, Mus musculus
gattgtcaaggatcagctgtaatga

SEQ ID NO: 935038 - DNA, 25 bp, Mus musculus
gattgtcaagtgcaactgcaatgta

SEQ ID NO: 935039 - DNA, 25 bp, Mus musculus
gattgtcgagacgtgcgaccgcatt

SEQ ID NO: 935040 - DNA, 25 bp, Mus musculus
gattgtcgagtcgtgcgaccgcatt

SEQ ID NO: 935041 - DNA, 25 bp, Mus musculus
gattgtgctcaaaaagtgctgcaag

SEQ ID NO: 935042 - DNA, 25 bp, Mus musculus
gattgtgctcaaaatgtgctgcaag

SEQ ID NO: 935043 - DNA, 25 bp, Mus musculus
gattgtgtgcgacaccttggatgac

SEQ ID NO: 935044 - DNA, 25 bp, Mus musculus
gattgtgtgcgacagcttggatgac

SEQ ID NO: 935045 - DNA, 25 bp, Mus musculus
gattgtgtgtctcgcttatggtagc

SEQ ID NO: 935046 - DNA, 25 bp, Mus musculus
gattgtgtgtctcggagaagatgac

SEQ ID NO: 935047 - DNA, 25 bp, Mus musculus
gattgtgtgtctggcttatggtagc

SEQ ID NO: 935048 - DNA, 25 bp, Mus musculus
gattgtgtgtctgggagaagatgac

SEQ ID NO: 935049 - DNA, 25 bp, Mus musculus
gattgttgaacatataattgacact

SEQ ID NO: 935050 - DNA, 25 bp, Mus musculus
gattgttgaagatataattgacact

SEQ ID NO: 935051 - DNA, 25 bp, Mus musculus
gattgttgtgcattctgactccaag

SEQ ID NO: 935052 - DNA, 25 bp, Mus musculus
gattgttgtggattctgactccaag

SEQ ID NO: 935053 - DNA, 25 bp, Mus musculus
gatttaaaagcgatgtcaatgaagc

SEQ ID NO: 935054 - DNA, 25 bp, Mus musculus
gatttaaaagggatgtcaatgaagc

SEQ ID NO: 935055 - DNA, 25 bp, Mus musculus
gatttacagctagtacatcactatt

SEQ ID NO: 935056 - DNA, 25 bp, Mus musculus
gatttacagctagttcatcactatt

SEQ ID NO: 935057 - DNA, 25 bp, Mus musculus
gatttacctttgcacaaagaagaat

SEQ ID NO: 935058 - DNA, 25 bp, Mus musculus
gatttacctttgcagaaagaagaat

SEQ ID NO: 935059 - DNA, 25 bp, Mus musculus
gatttagtatcaaaacttctctatt

SEQ ID NO: 935060 - DNA, 25 bp, Mus musculus
gatttagtatcaaatcttctctatt

SEQ ID NO: 935061 - DNA, 25 bp, Mus musculus
gatttatcagaaacatacaagaaat

SEQ ID NO: 935062 - DNA, 25 bp, Mus musculus
gatttatcagtaacatacaagaaat

SEQ ID NO: 935063 - DNA, 25 bp, Mus musculus
gatttatcatttaacaaaacatata

SEQ ID NO: 935064 - DNA, 25 bp, Mus musculus
gatttatcatttaagaaaacatata

SEQ ID NO: 935065 - DNA, 25 bp, Mus musculus
gatttatcccagcatctgcagctaa

SEQ ID NO: 935066 - DNA, 25 bp, Mus musculus
gatttatcccaggatctgcagctaa

SEQ ID NO: 935067 - DNA, 25 bp, Mus musculus
gatttatgagactaccgttaataag

SEQ ID NO: 935068 - DNA, 25 bp, Mus musculus
gatttatgagtctaccgttaataag

SEQ ID NO: 935069 - DNA, 25 bp, Mus musculus
gatttattactgctgatcaagcgag

SEQ ID NO: 935070 - DNA, 25 bp, Mus musculus
gatttattactggtgatcaagcgag

SEQ ID NO: 935071 - DNA, 25 bp, Mus musculus
gatttcatagttgaagttatcaatg

SEQ ID NO: 935072 - DNA, 25 bp, Mus musculus
gatttcatagttgatgttatcaatg

SEQ ID NO: 935073 - DNA, 25 bp, Mus musculus
gatttccaagcaatctggtacacgg

SEQ ID NO: 935074 - DNA, 25 bp, Mus musculus
gatttccaagcaatgtggtacacgg

SEQ ID NO: 935075 - DNA, 25 bp, Mus musculus
gatttccacagtcttgctctagcta

SEQ ID NO: 935076 - DNA, 25 bp, Mus musculus
gatttccacagtgttgctctagcta

SEQ ID NO: 935077 - DNA, 25 bp, Mus musculus
gatttcccagcacagcaagctgacg

SEQ ID NO: 935078 - DNA, 25 bp, Mus musculus
gatttcccagcagagcaagctgacg

SEQ ID NO: 935079 - DNA, 25 bp, Mus musculus
gatttccgatgacttcctggtacag

SEQ ID NO: 935080 - DNA, 25 bp, Mus musculus
gatttccgatgagttcctggtacag

SEQ ID NO: 935081 - DNA, 25 bp, Mus musculus
gatttcctgattcttccccagaaag

SEQ ID NO: 935082 - DNA, 25 bp, Mus musculus
gatttcctgattgttccccagaaag

SEQ ID NO: 935083 - DNA, 25 bp, Mus musculus
gatttctcaaagctgtgtgtgctgc

SEQ ID NO: 935084 - DNA, 25 bp, Mus musculus
gatttctcaaaggtgtgtgtgctgc

SEQ ID NO: 935085 - DNA, 25 bp, Mus musculus
gatttctgaaggcgcttgtcaatga

SEQ ID NO: 935086 - DNA, 25 bp, Mus musculus
gatttctgaaggggcttgtcaatga

SEQ ID NO: 935087 - DNA, 25 bp, Mus musculus
gatttgatgacaatcgaagaaattt

SEQ ID NO: 935088 - DNA, 25 bp, Mus musculus
gatttgatgacaatggaagaaattt

SEQ ID NO: 935089 - DNA, 25 bp, Mus musculus
gatttgattgcagacggagcaaaga

SEQ ID NO: 935090 - DNA, 25 bp, Mus musculus
gatttgattgcagagggagcaaaga

SEQ ID NO: 935091 - DNA, 25 bp, Mus musculus
gatttgcaggcaggaaaagcttttg

SEQ ID NO: 935092 - DNA, 25 bp, Mus musculus
gatttgcagggaggaaaagcttttg

SEQ ID NO: 935093 - DNA, 25 bp, Mus musculus
gatttgctggtgaacgttcaattgt

SEQ ID NO: 935094 - DNA, 25 bp, Mus musculus
gatttgctggtgaacttatgtaatc

SEQ ID NO: 935095 - DNA, 25 bp, Mus musculus
gatttgctggtgaaggttcaattgt

SEQ ID NO: 935096 - DNA, 25 bp, Mus musculus
gatttgctggtgaagttatgtaatc

SEQ ID NO: 935097 - DNA, 25 bp, Mus musculus
gatttgcttccaaaccaggaaaagc

SEQ ID NO: 935098 - DNA, 25 bp, Mus musculus
gatttgcttccaaacgaaaagcgac

SEQ ID NO: 935099 - DNA, 25 bp, Mus musculus
gatttgcttccaaagcaggaaaagc

SEQ ID NO: 935100 - DNA, 25 bp, Mus musculus
gatttgcttccaaaggaaaagcgac

SEQ ID NO: 935101 - DNA, 25 bp, Mus musculus
gatttggagtagatcaatccccttc

SEQ ID NO: 935102 - DNA, 25 bp, Mus musculus
gatttggagtagttcaatccccttc

SEQ ID NO: 935103 - DNA, 25 bp, Mus musculus
gatttggatgttcccgtatctgccc

SEQ ID NO: 935104 - DNA, 25 bp, Mus musculus
gatttggatgttccggtatctgccc

SEQ ID NO: 935105 - DNA, 25 bp, Mus musculus
gatttggcaatgatcgaagcaattt

SEQ ID NO: 935106 - DNA, 25 bp, Mus musculus
gatttggcaatgatcgtggctatgg

SEQ ID NO: 935107 - DNA, 25 bp, Mus musculus
gatttggcaatgatcgtggttatgg

SEQ ID NO: 935108 - DNA, 25 bp, Mus musculus
gatttggcaatgatggaagcaattt

SEQ ID NO: 935109 - DNA, 25 bp, Mus musculus
gatttggcaatgatggtggctatgg

SEQ ID NO: 935110 - DNA, 25 bp, Mus musculus
gatttggcaatgatggtggttatgg

SEQ ID NO: 935111 - DNA, 25 bp, Mus musculus
gatttggctcatcacgaggactgac

SEQ ID NO: 935112 - DNA, 25 bp, Mus musculus
gatttggctcatcacttggcagttc

SEQ ID NO: 935113 - DNA, 25 bp, Mus musculus
gatttggctcatcaggaggactgac

SEQ ID NO: 935114 - DNA, 25 bp, Mus musculus
gatttggctcatcagttggcagttc

SEQ ID NO: 935115 - DNA, 25 bp, Mus musculus
gatttgggcacgatgtataccaggt

SEQ ID NO: 935116 - DNA, 25 bp, Mus musculus
gatttgggcacgcactgtcagggca

SEQ ID NO: 935117 - DNA, 25 bp, Mus musculus
gatttgggcacggactgtcagggca

SEQ ID NO: 935118 - DNA, 25 bp, Mus musculus
gatttgggcacgttgtataccaggt

SEQ ID NO: 935119 - DNA, 25 bp, Mus musculus
gattttaaagagatgattccagaat

SEQ ID NO: 935120 - DNA, 25 bp, Mus musculus
gattttaaagagttgattccagaat

SEQ ID NO: 935121 - DNA, 25 bp, Mus musculus
gattttacagagtgctaccagtata

SEQ ID NO: 935122 - DNA, 25 bp, Mus musculus
gattttacagtgtgctaccagtata

SEQ ID NO: 935123 - DNA, 25 bp, Mus musculus
gattttatgctttacgtgaaggcga

SEQ ID NO: 935124 - DNA, 25 bp, Mus musculus
gattttatgctttaggtgaaggcga

SEQ ID NO: 935125 - DNA, 25 bp, Mus musculus
gattttcggcaacgatgagccccaa

SEQ ID NO: 935126 - DNA, 25 bp, Mus musculus
gattttcggcaacggcgtctactgg

SEQ ID NO: 935127 - DNA, 25 bp, Mus musculus
gattttcggcaaggatgagccccaa

SEQ ID NO: 935128 - DNA, 25 bp, Mus musculus
gattttcggcaagggcgtctactgg

SEQ ID NO: 935129 - DNA, 25 bp, Mus musculus
gattttctggataacagtgcctcgg

SEQ ID NO: 935130 - DNA, 25 bp, Mus musculus
gattttctggataaccccacctgga

SEQ ID NO: 935131 - DNA, 25 bp, Mus musculus
gattttctggataacgtgcttctgt

SEQ ID NO: 935132 - DNA, 25 bp, Mus musculus
gattttctggataagagtgcctcgg

SEQ ID NO: 935133 - DNA, 25 bp, Mus musculus
gattttctggataagcccacctgga

SEQ ID NO: 935134 - DNA, 25 bp, Mus musculus
gattttctggataaggtgcttctgt

SEQ ID NO: 935135 - DNA, 25 bp, Mus musculus
gattttcttcacatattccatgcca

SEQ ID NO: 935136 - DNA, 25 bp, Mus musculus
gattttcttcacattttccatgcca

SEQ ID NO: 935137 - DNA, 25 bp, Mus musculus
gattttgaaacacaagaagctgatc

SEQ ID NO: 935138 - DNA, 25 bp, Mus musculus
gattttgaaagacaagaagctgatc

SEQ ID NO: 935139 - DNA, 25 bp, Mus musculus
gattttgagaagcatgatgacagca

SEQ ID NO: 935140 - DNA, 25 bp, Mus musculus
gattttgagaaggatgatgacagca

SEQ ID NO: 935141 - DNA, 25 bp, Mus musculus
gattttgatgaaaaaggagtgctga

SEQ ID NO: 935142 - DNA, 25 bp, Mus musculus
gattttgatgaaaatggagtgctga

SEQ ID NO: 935143 - DNA, 25 bp, Mus musculus
gattttgctctagacaatggacagc

SEQ ID NO: 935144 - DNA, 25 bp, Mus musculus
gattttgctctagagaatggacagc

SEQ ID NO: 935145 - DNA, 25 bp, Mus musculus
gattttgctgaagcatcaacaggca

SEQ ID NO: 935146 - DNA, 25 bp, Mus musculus
gattttgctgaagcttcaacaggca

SEQ ID NO: 935147 - DNA, 25 bp, Mus musculus
gattttggaacacgcaacaatatca

SEQ ID NO: 935148 - DNA, 25 bp, Mus musculus
gattttggaacaggcaacaatatca

SEQ ID NO: 935149 - DNA, 25 bp, Mus musculus
gatttttacaaggacttgacatcag

SEQ ID NO: 935150 - DNA, 25 bp, Mus musculus
gatttttacatggacttgacatcag

SEQ ID NO: 935151 - DNA, 25 bp, Mus musculus
gatttttcggaacacagcgtggaag

SEQ ID NO: 935152 - DNA, 25 bp, Mus musculus
gatttttcggaagacagcgtggaag

SEQ ID NO: 935153 - DNA, 25 bp, Mus musculus
gatttttgaacccatatgaaaataa

SEQ ID NO: 935154 - DNA, 25 bp, Mus musculus
gatttttgaagccatatgaaaataa

SEQ ID NO: 935155 - DNA, 25 bp, Mus musculus
gcaaaaacaaagctcctgggctcca

SEQ ID NO: 935156 - DNA, 25 bp, Mus musculus
gcaaaaacaatgctcctgggctcca

SEQ ID NO: 935157 - DNA, 25 bp, Mus musculus
gcaaaaacagatgtggaaagagcac

SEQ ID NO: 935158 - DNA, 25 bp, Mus musculus
gcaaaaacagttgtggaaagagcac

SEQ ID NO: 935159 - DNA, 25 bp, Mus musculus
gcaaaaatgagaaacagatgaaaat

SEQ ID NO: 935160 - DNA, 25 bp, Mus musculus
gcaaaaatgagaaagagatgaaaat

SEQ ID NO: 935161 - DNA, 25 bp, Mus musculus
gcaaaaatgttacacggatcctatg

SEQ ID NO: 935162 - DNA, 25 bp, Mus musculus
gcaaaaatgttacagggatcctatg

SEQ ID NO: 935163 - DNA, 25 bp, Mus musculus
gcaaaacatgctgagcattgccgtg

SEQ ID NO: 935164 - DNA, 25 bp, Mus musculus
gcaaaacatggtgagcattgccgtg

SEQ ID NO: 935165 - DNA, 25 bp, Mus musculus
gcaaaaccagaccccgcaggatccc

SEQ ID NO: 935166 - DNA, 25 bp, Mus musculus
gcaaaaccagatccaagtggagaat

SEQ ID NO: 935167 - DNA, 25 bp, Mus musculus
gcaaaaccagtccccgcaggatccc

SEQ ID NO: 935168 - DNA, 25 bp, Mus musculus
gcaaaaccagttccaagtggagaat

SEQ ID NO: 935169 - DNA, 25 bp, Mus musculus
gcaaaactgaagcatctgaaccaat

SEQ ID NO: 935170 - DNA, 25 bp, Mus musculus
gcaaaactgaagcatggcgtggttc

SEQ ID NO: 935171 - DNA, 25 bp, Mus musculus
gcaaaactgaaggatctgaaccaat

SEQ ID NO: 935172 - DNA, 25 bp, Mus musculus
gcaaaactgaaggatggcgtggttc

SEQ ID NO: 935173 - DNA, 25 bp, Mus musculus
gcaaaagaataatccaagggtgaaa

SEQ ID NO: 935174 - DNA, 25 bp, Mus musculus
gcaaaagaattatccaagggtgaaa

SEQ ID NO: 935175 - DNA, 25 bp, Mus musculus
gcaaaagcagctacctgtttgcagt

SEQ ID NO: 935176 - DNA, 25 bp, Mus musculus
gcaaaagcaggtacctgtttgcagt

SEQ ID NO: 935177 - DNA, 25 bp, Mus musculus
gcaaaaggagcacgtgcttttggat

SEQ ID NO: 935178 - DNA, 25 bp, Mus musculus
gcaaaaggagcaggtgcttttggat

SEQ ID NO: 935179 - DNA, 25 bp, Mus musculus
gcaaaagtgtggatgaactcttcca

SEQ ID NO: 935180 - DNA, 25 bp, Mus musculus
gcaaaagtgtggttgaactcttcca

SEQ ID NO: 935181 - DNA, 25 bp, Mus musculus
gcaaaagttgatactggacaactgt

SEQ ID NO: 935182 - DNA, 25 bp, Mus musculus
gcaaaagttgattctggacaactgt

SEQ ID NO: 935183 - DNA, 25 bp, Mus musculus
gcaaaatactcacacaaagaagaat

SEQ ID NO: 935184 - DNA, 25 bp, Mus musculus
gcaaaatactcacagaaagaagaat

SEQ ID NO: 935185 - DNA, 25 bp, Mus musculus
gcaaaatagcgaagtctggaataaa

SEQ ID NO: 935186 - DNA, 25 bp, Mus musculus
gcaaaatagcgatgtctggaataaa

SEQ ID NO: 935187 - DNA, 25 bp, Mus musculus
gcaaaatcagcgagtacattgtaga

SEQ ID NO: 935188 - DNA, 25 bp, Mus musculus
gcaaaatcagcgtgtacattgtaga

SEQ ID NO: 935189 - DNA, 25 bp, Mus musculus
gcaaaatctcaaattgctcttaaac

SEQ ID NO: 935190 - DNA, 25 bp, Mus musculus
gcaaaatctcaatttgctcttaaac

SEQ ID NO: 935191 - DNA, 25 bp, Mus musculus
gcaaaatgggcgagcaacctatctt

SEQ ID NO: 935192 - DNA, 25 bp, Mus musculus
gcaaaatgggggagcaacctatctt

SEQ ID NO: 935193 - DNA, 25 bp, Mus musculus
gcaaacaaacagcatttgccgaatg

SEQ ID NO: 935194 - DNA, 25 bp, Mus musculus
gcaaacaaacaggatttgccgaatg

SEQ ID NO: 935195 - DNA, 25 bp, Mus musculus
gcaaacaaattgctactgcttcgtg

SEQ ID NO: 935196 - DNA, 25 bp, Mus musculus
gcaaacaaattggtactgcttcgtg

SEQ ID NO: 935197 - DNA, 25 bp, Mus musculus
gcaaacaatcagcctgccgaatctg

SEQ ID NO: 935198 - DNA, 25 bp, Mus musculus
gcaaacaatcaggctgccgaatctg

SEQ ID NO: 935199 - DNA, 25 bp, Mus musculus
gcaaacaccccacgtgatcatggaa

SEQ ID NO: 935200 - DNA, 25 bp, Mus musculus
gcaaacaccccaggtgatcatggaa

SEQ ID NO: 935201 - DNA, 25 bp, Mus musculus
gcaaacactgcacgttaaaatgcca

SEQ ID NO: 935202 - DNA, 25 bp, Mus musculus
gcaaacactgcaggttaaaatgcca

SEQ ID NO: 935203 - DNA, 25 bp, Mus musculus
gcaaacactgtagaccttcgagtca

SEQ ID NO: 935204 - DNA, 25 bp, Mus musculus
gcaaacactgtagagcttcgagtca

SEQ ID NO: 935205 - DNA, 25 bp, Mus musculus
gcaaacactgtctaccaccatcaaa

SEQ ID NO: 935206 - DNA, 25 bp, Mus musculus
gcaaacactgtctagcaccatcaaa

SEQ ID NO: 935207 - DNA, 25 bp, Mus musculus
gcaaacagagagacataatgatgag

SEQ ID NO: 935208 - DNA, 25 bp, Mus musculus
gcaaacagagtgacataatgatgag

SEQ ID NO: 935209 - DNA, 25 bp, Mus musculus
gcaaacatcatcatccctgagtttg

SEQ ID NO: 935210 - DNA, 25 bp, Mus musculus
gcaaacatcatcatgcctgagtttg

SEQ ID NO: 935211 - DNA, 25 bp, Mus musculus
gcaaacatggcaccagagtcactcg

SEQ ID NO: 935212 - DNA, 25 bp, Mus musculus
gcaaacatggcacgctctacacaga

SEQ ID NO: 935213 - DNA, 25 bp, Mus musculus
gcaaacatggcagcagagtcactcg

SEQ ID NO: 935214 - DNA, 25 bp, Mus musculus
gcaaacatggcaggctctacacaga

SEQ ID NO: 935215 - DNA, 25 bp, Mus musculus
gcaaacattgtgaacatgtgaacga

SEQ ID NO: 935216 - DNA, 25 bp, Mus musculus
gcaaacattgtgaagatgtgaacga

SEQ ID NO: 935217 - DNA, 25 bp, Mus musculus
gcaaaccagcaactgcgactgtatc

SEQ ID NO: 935218 - DNA, 25 bp, Mus musculus
gcaaaccagcaagtgcgactgtatc

SEQ ID NO: 935219 - DNA, 25 bp, Mus musculus
gcaaaccatgatctcaagaccagag

SEQ ID NO: 935220 - DNA, 25 bp, Mus musculus
gcaaaccatgcctcaatctaggtgg

SEQ ID NO: 935221 - DNA, 25 bp, Mus musculus
gcaaaccatggctcaatctaggtgg

SEQ ID NO: 935222 - DNA, 25 bp, Mus musculus
gcaaaccatgttctcaagaccagag

SEQ ID NO: 935223 - DNA, 25 bp, Mus musculus
gcaaaccattcactttgcaggagac

SEQ ID NO: 935224 - DNA, 25 bp, Mus musculus
gcaaaccattcagtttgcaggagac

SEQ ID NO: 935225 - DNA, 25 bp, Mus musculus
gcaaacctaaagcgtatgcatttat

SEQ ID NO: 935226 - DNA, 25 bp, Mus musculus
gcaaacctaaagggtatgcatttat

SEQ ID NO: 935227 - DNA, 25 bp, Mus musculus
gcaaacggcaggaggaggaagaggt

SEQ ID NO: 935228 - DNA, 25 bp, Mus musculus
gcaaacggcaggtggaggaagaggt

SEQ ID NO: 935229 - DNA, 25 bp, Mus musculus
gcaaactcagatccaatctcatggg

SEQ ID NO: 935230 - DNA, 25 bp, Mus musculus
gcaaactcagcacaaaggatcataa

SEQ ID NO: 935231 - DNA, 25 bp, Mus musculus
gcaaactcagcacataggatcataa

SEQ ID NO: 935232 - DNA, 25 bp, Mus musculus
gcaaactcagttccaatctcatggg

SEQ ID NO: 935233 - DNA, 25 bp, Mus musculus
gcaaactgttctccggtggagggag

SEQ ID NO: 935234 - DNA, 25 bp, Mus musculus
gcaaactgttctgcggtggagggag

SEQ ID NO: 935235 - DNA, 25 bp, Mus musculus
gcaaagaaaacaccgctattccaga

SEQ ID NO: 935236 - DNA, 25 bp, Mus musculus
gcaaagaaaacagcgctattccaga

SEQ ID NO: 935237 - DNA, 25 bp, Mus musculus
gcaaagaaagttgcaaaaatcttgg

SEQ ID NO: 935238 - DNA, 25 bp, Mus musculus
gcaaagaaagttgcaaatgattcat

SEQ ID NO: 935239 - DNA, 25 bp, Mus musculus
gcaaagaaagttgctaaaatcttgg

SEQ ID NO: 935240 - DNA, 25 bp, Mus musculus
gcaaagaaagttgctaatgattcat

SEQ ID NO: 935241 - DNA, 25 bp, Mus musculus
gcaaagaaggagagaaaaacaccta

SEQ ID NO: 935242 - DNA, 25 bp, Mus musculus
gcaaagaaggtgagaaaaacaccta

SEQ ID NO: 935243 - DNA, 25 bp, Mus musculus
gcaaagaagtcagcaaaagccaaat

SEQ ID NO: 935244 - DNA, 25 bp, Mus musculus
gcaaagaagtgagcaaaagccaaat

SEQ ID NO: 935245 - DNA, 25 bp, Mus musculus
gcaaagaatgggctaaccatagaga

SEQ ID NO: 935246 - DNA, 25 bp, Mus musculus
gcaaagaatggggtaaccatagaga

SEQ ID NO: 935247 - DNA, 25 bp, Mus musculus
gcaaagacggaacgactggaaatgg

SEQ ID NO: 935248 - DNA, 25 bp, Mus musculus
gcaaagacggaaggactggaaatgg

SEQ ID NO: 935249 - DNA, 25 bp, Mus musculus
gcaaagactcagagcattacaaagc

SEQ ID NO: 935250 - DNA, 25 bp, Mus musculus
gcaaagactcagaggattacaaagc

SEQ ID NO: 935251 - DNA, 25 bp, Mus musculus
gcaaagagatggagtcatgcacttc

SEQ ID NO: 935252 - DNA, 25 bp, Mus musculus
gcaaagagatggtgtcatgcacttc

SEQ ID NO: 935253 - DNA, 25 bp, Mus musculus
gcaaagagtcagacatttacattgt

SEQ ID NO: 935254 - DNA, 25 bp, Mus musculus
gcaaagagtcagtcatttacattgt

SEQ ID NO: 935255 - DNA, 25 bp, Mus musculus
gcaaagattttaatcgcactcctgg

SEQ ID NO: 935256 - DNA, 25 bp, Mus musculus
gcaaagattttattcgcactcctgg

SEQ ID NO: 935257 - DNA, 25 bp, Mus musculus
gcaaagcaagagattcgagtaagag

SEQ ID NO: 935258 - DNA, 25 bp, Mus musculus
gcaaagcaagagtttcgagtaagag

SEQ ID NO: 935259 - DNA, 25 bp, Mus musculus
gcaaaggaagaggacaagatgcaag

SEQ ID NO: 935260 - DNA, 25 bp, Mus musculus
gcaaaggaagaggagaagatgcaag

SEQ ID NO: 935261 - DNA, 25 bp, Mus musculus
gcaaaggaagctcaatgacagtcac

SEQ ID NO: 935262 - DNA, 25 bp, Mus musculus
gcaaaggaaggtcaatgacagtcac

SEQ ID NO: 935263 - DNA, 25 bp, Mus musculus
gcaaaggactgtcgtcaatgtgcgg

SEQ ID NO: 935264 - DNA, 25 bp, Mus musculus
gcaaaggactgtggtcaatgtgcgg

SEQ ID NO: 935265 - DNA, 25 bp, Mus musculus
gcaaaggaggcacctgcgattggag

SEQ ID NO: 935266 - DNA, 25 bp, Mus musculus
gcaaaggaggcagctgcgattggag

SEQ ID NO: 935267 - DNA, 25 bp, Mus musculus
gcaaaggaggcttggtgctaacagt

SEQ ID NO: 935268 - DNA, 25 bp, Mus musculus
gcaaaggagggttggtgctaacagt

SEQ ID NO: 935269 - DNA, 25 bp, Mus musculus
gcaaaggatctacatgagaatgaag

SEQ ID NO: 935270 - DNA, 25 bp, Mus musculus
gcaaaggatctagatgagaatgaag

SEQ ID NO: 935271 - DNA, 25 bp, Mus musculus
gcaaaggcagcatctattcccagaa

SEQ ID NO: 935272 - DNA, 25 bp, Mus musculus
gcaaaggcaggatctattcccagaa

SEQ ID NO: 935273 - DNA, 25 bp, Mus musculus
gcaaaggcgtcgagatccccactta

SEQ ID NO: 935274 - DNA, 25 bp, Mus musculus
gcaaaggcgtcgtgatccccactta

SEQ ID NO: 935275 - DNA, 25 bp, Mus musculus
gcaaaggctcagcacagaggcggtg

SEQ ID NO: 935276 - DNA, 25 bp, Mus musculus
gcaaaggctcaggacagaggcggtg

SEQ ID NO: 935277 - DNA, 25 bp, Mus musculus
gcaaaggcttttcgggcaggggctg

SEQ ID NO: 935278 - DNA, 25 bp, Mus musculus
gcaaaggcttttcgggctgactttg

SEQ ID NO: 935279 - DNA, 25 bp, Mus musculus
gcaaaggcttttggggcaggggctg

SEQ ID NO: 935280 - DNA, 25 bp, Mus musculus
gcaaaggcttttggggctgactttg

SEQ ID NO: 935281 - DNA, 25 bp, Mus musculus
gcaaagtgacagcagcaacgcctat

SEQ ID NO: 935282 - DNA, 25 bp, Mus musculus
gcaaagtgacaggagcaacgcctat

SEQ ID NO: 935283 - DNA, 25 bp, Mus musculus
gcaaagttagatccaatgtcttggg

SEQ ID NO: 935284 - DNA, 25 bp, Mus musculus
gcaaagttagttccaatgtcttggg

SEQ ID NO: 935285 - DNA, 25 bp, Mus musculus
gcaaataatgagctccagacctggg

SEQ ID NO: 935286 - DNA, 25 bp, Mus musculus
gcaaataatgaggtccagacctggg

SEQ ID NO: 935287 - DNA, 25 bp, Mus musculus
gcaaatataaaacgtgacaggagac

SEQ ID NO: 935288 - DNA, 25 bp, Mus musculus
gcaaatataaaaggtgacaggagac

SEQ ID NO: 935289 - DNA, 25 bp, Mus musculus
gcaaatatggttttcctgtacagag

SEQ ID NO: 935290 - DNA, 25 bp, Mus musculus
gcaaatatggttttgctgtacagag

SEQ ID NO: 935291 - DNA, 25 bp, Mus musculus
gcaaatcagaagcctaggcaagcca

SEQ ID NO: 935292 - DNA, 25 bp, Mus musculus
gcaaatcagaaggctaggcaagcca

SEQ ID NO: 935293 - DNA, 25 bp, Mus musculus
gcaaatccagaaagtgcaagtggtg

SEQ ID NO: 935294 - DNA, 25 bp, Mus musculus
gcaaatccagagcatctctctcaac

SEQ ID NO: 935295 - DNA, 25 bp, Mus musculus
gcaaatccagagctgaaaatccagg

SEQ ID NO: 935296 - DNA, 25 bp, Mus musculus
gcaaatccagaggatctctctcaac

SEQ ID NO: 935297 - DNA, 25 bp, Mus musculus
gcaaatccagaggtgaaaatccagg

SEQ ID NO: 935298 - DNA, 25 bp, Mus musculus
gcaaatccagtaagtgcaagtggtg

SEQ ID NO: 935299 - DNA, 25 bp, Mus musculus
gcaaatccttccagaaacttcatgg

SEQ ID NO: 935300 - DNA, 25 bp, Mus musculus
gcaaatccttcctgaaacttcatgg

SEQ ID NO: 935301 - DNA, 25 bp, Mus musculus
gcaaatgaggccgaacagctaatcc

SEQ ID NO: 935302 - DNA, 25 bp, Mus musculus
gcaaatgagggcgaacagctaatcc

SEQ ID NO: 935303 - DNA, 25 bp, Mus musculus
gcaaatgatgagagttctagaagag

SEQ ID NO: 935304 - DNA, 25 bp, Mus musculus
gcaaatgatgtgagttctagaagag

SEQ ID NO: 935305 - DNA, 25 bp, Mus musculus
gcaaatgcacagcaaactttgctgg

SEQ ID NO: 935306 - DNA, 25 bp, Mus musculus
gcaaatgcacaggaaactttgctgg

SEQ ID NO: 935307 - DNA, 25 bp, Mus musculus
gcaaatggcgaaagtcctaggtggg

SEQ ID NO: 935308 - DNA, 25 bp, Mus musculus
gcaaatggcgtaagtcctaggtggg

SEQ ID NO: 935309 - DNA, 25 bp, Mus musculus
gcaaatgtaaaaagacttgtaggga

SEQ ID NO: 935310 - DNA, 25 bp, Mus musculus
gcaaatgtaaaatgacttgtaggga

SEQ ID NO: 935311 - DNA, 25 bp, Mus musculus
gcaaatgtgaaacgctaccttggac

SEQ ID NO: 935312 - DNA, 25 bp, Mus musculus
gcaaatgtgaaacgctggcacagaa

SEQ ID NO: 935313 - DNA, 25 bp, Mus musculus
gcaaatgtgaaaggctaccttggac

SEQ ID NO: 935314 - DNA, 25 bp, Mus musculus
gcaaatgtgaaaggctggcacagaa

SEQ ID NO: 935315 - DNA, 25 bp, Mus musculus
gcaaattaacagagtgtccaagcac

SEQ ID NO: 935316 - DNA, 25 bp, Mus musculus
gcaaattaacagtgtgtccaagcac

SEQ ID NO: 935317 - DNA, 25 bp, Mus musculus
gcaaattcagatataaaaagatctt

SEQ ID NO: 935318 - DNA, 25 bp, Mus musculus
gcaaattcagctaataattttcaag

SEQ ID NO: 935319 - DNA, 25 bp, Mus musculus
gcaaattcaggtaataattttcaag

SEQ ID NO: 935320 - DNA, 25 bp, Mus musculus
gcaaattcagttataaaaagatctt

SEQ ID NO: 935321 - DNA, 25 bp, Mus musculus
gcaaattgtcagcgacatgaaggat

SEQ ID NO: 935322 - DNA, 25 bp, Mus musculus
gcaaattgtcagggacatgaaggat

SEQ ID NO: 935323 - DNA, 25 bp, Mus musculus
gcaacaacagatacaacagcagcaa

SEQ ID NO: 935324 - DNA, 25 bp, Mus musculus
gcaacaacagttacaacagcagcaa

SEQ ID NO: 935325 - DNA, 25 bp, Mus musculus
gcaacaagcatgcgatctcgggaac

SEQ ID NO: 935326 - DNA, 25 bp, Mus musculus
gcaacaagcatgggatctcgggaac

SEQ ID NO: 935327 - DNA, 25 bp, Mus musculus
gcaacaatgcagcggttgacaactt

SEQ ID NO: 935328 - DNA, 25 bp, Mus musculus
gcaacaatgcaggggttgacaactt

SEQ ID NO: 935329 - DNA, 25 bp, Mus musculus
gcaacacagatgcaggaagagcaga

SEQ ID NO: 935330 - DNA, 25 bp, Mus musculus
gcaacacagatggaggaagagcaga

SEQ ID NO: 935331 - DNA, 25 bp, Mus musculus
gcaacacgccctcggccgacaactg

SEQ ID NO: 935332 - DNA, 25 bp, Mus musculus
gcaacacgccctgggccgacaactg

SEQ ID NO: 935333 - DNA, 25 bp, Mus musculus
gcaacacggacacactggtccctga

SEQ ID NO: 935334 - DNA, 25 bp, Mus musculus
gcaacacggacagactggtccctga

SEQ ID NO: 935335 - DNA, 25 bp, Mus musculus
gcaacagaatatcacatacacaaaa

SEQ ID NO: 935336 - DNA, 25 bp, Mus musculus
gcaacagaatatcagatacacaaaa

SEQ ID NO: 935337 - DNA, 25 bp, Mus musculus
gcaacagatacgattgctgggcttt

SEQ ID NO: 935338 - DNA, 25 bp, Mus musculus
gcaacagatacgtttgctgggcttt

SEQ ID NO: 935339 - DNA, 25 bp, Mus musculus
gcaacagatgatgatcaactgtgtt

SEQ ID NO: 935340 - DNA, 25 bp, Mus musculus
gcaacagatgcgaacatgtggatga

SEQ ID NO: 935341 - DNA, 25 bp, Mus musculus
gcaacagatgcgaagatgtggatga

SEQ ID NO: 935342 - DNA, 25 bp, Mus musculus
gcaacagatgttgatcaactgtgtt

SEQ ID NO: 935343 - DNA, 25 bp, Mus musculus
gcaacaggaactttgcatcatgcct

SEQ ID NO: 935344 - DNA, 25 bp, Mus musculus
gcaacaggaagtttgcatcatgcct

SEQ ID NO: 935345 - DNA, 25 bp, Mus musculus
gcaacaggatgtacactataaatgg

SEQ ID NO: 935346 - DNA, 25 bp, Mus musculus
gcaacaggatgtactctataaatgg

SEQ ID NO: 935347 - DNA, 25 bp, Mus musculus
gcaacagttgccatccagcattcgg

SEQ ID NO: 935348 - DNA, 25 bp, Mus musculus
gcaacagttgcgttctccccaggga

SEQ ID NO: 935349 - DNA, 25 bp, Mus musculus
gcaacagttgctcccatgcatcatt

SEQ ID NO: 935350 - DNA, 25 bp, Mus musculus
gcaacagttggcatccagcattcgg

SEQ ID NO: 935351 - DNA, 25 bp, Mus musculus
gcaacagttgggttctccccaggga

SEQ ID NO: 935352 - DNA, 25 bp, Mus musculus
gcaacagttggtcccatgcatcatt

SEQ ID NO: 935353 - DNA, 25 bp, Mus musculus
gcaacataacgacgctgagctcggg

SEQ ID NO: 935354 - DNA, 25 bp, Mus musculus
gcaacataacgaggctgagctcggg

SEQ ID NO: 935355 - DNA, 25 bp, Mus musculus
gcaacatgcacaccctatttaagag

SEQ ID NO: 935356 - DNA, 25 bp, Mus musculus
gcaacatgcacagcctatttaagag

SEQ ID NO: 935357 - DNA, 25 bp, Mus musculus
gcaacatggaagagaaggatgcgaa

SEQ ID NO: 935358 - DNA, 25 bp, Mus musculus
gcaacatggaagtgaaggatgcgaa

SEQ ID NO: 935359 - DNA, 25 bp, Mus musculus
gcaacatgtcaacacgtactggaaa

SEQ ID NO: 935360 - DNA, 25 bp, Mus musculus
gcaacatgtcaacaggtactggaaa

SEQ ID NO: 935361 - DNA, 25 bp, Mus musculus
gcaacattagcacgtccagcagtgg

SEQ ID NO: 935362 - DNA, 25 bp, Mus musculus
gcaacattagcaggtccagcagtgg

SEQ ID NO: 935363 - DNA, 25 bp, Mus musculus
gcaaccaaaacccagtcttcagtct

SEQ ID NO: 935364 - DNA, 25 bp, Mus musculus
gcaaccaaaagccagtcttcagtct

SEQ ID NO: 935365 - DNA, 25 bp, Mus musculus
gcaaccaaatacaaaatcccatata

SEQ ID NO: 935366 - DNA, 25 bp, Mus musculus
gcaaccaaatacaatatcccatata

SEQ ID NO: 935367 - DNA, 25 bp, Mus musculus
gcaaccaagactgtcacttgtaccc

SEQ ID NO: 935368 - DNA, 25 bp, Mus musculus
gcaaccaagagtgtcacttgtaccc

SEQ ID NO: 935369 - DNA, 25 bp, Mus musculus
gcaaccaccgcagaagaggctcaga

SEQ ID NO: 935370 - DNA, 25 bp, Mus musculus
gcaaccaccggagaagaggctcaga

SEQ ID NO: 935371 - DNA, 25 bp, Mus musculus
gcaaccactgtggaacatttggcta

SEQ ID NO: 935372 - DNA, 25 bp, Mus musculus
gcaaccactgtggatcatttggcta

SEQ ID NO: 935373 - DNA, 25 bp, Mus musculus
gcaaccagaagcaattgagaagccg

SEQ ID NO: 935374 - DNA, 25 bp, Mus musculus
gcaaccagaagctattgagaagccg

SEQ ID NO: 935375 - DNA, 25 bp, Mus musculus
gcaaccagagagcacaattgacttt

SEQ ID NO: 935376 - DNA, 25 bp, Mus musculus
gcaaccagagagcagaattgacttt

SEQ ID NO: 935377 - DNA, 25 bp, Mus musculus
gcaaccagtgtgtgcatgtggacga

SEQ ID NO: 935378 - DNA, 25 bp, Mus musculus
gcaaccagtgtgtggatgtggacga

SEQ ID NO: 935379 - DNA, 25 bp, Mus musculus
gcaacctatgatcatggcatttgca

SEQ ID NO: 935380 - DNA, 25 bp, Mus musculus
gcaacctatgatgatggcatttgca

SEQ ID NO: 935381 - DNA, 25 bp, Mus musculus
gcaacctatttgactgcttcatgga

SEQ ID NO: 935382 - DNA, 25 bp, Mus musculus
gcaacctatttgtctgcttcatgga

SEQ ID NO: 935383 - DNA, 25 bp, Mus musculus
gcaacctcaatgaacgaagtgcttg

SEQ ID NO: 935384 - DNA, 25 bp, Mus musculus
gcaacctcaatgaaggaagtgcttg

SEQ ID NO: 935385 - DNA, 25 bp, Mus musculus
gcaacctccaagcctgaagggcacg

SEQ ID NO: 935386 - DNA, 25 bp, Mus musculus
gcaacctccaaggctgaagggcacg

SEQ ID NO: 935387 - DNA, 25 bp, Mus musculus
gcaacctgcctaaaaccagcagcag

SEQ ID NO: 935388 - DNA, 25 bp, Mus musculus
gcaacctgcctataaccagcagcag

SEQ ID NO: 935389 - DNA, 25 bp, Mus musculus
gcaacctgtcagccctgctgtccac

SEQ ID NO: 935390 - DNA, 25 bp, Mus musculus
gcaacctgtcaggcctgctgtccac

SEQ ID NO: 935391 - DNA, 25 bp, Mus musculus
gcaacgattcaacctcttgcttcta

SEQ ID NO: 935392 - DNA, 25 bp, Mus musculus
gcaacgattcaacgaggagccccga

SEQ ID NO: 935393 - DNA, 25 bp, Mus musculus
gcaacgattcaagctcttgcttcta

SEQ ID NO: 935394 - DNA, 25 bp, Mus musculus
gcaacgattcaaggaggagccccga

SEQ ID NO: 935395 - DNA, 25 bp, Mus musculus
gcaacggccccacaaattactgtgc

SEQ ID NO: 935396 - DNA, 25 bp, Mus musculus
gcaacggccccacaagctgactgcg

SEQ ID NO: 935397 - DNA, 25 bp, Mus musculus
gcaacggccccagaaattactgtgc

SEQ ID NO: 935398 - DNA, 25 bp, Mus musculus
gcaacggccccagaagctgactgcg

SEQ ID NO: 935399 - DNA, 25 bp, Mus musculus
gcaacggtgcggcagcgtgcttccg

SEQ ID NO: 935400 - DNA, 25 bp, Mus musculus
gcaacggtgcgggagcgtgcttccg

SEQ ID NO: 935401 - DNA, 25 bp, Mus musculus
gcaactacagctctcaccccaccat

SEQ ID NO: 935402 - DNA, 25 bp, Mus musculus
gcaactacaggtctcaccccaccat

SEQ ID NO: 935403 - DNA, 25 bp, Mus musculus
gcaactactggcaccatcctcacca

SEQ ID NO: 935404 - DNA, 25 bp, Mus musculus
gcaactactggcacgatcctcacca

SEQ ID NO: 935405 - DNA, 25 bp, Mus musculus
gcaactcaagcatggatgccctgag

SEQ ID NO: 935406 - DNA, 25 bp, Mus musculus
gcaactcaagctctaaggtacaaat

SEQ ID NO: 935407 - DNA, 25 bp, Mus musculus
gcaactcaaggatggatgccctgag

SEQ ID NO: 935408 - DNA, 25 bp, Mus musculus
gcaactcaaggtctaaggtacaaat

SEQ ID NO: 935409 - DNA, 25 bp, Mus musculus
gcaactcaggattgcagcaggagag

SEQ ID NO: 935410 - DNA, 25 bp, Mus musculus
gcaactcaggtttgcagcaggagag

SEQ ID NO: 935411 - DNA, 25 bp, Mus musculus
gcaactccacagactcagctgcagc

SEQ ID NO: 935412 - DNA, 25 bp, Mus musculus
gcaactccacagtctcagctgcagc

SEQ ID NO: 935413 - DNA, 25 bp, Mus musculus
gcaactccatctttcgtctggctcc

SEQ ID NO: 935414 - DNA, 25 bp, Mus musculus
gcaactccatctttggtctggctcc

SEQ ID NO: 935415 - DNA, 25 bp, Mus musculus
gcaactccattcaaagtacgatgag

SEQ ID NO: 935416 - DNA, 25 bp, Mus musculus
gcaactccattcaatgtacgatgag

SEQ ID NO: 935417 - DNA, 25 bp, Mus musculus
gcaactccgacatccatcctgcagt

SEQ ID NO: 935418 - DNA, 25 bp, Mus musculus
gcaactccgacatccgcagacagac

SEQ ID NO: 935419 - DNA, 25 bp, Mus musculus
gcaactccgacatcctgatccgggc

SEQ ID NO: 935420 - DNA, 25 bp, Mus musculus
gcaactccgacatcgatcctgcagt

SEQ ID NO: 935421 - DNA, 25 bp, Mus musculus
gcaactccgacatcggcagacagac

SEQ ID NO: 935422 - DNA, 25 bp, Mus musculus
gcaactccgacatcgtgatccgggc

SEQ ID NO: 935423 - DNA, 25 bp, Mus musculus
gcaactcggacctgcatgctaaaag

SEQ ID NO: 935424 - DNA, 25 bp, Mus musculus
gcaactcggacctgctcataagggc

SEQ ID NO: 935425 - DNA, 25 bp, Mus musculus
gcaactcggacctggatgctaaaag

SEQ ID NO: 935426 - DNA, 25 bp, Mus musculus
gcaactcggacctggtcataagggc

SEQ ID NO: 935427 - DNA, 25 bp, Mus musculus
gcaactcggcaaacagttattatca

SEQ ID NO: 935428 - DNA, 25 bp, Mus musculus
gcaactcggcaaactgttattatca

SEQ ID NO: 935429 - DNA, 25 bp, Mus musculus
gcaactctcatgcacttcccagtca

SEQ ID NO: 935430 - DNA, 25 bp, Mus musculus
gcaactctcatgcagttcccagtca

SEQ ID NO: 935431 - DNA, 25 bp, Mus musculus
gcaactcttattcggctgtgcctaa

SEQ ID NO: 935432 - DNA, 25 bp, Mus musculus
gcaactcttattcttggaaatctac

SEQ ID NO: 935433 - DNA, 25 bp, Mus musculus
gcaactcttattgggctgtgcctaa

SEQ ID NO: 935434 - DNA, 25 bp, Mus musculus
gcaactcttattgttggaaatctac

SEQ ID NO: 935435 - DNA, 25 bp, Mus musculus
gcaactgtcaggagtctcccagtga

SEQ ID NO: 935436 - DNA, 25 bp, Mus musculus
gcaactgtcaggtgtctcccagtga

SEQ ID NO: 935437 - DNA, 25 bp, Mus musculus
gcaactgtgtggacatcaacgaatg

SEQ ID NO: 935438 - DNA, 25 bp, Mus musculus
gcaactgtgtggtcatcaacgaatg

SEQ ID NO: 935439 - DNA, 25 bp, Mus musculus
gcaacttacaggaagttgtgccagc

SEQ ID NO: 935440 - DNA, 25 bp, Mus musculus
gcaacttacaggagcttgtgccagc

SEQ ID NO: 935441 - DNA, 25 bp, Mus musculus
gcaacttacaggaggttgtgccagc

SEQ ID NO: 935442 - DNA, 25 bp, Mus musculus
gcaacttacaggtagttgtgccagc

SEQ ID NO: 935443 - DNA, 25 bp, Mus musculus
gcaacttccactatcgagctggaca

SEQ ID NO: 935444 - DNA, 25 bp, Mus musculus
gcaacttccactatggagctggaca

SEQ ID NO: 935445 - DNA, 25 bp, Mus musculus
gcaacttcctaaagttgtatctagt

SEQ ID NO: 935446 - DNA, 25 bp, Mus musculus
gcaacttcctaatgttgtatctagt

SEQ ID NO: 935447 - DNA, 25 bp, Mus musculus
gcaacttctctgcaaccaagcaaca

SEQ ID NO: 935448 - DNA, 25 bp, Mus musculus
gcaacttctctggaaccaagcaaca

SEQ ID NO: 935449 - DNA, 25 bp, Mus musculus
gcaacttgtcagatgtttctgtggt

SEQ ID NO: 935450 - DNA, 25 bp, Mus musculus
gcaacttgtcagttgtttctgtggt

SEQ ID NO: 935451 - DNA, 25 bp, Mus musculus
gcaagaacacctacagtgagatgat

SEQ ID NO: 935452 - DNA, 25 bp, Mus musculus
gcaagaacaccttcagtgagatgat

SEQ ID NO: 935453 - DNA, 25 bp, Mus musculus
gcaagaaccgcagacaatcaggctc

SEQ ID NO: 935454 - DNA, 25 bp, Mus musculus
gcaagaaccggagacaatcaggctc

SEQ ID NO: 935455 - DNA, 25 bp, Mus musculus
gcaagaacggcattaatctttctgg

SEQ ID NO: 935456 - DNA, 25 bp, Mus musculus
gcaagaacgggattaatctttctgg

SEQ ID NO: 935457 - DNA, 25 bp, Mus musculus
gcaagaagagatgacgccttcgtac

SEQ ID NO: 935458 - DNA, 25 bp, Mus musculus
gcaagaagagttgacgccttcgtac

SEQ ID NO: 935459 - DNA, 25 bp, Mus musculus
gcaagaagccggcggctctgccagt

SEQ ID NO: 935460 - DNA, 25 bp, Mus musculus
gcaagaagccgggggctctgccagt

SEQ ID NO: 935461 - DNA, 25 bp, Mus musculus
gcaagaagctgcttcgccccatcag

SEQ ID NO: 935462 - DNA, 25 bp, Mus musculus
gcaagaagctgcttggccccatcag

SEQ ID NO: 935463 - DNA, 25 bp, Mus musculus
gcaagaatacagctatggttttcta

SEQ ID NO: 935464 - DNA, 25 bp, Mus musculus
gcaagaatacaggtatggttttcta

SEQ ID NO: 935465 - DNA, 25 bp, Mus musculus
gcaagaattgactgacagaaatgtg

SEQ ID NO: 935466 - DNA, 25 bp, Mus musculus
gcaagaattgtctgacagaaatgtg

SEQ ID NO: 935467 - DNA, 25 bp, Mus musculus
gcaagacaagcctttggatgccatt

SEQ ID NO: 935468 - DNA, 25 bp, Mus musculus
gcaagacaagctgcgaagtttccca

SEQ ID NO: 935469 - DNA, 25 bp, Mus musculus
gcaagacaaggctttggatgccatt

SEQ ID NO: 935470 - DNA, 25 bp, Mus musculus
gcaagacaaggtgcgaagtttccca

SEQ ID NO: 935471 - DNA, 25 bp, Mus musculus
gcaagacacctacagactagcacac

SEQ ID NO: 935472 - DNA, 25 bp, Mus musculus
gcaagacacctagagactagcacac

SEQ ID NO: 935473 - DNA, 25 bp, Mus musculus
gcaagaccaaagacagcggggatgc

SEQ ID NO: 935474 - DNA, 25 bp, Mus musculus
gcaagaccaaagtcagcggggatgc

SEQ ID NO: 935475 - DNA, 25 bp, Mus musculus
gcaagacctggccactatattattc

SEQ ID NO: 935476 - DNA, 25 bp, Mus musculus
gcaagacctggccagtatattattc

SEQ ID NO: 935477 - DNA, 25 bp, Mus musculus
gcaagaccttcaaacctgtggaaca

SEQ ID NO: 935478 - DNA, 25 bp, Mus musculus
gcaagaccttcaaagctgtggaaca

SEQ ID NO: 935479 - DNA, 25 bp, Mus musculus
gcaagacgtcgtgtcgcatgtgggc

SEQ ID NO: 935480 - DNA, 25 bp, Mus musculus
gcaagacgtcgtgtggcatgtgggc

SEQ ID NO: 935481 - DNA, 25 bp, Mus musculus
gcaagagacataaacaagacccgga

SEQ ID NO: 935482 - DNA, 25 bp, Mus musculus
gcaagagacataaacacccggatgg

SEQ ID NO: 935483 - DNA, 25 bp, Mus musculus
gcaagagacataaagaagacccgga

SEQ ID NO: 935484 - DNA, 25 bp, Mus musculus
gcaagagacataaagacccggatgg

SEQ ID NO: 935485 - DNA, 25 bp, Mus musculus
gcaagagcaaaaagtttcaaatgta

SEQ ID NO: 935486 - DNA, 25 bp, Mus musculus
gcaagagcaaaatgtttcaaatgta

SEQ ID NO: 935487 - DNA, 25 bp, Mus musculus
gcaagagcagctggtgaatttttgc

SEQ ID NO: 935488 - DNA, 25 bp, Mus musculus
gcaagagcaggtggtgaatttttgc

SEQ ID NO: 935489 - DNA, 25 bp, Mus musculus
gcaagagctgtgaccggtgccggga

SEQ ID NO: 935490 - DNA, 25 bp, Mus musculus
gcaagagctgtgacgggtgccggga

SEQ ID NO: 935491 - DNA, 25 bp, Mus musculus
gcaagaggaatgtgcgttcctattt

SEQ ID NO: 935492 - DNA, 25 bp, Mus musculus
gcaagaggaatgtgggttcctattt

SEQ ID NO: 935493 - DNA, 25 bp, Mus musculus
gcaagaggatgacatcgactggggt

SEQ ID NO: 935494 - DNA, 25 bp, Mus musculus
gcaagaggatgagatcgactggggt

SEQ ID NO: 935495 - DNA, 25 bp, Mus musculus
gcaagaggcaagacctggggatctg

SEQ ID NO: 935496 - DNA, 25 bp, Mus musculus
gcaagaggcaagtcctggggatctg

SEQ ID NO: 935497 - DNA, 25 bp, Mus musculus
gcaagagttcaaattgatctctaca

SEQ ID NO: 935498 - DNA, 25 bp, Mus musculus
gcaagagttcaacaagtttgatctc

SEQ ID NO: 935499 - DNA, 25 bp, Mus musculus
gcaagagttcaagaagtttgatctc

SEQ ID NO: 935500 - DNA, 25 bp, Mus musculus
gcaagagttcaatttgatctctaca

SEQ ID NO: 935501 - DNA, 25 bp, Mus musculus
gcaagataaaagagcagaggaagat

SEQ ID NO: 935502 - DNA, 25 bp, Mus musculus
gcaagataaagtagagcagaggaag

SEQ ID NO: 935503 - DNA, 25 bp, Mus musculus
gcaagataaagtagcagaggaagat

SEQ ID NO: 935504 - DNA, 25 bp, Mus musculus
gcaagataaagttgagcagaggaag

SEQ ID NO: 935505 - DNA, 25 bp, Mus musculus
gcaagataaagttgcagaggaagat

SEQ ID NO: 935506 - DNA, 25 bp, Mus musculus
gcaagataaatgagcagaggaagat

SEQ ID NO: 935507 - DNA, 25 bp, Mus musculus
gcaagatattcacctggatccagac

SEQ ID NO: 935508 - DNA, 25 bp, Mus musculus
gcaagatattcagctggatccagac

SEQ ID NO: 935509 - DNA, 25 bp, Mus musculus
gcaagatcaaagatgatagaaccaa

SEQ ID NO: 935510 - DNA, 25 bp, Mus musculus
gcaagatcaaagcctcagcgttctc

SEQ ID NO: 935511 - DNA, 25 bp, Mus musculus
gcaagatcaaaggctcagcgttctc

SEQ ID NO: 935512 - DNA, 25 bp, Mus musculus
gcaagatcaaagttgatagaaccaa

SEQ ID NO: 935513 - DNA, 25 bp, Mus musculus
gcaagatcacttcaagtgggtaaag

SEQ ID NO: 935514 - DNA, 25 bp, Mus musculus
gcaagatcacttcatgtgggtaaag

SEQ ID NO: 935515 - DNA, 25 bp, Mus musculus
gcaagatcataaagtcctgccccga

SEQ ID NO: 935516 - DNA, 25 bp, Mus musculus
gcaagatcataatgtcctgccccga

SEQ ID NO: 935517 - DNA, 25 bp, Mus musculus
gcaagatcccaccacgctgcaacct

SEQ ID NO: 935518 - DNA, 25 bp, Mus musculus
gcaagatcccaccaggctgcaacct

SEQ ID NO: 935519 - DNA, 25 bp, Mus musculus
gcaagatccttgcttctcgctggaa

SEQ ID NO: 935520 - DNA, 25 bp, Mus musculus
gcaagatccttggttctcgctggaa

SEQ ID NO: 935521 - DNA, 25 bp, Mus musculus
gcaagatctctgccaatccatagta

SEQ ID NO: 935522 - DNA, 25 bp, Mus musculus
gcaagatctctggcaatccatagta

SEQ ID NO: 935523 - DNA, 25 bp, Mus musculus
gcaagatgagctggactatcaccgg

SEQ ID NO: 935524 - DNA, 25 bp, Mus musculus
gcaagatgaggtggactatcaccgg

SEQ ID NO: 935525 - DNA, 25 bp, Mus musculus
gcaagattaaagatgtacaagcatt

SEQ ID NO: 935526 - DNA, 25 bp, Mus musculus
gcaagattaaagttgtacaagcatt

SEQ ID NO: 935527 - DNA, 25 bp, Mus musculus
gcaagcaaatcaatgatgagaagac

SEQ ID NO: 935528 - DNA, 25 bp, Mus musculus
gcaagcaaatgaatgatgagaagac

SEQ ID NO: 935529 - DNA, 25 bp, Mus musculus
gcaagcaagaacaaggatgagagcg

SEQ ID NO: 935530 - DNA, 25 bp, Mus musculus
gcaagcaagatcaaggatgagagcg

SEQ ID NO: 935531 - DNA, 25 bp, Mus musculus
gcaagcacaacctgagtggggagac

SEQ ID NO: 935532 - DNA, 25 bp, Mus musculus
gcaagcacaacctgtgtggggagac

SEQ ID NO: 935533 - DNA, 25 bp, Mus musculus
gcaagcacaacgcaccagagaactg

SEQ ID NO: 935534 - DNA, 25 bp, Mus musculus
gcaagcacaacggaccagagaactg

SEQ ID NO: 935535 - DNA, 25 bp, Mus musculus
gcaagccaagcagtctctggtccca

SEQ ID NO: 935536 - DNA, 25 bp, Mus musculus
gcaagccaaggagtctctggtccca

SEQ ID NO: 935537 - DNA, 25 bp, Mus musculus
gcaagccaatcccacttatgctcct

SEQ ID NO: 935538 - DNA, 25 bp, Mus musculus
gcaagccaatcccagttatgctcct

SEQ ID NO: 935539 - DNA, 25 bp, Mus musculus
gcaagccaggacccacctgcacatc

SEQ ID NO: 935540 - DNA, 25 bp, Mus musculus
gcaagccaggtcccacctgcacatc

SEQ ID NO: 935541 - DNA, 25 bp, Mus musculus
gcaagccatgctgtttccatggaga

SEQ ID NO: 935542 - DNA, 25 bp, Mus musculus
gcaagccatggtgtttccatggaga

SEQ ID NO: 935543 - DNA, 25 bp, Mus musculus
gcaagccccaagaggatgattattg

SEQ ID NO: 935544 - DNA, 25 bp, Mus musculus
gcaagccccaagtggatgattattg

SEQ ID NO: 935545 - DNA, 25 bp, Mus musculus
gcaagcccctcacgttctgtgctga

SEQ ID NO: 935546 - DNA, 25 bp, Mus musculus
gcaagcccctcaggttctgtgctga

SEQ ID NO: 935547 - DNA, 25 bp, Mus musculus
gcaagccctcagcctgtgaatctcc

SEQ ID NO: 935548 - DNA, 25 bp, Mus musculus
gcaagccctcaggctgtgaatctcc

SEQ ID NO: 935549 - DNA, 25 bp, Mus musculus
gcaagcctcaagacgaaagtaggtg

SEQ ID NO: 935550 - DNA, 25 bp, Mus musculus
gcaagcctcaagtcgaaagtaggtg

SEQ ID NO: 935551 - DNA, 25 bp, Mus musculus
gcaagcgagaccccatcagtgagag

SEQ ID NO: 935552 - DNA, 25 bp, Mus musculus
gcaagcgagagcccatcagtgagag

SEQ ID NO: 935553 - DNA, 25 bp, Mus musculus
gcaagcgccgcaagtttctggagac

SEQ ID NO: 935554 - DNA, 25 bp, Mus musculus
gcaagcgccgcatgtttctggagac

SEQ ID NO: 935555 - DNA, 25 bp, Mus musculus
gcaagctatgcatctggtgaaaagc

SEQ ID NO: 935556 - DNA, 25 bp, Mus musculus
gcaagctatggatctggtgaaaagc

SEQ ID NO: 935557 - DNA, 25 bp, Mus musculus
gcaagctgctcgactggctggtgga

SEQ ID NO: 935558 - DNA, 25 bp, Mus musculus
gcaagctgctcgtctggctggtgga

SEQ ID NO: 935559 - DNA, 25 bp, Mus musculus
gcaagctggaagaagagacttttca

SEQ ID NO: 935560 - DNA, 25 bp, Mus musculus
gcaagctggaagaagctgggagggc

SEQ ID NO: 935561 - DNA, 25 bp, Mus musculus
gcaagctggaagcggctgcagtgct

SEQ ID NO: 935562 - DNA, 25 bp, Mus musculus
gcaagctggaagctgaaattaaaaa

SEQ ID NO: 935563 - DNA, 25 bp, Mus musculus
gcaagctggaaggggctgcagtgct

SEQ ID NO: 935564 - DNA, 25 bp, Mus musculus
gcaagctggaaggtgaaattaaaaa

SEQ ID NO: 935565 - DNA, 25 bp, Mus musculus
gcaagctggaagtagagacttttca

SEQ ID NO: 935566 - DNA, 25 bp, Mus musculus
gcaagctggaagtagctgggagggc

SEQ ID NO: 935567 - DNA, 25 bp, Mus musculus
gcaagctggtaacagtgcacaggtc

SEQ ID NO: 935568 - DNA, 25 bp, Mus musculus
gcaagctggtaagagtgcacaggtc

SEQ ID NO: 935569 - DNA, 25 bp, Mus musculus
gcaaggaagcggcaacagcacagtg

SEQ ID NO: 935570 - DNA, 25 bp, Mus musculus
gcaaggaagcgggaacagcacagtg

SEQ ID NO: 935571 - DNA, 25 bp, Mus musculus
gcaaggagagaacggcgctgctggc

SEQ ID NO: 935572 - DNA, 25 bp, Mus musculus
gcaaggagagaagggcgctgctggc

SEQ ID NO: 935573 - DNA, 25 bp, Mus musculus
gcaaggagagcgaggctggactggt

SEQ ID NO: 935574 - DNA, 25 bp, Mus musculus
gcaaggagagcgtggctggactggt

SEQ ID NO: 935575 - DNA, 25 bp, Mus musculus
gcaaggagcggtcatgaaaaactgg

SEQ ID NO: 935576 - DNA, 25 bp, Mus musculus
gcaaggagcggtgatgaaaaactgg

SEQ ID NO: 935577 - DNA, 25 bp, Mus musculus
gcaaggatagcatccatgtcttaca

SEQ ID NO: 935578 - DNA, 25 bp, Mus musculus
gcaaggatagcgagcgcctcatcta

SEQ ID NO: 935579 - DNA, 25 bp, Mus musculus
gcaaggataggatccatgtcttaca

SEQ ID NO: 935580 - DNA, 25 bp, Mus musculus
gcaaggatagggagcgcctcatcta

SEQ ID NO: 935581 - DNA, 25 bp, Mus musculus
gcaaggcagtagccaaagagccgag

SEQ ID NO: 935582 - DNA, 25 bp, Mus musculus
gcaaggcagtaggcaaagagccgag

SEQ ID NO: 935583 - DNA, 25 bp, Mus musculus
gcaaggccaacacgcgataccaaaa

SEQ ID NO: 935584 - DNA, 25 bp, Mus musculus
gcaaggccaacaggcgataccaaaa

SEQ ID NO: 935585 - DNA, 25 bp, Mus musculus
gcaaggccagagatctagagaactg

SEQ ID NO: 935586 - DNA, 25 bp, Mus musculus
gcaaggccagtgatctagagaactg

SEQ ID NO: 935587 - DNA, 25 bp, Mus musculus
gcaaggccagtgcatgcgcctatgt

SEQ ID NO: 935588 - DNA, 25 bp, Mus musculus
gcaaggccagtggatgcgcctatgt

SEQ ID NO: 935589 - DNA, 25 bp, Mus musculus
gcaaggcctcaagttgggatatcta

SEQ ID NO: 935590 - DNA, 25 bp, Mus musculus
gcaaggcctctagttgggatatcta

SEQ ID NO: 935591 - DNA, 25 bp, Mus musculus
gcaaggctgtctatacagttttgca

SEQ ID NO: 935592 - DNA, 25 bp, Mus musculus
gcaaggctgtggcctccataggcta

SEQ ID NO: 935593 - DNA, 25 bp, Mus musculus
gcaaggctgtgggctccataggcta

SEQ ID NO: 935594 - DNA, 25 bp, Mus musculus
gcaaggctgtgtatacagttttgca

SEQ ID NO: 935595 - DNA, 25 bp, Mus musculus
gcaaggctttgacactaaagacatt

SEQ ID NO: 935596 - DNA, 25 bp, Mus musculus
gcaaggctttgagactaaagacatt

SEQ ID NO: 935597 - DNA, 25 bp, Mus musculus
gcaagggcaaggcttcttggcccag

SEQ ID NO: 935598 - DNA, 25 bp, Mus musculus
gcaagggcaagggttcttggcccag

SEQ ID NO: 935599 - DNA, 25 bp, Mus musculus
gcaagggcatggatcatcggctgtt

SEQ ID NO: 935600 - DNA, 25 bp, Mus musculus
gcaagggcatggatgatcggctgtt

SEQ ID NO: 935601 - DNA, 25 bp, Mus musculus
gcaaggggagactggccaatcacaa

SEQ ID NO: 935602 - DNA, 25 bp, Mus musculus
gcaaggggagtctggccaatcacaa

SEQ ID NO: 935603 - DNA, 25 bp, Mus musculus
gcaaggggtgacctaggagatatgg

SEQ ID NO: 935604 - DNA, 25 bp, Mus musculus
gcaaggggtgaccttggagatatgg

SEQ ID NO: 935605 - DNA, 25 bp, Mus musculus
gcaaggttcctgccgctaacgtcct

SEQ ID NO: 935606 - DNA, 25 bp, Mus musculus
gcaaggttcctggcgctaacgtcct

SEQ ID NO: 935607 - DNA, 25 bp, Mus musculus
gcaagtatagcacgtctggaatttg

SEQ ID NO: 935608 - DNA, 25 bp, Mus musculus
gcaagtatagcaggtctggaatttg

SEQ ID NO: 935609 - DNA, 25 bp, Mus musculus
gcaagtcgaggaagccgtcaagact

SEQ ID NO: 935610 - DNA, 25 bp, Mus musculus
gcaagtcgaggatgccgtcaagact

SEQ ID NO: 935611 - DNA, 25 bp, Mus musculus
gcaagtctcgctagtggttccaatc

SEQ ID NO: 935612 - DNA, 25 bp, Mus musculus
gcaagtctcggtagtggttccaatc

SEQ ID NO: 935613 - DNA, 25 bp, Mus musculus
gcaagtgctcagcaagactcttcaa

SEQ ID NO: 935614 - DNA, 25 bp, Mus musculus
gcaagtgctcagcaggccatgacac

SEQ ID NO: 935615 - DNA, 25 bp, Mus musculus
gcaagtgctcaggaagactcttcaa

SEQ ID NO: 935616 - DNA, 25 bp, Mus musculus
gcaagtgctcaggaggccatgacac

SEQ ID NO: 935617 - DNA, 25 bp, Mus musculus
gcaagtggagctgaagtatttgact

SEQ ID NO: 935618 - DNA, 25 bp, Mus musculus
gcaagtggaggtgaagtatttgact

SEQ ID NO: 935619 - DNA, 25 bp, Mus musculus
gcaagtggcatgcagatgttgcagt

SEQ ID NO: 935620 - DNA, 25 bp, Mus musculus
gcaagtggcatggagatgttgcagt

SEQ ID NO: 935621 - DNA, 25 bp, Mus musculus
gcaagtgttgctgatccttgtcttt

SEQ ID NO: 935622 - DNA, 25 bp, Mus musculus
gcaagtgttggtgatccttgtcttt

SEQ ID NO: 935623 - DNA, 25 bp, Mus musculus
gcaagttaaaagcaacttctgcagg

SEQ ID NO: 935624 - DNA, 25 bp, Mus musculus
gcaagttaaaaggaacttctgcagg

SEQ ID NO: 935625 - DNA, 25 bp, Mus musculus
gcaagttcacagatgtgaccttgag

SEQ ID NO: 935626 - DNA, 25 bp, Mus musculus
gcaagttcacagttgtgaccttgag

SEQ ID NO: 935627 - DNA, 25 bp, Mus musculus
gcaataaaatgcatcctattaatgg

SEQ ID NO: 935628 - DNA, 25 bp, Mus musculus
gcaataaaatgcatgctattaatgg

SEQ ID NO: 935629 - DNA, 25 bp, Mus musculus
gcaatataagccacaatggaaggtc

SEQ ID NO: 935630 - DNA, 25 bp, Mus musculus
gcaatataaggcacaatggaaggtc

SEQ ID NO: 935631 - DNA, 25 bp, Mus musculus
gcaatatgacagagctgtccatgct

SEQ ID NO: 935632 - DNA, 25 bp, Mus musculus
gcaatatgacagtgctgtccatgct

SEQ ID NO: 935633 - DNA, 25 bp, Mus musculus
gcaatatgactgaaacggcatggac

SEQ ID NO: 935634 - DNA, 25 bp, Mus musculus
gcaatatgactgcccgaagcctttc

SEQ ID NO: 935635 - DNA, 25 bp, Mus musculus
gcaatatgactggccgaagcctttc

SEQ ID NO: 935636 - DNA, 25 bp, Mus musculus
gcaatatgactgtaacggcatggac

SEQ ID NO: 935637 - DNA, 25 bp, Mus musculus
gcaatattccagaaaccccacctcc

SEQ ID NO: 935638 - DNA, 25 bp, Mus musculus
gcaatattccagtaaccccacctcc

SEQ ID NO: 935639 - DNA, 25 bp, Mus musculus
gcaatcaaagatgtcctggggaagg

SEQ ID NO: 935640 - DNA, 25 bp, Mus musculus
gcaatcaaagttgtcctggggaagg

SEQ ID NO: 935641 - DNA, 25 bp, Mus musculus
gcaatcaagagacaagtggctggaa

SEQ ID NO: 935642 - DNA, 25 bp, Mus musculus
gcaatcaagagagaagtggctggaa

SEQ ID NO: 935643 - DNA, 25 bp, Mus musculus
gcaatcaagcagcaacctgggcagt

SEQ ID NO: 935644 - DNA, 25 bp, Mus musculus
gcaatcaagcaggaacctgggcagt

SEQ ID NO: 935645 - DNA, 25 bp, Mus musculus
gcaatcactccccacccgtgggaat

SEQ ID NO: 935646 - DNA, 25 bp, Mus musculus
gcaatcactccccagccgtgggaat

SEQ ID NO: 935647 - DNA, 25 bp, Mus musculus
gcaatcactgcccacgaagggaaga

SEQ ID NO: 935648 - DNA, 25 bp, Mus musculus
gcaatcactgcccaggaagggaaga

SEQ ID NO: 935649 - DNA, 25 bp, Mus musculus
gcaatcagagattttgcgtgggaga

SEQ ID NO: 935650 - DNA, 25 bp, Mus musculus
gcaatcagagtttttgcgtgggaga

SEQ ID NO: 935651 - DNA, 25 bp, Mus musculus
gcaatccagtcccccagcagtacgt

SEQ ID NO: 935652 - DNA, 25 bp, Mus musculus
gcaatccagtgccccagcagtacgt

SEQ ID NO: 935653 - DNA, 25 bp, Mus musculus
gcaatccatgagatcagggcactga

SEQ ID NO: 935654 - DNA, 25 bp, Mus musculus
gcaatccatgagttcagggcactga

SEQ ID NO: 935655 - DNA, 25 bp, Mus musculus
gcaatccttcagacctccagagtga

SEQ ID NO: 935656 - DNA, 25 bp, Mus musculus
gcaatccttcagtcctccagagtga

SEQ ID NO: 935657 - DNA, 25 bp, Mus musculus
gcaatcgccactaacaggggaggcg

SEQ ID NO: 935658 - DNA, 25 bp, Mus musculus
gcaatcgccactaagaggggaggcg

SEQ ID NO: 935659 - DNA, 25 bp, Mus musculus
gcaatcgtagatcactgcatggata

SEQ ID NO: 935660 - DNA, 25 bp, Mus musculus
gcaatcgtagatcagtgcatggata

SEQ ID NO: 935661 - DNA, 25 bp, Mus musculus
gcaatctgaaatagtgattggacaa

SEQ ID NO: 935662 - DNA, 25 bp, Mus musculus
gcaatctgaaattgtgattggacaa

SEQ ID NO: 935663 - DNA, 25 bp, Mus musculus
gcaatctgagagatctcaatagaaa

SEQ ID NO: 935664 - DNA, 25 bp, Mus musculus
gcaatctgagtgatctcaatagaaa

SEQ ID NO: 935665 - DNA, 25 bp, Mus musculus
gcaatctgtcggcggtggagggctt

SEQ ID NO: 935666 - DNA, 25 bp, Mus musculus
gcaatctgtcgggggtggagggctt

SEQ ID NO: 935667 - DNA, 25 bp, Mus musculus
gcaatcttaaagatcaggtcctgta

SEQ ID NO: 935668 - DNA, 25 bp, Mus musculus
gcaatcttaaagatcgaggcgccga

SEQ ID NO: 935669 - DNA, 25 bp, Mus musculus
gcaatcttaaagatcgcttgtccat

SEQ ID NO: 935670 - DNA, 25 bp, Mus musculus
gcaatcttaaagatcggggctgagg

SEQ ID NO: 935671 - DNA, 25 bp, Mus musculus
gcaatcttaaagatgaggtcctgta

SEQ ID NO: 935672 - DNA, 25 bp, Mus musculus
gcaatcttaaagatggaggcgccga

SEQ ID NO: 935673 - DNA, 25 bp, Mus musculus
gcaatcttaaagatggcttgtccat

SEQ ID NO: 935674 - DNA, 25 bp, Mus musculus
gcaatcttaaagatgggggctgagg

SEQ ID NO: 935675 - DNA, 25 bp, Mus musculus
gcaatgccagctggcccagagtggt

SEQ ID NO: 935676 - DNA, 25 bp, Mus musculus
gcaatgccagcttgaacgacatgtg

SEQ ID NO: 935677 - DNA, 25 bp, Mus musculus
gcaatgccaggtggcccagagtggt

SEQ ID NO: 935678 - DNA, 25 bp, Mus musculus
gcaatgccaggttgaacgacatgtg

SEQ ID NO: 935679 - DNA, 25 bp, Mus musculus
gcaatgccatggatgtcatcctgca

SEQ ID NO: 935680 - DNA, 25 bp, Mus musculus
gcaatgccatggttgtcatcctgca

SEQ ID NO: 935681 - DNA, 25 bp, Mus musculus
gcaatggacagatgaccactcccga

SEQ ID NO: 935682 - DNA, 25 bp, Mus musculus
gcaatggacagatgtccactcccga

SEQ ID NO: 935683 - DNA, 25 bp, Mus musculus
gcaatggataccctcatctaatcgt

SEQ ID NO: 935684 - DNA, 25 bp, Mus musculus
gcaatggataccctgatctaatcgt

SEQ ID NO: 935685 - DNA, 25 bp, Mus musculus
gcaatgtgggtgccctcctcagccc

SEQ ID NO: 935686 - DNA, 25 bp, Mus musculus
gcaatgtgggtggcctcctcagccc

SEQ ID NO: 935687 - DNA, 25 bp, Mus musculus
gcaatgtgtccacagcaagatttga

SEQ ID NO: 935688 - DNA, 25 bp, Mus musculus
gcaatgtgtccagagcaagatttga

SEQ ID NO: 935689 - DNA, 25 bp, Mus musculus
gcaattaaagcatgttctggaggag

SEQ ID NO: 935690 - DNA, 25 bp, Mus musculus
gcaattaaaggatgttctggaggag

SEQ ID NO: 935691 - DNA, 25 bp, Mus musculus
gcaattactgggaacatctcaggaa

SEQ ID NO: 935692 - DNA, 25 bp, Mus musculus
gcaattactgggaagatctcaggaa

SEQ ID NO: 935693 - DNA, 25 bp, Mus musculus
gcaattctacagataaatggaatta

SEQ ID NO: 935694 - DNA, 25 bp, Mus musculus
gcaattctacagttaaatggaatta

SEQ ID NO: 935695 - DNA, 25 bp, Mus musculus
gcaattgcagcgacggaatctggca

SEQ ID NO: 935696 - DNA, 25 bp, Mus musculus
gcaattgcagggacggaatctggca

SEQ ID NO: 935697 - DNA, 25 bp, Mus musculus
gcaattgccaggagaagcctagtga

SEQ ID NO: 935698 - DNA, 25 bp, Mus musculus
gcaattgccaggtgaagcctagtga

SEQ ID NO: 935699 - DNA, 25 bp, Mus musculus
gcaattggaaagacagtgatgtgac

SEQ ID NO: 935700 - DNA, 25 bp, Mus musculus
gcaattggaaagctatctggccagg

SEQ ID NO: 935701 - DNA, 25 bp, Mus musculus
gcaattggaaaggtatctggccagg

SEQ ID NO: 935702 - DNA, 25 bp, Mus musculus
gcaattggaaagtcagtgatgtgac

SEQ ID NO: 935703 - DNA, 25 bp, Mus musculus
gcaattgtgaggatgagcccatgga

SEQ ID NO: 935704 - DNA, 25 bp, Mus musculus
gcaattgtgaggttgagcccatgga

SEQ ID NO: 935705 - DNA, 25 bp, Mus musculus
gcaatttggggctgctcatatggag

SEQ ID NO: 935706 - DNA, 25 bp, Mus musculus
gcaatttggggctggtcatatggag

SEQ ID NO: 935707 - DNA, 25 bp, Mus musculus
gcacaaaaagcgactcagctgtatg

SEQ ID NO: 935708 - DNA, 25 bp, Mus musculus
gcacaaaaagggactcagctgtatg

SEQ ID NO: 935709 - DNA, 25 bp, Mus musculus
gcacaaacagagccccaggtactga

SEQ ID NO: 935710 - DNA, 25 bp, Mus musculus
gcacaaacagccggaaattgtgaag

SEQ ID NO: 935711 - DNA, 25 bp, Mus musculus
gcacaaacaggcggaaattgtgaag

SEQ ID NO: 935712 - DNA, 25 bp, Mus musculus
gcacaaacagtgccccaggtactga

SEQ ID NO: 935713 - DNA, 25 bp, Mus musculus
gcacaaagagcctgccagctcttgg

SEQ ID NO: 935714 - DNA, 25 bp, Mus musculus
gcacaaagaggctgccagctcttgg

SEQ ID NO: 935715 - DNA, 25 bp, Mus musculus
gcacaaataatactgcttacagaca

SEQ ID NO: 935716 - DNA, 25 bp, Mus musculus
gcacaaataatagtgcttacagaca

SEQ ID NO: 935717 - DNA, 25 bp, Mus musculus
gcacaacagcagatcccagcatggt

SEQ ID NO: 935718 - DNA, 25 bp, Mus musculus
gcacaacagcagttcccagcatggt

SEQ ID NO: 935719 - DNA, 25 bp, Mus musculus
gcacaacttcaatgaattcctgttc

SEQ ID NO: 935720 - DNA, 25 bp, Mus musculus
gcacaacttcaatgtattcctgttc

SEQ ID NO: 935721 - DNA, 25 bp, Mus musculus
gcacaagaacagaccaaatctcggt

SEQ ID NO: 935722 - DNA, 25 bp, Mus musculus
gcacaagaacagtccaaatctcggt

SEQ ID NO: 935723 - DNA, 25 bp, Mus musculus
gcacaagaagcgtgcaggtagctcc

SEQ ID NO: 935724 - DNA, 25 bp, Mus musculus
gcacaagaagggtgcaggtagctcc

SEQ ID NO: 935725 - DNA, 25 bp, Mus musculus
gcacaagagaatcagctgatgttcc

SEQ ID NO: 935726 - DNA, 25 bp, Mus musculus
gcacaagagaatgagctgatgttcc

SEQ ID NO: 935727 - DNA, 25 bp, Mus musculus
gcacaagagcagcccaggatctgtt

SEQ ID NO: 935728 - DNA, 25 bp, Mus musculus
gcacaagagcaggccaggatctgtt

SEQ ID NO: 935729 - DNA, 25 bp, Mus musculus
gcacaagatcaactgtcggatggaa

SEQ ID NO: 935730 - DNA, 25 bp, Mus musculus
gcacaagatcaagtgtcggatggaa

SEQ ID NO: 935731 - DNA, 25 bp, Mus musculus
gcacaagcagcctcctctgctggtg

SEQ ID NO: 935732 - DNA, 25 bp, Mus musculus
gcacaagcagctgttgcagcggctg

SEQ ID NO: 935733 - DNA, 25 bp, Mus musculus
gcacaagcaggctcctctgctggtg

SEQ ID NO: 935734 - DNA, 25 bp, Mus musculus
gcacaagcaggtgttgcagcggctg

SEQ ID NO: 935735 - DNA, 25 bp, Mus musculus
gcacaagccacaatttacacccacc

SEQ ID NO: 935736 - DNA, 25 bp, Mus musculus
gcacaagccacattttacacccacc

SEQ ID NO: 935737 - DNA, 25 bp, Mus musculus
gcacaagcgacggaagctaacagcc

SEQ ID NO: 935738 - DNA, 25 bp, Mus musculus
gcacaagcgagggaagctaacagcc

SEQ ID NO: 935739 - DNA, 25 bp, Mus musculus
gcacaagcgatgctcatctttttga

SEQ ID NO: 935740 - DNA, 25 bp, Mus musculus
gcacaagcgatgctgatctttttga

SEQ ID NO: 935741 - DNA, 25 bp, Mus musculus
gcacaagcggctcactgagctggag

SEQ ID NO: 935742 - DNA, 25 bp, Mus musculus
gcacaagcgggtcactgagctggag

SEQ ID NO: 935743 - DNA, 25 bp, Mus musculus
gcacaagctgcagcagcagcagcag

SEQ ID NO: 935744 - DNA, 25 bp, Mus musculus
gcacaagctggagcagcagcagcag

SEQ ID NO: 935745 - DNA, 25 bp, Mus musculus
gcacaaggaactctttgatgaactt

SEQ ID NO: 935746 - DNA, 25 bp, Mus musculus
gcacaaggaactgtttgatgaactt

SEQ ID NO: 935747 - DNA, 25 bp, Mus musculus
gcacaagtacaccacagacggcaac

SEQ ID NO: 935748 - DNA, 25 bp, Mus musculus
gcacaagtacaccgaaatgtgtcat

SEQ ID NO: 935749 - DNA, 25 bp, Mus musculus
gcacaagtacacgacagacggcaac

SEQ ID NO: 935750 - DNA, 25 bp, Mus musculus
gcacaagtacacggaaatgtgtcat

SEQ ID NO: 935751 - DNA, 25 bp, Mus musculus
gcacaagtccctggaaaagctactt

SEQ ID NO: 935752 - DNA, 25 bp, Mus musculus
gcacaagtccctggtaaagctactt

SEQ ID NO: 935753 - DNA, 25 bp, Mus musculus
gcacaagtggaggacgtggtggaca

SEQ ID NO: 935754 - DNA, 25 bp, Mus musculus
gcacaagtggaggaggtggtggaca

SEQ ID NO: 935755 - DNA, 25 bp, Mus musculus
gcacaagttagacgtgagggtggta

SEQ ID NO: 935756 - DNA, 25 bp, Mus musculus
gcacaagttagaggtgagggtggta

SEQ ID NO: 935757 - DNA, 25 bp, Mus musculus
gcacaagtttgcaaccaatgttgtg

SEQ ID NO: 935758 - DNA, 25 bp, Mus musculus
gcacaagtttgcaagcaatgttgtg

SEQ ID NO: 935759 - DNA, 25 bp, Mus musculus
gcacaatcagagccttggctgttac

SEQ ID NO: 935760 - DNA, 25 bp, Mus musculus
gcacaatcagtgccttggctgttac

SEQ ID NO: 935761 - DNA, 25 bp, Mus musculus
gcacaatggacacagtgcctttcag

SEQ ID NO: 935762 - DNA, 25 bp, Mus musculus
gcacaatggacagagtgcctttcag

SEQ ID NO: 935763 - DNA, 25 bp, Mus musculus
gcacaatttcaccgtattagaaaga

SEQ ID NO: 935764 - DNA, 25 bp, Mus musculus
gcacaatttcacggtattagaaaga

SEQ ID NO: 935765 - DNA, 25 bp, Mus musculus
gcacacaagtataacgtgatgttcc

SEQ ID NO: 935766 - DNA, 25 bp, Mus musculus
gcacacaagtataaggtgatgttcc

SEQ ID NO: 935767 - DNA, 25 bp, Mus musculus
gcacacacacagcgattgagtcctg

SEQ ID NO: 935768 - DNA, 25 bp, Mus musculus
gcacacacacagggattgagtcctg

SEQ ID NO: 935769 - DNA, 25 bp, Mus musculus
gcacacacagctactttgagactgt

SEQ ID NO: 935770 - DNA, 25 bp, Mus musculus
gcacacacaggtactttgagactgt

SEQ ID NO: 935771 - DNA, 25 bp, Mus musculus
gcacacacgaccttcgacgtaccat

SEQ ID NO: 935772 - DNA, 25 bp, Mus musculus
gcacacacgaccttggacgtaccat

SEQ ID NO: 935773 - DNA, 25 bp, Mus musculus
gcacacaggatgctcctctttatgt

SEQ ID NO: 935774 - DNA, 25 bp, Mus musculus
gcacacaggatggtcctctttatgt

SEQ ID NO: 935775 - DNA, 25 bp, Mus musculus
gcacacagggtgcgcccctgtatgt

SEQ ID NO: 935776 - DNA, 25 bp, Mus musculus
gcacacagggtgggcccctgtatgt

SEQ ID NO: 935777 - DNA, 25 bp, Mus musculus
gcacacagtgcattcccgacaaacc

SEQ ID NO: 935778 - DNA, 25 bp, Mus musculus
gcacacagtgcattgccgacaaacc

SEQ ID NO: 935779 - DNA, 25 bp, Mus musculus
gcacacatcaagaaacttgaagaag

SEQ ID NO: 935780 - DNA, 25 bp, Mus musculus
gcacacatcaagtaacttgaagaag

SEQ ID NO: 935781 - DNA, 25 bp, Mus musculus
gcacacatgaccagtacatgatcat

SEQ ID NO: 935782 - DNA, 25 bp, Mus musculus
gcacacatgacctgtacatgatcat

SEQ ID NO: 935783 - DNA, 25 bp, Mus musculus
gcacaccatgagcctactcatcttc

SEQ ID NO: 935784 - DNA, 25 bp, Mus musculus
gcacaccatgaggctactcatcttc

SEQ ID NO: 935785 - DNA, 25 bp, Mus musculus
gcacacccagcagcccgagcaacac

SEQ ID NO: 935786 - DNA, 25 bp, Mus musculus
gcacacccaggagcccgagcaacac

SEQ ID NO: 935787 - DNA, 25 bp, Mus musculus
gcacactaccagctcgcctataggt

SEQ ID NO: 935788 - DNA, 25 bp, Mus musculus
gcacactaccagctcggtaacgaca

SEQ ID NO: 935789 - DNA, 25 bp, Mus musculus
gcacactaccagctggcctataggt

SEQ ID NO: 935790 - DNA, 25 bp, Mus musculus
gcacactaccagctgggtaacgaca

SEQ ID NO: 935791 - DNA, 25 bp, Mus musculus
gcacactatgaacacctgggtacac

SEQ ID NO: 935792 - DNA, 25 bp, Mus musculus
gcacactatgtacacctgggtacac

SEQ ID NO: 935793 - DNA, 25 bp, Mus musculus
gcacactgagatatgcagatcgggc

SEQ ID NO: 935794 - DNA, 25 bp, Mus musculus
gcacactgagttatgcagatcgggc

SEQ ID NO: 935795 - DNA, 25 bp, Mus musculus
gcacagaagaaaccattgtggaaca

SEQ ID NO: 935796 - DNA, 25 bp, Mus musculus
gcacagaagaaagcattgtggaaca

SEQ ID NO: 935797 - DNA, 25 bp, Mus musculus
gcacagaagcgacgcattgacgtca

SEQ ID NO: 935798 - DNA, 25 bp, Mus musculus
gcacagaagcgaggcattgacgtca

SEQ ID NO: 935799 - DNA, 25 bp, Mus musculus
gcacagaagggactcgacccataca

SEQ ID NO: 935800 - DNA, 25 bp, Mus musculus
gcacagaagggactctcaactcttg

SEQ ID NO: 935801 - DNA, 25 bp, Mus musculus
gcacagaagggactggacccataca

SEQ ID NO: 935802 - DNA, 25 bp, Mus musculus
gcacagaagggactgtcaactcttg

SEQ ID NO: 935803 - DNA, 25 bp, Mus musculus
gcacagaataaacacactgtgacag

SEQ ID NO: 935804 - DNA, 25 bp, Mus musculus
gcacagaataaacagactgtgacag

SEQ ID NO: 935805 - DNA, 25 bp, Mus musculus
gcacagacagcagcatgcaaaacaa

SEQ ID NO: 935806 - DNA, 25 bp, Mus musculus
gcacagacaggagcatgcaaaacaa

SEQ ID NO: 935807 - DNA, 25 bp, Mus musculus
gcacagacggatcaacagtaaaaaa

SEQ ID NO: 935808 - DNA, 25 bp, Mus musculus
gcacagacggttcaacagtaaaaaa

SEQ ID NO: 935809 - DNA, 25 bp, Mus musculus
gcacagactcaacgctccttgtcag

SEQ ID NO: 935810 - DNA, 25 bp, Mus musculus
gcacagactcaaggctccttgtcag

SEQ ID NO: 935811 - DNA, 25 bp, Mus musculus
gcacagagaagccacgttacaaact

SEQ ID NO: 935812 - DNA, 25 bp, Mus musculus
gcacagagaagccaggttacaaact

SEQ ID NO: 935813 - DNA, 25 bp, Mus musculus
gcacagatcttcaacgcctgggctg

SEQ ID NO: 935814 - DNA, 25 bp, Mus musculus
gcacagatcttcaaggcctgggctg

SEQ ID NO: 935815 - DNA, 25 bp, Mus musculus
gcacagatggcgacagagagaaggc

SEQ ID NO: 935816 - DNA, 25 bp, Mus musculus
gcacagatggggacagagagaaggc

SEQ ID NO: 935817 - DNA, 25 bp, Mus musculus
gcacagcaaacacagccctttgcca

SEQ ID NO: 935818 - DNA, 25 bp, Mus musculus
gcacagcaaacagagccctttgcca

SEQ ID NO: 935819 - DNA, 25 bp, Mus musculus
gcacagcaactacgcatgaagcact

SEQ ID NO: 935820 - DNA, 25 bp, Mus musculus
gcacagcaactaggcatgaagcact

SEQ ID NO: 935821 - DNA, 25 bp, Mus musculus
gcacagcactcccagggggaagggc

SEQ ID NO: 935822 - DNA, 25 bp, Mus musculus
gcacagcactgccagggggaagggc

SEQ ID NO: 935823 - DNA, 25 bp, Mus musculus
gcacagcagcagatgattgtggaac

SEQ ID NO: 935824 - DNA, 25 bp, Mus musculus
gcacagcagcagttgattgtggaac

SEQ ID NO: 935825 - DNA, 25 bp, Mus musculus
gcacagcatgagaaactctctggag

SEQ ID NO: 935826 - DNA, 25 bp, Mus musculus
gcacagcatgtgaaactctctggag

SEQ ID NO: 935827 - DNA, 25 bp, Mus musculus
gcacagccaaagatgaactgacctg

SEQ ID NO: 935828 - DNA, 25 bp, Mus musculus
gcacagccaaagttgaactgacctg

SEQ ID NO: 935829 - DNA, 25 bp, Mus musculus
gcacagccatggcgcccaggaggac

SEQ ID NO: 935830 - DNA, 25 bp, Mus musculus
gcacagccatggcggccaggaggac

SEQ ID NO: 935831 - DNA, 25 bp, Mus musculus
gcacagccccagagctctctctgtg

SEQ ID NO: 935832 - DNA, 25 bp, Mus musculus
gcacagccccagcccagcagaggag

SEQ ID NO: 935833 - DNA, 25 bp, Mus musculus
gcacagccccaggccagcagaggag

SEQ ID NO: 935834 - DNA, 25 bp, Mus musculus
gcacagccccagtgctctctctgtg

SEQ ID NO: 935835 - DNA, 25 bp, Mus musculus
gcacagcccccacctcgtagtgcat

SEQ ID NO: 935836 - DNA, 25 bp, Mus musculus
gcacagcccccagctcgtagtgcat

SEQ ID NO: 935837 - DNA, 25 bp, Mus musculus
gcacagccgaggagcgatccaagaa

SEQ ID NO: 935838 - DNA, 25 bp, Mus musculus
gcacagccgaggagcgtatttcctg

SEQ ID NO: 935839 - DNA, 25 bp, Mus musculus
gcacagccgaggagggatccaagaa

SEQ ID NO: 935840 - DNA, 25 bp, Mus musculus
gcacagccgaggagggtatttcctg

SEQ ID NO: 935841 - DNA, 25 bp, Mus musculus
gcacagcctcagctgtgattgggct

SEQ ID NO: 935842 - DNA, 25 bp, Mus musculus
gcacagcctcaggtgtgattgggct

SEQ ID NO: 935843 - DNA, 25 bp, Mus musculus
gcacagcctgctcttcctcctggcc

SEQ ID NO: 935844 - DNA, 25 bp, Mus musculus
gcacagcctggtcttcctcctggcc

SEQ ID NO: 935845 - DNA, 25 bp, Mus musculus
gcacagctggaacactggccgcacg

SEQ ID NO: 935846 - DNA, 25 bp, Mus musculus
gcacagctggaacagtggccgcacg

SEQ ID NO: 935847 - DNA, 25 bp, Mus musculus
gcacagctgtcaccaacattaccac

SEQ ID NO: 935848 - DNA, 25 bp, Mus musculus
gcacagctgtcacctacattaccac

SEQ ID NO: 935849 - DNA, 25 bp, Mus musculus
gcacaggaagatccatctgtttgac

SEQ ID NO: 935850 - DNA, 25 bp, Mus musculus
gcacaggaagttccatctgtttgac

SEQ ID NO: 935851 - DNA, 25 bp, Mus musculus
gcacaggagatcaacaatctctctg

SEQ ID NO: 935852 - DNA, 25 bp, Mus musculus
gcacaggagatcaagaatctctctg

SEQ ID NO: 935853 - DNA, 25 bp, Mus musculus
gcacaggattgacgtccagaaggat

SEQ ID NO: 935854 - DNA, 25 bp, Mus musculus
gcacaggattgaggtccagaaggat

SEQ ID NO: 935855 - DNA, 25 bp, Mus musculus
gcacaggccttgcgctggagcaccc

SEQ ID NO: 935856 - DNA, 25 bp, Mus musculus
gcacaggccttgggctggagcaccc

SEQ ID NO: 935857 - DNA, 25 bp, Mus musculus
gcacaggctcagccgtggaagctcc

SEQ ID NO: 935858 - DNA, 25 bp, Mus musculus
gcacaggctcaggcgtggaagctcc

SEQ ID NO: 935859 - DNA, 25 bp, Mus musculus
gcacaggctccacgctgttggaaag

SEQ ID NO: 935860 - DNA, 25 bp, Mus musculus
gcacaggctccaggctgttggaaag

SEQ ID NO: 935861 - DNA, 25 bp, Mus musculus
gcacaggtggcaaacaaccagcatt

SEQ ID NO: 935862 - DNA, 25 bp, Mus musculus
gcacaggtggcaaagaaccagcatt

SEQ ID NO: 935863 - DNA, 25 bp, Mus musculus
gcacagtcctcggacgagtatatat

SEQ ID NO: 935864 - DNA, 25 bp, Mus musculus
gcacagtcctcggaggagtatatat

SEQ ID NO: 935865 - DNA, 25 bp, Mus musculus
gcacagtcctgacgtgtgccaccag

SEQ ID NO: 935866 - DNA, 25 bp, Mus musculus
gcacagtcctgaggtgtgccaccag

SEQ ID NO: 935867 - DNA, 25 bp, Mus musculus
gcacagtgtcagatcctgtcagatg

SEQ ID NO: 935868 - DNA, 25 bp, Mus musculus
gcacagtgtcagttcctgtcagatg

SEQ ID NO: 935869 - DNA, 25 bp, Mus musculus
gcacagtgtgcgaacatgtggatga

SEQ ID NO: 935870 - DNA, 25 bp, Mus musculus
gcacagtgtgcgaagatgtggatga

SEQ ID NO: 935871 - DNA, 25 bp, Mus musculus
gcacagttccagacatctcttaaca

SEQ ID NO: 935872 - DNA, 25 bp, Mus musculus
gcacagttccagtcatctcttaaca

SEQ ID NO: 935873 - DNA, 25 bp, Mus musculus
gcacataaaaacttgcattgaggcc

SEQ ID NO: 935874 - DNA, 25 bp, Mus musculus
gcacataaaatcttgcattgaggcc

SEQ ID NO: 935875 - DNA, 25 bp, Mus musculus
gcacataaagaaaaagcagcgttcc

SEQ ID NO: 935876 - DNA, 25 bp, Mus musculus
gcacataaagaaaatgcagcgttcc

SEQ ID NO: 935877 - DNA, 25 bp, Mus musculus
gcacatacccagcatcaaaacccta

SEQ ID NO: 935878 - DNA, 25 bp, Mus musculus
gcacatacccagcttgctgccttga

SEQ ID NO: 935879 - DNA, 25 bp, Mus musculus
gcacatacccaggatcaaaacccta

SEQ ID NO: 935880 - DNA, 25 bp, Mus musculus
gcacatacccaggttgctgccttga

SEQ ID NO: 935881 - DNA, 25 bp, Mus musculus
gcacatagaccagccctcctccaga

SEQ ID NO: 935882 - DNA, 25 bp, Mus musculus
gcacatagaccagcgctcctccaga

SEQ ID NO: 935883 - DNA, 25 bp, Mus musculus
gcacatattcctcaaagctgatgga

SEQ ID NO: 935884 - DNA, 25 bp, Mus musculus
gcacatattcctgaaagctgatgga

SEQ ID NO: 935885 - DNA, 25 bp, Mus musculus
gcacatcaagaaactggaggagcag

SEQ ID NO: 935886 - DNA, 25 bp, Mus musculus
gcacatcaagacctgtgttcctgtg

SEQ ID NO: 935887 - DNA, 25 bp, Mus musculus
gcacatcaagctccctttgtgtgcc

SEQ ID NO: 935888 - DNA, 25 bp, Mus musculus
gcacatcaaggtccctttgtgtgcc

SEQ ID NO: 935889 - DNA, 25 bp, Mus musculus
gcacatcaagtaactggaggagcag

SEQ ID NO: 935890 - DNA, 25 bp, Mus musculus
gcacatcaagtcctgtgttcctgtg

SEQ ID NO: 935891 - DNA, 25 bp, Mus musculus
gcacatcaagtttcagccctaccac

SEQ ID NO: 935892 - DNA, 25 bp, Mus musculus
gcacatcaagtttctgccctaccac

SEQ ID NO: 935893 - DNA, 25 bp, Mus musculus
gcacatcattctgacggatggcctg

SEQ ID NO: 935894 - DNA, 25 bp, Mus musculus
gcacatcattctgagggatggcctg

SEQ ID NO: 935895 - DNA, 25 bp, Mus musculus
gcacatcctgacggatgcagatccc

SEQ ID NO: 935896 - DNA, 25 bp, Mus musculus
gcacatcctgtcggatgcagatccc

SEQ ID NO: 935897 - DNA, 25 bp, Mus musculus
gcacatctctgaagtggaaggggag

SEQ ID NO: 935898 - DNA, 25 bp, Mus musculus
gcacatctctgatgtggaaggggag

SEQ ID NO: 935899 - DNA, 25 bp, Mus musculus
gcacatgcctgtctcgaaacaacct

SEQ ID NO: 935900 - DNA, 25 bp, Mus musculus
gcacatgcctgtctggaaacaacct

SEQ ID NO: 935901 - DNA, 25 bp, Mus musculus
gcacatgcttctgaccctcagtttg

SEQ ID NO: 935902 - DNA, 25 bp, Mus musculus
gcacatgcttctgagcctcagtttg

SEQ ID NO: 935903 - DNA, 25 bp, Mus musculus
gcacatggaccacttggaggtgggc

SEQ ID NO: 935904 - DNA, 25 bp, Mus musculus
gcacatggaccagttggaggtgggc

SEQ ID NO: 935905 - DNA, 25 bp, Mus musculus
gcacatgtgtagcgtgtgtgaggac

SEQ ID NO: 935906 - DNA, 25 bp, Mus musculus
gcacatgtgtagggtgtgtgaggac

SEQ ID NO: 935907 - DNA, 25 bp, Mus musculus
gcacattcaactccatacaaggtgt

SEQ ID NO: 935908 - DNA, 25 bp, Mus musculus
gcacattcaagtccatacaaggtgt

SEQ ID NO: 935909 - DNA, 25 bp, Mus musculus
gcacattcagatacggtggagcagg

SEQ ID NO: 935910 - DNA, 25 bp, Mus musculus
gcacattcagcagatacggtggagc

SEQ ID NO: 935911 - DNA, 25 bp, Mus musculus
gcacattcagcagtgtgttccagag

SEQ ID NO: 935912 - DNA, 25 bp, Mus musculus
gcacattcaggagatacggtggagc

SEQ ID NO: 935913 - DNA, 25 bp, Mus musculus
gcacattcaggagtgtgttccagag

SEQ ID NO: 935914 - DNA, 25 bp, Mus musculus
gcacattcagttacggtggagcagg

SEQ ID NO: 935915 - DNA, 25 bp, Mus musculus
gcacatttttcgacatccgcagaca

SEQ ID NO: 935916 - DNA, 25 bp, Mus musculus
gcacatttttcgtcatccgcagaca

SEQ ID NO: 935917 - DNA, 25 bp, Mus musculus
gcaccaaaggagcgcccatctacat

SEQ ID NO: 935918 - DNA, 25 bp, Mus musculus
gcaccaaaggagggcccatctacat

SEQ ID NO: 935919 - DNA, 25 bp, Mus musculus
gcaccaaatgactcgaccgatcatc

SEQ ID NO: 935920 - DNA, 25 bp, Mus musculus
gcaccaaatgtctcgaccgatcatc

SEQ ID NO: 935921 - DNA, 25 bp, Mus musculus
gcaccaacagcgccaggcagcacga

SEQ ID NO: 935922 - DNA, 25 bp, Mus musculus
gcaccaacagggccaggcagcacga

SEQ ID NO: 935923 - DNA, 25 bp, Mus musculus
gcaccaagaagtcgcagcctgacaa

SEQ ID NO: 935924 - DNA, 25 bp, Mus musculus
gcaccaagaagtggcagcctgacaa

SEQ ID NO: 935925 - DNA, 25 bp, Mus musculus
gcaccaatgaacagtacatgatgat

SEQ ID NO: 935926 - DNA, 25 bp, Mus musculus
gcaccaatgaactgtacatgatgat

SEQ ID NO: 935927 - DNA, 25 bp, Mus musculus
gcaccaattccacactgttcaacct

SEQ ID NO: 935928 - DNA, 25 bp, Mus musculus
gcaccaattccagactgttcaacct

SEQ ID NO: 935929 - DNA, 25 bp, Mus musculus
gcaccacaagttctctctcttcagc

SEQ ID NO: 935930 - DNA, 25 bp, Mus musculus
gcaccacaagttctgtctcttcagc

SEQ ID NO: 935931 - DNA, 25 bp, Mus musculus
gcaccacatacaaacacttcgatga

SEQ ID NO: 935932 - DNA, 25 bp, Mus musculus
gcaccacatacatacacttcgatga

SEQ ID NO: 935933 - DNA, 25 bp, Mus musculus
gcaccaccacagcgcctgaagctgc

SEQ ID NO: 935934 - DNA, 25 bp, Mus musculus
gcaccaccacagggcctgaagctgc

SEQ ID NO: 935935 - DNA, 25 bp, Mus musculus
gcaccaccaggaagcgtgttaggag

SEQ ID NO: 935936 - DNA, 25 bp, Mus musculus
gcaccaccaggaagggtgttaggag

SEQ ID NO: 935937 - DNA, 25 bp, Mus musculus
gcaccaccttactgcgtaatgcatg

SEQ ID NO: 935938 - DNA, 25 bp, Mus musculus
gcaccaccttactgggtaatgcatg

SEQ ID NO: 935939 - DNA, 25 bp, Mus musculus
gcaccacgagcacataagaggagtc

SEQ ID NO: 935940 - DNA, 25 bp, Mus musculus
gcaccacgagcacttgttccaagtt

SEQ ID NO: 935941 - DNA, 25 bp, Mus musculus
gcaccacgagcagataagaggagtc

SEQ ID NO: 935942 - DNA, 25 bp, Mus musculus
gcaccacgagcagttgttccaagtt

SEQ ID NO: 935943 - DNA, 25 bp, Mus musculus
gcaccacgtcagaatgattcctgcc

SEQ ID NO: 935944 - DNA, 25 bp, Mus musculus
gcaccacgtcagtatgattcctgcc

SEQ ID NO: 935945 - DNA, 25 bp, Mus musculus
gcaccagatgccagcatgttgatga

SEQ ID NO: 935946 - DNA, 25 bp, Mus musculus
gcaccagatgccaggatgttgatga

SEQ ID NO: 935947 - DNA, 25 bp, Mus musculus
gcaccagcaactcccatgacaaatc

SEQ ID NO: 935948 - DNA, 25 bp, Mus musculus
gcaccagcaactgccatgacaaatc

SEQ ID NO: 935949 - DNA, 25 bp, Mus musculus
gcaccagcacaaggccagttggtag

SEQ ID NO: 935950 - DNA, 25 bp, Mus musculus
gcaccagcacaaggcttggtagcaa

SEQ ID NO: 935951 - DNA, 25 bp, Mus musculus
gcaccagcacaagggcagttggtag

SEQ ID NO: 935952 - DNA, 25 bp, Mus musculus
gcaccagcacaagggttggtagcaa

SEQ ID NO: 935953 - DNA, 25 bp, Mus musculus
gcaccagcagcacgcaggacttccc

SEQ ID NO: 935954 - DNA, 25 bp, Mus musculus
gcaccagcagcacggaggacttccc

SEQ ID NO: 935955 - DNA, 25 bp, Mus musculus
gcaccagcagcataacatgagattg

SEQ ID NO: 935956 - DNA, 25 bp, Mus musculus
gcaccagcagcatatcatgagattg

SEQ ID NO: 935957 - DNA, 25 bp, Mus musculus
gcaccagcatttcgtataggaggga

SEQ ID NO: 935958 - DNA, 25 bp, Mus musculus
gcaccagcatttggtataggaggga

SEQ ID NO: 935959 - DNA, 25 bp, Mus musculus
gcaccagccacgaactcccttctgc

SEQ ID NO: 935960 - DNA, 25 bp, Mus musculus
gcaccagccacgaagtcccttctgc

SEQ ID NO: 935961 - DNA, 25 bp, Mus musculus
gcaccagctgatccagataccgcta

SEQ ID NO: 935962 - DNA, 25 bp, Mus musculus
gcaccagctgatcctgataccgcta

SEQ ID NO: 935963 - DNA, 25 bp, Mus musculus
gcaccaggcccgacagtttcttgga

SEQ ID NO: 935964 - DNA, 25 bp, Mus musculus
gcaccaggcccgactgtttcttgga

SEQ ID NO: 935965 - DNA, 25 bp, Mus musculus
gcaccagtacagctcacagcctctg

SEQ ID NO: 935966 - DNA, 25 bp, Mus musculus
gcaccagtacaggtcacagcctctg

SEQ ID NO: 935967 - DNA, 25 bp, Mus musculus
gcaccagtgcccatcatcatctttg

SEQ ID NO: 935968 - DNA, 25 bp, Mus musculus
gcaccagtgcccatgatcatctttg

SEQ ID NO: 935969 - DNA, 25 bp, Mus musculus
gcaccatcactcacacctatgtccc

SEQ ID NO: 935970 - DNA, 25 bp, Mus musculus
gcaccatcactctcacctatgtccc

SEQ ID NO: 935971 - DNA, 25 bp, Mus musculus
gcaccatcccatcgtatataatgac

SEQ ID NO: 935972 - DNA, 25 bp, Mus musculus
gcaccatcccatggtatataatgac

SEQ ID NO: 935973 - DNA, 25 bp, Mus musculus
gcaccatccgagagggaatgctggt

SEQ ID NO: 935974 - DNA, 25 bp, Mus musculus
gcaccatccgagtgggaatgctggt

SEQ ID NO: 935975 - DNA, 25 bp, Mus musculus
gcaccatgtgtgagcacgtgaatga

SEQ ID NO: 935976 - DNA, 25 bp, Mus musculus
gcaccatgtgtgaggacgtgaatga

SEQ ID NO: 935977 - DNA, 25 bp, Mus musculus
gcaccattaatcagtacccgcttac

SEQ ID NO: 935978 - DNA, 25 bp, Mus musculus
gcaccattaatctgtacccgcttac

SEQ ID NO: 935979 - DNA, 25 bp, Mus musculus
gcaccattatcttgaatgtggaatg

SEQ ID NO: 935980 - DNA, 25 bp, Mus musculus
gcaccattatcttgtatgtggaatg

SEQ ID NO: 935981 - DNA, 25 bp, Mus musculus
gcacccaaactactcggacaagcat

SEQ ID NO: 935982 - DNA, 25 bp, Mus musculus
gcacccaaactactgggacaagcat

SEQ ID NO: 935983 - DNA, 25 bp, Mus musculus
gcacccacactgcactgcagaaggg

SEQ ID NO: 935984 - DNA, 25 bp, Mus musculus
gcacccacactgctgagaagccatt

SEQ ID NO: 935985 - DNA, 25 bp, Mus musculus
gcacccacactggactgcagaaggg

SEQ ID NO: 935986 - DNA, 25 bp, Mus musculus
gcacccacactggtgagaagccatt

SEQ ID NO: 935987 - DNA, 25 bp, Mus musculus
gcacccacgtatccccctgcagcgg

SEQ ID NO: 935988 - DNA, 25 bp, Mus musculus
gcacccacgtatgcccctgcagcgg

SEQ ID NO: 935989 - DNA, 25 bp, Mus musculus
gcacccactgccagcatatcaacga

SEQ ID NO: 935990 - DNA, 25 bp, Mus musculus
gcacccactgccaggatatcaacga

SEQ ID NO: 935991 - DNA, 25 bp, Mus musculus
gcacccagacctccctccatgaaca

SEQ ID NO: 935992 - DNA, 25 bp, Mus musculus
gcacccagacctgcctccatgaaca

SEQ ID NO: 935993 - DNA, 25 bp, Mus musculus
gcaccccaaatgctcgggagcccac

SEQ ID NO: 935994 - DNA, 25 bp, Mus musculus
gcaccccaaatgctggggagcccac

SEQ ID NO: 935995 - DNA, 25 bp, Mus musculus
gcaccccaaccacgtctcgccagtg

SEQ ID NO: 935996 - DNA, 25 bp, Mus musculus
gcaccccaaccaggtctcgccagtg

SEQ ID NO: 935997 - DNA, 25 bp, Mus musculus
gcaccccaagcctccatgatgttcc

SEQ ID NO: 935998 - DNA, 25 bp, Mus musculus
gcaccccaaggctccatgatgttcc

SEQ ID NO: 935999 - DNA, 25 bp, Mus musculus
gcacccccatcacccccctcaagtt

SEQ ID NO: 936000 - DNA, 25 bp, Mus musculus
gcacccccatcagccccctcaagtt

SEQ ID NO: 936001 - DNA, 25 bp, Mus musculus
gcaccccggccccacctgagtgatc

SEQ ID NO: 936002 - DNA, 25 bp, Mus musculus
gcaccccggccccacggctggctgt

SEQ ID NO: 936003 - DNA, 25 bp, Mus musculus
gcaccccggccccagctgagtgatc

SEQ ID NO: 936004 - DNA, 25 bp, Mus musculus
gcaccccggccccagggctggctgt

SEQ ID NO: 936005 - DNA, 25 bp, Mus musculus
gcacccctgccacataatcagcctt

SEQ ID NO: 936006 - DNA, 25 bp, Mus musculus
gcacccctgccactctcctggctgc

SEQ ID NO: 936007 - DNA, 25 bp, Mus musculus
gcacccctgccagataatcagcctt

SEQ ID NO: 936008 - DNA, 25 bp, Mus musculus
gcacccctgccagtctcctggctgc

SEQ ID NO: 936009 - DNA, 25 bp, Mus musculus
gcacccctttatcacggtatcagag

SEQ ID NO: 936010 - DNA, 25 bp, Mus musculus
gcacccctttatcagggtatcagag

SEQ ID NO: 936011 - DNA, 25 bp, Mus musculus
gcacccgagctacgggaagacaccc

SEQ ID NO: 936012 - DNA, 25 bp, Mus musculus
gcacccgagctaggggaagacaccc

SEQ ID NO: 936013 - DNA, 25 bp, Mus musculus
gcacccgcagctggtgctgcaggcg

SEQ ID NO: 936014 - DNA, 25 bp, Mus musculus
gcacccgcaggtggtgctgcaggcg

SEQ ID NO: 936015 - DNA, 25 bp, Mus musculus
gcaccctattgatgcgtacctgtcc

SEQ ID NO: 936016 - DNA, 25 bp, Mus musculus
gcaccctattgatgggtacctgtcc

SEQ ID NO: 936017 - DNA, 25 bp, Mus musculus
gcaccctcaaaccacgtgatcatgc

SEQ ID NO: 936018 - DNA, 25 bp, Mus musculus
gcaccctcaaaccaggtgatcatgc

SEQ ID NO: 936019 - DNA, 25 bp, Mus musculus
gcaccctcacaacataatcgttatg

SEQ ID NO: 936020 - DNA, 25 bp, Mus musculus
gcaccctcacaagataatcgttatg

SEQ ID NO: 936021 - DNA, 25 bp, Mus musculus
gcaccctcagcaccgcgtccaccag

SEQ ID NO: 936022 - DNA, 25 bp, Mus musculus
gcaccctcaggaccgcgtccaccag

SEQ ID NO: 936023 - DNA, 25 bp, Mus musculus
gcacccttgatgaagatttagcgcc

SEQ ID NO: 936024 - DNA, 25 bp, Mus musculus
gcacccttgatgcagaagatttagc

SEQ ID NO: 936025 - DNA, 25 bp, Mus musculus
gcacccttgatggagaagatttagc

SEQ ID NO: 936026 - DNA, 25 bp, Mus musculus
gcacccttgatgtagatttagcgcc

SEQ ID NO: 936027 - DNA, 25 bp, Mus musculus
gcaccgcattcagacggttctcatc

SEQ ID NO: 936028 - DNA, 25 bp, Mus musculus
gcaccgcattcagagggttctcatc

SEQ ID NO: 936029 - DNA, 25 bp, Mus musculus
gcaccgccaacgagatcatagacaa

SEQ ID NO: 936030 - DNA, 25 bp, Mus musculus
gcaccgccaaggagatcatagacaa

SEQ ID NO: 936031 - DNA, 25 bp, Mus musculus
gcaccgcctttggacgatggaagag

SEQ ID NO: 936032 - DNA, 25 bp, Mus musculus
gcaccgcctttggaggatggaagag

SEQ ID NO: 936033 - DNA, 25 bp, Mus musculus
gcaccgcgaactcagtacacaacag

SEQ ID NO: 936034 - DNA, 25 bp, Mus musculus
gcaccgcgaagtcagtacacaacag

SEQ ID NO: 936035 - DNA, 25 bp, Mus musculus
gcaccggcttctcccccccactgcc

SEQ ID NO: 936036 - DNA, 25 bp, Mus musculus
gcaccggcttctcgaagtcacctgg

SEQ ID NO: 936037 - DNA, 25 bp, Mus musculus
gcaccggcttctgccccccactgcc

SEQ ID NO: 936038 - DNA, 25 bp, Mus musculus
gcaccggcttctggaagtcacctgg

SEQ ID NO: 936039 - DNA, 25 bp, Mus musculus
gcaccgtcagcctcaagtccacccc

SEQ ID NO: 936040 - DNA, 25 bp, Mus musculus
gcaccgtcaggctcaagtccacccc

SEQ ID NO: 936041 - DNA, 25 bp, Mus musculus
gcaccgtgtgaccatgaacgagttt

SEQ ID NO: 936042 - DNA, 25 bp, Mus musculus
gcaccgtgtgtccatgaacgagttt

SEQ ID NO: 936043 - DNA, 25 bp, Mus musculus
gcacctacggcctgactcctcacta

SEQ ID NO: 936044 - DNA, 25 bp, Mus musculus
gcacctacgggctgactcctcacta

SEQ ID NO: 936045 - DNA, 25 bp, Mus musculus
gcacctactcaacctctcagaactg

SEQ ID NO: 936046 - DNA, 25 bp, Mus musculus
gcacctactcaagctctcagaactg

SEQ ID NO: 936047 - DNA, 25 bp, Mus musculus
gcacctatagagtctataatataaa

SEQ ID NO: 936048 - DNA, 25 bp, Mus musculus
gcacctatagatggcattcgctcat

SEQ ID NO: 936049 - DNA, 25 bp, Mus musculus
gcacctatagtgtctataatataaa

SEQ ID NO: 936050 - DNA, 25 bp, Mus musculus
gcacctatagttggcattcgctcat

SEQ ID NO: 936051 - DNA, 25 bp, Mus musculus
gcacctcaagagcgagagaaaatga

SEQ ID NO: 936052 - DNA, 25 bp, Mus musculus
gcacctcaagagctacctaagagta

SEQ ID NO: 936053 - DNA, 25 bp, Mus musculus
gcacctcaagagggagagaaaatga

SEQ ID NO: 936054 - DNA, 25 bp, Mus musculus
gcacctcaagaggtacctaagagta

SEQ ID NO: 936055 - DNA, 25 bp, Mus musculus
gcacctcaagcagcagcaggagatg

SEQ ID NO: 936056 - DNA, 25 bp, Mus musculus
gcacctcaaggacggttcagaagcg

SEQ ID NO: 936057 - DNA, 25 bp, Mus musculus
gcacctcaaggagcagcaggagatg

SEQ ID NO: 936058 - DNA, 25 bp, Mus musculus
gcacctcaaggagggttcagaagcg

SEQ ID NO: 936059 - DNA, 25 bp, Mus musculus
gcacctcaccccctccccgaagctg

SEQ ID NO: 936060 - DNA, 25 bp, Mus musculus
gcacctcaccgcctccccgaagctg

SEQ ID NO: 936061 - DNA, 25 bp, Mus musculus
gcacctcagcagcctcaagcaagac

SEQ ID NO: 936062 - DNA, 25 bp, Mus musculus
gcacctcagcaggctcaagcaagac

SEQ ID NO: 936063 - DNA, 25 bp, Mus musculus
gcacctccacagagaaaaagctgcc

SEQ ID NO: 936064 - DNA, 25 bp, Mus musculus
gcacctccacagtgaaaaagctgcc

SEQ ID NO: 936065 - DNA, 25 bp, Mus musculus
gcacctccagacaagttcagaatgc

SEQ ID NO: 936066 - DNA, 25 bp, Mus musculus
gcacctccagtcaagttcagaatgc

SEQ ID NO: 936067 - DNA, 25 bp, Mus musculus
gcacctccttccagaagagtaaagg

SEQ ID NO: 936068 - DNA, 25 bp, Mus musculus
gcacctccttcctgaagagtaaagg

SEQ ID NO: 936069 - DNA, 25 bp, Mus musculus
gcacctcgtcaccactactataatc

SEQ ID NO: 936070 - DNA, 25 bp, Mus musculus
gcacctcgtcaccagtactataatc

SEQ ID NO: 936071 - DNA, 25 bp, Mus musculus
gcacctctaccccctggtcttggta

SEQ ID NO: 936072 - DNA, 25 bp, Mus musculus
gcacctctacgccctggtcttggta

SEQ ID NO: 936073 - DNA, 25 bp, Mus musculus
gcacctctgcagcttcaggtctcaa

SEQ ID NO: 936074 - DNA, 25 bp, Mus musculus
gcacctctgcaggttcaggtctcaa

SEQ ID NO: 936075 - DNA, 25 bp, Mus musculus
gcacctgagacaatcctaaaggact

SEQ ID NO: 936076 - DNA, 25 bp, Mus musculus
gcacctgagacattcctaaaggact

SEQ ID NO: 936077 - DNA, 25 bp, Mus musculus
gcacctgaggacaaagtctggagct

SEQ ID NO: 936078 - DNA, 25 bp, Mus musculus
gcacctgaggtcaaagtctggagct

SEQ ID NO: 936079 - DNA, 25 bp, Mus musculus
gcacctgcaacagagagttgacaaa

SEQ ID NO: 936080 - DNA, 25 bp, Mus musculus
gcacctgcaacaggagagagttgac

SEQ ID NO: 936081 - DNA, 25 bp, Mus musculus
gcacctgcaagagagagttgacaaa

SEQ ID NO: 936082 - DNA, 25 bp, Mus musculus
gcacctgcaagaggagagagttgac

SEQ ID NO: 936083 - DNA, 25 bp, Mus musculus
gcacctgcagcgtgtgggccacttt

SEQ ID NO: 936084 - DNA, 25 bp, Mus musculus
gcacctgcagggtgtgggccacttt

SEQ ID NO: 936085 - DNA, 25 bp, Mus musculus
gcacctggatccaccctgctcttca

SEQ ID NO: 936086 - DNA, 25 bp, Mus musculus
gcacctggatccattttgttcccaa

SEQ ID NO: 936087 - DNA, 25 bp, Mus musculus
gcacctggatgcaccctgctcttca

SEQ ID NO: 936088 - DNA, 25 bp, Mus musculus
gcacctggatgcattttgttcccaa

SEQ ID NO: 936089 - DNA, 25 bp, Mus musculus
gcacctgtggatctgctcggcccta

SEQ ID NO: 936090 - DNA, 25 bp, Mus musculus
gcacctgtggatgtgctcggcccta

SEQ ID NO: 936091 - DNA, 25 bp, Mus musculus
gcacctgttcttccctcactgtcag

SEQ ID NO: 936092 - DNA, 25 bp, Mus musculus
gcacctgttcttgcctcactgtcag

SEQ ID NO: 936093 - DNA, 25 bp, Mus musculus
gcaccttaggagagtaaagagctgg

SEQ ID NO: 936094 - DNA, 25 bp, Mus musculus
gcaccttaggagtgtaaagagctgg

SEQ ID NO: 936095 - DNA, 25 bp, Mus musculus
gcaccttcacagctctgccctgtaa

SEQ ID NO: 936096 - DNA, 25 bp, Mus musculus
gcaccttcacaggtctgccctgtaa

SEQ ID NO: 936097 - DNA, 25 bp, Mus musculus
gcaccttcagcctggagccagacat

SEQ ID NO: 936098 - DNA, 25 bp, Mus musculus
gcaccttcaggctggagccagacat

SEQ ID NO: 936099 - DNA, 25 bp, Mus musculus
gcaccttccggcaacgtgttggagc

SEQ ID NO: 936100 - DNA, 25 bp, Mus musculus
gcaccttccggcaaggtgttggagc

SEQ ID NO: 936101 - DNA, 25 bp, Mus musculus
gcaccttgcgttaagactcctgtcc

SEQ ID NO: 936102 - DNA, 25 bp, Mus musculus
gcaccttgcgtttagactcctgtcc

SEQ ID NO: 936103 - DNA, 25 bp, Mus musculus
gcaccttggccaccactcctaatag

SEQ ID NO: 936104 - DNA, 25 bp, Mus musculus
gcaccttggccacctctcctaatag

SEQ ID NO: 936105 - DNA, 25 bp, Mus musculus
gcaccttgtgccttgcgctctggac

SEQ ID NO: 936106 - DNA, 25 bp, Mus musculus
gcaccttgtggcttgcgctctggac

SEQ ID NO: 936107 - DNA, 25 bp, Mus musculus
gcacgaaagttgcacgatgtgtttg

SEQ ID NO: 936108 - DNA, 25 bp, Mus musculus
gcacgaaagttgcaggatgtgtttg

SEQ ID NO: 936109 - DNA, 25 bp, Mus musculus
gcacgacgccacatcggaagggggt

SEQ ID NO: 936110 - DNA, 25 bp, Mus musculus
gcacgacgccacttcggaagggggt

SEQ ID NO: 936111 - DNA, 25 bp, Mus musculus
gcacgagaacagcgactactgtgaa

SEQ ID NO: 936112 - DNA, 25 bp, Mus musculus
gcacgagaacagggactactgtgaa

SEQ ID NO: 936113 - DNA, 25 bp, Mus musculus
gcacgagaatgacatgtttagcatg

SEQ ID NO: 936114 - DNA, 25 bp, Mus musculus
gcacgagaatgagatgtttagcatg

SEQ ID NO: 936115 - DNA, 25 bp, Mus musculus
gcacgcaggatgagtatccatcgag

SEQ ID NO: 936116 - DNA, 25 bp, Mus musculus
gcacgcaggatgcacctctctacgt

SEQ ID NO: 936117 - DNA, 25 bp, Mus musculus
gcacgcaggatggacctctctacgt

SEQ ID NO: 936118 - DNA, 25 bp, Mus musculus
gcacgcaggatgtgtatccatcgag

SEQ ID NO: 936119 - DNA, 25 bp, Mus musculus
gcacgcccagatatggatgctgtgt

SEQ ID NO: 936120 - DNA, 25 bp, Mus musculus
gcacgcccagttatggatgctgtgt

SEQ ID NO: 936121 - DNA, 25 bp, Mus musculus
gcacgcctacagcttcctggtggct

SEQ ID NO: 936122 - DNA, 25 bp, Mus musculus
gcacgcctacaggttcctggtggct

SEQ ID NO: 936123 - DNA, 25 bp, Mus musculus
gcacgcggcggccccacgctgcggc

SEQ ID NO: 936124 - DNA, 25 bp, Mus musculus
gcacgcggcggcccgacgctgcggc

SEQ ID NO: 936125 - DNA, 25 bp, Mus musculus
gcacgcggtcagaactgtgccggat

SEQ ID NO: 936126 - DNA, 25 bp, Mus musculus
gcacgcggtcagagaaagccaagta

SEQ ID NO: 936127 - DNA, 25 bp, Mus musculus
gcacgcggtcagtactgtgccggat

SEQ ID NO: 936128 - DNA, 25 bp, Mus musculus
gcacgcggtcagtgaaagccaagta

SEQ ID NO: 936129 - DNA, 25 bp, Mus musculus
gcacgctcatagcactgccgctcca

SEQ ID NO: 936130 - DNA, 25 bp, Mus musculus
gcacgctcatagcagtgccgctcca

SEQ ID NO: 936131 - DNA, 25 bp, Mus musculus
gcacggaatgcctattgtgagaaca

SEQ ID NO: 936132 - DNA, 25 bp, Mus musculus
gcacggaatggctattgtgagaaca

SEQ ID NO: 936133 - DNA, 25 bp, Mus musculus
gcacggagagatgcttttactgact

SEQ ID NO: 936134 - DNA, 25 bp, Mus musculus
gcacggagagccttccatatgacca

SEQ ID NO: 936135 - DNA, 25 bp, Mus musculus
gcacggagaggcttccatatgacca

SEQ ID NO: 936136 - DNA, 25 bp, Mus musculus
gcacggagagttgcttttactgact

SEQ ID NO: 936137 - DNA, 25 bp, Mus musculus
gcacggatcactcatgtggacaatg

SEQ ID NO: 936138 - DNA, 25 bp, Mus musculus
gcacggatcactgatgtggacaatg

SEQ ID NO: 936139 - DNA, 25 bp, Mus musculus
gcacggatcataaacagctgcgagt

SEQ ID NO: 936140 - DNA, 25 bp, Mus musculus
gcacggatcataaagagctgcgagt

SEQ ID NO: 936141 - DNA, 25 bp, Mus musculus
gcacggcatctaaaatgtcacccag

SEQ ID NO: 936142 - DNA, 25 bp, Mus musculus
gcacggcatctaagcggagctgacc

SEQ ID NO: 936143 - DNA, 25 bp, Mus musculus
gcacggcatctaagtacgtgccctg

SEQ ID NO: 936144 - DNA, 25 bp, Mus musculus
gcacggcatctataatgtcacccag

SEQ ID NO: 936145 - DNA, 25 bp, Mus musculus
gcacggcatctatgcggagctgacc

SEQ ID NO: 936146 - DNA, 25 bp, Mus musculus
gcacggcatctatgtacgtgccctg

SEQ ID NO: 936147 - DNA, 25 bp, Mus musculus
gcacggcctacactcttacgagaag

SEQ ID NO: 936148 - DNA, 25 bp, Mus musculus
gcacggcctacactgttacgagaag

SEQ ID NO: 936149 - DNA, 25 bp, Mus musculus
gcacggctccagaaagatgacagga

SEQ ID NO: 936150 - DNA, 25 bp, Mus musculus
gcacggctccagtaagatgacagga

SEQ ID NO: 936151 - DNA, 25 bp, Mus musculus
gcacgggaagcaagtgggcagcatc

SEQ ID NO: 936152 - DNA, 25 bp, Mus musculus
gcacgggaaggaagtgggcagcatc

SEQ ID NO: 936153 - DNA, 25 bp, Mus musculus
gcacgggctacacgttgcgttacag

SEQ ID NO: 936154 - DNA, 25 bp, Mus musculus
gcacgggctacaggttgcgttacag

SEQ ID NO: 936155 - DNA, 25 bp, Mus musculus
gcacggtgaatccacgtttgatctg

SEQ ID NO: 936156 - DNA, 25 bp, Mus musculus
gcacggtgaatccaggtttgatctg

SEQ ID NO: 936157 - DNA, 25 bp, Mus musculus
gcacgtcgacgacacggaacgaatg

SEQ ID NO: 936158 - DNA, 25 bp, Mus musculus
gcacgtcgacgacagggaacgaatg

SEQ ID NO: 936159 - DNA, 25 bp, Mus musculus
gcacgtctgccactgcgaccagtac

SEQ ID NO: 936160 - DNA, 25 bp, Mus musculus
gcacgtctgccagtgcgaccagtac

SEQ ID NO: 936161 - DNA, 25 bp, Mus musculus
gcacgtctttgaccatccatgggaa

SEQ ID NO: 936162 - DNA, 25 bp, Mus musculus
gcacgtctttgacttattggtgcag

SEQ ID NO: 936163 - DNA, 25 bp, Mus musculus
gcacgtctttgagcatccatgggaa

SEQ ID NO: 936164 - DNA, 25 bp, Mus musculus
gcacgtctttgagttattggtgcag

SEQ ID NO: 936165 - DNA, 25 bp, Mus musculus
gcacgtgaccgactccgggacgcag

SEQ ID NO: 936166 - DNA, 25 bp, Mus musculus
gcacgtgaccgagtccgggacgcag

SEQ ID NO: 936167 - DNA, 25 bp, Mus musculus
gcactaaaagaagacatgcaaagct

SEQ ID NO: 936168 - DNA, 25 bp, Mus musculus
gcactaaaagaagagatgcaaagct

SEQ ID NO: 936169 - DNA, 25 bp, Mus musculus
gcactaaaagctacatggcccctga

SEQ ID NO: 936170 - DNA, 25 bp, Mus musculus
gcactaaaaggtacatggcccctga

SEQ ID NO: 936171 - DNA, 25 bp, Mus musculus
gcactacaggaactgggaggtctga

SEQ ID NO: 936172 - DNA, 25 bp, Mus musculus
gcactacaggaagtgggaggtctga

SEQ ID NO: 936173 - DNA, 25 bp, Mus musculus
gcactaccagagaggcacagctcag

SEQ ID NO: 936174 - DNA, 25 bp, Mus musculus
gcactaccagcaagacatgggatct

SEQ ID NO: 936175 - DNA, 25 bp, Mus musculus
gcactaccaggaagacatgggatct

SEQ ID NO: 936176 - DNA, 25 bp, Mus musculus
gcactaccagtgaggcacagctcag

SEQ ID NO: 936177 - DNA, 25 bp, Mus musculus
gcactacgagtacccgcatgtcatg

SEQ ID NO: 936178 - DNA, 25 bp, Mus musculus
gcactacgagtaccggcatgtcatg

SEQ ID NO: 936179 - DNA, 25 bp, Mus musculus
gcactactggagccactgccagtca

SEQ ID NO: 936180 - DNA, 25 bp, Mus musculus
gcactactggagcctctgccagtca

SEQ ID NO: 936181 - DNA, 25 bp, Mus musculus
gcactagatatcaaaatcgggtcat

SEQ ID NO: 936182 - DNA, 25 bp, Mus musculus
gcactagatatcaatctgtggttct

SEQ ID NO: 936183 - DNA, 25 bp, Mus musculus
gcactagatatctaaatcgggtcat

SEQ ID NO: 936184 - DNA, 25 bp, Mus musculus
gcactagatatctatctgtggttct

SEQ ID NO: 936185 - DNA, 25 bp, Mus musculus
gcactagctcttcacctctggggac

SEQ ID NO: 936186 - DNA, 25 bp, Mus musculus
gcactagctcttcacgactgggcag

SEQ ID NO: 936187 - DNA, 25 bp, Mus musculus
gcactagctcttcagctctggggac

SEQ ID NO: 936188 - DNA, 25 bp, Mus musculus
gcactagctcttcaggactgggcag

SEQ ID NO: 936189 - DNA, 25 bp, Mus musculus
gcactagggaagctcccggatgttg

SEQ ID NO: 936190 - DNA, 25 bp, Mus musculus
gcactagggaaggtcccggatgttg

SEQ ID NO: 936191 - DNA, 25 bp, Mus musculus
gcactcagcacacagcgagggaaga

SEQ ID NO: 936192 - DNA, 25 bp, Mus musculus
gcactcagcacagagcgagggaaga

SEQ ID NO: 936193 - DNA, 25 bp, Mus musculus
gcactcagcctggacgacacagagc

SEQ ID NO: 936194 - DNA, 25 bp, Mus musculus
gcactcagcctggaggacacagagc

SEQ ID NO: 936195 - DNA, 25 bp, Mus musculus
gcactcaggaagcgcccctgtacgt

SEQ ID NO: 936196 - DNA, 25 bp, Mus musculus
gcactcaggaagggcccctgtacgt

SEQ ID NO: 936197 - DNA, 25 bp, Mus musculus
gcactcatcatgctggacaatgcca

SEQ ID NO: 936198 - DNA, 25 bp, Mus musculus
gcactcatcatggtggacaatgcca

SEQ ID NO: 936199 - DNA, 25 bp, Mus musculus
gcactcccaagattcataattagga

SEQ ID NO: 936200 - DNA, 25 bp, Mus musculus
gcactcccaagattgataattagga

SEQ ID NO: 936201 - DNA, 25 bp, Mus musculus
gcactcccatggcttctccatatcg

SEQ ID NO: 936202 - DNA, 25 bp, Mus musculus
gcactcccatgggttctccatatcg

SEQ ID NO: 936203 - DNA, 25 bp, Mus musculus
gcactcctggtggtcaccgcaggga

SEQ ID NO: 936204 - DNA, 25 bp, Mus musculus
gcactcctggtggtccgtcttctgg

SEQ ID NO: 936205 - DNA, 25 bp, Mus musculus
gcactcctggtggtgaccgcaggga

SEQ ID NO: 936206 - DNA, 25 bp, Mus musculus
gcactcctggtggtgcgtcttctgg

SEQ ID NO: 936207 - DNA, 25 bp, Mus musculus
gcactcgctgctgtccttcgtggta

SEQ ID NO: 936208 - DNA, 25 bp, Mus musculus
gcactcgctggtgtccttcgtggta

SEQ ID NO: 936209 - DNA, 25 bp, Mus musculus
gcactcgggagacaccattcgaact

SEQ ID NO: 936210 - DNA, 25 bp, Mus musculus
gcactcgggagacagcattcgaact

SEQ ID NO: 936211 - DNA, 25 bp, Mus musculus
gcactctcagcctaccggctctctg

SEQ ID NO: 936212 - DNA, 25 bp, Mus musculus
gcactctcaggctaccggctctctg

SEQ ID NO: 936213 - DNA, 25 bp, Mus musculus
gcactctccaaccacccaatagtta

SEQ ID NO: 936214 - DNA, 25 bp, Mus musculus
gcactctccaaccacttacagttag

SEQ ID NO: 936215 - DNA, 25 bp, Mus musculus
gcactctccaaccagccaatagtta

SEQ ID NO: 936216 - DNA, 25 bp, Mus musculus
gcactctccaaccagttacagttag

SEQ ID NO: 936217 - DNA, 25 bp, Mus musculus
gcactctgagagagaagctggactc

SEQ ID NO: 936218 - DNA, 25 bp, Mus musculus
gcactctgagtgagaagctggactc

SEQ ID NO: 936219 - DNA, 25 bp, Mus musculus
gcactctgcgaacggaaatgctcat

SEQ ID NO: 936220 - DNA, 25 bp, Mus musculus
gcactctgcgaagggaaatgctcat

SEQ ID NO: 936221 - DNA, 25 bp, Mus musculus
gcactctggaggcacagtaaaagac

SEQ ID NO: 936222 - DNA, 25 bp, Mus musculus
gcactctggaggcagagtaaaagac

SEQ ID NO: 936223 - DNA, 25 bp, Mus musculus
gcactctttgagcaagaaatggaca

SEQ ID NO: 936224 - DNA, 25 bp, Mus musculus
gcactctttgaggaagaaatggaca

SEQ ID NO: 936225 - DNA, 25 bp, Mus musculus
gcactctttttgctatgatcactgc

SEQ ID NO: 936226 - DNA, 25 bp, Mus musculus
gcactctttttggtatgatcactgc

SEQ ID NO: 936227 - DNA, 25 bp, Mus musculus
gcactgaagaagataaagcgctcat

SEQ ID NO: 936228 - DNA, 25 bp, Mus musculus
gcactgaagaagttaaagcgctcat

SEQ ID NO: 936229 - DNA, 25 bp, Mus musculus
gcactgagacagcgctttctgaggg

SEQ ID NO: 936230 - DNA, 25 bp, Mus musculus
gcactgagacagggctttctgaggg

SEQ ID NO: 936231 - DNA, 25 bp, Mus musculus
gcactgaggcggcaagcctgtggga

SEQ ID NO: 936232 - DNA, 25 bp, Mus musculus
gcactgaggcgggaagcctgtggga

SEQ ID NO: 936233 - DNA, 25 bp, Mus musculus
gcactgagggacagtaccttctgaa

SEQ ID NO: 936234 - DNA, 25 bp, Mus musculus
gcactgagggactgtaccttctgaa

SEQ ID NO: 936235 - DNA, 25 bp, Mus musculus
gcactgatatcacgaggagccatgg

SEQ ID NO: 936236 - DNA, 25 bp, Mus musculus
gcactgatatcaggaggagccatgg

SEQ ID NO: 936237 - DNA, 25 bp, Mus musculus
gcactgattgctgctgtcagatgca

SEQ ID NO: 936238 - DNA, 25 bp, Mus musculus
gcactgattggtgctgtcagatgca

SEQ ID NO: 936239 - DNA, 25 bp, Mus musculus
gcactgcaaacaatattatgcctta

SEQ ID NO: 936240 - DNA, 25 bp, Mus musculus
gcactgcaaacattattatgcctta

SEQ ID NO: 936241 - DNA, 25 bp, Mus musculus
gcactgcagacacaccctgctgcag

SEQ ID NO: 936242 - DNA, 25 bp, Mus musculus
gcactgcagacagaccctgctgcag

SEQ ID NO: 936243 - DNA, 25 bp, Mus musculus
gcactgcatccacctctgttcctaa

SEQ ID NO: 936244 - DNA, 25 bp, Mus musculus
gcactgcatccagctctgttcctaa

SEQ ID NO: 936245 - DNA, 25 bp, Mus musculus
gcactgcatgagaaactctctggag

SEQ ID NO: 936246 - DNA, 25 bp, Mus musculus
gcactgcatgtgaaactctctggag

SEQ ID NO: 936247 - DNA, 25 bp, Mus musculus
gcactgccaacacatctacacacaa

SEQ ID NO: 936248 - DNA, 25 bp, Mus musculus
gcactgccaacacggtgcatcgctt

SEQ ID NO: 936249 - DNA, 25 bp, Mus musculus
gcactgccaacagatctacacacaa

SEQ ID NO: 936250 - DNA, 25 bp, Mus musculus
gcactgccaacagggtgcatcgctt

SEQ ID NO: 936251 - DNA, 25 bp, Mus musculus
gcactgccaccgcgttcacattctc

SEQ ID NO: 936252 - DNA, 25 bp, Mus musculus
gcactgccaccgctcacgaagttgg

SEQ ID NO: 936253 - DNA, 25 bp, Mus musculus
gcactgccaccgggttcacattctc

SEQ ID NO: 936254 - DNA, 25 bp, Mus musculus
gcactgccaccggtcacgaagttgg

SEQ ID NO: 936255 - DNA, 25 bp, Mus musculus
gcactgccagcacggggtctggacc

SEQ ID NO: 936256 - DNA, 25 bp, Mus musculus
gcactgccaggacggggtctggacc

SEQ ID NO: 936257 - DNA, 25 bp, Mus musculus
gcactgccggccttggtgaatattt

SEQ ID NO: 936258 - DNA, 25 bp, Mus musculus
gcactgccgggacatggctcagcgg

SEQ ID NO: 936259 - DNA, 25 bp, Mus musculus
gcactgccgggagatggctcagcgg

SEQ ID NO: 936260 - DNA, 25 bp, Mus musculus
gcactgccgggcttggtgaatattt

SEQ ID NO: 936261 - DNA, 25 bp, Mus musculus
gcactgcctgtgaacacttggatga

SEQ ID NO: 936262 - DNA, 25 bp, Mus musculus
gcactgcctgtgaagacttggatga

SEQ ID NO: 936263 - DNA, 25 bp, Mus musculus
gcactgctctcaatccaggtcaatg

SEQ ID NO: 936264 - DNA, 25 bp, Mus musculus
gcactgctctcaatgcaggtcaatg

SEQ ID NO: 936265 - DNA, 25 bp, Mus musculus
gcactgctgaaacgtactaatgcat

SEQ ID NO: 936266 - DNA, 25 bp, Mus musculus
gcactgctgaaaggtactaatgcat

SEQ ID NO: 936267 - DNA, 25 bp, Mus musculus
gcactgcttaagctagatagacgag

SEQ ID NO: 936268 - DNA, 25 bp, Mus musculus
gcactgcttaaggtagatagacgag

SEQ ID NO: 936269 - DNA, 25 bp, Mus musculus
gcactggaagctcaatgagagtcat

SEQ ID NO: 936270 - DNA, 25 bp, Mus musculus
gcactggaaggtcaatgagagtcat

SEQ ID NO: 936271 - DNA, 25 bp, Mus musculus
gcactggacaagcacagcggccacc

SEQ ID NO: 936272 - DNA, 25 bp, Mus musculus
gcactggacaaggacagcggccacc

SEQ ID NO: 936273 - DNA, 25 bp, Mus musculus
gcactggacttgctgaaacctggtc

SEQ ID NO: 936274 - DNA, 25 bp, Mus musculus
gcactggacttggtgaaacctggtc

SEQ ID NO: 936275 - DNA, 25 bp, Mus musculus
gcactggataagcctagagaaggcc

SEQ ID NO: 936276 - DNA, 25 bp, Mus musculus
gcactggataaggctagagaaggcc

SEQ ID NO: 936277 - DNA, 25 bp, Mus musculus
gcactggcacagcgttactactcac

SEQ ID NO: 936278 - DNA, 25 bp, Mus musculus
gcactggcacagggttactactcac

SEQ ID NO: 936279 - DNA, 25 bp, Mus musculus
gcactggcagccctgtacggagatc

SEQ ID NO: 936280 - DNA, 25 bp, Mus musculus
gcactggcagcgctggtctacaact

SEQ ID NO: 936281 - DNA, 25 bp, Mus musculus
gcactggcaggcctgtacggagatc

SEQ ID NO: 936282 - DNA, 25 bp, Mus musculus
gcactggcagggctggtctacaact

SEQ ID NO: 936283 - DNA, 25 bp, Mus musculus
gcactggccgtaaaaggttcagact

SEQ ID NO: 936284 - DNA, 25 bp, Mus musculus
gcactggccgtaaatggttcagact

SEQ ID NO: 936285 - DNA, 25 bp, Mus musculus
gcactggctggaaacgccaagacca

SEQ ID NO: 936286 - DNA, 25 bp, Mus musculus
gcactggctggaaaggccaagacca

SEQ ID NO: 936287 - DNA, 25 bp, Mus musculus
gcactgggaaatatggctttgtaat

SEQ ID NO: 936288 - DNA, 25 bp, Mus musculus
gcactgggaacgcttgtcgcttact

SEQ ID NO: 936289 - DNA, 25 bp, Mus musculus
gcactgggaaggcttgtcgcttact

SEQ ID NO: 936290 - DNA, 25 bp, Mus musculus
gcactgggaattatggctttgtaat

SEQ ID NO: 936291 - DNA, 25 bp, Mus musculus
gcactggtgcagattctgggcctca

SEQ ID NO: 936292 - DNA, 25 bp, Mus musculus
gcactggtgcagctgtatccagatg

SEQ ID NO: 936293 - DNA, 25 bp, Mus musculus
gcactggtgcaggtgtatccagatg

SEQ ID NO: 936294 - DNA, 25 bp, Mus musculus
gcactggtgcagtttctgggcctca

SEQ ID NO: 936295 - DNA, 25 bp, Mus musculus
gcactgtacaagcacgccacagaag

SEQ ID NO: 936296 - DNA, 25 bp, Mus musculus
gcactgtacaagcaggccacagaag

SEQ ID NO: 936297 - DNA, 25 bp, Mus musculus
gcactgtcagaacaagcctgccatc

SEQ ID NO: 936298 - DNA, 25 bp, Mus musculus
gcactgtcagatcaaacctggaccc

SEQ ID NO: 936299 - DNA, 25 bp, Mus musculus
gcactgtcagcttccgagtccgagg

SEQ ID NO: 936300 - DNA, 25 bp, Mus musculus
gcactgtcaggttccgagtccgagg

SEQ ID NO: 936301 - DNA, 25 bp, Mus musculus
gcactgtcagtacaagcctgccatc

SEQ ID NO: 936302 - DNA, 25 bp, Mus musculus
gcactgtcagttcaaacctggaccc

SEQ ID NO: 936303 - DNA, 25 bp, Mus musculus
gcactgtccaaacggccagaagggg

SEQ ID NO: 936304 - DNA, 25 bp, Mus musculus
gcactgtccaaagggccagaagggg

SEQ ID NO: 936305 - DNA, 25 bp, Mus musculus
gcactgtctgctcccaccccttgag

SEQ ID NO: 936306 - DNA, 25 bp, Mus musculus
gcactgtctgctgccaccccttgag

SEQ ID NO: 936307 - DNA, 25 bp, Mus musculus
gcactgtgcggcgacacacaccaga

SEQ ID NO: 936308 - DNA, 25 bp, Mus musculus
gcactgtgcggcgacatcccacggg

SEQ ID NO: 936309 - DNA, 25 bp, Mus musculus
gcactgtgcggcgagacacaccaga

SEQ ID NO: 936310 - DNA, 25 bp, Mus musculus
gcactgtgcggcgagatcccacggg

SEQ ID NO: 936311 - DNA, 25 bp, Mus musculus
gcactgtggttgcctgggacccacg

SEQ ID NO: 936312 - DNA, 25 bp, Mus musculus
gcactgtggttgctgagcggggcac

SEQ ID NO: 936313 - DNA, 25 bp, Mus musculus
gcactgtggttggctgggacccacg

SEQ ID NO: 936314 - DNA, 25 bp, Mus musculus
gcactgtggttggtgagcggggcac

SEQ ID NO: 936315 - DNA, 25 bp, Mus musculus
gcactgtgtgcatcaactgctacga

SEQ ID NO: 936316 - DNA, 25 bp, Mus musculus
gcactgtgtggatcaactgctacga

SEQ ID NO: 936317 - DNA, 25 bp, Mus musculus
gcactgttggcccacgtgacaagct

SEQ ID NO: 936318 - DNA, 25 bp, Mus musculus
gcactgttggcccaggtgacaagct

SEQ ID NO: 936319 - DNA, 25 bp, Mus musculus
gcactgtttgagctggctttatgtg

SEQ ID NO: 936320 - DNA, 25 bp, Mus musculus
gcactgtttgtgctggctttatgtg

SEQ ID NO: 936321 - DNA, 25 bp, Mus musculus
gcacttacagctccttgaggaagct

SEQ ID NO: 936322 - DNA, 25 bp, Mus musculus
gcacttacagctgcttgaggaagct

SEQ ID NO: 936323 - DNA, 25 bp, Mus musculus
gcacttacagctggattacattaac

SEQ ID NO: 936324 - DNA, 25 bp, Mus musculus
gcacttacaggtggattacattaac

SEQ ID NO: 936325 - DNA, 25 bp, Mus musculus
gcacttacgccaagcgcttcaccat

SEQ ID NO: 936326 - DNA, 25 bp, Mus musculus
gcacttacgccaagggcttcaccat

SEQ ID NO: 936327 - DNA, 25 bp, Mus musculus
gcacttagagaaagcacaatgggtc

SEQ ID NO: 936328 - DNA, 25 bp, Mus musculus
gcacttagagtaagcacaatgggtc

SEQ ID NO: 936329 - DNA, 25 bp, Mus musculus
gcacttccactactcgtttgtggag

SEQ ID NO: 936330 - DNA, 25 bp, Mus musculus
gcacttccactactggtttgtggag

SEQ ID NO: 936331 - DNA, 25 bp, Mus musculus
gcacttcccctcctcaagctgattg

SEQ ID NO: 936332 - DNA, 25 bp, Mus musculus
gcacttcccctcctgaagctgattg

SEQ ID NO: 936333 - DNA, 25 bp, Mus musculus
gcacttcgagaggttgcaggccccg

SEQ ID NO: 936334 - DNA, 25 bp, Mus musculus
gcacttcgagtggttgcaggccccg

SEQ ID NO: 936335 - DNA, 25 bp, Mus musculus
gcacttcggggacgtggccaagcag

SEQ ID NO: 936336 - DNA, 25 bp, Mus musculus
gcacttcggggaggtggccaagcag

SEQ ID NO: 936337 - DNA, 25 bp, Mus musculus
gcacttctcctgctactggctctgg

SEQ ID NO: 936338 - DNA, 25 bp, Mus musculus
gcacttctcctggtactggctctgg

SEQ ID NO: 936339 - DNA, 25 bp, Mus musculus
gcacttgaaaaacacatagaagaag

SEQ ID NO: 936340 - DNA, 25 bp, Mus musculus
gcacttgaaaaacagatagaagaag

SEQ ID NO: 936341 - DNA, 25 bp, Mus musculus
gcacttggaacatgcgtaatgcacc

SEQ ID NO: 936342 - DNA, 25 bp, Mus musculus
gcacttggaacatgggtaatgcacc

SEQ ID NO: 936343 - DNA, 25 bp, Mus musculus
gcacttggaatcacagcagaaacga

SEQ ID NO: 936344 - DNA, 25 bp, Mus musculus
gcacttggaatcacagcagcagaaa

SEQ ID NO: 936345 - DNA, 25 bp, Mus musculus
gcacttggaatctcagcagaaacga

SEQ ID NO: 936346 - DNA, 25 bp, Mus musculus
gcacttggaatctcagcagcagaaa

SEQ ID NO: 936347 - DNA, 25 bp, Mus musculus
gcacttggagtgctgaatcaaagac

SEQ ID NO: 936348 - DNA, 25 bp, Mus musculus
gcacttggagtggtgaatcaaagac

SEQ ID NO: 936349 - DNA, 25 bp, Mus musculus
gcacttgtagcttggactctatggg

SEQ ID NO: 936350 - DNA, 25 bp, Mus musculus
gcacttgtaggttggactctatggg

SEQ ID NO: 936351 - DNA, 25 bp, Mus musculus
gcacttgtgaaaattctgatttgtg

SEQ ID NO: 936352 - DNA, 25 bp, Mus musculus
gcacttgtgaaaccctgcaagagcc

SEQ ID NO: 936353 - DNA, 25 bp, Mus musculus
gcacttgtgaaagcctgcaagagcc

SEQ ID NO: 936354 - DNA, 25 bp, Mus musculus
gcacttgtgaaatttctgatttgtg

SEQ ID NO: 936355 - DNA, 25 bp, Mus musculus
gcactttcttccgacaactggagga

SEQ ID NO: 936356 - DNA, 25 bp, Mus musculus
gcactttcttccgagaactggagga

SEQ ID NO: 936357 - DNA, 25 bp, Mus musculus
gcactttgaagacaattgttgtgtg

SEQ ID NO: 936358 - DNA, 25 bp, Mus musculus
gcactttgaagacgtgtgagtgttg

SEQ ID NO: 936359 - DNA, 25 bp, Mus musculus
gcactttgaagagaattgttgtgtg

SEQ ID NO: 936360 - DNA, 25 bp, Mus musculus
gcactttgaagaggtgtgagtgttg

SEQ ID NO: 936361 - DNA, 25 bp, Mus musculus
gcacttttccttagatcgctgccag

SEQ ID NO: 936362 - DNA, 25 bp, Mus musculus
gcacttttcctttgatcgctgccag

SEQ ID NO: 936363 - DNA, 25 bp, Mus musculus
gcactttttgagcaagagatggaca

SEQ ID NO: 936364 - DNA, 25 bp, Mus musculus
gcactttttgaggaagagatggaca

SEQ ID NO: 936365 - DNA, 25 bp, Mus musculus
gcagaaaaaaagctttatgaagctg

SEQ ID NO: 936366 - DNA, 25 bp, Mus musculus
gcagaaaaaaaggtttatgaagctg

SEQ ID NO: 936367 - DNA, 25 bp, Mus musculus
gcagaaaagaaacgagatcactatg

SEQ ID NO: 936368 - DNA, 25 bp, Mus musculus
gcagaaaagaaaggagatcactatg

SEQ ID NO: 936369 - DNA, 25 bp, Mus musculus
gcagaaaagaagcgactgaccatgc

SEQ ID NO: 936370 - DNA, 25 bp, Mus musculus
gcagaaaagaagggactgaccatgc

SEQ ID NO: 936371 - DNA, 25 bp, Mus musculus
gcagaaacatcactatcagcagcgt

SEQ ID NO: 936372 - DNA, 25 bp, Mus musculus
gcagaaacatcagtatcagcagcgt

SEQ ID NO: 936373 - DNA, 25 bp, Mus musculus
gcagaaaccgaaaaagccttgatag

SEQ ID NO: 936374 - DNA, 25 bp, Mus musculus
gcagaaaccgtaaaagccttgatag

SEQ ID NO: 936375 - DNA, 25 bp, Mus musculus
gcagaaactgattgaagccgacatc

SEQ ID NO: 936376 - DNA, 25 bp, Mus musculus
gcagaaactgtttgaagccgacatc

SEQ ID NO: 936377 - DNA, 25 bp, Mus musculus
gcagaaagaaaaccccttatgttag

SEQ ID NO: 936378 - DNA, 25 bp, Mus musculus
gcagaaagaaaagcccttatgttag

SEQ ID NO: 936379 - DNA, 25 bp, Mus musculus
gcagaaagactggacagaagctgaa

SEQ ID NO: 936380 - DNA, 25 bp, Mus musculus
gcagaaagactggagagaagctgaa

SEQ ID NO: 936381 - DNA, 25 bp, Mus musculus
gcagaaagagagagaacgaattcgc

SEQ ID NO: 936382 - DNA, 25 bp, Mus musculus
gcagaaagagagtgaacgaattcgc

SEQ ID NO: 936383 - DNA, 25 bp, Mus musculus
gcagaaagagctcagggactgcagt

SEQ ID NO: 936384 - DNA, 25 bp, Mus musculus
gcagaaagagctcagggactggagt

SEQ ID NO: 936385 - DNA, 25 bp, Mus musculus
gcagaaagaggtcagggactgcagt

SEQ ID NO: 936386 - DNA, 25 bp, Mus musculus
gcagaaagaggtcagggactggagt

SEQ ID NO: 936387 - DNA, 25 bp, Mus musculus
gcagaaagctcgaattacttttaaa

SEQ ID NO: 936388 - DNA, 25 bp, Mus musculus
gcagaaagctggaattacttttaaa

SEQ ID NO: 936389 - DNA, 25 bp, Mus musculus
gcagaaaggagaatatttaccttta

SEQ ID NO: 936390 - DNA, 25 bp, Mus musculus
gcagaaaggagattatttaccttta

SEQ ID NO: 936391 - DNA, 25 bp, Mus musculus
gcagaaagtggcttaatctgtaaca

SEQ ID NO: 936392 - DNA, 25 bp, Mus musculus
gcagaaagtggctttatctgtaaca

SEQ ID NO: 936393 - DNA, 25 bp, Mus musculus
gcagaaatagcgcagatttgtagtt

SEQ ID NO: 936394 - DNA, 25 bp, Mus musculus
gcagaaatagggcagatttgtagtt

SEQ ID NO: 936395 - DNA, 25 bp, Mus musculus
gcagaaatgaaaagggctcggtgtg

SEQ ID NO: 936396 - DNA, 25 bp, Mus musculus
gcagaaatgaaatgggctcggtgtg

SEQ ID NO: 936397 - DNA, 25 bp, Mus musculus
gcagaaatgaagctctgattgctct

SEQ ID NO: 936398 - DNA, 25 bp, Mus musculus
gcagaaatgaaggtctgattgctct

SEQ ID NO: 936399 - DNA, 25 bp, Mus musculus
gcagaaatgcagaaagtttttaaag

SEQ ID NO: 936400 - DNA, 25 bp, Mus musculus
gcagaaatgcagtaagtttttaaag

SEQ ID NO: 936401 - DNA, 25 bp, Mus musculus
gcagaaattcacaacagacatcagg

SEQ ID NO: 936402 - DNA, 25 bp, Mus musculus
gcagaaattctcaacagacatcagg

SEQ ID NO: 936403 - DNA, 25 bp, Mus musculus
gcagaaattgaacagagagaagcgc

SEQ ID NO: 936404 - DNA, 25 bp, Mus musculus
gcagaaattgaagagagagaagcgc

SEQ ID NO: 936405 - DNA, 25 bp, Mus musculus
gcagaacaacaacgaggagactccc

SEQ ID NO: 936406 - DNA, 25 bp, Mus musculus
gcagaacaacaaggaggagactccc

SEQ ID NO: 936407 - DNA, 25 bp, Mus musculus
gcagaacacaagcgcaagatcatca

SEQ ID NO: 936408 - DNA, 25 bp, Mus musculus
gcagaacacaagggcaagatcatca

SEQ ID NO: 936409 - DNA, 25 bp, Mus musculus
gcagaacaccagctacgctctatgg

SEQ ID NO: 936410 - DNA, 25 bp, Mus musculus
gcagaacaccaggtacgctctatgg

SEQ ID NO: 936411 - DNA, 25 bp, Mus musculus
gcagaacagattcacagcctctctc

SEQ ID NO: 936412 - DNA, 25 bp, Mus musculus
gcagaacagattcaccagcagcaac

SEQ ID NO: 936413 - DNA, 25 bp, Mus musculus
gcagaacagattcagagcctctctc

SEQ ID NO: 936414 - DNA, 25 bp, Mus musculus
gcagaacagattcagcagcagcaac

SEQ ID NO: 936415 - DNA, 25 bp, Mus musculus
gcagaacattcgcctccgggagtgt

SEQ ID NO: 936416 - DNA, 25 bp, Mus musculus
gcagaacattcggctccgggagtgt

SEQ ID NO: 936417 - DNA, 25 bp, Mus musculus
gcagaaccatactaagcattatcca

SEQ ID NO: 936418 - DNA, 25 bp, Mus musculus
gcagaaccatactaattgcttttgc

SEQ ID NO: 936419 - DNA, 25 bp, Mus musculus
gcagaaccatactatgcattatcca

SEQ ID NO: 936420 - DNA, 25 bp, Mus musculus
gcagaaccatactatttgcttttgc

SEQ ID NO: 936421 - DNA, 25 bp, Mus musculus
gcagaacccaagagcctggggtctc

SEQ ID NO: 936422 - DNA, 25 bp, Mus musculus
gcagaacccaagaggctggggtctc

SEQ ID NO: 936423 - DNA, 25 bp, Mus musculus
gcagaacgagcttgtgaaccatggc

SEQ ID NO: 936424 - DNA, 25 bp, Mus musculus
gcagaacgaggttgtgaaccatggc

SEQ ID NO: 936425 - DNA, 25 bp, Mus musculus
gcagaacgctgcacatttgaagaca

SEQ ID NO: 936426 - DNA, 25 bp, Mus musculus
gcagaacgctgcatgtgaatggctg

SEQ ID NO: 936427 - DNA, 25 bp, Mus musculus
gcagaacgctgctcatttgaagaca

SEQ ID NO: 936428 - DNA, 25 bp, Mus musculus
gcagaacgctgcttgtgaatggctg

SEQ ID NO: 936429 - DNA, 25 bp, Mus musculus
gcagaacggaaatacgcaaatactg

SEQ ID NO: 936430 - DNA, 25 bp, Mus musculus
gcagaacggaaataggcaaatactg

SEQ ID NO: 936431 - DNA, 25 bp, Mus musculus
gcagaactcagacacgattatggct

SEQ ID NO: 936432 - DNA, 25 bp, Mus musculus
gcagaactcagacaggattatggct

SEQ ID NO: 936433 - DNA, 25 bp, Mus musculus
gcagaagaaaagaagaaacaagagc

SEQ ID NO: 936434 - DNA, 25 bp, Mus musculus
gcagaagaaaagtagaaacaagagc

SEQ ID NO: 936435 - DNA, 25 bp, Mus musculus
gcagaagaaaatacagatgtccaac

SEQ ID NO: 936436 - DNA, 25 bp, Mus musculus
gcagaagaaaattcagatgtccaac

SEQ ID NO: 936437 - DNA, 25 bp, Mus musculus
gcagaagaaacacatggtgatgtgg

SEQ ID NO: 936438 - DNA, 25 bp, Mus musculus
gcagaagaaacagatggtgatgtgg

SEQ ID NO: 936439 - DNA, 25 bp, Mus musculus
gcagaagaactggccctatcccatt

SEQ ID NO: 936440 - DNA, 25 bp, Mus musculus
gcagaagaactggcgctatcccatt

SEQ ID NO: 936441 - DNA, 25 bp, Mus musculus
gcagaagaagaggatccaaacttct

SEQ ID NO: 936442 - DNA, 25 bp, Mus musculus
gcagaagaagtggatccaaacttct

SEQ ID NO: 936443 - DNA, 25 bp, Mus musculus
gcagaagagtggcacggctgttctc

SEQ ID NO: 936444 - DNA, 25 bp, Mus musculus
gcagaagagtgggacggctgttctc

SEQ ID NO: 936445 - DNA, 25 bp, Mus musculus
gcagaagcactccaaaaactaaagc

SEQ ID NO: 936446 - DNA, 25 bp, Mus musculus
gcagaagcactccaagtgtgtctga

SEQ ID NO: 936447 - DNA, 25 bp, Mus musculus
gcagaagcactccataaactaaagc

SEQ ID NO: 936448 - DNA, 25 bp, Mus musculus
gcagaagcactccatgtgtgtctga

SEQ ID NO: 936449 - DNA, 25 bp, Mus musculus
gcagaagcagcacggcacacatatg

SEQ ID NO: 936450 - DNA, 25 bp, Mus musculus
gcagaagcagcagggcacacatatg

SEQ ID NO: 936451 - DNA, 25 bp, Mus musculus
gcagaagcagcttcgtcatactata

SEQ ID NO: 936452 - DNA, 25 bp, Mus musculus
gcagaagcaggttcgtcatactata

SEQ ID NO: 936453 - DNA, 25 bp, Mus musculus
gcagaagccgccaagccgagtgctg

SEQ ID NO: 936454 - DNA, 25 bp, Mus musculus
gcagaagccggcaagccgagtgctg

SEQ ID NO: 936455 - DNA, 25 bp, Mus musculus
gcagaagctgcgagtgaagaagatc

SEQ ID NO: 936456 - DNA, 25 bp, Mus musculus
gcagaagctgcgtgtgaagaagatc

SEQ ID NO: 936457 - DNA, 25 bp, Mus musculus
gcagaaggcaagcttcggctcctgg

SEQ ID NO: 936458 - DNA, 25 bp, Mus musculus
gcagaaggcaaggttcggctcctgg

SEQ ID NO: 936459 - DNA, 25 bp, Mus musculus
gcagaaggcacacatggacagatgg

SEQ ID NO: 936460 - DNA, 25 bp, Mus musculus
gcagaaggcacacgtgaaggagaca

SEQ ID NO: 936461 - DNA, 25 bp, Mus musculus
gcagaaggcacagatggacagatgg

SEQ ID NO: 936462 - DNA, 25 bp, Mus musculus
gcagaaggcacaggtgaaggagaca

SEQ ID NO: 936463 - DNA, 25 bp, Mus musculus
gcagaagggttacgatgatgctgtt

SEQ ID NO: 936464 - DNA, 25 bp, Mus musculus
gcagaagggttaggatgatgctgtt

SEQ ID NO: 936465 - DNA, 25 bp, Mus musculus
gcagaagtccagaggctggttccca

SEQ ID NO: 936466 - DNA, 25 bp, Mus musculus
gcagaagtccagtggctggttccca

SEQ ID NO: 936467 - DNA, 25 bp, Mus musculus
gcagaagtctgccaccaacagcagg

SEQ ID NO: 936468 - DNA, 25 bp, Mus musculus
gcagaagtctgccagcaacagcagg

SEQ ID NO: 936469 - DNA, 25 bp, Mus musculus
gcagaagtggacttcatccctgctg

SEQ ID NO: 936470 - DNA, 25 bp, Mus musculus
gcagaagtggacttgatccctgctg

SEQ ID NO: 936471 - DNA, 25 bp, Mus musculus
gcagaataaaaggtcccacaggcac

SEQ ID NO: 936472 - DNA, 25 bp, Mus musculus
gcagaataaaaggtgccacaggcac

SEQ ID NO: 936473 - DNA, 25 bp, Mus musculus
gcagaatattctaacatgctcctgc

SEQ ID NO: 936474 - DNA, 25 bp, Mus musculus
gcagaatattctaagatgctcctgc

SEQ ID NO: 936475 - DNA, 25 bp, Mus musculus
gcagaatgaaaacattaaagcactt

SEQ ID NO: 936476 - DNA, 25 bp, Mus musculus
gcagaatgaaaagattaaagcactt

SEQ ID NO: 936477 - DNA, 25 bp, Mus musculus
gcagaatgctagagtacagtgatgt

SEQ ID NO: 936478 - DNA, 25 bp, Mus musculus
gcagaatgctagtgtacagtgatgt

SEQ ID NO: 936479 - DNA, 25 bp, Mus musculus
gcagaatgctatcaaaagccccagg

SEQ ID NO: 936480 - DNA, 25 bp, Mus musculus
gcagaatgctttcaaaagccccagg

SEQ ID NO: 936481 - DNA, 25 bp, Mus musculus
gcagacaacaaacacaatgggacat

SEQ ID NO: 936482 - DNA, 25 bp, Mus musculus
gcagacaacaaagacaatgggacat

SEQ ID NO: 936483 - DNA, 25 bp, Mus musculus
gcagacacagcgcagatgtaattct

SEQ ID NO: 936484 - DNA, 25 bp, Mus musculus
gcagacacagggcagatgtaattct

SEQ ID NO: 936485 - DNA, 25 bp, Mus musculus
gcagacagaccgcgcatcctccttc

SEQ ID NO: 936486 - DNA, 25 bp, Mus musculus
gcagacagaccgggcatcctccttc

SEQ ID NO: 936487 - DNA, 25 bp, Mus musculus
gcagacagagagctgcagaaatcct

SEQ ID NO: 936488 - DNA, 25 bp, Mus musculus
gcagacagagctggacagtcacatc

SEQ ID NO: 936489 - DNA, 25 bp, Mus musculus
gcagacagaggtggacagtcacatc

SEQ ID NO: 936490 - DNA, 25 bp, Mus musculus
gcagacagagtgctgcagaaatcct

SEQ ID NO: 936491 - DNA, 25 bp, Mus musculus
gcagacagcacccacgttgatgggg

SEQ ID NO: 936492 - DNA, 25 bp, Mus musculus
gcagacagcacccaggttgatgggg

SEQ ID NO: 936493 - DNA, 25 bp, Mus musculus
gcagacagcatcagcattgctgaaa

SEQ ID NO: 936494 - DNA, 25 bp, Mus musculus
gcagacagcatcaggattgctgaaa

SEQ ID NO: 936495 - DNA, 25 bp, Mus musculus
gcagacagtaaccaccttgctccgg

SEQ ID NO: 936496 - DNA, 25 bp, Mus musculus
gcagacagtaaccagcttgctccgg

SEQ ID NO: 936497 - DNA, 25 bp, Mus musculus
gcagacatagatatgaggacacact

SEQ ID NO: 936498 - DNA, 25 bp, Mus musculus
gcagacatagttatgaggacacact

SEQ ID NO: 936499 - DNA, 25 bp, Mus musculus
gcagacatgaagccctttgttgaaa

SEQ ID NO: 936500 - DNA, 25 bp, Mus musculus
gcagacatgaaggcctttgttgaaa

SEQ ID NO: 936501 - DNA, 25 bp, Mus musculus
gcagacattccgcactggtatcaga

SEQ ID NO: 936502 - DNA, 25 bp, Mus musculus
gcagacattccgcagtggtatcaga

SEQ ID NO: 936503 - DNA, 25 bp, Mus musculus
gcagacatttctggcgacacccaga

SEQ ID NO: 936504 - DNA, 25 bp, Mus musculus
gcagacatttctggggacacccaga

SEQ ID NO: 936505 - DNA, 25 bp, Mus musculus
gcagacattttaaataattttgaaa

SEQ ID NO: 936506 - DNA, 25 bp, Mus musculus
gcagacattttagcaggttttctga

SEQ ID NO: 936507 - DNA, 25 bp, Mus musculus
gcagacattttagcatataattttg

SEQ ID NO: 936508 - DNA, 25 bp, Mus musculus
gcagacattttagctggttttctga

SEQ ID NO: 936509 - DNA, 25 bp, Mus musculus
gcagacattttagcttataattttg

SEQ ID NO: 936510 - DNA, 25 bp, Mus musculus
gcagacattttatataattttgaaa

SEQ ID NO: 936511 - DNA, 25 bp, Mus musculus
gcagaccaagctggaattcccagag

SEQ ID NO: 936512 - DNA, 25 bp, Mus musculus
gcagaccaaggtggaattcccagag

SEQ ID NO: 936513 - DNA, 25 bp, Mus musculus
gcagaccacccacgctttaaagatc

SEQ ID NO: 936514 - DNA, 25 bp, Mus musculus
gcagaccacccaggctttaaagatc

SEQ ID NO: 936515 - DNA, 25 bp, Mus musculus
gcagaccacgactgcgtacaagaaa

SEQ ID NO: 936516 - DNA, 25 bp, Mus musculus
gcagaccacgactgggtacaagaaa

SEQ ID NO: 936517 - DNA, 25 bp, Mus musculus
gcagaccagcagacagtaaaacaga

SEQ ID NO: 936518 - DNA, 25 bp, Mus musculus
gcagaccagcagacattctcctgtc

SEQ ID NO: 936519 - DNA, 25 bp, Mus musculus
gcagaccagcagactgtaaaacaga

SEQ ID NO: 936520 - DNA, 25 bp, Mus musculus
gcagaccagcagactttctcctgtc

SEQ ID NO: 936521 - DNA, 25 bp, Mus musculus
gcagaccatcagacccctgttctca

SEQ ID NO: 936522 - DNA, 25 bp, Mus musculus
gcagaccatcagtcccctgttctca

SEQ ID NO: 936523 - DNA, 25 bp, Mus musculus
gcagaccatgggcccgaggaggaca

SEQ ID NO: 936524 - DNA, 25 bp, Mus musculus
gcagaccatggggccgaggaggaca

SEQ ID NO: 936525 - DNA, 25 bp, Mus musculus
gcagacccagctttcagttctccca

SEQ ID NO: 936526 - DNA, 25 bp, Mus musculus
gcagacccaggtttcagttctccca

SEQ ID NO: 936527 - DNA, 25 bp, Mus musculus
gcagaccgacacaacagcaagctga

SEQ ID NO: 936528 - DNA, 25 bp, Mus musculus
gcagaccgacacaagagcaagctga

SEQ ID NO: 936529 - DNA, 25 bp, Mus musculus
gcagacctcaccatcctcacaggtc

SEQ ID NO: 936530 - DNA, 25 bp, Mus musculus
gcagacctcacccacacactggatg

SEQ ID NO: 936531 - DNA, 25 bp, Mus musculus
gcagacctcaccgacacactggatg

SEQ ID NO: 936532 - DNA, 25 bp, Mus musculus
gcagacctcaccttcctcacaggtc

SEQ ID NO: 936533 - DNA, 25 bp, Mus musculus
gcagacctgagcaaaagtgaactca

SEQ ID NO: 936534 - DNA, 25 bp, Mus musculus
gcagacctgagcaatagtgaactca

SEQ ID NO: 936535 - DNA, 25 bp, Mus musculus
gcagacgcagcaatcgtgcattttg

SEQ ID NO: 936536 - DNA, 25 bp, Mus musculus
gcagacgcagcattcgtgcattttg

SEQ ID NO: 936537 - DNA, 25 bp, Mus musculus
gcagacggggagcgcagaagatgct

SEQ ID NO: 936538 - DNA, 25 bp, Mus musculus
gcagacggggagggcagaagatgct

SEQ ID NO: 936539 - DNA, 25 bp, Mus musculus
gcagacgtgcttcacactggtttac

SEQ ID NO: 936540 - DNA, 25 bp, Mus musculus
gcagacgtgcttcagactggtttac

SEQ ID NO: 936541 - DNA, 25 bp, Mus musculus
gcagactaacaacattcttgtattc

SEQ ID NO: 936542 - DNA, 25 bp, Mus musculus
gcagactaacaagattcttgtattc

SEQ ID NO: 936543 - DNA, 25 bp, Mus musculus
gcagactacagccgtcagcagagca

SEQ ID NO: 936544 - DNA, 25 bp, Mus musculus
gcagactacagcggtcagcagagca

SEQ ID NO: 936545 - DNA, 25 bp, Mus musculus
gcagacttagggcatggtggttgtt

SEQ ID NO: 936546 - DNA, 25 bp, Mus musculus
gcagacttaggggatggtggttgtt

SEQ ID NO: 936547 - DNA, 25 bp, Mus musculus
gcagagaaaagcaactgctgtcttc

SEQ ID NO: 936548 - DNA, 25 bp, Mus musculus
gcagagaaaagcaagtgctgtcttc

SEQ ID NO: 936549 - DNA, 25 bp, Mus musculus
gcagagaactaggagaatatgctct

SEQ ID NO: 936550 - DNA, 25 bp, Mus musculus
gcagagaacttggagaatatgctct

SEQ ID NO: 936551 - DNA, 25 bp, Mus musculus
gcagagaagacaagattgacataaa

SEQ ID NO: 936552 - DNA, 25 bp, Mus musculus
gcagagaagacatgattgacataaa

SEQ ID NO: 936553 - DNA, 25 bp, Mus musculus
gcagagaagcagcggtacctggatg

SEQ ID NO: 936554 - DNA, 25 bp, Mus musculus
gcagagaagcaggggtacctggatg

SEQ ID NO: 936555 - DNA, 25 bp, Mus musculus
gcagagaaggctcactgccatggag

SEQ ID NO: 936556 - DNA, 25 bp, Mus musculus
gcagagaaggctcactgctgtatgc

SEQ ID NO: 936557 - DNA, 25 bp, Mus musculus
gcagagaaggctcagtgccatggag

SEQ ID NO: 936558 - DNA, 25 bp, Mus musculus
gcagagaaggctcagtgctgtatgc

SEQ ID NO: 936559 - DNA, 25 bp, Mus musculus
gcagagaatgaacgccgcagagaag

SEQ ID NO: 936560 - DNA, 25 bp, Mus musculus
gcagagaatgaaggccgcagagaag

SEQ ID NO: 936561 - DNA, 25 bp, Mus musculus
gcagagacaaattgaacaagaaaaa

SEQ ID NO: 936562 - DNA, 25 bp, Mus musculus
gcagagacaatttgaacaagaaaaa

SEQ ID NO: 936563 - DNA, 25 bp, Mus musculus
gcagagacagatgcactgttgtgga

SEQ ID NO: 936564 - DNA, 25 bp, Mus musculus
gcagagacagccacggtggttctgg

SEQ ID NO: 936565 - DNA, 25 bp, Mus musculus
gcagagacaggcacggtggttctgg

SEQ ID NO: 936566 - DNA, 25 bp, Mus musculus
gcagagacagttgcactgttgtgga

SEQ ID NO: 936567 - DNA, 25 bp, Mus musculus
gcagagagagctctggaagcgctca

SEQ ID NO: 936568 - DNA, 25 bp, Mus musculus
gcagagagaggtctggaagcgctca

SEQ ID NO: 936569 - DNA, 25 bp, Mus musculus
gcagagagcagttacccgtgaatca

SEQ ID NO: 936570 - DNA, 25 bp, Mus musculus
gcagagagcagttagccgtgaatca

SEQ ID NO: 936571 - DNA, 25 bp, Mus musculus
gcagagagtaagaactgtgccaagt

SEQ ID NO: 936572 - DNA, 25 bp, Mus musculus
gcagagagtaagtactgtgccaagt

SEQ ID NO: 936573 - DNA, 25 bp, Mus musculus
gcagagatattacacattgctatgc

SEQ ID NO: 936574 - DNA, 25 bp, Mus musculus
gcagagatattacagattgctatgc

SEQ ID NO: 936575 - DNA, 25 bp, Mus musculus
gcagagatcatttcactttgtaaac

SEQ ID NO: 936576 - DNA, 25 bp, Mus musculus
gcagagatcatttctctttgtaaac

SEQ ID NO: 936577 - DNA, 25 bp, Mus musculus
gcagagatgatcaacgtcacaaaga

SEQ ID NO: 936578 - DNA, 25 bp, Mus musculus
gcagagatgatcaaggtcacaaaga

SEQ ID NO: 936579 - DNA, 25 bp, Mus musculus
gcagagattgttgtccattctgact

SEQ ID NO: 936580 - DNA, 25 bp, Mus musculus
gcagagattgttgtgcattctgact

SEQ ID NO: 936581 - DNA, 25 bp, Mus musculus
gcagagcaccggattgattttgtcg

SEQ ID NO: 936582 - DNA, 25 bp, Mus musculus
gcagagcaccggtttgattttgtcg

SEQ ID NO: 936583 - DNA, 25 bp, Mus musculus
gcagagcagatgcgatgagccggca

SEQ ID NO: 936584 - DNA, 25 bp, Mus musculus
gcagagcagatgggatgagccggca

SEQ ID NO: 936585 - DNA, 25 bp, Mus musculus
gcagagcagcagcaacctgtgtctc

SEQ ID NO: 936586 - DNA, 25 bp, Mus musculus
gcagagcagcaggaacctgtgtctc

SEQ ID NO: 936587 - DNA, 25 bp, Mus musculus
gcagagcaggagaagagaaggagga

SEQ ID NO: 936588 - DNA, 25 bp, Mus musculus
gcagagcaggcgcgactgtcctgtg

SEQ ID NO: 936589 - DNA, 25 bp, Mus musculus
gcagagcaggcgggactgtcctgtg

SEQ ID NO: 936590 - DNA, 25 bp, Mus musculus
gcagagcaggtgaagagaaggagga

SEQ ID NO: 936591 - DNA, 25 bp, Mus musculus
gcagagccagatcactatgttgtca

SEQ ID NO: 936592 - DNA, 25 bp, Mus musculus
gcagagccagtgagccctgcctagc

SEQ ID NO: 936593 - DNA, 25 bp, Mus musculus
gcagagccagtgtgccctgcctagc

SEQ ID NO: 936594 - DNA, 25 bp, Mus musculus
gcagagccagttcactatgttgtca

SEQ ID NO: 936595 - DNA, 25 bp, Mus musculus
gcagagccctactttcagggaggag

SEQ ID NO: 936596 - DNA, 25 bp, Mus musculus
gcagagccctccctttcgggaagac

SEQ ID NO: 936597 - DNA, 25 bp, Mus musculus
gcagagccctgcctttcgggaagac

SEQ ID NO: 936598 - DNA, 25 bp, Mus musculus
gcagagcccttctttcagggaggag

SEQ ID NO: 936599 - DNA, 25 bp, Mus musculus
gcagagcctcagaatctatcactga

SEQ ID NO: 936600 - DNA, 25 bp, Mus musculus
gcagagcctcagtatctatcactga

SEQ ID NO: 936601 - DNA, 25 bp, Mus musculus
gcagagcctgagatctggtggctct

SEQ ID NO: 936602 - DNA, 25 bp, Mus musculus
gcagagcctgagccccaggatgggt

SEQ ID NO: 936603 - DNA, 25 bp, Mus musculus
gcagagcctgaggcccaggatgggt

SEQ ID NO: 936604 - DNA, 25 bp, Mus musculus
gcagagcctgagttctggtggctct

SEQ ID NO: 936605 - DNA, 25 bp, Mus musculus
gcagagcgagggctccgtctcccag

SEQ ID NO: 936606 - DNA, 25 bp, Mus musculus
gcagagcgaggggtccgtctcccag

SEQ ID NO: 936607 - DNA, 25 bp, Mus musculus
gcagagcgggatgtcgatattctga

SEQ ID NO: 936608 - DNA, 25 bp, Mus musculus
gcagagcgggatgtggatattctga

SEQ ID NO: 936609 - DNA, 25 bp, Mus musculus
gcagagctaaagcgtttggatccag

SEQ ID NO: 936610 - DNA, 25 bp, Mus musculus
gcagagctaaagggtttggatccag

SEQ ID NO: 936611 - DNA, 25 bp, Mus musculus
gcagagctaacacgacgaagaggag

SEQ ID NO: 936612 - DNA, 25 bp, Mus musculus
gcagagctaacaggacgaagaggag

SEQ ID NO: 936613 - DNA, 25 bp, Mus musculus
gcagagctagagctcacctggagga

SEQ ID NO: 936614 - DNA, 25 bp, Mus musculus
gcagagctagaggtcacctggagga

SEQ ID NO: 936615 - DNA, 25 bp, Mus musculus
gcagagctgtgacgccttgagagtg

SEQ ID NO: 936616 - DNA, 25 bp, Mus musculus
gcagagctgtgaggccttgagagtg

SEQ ID NO: 936617 - DNA, 25 bp, Mus musculus
gcagaggaagctccgggcagcagag

SEQ ID NO: 936618 - DNA, 25 bp, Mus musculus
gcagaggaaggtccgggcagcagag

SEQ ID NO: 936619 - DNA, 25 bp, Mus musculus
gcagaggagatcaactttgaacagc

SEQ ID NO: 936620 - DNA, 25 bp, Mus musculus
gcagaggagatcaagtttgaacagc

SEQ ID NO: 936621 - DNA, 25 bp, Mus musculus
gcagaggaggagctcacgctcacgc

SEQ ID NO: 936622 - DNA, 25 bp, Mus musculus
gcagaggaggaggtcacgctcacgc

SEQ ID NO: 936623 - DNA, 25 bp, Mus musculus
gcagaggataagaactctcagaagg

SEQ ID NO: 936624 - DNA, 25 bp, Mus musculus
gcagaggataagtactctcagaagg

SEQ ID NO: 936625 - DNA, 25 bp, Mus musculus
gcagaggcacagattcggtcatttt

SEQ ID NO: 936626 - DNA, 25 bp, Mus musculus
gcagaggcacagtttcggtcatttt

SEQ ID NO: 936627 - DNA, 25 bp, Mus musculus
gcagaggcagataaaggagagtgct

SEQ ID NO: 936628 - DNA, 25 bp, Mus musculus
gcagaggcagccgtgcccacacttt

SEQ ID NO: 936629 - DNA, 25 bp, Mus musculus
gcagaggcaggcgtgcccacacttt

SEQ ID NO: 936630 - DNA, 25 bp, Mus musculus
gcagaggcagttaaaggagagtgct

SEQ ID NO: 936631 - DNA, 25 bp, Mus musculus
gcagaggctgcactatgagagtaag

SEQ ID NO: 936632 - DNA, 25 bp, Mus musculus
gcagaggctgcggacagtacttatt

SEQ ID NO: 936633 - DNA, 25 bp, Mus musculus
gcagaggctggactatgagagtaag

SEQ ID NO: 936634 - DNA, 25 bp, Mus musculus
gcagaggctggggacagtacttatt

SEQ ID NO: 936635 - DNA, 25 bp, Mus musculus
gcagaggcttgacctgaaggagcat

SEQ ID NO: 936636 - DNA, 25 bp, Mus musculus
gcagaggcttgagctgaaggagcat

SEQ ID NO: 936637 - DNA, 25 bp, Mus musculus
gcagagtacgagatcctacctggct

SEQ ID NO: 936638 - DNA, 25 bp, Mus musculus
gcagagtacgagcagttcctacctg

SEQ ID NO: 936639 - DNA, 25 bp, Mus musculus
gcagagtacgaggagttcctacctg

SEQ ID NO: 936640 - DNA, 25 bp, Mus musculus
gcagagtacgagttcctacctggct

SEQ ID NO: 936641 - DNA, 25 bp, Mus musculus
gcagagtgagcacccccacagtgaa

SEQ ID NO: 936642 - DNA, 25 bp, Mus musculus
gcagagtgagcagccccacagtgaa

SEQ ID NO: 936643 - DNA, 25 bp, Mus musculus
gcagagtggaagagtgatcaggtgt

SEQ ID NO: 936644 - DNA, 25 bp, Mus musculus
gcagagtggaagtgtgatcaggtgt

SEQ ID NO: 936645 - DNA, 25 bp, Mus musculus
gcagagtgggacatcgggggcttac

SEQ ID NO: 936646 - DNA, 25 bp, Mus musculus
gcagagtgggacatggggggcttac

SEQ ID NO: 936647 - DNA, 25 bp, Mus musculus
gcagagtgtacaccgaccctagggt

SEQ ID NO: 936648 - DNA, 25 bp, Mus musculus
gcagagtgtacagcgaccctagggt

SEQ ID NO: 936649 - DNA, 25 bp, Mus musculus
gcagagtgtgcgccagtgcccgtcc

SEQ ID NO: 936650 - DNA, 25 bp, Mus musculus
gcagagtgtgcgcctgtgcccgtcc

SEQ ID NO: 936651 - DNA, 25 bp, Mus musculus
gcagagtgtgtgcacgctatttcag

SEQ ID NO: 936652 - DNA, 25 bp, Mus musculus
gcagagtgtgtgcaggctatttcag

SEQ ID NO: 936653 - DNA, 25 bp, Mus musculus
gcagagttaaagaacatttctggat

SEQ ID NO: 936654 - DNA, 25 bp, Mus musculus
gcagagttaaagtacatttctggat

SEQ ID NO: 936655 - DNA, 25 bp, Mus musculus
gcagagttaattcacctagaagacg

SEQ ID NO: 936656 - DNA, 25 bp, Mus musculus
gcagagttaattcagctagaagacg

SEQ ID NO: 936657 - DNA, 25 bp, Mus musculus
gcagagttcaagagtaaactggagc

SEQ ID NO: 936658 - DNA, 25 bp, Mus musculus
gcagagttcaagcccagcctgtccc

SEQ ID NO: 936659 - DNA, 25 bp, Mus musculus
gcagagttcaaggccagcctgtccc

SEQ ID NO: 936660 - DNA, 25 bp, Mus musculus
gcagagttcaagtgtaaactggagc

SEQ ID NO: 936661 - DNA, 25 bp, Mus musculus
gcagagttctctctaaacctttgac

SEQ ID NO: 936662 - DNA, 25 bp, Mus musculus
gcagagttctctcttaacctttgac

SEQ ID NO: 936663 - DNA, 25 bp, Mus musculus
gcagataaagataatggaggtgact

SEQ ID NO: 936664 - DNA, 25 bp, Mus musculus
gcagataaagttaatggaggtgact

SEQ ID NO: 936665 - DNA, 25 bp, Mus musculus
gcagatactcataactatggctatg

SEQ ID NO: 936666 - DNA, 25 bp, Mus musculus
gcagatactcataagtatggctatg

SEQ ID NO: 936667 - DNA, 25 bp, Mus musculus
gcagatagagacacaggtggccagt

SEQ ID NO: 936668 - DNA, 25 bp, Mus musculus
gcagatagagactcaggtggccagt

SEQ ID NO: 936669 - DNA, 25 bp, Mus musculus
gcagatattacaaagtgaaaaagac

SEQ ID NO: 936670 - DNA, 25 bp, Mus musculus
gcagatattagaaagtgaaaaagac

SEQ ID NO: 936671 - DNA, 25 bp, Mus musculus
gcagatcaagatttccatggagaat

SEQ ID NO: 936672 - DNA, 25 bp, Mus musculus
gcagatcaagttttccatggagaat

SEQ ID NO: 936673 - DNA, 25 bp, Mus musculus
gcagatcaatcaaattggagatctg

SEQ ID NO: 936674 - DNA, 25 bp, Mus musculus
gcagatcaatgaaattggagatctg

SEQ ID NO: 936675 - DNA, 25 bp, Mus musculus
gcagatcacgctacggttctccagg

SEQ ID NO: 936676 - DNA, 25 bp, Mus musculus
gcagatcacggtacggttctccagg

SEQ ID NO: 936677 - DNA, 25 bp, Mus musculus
gcagatcagaaacgattacaccagc

SEQ ID NO: 936678 - DNA, 25 bp, Mus musculus
gcagatcagaaaggattacaccagc

SEQ ID NO: 936679 - DNA, 25 bp, Mus musculus
gcagatccagaaagtccaggtggtc

SEQ ID NO: 936680 - DNA, 25 bp, Mus musculus
gcagatccagcaggttaacatgcct

SEQ ID NO: 936681 - DNA, 25 bp, Mus musculus
gcagatccagcttaacatgccttac

SEQ ID NO: 936682 - DNA, 25 bp, Mus musculus
gcagatccaggacctggtggaagcc

SEQ ID NO: 936683 - DNA, 25 bp, Mus musculus
gcagatccaggacgacttcttcctg

SEQ ID NO: 936684 - DNA, 25 bp, Mus musculus
gcagatccaggagctggtggaagcc

SEQ ID NO: 936685 - DNA, 25 bp, Mus musculus
gcagatccaggaggacttcttcctg

SEQ ID NO: 936686 - DNA, 25 bp, Mus musculus
gcagatccaggaggttaacatgcct

SEQ ID NO: 936687 - DNA, 25 bp, Mus musculus
gcagatccaggttaacatgccttac

SEQ ID NO: 936688 - DNA, 25 bp, Mus musculus
gcagatccagtaagtccaggtggtc

SEQ ID NO: 936689 - DNA, 25 bp, Mus musculus
gcagatcccgatggctatgagttct

SEQ ID NO: 936690 - DNA, 25 bp, Mus musculus
gcagatcccgttggctatgagttct

SEQ ID NO: 936691 - DNA, 25 bp, Mus musculus
gcagatccgactccagtgcggactg

SEQ ID NO: 936692 - DNA, 25 bp, Mus musculus
gcagatccgactcctgtgcggactg

SEQ ID NO: 936693 - DNA, 25 bp, Mus musculus
gcagatcctctgatggagccagaga

SEQ ID NO: 936694 - DNA, 25 bp, Mus musculus
gcagatcctctgttggagccagaga

SEQ ID NO: 936695 - DNA, 25 bp, Mus musculus
gcagatctcagacatttcattgttt

SEQ ID NO: 936696 - DNA, 25 bp, Mus musculus
gcagatctcagagatttcattgttt

SEQ ID NO: 936697 - DNA, 25 bp, Mus musculus
gcagatctctcacgggagacccagc

SEQ ID NO: 936698 - DNA, 25 bp, Mus musculus
gcagatctctcacgggatcatgagg

SEQ ID NO: 936699 - DNA, 25 bp, Mus musculus
gcagatctctcaggggagacccagc

SEQ ID NO: 936700 - DNA, 25 bp, Mus musculus
gcagatctctcaggggatcatgagg

SEQ ID NO: 936701 - DNA, 25 bp, Mus musculus
gcagatgaagatgtaccgaggcttc

SEQ ID NO: 936702 - DNA, 25 bp, Mus musculus
gcagatgaagcgaacttgcaacaga

SEQ ID NO: 936703 - DNA, 25 bp, Mus musculus
gcagatgaagcgaagttgcaacaga

SEQ ID NO: 936704 - DNA, 25 bp, Mus musculus
gcagatgaagttgtaccgaggcttc

SEQ ID NO: 936705 - DNA, 25 bp, Mus musculus
gcagatgagtgggacatccacttca

SEQ ID NO: 936706 - DNA, 25 bp, Mus musculus
gcagatgagtgggagatccacttca

SEQ ID NO: 936707 - DNA, 25 bp, Mus musculus
gcagatgcgcagctcttgatttgga

SEQ ID NO: 936708 - DNA, 25 bp, Mus musculus
gcagatgcgcaggtcttgatttgga

SEQ ID NO: 936709 - DNA, 25 bp, Mus musculus
gcagatgctaaataagttctagaag

SEQ ID NO: 936710 - DNA, 25 bp, Mus musculus
gcagatgctaaatatgttctagaag

SEQ ID NO: 936711 - DNA, 25 bp, Mus musculus
gcagatgctcggcctgtcatttcgc

SEQ ID NO: 936712 - DNA, 25 bp, Mus musculus
gcagatgctcgggctgtcatttcgc

SEQ ID NO: 936713 - DNA, 25 bp, Mus musculus
gcagatgctgacatggacttggccg

SEQ ID NO: 936714 - DNA, 25 bp, Mus musculus
gcagatgctgacttggacttggccg

SEQ ID NO: 936715 - DNA, 25 bp, Mus musculus
gcagatggaattataagtactatta

SEQ ID NO: 936716 - DNA, 25 bp, Mus musculus
gcagatggaattattagtactatta

SEQ ID NO: 936717 - DNA, 25 bp, Mus musculus
gcagatggctgacgaaatggtagaa

SEQ ID NO: 936718 - DNA, 25 bp, Mus musculus
gcagatggctgaggaaatggtagaa

SEQ ID NO: 936719 - DNA, 25 bp, Mus musculus
gcagatgggctgcgccttggccgat

SEQ ID NO: 936720 - DNA, 25 bp, Mus musculus
gcagatgggctgggccttggccgat

SEQ ID NO: 936721 - DNA, 25 bp, Mus musculus
gcagatggtacaccagccttcaagg

SEQ ID NO: 936722 - DNA, 25 bp, Mus musculus
gcagatggtacagcagccttcaagg

SEQ ID NO: 936723 - DNA, 25 bp, Mus musculus
gcagatggtctgctgtagccgtcct

SEQ ID NO: 936724 - DNA, 25 bp, Mus musculus
gcagatggtctggtgtagccgtcct

SEQ ID NO: 936725 - DNA, 25 bp, Mus musculus
gcagatgtagatcatcctatctaag

SEQ ID NO: 936726 - DNA, 25 bp, Mus musculus
gcagatgtagttcatcctatctaag

SEQ ID NO: 936727 - DNA, 25 bp, Mus musculus
gcagatgtatggcgcgcgcgggaag

SEQ ID NO: 936728 - DNA, 25 bp, Mus musculus
gcagatgtatggcgggcgcgggaag

SEQ ID NO: 936729 - DNA, 25 bp, Mus musculus
gcagatgtggcagtgtttggatgcc

SEQ ID NO: 936730 - DNA, 25 bp, Mus musculus
gcagatgtgggagtgtttggatgcc

SEQ ID NO: 936731 - DNA, 25 bp, Mus musculus
gcagatgttgtttccctcttcatta

SEQ ID NO: 936732 - DNA, 25 bp, Mus musculus
gcagatgttgtttcgctcttcatta

SEQ ID NO: 936733 - DNA, 25 bp, Mus musculus
gcagattagcagacatgaatgctac

SEQ ID NO: 936734 - DNA, 25 bp, Mus musculus
gcagattagcagtcatgaatgctac

SEQ ID NO: 936735 - DNA, 25 bp, Mus musculus
gcagattcagcacagagctgatgag

SEQ ID NO: 936736 - DNA, 25 bp, Mus musculus
gcagattcagctgattctcgggccc

SEQ ID NO: 936737 - DNA, 25 bp, Mus musculus
gcagattcaggacagagctgatgag

SEQ ID NO: 936738 - DNA, 25 bp, Mus musculus
gcagattcaggtgattctcgggccc

SEQ ID NO: 936739 - DNA, 25 bp, Mus musculus
gcagatttaaagaacccaatatggc

SEQ ID NO: 936740 - DNA, 25 bp, Mus musculus
gcagatttaatgaacccaatatggc

SEQ ID NO: 936741 - DNA, 25 bp, Mus musculus
gcagatttcgctctggcaagagcaa

SEQ ID NO: 936742 - DNA, 25 bp, Mus musculus
gcagatttcggtctggcaagagcaa

SEQ ID NO: 936743 - DNA, 25 bp, Mus musculus
gcagatttggcacacagcaggccag

SEQ ID NO: 936744 - DNA, 25 bp, Mus musculus
gcagatttgggacacagcaggccag

SEQ ID NO: 936745 - DNA, 25 bp, Mus musculus
gcagcaacaaagcctgtactttgga

SEQ ID NO: 936746 - DNA, 25 bp, Mus musculus
gcagcaacaaaggctgtactttgga

SEQ ID NO: 936747 - DNA, 25 bp, Mus musculus
gcagcaacagcagcagctcctgaag

SEQ ID NO: 936748 - DNA, 25 bp, Mus musculus
gcagcaacaggagcagctcctgaag

SEQ ID NO: 936749 - DNA, 25 bp, Mus musculus
gcagcaacagttcgcatccagcatt

SEQ ID NO: 936750 - DNA, 25 bp, Mus musculus
gcagcaacagttcggttctccccag

SEQ ID NO: 936751 - DNA, 25 bp, Mus musculus
gcagcaacagttcgtcccatgcatc

SEQ ID NO: 936752 - DNA, 25 bp, Mus musculus
gcagcaacagttggcatccagcatt

SEQ ID NO: 936753 - DNA, 25 bp, Mus musculus
gcagcaacagttgggttctccccag

SEQ ID NO: 936754 - DNA, 25 bp, Mus musculus
gcagcaacagttggtcccatgcatc

SEQ ID NO: 936755 - DNA, 25 bp, Mus musculus
gcagcaaccaagcagacagtgatgg

SEQ ID NO: 936756 - DNA, 25 bp, Mus musculus
gcagcaaccaagctgtgattggact

SEQ ID NO: 936757 - DNA, 25 bp, Mus musculus
gcagcaaccaaggagacagtgatgg

SEQ ID NO: 936758 - DNA, 25 bp, Mus musculus
gcagcaaccaaggtgtgattggact

SEQ ID NO: 936759 - DNA, 25 bp, Mus musculus
gcagcaaccagaagcaattgagaag

SEQ ID NO: 936760 - DNA, 25 bp, Mus musculus
gcagcaaccagaaggaattgagaag

SEQ ID NO: 936761 - DNA, 25 bp, Mus musculus
gcagcaaccatgcgtgagtgcatct

SEQ ID NO: 936762 - DNA, 25 bp, Mus musculus
gcagcaaccatgggtgagtgcatct

SEQ ID NO: 936763 - DNA, 25 bp, Mus musculus
gcagcaacggtgcgccagcgtgctt

SEQ ID NO: 936764 - DNA, 25 bp, Mus musculus
gcagcaacggtgcggcagcgtgctt

SEQ ID NO: 936765 - DNA, 25 bp, Mus musculus
gcagcaagaaagcgaagctgcccat

SEQ ID NO: 936766 - DNA, 25 bp, Mus musculus
gcagcaagaaagctacccctgcagt

SEQ ID NO: 936767 - DNA, 25 bp, Mus musculus
gcagcaagaaagggaagctgcccat

SEQ ID NO: 936768 - DNA, 25 bp, Mus musculus
gcagcaagaaaggtacccctgcagt

SEQ ID NO: 936769 - DNA, 25 bp, Mus musculus
gcagcaagaacaccatcagtgagat

SEQ ID NO: 936770 - DNA, 25 bp, Mus musculus
gcagcaagaacaccttcagtgagat

SEQ ID NO: 936771 - DNA, 25 bp, Mus musculus
gcagcaagagaacaaactcacagag

SEQ ID NO: 936772 - DNA, 25 bp, Mus musculus
gcagcaagagatccactgttgtggc

SEQ ID NO: 936773 - DNA, 25 bp, Mus musculus
gcagcaagagcacgtggtgaatttt

SEQ ID NO: 936774 - DNA, 25 bp, Mus musculus
gcagcaagagcaggtggtgaatttt

SEQ ID NO: 936775 - DNA, 25 bp, Mus musculus
gcagcaagagtacaaactcacagag

SEQ ID NO: 936776 - DNA, 25 bp, Mus musculus
gcagcaagagttccactgttgtggc

SEQ ID NO: 936777 - DNA, 25 bp, Mus musculus
gcagcaagatcaaacatgatagaac

SEQ ID NO: 936778 - DNA, 25 bp, Mus musculus
gcagcaagatcaaagatgatagaac

SEQ ID NO: 936779 - DNA, 25 bp, Mus musculus
gcagcaaggcctcaagttgggatat

SEQ ID NO: 936780 - DNA, 25 bp, Mus musculus
gcagcaaggcctgaagttgggatat

SEQ ID NO: 936781 - DNA, 25 bp, Mus musculus
gcagcacaagcgagggaagctaaca

SEQ ID NO: 936782 - DNA, 25 bp, Mus musculus
gcagcacaagcgtgggaagctaaca

SEQ ID NO: 936783 - DNA, 25 bp, Mus musculus
gcagcacaagctccagcagcagcag

SEQ ID NO: 936784 - DNA, 25 bp, Mus musculus
gcagcacaagctgcagcagcagcag

SEQ ID NO: 936785 - DNA, 25 bp, Mus musculus
gcagcaccagatttcaatgggagaa

SEQ ID NO: 936786 - DNA, 25 bp, Mus musculus
gcagcaccagcgcctgtccaccaga

SEQ ID NO: 936787 - DNA, 25 bp, Mus musculus
gcagcaccagggcctgtccaccaga

SEQ ID NO: 936788 - DNA, 25 bp, Mus musculus
gcagcaccagttttcaatgggagaa

SEQ ID NO: 936789 - DNA, 25 bp, Mus musculus
gcagcaccggcctaaagaagcccag

SEQ ID NO: 936790 - DNA, 25 bp, Mus musculus
gcagcaccgggctaaagaagcccag

SEQ ID NO: 936791 - DNA, 25 bp, Mus musculus
gcagcacgagaacaccgactactgt

SEQ ID NO: 936792 - DNA, 25 bp, Mus musculus
gcagcacgagaacagcgactactgt

SEQ ID NO: 936793 - DNA, 25 bp, Mus musculus
gcagcacgccatcaatgatgatgtt

SEQ ID NO: 936794 - DNA, 25 bp, Mus musculus
gcagcacgccctatgtgcaggagtt

SEQ ID NO: 936795 - DNA, 25 bp, Mus musculus
gcagcacgccgtatgtgcaggagtt

SEQ ID NO: 936796 - DNA, 25 bp, Mus musculus
gcagcacgccttcaatgatgatgtt

SEQ ID NO: 936797 - DNA, 25 bp, Mus musculus
gcagcactgtttcagctggctttat

SEQ ID NO: 936798 - DNA, 25 bp, Mus musculus
gcagcactgtttgagctggctttat

SEQ ID NO: 936799 - DNA, 25 bp, Mus musculus
gcagcacttcagagctgtcttcctg

SEQ ID NO: 936800 - DNA, 25 bp, Mus musculus
gcagcacttcagtgctgtcttcctg

SEQ ID NO: 936801 - DNA, 25 bp, Mus musculus
gcagcagaaaagaaatatggaaggt

SEQ ID NO: 936802 - DNA, 25 bp, Mus musculus
gcagcagaaaagtaatatggaaggt

SEQ ID NO: 936803 - DNA, 25 bp, Mus musculus
gcagcagaaaccctaaaagccttga

SEQ ID NO: 936804 - DNA, 25 bp, Mus musculus
gcagcagaaaccgtaaaagccttga

SEQ ID NO: 936805 - DNA, 25 bp, Mus musculus
gcagcagaaattcacaacagacatc

SEQ ID NO: 936806 - DNA, 25 bp, Mus musculus
gcagcagaaattgacaacagacatc

SEQ ID NO: 936807 - DNA, 25 bp, Mus musculus
gcagcagaagaaaaatcagatgtcc

SEQ ID NO: 936808 - DNA, 25 bp, Mus musculus
gcagcagaagaaaattcagatgtcc

SEQ ID NO: 936809 - DNA, 25 bp, Mus musculus
gcagcagaagatcctgtgcagcaaa

SEQ ID NO: 936810 - DNA, 25 bp, Mus musculus
gcagcagaagattctctgtggcaag

SEQ ID NO: 936811 - DNA, 25 bp, Mus musculus
gcagcagaagttcctgtgcagcaaa

SEQ ID NO: 936812 - DNA, 25 bp, Mus musculus
gcagcagaagtttctctgtggcaag

SEQ ID NO: 936813 - DNA, 25 bp, Mus musculus
gcagcagacctgcaaagcaaagcca

SEQ ID NO: 936814 - DNA, 25 bp, Mus musculus
gcagcagacctggaaagcaaagcca

SEQ ID NO: 936815 - DNA, 25 bp, Mus musculus
gcagcagactcgactcaaggagctg

SEQ ID NO: 936816 - DNA, 25 bp, Mus musculus
gcagcagactcgtctcaaggagctg

SEQ ID NO: 936817 - DNA, 25 bp, Mus musculus
gcagcagagaagaaagcccgctggg

SEQ ID NO: 936818 - DNA, 25 bp, Mus musculus
gcagcagagaagcgcggtgctggtg

SEQ ID NO: 936819 - DNA, 25 bp, Mus musculus
gcagcagagaagggcggtgctggtg

SEQ ID NO: 936820 - DNA, 25 bp, Mus musculus
gcagcagagaagtaagcccgctggg

SEQ ID NO: 936821 - DNA, 25 bp, Mus musculus
gcagcagaggcccccaactcctgaa

SEQ ID NO: 936822 - DNA, 25 bp, Mus musculus
gcagcagaggctcgactatgagagt

SEQ ID NO: 936823 - DNA, 25 bp, Mus musculus
gcagcagaggctggactatgagagt

SEQ ID NO: 936824 - DNA, 25 bp, Mus musculus
gcagcagagggccccaactcctgaa

SEQ ID NO: 936825 - DNA, 25 bp, Mus musculus
gcagcagatccaccaggttaacatg

SEQ ID NO: 936826 - DNA, 25 bp, Mus musculus
gcagcagatccacgttaacatgcct

SEQ ID NO: 936827 - DNA, 25 bp, Mus musculus
gcagcagatccagcaggttaacatg

SEQ ID NO: 936828 - DNA, 25 bp, Mus musculus
gcagcagatccaggttaacatgcct

SEQ ID NO: 936829 - DNA, 25 bp, Mus musculus
gcagcagcaccacatttcaatggga

SEQ ID NO: 936830 - DNA, 25 bp, Mus musculus
gcagcagcaccacggcctgtccacc

SEQ ID NO: 936831 - DNA, 25 bp, Mus musculus
gcagcagcaccagatttcaatggga

SEQ ID NO: 936832 - DNA, 25 bp, Mus musculus
gcagcagcaccagggcctgtccacc

SEQ ID NO: 936833 - DNA, 25 bp, Mus musculus
gcagcagcagccggcaggaacccac

SEQ ID NO: 936834 - DNA, 25 bp, Mus musculus
gcagcagcagccgggaggaacccac

SEQ ID NO: 936835 - DNA, 25 bp, Mus musculus
gcagcagcagcggtaccatcccaga

SEQ ID NO: 936836 - DNA, 25 bp, Mus musculus
gcagcagcaggggtaccatcccaga

SEQ ID NO: 936837 - DNA, 25 bp, Mus musculus
gcagcagcagttagagggcgtgcgc

SEQ ID NO: 936838 - DNA, 25 bp, Mus musculus
gcagcagcagtttgagggcgtgcgc

SEQ ID NO: 936839 - DNA, 25 bp, Mus musculus
gcagcagccaagcacacttagcctg

SEQ ID NO: 936840 - DNA, 25 bp, Mus musculus
gcagcagccaaggacacttagcctg

SEQ ID NO: 936841 - DNA, 25 bp, Mus musculus
gcagcagcccatacaatcctcctga

SEQ ID NO: 936842 - DNA, 25 bp, Mus musculus
gcagcagcccattcaatcctcctga

SEQ ID NO: 936843 - DNA, 25 bp, Mus musculus
gcagcagccctgctgtctgagagca

SEQ ID NO: 936844 - DNA, 25 bp, Mus musculus
gcagcagccctggtgtctgagagca

SEQ ID NO: 936845 - DNA, 25 bp, Mus musculus
gcagcagccgggaggaacccacttt

SEQ ID NO: 936846 - DNA, 25 bp, Mus musculus
gcagcagccgggtggaacccacttt

SEQ ID NO: 936847 - DNA, 25 bp, Mus musculus
gcagcagcgcaacaccttcacagcc

SEQ ID NO: 936848 - DNA, 25 bp, Mus musculus
gcagcagcgcaagaccttcacagcc

SEQ ID NO: 936849 - DNA, 25 bp, Mus musculus
gcagcagcgcagcctcaggctggct

SEQ ID NO: 936850 - DNA, 25 bp, Mus musculus
gcagcagcgcaggctcaggctggct

SEQ ID NO: 936851 - DNA, 25 bp, Mus musculus
gcagcaggagcacatcgccaagcag

SEQ ID NO: 936852 - DNA, 25 bp, Mus musculus
gcagcaggagcagatcgccaagcag

SEQ ID NO: 936853 - DNA, 25 bp, Mus musculus
gcagcaggccgccctagaaaatgct

SEQ ID NO: 936854 - DNA, 25 bp, Mus musculus
gcagcaggccgcgctagaaaatgct

SEQ ID NO: 936855 - DNA, 25 bp, Mus musculus
gcagcaggcgccgacggcgtccctg

SEQ ID NO: 936856 - DNA, 25 bp, Mus musculus
gcagcaggcgccgagggcgtccctg

SEQ ID NO: 936857 - DNA, 25 bp, Mus musculus
gcagcagggaagacaggctttgcca

SEQ ID NO: 936858 - DNA, 25 bp, Mus musculus
gcagcagggaagcctttgccaccac

SEQ ID NO: 936859 - DNA, 25 bp, Mus musculus
gcagcagggaaggctttgccaccac

SEQ ID NO: 936860 - DNA, 25 bp, Mus musculus
gcagcagggaagtcaggctttgcca

SEQ ID NO: 936861 - DNA, 25 bp, Mus musculus
gcagcaggttcagccattccatttg

SEQ ID NO: 936862 - DNA, 25 bp, Mus musculus
gcagcaggttcagcgattccatttg

SEQ ID NO: 936863 - DNA, 25 bp, Mus musculus
gcagcagtaccgcaagctgctcagg

SEQ ID NO: 936864 - DNA, 25 bp, Mus musculus
gcagcagtaccggaagctgctcagg

SEQ ID NO: 936865 - DNA, 25 bp, Mus musculus
gcagcagtgaccaaactctgcgctg

SEQ ID NO: 936866 - DNA, 25 bp, Mus musculus
gcagcagtgaccaatctctgcgctg

SEQ ID NO: 936867 - DNA, 25 bp, Mus musculus
gcagcagtgtgacacccctcacgta

SEQ ID NO: 936868 - DNA, 25 bp, Mus musculus
gcagcagtgtgacagccctcacgta

SEQ ID NO: 936869 - DNA, 25 bp, Mus musculus
gcagcagttgcacgaatctcagcaa

SEQ ID NO: 936870 - DNA, 25 bp, Mus musculus
gcagcagttgcaggaatctcagcaa

SEQ ID NO: 936871 - DNA, 25 bp, Mus musculus
gcagcagtttcagggcgtgcgcatg

SEQ ID NO: 936872 - DNA, 25 bp, Mus musculus
gcagcagtttgagggcgtgcgcatg

SEQ ID NO: 936873 - DNA, 25 bp, Mus musculus
gcagcagtttgtcgagggcgtgcgc

SEQ ID NO: 936874 - DNA, 25 bp, Mus musculus
gcagcagtttgtggagggcgtgcgc

SEQ ID NO: 936875 - DNA, 25 bp, Mus musculus
gcagcataagcatgagattgactct

SEQ ID NO: 936876 - DNA, 25 bp, Mus musculus
gcagcataaggatgagattgactct

SEQ ID NO: 936877 - DNA, 25 bp, Mus musculus
gcagcatcctcgtgccgtgttaact

SEQ ID NO: 936878 - DNA, 25 bp, Mus musculus
gcagcatcctggtgccgtgttaact

SEQ ID NO: 936879 - DNA, 25 bp, Mus musculus
gcagcatctgagcaacaagcaatgg

SEQ ID NO: 936880 - DNA, 25 bp, Mus musculus
gcagcatctgagcaagactcttcaa

SEQ ID NO: 936881 - DNA, 25 bp, Mus musculus
gcagcatctgaggaacaagcaatgg

SEQ ID NO: 936882 - DNA, 25 bp, Mus musculus
gcagcatctgaggaagactcttcaa

SEQ ID NO: 936883 - DNA, 25 bp, Mus musculus
gcagcattcctgaacatgcgaccat

SEQ ID NO: 936884 - DNA, 25 bp, Mus musculus
gcagcattcctgaagatgcgaccat

SEQ ID NO: 936885 - DNA, 25 bp, Mus musculus
gcagcattgtcactttcttagcaag

SEQ ID NO: 936886 - DNA, 25 bp, Mus musculus
gcagcattgtcagtttcttagcaag

SEQ ID NO: 936887 - DNA, 25 bp, Mus musculus
gcagcatttgcccacaggagggcat

SEQ ID NO: 936888 - DNA, 25 bp, Mus musculus
gcagcatttgcccagaggagggcat

SEQ ID NO: 936889 - DNA, 25 bp, Mus musculus
gcagccaacacaaacggcatttgct

SEQ ID NO: 936890 - DNA, 25 bp, Mus musculus
gcagccaacacaaagggcatttgct

SEQ ID NO: 936891 - DNA, 25 bp, Mus musculus
gcagccaacagacgcagtaagccca

SEQ ID NO: 936892 - DNA, 25 bp, Mus musculus
gcagccaacagactaagcccagagt

SEQ ID NO: 936893 - DNA, 25 bp, Mus musculus
gcagccaacagaggcagtaagccca

SEQ ID NO: 936894 - DNA, 25 bp, Mus musculus
gcagccaacagagtaagcccagagt

SEQ ID NO: 936895 - DNA, 25 bp, Mus musculus
gcagccaacatccttcgagctggtg

SEQ ID NO: 936896 - DNA, 25 bp, Mus musculus
gcagccaacatcgttcgagctggtg

SEQ ID NO: 936897 - DNA, 25 bp, Mus musculus
gcagccaacgtctgatttccagtcc

SEQ ID NO: 936898 - DNA, 25 bp, Mus musculus
gcagccaacgtctgttttccagtcc

SEQ ID NO: 936899 - DNA, 25 bp, Mus musculus
gcagccaagaaactgggcacagaag

SEQ ID NO: 936900 - DNA, 25 bp, Mus musculus
gcagccaagaaagtgggcacagaag

SEQ ID NO: 936901 - DNA, 25 bp, Mus musculus
gcagccaagcagcacaacatgccct

SEQ ID NO: 936902 - DNA, 25 bp, Mus musculus
gcagccaagcaggacaacatgccct

SEQ ID NO: 936903 - DNA, 25 bp, Mus musculus
gcagccaaggacacttagcctgtga

SEQ ID NO: 936904 - DNA, 25 bp, Mus musculus
gcagccaaggtcacttagcctgtga

SEQ ID NO: 936905 - DNA, 25 bp, Mus musculus
gcagccaatgagccaggggattctt

SEQ ID NO: 936906 - DNA, 25 bp, Mus musculus
gcagccaatgagcgggattcttctc

SEQ ID NO: 936907 - DNA, 25 bp, Mus musculus
gcagccaatgaggcaggggattctt

SEQ ID NO: 936908 - DNA, 25 bp, Mus musculus
gcagccaatgagggggattcttctc

SEQ ID NO: 936909 - DNA, 25 bp, Mus musculus
gcagccagagagggaaactgaggct

SEQ ID NO: 936910 - DNA, 25 bp, Mus musculus
gcagccagagcttgtccaggtgact

SEQ ID NO: 936911 - DNA, 25 bp, Mus musculus
gcagccagaggttgtccaggtgact

SEQ ID NO: 936912 - DNA, 25 bp, Mus musculus
gcagccagagtgggaaactgaggct

SEQ ID NO: 936913 - DNA, 25 bp, Mus musculus
gcagccaggcgcaacctgcgggagg

SEQ ID NO: 936914 - DNA, 25 bp, Mus musculus
gcagccaggcgctacctgcgggagg

SEQ ID NO: 936915 - DNA, 25 bp, Mus musculus
gcagccatcaaagactcctggacac

SEQ ID NO: 936916 - DNA, 25 bp, Mus musculus
gcagccatcaaagagtcctggacac

SEQ ID NO: 936917 - DNA, 25 bp, Mus musculus
gcagccatggaactggaagccccct

SEQ ID NO: 936918 - DNA, 25 bp, Mus musculus
gcagccatggaagtggaagccccct

SEQ ID NO: 936919 - DNA, 25 bp, Mus musculus
gcagccattaagctgcaggacccag

SEQ ID NO: 936920 - DNA, 25 bp, Mus musculus
gcagccattatgctgcaggacccag

SEQ ID NO: 936921 - DNA, 25 bp, Mus musculus
gcagccattgtgctggccttaggtg

SEQ ID NO: 936922 - DNA, 25 bp, Mus musculus
gcagccattgtggtggccttaggtg

SEQ ID NO: 936923 - DNA, 25 bp, Mus musculus
gcagcccaagaacaaccaagagccg

SEQ ID NO: 936924 - DNA, 25 bp, Mus musculus
gcagcccaagaacacgcaaatccag

SEQ ID NO: 936925 - DNA, 25 bp, Mus musculus
gcagcccaagaagaaccaagagccg

SEQ ID NO: 936926 - DNA, 25 bp, Mus musculus
gcagcccaagaagacgcaaatccag

SEQ ID NO: 936927 - DNA, 25 bp, Mus musculus
gcagcccaagcaggctccgccccca

SEQ ID NO: 936928 - DNA, 25 bp, Mus musculus
gcagcccaaggaggctccgccccca

SEQ ID NO: 936929 - DNA, 25 bp, Mus musculus
gcagcccacaagataactggcctta

SEQ ID NO: 936930 - DNA, 25 bp, Mus musculus
gcagcccacaagttaactggcctta

SEQ ID NO: 936931 - DNA, 25 bp, Mus musculus
gcagcccacacgctgacagaaaccg

SEQ ID NO: 936932 - DNA, 25 bp, Mus musculus
gcagcccacacggtgacagaaaccg

SEQ ID NO: 936933 - DNA, 25 bp, Mus musculus
gcagcccagaagcgtgtgcagatta

SEQ ID NO: 936934 - DNA, 25 bp, Mus musculus
gcagcccagaagggtgtgcagatta

SEQ ID NO: 936935 - DNA, 25 bp, Mus musculus
gcagccccccagcacacaaaggctc

SEQ ID NO: 936936 - DNA, 25 bp, Mus musculus
gcagccccccaggacacaaaggctc

SEQ ID NO: 936937 - DNA, 25 bp, Mus musculus
gcagcccccgatcactacatgccat

SEQ ID NO: 936938 - DNA, 25 bp, Mus musculus
gcagcccccgatcagtacatgccat

SEQ ID NO: 936939 - DNA, 25 bp, Mus musculus
gcagcccccgcacggagctccgctt

SEQ ID NO: 936940 - DNA, 25 bp, Mus musculus
gcagcccccgcagggagctccgctt

SEQ ID NO: 936941 - DNA, 25 bp, Mus musculus
gcagcccctgttctcgtgattgagg

SEQ ID NO: 936942 - DNA, 25 bp, Mus musculus
gcagcccctgttctggtgattgagg

SEQ ID NO: 936943 - DNA, 25 bp, Mus musculus
gcagccccttgactatggcaagaag

SEQ ID NO: 936944 - DNA, 25 bp, Mus musculus
gcagccccttgagtatggcaagaag

SEQ ID NO: 936945 - DNA, 25 bp, Mus musculus
gcagccctggagtctgagagcaagg

SEQ ID NO: 936946 - DNA, 25 bp, Mus musculus
gcagccctggtgtctgagagcaagg

SEQ ID NO: 936947 - DNA, 25 bp, Mus musculus
gcagccgaaccacccaagctctcct

SEQ ID NO: 936948 - DNA, 25 bp, Mus musculus
gcagccgaaccagccaagctctcct

SEQ ID NO: 936949 - DNA, 25 bp, Mus musculus
gcagccgcaatgcatccaagttcga

SEQ ID NO: 936950 - DNA, 25 bp, Mus musculus
gcagccgcaatggatccaagttcga

SEQ ID NO: 936951 - DNA, 25 bp, Mus musculus
gcagccgccgcggacgtctttggcc

SEQ ID NO: 936952 - DNA, 25 bp, Mus musculus
gcagccgccgcggaggtctttggcc

SEQ ID NO: 936953 - DNA, 25 bp, Mus musculus
gcagccgctgagctcaacaagcagc

SEQ ID NO: 936954 - DNA, 25 bp, Mus musculus
gcagccgctgaggtcaacaagcagc

SEQ ID NO: 936955 - DNA, 25 bp, Mus musculus
gcagccggagcacgggagcccaaag

SEQ ID NO: 936956 - DNA, 25 bp, Mus musculus
gcagccggagcaggggagcccaaag

SEQ ID NO: 936957 - DNA, 25 bp, Mus musculus
gcagccgggcagctttgccaagctg

SEQ ID NO: 936958 - DNA, 25 bp, Mus musculus
gcagccgggcaggtttgccaagctg

SEQ ID NO: 936959 - DNA, 25 bp, Mus musculus
gcagccggggctcccatcagtcacc

SEQ ID NO: 936960 - DNA, 25 bp, Mus musculus
gcagccggggctccgatcagtcacc

SEQ ID NO: 936961 - DNA, 25 bp, Mus musculus
gcagccgtgagacggtttgtggatg

SEQ ID NO: 936962 - DNA, 25 bp, Mus musculus
gcagccgtgagagggtttgtggatg

SEQ ID NO: 936963 - DNA, 25 bp, Mus musculus
gcagcctatgaacattgaagagaat

SEQ ID NO: 936964 - DNA, 25 bp, Mus musculus
gcagcctatgaagattgaagagaat

SEQ ID NO: 936965 - DNA, 25 bp, Mus musculus
gcagcctcagccaagttgaagttca

SEQ ID NO: 936966 - DNA, 25 bp, Mus musculus
gcagcctcaggcaagttgaagttca

SEQ ID NO: 936967 - DNA, 25 bp, Mus musculus
gcagcctctgtacacgtccggatag

SEQ ID NO: 936968 - DNA, 25 bp, Mus musculus
gcagcctctgtacaggtccggatag

SEQ ID NO: 936969 - DNA, 25 bp, Mus musculus
gcagcctgtaagatcttgcagatac

SEQ ID NO: 936970 - DNA, 25 bp, Mus musculus
gcagcctgtaagcccagcactatgg

SEQ ID NO: 936971 - DNA, 25 bp, Mus musculus
gcagcctgtaaggccagcactatgg

SEQ ID NO: 936972 - DNA, 25 bp, Mus musculus
gcagcctgtaagttcttgcagatac

SEQ ID NO: 936973 - DNA, 25 bp, Mus musculus
gcagcctgtctacgtggggtgacta

SEQ ID NO: 936974 - DNA, 25 bp, Mus musculus
gcagcctgtctaggtggggtgacta

SEQ ID NO: 936975 - DNA, 25 bp, Mus musculus
gcagccttactacgtcatgcacaga

SEQ ID NO: 936976 - DNA, 25 bp, Mus musculus
gcagccttactaggtcatgcacaga

SEQ ID NO: 936977 - DNA, 25 bp, Mus musculus
gcagccttcacgctcagttctgaca

SEQ ID NO: 936978 - DNA, 25 bp, Mus musculus
gcagccttcaggctcagttctgaca

SEQ ID NO: 936979 - DNA, 25 bp, Mus musculus
gcagccttcctggaccatgtggacg

SEQ ID NO: 936980 - DNA, 25 bp, Mus musculus
gcagccttcctggagcatgtggacg

SEQ ID NO: 936981 - DNA, 25 bp, Mus musculus
gcagccttgatggaccagagttctc

SEQ ID NO: 936982 - DNA, 25 bp, Mus musculus
gcagccttgatggagcagagttctc

SEQ ID NO: 936983 - DNA, 25 bp, Mus musculus
gcagcgacactccgcccagctgtgg

SEQ ID NO: 936984 - DNA, 25 bp, Mus musculus
gcagcgacactcggcccagctgtgg

SEQ ID NO: 936985 - DNA, 25 bp, Mus musculus
gcagcgacacttctccttcacacac

SEQ ID NO: 936986 - DNA, 25 bp, Mus musculus
gcagcgacacttgtccttcacacac

SEQ ID NO: 936987 - DNA, 25 bp, Mus musculus
gcagcgactaagcacgaagggatgg

SEQ ID NO: 936988 - DNA, 25 bp, Mus musculus
gcagcgactaagcaggaagggatgg

SEQ ID NO: 936989 - DNA, 25 bp, Mus musculus
gcagcgactttgagttccaggcccg

SEQ ID NO: 936990 - DNA, 25 bp, Mus musculus
gcagcgactttgtgttccaggcccg

SEQ ID NO: 936991 - DNA, 25 bp, Mus musculus
gcagcgagaccacacctgcacacct

SEQ ID NO: 936992 - DNA, 25 bp, Mus musculus
gcagcgagaccagacctgcacacct

SEQ ID NO: 936993 - DNA, 25 bp, Mus musculus
gcagcgagacttgcaaaaggtgctg

SEQ ID NO: 936994 - DNA, 25 bp, Mus musculus
gcagcgagacttgctaaaggtgctg

SEQ ID NO: 936995 - DNA, 25 bp, Mus musculus
gcagcgagagctggaggtagaggta

SEQ ID NO: 936996 - DNA, 25 bp, Mus musculus
gcagcgagaggtggaggtagaggta

SEQ ID NO: 936997 - DNA, 25 bp, Mus musculus
gcagcgagcgagaggtgatcatgtg

SEQ ID NO: 936998 - DNA, 25 bp, Mus musculus
gcagcgagcgagtggtgatcatgtg

SEQ ID NO: 936999 - DNA, 25 bp, Mus musculus
gcagcgagtcagaaccatctgccag

SEQ ID NO: 937000 - DNA, 25 bp, Mus musculus
gcagcgagtcagtaccatctgccag

SEQ ID NO: 937001 - DNA, 25 bp, Mus musculus
gcagcgatggcccagggctttgacc

SEQ ID NO: 937002 - DNA, 25 bp, Mus musculus
gcagcgatgggccagggctttgacc

SEQ ID NO: 937003 - DNA, 25 bp, Mus musculus
gcagcgcaagaccttcacagcctgg

SEQ ID NO: 937004 - DNA, 25 bp, Mus musculus
gcagcgcaagtccttcacagcctgg

SEQ ID NO: 937005 - DNA, 25 bp, Mus musculus
gcagcgcagcctgagctgctgtggc

SEQ ID NO: 937006 - DNA, 25 bp, Mus musculus
gcagcgcagcgtgagctgctgtggc

SEQ ID NO: 937007 - DNA, 25 bp, Mus musculus
gcagcgcaggagcttcagccagatg

SEQ ID NO: 937008 - DNA, 25 bp, Mus musculus
gcagcgcaggaggttcagccagatg

SEQ ID NO: 937009 - DNA, 25 bp, Mus musculus
gcagcgccaagtgacagtcagcttg

SEQ ID NO: 937010 - DNA, 25 bp, Mus musculus
gcagcgccaagtgagagtcagcttg

SEQ ID NO: 937011 - DNA, 25 bp, Mus musculus
gcagcgcccaggctgggaattgctg

SEQ ID NO: 937012 - DNA, 25 bp, Mus musculus
gcagcgcccagggtgggaattgctg

SEQ ID NO: 937013 - DNA, 25 bp, Mus musculus
gcagcgcgggcccgtgtacattggt

SEQ ID NO: 937014 - DNA, 25 bp, Mus musculus
gcagcgcgggccggtgtacattggt

SEQ ID NO: 937015 - DNA, 25 bp, Mus musculus
gcagcgctcacgcgaaccagtgacc

SEQ ID NO: 937016 - DNA, 25 bp, Mus musculus
gcagcgctcacgggaaccagtgacc

SEQ ID NO: 937017 - DNA, 25 bp, Mus musculus
gcagcggaagaaatggcaaaatgtc

SEQ ID NO: 937018 - DNA, 25 bp, Mus musculus
gcagcggaagcatgcaaactagaga

SEQ ID NO: 937019 - DNA, 25 bp, Mus musculus
gcagcggaagcatggaaactagaga

SEQ ID NO: 937020 - DNA, 25 bp, Mus musculus
gcagcggaagtaatggcaaaatgtc

SEQ ID NO: 937021 - DNA, 25 bp, Mus musculus
gcagcggacttcagttctatttggc

SEQ ID NO: 937022 - DNA, 25 bp, Mus musculus
gcagcggacttctgttctatttggc

SEQ ID NO: 937023 - DNA, 25 bp, Mus musculus
gcagcggagaagtgcatgtcgcgtg

SEQ ID NO: 937024 - DNA, 25 bp, Mus musculus
gcagcggagaagtgctgaaggcctt

SEQ ID NO: 937025 - DNA, 25 bp, Mus musculus
gcagcggagaagtggatgtcgcgtg

SEQ ID NO: 937026 - DNA, 25 bp, Mus musculus
gcagcggagaagtggtgaaggcctt

SEQ ID NO: 937027 - DNA, 25 bp, Mus musculus
gcagcggaggatgtggatgaatgca

SEQ ID NO: 937028 - DNA, 25 bp, Mus musculus
gcagcggaggttgtggatgaatgca

SEQ ID NO: 937029 - DNA, 25 bp, Mus musculus
gcagcggcagcgacatggcctttgc

SEQ ID NO: 937030 - DNA, 25 bp, Mus musculus
gcagcggcagcgacttggcctttgc

SEQ ID NO: 937031 - DNA, 25 bp, Mus musculus
gcagcgggctgccacgagccgtgga

SEQ ID NO: 937032 - DNA, 25 bp, Mus musculus
gcagcgggctgccaggagccgtgga

SEQ ID NO: 937033 - DNA, 25 bp, Mus musculus
gcagcggtgcagatgacagttcgtg

SEQ ID NO: 937034 - DNA, 25 bp, Mus musculus
gcagcggtgcagttgacagttcgtg

SEQ ID NO: 937035 - DNA, 25 bp, Mus musculus
gcagcggtggcacaatgttggcttc

SEQ ID NO: 937036 - DNA, 25 bp, Mus musculus
gcagcggtggcagaatgttggcttc

SEQ ID NO: 937037 - DNA, 25 bp, Mus musculus
gcagcgtccagcgtccgcccctcca

SEQ ID NO: 937038 - DNA, 25 bp, Mus musculus
gcagcgtccagcgtgcgcccctcca

SEQ ID NO: 937039 - DNA, 25 bp, Mus musculus
gcagcgtccttgagctgaggctgca

SEQ ID NO: 937040 - DNA, 25 bp, Mus musculus
gcagcgtccttgtgctgaggctgca

SEQ ID NO: 937041 - DNA, 25 bp, Mus musculus
gcagcgtgaacacacaaatcccttc

SEQ ID NO: 937042 - DNA, 25 bp, Mus musculus
gcagcgtgaacacacggggcttccg

SEQ ID NO: 937043 - DNA, 25 bp, Mus musculus
gcagcgtgaacacagaaatcccttc

SEQ ID NO: 937044 - DNA, 25 bp, Mus musculus
gcagcgtgaacacagggggcttccg

SEQ ID NO: 937045 - DNA, 25 bp, Mus musculus
gcagcgtgagccagtgggtgtttga

SEQ ID NO: 937046 - DNA, 25 bp, Mus musculus
gcagcgtgagctcctggtattttgg

SEQ ID NO: 937047 - DNA, 25 bp, Mus musculus
gcagcgtgaggcagtgggtgtttga

SEQ ID NO: 937048 - DNA, 25 bp, Mus musculus
gcagcgtgaggtcctggtattttgg

SEQ ID NO: 937049 - DNA, 25 bp, Mus musculus
gcagcgtggagacatatgagccaga

SEQ ID NO: 937050 - DNA, 25 bp, Mus musculus
gcagcgtggagagatatgagccaga

SEQ ID NO: 937051 - DNA, 25 bp, Mus musculus
gcagctaaacagtgttatattgctt

SEQ ID NO: 937052 - DNA, 25 bp, Mus musculus
gcagctaaactgtgttatattgctt

SEQ ID NO: 937053 - DNA, 25 bp, Mus musculus
gcagctaaagcaattacacctagct

SEQ ID NO: 937054 - DNA, 25 bp, Mus musculus
gcagctaaaggaattacacctagct

SEQ ID NO: 937055 - DNA, 25 bp, Mus musculus
gcagctaagagccacgtaatttcta

SEQ ID NO: 937056 - DNA, 25 bp, Mus musculus
gcagctaagagccaggtaatttcta

SEQ ID NO: 937057 - DNA, 25 bp, Mus musculus
gcagctaccccaacaatgcaccttc

SEQ ID NO: 937058 - DNA, 25 bp, Mus musculus
gcagctaccccaactatgcaccttc

SEQ ID NO: 937059 - DNA, 25 bp, Mus musculus
gcagctactccaaacggttatgagc

SEQ ID NO: 937060 - DNA, 25 bp, Mus musculus
gcagctactccaaagggttatgagc

SEQ ID NO: 937061 - DNA, 25 bp, Mus musculus
gcagctagagcgacagcagttggaa

SEQ ID NO: 937062 - DNA, 25 bp, Mus musculus
gcagctagagcgtcagcagttggaa

SEQ ID NO: 937063 - DNA, 25 bp, Mus musculus
gcagctatcccacacactcagaacc

SEQ ID NO: 937064 - DNA, 25 bp, Mus musculus
gcagctatcccacagactcagaacc

SEQ ID NO: 937065 - DNA, 25 bp, Mus musculus
gcagctattcagctgctgggcatgc

SEQ ID NO: 937066 - DNA, 25 bp, Mus musculus
gcagctattcaggtgctgggcatgc

SEQ ID NO: 937067 - DNA, 25 bp, Mus musculus
gcagctcaaaagcgaaattatcgct

SEQ ID NO: 937068 - DNA, 25 bp, Mus musculus
gcagctcaaaagggaaattatcgct

SEQ ID NO: 937069 - DNA, 25 bp, Mus musculus
gcagctcaagcaccccctcaacaca

SEQ ID NO: 937070 - DNA, 25 bp, Mus musculus
gcagctcaagcagcccctcaacaca

SEQ ID NO: 937071 - DNA, 25 bp, Mus musculus
gcagctcaaggacgctcaacgcaca

SEQ ID NO: 937072 - DNA, 25 bp, Mus musculus
gcagctcaaggaggctcaacgcaca

SEQ ID NO: 937073 - DNA, 25 bp, Mus musculus
gcagctcacacccacgtgctggctg

SEQ ID NO: 937074 - DNA, 25 bp, Mus musculus
gcagctcacacccaggtgctggctg

SEQ ID NO: 937075 - DNA, 25 bp, Mus musculus
gcagctcagttcttcgtgaaagcag

SEQ ID NO: 937076 - DNA, 25 bp, Mus musculus
gcagctcagttcttggtgaaagcag

SEQ ID NO: 937077 - DNA, 25 bp, Mus musculus
gcagctcatgagaacgtacacactg

SEQ ID NO: 937078 - DNA, 25 bp, Mus musculus
gcagctcatgagaaggtacacactg

SEQ ID NO: 937079 - DNA, 25 bp, Mus musculus
gcagctcattaacgtcacacggctg

SEQ ID NO: 937080 - DNA, 25 bp, Mus musculus
gcagctcattaaggtcacacggctg

SEQ ID NO: 937081 - DNA, 25 bp, Mus musculus
gcagctccatccgccgtctgtcatc

SEQ ID NO: 937082 - DNA, 25 bp, Mus musculus
gcagctccatccgcggtctgtcatc

SEQ ID NO: 937083 - DNA, 25 bp, Mus musculus
gcagctccctagaacatggattcat

SEQ ID NO: 937084 - DNA, 25 bp, Mus musculus
gcagctccctagaacggcaacaacc

SEQ ID NO: 937085 - DNA, 25 bp, Mus musculus
gcagctccctagaagatggattcat

SEQ ID NO: 937086 - DNA, 25 bp, Mus musculus
gcagctccctagaagggcaacaacc

SEQ ID NO: 937087 - DNA, 25 bp, Mus musculus
gcagctcgacagatgccaaagtctg

SEQ ID NO: 937088 - DNA, 25 bp, Mus musculus
gcagctcgacagctgcagggccctg

SEQ ID NO: 937089 - DNA, 25 bp, Mus musculus
gcagctcgacaggtgcagggccctg

SEQ ID NO: 937090 - DNA, 25 bp, Mus musculus
gcagctcgacagttgccaaagtctg

SEQ ID NO: 937091 - DNA, 25 bp, Mus musculus
gcagctgaaattagtccgtgctccg

SEQ ID NO: 937092 - DNA, 25 bp, Mus musculus
gcagctgaaatttgtccgtgctccg

SEQ ID NO: 937093 - DNA, 25 bp, Mus musculus
gcagctgaacaacaaggcagaaggg

SEQ ID NO: 937094 - DNA, 25 bp, Mus musculus
gcagctgaacaagaaggcagaaggg

SEQ ID NO: 937095 - DNA, 25 bp, Mus musculus
gcagctgactctgtacagcagccgc

SEQ ID NO: 937096 - DNA, 25 bp, Mus musculus
gcagctgactgtgtacagcagccgc

SEQ ID NO: 937097 - DNA, 25 bp, Mus musculus
gcagctgaggcacagaaaaggcagg

SEQ ID NO: 937098 - DNA, 25 bp, Mus musculus
gcagctgaggcacggtcagaaagca

SEQ ID NO: 937099 - DNA, 25 bp, Mus musculus
gcagctgaggcacgtctccaaggaa

SEQ ID NO: 937100 - DNA, 25 bp, Mus musculus
gcagctgaggcagagaaaaggcagg

SEQ ID NO: 937101 - DNA, 25 bp, Mus musculus
gcagctgaggcagggtcagaaagca

SEQ ID NO: 937102 - DNA, 25 bp, Mus musculus
gcagctgaggcaggtctccaaggaa

SEQ ID NO: 937103 - DNA, 25 bp, Mus musculus
gcagctgatggacgtttttaaattt

SEQ ID NO: 937104 - DNA, 25 bp, Mus musculus
gcagctgatggaggtttttaaattt

SEQ ID NO: 937105 - DNA, 25 bp, Mus musculus
gcagctgcaaagcagggctgctggc

SEQ ID NO: 937106 - DNA, 25 bp, Mus musculus
gcagctgcaaaggagggctgctggc

SEQ ID NO: 937107 - DNA, 25 bp, Mus musculus
gcagctgcaaggcacgttggcgtgg

SEQ ID NO: 937108 - DNA, 25 bp, Mus musculus
gcagctgcaaggcaggttggcgtgg

SEQ ID NO: 937109 - DNA, 25 bp, Mus musculus
gcagctgcagcacggctcatggcag

SEQ ID NO: 937110 - DNA, 25 bp, Mus musculus
gcagctgcagcagggctcatggcag

SEQ ID NO: 937111 - DNA, 25 bp, Mus musculus
gcagctgcatgtgcaccctctctat

SEQ ID NO: 937112 - DNA, 25 bp, Mus musculus
gcagctgcatgtgctccctctctat

SEQ ID NO: 937113 - DNA, 25 bp, Mus musculus
gcagctgccatccacgcagcagcag

SEQ ID NO: 937114 - DNA, 25 bp, Mus musculus
gcagctgccatccaggcagcagcag

SEQ ID NO: 937115 - DNA, 25 bp, Mus musculus
gcagctgccgataactacgccctgg

SEQ ID NO: 937116 - DNA, 25 bp, Mus musculus
gcagctgccgataagtacgccctgg

SEQ ID NO: 937117 - DNA, 25 bp, Mus musculus
gcagctgcggggatcgaagctgtgc

SEQ ID NO: 937118 - DNA, 25 bp, Mus musculus
gcagctgcggggatggaagctgtgc

SEQ ID NO: 937119 - DNA, 25 bp, Mus musculus
gcagctgctaagaacagaaaaattg

SEQ ID NO: 937120 - DNA, 25 bp, Mus musculus
gcagctgctaagaagagaaaaattg

SEQ ID NO: 937121 - DNA, 25 bp, Mus musculus
gcagctgctactcgaaatgctgacc

SEQ ID NO: 937122 - DNA, 25 bp, Mus musculus
gcagctgctactggaaatgctgacc

SEQ ID NO: 937123 - DNA, 25 bp, Mus musculus
gcagctgctccacactggatgagct

SEQ ID NO: 937124 - DNA, 25 bp, Mus musculus
gcagctgctccagactggatgagct

SEQ ID NO: 937125 - DNA, 25 bp, Mus musculus
gcagctgctgaccctgagcaatgag

SEQ ID NO: 937126 - DNA, 25 bp, Mus musculus
gcagctgctgtccctgagcaatgag

SEQ ID NO: 937127 - DNA, 25 bp, Mus musculus
gcagctggacaacttccctggctgg

SEQ ID NO: 937128 - DNA, 25 bp, Mus musculus
gcagctggacaagttccctggctgg

SEQ ID NO: 937129 - DNA, 25 bp, Mus musculus
gcagctggagatgaactttctagat

SEQ ID NO: 937130 - DNA, 25 bp, Mus musculus
gcagctggagcaccttattaatcaa

SEQ ID NO: 937131 - DNA, 25 bp, Mus musculus
gcagctggagctggtcaagctgcca

SEQ ID NO: 937132 - DNA, 25 bp, Mus musculus
gcagctggagctgtggaacaccagc

SEQ ID NO: 937133 - DNA, 25 bp, Mus musculus
gcagctggaggaccttattaatcaa

SEQ ID NO: 937134 - DNA, 25 bp, Mus musculus
gcagctggaggtggtcaagctgcca

SEQ ID NO: 937135 - DNA, 25 bp, Mus musculus
gcagctggaggtgtggaacaccagc

SEQ ID NO: 937136 - DNA, 25 bp, Mus musculus
gcagctggagttgaactttctagat

SEQ ID NO: 937137 - DNA, 25 bp, Mus musculus
gcagctggctaacaatgtgactgtg

SEQ ID NO: 937138 - DNA, 25 bp, Mus musculus
gcagctggctaagaatgtgactgtg

SEQ ID NO: 937139 - DNA, 25 bp, Mus musculus
gcagctgggcaacatccttaccaaa

SEQ ID NO: 937140 - DNA, 25 bp, Mus musculus
gcagctgggcaagatccttaccaaa

SEQ ID NO: 937141 - DNA, 25 bp, Mus musculus
gcagctggggccttcgtgttgggag

SEQ ID NO: 937142 - DNA, 25 bp, Mus musculus
gcagctggggccttggtgttgggag

SEQ ID NO: 937143 - DNA, 25 bp, Mus musculus
gcagctggtacacgggctgtgaaca

SEQ ID NO: 937144 - DNA, 25 bp, Mus musculus
gcagctggtacaggggctgtgaaca

SEQ ID NO: 937145 - DNA, 25 bp, Mus musculus
gcagctggtgaagaacacaagtagt

SEQ ID NO: 937146 - DNA, 25 bp, Mus musculus
gcagctggtggaccactacaccaca

SEQ ID NO: 937147 - DNA, 25 bp, Mus musculus
gcagctggtggacgcatggctggaa

SEQ ID NO: 937148 - DNA, 25 bp, Mus musculus
gcagctggtggagcactacaccaca

SEQ ID NO: 937149 - DNA, 25 bp, Mus musculus
gcagctggtggaggcatggctggaa

SEQ ID NO: 937150 - DNA, 25 bp, Mus musculus
gcagctggtgtagaacacaagtagt

SEQ ID NO: 937151 - DNA, 25 bp, Mus musculus
gcagctggtgtggactttgaagaaa

SEQ ID NO: 937152 - DNA, 25 bp, Mus musculus
gcagctggtgtggagtttgaagaaa

SEQ ID NO: 937153 - DNA, 25 bp, Mus musculus
gcagctgtgacgagcgcaatgctgc

SEQ ID NO: 937154 - DNA, 25 bp, Mus musculus
gcagctgtgacgagggcaatgctgc

SEQ ID NO: 937155 - DNA, 25 bp, Mus musculus
gcagctgtgctgaaccgcatcctgg

SEQ ID NO: 937156 - DNA, 25 bp, Mus musculus
gcagctgtgctgaagcgcatcctgg

SEQ ID NO: 937157 - DNA, 25 bp, Mus musculus
gcagcttaagctcttacattccgct

SEQ ID NO: 937158 - DNA, 25 bp, Mus musculus
gcagcttaaggtcttacattccgct

SEQ ID NO: 937159 - DNA, 25 bp, Mus musculus
gcagcttcagattcccttcagggaa

SEQ ID NO: 937160 - DNA, 25 bp, Mus musculus
gcagcttcagtttcccttcagggaa

SEQ ID NO: 937161 - DNA, 25 bp, Mus musculus
gcagcttcctgagtcgtatccttgg

SEQ ID NO: 937162 - DNA, 25 bp, Mus musculus
gcagcttcctgagtggtatccttgg

SEQ ID NO: 937163 - DNA, 25 bp, Mus musculus
gcagcttcttcagacgtagaactag

SEQ ID NO: 937164 - DNA, 25 bp, Mus musculus
gcagcttcttcagaggtagaactag

SEQ ID NO: 937165 - DNA, 25 bp, Mus musculus
gcagcttgcgcgcccggccgccccg

SEQ ID NO: 937166 - DNA, 25 bp, Mus musculus
gcagcttgcgcggccggccgccccg

SEQ ID NO: 937167 - DNA, 25 bp, Mus musculus
gcagcttgtgcacgatcagtatgga

SEQ ID NO: 937168 - DNA, 25 bp, Mus musculus
gcagcttgtgcaggatcagtatgga

SEQ ID NO: 937169 - DNA, 25 bp, Mus musculus
gcagctttctcccacgtgctcacca

SEQ ID NO: 937170 - DNA, 25 bp, Mus musculus
gcagctttctcccaggtgctcacca

SEQ ID NO: 937171 - DNA, 25 bp, Mus musculus
gcaggaaaaacacaggccagcaagc

SEQ ID NO: 937172 - DNA, 25 bp, Mus musculus
gcaggaaaaacagaggccagcaagc

SEQ ID NO: 937173 - DNA, 25 bp, Mus musculus
gcaggaaactggagtgtgggttcgc

SEQ ID NO: 937174 - DNA, 25 bp, Mus musculus
gcaggaaactggtgtgtgggttcgc

SEQ ID NO: 937175 - DNA, 25 bp, Mus musculus
gcaggaaaggccaaataagttggtg

SEQ ID NO: 937176 - DNA, 25 bp, Mus musculus
gcaggaaagggcaaataagttggtg

SEQ ID NO: 937177 - DNA, 25 bp, Mus musculus
gcaggaaagttgcactattatcccc

SEQ ID NO: 937178 - DNA, 25 bp, Mus musculus
gcaggaaagttgcagtattatcccc

SEQ ID NO: 937179 - DNA, 25 bp, Mus musculus
gcaggaacacaaactgaaagtcgct

SEQ ID NO: 937180 - DNA, 25 bp, Mus musculus
gcaggaacacaatctgaaagtcgct

SEQ ID NO: 937181 - DNA, 25 bp, Mus musculus
gcaggaacagcgtcaagtcctccat

SEQ ID NO: 937182 - DNA, 25 bp, Mus musculus
gcaggaacagcgtttaatgtggaga

SEQ ID NO: 937183 - DNA, 25 bp, Mus musculus
gcaggaacagggtcaagtcctccat

SEQ ID NO: 937184 - DNA, 25 bp, Mus musculus
gcaggaacagggtttaatgtggaga

SEQ ID NO: 937185 - DNA, 25 bp, Mus musculus
gcaggaaccaatcagacaccatgat

SEQ ID NO: 937186 - DNA, 25 bp, Mus musculus
gcaggaaccaatcgagccattccgt

SEQ ID NO: 937187 - DNA, 25 bp, Mus musculus
gcaggaaccaatgagacaccatgat

SEQ ID NO: 937188 - DNA, 25 bp, Mus musculus
gcaggaaccaatggagccattccgt

SEQ ID NO: 937189 - DNA, 25 bp, Mus musculus
gcaggaactcaggcagcagaacgag

SEQ ID NO: 937190 - DNA, 25 bp, Mus musculus
gcaggaactcaggctgcagaacgag

SEQ ID NO: 937191 - DNA, 25 bp, Mus musculus
gcaggaagtcagaacgctgttatca

SEQ ID NO: 937192 - DNA, 25 bp, Mus musculus
gcaggaagtcagaaggctgttatca

SEQ ID NO: 937193 - DNA, 25 bp, Mus musculus
gcaggaagtgccagcatcacaacga

SEQ ID NO: 937194 - DNA, 25 bp, Mus musculus
gcaggaagtgccaggatcacaacga

SEQ ID NO: 937195 - DNA, 25 bp, Mus musculus
gcaggaatgaaccttggctccagaa

SEQ ID NO: 937196 - DNA, 25 bp, Mus musculus
gcaggaatgatccttggctccagaa

SEQ ID NO: 937197 - DNA, 25 bp, Mus musculus
gcaggaatggcttccagacctcctg

SEQ ID NO: 937198 - DNA, 25 bp, Mus musculus
gcaggaatgggttccagacctcctg

SEQ ID NO: 937199 - DNA, 25 bp, Mus musculus
gcaggaatttcctgcccgtgaagag

SEQ ID NO: 937200 - DNA, 25 bp, Mus musculus
gcaggaatttcctggccgtgaagag

SEQ ID NO: 937201 - DNA, 25 bp, Mus musculus
gcaggacaaacgcgtgtggctggag

SEQ ID NO: 937202 - DNA, 25 bp, Mus musculus
gcaggacaaacgggtgtggctggag

SEQ ID NO: 937203 - DNA, 25 bp, Mus musculus
gcaggaccacagaactacagctgaa

SEQ ID NO: 937204 - DNA, 25 bp, Mus musculus
gcaggaccacagatatatatcttca

SEQ ID NO: 937205 - DNA, 25 bp, Mus musculus
gcaggaccacagtactacagctgaa

SEQ ID NO: 937206 - DNA, 25 bp, Mus musculus
gcaggaccacagttatatatcttca

SEQ ID NO: 937207 - DNA, 25 bp, Mus musculus
gcaggaccagaggatgcctggactt

SEQ ID NO: 937208 - DNA, 25 bp, Mus musculus
gcaggaccagtggatgcctggactt

SEQ ID NO: 937209 - DNA, 25 bp, Mus musculus
gcaggacccacacgtgactcagggc

SEQ ID NO: 937210 - DNA, 25 bp, Mus musculus
gcaggacccacaggtgactcagggc

SEQ ID NO: 937211 - DNA, 25 bp, Mus musculus
gcaggaccgagacacctccttccgc

SEQ ID NO: 937212 - DNA, 25 bp, Mus musculus
gcaggaccgagacagctccttccgc

SEQ ID NO: 937213 - DNA, 25 bp, Mus musculus
gcaggacctaaacgattacatgcgt

SEQ ID NO: 937214 - DNA, 25 bp, Mus musculus
gcaggacctaaaggattacatgcgt

SEQ ID NO: 937215 - DNA, 25 bp, Mus musculus
gcaggacgcccacgaactgtatgag

SEQ ID NO: 937216 - DNA, 25 bp, Mus musculus
gcaggacgcccacgtctttcaacac

SEQ ID NO: 937217 - DNA, 25 bp, Mus musculus
gcaggacgcccaggaactgtatgag

SEQ ID NO: 937218 - DNA, 25 bp, Mus musculus
gcaggacgcccaggtctttcaacac

SEQ ID NO: 937219 - DNA, 25 bp, Mus musculus
gcaggacggagcatcgttggagcct

SEQ ID NO: 937220 - DNA, 25 bp, Mus musculus
gcaggacggagcatggttggagcct

SEQ ID NO: 937221 - DNA, 25 bp, Mus musculus
gcaggacgtcagacacagcgttcac

SEQ ID NO: 937222 - DNA, 25 bp, Mus musculus
gcaggacgtcagtcacagcgttcac

SEQ ID NO: 937223 - DNA, 25 bp, Mus musculus
gcaggacgtgctgacagagttagtc

SEQ ID NO: 937224 - DNA, 25 bp, Mus musculus
gcaggacgtggtgacagagttagtc

SEQ ID NO: 937225 - DNA, 25 bp, Mus musculus
gcaggacttgcattcatgtgaacga

SEQ ID NO: 937226 - DNA, 25 bp, Mus musculus
gcaggacttgcattgatgtgaacga

SEQ ID NO: 937227 - DNA, 25 bp, Mus musculus
gcaggagaagagtatcgatgatgat

SEQ ID NO: 937228 - DNA, 25 bp, Mus musculus
gcaggagaagatcacaagagggaag

SEQ ID NO: 937229 - DNA, 25 bp, Mus musculus
gcaggagaagatcgtggatcgcact

SEQ ID NO: 937230 - DNA, 25 bp, Mus musculus
gcaggagaagatgacaagagggaag

SEQ ID NO: 937231 - DNA, 25 bp, Mus musculus
gcaggagaagatggtggatcgcact

SEQ ID NO: 937232 - DNA, 25 bp, Mus musculus
gcaggagaagtgtatcgatgatgat

SEQ ID NO: 937233 - DNA, 25 bp, Mus musculus
gcaggagaatgactcgtgggtgtgc

SEQ ID NO: 937234 - DNA, 25 bp, Mus musculus
gcaggagaatgactggtgggtgtgc

SEQ ID NO: 937235 - DNA, 25 bp, Mus musculus
gcaggagacaagaacttcatcactg

SEQ ID NO: 937236 - DNA, 25 bp, Mus musculus
gcaggagacaagtacttcatcactg

SEQ ID NO: 937237 - DNA, 25 bp, Mus musculus
gcaggagagctcaacaatggatttg

SEQ ID NO: 937238 - DNA, 25 bp, Mus musculus
gcaggagagctcaagaatggatttg

SEQ ID NO: 937239 - DNA, 25 bp, Mus musculus
gcaggagagttccaccgtttgctgc

SEQ ID NO: 937240 - DNA, 25 bp, Mus musculus
gcaggagagttccagcgtttgctgc

SEQ ID NO: 937241 - DNA, 25 bp, Mus musculus
gcaggagatcctccaagcccacaga

SEQ ID NO: 937242 - DNA, 25 bp, Mus musculus
gcaggagatcctcctagcccacaga

SEQ ID NO: 937243 - DNA, 25 bp, Mus musculus
gcaggagcagatcgccaagcagcag

SEQ ID NO: 937244 - DNA, 25 bp, Mus musculus
gcaggagcagcccaacgagggcatc

SEQ ID NO: 937245 - DNA, 25 bp, Mus musculus
gcaggagcagctcacaggtctgatc

SEQ ID NO: 937246 - DNA, 25 bp, Mus musculus
gcaggagcagctgacaggtctgatc

SEQ ID NO: 937247 - DNA, 25 bp, Mus musculus
gcaggagcagcttcgggcagttcat

SEQ ID NO: 937248 - DNA, 25 bp, Mus musculus
gcaggagcaggccaacgagggcatc

SEQ ID NO: 937249 - DNA, 25 bp, Mus musculus
gcaggagcaggttcgggcagttcat

SEQ ID NO: 937250 - DNA, 25 bp, Mus musculus
gcaggagcagttcgccaagcagcag

SEQ ID NO: 937251 - DNA, 25 bp, Mus musculus
gcaggagcccaacccacaggtagag

SEQ ID NO: 937252 - DNA, 25 bp, Mus musculus
gcaggagcccaagccacaggtagag

SEQ ID NO: 937253 - DNA, 25 bp, Mus musculus
gcaggagcgcagcttcctcatgagg

SEQ ID NO: 937254 - DNA, 25 bp, Mus musculus
gcaggagcgcaggttcctcatgagg

SEQ ID NO: 937255 - DNA, 25 bp, Mus musculus
gcaggagcgtgcagtccaggaacac

SEQ ID NO: 937256 - DNA, 25 bp, Mus musculus
gcaggagcgtgctgtccaggaacac

SEQ ID NO: 937257 - DNA, 25 bp, Mus musculus
gcaggagctagaagcggaatacttg

SEQ ID NO: 937258 - DNA, 25 bp, Mus musculus
gcaggagctagaaggggaatacttg

SEQ ID NO: 937259 - DNA, 25 bp, Mus musculus
gcaggaggacgacgtgctgctggtg

SEQ ID NO: 937260 - DNA, 25 bp, Mus musculus
gcaggaggacgaggtgctgctggtg

SEQ ID NO: 937261 - DNA, 25 bp, Mus musculus
gcaggaggccagagacaagaggacc

SEQ ID NO: 937262 - DNA, 25 bp, Mus musculus
gcaggaggccagtgacaagaggacc

SEQ ID NO: 937263 - DNA, 25 bp, Mus musculus
gcaggagggacacgcatcaccccaa

SEQ ID NO: 937264 - DNA, 25 bp, Mus musculus
gcaggagggacaggcatcaccccaa

SEQ ID NO: 937265 - DNA, 25 bp, Mus musculus
gcaggatactatctatataacaggc

SEQ ID NO: 937266 - DNA, 25 bp, Mus musculus
gcaggatactatgtatataacaggc

SEQ ID NO: 937267 - DNA, 25 bp, Mus musculus
gcaggatcaagagacgtgacgtgtt

SEQ ID NO: 937268 - DNA, 25 bp, Mus musculus
gcaggatcaagagaggtgacgtgtt

SEQ ID NO: 937269 - DNA, 25 bp, Mus musculus
gcaggatcctccgacagttctgtcc

SEQ ID NO: 937270 - DNA, 25 bp, Mus musculus
gcaggatcctccgagagttctgtcc

SEQ ID NO: 937271 - DNA, 25 bp, Mus musculus
gcaggatcgactcagacctactgca

SEQ ID NO: 937272 - DNA, 25 bp, Mus musculus
gcaggatcgactgagacctactgca

SEQ ID NO: 937273 - DNA, 25 bp, Mus musculus
gcaggatgacggaaaaatgtttatt

SEQ ID NO: 937274 - DNA, 25 bp, Mus musculus
gcaggatgacggtaaaatgtttatt

SEQ ID NO: 937275 - DNA, 25 bp, Mus musculus
gcaggatggaagagaagctgaagaa

SEQ ID NO: 937276 - DNA, 25 bp, Mus musculus
gcaggatggaagccacttgaagagg

SEQ ID NO: 937277 - DNA, 25 bp, Mus musculus
gcaggatggaaggcacttgaagagg

SEQ ID NO: 937278 - DNA, 25 bp, Mus musculus
gcaggatggaagtgaagctgaagaa

SEQ ID NO: 937279 - DNA, 25 bp, Mus musculus
gcaggatgttccagcggaggaatgg

SEQ ID NO: 937280 - DNA, 25 bp, Mus musculus
gcaggatgttccaggggaggaatgg

SEQ ID NO: 937281 - DNA, 25 bp, Mus musculus
gcaggattgcattacgaaagaatgt

SEQ ID NO: 937282 - DNA, 25 bp, Mus musculus
gcaggattgcattaggaaagaatgt

SEQ ID NO: 937283 - DNA, 25 bp, Mus musculus
gcaggattgtagcctctatcacacg

SEQ ID NO: 937284 - DNA, 25 bp, Mus musculus
gcaggattgtaggctctatcacacg

SEQ ID NO: 937285 - DNA, 25 bp, Mus musculus
gcaggatttcagccaattacctcca

SEQ ID NO: 937286 - DNA, 25 bp, Mus musculus
gcaggatttcaggcaattacctcca

SEQ ID NO: 937287 - DNA, 25 bp, Mus musculus
gcaggcaaaactgactgaccttcag

SEQ ID NO: 937288 - DNA, 25 bp, Mus musculus
gcaggcaaaactgagtgaccttcag

SEQ ID NO: 937289 - DNA, 25 bp, Mus musculus
gcaggcacagagatgagtcagtctg

SEQ ID NO: 937290 - DNA, 25 bp, Mus musculus
gcaggcacagagttgagtcagtctg

SEQ ID NO: 937291 - DNA, 25 bp, Mus musculus
gcaggcaccagtctctggggtggcc

SEQ ID NO: 937292 - DNA, 25 bp, Mus musculus
gcaggcaccagtgtctggggtggcc

SEQ ID NO: 937293 - DNA, 25 bp, Mus musculus
gcaggcacccaagacgtcattggtg

SEQ ID NO: 937294 - DNA, 25 bp, Mus musculus
gcaggcacccaagaggtcattggtg

SEQ ID NO: 937295 - DNA, 25 bp, Mus musculus
gcaggcagcccacggatgcagcgtc

SEQ ID NO: 937296 - DNA, 25 bp, Mus musculus
gcaggcagcccagggatgcagcgtc

SEQ ID NO: 937297 - DNA, 25 bp, Mus musculus
gcaggcagtctctgcgttcagacaa

SEQ ID NO: 937298 - DNA, 25 bp, Mus musculus
gcaggcagtctctgggttcagacaa

SEQ ID NO: 937299 - DNA, 25 bp, Mus musculus
gcaggcagtgtgagcacatggatga

SEQ ID NO: 937300 - DNA, 25 bp, Mus musculus
gcaggcagtgtgaggacatggatga

SEQ ID NO: 937301 - DNA, 25 bp, Mus musculus
gcaggcatatgcttccttggggact

SEQ ID NO: 937302 - DNA, 25 bp, Mus musculus
gcaggcatatgcttcggagactcgg

SEQ ID NO: 937303 - DNA, 25 bp, Mus musculus
gcaggcatatgcttgcttggggact

SEQ ID NO: 937304 - DNA, 25 bp, Mus musculus
gcaggcatatgcttgggagactcgg

SEQ ID NO: 937305 - DNA, 25 bp, Mus musculus
gcaggcatatttccctgcataagtg

SEQ ID NO: 937306 - DNA, 25 bp, Mus musculus
gcaggcatatttgcctgcataagtg

SEQ ID NO: 937307 - DNA, 25 bp, Mus musculus
gcaggcatccggcaagctgaatgca

SEQ ID NO: 937308 - DNA, 25 bp, Mus musculus
gcaggcatccgggaagctgaatgca

SEQ ID NO: 937309 - DNA, 25 bp, Mus musculus
gcaggcatgacacgagctggagaag

SEQ ID NO: 937310 - DNA, 25 bp, Mus musculus
gcaggcatgacaggagctggagaag

SEQ ID NO: 937311 - DNA, 25 bp, Mus musculus
gcaggcatgccacgctatcaagtac

SEQ ID NO: 937312 - DNA, 25 bp, Mus musculus
gcaggcatgccaggctatcaagtac

SEQ ID NO: 937313 - DNA, 25 bp, Mus musculus
gcaggccaagaaacagactgcagcc

SEQ ID NO: 937314 - DNA, 25 bp, Mus musculus
gcaggccaagaatcagactgcagcc

SEQ ID NO: 937315 - DNA, 25 bp, Mus musculus
gcaggccatcaacgtgactcacaaa

SEQ ID NO: 937316 - DNA, 25 bp, Mus musculus
gcaggccatcaaggtgactcacaaa

SEQ ID NO: 937317 - DNA, 25 bp, Mus musculus
gcaggccatgcacctcgtgaagaac

SEQ ID NO: 937318 - DNA, 25 bp, Mus musculus
gcaggccatggacctcgtgaagaac

SEQ ID NO: 937319 - DNA, 25 bp, Mus musculus
gcaggccccagtcggctctgtgtac

SEQ ID NO: 937320 - DNA, 25 bp, Mus musculus
gcaggccccagtgggctctgtgtac

SEQ ID NO: 937321 - DNA, 25 bp, Mus musculus
gcaggccgcgctagaaaatgctact

SEQ ID NO: 937322 - DNA, 25 bp, Mus musculus
gcaggccgcggtagaaaatgctact

SEQ ID NO: 937323 - DNA, 25 bp, Mus musculus
gcaggccgctgtctcagcgcaggct

SEQ ID NO: 937324 - DNA, 25 bp, Mus musculus
gcaggccgctgtctgagcgcaggct

SEQ ID NO: 937325 - DNA, 25 bp, Mus musculus
gcaggccgtaggacagtatacaacc

SEQ ID NO: 937326 - DNA, 25 bp, Mus musculus
gcaggccgtaggtcagtatacaacc

SEQ ID NO: 937327 - DNA, 25 bp, Mus musculus
gcaggcctcatacgcaccgtggtca

SEQ ID NO: 937328 - DNA, 25 bp, Mus musculus
gcaggcctcataggcaccgtggtca

SEQ ID NO: 937329 - DNA, 25 bp, Mus musculus
gcaggcgcagctcaagtgctgtggc

SEQ ID NO: 937330 - DNA, 25 bp, Mus musculus
gcaggcgcaggtcaagtgctgtggc

SEQ ID NO: 937331 - DNA, 25 bp, Mus musculus
gcaggcgccgagcgcgtccctgtct

SEQ ID NO: 937332 - DNA, 25 bp, Mus musculus
gcaggcgccgagggcgtccctgtct

SEQ ID NO: 937333 - DNA, 25 bp, Mus musculus
gcaggcgcgcgagaagctcgcgctg

SEQ ID NO: 937334 - DNA, 25 bp, Mus musculus
gcaggcgcgcgagatgctcgcgctg

SEQ ID NO: 937335 - DNA, 25 bp, Mus musculus
gcaggcgtgaggaaactgctgtcat

SEQ ID NO: 937336 - DNA, 25 bp, Mus musculus
gcaggcgtgaggtaactgctgtcat

SEQ ID NO: 937337 - DNA, 25 bp, Mus musculus
gcaggctacatgcggttgacctgta

SEQ ID NO: 937338 - DNA, 25 bp, Mus musculus
gcaggctacatggggttgacctgta

SEQ ID NO: 937339 - DNA, 25 bp, Mus musculus
gcaggctcagagatgggcccagtgc

SEQ ID NO: 937340 - DNA, 25 bp, Mus musculus
gcaggctcagagttgggcccagtgc

SEQ ID NO: 937341 - DNA, 25 bp, Mus musculus
gcaggctcagctgcaggctgtgaca

SEQ ID NO: 937342 - DNA, 25 bp, Mus musculus
gcaggctcaggtgcaggctgtgaca

SEQ ID NO: 937343 - DNA, 25 bp, Mus musculus
gcaggctcgagcagagtccgtctcc

SEQ ID NO: 937344 - DNA, 25 bp, Mus musculus
gcaggctcgagcagtgtccgtctcc

SEQ ID NO: 937345 - DNA, 25 bp, Mus musculus
gcaggctctgcacttggagagcaaa

SEQ ID NO: 937346 - DNA, 25 bp, Mus musculus
gcaggctctgcagttggagagcaaa

SEQ ID NO: 937347 - DNA, 25 bp, Mus musculus
gcaggctgtatgcgtctgacagaag

SEQ ID NO: 937348 - DNA, 25 bp, Mus musculus
gcaggctgtatgggtctgacagaag

SEQ ID NO: 937349 - DNA, 25 bp, Mus musculus
gcagggaaagcacatgatgctgcag

SEQ ID NO: 937350 - DNA, 25 bp, Mus musculus
gcagggaaagcagatgatgctgcag

SEQ ID NO: 937351 - DNA, 25 bp, Mus musculus
gcagggaccaaggttggggtgcttc

SEQ ID NO: 937352 - DNA, 25 bp, Mus musculus
gcagggaccacgccctctgccaacc

SEQ ID NO: 937353 - DNA, 25 bp, Mus musculus
gcagggaccaggccctctgccaacc

SEQ ID NO: 937354 - DNA, 25 bp, Mus musculus
gcagggaccatggttggggtgcttc

SEQ ID NO: 937355 - DNA, 25 bp, Mus musculus
gcagggactgggctgcaggtcctgg

SEQ ID NO: 937356 - DNA, 25 bp, Mus musculus
gcagggactggggtgcaggtcctgg

SEQ ID NO: 937357 - DNA, 25 bp, Mus musculus
gcagggagcacacaacctttgacat

SEQ ID NO: 937358 - DNA, 25 bp, Mus musculus
gcagggagcacacctcatcctgtgc

SEQ ID NO: 937359 - DNA, 25 bp, Mus musculus
gcagggagcacagaacctttgacat

SEQ ID NO: 937360 - DNA, 25 bp, Mus musculus
gcagggagcacagctcatcctgtgc

SEQ ID NO: 937361 - DNA, 25 bp, Mus musculus
gcagggagccgcagcgtagaggcag

SEQ ID NO: 937362 - DNA, 25 bp, Mus musculus
gcagggagccgcagggtagaggcag

SEQ ID NO: 937363 - DNA, 25 bp, Mus musculus
gcagggagcgagagtgtgaacatgg

SEQ ID NO: 937364 - DNA, 25 bp, Mus musculus
gcagggagcgagtgtgtgaacatgg

SEQ ID NO: 937365 - DNA, 25 bp, Mus musculus
gcagggatttgcagcgaggaaaagc

SEQ ID NO: 937366 - DNA, 25 bp, Mus musculus
gcagggatttgcagggaggaaaagc

SEQ ID NO: 937367 - DNA, 25 bp, Mus musculus
gcagggcaagatccggactcttcag

SEQ ID NO: 937368 - DNA, 25 bp, Mus musculus
gcagggcaagttccggactcttcag

SEQ ID NO: 937369 - DNA, 25 bp, Mus musculus
gcagggcatcaacaagtcaacaaaa

SEQ ID NO: 937370 - DNA, 25 bp, Mus musculus
gcagggcatcaactattggctggat

SEQ ID NO: 937371 - DNA, 25 bp, Mus musculus
gcagggcatcaagaagtcaacaaaa

SEQ ID NO: 937372 - DNA, 25 bp, Mus musculus
gcagggcatcaagtattggctggat

SEQ ID NO: 937373 - DNA, 25 bp, Mus musculus
gcagggcatcatctataaaaagggg

SEQ ID NO: 937374 - DNA, 25 bp, Mus musculus
gcagggcatcatgtataaaaagggg

SEQ ID NO: 937375 - DNA, 25 bp, Mus musculus
gcagggccagaacgagctcccagcg

SEQ ID NO: 937376 - DNA, 25 bp, Mus musculus
gcagggccagaacgtgatggtgcag

SEQ ID NO: 937377 - DNA, 25 bp, Mus musculus
gcagggccagaaggagctcccagcg

SEQ ID NO: 937378 - DNA, 25 bp, Mus musculus
gcagggccagaaggtgatggtgcag

SEQ ID NO: 937379 - DNA, 25 bp, Mus musculus
gcagggccagagctgagcagcggct

SEQ ID NO: 937380 - DNA, 25 bp, Mus musculus
gcagggccagatgtagtgctgagca

SEQ ID NO: 937381 - DNA, 25 bp, Mus musculus
gcagggccagtgctgagcagcggct

SEQ ID NO: 937382 - DNA, 25 bp, Mus musculus
gcagggccagttgtagtgctgagca

SEQ ID NO: 937383 - DNA, 25 bp, Mus musculus
gcagggccctcacgaacaatggccc

SEQ ID NO: 937384 - DNA, 25 bp, Mus musculus
gcagggccctcaggaacaatggccc

SEQ ID NO: 937385 - DNA, 25 bp, Mus musculus
gcagggccgggagactcttggtctt

SEQ ID NO: 937386 - DNA, 25 bp, Mus musculus
gcagggccgggagagtcttggtctt

SEQ ID NO: 937387 - DNA, 25 bp, Mus musculus
gcagggccgtcgtgatggcgtctgg

SEQ ID NO: 937388 - DNA, 25 bp, Mus musculus
gcagggccgtcgtgttggcgtctgg

SEQ ID NO: 937389 - DNA, 25 bp, Mus musculus
gcagggcttaccaggtgtccctgga

SEQ ID NO: 937390 - DNA, 25 bp, Mus musculus
gcagggcttacctggtgtccctgga

SEQ ID NO: 937391 - DNA, 25 bp, Mus musculus
gcagggcttgctcttctcctcttgc

SEQ ID NO: 937392 - DNA, 25 bp, Mus musculus
gcagggcttgctgttctcctcttgc

SEQ ID NO: 937393 - DNA, 25 bp, Mus musculus
gcaggggaactccgagtgagcggcc

SEQ ID NO: 937394 - DNA, 25 bp, Mus musculus
gcaggggaactccgtgtgagcggcc

SEQ ID NO: 937395 - DNA, 25 bp, Mus musculus
gcaggggacaagatcacctttgcag

SEQ ID NO: 937396 - DNA, 25 bp, Mus musculus
gcaggggacaagatcacctttgtgg

SEQ ID NO: 937397 - DNA, 25 bp, Mus musculus
gcaggggacaagttcacctttgcag

SEQ ID NO: 937398 - DNA, 25 bp, Mus musculus
gcaggggacaagttcacctttgtgg

SEQ ID NO: 937399 - DNA, 25 bp, Mus musculus
gcaggggaggcacgtatggatgtat

SEQ ID NO: 937400 - DNA, 25 bp, Mus musculus
gcaggggaggcaggtatggatgtat

SEQ ID NO: 937401 - DNA, 25 bp, Mus musculus
gcaggggcccatttagaacatgaat

SEQ ID NO: 937402 - DNA, 25 bp, Mus musculus
gcaggggcccattttgaacatgaat

SEQ ID NO: 937403 - DNA, 25 bp, Mus musculus
gcaggggcctcacatcgaccaaaag

SEQ ID NO: 937404 - DNA, 25 bp, Mus musculus
gcaggggcctcacgtggatgaaact

SEQ ID NO: 937405 - DNA, 25 bp, Mus musculus
gcaggggcctcagatcgaccaaaag

SEQ ID NO: 937406 - DNA, 25 bp, Mus musculus
gcaggggcctcaggtggatgaaact

SEQ ID NO: 937407 - DNA, 25 bp, Mus musculus
gcaggggctcaacgcagacacgctg

SEQ ID NO: 937408 - DNA, 25 bp, Mus musculus
gcaggggctcaaggcagacacgctg

SEQ ID NO: 937409 - DNA, 25 bp, Mus musculus
gcaggggctgcacggggcacagcat

SEQ ID NO: 937410 - DNA, 25 bp, Mus musculus
gcaggggctgcagggggcacagcat

SEQ ID NO: 937411 - DNA, 25 bp, Mus musculus
gcagggggcgggatccagagcaacc

SEQ ID NO: 937412 - DNA, 25 bp, Mus musculus
gcagggggcgggttccagagcaacc

SEQ ID NO: 937413 - DNA, 25 bp, Mus musculus
gcaggggttcaaacagacccagtct

SEQ ID NO: 937414 - DNA, 25 bp, Mus musculus
gcaggggttcaatcagacccagtct

SEQ ID NO: 937415 - DNA, 25 bp, Mus musculus
gcaggggtttcacgcagaaaatgta

SEQ ID NO: 937416 - DNA, 25 bp, Mus musculus
gcaggggtttcacgtctgcattaca

SEQ ID NO: 937417 - DNA, 25 bp, Mus musculus
gcaggggtttcaggcagaaaatgta

SEQ ID NO: 937418 - DNA, 25 bp, Mus musculus
gcaggggtttcaggtctgcattaca

SEQ ID NO: 937419 - DNA, 25 bp, Mus musculus
gcagggtgcccagatgatggtagtg

SEQ ID NO: 937420 - DNA, 25 bp, Mus musculus
gcagggtgccgagatgatggtagtg

SEQ ID NO: 937421 - DNA, 25 bp, Mus musculus
gcagggtgtgagctaaccatcctgt

SEQ ID NO: 937422 - DNA, 25 bp, Mus musculus
gcagggtgtgaggtaaccatcctgt

SEQ ID NO: 937423 - DNA, 25 bp, Mus musculus
gcaggtaaagaaccaaatatgcccc

SEQ ID NO: 937424 - DNA, 25 bp, Mus musculus
gcaggtaaagtaccaaatatgcccc

SEQ ID NO: 937425 - DNA, 25 bp, Mus musculus
gcaggtaattaacgagatggtgcgg

SEQ ID NO: 937426 - DNA, 25 bp, Mus musculus
gcaggtaattagtgaaatggttaag

SEQ ID NO: 937427 - DNA, 25 bp, Mus musculus
gcaggtaatttacgagatggtgcgg

SEQ ID NO: 937428 - DNA, 25 bp, Mus musculus
gcaggtaatttgtgaaatggttaag

SEQ ID NO: 937429 - DNA, 25 bp, Mus musculus
gcaggtaccatacacaaatgcgatg

SEQ ID NO: 937430 - DNA, 25 bp, Mus musculus
gcaggtaccatacagaaatgcgatg

SEQ ID NO: 937431 - DNA, 25 bp, Mus musculus
gcaggtagccaaccttgaggcggcc

SEQ ID NO: 937432 - DNA, 25 bp, Mus musculus
gcaggtagccaagcttgaggcggcc

SEQ ID NO: 937433 - DNA, 25 bp, Mus musculus
gcaggtatccatgccgctgtgtgga

SEQ ID NO: 937434 - DNA, 25 bp, Mus musculus
gcaggtatccatgcggctgtgtgga

SEQ ID NO: 937435 - DNA, 25 bp, Mus musculus
gcaggtatgccacgttatccagtct

SEQ ID NO: 937436 - DNA, 25 bp, Mus musculus
gcaggtatgccaggttatccagtct

SEQ ID NO: 937437 - DNA, 25 bp, Mus musculus
gcaggtcaaccacggaaaatgccaa

SEQ ID NO: 937438 - DNA, 25 bp, Mus musculus
gcaggtcaaccagggaaaatgccaa

SEQ ID NO: 937439 - DNA, 25 bp, Mus musculus
gcaggtcaacttacagataccatgg

SEQ ID NO: 937440 - DNA, 25 bp, Mus musculus
gcaggtcaacttactgataccatgg

SEQ ID NO: 937441 - DNA, 25 bp, Mus musculus
gcaggtcacctgcacgtattttatg

SEQ ID NO: 937442 - DNA, 25 bp, Mus musculus
gcaggtcacctgcaggtattttatg

SEQ ID NO: 937443 - DNA, 25 bp, Mus musculus
gcaggtccagagattccctactcct

SEQ ID NO: 937444 - DNA, 25 bp, Mus musculus
gcaggtccagagtttccctactcct

SEQ ID NO: 937445 - DNA, 25 bp, Mus musculus
gcaggtcgagacccagtaccactcc

SEQ ID NO: 937446 - DNA, 25 bp, Mus musculus
gcaggtcgagaccctgtaccactcc

SEQ ID NO: 937447 - DNA, 25 bp, Mus musculus
gcaggtctctactgcctacaagaag

SEQ ID NO: 937448 - DNA, 25 bp, Mus musculus
gcaggtctctactgcctatgtgaaa

SEQ ID NO: 937449 - DNA, 25 bp, Mus musculus
gcaggtctctactggctacaagaag

SEQ ID NO: 937450 - DNA, 25 bp, Mus musculus
gcaggtctctactggctatgtgaaa

SEQ ID NO: 937451 - DNA, 25 bp, Mus musculus
gcaggtgcagacaaaatgatcagag

SEQ ID NO: 937452 - DNA, 25 bp, Mus musculus
gcaggtgcagactaaatgatcagag

SEQ ID NO: 937453 - DNA, 25 bp, Mus musculus
gcaggtgctggcccccttgcagttg

SEQ ID NO: 937454 - DNA, 25 bp, Mus musculus
gcaggtgctggcccgcttgcagttg

SEQ ID NO: 937455 - DNA, 25 bp, Mus musculus
gcaggtggacagcaactcaatggaa

SEQ ID NO: 937456 - DNA, 25 bp, Mus musculus
gcaggtggacagcatctcaatggaa

SEQ ID NO: 937457 - DNA, 25 bp, Mus musculus
gcaggtgggagccacggtggagttc

SEQ ID NO: 937458 - DNA, 25 bp, Mus musculus
gcaggtgggagccagggtggagttc

SEQ ID NO: 937459 - DNA, 25 bp, Mus musculus
gcaggtggtccccgagtttgcaaat

SEQ ID NO: 937460 - DNA, 25 bp, Mus musculus
gcaggtggtccccgtgtttgcaaat

SEQ ID NO: 937461 - DNA, 25 bp, Mus musculus
gcaggtggtgaccatctgggcttca

SEQ ID NO: 937462 - DNA, 25 bp, Mus musculus
gcaggtggtgacgatctgggcttca

SEQ ID NO: 937463 - DNA, 25 bp, Mus musculus
gcaggtgttcgacgactctgccgct

SEQ ID NO: 937464 - DNA, 25 bp, Mus musculus
gcaggtgttcgaggactctgccgct

SEQ ID NO: 937465 - DNA, 25 bp, Mus musculus
gcaggtgttggacactgaatgccag

SEQ ID NO: 937466 - DNA, 25 bp, Mus musculus
gcaggtgttggaccagactgaatgc

SEQ ID NO: 937467 - DNA, 25 bp, Mus musculus
gcaggtgttggagactgaatgccag

SEQ ID NO: 937468 - DNA, 25 bp, Mus musculus
gcaggtgttggagcagactgaatgc

SEQ ID NO: 937469 - DNA, 25 bp, Mus musculus
gcaggttcagcgattccatttgtaa

SEQ ID NO: 937470 - DNA, 25 bp, Mus musculus
gcaggttcagcgtttccatttgtaa

SEQ ID NO: 937471 - DNA, 25 bp, Mus musculus
gcaggttcgaagatgtctatcagct

SEQ ID NO: 937472 - DNA, 25 bp, Mus musculus
gcaggttcgaagttgtctatcagct

SEQ ID NO: 937473 - DNA, 25 bp, Mus musculus
gcaggtttagaacacagcgtggaag

SEQ ID NO: 937474 - DNA, 25 bp, Mus musculus
gcaggtttagaagacagcgtggaag

SEQ ID NO: 937475 - DNA, 25 bp, Mus musculus
gcagtaaccgagctcacgtcgctcc

SEQ ID NO: 937476 - DNA, 25 bp, Mus musculus
gcagtaaccgaggtcacgtcgctcc

SEQ ID NO: 937477 - DNA, 25 bp, Mus musculus
gcagtaactgccaagaagacagcaa

SEQ ID NO: 937478 - DNA, 25 bp, Mus musculus
gcagtaactggcaagaagacagcaa

SEQ ID NO: 937479 - DNA, 25 bp, Mus musculus
gcagtaagacaaagccacctggaga

SEQ ID NO: 937480 - DNA, 25 bp, Mus musculus
gcagtaagacaatgccacctggaga

SEQ ID NO: 937481 - DNA, 25 bp, Mus musculus
gcagtaattccgaaatcaacatgca

SEQ ID NO: 937482 - DNA, 25 bp, Mus musculus
gcagtaattccgagtcctgaagaaa

SEQ ID NO: 937483 - DNA, 25 bp, Mus musculus
gcagtaattccgtaatcaacatgca

SEQ ID NO: 937484 - DNA, 25 bp, Mus musculus
gcagtaattccgtgtcctgaagaaa

SEQ ID NO: 937485 - DNA, 25 bp, Mus musculus
gcagtacaaacagtacttttgagga

SEQ ID NO: 937486 - DNA, 25 bp, Mus musculus
gcagtacaaagagtacttttgagga

SEQ ID NO: 937487 - DNA, 25 bp, Mus musculus
gcagtacaggcccacgtccccatca

SEQ ID NO: 937488 - DNA, 25 bp, Mus musculus
gcagtacaggcccaggtccccatca

SEQ ID NO: 937489 - DNA, 25 bp, Mus musculus
gcagtaccgagtcgagctggctgag

SEQ ID NO: 937490 - DNA, 25 bp, Mus musculus
gcagtaccgagtggagctggctgag

SEQ ID NO: 937491 - DNA, 25 bp, Mus musculus
gcagtaccgatgctaccagatgcta

SEQ ID NO: 937492 - DNA, 25 bp, Mus musculus
gcagtaccgatggtaccagatgcta

SEQ ID NO: 937493 - DNA, 25 bp, Mus musculus
gcagtacctaaaattctctacaata

SEQ ID NO: 937494 - DNA, 25 bp, Mus musculus
gcagtacctaaatttctctacaata

SEQ ID NO: 937495 - DNA, 25 bp, Mus musculus
gcagtacctgaactccaaggcactg

SEQ ID NO: 937496 - DNA, 25 bp, Mus musculus
gcagtacctgaagtccaaggcactg

SEQ ID NO: 937497 - DNA, 25 bp, Mus musculus
gcagtagcagtaataggaaagccgc

SEQ ID NO: 937498 - DNA, 25 bp, Mus musculus
gcagtagcagtaattggaaagccgc

SEQ ID NO: 937499 - DNA, 25 bp, Mus musculus
gcagtagccaattacagaatctggg

SEQ ID NO: 937500 - DNA, 25 bp, Mus musculus
gcagtagccaattagagaatctggg

SEQ ID NO: 937501 - DNA, 25 bp, Mus musculus
gcagtagcttccaacaaccccaaga

SEQ ID NO: 937502 - DNA, 25 bp, Mus musculus
gcagtagcttccaagaaccccaaga

SEQ ID NO: 937503 - DNA, 25 bp, Mus musculus
gcagtagtccaacatgcctttgagt

SEQ ID NO: 937504 - DNA, 25 bp, Mus musculus
gcagtagtccaactgattagaattt

SEQ ID NO: 937505 - DNA, 25 bp, Mus musculus
gcagtagtccaagatgcctttgagt

SEQ ID NO: 937506 - DNA, 25 bp, Mus musculus
gcagtagtccaagtgattagaattt

SEQ ID NO: 937507 - DNA, 25 bp, Mus musculus
gcagtatcacagcctgaagctggag

SEQ ID NO: 937508 - DNA, 25 bp, Mus musculus
gcagtatcacaggctgaagctggag

SEQ ID NO: 937509 - DNA, 25 bp, Mus musculus
gcagtatggaagatcccagaaatcc

SEQ ID NO: 937510 - DNA, 25 bp, Mus musculus
gcagtatggaagttcccagaaatcc

SEQ ID NO: 937511 - DNA, 25 bp, Mus musculus
gcagtatggagaccatcgagattga

SEQ ID NO: 937512 - DNA, 25 bp, Mus musculus
gcagtatggagagcatcgagattga

SEQ ID NO: 937513 - DNA, 25 bp, Mus musculus
gcagtattccaaagattttggccaa

SEQ ID NO: 937514 - DNA, 25 bp, Mus musculus
gcagtattccaatgattttggccaa

SEQ ID NO: 937515 - DNA, 25 bp, Mus musculus
gcagtatttgattttgaatacggca

SEQ ID NO: 937516 - DNA, 25 bp, Mus musculus
gcagtatttgtttttgaatacggca

SEQ ID NO: 937517 - DNA, 25 bp, Mus musculus
gcagtcaagaaaccctgtaccccag

SEQ ID NO: 937518 - DNA, 25 bp, Mus musculus
gcagtcaagaaacgacatctgattt

SEQ ID NO: 937519 - DNA, 25 bp, Mus musculus
gcagtcaagaaagcctgtaccccag

SEQ ID NO: 937520 - DNA, 25 bp, Mus musculus
gcagtcaagaaaggacatctgattt

SEQ ID NO: 937521 - DNA, 25 bp, Mus musculus
gcagtcacagctggataccctccgt

SEQ ID NO: 937522 - DNA, 25 bp, Mus musculus
gcagtcacaggtggataccctccgt

SEQ ID NO: 937523 - DNA, 25 bp, Mus musculus
gcagtccatgcagggttccagtacg

SEQ ID NO: 937524 - DNA, 25 bp, Mus musculus
gcagtccatggagggttccagtacg

SEQ ID NO: 937525 - DNA, 25 bp, Mus musculus
gcagtccccaaacgatgataatgaa

SEQ ID NO: 937526 - DNA, 25 bp, Mus musculus
gcagtccccaaaggatgataatgaa

SEQ ID NO: 937527 - DNA, 25 bp, Mus musculus
gcagtcctagaacgagatgcgattc

SEQ ID NO: 937528 - DNA, 25 bp, Mus musculus
gcagtcctagaaggagatgcgattc

SEQ ID NO: 937529 - DNA, 25 bp, Mus musculus
gcagtcctccattgaagacagcgag

SEQ ID NO: 937530 - DNA, 25 bp, Mus musculus
gcagtcctcctttgaagacagcgag

SEQ ID NO: 937531 - DNA, 25 bp, Mus musculus
gcagtcgaaagacgcagacatcgac

SEQ ID NO: 937532 - DNA, 25 bp, Mus musculus
gcagtcgaaagaggcagacatcgac

SEQ ID NO: 937533 - DNA, 25 bp, Mus musculus
gcagtcgctcctatcgcatgtgggc

SEQ ID NO: 937534 - DNA, 25 bp, Mus musculus
gcagtcgctcctatggcatgtgggc

SEQ ID NO: 937535 - DNA, 25 bp, Mus musculus
gcagtctcagctgcccccaaagcgg

SEQ ID NO: 937536 - DNA, 25 bp, Mus musculus
gcagtctcaggtgcccccaaagcgg

SEQ ID NO: 937537 - DNA, 25 bp, Mus musculus
gcagtctgacctctacaagaagact

SEQ ID NO: 937538 - DNA, 25 bp, Mus musculus
gcagtctgacctgtacaagaagact

SEQ ID NO: 937539 - DNA, 25 bp, Mus musculus
gcagtctgatggcgcagcagcagaa

SEQ ID NO: 937540 - DNA, 25 bp, Mus musculus
gcagtctgatggggcagcagcagaa

SEQ ID NO: 937541 - DNA, 25 bp, Mus musculus
gcagtcttctctcgaaacccaggct

SEQ ID NO: 937542 - DNA, 25 bp, Mus musculus
gcagtcttctctggaaacccaggct

SEQ ID NO: 937543 - DNA, 25 bp, Mus musculus
gcagtgaaacagctgggtgttaacc

SEQ ID NO: 937544 - DNA, 25 bp, Mus musculus
gcagtgaaacaggtgggtgttaacc

SEQ ID NO: 937545 - DNA, 25 bp, Mus musculus
gcagtgaagcgacgtcacagagagt

SEQ ID NO: 937546 - DNA, 25 bp, Mus musculus
gcagtgaagcgaggtcacagagagt

SEQ ID NO: 937547 - DNA, 25 bp, Mus musculus
gcagtgaccaaactctgcgctgagg

SEQ ID NO: 937548 - DNA, 25 bp, Mus musculus
gcagtgaccaaagtctgcgctgagg

SEQ ID NO: 937549 - DNA, 25 bp, Mus musculus
gcagtgagccagatgccttctggga

SEQ ID NO: 937550 - DNA, 25 bp, Mus musculus
gcagtgagccagttgccttctggga

SEQ ID NO: 937551 - DNA, 25 bp, Mus musculus
gcagtgattggacgtctgatagctg

SEQ ID NO: 937552 - DNA, 25 bp, Mus musculus
gcagtgattggaggtctgatagctg

SEQ ID NO: 937553 - DNA, 25 bp, Mus musculus
gcagtgcaaaaaccctatcaccaca

SEQ ID NO: 937554 - DNA, 25 bp, Mus musculus
gcagtgcaaaaagcctatcaccaca

SEQ ID NO: 937555 - DNA, 25 bp, Mus musculus
gcagtgcaggagcgacgactgacgt

SEQ ID NO: 937556 - DNA, 25 bp, Mus musculus
gcagtgcaggagggacgactgacgt

SEQ ID NO: 937557 - DNA, 25 bp, Mus musculus
gcagtgcctcctgccgtccacctcc

SEQ ID NO: 937558 - DNA, 25 bp, Mus musculus
gcagtgcctcctgcggtccacctcc

SEQ ID NO: 937559 - DNA, 25 bp, Mus musculus
gcagtgctagatgggtgcaaagctt

SEQ ID NO: 937560 - DNA, 25 bp, Mus musculus
gcagtgctagttgggtgcaaagctt

SEQ ID NO: 937561 - DNA, 25 bp, Mus musculus
gcagtgcttattatcctggataata

SEQ ID NO: 937562 - DNA, 25 bp, Mus musculus
gcagtgcttattatgctggataata

SEQ ID NO: 937563 - DNA, 25 bp, Mus musculus
gcagtggagactcagcaaatcggcc

SEQ ID NO: 937564 - DNA, 25 bp, Mus musculus
gcagtggagactcgtcttgctttgt

SEQ ID NO: 937565 - DNA, 25 bp, Mus musculus
gcagtggagactgagcaaatcggcc

SEQ ID NO: 937566 - DNA, 25 bp, Mus musculus
gcagtggagactggtcttgctttgt

SEQ ID NO: 937567 - DNA, 25 bp, Mus musculus
gcagtggaggcaaacgatcgtaaga

SEQ ID NO: 937568 - DNA, 25 bp, Mus musculus
gcagtggaggcaaaggatcgtaaga

SEQ ID NO: 937569 - DNA, 25 bp, Mus musculus
gcagtggatggagacgttcgggcct

SEQ ID NO: 937570 - DNA, 25 bp, Mus musculus
gcagtggatggagaggttcgggcct

SEQ ID NO: 937571 - DNA, 25 bp, Mus musculus
gcagtggcataacgtacagaaagtt

SEQ ID NO: 937572 - DNA, 25 bp, Mus musculus
gcagtggcataaggtacagaaagtt

SEQ ID NO: 937573 - DNA, 25 bp, Mus musculus
gcagtggcgcagatttactttcaag

SEQ ID NO: 937574 - DNA, 25 bp, Mus musculus
gcagtggcgcagcatggcgcagaag

SEQ ID NO: 937575 - DNA, 25 bp, Mus musculus
gcagtggcgcaggatggcgcagaag

SEQ ID NO: 937576 - DNA, 25 bp, Mus musculus
gcagtggcgcagttttactttcaag

SEQ ID NO: 937577 - DNA, 25 bp, Mus musculus
gcagtggcgccgtccagaggaccag

SEQ ID NO: 937578 - DNA, 25 bp, Mus musculus
gcagtggcgcggtccagaggaccag

SEQ ID NO: 937579 - DNA, 25 bp, Mus musculus
gcagtgggaaagcgagtcatgtggc

SEQ ID NO: 937580 - DNA, 25 bp, Mus musculus
gcagtgggaaagggagtcatgtggc

SEQ ID NO: 937581 - DNA, 25 bp, Mus musculus
gcagtgggagaaagatgatgacata

SEQ ID NO: 937582 - DNA, 25 bp, Mus musculus
gcagtgggagtaagatgatgacata

SEQ ID NO: 937583 - DNA, 25 bp, Mus musculus
gcagtgggtggacgtggaacgcacg

SEQ ID NO: 937584 - DNA, 25 bp, Mus musculus
gcagtgggtggaggtggaacgcacg

SEQ ID NO: 937585 - DNA, 25 bp, Mus musculus
gcagtggtggagctcagagtcagag

SEQ ID NO: 937586 - DNA, 25 bp, Mus musculus
gcagtggtggagctcagggtagtac

SEQ ID NO: 937587 - DNA, 25 bp, Mus musculus
gcagtggtggaggtcagagtcagag

SEQ ID NO: 937588 - DNA, 25 bp, Mus musculus
gcagtggtggaggtcagggtagtac

SEQ ID NO: 937589 - DNA, 25 bp, Mus musculus
gcagtgtcagagctgccctaggaga

SEQ ID NO: 937590 - DNA, 25 bp, Mus musculus
gcagtgtcagatcctttctagattc

SEQ ID NO: 937591 - DNA, 25 bp, Mus musculus
gcagtgtcagtgctgccctaggaga

SEQ ID NO: 937592 - DNA, 25 bp, Mus musculus
gcagtgtcagttcctttctagattc

SEQ ID NO: 937593 - DNA, 25 bp, Mus musculus
gcagtgtgacagccctcacgtagtc

SEQ ID NO: 937594 - DNA, 25 bp, Mus musculus
gcagtgtgacaggcctcacgtagtc

SEQ ID NO: 937595 - DNA, 25 bp, Mus musculus
gcagtgtgcccacgaccctgagctc

SEQ ID NO: 937596 - DNA, 25 bp, Mus musculus
gcagtgtgcccaggaccctgagctc

SEQ ID NO: 937597 - DNA, 25 bp, Mus musculus
gcagtgtgtgaaccaaggagaactc

SEQ ID NO: 937598 - DNA, 25 bp, Mus musculus
gcagtgtgtgaagcaaggagaactc

SEQ ID NO: 937599 - DNA, 25 bp, Mus musculus
gcagtgttacaacagttggtgaaaa

SEQ ID NO: 937600 - DNA, 25 bp, Mus musculus
gcagtgttacaagagttggtgaaaa

SEQ ID NO: 937601 - DNA, 25 bp, Mus musculus
gcagttaaccagagctgagcctacc

SEQ ID NO: 937602 - DNA, 25 bp, Mus musculus
gcagttaaccagtgctgagcctacc

SEQ ID NO: 937603 - DNA, 25 bp, Mus musculus
gcagttaccacacgacaacaacagg

SEQ ID NO: 937604 - DNA, 25 bp, Mus musculus
gcagttaccacaggacaacaacagg

SEQ ID NO: 937605 - DNA, 25 bp, Mus musculus
gcagttacgtagctctggtcagcta

SEQ ID NO: 937606 - DNA, 25 bp, Mus musculus
gcagttacgtaggtctggtcagcta

SEQ ID NO: 937607 - DNA, 25 bp, Mus musculus
gcagttagcagtcaaactcagcaac

SEQ ID NO: 937608 - DNA, 25 bp, Mus musculus
gcagttagcagtcaatatatggact

SEQ ID NO: 937609 - DNA, 25 bp, Mus musculus
gcagttagcagtcatactcagcaac

SEQ ID NO: 937610 - DNA, 25 bp, Mus musculus
gcagttagcagtcattatatggact

SEQ ID NO: 937611 - DNA, 25 bp, Mus musculus
gcagttatgcagaacttgtcacaaa

SEQ ID NO: 937612 - DNA, 25 bp, Mus musculus
gcagttatgcagtacttgtcacaaa

SEQ ID NO: 937613 - DNA, 25 bp, Mus musculus
gcagttattgtgcattctcaaacaa

SEQ ID NO: 937614 - DNA, 25 bp, Mus musculus
gcagttattgtggattctcaaacaa

SEQ ID NO: 937615 - DNA, 25 bp, Mus musculus
gcagttcaaacacctctatgaactg

SEQ ID NO: 937616 - DNA, 25 bp, Mus musculus
gcagttcaaacagctctatgaactg

SEQ ID NO: 937617 - DNA, 25 bp, Mus musculus
gcagttcaagaagcgttctgtggag

SEQ ID NO: 937618 - DNA, 25 bp, Mus musculus
gcagttcaagccaataaaagcgaaa

SEQ ID NO: 937619 - DNA, 25 bp, Mus musculus
gcagttcaagcctccggcctatctg

SEQ ID NO: 937620 - DNA, 25 bp, Mus musculus
gcagttcaagcgctaacttaaagag

SEQ ID NO: 937621 - DNA, 25 bp, Mus musculus
gcagttcaaggcaataaaagcgaaa

SEQ ID NO: 937622 - DNA, 25 bp, Mus musculus
gcagttcaaggctccggcctatctg

SEQ ID NO: 937623 - DNA, 25 bp, Mus musculus
gcagttcaagggctaacttaaagag

SEQ ID NO: 937624 - DNA, 25 bp, Mus musculus
gcagttcaagtagcgttctgtggag

SEQ ID NO: 937625 - DNA, 25 bp, Mus musculus
gcagttcacgattctcgagcaggtg

SEQ ID NO: 937626 - DNA, 25 bp, Mus musculus
gcagttcacgtttctcgagcaggtg

SEQ ID NO: 937627 - DNA, 25 bp, Mus musculus
gcagttcagtagctatgagccagaa

SEQ ID NO: 937628 - DNA, 25 bp, Mus musculus
gcagttcagtaggtatgagccagaa

SEQ ID NO: 937629 - DNA, 25 bp, Mus musculus
gcagttccaacaatccccaaagcca

SEQ ID NO: 937630 - DNA, 25 bp, Mus musculus
gcagttccaacattccccaaagcca

SEQ ID NO: 937631 - DNA, 25 bp, Mus musculus
gcagttcccaagaaccattcatttc

SEQ ID NO: 937632 - DNA, 25 bp, Mus musculus
gcagttcccaagaagcattcatttc

SEQ ID NO: 937633 - DNA, 25 bp, Mus musculus
gcagttccgaaagaagtggaataag

SEQ ID NO: 937634 - DNA, 25 bp, Mus musculus
gcagttccgaaagatgtggaataag

SEQ ID NO: 937635 - DNA, 25 bp, Mus musculus
gcagttccgcagcctcagggaagac

SEQ ID NO: 937636 - DNA, 25 bp, Mus musculus
gcagttccgcaggctcagggaagac

SEQ ID NO: 937637 - DNA, 25 bp, Mus musculus
gcagttccgtcacgtatctacagaa

SEQ ID NO: 937638 - DNA, 25 bp, Mus musculus
gcagttccgtcaggtatctacagaa

SEQ ID NO: 937639 - DNA, 25 bp, Mus musculus
gcagttcgcagaacagaaactggac

SEQ ID NO: 937640 - DNA, 25 bp, Mus musculus
gcagttcgcagatcagaaactggac

SEQ ID NO: 937641 - DNA, 25 bp, Mus musculus
gcagttctcatgcacgcctatcgct

SEQ ID NO: 937642 - DNA, 25 bp, Mus musculus
gcagttctcatgcaggcctatcgct

SEQ ID NO: 937643 - DNA, 25 bp, Mus musculus
gcagttgcagcaatctcagcaaatg

SEQ ID NO: 937644 - DNA, 25 bp, Mus musculus
gcagttgcaggaatctcagcaaatg

SEQ ID NO: 937645 - DNA, 25 bp, Mus musculus
gcagttgctccccacccctgaggtg

SEQ ID NO: 937646 - DNA, 25 bp, Mus musculus
gcagttgctccccagccctgaggtg

SEQ ID NO: 937647 - DNA, 25 bp, Mus musculus
gcagtttatccccagccggcgattg

SEQ ID NO: 937648 - DNA, 25 bp, Mus musculus
gcagtttatcccgagccggcgattg

SEQ ID NO: 937649 - DNA, 25 bp, Mus musculus
gcagtttgagcagtgcatttcccag

SEQ ID NO: 937650 - DNA, 25 bp, Mus musculus
gcagtttgaggagtgcatttcccag

SEQ ID NO: 937651 - DNA, 25 bp, Mus musculus
gcagtttgcggttgaaaatggaaga

SEQ ID NO: 937652 - DNA, 25 bp, Mus musculus
gcagtttgcggttgtaaatggaaga

SEQ ID NO: 937653 - DNA, 25 bp, Mus musculus
gcagtttgtgcagggcgtgcgcatg

SEQ ID NO: 937654 - DNA, 25 bp, Mus musculus
gcagtttgtggagggcgtgcgcatg

SEQ ID NO: 937655 - DNA, 25 bp, Mus musculus
gcagtttttgagaccggtgctcggc

SEQ ID NO: 937656 - DNA, 25 bp, Mus musculus
gcagtttttgagacgggtgctcggc

SEQ ID NO: 937657 - DNA, 25 bp, Mus musculus
gcataaaaggaacagagaattcaac

SEQ ID NO: 937658 - DNA, 25 bp, Mus musculus
gcataaaaggaaccagagagaattc

SEQ ID NO: 937659 - DNA, 25 bp, Mus musculus
gcataaaaggaagagagaattcaac

SEQ ID NO: 937660 - DNA, 25 bp, Mus musculus
gcataaaaggaagcagagagaattc

SEQ ID NO: 937661 - DNA, 25 bp, Mus musculus
gcataaaatcagctgctcgactgat

SEQ ID NO: 937662 - DNA, 25 bp, Mus musculus
gcataaaatcaggtgctcgactgat

SEQ ID NO: 937663 - DNA, 25 bp, Mus musculus
gcataaatgagacgactgcctgggt

SEQ ID NO: 937664 - DNA, 25 bp, Mus musculus
gcataaatgagaggactgcctgggt

SEQ ID NO: 937665 - DNA, 25 bp, Mus musculus
gcataaattgaatctgtataaactg

SEQ ID NO: 937666 - DNA, 25 bp, Mus musculus
gcataaattgtatctgtataaactg

SEQ ID NO: 937667 - DNA, 25 bp, Mus musculus
gcataacaagatttggcaagaaaac

SEQ ID NO: 937668 - DNA, 25 bp, Mus musculus
gcataacaagttttggcaagaaaac

SEQ ID NO: 937669 - DNA, 25 bp, Mus musculus
gcataactaaagcttatgaaatgtt

SEQ ID NO: 937670 - DNA, 25 bp, Mus musculus
gcataactaaaggttatgaaatgtt

SEQ ID NO: 937671 - DNA, 25 bp, Mus musculus
gcataacttcctcagaaggacttga

SEQ ID NO: 937672 - DNA, 25 bp, Mus musculus
gcataacttcctgagaaggacttga

SEQ ID NO: 937673 - DNA, 25 bp, Mus musculus
gcataagacatacacgggcatgacc

SEQ ID NO: 937674 - DNA, 25 bp, Mus musculus
gcataagacatacaggggcatgacc

SEQ ID NO: 937675 - DNA, 25 bp, Mus musculus
gcataataccgaggcgccatacaat

SEQ ID NO: 937676 - DNA, 25 bp, Mus musculus
gcataataccgaggggccatacaat

SEQ ID NO: 937677 - DNA, 25 bp, Mus musculus
gcataatagcaacgattggagaagc

SEQ ID NO: 937678 - DNA, 25 bp, Mus musculus
gcataatagcaaggattggagaagc

SEQ ID NO: 937679 - DNA, 25 bp, Mus musculus
gcataatgggaacgaccaaggacac

SEQ ID NO: 937680 - DNA, 25 bp, Mus musculus
gcataatgggaaggaccaaggacac

SEQ ID NO: 937681 - DNA, 25 bp, Mus musculus
gcatacaaattgctttcatgactta

SEQ ID NO: 937682 - DNA, 25 bp, Mus musculus
gcatacaaattggtttcatgactta

SEQ ID NO: 937683 - DNA, 25 bp, Mus musculus
gcatacactgagccctctcacatcc

SEQ ID NO: 937684 - DNA, 25 bp, Mus musculus
gcatacactgtgccctctcacatcc

SEQ ID NO: 937685 - DNA, 25 bp, Mus musculus
gcatacagtctgcaggaagaaggac

SEQ ID NO: 937686 - DNA, 25 bp, Mus musculus
gcatacagtctggaggaagaaggac

SEQ ID NO: 937687 - DNA, 25 bp, Mus musculus
gcatacctcgcacacaggaagtatg

SEQ ID NO: 937688 - DNA, 25 bp, Mus musculus
gcatacctcgcacagaggaagtatg

SEQ ID NO: 937689 - DNA, 25 bp, Mus musculus
gcatactttatacgactcattctga

SEQ ID NO: 937690 - DNA, 25 bp, Mus musculus
gcatactttataggactcattctga

SEQ ID NO: 937691 - DNA, 25 bp, Mus musculus
gcataggacattatccttcccgtcg

SEQ ID NO: 937692 - DNA, 25 bp, Mus musculus
gcataggacattttccttcccgtcg

SEQ ID NO: 937693 - DNA, 25 bp, Mus musculus
gcatagttctttctaaaatgatcaa

SEQ ID NO: 937694 - DNA, 25 bp, Mus musculus
gcatagttctttgtaaaatgatcaa

SEQ ID NO: 937695 - DNA, 25 bp, Mus musculus
gcatataaactgccgagatgtccct

SEQ ID NO: 937696 - DNA, 25 bp, Mus musculus
gcatataaactggcgagatgtccct

SEQ ID NO: 937697 - DNA, 25 bp, Mus musculus
gcatataattcaatttgaccagcct

SEQ ID NO: 937698 - DNA, 25 bp, Mus musculus
gcatataattcattttgaccagcct

SEQ ID NO: 937699 - DNA, 25 bp, Mus musculus
gcatatattttattaatttcagtaa

SEQ ID NO: 937700 - DNA, 25 bp, Mus musculus
gcatatattttatttatttcagtaa

SEQ ID NO: 937701 - DNA, 25 bp, Mus musculus
gcatatccagcagacatgttcagcc

SEQ ID NO: 937702 - DNA, 25 bp, Mus musculus
gcatatccagcagagatgttcagcc

SEQ ID NO: 937703 - DNA, 25 bp, Mus musculus
gcatatctaccacgtaagattaaaa

SEQ ID NO: 937704 - DNA, 25 bp, Mus musculus
gcatatctaccaggtaagattaaaa

SEQ ID NO: 937705 - DNA, 25 bp, Mus musculus
gcatatgcagaagacaagaaaaatt

SEQ ID NO: 937706 - DNA, 25 bp, Mus musculus
gcatatgcagaagacttagcaaaac

SEQ ID NO: 937707 - DNA, 25 bp, Mus musculus
gcatatgcagaagagaagaaaaatt

SEQ ID NO: 937708 - DNA, 25 bp, Mus musculus
gcatatgcagaagagttagcaaaac

SEQ ID NO: 937709 - DNA, 25 bp, Mus musculus
gcatatgcgctgctggacgcagacg

SEQ ID NO: 937710 - DNA, 25 bp, Mus musculus
gcatatgcgctgcttccagatgcct

SEQ ID NO: 937711 - DNA, 25 bp, Mus musculus
gcatatgcgctggtggacgcagacg

SEQ ID NO: 937712 - DNA, 25 bp, Mus musculus
gcatatgcgctggttccagatgcct

SEQ ID NO: 937713 - DNA, 25 bp, Mus musculus
gcatatgctgatcctgggcataact

SEQ ID NO: 937714 - DNA, 25 bp, Mus musculus
gcatatgctgttcctgggcataact

SEQ ID NO: 937715 - DNA, 25 bp, Mus musculus
gcatatgtacagacccagaagtatc

SEQ ID NO: 937716 - DNA, 25 bp, Mus musculus
gcatatgtacagccagaccgaaggc

SEQ ID NO: 937717 - DNA, 25 bp, Mus musculus
gcatatgtacaggcagaccgaaggc

SEQ ID NO: 937718 - DNA, 25 bp, Mus musculus
gcatatgtacagtcccagaagtatc

SEQ ID NO: 937719 - DNA, 25 bp, Mus musculus
gcatatgtatgccacgttatgaagg

SEQ ID NO: 937720 - DNA, 25 bp, Mus musculus
gcatatgtatgccaggttatgaagg

SEQ ID NO: 937721 - DNA, 25 bp, Mus musculus
gcatattcagagctctatcgtccaa

SEQ ID NO: 937722 - DNA, 25 bp, Mus musculus
gcatattcagaggtctatcgtccaa

SEQ ID NO: 937723 - DNA, 25 bp, Mus musculus
gcatcaaacaaggaggaatcgtctt

SEQ ID NO: 937724 - DNA, 25 bp, Mus musculus
gcatcaaacaatttgtcgtcctact

SEQ ID NO: 937725 - DNA, 25 bp, Mus musculus
gcatcaaacatggaggaatcgtctt

SEQ ID NO: 937726 - DNA, 25 bp, Mus musculus
gcatcaaacattttgtcgtcctact

SEQ ID NO: 937727 - DNA, 25 bp, Mus musculus
gcatcaacagaataaccagagctct

SEQ ID NO: 937728 - DNA, 25 bp, Mus musculus
gcatcaacagccaaccctctgagag

SEQ ID NO: 937729 - DNA, 25 bp, Mus musculus
gcatcaacagccaagcctctgagag

SEQ ID NO: 937730 - DNA, 25 bp, Mus musculus
gcatcaacagccaaggtagagatca

SEQ ID NO: 937731 - DNA, 25 bp, Mus musculus
gcatcaacaggcaaggtagagatca

SEQ ID NO: 937732 - DNA, 25 bp, Mus musculus
gcatcaacagtataaccagagctct

SEQ ID NO: 937733 - DNA, 25 bp, Mus musculus
gcatcaagaatgaactgtatcccct

SEQ ID NO: 937734 - DNA, 25 bp, Mus musculus
gcatcaagaatgaagtgtatcccct

SEQ ID NO: 937735 - DNA, 25 bp, Mus musculus
gcatcaaggacacatcaacaaggat

SEQ ID NO: 937736 - DNA, 25 bp, Mus musculus
gcatcaaggagacatcaacaaggat

SEQ ID NO: 937737 - DNA, 25 bp, Mus musculus
gcatcaaggagcaggacatcaacaa

SEQ ID NO: 937738 - DNA, 25 bp, Mus musculus
gcatcaaggagctggacatcaacaa

SEQ ID NO: 937739 - DNA, 25 bp, Mus musculus
gcatcacactagatctttccagtgg

SEQ ID NO: 937740 - DNA, 25 bp, Mus musculus
gcatcacactagttctttccagtgg

SEQ ID NO: 937741 - DNA, 25 bp, Mus musculus
gcatcacagccccccttcagtatgg

SEQ ID NO: 937742 - DNA, 25 bp, Mus musculus
gcatcacagcccccgttcagtatgg

SEQ ID NO: 937743 - DNA, 25 bp, Mus musculus
gcatcacagtgacacggcccaatgt

SEQ ID NO: 937744 - DNA, 25 bp, Mus musculus
gcatcacagtgacagggcccaatgt

SEQ ID NO: 937745 - DNA, 25 bp, Mus musculus
gcatcaccagctggtacagaggatc

SEQ ID NO: 937746 - DNA, 25 bp, Mus musculus
gcatcaccaggtggtacagaggatc

SEQ ID NO: 937747 - DNA, 25 bp, Mus musculus
gcatcacccaggaactgatggcctg

SEQ ID NO: 937748 - DNA, 25 bp, Mus musculus
gcatcacccaggaagtgatggcctg

SEQ ID NO: 937749 - DNA, 25 bp, Mus musculus
gcatcacgctaacgattctgagggc

SEQ ID NO: 937750 - DNA, 25 bp, Mus musculus
gcatcacgctaaggattctgagggc

SEQ ID NO: 937751 - DNA, 25 bp, Mus musculus
gcatcactcaagcagaagctgtgtg

SEQ ID NO: 937752 - DNA, 25 bp, Mus musculus
gcatcactcaaggagaagctgtgtg

SEQ ID NO: 937753 - DNA, 25 bp, Mus musculus
gcatcactgcagatcagagtaaagg

SEQ ID NO: 937754 - DNA, 25 bp, Mus musculus
gcatcactgcagttcagagtaaagg

SEQ ID NO: 937755 - DNA, 25 bp, Mus musculus
gcatcagacaggccaacgtttcata

SEQ ID NO: 937756 - DNA, 25 bp, Mus musculus
gcatcagacagggcaacgtttcata

SEQ ID NO: 937757 - DNA, 25 bp, Mus musculus
gcatcagcaaagcatcgaccattat

SEQ ID NO: 937758 - DNA, 25 bp, Mus musculus
gcatcagcaaaggatcgaccattat

SEQ ID NO: 937759 - DNA, 25 bp, Mus musculus
gcatcagcacgaatcgtgcagtctt

SEQ ID NO: 937760 - DNA, 25 bp, Mus musculus
gcatcagcacgaatggtgcagtctt

SEQ ID NO: 937761 - DNA, 25 bp, Mus musculus
gcatcagccacagacgccgttccca

SEQ ID NO: 937762 - DNA, 25 bp, Mus musculus
gcatcagccacagaggccgttccca

SEQ ID NO: 937763 - DNA, 25 bp, Mus musculus
gcatcaggactcacaggtaaatgca

SEQ ID NO: 937764 - DNA, 25 bp, Mus musculus
gcatcaggactctcaggtaaatgca

SEQ ID NO: 937765 - DNA, 25 bp, Mus musculus
gcatcaggcgctgaccatgccccca

SEQ ID NO: 937766 - DNA, 25 bp, Mus musculus
gcatcaggcggtgaccatgccccca

SEQ ID NO: 937767 - DNA, 25 bp, Mus musculus
gcatcagtatacatcggagactctg

SEQ ID NO: 937768 - DNA, 25 bp, Mus musculus
gcatcagtatacatgggagactctg

SEQ ID NO: 937769 - DNA, 25 bp, Mus musculus
gcatcagtgacgctaaaccagtcag

SEQ ID NO: 937770 - DNA, 25 bp, Mus musculus
gcatcagtgacggtaaaccagtcag

SEQ ID NO: 937771 - DNA, 25 bp, Mus musculus
gcatcatacaagattgtgtggccat

SEQ ID NO: 937772 - DNA, 25 bp, Mus musculus
gcatcatacaagtttgtgtggccat

SEQ ID NO: 937773 - DNA, 25 bp, Mus musculus
gcatcatccttaccagggagaagaa

SEQ ID NO: 937774 - DNA, 25 bp, Mus musculus
gcatcatccttagcagggagaagaa

SEQ ID NO: 937775 - DNA, 25 bp, Mus musculus
gcatcatgaacccagactataatgt

SEQ ID NO: 937776 - DNA, 25 bp, Mus musculus
gcatcatgaagccagactataatgt

SEQ ID NO: 937777 - DNA, 25 bp, Mus musculus
gcatcatttaatcgtcaggggagta

SEQ ID NO: 937778 - DNA, 25 bp, Mus musculus
gcatcatttaatggtcaggggagta

SEQ ID NO: 937779 - DNA, 25 bp, Mus musculus
gcatccagacaacgcacaagtgaga

SEQ ID NO: 937780 - DNA, 25 bp, Mus musculus
gcatccagacaaggcacaagtgaga

SEQ ID NO: 937781 - DNA, 25 bp, Mus musculus
gcatccagagcatgctgcccagaaa

SEQ ID NO: 937782 - DNA, 25 bp, Mus musculus
gcatccagagctctggtagcagcct

SEQ ID NO: 937783 - DNA, 25 bp, Mus musculus
gcatccagaggatgctgcccagaaa

SEQ ID NO: 937784 - DNA, 25 bp, Mus musculus
gcatccagaggtctggtagcagcct

SEQ ID NO: 937785 - DNA, 25 bp, Mus musculus
gcatccaggccaaattagaaaaagt

SEQ ID NO: 937786 - DNA, 25 bp, Mus musculus
gcatccaggccatattagaaaaagt

SEQ ID NO: 937787 - DNA, 25 bp, Mus musculus
gcatccagggacatgttggtgccag

SEQ ID NO: 937788 - DNA, 25 bp, Mus musculus
gcatccagggtcatgttggtgccag

SEQ ID NO: 937789 - DNA, 25 bp, Mus musculus
gcatccagtcaacggcctttgatac

SEQ ID NO: 937790 - DNA, 25 bp, Mus musculus
gcatccagtcaagggcctttgatac

SEQ ID NO: 937791 - DNA, 25 bp, Mus musculus
gcatccatgcagaattcaagagaca

SEQ ID NO: 937792 - DNA, 25 bp, Mus musculus
gcatccatgcagtattcaagagaca

SEQ ID NO: 937793 - DNA, 25 bp, Mus musculus
gcatcccaaccacgcagaactcatt

SEQ ID NO: 937794 - DNA, 25 bp, Mus musculus
gcatcccaaccaggcagaactcatt

SEQ ID NO: 937795 - DNA, 25 bp, Mus musculus
gcatccccaaagatctccctgagac

SEQ ID NO: 937796 - DNA, 25 bp, Mus musculus
gcatccccaaagttctccctgagac

SEQ ID NO: 937797 - DNA, 25 bp, Mus musculus
gcatcccctatgatcctatacactg

SEQ ID NO: 937798 - DNA, 25 bp, Mus musculus
gcatcccctatgttcctatacactg

SEQ ID NO: 937799 - DNA, 25 bp, Mus musculus
gcatccctgtggcacgtgaccttgg

SEQ ID NO: 937800 - DNA, 25 bp, Mus musculus
gcatccctgtggcactggaggtgaa

SEQ ID NO: 937801 - DNA, 25 bp, Mus musculus
gcatccctgtggcaggtgaccttgg

SEQ ID NO: 937802 - DNA, 25 bp, Mus musculus
gcatccctgtggcagtggaggtgaa

SEQ ID NO: 937803 - DNA, 25 bp, Mus musculus
gcatcccttgtaaacaaacgtgtga

SEQ ID NO: 937804 - DNA, 25 bp, Mus musculus
gcatcccttgtaaagaaacgtgtga

SEQ ID NO: 937805 - DNA, 25 bp, Mus musculus
gcatccgtatcaactcaacaaggac

SEQ ID NO: 937806 - DNA, 25 bp, Mus musculus
gcatccgtatcaagacatgttcagc

SEQ ID NO: 937807 - DNA, 25 bp, Mus musculus
gcatccgtatcatctcaacaaggac

SEQ ID NO: 937808 - DNA, 25 bp, Mus musculus
gcatccgtatcatgacatgttcagc

SEQ ID NO: 937809 - DNA, 25 bp, Mus musculus
gcatcctacggtcacgaaaccgcat

SEQ ID NO: 937810 - DNA, 25 bp, Mus musculus
gcatcctacggtcaggaaaccgcat

SEQ ID NO: 937811 - DNA, 25 bp, Mus musculus
gcatcctcagctatttggagagctg

SEQ ID NO: 937812 - DNA, 25 bp, Mus musculus
gcatcctcaggtatttggagagctg

SEQ ID NO: 937813 - DNA, 25 bp, Mus musculus
gcatcctctgtggacgctttggcca

SEQ ID NO: 937814 - DNA, 25 bp, Mus musculus
gcatcctctgtggaggctttggcca

SEQ ID NO: 937815 - DNA, 25 bp, Mus musculus
gcatcctgaaagcggtgaaccttca

SEQ ID NO: 937816 - DNA, 25 bp, Mus musculus
gcatcctgaaaggggtgaaccttca

SEQ ID NO: 937817 - DNA, 25 bp, Mus musculus
gcatcctgtaaatggaacacgagac

SEQ ID NO: 937818 - DNA, 25 bp, Mus musculus
gcatcctgtatatggaacacgagac

SEQ ID NO: 937819 - DNA, 25 bp, Mus musculus
gcatcctgtccccaaacaagccttc

SEQ ID NO: 937820 - DNA, 25 bp, Mus musculus
gcatcctgtcccgaaacaagccttc

SEQ ID NO: 937821 - DNA, 25 bp, Mus musculus
gcatccttgctattcctcctgggcc

SEQ ID NO: 937822 - DNA, 25 bp, Mus musculus
gcatccttgctattgctcctgggcc

SEQ ID NO: 937823 - DNA, 25 bp, Mus musculus
gcatcgaagcgtttcatgactccgg

SEQ ID NO: 937824 - DNA, 25 bp, Mus musculus
gcatcgaagcgtttccaatcccgga

SEQ ID NO: 937825 - DNA, 25 bp, Mus musculus
gcatcgaagcgtttcgctccttccg

SEQ ID NO: 937826 - DNA, 25 bp, Mus musculus
gcatcgaagcgtttgatgactccgg

SEQ ID NO: 937827 - DNA, 25 bp, Mus musculus
gcatcgaagcgtttgcaatcccgga

SEQ ID NO: 937828 - DNA, 25 bp, Mus musculus
gcatcgaagcgtttggctccttccg

SEQ ID NO: 937829 - DNA, 25 bp, Mus musculus
gcatcgagggcgctacccgactctt

SEQ ID NO: 937830 - DNA, 25 bp, Mus musculus
gcatcgagggggctacccgactctt

SEQ ID NO: 937831 - DNA, 25 bp, Mus musculus
gcatcgccaccacacgggaagaagt

SEQ ID NO: 937832 - DNA, 25 bp, Mus musculus
gcatcgccaccacaggggaagaagt

SEQ ID NO: 937833 - DNA, 25 bp, Mus musculus
gcatcgcctgcacggcatggaacaa

SEQ ID NO: 937834 - DNA, 25 bp, Mus musculus
gcatcgcctgcagggcatggaacaa

SEQ ID NO: 937835 - DNA, 25 bp, Mus musculus
gcatcggcagcacagcagcgctctc

SEQ ID NO: 937836 - DNA, 25 bp, Mus musculus
gcatcggcaggacagcagcgctctc

SEQ ID NO: 937837 - DNA, 25 bp, Mus musculus
gcatcggccagccacgtatgcactc

SEQ ID NO: 937838 - DNA, 25 bp, Mus musculus
gcatcggccagccaggtatgcactc

SEQ ID NO: 937839 - DNA, 25 bp, Mus musculus
gcatcgtcacagaatatgcttccct

SEQ ID NO: 937840 - DNA, 25 bp, Mus musculus
gcatcgtcacagtatatgcttccct

SEQ ID NO: 937841 - DNA, 25 bp, Mus musculus
gcatcgttcttccacccaaggaccc

SEQ ID NO: 937842 - DNA, 25 bp, Mus musculus
gcatcgttcttccagccaaggaccc

SEQ ID NO: 937843 - DNA, 25 bp, Mus musculus
gcatctaagaaaccttgtgatcagc

SEQ ID NO: 937844 - DNA, 25 bp, Mus musculus
gcatctaagaaagcttgtgatcagc

SEQ ID NO: 937845 - DNA, 25 bp, Mus musculus
gcatctaatatgaacgaagtactta

SEQ ID NO: 937846 - DNA, 25 bp, Mus musculus
gcatctaatatgaaggaagtactta

SEQ ID NO: 937847 - DNA, 25 bp, Mus musculus
gcatctaattcacatcatgattctg

SEQ ID NO: 937848 - DNA, 25 bp, Mus musculus
gcatctaattcagatcatgattctg

SEQ ID NO: 937849 - DNA, 25 bp, Mus musculus
gcatctacttacggctggcccgctc

SEQ ID NO: 937850 - DNA, 25 bp, Mus musculus
gcatctacttcagctgcgtgcagaa

SEQ ID NO: 937851 - DNA, 25 bp, Mus musculus
gcatctacttgagctgcgtgcagaa

SEQ ID NO: 937852 - DNA, 25 bp, Mus musculus
gcatctactttcggctggcccgctc

SEQ ID NO: 937853 - DNA, 25 bp, Mus musculus
gcatctagttgtcaggagtttaaga

SEQ ID NO: 937854 - DNA, 25 bp, Mus musculus
gcatctagttgtgaggagtttaaga

SEQ ID NO: 937855 - DNA, 25 bp, Mus musculus
gcatctatcaagcgagcaccatcat

SEQ ID NO: 937856 - DNA, 25 bp, Mus musculus
gcatctatcaagggagcaccatcat

SEQ ID NO: 937857 - DNA, 25 bp, Mus musculus
gcatctcaaaggcacgttcggggct

SEQ ID NO: 937858 - DNA, 25 bp, Mus musculus
gcatctcaaaggcaggttcggggct

SEQ ID NO: 937859 - DNA, 25 bp, Mus musculus
gcatctcaacaacgacttggctttt

SEQ ID NO: 937860 - DNA, 25 bp, Mus musculus
gcatctcaacaaggacttggctttt

SEQ ID NO: 937861 - DNA, 25 bp, Mus musculus
gcatctcagacacgtgtttgcccaa

SEQ ID NO: 937862 - DNA, 25 bp, Mus musculus
gcatctcagacaggtgtttgcccaa

SEQ ID NO: 937863 - DNA, 25 bp, Mus musculus
gcatctcaggcaactttataaaata

SEQ ID NO: 937864 - DNA, 25 bp, Mus musculus
gcatctcagggaactttataaaata

SEQ ID NO: 937865 - DNA, 25 bp, Mus musculus
gcatctccagctcccacctgctcgc

SEQ ID NO: 937866 - DNA, 25 bp, Mus musculus
gcatctccaggtcccacctgctcgc

SEQ ID NO: 937867 - DNA, 25 bp, Mus musculus
gcatctcctgtgacaagttattgga

SEQ ID NO: 937868 - DNA, 25 bp, Mus musculus
gcatctcctgtgactagttattgga

SEQ ID NO: 937869 - DNA, 25 bp, Mus musculus
gcatctcgacagcgcggagacgcgt

SEQ ID NO: 937870 - DNA, 25 bp, Mus musculus
gcatctcgacagcggggagacgcgt

SEQ ID NO: 937871 - DNA, 25 bp, Mus musculus
gcatctctcgctctatgccgtggtg

SEQ ID NO: 937872 - DNA, 25 bp, Mus musculus
gcatctctcggtctatgccgtggtg

SEQ ID NO: 937873 - DNA, 25 bp, Mus musculus
gcatctctgccgcgtcatcgagcat

SEQ ID NO: 937874 - DNA, 25 bp, Mus musculus
gcatctctgccgggtcatcgagcat

SEQ ID NO: 937875 - DNA, 25 bp, Mus musculus
gcatctgaaataataggatttttat

SEQ ID NO: 937876 - DNA, 25 bp, Mus musculus
gcatctgaaataattggatttttat

SEQ ID NO: 937877 - DNA, 25 bp, Mus musculus
gcatctgaagaggtggccatggccc

SEQ ID NO: 937878 - DNA, 25 bp, Mus musculus
gcatctgaagtggtggccatggccc

SEQ ID NO: 937879 - DNA, 25 bp, Mus musculus
gcatctgacaagctgcagcaagggt

SEQ ID NO: 937880 - DNA, 25 bp, Mus musculus
gcatctgacaaggtgcagcaagggt

SEQ ID NO: 937881 - DNA, 25 bp, Mus musculus
gcatctgatgaccaaactgtctgcc

SEQ ID NO: 937882 - DNA, 25 bp, Mus musculus
gcatctgatgaccatactgtctgcc

SEQ ID NO: 937883 - DNA, 25 bp, Mus musculus
gcatctgcacagctggccccaaagt

SEQ ID NO: 937884 - DNA, 25 bp, Mus musculus
gcatctgcacaggtggccccaaagt

SEQ ID NO: 937885 - DNA, 25 bp, Mus musculus
gcatctgccccagctgaagaggtag

SEQ ID NO: 937886 - DNA, 25 bp, Mus musculus
gcatctgcccgagctgaagaggtag

SEQ ID NO: 937887 - DNA, 25 bp, Mus musculus
gcatctgcctaacgatgacggtggc

SEQ ID NO: 937888 - DNA, 25 bp, Mus musculus
gcatctgccttacgatgacggtggc

SEQ ID NO: 937889 - DNA, 25 bp, Mus musculus
gcatctgggaagaagccaccatggg

SEQ ID NO: 937890 - DNA, 25 bp, Mus musculus
gcatctgggaagtagccaccatggg

SEQ ID NO: 937891 - DNA, 25 bp, Mus musculus
gcatctggtcatcccacgaacctct

SEQ ID NO: 937892 - DNA, 25 bp, Mus musculus
gcatctggtcatgccacgaacctct

SEQ ID NO: 937893 - DNA, 25 bp, Mus musculus
gcatctgtaataccaggatgctggt

SEQ ID NO: 937894 - DNA, 25 bp, Mus musculus
gcatctgtaatacgtgtgtgctgaa

SEQ ID NO: 937895 - DNA, 25 bp, Mus musculus
gcatctgtaatagcaggatgctggt

SEQ ID NO: 937896 - DNA, 25 bp, Mus musculus
gcatctgtaataggtgtgtgctgaa

SEQ ID NO: 937897 - DNA, 25 bp, Mus musculus
gcatctgttgtgctcaacttcatcc

SEQ ID NO: 937898 - DNA, 25 bp, Mus musculus
gcatctgttgtggtcaacttcatcc

SEQ ID NO: 937899 - DNA, 25 bp, Mus musculus
gcatcttctaagcttttccattatt

SEQ ID NO: 937900 - DNA, 25 bp, Mus musculus
gcatcttctaaggttttccattatt

SEQ ID NO: 937901 - DNA, 25 bp, Mus musculus
gcatcttgacaacacagaggagggc

SEQ ID NO: 937902 - DNA, 25 bp, Mus musculus
gcatcttgacaagacagaggagggc

SEQ ID NO: 937903 - DNA, 25 bp, Mus musculus
gcatcttggggtgaagggttcagca

SEQ ID NO: 937904 - DNA, 25 bp, Mus musculus
gcatcttggggtgatgggttcagca

SEQ ID NO: 937905 - DNA, 25 bp, Mus musculus
gcatgaaaagccccttgctgctgga

SEQ ID NO: 937906 - DNA, 25 bp, Mus musculus
gcatgaaaaggcccttgctgctgga

SEQ ID NO: 937907 - DNA, 25 bp, Mus musculus
gcatgaaacgatatgaacttccagc

SEQ ID NO: 937908 - DNA, 25 bp, Mus musculus
gcatgaaacgttatgaacttccagc

SEQ ID NO: 937909 - DNA, 25 bp, Mus musculus
gcatgaaaggcacaaacttggtaca

SEQ ID NO: 937910 - DNA, 25 bp, Mus musculus
gcatgaaaggcacatacttggtaca

SEQ ID NO: 937911 - DNA, 25 bp, Mus musculus
gcatgaagatcagacgaaacatcca

SEQ ID NO: 937912 - DNA, 25 bp, Mus musculus
gcatgaagatcagaggaaacatcca

SEQ ID NO: 937913 - DNA, 25 bp, Mus musculus
gcatgaagcgctcccgctctggtga

SEQ ID NO: 937914 - DNA, 25 bp, Mus musculus
gcatgaagcgggaacctgtgcagga

SEQ ID NO: 937915 - DNA, 25 bp, Mus musculus
gcatgaagcgggaagctgtgcagga

SEQ ID NO: 937916 - DNA, 25 bp, Mus musculus
gcatgaagcggtcccgctctggtga

SEQ ID NO: 937917 - DNA, 25 bp, Mus musculus
gcatgaagtagacaccatccatgtg

SEQ ID NO: 937918 - DNA, 25 bp, Mus musculus
gcatgaagtagagaccatccatgtg

SEQ ID NO: 937919 - DNA, 25 bp, Mus musculus
gcatgaattcagcgatgacctggat

SEQ ID NO: 937920 - DNA, 25 bp, Mus musculus
gcatgaattcagggatgacctggat

SEQ ID NO: 937921 - DNA, 25 bp, Mus musculus
gcatgacacagtacagggacataca

SEQ ID NO: 937922 - DNA, 25 bp, Mus musculus
gcatgacacagttcagggacataca

SEQ ID NO: 937923 - DNA, 25 bp, Mus musculus
gcatgacactaaacatggagtggat

SEQ ID NO: 937924 - DNA, 25 bp, Mus musculus
gcatgacactaatcatggagtggat

SEQ ID NO: 937925 - DNA, 25 bp, Mus musculus
gcatgaccagagtagtccatggaag

SEQ ID NO: 937926 - DNA, 25 bp, Mus musculus
gcatgaccagtgtagtccatggaag

SEQ ID NO: 937927 - DNA, 25 bp, Mus musculus
gcatgagaagacaagcaatcatctt

SEQ ID NO: 937928 - DNA, 25 bp, Mus musculus
gcatgagaagtcaagcaatcatctt

SEQ ID NO: 937929 - DNA, 25 bp, Mus musculus
gcatgagacgggaacctgtacagag

SEQ ID NO: 937930 - DNA, 25 bp, Mus musculus
gcatgagacgggaagctgtacagag

SEQ ID NO: 937931 - DNA, 25 bp, Mus musculus
gcatgagagtcacgtttcccaacct

SEQ ID NO: 937932 - DNA, 25 bp, Mus musculus
gcatgagagtcaggtttcccaacct

SEQ ID NO: 937933 - DNA, 25 bp, Mus musculus
gcatgagcggcacgagcgagaggat

SEQ ID NO: 937934 - DNA, 25 bp, Mus musculus
gcatgagcggcaggagcgagaggat

SEQ ID NO: 937935 - DNA, 25 bp, Mus musculus
gcatgagctcaacccgtacatcccc

SEQ ID NO: 937936 - DNA, 25 bp, Mus musculus
gcatgagctcaaccggtacatcccc

SEQ ID NO: 937937 - DNA, 25 bp, Mus musculus
gcatgaggaaagacatgatactgtc

SEQ ID NO: 937938 - DNA, 25 bp, Mus musculus
gcatgaggaaagacttgatactgtc

SEQ ID NO: 937939 - DNA, 25 bp, Mus musculus
gcatgaggagaaccctatgggaagg

SEQ ID NO: 937940 - DNA, 25 bp, Mus musculus
gcatgaggagaagcctatgggaagg

SEQ ID NO: 937941 - DNA, 25 bp, Mus musculus
gcatgagtattacacaggctggttt

SEQ ID NO: 937942 - DNA, 25 bp, Mus musculus
gcatgagtattacagaggctggttt

SEQ ID NO: 937943 - DNA, 25 bp, Mus musculus
gcatgagtgtcatgcgcattaccac

SEQ ID NO: 937944 - DNA, 25 bp, Mus musculus
gcatgagtgtcatgggcattaccac

SEQ ID NO: 937945 - DNA, 25 bp, Mus musculus
gcatgatcttgcaattgaagtggac

SEQ ID NO: 937946 - DNA, 25 bp, Mus musculus
gcatgatcttgctattgaagtggac

SEQ ID NO: 937947 - DNA, 25 bp, Mus musculus
gcatgatgccccagcaaacacaatt

SEQ ID NO: 937948 - DNA, 25 bp, Mus musculus
gcatgatgccccaggaaacacaatt

SEQ ID NO: 937949 - DNA, 25 bp, Mus musculus
gcatgcaaaaactaccctgcgggaa

SEQ ID NO: 937950 - DNA, 25 bp, Mus musculus
gcatgcaaaaactagcctgcgggaa

SEQ ID NO: 937951 - DNA, 25 bp, Mus musculus
gcatgcaacatactgctggctggac

SEQ ID NO: 937952 - DNA, 25 bp, Mus musculus
gcatgcaacatagtgctggctggac

SEQ ID NO: 937953 - DNA, 25 bp, Mus musculus
gcatgcaagcagccatcttcgaaaa

SEQ ID NO: 937954 - DNA, 25 bp, Mus musculus
gcatgcaagcaggcatcttcgaaaa

SEQ ID NO: 937955 - DNA, 25 bp, Mus musculus
gcatgcacacctcacgttccctcag

SEQ ID NO: 937956 - DNA, 25 bp, Mus musculus
gcatgcacacctcaggttccctcag

SEQ ID NO: 937957 - DNA, 25 bp, Mus musculus
gcatgcagaacactcacagcggagt

SEQ ID NO: 937958 - DNA, 25 bp, Mus musculus
gcatgcagaacagtcacagcggagt

SEQ ID NO: 937959 - DNA, 25 bp, Mus musculus
gcatgcagttaagacaacagcacat

SEQ ID NO: 937960 - DNA, 25 bp, Mus musculus
gcatgcagttaagacgatcgctgca

SEQ ID NO: 937961 - DNA, 25 bp, Mus musculus
gcatgcagttaagagaacagcacat

SEQ ID NO: 937962 - DNA, 25 bp, Mus musculus
gcatgcagttaagaggatcgctgca

SEQ ID NO: 937963 - DNA, 25 bp, Mus musculus
gcatgccagaaggacgcggcgctct

SEQ ID NO: 937964 - DNA, 25 bp, Mus musculus
gcatgccagaaggaggcggcgctct

SEQ ID NO: 937965 - DNA, 25 bp, Mus musculus
gcatgccgtggacagaaacaaggag

SEQ ID NO: 937966 - DNA, 25 bp, Mus musculus
gcatgccgtggagagaaacaaggag

SEQ ID NO: 937967 - DNA, 25 bp, Mus musculus
gcatgcctcctgagaaaacgagggc

SEQ ID NO: 937968 - DNA, 25 bp, Mus musculus
gcatgcctcctgtgaaaacgagggc

SEQ ID NO: 937969 - DNA, 25 bp, Mus musculus
gcatgcctgtgctacacagtgtgct

SEQ ID NO: 937970 - DNA, 25 bp, Mus musculus
gcatgcctgtgctagacagtgtgct

SEQ ID NO: 937971 - DNA, 25 bp, Mus musculus
gcatgcgcaaggagcccgtgcagcg

SEQ ID NO: 937972 - DNA, 25 bp, Mus musculus
gcatgcgcaaggaggccgtgcagcg

SEQ ID NO: 937973 - DNA, 25 bp, Mus musculus
gcatgcgttgccatctctggggaaa

SEQ ID NO: 937974 - DNA, 25 bp, Mus musculus
gcatgcgttggcatctctggggaaa

SEQ ID NO: 937975 - DNA, 25 bp, Mus musculus
gcatgctccgtggtccaccggcttc

SEQ ID NO: 937976 - DNA, 25 bp, Mus musculus
gcatgctccgtggtgcaccggcttc

SEQ ID NO: 937977 - DNA, 25 bp, Mus musculus
gcatgctggcagagcccaacgatga

SEQ ID NO: 937978 - DNA, 25 bp, Mus musculus
gcatgctggcagtgcccaacgatga

SEQ ID NO: 937979 - DNA, 25 bp, Mus musculus
gcatggacgcagcttctccaaacct

SEQ ID NO: 937980 - DNA, 25 bp, Mus musculus
gcatggacgcaggttctccaaacct

SEQ ID NO: 937981 - DNA, 25 bp, Mus musculus
gcatggacttgacgtgtcggaaatg

SEQ ID NO: 937982 - DNA, 25 bp, Mus musculus
gcatggacttgaggtgtcggaaatg

SEQ ID NO: 937983 - DNA, 25 bp, Mus musculus
gcatggagcaagatcattccctgat

SEQ ID NO: 937984 - DNA, 25 bp, Mus musculus
gcatggagcaagttcattccctgat

SEQ ID NO: 937985 - DNA, 25 bp, Mus musculus
gcatggatatgacgtccagagattc

SEQ ID NO: 937986 - DNA, 25 bp, Mus musculus
gcatggatatgaggtccagagattc

SEQ ID NO: 937987 - DNA, 25 bp, Mus musculus
gcatggatgaaggcaagctacagtt

SEQ ID NO: 937988 - DNA, 25 bp, Mus musculus
gcatggatgaaggctagctacagtt

SEQ ID NO: 937989 - DNA, 25 bp, Mus musculus
gcatggatggagagacggatgacga

SEQ ID NO: 937990 - DNA, 25 bp, Mus musculus
gcatggatggagtgacggatgacga

SEQ ID NO: 937991 - DNA, 25 bp, Mus musculus
gcatggcacccacgcacggagggag

SEQ ID NO: 937992 - DNA, 25 bp, Mus musculus
gcatggcacccacgcgcgaagggag

SEQ ID NO: 937993 - DNA, 25 bp, Mus musculus
gcatggcacccaggcacggagggag

SEQ ID NO: 937994 - DNA, 25 bp, Mus musculus
gcatggcacccaggcgcgaagggag

SEQ ID NO: 937995 - DNA, 25 bp, Mus musculus
gcatggcctgtgcggtggagtccat

SEQ ID NO: 937996 - DNA, 25 bp, Mus musculus
gcatggcctgtggggtggagtccat

SEQ ID NO: 937997 - DNA, 25 bp, Mus musculus
gcatggcgagctatgttttggacga

SEQ ID NO: 937998 - DNA, 25 bp, Mus musculus
gcatggcgaggtatgttttggacga

SEQ ID NO: 937999 - DNA, 25 bp, Mus musculus
gcatggctctagattcattcagctg

SEQ ID NO: 938000 - DNA, 25 bp, Mus musculus
gcatggctctagtttcattcagctg

SEQ ID NO: 938001 - DNA, 25 bp, Mus musculus
gcatgggagccaacattcctatgat

SEQ ID NO: 938002 - DNA, 25 bp, Mus musculus
gcatgggagccaactttcctatgat

SEQ ID NO: 938003 - DNA, 25 bp, Mus musculus
gcatgggcaggcctccccagcgcag

SEQ ID NO: 938004 - DNA, 25 bp, Mus musculus
gcatgggcaggcctccgcagactta

SEQ ID NO: 938005 - DNA, 25 bp, Mus musculus
gcatgggcaggcctgcccagcgcag

SEQ ID NO: 938006 - DNA, 25 bp, Mus musculus
gcatgggcaggcctgcgcagactta

SEQ ID NO: 938007 - DNA, 25 bp, Mus musculus
gcatgggctacaaggcctcttcctg

SEQ ID NO: 938008 - DNA, 25 bp, Mus musculus
gcatgggctacatggcctcttcctg

SEQ ID NO: 938009 - DNA, 25 bp, Mus musculus
gcatggggcaggccatgggtgccat

SEQ ID NO: 938010 - DNA, 25 bp, Mus musculus
gcatggggcagggcatgggtgccat

SEQ ID NO: 938011 - DNA, 25 bp, Mus musculus
gcatggtagaaacatctaaaggggt

SEQ ID NO: 938012 - DNA, 25 bp, Mus musculus
gcatggtagaaacgcctttgtagat

SEQ ID NO: 938013 - DNA, 25 bp, Mus musculus
gcatggtagaaagatctaaaggggt

SEQ ID NO: 938014 - DNA, 25 bp, Mus musculus
gcatggtagaaaggcctttgtagat

SEQ ID NO: 938015 - DNA, 25 bp, Mus musculus
gcatggtaggctaagcacacggatc

SEQ ID NO: 938016 - DNA, 25 bp, Mus musculus
gcatggtagggtaagcacacggatc

SEQ ID NO: 938017 - DNA, 25 bp, Mus musculus
gcatggtataagcatgacatcgttc

SEQ ID NO: 938018 - DNA, 25 bp, Mus musculus
gcatggtataaggatgacatcgttc

SEQ ID NO: 938019 - DNA, 25 bp, Mus musculus
gcatggtcgttgtgcgaatctgcta

SEQ ID NO: 938020 - DNA, 25 bp, Mus musculus
gcatggtcgttgtgggaatctgcta

SEQ ID NO: 938021 - DNA, 25 bp, Mus musculus
gcatggtggtcacgggagaccacac

SEQ ID NO: 938022 - DNA, 25 bp, Mus musculus
gcatggtggtcaggggagaccacac

SEQ ID NO: 938023 - DNA, 25 bp, Mus musculus
gcatggtgtggtcgttggagcctct

SEQ ID NO: 938024 - DNA, 25 bp, Mus musculus
gcatggtgtggtggttggagcctct

SEQ ID NO: 938025 - DNA, 25 bp, Mus musculus
gcatggttcaagatgaagtgtccgg

SEQ ID NO: 938026 - DNA, 25 bp, Mus musculus
gcatggttcaagttgaagtgtccgg

SEQ ID NO: 938027 - DNA, 25 bp, Mus musculus
gcatggttccagattcatacagcaa

SEQ ID NO: 938028 - DNA, 25 bp, Mus musculus
gcatggttccagtttcatacagcaa

SEQ ID NO: 938029 - DNA, 25 bp, Mus musculus
gcatgtagatatcgcagacgaggca

SEQ ID NO: 938030 - DNA, 25 bp, Mus musculus
gcatgtagatatggcagacgaggca

SEQ ID NO: 938031 - DNA, 25 bp, Mus musculus
gcatgtatatctttcgttttggctt

SEQ ID NO: 938032 - DNA, 25 bp, Mus musculus
gcatgtatatctttggttttggctt

SEQ ID NO: 938033 - DNA, 25 bp, Mus musculus
gcatgtcacagagcacttttaataa

SEQ ID NO: 938034 - DNA, 25 bp, Mus musculus
gcatgtcacagagcagaatgattgg

SEQ ID NO: 938035 - DNA, 25 bp, Mus musculus
gcatgtcacagagctcttttaataa

SEQ ID NO: 938036 - DNA, 25 bp, Mus musculus
gcatgtcacagagctgaatgattgg

SEQ ID NO: 938037 - DNA, 25 bp, Mus musculus
gcatgtcagaggaaattatgacatg

SEQ ID NO: 938038 - DNA, 25 bp, Mus musculus
gcatgtcagaggaatttatgacatg

SEQ ID NO: 938039 - DNA, 25 bp, Mus musculus
gcatgtcatgcgtgaagataaatgt

SEQ ID NO: 938040 - DNA, 25 bp, Mus musculus
gcatgtcatgggtgaagataaatgt

SEQ ID NO: 938041 - DNA, 25 bp, Mus musculus
gcatgtccagagggatggacaagtt

SEQ ID NO: 938042 - DNA, 25 bp, Mus musculus
gcatgtccagtgggatggacaagtt

SEQ ID NO: 938043 - DNA, 25 bp, Mus musculus
gcatgtcctgcacaccctggagagg

SEQ ID NO: 938044 - DNA, 25 bp, Mus musculus
gcatgtcctggacaccctggagagg

SEQ ID NO: 938045 - DNA, 25 bp, Mus musculus
gcatgtcgtggacatgagacagata

SEQ ID NO: 938046 - DNA, 25 bp, Mus musculus
gcatgtcgtggagatgagacagata

SEQ ID NO: 938047 - DNA, 25 bp, Mus musculus
gcatgtctgaccagtcaaactgggc

SEQ ID NO: 938048 - DNA, 25 bp, Mus musculus
gcatgtctgacctgtcaaactgggc

SEQ ID NO: 938049 - DNA, 25 bp, Mus musculus
gcatgtggcagacaggctgctgcag

SEQ ID NO: 938050 - DNA, 25 bp, Mus musculus
gcatgtggcagagaggctgctgcag

SEQ ID NO: 938051 - DNA, 25 bp, Mus musculus
gcatgtggtcaacgacttaatgggc

SEQ ID NO: 938052 - DNA, 25 bp, Mus musculus
gcatgtggtcaacgttcttgcagaa

SEQ ID NO: 938053 - DNA, 25 bp, Mus musculus
gcatgtggtcaaggacttaatgggc

SEQ ID NO: 938054 - DNA, 25 bp, Mus musculus
gcatgtggtcaaggttcttgcagaa

SEQ ID NO: 938055 - DNA, 25 bp, Mus musculus
gcatgttcgtctttcggggctatac

SEQ ID NO: 938056 - DNA, 25 bp, Mus musculus
gcatgttcgtctttgggggctatac

SEQ ID NO: 938057 - DNA, 25 bp, Mus musculus
gcatgttcttggaaacctgatatct

SEQ ID NO: 938058 - DNA, 25 bp, Mus musculus
gcatgttcttggtaacctgatatct

SEQ ID NO: 938059 - DNA, 25 bp, Mus musculus
gcatgttgattcaagaagctactat

SEQ ID NO: 938060 - DNA, 25 bp, Mus musculus
gcatgttgattctagaagctactat

SEQ ID NO: 938061 - DNA, 25 bp, Mus musculus
gcatgtttacagaggccggcctcat

SEQ ID NO: 938062 - DNA, 25 bp, Mus musculus
gcatgtttacagataggtgacagca

SEQ ID NO: 938063 - DNA, 25 bp, Mus musculus
gcatgtttacagtggccggcctcat

SEQ ID NO: 938064 - DNA, 25 bp, Mus musculus
gcatgtttacagttaggtgacagca

SEQ ID NO: 938065 - DNA, 25 bp, Mus musculus
gcatgtttcaggaggtttgttgaag

SEQ ID NO: 938066 - DNA, 25 bp, Mus musculus
gcatgtttcaggtggtttgttgaag

SEQ ID NO: 938067 - DNA, 25 bp, Mus musculus
gcatgtttgctgaaaacaatggcct

SEQ ID NO: 938068 - DNA, 25 bp, Mus musculus
gcatgtttgctgtaaacaatggcct

SEQ ID NO: 938069 - DNA, 25 bp, Mus musculus
gcattaccttgccacgagactacgg

SEQ ID NO: 938070 - DNA, 25 bp, Mus musculus
gcattaccttgccaggagactacgg

SEQ ID NO: 938071 - DNA, 25 bp, Mus musculus
gcattacgtcatctactatgagatg

SEQ ID NO: 938072 - DNA, 25 bp, Mus musculus
gcattacgtcatgtactatgagatg

SEQ ID NO: 938073 - DNA, 25 bp, Mus musculus
gcattactaatcaaaatacgcctac

SEQ ID NO: 938074 - DNA, 25 bp, Mus musculus
gcattactaatcaaagtggacccaa

SEQ ID NO: 938075 - DNA, 25 bp, Mus musculus
gcattactaatcaatatacgcctac

SEQ ID NO: 938076 - DNA, 25 bp, Mus musculus
gcattactaatcaatgtggacccaa

SEQ ID NO: 938077 - DNA, 25 bp, Mus musculus
gcattaggagcgatctgacaggccg

SEQ ID NO: 938078 - DNA, 25 bp, Mus musculus
gcattaggagcgttctgacaggccg

SEQ ID NO: 938079 - DNA, 25 bp, Mus musculus
gcattatccaatcgtacatggactc

SEQ ID NO: 938080 - DNA, 25 bp, Mus musculus
gcattatccaatggtacatggactc

SEQ ID NO: 938081 - DNA, 25 bp, Mus musculus
gcattatgaggtctcagaaatgctt

SEQ ID NO: 938082 - DNA, 25 bp, Mus musculus
gcattatgaggtgtcagaaatgctt

SEQ ID NO: 938083 - DNA, 25 bp, Mus musculus
gcattatttacacggacctcaagct

SEQ ID NO: 938084 - DNA, 25 bp, Mus musculus
gcattatttacagggacctcaagct

SEQ ID NO: 938085 - DNA, 25 bp, Mus musculus
gcattcaaggggcacgtgtttgctt

SEQ ID NO: 938086 - DNA, 25 bp, Mus musculus
gcattcaaggggcaggtgtttgctt

SEQ ID NO: 938087 - DNA, 25 bp, Mus musculus
gcattcacagaacttgggatgctaa

SEQ ID NO: 938088 - DNA, 25 bp, Mus musculus
gcattcacagcgacctggctgcacg

SEQ ID NO: 938089 - DNA, 25 bp, Mus musculus
gcattcacagggacctggctgcacg

SEQ ID NO: 938090 - DNA, 25 bp, Mus musculus
gcattcacagtacttgggatgctaa

SEQ ID NO: 938091 - DNA, 25 bp, Mus musculus
gcattcactgcagtcatatggacga

SEQ ID NO: 938092 - DNA, 25 bp, Mus musculus
gcattcactgcagtgatatggacga

SEQ ID NO: 938093 - DNA, 25 bp, Mus musculus
gcattcagagcgttctcatcgtgga

SEQ ID NO: 938094 - DNA, 25 bp, Mus musculus
gcattcagagggttctcatcgtgga

SEQ ID NO: 938095 - DNA, 25 bp, Mus musculus
gcattcagtgtctacgtggaaatgg

SEQ ID NO: 938096 - DNA, 25 bp, Mus musculus
gcattcagtgtctaggtggaaatgg

SEQ ID NO: 938097 - DNA, 25 bp, Mus musculus
gcattcatgcagaaaatcttttcag

SEQ ID NO: 938098 - DNA, 25 bp, Mus musculus
gcattcatgcagtaaatcttttcag

SEQ ID NO: 938099 - DNA, 25 bp, Mus musculus
gcattcatgcggaaagacgtgcgag

SEQ ID NO: 938100 - DNA, 25 bp, Mus musculus
gcattcatgcggatgcgttttgact

SEQ ID NO: 938101 - DNA, 25 bp, Mus musculus
gcattcatgcggtaagacgtgcgag

SEQ ID NO: 938102 - DNA, 25 bp, Mus musculus
gcattcatgcggttgcgttttgact

SEQ ID NO: 938103 - DNA, 25 bp, Mus musculus
gcattcatttatcgatccagaaaat

SEQ ID NO: 938104 - DNA, 25 bp, Mus musculus
gcattcatttatcggatccagaaaa

SEQ ID NO: 938105 - DNA, 25 bp, Mus musculus
gcattcatttatctctgttacaaaa

SEQ ID NO: 938106 - DNA, 25 bp, Mus musculus
gcattcatttatggatccagaaaat

SEQ ID NO: 938107 - DNA, 25 bp, Mus musculus
gcattcatttatgggatccagaaaa

SEQ ID NO: 938108 - DNA, 25 bp, Mus musculus
gcattcatttatgtctgttacaaaa

SEQ ID NO: 938109 - DNA, 25 bp, Mus musculus
gcattccccaatcgtccatttactc

SEQ ID NO: 938110 - DNA, 25 bp, Mus musculus
gcattccccaatggtccatttactc

SEQ ID NO: 938111 - DNA, 25 bp, Mus musculus
gcattcccgaaccacatatgagcgg

SEQ ID NO: 938112 - DNA, 25 bp, Mus musculus
gcattcccgaaccagatatgagcgg

SEQ ID NO: 938113 - DNA, 25 bp, Mus musculus
gcattcctgaagatgcgaccatcaa

SEQ ID NO: 938114 - DNA, 25 bp, Mus musculus
gcattcctgaagttgcgaccatcaa

SEQ ID NO: 938115 - DNA, 25 bp, Mus musculus
gcattcctgacacccgacctcttca

SEQ ID NO: 938116 - DNA, 25 bp, Mus musculus
gcattcctgacagccgacctcttca

SEQ ID NO: 938117 - DNA, 25 bp, Mus musculus
gcattccttttgcccctcatattga

SEQ ID NO: 938118 - DNA, 25 bp, Mus musculus
gcattccttttggccctcatattga

SEQ ID NO: 938119 - DNA, 25 bp, Mus musculus
gcattctacactcctggacatcggt

SEQ ID NO: 938120 - DNA, 25 bp, Mus musculus
gcattctacagtcctggacatcggt

SEQ ID NO: 938121 - DNA, 25 bp, Mus musculus
gcattctctacccacatgaggtggc

SEQ ID NO: 938122 - DNA, 25 bp, Mus musculus
gcattctctacccagatgaggtggc

SEQ ID NO: 938123 - DNA, 25 bp, Mus musculus
gcattctgggcgtcaaccggatgca

SEQ ID NO: 938124 - DNA, 25 bp, Mus musculus
gcattctgggggtcaaccggatgca

SEQ ID NO: 938125 - DNA, 25 bp, Mus musculus
gcattgaactcacggtcacctccag

SEQ ID NO: 938126 - DNA, 25 bp, Mus musculus
gcattgaactcagggtcacctccag

SEQ ID NO: 938127 - DNA, 25 bp, Mus musculus
gcattgaagtgttaaacacaccaac

SEQ ID NO: 938128 - DNA, 25 bp, Mus musculus
gcattgaagtgttatacacaccaac

SEQ ID NO: 938129 - DNA, 25 bp, Mus musculus
gcattgacatagcctcgttcaggcc

SEQ ID NO: 938130 - DNA, 25 bp, Mus musculus
gcattgacatagcgaacgtctagct

SEQ ID NO: 938131 - DNA, 25 bp, Mus musculus
gcattgacataggctcgttcaggcc

SEQ ID NO: 938132 - DNA, 25 bp, Mus musculus
gcattgacatagggaacgtctagct

SEQ ID NO: 938133 - DNA, 25 bp, Mus musculus
gcattgatgaccagagttacaagca

SEQ ID NO: 938134 - DNA, 25 bp, Mus musculus
gcattgatgaccagtgttacaagca

SEQ ID NO: 938135 - DNA, 25 bp, Mus musculus
gcattgctgtctctgaaaaatgaat

SEQ ID NO: 938136 - DNA, 25 bp, Mus musculus
gcattgctgtctgtgaaaaatgaat

SEQ ID NO: 938137 - DNA, 25 bp, Mus musculus
gcattgctgtcttacatagtaattt

SEQ ID NO: 938138 - DNA, 25 bp, Mus musculus
gcattgctgtgttacatagtaattt

SEQ ID NO: 938139 - DNA, 25 bp, Mus musculus
gcattggaagagagtatcctcagag

SEQ ID NO: 938140 - DNA, 25 bp, Mus musculus
gcattggaagagtgtatcctcagag

SEQ ID NO: 938141 - DNA, 25 bp, Mus musculus
gcattggcggagctgtggacctcgt

SEQ ID NO: 938142 - DNA, 25 bp, Mus musculus
gcattggcggaggtgtggacctcgt

SEQ ID NO: 938143 - DNA, 25 bp, Mus musculus
gcattgtcagattcttagcaaggtt

SEQ ID NO: 938144 - DNA, 25 bp, Mus musculus
gcattgtcagtttcttagcaaggtt

SEQ ID NO: 938145 - DNA, 25 bp, Mus musculus
gcattgtgagggcagctgttgtgga

SEQ ID NO: 938146 - DNA, 25 bp, Mus musculus
gcattgtgagggctgttctgtagtg

SEQ ID NO: 938147 - DNA, 25 bp, Mus musculus
gcattgtgaggggagctgttgtgga

SEQ ID NO: 938148 - DNA, 25 bp, Mus musculus
gcattgtgaggggtgttctgtagtg

SEQ ID NO: 938149 - DNA, 25 bp, Mus musculus
gcattgtttatggacgaaaacacag

SEQ ID NO: 938150 - DNA, 25 bp, Mus musculus
gcattgtttatggaggaaaacacag

SEQ ID NO: 938151 - DNA, 25 bp, Mus musculus
gcatttaatgcctcctgcctgtcct

SEQ ID NO: 938152 - DNA, 25 bp, Mus musculus
gcatttaatggctcctgcctgtcct

SEQ ID NO: 938153 - DNA, 25 bp, Mus musculus
gcatttactatgacggactcatggc

SEQ ID NO: 938154 - DNA, 25 bp, Mus musculus
gcatttactatgtcggactcatggc

SEQ ID NO: 938155 - DNA, 25 bp, Mus musculus
gcatttagaaagcacaaaacaactt

SEQ ID NO: 938156 - DNA, 25 bp, Mus musculus
gcatttagaatgcacaaaacaactt

SEQ ID NO: 938157 - DNA, 25 bp, Mus musculus
gcatttcaagcatattaccttccaa

SEQ ID NO: 938158 - DNA, 25 bp, Mus musculus
gcatttcaaggatattaccttccaa

SEQ ID NO: 938159 - DNA, 25 bp, Mus musculus
gcatttcgcaagcgtcatgtaaaag

SEQ ID NO: 938160 - DNA, 25 bp, Mus musculus
gcatttcgcaagggtcatgtaaaag

SEQ ID NO: 938161 - DNA, 25 bp, Mus musculus
gcatttcttgagctaaatgaggaag

SEQ ID NO: 938162 - DNA, 25 bp, Mus musculus
gcatttcttgaggtaaatgaggaag

SEQ ID NO: 938163 - DNA, 25 bp, Mus musculus
gcatttgagacacttccgacgagat

SEQ ID NO: 938164 - DNA, 25 bp, Mus musculus
gcatttgagacagttccgacgagat

SEQ ID NO: 938165 - DNA, 25 bp, Mus musculus
gcatttgcagactccaaaaaacaaa

SEQ ID NO: 938166 - DNA, 25 bp, Mus musculus
gcatttgcagtctccaaaaaacaaa

SEQ ID NO: 938167 - DNA, 25 bp, Mus musculus
gcatttgcccagaggagggcattgg

SEQ ID NO: 938168 - DNA, 25 bp, Mus musculus
gcatttgcccagtggagggcattgg

SEQ ID NO: 938169 - DNA, 25 bp, Mus musculus
gcatttggatgacgatggaagactg

SEQ ID NO: 938170 - DNA, 25 bp, Mus musculus
gcatttggatgaggatggaagactg

SEQ ID NO: 938171 - DNA, 25 bp, Mus musculus
gcatttggtgagctgcggcttgttc

SEQ ID NO: 938172 - DNA, 25 bp, Mus musculus
gcatttggtgaggtgcggcttgttc

SEQ ID NO: 938173 - DNA, 25 bp, Mus musculus
gcatttgtggcacacagagatagta

SEQ ID NO: 938174 - DNA, 25 bp, Mus musculus
gcatttgtgggacacagagatagta

SEQ ID NO: 938175 - DNA, 25 bp, Mus musculus
gcatttgttggacgctttctgtctc

SEQ ID NO: 938176 - DNA, 25 bp, Mus musculus
gcatttgttggaggctttctgtctc

SEQ ID NO: 938177 - DNA, 25 bp, Mus musculus
gcattttctgggcaatgaattccac

SEQ ID NO: 938178 - DNA, 25 bp, Mus musculus
gcattttctggggaatgaattccac

SEQ ID NO: 938179 - DNA, 25 bp, Mus musculus
gcattttgaaaacttccaatctgag

SEQ ID NO: 938180 - DNA, 25 bp, Mus musculus
gcattttgaaaagttccaatctgag

SEQ ID NO: 938181 - DNA, 25 bp, Mus musculus
gcattttgagaaagcaattgagctg

SEQ ID NO: 938182 - DNA, 25 bp, Mus musculus
gcattttgagcttttctctgtgtag

SEQ ID NO: 938183 - DNA, 25 bp, Mus musculus
gcattttgaggcaatcagtgacgag

SEQ ID NO: 938184 - DNA, 25 bp, Mus musculus
gcattttgaggctatcagtgacgag

SEQ ID NO: 938185 - DNA, 25 bp, Mus musculus
gcattttgaggttttctctgtgtag

SEQ ID NO: 938186 - DNA, 25 bp, Mus musculus
gcattttgagtaagcaattgagctg

SEQ ID NO: 938187 - DNA, 25 bp, Mus musculus
gccaaaaaagcgaaagatgtgaccg

SEQ ID NO: 938188 - DNA, 25 bp, Mus musculus
gccaaaaaagcgtaagatgtgaccg

SEQ ID NO: 938189 - DNA, 25 bp, Mus musculus
gccaaaaacaatcgtgacttggact

SEQ ID NO: 938190 - DNA, 25 bp, Mus musculus
gccaaaaacaatggtgacttggact

SEQ ID NO: 938191 - DNA, 25 bp, Mus musculus
gccaaaaacgcaagtttgcagatac

SEQ ID NO: 938192 - DNA, 25 bp, Mus musculus
gccaaaaacggaagtttgcagatac

SEQ ID NO: 938193 - DNA, 25 bp, Mus musculus
gccaaaactgagcctgagaatacga

SEQ ID NO: 938194 - DNA, 25 bp, Mus musculus
gccaaaactgaggctgagaatacga

SEQ ID NO: 938195 - DNA, 25 bp, Mus musculus
gccaaaatcacactgaacaccttcc

SEQ ID NO: 938196 - DNA, 25 bp, Mus musculus
gccaaaatcacagtgaacaccttcc

SEQ ID NO: 938197 - DNA, 25 bp, Mus musculus
gccaaacaaagagacctggaaagtc

SEQ ID NO: 938198 - DNA, 25 bp, Mus musculus
gccaaacaaagagagctggaaagtc

SEQ ID NO: 938199 - DNA, 25 bp, Mus musculus
gccaaactgaagcgcgactaccctg

SEQ ID NO: 938200 - DNA, 25 bp, Mus musculus
gccaaactgaagcgggactaccctg

SEQ ID NO: 938201 - DNA, 25 bp, Mus musculus
gccaaacttcaagaagcatacagtt

SEQ ID NO: 938202 - DNA, 25 bp, Mus musculus
gccaaacttcaagaagtaccagtac

SEQ ID NO: 938203 - DNA, 25 bp, Mus musculus
gccaaacttcaagatgcatacagtt

SEQ ID NO: 938204 - DNA, 25 bp, Mus musculus
gccaaacttcaagatgtaccagtac

SEQ ID NO: 938205 - DNA, 25 bp, Mus musculus
gccaaacttcagataataacagact

SEQ ID NO: 938206 - DNA, 25 bp, Mus musculus
gccaaacttcagttaataacagact

SEQ ID NO: 938207 - DNA, 25 bp, Mus musculus
gccaaacttttccactgtgtccatt

SEQ ID NO: 938208 - DNA, 25 bp, Mus musculus
gccaaacttttccagtgtgtccatt

SEQ ID NO: 938209 - DNA, 25 bp, Mus musculus
gccaaagaaaagcaaagacaagctg

SEQ ID NO: 938210 - DNA, 25 bp, Mus musculus
gccaaagaaaaggaaagacaagctg

SEQ ID NO: 938211 - DNA, 25 bp, Mus musculus
gccaaagaccctatcgtcaacgtgt

SEQ ID NO: 938212 - DNA, 25 bp, Mus musculus
gccaaagaccctttcgtcaacgtgt

SEQ ID NO: 938213 - DNA, 25 bp, Mus musculus
gccaaagaggaacgcatcgtcatgt

SEQ ID NO: 938214 - DNA, 25 bp, Mus musculus
gccaaagaggaaggcatcgtcatgt

SEQ ID NO: 938215 - DNA, 25 bp, Mus musculus
gccaaagaggagattttcggaccag

SEQ ID NO: 938216 - DNA, 25 bp, Mus musculus
gccaaagaggagtttttcggaccag

SEQ ID NO: 938217 - DNA, 25 bp, Mus musculus
gccaaagcaaaaatgaggagtggga

SEQ ID NO: 938218 - DNA, 25 bp, Mus musculus
gccaaagcaaaattgaggagtggga

SEQ ID NO: 938219 - DNA, 25 bp, Mus musculus
gccaaagctgagaaggaagaagaga

SEQ ID NO: 938220 - DNA, 25 bp, Mus musculus
gccaaagctgagtaggaagaagaga

SEQ ID NO: 938221 - DNA, 25 bp, Mus musculus
gccaaaggaaatgacacaggatatc

SEQ ID NO: 938222 - DNA, 25 bp, Mus musculus
gccaaaggaaatgagacaggatatc

SEQ ID NO: 938223 - DNA, 25 bp, Mus musculus
gccaaagtcaagagtatcccatatg

SEQ ID NO: 938224 - DNA, 25 bp, Mus musculus
gccaaagtcaagtgtatcccatatg

SEQ ID NO: 938225 - DNA, 25 bp, Mus musculus
gccaaagtcacccaagctgacccca

SEQ ID NO: 938226 - DNA, 25 bp, Mus musculus
gccaaagtcagccaagctgacccca

SEQ ID NO: 938227 - DNA, 25 bp, Mus musculus
gccaaagttgataccgatggcaacg

SEQ ID NO: 938228 - DNA, 25 bp, Mus musculus
gccaaagttgttaccgatggcaacg

SEQ ID NO: 938229 - DNA, 25 bp, Mus musculus
gccaaatctccacgatggaggcctg

SEQ ID NO: 938230 - DNA, 25 bp, Mus musculus
gccaaatctccaggatggaggcctg

SEQ ID NO: 938231 - DNA, 25 bp, Mus musculus
gccaaatttcgccacatagtgtctg

SEQ ID NO: 938232 - DNA, 25 bp, Mus musculus
gccaaatttcgccagatagtgtctg

SEQ ID NO: 938233 - DNA, 25 bp, Mus musculus
gccaacaaacagctgtgcaaaccgc

SEQ ID NO: 938234 - DNA, 25 bp, Mus musculus
gccaacaaacaggtgtgcaaaccgc

SEQ ID NO: 938235 - DNA, 25 bp, Mus musculus
gccaacaagcagcacctccccaatg

SEQ ID NO: 938236 - DNA, 25 bp, Mus musculus
gccaacaagcaggacctccccaatg

SEQ ID NO: 938237 - DNA, 25 bp, Mus musculus
gccaacacaaagcgcatttgcttca

SEQ ID NO: 938238 - DNA, 25 bp, Mus musculus
gccaacacaaagggcatttgcttca

SEQ ID NO: 938239 - DNA, 25 bp, Mus musculus
gccaacacagcgtgtgggcctggcc

SEQ ID NO: 938240 - DNA, 25 bp, Mus musculus
gccaacacagggtgtgggcctggcc

SEQ ID NO: 938241 - DNA, 25 bp, Mus musculus
gccaacacccagcgtacatatggaa

SEQ ID NO: 938242 - DNA, 25 bp, Mus musculus
gccaacacccagggtacatatggaa

SEQ ID NO: 938243 - DNA, 25 bp, Mus musculus
gccaacagagaaagcccagagtccg

SEQ ID NO: 938244 - DNA, 25 bp, Mus musculus
gccaacagagccagtaagcccagag

SEQ ID NO: 938245 - DNA, 25 bp, Mus musculus
gccaacagaggcagtaagcccagag

SEQ ID NO: 938246 - DNA, 25 bp, Mus musculus
gccaacagagtaagcccagagtccg

SEQ ID NO: 938247 - DNA, 25 bp, Mus musculus
gccaacatcaaactgtgctccctta

SEQ ID NO: 938248 - DNA, 25 bp, Mus musculus
gccaacatcaaagtgtgctccctta

SEQ ID NO: 938249 - DNA, 25 bp, Mus musculus
gccaacattgctcgtggcatcagaa

SEQ ID NO: 938250 - DNA, 25 bp, Mus musculus
gccaacattgctggtggcatcagaa

SEQ ID NO: 938251 - DNA, 25 bp, Mus musculus
gccaaccaaccgaatggcgaagaac

SEQ ID NO: 938252 - DNA, 25 bp, Mus musculus
gccaaccaacggaatggcgaagaac

SEQ ID NO: 938253 - DNA, 25 bp, Mus musculus
gccaaccagacaagccatgtcggac

SEQ ID NO: 938254 - DNA, 25 bp, Mus musculus
gccaaccagacatgccatgtcggac

SEQ ID NO: 938255 - DNA, 25 bp, Mus musculus
gccaaccagcggaaatgtgagcgtg

SEQ ID NO: 938256 - DNA, 25 bp, Mus musculus
gccaaccagcggtaatgtgagcgtg

SEQ ID NO: 938257 - DNA, 25 bp, Mus musculus
gccaacccagaggacggagtgagct

SEQ ID NO: 938258 - DNA, 25 bp, Mus musculus
gccaacccagaggagggagtgagct

SEQ ID NO: 938259 - DNA, 25 bp, Mus musculus
gccaaccctgtcaacgtgggctgtc

SEQ ID NO: 938260 - DNA, 25 bp, Mus musculus
gccaaccctgtcaaggtgggctgtc

SEQ ID NO: 938261 - DNA, 25 bp, Mus musculus
gccaacctgtatcacaatatgtctg

SEQ ID NO: 938262 - DNA, 25 bp, Mus musculus
gccaacctgtatcagaatatgtctg

SEQ ID NO: 938263 - DNA, 25 bp, Mus musculus
gccaacgatgcacggagccgaaact

SEQ ID NO: 938264 - DNA, 25 bp, Mus musculus
gccaacgatgcagggagccgaaact

SEQ ID NO: 938265 - DNA, 25 bp, Mus musculus
gccaacgcaaatgccgtgcagaccg

SEQ ID NO: 938266 - DNA, 25 bp, Mus musculus
gccaacgcaattgccgtgcagaccg

SEQ ID NO: 938267 - DNA, 25 bp, Mus musculus
gccaacgtccgacattgttgccagt

SEQ ID NO: 938268 - DNA, 25 bp, Mus musculus
gccaacgtccgagattgttgccagt

SEQ ID NO: 938269 - DNA, 25 bp, Mus musculus
gccaacgtctgaattccagtccctg

SEQ ID NO: 938270 - DNA, 25 bp, Mus musculus
gccaacgtctgatttccagtccctg

SEQ ID NO: 938271 - DNA, 25 bp, Mus musculus
gccaactcaacatgaatggttttcg

SEQ ID NO: 938272 - DNA, 25 bp, Mus musculus
gccaactcaacatgtatggttttcg

SEQ ID NO: 938273 - DNA, 25 bp, Mus musculus
gccaactcagattcgatgtacattg

SEQ ID NO: 938274 - DNA, 25 bp, Mus musculus
gccaactcagtttcgatgtacattg

SEQ ID NO: 938275 - DNA, 25 bp, Mus musculus
gccaactccgatttctcctcctcat

SEQ ID NO: 938276 - DNA, 25 bp, Mus musculus
gccaactccgttttctcctcctcat

SEQ ID NO: 938277 - DNA, 25 bp, Mus musculus
gccaactggcgacacgcccacatgc

SEQ ID NO: 938278 - DNA, 25 bp, Mus musculus
gccaactggcgacacgctctgatgg

SEQ ID NO: 938279 - DNA, 25 bp, Mus musculus
gccaactggcgacaggcccacatgc

SEQ ID NO: 938280 - DNA, 25 bp, Mus musculus
gccaactggcgacaggctctgatgg

SEQ ID NO: 938281 - DNA, 25 bp, Mus musculus
gccaacttcctgaacggtgcccacg

SEQ ID NO: 938282 - DNA, 25 bp, Mus musculus
gccaacttcctgaagggtgcccacg

SEQ ID NO: 938283 - DNA, 25 bp, Mus musculus
gccaagaaaaagagcattcacatca

SEQ ID NO: 938284 - DNA, 25 bp, Mus musculus
gccaagaaaaagtgcattcacatca

SEQ ID NO: 938285 - DNA, 25 bp, Mus musculus
gccaagaaactacgactaactgaag

SEQ ID NO: 938286 - DNA, 25 bp, Mus musculus
gccaagaaactaggactaactgaag

SEQ ID NO: 938287 - DNA, 25 bp, Mus musculus
gccaagaaagactgacctcttccag

SEQ ID NO: 938288 - DNA, 25 bp, Mus musculus
gccaagaaagagggcacagaagttt

SEQ ID NO: 938289 - DNA, 25 bp, Mus musculus
gccaagaaagatccgtcgtcagcaa

SEQ ID NO: 938290 - DNA, 25 bp, Mus musculus
gccaagaaagtctgacctcttccag

SEQ ID NO: 938291 - DNA, 25 bp, Mus musculus
gccaagaaagtgggcacagaagttt

SEQ ID NO: 938292 - DNA, 25 bp, Mus musculus
gccaagaaagttccgtcgtcagcaa

SEQ ID NO: 938293 - DNA, 25 bp, Mus musculus
gccaagaaatttgacgcctctggct

SEQ ID NO: 938294 - DNA, 25 bp, Mus musculus
gccaagaaatttgaggcctctggct

SEQ ID NO: 938295 - DNA, 25 bp, Mus musculus
gccaagaacgccgacatggcccgaa

SEQ ID NO: 938296 - DNA, 25 bp, Mus musculus
gccaagaacgccgagatggcccgaa

SEQ ID NO: 938297 - DNA, 25 bp, Mus musculus
gccaagaacgctatttgaatatcat

SEQ ID NO: 938298 - DNA, 25 bp, Mus musculus
gccaagaacggtatttgaatatcat

SEQ ID NO: 938299 - DNA, 25 bp, Mus musculus
gccaagaagagtcgaatccttgttt

SEQ ID NO: 938300 - DNA, 25 bp, Mus musculus
gccaagaagagtggaatccttgttt

SEQ ID NO: 938301 - DNA, 25 bp, Mus musculus
gccaagaagcagcctcgcagccttc

SEQ ID NO: 938302 - DNA, 25 bp, Mus musculus
gccaagaagcaggctcgcagccttc

SEQ ID NO: 938303 - DNA, 25 bp, Mus musculus
gccaagaaggagaacgaacaagcca

SEQ ID NO: 938304 - DNA, 25 bp, Mus musculus
gccaagaaggagaaggaacaagcca

SEQ ID NO: 938305 - DNA, 25 bp, Mus musculus
gccaagaaggaggccttacaaatgc

SEQ ID NO: 938306 - DNA, 25 bp, Mus musculus
gccaagaaggtggccttacaaatgc

SEQ ID NO: 938307 - DNA, 25 bp, Mus musculus
gccaagacagatcggcgatagcagc

SEQ ID NO: 938308 - DNA, 25 bp, Mus musculus
gccaagacagttcggcgatagcagc

SEQ ID NO: 938309 - DNA, 25 bp, Mus musculus
gccaagacatagacttgccatgtag

SEQ ID NO: 938310 - DNA, 25 bp, Mus musculus
gccaagacatagctcattctggagt

SEQ ID NO: 938311 - DNA, 25 bp, Mus musculus
gccaagacataggtcattctggagt

SEQ ID NO: 938312 - DNA, 25 bp, Mus musculus
gccaagacatagtcttgccatgtag

SEQ ID NO: 938313 - DNA, 25 bp, Mus musculus
gccaagacccggcacggcgtggagg

SEQ ID NO: 938314 - DNA, 25 bp, Mus musculus
gccaagacccggcagggcgtggagg

SEQ ID NO: 938315 - DNA, 25 bp, Mus musculus
gccaagacccggcatgagtatcttt

SEQ ID NO: 938316 - DNA, 25 bp, Mus musculus
gccaagacccgggatgagtatcttt

SEQ ID NO: 938317 - DNA, 25 bp, Mus musculus
gccaagagagcgcaagctctgcaga

SEQ ID NO: 938318 - DNA, 25 bp, Mus musculus
gccaagagagcggaagctctgcaga

SEQ ID NO: 938319 - DNA, 25 bp, Mus musculus
gccaagagctcacctttgggattcc

SEQ ID NO: 938320 - DNA, 25 bp, Mus musculus
gccaagagctcagctttgggattcc

SEQ ID NO: 938321 - DNA, 25 bp, Mus musculus
gccaagagtgccagcctgaacctgt

SEQ ID NO: 938322 - DNA, 25 bp, Mus musculus
gccaagagtgccaggctgaacctgt

SEQ ID NO: 938323 - DNA, 25 bp, Mus musculus
gccaagatctagatccagttttttg

SEQ ID NO: 938324 - DNA, 25 bp, Mus musculus
gccaagatctcgtggatcgcactcg

SEQ ID NO: 938325 - DNA, 25 bp, Mus musculus
gccaagatctggtggatcgcactcg

SEQ ID NO: 938326 - DNA, 25 bp, Mus musculus
gccaagatcttgatccagttttttg

SEQ ID NO: 938327 - DNA, 25 bp, Mus musculus
gccaagatgaaacacgagccggttc

SEQ ID NO: 938328 - DNA, 25 bp, Mus musculus
gccaagatgaaacaggagccggttc

SEQ ID NO: 938329 - DNA, 25 bp, Mus musculus
gccaagatttggattcaagtcaatc

SEQ ID NO: 938330 - DNA, 25 bp, Mus musculus
gccaagatttggtttcaagtcaatc

SEQ ID NO: 938331 - DNA, 25 bp, Mus musculus
gccaagcaagcaagcctgctgacag

SEQ ID NO: 938332 - DNA, 25 bp, Mus musculus
gccaagcaaggaagcctgctgacag

SEQ ID NO: 938333 - DNA, 25 bp, Mus musculus
gccaagcaggcaaaagctgctttac

SEQ ID NO: 938334 - DNA, 25 bp, Mus musculus
gccaagcagggaaaagctgctttac

SEQ ID NO: 938335 - DNA, 25 bp, Mus musculus
gccaagccatgacgcaagaaactac

SEQ ID NO: 938336 - DNA, 25 bp, Mus musculus
gccaagccatgaggcaagaaactac

SEQ ID NO: 938337 - DNA, 25 bp, Mus musculus
gccaagccccagcagtcggtgacat

SEQ ID NO: 938338 - DNA, 25 bp, Mus musculus
gccaagccccaggagtcggtgacat

SEQ ID NO: 938339 - DNA, 25 bp, Mus musculus
gccaagcctgcgactcaatagatct

SEQ ID NO: 938340 - DNA, 25 bp, Mus musculus
gccaagcctgggactcaatagatct

SEQ ID NO: 938341 - DNA, 25 bp, Mus musculus
gccaagcgcaggcgggtggtcgtct

SEQ ID NO: 938342 - DNA, 25 bp, Mus musculus
gccaagcgcaggggggtggtcgtct

SEQ ID NO: 938343 - DNA, 25 bp, Mus musculus
gccaagctagagcacaaccttctgg

SEQ ID NO: 938344 - DNA, 25 bp, Mus musculus
gccaagctagaggacaaccttctgg

SEQ ID NO: 938345 - DNA, 25 bp, Mus musculus
gccaagctctacaacgtctccaacg

SEQ ID NO: 938346 - DNA, 25 bp, Mus musculus
gccaagctctacaaggtctccaacg

SEQ ID NO: 938347 - DNA, 25 bp, Mus musculus
gccaagctctatcgtcgggagccac

SEQ ID NO: 938348 - DNA, 25 bp, Mus musculus
gccaagctctatggtcgggagccac

SEQ ID NO: 938349 - DNA, 25 bp, Mus musculus
gccaagctgaggcgcggcatcgtga

SEQ ID NO: 938350 - DNA, 25 bp, Mus musculus
gccaagctgaggcggggcatcgtga

SEQ ID NO: 938351 - DNA, 25 bp, Mus musculus
gccaagctgtgccgatgccgggaga

SEQ ID NO: 938352 - DNA, 25 bp, Mus musculus
gccaagctgtgcggatgccgggaga

SEQ ID NO: 938353 - DNA, 25 bp, Mus musculus
gccaagcttgcccactatgtgggat

SEQ ID NO: 938354 - DNA, 25 bp, Mus musculus
gccaagcttgcccagtatgtgggat

SEQ ID NO: 938355 - DNA, 25 bp, Mus musculus
gccaaggaggagatctttggaccag

SEQ ID NO: 938356 - DNA, 25 bp, Mus musculus
gccaaggaggagttctttggaccag

SEQ ID NO: 938357 - DNA, 25 bp, Mus musculus
gccaaggaggtccacctgctcggca

SEQ ID NO: 938358 - DNA, 25 bp, Mus musculus
gccaaggaggtccacctgttcatga

SEQ ID NO: 938359 - DNA, 25 bp, Mus musculus
gccaaggaggtccagctgctcggca

SEQ ID NO: 938360 - DNA, 25 bp, Mus musculus
gccaaggaggtccagctgttcatga

SEQ ID NO: 938361 - DNA, 25 bp, Mus musculus
gccaaggatgctatcccaatgtgtg

SEQ ID NO: 938362 - DNA, 25 bp, Mus musculus
gccaaggatgctatgccaatgtgtg

SEQ ID NO: 938363 - DNA, 25 bp, Mus musculus
gccaaggatgctcggaagtccgtgg

SEQ ID NO: 938364 - DNA, 25 bp, Mus musculus
gccaaggatgctgggaagtccgtgg

SEQ ID NO: 938365 - DNA, 25 bp, Mus musculus
gccaaggcagcctgtcaggttgtag

SEQ ID NO: 938366 - DNA, 25 bp, Mus musculus
gccaaggcaggctgtcaggttgtag

SEQ ID NO: 938367 - DNA, 25 bp, Mus musculus
gccaaggccacgcagctctttgttc

SEQ ID NO: 938368 - DNA, 25 bp, Mus musculus
gccaaggccacggagctctttgttc

SEQ ID NO: 938369 - DNA, 25 bp, Mus musculus
gccaaggcggagcccaagcgccgct

SEQ ID NO: 938370 - DNA, 25 bp, Mus musculus
gccaaggcggaggccaagcgccgct

SEQ ID NO: 938371 - DNA, 25 bp, Mus musculus
gccaagggcaggctgtttaggaatc

SEQ ID NO: 938372 - DNA, 25 bp, Mus musculus
gccaagggcagggtgtttaggaatc

SEQ ID NO: 938373 - DNA, 25 bp, Mus musculus
gccaaggtgacagaacgatttcgat

SEQ ID NO: 938374 - DNA, 25 bp, Mus musculus
gccaaggtgagagaacgatttcgat

SEQ ID NO: 938375 - DNA, 25 bp, Mus musculus
gccaagtacacactgtgtgattcag

SEQ ID NO: 938376 - DNA, 25 bp, Mus musculus
gccaagtacacagtgtgtgattcag

SEQ ID NO: 938377 - DNA, 25 bp, Mus musculus
gccaagtctacacgtggtgtctacc

SEQ ID NO: 938378 - DNA, 25 bp, Mus musculus
gccaagtctacaggtggtgtctacc

SEQ ID NO: 938379 - DNA, 25 bp, Mus musculus
gccaagtctcggctggatgaaactc

SEQ ID NO: 938380 - DNA, 25 bp, Mus musculus
gccaagtctcgggtggatgaaactc

SEQ ID NO: 938381 - DNA, 25 bp, Mus musculus
gccaagtctgcaatcagaagaggat

SEQ ID NO: 938382 - DNA, 25 bp, Mus musculus
gccaagtctggaatcagaagaggat

SEQ ID NO: 938383 - DNA, 25 bp, Mus musculus
gccaagtgagagtcagcttgcgaag

SEQ ID NO: 938384 - DNA, 25 bp, Mus musculus
gccaagtgagtgtcagcttgcgaag

SEQ ID NO: 938385 - DNA, 25 bp, Mus musculus
gccaagttagcaccactccagggca

SEQ ID NO: 938386 - DNA, 25 bp, Mus musculus
gccaagttagcagcactccagggca

SEQ ID NO: 938387 - DNA, 25 bp, Mus musculus
gccaagtttacacggattaatacag

SEQ ID NO: 938388 - DNA, 25 bp, Mus musculus
gccaagtttacagggattaatacag

SEQ ID NO: 938389 - DNA, 25 bp, Mus musculus
gccaagtttgagcatgccaccagcc

SEQ ID NO: 938390 - DNA, 25 bp, Mus musculus
gccaagtttgagtctggagacgtga

SEQ ID NO: 938391 - DNA, 25 bp, Mus musculus
gccaagtttgcacacgttgtactcc

SEQ ID NO: 938392 - DNA, 25 bp, Mus musculus
gccaagtttgcacaggttgtactcc

SEQ ID NO: 938393 - DNA, 25 bp, Mus musculus
gccaagtttgtgcatgccaccagcc

SEQ ID NO: 938394 - DNA, 25 bp, Mus musculus
gccaagtttgtgtctggagacgtga

SEQ ID NO: 938395 - DNA, 25 bp, Mus musculus
gccaatagcacacaacttcccagca

SEQ ID NO: 938396 - DNA, 25 bp, Mus musculus
gccaatagcacagaacttcccagca

SEQ ID NO: 938397 - DNA, 25 bp, Mus musculus
gccaatcacgccaactgcatcgtgc

SEQ ID NO: 938398 - DNA, 25 bp, Mus musculus
gccaatcacgccaagtgcatcgtgc

SEQ ID NO: 938399 - DNA, 25 bp, Mus musculus
gccaatcccctgcctgtcgacctac

SEQ ID NO: 938400 - DNA, 25 bp, Mus musculus
gccaatcccctggctgtcgacctac

SEQ ID NO: 938401 - DNA, 25 bp, Mus musculus
gccaatgaagagaacaagtatgact

SEQ ID NO: 938402 - DNA, 25 bp, Mus musculus
gccaatgaagtgaacaagtatgact

SEQ ID NO: 938403 - DNA, 25 bp, Mus musculus
gccaatgagagacgacacaatgtag

SEQ ID NO: 938404 - DNA, 25 bp, Mus musculus
gccaatgagagaggacacaatgtag

SEQ ID NO: 938405 - DNA, 25 bp, Mus musculus
gccaatgaggcaggggattcttctc

SEQ ID NO: 938406 - DNA, 25 bp, Mus musculus
gccaatgaggcggattcttctcagg

SEQ ID NO: 938407 - DNA, 25 bp, Mus musculus
gccaatgagggaggggattcttctc

SEQ ID NO: 938408 - DNA, 25 bp, Mus musculus
gccaatgagggggattcttctcagg

SEQ ID NO: 938409 - DNA, 25 bp, Mus musculus
gccaatgcgaaccacttcttcgcca

SEQ ID NO: 938410 - DNA, 25 bp, Mus musculus
gccaatgcgaacgacttcttcgcca

SEQ ID NO: 938411 - DNA, 25 bp, Mus musculus
gccaatgctgagagcaactgtgggt

SEQ ID NO: 938412 - DNA, 25 bp, Mus musculus
gccaatgctgagcatgcccaagaat

SEQ ID NO: 938413 - DNA, 25 bp, Mus musculus
gccaatgctgaggatgcccaagaat

SEQ ID NO: 938414 - DNA, 25 bp, Mus musculus
gccaatgctgagtgcaactgtgggt

SEQ ID NO: 938415 - DNA, 25 bp, Mus musculus
gccaatggaaggaacgtcaatggag

SEQ ID NO: 938416 - DNA, 25 bp, Mus musculus
gccaatggaaggaaggtcaatggag

SEQ ID NO: 938417 - DNA, 25 bp, Mus musculus
gccaatggccaaatcaaagaaatcg

SEQ ID NO: 938418 - DNA, 25 bp, Mus musculus
gccaatggccaattcaaagaaatcg

SEQ ID NO: 938419 - DNA, 25 bp, Mus musculus
gccaatgggaacgcacaaaatgagg

SEQ ID NO: 938420 - DNA, 25 bp, Mus musculus
gccaatgggaacgctcaaaatgagg

SEQ ID NO: 938421 - DNA, 25 bp, Mus musculus
gccaatgtggacaacgtattctttg

SEQ ID NO: 938422 - DNA, 25 bp, Mus musculus
gccaatgtggacaacgtcattgtgc

SEQ ID NO: 938423 - DNA, 25 bp, Mus musculus
gccaatgtggacaaggtattctttg

SEQ ID NO: 938424 - DNA, 25 bp, Mus musculus
gccaatgtggacaaggtcattgtgc

SEQ ID NO: 938425 - DNA, 25 bp, Mus musculus
gccaatgtgtcccacttcccggaga

SEQ ID NO: 938426 - DNA, 25 bp, Mus musculus
gccaatgtgtccgacttcccggaga

SEQ ID NO: 938427 - DNA, 25 bp, Mus musculus
gccaatgttcaggaccttgcagaag

SEQ ID NO: 938428 - DNA, 25 bp, Mus musculus
gccaatgttcaggagcttgcagaag

SEQ ID NO: 938429 - DNA, 25 bp, Mus musculus
gccaattactgaccaaattgctgtt

SEQ ID NO: 938430 - DNA, 25 bp, Mus musculus
gccaattactgagcaaattgctgtt

SEQ ID NO: 938431 - DNA, 25 bp, Mus musculus
gccaattgagctcatgatgaatgag

SEQ ID NO: 938432 - DNA, 25 bp, Mus musculus
gccaattgaggtcatgatgaatgag

SEQ ID NO: 938433 - DNA, 25 bp, Mus musculus
gccacaaaaaaaacctgcagctcat

SEQ ID NO: 938434 - DNA, 25 bp, Mus musculus
gccacaaaaaaatcctgcagctcat

SEQ ID NO: 938435 - DNA, 25 bp, Mus musculus
gccacaaaaagccaccaccaagtga

SEQ ID NO: 938436 - DNA, 25 bp, Mus musculus
gccacaaaaagccacggatggctgt

SEQ ID NO: 938437 - DNA, 25 bp, Mus musculus
gccacaaaaagccagcaccaagtga

SEQ ID NO: 938438 - DNA, 25 bp, Mus musculus
gccacaaaaagccagggatggctgt

SEQ ID NO: 938439 - DNA, 25 bp, Mus musculus
gccacaaaatcatcaggattccata

SEQ ID NO: 938440 - DNA, 25 bp, Mus musculus
gccacaaaatgatcaggattccata

SEQ ID NO: 938441 - DNA, 25 bp, Mus musculus
gccacaaatgctcgctaaaacgctg

SEQ ID NO: 938442 - DNA, 25 bp, Mus musculus
gccacaaatgctggctaaaacgctg

SEQ ID NO: 938443 - DNA, 25 bp, Mus musculus
gccacaagcgctgactgaaaatgtg

SEQ ID NO: 938444 - DNA, 25 bp, Mus musculus
gccacaagcgctgagtgaaaatgtg

SEQ ID NO: 938445 - DNA, 25 bp, Mus musculus
gccacaaggaccctttcatttcagg

SEQ ID NO: 938446 - DNA, 25 bp, Mus musculus
gccacaaggaccgtttcatttcagg

SEQ ID NO: 938447 - DNA, 25 bp, Mus musculus
gccacaatcaaagacgaaagcaagc

SEQ ID NO: 938448 - DNA, 25 bp, Mus musculus
gccacaatcaaagaggaaagcaagc

SEQ ID NO: 938449 - DNA, 25 bp, Mus musculus
gccacaatgagactgtggtgcaggt

SEQ ID NO: 938450 - DNA, 25 bp, Mus musculus
gccacaatgagagtgtggtgcaggt

SEQ ID NO: 938451 - DNA, 25 bp, Mus musculus
gccacacaagacgcgagcacaggaa

SEQ ID NO: 938452 - DNA, 25 bp, Mus musculus
gccacacaagtcgcgagcacaggaa

SEQ ID NO: 938453 - DNA, 25 bp, Mus musculus
gccacacagctccacagcacgtacg

SEQ ID NO: 938454 - DNA, 25 bp, Mus musculus
gccacacagctccagagcacgtacg

SEQ ID NO: 938455 - DNA, 25 bp, Mus musculus
gccacacatgcatatcacaactcac

SEQ ID NO: 938456 - DNA, 25 bp, Mus musculus
gccacacatggatatcacaactcac

SEQ ID NO: 938457 - DNA, 25 bp, Mus musculus
gccacaccagccttgatgattcgac

SEQ ID NO: 938458 - DNA, 25 bp, Mus musculus
gccacaccaggcttgatgattcgac

SEQ ID NO: 938459 - DNA, 25 bp, Mus musculus
gccacaccatataccgaagcaaagg

SEQ ID NO: 938460 - DNA, 25 bp, Mus musculus
gccacaccatatataaactacactc

SEQ ID NO: 938461 - DNA, 25 bp, Mus musculus
gccacaccatttaccgaagcaaagg

SEQ ID NO: 938462 - DNA, 25 bp, Mus musculus
gccacaccatttataaactacactc

SEQ ID NO: 938463 - DNA, 25 bp, Mus musculus
gccacacctagccaccaccaccacc

SEQ ID NO: 938464 - DNA, 25 bp, Mus musculus
gccacacctagccagcaccaccacc

SEQ ID NO: 938465 - DNA, 25 bp, Mus musculus
gccacacgtgaccactatggcaaga

SEQ ID NO: 938466 - DNA, 25 bp, Mus musculus
gccacacgtgaccagtatggcaaga

SEQ ID NO: 938467 - DNA, 25 bp, Mus musculus
gccacagaagcaccaggggagaacc

SEQ ID NO: 938468 - DNA, 25 bp, Mus musculus
gccacagaagcacgggagaaccccc

SEQ ID NO: 938469 - DNA, 25 bp, Mus musculus
gccacagaagcagcaggggagaacc

SEQ ID NO: 938470 - DNA, 25 bp, Mus musculus
gccacagaagcaggggagaaccccc

SEQ ID NO: 938471 - DNA, 25 bp, Mus musculus
gccacagaagcagtcagtacaacac

SEQ ID NO: 938472 - DNA, 25 bp, Mus musculus
gccacagaagcagtcgtatttatga

SEQ ID NO: 938473 - DNA, 25 bp, Mus musculus
gccacagaagcagtgagtacaacac

SEQ ID NO: 938474 - DNA, 25 bp, Mus musculus
gccacagaagcagtggtatttatga

SEQ ID NO: 938475 - DNA, 25 bp, Mus musculus
gccacagacaatccaatggtctttg

SEQ ID NO: 938476 - DNA, 25 bp, Mus musculus
gccacagacaatcctatggtctttg

SEQ ID NO: 938477 - DNA, 25 bp, Mus musculus
gccacagcacctatcgggctgaatg

SEQ ID NO: 938478 - DNA, 25 bp, Mus musculus
gccacagcacctatggggctgaatg

SEQ ID NO: 938479 - DNA, 25 bp, Mus musculus
gccacagcagcgctgtcctccatga

SEQ ID NO: 938480 - DNA, 25 bp, Mus musculus
gccacagcagcggtgtcctccatga

SEQ ID NO: 938481 - DNA, 25 bp, Mus musculus
gccacagccaaacttgaagaaatac

SEQ ID NO: 938482 - DNA, 25 bp, Mus musculus
gccacagccaaagttgaagaaatac

SEQ ID NO: 938483 - DNA, 25 bp, Mus musculus
gccacaggatggccagactcagcct

SEQ ID NO: 938484 - DNA, 25 bp, Mus musculus
gccacaggatggccaggcagactca

SEQ ID NO: 938485 - DNA, 25 bp, Mus musculus
gccacaggatgggcagactcagcct

SEQ ID NO: 938486 - DNA, 25 bp, Mus musculus
gccacaggatgggcaggcagactca

SEQ ID NO: 938487 - DNA, 25 bp, Mus musculus
gccacaggcaccctgtctgacctgg

SEQ ID NO: 938488 - DNA, 25 bp, Mus musculus
gccacaggcaccgtgtctgacctgg

SEQ ID NO: 938489 - DNA, 25 bp, Mus musculus
gccacagtcaagcactcattgtggg

SEQ ID NO: 938490 - DNA, 25 bp, Mus musculus
gccacagtcaaggactcattgtggg

SEQ ID NO: 938491 - DNA, 25 bp, Mus musculus
gccacatagaagcctctcagcacca

SEQ ID NO: 938492 - DNA, 25 bp, Mus musculus
gccacatagaaggctctcagcacca

SEQ ID NO: 938493 - DNA, 25 bp, Mus musculus
gccacatcagcgcacttgatttccg

SEQ ID NO: 938494 - DNA, 25 bp, Mus musculus
gccacatcagggcacttgatttccg

SEQ ID NO: 938495 - DNA, 25 bp, Mus musculus
gccacatctccacatgaagtcctgc

SEQ ID NO: 938496 - DNA, 25 bp, Mus musculus
gccacatctccagatgaagtcctgc

SEQ ID NO: 938497 - DNA, 25 bp, Mus musculus
gccacatggatgaaaatgtgagcag

SEQ ID NO: 938498 - DNA, 25 bp, Mus musculus
gccacatggatgaatatgtgagcag

SEQ ID NO: 938499 - DNA, 25 bp, Mus musculus
gccaccaaaatgaacgaagctctga

SEQ ID NO: 938500 - DNA, 25 bp, Mus musculus
gccaccaaaatgaaggaagctctga

SEQ ID NO: 938501 - DNA, 25 bp, Mus musculus
gccaccaagcagaaacagcacctct

SEQ ID NO: 938502 - DNA, 25 bp, Mus musculus
gccaccaagcagcagattacctgga

SEQ ID NO: 938503 - DNA, 25 bp, Mus musculus
gccaccaagcaggagattacctgga

SEQ ID NO: 938504 - DNA, 25 bp, Mus musculus
gccaccaagcagtaacagcacctct

SEQ ID NO: 938505 - DNA, 25 bp, Mus musculus
gccaccacagcacaactgtctggcc

SEQ ID NO: 938506 - DNA, 25 bp, Mus musculus
gccaccacagcagaactgtctggcc

SEQ ID NO: 938507 - DNA, 25 bp, Mus musculus
gccaccacagcggaagaagtcaaga

SEQ ID NO: 938508 - DNA, 25 bp, Mus musculus
gccaccacagcttggcactgaattc

SEQ ID NO: 938509 - DNA, 25 bp, Mus musculus
gccaccacaggggaagaagtcaaga

SEQ ID NO: 938510 - DNA, 25 bp, Mus musculus
gccaccacaggttggcactgaattc

SEQ ID NO: 938511 - DNA, 25 bp, Mus musculus
gccaccacccttcatgccccctcca

SEQ ID NO: 938512 - DNA, 25 bp, Mus musculus
gccaccacccttgatgccccctcca

SEQ ID NO: 938513 - DNA, 25 bp, Mus musculus
gccaccaccgctcacgatgcagatc

SEQ ID NO: 938514 - DNA, 25 bp, Mus musculus
gccaccaccgctgacgatgcagatc

SEQ ID NO: 938515 - DNA, 25 bp, Mus musculus
gccaccactcctctcgatcccagag

SEQ ID NO: 938516 - DNA, 25 bp, Mus musculus
gccaccactcctctggatcccagag

SEQ ID NO: 938517 - DNA, 25 bp, Mus musculus
gccaccatgagccaccaagatcact

SEQ ID NO: 938518 - DNA, 25 bp, Mus musculus
gccaccatgagcgaccaagatcact

SEQ ID NO: 938519 - DNA, 25 bp, Mus musculus
gccacccaattgcctgttaacaaaa

SEQ ID NO: 938520 - DNA, 25 bp, Mus musculus
gccacccaattggctgttaacaaaa

SEQ ID NO: 938521 - DNA, 25 bp, Mus musculus
gccacccattcacggcatatttgga

SEQ ID NO: 938522 - DNA, 25 bp, Mus musculus
gccacccattcagggcatatttgga

SEQ ID NO: 938523 - DNA, 25 bp, Mus musculus
gccacccctgggacaagctcaggcc

SEQ ID NO: 938524 - DNA, 25 bp, Mus musculus
gccacccctgggactagctcaggcc

SEQ ID NO: 938525 - DNA, 25 bp, Mus musculus
gccacccgacagcgccgcagcctcg

SEQ ID NO: 938526 - DNA, 25 bp, Mus musculus
gccacccgacagggccgcagcctcg

SEQ ID NO: 938527 - DNA, 25 bp, Mus musculus
gccaccctggggccgtcgggatgga

SEQ ID NO: 938528 - DNA, 25 bp, Mus musculus
gccaccctgggggcgtcgggatgga

SEQ ID NO: 938529 - DNA, 25 bp, Mus musculus
gccaccctgtgcagaaatgagggag

SEQ ID NO: 938530 - DNA, 25 bp, Mus musculus
gccaccctgtgcagtaatgagggag

SEQ ID NO: 938531 - DNA, 25 bp, Mus musculus
gccaccgatttaaaccttgtgcccc

SEQ ID NO: 938532 - DNA, 25 bp, Mus musculus
gccaccgatttaaagcttgtgcccc

SEQ ID NO: 938533 - DNA, 25 bp, Mus musculus
gccaccgcagcgctgtcagctatga

SEQ ID NO: 938534 - DNA, 25 bp, Mus musculus
gccaccgcagcggtgtcagctatga

SEQ ID NO: 938535 - DNA, 25 bp, Mus musculus
gccaccgccgcgccatggatgggca

SEQ ID NO: 938536 - DNA, 25 bp, Mus musculus
gccaccgccgcggcatggatgggca

SEQ ID NO: 938537 - DNA, 25 bp, Mus musculus
gccacctcacgacgttcctggacat

SEQ ID NO: 938538 - DNA, 25 bp, Mus musculus
gccacctcacgaggttcctggacat

SEQ ID NO: 938539 - DNA, 25 bp, Mus musculus
gccacctctctgctggaatgcagag

SEQ ID NO: 938540 - DNA, 25 bp, Mus musculus
gccacctctctggtggaatgcagag

SEQ ID NO: 938541 - DNA, 25 bp, Mus musculus
gccacctggacgaattccaccgaac

SEQ ID NO: 938542 - DNA, 25 bp, Mus musculus
gccacctggacgtattccaccgaac

SEQ ID NO: 938543 - DNA, 25 bp, Mus musculus
gccacctgggcacgtcagccggctc

SEQ ID NO: 938544 - DNA, 25 bp, Mus musculus
gccacctgggcaggtcagccggctc

SEQ ID NO: 938545 - DNA, 25 bp, Mus musculus
gccacgaaatcaacacgagagcttg

SEQ ID NO: 938546 - DNA, 25 bp, Mus musculus
gccacgaaatgaacacgagagcttg

SEQ ID NO: 938547 - DNA, 25 bp, Mus musculus
gccacgacctagctcatgggccatt

SEQ ID NO: 938548 - DNA, 25 bp, Mus musculus
gccacgacctaggtcatgggccatt

SEQ ID NO: 938549 - DNA, 25 bp, Mus musculus
gccacgagacagactggtcttaggc

SEQ ID NO: 938550 - DNA, 25 bp, Mus musculus
gccacgagacagtctggtcttaggc

SEQ ID NO: 938551 - DNA, 25 bp, Mus musculus
gccacgagagctgagggagtttaac

SEQ ID NO: 938552 - DNA, 25 bp, Mus musculus
gccacgagaggtgagggagtttaac

SEQ ID NO: 938553 - DNA, 25 bp, Mus musculus
gccacgagcaagaaagcaaagggag

SEQ ID NO: 938554 - DNA, 25 bp, Mus musculus
gccacgagcaagtaagcaaagggag

SEQ ID NO: 938555 - DNA, 25 bp, Mus musculus
gccacgctggttcacatcacgtcta

SEQ ID NO: 938556 - DNA, 25 bp, Mus musculus
gccacgctggttcagatcacgtcta

SEQ ID NO: 938557 - DNA, 25 bp, Mus musculus
gccacggaacaacgtagatgccacc

SEQ ID NO: 938558 - DNA, 25 bp, Mus musculus
gccacggaacaaggtagatgccacc

SEQ ID NO: 938559 - DNA, 25 bp, Mus musculus
gccacggaggatcaggatgaggaag

SEQ ID NO: 938560 - DNA, 25 bp, Mus musculus
gccacggaggatctcccgcatggtt

SEQ ID NO: 938561 - DNA, 25 bp, Mus musculus
gccacggaggatgaggatgaggaag

SEQ ID NO: 938562 - DNA, 25 bp, Mus musculus
gccacggaggatgtcccgcatggtt

SEQ ID NO: 938563 - DNA, 25 bp, Mus musculus
gccacggggccacgcatcttcatgc

SEQ ID NO: 938564 - DNA, 25 bp, Mus musculus
gccacggggccaggcatcttcatgc

SEQ ID NO: 938565 - DNA, 25 bp, Mus musculus
gccacgtacctacaacaccacgctg

SEQ ID NO: 938566 - DNA, 25 bp, Mus musculus
gccacgtacctagaacaccacgctg

SEQ ID NO: 938567 - DNA, 25 bp, Mus musculus
gccacgtctctgtgcacacagaagc

SEQ ID NO: 938568 - DNA, 25 bp, Mus musculus
gccacgtctctgtggacacagaagc

SEQ ID NO: 938569 - DNA, 25 bp, Mus musculus
gccacgtgacgacggcagaactttc

SEQ ID NO: 938570 - DNA, 25 bp, Mus musculus
gccacgtgacgagggcagaactttc

SEQ ID NO: 938571 - DNA, 25 bp, Mus musculus
gccacgttgccgacttcctggtggc

SEQ ID NO: 938572 - DNA, 25 bp, Mus musculus
gccacgttgccgagaacctgccaga

SEQ ID NO: 938573 - DNA, 25 bp, Mus musculus
gccacgttgccgattttgtcctgga

SEQ ID NO: 938574 - DNA, 25 bp, Mus musculus
gccacgttgccgtcttcctggtggc

SEQ ID NO: 938575 - DNA, 25 bp, Mus musculus
gccacgttgccgtgaacctgccaga

SEQ ID NO: 938576 - DNA, 25 bp, Mus musculus
gccacgttgccgtttttgtcctgga

SEQ ID NO: 938577 - DNA, 25 bp, Mus musculus
gccactcattcacggagtgttgtga

SEQ ID NO: 938578 - DNA, 25 bp, Mus musculus
gccactcattcagggagtgttgtga

SEQ ID NO: 938579 - DNA, 25 bp, Mus musculus
gccactcggctgcacatcgcaacga

SEQ ID NO: 938580 - DNA, 25 bp, Mus musculus
gccactcggctgcagatcgcaacga

SEQ ID NO: 938581 - DNA, 25 bp, Mus musculus
gccactctagcactgttccgaatgc

SEQ ID NO: 938582 - DNA, 25 bp, Mus musculus
gccactctagcagtgttccgaatgc

SEQ ID NO: 938583 - DNA, 25 bp, Mus musculus
gccactgaccgacaagtgcccccgc

SEQ ID NO: 938584 - DNA, 25 bp, Mus musculus
gccactgaccgagaagtgcccccgc

SEQ ID NO: 938585 - DNA, 25 bp, Mus musculus
gccactgacgcaccagagtgagggc

SEQ ID NO: 938586 - DNA, 25 bp, Mus musculus
gccactgacggaccagagtgagggc

SEQ ID NO: 938587 - DNA, 25 bp, Mus musculus
gccactgcaagccggaagaaagcca

SEQ ID NO: 938588 - DNA, 25 bp, Mus musculus
gccactgcaagcgggaagaaagcca

SEQ ID NO: 938589 - DNA, 25 bp, Mus musculus
gccactgcagagccattgcccgaag

SEQ ID NO: 938590 - DNA, 25 bp, Mus musculus
gccactgcagaggcattgcccgaag

SEQ ID NO: 938591 - DNA, 25 bp, Mus musculus
gccactgccaagcccaccacatcaa

SEQ ID NO: 938592 - DNA, 25 bp, Mus musculus
gccactgccaaggccaccacatcaa

SEQ ID NO: 938593 - DNA, 25 bp, Mus musculus
gccactgctttgcctgtaccccagt

SEQ ID NO: 938594 - DNA, 25 bp, Mus musculus
gccactgctttggctgtaccccagt

SEQ ID NO: 938595 - DNA, 25 bp, Mus musculus
gccactggccctcacgctcagcagg

SEQ ID NO: 938596 - DNA, 25 bp, Mus musculus
gccactggccctcaggctcagcagg

SEQ ID NO: 938597 - DNA, 25 bp, Mus musculus
gccactggggagaggggccattgca

SEQ ID NO: 938598 - DNA, 25 bp, Mus musculus
gccactggggagtggggccattgca

SEQ ID NO: 938599 - DNA, 25 bp, Mus musculus
gccacttactacaatttctgaagtg

SEQ ID NO: 938600 - DNA, 25 bp, Mus musculus
gccacttactactatttctgaagtg

SEQ ID NO: 938601 - DNA, 25 bp, Mus musculus
gccacttcagcaagttcattcccga

SEQ ID NO: 938602 - DNA, 25 bp, Mus musculus
gccacttcaggaagttcattcccga

SEQ ID NO: 938603 - DNA, 25 bp, Mus musculus
gccacttccaagctagcgttggtat

SEQ ID NO: 938604 - DNA, 25 bp, Mus musculus
gccacttccaaggtagcgttggtat

SEQ ID NO: 938605 - DNA, 25 bp, Mus musculus
gccacttccgctcaactattttgca

SEQ ID NO: 938606 - DNA, 25 bp, Mus musculus
gccacttccggtcaactattttgca

SEQ ID NO: 938607 - DNA, 25 bp, Mus musculus
gccactttcatgccgttcaaccgag

SEQ ID NO: 938608 - DNA, 25 bp, Mus musculus
gccactttcatggcgttcaaccgag

SEQ ID NO: 938609 - DNA, 25 bp, Mus musculus
gccagaaaacagctgctgcctagga

SEQ ID NO: 938610 - DNA, 25 bp, Mus musculus
gccagaaaacaggtgctgcctagga

SEQ ID NO: 938611 - DNA, 25 bp, Mus musculus
gccagaaacatgaaggcctcattca

SEQ ID NO: 938612 - DNA, 25 bp, Mus musculus
gccagaaacatgtaggcctcattca

SEQ ID NO: 938613 - DNA, 25 bp, Mus musculus
gccagaaatgcggctggtgtcattt

SEQ ID NO: 938614 - DNA, 25 bp, Mus musculus
gccagaaatggggctggtgtcattt

SEQ ID NO: 938615 - DNA, 25 bp, Mus musculus
gccagaacactgccaccatgaggtc

SEQ ID NO: 938616 - DNA, 25 bp, Mus musculus
gccagaacactggcaccatgaggtc

SEQ ID NO: 938617 - DNA, 25 bp, Mus musculus
gccagaacagatagtcgtacaagca

SEQ ID NO: 938618 - DNA, 25 bp, Mus musculus
gccagaacagccagcccttcggcag

SEQ ID NO: 938619 - DNA, 25 bp, Mus musculus
gccagaacaggcagcccttcggcag

SEQ ID NO: 938620 - DNA, 25 bp, Mus musculus
gccagaacagttagtcgtacaagca

SEQ ID NO: 938621 - DNA, 25 bp, Mus musculus
gccagaagactacattgaggaggag

SEQ ID NO: 938622 - DNA, 25 bp, Mus musculus
gccagaagactacccgccgtgccac

SEQ ID NO: 938623 - DNA, 25 bp, Mus musculus
gccagaagactagattgaggaggag

SEQ ID NO: 938624 - DNA, 25 bp, Mus musculus
gccagaagactagccgccgtgccac

SEQ ID NO: 938625 - DNA, 25 bp, Mus musculus
gccagaagagatcctcagctctctc

SEQ ID NO: 938626 - DNA, 25 bp, Mus musculus
gccagaagagccatggcgagtgccc

SEQ ID NO: 938627 - DNA, 25 bp, Mus musculus
gccagaagaggcatggcgagtgccc

SEQ ID NO: 938628 - DNA, 25 bp, Mus musculus
gccagaagagttcctcagctctctc

SEQ ID NO: 938629 - DNA, 25 bp, Mus musculus
gccagaagcaagcagttcacaggcc

SEQ ID NO: 938630 - DNA, 25 bp, Mus musculus
gccagaagcaaggagttcacaggcc

SEQ ID NO: 938631 - DNA, 25 bp, Mus musculus
gccagaaggaagtaaaaatccatcg

SEQ ID NO: 938632 - DNA, 25 bp, Mus musculus
gccagaaggaagtataaatccatcg

SEQ ID NO: 938633 - DNA, 25 bp, Mus musculus
gccagaatactgcggtggctacatc

SEQ ID NO: 938634 - DNA, 25 bp, Mus musculus
gccagaatactggggtggctacatc

SEQ ID NO: 938635 - DNA, 25 bp, Mus musculus
gccagaattactccatctcccctca

SEQ ID NO: 938636 - DNA, 25 bp, Mus musculus
gccagaattactgcatctcccctca

SEQ ID NO: 938637 - DNA, 25 bp, Mus musculus
gccagacacccacaggctggtccag

SEQ ID NO: 938638 - DNA, 25 bp, Mus musculus
gccagacacccagaggctggtccag

SEQ ID NO: 938639 - DNA, 25 bp, Mus musculus
gccagacagacgcgtccacctcagg

SEQ ID NO: 938640 - DNA, 25 bp, Mus musculus
gccagacagacgggtccacctcagg

SEQ ID NO: 938641 - DNA, 25 bp, Mus musculus
gccagacataaacgtacatacttca

SEQ ID NO: 938642 - DNA, 25 bp, Mus musculus
gccagacataaaggtacatacttca

SEQ ID NO: 938643 - DNA, 25 bp, Mus musculus
gccagaccagaacgtctgctgagag

SEQ ID NO: 938644 - DNA, 25 bp, Mus musculus
gccagaccagaaggtctgctgagag

SEQ ID NO: 938645 - DNA, 25 bp, Mus musculus
gccagaccagatccaagaattaccc

SEQ ID NO: 938646 - DNA, 25 bp, Mus musculus
gccagaccagcatcaagttactggt

SEQ ID NO: 938647 - DNA, 25 bp, Mus musculus
gccagaccaggatcaagttactggt

SEQ ID NO: 938648 - DNA, 25 bp, Mus musculus
gccagaccagttccaagaattaccc

SEQ ID NO: 938649 - DNA, 25 bp, Mus musculus
gccagaccctgacgtctatgacccc

SEQ ID NO: 938650 - DNA, 25 bp, Mus musculus
gccagaccctgaggtctatgacccc

SEQ ID NO: 938651 - DNA, 25 bp, Mus musculus
gccagacctcatccattccagaata

SEQ ID NO: 938652 - DNA, 25 bp, Mus musculus
gccagacctcatgcattccagaata

SEQ ID NO: 938653 - DNA, 25 bp, Mus musculus
gccagacgggaaccctcttatccga

SEQ ID NO: 938654 - DNA, 25 bp, Mus musculus
gccagacgggaagcctcttatccga

SEQ ID NO: 938655 - DNA, 25 bp, Mus musculus
gccagacttaaacatttcacaggtc

SEQ ID NO: 938656 - DNA, 25 bp, Mus musculus
gccagacttaaactggcccagacgt

SEQ ID NO: 938657 - DNA, 25 bp, Mus musculus
gccagacttaaagatttcacaggtc

SEQ ID NO: 938658 - DNA, 25 bp, Mus musculus
gccagacttaaagtggcccagacgt

SEQ ID NO: 938659 - DNA, 25 bp, Mus musculus
gccagagaactgcttgaacagatgg

SEQ ID NO: 938660 - DNA, 25 bp, Mus musculus
gccagagaactggttgaacagatgg

SEQ ID NO: 938661 - DNA, 25 bp, Mus musculus
gccagagacacacgaacctgaggag

SEQ ID NO: 938662 - DNA, 25 bp, Mus musculus
gccagagacacaggaacctgaggag

SEQ ID NO: 938663 - DNA, 25 bp, Mus musculus
gccagagaccgacggagggagccat

SEQ ID NO: 938664 - DNA, 25 bp, Mus musculus
gccagagaccgagggagggagccat

SEQ ID NO: 938665 - DNA, 25 bp, Mus musculus
gccagagagaaacattcagtttaag

SEQ ID NO: 938666 - DNA, 25 bp, Mus musculus
gccagagagaaagattcagtttaag

SEQ ID NO: 938667 - DNA, 25 bp, Mus musculus
gccagagagatgaaatgctcccact

SEQ ID NO: 938668 - DNA, 25 bp, Mus musculus
gccagagagatgtaatgctcccact

SEQ ID NO: 938669 - DNA, 25 bp, Mus musculus
gccagagaggagcttttttcgccgt

SEQ ID NO: 938670 - DNA, 25 bp, Mus musculus
gccagagaggaggttttttcgccgt

SEQ ID NO: 938671 - DNA, 25 bp, Mus musculus
gccagagcagagaggaggtggacca

SEQ ID NO: 938672 - DNA, 25 bp, Mus musculus
gccagagcagagtggaggtggacca

SEQ ID NO: 938673 - DNA, 25 bp, Mus musculus
gccagagcagatgaagtgagagaca

SEQ ID NO: 938674 - DNA, 25 bp, Mus musculus
gccagagcagcacggccctgttctc

SEQ ID NO: 938675 - DNA, 25 bp, Mus musculus
gccagagcagcagggccctgttctc

SEQ ID NO: 938676 - DNA, 25 bp, Mus musculus
gccagagcagcctccttaggcttat

SEQ ID NO: 938677 - DNA, 25 bp, Mus musculus
gccagagcaggctccttaggcttat

SEQ ID NO: 938678 - DNA, 25 bp, Mus musculus
gccagagcagttgaagtgagagaca

SEQ ID NO: 938679 - DNA, 25 bp, Mus musculus
gccagagtacggccgtcctagtgtg

SEQ ID NO: 938680 - DNA, 25 bp, Mus musculus
gccagagtacgggcgtcctagtgtg

SEQ ID NO: 938681 - DNA, 25 bp, Mus musculus
gccagagtcaagatagagtcagcag

SEQ ID NO: 938682 - DNA, 25 bp, Mus musculus
gccagagtcaagttagagtcagcag

SEQ ID NO: 938683 - DNA, 25 bp, Mus musculus
gccagagtgcagctgtggtttcaga

SEQ ID NO: 938684 - DNA, 25 bp, Mus musculus
gccagagtgcaggtgtggtttcaga

SEQ ID NO: 938685 - DNA, 25 bp, Mus musculus
gccagagttacacgaacgtcatcca

SEQ ID NO: 938686 - DNA, 25 bp, Mus musculus
gccagagttacaggaacgtcatcca

SEQ ID NO: 938687 - DNA, 25 bp, Mus musculus
gccagataccagcttgctggtgacc

SEQ ID NO: 938688 - DNA, 25 bp, Mus musculus
gccagataccaggttgctggtgacc

SEQ ID NO: 938689 - DNA, 25 bp, Mus musculus
gccagatatactgtcttgtttcagt

SEQ ID NO: 938690 - DNA, 25 bp, Mus musculus
gccagatatagtgtcttgtttcagt

SEQ ID NO: 938691 - DNA, 25 bp, Mus musculus
gccagatcccgctgcgtggagacct

SEQ ID NO: 938692 - DNA, 25 bp, Mus musculus
gccagatcccgctgggtggagacct

SEQ ID NO: 938693 - DNA, 25 bp, Mus musculus
gccagatgagcatcatggctgctgt

SEQ ID NO: 938694 - DNA, 25 bp, Mus musculus
gccagatgaggatcatggctgctgt

SEQ ID NO: 938695 - DNA, 25 bp, Mus musculus
gccagatgctacgacgttccatatc

SEQ ID NO: 938696 - DNA, 25 bp, Mus musculus
gccagatgctacgaggttccatatc

SEQ ID NO: 938697 - DNA, 25 bp, Mus musculus
gccagatgggacagtggaggaacgc

SEQ ID NO: 938698 - DNA, 25 bp, Mus musculus
gccagatgggtcagtggaggaacgc

SEQ ID NO: 938699 - DNA, 25 bp, Mus musculus
gccagatgtcaacaaagcgtgtacc

SEQ ID NO: 938700 - DNA, 25 bp, Mus musculus
gccagatgtcaacatatctgtttca

SEQ ID NO: 938701 - DNA, 25 bp, Mus musculus
gccagatgtcaagaaagcgtgtacc

SEQ ID NO: 938702 - DNA, 25 bp, Mus musculus
gccagatgtcaagatatctgtttca

SEQ ID NO: 938703 - DNA, 25 bp, Mus musculus
gccagatttaagctgggcatgttca

SEQ ID NO: 938704 - DNA, 25 bp, Mus musculus
gccagatttaaggtgggcatgttca

SEQ ID NO: 938705 - DNA, 25 bp, Mus musculus
gccagatttgctgctgtgtaatgga

SEQ ID NO: 938706 - DNA, 25 bp, Mus musculus
gccagatttggtgctgtgtaatgga

SEQ ID NO: 938707 - DNA, 25 bp, Mus musculus
gccagattttcaggccattgtgctt

SEQ ID NO: 938708 - DNA, 25 bp, Mus musculus
gccagattttcagggcattgtgctt

SEQ ID NO: 938709 - DNA, 25 bp, Mus musculus
gccagcaacgctatagaaaatgatg

SEQ ID NO: 938710 - DNA, 25 bp, Mus musculus
gccagcaacggtatagaaaatgatg

SEQ ID NO: 938711 - DNA, 25 bp, Mus musculus
gccagcaatgagcatgtgactaaag

SEQ ID NO: 938712 - DNA, 25 bp, Mus musculus
gccagcaatgaggatgtgactaaag

SEQ ID NO: 938713 - DNA, 25 bp, Mus musculus
gccagcacagccacacaaaccaatg

SEQ ID NO: 938714 - DNA, 25 bp, Mus musculus
gccagcacaggcacacaaaccaatg

SEQ ID NO: 938715 - DNA, 25 bp, Mus musculus
gccagcagagaagaagtgaccatta

SEQ ID NO: 938716 - DNA, 25 bp, Mus musculus
gccagcagagaagatgtgaccatta

SEQ ID NO: 938717 - DNA, 25 bp, Mus musculus
gccagcagagtgaacggagcaagag

SEQ ID NO: 938718 - DNA, 25 bp, Mus musculus
gccagcagagtgaagggagcaagag

SEQ ID NO: 938719 - DNA, 25 bp, Mus musculus
gccagcagcagaacccagagtccca

SEQ ID NO: 938720 - DNA, 25 bp, Mus musculus
gccagcagcagaatttgtggcccta

SEQ ID NO: 938721 - DNA, 25 bp, Mus musculus
gccagcagcagatcccagagtccca

SEQ ID NO: 938722 - DNA, 25 bp, Mus musculus
gccagcagcagattttgtggcccta

SEQ ID NO: 938723 - DNA, 25 bp, Mus musculus
gccagcagctcagacccccatcagc

SEQ ID NO: 938724 - DNA, 25 bp, Mus musculus
gccagcagctcagagccccatcagc

SEQ ID NO: 938725 - DNA, 25 bp, Mus musculus
gccagcatcacccgcagcagtcaga

SEQ ID NO: 938726 - DNA, 25 bp, Mus musculus
gccagcatcaccggcagcagtcaga

SEQ ID NO: 938727 - DNA, 25 bp, Mus musculus
gccagccaacttagactcctgcgcc

SEQ ID NO: 938728 - DNA, 25 bp, Mus musculus
gccagccaactttgactcctgcgcc

SEQ ID NO: 938729 - DNA, 25 bp, Mus musculus
gccagccacacacccacagtctggt

SEQ ID NO: 938730 - DNA, 25 bp, Mus musculus
gccagccacacagccacagtctggt

SEQ ID NO: 938731 - DNA, 25 bp, Mus musculus
gccagccactcacaacccctggcct

SEQ ID NO: 938732 - DNA, 25 bp, Mus musculus
gccagccactcagaacccctggcct

SEQ ID NO: 938733 - DNA, 25 bp, Mus musculus
gccagccaggattttgtggacgttt

SEQ ID NO: 938734 - DNA, 25 bp, Mus musculus
gccagccaggcctgcagcatcaatc

SEQ ID NO: 938735 - DNA, 25 bp, Mus musculus
gccagccagggctgcagcatcaatc

SEQ ID NO: 938736 - DNA, 25 bp, Mus musculus
gccagccaggtttttgtggacgttt

SEQ ID NO: 938737 - DNA, 25 bp, Mus musculus
gccagccatgctggctggggagttt

SEQ ID NO: 938738 - DNA, 25 bp, Mus musculus
gccagccatggtggctggggagttt

SEQ ID NO: 938739 - DNA, 25 bp, Mus musculus
gccagcccagaggaaccccaactgc

SEQ ID NO: 938740 - DNA, 25 bp, Mus musculus
gccagcccagcgcaaacgctacaag

SEQ ID NO: 938741 - DNA, 25 bp, Mus musculus
gccagcccagcggcacctacccgcg

SEQ ID NO: 938742 - DNA, 25 bp, Mus musculus
gccagcccagctatccttacccagt

SEQ ID NO: 938743 - DNA, 25 bp, Mus musculus
gccagcccagctatgcttacccagt

SEQ ID NO: 938744 - DNA, 25 bp, Mus musculus
gccagcccagggcaaacgctacaag

SEQ ID NO: 938745 - DNA, 25 bp, Mus musculus
gccagcccaggggcacctacccgcg

SEQ ID NO: 938746 - DNA, 25 bp, Mus musculus
gccagcccagtggaaccccaactgc

SEQ ID NO: 938747 - DNA, 25 bp, Mus musculus
gccagccctgagcacgagtctgcag

SEQ ID NO: 938748 - DNA, 25 bp, Mus musculus
gccagccctgagcaggagtctgcag

SEQ ID NO: 938749 - DNA, 25 bp, Mus musculus
gccagcctcctgcgtgttctcttcc

SEQ ID NO: 938750 - DNA, 25 bp, Mus musculus
gccagcctcctgcgttggctgcaag

SEQ ID NO: 938751 - DNA, 25 bp, Mus musculus
gccagcctcctgggtgttctcttcc

SEQ ID NO: 938752 - DNA, 25 bp, Mus musculus
gccagcctcctgggttggctgcaag

SEQ ID NO: 938753 - DNA, 25 bp, Mus musculus
gccagcctgagccagccagaggaag

SEQ ID NO: 938754 - DNA, 25 bp, Mus musculus
gccagcctgagcgagccagaggaag

SEQ ID NO: 938755 - DNA, 25 bp, Mus musculus
gccagcgagagcaacctctctgaga

SEQ ID NO: 938756 - DNA, 25 bp, Mus musculus
gccagcgagagcaagctctctgaga

SEQ ID NO: 938757 - DNA, 25 bp, Mus musculus
gccagcgccgaccgtgacctcgtga

SEQ ID NO: 938758 - DNA, 25 bp, Mus musculus
gccagcgccgtccgtgacctcgtga

SEQ ID NO: 938759 - DNA, 25 bp, Mus musculus
gccagctactcccacgttgcccaca

SEQ ID NO: 938760 - DNA, 25 bp, Mus musculus
gccagctactcccaggttgcccaca

SEQ ID NO: 938761 - DNA, 25 bp, Mus musculus
gccagctcaaagctgtgtgtcaacc

SEQ ID NO: 938762 - DNA, 25 bp, Mus musculus
gccagctcaaaggtgtgtgtcaacc

SEQ ID NO: 938763 - DNA, 25 bp, Mus musculus
gccagctccacgtcacaggatgctg

SEQ ID NO: 938764 - DNA, 25 bp, Mus musculus
gccagctccaggtcacaggatgctg

SEQ ID NO: 938765 - DNA, 25 bp, Mus musculus
gccagctcgactagatgaagttcct

SEQ ID NO: 938766 - DNA, 25 bp, Mus musculus
gccagctcgagtagatgaagttcct

SEQ ID NO: 938767 - DNA, 25 bp, Mus musculus
gccagctgttagatgacggccataa

SEQ ID NO: 938768 - DNA, 25 bp, Mus musculus
gccagctgttagttgacggccataa

SEQ ID NO: 938769 - DNA, 25 bp, Mus musculus
gccagcttaaagcacggagaattac

SEQ ID NO: 938770 - DNA, 25 bp, Mus musculus
gccagcttaaagcagggagaattac

SEQ ID NO: 938771 - DNA, 25 bp, Mus musculus
gccagcttcttttcaatcatccaga

SEQ ID NO: 938772 - DNA, 25 bp, Mus musculus
gccagcttcttttctatcatccaga

SEQ ID NO: 938773 - DNA, 25 bp, Mus musculus
gccagctttgggcggctggctgtgg

SEQ ID NO: 938774 - DNA, 25 bp, Mus musculus
gccagctttggggggctggctgtgg

SEQ ID NO: 938775 - DNA, 25 bp, Mus musculus
gccaggaagaaacgaaaatcagagg

SEQ ID NO: 938776 - DNA, 25 bp, Mus musculus
gccaggaagaaaggaaaatcagagg

SEQ ID NO: 938777 - DNA, 25 bp, Mus musculus
gccaggaaggatttatcttagttgg

SEQ ID NO: 938778 - DNA, 25 bp, Mus musculus
gccaggaaggttttatcttagttgg

SEQ ID NO: 938779 - DNA, 25 bp, Mus musculus
gccaggacctccaacgcaagatcac

SEQ ID NO: 938780 - DNA, 25 bp, Mus musculus
gccaggacctccaaggcaagatcac

SEQ ID NO: 938781 - DNA, 25 bp, Mus musculus
gccaggacgagacaacatcccatta

SEQ ID NO: 938782 - DNA, 25 bp, Mus musculus
gccaggacgagacatcatcccatta

SEQ ID NO: 938783 - DNA, 25 bp, Mus musculus
gccaggacgctgctctgccatcaaa

SEQ ID NO: 938784 - DNA, 25 bp, Mus musculus
gccaggacgctggtctgccatcaaa

SEQ ID NO: 938785 - DNA, 25 bp, Mus musculus
gccaggagaatgctccgtctcccag

SEQ ID NO: 938786 - DNA, 25 bp, Mus musculus
gccaggagaatggtccgtctcccag

SEQ ID NO: 938787 - DNA, 25 bp, Mus musculus
gccaggagagagcggagaaagggga

SEQ ID NO: 938788 - DNA, 25 bp, Mus musculus
gccaggagagaggggagaaagggga

SEQ ID NO: 938789 - DNA, 25 bp, Mus musculus
gccaggagcttgctttgaaggagat

SEQ ID NO: 938790 - DNA, 25 bp, Mus musculus
gccaggagcttggtttgaaggagat

SEQ ID NO: 938791 - DNA, 25 bp, Mus musculus
gccaggagggaccattctgacgttg

SEQ ID NO: 938792 - DNA, 25 bp, Mus musculus
gccaggagggacgattctgacgttg

SEQ ID NO: 938793 - DNA, 25 bp, Mus musculus
gccaggatgctaagatggctggtat

SEQ ID NO: 938794 - DNA, 25 bp, Mus musculus
gccaggatgctatgatggctggtat

SEQ ID NO: 938795 - DNA, 25 bp, Mus musculus
gccaggattaaaaacgatactcact

SEQ ID NO: 938796 - DNA, 25 bp, Mus musculus
gccaggattaaaaaggatactcact

SEQ ID NO: 938797 - DNA, 25 bp, Mus musculus
gccaggatttgaccaactacagttt

SEQ ID NO: 938798 - DNA, 25 bp, Mus musculus
gccaggatttgagcaactacagttt

SEQ ID NO: 938799 - DNA, 25 bp, Mus musculus
gccaggcagttcaacgcaataaaag

SEQ ID NO: 938800 - DNA, 25 bp, Mus musculus
gccaggcagttcaacggctaactta

SEQ ID NO: 938801 - DNA, 25 bp, Mus musculus
gccaggcagttcaaggcaataaaag

SEQ ID NO: 938802 - DNA, 25 bp, Mus musculus
gccaggcagttcaagggctaactta

SEQ ID NO: 938803 - DNA, 25 bp, Mus musculus
gccaggcatccaggctcatgttggt

SEQ ID NO: 938804 - DNA, 25 bp, Mus musculus
gccaggcatccagggtcatgttggt

SEQ ID NO: 938805 - DNA, 25 bp, Mus musculus
gccaggccaatccctccctcttcgc

SEQ ID NO: 938806 - DNA, 25 bp, Mus musculus
gccaggccaatcgctccctcttcgc

SEQ ID NO: 938807 - DNA, 25 bp, Mus musculus
gccaggccagcctcctgtgggcctc

SEQ ID NO: 938808 - DNA, 25 bp, Mus musculus
gccaggccaggctcctgtgggcctc

SEQ ID NO: 938809 - DNA, 25 bp, Mus musculus
gccaggccgtcaagatcctccatga

SEQ ID NO: 938810 - DNA, 25 bp, Mus musculus
gccaggccgtcaagttcctccatga

SEQ ID NO: 938811 - DNA, 25 bp, Mus musculus
gccaggcgcaacctgcgggaggcaa

SEQ ID NO: 938812 - DNA, 25 bp, Mus musculus
gccaggcgcatcctgcgggaggcaa

SEQ ID NO: 938813 - DNA, 25 bp, Mus musculus
gccaggcgcggccggatatgtggta

SEQ ID NO: 938814 - DNA, 25 bp, Mus musculus
gccaggcgcggcgggatatgtggta

SEQ ID NO: 938815 - DNA, 25 bp, Mus musculus
gccaggcgtgggcccgcagcctcgt

SEQ ID NO: 938816 - DNA, 25 bp, Mus musculus
gccaggcgtggggccgcagcctcgt

SEQ ID NO: 938817 - DNA, 25 bp, Mus musculus
gccaggctagagatcctgcagcttc

SEQ ID NO: 938818 - DNA, 25 bp, Mus musculus
gccaggctagagttcctgcagcttc

SEQ ID NO: 938819 - DNA, 25 bp, Mus musculus
gccaggctggaacaactctattcgt

SEQ ID NO: 938820 - DNA, 25 bp, Mus musculus
gccaggctggaagaactctattcgt

SEQ ID NO: 938821 - DNA, 25 bp, Mus musculus
gccagggacatacgaatgttctaga

SEQ ID NO: 938822 - DNA, 25 bp, Mus musculus
gccagggacataggaatgttctaga

SEQ ID NO: 938823 - DNA, 25 bp, Mus musculus
gccagggaggagattttacatctcc

SEQ ID NO: 938824 - DNA, 25 bp, Mus musculus
gccagggaggagtttttacatctcc

SEQ ID NO: 938825 - DNA, 25 bp, Mus musculus
gccagggcaacgaggtcagacctga

SEQ ID NO: 938826 - DNA, 25 bp, Mus musculus
gccagggcaaggaggtcagacctga

SEQ ID NO: 938827 - DNA, 25 bp, Mus musculus
gccagggctgagccttgttccccct

SEQ ID NO: 938828 - DNA, 25 bp, Mus musculus
gccagggctgaggcttgttccccct

SEQ ID NO: 938829 - DNA, 25 bp, Mus musculus
gccagggggctgaccgacgagtccg

SEQ ID NO: 938830 - DNA, 25 bp, Mus musculus
gccagggggctgacggacgagtccg

SEQ ID NO: 938831 - DNA, 25 bp, Mus musculus
gccagggtcactgtcactccagctc

SEQ ID NO: 938832 - DNA, 25 bp, Mus musculus
gccagggtcactgtgactccagctc

SEQ ID NO: 938833 - DNA, 25 bp, Mus musculus
gccagggttcagcctgccatggaca

SEQ ID NO: 938834 - DNA, 25 bp, Mus musculus
gccagggttcaggctgccatggaca

SEQ ID NO: 938835 - DNA, 25 bp, Mus musculus
gccaggtgcaccagcgagcctgtca

SEQ ID NO: 938836 - DNA, 25 bp, Mus musculus
gccaggtgcacctgcgagcctgtca

SEQ ID NO: 938837 - DNA, 25 bp, Mus musculus
gccaggtgggagggatgaggtgagt

SEQ ID NO: 938838 - DNA, 25 bp, Mus musculus
gccaggtgggtgggatgaggtgagt

SEQ ID NO: 938839 - DNA, 25 bp, Mus musculus
gccaggtgtccgcggtgaagatggc

SEQ ID NO: 938840 - DNA, 25 bp, Mus musculus
gccaggtgtccggggtgaagatggc

SEQ ID NO: 938841 - DNA, 25 bp, Mus musculus
gccaggttcaataacacggtgcagg

SEQ ID NO: 938842 - DNA, 25 bp, Mus musculus
gccaggttcaataagacggtgcagg

SEQ ID NO: 938843 - DNA, 25 bp, Mus musculus
gccagtaaagccaacgtgcagcagc

SEQ ID NO: 938844 - DNA, 25 bp, Mus musculus
gccagtaaagccaaggtgcagcagc

SEQ ID NO: 938845 - DNA, 25 bp, Mus musculus
gccagtaatacaatcaaactacaac

SEQ ID NO: 938846 - DNA, 25 bp, Mus musculus
gccagtaatacattcaaactacaac

SEQ ID NO: 938847 - DNA, 25 bp, Mus musculus
gccagtacagcgtctgatccgacat

SEQ ID NO: 938848 - DNA, 25 bp, Mus musculus
gccagtacagggtctgatccgacat

SEQ ID NO: 938849 - DNA, 25 bp, Mus musculus
gccagtatggagacacggactattt

SEQ ID NO: 938850 - DNA, 25 bp, Mus musculus
gccagtatggagatcctcaccacga

SEQ ID NO: 938851 - DNA, 25 bp, Mus musculus
gccagtatggagtcacggactattt

SEQ ID NO: 938852 - DNA, 25 bp, Mus musculus
gccagtatggagttcctcaccacga

SEQ ID NO: 938853 - DNA, 25 bp, Mus musculus
gccagtcaagatagccagccctgga

SEQ ID NO: 938854 - DNA, 25 bp, Mus musculus
gccagtcaagttagccagccctgga

SEQ ID NO: 938855 - DNA, 25 bp, Mus musculus
gccagtcacactatgcggtgacatc

SEQ ID NO: 938856 - DNA, 25 bp, Mus musculus
gccagtcacagtatgcggtgacatc

SEQ ID NO: 938857 - DNA, 25 bp, Mus musculus
gccagtcactttccaaaccgcacag

SEQ ID NO: 938858 - DNA, 25 bp, Mus musculus
gccagtcactttccaaccagcaatg

SEQ ID NO: 938859 - DNA, 25 bp, Mus musculus
gccagtcactttcctaaccgcacag

SEQ ID NO: 938860 - DNA, 25 bp, Mus musculus
gccagtcactttcctaccagcaatg

SEQ ID NO: 938861 - DNA, 25 bp, Mus musculus
gccagtcaggatcgtgaagcgcagc

SEQ ID NO: 938862 - DNA, 25 bp, Mus musculus
gccagtcaggatggtgaagcgcagc

SEQ ID NO: 938863 - DNA, 25 bp, Mus musculus
gccagtctggagccgtccctacagc

SEQ ID NO: 938864 - DNA, 25 bp, Mus musculus
gccagtctggaggcgtccctacagc

SEQ ID NO: 938865 - DNA, 25 bp, Mus musculus
gccagtctggaggtcgcgtccctac

SEQ ID NO: 938866 - DNA, 25 bp, Mus musculus
gccagtctggaggtggcgtccctac

SEQ ID NO: 938867 - DNA, 25 bp, Mus musculus
gccagtctgggggacgaaagaccac

SEQ ID NO: 938868 - DNA, 25 bp, Mus musculus
gccagtctgggggaggaaagaccac

SEQ ID NO: 938869 - DNA, 25 bp, Mus musculus
gccagtgaagaggaagttagaagat

SEQ ID NO: 938870 - DNA, 25 bp, Mus musculus
gccagtgaagtggaagttagaagat

SEQ ID NO: 938871 - DNA, 25 bp, Mus musculus
gccagtgagaagcgatattacttcc

SEQ ID NO: 938872 - DNA, 25 bp, Mus musculus
gccagtgagaagggatattacttcc

SEQ ID NO: 938873 - DNA, 25 bp, Mus musculus
gccagtgaggctgtcatctgggagg

SEQ ID NO: 938874 - DNA, 25 bp, Mus musculus
gccagtgagggtgtcatctgggagg

SEQ ID NO: 938875 - DNA, 25 bp, Mus musculus
gccagtgcagaagctccacaggaac

SEQ ID NO: 938876 - DNA, 25 bp, Mus musculus
gccagtgcagtagctccacaggaac

SEQ ID NO: 938877 - DNA, 25 bp, Mus musculus
gccagtgcccccaccggatgcagaa

SEQ ID NO: 938878 - DNA, 25 bp, Mus musculus
gccagtgccccctccggatgcagaa

SEQ ID NO: 938879 - DNA, 25 bp, Mus musculus
gccagtgctgcaacagcaaaccacg

SEQ ID NO: 938880 - DNA, 25 bp, Mus musculus
gccagtgctggaacagcaaaccacg

SEQ ID NO: 938881 - DNA, 25 bp, Mus musculus
gccagtggcgcagaggtgtttgatt

SEQ ID NO: 938882 - DNA, 25 bp, Mus musculus
gccagtggcggagaggtgtttgatt

SEQ ID NO: 938883 - DNA, 25 bp, Mus musculus
gccagtgtgttaagccaaatttacg

SEQ ID NO: 938884 - DNA, 25 bp, Mus musculus
gccagtgtgttaagtattttggaaa

SEQ ID NO: 938885 - DNA, 25 bp, Mus musculus
gccagtgtgttatgccaaatttacg

SEQ ID NO: 938886 - DNA, 25 bp, Mus musculus
gccagtgtgttatgtattttggaaa

SEQ ID NO: 938887 - DNA, 25 bp, Mus musculus
gccagttcaacagccccaaatggaa

SEQ ID NO: 938888 - DNA, 25 bp, Mus musculus
gccagttcaactttatccaccgcca

SEQ ID NO: 938889 - DNA, 25 bp, Mus musculus
gccagttcaagagccccaaatggaa

SEQ ID NO: 938890 - DNA, 25 bp, Mus musculus
gccagttcaagtttatccaccgcca

SEQ ID NO: 938891 - DNA, 25 bp, Mus musculus
gccagttcagcaagacagaagtgtt

SEQ ID NO: 938892 - DNA, 25 bp, Mus musculus
gccagttcaggaagacagaagtgtt

SEQ ID NO: 938893 - DNA, 25 bp, Mus musculus
gccagttcctcagggcagtggctca

SEQ ID NO: 938894 - DNA, 25 bp, Mus musculus
gccagttcctgagggcagtggctca

SEQ ID NO: 938895 - DNA, 25 bp, Mus musculus
gccagttcttcactgctgagcctac

SEQ ID NO: 938896 - DNA, 25 bp, Mus musculus
gccagttcttcagtgctgagcctac

SEQ ID NO: 938897 - DNA, 25 bp, Mus musculus
gccataatgacaagtaccaggtgtg

SEQ ID NO: 938898 - DNA, 25 bp, Mus musculus
gccataatgagaagtaccaggtgtg

SEQ ID NO: 938899 - DNA, 25 bp, Mus musculus
gccatacagctgctaaacaccagag

SEQ ID NO: 938900 - DNA, 25 bp, Mus musculus
gccatacagctggtaaacaccagag

SEQ ID NO: 938901 - DNA, 25 bp, Mus musculus
gccatacttaagagaatctgtgtcc

SEQ ID NO: 938902 - DNA, 25 bp, Mus musculus
gccatacttaagagtatctgtgtcc

SEQ ID NO: 938903 - DNA, 25 bp, Mus musculus
gccatagcagcactgatggatgtca

SEQ ID NO: 938904 - DNA, 25 bp, Mus musculus
gccatagcaggactgatggatgtca

SEQ ID NO: 938905 - DNA, 25 bp, Mus musculus
gccatatcagcaacaagttcctgtt

SEQ ID NO: 938906 - DNA, 25 bp, Mus musculus
gccatatcaggaacaagttcctgtt

SEQ ID NO: 938907 - DNA, 25 bp, Mus musculus
gccatatccttccacatgtatcggg

SEQ ID NO: 938908 - DNA, 25 bp, Mus musculus
gccatatccttccacatgtatctgg

SEQ ID NO: 938909 - DNA, 25 bp, Mus musculus
gccatatccttccagatgtatcggg

SEQ ID NO: 938910 - DNA, 25 bp, Mus musculus
gccatatccttccagatgtatctgg

SEQ ID NO: 938911 - DNA, 25 bp, Mus musculus
gccatcaaacagctagtgaagcatt

SEQ ID NO: 938912 - DNA, 25 bp, Mus musculus
gccatcaaacaggtagtgaagcatt

SEQ ID NO: 938913 - DNA, 25 bp, Mus musculus
gccatcaaagagacctggacacaca

SEQ ID NO: 938914 - DNA, 25 bp, Mus musculus
gccatcaaagagtcctggacacaca

SEQ ID NO: 938915 - DNA, 25 bp, Mus musculus
gccatcaaatatgaagcacacagtg

SEQ ID NO: 938916 - DNA, 25 bp, Mus musculus
gccatcaaatttgaagcacacagtg

SEQ ID NO: 938917 - DNA, 25 bp, Mus musculus
gccatcacctatgacacactaaagt

SEQ ID NO: 938918 - DNA, 25 bp, Mus musculus
gccatcacctatgacagcggagaag

SEQ ID NO: 938919 - DNA, 25 bp, Mus musculus
gccatcacctatgacatggtagaag

SEQ ID NO: 938920 - DNA, 25 bp, Mus musculus
gccatcacctatgagacactaaagt

SEQ ID NO: 938921 - DNA, 25 bp, Mus musculus
gccatcacctatgagagcggagaag

SEQ ID NO: 938922 - DNA, 25 bp, Mus musculus
gccatcacctatgagatggtagaag

SEQ ID NO: 938923 - DNA, 25 bp, Mus musculus
gccatcactaagatcaaaccacata

SEQ ID NO: 938924 - DNA, 25 bp, Mus musculus
gccatcactaagttcaaaccacata

SEQ ID NO: 938925 - DNA, 25 bp, Mus musculus
gccatcaggaagcagcaggaagaat

SEQ ID NO: 938926 - DNA, 25 bp, Mus musculus
gccatcaggaaggagcaggaagaat

SEQ ID NO: 938927 - DNA, 25 bp, Mus musculus
gccatcaggacacacttgaaccgga

SEQ ID NO: 938928 - DNA, 25 bp, Mus musculus
gccatcaggacagacttgaaccgga

SEQ ID NO: 938929 - DNA, 25 bp, Mus musculus
gccatcagggaacatacattgtgtg

SEQ ID NO: 938930 - DNA, 25 bp, Mus musculus
gccatcagggaaccttccctgttga

SEQ ID NO: 938931 - DNA, 25 bp, Mus musculus
gccatcagggaagatacattgtgtg

SEQ ID NO: 938932 - DNA, 25 bp, Mus musculus
gccatcagggaagcttccctgttga

SEQ ID NO: 938933 - DNA, 25 bp, Mus musculus
gccatcatcgatcctgcacaggagg

SEQ ID NO: 938934 - DNA, 25 bp, Mus musculus
gccatcatcgatgctgcacaggagg

SEQ ID NO: 938935 - DNA, 25 bp, Mus musculus
gccatcatgcgccccaatgacagtc

SEQ ID NO: 938936 - DNA, 25 bp, Mus musculus
gccatcatgcgcccgaatgacagtc

SEQ ID NO: 938937 - DNA, 25 bp, Mus musculus
gccatcattgcaaagatctataccc

SEQ ID NO: 938938 - DNA, 25 bp, Mus musculus
gccatcattggaaagatctataccc

SEQ ID NO: 938939 - DNA, 25 bp, Mus musculus
gccatccagctgatcacgcgcatgg

SEQ ID NO: 938940 - DNA, 25 bp, Mus musculus
gccatccagctgttcacgcgcatgg

SEQ ID NO: 938941 - DNA, 25 bp, Mus musculus
gccatccaggccgaactgggagacc

SEQ ID NO: 938942 - DNA, 25 bp, Mus musculus
gccatccagggcgaactgggagacc

SEQ ID NO: 938943 - DNA, 25 bp, Mus musculus
gccatcccaaagcgtttgcatatat

SEQ ID NO: 938944 - DNA, 25 bp, Mus musculus
gccatcccaaagggtttgcatatat

SEQ ID NO: 938945 - DNA, 25 bp, Mus musculus
gccatcccaacacgtgatgacccca

SEQ ID NO: 938946 - DNA, 25 bp, Mus musculus
gccatcccaacaggtgatgacccca

SEQ ID NO: 938947 - DNA, 25 bp, Mus musculus
gccatcccagcacccccaaaaggaa

SEQ ID NO: 938948 - DNA, 25 bp, Mus musculus
gccatcccagcagccccaaaaggaa

SEQ ID NO: 938949 - DNA, 25 bp, Mus musculus
gccatccccagacgattatcacaaa

SEQ ID NO: 938950 - DNA, 25 bp, Mus musculus
gccatccccagaggattatcacaaa

SEQ ID NO: 938951 - DNA, 25 bp, Mus musculus
gccatcccgaggcagaaatgtctgc

SEQ ID NO: 938952 - DNA, 25 bp, Mus musculus
gccatcccgagggagaaatgtctgc

SEQ ID NO: 938953 - DNA, 25 bp, Mus musculus
gccatcctggcgatcattacagggg

SEQ ID NO: 938954 - DNA, 25 bp, Mus musculus
gccatcctggcgcggaattctaccg

SEQ ID NO: 938955 - DNA, 25 bp, Mus musculus
gccatcctggcggggaattctaccg

SEQ ID NO: 938956 - DNA, 25 bp, Mus musculus
gccatcctggcgttcattacagggg

SEQ ID NO: 938957 - DNA, 25 bp, Mus musculus
gccatcctggcttgctcttctggtg

SEQ ID NO: 938958 - DNA, 25 bp, Mus musculus
gccatcctgggttgctcttctggtg

SEQ ID NO: 938959 - DNA, 25 bp, Mus musculus
gccatcctgtcgcacttttccacag

SEQ ID NO: 938960 - DNA, 25 bp, Mus musculus
gccatcctgtcggacttttccacag

SEQ ID NO: 938961 - DNA, 25 bp, Mus musculus
gccatcgacagtcgcaaccctcctg

SEQ ID NO: 938962 - DNA, 25 bp, Mus musculus
gccatcgacagtggcaaccctcctg

SEQ ID NO: 938963 - DNA, 25 bp, Mus musculus
gccatcgagcagctattcccaagcc

SEQ ID NO: 938964 - DNA, 25 bp, Mus musculus
gccatcgagcagctgtcaccggatg

SEQ ID NO: 938965 - DNA, 25 bp, Mus musculus
gccatcgagcaggtattcccaagcc

SEQ ID NO: 938966 - DNA, 25 bp, Mus musculus
gccatcgagcaggtgtcaccggatg

SEQ ID NO: 938967 - DNA, 25 bp, Mus musculus
gccatcgagtggaactttgagaagt

SEQ ID NO: 938968 - DNA, 25 bp, Mus musculus
gccatcgagtggaagtttgagaagt

SEQ ID NO: 938969 - DNA, 25 bp, Mus musculus
gccatcggatcaatcgctctgcctg

SEQ ID NO: 938970 - DNA, 25 bp, Mus musculus
gccatcggatcaatggctctgcctg

SEQ ID NO: 938971 - DNA, 25 bp, Mus musculus
gccatcggcttcctatttgcatagg

SEQ ID NO: 938972 - DNA, 25 bp, Mus musculus
gccatcggcttcgtatttgcatagg

SEQ ID NO: 938973 - DNA, 25 bp, Mus musculus
gccatcgtagctgccgatccccttg

SEQ ID NO: 938974 - DNA, 25 bp, Mus musculus
gccatcgtaggtgccgatccccttg

SEQ ID NO: 938975 - DNA, 25 bp, Mus musculus
gccatcgttaagctcttccatggtg

SEQ ID NO: 938976 - DNA, 25 bp, Mus musculus
gccatcgttaaggtcttccatggtg

SEQ ID NO: 938977 - DNA, 25 bp, Mus musculus
gccatctagctaatcgggtagctgg

SEQ ID NO: 938978 - DNA, 25 bp, Mus musculus
gccatctagctaatggggtagctgg

SEQ ID NO: 938979 - DNA, 25 bp, Mus musculus
gccatctatgagcacaaagtgtatt

SEQ ID NO: 938980 - DNA, 25 bp, Mus musculus
gccatctatgaggacaaagtgtatt

SEQ ID NO: 938981 - DNA, 25 bp, Mus musculus
gccatctcagagactatggtcaact

SEQ ID NO: 938982 - DNA, 25 bp, Mus musculus
gccatctcagctgatgaagaggctc

SEQ ID NO: 938983 - DNA, 25 bp, Mus musculus
gccatctcaggtgatgaagaggctc

SEQ ID NO: 938984 - DNA, 25 bp, Mus musculus
gccatctcagtgactatggtcaact

SEQ ID NO: 938985 - DNA, 25 bp, Mus musculus
gccatctccaagcaactggcttccc

SEQ ID NO: 938986 - DNA, 25 bp, Mus musculus
gccatctccaaggaactggcttccc

SEQ ID NO: 938987 - DNA, 25 bp, Mus musculus
gccatctcccagcgtgtagagtcag

SEQ ID NO: 938988 - DNA, 25 bp, Mus musculus
gccatctcccagggtgtagagtcag

SEQ ID NO: 938989 - DNA, 25 bp, Mus musculus
gccatctcctctcttgtccgagagc

SEQ ID NO: 938990 - DNA, 25 bp, Mus musculus
gccatctcctgtcttgtccgagagc

SEQ ID NO: 938991 - DNA, 25 bp, Mus musculus
gccatctggcaaagcgtatacctgg

SEQ ID NO: 938992 - DNA, 25 bp, Mus musculus
gccatctggcaaagggtatacctgg

SEQ ID NO: 938993 - DNA, 25 bp, Mus musculus
gccatctgtagccccgacaccatgg

SEQ ID NO: 938994 - DNA, 25 bp, Mus musculus
gccatctgtagcccggacaccatgg

SEQ ID NO: 938995 - DNA, 25 bp, Mus musculus
gccatcttcctcagcaggtccctag

SEQ ID NO: 938996 - DNA, 25 bp, Mus musculus
gccatcttcctcaggaggtccctag

SEQ ID NO: 938997 - DNA, 25 bp, Mus musculus
gccatcttccttcactcctgcgcca

SEQ ID NO: 938998 - DNA, 25 bp, Mus musculus
gccatcttccttcagactcctgcgc

SEQ ID NO: 938999 - DNA, 25 bp, Mus musculus
gccatcttccttgactcctgcgcca

SEQ ID NO: 939000 - DNA, 25 bp, Mus musculus
gccatcttccttgagactcctgcgc

SEQ ID NO: 939001 - DNA, 25 bp, Mus musculus
gccatcttggatcttctggacacag

SEQ ID NO: 939002 - DNA, 25 bp, Mus musculus
gccatcttggatgttctggacacag

SEQ ID NO: 939003 - DNA, 25 bp, Mus musculus
gccatgaacgctttgaacgcttccg

SEQ ID NO: 939004 - DNA, 25 bp, Mus musculus
gccatgaacggtttgaacgcttccg

SEQ ID NO: 939005 - DNA, 25 bp, Mus musculus
gccatgaagaacaattgccagccat

SEQ ID NO: 939006 - DNA, 25 bp, Mus musculus
gccatgaagaacatccacaggagag

SEQ ID NO: 939007 - DNA, 25 bp, Mus musculus
gccatgaagaacctgaccgagctga

SEQ ID NO: 939008 - DNA, 25 bp, Mus musculus
gccatgaagaacgtgaccgagctga

SEQ ID NO: 939009 - DNA, 25 bp, Mus musculus
gccatgaagaactattgccagccat

SEQ ID NO: 939010 - DNA, 25 bp, Mus musculus
gccatgaagaacttccacaggagag

SEQ ID NO: 939011 - DNA, 25 bp, Mus musculus
gccatgaagaagatctttgatgatg

SEQ ID NO: 939012 - DNA, 25 bp, Mus musculus
gccatgaagaagttctttgatgatg

SEQ ID NO: 939013 - DNA, 25 bp, Mus musculus
gccatgaagatggaccataccataa

SEQ ID NO: 939014 - DNA, 25 bp, Mus musculus
gccatgaagatggagcataccataa

SEQ ID NO: 939015 - DNA, 25 bp, Mus musculus
gccatgaccccactgaccgtctggt

SEQ ID NO: 939016 - DNA, 25 bp, Mus musculus
gccatgaccccagtgaccgtctggt

SEQ ID NO: 939017 - DNA, 25 bp, Mus musculus
gccatgactggacgctgaaaggtgc

SEQ ID NO: 939018 - DNA, 25 bp, Mus musculus
gccatgactggaggctgaaaggtgc

SEQ ID NO: 939019 - DNA, 25 bp, Mus musculus
gccatgagagagatcccatggtttc

SEQ ID NO: 939020 - DNA, 25 bp, Mus musculus
gccatgagagagcactgcctccaga

SEQ ID NO: 939021 - DNA, 25 bp, Mus musculus
gccatgagagagctatatgctatga

SEQ ID NO: 939022 - DNA, 25 bp, Mus musculus
gccatgagagaggactgcctccaga

SEQ ID NO: 939023 - DNA, 25 bp, Mus musculus
gccatgagagaggtatatgctatga

SEQ ID NO: 939024 - DNA, 25 bp, Mus musculus
gccatgagagagttcccatggtttc

SEQ ID NO: 939025 - DNA, 25 bp, Mus musculus
gccatgagagcgaactggcggaaga

SEQ ID NO: 939026 - DNA, 25 bp, Mus musculus
gccatgagagcgaagtggcggaaga

SEQ ID NO: 939027 - DNA, 25 bp, Mus musculus
gccatgagcaagatgccttggcaga

SEQ ID NO: 939028 - DNA, 25 bp, Mus musculus
gccatgagcaagttgccttggcaga

SEQ ID NO: 939029 - DNA, 25 bp, Mus musculus
gccatgatgcagcactcgcctttct

SEQ ID NO: 939030 - DNA, 25 bp, Mus musculus
gccatgatgcaggactcgcctttct

SEQ ID NO: 939031 - DNA, 25 bp, Mus musculus
gccatgcacccgcacgtggtgctgc

SEQ ID NO: 939032 - DNA, 25 bp, Mus musculus
gccatgcacccgcaggtggtgctgc

SEQ ID NO: 939033 - DNA, 25 bp, Mus musculus
gccatgccaattgacgtcatgatga

SEQ ID NO: 939034 - DNA, 25 bp, Mus musculus
gccatgccaattgaggtcatgatga

SEQ ID NO: 939035 - DNA, 25 bp, Mus musculus
gccatgcggcggccagagaccgctg

SEQ ID NO: 939036 - DNA, 25 bp, Mus musculus
gccatgcggcgggcagagaccgctg

SEQ ID NO: 939037 - DNA, 25 bp, Mus musculus
gccatgctcaagacacccaacacat

SEQ ID NO: 939038 - DNA, 25 bp, Mus musculus
gccatgctcaagtcacccaacacat

SEQ ID NO: 939039 - DNA, 25 bp, Mus musculus
gccatgctcgagggctccctgctgg

SEQ ID NO: 939040 - DNA, 25 bp, Mus musculus
gccatgctcgtgggctccctgctgg

SEQ ID NO: 939041 - DNA, 25 bp, Mus musculus
gccatgctctataacgatgttcgca

SEQ ID NO: 939042 - DNA, 25 bp, Mus musculus
gccatgctctataaggatgttcgca

SEQ ID NO: 939043 - DNA, 25 bp, Mus musculus
gccatgctgcagctgctgggcccca

SEQ ID NO: 939044 - DNA, 25 bp, Mus musculus
gccatgctgcaggtgctgggcccca

SEQ ID NO: 939045 - DNA, 25 bp, Mus musculus
gccatgcttcagaggcttctggatg

SEQ ID NO: 939046 - DNA, 25 bp, Mus musculus
gccatgcttcagtggcttctggatg

SEQ ID NO: 939047 - DNA, 25 bp, Mus musculus
gccatggaacagcaggaagtgaaca

SEQ ID NO: 939048 - DNA, 25 bp, Mus musculus
gccatggaacaggaggaagtgaaca

SEQ ID NO: 939049 - DNA, 25 bp, Mus musculus
gccatggaagaggaagccccctcca

SEQ ID NO: 939050 - DNA, 25 bp, Mus musculus
gccatggaagtggaagccccctcca

SEQ ID NO: 939051 - DNA, 25 bp, Mus musculus
gccatggacgagattcagccagacc

SEQ ID NO: 939052 - DNA, 25 bp, Mus musculus
gccatggacgagtttcagccagacc

SEQ ID NO: 939053 - DNA, 25 bp, Mus musculus
gccatggagatgcagcagttgacct

SEQ ID NO: 939054 - DNA, 25 bp, Mus musculus
gccatggagatggagcagttgacct

SEQ ID NO: 939055 - DNA, 25 bp, Mus musculus
gccatggagctcattctacctccag

SEQ ID NO: 939056 - DNA, 25 bp, Mus musculus
gccatggagctctttctacctccag

SEQ ID NO: 939057 - DNA, 25 bp, Mus musculus
gccatggccttgcactatttacatg

SEQ ID NO: 939058 - DNA, 25 bp, Mus musculus
gccatggccttgcagtatttacatg

SEQ ID NO: 939059 - DNA, 25 bp, Mus musculus
gccatggcgaacaaatttctggaag

SEQ ID NO: 939060 - DNA, 25 bp, Mus musculus
gccatggcgaaccacgtgatcaggt

SEQ ID NO: 939061 - DNA, 25 bp, Mus musculus
gccatggcgaaccaggtgatcaggt

SEQ ID NO: 939062 - DNA, 25 bp, Mus musculus
gccatggcgaagccagggctgtctc

SEQ ID NO: 939063 - DNA, 25 bp, Mus musculus
gccatggcgaaggcagggctgtctc

SEQ ID NO: 939064 - DNA, 25 bp, Mus musculus
gccatggcgatcaaatttctggaag

SEQ ID NO: 939065 - DNA, 25 bp, Mus musculus
gccatggcggccaggaggacacatg

SEQ ID NO: 939066 - DNA, 25 bp, Mus musculus
gccatggcgggcaggaggacacatg

SEQ ID NO: 939067 - DNA, 25 bp, Mus musculus
gccatggctgacaagatcctgaggg

SEQ ID NO: 939068 - DNA, 25 bp, Mus musculus
gccatggctgtcaagatcctgaggg

SEQ ID NO: 939069 - DNA, 25 bp, Mus musculus
gccatgggggaccctcctgactatg

SEQ ID NO: 939070 - DNA, 25 bp, Mus musculus
gccatgggggacgctcctgactatg

SEQ ID NO: 939071 - DNA, 25 bp, Mus musculus
gccatggtcactctggaccctgatg

SEQ ID NO: 939072 - DNA, 25 bp, Mus musculus
gccatggtcactgtggaccctgatg

SEQ ID NO: 939073 - DNA, 25 bp, Mus musculus
gccatgtactcgcgccgtcgttccc

SEQ ID NO: 939074 - DNA, 25 bp, Mus musculus
gccatgtactcgggccgtcgttccc

SEQ ID NO: 939075 - DNA, 25 bp, Mus musculus
gccatgtatgattccaccggctccc

SEQ ID NO: 939076 - DNA, 25 bp, Mus musculus
gccatgtatgtttccaccggctccc

SEQ ID NO: 939077 - DNA, 25 bp, Mus musculus
gccatgtcagccagtataatgtttg

SEQ ID NO: 939078 - DNA, 25 bp, Mus musculus
gccatgtcaggcagtataatgtttg

SEQ ID NO: 939079 - DNA, 25 bp, Mus musculus
gccatgtctactttccgcctggccc

SEQ ID NO: 939080 - DNA, 25 bp, Mus musculus
gccatgtctagtttccgcctggccc

SEQ ID NO: 939081 - DNA, 25 bp, Mus musculus
gccatgtgaacacgaagatgacaac

SEQ ID NO: 939082 - DNA, 25 bp, Mus musculus
gccatgtgaacaggaagatgacaac

SEQ ID NO: 939083 - DNA, 25 bp, Mus musculus
gccatgttactgcacgaccacagga

SEQ ID NO: 939084 - DNA, 25 bp, Mus musculus
gccatgttactggacgaccacagga

SEQ ID NO: 939085 - DNA, 25 bp, Mus musculus
gccatgttggatgccgccttggacc

SEQ ID NO: 939086 - DNA, 25 bp, Mus musculus
gccatgttggttgccgccttggacc

SEQ ID NO: 939087 - DNA, 25 bp, Mus musculus
gccattaacaagccatatgaaaaag

SEQ ID NO: 939088 - DNA, 25 bp, Mus musculus
gccattaacaagccttatgaaaaag

SEQ ID NO: 939089 - DNA, 25 bp, Mus musculus
gccattaagaagcacgcagagatcc

SEQ ID NO: 939090 - DNA, 25 bp, Mus musculus
gccattaagaagcaggcagagatcc

SEQ ID NO: 939091 - DNA, 25 bp, Mus musculus
gccattacaccaaggaacttccccc

SEQ ID NO: 939092 - DNA, 25 bp, Mus musculus
gccattacaccatggaacttccccc

SEQ ID NO: 939093 - DNA, 25 bp, Mus musculus
gccattcaagaggcagccacagcag

SEQ ID NO: 939094 - DNA, 25 bp, Mus musculus
gccattcaagctggttgaaaagaaa

SEQ ID NO: 939095 - DNA, 25 bp, Mus musculus
gccattcaaggtggttgaaaagaaa

SEQ ID NO: 939096 - DNA, 25 bp, Mus musculus
gccattcaagtggcagccacagcag

SEQ ID NO: 939097 - DNA, 25 bp, Mus musculus
gccattcacacacgccgatacaaag

SEQ ID NO: 939098 - DNA, 25 bp, Mus musculus
gccattcacacaggccgatacaaag

SEQ ID NO: 939099 - DNA, 25 bp, Mus musculus
gccattcagctgatccagtttgtcc

SEQ ID NO: 939100 - DNA, 25 bp, Mus musculus
gccattcagctgttccagtttgtcc

SEQ ID NO: 939101 - DNA, 25 bp, Mus musculus
gccattctgcacagtaaatccatgg

SEQ ID NO: 939102 - DNA, 25 bp, Mus musculus
gccattctgcactgtaaatccatgg

SEQ ID NO: 939103 - DNA, 25 bp, Mus musculus
gccattcttaacaatacaaagggcc

SEQ ID NO: 939104 - DNA, 25 bp, Mus musculus
gccattcttaactatacaaagggcc

SEQ ID NO: 939105 - DNA, 25 bp, Mus musculus
gccattgaagagtggcagaaaacag

SEQ ID NO: 939106 - DNA, 25 bp, Mus musculus
gccattgaagtgtggcagaaaacag

SEQ ID NO: 939107 - DNA, 25 bp, Mus musculus
gccattgaatatgacatgtgcataa

SEQ ID NO: 939108 - DNA, 25 bp, Mus musculus
gccattgaatatgacgtgtcagctg

SEQ ID NO: 939109 - DNA, 25 bp, Mus musculus
gccattgaatatgagatgtgcataa

SEQ ID NO: 939110 - DNA, 25 bp, Mus musculus
gccattgaatatgaggtgtcagctg

SEQ ID NO: 939111 - DNA, 25 bp, Mus musculus
gccattgacgcacattgtttgctgc

SEQ ID NO: 939112 - DNA, 25 bp, Mus musculus
gccattgacgcagattgtttgctgc

SEQ ID NO: 939113 - DNA, 25 bp, Mus musculus
gccattgaggaccccgagctagaag

SEQ ID NO: 939114 - DNA, 25 bp, Mus musculus
gccattgaggacccggagctagaag

SEQ ID NO: 939115 - DNA, 25 bp, Mus musculus
gccattgataagaattttgattctg

SEQ ID NO: 939116 - DNA, 25 bp, Mus musculus
gccattgataagtattttgattctg

SEQ ID NO: 939117 - DNA, 25 bp, Mus musculus
gccattgcaatggcactcatgggag

SEQ ID NO: 939118 - DNA, 25 bp, Mus musculus
gccattgcaatggctctcatgggag

SEQ ID NO: 939119 - DNA, 25 bp, Mus musculus
gccattgcacagagcctcaacacct

SEQ ID NO: 939120 - DNA, 25 bp, Mus musculus
gccattgcacagtgcctcaacacct

SEQ ID NO: 939121 - DNA, 25 bp, Mus musculus
gccattgcagagatcgagcggctgc

SEQ ID NO: 939122 - DNA, 25 bp, Mus musculus
gccattgcagagatggagcggctgc

SEQ ID NO: 939123 - DNA, 25 bp, Mus musculus
gccattgccactggttctgagctgt

SEQ ID NO: 939124 - DNA, 25 bp, Mus musculus
gccattgccagacatccttgtgtgt

SEQ ID NO: 939125 - DNA, 25 bp, Mus musculus
gccattgccagagatccttgtgtgt

SEQ ID NO: 939126 - DNA, 25 bp, Mus musculus
gccattgccagtggttctgagctgt

SEQ ID NO: 939127 - DNA, 25 bp, Mus musculus
gccattgctgcacgaaatgctgcca

SEQ ID NO: 939128 - DNA, 25 bp, Mus musculus
gccattgctgcaggaaatgctgcca

SEQ ID NO: 939129 - DNA, 25 bp, Mus musculus
gccattgctgctgtgatggccttcc

SEQ ID NO: 939130 - DNA, 25 bp, Mus musculus
gccattgctggtgtgatggccttcc

SEQ ID NO: 939131 - DNA, 25 bp, Mus musculus
gccattggtgagctgaaaaatgaat

SEQ ID NO: 939132 - DNA, 25 bp, Mus musculus
gccattggtgaggtgaaaaatgaat

SEQ ID NO: 939133 - DNA, 25 bp, Mus musculus
gccattgtagctttcagtgtctgtg

SEQ ID NO: 939134 - DNA, 25 bp, Mus musculus
gccattgtaggtttcagtgtctgtg

SEQ ID NO: 939135 - DNA, 25 bp, Mus musculus
gccattgtcaagcaagaagagacag

SEQ ID NO: 939136 - DNA, 25 bp, Mus musculus
gccattgtcaaggaagaagagacag

SEQ ID NO: 939137 - DNA, 25 bp, Mus musculus
gccattgtctgcatgtgtctgccca

SEQ ID NO: 939138 - DNA, 25 bp, Mus musculus
gccattgtctgcttgtgtctgccca

SEQ ID NO: 939139 - DNA, 25 bp, Mus musculus
gccatttagaagctgtgccgatgct

SEQ ID NO: 939140 - DNA, 25 bp, Mus musculus
gccatttagaaggtgtgccgatgct

SEQ ID NO: 939141 - DNA, 25 bp, Mus musculus
gccatttcagacgctaatgtttttg

SEQ ID NO: 939142 - DNA, 25 bp, Mus musculus
gccatttcagctttggtatgcctca

SEQ ID NO: 939143 - DNA, 25 bp, Mus musculus
gccatttcagctttggtatgcctcc

SEQ ID NO: 939144 - DNA, 25 bp, Mus musculus
gccatttcaggtttggtatgcctca

SEQ ID NO: 939145 - DNA, 25 bp, Mus musculus
gccatttcaggtttggtatgcctcc

SEQ ID NO: 939146 - DNA, 25 bp, Mus musculus
gccatttcagtcgctaatgtttttg

SEQ ID NO: 939147 - DNA, 25 bp, Mus musculus
gccatttccacatactgctggggat

SEQ ID NO: 939148 - DNA, 25 bp, Mus musculus
gccatttccacatacttcagcaatc

SEQ ID NO: 939149 - DNA, 25 bp, Mus musculus
gccatttccacatagtgctggggat

SEQ ID NO: 939150 - DNA, 25 bp, Mus musculus
gccatttccacatagttcagcaatc

SEQ ID NO: 939151 - DNA, 25 bp, Mus musculus
gccatttcctcacgtgaagctgtgt

SEQ ID NO: 939152 - DNA, 25 bp, Mus musculus
gccatttcctcaggtgaagctgtgt

SEQ ID NO: 939153 - DNA, 25 bp, Mus musculus
gccatttgaacacgtcaaaggcatt

SEQ ID NO: 939154 - DNA, 25 bp, Mus musculus
gccatttgaacaggtcaaaggcatt

SEQ ID NO: 939155 - DNA, 25 bp, Mus musculus
gccatttggttccaagatatagctg

SEQ ID NO: 939156 - DNA, 25 bp, Mus musculus
gccatttggttccatgatatagctg

SEQ ID NO: 939157 - DNA, 25 bp, Mus musculus
gccattttacagaatctgcaccatc

SEQ ID NO: 939158 - DNA, 25 bp, Mus musculus
gccattttacagtatctgcaccatc

SEQ ID NO: 939159 - DNA, 25 bp, Mus musculus
gcccaaacagctatcatcaggacag

SEQ ID NO: 939160 - DNA, 25 bp, Mus musculus
gcccaaacaggtatcatcaggacag

SEQ ID NO: 939161 - DNA, 25 bp, Mus musculus
gcccaaagaagacacccatataatg

SEQ ID NO: 939162 - DNA, 25 bp, Mus musculus
gcccaaagaagagacccatataatg

SEQ ID NO: 939163 - DNA, 25 bp, Mus musculus
gcccaaagagatgaagttggcgctc

SEQ ID NO: 939164 - DNA, 25 bp, Mus musculus
gcccaaagagttgaagttggcgctc

SEQ ID NO: 939165 - DNA, 25 bp, Mus musculus
gcccaaaggacacaataatcctcag

SEQ ID NO: 939166 - DNA, 25 bp, Mus musculus
gcccaaaggacacctggctgtatag

SEQ ID NO: 939167 - DNA, 25 bp, Mus musculus
gcccaaaggacagaataatcctcag

SEQ ID NO: 939168 - DNA, 25 bp, Mus musculus
gcccaaaggacagctggctgtatag

SEQ ID NO: 939169 - DNA, 25 bp, Mus musculus
gcccaaccatcctgctgaaccgaat

SEQ ID NO: 939170 - DNA, 25 bp, Mus musculus
gcccaaccatgctgctgaaccgaat

SEQ ID NO: 939171 - DNA, 25 bp, Mus musculus
gcccaaccctcagacgtttaataag

SEQ ID NO: 939172 - DNA, 25 bp, Mus musculus
gcccaaccctcagaggtttaataag

SEQ ID NO: 939173 - DNA, 25 bp, Mus musculus
gcccaacgtgtcataatatcattga

SEQ ID NO: 939174 - DNA, 25 bp, Mus musculus
gcccaacgtgtcattatatcattga

SEQ ID NO: 939175 - DNA, 25 bp, Mus musculus
gcccaagaagaaccaagagccggag

SEQ ID NO: 939176 - DNA, 25 bp, Mus musculus
gcccaagaagacgcaaatccagatc

SEQ ID NO: 939177 - DNA, 25 bp, Mus musculus
gcccaagaagtaccaagagccggag

SEQ ID NO: 939178 - DNA, 25 bp, Mus musculus
gcccaagaagtcgcaaatccagatc

SEQ ID NO: 939179 - DNA, 25 bp, Mus musculus
gcccaagacacccacgccagccacg

SEQ ID NO: 939180 - DNA, 25 bp, Mus musculus
gcccaagacacccaggccagccacg

SEQ ID NO: 939181 - DNA, 25 bp, Mus musculus
gcccaagaccagctcacggatgatt

SEQ ID NO: 939182 - DNA, 25 bp, Mus musculus
gcccaagaccaggtcacggatgatt

SEQ ID NO: 939183 - DNA, 25 bp, Mus musculus
gcccaagaggaacgttagcgcggat

SEQ ID NO: 939184 - DNA, 25 bp, Mus musculus
gcccaagaggaaggttagcgcggat

SEQ ID NO: 939185 - DNA, 25 bp, Mus musculus
gcccaagcagccatgtggcagcaac

SEQ ID NO: 939186 - DNA, 25 bp, Mus musculus
gcccaagcagccttgtggcagcaac

SEQ ID NO: 939187 - DNA, 25 bp, Mus musculus
gcccaagccaaacggctcatccagg

SEQ ID NO: 939188 - DNA, 25 bp, Mus musculus
gcccaagccaaagggctcatccagg

SEQ ID NO: 939189 - DNA, 25 bp, Mus musculus
gcccaagccaatcaacgtccgggtg

SEQ ID NO: 939190 - DNA, 25 bp, Mus musculus
gcccaagccattcaacgtccgggtg

SEQ ID NO: 939191 - DNA, 25 bp, Mus musculus
gcccaagttgcccacactgcgctct

SEQ ID NO: 939192 - DNA, 25 bp, Mus musculus
gcccaagttgcccagactgcgctct

SEQ ID NO: 939193 - DNA, 25 bp, Mus musculus
gcccaataagctattcaattgatcg

SEQ ID NO: 939194 - DNA, 25 bp, Mus musculus
gcccaataaggtattcaattgatcg

SEQ ID NO: 939195 - DNA, 25 bp, Mus musculus
gcccaatcagacagaagacctcagt

SEQ ID NO: 939196 - DNA, 25 bp, Mus musculus
gcccaatcagtcagaagacctcagt

SEQ ID NO: 939197 - DNA, 25 bp, Mus musculus
gcccaatcctcagacgtttgaccgg

SEQ ID NO: 939198 - DNA, 25 bp, Mus musculus
gcccaatcctcagaggtttgaccgg

SEQ ID NO: 939199 - DNA, 25 bp, Mus musculus
gcccaattctggcacactcactctt

SEQ ID NO: 939200 - DNA, 25 bp, Mus musculus
gcccaattctgggacactcactctt

SEQ ID NO: 939201 - DNA, 25 bp, Mus musculus
gcccacaacacacgtcagccaaagc

SEQ ID NO: 939202 - DNA, 25 bp, Mus musculus
gcccacaacacaggtcagccaaagc

SEQ ID NO: 939203 - DNA, 25 bp, Mus musculus
gcccacacagcgtgtgtccccagga

SEQ ID NO: 939204 - DNA, 25 bp, Mus musculus
gcccacacagcttcactatctgcaa

SEQ ID NO: 939205 - DNA, 25 bp, Mus musculus
gcccacacagcttctgcagtacagc

SEQ ID NO: 939206 - DNA, 25 bp, Mus musculus
gcccacacagggtgtgtccccagga

SEQ ID NO: 939207 - DNA, 25 bp, Mus musculus
gcccacacaggttcactatctgcaa

SEQ ID NO: 939208 - DNA, 25 bp, Mus musculus
gcccacacaggttctgcagtacagc

SEQ ID NO: 939209 - DNA, 25 bp, Mus musculus
gcccacacagtcaacccttaaagaa

SEQ ID NO: 939210 - DNA, 25 bp, Mus musculus
gcccacacagtcaagccttaaagaa

SEQ ID NO: 939211 - DNA, 25 bp, Mus musculus
gcccacagctcggacatgggagctt

SEQ ID NO: 939212 - DNA, 25 bp, Mus musculus
gcccacagctcggacgacagatggg

SEQ ID NO: 939213 - DNA, 25 bp, Mus musculus
gcccacagctcggagatgggagctt

SEQ ID NO: 939214 - DNA, 25 bp, Mus musculus
gcccacagctcggaggacagatggg

SEQ ID NO: 939215 - DNA, 25 bp, Mus musculus
gcccacagcttcagaatacaggggt

SEQ ID NO: 939216 - DNA, 25 bp, Mus musculus
gcccacagcttcagtatacaggggt

SEQ ID NO: 939217 - DNA, 25 bp, Mus musculus
gcccacagtcagactctcttgagat

SEQ ID NO: 939218 - DNA, 25 bp, Mus musculus
gcccacagtcagtctctcttgagat

SEQ ID NO: 939219 - DNA, 25 bp, Mus musculus
gcccacatcaataagagcccggcgg

SEQ ID NO: 939220 - DNA, 25 bp, Mus musculus
gcccacatcaattagagcccggcgg

SEQ ID NO: 939221 - DNA, 25 bp, Mus musculus
gcccacattccacggccctctgcct

SEQ ID NO: 939222 - DNA, 25 bp, Mus musculus
gcccacattccagggccctctgcct

SEQ ID NO: 939223 - DNA, 25 bp, Mus musculus
gcccaccaagctgcagctgaactac

SEQ ID NO: 939224 - DNA, 25 bp, Mus musculus
gcccaccaaggtgcagctgaactac

SEQ ID NO: 939225 - DNA, 25 bp, Mus musculus
gcccacccagcacctgtgaactcgg

SEQ ID NO: 939226 - DNA, 25 bp, Mus musculus
gcccacccagcttatgaacaggccc

SEQ ID NO: 939227 - DNA, 25 bp, Mus musculus
gcccacccaggacctgtgaactcgg

SEQ ID NO: 939228 - DNA, 25 bp, Mus musculus
gcccacccaggttatgaacaggccc

SEQ ID NO: 939229 - DNA, 25 bp, Mus musculus
gcccaccgtgacatcgacgaatgca

SEQ ID NO: 939230 - DNA, 25 bp, Mus musculus
gcccaccgtgtcatcgacgaatgca

SEQ ID NO: 939231 - DNA, 25 bp, Mus musculus
gcccacctatcgagtcgccagtggt

SEQ ID NO: 939232 - DNA, 25 bp, Mus musculus
gcccacctatcgtgtcgccagtggt

SEQ ID NO: 939233 - DNA, 25 bp, Mus musculus
gcccacgcacagctctctgaagtac

SEQ ID NO: 939234 - DNA, 25 bp, Mus musculus
gcccacgcactgctctctgaagtac

SEQ ID NO: 939235 - DNA, 25 bp, Mus musculus
gcccacggtgctggcccagcgactc

SEQ ID NO: 939236 - DNA, 25 bp, Mus musculus
gcccacggtgctgggccagcgactc

SEQ ID NO: 939237 - DNA, 25 bp, Mus musculus
gcccacgtacctcacgctcatgtac

SEQ ID NO: 939238 - DNA, 25 bp, Mus musculus
gcccacgtacctcactacaagccca

SEQ ID NO: 939239 - DNA, 25 bp, Mus musculus
gcccacgtacctcacttctggctca

SEQ ID NO: 939240 - DNA, 25 bp, Mus musculus
gcccacgtacctcaggctcatgtac

SEQ ID NO: 939241 - DNA, 25 bp, Mus musculus
gcccacgtacctcagtacaagccca

SEQ ID NO: 939242 - DNA, 25 bp, Mus musculus
gcccacgtacctcagttctggctca

SEQ ID NO: 939243 - DNA, 25 bp, Mus musculus
gcccactcactactgggaacaccat

SEQ ID NO: 939244 - DNA, 25 bp, Mus musculus
gcccactcactagtgggaacaccat

SEQ ID NO: 939245 - DNA, 25 bp, Mus musculus
gcccactcagcctcctattaatgca

SEQ ID NO: 939246 - DNA, 25 bp, Mus musculus
gcccactcaggctcctattaatgca

SEQ ID NO: 939247 - DNA, 25 bp, Mus musculus
gcccactgccggatcctaataacta

SEQ ID NO: 939248 - DNA, 25 bp, Mus musculus
gcccactgccggttcctaataacta

SEQ ID NO: 939249 - DNA, 25 bp, Mus musculus
gcccactgggcccccgtgaaagcta

SEQ ID NO: 939250 - DNA, 25 bp, Mus musculus
gcccactgggccccggtgaaagcta

SEQ ID NO: 939251 - DNA, 25 bp, Mus musculus
gcccacttggcaggcagaggccatc

SEQ ID NO: 939252 - DNA, 25 bp, Mus musculus
gcccacttgggaggcagaggccatc

SEQ ID NO: 939253 - DNA, 25 bp, Mus musculus
gcccagaaccagcccaagaaaggag

SEQ ID NO: 939254 - DNA, 25 bp, Mus musculus
gcccagaaccaggccaagaaaggag

SEQ ID NO: 939255 - DNA, 25 bp, Mus musculus
gcccagaagcagctactctatctac

SEQ ID NO: 939256 - DNA, 25 bp, Mus musculus
gcccagaagcaggtactctatctac

SEQ ID NO: 939257 - DNA, 25 bp, Mus musculus
gcccagaaggagatccttaagctgt

SEQ ID NO: 939258 - DNA, 25 bp, Mus musculus
gcccagaaggagttccttaagctgt

SEQ ID NO: 939259 - DNA, 25 bp, Mus musculus
gcccagaagtagtttggaatgatca

SEQ ID NO: 939260 - DNA, 25 bp, Mus musculus
gcccagaagttgtttggaatgatca

SEQ ID NO: 939261 - DNA, 25 bp, Mus musculus
gcccagacagagactcaggtgcaga

SEQ ID NO: 939262 - DNA, 25 bp, Mus musculus
gcccagacagtccaccaggtgacag

SEQ ID NO: 939263 - DNA, 25 bp, Mus musculus
gcccagacagtccagcaggtgacag

SEQ ID NO: 939264 - DNA, 25 bp, Mus musculus
gcccagacagtgactcaggtgcaga

SEQ ID NO: 939265 - DNA, 25 bp, Mus musculus
gcccagacttctcggcttaaggtga

SEQ ID NO: 939266 - DNA, 25 bp, Mus musculus
gcccagacttctgggcttaaggtga

SEQ ID NO: 939267 - DNA, 25 bp, Mus musculus
gcccagagagaggtcttttggctgt

SEQ ID NO: 939268 - DNA, 25 bp, Mus musculus
gcccagagagtggtcttttggctgt

SEQ ID NO: 939269 - DNA, 25 bp, Mus musculus
gcccagagatccagctgccaaacgg

SEQ ID NO: 939270 - DNA, 25 bp, Mus musculus
gcccagagatcctgctgccaaacgg

SEQ ID NO: 939271 - DNA, 25 bp, Mus musculus
gcccagagctagatttgtcaaatcc

SEQ ID NO: 939272 - DNA, 25 bp, Mus musculus
gcccagagctagttttgtcaaatcc

SEQ ID NO: 939273 - DNA, 25 bp, Mus musculus
gcccagattaaactcaaataattta

SEQ ID NO: 939274 - DNA, 25 bp, Mus musculus
gcccagattaaagtcaaataattta

SEQ ID NO: 939275 - DNA, 25 bp, Mus musculus
gcccagattattcacgccagtggag

SEQ ID NO: 939276 - DNA, 25 bp, Mus musculus
gcccagattattcaggccagtggag

SEQ ID NO: 939277 - DNA, 25 bp, Mus musculus
gcccagcacagcatcagaaactctc

SEQ ID NO: 939278 - DNA, 25 bp, Mus musculus
gcccagcacagcatgagaaactctc

SEQ ID NO: 939279 - DNA, 25 bp, Mus musculus
gcccagcactgcatcagaaactctc

SEQ ID NO: 939280 - DNA, 25 bp, Mus musculus
gcccagcactgcatgagaaactctc

SEQ ID NO: 939281 - DNA, 25 bp, Mus musculus
gcccagcatttgcgggagagcacgg

SEQ ID NO: 939282 - DNA, 25 bp, Mus musculus
gcccagcatttgggggagagcacgg

SEQ ID NO: 939283 - DNA, 25 bp, Mus musculus
gcccagccaggacctatcctctgaa

SEQ ID NO: 939284 - DNA, 25 bp, Mus musculus
gcccagccaggagctatcctctgaa

SEQ ID NO: 939285 - DNA, 25 bp, Mus musculus
gcccagcccgctcaagcaggtagag

SEQ ID NO: 939286 - DNA, 25 bp, Mus musculus
gcccagcccggtcaagcaggtagag

SEQ ID NO: 939287 - DNA, 25 bp, Mus musculus
gcccagcgagcgctgcgaagctggg

SEQ ID NO: 939288 - DNA, 25 bp, Mus musculus
gcccagcgagcggtgcgaagctggg

SEQ ID NO: 939289 - DNA, 25 bp, Mus musculus
gcccagcgcgtgccatgaagcacta

SEQ ID NO: 939290 - DNA, 25 bp, Mus musculus
gcccagcgcgtgcgacgaattcata

SEQ ID NO: 939291 - DNA, 25 bp, Mus musculus
gcccagcgcgtggcatgaagcacta

SEQ ID NO: 939292 - DNA, 25 bp, Mus musculus
gcccagcgcgtgggacgaattcata

SEQ ID NO: 939293 - DNA, 25 bp, Mus musculus
gcccagctcgcataccgtgtcaagg

SEQ ID NO: 939294 - DNA, 25 bp, Mus musculus
gcccagctcggataccgtgtcaagg

SEQ ID NO: 939295 - DNA, 25 bp, Mus musculus
gcccagctctggcatgggttgaaga

SEQ ID NO: 939296 - DNA, 25 bp, Mus musculus
gcccagctctggcgagaactctgat

SEQ ID NO: 939297 - DNA, 25 bp, Mus musculus
gcccagctctgggatgggttgaaga

SEQ ID NO: 939298 - DNA, 25 bp, Mus musculus
gcccagctctggggagaactctgat

SEQ ID NO: 939299 - DNA, 25 bp, Mus musculus
gcccagctgagcaccttgagccacg

SEQ ID NO: 939300 - DNA, 25 bp, Mus musculus
gcccagctgagcacgttgagccacg

SEQ ID NO: 939301 - DNA, 25 bp, Mus musculus
gcccaggaagaaacatgtatcatgg

SEQ ID NO: 939302 - DNA, 25 bp, Mus musculus
gcccaggaagaagaatgtcccttct

SEQ ID NO: 939303 - DNA, 25 bp, Mus musculus
gcccaggaagcagactgagagtgaa

SEQ ID NO: 939304 - DNA, 25 bp, Mus musculus
gcccaggaaggagactgagagtgaa

SEQ ID NO: 939305 - DNA, 25 bp, Mus musculus
gcccaggaagtaacatgtatcatgg

SEQ ID NO: 939306 - DNA, 25 bp, Mus musculus
gcccaggaagtagaatgtcccttct

SEQ ID NO: 939307 - DNA, 25 bp, Mus musculus
gcccaggacagtagcgaacagacgc

SEQ ID NO: 939308 - DNA, 25 bp, Mus musculus
gcccaggacagtagggaacagacgc

SEQ ID NO: 939309 - DNA, 25 bp, Mus musculus
gcccaggagcagctgtagctacttc

SEQ ID NO: 939310 - DNA, 25 bp, Mus musculus
gcccaggagcaggtgtagctacttc

SEQ ID NO: 939311 - DNA, 25 bp, Mus musculus
gcccaggccgctcccggatgttgcg

SEQ ID NO: 939312 - DNA, 25 bp, Mus musculus
gcccaggccggtcccggatgttgcg

SEQ ID NO: 939313 - DNA, 25 bp, Mus musculus
gcccaggctgaaagtgagaatagcc

SEQ ID NO: 939314 - DNA, 25 bp, Mus musculus
gcccaggctgaatgtgagaatagcc

SEQ ID NO: 939315 - DNA, 25 bp, Mus musculus
gcccagggacagctggtggagtttg

SEQ ID NO: 939316 - DNA, 25 bp, Mus musculus
gcccagggacaggtggtggagtttg

SEQ ID NO: 939317 - DNA, 25 bp, Mus musculus
gcccaggtcaagcactatgagaaag

SEQ ID NO: 939318 - DNA, 25 bp, Mus musculus
gcccaggtcaagcagtccatgaaga

SEQ ID NO: 939319 - DNA, 25 bp, Mus musculus
gcccaggtcaaggactatgagaaag

SEQ ID NO: 939320 - DNA, 25 bp, Mus musculus
gcccaggtcaaggagtccatgaaga

SEQ ID NO: 939321 - DNA, 25 bp, Mus musculus
gcccagtctgatacacttttggcgt

SEQ ID NO: 939322 - DNA, 25 bp, Mus musculus
gcccagtctgttacacttttggcgt

SEQ ID NO: 939323 - DNA, 25 bp, Mus musculus
gcccagtgaccaccctggcagcgag

SEQ ID NO: 939324 - DNA, 25 bp, Mus musculus
gcccagtgaccagcctggcagcgag

SEQ ID NO: 939325 - DNA, 25 bp, Mus musculus
gcccagtgcaccctggaaaaagtcc

SEQ ID NO: 939326 - DNA, 25 bp, Mus musculus
gcccagtgcaccgtggaaaaagtcc

SEQ ID NO: 939327 - DNA, 25 bp, Mus musculus
gcccagtgcagcaggccacgcgggg

SEQ ID NO: 939328 - DNA, 25 bp, Mus musculus
gcccagtgcagccctgtagcatcct

SEQ ID NO: 939329 - DNA, 25 bp, Mus musculus
gcccagtgcagcgctgtagcatcct

SEQ ID NO: 939330 - DNA, 25 bp, Mus musculus
gcccagtgcagctggccacgcgggg

SEQ ID NO: 939331 - DNA, 25 bp, Mus musculus
gcccagttttctcacgaaattgggc

SEQ ID NO: 939332 - DNA, 25 bp, Mus musculus
gcccagttttctcaggaaattgggc

SEQ ID NO: 939333 - DNA, 25 bp, Mus musculus
gcccatatcaagaacccctggctgt

SEQ ID NO: 939334 - DNA, 25 bp, Mus musculus
gcccatatcaagaacgagtttgaca

SEQ ID NO: 939335 - DNA, 25 bp, Mus musculus
gcccatatcaagaagccctggctgt

SEQ ID NO: 939336 - DNA, 25 bp, Mus musculus
gcccatatcaagaaggagtttgaca

SEQ ID NO: 939337 - DNA, 25 bp, Mus musculus
gcccatccaggccacgctgggcagc

SEQ ID NO: 939338 - DNA, 25 bp, Mus musculus
gcccatccaggccaggctgggcagc

SEQ ID NO: 939339 - DNA, 25 bp, Mus musculus
gcccatctaaacatgccttgaacac

SEQ ID NO: 939340 - DNA, 25 bp, Mus musculus
gcccatctaaacttgccttgaacac

SEQ ID NO: 939341 - DNA, 25 bp, Mus musculus
gcccatctcccacactgataatggt

SEQ ID NO: 939342 - DNA, 25 bp, Mus musculus
gcccatctcccagactgataatggt

SEQ ID NO: 939343 - DNA, 25 bp, Mus musculus
gcccatgatgcacttcctgcgctgt

SEQ ID NO: 939344 - DNA, 25 bp, Mus musculus
gcccatgatgcttgagccctcgatg

SEQ ID NO: 939345 - DNA, 25 bp, Mus musculus
gcccatgatgcttgtgccctcgatg

SEQ ID NO: 939346 - DNA, 25 bp, Mus musculus
gcccatgatggacttcctgcgctgt

SEQ ID NO: 939347 - DNA, 25 bp, Mus musculus
gcccatgattaccgtggatgggaag

SEQ ID NO: 939348 - DNA, 25 bp, Mus musculus
gcccatgattacggtggatgggaag

SEQ ID NO: 939349 - DNA, 25 bp, Mus musculus
gcccatgcagatggcctctgcacaa

SEQ ID NO: 939350 - DNA, 25 bp, Mus musculus
gcccatgcagttggcctctgcacaa

SEQ ID NO: 939351 - DNA, 25 bp, Mus musculus
gcccatgccctgagatcagaccacc

SEQ ID NO: 939352 - DNA, 25 bp, Mus musculus
gcccatgccctgtgatcagaccacc

SEQ ID NO: 939353 - DNA, 25 bp, Mus musculus
gcccatggagatcgtggaagggcat

SEQ ID NO: 939354 - DNA, 25 bp, Mus musculus
gcccatggagatggtggaagggcat

SEQ ID NO: 939355 - DNA, 25 bp, Mus musculus
gcccatggagctcctgtccagagtg

SEQ ID NO: 939356 - DNA, 25 bp, Mus musculus
gcccatggaggtcctgtccagagtg

SEQ ID NO: 939357 - DNA, 25 bp, Mus musculus
gcccatggtcttaaccccatcgtac

SEQ ID NO: 939358 - DNA, 25 bp, Mus musculus
gcccatggtcttaagcccatcgtac

SEQ ID NO: 939359 - DNA, 25 bp, Mus musculus
gcccatgtaccaagtgtccccaagg

SEQ ID NO: 939360 - DNA, 25 bp, Mus musculus
gcccatgtaccatgtgtccccaagg

SEQ ID NO: 939361 - DNA, 25 bp, Mus musculus
gcccattcttaacattcctttgaga

SEQ ID NO: 939362 - DNA, 25 bp, Mus musculus
gcccattcttaagattcctttgaga

SEQ ID NO: 939363 - DNA, 25 bp, Mus musculus
gcccattgccacatttcagattgcg

SEQ ID NO: 939364 - DNA, 25 bp, Mus musculus
gcccattgccacttttcagattgcg

SEQ ID NO: 939365 - DNA, 25 bp, Mus musculus
gcccattggaaacacgttcagacaa

SEQ ID NO: 939366 - DNA, 25 bp, Mus musculus
gcccattggaaacaggttcagacaa

SEQ ID NO: 939367 - DNA, 25 bp, Mus musculus
gcccatttccgacggcagatttact

SEQ ID NO: 939368 - DNA, 25 bp, Mus musculus
gcccatttccgagggcagatttact

SEQ ID NO: 939369 - DNA, 25 bp, Mus musculus
gcccatttgcagagagtactgcctg

SEQ ID NO: 939370 - DNA, 25 bp, Mus musculus
gcccatttgcagtgagtactgcctg

SEQ ID NO: 939371 - DNA, 25 bp, Mus musculus
gcccattttgctggtgagcttcttc

SEQ ID NO: 939372 - DNA, 25 bp, Mus musculus
gcccattttggtggtgagcttcttc

SEQ ID NO: 939373 - DNA, 25 bp, Mus musculus
gccccaaatctgcacatctcatagg

SEQ ID NO: 939374 - DNA, 25 bp, Mus musculus
gccccaaatctgcacatgtgaatcc

SEQ ID NO: 939375 - DNA, 25 bp, Mus musculus
gccccaaatctgcagatctcatagg

SEQ ID NO: 939376 - DNA, 25 bp, Mus musculus
gccccaaatctgcagatgtgaatcc

SEQ ID NO: 939377 - DNA, 25 bp, Mus musculus
gccccaacactacggacaataaata

SEQ ID NO: 939378 - DNA, 25 bp, Mus musculus
gccccaacactagggacaataaata

SEQ ID NO: 939379 - DNA, 25 bp, Mus musculus
gccccaacagaagcagacatcatgt

SEQ ID NO: 939380 - DNA, 25 bp, Mus musculus
gccccaacagaagcagcatgtctgc

SEQ ID NO: 939381 - DNA, 25 bp, Mus musculus
gccccaacagaagctgacatcatgt

SEQ ID NO: 939382 - DNA, 25 bp, Mus musculus
gccccaacagaagctgcatgtctgc

SEQ ID NO: 939383 - DNA, 25 bp, Mus musculus
gccccaacagcgcgccacagattgt

SEQ ID NO: 939384 - DNA, 25 bp, Mus musculus
gccccaacagcgcgtctggaggagg

SEQ ID NO: 939385 - DNA, 25 bp, Mus musculus
gccccaacagcgggccacagattgt

SEQ ID NO: 939386 - DNA, 25 bp, Mus musculus
gccccaacagcgggtctggaggagg

SEQ ID NO: 939387 - DNA, 25 bp, Mus musculus
gccccaacgattctagcccagcctg

SEQ ID NO: 939388 - DNA, 25 bp, Mus musculus
gccccaacgattgtagcccagcctg

SEQ ID NO: 939389 - DNA, 25 bp, Mus musculus
gccccaactgaggaatggatacaga

SEQ ID NO: 939390 - DNA, 25 bp, Mus musculus
gccccaactgtggaatggatacaga

SEQ ID NO: 939391 - DNA, 25 bp, Mus musculus
gccccaagatcaggacgctcgcaca

SEQ ID NO: 939392 - DNA, 25 bp, Mus musculus
gccccaagatgaggacgctcgcaca

SEQ ID NO: 939393 - DNA, 25 bp, Mus musculus
gccccaatgtatcggcctgttcacc

SEQ ID NO: 939394 - DNA, 25 bp, Mus musculus
gccccaatgtatgggcctgttcacc

SEQ ID NO: 939395 - DNA, 25 bp, Mus musculus
gccccacagaagctgattgaacaga

SEQ ID NO: 939396 - DNA, 25 bp, Mus musculus
gccccacagaaggtgattgaacaga

SEQ ID NO: 939397 - DNA, 25 bp, Mus musculus
gccccacagacccaacatgtctctc

SEQ ID NO: 939398 - DNA, 25 bp, Mus musculus
gccccacagacccatcatgtctctc

SEQ ID NO: 939399 - DNA, 25 bp, Mus musculus
gccccacagcaaaacgccagatatt

SEQ ID NO: 939400 - DNA, 25 bp, Mus musculus
gccccacagcaaaaggccagatatt

SEQ ID NO: 939401 - DNA, 25 bp, Mus musculus
gccccaccgcatctgtagcatcctg

SEQ ID NO: 939402 - DNA, 25 bp, Mus musculus
gccccaccgcatgtgtagcatcctg

SEQ ID NO: 939403 - DNA, 25 bp, Mus musculus
gccccacgccagcattacatcttct

SEQ ID NO: 939404 - DNA, 25 bp, Mus musculus
gccccacgccaggattacatcttct

SEQ ID NO: 939405 - DNA, 25 bp, Mus musculus
gccccactattgccttaagtttgct

SEQ ID NO: 939406 - DNA, 25 bp, Mus musculus
gccccactattgcggcatctttcat

SEQ ID NO: 939407 - DNA, 25 bp, Mus musculus
gccccactattggcttaagtttgct

SEQ ID NO: 939408 - DNA, 25 bp, Mus musculus
gccccactattggggcatctttcat

SEQ ID NO: 939409 - DNA, 25 bp, Mus musculus
gccccactggtgcgggccatgtagg

SEQ ID NO: 939410 - DNA, 25 bp, Mus musculus
gccccactggtgggggccatgtagg

SEQ ID NO: 939411 - DNA, 25 bp, Mus musculus
gccccagaggcaacacagaagatga

SEQ ID NO: 939412 - DNA, 25 bp, Mus musculus
gccccagaggcatcacagaagatga

SEQ ID NO: 939413 - DNA, 25 bp, Mus musculus
gccccagcagagaaaagaagccagt

SEQ ID NO: 939414 - DNA, 25 bp, Mus musculus
gccccagcagctctactggacagca

SEQ ID NO: 939415 - DNA, 25 bp, Mus musculus
gccccagcaggtctactggacagca

SEQ ID NO: 939416 - DNA, 25 bp, Mus musculus
gccccagcagtgaaaagaagccagt

SEQ ID NO: 939417 - DNA, 25 bp, Mus musculus
gccccagcctccaccatgccaatca

SEQ ID NO: 939418 - DNA, 25 bp, Mus musculus
gccccagcctgcaccatgccaatca

SEQ ID NO: 939419 - DNA, 25 bp, Mus musculus
gccccagcgattctcaaggtgaaga

SEQ ID NO: 939420 - DNA, 25 bp, Mus musculus
gccccagcgattctgaaggtgaaga

SEQ ID NO: 939421 - DNA, 25 bp, Mus musculus
gccccagctcctctcatgttgccac

SEQ ID NO: 939422 - DNA, 25 bp, Mus musculus
gccccagctcctctgatgttgccac

SEQ ID NO: 939423 - DNA, 25 bp, Mus musculus
gccccagctgattcagccatggctg

SEQ ID NO: 939424 - DNA, 25 bp, Mus musculus
gccccagctgctgcccccttatcgc

SEQ ID NO: 939425 - DNA, 25 bp, Mus musculus
gccccagctggtgcccccttatcgc

SEQ ID NO: 939426 - DNA, 25 bp, Mus musculus
gccccagctgtgcggcagttttggc

SEQ ID NO: 939427 - DNA, 25 bp, Mus musculus
gccccagctgtggggcagttttggc

SEQ ID NO: 939428 - DNA, 25 bp, Mus musculus
gccccagctgtttcagccatggctg

SEQ ID NO: 939429 - DNA, 25 bp, Mus musculus
gccccaggagccacggactctgtga

SEQ ID NO: 939430 - DNA, 25 bp, Mus musculus
gccccaggagcctcggactctgtga

SEQ ID NO: 939431 - DNA, 25 bp, Mus musculus
gccccaggaggagacgctctctcgg

SEQ ID NO: 939432 - DNA, 25 bp, Mus musculus
gccccaggaggagaggctctctcgg

SEQ ID NO: 939433 - DNA, 25 bp, Mus musculus
gccccaggccagcacgtgtacagtg

SEQ ID NO: 939434 - DNA, 25 bp, Mus musculus
gccccaggccagcactgggctctgg

SEQ ID NO: 939435 - DNA, 25 bp, Mus musculus
gccccaggccagcaggtgtacagtg

SEQ ID NO: 939436 - DNA, 25 bp, Mus musculus
gccccaggccagcagtgggctctgg

SEQ ID NO: 939437 - DNA, 25 bp, Mus musculus
gccccaggccgtcaatgaccagtgc

SEQ ID NO: 939438 - DNA, 25 bp, Mus musculus
gccccaggccgtcgactaaagacca

SEQ ID NO: 939439 - DNA, 25 bp, Mus musculus
gccccaggccgtgaatgaccagtgc

SEQ ID NO: 939440 - DNA, 25 bp, Mus musculus
gccccaggccgtggactaaagacca

SEQ ID NO: 939441 - DNA, 25 bp, Mus musculus
gccccagggcaacgattctgtaccc

SEQ ID NO: 939442 - DNA, 25 bp, Mus musculus
gccccagggcaacgtggctgccttt

SEQ ID NO: 939443 - DNA, 25 bp, Mus musculus
gccccagggcaaggattctgtaccc

SEQ ID NO: 939444 - DNA, 25 bp, Mus musculus
gccccagggcaaggtggctgccttt

SEQ ID NO: 939445 - DNA, 25 bp, Mus musculus
gccccagtgacacacgttcagcggt

SEQ ID NO: 939446 - DNA, 25 bp, Mus musculus
gccccagtgacacaggttcagcggt

SEQ ID NO: 939447 - DNA, 25 bp, Mus musculus
gccccagtgcagattaaggttgagg

SEQ ID NO: 939448 - DNA, 25 bp, Mus musculus
gccccagtgcagtttaaggttgagg

SEQ ID NO: 939449 - DNA, 25 bp, Mus musculus
gccccagtttgactctgtgaaagca

SEQ ID NO: 939450 - DNA, 25 bp, Mus musculus
gccccagtttgagtctgtgaaagca

SEQ ID NO: 939451 - DNA, 25 bp, Mus musculus
gccccatcctcacctcaccagtccc

SEQ ID NO: 939452 - DNA, 25 bp, Mus musculus
gccccatcctcagctcaccagtccc

SEQ ID NO: 939453 - DNA, 25 bp, Mus musculus
gccccatgatcgtgttggtgttgga

SEQ ID NO: 939454 - DNA, 25 bp, Mus musculus
gccccatgatggtgttggtgttgga

SEQ ID NO: 939455 - DNA, 25 bp, Mus musculus
gccccatgggcccccgacactgtat

SEQ ID NO: 939456 - DNA, 25 bp, Mus musculus
gccccatgggccccggacactgtat

SEQ ID NO: 939457 - DNA, 25 bp, Mus musculus
gccccatttacacggagaagctggg

SEQ ID NO: 939458 - DNA, 25 bp, Mus musculus
gccccatttacagggagaagctggg

SEQ ID NO: 939459 - DNA, 25 bp, Mus musculus
gcccccaaagagccaagctctcaac

SEQ ID NO: 939460 - DNA, 25 bp, Mus musculus
gcccccaaagaggcaagctctcaac

SEQ ID NO: 939461 - DNA, 25 bp, Mus musculus
gcccccaagaaacaatggcttcact

SEQ ID NO: 939462 - DNA, 25 bp, Mus musculus
gcccccaagaaagaatggcttcact

SEQ ID NO: 939463 - DNA, 25 bp, Mus musculus
gcccccagagagctctcatggtacc

SEQ ID NO: 939464 - DNA, 25 bp, Mus musculus
gcccccagagaggtctcatggtacc

SEQ ID NO: 939465 - DNA, 25 bp, Mus musculus
gcccccagtcagatctgtctcgaga

SEQ ID NO: 939466 - DNA, 25 bp, Mus musculus
gcccccagtcagcccggggctgtgc

SEQ ID NO: 939467 - DNA, 25 bp, Mus musculus
gcccccagtcaggccggggctgtgc

SEQ ID NO: 939468 - DNA, 25 bp, Mus musculus
gcccccagtcagttctgtctcgaga

SEQ ID NO: 939469 - DNA, 25 bp, Mus musculus
gccccccagccactgtgaccccaca

SEQ ID NO: 939470 - DNA, 25 bp, Mus musculus
gccccccagccagtgtgaccccaca

SEQ ID NO: 939471 - DNA, 25 bp, Mus musculus
gcccccccagcgctaccacctaagc

SEQ ID NO: 939472 - DNA, 25 bp, Mus musculus
gcccccccagggctaccacctaagc

SEQ ID NO: 939473 - DNA, 25 bp, Mus musculus
gcccccctccttccatccaaatgtt

SEQ ID NO: 939474 - DNA, 25 bp, Mus musculus
gcccccctccttccttccaaatgtt

SEQ ID NO: 939475 - DNA, 25 bp, Mus musculus
gccccccttttcagaatgaagatat

SEQ ID NO: 939476 - DNA, 25 bp, Mus musculus
gccccccttttctgaatgaagatat

SEQ ID NO: 939477 - DNA, 25 bp, Mus musculus
gcccccgatcagaacatgccattgc

SEQ ID NO: 939478 - DNA, 25 bp, Mus musculus
gcccccgatcagtacatgccattgc

SEQ ID NO: 939479 - DNA, 25 bp, Mus musculus
gcccccgcagcgagctccgctttgg

SEQ ID NO: 939480 - DNA, 25 bp, Mus musculus
gcccccgcagggagctccgctttgg

SEQ ID NO: 939481 - DNA, 25 bp, Mus musculus
gccccctcagcccacgatctagagt

SEQ ID NO: 939482 - DNA, 25 bp, Mus musculus
gccccctcagcccacggtctcccta

SEQ ID NO: 939483 - DNA, 25 bp, Mus musculus
gccccctcagcccacgtggtgctct

SEQ ID NO: 939484 - DNA, 25 bp, Mus musculus
gccccctcagcccaggatctagagt

SEQ ID NO: 939485 - DNA, 25 bp, Mus musculus
gccccctcagcccagggtctcccta

SEQ ID NO: 939486 - DNA, 25 bp, Mus musculus
gccccctcagcccaggtggtgctct

SEQ ID NO: 939487 - DNA, 25 bp, Mus musculus
gccccctgagctgacaaaccgatac

SEQ ID NO: 939488 - DNA, 25 bp, Mus musculus
gccccctgaggtgacaaaccgatac

SEQ ID NO: 939489 - DNA, 25 bp, Mus musculus
gccccctgcaagcgtgactctggag

SEQ ID NO: 939490 - DNA, 25 bp, Mus musculus
gccccctgcaagggtgactctggag

SEQ ID NO: 939491 - DNA, 25 bp, Mus musculus
gccccgacacaggtcgagaatataa

SEQ ID NO: 939492 - DNA, 25 bp, Mus musculus
gccccgacacaggtctgtatccaga

SEQ ID NO: 939493 - DNA, 25 bp, Mus musculus
gccccgacacaggtggagaatataa

SEQ ID NO: 939494 - DNA, 25 bp, Mus musculus
gccccgacacaggtgtgtatccaga

SEQ ID NO: 939495 - DNA, 25 bp, Mus musculus
gccccgatcaagctgggagatgcca

SEQ ID NO: 939496 - DNA, 25 bp, Mus musculus
gccccgatcaaggtgggagatgcca

SEQ ID NO: 939497 - DNA, 25 bp, Mus musculus
gccccgccggccaatgggcccagtg

SEQ ID NO: 939498 - DNA, 25 bp, Mus musculus
gccccgccggcctatgggcccagtg

SEQ ID NO: 939499 - DNA, 25 bp, Mus musculus
gccccgcgagctaaaatgggtacta

SEQ ID NO: 939500 - DNA, 25 bp, Mus musculus
gccccgcgaggtaaaatgggtacta

SEQ ID NO: 939501 - DNA, 25 bp, Mus musculus
gccccggaggagctgacagagttag

SEQ ID NO: 939502 - DNA, 25 bp, Mus musculus
gccccggaggaggtgacagagttag

SEQ ID NO: 939503 - DNA, 25 bp, Mus musculus
gccccggccaagctattgctgtccc

SEQ ID NO: 939504 - DNA, 25 bp, Mus musculus
gccccggccaaggtattgctgtccc

SEQ ID NO: 939505 - DNA, 25 bp, Mus musculus
gccccggcctgcttctggtgtgcat

SEQ ID NO: 939506 - DNA, 25 bp, Mus musculus
gccccggcctgcttgtggtgtgcat

SEQ ID NO: 939507 - DNA, 25 bp, Mus musculus
gccccggtagagctatggatggatc

SEQ ID NO: 939508 - DNA, 25 bp, Mus musculus
gccccggtagaggtatggatggatc

SEQ ID NO: 939509 - DNA, 25 bp, Mus musculus
gccccgtggaagacaccatcattgg

SEQ ID NO: 939510 - DNA, 25 bp, Mus musculus
gccccgtggaagactccatcattgg

SEQ ID NO: 939511 - DNA, 25 bp, Mus musculus
gcccctaaagagctgaacattgacc

SEQ ID NO: 939512 - DNA, 25 bp, Mus musculus
gcccctaaagaggtgaacattgacc

SEQ ID NO: 939513 - DNA, 25 bp, Mus musculus
gcccctacataaaatggttcctaca

SEQ ID NO: 939514 - DNA, 25 bp, Mus musculus
gcccctacattaaatggttcctaca

SEQ ID NO: 939515 - DNA, 25 bp, Mus musculus
gcccctacccatcctcccaagttat

SEQ ID NO: 939516 - DNA, 25 bp, Mus musculus
gcccctacccatgctcccaagttat

SEQ ID NO: 939517 - DNA, 25 bp, Mus musculus
gcccctatgcccaacgttgtgatgg

SEQ ID NO: 939518 - DNA, 25 bp, Mus musculus
gcccctatgcccaaggttgtgatgg

SEQ ID NO: 939519 - DNA, 25 bp, Mus musculus
gcccctcaaagacaacaacacctac

SEQ ID NO: 939520 - DNA, 25 bp, Mus musculus
gcccctcaaagacatcaacacctac

SEQ ID NO: 939521 - DNA, 25 bp, Mus musculus
gcccctcaccgacgaggagaatggc

SEQ ID NO: 939522 - DNA, 25 bp, Mus musculus
gcccctcaccgaggaggagaatggc

SEQ ID NO: 939523 - DNA, 25 bp, Mus musculus
gcccctcagagcagtatgggctaat

SEQ ID NO: 939524 - DNA, 25 bp, Mus musculus
gcccctcagagctgtatgggctaat

SEQ ID NO: 939525 - DNA, 25 bp, Mus musculus
gcccctcctacacgatccgattggc

SEQ ID NO: 939526 - DNA, 25 bp, Mus musculus
gcccctcctacaggatccgattggc

SEQ ID NO: 939527 - DNA, 25 bp, Mus musculus
gcccctcctccacgtatgatgggcc

SEQ ID NO: 939528 - DNA, 25 bp, Mus musculus
gcccctcctccaggtatgatgggcc

SEQ ID NO: 939529 - DNA, 25 bp, Mus musculus
gcccctcgggaatcaggggacatcc

SEQ ID NO: 939530 - DNA, 25 bp, Mus musculus
gcccctcgggtatcaggggacatcc

SEQ ID NO: 939531 - DNA, 25 bp, Mus musculus
gcccctcttcctggagttccctgag

SEQ ID NO: 939532 - DNA, 25 bp, Mus musculus
gcccctcttcctggtgttccctgag

SEQ ID NO: 939533 - DNA, 25 bp, Mus musculus
gcccctgaagagcactgcattatct

SEQ ID NO: 939534 - DNA, 25 bp, Mus musculus
gcccctgaagaggactgcattatct

SEQ ID NO: 939535 - DNA, 25 bp, Mus musculus
gcccctgaagatggagagaagagga

SEQ ID NO: 939536 - DNA, 25 bp, Mus musculus
gcccctgaagttggagagaagagga

SEQ ID NO: 939537 - DNA, 25 bp, Mus musculus
gcccctgatgcctgggactatagcc

SEQ ID NO: 939538 - DNA, 25 bp, Mus musculus
gcccctgatggctgggactatagcc

SEQ ID NO: 939539 - DNA, 25 bp, Mus musculus
gcccctgcaaagcttttccatctcc

SEQ ID NO: 939540 - DNA, 25 bp, Mus musculus
gcccctgcaaaggttttccatctcc

SEQ ID NO: 939541 - DNA, 25 bp, Mus musculus
gcccctgcagaagactgctagctac

SEQ ID NO: 939542 - DNA, 25 bp, Mus musculus
gcccctgcagcacctcatggtcagg

SEQ ID NO: 939543 - DNA, 25 bp, Mus musculus
gcccctgcaggacctcatggtcagg

SEQ ID NO: 939544 - DNA, 25 bp, Mus musculus
gcccctgcagtacacatatggagcc

SEQ ID NO: 939545 - DNA, 25 bp, Mus musculus
gcccctgcagtagacatatggagcc

SEQ ID NO: 939546 - DNA, 25 bp, Mus musculus
gcccctgcagtagactgctagctac

SEQ ID NO: 939547 - DNA, 25 bp, Mus musculus
gcccctgcctgaccaaggggaccag

SEQ ID NO: 939548 - DNA, 25 bp, Mus musculus
gcccctgcctgagcaaggggaccag

SEQ ID NO: 939549 - DNA, 25 bp, Mus musculus
gcccctgctcaactctgaaaatgca

SEQ ID NO: 939550 - DNA, 25 bp, Mus musculus
gcccctgctcaagtctgaaaatgca

SEQ ID NO: 939551 - DNA, 25 bp, Mus musculus
gcccctgctcagcacatgcttctac

SEQ ID NO: 939552 - DNA, 25 bp, Mus musculus
gcccctgctcagcagatgcttctac

SEQ ID NO: 939553 - DNA, 25 bp, Mus musculus
gcccctgctgcacggcccagatatt

SEQ ID NO: 939554 - DNA, 25 bp, Mus musculus
gcccctgctgcagggcccagatatt

SEQ ID NO: 939555 - DNA, 25 bp, Mus musculus
gcccctggaagagaaggccctgatg

SEQ ID NO: 939556 - DNA, 25 bp, Mus musculus
gcccctggaagagatggccctgatg

SEQ ID NO: 939557 - DNA, 25 bp, Mus musculus
gcccctgggctgctggctctcgagg

SEQ ID NO: 939558 - DNA, 25 bp, Mus musculus
gcccctgggctggtggctctcgagg

SEQ ID NO: 939559 - DNA, 25 bp, Mus musculus
gcccctggggagtcttctgagctcc

SEQ ID NO: 939560 - DNA, 25 bp, Mus musculus
gcccctggggtgtcttctgagctcc

SEQ ID NO: 939561 - DNA, 25 bp, Mus musculus
gcccctgtccagatactgcaggaat

SEQ ID NO: 939562 - DNA, 25 bp, Mus musculus
gcccctgtccagttactgcaggaat

SEQ ID NO: 939563 - DNA, 25 bp, Mus musculus
gcccctgtgacattctgctgggctt

SEQ ID NO: 939564 - DNA, 25 bp, Mus musculus
gcccctgtgacattgtgctgggctt

SEQ ID NO: 939565 - DNA, 25 bp, Mus musculus
gcccctgttctgctgattgaggctg

SEQ ID NO: 939566 - DNA, 25 bp, Mus musculus
gcccctgttctggtgattgaggctg

SEQ ID NO: 939567 - DNA, 25 bp, Mus musculus
gccccttattatccattgggcagcc

SEQ ID NO: 939568 - DNA, 25 bp, Mus musculus
gccccttattttccattgggcagcc

SEQ ID NO: 939569 - DNA, 25 bp, Mus musculus
gccccttgagaatggcaagaagaag

SEQ ID NO: 939570 - DNA, 25 bp, Mus musculus
gccccttgagtatggcaagaagaag

SEQ ID NO: 939571 - DNA, 25 bp, Mus musculus
gcccgaaagactctaaagcgcctga

SEQ ID NO: 939572 - DNA, 25 bp, Mus musculus
gcccgaaagagtctaaagcgcctga

SEQ ID NO: 939573 - DNA, 25 bp, Mus musculus
gcccgacagaatactcctaagacca

SEQ ID NO: 939574 - DNA, 25 bp, Mus musculus
gcccgacagaattctcctaagacca

SEQ ID NO: 939575 - DNA, 25 bp, Mus musculus
gcccgaccgattagatgtccatgca

SEQ ID NO: 939576 - DNA, 25 bp, Mus musculus
gcccgaccgatttgatgtccatgca

SEQ ID NO: 939577 - DNA, 25 bp, Mus musculus
gcccgacctgacatgccttccagcc

SEQ ID NO: 939578 - DNA, 25 bp, Mus musculus
gcccgacctgtcatgccttccagcc

SEQ ID NO: 939579 - DNA, 25 bp, Mus musculus
gcccgagaccctcagtgggccacat

SEQ ID NO: 939580 - DNA, 25 bp, Mus musculus
gcccgagaccgtcagtgggccacat

SEQ ID NO: 939581 - DNA, 25 bp, Mus musculus
gcccgcacagctcccaggaaggtgg

SEQ ID NO: 939582 - DNA, 25 bp, Mus musculus
gcccgcacaggtcccaggaaggtgg

SEQ ID NO: 939583 - DNA, 25 bp, Mus musculus
gcccgcaccgcatcttctgttgagc

SEQ ID NO: 939584 - DNA, 25 bp, Mus musculus
gcccgcaccggatcttctgttgagc

SEQ ID NO: 939585 - DNA, 25 bp, Mus musculus
gcccgcactggaccgtgctcttcag

SEQ ID NO: 939586 - DNA, 25 bp, Mus musculus
gcccgcactggagcgtgctcttcag

SEQ ID NO: 939587 - DNA, 25 bp, Mus musculus
gcccgcagtgtgagtgcctgctcac

SEQ ID NO: 939588 - DNA, 25 bp, Mus musculus
gcccgcagtgtgtgtgcctgctcac

SEQ ID NO: 939589 - DNA, 25 bp, Mus musculus
gcccgcccagcttgtcttgacaccc

SEQ ID NO: 939590 - DNA, 25 bp, Mus musculus
gcccgcccaggttgtcttgacaccc

SEQ ID NO: 939591 - DNA, 25 bp, Mus musculus
gcccgcctctcttgacagcatttca

SEQ ID NO: 939592 - DNA, 25 bp, Mus musculus
gcccgcctctgttgacagcatttca

SEQ ID NO: 939593 - DNA, 25 bp, Mus musculus
gcccgcctgggcagcgatccctgct

SEQ ID NO: 939594 - DNA, 25 bp, Mus musculus
gcccgcctgggcagggatccctgct

SEQ ID NO: 939595 - DNA, 25 bp, Mus musculus
gcccgctgcgtgcacattgatgagt

SEQ ID NO: 939596 - DNA, 25 bp, Mus musculus
gcccgctgcgtggacattgatgagt

SEQ ID NO: 939597 - DNA, 25 bp, Mus musculus
gcccgctttgagcgcctgaggaaga

SEQ ID NO: 939598 - DNA, 25 bp, Mus musculus
gcccgctttgagggcctgaggaaga

SEQ ID NO: 939599 - DNA, 25 bp, Mus musculus
gcccggacaaaacatgaagagctcc

SEQ ID NO: 939600 - DNA, 25 bp, Mus musculus
gcccggacaatacatgaagagctcc

SEQ ID NO: 939601 - DNA, 25 bp, Mus musculus
gcccggacctcaccagaaatctccc

SEQ ID NO: 939602 - DNA, 25 bp, Mus musculus
gcccggacctcacgtctctgcctcc

SEQ ID NO: 939603 - DNA, 25 bp, Mus musculus
gcccggacctcagcagaaatctccc

SEQ ID NO: 939604 - DNA, 25 bp, Mus musculus
gcccggacctcaggtctctgcctcc

SEQ ID NO: 939605 - DNA, 25 bp, Mus musculus
gcccggagatgacgcgtcgatcagc

SEQ ID NO: 939606 - DNA, 25 bp, Mus musculus
gcccggagatgaggcgtcgatcagc

SEQ ID NO: 939607 - DNA, 25 bp, Mus musculus
gcccggaggagatgcacgtggatga

SEQ ID NO: 939608 - DNA, 25 bp, Mus musculus
gcccggaggagatgcagcacgcccc

SEQ ID NO: 939609 - DNA, 25 bp, Mus musculus
gcccggaggagatggacgtggatga

SEQ ID NO: 939610 - DNA, 25 bp, Mus musculus
gcccggaggagatggagcacgcccc

SEQ ID NO: 939611 - DNA, 25 bp, Mus musculus
gcccggattattcgagatccatcac

SEQ ID NO: 939612 - DNA, 25 bp, Mus musculus
gcccggattattggagatccatcac

SEQ ID NO: 939613 - DNA, 25 bp, Mus musculus
gcccggcagacatacatatgaggac

SEQ ID NO: 939614 - DNA, 25 bp, Mus musculus
gcccggcagacatagatatgaggac

SEQ ID NO: 939615 - DNA, 25 bp, Mus musculus
gcccggcccagccccgtcaagcagg

SEQ ID NO: 939616 - DNA, 25 bp, Mus musculus
gcccggcccagcccggtcaagcagg

SEQ ID NO: 939617 - DNA, 25 bp, Mus musculus
gcccggctccctcacgtataagtat

SEQ ID NO: 939618 - DNA, 25 bp, Mus musculus
gcccggctccctcaggtataagtat

SEQ ID NO: 939619 - DNA, 25 bp, Mus musculus
gcccggcttagaactctccgctggt

SEQ ID NO: 939620 - DNA, 25 bp, Mus musculus
gcccggcttagatctctccgctggt

SEQ ID NO: 939621 - DNA, 25 bp, Mus musculus
gcccgggagcagcctgaagctgagg

SEQ ID NO: 939622 - DNA, 25 bp, Mus musculus
gcccgggagcaggctgaagctgagg

SEQ ID NO: 939623 - DNA, 25 bp, Mus musculus
gcccggggtcagccatgggagccgc

SEQ ID NO: 939624 - DNA, 25 bp, Mus musculus
gcccggggtcaggcatgggagccgc

SEQ ID NO: 939625 - DNA, 25 bp, Mus musculus
gcccggtttcacatgagagcacatg

SEQ ID NO: 939626 - DNA, 25 bp, Mus musculus
gcccggtttcacttgagagcacatg

SEQ ID NO: 939627 - DNA, 25 bp, Mus musculus
gcccgtatagattacatctcgctta

SEQ ID NO: 939628 - DNA, 25 bp, Mus musculus
gcccgtatagccacgtcagctttac

SEQ ID NO: 939629 - DNA, 25 bp, Mus musculus
gcccgtataggcacgtcagctttac

SEQ ID NO: 939630 - DNA, 25 bp, Mus musculus
gcccgtatagtttacatctcgctta

SEQ ID NO: 939631 - DNA, 25 bp, Mus musculus
gcccgtcagaagcgttggtgagaag

SEQ ID NO: 939632 - DNA, 25 bp, Mus musculus
gcccgtcagaagggttggtgagaag

SEQ ID NO: 939633 - DNA, 25 bp, Mus musculus
gcccgtgcccctcagcttctaggaa

SEQ ID NO: 939634 - DNA, 25 bp, Mus musculus
gcccgtgcccgtcagcttctaggaa

SEQ ID NO: 939635 - DNA, 25 bp, Mus musculus
gcccgtgttccaccaccacctctgc

SEQ ID NO: 939636 - DNA, 25 bp, Mus musculus
gcccgtgttccagcaccacctctgc

SEQ ID NO: 939637 - DNA, 25 bp, Mus musculus
gcccgttcagcgctgggcttcaaca

SEQ ID NO: 939638 - DNA, 25 bp, Mus musculus
gcccgttcagggctgggcttcaaca

SEQ ID NO: 939639 - DNA, 25 bp, Mus musculus
gcccgttgagcaagcaagtggccag

SEQ ID NO: 939640 - DNA, 25 bp, Mus musculus
gcccgttgagcaagtggccagcagc

SEQ ID NO: 939641 - DNA, 25 bp, Mus musculus
gcccgttgaggaagcaagtggccag

SEQ ID NO: 939642 - DNA, 25 bp, Mus musculus
gcccgttgaggaagtggccagcagc

SEQ ID NO: 939643 - DNA, 25 bp, Mus musculus
gccctacaagagttcctcctgctcc

SEQ ID NO: 939644 - DNA, 25 bp, Mus musculus
gccctacaagtgttcctcctgctcc

SEQ ID NO: 939645 - DNA, 25 bp, Mus musculus
gccctacacagccacctccggtctg

SEQ ID NO: 939646 - DNA, 25 bp, Mus musculus
gccctacacagccagctccggtctg

SEQ ID NO: 939647 - DNA, 25 bp, Mus musculus
gccctacccgagaggacgcgaccgt

SEQ ID NO: 939648 - DNA, 25 bp, Mus musculus
gccctacccgagtggacgcgaccgt

SEQ ID NO: 939649 - DNA, 25 bp, Mus musculus
gccctactatatcaaccacgagacc

SEQ ID NO: 939650 - DNA, 25 bp, Mus musculus
gccctactatatcatccacgagacc

SEQ ID NO: 939651 - DNA, 25 bp, Mus musculus
gccctagcttggcggctttcaggta

SEQ ID NO: 939652 - DNA, 25 bp, Mus musculus
gccctagcttgggggctttcaggta

SEQ ID NO: 939653 - DNA, 25 bp, Mus musculus
gccctagtgagacactctacacgga

SEQ ID NO: 939654 - DNA, 25 bp, Mus musculus
gccctagtgagagactctacacgga

SEQ ID NO: 939655 - DNA, 25 bp, Mus musculus
gccctatatccacgaggagtttctc

SEQ ID NO: 939656 - DNA, 25 bp, Mus musculus
gccctatatccaggaggagtttctc

SEQ ID NO: 939657 - DNA, 25 bp, Mus musculus
gccctatcagaacaccatcggggct

SEQ ID NO: 939658 - DNA, 25 bp, Mus musculus
gccctatcagaagaccatcggggct

SEQ ID NO: 939659 - DNA, 25 bp, Mus musculus
gccctatttcagcaaactcccatct

SEQ ID NO: 939660 - DNA, 25 bp, Mus musculus
gccctatttcagcttgtctactttt

SEQ ID NO: 939661 - DNA, 25 bp, Mus musculus
gccctatttcaggaaactcccatct

SEQ ID NO: 939662 - DNA, 25 bp, Mus musculus
gccctatttcaggttgtctactttt

SEQ ID NO: 939663 - DNA, 25 bp, Mus musculus
gccctcacacagaaaggcctaaaga

SEQ ID NO: 939664 - DNA, 25 bp, Mus musculus
gccctcacacagagaggtctgaaga

SEQ ID NO: 939665 - DNA, 25 bp, Mus musculus
gccctcacacagccctaaagaatgt

SEQ ID NO: 939666 - DNA, 25 bp, Mus musculus
gccctcacacagctttccctctgta

SEQ ID NO: 939667 - DNA, 25 bp, Mus musculus
gccctcacacaggcctaaagaatgt

SEQ ID NO: 939668 - DNA, 25 bp, Mus musculus
gccctcacacaggtttccctctgta

SEQ ID NO: 939669 - DNA, 25 bp, Mus musculus
gccctcacacagtaaggcctaaaga

SEQ ID NO: 939670 - DNA, 25 bp, Mus musculus
gccctcacacagtgaggtctgaaga

SEQ ID NO: 939671 - DNA, 25 bp, Mus musculus
gccctcacagccacccggtccttct

SEQ ID NO: 939672 - DNA, 25 bp, Mus musculus
gccctcacaggcacccggtccttct

SEQ ID NO: 939673 - DNA, 25 bp, Mus musculus
gccctcacatctttgctttgtcgga

SEQ ID NO: 939674 - DNA, 25 bp, Mus musculus
gccctcacatgtttgctttgtcgga

SEQ ID NO: 939675 - DNA, 25 bp, Mus musculus
gccctcacgcctgtcgtggttacgc

SEQ ID NO: 939676 - DNA, 25 bp, Mus musculus
gccctcacgcctgtggtggttacgc

SEQ ID NO: 939677 - DNA, 25 bp, Mus musculus
gccctcagagagctcctggaaggac

SEQ ID NO: 939678 - DNA, 25 bp, Mus musculus
gccctcagagcgtctttggaggcta

SEQ ID NO: 939679 - DNA, 25 bp, Mus musculus
gccctcagagggtctttggaggcta

SEQ ID NO: 939680 - DNA, 25 bp, Mus musculus
gccctcagagtgctcctggaaggac

SEQ ID NO: 939681 - DNA, 25 bp, Mus musculus
gccctcagatggcacgaccccacag

SEQ ID NO: 939682 - DNA, 25 bp, Mus musculus
gccctcagatggcacgcccaagtat

SEQ ID NO: 939683 - DNA, 25 bp, Mus musculus
gccctcagatggcaggaccccacag

SEQ ID NO: 939684 - DNA, 25 bp, Mus musculus
gccctcagatggcaggcccaagtat

SEQ ID NO: 939685 - DNA, 25 bp, Mus musculus
gccctcatagcagttgctgcaattg

SEQ ID NO: 939686 - DNA, 25 bp, Mus musculus
gccctcataggagttgctgcaattg

SEQ ID NO: 939687 - DNA, 25 bp, Mus musculus
gccctcatcaatgaggaactctatg

SEQ ID NO: 939688 - DNA, 25 bp, Mus musculus
gccctcatcattgaggaactctatg

SEQ ID NO: 939689 - DNA, 25 bp, Mus musculus
gccctcatttccgacgctactaaag

SEQ ID NO: 939690 - DNA, 25 bp, Mus musculus
gccctcatttccgaggctactaaag

SEQ ID NO: 939691 - DNA, 25 bp, Mus musculus
gccctccagaagcccaagaaatatg

SEQ ID NO: 939692 - DNA, 25 bp, Mus musculus
gccctccagaaggccaagaaatatg

SEQ ID NO: 939693 - DNA, 25 bp, Mus musculus
gccctccatgcacatagtcttgaag

SEQ ID NO: 939694 - DNA, 25 bp, Mus musculus
gccctccatggacatagtcttgaag

SEQ ID NO: 939695 - DNA, 25 bp, Mus musculus
gccctcccagatatgcccgccgaga

SEQ ID NO: 939696 - DNA, 25 bp, Mus musculus
gccctcccagcgccagccgcacagt

SEQ ID NO: 939697 - DNA, 25 bp, Mus musculus
gccctcccagggccagccgcacagt

SEQ ID NO: 939698 - DNA, 25 bp, Mus musculus
gccctcccagttatgcccgccgaga

SEQ ID NO: 939699 - DNA, 25 bp, Mus musculus
gccctccgaaaactcctggaggtca

SEQ ID NO: 939700 - DNA, 25 bp, Mus musculus
gccctccgaaaactgctggaggtca

SEQ ID NO: 939701 - DNA, 25 bp, Mus musculus
gccctccgagcagtcgcccgagaca

SEQ ID NO: 939702 - DNA, 25 bp, Mus musculus
gccctccgagcagtggcccgagaca

SEQ ID NO: 939703 - DNA, 25 bp, Mus musculus
gccctccgtgaactggaaggcctga

SEQ ID NO: 939704 - DNA, 25 bp, Mus musculus
gccctccgtgaagtggaaggcctga

SEQ ID NO: 939705 - DNA, 25 bp, Mus musculus
gccctcctctggctcgtaaattgct

SEQ ID NO: 939706 - DNA, 25 bp, Mus musculus
gccctcctctggctggtaaattgct

SEQ ID NO: 939707 - DNA, 25 bp, Mus musculus
gccctcgaatctgccgttctctgag

SEQ ID NO: 939708 - DNA, 25 bp, Mus musculus
gccctcgaatgtgccgttctctgag

SEQ ID NO: 939709 - DNA, 25 bp, Mus musculus
gccctctaccagcttccaccacagc

SEQ ID NO: 939710 - DNA, 25 bp, Mus musculus
gccctctaccaggttccaccacagc

SEQ ID NO: 939711 - DNA, 25 bp, Mus musculus
gccctctccaagacatataacacca

SEQ ID NO: 939712 - DNA, 25 bp, Mus musculus
gccctctccaagtcatataacacca

SEQ ID NO: 939713 - DNA, 25 bp, Mus musculus
gccctctgccagcaacagattggct

SEQ ID NO: 939714 - DNA, 25 bp, Mus musculus
gccctctgccaggaacagattggct

SEQ ID NO: 939715 - DNA, 25 bp, Mus musculus
gccctcttccacaacaatcacctat

SEQ ID NO: 939716 - DNA, 25 bp, Mus musculus
gccctcttccacaagaatcacctat

SEQ ID NO: 939717 - DNA, 25 bp, Mus musculus
gccctgaacagtgccatatgagaac

SEQ ID NO: 939718 - DNA, 25 bp, Mus musculus
gccctgaacagtgccgcaacataac

SEQ ID NO: 939719 - DNA, 25 bp, Mus musculus
gccctgaacagtgcgatatgagaac

SEQ ID NO: 939720 - DNA, 25 bp, Mus musculus
gccctgaacagtgcggcaacataac

SEQ ID NO: 939721 - DNA, 25 bp, Mus musculus
gccctgacaaagaacgagcaccctc

SEQ ID NO: 939722 - DNA, 25 bp, Mus musculus
gccctgacaaagaaggagcaccctc

SEQ ID NO: 939723 - DNA, 25 bp, Mus musculus
gccctgacagtttgcaaaacattcc

SEQ ID NO: 939724 - DNA, 25 bp, Mus musculus
gccctgacagtttggaaaacattcc

SEQ ID NO: 939725 - DNA, 25 bp, Mus musculus
gccctgaccccagactccccagact

SEQ ID NO: 939726 - DNA, 25 bp, Mus musculus
gccctgaccccagagtccccagact

SEQ ID NO: 939727 - DNA, 25 bp, Mus musculus
gccctgaccgattcacaatgacatc

SEQ ID NO: 939728 - DNA, 25 bp, Mus musculus
gccctgaccgtttcacaatgacatc

SEQ ID NO: 939729 - DNA, 25 bp, Mus musculus
gccctgagaaacagggtgctcttct

SEQ ID NO: 939730 - DNA, 25 bp, Mus musculus
gccctgagaaactgggtgctcttct

SEQ ID NO: 939731 - DNA, 25 bp, Mus musculus
gccctgatagacccaactcatttgt

SEQ ID NO: 939732 - DNA, 25 bp, Mus musculus
gccctgatagtcccaactcatttgt

SEQ ID NO: 939733 - DNA, 25 bp, Mus musculus
gccctgatcacccacttgttttgga

SEQ ID NO: 939734 - DNA, 25 bp, Mus musculus
gccctgatcacccagttgttttgga

SEQ ID NO: 939735 - DNA, 25 bp, Mus musculus
gccctgattccacgcttcttgccac

SEQ ID NO: 939736 - DNA, 25 bp, Mus musculus
gccctgattccaggcttcttgccac

SEQ ID NO: 939737 - DNA, 25 bp, Mus musculus
gccctgcagcagctgattcaggatt

SEQ ID NO: 939738 - DNA, 25 bp, Mus musculus
gccctgcagcagctgttcaggatga

SEQ ID NO: 939739 - DNA, 25 bp, Mus musculus
gccctgcagcaggtgattcaggatt

SEQ ID NO: 939740 - DNA, 25 bp, Mus musculus
gccctgcagcaggtgttcaggatga

SEQ ID NO: 939741 - DNA, 25 bp, Mus musculus
gccctgcagtgtcactgctgcccta

SEQ ID NO: 939742 - DNA, 25 bp, Mus musculus
gccctgcagtgtcacttcctttcta

SEQ ID NO: 939743 - DNA, 25 bp, Mus musculus
gccctgcagtgtcagtgctgcccta

SEQ ID NO: 939744 - DNA, 25 bp, Mus musculus
gccctgcagtgtcagttcctttcta

SEQ ID NO: 939745 - DNA, 25 bp, Mus musculus
gccctgcataagcggtgtgtctgct

SEQ ID NO: 939746 - DNA, 25 bp, Mus musculus
gccctgcataaggggtgtgtctgct

SEQ ID NO: 939747 - DNA, 25 bp, Mus musculus
gccctgcatcaacgagcttgtgtca

SEQ ID NO: 939748 - DNA, 25 bp, Mus musculus
gccctgcatcaaggagcttgtgtca

SEQ ID NO: 939749 - DNA, 25 bp, Mus musculus
gccctgccatgttgcatgccgcctt

SEQ ID NO: 939750 - DNA, 25 bp, Mus musculus
gccctgccatgttggatgccgcctt

SEQ ID NO: 939751 - DNA, 25 bp, Mus musculus
gccctgcccagaaactccccccagg

SEQ ID NO: 939752 - DNA, 25 bp, Mus musculus
gccctgcccagaccctgaccccagg

SEQ ID NO: 939753 - DNA, 25 bp, Mus musculus
gccctgcccagagcctgaccccagg

SEQ ID NO: 939754 - DNA, 25 bp, Mus musculus
gccctgcccagatactccccccagg

SEQ ID NO: 939755 - DNA, 25 bp, Mus musculus
gccctgccccagattgctgccaaga

SEQ ID NO: 939756 - DNA, 25 bp, Mus musculus
gccctgccccagtttgctgccaaga

SEQ ID NO: 939757 - DNA, 25 bp, Mus musculus
gccctgcgatgacgttggcttcaat

SEQ ID NO: 939758 - DNA, 25 bp, Mus musculus
gccctgcgatgaggttggcttcaat

SEQ ID NO: 939759 - DNA, 25 bp, Mus musculus
gccctgcggacacgacttttgctct

SEQ ID NO: 939760 - DNA, 25 bp, Mus musculus
gccctgcggacacgagaatgtctga

SEQ ID NO: 939761 - DNA, 25 bp, Mus musculus
gccctgcggacacgattcatcctat

SEQ ID NO: 939762 - DNA, 25 bp, Mus musculus
gccctgcggacacgtcttttgctct

SEQ ID NO: 939763 - DNA, 25 bp, Mus musculus
gccctgcggacacgtgaatgtctga

SEQ ID NO: 939764 - DNA, 25 bp, Mus musculus
gccctgcggacacgtttcatcctat

SEQ ID NO: 939765 - DNA, 25 bp, Mus musculus
gccctgcgggcacacgtggacgacc

SEQ ID NO: 939766 - DNA, 25 bp, Mus musculus
gccctgcgggcacaggtggacgacc

SEQ ID NO: 939767 - DNA, 25 bp, Mus musculus
gccctgcgtcgggacgctccatcat

SEQ ID NO: 939768 - DNA, 25 bp, Mus musculus
gccctgcgtcgggaggctccatcat

SEQ ID NO: 939769 - DNA, 25 bp, Mus musculus
gccctgctaacgaagacccagcatg

SEQ ID NO: 939770 - DNA, 25 bp, Mus musculus
gccctgctaacgacccagcatggag

SEQ ID NO: 939771 - DNA, 25 bp, Mus musculus
gccctgctaacgtagacccagcatg

SEQ ID NO: 939772 - DNA, 25 bp, Mus musculus
gccctgctaacgtcccagcatggag

SEQ ID NO: 939773 - DNA, 25 bp, Mus musculus
gccctgctccagagcctcaacctgg

SEQ ID NO: 939774 - DNA, 25 bp, Mus musculus
gccctgctccagtgcctcaacctgg

SEQ ID NO: 939775 - DNA, 25 bp, Mus musculus
gccctgctcccacacagagccaacc

SEQ ID NO: 939776 - DNA, 25 bp, Mus musculus
gccctgctcccacagagagccaacc

SEQ ID NO: 939777 - DNA, 25 bp, Mus musculus
gccctgctctcactattccggctga

SEQ ID NO: 939778 - DNA, 25 bp, Mus musculus
gccctgctctcagtattccggctga

SEQ ID NO: 939779 - DNA, 25 bp, Mus musculus
gccctgctgcagaacagacccaagc

SEQ ID NO: 939780 - DNA, 25 bp, Mus musculus
gccctgctgcagaagagacccaagc

SEQ ID NO: 939781 - DNA, 25 bp, Mus musculus
gccctgctggctggggagacagcag

SEQ ID NO: 939782 - DNA, 25 bp, Mus musculus
gccctgctgggtggggagacagcag

SEQ ID NO: 939783 - DNA, 25 bp, Mus musculus
gccctggaacagcccgaatctggtt

SEQ ID NO: 939784 - DNA, 25 bp, Mus musculus
gccctggaacaggccgaatctggtt

SEQ ID NO: 939785 - DNA, 25 bp, Mus musculus
gccctggacgttcagtgtggaaaat

SEQ ID NO: 939786 - DNA, 25 bp, Mus musculus
gccctggacgttgagtgtggaaaat

SEQ ID NO: 939787 - DNA, 25 bp, Mus musculus
gccctggagactggaacctgaaaat

SEQ ID NO: 939788 - DNA, 25 bp, Mus musculus
gccctggagagtggaacctgaaaat

SEQ ID NO: 939789 - DNA, 25 bp, Mus musculus
gccctggagtccatctgtaaagagc

SEQ ID NO: 939790 - DNA, 25 bp, Mus musculus
gccctggagtccatgtgtaaagagc

SEQ ID NO: 939791 - DNA, 25 bp, Mus musculus
gccctggcacaccccccaaggaaag

SEQ ID NO: 939792 - DNA, 25 bp, Mus musculus
gccctggcacacgccccaaggaaag

SEQ ID NO: 939793 - DNA, 25 bp, Mus musculus
gccctggcagagctcgcatctctcg

SEQ ID NO: 939794 - DNA, 25 bp, Mus musculus
gccctggcagaggtcgcatctctcg

SEQ ID NO: 939795 - DNA, 25 bp, Mus musculus
gccctggcagccccacagactgaag

SEQ ID NO: 939796 - DNA, 25 bp, Mus musculus
gccctggcagccccacagcagactg

SEQ ID NO: 939797 - DNA, 25 bp, Mus musculus
gccctggcagcccctcagactgaag

SEQ ID NO: 939798 - DNA, 25 bp, Mus musculus
gccctggcagcccctcagcagactg

SEQ ID NO: 939799 - DNA, 25 bp, Mus musculus
gccctggccaagctcctggacaata

SEQ ID NO: 939800 - DNA, 25 bp, Mus musculus
gccctggccaaggtcctggacaata

SEQ ID NO: 939801 - DNA, 25 bp, Mus musculus
gccctggccgagcaagccgagatac

SEQ ID NO: 939802 - DNA, 25 bp, Mus musculus
gccctggccgaggaagccgagatac

SEQ ID NO: 939803 - DNA, 25 bp, Mus musculus
gccctggggagactgctcagttaca

SEQ ID NO: 939804 - DNA, 25 bp, Mus musculus
gccctggggagagtgctcagttaca

SEQ ID NO: 939805 - DNA, 25 bp, Mus musculus
gccctggtgcaagacagtgtccaag

SEQ ID NO: 939806 - DNA, 25 bp, Mus musculus
gccctggtgcaagagagtgtccaag

SEQ ID NO: 939807 - DNA, 25 bp, Mus musculus
gccctggtggcgttggtggctgtgt

SEQ ID NO: 939808 - DNA, 25 bp, Mus musculus
gccctggtggctccaagtacagcac

SEQ ID NO: 939809 - DNA, 25 bp, Mus musculus
gccctggtggggttggtggctgtgt

SEQ ID NO: 939810 - DNA, 25 bp, Mus musculus
gccctggtgggtccaagtacagcac

SEQ ID NO: 939811 - DNA, 25 bp, Mus musculus
gccctggtggtgaacgtcattgcac

SEQ ID NO: 939812 - DNA, 25 bp, Mus musculus
gccctggtggtgaaggtcattgcac

SEQ ID NO: 939813 - DNA, 25 bp, Mus musculus
gccctgtaaatgccttgctgaaagg

SEQ ID NO: 939814 - DNA, 25 bp, Mus musculus
gccctgtaaatggcttgctgaaagg

SEQ ID NO: 939815 - DNA, 25 bp, Mus musculus
gccctgtacaaacgggcagccacag

SEQ ID NO: 939816 - DNA, 25 bp, Mus musculus
gccctgtacaaaggggcagccacag

SEQ ID NO: 939817 - DNA, 25 bp, Mus musculus
gccctgtcgccattcgatcatctgt

SEQ ID NO: 939818 - DNA, 25 bp, Mus musculus
gccctgtcgccattggatcatctgt

SEQ ID NO: 939819 - DNA, 25 bp, Mus musculus
gccctgtcgcctctctgccacaact

SEQ ID NO: 939820 - DNA, 25 bp, Mus musculus
gccctgtcgcctgtctgccacaact

SEQ ID NO: 939821 - DNA, 25 bp, Mus musculus
gccctgtgaacaagatgccctggca

SEQ ID NO: 939822 - DNA, 25 bp, Mus musculus
gccctgtgaacatgatgccctggca

SEQ ID NO: 939823 - DNA, 25 bp, Mus musculus
gccctgtgagattcaggtgccatgc

SEQ ID NO: 939824 - DNA, 25 bp, Mus musculus
gccctgtgagtttcaggtgccatgc

SEQ ID NO: 939825 - DNA, 25 bp, Mus musculus
gccctgtggaccaacgcaccaaggg

SEQ ID NO: 939826 - DNA, 25 bp, Mus musculus
gccctgtggaccaaggcaccaaggg

SEQ ID NO: 939827 - DNA, 25 bp, Mus musculus
gccctgtggcataacgtgatgttcc

SEQ ID NO: 939828 - DNA, 25 bp, Mus musculus
gccctgtggcataaggtgatgttcc

SEQ ID NO: 939829 - DNA, 25 bp, Mus musculus
gccctgttggatggagaacaactct

SEQ ID NO: 939830 - DNA, 25 bp, Mus musculus
gccctgttggttggagaacaactct

SEQ ID NO: 939831 - DNA, 25 bp, Mus musculus
gcccttagagatgcaacaaggagac

SEQ ID NO: 939832 - DNA, 25 bp, Mus musculus
gcccttagagttgcaacaaggagac

SEQ ID NO: 939833 - DNA, 25 bp, Mus musculus
gcccttagggtgcaccaagccgggg

SEQ ID NO: 939834 - DNA, 25 bp, Mus musculus
gcccttagggtgcagcaagccgggg

SEQ ID NO: 939835 - DNA, 25 bp, Mus musculus
gcccttcaagctctatataccttgt

SEQ ID NO: 939836 - DNA, 25 bp, Mus musculus
gcccttcaaggtctatataccttgt

SEQ ID NO: 939837 - DNA, 25 bp, Mus musculus
gcccttcagagacgtctatctccat

SEQ ID NO: 939838 - DNA, 25 bp, Mus musculus
gcccttcagagaggtctatctccat

SEQ ID NO: 939839 - DNA, 25 bp, Mus musculus
gcccttccaccgcgaggatcagctg

SEQ ID NO: 939840 - DNA, 25 bp, Mus musculus
gcccttccaccgggaggatcagctg

SEQ ID NO: 939841 - DNA, 25 bp, Mus musculus
gcccttccagctgactggttatcct

SEQ ID NO: 939842 - DNA, 25 bp, Mus musculus
gcccttccaggtgactggttatcct

SEQ ID NO: 939843 - DNA, 25 bp, Mus musculus
gcccttcctccgatggctacagatg

SEQ ID NO: 939844 - DNA, 25 bp, Mus musculus
gcccttcctccgttggctacagatg

SEQ ID NO: 939845 - DNA, 25 bp, Mus musculus
gcccttcctggacaccctgcgaagg

SEQ ID NO: 939846 - DNA, 25 bp, Mus musculus
gcccttcctggacagcctgcgaagg

SEQ ID NO: 939847 - DNA, 25 bp, Mus musculus
gcccttctaagccacatccttccac

SEQ ID NO: 939848 - DNA, 25 bp, Mus musculus
gcccttctaagccagatccttccac

SEQ ID NO: 939849 - DNA, 25 bp, Mus musculus
gcccttctacggctgtgccttcttc

SEQ ID NO: 939850 - DNA, 25 bp, Mus musculus
gcccttctacgggtgtgccttcttc

SEQ ID NO: 939851 - DNA, 25 bp, Mus musculus
gcccttcttcaacaaaggtacactg

SEQ ID NO: 939852 - DNA, 25 bp, Mus musculus
gcccttcttcaagaaaggtacactg

SEQ ID NO: 939853 - DNA, 25 bp, Mus musculus
gcccttcttcagagggagtctggag

SEQ ID NO: 939854 - DNA, 25 bp, Mus musculus
gcccttcttcagtgggagtctggag

SEQ ID NO: 939855 - DNA, 25 bp, Mus musculus
gcccttgatgtgaccgcgtgtgtgg

SEQ ID NO: 939856 - DNA, 25 bp, Mus musculus
gcccttgatgtgacggcgtgtgtgg

SEQ ID NO: 939857 - DNA, 25 bp, Mus musculus
gcccttgatgtgaggcgtgtgtgga

SEQ ID NO: 939858 - DNA, 25 bp, Mus musculus
gcccttgatgtgtggcgtgtgtgga

SEQ ID NO: 939859 - DNA, 25 bp, Mus musculus
gcccttgcagctaaaatttgctatg

SEQ ID NO: 939860 - DNA, 25 bp, Mus musculus
gcccttgcaggtaaaatttgctatg

SEQ ID NO: 939861 - DNA, 25 bp, Mus musculus
gcccttgctcctccttgcttcccag

SEQ ID NO: 939862 - DNA, 25 bp, Mus musculus
gcccttgctcctcgaggcagtgaca

SEQ ID NO: 939863 - DNA, 25 bp, Mus musculus
gcccttgctcctgcttgcttcccag

SEQ ID NO: 939864 - DNA, 25 bp, Mus musculus
gcccttgctcctggaggcagtgaca

SEQ ID NO: 939865 - DNA, 25 bp, Mus musculus
gcccttggagcacgtcaaagctgca

SEQ ID NO: 939866 - DNA, 25 bp, Mus musculus
gcccttggagcaggtcaaagctgca

SEQ ID NO: 939867 - DNA, 25 bp, Mus musculus
gcccttgtggctagctcctacatca

SEQ ID NO: 939868 - DNA, 25 bp, Mus musculus
gcccttgtgggtagctcctacatca

SEQ ID NO: 939869 - DNA, 25 bp, Mus musculus
gccctttgctaggatctcttgagcc

SEQ ID NO: 939870 - DNA, 25 bp, Mus musculus
gccctttgcttggatctcttgagcc

SEQ ID NO: 939871 - DNA, 25 bp, Mus musculus
gccctttttgagccgtggtgagaag

SEQ ID NO: 939872 - DNA, 25 bp, Mus musculus
gccctttttgcctgcagagatacaa

SEQ ID NO: 939873 - DNA, 25 bp, Mus musculus
gccctttttggctgcagagatacaa

SEQ ID NO: 939874 - DNA, 25 bp, Mus musculus
gccctttttgtgccgtggtgagaag

SEQ ID NO: 939875 - DNA, 25 bp, Mus musculus
gccgaaaaaatcagcccccgactct

SEQ ID NO: 939876 - DNA, 25 bp, Mus musculus
gccgaaaaaatcaggccccgactct

SEQ ID NO: 939877 - DNA, 25 bp, Mus musculus
gccgaaagaccacccaacaattctc

SEQ ID NO: 939878 - DNA, 25 bp, Mus musculus
gccgaaagaccagccaacaattctc

SEQ ID NO: 939879 - DNA, 25 bp, Mus musculus
gccgaaatcagatactcttccccgc

SEQ ID NO: 939880 - DNA, 25 bp, Mus musculus
gccgaaatcagatagtcttccccgc

SEQ ID NO: 939881 - DNA, 25 bp, Mus musculus
gccgaaccagccaagctctcctcca

SEQ ID NO: 939882 - DNA, 25 bp, Mus musculus
gccgaaccaggcaagctctcctcca

SEQ ID NO: 939883 - DNA, 25 bp, Mus musculus
gccgaagccccacttgtaccgagct

SEQ ID NO: 939884 - DNA, 25 bp, Mus musculus
gccgaagccccagttgtaccgagct

SEQ ID NO: 939885 - DNA, 25 bp, Mus musculus
gccgaagctcaaagacaatgtcagt

SEQ ID NO: 939886 - DNA, 25 bp, Mus musculus
gccgaagctcaatgacaatgtcagt

SEQ ID NO: 939887 - DNA, 25 bp, Mus musculus
gccgaagctgagatactccatgttt

SEQ ID NO: 939888 - DNA, 25 bp, Mus musculus
gccgaagctgagttactccatgttt

SEQ ID NO: 939889 - DNA, 25 bp, Mus musculus
gccgaaggacgccctatgaagtctt

SEQ ID NO: 939890 - DNA, 25 bp, Mus musculus
gccgaaggacgcgctatgaagtctt

SEQ ID NO: 939891 - DNA, 25 bp, Mus musculus
gccgaaggagcacgagccgctcccg

SEQ ID NO: 939892 - DNA, 25 bp, Mus musculus
gccgaaggagcaggagccgctcccg

SEQ ID NO: 939893 - DNA, 25 bp, Mus musculus
gccgaatcagaggaggtcctgaccg

SEQ ID NO: 939894 - DNA, 25 bp, Mus musculus
gccgaatcagtggaggtcctgaccg

SEQ ID NO: 939895 - DNA, 25 bp, Mus musculus
gccgaatgtcaacgtggcagtgttt

SEQ ID NO: 939896 - DNA, 25 bp, Mus musculus
gccgaatgtcaaggtggcagtgttt

SEQ ID NO: 939897 - DNA, 25 bp, Mus musculus
gccgaccaccacaccggcttgctga

SEQ ID NO: 939898 - DNA, 25 bp, Mus musculus
gccgaccaccacacgggcttgctga

SEQ ID NO: 939899 - DNA, 25 bp, Mus musculus
gccgacccagctctgtgcagacgtt

SEQ ID NO: 939900 - DNA, 25 bp, Mus musculus
gccgacccaggtctgtgcagacgtt

SEQ ID NO: 939901 - DNA, 25 bp, Mus musculus
gccgacgcagaaagaagaagtaaac

SEQ ID NO: 939902 - DNA, 25 bp, Mus musculus
gccgacgcagtaagaagaagtaaac

SEQ ID NO: 939903 - DNA, 25 bp, Mus musculus
gccgactctgcacaatatgcacagc

SEQ ID NO: 939904 - DNA, 25 bp, Mus musculus
gccgactctgcagaatatgcacagc

SEQ ID NO: 939905 - DNA, 25 bp, Mus musculus
gccgactgcaaacacatcattgcca

SEQ ID NO: 939906 - DNA, 25 bp, Mus musculus
gccgactgcaaacagatcattgcca

SEQ ID NO: 939907 - DNA, 25 bp, Mus musculus
gccgactgcgggacgatcctcctgc

SEQ ID NO: 939908 - DNA, 25 bp, Mus musculus
gccgactgcgggtcgatcctcctgc

SEQ ID NO: 939909 - DNA, 25 bp, Mus musculus
gccgagaagtcccgagctgaagagg

SEQ ID NO: 939910 - DNA, 25 bp, Mus musculus
gccgagaagtcccgtgctgaagagg

SEQ ID NO: 939911 - DNA, 25 bp, Mus musculus
gccgagatcgagccatggtggagct

SEQ ID NO: 939912 - DNA, 25 bp, Mus musculus
gccgagatcgaggcatggtggagct

SEQ ID NO: 939913 - DNA, 25 bp, Mus musculus
gccgagcaaaacatcgtgagcattg

SEQ ID NO: 939914 - DNA, 25 bp, Mus musculus
gccgagcaaaacatggtgagcattg

SEQ ID NO: 939915 - DNA, 25 bp, Mus musculus
gccgagccatgacgtattactacaa

SEQ ID NO: 939916 - DNA, 25 bp, Mus musculus
gccgagccatgaggtattactacaa

SEQ ID NO: 939917 - DNA, 25 bp, Mus musculus
gccgagcccgcctcagttgacagca

SEQ ID NO: 939918 - DNA, 25 bp, Mus musculus
gccgagcccgcctctgttgacagca

SEQ ID NO: 939919 - DNA, 25 bp, Mus musculus
gccgagcgccctcagttgagcccca

SEQ ID NO: 939920 - DNA, 25 bp, Mus musculus
gccgagcgccctgagttgagcccca

SEQ ID NO: 939921 - DNA, 25 bp, Mus musculus
gccgagcgtaagatcccctgcttcg

SEQ ID NO: 939922 - DNA, 25 bp, Mus musculus
gccgagcgtaagcctgatggatgtc

SEQ ID NO: 939923 - DNA, 25 bp, Mus musculus
gccgagcgtaaggctgatggatgtc

SEQ ID NO: 939924 - DNA, 25 bp, Mus musculus
gccgagcgtaagttcccctgcttcg

SEQ ID NO: 939925 - DNA, 25 bp, Mus musculus
gccgagctgcgggacagggtctgct

SEQ ID NO: 939926 - DNA, 25 bp, Mus musculus
gccgagctgcgggagagggtctgct

SEQ ID NO: 939927 - DNA, 25 bp, Mus musculus
gccgaggaggcatccaagaacctgc

SEQ ID NO: 939928 - DNA, 25 bp, Mus musculus
gccgaggaggctatttcctggtgga

SEQ ID NO: 939929 - DNA, 25 bp, Mus musculus
gccgaggagggatccaagaacctgc

SEQ ID NO: 939930 - DNA, 25 bp, Mus musculus
gccgaggagggtatttcctggtgga

SEQ ID NO: 939931 - DNA, 25 bp, Mus musculus
gccgaggccaaccgtccagaaggat

SEQ ID NO: 939932 - DNA, 25 bp, Mus musculus
gccgaggccaaccgtgtgctgctga

SEQ ID NO: 939933 - DNA, 25 bp, Mus musculus
gccgaggccaacggtccagaaggat

SEQ ID NO: 939934 - DNA, 25 bp, Mus musculus
gccgaggccaacggtgtgctgctga

SEQ ID NO: 939935 - DNA, 25 bp, Mus musculus
gccgagggagagccaatacagagtg

SEQ ID NO: 939936 - DNA, 25 bp, Mus musculus
gccgagggagaggcaatacagagtg

SEQ ID NO: 939937 - DNA, 25 bp, Mus musculus
gccgagggatcacacggattgaaga

SEQ ID NO: 939938 - DNA, 25 bp, Mus musculus
gccgagggatcacagggattgaaga

SEQ ID NO: 939939 - DNA, 25 bp, Mus musculus
gccgaggtcacacatgaaattatgg

SEQ ID NO: 939940 - DNA, 25 bp, Mus musculus
gccgaggtcacagatgaaattatgg

SEQ ID NO: 939941 - DNA, 25 bp, Mus musculus
gccgaggtccagatacaggaggtgt

SEQ ID NO: 939942 - DNA, 25 bp, Mus musculus
gccgaggtccagttacaggaggtgt

SEQ ID NO: 939943 - DNA, 25 bp, Mus musculus
gccgagtaccagagcccacagacgc

SEQ ID NO: 939944 - DNA, 25 bp, Mus musculus
gccgagtaccagcacctgacgttcc

SEQ ID NO: 939945 - DNA, 25 bp, Mus musculus
gccgagtaccaggacctgacgttcc

SEQ ID NO: 939946 - DNA, 25 bp, Mus musculus
gccgagtaccagtgcccacagacgc

SEQ ID NO: 939947 - DNA, 25 bp, Mus musculus
gccgagtataagcaattaaccctga

SEQ ID NO: 939948 - DNA, 25 bp, Mus musculus
gccgagtataaggaattaaccctga

SEQ ID NO: 939949 - DNA, 25 bp, Mus musculus
gccgagtgttcctgaacacaaccgt

SEQ ID NO: 939950 - DNA, 25 bp, Mus musculus
gccgagtgttgctgaacacaaccgt

SEQ ID NO: 939951 - DNA, 25 bp, Mus musculus
gccgataggaagaatgaacatcatc

SEQ ID NO: 939952 - DNA, 25 bp, Mus musculus
gccgataggaagtatgaacatcatc

SEQ ID NO: 939953 - DNA, 25 bp, Mus musculus
gccgatctctgccacctttgtttac

SEQ ID NO: 939954 - DNA, 25 bp, Mus musculus
gccgatctctgccagctttgtttac

SEQ ID NO: 939955 - DNA, 25 bp, Mus musculus
gccgatgatcttcgttttgagttct

SEQ ID NO: 939956 - DNA, 25 bp, Mus musculus
gccgatgatcttggttttgagttct

SEQ ID NO: 939957 - DNA, 25 bp, Mus musculus
gccgatgggctgcatgaagtgtcct

SEQ ID NO: 939958 - DNA, 25 bp, Mus musculus
gccgatgggctggatgaagtgtcct

SEQ ID NO: 939959 - DNA, 25 bp, Mus musculus
gccgatttgggcaccatgtatacca

SEQ ID NO: 939960 - DNA, 25 bp, Mus musculus
gccgatttgggcaccgactgtcagg

SEQ ID NO: 939961 - DNA, 25 bp, Mus musculus
gccgatttgggcacgatgtatacca

SEQ ID NO: 939962 - DNA, 25 bp, Mus musculus
gccgatttgggcacggactgtcagg

SEQ ID NO: 939963 - DNA, 25 bp, Mus musculus
gccgcaaagaagatccaccaggtga

SEQ ID NO: 939964 - DNA, 25 bp, Mus musculus
gccgcaaagaagttccaccaggtga

SEQ ID NO: 939965 - DNA, 25 bp, Mus musculus
gccgcaagagccttgagatgctccc

SEQ ID NO: 939966 - DNA, 25 bp, Mus musculus
gccgcaagaggcttgagatgctccc

SEQ ID NO: 939967 - DNA, 25 bp, Mus musculus
gccgcaagccagcacccacctgcac

SEQ ID NO: 939968 - DNA, 25 bp, Mus musculus
gccgcaagccaggacccacctgcac

SEQ ID NO: 939969 - DNA, 25 bp, Mus musculus
gccgcaagtttgcggaggcgatcgg

SEQ ID NO: 939970 - DNA, 25 bp, Mus musculus
gccgcaagtttggggaggcgatcgg

SEQ ID NO: 939971 - DNA, 25 bp, Mus musculus
gccgcacagcctcctcttcctcctg

SEQ ID NO: 939972 - DNA, 25 bp, Mus musculus
gccgcacagcctgctcttcctcctg

SEQ ID NO: 939973 - DNA, 25 bp, Mus musculus
gccgcaccttcacacgtctgccctg

SEQ ID NO: 939974 - DNA, 25 bp, Mus musculus
gccgcaccttcacaggtctgccctg

SEQ ID NO: 939975 - DNA, 25 bp, Mus musculus
gccgcactcatcatcgtggacaatg

SEQ ID NO: 939976 - DNA, 25 bp, Mus musculus
gccgcactcatcatggtggacaatg

SEQ ID NO: 939977 - DNA, 25 bp, Mus musculus
gccgcactggataacgctagagaag

SEQ ID NO: 939978 - DNA, 25 bp, Mus musculus
gccgcactggataaggctagagaag

SEQ ID NO: 939979 - DNA, 25 bp, Mus musculus
gccgcagccgctgacgtcaacaagc

SEQ ID NO: 939980 - DNA, 25 bp, Mus musculus
gccgcagccgctgaggtcaacaagc

SEQ ID NO: 939981 - DNA, 25 bp, Mus musculus
gccgcagcgcagaccgcagaggccc

SEQ ID NO: 939982 - DNA, 25 bp, Mus musculus
gccgcagcgcagtccgcagaggccc

SEQ ID NO: 939983 - DNA, 25 bp, Mus musculus
gccgcagcggcgatgccgttctgag

SEQ ID NO: 939984 - DNA, 25 bp, Mus musculus
gccgcagcggggatgccgttctgag

SEQ ID NO: 939985 - DNA, 25 bp, Mus musculus
gccgcaggacagcaccacgccccac

SEQ ID NO: 939986 - DNA, 25 bp, Mus musculus
gccgcaggacaggaccacgccccac

SEQ ID NO: 939987 - DNA, 25 bp, Mus musculus
gccgcatgagctgtggtactagctc

SEQ ID NO: 939988 - DNA, 25 bp, Mus musculus
gccgcatgaggtgtggtactagctc

SEQ ID NO: 939989 - DNA, 25 bp, Mus musculus
gccgccaagaagcacgctcgcagcc

SEQ ID NO: 939990 - DNA, 25 bp, Mus musculus
gccgccaagaagcaggctcgcagcc

SEQ ID NO: 939991 - DNA, 25 bp, Mus musculus
gccgccaaggcggaccccaagcgcc

SEQ ID NO: 939992 - DNA, 25 bp, Mus musculus
gccgccaaggcggagcccaagcgcc

SEQ ID NO: 939993 - DNA, 25 bp, Mus musculus
gccgccacagagttctgtccttgga

SEQ ID NO: 939994 - DNA, 25 bp, Mus musculus
gccgccacagcaactggtgtgccta

SEQ ID NO: 939995 - DNA, 25 bp, Mus musculus
gccgccacagctcctgttgagtcag

SEQ ID NO: 939996 - DNA, 25 bp, Mus musculus
gccgccacaggaactggtgtgccta

SEQ ID NO: 939997 - DNA, 25 bp, Mus musculus
gccgccacaggtcctgttgagtcag

SEQ ID NO: 939998 - DNA, 25 bp, Mus musculus
gccgccacagtgttctgtccttgga

SEQ ID NO: 939999 - DNA, 25 bp, Mus musculus
gccgccaccatgacggtgggcaaga

SEQ ID NO: 940000 - DNA, 25 bp, Mus musculus
gccgccaccatgagcgatcagcagc

SEQ ID NO: 940001 - DNA, 25 bp, Mus musculus
gccgccaccatgtcggtgggcaaga

SEQ ID NO: 940002 - DNA, 25 bp, Mus musculus
gccgccaccatgtgcgatcagcagc

SEQ ID NO: 940003 - DNA, 25 bp, Mus musculus
gccgccagaacgatgccccatcccc

SEQ ID NO: 940004 - DNA, 25 bp, Mus musculus
gccgccagaacgttgccccatcccc

SEQ ID NO: 940005 - DNA, 25 bp, Mus musculus
gccgccagcgccctccgtgacctcg

SEQ ID NO: 940006 - DNA, 25 bp, Mus musculus
gccgccagcgccgtccgtgacctcg

SEQ ID NO: 940007 - DNA, 25 bp, Mus musculus
gccgccatagctttatggagccgta

SEQ ID NO: 940008 - DNA, 25 bp, Mus musculus
gccgccataggtttatggagccgta

SEQ ID NO: 940009 - DNA, 25 bp, Mus musculus
gccgccatatcacgaacaagttcct

SEQ ID NO: 940010 - DNA, 25 bp, Mus musculus
gccgccatatcaggaacaagttcct

SEQ ID NO: 940011 - DNA, 25 bp, Mus musculus
gccgccatcatgactgccacaactt

SEQ ID NO: 940012 - DNA, 25 bp, Mus musculus
gccgccatcatgtctgccacaactt

SEQ ID NO: 940013 - DNA, 25 bp, Mus musculus
gccgccatgctcctgggctccctgc

SEQ ID NO: 940014 - DNA, 25 bp, Mus musculus
gccgccatgctcgtgggctccctgc

SEQ ID NO: 940015 - DNA, 25 bp, Mus musculus
gccgccatggcgatcaaatttctgg

SEQ ID NO: 940016 - DNA, 25 bp, Mus musculus
gccgccatggcgttcaaatttctgg

SEQ ID NO: 940017 - DNA, 25 bp, Mus musculus
gccgcccagcgagccctgcgaagct

SEQ ID NO: 940018 - DNA, 25 bp, Mus musculus
gccgcccagcgagcgctgcgaagct

SEQ ID NO: 940019 - DNA, 25 bp, Mus musculus
gccgcccgagcagttgccccagaat

SEQ ID NO: 940020 - DNA, 25 bp, Mus musculus
gccgcccgaggagttgccccagaat

SEQ ID NO: 940021 - DNA, 25 bp, Mus musculus
gccgccctttatgtatcccccatat

SEQ ID NO: 940022 - DNA, 25 bp, Mus musculus
gccgccctttttgtatcccccatat

SEQ ID NO: 940023 - DNA, 25 bp, Mus musculus
gccgccgccaccatcagcgatcagc

SEQ ID NO: 940024 - DNA, 25 bp, Mus musculus
gccgccgccaccatgagcgatcagc

SEQ ID NO: 940025 - DNA, 25 bp, Mus musculus
gccgccgccgcccgtgcataagtaa

SEQ ID NO: 940026 - DNA, 25 bp, Mus musculus
gccgccgccgccggtgcataagtaa

SEQ ID NO: 940027 - DNA, 25 bp, Mus musculus
gccgccgccgctgcataagtaaagg

SEQ ID NO: 940028 - DNA, 25 bp, Mus musculus
gccgccgccggtgcataagtaaagg

SEQ ID NO: 940029 - DNA, 25 bp, Mus musculus
gccgccgcctcacgcgccagcaggt

SEQ ID NO: 940030 - DNA, 25 bp, Mus musculus
gccgccgcctcacgggccagcaggt

SEQ ID NO: 940031 - DNA, 25 bp, Mus musculus
gccgccgcggagcacgcatggagag

SEQ ID NO: 940032 - DNA, 25 bp, Mus musculus
gccgccgcggagcaggcatggagag

SEQ ID NO: 940033 - DNA, 25 bp, Mus musculus
gccgccgcggagctctttggccagt

SEQ ID NO: 940034 - DNA, 25 bp, Mus musculus
gccgccgcggaggtctttggccagt

SEQ ID NO: 940035 - DNA, 25 bp, Mus musculus
gccgccgtgcggcgagcagcaatga

SEQ ID NO: 940036 - DNA, 25 bp, Mus musculus
gccgccgtgcggcgatagctgcccc

SEQ ID NO: 940037 - DNA, 25 bp, Mus musculus
gccgccgtgcggggagcagcaatga

SEQ ID NO: 940038 - DNA, 25 bp, Mus musculus
gccgccgtgcggggatagctgcccc

SEQ ID NO: 940039 - DNA, 25 bp, Mus musculus
gccgccgtggacgacgtgtccacag

SEQ ID NO: 940040 - DNA, 25 bp, Mus musculus
gccgccgtggacgaggtgtccacag

SEQ ID NO: 940041 - DNA, 25 bp, Mus musculus
gccgcctatgattctatggcacagg

SEQ ID NO: 940042 - DNA, 25 bp, Mus musculus
gccgcctatgtttctatggcacagg

SEQ ID NO: 940043 - DNA, 25 bp, Mus musculus
gccgcctcacggcccagcaggtggc

SEQ ID NO: 940044 - DNA, 25 bp, Mus musculus
gccgcctcacgggccagcaggtggc

SEQ ID NO: 940045 - DNA, 25 bp, Mus musculus
gccgcctcagctgtttgaaccatga

SEQ ID NO: 940046 - DNA, 25 bp, Mus musculus
gccgcctcaggtgtttgaaccatga

SEQ ID NO: 940047 - DNA, 25 bp, Mus musculus
gccgcctcctcccagcctgaagcta

SEQ ID NO: 940048 - DNA, 25 bp, Mus musculus
gccgcctcctccgagcctgaagcta

SEQ ID NO: 940049 - DNA, 25 bp, Mus musculus
gccgcctgtgcccgccccgtctcct

SEQ ID NO: 940050 - DNA, 25 bp, Mus musculus
gccgcctgtgccggccccgtctcct

SEQ ID NO: 940051 - DNA, 25 bp, Mus musculus
gccgcctgtgcgcgaaggacctgtg

SEQ ID NO: 940052 - DNA, 25 bp, Mus musculus
gccgcctgtgcgggaaggacctgtg

SEQ ID NO: 940053 - DNA, 25 bp, Mus musculus
gccgccttcactcactgcaccgcgt

SEQ ID NO: 940054 - DNA, 25 bp, Mus musculus
gccgccttcagtcactgcaccgcgt

SEQ ID NO: 940055 - DNA, 25 bp, Mus musculus
gccgccttcgaccatgcagtttgac

SEQ ID NO: 940056 - DNA, 25 bp, Mus musculus
gccgccttcgtccatgcagtttgac

SEQ ID NO: 940057 - DNA, 25 bp, Mus musculus
gccgcgaccttccaccagcagcatg

SEQ ID NO: 940058 - DNA, 25 bp, Mus musculus
gccgcgaccttccagcagcagcatg

SEQ ID NO: 940059 - DNA, 25 bp, Mus musculus
gccgcgagacagcgctgatgaagcc

SEQ ID NO: 940060 - DNA, 25 bp, Mus musculus
gccgcgagacagggctgatgaagcc

SEQ ID NO: 940061 - DNA, 25 bp, Mus musculus
gccgcgcgcgggctgctgtgagtgg

SEQ ID NO: 940062 - DNA, 25 bp, Mus musculus
gccgcgcgcggggtgctgtgagtgg

SEQ ID NO: 940063 - DNA, 25 bp, Mus musculus
gccgcgcggtgactcggatactttg

SEQ ID NO: 940064 - DNA, 25 bp, Mus musculus
gccgcgcggtgactgggatactttg

SEQ ID NO: 940065 - DNA, 25 bp, Mus musculus
gccgcgcgtgactccacagaggcgt

SEQ ID NO: 940066 - DNA, 25 bp, Mus musculus
gccgcgcgtgtctccacagaggcgt

SEQ ID NO: 940067 - DNA, 25 bp, Mus musculus
gccgcgctgggacgcatgtcatgtt

SEQ ID NO: 940068 - DNA, 25 bp, Mus musculus
gccgcgctgggaggcatgtcatgtt

SEQ ID NO: 940069 - DNA, 25 bp, Mus musculus
gccgcggagcagccatggagagtag

SEQ ID NO: 940070 - DNA, 25 bp, Mus musculus
gccgcggagcaggcatggagagtag

SEQ ID NO: 940071 - DNA, 25 bp, Mus musculus
gccgcggatccgcatttgcaggccc

SEQ ID NO: 940072 - DNA, 25 bp, Mus musculus
gccgcggatccggatttgcaggccc

SEQ ID NO: 940073 - DNA, 25 bp, Mus musculus
gccgcggcaatgcacagggaggaga

SEQ ID NO: 940074 - DNA, 25 bp, Mus musculus
gccgcggcaatgcagagggaggaga

SEQ ID NO: 940075 - DNA, 25 bp, Mus musculus
gccgcggccagactctggaaataaa

SEQ ID NO: 940076 - DNA, 25 bp, Mus musculus
gccgcggccagagtctggaaataaa

SEQ ID NO: 940077 - DNA, 25 bp, Mus musculus
gccgcggcccagcttaaatggaatc

SEQ ID NO: 940078 - DNA, 25 bp, Mus musculus
gccgcggcccaggttaaatggaatc

SEQ ID NO: 940079 - DNA, 25 bp, Mus musculus
gccgcgggaaagagtccagcctctg

SEQ ID NO: 940080 - DNA, 25 bp, Mus musculus
gccgcgggaaagcataaagcatcag

SEQ ID NO: 940081 - DNA, 25 bp, Mus musculus
gccgcgggaaaggataaagcatcag

SEQ ID NO: 940082 - DNA, 25 bp, Mus musculus
gccgcgggaaagtgtccagcctctg

SEQ ID NO: 940083 - DNA, 25 bp, Mus musculus
gccgcggggcgtggcattgaagtga

SEQ ID NO: 940084 - DNA, 25 bp, Mus musculus
gccgcggggcgtgggattgaagtga

SEQ ID NO: 940085 - DNA, 25 bp, Mus musculus
gccgcgtccgggagatctctgggct

SEQ ID NO: 940086 - DNA, 25 bp, Mus musculus
gccgcgtccgggtgatctctgggct

SEQ ID NO: 940087 - DNA, 25 bp, Mus musculus
gccgctatccagcttgtcatttcaa

SEQ ID NO: 940088 - DNA, 25 bp, Mus musculus
gccgctatccaggttgtcatttcaa

SEQ ID NO: 940089 - DNA, 25 bp, Mus musculus
gccgctcaagatcctggtatatgac

SEQ ID NO: 940090 - DNA, 25 bp, Mus musculus
gccgctcaagttcctggtatatgac

SEQ ID NO: 940091 - DNA, 25 bp, Mus musculus
gccgctcgtgcgtgcacctgaacga

SEQ ID NO: 940092 - DNA, 25 bp, Mus musculus
gccgctcgtgcgtggacctgaacga

SEQ ID NO: 940093 - DNA, 25 bp, Mus musculus
gccgctcttccgctccctaaccatg

SEQ ID NO: 940094 - DNA, 25 bp, Mus musculus
gccgctcttccggtccctaaccatg

SEQ ID NO: 940095 - DNA, 25 bp, Mus musculus
gccgctgaagagcgtattgaagggc

SEQ ID NO: 940096 - DNA, 25 bp, Mus musculus
gccgctgaagagggtattgaagggc

SEQ ID NO: 940097 - DNA, 25 bp, Mus musculus
gccgctgagtggatacattccacca

SEQ ID NO: 940098 - DNA, 25 bp, Mus musculus
gccgctgagtggttacattccacca

SEQ ID NO: 940099 - DNA, 25 bp, Mus musculus
gccgctgcagcccccccagcctgca

SEQ ID NO: 940100 - DNA, 25 bp, Mus musculus
gccgctgcaggccccccagcctgca

SEQ ID NO: 940101 - DNA, 25 bp, Mus musculus
gccgctgtcaaaagtcttgcgctca

SEQ ID NO: 940102 - DNA, 25 bp, Mus musculus
gccgctgtcaaatgtcttgcgctca

SEQ ID NO: 940103 - DNA, 25 bp, Mus musculus
gccgctgtgaggacattgatgaatg

SEQ ID NO: 940104 - DNA, 25 bp, Mus musculus
gccgctgtgaggtcattgatgaatg

SEQ ID NO: 940105 - DNA, 25 bp, Mus musculus
gccgcttcaaagatgtcctgttgct

SEQ ID NO: 940106 - DNA, 25 bp, Mus musculus
gccgcttcaaagttgtcctgttgct

SEQ ID NO: 940107 - DNA, 25 bp, Mus musculus
gccgcttccgcaagctgcactgtac

SEQ ID NO: 940108 - DNA, 25 bp, Mus musculus
gccgcttccggaagctgcactgtac

SEQ ID NO: 940109 - DNA, 25 bp, Mus musculus
gccgcttgcggacgtttggattcag

SEQ ID NO: 940110 - DNA, 25 bp, Mus musculus
gccgcttgcggaggtttggattcag

SEQ ID NO: 940111 - DNA, 25 bp, Mus musculus
gccggaaggactatccggtgcaggt

SEQ ID NO: 940112 - DNA, 25 bp, Mus musculus
gccggaaggactatgcggtgcaggt

SEQ ID NO: 940113 - DNA, 25 bp, Mus musculus
gccggaagtgaaccccctgcccgga

SEQ ID NO: 940114 - DNA, 25 bp, Mus musculus
gccggaagtgaagcccctgcccgga

SEQ ID NO: 940115 - DNA, 25 bp, Mus musculus
gccggactgagacaattctgagtgc

SEQ ID NO: 940116 - DNA, 25 bp, Mus musculus
gccggactgagagaattctgagtgc

SEQ ID NO: 940117 - DNA, 25 bp, Mus musculus
gccggagcagcggagcccaaagaag

SEQ ID NO: 940118 - DNA, 25 bp, Mus musculus
gccggagcaggggagcccaaagaag

SEQ ID NO: 940119 - DNA, 25 bp, Mus musculus
gccggagcggctcacgttccagcta

SEQ ID NO: 940120 - DNA, 25 bp, Mus musculus
gccggagcggctcaggttccagcta

SEQ ID NO: 940121 - DNA, 25 bp, Mus musculus
gccggagctgatttatgaccagaat

SEQ ID NO: 940122 - DNA, 25 bp, Mus musculus
gccggagctgttttatgaccagaat

SEQ ID NO: 940123 - DNA, 25 bp, Mus musculus
gccggagctttgaacaaagagtgga

SEQ ID NO: 940124 - DNA, 25 bp, Mus musculus
gccggagctttgtacaaagagtgga

SEQ ID NO: 940125 - DNA, 25 bp, Mus musculus
gccggagtggcctctgcatcctaga

SEQ ID NO: 940126 - DNA, 25 bp, Mus musculus
gccggagtggcctggtgttcccggc

SEQ ID NO: 940127 - DNA, 25 bp, Mus musculus
gccggagtgggctctgcatcctaga

SEQ ID NO: 940128 - DNA, 25 bp, Mus musculus
gccggagtgggctggtgttcccggc

SEQ ID NO: 940129 - DNA, 25 bp, Mus musculus
gccggagttgcacaagactcatgca

SEQ ID NO: 940130 - DNA, 25 bp, Mus musculus
gccggagttgcacagaagactcatg

SEQ ID NO: 940131 - DNA, 25 bp, Mus musculus
gccggagttgcaccagaagactcat

SEQ ID NO: 940132 - DNA, 25 bp, Mus musculus
gccggagttgcagaagactcatgca

SEQ ID NO: 940133 - DNA, 25 bp, Mus musculus
gccggagttgcagagaagactcatg

SEQ ID NO: 940134 - DNA, 25 bp, Mus musculus
gccggagttgcagcagaagactcat

SEQ ID NO: 940135 - DNA, 25 bp, Mus musculus
gccggatgctgacatggtttttgat

SEQ ID NO: 940136 - DNA, 25 bp, Mus musculus
gccggatgctgagatggtttttgat

SEQ ID NO: 940137 - DNA, 25 bp, Mus musculus
gccggatgctgtcgctggctacaga

SEQ ID NO: 940138 - DNA, 25 bp, Mus musculus
gccggatgctgtcggtggctacaga

SEQ ID NO: 940139 - DNA, 25 bp, Mus musculus
gccggatgtgttcacaggaaagatt

SEQ ID NO: 940140 - DNA, 25 bp, Mus musculus
gccggatgtgttcagaggaaagatt

SEQ ID NO: 940141 - DNA, 25 bp, Mus musculus
gccggcaagcagaagggcgggtcct

SEQ ID NO: 940142 - DNA, 25 bp, Mus musculus
gccggcaagcagtagggcgggtcct

SEQ ID NO: 940143 - DNA, 25 bp, Mus musculus
gccggcaagcccctcccgacaccca

SEQ ID NO: 940144 - DNA, 25 bp, Mus musculus
gccggcaagcccctccgacacctgc

SEQ ID NO: 940145 - DNA, 25 bp, Mus musculus
gccggcaagcccctgccgacaccca

SEQ ID NO: 940146 - DNA, 25 bp, Mus musculus
gccggcaagcccctgcgacacctgc

SEQ ID NO: 940147 - DNA, 25 bp, Mus musculus
gccggcaggaactgagtggacgacc

SEQ ID NO: 940148 - DNA, 25 bp, Mus musculus
gccggcaggaactgtgtggacgacc

SEQ ID NO: 940149 - DNA, 25 bp, Mus musculus
gccggcatgaagctgcgggagctga

SEQ ID NO: 940150 - DNA, 25 bp, Mus musculus
gccggcatgaaggtgcgggagctga

SEQ ID NO: 940151 - DNA, 25 bp, Mus musculus
gccggccagccacataagtacggtt

SEQ ID NO: 940152 - DNA, 25 bp, Mus musculus
gccggccagccagataagtacggtt

SEQ ID NO: 940153 - DNA, 25 bp, Mus musculus
gccggcctagctcacggttttatga

SEQ ID NO: 940154 - DNA, 25 bp, Mus musculus
gccggcctagctcagggttttatga

SEQ ID NO: 940155 - DNA, 25 bp, Mus musculus
gccggcgcgcctcacagactgagcg

SEQ ID NO: 940156 - DNA, 25 bp, Mus musculus
gccggcgcgcctcagagactgagcg

SEQ ID NO: 940157 - DNA, 25 bp, Mus musculus
gccggcgcgcgccgagacctggtga

SEQ ID NO: 940158 - DNA, 25 bp, Mus musculus
gccggcgcgcgcggagacctggtga

SEQ ID NO: 940159 - DNA, 25 bp, Mus musculus
gccggcgggaagcttggctgctgga

SEQ ID NO: 940160 - DNA, 25 bp, Mus musculus
gccggcgggaaggttggctgctgga

SEQ ID NO: 940161 - DNA, 25 bp, Mus musculus
gccggcgggtaggacgcaagctgca

SEQ ID NO: 940162 - DNA, 25 bp, Mus musculus
gccggcgggtaggaggcaagctgca

SEQ ID NO: 940163 - DNA, 25 bp, Mus musculus
gccggctagatcacagtcaagcagg

SEQ ID NO: 940164 - DNA, 25 bp, Mus musculus
gccggctagatcactgtcaagcagg

SEQ ID NO: 940165 - DNA, 25 bp, Mus musculus
gccggctctgagcacttctgaagat

SEQ ID NO: 940166 - DNA, 25 bp, Mus musculus
gccggctctgagcagttctgaagat

SEQ ID NO: 940167 - DNA, 25 bp, Mus musculus
gccggctgagcagaaacaacaaata

SEQ ID NO: 940168 - DNA, 25 bp, Mus musculus
gccggctgaggagaaacaacaaata

SEQ ID NO: 940169 - DNA, 25 bp, Mus musculus
gccgggaagggacgcagtcagtgtg

SEQ ID NO: 940170 - DNA, 25 bp, Mus musculus
gccgggaagggacggagtcagtgtg

SEQ ID NO: 940171 - DNA, 25 bp, Mus musculus
gccgggaaggtgaacaagcttggac

SEQ ID NO: 940172 - DNA, 25 bp, Mus musculus
gccgggaaggtgaagaagcttggac

SEQ ID NO: 940173 - DNA, 25 bp, Mus musculus
gccgggagagaccctcaggacttgt

SEQ ID NO: 940174 - DNA, 25 bp, Mus musculus
gccgggagagacgcagtgagaaagg

SEQ ID NO: 940175 - DNA, 25 bp, Mus musculus
gccgggagagacttggtctttgtaa

SEQ ID NO: 940176 - DNA, 25 bp, Mus musculus
gccgggagagtccctcaggacttgt

SEQ ID NO: 940177 - DNA, 25 bp, Mus musculus
gccgggagagtcgcagtgagaaagg

SEQ ID NO: 940178 - DNA, 25 bp, Mus musculus
gccgggagagtcttggtctttgtaa

SEQ ID NO: 940179 - DNA, 25 bp, Mus musculus
gccgggagtccacgctaagcttcag

SEQ ID NO: 940180 - DNA, 25 bp, Mus musculus
gccgggagtccaggctaagcttcag

SEQ ID NO: 940181 - DNA, 25 bp, Mus musculus
gccgggatacagctgtgaatgaggc

SEQ ID NO: 940182 - DNA, 25 bp, Mus musculus
gccgggatacaggtgtgaatgaggc

SEQ ID NO: 940183 - DNA, 25 bp, Mus musculus
gccgggatacggcaggctaaggcca

SEQ ID NO: 940184 - DNA, 25 bp, Mus musculus
gccgggatacgggaggctaaggcca

SEQ ID NO: 940185 - DNA, 25 bp, Mus musculus
gccgggatcaagccagagatgcttt

SEQ ID NO: 940186 - DNA, 25 bp, Mus musculus
gccgggatcaaggcagagatgcttt

SEQ ID NO: 940187 - DNA, 25 bp, Mus musculus
gccgggcagccacgcaccacctacc

SEQ ID NO: 940188 - DNA, 25 bp, Mus musculus
gccgggcagccaggcaccacctacc

SEQ ID NO: 940189 - DNA, 25 bp, Mus musculus
gccgggcagcggcctggaggaggga

SEQ ID NO: 940190 - DNA, 25 bp, Mus musculus
gccgggcagcgggctggaggaggga

SEQ ID NO: 940191 - DNA, 25 bp, Mus musculus
gccgggcgagctggaaaccatggcc

SEQ ID NO: 940192 - DNA, 25 bp, Mus musculus
gccgggcgaggtggaaaccatggcc

SEQ ID NO: 940193 - DNA, 25 bp, Mus musculus
gccgggctatgacatattactacaa

SEQ ID NO: 940194 - DNA, 25 bp, Mus musculus
gccgggctatgagatattactacaa

SEQ ID NO: 940195 - DNA, 25 bp, Mus musculus
gccgggctccagctcttcacttgag

SEQ ID NO: 940196 - DNA, 25 bp, Mus musculus
gccgggctccaggtcttcacttgag

SEQ ID NO: 940197 - DNA, 25 bp, Mus musculus
gccggggctccgatcagtcaccagc

SEQ ID NO: 940198 - DNA, 25 bp, Mus musculus
gccggggctccgttcagtcaccagc

SEQ ID NO: 940199 - DNA, 25 bp, Mus musculus
gccggggtggccaattggagaagct

SEQ ID NO: 940200 - DNA, 25 bp, Mus musculus
gccggggtggcctattggagaagct

SEQ ID NO: 940201 - DNA, 25 bp, Mus musculus
gccgggttttcaccacactgcccca

SEQ ID NO: 940202 - DNA, 25 bp, Mus musculus
gccgggttttcagcacactgcccca

SEQ ID NO: 940203 - DNA, 25 bp, Mus musculus
gccggtaccctggtcatcgagaaat

SEQ ID NO: 940204 - DNA, 25 bp, Mus musculus
gccggtaccctggtgatcgagaaat

SEQ ID NO: 940205 - DNA, 25 bp, Mus musculus
gccggtaggaagaacccattgctcc

SEQ ID NO: 940206 - DNA, 25 bp, Mus musculus
gccggtaggaagaagccattgctcc

SEQ ID NO: 940207 - DNA, 25 bp, Mus musculus
gccggtctctcgatctcatcgcaga

SEQ ID NO: 940208 - DNA, 25 bp, Mus musculus
gccggtctctcgttctcatcgcaga

SEQ ID NO: 940209 - DNA, 25 bp, Mus musculus
gccggtgccaaggccgccacagaac

SEQ ID NO: 940210 - DNA, 25 bp, Mus musculus
gccggtgccaaggcggccacagaac

SEQ ID NO: 940211 - DNA, 25 bp, Mus musculus
gccggtgccgcgctttcaggtagct

SEQ ID NO: 940212 - DNA, 25 bp, Mus musculus
gccggtgccgggctttcaggtagct

SEQ ID NO: 940213 - DNA, 25 bp, Mus musculus
gccggttccgagctgtgtgaggacg

SEQ ID NO: 940214 - DNA, 25 bp, Mus musculus
gccggttccgaggtgtgtgaggacg

SEQ ID NO: 940215 - DNA, 25 bp, Mus musculus
gccgtagacctgaacgtgtccccct

SEQ ID NO: 940216 - DNA, 25 bp, Mus musculus
gccgtagacctgaaggtgtccccct

SEQ ID NO: 940217 - DNA, 25 bp, Mus musculus
gccgtcaagtacctccatgataaca

SEQ ID NO: 940218 - DNA, 25 bp, Mus musculus
gccgtcaagttcctccatgataaca

SEQ ID NO: 940219 - DNA, 25 bp, Mus musculus
gccgtcaatagtgccggaaactgct

SEQ ID NO: 940220 - DNA, 25 bp, Mus musculus
gccgtcaatagtgcgggaaactgct

SEQ ID NO: 940221 - DNA, 25 bp, Mus musculus
gccgtcaccatgcccctggctagag

SEQ ID NO: 940222 - DNA, 25 bp, Mus musculus
gccgtcaccatgccgctggctagag

SEQ ID NO: 940223 - DNA, 25 bp, Mus musculus
gccgtccaagagcccattgtgagct

SEQ ID NO: 940224 - DNA, 25 bp, Mus musculus
gccgtccaagaggccattgtgagct

SEQ ID NO: 940225 - DNA, 25 bp, Mus musculus
gccgtccatgaacaaatcccgtact

SEQ ID NO: 940226 - DNA, 25 bp, Mus musculus
gccgtccatgaacaagggtccagga

SEQ ID NO: 940227 - DNA, 25 bp, Mus musculus
gccgtccatgaacatatcccgtact

SEQ ID NO: 940228 - DNA, 25 bp, Mus musculus
gccgtccatgaacatgggtccagga

SEQ ID NO: 940229 - DNA, 25 bp, Mus musculus
gccgtcgtgtaggcgtctggaacgt

SEQ ID NO: 940230 - DNA, 25 bp, Mus musculus
gccgtcgtgttggcgtctggaacgt

SEQ ID NO: 940231 - DNA, 25 bp, Mus musculus
gccgtctgccaacgactttattgac

SEQ ID NO: 940232 - DNA, 25 bp, Mus musculus
gccgtctgccaaggactttattgac

SEQ ID NO: 940233 - DNA, 25 bp, Mus musculus
gccgtcttgtttaacattgacgagt

SEQ ID NO: 940234 - DNA, 25 bp, Mus musculus
gccgtcttgtttaagattgacgagt

SEQ ID NO: 940235 - DNA, 25 bp, Mus musculus
gccgtgaagactgagccggtggagc

SEQ ID NO: 940236 - DNA, 25 bp, Mus musculus
gccgtgaagagtgagccggtggagc

SEQ ID NO: 940237 - DNA, 25 bp, Mus musculus
gccgtgagagcgtttgtggatgaca

SEQ ID NO: 940238 - DNA, 25 bp, Mus musculus
gccgtgagagggtttgtggatgaca

SEQ ID NO: 940239 - DNA, 25 bp, Mus musculus
gccgtgcattaccgtattattatga

SEQ ID NO: 940240 - DNA, 25 bp, Mus musculus
gccgtgcattacggtattattatga

SEQ ID NO: 940241 - DNA, 25 bp, Mus musculus
gccgtgccaccgatgatgacatgca

SEQ ID NO: 940242 - DNA, 25 bp, Mus musculus
gccgtgccacggatgatgacatgca

SEQ ID NO: 940243 - DNA, 25 bp, Mus musculus
gccgtgccgcggcagaggaaaagca

SEQ ID NO: 940244 - DNA, 25 bp, Mus musculus
gccgtgccgcggctgtgccaggaga

SEQ ID NO: 940245 - DNA, 25 bp, Mus musculus
gccgtgccgcgggagaggaaaagca

SEQ ID NO: 940246 - DNA, 25 bp, Mus musculus
gccgtgccgcgggtgtgccaggaga

SEQ ID NO: 940247 - DNA, 25 bp, Mus musculus
gccgtgctaaatcttgctgctggga

SEQ ID NO: 940248 - DNA, 25 bp, Mus musculus
gccgtgctaattcttgctgctggga

SEQ ID NO: 940249 - DNA, 25 bp, Mus musculus
gccgtggaagagtgaagacacctcg

SEQ ID NO: 940250 - DNA, 25 bp, Mus musculus
gccgtggaagtgtgaagacacctcg

SEQ ID NO: 940251 - DNA, 25 bp, Mus musculus
gccgtggacgagctgtccacagaac

SEQ ID NO: 940252 - DNA, 25 bp, Mus musculus
gccgtggacgaggtgtccacagaac

SEQ ID NO: 940253 - DNA, 25 bp, Mus musculus
gccgtggacttagaccatcactctt

SEQ ID NO: 940254 - DNA, 25 bp, Mus musculus
gccgtggacttagagcatcactctt

SEQ ID NO: 940255 - DNA, 25 bp, Mus musculus
gccgtggaggagatggaggcggaag

SEQ ID NO: 940256 - DNA, 25 bp, Mus musculus
gccgtggaggagttggaggcggaag

SEQ ID NO: 940257 - DNA, 25 bp, Mus musculus
gccgtggcagaccggcttacggcgt

SEQ ID NO: 940258 - DNA, 25 bp, Mus musculus
gccgtggcagacgggcttacggcgt

SEQ ID NO: 940259 - DNA, 25 bp, Mus musculus
gccgtggccatacacgtcctgtcca

SEQ ID NO: 940260 - DNA, 25 bp, Mus musculus
gccgtggccatacaggtcctgtcca

SEQ ID NO: 940261 - DNA, 25 bp, Mus musculus
gccgtggcccagactatcatgaaca

SEQ ID NO: 940262 - DNA, 25 bp, Mus musculus
gccgtggcccagtctatcatgaaca

SEQ ID NO: 940263 - DNA, 25 bp, Mus musculus
gccgtggcccccattccagggaagc

SEQ ID NO: 940264 - DNA, 25 bp, Mus musculus
gccgtggcccgcattccagggaagc

SEQ ID NO: 940265 - DNA, 25 bp, Mus musculus
gccgtggctgcagacgtatctgttc

SEQ ID NO: 940266 - DNA, 25 bp, Mus musculus
gccgtggctgcagaggtatctgttc

SEQ ID NO: 940267 - DNA, 25 bp, Mus musculus
gccgtgggtcacaacaagccgtctc

SEQ ID NO: 940268 - DNA, 25 bp, Mus musculus
gccgtgggtcacaacgtcaaagcaa

SEQ ID NO: 940269 - DNA, 25 bp, Mus musculus
gccgtgggtcacaagaagccgtctc

SEQ ID NO: 940270 - DNA, 25 bp, Mus musculus
gccgtgggtcacaaggtcaaagcaa

SEQ ID NO: 940271 - DNA, 25 bp, Mus musculus
gccgtgtgcacgctgaaacctacag

SEQ ID NO: 940272 - DNA, 25 bp, Mus musculus
gccgtgtgcacggtgaaacctacag

SEQ ID NO: 940273 - DNA, 25 bp, Mus musculus
gccgtttccacgcaagatgctacca

SEQ ID NO: 940274 - DNA, 25 bp, Mus musculus
gccgtttccacggaagatgctacca

SEQ ID NO: 940275 - DNA, 25 bp, Mus musculus
gcctaaagcccgaccagtccaacgt

SEQ ID NO: 940276 - DNA, 25 bp, Mus musculus
gcctaaagccggaccagtccaacgt

SEQ ID NO: 940277 - DNA, 25 bp, Mus musculus
gcctaagcagcttctatttccagtg

SEQ ID NO: 940278 - DNA, 25 bp, Mus musculus
gcctaagcaggttctatttccagtg

SEQ ID NO: 940279 - DNA, 25 bp, Mus musculus
gcctaagccacactgacaacagcta

SEQ ID NO: 940280 - DNA, 25 bp, Mus musculus
gcctaagccacagtgacaacagcta

SEQ ID NO: 940281 - DNA, 25 bp, Mus musculus
gcctaagggaaacacgagaccatga

SEQ ID NO: 940282 - DNA, 25 bp, Mus musculus
gcctaagggaaacaggagaccatga

SEQ ID NO: 940283 - DNA, 25 bp, Mus musculus
gcctaatgacagaaattatgccacc

SEQ ID NO: 940284 - DNA, 25 bp, Mus musculus
gcctaatgacagtaattatgccacc

SEQ ID NO: 940285 - DNA, 25 bp, Mus musculus
gcctacaaagagccctttgccagtg

SEQ ID NO: 940286 - DNA, 25 bp, Mus musculus
gcctacaaagaggcctttgccagtg

SEQ ID NO: 940287 - DNA, 25 bp, Mus musculus
gcctacaactacctgggcagcccat

SEQ ID NO: 940288 - DNA, 25 bp, Mus musculus
gcctacaactacgtgggcagcccat

SEQ ID NO: 940289 - DNA, 25 bp, Mus musculus
gcctacaatctgaatgaagaaagac

SEQ ID NO: 940290 - DNA, 25 bp, Mus musculus
gcctacaatctgtatgaagaaagac

SEQ ID NO: 940291 - DNA, 25 bp, Mus musculus
gcctacactcatacgagaagcggct

SEQ ID NO: 940292 - DNA, 25 bp, Mus musculus
gcctacactcttacgagaagcggct

SEQ ID NO: 940293 - DNA, 25 bp, Mus musculus
gcctacaggtgatccagtcagcaat

SEQ ID NO: 940294 - DNA, 25 bp, Mus musculus
gcctacaggtgatcgagtcagcaat

SEQ ID NO: 940295 - DNA, 25 bp, Mus musculus
gcctacagtctgaatgaagaaagac

SEQ ID NO: 940296 - DNA, 25 bp, Mus musculus
gcctacagtctgtatgaagaaagac

SEQ ID NO: 940297 - DNA, 25 bp, Mus musculus
gcctacagtgacaacattgacagtt

SEQ ID NO: 940298 - DNA, 25 bp, Mus musculus
gcctacagtgacaagattgacagtt

SEQ ID NO: 940299 - DNA, 25 bp, Mus musculus
gcctacagtgcgcgcgatgaggctg

SEQ ID NO: 940300 - DNA, 25 bp, Mus musculus
gcctacagtgcgcgggatgaggctg

SEQ ID NO: 940301 - DNA, 25 bp, Mus musculus
gcctacatccagcgttgccccgttg

SEQ ID NO: 940302 - DNA, 25 bp, Mus musculus
gcctacatccagggttgccccgttg

SEQ ID NO: 940303 - DNA, 25 bp, Mus musculus
gcctacattaatcattccattggct

SEQ ID NO: 940304 - DNA, 25 bp, Mus musculus
gcctacattaatcctaccgtcttga

SEQ ID NO: 940305 - DNA, 25 bp, Mus musculus
gcctacattaatgattccattggct

SEQ ID NO: 940306 - DNA, 25 bp, Mus musculus
gcctacattaatgctaccgtcttga

SEQ ID NO: 940307 - DNA, 25 bp, Mus musculus
gcctacattgagatggagaactgta

SEQ ID NO: 940308 - DNA, 25 bp, Mus musculus
gcctacattgagttggagaactgta

SEQ ID NO: 940309 - DNA, 25 bp, Mus musculus
gcctacccagcaagaagctcactat

SEQ ID NO: 940310 - DNA, 25 bp, Mus musculus
gcctacccaggaagaagctcactat

SEQ ID NO: 940311 - DNA, 25 bp, Mus musculus
gcctacccgacacgaaggtctatat

SEQ ID NO: 940312 - DNA, 25 bp, Mus musculus
gcctacccgacaggaaggtctatat

SEQ ID NO: 940313 - DNA, 25 bp, Mus musculus
gcctacctagcgagtgcacccccac

SEQ ID NO: 940314 - DNA, 25 bp, Mus musculus
gcctacctagcgtgtgcacccccac

SEQ ID NO: 940315 - DNA, 25 bp, Mus musculus
gcctacctctcacgtgacgtgctag

SEQ ID NO: 940316 - DNA, 25 bp, Mus musculus
gcctacctctcaggtgacgtgctag

SEQ ID NO: 940317 - DNA, 25 bp, Mus musculus
gcctacctgccgcaaatctcccagc

SEQ ID NO: 940318 - DNA, 25 bp, Mus musculus
gcctacctgccggaaatctcccagc

SEQ ID NO: 940319 - DNA, 25 bp, Mus musculus
gcctacgactcacatgtccctggat

SEQ ID NO: 940320 - DNA, 25 bp, Mus musculus
gcctacgactcagatgtccctggat

SEQ ID NO: 940321 - DNA, 25 bp, Mus musculus
gcctacggcaaggaaacatgacagc

SEQ ID NO: 940322 - DNA, 25 bp, Mus musculus
gcctacggcatggaaacatgacagc

SEQ ID NO: 940323 - DNA, 25 bp, Mus musculus
gcctacggccaagacacggttccgg

SEQ ID NO: 940324 - DNA, 25 bp, Mus musculus
gcctacggccaagagacggttccgg

SEQ ID NO: 940325 - DNA, 25 bp, Mus musculus
gcctactcagcgctaacatcagggc

SEQ ID NO: 940326 - DNA, 25 bp, Mus musculus
gcctactcagggctaacatcagggc

SEQ ID NO: 940327 - DNA, 25 bp, Mus musculus
gcctactctgtgaacgcccgagacc

SEQ ID NO: 940328 - DNA, 25 bp, Mus musculus
gcctactctgtgaacggacaggaag

SEQ ID NO: 940329 - DNA, 25 bp, Mus musculus
gcctactctgtgaactctagggaca

SEQ ID NO: 940330 - DNA, 25 bp, Mus musculus
gcctactctgtgaaggcccgagacc

SEQ ID NO: 940331 - DNA, 25 bp, Mus musculus
gcctactctgtgaagggacaggaag

SEQ ID NO: 940332 - DNA, 25 bp, Mus musculus
gcctactctgtgaagtctagggaca

SEQ ID NO: 940333 - DNA, 25 bp, Mus musculus
gcctactgctgtcgatttccagcca

SEQ ID NO: 940334 - DNA, 25 bp, Mus musculus
gcctactgctgtggatttccagcca

SEQ ID NO: 940335 - DNA, 25 bp, Mus musculus
gcctactgtgaacacattgacgagt

SEQ ID NO: 940336 - DNA, 25 bp, Mus musculus
gcctactgtgaagacattgacgagt

SEQ ID NO: 940337 - DNA, 25 bp, Mus musculus
gcctagaaagacggacctgttccag

SEQ ID NO: 940338 - DNA, 25 bp, Mus musculus
gcctagaaagtcggacctgttccag

SEQ ID NO: 940339 - DNA, 25 bp, Mus musculus
gcctagaacacgcagcagaagaagc

SEQ ID NO: 940340 - DNA, 25 bp, Mus musculus
gcctagaacacgctctgcaaagaaa

SEQ ID NO: 940341 - DNA, 25 bp, Mus musculus
gcctagaacacggtctgcaaagaaa

SEQ ID NO: 940342 - DNA, 25 bp, Mus musculus
gcctagaacaggcagcagaagaagc

SEQ ID NO: 940343 - DNA, 25 bp, Mus musculus
gcctagcgccgacagatagtgctgg

SEQ ID NO: 940344 - DNA, 25 bp, Mus musculus
gcctagcgccgacagattggagaat

SEQ ID NO: 940345 - DNA, 25 bp, Mus musculus
gcctagcgccgagagatagtgctgg

SEQ ID NO: 940346 - DNA, 25 bp, Mus musculus
gcctagcgccgagagattggagaat

SEQ ID NO: 940347 - DNA, 25 bp, Mus musculus
gcctagcgggaacagcagtagcagt

SEQ ID NO: 940348 - DNA, 25 bp, Mus musculus
gcctagcgggaagagcagtagcagt

SEQ ID NO: 940349 - DNA, 25 bp, Mus musculus
gcctagctcaagtcttttattcaaa

SEQ ID NO: 940350 - DNA, 25 bp, Mus musculus
gcctagctcatgtcttttattcaaa

SEQ ID NO: 940351 - DNA, 25 bp, Mus musculus
gcctaggcagcaaatatgttatttc

SEQ ID NO: 940352 - DNA, 25 bp, Mus musculus
gcctaggcaggaaatatgttatttc

SEQ ID NO: 940353 - DNA, 25 bp, Mus musculus
gcctagtcatctgccaacacgactc

SEQ ID NO: 940354 - DNA, 25 bp, Mus musculus
gcctagtcatctgcgaacacgactc

SEQ ID NO: 940355 - DNA, 25 bp, Mus musculus
gcctagtcgaagagcccccctcctt

SEQ ID NO: 940356 - DNA, 25 bp, Mus musculus
gcctagtcgaagcccagagaagaag

SEQ ID NO: 940357 - DNA, 25 bp, Mus musculus
gcctagtcgaaggccagagaagaag

SEQ ID NO: 940358 - DNA, 25 bp, Mus musculus
gcctagtcgaagtgcccccctcctt

SEQ ID NO: 940359 - DNA, 25 bp, Mus musculus
gcctatatcaagaacgaatttgaca

SEQ ID NO: 940360 - DNA, 25 bp, Mus musculus
gcctatatcaagaaggaatttgaca

SEQ ID NO: 940361 - DNA, 25 bp, Mus musculus
gcctatatgaagccattatatgaga

SEQ ID NO: 940362 - DNA, 25 bp, Mus musculus
gcctatatgaaggcattatatgaga

SEQ ID NO: 940363 - DNA, 25 bp, Mus musculus
gcctatatggctcccgagcgcatcg

SEQ ID NO: 940364 - DNA, 25 bp, Mus musculus
gcctatatggctgccgagcgcatcg

SEQ ID NO: 940365 - DNA, 25 bp, Mus musculus
gcctatcagcggccttatccgctgg

SEQ ID NO: 940366 - DNA, 25 bp, Mus musculus
gcctatcagcggctcatagaagagc

SEQ ID NO: 940367 - DNA, 25 bp, Mus musculus
gcctatcagcgggcttatccgctgg

SEQ ID NO: 940368 - DNA, 25 bp, Mus musculus
gcctatcagcgggtcatagaagagc

SEQ ID NO: 940369 - DNA, 25 bp, Mus musculus
gcctatcagctgcacgtggccaaga

SEQ ID NO: 940370 - DNA, 25 bp, Mus musculus
gcctatcagctgcaggtggccaaga

SEQ ID NO: 940371 - DNA, 25 bp, Mus musculus
gcctatccacagatgctacggaaca

SEQ ID NO: 940372 - DNA, 25 bp, Mus musculus
gcctatccacagttgctacggaaca

SEQ ID NO: 940373 - DNA, 25 bp, Mus musculus
gcctatctaaagcacactcaccaac

SEQ ID NO: 940374 - DNA, 25 bp, Mus musculus
gcctatctaaaggacactcaccaac

SEQ ID NO: 940375 - DNA, 25 bp, Mus musculus
gcctatgaagattgaagagaataga

SEQ ID NO: 940376 - DNA, 25 bp, Mus musculus
gcctatgaagcaaccacatgaaatt

SEQ ID NO: 940377 - DNA, 25 bp, Mus musculus
gcctatgaaggaaccacatgaaatt

SEQ ID NO: 940378 - DNA, 25 bp, Mus musculus
gcctatgaaggacgttccgagttgg

SEQ ID NO: 940379 - DNA, 25 bp, Mus musculus
gcctatgaaggaggttccgagttgg

SEQ ID NO: 940380 - DNA, 25 bp, Mus musculus
gcctatgaagtttgaagagaataga

SEQ ID NO: 940381 - DNA, 25 bp, Mus musculus
gcctatgacttcaacgctgacatct

SEQ ID NO: 940382 - DNA, 25 bp, Mus musculus
gcctatgacttcaaggctgacatct

SEQ ID NO: 940383 - DNA, 25 bp, Mus musculus
gcctatgcaacccccagtccccagt

SEQ ID NO: 940384 - DNA, 25 bp, Mus musculus
gcctatgcaagccccagtccccagt

SEQ ID NO: 940385 - DNA, 25 bp, Mus musculus
gcctattacatgcatacatgggcgg

SEQ ID NO: 940386 - DNA, 25 bp, Mus musculus
gcctattacatgccaacaattctct

SEQ ID NO: 940387 - DNA, 25 bp, Mus musculus
gcctattacatggatacatgggcgg

SEQ ID NO: 940388 - DNA, 25 bp, Mus musculus
gcctattacatggcaacaattctct

SEQ ID NO: 940389 - DNA, 25 bp, Mus musculus
gcctattaccaaatcgaacaccgag

SEQ ID NO: 940390 - DNA, 25 bp, Mus musculus
gcctattaccaaatggaacaccgag

SEQ ID NO: 940391 - DNA, 25 bp, Mus musculus
gcctattcagcgacagaggcagagg

SEQ ID NO: 940392 - DNA, 25 bp, Mus musculus
gcctattcagggacagaggcagagg

SEQ ID NO: 940393 - DNA, 25 bp, Mus musculus
gcctattctgtgaacaaaatgatga

SEQ ID NO: 940394 - DNA, 25 bp, Mus musculus
gcctattctgtgaagaaaatgatga

SEQ ID NO: 940395 - DNA, 25 bp, Mus musculus
gcctattggaatcgtgccaacacgc

SEQ ID NO: 940396 - DNA, 25 bp, Mus musculus
gcctattggaatggtgccaacacgc

SEQ ID NO: 940397 - DNA, 25 bp, Mus musculus
gcctattgtgagcaactaatgacca

SEQ ID NO: 940398 - DNA, 25 bp, Mus musculus
gcctattgtgaggaactaatgacca

SEQ ID NO: 940399 - DNA, 25 bp, Mus musculus
gcctcaaacacaaccacttcagcac

SEQ ID NO: 940400 - DNA, 25 bp, Mus musculus
gcctcaaacacaagtgactctccta

SEQ ID NO: 940401 - DNA, 25 bp, Mus musculus
gcctcaaacacatccacttcagcac

SEQ ID NO: 940402 - DNA, 25 bp, Mus musculus
gcctcaaacacatgtgactctccta

SEQ ID NO: 940403 - DNA, 25 bp, Mus musculus
gcctcaagacatcgagtgctgcgga

SEQ ID NO: 940404 - DNA, 25 bp, Mus musculus
gcctcaagacatggagtgctgcgga

SEQ ID NO: 940405 - DNA, 25 bp, Mus musculus
gcctcaagaggacgtgtcctaactt

SEQ ID NO: 940406 - DNA, 25 bp, Mus musculus
gcctcaagaggaggtgtcctaactt

SEQ ID NO: 940407 - DNA, 25 bp, Mus musculus
gcctcaaggggacgctcgtgtgcgt

SEQ ID NO: 940408 - DNA, 25 bp, Mus musculus
gcctcaaggggaggctcgtgtgcgt

SEQ ID NO: 940409 - DNA, 25 bp, Mus musculus
gcctcaatggctacaagtgtgactg

SEQ ID NO: 940410 - DNA, 25 bp, Mus musculus
gcctcaatgggtacaagtgtgactg

SEQ ID NO: 940411 - DNA, 25 bp, Mus musculus
gcctcacatgcatccaatcaatgaa

SEQ ID NO: 940412 - DNA, 25 bp, Mus musculus
gcctcacatggatccaatcaatgaa

SEQ ID NO: 940413 - DNA, 25 bp, Mus musculus
gcctcacctacaacgacttcctgat

SEQ ID NO: 940414 - DNA, 25 bp, Mus musculus
gcctcacctacatcgacttcctgat

SEQ ID NO: 940415 - DNA, 25 bp, Mus musculus
gcctcactgaaacctgggaagtcat

SEQ ID NO: 940416 - DNA, 25 bp, Mus musculus
gcctcactgaaagctgggaagtcat

SEQ ID NO: 940417 - DNA, 25 bp, Mus musculus
gcctcagaagcatgcgggctcctgg

SEQ ID NO: 940418 - DNA, 25 bp, Mus musculus
gcctcagaaggatgcgggctcctgg

SEQ ID NO: 940419 - DNA, 25 bp, Mus musculus
gcctcagaaggtcgccttcccagga

SEQ ID NO: 940420 - DNA, 25 bp, Mus musculus
gcctcagaaggtggccttcccagga

SEQ ID NO: 940421 - DNA, 25 bp, Mus musculus
gcctcagcagcgcttccccatcatt

SEQ ID NO: 940422 - DNA, 25 bp, Mus musculus
gcctcagcagggcttccccatcatt

SEQ ID NO: 940423 - DNA, 25 bp, Mus musculus
gcctcagccaggaccagctgacagt

SEQ ID NO: 940424 - DNA, 25 bp, Mus musculus
gcctcagccaggacgagctgacagt

SEQ ID NO: 940425 - DNA, 25 bp, Mus musculus
gcctcagcctaccatttcttttgat

SEQ ID NO: 940426 - DNA, 25 bp, Mus musculus
gcctcagcctacgatttcttttgat

SEQ ID NO: 940427 - DNA, 25 bp, Mus musculus
gcctcagctgcacactgccccattg

SEQ ID NO: 940428 - DNA, 25 bp, Mus musculus
gcctcagctggacactgccccattg

SEQ ID NO: 940429 - DNA, 25 bp, Mus musculus
gcctcaggacagctataaggcagta

SEQ ID NO: 940430 - DNA, 25 bp, Mus musculus
gcctcaggacaggtataaggcagta

SEQ ID NO: 940431 - DNA, 25 bp, Mus musculus
gcctcaggtgagcacgatcggaacg

SEQ ID NO: 940432 - DNA, 25 bp, Mus musculus
gcctcaggtgagcaggatcggaacg

SEQ ID NO: 940433 - DNA, 25 bp, Mus musculus
gcctcagtatccatcattgccagta

SEQ ID NO: 940434 - DNA, 25 bp, Mus musculus
gcctcagtatccatgattgccagta

SEQ ID NO: 940435 - DNA, 25 bp, Mus musculus
gcctcagttgcatacacgtggatga

SEQ ID NO: 940436 - DNA, 25 bp, Mus musculus
gcctcagttgcatagacgtggatga

SEQ ID NO: 940437 - DNA, 25 bp, Mus musculus
gcctcagtttctcctcttggataac

SEQ ID NO: 940438 - DNA, 25 bp, Mus musculus
gcctcagtttctgctcttggataac

SEQ ID NO: 940439 - DNA, 25 bp, Mus musculus
gcctcatacattcgaacctccaact

SEQ ID NO: 940440 - DNA, 25 bp, Mus musculus
gcctcatacattggaacctccaact

SEQ ID NO: 940441 - DNA, 25 bp, Mus musculus
gcctcatagacacacaaacagctat

SEQ ID NO: 940442 - DNA, 25 bp, Mus musculus
gcctcatagacacagaaacagctat

SEQ ID NO: 940443 - DNA, 25 bp, Mus musculus
gcctcatcattgcgggaggaggtgg

SEQ ID NO: 940444 - DNA, 25 bp, Mus musculus
gcctcatcattgggggaggaggtgg

SEQ ID NO: 940445 - DNA, 25 bp, Mus musculus
gcctcatccagactctgttcatctc

SEQ ID NO: 940446 - DNA, 25 bp, Mus musculus
gcctcatccagactgtgttcatctc

SEQ ID NO: 940447 - DNA, 25 bp, Mus musculus
gcctcatcccagcgtttactcctgg

SEQ ID NO: 940448 - DNA, 25 bp, Mus musculus
gcctcatcccagggtttactcctgg

SEQ ID NO: 940449 - DNA, 25 bp, Mus musculus
gcctcatccttatacgagaaaccat

SEQ ID NO: 940450 - DNA, 25 bp, Mus musculus
gcctcatccttataggagaaaccat

SEQ ID NO: 940451 - DNA, 25 bp, Mus musculus
gcctcatcgtggattactcctgcgc

SEQ ID NO: 940452 - DNA, 25 bp, Mus musculus
gcctcatcgtggtttactcctgcgc

SEQ ID NO: 940453 - DNA, 25 bp, Mus musculus
gcctcatggaatcacctgctctgcc

SEQ ID NO: 940454 - DNA, 25 bp, Mus musculus
gcctcatggaatcacgtgccaacag

SEQ ID NO: 940455 - DNA, 25 bp, Mus musculus
gcctcatggaatcagctgctctgcc

SEQ ID NO: 940456 - DNA, 25 bp, Mus musculus
gcctcatggaatcaggtgccaacag

SEQ ID NO: 940457 - DNA, 25 bp, Mus musculus
gcctccaaaaacttcaccctcatca

SEQ ID NO: 940458 - DNA, 25 bp, Mus musculus
gcctccaaaaacttgaccctcatca

SEQ ID NO: 940459 - DNA, 25 bp, Mus musculus
gcctccaacatcatcgaagttaaaa

SEQ ID NO: 940460 - DNA, 25 bp, Mus musculus
gcctccaacatcatggaagttaaaa

SEQ ID NO: 940461 - DNA, 25 bp, Mus musculus
gcctccaaggcttcccgtgagaacg

SEQ ID NO: 940462 - DNA, 25 bp, Mus musculus
gcctccaagggttcccgtgagaacg

SEQ ID NO: 940463 - DNA, 25 bp, Mus musculus
gcctccaatttgcacgtagctatcc

SEQ ID NO: 940464 - DNA, 25 bp, Mus musculus
gcctccaatttgcaggtagctatcc

SEQ ID NO: 940465 - DNA, 25 bp, Mus musculus
gcctccaccaggcgcacgttagatg

SEQ ID NO: 940466 - DNA, 25 bp, Mus musculus
gcctccaccaggggcacgttagatg

SEQ ID NO: 940467 - DNA, 25 bp, Mus musculus
gcctccactttgctgaaagtcaaca

SEQ ID NO: 940468 - DNA, 25 bp, Mus musculus
gcctccactttggtgaaagtcaaca

SEQ ID NO: 940469 - DNA, 25 bp, Mus musculus
gcctccagccaccacgtgactctac

SEQ ID NO: 940470 - DNA, 25 bp, Mus musculus
gcctccagccaccaggtgactctac

SEQ ID NO: 940471 - DNA, 25 bp, Mus musculus
gcctccagcctgattaaagtgaaca

SEQ ID NO: 940472 - DNA, 25 bp, Mus musculus
gcctccagcctgtttaaagtgaaca

SEQ ID NO: 940473 - DNA, 25 bp, Mus musculus
gcctccagctcccagcatccaagga

SEQ ID NO: 940474 - DNA, 25 bp, Mus musculus
gcctccagctccgagcatccaagga

SEQ ID NO: 940475 - DNA, 25 bp, Mus musculus
gcctccatgtggatataccgctgtg

SEQ ID NO: 940476 - DNA, 25 bp, Mus musculus
gcctccatgtggcatttggcacatc

SEQ ID NO: 940477 - DNA, 25 bp, Mus musculus
gcctccatgtgggatttggcacatc

SEQ ID NO: 940478 - DNA, 25 bp, Mus musculus
gcctccatgtggttataccgctgtg

SEQ ID NO: 940479 - DNA, 25 bp, Mus musculus
gcctcccaggaacagagggagaagg

SEQ ID NO: 940480 - DNA, 25 bp, Mus musculus
gcctcccaggaagagagggagaagg

SEQ ID NO: 940481 - DNA, 25 bp, Mus musculus
gcctcccagtagatccaactgggac

SEQ ID NO: 940482 - DNA, 25 bp, Mus musculus
gcctcccagtagttccaactgggac

SEQ ID NO: 940483 - DNA, 25 bp, Mus musculus
gcctccccacagcgcgccatgactc

SEQ ID NO: 940484 - DNA, 25 bp, Mus musculus
gcctccccacagggcgccatgactc

SEQ ID NO: 940485 - DNA, 25 bp, Mus musculus
gcctcccctgcaaacattcctgcga

SEQ ID NO: 940486 - DNA, 25 bp, Mus musculus
gcctcccctgcaaagattcctgcga

SEQ ID NO: 940487 - DNA, 25 bp, Mus musculus
gcctccctccctcgcagggggagga

SEQ ID NO: 940488 - DNA, 25 bp, Mus musculus
gcctccctccctggcagggggagga

SEQ ID NO: 940489 - DNA, 25 bp, Mus musculus
gcctccctgaagcgctaccagtggt

SEQ ID NO: 940490 - DNA, 25 bp, Mus musculus
gcctccctgaagggctaccagtggt

SEQ ID NO: 940491 - DNA, 25 bp, Mus musculus
gcctccgctcagcaacgagttcaag

SEQ ID NO: 940492 - DNA, 25 bp, Mus musculus
gcctccgctcagctaaacagaatct

SEQ ID NO: 940493 - DNA, 25 bp, Mus musculus
gcctccgctcaggaacgagttcaag

SEQ ID NO: 940494 - DNA, 25 bp, Mus musculus
gcctccgctcaggtaaacagaatct

SEQ ID NO: 940495 - DNA, 25 bp, Mus musculus
gcctccggccatactttcagtgtct

SEQ ID NO: 940496 - DNA, 25 bp, Mus musculus
gcctccggccattctttcagtgtct

SEQ ID NO: 940497 - DNA, 25 bp, Mus musculus
gcctccggcctgcaggatccgattc

SEQ ID NO: 940498 - DNA, 25 bp, Mus musculus
gcctccggcctggaggatccgattc

SEQ ID NO: 940499 - DNA, 25 bp, Mus musculus
gcctccgggggacacttgcagctat

SEQ ID NO: 940500 - DNA, 25 bp, Mus musculus
gcctccgggggacagttgcagctat

SEQ ID NO: 940501 - DNA, 25 bp, Mus musculus
gcctccgtcccccacacacctgctc

SEQ ID NO: 940502 - DNA, 25 bp, Mus musculus
gcctccgtccccgacacacctgctc

SEQ ID NO: 940503 - DNA, 25 bp, Mus musculus
gcctccgtgctgcgggcagaatcct

SEQ ID NO: 940504 - DNA, 25 bp, Mus musculus
gcctccgtgctgggggcagaatcct

SEQ ID NO: 940505 - DNA, 25 bp, Mus musculus
gcctcctcagcgccgcaagcttctt

SEQ ID NO: 940506 - DNA, 25 bp, Mus musculus
gcctcctcagggccgcaagcttctt

SEQ ID NO: 940507 - DNA, 25 bp, Mus musculus
gcctcctgaatgcacagtcaccacc

SEQ ID NO: 940508 - DNA, 25 bp, Mus musculus
gcctcctgaatgcacttggaatgcc

SEQ ID NO: 940509 - DNA, 25 bp, Mus musculus
gcctcctgaatgcagttggaatgcc

SEQ ID NO: 940510 - DNA, 25 bp, Mus musculus
gcctcctgaatggacagtcaccacc

SEQ ID NO: 940511 - DNA, 25 bp, Mus musculus
gcctcctgcgctccacctccagcga

SEQ ID NO: 940512 - DNA, 25 bp, Mus musculus
gcctcctgcggtccacctccagcga

SEQ ID NO: 940513 - DNA, 25 bp, Mus musculus
gcctcctgctccagtgactttccag

SEQ ID NO: 940514 - DNA, 25 bp, Mus musculus
gcctcctgctcctgtgactttccag

SEQ ID NO: 940515 - DNA, 25 bp, Mus musculus
gcctcgaaagagagctggaggccca

SEQ ID NO: 940516 - DNA, 25 bp, Mus musculus
gcctcgaaagagtgctggaggccca

SEQ ID NO: 940517 - DNA, 25 bp, Mus musculus
gcctcgacttaactgacagtatcat

SEQ ID NO: 940518 - DNA, 25 bp, Mus musculus
gcctcgacttaagtgacagtatcat

SEQ ID NO: 940519 - DNA, 25 bp, Mus musculus
gcctcgagagcccactattcagtgt

SEQ ID NO: 940520 - DNA, 25 bp, Mus musculus
gcctcgagagccgactattcagtgt

SEQ ID NO: 940521 - DNA, 25 bp, Mus musculus
gcctcgcagatgagagccttgagcc

SEQ ID NO: 940522 - DNA, 25 bp, Mus musculus
gcctcgcagatgtgagccttgagcc

SEQ ID NO: 940523 - DNA, 25 bp, Mus musculus
gcctcgcggaggaaaatcaactaaa

SEQ ID NO: 940524 - DNA, 25 bp, Mus musculus
gcctcgcggaggtaaatcaactaaa

SEQ ID NO: 940525 - DNA, 25 bp, Mus musculus
gcctcgctggcattcccatttacca

SEQ ID NO: 940526 - DNA, 25 bp, Mus musculus
gcctcgctgggattcccatttacca

SEQ ID NO: 940527 - DNA, 25 bp, Mus musculus
gcctcgctggtgcctggaggggtag

SEQ ID NO: 940528 - DNA, 25 bp, Mus musculus
gcctcgctggtggctggaggggtag

SEQ ID NO: 940529 - DNA, 25 bp, Mus musculus
gcctcggaacagttctttatttatg

SEQ ID NO: 940530 - DNA, 25 bp, Mus musculus
gcctcggaacagttgtttatttatg

SEQ ID NO: 940531 - DNA, 25 bp, Mus musculus
gcctcggacgcaattctatcgccat

SEQ ID NO: 940532 - DNA, 25 bp, Mus musculus
gcctcggacggaattctatcgccat

SEQ ID NO: 940533 - DNA, 25 bp, Mus musculus
gcctcggagcagagcgatcagcagc

SEQ ID NO: 940534 - DNA, 25 bp, Mus musculus
gcctcggagcagtgcgatcagcagc

SEQ ID NO: 940535 - DNA, 25 bp, Mus musculus
gcctcggcatgttcctgtggacaaa

SEQ ID NO: 940536 - DNA, 25 bp, Mus musculus
gcctcggcatgttcgtgtggacaaa

SEQ ID NO: 940537 - DNA, 25 bp, Mus musculus
gcctcggcccagcacagccccccag

SEQ ID NO: 940538 - DNA, 25 bp, Mus musculus
gcctcggcccaggacagccccccag

SEQ ID NO: 940539 - DNA, 25 bp, Mus musculus
gcctcgtactcacaaacgaaagctg

SEQ ID NO: 940540 - DNA, 25 bp, Mus musculus
gcctcgtactcagaaacgaaagctg

SEQ ID NO: 940541 - DNA, 25 bp, Mus musculus
gcctcgtcatccacaccaagatgaa

SEQ ID NO: 940542 - DNA, 25 bp, Mus musculus
gcctcgtcatctgggagggcattga

SEQ ID NO: 940543 - DNA, 25 bp, Mus musculus
gcctcgtcatgcacaccaagatgaa

SEQ ID NO: 940544 - DNA, 25 bp, Mus musculus
gcctcgtcatgtgggagggcattga

SEQ ID NO: 940545 - DNA, 25 bp, Mus musculus
gcctcgttcactccaatgatggcac

SEQ ID NO: 940546 - DNA, 25 bp, Mus musculus
gcctcgttcactcctatgatggcac

SEQ ID NO: 940547 - DNA, 25 bp, Mus musculus
gcctctaacagacgtaccttaatgg

SEQ ID NO: 940548 - DNA, 25 bp, Mus musculus
gcctctaacagaggtaccttaatgg

SEQ ID NO: 940549 - DNA, 25 bp, Mus musculus
gcctctaagaacagtgttcaccgag

SEQ ID NO: 940550 - DNA, 25 bp, Mus musculus
gcctctaagaactgtgttcaccgag

SEQ ID NO: 940551 - DNA, 25 bp, Mus musculus
gcctctaagaagagtatacaccgag

SEQ ID NO: 940552 - DNA, 25 bp, Mus musculus
gcctctaagaagtgtatacaccgag

SEQ ID NO: 940553 - DNA, 25 bp, Mus musculus
gcctctaagtagctgactgtccagg

SEQ ID NO: 940554 - DNA, 25 bp, Mus musculus
gcctctaagtcccatcacctgtttg

SEQ ID NO: 940555 - DNA, 25 bp, Mus musculus
gcctctaagtgccatcacctgtttg

SEQ ID NO: 940556 - DNA, 25 bp, Mus musculus
gcctctaagttgctgactgtccagg

SEQ ID NO: 940557 - DNA, 25 bp, Mus musculus
gcctctacagaaatgatgggctccc

SEQ ID NO: 940558 - DNA, 25 bp, Mus musculus
gcctctacagaacgctgaggagcta

SEQ ID NO: 940559 - DNA, 25 bp, Mus musculus
gcctctacagaaggctgaggagcta

SEQ ID NO: 940560 - DNA, 25 bp, Mus musculus
gcctctacagatcgtgatggaactt

SEQ ID NO: 940561 - DNA, 25 bp, Mus musculus
gcctctacagatggtgatggaactt

SEQ ID NO: 940562 - DNA, 25 bp, Mus musculus
gcctctacagtaatgatgggctccc

SEQ ID NO: 940563 - DNA, 25 bp, Mus musculus
gcctctacctcgctgagaggccatc

SEQ ID NO: 940564 - DNA, 25 bp, Mus musculus
gcctctacctcggtgagaggccatc

SEQ ID NO: 940565 - DNA, 25 bp, Mus musculus
gcctctcaccgccgtgcccaggagt

SEQ ID NO: 940566 - DNA, 25 bp, Mus musculus
gcctctcaccgcggtgcccaggagt

SEQ ID NO: 940567 - DNA, 25 bp, Mus musculus
gcctctcagaagacaaaagagagca

SEQ ID NO: 940568 - DNA, 25 bp, Mus musculus
gcctctcagaagcatcactatttca

SEQ ID NO: 940569 - DNA, 25 bp, Mus musculus
gcctctcagaaggatcactatttca

SEQ ID NO: 940570 - DNA, 25 bp, Mus musculus
gcctctcagaagtcaaaagagagca

SEQ ID NO: 940571 - DNA, 25 bp, Mus musculus
gcctctcataaacacatcatggaaa

SEQ ID NO: 940572 - DNA, 25 bp, Mus musculus
gcctctcataaacagatcatggaaa

SEQ ID NO: 940573 - DNA, 25 bp, Mus musculus
gcctctcgaaggcaaacagcatgca

SEQ ID NO: 940574 - DNA, 25 bp, Mus musculus
gcctctcgaagggaaacagcatgca

SEQ ID NO: 940575 - DNA, 25 bp, Mus musculus
gcctctctgtgcgccgcaatacaga

SEQ ID NO: 940576 - DNA, 25 bp, Mus musculus
gcctctctgtgcgcggcaatacaga

SEQ ID NO: 940577 - DNA, 25 bp, Mus musculus
gcctctgacgagcacgactcggtgc

SEQ ID NO: 940578 - DNA, 25 bp, Mus musculus
gcctctgacgagcaggactcggtgc

SEQ ID NO: 940579 - DNA, 25 bp, Mus musculus
gcctctgacgggccatatctgctgt

SEQ ID NO: 940580 - DNA, 25 bp, Mus musculus
gcctctgacggggcatatctgctgt

SEQ ID NO: 940581 - DNA, 25 bp, Mus musculus
gcctctgaggaaagatataaaaact

SEQ ID NO: 940582 - DNA, 25 bp, Mus musculus
gcctctgaggcaactacatgaatga

SEQ ID NO: 940583 - DNA, 25 bp, Mus musculus
gcctctgagggaactacatgaatga

SEQ ID NO: 940584 - DNA, 25 bp, Mus musculus
gcctctgaggtaagatataaaaact

SEQ ID NO: 940585 - DNA, 25 bp, Mus musculus
gcctctgataaacgcaactgttgga

SEQ ID NO: 940586 - DNA, 25 bp, Mus musculus
gcctctgataaaggcaactgttgga

SEQ ID NO: 940587 - DNA, 25 bp, Mus musculus
gcctctgcccaccacgcttggaagg

SEQ ID NO: 940588 - DNA, 25 bp, Mus musculus
gcctctgcccaccaggcttggaagg

SEQ ID NO: 940589 - DNA, 25 bp, Mus musculus
gcctctgccttcctcgattcaccgg

SEQ ID NO: 940590 - DNA, 25 bp, Mus musculus
gcctctgccttcctggattcaccgg

SEQ ID NO: 940591 - DNA, 25 bp, Mus musculus
gcctctggcagaagcttctctctct

SEQ ID NO: 940592 - DNA, 25 bp, Mus musculus
gcctctggcagaaggttctctctct

SEQ ID NO: 940593 - DNA, 25 bp, Mus musculus
gcctctggcatcggcgatgaagacc

SEQ ID NO: 940594 - DNA, 25 bp, Mus musculus
gcctctggcatcggggatgaagacc

SEQ ID NO: 940595 - DNA, 25 bp, Mus musculus
gcctctgtacacctccggatagctt

SEQ ID NO: 940596 - DNA, 25 bp, Mus musculus
gcctctgtacacgtccggatagctt

SEQ ID NO: 940597 - DNA, 25 bp, Mus musculus
gcctctgtaccctggcccgggaccc

SEQ ID NO: 940598 - DNA, 25 bp, Mus musculus
gcctctgtacgctggcccgggaccc

SEQ ID NO: 940599 - DNA, 25 bp, Mus musculus
gcctctgtccagagtcacagcctct

SEQ ID NO: 940600 - DNA, 25 bp, Mus musculus
gcctctgtccagtgtcacagcctct

SEQ ID NO: 940601 - DNA, 25 bp, Mus musculus
gcctctgtggatgacgtcactactt

SEQ ID NO: 940602 - DNA, 25 bp, Mus musculus
gcctctgtggatgaggtcactactt

SEQ ID NO: 940603 - DNA, 25 bp, Mus musculus
gcctctgtgtctcactaatgctcat

SEQ ID NO: 940604 - DNA, 25 bp, Mus musculus
gcctctgtgtctcgtttaaaaagct

SEQ ID NO: 940605 - DNA, 25 bp, Mus musculus
gcctctgtgtctgactaatgctcat

SEQ ID NO: 940606 - DNA, 25 bp, Mus musculus
gcctctgtgtctggtttaaaaagct

SEQ ID NO: 940607 - DNA, 25 bp, Mus musculus
gcctctgttgatgacagccgtcttg

SEQ ID NO: 940608 - DNA, 25 bp, Mus musculus
gcctctgttgttgacagccgtcttg

SEQ ID NO: 940609 - DNA, 25 bp, Mus musculus
gcctcttaagctcattttcttggtg

SEQ ID NO: 940610 - DNA, 25 bp, Mus musculus
gcctcttaagggagatcgccacgac

SEQ ID NO: 940611 - DNA, 25 bp, Mus musculus
gcctcttaagggtgatcgccacgac

SEQ ID NO: 940612 - DNA, 25 bp, Mus musculus
gcctcttaaggtcattttcttggtg

SEQ ID NO: 940613 - DNA, 25 bp, Mus musculus
gcctcttcagcaagctgcactgcac

SEQ ID NO: 940614 - DNA, 25 bp, Mus musculus
gcctcttcaggaagctgcactgcac

SEQ ID NO: 940615 - DNA, 25 bp, Mus musculus
gcctcttcatggcggctctgccctt

SEQ ID NO: 940616 - DNA, 25 bp, Mus musculus
gcctcttcatgggggctctgccctt

SEQ ID NO: 940617 - DNA, 25 bp, Mus musculus
gcctcttgaagaagtttcctgtggc

SEQ ID NO: 940618 - DNA, 25 bp, Mus musculus
gcctcttgaagatgtttcctgtggc

SEQ ID NO: 940619 - DNA, 25 bp, Mus musculus
gcctcttgcctgctagcagccacat

SEQ ID NO: 940620 - DNA, 25 bp, Mus musculus
gcctcttgcctggtagcagccacat

SEQ ID NO: 940621 - DNA, 25 bp, Mus musculus
gcctcttgggagcccttgcaatctc

SEQ ID NO: 940622 - DNA, 25 bp, Mus musculus
gcctcttgggtgcccttgcaatctc

SEQ ID NO: 940623 - DNA, 25 bp, Mus musculus
gcctcttggtccttcaggatttcaa

SEQ ID NO: 940624 - DNA, 25 bp, Mus musculus
gcctcttggtccttcttccaccctc

SEQ ID NO: 940625 - DNA, 25 bp, Mus musculus
gcctcttggtccttgaggatttcaa

SEQ ID NO: 940626 - DNA, 25 bp, Mus musculus
gcctcttggtccttgttccaccctc

SEQ ID NO: 940627 - DNA, 25 bp, Mus musculus
gcctctttggaggctcatccaaaat

SEQ ID NO: 940628 - DNA, 25 bp, Mus musculus
gcctctttggctgctgggaacgctt

SEQ ID NO: 940629 - DNA, 25 bp, Mus musculus
gcctctttgggtgctgggaacgctt

SEQ ID NO: 940630 - DNA, 25 bp, Mus musculus
gcctctttggtggctcatccaaaat

SEQ ID NO: 940631 - DNA, 25 bp, Mus musculus
gcctgaaaaaaacattgccctagat

SEQ ID NO: 940632 - DNA, 25 bp, Mus musculus
gcctgaaaaatacattgccctagat

SEQ ID NO: 940633 - DNA, 25 bp, Mus musculus
gcctgaaagcagaccggcattctca

SEQ ID NO: 940634 - DNA, 25 bp, Mus musculus
gcctgaaagcagtccggcattctca

SEQ ID NO: 940635 - DNA, 25 bp, Mus musculus
gcctgaaagcatccagtttgtgctc

SEQ ID NO: 940636 - DNA, 25 bp, Mus musculus
gcctgaaagcatcctgtttgtgctc

SEQ ID NO: 940637 - DNA, 25 bp, Mus musculus
gcctgaacaattccagtatactctg

SEQ ID NO: 940638 - DNA, 25 bp, Mus musculus
gcctgaacaattcctgtatactctg

SEQ ID NO: 940639 - DNA, 25 bp, Mus musculus
gcctgaacagagagctgaaattatc

SEQ ID NO: 940640 - DNA, 25 bp, Mus musculus
gcctgaacagtgagctgaaattatc

SEQ ID NO: 940641 - DNA, 25 bp, Mus musculus
gcctgacactgactctcatggtacc

SEQ ID NO: 940642 - DNA, 25 bp, Mus musculus
gcctgacactgagtctcatggtacc

SEQ ID NO: 940643 - DNA, 25 bp, Mus musculus
gcctgacagcctgtcaatccctggc

SEQ ID NO: 940644 - DNA, 25 bp, Mus musculus
gcctgacagcctgtgaatccctggc

SEQ ID NO: 940645 - DNA, 25 bp, Mus musculus
gcctgacccagacgtctttgaccca

SEQ ID NO: 940646 - DNA, 25 bp, Mus musculus
gcctgacccagaggtctttgaccca

SEQ ID NO: 940647 - DNA, 25 bp, Mus musculus
gcctgacgcagaacctggctcggct

SEQ ID NO: 940648 - DNA, 25 bp, Mus musculus
gcctgacgcagaacgtggctcggct

SEQ ID NO: 940649 - DNA, 25 bp, Mus musculus
gcctgactcagaacaggtgagaact

SEQ ID NO: 940650 - DNA, 25 bp, Mus musculus
gcctgactcagatcaggtgagaact

SEQ ID NO: 940651 - DNA, 25 bp, Mus musculus
gcctgagcatcacacagcctgcgct

SEQ ID NO: 940652 - DNA, 25 bp, Mus musculus
gcctgagcatcacagagcctgcgct

SEQ ID NO: 940653 - DNA, 25 bp, Mus musculus
gcctgaggaaagagttaaaaattgc

SEQ ID NO: 940654 - DNA, 25 bp, Mus musculus
gcctgaggaaagtgttaaaaattgc

SEQ ID NO: 940655 - DNA, 25 bp, Mus musculus
gcctgaggaaatagctggtggcgtt

SEQ ID NO: 940656 - DNA, 25 bp, Mus musculus
gcctgaggaaattgctggtggcgtt

SEQ ID NO: 940657 - DNA, 25 bp, Mus musculus
gcctgaggagacgcagaggcagggc

SEQ ID NO: 940658 - DNA, 25 bp, Mus musculus
gcctgaggagcgcgaagaatgggcc

SEQ ID NO: 940659 - DNA, 25 bp, Mus musculus
gcctgaggagcgggaagaatgggcc

SEQ ID NO: 940660 - DNA, 25 bp, Mus musculus
gcctgaggagtccccgcgtggagcg

SEQ ID NO: 940661 - DNA, 25 bp, Mus musculus
gcctgaggagtccccgctcatcact

SEQ ID NO: 940662 - DNA, 25 bp, Mus musculus
gcctgaggagtcccggcgtggagcg

SEQ ID NO: 940663 - DNA, 25 bp, Mus musculus
gcctgaggagtcccggctcatcact

SEQ ID NO: 940664 - DNA, 25 bp, Mus musculus
gcctgaggagtcgcagaggcagggc

SEQ ID NO: 940665 - DNA, 25 bp, Mus musculus
gcctgattctgacgttctgctgtga

SEQ ID NO: 940666 - DNA, 25 bp, Mus musculus
gcctgattctgaggttctgctgtga

SEQ ID NO: 940667 - DNA, 25 bp, Mus musculus
gcctgcaacacgccaggcgtcctct

SEQ ID NO: 940668 - DNA, 25 bp, Mus musculus
gcctgcaacacgcctggcgtcctct

SEQ ID NO: 940669 - DNA, 25 bp, Mus musculus
gcctgcaactcgctcataaagcagc

SEQ ID NO: 940670 - DNA, 25 bp, Mus musculus
gcctgcaactcggtcataaagcagc

SEQ ID NO: 940671 - DNA, 25 bp, Mus musculus
gcctgcactttacacgtggctttgc

SEQ ID NO: 940672 - DNA, 25 bp, Mus musculus
gcctgcactttacaggtggctttgc

SEQ ID NO: 940673 - DNA, 25 bp, Mus musculus
gcctgcagaatccgccagcgcccga

SEQ ID NO: 940674 - DNA, 25 bp, Mus musculus
gcctgcagaatcggccagcgcccga

SEQ ID NO: 940675 - DNA, 25 bp, Mus musculus
gcctgcagacctctcacaaggatga

SEQ ID NO: 940676 - DNA, 25 bp, Mus musculus
gcctgcagacctctcagcgaacatc

SEQ ID NO: 940677 - DNA, 25 bp, Mus musculus
gcctgcagacctctgacaaggatga

SEQ ID NO: 940678 - DNA, 25 bp, Mus musculus
gcctgcagacctctgagcgaacatc

SEQ ID NO: 940679 - DNA, 25 bp, Mus musculus
gcctgcagaggcagatataatggaa

SEQ ID NO: 940680 - DNA, 25 bp, Mus musculus
gcctgcagaggctgatataatggaa

SEQ ID NO: 940681 - DNA, 25 bp, Mus musculus
gcctgcaggacaactcctggcagct

SEQ ID NO: 940682 - DNA, 25 bp, Mus musculus
gcctgcaggacatctcctggcagct

SEQ ID NO: 940683 - DNA, 25 bp, Mus musculus
gcctgcagttaattccccgggaaga

SEQ ID NO: 940684 - DNA, 25 bp, Mus musculus
gcctgcagttaattgcccgggaaga

SEQ ID NO: 940685 - DNA, 25 bp, Mus musculus
gcctgcatctacctttgcagatcaa

SEQ ID NO: 940686 - DNA, 25 bp, Mus musculus
gcctgcatctctctcttaaccttca

SEQ ID NO: 940687 - DNA, 25 bp, Mus musculus
gcctgcatctgccacacgctgggtc

SEQ ID NO: 940688 - DNA, 25 bp, Mus musculus
gcctgcatctgccagacgctgggtc

SEQ ID NO: 940689 - DNA, 25 bp, Mus musculus
gcctgcatctgtctcttaaccttca

SEQ ID NO: 940690 - DNA, 25 bp, Mus musculus
gcctgcatcttcctttgcagatcaa

SEQ ID NO: 940691 - DNA, 25 bp, Mus musculus
gcctgcattacacacgactcccctc

SEQ ID NO: 940692 - DNA, 25 bp, Mus musculus
gcctgcattacacaggactcccctc

SEQ ID NO: 940693 - DNA, 25 bp, Mus musculus
gcctgccaagaccctaccactgaag

SEQ ID NO: 940694 - DNA, 25 bp, Mus musculus
gcctgccaagctcctcttctgtgct

SEQ ID NO: 940695 - DNA, 25 bp, Mus musculus
gcctgccaaggtcctcttctgtgct

SEQ ID NO: 940696 - DNA, 25 bp, Mus musculus
gcctgccaagtccctaccactgaag

SEQ ID NO: 940697 - DNA, 25 bp, Mus musculus
gcctgccaccagcttacgtctggac

SEQ ID NO: 940698 - DNA, 25 bp, Mus musculus
gcctgccaccaggttacgtctggac

SEQ ID NO: 940699 - DNA, 25 bp, Mus musculus
gcctgccagaggccctgtttgctga

SEQ ID NO: 940700 - DNA, 25 bp, Mus musculus
gcctgccagagggcctgtttgctga

SEQ ID NO: 940701 - DNA, 25 bp, Mus musculus
gcctgccaggattttaccggaagac

SEQ ID NO: 940702 - DNA, 25 bp, Mus musculus
gcctgccaggtttttaccggaagac

SEQ ID NO: 940703 - DNA, 25 bp, Mus musculus
gcctgccatgagacgaaagtaggtg

SEQ ID NO: 940704 - DNA, 25 bp, Mus musculus
gcctgccatgagcaattcttctact

SEQ ID NO: 940705 - DNA, 25 bp, Mus musculus
gcctgccatgaggaattcttctact

SEQ ID NO: 940706 - DNA, 25 bp, Mus musculus
gcctgccatgagtcgaaagtaggtg

SEQ ID NO: 940707 - DNA, 25 bp, Mus musculus
gcctgcccaaataatggaggctggg

SEQ ID NO: 940708 - DNA, 25 bp, Mus musculus
gcctgcccaattaatggaggctggg

SEQ ID NO: 940709 - DNA, 25 bp, Mus musculus
gcctgcccagcctgcctatccctaa

SEQ ID NO: 940710 - DNA, 25 bp, Mus musculus
gcctgcccaggctgcctatccctaa

SEQ ID NO: 940711 - DNA, 25 bp, Mus musculus
gcctgccctcccccaaattgtggct

SEQ ID NO: 940712 - DNA, 25 bp, Mus musculus
gcctgccctcccgcaaattgtggct

SEQ ID NO: 940713 - DNA, 25 bp, Mus musculus
gcctgccgccaacgcttccaggagc

SEQ ID NO: 940714 - DNA, 25 bp, Mus musculus
gcctgccgccaaggcttccaggagc

SEQ ID NO: 940715 - DNA, 25 bp, Mus musculus
gcctgcctcacgctccgctatgttt

SEQ ID NO: 940716 - DNA, 25 bp, Mus musculus
gcctgcctcacggtccgctatgttt

SEQ ID NO: 940717 - DNA, 25 bp, Mus musculus
gcctgcctcataaacgaggtggaca

SEQ ID NO: 940718 - DNA, 25 bp, Mus musculus
gcctgcctcataaaggaggtggaca

SEQ ID NO: 940719 - DNA, 25 bp, Mus musculus
gcctgcctctggccttcctcggtga

SEQ ID NO: 940720 - DNA, 25 bp, Mus musculus
gcctgcctctgggcttcctcggtga

SEQ ID NO: 940721 - DNA, 25 bp, Mus musculus
gcctgcgaagatctgctcacaaaag

SEQ ID NO: 940722 - DNA, 25 bp, Mus musculus
gcctgcgaagttctgctcacaaaag

SEQ ID NO: 940723 - DNA, 25 bp, Mus musculus
gcctgcggatccaacctcagtttgc

SEQ ID NO: 940724 - DNA, 25 bp, Mus musculus
gcctgcggatccaagctcagtttgc

SEQ ID NO: 940725 - DNA, 25 bp, Mus musculus
gcctgcggttaactgagcaaaccaa

SEQ ID NO: 940726 - DNA, 25 bp, Mus musculus
gcctgcggttaagtgagcaaaccaa

SEQ ID NO: 940727 - DNA, 25 bp, Mus musculus
gcctgcgtctgtttcctttgagcgc

SEQ ID NO: 940728 - DNA, 25 bp, Mus musculus
gcctgcgtctgtttgctttgagcgc

SEQ ID NO: 940729 - DNA, 25 bp, Mus musculus
gcctgcgtgacgagtcacgatgtct

SEQ ID NO: 940730 - DNA, 25 bp, Mus musculus
gcctgcgtgacgtgtcacgatgtct

SEQ ID NO: 940731 - DNA, 25 bp, Mus musculus
gcctgctacaagctgcagcagaaag

SEQ ID NO: 940732 - DNA, 25 bp, Mus musculus
gcctgctacaaggtgcagcagaaag

SEQ ID NO: 940733 - DNA, 25 bp, Mus musculus
gcctgctacggccgcactcggaacc

SEQ ID NO: 940734 - DNA, 25 bp, Mus musculus
gcctgctacggccggactcggaacc

SEQ ID NO: 940735 - DNA, 25 bp, Mus musculus
gcctgctcatggaatttgacatctg

SEQ ID NO: 940736 - DNA, 25 bp, Mus musculus
gcctgctcatggtatttgacatctg

SEQ ID NO: 940737 - DNA, 25 bp, Mus musculus
gcctgctctcgactgggcagtatca

SEQ ID NO: 940738 - DNA, 25 bp, Mus musculus
gcctgctctcgagtgggcagtatca

SEQ ID NO: 940739 - DNA, 25 bp, Mus musculus
gcctgctgaacacagcctggatatg

SEQ ID NO: 940740 - DNA, 25 bp, Mus musculus
gcctgctgaacagagcctggatatg

SEQ ID NO: 940741 - DNA, 25 bp, Mus musculus
gcctgctgatgcaagctgagaggta

SEQ ID NO: 940742 - DNA, 25 bp, Mus musculus
gcctgctgatgcagcagctgagagg

SEQ ID NO: 940743 - DNA, 25 bp, Mus musculus
gcctgctgatgcagcctgagaggta

SEQ ID NO: 940744 - DNA, 25 bp, Mus musculus
gcctgctgatgcaggagctgagagg

SEQ ID NO: 940745 - DNA, 25 bp, Mus musculus
gcctgctgatgcaggctgagaggta

SEQ ID NO: 940746 - DNA, 25 bp, Mus musculus
gcctgctgatgctagctgagaggta

SEQ ID NO: 940747 - DNA, 25 bp, Mus musculus
gcctgctgcaaccacttctttgtct

SEQ ID NO: 940748 - DNA, 25 bp, Mus musculus
gcctgctgcaaccagttctttgtct

SEQ ID NO: 940749 - DNA, 25 bp, Mus musculus
gcctgctgcatactgttcttcgtgt

SEQ ID NO: 940750 - DNA, 25 bp, Mus musculus
gcctgctgcatagtgttcttcgtgt

SEQ ID NO: 940751 - DNA, 25 bp, Mus musculus
gcctgctgccgatcacagtctctgg

SEQ ID NO: 940752 - DNA, 25 bp, Mus musculus
gcctgctgccgatctcagtctctgg

SEQ ID NO: 940753 - DNA, 25 bp, Mus musculus
gcctgcttacagcaagccgagatac

SEQ ID NO: 940754 - DNA, 25 bp, Mus musculus
gcctgcttacaggaagccgagatac

SEQ ID NO: 940755 - DNA, 25 bp, Mus musculus
gcctgcttctcgcttcagcatgggc

SEQ ID NO: 940756 - DNA, 25 bp, Mus musculus
gcctgcttctcggttcagcatgggc

SEQ ID NO: 940757 - DNA, 25 bp, Mus musculus
gcctgcttctgctcccctccccatt

SEQ ID NO: 940758 - DNA, 25 bp, Mus musculus
gcctgcttctgctcgcctccccatt

SEQ ID NO: 940759 - DNA, 25 bp, Mus musculus
gcctgcttgccacgttttgctggac

SEQ ID NO: 940760 - DNA, 25 bp, Mus musculus
gcctgcttgccaggttttgctggac

SEQ ID NO: 940761 - DNA, 25 bp, Mus musculus
gcctggaaagcgccaaggagatcaa

SEQ ID NO: 940762 - DNA, 25 bp, Mus musculus
gcctggaaagggccaaggagatcaa

SEQ ID NO: 940763 - DNA, 25 bp, Mus musculus
gcctggaacaaacgatgtaatggag

SEQ ID NO: 940764 - DNA, 25 bp, Mus musculus
gcctggaacaaaggatgtaatggag

SEQ ID NO: 940765 - DNA, 25 bp, Mus musculus
gcctggaagcaagacgttgcagaat

SEQ ID NO: 940766 - DNA, 25 bp, Mus musculus
gcctggaagcaagaggttgcagaat

SEQ ID NO: 940767 - DNA, 25 bp, Mus musculus
gcctggaagccctccatgccaattc

SEQ ID NO: 940768 - DNA, 25 bp, Mus musculus
gcctggaagccctcgatgccaattc

SEQ ID NO: 940769 - DNA, 25 bp, Mus musculus
gcctggaaggtccccgagcatgcaa

SEQ ID NO: 940770 - DNA, 25 bp, Mus musculus
gcctggaaggtccccgattgaaaag

SEQ ID NO: 940771 - DNA, 25 bp, Mus musculus
gcctggaaggtcccggagcatgcaa

SEQ ID NO: 940772 - DNA, 25 bp, Mus musculus
gcctggaaggtcccggattgaaaag

SEQ ID NO: 940773 - DNA, 25 bp, Mus musculus
gcctggacagaaatatcttgagcct

SEQ ID NO: 940774 - DNA, 25 bp, Mus musculus
gcctggacagtaatatcttgagcct

SEQ ID NO: 940775 - DNA, 25 bp, Mus musculus
gcctggactgatcggaaggaggcca

SEQ ID NO: 940776 - DNA, 25 bp, Mus musculus
gcctggactgatgggaaggaggcca

SEQ ID NO: 940777 - DNA, 25 bp, Mus musculus
gcctggagagcaagttctccctgga

SEQ ID NO: 940778 - DNA, 25 bp, Mus musculus
gcctggagagctccatatcctgtat

SEQ ID NO: 940779 - DNA, 25 bp, Mus musculus
gcctggagaggaagttctccctgga

SEQ ID NO: 940780 - DNA, 25 bp, Mus musculus
gcctggagaggtccatatcctgtat

SEQ ID NO: 940781 - DNA, 25 bp, Mus musculus
gcctggagctgtcgaaggtccaaac

SEQ ID NO: 940782 - DNA, 25 bp, Mus musculus
gcctggagctgtggaaggtccaaac

SEQ ID NO: 940783 - DNA, 25 bp, Mus musculus
gcctggaggtccgaccacaccctga

SEQ ID NO: 940784 - DNA, 25 bp, Mus musculus
gcctggaggtccgacgcgagtgagc

SEQ ID NO: 940785 - DNA, 25 bp, Mus musculus
gcctggaggtccgagcacaccctga

SEQ ID NO: 940786 - DNA, 25 bp, Mus musculus
gcctggaggtccgaggcgagtgagc

SEQ ID NO: 940787 - DNA, 25 bp, Mus musculus
gcctggagtaaccggactgcaagga

SEQ ID NO: 940788 - DNA, 25 bp, Mus musculus
gcctggagtaacgggactgcaagga

SEQ ID NO: 940789 - DNA, 25 bp, Mus musculus
gcctggatatatcgcggtgataact

SEQ ID NO: 940790 - DNA, 25 bp, Mus musculus
gcctggatatatggcggtgataact

SEQ ID NO: 940791 - DNA, 25 bp, Mus musculus
gcctggatcctgatgatgaggacag

SEQ ID NO: 940792 - DNA, 25 bp, Mus musculus
gcctggatcctgattagatgatgag

SEQ ID NO: 940793 - DNA, 25 bp, Mus musculus
gcctggatcctgcgctttttgtaga

SEQ ID NO: 940794 - DNA, 25 bp, Mus musculus
gcctggatcctgggctttttgtaga

SEQ ID NO: 940795 - DNA, 25 bp, Mus musculus
gcctggatcctgttgatgaggacag

SEQ ID NO: 940796 - DNA, 25 bp, Mus musculus
gcctggatcctgtttagatgatgag

SEQ ID NO: 940797 - DNA, 25 bp, Mus musculus
gcctggcaagcgctactgacagtcg

SEQ ID NO: 940798 - DNA, 25 bp, Mus musculus
gcctggcaagggctactgacagtcg

SEQ ID NO: 940799 - DNA, 25 bp, Mus musculus
gcctggcacaagccctggtggaacc

SEQ ID NO: 940800 - DNA, 25 bp, Mus musculus
gcctggcacatgccctggtggaacc

SEQ ID NO: 940801 - DNA, 25 bp, Mus musculus
gcctggccaccacccccactctgcc

SEQ ID NO: 940802 - DNA, 25 bp, Mus musculus
gcctggccaccacgataaagcatga

SEQ ID NO: 940803 - DNA, 25 bp, Mus musculus
gcctggccaccagccccactctgcc

SEQ ID NO: 940804 - DNA, 25 bp, Mus musculus
gcctggccaccaggataaagcatga

SEQ ID NO: 940805 - DNA, 25 bp, Mus musculus
gcctggccagatcagcatatagggc

SEQ ID NO: 940806 - DNA, 25 bp, Mus musculus
gcctggccagtacacggtctgatcc

SEQ ID NO: 940807 - DNA, 25 bp, Mus musculus
gcctggccagtacagggtctgatcc

SEQ ID NO: 940808 - DNA, 25 bp, Mus musculus
gcctggccagttcagcatatagggc

SEQ ID NO: 940809 - DNA, 25 bp, Mus musculus
gcctggcccacgcacagctctctga

SEQ ID NO: 940810 - DNA, 25 bp, Mus musculus
gcctggcccacgcagagctctctga

SEQ ID NO: 940811 - DNA, 25 bp, Mus musculus
gcctggcccctacaaaaaatggttc

SEQ ID NO: 940812 - DNA, 25 bp, Mus musculus
gcctggcccctacataaaatggttc

SEQ ID NO: 940813 - DNA, 25 bp, Mus musculus
gcctggcccgcacttagcattcagg

SEQ ID NO: 940814 - DNA, 25 bp, Mus musculus
gcctggcccggacttagcattcagg

SEQ ID NO: 940815 - DNA, 25 bp, Mus musculus
gcctggcctacgcggccaaggaggg

SEQ ID NO: 940816 - DNA, 25 bp, Mus musculus
gcctggcctacggggccaaggaggg

SEQ ID NO: 940817 - DNA, 25 bp, Mus musculus
gcctggcctccgcataaagatagag

SEQ ID NO: 940818 - DNA, 25 bp, Mus musculus
gcctggcctccgcgtttgtattgag

SEQ ID NO: 940819 - DNA, 25 bp, Mus musculus
gcctggcctccggataaagatagag

SEQ ID NO: 940820 - DNA, 25 bp, Mus musculus
gcctggcctccgggtttgtattgag

SEQ ID NO: 940821 - DNA, 25 bp, Mus musculus
gcctggctgtggcttacacagcctt

SEQ ID NO: 940822 - DNA, 25 bp, Mus musculus
gcctggctgtgggttacacagcctt

SEQ ID NO: 940823 - DNA, 25 bp, Mus musculus
gcctgggaagagctccgtgagcgct

SEQ ID NO: 940824 - DNA, 25 bp, Mus musculus
gcctgggaagaggtccgtgagcgct

SEQ ID NO: 940825 - DNA, 25 bp, Mus musculus
gcctgggaagcgccccagtgctcgt

SEQ ID NO: 940826 - DNA, 25 bp, Mus musculus
gcctgggaagggccccagtgctcgt

SEQ ID NO: 940827 - DNA, 25 bp, Mus musculus
gcctgggatcggcaggcacacacca

SEQ ID NO: 940828 - DNA, 25 bp, Mus musculus
gcctgggatcgggaggcacacacca

SEQ ID NO: 940829 - DNA, 25 bp, Mus musculus
gcctgggccacgaaagaaaatgaac

SEQ ID NO: 940830 - DNA, 25 bp, Mus musculus
gcctgggccacgcagcagctgaagg

SEQ ID NO: 940831 - DNA, 25 bp, Mus musculus
gcctgggccacggagcagctgaagg

SEQ ID NO: 940832 - DNA, 25 bp, Mus musculus
gcctgggccacgtaagaaaatgaac

SEQ ID NO: 940833 - DNA, 25 bp, Mus musculus
gcctgggcctcaagtccccaagact

SEQ ID NO: 940834 - DNA, 25 bp, Mus musculus
gcctgggcctcatgtccccaagact

SEQ ID NO: 940835 - DNA, 25 bp, Mus musculus
gcctgggctgagatgaggtgccact

SEQ ID NO: 940836 - DNA, 25 bp, Mus musculus
gcctgggctgagttgaggtgccact

SEQ ID NO: 940837 - DNA, 25 bp, Mus musculus
gcctggggaaagcctactcaaaaag

SEQ ID NO: 940838 - DNA, 25 bp, Mus musculus
gcctggggaaaggctactcaaaaag

SEQ ID NO: 940839 - DNA, 25 bp, Mus musculus
gcctggggagaatgagcagtttgag

SEQ ID NO: 940840 - DNA, 25 bp, Mus musculus
gcctggggagtatgagcagtttgag

SEQ ID NO: 940841 - DNA, 25 bp, Mus musculus
gcctggggcttgcaacatgggtgac

SEQ ID NO: 940842 - DNA, 25 bp, Mus musculus
gcctggggcttggaacatgggtgac

SEQ ID NO: 940843 - DNA, 25 bp, Mus musculus
gcctggtactcacaccgcatgacta

SEQ ID NO: 940844 - DNA, 25 bp, Mus musculus
gcctggtactcacactgcggtccaa

SEQ ID NO: 940845 - DNA, 25 bp, Mus musculus
gcctggtactcacagcgcatgacta

SEQ ID NO: 940846 - DNA, 25 bp, Mus musculus
gcctggtactcacagtgcggtccaa

SEQ ID NO: 940847 - DNA, 25 bp, Mus musculus
gcctggtcagccagtccctcgagag

SEQ ID NO: 940848 - DNA, 25 bp, Mus musculus
gcctggtcagctgaaagcagccatt

SEQ ID NO: 940849 - DNA, 25 bp, Mus musculus
gcctggtcaggcagtccctcgagag

SEQ ID NO: 940850 - DNA, 25 bp, Mus musculus
gcctggtcaggtgaaagcagccatt

SEQ ID NO: 940851 - DNA, 25 bp, Mus musculus
gcctggtttccactcagtccttagc

SEQ ID NO: 940852 - DNA, 25 bp, Mus musculus
gcctggtttccactccacctcctgg

SEQ ID NO: 940853 - DNA, 25 bp, Mus musculus
gcctggtttccactgagtccttagc

SEQ ID NO: 940854 - DNA, 25 bp, Mus musculus
gcctggtttccactgcacctcctgg

SEQ ID NO: 940855 - DNA, 25 bp, Mus musculus
gcctgtatgctccacgcaaggagga

SEQ ID NO: 940856 - DNA, 25 bp, Mus musculus
gcctgtatgctccaggcaaggagga

SEQ ID NO: 940857 - DNA, 25 bp, Mus musculus
gcctgtcaaagacgagaaggctgga

SEQ ID NO: 940858 - DNA, 25 bp, Mus musculus
gcctgtcaaagaggagaaggctgga

SEQ ID NO: 940859 - DNA, 25 bp, Mus musculus
gcctgtcaacagcctcaagtacatg

SEQ ID NO: 940860 - DNA, 25 bp, Mus musculus
gcctgtcaacaggctcaagtacatg

SEQ ID NO: 940861 - DNA, 25 bp, Mus musculus
gcctgtcatgagcaactcagccacc

SEQ ID NO: 940862 - DNA, 25 bp, Mus musculus
gcctgtcatgaggaactcagccacc

SEQ ID NO: 940863 - DNA, 25 bp, Mus musculus
gcctgtcccatgcatttgaaataag

SEQ ID NO: 940864 - DNA, 25 bp, Mus musculus
gcctgtcccatggatttgaaataag

SEQ ID NO: 940865 - DNA, 25 bp, Mus musculus
gcctgtcctgcttgttcctcaaagt

SEQ ID NO: 940866 - DNA, 25 bp, Mus musculus
gcctgtcctggttgttcctcaaagt

SEQ ID NO: 940867 - DNA, 25 bp, Mus musculus
gcctgtcgtgatgtcaacgaatgct

SEQ ID NO: 940868 - DNA, 25 bp, Mus musculus
gcctgtcgtgttgtcaacgaatgct

SEQ ID NO: 940869 - DNA, 25 bp, Mus musculus
gcctgtctagctggggtgactagga

SEQ ID NO: 940870 - DNA, 25 bp, Mus musculus
gcctgtctaggtggggtgactagga

SEQ ID NO: 940871 - DNA, 25 bp, Mus musculus
gcctgtctgagccgctacagaacct

SEQ ID NO: 940872 - DNA, 25 bp, Mus musculus
gcctgtctgagcggctacagaacct

SEQ ID NO: 940873 - DNA, 25 bp, Mus musculus
gcctgtctgtgactcgattggccgc

SEQ ID NO: 940874 - DNA, 25 bp, Mus musculus
gcctgtctgtgactcgtttgtggac

SEQ ID NO: 940875 - DNA, 25 bp, Mus musculus
gcctgtctgtgactggattggccgc

SEQ ID NO: 940876 - DNA, 25 bp, Mus musculus
gcctgtctgtgactggtttgtggac

SEQ ID NO: 940877 - DNA, 25 bp, Mus musculus
gcctgtgaagacttggatgaatgtg

SEQ ID NO: 940878 - DNA, 25 bp, Mus musculus
gcctgtgaagtcttggatgaatgtg

SEQ ID NO: 940879 - DNA, 25 bp, Mus musculus
gcctgtgacccacagcagaggggca

SEQ ID NO: 940880 - DNA, 25 bp, Mus musculus
gcctgtgacccacaggggcaggctg

SEQ ID NO: 940881 - DNA, 25 bp, Mus musculus
gcctgtgacccagagcagaggggca

SEQ ID NO: 940882 - DNA, 25 bp, Mus musculus
gcctgtgacccagaggggcaggctg

SEQ ID NO: 940883 - DNA, 25 bp, Mus musculus
gcctgtgagaaccacctcagtgggc

SEQ ID NO: 940884 - DNA, 25 bp, Mus musculus
gcctgtgagaacgacctcagtgggc

SEQ ID NO: 940885 - DNA, 25 bp, Mus musculus
gcctgtgagatccacgtgcaggcag

SEQ ID NO: 940886 - DNA, 25 bp, Mus musculus
gcctgtgagatccaggtgcaggcag

SEQ ID NO: 940887 - DNA, 25 bp, Mus musculus
gcctgtgccaagctcgagtatgcct

SEQ ID NO: 940888 - DNA, 25 bp, Mus musculus
gcctgtgccaaggtcgagtatgcct

SEQ ID NO: 940889 - DNA, 25 bp, Mus musculus
gcctgtgcccagctggagattgacg

SEQ ID NO: 940890 - DNA, 25 bp, Mus musculus
gcctgtgcccaggtggagattgacg

SEQ ID NO: 940891 - DNA, 25 bp, Mus musculus
gcctgtgccgagagttcccagcatc

SEQ ID NO: 940892 - DNA, 25 bp, Mus musculus
gcctgtgccgagtgttcccagcatc

SEQ ID NO: 940893 - DNA, 25 bp, Mus musculus
gcctgtgccgcccccgtctccttgc

SEQ ID NO: 940894 - DNA, 25 bp, Mus musculus
gcctgtgccggccccgtctccttgc

SEQ ID NO: 940895 - DNA, 25 bp, Mus musculus
gcctgtgccttgcacggctgttctc

SEQ ID NO: 940896 - DNA, 25 bp, Mus musculus
gcctgtgccttggacggctgttctc

SEQ ID NO: 940897 - DNA, 25 bp, Mus musculus
gcctgtgctaatccatactttttgg

SEQ ID NO: 940898 - DNA, 25 bp, Mus musculus
gcctgtgctattccatactttttgg

SEQ ID NO: 940899 - DNA, 25 bp, Mus musculus
gcctgtgctggacgcttttgggaat

SEQ ID NO: 940900 - DNA, 25 bp, Mus musculus
gcctgtgctggaggcttttgggaat

SEQ ID NO: 940901 - DNA, 25 bp, Mus musculus
gcctgtggattccacatgagaagac

SEQ ID NO: 940902 - DNA, 25 bp, Mus musculus
gcctgtggattccagatgagaagac

SEQ ID NO: 940903 - DNA, 25 bp, Mus musculus
gcctgtggtttcctcgctgaggaat

SEQ ID NO: 940904 - DNA, 25 bp, Mus musculus
gcctgtggtttcctggctgaggaat

SEQ ID NO: 940905 - DNA, 25 bp, Mus musculus
gcctgtgtatcacgagctgagacag

SEQ ID NO: 940906 - DNA, 25 bp, Mus musculus
gcctgtgtatcaggagctgagacag

SEQ ID NO: 940907 - DNA, 25 bp, Mus musculus
gcctgtgtggatgtgaacgagtgtg

SEQ ID NO: 940908 - DNA, 25 bp, Mus musculus
gcctgtgtggttgtgaacgagtgtg

SEQ ID NO: 940909 - DNA, 25 bp, Mus musculus
gcctgttcagcccaaatttgaattt

SEQ ID NO: 940910 - DNA, 25 bp, Mus musculus
gcctgttcaggccaaatttgaattt

SEQ ID NO: 940911 - DNA, 25 bp, Mus musculus
gcctgttctgctttcagtgtctgtg

SEQ ID NO: 940912 - DNA, 25 bp, Mus musculus
gcctgttctggtttcagtgtctgtg

SEQ ID NO: 940913 - DNA, 25 bp, Mus musculus
gccttaaatgtagaccttgtggtgt

SEQ ID NO: 940914 - DNA, 25 bp, Mus musculus
gccttaaatgtagagcttgtggtgt

SEQ ID NO: 940915 - DNA, 25 bp, Mus musculus
gccttaagtgcttgcttcccagagc

SEQ ID NO: 940916 - DNA, 25 bp, Mus musculus
gccttaagtggttgcttcccagagc

SEQ ID NO: 940917 - DNA, 25 bp, Mus musculus
gccttacagttagactactcgtacc

SEQ ID NO: 940918 - DNA, 25 bp, Mus musculus
gccttacagttagagtactcgtacc

SEQ ID NO: 940919 - DNA, 25 bp, Mus musculus
gccttacctccacaacccgctcagt

SEQ ID NO: 940920 - DNA, 25 bp, Mus musculus
gccttacctccagaacccgctcagt

SEQ ID NO: 940921 - DNA, 25 bp, Mus musculus
gccttactagctcatgcacagattg

SEQ ID NO: 940922 - DNA, 25 bp, Mus musculus
gccttactaggtcatgcacagattg

SEQ ID NO: 940923 - DNA, 25 bp, Mus musculus
gccttactggcccggggtgctgacc

SEQ ID NO: 940924 - DNA, 25 bp, Mus musculus
gccttactgggccggggtgctgacc

SEQ ID NO: 940925 - DNA, 25 bp, Mus musculus
gccttacttgctgacattggtggtc

SEQ ID NO: 940926 - DNA, 25 bp, Mus musculus
gccttacttggtgacattggtggtc

SEQ ID NO: 940927 - DNA, 25 bp, Mus musculus
gccttatacccgcagagagaagcgc

SEQ ID NO: 940928 - DNA, 25 bp, Mus musculus
gccttatacccggagagagaagcgc

SEQ ID NO: 940929 - DNA, 25 bp, Mus musculus
gccttatactggaacaagaaacagt

SEQ ID NO: 940930 - DNA, 25 bp, Mus musculus
gccttatactggaagaagaaacagt

SEQ ID NO: 940931 - DNA, 25 bp, Mus musculus
gccttatgcccacctccaggctatg

SEQ ID NO: 940932 - DNA, 25 bp, Mus musculus
gccttatgcccagctccaggctatg

SEQ ID NO: 940933 - DNA, 25 bp, Mus musculus
gccttatgccctggttccacggcaa

SEQ ID NO: 940934 - DNA, 25 bp, Mus musculus
gccttatgccgtggttccacggcaa

SEQ ID NO: 940935 - DNA, 25 bp, Mus musculus
gccttatgcctttgagcggggagac

SEQ ID NO: 940936 - DNA, 25 bp, Mus musculus
gccttatgcctttgtgcggggagac

SEQ ID NO: 940937 - DNA, 25 bp, Mus musculus
gccttatgggcagtgaacttgctgg

SEQ ID NO: 940938 - DNA, 25 bp, Mus musculus
gccttatggggagtgaacttgctgg

SEQ ID NO: 940939 - DNA, 25 bp, Mus musculus
gccttattcaagccctggtgtgtgc

SEQ ID NO: 940940 - DNA, 25 bp, Mus musculus
gccttattcaagcggtgtggaatat

SEQ ID NO: 940941 - DNA, 25 bp, Mus musculus
gccttattcaaggcctggtgtgtgc

SEQ ID NO: 940942 - DNA, 25 bp, Mus musculus
gccttattcaaggggtgtggaatat

SEQ ID NO: 940943 - DNA, 25 bp, Mus musculus
gccttcaaagaatgtctgtaaggca

SEQ ID NO: 940944 - DNA, 25 bp, Mus musculus
gccttcaaagtatgtctgtaaggca

SEQ ID NO: 940945 - DNA, 25 bp, Mus musculus
gccttcaaggagaagtacatggagt

SEQ ID NO: 940946 - DNA, 25 bp, Mus musculus
gccttcaaggcgccccccacaggct

SEQ ID NO: 940947 - DNA, 25 bp, Mus musculus
gccttcaaggggccccccacaggct

SEQ ID NO: 940948 - DNA, 25 bp, Mus musculus
gccttcaaggtgaagtacatggagt

SEQ ID NO: 940949 - DNA, 25 bp, Mus musculus
gccttcagagcccttctacatgatc

SEQ ID NO: 940950 - DNA, 25 bp, Mus musculus
gccttcagaggccttctacatgatc

SEQ ID NO: 940951 - DNA, 25 bp, Mus musculus
gccttcagcaagatgaggatgtgtt

SEQ ID NO: 940952 - DNA, 25 bp, Mus musculus
gccttcagcaagttgaggatgtgtt

SEQ ID NO: 940953 - DNA, 25 bp, Mus musculus
gccttcagtctgctcgcccggttgc

SEQ ID NO: 940954 - DNA, 25 bp, Mus musculus
gccttcagtctgctggcccggttgc

SEQ ID NO: 940955 - DNA, 25 bp, Mus musculus
gccttcatagctggtggtgaagttg

SEQ ID NO: 940956 - DNA, 25 bp, Mus musculus
gccttcataggtggtggtgaagttg

SEQ ID NO: 940957 - DNA, 25 bp, Mus musculus
gccttcatcattttctgcaatgctg

SEQ ID NO: 940958 - DNA, 25 bp, Mus musculus
gccttcatcattttgtgcaatgctg

SEQ ID NO: 940959 - DNA, 25 bp, Mus musculus
gccttcatgtgccacgctggcgact

SEQ ID NO: 940960 - DNA, 25 bp, Mus musculus
gccttcatgtgccaggctggcgact

SEQ ID NO: 940961 - DNA, 25 bp, Mus musculus
gccttccaaagacgcctgctgttcc

SEQ ID NO: 940962 - DNA, 25 bp, Mus musculus
gccttccaaagaggcctgctgttcc

SEQ ID NO: 940963 - DNA, 25 bp, Mus musculus
gccttccagatacattgacatcagc

SEQ ID NO: 940964 - DNA, 25 bp, Mus musculus
gccttccagatacgtcttccaagtt

SEQ ID NO: 940965 - DNA, 25 bp, Mus musculus
gccttccagatagattgacatcagc

SEQ ID NO: 940966 - DNA, 25 bp, Mus musculus
gccttccagataggtcttccaagtt

SEQ ID NO: 940967 - DNA, 25 bp, Mus musculus
gccttccagtcacaggacatcctgg

SEQ ID NO: 940968 - DNA, 25 bp, Mus musculus
gccttccagtcagaggacatcctgg

SEQ ID NO: 940969 - DNA, 25 bp, Mus musculus
gccttccgagatgagacggcagtga

SEQ ID NO: 940970 - DNA, 25 bp, Mus musculus
gccttccgagcgcagtactgctatg

SEQ ID NO: 940971 - DNA, 25 bp, Mus musculus
gccttccgagggcagtactgctatg

SEQ ID NO: 940972 - DNA, 25 bp, Mus musculus
gccttccgagttgagacggcagtga

SEQ ID NO: 940973 - DNA, 25 bp, Mus musculus
gccttcctattgcccaacacatcta

SEQ ID NO: 940974 - DNA, 25 bp, Mus musculus
gccttcctattggccaacacatcta

SEQ ID NO: 940975 - DNA, 25 bp, Mus musculus
gccttcctggagcatgtggacgatg

SEQ ID NO: 940976 - DNA, 25 bp, Mus musculus
gccttcctggaggatgtggacgatg

SEQ ID NO: 940977 - DNA, 25 bp, Mus musculus
gccttcctgtcactgctctggatgt

SEQ ID NO: 940978 - DNA, 25 bp, Mus musculus
gccttcctgtcagtgctctggatgt

SEQ ID NO: 940979 - DNA, 25 bp, Mus musculus
gccttcgagcacatccccttaggcc

SEQ ID NO: 940980 - DNA, 25 bp, Mus musculus
gccttcgagcacatcggagtgttgt

SEQ ID NO: 940981 - DNA, 25 bp, Mus musculus
gccttcgagcacatgcccttaggcc

SEQ ID NO: 940982 - DNA, 25 bp, Mus musculus
gccttcgagcacatgggagtgttgt

SEQ ID NO: 940983 - DNA, 25 bp, Mus musculus
gccttcgatacccacatccatgctg

SEQ ID NO: 940984 - DNA, 25 bp, Mus musculus
gccttcgataccgacatccatgctg

SEQ ID NO: 940985 - DNA, 25 bp, Mus musculus
gccttcggtgacatcaccaatgagg

SEQ ID NO: 940986 - DNA, 25 bp, Mus musculus
gccttcggtgacatgaccaatgagg

SEQ ID NO: 940987 - DNA, 25 bp, Mus musculus
gccttcgtcaggaacgcctctctgc

SEQ ID NO: 940988 - DNA, 25 bp, Mus musculus
gccttcgtcaggaaggcctctctgc

SEQ ID NO: 940989 - DNA, 25 bp, Mus musculus
gccttctaagctacctgaaccagct

SEQ ID NO: 940990 - DNA, 25 bp, Mus musculus
gccttctaaggtacctgaaccagct

SEQ ID NO: 940991 - DNA, 25 bp, Mus musculus
gccttctatcacaactattttaatt

SEQ ID NO: 940992 - DNA, 25 bp, Mus musculus
gccttctatcacaagtattttaatt

SEQ ID NO: 940993 - DNA, 25 bp, Mus musculus
gccttctatgtcatcgtggggtttt

SEQ ID NO: 940994 - DNA, 25 bp, Mus musculus
gccttctatgtcatggtggggtttt

SEQ ID NO: 940995 - DNA, 25 bp, Mus musculus
gccttctattcccacatctgtgggg

SEQ ID NO: 940996 - DNA, 25 bp, Mus musculus
gccttctattcccagatctgtgggg

SEQ ID NO: 940997 - DNA, 25 bp, Mus musculus
gccttctcagctgtcatgatgctac

SEQ ID NO: 940998 - DNA, 25 bp, Mus musculus
gccttctcaggtgtcatgatgctac

SEQ ID NO: 940999 - DNA, 25 bp, Mus musculus
gccttctctccgtgcaacctgacga

SEQ ID NO: 941000 - DNA, 25 bp, Mus musculus
gccttctctccgtggaacctgacga

SEQ ID NO: 941001 - DNA, 25 bp, Mus musculus
gccttctggcagcgtccctgcatgt

SEQ ID NO: 941002 - DNA, 25 bp, Mus musculus
gccttctggcagggtccctgcatgt

SEQ ID NO: 941003 - DNA, 25 bp, Mus musculus
gccttcttactgagtcctactgaaa

SEQ ID NO: 941004 - DNA, 25 bp, Mus musculus
gccttcttactgtgtcctactgaaa

SEQ ID NO: 941005 - DNA, 25 bp, Mus musculus
gccttcttcatgcatgaggatgaag

SEQ ID NO: 941006 - DNA, 25 bp, Mus musculus
gccttcttcatggatgaggatgaag

SEQ ID NO: 941007 - DNA, 25 bp, Mus musculus
gccttcttgcatcaatggagaaaag

SEQ ID NO: 941008 - DNA, 25 bp, Mus musculus
gccttcttgcatccagaatggagaa

SEQ ID NO: 941009 - DNA, 25 bp, Mus musculus
gccttcttgcatgaatggagaaaag

SEQ ID NO: 941010 - DNA, 25 bp, Mus musculus
gccttcttgcatgcagaatggagaa

SEQ ID NO: 941011 - DNA, 25 bp, Mus musculus
gccttgaaagcacccgctaacgtcc

SEQ ID NO: 941012 - DNA, 25 bp, Mus musculus
gccttgaaagcagccgctaacgtcc

SEQ ID NO: 941013 - DNA, 25 bp, Mus musculus
gccttgaaagcttttagcctagatt

SEQ ID NO: 941014 - DNA, 25 bp, Mus musculus
gccttgaaaggttttagcctagatt

SEQ ID NO: 941015 - DNA, 25 bp, Mus musculus
gccttgacatgtcgggagttggctg

SEQ ID NO: 941016 - DNA, 25 bp, Mus musculus
gccttgacatgtggggagttggctg

SEQ ID NO: 941017 - DNA, 25 bp, Mus musculus
gccttgacttctcctaagcggtaca

SEQ ID NO: 941018 - DNA, 25 bp, Mus musculus
gccttgacttctgctaagcggtaca

SEQ ID NO: 941019 - DNA, 25 bp, Mus musculus
gccttgagagagaacaaattttcca

SEQ ID NO: 941020 - DNA, 25 bp, Mus musculus
gccttgagagagaagaaattttcca

SEQ ID NO: 941021 - DNA, 25 bp, Mus musculus
gccttgagtgcatggccatgacgat

SEQ ID NO: 941022 - DNA, 25 bp, Mus musculus
gccttgagtggatggccatgacgat

SEQ ID NO: 941023 - DNA, 25 bp, Mus musculus
gccttgatggagcagagttctcccg

SEQ ID NO: 941024 - DNA, 25 bp, Mus musculus
gccttgatggaggagagttctcccg

SEQ ID NO: 941025 - DNA, 25 bp, Mus musculus
gccttgattcagcaccaggtagacc

SEQ ID NO: 941026 - DNA, 25 bp, Mus musculus
gccttgattcaggaccaggtagacc

SEQ ID NO: 941027 - DNA, 25 bp, Mus musculus
gccttgcaagcaaggtgcagagctt

SEQ ID NO: 941028 - DNA, 25 bp, Mus musculus
gccttgcaagcggagagttagattt

SEQ ID NO: 941029 - DNA, 25 bp, Mus musculus
gccttgcaagctatgtctgagctca

SEQ ID NO: 941030 - DNA, 25 bp, Mus musculus
gccttgcaaggaaggtgcagagctt

SEQ ID NO: 941031 - DNA, 25 bp, Mus musculus
gccttgcaaggggagagttagattt

SEQ ID NO: 941032 - DNA, 25 bp, Mus musculus
gccttgcaaggtatgtctgagctca

SEQ ID NO: 941033 - DNA, 25 bp, Mus musculus
gccttgcagactatgccgacgatgg

SEQ ID NO: 941034 - DNA, 25 bp, Mus musculus
gccttgcagagtatgccgacgatgg

SEQ ID NO: 941035 - DNA, 25 bp, Mus musculus
gccttgccagatccaccttgaatga

SEQ ID NO: 941036 - DNA, 25 bp, Mus musculus
gccttgccagttccaccttgaatga

SEQ ID NO: 941037 - DNA, 25 bp, Mus musculus
gccttgcgatggcgctacagagact

SEQ ID NO: 941038 - DNA, 25 bp, Mus musculus
gccttgcgatggcggtacagagact

SEQ ID NO: 941039 - DNA, 25 bp, Mus musculus
gccttgctatttagtatcctgttta

SEQ ID NO: 941040 - DNA, 25 bp, Mus musculus
gccttgctattttgtatcctgttta

SEQ ID NO: 941041 - DNA, 25 bp, Mus musculus
gccttgctcaaacgaaccaacgcat

SEQ ID NO: 941042 - DNA, 25 bp, Mus musculus
gccttgctcaaaggaaccaacgcat

SEQ ID NO: 941043 - DNA, 25 bp, Mus musculus
gccttgctgccacgtatgaatcaag

SEQ ID NO: 941044 - DNA, 25 bp, Mus musculus
gccttgctgccaggtatgaatcaag

SEQ ID NO: 941045 - DNA, 25 bp, Mus musculus
gccttgcttcagccgtctgtggagg

SEQ ID NO: 941046 - DNA, 25 bp, Mus musculus
gccttgcttcaggcgtctgtggagg

SEQ ID NO: 941047 - DNA, 25 bp, Mus musculus
gccttggactgccaccaagtctcag

SEQ ID NO: 941048 - DNA, 25 bp, Mus musculus
gccttggactgccagcaagtctcag

SEQ ID NO: 941049 - DNA, 25 bp, Mus musculus
gccttggaggaggctcagctgcgtc

SEQ ID NO: 941050 - DNA, 25 bp, Mus musculus
gccttggaggtggctcagctgcgtc

SEQ ID NO: 941051 - DNA, 25 bp, Mus musculus
gccttggcaacacaccccaatatcc

SEQ ID NO: 941052 - DNA, 25 bp, Mus musculus
gccttggcaacagaccccaatatcc

SEQ ID NO: 941053 - DNA, 25 bp, Mus musculus
gccttggccaagcccaggttatcaa

SEQ ID NO: 941054 - DNA, 25 bp, Mus musculus
gccttggccaaggccaggttatcaa

SEQ ID NO: 941055 - DNA, 25 bp, Mus musculus
gccttggctttggacctcctgatgg

SEQ ID NO: 941056 - DNA, 25 bp, Mus musculus
gccttggctttggacgtcggtgagc

SEQ ID NO: 941057 - DNA, 25 bp, Mus musculus
gccttggctttggagctcctgatgg

SEQ ID NO: 941058 - DNA, 25 bp, Mus musculus
gccttggctttggaggtcggtgagc

SEQ ID NO: 941059 - DNA, 25 bp, Mus musculus
gccttggggaggcacactgtggcct

SEQ ID NO: 941060 - DNA, 25 bp, Mus musculus
gccttggggaggcagactgtggcct

SEQ ID NO: 941061 - DNA, 25 bp, Mus musculus
gccttgggtcagagctttatcttca

SEQ ID NO: 941062 - DNA, 25 bp, Mus musculus
gccttgggtcagtgctttatcttca

SEQ ID NO: 941063 - DNA, 25 bp, Mus musculus
gccttgtaaaaacgtatatcatgta

SEQ ID NO: 941064 - DNA, 25 bp, Mus musculus
gccttgtaaaaaggtatatcatgta

SEQ ID NO: 941065 - DNA, 25 bp, Mus musculus
gccttgtgcccctacagatgtcatg

SEQ ID NO: 941066 - DNA, 25 bp, Mus musculus
gccttgtgcccctagagatgtcatg

SEQ ID NO: 941067 - DNA, 25 bp, Mus musculus
gccttgtgtcaaaaccctatgtccc

SEQ ID NO: 941068 - DNA, 25 bp, Mus musculus
gccttgtgtcaaaacggaagatgga

SEQ ID NO: 941069 - DNA, 25 bp, Mus musculus
gccttgtgtcaaaagcctatgtccc

SEQ ID NO: 941070 - DNA, 25 bp, Mus musculus
gccttgtgtcaaaagggaagatgga

SEQ ID NO: 941071 - DNA, 25 bp, Mus musculus
gcctttaacccacgtgactcatatt

SEQ ID NO: 941072 - DNA, 25 bp, Mus musculus
gcctttaacccaggtgactcatatt

SEQ ID NO: 941073 - DNA, 25 bp, Mus musculus
gcctttactccacacaaatcgccat

SEQ ID NO: 941074 - DNA, 25 bp, Mus musculus
gcctttactccactgcctatgactc

SEQ ID NO: 941075 - DNA, 25 bp, Mus musculus
gcctttactccagacaaatcgccat

SEQ ID NO: 941076 - DNA, 25 bp, Mus musculus
gcctttactccagtgcctatgactc

SEQ ID NO: 941077 - DNA, 25 bp, Mus musculus
gcctttagccccagtggatctaaag

SEQ ID NO: 941078 - DNA, 25 bp, Mus musculus
gcctttagcccctgtggatctaaag

SEQ ID NO: 941079 - DNA, 25 bp, Mus musculus
gcctttatcagaaacgtgttcctgg

SEQ ID NO: 941080 - DNA, 25 bp, Mus musculus
gcctttatcagaaaggtgttcctgg

SEQ ID NO: 941081 - DNA, 25 bp, Mus musculus
gcctttattcagcctgacgtgtttc

SEQ ID NO: 941082 - DNA, 25 bp, Mus musculus
gcctttattcaggctgacgtgtttc

SEQ ID NO: 941083 - DNA, 25 bp, Mus musculus
gcctttcaacagctcgtttccttct

SEQ ID NO: 941084 - DNA, 25 bp, Mus musculus
gcctttcaacagctggtttccttct

SEQ ID NO: 941085 - DNA, 25 bp, Mus musculus
gcctttcaccagaaatacactgtga

SEQ ID NO: 941086 - DNA, 25 bp, Mus musculus
gcctttcaccagtaatacactgtga

SEQ ID NO: 941087 - DNA, 25 bp, Mus musculus
gcctttcctgaacatgatccatgcc

SEQ ID NO: 941088 - DNA, 25 bp, Mus musculus
gcctttcctgaagatgatccatgcc

SEQ ID NO: 941089 - DNA, 25 bp, Mus musculus
gcctttctgaagagtcctcacgagg

SEQ ID NO: 941090 - DNA, 25 bp, Mus musculus
gcctttctgaagtgtcctcacgagg

SEQ ID NO: 941091 - DNA, 25 bp, Mus musculus
gcctttctgcaacactacagagcgg

SEQ ID NO: 941092 - DNA, 25 bp, Mus musculus
gcctttctgcaagactacagagcgg

SEQ ID NO: 941093 - DNA, 25 bp, Mus musculus
gcctttgaaaagctgttgaagagcc

SEQ ID NO: 941094 - DNA, 25 bp, Mus musculus
gcctttgaaaaggtgttgaagagcc

SEQ ID NO: 941095 - DNA, 25 bp, Mus musculus
gcctttgaccatgccgatccttcca

SEQ ID NO: 941096 - DNA, 25 bp, Mus musculus
gcctttgaccatgcggatccttcca

SEQ ID NO: 941097 - DNA, 25 bp, Mus musculus
gcctttgcaagtcacgccgtctact

SEQ ID NO: 941098 - DNA, 25 bp, Mus musculus
gcctttgcaagtcaggccgtctact

SEQ ID NO: 941099 - DNA, 25 bp, Mus musculus
gcctttgcacagaactggtgcatca

SEQ ID NO: 941100 - DNA, 25 bp, Mus musculus
gcctttgcacagtactggtgcatca

SEQ ID NO: 941101 - DNA, 25 bp, Mus musculus
gcctttgcagagccaggcagggtgc

SEQ ID NO: 941102 - DNA, 25 bp, Mus musculus
gcctttgcagagcctggcagggtgc

SEQ ID NO: 941103 - DNA, 25 bp, Mus musculus
gcctttgctgcacgaatcctggaga

SEQ ID NO: 941104 - DNA, 25 bp, Mus musculus
gcctttgctgcaggaatcctggaga

SEQ ID NO: 941105 - DNA, 25 bp, Mus musculus
gcctttgctgcggacagtaaatcca

SEQ ID NO: 941106 - DNA, 25 bp, Mus musculus
gcctttgctggggacagtaaatcca

SEQ ID NO: 941107 - DNA, 25 bp, Mus musculus
gcctttggagagatagaaaatattg

SEQ ID NO: 941108 - DNA, 25 bp, Mus musculus
gcctttggagagttagaaaatattg

SEQ ID NO: 941109 - DNA, 25 bp, Mus musculus
gcctttggagcatggaagagtgtgg

SEQ ID NO: 941110 - DNA, 25 bp, Mus musculus
gcctttggaggatggaagagtgtgg

SEQ ID NO: 941111 - DNA, 25 bp, Mus musculus
gcctttggcaactgcgagtgctacg

SEQ ID NO: 941112 - DNA, 25 bp, Mus musculus
gcctttggcactcagaccaagccac

SEQ ID NO: 941113 - DNA, 25 bp, Mus musculus
gcctttggcactgtagctatctctg

SEQ ID NO: 941114 - DNA, 25 bp, Mus musculus
gcctttggcagtcagaccaagccac

SEQ ID NO: 941115 - DNA, 25 bp, Mus musculus
gcctttggcagtgtagctatctctg

SEQ ID NO: 941116 - DNA, 25 bp, Mus musculus
gcctttggcatctgcgagtgctacg

SEQ ID NO: 941117 - DNA, 25 bp, Mus musculus
gcctttgggaagccgacagacttat

SEQ ID NO: 941118 - DNA, 25 bp, Mus musculus
gcctttgggaaggcgacagacttat

SEQ ID NO: 941119 - DNA, 25 bp, Mus musculus
gcctttggggatgtcgtcaccgtca

SEQ ID NO: 941120 - DNA, 25 bp, Mus musculus
gcctttggggttgtcgtcaccgtca

SEQ ID NO: 941121 - DNA, 25 bp, Mus musculus
gcctttggtgacatcacacttgaag

SEQ ID NO: 941122 - DNA, 25 bp, Mus musculus
gcctttggtgacatgacacttgaag

SEQ ID NO: 941123 - DNA, 25 bp, Mus musculus
gcctttgtagaccaaagcccatggc

SEQ ID NO: 941124 - DNA, 25 bp, Mus musculus
gcctttgtagaccaagtggtgtcta

SEQ ID NO: 941125 - DNA, 25 bp, Mus musculus
gcctttgtagaccatagcccatggc

SEQ ID NO: 941126 - DNA, 25 bp, Mus musculus
gcctttgtagaccatgtggtgtcta

SEQ ID NO: 941127 - DNA, 25 bp, Mus musculus
gcctttgtctggaagcggcctctgg

SEQ ID NO: 941128 - DNA, 25 bp, Mus musculus
gcctttgtctggtagcggcctctgg

SEQ ID NO: 941129 - DNA, 25 bp, Mus musculus
gcctttgtgcgacacggcccccttg

SEQ ID NO: 941130 - DNA, 25 bp, Mus musculus
gcctttgtgcgagacggcccccttg

SEQ ID NO: 941131 - DNA, 25 bp, Mus musculus
gccttttcagaactcaagctcttct

SEQ ID NO: 941132 - DNA, 25 bp, Mus musculus
gccttttcagcgctacagtgcatgt

SEQ ID NO: 941133 - DNA, 25 bp, Mus musculus
gccttttcagggctacagtgcatgt

SEQ ID NO: 941134 - DNA, 25 bp, Mus musculus
gccttttcagtactcaagctcttct

SEQ ID NO: 941135 - DNA, 25 bp, Mus musculus
gccttttgtcagcgattcgataaac

SEQ ID NO: 941136 - DNA, 25 bp, Mus musculus
gccttttgtcagggattcgataaac

SEQ ID NO: 941137 - DNA, 25 bp, Mus musculus
gcgaaaaaggcatgactgagtggga

SEQ ID NO: 941138 - DNA, 25 bp, Mus musculus
gcgaaaaagggatgactgagtggga

SEQ ID NO: 941139 - DNA, 25 bp, Mus musculus
gcgaaaccaccaaacgtgcctactc

SEQ ID NO: 941140 - DNA, 25 bp, Mus musculus
gcgaaaccaccaaaggtgcctactc

SEQ ID NO: 941141 - DNA, 25 bp, Mus musculus
gcgaaaccagagcggcaggacacag

SEQ ID NO: 941142 - DNA, 25 bp, Mus musculus
gcgaaaccagaggggcaggacacag

SEQ ID NO: 941143 - DNA, 25 bp, Mus musculus
gcgaaaccagctccacaggatgatt

SEQ ID NO: 941144 - DNA, 25 bp, Mus musculus
gcgaaaccaggtccacaggatgatt

SEQ ID NO: 941145 - DNA, 25 bp, Mus musculus
gcgaaaggaacagactgacttaacc

SEQ ID NO: 941146 - DNA, 25 bp, Mus musculus
gcgaaaggaacagagtgacttaacc

SEQ ID NO: 941147 - DNA, 25 bp, Mus musculus
gcgaacaatacacgtggccaagaag

SEQ ID NO: 941148 - DNA, 25 bp, Mus musculus
gcgaacaatacactcaggatggcta

SEQ ID NO: 941149 - DNA, 25 bp, Mus musculus
gcgaacaatacaggtggccaagaag

SEQ ID NO: 941150 - DNA, 25 bp, Mus musculus
gcgaacaatacagtcaggatggcta

SEQ ID NO: 941151 - DNA, 25 bp, Mus musculus
gcgaagacccagacatggctgacat

SEQ ID NO: 941152 - DNA, 25 bp, Mus musculus
gcgaagacccagtcatggctgacat

SEQ ID NO: 941153 - DNA, 25 bp, Mus musculus
gcgaagaggaggaacagcagccttc

SEQ ID NO: 941154 - DNA, 25 bp, Mus musculus
gcgaagaggaggaagagcagccttc

SEQ ID NO: 941155 - DNA, 25 bp, Mus musculus
gcgaagcaaagactactccattgcg

SEQ ID NO: 941156 - DNA, 25 bp, Mus musculus
gcgaagcaaagagtactccattgcg

SEQ ID NO: 941157 - DNA, 25 bp, Mus musculus
gcgaagctcagaggcatcagaaaca

SEQ ID NO: 941158 - DNA, 25 bp, Mus musculus
gcgaagctcagagggatcagaaaca

SEQ ID NO: 941159 - DNA, 25 bp, Mus musculus
gcgaaggcagttcaattgtttgagg

SEQ ID NO: 941160 - DNA, 25 bp, Mus musculus
gcgaaggcagttgaattgtttgagg

SEQ ID NO: 941161 - DNA, 25 bp, Mus musculus
gcgaaggctgacggcagcaaggaga

SEQ ID NO: 941162 - DNA, 25 bp, Mus musculus
gcgaaggctgtcggcagcaaggaga

SEQ ID NO: 941163 - DNA, 25 bp, Mus musculus
gcgaagtctgtgattcgtaagacag

SEQ ID NO: 941164 - DNA, 25 bp, Mus musculus
gcgaagtctgtgtttcgtaagacag

SEQ ID NO: 941165 - DNA, 25 bp, Mus musculus
gcgaatcaaagacatggatctgtcc

SEQ ID NO: 941166 - DNA, 25 bp, Mus musculus
gcgaatcaaagagatggatctgtcc

SEQ ID NO: 941167 - DNA, 25 bp, Mus musculus
gcgaatcaccgcagacatgaagaac

SEQ ID NO: 941168 - DNA, 25 bp, Mus musculus
gcgaatcaccgctgacatgaagaac

SEQ ID NO: 941169 - DNA, 25 bp, Mus musculus
gcgacaaacagaacagaaaagaaat

SEQ ID NO: 941170 - DNA, 25 bp, Mus musculus
gcgacaaacagaatgcaacaaggat

SEQ ID NO: 941171 - DNA, 25 bp, Mus musculus
gcgacaaacagatcagaaaagaaat

SEQ ID NO: 941172 - DNA, 25 bp, Mus musculus
gcgacaaacagattgcaacaaggat

SEQ ID NO: 941173 - DNA, 25 bp, Mus musculus
gcgacaacagatggagaagtcttta

SEQ ID NO: 941174 - DNA, 25 bp, Mus musculus
gcgacaacagttggagaagtcttta

SEQ ID NO: 941175 - DNA, 25 bp, Mus musculus
gcgacaaggcggcacactttctgca

SEQ ID NO: 941176 - DNA, 25 bp, Mus musculus
gcgacaaggcggcagactttctgca

SEQ ID NO: 941177 - DNA, 25 bp, Mus musculus
gcgacaccagcagcatcacgatgac

SEQ ID NO: 941178 - DNA, 25 bp, Mus musculus
gcgacaccaggagcatcacgatgac

SEQ ID NO: 941179 - DNA, 25 bp, Mus musculus
gcgacaccatgacgtacattctaat

SEQ ID NO: 941180 - DNA, 25 bp, Mus musculus
gcgacaccatgaggtacattctaat

SEQ ID NO: 941181 - DNA, 25 bp, Mus musculus
gcgacactcgccccagctgtggtcc

SEQ ID NO: 941182 - DNA, 25 bp, Mus musculus
gcgacactcggcccagctgtggtcc

SEQ ID NO: 941183 - DNA, 25 bp, Mus musculus
gcgacagcagctcaaggagatcacc

SEQ ID NO: 941184 - DNA, 25 bp, Mus musculus
gcgacagcaggtcaaggagatcacc

SEQ ID NO: 941185 - DNA, 25 bp, Mus musculus
gcgacaggagctgaacatcccggct

SEQ ID NO: 941186 - DNA, 25 bp, Mus musculus
gcgacaggaggtgaacatcccggct

SEQ ID NO: 941187 - DNA, 25 bp, Mus musculus
gcgacatgagctagccaagtttatc

SEQ ID NO: 941188 - DNA, 25 bp, Mus musculus
gcgacatgaggtagccaagtttatc

SEQ ID NO: 941189 - DNA, 25 bp, Mus musculus
gcgacatttcagcaacctcaagtat

SEQ ID NO: 941190 - DNA, 25 bp, Mus musculus
gcgacatttcaggaacctcaagtat

SEQ ID NO: 941191 - DNA, 25 bp, Mus musculus
gcgaccagagattataaagctgtcc

SEQ ID NO: 941192 - DNA, 25 bp, Mus musculus
gcgaccagagtttataaagctgtcc

SEQ ID NO: 941193 - DNA, 25 bp, Mus musculus
gcgaccagcacaatcagctgcagct

SEQ ID NO: 941194 - DNA, 25 bp, Mus musculus
gcgaccagcacattcagctgcagct

SEQ ID NO: 941195 - DNA, 25 bp, Mus musculus
gcgacccaagttccatttaaatatt

SEQ ID NO: 941196 - DNA, 25 bp, Mus musculus
gcgacccaagttcctggacaaattt

SEQ ID NO: 941197 - DNA, 25 bp, Mus musculus
gcgacccaagttgcatttaaatatt

SEQ ID NO: 941198 - DNA, 25 bp, Mus musculus
gcgacccaagttgctggacaaattt

SEQ ID NO: 941199 - DNA, 25 bp, Mus musculus
gcgacccacacgacaaactacaact

SEQ ID NO: 941200 - DNA, 25 bp, Mus musculus
gcgacccacacgtcaaactacaact

SEQ ID NO: 941201 - DNA, 25 bp, Mus musculus
gcgaccctgacacagtcatgtggct

SEQ ID NO: 941202 - DNA, 25 bp, Mus musculus
gcgaccctgacagagtcatgtggct

SEQ ID NO: 941203 - DNA, 25 bp, Mus musculus
gcgaccctgcaacagttctttttgc

SEQ ID NO: 941204 - DNA, 25 bp, Mus musculus
gcgaccctgcaacatggagggggca

SEQ ID NO: 941205 - DNA, 25 bp, Mus musculus
gcgaccctgcaagagttctttttgc

SEQ ID NO: 941206 - DNA, 25 bp, Mus musculus
gcgaccctgcaagatggagggggca

SEQ ID NO: 941207 - DNA, 25 bp, Mus musculus
gcgacctgtgcaacctcgcatccct

SEQ ID NO: 941208 - DNA, 25 bp, Mus musculus
gcgacctgtgcagtaacctcgcatc

SEQ ID NO: 941209 - DNA, 25 bp, Mus musculus
gcgacctgtgcagttacctcgcatc

SEQ ID NO: 941210 - DNA, 25 bp, Mus musculus
gcgacctgtgcatcctcgcatccct

SEQ ID NO: 941211 - DNA, 25 bp, Mus musculus
gcgaccttccagcagcagcatgaag

SEQ ID NO: 941212 - DNA, 25 bp, Mus musculus
gcgaccttccaggagcagcatgaag

SEQ ID NO: 941213 - DNA, 25 bp, Mus musculus
gcgacgaaggagcagtcataaacga

SEQ ID NO: 941214 - DNA, 25 bp, Mus musculus
gcgacgaaggaggagtcataaacga

SEQ ID NO: 941215 - DNA, 25 bp, Mus musculus
gcgacggcatccggctgggccatgc

SEQ ID NO: 941216 - DNA, 25 bp, Mus musculus
gcgacggcatccgggtgggccatgc

SEQ ID NO: 941217 - DNA, 25 bp, Mus musculus
gcgacggcgctaaggtggattgtcc

SEQ ID NO: 941218 - DNA, 25 bp, Mus musculus
gcgacggcgctatggtggattgtcc

SEQ ID NO: 941219 - DNA, 25 bp, Mus musculus
gcgacggtcaggcctggattttgat

SEQ ID NO: 941220 - DNA, 25 bp, Mus musculus
gcgacggtcagggctggattttgat

SEQ ID NO: 941221 - DNA, 25 bp, Mus musculus
gcgactaagcagcaagggatggaag

SEQ ID NO: 941222 - DNA, 25 bp, Mus musculus
gcgactaagcaggaagggatggaag

SEQ ID NO: 941223 - DNA, 25 bp, Mus musculus
gcgactatagctctccaggtcaatg

SEQ ID NO: 941224 - DNA, 25 bp, Mus musculus
gcgactatagctctctgctcagtac

SEQ ID NO: 941225 - DNA, 25 bp, Mus musculus
gcgactatagctctgcaggtcaatg

SEQ ID NO: 941226 - DNA, 25 bp, Mus musculus
gcgactatagctctgtgctcagtac

SEQ ID NO: 941227 - DNA, 25 bp, Mus musculus
gcgactcaagcagggggccaacatc

SEQ ID NO: 941228 - DNA, 25 bp, Mus musculus
gcgactcaaggagggggccaacatc

SEQ ID NO: 941229 - DNA, 25 bp, Mus musculus
gcgactccagcaaactaatcactcg

SEQ ID NO: 941230 - DNA, 25 bp, Mus musculus
gcgactccaggaaactaatcactcg

SEQ ID NO: 941231 - DNA, 25 bp, Mus musculus
gcgactcctggtcacgtcaaagagc

SEQ ID NO: 941232 - DNA, 25 bp, Mus musculus
gcgactcctggtcaggtcaaagagc

SEQ ID NO: 941233 - DNA, 25 bp, Mus musculus
gcgactctttctcacatcacaaaca

SEQ ID NO: 941234 - DNA, 25 bp, Mus musculus
gcgactctttctcagatcacaaaca

SEQ ID NO: 941235 - DNA, 25 bp, Mus musculus
gcgactgatcaacgaactggctaaa

SEQ ID NO: 941236 - DNA, 25 bp, Mus musculus
gcgactgatcaaggaactggctaaa

SEQ ID NO: 941237 - DNA, 25 bp, Mus musculus
gcgactgctgaccatgagcatctat

SEQ ID NO: 941238 - DNA, 25 bp, Mus musculus
gcgactgctgagaccatgagcatct

SEQ ID NO: 941239 - DNA, 25 bp, Mus musculus
gcgactgctgtccatgagcatctat

SEQ ID NO: 941240 - DNA, 25 bp, Mus musculus
gcgactgctgtgaccatgagcatct

SEQ ID NO: 941241 - DNA, 25 bp, Mus musculus
gcgacttctaagcgcggcagacatg

SEQ ID NO: 941242 - DNA, 25 bp, Mus musculus
gcgacttctaagggcggcagacatg

SEQ ID NO: 941243 - DNA, 25 bp, Mus musculus
gcgagaaatgagagaaacgcaccaa

SEQ ID NO: 941244 - DNA, 25 bp, Mus musculus
gcgagaaatgcaaacagctgctgtc

SEQ ID NO: 941245 - DNA, 25 bp, Mus musculus
gcgagaaatggaaacagctgctgtc

SEQ ID NO: 941246 - DNA, 25 bp, Mus musculus
gcgagaaatgtgagaaacgcaccaa

SEQ ID NO: 941247 - DNA, 25 bp, Mus musculus
gcgagacagggacgcacagctggtg

SEQ ID NO: 941248 - DNA, 25 bp, Mus musculus
gcgagacagggaggcacagctggtg

SEQ ID NO: 941249 - DNA, 25 bp, Mus musculus
gcgagaccagacctgcacacctgtg

SEQ ID NO: 941250 - DNA, 25 bp, Mus musculus
gcgagaccagtcctgcacacctgtg

SEQ ID NO: 941251 - DNA, 25 bp, Mus musculus
gcgagaccggcgcatggaacaagat

SEQ ID NO: 941252 - DNA, 25 bp, Mus musculus
gcgagaccggggcatggaacaagat

SEQ ID NO: 941253 - DNA, 25 bp, Mus musculus
gcgagacctcttaggcctctctgtt

SEQ ID NO: 941254 - DNA, 25 bp, Mus musculus
gcgagacctctttggcctctctgtt

SEQ ID NO: 941255 - DNA, 25 bp, Mus musculus
gcgagacttgcaaaaggtgctggat

SEQ ID NO: 941256 - DNA, 25 bp, Mus musculus
gcgagacttgcataaggtgctggat

SEQ ID NO: 941257 - DNA, 25 bp, Mus musculus
gcgagaggagccctcccaccttgac

SEQ ID NO: 941258 - DNA, 25 bp, Mus musculus
gcgagaggaggcctcccaccttgac

SEQ ID NO: 941259 - DNA, 25 bp, Mus musculus
gcgagaggtcaacgccccacgcatg

SEQ ID NO: 941260 - DNA, 25 bp, Mus musculus
gcgagaggtcaaggccccacgcatg

SEQ ID NO: 941261 - DNA, 25 bp, Mus musculus
gcgagagtggcctgtaaaaaatggt

SEQ ID NO: 941262 - DNA, 25 bp, Mus musculus
gcgagagtgggctgtaaaaaatggt

SEQ ID NO: 941263 - DNA, 25 bp, Mus musculus
gcgagatcatcaaaccagaagattt

SEQ ID NO: 941264 - DNA, 25 bp, Mus musculus
gcgagatcatcataccagaagattt

SEQ ID NO: 941265 - DNA, 25 bp, Mus musculus
gcgagatgtggactttctagtgcag

SEQ ID NO: 941266 - DNA, 25 bp, Mus musculus
gcgagatgtggagtttctagtgcag

SEQ ID NO: 941267 - DNA, 25 bp, Mus musculus
gcgagcacccggcatacacttttgg

SEQ ID NO: 941268 - DNA, 25 bp, Mus musculus
gcgagcacccggcgaggcagagtaa

SEQ ID NO: 941269 - DNA, 25 bp, Mus musculus
gcgagcacccgggatacacttttgg

SEQ ID NO: 941270 - DNA, 25 bp, Mus musculus
gcgagcacccggggaggcagagtaa

SEQ ID NO: 941271 - DNA, 25 bp, Mus musculus
gcgagcagagctgcacccagtagaa

SEQ ID NO: 941272 - DNA, 25 bp, Mus musculus
gcgagcagaggtgcacccagtagaa

SEQ ID NO: 941273 - DNA, 25 bp, Mus musculus
gcgagcaggacgcgaaggatgcgaa

SEQ ID NO: 941274 - DNA, 25 bp, Mus musculus
gcgagcaggacgggaaggatgcgaa

SEQ ID NO: 941275 - DNA, 25 bp, Mus musculus
gcgagcaggagagcctgaaagagtt

SEQ ID NO: 941276 - DNA, 25 bp, Mus musculus
gcgagcaggagagcgtgaaagagtt

SEQ ID NO: 941277 - DNA, 25 bp, Mus musculus
gcgagccaagaacctggcctggccc

SEQ ID NO: 941278 - DNA, 25 bp, Mus musculus
gcgagccaagaagctggcctggccc

SEQ ID NO: 941279 - DNA, 25 bp, Mus musculus
gcgagcccacgccgcgcttaagcga

SEQ ID NO: 941280 - DNA, 25 bp, Mus musculus
gcgagcccacgccgggcttaagcga

SEQ ID NO: 941281 - DNA, 25 bp, Mus musculus
gcgagcccagcaggaagatgcatta

SEQ ID NO: 941282 - DNA, 25 bp, Mus musculus
gcgagcccagccaagaagacagcaa

SEQ ID NO: 941283 - DNA, 25 bp, Mus musculus
gcgagcccaggaggaagatgcatta

SEQ ID NO: 941284 - DNA, 25 bp, Mus musculus
gcgagcccaggcaagaagacagcaa

SEQ ID NO: 941285 - DNA, 25 bp, Mus musculus
gcgagcccctcgctcttcaaagctt

SEQ ID NO: 941286 - DNA, 25 bp, Mus musculus
gcgagcccctcggtcttcaaagctt

SEQ ID NO: 941287 - DNA, 25 bp, Mus musculus
gcgagccgccgggacatgctgttga

SEQ ID NO: 941288 - DNA, 25 bp, Mus musculus
gcgagccgccgggagatgctgttga

SEQ ID NO: 941289 - DNA, 25 bp, Mus musculus
gcgagcgtctggcacgtccaagggt

SEQ ID NO: 941290 - DNA, 25 bp, Mus musculus
gcgagcgtctggcaggtccaagggt

SEQ ID NO: 941291 - DNA, 25 bp, Mus musculus
gcgagctagttgtgcgtcgcatccg

SEQ ID NO: 941292 - DNA, 25 bp, Mus musculus
gcgagctagttgtgggtcgcatccg

SEQ ID NO: 941293 - DNA, 25 bp, Mus musculus
gcgagctctgaacatagcagtggac

SEQ ID NO: 941294 - DNA, 25 bp, Mus musculus
gcgagctctgaagatagcagtggac

SEQ ID NO: 941295 - DNA, 25 bp, Mus musculus
gcgagcttggcgaacctaccagctc

SEQ ID NO: 941296 - DNA, 25 bp, Mus musculus
gcgagcttggcgaagctaccagctc

SEQ ID NO: 941297 - DNA, 25 bp, Mus musculus
gcgaggaaacagccactctcgattt

SEQ ID NO: 941298 - DNA, 25 bp, Mus musculus
gcgaggaaacaggcactctcgattt

SEQ ID NO: 941299 - DNA, 25 bp, Mus musculus
gcgaggaaagcaaccttgaagaagt

SEQ ID NO: 941300 - DNA, 25 bp, Mus musculus
gcgaggaaagcatccttgaagaagt

SEQ ID NO: 941301 - DNA, 25 bp, Mus musculus
gcgaggacgagacctctatttcagt

SEQ ID NO: 941302 - DNA, 25 bp, Mus musculus
gcgaggacgagacctctggtgcaag

SEQ ID NO: 941303 - DNA, 25 bp, Mus musculus
gcgaggacgagagctctatttcagt

SEQ ID NO: 941304 - DNA, 25 bp, Mus musculus
gcgaggacgagagctctggtgcaag

SEQ ID NO: 941305 - DNA, 25 bp, Mus musculus
gcgaggactgcaagctaccttgcaa

SEQ ID NO: 941306 - DNA, 25 bp, Mus musculus
gcgaggactgcaagctgccctgcaa

SEQ ID NO: 941307 - DNA, 25 bp, Mus musculus
gcgaggactgcatgctaccttgcaa

SEQ ID NO: 941308 - DNA, 25 bp, Mus musculus
gcgaggactgcatgctgccctgcaa

SEQ ID NO: 941309 - DNA, 25 bp, Mus musculus
gcgaggagagcacgaaatgtggtct

SEQ ID NO: 941310 - DNA, 25 bp, Mus musculus
gcgaggagagcaggaaatgtggtct

SEQ ID NO: 941311 - DNA, 25 bp, Mus musculus
gcgaggagagcccgttgtctggaga

SEQ ID NO: 941312 - DNA, 25 bp, Mus musculus
gcgaggagagccggttgtctggaga

SEQ ID NO: 941313 - DNA, 25 bp, Mus musculus
gcgaggaggagacgctgcgcctgtc

SEQ ID NO: 941314 - DNA, 25 bp, Mus musculus
gcgaggaggagaggctgcgcctgtc

SEQ ID NO: 941315 - DNA, 25 bp, Mus musculus
gcgaggatggacatgaaagtccact

SEQ ID NO: 941316 - DNA, 25 bp, Mus musculus
gcgaggatggtcatgaaagtccact

SEQ ID NO: 941317 - DNA, 25 bp, Mus musculus
gcgaggcaagattgtgaaggtgcca

SEQ ID NO: 941318 - DNA, 25 bp, Mus musculus
gcgaggcaagtttgtgaaggtgcca

SEQ ID NO: 941319 - DNA, 25 bp, Mus musculus
gcgaggccaaagagcattgctctcc

SEQ ID NO: 941320 - DNA, 25 bp, Mus musculus
gcgaggccaaagtgcattgctctcc

SEQ ID NO: 941321 - DNA, 25 bp, Mus musculus
gcgaggcgagccaccatgacaaccc

SEQ ID NO: 941322 - DNA, 25 bp, Mus musculus
gcgaggcgagcgtgcacagtgctct

SEQ ID NO: 941323 - DNA, 25 bp, Mus musculus
gcgaggcgaggcaccatgacaaccc

SEQ ID NO: 941324 - DNA, 25 bp, Mus musculus
gcgaggcgagggtgcacagtgctct

SEQ ID NO: 941325 - DNA, 25 bp, Mus musculus
gcgaggctggagccaccatgagcca

SEQ ID NO: 941326 - DNA, 25 bp, Mus musculus
gcgaggctggaggcaccatgagcca

SEQ ID NO: 941327 - DNA, 25 bp, Mus musculus
gcgaggctgtcggccaagcccgccc

SEQ ID NO: 941328 - DNA, 25 bp, Mus musculus
gcgaggctgtcggcgaagcccgccc

SEQ ID NO: 941329 - DNA, 25 bp, Mus musculus
gcgagggcggcacacgccagtgctg

SEQ ID NO: 941330 - DNA, 25 bp, Mus musculus
gcgagggcggcagacgccagtgctg

SEQ ID NO: 941331 - DNA, 25 bp, Mus musculus
gcgagggtgatgcgagtgagcctgt

SEQ ID NO: 941332 - DNA, 25 bp, Mus musculus
gcgagggtgatgggagtgagcctgt

SEQ ID NO: 941333 - DNA, 25 bp, Mus musculus
gcgaggtcttcgaaagaaccaagca

SEQ ID NO: 941334 - DNA, 25 bp, Mus musculus
gcgaggtcttcgcccttcccaggac

SEQ ID NO: 941335 - DNA, 25 bp, Mus musculus
gcgaggtcttcggccttcccaggac

SEQ ID NO: 941336 - DNA, 25 bp, Mus musculus
gcgaggtcttcgtaagaaccaagca

SEQ ID NO: 941337 - DNA, 25 bp, Mus musculus
gcgaggttgttaagactactgggaa

SEQ ID NO: 941338 - DNA, 25 bp, Mus musculus
gcgaggttgttaagatcctggaccg

SEQ ID NO: 941339 - DNA, 25 bp, Mus musculus
gcgaggttgttaagtctactgggaa

SEQ ID NO: 941340 - DNA, 25 bp, Mus musculus
gcgaggttgttaagttcctggaccg

SEQ ID NO: 941341 - DNA, 25 bp, Mus musculus
gcgagtaaagagatgtttgaagata

SEQ ID NO: 941342 - DNA, 25 bp, Mus musculus
gcgagtaaagagttgtttgaagata

SEQ ID NO: 941343 - DNA, 25 bp, Mus musculus
gcgagtagaggacgtggaggatgca

SEQ ID NO: 941344 - DNA, 25 bp, Mus musculus
gcgagtagaggaggtggaggatgca

SEQ ID NO: 941345 - DNA, 25 bp, Mus musculus
gcgagtagcaggaggcgtccggtcg

SEQ ID NO: 941346 - DNA, 25 bp, Mus musculus
gcgagtagcaggtggcgtccggtcg

SEQ ID NO: 941347 - DNA, 25 bp, Mus musculus
gcgagtccttaggaaccagactagc

SEQ ID NO: 941348 - DNA, 25 bp, Mus musculus
gcgagtccttatcacacgtccccat

SEQ ID NO: 941349 - DNA, 25 bp, Mus musculus
gcgagtccttatgacacgtccccat

SEQ ID NO: 941350 - DNA, 25 bp, Mus musculus
gcgagtccttcaaccagactagcat

SEQ ID NO: 941351 - DNA, 25 bp, Mus musculus
gcgagtccttgaaccagactagcat

SEQ ID NO: 941352 - DNA, 25 bp, Mus musculus
gcgagtcctttggaaccagactagc

SEQ ID NO: 941353 - DNA, 25 bp, Mus musculus
gcgagtcttcggcgccctctgtcct

SEQ ID NO: 941354 - DNA, 25 bp, Mus musculus
gcgagtcttcggggccctctgtcct

SEQ ID NO: 941355 - DNA, 25 bp, Mus musculus
gcgagtgagccccacaccacctcat

SEQ ID NO: 941356 - DNA, 25 bp, Mus musculus
gcgagtgagccccacgtctgtctcc

SEQ ID NO: 941357 - DNA, 25 bp, Mus musculus
gcgagtgagccccagaccacctcat

SEQ ID NO: 941358 - DNA, 25 bp, Mus musculus
gcgagtgagccccaggtctgtctcc

SEQ ID NO: 941359 - DNA, 25 bp, Mus musculus
gcgagtgtctcccacgctttgaagg

SEQ ID NO: 941360 - DNA, 25 bp, Mus musculus
gcgagtgtctcccaggctttgaagg

SEQ ID NO: 941361 - DNA, 25 bp, Mus musculus
gcgagttattagcatgcctggtgtg

SEQ ID NO: 941362 - DNA, 25 bp, Mus musculus
gcgagttattagccacatgactcag

SEQ ID NO: 941363 - DNA, 25 bp, Mus musculus
gcgagttattaggatgcctggtgtg

SEQ ID NO: 941364 - DNA, 25 bp, Mus musculus
gcgagttattaggcacatgactcag

SEQ ID NO: 941365 - DNA, 25 bp, Mus musculus
gcgagttgcactggagaactcggag

SEQ ID NO: 941366 - DNA, 25 bp, Mus musculus
gcgagttgcagtggagaactcggag

SEQ ID NO: 941367 - DNA, 25 bp, Mus musculus
gcgataaaggatcccttccctgatg

SEQ ID NO: 941368 - DNA, 25 bp, Mus musculus
gcgataaaggttcccttccctgatg

SEQ ID NO: 941369 - DNA, 25 bp, Mus musculus
gcgatacaagcaacttgtggagatg

SEQ ID NO: 941370 - DNA, 25 bp, Mus musculus
gcgatacaaggaacttgtggagatg

SEQ ID NO: 941371 - DNA, 25 bp, Mus musculus
gcgatagggtaaaccctcgagacct

SEQ ID NO: 941372 - DNA, 25 bp, Mus musculus
gcgatagggttaaccctcgagacct

SEQ ID NO: 941373 - DNA, 25 bp, Mus musculus
gcgataggtacacttctgacacaac

SEQ ID NO: 941374 - DNA, 25 bp, Mus musculus
gcgataggtacagttctgacacaac

SEQ ID NO: 941375 - DNA, 25 bp, Mus musculus
gcgatatcactgacatgaccaatgc

SEQ ID NO: 941376 - DNA, 25 bp, Mus musculus
gcgatatcactgacttgaccaatgc

SEQ ID NO: 941377 - DNA, 25 bp, Mus musculus
gcgatatctgaacggcgagaatcct

SEQ ID NO: 941378 - DNA, 25 bp, Mus musculus
gcgatatctgaagggcgagaatcct

SEQ ID NO: 941379 - DNA, 25 bp, Mus musculus
gcgatatgctctgaaccacccggac

SEQ ID NO: 941380 - DNA, 25 bp, Mus musculus
gcgatatgctgtgaaccacccggac

SEQ ID NO: 941381 - DNA, 25 bp, Mus musculus
gcgatcagcctgccctttagtaaaa

SEQ ID NO: 941382 - DNA, 25 bp, Mus musculus
gcgatcagcctggcctttagtaaaa

SEQ ID NO: 941383 - DNA, 25 bp, Mus musculus
gcgatccctcaacgtctgcctactt

SEQ ID NO: 941384 - DNA, 25 bp, Mus musculus
gcgatccctcaaggtctgcctactt

SEQ ID NO: 941385 - DNA, 25 bp, Mus musculus
gcgatcctcccccaacactacaggc

SEQ ID NO: 941386 - DNA, 25 bp, Mus musculus
gcgatcctcccccatcactacaggc

SEQ ID NO: 941387 - DNA, 25 bp, Mus musculus
gcgatcctggctactctggagacca

SEQ ID NO: 941388 - DNA, 25 bp, Mus musculus
gcgatcctggcttctctggagacca

SEQ ID NO: 941389 - DNA, 25 bp, Mus musculus
gcgatgagccaacgcatagagatct

SEQ ID NO: 941390 - DNA, 25 bp, Mus musculus
gcgatgagccaaggcatagagatct

SEQ ID NO: 941391 - DNA, 25 bp, Mus musculus
gcgatgctcgatgctttcttctgta

SEQ ID NO: 941392 - DNA, 25 bp, Mus musculus
gcgatgctcgttgctttcttctgta

SEQ ID NO: 941393 - DNA, 25 bp, Mus musculus
gcgatggcggaacagagactcagcc

SEQ ID NO: 941394 - DNA, 25 bp, Mus musculus
gcgatggcggtacagagactcagcc

SEQ ID NO: 941395 - DNA, 25 bp, Mus musculus
gcgatggctgctatgacatggtgca

SEQ ID NO: 941396 - DNA, 25 bp, Mus musculus
gcgatggctggtatgacatggtgca

SEQ ID NO: 941397 - DNA, 25 bp, Mus musculus
gcgatggtgtaacgtggatgatgac

SEQ ID NO: 941398 - DNA, 25 bp, Mus musculus
gcgatggtgtaaggtggatgatgac

SEQ ID NO: 941399 - DNA, 25 bp, Mus musculus
gcgatgtcaaagctgacaacgtgct

SEQ ID NO: 941400 - DNA, 25 bp, Mus musculus
gcgatgtcaaaggtgacaacgtgct

SEQ ID NO: 941401 - DNA, 25 bp, Mus musculus
gcgatgtttgagaactatgacatca

SEQ ID NO: 941402 - DNA, 25 bp, Mus musculus
gcgatgtttgagaagtatgacatca

SEQ ID NO: 941403 - DNA, 25 bp, Mus musculus
gcgattatctatactacattagtaa

SEQ ID NO: 941404 - DNA, 25 bp, Mus musculus
gcgattatctttactacattagtaa

SEQ ID NO: 941405 - DNA, 25 bp, Mus musculus
gcgattccagcacgctggttttaac

SEQ ID NO: 941406 - DNA, 25 bp, Mus musculus
gcgattccagcaggctggttttaac

SEQ ID NO: 941407 - DNA, 25 bp, Mus musculus
gcgattgaagagacttttcacagag

SEQ ID NO: 941408 - DNA, 25 bp, Mus musculus
gcgattgaagagtcttttcacagag

SEQ ID NO: 941409 - DNA, 25 bp, Mus musculus
gcgattgccaaccacacgtaccacc

SEQ ID NO: 941410 - DNA, 25 bp, Mus musculus
gcgattgccaaccagacgtaccacc

SEQ ID NO: 941411 - DNA, 25 bp, Mus musculus
gcgatttaaaagcgatgtcaatgaa

SEQ ID NO: 941412 - DNA, 25 bp, Mus musculus
gcgatttaaaagggatgtcaatgaa

SEQ ID NO: 941413 - DNA, 25 bp, Mus musculus
gcgcaaactgcgcaaacgctacaag

SEQ ID NO: 941414 - DNA, 25 bp, Mus musculus
gcgcaaactgggcaaacgctacaag

SEQ ID NO: 941415 - DNA, 25 bp, Mus musculus
gcgcaaagagatggagtcatgcact

SEQ ID NO: 941416 - DNA, 25 bp, Mus musculus
gcgcaaagagatggtgtcatgcact

SEQ ID NO: 941417 - DNA, 25 bp, Mus musculus
gcgcaaatccttccagaaacttcat

SEQ ID NO: 941418 - DNA, 25 bp, Mus musculus
gcgcaaatccttcctgaaacttcat

SEQ ID NO: 941419 - DNA, 25 bp, Mus musculus
gcgcaagcccctcacgttctgtgct

SEQ ID NO: 941420 - DNA, 25 bp, Mus musculus
gcgcaagcccctcaggttctgtgct

SEQ ID NO: 941421 - DNA, 25 bp, Mus musculus
gcgcaagcgccgcaagtttctggag

SEQ ID NO: 941422 - DNA, 25 bp, Mus musculus
gcgcaagcgccgcatgtttctggag

SEQ ID NO: 941423 - DNA, 25 bp, Mus musculus
gcgcaaggagatcctgtggggcctg

SEQ ID NO: 941424 - DNA, 25 bp, Mus musculus
gcgcaaggagatcgtggggctgcga

SEQ ID NO: 941425 - DNA, 25 bp, Mus musculus
gcgcaaggagatcttgtctgtaggt

SEQ ID NO: 941426 - DNA, 25 bp, Mus musculus
gcgcaaggagatgctgtggggcctg

SEQ ID NO: 941427 - DNA, 25 bp, Mus musculus
gcgcaaggagatggtggggctgcga

SEQ ID NO: 941428 - DNA, 25 bp, Mus musculus
gcgcaaggagatgttgtctgtaggt

SEQ ID NO: 941429 - DNA, 25 bp, Mus musculus
gcgcaaggccaacacgcgataccaa

SEQ ID NO: 941430 - DNA, 25 bp, Mus musculus
gcgcaaggccaacaggcgataccaa

SEQ ID NO: 941431 - DNA, 25 bp, Mus musculus
gcgcaaggcccacgattttcactgg

SEQ ID NO: 941432 - DNA, 25 bp, Mus musculus
gcgcaaggcccaggattttcactgg

SEQ ID NO: 941433 - DNA, 25 bp, Mus musculus
gcgcaagtctcgctagtggttccaa

SEQ ID NO: 941434 - DNA, 25 bp, Mus musculus
gcgcaagtctcggtagtggttccaa

SEQ ID NO: 941435 - DNA, 25 bp, Mus musculus
gcgcacagagaacgtggggactcta

SEQ ID NO: 941436 - DNA, 25 bp, Mus musculus
gcgcacagagaaggtggggactcta

SEQ ID NO: 941437 - DNA, 25 bp, Mus musculus
gcgcacagcaaacacagccctttgc

SEQ ID NO: 941438 - DNA, 25 bp, Mus musculus
gcgcacagcaaacagagccctttgc

SEQ ID NO: 941439 - DNA, 25 bp, Mus musculus
gcgcacagcgcggactcgaggccag

SEQ ID NO: 941440 - DNA, 25 bp, Mus musculus
gcgcacagcgctaaaatgtcggctc

SEQ ID NO: 941441 - DNA, 25 bp, Mus musculus
gcgcacagcggggactcgaggccag

SEQ ID NO: 941442 - DNA, 25 bp, Mus musculus
gcgcacagcggtaaaatgtcggctc

SEQ ID NO: 941443 - DNA, 25 bp, Mus musculus
gcgcaccaagcccatggtggcgtgt

SEQ ID NO: 941444 - DNA, 25 bp, Mus musculus
gcgcaccaaggccatggtggcgtgt

SEQ ID NO: 941445 - DNA, 25 bp, Mus musculus
gcgcaccacgagcacataagaggag

SEQ ID NO: 941446 - DNA, 25 bp, Mus musculus
gcgcaccacgagcacttgttccaag

SEQ ID NO: 941447 - DNA, 25 bp, Mus musculus
gcgcaccacgagcagataagaggag

SEQ ID NO: 941448 - DNA, 25 bp, Mus musculus
gcgcaccacgagcagttgttccaag

SEQ ID NO: 941449 - DNA, 25 bp, Mus musculus
gcgcaccattaatcagtacccgctt

SEQ ID NO: 941450 - DNA, 25 bp, Mus musculus
gcgcaccattaatctgtacccgctt

SEQ ID NO: 941451 - DNA, 25 bp, Mus musculus
gcgcacctacggcctgactcctcac

SEQ ID NO: 941452 - DNA, 25 bp, Mus musculus
gcgcacctacgggctgactcctcac

SEQ ID NO: 941453 - DNA, 25 bp, Mus musculus
gcgcacctgccgcctgcgaccgagg

SEQ ID NO: 941454 - DNA, 25 bp, Mus musculus
gcgcacctgccggctgcgaccgagg

SEQ ID NO: 941455 - DNA, 25 bp, Mus musculus
gcgcacggcatctaaaatgtcaccc

SEQ ID NO: 941456 - DNA, 25 bp, Mus musculus
gcgcacggcatctaagcggagctga

SEQ ID NO: 941457 - DNA, 25 bp, Mus musculus
gcgcacggcatctaagtacgtgccc

SEQ ID NO: 941458 - DNA, 25 bp, Mus musculus
gcgcacggcatctataatgtcaccc

SEQ ID NO: 941459 - DNA, 25 bp, Mus musculus
gcgcacggcatctatgcggagctga

SEQ ID NO: 941460 - DNA, 25 bp, Mus musculus
gcgcacggcatctatgtacgtgccc

SEQ ID NO: 941461 - DNA, 25 bp, Mus musculus
gcgcactgagcgcccaggagacctt

SEQ ID NO: 941462 - DNA, 25 bp, Mus musculus
gcgcactgagggcccaggagacctt

SEQ ID NO: 941463 - DNA, 25 bp, Mus musculus
gcgcagaagccgccaagccgagtgc

SEQ ID NO: 941464 - DNA, 25 bp, Mus musculus
gcgcagaagccggcaagccgagtgc

SEQ ID NO: 941465 - DNA, 25 bp, Mus musculus
gcgcagacagctgtcagctgactcc

SEQ ID NO: 941466 - DNA, 25 bp, Mus musculus
gcgcagacaggtgtcagctgactcc

SEQ ID NO: 941467 - DNA, 25 bp, Mus musculus
gcgcagaggcagataaaggagagtg

SEQ ID NO: 941468 - DNA, 25 bp, Mus musculus
gcgcagaggcagttaaaggagagtg

SEQ ID NO: 941469 - DNA, 25 bp, Mus musculus
gcgcagaggctgcggacagtactta

SEQ ID NO: 941470 - DNA, 25 bp, Mus musculus
gcgcagaggctggggacagtactta

SEQ ID NO: 941471 - DNA, 25 bp, Mus musculus
gcgcagcacaagcgagggaagctaa

SEQ ID NO: 941472 - DNA, 25 bp, Mus musculus
gcgcagcacaagcgtgggaagctaa

SEQ ID NO: 941473 - DNA, 25 bp, Mus musculus
gcgcagccaccgcacctgcgggagg

SEQ ID NO: 941474 - DNA, 25 bp, Mus musculus
gcgcagccaccgcgctcatgcgtgc

SEQ ID NO: 941475 - DNA, 25 bp, Mus musculus
gcgcagccaccggacctgcgggagg

SEQ ID NO: 941476 - DNA, 25 bp, Mus musculus
gcgcagccaccgggctcatgcgtgc

SEQ ID NO: 941477 - DNA, 25 bp, Mus musculus
gcgcagcggaagaaatggcaaaatg

SEQ ID NO: 941478 - DNA, 25 bp, Mus musculus
gcgcagcggaagtaatggcaaaatg

SEQ ID NO: 941479 - DNA, 25 bp, Mus musculus
gcgcagctcgccatttcagtcgaac

SEQ ID NO: 941480 - DNA, 25 bp, Mus musculus
gcgcagctcggcatttcagtcgaac

SEQ ID NO: 941481 - DNA, 25 bp, Mus musculus
gcgcagctgctactcgaaatgctga

SEQ ID NO: 941482 - DNA, 25 bp, Mus musculus
gcgcagctgctactggaaatgctga

SEQ ID NO: 941483 - DNA, 25 bp, Mus musculus
gcgcaggagcgtcgattggtgacca

SEQ ID NO: 941484 - DNA, 25 bp, Mus musculus
gcgcaggagcgtggattggtgacca

SEQ ID NO: 941485 - DNA, 25 bp, Mus musculus
gcgcaggatggacgagagagggcca

SEQ ID NO: 941486 - DNA, 25 bp, Mus musculus
gcgcaggatggaggagagagggcca

SEQ ID NO: 941487 - DNA, 25 bp, Mus musculus
gcgcaggcacaacgcttgttggaga

SEQ ID NO: 941488 - DNA, 25 bp, Mus musculus
gcgcaggcacaaggcttgttggaga

SEQ ID NO: 941489 - DNA, 25 bp, Mus musculus
gcgcaggcagcaaagcgccccccag

SEQ ID NO: 941490 - DNA, 25 bp, Mus musculus
gcgcaggcaggaaagcgccccccag

SEQ ID NO: 941491 - DNA, 25 bp, Mus musculus
gcgcagggagcgactataggcgtga

SEQ ID NO: 941492 - DNA, 25 bp, Mus musculus
gcgcagggagggactataggcgtga

SEQ ID NO: 941493 - DNA, 25 bp, Mus musculus
gcgcagtatggagaccatcgagatt

SEQ ID NO: 941494 - DNA, 25 bp, Mus musculus
gcgcagtatggagagcatcgagatt

SEQ ID NO: 941495 - DNA, 25 bp, Mus musculus
gcgcagtccccaaacgatgataatg

SEQ ID NO: 941496 - DNA, 25 bp, Mus musculus
gcgcagtccccaaaggatgataatg

SEQ ID NO: 941497 - DNA, 25 bp, Mus musculus
gcgcagtcctccattgaagacagcg

SEQ ID NO: 941498 - DNA, 25 bp, Mus musculus
gcgcagtcctcctttgaagacagcg

SEQ ID NO: 941499 - DNA, 25 bp, Mus musculus
gcgcagtgtgcacccgttcccctgg

SEQ ID NO: 941500 - DNA, 25 bp, Mus musculus
gcgcagtgtggacccgttcccctgg

SEQ ID NO: 941501 - DNA, 25 bp, Mus musculus
gcgcatacagagcaagacctatgca

SEQ ID NO: 941502 - DNA, 25 bp, Mus musculus
gcgcatacagtgcaagacctatgca

SEQ ID NO: 941503 - DNA, 25 bp, Mus musculus
gcgcatcatgagcgtggagttctac

SEQ ID NO: 941504 - DNA, 25 bp, Mus musculus
gcgcatcatgagggtggagttctac

SEQ ID NO: 941505 - DNA, 25 bp, Mus musculus
gcgcatccaggacctcttggacaag

SEQ ID NO: 941506 - DNA, 25 bp, Mus musculus
gcgcatccaggagctcttggacaag

SEQ ID NO: 941507 - DNA, 25 bp, Mus musculus
gcgcatcctgcagccacattgccaa

SEQ ID NO: 941508 - DNA, 25 bp, Mus musculus
gcgcatcctggagccacattgccaa

SEQ ID NO: 941509 - DNA, 25 bp, Mus musculus
gcgcatcgcagacttgacatcctgc

SEQ ID NO: 941510 - DNA, 25 bp, Mus musculus
gcgcatcgcagagttgacatcctgc

SEQ ID NO: 941511 - DNA, 25 bp, Mus musculus
gcgcatctgcctaacgatgacggtg

SEQ ID NO: 941512 - DNA, 25 bp, Mus musculus
gcgcatctgcctcaacgatgacggt

SEQ ID NO: 941513 - DNA, 25 bp, Mus musculus
gcgcatctgcctgaacgatgacggt

SEQ ID NO: 941514 - DNA, 25 bp, Mus musculus
gcgcatctgccttacgatgacggtg

SEQ ID NO: 941515 - DNA, 25 bp, Mus musculus
gcgcatggtggacgaccccgtggct

SEQ ID NO: 941516 - DNA, 25 bp, Mus musculus
gcgcatggtggaggaccccgtggct

SEQ ID NO: 941517 - DNA, 25 bp, Mus musculus
gcgcatggtggtcacgggagaccac

SEQ ID NO: 941518 - DNA, 25 bp, Mus musculus
gcgcatggtggtcaggggagaccac

SEQ ID NO: 941519 - DNA, 25 bp, Mus musculus
gcgccaaggccacagaaatcttggt

SEQ ID NO: 941520 - DNA, 25 bp, Mus musculus
gcgccaaggccagagaaatcttggt

SEQ ID NO: 941521 - DNA, 25 bp, Mus musculus
gcgccaagtgagagtcagcttgcga

SEQ ID NO: 941522 - DNA, 25 bp, Mus musculus
gcgccaagtgagtgtcagcttgcga

SEQ ID NO: 941523 - DNA, 25 bp, Mus musculus
gcgccacgagaacgtcattgggcta

SEQ ID NO: 941524 - DNA, 25 bp, Mus musculus
gcgccacgagaactggacatttggt

SEQ ID NO: 941525 - DNA, 25 bp, Mus musculus
gcgccacgagaaggtcattgggcta

SEQ ID NO: 941526 - DNA, 25 bp, Mus musculus
gcgccacgagaagtggacatttggt

SEQ ID NO: 941527 - DNA, 25 bp, Mus musculus
gcgccactgcaagccggaagaaagc

SEQ ID NO: 941528 - DNA, 25 bp, Mus musculus
gcgccactgcaagcgggaagaaagc

SEQ ID NO: 941529 - DNA, 25 bp, Mus musculus
gcgccagcaagccgtggggcaggag

SEQ ID NO: 941530 - DNA, 25 bp, Mus musculus
gcgccagcaagcggtggggcaggag

SEQ ID NO: 941531 - DNA, 25 bp, Mus musculus
gcgccagcacaacgtgtggcgaaag

SEQ ID NO: 941532 - DNA, 25 bp, Mus musculus
gcgccagcacaaggtgtggcgaaag

SEQ ID NO: 941533 - DNA, 25 bp, Mus musculus
gcgccagggcaacgaggtcagacct

SEQ ID NO: 941534 - DNA, 25 bp, Mus musculus
gcgccagggcaaggaggtcagacct

SEQ ID NO: 941535 - DNA, 25 bp, Mus musculus
gcgccatcttccttcactcctgcgc

SEQ ID NO: 941536 - DNA, 25 bp, Mus musculus
gcgccatcttccttcagactcctgc

SEQ ID NO: 941537 - DNA, 25 bp, Mus musculus
gcgccatcttccttgactcctgcgc

SEQ ID NO: 941538 - DNA, 25 bp, Mus musculus
gcgccatcttccttgagactcctgc

SEQ ID NO: 941539 - DNA, 25 bp, Mus musculus
gcgccatgaacgctttgaacgcttc

SEQ ID NO: 941540 - DNA, 25 bp, Mus musculus
gcgccatgaacggtttgaacgcttc

SEQ ID NO: 941541 - DNA, 25 bp, Mus musculus
gcgccatgactggacgctgaaaggt

SEQ ID NO: 941542 - DNA, 25 bp, Mus musculus
gcgccatgactggaggctgaaaggt

SEQ ID NO: 941543 - DNA, 25 bp, Mus musculus
gcgccattgctgctgtgatggcctt

SEQ ID NO: 941544 - DNA, 25 bp, Mus musculus
gcgccattgctggtgtgatggcctt

SEQ ID NO: 941545 - DNA, 25 bp, Mus musculus
gcgcccaaagactcaggggcctacc

SEQ ID NO: 941546 - DNA, 25 bp, Mus musculus
gcgcccaaagtctcaggggcctacc

SEQ ID NO: 941547 - DNA, 25 bp, Mus musculus
gcgcccacgccacacctgcctatcc

SEQ ID NO: 941548 - DNA, 25 bp, Mus musculus
gcgcccacgccagacctgcctatcc

SEQ ID NO: 941549 - DNA, 25 bp, Mus musculus
gcgcccacgttgcgatctgaaccaa

SEQ ID NO: 941550 - DNA, 25 bp, Mus musculus
gcgcccacgttgggatctgaaccaa

SEQ ID NO: 941551 - DNA, 25 bp, Mus musculus
gcgcccaggggacatgtataccagg

SEQ ID NO: 941552 - DNA, 25 bp, Mus musculus
gcgcccaggggagatgtataccagg

SEQ ID NO: 941553 - DNA, 25 bp, Mus musculus
gcgcccagtctgatacacttttggc

SEQ ID NO: 941554 - DNA, 25 bp, Mus musculus
gcgcccagtctgttacacttttggc

SEQ ID NO: 941555 - DNA, 25 bp, Mus musculus
gcgcccatgcagatggcctctgcac

SEQ ID NO: 941556 - DNA, 25 bp, Mus musculus
gcgcccatgcagttggcctctgcac

SEQ ID NO: 941557 - DNA, 25 bp, Mus musculus
gcgccccagcctccaccatgccaat

SEQ ID NO: 941558 - DNA, 25 bp, Mus musculus
gcgccccagcctgcaccatgccaat

SEQ ID NO: 941559 - DNA, 25 bp, Mus musculus
gcgccccagctgtgcggcagttttg

SEQ ID NO: 941560 - DNA, 25 bp, Mus musculus
gcgccccagctgtggggcagttttg

SEQ ID NO: 941561 - DNA, 25 bp, Mus musculus
gcgcccgaccgattagatgtccatg

SEQ ID NO: 941562 - DNA, 25 bp, Mus musculus
gcgcccgaccgatttgatgtccatg

SEQ ID NO: 941563 - DNA, 25 bp, Mus musculus
gcgccctcagagggaagatgcccga

SEQ ID NO: 941564 - DNA, 25 bp, Mus musculus
gcgccctcagatgtcacctgtacgg

SEQ ID NO: 941565 - DNA, 25 bp, Mus musculus
gcgccctcagcatgactgagtggga

SEQ ID NO: 941566 - DNA, 25 bp, Mus musculus
gcgccctcaggatgactgagtggga

SEQ ID NO: 941567 - DNA, 25 bp, Mus musculus
gcgccctcagtgggaagatgcccga

SEQ ID NO: 941568 - DNA, 25 bp, Mus musculus
gcgccctcagttgtcacctgtacgg

SEQ ID NO: 941569 - DNA, 25 bp, Mus musculus
gcgccctgagctcgacaagtgacgc

SEQ ID NO: 941570 - DNA, 25 bp, Mus musculus
gcgccctgagctggacaagtgacgc

SEQ ID NO: 941571 - DNA, 25 bp, Mus musculus
gcgccctgccaacattttcacctga

SEQ ID NO: 941572 - DNA, 25 bp, Mus musculus
gcgccctgccaagattttcacctga

SEQ ID NO: 941573 - DNA, 25 bp, Mus musculus
gcgcccttcctccgatggctacaga

SEQ ID NO: 941574 - DNA, 25 bp, Mus musculus
gcgcccttcctccgttggctacaga

SEQ ID NO: 941575 - DNA, 25 bp, Mus musculus
gcgccgagcgccctcagttgagccc

SEQ ID NO: 941576 - DNA, 25 bp, Mus musculus
gcgccgagcgccctgagttgagccc

SEQ ID NO: 941577 - DNA, 25 bp, Mus musculus
gcgccgcaagctacctgcgctgcga

SEQ ID NO: 941578 - DNA, 25 bp, Mus musculus
gcgccgcaaggtacctgcgctgcga

SEQ ID NO: 941579 - DNA, 25 bp, Mus musculus
gcgccgccatgctcctgggctccct

SEQ ID NO: 941580 - DNA, 25 bp, Mus musculus
gcgccgccatgctcgtgggctccct

SEQ ID NO: 941581 - DNA, 25 bp, Mus musculus
gcgccgccggcttcaagcgctgtct

SEQ ID NO: 941582 - DNA, 25 bp, Mus musculus
gcgccgccgggttcaagcgctgtct

SEQ ID NO: 941583 - DNA, 25 bp, Mus musculus
gcgccgcctgaccgcttcccgccgg

SEQ ID NO: 941584 - DNA, 25 bp, Mus musculus
gcgccgcctgtccgcttcccgccgg

SEQ ID NO: 941585 - DNA, 25 bp, Mus musculus
gcgccgctgtgacgtacagtcatgt

SEQ ID NO: 941586 - DNA, 25 bp, Mus musculus
gcgccgctgtgaggtacagtcatgt

SEQ ID NO: 941587 - DNA, 25 bp, Mus musculus
gcgccgtacacacgaattctttatg

SEQ ID NO: 941588 - DNA, 25 bp, Mus musculus
gcgccgtacacaggaattctttatg

SEQ ID NO: 941589 - DNA, 25 bp, Mus musculus
gcgccgtgagattcgcgcagaggac

SEQ ID NO: 941590 - DNA, 25 bp, Mus musculus
gcgccgtgagtttcgcgcagaggac

SEQ ID NO: 941591 - DNA, 25 bp, Mus musculus
gcgccgtggcagaccggcttacggc

SEQ ID NO: 941592 - DNA, 25 bp, Mus musculus
gcgccgtggcagacgggcttacggc

SEQ ID NO: 941593 - DNA, 25 bp, Mus musculus
gcgcctacctctcacgtgacgtgct

SEQ ID NO: 941594 - DNA, 25 bp, Mus musculus
gcgcctacctctcaggtgacgtgct

SEQ ID NO: 941595 - DNA, 25 bp, Mus musculus
gcgcctactcagcgctaacatcagg

SEQ ID NO: 941596 - DNA, 25 bp, Mus musculus
gcgcctactcagggctaacatcagg

SEQ ID NO: 941597 - DNA, 25 bp, Mus musculus
gcgcctcaaacacaaccacttcagc

SEQ ID NO: 941598 - DNA, 25 bp, Mus musculus
gcgcctcaaacacaagtgactctcc

SEQ ID NO: 941599 - DNA, 25 bp, Mus musculus
gcgcctcaaacacatccacttcagc

SEQ ID NO: 941600 - DNA, 25 bp, Mus musculus
gcgcctcaaacacatgtgactctcc

SEQ ID NO: 941601 - DNA, 25 bp, Mus musculus
gcgcctcccgcggagcccgcacgac

SEQ ID NO: 941602 - DNA, 25 bp, Mus musculus
gcgcctcccggggagcccgcacgac

SEQ ID NO: 941603 - DNA, 25 bp, Mus musculus
gcgcctcctcagcgccgcaagcttc

SEQ ID NO: 941604 - DNA, 25 bp, Mus musculus
gcgcctcctcagggccgcaagcttc

SEQ ID NO: 941605 - DNA, 25 bp, Mus musculus
gcgcctgaagcaactcatcggtgaa

SEQ ID NO: 941606 - DNA, 25 bp, Mus musculus
gcgcctgaaggaactcatcggtgaa

SEQ ID NO: 941607 - DNA, 25 bp, Mus musculus
gcgcctgcagctctctgcaagaaca

SEQ ID NO: 941608 - DNA, 25 bp, Mus musculus
gcgcctgcagctggtggtggaagag

SEQ ID NO: 941609 - DNA, 25 bp, Mus musculus
gcgcctgcagcttcacattgagatc

SEQ ID NO: 941610 - DNA, 25 bp, Mus musculus
gcgcctgcaggtctctgcaagaaca

SEQ ID NO: 941611 - DNA, 25 bp, Mus musculus
gcgcctgcaggtggtggtggaagag

SEQ ID NO: 941612 - DNA, 25 bp, Mus musculus
gcgcctgcaggttcacattgagatc

SEQ ID NO: 941613 - DNA, 25 bp, Mus musculus
gcgcctggcctccgcataaagatag

SEQ ID NO: 941614 - DNA, 25 bp, Mus musculus
gcgcctggcctccgcgtttgtattg

SEQ ID NO: 941615 - DNA, 25 bp, Mus musculus
gcgcctggcctccggataaagatag

SEQ ID NO: 941616 - DNA, 25 bp, Mus musculus
gcgcctggcctccgggtttgtattg

SEQ ID NO: 941617 - DNA, 25 bp, Mus musculus
gcgcctggtggacgacatggaaaac

SEQ ID NO: 941618 - DNA, 25 bp, Mus musculus
gcgcctggtggaggacatggaaaac

SEQ ID NO: 941619 - DNA, 25 bp, Mus musculus
gcgccttaagcaggaagagctgata

SEQ ID NO: 941620 - DNA, 25 bp, Mus musculus
gcgccttaaggaggaagagctgata

SEQ ID NO: 941621 - DNA, 25 bp, Mus musculus
gcgccttcttgcatcaatggagaaa

SEQ ID NO: 941622 - DNA, 25 bp, Mus musculus
gcgccttcttgcatccagaatggag

SEQ ID NO: 941623 - DNA, 25 bp, Mus musculus
gcgccttcttgcatgaatggagaaa

SEQ ID NO: 941624 - DNA, 25 bp, Mus musculus
gcgccttcttgcatgcagaatggag

SEQ ID NO: 941625 - DNA, 25 bp, Mus musculus
gcgcctttgtgcgacacggccccct

SEQ ID NO: 941626 - DNA, 25 bp, Mus musculus
gcgcctttgtgcgagacggccccct

SEQ ID NO: 941627 - DNA, 25 bp, Mus musculus
gcgcgaggagctccagaaatcttga

SEQ ID NO: 941628 - DNA, 25 bp, Mus musculus
gcgcgaggaggtccagaaatcttga

SEQ ID NO: 941629 - DNA, 25 bp, Mus musculus
gcgcgcacagagctgaagcgctgca

SEQ ID NO: 941630 - DNA, 25 bp, Mus musculus
gcgcgcacagctgggtggctgtggt

SEQ ID NO: 941631 - DNA, 25 bp, Mus musculus
gcgcgcacaggtgggtggctgtggt

SEQ ID NO: 941632 - DNA, 25 bp, Mus musculus
gcgcgcacagtgctgaagcgctgca

SEQ ID NO: 941633 - DNA, 25 bp, Mus musculus
gcgcgccctgcccaacagcctcgct

SEQ ID NO: 941634 - DNA, 25 bp, Mus musculus
gcgcgccctggccaacagcctcgct

SEQ ID NO: 941635 - DNA, 25 bp, Mus musculus
gcgcgccgagatgaactttctagat

SEQ ID NO: 941636 - DNA, 25 bp, Mus musculus
gcgcgccgagcgtgtgtgggatgac

SEQ ID NO: 941637 - DNA, 25 bp, Mus musculus
gcgcgccgagggtgtgtgggatgac

SEQ ID NO: 941638 - DNA, 25 bp, Mus musculus
gcgcgccgagttgaactttctagat

SEQ ID NO: 941639 - DNA, 25 bp, Mus musculus
gcgcgccgctgtgacgtacagtcat

SEQ ID NO: 941640 - DNA, 25 bp, Mus musculus
gcgcgccgctgtgaggtacagtcat

SEQ ID NO: 941641 - DNA, 25 bp, Mus musculus
gcgcgcgcagaggtttcatagtcct

SEQ ID NO: 941642 - DNA, 25 bp, Mus musculus
gcgcgcgcagtggtttcatagtcct

SEQ ID NO: 941643 - DNA, 25 bp, Mus musculus
gcgcgcggagcacactgtcgctaac

SEQ ID NO: 941644 - DNA, 25 bp, Mus musculus
gcgcgcggagcacccctctctatag

SEQ ID NO: 941645 - DNA, 25 bp, Mus musculus
gcgcgcggagcagactgtcgctaac

SEQ ID NO: 941646 - DNA, 25 bp, Mus musculus
gcgcgcggagcagccctctctatag

SEQ ID NO: 941647 - DNA, 25 bp, Mus musculus
gcgcgcgggcctgacggtacctgaa

SEQ ID NO: 941648 - DNA, 25 bp, Mus musculus
gcgcgcgggcctgagggtacctgaa

SEQ ID NO: 941649 - DNA, 25 bp, Mus musculus
gcgcgctaaaaaagcttgtttctgg

SEQ ID NO: 941650 - DNA, 25 bp, Mus musculus
gcgcgctaaaaatgcttgtttctgg

SEQ ID NO: 941651 - DNA, 25 bp, Mus musculus
gcgcgctttgagcgcctgaagaaga

SEQ ID NO: 941652 - DNA, 25 bp, Mus musculus
gcgcgctttgagggcctgaagaaga

SEQ ID NO: 941653 - DNA, 25 bp, Mus musculus
gcgcggaaattaggccaagagccag

SEQ ID NO: 941654 - DNA, 25 bp, Mus musculus
gcgcggaaattagggcaagagccag

SEQ ID NO: 941655 - DNA, 25 bp, Mus musculus
gcgcggacccagagtgcttgggatc

SEQ ID NO: 941656 - DNA, 25 bp, Mus musculus
gcgcggacccagtgtgcttgggatc

SEQ ID NO: 941657 - DNA, 25 bp, Mus musculus
gcgcggcgcggaccttagcagatca

SEQ ID NO: 941658 - DNA, 25 bp, Mus musculus
gcgcggcgcggactcacattagctt

SEQ ID NO: 941659 - DNA, 25 bp, Mus musculus
gcgcggcgcggagcttagcagatca

SEQ ID NO: 941660 - DNA, 25 bp, Mus musculus
gcgcggcgcggagtcacattagctt

SEQ ID NO: 941661 - DNA, 25 bp, Mus musculus
gcgcgggcagcgctaaaatgtcggc

SEQ ID NO: 941662 - DNA, 25 bp, Mus musculus
gcgcgggcagcggtaaaatgtcggc

SEQ ID NO: 941663 - DNA, 25 bp, Mus musculus
gcgcgggccgctgtacattggtgaa

SEQ ID NO: 941664 - DNA, 25 bp, Mus musculus
gcgcgggccggtgtacattggtgaa

SEQ ID NO: 941665 - DNA, 25 bp, Mus musculus
gcgcgggcctgacggtacctgaagc

SEQ ID NO: 941666 - DNA, 25 bp, Mus musculus
gcgcgggcctgagggtacctgaagc

SEQ ID NO: 941667 - DNA, 25 bp, Mus musculus
gcgcgggctccacaggcgtccggtc

SEQ ID NO: 941668 - DNA, 25 bp, Mus musculus
gcgcgggctccagaggcgtccggtc

SEQ ID NO: 941669 - DNA, 25 bp, Mus musculus
gcgcggggtgcggacgtcgctcatc

SEQ ID NO: 941670 - DNA, 25 bp, Mus musculus
gcgcggggtgcggaggtcgctcatc

SEQ ID NO: 941671 - DNA, 25 bp, Mus musculus
gcgcgggtcatgcaccggcaccacg

SEQ ID NO: 941672 - DNA, 25 bp, Mus musculus
gcgcgggtcatggaccggcaccacg

SEQ ID NO: 941673 - DNA, 25 bp, Mus musculus
gcgcggtgactgcgatactttgcag

SEQ ID NO: 941674 - DNA, 25 bp, Mus musculus
gcgcggtgactgggatactttgcag

SEQ ID NO: 941675 - DNA, 25 bp, Mus musculus
gcgcgtgaagctctccagtcctgag

SEQ ID NO: 941676 - DNA, 25 bp, Mus musculus
gcgcgtgaaggtctccagtcctgag

SEQ ID NO: 941677 - DNA, 25 bp, Mus musculus
gcgcgtgcccggcctgccgcctatg

SEQ ID NO: 941678 - DNA, 25 bp, Mus musculus
gcgcgtgcccgggctgccgcctatg

SEQ ID NO: 941679 - DNA, 25 bp, Mus musculus
gcgcgtgcgggtctggtacaagctg

SEQ ID NO: 941680 - DNA, 25 bp, Mus musculus
gcgcgtgcgggtgtggtacaagctg

SEQ ID NO: 941681 - DNA, 25 bp, Mus musculus
gcgcgtggatgactcaagctggccc

SEQ ID NO: 941682 - DNA, 25 bp, Mus musculus
gcgcgtggatgactcggcagccacg

SEQ ID NO: 941683 - DNA, 25 bp, Mus musculus
gcgcgtggatgactgaagctggccc

SEQ ID NO: 941684 - DNA, 25 bp, Mus musculus
gcgcgtggatgactgggcagccacg

SEQ ID NO: 941685 - DNA, 25 bp, Mus musculus
gcgctaccttggagcttcagtcccc

SEQ ID NO: 941686 - DNA, 25 bp, Mus musculus
gcgctaccttggtgcttcagtcccc

SEQ ID NO: 941687 - DNA, 25 bp, Mus musculus
gcgctagcgcttcacagttcctggt

SEQ ID NO: 941688 - DNA, 25 bp, Mus musculus
gcgctagcgcttcagagttcctggt

SEQ ID NO: 941689 - DNA, 25 bp, Mus musculus
gcgctatcagttctcacccccactt

SEQ ID NO: 941690 - DNA, 25 bp, Mus musculus
gcgctatcagttctgacccccactt

SEQ ID NO: 941691 - DNA, 25 bp, Mus musculus
gcgctcaaccagctggatgtgtggg

SEQ ID NO: 941692 - DNA, 25 bp, Mus musculus
gcgctcaaccaggtggatgtgtggg

SEQ ID NO: 941693 - DNA, 25 bp, Mus musculus
gcgctcaccctgattgactcgtggt

SEQ ID NO: 941694 - DNA, 25 bp, Mus musculus
gcgctcaccctgcgactactgtgaa

SEQ ID NO: 941695 - DNA, 25 bp, Mus musculus
gcgctcaccctgggactactgtgaa

SEQ ID NO: 941696 - DNA, 25 bp, Mus musculus
gcgctcaccctgtttgactcgtggt

SEQ ID NO: 941697 - DNA, 25 bp, Mus musculus
gcgctcacggcaaccagtgaccttt

SEQ ID NO: 941698 - DNA, 25 bp, Mus musculus
gcgctcacgggaaccagtgaccttt

SEQ ID NO: 941699 - DNA, 25 bp, Mus musculus
gcgctcatgccacgttttttattgg

SEQ ID NO: 941700 - DNA, 25 bp, Mus musculus
gcgctcatgccaggttttttattgg

SEQ ID NO: 941701 - DNA, 25 bp, Mus musculus
gcgctccccgagctgtgaatgaggc

SEQ ID NO: 941702 - DNA, 25 bp, Mus musculus
gcgctccccgaggtgtgaatgaggc

SEQ ID NO: 941703 - DNA, 25 bp, Mus musculus
gcgctcggaactctgtcgtgattaa

SEQ ID NO: 941704 - DNA, 25 bp, Mus musculus
gcgctcggaactgtgtcgtgattaa

SEQ ID NO: 941705 - DNA, 25 bp, Mus musculus
gcgctcggctgccacttctatgaag

SEQ ID NO: 941706 - DNA, 25 bp, Mus musculus
gcgctcggctgccagttctatgaag

SEQ ID NO: 941707 - DNA, 25 bp, Mus musculus
gcgctctctgagcaaatcaagaaag

SEQ ID NO: 941708 - DNA, 25 bp, Mus musculus
gcgctctctgaggaaatcaagaaag

SEQ ID NO: 941709 - DNA, 25 bp, Mus musculus
gcgctctctgctcacctatgaggag

SEQ ID NO: 941710 - DNA, 25 bp, Mus musculus
gcgctctctgctcagtctgaagatg

SEQ ID NO: 941711 - DNA, 25 bp, Mus musculus
gcgctctctgctgacctatgaggag

SEQ ID NO: 941712 - DNA, 25 bp, Mus musculus
gcgctctctgctgagtctgaagatg

SEQ ID NO: 941713 - DNA, 25 bp, Mus musculus
gcgctctgccagcagctgtactgta

SEQ ID NO: 941714 - DNA, 25 bp, Mus musculus
gcgctctgccaggagctgtactgta

SEQ ID NO: 941715 - DNA, 25 bp, Mus musculus
gcgctctgggacccagaaaaccttg

SEQ ID NO: 941716 - DNA, 25 bp, Mus musculus
gcgctctgggaccctgaaaaccttg

SEQ ID NO: 941717 - DNA, 25 bp, Mus musculus
gcgctcttctcttatgttcttgctg

SEQ ID NO: 941718 - DNA, 25 bp, Mus musculus
gcgctcttctgttatgttcttgctg

SEQ ID NO: 941719 - DNA, 25 bp, Mus musculus
gcgctgacagctacagagctatcgt

SEQ ID NO: 941720 - DNA, 25 bp, Mus musculus
gcgctgacaggtacagagctatcgt

SEQ ID NO: 941721 - DNA, 25 bp, Mus musculus
gcgctgcagctgacactgtacagca

SEQ ID NO: 941722 - DNA, 25 bp, Mus musculus
gcgctgcagctgactctgtacagca

SEQ ID NO: 941723 - DNA, 25 bp, Mus musculus
gcgctgccattcaactggcagccac

SEQ ID NO: 941724 - DNA, 25 bp, Mus musculus
gcgctgccattcaagtggcagccac

SEQ ID NO: 941725 - DNA, 25 bp, Mus musculus
gcgctgcctcagagcccaccgcaac

SEQ ID NO: 941726 - DNA, 25 bp, Mus musculus
gcgctgcctcagtgcccaccgcaac

SEQ ID NO: 941727 - DNA, 25 bp, Mus musculus
gcgctgcgagagaggaagacgactg

SEQ ID NO: 941728 - DNA, 25 bp, Mus musculus
gcgctgcgagtgaggaagacgactg

SEQ ID NO: 941729 - DNA, 25 bp, Mus musculus
gcgctgctcagaaccaaccaagaat

SEQ ID NO: 941730 - DNA, 25 bp, Mus musculus
gcgctgctcagaaccgatcaataag

SEQ ID NO: 941731 - DNA, 25 bp, Mus musculus
gcgctgctcagaacgaaccaagaat

SEQ ID NO: 941732 - DNA, 25 bp, Mus musculus
gcgctgctcagaacggatcaataag

SEQ ID NO: 941733 - DNA, 25 bp, Mus musculus
gcgctgctggagcacagagaaaaag

SEQ ID NO: 941734 - DNA, 25 bp, Mus musculus
gcgctgctggaggacagagaaaaag

SEQ ID NO: 941735 - DNA, 25 bp, Mus musculus
gcgctgcttgaaaacacactgagtc

SEQ ID NO: 941736 - DNA, 25 bp, Mus musculus
gcgctgcttgaaaagacactgagtc

SEQ ID NO: 941737 - DNA, 25 bp, Mus musculus
gcgctggcagcttgtagatacccca

SEQ ID NO: 941738 - DNA, 25 bp, Mus musculus
gcgctggcaggtcccagggattttg

SEQ ID NO: 941739 - DNA, 25 bp, Mus musculus
gcgctggcaggtgccagggattttg

SEQ ID NO: 941740 - DNA, 25 bp, Mus musculus
gcgctggcaggttgtagatacccca

SEQ ID NO: 941741 - DNA, 25 bp, Mus musculus
gcgctggcggctgatgaagcctgga

SEQ ID NO: 941742 - DNA, 25 bp, Mus musculus
gcgctggcggctgttccgaatgcca

SEQ ID NO: 941743 - DNA, 25 bp, Mus musculus
gcgctggcgggtgatgaagcctgga

SEQ ID NO: 941744 - DNA, 25 bp, Mus musculus
gcgctggcgggtgttccgaatgcca

SEQ ID NO: 941745 - DNA, 25 bp, Mus musculus
gcgctggctgaggacgtggaggtcc

SEQ ID NO: 941746 - DNA, 25 bp, Mus musculus
gcgctggctgaggaggtggaggtcc

SEQ ID NO: 941747 - DNA, 25 bp, Mus musculus
gcgctgggagccatgtcatgttacc

SEQ ID NO: 941748 - DNA, 25 bp, Mus musculus
gcgctgggaggcatgtcatgttacc

SEQ ID NO: 941749 - DNA, 25 bp, Mus musculus
gcgctgtacgagcctccagcatacc

SEQ ID NO: 941750 - DNA, 25 bp, Mus musculus
gcgctgtacgaggctccagcatacc

SEQ ID NO: 941751 - DNA, 25 bp, Mus musculus
gcgctgtcagatcaagatccacttc

SEQ ID NO: 941752 - DNA, 25 bp, Mus musculus
gcgctgtcagttcaagatccacttc

SEQ ID NO: 941753 - DNA, 25 bp, Mus musculus
gcgctgtccaggctcttcaaagctt

SEQ ID NO: 941754 - DNA, 25 bp, Mus musculus
gcgctgtccagggtcttcaaagctt

SEQ ID NO: 941755 - DNA, 25 bp, Mus musculus
gcgctgtgggacacaaagcacctgg

SEQ ID NO: 941756 - DNA, 25 bp, Mus musculus
gcgctgtgggacacacacctggagg

SEQ ID NO: 941757 - DNA, 25 bp, Mus musculus
gcgctgtgggacactaagcacctgg

SEQ ID NO: 941758 - DNA, 25 bp, Mus musculus
gcgctgtgggacactcacctggagg

SEQ ID NO: 941759 - DNA, 25 bp, Mus musculus
gcgcttaagtttatcaattcctcag

SEQ ID NO: 941760 - DNA, 25 bp, Mus musculus
gcgcttaagtttatcgctgcagttc

SEQ ID NO: 941761 - DNA, 25 bp, Mus musculus
gcgcttaagtttatctgctctatgc

SEQ ID NO: 941762 - DNA, 25 bp, Mus musculus
gcgcttaagtttatgaattcctcag

SEQ ID NO: 941763 - DNA, 25 bp, Mus musculus
gcgcttaagtttatggctgcagttc

SEQ ID NO: 941764 - DNA, 25 bp, Mus musculus
gcgcttaagtttatgtgctctatgc

SEQ ID NO: 941765 - DNA, 25 bp, Mus musculus
gcgcttaatagaatcttctggatct

SEQ ID NO: 941766 - DNA, 25 bp, Mus musculus
gcgcttaatagattcttctggatct

SEQ ID NO: 941767 - DNA, 25 bp, Mus musculus
gcgcttatttgacgagaatgagatc

SEQ ID NO: 941768 - DNA, 25 bp, Mus musculus
gcgcttatttgaggagaatgagatc

SEQ ID NO: 941769 - DNA, 25 bp, Mus musculus
gcgcttctatcaaacctgttcctga

SEQ ID NO: 941770 - DNA, 25 bp, Mus musculus
gcgcttctatcaaagctgttcctga

SEQ ID NO: 941771 - DNA, 25 bp, Mus musculus
gcgcttcttcctgccggacatcacc

SEQ ID NO: 941772 - DNA, 25 bp, Mus musculus
gcgcttcttcctgcgggacatcacc

SEQ ID NO: 941773 - DNA, 25 bp, Mus musculus
gcgcttgcagaaggggcgcctaagc

SEQ ID NO: 941774 - DNA, 25 bp, Mus musculus
gcgcttgcagccatgacgagtgtgc

SEQ ID NO: 941775 - DNA, 25 bp, Mus musculus
gcgcttgcaggcatgacgagtgtgc

SEQ ID NO: 941776 - DNA, 25 bp, Mus musculus
gcgcttgcagtaggggcgcctaagc

SEQ ID NO: 941777 - DNA, 25 bp, Mus musculus
gcgcttggcagacccagacatcaga

SEQ ID NO: 941778 - DNA, 25 bp, Mus musculus
gcgcttggcagagccagacatcaga

SEQ ID NO: 941779 - DNA, 25 bp, Mus musculus
gcgctttgagcgcctgaagaagatc

SEQ ID NO: 941780 - DNA, 25 bp, Mus musculus
gcgctttgagggcctgaagaagatc

SEQ ID NO: 941781 - DNA, 25 bp, Mus musculus
gcggaaattacacataaatttgggc

SEQ ID NO: 941782 - DNA, 25 bp, Mus musculus
gcggaaattacagataaatttgggc

SEQ ID NO: 941783 - DNA, 25 bp, Mus musculus
gcggaaattaggccaagagccagag

SEQ ID NO: 941784 - DNA, 25 bp, Mus musculus
gcggaaattagggcaagagccagag

SEQ ID NO: 941785 - DNA, 25 bp, Mus musculus
gcggaagaacaccaaagagtgagta

SEQ ID NO: 941786 - DNA, 25 bp, Mus musculus
gcggaagaacaccatagagtgagta

SEQ ID NO: 941787 - DNA, 25 bp, Mus musculus
gcggaagcaagagactgaaccacgt

SEQ ID NO: 941788 - DNA, 25 bp, Mus musculus
gcggaagcaagagagtgaaccacgt

SEQ ID NO: 941789 - DNA, 25 bp, Mus musculus
gcggaagcacaacgacctgtacctg

SEQ ID NO: 941790 - DNA, 25 bp, Mus musculus
gcggaagcacaaggacctgtacctg

SEQ ID NO: 941791 - DNA, 25 bp, Mus musculus
gcggaagcatggaaactagagagat

SEQ ID NO: 941792 - DNA, 25 bp, Mus musculus
gcggaagcatggtaactagagagat

SEQ ID NO: 941793 - DNA, 25 bp, Mus musculus
gcggaagcggagaggtcatctcaga

SEQ ID NO: 941794 - DNA, 25 bp, Mus musculus
gcggaagcggagtggtcatctcaga

SEQ ID NO: 941795 - DNA, 25 bp, Mus musculus
gcggaatagaggcaaacaggccacc

SEQ ID NO: 941796 - DNA, 25 bp, Mus musculus
gcggaatagagggaaacaggccacc

SEQ ID NO: 941797 - DNA, 25 bp, Mus musculus
gcggaattcacaagtggatcagcga

SEQ ID NO: 941798 - DNA, 25 bp, Mus musculus
gcggaattcacatgtggatcagcga

SEQ ID NO: 941799 - DNA, 25 bp, Mus musculus
gcggaatttccgcatccgaggatgt

SEQ ID NO: 941800 - DNA, 25 bp, Mus musculus
gcggaatttccggatccgaggatgt

SEQ ID NO: 941801 - DNA, 25 bp, Mus musculus
gcggacaccgcacgcagtgtccttg

SEQ ID NO: 941802 - DNA, 25 bp, Mus musculus
gcggacaccgcaggcagtgtccttg

SEQ ID NO: 941803 - DNA, 25 bp, Mus musculus
gcggacacgtatcatcctatctaag

SEQ ID NO: 941804 - DNA, 25 bp, Mus musculus
gcggacacgtcaatgtctgaagccg

SEQ ID NO: 941805 - DNA, 25 bp, Mus musculus
gcggacacgtcttttgctctgcatg

SEQ ID NO: 941806 - DNA, 25 bp, Mus musculus
gcggacacgtgaatgtctgaagccg

SEQ ID NO: 941807 - DNA, 25 bp, Mus musculus
gcggacacgtgttttgctctgcatg

SEQ ID NO: 941808 - DNA, 25 bp, Mus musculus
gcggacacgtttcatcctatctaag

SEQ ID NO: 941809 - DNA, 25 bp, Mus musculus
gcggacacttgtcaagcagcaggaa

SEQ ID NO: 941810 - DNA, 25 bp, Mus musculus
gcggacacttgtcgagcattctgga

SEQ ID NO: 941811 - DNA, 25 bp, Mus musculus
gcggacacttgtgaagcagcaggaa

SEQ ID NO: 941812 - DNA, 25 bp, Mus musculus
gcggacacttgtggagcattctgga

SEQ ID NO: 941813 - DNA, 25 bp, Mus musculus
gcggacatcatgcagtatgctgtga

SEQ ID NO: 941814 - DNA, 25 bp, Mus musculus
gcggacatcatggagtatgctgtga

SEQ ID NO: 941815 - DNA, 25 bp, Mus musculus
gcggacatcttcctcaggaatgtca

SEQ ID NO: 941816 - DNA, 25 bp, Mus musculus
gcggacatcttcctcgacacatctt

SEQ ID NO: 941817 - DNA, 25 bp, Mus musculus
gcggacatcttcctgaggaatgtca

SEQ ID NO: 941818 - DNA, 25 bp, Mus musculus
gcggacatcttcctggacacatctt

SEQ ID NO: 941819 - DNA, 25 bp, Mus musculus
gcggacccagagtgcttgggatccc

SEQ ID NO: 941820 - DNA, 25 bp, Mus musculus
gcggacccagtgtgcttgggatccc

SEQ ID NO: 941821 - DNA, 25 bp, Mus musculus
gcggaccctggcctccctgagggat

SEQ ID NO: 941822 - DNA, 25 bp, Mus musculus
gcggaccctggcctgcctgagggat

SEQ ID NO: 941823 - DNA, 25 bp, Mus musculus
gcggacgcgctgcgaggatctggat

SEQ ID NO: 941824 - DNA, 25 bp, Mus musculus
gcggacgcgctgggaggatctggat

SEQ ID NO: 941825 - DNA, 25 bp, Mus musculus
gcggactacttacctgaagccagga

SEQ ID NO: 941826 - DNA, 25 bp, Mus musculus
gcggactacttagctgaagccagga

SEQ ID NO: 941827 - DNA, 25 bp, Mus musculus
gcggacttcacttctatttggcttg

SEQ ID NO: 941828 - DNA, 25 bp, Mus musculus
gcggacttcagttctatttggcttg

SEQ ID NO: 941829 - DNA, 25 bp, Mus musculus
gcggagaaagagctctccgagcaga

SEQ ID NO: 941830 - DNA, 25 bp, Mus musculus
gcggagaaagctctccgagcagatt

SEQ ID NO: 941831 - DNA, 25 bp, Mus musculus
gcggagaaaggtctccgagcagatt

SEQ ID NO: 941832 - DNA, 25 bp, Mus musculus
gcggagaaagtgctctccgagcaga

SEQ ID NO: 941833 - DNA, 25 bp, Mus musculus
gcggagaagtggagaaggccttgga

SEQ ID NO: 941834 - DNA, 25 bp, Mus musculus
gcggagaagtggatgtcgcgtggag

SEQ ID NO: 941835 - DNA, 25 bp, Mus musculus
gcggagaagtggtgaaggccttgga

SEQ ID NO: 941836 - DNA, 25 bp, Mus musculus
gcggagaagtggttgtcgcgtggag

SEQ ID NO: 941837 - DNA, 25 bp, Mus musculus
gcggagaatgtttgcatattgatga

SEQ ID NO: 941838 - DNA, 25 bp, Mus musculus
gcggagaatgtttggatattgatga

SEQ ID NO: 941839 - DNA, 25 bp, Mus musculus
gcggagacagcgggctcaccctacc

SEQ ID NO: 941840 - DNA, 25 bp, Mus musculus
gcggagacagcttgcagaattcagc

SEQ ID NO: 941841 - DNA, 25 bp, Mus musculus
gcggagacagctttcggccgagtcc

SEQ ID NO: 941842 - DNA, 25 bp, Mus musculus
gcggagacagggggctcaccctacc

SEQ ID NO: 941843 - DNA, 25 bp, Mus musculus
gcggagacaggttgcagaattcagc

SEQ ID NO: 941844 - DNA, 25 bp, Mus musculus
gcggagacaggtttcggccgagtcc

SEQ ID NO: 941845 - DNA, 25 bp, Mus musculus
gcggagactccacgtgctgaagtcc

SEQ ID NO: 941846 - DNA, 25 bp, Mus musculus
gcggagactccaggtgctgaagtcc

SEQ ID NO: 941847 - DNA, 25 bp, Mus musculus
gcggagagactgcgatgagcacagc

SEQ ID NO: 941848 - DNA, 25 bp, Mus musculus
gcggagagactgggatgagcacagc

SEQ ID NO: 941849 - DNA, 25 bp, Mus musculus
gcggagagagctgagatggtggttg

SEQ ID NO: 941850 - DNA, 25 bp, Mus musculus
gcggagagaggtgagatggtggttg

SEQ ID NO: 941851 - DNA, 25 bp, Mus musculus
gcggagagcgacatgtccttccgaa

SEQ ID NO: 941852 - DNA, 25 bp, Mus musculus
gcggagagcgtcatgtccttccgaa

SEQ ID NO: 941853 - DNA, 25 bp, Mus musculus
gcggagcagaatcatttccagagca

SEQ ID NO: 941854 - DNA, 25 bp, Mus musculus
gcggagcagaatgatttccagagca

SEQ ID NO: 941855 - DNA, 25 bp, Mus musculus
gcggagcatatgctcatcctgggca

SEQ ID NO: 941856 - DNA, 25 bp, Mus musculus
gcggagcatatgctgatcctgggca

SEQ ID NO: 941857 - DNA, 25 bp, Mus musculus
gcggagccactgaccgaccagagtg

SEQ ID NO: 941858 - DNA, 25 bp, Mus musculus
gcggagccactgacggaccagagtg

SEQ ID NO: 941859 - DNA, 25 bp, Mus musculus
gcggagcttttgcacgtggctttgc

SEQ ID NO: 941860 - DNA, 25 bp, Mus musculus
gcggagcttttgcaggtggctttgc

SEQ ID NO: 941861 - DNA, 25 bp, Mus musculus
gcggaggagccacgaaggtggtcag

SEQ ID NO: 941862 - DNA, 25 bp, Mus musculus
gcggaggagccaggaaggtggtcag

SEQ ID NO: 941863 - DNA, 25 bp, Mus musculus
gcggaggaggcgcacgagcaaaaat

SEQ ID NO: 941864 - DNA, 25 bp, Mus musculus
gcggaggaggcggacgagcaaaaat

SEQ ID NO: 941865 - DNA, 25 bp, Mus musculus
gcggaggattcacgtatgggaccca

SEQ ID NO: 941866 - DNA, 25 bp, Mus musculus
gcggaggattcaggtatgggaccca

SEQ ID NO: 941867 - DNA, 25 bp, Mus musculus
gcggaggccgcgagtaatgttcaag

SEQ ID NO: 941868 - DNA, 25 bp, Mus musculus
gcggaggccgcgtgtaatgttcaag

SEQ ID NO: 941869 - DNA, 25 bp, Mus musculus
gcggaggtaatcgacaggctgagta

SEQ ID NO: 941870 - DNA, 25 bp, Mus musculus
gcggaggtaatcgagaggctgagta

SEQ ID NO: 941871 - DNA, 25 bp, Mus musculus
gcggaggtgcagctgaagttgacct

SEQ ID NO: 941872 - DNA, 25 bp, Mus musculus
gcggaggtgcaggtgaagttgacct

SEQ ID NO: 941873 - DNA, 25 bp, Mus musculus
gcggatgaacaagacctgtactacc

SEQ ID NO: 941874 - DNA, 25 bp, Mus musculus
gcggatgaacaagagctgtactacc

SEQ ID NO: 941875 - DNA, 25 bp, Mus musculus
gcggcaaaagagctttatggatttc

SEQ ID NO: 941876 - DNA, 25 bp, Mus musculus
gcggcaaaagagtgatagaaggaag

SEQ ID NO: 941877 - DNA, 25 bp, Mus musculus
gcggcaaaagtgctttatggatttc

SEQ ID NO: 941878 - DNA, 25 bp, Mus musculus
gcggcaaaagtgtgatagaaggaag

SEQ ID NO: 941879 - DNA, 25 bp, Mus musculus
gcggcaaagcaaaggacattctcct

SEQ ID NO: 941880 - DNA, 25 bp, Mus musculus
gcggcaaagcaatggacattctcct

SEQ ID NO: 941881 - DNA, 25 bp, Mus musculus
gcggcaatgcagagggaggagaagc

SEQ ID NO: 941882 - DNA, 25 bp, Mus musculus
gcggcaatgcagtgggaggagaagc

SEQ ID NO: 941883 - DNA, 25 bp, Mus musculus
gcggcacagcctcacctgtgattgg

SEQ ID NO: 941884 - DNA, 25 bp, Mus musculus
gcggcacagcctcagctgtgattgg

SEQ ID NO: 941885 - DNA, 25 bp, Mus musculus
gcggcaccagccccgggtggaacgc

SEQ ID NO: 941886 - DNA, 25 bp, Mus musculus
gcggcaccaggcccgggtggaacgc

SEQ ID NO: 941887 - DNA, 25 bp, Mus musculus
gcggcagagcagaccattaagcacc

SEQ ID NO: 941888 - DNA, 25 bp, Mus musculus
gcggcagagcagtccattaagcacc

SEQ ID NO: 941889 - DNA, 25 bp, Mus musculus
gcggcagcaacacgagcagctcctg

SEQ ID NO: 941890 - DNA, 25 bp, Mus musculus
gcggcagcaacaggagcagctcctg

SEQ ID NO: 941891 - DNA, 25 bp, Mus musculus
gcggcagcagcacgggtaccatccc

SEQ ID NO: 941892 - DNA, 25 bp, Mus musculus
gcggcagcagcaggggtaccatccc

SEQ ID NO: 941893 - DNA, 25 bp, Mus musculus
gcggcagcagcgcaccctcaggctg

SEQ ID NO: 941894 - DNA, 25 bp, Mus musculus
gcggcagcagcgcagcctcaggctg

SEQ ID NO: 941895 - DNA, 25 bp, Mus musculus
gcggcagcgacaaggcctttgcctc

SEQ ID NO: 941896 - DNA, 25 bp, Mus musculus
gcggcagcgacatggcctttgcctc

SEQ ID NO: 941897 - DNA, 25 bp, Mus musculus
gcggcagctgctcaccctgagcaat

SEQ ID NO: 941898 - DNA, 25 bp, Mus musculus
gcggcagctgctgaccctgagcaat

SEQ ID NO: 941899 - DNA, 25 bp, Mus musculus
gcggcagtagagacagatacagagt

SEQ ID NO: 941900 - DNA, 25 bp, Mus musculus
gcggcagtagagtcagatacagagt

SEQ ID NO: 941901 - DNA, 25 bp, Mus musculus
gcggcatctcaaacttgagtatcac

SEQ ID NO: 941902 - DNA, 25 bp, Mus musculus
gcggcatctcaatcttgagtatcac

SEQ ID NO: 941903 - DNA, 25 bp, Mus musculus
gcggcatctctgcggcccacatgaa

SEQ ID NO: 941904 - DNA, 25 bp, Mus musculus
gcggcatctctggggcccacatgaa

SEQ ID NO: 941905 - DNA, 25 bp, Mus musculus
gcggcatgagcgtcgagagggcatg

SEQ ID NO: 941906 - DNA, 25 bp, Mus musculus
gcggcatgagggtcgagagggcatg

SEQ ID NO: 941907 - DNA, 25 bp, Mus musculus
gcggcatgccagaacctgtaattga

SEQ ID NO: 941908 - DNA, 25 bp, Mus musculus
gcggcatgccagtacctgtaattga

SEQ ID NO: 941909 - DNA, 25 bp, Mus musculus
gcggccaccctgggcccgtcgggat

SEQ ID NO: 941910 - DNA, 25 bp, Mus musculus
gcggccaccctggggccgtcgggat

SEQ ID NO: 941911 - DNA, 25 bp, Mus musculus
gcggccagcccacggcaaacgctac

SEQ ID NO: 941912 - DNA, 25 bp, Mus musculus
gcggccagcccacgggcacctaccc

SEQ ID NO: 941913 - DNA, 25 bp, Mus musculus
gcggccagcccagggcaaacgctac

SEQ ID NO: 941914 - DNA, 25 bp, Mus musculus
gcggccagcccaggggcacctaccc

SEQ ID NO: 941915 - DNA, 25 bp, Mus musculus
gcggccaggagcttcgtttgaagga

SEQ ID NO: 941916 - DNA, 25 bp, Mus musculus
gcggccaggagcttggtttgaagga

SEQ ID NO: 941917 - DNA, 25 bp, Mus musculus
gcggccatgaagaacaattgccagc

SEQ ID NO: 941918 - DNA, 25 bp, Mus musculus
gcggccatgaagaacgtgaccgagc

SEQ ID NO: 941919 - DNA, 25 bp, Mus musculus
gcggccatgaagaacttccacagga

SEQ ID NO: 941920 - DNA, 25 bp, Mus musculus
gcggccatgaagaagaattgccagc

SEQ ID NO: 941921 - DNA, 25 bp, Mus musculus
gcggccatgaagaaggtgaccgagc

SEQ ID NO: 941922 - DNA, 25 bp, Mus musculus
gcggccatgaagaagttccacagga

SEQ ID NO: 941923 - DNA, 25 bp, Mus musculus
gcggccatgaagcatgtctgctgtg

SEQ ID NO: 941924 - DNA, 25 bp, Mus musculus
gcggccatgaagccgggtgctactt

SEQ ID NO: 941925 - DNA, 25 bp, Mus musculus
gcggccatgaaggatgtctgctgtg

SEQ ID NO: 941926 - DNA, 25 bp, Mus musculus
gcggccatgaaggcgggtgctactt

SEQ ID NO: 941927 - DNA, 25 bp, Mus musculus
gcggcccacccacgacctgtgaact

SEQ ID NO: 941928 - DNA, 25 bp, Mus musculus
gcggcccacccaggacctgtgaact

SEQ ID NO: 941929 - DNA, 25 bp, Mus musculus
gcggcccctgcacaagactgctagc

SEQ ID NO: 941930 - DNA, 25 bp, Mus musculus
gcggcccctgcagaagactgctagc

SEQ ID NO: 941931 - DNA, 25 bp, Mus musculus
gcggccctgcagatcaccagcaaaa

SEQ ID NO: 941932 - DNA, 25 bp, Mus musculus
gcggccctgcagcagtgactagcac

SEQ ID NO: 941933 - DNA, 25 bp, Mus musculus
gcggccctgcaggagtgactagcac

SEQ ID NO: 941934 - DNA, 25 bp, Mus musculus
gcggccctgcagttcaccagcaaaa

SEQ ID NO: 941935 - DNA, 25 bp, Mus musculus
gcggccgaagctgacatactccatg

SEQ ID NO: 941936 - DNA, 25 bp, Mus musculus
gcggccgaagctgagatactccatg

SEQ ID NO: 941937 - DNA, 25 bp, Mus musculus
gcggccgaccagatgtgaggtgaga

SEQ ID NO: 941938 - DNA, 25 bp, Mus musculus
gcggccgaccagttgtgaggtgaga

SEQ ID NO: 941939 - DNA, 25 bp, Mus musculus
gcggccgaggtccacttacaggagg

SEQ ID NO: 941940 - DNA, 25 bp, Mus musculus
gcggccgaggtccagttacaggagg

SEQ ID NO: 941941 - DNA, 25 bp, Mus musculus
gcggccgctgtcaaaagtcttgcgc

SEQ ID NO: 941942 - DNA, 25 bp, Mus musculus
gcggccgctgtcaatagtcttgcgc

SEQ ID NO: 941943 - DNA, 25 bp, Mus musculus
gcggccggagtgccctctgcatcct

SEQ ID NO: 941944 - DNA, 25 bp, Mus musculus
gcggccggagtgcgctggtgttccc

SEQ ID NO: 941945 - DNA, 25 bp, Mus musculus
gcggccggagtggcctctgcatcct

SEQ ID NO: 941946 - DNA, 25 bp, Mus musculus
gcggccggagtgggctggtgttccc

SEQ ID NO: 941947 - DNA, 25 bp, Mus musculus
gcggccgggagacaccctcaggact

SEQ ID NO: 941948 - DNA, 25 bp, Mus musculus
gcggccgggagacacgcagtgagaa

SEQ ID NO: 941949 - DNA, 25 bp, Mus musculus
gcggccgggagagaccctcaggact

SEQ ID NO: 941950 - DNA, 25 bp, Mus musculus
gcggccgggagagacgcagtgagaa

SEQ ID NO: 941951 - DNA, 25 bp, Mus musculus
gcggccgggctccacctcttcactt

SEQ ID NO: 941952 - DNA, 25 bp, Mus musculus
gcggccgggctccagctcttcactt

SEQ ID NO: 941953 - DNA, 25 bp, Mus musculus
gcggccggtctctccttctcatcgc

SEQ ID NO: 941954 - DNA, 25 bp, Mus musculus
gcggccggtctctcgttctcatcgc

SEQ ID NO: 941955 - DNA, 25 bp, Mus musculus
gcggccggttccgacgtgtgtgagg

SEQ ID NO: 941956 - DNA, 25 bp, Mus musculus
gcggccggttccgaggtgtgtgagg

SEQ ID NO: 941957 - DNA, 25 bp, Mus musculus
gcggcctacaaacagctagtgactt

SEQ ID NO: 941958 - DNA, 25 bp, Mus musculus
gcggcctacaaagagctagtgactt

SEQ ID NO: 941959 - DNA, 25 bp, Mus musculus
gcggcctagaacaccgtctgcaaag

SEQ ID NO: 941960 - DNA, 25 bp, Mus musculus
gcggcctagaacacggtctgcaaag

SEQ ID NO: 941961 - DNA, 25 bp, Mus musculus
gcggcctgaccccgctccactctag

SEQ ID NO: 941962 - DNA, 25 bp, Mus musculus
gcggcctgacccggctccactctag

SEQ ID NO: 941963 - DNA, 25 bp, Mus musculus
gcggcctggccccgacttagcattc

SEQ ID NO: 941964 - DNA, 25 bp, Mus musculus
gcggcctggcccggacttagcattc

SEQ ID NO: 941965 - DNA, 25 bp, Mus musculus
gcggcctgtgagcgtcaaagcttgc

SEQ ID NO: 941966 - DNA, 25 bp, Mus musculus
gcggcctgtgagggtcaaagcttgc

SEQ ID NO: 941967 - DNA, 25 bp, Mus musculus
gcggccttgcttcacgcgtctgtgg

SEQ ID NO: 941968 - DNA, 25 bp, Mus musculus
gcggccttgcttcaggcgtctgtgg

SEQ ID NO: 941969 - DNA, 25 bp, Mus musculus
gcggcgacagctcttctacttacaa

SEQ ID NO: 941970 - DNA, 25 bp, Mus musculus
gcggcgacaggtcttctacttacaa

SEQ ID NO: 941971 - DNA, 25 bp, Mus musculus
gcggcgcaggcaccaaagcgccccc

SEQ ID NO: 941972 - DNA, 25 bp, Mus musculus
gcggcgcaggcagcaaagcgccccc

SEQ ID NO: 941973 - DNA, 25 bp, Mus musculus
gcggcgcctgaacgaactcatcggt

SEQ ID NO: 941974 - DNA, 25 bp, Mus musculus
gcggcgcctgaaggaactcatcggt

SEQ ID NO: 941975 - DNA, 25 bp, Mus musculus
gcggcgcgcacacagctgaagcgct

SEQ ID NO: 941976 - DNA, 25 bp, Mus musculus
gcggcgcgcacacctgggtggctgt

SEQ ID NO: 941977 - DNA, 25 bp, Mus musculus
gcggcgcgcacagagctgaagcgct

SEQ ID NO: 941978 - DNA, 25 bp, Mus musculus
gcggcgcgcacagctgggtggctgt

SEQ ID NO: 941979 - DNA, 25 bp, Mus musculus
gcggcgcgccgacggtgtgtgggat

SEQ ID NO: 941980 - DNA, 25 bp, Mus musculus
gcggcgcgccgacttgaactttcta

SEQ ID NO: 941981 - DNA, 25 bp, Mus musculus
gcggcgcgccgagggtgtgtgggat

SEQ ID NO: 941982 - DNA, 25 bp, Mus musculus
gcggcgcgccgagttgaactttcta

SEQ ID NO: 941983 - DNA, 25 bp, Mus musculus
gcggcgcgcgcacaggtttcatagt

SEQ ID NO: 941984 - DNA, 25 bp, Mus musculus
gcggcgcgcgcagaggtttcatagt

SEQ ID NO: 941985 - DNA, 25 bp, Mus musculus
gcggcgcgggagctgctggagagtc

SEQ ID NO: 941986 - DNA, 25 bp, Mus musculus
gcggcgcgggaggtgctggagagtc

SEQ ID NO: 941987 - DNA, 25 bp, Mus musculus
gcggcgcgggcagccgtaaaatgtc

SEQ ID NO: 941988 - DNA, 25 bp, Mus musculus
gcggcgcgggcagcggtaaaatgtc

SEQ ID NO: 941989 - DNA, 25 bp, Mus musculus
gcggcgctggcgcgtgatgaagcct

SEQ ID NO: 941990 - DNA, 25 bp, Mus musculus
gcggcgctggcgcgtgttccgaatg

SEQ ID NO: 941991 - DNA, 25 bp, Mus musculus
gcggcgctggcgggtgatgaagcct

SEQ ID NO: 941992 - DNA, 25 bp, Mus musculus
gcggcgctggcgggtgttccgaatg

SEQ ID NO: 941993 - DNA, 25 bp, Mus musculus
gcggcgctgtcacatcaagatccac

SEQ ID NO: 941994 - DNA, 25 bp, Mus musculus
gcggcgctgtcagatcaagatccac

SEQ ID NO: 941995 - DNA, 25 bp, Mus musculus
gcggcggaagcggacaggtcatctc

SEQ ID NO: 941996 - DNA, 25 bp, Mus musculus
gcggcggaagcggagaggtcatctc

SEQ ID NO: 941997 - DNA, 25 bp, Mus musculus
gcggcggagcagaaatagatgaaga

SEQ ID NO: 941998 - DNA, 25 bp, Mus musculus
gcggcggagcagattcggaggcgcc

SEQ ID NO: 941999 - DNA, 25 bp, Mus musculus
gcggcggagcagtaatagatgaaga

SEQ ID NO: 942000 - DNA, 25 bp, Mus musculus
gcggcggagcagtttcggaggcgcc

SEQ ID NO: 942001 - DNA, 25 bp, Mus musculus
gcggcggcagaacccagcagtgatg

SEQ ID NO: 942002 - DNA, 25 bp, Mus musculus
gcggcggcagtacccagcagtgatg

SEQ ID NO: 942003 - DNA, 25 bp, Mus musculus
gcggcggcgccgctgccaagtgctg

SEQ ID NO: 942004 - DNA, 25 bp, Mus musculus
gcggcggcgccggtgccaagtgctg

SEQ ID NO: 942005 - DNA, 25 bp, Mus musculus
gcggcggcggcacaacccagcagtg

SEQ ID NO: 942006 - DNA, 25 bp, Mus musculus
gcggcggcggcagaacccagcagtg

SEQ ID NO: 942007 - DNA, 25 bp, Mus musculus
gcggcgggacaacctggggtctcag

SEQ ID NO: 942008 - DNA, 25 bp, Mus musculus
gcggcgggacaacgaggtctgaaga

SEQ ID NO: 942009 - DNA, 25 bp, Mus musculus
gcggcgggacaagctggggtctcag

SEQ ID NO: 942010 - DNA, 25 bp, Mus musculus
gcggcgggacaaggaggtctgaaga

SEQ ID NO: 942011 - DNA, 25 bp, Mus musculus
gcggcgggcgagcacagcagaccca

SEQ ID NO: 942012 - DNA, 25 bp, Mus musculus
gcggcgggcgagcacagcctctgga

SEQ ID NO: 942013 - DNA, 25 bp, Mus musculus
gcggcgggcgagcaccctctggatg

SEQ ID NO: 942014 - DNA, 25 bp, Mus musculus
gcggcgggcgagcacgtggaaggga

SEQ ID NO: 942015 - DNA, 25 bp, Mus musculus
gcggcgggcgagcagagcagaccca

SEQ ID NO: 942016 - DNA, 25 bp, Mus musculus
gcggcgggcgagcagagcctctgga

SEQ ID NO: 942017 - DNA, 25 bp, Mus musculus
gcggcgggcgagcagcctctggatg

SEQ ID NO: 942018 - DNA, 25 bp, Mus musculus
gcggcgggcgagcaggtggaaggga

SEQ ID NO: 942019 - DNA, 25 bp, Mus musculus
gcggcgggctgacgttttgcctgat

SEQ ID NO: 942020 - DNA, 25 bp, Mus musculus
gcggcgggctgaggttttgcctgat

SEQ ID NO: 942021 - DNA, 25 bp, Mus musculus
gcggcggttgagacttctccattcc

SEQ ID NO: 942022 - DNA, 25 bp, Mus musculus
gcggcggttgagtcttctccattcc

SEQ ID NO: 942023 - DNA, 25 bp, Mus musculus
gcggcgtgagcccagatcatgcaga

SEQ ID NO: 942024 - DNA, 25 bp, Mus musculus
gcggcgtgaggccagatcatgcaga

SEQ ID NO: 942025 - DNA, 25 bp, Mus musculus
gcggctcaagctggcccagctgctt

SEQ ID NO: 942026 - DNA, 25 bp, Mus musculus
gcggctcaaggtggcccagctgctt

SEQ ID NO: 942027 - DNA, 25 bp, Mus musculus
gcggctcaccggctcgattctggcc

SEQ ID NO: 942028 - DNA, 25 bp, Mus musculus
gcggctcaccgggtcgattctggcc

SEQ ID NO: 942029 - DNA, 25 bp, Mus musculus
gcggctctcaagcagaaaaatggct

SEQ ID NO: 942030 - DNA, 25 bp, Mus musculus
gcggctctcaagcaggccaaagcaa

SEQ ID NO: 942031 - DNA, 25 bp, Mus musculus
gcggctctcaaggagaaaaatggct

SEQ ID NO: 942032 - DNA, 25 bp, Mus musculus
gcggctctcaaggaggccaaagcaa

SEQ ID NO: 942033 - DNA, 25 bp, Mus musculus
gcggctcttgagcttttagaagagg

SEQ ID NO: 942034 - DNA, 25 bp, Mus musculus
gcggctcttgaggttttagaagagg

SEQ ID NO: 942035 - DNA, 25 bp, Mus musculus
gcggctgcagcacgccaccatggca

SEQ ID NO: 942036 - DNA, 25 bp, Mus musculus
gcggctgcagcaggccaccatggca

SEQ ID NO: 942037 - DNA, 25 bp, Mus musculus
gcggctgcgagaccttcctctcaca

SEQ ID NO: 942038 - DNA, 25 bp, Mus musculus
gcggctgcgagagcttcctctcaca

SEQ ID NO: 942039 - DNA, 25 bp, Mus musculus
gcggctggaagaccaacaaagaaga

SEQ ID NO: 942040 - DNA, 25 bp, Mus musculus
gcggctggaagagcaacaaagaaga

SEQ ID NO: 942041 - DNA, 25 bp, Mus musculus
gcggctggagagcccacgatggcct

SEQ ID NO: 942042 - DNA, 25 bp, Mus musculus
gcggctggagcttttcccgctcaga

SEQ ID NO: 942043 - DNA, 25 bp, Mus musculus
gcggctggaggttttcccgctcaga

SEQ ID NO: 942044 - DNA, 25 bp, Mus musculus
gcggctggagtgcccacgatggcct

SEQ ID NO: 942045 - DNA, 25 bp, Mus musculus
gcggctgtatgtccacagccccgag

SEQ ID NO: 942046 - DNA, 25 bp, Mus musculus
gcggctgtatgtccagcacagcccc

SEQ ID NO: 942047 - DNA, 25 bp, Mus musculus
gcggctgtatgtcgacggatgacga

SEQ ID NO: 942048 - DNA, 25 bp, Mus musculus
gcggctgtatgtgcacagccccgag

SEQ ID NO: 942049 - DNA, 25 bp, Mus musculus
gcggctgtatgtgcagcacagcccc

SEQ ID NO: 942050 - DNA, 25 bp, Mus musculus
gcggctgtatgtggacggatgacga

SEQ ID NO: 942051 - DNA, 25 bp, Mus musculus
gcggctttccttccagtaacgttca

SEQ ID NO: 942052 - DNA, 25 bp, Mus musculus
gcggctttccttcctgtaacgttca

SEQ ID NO: 942053 - DNA, 25 bp, Mus musculus
gcgggaaacccctgaagctgacgta

SEQ ID NO: 942054 - DNA, 25 bp, Mus musculus
gcgggaaaccgctgaagctgacgta

SEQ ID NO: 942055 - DNA, 25 bp, Mus musculus
gcgggaacgcatcgaattgacgaca

SEQ ID NO: 942056 - DNA, 25 bp, Mus musculus
gcgggaacgcatcgtattgacgaca

SEQ ID NO: 942057 - DNA, 25 bp, Mus musculus
gcgggaactgctcgtgtgatccttg

SEQ ID NO: 942058 - DNA, 25 bp, Mus musculus
gcgggaactgctggtgtgatccttg

SEQ ID NO: 942059 - DNA, 25 bp, Mus musculus
gcgggaagaggacgccaagtcagaa

SEQ ID NO: 942060 - DNA, 25 bp, Mus musculus
gcgggaagaggaggccaagtcagaa

SEQ ID NO: 942061 - DNA, 25 bp, Mus musculus
gcgggaagcgccggcggccctggtg

SEQ ID NO: 942062 - DNA, 25 bp, Mus musculus
gcgggaagcggcggcggccctggtg

SEQ ID NO: 942063 - DNA, 25 bp, Mus musculus
gcgggaagctaacaaactgaggctc

SEQ ID NO: 942064 - DNA, 25 bp, Mus musculus
gcgggaagctaagaaactgaggctc

SEQ ID NO: 942065 - DNA, 25 bp, Mus musculus
gcgggaatgtcaagcagtaggtaga

SEQ ID NO: 942066 - DNA, 25 bp, Mus musculus
gcgggaatgtgaagcagtaggtaga

SEQ ID NO: 942067 - DNA, 25 bp, Mus musculus
gcgggaattgctctcggtgtgatta

SEQ ID NO: 942068 - DNA, 25 bp, Mus musculus
gcgggaattgctctgggcgtcatca

SEQ ID NO: 942069 - DNA, 25 bp, Mus musculus
gcgggaattgctcttggagttctta

SEQ ID NO: 942070 - DNA, 25 bp, Mus musculus
gcgggaattggtctcggtgtgatta

SEQ ID NO: 942071 - DNA, 25 bp, Mus musculus
gcgggaattggtctgggcgtcatca

SEQ ID NO: 942072 - DNA, 25 bp, Mus musculus
gcgggaattggtcttggagttctta

SEQ ID NO: 942073 - DNA, 25 bp, Mus musculus
gcgggacaagcaggtctgaagaagg

SEQ ID NO: 942074 - DNA, 25 bp, Mus musculus
gcgggacaagctggggtctcagaat

SEQ ID NO: 942075 - DNA, 25 bp, Mus musculus
gcgggacaaggaggtctgaagaagg

SEQ ID NO: 942076 - DNA, 25 bp, Mus musculus
gcgggacaaggtggggtctcagaat

SEQ ID NO: 942077 - DNA, 25 bp, Mus musculus
gcgggacacacacgttatctgtcct

SEQ ID NO: 942078 - DNA, 25 bp, Mus musculus
gcgggacacacaggttatctgtcct

SEQ ID NO: 942079 - DNA, 25 bp, Mus musculus
gcgggacccgagatccacgtgtcgg

SEQ ID NO: 942080 - DNA, 25 bp, Mus musculus
gcgggacccgagatcccactgagat

SEQ ID NO: 942081 - DNA, 25 bp, Mus musculus
gcgggacccgagcagatcccactga

SEQ ID NO: 942082 - DNA, 25 bp, Mus musculus
gcgggacccgagctgtgtctcttca

SEQ ID NO: 942083 - DNA, 25 bp, Mus musculus
gcgggacccgaggagatcccactga

SEQ ID NO: 942084 - DNA, 25 bp, Mus musculus
gcgggacccgaggtgtgtctcttca

SEQ ID NO: 942085 - DNA, 25 bp, Mus musculus
gcgggacccgagttccacgtgtcgg

SEQ ID NO: 942086 - DNA, 25 bp, Mus musculus
gcgggacccgagttcccactgagat

SEQ ID NO: 942087 - DNA, 25 bp, Mus musculus
gcgggacgcaaacgaggaagccagc

SEQ ID NO: 942088 - DNA, 25 bp, Mus musculus
gcgggacgcaaaggaggaagccagc

SEQ ID NO: 942089 - DNA, 25 bp, Mus musculus
gcgggactacgtcacgctgttcggc

SEQ ID NO: 942090 - DNA, 25 bp, Mus musculus
gcgggactacgtcaggctgttcggc

SEQ ID NO: 942091 - DNA, 25 bp, Mus musculus
gcgggagaagatggttggtaaaggc

SEQ ID NO: 942092 - DNA, 25 bp, Mus musculus
gcgggagaagcctctgcaccccgac

SEQ ID NO: 942093 - DNA, 25 bp, Mus musculus
gcgggagaagcttgatccaaaagat

SEQ ID NO: 942094 - DNA, 25 bp, Mus musculus
gcgggagaaggctctgcaccccgac

SEQ ID NO: 942095 - DNA, 25 bp, Mus musculus
gcgggagaaggttgatccaaaagat

SEQ ID NO: 942096 - DNA, 25 bp, Mus musculus
gcgggagaagttggttggtaaaggc

SEQ ID NO: 942097 - DNA, 25 bp, Mus musculus
gcgggagacctcaacgcttccaagg

SEQ ID NO: 942098 - DNA, 25 bp, Mus musculus
gcgggagacctcaaggcttccaagg

SEQ ID NO: 942099 - DNA, 25 bp, Mus musculus
gcgggagagagacgcccagctgatt

SEQ ID NO: 942100 - DNA, 25 bp, Mus musculus
gcgggagagagaggcccagctgatt

SEQ ID NO: 942101 - DNA, 25 bp, Mus musculus
gcgggagatggacgtcctggcaaca

SEQ ID NO: 942102 - DNA, 25 bp, Mus musculus
gcgggagatggaggtcctggcaaca

SEQ ID NO: 942103 - DNA, 25 bp, Mus musculus
gcgggagcagcaccccttggggaaa

SEQ ID NO: 942104 - DNA, 25 bp, Mus musculus
gcgggagcagcccggaagctcattt

SEQ ID NO: 942105 - DNA, 25 bp, Mus musculus
gcgggagcaggaccccttggggaaa

SEQ ID NO: 942106 - DNA, 25 bp, Mus musculus
gcgggagcaggccggaagctcattt

SEQ ID NO: 942107 - DNA, 25 bp, Mus musculus
gcgggaggcgcagacataaaggaga

SEQ ID NO: 942108 - DNA, 25 bp, Mus musculus
gcgggaggcgcagagataaaggaga

SEQ ID NO: 942109 - DNA, 25 bp, Mus musculus
gcgggatatgcacctgtgcccctgg

SEQ ID NO: 942110 - DNA, 25 bp, Mus musculus
gcgggatatgcagctgtgcccctgg

SEQ ID NO: 942111 - DNA, 25 bp, Mus musculus
gcgggatgtgcatattctgaaccac

SEQ ID NO: 942112 - DNA, 25 bp, Mus musculus
gcgggatgtggatattctgaaccac

SEQ ID NO: 942113 - DNA, 25 bp, Mus musculus
gcgggattcttccgcggaacaagtg

SEQ ID NO: 942114 - DNA, 25 bp, Mus musculus
gcgggattcttccggggaacaagtg

SEQ ID NO: 942115 - DNA, 25 bp, Mus musculus
gcgggcacagctggacgaccccccg

SEQ ID NO: 942116 - DNA, 25 bp, Mus musculus
gcgggcacaggtggacgaccccccg

SEQ ID NO: 942117 - DNA, 25 bp, Mus musculus
gcgggcacggcaatcgtacaagtac

SEQ ID NO: 942118 - DNA, 25 bp, Mus musculus
gcgggcacgggaatcgtacaagtac

SEQ ID NO: 942119 - DNA, 25 bp, Mus musculus
gcgggcagcgctaaaatgtcggctc

SEQ ID NO: 942120 - DNA, 25 bp, Mus musculus
gcgggcagcggtaaaatgtcggctc

SEQ ID NO: 942121 - DNA, 25 bp, Mus musculus
gcgggccaagagcaaagcccagaag

SEQ ID NO: 942122 - DNA, 25 bp, Mus musculus
gcgggccaagcagagcaaagcccag

SEQ ID NO: 942123 - DNA, 25 bp, Mus musculus
gcgggccaaggagagcaaagcccag

SEQ ID NO: 942124 - DNA, 25 bp, Mus musculus
gcgggccaagtgcaaagcccagaag

SEQ ID NO: 942125 - DNA, 25 bp, Mus musculus
gcgggccacagaagccaaccgtgtg

SEQ ID NO: 942126 - DNA, 25 bp, Mus musculus
gcgggccacagaaggcaaccgtgtg

SEQ ID NO: 942127 - DNA, 25 bp, Mus musculus
gcgggcccagatgctgatagcccaa

SEQ ID NO: 942128 - DNA, 25 bp, Mus musculus
gcgggcccagcagcccctggcgcag

SEQ ID NO: 942129 - DNA, 25 bp, Mus musculus
gcgggcccagcccctggcgcagctc

SEQ ID NO: 942130 - DNA, 25 bp, Mus musculus
gcgggcccaggagcccctggcgcag

SEQ ID NO: 942131 - DNA, 25 bp, Mus musculus
gcgggcccaggccctggcgcagctc

SEQ ID NO: 942132 - DNA, 25 bp, Mus musculus
gcgggcccagttgctgatagcccaa

SEQ ID NO: 942133 - DNA, 25 bp, Mus musculus
gcgggcccggaaatgcacttagcga

SEQ ID NO: 942134 - DNA, 25 bp, Mus musculus
gcgggcccggcactgtgcagcatgg

SEQ ID NO: 942135 - DNA, 25 bp, Mus musculus
gcgggcccgggactgtgcagcatgg

SEQ ID NO: 942136 - DNA, 25 bp, Mus musculus
gcgggcccggtaatgcacttagcga

SEQ ID NO: 942137 - DNA, 25 bp, Mus musculus
gcgggccgcgacatcgactgtcctg

SEQ ID NO: 942138 - DNA, 25 bp, Mus musculus
gcgggccgcgacatggactgtcctg

SEQ ID NO: 942139 - DNA, 25 bp, Mus musculus
gcgggcctcgcacagacctgatgtc

SEQ ID NO: 942140 - DNA, 25 bp, Mus musculus
gcgggcctcgcagagacctgatgtc

SEQ ID NO: 942141 - DNA, 25 bp, Mus musculus
gcgggcgaccgcagctgggcaggtg

SEQ ID NO: 942142 - DNA, 25 bp, Mus musculus
gcgggcgaccgcaggtgggcaggtg

SEQ ID NO: 942143 - DNA, 25 bp, Mus musculus
gcgggcgactcacgcaccatgagcc

SEQ ID NO: 942144 - DNA, 25 bp, Mus musculus
gcgggcgactcaggcaccatgagcc

SEQ ID NO: 942145 - DNA, 25 bp, Mus musculus
gcgggcgagcagagcagacccagga

SEQ ID NO: 942146 - DNA, 25 bp, Mus musculus
gcgggcgagcagagcctctggatgg

SEQ ID NO: 942147 - DNA, 25 bp, Mus musculus
gcgggcgagcagcctctggatggac

SEQ ID NO: 942148 - DNA, 25 bp, Mus musculus
gcgggcgagcagctggaagggactc

SEQ ID NO: 942149 - DNA, 25 bp, Mus musculus
gcgggcgagcaggctctggatggac

SEQ ID NO: 942150 - DNA, 25 bp, Mus musculus
gcgggcgagcaggtggaagggactc

SEQ ID NO: 942151 - DNA, 25 bp, Mus musculus
gcgggcgagcagtgcagacccagga

SEQ ID NO: 942152 - DNA, 25 bp, Mus musculus
gcgggcgagcagtgcctctggatgg

SEQ ID NO: 942153 - DNA, 25 bp, Mus musculus
gcgggcgcggattgtgccttctgaa

SEQ ID NO: 942154 - DNA, 25 bp, Mus musculus
gcgggcgcggtttgtgccttctgaa

SEQ ID NO: 942155 - DNA, 25 bp, Mus musculus
gcgggctcttctgacgtacctgaat

SEQ ID NO: 942156 - DNA, 25 bp, Mus musculus
gcgggctcttctgaggtacctgaat

SEQ ID NO: 942157 - DNA, 25 bp, Mus musculus
gcgggctgagcttttgcctgatttg

SEQ ID NO: 942158 - DNA, 25 bp, Mus musculus
gcgggctgaggttttgcctgatttg

SEQ ID NO: 942159 - DNA, 25 bp, Mus musculus
gcgggctgccagcagccgtggacgt

SEQ ID NO: 942160 - DNA, 25 bp, Mus musculus
gcgggctgccaggagccgtggacgt

SEQ ID NO: 942161 - DNA, 25 bp, Mus musculus
gcgggctttgcgaatgtcaaccttg

SEQ ID NO: 942162 - DNA, 25 bp, Mus musculus
gcgggctttgggaatgtcaaccttg

SEQ ID NO: 942163 - DNA, 25 bp, Mus musculus
gcggggacagatctcaagaccagag

SEQ ID NO: 942164 - DNA, 25 bp, Mus musculus
gcggggacagttctcaagaccagag

SEQ ID NO: 942165 - DNA, 25 bp, Mus musculus
gcggggactggacacctgggctgtc

SEQ ID NO: 942166 - DNA, 25 bp, Mus musculus
gcggggactggagacctgggctgtc

SEQ ID NO: 942167 - DNA, 25 bp, Mus musculus
gcggggatgcccaacgcatgaatgc

SEQ ID NO: 942168 - DNA, 25 bp, Mus musculus
gcggggatgcccaaggcatgaatgc

SEQ ID NO: 942169 - DNA, 25 bp, Mus musculus
gcggggatggtcgacgacttgcact

SEQ ID NO: 942170 - DNA, 25 bp, Mus musculus
gcggggatggtcgaggacttgcact

SEQ ID NO: 942171 - DNA, 25 bp, Mus musculus
gcggggcctgtcgtcatgtcaacga

SEQ ID NO: 942172 - DNA, 25 bp, Mus musculus
gcggggcctgtcgtgatgtcaacga

SEQ ID NO: 942173 - DNA, 25 bp, Mus musculus
gcggggcgagagtgcgctgtaaaaa

SEQ ID NO: 942174 - DNA, 25 bp, Mus musculus
gcggggcgagagtgggctgtaaaaa

SEQ ID NO: 942175 - DNA, 25 bp, Mus musculus
gcggggcgtgggattgaagtgagtg

SEQ ID NO: 942176 - DNA, 25 bp, Mus musculus
gcggggcgtgggtttgaagtgagtg

SEQ ID NO: 942177 - DNA, 25 bp, Mus musculus
gcggggctgtggatctttccagaac

SEQ ID NO: 942178 - DNA, 25 bp, Mus musculus
gcggggctgtggttctttccagaac

SEQ ID NO: 942179 - DNA, 25 bp, Mus musculus
gcggggcttgcaccaggtggttgca

SEQ ID NO: 942180 - DNA, 25 bp, Mus musculus
gcggggcttgcacgtggttgcattt

SEQ ID NO: 942181 - DNA, 25 bp, Mus musculus
gcggggcttgcagcaggtggttgca

SEQ ID NO: 942182 - DNA, 25 bp, Mus musculus
gcggggcttgcaggtggttgcattt

SEQ ID NO: 942183 - DNA, 25 bp, Mus musculus
gcgggggtgccacgcacttgagcat

SEQ ID NO: 942184 - DNA, 25 bp, Mus musculus
gcgggggtgccacgctgaccatcgt

SEQ ID NO: 942185 - DNA, 25 bp, Mus musculus
gcgggggtgccacggacttgagcat

SEQ ID NO: 942186 - DNA, 25 bp, Mus musculus
gcgggggtgccacggtgaccatcgt

SEQ ID NO: 942187 - DNA, 25 bp, Mus musculus
gcggggtgagacgatcctcctgcaa

SEQ ID NO: 942188 - DNA, 25 bp, Mus musculus
gcggggtgagtcgatcctcctgcaa

SEQ ID NO: 942189 - DNA, 25 bp, Mus musculus
gcggggtgcggacgtcgctcatccg

SEQ ID NO: 942190 - DNA, 25 bp, Mus musculus
gcggggtgcggaggtcgctcatccg

SEQ ID NO: 942191 - DNA, 25 bp, Mus musculus
gcgggtagccagcgagcacctgtga

SEQ ID NO: 942192 - DNA, 25 bp, Mus musculus
gcgggtagccagggagcacctgtga

SEQ ID NO: 942193 - DNA, 25 bp, Mus musculus
gcgggtcctgcgatcttggcccagc

SEQ ID NO: 942194 - DNA, 25 bp, Mus musculus
gcgggtcctgcgttcttggcccagc

SEQ ID NO: 942195 - DNA, 25 bp, Mus musculus
gcgggtgatccccatgaagagagca

SEQ ID NO: 942196 - DNA, 25 bp, Mus musculus
gcgggtgatcccgatgaagagagca

SEQ ID NO: 942197 - DNA, 25 bp, Mus musculus
gcggtaacagagtactgtttggcag

SEQ ID NO: 942198 - DNA, 25 bp, Mus musculus
gcggtaacagtgtactgtttggcag

SEQ ID NO: 942199 - DNA, 25 bp, Mus musculus
gcggtaatagtgctgctttagccct

SEQ ID NO: 942200 - DNA, 25 bp, Mus musculus
gcggtaatagtggtgctttagccct

SEQ ID NO: 942201 - DNA, 25 bp, Mus musculus
gcggtagcggtgaacgctgttgctc

SEQ ID NO: 942202 - DNA, 25 bp, Mus musculus
gcggtagcggtgaatgtgggatcct

SEQ ID NO: 942203 - DNA, 25 bp, Mus musculus
gcggtagcggtgccttctctccgtg

SEQ ID NO: 942204 - DNA, 25 bp, Mus musculus
gcggtagcggtgcgtgtcaccgaag

SEQ ID NO: 942205 - DNA, 25 bp, Mus musculus
gcggtagcggtggcttctctccgtg

SEQ ID NO: 942206 - DNA, 25 bp, Mus musculus
gcggtagcggtgggtgtcaccgaag

SEQ ID NO: 942207 - DNA, 25 bp, Mus musculus
gcggtagcggtgtacgctgttgctc

SEQ ID NO: 942208 - DNA, 25 bp, Mus musculus
gcggtagcggtgtatgtgggatcct

SEQ ID NO: 942209 - DNA, 25 bp, Mus musculus
gcggtccaggagattgtgccttctg

SEQ ID NO: 942210 - DNA, 25 bp, Mus musculus
gcggtccaggagtttgtgccttctg

SEQ ID NO: 942211 - DNA, 25 bp, Mus musculus
gcggtcctttgacgacatcgctgaa

SEQ ID NO: 942212 - DNA, 25 bp, Mus musculus
gcggtcctttgacgtcatcgctgaa

SEQ ID NO: 942213 - DNA, 25 bp, Mus musculus
gcggtcggggctcgtcaggacaaag

SEQ ID NO: 942214 - DNA, 25 bp, Mus musculus
gcggtcggggctggtcaggacaaag

SEQ ID NO: 942215 - DNA, 25 bp, Mus musculus
gcggtctcgaagagagagacgacaa

SEQ ID NO: 942216 - DNA, 25 bp, Mus musculus
gcggtctcgaagagtgagacgacaa

SEQ ID NO: 942217 - DNA, 25 bp, Mus musculus
gcggtctctgacttatgggacacgt

SEQ ID NO: 942218 - DNA, 25 bp, Mus musculus
gcggtctctgtcttatgggacacgt

SEQ ID NO: 942219 - DNA, 25 bp, Mus musculus
gcggtctgcccgcgaagtgtggcct

SEQ ID NO: 942220 - DNA, 25 bp, Mus musculus
gcggtctgcccgggaagtgtggcct

SEQ ID NO: 942221 - DNA, 25 bp, Mus musculus
gcggtgactgcgatactttgcagtg

SEQ ID NO: 942222 - DNA, 25 bp, Mus musculus
gcggtgactgggatactttgcagtg

SEQ ID NO: 942223 - DNA, 25 bp, Mus musculus
gcggtgagcgacatgtccttccgaa

SEQ ID NO: 942224 - DNA, 25 bp, Mus musculus
gcggtgagcgtcatgtccttccgaa

SEQ ID NO: 942225 - DNA, 25 bp, Mus musculus
gcggtgatgaagacaatagatgact

SEQ ID NO: 942226 - DNA, 25 bp, Mus musculus
gcggtgatgaagtcaatagatgact

SEQ ID NO: 942227 - DNA, 25 bp, Mus musculus
gcggtgatgcgcaacggctacgagg

SEQ ID NO: 942228 - DNA, 25 bp, Mus musculus
gcggtgatgcgcaacgtatgaatgc

SEQ ID NO: 942229 - DNA, 25 bp, Mus musculus
gcggtgatgcgcaagggctacgagg

SEQ ID NO: 942230 - DNA, 25 bp, Mus musculus
gcggtgatgcgcaaggtatgaatgc

SEQ ID NO: 942231 - DNA, 25 bp, Mus musculus
gcggtgcccgttgaccaagtggcca

SEQ ID NO: 942232 - DNA, 25 bp, Mus musculus
gcggtgcccgttgacgaagcaagtg

SEQ ID NO: 942233 - DNA, 25 bp, Mus musculus
gcggtgcccgttgagcaagtggcca

SEQ ID NO: 942234 - DNA, 25 bp, Mus musculus
gcggtgcccgttgaggaagcaagtg

SEQ ID NO: 942235 - DNA, 25 bp, Mus musculus
gcggtgctcgaaccatctacaccag

SEQ ID NO: 942236 - DNA, 25 bp, Mus musculus
gcggtgctcgaagcatctacaccag

SEQ ID NO: 942237 - DNA, 25 bp, Mus musculus
gcggtggagcccaactttcagccat

SEQ ID NO: 942238 - DNA, 25 bp, Mus musculus
gcggtggagcccaagtttcagccat

SEQ ID NO: 942239 - DNA, 25 bp, Mus musculus
gcggtggcagaatgttggcttccag

SEQ ID NO: 942240 - DNA, 25 bp, Mus musculus
gcggtggcagtatgttggcttccag

SEQ ID NO: 942241 - DNA, 25 bp, Mus musculus
gcggtggtagtgctggctatggcgg

SEQ ID NO: 942242 - DNA, 25 bp, Mus musculus
gcggtggtagtggtggctatggcgg

SEQ ID NO: 942243 - DNA, 25 bp, Mus musculus
gcggtggttcagctgaccccatatt

SEQ ID NO: 942244 - DNA, 25 bp, Mus musculus
gcggtggttcaggtgaccccatatt

SEQ ID NO: 942245 - DNA, 25 bp, Mus musculus
gcggttacactgcgtggagttccag

SEQ ID NO: 942246 - DNA, 25 bp, Mus musculus
gcggttacactgggtggagttccag

SEQ ID NO: 942247 - DNA, 25 bp, Mus musculus
gcggttacagcgcatctgactggaa

SEQ ID NO: 942248 - DNA, 25 bp, Mus musculus
gcggttacagggcatctgactggaa

SEQ ID NO: 942249 - DNA, 25 bp, Mus musculus
gcggttgagacttctccattccctc

SEQ ID NO: 942250 - DNA, 25 bp, Mus musculus
gcggttgagagttctccattccctc

SEQ ID NO: 942251 - DNA, 25 bp, Mus musculus
gcggttggagagagtgtgaacatgg

SEQ ID NO: 942252 - DNA, 25 bp, Mus musculus
gcggttggagagtgtgtgaacatgg

SEQ ID NO: 942253 - DNA, 25 bp, Mus musculus
gcggtttgccagcgaaaatcatagt

SEQ ID NO: 942254 - DNA, 25 bp, Mus musculus
gcggtttgccagcgcgacggaacaa

SEQ ID NO: 942255 - DNA, 25 bp, Mus musculus
gcggtttgccagctcggatgatgag

SEQ ID NO: 942256 - DNA, 25 bp, Mus musculus
gcggtttgccagggaaaatcatagt

SEQ ID NO: 942257 - DNA, 25 bp, Mus musculus
gcggtttgccagggcgacggaacaa

SEQ ID NO: 942258 - DNA, 25 bp, Mus musculus
gcggtttgccaggtcggatgatgag

SEQ ID NO: 942259 - DNA, 25 bp, Mus musculus
gcgtagagaatgcgggtttccgctt

SEQ ID NO: 942260 - DNA, 25 bp, Mus musculus
gcgtagagaatgggggtttccgctt

SEQ ID NO: 942261 - DNA, 25 bp, Mus musculus
gcgtagcaagcccgtcctggacaat

SEQ ID NO: 942262 - DNA, 25 bp, Mus musculus
gcgtagcaagccggtcctggacaat

SEQ ID NO: 942263 - DNA, 25 bp, Mus musculus
gcgtaggaagggaggtgctgatcgg

SEQ ID NO: 942264 - DNA, 25 bp, Mus musculus
gcgtaggaagggtggtgctgatcgg

SEQ ID NO: 942265 - DNA, 25 bp, Mus musculus
gcgtcaccagagtgggcagagaaga

SEQ ID NO: 942266 - DNA, 25 bp, Mus musculus
gcgtcaccagtgtgggcagagaaga

SEQ ID NO: 942267 - DNA, 25 bp, Mus musculus
gcgtcactgtaacattctgatttta

SEQ ID NO: 942268 - DNA, 25 bp, Mus musculus
gcgtcactgtaagattctgatttta

SEQ ID NO: 942269 - DNA, 25 bp, Mus musculus
gcgtcatgtgcacagacaggctttg

SEQ ID NO: 942270 - DNA, 25 bp, Mus musculus
gcgtcatgtgcacgctttgatatgt

SEQ ID NO: 942271 - DNA, 25 bp, Mus musculus
gcgtcatgtgcagagacaggctttg

SEQ ID NO: 942272 - DNA, 25 bp, Mus musculus
gcgtcatgtgcaggctttgatatgt

SEQ ID NO: 942273 - DNA, 25 bp, Mus musculus
gcgtccagcgtgcgcccctccagca

SEQ ID NO: 942274 - DNA, 25 bp, Mus musculus
gcgtccagcgtgggcccctccagca

SEQ ID NO: 942275 - DNA, 25 bp, Mus musculus
gcgtccccgcggaccgcactgagag

SEQ ID NO: 942276 - DNA, 25 bp, Mus musculus
gcgtccccgcggacggcactgagag

SEQ ID NO: 942277 - DNA, 25 bp, Mus musculus
gcgtccgtgccccttctgtacttca

SEQ ID NO: 942278 - DNA, 25 bp, Mus musculus
gcgtccgtgcccgttctgtacttca

SEQ ID NO: 942279 - DNA, 25 bp, Mus musculus
gcgtcctaaccggcaatgtcatcat

SEQ ID NO: 942280 - DNA, 25 bp, Mus musculus
gcgtcctaacgggcaatgtcatcat

SEQ ID NO: 942281 - DNA, 25 bp, Mus musculus
gcgtcctcagactccataaaacgtt

SEQ ID NO: 942282 - DNA, 25 bp, Mus musculus
gcgtcctcagactcgataaaacgtt

SEQ ID NO: 942283 - DNA, 25 bp, Mus musculus
gcgtcctcgtaactgccattctgtc

SEQ ID NO: 942284 - DNA, 25 bp, Mus musculus
gcgtcctcgtaagtgccattctgtc

SEQ ID NO: 942285 - DNA, 25 bp, Mus musculus
gcgtcctctgacccactcttggaac

SEQ ID NO: 942286 - DNA, 25 bp, Mus musculus
gcgtcctctgaccctctcttggaac

SEQ ID NO: 942287 - DNA, 25 bp, Mus musculus
gcgtcggcttcgcactatacctgga

SEQ ID NO: 942288 - DNA, 25 bp, Mus musculus
gcgtcggcttcggactatacctgga

SEQ ID NO: 942289 - DNA, 25 bp, Mus musculus
gcgtcgggaccacgatgaggctgta

SEQ ID NO: 942290 - DNA, 25 bp, Mus musculus
gcgtcgggaccaggatgaggctgta

SEQ ID NO: 942291 - DNA, 25 bp, Mus musculus
gcgtcgggagcctccatcatggcac

SEQ ID NO: 942292 - DNA, 25 bp, Mus musculus
gcgtcgggaggctccatcatggcac

SEQ ID NO: 942293 - DNA, 25 bp, Mus musculus
gcgtcgtgcatgcacatggatgatg

SEQ ID NO: 942294 - DNA, 25 bp, Mus musculus
gcgtcgtgcatgcagatggatgatg

SEQ ID NO: 942295 - DNA, 25 bp, Mus musculus
gcgtctaaagccttcgagtaccttc

SEQ ID NO: 942296 - DNA, 25 bp, Mus musculus
gcgtctaaaggcttcgagtaccttc

SEQ ID NO: 942297 - DNA, 25 bp, Mus musculus
gcgtctacggcggactggaacactc

SEQ ID NO: 942298 - DNA, 25 bp, Mus musculus
gcgtctacggcggagtggaacactc

SEQ ID NO: 942299 - DNA, 25 bp, Mus musculus
gcgtctcatgatggagagaagagga

SEQ ID NO: 942300 - DNA, 25 bp, Mus musculus
gcgtctcatgttggagagaagagga

SEQ ID NO: 942301 - DNA, 25 bp, Mus musculus
gcgtctcctgcacgtgaggagcatg

SEQ ID NO: 942302 - DNA, 25 bp, Mus musculus
gcgtctcctgcaggtgaggagcatg

SEQ ID NO: 942303 - DNA, 25 bp, Mus musculus
gcgtctcgagacaagaccataaagt

SEQ ID NO: 942304 - DNA, 25 bp, Mus musculus
gcgtctcgagacaagaccatcatca

SEQ ID NO: 942305 - DNA, 25 bp, Mus musculus
gcgtctcgagtcaagaccataaagt

SEQ ID NO: 942306 - DNA, 25 bp, Mus musculus
gcgtctcgagtcaagaccatcatca

SEQ ID NO: 942307 - DNA, 25 bp, Mus musculus
gcgtctgcagagcaatctgggaccc

SEQ ID NO: 942308 - DNA, 25 bp, Mus musculus
gcgtctgcagaggaatctgggaccc

SEQ ID NO: 942309 - DNA, 25 bp, Mus musculus
gcgtctgctgctcatatcccctttg

SEQ ID NO: 942310 - DNA, 25 bp, Mus musculus
gcgtctgctgctgatatcccctttg

SEQ ID NO: 942311 - DNA, 25 bp, Mus musculus
gcgtctggatcacgacccctccccg

SEQ ID NO: 942312 - DNA, 25 bp, Mus musculus
gcgtctggatcaggacccctccccg

SEQ ID NO: 942313 - DNA, 25 bp, Mus musculus
gcgtctttggagcgtggaagagcag

SEQ ID NO: 942314 - DNA, 25 bp, Mus musculus
gcgtctttggagggtggaagagcag

SEQ ID NO: 942315 - DNA, 25 bp, Mus musculus
gcgtgaacaagctgcggcaccagaa

SEQ ID NO: 942316 - DNA, 25 bp, Mus musculus
gcgtgaacaagctggggcaccagaa

SEQ ID NO: 942317 - DNA, 25 bp, Mus musculus
gcgtgaacacagaaatcccttcact

SEQ ID NO: 942318 - DNA, 25 bp, Mus musculus
gcgtgaacacagcgggcttccgaag

SEQ ID NO: 942319 - DNA, 25 bp, Mus musculus
gcgtgaacacagggggcttccgaag

SEQ ID NO: 942320 - DNA, 25 bp, Mus musculus
gcgtgaacacagtaatcccttcact

SEQ ID NO: 942321 - DNA, 25 bp, Mus musculus
gcgtgaccctcctgcagcaactggt

SEQ ID NO: 942322 - DNA, 25 bp, Mus musculus
gcgtgaccctcctggagcaactggt

SEQ ID NO: 942323 - DNA, 25 bp, Mus musculus
gcgtgactacctgacgctttttggc

SEQ ID NO: 942324 - DNA, 25 bp, Mus musculus
gcgtgactacctgaggctttttggc

SEQ ID NO: 942325 - DNA, 25 bp, Mus musculus
gcgtgatcaatgcttctccctgcca

SEQ ID NO: 942326 - DNA, 25 bp, Mus musculus
gcgtgatcaatggttctccctgcca

SEQ ID NO: 942327 - DNA, 25 bp, Mus musculus
gcgtgatgttggcaaagtattaatg

SEQ ID NO: 942328 - DNA, 25 bp, Mus musculus
gcgtgatgttgggaaagtattaatg

SEQ ID NO: 942329 - DNA, 25 bp, Mus musculus
gcgtgcacagcgaagaatagccagg

SEQ ID NO: 942330 - DNA, 25 bp, Mus musculus
gcgtgcacagggaagaatagccagg

SEQ ID NO: 942331 - DNA, 25 bp, Mus musculus
gcgtgccattgtcctggagacgaca

SEQ ID NO: 942332 - DNA, 25 bp, Mus musculus
gcgtgccattgtgctggagacgaca

SEQ ID NO: 942333 - DNA, 25 bp, Mus musculus
gcgtgcccagcgtcctgtgggcact

SEQ ID NO: 942334 - DNA, 25 bp, Mus musculus
gcgtgcccagggtcctgtgggcact

SEQ ID NO: 942335 - DNA, 25 bp, Mus musculus
gcgtgcccggcctgccgcctatggc

SEQ ID NO: 942336 - DNA, 25 bp, Mus musculus
gcgtgcccgggctgccgcctatggc

SEQ ID NO: 942337 - DNA, 25 bp, Mus musculus
gcgtgcctggagaataggtgctcct

SEQ ID NO: 942338 - DNA, 25 bp, Mus musculus
gcgtgcctggagctgctcctatgtt

SEQ ID NO: 942339 - DNA, 25 bp, Mus musculus
gcgtgcctggaggtgctcctatgtt

SEQ ID NO: 942340 - DNA, 25 bp, Mus musculus
gcgtgcctggagtataggtgctcct

SEQ ID NO: 942341 - DNA, 25 bp, Mus musculus
gcgtgcttagctggtgtgacaagaa

SEQ ID NO: 942342 - DNA, 25 bp, Mus musculus
gcgtgcttaggtggtgtgacaagaa

SEQ ID NO: 942343 - DNA, 25 bp, Mus musculus
gcgtggacacgatccgtcagatgtc

SEQ ID NO: 942344 - DNA, 25 bp, Mus musculus
gcgtggacacgatcggtcagatgtc

SEQ ID NO: 942345 - DNA, 25 bp, Mus musculus
gcgtggagagatatgagccagagcg

SEQ ID NO: 942346 - DNA, 25 bp, Mus musculus
gcgtggagagttatgagccagagcg

SEQ ID NO: 942347 - DNA, 25 bp, Mus musculus
gcgtggagattacacggtttcctga

SEQ ID NO: 942348 - DNA, 25 bp, Mus musculus
gcgtggagattacagggtttcctga

SEQ ID NO: 942349 - DNA, 25 bp, Mus musculus
gcgtggaggtggcgtgctgtgagtg

SEQ ID NO: 942350 - DNA, 25 bp, Mus musculus
gcgtggaggtggggtgctgtgagtg

SEQ ID NO: 942351 - DNA, 25 bp, Mus musculus
gcgtggagtccttcagaagcttatc

SEQ ID NO: 942352 - DNA, 25 bp, Mus musculus
gcgtggagtccttctgaagcttatc

SEQ ID NO: 942353 - DNA, 25 bp, Mus musculus
gcgtggatagcctttccctgagcac

SEQ ID NO: 942354 - DNA, 25 bp, Mus musculus
gcgtggataggctttccctgagcac

SEQ ID NO: 942355 - DNA, 25 bp, Mus musculus
gcgtggatgactcaagctggccccg

SEQ ID NO: 942356 - DNA, 25 bp, Mus musculus
gcgtggatgactcggcagccacgcc

SEQ ID NO: 942357 - DNA, 25 bp, Mus musculus
gcgtggatgactgaagctggccccg

SEQ ID NO: 942358 - DNA, 25 bp, Mus musculus
gcgtggatgactgggcagccacgcc

SEQ ID NO: 942359 - DNA, 25 bp, Mus musculus
gcgtggatgctgacagggacaccaa

SEQ ID NO: 942360 - DNA, 25 bp, Mus musculus
gcgtggatgctgactgggacaccaa

SEQ ID NO: 942361 - DNA, 25 bp, Mus musculus
gcgtggcaatccagacccccagcag

SEQ ID NO: 942362 - DNA, 25 bp, Mus musculus
gcgtggcaatccagtcccccagcag

SEQ ID NO: 942363 - DNA, 25 bp, Mus musculus
gcgtggcttgagcaacaaaagaatc

SEQ ID NO: 942364 - DNA, 25 bp, Mus musculus
gcgtggcttgaggaacaaaagaatc

SEQ ID NO: 942365 - DNA, 25 bp, Mus musculus
gcgtgggcatttttcggtccccatg

SEQ ID NO: 942366 - DNA, 25 bp, Mus musculus
gcgtgggcatttttgggtccccatg

SEQ ID NO: 942367 - DNA, 25 bp, Mus musculus
gcgtggggctaaatgaacaggtcct

SEQ ID NO: 942368 - DNA, 25 bp, Mus musculus
gcgtggggctaattgaacaggtcct

SEQ ID NO: 942369 - DNA, 25 bp, Mus musculus
gcgtggtaaatgatgacggtacagt

SEQ ID NO: 942370 - DNA, 25 bp, Mus musculus
gcgtggtaaatgttgacggtacagt

SEQ ID NO: 942371 - DNA, 25 bp, Mus musculus
gcgtggtcccagcgggaggctcgta

SEQ ID NO: 942372 - DNA, 25 bp, Mus musculus
gcgtggtcccagggggaggctcgta

SEQ ID NO: 942373 - DNA, 25 bp, Mus musculus
gcgtgtaatttctgatgaagggggc

SEQ ID NO: 942374 - DNA, 25 bp, Mus musculus
gcgtgtaatttctgttgaagggggc

SEQ ID NO: 942375 - DNA, 25 bp, Mus musculus
gcgtgtacggcggacatgaagttgg

SEQ ID NO: 942376 - DNA, 25 bp, Mus musculus
gcgtgtacggcggagatgaagttgg

SEQ ID NO: 942377 - DNA, 25 bp, Mus musculus
gcgtgtcaaggacacggagtcattc

SEQ ID NO: 942378 - DNA, 25 bp, Mus musculus
gcgtgtcaaggacagggagtcattc

SEQ ID NO: 942379 - DNA, 25 bp, Mus musculus
gcgtgtcctgaacattcccctcgtg

SEQ ID NO: 942380 - DNA, 25 bp, Mus musculus
gcgtgtcctgaagattcccctcgtg

SEQ ID NO: 942381 - DNA, 25 bp, Mus musculus
gcgtgtctggagattcgacttgaag

SEQ ID NO: 942382 - DNA, 25 bp, Mus musculus
gcgtgtctggagtttcgacttgaag

SEQ ID NO: 942383 - DNA, 25 bp, Mus musculus
gcgtgtgaggtacacgtgtcggctc

SEQ ID NO: 942384 - DNA, 25 bp, Mus musculus
gcgtgtgaggtacaggtgtcggctc

SEQ ID NO: 942385 - DNA, 25 bp, Mus musculus
gcgtgtgcagagcttctcacacagc

SEQ ID NO: 942386 - DNA, 25 bp, Mus musculus
gcgtgtgcagaggttctcacacagc

SEQ ID NO: 942387 - DNA, 25 bp, Mus musculus
gcgtgtgctcgtcgcacggaggtgc

SEQ ID NO: 942388 - DNA, 25 bp, Mus musculus
gcgtgtgctcgtggcacggaggtgc

SEQ ID NO: 942389 - DNA, 25 bp, Mus musculus
gcgtgtgggctccaagtgcctgtgg

SEQ ID NO: 942390 - DNA, 25 bp, Mus musculus
gcgtgtgggctccatgtgcctgtgg

SEQ ID NO: 942391 - DNA, 25 bp, Mus musculus
gcgtgtgtacagaacgttacacagg

SEQ ID NO: 942392 - DNA, 25 bp, Mus musculus
gcgtgtgtacagaaggttacacagg

SEQ ID NO: 942393 - DNA, 25 bp, Mus musculus
gcgtgtgtggagttcaccttccagc

SEQ ID NO: 942394 - DNA, 25 bp, Mus musculus
gcgtgtgtggtgttcaccttccagc

SEQ ID NO: 942395 - DNA, 25 bp, Mus musculus
gcgtgtgtgtgacaaccgtcgtcgc

SEQ ID NO: 942396 - DNA, 25 bp, Mus musculus
gcgtgtgtgtgacaccagaaccgtc

SEQ ID NO: 942397 - DNA, 25 bp, Mus musculus
gcgtgtgtgtgagaaccgtcgtcgc

SEQ ID NO: 942398 - DNA, 25 bp, Mus musculus
gcgtgtgtgtgagaccagaaccgtc

SEQ ID NO: 942399 - DNA, 25 bp, Mus musculus
gcgtgtgttaagccatcaaacaatg

SEQ ID NO: 942400 - DNA, 25 bp, Mus musculus
gcgtgtgttaagcttaccaacatat

SEQ ID NO: 942401 - DNA, 25 bp, Mus musculus
gcgtgtgttaaggcatcaaacaatg

SEQ ID NO: 942402 - DNA, 25 bp, Mus musculus
gcgtgtgttaaggttaccaacatat

SEQ ID NO: 942403 - DNA, 25 bp, Mus musculus
gcgtgttctccccgacgagggatct

SEQ ID NO: 942404 - DNA, 25 bp, Mus musculus
gcgtgttctcccggacgagggatct

SEQ ID NO: 942405 - DNA, 25 bp, Mus musculus
gcgtgttgctggatgagtattggag

SEQ ID NO: 942406 - DNA, 25 bp, Mus musculus
gcgtgttgctggctgccatgcctat

SEQ ID NO: 942407 - DNA, 25 bp, Mus musculus
gcgtgttgctggctggattgccttt

SEQ ID NO: 942408 - DNA, 25 bp, Mus musculus
gcgtgttgctgggtgccatgcctat

SEQ ID NO: 942409 - DNA, 25 bp, Mus musculus
gcgtgttgctgggtggattgccttt

SEQ ID NO: 942410 - DNA, 25 bp, Mus musculus
gcgtgttgctggttgagtattggag

SEQ ID NO: 942411 - DNA, 25 bp, Mus musculus
gcgtgttggtcgcctctctgccttt

SEQ ID NO: 942412 - DNA, 25 bp, Mus musculus
gcgtgttggtcgcgggggttctact

SEQ ID NO: 942413 - DNA, 25 bp, Mus musculus
gcgtgttggtcggctctctgccttt

SEQ ID NO: 942414 - DNA, 25 bp, Mus musculus
gcgtgttggtcgggggggttctact

SEQ ID NO: 942415 - DNA, 25 bp, Mus musculus
gcgttagatgcacatgggagaagct

SEQ ID NO: 942416 - DNA, 25 bp, Mus musculus
gcgttagatgcagatgggagaagct

SEQ ID NO: 942417 - DNA, 25 bp, Mus musculus
gcgttatcagagtgaagccatagag

SEQ ID NO: 942418 - DNA, 25 bp, Mus musculus
gcgttatcagtgtgaagccatagag

SEQ ID NO: 942419 - DNA, 25 bp, Mus musculus
gcgttcaactgtgaccgacaggtac

SEQ ID NO: 942420 - DNA, 25 bp, Mus musculus
gcgttcaactgtgagcgacaggtac

SEQ ID NO: 942421 - DNA, 25 bp, Mus musculus
gcgttccagtggcgatggagaagag

SEQ ID NO: 942422 - DNA, 25 bp, Mus musculus
gcgttccagtggggatggagaagag

SEQ ID NO: 942423 - DNA, 25 bp, Mus musculus
gcgttcctaaggcgcattctccact

SEQ ID NO: 942424 - DNA, 25 bp, Mus musculus
gcgttcctaaggcggattctccact

SEQ ID NO: 942425 - DNA, 25 bp, Mus musculus
gcgttctcccagatgattggcatgc

SEQ ID NO: 942426 - DNA, 25 bp, Mus musculus
gcgttctcccagttgattggcatgc

SEQ ID NO: 942427 - DNA, 25 bp, Mus musculus
gcgttgcgcagtaggtttacggcag

SEQ ID NO: 942428 - DNA, 25 bp, Mus musculus
gcgttgcgcagttggtttacggcag

SEQ ID NO: 942429 - DNA, 25 bp, Mus musculus
gcgttggacaaatggcagatacatc

SEQ ID NO: 942430 - DNA, 25 bp, Mus musculus
gcgttggacatatggcagatacatc

SEQ ID NO: 942431 - DNA, 25 bp, Mus musculus
gcgttggatgcttacatccaggcat

SEQ ID NO: 942432 - DNA, 25 bp, Mus musculus
gcgttggatggttacatccaggcat

SEQ ID NO: 942433 - DNA, 25 bp, Mus musculus
gcgttggtaaaagcccagtcacaat

SEQ ID NO: 942434 - DNA, 25 bp, Mus musculus
gcgttggtaaaagcgcagtcacaat

SEQ ID NO: 942435 - DNA, 25 bp, Mus musculus
gcgttgtcagtcatatggggcccag

SEQ ID NO: 942436 - DNA, 25 bp, Mus musculus
gcgttgtcagtcttatggggcccag

SEQ ID NO: 942437 - DNA, 25 bp, Mus musculus
gcgtttccctcagcaaccatcactt

SEQ ID NO: 942438 - DNA, 25 bp, Mus musculus
gcgtttccctcagctaccatcactt

SEQ ID NO: 942439 - DNA, 25 bp, Mus musculus
gcgtttgagctaaaagaaatgctca

SEQ ID NO: 942440 - DNA, 25 bp, Mus musculus
gcgtttgagctaaatgaaatgctca

SEQ ID NO: 942441 - DNA, 25 bp, Mus musculus
gcgtttgcttcaagactttatatgg

SEQ ID NO: 942442 - DNA, 25 bp, Mus musculus
gcgtttgcttcatgactttatatgg

SEQ ID NO: 942443 - DNA, 25 bp, Mus musculus
gcgtttttcaagaatgaagtcagag

SEQ ID NO: 942444 - DNA, 25 bp, Mus musculus
gcgtttttcaagcatgtcactgatt

SEQ ID NO: 942445 - DNA, 25 bp, Mus musculus
gcgtttttcaaggatgtcactgatt

SEQ ID NO: 942446 - DNA, 25 bp, Mus musculus
gcgtttttcaagtatgaagtcagag

SEQ ID NO: 942447 - DNA, 25 bp, Mus musculus
gctaaaaagagggacgtgctgtcag

SEQ ID NO: 942448 - DNA, 25 bp, Mus musculus
gctaaaaagagggaggtgctgtcag

SEQ ID NO: 942449 - DNA, 25 bp, Mus musculus
gctaaaaagccaatgactaagatcg

SEQ ID NO: 942450 - DNA, 25 bp, Mus musculus
gctaaaaagccattgactaagatcg

SEQ ID NO: 942451 - DNA, 25 bp, Mus musculus
gctaaaagacaacgcaggctacatg

SEQ ID NO: 942452 - DNA, 25 bp, Mus musculus
gctaaaagacaaggcaggctacatg

SEQ ID NO: 942453 - DNA, 25 bp, Mus musculus
gctaaaatgaggcacgaacatcgaa

SEQ ID NO: 942454 - DNA, 25 bp, Mus musculus
gctaaaatgaggcaggaacatcgaa

SEQ ID NO: 942455 - DNA, 25 bp, Mus musculus
gctaaaattaagcagctgacaagta

SEQ ID NO: 942456 - DNA, 25 bp, Mus musculus
gctaaaattaaggagctgacaagta

SEQ ID NO: 942457 - DNA, 25 bp, Mus musculus
gctaaacaacaacatctgtgatatt

SEQ ID NO: 942458 - DNA, 25 bp, Mus musculus
gctaaacaacaagatctgtgatatt

SEQ ID NO: 942459 - DNA, 25 bp, Mus musculus
gctaaacacccacatgcaaaacttt

SEQ ID NO: 942460 - DNA, 25 bp, Mus musculus
gctaaacacccagatgcaaaacttt

SEQ ID NO: 942461 - DNA, 25 bp, Mus musculus
gctaaactctcaccaaaatgtgagc

SEQ ID NO: 942462 - DNA, 25 bp, Mus musculus
gctaaactctcacctaaatgtgagc

SEQ ID NO: 942463 - DNA, 25 bp, Mus musculus
gctaaactttgtcacttgcactaag

SEQ ID NO: 942464 - DNA, 25 bp, Mus musculus
gctaaactttgtgacttgcactaag

SEQ ID NO: 942465 - DNA, 25 bp, Mus musculus
gctaaaggagcctgtgaggggaaga

SEQ ID NO: 942466 - DNA, 25 bp, Mus musculus
gctaaaggaggctgtgaggggaaga

SEQ ID NO: 942467 - DNA, 25 bp, Mus musculus
gctaaaggggaacaaaagacatgct

SEQ ID NO: 942468 - DNA, 25 bp, Mus musculus
gctaaaggggaagaaaagacatgct

SEQ ID NO: 942469 - DNA, 25 bp, Mus musculus
gctaaatcacatcacgtgacagagt

SEQ ID NO: 942470 - DNA, 25 bp, Mus musculus
gctaaatcacatcaggtgacagagt

SEQ ID NO: 942471 - DNA, 25 bp, Mus musculus
gctaaatttagacacattgtttccg

SEQ ID NO: 942472 - DNA, 25 bp, Mus musculus
gctaaatttagacagattgtttccg

SEQ ID NO: 942473 - DNA, 25 bp, Mus musculus
gctaacatcataaacgctggcccag

SEQ ID NO: 942474 - DNA, 25 bp, Mus musculus
gctaacatcataaaggctggcccag

SEQ ID NO: 942475 - DNA, 25 bp, Mus musculus
gctaacccagaaatgacatcagatg

SEQ ID NO: 942476 - DNA, 25 bp, Mus musculus
gctaacccagcagaacgtcagctgc

SEQ ID NO: 942477 - DNA, 25 bp, Mus musculus
gctaacccaggagaacgtcagctgc

SEQ ID NO: 942478 - DNA, 25 bp, Mus musculus
gctaacccagtaatgacatcagatg

SEQ ID NO: 942479 - DNA, 25 bp, Mus musculus
gctaactcaggagacgagccattta

SEQ ID NO: 942480 - DNA, 25 bp, Mus musculus
gctaactcaggagacgtacttggaa

SEQ ID NO: 942481 - DNA, 25 bp, Mus musculus
gctaactcaggagaggagccattta

SEQ ID NO: 942482 - DNA, 25 bp, Mus musculus
gctaactcaggagaggtacttggaa

SEQ ID NO: 942483 - DNA, 25 bp, Mus musculus
gctaacttacagagttgagtggcct

SEQ ID NO: 942484 - DNA, 25 bp, Mus musculus
gctaacttacagtgttgagtggcct

SEQ ID NO: 942485 - DNA, 25 bp, Mus musculus
gctaagagccagctaatttctaatg

SEQ ID NO: 942486 - DNA, 25 bp, Mus musculus
gctaagagccaggtaatttctaatg

SEQ ID NO: 942487 - DNA, 25 bp, Mus musculus
gctaagagggcgaaaattcgcctcc

SEQ ID NO: 942488 - DNA, 25 bp, Mus musculus
gctaagagggcgaaatgtggagccc

SEQ ID NO: 942489 - DNA, 25 bp, Mus musculus
gctaagagggcgaatattcgcctcc

SEQ ID NO: 942490 - DNA, 25 bp, Mus musculus
gctaagagggcgaattgtggagccc

SEQ ID NO: 942491 - DNA, 25 bp, Mus musculus
gctaagccagtgcgagtgtgcagcc

SEQ ID NO: 942492 - DNA, 25 bp, Mus musculus
gctaagccagtgggagtgtgcagcc

SEQ ID NO: 942493 - DNA, 25 bp, Mus musculus
gctaagcgagaaaggcaaacagcat

SEQ ID NO: 942494 - DNA, 25 bp, Mus musculus
gctaagcgagtaaggcaaacagcat

SEQ ID NO: 942495 - DNA, 25 bp, Mus musculus
gctaaggacattgacacagaaagac

SEQ ID NO: 942496 - DNA, 25 bp, Mus musculus
gctaaggacattgagacagaaagac

SEQ ID NO: 942497 - DNA, 25 bp, Mus musculus
gctaaggagccacagccagtccttc

SEQ ID NO: 942498 - DNA, 25 bp, Mus musculus
gctaaggagccagagccagtccttc

SEQ ID NO: 942499 - DNA, 25 bp, Mus musculus
gctaaggccacaaaagtgacgttcc

SEQ ID NO: 942500 - DNA, 25 bp, Mus musculus
gctaaggccacaaatgtgacgttcc

SEQ ID NO: 942501 - DNA, 25 bp, Mus musculus
gctaaggcgaggcattttaggtgat

SEQ ID NO: 942502 - DNA, 25 bp, Mus musculus
gctaaggcgagggattttaggtgat

SEQ ID NO: 942503 - DNA, 25 bp, Mus musculus
gctaagggacaacgctgtcccttcc

SEQ ID NO: 942504 - DNA, 25 bp, Mus musculus
gctaagggacaaggctgtcccttcc

SEQ ID NO: 942505 - DNA, 25 bp, Mus musculus
gctaagggacagatggctatgaacg

SEQ ID NO: 942506 - DNA, 25 bp, Mus musculus
gctaagggacagttggctatgaacg

SEQ ID NO: 942507 - DNA, 25 bp, Mus musculus
gctaagtactgggacctcatctatg

SEQ ID NO: 942508 - DNA, 25 bp, Mus musculus
gctaagtactgggagctcatctatg

SEQ ID NO: 942509 - DNA, 25 bp, Mus musculus
gctaagtcctatgaaattttattgc

SEQ ID NO: 942510 - DNA, 25 bp, Mus musculus
gctaagtcctatgatattttattgc

SEQ ID NO: 942511 - DNA, 25 bp, Mus musculus
gctaatcctggacgtcctagaagac

SEQ ID NO: 942512 - DNA, 25 bp, Mus musculus
gctaatcctggacttagcagcccaa

SEQ ID NO: 942513 - DNA, 25 bp, Mus musculus
gctaatcctggaggtcctagaagac

SEQ ID NO: 942514 - DNA, 25 bp, Mus musculus
gctaatcctggagttagcagcccaa

SEQ ID NO: 942515 - DNA, 25 bp, Mus musculus
gctaatgaaagacacaaacaaactg

SEQ ID NO: 942516 - DNA, 25 bp, Mus musculus
gctaatgaaagacacggacatgaaa

SEQ ID NO: 942517 - DNA, 25 bp, Mus musculus
gctaatgaaagacagaaacaaactg

SEQ ID NO: 942518 - DNA, 25 bp, Mus musculus
gctaatgaaagacagggacatgaaa

SEQ ID NO: 942519 - DNA, 25 bp, Mus musculus
gctaatgaagcgctggagagggggc

SEQ ID NO: 942520 - DNA, 25 bp, Mus musculus
gctaatgaagggctggagagggggc

SEQ ID NO: 942521 - DNA, 25 bp, Mus musculus
gctaatgatactctcggccagtgaa

SEQ ID NO: 942522 - DNA, 25 bp, Mus musculus
gctaatgatactgtcggccagtgaa

SEQ ID NO: 942523 - DNA, 25 bp, Mus musculus
gctaatggctcacctttcaacattt

SEQ ID NO: 942524 - DNA, 25 bp, Mus musculus
gctaatggctcagctttcaacattt

SEQ ID NO: 942525 - DNA, 25 bp, Mus musculus
gctaatgggaagagtacatctcgga

SEQ ID NO: 942526 - DNA, 25 bp, Mus musculus
gctaatgggaagtgtacatctcgga

SEQ ID NO: 942527 - DNA, 25 bp, Mus musculus
gctaattcccaacgattcacacctc

SEQ ID NO: 942528 - DNA, 25 bp, Mus musculus
gctaattcccaaggattcacacctc

SEQ ID NO: 942529 - DNA, 25 bp, Mus musculus
gctaattgatcaaaaagctgacctt

SEQ ID NO: 942530 - DNA, 25 bp, Mus musculus
gctaattgatcataaagctgacctt

SEQ ID NO: 942531 - DNA, 25 bp, Mus musculus
gctacaaactcacagacaagacagt

SEQ ID NO: 942532 - DNA, 25 bp, Mus musculus
gctacaaactgacagacaagacagt

SEQ ID NO: 942533 - DNA, 25 bp, Mus musculus
gctacaaatgcaggcaatgcaacgc

SEQ ID NO: 942534 - DNA, 25 bp, Mus musculus
gctacaaatgcagggaatgcaacgc

SEQ ID NO: 942535 - DNA, 25 bp, Mus musculus
gctacaacaaccgccgagacctgaa

SEQ ID NO: 942536 - DNA, 25 bp, Mus musculus
gctacaacaagcgccgagacctgaa

SEQ ID NO: 942537 - DNA, 25 bp, Mus musculus
gctacaacttcacatatgccaagta

SEQ ID NO: 942538 - DNA, 25 bp, Mus musculus
gctacaacttcagatatgccaagta

SEQ ID NO: 942539 - DNA, 25 bp, Mus musculus
gctacaagcacaactcctaatagta

SEQ ID NO: 942540 - DNA, 25 bp, Mus musculus
gctacaagcacatctcctaatagta

SEQ ID NO: 942541 - DNA, 25 bp, Mus musculus
gctacaaggagaacctggacatatg

SEQ ID NO: 942542 - DNA, 25 bp, Mus musculus
gctacaaggagaacctggacttatg

SEQ ID NO: 942543 - DNA, 25 bp, Mus musculus
gctacaaggagaaccttgacatttg

SEQ ID NO: 942544 - DNA, 25 bp, Mus musculus
gctacaaggagaacgtggacatatg

SEQ ID NO: 942545 - DNA, 25 bp, Mus musculus
gctacaaggagaacgtggacttatg

SEQ ID NO: 942546 - DNA, 25 bp, Mus musculus
gctacaaggagaacgttgacatttg

SEQ ID NO: 942547 - DNA, 25 bp, Mus musculus
gctacacaggacatcatgcctatgc

SEQ ID NO: 942548 - DNA, 25 bp, Mus musculus
gctacacaggacttcatgcctatgc

SEQ ID NO: 942549 - DNA, 25 bp, Mus musculus
gctacaccatccccccgcaggctgg

SEQ ID NO: 942550 - DNA, 25 bp, Mus musculus
gctacaccatccgcccgcaggctgg

SEQ ID NO: 942551 - DNA, 25 bp, Mus musculus
gctacacctgcccgtcagggatccc

SEQ ID NO: 942552 - DNA, 25 bp, Mus musculus
gctacacctgcccgtccaaccgtga

SEQ ID NO: 942553 - DNA, 25 bp, Mus musculus
gctacacctgccggtcagggatccc

SEQ ID NO: 942554 - DNA, 25 bp, Mus musculus
gctacacctgccggtccaaccgtga

SEQ ID NO: 942555 - DNA, 25 bp, Mus musculus
gctacacgcagacactggacatttg

SEQ ID NO: 942556 - DNA, 25 bp, Mus musculus
gctacacgcagacagtggacatttg

SEQ ID NO: 942557 - DNA, 25 bp, Mus musculus
gctacagagaacctgcagcgcttgt

SEQ ID NO: 942558 - DNA, 25 bp, Mus musculus
gctacagagatcctgcagcgcttgt

SEQ ID NO: 942559 - DNA, 25 bp, Mus musculus
gctacagaggtgaccaacaggccat

SEQ ID NO: 942560 - DNA, 25 bp, Mus musculus
gctacagaggtgcgcttactgtaag

SEQ ID NO: 942561 - DNA, 25 bp, Mus musculus
gctacagaggtgggcttactgtaag

SEQ ID NO: 942562 - DNA, 25 bp, Mus musculus
gctacagaggtgtccaacaggccat

SEQ ID NO: 942563 - DNA, 25 bp, Mus musculus
gctacagataagggacacagcaggc

SEQ ID NO: 942564 - DNA, 25 bp, Mus musculus
gctacagatatgggacacagcaggc

SEQ ID NO: 942565 - DNA, 25 bp, Mus musculus
gctacagctacctaccatgtccaaa

SEQ ID NO: 942566 - DNA, 25 bp, Mus musculus
gctacagctacctagcatgtccaaa

SEQ ID NO: 942567 - DNA, 25 bp, Mus musculus
gctacagctgcgctgggaggatcgg

SEQ ID NO: 942568 - DNA, 25 bp, Mus musculus
gctacagctgggctgggaggatcgg

SEQ ID NO: 942569 - DNA, 25 bp, Mus musculus
gctacagtaaaaccccatccaaaat

SEQ ID NO: 942570 - DNA, 25 bp, Mus musculus
gctacagtaaaagcccatccaaaat

SEQ ID NO: 942571 - DNA, 25 bp, Mus musculus
gctacagtaggggacatcactattg

SEQ ID NO: 942572 - DNA, 25 bp, Mus musculus
gctacagtaggggagatcactattg

SEQ ID NO: 942573 - DNA, 25 bp, Mus musculus
gctacagtcatacactccagacaag

SEQ ID NO: 942574 - DNA, 25 bp, Mus musculus
gctacagtcatacagtccagacaag

SEQ ID NO: 942575 - DNA, 25 bp, Mus musculus
gctacatcaaagaccaggtgtttgg

SEQ ID NO: 942576 - DNA, 25 bp, Mus musculus
gctacatcaaagtccaggtgtttgg

SEQ ID NO: 942577 - DNA, 25 bp, Mus musculus
gctacatcagcgtgcggttctatga

SEQ ID NO: 942578 - DNA, 25 bp, Mus musculus
gctacatcagggtgcggttctatga

SEQ ID NO: 942579 - DNA, 25 bp, Mus musculus
gctacatctcagcccagggctttga

SEQ ID NO: 942580 - DNA, 25 bp, Mus musculus
gctacatctcagccccctggtttga

SEQ ID NO: 942581 - DNA, 25 bp, Mus musculus
gctacatctcaggccagggctttga

SEQ ID NO: 942582 - DNA, 25 bp, Mus musculus
gctacatctcaggcccctggtttga

SEQ ID NO: 942583 - DNA, 25 bp, Mus musculus
gctacatgagcgcagtggatttgat

SEQ ID NO: 942584 - DNA, 25 bp, Mus musculus
gctacatgagggcagtggatttgat

SEQ ID NO: 942585 - DNA, 25 bp, Mus musculus
gctacatggcctcccccccttcttc

SEQ ID NO: 942586 - DNA, 25 bp, Mus musculus
gctacatggcctgccccccttcttc

SEQ ID NO: 942587 - DNA, 25 bp, Mus musculus
gctacattcaagcatttacttacaa

SEQ ID NO: 942588 - DNA, 25 bp, Mus musculus
gctacattcaaggatttacttacaa

SEQ ID NO: 942589 - DNA, 25 bp, Mus musculus
gctaccaaaatccgtaaggagagct

SEQ ID NO: 942590 - DNA, 25 bp, Mus musculus
gctaccaaaatcggtaaggagagct

SEQ ID NO: 942591 - DNA, 25 bp, Mus musculus
gctaccacaaccagctgctgaaccg

SEQ ID NO: 942592 - DNA, 25 bp, Mus musculus
gctaccacaacctgctgctgaaccg

SEQ ID NO: 942593 - DNA, 25 bp, Mus musculus
gctaccacccagcacctagaagaaa

SEQ ID NO: 942594 - DNA, 25 bp, Mus musculus
gctaccacccagcagctagaagaaa

SEQ ID NO: 942595 - DNA, 25 bp, Mus musculus
gctaccagggagcacggacaatgct

SEQ ID NO: 942596 - DNA, 25 bp, Mus musculus
gctaccagggaggacggacaatgct

SEQ ID NO: 942597 - DNA, 25 bp, Mus musculus
gctaccatagcagactacacggact

SEQ ID NO: 942598 - DNA, 25 bp, Mus musculus
gctaccatagcctccacttacctgt

SEQ ID NO: 942599 - DNA, 25 bp, Mus musculus
gctaccataggagactacacggact

SEQ ID NO: 942600 - DNA, 25 bp, Mus musculus
gctaccataggctccacttacctgt

SEQ ID NO: 942601 - DNA, 25 bp, Mus musculus
gctaccccaacaatgcaccttccgg

SEQ ID NO: 942602 - DNA, 25 bp, Mus musculus
gctaccccaacattgcaccttccgg

SEQ ID NO: 942603 - DNA, 25 bp, Mus musculus
gctaccccagctcccgatccctgcc

SEQ ID NO: 942604 - DNA, 25 bp, Mus musculus
gctaccccaggtcccgatccctgcc

SEQ ID NO: 942605 - DNA, 25 bp, Mus musculus
gctaccgagaccctggctccatcta

SEQ ID NO: 942606 - DNA, 25 bp, Mus musculus
gctaccgagagcctggctccatcta

SEQ ID NO: 942607 - DNA, 25 bp, Mus musculus
gctaccggagttcgatcggtcatgg

SEQ ID NO: 942608 - DNA, 25 bp, Mus musculus
gctaccggagttggatcggtcatgg

SEQ ID NO: 942609 - DNA, 25 bp, Mus musculus
gctaccgttgcaatcatacaatccc

SEQ ID NO: 942610 - DNA, 25 bp, Mus musculus
gctaccgttgcaatgatacaatccc

SEQ ID NO: 942611 - DNA, 25 bp, Mus musculus
gctacctaactgcccccaccaagcg

SEQ ID NO: 942612 - DNA, 25 bp, Mus musculus
gctacctaactggccccaccaagcg

SEQ ID NO: 942613 - DNA, 25 bp, Mus musculus
gctacctatgacaacgcttacacgg

SEQ ID NO: 942614 - DNA, 25 bp, Mus musculus
gctacctatgacaaggcttacacgg

SEQ ID NO: 942615 - DNA, 25 bp, Mus musculus
gctacctcaacatctttgtccctga

SEQ ID NO: 942616 - DNA, 25 bp, Mus musculus
gctacctcaagatctttgtccctga

SEQ ID NO: 942617 - DNA, 25 bp, Mus musculus
gctacctcagacgccaagagtggca

SEQ ID NO: 942618 - DNA, 25 bp, Mus musculus
gctacctcagtcgccaagagtggca

SEQ ID NO: 942619 - DNA, 25 bp, Mus musculus
gctacctctcagccccaagctggat

SEQ ID NO: 942620 - DNA, 25 bp, Mus musculus
gctacctctcaggcccaagctggat

SEQ ID NO: 942621 - DNA, 25 bp, Mus musculus
gctacctgcacgctgggagtgtgga

SEQ ID NO: 942622 - DNA, 25 bp, Mus musculus
gctacctgcacggtgggagtgtgga

SEQ ID NO: 942623 - DNA, 25 bp, Mus musculus
gctacctggaagagtgcctgctcac

SEQ ID NO: 942624 - DNA, 25 bp, Mus musculus
gctacctggaagtgtgcctgctcac

SEQ ID NO: 942625 - DNA, 25 bp, Mus musculus
gctaccttagcatcgagcggtccac

SEQ ID NO: 942626 - DNA, 25 bp, Mus musculus
gctaccttaggatcgagcggtccac

SEQ ID NO: 942627 - DNA, 25 bp, Mus musculus
gctaccttctgtaactgtttgcttt

SEQ ID NO: 942628 - DNA, 25 bp, Mus musculus
gctaccttctgttactgtttgcttt

SEQ ID NO: 942629 - DNA, 25 bp, Mus musculus
gctaccttggagcttcagtccccag

SEQ ID NO: 942630 - DNA, 25 bp, Mus musculus
gctaccttggtgcttcagtccccag

SEQ ID NO: 942631 - DNA, 25 bp, Mus musculus
gctacgactacactcagggtagtac

SEQ ID NO: 942632 - DNA, 25 bp, Mus musculus
gctacgactacagtcagggtagtac

SEQ ID NO: 942633 - DNA, 25 bp, Mus musculus
gctacgttttcattctgatctctgg

SEQ ID NO: 942634 - DNA, 25 bp, Mus musculus
gctacgttttcattgtgatctctgg

SEQ ID NO: 942635 - DNA, 25 bp, Mus musculus
gctactacagcaactgaaccgcacc

SEQ ID NO: 942636 - DNA, 25 bp, Mus musculus
gctactacaggaactgaaccgcacc

SEQ ID NO: 942637 - DNA, 25 bp, Mus musculus
gctactactacatcaccaaacctat

SEQ ID NO: 942638 - DNA, 25 bp, Mus musculus
gctactactacatctccaaacctat

SEQ ID NO: 942639 - DNA, 25 bp, Mus musculus
gctactcaagctgacctgatggagt

SEQ ID NO: 942640 - DNA, 25 bp, Mus musculus
gctactcaaggtgacctgatggagt

SEQ ID NO: 942641 - DNA, 25 bp, Mus musculus
gctactccaaagcgttatgagccag

SEQ ID NO: 942642 - DNA, 25 bp, Mus musculus
gctactccaaagggttatgagccag

SEQ ID NO: 942643 - DNA, 25 bp, Mus musculus
gctactccagctacgtaggtgccat

SEQ ID NO: 942644 - DNA, 25 bp, Mus musculus
gctactccaggtacgtaggtgccat

SEQ ID NO: 942645 - DNA, 25 bp, Mus musculus
gctactcccagacgagagacggagg

SEQ ID NO: 942646 - DNA, 25 bp, Mus musculus
gctactcccagaggagagacggagg

SEQ ID NO: 942647 - DNA, 25 bp, Mus musculus
gctactcccaggcgggcctggtgtg

SEQ ID NO: 942648 - DNA, 25 bp, Mus musculus
gctactcccaggggggcctggtgtg

SEQ ID NO: 942649 - DNA, 25 bp, Mus musculus
gctactgcccaggacgcacagtccc

SEQ ID NO: 942650 - DNA, 25 bp, Mus musculus
gctactgcccaggaggcacagtccc

SEQ ID NO: 942651 - DNA, 25 bp, Mus musculus
gctactggagaacaagtcttggaca

SEQ ID NO: 942652 - DNA, 25 bp, Mus musculus
gctactggagaacgtgcaaaacatg

SEQ ID NO: 942653 - DNA, 25 bp, Mus musculus
gctactggagaagaagtcttggaca

SEQ ID NO: 942654 - DNA, 25 bp, Mus musculus
gctactggagaaggtgcaaaacatg

SEQ ID NO: 942655 - DNA, 25 bp, Mus musculus
gctactgtcatcctagtctcattgg

SEQ ID NO: 942656 - DNA, 25 bp, Mus musculus
gctactgtcatccttgtctcattgg

SEQ ID NO: 942657 - DNA, 25 bp, Mus musculus
gctactgtgcgcaatggatctgtcc

SEQ ID NO: 942658 - DNA, 25 bp, Mus musculus
gctactgtgcgctatggatctgtcc

SEQ ID NO: 942659 - DNA, 25 bp, Mus musculus
gctactgtgttgatgtgaacgagtg

SEQ ID NO: 942660 - DNA, 25 bp, Mus musculus
gctactgtgttgttgtgaacgagtg

SEQ ID NO: 942661 - DNA, 25 bp, Mus musculus
gctacttatcaactgtatgtggaaa

SEQ ID NO: 942662 - DNA, 25 bp, Mus musculus
gctacttatcaagtgtatgtggaaa

SEQ ID NO: 942663 - DNA, 25 bp, Mus musculus
gctacttctcaacgaaacttcattc

SEQ ID NO: 942664 - DNA, 25 bp, Mus musculus
gctacttctcaacgaggcgcttcca

SEQ ID NO: 942665 - DNA, 25 bp, Mus musculus
gctacttctcaaggaaacttcattc

SEQ ID NO: 942666 - DNA, 25 bp, Mus musculus
gctacttctcaaggaggcgcttcca

SEQ ID NO: 942667 - DNA, 25 bp, Mus musculus
gctacttctggcaacgccagatcct

SEQ ID NO: 942668 - DNA, 25 bp, Mus musculus
gctacttctggcaaggccagatcct

SEQ ID NO: 942669 - DNA, 25 bp, Mus musculus
gctacttggcaccaaagcaatatag

SEQ ID NO: 942670 - DNA, 25 bp, Mus musculus
gctacttggcacgaaagcaatatag

SEQ ID NO: 942671 - DNA, 25 bp, Mus musculus
gctagaaatgctctggggaaggatc

SEQ ID NO: 942672 - DNA, 25 bp, Mus musculus
gctagaaatggtctggggaaggatc

SEQ ID NO: 942673 - DNA, 25 bp, Mus musculus
gctagaacaacaccgacagctattt

SEQ ID NO: 942674 - DNA, 25 bp, Mus musculus
gctagaacaacacgtgttgggagcc

SEQ ID NO: 942675 - DNA, 25 bp, Mus musculus
gctagaacaacagcgacagctattt

SEQ ID NO: 942676 - DNA, 25 bp, Mus musculus
gctagaacaacaggtgttgggagcc

SEQ ID NO: 942677 - DNA, 25 bp, Mus musculus
gctagaactgatccactgggcccag

SEQ ID NO: 942678 - DNA, 25 bp, Mus musculus
gctagaactgttccactgggcccag

SEQ ID NO: 942679 - DNA, 25 bp, Mus musculus
gctagaatcgctctttggtcctttg

SEQ ID NO: 942680 - DNA, 25 bp, Mus musculus
gctagaatcggtctttggtcctttg

SEQ ID NO: 942681 - DNA, 25 bp, Mus musculus
gctagactggcgtgctgacccccac

SEQ ID NO: 942682 - DNA, 25 bp, Mus musculus
gctagactggctgcgaagctggggt

SEQ ID NO: 942683 - DNA, 25 bp, Mus musculus
gctagactggggtgctgacccccac

SEQ ID NO: 942684 - DNA, 25 bp, Mus musculus
gctagactgggtgcgaagctggggt

SEQ ID NO: 942685 - DNA, 25 bp, Mus musculus
gctagagcataacgtttatctcaag

SEQ ID NO: 942686 - DNA, 25 bp, Mus musculus
gctagagcataaggtttatctcaag

SEQ ID NO: 942687 - DNA, 25 bp, Mus musculus
gctagagccaagcgccgggcgtgga

SEQ ID NO: 942688 - DNA, 25 bp, Mus musculus
gctagagccaagggccgggcgtgga

SEQ ID NO: 942689 - DNA, 25 bp, Mus musculus
gctagagcgtgtcggcatcgttctg

SEQ ID NO: 942690 - DNA, 25 bp, Mus musculus
gctagagcgtgtgggcatcgttctg

SEQ ID NO: 942691 - DNA, 25 bp, Mus musculus
gctagatgagccagataaattgttg

SEQ ID NO: 942692 - DNA, 25 bp, Mus musculus
gctagatgaggcagataaattgttg

SEQ ID NO: 942693 - DNA, 25 bp, Mus musculus
gctagattatagagataaacaagca

SEQ ID NO: 942694 - DNA, 25 bp, Mus musculus
gctagattatagtgataaacaagca

SEQ ID NO: 942695 - DNA, 25 bp, Mus musculus
gctagcagagactctgtagaaatgc

SEQ ID NO: 942696 - DNA, 25 bp, Mus musculus
gctagcagagtctctgtagaaatgc

SEQ ID NO: 942697 - DNA, 25 bp, Mus musculus
gctagcataattcacaaaatcagaa

SEQ ID NO: 942698 - DNA, 25 bp, Mus musculus
gctagcataattcagaaaatcagaa

SEQ ID NO: 942699 - DNA, 25 bp, Mus musculus
gctagccaagatatcaacctgaatt

SEQ ID NO: 942700 - DNA, 25 bp, Mus musculus
gctagccaagctgctggattaaaag

SEQ ID NO: 942701 - DNA, 25 bp, Mus musculus
gctagccaaggtgctggattaaaag

SEQ ID NO: 942702 - DNA, 25 bp, Mus musculus
gctagccaagttatcaacctgaatt

SEQ ID NO: 942703 - DNA, 25 bp, Mus musculus
gctagcccaccgagattaggaagtg

SEQ ID NO: 942704 - DNA, 25 bp, Mus musculus
gctagcccaccgtgattaggaagtg

SEQ ID NO: 942705 - DNA, 25 bp, Mus musculus
gctagcctgctgaggaagagtgggc

SEQ ID NO: 942706 - DNA, 25 bp, Mus musculus
gctagcctgctgtggaagagtgggc

SEQ ID NO: 942707 - DNA, 25 bp, Mus musculus
gctagcgcttcacagttcctggttc

SEQ ID NO: 942708 - DNA, 25 bp, Mus musculus
gctagcgcttcagagttcctggttc

SEQ ID NO: 942709 - DNA, 25 bp, Mus musculus
gctagctatgacctatgaggagatc

SEQ ID NO: 942710 - DNA, 25 bp, Mus musculus
gctagctatgtcctatgaggagatc

SEQ ID NO: 942711 - DNA, 25 bp, Mus musculus
gctagcttcaagcacccaaagatca

SEQ ID NO: 942712 - DNA, 25 bp, Mus musculus
gctagcttcaaggacccaaagatca

SEQ ID NO: 942713 - DNA, 25 bp, Mus musculus
gctaggaacaaacagaacctgcacc

SEQ ID NO: 942714 - DNA, 25 bp, Mus musculus
gctaggaacaaacagaccccgaggc

SEQ ID NO: 942715 - DNA, 25 bp, Mus musculus
gctaggaacaaacgtcaggtgccca

SEQ ID NO: 942716 - DNA, 25 bp, Mus musculus
gctaggaacaaagagaacctgcacc

SEQ ID NO: 942717 - DNA, 25 bp, Mus musculus
gctaggaacaaagagaccccgaggc

SEQ ID NO: 942718 - DNA, 25 bp, Mus musculus
gctaggaacaaaggtcaggtgccca

SEQ ID NO: 942719 - DNA, 25 bp, Mus musculus
gctaggagagagcaggaaaagcagc

SEQ ID NO: 942720 - DNA, 25 bp, Mus musculus
gctaggagagaggaggaaaagcagc

SEQ ID NO: 942721 - DNA, 25 bp, Mus musculus
gctaggcaagaacaagttcagggat

SEQ ID NO: 942722 - DNA, 25 bp, Mus musculus
gctaggcaagtacaagttcagggat

SEQ ID NO: 942723 - DNA, 25 bp, Mus musculus
gctagggtagcttgttcctgcttga

SEQ ID NO: 942724 - DNA, 25 bp, Mus musculus
gctagggtaggttgttcctgcttga

SEQ ID NO: 942725 - DNA, 25 bp, Mus musculus
gctaggtctgcacgtgcagttccct

SEQ ID NO: 942726 - DNA, 25 bp, Mus musculus
gctaggtctgcaggtgcagttccct

SEQ ID NO: 942727 - DNA, 25 bp, Mus musculus
gctaggtgccaagacggagctccgc

SEQ ID NO: 942728 - DNA, 25 bp, Mus musculus
gctaggtgccaagagggagctccgc

SEQ ID NO: 942729 - DNA, 25 bp, Mus musculus
gctagtgccactcgacacggtgctg

SEQ ID NO: 942730 - DNA, 25 bp, Mus musculus
gctagtgccactggacacggtgctg

SEQ ID NO: 942731 - DNA, 25 bp, Mus musculus
gctagtggagcagaagactctgagc

SEQ ID NO: 942732 - DNA, 25 bp, Mus musculus
gctagtggaggagaagactctgagc

SEQ ID NO: 942733 - DNA, 25 bp, Mus musculus
gctagtgtaaaacaaagatgatgac

SEQ ID NO: 942734 - DNA, 25 bp, Mus musculus
gctagtgtaaaagaaagatgatgac

SEQ ID NO: 942735 - DNA, 25 bp, Mus musculus
gctagtgtggataacgttttggaac

SEQ ID NO: 942736 - DNA, 25 bp, Mus musculus
gctagtgtggataaggttttggaac

SEQ ID NO: 942737 - DNA, 25 bp, Mus musculus
gctagttcagccactggctccagca

SEQ ID NO: 942738 - DNA, 25 bp, Mus musculus
gctagttcaggcactggctccagca

SEQ ID NO: 942739 - DNA, 25 bp, Mus musculus
gctagttggaagcctctgggtggta

SEQ ID NO: 942740 - DNA, 25 bp, Mus musculus
gctagttggaaggctctgggtggta

SEQ ID NO: 942741 - DNA, 25 bp, Mus musculus
gctataaaaattacagtaccaaagc

SEQ ID NO: 942742 - DNA, 25 bp, Mus musculus
gctataaaaattactgtaccaaagc

SEQ ID NO: 942743 - DNA, 25 bp, Mus musculus
gctataaagtctccaaattctgaac

SEQ ID NO: 942744 - DNA, 25 bp, Mus musculus
gctataaagtctgcaaattctgaac

SEQ ID NO: 942745 - DNA, 25 bp, Mus musculus
gctataacacagcagtcatactact

SEQ ID NO: 942746 - DNA, 25 bp, Mus musculus
gctataacacaggagtcatactact

SEQ ID NO: 942747 - DNA, 25 bp, Mus musculus
gctatacaacaccagactgggccca

SEQ ID NO: 942748 - DNA, 25 bp, Mus musculus
gctatacaacacgagactgggccca

SEQ ID NO: 942749 - DNA, 25 bp, Mus musculus
gctatactggttcctttgtatgtat

SEQ ID NO: 942750 - DNA, 25 bp, Mus musculus
gctatactggttgctttgtatgtat

SEQ ID NO: 942751 - DNA, 25 bp, Mus musculus
gctatagaaaggccgctttcgttgc

SEQ ID NO: 942752 - DNA, 25 bp, Mus musculus
gctatagaaaggctgaaggcactgg

SEQ ID NO: 942753 - DNA, 25 bp, Mus musculus
gctatagaaagggcgctttcgttgc

SEQ ID NO: 942754 - DNA, 25 bp, Mus musculus
gctatagaaagggtgaaggcactgg

SEQ ID NO: 942755 - DNA, 25 bp, Mus musculus
gctatagctgcgaacgctctgagga

SEQ ID NO: 942756 - DNA, 25 bp, Mus musculus
gctatagctgcgaaggctctgagga

SEQ ID NO: 942757 - DNA, 25 bp, Mus musculus
gctatatattatcggtgtgctggat

SEQ ID NO: 942758 - DNA, 25 bp, Mus musculus
gctatatattatgggtgtgctggat

SEQ ID NO: 942759 - DNA, 25 bp, Mus musculus
gctatatcggagacacagcttcatg

SEQ ID NO: 942760 - DNA, 25 bp, Mus musculus
gctatatcggagtcacagcttcatg

SEQ ID NO: 942761 - DNA, 25 bp, Mus musculus
gctatcaacacacgcattcctgaag

SEQ ID NO: 942762 - DNA, 25 bp, Mus musculus
gctatcaacacaggcattcctgaag

SEQ ID NO: 942763 - DNA, 25 bp, Mus musculus
gctatcaagctgcagcccatcaagt

SEQ ID NO: 942764 - DNA, 25 bp, Mus musculus
gctatcaagctggagcccatcaagt

SEQ ID NO: 942765 - DNA, 25 bp, Mus musculus
gctatcagttctcacccccacttcg

SEQ ID NO: 942766 - DNA, 25 bp, Mus musculus
gctatcagttctgacccccacttcg

SEQ ID NO: 942767 - DNA, 25 bp, Mus musculus
gctatcatgaagaaattagaagagt

SEQ ID NO: 942768 - DNA, 25 bp, Mus musculus
gctatcatgaagtaattagaagagt

SEQ ID NO: 942769 - DNA, 25 bp, Mus musculus
gctatcatttcacactggttatgac

SEQ ID NO: 942770 - DNA, 25 bp, Mus musculus
gctatcatttcacagtggttatgac

SEQ ID NO: 942771 - DNA, 25 bp, Mus musculus
gctatccagcagagccatggaactg

SEQ ID NO: 942772 - DNA, 25 bp, Mus musculus
gctatccagcagtgccatggaactg

SEQ ID NO: 942773 - DNA, 25 bp, Mus musculus
gctatccaggaccccgctgacactt

SEQ ID NO: 942774 - DNA, 25 bp, Mus musculus
gctatccaggacccggctgacactt

SEQ ID NO: 942775 - DNA, 25 bp, Mus musculus
gctatcccacagactcagaaccgtg

SEQ ID NO: 942776 - DNA, 25 bp, Mus musculus
gctatcccacagtctcagaaccgtg

SEQ ID NO: 942777 - DNA, 25 bp, Mus musculus
gctatcccagcaccgggacttcatc

SEQ ID NO: 942778 - DNA, 25 bp, Mus musculus
gctatcccagccccctctgcccccc

SEQ ID NO: 942779 - DNA, 25 bp, Mus musculus
gctatcccaggaccgggacttcatc

SEQ ID NO: 942780 - DNA, 25 bp, Mus musculus
gctatcccaggcccctctgcccccc

SEQ ID NO: 942781 - DNA, 25 bp, Mus musculus
gctatcctgaggatgcaggtcagca

SEQ ID NO: 942782 - DNA, 25 bp, Mus musculus
gctatcctgaggttgcaggtcagca

SEQ ID NO: 942783 - DNA, 25 bp, Mus musculus
gctatctgttatcaaacaaatgtcc

SEQ ID NO: 942784 - DNA, 25 bp, Mus musculus
gctatctgttatgaaacaaatgtcc

SEQ ID NO: 942785 - DNA, 25 bp, Mus musculus
gctatcttagcacctcggtctccag

SEQ ID NO: 942786 - DNA, 25 bp, Mus musculus
gctatcttagcagctcggtctccag

SEQ ID NO: 942787 - DNA, 25 bp, Mus musculus
gctatgaaccagagggtgtctggcc

SEQ ID NO: 942788 - DNA, 25 bp, Mus musculus
gctatgaaccagtgggtgtctggcc

SEQ ID NO: 942789 - DNA, 25 bp, Mus musculus
gctatgacacagaggtaggtgagac

SEQ ID NO: 942790 - DNA, 25 bp, Mus musculus
gctatgacacagtggtaggtgagac

SEQ ID NO: 942791 - DNA, 25 bp, Mus musculus
gctatgacgactggcggggacagta

SEQ ID NO: 942792 - DNA, 25 bp, Mus musculus
gctatgacgactgggggggacagta

SEQ ID NO: 942793 - DNA, 25 bp, Mus musculus
gctatgatccagcacatgctgtcca

SEQ ID NO: 942794 - DNA, 25 bp, Mus musculus
gctatgatccagcagatgctgtcca

SEQ ID NO: 942795 - DNA, 25 bp, Mus musculus
gctatgccagaacacatagtcgtac

SEQ ID NO: 942796 - DNA, 25 bp, Mus musculus
gctatgccagaacagatagtcgtac

SEQ ID NO: 942797 - DNA, 25 bp, Mus musculus
gctatgccagagaggtggaaccaag

SEQ ID NO: 942798 - DNA, 25 bp, Mus musculus
gctatgccagagtggtggaaccaag

SEQ ID NO: 942799 - DNA, 25 bp, Mus musculus
gctatggaacagactgtcccagaaa

SEQ ID NO: 942800 - DNA, 25 bp, Mus musculus
gctatggaacagtctgtcccagaaa

SEQ ID NO: 942801 - DNA, 25 bp, Mus musculus
gctatggaagctctatcctgacagt

SEQ ID NO: 942802 - DNA, 25 bp, Mus musculus
gctatggaaggtctatcctgacagt

SEQ ID NO: 942803 - DNA, 25 bp, Mus musculus
gctatggcaaccagtataatgtttg

SEQ ID NO: 942804 - DNA, 25 bp, Mus musculus
gctatggcaagcagtataatgtttg

SEQ ID NO: 942805 - DNA, 25 bp, Mus musculus
gctatggcagaaagccctgcaggaa

SEQ ID NO: 942806 - DNA, 25 bp, Mus musculus
gctatggcagaggttttatgaagag

SEQ ID NO: 942807 - DNA, 25 bp, Mus musculus
gctatggcagagtgctgggattaca

SEQ ID NO: 942808 - DNA, 25 bp, Mus musculus
gctatggcagctacttaaaattctg

SEQ ID NO: 942809 - DNA, 25 bp, Mus musculus
gctatggcagctgattggagttgtg

SEQ ID NO: 942810 - DNA, 25 bp, Mus musculus
gctatggcaggtacttaaaattctg

SEQ ID NO: 942811 - DNA, 25 bp, Mus musculus
gctatggcaggtgattggagttgtg

SEQ ID NO: 942812 - DNA, 25 bp, Mus musculus
gctatggcagtaagccctgcaggaa

SEQ ID NO: 942813 - DNA, 25 bp, Mus musculus
gctatggcagtggttttatgaagag

SEQ ID NO: 942814 - DNA, 25 bp, Mus musculus
gctatggcagtgtgctgggattaca

SEQ ID NO: 942815 - DNA, 25 bp, Mus musculus
gctatgggcgagcagctcttgccag

SEQ ID NO: 942816 - DNA, 25 bp, Mus musculus
gctatgggcgaggagctcttgccag

SEQ ID NO: 942817 - DNA, 25 bp, Mus musculus
gctatgggtcagctagtgggcagca

SEQ ID NO: 942818 - DNA, 25 bp, Mus musculus
gctatgggtcaggtagtgggcagca

SEQ ID NO: 942819 - DNA, 25 bp, Mus musculus
gctatggttttatccaatatgagaa

SEQ ID NO: 942820 - DNA, 25 bp, Mus musculus
gctatggttttatcgaatatgagaa

SEQ ID NO: 942821 - DNA, 25 bp, Mus musculus
gctatgtcagaaggcttatcaggtt

SEQ ID NO: 942822 - DNA, 25 bp, Mus musculus
gctatgtcagcaaaccatccaatgc

SEQ ID NO: 942823 - DNA, 25 bp, Mus musculus
gctatgtcaggaaaccatccaatgc

SEQ ID NO: 942824 - DNA, 25 bp, Mus musculus
gctatgtcagtaggcttatcaggtt

SEQ ID NO: 942825 - DNA, 25 bp, Mus musculus
gctatgtggaaaatcgtaaaattgt

SEQ ID NO: 942826 - DNA, 25 bp, Mus musculus
gctatgtggaaaatggtaaaattgt

SEQ ID NO: 942827 - DNA, 25 bp, Mus musculus
gctattaaagctggagagtaaggcc

SEQ ID NO: 942828 - DNA, 25 bp, Mus musculus
gctattaaagctggtgagaaatgcc

SEQ ID NO: 942829 - DNA, 25 bp, Mus musculus
gctattaaaggtggagagtaaggcc

SEQ ID NO: 942830 - DNA, 25 bp, Mus musculus
gctattaaaggtggtgagaaatgcc

SEQ ID NO: 942831 - DNA, 25 bp, Mus musculus
gctattatcactcggccctctcttt

SEQ ID NO: 942832 - DNA, 25 bp, Mus musculus
gctattatcactgggccctctcttt

SEQ ID NO: 942833 - DNA, 25 bp, Mus musculus
gctattcaaaacagcgtggaagatg

SEQ ID NO: 942834 - DNA, 25 bp, Mus musculus
gctattcaaatcagcgtggaagatg

SEQ ID NO: 942835 - DNA, 25 bp, Mus musculus
gctattccttcacgtcgctggattt

SEQ ID NO: 942836 - DNA, 25 bp, Mus musculus
gctattccttcaggtcgctggattt

SEQ ID NO: 942837 - DNA, 25 bp, Mus musculus
gctattcgtgatggccttttggcca

SEQ ID NO: 942838 - DNA, 25 bp, Mus musculus
gctattcgtgatgggcttttggcca

SEQ ID NO: 942839 - DNA, 25 bp, Mus musculus
gctattgaagaccgctgtgtggttc

SEQ ID NO: 942840 - DNA, 25 bp, Mus musculus
gctattgaagacggctgtgtggttc

SEQ ID NO: 942841 - DNA, 25 bp, Mus musculus
gctattgcagaggtggcttttgcag

SEQ ID NO: 942842 - DNA, 25 bp, Mus musculus
gctattgcagctttcctggcagaac

SEQ ID NO: 942843 - DNA, 25 bp, Mus musculus
gctattgcaggtttcctggcagaac

SEQ ID NO: 942844 - DNA, 25 bp, Mus musculus
gctattgcagtggtggcttttgcag

SEQ ID NO: 942845 - DNA, 25 bp, Mus musculus
gctattggctcttatgttggcgctg

SEQ ID NO: 942846 - DNA, 25 bp, Mus musculus
gctattggctgttatgttggcgctg

SEQ ID NO: 942847 - DNA, 25 bp, Mus musculus
gctatttaagctggccaccactgca

SEQ ID NO: 942848 - DNA, 25 bp, Mus musculus
gctatttaaggtggccaccactgca

SEQ ID NO: 942849 - DNA, 25 bp, Mus musculus
gctatttcagcctttgatgggacag

SEQ ID NO: 942850 - DNA, 25 bp, Mus musculus
gctatttcaggctttgatgggacag

SEQ ID NO: 942851 - DNA, 25 bp, Mus musculus
gctatttcatgctgcatgacctcaa

SEQ ID NO: 942852 - DNA, 25 bp, Mus musculus
gctatttcatgctggatgacctcaa

SEQ ID NO: 942853 - DNA, 25 bp, Mus musculus
gctatttgcgtacccgcctgtgtgg

SEQ ID NO: 942854 - DNA, 25 bp, Mus musculus
gctatttgcgtagccgcctgtgtgg

SEQ ID NO: 942855 - DNA, 25 bp, Mus musculus
gctcaaaaaagccacgcctctgatc

SEQ ID NO: 942856 - DNA, 25 bp, Mus musculus
gctcaaaaaagccaggcctctgatc

SEQ ID NO: 942857 - DNA, 25 bp, Mus musculus
gctcaaaatgtgcctctcccagtgt

SEQ ID NO: 942858 - DNA, 25 bp, Mus musculus
gctcaaaatgtggctctcccagtgt

SEQ ID NO: 942859 - DNA, 25 bp, Mus musculus
gctcaaacacagctcaaagattaga

SEQ ID NO: 942860 - DNA, 25 bp, Mus musculus
gctcaaacacaggtcaaagattaga

SEQ ID NO: 942861 - DNA, 25 bp, Mus musculus
gctcaaaccaagaccctccaccagc

SEQ ID NO: 942862 - DNA, 25 bp, Mus musculus
gctcaaaccaagtccctccaccagc

SEQ ID NO: 942863 - DNA, 25 bp, Mus musculus
gctcaaagccatcgtttgactctgc

SEQ ID NO: 942864 - DNA, 25 bp, Mus musculus
gctcaaagccatggtttgactctgc

SEQ ID NO: 942865 - DNA, 25 bp, Mus musculus
gctcaacaagctgaatgaccttcgc

SEQ ID NO: 942866 - DNA, 25 bp, Mus musculus
gctcaacaaggtgaatgaccttcgc

SEQ ID NO: 942867 - DNA, 25 bp, Mus musculus
gctcaaccacctcactcattcttac

SEQ ID NO: 942868 - DNA, 25 bp, Mus musculus
gctcaaccacctcagtcattcttac

SEQ ID NO: 942869 - DNA, 25 bp, Mus musculus
gctcaaccagaacatggaggtgcag

SEQ ID NO: 942870 - DNA, 25 bp, Mus musculus
gctcaaccagaagatggaggtgcag

SEQ ID NO: 942871 - DNA, 25 bp, Mus musculus
gctcaaccagacgcacctctagtat

SEQ ID NO: 942872 - DNA, 25 bp, Mus musculus
gctcaaccagaggacatatcaggcc

SEQ ID NO: 942873 - DNA, 25 bp, Mus musculus
gctcaaccagatccttgcatgaacc

SEQ ID NO: 942874 - DNA, 25 bp, Mus musculus
gctcaaccagcgcatcgttctgcct

SEQ ID NO: 942875 - DNA, 25 bp, Mus musculus
gctcaaccagctggatgtgtggggc

SEQ ID NO: 942876 - DNA, 25 bp, Mus musculus
gctcaaccagggcatcgttctgcct

SEQ ID NO: 942877 - DNA, 25 bp, Mus musculus
gctcaaccaggtggatgtgtggggc

SEQ ID NO: 942878 - DNA, 25 bp, Mus musculus
gctcaaccagtcgcacctctagtat

SEQ ID NO: 942879 - DNA, 25 bp, Mus musculus
gctcaaccagtggacatatcaggcc

SEQ ID NO: 942880 - DNA, 25 bp, Mus musculus
gctcaaccagttccttgcatgaacc

SEQ ID NO: 942881 - DNA, 25 bp, Mus musculus
gctcaacgccaacctcgctgttcag

SEQ ID NO: 942882 - DNA, 25 bp, Mus musculus
gctcaacgccaagctcgctgttcag

SEQ ID NO: 942883 - DNA, 25 bp, Mus musculus
gctcaacggcaacacccaatcagag

SEQ ID NO: 942884 - DNA, 25 bp, Mus musculus
gctcaacggcaagacccaatcagag

SEQ ID NO: 942885 - DNA, 25 bp, Mus musculus
gctcaactggctgaatgccctggag

SEQ ID NO: 942886 - DNA, 25 bp, Mus musculus
gctcaactgggtgaatgccctggag

SEQ ID NO: 942887 - DNA, 25 bp, Mus musculus
gctcaacttgtccaatttcgaggac

SEQ ID NO: 942888 - DNA, 25 bp, Mus musculus
gctcaacttgtccattttcgaggac

SEQ ID NO: 942889 - DNA, 25 bp, Mus musculus
gctcaagaacagattggtggtaatc

SEQ ID NO: 942890 - DNA, 25 bp, Mus musculus
gctcaagaacagtttggtggtaatc

SEQ ID NO: 942891 - DNA, 25 bp, Mus musculus
gctcaagaaggcaacattactgtgt

SEQ ID NO: 942892 - DNA, 25 bp, Mus musculus
gctcaagaaggcaagattactgtgt

SEQ ID NO: 942893 - DNA, 25 bp, Mus musculus
gctcaagcagcccctcaacacaact

SEQ ID NO: 942894 - DNA, 25 bp, Mus musculus
gctcaagcaggccctcaacacaact

SEQ ID NO: 942895 - DNA, 25 bp, Mus musculus
gctcaagccaacaacagctctgaag

SEQ ID NO: 942896 - DNA, 25 bp, Mus musculus
gctcaagccaacaagagctctgaag

SEQ ID NO: 942897 - DNA, 25 bp, Mus musculus
gctcaagctcggaggtggcagggta

SEQ ID NO: 942898 - DNA, 25 bp, Mus musculus
gctcaagctcggtggtggcagggta

SEQ ID NO: 942899 - DNA, 25 bp, Mus musculus
gctcaagctggagacacctgtgatc

SEQ ID NO: 942900 - DNA, 25 bp, Mus musculus
gctcaagctggagagacctgtgatc

SEQ ID NO: 942901 - DNA, 25 bp, Mus musculus
gctcaaggagcctcaacgcacagcg

SEQ ID NO: 942902 - DNA, 25 bp, Mus musculus
gctcaaggaggctcaacgcacagcg

SEQ ID NO: 942903 - DNA, 25 bp, Mus musculus
gctcaaggctaacgcccaggccctg

SEQ ID NO: 942904 - DNA, 25 bp, Mus musculus
gctcaaggctaaggcccaggccctg

SEQ ID NO: 942905 - DNA, 25 bp, Mus musculus
gctcaagtcaagagatatgatcata

SEQ ID NO: 942906 - DNA, 25 bp, Mus musculus
gctcaagtcaagtgatatgatcata

SEQ ID NO: 942907 - DNA, 25 bp, Mus musculus
gctcaagtcctttcagtcttttgat

SEQ ID NO: 942908 - DNA, 25 bp, Mus musculus
gctcaagtcctttctgtcttttgat

SEQ ID NO: 942909 - DNA, 25 bp, Mus musculus
gctcaatcagcgaatggagatcgtt

SEQ ID NO: 942910 - DNA, 25 bp, Mus musculus
gctcaatcagggaatggagatcgtt

SEQ ID NO: 942911 - DNA, 25 bp, Mus musculus
gctcaatgagagcacgtcaaggagg

SEQ ID NO: 942912 - DNA, 25 bp, Mus musculus
gctcaatgagagcaggtcaaggagg

SEQ ID NO: 942913 - DNA, 25 bp, Mus musculus
gctcaattggaaaacaggtccttct

SEQ ID NO: 942914 - DNA, 25 bp, Mus musculus
gctcaattggaaaacgaatcttcta

SEQ ID NO: 942915 - DNA, 25 bp, Mus musculus
gctcaattggaaaagaggtccttct

SEQ ID NO: 942916 - DNA, 25 bp, Mus musculus
gctcaattggaaaaggaatcttcta

SEQ ID NO: 942917 - DNA, 25 bp, Mus musculus
gctcacaacatccacaatgtctgca

SEQ ID NO: 942918 - DNA, 25 bp, Mus musculus
gctcacaacatcgacaatgtctgca

SEQ ID NO: 942919 - DNA, 25 bp, Mus musculus
gctcacacccaaaagatggcgacgc

SEQ ID NO: 942920 - DNA, 25 bp, Mus musculus
gctcacacccagctgctggctgagg

SEQ ID NO: 942921 - DNA, 25 bp, Mus musculus
gctcacacccaggtgctggctgagg

SEQ ID NO: 942922 - DNA, 25 bp, Mus musculus
gctcacacccatggcgacgccgtga

SEQ ID NO: 942923 - DNA, 25 bp, Mus musculus
gctcacaccctaaagatggcgacgc

SEQ ID NO: 942924 - DNA, 25 bp, Mus musculus
gctcacacccttggcgacgccgtga

SEQ ID NO: 942925 - DNA, 25 bp, Mus musculus
gctcacagaatgcaagtcacacaag

SEQ ID NO: 942926 - DNA, 25 bp, Mus musculus
gctcacagaatgcatgtcacacaag

SEQ ID NO: 942927 - DNA, 25 bp, Mus musculus
gctcacagtgaacgcccgtgagcac

SEQ ID NO: 942928 - DNA, 25 bp, Mus musculus
gctcacagtgaaggcccgtgagcac

SEQ ID NO: 942929 - DNA, 25 bp, Mus musculus
gctcacattcgacacgagttgaaca

SEQ ID NO: 942930 - DNA, 25 bp, Mus musculus
gctcacattcgacaggagttgaaca

SEQ ID NO: 942931 - DNA, 25 bp, Mus musculus
gctcaccaccaatgagtacgtctac

SEQ ID NO: 942932 - DNA, 25 bp, Mus musculus
gctcaccaccaatgtgtacgtctac

SEQ ID NO: 942933 - DNA, 25 bp, Mus musculus
gctcaccaccatctccccggaacag

SEQ ID NO: 942934 - DNA, 25 bp, Mus musculus
gctcaccaccatgtccccggaacag

SEQ ID NO: 942935 - DNA, 25 bp, Mus musculus
gctcaccatcaaaagcaagccgctt

SEQ ID NO: 942936 - DNA, 25 bp, Mus musculus
gctcaccatcaatagcaagccgctt

SEQ ID NO: 942937 - DNA, 25 bp, Mus musculus
gctcacccacagagtgctgacctag

SEQ ID NO: 942938 - DNA, 25 bp, Mus musculus
gctcacccacagtgtgctgacctag

SEQ ID NO: 942939 - DNA, 25 bp, Mus musculus
gctcacccagagtgtcctgagagcc

SEQ ID NO: 942940 - DNA, 25 bp, Mus musculus
gctcacccaggaagtgagagtctgg

SEQ ID NO: 942941 - DNA, 25 bp, Mus musculus
gctcacccaggatgtgagagtctgg

SEQ ID NO: 942942 - DNA, 25 bp, Mus musculus
gctcacccagtgtgtcctgagagcc

SEQ ID NO: 942943 - DNA, 25 bp, Mus musculus
gctcaccccgagtgggtcagctgag

SEQ ID NO: 942944 - DNA, 25 bp, Mus musculus
gctcaccccgtgtgggtcagctgag

SEQ ID NO: 942945 - DNA, 25 bp, Mus musculus
gctcaccctcagcaaaggcgggaac

SEQ ID NO: 942946 - DNA, 25 bp, Mus musculus
gctcaccctcaggaaaggcgggaac

SEQ ID NO: 942947 - DNA, 25 bp, Mus musculus
gctcaccctgattgactcgtggtgc

SEQ ID NO: 942948 - DNA, 25 bp, Mus musculus
gctcaccctgcgactactgtgaaga

SEQ ID NO: 942949 - DNA, 25 bp, Mus musculus
gctcaccctggacgttcctggtgtc

SEQ ID NO: 942950 - DNA, 25 bp, Mus musculus
gctcaccctggaggttcctggtgtc

SEQ ID NO: 942951 - DNA, 25 bp, Mus musculus
gctcaccctgggactactgtgaaga

SEQ ID NO: 942952 - DNA, 25 bp, Mus musculus
gctcaccctgtttgactcgtggtgc

SEQ ID NO: 942953 - DNA, 25 bp, Mus musculus
gctcacctacatcaagcttagtggg

SEQ ID NO: 942954 - DNA, 25 bp, Mus musculus
gctcacctacatcatgcttagtggg

SEQ ID NO: 942955 - DNA, 25 bp, Mus musculus
gctcaccttgaaaatgaagtccctc

SEQ ID NO: 942956 - DNA, 25 bp, Mus musculus
gctcaccttgagttcgacttccacc

SEQ ID NO: 942957 - DNA, 25 bp, Mus musculus
gctcaccttgtaaatgaagtccctc

SEQ ID NO: 942958 - DNA, 25 bp, Mus musculus
gctcaccttgtgttcgacttccacc

SEQ ID NO: 942959 - DNA, 25 bp, Mus musculus
gctcacgagaagatgtgtatgtcga

SEQ ID NO: 942960 - DNA, 25 bp, Mus musculus
gctcacgagaagttgtgtatgtcga

SEQ ID NO: 942961 - DNA, 25 bp, Mus musculus
gctcacgagggcgacgctcggctat

SEQ ID NO: 942962 - DNA, 25 bp, Mus musculus
gctcacgagggcgaggctcggctat

SEQ ID NO: 942963 - DNA, 25 bp, Mus musculus
gctcacgcctctagaccagcagtta

SEQ ID NO: 942964 - DNA, 25 bp, Mus musculus
gctcacgcctctcttctgtattatg

SEQ ID NO: 942965 - DNA, 25 bp, Mus musculus
gctcacgcctctgttctgtattatg

SEQ ID NO: 942966 - DNA, 25 bp, Mus musculus
gctcacgcctcttgaccagcagtta

SEQ ID NO: 942967 - DNA, 25 bp, Mus musculus
gctcacgtcgcacaccatggaggag

SEQ ID NO: 942968 - DNA, 25 bp, Mus musculus
gctcacgtcgcacagcatggaggag

SEQ ID NO: 942969 - DNA, 25 bp, Mus musculus
gctcactcatgcagcttgctgatgc

SEQ ID NO: 942970 - DNA, 25 bp, Mus musculus
gctcactcatgcaggttgctgatgc

SEQ ID NO: 942971 - DNA, 25 bp, Mus musculus
gctcactgccaacgggacaatgacg

SEQ ID NO: 942972 - DNA, 25 bp, Mus musculus
gctcactgccaacgtgaaagcagcc

SEQ ID NO: 942973 - DNA, 25 bp, Mus musculus
gctcactgccaaggggacaatgacg

SEQ ID NO: 942974 - DNA, 25 bp, Mus musculus
gctcactgccaaggtgaaagcagcc

SEQ ID NO: 942975 - DNA, 25 bp, Mus musculus
gctcactggatccccgcccttcact

SEQ ID NO: 942976 - DNA, 25 bp, Mus musculus
gctcactggatcgccgcccttcact

SEQ ID NO: 942977 - DNA, 25 bp, Mus musculus
gctcactggtgacaaccctctgcag

SEQ ID NO: 942978 - DNA, 25 bp, Mus musculus
gctcactggtgactggcccccgaga

SEQ ID NO: 942979 - DNA, 25 bp, Mus musculus
gctcactggtgagaaccctctgcag

SEQ ID NO: 942980 - DNA, 25 bp, Mus musculus
gctcactggtgagtggcccccgaga

SEQ ID NO: 942981 - DNA, 25 bp, Mus musculus
gctcactgtggacgagctgaagttc

SEQ ID NO: 942982 - DNA, 25 bp, Mus musculus
gctcactgtggaggagctgaagttc

SEQ ID NO: 942983 - DNA, 25 bp, Mus musculus
gctcagaaacagccggaaaaactga

SEQ ID NO: 942984 - DNA, 25 bp, Mus musculus
gctcagaaacaggcggaaaaactga

SEQ ID NO: 942985 - DNA, 25 bp, Mus musculus
gctcagaaagctgtgtatgatcgga

SEQ ID NO: 942986 - DNA, 25 bp, Mus musculus
gctcagaaaggtgtgtatgatcgga

SEQ ID NO: 942987 - DNA, 25 bp, Mus musculus
gctcagaaccttacaatcttcctga

SEQ ID NO: 942988 - DNA, 25 bp, Mus musculus
gctcagaacctttcaatcttcctga

SEQ ID NO: 942989 - DNA, 25 bp, Mus musculus
gctcagaacgaaccaagaattgtca

SEQ ID NO: 942990 - DNA, 25 bp, Mus musculus
gctcagaacgcatcaataagccaag

SEQ ID NO: 942991 - DNA, 25 bp, Mus musculus
gctcagaacggatcaataagccaag

SEQ ID NO: 942992 - DNA, 25 bp, Mus musculus
gctcagaacgtaccaagaattgtca

SEQ ID NO: 942993 - DNA, 25 bp, Mus musculus
gctcagacagtgcgtgtccacccag

SEQ ID NO: 942994 - DNA, 25 bp, Mus musculus
gctcagacagtgggtgtccacccag

SEQ ID NO: 942995 - DNA, 25 bp, Mus musculus
gctcagaccaagcccaccttcttga

SEQ ID NO: 942996 - DNA, 25 bp, Mus musculus
gctcagaccaaggccaccttcttga

SEQ ID NO: 942997 - DNA, 25 bp, Mus musculus
gctcagagagtccgcgtccctacag

SEQ ID NO: 942998 - DNA, 25 bp, Mus musculus
gctcagagagtccggtctgagtgcc

SEQ ID NO: 942999 - DNA, 25 bp, Mus musculus
gctcagagagtcggcgtccctacag

SEQ ID NO: 943000 - DNA, 25 bp, Mus musculus
gctcagagagtcgggtctgagtgcc

SEQ ID NO: 943001 - DNA, 25 bp, Mus musculus
gctcagagcacacgtgcctggatcc

SEQ ID NO: 943002 - DNA, 25 bp, Mus musculus
gctcagagcacaggtgcctggatcc

SEQ ID NO: 943003 - DNA, 25 bp, Mus musculus
gctcagagggatcagaaacatcgag

SEQ ID NO: 943004 - DNA, 25 bp, Mus musculus
gctcagagggttcagaaacatcgag

SEQ ID NO: 943005 - DNA, 25 bp, Mus musculus
gctcagagtacacgagctggagatg

SEQ ID NO: 943006 - DNA, 25 bp, Mus musculus
gctcagagtacaggagctggagatg

SEQ ID NO: 943007 - DNA, 25 bp, Mus musculus
gctcagatccaaatcgtaactcacc

SEQ ID NO: 943008 - DNA, 25 bp, Mus musculus
gctcagatccaaatggtaactcacc

SEQ ID NO: 943009 - DNA, 25 bp, Mus musculus
gctcagatgaaaagaagaaaccaaa

SEQ ID NO: 943010 - DNA, 25 bp, Mus musculus
gctcagatgataagaagaaaccaaa

SEQ ID NO: 943011 - DNA, 25 bp, Mus musculus
gctcagatggcaaaccaacaggaac

SEQ ID NO: 943012 - DNA, 25 bp, Mus musculus
gctcagatggcaaagcaacaggaac

SEQ ID NO: 943013 - DNA, 25 bp, Mus musculus
gctcagcagaagcttccagatgaag

SEQ ID NO: 943014 - DNA, 25 bp, Mus musculus
gctcagcagaaggttccagatgaag

SEQ ID NO: 943015 - DNA, 25 bp, Mus musculus
gctcagcagtggctttgatgacatt

SEQ ID NO: 943016 - DNA, 25 bp, Mus musculus
gctcagcagtgggtttgatgacatt

SEQ ID NO: 943017 - DNA, 25 bp, Mus musculus
gctcagcatgaaagccgggctggag

SEQ ID NO: 943018 - DNA, 25 bp, Mus musculus
gctcagcatgtaagccgggctggag

SEQ ID NO: 943019 - DNA, 25 bp, Mus musculus
gctcagcctggaagacctgccaggc

SEQ ID NO: 943020 - DNA, 25 bp, Mus musculus
gctcagcctggatgacctgccaggc

SEQ ID NO: 943021 - DNA, 25 bp, Mus musculus
gctcagcgacagattccggtattca

SEQ ID NO: 943022 - DNA, 25 bp, Mus musculus
gctcagcgacagtttccggtattca

SEQ ID NO: 943023 - DNA, 25 bp, Mus musculus
gctcagcgcgtgaacctctccagtc

SEQ ID NO: 943024 - DNA, 25 bp, Mus musculus
gctcagcgcgtgaagctctccagtc

SEQ ID NO: 943025 - DNA, 25 bp, Mus musculus
gctcagcgtggaccccttggatgaa

SEQ ID NO: 943026 - DNA, 25 bp, Mus musculus
gctcagcgtggacctgcagcccttg

SEQ ID NO: 943027 - DNA, 25 bp, Mus musculus
gctcagcgtggagcccttggatgaa

SEQ ID NO: 943028 - DNA, 25 bp, Mus musculus
gctcagcgtggagctgcagcccttg

SEQ ID NO: 943029 - DNA, 25 bp, Mus musculus
gctcagctaaagcggtggtgctact

SEQ ID NO: 943030 - DNA, 25 bp, Mus musculus
gctcagctaatgcggtggtgctact

SEQ ID NO: 943031 - DNA, 25 bp, Mus musculus
gctcagctcatccacatgagctggg

SEQ ID NO: 943032 - DNA, 25 bp, Mus musculus
gctcagctcatccagatgagctggg

SEQ ID NO: 943033 - DNA, 25 bp, Mus musculus
gctcaggacacagacgcaccaggta

SEQ ID NO: 943034 - DNA, 25 bp, Mus musculus
gctcaggacacagaggcaccaggta

SEQ ID NO: 943035 - DNA, 25 bp, Mus musculus
gctcaggagcgaaactgacaccagc

SEQ ID NO: 943036 - DNA, 25 bp, Mus musculus
gctcaggagcgaaagtgacaccagc

SEQ ID NO: 943037 - DNA, 25 bp, Mus musculus
gctcaggccgcctccaggtttacct

SEQ ID NO: 943038 - DNA, 25 bp, Mus musculus
gctcaggccggctccaggtttacct

SEQ ID NO: 943039 - DNA, 25 bp, Mus musculus
gctcaggcggagaactactctcaaa

SEQ ID NO: 943040 - DNA, 25 bp, Mus musculus
gctcaggcggagaagtactctcaaa

SEQ ID NO: 943041 - DNA, 25 bp, Mus musculus
gctcaggctgagaactactctcaga

SEQ ID NO: 943042 - DNA, 25 bp, Mus musculus
gctcaggctgagaagtactctcaga

SEQ ID NO: 943043 - DNA, 25 bp, Mus musculus
gctcaggcttgtctttctatctttc

SEQ ID NO: 943044 - DNA, 25 bp, Mus musculus
gctcaggcttgtgtttctatctttc

SEQ ID NO: 943045 - DNA, 25 bp, Mus musculus
gctcagggaaagcacgttcgacttc

SEQ ID NO: 943046 - DNA, 25 bp, Mus musculus
gctcagggaaagcaggttcgacttc

SEQ ID NO: 943047 - DNA, 25 bp, Mus musculus
gctcagggagcttgctacctgtgtg

SEQ ID NO: 943048 - DNA, 25 bp, Mus musculus
gctcagggaggttgctacctgtgtg

SEQ ID NO: 943049 - DNA, 25 bp, Mus musculus
gctcaggggccacgagctgaagttg

SEQ ID NO: 943050 - DNA, 25 bp, Mus musculus
gctcaggggccaggagctgaagttg

SEQ ID NO: 943051 - DNA, 25 bp, Mus musculus
gctcagttcacacaaataccagatc

SEQ ID NO: 943052 - DNA, 25 bp, Mus musculus
gctcagttcacagaaataccagatc

SEQ ID NO: 943053 - DNA, 25 bp, Mus musculus
gctcagttcttgctgaaagcagccc

SEQ ID NO: 943054 - DNA, 25 bp, Mus musculus
gctcagttcttggtgaaagcagccc

SEQ ID NO: 943055 - DNA, 25 bp, Mus musculus
gctcatagacaacatgggagctttc

SEQ ID NO: 943056 - DNA, 25 bp, Mus musculus
gctcatagacaagatgggagctttc

SEQ ID NO: 943057 - DNA, 25 bp, Mus musculus
gctcatcagtcacttctcaggttcc

SEQ ID NO: 943058 - DNA, 25 bp, Mus musculus
gctcatcagtcagttctcaggttcc

SEQ ID NO: 943059 - DNA, 25 bp, Mus musculus
gctcatcatctgcattcctccccag

SEQ ID NO: 943060 - DNA, 25 bp, Mus musculus
gctcatcatctggattcctccccag

SEQ ID NO: 943061 - DNA, 25 bp, Mus musculus
gctcatccagatgagctgggccacc

SEQ ID NO: 943062 - DNA, 25 bp, Mus musculus
gctcatccagcccaaagggggcagt

SEQ ID NO: 943063 - DNA, 25 bp, Mus musculus
gctcatccaggccaaagggggcagt

SEQ ID NO: 943064 - DNA, 25 bp, Mus musculus
gctcatccagttgagctgggccacc

SEQ ID NO: 943065 - DNA, 25 bp, Mus musculus
gctcatccggaaggagcttcgtcca

SEQ ID NO: 943066 - DNA, 25 bp, Mus musculus
gctcatccggaaggtgcttcgtcca

SEQ ID NO: 943067 - DNA, 25 bp, Mus musculus
gctcatcctgcaccaaattgccttc

SEQ ID NO: 943068 - DNA, 25 bp, Mus musculus
gctcatcctgcagcaaattgccttc

SEQ ID NO: 943069 - DNA, 25 bp, Mus musculus
gctcatcggaacagcgaaatgggaa

SEQ ID NO: 943070 - DNA, 25 bp, Mus musculus
gctcatcggaacagggaaatgggaa

SEQ ID NO: 943071 - DNA, 25 bp, Mus musculus
gctcatctcccacacatacgggagc

SEQ ID NO: 943072 - DNA, 25 bp, Mus musculus
gctcatctcccagacatacgggagc

SEQ ID NO: 943073 - DNA, 25 bp, Mus musculus
gctcatgagaagctacacactgaat

SEQ ID NO: 943074 - DNA, 25 bp, Mus musculus
gctcatgagaaggtacacactgaat

SEQ ID NO: 943075 - DNA, 25 bp, Mus musculus
gctcatgcagcatgatctacacatt

SEQ ID NO: 943076 - DNA, 25 bp, Mus musculus
gctcatgcaggatgatctacacatt

SEQ ID NO: 943077 - DNA, 25 bp, Mus musculus
gctcatggagagagcagtagagatg

SEQ ID NO: 943078 - DNA, 25 bp, Mus musculus
gctcatggagcttgagatcttcttg

SEQ ID NO: 943079 - DNA, 25 bp, Mus musculus
gctcatggaggttgagatcttcttg

SEQ ID NO: 943080 - DNA, 25 bp, Mus musculus
gctcatggagtgagcagtagagatg

SEQ ID NO: 943081 - DNA, 25 bp, Mus musculus
gctcatggctcacgtgaaccagacc

SEQ ID NO: 943082 - DNA, 25 bp, Mus musculus
gctcatggctcaggtgaaccagacc

SEQ ID NO: 943083 - DNA, 25 bp, Mus musculus
gctcatgggacacgtgaacaccttt

SEQ ID NO: 943084 - DNA, 25 bp, Mus musculus
gctcatgggacaggtgaacaccttt

SEQ ID NO: 943085 - DNA, 25 bp, Mus musculus
gctcatgttctacgcagcaagagct

SEQ ID NO: 943086 - DNA, 25 bp, Mus musculus
gctcatgttctaggcagcaagagct

SEQ ID NO: 943087 - DNA, 25 bp, Mus musculus
gctcattaagctcacacggctgcag

SEQ ID NO: 943088 - DNA, 25 bp, Mus musculus
gctcattaaggtcacacggctgcag

SEQ ID NO: 943089 - DNA, 25 bp, Mus musculus
gctcattgagctgaatgggcagaac

SEQ ID NO: 943090 - DNA, 25 bp, Mus musculus
gctcattgaggtgaatgggcagaac

SEQ ID NO: 943091 - DNA, 25 bp, Mus musculus
gctcattgatgtcgatgagaaaaac

SEQ ID NO: 943092 - DNA, 25 bp, Mus musculus
gctcattgatgtggatgagaaaaac

SEQ ID NO: 943093 - DNA, 25 bp, Mus musculus
gctcatttcccacacacctggattt

SEQ ID NO: 943094 - DNA, 25 bp, Mus musculus
gctcatttcccacagacctggattt

SEQ ID NO: 943095 - DNA, 25 bp, Mus musculus
gctccaaaagcacttggcagccaag

SEQ ID NO: 943096 - DNA, 25 bp, Mus musculus
gctccaaaagcagttggcagccaag

SEQ ID NO: 943097 - DNA, 25 bp, Mus musculus
gctccaaagtcgctttctgtatgca

SEQ ID NO: 943098 - DNA, 25 bp, Mus musculus
gctccaaagtcggtttctgtatgca

SEQ ID NO: 943099 - DNA, 25 bp, Mus musculus
gctccaacgatgagaaagagttcct

SEQ ID NO: 943100 - DNA, 25 bp, Mus musculus
gctccaacgatgtgaaagagttcct

SEQ ID NO: 943101 - DNA, 25 bp, Mus musculus
gctccaactcttggcattgaccttg

SEQ ID NO: 943102 - DNA, 25 bp, Mus musculus
gctccaactcttgggattgaccttg

SEQ ID NO: 943103 - DNA, 25 bp, Mus musculus
gctccaactgccgtccctacagccg

SEQ ID NO: 943104 - DNA, 25 bp, Mus musculus
gctccaactggcgtccctacagccg

SEQ ID NO: 943105 - DNA, 25 bp, Mus musculus
gctccaactttcctcctgagactgg

SEQ ID NO: 943106 - DNA, 25 bp, Mus musculus
gctccaactttcgtcctgagactgg

SEQ ID NO: 943107 - DNA, 25 bp, Mus musculus
gctccacatgaactcacagaagaac

SEQ ID NO: 943108 - DNA, 25 bp, Mus musculus
gctccacatgacattctctggcttc

SEQ ID NO: 943109 - DNA, 25 bp, Mus musculus
gctccacatgccatttaccaatcta

SEQ ID NO: 943110 - DNA, 25 bp, Mus musculus
gctccacatggcatttaccaatcta

SEQ ID NO: 943111 - DNA, 25 bp, Mus musculus
gctccacatgtactcacagaagaac

SEQ ID NO: 943112 - DNA, 25 bp, Mus musculus
gctccacatgtcattctctggcttc

SEQ ID NO: 943113 - DNA, 25 bp, Mus musculus
gctccaccgcccgacactgtgtttc

SEQ ID NO: 943114 - DNA, 25 bp, Mus musculus
gctccaccgcccgagactgtgtttc

SEQ ID NO: 943115 - DNA, 25 bp, Mus musculus
gctccaccttcaatcgctacaaact

SEQ ID NO: 943116 - DNA, 25 bp, Mus musculus
gctccaccttcaatggctacaaact

SEQ ID NO: 943117 - DNA, 25 bp, Mus musculus
gctccactcatgcagctgacctgca

SEQ ID NO: 943118 - DNA, 25 bp, Mus musculus
gctccactcatggagctgacctgca

SEQ ID NO: 943119 - DNA, 25 bp, Mus musculus
gctccagaacgacaagaataatgca

SEQ ID NO: 943120 - DNA, 25 bp, Mus musculus
gctccagaacgacatgaataatgca

SEQ ID NO: 943121 - DNA, 25 bp, Mus musculus
gctccagatgatgagaagctgtatg

SEQ ID NO: 943122 - DNA, 25 bp, Mus musculus
gctccagatgctgtggccagcgtca

SEQ ID NO: 943123 - DNA, 25 bp, Mus musculus
gctccagatggtgtggccagcgtca

SEQ ID NO: 943124 - DNA, 25 bp, Mus musculus
gctccagatgttgagaagctgtatg

SEQ ID NO: 943125 - DNA, 25 bp, Mus musculus
gctccagattcacgcgacaactggc

SEQ ID NO: 943126 - DNA, 25 bp, Mus musculus
gctccagattcaggcgacaactggc

SEQ ID NO: 943127 - DNA, 25 bp, Mus musculus
gctccagcacagcatgcgggctcct

SEQ ID NO: 943128 - DNA, 25 bp, Mus musculus
gctccagcacagcctcggctgacca

SEQ ID NO: 943129 - DNA, 25 bp, Mus musculus
gctccagcacaggatgcgggctcct

SEQ ID NO: 943130 - DNA, 25 bp, Mus musculus
gctccagcacaggctcggctgacca

SEQ ID NO: 943131 - DNA, 25 bp, Mus musculus
gctccagcatagccccacggcctgc

SEQ ID NO: 943132 - DNA, 25 bp, Mus musculus
gctccagcataggcccacggcctgc

SEQ ID NO: 943133 - DNA, 25 bp, Mus musculus
gctccagccacaccccaagcccagc

SEQ ID NO: 943134 - DNA, 25 bp, Mus musculus
gctccagccacagcccaagcccagc

SEQ ID NO: 943135 - DNA, 25 bp, Mus musculus
gctccagctcgacgtgacatggagg

SEQ ID NO: 943136 - DNA, 25 bp, Mus musculus
gctccagctcgaggtgacatggagg

SEQ ID NO: 943137 - DNA, 25 bp, Mus musculus
gctccaggagaccacggagagaaat

SEQ ID NO: 943138 - DNA, 25 bp, Mus musculus
gctccaggagaccagggagagaaat

SEQ ID NO: 943139 - DNA, 25 bp, Mus musculus
gctccaggatttcacattcttccca

SEQ ID NO: 943140 - DNA, 25 bp, Mus musculus
gctccaggatttcagattcttccca

SEQ ID NO: 943141 - DNA, 25 bp, Mus musculus
gctccaggcaggctggagtgtcatc

SEQ ID NO: 943142 - DNA, 25 bp, Mus musculus
gctccaggcagggtggagtgtcatc

SEQ ID NO: 943143 - DNA, 25 bp, Mus musculus
gctccagtgaccagcccgtccctgc

SEQ ID NO: 943144 - DNA, 25 bp, Mus musculus
gctccagtgaccaggccgtccctgc

SEQ ID NO: 943145 - DNA, 25 bp, Mus musculus
gctccagttttacacgaatctgggc

SEQ ID NO: 943146 - DNA, 25 bp, Mus musculus
gctccagttttacaggaatctgggc

SEQ ID NO: 943147 - DNA, 25 bp, Mus musculus
gctccatccgccctctgtcatcccg

SEQ ID NO: 943148 - DNA, 25 bp, Mus musculus
gctccatccgccgtctgtcatcccg

SEQ ID NO: 943149 - DNA, 25 bp, Mus musculus
gctccatgggcttcccaggcctctt

SEQ ID NO: 943150 - DNA, 25 bp, Mus musculus
gctccatggggttcccaggcctctt

SEQ ID NO: 943151 - DNA, 25 bp, Mus musculus
gctccatgtcggaagttgatcttga

SEQ ID NO: 943152 - DNA, 25 bp, Mus musculus
gctccatgtcggatgatcttgaaag

SEQ ID NO: 943153 - DNA, 25 bp, Mus musculus
gctccatgtcggtagttgatcttga

SEQ ID NO: 943154 - DNA, 25 bp, Mus musculus
gctccatgtcggttgatcttgaaag

SEQ ID NO: 943155 - DNA, 25 bp, Mus musculus
gctcccaagctgcaatccccaaaag

SEQ ID NO: 943156 - DNA, 25 bp, Mus musculus
gctcccaagctggaatccccaaaag

SEQ ID NO: 943157 - DNA, 25 bp, Mus musculus
gctcccaaggagccccccaagaagc

SEQ ID NO: 943158 - DNA, 25 bp, Mus musculus
gctcccaaggaggcccccaagaagc

SEQ ID NO: 943159 - DNA, 25 bp, Mus musculus
gctcccacacagccttggacaaatt

SEQ ID NO: 943160 - DNA, 25 bp, Mus musculus
gctcccacacagctgagaagcccta

SEQ ID NO: 943161 - DNA, 25 bp, Mus musculus
gctcccacacaggcttggacaaatt

SEQ ID NO: 943162 - DNA, 25 bp, Mus musculus
gctcccacacaggtgagaagcccta

SEQ ID NO: 943163 - DNA, 25 bp, Mus musculus
gctcccacagagagccaacccactg

SEQ ID NO: 943164 - DNA, 25 bp, Mus musculus
gctcccacagcgaagccctgcccgg

SEQ ID NO: 943165 - DNA, 25 bp, Mus musculus
gctcccacagggaagccctgcccgg

SEQ ID NO: 943166 - DNA, 25 bp, Mus musculus
gctcccacagtgagccaacccactg

SEQ ID NO: 943167 - DNA, 25 bp, Mus musculus
gctcccacccagaaggctgccttct

SEQ ID NO: 943168 - DNA, 25 bp, Mus musculus
gctcccacccagtaggctgccttct

SEQ ID NO: 943169 - DNA, 25 bp, Mus musculus
gctcccaccgagcacgtgacattcc

SEQ ID NO: 943170 - DNA, 25 bp, Mus musculus
gctcccaccgagcaggtgacattcc

SEQ ID NO: 943171 - DNA, 25 bp, Mus musculus
gctcccagaatgatatggctgcagc

SEQ ID NO: 943172 - DNA, 25 bp, Mus musculus
gctcccagaatgcatgtaaccatta

SEQ ID NO: 943173 - DNA, 25 bp, Mus musculus
gctcccagaatggatgtaaccatta

SEQ ID NO: 943174 - DNA, 25 bp, Mus musculus
gctcccagaatgttatggctgcagc

SEQ ID NO: 943175 - DNA, 25 bp, Mus musculus
gctcccaggactcgtcaatgtggct

SEQ ID NO: 943176 - DNA, 25 bp, Mus musculus
gctcccaggactggtcaatgtggct

SEQ ID NO: 943177 - DNA, 25 bp, Mus musculus
gctccccagcagctccctggaatcc

SEQ ID NO: 943178 - DNA, 25 bp, Mus musculus
gctccccagcaggtccctggaatcc

SEQ ID NO: 943179 - DNA, 25 bp, Mus musculus
gctcccccaatccacgaggctgctg

SEQ ID NO: 943180 - DNA, 25 bp, Mus musculus
gctcccccaatccactacaggaggc

SEQ ID NO: 943181 - DNA, 25 bp, Mus musculus
gctcccccaatccaggaggctgctg

SEQ ID NO: 943182 - DNA, 25 bp, Mus musculus
gctcccccaatccagtacaggaggc

SEQ ID NO: 943183 - DNA, 25 bp, Mus musculus
gctcccccagctcctcacctgggcc

SEQ ID NO: 943184 - DNA, 25 bp, Mus musculus
gctcccccaggtcctcacctgggcc

SEQ ID NO: 943185 - DNA, 25 bp, Mus musculus
gctccccgagctgtgaatgaggcag

SEQ ID NO: 943186 - DNA, 25 bp, Mus musculus
gctccccgaggtgtgaatgaggcag

SEQ ID NO: 943187 - DNA, 25 bp, Mus musculus
gctccccgttagcccagcaggtggc

SEQ ID NO: 943188 - DNA, 25 bp, Mus musculus
gctccccgttaggccagcaggtggc

SEQ ID NO: 943189 - DNA, 25 bp, Mus musculus
gctcccctcttgcatgtcacggcag

SEQ ID NO: 943190 - DNA, 25 bp, Mus musculus
gctcccctcttggatgtcacggcag

SEQ ID NO: 943191 - DNA, 25 bp, Mus musculus
gctcccgaaaccaactggagctgat

SEQ ID NO: 943192 - DNA, 25 bp, Mus musculus
gctcccgaaaccaagtggagctgat

SEQ ID NO: 943193 - DNA, 25 bp, Mus musculus
gctcccgagaagctgatcgtgaaga

SEQ ID NO: 943194 - DNA, 25 bp, Mus musculus
gctcccgagaaggtgatcgtgaaga

SEQ ID NO: 943195 - DNA, 25 bp, Mus musculus
gctcccgccaaacgccatgagaatt

SEQ ID NO: 943196 - DNA, 25 bp, Mus musculus
gctcccgccaaaggccatgagaatt

SEQ ID NO: 943197 - DNA, 25 bp, Mus musculus
gctcccgcctcgcgttgctgttctg

SEQ ID NO: 943198 - DNA, 25 bp, Mus musculus
gctcccgcctcgggttgctgttctg

SEQ ID NO: 943199 - DNA, 25 bp, Mus musculus
gctcccgctaagtcgtcagcgcaga

SEQ ID NO: 943200 - DNA, 25 bp, Mus musculus
gctcccgctactgttgcagaggttt

SEQ ID NO: 943201 - DNA, 25 bp, Mus musculus
gctcccgctagtgttgcagaggttt

SEQ ID NO: 943202 - DNA, 25 bp, Mus musculus
gctcccgctatgtcgtcagcgcaga

SEQ ID NO: 943203 - DNA, 25 bp, Mus musculus
gctcccggcgtccacatgattgctg

SEQ ID NO: 943204 - DNA, 25 bp, Mus musculus
gctcccggcgtccagatgattgctg

SEQ ID NO: 943205 - DNA, 25 bp, Mus musculus
gctcccgggagccgggcagccacag

SEQ ID NO: 943206 - DNA, 25 bp, Mus musculus
gctcccgggagccgtcgagctagag

SEQ ID NO: 943207 - DNA, 25 bp, Mus musculus
gctcccgggagcggggcagccacag

SEQ ID NO: 943208 - DNA, 25 bp, Mus musculus
gctcccgggagcggtcgagctagag

SEQ ID NO: 943209 - DNA, 25 bp, Mus musculus
gctccctagaagatggattcatggg

SEQ ID NO: 943210 - DNA, 25 bp, Mus musculus
gctccctagaagcgcaacaacccgg

SEQ ID NO: 943211 - DNA, 25 bp, Mus musculus
gctccctagaagggcaacaacccgg

SEQ ID NO: 943212 - DNA, 25 bp, Mus musculus
gctccctagaagttggattcatggg

SEQ ID NO: 943213 - DNA, 25 bp, Mus musculus
gctccctcagctataagtattgttt

SEQ ID NO: 943214 - DNA, 25 bp, Mus musculus
gctccctcagctcctcctggacttc

SEQ ID NO: 943215 - DNA, 25 bp, Mus musculus
gctccctcagctgctcctggacttc

SEQ ID NO: 943216 - DNA, 25 bp, Mus musculus
gctccctcaggtataagtattgttt

SEQ ID NO: 943217 - DNA, 25 bp, Mus musculus
gctccctgagggctacctcggaatc

SEQ ID NO: 943218 - DNA, 25 bp, Mus musculus
gctccctgaggggtacctcggaatc

SEQ ID NO: 943219 - DNA, 25 bp, Mus musculus
gctccctgcactcgtcctccatcgg

SEQ ID NO: 943220 - DNA, 25 bp, Mus musculus
gctccctgcactggtcctccatcgg

SEQ ID NO: 943221 - DNA, 25 bp, Mus musculus
gctccctgcaggctcccacaaaaca

SEQ ID NO: 943222 - DNA, 25 bp, Mus musculus
gctccctgcagggtcccacaaaaca

SEQ ID NO: 943223 - DNA, 25 bp, Mus musculus
gctccctgctcccgcaagacattgc

SEQ ID NO: 943224 - DNA, 25 bp, Mus musculus
gctccctgctccggcaagacattgc

SEQ ID NO: 943225 - DNA, 25 bp, Mus musculus
gctccgcaactacacgtctcacccc

SEQ ID NO: 943226 - DNA, 25 bp, Mus musculus
gctccgcaactacaggtctcacccc

SEQ ID NO: 943227 - DNA, 25 bp, Mus musculus
gctccgcacctccacacaagttcag

SEQ ID NO: 943228 - DNA, 25 bp, Mus musculus
gctccgcacctccagacaagttcag

SEQ ID NO: 943229 - DNA, 25 bp, Mus musculus
gctccgcctttggcaactgcgagtg

SEQ ID NO: 943230 - DNA, 25 bp, Mus musculus
gctccgcctttggcactgtagctat

SEQ ID NO: 943231 - DNA, 25 bp, Mus musculus
gctccgcctttggcagtcagaccaa

SEQ ID NO: 943232 - DNA, 25 bp, Mus musculus
gctccgcctttggctactgcgagtg

SEQ ID NO: 943233 - DNA, 25 bp, Mus musculus
gctccgcctttggctctgtagctat

SEQ ID NO: 943234 - DNA, 25 bp, Mus musculus
gctccgcctttggctgtcagaccaa

SEQ ID NO: 943235 - DNA, 25 bp, Mus musculus
gctccgcgccagcctcctgcttcag

SEQ ID NO: 943236 - DNA, 25 bp, Mus musculus
gctccgcgccaggctcctgcttcag

SEQ ID NO: 943237 - DNA, 25 bp, Mus musculus
gctccgcgggctcaggaaatataag

SEQ ID NO: 943238 - DNA, 25 bp, Mus musculus
gctccgcgggctgaggaaatataag

SEQ ID NO: 943239 - DNA, 25 bp, Mus musculus
gctccgcgtgagaatcaaatacctg

SEQ ID NO: 943240 - DNA, 25 bp, Mus musculus
gctccgcgtgtgaatcaaatacctg

SEQ ID NO: 943241 - DNA, 25 bp, Mus musculus
gctccggaagcacgataagaaaagc

SEQ ID NO: 943242 - DNA, 25 bp, Mus musculus
gctccggaaggacgataagaaaagc

SEQ ID NO: 943243 - DNA, 25 bp, Mus musculus
gctccggcaaattacgtctgacttt

SEQ ID NO: 943244 - DNA, 25 bp, Mus musculus
gctccggcaaattaggtctgacttt

SEQ ID NO: 943245 - DNA, 25 bp, Mus musculus
gctccggcaacacgtggaagatctc

SEQ ID NO: 943246 - DNA, 25 bp, Mus musculus
gctccggcaacaggtggaagatctc

SEQ ID NO: 943247 - DNA, 25 bp, Mus musculus
gctccgggctgactcaagtccatca

SEQ ID NO: 943248 - DNA, 25 bp, Mus musculus
gctccgggctgagtcaagtccatca

SEQ ID NO: 943249 - DNA, 25 bp, Mus musculus
gctccggggacacgccttcccaggc

SEQ ID NO: 943250 - DNA, 25 bp, Mus musculus
gctccggggacaggccttcccaggc

SEQ ID NO: 943251 - DNA, 25 bp, Mus musculus
gctccggtaccacggtccagcctgt

SEQ ID NO: 943252 - DNA, 25 bp, Mus musculus
gctccggtaccagggtccagcctgt

SEQ ID NO: 943253 - DNA, 25 bp, Mus musculus
gctccggtcactatcagtgaaacat

SEQ ID NO: 943254 - DNA, 25 bp, Mus musculus
gctccggtcactatcgtgataaagt

SEQ ID NO: 943255 - DNA, 25 bp, Mus musculus
gctccggtcactatgagtgaaacat

SEQ ID NO: 943256 - DNA, 25 bp, Mus musculus
gctccggtcactatggtgataaagt

SEQ ID NO: 943257 - DNA, 25 bp, Mus musculus
gctccgtatagacgaagcccagccc

SEQ ID NO: 943258 - DNA, 25 bp, Mus musculus
gctccgtatagaggaagcccagccc

SEQ ID NO: 943259 - DNA, 25 bp, Mus musculus
gctccgtcctggatactccatgttt

SEQ ID NO: 943260 - DNA, 25 bp, Mus musculus
gctccgtcctggttactccatgttt

SEQ ID NO: 943261 - DNA, 25 bp, Mus musculus
gctcctacagcacccgtttgttaag

SEQ ID NO: 943262 - DNA, 25 bp, Mus musculus
gctcctacaggacccgtttgttaag

SEQ ID NO: 943263 - DNA, 25 bp, Mus musculus
gctcctagcccacatcccaccctga

SEQ ID NO: 943264 - DNA, 25 bp, Mus musculus
gctcctagcccagatcccaccctga

SEQ ID NO: 943265 - DNA, 25 bp, Mus musculus
gctcctatgtgtcacgaaggccaag

SEQ ID NO: 943266 - DNA, 25 bp, Mus musculus
gctcctatgtgtcacgtaggaaggc

SEQ ID NO: 943267 - DNA, 25 bp, Mus musculus
gctcctatgtgtcaggaaggccaag

SEQ ID NO: 943268 - DNA, 25 bp, Mus musculus
gctcctatgtgtcaggtaggaaggc

SEQ ID NO: 943269 - DNA, 25 bp, Mus musculus
gctcctcacagcaaccagcctccca

SEQ ID NO: 943270 - DNA, 25 bp, Mus musculus
gctcctcacagcaaccctcccatgt

SEQ ID NO: 943271 - DNA, 25 bp, Mus musculus
gctcctcacagcaagcagcctccca

SEQ ID NO: 943272 - DNA, 25 bp, Mus musculus
gctcctcacagcaagcctcccatgt

SEQ ID NO: 943273 - DNA, 25 bp, Mus musculus
gctcctcactgcttcccgtactact

SEQ ID NO: 943274 - DNA, 25 bp, Mus musculus
gctcctcactgcttgccgtactact

SEQ ID NO: 943275 - DNA, 25 bp, Mus musculus
gctcctccagcgtccggtactggga

SEQ ID NO: 943276 - DNA, 25 bp, Mus musculus
gctcctccagctgtttgtggtagcc

SEQ ID NO: 943277 - DNA, 25 bp, Mus musculus
gctcctccagcttgtctatctgcac

SEQ ID NO: 943278 - DNA, 25 bp, Mus musculus
gctcctccagggtccggtactggga

SEQ ID NO: 943279 - DNA, 25 bp, Mus musculus
gctcctccaggtgtttgtggtagcc

SEQ ID NO: 943280 - DNA, 25 bp, Mus musculus
gctcctccaggttgtctatctgcac

SEQ ID NO: 943281 - DNA, 25 bp, Mus musculus
gctcctcctcagcactgtgcctcac

SEQ ID NO: 943282 - DNA, 25 bp, Mus musculus
gctcctcctcaggactgtgcctcac

SEQ ID NO: 943283 - DNA, 25 bp, Mus musculus
gctcctcgcagactttcagagatgg

SEQ ID NO: 943284 - DNA, 25 bp, Mus musculus
gctcctcgcagagtttcagagatgg

SEQ ID NO: 943285 - DNA, 25 bp, Mus musculus
gctcctcggaccggagctgatccgt

SEQ ID NO: 943286 - DNA, 25 bp, Mus musculus
gctcctcggagcggagctgatccgt

SEQ ID NO: 943287 - DNA, 25 bp, Mus musculus
gctcctcgtgtgcgcattcctttgt

SEQ ID NO: 943288 - DNA, 25 bp, Mus musculus
gctcctcgtgtgcgctgcacgatct

SEQ ID NO: 943289 - DNA, 25 bp, Mus musculus
gctcctcgtgtgcggattcctttgt

SEQ ID NO: 943290 - DNA, 25 bp, Mus musculus
gctcctcgtgtgcggtgcacgatct

SEQ ID NO: 943291 - DNA, 25 bp, Mus musculus
gctcctctcttgctcaaactacaac

SEQ ID NO: 943292 - DNA, 25 bp, Mus musculus
gctcctctcttggtcaaactacaac

SEQ ID NO: 943293 - DNA, 25 bp, Mus musculus
gctcctgaaccacctggtccctgag

SEQ ID NO: 943294 - DNA, 25 bp, Mus musculus
gctcctgaaccagctggtccctgag

SEQ ID NO: 943295 - DNA, 25 bp, Mus musculus
gctcctgaagagcttggtggagggc

SEQ ID NO: 943296 - DNA, 25 bp, Mus musculus
gctcctgaagaggttggtggagggc

SEQ ID NO: 943297 - DNA, 25 bp, Mus musculus
gctcctgaagcctgggtggtcagac

SEQ ID NO: 943298 - DNA, 25 bp, Mus musculus
gctcctgaaggctgggtggtcagac

SEQ ID NO: 943299 - DNA, 25 bp, Mus musculus
gctcctgattaacacgggagcacat

SEQ ID NO: 943300 - DNA, 25 bp, Mus musculus
gctcctgattaacaggggagcacat

SEQ ID NO: 943301 - DNA, 25 bp, Mus musculus
gctcctgcagcaaacccaccatgcc

SEQ ID NO: 943302 - DNA, 25 bp, Mus musculus
gctcctgcagcaaagccaccatgcc

SEQ ID NO: 943303 - DNA, 25 bp, Mus musculus
gctcctgcagcaaattagccgtcac

SEQ ID NO: 943304 - DNA, 25 bp, Mus musculus
gctcctgcagcagggctgctggcct

SEQ ID NO: 943305 - DNA, 25 bp, Mus musculus
gctcctgcagctcctaagcagcgcc

SEQ ID NO: 943306 - DNA, 25 bp, Mus musculus
gctcctgcaggaaattagccgtcac

SEQ ID NO: 943307 - DNA, 25 bp, Mus musculus
gctcctgcaggagggctgctggcct

SEQ ID NO: 943308 - DNA, 25 bp, Mus musculus
gctcctgcaggtcctaagcagcgcc

SEQ ID NO: 943309 - DNA, 25 bp, Mus musculus
gctcctgccttgatcacagggtccc

SEQ ID NO: 943310 - DNA, 25 bp, Mus musculus
gctcctgccttgatgacagggtccc

SEQ ID NO: 943311 - DNA, 25 bp, Mus musculus
gctcctgctagccactgctttcgca

SEQ ID NO: 943312 - DNA, 25 bp, Mus musculus
gctcctgctagccagtgctttcgca

SEQ ID NO: 943313 - DNA, 25 bp, Mus musculus
gctcctgctgctgccgttcagctca

SEQ ID NO: 943314 - DNA, 25 bp, Mus musculus
gctcctgctgctgcggttcagctca

SEQ ID NO: 943315 - DNA, 25 bp, Mus musculus
gctcctgcttcccgtgttccgaatg

SEQ ID NO: 943316 - DNA, 25 bp, Mus musculus
gctcctgcttccggtgttccgaatg

SEQ ID NO: 943317 - DNA, 25 bp, Mus musculus
gctcctggacagctggtggtcgggc

SEQ ID NO: 943318 - DNA, 25 bp, Mus musculus
gctcctggacaggtggtggtcgggc

SEQ ID NO: 943319 - DNA, 25 bp, Mus musculus
gctcctggagcacccccaggctgaa

SEQ ID NO: 943320 - DNA, 25 bp, Mus musculus
gctcctggagcagccccaggctgaa

SEQ ID NO: 943321 - DNA, 25 bp, Mus musculus
gctcctggagcgaggtgtggacgtg

SEQ ID NO: 943322 - DNA, 25 bp, Mus musculus
gctcctggagggaggtgtggacgtg

SEQ ID NO: 943323 - DNA, 25 bp, Mus musculus
gctcctggatgaaacgtcgagattt

SEQ ID NO: 943324 - DNA, 25 bp, Mus musculus
gctcctggatgaaaggtcgagattt

SEQ ID NO: 943325 - DNA, 25 bp, Mus musculus
gctcctggatgacatgaagttctcc

SEQ ID NO: 943326 - DNA, 25 bp, Mus musculus
gctcctggatgagatgaagttctcc

SEQ ID NO: 943327 - DNA, 25 bp, Mus musculus
gctcctggcatgctacttttctcac

SEQ ID NO: 943328 - DNA, 25 bp, Mus musculus
gctcctggcatggtacttttctcac

SEQ ID NO: 943329 - DNA, 25 bp, Mus musculus
gctcctgggggacctctcagatact

SEQ ID NO: 943330 - DNA, 25 bp, Mus musculus
gctcctgggggagctctcagatact

SEQ ID NO: 943331 - DNA, 25 bp, Mus musculus
gctcctgggtacaacccaaaggtca

SEQ ID NO: 943332 - DNA, 25 bp, Mus musculus
gctcctgggtacaagccaaaggtca

SEQ ID NO: 943333 - DNA, 25 bp, Mus musculus
gctcctggtgcacagccttcaccac

SEQ ID NO: 943334 - DNA, 25 bp, Mus musculus
gctcctggtgcagagccttcaccac

SEQ ID NO: 943335 - DNA, 25 bp, Mus musculus
gctccttaccagcagatcgagactc

SEQ ID NO: 943336 - DNA, 25 bp, Mus musculus
gctccttaccaggagatcgagactc

SEQ ID NO: 943337 - DNA, 25 bp, Mus musculus
gctccttgatgcaaaatttgctgat

SEQ ID NO: 943338 - DNA, 25 bp, Mus musculus
gctccttgatgcaatatttgctgat

SEQ ID NO: 943339 - DNA, 25 bp, Mus musculus
gctccttgtagactaaacacatgaa

SEQ ID NO: 943340 - DNA, 25 bp, Mus musculus
gctccttgtagacttaacacatgaa

SEQ ID NO: 943341 - DNA, 25 bp, Mus musculus
gctcctttggcgtacgcggacttgg

SEQ ID NO: 943342 - DNA, 25 bp, Mus musculus
gctcctttggcgtaggcggacttgg

SEQ ID NO: 943343 - DNA, 25 bp, Mus musculus
gctcgaacagacaaccctttgagga

SEQ ID NO: 943344 - DNA, 25 bp, Mus musculus
gctcgaacagacaacggtgtgtctg

SEQ ID NO: 943345 - DNA, 25 bp, Mus musculus
gctcgaacagacaagcctttgagga

SEQ ID NO: 943346 - DNA, 25 bp, Mus musculus
gctcgaacagacaagggtgtgtctg

SEQ ID NO: 943347 - DNA, 25 bp, Mus musculus
gctcgacaaccacgttggcttcaaa

SEQ ID NO: 943348 - DNA, 25 bp, Mus musculus
gctcgacaaccaggttggcttcaaa

SEQ ID NO: 943349 - DNA, 25 bp, Mus musculus
gctcgacacgcacacggaggtatgt

SEQ ID NO: 943350 - DNA, 25 bp, Mus musculus
gctcgacacgcacagggaggtatgt

SEQ ID NO: 943351 - DNA, 25 bp, Mus musculus
gctcgagaacctgacgtcattgctg

SEQ ID NO: 943352 - DNA, 25 bp, Mus musculus
gctcgagaacctgaggtcattgctg

SEQ ID NO: 943353 - DNA, 25 bp, Mus musculus
gctcgagtcaccctttgccatctct

SEQ ID NO: 943354 - DNA, 25 bp, Mus musculus
gctcgagtcaccgtttgccatctct

SEQ ID NO: 943355 - DNA, 25 bp, Mus musculus
gctcgatactcgatcctgcatgcca

SEQ ID NO: 943356 - DNA, 25 bp, Mus musculus
gctcgatactcgttcctgcatgcca

SEQ ID NO: 943357 - DNA, 25 bp, Mus musculus
gctcgcaaagcctggcaaaacccac

SEQ ID NO: 943358 - DNA, 25 bp, Mus musculus
gctcgcaaaggctggcaaaacccac

SEQ ID NO: 943359 - DNA, 25 bp, Mus musculus
gctcgcaacaggctagcagagatcc

SEQ ID NO: 943360 - DNA, 25 bp, Mus musculus
gctcgcaacagggtagcagagatcc

SEQ ID NO: 943361 - DNA, 25 bp, Mus musculus
gctcgcacacggcctctgtgctcga

SEQ ID NO: 943362 - DNA, 25 bp, Mus musculus
gctcgcacacggcctggaggtgtga

SEQ ID NO: 943363 - DNA, 25 bp, Mus musculus
gctcgcacacgggctctgtgctcga

SEQ ID NO: 943364 - DNA, 25 bp, Mus musculus
gctcgcacacgggctggaggtgtga

SEQ ID NO: 943365 - DNA, 25 bp, Mus musculus
gctcgcaccatgcctgatcagctga

SEQ ID NO: 943366 - DNA, 25 bp, Mus musculus
gctcgcaccatggctgatcagctga

SEQ ID NO: 943367 - DNA, 25 bp, Mus musculus
gctcgcagagccaggggtagagcca

SEQ ID NO: 943368 - DNA, 25 bp, Mus musculus
gctcgcagaggcaggggtagagcca

SEQ ID NO: 943369 - DNA, 25 bp, Mus musculus
gctcgcagccggccaagctgaggag

SEQ ID NO: 943370 - DNA, 25 bp, Mus musculus
gctcgcagccgggcaagctgaggag

SEQ ID NO: 943371 - DNA, 25 bp, Mus musculus
gctcgcagtgcttacagaacgatgt

SEQ ID NO: 943372 - DNA, 25 bp, Mus musculus
gctcgcagtgcttacctcttctgtc

SEQ ID NO: 943373 - DNA, 25 bp, Mus musculus
gctcgcagtgcttagagaacgatgt

SEQ ID NO: 943374 - DNA, 25 bp, Mus musculus
gctcgcagtgcttagctcttctgtc

SEQ ID NO: 943375 - DNA, 25 bp, Mus musculus
gctcgcagttcaagcagatgccaga

SEQ ID NO: 943376 - DNA, 25 bp, Mus musculus
gctcgcagttcaaggagatgccaga

SEQ ID NO: 943377 - DNA, 25 bp, Mus musculus
gctcgccaggtgcgcgaagattgtc

SEQ ID NO: 943378 - DNA, 25 bp, Mus musculus
gctcgccaggtgggcgaagattgtc

SEQ ID NO: 943379 - DNA, 25 bp, Mus musculus
gctcgcctcagactgtgttcagttc

SEQ ID NO: 943380 - DNA, 25 bp, Mus musculus
gctcgcctcagacttccctggcagc

SEQ ID NO: 943381 - DNA, 25 bp, Mus musculus
gctcgcctcagagtgtgttcagttc

SEQ ID NO: 943382 - DNA, 25 bp, Mus musculus
gctcgcctcagagttccctggcagc

SEQ ID NO: 943383 - DNA, 25 bp, Mus musculus
gctcgcctgcaacgttcctgctgct

SEQ ID NO: 943384 - DNA, 25 bp, Mus musculus
gctcgcctgcaactgtctcacttta

SEQ ID NO: 943385 - DNA, 25 bp, Mus musculus
gctcgcctgcaaggttcctgctgct

SEQ ID NO: 943386 - DNA, 25 bp, Mus musculus
gctcgcctgcaagtgtctcacttta

SEQ ID NO: 943387 - DNA, 25 bp, Mus musculus
gctcgctaagccacactcattctcc

SEQ ID NO: 943388 - DNA, 25 bp, Mus musculus
gctcgctaagccggctgccctttct

SEQ ID NO: 943389 - DNA, 25 bp, Mus musculus
gctcgctaaggcacactcattctcc

SEQ ID NO: 943390 - DNA, 25 bp, Mus musculus
gctcgctaaggcggctgccctttct

SEQ ID NO: 943391 - DNA, 25 bp, Mus musculus
gctcggaactctgtcgtgattaaat

SEQ ID NO: 943392 - DNA, 25 bp, Mus musculus
gctcggaactgtgtcgtgattaaat

SEQ ID NO: 943393 - DNA, 25 bp, Mus musculus
gctcggaatgctgatatcgataacg

SEQ ID NO: 943394 - DNA, 25 bp, Mus musculus
gctcggaatggtgatatcgataacg

SEQ ID NO: 943395 - DNA, 25 bp, Mus musculus
gctcggaccactgccaaggaagggc

SEQ ID NO: 943396 - DNA, 25 bp, Mus musculus
gctcggaccagtgccaaggaagggc

SEQ ID NO: 943397 - DNA, 25 bp, Mus musculus
gctcggacccagccccaaaaggagc

SEQ ID NO: 943398 - DNA, 25 bp, Mus musculus
gctcggacccaggcccaaaaggagc

SEQ ID NO: 943399 - DNA, 25 bp, Mus musculus
gctcggaggacaggtcaatggccaa

SEQ ID NO: 943400 - DNA, 25 bp, Mus musculus
gctcggaggagaggtcaatggccaa

SEQ ID NO: 943401 - DNA, 25 bp, Mus musculus
gctcggctatcactccaggatcccg

SEQ ID NO: 943402 - DNA, 25 bp, Mus musculus
gctcggctatcagtccaggatcccg

SEQ ID NO: 943403 - DNA, 25 bp, Mus musculus
gctcggctgccacttctatgaaggc

SEQ ID NO: 943404 - DNA, 25 bp, Mus musculus
gctcggctgccagttctatgaaggc

SEQ ID NO: 943405 - DNA, 25 bp, Mus musculus
gctcggcttcctgacatgaagaaac

SEQ ID NO: 943406 - DNA, 25 bp, Mus musculus
gctcggcttcctgagatgaagaaac

SEQ ID NO: 943407 - DNA, 25 bp, Mus musculus
gctcgggacgcactggatatggtta

SEQ ID NO: 943408 - DNA, 25 bp, Mus musculus
gctcgggacgcagtggatatggtta

SEQ ID NO: 943409 - DNA, 25 bp, Mus musculus
gctcgggccaagctccagtacatga

SEQ ID NO: 943410 - DNA, 25 bp, Mus musculus
gctcgggccaaggtccagtacatga

SEQ ID NO: 943411 - DNA, 25 bp, Mus musculus
gctcgggccgagagaccgtggcgga

SEQ ID NO: 943412 - DNA, 25 bp, Mus musculus
gctcgggccgagtgaccgtggcgga

SEQ ID NO: 943413 - DNA, 25 bp, Mus musculus
gctcgggctcagtgcatgagaccct

SEQ ID NO: 943414 - DNA, 25 bp, Mus musculus
gctcgggctcagtgcttgttgacct

SEQ ID NO: 943415 - DNA, 25 bp, Mus musculus
gctcgggctcagtggatgagaccct

SEQ ID NO: 943416 - DNA, 25 bp, Mus musculus
gctcgggctcagtggttgttgacct

SEQ ID NO: 943417 - DNA, 25 bp, Mus musculus
gctcgggctgccaactgcccttcac

SEQ ID NO: 943418 - DNA, 25 bp, Mus musculus
gctcgggctgccaagtgcccttcac

SEQ ID NO: 943419 - DNA, 25 bp, Mus musculus
gctcgggttgagcctcgcctgtgca

SEQ ID NO: 943420 - DNA, 25 bp, Mus musculus
gctcgggttgaggctcgcctgtgca

SEQ ID NO: 943421 - DNA, 25 bp, Mus musculus
gctcggtgatggaagcaacagaaga

SEQ ID NO: 943422 - DNA, 25 bp, Mus musculus
gctcggtgatggcaacagaagaaaa

SEQ ID NO: 943423 - DNA, 25 bp, Mus musculus
gctcggtgatgggaacagaagaaaa

SEQ ID NO: 943424 - DNA, 25 bp, Mus musculus
gctcggtgatggtagcaacagaaga

SEQ ID NO: 943425 - DNA, 25 bp, Mus musculus
gctcggtgtgacccttagaagattt

SEQ ID NO: 943426 - DNA, 25 bp, Mus musculus
gctcggtgtgagctgcttttgatac

SEQ ID NO: 943427 - DNA, 25 bp, Mus musculus
gctcggtgtgtcccttagaagattt

SEQ ID NO: 943428 - DNA, 25 bp, Mus musculus
gctcggtgtgtgctgcttttgatac

SEQ ID NO: 943429 - DNA, 25 bp, Mus musculus
gctcgtgcgtggacctgaacgagtg

SEQ ID NO: 943430 - DNA, 25 bp, Mus musculus
gctcgtgcgtggtcctgaacgagtg

SEQ ID NO: 943431 - DNA, 25 bp, Mus musculus
gctctaaaaactcaagatgtggagt

SEQ ID NO: 943432 - DNA, 25 bp, Mus musculus
gctctaaaaactcatgatgtggagt

SEQ ID NO: 943433 - DNA, 25 bp, Mus musculus
gctctacaagctctccaacggtgca

SEQ ID NO: 943434 - DNA, 25 bp, Mus musculus
gctctacaaggtctccaacggtgca

SEQ ID NO: 943435 - DNA, 25 bp, Mus musculus
gctctacacgatgcggccgaaagtc

SEQ ID NO: 943436 - DNA, 25 bp, Mus musculus
gctctacacgttgcggccgaaagtc

SEQ ID NO: 943437 - DNA, 25 bp, Mus musculus
gctctaccacggctcgaaactccag

SEQ ID NO: 943438 - DNA, 25 bp, Mus musculus
gctctaccacggctggaaactccag

SEQ ID NO: 943439 - DNA, 25 bp, Mus musculus
gctctagaagcgtacaggcgggagc

SEQ ID NO: 943440 - DNA, 25 bp, Mus musculus
gctctagaagggtacaggcgggagc

SEQ ID NO: 943441 - DNA, 25 bp, Mus musculus
gctctagagaagcagctagaagcga

SEQ ID NO: 943442 - DNA, 25 bp, Mus musculus
gctctagagaaggagctagaagcga

SEQ ID NO: 943443 - DNA, 25 bp, Mus musculus
gctctagtgcagcggatgtcactac

SEQ ID NO: 943444 - DNA, 25 bp, Mus musculus
gctctagtgcaggggatgtcactac

SEQ ID NO: 943445 - DNA, 25 bp, Mus musculus
gctctataagcatgttcgcaacctg

SEQ ID NO: 943446 - DNA, 25 bp, Mus musculus
gctctataaggatgttcgcaacctg

SEQ ID NO: 943447 - DNA, 25 bp, Mus musculus
gctctatcctagcgactctgactgt

SEQ ID NO: 943448 - DNA, 25 bp, Mus musculus
gctctatcctagggactctgactgt

SEQ ID NO: 943449 - DNA, 25 bp, Mus musculus
gctctcaatgcaggtcaatggccaa

SEQ ID NO: 943450 - DNA, 25 bp, Mus musculus
gctctcaatggaggtcaatggccaa

SEQ ID NO: 943451 - DNA, 25 bp, Mus musculus
gctctcacaactattgttcactctg

SEQ ID NO: 943452 - DNA, 25 bp, Mus musculus
gctctcacaacttttgttcactctg

SEQ ID NO: 943453 - DNA, 25 bp, Mus musculus
gctctcacagaacatacccagctat

SEQ ID NO: 943454 - DNA, 25 bp, Mus musculus
gctctcacagaagatacccagctat

SEQ ID NO: 943455 - DNA, 25 bp, Mus musculus
gctctcacagataaaggaatccaaa

SEQ ID NO: 943456 - DNA, 25 bp, Mus musculus
gctctcacagttaaaggaatccaaa

SEQ ID NO: 943457 - DNA, 25 bp, Mus musculus
gctctcaccgagcgcagccttgggt

SEQ ID NO: 943458 - DNA, 25 bp, Mus musculus
gctctcaccgtgcgcagccttgggt

SEQ ID NO: 943459 - DNA, 25 bp, Mus musculus
gctctcagaacaccctccaggtagc

SEQ ID NO: 943460 - DNA, 25 bp, Mus musculus
gctctcagaacagcctccaggtagc

SEQ ID NO: 943461 - DNA, 25 bp, Mus musculus
gctctcagaaggcaaatgtgccgag

SEQ ID NO: 943462 - DNA, 25 bp, Mus musculus
gctctcagaaggccaagttcgacag

SEQ ID NO: 943463 - DNA, 25 bp, Mus musculus
gctctcagaagggaaatgtgccgag

SEQ ID NO: 943464 - DNA, 25 bp, Mus musculus
gctctcagaagggcaagttcgacag

SEQ ID NO: 943465 - DNA, 25 bp, Mus musculus
gctctcagctcaccggaacctgcct

SEQ ID NO: 943466 - DNA, 25 bp, Mus musculus
gctctcagctcaccggtcacacagc

SEQ ID NO: 943467 - DNA, 25 bp, Mus musculus
gctctcagctcagcggaacctgcct

SEQ ID NO: 943468 - DNA, 25 bp, Mus musculus
gctctcagctcagcggtcacacagc

SEQ ID NO: 943469 - DNA, 25 bp, Mus musculus
gctctcaggctctgcgagttggaac

SEQ ID NO: 943470 - DNA, 25 bp, Mus musculus
gctctcaggctctgggagttggaac

SEQ ID NO: 943471 - DNA, 25 bp, Mus musculus
gctctcattgagccttatgtaaaca

SEQ ID NO: 943472 - DNA, 25 bp, Mus musculus
gctctcattgaggcttatgtaaaca

SEQ ID NO: 943473 - DNA, 25 bp, Mus musculus
gctctccaccaccacgtttcctgct

SEQ ID NO: 943474 - DNA, 25 bp, Mus musculus
gctctccaccaccaggtttcctgct

SEQ ID NO: 943475 - DNA, 25 bp, Mus musculus
gctctccatggacacactacagatg

SEQ ID NO: 943476 - DNA, 25 bp, Mus musculus
gctctccatggacagactacagatg

SEQ ID NO: 943477 - DNA, 25 bp, Mus musculus
gctctcccaatgccagtgcggccgc

SEQ ID NO: 943478 - DNA, 25 bp, Mus musculus
gctctcccaatgcctgtgcggccgc

SEQ ID NO: 943479 - DNA, 25 bp, Mus musculus
gctctccgcccacacagatgagccg

SEQ ID NO: 943480 - DNA, 25 bp, Mus musculus
gctctccgcccacagagatgagccg

SEQ ID NO: 943481 - DNA, 25 bp, Mus musculus
gctctcctgttacgcgtctcttttc

SEQ ID NO: 943482 - DNA, 25 bp, Mus musculus
gctctcctgttaggcgtctcttttc

SEQ ID NO: 943483 - DNA, 25 bp, Mus musculus
gctctcgaagctgagacgagggaag

SEQ ID NO: 943484 - DNA, 25 bp, Mus musculus
gctctcgaaggtgagacgagggaag

SEQ ID NO: 943485 - DNA, 25 bp, Mus musculus
gctctcgatccacgacagcattcct

SEQ ID NO: 943486 - DNA, 25 bp, Mus musculus
gctctcgatccacgtcagcattcct

SEQ ID NO: 943487 - DNA, 25 bp, Mus musculus
gctctcgccaaacgtgatgagaatt

SEQ ID NO: 943488 - DNA, 25 bp, Mus musculus
gctctcgccaaaggtgatgagaatt

SEQ ID NO: 943489 - DNA, 25 bp, Mus musculus
gctctcggcctccacagatccgtga

SEQ ID NO: 943490 - DNA, 25 bp, Mus musculus
gctctcggcctccagagatccgtga

SEQ ID NO: 943491 - DNA, 25 bp, Mus musculus
gctctcgggagacgttctaaatggc

SEQ ID NO: 943492 - DNA, 25 bp, Mus musculus
gctctcgggagaggttctaaatggc

SEQ ID NO: 943493 - DNA, 25 bp, Mus musculus
gctctctaagcgccatgcagctccc

SEQ ID NO: 943494 - DNA, 25 bp, Mus musculus
gctctctaagggccatgcagctccc

SEQ ID NO: 943495 - DNA, 25 bp, Mus musculus
gctctctacctgcacgcagcctgat

SEQ ID NO: 943496 - DNA, 25 bp, Mus musculus
gctctctacctgcaggcagcctgat

SEQ ID NO: 943497 - DNA, 25 bp, Mus musculus
gctctctagaacagaactcattata

SEQ ID NO: 943498 - DNA, 25 bp, Mus musculus
gctctctagaactgaactcattata

SEQ ID NO: 943499 - DNA, 25 bp, Mus musculus
gctctctatgatcttaccaatatat

SEQ ID NO: 943500 - DNA, 25 bp, Mus musculus
gctctctatgttcttaccaatatat

SEQ ID NO: 943501 - DNA, 25 bp, Mus musculus
gctctctcagcgcatctcctccctc

SEQ ID NO: 943502 - DNA, 25 bp, Mus musculus
gctctctcagcggatctcctccctc

SEQ ID NO: 943503 - DNA, 25 bp, Mus musculus
gctctctccagccacgatgtgatgg

SEQ ID NO: 943504 - DNA, 25 bp, Mus musculus
gctctctccagccaggatgtgatgg

SEQ ID NO: 943505 - DNA, 25 bp, Mus musculus
gctctctccccaagactgacttgga

SEQ ID NO: 943506 - DNA, 25 bp, Mus musculus
gctctctccccatgactgacttgga

SEQ ID NO: 943507 - DNA, 25 bp, Mus musculus
gctctctcctaactcgtcagtacca

SEQ ID NO: 943508 - DNA, 25 bp, Mus musculus
gctctctcctaactggtcagtacca

SEQ ID NO: 943509 - DNA, 25 bp, Mus musculus
gctctctgacagctgtccccagaac

SEQ ID NO: 943510 - DNA, 25 bp, Mus musculus
gctctctgacaggtgtccccagaac

SEQ ID NO: 943511 - DNA, 25 bp, Mus musculus
gctctctgagcaaatcaagaaagca

SEQ ID NO: 943512 - DNA, 25 bp, Mus musculus
gctctctgaggaaatcaagaaagca

SEQ ID NO: 943513 - DNA, 25 bp, Mus musculus
gctctcttcttgctgcccgtggtgg

SEQ ID NO: 943514 - DNA, 25 bp, Mus musculus
gctctcttcttggtgcccgtggtgg

SEQ ID NO: 943515 - DNA, 25 bp, Mus musculus
gctctctttcaacgctggagacgta

SEQ ID NO: 943516 - DNA, 25 bp, Mus musculus
gctctctttcaaggctggagacgta

SEQ ID NO: 943517 - DNA, 25 bp, Mus musculus
gctctgaaggctacaccatgaggcc

SEQ ID NO: 943518 - DNA, 25 bp, Mus musculus
gctctgaaggctggaataagcagca

SEQ ID NO: 943519 - DNA, 25 bp, Mus musculus
gctctgaagggtacaccatgaggcc

SEQ ID NO: 943520 - DNA, 25 bp, Mus musculus
gctctgaagggtggaataagcagca

SEQ ID NO: 943521 - DNA, 25 bp, Mus musculus
gctctgaatgtgtgcatgtgaatga

SEQ ID NO: 943522 - DNA, 25 bp, Mus musculus
gctctgaatgtgtggatgtgaatga

SEQ ID NO: 943523 - DNA, 25 bp, Mus musculus
gctctgacagccgggagtgggagac

SEQ ID NO: 943524 - DNA, 25 bp, Mus musculus
gctctgacaggcgggagtgggagac

SEQ ID NO: 943525 - DNA, 25 bp, Mus musculus
gctctgacctccccctcttcagtct

SEQ ID NO: 943526 - DNA, 25 bp, Mus musculus
gctctgacctccgcctcttcagtct

SEQ ID NO: 943527 - DNA, 25 bp, Mus musculus
gctctgactgatctctctcttgcct

SEQ ID NO: 943528 - DNA, 25 bp, Mus musculus
gctctgactgttctctctcttgcct

SEQ ID NO: 943529 - DNA, 25 bp, Mus musculus
gctctgacttggctctgaagactgt

SEQ ID NO: 943530 - DNA, 25 bp, Mus musculus
gctctgacttgggtctgaagactgt

SEQ ID NO: 943531 - DNA, 25 bp, Mus musculus
gctctgagaaagatcaagacagtgg

SEQ ID NO: 943532 - DNA, 25 bp, Mus musculus
gctctgagaaagttcaagacagtgg

SEQ ID NO: 943533 - DNA, 25 bp, Mus musculus
gctctgagaacacgaagcccagccc

SEQ ID NO: 943534 - DNA, 25 bp, Mus musculus
gctctgagaacaggaagcccagccc

SEQ ID NO: 943535 - DNA, 25 bp, Mus musculus
gctctgagacagcgccatctccaga

SEQ ID NO: 943536 - DNA, 25 bp, Mus musculus
gctctgagacagggccatctccaga

SEQ ID NO: 943537 - DNA, 25 bp, Mus musculus
gctctgagagcatgtgcccgatatt

SEQ ID NO: 943538 - DNA, 25 bp, Mus musculus
gctctgagaggatgtgcccgatatt

SEQ ID NO: 943539 - DNA, 25 bp, Mus musculus
gctctgatgtatcgatcggaacgtc

SEQ ID NO: 943540 - DNA, 25 bp, Mus musculus
gctctgatgtatggatcggaacgtc

SEQ ID NO: 943541 - DNA, 25 bp, Mus musculus
gctctgattggacgtcggtgagctg

SEQ ID NO: 943542 - DNA, 25 bp, Mus musculus
gctctgattggaggtcggtgagctg

SEQ ID NO: 943543 - DNA, 25 bp, Mus musculus
gctctgcaaggctgagtatacagtt

SEQ ID NO: 943544 - DNA, 25 bp, Mus musculus
gctctgcaaggctgtgtatacagtt

SEQ ID NO: 943545 - DNA, 25 bp, Mus musculus
gctctgcaatcagacattttgcgtg

SEQ ID NO: 943546 - DNA, 25 bp, Mus musculus
gctctgcaatcagagattttgcgtg

SEQ ID NO: 943547 - DNA, 25 bp, Mus musculus
gctctgcacagacacgagcatgcaa

SEQ ID NO: 943548 - DNA, 25 bp, Mus musculus
gctctgcacagacaggagcatgcaa

SEQ ID NO: 943549 - DNA, 25 bp, Mus musculus
gctctgcagctgaatgttgtatggg

SEQ ID NO: 943550 - DNA, 25 bp, Mus musculus
gctctgcagctgctcacagctctgg

SEQ ID NO: 943551 - DNA, 25 bp, Mus musculus
gctctgcagctggtcacagctctgg

SEQ ID NO: 943552 - DNA, 25 bp, Mus musculus
gctctgcagctgtatgttgtatggg

SEQ ID NO: 943553 - DNA, 25 bp, Mus musculus
gctctgcaggaggtcctggcacacc

SEQ ID NO: 943554 - DNA, 25 bp, Mus musculus
gctctgcaggtggtcctggcacacc

SEQ ID NO: 943555 - DNA, 25 bp, Mus musculus
gctctgccaaccatatgggaagatc

SEQ ID NO: 943556 - DNA, 25 bp, Mus musculus
gctctgccaaccttatgggaagatc

SEQ ID NO: 943557 - DNA, 25 bp, Mus musculus
gctctgccagcagctgtactgtagc

SEQ ID NO: 943558 - DNA, 25 bp, Mus musculus
gctctgccaggagctgtactgtagc

SEQ ID NO: 943559 - DNA, 25 bp, Mus musculus
gctctgcccacacacggtgtgtccc

SEQ ID NO: 943560 - DNA, 25 bp, Mus musculus
gctctgcccacacacgttctgcagt

SEQ ID NO: 943561 - DNA, 25 bp, Mus musculus
gctctgcccacacagggtgtgtccc

SEQ ID NO: 943562 - DNA, 25 bp, Mus musculus
gctctgcccacacaggttctgcagt

SEQ ID NO: 943563 - DNA, 25 bp, Mus musculus
gctctgccctgtgactttcaggtgc

SEQ ID NO: 943564 - DNA, 25 bp, Mus musculus
gctctgccctgtgagtttcaggtgc

SEQ ID NO: 943565 - DNA, 25 bp, Mus musculus
gctctgcctcggaccgaattctatc

SEQ ID NO: 943566 - DNA, 25 bp, Mus musculus
gctctgcctcggacggaattctatc

SEQ ID NO: 943567 - DNA, 25 bp, Mus musculus
gctctgcgtgcccacggtcctgtgg

SEQ ID NO: 943568 - DNA, 25 bp, Mus musculus
gctctgcgtgcccagggtcctgtgg

SEQ ID NO: 943569 - DNA, 25 bp, Mus musculus
gctctgctgcatcacaacctcttac

SEQ ID NO: 943570 - DNA, 25 bp, Mus musculus
gctctgctgcatcaccccagcacta

SEQ ID NO: 943571 - DNA, 25 bp, Mus musculus
gctctgctgcatcacgtaccaccag

SEQ ID NO: 943572 - DNA, 25 bp, Mus musculus
gctctgctgcatcagaacctcttac

SEQ ID NO: 943573 - DNA, 25 bp, Mus musculus
gctctgctgcatcagcccagcacta

SEQ ID NO: 943574 - DNA, 25 bp, Mus musculus
gctctgctgcatcaggtaccaccag

SEQ ID NO: 943575 - DNA, 25 bp, Mus musculus
gctctgctgctgctcgaacgggttc

SEQ ID NO: 943576 - DNA, 25 bp, Mus musculus
gctctgctgctgctggaacgggttc

SEQ ID NO: 943577 - DNA, 25 bp, Mus musculus
gctctgctggaaaacaaactaagtg

SEQ ID NO: 943578 - DNA, 25 bp, Mus musculus
gctctgctggaaaagaaactaagtg

SEQ ID NO: 943579 - DNA, 25 bp, Mus musculus
gctctggaagaggtgctgctggata

SEQ ID NO: 943580 - DNA, 25 bp, Mus musculus
gctctggaagtggtgctgctggata

SEQ ID NO: 943581 - DNA, 25 bp, Mus musculus
gctctggagaaacagtttgagagga

SEQ ID NO: 943582 - DNA, 25 bp, Mus musculus
gctctggagaaagagtttgagagga

SEQ ID NO: 943583 - DNA, 25 bp, Mus musculus
gctctggagaagatgtttcgagtca

SEQ ID NO: 943584 - DNA, 25 bp, Mus musculus
gctctggagaagttgtttcgagtca

SEQ ID NO: 943585 - DNA, 25 bp, Mus musculus
gctctggatgagagggagatgagac

SEQ ID NO: 943586 - DNA, 25 bp, Mus musculus
gctctggatgagtgggagatgagac

SEQ ID NO: 943587 - DNA, 25 bp, Mus musculus
gctctggcacagccggagagaagcc

SEQ ID NO: 943588 - DNA, 25 bp, Mus musculus
gctctggcacagctgctttgccaga

SEQ ID NO: 943589 - DNA, 25 bp, Mus musculus
gctctggcacaggcggagagaagcc

SEQ ID NO: 943590 - DNA, 25 bp, Mus musculus
gctctggcacaggtgctttgccaga

SEQ ID NO: 943591 - DNA, 25 bp, Mus musculus
gctctggcagacgtcccattcctgc

SEQ ID NO: 943592 - DNA, 25 bp, Mus musculus
gctctggcagtcgtcccattcctgc

SEQ ID NO: 943593 - DNA, 25 bp, Mus musculus
gctctgggacccagaaaaccttgag

SEQ ID NO: 943594 - DNA, 25 bp, Mus musculus
gctctgggaccctgaaaaccttgag

SEQ ID NO: 943595 - DNA, 25 bp, Mus musculus
gctctgggatcacggggctcattgt

SEQ ID NO: 943596 - DNA, 25 bp, Mus musculus
gctctgggatcagggggctcattgt

SEQ ID NO: 943597 - DNA, 25 bp, Mus musculus
gctctggggaagccttggccacgag

SEQ ID NO: 943598 - DNA, 25 bp, Mus musculus
gctctggggaagctgctgcccagac

SEQ ID NO: 943599 - DNA, 25 bp, Mus musculus
gctctggggaaggcttggccacgag

SEQ ID NO: 943600 - DNA, 25 bp, Mus musculus
gctctggggaaggtgctgcccagac

SEQ ID NO: 943601 - DNA, 25 bp, Mus musculus
gctctggtcgagcaagatgggctcc

SEQ ID NO: 943602 - DNA, 25 bp, Mus musculus
gctctggtcgaggaagatgggctcc

SEQ ID NO: 943603 - DNA, 25 bp, Mus musculus
gctctggtcttacgttcttgattgt

SEQ ID NO: 943604 - DNA, 25 bp, Mus musculus
gctctggtcttaggttcttgattgt

SEQ ID NO: 943605 - DNA, 25 bp, Mus musculus
gctctgtaagcaccctaggatgtca

SEQ ID NO: 943606 - DNA, 25 bp, Mus musculus
gctctgtaagcagcctaggatgtca

SEQ ID NO: 943607 - DNA, 25 bp, Mus musculus
gctctgtagcagctctagtgacagg

SEQ ID NO: 943608 - DNA, 25 bp, Mus musculus
gctctgtagcaggtctagtgacagg

SEQ ID NO: 943609 - DNA, 25 bp, Mus musculus
gctctgtcatcacacacaccctctc

SEQ ID NO: 943610 - DNA, 25 bp, Mus musculus
gctctgtcatcacacattctttaag

SEQ ID NO: 943611 - DNA, 25 bp, Mus musculus
gctctgtcatcacagacaccctctc

SEQ ID NO: 943612 - DNA, 25 bp, Mus musculus
gctctgtcatcacagattctttaag

SEQ ID NO: 943613 - DNA, 25 bp, Mus musculus
gctctgtgataccacaccctgaaga

SEQ ID NO: 943614 - DNA, 25 bp, Mus musculus
gctctgtgataccagaccctgaaga

SEQ ID NO: 943615 - DNA, 25 bp, Mus musculus
gctctgttcagacgataccacgggc

SEQ ID NO: 943616 - DNA, 25 bp, Mus musculus
gctctgttcagaggataccacgggc

SEQ ID NO: 943617 - DNA, 25 bp, Mus musculus
gctcttaaagactttaatctgtttt

SEQ ID NO: 943618 - DNA, 25 bp, Mus musculus
gctcttaaagctagctcggaacaca

SEQ ID NO: 943619 - DNA, 25 bp, Mus musculus
gctcttaaagctcggaacacacgct

SEQ ID NO: 943620 - DNA, 25 bp, Mus musculus
gctcttaaaggtagctcggaacaca

SEQ ID NO: 943621 - DNA, 25 bp, Mus musculus
gctcttaaaggtcggaacacacgct

SEQ ID NO: 943622 - DNA, 25 bp, Mus musculus
gctcttaaagtctttaatctgtttt

SEQ ID NO: 943623 - DNA, 25 bp, Mus musculus
gctcttaattatcggagatacagtt

SEQ ID NO: 943624 - DNA, 25 bp, Mus musculus
gctcttaattatgggagatacagtt

SEQ ID NO: 943625 - DNA, 25 bp, Mus musculus
gctcttagcatgcttcataagttct

SEQ ID NO: 943626 - DNA, 25 bp, Mus musculus
gctcttagcatggttcataagttct

SEQ ID NO: 943627 - DNA, 25 bp, Mus musculus
gctcttattaagcatacagccatga

SEQ ID NO: 943628 - DNA, 25 bp, Mus musculus
gctcttattaaggatacagccatga

SEQ ID NO: 943629 - DNA, 25 bp, Mus musculus
gctcttcaaactgaaaaccagcacc

SEQ ID NO: 943630 - DNA, 25 bp, Mus musculus
gctcttcaaactgataaccagcacc

SEQ ID NO: 943631 - DNA, 25 bp, Mus musculus
gctcttcaacaccacataatgtgtc

SEQ ID NO: 943632 - DNA, 25 bp, Mus musculus
gctcttcaacaccagataatgtgtc

SEQ ID NO: 943633 - DNA, 25 bp, Mus musculus
gctcttcacctgcttcctggcagtg

SEQ ID NO: 943634 - DNA, 25 bp, Mus musculus
gctcttcacctggttcctggcagtg

SEQ ID NO: 943635 - DNA, 25 bp, Mus musculus
gctcttccaacacttcgacaaaatt

SEQ ID NO: 943636 - DNA, 25 bp, Mus musculus
gctcttccaagacttcgacaaaatt

SEQ ID NO: 943637 - DNA, 25 bp, Mus musculus
gctcttcgaatggaaatacccctcc

SEQ ID NO: 943638 - DNA, 25 bp, Mus musculus
gctcttcgaatggatatacccctcc

SEQ ID NO: 943639 - DNA, 25 bp, Mus musculus
gctcttcgtcaacgaaacctgcaga

SEQ ID NO: 943640 - DNA, 25 bp, Mus musculus
gctcttcgtcaacgccggaagtgat

SEQ ID NO: 943641 - DNA, 25 bp, Mus musculus
gctcttcgtcaaggaaacctgcaga

SEQ ID NO: 943642 - DNA, 25 bp, Mus musculus
gctcttcgtcaaggccggaagtgat

SEQ ID NO: 943643 - DNA, 25 bp, Mus musculus
gctcttctcacacgcacagcggaag

SEQ ID NO: 943644 - DNA, 25 bp, Mus musculus
gctcttctcacaggcacagcggaag

SEQ ID NO: 943645 - DNA, 25 bp, Mus musculus
gctcttctttaatatgatcatccta

SEQ ID NO: 943646 - DNA, 25 bp, Mus musculus
gctcttcttttatatgatcatccta

SEQ ID NO: 943647 - DNA, 25 bp, Mus musculus
gctcttgaaacaatttgaattcaga

SEQ ID NO: 943648 - DNA, 25 bp, Mus musculus
gctcttgaaagaatttgaattcaga

SEQ ID NO: 943649 - DNA, 25 bp, Mus musculus
gctcttgaccaacttccaggaagac

SEQ ID NO: 943650 - DNA, 25 bp, Mus musculus
gctcttgaccaagttccaggaagac

SEQ ID NO: 943651 - DNA, 25 bp, Mus musculus
gctcttgcctgtcccctgttcactg

SEQ ID NO: 943652 - DNA, 25 bp, Mus musculus
gctcttgcctgtgccctgttcactg

SEQ ID NO: 943653 - DNA, 25 bp, Mus musculus
gctcttggagaacttcatcagtggt

SEQ ID NO: 943654 - DNA, 25 bp, Mus musculus
gctcttggagaagttcatcagtggt

SEQ ID NO: 943655 - DNA, 25 bp, Mus musculus
gctcttggtgtgcacacttcccgag

SEQ ID NO: 943656 - DNA, 25 bp, Mus musculus
gctcttggtgtggacacttcccgag

SEQ ID NO: 943657 - DNA, 25 bp, Mus musculus
gctctttagaagccttcagaaatgg

SEQ ID NO: 943658 - DNA, 25 bp, Mus musculus
gctctttagaaggcttcagaaatgg

SEQ ID NO: 943659 - DNA, 25 bp, Mus musculus
gctctttcagccgtggcccacttta

SEQ ID NO: 943660 - DNA, 25 bp, Mus musculus
gctctttcaggcgtggcccacttta

SEQ ID NO: 943661 - DNA, 25 bp, Mus musculus
gctctttgaaagcgctgctgaaaag

SEQ ID NO: 943662 - DNA, 25 bp, Mus musculus
gctctttgaaagggctgctgaaaag

SEQ ID NO: 943663 - DNA, 25 bp, Mus musculus
gctctttgatcacgtggtaaagacg

SEQ ID NO: 943664 - DNA, 25 bp, Mus musculus
gctctttgatcaggtggtaaagacg

SEQ ID NO: 943665 - DNA, 25 bp, Mus musculus
gctctttgtacacgatgagaaaggt

SEQ ID NO: 943666 - DNA, 25 bp, Mus musculus
gctctttgtacaggatgagaaaggt

SEQ ID NO: 943667 - DNA, 25 bp, Mus musculus
gctctttgtcctaacattagcctca

SEQ ID NO: 943668 - DNA, 25 bp, Mus musculus
gctctttgtcctaagattagcctca

SEQ ID NO: 943669 - DNA, 25 bp, Mus musculus
gctctttgtgttcgatgtttcgtct

SEQ ID NO: 943670 - DNA, 25 bp, Mus musculus
gctctttgtgttggatgtttcgtct

SEQ ID NO: 943671 - DNA, 25 bp, Mus musculus
gctctttgttcgaaaaaatgctgct

SEQ ID NO: 943672 - DNA, 25 bp, Mus musculus
gctctttgttcgaataaatgctgct

SEQ ID NO: 943673 - DNA, 25 bp, Mus musculus
gctcttttctcgtacaaacattgct

SEQ ID NO: 943674 - DNA, 25 bp, Mus musculus
gctcttttctggtacaaacattgct

SEQ ID NO: 943675 - DNA, 25 bp, Mus musculus
gctgaaaaagacaactggcctggtg

SEQ ID NO: 943676 - DNA, 25 bp, Mus musculus
gctgaaaaagagctgcatgagaaat

SEQ ID NO: 943677 - DNA, 25 bp, Mus musculus
gctgaaaaagaggtgcatgagaaat

SEQ ID NO: 943678 - DNA, 25 bp, Mus musculus
gctgaaaaagcctgtagattttgaa

SEQ ID NO: 943679 - DNA, 25 bp, Mus musculus
gctgaaaaaggctgtagattttgaa

SEQ ID NO: 943680 - DNA, 25 bp, Mus musculus
gctgaaaaagtcaactggcctggtg

SEQ ID NO: 943681 - DNA, 25 bp, Mus musculus
gctgaaaaccttcgggatgtccaga

SEQ ID NO: 943682 - DNA, 25 bp, Mus musculus
gctgaaaaccttggggatgtccaga

SEQ ID NO: 943683 - DNA, 25 bp, Mus musculus
gctgaaactgaatgccatgttcctg

SEQ ID NO: 943684 - DNA, 25 bp, Mus musculus
gctgaaactgtatgccatgttcctg

SEQ ID NO: 943685 - DNA, 25 bp, Mus musculus
gctgaaagagctgacagtgaaaaga

SEQ ID NO: 943686 - DNA, 25 bp, Mus musculus
gctgaaagaggtgacagtgaaaaga

SEQ ID NO: 943687 - DNA, 25 bp, Mus musculus
gctgaaatggcgtggcaactcaagg

SEQ ID NO: 943688 - DNA, 25 bp, Mus musculus
gctgaaatggggtggcaactcaagg

SEQ ID NO: 943689 - DNA, 25 bp, Mus musculus
gctgaaattgctgaattatgtaacc

SEQ ID NO: 943690 - DNA, 25 bp, Mus musculus
gctgaaattggtgaattatgtaacc

SEQ ID NO: 943691 - DNA, 25 bp, Mus musculus
gctgaaatttctccgtgctccgatg

SEQ ID NO: 943692 - DNA, 25 bp, Mus musculus
gctgaaatttgtccgtgctccgatg

SEQ ID NO: 943693 - DNA, 25 bp, Mus musculus
gctgaacagctgcacaccacctgag

SEQ ID NO: 943694 - DNA, 25 bp, Mus musculus
gctgaacagctggacaccacctgag

SEQ ID NO: 943695 - DNA, 25 bp, Mus musculus
gctgaacatgcacctgttccgctct

SEQ ID NO: 943696 - DNA, 25 bp, Mus musculus
gctgaacatggacctgttccgctct

SEQ ID NO: 943697 - DNA, 25 bp, Mus musculus
gctgaacggcaccagcttgggaaag

SEQ ID NO: 943698 - DNA, 25 bp, Mus musculus
gctgaacggcacgagcttgggaaag

SEQ ID NO: 943699 - DNA, 25 bp, Mus musculus
gctgaacgtcgtcgtggacggactg

SEQ ID NO: 943700 - DNA, 25 bp, Mus musculus
gctgaacgtcgtggtggacggactg

SEQ ID NO: 943701 - DNA, 25 bp, Mus musculus
gctgaagaaaagaactctcaaaaag

SEQ ID NO: 943702 - DNA, 25 bp, Mus musculus
gctgaagaaaagcccttggcaatta

SEQ ID NO: 943703 - DNA, 25 bp, Mus musculus
gctgaagaaaaggccttggcaatta

SEQ ID NO: 943704 - DNA, 25 bp, Mus musculus
gctgaagaaaagtactctcaaaaag

SEQ ID NO: 943705 - DNA, 25 bp, Mus musculus
gctgaagaagagcatcatggtccac

SEQ ID NO: 943706 - DNA, 25 bp, Mus musculus
gctgaagaagcatgtggatgccgcc

SEQ ID NO: 943707 - DNA, 25 bp, Mus musculus
gctgaagaaggatgtggatgccgcc

SEQ ID NO: 943708 - DNA, 25 bp, Mus musculus
gctgaagaagtgcatcatggtccac

SEQ ID NO: 943709 - DNA, 25 bp, Mus musculus
gctgaagacacacgggctccttatt

SEQ ID NO: 943710 - DNA, 25 bp, Mus musculus
gctgaagacacaggggctccttatt

SEQ ID NO: 943711 - DNA, 25 bp, Mus musculus
gctgaagcccagaacccctacccat

SEQ ID NO: 943712 - DNA, 25 bp, Mus musculus
gctgaagcccagaacctgtgattgg

SEQ ID NO: 943713 - DNA, 25 bp, Mus musculus
gctgaagcccagaagccctacccat

SEQ ID NO: 943714 - DNA, 25 bp, Mus musculus
gctgaagcccagaagctgtgattgg

SEQ ID NO: 943715 - DNA, 25 bp, Mus musculus
gctgaagcccctcccgcagactccg

SEQ ID NO: 943716 - DNA, 25 bp, Mus musculus
gctgaagcccctgccgcagactccg

SEQ ID NO: 943717 - DNA, 25 bp, Mus musculus
gctgaagcctttcgcaagattgtgg

SEQ ID NO: 943718 - DNA, 25 bp, Mus musculus
gctgaagcctttggcaagattgtgg

SEQ ID NO: 943719 - DNA, 25 bp, Mus musculus
gctgaagctacacggttgaaaaata

SEQ ID NO: 943720 - DNA, 25 bp, Mus musculus
gctgaagctacagggttgaaaaata

SEQ ID NO: 943721 - DNA, 25 bp, Mus musculus
gctgaaggagaccacaaggactcca

SEQ ID NO: 943722 - DNA, 25 bp, Mus musculus
gctgaaggagaccagaaggactcca

SEQ ID NO: 943723 - DNA, 25 bp, Mus musculus
gctgaaggagcctgaaactcgggct

SEQ ID NO: 943724 - DNA, 25 bp, Mus musculus
gctgaaggaggctgaaactcgggct

SEQ ID NO: 943725 - DNA, 25 bp, Mus musculus
gctgaaggatgactgtcctgaagtc

SEQ ID NO: 943726 - DNA, 25 bp, Mus musculus
gctgaaggatgagtgtcctgaagtc

SEQ ID NO: 943727 - DNA, 25 bp, Mus musculus
gctgaaggctacaacttggtaatct

SEQ ID NO: 943728 - DNA, 25 bp, Mus musculus
gctgaaggctacaagttggtaatct

SEQ ID NO: 943729 - DNA, 25 bp, Mus musculus
gctgaaggctcgcaacaccaagaag

SEQ ID NO: 943730 - DNA, 25 bp, Mus musculus
gctgaaggctcggaacaccaagaag

SEQ ID NO: 943731 - DNA, 25 bp, Mus musculus
gctgaagtcccgagcccaaccgcgt

SEQ ID NO: 943732 - DNA, 25 bp, Mus musculus
gctgaagtcccgagcttgagcccca

SEQ ID NO: 943733 - DNA, 25 bp, Mus musculus
gctgaagtcccgaggccaaccgcgt

SEQ ID NO: 943734 - DNA, 25 bp, Mus musculus
gctgaagtcccgaggttgagcccca

SEQ ID NO: 943735 - DNA, 25 bp, Mus musculus
gctgaagtggaggcccctccgcctc

SEQ ID NO: 943736 - DNA, 25 bp, Mus musculus
gctgaagtggaggcgcctccgcctc

SEQ ID NO: 943737 - DNA, 25 bp, Mus musculus
gctgaagttcagcaattttatggtg

SEQ ID NO: 943738 - DNA, 25 bp, Mus musculus
gctgaagttcaggaattttatggtg

SEQ ID NO: 943739 - DNA, 25 bp, Mus musculus
gctgaagttcatcatggcttgtgcc

SEQ ID NO: 943740 - DNA, 25 bp, Mus musculus
gctgaagttcatgatggcttgtgcc

SEQ ID NO: 943741 - DNA, 25 bp, Mus musculus
gctgaatatgaacgacaatcagtta

SEQ ID NO: 943742 - DNA, 25 bp, Mus musculus
gctgaatatgaaggacaatcagtta

SEQ ID NO: 943743 - DNA, 25 bp, Mus musculus
gctgaattctgtctaataccacgga

SEQ ID NO: 943744 - DNA, 25 bp, Mus musculus
gctgaattctgtgtaataccacgga

SEQ ID NO: 943745 - DNA, 25 bp, Mus musculus
gctgaatttacgctcaccattcttg

SEQ ID NO: 943746 - DNA, 25 bp, Mus musculus
gctgaatttacgctggctctcccaa

SEQ ID NO: 943747 - DNA, 25 bp, Mus musculus
gctgaatttacggtcaccattcttg

SEQ ID NO: 943748 - DNA, 25 bp, Mus musculus
gctgaatttacggtggctctcccaa

SEQ ID NO: 943749 - DNA, 25 bp, Mus musculus
gctgaattttagagaacgagttagt

SEQ ID NO: 943750 - DNA, 25 bp, Mus musculus
gctgaattttagagaatggctctga

SEQ ID NO: 943751 - DNA, 25 bp, Mus musculus
gctgaattttagtgaacgagttagt

SEQ ID NO: 943752 - DNA, 25 bp, Mus musculus
gctgaattttagtgaatggctctga

SEQ ID NO: 943753 - DNA, 25 bp, Mus musculus
gctgacaacaaacgtatgtcaccag

SEQ ID NO: 943754 - DNA, 25 bp, Mus musculus
gctgacaacaaaggtatgtcaccag

SEQ ID NO: 943755 - DNA, 25 bp, Mus musculus
gctgacacctcacggcacacttgcc

SEQ ID NO: 943756 - DNA, 25 bp, Mus musculus
gctgacacctcagggcacacttgcc

SEQ ID NO: 943757 - DNA, 25 bp, Mus musculus
gctgacactgaccaaatcttattct

SEQ ID NO: 943758 - DNA, 25 bp, Mus musculus
gctgacactgccaccactcgccctg

SEQ ID NO: 943759 - DNA, 25 bp, Mus musculus
gctgacactggcaccactcgccctg

SEQ ID NO: 943760 - DNA, 25 bp, Mus musculus
gctgacactgtccaaatcttattct

SEQ ID NO: 943761 - DNA, 25 bp, Mus musculus
gctgacagagcacgtgtcttagctg

SEQ ID NO: 943762 - DNA, 25 bp, Mus musculus
gctgacagagcaggtgtcttagctg

SEQ ID NO: 943763 - DNA, 25 bp, Mus musculus
gctgacagagcttttcttcatgcat

SEQ ID NO: 943764 - DNA, 25 bp, Mus musculus
gctgacagaggttttcttcatgcat

SEQ ID NO: 943765 - DNA, 25 bp, Mus musculus
gctgacagccagaacaattggctgg

SEQ ID NO: 943766 - DNA, 25 bp, Mus musculus
gctgacagccagaacgtagcccctg

SEQ ID NO: 943767 - DNA, 25 bp, Mus musculus
gctgacagccagaagaattggctgg

SEQ ID NO: 943768 - DNA, 25 bp, Mus musculus
gctgacagccagaaggtagcccctg

SEQ ID NO: 943769 - DNA, 25 bp, Mus musculus
gctgacatccagaggctaaaggaag

SEQ ID NO: 943770 - DNA, 25 bp, Mus musculus
gctgacatccagtggctaaaggaag

SEQ ID NO: 943771 - DNA, 25 bp, Mus musculus
gctgacatcctgttctacgtggtga

SEQ ID NO: 943772 - DNA, 25 bp, Mus musculus
gctgacatcctgttgtacgtggtga

SEQ ID NO: 943773 - DNA, 25 bp, Mus musculus
gctgacattcagagttgaaactgtg

SEQ ID NO: 943774 - DNA, 25 bp, Mus musculus
gctgacattcagctgcagtctttgt

SEQ ID NO: 943775 - DNA, 25 bp, Mus musculus
gctgacattcaggtgcagtctttgt

SEQ ID NO: 943776 - DNA, 25 bp, Mus musculus
gctgacattcagtgttgaaactgtg

SEQ ID NO: 943777 - DNA, 25 bp, Mus musculus
gctgaccaagagtcatgcaagggcc

SEQ ID NO: 943778 - DNA, 25 bp, Mus musculus
gctgaccaagcgactgcacaggact

SEQ ID NO: 943779 - DNA, 25 bp, Mus musculus
gctgaccaagggactgcacaggact

SEQ ID NO: 943780 - DNA, 25 bp, Mus musculus
gctgaccaagtgtcatgcaagggcc

SEQ ID NO: 943781 - DNA, 25 bp, Mus musculus
gctgaccatgagacaaaacccctgg

SEQ ID NO: 943782 - DNA, 25 bp, Mus musculus
gctgaccatgtgacaaaacccctgg

SEQ ID NO: 943783 - DNA, 25 bp, Mus musculus
gctgacccagctcaaggagctgggc

SEQ ID NO: 943784 - DNA, 25 bp, Mus musculus
gctgacccaggtcaaggagctgggc

SEQ ID NO: 943785 - DNA, 25 bp, Mus musculus
gctgacccccaacaggccattaact

SEQ ID NO: 943786 - DNA, 25 bp, Mus musculus
gctgacccccaacgccatcgcccac

SEQ ID NO: 943787 - DNA, 25 bp, Mus musculus
gctgacccccaagaggccattaact

SEQ ID NO: 943788 - DNA, 25 bp, Mus musculus
gctgacccccaaggccatcgcccac

SEQ ID NO: 943789 - DNA, 25 bp, Mus musculus
gctgacccgaccggtgctcgccgct

SEQ ID NO: 943790 - DNA, 25 bp, Mus musculus
gctgacccgagcggtgctcgccgct

SEQ ID NO: 943791 - DNA, 25 bp, Mus musculus
gctgacgatgagcctgactttgaac

SEQ ID NO: 943792 - DNA, 25 bp, Mus musculus
gctgacgatgaggctgactttgaac

SEQ ID NO: 943793 - DNA, 25 bp, Mus musculus
gctgacggcaccatcgcgtttatgt

SEQ ID NO: 943794 - DNA, 25 bp, Mus musculus
gctgacggcaccatggcgtttatgt

SEQ ID NO: 943795 - DNA, 25 bp, Mus musculus
gctgacgtcaaaagcgtcatcttca

SEQ ID NO: 943796 - DNA, 25 bp, Mus musculus
gctgacgtcaaaagggtcatcttca

SEQ ID NO: 943797 - DNA, 25 bp, Mus musculus
gctgacgtcatagtacaggattcat

SEQ ID NO: 943798 - DNA, 25 bp, Mus musculus
gctgacgtcatagttcaggattcat

SEQ ID NO: 943799 - DNA, 25 bp, Mus musculus
gctgactcagcaaatggaacttcca

SEQ ID NO: 943800 - DNA, 25 bp, Mus musculus
gctgactcagcccggcaagctgaca

SEQ ID NO: 943801 - DNA, 25 bp, Mus musculus
gctgactcaggaaatggaacttcca

SEQ ID NO: 943802 - DNA, 25 bp, Mus musculus
gctgactcaggccggcaagctgaca

SEQ ID NO: 943803 - DNA, 25 bp, Mus musculus
gctgactctaagaaaagagaaggct

SEQ ID NO: 943804 - DNA, 25 bp, Mus musculus
gctgactctaagtaaagagaaggct

SEQ ID NO: 943805 - DNA, 25 bp, Mus musculus
gctgactgagcacaaggcagatgtt

SEQ ID NO: 943806 - DNA, 25 bp, Mus musculus
gctgactgagcacactctgcagagg

SEQ ID NO: 943807 - DNA, 25 bp, Mus musculus
gctgactgagcacgcggtggaggga

SEQ ID NO: 943808 - DNA, 25 bp, Mus musculus
gctgactgagcagactctgcagagg

SEQ ID NO: 943809 - DNA, 25 bp, Mus musculus
gctgactgagcaggcggtggaggga

SEQ ID NO: 943810 - DNA, 25 bp, Mus musculus
gctgactgaggacaaggcagatgtt

SEQ ID NO: 943811 - DNA, 25 bp, Mus musculus
gctgactgcagacctgtatctccag

SEQ ID NO: 943812 - DNA, 25 bp, Mus musculus
gctgactgcagagctgtatctccag

SEQ ID NO: 943813 - DNA, 25 bp, Mus musculus
gctgactgttcatgcgcttgtgaac

SEQ ID NO: 943814 - DNA, 25 bp, Mus musculus
gctgactgttcatgggcttgtgaac

SEQ ID NO: 943815 - DNA, 25 bp, Mus musculus
gctgacttcctgcacgaatatgtca

SEQ ID NO: 943816 - DNA, 25 bp, Mus musculus
gctgacttcctgcaggaatatgtca

SEQ ID NO: 943817 - DNA, 25 bp, Mus musculus
gctgagaaacctaacaattgtggat

SEQ ID NO: 943818 - DNA, 25 bp, Mus musculus
gctgagaaaccttacaattgtggat

SEQ ID NO: 943819 - DNA, 25 bp, Mus musculus
gctgagaaagaagaccaagagaaac

SEQ ID NO: 943820 - DNA, 25 bp, Mus musculus
gctgagaaagaagagcaagagaaac

SEQ ID NO: 943821 - DNA, 25 bp, Mus musculus
gctgagaacgggacgtcctctggct

SEQ ID NO: 943822 - DNA, 25 bp, Mus musculus
gctgagaacgggtcgtcctctggct

SEQ ID NO: 943823 - DNA, 25 bp, Mus musculus
gctgagaagccgcctgtccctgaga

SEQ ID NO: 943824 - DNA, 25 bp, Mus musculus
gctgagaagccggctgtccctgaga

SEQ ID NO: 943825 - DNA, 25 bp, Mus musculus
gctgagaagcctaacaacgcaattc

SEQ ID NO: 943826 - DNA, 25 bp, Mus musculus
gctgagaagcctaagaacgcaattc

SEQ ID NO: 943827 - DNA, 25 bp, Mus musculus
gctgagacagcaagcgggaaaactc

SEQ ID NO: 943828 - DNA, 25 bp, Mus musculus
gctgagacagcatataagctggttc

SEQ ID NO: 943829 - DNA, 25 bp, Mus musculus
gctgagacaggaagcgggaaaactc

SEQ ID NO: 943830 - DNA, 25 bp, Mus musculus
gctgagacaggatataagctggttc

SEQ ID NO: 943831 - DNA, 25 bp, Mus musculus
gctgagagacaacacaggccagctg

SEQ ID NO: 943832 - DNA, 25 bp, Mus musculus
gctgagagacaagacaggccagctg

SEQ ID NO: 943833 - DNA, 25 bp, Mus musculus
gctgagaggaccaacgcaatacagt

SEQ ID NO: 943834 - DNA, 25 bp, Mus musculus
gctgagaggaccaaggcaatacagt

SEQ ID NO: 943835 - DNA, 25 bp, Mus musculus
gctgagagtcggcccctgtctccaa

SEQ ID NO: 943836 - DNA, 25 bp, Mus musculus
gctgagagtcggcggcctggtgtac

SEQ ID NO: 943837 - DNA, 25 bp, Mus musculus
gctgagagtcgggccctgtctccaa

SEQ ID NO: 943838 - DNA, 25 bp, Mus musculus
gctgagagtcgggggcctggtgtac

SEQ ID NO: 943839 - DNA, 25 bp, Mus musculus
gctgagattaaacacagctgcagca

SEQ ID NO: 943840 - DNA, 25 bp, Mus musculus
gctgagattaaagacagctgcagca

SEQ ID NO: 943841 - DNA, 25 bp, Mus musculus
gctgagattacacaggcctcattca

SEQ ID NO: 943842 - DNA, 25 bp, Mus musculus
gctgagattacagaggcctcattca

SEQ ID NO: 943843 - DNA, 25 bp, Mus musculus
gctgagcaaacacctgcccgggagg

SEQ ID NO: 943844 - DNA, 25 bp, Mus musculus
gctgagcaaacagctgcccgggagg

SEQ ID NO: 943845 - DNA, 25 bp, Mus musculus
gctgagcaaattcacatataaaaag

SEQ ID NO: 943846 - DNA, 25 bp, Mus musculus
gctgagcaaattcacctaataattt

SEQ ID NO: 943847 - DNA, 25 bp, Mus musculus
gctgagcaaattcagatataaaaag

SEQ ID NO: 943848 - DNA, 25 bp, Mus musculus
gctgagcaaattcagctaataattt

SEQ ID NO: 943849 - DNA, 25 bp, Mus musculus
gctgagcaagatgacctggactatc

SEQ ID NO: 943850 - DNA, 25 bp, Mus musculus
gctgagcaagatgagctggactatc

SEQ ID NO: 943851 - DNA, 25 bp, Mus musculus
gctgagcaagcatgaacatggaaag

SEQ ID NO: 943852 - DNA, 25 bp, Mus musculus
gctgagcaaggatgaacatggaaag

SEQ ID NO: 943853 - DNA, 25 bp, Mus musculus
gctgagcacacactcagaaacttac

SEQ ID NO: 943854 - DNA, 25 bp, Mus musculus
gctgagcacagactcagaaacttac

SEQ ID NO: 943855 - DNA, 25 bp, Mus musculus
gctgagcacgatgagccacgtggtg

SEQ ID NO: 943856 - DNA, 25 bp, Mus musculus
gctgagcacgttgagccacgtggtg

SEQ ID NO: 943857 - DNA, 25 bp, Mus musculus
gctgagcagaagcgccttcttgaag

SEQ ID NO: 943858 - DNA, 25 bp, Mus musculus
gctgagcagaagggccttcttgaag

SEQ ID NO: 943859 - DNA, 25 bp, Mus musculus
gctgagccgagacaagagccctggg

SEQ ID NO: 943860 - DNA, 25 bp, Mus musculus
gctgagccgagagaagagccctggg

SEQ ID NO: 943861 - DNA, 25 bp, Mus musculus
gctgagcctgggacactgttctggg

SEQ ID NO: 943862 - DNA, 25 bp, Mus musculus
gctgagcctgggcaacaaaaactgc

SEQ ID NO: 943863 - DNA, 25 bp, Mus musculus
gctgagcctggggaacaaaaactgc

SEQ ID NO: 943864 - DNA, 25 bp, Mus musculus
gctgagcctgggtcactgttctggg

SEQ ID NO: 943865 - DNA, 25 bp, Mus musculus
gctgagcttgcacgcatctagtctt

SEQ ID NO: 943866 - DNA, 25 bp, Mus musculus
gctgagcttgcaggcatctagtctt

SEQ ID NO: 943867 - DNA, 25 bp, Mus musculus
gctgagcttgctaacctacaagaag

SEQ ID NO: 943868 - DNA, 25 bp, Mus musculus
gctgagcttgctaacgtggaagaag

SEQ ID NO: 943869 - DNA, 25 bp, Mus musculus
gctgagcttgctaagctacaagaag

SEQ ID NO: 943870 - DNA, 25 bp, Mus musculus
gctgagcttgctaaggtggaagaag

SEQ ID NO: 943871 - DNA, 25 bp, Mus musculus
gctgaggacgctcctgtgtccccag

SEQ ID NO: 943872 - DNA, 25 bp, Mus musculus
gctgaggacggtcctgtgtccccag

SEQ ID NO: 943873 - DNA, 25 bp, Mus musculus
gctgaggatgatgacgatgacgatg

SEQ ID NO: 943874 - DNA, 25 bp, Mus musculus
gctgaggatgatgaggatgacgatg

SEQ ID NO: 943875 - DNA, 25 bp, Mus musculus
gctgaggcagagaaaaggcaggagc

SEQ ID NO: 943876 - DNA, 25 bp, Mus musculus
gctgaggcagcgtcagaaagcatgg

SEQ ID NO: 943877 - DNA, 25 bp, Mus musculus
gctgaggcagctctccaaggaagag

SEQ ID NO: 943878 - DNA, 25 bp, Mus musculus
gctgaggcagggtcagaaagcatgg

SEQ ID NO: 943879 - DNA, 25 bp, Mus musculus
gctgaggcaggtctccaaggaagag

SEQ ID NO: 943880 - DNA, 25 bp, Mus musculus
gctgaggcagtgaaaaggcaggagc

SEQ ID NO: 943881 - DNA, 25 bp, Mus musculus
gctgaggcggcgcatcgtgaagctg

SEQ ID NO: 943882 - DNA, 25 bp, Mus musculus
gctgaggcggggcatcgtgaagctg

SEQ ID NO: 943883 - DNA, 25 bp, Mus musculus
gctgaggctgcgcaggtactgccat

SEQ ID NO: 943884 - DNA, 25 bp, Mus musculus
gctgaggctgcggaggtactgccat

SEQ ID NO: 943885 - DNA, 25 bp, Mus musculus
gctgaggtcacttcatcacacacag

SEQ ID NO: 943886 - DNA, 25 bp, Mus musculus
gctgaggtcacttcttcacacacag

SEQ ID NO: 943887 - DNA, 25 bp, Mus musculus
gctgaggtggagaacgccaagggga

SEQ ID NO: 943888 - DNA, 25 bp, Mus musculus
gctgaggtggagaaggccaagggga

SEQ ID NO: 943889 - DNA, 25 bp, Mus musculus
gctgagtaagccgacttctctagcc

SEQ ID NO: 943890 - DNA, 25 bp, Mus musculus
gctgagtaagccgagttctctagcc

SEQ ID NO: 943891 - DNA, 25 bp, Mus musculus
gctgagtatagacgtgctccagacc

SEQ ID NO: 943892 - DNA, 25 bp, Mus musculus
gctgagtatagaggtgctccagacc

SEQ ID NO: 943893 - DNA, 25 bp, Mus musculus
gctgagtcagctcctggcttggcct

SEQ ID NO: 943894 - DNA, 25 bp, Mus musculus
gctgagtcaggtcctggcttggcct

SEQ ID NO: 943895 - DNA, 25 bp, Mus musculus
gctgagtcccaaagcatgcatgctg

SEQ ID NO: 943896 - DNA, 25 bp, Mus musculus
gctgagtcccaaagcgtcttcagat

SEQ ID NO: 943897 - DNA, 25 bp, Mus musculus
gctgagtcccaaagctgtcctgcag

SEQ ID NO: 943898 - DNA, 25 bp, Mus musculus
gctgagtcccaaaggatgcatgctg

SEQ ID NO: 943899 - DNA, 25 bp, Mus musculus
gctgagtcccaaagggtcttcagat

SEQ ID NO: 943900 - DNA, 25 bp, Mus musculus
gctgagtcccaaaggtgtcctgcag

SEQ ID NO: 943901 - DNA, 25 bp, Mus musculus
gctgagtctgtgcgcatgcgagggg

SEQ ID NO: 943902 - DNA, 25 bp, Mus musculus
gctgagtctgtgcggatgcgagggg

SEQ ID NO: 943903 - DNA, 25 bp, Mus musculus
gctgagttcaccaacactggccgtg

SEQ ID NO: 943904 - DNA, 25 bp, Mus musculus
gctgagttcaccaagactggccgtg

SEQ ID NO: 943905 - DNA, 25 bp, Mus musculus
gctgagttctggctggatctgcagc

SEQ ID NO: 943906 - DNA, 25 bp, Mus musculus
gctgagttctgggtggatctgcagc

SEQ ID NO: 943907 - DNA, 25 bp, Mus musculus
gctgagtttgaggacgctcaacgca

SEQ ID NO: 943908 - DNA, 25 bp, Mus musculus
gctgagtttgaggaggctcaacgca

SEQ ID NO: 943909 - DNA, 25 bp, Mus musculus
gctgataacacacgccatggcgcag

SEQ ID NO: 943910 - DNA, 25 bp, Mus musculus
gctgataacacacgtgccttcttca

SEQ ID NO: 943911 - DNA, 25 bp, Mus musculus
gctgataacacaggccatggcgcag

SEQ ID NO: 943912 - DNA, 25 bp, Mus musculus
gctgataacacaggtgccttcttca

SEQ ID NO: 943913 - DNA, 25 bp, Mus musculus
gctgataaccaccgctctgaagcgt

SEQ ID NO: 943914 - DNA, 25 bp, Mus musculus
gctgataaccacctctctgggtcct

SEQ ID NO: 943915 - DNA, 25 bp, Mus musculus
gctgataaccacggctctgaagcgt

SEQ ID NO: 943916 - DNA, 25 bp, Mus musculus
gctgataaccacgtctctgggtcct

SEQ ID NO: 943917 - DNA, 25 bp, Mus musculus
gctgataagaataactttcccggag

SEQ ID NO: 943918 - DNA, 25 bp, Mus musculus
gctgataagaataagtttcccggag

SEQ ID NO: 943919 - DNA, 25 bp, Mus musculus
gctgataattcagacgtcagaaata

SEQ ID NO: 943920 - DNA, 25 bp, Mus musculus
gctgataattcagaggtcagaaata

SEQ ID NO: 943921 - DNA, 25 bp, Mus musculus
gctgatcaagctcttggataaactt

SEQ ID NO: 943922 - DNA, 25 bp, Mus musculus
gctgatcaaggaaccttctgtggat

SEQ ID NO: 943923 - DNA, 25 bp, Mus musculus
gctgatcaaggatccttctgtggat

SEQ ID NO: 943924 - DNA, 25 bp, Mus musculus
gctgatcaaggtcttggataaactt

SEQ ID NO: 943925 - DNA, 25 bp, Mus musculus
gctgatcaggtccacggcaatggca

SEQ ID NO: 943926 - DNA, 25 bp, Mus musculus
gctgatcaggtccagggcaatggca

SEQ ID NO: 943927 - DNA, 25 bp, Mus musculus
gctgatcccccagacaggccaggct

SEQ ID NO: 943928 - DNA, 25 bp, Mus musculus
gctgatcccccagacagtcatggac

SEQ ID NO: 943929 - DNA, 25 bp, Mus musculus
gctgatcccccagagaggccaggct

SEQ ID NO: 943930 - DNA, 25 bp, Mus musculus
gctgatcccccagagagtcatggac

SEQ ID NO: 943931 - DNA, 25 bp, Mus musculus
gctgatgaaaaagctgctggaagcc

SEQ ID NO: 943932 - DNA, 25 bp, Mus musculus
gctgatgaaatagctgctggaagcc

SEQ ID NO: 943933 - DNA, 25 bp, Mus musculus
gctgatgaagtgcacctgacatcag

SEQ ID NO: 943934 - DNA, 25 bp, Mus musculus
gctgatgaagtggacctgacatcag

SEQ ID NO: 943935 - DNA, 25 bp, Mus musculus
gctgatgacccactcttatctcctc

SEQ ID NO: 943936 - DNA, 25 bp, Mus musculus
gctgatgacccagtcttatctcctc

SEQ ID NO: 943937 - DNA, 25 bp, Mus musculus
gctgatgagcagagattctgcaacg

SEQ ID NO: 943938 - DNA, 25 bp, Mus musculus
gctgatgagcagtgattctgcaacg

SEQ ID NO: 943939 - DNA, 25 bp, Mus musculus
gctgatgagctcaacggtttagcct

SEQ ID NO: 943940 - DNA, 25 bp, Mus musculus
gctgatgagctcaactctgaagtgt

SEQ ID NO: 943941 - DNA, 25 bp, Mus musculus
gctgatgagctcaagggtttagcct

SEQ ID NO: 943942 - DNA, 25 bp, Mus musculus
gctgatgagctcaagtctgaagtgt

SEQ ID NO: 943943 - DNA, 25 bp, Mus musculus
gctgatgcagaccgagaagcagttc

SEQ ID NO: 943944 - DNA, 25 bp, Mus musculus
gctgatgcagacggagaagcagttc

SEQ ID NO: 943945 - DNA, 25 bp, Mus musculus
gctgatgcagcccatgctggagtat

SEQ ID NO: 943946 - DNA, 25 bp, Mus musculus
gctgatgcagctcacaagcagatcc

SEQ ID NO: 943947 - DNA, 25 bp, Mus musculus
gctgatgcagctcagaagcagatcc

SEQ ID NO: 943948 - DNA, 25 bp, Mus musculus
gctgatgcaggccatgctggagtat

SEQ ID NO: 943949 - DNA, 25 bp, Mus musculus
gctgatgcatcctgtaggtggtggc

SEQ ID NO: 943950 - DNA, 25 bp, Mus musculus
gctgatgcatgctgtaggtggtggc

SEQ ID NO: 943951 - DNA, 25 bp, Mus musculus
gctgatgccaagaaacggccatcgt

SEQ ID NO: 943952 - DNA, 25 bp, Mus musculus
gctgatgccaagtaacggccatcgt

SEQ ID NO: 943953 - DNA, 25 bp, Mus musculus
gctgatggacacagtgatatttatc

SEQ ID NO: 943954 - DNA, 25 bp, Mus musculus
gctgatggacactgtgatatttatc

SEQ ID NO: 943955 - DNA, 25 bp, Mus musculus
gctgatggacagccctgggatcgat

SEQ ID NO: 943956 - DNA, 25 bp, Mus musculus
gctgatggacaggcctgggatcgat

SEQ ID NO: 943957 - DNA, 25 bp, Mus musculus
gctgatggagctttttaaatttgat

SEQ ID NO: 943958 - DNA, 25 bp, Mus musculus
gctgatggaggtttttaaatttgat

SEQ ID NO: 943959 - DNA, 25 bp, Mus musculus
gctgatggcaaacgaaaagagaaga

SEQ ID NO: 943960 - DNA, 25 bp, Mus musculus
gctgatggcaaaggaaaagagaaga

SEQ ID NO: 943961 - DNA, 25 bp, Mus musculus
gctgatggccagactctgtttgctg

SEQ ID NO: 943962 - DNA, 25 bp, Mus musculus
gctgatggccagattttcatttatg

SEQ ID NO: 943963 - DNA, 25 bp, Mus musculus
gctgatggccagtctctgtttgctg

SEQ ID NO: 943964 - DNA, 25 bp, Mus musculus
gctgatggccagtttttcatttatg

SEQ ID NO: 943965 - DNA, 25 bp, Mus musculus
gctgatggctattccgagaataatg

SEQ ID NO: 943966 - DNA, 25 bp, Mus musculus
gctgatggctattcggagaataatg

SEQ ID NO: 943967 - DNA, 25 bp, Mus musculus
gctgatgggagacacaaagatgtag

SEQ ID NO: 943968 - DNA, 25 bp, Mus musculus
gctgatgggagacagaaagatgtag

SEQ ID NO: 943969 - DNA, 25 bp, Mus musculus
gctgatgtccagaggcacccctttt

SEQ ID NO: 943970 - DNA, 25 bp, Mus musculus
gctgatgtccagtggcacccctttt

SEQ ID NO: 943971 - DNA, 25 bp, Mus musculus
gctgatgttgagcctttgttgacca

SEQ ID NO: 943972 - DNA, 25 bp, Mus musculus
gctgatgttgaggctttgttgacca

SEQ ID NO: 943973 - DNA, 25 bp, Mus musculus
gctgattcgagacgttccgtgagga

SEQ ID NO: 943974 - DNA, 25 bp, Mus musculus
gctgattcgagaggttccgtgagga

SEQ ID NO: 943975 - DNA, 25 bp, Mus musculus
gctgattgacaaaatcctggaagag

SEQ ID NO: 943976 - DNA, 25 bp, Mus musculus
gctgattgacaatatcctggaagag

SEQ ID NO: 943977 - DNA, 25 bp, Mus musculus
gctgattggtgaaaaccgctgtatg

SEQ ID NO: 943978 - DNA, 25 bp, Mus musculus
gctgattggtgaaatccgctgtatg

SEQ ID NO: 943979 - DNA, 25 bp, Mus musculus
gctgcaaaaacaaagctcctgggct

SEQ ID NO: 943980 - DNA, 25 bp, Mus musculus
gctgcaaaaacatagctcctgggct

SEQ ID NO: 943981 - DNA, 25 bp, Mus musculus
gctgcaaaaacgtcctggtctctcc

SEQ ID NO: 943982 - DNA, 25 bp, Mus musculus
gctgcaaaaacttgagaattacatt

SEQ ID NO: 943983 - DNA, 25 bp, Mus musculus
gctgcaaaaaggtcctggtctctcc

SEQ ID NO: 943984 - DNA, 25 bp, Mus musculus
gctgcaaaaagttgagaattacatt

SEQ ID NO: 943985 - DNA, 25 bp, Mus musculus
gctgcaaaagaaatatccaagggtg

SEQ ID NO: 943986 - DNA, 25 bp, Mus musculus
gctgcaaaagaattatccaagggtg

SEQ ID NO: 943987 - DNA, 25 bp, Mus musculus
gctgcaagaagacatgacgccttcg

SEQ ID NO: 943988 - DNA, 25 bp, Mus musculus
gctgcaagaagagatgacgccttcg

SEQ ID NO: 943989 - DNA, 25 bp, Mus musculus
gctgcaagaattcactgacagaaat

SEQ ID NO: 943990 - DNA, 25 bp, Mus musculus
gctgcaagaattgactgacagaaat

SEQ ID NO: 943991 - DNA, 25 bp, Mus musculus
gctgcaaggcagcttggcgtgggtg

SEQ ID NO: 943992 - DNA, 25 bp, Mus musculus
gctgcaaggcaggttggcgtgggtg

SEQ ID NO: 943993 - DNA, 25 bp, Mus musculus
gctgcaatggagagttgtgatcgca

SEQ ID NO: 943994 - DNA, 25 bp, Mus musculus
gctgcaatggagtgttgtgatcgca

SEQ ID NO: 943995 - DNA, 25 bp, Mus musculus
gctgcacaagacacgggtcacagtg

SEQ ID NO: 943996 - DNA, 25 bp, Mus musculus
gctgcacaagcacctgttgcagcgg

SEQ ID NO: 943997 - DNA, 25 bp, Mus musculus
gctgcacaagcagctgttgcagcgg

SEQ ID NO: 943998 - DNA, 25 bp, Mus musculus
gctgcacaagcgcgtcactgagctg

SEQ ID NO: 943999 - DNA, 25 bp, Mus musculus
gctgcacaagcgggtcactgagctg

SEQ ID NO: 944000 - DNA, 25 bp, Mus musculus
gctgcacaagtcacgggtcacagtg

SEQ ID NO: 944001 - DNA, 25 bp, Mus musculus
gctgcacaccagcattttgctaaca

SEQ ID NO: 944002 - DNA, 25 bp, Mus musculus
gctgcacaccaggattttgctaaca

SEQ ID NO: 944003 - DNA, 25 bp, Mus musculus
gctgcacagatgagagacaaattcc

SEQ ID NO: 944004 - DNA, 25 bp, Mus musculus
gctgcacagatgtgagacaaattcc

SEQ ID NO: 944005 - DNA, 25 bp, Mus musculus
gctgcacatcaacacctgtgttcct

SEQ ID NO: 944006 - DNA, 25 bp, Mus musculus
gctgcacatcaacgtccctttgtgt

SEQ ID NO: 944007 - DNA, 25 bp, Mus musculus
gctgcacatcaagacctgtgttcct

SEQ ID NO: 944008 - DNA, 25 bp, Mus musculus
gctgcacatcaaggtccctttgtgt

SEQ ID NO: 944009 - DNA, 25 bp, Mus musculus
gctgcacatcctcacggatgcagat

SEQ ID NO: 944010 - DNA, 25 bp, Mus musculus
gctgcacatcctgacggatgcagat

SEQ ID NO: 944011 - DNA, 25 bp, Mus musculus
gctgcaccatagctttcatagcttt

SEQ ID NO: 944012 - DNA, 25 bp, Mus musculus
gctgcaccataggtttcatagcttt

SEQ ID NO: 944013 - DNA, 25 bp, Mus musculus
gctgcacgcccgcatgtgtttcttt

SEQ ID NO: 944014 - DNA, 25 bp, Mus musculus
gctgcacgccctaatttctaatgcc

SEQ ID NO: 944015 - DNA, 25 bp, Mus musculus
gctgcacgccggcatgtgtttcttt

SEQ ID NO: 944016 - DNA, 25 bp, Mus musculus
gctgcacgccgtaatttctaatgcc

SEQ ID NO: 944017 - DNA, 25 bp, Mus musculus
gctgcactgccgcccttggtgaata

SEQ ID NO: 944018 - DNA, 25 bp, Mus musculus
gctgcactgccggccttggtgaata

SEQ ID NO: 944019 - DNA, 25 bp, Mus musculus
gctgcacttgagcaagcatcaagag

SEQ ID NO: 944020 - DNA, 25 bp, Mus musculus
gctgcacttgaggaagcatcaagag

SEQ ID NO: 944021 - DNA, 25 bp, Mus musculus
gctgcagaaactcattgaagccgac

SEQ ID NO: 944022 - DNA, 25 bp, Mus musculus
gctgcagaaactgattgaagccgac

SEQ ID NO: 944023 - DNA, 25 bp, Mus musculus
gctgcagaaccagtttgttgtattc

SEQ ID NO: 944024 - DNA, 25 bp, Mus musculus
gctgcagaacgagtttgttgtattc

SEQ ID NO: 944025 - DNA, 25 bp, Mus musculus
gctgcagaagagacccaagccagac

SEQ ID NO: 944026 - DNA, 25 bp, Mus musculus
gctgcagaagtgacccaagccagac

SEQ ID NO: 944027 - DNA, 25 bp, Mus musculus
gctgcagaccatcactcccctgttc

SEQ ID NO: 944028 - DNA, 25 bp, Mus musculus
gctgcagaccatcagtcccctgttc

SEQ ID NO: 944029 - DNA, 25 bp, Mus musculus
gctgcagagccagtcagccctgcct

SEQ ID NO: 944030 - DNA, 25 bp, Mus musculus
gctgcagagccagtgagccctgcct

SEQ ID NO: 944031 - DNA, 25 bp, Mus musculus
gctgcagaggataactactctcaga

SEQ ID NO: 944032 - DNA, 25 bp, Mus musculus
gctgcagaggataagtactctcaga

SEQ ID NO: 944033 - DNA, 25 bp, Mus musculus
gctgcagaggccccgtggggcccct

SEQ ID NO: 944034 - DNA, 25 bp, Mus musculus
gctgcagagggcccgtggggcccct

SEQ ID NO: 944035 - DNA, 25 bp, Mus musculus
gctgcagatttgcgacacagcaggc

SEQ ID NO: 944036 - DNA, 25 bp, Mus musculus
gctgcagatttgggacacagcaggc

SEQ ID NO: 944037 - DNA, 25 bp, Mus musculus
gctgcagcaagacttccactgttgt

SEQ ID NO: 944038 - DNA, 25 bp, Mus musculus
gctgcagcaagagttccactgttgt

SEQ ID NO: 944039 - DNA, 25 bp, Mus musculus
gctgcagcacttcactgctgtcttc

SEQ ID NO: 944040 - DNA, 25 bp, Mus musculus
gctgcagcacttcagtgctgtcttc

SEQ ID NO: 944041 - DNA, 25 bp, Mus musculus
gctgcagcagaaaacaaatatggaa

SEQ ID NO: 944042 - DNA, 25 bp, Mus musculus
gctgcagcagaaaagaaatatggaa

SEQ ID NO: 944043 - DNA, 25 bp, Mus musculus
gctgcagcagaacattctctgtggc

SEQ ID NO: 944044 - DNA, 25 bp, Mus musculus
gctgcagcagaagattctctgtggc

SEQ ID NO: 944045 - DNA, 25 bp, Mus musculus
gctgcagcagattgtcaatctgatc

SEQ ID NO: 944046 - DNA, 25 bp, Mus musculus
gctgcagcagcacctgcgaggctcc

SEQ ID NO: 944047 - DNA, 25 bp, Mus musculus
gctgcagcagcccaccatggcagaa

SEQ ID NO: 944048 - DNA, 25 bp, Mus musculus
gctgcagcagcgctcatggcagata

SEQ ID NO: 944049 - DNA, 25 bp, Mus musculus
gctgcagcaggacctgcgaggctcc

SEQ ID NO: 944050 - DNA, 25 bp, Mus musculus
gctgcagcaggccaccatggcagaa

SEQ ID NO: 944051 - DNA, 25 bp, Mus musculus
gctgcagcagggctcatggcagata

SEQ ID NO: 944052 - DNA, 25 bp, Mus musculus
gctgcagcagtttgtcaatctgatc

SEQ ID NO: 944053 - DNA, 25 bp, Mus musculus
gctgcagcccagaacggtgtgcaga

SEQ ID NO: 944054 - DNA, 25 bp, Mus musculus
gctgcagcccagaagggtgtgcaga

SEQ ID NO: 944055 - DNA, 25 bp, Mus musculus
gctgcagccgagcgaatgggcttgg

SEQ ID NO: 944056 - DNA, 25 bp, Mus musculus
gctgcagccgagggaatgggcttgg

SEQ ID NO: 944057 - DNA, 25 bp, Mus musculus
gctgcagcctctctccggatagctt

SEQ ID NO: 944058 - DNA, 25 bp, Mus musculus
gctgcagcctctgtccggatagctt

SEQ ID NO: 944059 - DNA, 25 bp, Mus musculus
gctgcagcgagacgtggaggtagag

SEQ ID NO: 944060 - DNA, 25 bp, Mus musculus
gctgcagcgagaggtggaggtagag

SEQ ID NO: 944061 - DNA, 25 bp, Mus musculus
gctgcagctcagcgggtgatagctg

SEQ ID NO: 944062 - DNA, 25 bp, Mus musculus
gctgcagctcagggggtgatagctg

SEQ ID NO: 944063 - DNA, 25 bp, Mus musculus
gctgcagctcttcttatttacgtcg

SEQ ID NO: 944064 - DNA, 25 bp, Mus musculus
gctgcagctcttgttatttacgtcg

SEQ ID NO: 944065 - DNA, 25 bp, Mus musculus
gctgcagctgacactgtacagcagc

SEQ ID NO: 944066 - DNA, 25 bp, Mus musculus
gctgcagctgactctgtacagcagc

SEQ ID NO: 944067 - DNA, 25 bp, Mus musculus
gctgcagctgctcatcgaggagcag

SEQ ID NO: 944068 - DNA, 25 bp, Mus musculus
gctgcagctgctgatcgaggagcag

SEQ ID NO: 944069 - DNA, 25 bp, Mus musculus
gctgcagctggacgtgtggaacacc

SEQ ID NO: 944070 - DNA, 25 bp, Mus musculus
gctgcagctggaggtgtggaacacc

SEQ ID NO: 944071 - DNA, 25 bp, Mus musculus
gctgcaggaatgccttccagacctc

SEQ ID NO: 944072 - DNA, 25 bp, Mus musculus
gctgcaggaatggcttccagacctc

SEQ ID NO: 944073 - DNA, 25 bp, Mus musculus
gctgcaggagcaaactgtgccagct

SEQ ID NO: 944074 - DNA, 25 bp, Mus musculus
gctgcaggagcaccttcgggcagtt

SEQ ID NO: 944075 - DNA, 25 bp, Mus musculus
gctgcaggagcagcagacaggtctg

SEQ ID NO: 944076 - DNA, 25 bp, Mus musculus
gctgcaggagcagctgacaggtctg

SEQ ID NO: 944077 - DNA, 25 bp, Mus musculus
gctgcaggagcagcttcgggcagtt

SEQ ID NO: 944078 - DNA, 25 bp, Mus musculus
gctgcaggaggaaactgtgccagct

SEQ ID NO: 944079 - DNA, 25 bp, Mus musculus
gctgcaggcccgctcccgagatgaa

SEQ ID NO: 944080 - DNA, 25 bp, Mus musculus
gctgcaggcccggtcccgagatgaa

SEQ ID NO: 944081 - DNA, 25 bp, Mus musculus
gctgcaggcggcatgaagatgagca

SEQ ID NO: 944082 - DNA, 25 bp, Mus musculus
gctgcaggcggcccaagatgtccat

SEQ ID NO: 944083 - DNA, 25 bp, Mus musculus
gctgcaggcggcgcaagatgtccat

SEQ ID NO: 944084 - DNA, 25 bp, Mus musculus
gctgcaggcggcttgaagatgagca

SEQ ID NO: 944085 - DNA, 25 bp, Mus musculus
gctgcagggcaacatccggactctt

SEQ ID NO: 944086 - DNA, 25 bp, Mus musculus
gctgcagggcaagatccggactctt

SEQ ID NO: 944087 - DNA, 25 bp, Mus musculus
gctgcaggtccagacattccctact

SEQ ID NO: 944088 - DNA, 25 bp, Mus musculus
gctgcaggtccagagattccctact

SEQ ID NO: 944089 - DNA, 25 bp, Mus musculus
gctgcagtaattcccaaatcaacat

SEQ ID NO: 944090 - DNA, 25 bp, Mus musculus
gctgcagtaattcccagtcctgaag

SEQ ID NO: 944091 - DNA, 25 bp, Mus musculus
gctgcagtaattccgaaatcaacat

SEQ ID NO: 944092 - DNA, 25 bp, Mus musculus
gctgcagtaattccgagtcctgaag

SEQ ID NO: 944093 - DNA, 25 bp, Mus musculus
gctgcagtcctgctgtgagaagctg

SEQ ID NO: 944094 - DNA, 25 bp, Mus musculus
gctgcagtcctggtgtgagaagctg

SEQ ID NO: 944095 - DNA, 25 bp, Mus musculus
gctgcagtgaaacgtgtgtttgacc

SEQ ID NO: 944096 - DNA, 25 bp, Mus musculus
gctgcagtgaaaggtgtgtttgacc

SEQ ID NO: 944097 - DNA, 25 bp, Mus musculus
gctgcatcagaacctcttacatatg

SEQ ID NO: 944098 - DNA, 25 bp, Mus musculus
gctgcatcagcatctctgctgtgca

SEQ ID NO: 944099 - DNA, 25 bp, Mus musculus
gctgcatcagcccagcactatggtg

SEQ ID NO: 944100 - DNA, 25 bp, Mus musculus
gctgcatcagctaccaccagcttct

SEQ ID NO: 944101 - DNA, 25 bp, Mus musculus
gctgcatcaggatctctgctgtgca

SEQ ID NO: 944102 - DNA, 25 bp, Mus musculus
gctgcatcaggccagcactatggtg

SEQ ID NO: 944103 - DNA, 25 bp, Mus musculus
gctgcatcaggtaccaccagcttct

SEQ ID NO: 944104 - DNA, 25 bp, Mus musculus
gctgcatcagtacctcttacatatg

SEQ ID NO: 944105 - DNA, 25 bp, Mus musculus
gctgcatccagacaaggcacaagtg

SEQ ID NO: 944106 - DNA, 25 bp, Mus musculus
gctgcatccagacatggcacaagtg

SEQ ID NO: 944107 - DNA, 25 bp, Mus musculus
gctgcatccagacgtctggtagcag

SEQ ID NO: 944108 - DNA, 25 bp, Mus musculus
gctgcatccagaggtctggtagcag

SEQ ID NO: 944109 - DNA, 25 bp, Mus musculus
gctgcatgaccactgtagtccatgg

SEQ ID NO: 944110 - DNA, 25 bp, Mus musculus
gctgcatgaccagtgtagtccatgg

SEQ ID NO: 944111 - DNA, 25 bp, Mus musculus
gctgcatggtagcctaagcacacgg

SEQ ID NO: 944112 - DNA, 25 bp, Mus musculus
gctgcatggtaggctaagcacacgg

SEQ ID NO: 944113 - DNA, 25 bp, Mus musculus
gctgcatgtgctccctctctatagc

SEQ ID NO: 944114 - DNA, 25 bp, Mus musculus
gctgcatgtgctgcctctctatagc

SEQ ID NO: 944115 - DNA, 25 bp, Mus musculus
gctgcattggcggacgtgtggacct

SEQ ID NO: 944116 - DNA, 25 bp, Mus musculus
gctgcattggcggaggtgtggacct

SEQ ID NO: 944117 - DNA, 25 bp, Mus musculus
gctgccaaaactgacgctgagaata

SEQ ID NO: 944118 - DNA, 25 bp, Mus musculus
gctgccaaaactgaggctgagaata

SEQ ID NO: 944119 - DNA, 25 bp, Mus musculus
gctgccaaacagatcgaaaaggacc

SEQ ID NO: 944120 - DNA, 25 bp, Mus musculus
gctgccaaacagttcgaaaaggacc

SEQ ID NO: 944121 - DNA, 25 bp, Mus musculus
gctgccaaacttcacataataacag

SEQ ID NO: 944122 - DNA, 25 bp, Mus musculus
gctgccaaacttcagataataacag

SEQ ID NO: 944123 - DNA, 25 bp, Mus musculus
gctgccaaagcataccatacttgca

SEQ ID NO: 944124 - DNA, 25 bp, Mus musculus
gctgccaaaggataccatacttgca

SEQ ID NO: 944125 - DNA, 25 bp, Mus musculus
gctgccaaagtcaactgtatcccat

SEQ ID NO: 944126 - DNA, 25 bp, Mus musculus
gctgccaaagtcaagtgtatcccat

SEQ ID NO: 944127 - DNA, 25 bp, Mus musculus
gctgccaaagtcacccaagctgacc

SEQ ID NO: 944128 - DNA, 25 bp, Mus musculus
gctgccaaagtctcccaagctgacc

SEQ ID NO: 944129 - DNA, 25 bp, Mus musculus
gctgccaagaagaaccatgaggctc

SEQ ID NO: 944130 - DNA, 25 bp, Mus musculus
gctgccaagaagtaccatgaggctc

SEQ ID NO: 944131 - DNA, 25 bp, Mus musculus
gctgccaccagaattgccagcggct

SEQ ID NO: 944132 - DNA, 25 bp, Mus musculus
gctgccaccagatttgccagcggct

SEQ ID NO: 944133 - DNA, 25 bp, Mus musculus
gctgccacgagacacactggtctta

SEQ ID NO: 944134 - DNA, 25 bp, Mus musculus
gctgccacgagacagactggtctta

SEQ ID NO: 944135 - DNA, 25 bp, Mus musculus
gctgccaggaagcatttatcttagt

SEQ ID NO: 944136 - DNA, 25 bp, Mus musculus
gctgccaggaaggatttatcttagt

SEQ ID NO: 944137 - DNA, 25 bp, Mus musculus
gctgccagtctggacgcgtccctac

SEQ ID NO: 944138 - DNA, 25 bp, Mus musculus
gctgccagtctggaggcgtccctac

SEQ ID NO: 944139 - DNA, 25 bp, Mus musculus
gctgccatccagccagcagcagcag

SEQ ID NO: 944140 - DNA, 25 bp, Mus musculus
gctgccatccaggcagcagcagcag

SEQ ID NO: 944141 - DNA, 25 bp, Mus musculus
gctgccatgactcatctggagagat

SEQ ID NO: 944142 - DNA, 25 bp, Mus musculus
gctgccatgactgatctggagagat

SEQ ID NO: 944143 - DNA, 25 bp, Mus musculus
gctgccatggtactgatggacagaa

SEQ ID NO: 944144 - DNA, 25 bp, Mus musculus
gctgccatggtagtgatggacagaa

SEQ ID NO: 944145 - DNA, 25 bp, Mus musculus
gctgccattcaactggcagccacag

SEQ ID NO: 944146 - DNA, 25 bp, Mus musculus
gctgccattcaagtggcagccacag

SEQ ID NO: 944147 - DNA, 25 bp, Mus musculus
gctgccattgagaaaatgaaacagc

SEQ ID NO: 944148 - DNA, 25 bp, Mus musculus
gctgccattgagacgtaccaccaga

SEQ ID NO: 944149 - DNA, 25 bp, Mus musculus
gctgccattgagtaaatgaaacagc

SEQ ID NO: 944150 - DNA, 25 bp, Mus musculus
gctgccattgagtcgtaccaccaga

SEQ ID NO: 944151 - DNA, 25 bp, Mus musculus
gctgcccaagaccacctcacggatg

SEQ ID NO: 944152 - DNA, 25 bp, Mus musculus
gctgcccaagaccagctcacggatg

SEQ ID NO: 944153 - DNA, 25 bp, Mus musculus
gctgcccactgccgcatcctaataa

SEQ ID NO: 944154 - DNA, 25 bp, Mus musculus
gctgcccactgccggatcctaataa

SEQ ID NO: 944155 - DNA, 25 bp, Mus musculus
gctgcccacttgcgaggcagaggcc

SEQ ID NO: 944156 - DNA, 25 bp, Mus musculus
gctgcccacttgggaggcagaggcc

SEQ ID NO: 944157 - DNA, 25 bp, Mus musculus
gctgcccagaagcagtcgaaagcca

SEQ ID NO: 944158 - DNA, 25 bp, Mus musculus
gctgcccagaaggagtcgaaagcca

SEQ ID NO: 944159 - DNA, 25 bp, Mus musculus
gctgcccatgccactggagctcgtg

SEQ ID NO: 944160 - DNA, 25 bp, Mus musculus
gctgcccatggcactggagctcgtg

SEQ ID NO: 944161 - DNA, 25 bp, Mus musculus
gctgcccccccaccgctaccaccta

SEQ ID NO: 944162 - DNA, 25 bp, Mus musculus
gctgcccccccagcgctaccaccta

SEQ ID NO: 944163 - DNA, 25 bp, Mus musculus
gctgcccctcagcagcagcaacagc

SEQ ID NO: 944164 - DNA, 25 bp, Mus musculus
gctgcccctcaggagcagcaacagc

SEQ ID NO: 944165 - DNA, 25 bp, Mus musculus
gctgcccctgggctgtcttctgagc

SEQ ID NO: 944166 - DNA, 25 bp, Mus musculus
gctgcccctggggtgtcttctgagc

SEQ ID NO: 944167 - DNA, 25 bp, Mus musculus
gctgcccgaaagcctgagaccgctg

SEQ ID NO: 944168 - DNA, 25 bp, Mus musculus
gctgcccgaaaggctgagaccgctg

SEQ ID NO: 944169 - DNA, 25 bp, Mus musculus
gctgcccggacaaaacatgaagagc

SEQ ID NO: 944170 - DNA, 25 bp, Mus musculus
gctgcccggacataacatgaagagc

SEQ ID NO: 944171 - DNA, 25 bp, Mus musculus
gctgcccggggtcacccatgggagc

SEQ ID NO: 944172 - DNA, 25 bp, Mus musculus
gctgcccggggtcagccatgggagc

SEQ ID NO: 944173 - DNA, 25 bp, Mus musculus
gctgccctagcagggtcggagcttc

SEQ ID NO: 944174 - DNA, 25 bp, Mus musculus
gctgccctagcgtcggagcttccac

SEQ ID NO: 944175 - DNA, 25 bp, Mus musculus
gctgccctaggagggtcggagcttc

SEQ ID NO: 944176 - DNA, 25 bp, Mus musculus
gctgccctagggtcggagcttccac

SEQ ID NO: 944177 - DNA, 25 bp, Mus musculus
gctgccctctgccacgaacagattg

SEQ ID NO: 944178 - DNA, 25 bp, Mus musculus
gctgccctctgccaggaacagattg

SEQ ID NO: 944179 - DNA, 25 bp, Mus musculus
gctgcccttctacgcgtgtgccttc

SEQ ID NO: 944180 - DNA, 25 bp, Mus musculus
gctgcccttctacgggtgtgccttc

SEQ ID NO: 944181 - DNA, 25 bp, Mus musculus
gctgccgactaggatgaaggacgca

SEQ ID NO: 944182 - DNA, 25 bp, Mus musculus
gctgccgactcgtcaatatagacct

SEQ ID NO: 944183 - DNA, 25 bp, Mus musculus
gctgccgactggtcaatatagacct

SEQ ID NO: 944184 - DNA, 25 bp, Mus musculus
gctgccgacttggatgaaggacgca

SEQ ID NO: 944185 - DNA, 25 bp, Mus musculus
gctgccgataagaacgccctggagc

SEQ ID NO: 944186 - DNA, 25 bp, Mus musculus
gctgccgataagtacgccctggagc

SEQ ID NO: 944187 - DNA, 25 bp, Mus musculus
gctgccgcagcaaaagccacaggaa

SEQ ID NO: 944188 - DNA, 25 bp, Mus musculus
gctgccgcagcaccacaggaaaggg

SEQ ID NO: 944189 - DNA, 25 bp, Mus musculus
gctgccgcagcagcacaggaaaggg

SEQ ID NO: 944190 - DNA, 25 bp, Mus musculus
gctgccgcagcataagccacaggaa

SEQ ID NO: 944191 - DNA, 25 bp, Mus musculus
gctgccgccgtgcgcggagcagcaa

SEQ ID NO: 944192 - DNA, 25 bp, Mus musculus
gctgccgccgtgcgcggatagctgc

SEQ ID NO: 944193 - DNA, 25 bp, Mus musculus
gctgccgccgtgcggggagcagcaa

SEQ ID NO: 944194 - DNA, 25 bp, Mus musculus
gctgccgccgtgcggggatagctgc

SEQ ID NO: 944195 - DNA, 25 bp, Mus musculus
gctgccgcgaggagtatggcgtttg

SEQ ID NO: 944196 - DNA, 25 bp, Mus musculus
gctgccgcgaggtgtatggcgtttg

SEQ ID NO: 944197 - DNA, 25 bp, Mus musculus
gctgccgctgagtgcatacattcca

SEQ ID NO: 944198 - DNA, 25 bp, Mus musculus
gctgccgctgagtggatacattcca

SEQ ID NO: 944199 - DNA, 25 bp, Mus musculus
gctgcctatatggcacccgagcgca

SEQ ID NO: 944200 - DNA, 25 bp, Mus musculus
gctgcctatatggctcccgagcgca

SEQ ID NO: 944201 - DNA, 25 bp, Mus musculus
gctgcctatgcctattgctatgcac

SEQ ID NO: 944202 - DNA, 25 bp, Mus musculus
gctgcctatggctattgctatgcac

SEQ ID NO: 944203 - DNA, 25 bp, Mus musculus
gctgcctcacagaagtcgacactgt

SEQ ID NO: 944204 - DNA, 25 bp, Mus musculus
gctgcctcacagtagtcgacactgt

SEQ ID NO: 944205 - DNA, 25 bp, Mus musculus
gctgcctcacatcgatccaatcaat

SEQ ID NO: 944206 - DNA, 25 bp, Mus musculus
gctgcctcacatggatccaatcaat

SEQ ID NO: 944207 - DNA, 25 bp, Mus musculus
gctgcctcagagcccaccgcaacga

SEQ ID NO: 944208 - DNA, 25 bp, Mus musculus
gctgcctcagagtactggctgactg

SEQ ID NO: 944209 - DNA, 25 bp, Mus musculus
gctgcctcagcacggcttccccatc

SEQ ID NO: 944210 - DNA, 25 bp, Mus musculus
gctgcctcagcagggcttccccatc

SEQ ID NO: 944211 - DNA, 25 bp, Mus musculus
gctgcctcagctcgcatagggcatg

SEQ ID NO: 944212 - DNA, 25 bp, Mus musculus
gctgcctcaggtcgcatagggcatg

SEQ ID NO: 944213 - DNA, 25 bp, Mus musculus
gctgcctcagtgcccaccgcaacga

SEQ ID NO: 944214 - DNA, 25 bp, Mus musculus
gctgcctcagtgtactggctgactg

SEQ ID NO: 944215 - DNA, 25 bp, Mus musculus
gctgcctcagtttcagctcttggat

SEQ ID NO: 944216 - DNA, 25 bp, Mus musculus
gctgcctcagtttctgctcttggat

SEQ ID NO: 944217 - DNA, 25 bp, Mus musculus
gctgcctgagccctaggaccatgaa

SEQ ID NO: 944218 - DNA, 25 bp, Mus musculus
gctgcctgaggcctaggaccatgaa

SEQ ID NO: 944219 - DNA, 25 bp, Mus musculus
gctgcctgcatcaacctttgcagat

SEQ ID NO: 944220 - DNA, 25 bp, Mus musculus
gctgcctgcatcagtctcttaacct

SEQ ID NO: 944221 - DNA, 25 bp, Mus musculus
gctgcctgcatctacctttgcagat

SEQ ID NO: 944222 - DNA, 25 bp, Mus musculus
gctgcctgcatctgtctcttaacct

SEQ ID NO: 944223 - DNA, 25 bp, Mus musculus
gctgcctgcttctccgttcagcatg

SEQ ID NO: 944224 - DNA, 25 bp, Mus musculus
gctgcctgcttctcggttcagcatg

SEQ ID NO: 944225 - DNA, 25 bp, Mus musculus
gctgcctgttctcctttcagtgtct

SEQ ID NO: 944226 - DNA, 25 bp, Mus musculus
gctgcctgttctgctttcagtgtct

SEQ ID NO: 944227 - DNA, 25 bp, Mus musculus
gctgccttacagcccccgggtgctc

SEQ ID NO: 944228 - DNA, 25 bp, Mus musculus
gctgccttacaggccccgggtgctc

SEQ ID NO: 944229 - DNA, 25 bp, Mus musculus
gctgccttacttcgtgacattggtg

SEQ ID NO: 944230 - DNA, 25 bp, Mus musculus
gctgccttacttggtgacattggtg

SEQ ID NO: 944231 - DNA, 25 bp, Mus musculus
gctgccttatggcgagtgaacttgc

SEQ ID NO: 944232 - DNA, 25 bp, Mus musculus
gctgccttatggggagtgaacttgc

SEQ ID NO: 944233 - DNA, 25 bp, Mus musculus
gctgccttcgcaacgtaagctcaga

SEQ ID NO: 944234 - DNA, 25 bp, Mus musculus
gctgccttcggaacgtaagctcaga

SEQ ID NO: 944235 - DNA, 25 bp, Mus musculus
gctgcgagagcttcctctcacagct

SEQ ID NO: 944236 - DNA, 25 bp, Mus musculus
gctgcgagaggttcctctcacagct

SEQ ID NO: 944237 - DNA, 25 bp, Mus musculus
gctgcgatcagcctcgcctttagta

SEQ ID NO: 944238 - DNA, 25 bp, Mus musculus
gctgcgatcagcctggcctttagta

SEQ ID NO: 944239 - DNA, 25 bp, Mus musculus
gctgcgcagactactttactggaaa

SEQ ID NO: 944240 - DNA, 25 bp, Mus musculus
gctgcgcagacttctttactggaaa

SEQ ID NO: 944241 - DNA, 25 bp, Mus musculus
gctgcgccaaattttcacctgacgg

SEQ ID NO: 944242 - DNA, 25 bp, Mus musculus
gctgcgccaatttttcacctgacgg

SEQ ID NO: 944243 - DNA, 25 bp, Mus musculus
gctgcgccttaacgaggaagagctg

SEQ ID NO: 944244 - DNA, 25 bp, Mus musculus
gctgcgccttaaggaggaagagctg

SEQ ID NO: 944245 - DNA, 25 bp, Mus musculus
gctgcgctctgccacgagctgtact

SEQ ID NO: 944246 - DNA, 25 bp, Mus musculus
gctgcgctctgccaggagctgtact

SEQ ID NO: 944247 - DNA, 25 bp, Mus musculus
gctgcgctgactcaggatgacattc

SEQ ID NO: 944248 - DNA, 25 bp, Mus musculus
gctgcgctgactgaggatgacattc

SEQ ID NO: 944249 - DNA, 25 bp, Mus musculus
gctgcgctgcgacagaggaagacga

SEQ ID NO: 944250 - DNA, 25 bp, Mus musculus
gctgcgctgcgagagaggaagacga

SEQ ID NO: 944251 - DNA, 25 bp, Mus musculus
gctgcggaagcatgatccagtcacc

SEQ ID NO: 944252 - DNA, 25 bp, Mus musculus
gctgcggaaggatgatccagtcacc

SEQ ID NO: 944253 - DNA, 25 bp, Mus musculus
gctgcggagacacgttgcagaattc

SEQ ID NO: 944254 - DNA, 25 bp, Mus musculus
gctgcggagacaggttgcagaattc

SEQ ID NO: 944255 - DNA, 25 bp, Mus musculus
gctgcggcatctcaatcttgagtat

SEQ ID NO: 944256 - DNA, 25 bp, Mus musculus
gctgcggcatctcattcttgagtat

SEQ ID NO: 944257 - DNA, 25 bp, Mus musculus
gctgcggcctacaaagagctagtga

SEQ ID NO: 944258 - DNA, 25 bp, Mus musculus
gctgcggcctacaatgagctagtga

SEQ ID NO: 944259 - DNA, 25 bp, Mus musculus
gctgcggcctgacccggctccactc

SEQ ID NO: 944260 - DNA, 25 bp, Mus musculus
gctgcggcctgaccgggctccactc

SEQ ID NO: 944261 - DNA, 25 bp, Mus musculus
gctgcggctggacgttttcccgctc

SEQ ID NO: 944262 - DNA, 25 bp, Mus musculus
gctgcggctggactgcccacgatgg

SEQ ID NO: 944263 - DNA, 25 bp, Mus musculus
gctgcggctggaggttttcccgctc

SEQ ID NO: 944264 - DNA, 25 bp, Mus musculus
gctgcggctggagtgcccacgatgg

SEQ ID NO: 944265 - DNA, 25 bp, Mus musculus
gctgcgggaaaccgctgaagctgac

SEQ ID NO: 944266 - DNA, 25 bp, Mus musculus
gctgcgggaaacggctgaagctgac

SEQ ID NO: 944267 - DNA, 25 bp, Mus musculus
gctgcgggagagggtctgctgacac

SEQ ID NO: 944268 - DNA, 25 bp, Mus musculus
gctgcgggagtgggtctgctgacac

SEQ ID NO: 944269 - DNA, 25 bp, Mus musculus
gctgcgggcacgcgaatcgtacaag

SEQ ID NO: 944270 - DNA, 25 bp, Mus musculus
gctgcgggcacgggaatcgtacaag

SEQ ID NO: 944271 - DNA, 25 bp, Mus musculus
gctgcgggcccgcaaatgcacttag

SEQ ID NO: 944272 - DNA, 25 bp, Mus musculus
gctgcgggcccgcgactgtgcagca

SEQ ID NO: 944273 - DNA, 25 bp, Mus musculus
gctgcgggcccggaaatgcacttag

SEQ ID NO: 944274 - DNA, 25 bp, Mus musculus
gctgcgggcccgggactgtgcagca

SEQ ID NO: 944275 - DNA, 25 bp, Mus musculus
gctgcgggctttcggaatgtcaacc

SEQ ID NO: 944276 - DNA, 25 bp, Mus musculus
gctgcgggctttgggaatgtcaacc

SEQ ID NO: 944277 - DNA, 25 bp, Mus musculus
gctgcggggatgcaagctgtgcctt

SEQ ID NO: 944278 - DNA, 25 bp, Mus musculus
gctgcggggatggaagctgtgcctt

SEQ ID NO: 944279 - DNA, 25 bp, Mus musculus
gctgcggttacactcggtggagttc

SEQ ID NO: 944280 - DNA, 25 bp, Mus musculus
gctgcggttacactgggtggagttc

SEQ ID NO: 944281 - DNA, 25 bp, Mus musculus
gctgcgtagagaatccgggtttccg

SEQ ID NO: 944282 - DNA, 25 bp, Mus musculus
gctgcgtagagaatgcgggtttccg

SEQ ID NO: 944283 - DNA, 25 bp, Mus musculus
gctgcgtcaatgagacacagtgtga

SEQ ID NO: 944284 - DNA, 25 bp, Mus musculus
gctgcgtcaatgtgacacagtgtga

SEQ ID NO: 944285 - DNA, 25 bp, Mus musculus
gctgcgtctttggacggtggaagag

SEQ ID NO: 944286 - DNA, 25 bp, Mus musculus
gctgcgtctttggagggtggaagag

SEQ ID NO: 944287 - DNA, 25 bp, Mus musculus
gctgcgtgcttacgtggtgtgacaa

SEQ ID NO: 944288 - DNA, 25 bp, Mus musculus
gctgcgtgcttaggtggtgtgacaa

SEQ ID NO: 944289 - DNA, 25 bp, Mus musculus
gctgctaagaagagaaaaattgcct

SEQ ID NO: 944290 - DNA, 25 bp, Mus musculus
gctgctaagaagtgaaaaattgcct

SEQ ID NO: 944291 - DNA, 25 bp, Mus musculus
gctgctaatcagcgtcagatctttg

SEQ ID NO: 944292 - DNA, 25 bp, Mus musculus
gctgctaatcagggtcagatctttg

SEQ ID NO: 944293 - DNA, 25 bp, Mus musculus
gctgctactcagagtttgctaaaga

SEQ ID NO: 944294 - DNA, 25 bp, Mus musculus
gctgctactcagtgtttgctaaaga

SEQ ID NO: 944295 - DNA, 25 bp, Mus musculus
gctgctactgcaaatgctgaccttt

SEQ ID NO: 944296 - DNA, 25 bp, Mus musculus
gctgctactggaaatgctgaccttt

SEQ ID NO: 944297 - DNA, 25 bp, Mus musculus
gctgctagaatccgtctttggtcct

SEQ ID NO: 944298 - DNA, 25 bp, Mus musculus
gctgctagaatcggtctttggtcct

SEQ ID NO: 944299 - DNA, 25 bp, Mus musculus
gctgctagacagcaagatccatgtc

SEQ ID NO: 944300 - DNA, 25 bp, Mus musculus
gctgctagacagccttgtgttgcgg

SEQ ID NO: 944301 - DNA, 25 bp, Mus musculus
gctgctagacaggaagatccatgtc

SEQ ID NO: 944302 - DNA, 25 bp, Mus musculus
gctgctagacaggcttgtgttgcgg

SEQ ID NO: 944303 - DNA, 25 bp, Mus musculus
gctgctagattatactgataaacaa

SEQ ID NO: 944304 - DNA, 25 bp, Mus musculus
gctgctagattatagtgataaacaa

SEQ ID NO: 944305 - DNA, 25 bp, Mus musculus
gctgctagccagctatttcttgttg

SEQ ID NO: 944306 - DNA, 25 bp, Mus musculus
gctgctagccaggtatttcttgttg

SEQ ID NO: 944307 - DNA, 25 bp, Mus musculus
gctgctaggcaactacaagttcagg

SEQ ID NO: 944308 - DNA, 25 bp, Mus musculus
gctgctaggcaagtacaagttcagg

SEQ ID NO: 944309 - DNA, 25 bp, Mus musculus
gctgctagttggaacgctctgggtg

SEQ ID NO: 944310 - DNA, 25 bp, Mus musculus
gctgctagttggaaggctctgggtg

SEQ ID NO: 944311 - DNA, 25 bp, Mus musculus
gctgctatagccatgaaagaagtga

SEQ ID NO: 944312 - DNA, 25 bp, Mus musculus
gctgctatagcctactattggaaag

SEQ ID NO: 944313 - DNA, 25 bp, Mus musculus
gctgctataggcatgaaagaagtga

SEQ ID NO: 944314 - DNA, 25 bp, Mus musculus
gctgctataggctactattggaaag

SEQ ID NO: 944315 - DNA, 25 bp, Mus musculus
gctgctatccagcttgccagttcaa

SEQ ID NO: 944316 - DNA, 25 bp, Mus musculus
gctgctatccaggttgccagttcaa

SEQ ID NO: 944317 - DNA, 25 bp, Mus musculus
gctgctatctgttaagaaacaaatg

SEQ ID NO: 944318 - DNA, 25 bp, Mus musculus
gctgctatctgttatgaaacaaatg

SEQ ID NO: 944319 - DNA, 25 bp, Mus musculus
gctgctcaaccacacgcacctctag

SEQ ID NO: 944320 - DNA, 25 bp, Mus musculus
gctgctcaaccactggacatatcag

SEQ ID NO: 944321 - DNA, 25 bp, Mus musculus
gctgctcaaccagacgcacctctag

SEQ ID NO: 944322 - DNA, 25 bp, Mus musculus
gctgctcaaccagtggacatatcag

SEQ ID NO: 944323 - DNA, 25 bp, Mus musculus
gctgctcaactgcgtgaatgccctg

SEQ ID NO: 944324 - DNA, 25 bp, Mus musculus
gctgctcaactgggtgaatgccctg

SEQ ID NO: 944325 - DNA, 25 bp, Mus musculus
gctgctcaagaacactttggtggta

SEQ ID NO: 944326 - DNA, 25 bp, Mus musculus
gctgctcaagaacagtttggtggta

SEQ ID NO: 944327 - DNA, 25 bp, Mus musculus
gctgctcaagcctcccccggctttt

SEQ ID NO: 944328 - DNA, 25 bp, Mus musculus
gctgctcaagctcgcaggtggcagg

SEQ ID NO: 944329 - DNA, 25 bp, Mus musculus
gctgctcaagctcggaggtggcagg

SEQ ID NO: 944330 - DNA, 25 bp, Mus musculus
gctgctcaaggctcccccggctttt

SEQ ID NO: 944331 - DNA, 25 bp, Mus musculus
gctgctcaccatcaaaagcaagccg

SEQ ID NO: 944332 - DNA, 25 bp, Mus musculus
gctgctcaccatcataagcaagccg

SEQ ID NO: 944333 - DNA, 25 bp, Mus musculus
gctgctcaccccctgtgggtcagct

SEQ ID NO: 944334 - DNA, 25 bp, Mus musculus
gctgctcaccccgtgtgggtcagct

SEQ ID NO: 944335 - DNA, 25 bp, Mus musculus
gctgctcagaaccaaccaagaattg

SEQ ID NO: 944336 - DNA, 25 bp, Mus musculus
gctgctcagaaccgatcaataagcc

SEQ ID NO: 944337 - DNA, 25 bp, Mus musculus
gctgctcagaacgaaccaagaattg

SEQ ID NO: 944338 - DNA, 25 bp, Mus musculus
gctgctcagaacggatcaataagcc

SEQ ID NO: 944339 - DNA, 25 bp, Mus musculus
gctgctcagaccaacgccaccttct

SEQ ID NO: 944340 - DNA, 25 bp, Mus musculus
gctgctcagaccaaggccaccttct

SEQ ID NO: 944341 - DNA, 25 bp, Mus musculus
gctgctcataagaggtatgcaatct

SEQ ID NO: 944342 - DNA, 25 bp, Mus musculus
gctgctcataagtggtatgcaatct

SEQ ID NO: 944343 - DNA, 25 bp, Mus musculus
gctgctccagaactatggcatgacg

SEQ ID NO: 944344 - DNA, 25 bp, Mus musculus
gctgctccagactggatgagctaaa

SEQ ID NO: 944345 - DNA, 25 bp, Mus musculus
gctgctccagcagcctgaagctacc

SEQ ID NO: 944346 - DNA, 25 bp, Mus musculus
gctgctccagctcagctaccaacgt

SEQ ID NO: 944347 - DNA, 25 bp, Mus musculus
gctgctccagctctaccaacgtcct

SEQ ID NO: 944348 - DNA, 25 bp, Mus musculus
gctgctccagctgagctaccaacgt

SEQ ID NO: 944349 - DNA, 25 bp, Mus musculus
gctgctccagctgtaccaacgtcct

SEQ ID NO: 944350 - DNA, 25 bp, Mus musculus
gctgctccaggagcctgaagctacc

SEQ ID NO: 944351 - DNA, 25 bp, Mus musculus
gctgctccagtactatggcatgacg

SEQ ID NO: 944352 - DNA, 25 bp, Mus musculus
gctgctccagtctggatgagctaaa

SEQ ID NO: 944353 - DNA, 25 bp, Mus musculus
gctgctcccgagaacgtgatcgtga

SEQ ID NO: 944354 - DNA, 25 bp, Mus musculus
gctgctcccgagaaggtgatcgtga

SEQ ID NO: 944355 - DNA, 25 bp, Mus musculus
gctgctccggaatctctatgagagc

SEQ ID NO: 944356 - DNA, 25 bp, Mus musculus
gctgctccggtatctctatgagagc

SEQ ID NO: 944357 - DNA, 25 bp, Mus musculus
gctgctcctgcacgtcctaagcagc

SEQ ID NO: 944358 - DNA, 25 bp, Mus musculus
gctgctcctgcaggtcctaagcagc

SEQ ID NO: 944359 - DNA, 25 bp, Mus musculus
gctgctcctggacggaggtgtggac

SEQ ID NO: 944360 - DNA, 25 bp, Mus musculus
gctgctcctggagggaggtgtggac

SEQ ID NO: 944361 - DNA, 25 bp, Mus musculus
gctgctcgggccaacctccagtaca

SEQ ID NO: 944362 - DNA, 25 bp, Mus musculus
gctgctcgggccaagctccagtaca

SEQ ID NO: 944363 - DNA, 25 bp, Mus musculus
gctgctctgacacgcgggagtggga

SEQ ID NO: 944364 - DNA, 25 bp, Mus musculus
gctgctctgacaggcgggagtggga

SEQ ID NO: 944365 - DNA, 25 bp, Mus musculus
gctgctctgactcgagtcttttcac

SEQ ID NO: 944366 - DNA, 25 bp, Mus musculus
gctgctctgactggagtcttttcac

SEQ ID NO: 944367 - DNA, 25 bp, Mus musculus
gctgctcttaaacactttaatctgt

SEQ ID NO: 944368 - DNA, 25 bp, Mus musculus
gctgctcttaaacctagctcggaac

SEQ ID NO: 944369 - DNA, 25 bp, Mus musculus
gctgctcttaaacctcggaacacac

SEQ ID NO: 944370 - DNA, 25 bp, Mus musculus
gctgctcttaaagactttaatctgt

SEQ ID NO: 944371 - DNA, 25 bp, Mus musculus
gctgctcttaaagctagctcggaac

SEQ ID NO: 944372 - DNA, 25 bp, Mus musculus
gctgctcttaaagctcggaacacac

SEQ ID NO: 944373 - DNA, 25 bp, Mus musculus
gctgctcttcttatatatgatcatc

SEQ ID NO: 944374 - DNA, 25 bp, Mus musculus
gctgctcttcttttatatgatcatc

SEQ ID NO: 944375 - DNA, 25 bp, Mus musculus
gctgctgaaagaccccctgactggg

SEQ ID NO: 944376 - DNA, 25 bp, Mus musculus
gctgctgaaagagcccctgactggg

SEQ ID NO: 944377 - DNA, 25 bp, Mus musculus
gctgctgaacaacaatgacggaaat

SEQ ID NO: 944378 - DNA, 25 bp, Mus musculus
gctgctgaacaagaatgacggaaat

SEQ ID NO: 944379 - DNA, 25 bp, Mus musculus
gctgctgaagaaaactactctcaaa

SEQ ID NO: 944380 - DNA, 25 bp, Mus musculus
gctgctgaagaaaagtactctcaaa

SEQ ID NO: 944381 - DNA, 25 bp, Mus musculus
gctgctgaagaggcaagtggaagtt

SEQ ID NO: 944382 - DNA, 25 bp, Mus musculus
gctgctgaagtggcaagtggaagtt

SEQ ID NO: 944383 - DNA, 25 bp, Mus musculus
gctgctgaattttacagaacgagtt

SEQ ID NO: 944384 - DNA, 25 bp, Mus musculus
gctgctgaattttacagaatggctc

SEQ ID NO: 944385 - DNA, 25 bp, Mus musculus
gctgctgaattttagagaacgagtt

SEQ ID NO: 944386 - DNA, 25 bp, Mus musculus
gctgctgaattttagagaatggctc

SEQ ID NO: 944387 - DNA, 25 bp, Mus musculus
gctgctgagacacgaagcgggaaaa

SEQ ID NO: 944388 - DNA, 25 bp, Mus musculus
gctgctgagacaggaagcgggaaaa

SEQ ID NO: 944389 - DNA, 25 bp, Mus musculus
gctgctgagcaacgatgaacatgga

SEQ ID NO: 944390 - DNA, 25 bp, Mus musculus
gctgctgagcaaggatgaacatgga

SEQ ID NO: 944391 - DNA, 25 bp, Mus musculus
gctgctgagcagcttcaattttata

SEQ ID NO: 944392 - DNA, 25 bp, Mus musculus
gctgctgagcaggttcaattttata

SEQ ID NO: 944393 - DNA, 25 bp, Mus musculus
gctgctgagcctggcgaacaaaaac

SEQ ID NO: 944394 - DNA, 25 bp, Mus musculus
gctgctgagcctggctcactgttct

SEQ ID NO: 944395 - DNA, 25 bp, Mus musculus
gctgctgagcctggggaacaaaaac

SEQ ID NO: 944396 - DNA, 25 bp, Mus musculus
gctgctgagcctgggtcactgttct

SEQ ID NO: 944397 - DNA, 25 bp, Mus musculus
gctgctgatgtccacaggcacccct

SEQ ID NO: 944398 - DNA, 25 bp, Mus musculus
gctgctgatgtccagaggcacccct

SEQ ID NO: 944399 - DNA, 25 bp, Mus musculus
gctgctgcagccgacggaatgggct

SEQ ID NO: 944400 - DNA, 25 bp, Mus musculus
gctgctgcagccgagggaatgggct

SEQ ID NO: 944401 - DNA, 25 bp, Mus musculus
gctgctgcagcctgtgcacagctcc

SEQ ID NO: 944402 - DNA, 25 bp, Mus musculus
gctgctgcagcttaccaacatatcc

SEQ ID NO: 944403 - DNA, 25 bp, Mus musculus
gctgctgcaggacgaaactgtgcca

SEQ ID NO: 944404 - DNA, 25 bp, Mus musculus
gctgctgcaggaggaaactgtgcca

SEQ ID NO: 944405 - DNA, 25 bp, Mus musculus
gctgctgcaggctgtgcacagctcc

SEQ ID NO: 944406 - DNA, 25 bp, Mus musculus
gctgctgcaggttaccaacatatcc

SEQ ID NO: 944407 - DNA, 25 bp, Mus musculus
gctgctgcggaaagccacggctttg

SEQ ID NO: 944408 - DNA, 25 bp, Mus musculus
gctgctgcggtaagccacggctttg

SEQ ID NO: 944409 - DNA, 25 bp, Mus musculus
gctgctgctatccacgttgccagtt

SEQ ID NO: 944410 - DNA, 25 bp, Mus musculus
gctgctgctatccaggttgccagtt

SEQ ID NO: 944411 - DNA, 25 bp, Mus musculus
gctgctgctgcaacgggttccagcc

SEQ ID NO: 944412 - DNA, 25 bp, Mus musculus
gctgctgctggaacgggttccagcc

SEQ ID NO: 944413 - DNA, 25 bp, Mus musculus
gctgctggaaaacactcagttttca

SEQ ID NO: 944414 - DNA, 25 bp, Mus musculus
gctgctggaaaagactcagttttca

SEQ ID NO: 944415 - DNA, 25 bp, Mus musculus
gctgctggacatcgagtgccaggag

SEQ ID NO: 944416 - DNA, 25 bp, Mus musculus
gctgctggacatggagtgccaggag

SEQ ID NO: 944417 - DNA, 25 bp, Mus musculus
gctgctggagcacagagaaaaagta

SEQ ID NO: 944418 - DNA, 25 bp, Mus musculus
gctgctggaggacagagaaaaagta

SEQ ID NO: 944419 - DNA, 25 bp, Mus musculus
gctgctggcttcaaagtgtgttaca

SEQ ID NO: 944420 - DNA, 25 bp, Mus musculus
gctgctggcttcatgtgttacagaa

SEQ ID NO: 944421 - DNA, 25 bp, Mus musculus
gctgctggcttctaagtgtgttaca

SEQ ID NO: 944422 - DNA, 25 bp, Mus musculus
gctgctggcttcttgtgttacagaa

SEQ ID NO: 944423 - DNA, 25 bp, Mus musculus
gctgctgggcttcgttcctgcctca

SEQ ID NO: 944424 - DNA, 25 bp, Mus musculus
gctgctgggcttggttcctgcctca

SEQ ID NO: 944425 - DNA, 25 bp, Mus musculus
gctgctggtgcacgcttatggagaa

SEQ ID NO: 944426 - DNA, 25 bp, Mus musculus
gctgctggtgcaggcttatggagaa

SEQ ID NO: 944427 - DNA, 25 bp, Mus musculus
gctgctggtgctcacgcattgcagc

SEQ ID NO: 944428 - DNA, 25 bp, Mus musculus
gctgctggtgctcaggcattgcagc

SEQ ID NO: 944429 - DNA, 25 bp, Mus musculus
gctgctggtgggcacgtgtgctgat

SEQ ID NO: 944430 - DNA, 25 bp, Mus musculus
gctgctggtgggcaggtgtgctgat

SEQ ID NO: 944431 - DNA, 25 bp, Mus musculus
gctgctggtttattaacaccaagct

SEQ ID NO: 944432 - DNA, 25 bp, Mus musculus
gctgctggtttatttacaccaagct

SEQ ID NO: 944433 - DNA, 25 bp, Mus musculus
gctgctgtaccgcgcagtgcagtct

SEQ ID NO: 944434 - DNA, 25 bp, Mus musculus
gctgctgtaccgggcagtgcagtct

SEQ ID NO: 944435 - DNA, 25 bp, Mus musculus
gctgctgtcactcgtgctcctggct

SEQ ID NO: 944436 - DNA, 25 bp, Mus musculus
gctgctgtcactggtgctcctggct

SEQ ID NO: 944437 - DNA, 25 bp, Mus musculus
gctgctgtccagacagtaaggtgcc

SEQ ID NO: 944438 - DNA, 25 bp, Mus musculus
gctgctgtccagactgtaaggtgcc

SEQ ID NO: 944439 - DNA, 25 bp, Mus musculus
gctgctgtggaacggactccccgga

SEQ ID NO: 944440 - DNA, 25 bp, Mus musculus
gctgctgtggaagggactccccgga

SEQ ID NO: 944441 - DNA, 25 bp, Mus musculus
gctgctgtgttaactttttctactc

SEQ ID NO: 944442 - DNA, 25 bp, Mus musculus
gctgctgtgttatctttttctactc

SEQ ID NO: 944443 - DNA, 25 bp, Mus musculus
gctgcttaagcttcaggccttcctc

SEQ ID NO: 944444 - DNA, 25 bp, Mus musculus
gctgcttaaggttcaggccttcctc

SEQ ID NO: 944445 - DNA, 25 bp, Mus musculus
gctgcttaatcccatcagtgtcttt

SEQ ID NO: 944446 - DNA, 25 bp, Mus musculus
gctgcttaatccgatcagtgtcttt

SEQ ID NO: 944447 - DNA, 25 bp, Mus musculus
gctgcttagagacttttgtcaagag

SEQ ID NO: 944448 - DNA, 25 bp, Mus musculus
gctgcttagagagttttgtcaagag

SEQ ID NO: 944449 - DNA, 25 bp, Mus musculus
gctgcttcaagacgcttggctttct

SEQ ID NO: 944450 - DNA, 25 bp, Mus musculus
gctgcttcaagaggcttggctttct

SEQ ID NO: 944451 - DNA, 25 bp, Mus musculus
gctgcttctcagacaggatggctaa

SEQ ID NO: 944452 - DNA, 25 bp, Mus musculus
gctgcttctcagtcaggatggctaa

SEQ ID NO: 944453 - DNA, 25 bp, Mus musculus
gctgcttctggaccaagtacatgaa

SEQ ID NO: 944454 - DNA, 25 bp, Mus musculus
gctgcttctggacctagtacatgaa

SEQ ID NO: 944455 - DNA, 25 bp, Mus musculus
gctgcttgaaaacacactgagtcct

SEQ ID NO: 944456 - DNA, 25 bp, Mus musculus
gctgcttgaaaagacactgagtcct

SEQ ID NO: 944457 - DNA, 25 bp, Mus musculus
gctgctttacgacgtgctgaatggg

SEQ ID NO: 944458 - DNA, 25 bp, Mus musculus
gctgctttacgaggtgctgaatggg

SEQ ID NO: 944459 - DNA, 25 bp, Mus musculus
gctgctttcccgcctagccactctc

SEQ ID NO: 944460 - DNA, 25 bp, Mus musculus
gctgctttcccggctagccactctc

SEQ ID NO: 944461 - DNA, 25 bp, Mus musculus
gctggaaaagaaactaagtgttgtg

SEQ ID NO: 944462 - DNA, 25 bp, Mus musculus
gctggaaaagactcagttttcagat

SEQ ID NO: 944463 - DNA, 25 bp, Mus musculus
gctggaaaagtaactaagtgttgtg

SEQ ID NO: 944464 - DNA, 25 bp, Mus musculus
gctggaaaagtctcagttttcagat

SEQ ID NO: 944465 - DNA, 25 bp, Mus musculus
gctggaaaggaacaggagccgctgc

SEQ ID NO: 944466 - DNA, 25 bp, Mus musculus
gctggaaaggaagaggagccgctgc

SEQ ID NO: 944467 - DNA, 25 bp, Mus musculus
gctggaaatgaggcctatggttcat

SEQ ID NO: 944468 - DNA, 25 bp, Mus musculus
gctggaaatgcaaccagtgaccttt

SEQ ID NO: 944469 - DNA, 25 bp, Mus musculus
gctggaaatggaaccagtgaccttt

SEQ ID NO: 944470 - DNA, 25 bp, Mus musculus
gctggaaatgtggcctatggttcat

SEQ ID NO: 944471 - DNA, 25 bp, Mus musculus
gctggaacaagacgtagtatggctc

SEQ ID NO: 944472 - DNA, 25 bp, Mus musculus
gctggaacaagaggtagtatggctc

SEQ ID NO: 944473 - DNA, 25 bp, Mus musculus
gctggaacagaggccgcacgaggga

SEQ ID NO: 944474 - DNA, 25 bp, Mus musculus
gctggaacagtggccgcacgaggga

SEQ ID NO: 944475 - DNA, 25 bp, Mus musculus
gctggaacccagagatgtctccgag

SEQ ID NO: 944476 - DNA, 25 bp, Mus musculus
gctggaacccagtgatgtctccgag

SEQ ID NO: 944477 - DNA, 25 bp, Mus musculus
gctggaagagaaagaacgggacctg

SEQ ID NO: 944478 - DNA, 25 bp, Mus musculus
gctggaagagcaacaaagaagagaa

SEQ ID NO: 944479 - DNA, 25 bp, Mus musculus
gctggaagaggaacaaagaagagaa

SEQ ID NO: 944480 - DNA, 25 bp, Mus musculus
gctggaagagtaagaacgggacctg

SEQ ID NO: 944481 - DNA, 25 bp, Mus musculus
gctggaagtgaacaacccagattcc

SEQ ID NO: 944482 - DNA, 25 bp, Mus musculus
gctggaagtgaacgcctgaaccaaa

SEQ ID NO: 944483 - DNA, 25 bp, Mus musculus
gctggaagtgaagaacccagattcc

SEQ ID NO: 944484 - DNA, 25 bp, Mus musculus
gctggaagtgaaggcctgaaccaaa

SEQ ID NO: 944485 - DNA, 25 bp, Mus musculus
gctggaatgcagataacaattgaaa

SEQ ID NO: 944486 - DNA, 25 bp, Mus musculus
gctggaatgcagcttgaaggtcttc

SEQ ID NO: 944487 - DNA, 25 bp, Mus musculus
gctggaatgcaggttgaaggtcttc

SEQ ID NO: 944488 - DNA, 25 bp, Mus musculus
gctggaatgcagttaacaattgaaa

SEQ ID NO: 944489 - DNA, 25 bp, Mus musculus
gctggacaagatccctggctggtcc

SEQ ID NO: 944490 - DNA, 25 bp, Mus musculus
gctggacaagttccctggctggtcc

SEQ ID NO: 944491 - DNA, 25 bp, Mus musculus
gctggacaatcacagggcactgctg

SEQ ID NO: 944492 - DNA, 25 bp, Mus musculus
gctggacaatcagagggcactgctg

SEQ ID NO: 944493 - DNA, 25 bp, Mus musculus
gctggacaatttaggctacagaaca

SEQ ID NO: 944494 - DNA, 25 bp, Mus musculus
gctggacaattttggctacagaaca

SEQ ID NO: 944495 - DNA, 25 bp, Mus musculus
gctggacacgcctgtccagggcaca

SEQ ID NO: 944496 - DNA, 25 bp, Mus musculus
gctggacacggctgtccagggcaca

SEQ ID NO: 944497 - DNA, 25 bp, Mus musculus
gctggacagagacttaattgacaag

SEQ ID NO: 944498 - DNA, 25 bp, Mus musculus
gctggacagagagttaattgacaag

SEQ ID NO: 944499 - DNA, 25 bp, Mus musculus
gctggacagcagcccccagttcttg

SEQ ID NO: 944500 - DNA, 25 bp, Mus musculus
gctggacagcaggccccagttcttg

SEQ ID NO: 944501 - DNA, 25 bp, Mus musculus
gctggacagcttcgtgtggaatttt

SEQ ID NO: 944502 - DNA, 25 bp, Mus musculus
gctggacagcttggtgtggaatttt

SEQ ID NO: 944503 - DNA, 25 bp, Mus musculus
gctggacatccagtgccaggaggta

SEQ ID NO: 944504 - DNA, 25 bp, Mus musculus
gctggacatcgagtgccaggaggta

SEQ ID NO: 944505 - DNA, 25 bp, Mus musculus
gctggacatggcaacgctgtggact

SEQ ID NO: 944506 - DNA, 25 bp, Mus musculus
gctggacatggcaaggctgtggact

SEQ ID NO: 944507 - DNA, 25 bp, Mus musculus
gctggaccagatgcggtgagcaccc

SEQ ID NO: 944508 - DNA, 25 bp, Mus musculus
gctggaccaggacgtggtgcccaca

SEQ ID NO: 944509 - DNA, 25 bp, Mus musculus
gctggaccaggaggtggtgcccaca

SEQ ID NO: 944510 - DNA, 25 bp, Mus musculus
gctggaccagttgcggtgagcaccc

SEQ ID NO: 944511 - DNA, 25 bp, Mus musculus
gctggacctagccccgaaggagctg

SEQ ID NO: 944512 - DNA, 25 bp, Mus musculus
gctggacctagcccggaaggagctg

SEQ ID NO: 944513 - DNA, 25 bp, Mus musculus
gctggacgccaacggtcatggagtc

SEQ ID NO: 944514 - DNA, 25 bp, Mus musculus
gctggacgccaagggtcatggagtc

SEQ ID NO: 944515 - DNA, 25 bp, Mus musculus
gctggacgtgctcgagcaacgactg

SEQ ID NO: 944516 - DNA, 25 bp, Mus musculus
gctggacgtgctggagcaacgactg

SEQ ID NO: 944517 - DNA, 25 bp, Mus musculus
gctggactctaaacagcctgccgag

SEQ ID NO: 944518 - DNA, 25 bp, Mus musculus
gctggactctaaactgcctgccgag

SEQ ID NO: 944519 - DNA, 25 bp, Mus musculus
gctggagaatcttctctgtccactt

SEQ ID NO: 944520 - DNA, 25 bp, Mus musculus
gctggagaatgttctctgtccactt

SEQ ID NO: 944521 - DNA, 25 bp, Mus musculus
gctggagagatgcccaccgggacag

SEQ ID NO: 944522 - DNA, 25 bp, Mus musculus
gctggagagatggccaccgggacag

SEQ ID NO: 944523 - DNA, 25 bp, Mus musculus
gctggagatcagcaggcgccagctg

SEQ ID NO: 944524 - DNA, 25 bp, Mus musculus
gctggagatcagcattcttagattc

SEQ ID NO: 944525 - DNA, 25 bp, Mus musculus
gctggagatcagcttcaatgctccc

SEQ ID NO: 944526 - DNA, 25 bp, Mus musculus
gctggagatcaggaggcgccagctg

SEQ ID NO: 944527 - DNA, 25 bp, Mus musculus
gctggagatcaggattcttagattc

SEQ ID NO: 944528 - DNA, 25 bp, Mus musculus
gctggagatcaggttcaatgctccc

SEQ ID NO: 944529 - DNA, 25 bp, Mus musculus
gctggagcagaggagataatcggag

SEQ ID NO: 944530 - DNA, 25 bp, Mus musculus
gctggagcagaggagatcatcgggg

SEQ ID NO: 944531 - DNA, 25 bp, Mus musculus
gctggagcagcaaagatctataccc

SEQ ID NO: 944532 - DNA, 25 bp, Mus musculus
gctggagcagcaggagtaccagggt

SEQ ID NO: 944533 - DNA, 25 bp, Mus musculus
gctggagcagcttcatccctgaggg

SEQ ID NO: 944534 - DNA, 25 bp, Mus musculus
gctggagcagcttcgggaggccttg

SEQ ID NO: 944535 - DNA, 25 bp, Mus musculus
gctggagcagcttctgccactctgt

SEQ ID NO: 944536 - DNA, 25 bp, Mus musculus
gctggagcagcttgaacttgagaag

SEQ ID NO: 944537 - DNA, 25 bp, Mus musculus
gctggagcaggaaagatctataccc

SEQ ID NO: 944538 - DNA, 25 bp, Mus musculus
gctggagcaggaggagtaccagggt

SEQ ID NO: 944539 - DNA, 25 bp, Mus musculus
gctggagcaggttcatccctgaggg

SEQ ID NO: 944540 - DNA, 25 bp, Mus musculus
gctggagcaggttcgggaggccttg

SEQ ID NO: 944541 - DNA, 25 bp, Mus musculus
gctggagcaggttctgccactctgt

SEQ ID NO: 944542 - DNA, 25 bp, Mus musculus
gctggagcaggttgaacttgagaag

SEQ ID NO: 944543 - DNA, 25 bp, Mus musculus
gctggagcagtggagataatcggag

SEQ ID NO: 944544 - DNA, 25 bp, Mus musculus
gctggagcagtggagatcatcgggg

SEQ ID NO: 944545 - DNA, 25 bp, Mus musculus
gctggagcccaaaaagatggcactt

SEQ ID NO: 944546 - DNA, 25 bp, Mus musculus
gctggagcccaaaatgatggcactt

SEQ ID NO: 944547 - DNA, 25 bp, Mus musculus
gctggagctacacgcgttggagctg

SEQ ID NO: 944548 - DNA, 25 bp, Mus musculus
gctggagctacacgggttggagctg

SEQ ID NO: 944549 - DNA, 25 bp, Mus musculus
gctggagctcggcacgcatttcagg

SEQ ID NO: 944550 - DNA, 25 bp, Mus musculus
gctggagctcggcaggcatttcagg

SEQ ID NO: 944551 - DNA, 25 bp, Mus musculus
gctggagctgaggagattattggtg

SEQ ID NO: 944552 - DNA, 25 bp, Mus musculus
gctggagctgtggagattattggtg

SEQ ID NO: 944553 - DNA, 25 bp, Mus musculus
gctggaggagcacctgtccatcaat

SEQ ID NO: 944554 - DNA, 25 bp, Mus musculus
gctggaggagcagctgtccatcaat

SEQ ID NO: 944555 - DNA, 25 bp, Mus musculus
gctggaggagcccaagcacattgct

SEQ ID NO: 944556 - DNA, 25 bp, Mus musculus
gctggaggagctcattcagattctc

SEQ ID NO: 944557 - DNA, 25 bp, Mus musculus
gctggaggaggactgtggcaacatg

SEQ ID NO: 944558 - DNA, 25 bp, Mus musculus
gctggaggaggagtgtggcaacatg

SEQ ID NO: 944559 - DNA, 25 bp, Mus musculus
gctggaggaggccaagcacattgct

SEQ ID NO: 944560 - DNA, 25 bp, Mus musculus
gctggaggaggtcattcagattctc

SEQ ID NO: 944561 - DNA, 25 bp, Mus musculus
gctggaggcccccacgattccccct

SEQ ID NO: 944562 - DNA, 25 bp, Mus musculus
gctggaggcccccaggattccccct

SEQ ID NO: 944563 - DNA, 25 bp, Mus musculus
gctggagggagacacaagcaggtgg

SEQ ID NO: 944564 - DNA, 25 bp, Mus musculus
gctggagggagacacaaggaggtgg

SEQ ID NO: 944565 - DNA, 25 bp, Mus musculus
gctggagggagacagaagcaggtgg

SEQ ID NO: 944566 - DNA, 25 bp, Mus musculus
gctggagggagacagaaggaggtgg

SEQ ID NO: 944567 - DNA, 25 bp, Mus musculus
gctggagtcagacgagtttgacaag

SEQ ID NO: 944568 - DNA, 25 bp, Mus musculus
gctggagtcagaggagtttgacaag

SEQ ID NO: 944569 - DNA, 25 bp, Mus musculus
gctggagtgagacagcctgtgctgt

SEQ ID NO: 944570 - DNA, 25 bp, Mus musculus
gctggagtgagacaggaggagcgct

SEQ ID NO: 944571 - DNA, 25 bp, Mus musculus
gctggagtgagacctgggaagtcat

SEQ ID NO: 944572 - DNA, 25 bp, Mus musculus
gctggagtgagagagcctgtgctgt

SEQ ID NO: 944573 - DNA, 25 bp, Mus musculus
gctggagtgagagaggaggagcgct

SEQ ID NO: 944574 - DNA, 25 bp, Mus musculus
gctggagtgagagctgggaagtcat

SEQ ID NO: 944575 - DNA, 25 bp, Mus musculus
gctggagtttcacgaactaatgacc

SEQ ID NO: 944576 - DNA, 25 bp, Mus musculus
gctggagtttcaggaactaatgacc

SEQ ID NO: 944577 - DNA, 25 bp, Mus musculus
gctggataacaacgatctgttcagc

SEQ ID NO: 944578 - DNA, 25 bp, Mus musculus
gctggataacaaggatctgttcagc

SEQ ID NO: 944579 - DNA, 25 bp, Mus musculus
gctggatagtaacgtgaacatcatt

SEQ ID NO: 944580 - DNA, 25 bp, Mus musculus
gctggatagtaaggtgaacatcatt

SEQ ID NO: 944581 - DNA, 25 bp, Mus musculus
gctggatcagcatgcgggctcctgg

SEQ ID NO: 944582 - DNA, 25 bp, Mus musculus
gctggatcaggatgcgggctcctgg

SEQ ID NO: 944583 - DNA, 25 bp, Mus musculus
gctggatcagtgattctagatggca

SEQ ID NO: 944584 - DNA, 25 bp, Mus musculus
gctggatcagtgtttctagatggca

SEQ ID NO: 944585 - DNA, 25 bp, Mus musculus
gctggatccgaaccccaagtaccac

SEQ ID NO: 944586 - DNA, 25 bp, Mus musculus
gctggatccgaattcttgttcctag

SEQ ID NO: 944587 - DNA, 25 bp, Mus musculus
gctggatccgctggacacaccactg

SEQ ID NO: 944588 - DNA, 25 bp, Mus musculus
gctggatccggtggacacaccactg

SEQ ID NO: 944589 - DNA, 25 bp, Mus musculus
gctggatccgtaccccaagtaccac

SEQ ID NO: 944590 - DNA, 25 bp, Mus musculus
gctggatccgtattcttgttcctag

SEQ ID NO: 944591 - DNA, 25 bp, Mus musculus
gctggatgagcacctttgtgctgct

SEQ ID NO: 944592 - DNA, 25 bp, Mus musculus
gctggatgaggacctttgtgctgct

SEQ ID NO: 944593 - DNA, 25 bp, Mus musculus
gctggatgatcctcgtgtcatccta

SEQ ID NO: 944594 - DNA, 25 bp, Mus musculus
gctggatgatgctcgtgtcatccta

SEQ ID NO: 944595 - DNA, 25 bp, Mus musculus
gctggatggggcccagccttgagga

SEQ ID NO: 944596 - DNA, 25 bp, Mus musculus
gctggatggggcgcagccttgagga

SEQ ID NO: 944597 - DNA, 25 bp, Mus musculus
gctggatgtgtatgcggagaagaaa

SEQ ID NO: 944598 - DNA, 25 bp, Mus musculus
gctggatgtgtatggggagaagaaa

SEQ ID NO: 944599 - DNA, 25 bp, Mus musculus
gctggatgtttgcacgcgagctata

SEQ ID NO: 944600 - DNA, 25 bp, Mus musculus
gctggatgtttgcaggcgagctata

SEQ ID NO: 944601 - DNA, 25 bp, Mus musculus
gctggatttatccacgtgtgaaatt

SEQ ID NO: 944602 - DNA, 25 bp, Mus musculus
gctggatttatccaggtgtgaaatt

SEQ ID NO: 944603 - DNA, 25 bp, Mus musculus
gctggcaaagccgggttccagcact

SEQ ID NO: 944604 - DNA, 25 bp, Mus musculus
gctggcaaaggcgggttccagcact

SEQ ID NO: 944605 - DNA, 25 bp, Mus musculus
gctggcaacattccacctccacctc

SEQ ID NO: 944606 - DNA, 25 bp, Mus musculus
gctggcaacattcctcctccacctc

SEQ ID NO: 944607 - DNA, 25 bp, Mus musculus
gctggcaagccgaacggcctggcgt

SEQ ID NO: 944608 - DNA, 25 bp, Mus musculus
gctggcaagccgaagggcctggcgt

SEQ ID NO: 944609 - DNA, 25 bp, Mus musculus
gctggcacaggacagggaggcctgg

SEQ ID NO: 944610 - DNA, 25 bp, Mus musculus
gctggcacaggacgcctggaggagc

SEQ ID NO: 944611 - DNA, 25 bp, Mus musculus
gctggcacaggagagggaggcctgg

SEQ ID NO: 944612 - DNA, 25 bp, Mus musculus
gctggcacaggaggcctggaggagc

SEQ ID NO: 944613 - DNA, 25 bp, Mus musculus
gctggcaccgctcacagactctggg

SEQ ID NO: 944614 - DNA, 25 bp, Mus musculus
gctggcaccgctcagagactctggg

SEQ ID NO: 944615 - DNA, 25 bp, Mus musculus
gctggcactcagcgagcatggcact

SEQ ID NO: 944616 - DNA, 25 bp, Mus musculus
gctggcactcagggagcatggcact

SEQ ID NO: 944617 - DNA, 25 bp, Mus musculus
gctggcagagaaccaacatggcttc

SEQ ID NO: 944618 - DNA, 25 bp, Mus musculus
gctggcagagaaccaataccacatc

SEQ ID NO: 944619 - DNA, 25 bp, Mus musculus
gctggcagagaagcaacatggcttc

SEQ ID NO: 944620 - DNA, 25 bp, Mus musculus
gctggcagagaagcaataccacatc

SEQ ID NO: 944621 - DNA, 25 bp, Mus musculus
gctggcagagccatacttgtaccgc

SEQ ID NO: 944622 - DNA, 25 bp, Mus musculus
gctggcagaggcatacttgtaccgc

SEQ ID NO: 944623 - DNA, 25 bp, Mus musculus
gctggcagagtcaaagtgttctgag

SEQ ID NO: 944624 - DNA, 25 bp, Mus musculus
gctggcagagtcccgttgccgagag

SEQ ID NO: 944625 - DNA, 25 bp, Mus musculus
gctggcagagtcgcgttgccgagag

SEQ ID NO: 944626 - DNA, 25 bp, Mus musculus
gctggcagagtctaagtgttctgag

SEQ ID NO: 944627 - DNA, 25 bp, Mus musculus
gctggcagccaaccgaatctatgag

SEQ ID NO: 944628 - DNA, 25 bp, Mus musculus
gctggcagccaagcgaatctatgag

SEQ ID NO: 944629 - DNA, 25 bp, Mus musculus
gctggcaggaggcacaaaggatgag

SEQ ID NO: 944630 - DNA, 25 bp, Mus musculus
gctggcaggaggcacgtcattcatt

SEQ ID NO: 944631 - DNA, 25 bp, Mus musculus
gctggcaggaggcagaaaggatgag

SEQ ID NO: 944632 - DNA, 25 bp, Mus musculus
gctggcaggaggcaggtcattcatt

SEQ ID NO: 944633 - DNA, 25 bp, Mus musculus
gctggcaggtcccagggattttgga

SEQ ID NO: 944634 - DNA, 25 bp, Mus musculus
gctggcaggtgccagggattttgga

SEQ ID NO: 944635 - DNA, 25 bp, Mus musculus
gctggcatcaagctgtcggccctgc

SEQ ID NO: 944636 - DNA, 25 bp, Mus musculus
gctggcatcaagctttggatgctaa

SEQ ID NO: 944637 - DNA, 25 bp, Mus musculus
gctggcatcaaggtgtcggccctgc

SEQ ID NO: 944638 - DNA, 25 bp, Mus musculus
gctggcatcaaggtttggatgctaa

SEQ ID NO: 944639 - DNA, 25 bp, Mus musculus
gctggcatggaacatgaaagagaag

SEQ ID NO: 944640 - DNA, 25 bp, Mus musculus
gctggcatggaagatgaaagagaag

SEQ ID NO: 944641 - DNA, 25 bp, Mus musculus
gctggccaatatctctgtgtcagaa

SEQ ID NO: 944642 - DNA, 25 bp, Mus musculus
gctggccaatttctctgtgtcagaa

SEQ ID NO: 944643 - DNA, 25 bp, Mus musculus
gctggccacactcgacgccgctgtg

SEQ ID NO: 944644 - DNA, 25 bp, Mus musculus
gctggccacactggacgccgctgtg

SEQ ID NO: 944645 - DNA, 25 bp, Mus musculus
gctggccaggagcgcttccactccc

SEQ ID NO: 944646 - DNA, 25 bp, Mus musculus
gctggccaggagcggttccactccc

SEQ ID NO: 944647 - DNA, 25 bp, Mus musculus
gctggcccagaagctagaggaagat

SEQ ID NO: 944648 - DNA, 25 bp, Mus musculus
gctggcccagtagctagaggaagat

SEQ ID NO: 944649 - DNA, 25 bp, Mus musculus
gctggcccttaccgtcttggaaaca

SEQ ID NO: 944650 - DNA, 25 bp, Mus musculus
gctggcccttacctcctgggctgac

SEQ ID NO: 944651 - DNA, 25 bp, Mus musculus
gctggcccttacggtcttggaaaca

SEQ ID NO: 944652 - DNA, 25 bp, Mus musculus
gctggcccttacgtcctgggctgac

SEQ ID NO: 944653 - DNA, 25 bp, Mus musculus
gctggccgagtccggtctttcattc

SEQ ID NO: 944654 - DNA, 25 bp, Mus musculus
gctggccgagtcgggtctttcattc

SEQ ID NO: 944655 - DNA, 25 bp, Mus musculus
gctggccgccggcccgtgtataaga

SEQ ID NO: 944656 - DNA, 25 bp, Mus musculus
gctggccgccgggccgtgtataaga

SEQ ID NO: 944657 - DNA, 25 bp, Mus musculus
gctggcctactaagcctatcagaag

SEQ ID NO: 944658 - DNA, 25 bp, Mus musculus
gctggcctactatgcctatcagaag

SEQ ID NO: 944659 - DNA, 25 bp, Mus musculus
gctggcctgccgctatgtttcagaa

SEQ ID NO: 944660 - DNA, 25 bp, Mus musculus
gctggcctgccggtatgtttcagaa

SEQ ID NO: 944661 - DNA, 25 bp, Mus musculus
gctggcctggcgttccacgcctacg

SEQ ID NO: 944662 - DNA, 25 bp, Mus musculus
gctggcctggggttccacgcctacg

SEQ ID NO: 944663 - DNA, 25 bp, Mus musculus
gctggccttcttgacctgaaaattg

SEQ ID NO: 944664 - DNA, 25 bp, Mus musculus
gctggccttcttgacggccttcttg

SEQ ID NO: 944665 - DNA, 25 bp, Mus musculus
gctggccttcttgagctgaaaattg

SEQ ID NO: 944666 - DNA, 25 bp, Mus musculus
gctggccttcttgagggccttcttg

SEQ ID NO: 944667 - DNA, 25 bp, Mus musculus
gctggccttgggaacgctgctgatc

SEQ ID NO: 944668 - DNA, 25 bp, Mus musculus
gctggccttgggaaggctgctgatc

SEQ ID NO: 944669 - DNA, 25 bp, Mus musculus
gctggcgaaagccattggagcgcag

SEQ ID NO: 944670 - DNA, 25 bp, Mus musculus
gctggcgaaagcgattggagcgcag

SEQ ID NO: 944671 - DNA, 25 bp, Mus musculus
gctggcgtagatcgactgtgccgct

SEQ ID NO: 944672 - DNA, 25 bp, Mus musculus
gctggcgtagttcgactgtgccgct

SEQ ID NO: 944673 - DNA, 25 bp, Mus musculus
gctggcgtccagccaatcctgaaca

SEQ ID NO: 944674 - DNA, 25 bp, Mus musculus
gctggcgtccaggcaatcctgaaca

SEQ ID NO: 944675 - DNA, 25 bp, Mus musculus
gctggctaagaatgtgactgtggcc

SEQ ID NO: 944676 - DNA, 25 bp, Mus musculus
gctggctaagtatgtgactgtggcc

SEQ ID NO: 944677 - DNA, 25 bp, Mus musculus
gctggctatgcccccatcgagcagc

SEQ ID NO: 944678 - DNA, 25 bp, Mus musculus
gctggctatggccccatcgagcagc

SEQ ID NO: 944679 - DNA, 25 bp, Mus musculus
gctggctcaatgaacccaagtttgt

SEQ ID NO: 944680 - DNA, 25 bp, Mus musculus
gctggctcaatgtacccaagtttgt

SEQ ID NO: 944681 - DNA, 25 bp, Mus musculus
gctggctcagagctgtctgccttat

SEQ ID NO: 944682 - DNA, 25 bp, Mus musculus
gctggctcagaggtgtctgccttat

SEQ ID NO: 944683 - DNA, 25 bp, Mus musculus
gctggctcttaacgttcgctatcct

SEQ ID NO: 944684 - DNA, 25 bp, Mus musculus
gctggctcttaaggttcgctatcct

SEQ ID NO: 944685 - DNA, 25 bp, Mus musculus
gctggctgaggacgtggaggtccag

SEQ ID NO: 944686 - DNA, 25 bp, Mus musculus
gctggctgaggaggtggaggtccag

SEQ ID NO: 944687 - DNA, 25 bp, Mus musculus
gctggctgtcaactgcttacgactc

SEQ ID NO: 944688 - DNA, 25 bp, Mus musculus
gctggctgtcaagtgcttacgactc

SEQ ID NO: 944689 - DNA, 25 bp, Mus musculus
gctggctgtgacgacctgatattca

SEQ ID NO: 944690 - DNA, 25 bp, Mus musculus
gctggctgtgacgagctgatattca

SEQ ID NO: 944691 - DNA, 25 bp, Mus musculus
gctggcttacagacaaagcctattt

SEQ ID NO: 944692 - DNA, 25 bp, Mus musculus
gctggcttacagtcaaagcctattt

SEQ ID NO: 944693 - DNA, 25 bp, Mus musculus
gctggcttcaatatcgaatctttct

SEQ ID NO: 944694 - DNA, 25 bp, Mus musculus
gctggcttcaatatggaatctttct

SEQ ID NO: 944695 - DNA, 25 bp, Mus musculus
gctggcttctaagtgtgttacagaa

SEQ ID NO: 944696 - DNA, 25 bp, Mus musculus
gctggcttctagtgttacagaagag

SEQ ID NO: 944697 - DNA, 25 bp, Mus musculus
gctggcttcttagtgtgttacagaa

SEQ ID NO: 944698 - DNA, 25 bp, Mus musculus
gctggcttcttgtgttacagaagag

SEQ ID NO: 944699 - DNA, 25 bp, Mus musculus
gctgggaaagaacatgaaagcagaa

SEQ ID NO: 944700 - DNA, 25 bp, Mus musculus
gctgggaaagaagatgaaagcagaa

SEQ ID NO: 944701 - DNA, 25 bp, Mus musculus
gctgggaaagcttgcagactggaca

SEQ ID NO: 944702 - DNA, 25 bp, Mus musculus
gctgggaaaggttgcagactggaca

SEQ ID NO: 944703 - DNA, 25 bp, Mus musculus
gctgggaattcaaatgactgtgatg

SEQ ID NO: 944704 - DNA, 25 bp, Mus musculus
gctgggaattcaagtctgcccggac

SEQ ID NO: 944705 - DNA, 25 bp, Mus musculus
gctgggaattcatatgactgtgatg

SEQ ID NO: 944706 - DNA, 25 bp, Mus musculus
gctgggaattcatgtctgcccggac

SEQ ID NO: 944707 - DNA, 25 bp, Mus musculus
gctgggacatgaagtgattaagacg

SEQ ID NO: 944708 - DNA, 25 bp, Mus musculus
gctgggacatgatgtgattaagacg

SEQ ID NO: 944709 - DNA, 25 bp, Mus musculus
gctgggacctacctatcacaaggct

SEQ ID NO: 944710 - DNA, 25 bp, Mus musculus
gctgggacctacctgaactacctgg

SEQ ID NO: 944711 - DNA, 25 bp, Mus musculus
gctgggacctacgtatcacaaggct

SEQ ID NO: 944712 - DNA, 25 bp, Mus musculus
gctgggacctacgtgaactacctgg

SEQ ID NO: 944713 - DNA, 25 bp, Mus musculus
gctgggactaaacgggacagctgtt

SEQ ID NO: 944714 - DNA, 25 bp, Mus musculus
gctgggactaaaggggacagctgtt

SEQ ID NO: 944715 - DNA, 25 bp, Mus musculus
gctgggactcatcatcttccaaagg

SEQ ID NO: 944716 - DNA, 25 bp, Mus musculus
gctgggactcatgatcttccaaagg

SEQ ID NO: 944717 - DNA, 25 bp, Mus musculus
gctgggactgctcggcccgctgctc

SEQ ID NO: 944718 - DNA, 25 bp, Mus musculus
gctgggactgctgggcccgctgctc

SEQ ID NO: 944719 - DNA, 25 bp, Mus musculus
gctgggagaaagaacgcatgtcatg

SEQ ID NO: 944720 - DNA, 25 bp, Mus musculus
gctgggagaaagaaggcatgtcatg

SEQ ID NO: 944721 - DNA, 25 bp, Mus musculus
gctgggagagcaccgggaacttcat

SEQ ID NO: 944722 - DNA, 25 bp, Mus musculus
gctgggagagcacgaggtgtaaaga

SEQ ID NO: 944723 - DNA, 25 bp, Mus musculus
gctgggagagcagcgggaacttcat

SEQ ID NO: 944724 - DNA, 25 bp, Mus musculus
gctgggagagcaggaggtgtaaaga

SEQ ID NO: 944725 - DNA, 25 bp, Mus musculus
gctgggagtgtgttcatgtgaacga

SEQ ID NO: 944726 - DNA, 25 bp, Mus musculus
gctgggagtgtgttgatgtgaacga

SEQ ID NO: 944727 - DNA, 25 bp, Mus musculus
gctgggagttcacgttcatgtggac

SEQ ID NO: 944728 - DNA, 25 bp, Mus musculus
gctgggagttcaggttcatgtggac

SEQ ID NO: 944729 - DNA, 25 bp, Mus musculus
gctgggatcattctctgcgtggtgg

SEQ ID NO: 944730 - DNA, 25 bp, Mus musculus
gctgggatcattgtctgcgtggtgg

SEQ ID NO: 944731 - DNA, 25 bp, Mus musculus
gctgggattacacgttggcttcctg

SEQ ID NO: 944732 - DNA, 25 bp, Mus musculus
gctgggattacaggttggcttcctg

SEQ ID NO: 944733 - DNA, 25 bp, Mus musculus
gctgggattagacgagttggaaccc

SEQ ID NO: 944734 - DNA, 25 bp, Mus musculus
gctgggattagaggagttggaaccc

SEQ ID NO: 944735 - DNA, 25 bp, Mus musculus
gctgggattgcacttttcaaagata

SEQ ID NO: 944736 - DNA, 25 bp, Mus musculus
gctgggattgcagttttcaaagata

SEQ ID NO: 944737 - DNA, 25 bp, Mus musculus
gctgggcaaagacgtgcgtgagcac

SEQ ID NO: 944738 - DNA, 25 bp, Mus musculus
gctgggcaaagaggtgcgtgagcac

SEQ ID NO: 944739 - DNA, 25 bp, Mus musculus
gctgggcaagatccttaccaaaact

SEQ ID NO: 944740 - DNA, 25 bp, Mus musculus
gctgggcaagttccttaccaaaact

SEQ ID NO: 944741 - DNA, 25 bp, Mus musculus
gctgggccttctacacagcgtgggt

SEQ ID NO: 944742 - DNA, 25 bp, Mus musculus
gctgggccttcttcacagcgtgggt

SEQ ID NO: 944743 - DNA, 25 bp, Mus musculus
gctgggccttggcggcctgggctgg

SEQ ID NO: 944744 - DNA, 25 bp, Mus musculus
gctgggccttgggggcctgggctgg

SEQ ID NO: 944745 - DNA, 25 bp, Mus musculus
gctgggcgagactcggagccgaggc

SEQ ID NO: 944746 - DNA, 25 bp, Mus musculus
gctgggcgagtctcggagccgaggc

SEQ ID NO: 944747 - DNA, 25 bp, Mus musculus
gctgggcgttggacatatggcagat

SEQ ID NO: 944748 - DNA, 25 bp, Mus musculus
gctgggcgttggacttatggcagat

SEQ ID NO: 944749 - DNA, 25 bp, Mus musculus
gctgggcttgagtcttccaaaatta

SEQ ID NO: 944750 - DNA, 25 bp, Mus musculus
gctgggcttgcttcctgcctcaaga

SEQ ID NO: 944751 - DNA, 25 bp, Mus musculus
gctgggcttggttcctgcctcaaga

SEQ ID NO: 944752 - DNA, 25 bp, Mus musculus
gctgggcttgtgtcttccaaaatta

SEQ ID NO: 944753 - DNA, 25 bp, Mus musculus
gctggggaactgctcgttcctgagt

SEQ ID NO: 944754 - DNA, 25 bp, Mus musculus
gctggggaactgctggttcctgagt

SEQ ID NO: 944755 - DNA, 25 bp, Mus musculus
gctggggaaggacggagtcaccacc

SEQ ID NO: 944756 - DNA, 25 bp, Mus musculus
gctggggaaggagggagtcaccacc

SEQ ID NO: 944757 - DNA, 25 bp, Mus musculus
gctggggacgatcttcacctgcctt

SEQ ID NO: 944758 - DNA, 25 bp, Mus musculus
gctggggacgttcttcacctgcctt

SEQ ID NO: 944759 - DNA, 25 bp, Mus musculus
gctggggagaagtccgtctttctgt

SEQ ID NO: 944760 - DNA, 25 bp, Mus musculus
gctggggagaagtcggtctttctgt

SEQ ID NO: 944761 - DNA, 25 bp, Mus musculus
gctggggccttgctgttgggagccc

SEQ ID NO: 944762 - DNA, 25 bp, Mus musculus
gctggggccttggtgttgggagccc

SEQ ID NO: 944763 - DNA, 25 bp, Mus musculus
gctggggcgcatctggttggctggc

SEQ ID NO: 944764 - DNA, 25 bp, Mus musculus
gctggggcgcatgtggttggctggc

SEQ ID NO: 944765 - DNA, 25 bp, Mus musculus
gctggggctggtcaagctgggaagc

SEQ ID NO: 944766 - DNA, 25 bp, Mus musculus
gctggggctggtgaagctgggaagc

SEQ ID NO: 944767 - DNA, 25 bp, Mus musculus
gctggggtgcagaatttctgaagtg

SEQ ID NO: 944768 - DNA, 25 bp, Mus musculus
gctggggtgcagtatttctgaagtg

SEQ ID NO: 944769 - DNA, 25 bp, Mus musculus
gctggggtgtctccggctggattgc

SEQ ID NO: 944770 - DNA, 25 bp, Mus musculus
gctggggtgtctgcggctggattgc

SEQ ID NO: 944771 - DNA, 25 bp, Mus musculus
gctgggtctgaactttgtcttcctt

SEQ ID NO: 944772 - DNA, 25 bp, Mus musculus
gctgggtctgtactttgtcttcctt

SEQ ID NO: 944773 - DNA, 25 bp, Mus musculus
gctgggtgacctggcatggattcat

SEQ ID NO: 944774 - DNA, 25 bp, Mus musculus
gctgggtgacctgggatggattcat

SEQ ID NO: 944775 - DNA, 25 bp, Mus musculus
gctgggtgagcccggagccaaaggt

SEQ ID NO: 944776 - DNA, 25 bp, Mus musculus
gctgggtgagccgggagccaaaggt

SEQ ID NO: 944777 - DNA, 25 bp, Mus musculus
gctgggtttgcccgattatcacaaa

SEQ ID NO: 944778 - DNA, 25 bp, Mus musculus
gctgggtttgccggattatcacaaa

SEQ ID NO: 944779 - DNA, 25 bp, Mus musculus
gctggtacagcctgtgaaatttgaa

SEQ ID NO: 944780 - DNA, 25 bp, Mus musculus
gctggtacagcggctgtgaacaatg

SEQ ID NO: 944781 - DNA, 25 bp, Mus musculus
gctggtacaggctgtgaaatttgaa

SEQ ID NO: 944782 - DNA, 25 bp, Mus musculus
gctggtacaggggctgtgaacaatg

SEQ ID NO: 944783 - DNA, 25 bp, Mus musculus
gctggtcaagaacaccatgggtaca

SEQ ID NO: 944784 - DNA, 25 bp, Mus musculus
gctggtcaagaacagcatgggtaca

SEQ ID NO: 944785 - DNA, 25 bp, Mus musculus
gctggtcaagcgtctagagacatgt

SEQ ID NO: 944786 - DNA, 25 bp, Mus musculus
gctggtcaagctgtggaatctggct

SEQ ID NO: 944787 - DNA, 25 bp, Mus musculus
gctggtcaagggtctagagacatgt

SEQ ID NO: 944788 - DNA, 25 bp, Mus musculus
gctggtcaaggtgtggaatctggct

SEQ ID NO: 944789 - DNA, 25 bp, Mus musculus
gctggtcaatgacaaacctttgaag

SEQ ID NO: 944790 - DNA, 25 bp, Mus musculus
gctggtcaatgagaaacctttgaag

SEQ ID NO: 944791 - DNA, 25 bp, Mus musculus
gctggtcacagacatctttcagaaa

SEQ ID NO: 944792 - DNA, 25 bp, Mus musculus
gctggtcacagagatctttcagaaa

SEQ ID NO: 944793 - DNA, 25 bp, Mus musculus
gctggtcacgagctaaccatcttgg

SEQ ID NO: 944794 - DNA, 25 bp, Mus musculus
gctggtcacgagctcttctgatctc

SEQ ID NO: 944795 - DNA, 25 bp, Mus musculus
gctggtcacgaggtaaccatcttgg

SEQ ID NO: 944796 - DNA, 25 bp, Mus musculus
gctggtcacgaggtcttctgatctc

SEQ ID NO: 944797 - DNA, 25 bp, Mus musculus
gctggtcagccaaaaggtgttgtgt

SEQ ID NO: 944798 - DNA, 25 bp, Mus musculus
gctggtcagccaaaagtctttctgt

SEQ ID NO: 944799 - DNA, 25 bp, Mus musculus
gctggtcagccaaaatgaggatgcc

SEQ ID NO: 944800 - DNA, 25 bp, Mus musculus
gctggtcagccaaatggtgttgtgt

SEQ ID NO: 944801 - DNA, 25 bp, Mus musculus
gctggtcagccaaatgtctttctgt

SEQ ID NO: 944802 - DNA, 25 bp, Mus musculus
gctggtcagccaaattgaggatgcc

SEQ ID NO: 944803 - DNA, 25 bp, Mus musculus
gctggtccttcacggcttgtaccag

SEQ ID NO: 944804 - DNA, 25 bp, Mus musculus
gctggtccttcagggcttgtaccag

SEQ ID NO: 944805 - DNA, 25 bp, Mus musculus
gctggtgaagagctcgtatatccag

SEQ ID NO: 944806 - DNA, 25 bp, Mus musculus
gctggtgaagagctggtatatccag

SEQ ID NO: 944807 - DNA, 25 bp, Mus musculus
gctggtgaagatatgtaatccaaag

SEQ ID NO: 944808 - DNA, 25 bp, Mus musculus
gctggtgaagcttcaattgtgaata

SEQ ID NO: 944809 - DNA, 25 bp, Mus musculus
gctggtgaaggttcaattgtgaata

SEQ ID NO: 944810 - DNA, 25 bp, Mus musculus
gctggtgaagttatgtaatccaaag

SEQ ID NO: 944811 - DNA, 25 bp, Mus musculus
gctggtgagaagaacagcagtggtg

SEQ ID NO: 944812 - DNA, 25 bp, Mus musculus
gctggtgagaagtacagcagtggtg

SEQ ID NO: 944813 - DNA, 25 bp, Mus musculus
gctggtgcagccttatggagaattc

SEQ ID NO: 944814 - DNA, 25 bp, Mus musculus
gctggtgcaggcttatggagaattc

SEQ ID NO: 944815 - DNA, 25 bp, Mus musculus
gctggtgcggctgagcagcatccat

SEQ ID NO: 944816 - DNA, 25 bp, Mus musculus
gctggtgcgggtgagcagcatccat

SEQ ID NO: 944817 - DNA, 25 bp, Mus musculus
gctggtgctcagccattgcagctct

SEQ ID NO: 944818 - DNA, 25 bp, Mus musculus
gctggtgctcaggcattgcagctct

SEQ ID NO: 944819 - DNA, 25 bp, Mus musculus
gctggtgctccgaggaccctaatga

SEQ ID NO: 944820 - DNA, 25 bp, Mus musculus
gctggtgctccgccattgcagctct

SEQ ID NO: 944821 - DNA, 25 bp, Mus musculus
gctggtgctccggcattgcagctct

SEQ ID NO: 944822 - DNA, 25 bp, Mus musculus
gctggtgctccgtggaccctaatga

SEQ ID NO: 944823 - DNA, 25 bp, Mus musculus
gctggtggagaccaccatgattggg

SEQ ID NO: 944824 - DNA, 25 bp, Mus musculus
gctggtggagaccagcatgattggg

SEQ ID NO: 944825 - DNA, 25 bp, Mus musculus
gctggtggagaccccttgtccggat

SEQ ID NO: 944826 - DNA, 25 bp, Mus musculus
gctggtggagacgccttgtccggat

SEQ ID NO: 944827 - DNA, 25 bp, Mus musculus
gctggtggagagttctccagtttta

SEQ ID NO: 944828 - DNA, 25 bp, Mus musculus
gctggtggagcactacaccacagat

SEQ ID NO: 944829 - DNA, 25 bp, Mus musculus
gctggtggagcaggaagtgaacatc

SEQ ID NO: 944830 - DNA, 25 bp, Mus musculus
gctggtggagccatggctggaaaga

SEQ ID NO: 944831 - DNA, 25 bp, Mus musculus
gctggtggagcgtgtcaccgaaggc

SEQ ID NO: 944832 - DNA, 25 bp, Mus musculus
gctggtggagctcatcctctccagc

SEQ ID NO: 944833 - DNA, 25 bp, Mus musculus
gctggtggaggactacaccacagat

SEQ ID NO: 944834 - DNA, 25 bp, Mus musculus
gctggtggaggaggaagtgaacatc

SEQ ID NO: 944835 - DNA, 25 bp, Mus musculus
gctggtggaggcatggctggaaaga

SEQ ID NO: 944836 - DNA, 25 bp, Mus musculus
gctggtggagggtgtcaccgaaggc

SEQ ID NO: 944837 - DNA, 25 bp, Mus musculus
gctggtggaggtcatcctctccagc

SEQ ID NO: 944838 - DNA, 25 bp, Mus musculus
gctggtggagtgttctccagtttta

SEQ ID NO: 944839 - DNA, 25 bp, Mus musculus
gctggtgggcagccttcattctgac

SEQ ID NO: 944840 - DNA, 25 bp, Mus musculus
gctggtgggcagctgtgctgatgtc

SEQ ID NO: 944841 - DNA, 25 bp, Mus musculus
gctggtgggcaggcttcattctgac

SEQ ID NO: 944842 - DNA, 25 bp, Mus musculus
gctggtgggcaggtgtgctgatgtc

SEQ ID NO: 944843 - DNA, 25 bp, Mus musculus
gctggtggtcctggcgccatcagct

SEQ ID NO: 944844 - DNA, 25 bp, Mus musculus
gctggtggtcctggcgtacaatggt

SEQ ID NO: 944845 - DNA, 25 bp, Mus musculus
gctggtggtcctggggccatcagct

SEQ ID NO: 944846 - DNA, 25 bp, Mus musculus
gctggtggtcctggggtacaatggt

SEQ ID NO: 944847 - DNA, 25 bp, Mus musculus
gctggtggtgaactaaagcaccgag

SEQ ID NO: 944848 - DNA, 25 bp, Mus musculus
gctggtggtgaactatatcatgtat

SEQ ID NO: 944849 - DNA, 25 bp, Mus musculus
gctggtggtgaactgctgtatcttg

SEQ ID NO: 944850 - DNA, 25 bp, Mus musculus
gctggtggtgaagtaaagcaccgag

SEQ ID NO: 944851 - DNA, 25 bp, Mus musculus
gctggtggtgaagtatatcatgtat

SEQ ID NO: 944852 - DNA, 25 bp, Mus musculus
gctggtggtgaagtgctgtatcttg

SEQ ID NO: 944853 - DNA, 25 bp, Mus musculus
gctggtgtccgacatgcatgctgtt

SEQ ID NO: 944854 - DNA, 25 bp, Mus musculus
gctggtgtccgacgtcttcagatta

SEQ ID NO: 944855 - DNA, 25 bp, Mus musculus
gctggtgtccgactgtcctgcaggt

SEQ ID NO: 944856 - DNA, 25 bp, Mus musculus
gctggtgtccgagatgcatgctgtt

SEQ ID NO: 944857 - DNA, 25 bp, Mus musculus
gctggtgtccgaggtcttcagatta

SEQ ID NO: 944858 - DNA, 25 bp, Mus musculus
gctggtgtccgagtgtcctgcaggt

SEQ ID NO: 944859 - DNA, 25 bp, Mus musculus
gctggtgtcctacgccacagaagga

SEQ ID NO: 944860 - DNA, 25 bp, Mus musculus
gctggtgtcctaggccacagaagga

SEQ ID NO: 944861 - DNA, 25 bp, Mus musculus
gctggtgtggagattgaagaaaaat

SEQ ID NO: 944862 - DNA, 25 bp, Mus musculus
gctggtgtggagtttgaagaaaaat

SEQ ID NO: 944863 - DNA, 25 bp, Mus musculus
gctggttacaaaaacttgttcgcag

SEQ ID NO: 944864 - DNA, 25 bp, Mus musculus
gctggttacaaaaagttgttcgcag

SEQ ID NO: 944865 - DNA, 25 bp, Mus musculus
gctggttcagatcacgtctaatatg

SEQ ID NO: 944866 - DNA, 25 bp, Mus musculus
gctggttcagttcacgtctaatatg

SEQ ID NO: 944867 - DNA, 25 bp, Mus musculus
gctggttgagcccttgagtgccacc

SEQ ID NO: 944868 - DNA, 25 bp, Mus musculus
gctggttgaggccttgagtgccacc

SEQ ID NO: 944869 - DNA, 25 bp, Mus musculus
gctggtttatttacaccaagctgga

SEQ ID NO: 944870 - DNA, 25 bp, Mus musculus
gctggtttattttcaccaagctgga

SEQ ID NO: 944871 - DNA, 25 bp, Mus musculus
gctggtttcagacgaggcctttccc

SEQ ID NO: 944872 - DNA, 25 bp, Mus musculus
gctggtttcagaggaggcctttccc

SEQ ID NO: 944873 - DNA, 25 bp, Mus musculus
gctggtttcccgcgtatgcatggac

SEQ ID NO: 944874 - DNA, 25 bp, Mus musculus
gctggtttcccgggtatgcatggac

SEQ ID NO: 944875 - DNA, 25 bp, Mus musculus
gctgtaatgaagcaaaatatctgca

SEQ ID NO: 944876 - DNA, 25 bp, Mus musculus
gctgtaatgaaggaaaatatctgca

SEQ ID NO: 944877 - DNA, 25 bp, Mus musculus
gctgtaccacaacgctggacacttt

SEQ ID NO: 944878 - DNA, 25 bp, Mus musculus
gctgtaccacaaggctggacacttt

SEQ ID NO: 944879 - DNA, 25 bp, Mus musculus
gctgtaccagcgaacggagaagcca

SEQ ID NO: 944880 - DNA, 25 bp, Mus musculus
gctgtaccagggaacggagaagcca

SEQ ID NO: 944881 - DNA, 25 bp, Mus musculus
gctgtaccggccagtgcagtctgtg

SEQ ID NO: 944882 - DNA, 25 bp, Mus musculus
gctgtaccgggcagtgcagtctgtg

SEQ ID NO: 944883 - DNA, 25 bp, Mus musculus
gctgtacctaccagtgagaggtcgt

SEQ ID NO: 944884 - DNA, 25 bp, Mus musculus
gctgtacctacctgtgagaggtcgt

SEQ ID NO: 944885 - DNA, 25 bp, Mus musculus
gctgtacgagcctccagcataccat

SEQ ID NO: 944886 - DNA, 25 bp, Mus musculus
gctgtacgaggctccagcataccat

SEQ ID NO: 944887 - DNA, 25 bp, Mus musculus
gctgtacggccgcaccaccatggca

SEQ ID NO: 944888 - DNA, 25 bp, Mus musculus
gctgtacggccgcagcaccatggca

SEQ ID NO: 944889 - DNA, 25 bp, Mus musculus
gctgtactcaagcagaatctgggag

SEQ ID NO: 944890 - DNA, 25 bp, Mus musculus
gctgtactcaaggagaatctgggag

SEQ ID NO: 944891 - DNA, 25 bp, Mus musculus
gctgtagctaaacgagttcatactg

SEQ ID NO: 944892 - DNA, 25 bp, Mus musculus
gctgtagctaaaggagttcatactg

SEQ ID NO: 944893 - DNA, 25 bp, Mus musculus
gctgtagtgaaacgtgccgaggatg

SEQ ID NO: 944894 - DNA, 25 bp, Mus musculus
gctgtagtgaaaggtgccgaggatg

SEQ ID NO: 944895 - DNA, 25 bp, Mus musculus
gctgtataagctacatttgaagaat

SEQ ID NO: 944896 - DNA, 25 bp, Mus musculus
gctgtataaggtacatttgaagaat

SEQ ID NO: 944897 - DNA, 25 bp, Mus musculus
gctgtatacccgtcagctgctggaa

SEQ ID NO: 944898 - DNA, 25 bp, Mus musculus
gctgtataccctggtcagcctgctg

SEQ ID NO: 944899 - DNA, 25 bp, Mus musculus
gctgtataccggtcagctgctggaa

SEQ ID NO: 944900 - DNA, 25 bp, Mus musculus
gctgtataccgtggtcagcctgctg

SEQ ID NO: 944901 - DNA, 25 bp, Mus musculus
gctgtatctggtcctctaccttcag

SEQ ID NO: 944902 - DNA, 25 bp, Mus musculus
gctgtatctggtgctctaccttcag

SEQ ID NO: 944903 - DNA, 25 bp, Mus musculus
gctgtatgagatggcagctctccag

SEQ ID NO: 944904 - DNA, 25 bp, Mus musculus
gctgtatgagcaagtaaagctctac

SEQ ID NO: 944905 - DNA, 25 bp, Mus musculus
gctgtatgagcacaaccacgaggaa

SEQ ID NO: 944906 - DNA, 25 bp, Mus musculus
gctgtatgaggaagtaaagctctac

SEQ ID NO: 944907 - DNA, 25 bp, Mus musculus
gctgtatgaggacaaccacgaggaa

SEQ ID NO: 944908 - DNA, 25 bp, Mus musculus
gctgtatgagttggcagctctccag

SEQ ID NO: 944909 - DNA, 25 bp, Mus musculus
gctgtatggaaacatggcctctgca

SEQ ID NO: 944910 - DNA, 25 bp, Mus musculus
gctgtatggaaagatggcctctgca

SEQ ID NO: 944911 - DNA, 25 bp, Mus musculus
gctgtatggatcagaaaaactaaca

SEQ ID NO: 944912 - DNA, 25 bp, Mus musculus
gctgtatggatctgaaaaactaaca

SEQ ID NO: 944913 - DNA, 25 bp, Mus musculus
gctgtatgtgcacagccccgaggcc

SEQ ID NO: 944914 - DNA, 25 bp, Mus musculus
gctgtatgtgcacggatgacgactc

SEQ ID NO: 944915 - DNA, 25 bp, Mus musculus
gctgtatgtgcagcacagccccgag

SEQ ID NO: 944916 - DNA, 25 bp, Mus musculus
gctgtatgtggacagccccgaggcc

SEQ ID NO: 944917 - DNA, 25 bp, Mus musculus
gctgtatgtggacggatgacgactc

SEQ ID NO: 944918 - DNA, 25 bp, Mus musculus
gctgtatgtggagcacagccccgag

SEQ ID NO: 944919 - DNA, 25 bp, Mus musculus
gctgtatttgccaaatgtggtccac

SEQ ID NO: 944920 - DNA, 25 bp, Mus musculus
gctgtatttggcaaatgtggtccac

SEQ ID NO: 944921 - DNA, 25 bp, Mus musculus
gctgtcaaaaagctacgactcgagg

SEQ ID NO: 944922 - DNA, 25 bp, Mus musculus
gctgtcaaaaaggtacgactcgagg

SEQ ID NO: 944923 - DNA, 25 bp, Mus musculus
gctgtcaaacttcacagtgaatgcc

SEQ ID NO: 944924 - DNA, 25 bp, Mus musculus
gctgtcaaacttcagagtgaatgcc

SEQ ID NO: 944925 - DNA, 25 bp, Mus musculus
gctgtcaagaacaacgcccagtctg

SEQ ID NO: 944926 - DNA, 25 bp, Mus musculus
gctgtcaagaacaaggcccagtctg

SEQ ID NO: 944927 - DNA, 25 bp, Mus musculus
gctgtcaccaacattaccacagcat

SEQ ID NO: 944928 - DNA, 25 bp, Mus musculus
gctgtcaccaagcaccccaactggt

SEQ ID NO: 944929 - DNA, 25 bp, Mus musculus
gctgtcaccaaggaccccaactggt

SEQ ID NO: 944930 - DNA, 25 bp, Mus musculus
gctgtcaccatcattaccacagcat

SEQ ID NO: 944931 - DNA, 25 bp, Mus musculus
gctgtcactgcggtcactttcctgt

SEQ ID NO: 944932 - DNA, 25 bp, Mus musculus
gctgtcactgctgctcctggctctg

SEQ ID NO: 944933 - DNA, 25 bp, Mus musculus
gctgtcactggggtcactttcctgt

SEQ ID NO: 944934 - DNA, 25 bp, Mus musculus
gctgtcactggtgctcctggctctg

SEQ ID NO: 944935 - DNA, 25 bp, Mus musculus
gctgtcagagactatgaaatccctg

SEQ ID NO: 944936 - DNA, 25 bp, Mus musculus
gctgtcagagctcctgctgtgagtg

SEQ ID NO: 944937 - DNA, 25 bp, Mus musculus
gctgtcagagctgctgctgtgagtg

SEQ ID NO: 944938 - DNA, 25 bp, Mus musculus
gctgtcagagtctatgaaatccctg

SEQ ID NO: 944939 - DNA, 25 bp, Mus musculus
gctgtcagtcatcttttctttcaac

SEQ ID NO: 944940 - DNA, 25 bp, Mus musculus
gctgtcagtcatgttttctttcaac

SEQ ID NO: 944941 - DNA, 25 bp, Mus musculus
gctgtcatcaagctaaccccaagga

SEQ ID NO: 944942 - DNA, 25 bp, Mus musculus
gctgtcatcaaggtaaccccaagga

SEQ ID NO: 944943 - DNA, 25 bp, Mus musculus
gctgtcatggcaggcactggggagc

SEQ ID NO: 944944 - DNA, 25 bp, Mus musculus
gctgtcatggccactggggagccca

SEQ ID NO: 944945 - DNA, 25 bp, Mus musculus
gctgtcatgggaggcactggggagc

SEQ ID NO: 944946 - DNA, 25 bp, Mus musculus
gctgtcatgggcactggggagccca

SEQ ID NO: 944947 - DNA, 25 bp, Mus musculus
gctgtcattatgatctttgagatga

SEQ ID NO: 944948 - DNA, 25 bp, Mus musculus
gctgtcattatgttctttgagatga

SEQ ID NO: 944949 - DNA, 25 bp, Mus musculus
gctgtcattgagctgctggggttgt

SEQ ID NO: 944950 - DNA, 25 bp, Mus musculus
gctgtcattgaggtgctggggttgt

SEQ ID NO: 944951 - DNA, 25 bp, Mus musculus
gctgtcattgcggcggatgtggtgg

SEQ ID NO: 944952 - DNA, 25 bp, Mus musculus
gctgtcattggggcggatgtggtgg

SEQ ID NO: 944953 - DNA, 25 bp, Mus musculus
gctgtccagaagctggggcttatgg

SEQ ID NO: 944954 - DNA, 25 bp, Mus musculus
gctgtccagaaggtggggcttatgg

SEQ ID NO: 944955 - DNA, 25 bp, Mus musculus
gctgtccagactctaaggtgcctgg

SEQ ID NO: 944956 - DNA, 25 bp, Mus musculus
gctgtccagactgtaaggtgcctgg

SEQ ID NO: 944957 - DNA, 25 bp, Mus musculus
gctgtccaggctcttcaaagcttca

SEQ ID NO: 944958 - DNA, 25 bp, Mus musculus
gctgtccagggtcttcaaagcttca

SEQ ID NO: 944959 - DNA, 25 bp, Mus musculus
gctgtcccagctgctcctggtcacg

SEQ ID NO: 944960 - DNA, 25 bp, Mus musculus
gctgtcccaggtgctcctggtcacg

SEQ ID NO: 944961 - DNA, 25 bp, Mus musculus
gctgtcccccagccgagtttgtctt

SEQ ID NO: 944962 - DNA, 25 bp, Mus musculus
gctgtcccccaggcgagtttgtctt

SEQ ID NO: 944963 - DNA, 25 bp, Mus musculus
gctgtccgagagaacacacagctgg

SEQ ID NO: 944964 - DNA, 25 bp, Mus musculus
gctgtccgagagaacaccaccaagg

SEQ ID NO: 944965 - DNA, 25 bp, Mus musculus
gctgtccgagagaacgtgggtgaca

SEQ ID NO: 944966 - DNA, 25 bp, Mus musculus
gctgtccgagagaagacacagctgg

SEQ ID NO: 944967 - DNA, 25 bp, Mus musculus
gctgtccgagagaagaccaccaagg

SEQ ID NO: 944968 - DNA, 25 bp, Mus musculus
gctgtccgagagaaggtgggtgaca

SEQ ID NO: 944969 - DNA, 25 bp, Mus musculus
gctgtccgagctctccactcccacc

SEQ ID NO: 944970 - DNA, 25 bp, Mus musculus
gctgtccgagctgtccactcccacc

SEQ ID NO: 944971 - DNA, 25 bp, Mus musculus
gctgtccttcctcgtgactctgaac

SEQ ID NO: 944972 - DNA, 25 bp, Mus musculus
gctgtccttcctggtgactctgaac

SEQ ID NO: 944973 - DNA, 25 bp, Mus musculus
gctgtcggccaagcccgcccctgcc

SEQ ID NO: 944974 - DNA, 25 bp, Mus musculus
gctgtcggcctagcccgcccctgcc

SEQ ID NO: 944975 - DNA, 25 bp, Mus musculus
gctgtctacaagcatggccgggccg

SEQ ID NO: 944976 - DNA, 25 bp, Mus musculus
gctgtctacaaggatggccgggccg

SEQ ID NO: 944977 - DNA, 25 bp, Mus musculus
gctgtctacgagaccctgaagaatc

SEQ ID NO: 944978 - DNA, 25 bp, Mus musculus
gctgtctacgagtccctgaagaatc

SEQ ID NO: 944979 - DNA, 25 bp, Mus musculus
gctgtctactgcaacggaccttcta

SEQ ID NO: 944980 - DNA, 25 bp, Mus musculus
gctgtctactgcaagggaccttcta

SEQ ID NO: 944981 - DNA, 25 bp, Mus musculus
gctgtctcaagagaagattctcagc

SEQ ID NO: 944982 - DNA, 25 bp, Mus musculus
gctgtctcaagagatgattctcagc

SEQ ID NO: 944983 - DNA, 25 bp, Mus musculus
gctgtctcagatcttcaacttttct

SEQ ID NO: 944984 - DNA, 25 bp, Mus musculus
gctgtctcagttcttcaacttttct

SEQ ID NO: 944985 - DNA, 25 bp, Mus musculus
gctgtctctaaacaccttttagaac

SEQ ID NO: 944986 - DNA, 25 bp, Mus musculus
gctgtctctaaacagcttttagaac

SEQ ID NO: 944987 - DNA, 25 bp, Mus musculus
gctgtctctaggcgtgacccagata

SEQ ID NO: 944988 - DNA, 25 bp, Mus musculus
gctgtctctaggggtgacccagata

SEQ ID NO: 944989 - DNA, 25 bp, Mus musculus
gctgtctctgaagactaccttgacc

SEQ ID NO: 944990 - DNA, 25 bp, Mus musculus
gctgtctctgaagagtaccttgacc

SEQ ID NO: 944991 - DNA, 25 bp, Mus musculus
gctgtctgcatgtgccctggccagg

SEQ ID NO: 944992 - DNA, 25 bp, Mus musculus
gctgtctgcatgtggcctggccagg

SEQ ID NO: 944993 - DNA, 25 bp, Mus musculus
gctgtctgcccaccagccctatccg

SEQ ID NO: 944994 - DNA, 25 bp, Mus musculus
gctgtctgcccacccctatccggat

SEQ ID NO: 944995 - DNA, 25 bp, Mus musculus
gctgtctgcccagcagccctatccg

SEQ ID NO: 944996 - DNA, 25 bp, Mus musculus
gctgtctgcccagccctatccggat

SEQ ID NO: 944997 - DNA, 25 bp, Mus musculus
gctgtctgtgagccatggcatgggc

SEQ ID NO: 944998 - DNA, 25 bp, Mus musculus
gctgtctgtgaggcatggcatgggc

SEQ ID NO: 944999 - DNA, 25 bp, Mus musculus
gctgtcttgcagctggaatgccatc

SEQ ID NO: 945000 - DNA, 25 bp, Mus musculus
gctgtcttgcaggacgcacgcatat

SEQ ID NO: 945001 - DNA, 25 bp, Mus musculus
gctgtcttgcaggaggcacgcatat

SEQ ID NO: 945002 - DNA, 25 bp, Mus musculus
gctgtcttgcaggtggaatgccatc

SEQ ID NO: 945003 - DNA, 25 bp, Mus musculus
gctgtcttggaagactgcacatcct

SEQ ID NO: 945004 - DNA, 25 bp, Mus musculus
gctgtcttggaagagtgcacatcct

SEQ ID NO: 945005 - DNA, 25 bp, Mus musculus
gctgtctttacactatgtaggccat

SEQ ID NO: 945006 - DNA, 25 bp, Mus musculus
gctgtctttacagtatgtaggccat

SEQ ID NO: 945007 - DNA, 25 bp, Mus musculus
gctgtgaaagccgtgttggaacaag

SEQ ID NO: 945008 - DNA, 25 bp, Mus musculus
gctgtgaaaggcgtgttggaacaag

SEQ ID NO: 945009 - DNA, 25 bp, Mus musculus
gctgtgaaatcttctattccaagga

SEQ ID NO: 945010 - DNA, 25 bp, Mus musculus
gctgtgaaatgttctattccaagga

SEQ ID NO: 945011 - DNA, 25 bp, Mus musculus
gctgtgaagatccactacccaggtg

SEQ ID NO: 945012 - DNA, 25 bp, Mus musculus
gctgtgaagatccagtacccaggtg

SEQ ID NO: 945013 - DNA, 25 bp, Mus musculus
gctgtgaatctgattcccatgctga

SEQ ID NO: 945014 - DNA, 25 bp, Mus musculus
gctgtgaatctgtttcccatgctga

SEQ ID NO: 945015 - DNA, 25 bp, Mus musculus
gctgtgaatgaaataatagctactc

SEQ ID NO: 945016 - DNA, 25 bp, Mus musculus
gctgtgaatgaattaatagctactc

SEQ ID NO: 945017 - DNA, 25 bp, Mus musculus
gctgtgacaattaacattgatcctg

SEQ ID NO: 945018 - DNA, 25 bp, Mus musculus
gctgtgacaattaagattgatcctg

SEQ ID NO: 945019 - DNA, 25 bp, Mus musculus
gctgtgacagatctgagcactgagg

SEQ ID NO: 945020 - DNA, 25 bp, Mus musculus
gctgtgacagcacctccgtccgagg

SEQ ID NO: 945021 - DNA, 25 bp, Mus musculus
gctgtgacaggacctccgtccgagg

SEQ ID NO: 945022 - DNA, 25 bp, Mus musculus
gctgtgacagttctgagcactgagg

SEQ ID NO: 945023 - DNA, 25 bp, Mus musculus
gctgtgacatggatcgctcccgtca

SEQ ID NO: 945024 - DNA, 25 bp, Mus musculus
gctgtgacatggatggctcccgtca

SEQ ID NO: 945025 - DNA, 25 bp, Mus musculus
gctgtgaccatagacccgcaaacag

SEQ ID NO: 945026 - DNA, 25 bp, Mus musculus
gctgtgaccatagagccgcaaacag

SEQ ID NO: 945027 - DNA, 25 bp, Mus musculus
gctgtgaccgagatcaagatccact

SEQ ID NO: 945028 - DNA, 25 bp, Mus musculus
gctgtgaccgagcttgaacatttca

SEQ ID NO: 945029 - DNA, 25 bp, Mus musculus
gctgtgaccgaggttgaacatttca

SEQ ID NO: 945030 - DNA, 25 bp, Mus musculus
gctgtgaccgagttcaagatccact

SEQ ID NO: 945031 - DNA, 25 bp, Mus musculus
gctgtgacgaggccaatgctgctgc

SEQ ID NO: 945032 - DNA, 25 bp, Mus musculus
gctgtgacgagggcaatgctgctgc

SEQ ID NO: 945033 - DNA, 25 bp, Mus musculus
gctgtgagacagacattgacgagtg

SEQ ID NO: 945034 - DNA, 25 bp, Mus musculus
gctgtgagacagactcttcctgagt

SEQ ID NO: 945035 - DNA, 25 bp, Mus musculus
gctgtgagacagtcattgacgagtg

SEQ ID NO: 945036 - DNA, 25 bp, Mus musculus
gctgtgagacagtctcttcctgagt

SEQ ID NO: 945037 - DNA, 25 bp, Mus musculus
gctgtgagacctcgcggctccacat

SEQ ID NO: 945038 - DNA, 25 bp, Mus musculus
gctgtgagacctggcggctccacat

SEQ ID NO: 945039 - DNA, 25 bp, Mus musculus
gctgtgagcccacactcgtcccagc

SEQ ID NO: 945040 - DNA, 25 bp, Mus musculus
gctgtgagcccagactcgtcccagc

SEQ ID NO: 945041 - DNA, 25 bp, Mus musculus
gctgtgagccggagatctctgggct

SEQ ID NO: 945042 - DNA, 25 bp, Mus musculus
gctgtgagccggtgatctctgggct

SEQ ID NO: 945043 - DNA, 25 bp, Mus musculus
gctgtgagctttgacgatttcatca

SEQ ID NO: 945044 - DNA, 25 bp, Mus musculus
gctgtgagctttgaggatttcatca

SEQ ID NO: 945045 - DNA, 25 bp, Mus musculus
gctgtgattgtcaacgatcagctgt

SEQ ID NO: 945046 - DNA, 25 bp, Mus musculus
gctgtgattgtcaaggatcagctgt

SEQ ID NO: 945047 - DNA, 25 bp, Mus musculus
gctgtgcacattcacatacggtgga

SEQ ID NO: 945048 - DNA, 25 bp, Mus musculus
gctgtgcacattcaccagatacggt

SEQ ID NO: 945049 - DNA, 25 bp, Mus musculus
gctgtgcacattcacgagtgtgttc

SEQ ID NO: 945050 - DNA, 25 bp, Mus musculus
gctgtgcacattcagatacggtgga

SEQ ID NO: 945051 - DNA, 25 bp, Mus musculus
gctgtgcacattcagcagatacggt

SEQ ID NO: 945052 - DNA, 25 bp, Mus musculus
gctgtgcacattcaggagtgtgttc

SEQ ID NO: 945053 - DNA, 25 bp, Mus musculus
gctgtgcagacaccccctgcaggaa

SEQ ID NO: 945054 - DNA, 25 bp, Mus musculus
gctgtgcagacagcccctgcaggaa

SEQ ID NO: 945055 - DNA, 25 bp, Mus musculus
gctgtgccagcagtggaggggaaag

SEQ ID NO: 945056 - DNA, 25 bp, Mus musculus
gctgtgccaggagtggaggggaaag

SEQ ID NO: 945057 - DNA, 25 bp, Mus musculus
gctgtgcccagtagtaacacagcat

SEQ ID NO: 945058 - DNA, 25 bp, Mus musculus
gctgtgcccagttgtaacacagcat

SEQ ID NO: 945059 - DNA, 25 bp, Mus musculus
gctgtgccctgctgcgtggggagac

SEQ ID NO: 945060 - DNA, 25 bp, Mus musculus
gctgtgccctgctgggtggggagac

SEQ ID NO: 945061 - DNA, 25 bp, Mus musculus
gctgtgcctcagcgcttagtcaaag

SEQ ID NO: 945062 - DNA, 25 bp, Mus musculus
gctgtgcctcagggcttagtcaaag

SEQ ID NO: 945063 - DNA, 25 bp, Mus musculus
gctgtgcctgtcctcgttgttcctc

SEQ ID NO: 945064 - DNA, 25 bp, Mus musculus
gctgtgcctgtcctggttgttcctc

SEQ ID NO: 945065 - DNA, 25 bp, Mus musculus
gctgtgctaccttacgatcgagcgg

SEQ ID NO: 945066 - DNA, 25 bp, Mus musculus
gctgtgctaccttaggatcgagcgg

SEQ ID NO: 945067 - DNA, 25 bp, Mus musculus
gctgtgctgaagcgcatcctggagg

SEQ ID NO: 945068 - DNA, 25 bp, Mus musculus
gctgtgctgaagggcatcctggagg

SEQ ID NO: 945069 - DNA, 25 bp, Mus musculus
gctgtggaaatgggcaacttctgtg

SEQ ID NO: 945070 - DNA, 25 bp, Mus musculus
gctgtggaaatgggccactttctgc

SEQ ID NO: 945071 - DNA, 25 bp, Mus musculus
gctgtggaaatggggaacttctgtg

SEQ ID NO: 945072 - DNA, 25 bp, Mus musculus
gctgtggaaatggggcactttctgc

SEQ ID NO: 945073 - DNA, 25 bp, Mus musculus
gctgtggaagcgactccccggagga

SEQ ID NO: 945074 - DNA, 25 bp, Mus musculus
gctgtggaagggactccccggagga

SEQ ID NO: 945075 - DNA, 25 bp, Mus musculus
gctgtggaccagaacctgatactac

SEQ ID NO: 945076 - DNA, 25 bp, Mus musculus
gctgtggaccagtacctgatactac

SEQ ID NO: 945077 - DNA, 25 bp, Mus musculus
gctgtggagaatcatgacttgcaga

SEQ ID NO: 945078 - DNA, 25 bp, Mus musculus
gctgtggagattcatgacttgcaga

SEQ ID NO: 945079 - DNA, 25 bp, Mus musculus
gctgtggaggctgtcgttgaatgta

SEQ ID NO: 945080 - DNA, 25 bp, Mus musculus
gctgtggaggctgtggttgaatgta

SEQ ID NO: 945081 - DNA, 25 bp, Mus musculus
gctgtggagggacaccaactgcttt

SEQ ID NO: 945082 - DNA, 25 bp, Mus musculus
gctgtggagggacactgacaggttt

SEQ ID NO: 945083 - DNA, 25 bp, Mus musculus
gctgtggagggacagcaactgcttt

SEQ ID NO: 945084 - DNA, 25 bp, Mus musculus
gctgtggagggacagtgacaggttt

SEQ ID NO: 945085 - DNA, 25 bp, Mus musculus
gctgtggatgcccccagaagtaatc

SEQ ID NO: 945086 - DNA, 25 bp, Mus musculus
gctgtggatggccccagaagtaatc

SEQ ID NO: 945087 - DNA, 25 bp, Mus musculus
gctgtggcacacatcactcaactgc

SEQ ID NO: 945088 - DNA, 25 bp, Mus musculus
gctgtggcacacttcactcaactgc

SEQ ID NO: 945089 - DNA, 25 bp, Mus musculus
gctgtggcactgcgcctagcgaccg

SEQ ID NO: 945090 - DNA, 25 bp, Mus musculus
gctgtggcactgggcctagcgaccg

SEQ ID NO: 945091 - DNA, 25 bp, Mus musculus
gctgtggcagaacaagccacgctat

SEQ ID NO: 945092 - DNA, 25 bp, Mus musculus
gctgtggcagaagaagccacgctat

SEQ ID NO: 945093 - DNA, 25 bp, Mus musculus
gctgtgggacacaaagcacctggag

SEQ ID NO: 945094 - DNA, 25 bp, Mus musculus
gctgtgggacacacacctggaggag

SEQ ID NO: 945095 - DNA, 25 bp, Mus musculus
gctgtgggacactaagcacctggag

SEQ ID NO: 945096 - DNA, 25 bp, Mus musculus
gctgtgggacactcacctggaggag

SEQ ID NO: 945097 - DNA, 25 bp, Mus musculus
gctgtggtctttctcgacgagccca

SEQ ID NO: 945098 - DNA, 25 bp, Mus musculus
gctgtggtctttctggacgagccca

SEQ ID NO: 945099 - DNA, 25 bp, Mus musculus
gctgtggtggaagacgagacaagtt

SEQ ID NO: 945100 - DNA, 25 bp, Mus musculus
gctgtggtggaagaggagacaagtt

SEQ ID NO: 945101 - DNA, 25 bp, Mus musculus
gctgtgtacggacaagtgcacctgg

SEQ ID NO: 945102 - DNA, 25 bp, Mus musculus
gctgtgtacggacatgtgcacctgg

SEQ ID NO: 945103 - DNA, 25 bp, Mus musculus
gctgtgtcctgacgatctttccaac

SEQ ID NO: 945104 - DNA, 25 bp, Mus musculus
gctgtgtcctgactatcccaggcgc

SEQ ID NO: 945105 - DNA, 25 bp, Mus musculus
gctgtgtcctgaggatctttccaac

SEQ ID NO: 945106 - DNA, 25 bp, Mus musculus
gctgtgtcctgagtatcccaggcgc

SEQ ID NO: 945107 - DNA, 25 bp, Mus musculus
gctgtgtgcccacgccagtatggaa

SEQ ID NO: 945108 - DNA, 25 bp, Mus musculus
gctgtgtgcccaggccagtatggaa

SEQ ID NO: 945109 - DNA, 25 bp, Mus musculus
gctgtgtgcctcagtgctaggttta

SEQ ID NO: 945110 - DNA, 25 bp, Mus musculus
gctgtgtgcctctgtgctaggttta

SEQ ID NO: 945111 - DNA, 25 bp, Mus musculus
gctgtgtgcgctctgttcctgcgcc

SEQ ID NO: 945112 - DNA, 25 bp, Mus musculus
gctgtgtgcggtctgttcctgcgcc

SEQ ID NO: 945113 - DNA, 25 bp, Mus musculus
gctgtgttatctttttctactcgtc

SEQ ID NO: 945114 - DNA, 25 bp, Mus musculus
gctgtgttatgtttttctactcgtc

SEQ ID NO: 945115 - DNA, 25 bp, Mus musculus
gctgttactaaacgatgactatgaa

SEQ ID NO: 945116 - DNA, 25 bp, Mus musculus
gctgttactaaaggatgactatgaa

SEQ ID NO: 945117 - DNA, 25 bp, Mus musculus
gctgttatgattagtgcaattgaga

SEQ ID NO: 945118 - DNA, 25 bp, Mus musculus
gctgttatgatttgtgcaattgaga

SEQ ID NO: 945119 - DNA, 25 bp, Mus musculus
gctgttattctggactccccaccca

SEQ ID NO: 945120 - DNA, 25 bp, Mus musculus
gctgttattctggagtccccaccca

SEQ ID NO: 945121 - DNA, 25 bp, Mus musculus
gctgttcagactaggtggcgatgtc

SEQ ID NO: 945122 - DNA, 25 bp, Mus musculus
gctgttcagagtaggtggcgatgtc

SEQ ID NO: 945123 - DNA, 25 bp, Mus musculus
gctgttcagcagaatattcaacaga

SEQ ID NO: 945124 - DNA, 25 bp, Mus musculus
gctgttcagcagtatattcaacaga

SEQ ID NO: 945125 - DNA, 25 bp, Mus musculus
gctgttcagtcagaagatgactcag

SEQ ID NO: 945126 - DNA, 25 bp, Mus musculus
gctgttcagtcagatgatgactcag

SEQ ID NO: 945127 - DNA, 25 bp, Mus musculus
gctgttcgcgaacaatcgagatccg

SEQ ID NO: 945128 - DNA, 25 bp, Mus musculus
gctgttcgcgaactgcgtccccacg

SEQ ID NO: 945129 - DNA, 25 bp, Mus musculus
gctgttcgcgaagaatcgagatccg

SEQ ID NO: 945130 - DNA, 25 bp, Mus musculus
gctgttcgcgaagtgcgtccccacg

SEQ ID NO: 945131 - DNA, 25 bp, Mus musculus
gctgttctattggtcgaatccatga

SEQ ID NO: 945132 - DNA, 25 bp, Mus musculus
gctgttctattggtggaatccatga

SEQ ID NO: 945133 - DNA, 25 bp, Mus musculus
gctgttctgtatccttcctgcgggc

SEQ ID NO: 945134 - DNA, 25 bp, Mus musculus
gctgttctgtatgcttcctgcgggc

SEQ ID NO: 945135 - DNA, 25 bp, Mus musculus
gctgttctttatcctgggtgctgtg

SEQ ID NO: 945136 - DNA, 25 bp, Mus musculus
gctgttctttttcctgggtgctgtg

SEQ ID NO: 945137 - DNA, 25 bp, Mus musculus
gctgttgccaaattcgctccactta

SEQ ID NO: 945138 - DNA, 25 bp, Mus musculus
gctgttgccaaattggctccactta

SEQ ID NO: 945139 - DNA, 25 bp, Mus musculus
gctgttgccgtgacctttgcagatc

SEQ ID NO: 945140 - DNA, 25 bp, Mus musculus
gctgttgccgtgtcctttgcagatc

SEQ ID NO: 945141 - DNA, 25 bp, Mus musculus
gctgttgcgacaaggtcaaggagat

SEQ ID NO: 945142 - DNA, 25 bp, Mus musculus
gctgttgcgacatggtcaaggagat

SEQ ID NO: 945143 - DNA, 25 bp, Mus musculus
gctgttggagcaactgtactgagtg

SEQ ID NO: 945144 - DNA, 25 bp, Mus musculus
gctgttggaggaactgtactgagtg

SEQ ID NO: 945145 - DNA, 25 bp, Mus musculus
gctgttggtggcaccgatggcaatg

SEQ ID NO: 945146 - DNA, 25 bp, Mus musculus
gctgttggtggcacggatggcaatg

SEQ ID NO: 945147 - DNA, 25 bp, Mus musculus
gctgtttgatatcctgacagtggaa

SEQ ID NO: 945148 - DNA, 25 bp, Mus musculus
gctgtttgatatgctgacagtggaa

SEQ ID NO: 945149 - DNA, 25 bp, Mus musculus
gctgtttgatgacggccgcctgaca

SEQ ID NO: 945150 - DNA, 25 bp, Mus musculus
gctgtttgatgagggccgcctgaca

SEQ ID NO: 945151 - DNA, 25 bp, Mus musculus
gctgtttgcaagaatgcatcttaac

SEQ ID NO: 945152 - DNA, 25 bp, Mus musculus
gctgtttgcaagctatccattatga

SEQ ID NO: 945153 - DNA, 25 bp, Mus musculus
gctgtttgcaaggtatccattatga

SEQ ID NO: 945154 - DNA, 25 bp, Mus musculus
gctgtttgcaagtatgcatcttaac

SEQ ID NO: 945155 - DNA, 25 bp, Mus musculus
gctgtttgtcgcactttatcttcaa

SEQ ID NO: 945156 - DNA, 25 bp, Mus musculus
gctgtttgtcgctctttatcttcaa

SEQ ID NO: 945157 - DNA, 25 bp, Mus musculus
gctgttttcacacgaactggtgact

SEQ ID NO: 945158 - DNA, 25 bp, Mus musculus
gctgttttcacaggaactggtgact

SEQ ID NO: 945159 - DNA, 25 bp, Mus musculus
gctgttttggcttgcatgagactcg

SEQ ID NO: 945160 - DNA, 25 bp, Mus musculus
gctgttttgggttgcatgagactcg

SEQ ID NO: 945161 - DNA, 25 bp, Mus musculus
gcttaaaatcagcaaattttgccaa

SEQ ID NO: 945162 - DNA, 25 bp, Mus musculus
gcttaaaatcagccagggagaagaa

SEQ ID NO: 945163 - DNA, 25 bp, Mus musculus
gcttaaaatcaggaaattttgccaa

SEQ ID NO: 945164 - DNA, 25 bp, Mus musculus
gcttaaaatcaggcagggagaagaa

SEQ ID NO: 945165 - DNA, 25 bp, Mus musculus
gcttaaacaacctacagcttcagga

SEQ ID NO: 945166 - DNA, 25 bp, Mus musculus
gcttaaacaacctagagcttcagga

SEQ ID NO: 945167 - DNA, 25 bp, Mus musculus
gcttaaacaacgtgattctgctgct

SEQ ID NO: 945168 - DNA, 25 bp, Mus musculus
gcttaaacaaggtgattctgctgct

SEQ ID NO: 945169 - DNA, 25 bp, Mus musculus
gcttaaacctggcaggactcacaaa

SEQ ID NO: 945170 - DNA, 25 bp, Mus musculus
gcttaaacctgggaggactcacaaa

SEQ ID NO: 945171 - DNA, 25 bp, Mus musculus
gcttaacagcccagcgcaatgtggc

SEQ ID NO: 945172 - DNA, 25 bp, Mus musculus
gcttaacagcccagggcaatgtggc

SEQ ID NO: 945173 - DNA, 25 bp, Mus musculus
gcttaaccttgaacatattgctacc

SEQ ID NO: 945174 - DNA, 25 bp, Mus musculus
gcttaaccttgaacttattgctacc

SEQ ID NO: 945175 - DNA, 25 bp, Mus musculus
gcttaagagaagctgttaggagtgg

SEQ ID NO: 945176 - DNA, 25 bp, Mus musculus
gcttaagagaaggtgttaggagtgg

SEQ ID NO: 945177 - DNA, 25 bp, Mus musculus
gcttaagcgacacgtgtccttggaa

SEQ ID NO: 945178 - DNA, 25 bp, Mus musculus
gcttaagcgacaggtgtccttggaa

SEQ ID NO: 945179 - DNA, 25 bp, Mus musculus
gcttaagtttatcaattcctcagag

SEQ ID NO: 945180 - DNA, 25 bp, Mus musculus
gcttaagtttatcgctgcagttccg

SEQ ID NO: 945181 - DNA, 25 bp, Mus musculus
gcttaagtttatctgctctatgccc

SEQ ID NO: 945182 - DNA, 25 bp, Mus musculus
gcttaagtttatgaattcctcagag

SEQ ID NO: 945183 - DNA, 25 bp, Mus musculus
gcttaagtttatggctgcagttccg

SEQ ID NO: 945184 - DNA, 25 bp, Mus musculus
gcttaagtttatgtgctctatgccc

SEQ ID NO: 945185 - DNA, 25 bp, Mus musculus
gcttaatactgcttaagtatttttc

SEQ ID NO: 945186 - DNA, 25 bp, Mus musculus
gcttaatactgctttagtatttttc

SEQ ID NO: 945187 - DNA, 25 bp, Mus musculus
gcttaatagaatcttctggatctgc

SEQ ID NO: 945188 - DNA, 25 bp, Mus musculus
gcttaatagattcttctggatctgc

SEQ ID NO: 945189 - DNA, 25 bp, Mus musculus
gcttaatatgagaaaggaacataat

SEQ ID NO: 945190 - DNA, 25 bp, Mus musculus
gcttaatatgtgaaaggaacataat

SEQ ID NO: 945191 - DNA, 25 bp, Mus musculus
gcttaatccgatcagtgtctttatg

SEQ ID NO: 945192 - DNA, 25 bp, Mus musculus
gcttaatccgttcagtgtctttatg

SEQ ID NO: 945193 - DNA, 25 bp, Mus musculus
gcttacaaagaatggaattgctagt

SEQ ID NO: 945194 - DNA, 25 bp, Mus musculus
gcttacaaagtatggaattgctagt

SEQ ID NO: 945195 - DNA, 25 bp, Mus musculus
gcttacagacggcctgactcctcac

SEQ ID NO: 945196 - DNA, 25 bp, Mus musculus
gcttacagacggcctttgctgttgg

SEQ ID NO: 945197 - DNA, 25 bp, Mus musculus
gcttacagacgggctgactcctcac

SEQ ID NO: 945198 - DNA, 25 bp, Mus musculus
gcttacagacgggctttgctgttgg

SEQ ID NO: 945199 - DNA, 25 bp, Mus musculus
gcttaccacgcacgcctgaaggcat

SEQ ID NO: 945200 - DNA, 25 bp, Mus musculus
gcttaccacgcaggcctgaaggcat

SEQ ID NO: 945201 - DNA, 25 bp, Mus musculus
gcttacggactacgccagcaggtgg

SEQ ID NO: 945202 - DNA, 25 bp, Mus musculus
gcttacggactacggccctgcacac

SEQ ID NO: 945203 - DNA, 25 bp, Mus musculus
gcttacggactaggccagcaggtgg

SEQ ID NO: 945204 - DNA, 25 bp, Mus musculus
gcttacggactagggccctgcacac

SEQ ID NO: 945205 - DNA, 25 bp, Mus musculus
gcttactcagcatgtcaatgggccc

SEQ ID NO: 945206 - DNA, 25 bp, Mus musculus
gcttactcaggatgtcaatgggccc

SEQ ID NO: 945207 - DNA, 25 bp, Mus musculus
gcttactgagaaactcaagccagtg

SEQ ID NO: 945208 - DNA, 25 bp, Mus musculus
gcttactgagtaactcaagccagtg

SEQ ID NO: 945209 - DNA, 25 bp, Mus musculus
gcttagagccctcgaggcgcggatc

SEQ ID NO: 945210 - DNA, 25 bp, Mus musculus
gcttagagccctggaggcgcggatc

SEQ ID NO: 945211 - DNA, 25 bp, Mus musculus
gcttagccaagacacatcggcgata

SEQ ID NO: 945212 - DNA, 25 bp, Mus musculus
gcttagccaagacagatcggcgata

SEQ ID NO: 945213 - DNA, 25 bp, Mus musculus
gcttaggagccacaagctgactgct

SEQ ID NO: 945214 - DNA, 25 bp, Mus musculus
gcttaggagccacaaggaggctggc

SEQ ID NO: 945215 - DNA, 25 bp, Mus musculus
gcttaggagccacaggaagtcacag

SEQ ID NO: 945216 - DNA, 25 bp, Mus musculus
gcttaggagccagaagctgactgct

SEQ ID NO: 945217 - DNA, 25 bp, Mus musculus
gcttaggagccagaaggaggctggc

SEQ ID NO: 945218 - DNA, 25 bp, Mus musculus
gcttaggagccagaggaagtcacag

SEQ ID NO: 945219 - DNA, 25 bp, Mus musculus
gcttataaaaatgtcaatcaagaag

SEQ ID NO: 945220 - DNA, 25 bp, Mus musculus
gcttataaaaatgtgaatcaagaag

SEQ ID NO: 945221 - DNA, 25 bp, Mus musculus
gcttatgaacagatcaagcgggcca

SEQ ID NO: 945222 - DNA, 25 bp, Mus musculus
gcttatgaacagttcaagcgggcca

SEQ ID NO: 945223 - DNA, 25 bp, Mus musculus
gcttatgcccagctcatccttggaa

SEQ ID NO: 945224 - DNA, 25 bp, Mus musculus
gcttatgcccaggtcatccttggaa

SEQ ID NO: 945225 - DNA, 25 bp, Mus musculus
gcttattatgctggataataagaaa

SEQ ID NO: 945226 - DNA, 25 bp, Mus musculus
gcttattatggtggataataagaaa

SEQ ID NO: 945227 - DNA, 25 bp, Mus musculus
gcttattgtcagctctgtgagaacg

SEQ ID NO: 945228 - DNA, 25 bp, Mus musculus
gcttattgtcaggtctgtgagaacg

SEQ ID NO: 945229 - DNA, 25 bp, Mus musculus
gcttcaaaagcgaccgagctccttt

SEQ ID NO: 945230 - DNA, 25 bp, Mus musculus
gcttcaaaagggaccgagctccttt

SEQ ID NO: 945231 - DNA, 25 bp, Mus musculus
gcttcaaactaaattggatgaacct

SEQ ID NO: 945232 - DNA, 25 bp, Mus musculus
gcttcaaacttaattggatgaacct

SEQ ID NO: 945233 - DNA, 25 bp, Mus musculus
gcttcaaatgggcaattggacggct

SEQ ID NO: 945234 - DNA, 25 bp, Mus musculus
gcttcaaatggggaattggacggct

SEQ ID NO: 945235 - DNA, 25 bp, Mus musculus
gcttcaacaggccacctgggcccca

SEQ ID NO: 945236 - DNA, 25 bp, Mus musculus
gcttcaacaggcgacctgggcccca

SEQ ID NO: 945237 - DNA, 25 bp, Mus musculus
gcttcaagagccttggctttctgag

SEQ ID NO: 945238 - DNA, 25 bp, Mus musculus
gcttcaagaggcttggctttctgag

SEQ ID NO: 945239 - DNA, 25 bp, Mus musculus
gcttcaaggccacgttgatggaaac

SEQ ID NO: 945240 - DNA, 25 bp, Mus musculus
gcttcaaggccaggttgatggaaac

SEQ ID NO: 945241 - DNA, 25 bp, Mus musculus
gcttcaatgccacgtacaagatgct

SEQ ID NO: 945242 - DNA, 25 bp, Mus musculus
gcttcaatgccaggtacaagatgct

SEQ ID NO: 945243 - DNA, 25 bp, Mus musculus
gcttcacagaagccagaggtcatca

SEQ ID NO: 945244 - DNA, 25 bp, Mus musculus
gcttcacagaaggcagaggtcatca

SEQ ID NO: 945245 - DNA, 25 bp, Mus musculus
gcttcacatacacgagcgacagttt

SEQ ID NO: 945246 - DNA, 25 bp, Mus musculus
gcttcacatacaggagcgacagttt

SEQ ID NO: 945247 - DNA, 25 bp, Mus musculus
gcttcaccccagctgaacaccttta

SEQ ID NO: 945248 - DNA, 25 bp, Mus musculus
gcttcaccccagctttgtatggaga

SEQ ID NO: 945249 - DNA, 25 bp, Mus musculus
gcttcaccccaggtgaacaccttta

SEQ ID NO: 945250 - DNA, 25 bp, Mus musculus
gcttcaccccaggtttgtatggaga

SEQ ID NO: 945251 - DNA, 25 bp, Mus musculus
gcttcaccgtggcacgggttcttac

SEQ ID NO: 945252 - DNA, 25 bp, Mus musculus
gcttcaccgtggcaggggttcttac

SEQ ID NO: 945253 - DNA, 25 bp, Mus musculus
gcttcacctcgcctcgacgttgtca

SEQ ID NO: 945254 - DNA, 25 bp, Mus musculus
gcttcacctcgcctggacgttgtca

SEQ ID NO: 945255 - DNA, 25 bp, Mus musculus
gcttcactgccctggcattgaccaa

SEQ ID NO: 945256 - DNA, 25 bp, Mus musculus
gcttcactgcgctggcattgaccaa

SEQ ID NO: 945257 - DNA, 25 bp, Mus musculus
gcttcagaagttaacgaaacatatt

SEQ ID NO: 945258 - DNA, 25 bp, Mus musculus
gcttcagaagttaaggaaacatatt

SEQ ID NO: 945259 - DNA, 25 bp, Mus musculus
gcttcagagactcacgattgaaaag

SEQ ID NO: 945260 - DNA, 25 bp, Mus musculus
gcttcagagactcaggattgaaaag

SEQ ID NO: 945261 - DNA, 25 bp, Mus musculus
gcttcagagtgagaacatcatccaa

SEQ ID NO: 945262 - DNA, 25 bp, Mus musculus
gcttcagagtgagatcatcatccaa

SEQ ID NO: 945263 - DNA, 25 bp, Mus musculus
gcttcagatttgcgacacagcaggc

SEQ ID NO: 945264 - DNA, 25 bp, Mus musculus
gcttcagatttgggacacagcaggc

SEQ ID NO: 945265 - DNA, 25 bp, Mus musculus
gcttcagcagattgtgaagaaatat

SEQ ID NO: 945266 - DNA, 25 bp, Mus musculus
gcttcagcagctatgatgaaggttc

SEQ ID NO: 945267 - DNA, 25 bp, Mus musculus
gcttcagcaggtatgatgaaggttc

SEQ ID NO: 945268 - DNA, 25 bp, Mus musculus
gcttcagcagtttgtgaagaaatat

SEQ ID NO: 945269 - DNA, 25 bp, Mus musculus
gcttcagcgagccccggctgttgat

SEQ ID NO: 945270 - DNA, 25 bp, Mus musculus
gcttcagcgagcccgggctgttgat

SEQ ID NO: 945271 - DNA, 25 bp, Mus musculus
gcttcagcgccgcccctggagagat

SEQ ID NO: 945272 - DNA, 25 bp, Mus musculus
gcttcagcgccgccgctggagagat

SEQ ID NO: 945273 - DNA, 25 bp, Mus musculus
gcttcagcgtgtctcatactacaag

SEQ ID NO: 945274 - DNA, 25 bp, Mus musculus
gcttcagcgtgtctgatactacaag

SEQ ID NO: 945275 - DNA, 25 bp, Mus musculus
gcttcaggtgagccctttaccctcc

SEQ ID NO: 945276 - DNA, 25 bp, Mus musculus
gcttcaggtgaggcctttaccctcc

SEQ ID NO: 945277 - DNA, 25 bp, Mus musculus
gcttcataatattaacagacccctg

SEQ ID NO: 945278 - DNA, 25 bp, Mus musculus
gcttcataattttaacagacccctg

SEQ ID NO: 945279 - DNA, 25 bp, Mus musculus
gcttcatcctagcgctttgcctgag

SEQ ID NO: 945280 - DNA, 25 bp, Mus musculus
gcttcatcctagcggtttgcctgag

SEQ ID NO: 945281 - DNA, 25 bp, Mus musculus
gcttcatgaccacctacacacttac

SEQ ID NO: 945282 - DNA, 25 bp, Mus musculus
gcttcatgaccagctacacacttac

SEQ ID NO: 945283 - DNA, 25 bp, Mus musculus
gcttcatgagatccaaattcaacac

SEQ ID NO: 945284 - DNA, 25 bp, Mus musculus
gcttcatgagatgcaaattcaacac

SEQ ID NO: 945285 - DNA, 25 bp, Mus musculus
gcttcatgataggatgtgacaactg

SEQ ID NO: 945286 - DNA, 25 bp, Mus musculus
gcttcatgattggatgtgacaactg

SEQ ID NO: 945287 - DNA, 25 bp, Mus musculus
gcttcatgtctgcatgtgtctagtc

SEQ ID NO: 945288 - DNA, 25 bp, Mus musculus
gcttcatgtctggatgtgtctagtc

SEQ ID NO: 945289 - DNA, 25 bp, Mus musculus
gcttcattggagctttaggattagc

SEQ ID NO: 945290 - DNA, 25 bp, Mus musculus
gcttcattggaggtttaggattagc

SEQ ID NO: 945291 - DNA, 25 bp, Mus musculus
gcttccaaacttgacgaaatctacg

SEQ ID NO: 945292 - DNA, 25 bp, Mus musculus
gcttccaaacttgaggaaatctacg

SEQ ID NO: 945293 - DNA, 25 bp, Mus musculus
gcttccaaagcaaaagcgacatgtt

SEQ ID NO: 945294 - DNA, 25 bp, Mus musculus
gcttccaaagcacaggctggctcgg

SEQ ID NO: 945295 - DNA, 25 bp, Mus musculus
gcttccaaagcaggaaaagcgacat

SEQ ID NO: 945296 - DNA, 25 bp, Mus musculus
gcttccaaagccaggtgtcagatgt

SEQ ID NO: 945297 - DNA, 25 bp, Mus musculus
gcttccaaaggaaaagcgacatgtt

SEQ ID NO: 945298 - DNA, 25 bp, Mus musculus
gcttccaaaggacaggctggctcgg

SEQ ID NO: 945299 - DNA, 25 bp, Mus musculus
gcttccaaaggaggaaaagcgacat

SEQ ID NO: 945300 - DNA, 25 bp, Mus musculus
gcttccaaaggcaggtgtcagatgt

SEQ ID NO: 945301 - DNA, 25 bp, Mus musculus
gcttccaagatgatccccacaccag

SEQ ID NO: 945302 - DNA, 25 bp, Mus musculus
gcttccaagatgatgcccacaccag

SEQ ID NO: 945303 - DNA, 25 bp, Mus musculus
gcttccacagaaactcaagtcaagg

SEQ ID NO: 945304 - DNA, 25 bp, Mus musculus
gcttccacagaccatgccttaagaa

SEQ ID NO: 945305 - DNA, 25 bp, Mus musculus
gcttccacagcccgagagtcaaaca

SEQ ID NO: 945306 - DNA, 25 bp, Mus musculus
gcttccacagccggagagtcaaaca

SEQ ID NO: 945307 - DNA, 25 bp, Mus musculus
gcttccacagctttcctttggatcc

SEQ ID NO: 945308 - DNA, 25 bp, Mus musculus
gcttccacaggtttcctttggatcc

SEQ ID NO: 945309 - DNA, 25 bp, Mus musculus
gcttccacagtaactcaagtcaagg

SEQ ID NO: 945310 - DNA, 25 bp, Mus musculus
gcttccacagtccatgccttaagaa

SEQ ID NO: 945311 - DNA, 25 bp, Mus musculus
gcttccacattactgactggctctg

SEQ ID NO: 945312 - DNA, 25 bp, Mus musculus
gcttccacattagtgactggctctg

SEQ ID NO: 945313 - DNA, 25 bp, Mus musculus
gcttccacctagcgactgccgcttc

SEQ ID NO: 945314 - DNA, 25 bp, Mus musculus
gcttccacctagggactgccgcttc

SEQ ID NO: 945315 - DNA, 25 bp, Mus musculus
gcttccacgccactagtcggcagct

SEQ ID NO: 945316 - DNA, 25 bp, Mus musculus
gcttccacgccacttgtcggcagct

SEQ ID NO: 945317 - DNA, 25 bp, Mus musculus
gcttccagagctttctaaggtgcta

SEQ ID NO: 945318 - DNA, 25 bp, Mus musculus
gcttccagaggtttctaaggtgcta

SEQ ID NO: 945319 - DNA, 25 bp, Mus musculus
gcttccatcttcaacgcctgggcag

SEQ ID NO: 945320 - DNA, 25 bp, Mus musculus
gcttccatcttcaaggcctgggcag

SEQ ID NO: 945321 - DNA, 25 bp, Mus musculus
gcttccatgactcgcataccagagg

SEQ ID NO: 945322 - DNA, 25 bp, Mus musculus
gcttccatgactggcataccagagg

SEQ ID NO: 945323 - DNA, 25 bp, Mus musculus
gcttcccaaaaaagtatccatcgag

SEQ ID NO: 945324 - DNA, 25 bp, Mus musculus
gcttcccaaaaatgtatccatcgag

SEQ ID NO: 945325 - DNA, 25 bp, Mus musculus
gcttcccagagccacgcacaagatg

SEQ ID NO: 945326 - DNA, 25 bp, Mus musculus
gcttcccagagccaggcacaagatg

SEQ ID NO: 945327 - DNA, 25 bp, Mus musculus
gcttccctcgcaacctcctgacctc

SEQ ID NO: 945328 - DNA, 25 bp, Mus musculus
gcttccctcgcggggctgcggtccc

SEQ ID NO: 945329 - DNA, 25 bp, Mus musculus
gcttccctcggaacctcctgacctc

SEQ ID NO: 945330 - DNA, 25 bp, Mus musculus
gcttccctcggggggctgcggtccc

SEQ ID NO: 945331 - DNA, 25 bp, Mus musculus
gcttccctgcagctacaaactctgg

SEQ ID NO: 945332 - DNA, 25 bp, Mus musculus
gcttccctgcaggtacaaactctgg

SEQ ID NO: 945333 - DNA, 25 bp, Mus musculus
gcttccctgctacaccaacttctcc

SEQ ID NO: 945334 - DNA, 25 bp, Mus musculus
gcttccctgctacagcaacttctcc

SEQ ID NO: 945335 - DNA, 25 bp, Mus musculus
gcttccctggcacacaaacatcatc

SEQ ID NO: 945336 - DNA, 25 bp, Mus musculus
gcttccctggcacagaaacatcatc

SEQ ID NO: 945337 - DNA, 25 bp, Mus musculus
gcttccctggctaaccaagcttccc

SEQ ID NO: 945338 - DNA, 25 bp, Mus musculus
gcttccctggctaagcaagcttccc

SEQ ID NO: 945339 - DNA, 25 bp, Mus musculus
gcttccctgtttcaccaaccttcca

SEQ ID NO: 945340 - DNA, 25 bp, Mus musculus
gcttccctgtttcaccaaccttccc

SEQ ID NO: 945341 - DNA, 25 bp, Mus musculus
gcttccctgtttcaccaagcttccc

SEQ ID NO: 945342 - DNA, 25 bp, Mus musculus
gcttccctgtttcaccaatcttccc

SEQ ID NO: 945343 - DNA, 25 bp, Mus musculus
gcttccctgtttcaccttccctgtt

SEQ ID NO: 945344 - DNA, 25 bp, Mus musculus
gcttccctgtttcagcaaccttcca

SEQ ID NO: 945345 - DNA, 25 bp, Mus musculus
gcttccctgtttcagcaaccttccc

SEQ ID NO: 945346 - DNA, 25 bp, Mus musculus
gcttccctgtttcagcaagcttccc

SEQ ID NO: 945347 - DNA, 25 bp, Mus musculus
gcttccctgtttcagcaatcttccc

SEQ ID NO: 945348 - DNA, 25 bp, Mus musculus
gcttccctgtttcagcttccctgtt

SEQ ID NO: 945349 - DNA, 25 bp, Mus musculus
gcttccgtatctatttctgccaaat

SEQ ID NO: 945350 - DNA, 25 bp, Mus musculus
gcttccgtatctttttctgccaaat

SEQ ID NO: 945351 - DNA, 25 bp, Mus musculus
gcttcctacaagatggacgtggact

SEQ ID NO: 945352 - DNA, 25 bp, Mus musculus
gcttcctacaagttggacgtggact

SEQ ID NO: 945353 - DNA, 25 bp, Mus musculus
gcttcctcagcaacctcagctcagc

SEQ ID NO: 945354 - DNA, 25 bp, Mus musculus
gcttcctcaggaacctcagctcagc

SEQ ID NO: 945355 - DNA, 25 bp, Mus musculus
gcttcctccaggatggattcatggg

SEQ ID NO: 945356 - DNA, 25 bp, Mus musculus
gcttcctccaggttggattcatggg

SEQ ID NO: 945357 - DNA, 25 bp, Mus musculus
gcttcctgaacggatgggctcttcc

SEQ ID NO: 945358 - DNA, 25 bp, Mus musculus
gcttcctgaagggatgggctcttcc

SEQ ID NO: 945359 - DNA, 25 bp, Mus musculus
gcttcctgagatagaagacatggaa

SEQ ID NO: 945360 - DNA, 25 bp, Mus musculus
gcttcctgagatgaagaaactgaaa

SEQ ID NO: 945361 - DNA, 25 bp, Mus musculus
gcttcctgagtgctatccttggcat

SEQ ID NO: 945362 - DNA, 25 bp, Mus musculus
gcttcctgagtggtatccttggcat

SEQ ID NO: 945363 - DNA, 25 bp, Mus musculus
gcttcctgagttagaagacatggaa

SEQ ID NO: 945364 - DNA, 25 bp, Mus musculus
gcttcctgagttgaagaaactgaaa

SEQ ID NO: 945365 - DNA, 25 bp, Mus musculus
gcttcctgatgaagttatagtgcct

SEQ ID NO: 945366 - DNA, 25 bp, Mus musculus
gcttcctgatgaatgtcattggtct

SEQ ID NO: 945367 - DNA, 25 bp, Mus musculus
gcttcctgatgatgttatagtgcct

SEQ ID NO: 945368 - DNA, 25 bp, Mus musculus
gcttcctgatgattgtcattggtct

SEQ ID NO: 945369 - DNA, 25 bp, Mus musculus
gcttcctgcctgccacggcgcagga

SEQ ID NO: 945370 - DNA, 25 bp, Mus musculus
gcttcctgcctggcacggcgcagga

SEQ ID NO: 945371 - DNA, 25 bp, Mus musculus
gcttcctgtccgaacagagactcag

SEQ ID NO: 945372 - DNA, 25 bp, Mus musculus
gcttcctgtccgtacagagactcag

SEQ ID NO: 945373 - DNA, 25 bp, Mus musculus
gcttccttaacacagatgggagctt

SEQ ID NO: 945374 - DNA, 25 bp, Mus musculus
gcttccttaagacagatgggagctt

SEQ ID NO: 945375 - DNA, 25 bp, Mus musculus
gcttccttgaagacacccacaggaa

SEQ ID NO: 945376 - DNA, 25 bp, Mus musculus
gcttccttgaagtcacccacaggaa

SEQ ID NO: 945377 - DNA, 25 bp, Mus musculus
gcttcctttcccgacaggtggatgt

SEQ ID NO: 945378 - DNA, 25 bp, Mus musculus
gcttcctttcccgagaggtggatgt

SEQ ID NO: 945379 - DNA, 25 bp, Mus musculus
gcttcctttgagcaggattctggag

SEQ ID NO: 945380 - DNA, 25 bp, Mus musculus
gcttcctttgaggaggattctggag

SEQ ID NO: 945381 - DNA, 25 bp, Mus musculus
gcttcgagatgaaggaggttttgaa

SEQ ID NO: 945382 - DNA, 25 bp, Mus musculus
gcttcgagatgatggaggttttgaa

SEQ ID NO: 945383 - DNA, 25 bp, Mus musculus
gcttcgagtcacagccctgagggcc

SEQ ID NO: 945384 - DNA, 25 bp, Mus musculus
gcttcgagtcacaggcctgagggcc

SEQ ID NO: 945385 - DNA, 25 bp, Mus musculus
gcttcgcctgggcatggaacaaaac

SEQ ID NO: 945386 - DNA, 25 bp, Mus musculus
gcttcgcctggggatggaacaaaac

SEQ ID NO: 945387 - DNA, 25 bp, Mus musculus
gcttcggacaggccaacgtttcata

SEQ ID NO: 945388 - DNA, 25 bp, Mus musculus
gcttcggacagggcaacgtttcata

SEQ ID NO: 945389 - DNA, 25 bp, Mus musculus
gcttcggagaagatgtggacccctg

SEQ ID NO: 945390 - DNA, 25 bp, Mus musculus
gcttcggagaagccctcctgccaga

SEQ ID NO: 945391 - DNA, 25 bp, Mus musculus
gcttcggagaaggcctcctgccaga

SEQ ID NO: 945392 - DNA, 25 bp, Mus musculus
gcttcggagaagttgtggacccctg

SEQ ID NO: 945393 - DNA, 25 bp, Mus musculus
gcttcggcagcgagcattcacctcc

SEQ ID NO: 945394 - DNA, 25 bp, Mus musculus
gcttcggcagcgtgcattcacctcc

SEQ ID NO: 945395 - DNA, 25 bp, Mus musculus
gcttcgggactacctccccgggatg

SEQ ID NO: 945396 - DNA, 25 bp, Mus musculus
gcttcgggactagctccccgggatg

SEQ ID NO: 945397 - DNA, 25 bp, Mus musculus
gcttcgggcccacctctccagtcta

SEQ ID NO: 945398 - DNA, 25 bp, Mus musculus
gcttcgggcccagctctccagtcta

SEQ ID NO: 945399 - DNA, 25 bp, Mus musculus
gcttcgggtgagaaggaagaggttg

SEQ ID NO: 945400 - DNA, 25 bp, Mus musculus
gcttcgggtgagtaggaagaggttg

SEQ ID NO: 945401 - DNA, 25 bp, Mus musculus
gcttcgttttcacacgggccgatca

SEQ ID NO: 945402 - DNA, 25 bp, Mus musculus
gcttcgttttcacaggggccgatca

SEQ ID NO: 945403 - DNA, 25 bp, Mus musculus
gcttctaagacacgaagtcttagaa

SEQ ID NO: 945404 - DNA, 25 bp, Mus musculus
gcttctaagacaggaagtcttagaa

SEQ ID NO: 945405 - DNA, 25 bp, Mus musculus
gcttctacaaaatacagatctaatc

SEQ ID NO: 945406 - DNA, 25 bp, Mus musculus
gcttctacaaaatagagatctaatc

SEQ ID NO: 945407 - DNA, 25 bp, Mus musculus
gcttctacagctggctgtggaggac

SEQ ID NO: 945408 - DNA, 25 bp, Mus musculus
gcttctacaggtggctgtggaggac

SEQ ID NO: 945409 - DNA, 25 bp, Mus musculus
gcttctatcaaacctgttcctgagc

SEQ ID NO: 945410 - DNA, 25 bp, Mus musculus
gcttctatcaaagctgttcctgagc

SEQ ID NO: 945411 - DNA, 25 bp, Mus musculus
gcttctatctgccacgatttgtgaa

SEQ ID NO: 945412 - DNA, 25 bp, Mus musculus
gcttctatctgccaggatttgtgaa

SEQ ID NO: 945413 - DNA, 25 bp, Mus musculus
gcttctcagaagagtattcacagag

SEQ ID NO: 945414 - DNA, 25 bp, Mus musculus
gcttctcagaagtgtattcacagag

SEQ ID NO: 945415 - DNA, 25 bp, Mus musculus
gcttctccaccactcctgagtcccc

SEQ ID NO: 945416 - DNA, 25 bp, Mus musculus
gcttctccaccagtcctgagtcccc

SEQ ID NO: 945417 - DNA, 25 bp, Mus musculus
gcttctccactgcatttgctgaata

SEQ ID NO: 945418 - DNA, 25 bp, Mus musculus
gcttctccactggatttgctgaata

SEQ ID NO: 945419 - DNA, 25 bp, Mus musculus
gcttctccgagactgcaatcaacta

SEQ ID NO: 945420 - DNA, 25 bp, Mus musculus
gcttctccgagagtgcaatcaacta

SEQ ID NO: 945421 - DNA, 25 bp, Mus musculus
gcttctcctccacctaaaccggaca

SEQ ID NO: 945422 - DNA, 25 bp, Mus musculus
gcttctcctccagctaaaccggaca

SEQ ID NO: 945423 - DNA, 25 bp, Mus musculus
gcttctgacaatcgaatcccgccta

SEQ ID NO: 945424 - DNA, 25 bp, Mus musculus
gcttctgacaatggaatcccgccta

SEQ ID NO: 945425 - DNA, 25 bp, Mus musculus
gcttctgagcagatctggagcccag

SEQ ID NO: 945426 - DNA, 25 bp, Mus musculus
gcttctgagcagccagttctggagc

SEQ ID NO: 945427 - DNA, 25 bp, Mus musculus
gcttctgagcagcttctgaaggaga

SEQ ID NO: 945428 - DNA, 25 bp, Mus musculus
gcttctgagcagcttgccccgttgc

SEQ ID NO: 945429 - DNA, 25 bp, Mus musculus
gcttctgagcaggcagttctggagc

SEQ ID NO: 945430 - DNA, 25 bp, Mus musculus
gcttctgagcaggttctgaaggaga

SEQ ID NO: 945431 - DNA, 25 bp, Mus musculus
gcttctgagcaggttgccccgttgc

SEQ ID NO: 945432 - DNA, 25 bp, Mus musculus
gcttctgagcagttctggagcccag

SEQ ID NO: 945433 - DNA, 25 bp, Mus musculus
gcttctgcaacgttctgtccccctg

SEQ ID NO: 945434 - DNA, 25 bp, Mus musculus
gcttctgcaaggttctgtccccctg

SEQ ID NO: 945435 - DNA, 25 bp, Mus musculus
gcttctgccaacaatgacgggattt

SEQ ID NO: 945436 - DNA, 25 bp, Mus musculus
gcttctgccaactatgacgggattt

SEQ ID NO: 945437 - DNA, 25 bp, Mus musculus
gcttctgctgtatgcgtggtctatc

SEQ ID NO: 945438 - DNA, 25 bp, Mus musculus
gcttctgctgtatgctgcccagcac

SEQ ID NO: 945439 - DNA, 25 bp, Mus musculus
gcttctgctgtatgggtggtctatc

SEQ ID NO: 945440 - DNA, 25 bp, Mus musculus
gcttctgctgtatggtgcccagcac

SEQ ID NO: 945441 - DNA, 25 bp, Mus musculus
gcttctggaccaagtacatgaacca

SEQ ID NO: 945442 - DNA, 25 bp, Mus musculus
gcttctggaccatgtacatgaacca

SEQ ID NO: 945443 - DNA, 25 bp, Mus musculus
gcttctggagacatctctgggaagc

SEQ ID NO: 945444 - DNA, 25 bp, Mus musculus
gcttctggagcaagtatcctgtcta

SEQ ID NO: 945445 - DNA, 25 bp, Mus musculus
gcttctggagctggtgtccccactg

SEQ ID NO: 945446 - DNA, 25 bp, Mus musculus
gcttctggaggaagtatcctgtcta

SEQ ID NO: 945447 - DNA, 25 bp, Mus musculus
gcttctggaggcaacgatggccagg

SEQ ID NO: 945448 - DNA, 25 bp, Mus musculus
gcttctggaggcaacgctatgctgt

SEQ ID NO: 945449 - DNA, 25 bp, Mus musculus
gcttctggaggcaaggatggccagg

SEQ ID NO: 945450 - DNA, 25 bp, Mus musculus
gcttctggaggcaaggctatgctgt

SEQ ID NO: 945451 - DNA, 25 bp, Mus musculus
gcttctggaggtggtgtccccactg

SEQ ID NO: 945452 - DNA, 25 bp, Mus musculus
gcttctggagtcatctctgggaagc

SEQ ID NO: 945453 - DNA, 25 bp, Mus musculus
gcttctggggtggtcaccttaaagc

SEQ ID NO: 945454 - DNA, 25 bp, Mus musculus
gcttctggggtggtgaccttaaagc

SEQ ID NO: 945455 - DNA, 25 bp, Mus musculus
gcttctgtcagtcaccccatgaatg

SEQ ID NO: 945456 - DNA, 25 bp, Mus musculus
gcttctgtcagtgaccccatgaatg

SEQ ID NO: 945457 - DNA, 25 bp, Mus musculus
gcttctgtccagcaccagacgacag

SEQ ID NO: 945458 - DNA, 25 bp, Mus musculus
gcttctgtccaggaccagacgacag

SEQ ID NO: 945459 - DNA, 25 bp, Mus musculus
gcttctgtgcacacatgtctgagag

SEQ ID NO: 945460 - DNA, 25 bp, Mus musculus
gcttctgtgcacacttgtctgagag

SEQ ID NO: 945461 - DNA, 25 bp, Mus musculus
gcttctgttggacataccttcctat

SEQ ID NO: 945462 - DNA, 25 bp, Mus musculus
gcttctgttggagataccttcctat

SEQ ID NO: 945463 - DNA, 25 bp, Mus musculus
gcttcttcagacgaacagtcagcaa

SEQ ID NO: 945464 - DNA, 25 bp, Mus musculus
gcttcttcagagatactgtcagcag

SEQ ID NO: 945465 - DNA, 25 bp, Mus musculus
gcttcttcagagctagaactagacc

SEQ ID NO: 945466 - DNA, 25 bp, Mus musculus
gcttcttcagaggtagaactagacc

SEQ ID NO: 945467 - DNA, 25 bp, Mus musculus
gcttcttcagtcgaacagtcagcaa

SEQ ID NO: 945468 - DNA, 25 bp, Mus musculus
gcttcttcagtgatactgtcagcag

SEQ ID NO: 945469 - DNA, 25 bp, Mus musculus
gcttcttccacgaatttgaaagatg

SEQ ID NO: 945470 - DNA, 25 bp, Mus musculus
gcttcttccacgtatttgaaagatg

SEQ ID NO: 945471 - DNA, 25 bp, Mus musculus
gcttcttccatgaacttctccatga

SEQ ID NO: 945472 - DNA, 25 bp, Mus musculus
gcttcttccatgtacttctccatga

SEQ ID NO: 945473 - DNA, 25 bp, Mus musculus
gcttcttcccatcaccccaggccac

SEQ ID NO: 945474 - DNA, 25 bp, Mus musculus
gcttcttcccatcagcccaggccac

SEQ ID NO: 945475 - DNA, 25 bp, Mus musculus
gcttcttcctgccggacatcaccat

SEQ ID NO: 945476 - DNA, 25 bp, Mus musculus
gcttcttcctgcgggacatcaccat

SEQ ID NO: 945477 - DNA, 25 bp, Mus musculus
gcttcttctgctcatgtctctgacc

SEQ ID NO: 945478 - DNA, 25 bp, Mus musculus
gcttcttctggtcatgtctctgacc

SEQ ID NO: 945479 - DNA, 25 bp, Mus musculus
gcttcttgttggcgatgtggctcag

SEQ ID NO: 945480 - DNA, 25 bp, Mus musculus
gcttcttgttggggatgtggctcag

SEQ ID NO: 945481 - DNA, 25 bp, Mus musculus
gcttctttggctctgaacccaagat

SEQ ID NO: 945482 - DNA, 25 bp, Mus musculus
gcttctttgggtctgaacccaagat

SEQ ID NO: 945483 - DNA, 25 bp, Mus musculus
gcttctttgtgtcgccttcaccacg

SEQ ID NO: 945484 - DNA, 25 bp, Mus musculus
gcttctttgtgtggccttcaccacg

SEQ ID NO: 945485 - DNA, 25 bp, Mus musculus
gcttgaaaaagaaacatcattactc

SEQ ID NO: 945486 - DNA, 25 bp, Mus musculus
gcttgaaaaagaaagatcattactc

SEQ ID NO: 945487 - DNA, 25 bp, Mus musculus
gcttgaaaagacactgagtcctcga

SEQ ID NO: 945488 - DNA, 25 bp, Mus musculus
gcttgaaaagtcactgagtcctcga

SEQ ID NO: 945489 - DNA, 25 bp, Mus musculus
gcttgaactagcaaccttgcagggc

SEQ ID NO: 945490 - DNA, 25 bp, Mus musculus
gcttgaactagcaagcttgcagggc

SEQ ID NO: 945491 - DNA, 25 bp, Mus musculus
gcttgaagtcaacacatttgctctt

SEQ ID NO: 945492 - DNA, 25 bp, Mus musculus
gcttgaagtcaacagatttgctctt

SEQ ID NO: 945493 - DNA, 25 bp, Mus musculus
gcttgacaaatgcgaacagtctggt

SEQ ID NO: 945494 - DNA, 25 bp, Mus musculus
gcttgacaaatgggaacagtctggt

SEQ ID NO: 945495 - DNA, 25 bp, Mus musculus
gcttgaccagctgttcttccaggag

SEQ ID NO: 945496 - DNA, 25 bp, Mus musculus
gcttgaccaggtgttcttccaggag

SEQ ID NO: 945497 - DNA, 25 bp, Mus musculus
gcttgaggaacacgaatggtaatgc

SEQ ID NO: 945498 - DNA, 25 bp, Mus musculus
gcttgaggaacaggaatggtaatgc

SEQ ID NO: 945499 - DNA, 25 bp, Mus musculus
gcttgagtccagcttcacattgaga

SEQ ID NO: 945500 - DNA, 25 bp, Mus musculus
gcttgagtccaggttcacattgaga

SEQ ID NO: 945501 - DNA, 25 bp, Mus musculus
gcttgagtgcaacaggcaagtgcag

SEQ ID NO: 945502 - DNA, 25 bp, Mus musculus
gcttgagtgcaacgcaccccggctg

SEQ ID NO: 945503 - DNA, 25 bp, Mus musculus
gcttgagtgcaagaggcaagtgcag

SEQ ID NO: 945504 - DNA, 25 bp, Mus musculus
gcttgagtgcaaggcaccccggctg

SEQ ID NO: 945505 - DNA, 25 bp, Mus musculus
gcttgcaaacagcatgtctctccat

SEQ ID NO: 945506 - DNA, 25 bp, Mus musculus
gcttgcaaacaggatgtctctccat

SEQ ID NO: 945507 - DNA, 25 bp, Mus musculus
gcttgcaaagctgtgccaatatcac

SEQ ID NO: 945508 - DNA, 25 bp, Mus musculus
gcttgcaaaggtgtgccaatatcac

SEQ ID NO: 945509 - DNA, 25 bp, Mus musculus
gcttgcagagcttgtgactgccacc

SEQ ID NO: 945510 - DNA, 25 bp, Mus musculus
gcttgcagaggttgtgactgccacc

SEQ ID NO: 945511 - DNA, 25 bp, Mus musculus
gcttgccaaaagctacagtgattgt

SEQ ID NO: 945512 - DNA, 25 bp, Mus musculus
gcttgccaaaaggtacagtgattgt

SEQ ID NO: 945513 - DNA, 25 bp, Mus musculus
gcttgcccagaatgtgggatccttt

SEQ ID NO: 945514 - DNA, 25 bp, Mus musculus
gcttgcccagtatgtgggatccttt

SEQ ID NO: 945515 - DNA, 25 bp, Mus musculus
gcttgccctgctcaggcagcagttg

SEQ ID NO: 945516 - DNA, 25 bp, Mus musculus
gcttgccctggtcaggcagcagttg

SEQ ID NO: 945517 - DNA, 25 bp, Mus musculus
gcttgccgattgaaaaacatccatt

SEQ ID NO: 945518 - DNA, 25 bp, Mus musculus
gcttgccgattgaataacatccatt

SEQ ID NO: 945519 - DNA, 25 bp, Mus musculus
gcttgcctgacgtcaatagccccac

SEQ ID NO: 945520 - DNA, 25 bp, Mus musculus
gcttgcctgacgtctatagccccac

SEQ ID NO: 945521 - DNA, 25 bp, Mus musculus
gcttgcctgcatcccttctcattga

SEQ ID NO: 945522 - DNA, 25 bp, Mus musculus
gcttgcctgcatgccttctcattga

SEQ ID NO: 945523 - DNA, 25 bp, Mus musculus
gcttgcctggcgcccgaaaagcatg

SEQ ID NO: 945524 - DNA, 25 bp, Mus musculus
gcttgcctggcggccgaaaagcatg

SEQ ID NO: 945525 - DNA, 25 bp, Mus musculus
gcttgccttaaacgtaatgctgcca

SEQ ID NO: 945526 - DNA, 25 bp, Mus musculus
gcttgccttaaaggtaatgctgcca

SEQ ID NO: 945527 - DNA, 25 bp, Mus musculus
gcttgccttgcttgctcctgcaacg

SEQ ID NO: 945528 - DNA, 25 bp, Mus musculus
gcttgccttggttgctcctgcaacg

SEQ ID NO: 945529 - DNA, 25 bp, Mus musculus
gcttgcggaatccacagggccagca

SEQ ID NO: 945530 - DNA, 25 bp, Mus musculus
gcttgcggaatcgacagggccagca

SEQ ID NO: 945531 - DNA, 25 bp, Mus musculus
gcttgcggctatctagtgtgtgcca

SEQ ID NO: 945532 - DNA, 25 bp, Mus musculus
gcttgcggctatgtagtgtgtgcca

SEQ ID NO: 945533 - DNA, 25 bp, Mus musculus
gcttgcggttcgaacggcctgctat

SEQ ID NO: 945534 - DNA, 25 bp, Mus musculus
gcttgcggttcgaagggcctgctat

SEQ ID NO: 945535 - DNA, 25 bp, Mus musculus
gcttgctaagctacaagaagactca

SEQ ID NO: 945536 - DNA, 25 bp, Mus musculus
gcttgctaagctggaagaagaaatt

SEQ ID NO: 945537 - DNA, 25 bp, Mus musculus
gcttgctaaggtacaagaagactca

SEQ ID NO: 945538 - DNA, 25 bp, Mus musculus
gcttgctaaggtggaagaagaaatt

SEQ ID NO: 945539 - DNA, 25 bp, Mus musculus
gcttgctcagcatggctgcagcaac

SEQ ID NO: 945540 - DNA, 25 bp, Mus musculus
gcttgctcagcctcctcggattaaa

SEQ ID NO: 945541 - DNA, 25 bp, Mus musculus
gcttgctcaggatggctgcagcaac

SEQ ID NO: 945542 - DNA, 25 bp, Mus musculus
gcttgctcaggctcctcggattaaa

SEQ ID NO: 945543 - DNA, 25 bp, Mus musculus
gcttgctgaacccccacagaacctg

SEQ ID NO: 945544 - DNA, 25 bp, Mus musculus
gcttgctgaaccgccacagaacctg

SEQ ID NO: 945545 - DNA, 25 bp, Mus musculus
gcttgctgagactctccgctggtgt

SEQ ID NO: 945546 - DNA, 25 bp, Mus musculus
gcttgctgagcgtttcccagtgtag

SEQ ID NO: 945547 - DNA, 25 bp, Mus musculus
gcttgctgagggtttcccagtgtag

SEQ ID NO: 945548 - DNA, 25 bp, Mus musculus
gcttgctgagtctctccgctggtgt

SEQ ID NO: 945549 - DNA, 25 bp, Mus musculus
gcttggaacctgattgccaacgtgc

SEQ ID NO: 945550 - DNA, 25 bp, Mus musculus
gcttggaacctgtttgccaacgtgc

SEQ ID NO: 945551 - DNA, 25 bp, Mus musculus
gcttggaatgagactgcagatcttg

SEQ ID NO: 945552 - DNA, 25 bp, Mus musculus
gcttggaatgagtctgcagatcttg

SEQ ID NO: 945553 - DNA, 25 bp, Mus musculus
gcttggactgaacgtacgcagggaa

SEQ ID NO: 945554 - DNA, 25 bp, Mus musculus
gcttggactgaaggtacgcagggaa

SEQ ID NO: 945555 - DNA, 25 bp, Mus musculus
gcttggagacatgaccagctactcc

SEQ ID NO: 945556 - DNA, 25 bp, Mus musculus
gcttggagacatgacgaactcagcc

SEQ ID NO: 945557 - DNA, 25 bp, Mus musculus
gcttggagacatgacggctcatccg

SEQ ID NO: 945558 - DNA, 25 bp, Mus musculus
gcttggagacatgactctaaggttg

SEQ ID NO: 945559 - DNA, 25 bp, Mus musculus
gcttggagacatgagcagctactcc

SEQ ID NO: 945560 - DNA, 25 bp, Mus musculus
gcttggagacatgaggaactcagcc

SEQ ID NO: 945561 - DNA, 25 bp, Mus musculus
gcttggagacatgagggctcatccg

SEQ ID NO: 945562 - DNA, 25 bp, Mus musculus
gcttggagacatgagtctaaggttg

SEQ ID NO: 945563 - DNA, 25 bp, Mus musculus
gcttggagagggctcttatggcagc

SEQ ID NO: 945564 - DNA, 25 bp, Mus musculus
gcttggagaggggtcttatggcagc

SEQ ID NO: 945565 - DNA, 25 bp, Mus musculus
gcttggatcacatgctgggcctaga

SEQ ID NO: 945566 - DNA, 25 bp, Mus musculus
gcttggatcacatggtgggcctaga

SEQ ID NO: 945567 - DNA, 25 bp, Mus musculus
gcttggatcgaacgcacggagggag

SEQ ID NO: 945568 - DNA, 25 bp, Mus musculus
gcttggatcgaaggcacggagggag

SEQ ID NO: 945569 - DNA, 25 bp, Mus musculus
gcttggattacacgtgaccaggact

SEQ ID NO: 945570 - DNA, 25 bp, Mus musculus
gcttggattacacgtggtgctctgg

SEQ ID NO: 945571 - DNA, 25 bp, Mus musculus
gcttggattacaggtgaccaggact

SEQ ID NO: 945572 - DNA, 25 bp, Mus musculus
gcttggattacaggtggtgctctgg

SEQ ID NO: 945573 - DNA, 25 bp, Mus musculus
gcttggcaaacgcgagagcaaacga

SEQ ID NO: 945574 - DNA, 25 bp, Mus musculus
gcttggcaaacgggagagcaaacga

SEQ ID NO: 945575 - DNA, 25 bp, Mus musculus
gcttggcagacccagacatcagaac

SEQ ID NO: 945576 - DNA, 25 bp, Mus musculus
gcttggcagagccagacatcagaac

SEQ ID NO: 945577 - DNA, 25 bp, Mus musculus
gcttggcgcgaaaaggtggacaagt

SEQ ID NO: 945578 - DNA, 25 bp, Mus musculus
gcttggcgcgatatgctaatgaaga

SEQ ID NO: 945579 - DNA, 25 bp, Mus musculus
gcttggcgcgctgaaggcgataaag

SEQ ID NO: 945580 - DNA, 25 bp, Mus musculus
gcttggcgcggtgaaggcgataaag

SEQ ID NO: 945581 - DNA, 25 bp, Mus musculus
gcttggcgcgtaaaggtggacaagt

SEQ ID NO: 945582 - DNA, 25 bp, Mus musculus
gcttggcgcgttatgctaatgaaga

SEQ ID NO: 945583 - DNA, 25 bp, Mus musculus
gcttggcgtgctcactaatgtattt

SEQ ID NO: 945584 - DNA, 25 bp, Mus musculus
gcttggcgtggtcactaatgtattt

SEQ ID NO: 945585 - DNA, 25 bp, Mus musculus
gcttggctatttcacgctttgatgg

SEQ ID NO: 945586 - DNA, 25 bp, Mus musculus
gcttggctatttcaggctttgatgg

SEQ ID NO: 945587 - DNA, 25 bp, Mus musculus
gcttgggactaccacgcctgtacgg

SEQ ID NO: 945588 - DNA, 25 bp, Mus musculus
gcttgggactaccaggcctgtacgg

SEQ ID NO: 945589 - DNA, 25 bp, Mus musculus
gcttggggccccaccgatgctggtg

SEQ ID NO: 945590 - DNA, 25 bp, Mus musculus
gcttggggccccacggatgctggtg

SEQ ID NO: 945591 - DNA, 25 bp, Mus musculus
gcttggtgagaaggaagagtgtgtg

SEQ ID NO: 945592 - DNA, 25 bp, Mus musculus
gcttggtgagtaggaagagtgtgtg

SEQ ID NO: 945593 - DNA, 25 bp, Mus musculus
gcttggttccagatgggtgtgtttt

SEQ ID NO: 945594 - DNA, 25 bp, Mus musculus
gcttggttccagcgtgactgactga

SEQ ID NO: 945595 - DNA, 25 bp, Mus musculus
gcttggttccagggtgactgactga

SEQ ID NO: 945596 - DNA, 25 bp, Mus musculus
gcttggttccagttgggtgtgtttt

SEQ ID NO: 945597 - DNA, 25 bp, Mus musculus
gcttgtcaacagcaggagccatggg

SEQ ID NO: 945598 - DNA, 25 bp, Mus musculus
gcttgtcaacagcgtccaggtgcac

SEQ ID NO: 945599 - DNA, 25 bp, Mus musculus
gcttgtcaacaggaggagccatggg

SEQ ID NO: 945600 - DNA, 25 bp, Mus musculus
gcttgtcaacagggtccaggtgcac

SEQ ID NO: 945601 - DNA, 25 bp, Mus musculus
gcttgtcaagaacacctggggaagt

SEQ ID NO: 945602 - DNA, 25 bp, Mus musculus
gcttgtcaagaacagctggggaagt

SEQ ID NO: 945603 - DNA, 25 bp, Mus musculus
gcttgtcaatgacgcagaattccac

SEQ ID NO: 945604 - DNA, 25 bp, Mus musculus
gcttgtcaatgaggcagaattccac

SEQ ID NO: 945605 - DNA, 25 bp, Mus musculus
gcttgtcagaatcaggtctgataga

SEQ ID NO: 945606 - DNA, 25 bp, Mus musculus
gcttgtcagattcaggtctgataga

SEQ ID NO: 945607 - DNA, 25 bp, Mus musculus
gcttgtctgtcgcgtgctccagctt

SEQ ID NO: 945608 - DNA, 25 bp, Mus musculus
gcttgtctgtcgggtgctccagctt

SEQ ID NO: 945609 - DNA, 25 bp, Mus musculus
gcttgtgcagcatcagtatggaaat

SEQ ID NO: 945610 - DNA, 25 bp, Mus musculus
gcttgtgcaggatcagtatggaaat

SEQ ID NO: 945611 - DNA, 25 bp, Mus musculus
gcttgtggctgcacccgcaggctgg

SEQ ID NO: 945612 - DNA, 25 bp, Mus musculus
gcttgtggctgctcccgcaggctgg

SEQ ID NO: 945613 - DNA, 25 bp, Mus musculus
gcttgtgtctcagttctgcagagca

SEQ ID NO: 945614 - DNA, 25 bp, Mus musculus
gcttgtgtctgagttctgcagagca

SEQ ID NO: 945615 - DNA, 25 bp, Mus musculus
gcttgttaagctgaatgcccttatc

SEQ ID NO: 945616 - DNA, 25 bp, Mus musculus
gcttgttaaggtgaatgcccttatc

SEQ ID NO: 945617 - DNA, 25 bp, Mus musculus
gcttgttgcctgctacgacaacgaa

SEQ ID NO: 945618 - DNA, 25 bp, Mus musculus
gcttgttgcctggtacgacaacgaa

SEQ ID NO: 945619 - DNA, 25 bp, Mus musculus
gctttaacagcttgttccatgccgt

SEQ ID NO: 945620 - DNA, 25 bp, Mus musculus
gctttaacaggttgttccatgccgt

SEQ ID NO: 945621 - DNA, 25 bp, Mus musculus
gctttacaataacattacatctcgc

SEQ ID NO: 945622 - DNA, 25 bp, Mus musculus
gctttacaataagattacatctcgc

SEQ ID NO: 945623 - DNA, 25 bp, Mus musculus
gctttacgagctgctgaatgggctc

SEQ ID NO: 945624 - DNA, 25 bp, Mus musculus
gctttacgaggtgctgaatgggctc

SEQ ID NO: 945625 - DNA, 25 bp, Mus musculus
gctttacttttgctatatcatgtat

SEQ ID NO: 945626 - DNA, 25 bp, Mus musculus
gctttacttttggtatatcatgtat

SEQ ID NO: 945627 - DNA, 25 bp, Mus musculus
gctttagagcctatcgatctgactg

SEQ ID NO: 945628 - DNA, 25 bp, Mus musculus
gctttagagcctatggatctgactg

SEQ ID NO: 945629 - DNA, 25 bp, Mus musculus
gctttagctccgcgactgtggaggc

SEQ ID NO: 945630 - DNA, 25 bp, Mus musculus
gctttagctccgggactgtggaggc

SEQ ID NO: 945631 - DNA, 25 bp, Mus musculus
gctttatcaaagatttcacaaagga

SEQ ID NO: 945632 - DNA, 25 bp, Mus musculus
gctttatcaaagttttcacaaagga

SEQ ID NO: 945633 - DNA, 25 bp, Mus musculus
gctttatcagccgttctgtcaaaga

SEQ ID NO: 945634 - DNA, 25 bp, Mus musculus
gctttatcagcggcgttcaatttgt

SEQ ID NO: 945635 - DNA, 25 bp, Mus musculus
gctttatcaggcgttctgtcaaaga

SEQ ID NO: 945636 - DNA, 25 bp, Mus musculus
gctttatcaggggcgttcaatttgt

SEQ ID NO: 945637 - DNA, 25 bp, Mus musculus
gctttattacaaccgcgaactttcc

SEQ ID NO: 945638 - DNA, 25 bp, Mus musculus
gctttattacaagcgcgaactttcc

SEQ ID NO: 945639 - DNA, 25 bp, Mus musculus
gctttattgtgacacgtacctgtgt

SEQ ID NO: 945640 - DNA, 25 bp, Mus musculus
gctttattgtgacaggtacctgtgt

SEQ ID NO: 945641 - DNA, 25 bp, Mus musculus
gctttcaaagccattggcacagcgt

SEQ ID NO: 945642 - DNA, 25 bp, Mus musculus
gctttcaaaggacaagtatttgtgc

SEQ ID NO: 945643 - DNA, 25 bp, Mus musculus
gctttcaaaggacatgtatttgtgc

SEQ ID NO: 945644 - DNA, 25 bp, Mus musculus
gctttcaaaggcattggcacagcgt

SEQ ID NO: 945645 - DNA, 25 bp, Mus musculus
gctttcaactctatggtcttgggca

SEQ ID NO: 945646 - DNA, 25 bp, Mus musculus
gctttcaactgtatggtcttgggca

SEQ ID NO: 945647 - DNA, 25 bp, Mus musculus
gctttcaccatacagccaatcatca

SEQ ID NO: 945648 - DNA, 25 bp, Mus musculus
gctttcaccatagagccaatcatca

SEQ ID NO: 945649 - DNA, 25 bp, Mus musculus
gctttcagagccagaaggcttgttg

SEQ ID NO: 945650 - DNA, 25 bp, Mus musculus
gctttcagagctttacaggtggtca

SEQ ID NO: 945651 - DNA, 25 bp, Mus musculus
gctttcagaggcagaaggcttgttg

SEQ ID NO: 945652 - DNA, 25 bp, Mus musculus
gctttcagaggtttacaggtggtca

SEQ ID NO: 945653 - DNA, 25 bp, Mus musculus
gctttcagatcacaacctgcaagaa

SEQ ID NO: 945654 - DNA, 25 bp, Mus musculus
gctttcagatcagaacctgcaagaa

SEQ ID NO: 945655 - DNA, 25 bp, Mus musculus
gctttccagcaacatgtgagcttat

SEQ ID NO: 945656 - DNA, 25 bp, Mus musculus
gctttccagcaagatgtgagcttat

SEQ ID NO: 945657 - DNA, 25 bp, Mus musculus
gctttccgcaagcccctttatggga

SEQ ID NO: 945658 - DNA, 25 bp, Mus musculus
gctttccgcaaggccctttatggga

SEQ ID NO: 945659 - DNA, 25 bp, Mus musculus
gctttcctggaaaattgttgtgtct

SEQ ID NO: 945660 - DNA, 25 bp, Mus musculus
gctttcctggaatattgttgtgtct

SEQ ID NO: 945661 - DNA, 25 bp, Mus musculus
gctttcctggcacacaaacatcatc

SEQ ID NO: 945662 - DNA, 25 bp, Mus musculus
gctttcctggcacaccaagcttccc

SEQ ID NO: 945663 - DNA, 25 bp, Mus musculus
gctttcctggcacagaaacatcatc

SEQ ID NO: 945664 - DNA, 25 bp, Mus musculus
gctttcctggcacagcaagcttccc

SEQ ID NO: 945665 - DNA, 25 bp, Mus musculus
gctttccttccactaacgttcatgt

SEQ ID NO: 945666 - DNA, 25 bp, Mus musculus
gctttccttccagtaacgttcatgt

SEQ ID NO: 945667 - DNA, 25 bp, Mus musculus
gctttcgacccgaggactatctcca

SEQ ID NO: 945668 - DNA, 25 bp, Mus musculus
gctttcgacccgtggactatctcca

SEQ ID NO: 945669 - DNA, 25 bp, Mus musculus
gctttctacaagcgatttatcaaag

SEQ ID NO: 945670 - DNA, 25 bp, Mus musculus
gctttctacaagggatttatcaaag

SEQ ID NO: 945671 - DNA, 25 bp, Mus musculus
gctttctcccagctgctcaccattg

SEQ ID NO: 945672 - DNA, 25 bp, Mus musculus
gctttctcccaggtgctcaccattg

SEQ ID NO: 945673 - DNA, 25 bp, Mus musculus
gctttctctgggaatgtgattttcc

SEQ ID NO: 945674 - DNA, 25 bp, Mus musculus
gctttctctgggtatgtgattttcc

SEQ ID NO: 945675 - DNA, 25 bp, Mus musculus
gctttctgaaagcgtgaaggctgca

SEQ ID NO: 945676 - DNA, 25 bp, Mus musculus
gctttctgaaagggtgaaggctgca

SEQ ID NO: 945677 - DNA, 25 bp, Mus musculus
gctttctgatcacgtgttgtttgtg

SEQ ID NO: 945678 - DNA, 25 bp, Mus musculus
gctttctgatcaggtgttgtttgtg

SEQ ID NO: 945679 - DNA, 25 bp, Mus musculus
gctttctgcagagacaatagtgtga

SEQ ID NO: 945680 - DNA, 25 bp, Mus musculus
gctttctgcagagagaatagtgtga

SEQ ID NO: 945681 - DNA, 25 bp, Mus musculus
gctttctgccagagatttgagcaat

SEQ ID NO: 945682 - DNA, 25 bp, Mus musculus
gctttctgccagtgatttgagcaat

SEQ ID NO: 945683 - DNA, 25 bp, Mus musculus
gctttgacagctgcaggtcctggtg

SEQ ID NO: 945684 - DNA, 25 bp, Mus musculus
gctttgacaggtgcaggtcctggtg

SEQ ID NO: 945685 - DNA, 25 bp, Mus musculus
gctttgataaggacaagttaaccat

SEQ ID NO: 945686 - DNA, 25 bp, Mus musculus
gctttgataaggtcaagttaaccat

SEQ ID NO: 945687 - DNA, 25 bp, Mus musculus
gctttgattccacctttgatgttca

SEQ ID NO: 945688 - DNA, 25 bp, Mus musculus
gctttgattccagctttgatgttca

SEQ ID NO: 945689 - DNA, 25 bp, Mus musculus
gctttgcaagcatggagtcaacaga

SEQ ID NO: 945690 - DNA, 25 bp, Mus musculus
gctttgcaaggatggagtcaacaga

SEQ ID NO: 945691 - DNA, 25 bp, Mus musculus
gctttgcagagccacatcactatgt

SEQ ID NO: 945692 - DNA, 25 bp, Mus musculus
gctttgcagagccagatcactatgt

SEQ ID NO: 945693 - DNA, 25 bp, Mus musculus
gctttgcatgtcatcggtgaagata

SEQ ID NO: 945694 - DNA, 25 bp, Mus musculus
gctttgcatgtcatgggtgaagata

SEQ ID NO: 945695 - DNA, 25 bp, Mus musculus
gctttgccagcaatctggtctgtct

SEQ ID NO: 945696 - DNA, 25 bp, Mus musculus
gctttgccagcatggaatcaacgga

SEQ ID NO: 945697 - DNA, 25 bp, Mus musculus
gctttgccaggaatctggtctgtct

SEQ ID NO: 945698 - DNA, 25 bp, Mus musculus
gctttgccaggatggaatcaacgga

SEQ ID NO: 945699 - DNA, 25 bp, Mus musculus
gctttggaagaaagccttgttggag

SEQ ID NO: 945700 - DNA, 25 bp, Mus musculus
gctttggaagaaaggcttgttggag

SEQ ID NO: 945701 - DNA, 25 bp, Mus musculus
gctttggactggcagctgaagttgg

SEQ ID NO: 945702 - DNA, 25 bp, Mus musculus
gctttggactgggagctgaagttgg

SEQ ID NO: 945703 - DNA, 25 bp, Mus musculus
gctttggatgagccttcggaggcca

SEQ ID NO: 945704 - DNA, 25 bp, Mus musculus
gctttggatgagtgtgaactggact

SEQ ID NO: 945705 - DNA, 25 bp, Mus musculus
gctttggatgcctcccggacctctg

SEQ ID NO: 945706 - DNA, 25 bp, Mus musculus
gctttggatgctgatgatgaagatg

SEQ ID NO: 945707 - DNA, 25 bp, Mus musculus
gctttggatggctcccggacctctg

SEQ ID NO: 945708 - DNA, 25 bp, Mus musculus
gctttggatggtgatgatgaagatg

SEQ ID NO: 945709 - DNA, 25 bp, Mus musculus
gctttggatgtgccttcggaggcca

SEQ ID NO: 945710 - DNA, 25 bp, Mus musculus
gctttggatgtgtgtgaactggact

SEQ ID NO: 945711 - DNA, 25 bp, Mus musculus
gctttggcagacgcaactctatgct

SEQ ID NO: 945712 - DNA, 25 bp, Mus musculus
gctttggcagcgcatctccatcttt

SEQ ID NO: 945713 - DNA, 25 bp, Mus musculus
gctttggcagcggatctccatcttt

SEQ ID NO: 945714 - DNA, 25 bp, Mus musculus
gctttggcagtcgcaactctatgct

SEQ ID NO: 945715 - DNA, 25 bp, Mus musculus
gctttgggcttcatgtgtccattgt

SEQ ID NO: 945716 - DNA, 25 bp, Mus musculus
gctttgggcttcttgtgtccattgt

SEQ ID NO: 945717 - DNA, 25 bp, Mus musculus
gctttgggtcagatgatccctattc

SEQ ID NO: 945718 - DNA, 25 bp, Mus musculus
gctttgggtcagttgatccctattc

SEQ ID NO: 945719 - DNA, 25 bp, Mus musculus
gctttgtaatctcgcattgtaaggg

SEQ ID NO: 945720 - DNA, 25 bp, Mus musculus
gctttgtaatctcggattgtaaggg

SEQ ID NO: 945721 - DNA, 25 bp, Mus musculus
gctttgtctcaacattgccagcgag

SEQ ID NO: 945722 - DNA, 25 bp, Mus musculus
gctttgtctcaagattgccagcgag

SEQ ID NO: 945723 - DNA, 25 bp, Mus musculus
gctttgtggcccagcatgacaacga

SEQ ID NO: 945724 - DNA, 25 bp, Mus musculus
gctttgtggcccaggatgacaacga

SEQ ID NO: 945725 - DNA, 25 bp, Mus musculus
gctttgtgggcaaacgtattgactt

SEQ ID NO: 945726 - DNA, 25 bp, Mus musculus
gctttgtgggcaaaggtattgactt

SEQ ID NO: 945727 - DNA, 25 bp, Mus musculus
gcttttaaatcccactttggtgcct

SEQ ID NO: 945728 - DNA, 25 bp, Mus musculus
gcttttaaatcccagtttggtgcct

SEQ ID NO: 945729 - DNA, 25 bp, Mus musculus
gcttttaatgatctagtgaagccag

SEQ ID NO: 945730 - DNA, 25 bp, Mus musculus
gcttttaatgttctagtgaagccag

SEQ ID NO: 945731 - DNA, 25 bp, Mus musculus
gcttttacatttctcataatccttc

SEQ ID NO: 945732 - DNA, 25 bp, Mus musculus
gcttttacatttgtcataatccttc

SEQ ID NO: 945733 - DNA, 25 bp, Mus musculus
gcttttagagatgacgctggagggg

SEQ ID NO: 945734 - DNA, 25 bp, Mus musculus
gcttttagagatgaggctggagggg

SEQ ID NO: 945735 - DNA, 25 bp, Mus musculus
gcttttagagctttgtgaagtatac

SEQ ID NO: 945736 - DNA, 25 bp, Mus musculus
gcttttagaggtttgtgaagtatac

SEQ ID NO: 945737 - DNA, 25 bp, Mus musculus
gcttttagcccacatagtcgccaca

SEQ ID NO: 945738 - DNA, 25 bp, Mus musculus
gcttttagcccagatagtcgccaca

SEQ ID NO: 945739 - DNA, 25 bp, Mus musculus
gcttttatcaattattttcaaaagt

SEQ ID NO: 945740 - DNA, 25 bp, Mus musculus
gcttttatcatttattttcaaaagt

SEQ ID NO: 945741 - DNA, 25 bp, Mus musculus
gcttttatctccacaggattaaaat

SEQ ID NO: 945742 - DNA, 25 bp, Mus musculus
gcttttatctccactggattaaaat

SEQ ID NO: 945743 - DNA, 25 bp, Mus musculus
gcttttattatacacgacacagtga

SEQ ID NO: 945744 - DNA, 25 bp, Mus musculus
gcttttattatacaggacacagtga

SEQ ID NO: 945745 - DNA, 25 bp, Mus musculus
gcttttcacgcaaggagttcgctct

SEQ ID NO: 945746 - DNA, 25 bp, Mus musculus
gcttttcacggaaggagttcgctct

SEQ ID NO: 945747 - DNA, 25 bp, Mus musculus
gcttttcagcaactcgtcaattttt

SEQ ID NO: 945748 - DNA, 25 bp, Mus musculus
gcttttcagcaactggtcaattttt

SEQ ID NO: 945749 - DNA, 25 bp, Mus musculus
gcttttcctttgagaccatcagcag

SEQ ID NO: 945750 - DNA, 25 bp, Mus musculus
gcttttcctttgagtccatcagcag

SEQ ID NO: 945751 - DNA, 25 bp, Mus musculus
gcttttctacaaccctcctgagccg

SEQ ID NO: 945752 - DNA, 25 bp, Mus musculus
gcttttctacaagcctcctgagccg

SEQ ID NO: 945753 - DNA, 25 bp, Mus musculus
gcttttgcagagaagaatggtttgt

SEQ ID NO: 945754 - DNA, 25 bp, Mus musculus
gcttttgcagagctttcctggcaga

SEQ ID NO: 945755 - DNA, 25 bp, Mus musculus
gcttttgcagaggtttcctggcaga

SEQ ID NO: 945756 - DNA, 25 bp, Mus musculus
gcttttgcagctggctttgcagctg

SEQ ID NO: 945757 - DNA, 25 bp, Mus musculus
gcttttgcagcttttagaagatggc

SEQ ID NO: 945758 - DNA, 25 bp, Mus musculus
gcttttgcaggtggctttgcagctg

SEQ ID NO: 945759 - DNA, 25 bp, Mus musculus
gcttttgcaggttttagaagatggc

SEQ ID NO: 945760 - DNA, 25 bp, Mus musculus
gcttttgcagtgaagaatggtttgt

SEQ ID NO: 945761 - DNA, 25 bp, Mus musculus
gcttttgctatgcccagacttcata

SEQ ID NO: 945762 - DNA, 25 bp, Mus musculus
gcttttgctatgccgagacttcata

SEQ ID NO: 945763 - DNA, 25 bp, Mus musculus
gcttttggaagtcaagtttggtgag

SEQ ID NO: 945764 - DNA, 25 bp, Mus musculus
gcttttggaagtgaagtttggtgag

SEQ ID NO: 945765 - DNA, 25 bp, Mus musculus
gcttttggcaagccttacaggagta

SEQ ID NO: 945766 - DNA, 25 bp, Mus musculus
gcttttggcaaggcttacaggagta

SEQ ID NO: 945767 - DNA, 25 bp, Mus musculus
gcttttgtctgcaaccttcacttga

SEQ ID NO: 945768 - DNA, 25 bp, Mus musculus
gcttttgtctgcaagcttcacttga

SEQ ID NO: 945769 - DNA, 25 bp, Mus musculus
gcttttgtgccgcacgtcgagattt

SEQ ID NO: 945770 - DNA, 25 bp, Mus musculus
gcttttgtgccgcaggtcgagattt

SEQ ID NO: 945771 - DNA, 25 bp, Mus musculus
gctttttaacaacgtgaactgaaga

SEQ ID NO: 945772 - DNA, 25 bp, Mus musculus
gctttttaacaaggtgaactgaaga

SEQ ID NO: 945773 - DNA, 25 bp, Mus musculus
gctttttggccgcacgttctctcca

SEQ ID NO: 945774 - DNA, 25 bp, Mus musculus
gctttttggccgcaggttctctcca

SEQ ID NO: 945775 - DNA, 25 bp, Mus musculus
ggaaaaaattattacatggaccatc

SEQ ID NO: 945776 - DNA, 25 bp, Mus musculus
ggaaaaaattattagatggaccatc

SEQ ID NO: 945777 - DNA, 25 bp, Mus musculus
ggaaaaacagaggccagcaagctcg

SEQ ID NO: 945778 - DNA, 25 bp, Mus musculus
ggaaaaacagtggccagcaagctcg

SEQ ID NO: 945779 - DNA, 25 bp, Mus musculus
ggaaaaagctcgccacccccatcag

SEQ ID NO: 945780 - DNA, 25 bp, Mus musculus
ggaaaaagctcggcacccccatcag

SEQ ID NO: 945781 - DNA, 25 bp, Mus musculus
ggaaaaaggaagctcatcgtggaga

SEQ ID NO: 945782 - DNA, 25 bp, Mus musculus
ggaaaaaggaaggtcatcgtggaga

SEQ ID NO: 945783 - DNA, 25 bp, Mus musculus
ggaaaaatatatctccgagaacatt

SEQ ID NO: 945784 - DNA, 25 bp, Mus musculus
ggaaaaatatatctgcgagaacatt

SEQ ID NO: 945785 - DNA, 25 bp, Mus musculus
ggaaaacaagatctcaaagacggaa

SEQ ID NO: 945786 - DNA, 25 bp, Mus musculus
ggaaaacaagttctcaaagacggaa

SEQ ID NO: 945787 - DNA, 25 bp, Mus musculus
ggaaaacaccacaacttatgaagaa

SEQ ID NO: 945788 - DNA, 25 bp, Mus musculus
ggaaaacaccacaagttatgaagaa

SEQ ID NO: 945789 - DNA, 25 bp, Mus musculus
ggaaaacagaataataacaattgaa

SEQ ID NO: 945790 - DNA, 25 bp, Mus musculus
ggaaaacagaattataacaattgaa

SEQ ID NO: 945791 - DNA, 25 bp, Mus musculus
ggaaaaccaatgcctcaccctgtga

SEQ ID NO: 945792 - DNA, 25 bp, Mus musculus
ggaaaaccaatggctcaccctgtga

SEQ ID NO: 945793 - DNA, 25 bp, Mus musculus
ggaaaaccagagtccagcctctgaa

SEQ ID NO: 945794 - DNA, 25 bp, Mus musculus
ggaaaaccagcttgctggtgaccag

SEQ ID NO: 945795 - DNA, 25 bp, Mus musculus
ggaaaaccaggttgctggtgaccag

SEQ ID NO: 945796 - DNA, 25 bp, Mus musculus
ggaaaaccagtgtccagcctctgaa

SEQ ID NO: 945797 - DNA, 25 bp, Mus musculus
ggaaaaccataccaaaatggcagac

SEQ ID NO: 945798 - DNA, 25 bp, Mus musculus
ggaaaaccataccataatggcagac

SEQ ID NO: 945799 - DNA, 25 bp, Mus musculus
ggaaaacctgtggacatattgatga

SEQ ID NO: 945800 - DNA, 25 bp, Mus musculus
ggaaaacctgtggagatattgatga

SEQ ID NO: 945801 - DNA, 25 bp, Mus musculus
ggaaaacgaaactgcctggaagaat

SEQ ID NO: 945802 - DNA, 25 bp, Mus musculus
ggaaaacgaaactggctggaagaat

SEQ ID NO: 945803 - DNA, 25 bp, Mus musculus
ggaaaactgtcccgccaggtatcat

SEQ ID NO: 945804 - DNA, 25 bp, Mus musculus
ggaaaactgtccggccaggtatcat

SEQ ID NO: 945805 - DNA, 25 bp, Mus musculus
ggaaaagaaagacagttcgatgccc

SEQ ID NO: 945806 - DNA, 25 bp, Mus musculus
ggaaaagaaagagagttcgatgccc

SEQ ID NO: 945807 - DNA, 25 bp, Mus musculus
ggaaaagaaccgacgagctcacctg

SEQ ID NO: 945808 - DNA, 25 bp, Mus musculus
ggaaaagaaccgaggctctccaggc

SEQ ID NO: 945809 - DNA, 25 bp, Mus musculus
ggaaaagaaccgtcgagctcacctg

SEQ ID NO: 945810 - DNA, 25 bp, Mus musculus
ggaaaagaaccgtggctctccaggc

SEQ ID NO: 945811 - DNA, 25 bp, Mus musculus
ggaaaagagctgcattctaatccct

SEQ ID NO: 945812 - DNA, 25 bp, Mus musculus
ggaaaagagctggattctaatccct

SEQ ID NO: 945813 - DNA, 25 bp, Mus musculus
ggaaaagataagatgaggaatttaa

SEQ ID NO: 945814 - DNA, 25 bp, Mus musculus
ggaaaagatatgatgaggaatttaa

SEQ ID NO: 945815 - DNA, 25 bp, Mus musculus
ggaaaagcagccatatattcagctt

SEQ ID NO: 945816 - DNA, 25 bp, Mus musculus
ggaaaagcaggcatatattcagctt

SEQ ID NO: 945817 - DNA, 25 bp, Mus musculus
ggaaaagcgaggaggcggctcagtg

SEQ ID NO: 945818 - DNA, 25 bp, Mus musculus
ggaaaagcgaggtggcggctcagtg

SEQ ID NO: 945819 - DNA, 25 bp, Mus musculus
ggaaaagcggccatcttctgtcacc

SEQ ID NO: 945820 - DNA, 25 bp, Mus musculus
ggaaaagcgggcatcttctgtcacc

SEQ ID NO: 945821 - DNA, 25 bp, Mus musculus
ggaaaagcgtgacactgaagcgcta

SEQ ID NO: 945822 - DNA, 25 bp, Mus musculus
ggaaaagcgtgacagtgaagcgcta

SEQ ID NO: 945823 - DNA, 25 bp, Mus musculus
ggaaaaggacagaatcatagagatt

SEQ ID NO: 945824 - DNA, 25 bp, Mus musculus
ggaaaaggacagtatcatagagatt

SEQ ID NO: 945825 - DNA, 25 bp, Mus musculus
ggaaaagggcgtccacagtggtaaa

SEQ ID NO: 945826 - DNA, 25 bp, Mus musculus
ggaaaagggcgtgcacagtggtaaa

SEQ ID NO: 945827 - DNA, 25 bp, Mus musculus
ggaaaagtaaagcgattgcttatat

SEQ ID NO: 945828 - DNA, 25 bp, Mus musculus
ggaaaagtaaagggattgcttatat

SEQ ID NO: 945829 - DNA, 25 bp, Mus musculus
ggaaaagtgcatcactcactggcag

SEQ ID NO: 945830 - DNA, 25 bp, Mus musculus
ggaaaagtgcatcagtcactggcag

SEQ ID NO: 945831 - DNA, 25 bp, Mus musculus
ggaaaagtgtgacaccatccatgtg

SEQ ID NO: 945832 - DNA, 25 bp, Mus musculus
ggaaaagtgtgagaccatccatgtg

SEQ ID NO: 945833 - DNA, 25 bp, Mus musculus
ggaaaataagatctgaaaatcaact

SEQ ID NO: 945834 - DNA, 25 bp, Mus musculus
ggaaaataagttctgaaaatcaact

SEQ ID NO: 945835 - DNA, 25 bp, Mus musculus
ggaaaatacagaactgtgtcagcat

SEQ ID NO: 945836 - DNA, 25 bp, Mus musculus
ggaaaatacagaccatacgatgcga

SEQ ID NO: 945837 - DNA, 25 bp, Mus musculus
ggaaaatacagagcatacgatgcga

SEQ ID NO: 945838 - DNA, 25 bp, Mus musculus
ggaaaatacagatctgtgtcagcat

SEQ ID NO: 945839 - DNA, 25 bp, Mus musculus
ggaaaatatcagcaaggagatgaaa

SEQ ID NO: 945840 - DNA, 25 bp, Mus musculus
ggaaaatatcaggaaggagatgaaa

SEQ ID NO: 945841 - DNA, 25 bp, Mus musculus
ggaaaatccacacagtttatcagac

SEQ ID NO: 945842 - DNA, 25 bp, Mus musculus
ggaaaatccacagagtttatcagac

SEQ ID NO: 945843 - DNA, 25 bp, Mus musculus
ggaaaatccccacacatttgacctc

SEQ ID NO: 945844 - DNA, 25 bp, Mus musculus
ggaaaatccccacagatttgacctc

SEQ ID NO: 945845 - DNA, 25 bp, Mus musculus
ggaaaatctttgatctcattggatt

SEQ ID NO: 945846 - DNA, 25 bp, Mus musculus
ggaaaatctttgttctcattggatt

SEQ ID NO: 945847 - DNA, 25 bp, Mus musculus
ggaaaatggctcagggggagcaccg

SEQ ID NO: 945848 - DNA, 25 bp, Mus musculus
ggaaaatggctctgggggagcaccg

SEQ ID NO: 945849 - DNA, 25 bp, Mus musculus
ggaaaatggctgccaaatggcacct

SEQ ID NO: 945850 - DNA, 25 bp, Mus musculus
ggaaaatggctgcctaatggcacct

SEQ ID NO: 945851 - DNA, 25 bp, Mus musculus
ggaaaattgcaccacgtgatgttat

SEQ ID NO: 945852 - DNA, 25 bp, Mus musculus
ggaaaattgcaccaggtgatgttat

SEQ ID NO: 945853 - DNA, 25 bp, Mus musculus
ggaaacaaaatttaagtacttatca

SEQ ID NO: 945854 - DNA, 25 bp, Mus musculus
ggaaacaaaatttatgtacttatca

SEQ ID NO: 945855 - DNA, 25 bp, Mus musculus
ggaaacatagagaggaactacaaga

SEQ ID NO: 945856 - DNA, 25 bp, Mus musculus
ggaaacatagagtggaactacaaga

SEQ ID NO: 945857 - DNA, 25 bp, Mus musculus
ggaaaccagagaagggcaagtcctg

SEQ ID NO: 945858 - DNA, 25 bp, Mus musculus
ggaaaccagagatgggcaagtcctg

SEQ ID NO: 945859 - DNA, 25 bp, Mus musculus
ggaaaccagagccaagcggtgctct

SEQ ID NO: 945860 - DNA, 25 bp, Mus musculus
ggaaaccagagccaagtggaaccag

SEQ ID NO: 945861 - DNA, 25 bp, Mus musculus
ggaaaccagagccatgcggtgctct

SEQ ID NO: 945862 - DNA, 25 bp, Mus musculus
ggaaaccagagccatgtggaaccag

SEQ ID NO: 945863 - DNA, 25 bp, Mus musculus
ggaaacggatttaggcaagtcaagc

SEQ ID NO: 945864 - DNA, 25 bp, Mus musculus
ggaaacggattttggcaagtcaagc

SEQ ID NO: 945865 - DNA, 25 bp, Mus musculus
ggaaactaagccattactcatcagt

SEQ ID NO: 945866 - DNA, 25 bp, Mus musculus
ggaaactaagcctggccttgtggta

SEQ ID NO: 945867 - DNA, 25 bp, Mus musculus
ggaaactaaggcattactcatcagt

SEQ ID NO: 945868 - DNA, 25 bp, Mus musculus
ggaaactaaggctggccttgtggta

SEQ ID NO: 945869 - DNA, 25 bp, Mus musculus
ggaaactctccccccatcttcatca

SEQ ID NO: 945870 - DNA, 25 bp, Mus musculus
ggaaactctcccgccatcttcatca

SEQ ID NO: 945871 - DNA, 25 bp, Mus musculus
ggaaactgagcaatttgctctgtaa

SEQ ID NO: 945872 - DNA, 25 bp, Mus musculus
ggaaactgagcacattaatccagta

SEQ ID NO: 945873 - DNA, 25 bp, Mus musculus
ggaaactgagcaccaaacaacatgt

SEQ ID NO: 945874 - DNA, 25 bp, Mus musculus
ggaaactgagcaccaagcttacaat

SEQ ID NO: 945875 - DNA, 25 bp, Mus musculus
ggaaactgagcaccagaataaagat

SEQ ID NO: 945876 - DNA, 25 bp, Mus musculus
ggaaactgagcagattaatccagta

SEQ ID NO: 945877 - DNA, 25 bp, Mus musculus
ggaaactgagcagcaaacaacatgt

SEQ ID NO: 945878 - DNA, 25 bp, Mus musculus
ggaaactgagcagcaagcttacaat

SEQ ID NO: 945879 - DNA, 25 bp, Mus musculus
ggaaactgagcagcagaataaagat

SEQ ID NO: 945880 - DNA, 25 bp, Mus musculus
ggaaactgagcattttgctctgtaa

SEQ ID NO: 945881 - DNA, 25 bp, Mus musculus
ggaaactgctacagcgttagcattc

SEQ ID NO: 945882 - DNA, 25 bp, Mus musculus
ggaaactgctacagggttagcattc

SEQ ID NO: 945883 - DNA, 25 bp, Mus musculus
ggaaacttggagcaggcaccgctcc

SEQ ID NO: 945884 - DNA, 25 bp, Mus musculus
ggaaacttggaggaggcaccgctcc

SEQ ID NO: 945885 - DNA, 25 bp, Mus musculus
ggaaagaaaacactgacaacataag

SEQ ID NO: 945886 - DNA, 25 bp, Mus musculus
ggaaagaaaacagtgacaacataag

SEQ ID NO: 945887 - DNA, 25 bp, Mus musculus
ggaaagacgaagctcttcctgaagg

SEQ ID NO: 945888 - DNA, 25 bp, Mus musculus
ggaaagacgaaggtcttcctgaagg

SEQ ID NO: 945889 - DNA, 25 bp, Mus musculus
ggaaagagagcaaacctgtcattct

SEQ ID NO: 945890 - DNA, 25 bp, Mus musculus
ggaaagagagcaaagctgtcattct

SEQ ID NO: 945891 - DNA, 25 bp, Mus musculus
ggaaagagccaaaccagccacaatc

SEQ ID NO: 945892 - DNA, 25 bp, Mus musculus
ggaaagagccaaacgagccacaatc

SEQ ID NO: 945893 - DNA, 25 bp, Mus musculus
ggaaagatattgagtcatataaaag

SEQ ID NO: 945894 - DNA, 25 bp, Mus musculus
ggaaagatattgtgtcatataaaag

SEQ ID NO: 945895 - DNA, 25 bp, Mus musculus
ggaaagattgagttcaggagggggc

SEQ ID NO: 945896 - DNA, 25 bp, Mus musculus
ggaaagattgtgttcaggagggggc

SEQ ID NO: 945897 - DNA, 25 bp, Mus musculus
ggaaagccgacaagggtgacaggat

SEQ ID NO: 945898 - DNA, 25 bp, Mus musculus
ggaaagccgagaagggtgacaggat

SEQ ID NO: 945899 - DNA, 25 bp, Mus musculus
ggaaagcgagaacctagtcaagaac

SEQ ID NO: 945900 - DNA, 25 bp, Mus musculus
ggaaagcgagaagctagtcaagaac

SEQ ID NO: 945901 - DNA, 25 bp, Mus musculus
ggaaagctcagacctgccgagagca

SEQ ID NO: 945902 - DNA, 25 bp, Mus musculus
ggaaagctcagagctgccgagagca

SEQ ID NO: 945903 - DNA, 25 bp, Mus musculus
ggaaagctcatgcgcggactggaca

SEQ ID NO: 945904 - DNA, 25 bp, Mus musculus
ggaaagctcatgggcggactggaca

SEQ ID NO: 945905 - DNA, 25 bp, Mus musculus
ggaaagctgatgaatgcacccttgt

SEQ ID NO: 945906 - DNA, 25 bp, Mus musculus
ggaaagctgatgtatgcacccttgt

SEQ ID NO: 945907 - DNA, 25 bp, Mus musculus
ggaaaggaagaggagccgctgctgc

SEQ ID NO: 945908 - DNA, 25 bp, Mus musculus
ggaaaggaagtggagccgctgctgc

SEQ ID NO: 945909 - DNA, 25 bp, Mus musculus
ggaaaggatgcactgtgtggctgca

SEQ ID NO: 945910 - DNA, 25 bp, Mus musculus
ggaaaggatgcagtgtgtggctgca

SEQ ID NO: 945911 - DNA, 25 bp, Mus musculus
ggaaaggcagctgtccacagccatg

SEQ ID NO: 945912 - DNA, 25 bp, Mus musculus
ggaaaggcaggtgtccacagccatg

SEQ ID NO: 945913 - DNA, 25 bp, Mus musculus
ggaaaggctccaaacgttctgaaga

SEQ ID NO: 945914 - DNA, 25 bp, Mus musculus
ggaaaggctccaaaggttctgaaga

SEQ ID NO: 945915 - DNA, 25 bp, Mus musculus
ggaaaggtgaaccctgctggttgtc

SEQ ID NO: 945916 - DNA, 25 bp, Mus musculus
ggaaaggtgaacgctgctggttgtc

SEQ ID NO: 945917 - DNA, 25 bp, Mus musculus
ggaaagtgagatacatgaacatgca

SEQ ID NO: 945918 - DNA, 25 bp, Mus musculus
ggaaagtgagttacatgaacatgca

SEQ ID NO: 945919 - DNA, 25 bp, Mus musculus
ggaaagtgtatcaaagcaaagtcct

SEQ ID NO: 945920 - DNA, 25 bp, Mus musculus
ggaaagtgtatcacaaagtcctgtg

SEQ ID NO: 945921 - DNA, 25 bp, Mus musculus
ggaaagtgtatctaagcaaagtcct

SEQ ID NO: 945922 - DNA, 25 bp, Mus musculus
ggaaagtgtatctcaaagtcctgtg

SEQ ID NO: 945923 - DNA, 25 bp, Mus musculus
ggaaagttgcacaattatcccctaa

SEQ ID NO: 945924 - DNA, 25 bp, Mus musculus
ggaaagttgcactattatcccctaa

SEQ ID NO: 945925 - DNA, 25 bp, Mus musculus
ggaaatacagcaaccaaagtcaaag

SEQ ID NO: 945926 - DNA, 25 bp, Mus musculus
ggaaatacaggaaccaaagtcaaag

SEQ ID NO: 945927 - DNA, 25 bp, Mus musculus
ggaaataccgtacatgggtacagta

SEQ ID NO: 945928 - DNA, 25 bp, Mus musculus
ggaaataccgtagatgggtacagta

SEQ ID NO: 945929 - DNA, 25 bp, Mus musculus
ggaaatactgaacgataagaaactg

SEQ ID NO: 945930 - DNA, 25 bp, Mus musculus
ggaaatactgaaggataagaaactg

SEQ ID NO: 945931 - DNA, 25 bp, Mus musculus
ggaaatagcgcgtaccactgatggt

SEQ ID NO: 945932 - DNA, 25 bp, Mus musculus
ggaaatagcgggtaccactgatggt

SEQ ID NO: 945933 - DNA, 25 bp, Mus musculus
ggaaatagtctgccagtgaaaggat

SEQ ID NO: 945934 - DNA, 25 bp, Mus musculus
ggaaatagtctgcctgtgaaaggat

SEQ ID NO: 945935 - DNA, 25 bp, Mus musculus
ggaaatatccagagcgacgagattt

SEQ ID NO: 945936 - DNA, 25 bp, Mus musculus
ggaaatatccagatttagagcgacg

SEQ ID NO: 945937 - DNA, 25 bp, Mus musculus
ggaaatatccagtgcgacgagattt

SEQ ID NO: 945938 - DNA, 25 bp, Mus musculus
ggaaatatccagttttagagcgacg

SEQ ID NO: 945939 - DNA, 25 bp, Mus musculus
ggaaatcacgaacatagcctgtatt

SEQ ID NO: 945940 - DNA, 25 bp, Mus musculus
ggaaatcacgaagatagcctgtatt

SEQ ID NO: 945941 - DNA, 25 bp, Mus musculus
ggaaatccacaaccatcgatactgg

SEQ ID NO: 945942 - DNA, 25 bp, Mus musculus
ggaaatccacaagcatcgatactgg

SEQ ID NO: 945943 - DNA, 25 bp, Mus musculus
ggaaatccagcctgttcatcagcag

SEQ ID NO: 945944 - DNA, 25 bp, Mus musculus
ggaaatccagcgcagagatgacctc

SEQ ID NO: 945945 - DNA, 25 bp, Mus musculus
ggaaatccaggctgttcatcagcag

SEQ ID NO: 945946 - DNA, 25 bp, Mus musculus
ggaaatccagggcagagatgacctc

SEQ ID NO: 945947 - DNA, 25 bp, Mus musculus
ggaaatccgacacggcttcttcaca

SEQ ID NO: 945948 - DNA, 25 bp, Mus musculus
ggaaatccgacagggcttcttcaca

SEQ ID NO: 945949 - DNA, 25 bp, Mus musculus
ggaaatcctcagcggattggcacat

SEQ ID NO: 945950 - DNA, 25 bp, Mus musculus
ggaaatcctcaggggattggcacat

SEQ ID NO: 945951 - DNA, 25 bp, Mus musculus
ggaaatcctgccaacaagggatcgc

SEQ ID NO: 945952 - DNA, 25 bp, Mus musculus
ggaaatcctggcaacaagggatcgc

SEQ ID NO: 945953 - DNA, 25 bp, Mus musculus
ggaaatcctgtgctgggagcatgcc

SEQ ID NO: 945954 - DNA, 25 bp, Mus musculus
ggaaatcctgtggtgggagcatgcc

SEQ ID NO: 945955 - DNA, 25 bp, Mus musculus
ggaaatccttagcacgaaggaggct

SEQ ID NO: 945956 - DNA, 25 bp, Mus musculus
ggaaatccttagcaggaaggaggct

SEQ ID NO: 945957 - DNA, 25 bp, Mus musculus
ggaaatcggtggaacttctgttgag

SEQ ID NO: 945958 - DNA, 25 bp, Mus musculus
ggaaatcggtggaagttctgttgag

SEQ ID NO: 945959 - DNA, 25 bp, Mus musculus
ggaaatctagaagacgaacaagaga

SEQ ID NO: 945960 - DNA, 25 bp, Mus musculus
ggaaatctagaagaggaacaagaga

SEQ ID NO: 945961 - DNA, 25 bp, Mus musculus
ggaaatctagagttctccagtttta

SEQ ID NO: 945962 - DNA, 25 bp, Mus musculus
ggaaatctagtgttctccagtttta

SEQ ID NO: 945963 - DNA, 25 bp, Mus musculus
ggaaatgagacgagctggagatcaa

SEQ ID NO: 945964 - DNA, 25 bp, Mus musculus
ggaaatgagacgcaagctgccactt

SEQ ID NO: 945965 - DNA, 25 bp, Mus musculus
ggaaatgagacggaagctgccactt

SEQ ID NO: 945966 - DNA, 25 bp, Mus musculus
ggaaatgagacgtgctggagatcaa

SEQ ID NO: 945967 - DNA, 25 bp, Mus musculus
ggaaatgagagtaacccttcctcca

SEQ ID NO: 945968 - DNA, 25 bp, Mus musculus
ggaaatgagagtaagccttcctcca

SEQ ID NO: 945969 - DNA, 25 bp, Mus musculus
ggaaatgaggtgcttgtagaccctg

SEQ ID NO: 945970 - DNA, 25 bp, Mus musculus
ggaaatgaggtggttgtagaccctg

SEQ ID NO: 945971 - DNA, 25 bp, Mus musculus
ggaaatgcaccaaaagatgagattg

SEQ ID NO: 945972 - DNA, 25 bp, Mus musculus
ggaaatgcaccaaatgatgagattg

SEQ ID NO: 945973 - DNA, 25 bp, Mus musculus
ggaaatgcagcttttccttactgct

SEQ ID NO: 945974 - DNA, 25 bp, Mus musculus
ggaaatgcaggttttccttactgct

SEQ ID NO: 945975 - DNA, 25 bp, Mus musculus
ggaaatgcctatcacatgcgagctg

SEQ ID NO: 945976 - DNA, 25 bp, Mus musculus
ggaaatgcctatcagatgcgagctg

SEQ ID NO: 945977 - DNA, 25 bp, Mus musculus
ggaaatgcgccacttgatgaaggtt

SEQ ID NO: 945978 - DNA, 25 bp, Mus musculus
ggaaatgcgccagttgatgaaggtt

SEQ ID NO: 945979 - DNA, 25 bp, Mus musculus
ggaaatggagccaagaagacagcaa

SEQ ID NO: 945980 - DNA, 25 bp, Mus musculus
ggaaatggaggcaagaagacagcaa

SEQ ID NO: 945981 - DNA, 25 bp, Mus musculus
ggaaatggcaaaaacgtatgtggac

SEQ ID NO: 945982 - DNA, 25 bp, Mus musculus
ggaaatggcaaaaaggtatgtggac

SEQ ID NO: 945983 - DNA, 25 bp, Mus musculus
ggaaatggggaacttctgtggcctg

SEQ ID NO: 945984 - DNA, 25 bp, Mus musculus
ggaaatggggcactttctgcatctt

SEQ ID NO: 945985 - DNA, 25 bp, Mus musculus
ggaaatgggggactttctgcatctt

SEQ ID NO: 945986 - DNA, 25 bp, Mus musculus
ggaaatggggtacttctgtggcctg

SEQ ID NO: 945987 - DNA, 25 bp, Mus musculus
ggaaattacctgcctttcctaatag

SEQ ID NO: 945988 - DNA, 25 bp, Mus musculus
ggaaattacctggctttcctaatag

SEQ ID NO: 945989 - DNA, 25 bp, Mus musculus
ggaaattcagccgatgctgggcctc

SEQ ID NO: 945990 - DNA, 25 bp, Mus musculus
ggaaattcagcctcaagtacctggc

SEQ ID NO: 945991 - DNA, 25 bp, Mus musculus
ggaaattcaggcgatgctgggcctc

SEQ ID NO: 945992 - DNA, 25 bp, Mus musculus
ggaaattcaggctcaagtacctggc

SEQ ID NO: 945993 - DNA, 25 bp, Mus musculus
ggaaattggcatcacgttgtttggg

SEQ ID NO: 945994 - DNA, 25 bp, Mus musculus
ggaaattggcatcaggttgtttggg

SEQ ID NO: 945995 - DNA, 25 bp, Mus musculus
ggaaatttggcagcttggataatgg

SEQ ID NO: 945996 - DNA, 25 bp, Mus musculus
ggaaatttgggagcttggataatgg

SEQ ID NO: 945997 - DNA, 25 bp, Mus musculus
ggaacaaaagcaaacatttgcaaca

SEQ ID NO: 945998 - DNA, 25 bp, Mus musculus
ggaacaaaagcaaagatttgcaaca

SEQ ID NO: 945999 - DNA, 25 bp, Mus musculus
ggaacaaaatagatcgtggctcacc

SEQ ID NO: 946000 - DNA, 25 bp, Mus musculus
ggaacaaaattgatcgtggctcacc

SEQ ID NO: 946001 - DNA, 25 bp, Mus musculus
ggaacaagagctagtatggctcttg

SEQ ID NO: 946002 - DNA, 25 bp, Mus musculus
ggaacaagaggtagtatggctcttg

SEQ ID NO: 946003 - DNA, 25 bp, Mus musculus
ggaacaaggccacgactgtggcggc

SEQ ID NO: 946004 - DNA, 25 bp, Mus musculus
ggaacaaggccaggactgtggcggc

SEQ ID NO: 946005 - DNA, 25 bp, Mus musculus
ggaacaataatgcacatgctgagga

SEQ ID NO: 946006 - DNA, 25 bp, Mus musculus
ggaacaataatgcagatgctgagga

SEQ ID NO: 946007 - DNA, 25 bp, Mus musculus
ggaacaatagcacacgaatgattgg

SEQ ID NO: 946008 - DNA, 25 bp, Mus musculus
ggaacaatagcacaggaatgattgg

SEQ ID NO: 946009 - DNA, 25 bp, Mus musculus
ggaacaatcacacacagcttacctc

SEQ ID NO: 946010 - DNA, 25 bp, Mus musculus
ggaacaatcacacaggccagaagag

SEQ ID NO: 946011 - DNA, 25 bp, Mus musculus
ggaacaatcacacgtgtagatgtca

SEQ ID NO: 946012 - DNA, 25 bp, Mus musculus
ggaacaatcacagacagcttacctc

SEQ ID NO: 946013 - DNA, 25 bp, Mus musculus
ggaacaatcacagaggccagaagag

SEQ ID NO: 946014 - DNA, 25 bp, Mus musculus
ggaacaatcacaggtgtagatgtca

SEQ ID NO: 946015 - DNA, 25 bp, Mus musculus
ggaacaatttcatacatgctatgct

SEQ ID NO: 946016 - DNA, 25 bp, Mus musculus
ggaacaatttcatagatgctatgct

SEQ ID NO: 946017 - DNA, 25 bp, Mus musculus
ggaacacaaaggaaagaaagcacgc

SEQ ID NO: 946018 - DNA, 25 bp, Mus musculus
ggaacacaaaggtaagaaagcacgc

SEQ ID NO: 946019 - DNA, 25 bp, Mus musculus
ggaacacaagttctcaaatgccctg

SEQ ID NO: 946020 - DNA, 25 bp, Mus musculus
ggaacacaagttctgaaatgccctg

SEQ ID NO: 946021 - DNA, 25 bp, Mus musculus
ggaacacatcagcgagagaccagct

SEQ ID NO: 946022 - DNA, 25 bp, Mus musculus
ggaacacatcagggagagaccagct

SEQ ID NO: 946023 - DNA, 25 bp, Mus musculus
ggaacactggcccgagaagctggag

SEQ ID NO: 946024 - DNA, 25 bp, Mus musculus
ggaacactggcccgcacaatatgac

SEQ ID NO: 946025 - DNA, 25 bp, Mus musculus
ggaacactggccggagaagctggag

SEQ ID NO: 946026 - DNA, 25 bp, Mus musculus
ggaacactggccggcacaatatgac

SEQ ID NO: 946027 - DNA, 25 bp, Mus musculus
ggaacagaaaatgacgagttactta

SEQ ID NO: 946028 - DNA, 25 bp, Mus musculus
ggaacagaaaatgaggagttactta

SEQ ID NO: 946029 - DNA, 25 bp, Mus musculus
ggaacagaacagcaaacaatggtca

SEQ ID NO: 946030 - DNA, 25 bp, Mus musculus
ggaacagaacaggaaacaatggtca

SEQ ID NO: 946031 - DNA, 25 bp, Mus musculus
ggaacagagagaggcgaccatggca

SEQ ID NO: 946032 - DNA, 25 bp, Mus musculus
ggaacagagagaggggaccatggca

SEQ ID NO: 946033 - DNA, 25 bp, Mus musculus
ggaacagatgcacgaatgggcttgg

SEQ ID NO: 946034 - DNA, 25 bp, Mus musculus
ggaacagatgcaggaatgggcttgg

SEQ ID NO: 946035 - DNA, 25 bp, Mus musculus
ggaacagattaacgacattttctac

SEQ ID NO: 946036 - DNA, 25 bp, Mus musculus
ggaacagattaaggacattttctac

SEQ ID NO: 946037 - DNA, 25 bp, Mus musculus
ggaacagcaatcatcactgtgggta

SEQ ID NO: 946038 - DNA, 25 bp, Mus musculus
ggaacagcaatcatgactgtgggta

SEQ ID NO: 946039 - DNA, 25 bp, Mus musculus
ggaacagcagatgcaaactccaaca

SEQ ID NO: 946040 - DNA, 25 bp, Mus musculus
ggaacagcagttgcaaactccaaca

SEQ ID NO: 946041 - DNA, 25 bp, Mus musculus
ggaacagccttacctacatcaaaat

SEQ ID NO: 946042 - DNA, 25 bp, Mus musculus
ggaacagccttagctacatcaaaat

SEQ ID NO: 946043 - DNA, 25 bp, Mus musculus
ggaacaggccctcccagggccttat

SEQ ID NO: 946044 - DNA, 25 bp, Mus musculus
ggaacaggccctccgagggccttat

SEQ ID NO: 946045 - DNA, 25 bp, Mus musculus
ggaacaggccgtcatgctagatgat

SEQ ID NO: 946046 - DNA, 25 bp, Mus musculus
ggaacaggccgtgatgctagatgat

SEQ ID NO: 946047 - DNA, 25 bp, Mus musculus
ggaacagttgattatttatgtgaat

SEQ ID NO: 946048 - DNA, 25 bp, Mus musculus
ggaacagttgtttatttatgtgaat

SEQ ID NO: 946049 - DNA, 25 bp, Mus musculus
ggaacatcagatcattcagtttccc

SEQ ID NO: 946050 - DNA, 25 bp, Mus musculus
ggaacatcagttcattcagtttccc

SEQ ID NO: 946051 - DNA, 25 bp, Mus musculus
ggaacatgagagcgccaagggtgtc

SEQ ID NO: 946052 - DNA, 25 bp, Mus musculus
ggaacatgagtgcgccaagggtgtc

SEQ ID NO: 946053 - DNA, 25 bp, Mus musculus
ggaacatgggcgcagacctgtgccg

SEQ ID NO: 946054 - DNA, 25 bp, Mus musculus
ggaacatgggcggagacctgtgccg

SEQ ID NO: 946055 - DNA, 25 bp, Mus musculus
ggaacattaaatcgtcttgcttctc

SEQ ID NO: 946056 - DNA, 25 bp, Mus musculus
ggaacattaaatggtcttgcttctc

SEQ ID NO: 946057 - DNA, 25 bp, Mus musculus
ggaacattattgcttcacctctgct

SEQ ID NO: 946058 - DNA, 25 bp, Mus musculus
ggaacattattggttcacctctgct

SEQ ID NO: 946059 - DNA, 25 bp, Mus musculus
ggaaccaagatgctcacatagatgt

SEQ ID NO: 946060 - DNA, 25 bp, Mus musculus
ggaaccaagatggtcacatagatgt

SEQ ID NO: 946061 - DNA, 25 bp, Mus musculus
ggaaccaatgagacaccatgattcc

SEQ ID NO: 946062 - DNA, 25 bp, Mus musculus
ggaaccaatgcagccattccgtagt

SEQ ID NO: 946063 - DNA, 25 bp, Mus musculus
ggaaccaatggagccattccgtagt

SEQ ID NO: 946064 - DNA, 25 bp, Mus musculus
ggaaccaatgtgacaccatgattcc

SEQ ID NO: 946065 - DNA, 25 bp, Mus musculus
ggaaccacagcgcccaactgtgaga

SEQ ID NO: 946066 - DNA, 25 bp, Mus musculus
ggaaccacagggcccaactgtgaga

SEQ ID NO: 946067 - DNA, 25 bp, Mus musculus
ggaaccaccactcgtacagcagcaa

SEQ ID NO: 946068 - DNA, 25 bp, Mus musculus
ggaaccaccactggtacagcagcaa

SEQ ID NO: 946069 - DNA, 25 bp, Mus musculus
ggaaccagaaagcacagtctggact

SEQ ID NO: 946070 - DNA, 25 bp, Mus musculus
ggaaccagaaaggacagtctggact

SEQ ID NO: 946071 - DNA, 25 bp, Mus musculus
ggaaccagagaagaccaaggaaagc

SEQ ID NO: 946072 - DNA, 25 bp, Mus musculus
ggaaccagagaagagcaaggaaagc

SEQ ID NO: 946073 - DNA, 25 bp, Mus musculus
ggaaccagagcctggtcaacgagct

SEQ ID NO: 946074 - DNA, 25 bp, Mus musculus
ggaaccagaggaaacagagaaagtc

SEQ ID NO: 946075 - DNA, 25 bp, Mus musculus
ggaaccagaggaaagagagaaagtc

SEQ ID NO: 946076 - DNA, 25 bp, Mus musculus
ggaaccagaggctggtcaacgagct

SEQ ID NO: 946077 - DNA, 25 bp, Mus musculus
ggaaccagagttcactaagtactgc

SEQ ID NO: 946078 - DNA, 25 bp, Mus musculus
ggaaccagagttcagtaagtactgc

SEQ ID NO: 946079 - DNA, 25 bp, Mus musculus
ggaaccatcaggctgctgattttcc

SEQ ID NO: 946080 - DNA, 25 bp, Mus musculus
ggaaccatcagggtgctgattttcc

SEQ ID NO: 946081 - DNA, 25 bp, Mus musculus
ggaaccatgaaaagaagagatgaga

SEQ ID NO: 946082 - DNA, 25 bp, Mus musculus
ggaaccatgaaatgaagagatgaga

SEQ ID NO: 946083 - DNA, 25 bp, Mus musculus
ggaaccatgaatccccacctgccgt

SEQ ID NO: 946084 - DNA, 25 bp, Mus musculus
ggaaccatgaatgcccacctgccgt

SEQ ID NO: 946085 - DNA, 25 bp, Mus musculus
ggaacccaacagcatcttgggtcag

SEQ ID NO: 946086 - DNA, 25 bp, Mus musculus
ggaacccaacaggatcttgggtcag

SEQ ID NO: 946087 - DNA, 25 bp, Mus musculus
ggaacccaagcccacgttgaagtat

SEQ ID NO: 946088 - DNA, 25 bp, Mus musculus
ggaacccaagccgacgttgaagtat

SEQ ID NO: 946089 - DNA, 25 bp, Mus musculus
ggaaccccagagcgagagttcgtgt

SEQ ID NO: 946090 - DNA, 25 bp, Mus musculus
ggaaccccagagggagagttcgtgt

SEQ ID NO: 946091 - DNA, 25 bp, Mus musculus
ggaacccctgcttgcatggtgccat

SEQ ID NO: 946092 - DNA, 25 bp, Mus musculus
ggaacccctgcttggatggtgccat

SEQ ID NO: 946093 - DNA, 25 bp, Mus musculus
ggaacccgtgagctcaatatccaac

SEQ ID NO: 946094 - DNA, 25 bp, Mus musculus
ggaacccgtgaggtcaatatccaac

SEQ ID NO: 946095 - DNA, 25 bp, Mus musculus
ggaaccctgaagcatcctcgctctg

SEQ ID NO: 946096 - DNA, 25 bp, Mus musculus
ggaaccctgaaggatcctcgctctg

SEQ ID NO: 946097 - DNA, 25 bp, Mus musculus
ggaaccgatcagaatatacacttct

SEQ ID NO: 946098 - DNA, 25 bp, Mus musculus
ggaaccgatcagtatatacacttct

SEQ ID NO: 946099 - DNA, 25 bp, Mus musculus
ggaaccggcattcatgtccagctcg

SEQ ID NO: 946100 - DNA, 25 bp, Mus musculus
ggaaccggcattgatgtccagctcg

SEQ ID NO: 946101 - DNA, 25 bp, Mus musculus
ggaacctacagatacgtatgtagga

SEQ ID NO: 946102 - DNA, 25 bp, Mus musculus
ggaacctacagataggtatgtagga

SEQ ID NO: 946103 - DNA, 25 bp, Mus musculus
ggaacctcagagggctgttgttgga

SEQ ID NO: 946104 - DNA, 25 bp, Mus musculus
ggaacctcagtgggctgttgttgga

SEQ ID NO: 946105 - DNA, 25 bp, Mus musculus
ggaacctcggggaactccctcagtg

SEQ ID NO: 946106 - DNA, 25 bp, Mus musculus
ggaacctcggggaagtccctcagtg

SEQ ID NO: 946107 - DNA, 25 bp, Mus musculus
ggaacctgtccactgctcataaggt

SEQ ID NO: 946108 - DNA, 25 bp, Mus musculus
ggaacctgtccagtgctcataaggt

SEQ ID NO: 946109 - DNA, 25 bp, Mus musculus
ggaacctttgcccctcattttccag

SEQ ID NO: 946110 - DNA, 25 bp, Mus musculus
ggaacctttgccgctcattttccag

SEQ ID NO: 946111 - DNA, 25 bp, Mus musculus
ggaacgacaaggccgattcgacaga

SEQ ID NO: 946112 - DNA, 25 bp, Mus musculus
ggaacgacaagggcgattcgacaga

SEQ ID NO: 946113 - DNA, 25 bp, Mus musculus
ggaacgcatcgtattgacgacagtg

SEQ ID NO: 946114 - DNA, 25 bp, Mus musculus
ggaacgcatcgttttgacgacagtg

SEQ ID NO: 946115 - DNA, 25 bp, Mus musculus
ggaacgcattggccgcctggtggac

SEQ ID NO: 946116 - DNA, 25 bp, Mus musculus
ggaacgcattgggcgcctggtggac

SEQ ID NO: 946117 - DNA, 25 bp, Mus musculus
ggaacggcagatcataatgttcact

SEQ ID NO: 946118 - DNA, 25 bp, Mus musculus
ggaacggcagatctggtacacggat

SEQ ID NO: 946119 - DNA, 25 bp, Mus musculus
ggaacggcagatgataatgttcact

SEQ ID NO: 946120 - DNA, 25 bp, Mus musculus
ggaacggcagatgtggtacacggat

SEQ ID NO: 946121 - DNA, 25 bp, Mus musculus
ggaacggggctgactatggagtcaa

SEQ ID NO: 946122 - DNA, 25 bp, Mus musculus
ggaacggggctgtctatggagtcaa

SEQ ID NO: 946123 - DNA, 25 bp, Mus musculus
ggaacgtatgatcgaaatttctatg

SEQ ID NO: 946124 - DNA, 25 bp, Mus musculus
ggaacgtatgatggaaatttctatg

SEQ ID NO: 946125 - DNA, 25 bp, Mus musculus
ggaacgtctcaacgctatgcttctg

SEQ ID NO: 946126 - DNA, 25 bp, Mus musculus
ggaacgtctcaaggctatgcttctg

SEQ ID NO: 946127 - DNA, 25 bp, Mus musculus
ggaacgtgaacacgtggttggactg

SEQ ID NO: 946128 - DNA, 25 bp, Mus musculus
ggaacgtgaacaggtggttggactg

SEQ ID NO: 946129 - DNA, 25 bp, Mus musculus
ggaacgttacaacagattgttctaa

SEQ ID NO: 946130 - DNA, 25 bp, Mus musculus
ggaacgttacaagagattgttctaa

SEQ ID NO: 946131 - DNA, 25 bp, Mus musculus
ggaactaaactaaacattgcgcagc

SEQ ID NO: 946132 - DNA, 25 bp, Mus musculus
ggaactaaactaaagattgcgcagc

SEQ ID NO: 946133 - DNA, 25 bp, Mus musculus
ggaactacagccaaccccaaaggag

SEQ ID NO: 946134 - DNA, 25 bp, Mus musculus
ggaactacaggcaaccccaaaggag

SEQ ID NO: 946135 - DNA, 25 bp, Mus musculus
ggaactacctcagtcgtaatcattg

SEQ ID NO: 946136 - DNA, 25 bp, Mus musculus
ggaactacctcagtggtaatcattg

SEQ ID NO: 946137 - DNA, 25 bp, Mus musculus
ggaactcaaaaggacagagaaaatt

SEQ ID NO: 946138 - DNA, 25 bp, Mus musculus
ggaactcaaaaggagagagaaaatt

SEQ ID NO: 946139 - DNA, 25 bp, Mus musculus
ggaactcaacaacgagatggcttca

SEQ ID NO: 946140 - DNA, 25 bp, Mus musculus
ggaactcaacaaggagatggcttca

SEQ ID NO: 946141 - DNA, 25 bp, Mus musculus
ggaactcaggcaccagaacgagatc

SEQ ID NO: 946142 - DNA, 25 bp, Mus musculus
ggaactcaggcagcagaacgagatc

SEQ ID NO: 946143 - DNA, 25 bp, Mus musculus
ggaactccgtctgagcggcctgtga

SEQ ID NO: 946144 - DNA, 25 bp, Mus musculus
ggaactccgtgtgagcggcctgtga

SEQ ID NO: 946145 - DNA, 25 bp, Mus musculus
ggaactcctgtccacagccgagtgg

SEQ ID NO: 946146 - DNA, 25 bp, Mus musculus
ggaactcctgtccagagccgagtgg

SEQ ID NO: 946147 - DNA, 25 bp, Mus musculus
ggaactcgagcctcctggaggaatt

SEQ ID NO: 946148 - DNA, 25 bp, Mus musculus
ggaactcgaggctcctggaggaatt

SEQ ID NO: 946149 - DNA, 25 bp, Mus musculus
ggaactctatatgactgttttggca

SEQ ID NO: 946150 - DNA, 25 bp, Mus musculus
ggaactctatatgagtgttttggca

SEQ ID NO: 946151 - DNA, 25 bp, Mus musculus
ggaactctggaacatgggtgtgttt

SEQ ID NO: 946152 - DNA, 25 bp, Mus musculus
ggaactctggaagatgggtgtgttt

SEQ ID NO: 946153 - DNA, 25 bp, Mus musculus
ggaactgaggctccggagggtgtag

SEQ ID NO: 946154 - DNA, 25 bp, Mus musculus
ggaactgagggtccggagggtgtag

SEQ ID NO: 946155 - DNA, 25 bp, Mus musculus
ggaactgcctaacgagcctcaaggc

SEQ ID NO: 946156 - DNA, 25 bp, Mus musculus
ggaactgcctaaggagcctcaaggc

SEQ ID NO: 946157 - DNA, 25 bp, Mus musculus
ggaactgctgctgtgatccttgcac

SEQ ID NO: 946158 - DNA, 25 bp, Mus musculus
ggaactgctgcttcctgagtgcgtt

SEQ ID NO: 946159 - DNA, 25 bp, Mus musculus
ggaactgctggtgtgatccttgcac

SEQ ID NO: 946160 - DNA, 25 bp, Mus musculus
ggaactgctggttcctgagtgcgtt

SEQ ID NO: 946161 - DNA, 25 bp, Mus musculus
ggaactggaccgaggagacgcttct

SEQ ID NO: 946162 - DNA, 25 bp, Mus musculus
ggaactggacggaggagacgcttct

SEQ ID NO: 946163 - DNA, 25 bp, Mus musculus
ggaactggccagcaagtgccgaggg

SEQ ID NO: 946164 - DNA, 25 bp, Mus musculus
ggaactggccaggaagtgccgaggg

SEQ ID NO: 946165 - DNA, 25 bp, Mus musculus
ggaactggcccacacgattgcaaat

SEQ ID NO: 946166 - DNA, 25 bp, Mus musculus
ggaactggcccacaggattgcaaat

SEQ ID NO: 946167 - DNA, 25 bp, Mus musculus
ggaactggggctttgaaccagaaga

SEQ ID NO: 946168 - DNA, 25 bp, Mus musculus
ggaactgggggtttgaaccagaaga

SEQ ID NO: 946169 - DNA, 25 bp, Mus musculus
ggaactggtcctcgcggcataacga

SEQ ID NO: 946170 - DNA, 25 bp, Mus musculus
ggaactggtcctcggggcataacga

SEQ ID NO: 946171 - DNA, 25 bp, Mus musculus
ggaactgtctttatccgtctacctt

SEQ ID NO: 946172 - DNA, 25 bp, Mus musculus
ggaactgtctttttccgtctacctt

SEQ ID NO: 946173 - DNA, 25 bp, Mus musculus
ggaacttcagatggcgagtctttac

SEQ ID NO: 946174 - DNA, 25 bp, Mus musculus
ggaacttcagcatcatctgggagat

SEQ ID NO: 946175 - DNA, 25 bp, Mus musculus
ggaacttcaggatcatctgggagat

SEQ ID NO: 946176 - DNA, 25 bp, Mus musculus
ggaacttcagttggcgagtctttac

SEQ ID NO: 946177 - DNA, 25 bp, Mus musculus
ggaacttcctcgacccatctctcca

SEQ ID NO: 946178 - DNA, 25 bp, Mus musculus
ggaacttcctcgtcccatctctcca

SEQ ID NO: 946179 - DNA, 25 bp, Mus musculus
ggaacttctcatcattcaatgtccc

SEQ ID NO: 946180 - DNA, 25 bp, Mus musculus
ggaacttctcttcattcaatgtccc

SEQ ID NO: 946181 - DNA, 25 bp, Mus musculus
ggaagaaaacagcaatctgcaagca

SEQ ID NO: 946182 - DNA, 25 bp, Mus musculus
ggaagaaaacaggaatctgcaagca

SEQ ID NO: 946183 - DNA, 25 bp, Mus musculus
ggaagaaaagcacagtaagcttctt

SEQ ID NO: 946184 - DNA, 25 bp, Mus musculus
ggaagaaaagcagagtaagcttctt

SEQ ID NO: 946185 - DNA, 25 bp, Mus musculus
ggaagaaaggcttgttggagctcga

SEQ ID NO: 946186 - DNA, 25 bp, Mus musculus
ggaagaaagggttgttggagctcga

SEQ ID NO: 946187 - DNA, 25 bp, Mus musculus
ggaagaacaccaaagagtgagtaaa

SEQ ID NO: 946188 - DNA, 25 bp, Mus musculus
ggaagaacaccatagagtgagtaaa

SEQ ID NO: 946189 - DNA, 25 bp, Mus musculus
ggaagaactttgtacacacagtccg

SEQ ID NO: 946190 - DNA, 25 bp, Mus musculus
ggaagaactttgtagacacagtccg

SEQ ID NO: 946191 - DNA, 25 bp, Mus musculus
ggaagaagtgtcatgcctttgcttc

SEQ ID NO: 946192 - DNA, 25 bp, Mus musculus
ggaagaagtgtcttgcctttgcttc

SEQ ID NO: 946193 - DNA, 25 bp, Mus musculus
ggaagaatctcactttagcatggac

SEQ ID NO: 946194 - DNA, 25 bp, Mus musculus
ggaagaatctgactttagcatggac

SEQ ID NO: 946195 - DNA, 25 bp, Mus musculus
ggaagaattccacgcacctagactc

SEQ ID NO: 946196 - DNA, 25 bp, Mus musculus
ggaagaattccacggacctagactc

SEQ ID NO: 946197 - DNA, 25 bp, Mus musculus
ggaagacaaatcaacgtgattccca

SEQ ID NO: 946198 - DNA, 25 bp, Mus musculus
ggaagacaaatcaaggtgattccca

SEQ ID NO: 946199 - DNA, 25 bp, Mus musculus
ggaagacaagcacctgtatatccgc

SEQ ID NO: 946200 - DNA, 25 bp, Mus musculus
ggaagacaagctgatgatgagcaga

SEQ ID NO: 946201 - DNA, 25 bp, Mus musculus
ggaagacaagctggttccatcaagg

SEQ ID NO: 946202 - DNA, 25 bp, Mus musculus
ggaagacaaggacctgtatatccgc

SEQ ID NO: 946203 - DNA, 25 bp, Mus musculus
ggaagacaaggtgatgatgagcaga

SEQ ID NO: 946204 - DNA, 25 bp, Mus musculus
ggaagacaaggtggttccatcaagg

SEQ ID NO: 946205 - DNA, 25 bp, Mus musculus
ggaagacacagcctccttctacctg

SEQ ID NO: 946206 - DNA, 25 bp, Mus musculus
ggaagacacagcctgcttctacctg

SEQ ID NO: 946207 - DNA, 25 bp, Mus musculus
ggaagacaccatcacgctgaccagc

SEQ ID NO: 946208 - DNA, 25 bp, Mus musculus
ggaagacaccatcaggctgaccagc

SEQ ID NO: 946209 - DNA, 25 bp, Mus musculus
ggaagacacgcagtatatatcctgg

SEQ ID NO: 946210 - DNA, 25 bp, Mus musculus
ggaagacacggagtatatatcctgg

SEQ ID NO: 946211 - DNA, 25 bp, Mus musculus
ggaagacactaacgatctccgtgtg

SEQ ID NO: 946212 - DNA, 25 bp, Mus musculus
ggaagacactaaggatctccgtgtg

SEQ ID NO: 946213 - DNA, 25 bp, Mus musculus
ggaagacatgtaaacatatcgatga

SEQ ID NO: 946214 - DNA, 25 bp, Mus musculus
ggaagacatgtaaagatatcgatga

SEQ ID NO: 946215 - DNA, 25 bp, Mus musculus
ggaagacgctcagacacgagttcag

SEQ ID NO: 946216 - DNA, 25 bp, Mus musculus
ggaagacgctcagagacgagttcag

SEQ ID NO: 946217 - DNA, 25 bp, Mus musculus
ggaagactctagacctaccttctag

SEQ ID NO: 946218 - DNA, 25 bp, Mus musculus
ggaagactctagacgtaccttctag

SEQ ID NO: 946219 - DNA, 25 bp, Mus musculus
ggaagacttcaacaggacgctggta

SEQ ID NO: 946220 - DNA, 25 bp, Mus musculus
ggaagacttcaagaggacgctggta

SEQ ID NO: 946221 - DNA, 25 bp, Mus musculus
ggaagacttcccttctttgaatcca

SEQ ID NO: 946222 - DNA, 25 bp, Mus musculus
ggaagacttcgcttctttgaatcca

SEQ ID NO: 946223 - DNA, 25 bp, Mus musculus
ggaagacttctccacgctagaaaat

SEQ ID NO: 946224 - DNA, 25 bp, Mus musculus
ggaagacttctccaggctagaaaat

SEQ ID NO: 946225 - DNA, 25 bp, Mus musculus
ggaagactttcattcgcacagtacg

SEQ ID NO: 946226 - DNA, 25 bp, Mus musculus
ggaagactttcattggcacagtacg

SEQ ID NO: 946227 - DNA, 25 bp, Mus musculus
ggaagactttctggacataaagaac

SEQ ID NO: 946228 - DNA, 25 bp, Mus musculus
ggaagactttgtggacataaagaac

SEQ ID NO: 946229 - DNA, 25 bp, Mus musculus
ggaagagaagtattcaggaagccat

SEQ ID NO: 946230 - DNA, 25 bp, Mus musculus
ggaagagaagtattgaggaagccat

SEQ ID NO: 946231 - DNA, 25 bp, Mus musculus
ggaagagatggccaaatacgcctac

SEQ ID NO: 946232 - DNA, 25 bp, Mus musculus
ggaagagatggccatatacgcctac

SEQ ID NO: 946233 - DNA, 25 bp, Mus musculus
ggaagagcagcatttcatcactggg

SEQ ID NO: 946234 - DNA, 25 bp, Mus musculus
ggaagagcaggatttcatcactggg

SEQ ID NO: 946235 - DNA, 25 bp, Mus musculus
ggaagagctgccatttcagtcgaac

SEQ ID NO: 946236 - DNA, 25 bp, Mus musculus
ggaagagctggcatttcagtcgaac

SEQ ID NO: 946237 - DNA, 25 bp, Mus musculus
ggaagaggaaagagaaagagagcga

SEQ ID NO: 946238 - DNA, 25 bp, Mus musculus
ggaagaggaaagagatgagccgcca

SEQ ID NO: 946239 - DNA, 25 bp, Mus musculus
ggaagaggaaagtgaaagagagcga

SEQ ID NO: 946240 - DNA, 25 bp, Mus musculus
ggaagaggaaagtgatgagccgcca

SEQ ID NO: 946241 - DNA, 25 bp, Mus musculus
ggaagaggaagacctccagagaatg

SEQ ID NO: 946242 - DNA, 25 bp, Mus musculus
ggaagaggaagagctccagagaatg

SEQ ID NO: 946243 - DNA, 25 bp, Mus musculus
ggaagaggagaagatgcaagtggac

SEQ ID NO: 946244 - DNA, 25 bp, Mus musculus
ggaagaggagcccaagtcagaactt

SEQ ID NO: 946245 - DNA, 25 bp, Mus musculus
ggaagaggagctccctgtgctggag

SEQ ID NO: 946246 - DNA, 25 bp, Mus musculus
ggaagaggaggacgaggctccgccc

SEQ ID NO: 946247 - DNA, 25 bp, Mus musculus
ggaagaggaggaggaggctccgccc

SEQ ID NO: 946248 - DNA, 25 bp, Mus musculus
ggaagaggaggccaagtcagaactt

SEQ ID NO: 946249 - DNA, 25 bp, Mus musculus
ggaagaggaggtccctgtgctggag

SEQ ID NO: 946250 - DNA, 25 bp, Mus musculus
ggaagaggagtagatgcaagtggac

SEQ ID NO: 946251 - DNA, 25 bp, Mus musculus
ggaagagtccatcacgagtttggaa

SEQ ID NO: 946252 - DNA, 25 bp, Mus musculus
ggaagagtccatcaggagtttggaa

SEQ ID NO: 946253 - DNA, 25 bp, Mus musculus
ggaagagtgaggtgcgccagacatc

SEQ ID NO: 946254 - DNA, 25 bp, Mus musculus
ggaagagtgaggtgggccagacatc

SEQ ID NO: 946255 - DNA, 25 bp, Mus musculus
ggaagagtttgacacgctccagcaa

SEQ ID NO: 946256 - DNA, 25 bp, Mus musculus
ggaagagtttgagacgctccagcaa

SEQ ID NO: 946257 - DNA, 25 bp, Mus musculus
ggaagatcaaaacgtcattgagttg

SEQ ID NO: 946258 - DNA, 25 bp, Mus musculus
ggaagatcaaaaggtcattgagttg

SEQ ID NO: 946259 - DNA, 25 bp, Mus musculus
ggaagatcaacccaaagaactccaa

SEQ ID NO: 946260 - DNA, 25 bp, Mus musculus
ggaagatcaacccaaagaatgcaaa

SEQ ID NO: 946261 - DNA, 25 bp, Mus musculus
ggaagatcaagccaaagaactccaa

SEQ ID NO: 946262 - DNA, 25 bp, Mus musculus
ggaagatcaagccaaagaatgcaaa

SEQ ID NO: 946263 - DNA, 25 bp, Mus musculus
ggaagatcagctcgctttggtcatc

SEQ ID NO: 946264 - DNA, 25 bp, Mus musculus
ggaagatcaggtcgctttggtcatc

SEQ ID NO: 946265 - DNA, 25 bp, Mus musculus
ggaagatcttgtcgtcaagagcaat

SEQ ID NO: 946266 - DNA, 25 bp, Mus musculus
ggaagatcttgtggtcaagagcaat

SEQ ID NO: 946267 - DNA, 25 bp, Mus musculus
ggaagatgagaaaattccagtgcta

SEQ ID NO: 946268 - DNA, 25 bp, Mus musculus
ggaagatgagtaaattccagtgcta

SEQ ID NO: 946269 - DNA, 25 bp, Mus musculus
ggaagattatgacggcggaggttgc

SEQ ID NO: 946270 - DNA, 25 bp, Mus musculus
ggaagattatgagggcggaggttgc

SEQ ID NO: 946271 - DNA, 25 bp, Mus musculus
ggaagatttgagaaagaacgagtga

SEQ ID NO: 946272 - DNA, 25 bp, Mus musculus
ggaagatttgagtaagaacgagtga

SEQ ID NO: 946273 - DNA, 25 bp, Mus musculus
ggaagcaaagcctcaagtcattctc

SEQ ID NO: 946274 - DNA, 25 bp, Mus musculus
ggaagcaaaggctcaagtcattctc

SEQ ID NO: 946275 - DNA, 25 bp, Mus musculus
ggaagcaagagactgaaccacgtat

SEQ ID NO: 946276 - DNA, 25 bp, Mus musculus
ggaagcaagagagtgaaccacgtat

SEQ ID NO: 946277 - DNA, 25 bp, Mus musculus
ggaagcacaacctgagtggagagac

SEQ ID NO: 946278 - DNA, 25 bp, Mus musculus
ggaagcacaacctgtgtggagagac

SEQ ID NO: 946279 - DNA, 25 bp, Mus musculus
ggaagcacagctggctttggccaaa

SEQ ID NO: 946280 - DNA, 25 bp, Mus musculus
ggaagcacaggtggctttggccaaa

SEQ ID NO: 946281 - DNA, 25 bp, Mus musculus
ggaagcacatccagaaggagcttgt

SEQ ID NO: 946282 - DNA, 25 bp, Mus musculus
ggaagcacatcctgaaggagcttgt

SEQ ID NO: 946283 - DNA, 25 bp, Mus musculus
ggaagcaccaccactattgtcaacc

SEQ ID NO: 946284 - DNA, 25 bp, Mus musculus
ggaagcaccacctctattgtcaacc

SEQ ID NO: 946285 - DNA, 25 bp, Mus musculus
ggaagcaccgaggaacaccagggcg

SEQ ID NO: 946286 - DNA, 25 bp, Mus musculus
ggaagcaccgtggaacaccagggcg

SEQ ID NO: 946287 - DNA, 25 bp, Mus musculus
ggaagcaccttgctgaccagaatgg

SEQ ID NO: 946288 - DNA, 25 bp, Mus musculus
ggaagcaccttggtgaccagaatgg

SEQ ID NO: 946289 - DNA, 25 bp, Mus musculus
ggaagcagagaacgcccagctgatc

SEQ ID NO: 946290 - DNA, 25 bp, Mus musculus
ggaagcagagaaggcccagctgatc

SEQ ID NO: 946291 - DNA, 25 bp, Mus musculus
ggaagcagagagcagaaaaggagga

SEQ ID NO: 946292 - DNA, 25 bp, Mus musculus
ggaagcagagaggagaaaaggagga

SEQ ID NO: 946293 - DNA, 25 bp, Mus musculus
ggaagcagagatgcccggaaccgcg

SEQ ID NO: 946294 - DNA, 25 bp, Mus musculus
ggaagcagagatggctatgaacggc

SEQ ID NO: 946295 - DNA, 25 bp, Mus musculus
ggaagcagagcacacgttattaaaa

SEQ ID NO: 946296 - DNA, 25 bp, Mus musculus
ggaagcagagcacaggttattaaaa

SEQ ID NO: 946297 - DNA, 25 bp, Mus musculus
ggaagcagagttgcccggaaccgcg

SEQ ID NO: 946298 - DNA, 25 bp, Mus musculus
ggaagcagagttggctatgaacggc

SEQ ID NO: 946299 - DNA, 25 bp, Mus musculus
ggaagcagctgccacactctgatag

SEQ ID NO: 946300 - DNA, 25 bp, Mus musculus
ggaagcagctgccagactctgatag

SEQ ID NO: 946301 - DNA, 25 bp, Mus musculus
ggaagcatggaaactagagagatgc

SEQ ID NO: 946302 - DNA, 25 bp, Mus musculus
ggaagcatggacaaagaagaccgtc

SEQ ID NO: 946303 - DNA, 25 bp, Mus musculus
ggaagcatggacaatgaagaccgtc

SEQ ID NO: 946304 - DNA, 25 bp, Mus musculus
ggaagcatggtaactagagagatgc

SEQ ID NO: 946305 - DNA, 25 bp, Mus musculus
ggaagccaaaaacaagaagcactta

SEQ ID NO: 946306 - DNA, 25 bp, Mus musculus
ggaagccaaaaacagcaagaagcgg

SEQ ID NO: 946307 - DNA, 25 bp, Mus musculus
ggaagccaaaaagaagaagcactta

SEQ ID NO: 946308 - DNA, 25 bp, Mus musculus
ggaagccaaaaagagcaagaagcgg

SEQ ID NO: 946309 - DNA, 25 bp, Mus musculus
ggaagccaagaggcctctttattag

SEQ ID NO: 946310 - DNA, 25 bp, Mus musculus
ggaagccaagccctggggcttgata

SEQ ID NO: 946311 - DNA, 25 bp, Mus musculus
ggaagccaagctgaaagccgccctc

SEQ ID NO: 946312 - DNA, 25 bp, Mus musculus
ggaagccaaggccaccatcaaccct

SEQ ID NO: 946313 - DNA, 25 bp, Mus musculus
ggaagccaaggccagcatcaaccct

SEQ ID NO: 946314 - DNA, 25 bp, Mus musculus
ggaagccaaggcctggggcttgata

SEQ ID NO: 946315 - DNA, 25 bp, Mus musculus
ggaagccaaggtgaaagccgccctc

SEQ ID NO: 946316 - DNA, 25 bp, Mus musculus
ggaagccaagtggcctctttattag

SEQ ID NO: 946317 - DNA, 25 bp, Mus musculus
ggaagccaatggcgattacatccct

SEQ ID NO: 946318 - DNA, 25 bp, Mus musculus
ggaagccaatggcgtttacatccct

SEQ ID NO: 946319 - DNA, 25 bp, Mus musculus
ggaagccagagacggtctgcgagct

SEQ ID NO: 946320 - DNA, 25 bp, Mus musculus
ggaagccagagagggtctgcgagct

SEQ ID NO: 946321 - DNA, 25 bp, Mus musculus
ggaagccaggagagggcctgaggca

SEQ ID NO: 946322 - DNA, 25 bp, Mus musculus
ggaagccaggagattagagtgggcc

SEQ ID NO: 946323 - DNA, 25 bp, Mus musculus
ggaagccaggagtgggcctgaggca

SEQ ID NO: 946324 - DNA, 25 bp, Mus musculus
ggaagccaggagtttagagtgggcc

SEQ ID NO: 946325 - DNA, 25 bp, Mus musculus
ggaagcccagaaaatccaatcagat

SEQ ID NO: 946326 - DNA, 25 bp, Mus musculus
ggaagcccagatttgccatggagaa

SEQ ID NO: 946327 - DNA, 25 bp, Mus musculus
ggaagcccagtaaatccaatcagat

SEQ ID NO: 946328 - DNA, 25 bp, Mus musculus
ggaagcccagttttgccatggagaa

SEQ ID NO: 946329 - DNA, 25 bp, Mus musculus
ggaagccccaccctgtgatggtaac

SEQ ID NO: 946330 - DNA, 25 bp, Mus musculus
ggaagccccagcctgtgatggtaac

SEQ ID NO: 946331 - DNA, 25 bp, Mus musculus
ggaagccctgagctcacttggtcgc

SEQ ID NO: 946332 - DNA, 25 bp, Mus musculus
ggaagccctgagctgtggttcccag

SEQ ID NO: 946333 - DNA, 25 bp, Mus musculus
ggaagccctgaggtcacttggtcgc

SEQ ID NO: 946334 - DNA, 25 bp, Mus musculus
ggaagccctgaggtgtggttcccag

SEQ ID NO: 946335 - DNA, 25 bp, Mus musculus
ggaagccctgtgaccaatggcacac

SEQ ID NO: 946336 - DNA, 25 bp, Mus musculus
ggaagccctgtgacgaatggcacac

SEQ ID NO: 946337 - DNA, 25 bp, Mus musculus
ggaagccgagctctgcattacattt

SEQ ID NO: 946338 - DNA, 25 bp, Mus musculus
ggaagccgagcttagcaacattaag

SEQ ID NO: 946339 - DNA, 25 bp, Mus musculus
ggaagccgaggtctgcattacattt

SEQ ID NO: 946340 - DNA, 25 bp, Mus musculus
ggaagccgaggttagcaacattaag

SEQ ID NO: 946341 - DNA, 25 bp, Mus musculus
ggaagcctggatagaggagaagttg

SEQ ID NO: 946342 - DNA, 25 bp, Mus musculus
ggaagcctggatagtggagaagttg

SEQ ID NO: 946343 - DNA, 25 bp, Mus musculus
ggaagccttggacaaaacagagaaa

SEQ ID NO: 946344 - DNA, 25 bp, Mus musculus
ggaagccttggagaaaacagagaaa

SEQ ID NO: 946345 - DNA, 25 bp, Mus musculus
ggaagcgcaacacgtcacctggagg

SEQ ID NO: 946346 - DNA, 25 bp, Mus musculus
ggaagcgcaacaggtcacctggagg

SEQ ID NO: 946347 - DNA, 25 bp, Mus musculus
ggaagcgccacacccccagaggaaa

SEQ ID NO: 946348 - DNA, 25 bp, Mus musculus
ggaagcgccacagccccagaggaaa

SEQ ID NO: 946349 - DNA, 25 bp, Mus musculus
ggaagcgctgctgcaggcagaggcc

SEQ ID NO: 946350 - DNA, 25 bp, Mus musculus
ggaagcgctggtgcaggcagaggcc

SEQ ID NO: 946351 - DNA, 25 bp, Mus musculus
ggaagcggagaggtcatctcagagc

SEQ ID NO: 946352 - DNA, 25 bp, Mus musculus
ggaagcggagtggtcatctcagagc

SEQ ID NO: 946353 - DNA, 25 bp, Mus musculus
ggaagctaagaaactgaggctcctt

SEQ ID NO: 946354 - DNA, 25 bp, Mus musculus
ggaagctaagtaactgaggctcctt

SEQ ID NO: 946355 - DNA, 25 bp, Mus musculus
ggaagctacttacgctactcagttg

SEQ ID NO: 946356 - DNA, 25 bp, Mus musculus
ggaagctacttaggctactcagttg

SEQ ID NO: 946357 - DNA, 25 bp, Mus musculus
ggaagctctggaccttttgggcaac

SEQ ID NO: 946358 - DNA, 25 bp, Mus musculus
ggaagctctggagcttttgggcaac

SEQ ID NO: 946359 - DNA, 25 bp, Mus musculus
ggaagctgacttcacggatgttcta

SEQ ID NO: 946360 - DNA, 25 bp, Mus musculus
ggaagctgacttcagggatgttcta

SEQ ID NO: 946361 - DNA, 25 bp, Mus musculus
ggaagctgtcagatctgagaagtca

SEQ ID NO: 946362 - DNA, 25 bp, Mus musculus
ggaagctgtcagcattctgcctaca

SEQ ID NO: 946363 - DNA, 25 bp, Mus musculus
ggaagctgtcaggattctgcctaca

SEQ ID NO: 946364 - DNA, 25 bp, Mus musculus
ggaagctgtcagttctgagaagtca

SEQ ID NO: 946365 - DNA, 25 bp, Mus musculus
ggaagctgtgaggaaagaagcaaaa

SEQ ID NO: 946366 - DNA, 25 bp, Mus musculus
ggaagctgtgatcttcaggaccata

SEQ ID NO: 946367 - DNA, 25 bp, Mus musculus
ggaagctgtgatgttcaggaccata

SEQ ID NO: 946368 - DNA, 25 bp, Mus musculus
ggaagctgtgggaacagcagcaagc

SEQ ID NO: 946369 - DNA, 25 bp, Mus musculus
ggaagctgtgggaagagcagcaagc

SEQ ID NO: 946370 - DNA, 25 bp, Mus musculus
ggaagctgtgtggaaagaagcaaaa

SEQ ID NO: 946371 - DNA, 25 bp, Mus musculus
ggaagctgttgtctatcttggagat

SEQ ID NO: 946372 - DNA, 25 bp, Mus musculus
ggaagctgttgtgtatcttggagat

SEQ ID NO: 946373 - DNA, 25 bp, Mus musculus
ggaaggaactatgctgttggctgct

SEQ ID NO: 946374 - DNA, 25 bp, Mus musculus
ggaaggaactttgctgttggctgct

SEQ ID NO: 946375 - DNA, 25 bp, Mus musculus
ggaaggaagattgaagtcggcagct

SEQ ID NO: 946376 - DNA, 25 bp, Mus musculus
ggaaggaagattgatgtcggcagct

SEQ ID NO: 946377 - DNA, 25 bp, Mus musculus
ggaaggaaggatcgtctgttttcac

SEQ ID NO: 946378 - DNA, 25 bp, Mus musculus
ggaaggaaggatggtctgttttcac

SEQ ID NO: 946379 - DNA, 25 bp, Mus musculus
ggaaggaagggagaagtttggagct

SEQ ID NO: 946380 - DNA, 25 bp, Mus musculus
ggaaggaagggagatgtttggagct

SEQ ID NO: 946381 - DNA, 25 bp, Mus musculus
ggaaggacaaggatgttgacctcct

SEQ ID NO: 946382 - DNA, 25 bp, Mus musculus
ggaaggacaaggttgttgacctcct

SEQ ID NO: 946383 - DNA, 25 bp, Mus musculus
ggaaggacagcacagcaaggtactc

SEQ ID NO: 946384 - DNA, 25 bp, Mus musculus
ggaaggacagccctcagttcctgca

SEQ ID NO: 946385 - DNA, 25 bp, Mus musculus
ggaaggacagcttcaactggagagc

SEQ ID NO: 946386 - DNA, 25 bp, Mus musculus
ggaaggacaggacagcaaggtactc

SEQ ID NO: 946387 - DNA, 25 bp, Mus musculus
ggaaggacaggcctcagttcctgca

SEQ ID NO: 946388 - DNA, 25 bp, Mus musculus
ggaaggacaggttcaactggagagc

SEQ ID NO: 946389 - DNA, 25 bp, Mus musculus
ggaaggaccacaaagatctggctac

SEQ ID NO: 946390 - DNA, 25 bp, Mus musculus
ggaaggaccacatagatctggctac

SEQ ID NO: 946391 - DNA, 25 bp, Mus musculus
ggaaggactatgcggtgcaggtggc

SEQ ID NO: 946392 - DNA, 25 bp, Mus musculus
ggaaggactatggggtgcaggtggc

SEQ ID NO: 946393 - DNA, 25 bp, Mus musculus
ggaaggaggaagagtgagctgggtg

SEQ ID NO: 946394 - DNA, 25 bp, Mus musculus
ggaaggaggaagtgtgagctgggtg

SEQ ID NO: 946395 - DNA, 25 bp, Mus musculus
ggaaggagtgagaaggaagaggccc

SEQ ID NO: 946396 - DNA, 25 bp, Mus musculus
ggaaggagtgtgaaggaagaggccc

SEQ ID NO: 946397 - DNA, 25 bp, Mus musculus
ggaaggatgaagattcctatcacat

SEQ ID NO: 946398 - DNA, 25 bp, Mus musculus
ggaaggatgaagtttcctatcacat

SEQ ID NO: 946399 - DNA, 25 bp, Mus musculus
ggaaggcaaggataccatccatgtc

SEQ ID NO: 946400 - DNA, 25 bp, Mus musculus
ggaaggcaaggatacggagcgcctc

SEQ ID NO: 946401 - DNA, 25 bp, Mus musculus
ggaaggcaaggatagcatccatgtc

SEQ ID NO: 946402 - DNA, 25 bp, Mus musculus
ggaaggcaaggatagggagcgcctc

SEQ ID NO: 946403 - DNA, 25 bp, Mus musculus
ggaaggcagaggcacgcgtgcccac

SEQ ID NO: 946404 - DNA, 25 bp, Mus musculus
ggaaggcagaggcaggcgtgcccac

SEQ ID NO: 946405 - DNA, 25 bp, Mus musculus
ggaaggcatcaacacaataaccaga

SEQ ID NO: 946406 - DNA, 25 bp, Mus musculus
ggaaggcatcaacagaataaccaga

SEQ ID NO: 946407 - DNA, 25 bp, Mus musculus
ggaaggcctcagcaagaagatggtc

SEQ ID NO: 946408 - DNA, 25 bp, Mus musculus
ggaaggcctcaggaagaagatggtc

SEQ ID NO: 946409 - DNA, 25 bp, Mus musculus
ggaaggcgagcgtgctgaccatcac

SEQ ID NO: 946410 - DNA, 25 bp, Mus musculus
ggaaggcgagggtgctgaccatcac

SEQ ID NO: 946411 - DNA, 25 bp, Mus musculus
ggaaggcttcagcaggaaccatggg

SEQ ID NO: 946412 - DNA, 25 bp, Mus musculus
ggaaggcttcaggaggaaccatggg

SEQ ID NO: 946413 - DNA, 25 bp, Mus musculus
ggaagggaagcatgcacaggccatt

SEQ ID NO: 946414 - DNA, 25 bp, Mus musculus
ggaagggaaggatgcacaggccatt

SEQ ID NO: 946415 - DNA, 25 bp, Mus musculus
ggaagggactatattgaccagtgga

SEQ ID NO: 946416 - DNA, 25 bp, Mus musculus
ggaagggactatattgatcagtgga

SEQ ID NO: 946417 - DNA, 25 bp, Mus musculus
ggaagggactttattgaccagtgga

SEQ ID NO: 946418 - DNA, 25 bp, Mus musculus
ggaagggactttattgatcagtgga

SEQ ID NO: 946419 - DNA, 25 bp, Mus musculus
ggaagggagctctgcatgctgaatg

SEQ ID NO: 946420 - DNA, 25 bp, Mus musculus
ggaagggagctctggatgctgaatg

SEQ ID NO: 946421 - DNA, 25 bp, Mus musculus
ggaagggcatagccagccacctaga

SEQ ID NO: 946422 - DNA, 25 bp, Mus musculus
ggaagggcataggcagccacctaga

SEQ ID NO: 946423 - DNA, 25 bp, Mus musculus
ggaagggcgtcttacatgacgtggt

SEQ ID NO: 946424 - DNA, 25 bp, Mus musculus
ggaagggcgtcttagatgacgtggt

SEQ ID NO: 946425 - DNA, 25 bp, Mus musculus
ggaagggctaatcaccacagtccat

SEQ ID NO: 946426 - DNA, 25 bp, Mus musculus
ggaagggctaatgaccacagtccat

SEQ ID NO: 946427 - DNA, 25 bp, Mus musculus
ggaagggctcagccagagtaacagt

SEQ ID NO: 946428 - DNA, 25 bp, Mus musculus
ggaagggctcaggcagagtaacagt

SEQ ID NO: 946429 - DNA, 25 bp, Mus musculus
ggaagtactgaaaccagagctctag

SEQ ID NO: 946430 - DNA, 25 bp, Mus musculus
ggaagtactgaaacgagagctctag

SEQ ID NO: 946431 - DNA, 25 bp, Mus musculus
ggaagtatggccgagggcttccaca

SEQ ID NO: 946432 - DNA, 25 bp, Mus musculus
ggaagtatgggcgagggcttccaca

SEQ ID NO: 946433 - DNA, 25 bp, Mus musculus
ggaagtatttctcgcctcggattac

SEQ ID NO: 946434 - DNA, 25 bp, Mus musculus
ggaagtatttctggcctcggattac

SEQ ID NO: 946435 - DNA, 25 bp, Mus musculus
ggaagtcaaaggcgaaggatgtgaa

SEQ ID NO: 946436 - DNA, 25 bp, Mus musculus
ggaagtcaaaggggaaggatgtgaa

SEQ ID NO: 946437 - DNA, 25 bp, Mus musculus
ggaagtcagaagcctgttatcagaa

SEQ ID NO: 946438 - DNA, 25 bp, Mus musculus
ggaagtcagaaggctgttatcagaa

SEQ ID NO: 946439 - DNA, 25 bp, Mus musculus
ggaagtcatcagaactgtacaactg

SEQ ID NO: 946440 - DNA, 25 bp, Mus musculus
ggaagtcatcagaagtgtacaactg

SEQ ID NO: 946441 - DNA, 25 bp, Mus musculus
ggaagtcatgaacgcctgctctgga

SEQ ID NO: 946442 - DNA, 25 bp, Mus musculus
ggaagtcatgaaggcctgctctgga

SEQ ID NO: 946443 - DNA, 25 bp, Mus musculus
ggaagtcatgcaagtcctgcaaaat

SEQ ID NO: 946444 - DNA, 25 bp, Mus musculus
ggaagtcatggaagtcctgcaaaat

SEQ ID NO: 946445 - DNA, 25 bp, Mus musculus
ggaagtcctcatcgctctgtttaag

SEQ ID NO: 946446 - DNA, 25 bp, Mus musculus
ggaagtcctcatcggtctgtttaag

SEQ ID NO: 946447 - DNA, 25 bp, Mus musculus
ggaagtccttaacgtgcagacccac

SEQ ID NO: 946448 - DNA, 25 bp, Mus musculus
ggaagtccttaaggtgcagacccac

SEQ ID NO: 946449 - DNA, 25 bp, Mus musculus
ggaagtcggccagatcctgtctgcc

SEQ ID NO: 946450 - DNA, 25 bp, Mus musculus
ggaagtcggcgagatcctgtctgcc

SEQ ID NO: 946451 - DNA, 25 bp, Mus musculus
ggaagtcggctgacattaacagcag

SEQ ID NO: 946452 - DNA, 25 bp, Mus musculus
ggaagtcggctgtcattaacagcag

SEQ ID NO: 946453 - DNA, 25 bp, Mus musculus
ggaagtctgccacatctctggctcc

SEQ ID NO: 946454 - DNA, 25 bp, Mus musculus
ggaagtctgccagatctctggctcc

SEQ ID NO: 946455 - DNA, 25 bp, Mus musculus
ggaagtgaaatccgcttgctatctt

SEQ ID NO: 946456 - DNA, 25 bp, Mus musculus
ggaagtgaaatcggcttgctatctt

SEQ ID NO: 946457 - DNA, 25 bp, Mus musculus
ggaagtgaagaacccagattccaaa

SEQ ID NO: 946458 - DNA, 25 bp, Mus musculus
ggaagtgaagcccctgcccggatgg

SEQ ID NO: 946459 - DNA, 25 bp, Mus musculus
ggaagtgaagccctgaaccaaaatg

SEQ ID NO: 946460 - DNA, 25 bp, Mus musculus
ggaagtgaaggccctgcccggatgg

SEQ ID NO: 946461 - DNA, 25 bp, Mus musculus
ggaagtgaaggcctgaaccaaaatg

SEQ ID NO: 946462 - DNA, 25 bp, Mus musculus
ggaagtgaagtacccagattccaaa

SEQ ID NO: 946463 - DNA, 25 bp, Mus musculus
ggaagtgcaataaggatcaggctgg

SEQ ID NO: 946464 - DNA, 25 bp, Mus musculus
ggaagtgcaatatggatcaggctgg

SEQ ID NO: 946465 - DNA, 25 bp, Mus musculus
ggaagtgcagcagaagtccagcggc

SEQ ID NO: 946466 - DNA, 25 bp, Mus musculus
ggaagtgcaggagaagtccagcggc

SEQ ID NO: 946467 - DNA, 25 bp, Mus musculus
ggaagtgcatagcaggagcttcctg

SEQ ID NO: 946468 - DNA, 25 bp, Mus musculus
ggaagtgcatagcagtggctgctac

SEQ ID NO: 946469 - DNA, 25 bp, Mus musculus
ggaagtgcataggaggagcttcctg

SEQ ID NO: 946470 - DNA, 25 bp, Mus musculus
ggaagtgcataggagtggctgctac

SEQ ID NO: 946471 - DNA, 25 bp, Mus musculus
ggaagtgccaagatatagatgagtg

SEQ ID NO: 946472 - DNA, 25 bp, Mus musculus
ggaagtgccaagttatagatgagtg

SEQ ID NO: 946473 - DNA, 25 bp, Mus musculus
ggaagtgccaggatcacaacgaatg

SEQ ID NO: 946474 - DNA, 25 bp, Mus musculus
ggaagtgccaggttcacaacgaatg

SEQ ID NO: 946475 - DNA, 25 bp, Mus musculus
ggaagtgctgaacgcagggaagcgg

SEQ ID NO: 946476 - DNA, 25 bp, Mus musculus
ggaagtgctgaaggcagggaagcgg

SEQ ID NO: 946477 - DNA, 25 bp, Mus musculus
ggaagtggtctgaatcttcctgacg

SEQ ID NO: 946478 - DNA, 25 bp, Mus musculus
ggaagtggtctgtatcttcctgacg

SEQ ID NO: 946479 - DNA, 25 bp, Mus musculus
ggaagtgtcgccagagaaacaataa

SEQ ID NO: 946480 - DNA, 25 bp, Mus musculus
ggaagtgtcgcttccaacagtgttc

SEQ ID NO: 946481 - DNA, 25 bp, Mus musculus
ggaagtgtcggcagagaaacaataa

SEQ ID NO: 946482 - DNA, 25 bp, Mus musculus
ggaagtgtcggttccaacagtgttc

SEQ ID NO: 946483 - DNA, 25 bp, Mus musculus
ggaagtgtgtggacatcaatgagtg

SEQ ID NO: 946484 - DNA, 25 bp, Mus musculus
ggaagtgtgtggtcatcaatgagtg

SEQ ID NO: 946485 - DNA, 25 bp, Mus musculus
ggaagtgttcaacgctgctgctgtc

SEQ ID NO: 946486 - DNA, 25 bp, Mus musculus
ggaagtgttcaaggctgctgctgtc

SEQ ID NO: 946487 - DNA, 25 bp, Mus musculus
ggaagttcacaacataaccaacaac

SEQ ID NO: 946488 - DNA, 25 bp, Mus musculus
ggaagttcacaacgaatgtatcatt

SEQ ID NO: 946489 - DNA, 25 bp, Mus musculus
ggaagttcacaagataaccaacaac

SEQ ID NO: 946490 - DNA, 25 bp, Mus musculus
ggaagttcacaaggaatgtatcatt

SEQ ID NO: 946491 - DNA, 25 bp, Mus musculus
ggaagttcgtggaacgcaagaagaa

SEQ ID NO: 946492 - DNA, 25 bp, Mus musculus
ggaagttcgtggaacgggaagacag

SEQ ID NO: 946493 - DNA, 25 bp, Mus musculus
ggaagttcgtggaaggcaagaagaa

SEQ ID NO: 946494 - DNA, 25 bp, Mus musculus
ggaagttcgtggaaggggaagacag

SEQ ID NO: 946495 - DNA, 25 bp, Mus musculus
ggaagttctttccttgcggaatata

SEQ ID NO: 946496 - DNA, 25 bp, Mus musculus
ggaagttctttcgttgcggaatata

SEQ ID NO: 946497 - DNA, 25 bp, Mus musculus
ggaagttgatgacgaagatgctgcc

SEQ ID NO: 946498 - DNA, 25 bp, Mus musculus
ggaagttgatgaggaagatgctgcc

SEQ ID NO: 946499 - DNA, 25 bp, Mus musculus
ggaagtttgactctcaggagagaat

SEQ ID NO: 946500 - DNA, 25 bp, Mus musculus
ggaagtttgactctgaggagagaat

SEQ ID NO: 946501 - DNA, 25 bp, Mus musculus
ggaataaagaaacgtgaccagaatg

SEQ ID NO: 946502 - DNA, 25 bp, Mus musculus
ggaataaagaaaggtgaccagaatg

SEQ ID NO: 946503 - DNA, 25 bp, Mus musculus
ggaataagaccacatcatctttaga

SEQ ID NO: 946504 - DNA, 25 bp, Mus musculus
ggaataagaccagatcatctttaga

SEQ ID NO: 946505 - DNA, 25 bp, Mus musculus
ggaataagatgacgtcctccacctt

SEQ ID NO: 946506 - DNA, 25 bp, Mus musculus
ggaataagatgaggtcctccacctt

SEQ ID NO: 946507 - DNA, 25 bp, Mus musculus
ggaataccagatcgcctataagtat

SEQ ID NO: 946508 - DNA, 25 bp, Mus musculus
ggaataccagatggcctataagtat

SEQ ID NO: 946509 - DNA, 25 bp, Mus musculus
ggaataccagcaaaatagtgatgtt

SEQ ID NO: 946510 - DNA, 25 bp, Mus musculus
ggaataccagcaaatgataatgcag

SEQ ID NO: 946511 - DNA, 25 bp, Mus musculus
ggaataccaggaaaatagtgatgtt

SEQ ID NO: 946512 - DNA, 25 bp, Mus musculus
ggaataccaggaaatgataatgcag

SEQ ID NO: 946513 - DNA, 25 bp, Mus musculus
ggaatacctgaaacccttcgcatcc

SEQ ID NO: 946514 - DNA, 25 bp, Mus musculus
ggaatacctgaaacgcttcgcatcc

SEQ ID NO: 946515 - DNA, 25 bp, Mus musculus
ggaatacgagaaagccctgcaggaa

SEQ ID NO: 946516 - DNA, 25 bp, Mus musculus
ggaatacgagtaagccctgcaggaa

SEQ ID NO: 946517 - DNA, 25 bp, Mus musculus
ggaatagaactgcccgtgcggcctc

SEQ ID NO: 946518 - DNA, 25 bp, Mus musculus
ggaatagaactggccgtgcggcctc

SEQ ID NO: 946519 - DNA, 25 bp, Mus musculus
ggaatatataaagacgcttgcacag

SEQ ID NO: 946520 - DNA, 25 bp, Mus musculus
ggaatatataaagaggcttgcacag

SEQ ID NO: 946521 - DNA, 25 bp, Mus musculus
ggaatatcagtgaacggtgacaaag

SEQ ID NO: 946522 - DNA, 25 bp, Mus musculus
ggaatatcagtgaagggtgacaaag

SEQ ID NO: 946523 - DNA, 25 bp, Mus musculus
ggaatatgagaaagagagccagaaa

SEQ ID NO: 946524 - DNA, 25 bp, Mus musculus
ggaatatgagtaagagagccagaaa

SEQ ID NO: 946525 - DNA, 25 bp, Mus musculus
ggaatatgtcaacacaattccagag

SEQ ID NO: 946526 - DNA, 25 bp, Mus musculus
ggaatatgtcaacaccccagaaggc

SEQ ID NO: 946527 - DNA, 25 bp, Mus musculus
ggaatatgtcaacacgacccacagt

SEQ ID NO: 946528 - DNA, 25 bp, Mus musculus
ggaatatgtcaacagaattccagag

SEQ ID NO: 946529 - DNA, 25 bp, Mus musculus
ggaatatgtcaacagcccagaaggc

SEQ ID NO: 946530 - DNA, 25 bp, Mus musculus
ggaatatgtcaacaggacccacagt

SEQ ID NO: 946531 - DNA, 25 bp, Mus musculus
ggaatatttgagaatcaagaccgga

SEQ ID NO: 946532 - DNA, 25 bp, Mus musculus
ggaatatttgagcagaatcaagacc

SEQ ID NO: 946533 - DNA, 25 bp, Mus musculus
ggaatatttgaggagaatcaagacc

SEQ ID NO: 946534 - DNA, 25 bp, Mus musculus
ggaatatttgagtatcaagaccgga

SEQ ID NO: 946535 - DNA, 25 bp, Mus musculus
ggaatcaaaaatcacataacaacta

SEQ ID NO: 946536 - DNA, 25 bp, Mus musculus
ggaatcaaaaatcacataagaaacc

SEQ ID NO: 946537 - DNA, 25 bp, Mus musculus
ggaatcaaaaatcagataacaacta

SEQ ID NO: 946538 - DNA, 25 bp, Mus musculus
ggaatcaaaaatcagataagaaacc

SEQ ID NO: 946539 - DNA, 25 bp, Mus musculus
ggaatcacactattcggatggaaga

SEQ ID NO: 946540 - DNA, 25 bp, Mus musculus
ggaatcacactattcgtcctgagtt

SEQ ID NO: 946541 - DNA, 25 bp, Mus musculus
ggaatcacactattgggatggaaga

SEQ ID NO: 946542 - DNA, 25 bp, Mus musculus
ggaatcacactattggtcctgagtt

SEQ ID NO: 946543 - DNA, 25 bp, Mus musculus
ggaatcacagcccaactactgtatg

SEQ ID NO: 946544 - DNA, 25 bp, Mus musculus
ggaatcacaggccaactactgtatg

SEQ ID NO: 946545 - DNA, 25 bp, Mus musculus
ggaatccatcaccacgctcgagaaa

SEQ ID NO: 946546 - DNA, 25 bp, Mus musculus
ggaatccatcaccaggctcgagaaa

SEQ ID NO: 946547 - DNA, 25 bp, Mus musculus
ggaatcctagctcctgtcatttggg

SEQ ID NO: 946548 - DNA, 25 bp, Mus musculus
ggaatcctaggtcctgtcatttggg

SEQ ID NO: 946549 - DNA, 25 bp, Mus musculus
ggaatccttgaaagccctctgggcg

SEQ ID NO: 946550 - DNA, 25 bp, Mus musculus
ggaatccttgaatgccctctgggcg

SEQ ID NO: 946551 - DNA, 25 bp, Mus musculus
ggaatcgtggcacgccccatgaatg

SEQ ID NO: 946552 - DNA, 25 bp, Mus musculus
ggaatcgtggcaggccccatgaatg

SEQ ID NO: 946553 - DNA, 25 bp, Mus musculus
ggaatctaggagcccaccttgggac

SEQ ID NO: 946554 - DNA, 25 bp, Mus musculus
ggaatctaggaggccaccttgggac

SEQ ID NO: 946555 - DNA, 25 bp, Mus musculus
ggaatctctgacaactacaggacat

SEQ ID NO: 946556 - DNA, 25 bp, Mus musculus
ggaatctctgacaagtacaggacat

SEQ ID NO: 946557 - DNA, 25 bp, Mus musculus
ggaatcttatctaaaacatcaaggc

SEQ ID NO: 946558 - DNA, 25 bp, Mus musculus
ggaatcttatgtaaaacatcaaggc

SEQ ID NO: 946559 - DNA, 25 bp, Mus musculus
ggaatcttgaaacgctcacccttgc

SEQ ID NO: 946560 - DNA, 25 bp, Mus musculus
ggaatcttgaaaggctcacccttgc

SEQ ID NO: 946561 - DNA, 25 bp, Mus musculus
ggaatctttgcgaagaactgctgaa

SEQ ID NO: 946562 - DNA, 25 bp, Mus musculus
ggaatctttgggaagaactgctgaa

SEQ ID NO: 946563 - DNA, 25 bp, Mus musculus
ggaatgaaggcgtgccaacatacgc

SEQ ID NO: 946564 - DNA, 25 bp, Mus musculus
ggaatgaaggcgtggcaacatacgc

SEQ ID NO: 946565 - DNA, 25 bp, Mus musculus
ggaatgaccgagagtgggaccgtgg

SEQ ID NO: 946566 - DNA, 25 bp, Mus musculus
ggaatgaccgtgagtgggaccgtgg

SEQ ID NO: 946567 - DNA, 25 bp, Mus musculus
ggaatgatggcgctatcctgggttt

SEQ ID NO: 946568 - DNA, 25 bp, Mus musculus
ggaatgatggggctatcctgggttt

SEQ ID NO: 946569 - DNA, 25 bp, Mus musculus
ggaatgccagctcatcctcccactt

SEQ ID NO: 946570 - DNA, 25 bp, Mus musculus
ggaatgccaggtcatcctcccactt

SEQ ID NO: 946571 - DNA, 25 bp, Mus musculus
ggaatggaagacctgtgacttggaa

SEQ ID NO: 946572 - DNA, 25 bp, Mus musculus
ggaatggaagccaaacagttctgct

SEQ ID NO: 946573 - DNA, 25 bp, Mus musculus
ggaatggaaggcaaacagttctgct

SEQ ID NO: 946574 - DNA, 25 bp, Mus musculus
ggaatggaagtcctgtgacttggaa

SEQ ID NO: 946575 - DNA, 25 bp, Mus musculus
ggaatggactcaattggtcaaagaa

SEQ ID NO: 946576 - DNA, 25 bp, Mus musculus
ggaatggactcatttggtcaaagaa

SEQ ID NO: 946577 - DNA, 25 bp, Mus musculus
ggaatgggagagatgcagaaagaga

SEQ ID NO: 946578 - DNA, 25 bp, Mus musculus
ggaatgggagagcttttgcctacca

SEQ ID NO: 946579 - DNA, 25 bp, Mus musculus
ggaatgggagaggttttgcctacca

SEQ ID NO: 946580 - DNA, 25 bp, Mus musculus
ggaatgggagagttgcagaaagaga

SEQ ID NO: 946581 - DNA, 25 bp, Mus musculus
ggaatgggctacataccatctgcca

SEQ ID NO: 946582 - DNA, 25 bp, Mus musculus
ggaatgggctacatcccgtatgtgc

SEQ ID NO: 946583 - DNA, 25 bp, Mus musculus
ggaatgggctacttaccatctgcca

SEQ ID NO: 946584 - DNA, 25 bp, Mus musculus
ggaatgggctacttcccgtatgtgc

SEQ ID NO: 946585 - DNA, 25 bp, Mus musculus
ggaatgttagaacagagactcagcc

SEQ ID NO: 946586 - DNA, 25 bp, Mus musculus
ggaatgttagagactcagccatggt

SEQ ID NO: 946587 - DNA, 25 bp, Mus musculus
ggaatgttagtacagagactcagcc

SEQ ID NO: 946588 - DNA, 25 bp, Mus musculus
ggaatgttagtgactcagccatggt

SEQ ID NO: 946589 - DNA, 25 bp, Mus musculus
ggaattaaacagccatgatgcacag

SEQ ID NO: 946590 - DNA, 25 bp, Mus musculus
ggaattaaacaggcatgatgcacag

SEQ ID NO: 946591 - DNA, 25 bp, Mus musculus
ggaattaaactacgcctgaggagcg

SEQ ID NO: 946592 - DNA, 25 bp, Mus musculus
ggaattaaactaggcctgaggagcg

SEQ ID NO: 946593 - DNA, 25 bp, Mus musculus
ggaattacactccaccttgtcaaaa

SEQ ID NO: 946594 - DNA, 25 bp, Mus musculus
ggaattacactcgaccttgtcaaaa

SEQ ID NO: 946595 - DNA, 25 bp, Mus musculus
ggaattacagccgaagaagcaggca

SEQ ID NO: 946596 - DNA, 25 bp, Mus musculus
ggaattacagcgatcgcttacactt

SEQ ID NO: 946597 - DNA, 25 bp, Mus musculus
ggaattacaggcgaagaagcaggca

SEQ ID NO: 946598 - DNA, 25 bp, Mus musculus
ggaattacagggatcgcttacactt

SEQ ID NO: 946599 - DNA, 25 bp, Mus musculus
ggaattatctgacgaaggctacctg

SEQ ID NO: 946600 - DNA, 25 bp, Mus musculus
ggaattatctgaggaaggctacctg

SEQ ID NO: 946601 - DNA, 25 bp, Mus musculus
ggaattattcatcgcgacttaaagc

SEQ ID NO: 946602 - DNA, 25 bp, Mus musculus
ggaattattcatcgggacttaaagc

SEQ ID NO: 946603 - DNA, 25 bp, Mus musculus
ggaattcaagatggtcaaataaaaa

SEQ ID NO: 946604 - DNA, 25 bp, Mus musculus
ggaattcaagttggtcaaataaaaa

SEQ ID NO: 946605 - DNA, 25 bp, Mus musculus
ggaattcaatgacgagtacctggtg

SEQ ID NO: 946606 - DNA, 25 bp, Mus musculus
ggaattcaatgacgtgtacctggtg

SEQ ID NO: 946607 - DNA, 25 bp, Mus musculus
ggaattcacaagtggatcagcgact

SEQ ID NO: 946608 - DNA, 25 bp, Mus musculus
ggaattcacatgtggatcagcgact

SEQ ID NO: 946609 - DNA, 25 bp, Mus musculus
ggaattccagagattaaaactattt

SEQ ID NO: 946610 - DNA, 25 bp, Mus musculus
ggaattccagagtttaaaactattt

SEQ ID NO: 946611 - DNA, 25 bp, Mus musculus
ggaattcctcaacgcttttcatgag

SEQ ID NO: 946612 - DNA, 25 bp, Mus musculus
ggaattcctcaaggcttttcatgag

SEQ ID NO: 946613 - DNA, 25 bp, Mus musculus
ggaattgaatgtgacgtaataaatc

SEQ ID NO: 946614 - DNA, 25 bp, Mus musculus
ggaattgaatgtgaggtaataaatc

SEQ ID NO: 946615 - DNA, 25 bp, Mus musculus
ggaattgatgttagcatggatgaaa

SEQ ID NO: 946616 - DNA, 25 bp, Mus musculus
ggaattgatgttaggatggatgaaa

SEQ ID NO: 946617 - DNA, 25 bp, Mus musculus
ggaattgcaaagagtactgggacta

SEQ ID NO: 946618 - DNA, 25 bp, Mus musculus
ggaattgcaaagatgtgtccaggtg

SEQ ID NO: 946619 - DNA, 25 bp, Mus musculus
ggaattgcaaagtgtactgggacta

SEQ ID NO: 946620 - DNA, 25 bp, Mus musculus
ggaattgcaaagttgtgtccaggtg

SEQ ID NO: 946621 - DNA, 25 bp, Mus musculus
ggaattgctcagcaggctttagaaa

SEQ ID NO: 946622 - DNA, 25 bp, Mus musculus
ggaattgctcagccgagagcaggct

SEQ ID NO: 946623 - DNA, 25 bp, Mus musculus
ggaattgctcaggaggctttagaaa

SEQ ID NO: 946624 - DNA, 25 bp, Mus musculus
ggaattgctcaggcgagagcaggct

SEQ ID NO: 946625 - DNA, 25 bp, Mus musculus
ggaattgctgataacatctcccttg

SEQ ID NO: 946626 - DNA, 25 bp, Mus musculus
ggaattgctgataacatgtctggtg

SEQ ID NO: 946627 - DNA, 25 bp, Mus musculus
ggaattgctgataagatctcccttg

SEQ ID NO: 946628 - DNA, 25 bp, Mus musculus
ggaattgctgataagatgtctggtg

SEQ ID NO: 946629 - DNA, 25 bp, Mus musculus
ggaattggtcctcgctctgtctgta

SEQ ID NO: 946630 - DNA, 25 bp, Mus musculus
ggaattggtcctggctctgtctgta

SEQ ID NO: 946631 - DNA, 25 bp, Mus musculus
ggaatttatgccattagttggagtc

SEQ ID NO: 946632 - DNA, 25 bp, Mus musculus
ggaatttatgcctttagttggagtc

SEQ ID NO: 946633 - DNA, 25 bp, Mus musculus
ggaatttccgcatccgaggatgtca

SEQ ID NO: 946634 - DNA, 25 bp, Mus musculus
ggaatttccggatccgaggatgtca

SEQ ID NO: 946635 - DNA, 25 bp, Mus musculus
ggaatttcctggccgtgaagagcat

SEQ ID NO: 946636 - DNA, 25 bp, Mus musculus
ggaatttcctgggcgtgaagagcat

SEQ ID NO: 946637 - DNA, 25 bp, Mus musculus
ggaatttgcaaaccagctactgaag

SEQ ID NO: 946638 - DNA, 25 bp, Mus musculus
ggaatttgcaaagcagctactgaag

SEQ ID NO: 946639 - DNA, 25 bp, Mus musculus
ggacaaaaacaaccaaacagctctg

SEQ ID NO: 946640 - DNA, 25 bp, Mus musculus
ggacaaaaacaagcaaacagctctg

SEQ ID NO: 946641 - DNA, 25 bp, Mus musculus
ggacaaaaccaacgatgtggagtac

SEQ ID NO: 946642 - DNA, 25 bp, Mus musculus
ggacaaaaccaaggatgtggagtac

SEQ ID NO: 946643 - DNA, 25 bp, Mus musculus
ggacaaacaacgagctaagttcaga

SEQ ID NO: 946644 - DNA, 25 bp, Mus musculus
ggacaaacaacgtgctaagttcaga

SEQ ID NO: 946645 - DNA, 25 bp, Mus musculus
ggacaaaccaggcacctatatcttc

SEQ ID NO: 946646 - DNA, 25 bp, Mus musculus
ggacaaaccaggcagctatatcttc

SEQ ID NO: 946647 - DNA, 25 bp, Mus musculus
ggacaaacggctgtggctggaggag

SEQ ID NO: 946648 - DNA, 25 bp, Mus musculus
ggacaaacgggtgtggctggaggag

SEQ ID NO: 946649 - DNA, 25 bp, Mus musculus
ggacaaagatgactggataagtgga

SEQ ID NO: 946650 - DNA, 25 bp, Mus musculus
ggacaaagatgagtggataagtgga

SEQ ID NO: 946651 - DNA, 25 bp, Mus musculus
ggacaaagatgccacgggatctgag

SEQ ID NO: 946652 - DNA, 25 bp, Mus musculus
ggacaaagatgccaggggatctgag

SEQ ID NO: 946653 - DNA, 25 bp, Mus musculus
ggacaaatagagcctacgagaacta

SEQ ID NO: 946654 - DNA, 25 bp, Mus musculus
ggacaaatagaggctacgagaacta

SEQ ID NO: 946655 - DNA, 25 bp, Mus musculus
ggacaaatccaggtggctcctccca

SEQ ID NO: 946656 - DNA, 25 bp, Mus musculus
ggacaaatcctcctggctcctccca

SEQ ID NO: 946657 - DNA, 25 bp, Mus musculus
ggacaaatcctcgtggctcctccca

SEQ ID NO: 946658 - DNA, 25 bp, Mus musculus
ggacaaatcctggtggctcctccca

SEQ ID NO: 946659 - DNA, 25 bp, Mus musculus
ggacaaatgatggactgtgtgtccc

SEQ ID NO: 946660 - DNA, 25 bp, Mus musculus
ggacaaatgatggagtgtgtgtccc

SEQ ID NO: 946661 - DNA, 25 bp, Mus musculus
ggacaacaagcacaagttctgccta

SEQ ID NO: 946662 - DNA, 25 bp, Mus musculus
ggacaacaagcacatgttctgccta

SEQ ID NO: 946663 - DNA, 25 bp, Mus musculus
ggacaacaattccaaagattttggc

SEQ ID NO: 946664 - DNA, 25 bp, Mus musculus
ggacaacaattccatagattttggc

SEQ ID NO: 946665 - DNA, 25 bp, Mus musculus
ggacaacagtggctcgttggatcct

SEQ ID NO: 946666 - DNA, 25 bp, Mus musculus
ggacaacagtggctggttggatcct

SEQ ID NO: 946667 - DNA, 25 bp, Mus musculus
ggacaacatcaacgtgtctttggac

SEQ ID NO: 946668 - DNA, 25 bp, Mus musculus
ggacaacatcaaggtgtctttggac

SEQ ID NO: 946669 - DNA, 25 bp, Mus musculus
ggacaacatcagagactggtgcatc

SEQ ID NO: 946670 - DNA, 25 bp, Mus musculus
ggacaacatcagtgactggtgcatc

SEQ ID NO: 946671 - DNA, 25 bp, Mus musculus
ggacaacatggaaactcccgttact

SEQ ID NO: 946672 - DNA, 25 bp, Mus musculus
ggacaacatggaaagtcccgttact

SEQ ID NO: 946673 - DNA, 25 bp, Mus musculus
ggacaacgagcgagtggtgacgtat

SEQ ID NO: 946674 - DNA, 25 bp, Mus musculus
ggacaacgagcgagttgggatggct

SEQ ID NO: 946675 - DNA, 25 bp, Mus musculus
ggacaacgagcgtgtggtgacgtat

SEQ ID NO: 946676 - DNA, 25 bp, Mus musculus
ggacaacgagcgtgttgggatggct

SEQ ID NO: 946677 - DNA, 25 bp, Mus musculus
ggacaacggatccagaaagctacag

SEQ ID NO: 946678 - DNA, 25 bp, Mus musculus
ggacaacggatccgtcttggaaaca

SEQ ID NO: 946679 - DNA, 25 bp, Mus musculus
ggacaacggatcgagaaagctacag

SEQ ID NO: 946680 - DNA, 25 bp, Mus musculus
ggacaacggatcggtcttggaaaca

SEQ ID NO: 946681 - DNA, 25 bp, Mus musculus
ggacaactgaaacgtctctcggcgt

SEQ ID NO: 946682 - DNA, 25 bp, Mus musculus
ggacaactgaaaggtctctcggcgt

SEQ ID NO: 946683 - DNA, 25 bp, Mus musculus
ggacaactgccacgttatctgtgcg

SEQ ID NO: 946684 - DNA, 25 bp, Mus musculus
ggacaactgccaggttatctgtgcg

SEQ ID NO: 946685 - DNA, 25 bp, Mus musculus
ggacaacttgcgctacagaacaggc

SEQ ID NO: 946686 - DNA, 25 bp, Mus musculus
ggacaacttgggctacagaacaggc

SEQ ID NO: 946687 - DNA, 25 bp, Mus musculus
ggacaagaaaactgatcattcgtat

SEQ ID NO: 946688 - DNA, 25 bp, Mus musculus
ggacaagaaaactgttcattcgtat

SEQ ID NO: 946689 - DNA, 25 bp, Mus musculus
ggacaagaacttagtgatgtggaga

SEQ ID NO: 946690 - DNA, 25 bp, Mus musculus
ggacaagaactttgtgatgtggaga

SEQ ID NO: 946691 - DNA, 25 bp, Mus musculus
ggacaagatgctggaccagactacg

SEQ ID NO: 946692 - DNA, 25 bp, Mus musculus
ggacaagatggtggaccagactacg

SEQ ID NO: 946693 - DNA, 25 bp, Mus musculus
ggacaagcaaggcacatgctctcca

SEQ ID NO: 946694 - DNA, 25 bp, Mus musculus
ggacaagcaagggacatgctctcca

SEQ ID NO: 946695 - DNA, 25 bp, Mus musculus
ggacaagcagcagctgctcaatgga

SEQ ID NO: 946696 - DNA, 25 bp, Mus musculus
ggacaagcagctcccatgcatcatt

SEQ ID NO: 946697 - DNA, 25 bp, Mus musculus
ggacaagcaggagctgctcaatgga

SEQ ID NO: 946698 - DNA, 25 bp, Mus musculus
ggacaagcaggtcccatgcatcatt

SEQ ID NO: 946699 - DNA, 25 bp, Mus musculus
ggacaagtctataacggtcgacatg

SEQ ID NO: 946700 - DNA, 25 bp, Mus musculus
ggacaagtctataagggtcgacatg

SEQ ID NO: 946701 - DNA, 25 bp, Mus musculus
ggacaagtggctcgcacccgatggc

SEQ ID NO: 946702 - DNA, 25 bp, Mus musculus
ggacaagtggctggcacccgatggc

SEQ ID NO: 946703 - DNA, 25 bp, Mus musculus
ggacaatacgagcccgctgagcagc

SEQ ID NO: 946704 - DNA, 25 bp, Mus musculus
ggacaatacgagccggctgagcagc

SEQ ID NO: 946705 - DNA, 25 bp, Mus musculus
ggacaatcagagcactgtccaggtg

SEQ ID NO: 946706 - DNA, 25 bp, Mus musculus
ggacaatcagagggcactgctggag

SEQ ID NO: 946707 - DNA, 25 bp, Mus musculus
ggacaatcagcgcctgttggtctgg

SEQ ID NO: 946708 - DNA, 25 bp, Mus musculus
ggacaatcagggcctgttggtctgg

SEQ ID NO: 946709 - DNA, 25 bp, Mus musculus
ggacaatcagtgcactgtccaggtg

SEQ ID NO: 946710 - DNA, 25 bp, Mus musculus
ggacaatcagtgggcactgctggag

SEQ ID NO: 946711 - DNA, 25 bp, Mus musculus
ggacaatctcaccctgtggacgtca

SEQ ID NO: 946712 - DNA, 25 bp, Mus musculus
ggacaatctcacgctgtggacgtca

SEQ ID NO: 946713 - DNA, 25 bp, Mus musculus
ggacaatgaaaacgtatccaacggt

SEQ ID NO: 946714 - DNA, 25 bp, Mus musculus
ggacaatgaaaaggtatccaacggt

SEQ ID NO: 946715 - DNA, 25 bp, Mus musculus
ggacaatgagcatggcagtacctgg

SEQ ID NO: 946716 - DNA, 25 bp, Mus musculus
ggacaatgaggatggcagtacctgg

SEQ ID NO: 946717 - DNA, 25 bp, Mus musculus
ggacaatgcaatttctgccagctgt

SEQ ID NO: 946718 - DNA, 25 bp, Mus musculus
ggacaatgcattttctgccagctgt

SEQ ID NO: 946719 - DNA, 25 bp, Mus musculus
ggacaattgaacaattgcctatagc

SEQ ID NO: 946720 - DNA, 25 bp, Mus musculus
ggacaattgactggctgtgttttgg

SEQ ID NO: 946721 - DNA, 25 bp, Mus musculus
ggacaattgagtggctgtgttttgg

SEQ ID NO: 946722 - DNA, 25 bp, Mus musculus
ggacaattgatcaattgcctatagc

SEQ ID NO: 946723 - DNA, 25 bp, Mus musculus
ggacaatttacgctacagaacaggc

SEQ ID NO: 946724 - DNA, 25 bp, Mus musculus
ggacaatttaggctacagaacaggc

SEQ ID NO: 946725 - DNA, 25 bp, Mus musculus
ggacacaaacgacgtataagtattg

SEQ ID NO: 946726 - DNA, 25 bp, Mus musculus
ggacacaaacgaggtataagtattg

SEQ ID NO: 946727 - DNA, 25 bp, Mus musculus
ggacacacaattcggccggcggcgg

SEQ ID NO: 946728 - DNA, 25 bp, Mus musculus
ggacacacaattcgtggacgcagac

SEQ ID NO: 946729 - DNA, 25 bp, Mus musculus
ggacacacaattgggccggcggcgg

SEQ ID NO: 946730 - DNA, 25 bp, Mus musculus
ggacacacaattggtggacgcagac

SEQ ID NO: 946731 - DNA, 25 bp, Mus musculus
ggacacacagaatcgatcgatctgc

SEQ ID NO: 946732 - DNA, 25 bp, Mus musculus
ggacacacagacactgtcctgttgg

SEQ ID NO: 946733 - DNA, 25 bp, Mus musculus
ggacacacagcttatctgtcctgtt

SEQ ID NO: 946734 - DNA, 25 bp, Mus musculus
ggacacacaggttatctgtcctgtt

SEQ ID NO: 946735 - DNA, 25 bp, Mus musculus
ggacacacagtatcgatcgatctgc

SEQ ID NO: 946736 - DNA, 25 bp, Mus musculus
ggacacacagtcactgtcctgttgg

SEQ ID NO: 946737 - DNA, 25 bp, Mus musculus
ggacacacggcctacttgtcctgct

SEQ ID NO: 946738 - DNA, 25 bp, Mus musculus
ggacacacgggctacttgtcctgct

SEQ ID NO: 946739 - DNA, 25 bp, Mus musculus
ggacacagagccaccaggtaacata

SEQ ID NO: 946740 - DNA, 25 bp, Mus musculus
ggacacagaggcaccaggtaacata

SEQ ID NO: 946741 - DNA, 25 bp, Mus musculus
ggacacagcaagagatttagttcct

SEQ ID NO: 946742 - DNA, 25 bp, Mus musculus
ggacacagcaagtgatttagttcct

SEQ ID NO: 946743 - DNA, 25 bp, Mus musculus
ggacacagcgagaattggacaaatt

SEQ ID NO: 946744 - DNA, 25 bp, Mus musculus
ggacacagcgagtattggacaaatt

SEQ ID NO: 946745 - DNA, 25 bp, Mus musculus
ggacacaggaagccattggctgacc

SEQ ID NO: 946746 - DNA, 25 bp, Mus musculus
ggacacaggaaggcattggctgacc

SEQ ID NO: 946747 - DNA, 25 bp, Mus musculus
ggacacatgcagaaaagtaaagaac

SEQ ID NO: 946748 - DNA, 25 bp, Mus musculus
ggacacatgcagccgcatacctctt

SEQ ID NO: 946749 - DNA, 25 bp, Mus musculus
ggacacatgcagctggtgaatgagc

SEQ ID NO: 946750 - DNA, 25 bp, Mus musculus
ggacacatgcaggcgcatacctctt

SEQ ID NO: 946751 - DNA, 25 bp, Mus musculus
ggacacatgcaggtggtgaatgagc

SEQ ID NO: 946752 - DNA, 25 bp, Mus musculus
ggacacatgcagtaaagtaaagaac

SEQ ID NO: 946753 - DNA, 25 bp, Mus musculus
ggacacattcagcactgtcatctcc

SEQ ID NO: 946754 - DNA, 25 bp, Mus musculus
ggacacattcagcagtgtcatctcc

SEQ ID NO: 946755 - DNA, 25 bp, Mus musculus
ggacaccaagcgtccaccaacagca

SEQ ID NO: 946756 - DNA, 25 bp, Mus musculus
ggacaccaagggtccaccaacagca

SEQ ID NO: 946757 - DNA, 25 bp, Mus musculus
ggacaccatcatccagaaagaacgc

SEQ ID NO: 946758 - DNA, 25 bp, Mus musculus
ggacaccatcttccagaaagaacgc

SEQ ID NO: 946759 - DNA, 25 bp, Mus musculus
ggacaccatgcatacgaagcacctt

SEQ ID NO: 946760 - DNA, 25 bp, Mus musculus
ggacaccatgcataggaagcacctt

SEQ ID NO: 946761 - DNA, 25 bp, Mus musculus
ggacacccaaggatgtgaatgagtg

SEQ ID NO: 946762 - DNA, 25 bp, Mus musculus
ggacacccaaggttgtgaatgagtg

SEQ ID NO: 946763 - DNA, 25 bp, Mus musculus
ggacaccgcgcacatctcaagcata

SEQ ID NO: 946764 - DNA, 25 bp, Mus musculus
ggacaccgcgcagatctcaagcata

SEQ ID NO: 946765 - DNA, 25 bp, Mus musculus
ggacacctaggcctcatccagagct

SEQ ID NO: 946766 - DNA, 25 bp, Mus musculus
ggacacctaggcctgatccagagct

SEQ ID NO: 946767 - DNA, 25 bp, Mus musculus
ggacacctgtcgcccatattttaat

SEQ ID NO: 946768 - DNA, 25 bp, Mus musculus
ggacacctgtcgcccctgagtgcaa

SEQ ID NO: 946769 - DNA, 25 bp, Mus musculus
ggacacctgtcgccgatattttaat

SEQ ID NO: 946770 - DNA, 25 bp, Mus musculus
ggacacctgtcgccgctgagtgcaa

SEQ ID NO: 946771 - DNA, 25 bp, Mus musculus
ggacacgagctggactgagcaaacc

SEQ ID NO: 946772 - DNA, 25 bp, Mus musculus
ggacacgagctggagtgagcaaacc

SEQ ID NO: 946773 - DNA, 25 bp, Mus musculus
ggacacgcaccactggtatgtgtgc

SEQ ID NO: 946774 - DNA, 25 bp, Mus musculus
ggacacgcaccagtggtatgtgtgc

SEQ ID NO: 946775 - DNA, 25 bp, Mus musculus
ggacacggagcaccccaccttggga

SEQ ID NO: 946776 - DNA, 25 bp, Mus musculus
ggacacggagcagcccaccttggga

SEQ ID NO: 946777 - DNA, 25 bp, Mus musculus
ggacacgtacaccgtttatgtcatc

SEQ ID NO: 946778 - DNA, 25 bp, Mus musculus
ggacacgtacacggtttatgtcatc

SEQ ID NO: 946779 - DNA, 25 bp, Mus musculus
ggacactacgaacagcacattagtt

SEQ ID NO: 946780 - DNA, 25 bp, Mus musculus
ggacactacgtacagcacattagtt

SEQ ID NO: 946781 - DNA, 25 bp, Mus musculus
ggacactcagagactgtctctggag

SEQ ID NO: 946782 - DNA, 25 bp, Mus musculus
ggacactcagagcatttccctagag

SEQ ID NO: 946783 - DNA, 25 bp, Mus musculus
ggacactcagaggatttccctagag

SEQ ID NO: 946784 - DNA, 25 bp, Mus musculus
ggacactcagagtctgtctctggag

SEQ ID NO: 946785 - DNA, 25 bp, Mus musculus
ggacactccaagccatgtagaagtc

SEQ ID NO: 946786 - DNA, 25 bp, Mus musculus
ggacactccaaggcatgtagaagtc

SEQ ID NO: 946787 - DNA, 25 bp, Mus musculus
ggacactgatcgccaccggggagat

SEQ ID NO: 946788 - DNA, 25 bp, Mus musculus
ggacactgatcggcaccggggagat

SEQ ID NO: 946789 - DNA, 25 bp, Mus musculus
ggacactggaaggtctacgtctggg

SEQ ID NO: 946790 - DNA, 25 bp, Mus musculus
ggacactggagacgtctacgtctgg

SEQ ID NO: 946791 - DNA, 25 bp, Mus musculus
ggacactggagaggtctacgtctgg

SEQ ID NO: 946792 - DNA, 25 bp, Mus musculus
ggacactggatggtctacgtctggg

SEQ ID NO: 946793 - DNA, 25 bp, Mus musculus
ggacactggtcacgtgaagtaaatg

SEQ ID NO: 946794 - DNA, 25 bp, Mus musculus
ggacactggtcaggtgaagtaaatg

SEQ ID NO: 946795 - DNA, 25 bp, Mus musculus
ggacactgtatccgttccatgtaag

SEQ ID NO: 946796 - DNA, 25 bp, Mus musculus
ggacactgtatcggttccatgtaag

SEQ ID NO: 946797 - DNA, 25 bp, Mus musculus
ggacactgtcaacggcagggtcaaa

SEQ ID NO: 946798 - DNA, 25 bp, Mus musculus
ggacactgtcaagggcagggtcaaa

SEQ ID NO: 946799 - DNA, 25 bp, Mus musculus
ggacacttaacacgtccccaggcaa

SEQ ID NO: 946800 - DNA, 25 bp, Mus musculus
ggacacttaacaggtccccaggcaa

SEQ ID NO: 946801 - DNA, 25 bp, Mus musculus
ggacacttgcagcggagactccggc

SEQ ID NO: 946802 - DNA, 25 bp, Mus musculus
ggacacttgcaggggagactccggc

SEQ ID NO: 946803 - DNA, 25 bp, Mus musculus
ggacagaaactaaaataagtgacga

SEQ ID NO: 946804 - DNA, 25 bp, Mus musculus
ggacagaaactaaattaagtgacga

SEQ ID NO: 946805 - DNA, 25 bp, Mus musculus
ggacagaacctcaacgagctgcggg

SEQ ID NO: 946806 - DNA, 25 bp, Mus musculus
ggacagaacctcaaggagctgcggg

SEQ ID NO: 946807 - DNA, 25 bp, Mus musculus
ggacagactggacgcattctggaat

SEQ ID NO: 946808 - DNA, 25 bp, Mus musculus
ggacagactggaggcattctggaat

SEQ ID NO: 946809 - DNA, 25 bp, Mus musculus
ggacagagagataattgacaagtac

SEQ ID NO: 946810 - DNA, 25 bp, Mus musculus
ggacagagagttaattgacaagtac

SEQ ID NO: 946811 - DNA, 25 bp, Mus musculus
ggacagagcgcgaacggccacagtc

SEQ ID NO: 946812 - DNA, 25 bp, Mus musculus
ggacagagcgggaacggccacagtc

SEQ ID NO: 946813 - DNA, 25 bp, Mus musculus
ggacagataactggcctcacgttga

SEQ ID NO: 946814 - DNA, 25 bp, Mus musculus
ggacagataactgggctcacgttga

SEQ ID NO: 946815 - DNA, 25 bp, Mus musculus
ggacagatcattccctggaacttcc

SEQ ID NO: 946816 - DNA, 25 bp, Mus musculus
ggacagatcattccgtggaacttcc

SEQ ID NO: 946817 - DNA, 25 bp, Mus musculus
ggacagatgtccactcccgagactc

SEQ ID NO: 946818 - DNA, 25 bp, Mus musculus
ggacagatgtgcactcccgagactc

SEQ ID NO: 946819 - DNA, 25 bp, Mus musculus
ggacagatgttcatcataggagaca

SEQ ID NO: 946820 - DNA, 25 bp, Mus musculus
ggacagatgttcatcggactttcag

SEQ ID NO: 946821 - DNA, 25 bp, Mus musculus
ggacagatgttcatgataggagaca

SEQ ID NO: 946822 - DNA, 25 bp, Mus musculus
ggacagatgttcatgggactttcag

SEQ ID NO: 946823 - DNA, 25 bp, Mus musculus
ggacagatgttctcaactcctggaa

SEQ ID NO: 946824 - DNA, 25 bp, Mus musculus
ggacagatgttctctactcctggaa

SEQ ID NO: 946825 - DNA, 25 bp, Mus musculus
ggacagattgcactttttgatgcca

SEQ ID NO: 946826 - DNA, 25 bp, Mus musculus
ggacagattgcagtttttgatgcca

SEQ ID NO: 946827 - DNA, 25 bp, Mus musculus
ggacagcaagaattgacagtaccag

SEQ ID NO: 946828 - DNA, 25 bp, Mus musculus
ggacagcaagagcctactttggtga

SEQ ID NO: 946829 - DNA, 25 bp, Mus musculus
ggacagcaagcgccatgtgaaactt

SEQ ID NO: 946830 - DNA, 25 bp, Mus musculus
ggacagcaagggccatgtgaaactt

SEQ ID NO: 946831 - DNA, 25 bp, Mus musculus
ggacagcaagtattgacagtaccag

SEQ ID NO: 946832 - DNA, 25 bp, Mus musculus
ggacagcaagtgcctactttggtga

SEQ ID NO: 946833 - DNA, 25 bp, Mus musculus
ggacagcacaaaagtctgcagaatc

SEQ ID NO: 946834 - DNA, 25 bp, Mus musculus
ggacagcacaaatgtctgcagaatc

SEQ ID NO: 946835 - DNA, 25 bp, Mus musculus
ggacagcacacacacgtactttgag

SEQ ID NO: 946836 - DNA, 25 bp, Mus musculus
ggacagcacacacaggtactttgag

SEQ ID NO: 946837 - DNA, 25 bp, Mus musculus
ggacagcagcagcttcttcgtcctg

SEQ ID NO: 946838 - DNA, 25 bp, Mus musculus
ggacagcagcagcttcttcgtggag

SEQ ID NO: 946839 - DNA, 25 bp, Mus musculus
ggacagcagcaggttcttcgtcctg

SEQ ID NO: 946840 - DNA, 25 bp, Mus musculus
ggacagcagcaggttcttcgtggag

SEQ ID NO: 946841 - DNA, 25 bp, Mus musculus
ggacagcatcctcacgtatttggag

SEQ ID NO: 946842 - DNA, 25 bp, Mus musculus
ggacagcatcctcaggtatttggag

SEQ ID NO: 946843 - DNA, 25 bp, Mus musculus
ggacagccagattgttgaagtcgaa

SEQ ID NO: 946844 - DNA, 25 bp, Mus musculus
ggacagccagtttgttgaagtcgaa

SEQ ID NO: 946845 - DNA, 25 bp, Mus musculus
ggacagccgtgctaaatcttgctgc

SEQ ID NO: 946846 - DNA, 25 bp, Mus musculus
ggacagccgtgctatatcttgctgc

SEQ ID NO: 946847 - DNA, 25 bp, Mus musculus
ggacagcctgcccacgctgcctatc

SEQ ID NO: 946848 - DNA, 25 bp, Mus musculus
ggacagcctgcccaggctgcctatc

SEQ ID NO: 946849 - DNA, 25 bp, Mus musculus
ggacagcgagcgcaatctgcagatc

SEQ ID NO: 946850 - DNA, 25 bp, Mus musculus
ggacagcgagggcaatctgcagatc

SEQ ID NO: 946851 - DNA, 25 bp, Mus musculus
ggacagctatcccacgaccgggact

SEQ ID NO: 946852 - DNA, 25 bp, Mus musculus
ggacagctatcccacgcccctctgc

SEQ ID NO: 946853 - DNA, 25 bp, Mus musculus
ggacagctatcccaggaccgggact

SEQ ID NO: 946854 - DNA, 25 bp, Mus musculus
ggacagctatcccaggcccctctgc

SEQ ID NO: 946855 - DNA, 25 bp, Mus musculus
ggacagctcggaccactgccaagga

SEQ ID NO: 946856 - DNA, 25 bp, Mus musculus
ggacagctcggacctctgccaagga

SEQ ID NO: 946857 - DNA, 25 bp, Mus musculus
ggacagctctctatcatcttaccaa

SEQ ID NO: 946858 - DNA, 25 bp, Mus musculus
ggacagctctctatgatcttaccaa

SEQ ID NO: 946859 - DNA, 25 bp, Mus musculus
ggacagctgcttaaccttcaggcct

SEQ ID NO: 946860 - DNA, 25 bp, Mus musculus
ggacagctgcttaagcttcaggcct

SEQ ID NO: 946861 - DNA, 25 bp, Mus musculus
ggacagctggatgaagctcgtgtca

SEQ ID NO: 946862 - DNA, 25 bp, Mus musculus
ggacagctggatgatgctcgtgtca

SEQ ID NO: 946863 - DNA, 25 bp, Mus musculus
ggacaggaagagactcgcaaagcta

SEQ ID NO: 946864 - DNA, 25 bp, Mus musculus
ggacaggaagtgactcgcaaagcta

SEQ ID NO: 946865 - DNA, 25 bp, Mus musculus
ggacaggattcgcaagctgaccagt

SEQ ID NO: 946866 - DNA, 25 bp, Mus musculus
ggacaggattcgcatgctgaccagt

SEQ ID NO: 946867 - DNA, 25 bp, Mus musculus
ggacaggcaatgaccaaataacccc

SEQ ID NO: 946868 - DNA, 25 bp, Mus musculus
ggacaggcaatgacgaaataacccc

SEQ ID NO: 946869 - DNA, 25 bp, Mus musculus
ggacaggcagctcacgaaaataaaa

SEQ ID NO: 946870 - DNA, 25 bp, Mus musculus
ggacaggcagctcaggaaaataaaa

SEQ ID NO: 946871 - DNA, 25 bp, Mus musculus
ggacaggcagtgctccagagtccag

SEQ ID NO: 946872 - DNA, 25 bp, Mus musculus
ggacaggcagtggtccagagtccag

SEQ ID NO: 946873 - DNA, 25 bp, Mus musculus
ggacaggtgcaagtaatcccacagg

SEQ ID NO: 946874 - DNA, 25 bp, Mus musculus
ggacaggtgcaagttatcccacagg

SEQ ID NO: 946875 - DNA, 25 bp, Mus musculus
ggacaggttatgggcgcaccagctg

SEQ ID NO: 946876 - DNA, 25 bp, Mus musculus
ggacaggttatgggggcaccagctg

SEQ ID NO: 946877 - DNA, 25 bp, Mus musculus
ggacaggttctttgcctctgtatga

SEQ ID NO: 946878 - DNA, 25 bp, Mus musculus
ggacaggttctttggctctgtatga

SEQ ID NO: 946879 - DNA, 25 bp, Mus musculus
ggacagtaggcaacagacgccgctt

SEQ ID NO: 946880 - DNA, 25 bp, Mus musculus
ggacagtagggaacagacgccgctt

SEQ ID NO: 946881 - DNA, 25 bp, Mus musculus
ggacagtctgacacagcaattacca

SEQ ID NO: 946882 - DNA, 25 bp, Mus musculus
ggacagtctgacactgcaattacca

SEQ ID NO: 946883 - DNA, 25 bp, Mus musculus
ggacagtctgcatcaactgctacaa

SEQ ID NO: 946884 - DNA, 25 bp, Mus musculus
ggacagtctggatcaactgctacaa

SEQ ID NO: 946885 - DNA, 25 bp, Mus musculus
ggacagtgagctggtgacccctcct

SEQ ID NO: 946886 - DNA, 25 bp, Mus musculus
ggacagtgaggtggtgacccctcct

SEQ ID NO: 946887 - DNA, 25 bp, Mus musculus
ggacagtgccaacatttaaacgagt

SEQ ID NO: 946888 - DNA, 25 bp, Mus musculus
ggacagtgccaacctgtgtgtcaac

SEQ ID NO: 946889 - DNA, 25 bp, Mus musculus
ggacagtgccaacctttctacgtct

SEQ ID NO: 946890 - DNA, 25 bp, Mus musculus
ggacagtgccaagatttaaacgagt

SEQ ID NO: 946891 - DNA, 25 bp, Mus musculus
ggacagtgccaagctgtgtgtcaac

SEQ ID NO: 946892 - DNA, 25 bp, Mus musculus
ggacagtgccaagctttctacgtct

SEQ ID NO: 946893 - DNA, 25 bp, Mus musculus
ggacagtgccagctgaggatggttc

SEQ ID NO: 946894 - DNA, 25 bp, Mus musculus
ggacagtgccaggtgaggatggttc

SEQ ID NO: 946895 - DNA, 25 bp, Mus musculus
ggacagtgcccaatgctggcggtcc

SEQ ID NO: 946896 - DNA, 25 bp, Mus musculus
ggacagtgcccattgctggcggtcc

SEQ ID NO: 946897 - DNA, 25 bp, Mus musculus
ggacagtgccttcacagtgatccac

SEQ ID NO: 946898 - DNA, 25 bp, Mus musculus
ggacagtgccttcacgtgccttgga

SEQ ID NO: 946899 - DNA, 25 bp, Mus musculus
ggacagtgccttcagagtgatccac

SEQ ID NO: 946900 - DNA, 25 bp, Mus musculus
ggacagtgccttcaggtgccttgga

SEQ ID NO: 946901 - DNA, 25 bp, Mus musculus
ggacagtgctctcagaacagtacgg

SEQ ID NO: 946902 - DNA, 25 bp, Mus musculus
ggacagtgctctgagaacagtacgg

SEQ ID NO: 946903 - DNA, 25 bp, Mus musculus
ggacagtgtctacatattgatgaat

SEQ ID NO: 946904 - DNA, 25 bp, Mus musculus
ggacagtgtctagatattgatgaat

SEQ ID NO: 946905 - DNA, 25 bp, Mus musculus
ggacagtgtgaccgtaccgaccctt

SEQ ID NO: 946906 - DNA, 25 bp, Mus musculus
ggacagtgtgacggtaccgaccctt

SEQ ID NO: 946907 - DNA, 25 bp, Mus musculus
ggacagtgtggacgggcagtctctg

SEQ ID NO: 946908 - DNA, 25 bp, Mus musculus
ggacagtgtggaggggcagtctctg

SEQ ID NO: 946909 - DNA, 25 bp, Mus musculus
ggacatacaagactcgtaccagcaa

SEQ ID NO: 946910 - DNA, 25 bp, Mus musculus
ggacatacaagactggtaccagcaa

SEQ ID NO: 946911 - DNA, 25 bp, Mus musculus
ggacatatcaattactgggattcag

SEQ ID NO: 946912 - DNA, 25 bp, Mus musculus
ggacatatcatttactgggattcag

SEQ ID NO: 946913 - DNA, 25 bp, Mus musculus
ggacatcagaagcacgagctatctg

SEQ ID NO: 946914 - DNA, 25 bp, Mus musculus
ggacatcagaagcaggagctatctg

SEQ ID NO: 946915 - DNA, 25 bp, Mus musculus
ggacatcatctttgaggacagtgcg

SEQ ID NO: 946916 - DNA, 25 bp, Mus musculus
ggacatcatctttgtggacagtgcg

SEQ ID NO: 946917 - DNA, 25 bp, Mus musculus
ggacatcatgcagtatgctgtgaac

SEQ ID NO: 946918 - DNA, 25 bp, Mus musculus
ggacatcatggagtatgctgtgaac

SEQ ID NO: 946919 - DNA, 25 bp, Mus musculus
ggacatcattcacaaatggcaaaat

SEQ ID NO: 946920 - DNA, 25 bp, Mus musculus
ggacatcattcacggctgcaaaata

SEQ ID NO: 946921 - DNA, 25 bp, Mus musculus
ggacatcattcagaaatggcaaaat

SEQ ID NO: 946922 - DNA, 25 bp, Mus musculus
ggacatcattcagggctgcaaaata

SEQ ID NO: 946923 - DNA, 25 bp, Mus musculus
ggacatccgtggcctagcccatgcc

SEQ ID NO: 946924 - DNA, 25 bp, Mus musculus
ggacatccgtggctccattgtctac

SEQ ID NO: 946925 - DNA, 25 bp, Mus musculus
ggacatccgtgggctagcccatgcc

SEQ ID NO: 946926 - DNA, 25 bp, Mus musculus
ggacatccgtgggtccattgtctac

SEQ ID NO: 946927 - DNA, 25 bp, Mus musculus
ggacatcctgaactactttgagagc

SEQ ID NO: 946928 - DNA, 25 bp, Mus musculus
ggacatcctgcctccttccttgtgt

SEQ ID NO: 946929 - DNA, 25 bp, Mus musculus
ggacatcctggctccttccttgtgt

SEQ ID NO: 946930 - DNA, 25 bp, Mus musculus
ggacatcctgtactactttgagagc

SEQ ID NO: 946931 - DNA, 25 bp, Mus musculus
ggacatctcacaaaaaacatcggac

SEQ ID NO: 946932 - DNA, 25 bp, Mus musculus
ggacatctcacataaaacatcggac

SEQ ID NO: 946933 - DNA, 25 bp, Mus musculus
ggacatctccaacatgcacatgatc

SEQ ID NO: 946934 - DNA, 25 bp, Mus musculus
ggacatctccaagatgcacatgatc

SEQ ID NO: 946935 - DNA, 25 bp, Mus musculus
ggacatctccagcgaagaggtgaat

SEQ ID NO: 946936 - DNA, 25 bp, Mus musculus
ggacatctccagggaagaggtgaat

SEQ ID NO: 946937 - DNA, 25 bp, Mus musculus
ggacatcttcaccacgtccagctag

SEQ ID NO: 946938 - DNA, 25 bp, Mus musculus
ggacatcttcaccactctaaatcca

SEQ ID NO: 946939 - DNA, 25 bp, Mus musculus
ggacatcttcaccaggtccagctag

SEQ ID NO: 946940 - DNA, 25 bp, Mus musculus
ggacatcttcaccagtctaaatcca

SEQ ID NO: 946941 - DNA, 25 bp, Mus musculus
ggacatcttcctcaggaatgtcaca

SEQ ID NO: 946942 - DNA, 25 bp, Mus musculus
ggacatcttcctcgacacatcttac

SEQ ID NO: 946943 - DNA, 25 bp, Mus musculus
ggacatcttcctgaggaatgtcaca

SEQ ID NO: 946944 - DNA, 25 bp, Mus musculus
ggacatcttcctggacacatcttac

SEQ ID NO: 946945 - DNA, 25 bp, Mus musculus
ggacatgaaacacgctctcaccccg

SEQ ID NO: 946946 - DNA, 25 bp, Mus musculus
ggacatgaaacaggctctcaccccg

SEQ ID NO: 946947 - DNA, 25 bp, Mus musculus
ggacatgccaagacattgacgagtg

SEQ ID NO: 946948 - DNA, 25 bp, Mus musculus
ggacatgccaagtcattgacgagtg

SEQ ID NO: 946949 - DNA, 25 bp, Mus musculus
ggacatggagactcgccttttcctt

SEQ ID NO: 946950 - DNA, 25 bp, Mus musculus
ggacatggagtctcgccttttcctt

SEQ ID NO: 946951 - DNA, 25 bp, Mus musculus
ggacatggcaagcctgtggactggt

SEQ ID NO: 946952 - DNA, 25 bp, Mus musculus
ggacatggcaaggctgtggactggt

SEQ ID NO: 946953 - DNA, 25 bp, Mus musculus
ggacatgtgcaacttcttggtgaat

SEQ ID NO: 946954 - DNA, 25 bp, Mus musculus
ggacatgtgcaagttcttggtgaat

SEQ ID NO: 946955 - DNA, 25 bp, Mus musculus
ggacattaagacctgctgtaactgg

SEQ ID NO: 946956 - DNA, 25 bp, Mus musculus
ggacattaagtcctgctgtaactgg

SEQ ID NO: 946957 - DNA, 25 bp, Mus musculus
ggacattgagacagaaagacatggc

SEQ ID NO: 946958 - DNA, 25 bp, Mus musculus
ggacattgagtcagaaagacatggc

SEQ ID NO: 946959 - DNA, 25 bp, Mus musculus
ggacattggtaccgagtgcatgaac

SEQ ID NO: 946960 - DNA, 25 bp, Mus musculus
ggacattggttccgagtgcatgaac

SEQ ID NO: 946961 - DNA, 25 bp, Mus musculus
ggacatttgaagctatcgccgggca

SEQ ID NO: 946962 - DNA, 25 bp, Mus musculus
ggacatttgaaggtatcgccgggca

SEQ ID NO: 946963 - DNA, 25 bp, Mus musculus
ggaccaaatgcaatgaataaaatgg

SEQ ID NO: 946964 - DNA, 25 bp, Mus musculus
ggaccaaatggaatgaataaaatgg

SEQ ID NO: 946965 - DNA, 25 bp, Mus musculus
ggaccacaaggaacaccatatgaag

SEQ ID NO: 946966 - DNA, 25 bp, Mus musculus
ggaccacaaggatcaccatatgaag

SEQ ID NO: 946967 - DNA, 25 bp, Mus musculus
ggaccacaccagatcctctaattct

SEQ ID NO: 946968 - DNA, 25 bp, Mus musculus
ggaccacaccagcattcggaggggt

SEQ ID NO: 946969 - DNA, 25 bp, Mus musculus
ggaccacaccaggattcggaggggt

SEQ ID NO: 946970 - DNA, 25 bp, Mus musculus
ggaccacaccagttcctctaattct

SEQ ID NO: 946971 - DNA, 25 bp, Mus musculus
ggaccaccacagctcgagaaatatc

SEQ ID NO: 946972 - DNA, 25 bp, Mus musculus
ggaccaccacagctggagaaatatc

SEQ ID NO: 946973 - DNA, 25 bp, Mus musculus
ggaccaccatgataatggaccatgt

SEQ ID NO: 946974 - DNA, 25 bp, Mus musculus
ggaccaccatgatattggaccatgt

SEQ ID NO: 946975 - DNA, 25 bp, Mus musculus
ggaccacccagccgtggctgccaca

SEQ ID NO: 946976 - DNA, 25 bp, Mus musculus
ggaccacccagcggtggctgccaca

SEQ ID NO: 946977 - DNA, 25 bp, Mus musculus
ggaccacgacgcactgaaggaggac

SEQ ID NO: 946978 - DNA, 25 bp, Mus musculus
ggaccacgacgctctgaaggaggac

SEQ ID NO: 946979 - DNA, 25 bp, Mus musculus
ggaccacgagattctcgagttcgcg

SEQ ID NO: 946980 - DNA, 25 bp, Mus musculus
ggaccacgagtttctcgagttcgcg

SEQ ID NO: 946981 - DNA, 25 bp, Mus musculus
ggaccactaccaagcaccagcaccc

SEQ ID NO: 946982 - DNA, 25 bp, Mus musculus
ggaccactaccatgcaccagcaccc

SEQ ID NO: 946983 - DNA, 25 bp, Mus musculus
ggaccactcccgatgcaactccagg

SEQ ID NO: 946984 - DNA, 25 bp, Mus musculus
ggaccactcccgcaagatgcaactc

SEQ ID NO: 946985 - DNA, 25 bp, Mus musculus
ggaccactcccggaagatgcaactc

SEQ ID NO: 946986 - DNA, 25 bp, Mus musculus
ggaccactcccgttgcaactccagg

SEQ ID NO: 946987 - DNA, 25 bp, Mus musculus
ggaccacttcaacacgactcatttc

SEQ ID NO: 946988 - DNA, 25 bp, Mus musculus
ggaccacttcaacaggactcatttc

SEQ ID NO: 946989 - DNA, 25 bp, Mus musculus
ggaccagaaccacgatggctgcatc

SEQ ID NO: 946990 - DNA, 25 bp, Mus musculus
ggaccagaaccaggatggctgcatc

SEQ ID NO: 946991 - DNA, 25 bp, Mus musculus
ggaccagagaagaagccacaggaag

SEQ ID NO: 946992 - DNA, 25 bp, Mus musculus
ggaccagagaagcagaagccacagg

SEQ ID NO: 946993 - DNA, 25 bp, Mus musculus
ggaccagagaaggagaagccacagg

SEQ ID NO: 946994 - DNA, 25 bp, Mus musculus
ggaccagagaagtagccacaggaag

SEQ ID NO: 946995 - DNA, 25 bp, Mus musculus
ggaccagagattcacatgtggagtt

SEQ ID NO: 946996 - DNA, 25 bp, Mus musculus
ggaccagagattcagatgtggagtt

SEQ ID NO: 946997 - DNA, 25 bp, Mus musculus
ggaccagcagatcctatgcacccga

SEQ ID NO: 946998 - DNA, 25 bp, Mus musculus
ggaccagcagatgctatgcacccga

SEQ ID NO: 946999 - DNA, 25 bp, Mus musculus
ggaccagctgcgcgcctgtcaagct

SEQ ID NO: 947000 - DNA, 25 bp, Mus musculus
ggaccagctgcgggcctgtcaagct

SEQ ID NO: 947001 - DNA, 25 bp, Mus musculus
ggaccaggacaacatatttcaagga

SEQ ID NO: 947002 - DNA, 25 bp, Mus musculus
ggaccaggacaagatatttcaagga

SEQ ID NO: 947003 - DNA, 25 bp, Mus musculus
ggaccaggagctggtgcccacagca

SEQ ID NO: 947004 - DNA, 25 bp, Mus musculus
ggaccaggaggtggtgcccacagca

SEQ ID NO: 947005 - DNA, 25 bp, Mus musculus
ggaccagggacacactcactctgtg

SEQ ID NO: 947006 - DNA, 25 bp, Mus musculus
ggaccagggacagactcactctgtg

SEQ ID NO: 947007 - DNA, 25 bp, Mus musculus
ggaccagtacctcgagtggctcacc

SEQ ID NO: 947008 - DNA, 25 bp, Mus musculus
ggaccagtacctcgtgtggctcacc

SEQ ID NO: 947009 - DNA, 25 bp, Mus musculus
ggaccagttcagctcctcagcaaga

SEQ ID NO: 947010 - DNA, 25 bp, Mus musculus
ggaccagttcaggtcctcagcaaga

SEQ ID NO: 947011 - DNA, 25 bp, Mus musculus
ggaccatcacaacatctgatactct

SEQ ID NO: 947012 - DNA, 25 bp, Mus musculus
ggaccatcacaagatctgatactct

SEQ ID NO: 947013 - DNA, 25 bp, Mus musculus
ggaccatcacaaggactgatactct

SEQ ID NO: 947014 - DNA, 25 bp, Mus musculus
ggaccatcacaaggtctgatactct

SEQ ID NO: 947015 - DNA, 25 bp, Mus musculus
ggaccatccccacacatgacaacgt

SEQ ID NO: 947016 - DNA, 25 bp, Mus musculus
ggaccatccccacagatgacaacgt

SEQ ID NO: 947017 - DNA, 25 bp, Mus musculus
ggaccatccgctccaagctctctcg

SEQ ID NO: 947018 - DNA, 25 bp, Mus musculus
ggaccatccggtccaagctctctcg

SEQ ID NO: 947019 - DNA, 25 bp, Mus musculus
ggaccatcgcagcggcggaacacaa

SEQ ID NO: 947020 - DNA, 25 bp, Mus musculus
ggaccatcgcaggggcggaacacaa

SEQ ID NO: 947021 - DNA, 25 bp, Mus musculus
ggaccatcggcgtacctggaatggg

SEQ ID NO: 947022 - DNA, 25 bp, Mus musculus
ggaccatcggggtacctggaatggg

SEQ ID NO: 947023 - DNA, 25 bp, Mus musculus
ggaccatgcaaaaacatcgccccct

SEQ ID NO: 947024 - DNA, 25 bp, Mus musculus
ggaccatgcaaatacatcgccccct

SEQ ID NO: 947025 - DNA, 25 bp, Mus musculus
ggacccacagctgtggatcgacgct

SEQ ID NO: 947026 - DNA, 25 bp, Mus musculus
ggacccacaggtgtggatcgacgct

SEQ ID NO: 947027 - DNA, 25 bp, Mus musculus
ggacccaccgccaacagaataaaga

SEQ ID NO: 947028 - DNA, 25 bp, Mus musculus
ggacccaccgccaacatggattcat

SEQ ID NO: 947029 - DNA, 25 bp, Mus musculus
ggacccaccgccaagagaataaaga

SEQ ID NO: 947030 - DNA, 25 bp, Mus musculus
ggacccaccgccaagatggattcat

SEQ ID NO: 947031 - DNA, 25 bp, Mus musculus
ggacccacctgcaacattctggtgc

SEQ ID NO: 947032 - DNA, 25 bp, Mus musculus
ggacccacctgcaactctacagaga

SEQ ID NO: 947033 - DNA, 25 bp, Mus musculus
ggacccacctgcaagattctggtgc

SEQ ID NO: 947034 - DNA, 25 bp, Mus musculus
ggacccacctgcaagtctacagaga

SEQ ID NO: 947035 - DNA, 25 bp, Mus musculus
ggacccacgattccgacccactgcc

SEQ ID NO: 947036 - DNA, 25 bp, Mus musculus
ggacccacgattgcgacccactgcc

SEQ ID NO: 947037 - DNA, 25 bp, Mus musculus
ggacccagagaaaactgtcctgacc

SEQ ID NO: 947038 - DNA, 25 bp, Mus musculus
ggacccagagaatactgtcctgacc

SEQ ID NO: 947039 - DNA, 25 bp, Mus musculus
ggacccagagatttcctgcaaaaga

SEQ ID NO: 947040 - DNA, 25 bp, Mus musculus
ggacccagagcaagtccacatgcga

SEQ ID NO: 947041 - DNA, 25 bp, Mus musculus
ggacccagaggaagtccacatgcga

SEQ ID NO: 947042 - DNA, 25 bp, Mus musculus
ggacccagagttttcctgcaaaaga

SEQ ID NO: 947043 - DNA, 25 bp, Mus musculus
ggacccaggacacacagctgcagca

SEQ ID NO: 947044 - DNA, 25 bp, Mus musculus
ggacccaggacagacagctgcagca

SEQ ID NO: 947045 - DNA, 25 bp, Mus musculus
ggacccatcgcagcaaatggcttgg

SEQ ID NO: 947046 - DNA, 25 bp, Mus musculus
ggacccatcggagcaaatggcttgg

SEQ ID NO: 947047 - DNA, 25 bp, Mus musculus
ggaccccaaactgccagctgatgag

SEQ ID NO: 947048 - DNA, 25 bp, Mus musculus
ggaccccaaagtgccagctgatgag

SEQ ID NO: 947049 - DNA, 25 bp, Mus musculus
ggaccccagaacaacagctgaggct

SEQ ID NO: 947050 - DNA, 25 bp, Mus musculus
ggaccccagaacaagagctgaggct

SEQ ID NO: 947051 - DNA, 25 bp, Mus musculus
ggaccccagatgcaccatgggcttg

SEQ ID NO: 947052 - DNA, 25 bp, Mus musculus
ggaccccagatggaccatgggcttg

SEQ ID NO: 947053 - DNA, 25 bp, Mus musculus
ggacccccattacaaatcttgtgaa

SEQ ID NO: 947054 - DNA, 25 bp, Mus musculus
ggacccccattacatatcttgtgaa

SEQ ID NO: 947055 - DNA, 25 bp, Mus musculus
ggaccccgagccagagtctttgtcc

SEQ ID NO: 947056 - DNA, 25 bp, Mus musculus
ggaccccgaggcagagtctttgtcc

SEQ ID NO: 947057 - DNA, 25 bp, Mus musculus
ggacccctgaagcacatagcattgt

SEQ ID NO: 947058 - DNA, 25 bp, Mus musculus
ggacccctgaagcttacagtctcta

SEQ ID NO: 947059 - DNA, 25 bp, Mus musculus
ggacccctgaaggacatagcattgt

SEQ ID NO: 947060 - DNA, 25 bp, Mus musculus
ggacccctgaaggttacagtctcta

SEQ ID NO: 947061 - DNA, 25 bp, Mus musculus
ggacccctgactgccattacaattc

SEQ ID NO: 947062 - DNA, 25 bp, Mus musculus
ggacccctgactgcgattacaattc

SEQ ID NO: 947063 - DNA, 25 bp, Mus musculus
ggaccctacacagacgctcggtggg

SEQ ID NO: 947064 - DNA, 25 bp, Mus musculus
ggaccctacacagaggctcggtggg

SEQ ID NO: 947065 - DNA, 25 bp, Mus musculus
ggaccctatgaacttgaaaacacag

SEQ ID NO: 947066 - DNA, 25 bp, Mus musculus
ggaccctatgaagttgaaaacacag

SEQ ID NO: 947067 - DNA, 25 bp, Mus musculus
ggaccctcagctttgatgaagataa

SEQ ID NO: 947068 - DNA, 25 bp, Mus musculus
ggaccctcaggtttgatgaagataa

SEQ ID NO: 947069 - DNA, 25 bp, Mus musculus
ggaccctgagatccaccaggtgaga

SEQ ID NO: 947070 - DNA, 25 bp, Mus musculus
ggaccctgagcaaacagatcctttt

SEQ ID NO: 947071 - DNA, 25 bp, Mus musculus
ggaccctgagcaaagagatcctttt

SEQ ID NO: 947072 - DNA, 25 bp, Mus musculus
ggaccctgagttccaccaggtgaga

SEQ ID NO: 947073 - DNA, 25 bp, Mus musculus
ggaccctggacattcagacactgac

SEQ ID NO: 947074 - DNA, 25 bp, Mus musculus
ggaccctggacattgagacactgac

SEQ ID NO: 947075 - DNA, 25 bp, Mus musculus
ggaccctggcctccctgagggatct

SEQ ID NO: 947076 - DNA, 25 bp, Mus musculus
ggaccctggcctgcctgagggatct

SEQ ID NO: 947077 - DNA, 25 bp, Mus musculus
ggaccctggtaacgtgccagagcca

SEQ ID NO: 947078 - DNA, 25 bp, Mus musculus
ggaccctggtaaggtgccagagcca

SEQ ID NO: 947079 - DNA, 25 bp, Mus musculus
ggaccctggttacaaattctgttga

SEQ ID NO: 947080 - DNA, 25 bp, Mus musculus
ggaccctggttacatattctgttga

SEQ ID NO: 947081 - DNA, 25 bp, Mus musculus
ggaccctgtgcatgccttcatgtac

SEQ ID NO: 947082 - DNA, 25 bp, Mus musculus
ggaccctgtgcatggcttcatgtac

SEQ ID NO: 947083 - DNA, 25 bp, Mus musculus
ggacccttgcggcacgcttccgggc

SEQ ID NO: 947084 - DNA, 25 bp, Mus musculus
ggacccttgcggcaggcttccgggc

SEQ ID NO: 947085 - DNA, 25 bp, Mus musculus
ggaccgactgcttactgatgtcaag

SEQ ID NO: 947086 - DNA, 25 bp, Mus musculus
ggaccgactggttactgatgtcaag

SEQ ID NO: 947087 - DNA, 25 bp, Mus musculus
ggaccgacttttcacagccactcag

SEQ ID NO: 947088 - DNA, 25 bp, Mus musculus
ggaccgacttttcacggttcagact

SEQ ID NO: 947089 - DNA, 25 bp, Mus musculus
ggaccgacttttcagagccactcag

SEQ ID NO: 947090 - DNA, 25 bp, Mus musculus
ggaccgacttttcagggttcagact

SEQ ID NO: 947091 - DNA, 25 bp, Mus musculus
ggaccgagacagctccttccgcttc

SEQ ID NO: 947092 - DNA, 25 bp, Mus musculus
ggaccgagacaggtccttccgcttc

SEQ ID NO: 947093 - DNA, 25 bp, Mus musculus
ggaccgagagcgttacacatcattt

SEQ ID NO: 947094 - DNA, 25 bp, Mus musculus
ggaccgagagctgagacgtggaatc

SEQ ID NO: 947095 - DNA, 25 bp, Mus musculus
ggaccgagagctgatctgtaaatcg

SEQ ID NO: 947096 - DNA, 25 bp, Mus musculus
ggaccgagagggttacacatcattt

SEQ ID NO: 947097 - DNA, 25 bp, Mus musculus
ggaccgagaggtgagacgtggaatc

SEQ ID NO: 947098 - DNA, 25 bp, Mus musculus
ggaccgagaggtgatctgtaaatcg

SEQ ID NO: 947099 - DNA, 25 bp, Mus musculus
ggaccgagcagccaacagttgaata

SEQ ID NO: 947100 - DNA, 25 bp, Mus musculus
ggaccgagcagcgaacagttgaata

SEQ ID NO: 947101 - DNA, 25 bp, Mus musculus
ggaccgccagattgtgccttctgaa

SEQ ID NO: 947102 - DNA, 25 bp, Mus musculus
ggaccgccagccactgggaaaacac

SEQ ID NO: 947103 - DNA, 25 bp, Mus musculus
ggaccgccaggcactgggaaaacac

SEQ ID NO: 947104 - DNA, 25 bp, Mus musculus
ggaccgccagtttgtgccttctgaa

SEQ ID NO: 947105 - DNA, 25 bp, Mus musculus
ggaccgccggagctcttttatgacc

SEQ ID NO: 947106 - DNA, 25 bp, Mus musculus
ggaccgccggagctgttttatgacc

SEQ ID NO: 947107 - DNA, 25 bp, Mus musculus
ggaccgctccgcgtcagaatcaaat

SEQ ID NO: 947108 - DNA, 25 bp, Mus musculus
ggaccgctccgcgtgagaatcaaat

SEQ ID NO: 947109 - DNA, 25 bp, Mus musculus
ggaccgcttataccccaaggaacag

SEQ ID NO: 947110 - DNA, 25 bp, Mus musculus
ggaccgcttatacgcttggggcata

SEQ ID NO: 947111 - DNA, 25 bp, Mus musculus
ggaccgcttatagcccaaggaacag

SEQ ID NO: 947112 - DNA, 25 bp, Mus musculus
ggaccgcttataggcttggggcata

SEQ ID NO: 947113 - DNA, 25 bp, Mus musculus
ggaccggatgctcaccgaggacccg

SEQ ID NO: 947114 - DNA, 25 bp, Mus musculus
ggaccggatgctcagcgaggacccg

SEQ ID NO: 947115 - DNA, 25 bp, Mus musculus
ggaccgggtgcccgtcatcgtggag

SEQ ID NO: 947116 - DNA, 25 bp, Mus musculus
ggaccgggtgccggtcatcgtggag

SEQ ID NO: 947117 - DNA, 25 bp, Mus musculus
ggacctaaagcattacatgcgtcag

SEQ ID NO: 947118 - DNA, 25 bp, Mus musculus
ggacctaaaggattacatgcgtcag

SEQ ID NO: 947119 - DNA, 25 bp, Mus musculus
ggacctacaacaccacctctgcagt

SEQ ID NO: 947120 - DNA, 25 bp, Mus musculus
ggacctacaagaccacctctgcagt

SEQ ID NO: 947121 - DNA, 25 bp, Mus musculus
ggacctagcccgcaaggagctgaag

SEQ ID NO: 947122 - DNA, 25 bp, Mus musculus
ggacctagcccggaaggagctgaag

SEQ ID NO: 947123 - DNA, 25 bp, Mus musculus
ggacctcaacagagggcagctgatc

SEQ ID NO: 947124 - DNA, 25 bp, Mus musculus
ggacctcaacagtgggcagctgatc

SEQ ID NO: 947125 - DNA, 25 bp, Mus musculus
ggacctcaacttcacaatgttcgat

SEQ ID NO: 947126 - DNA, 25 bp, Mus musculus
ggacctcaacttcagaatgttcgat

SEQ ID NO: 947127 - DNA, 25 bp, Mus musculus
ggacctcaagcagcgcgggctgacc

SEQ ID NO: 947128 - DNA, 25 bp, Mus musculus
ggacctcaaggagcgcgggctgacc

SEQ ID NO: 947129 - DNA, 25 bp, Mus musculus
ggacctcacaaacgtagttcttcca

SEQ ID NO: 947130 - DNA, 25 bp, Mus musculus
ggacctcacaaaggtagttcttcca

SEQ ID NO: 947131 - DNA, 25 bp, Mus musculus
ggacctcaggctgactgctgtccac

SEQ ID NO: 947132 - DNA, 25 bp, Mus musculus
ggacctcagggtgactgctgtccac

SEQ ID NO: 947133 - DNA, 25 bp, Mus musculus
ggacctccaaccgctcatcgacatc

SEQ ID NO: 947134 - DNA, 25 bp, Mus musculus
ggacctccaagcgctcatcgacatc

SEQ ID NO: 947135 - DNA, 25 bp, Mus musculus
ggacctccaggacgcggtctgcctg

SEQ ID NO: 947136 - DNA, 25 bp, Mus musculus
ggacctccaggacggggtctgcctg

SEQ ID NO: 947137 - DNA, 25 bp, Mus musculus
ggacctctgcagatcattgtgaaca

SEQ ID NO: 947138 - DNA, 25 bp, Mus musculus
ggacctctgcagatgattgtgaaca

SEQ ID NO: 947139 - DNA, 25 bp, Mus musculus
ggacctgaagagcacgagcagagga

SEQ ID NO: 947140 - DNA, 25 bp, Mus musculus
ggacctgaagagcaggagcagagga

SEQ ID NO: 947141 - DNA, 25 bp, Mus musculus
ggacctgaagctggagaacctcatg

SEQ ID NO: 947142 - DNA, 25 bp, Mus musculus
ggacctgaaggagccgtcgcctgcc

SEQ ID NO: 947143 - DNA, 25 bp, Mus musculus
ggacctgaaggagcggtcgcctgcc

SEQ ID NO: 947144 - DNA, 25 bp, Mus musculus
ggacctgaaggtggagaacctcatg

SEQ ID NO: 947145 - DNA, 25 bp, Mus musculus
ggacctgaccagtcaatatatattg

SEQ ID NO: 947146 - DNA, 25 bp, Mus musculus
ggacctgaccagtctatatatattg

SEQ ID NO: 947147 - DNA, 25 bp, Mus musculus
ggacctgactcacagaggaagaacc

SEQ ID NO: 947148 - DNA, 25 bp, Mus musculus
ggacctgactcagagaggaagaacc

SEQ ID NO: 947149 - DNA, 25 bp, Mus musculus
ggacctgagagaagcgtgtgctaat

SEQ ID NO: 947150 - DNA, 25 bp, Mus musculus
ggacctgagagaagggtgtgctaat

SEQ ID NO: 947151 - DNA, 25 bp, Mus musculus
ggacctgagagaagtgtgctaatga

SEQ ID NO: 947152 - DNA, 25 bp, Mus musculus
ggacctgagagatgtgtgctaatga

SEQ ID NO: 947153 - DNA, 25 bp, Mus musculus
ggacctgcccagcggtggagctgcc

SEQ ID NO: 947154 - DNA, 25 bp, Mus musculus
ggacctgcccaggggtggagctgcc

SEQ ID NO: 947155 - DNA, 25 bp, Mus musculus
ggacctggagacagccttccctcgg

SEQ ID NO: 947156 - DNA, 25 bp, Mus musculus
ggacctggagtcagccttccctcgg

SEQ ID NO: 947157 - DNA, 25 bp, Mus musculus
ggacctggcaggatcggagcctcct

SEQ ID NO: 947158 - DNA, 25 bp, Mus musculus
ggacctggcaggatcggccaccgct

SEQ ID NO: 947159 - DNA, 25 bp, Mus musculus
ggacctggcaggatgggagcctcct

SEQ ID NO: 947160 - DNA, 25 bp, Mus musculus
ggacctggcaggatgggccaccgct

SEQ ID NO: 947161 - DNA, 25 bp, Mus musculus
ggacctgggaaacaatatctatcag

SEQ ID NO: 947162 - DNA, 25 bp, Mus musculus
ggacctgggaaagaatatctatcag

SEQ ID NO: 947163 - DNA, 25 bp, Mus musculus
ggacctgtgtggatattgatgaatg

SEQ ID NO: 947164 - DNA, 25 bp, Mus musculus
ggacctgtgtggttattgatgaatg

SEQ ID NO: 947165 - DNA, 25 bp, Mus musculus
ggaccttcagcaaatggctggtgat

SEQ ID NO: 947166 - DNA, 25 bp, Mus musculus
ggaccttcaggaaatggctggtgat

SEQ ID NO: 947167 - DNA, 25 bp, Mus musculus
ggaccttcattgagaatggccaatg

SEQ ID NO: 947168 - DNA, 25 bp, Mus musculus
ggaccttcattgtgaatggccaatg

SEQ ID NO: 947169 - DNA, 25 bp, Mus musculus
ggaccttcggcgctgggcttcaaca

SEQ ID NO: 947170 - DNA, 25 bp, Mus musculus
ggaccttcggggctgggcttcaaca

SEQ ID NO: 947171 - DNA, 25 bp, Mus musculus
ggaccttctcagcgacagtgcgggc

SEQ ID NO: 947172 - DNA, 25 bp, Mus musculus
ggaccttctcagctgcgggcttcgc

SEQ ID NO: 947173 - DNA, 25 bp, Mus musculus
ggaccttctcagggacagtgcgggc

SEQ ID NO: 947174 - DNA, 25 bp, Mus musculus
ggaccttctcaggtgcgggcttcgc

SEQ ID NO: 947175 - DNA, 25 bp, Mus musculus
ggaccttgagcaccccaaagaagtg

SEQ ID NO: 947176 - DNA, 25 bp, Mus musculus
ggaccttgagcacgaggcttctcag

SEQ ID NO: 947177 - DNA, 25 bp, Mus musculus
ggaccttgagcagcccaaagaagtg

SEQ ID NO: 947178 - DNA, 25 bp, Mus musculus
ggaccttgagcaggaggcttctcag

SEQ ID NO: 947179 - DNA, 25 bp, Mus musculus
ggaccttggcagcggaatcaaagac

SEQ ID NO: 947180 - DNA, 25 bp, Mus musculus
ggaccttggcaggggaatcaaagac

SEQ ID NO: 947181 - DNA, 25 bp, Mus musculus
ggacctttcaaacatacccctgatc

SEQ ID NO: 947182 - DNA, 25 bp, Mus musculus
ggacctttcaaagatacccctgatc

SEQ ID NO: 947183 - DNA, 25 bp, Mus musculus
ggaccttttcatagcttggatgata

SEQ ID NO: 947184 - DNA, 25 bp, Mus musculus
ggaccttttcataggttggatgata

SEQ ID NO: 947185 - DNA, 25 bp, Mus musculus
ggacgaaaccaccaaccgcatgcac

SEQ ID NO: 947186 - DNA, 25 bp, Mus musculus
ggacgaaaccacgaaccgcatgcac

SEQ ID NO: 947187 - DNA, 25 bp, Mus musculus
ggacgaagtgattgactttggcgac

SEQ ID NO: 947188 - DNA, 25 bp, Mus musculus
ggacgaagtgtttgactttggcgac

SEQ ID NO: 947189 - DNA, 25 bp, Mus musculus
ggacgaccagagcagctgtctgaag

SEQ ID NO: 947190 - DNA, 25 bp, Mus musculus
ggacgaccagaggagctgtctgaag

SEQ ID NO: 947191 - DNA, 25 bp, Mus musculus
ggacgacctgcacctactgaagtca

SEQ ID NO: 947192 - DNA, 25 bp, Mus musculus
ggacgacctgcagctactgaagtca

SEQ ID NO: 947193 - DNA, 25 bp, Mus musculus
ggacgacgaagtcaaccgaatgcac

SEQ ID NO: 947194 - DNA, 25 bp, Mus musculus
ggacgacgaagtgaaccgaatgcac

SEQ ID NO: 947195 - DNA, 25 bp, Mus musculus
ggacgactgaaacatatcgatgaag

SEQ ID NO: 947196 - DNA, 25 bp, Mus musculus
ggacgactgaaagatatcgatgaag

SEQ ID NO: 947197 - DNA, 25 bp, Mus musculus
ggacgagaagcggactcacgaccac

SEQ ID NO: 947198 - DNA, 25 bp, Mus musculus
ggacgagaagcggagtcacgaccac

SEQ ID NO: 947199 - DNA, 25 bp, Mus musculus
ggacgagattgacataatcaatcta

SEQ ID NO: 947200 - DNA, 25 bp, Mus musculus
ggacgagattgagataatcaatcta

SEQ ID NO: 947201 - DNA, 25 bp, Mus musculus
ggacgaggagagcaacttcccacat

SEQ ID NO: 947202 - DNA, 25 bp, Mus musculus
ggacgaggagagcatcttcccacat

SEQ ID NO: 947203 - DNA, 25 bp, Mus musculus
ggacgcaaagcaggaagccagcaaa

SEQ ID NO: 947204 - DNA, 25 bp, Mus musculus
ggacgcaaaggaggaagccagcaaa

SEQ ID NO: 947205 - DNA, 25 bp, Mus musculus
ggacgcacagccctcctgtgccacc

SEQ ID NO: 947206 - DNA, 25 bp, Mus musculus
ggacgcacaggcctcctgtgccacc

SEQ ID NO: 947207 - DNA, 25 bp, Mus musculus
ggacgcagaagacactgagaggaat

SEQ ID NO: 947208 - DNA, 25 bp, Mus musculus
ggacgcagaagaccctaccgaggac

SEQ ID NO: 947209 - DNA, 25 bp, Mus musculus
ggacgcagaagactttgactttggc

SEQ ID NO: 947210 - DNA, 25 bp, Mus musculus
ggacgcagaagagactgagaggaat

SEQ ID NO: 947211 - DNA, 25 bp, Mus musculus
ggacgcagaagagcctaccgaggac

SEQ ID NO: 947212 - DNA, 25 bp, Mus musculus
ggacgcagaagagtttgactttggc

SEQ ID NO: 947213 - DNA, 25 bp, Mus musculus
ggacgcatagaggaagtagtggagg

SEQ ID NO: 947214 - DNA, 25 bp, Mus musculus
ggacgcatagtggaagtagtggagg

SEQ ID NO: 947215 - DNA, 25 bp, Mus musculus
ggacgccaagcgcttaagtctaagg

SEQ ID NO: 947216 - DNA, 25 bp, Mus musculus
ggacgccaagcgtcatggagtcctg

SEQ ID NO: 947217 - DNA, 25 bp, Mus musculus
ggacgccaagggcttaagtctaagg

SEQ ID NO: 947218 - DNA, 25 bp, Mus musculus
ggacgccaagggtcatggagtcctg

SEQ ID NO: 947219 - DNA, 25 bp, Mus musculus
ggacgcccagcaactgtatgaggct

SEQ ID NO: 947220 - DNA, 25 bp, Mus musculus
ggacgcccagctctttcaacactcc

SEQ ID NO: 947221 - DNA, 25 bp, Mus musculus
ggacgcccaggaactgtatgaggct

SEQ ID NO: 947222 - DNA, 25 bp, Mus musculus
ggacgcccaggtctttcaacactcc

SEQ ID NO: 947223 - DNA, 25 bp, Mus musculus
ggacgcgctgcgaggatctggatga

SEQ ID NO: 947224 - DNA, 25 bp, Mus musculus
ggacgcgctgggaggatctggatga

SEQ ID NO: 947225 - DNA, 25 bp, Mus musculus
ggacgcgtcaacacagggctgcatg

SEQ ID NO: 947226 - DNA, 25 bp, Mus musculus
ggacgcgtcaacactgggctgcatg

SEQ ID NO: 947227 - DNA, 25 bp, Mus musculus
ggacgctgccggccatcgtcgttct

SEQ ID NO: 947228 - DNA, 25 bp, Mus musculus
ggacgctgccggctctcttccactg

SEQ ID NO: 947229 - DNA, 25 bp, Mus musculus
ggacgctgccgggcatcgtcgttct

SEQ ID NO: 947230 - DNA, 25 bp, Mus musculus
ggacgctgccgggtctcttccactg

SEQ ID NO: 947231 - DNA, 25 bp, Mus musculus
ggacgctgcgagcaagagccctggg

SEQ ID NO: 947232 - DNA, 25 bp, Mus musculus
ggacgctgcgaggaagagccctggg

SEQ ID NO: 947233 - DNA, 25 bp, Mus musculus
ggacgctgtcagctctgtctgcact

SEQ ID NO: 947234 - DNA, 25 bp, Mus musculus
ggacgctgtcaggtctgtctgcact

SEQ ID NO: 947235 - DNA, 25 bp, Mus musculus
ggacgctttgtgatcgaagaggttc

SEQ ID NO: 947236 - DNA, 25 bp, Mus musculus
ggacgctttgtgttcgaagaggttc

SEQ ID NO: 947237 - DNA, 25 bp, Mus musculus
ggacggagcatgcttggagcctctc

SEQ ID NO: 947238 - DNA, 25 bp, Mus musculus
ggacggagcatggttggagcctctc

SEQ ID NO: 947239 - DNA, 25 bp, Mus musculus
ggacggcaagctcggctcctgcggc

SEQ ID NO: 947240 - DNA, 25 bp, Mus musculus
ggacggcaaggtcggctcctgcggc

SEQ ID NO: 947241 - DNA, 25 bp, Mus musculus
ggacggcaggagctggtagatttgc

SEQ ID NO: 947242 - DNA, 25 bp, Mus musculus
ggacggcaggaggtggtagatttgc

SEQ ID NO: 947243 - DNA, 25 bp, Mus musculus
ggacggccagcgaagtctcgtgagc

SEQ ID NO: 947244 - DNA, 25 bp, Mus musculus
ggacggccagggaagtctcgtgagc

SEQ ID NO: 947245 - DNA, 25 bp, Mus musculus
ggacggctcccccacctcctcacct

SEQ ID NO: 947246 - DNA, 25 bp, Mus musculus
ggacggctcccccagctcctcacct

SEQ ID NO: 947247 - DNA, 25 bp, Mus musculus
ggacggctgccgcgttgtgagcccc

SEQ ID NO: 947248 - DNA, 25 bp, Mus musculus
ggacggctgccgggttgtgagcccc

SEQ ID NO: 947249 - DNA, 25 bp, Mus musculus
ggacggggagacccatataatgccc

SEQ ID NO: 947250 - DNA, 25 bp, Mus musculus
ggacggggagctgctgaggactaac

SEQ ID NO: 947251 - DNA, 25 bp, Mus musculus
ggacggggaggtgctgaggactaac

SEQ ID NO: 947252 - DNA, 25 bp, Mus musculus
ggacggggagtcccatataatgccc

SEQ ID NO: 947253 - DNA, 25 bp, Mus musculus
ggacggtacctgcattgtgcttctt

SEQ ID NO: 947254 - DNA, 25 bp, Mus musculus
ggacggtacctggattgtgcttctt

SEQ ID NO: 947255 - DNA, 25 bp, Mus musculus
ggacggtcctagcctcagcgttctc

SEQ ID NO: 947256 - DNA, 25 bp, Mus musculus
ggacggtcctaggctcagcgttctc

SEQ ID NO: 947257 - DNA, 25 bp, Mus musculus
ggacgtagtcaagcacattgaaagc

SEQ ID NO: 947258 - DNA, 25 bp, Mus musculus
ggacgtagtcaagctcattgaaagc

SEQ ID NO: 947259 - DNA, 25 bp, Mus musculus
ggacgtagtgaacgtggccctatga

SEQ ID NO: 947260 - DNA, 25 bp, Mus musculus
ggacgtagtgaaggtggccctatga

SEQ ID NO: 947261 - DNA, 25 bp, Mus musculus
ggacgtcaccgacgatgaagaggaa

SEQ ID NO: 947262 - DNA, 25 bp, Mus musculus
ggacgtcaccgaggatgaagaggaa

SEQ ID NO: 947263 - DNA, 25 bp, Mus musculus
ggacgtgaagagcctggagtcagcc

SEQ ID NO: 947264 - DNA, 25 bp, Mus musculus
ggacgtgaagtgcctggagtcagcc

SEQ ID NO: 947265 - DNA, 25 bp, Mus musculus
ggacgtgcatcgagacatgtgcagt

SEQ ID NO: 947266 - DNA, 25 bp, Mus musculus
ggacgtgcatcgtgacatgtgcagt

SEQ ID NO: 947267 - DNA, 25 bp, Mus musculus
ggacgtgccaagcccagcactatgg

SEQ ID NO: 947268 - DNA, 25 bp, Mus musculus
ggacgtgccaaggccagcactatgg

SEQ ID NO: 947269 - DNA, 25 bp, Mus musculus
ggacgtgctgcagcaacgactgcga

SEQ ID NO: 947270 - DNA, 25 bp, Mus musculus
ggacgtgctggagcaacgactgcga

SEQ ID NO: 947271 - DNA, 25 bp, Mus musculus
ggacgtggaaggcattttgtgactt

SEQ ID NO: 947272 - DNA, 25 bp, Mus musculus
ggacgtggaaggccttgatcctgct

SEQ ID NO: 947273 - DNA, 25 bp, Mus musculus
ggacgtggaagggattttgtgactt

SEQ ID NO: 947274 - DNA, 25 bp, Mus musculus
ggacgtggaagggcttgatcctgct

SEQ ID NO: 947275 - DNA, 25 bp, Mus musculus
ggacgtggcttgcacacgcatagcc

SEQ ID NO: 947276 - DNA, 25 bp, Mus musculus
ggacgtggcttgcagacgcatagcc

SEQ ID NO: 947277 - DNA, 25 bp, Mus musculus
ggacgtggtcagccactggcaggac

SEQ ID NO: 947278 - DNA, 25 bp, Mus musculus
ggacgtggtcaggcactggcaggac

SEQ ID NO: 947279 - DNA, 25 bp, Mus musculus
ggacgtgttagtcacagccacctgt

SEQ ID NO: 947280 - DNA, 25 bp, Mus musculus
ggacgtgttagtcagagccacctgt

SEQ ID NO: 947281 - DNA, 25 bp, Mus musculus
ggacgttcagcttcgtctcaatagt

SEQ ID NO: 947282 - DNA, 25 bp, Mus musculus
ggacgttcaggttcgtctcaatagt

SEQ ID NO: 947283 - DNA, 25 bp, Mus musculus
ggacgtttcccacatctgtctcgag

SEQ ID NO: 947284 - DNA, 25 bp, Mus musculus
ggacgtttcccagatctgtctcgag

SEQ ID NO: 947285 - DNA, 25 bp, Mus musculus
ggactaaggaacaccactactttaa

SEQ ID NO: 947286 - DNA, 25 bp, Mus musculus
ggactaaggatcaccactactttaa

SEQ ID NO: 947287 - DNA, 25 bp, Mus musculus
ggactaatagttaacggtcgtgcat

SEQ ID NO: 947288 - DNA, 25 bp, Mus musculus
ggactaatagttaagggtcgtgcat

SEQ ID NO: 947289 - DNA, 25 bp, Mus musculus
ggactacaaggtatatgggtatgtg

SEQ ID NO: 947290 - DNA, 25 bp, Mus musculus
ggactacaaggtttatgggtatgtg

SEQ ID NO: 947291 - DNA, 25 bp, Mus musculus
ggactaccagccctgtacggagatc

SEQ ID NO: 947292 - DNA, 25 bp, Mus musculus
ggactaccagcttctaacatccgtg

SEQ ID NO: 947293 - DNA, 25 bp, Mus musculus
ggactaccaggcctgtacggagatc

SEQ ID NO: 947294 - DNA, 25 bp, Mus musculus
ggactaccaggttctaacatccgtg

SEQ ID NO: 947295 - DNA, 25 bp, Mus musculus
ggactacgggagattcttggcacca

SEQ ID NO: 947296 - DNA, 25 bp, Mus musculus
ggactacgggagtttcttggcacca

SEQ ID NO: 947297 - DNA, 25 bp, Mus musculus
ggactacgtcagcctgttcggcatc

SEQ ID NO: 947298 - DNA, 25 bp, Mus musculus
ggactacgtcaggctgttcggcatc

SEQ ID NO: 947299 - DNA, 25 bp, Mus musculus
ggactagcaaatcacaagttacgag

SEQ ID NO: 947300 - DNA, 25 bp, Mus musculus
ggactagcaaatcacgaggtgcttg

SEQ ID NO: 947301 - DNA, 25 bp, Mus musculus
ggactagcaaatcagaagttacgag

SEQ ID NO: 947302 - DNA, 25 bp, Mus musculus
ggactagcaaatcaggaggtgcttg

SEQ ID NO: 947303 - DNA, 25 bp, Mus musculus
ggactatgacagagataagcggttc

SEQ ID NO: 947304 - DNA, 25 bp, Mus musculus
ggactatgacagtgataagcggttc

SEQ ID NO: 947305 - DNA, 25 bp, Mus musculus
ggactcaacgctgcagccccaggac

SEQ ID NO: 947306 - DNA, 25 bp, Mus musculus
ggactcaacggtgcagccccaggac

SEQ ID NO: 947307 - DNA, 25 bp, Mus musculus
ggactcagagcgcctagatggagcg

SEQ ID NO: 947308 - DNA, 25 bp, Mus musculus
ggactcagagggcctagatggagcg

SEQ ID NO: 947309 - DNA, 25 bp, Mus musculus
ggactcaggtagatgagaggccagg

SEQ ID NO: 947310 - DNA, 25 bp, Mus musculus
ggactcaggtaggttgatggaaacc

SEQ ID NO: 947311 - DNA, 25 bp, Mus musculus
ggactcaggttgatgagaggccagg

SEQ ID NO: 947312 - DNA, 25 bp, Mus musculus
ggactcaggttggttgatggaaacc

SEQ ID NO: 947313 - DNA, 25 bp, Mus musculus
ggactcattttgcccaccccgtgaa

SEQ ID NO: 947314 - DNA, 25 bp, Mus musculus
ggactcattttggccaccccgtgaa

SEQ ID NO: 947315 - DNA, 25 bp, Mus musculus
ggactccaggcattgtaatggcgtt

SEQ ID NO: 947316 - DNA, 25 bp, Mus musculus
ggactccagggattgtaatggcgtt

SEQ ID NO: 947317 - DNA, 25 bp, Mus musculus
ggactcccagaacatagtcacatgc

SEQ ID NO: 947318 - DNA, 25 bp, Mus musculus
ggactcccagaagatagtcacatgc

SEQ ID NO: 947319 - DNA, 25 bp, Mus musculus
ggactccctggaagccatgaccagg

SEQ ID NO: 947320 - DNA, 25 bp, Mus musculus
ggactccctggatgccatgaccagg

SEQ ID NO: 947321 - DNA, 25 bp, Mus musculus
ggactccgtgaacacacggatgcag

SEQ ID NO: 947322 - DNA, 25 bp, Mus musculus
ggactccgtgaagacacggatgcag

SEQ ID NO: 947323 - DNA, 25 bp, Mus musculus
ggactcctatagctcaccgtggagt

SEQ ID NO: 947324 - DNA, 25 bp, Mus musculus
ggactcctataggtcaccgtggagt

SEQ ID NO: 947325 - DNA, 25 bp, Mus musculus
ggactccttccagtcggatgatctg

SEQ ID NO: 947326 - DNA, 25 bp, Mus musculus
ggactccttccagtgggatgatctg

SEQ ID NO: 947327 - DNA, 25 bp, Mus musculus
ggactcgggtcgcaacctccagctc

SEQ ID NO: 947328 - DNA, 25 bp, Mus musculus
ggactcgggtcggaacctccagctc

SEQ ID NO: 947329 - DNA, 25 bp, Mus musculus
ggactcgtgcctaccgaaacatgac

SEQ ID NO: 947330 - DNA, 25 bp, Mus musculus
ggactcgtgcctacggaaacatgac

SEQ ID NO: 947331 - DNA, 25 bp, Mus musculus
ggactctaaactccctgccgagcta

SEQ ID NO: 947332 - DNA, 25 bp, Mus musculus
ggactctaaactgcctgccgagcta

SEQ ID NO: 947333 - DNA, 25 bp, Mus musculus
ggactctcagaacctcagtgcatac

SEQ ID NO: 947334 - DNA, 25 bp, Mus musculus
ggactctcagtacctcagtgcatac

SEQ ID NO: 947335 - DNA, 25 bp, Mus musculus
ggactctgatagcagagcgtttctg

SEQ ID NO: 947336 - DNA, 25 bp, Mus musculus
ggactctgattgcagagcgtttctg

SEQ ID NO: 947337 - DNA, 25 bp, Mus musculus
ggactcttagctgccagcctgctgt

SEQ ID NO: 947338 - DNA, 25 bp, Mus musculus
ggactcttagctgcgagcctgctgt

SEQ ID NO: 947339 - DNA, 25 bp, Mus musculus
ggactgaagacgatatgttcatatc

SEQ ID NO: 947340 - DNA, 25 bp, Mus musculus
ggactgaagacgttatgttcatatc

SEQ ID NO: 947341 - DNA, 25 bp, Mus musculus
ggactgacagaacaactaatgcgtc

SEQ ID NO: 947342 - DNA, 25 bp, Mus musculus
ggactgacagtacaactaatgcgtc

SEQ ID NO: 947343 - DNA, 25 bp, Mus musculus
ggactgacttcacggcttttgcagg

SEQ ID NO: 947344 - DNA, 25 bp, Mus musculus
ggactgacttcagggcttttgcagg

SEQ ID NO: 947345 - DNA, 25 bp, Mus musculus
ggactgagagaattctgagtgccac

SEQ ID NO: 947346 - DNA, 25 bp, Mus musculus
ggactgagagtattctgagtgccac

SEQ ID NO: 947347 - DNA, 25 bp, Mus musculus
ggactgagcgctcttgacgaagtga

SEQ ID NO: 947348 - DNA, 25 bp, Mus musculus
ggactgagcggtcttgacgaagtga

SEQ ID NO: 947349 - DNA, 25 bp, Mus musculus
ggactgaggccacatcatggccctc

SEQ ID NO: 947350 - DNA, 25 bp, Mus musculus
ggactgaggccagatcatggccctc

SEQ ID NO: 947351 - DNA, 25 bp, Mus musculus
ggactgcaagtactgggcactacat

SEQ ID NO: 947352 - DNA, 25 bp, Mus musculus
ggactgcaagtagtgggcactacat

SEQ ID NO: 947353 - DNA, 25 bp, Mus musculus
ggactgcaatagctgtggggaccat

SEQ ID NO: 947354 - DNA, 25 bp, Mus musculus
ggactgcaataggtgtggggaccat

SEQ ID NO: 947355 - DNA, 25 bp, Mus musculus
ggactgcagaatcacagatttgacc

SEQ ID NO: 947356 - DNA, 25 bp, Mus musculus
ggactgcagaatgacagatttgacc

SEQ ID NO: 947357 - DNA, 25 bp, Mus musculus
ggactgcagcctaaatggcaaaatg

SEQ ID NO: 947358 - DNA, 25 bp, Mus musculus
ggactgcagccttaatggcaaaatg

SEQ ID NO: 947359 - DNA, 25 bp, Mus musculus
ggactgcatgcagggccgtgtagcc

SEQ ID NO: 947360 - DNA, 25 bp, Mus musculus
ggactgcatggagggccgtgtagcc

SEQ ID NO: 947361 - DNA, 25 bp, Mus musculus
ggactgccagaacttggctccagaa

SEQ ID NO: 947362 - DNA, 25 bp, Mus musculus
ggactgccagcaagtctcaggtcta

SEQ ID NO: 947363 - DNA, 25 bp, Mus musculus
ggactgccagcgtcacgtggtactg

SEQ ID NO: 947364 - DNA, 25 bp, Mus musculus
ggactgccaggaagtctcaggtcta

SEQ ID NO: 947365 - DNA, 25 bp, Mus musculus
ggactgccagggtcacgtggtactg

SEQ ID NO: 947366 - DNA, 25 bp, Mus musculus
ggactgccagtacttggctccagaa

SEQ ID NO: 947367 - DNA, 25 bp, Mus musculus
ggactgccccaacgctgacttcccc

SEQ ID NO: 947368 - DNA, 25 bp, Mus musculus
ggactgccccaaggctgacttcccc

SEQ ID NO: 947369 - DNA, 25 bp, Mus musculus
ggactgcctgccagcattttaccgg

SEQ ID NO: 947370 - DNA, 25 bp, Mus musculus
ggactgcctgccaggattttaccgg

SEQ ID NO: 947371 - DNA, 25 bp, Mus musculus
ggactgctgtcaatgggagccggtg

SEQ ID NO: 947372 - DNA, 25 bp, Mus musculus
ggactgctgtcattgggagccggtg

SEQ ID NO: 947373 - DNA, 25 bp, Mus musculus
ggactggaagacaacgtggttccat

SEQ ID NO: 947374 - DNA, 25 bp, Mus musculus
ggactggaagacaaggtggttccat

SEQ ID NO: 947375 - DNA, 25 bp, Mus musculus
ggactggaagagcgcatctgtggtc

SEQ ID NO: 947376 - DNA, 25 bp, Mus musculus
ggactggaagagggcatctgtggtc

SEQ ID NO: 947377 - DNA, 25 bp, Mus musculus
ggactggaaggacacccctcagttc

SEQ ID NO: 947378 - DNA, 25 bp, Mus musculus
ggactggaaggacagccctcagttc

SEQ ID NO: 947379 - DNA, 25 bp, Mus musculus
ggactggacagccactttgttgaag

SEQ ID NO: 947380 - DNA, 25 bp, Mus musculus
ggactggacagccagtttgttgaag

SEQ ID NO: 947381 - DNA, 25 bp, Mus musculus
ggactggcatcacgggcactagctg

SEQ ID NO: 947382 - DNA, 25 bp, Mus musculus
ggactggcatcaggggcactagctg

SEQ ID NO: 947383 - DNA, 25 bp, Mus musculus
ggactggccagacgctcagattccc

SEQ ID NO: 947384 - DNA, 25 bp, Mus musculus
ggactggccagaggctcagattccc

SEQ ID NO: 947385 - DNA, 25 bp, Mus musculus
ggactgggtgcacttggcttgggcc

SEQ ID NO: 947386 - DNA, 25 bp, Mus musculus
ggactgggtggacttggcttgggcc

SEQ ID NO: 947387 - DNA, 25 bp, Mus musculus
ggactggtttttcattcacaaggag

SEQ ID NO: 947388 - DNA, 25 bp, Mus musculus
ggactggtttttgattcacaaggag

SEQ ID NO: 947389 - DNA, 25 bp, Mus musculus
ggactgtcagactgctgggctgatc

SEQ ID NO: 947390 - DNA, 25 bp, Mus musculus
ggactgtcagcattctctttcaaaa

SEQ ID NO: 947391 - DNA, 25 bp, Mus musculus
ggactgtcaggattctctttcaaaa

SEQ ID NO: 947392 - DNA, 25 bp, Mus musculus
ggactgtcagtctgctgggctgatc

SEQ ID NO: 947393 - DNA, 25 bp, Mus musculus
ggactgtgagaaggcttctttggct

SEQ ID NO: 947394 - DNA, 25 bp, Mus musculus
ggactgtgagccttctttggcttgc

SEQ ID NO: 947395 - DNA, 25 bp, Mus musculus
ggactgtgaggcttctttggcttgc

SEQ ID NO: 947396 - DNA, 25 bp, Mus musculus
ggactgtgagtaggcttctttggct

SEQ ID NO: 947397 - DNA, 25 bp, Mus musculus
ggactgtgcaggatgaaaacgaggc

SEQ ID NO: 947398 - DNA, 25 bp, Mus musculus
ggactgtgcaggttgaaaacgaggc

SEQ ID NO: 947399 - DNA, 25 bp, Mus musculus
ggacttaagtacaacaaaggaggtg

SEQ ID NO: 947400 - DNA, 25 bp, Mus musculus
ggacttaagtacaagaaaggaggtg

SEQ ID NO: 947401 - DNA, 25 bp, Mus musculus
ggacttaataacactgtctggctgc

SEQ ID NO: 947402 - DNA, 25 bp, Mus musculus
ggacttaataactctgtctggctgc

SEQ ID NO: 947403 - DNA, 25 bp, Mus musculus
ggacttacacttcaacggtctgagc

SEQ ID NO: 947404 - DNA, 25 bp, Mus musculus
ggacttacacttcaagatgtttgat

SEQ ID NO: 947405 - DNA, 25 bp, Mus musculus
ggacttacacttcatcggtctgagc

SEQ ID NO: 947406 - DNA, 25 bp, Mus musculus
ggacttacacttcatgatgtttgat

SEQ ID NO: 947407 - DNA, 25 bp, Mus musculus
ggacttacagcaagacaaggaggct

SEQ ID NO: 947408 - DNA, 25 bp, Mus musculus
ggacttacaggaagacaaggaggct

SEQ ID NO: 947409 - DNA, 25 bp, Mus musculus
ggacttactacacctgggcatggca

SEQ ID NO: 947410 - DNA, 25 bp, Mus musculus
ggacttactacacgtggctgcggct

SEQ ID NO: 947411 - DNA, 25 bp, Mus musculus
ggacttactacagctgggcatggca

SEQ ID NO: 947412 - DNA, 25 bp, Mus musculus
ggacttactacaggtggctgcggct

SEQ ID NO: 947413 - DNA, 25 bp, Mus musculus
ggacttactgcgtttgaatgccggt

SEQ ID NO: 947414 - DNA, 25 bp, Mus musculus
ggacttactgggtttgaatgccggt

SEQ ID NO: 947415 - DNA, 25 bp, Mus musculus
ggacttagagcatcactcttacaga

SEQ ID NO: 947416 - DNA, 25 bp, Mus musculus
ggacttagaggatcactcttacaga

SEQ ID NO: 947417 - DNA, 25 bp, Mus musculus
ggacttcaagcagaatccggagcaa

SEQ ID NO: 947418 - DNA, 25 bp, Mus musculus
ggacttcaaggacgctgccccctct

SEQ ID NO: 947419 - DNA, 25 bp, Mus musculus
ggacttcaaggagaatccggagcaa

SEQ ID NO: 947420 - DNA, 25 bp, Mus musculus
ggacttcaaggaggctgccccctct

SEQ ID NO: 947421 - DNA, 25 bp, Mus musculus
ggacttccagaaaagccagtaagaa

SEQ ID NO: 947422 - DNA, 25 bp, Mus musculus
ggacttccagtaaagccagtaagaa

SEQ ID NO: 947423 - DNA, 25 bp, Mus musculus
ggacttgatcctgagcccctgccac

SEQ ID NO: 947424 - DNA, 25 bp, Mus musculus
ggacttgatcgtgagcccctgccac

SEQ ID NO: 947425 - DNA, 25 bp, Mus musculus
ggacttgcataccttgatccttgtc

SEQ ID NO: 947426 - DNA, 25 bp, Mus musculus
ggacttgcattccttgatccttgtc

SEQ ID NO: 947427 - DNA, 25 bp, Mus musculus
ggacttgcattgatgtgaacgaatg

SEQ ID NO: 947428 - DNA, 25 bp, Mus musculus
ggacttgcattgttgtgaacgaatg

SEQ ID NO: 947429 - DNA, 25 bp, Mus musculus
ggacttgccacgattgtcttcatcc

SEQ ID NO: 947430 - DNA, 25 bp, Mus musculus
ggacttgccacgtttgtcttcatcc

SEQ ID NO: 947431 - DNA, 25 bp, Mus musculus
ggacttgctgtacgttatgatgagt

SEQ ID NO: 947432 - DNA, 25 bp, Mus musculus
ggacttgctgtaggttatgatgagt

SEQ ID NO: 947433 - DNA, 25 bp, Mus musculus
ggacttggaacacgtagccaatgag

SEQ ID NO: 947434 - DNA, 25 bp, Mus musculus
ggacttggaacaggtagccaatgag

SEQ ID NO: 947435 - DNA, 25 bp, Mus musculus
ggacttggcaacagcgtctctgtga

SEQ ID NO: 947436 - DNA, 25 bp, Mus musculus
ggacttggcaacagggtctctgtga

SEQ ID NO: 947437 - DNA, 25 bp, Mus musculus
ggacttggggcgacgtatgtgatga

SEQ ID NO: 947438 - DNA, 25 bp, Mus musculus
ggacttggggggacgtatgtgatga

SEQ ID NO: 947439 - DNA, 25 bp, Mus musculus
ggacttgtaataaacctgcgaagct

SEQ ID NO: 947440 - DNA, 25 bp, Mus musculus
ggacttgtaataaagctgcgaagct

SEQ ID NO: 947441 - DNA, 25 bp, Mus musculus
ggactttaagcacacttggatattt

SEQ ID NO: 947442 - DNA, 25 bp, Mus musculus
ggactttaaggacacttggatattt

SEQ ID NO: 947443 - DNA, 25 bp, Mus musculus
ggactttcatgcacagtggtgtggc

SEQ ID NO: 947444 - DNA, 25 bp, Mus musculus
ggactttcatgcactgtggtgtggc

SEQ ID NO: 947445 - DNA, 25 bp, Mus musculus
ggactttcccaaactgccctactta

SEQ ID NO: 947446 - DNA, 25 bp, Mus musculus
ggactttcccaatctgccctactta

SEQ ID NO: 947447 - DNA, 25 bp, Mus musculus
ggactttcctaacctgccctacttg

SEQ ID NO: 947448 - DNA, 25 bp, Mus musculus
ggactttcctaagctgccctacttg

SEQ ID NO: 947449 - DNA, 25 bp, Mus musculus
ggactttgtgagaggtttgtacacc

SEQ ID NO: 947450 - DNA, 25 bp, Mus musculus
ggactttgtgagtggtttgtacacc

SEQ ID NO: 947451 - DNA, 25 bp, Mus musculus
ggagaaacacagctccttcacccac

SEQ ID NO: 947452 - DNA, 25 bp, Mus musculus
ggagaaacacaggtccttcacccac

SEQ ID NO: 947453 - DNA, 25 bp, Mus musculus
ggagaaactcagccaacgcctggac

SEQ ID NO: 947454 - DNA, 25 bp, Mus musculus
ggagaaactcaggcaacgcctggac

SEQ ID NO: 947455 - DNA, 25 bp, Mus musculus
ggagaaagagcattgaagaacaaaa

SEQ ID NO: 947456 - DNA, 25 bp, Mus musculus
ggagaaagagcctgccactcgctga

SEQ ID NO: 947457 - DNA, 25 bp, Mus musculus
ggagaaagagctggaggtgattggc

SEQ ID NO: 947458 - DNA, 25 bp, Mus musculus
ggagaaagaggattgaagaacaaaa

SEQ ID NO: 947459 - DNA, 25 bp, Mus musculus
ggagaaagaggctgccactcgctga

SEQ ID NO: 947460 - DNA, 25 bp, Mus musculus
ggagaaagaggtggaggtgattggc

SEQ ID NO: 947461 - DNA, 25 bp, Mus musculus
ggagaaagctaacgcttatgcagcc

SEQ ID NO: 947462 - DNA, 25 bp, Mus musculus
ggagaaagctaaggcttatgcagcc

SEQ ID NO: 947463 - DNA, 25 bp, Mus musculus
ggagaaagcttgcacgcctttctca

SEQ ID NO: 947464 - DNA, 25 bp, Mus musculus
ggagaaagcttgcaggcctttctca

SEQ ID NO: 947465 - DNA, 25 bp, Mus musculus
ggagaaaggatgcacgaccatcagc

SEQ ID NO: 947466 - DNA, 25 bp, Mus musculus
ggagaaaggatgcaggaccatcagc

SEQ ID NO: 947467 - DNA, 25 bp, Mus musculus
ggagaaaggctgcagctggaacctt

SEQ ID NO: 947468 - DNA, 25 bp, Mus musculus
ggagaaaggctgcgtgaagaccctt

SEQ ID NO: 947469 - DNA, 25 bp, Mus musculus
ggagaaaggctggagctggaacctt

SEQ ID NO: 947470 - DNA, 25 bp, Mus musculus
ggagaaaggctgggtgaagaccctt

SEQ ID NO: 947471 - DNA, 25 bp, Mus musculus
ggagaaagtgagcacttttgctgcc

SEQ ID NO: 947472 - DNA, 25 bp, Mus musculus
ggagaaagtgaggacttttgctgcc

SEQ ID NO: 947473 - DNA, 25 bp, Mus musculus
ggagaaagtggcaacatcttagggt

SEQ ID NO: 947474 - DNA, 25 bp, Mus musculus
ggagaaagtggcaactcagtacagg

SEQ ID NO: 947475 - DNA, 25 bp, Mus musculus
ggagaaagtggcaagatcttagggt

SEQ ID NO: 947476 - DNA, 25 bp, Mus musculus
ggagaaagtggcaagtcagtacagg

SEQ ID NO: 947477 - DNA, 25 bp, Mus musculus
ggagaaatgtgtcgcttcagggaaa

SEQ ID NO: 947478 - DNA, 25 bp, Mus musculus
ggagaaatgtgtggcttcagggaaa

SEQ ID NO: 947479 - DNA, 25 bp, Mus musculus
ggagaacagctccgggactttctct

SEQ ID NO: 947480 - DNA, 25 bp, Mus musculus
ggagaacagctccggtttgagtttt

SEQ ID NO: 947481 - DNA, 25 bp, Mus musculus
ggagaacagctcggggactttctct

SEQ ID NO: 947482 - DNA, 25 bp, Mus musculus
ggagaacagctcgggtttgagtttt

SEQ ID NO: 947483 - DNA, 25 bp, Mus musculus
ggagaacatctctacgcctgaggct

SEQ ID NO: 947484 - DNA, 25 bp, Mus musculus
ggagaacatctctaggcctgaggct

SEQ ID NO: 947485 - DNA, 25 bp, Mus musculus
ggagaaccgcaacatatttcttcta

SEQ ID NO: 947486 - DNA, 25 bp, Mus musculus
ggagaaccgcaagatatttcttcta

SEQ ID NO: 947487 - DNA, 25 bp, Mus musculus
ggagaactacagcacgccagaagca

SEQ ID NO: 947488 - DNA, 25 bp, Mus musculus
ggagaactacagcaggccagaagca

SEQ ID NO: 947489 - DNA, 25 bp, Mus musculus
ggagaactagcacgtgacttaagag

SEQ ID NO: 947490 - DNA, 25 bp, Mus musculus
ggagaactagcaggtgacttaagag

SEQ ID NO: 947491 - DNA, 25 bp, Mus musculus
ggagaactatgacgctctcctgaac

SEQ ID NO: 947492 - DNA, 25 bp, Mus musculus
ggagaactatgaggctctcctgaac

SEQ ID NO: 947493 - DNA, 25 bp, Mus musculus
ggagaactcacaggaggatgaaatg

SEQ ID NO: 947494 - DNA, 25 bp, Mus musculus
ggagaactcagaggaggatgaaatg

SEQ ID NO: 947495 - DNA, 25 bp, Mus musculus
ggagaactcgcaccagggtccacgc

SEQ ID NO: 947496 - DNA, 25 bp, Mus musculus
ggagaactcgcagcagggtccacgc

SEQ ID NO: 947497 - DNA, 25 bp, Mus musculus
ggagaactgcaacctcgagggaaaa

SEQ ID NO: 947498 - DNA, 25 bp, Mus musculus
ggagaactgcaagctcgagggaaaa

SEQ ID NO: 947499 - DNA, 25 bp, Mus musculus
ggagaactgcagccatcagaagggg

SEQ ID NO: 947500 - DNA, 25 bp, Mus musculus
ggagaactgcagcttctcccatggg

SEQ ID NO: 947501 - DNA, 25 bp, Mus musculus
ggagaactgcaggcatcagaagggg

SEQ ID NO: 947502 - DNA, 25 bp, Mus musculus
ggagaactgcaggttctcccatggg

SEQ ID NO: 947503 - DNA, 25 bp, Mus musculus
ggagaactggctacactctcaacag

SEQ ID NO: 947504 - DNA, 25 bp, Mus musculus
ggagaactggctactctctcaacag

SEQ ID NO: 947505 - DNA, 25 bp, Mus musculus
ggagaagaagaacgtagctacatca

SEQ ID NO: 947506 - DNA, 25 bp, Mus musculus
ggagaagaagaaggtagctacatca

SEQ ID NO: 947507 - DNA, 25 bp, Mus musculus
ggagaagaagcaatgtctgaccgtc

SEQ ID NO: 947508 - DNA, 25 bp, Mus musculus
ggagaagaaggaatgtctgaccgtc

SEQ ID NO: 947509 - DNA, 25 bp, Mus musculus
ggagaagagcggacacagcccttgg

SEQ ID NO: 947510 - DNA, 25 bp, Mus musculus
ggagaagagcggtcacagcccttgg

SEQ ID NO: 947511 - DNA, 25 bp, Mus musculus
ggagaagaggagcttgtcatccctc

SEQ ID NO: 947512 - DNA, 25 bp, Mus musculus
ggagaagaggaggttgtcatccctc

SEQ ID NO: 947513 - DNA, 25 bp, Mus musculus
ggagaagaggcagcaaatcaatatc

SEQ ID NO: 947514 - DNA, 25 bp, Mus musculus
ggagaagagggagcaaatcaatatc

SEQ ID NO: 947515 - DNA, 25 bp, Mus musculus
ggagaagagtatgacgagcgagact

SEQ ID NO: 947516 - DNA, 25 bp, Mus musculus
ggagaagagtatgaggagcgagact

SEQ ID NO: 947517 - DNA, 25 bp, Mus musculus
ggagaagatgctaccgatgccttcc

SEQ ID NO: 947518 - DNA, 25 bp, Mus musculus
ggagaagatgctacggatgccttcc

SEQ ID NO: 947519 - DNA, 25 bp, Mus musculus
ggagaagcagaccatggtgaatccg

SEQ ID NO: 947520 - DNA, 25 bp, Mus musculus
ggagaagcagtccatggtgaatccg

SEQ ID NO: 947521 - DNA, 25 bp, Mus musculus
ggagaagctgagcacaagatctaat

SEQ ID NO: 947522 - DNA, 25 bp, Mus musculus
ggagaagctgaggacaagatctaat

SEQ ID NO: 947523 - DNA, 25 bp, Mus musculus
ggagaagctgcacgggctgtacgag

SEQ ID NO: 947524 - DNA, 25 bp, Mus musculus
ggagaagctgcctacagcaagaggg

SEQ ID NO: 947525 - DNA, 25 bp, Mus musculus
ggagaagctgcctagagcaagaggg

SEQ ID NO: 947526 - DNA, 25 bp, Mus musculus
ggagaagctggacgggctgtacgag

SEQ ID NO: 947527 - DNA, 25 bp, Mus musculus
ggagaagctgtcggctcagggactt

SEQ ID NO: 947528 - DNA, 25 bp, Mus musculus
ggagaagctgtcgggtcagggactt

SEQ ID NO: 947529 - DNA, 25 bp, Mus musculus
ggagaaggagctggtgaataaggat

SEQ ID NO: 947530 - DNA, 25 bp, Mus musculus
ggagaaggaggtggtgaataaggat

SEQ ID NO: 947531 - DNA, 25 bp, Mus musculus
ggagaaggatgagccgaactaccat

SEQ ID NO: 947532 - DNA, 25 bp, Mus musculus
ggagaaggatgagcggaactaccat

SEQ ID NO: 947533 - DNA, 25 bp, Mus musculus
ggagaaggccagcggccgctttggc

SEQ ID NO: 947534 - DNA, 25 bp, Mus musculus
ggagaaggccaggggccgctttggc

SEQ ID NO: 947535 - DNA, 25 bp, Mus musculus
ggagaagggaaatatgctggcttat

SEQ ID NO: 947536 - DNA, 25 bp, Mus musculus
ggagaagggatatatgctggcttat

SEQ ID NO: 947537 - DNA, 25 bp, Mus musculus
ggagaaggtcacaacaactaaaaga

SEQ ID NO: 947538 - DNA, 25 bp, Mus musculus
ggagaaggtcacaagaactaaaaga

SEQ ID NO: 947539 - DNA, 25 bp, Mus musculus
ggagaagtcgctctttctgtggagc

SEQ ID NO: 947540 - DNA, 25 bp, Mus musculus
ggagaagtcggtctttctgtggagc

SEQ ID NO: 947541 - DNA, 25 bp, Mus musculus
ggagaagtgcttacagtcttcttct

SEQ ID NO: 947542 - DNA, 25 bp, Mus musculus
ggagaagtgcttactgtcttcttct

SEQ ID NO: 947543 - DNA, 25 bp, Mus musculus
ggagaagtggagaaggccttggagt

SEQ ID NO: 947544 - DNA, 25 bp, Mus musculus
ggagaagtggatgtcgcgtggaggg

SEQ ID NO: 947545 - DNA, 25 bp, Mus musculus
ggagaagtggtgaaggccttggagt

SEQ ID NO: 947546 - DNA, 25 bp, Mus musculus
ggagaagtggttgtcgcgtggaggg

SEQ ID NO: 947547 - DNA, 25 bp, Mus musculus
ggagaataagctttgtgagatgatc

SEQ ID NO: 947548 - DNA, 25 bp, Mus musculus
ggagaataaggtttgtgagatgatc

SEQ ID NO: 947549 - DNA, 25 bp, Mus musculus
ggagaatacaggcattacagcaatg

SEQ ID NO: 947550 - DNA, 25 bp, Mus musculus
ggagaatacaggctctgttcactag

SEQ ID NO: 947551 - DNA, 25 bp, Mus musculus
ggagaatacagggattacagcaatg

SEQ ID NO: 947552 - DNA, 25 bp, Mus musculus
ggagaatacagggtctgttcactag

SEQ ID NO: 947553 - DNA, 25 bp, Mus musculus
ggagaatgactgctgggtgtgcaaa

SEQ ID NO: 947554 - DNA, 25 bp, Mus musculus
ggagaatgactggtgggtgtgcaaa

SEQ ID NO: 947555 - DNA, 25 bp, Mus musculus
ggagaatgagcatgctcgcaccatg

SEQ ID NO: 947556 - DNA, 25 bp, Mus musculus
ggagaatgaggatgctcgcaccatg

SEQ ID NO: 947557 - DNA, 25 bp, Mus musculus
ggagaatgatgtctctaatggatgg

SEQ ID NO: 947558 - DNA, 25 bp, Mus musculus
ggagaatgatgtgtctaatggatgg

SEQ ID NO: 947559 - DNA, 25 bp, Mus musculus
ggagaatgggcacgtggcactgatg

SEQ ID NO: 947560 - DNA, 25 bp, Mus musculus
ggagaatgggcacttgttacaggtg

SEQ ID NO: 947561 - DNA, 25 bp, Mus musculus
ggagaatgggcaggtggcactgatg

SEQ ID NO: 947562 - DNA, 25 bp, Mus musculus
ggagaatgggcagttgttacaggtg

SEQ ID NO: 947563 - DNA, 25 bp, Mus musculus
ggagaatgtccacatcagcagcgtt

SEQ ID NO: 947564 - DNA, 25 bp, Mus musculus
ggagaatgtcgacatcagcagcgtt

SEQ ID NO: 947565 - DNA, 25 bp, Mus musculus
ggagaatgtgcgctcatggcagata

SEQ ID NO: 947566 - DNA, 25 bp, Mus musculus
ggagaatgtgggctcatggcagata

SEQ ID NO: 947567 - DNA, 25 bp, Mus musculus
ggagaatgtgttaaccaagtgataa

SEQ ID NO: 947568 - DNA, 25 bp, Mus musculus
ggagaatgtgttaagcaagtgataa

SEQ ID NO: 947569 - DNA, 25 bp, Mus musculus
ggagaatgtttgcatattgatgagt

SEQ ID NO: 947570 - DNA, 25 bp, Mus musculus
ggagaatgtttggatattgatgagt

SEQ ID NO: 947571 - DNA, 25 bp, Mus musculus
ggagaattacagaactgtttatcag

SEQ ID NO: 947572 - DNA, 25 bp, Mus musculus
ggagaattacagtactgtttatcag

SEQ ID NO: 947573 - DNA, 25 bp, Mus musculus
ggagaatttctgaaagtgcaacagt

SEQ ID NO: 947574 - DNA, 25 bp, Mus musculus
ggagaatttctgtaagtgcaacagt

SEQ ID NO: 947575 - DNA, 25 bp, Mus musculus
ggagacaacaccctattttataggc

SEQ ID NO: 947576 - DNA, 25 bp, Mus musculus
ggagacaacacccttttttataggc

SEQ ID NO: 947577 - DNA, 25 bp, Mus musculus
ggagacaacatacacgataagaaca

SEQ ID NO: 947578 - DNA, 25 bp, Mus musculus
ggagacaacatacaggataagaaca

SEQ ID NO: 947579 - DNA, 25 bp, Mus musculus
ggagacacagaccactgaggaagag

SEQ ID NO: 947580 - DNA, 25 bp, Mus musculus
ggagacacagacgctgttccggcgc

SEQ ID NO: 947581 - DNA, 25 bp, Mus musculus
ggagacacagtccactgaggaagag

SEQ ID NO: 947582 - DNA, 25 bp, Mus musculus
ggagacacagtcgctgttccggcgc

SEQ ID NO: 947583 - DNA, 25 bp, Mus musculus
ggagacactgtgcttacttggcctt

SEQ ID NO: 947584 - DNA, 25 bp, Mus musculus
ggagacactgtggttacttggcctt

SEQ ID NO: 947585 - DNA, 25 bp, Mus musculus
ggagacagagagatttgtgtcagaa

SEQ ID NO: 947586 - DNA, 25 bp, Mus musculus
ggagacagagagttttgtgtcagaa

SEQ ID NO: 947587 - DNA, 25 bp, Mus musculus
ggagacagagctattgacctcatgg

SEQ ID NO: 947588 - DNA, 25 bp, Mus musculus
ggagacagaggtattgacctcatgg

SEQ ID NO: 947589 - DNA, 25 bp, Mus musculus
ggagacagcgcgcgagtttgtagat

SEQ ID NO: 947590 - DNA, 25 bp, Mus musculus
ggagacagcgggcgagtttgtagat

SEQ ID NO: 947591 - DNA, 25 bp, Mus musculus
ggagacagggctacctgtgggtgcc

SEQ ID NO: 947592 - DNA, 25 bp, Mus musculus
ggagacaggggtacctgtgggtgcc

SEQ ID NO: 947593 - DNA, 25 bp, Mus musculus
ggagacatgcgccacgcactgaaca

SEQ ID NO: 947594 - DNA, 25 bp, Mus musculus
ggagacatgcgccaggcactgaaca

SEQ ID NO: 947595 - DNA, 25 bp, Mus musculus
ggagaccaagatccgactcagtggg

SEQ ID NO: 947596 - DNA, 25 bp, Mus musculus
ggagaccaagttccgactcagtggg

SEQ ID NO: 947597 - DNA, 25 bp, Mus musculus
ggagaccacaatttccatccagttg

SEQ ID NO: 947598 - DNA, 25 bp, Mus musculus
ggagaccacactcaaaaaagttgtg

SEQ ID NO: 947599 - DNA, 25 bp, Mus musculus
ggagaccacagtcaaaaaagttgtg

SEQ ID NO: 947600 - DNA, 25 bp, Mus musculus
ggagaccacattttccatccagttg

SEQ ID NO: 947601 - DNA, 25 bp, Mus musculus
ggagaccagactgacgctgtgtttc

SEQ ID NO: 947602 - DNA, 25 bp, Mus musculus
ggagaccagactgaggctgtgtttc

SEQ ID NO: 947603 - DNA, 25 bp, Mus musculus
ggagaccataggacaaggatgagag

SEQ ID NO: 947604 - DNA, 25 bp, Mus musculus
ggagaccataggtcaaggatgagag

SEQ ID NO: 947605 - DNA, 25 bp, Mus musculus
ggagaccatctgcacgtacaacttg

SEQ ID NO: 947606 - DNA, 25 bp, Mus musculus
ggagaccatctgcaggtacaacttg

SEQ ID NO: 947607 - DNA, 25 bp, Mus musculus
ggagacccattgagccccaattcct

SEQ ID NO: 947608 - DNA, 25 bp, Mus musculus
ggagacccattgtgccccaattcct

SEQ ID NO: 947609 - DNA, 25 bp, Mus musculus
ggagaccccaagcgagagatggctg

SEQ ID NO: 947610 - DNA, 25 bp, Mus musculus
ggagaccccaagggagagatggctg

SEQ ID NO: 947611 - DNA, 25 bp, Mus musculus
ggagaccgcaggacccggaaccatg

SEQ ID NO: 947612 - DNA, 25 bp, Mus musculus
ggagaccgcaggacgcggaaccatg

SEQ ID NO: 947613 - DNA, 25 bp, Mus musculus
ggagacctcaagccttccaaggaat

SEQ ID NO: 947614 - DNA, 25 bp, Mus musculus
ggagacctcaaggcttccaaggaat

SEQ ID NO: 947615 - DNA, 25 bp, Mus musculus
ggagacctggagcatccccaggacg

SEQ ID NO: 947616 - DNA, 25 bp, Mus musculus
ggagacctggaggatccccaggacg

SEQ ID NO: 947617 - DNA, 25 bp, Mus musculus
ggagacctggtgcgtgtgaacaaag

SEQ ID NO: 947618 - DNA, 25 bp, Mus musculus
ggagacctggtgggtgtgaacaaag

SEQ ID NO: 947619 - DNA, 25 bp, Mus musculus
ggagacgaggctctttcacgaggat

SEQ ID NO: 947620 - DNA, 25 bp, Mus musculus
ggagacgagggtctttcacgaggat

SEQ ID NO: 947621 - DNA, 25 bp, Mus musculus
ggagacgcacagccatatctgctgt

SEQ ID NO: 947622 - DNA, 25 bp, Mus musculus
ggagacgcacaggcatatctgctgt

SEQ ID NO: 947623 - DNA, 25 bp, Mus musculus
ggagacgctcagacctcacgtggta

SEQ ID NO: 947624 - DNA, 25 bp, Mus musculus
ggagacgctcagtcctcacgtggta

SEQ ID NO: 947625 - DNA, 25 bp, Mus musculus
ggagacgctgaacaggtcctgggcc

SEQ ID NO: 947626 - DNA, 25 bp, Mus musculus
ggagacgctgaagaggtcctgggcc

SEQ ID NO: 947627 - DNA, 25 bp, Mus musculus
ggagacgctgagccatggcagtttc

SEQ ID NO: 947628 - DNA, 25 bp, Mus musculus
ggagacgctgaggcatggcagtttc

SEQ ID NO: 947629 - DNA, 25 bp, Mus musculus
ggagacggaaaactgtcattggtct

SEQ ID NO: 947630 - DNA, 25 bp, Mus musculus
ggagacggaaaagtgtcattggtct

SEQ ID NO: 947631 - DNA, 25 bp, Mus musculus
ggagacgtacaacattttttatgct

SEQ ID NO: 947632 - DNA, 25 bp, Mus musculus
ggagacgtacaagattttttatgct

SEQ ID NO: 947633 - DNA, 25 bp, Mus musculus
ggagacgtgaagattgtgtgtgttg

SEQ ID NO: 947634 - DNA, 25 bp, Mus musculus
ggagacgtgaagtttgtgtgtgttg

SEQ ID NO: 947635 - DNA, 25 bp, Mus musculus
ggagactatgagttactcaagagct

SEQ ID NO: 947636 - DNA, 25 bp, Mus musculus
ggagactatgagtttctcaagagct

SEQ ID NO: 947637 - DNA, 25 bp, Mus musculus
ggagactattgaaattaatcccaag

SEQ ID NO: 947638 - DNA, 25 bp, Mus musculus
ggagactattgatattaatcccaag

SEQ ID NO: 947639 - DNA, 25 bp, Mus musculus
ggagactccctggacgtttgcctca

SEQ ID NO: 947640 - DNA, 25 bp, Mus musculus
ggagactccctggaggtttgcctca

SEQ ID NO: 947641 - DNA, 25 bp, Mus musculus
ggagactctgagcttggattcctgt

SEQ ID NO: 947642 - DNA, 25 bp, Mus musculus
ggagactctgaggttggattcctgt

SEQ ID NO: 947643 - DNA, 25 bp, Mus musculus
ggagactgagcatgaggctgtagag

SEQ ID NO: 947644 - DNA, 25 bp, Mus musculus
ggagactgaggatgaggctgtagag

SEQ ID NO: 947645 - DNA, 25 bp, Mus musculus
ggagactgcattcacatagatgaat

SEQ ID NO: 947646 - DNA, 25 bp, Mus musculus
ggagactgcattgacatagatgaat

SEQ ID NO: 947647 - DNA, 25 bp, Mus musculus
ggagactggacacaacgattccggg

SEQ ID NO: 947648 - DNA, 25 bp, Mus musculus
ggagactggacagaacgattccggg

SEQ ID NO: 947649 - DNA, 25 bp, Mus musculus
ggagacttggctccaactttctgca

SEQ ID NO: 947650 - DNA, 25 bp, Mus musculus
ggagacttggctccagcctgaggag

SEQ ID NO: 947651 - DNA, 25 bp, Mus musculus
ggagacttggctcctactttctgca

SEQ ID NO: 947652 - DNA, 25 bp, Mus musculus
ggagacttggctcctgcctgaggag

SEQ ID NO: 947653 - DNA, 25 bp, Mus musculus
ggagacttggcttgggggcatgtaa

SEQ ID NO: 947654 - DNA, 25 bp, Mus musculus
ggagacttgggttgggggcatgtaa

SEQ ID NO: 947655 - DNA, 25 bp, Mus musculus
ggagactttgtcagccatgccaaag

SEQ ID NO: 947656 - DNA, 25 bp, Mus musculus
ggagactttgtcaggcatgccaaag

SEQ ID NO: 947657 - DNA, 25 bp, Mus musculus
ggagagaaggaagacccagagaagt

SEQ ID NO: 947658 - DNA, 25 bp, Mus musculus
ggagagaaggaagagccagagaagt

SEQ ID NO: 947659 - DNA, 25 bp, Mus musculus
ggagagacagaacccaataacccca

SEQ ID NO: 947660 - DNA, 25 bp, Mus musculus
ggagagacagaagccaataacccca

SEQ ID NO: 947661 - DNA, 25 bp, Mus musculus
ggagagacagaggaaacaacgtttg

SEQ ID NO: 947662 - DNA, 25 bp, Mus musculus
ggagagacagtggaaacaacgtttg

SEQ ID NO: 947663 - DNA, 25 bp, Mus musculus
ggagagactgcgatgagcacagctc

SEQ ID NO: 947664 - DNA, 25 bp, Mus musculus
ggagagactgctcactcgataccag

SEQ ID NO: 947665 - DNA, 25 bp, Mus musculus
ggagagactgctgactcgataccag

SEQ ID NO: 947666 - DNA, 25 bp, Mus musculus
ggagagactgggatgagcacagctc

SEQ ID NO: 947667 - DNA, 25 bp, Mus musculus
ggagagagaccacgataagaaacgc

SEQ ID NO: 947668 - DNA, 25 bp, Mus musculus
ggagagagaccaggataagaaacgc

SEQ ID NO: 947669 - DNA, 25 bp, Mus musculus
ggagagagagccacgattacaggag

SEQ ID NO: 947670 - DNA, 25 bp, Mus musculus
ggagagagagccccagctgattcat

SEQ ID NO: 947671 - DNA, 25 bp, Mus musculus
ggagagagaggcacgattacaggag

SEQ ID NO: 947672 - DNA, 25 bp, Mus musculus
ggagagagaggcccagctgattcat

SEQ ID NO: 947673 - DNA, 25 bp, Mus musculus
ggagagagccatcattgacatgtac

SEQ ID NO: 947674 - DNA, 25 bp, Mus musculus
ggagagagccatgattgacatgtac

SEQ ID NO: 947675 - DNA, 25 bp, Mus musculus
ggagagagggaacagcaaatgtgtc

SEQ ID NO: 947676 - DNA, 25 bp, Mus musculus
ggagagagggaagagcaaatgtgtc

SEQ ID NO: 947677 - DNA, 25 bp, Mus musculus
ggagagagtcctcacaatggcaatg

SEQ ID NO: 947678 - DNA, 25 bp, Mus musculus
ggagagagtcctcacgcacctccaa

SEQ ID NO: 947679 - DNA, 25 bp, Mus musculus
ggagagagtcctcagaatggcaatg

SEQ ID NO: 947680 - DNA, 25 bp, Mus musculus
ggagagagtcctcaggcacctccaa

SEQ ID NO: 947681 - DNA, 25 bp, Mus musculus
ggagagagtgagtgcatctgatggc

SEQ ID NO: 947682 - DNA, 25 bp, Mus musculus
ggagagagtgcgcatgttactggat

SEQ ID NO: 947683 - DNA, 25 bp, Mus musculus
ggagagagtgggcatgttactggat

SEQ ID NO: 947684 - DNA, 25 bp, Mus musculus
ggagagagtgtgtgcatctgatggc

SEQ ID NO: 947685 - DNA, 25 bp, Mus musculus
ggagagatagatctagctagtgaag

SEQ ID NO: 947686 - DNA, 25 bp, Mus musculus
ggagagatagttctagctagtgaag

SEQ ID NO: 947687 - DNA, 25 bp, Mus musculus
ggagagattgatgctgcacctcctg

SEQ ID NO: 947688 - DNA, 25 bp, Mus musculus
ggagagattgttgctgcacctcctg

SEQ ID NO: 947689 - DNA, 25 bp, Mus musculus
ggagagcaaaaacaatcgggttgag

SEQ ID NO: 947690 - DNA, 25 bp, Mus musculus
ggagagcaaaaactttcgtgaacag

SEQ ID NO: 947691 - DNA, 25 bp, Mus musculus
ggagagcaaaaagaatcgggttgag

SEQ ID NO: 947692 - DNA, 25 bp, Mus musculus
ggagagcaaaaagtttcgtgaacag

SEQ ID NO: 947693 - DNA, 25 bp, Mus musculus
ggagagcaagagcatattatcagga

SEQ ID NO: 947694 - DNA, 25 bp, Mus musculus
ggagagcaagagcgtttgttcctta

SEQ ID NO: 947695 - DNA, 25 bp, Mus musculus
ggagagcaagaggatattatcagga

SEQ ID NO: 947696 - DNA, 25 bp, Mus musculus
ggagagcaagagggtttgttcctta

SEQ ID NO: 947697 - DNA, 25 bp, Mus musculus
ggagagcagagccttggaaagacgt

SEQ ID NO: 947698 - DNA, 25 bp, Mus musculus
ggagagcagagcgttggaaagacgt

SEQ ID NO: 947699 - DNA, 25 bp, Mus musculus
ggagagcatgacaaatgcggtgctc

SEQ ID NO: 947700 - DNA, 25 bp, Mus musculus
ggagagcatgtcaaatgcggtgctc

SEQ ID NO: 947701 - DNA, 25 bp, Mus musculus
ggagagccagccttagaatcagact

SEQ ID NO: 947702 - DNA, 25 bp, Mus musculus
ggagagccaggcttagaatcagact

SEQ ID NO: 947703 - DNA, 25 bp, Mus musculus
ggagagcctgagtgctgatatttta

SEQ ID NO: 947704 - DNA, 25 bp, Mus musculus
ggagagcctgcgaacttctgctcac

SEQ ID NO: 947705 - DNA, 25 bp, Mus musculus
ggagagcctgcgaagttctgctcac

SEQ ID NO: 947706 - DNA, 25 bp, Mus musculus
ggagagcctgtgtgctgatatttta

SEQ ID NO: 947707 - DNA, 25 bp, Mus musculus
ggagagcgagaagaattttatttat

SEQ ID NO: 947708 - DNA, 25 bp, Mus musculus
ggagagcgagtagaattttatttat

SEQ ID NO: 947709 - DNA, 25 bp, Mus musculus
ggagagcgctcacgtgcagagatcg

SEQ ID NO: 947710 - DNA, 25 bp, Mus musculus
ggagagcgctcaggtgcagagatcg

SEQ ID NO: 947711 - DNA, 25 bp, Mus musculus
ggagagcggcagaggttccagggcc

SEQ ID NO: 947712 - DNA, 25 bp, Mus musculus
ggagagcggcagtggttccagggcc

SEQ ID NO: 947713 - DNA, 25 bp, Mus musculus
ggagagcggtgagccacatgtcctt

SEQ ID NO: 947714 - DNA, 25 bp, Mus musculus
ggagagcggtgagcgacatgtcctt

SEQ ID NO: 947715 - DNA, 25 bp, Mus musculus
ggagagctcaagaatggatttgcta

SEQ ID NO: 947716 - DNA, 25 bp, Mus musculus
ggagagctcaagtatggatttgcta

SEQ ID NO: 947717 - DNA, 25 bp, Mus musculus
ggagagcttcaacgcatatgagcgt

SEQ ID NO: 947718 - DNA, 25 bp, Mus musculus
ggagagcttcaaggcatatgagcgt

SEQ ID NO: 947719 - DNA, 25 bp, Mus musculus
ggagagcttcttctcctcatgtctc

SEQ ID NO: 947720 - DNA, 25 bp, Mus musculus
ggagagcttcttctgctcatgtctc

SEQ ID NO: 947721 - DNA, 25 bp, Mus musculus
ggagaggaaacgatcctggggcaga

SEQ ID NO: 947722 - DNA, 25 bp, Mus musculus
ggagaggaaacgttcctggggcaga

SEQ ID NO: 947723 - DNA, 25 bp, Mus musculus
ggagaggaagacggactccaagatg

SEQ ID NO: 947724 - DNA, 25 bp, Mus musculus
ggagaggaagtcggactccaagatg

SEQ ID NO: 947725 - DNA, 25 bp, Mus musculus
ggagaggaggctctggtcagctacc

SEQ ID NO: 947726 - DNA, 25 bp, Mus musculus
ggagaggagggtctggtcagctacc

SEQ ID NO: 947727 - DNA, 25 bp, Mus musculus
ggagaggccaagcacctgctcactc

SEQ ID NO: 947728 - DNA, 25 bp, Mus musculus
ggagaggccaaggacctgctcactc

SEQ ID NO: 947729 - DNA, 25 bp, Mus musculus
ggagaggctggacgctgagtttggt

SEQ ID NO: 947730 - DNA, 25 bp, Mus musculus
ggagaggctggaggctgagtttggt

SEQ ID NO: 947731 - DNA, 25 bp, Mus musculus
ggagagggaacacgagtacatcagg

SEQ ID NO: 947732 - DNA, 25 bp, Mus musculus
ggagagggaacaggagtacatcagg

SEQ ID NO: 947733 - DNA, 25 bp, Mus musculus
ggagagggacatcatgctagccaaa

SEQ ID NO: 947734 - DNA, 25 bp, Mus musculus
ggagagggacatgatgctagccaaa

SEQ ID NO: 947735 - DNA, 25 bp, Mus musculus
ggagagggggagccatttgcaggcc

SEQ ID NO: 947736 - DNA, 25 bp, Mus musculus
ggagagggggaggcatttgcaggcc

SEQ ID NO: 947737 - DNA, 25 bp, Mus musculus
ggagaggtcagacgatgcaaagaag

SEQ ID NO: 947738 - DNA, 25 bp, Mus musculus
ggagaggtcagacgctgtcaaaata

SEQ ID NO: 947739 - DNA, 25 bp, Mus musculus
ggagaggtcagaggatgcaaagaag

SEQ ID NO: 947740 - DNA, 25 bp, Mus musculus
ggagaggtcagaggctgtcaaaata

SEQ ID NO: 947741 - DNA, 25 bp, Mus musculus
ggagaggtgaacagggatgccttca

SEQ ID NO: 947742 - DNA, 25 bp, Mus musculus
ggagaggtgaactgggatgccttca

SEQ ID NO: 947743 - DNA, 25 bp, Mus musculus
ggagaggtggaacaccatgtctagc

SEQ ID NO: 947744 - DNA, 25 bp, Mus musculus
ggagaggtggaagaccatgtctagc

SEQ ID NO: 947745 - DNA, 25 bp, Mus musculus
ggagaggtggagagggatgcctttt

SEQ ID NO: 947746 - DNA, 25 bp, Mus musculus
ggagaggtggagtgggatgcctttt

SEQ ID NO: 947747 - DNA, 25 bp, Mus musculus
ggagagtaactacctttgcatcatg

SEQ ID NO: 947748 - DNA, 25 bp, Mus musculus
ggagagtaactagctttgcatcatg

SEQ ID NO: 947749 - DNA, 25 bp, Mus musculus
ggagagtcacagctaaagaacgctt

SEQ ID NO: 947750 - DNA, 25 bp, Mus musculus
ggagagtcacaggtaaagaacgctt

SEQ ID NO: 947751 - DNA, 25 bp, Mus musculus
ggagagtgagaacatcttggctgca

SEQ ID NO: 947752 - DNA, 25 bp, Mus musculus
ggagagtgagaagatcttggctgca

SEQ ID NO: 947753 - DNA, 25 bp, Mus musculus
ggagagttagagcaaccgaagaagc

SEQ ID NO: 947754 - DNA, 25 bp, Mus musculus
ggagagttagagcatccgaagaagc

SEQ ID NO: 947755 - DNA, 25 bp, Mus musculus
ggagagttcatcaccactgtgcaac

SEQ ID NO: 947756 - DNA, 25 bp, Mus musculus
ggagagttcatcacgactgtgcaac

SEQ ID NO: 947757 - DNA, 25 bp, Mus musculus
ggagagttccagcgtttgctgccaa

SEQ ID NO: 947758 - DNA, 25 bp, Mus musculus
ggagagttccagggtttgctgccaa

SEQ ID NO: 947759 - DNA, 25 bp, Mus musculus
ggagagtttgaacgcttcgtggcca

SEQ ID NO: 947760 - DNA, 25 bp, Mus musculus
ggagagtttgaaggcttcgtggcca

SEQ ID NO: 947761 - DNA, 25 bp, Mus musculus
ggagatacattgctaggtatgggct

SEQ ID NO: 947762 - DNA, 25 bp, Mus musculus
ggagatacattggtaggtatgggct

SEQ ID NO: 947763 - DNA, 25 bp, Mus musculus
ggagataccaaaaaaagcgaccagt

SEQ ID NO: 947764 - DNA, 25 bp, Mus musculus
ggagataccaaaaatagcgaccagt

SEQ ID NO: 947765 - DNA, 25 bp, Mus musculus
ggagatagtcatcgccatgatgatg

SEQ ID NO: 947766 - DNA, 25 bp, Mus musculus
ggagatagtcatggccatgatgatg

SEQ ID NO: 947767 - DNA, 25 bp, Mus musculus
ggagatatagtcatcgtggatgaaa

SEQ ID NO: 947768 - DNA, 25 bp, Mus musculus
ggagatatagtcatggtggatgaaa

SEQ ID NO: 947769 - DNA, 25 bp, Mus musculus
ggagatatatgtccacaacatgggt

SEQ ID NO: 947770 - DNA, 25 bp, Mus musculus
ggagatatatgtgcacaacatgggt

SEQ ID NO: 947771 - DNA, 25 bp, Mus musculus
ggagatatcgatattatgtccttga

SEQ ID NO: 947772 - DNA, 25 bp, Mus musculus
ggagatatcgttattatgtccttga

SEQ ID NO: 947773 - DNA, 25 bp, Mus musculus
ggagatcaaaatcgctcgcgctgta

SEQ ID NO: 947774 - DNA, 25 bp, Mus musculus
ggagatcaaaatggctcgcgctgta

SEQ ID NO: 947775 - DNA, 25 bp, Mus musculus
ggagatcaagaatctctctggctgg

SEQ ID NO: 947776 - DNA, 25 bp, Mus musculus
ggagatcaagaggatagataggttc

SEQ ID NO: 947777 - DNA, 25 bp, Mus musculus
ggagatcaagattgaacagcatcaa

SEQ ID NO: 947778 - DNA, 25 bp, Mus musculus
ggagatcaagcacttgcaccagagg

SEQ ID NO: 947779 - DNA, 25 bp, Mus musculus
ggagatcaaggacttgcaccagagg

SEQ ID NO: 947780 - DNA, 25 bp, Mus musculus
ggagatcaagtatctctctggctgg

SEQ ID NO: 947781 - DNA, 25 bp, Mus musculus
ggagatcaagtggatagataggttc

SEQ ID NO: 947782 - DNA, 25 bp, Mus musculus
ggagatcaagtttgaacagcatcaa

SEQ ID NO: 947783 - DNA, 25 bp, Mus musculus
ggagatcaggaggcgccagctgaca

SEQ ID NO: 947784 - DNA, 25 bp, Mus musculus
ggagatcaggatcaatgctcccttc

SEQ ID NO: 947785 - DNA, 25 bp, Mus musculus
ggagatcaggtggcgccagctgaca

SEQ ID NO: 947786 - DNA, 25 bp, Mus musculus
ggagatcaggttcaatgctcccttc

SEQ ID NO: 947787 - DNA, 25 bp, Mus musculus
ggagatcatcaacggcatgggttat

SEQ ID NO: 947788 - DNA, 25 bp, Mus musculus
ggagatcatcaagggcatgggttat

SEQ ID NO: 947789 - DNA, 25 bp, Mus musculus
ggagatcatgcaagaaaagtctttc

SEQ ID NO: 947790 - DNA, 25 bp, Mus musculus
ggagatcatgcaggcctactcggtg

SEQ ID NO: 947791 - DNA, 25 bp, Mus musculus
ggagatcatgcatgaaaagtctttc

SEQ ID NO: 947792 - DNA, 25 bp, Mus musculus
ggagatcatggaggcctactcggtg

SEQ ID NO: 947793 - DNA, 25 bp, Mus musculus
ggagatccagctcatggtagaagag

SEQ ID NO: 947794 - DNA, 25 bp, Mus musculus
ggagatccagctgatggtagaagag

SEQ ID NO: 947795 - DNA, 25 bp, Mus musculus
ggagatccgagacactacaggagcc

SEQ ID NO: 947796 - DNA, 25 bp, Mus musculus
ggagatccgagagactacaggagcc

SEQ ID NO: 947797 - DNA, 25 bp, Mus musculus
ggagatcctcctagcccacagacgc

SEQ ID NO: 947798 - DNA, 25 bp, Mus musculus
ggagatcctccttgcccacagacgc

SEQ ID NO: 947799 - DNA, 25 bp, Mus musculus
ggagatcgagcacgtgaatgagcga

SEQ ID NO: 947800 - DNA, 25 bp, Mus musculus
ggagatcgagcacgttcctcatgag

SEQ ID NO: 947801 - DNA, 25 bp, Mus musculus
ggagatcgagcaggtgaatgagcga

SEQ ID NO: 947802 - DNA, 25 bp, Mus musculus
ggagatcgagcaggttcctcatgag

SEQ ID NO: 947803 - DNA, 25 bp, Mus musculus
ggagatcgagcgcctgatctcagcc

SEQ ID NO: 947804 - DNA, 25 bp, Mus musculus
ggagatcgagggcctgatctcagcc

SEQ ID NO: 947805 - DNA, 25 bp, Mus musculus
ggagatctcaagatcccagtgggaa

SEQ ID NO: 947806 - DNA, 25 bp, Mus musculus
ggagatctcaagttcccagtgggaa

SEQ ID NO: 947807 - DNA, 25 bp, Mus musculus
ggagatgaagaacatattgcctcac

SEQ ID NO: 947808 - DNA, 25 bp, Mus musculus
ggagatgaagaagatattgcctcac

SEQ ID NO: 947809 - DNA, 25 bp, Mus musculus
ggagatgaagtagacgtatattcaa

SEQ ID NO: 947810 - DNA, 25 bp, Mus musculus
ggagatgaagtagaggtatattcaa

SEQ ID NO: 947811 - DNA, 25 bp, Mus musculus
ggagatgacaaagtatattccacaa

SEQ ID NO: 947812 - DNA, 25 bp, Mus musculus
ggagatgacaaagtttattccacaa

SEQ ID NO: 947813 - DNA, 25 bp, Mus musculus
ggagatgagcagcagccggccccgt

SEQ ID NO: 947814 - DNA, 25 bp, Mus musculus
ggagatgagcaggagccggccccgt

SEQ ID NO: 947815 - DNA, 25 bp, Mus musculus
ggagatgcagagcatcctgctgaac

SEQ ID NO: 947816 - DNA, 25 bp, Mus musculus
ggagatgcagaggatcctgctgaac

SEQ ID NO: 947817 - DNA, 25 bp, Mus musculus
ggagatgcagctcttcttggtccta

SEQ ID NO: 947818 - DNA, 25 bp, Mus musculus
ggagatgcaggtcttcttggtccta

SEQ ID NO: 947819 - DNA, 25 bp, Mus musculus
ggagatgcatctcgcaaatactgct

SEQ ID NO: 947820 - DNA, 25 bp, Mus musculus
ggagatgcatctcggaaatactgct

SEQ ID NO: 947821 - DNA, 25 bp, Mus musculus
ggagatggagacatctcaagctgga

SEQ ID NO: 947822 - DNA, 25 bp, Mus musculus
ggagatggagcagacgctccaggag

SEQ ID NO: 947823 - DNA, 25 bp, Mus musculus
ggagatggagcagaggctccaggag

SEQ ID NO: 947824 - DNA, 25 bp, Mus musculus
ggagatggagtcatctcaagctgga

SEQ ID NO: 947825 - DNA, 25 bp, Mus musculus
ggagatggccctctttgagcaagaa

SEQ ID NO: 947826 - DNA, 25 bp, Mus musculus
ggagatggccctgtttgagcaagaa

SEQ ID NO: 947827 - DNA, 25 bp, Mus musculus
ggagatgtcatcaccgtgctcgaac

SEQ ID NO: 947828 - DNA, 25 bp, Mus musculus
ggagatgtcatcacggtgctcgaac

SEQ ID NO: 947829 - DNA, 25 bp, Mus musculus
ggagatgtgttcattccacggcagc

SEQ ID NO: 947830 - DNA, 25 bp, Mus musculus
ggagatgtgttctttccacggcagc

SEQ ID NO: 947831 - DNA, 25 bp, Mus musculus
ggagattagccgagccaggtatgcc

SEQ ID NO: 947832 - DNA, 25 bp, Mus musculus
ggagattagcggagccaggtatgcc

SEQ ID NO: 947833 - DNA, 25 bp, Mus musculus
ggagattctgagaccttgctacatc

SEQ ID NO: 947834 - DNA, 25 bp, Mus musculus
ggagattctgagccgaatggacccg

SEQ ID NO: 947835 - DNA, 25 bp, Mus musculus
ggagattctgaggcgaatggacccg

SEQ ID NO: 947836 - DNA, 25 bp, Mus musculus
ggagattctgagtccttgctacatc

SEQ ID NO: 947837 - DNA, 25 bp, Mus musculus
ggagattgaatgcgacgacctggcc

SEQ ID NO: 947838 - DNA, 25 bp, Mus musculus
ggagattgaatgggacgacctggcc

SEQ ID NO: 947839 - DNA, 25 bp, Mus musculus
ggagattgagcaccttgttgctcgg

SEQ ID NO: 947840 - DNA, 25 bp, Mus musculus
ggagattgaggaccttgttgctcgg

SEQ ID NO: 947841 - DNA, 25 bp, Mus musculus
ggagattgcccacgatgccctgaag

SEQ ID NO: 947842 - DNA, 25 bp, Mus musculus
ggagattgcccaggatgccctgaag

SEQ ID NO: 947843 - DNA, 25 bp, Mus musculus
ggagatttctgaagcggcttgtcaa

SEQ ID NO: 947844 - DNA, 25 bp, Mus musculus
ggagatttctgaaggggcttgtcaa

SEQ ID NO: 947845 - DNA, 25 bp, Mus musculus
ggagatttgcagaccaacgtcgtgc

SEQ ID NO: 947846 - DNA, 25 bp, Mus musculus
ggagatttgcagtccaacgtcgtgc

SEQ ID NO: 947847 - DNA, 25 bp, Mus musculus
ggagattttgaaagacaagaagctg

SEQ ID NO: 947848 - DNA, 25 bp, Mus musculus
ggagattttgaatgacaagaagctg

SEQ ID NO: 947849 - DNA, 25 bp, Mus musculus
ggagcaaaagagcgaataattctct

SEQ ID NO: 947850 - DNA, 25 bp, Mus musculus
ggagcaaaagagggaataattctct

SEQ ID NO: 947851 - DNA, 25 bp, Mus musculus
ggagcaaacaatcacgctgccgaat

SEQ ID NO: 947852 - DNA, 25 bp, Mus musculus
ggagcaaacaatcaggctgccgaat

SEQ ID NO: 947853 - DNA, 25 bp, Mus musculus
ggagcaaacgcaagcgagaaaacag

SEQ ID NO: 947854 - DNA, 25 bp, Mus musculus
ggagcaaacggaagcgagaaaacag

SEQ ID NO: 947855 - DNA, 25 bp, Mus musculus
ggagcaaaggagccttggtgctaac

SEQ ID NO: 947856 - DNA, 25 bp, Mus musculus
ggagcaaaggaggcttggtgctaac

SEQ ID NO: 947857 - DNA, 25 bp, Mus musculus
ggagcaaaggctcacgacagaggcg

SEQ ID NO: 947858 - DNA, 25 bp, Mus musculus
ggagcaaaggctcaggacagaggcg

SEQ ID NO: 947859 - DNA, 25 bp, Mus musculus
ggagcaaattaacacagtgtccaag

SEQ ID NO: 947860 - DNA, 25 bp, Mus musculus
ggagcaaattaacagagtgtccaag

SEQ ID NO: 947861 - DNA, 25 bp, Mus musculus
ggagcaaccagacagcaccgtactg

SEQ ID NO: 947862 - DNA, 25 bp, Mus musculus
ggagcaaccagagagcaccgtactg

SEQ ID NO: 947863 - DNA, 25 bp, Mus musculus
ggagcaagctggaacaagagacttt

SEQ ID NO: 947864 - DNA, 25 bp, Mus musculus
ggagcaagctggaacaagctgggag

SEQ ID NO: 947865 - DNA, 25 bp, Mus musculus
ggagcaagctggaacctgaaattaa

SEQ ID NO: 947866 - DNA, 25 bp, Mus musculus
ggagcaagctggaacgggctgcagt

SEQ ID NO: 947867 - DNA, 25 bp, Mus musculus
ggagcaagctggaagaagagacttt

SEQ ID NO: 947868 - DNA, 25 bp, Mus musculus
ggagcaagctggaagaagctgggag

SEQ ID NO: 947869 - DNA, 25 bp, Mus musculus
ggagcaagctggaagctgaaattaa

SEQ ID NO: 947870 - DNA, 25 bp, Mus musculus
ggagcaagctggaaggggctgcagt

SEQ ID NO: 947871 - DNA, 25 bp, Mus musculus
ggagcaatacagctccttccaaaat

SEQ ID NO: 947872 - DNA, 25 bp, Mus musculus
ggagcaatacaggtccttccaaaat

SEQ ID NO: 947873 - DNA, 25 bp, Mus musculus
ggagcacccttgatcaagatttagc

SEQ ID NO: 947874 - DNA, 25 bp, Mus musculus
ggagcacccttgatccagaagattt

SEQ ID NO: 947875 - DNA, 25 bp, Mus musculus
ggagcacccttgatgaagatttagc

SEQ ID NO: 947876 - DNA, 25 bp, Mus musculus
ggagcacccttgatgcagaagattt

SEQ ID NO: 947877 - DNA, 25 bp, Mus musculus
ggagcacctgaattctgatggccac

SEQ ID NO: 947878 - DNA, 25 bp, Mus musculus
ggagcacctgcaccgtgtgggccac

SEQ ID NO: 947879 - DNA, 25 bp, Mus musculus
ggagcacctgcagcgtgtgggccac

SEQ ID NO: 947880 - DNA, 25 bp, Mus musculus
ggagcacctgtattctgatggccac

SEQ ID NO: 947881 - DNA, 25 bp, Mus musculus
ggagcacgtctttgaccatccatgg

SEQ ID NO: 947882 - DNA, 25 bp, Mus musculus
ggagcacgtctttgacttattggtg

SEQ ID NO: 947883 - DNA, 25 bp, Mus musculus
ggagcacgtctttgtccatccatgg

SEQ ID NO: 947884 - DNA, 25 bp, Mus musculus
ggagcacgtctttgtcttattggtg

SEQ ID NO: 947885 - DNA, 25 bp, Mus musculus
ggagcactaccacgaagacatggga

SEQ ID NO: 947886 - DNA, 25 bp, Mus musculus
ggagcactaccaggaagacatggga

SEQ ID NO: 947887 - DNA, 25 bp, Mus musculus
ggagcagaaagcaggaattactttt

SEQ ID NO: 947888 - DNA, 25 bp, Mus musculus
ggagcagaaagctggaattactttt

SEQ ID NO: 947889 - DNA, 25 bp, Mus musculus
ggagcagaagacaaaagaaattgat

SEQ ID NO: 947890 - DNA, 25 bp, Mus musculus
ggagcagaagatccgcctgaagcgc

SEQ ID NO: 947891 - DNA, 25 bp, Mus musculus
ggagcagaagcaccttcgtcatact

SEQ ID NO: 947892 - DNA, 25 bp, Mus musculus
ggagcagaagcagcttcgtcatact

SEQ ID NO: 947893 - DNA, 25 bp, Mus musculus
ggagcagaagcttatgttcttgctg

SEQ ID NO: 947894 - DNA, 25 bp, Mus musculus
ggagcagaaggttatgttcttgctg

SEQ ID NO: 947895 - DNA, 25 bp, Mus musculus
ggagcagaagtcaaaagaaattgat

SEQ ID NO: 947896 - DNA, 25 bp, Mus musculus
ggagcagaagttccgcctgaagcgc

SEQ ID NO: 947897 - DNA, 25 bp, Mus musculus
ggagcagaccagaaggggcaagcgc

SEQ ID NO: 947898 - DNA, 25 bp, Mus musculus
ggagcagaccagctgactggttatc

SEQ ID NO: 947899 - DNA, 25 bp, Mus musculus
ggagcagaccaggtgactggttatc

SEQ ID NO: 947900 - DNA, 25 bp, Mus musculus
ggagcagaccagtaggggcaagcgc

SEQ ID NO: 947901 - DNA, 25 bp, Mus musculus
ggagcagacgcgtcgaggcgagcgc

SEQ ID NO: 947902 - DNA, 25 bp, Mus musculus
ggagcagacgggtcgaggcgagcgc

SEQ ID NO: 947903 - DNA, 25 bp, Mus musculus
ggagcagagcagcttctgctggaca

SEQ ID NO: 947904 - DNA, 25 bp, Mus musculus
ggagcagagcaggttctgctggaca

SEQ ID NO: 947905 - DNA, 25 bp, Mus musculus
ggagcagatcaaagaaattggagat

SEQ ID NO: 947906 - DNA, 25 bp, Mus musculus
ggagcagatcaatgaaattggagat

SEQ ID NO: 947907 - DNA, 25 bp, Mus musculus
ggagcagatgtacttcatcctatct

SEQ ID NO: 947908 - DNA, 25 bp, Mus musculus
ggagcagatgtagttcatcctatct

SEQ ID NO: 947909 - DNA, 25 bp, Mus musculus
ggagcagattagcacacatgaatgc

SEQ ID NO: 947910 - DNA, 25 bp, Mus musculus
ggagcagattagcagacatgaatgc

SEQ ID NO: 947911 - DNA, 25 bp, Mus musculus
ggagcagcccaacgaggctccgccc

SEQ ID NO: 947912 - DNA, 25 bp, Mus musculus
ggagcagcccaaggaggctccgccc

SEQ ID NO: 947913 - DNA, 25 bp, Mus musculus
ggagcagccgctgtatcttcgagat

SEQ ID NO: 947914 - DNA, 25 bp, Mus musculus
ggagcagccggtgtatcttcgagat

SEQ ID NO: 947915 - DNA, 25 bp, Mus musculus
ggagcagctgaaaagcttgaagttg

SEQ ID NO: 947916 - DNA, 25 bp, Mus musculus
ggagcagctgcctgcagagctggca

SEQ ID NO: 947917 - DNA, 25 bp, Mus musculus
ggagcagctggctgcagagctggca

SEQ ID NO: 947918 - DNA, 25 bp, Mus musculus
ggagcagctgtaaagcttgaagttg

SEQ ID NO: 947919 - DNA, 25 bp, Mus musculus
ggagcaggaacacggtcaagtcctc

SEQ ID NO: 947920 - DNA, 25 bp, Mus musculus
ggagcaggaacacggtttaatgtgg

SEQ ID NO: 947921 - DNA, 25 bp, Mus musculus
ggagcaggaacagggtcaagtcctc

SEQ ID NO: 947922 - DNA, 25 bp, Mus musculus
ggagcaggaacagggtttaatgtgg

SEQ ID NO: 947923 - DNA, 25 bp, Mus musculus
ggagcaggacatcctggcctcaaac

SEQ ID NO: 947924 - DNA, 25 bp, Mus musculus
ggagcaggacatctttgcacaccct

SEQ ID NO: 947925 - DNA, 25 bp, Mus musculus
ggagcaggacatgctggcctcaaac

SEQ ID NO: 947926 - DNA, 25 bp, Mus musculus
ggagcaggacatgtttgcacaccct

SEQ ID NO: 947927 - DNA, 25 bp, Mus musculus
ggagcaggctcagacatgggcccag

SEQ ID NO: 947928 - DNA, 25 bp, Mus musculus
ggagcaggctcagagatgggcccag

SEQ ID NO: 947929 - DNA, 25 bp, Mus musculus
ggagcagtcgaaagaggcagacatc

SEQ ID NO: 947930 - DNA, 25 bp, Mus musculus
ggagcagtcgaaagtggcagacatc

SEQ ID NO: 947931 - DNA, 25 bp, Mus musculus
ggagcagtgggacaaagatgatgac

SEQ ID NO: 947932 - DNA, 25 bp, Mus musculus
ggagcagtgggagaaagatgatgac

SEQ ID NO: 947933 - DNA, 25 bp, Mus musculus
ggagcatatgctcatcctgggcata

SEQ ID NO: 947934 - DNA, 25 bp, Mus musculus
ggagcatatgctgatcctgggcata

SEQ ID NO: 947935 - DNA, 25 bp, Mus musculus
ggagcatctctccgtctatgccgtg

SEQ ID NO: 947936 - DNA, 25 bp, Mus musculus
ggagcatctctcggtctatgccgtg

SEQ ID NO: 947937 - DNA, 25 bp, Mus musculus
ggagcatttggtgacgtgcggcttg

SEQ ID NO: 947938 - DNA, 25 bp, Mus musculus
ggagcatttggtgaggtgcggcttg

SEQ ID NO: 947939 - DNA, 25 bp, Mus musculus
ggagcatttgtgcgacacagagata

SEQ ID NO: 947940 - DNA, 25 bp, Mus musculus
ggagcatttgtgggacacagagata

SEQ ID NO: 947941 - DNA, 25 bp, Mus musculus
ggagcattttgacaaagcaattgag

SEQ ID NO: 947942 - DNA, 25 bp, Mus musculus
ggagcattttgacgttttctctgtg

SEQ ID NO: 947943 - DNA, 25 bp, Mus musculus
ggagcattttgagaaagcaattgag

SEQ ID NO: 947944 - DNA, 25 bp, Mus musculus
ggagcattttgaggttttctctgtg

SEQ ID NO: 947945 - DNA, 25 bp, Mus musculus
ggagccaaagatggcaagcttcctc

SEQ ID NO: 947946 - DNA, 25 bp, Mus musculus
ggagccaaagttggcaagcttcctc

SEQ ID NO: 947947 - DNA, 25 bp, Mus musculus
ggagccaacaatcctatgatgggca

SEQ ID NO: 947948 - DNA, 25 bp, Mus musculus
ggagccaacattcctatgatgggca

SEQ ID NO: 947949 - DNA, 25 bp, Mus musculus
ggagccaatcagctgtccggtacct

SEQ ID NO: 947950 - DNA, 25 bp, Mus musculus
ggagccaatcaggtgtccggtacct

SEQ ID NO: 947951 - DNA, 25 bp, Mus musculus
ggagccacacatccatatcacaact

SEQ ID NO: 947952 - DNA, 25 bp, Mus musculus
ggagccacacatgcatatcacaact

SEQ ID NO: 947953 - DNA, 25 bp, Mus musculus
ggagccactgaccgaccagagtgag

SEQ ID NO: 947954 - DNA, 25 bp, Mus musculus
ggagccactgacggaccagagtgag

SEQ ID NO: 947955 - DNA, 25 bp, Mus musculus
ggagccagcaagaccaacaagcttc

SEQ ID NO: 947956 - DNA, 25 bp, Mus musculus
ggagccagcaagtccaacaagcttc

SEQ ID NO: 947957 - DNA, 25 bp, Mus musculus
ggagccagcttgctctgacagaagt

SEQ ID NO: 947958 - DNA, 25 bp, Mus musculus
ggagccagcttggtctgacagaagt

SEQ ID NO: 947959 - DNA, 25 bp, Mus musculus
ggagccaggcgtggcgccgcagcct

SEQ ID NO: 947960 - DNA, 25 bp, Mus musculus
ggagccaggcgtggggccgcagcct

SEQ ID NO: 947961 - DNA, 25 bp, Mus musculus
ggagcccaaaaacatggcacttcca

SEQ ID NO: 947962 - DNA, 25 bp, Mus musculus
ggagcccaaaaagatggcacttcca

SEQ ID NO: 947963 - DNA, 25 bp, Mus musculus
ggagcccaagattcagccatggctg

SEQ ID NO: 947964 - DNA, 25 bp, Mus musculus
ggagcccaagccacaggtagaggag

SEQ ID NO: 947965 - DNA, 25 bp, Mus musculus
ggagcccaaggcacaggtagaggag

SEQ ID NO: 947966 - DNA, 25 bp, Mus musculus
ggagcccaagtttcagccatggctg

SEQ ID NO: 947967 - DNA, 25 bp, Mus musculus
ggagcccacacacgttcactatctg

SEQ ID NO: 947968 - DNA, 25 bp, Mus musculus
ggagcccacacaggttcactatctg

SEQ ID NO: 947969 - DNA, 25 bp, Mus musculus
ggagcccagaaccacgccaagaaag

SEQ ID NO: 947970 - DNA, 25 bp, Mus musculus
ggagcccagaaccaggccaagaaag

SEQ ID NO: 947971 - DNA, 25 bp, Mus musculus
ggagcccagaagatgtttggaatga

SEQ ID NO: 947972 - DNA, 25 bp, Mus musculus
ggagcccagaagttgtttggaatga

SEQ ID NO: 947973 - DNA, 25 bp, Mus musculus
ggagcccagcgcgtcgcatgaagca

SEQ ID NO: 947974 - DNA, 25 bp, Mus musculus
ggagcccagcgcgtcggacgaattc

SEQ ID NO: 947975 - DNA, 25 bp, Mus musculus
ggagcccagcgcgtggcatgaagca

SEQ ID NO: 947976 - DNA, 25 bp, Mus musculus
ggagcccagcgcgtgggacgaattc

SEQ ID NO: 947977 - DNA, 25 bp, Mus musculus
ggagccccagcgtacccagccagcc

SEQ ID NO: 947978 - DNA, 25 bp, Mus musculus
ggagccccagggtacccagccagcc

SEQ ID NO: 947979 - DNA, 25 bp, Mus musculus
ggagcccgtcagaaccgttggtgag

SEQ ID NO: 947980 - DNA, 25 bp, Mus musculus
ggagcccgtcagaagcgttggtgag

SEQ ID NO: 947981 - DNA, 25 bp, Mus musculus
ggagccctctaccacgttccaccac

SEQ ID NO: 947982 - DNA, 25 bp, Mus musculus
ggagccctctaccaggttccaccac

SEQ ID NO: 947983 - DNA, 25 bp, Mus musculus
ggagccctggagcagtctcagctag

SEQ ID NO: 947984 - DNA, 25 bp, Mus musculus
ggagccctggagcattaccaggcaa

SEQ ID NO: 947985 - DNA, 25 bp, Mus musculus
ggagccctggaggagtctcagctag

SEQ ID NO: 947986 - DNA, 25 bp, Mus musculus
ggagccctggaggattaccaggcaa

SEQ ID NO: 947987 - DNA, 25 bp, Mus musculus
ggagcccttgacgcctccttggcat

SEQ ID NO: 947988 - DNA, 25 bp, Mus musculus
ggagcccttgtcgcctccttggcat

SEQ ID NO: 947989 - DNA, 25 bp, Mus musculus
ggagccgaagctcaatgacaatgtc

SEQ ID NO: 947990 - DNA, 25 bp, Mus musculus
ggagccgaagctcattgacaatgtc

SEQ ID NO: 947991 - DNA, 25 bp, Mus musculus
ggagccgagtccagttcctccatca

SEQ ID NO: 947992 - DNA, 25 bp, Mus musculus
ggagccgagtgcagttcctccatca

SEQ ID NO: 947993 - DNA, 25 bp, Mus musculus
ggagccgcagagctgctttgtctgg

SEQ ID NO: 947994 - DNA, 25 bp, Mus musculus
ggagccgcagaggtgctttgtctgg

SEQ ID NO: 947995 - DNA, 25 bp, Mus musculus
ggagccgcagcagttgccccagaat

SEQ ID NO: 947996 - DNA, 25 bp, Mus musculus
ggagccgcaggagttgccccagaat

SEQ ID NO: 947997 - DNA, 25 bp, Mus musculus
ggagccgcgcgtctctccacagagg

SEQ ID NO: 947998 - DNA, 25 bp, Mus musculus
ggagccgcgcgtgtctccacagagg

SEQ ID NO: 947999 - DNA, 25 bp, Mus musculus
ggagccgctgtgagcacattgatga

SEQ ID NO: 948000 - DNA, 25 bp, Mus musculus
ggagccgctgtgaggacattgatga

SEQ ID NO: 948001 - DNA, 25 bp, Mus musculus
ggagcctatgaacgaaccacatgaa

SEQ ID NO: 948002 - DNA, 25 bp, Mus musculus
ggagcctatgaaggaaccacatgaa

SEQ ID NO: 948003 - DNA, 25 bp, Mus musculus
ggagcctcccaggaagagagggaga

SEQ ID NO: 948004 - DNA, 25 bp, Mus musculus
ggagcctcccaggatgagagggaga

SEQ ID NO: 948005 - DNA, 25 bp, Mus musculus
ggagcctctacactaatgatgggct

SEQ ID NO: 948006 - DNA, 25 bp, Mus musculus
ggagcctctacagtaatgatgggct

SEQ ID NO: 948007 - DNA, 25 bp, Mus musculus
ggagcctgaaaaatacattgcccta

SEQ ID NO: 948008 - DNA, 25 bp, Mus musculus
ggagcctgaaaattacattgcccta

SEQ ID NO: 948009 - DNA, 25 bp, Mus musculus
ggagcctgggatcgcgaggcacaca

SEQ ID NO: 948010 - DNA, 25 bp, Mus musculus
ggagcctgggatcgggaggcacaca

SEQ ID NO: 948011 - DNA, 25 bp, Mus musculus
ggagccttataccccgagagagaag

SEQ ID NO: 948012 - DNA, 25 bp, Mus musculus
ggagccttatacccggagagagaag

SEQ ID NO: 948013 - DNA, 25 bp, Mus musculus
ggagccttctggcacggtccctgca

SEQ ID NO: 948014 - DNA, 25 bp, Mus musculus
ggagccttctggcagggtccctgca

SEQ ID NO: 948015 - DNA, 25 bp, Mus musculus
ggagccttggatgaagttgtgctca

SEQ ID NO: 948016 - DNA, 25 bp, Mus musculus
ggagccttggttgaagttgtgctca

SEQ ID NO: 948017 - DNA, 25 bp, Mus musculus
ggagcctttggagacatagaaaata

SEQ ID NO: 948018 - DNA, 25 bp, Mus musculus
ggagcctttggagagatagaaaata

SEQ ID NO: 948019 - DNA, 25 bp, Mus musculus
ggagcctttgggaacgcgacagact

SEQ ID NO: 948020 - DNA, 25 bp, Mus musculus
ggagcctttgggaaggcgacagact

SEQ ID NO: 948021 - DNA, 25 bp, Mus musculus
ggagcgaaagagacaccagcagtct

SEQ ID NO: 948022 - DNA, 25 bp, Mus musculus
ggagcgaaagtgacaccagcagtct

SEQ ID NO: 948023 - DNA, 25 bp, Mus musculus
ggagcgacaccacgagcatcacgat

SEQ ID NO: 948024 - DNA, 25 bp, Mus musculus
ggagcgacaccaggagcatcacgat

SEQ ID NO: 948025 - DNA, 25 bp, Mus musculus
ggagcgacatgacgtagccaagttt

SEQ ID NO: 948026 - DNA, 25 bp, Mus musculus
ggagcgacatgaggtagccaagttt

SEQ ID NO: 948027 - DNA, 25 bp, Mus musculus
ggagcgaccagcacattcagctgca

SEQ ID NO: 948028 - DNA, 25 bp, Mus musculus
ggagcgaccagcactttcagctgca

SEQ ID NO: 948029 - DNA, 25 bp, Mus musculus
ggagcgagcccaccaggaagatgca

SEQ ID NO: 948030 - DNA, 25 bp, Mus musculus
ggagcgagcccacgcaagaagacag

SEQ ID NO: 948031 - DNA, 25 bp, Mus musculus
ggagcgagcccagcaggaagatgca

SEQ ID NO: 948032 - DNA, 25 bp, Mus musculus
ggagcgagcccaggcaagaagacag

SEQ ID NO: 948033 - DNA, 25 bp, Mus musculus
ggagcgaggaagccacctgatgcag

SEQ ID NO: 948034 - DNA, 25 bp, Mus musculus
ggagcgaggaagcgatcgcttacac

SEQ ID NO: 948035 - DNA, 25 bp, Mus musculus
ggagcgaggaaggcacctgatgcag

SEQ ID NO: 948036 - DNA, 25 bp, Mus musculus
ggagcgaggaagggatcgcttacac

SEQ ID NO: 948037 - DNA, 25 bp, Mus musculus
ggagcgcagaagcctgagaccgctg

SEQ ID NO: 948038 - DNA, 25 bp, Mus musculus
ggagcgcagaaggctgagaccgctg

SEQ ID NO: 948039 - DNA, 25 bp, Mus musculus
ggagcgcatacactgcaagacctat

SEQ ID NO: 948040 - DNA, 25 bp, Mus musculus
ggagcgcatacagtgcaagacctat

SEQ ID NO: 948041 - DNA, 25 bp, Mus musculus
ggagcgcccagtctcatacactttt

SEQ ID NO: 948042 - DNA, 25 bp, Mus musculus
ggagcgcccagtctgatacactttt

SEQ ID NO: 948043 - DNA, 25 bp, Mus musculus
ggagcgcccgagcccctgggacggg

SEQ ID NO: 948044 - DNA, 25 bp, Mus musculus
ggagcgcccgaggccctgggacggg

SEQ ID NO: 948045 - DNA, 25 bp, Mus musculus
ggagcgctgcctcacagcccaccgc

SEQ ID NO: 948046 - DNA, 25 bp, Mus musculus
ggagcgctgcctcagagcccaccgc

SEQ ID NO: 948047 - DNA, 25 bp, Mus musculus
ggagcggagagccacatgtccttcc

SEQ ID NO: 948048 - DNA, 25 bp, Mus musculus
ggagcggagagcgacatgtccttcc

SEQ ID NO: 948049 - DNA, 25 bp, Mus musculus
ggagcggcaaaacagctttatggat

SEQ ID NO: 948050 - DNA, 25 bp, Mus musculus
ggagcggcaaaacagtgatagaagg

SEQ ID NO: 948051 - DNA, 25 bp, Mus musculus
ggagcggcaaaagagctttatggat

SEQ ID NO: 948052 - DNA, 25 bp, Mus musculus
ggagcggcaaaagagtgatagaagg

SEQ ID NO: 948053 - DNA, 25 bp, Mus musculus
ggagcggcagactcagagagaagct

SEQ ID NO: 948054 - DNA, 25 bp, Mus musculus
ggagcggcagtctcagagagaagct

SEQ ID NO: 948055 - DNA, 25 bp, Mus musculus
ggagcggcggtgagatccattgtag

SEQ ID NO: 948056 - DNA, 25 bp, Mus musculus
ggagcggcggtgctgtgccaagtgt

SEQ ID NO: 948057 - DNA, 25 bp, Mus musculus
ggagcggcggtggtgtgccaagtgt

SEQ ID NO: 948058 - DNA, 25 bp, Mus musculus
ggagcggcggtgtgatccattgtag

SEQ ID NO: 948059 - DNA, 25 bp, Mus musculus
ggagcggctcagcttccagctacgg

SEQ ID NO: 948060 - DNA, 25 bp, Mus musculus
ggagcggctcaggttccagctacgg

SEQ ID NO: 948061 - DNA, 25 bp, Mus musculus
ggagcgggagaactatgacaacatg

SEQ ID NO: 948062 - DNA, 25 bp, Mus musculus
ggagcgggagaagtatgacaacatg

SEQ ID NO: 948063 - DNA, 25 bp, Mus musculus
ggagcggggccgcggtctgcgtgct

SEQ ID NO: 948064 - DNA, 25 bp, Mus musculus
ggagcggggccggggtctgcgtgct

SEQ ID NO: 948065 - DNA, 25 bp, Mus musculus
ggagcggttcagctctgtgacgaga

SEQ ID NO: 948066 - DNA, 25 bp, Mus musculus
ggagcggttcaggtctgtgacgaga

SEQ ID NO: 948067 - DNA, 25 bp, Mus musculus
ggagcgtctgctgctacaagtgtga

SEQ ID NO: 948068 - DNA, 25 bp, Mus musculus
ggagcgtctggtgctacaagtgtga

SEQ ID NO: 948069 - DNA, 25 bp, Mus musculus
ggagcgtgctctccaggaacacaat

SEQ ID NO: 948070 - DNA, 25 bp, Mus musculus
ggagcgtgctgtccaggaacacaat

SEQ ID NO: 948071 - DNA, 25 bp, Mus musculus
ggagcgtggagaccatcttcaacaa

SEQ ID NO: 948072 - DNA, 25 bp, Mus musculus
ggagcgtggagagcatcttcaacaa

SEQ ID NO: 948073 - DNA, 25 bp, Mus musculus
ggagcgtgtgcagacgttctcacac

SEQ ID NO: 948074 - DNA, 25 bp, Mus musculus
ggagcgtgtgcagaggttctcacac

SEQ ID NO: 948075 - DNA, 25 bp, Mus musculus
ggagctacacggcttggagctggag

SEQ ID NO: 948076 - DNA, 25 bp, Mus musculus
ggagctacacgggttggagctggag

SEQ ID NO: 948077 - DNA, 25 bp, Mus musculus
ggagctacactgcctatagggcagc

SEQ ID NO: 948078 - DNA, 25 bp, Mus musculus
ggagctacactggctatagggcagc

SEQ ID NO: 948079 - DNA, 25 bp, Mus musculus
ggagctaccccacgtcccgatccct

SEQ ID NO: 948080 - DNA, 25 bp, Mus musculus
ggagctaccccaggtcccgatccct

SEQ ID NO: 948081 - DNA, 25 bp, Mus musculus
ggagctactacacgaactgaaccgc

SEQ ID NO: 948082 - DNA, 25 bp, Mus musculus
ggagctactacaggaactgaaccgc

SEQ ID NO: 948083 - DNA, 25 bp, Mus musculus
ggagctagaagccgaatacttggcc

SEQ ID NO: 948084 - DNA, 25 bp, Mus musculus
ggagctagaagcggaatacttggcc

SEQ ID NO: 948085 - DNA, 25 bp, Mus musculus
ggagctatggaacactctgtcccag

SEQ ID NO: 948086 - DNA, 25 bp, Mus musculus
ggagctatggaacagtctgtcccag

SEQ ID NO: 948087 - DNA, 25 bp, Mus musculus
ggagctattcagcggatgatggcgt

SEQ ID NO: 948088 - DNA, 25 bp, Mus musculus
ggagctattcaggggatgatggcgt

SEQ ID NO: 948089 - DNA, 25 bp, Mus musculus
ggagctatttaacctggccaccact

SEQ ID NO: 948090 - DNA, 25 bp, Mus musculus
ggagctatttaagctggccaccact

SEQ ID NO: 948091 - DNA, 25 bp, Mus musculus
ggagctcatccacgccaaagggggc

SEQ ID NO: 948092 - DNA, 25 bp, Mus musculus
ggagctcatccaggccaaagggggc

SEQ ID NO: 948093 - DNA, 25 bp, Mus musculus
ggagctccatggcgaagtcatcagg

SEQ ID NO: 948094 - DNA, 25 bp, Mus musculus
ggagctccatggggaagtcatcagg

SEQ ID NO: 948095 - DNA, 25 bp, Mus musculus
ggagctcggcagccatttcagggaa

SEQ ID NO: 948096 - DNA, 25 bp, Mus musculus
ggagctcggcaggcatttcagggaa

SEQ ID NO: 948097 - DNA, 25 bp, Mus musculus
ggagctctctgacacgtgtccccag

SEQ ID NO: 948098 - DNA, 25 bp, Mus musculus
ggagctctctgacaggtgtccccag

SEQ ID NO: 948099 - DNA, 25 bp, Mus musculus
ggagctctggatgctgaatgctccc

SEQ ID NO: 948100 - DNA, 25 bp, Mus musculus
ggagctctggttgctgaatgctccc

SEQ ID NO: 948101 - DNA, 25 bp, Mus musculus
ggagctgaaagacgtgacagtgaaa

SEQ ID NO: 948102 - DNA, 25 bp, Mus musculus
ggagctgaaagaggtgacagtgaaa

SEQ ID NO: 948103 - DNA, 25 bp, Mus musculus
ggagctgaagccggagcaggaaacc

SEQ ID NO: 948104 - DNA, 25 bp, Mus musculus
ggagctgaagctcacatgtcaaaca

SEQ ID NO: 948105 - DNA, 25 bp, Mus musculus
ggagctgaaggcggagcaggaaacc

SEQ ID NO: 948106 - DNA, 25 bp, Mus musculus
ggagctgaaggctcccaacaccaag

SEQ ID NO: 948107 - DNA, 25 bp, Mus musculus
ggagctgaaggctcgcaacaccaag

SEQ ID NO: 948108 - DNA, 25 bp, Mus musculus
ggagctgaaggtcacatgtcaaaca

SEQ ID NO: 948109 - DNA, 25 bp, Mus musculus
ggagctgacagaccttttcttcatg

SEQ ID NO: 948110 - DNA, 25 bp, Mus musculus
ggagctgacagagcttttcttcatg

SEQ ID NO: 948111 - DNA, 25 bp, Mus musculus
ggagctgaccatctgacaaaacccc

SEQ ID NO: 948112 - DNA, 25 bp, Mus musculus
ggagctgaccatgtgacaaaacccc

SEQ ID NO: 948113 - DNA, 25 bp, Mus musculus
ggagctgcacaactcacgggtcaca

SEQ ID NO: 948114 - DNA, 25 bp, Mus musculus
ggagctgcacaagtcacgggtcaca

SEQ ID NO: 948115 - DNA, 25 bp, Mus musculus
ggagctgcacttgaccaagcatcaa

SEQ ID NO: 948116 - DNA, 25 bp, Mus musculus
ggagctgcacttgagcaagcatcaa

SEQ ID NO: 948117 - DNA, 25 bp, Mus musculus
ggagctgcagagccattgactactg

SEQ ID NO: 948118 - DNA, 25 bp, Mus musculus
ggagctgcagaggcattgactactg

SEQ ID NO: 948119 - DNA, 25 bp, Mus musculus
ggagctgcagcacgacctgcgaggc

SEQ ID NO: 948120 - DNA, 25 bp, Mus musculus
ggagctgcagcaggacctgcgaggc

SEQ ID NO: 948121 - DNA, 25 bp, Mus musculus
ggagctgcagcgatacaaactgcag

SEQ ID NO: 948122 - DNA, 25 bp, Mus musculus
ggagctgcaggccccgtcccgagat

SEQ ID NO: 948123 - DNA, 25 bp, Mus musculus
ggagctgcaggcccggtcccgagat

SEQ ID NO: 948124 - DNA, 25 bp, Mus musculus
ggagctgcagggatacaaactgcag

SEQ ID NO: 948125 - DNA, 25 bp, Mus musculus
ggagctgccaaacccaagctgaccc

SEQ ID NO: 948126 - DNA, 25 bp, Mus musculus
ggagctgccaaagccaagctgaccc

SEQ ID NO: 948127 - DNA, 25 bp, Mus musculus
ggagctgcctcacacaagtcgacac

SEQ ID NO: 948128 - DNA, 25 bp, Mus musculus
ggagctgcctcacagaagtcgacac

SEQ ID NO: 948129 - DNA, 25 bp, Mus musculus
ggagctgctccgcaatctctatgag

SEQ ID NO: 948130 - DNA, 25 bp, Mus musculus
ggagctgctccggaatctctatgag

SEQ ID NO: 948131 - DNA, 25 bp, Mus musculus
ggagctgctgaacaggcaagtggaa

SEQ ID NO: 948132 - DNA, 25 bp, Mus musculus
ggagctgctgaagaggcaagtggaa

SEQ ID NO: 948133 - DNA, 25 bp, Mus musculus
ggagctgcttaactaccaccctcgg

SEQ ID NO: 948134 - DNA, 25 bp, Mus musculus
ggagctgcttaagtaccaccctcgg

SEQ ID NO: 948135 - DNA, 25 bp, Mus musculus
ggagctgctttccccgctagccact

SEQ ID NO: 948136 - DNA, 25 bp, Mus musculus
ggagctgctttcccggctagccact

SEQ ID NO: 948137 - DNA, 25 bp, Mus musculus
ggagctggagagaaaaatatcagga

SEQ ID NO: 948138 - DNA, 25 bp, Mus musculus
ggagctggagagcaaagccatagag

SEQ ID NO: 948139 - DNA, 25 bp, Mus musculus
ggagctggagagcctgccttgggga

SEQ ID NO: 948140 - DNA, 25 bp, Mus musculus
ggagctggagaggaaagccatagag

SEQ ID NO: 948141 - DNA, 25 bp, Mus musculus
ggagctggagaggctgccttgggga

SEQ ID NO: 948142 - DNA, 25 bp, Mus musculus
ggagctggagagtaaaatatcagga

SEQ ID NO: 948143 - DNA, 25 bp, Mus musculus
ggagctggccagcactgccgcttcg

SEQ ID NO: 948144 - DNA, 25 bp, Mus musculus
ggagctggccaggactgccgcttcg

SEQ ID NO: 948145 - DNA, 25 bp, Mus musculus
ggagctgtataacgtacatttgaag

SEQ ID NO: 948146 - DNA, 25 bp, Mus musculus
ggagctgtataaggtacatttgaag

SEQ ID NO: 948147 - DNA, 25 bp, Mus musculus
ggagctgtatgacgaagtaaagctc

SEQ ID NO: 948148 - DNA, 25 bp, Mus musculus
ggagctgtatgaggaagtaaagctc

SEQ ID NO: 948149 - DNA, 25 bp, Mus musculus
ggagctgtgtagatgtcaatgagtg

SEQ ID NO: 948150 - DNA, 25 bp, Mus musculus
ggagctgtgtagttgtcaatgagtg

SEQ ID NO: 948151 - DNA, 25 bp, Mus musculus
ggagctgttcagagtaggtggcgat

SEQ ID NO: 948152 - DNA, 25 bp, Mus musculus
ggagctgttcagagttgaagaggac

SEQ ID NO: 948153 - DNA, 25 bp, Mus musculus
ggagctgttcagtgtaggtggcgat

SEQ ID NO: 948154 - DNA, 25 bp, Mus musculus
ggagctgttcagtgttgaagaggac

SEQ ID NO: 948155 - DNA, 25 bp, Mus musculus
ggagctgttctgtaagcttcctgcg

SEQ ID NO: 948156 - DNA, 25 bp, Mus musculus
ggagctgttctgtatgcttcctgcg

SEQ ID NO: 948157 - DNA, 25 bp, Mus musculus
ggagcttacagacgcgctgactcct

SEQ ID NO: 948158 - DNA, 25 bp, Mus musculus
ggagcttacagacgcgctttgctgt

SEQ ID NO: 948159 - DNA, 25 bp, Mus musculus
ggagcttacagacgggctgactcct

SEQ ID NO: 948160 - DNA, 25 bp, Mus musculus
ggagcttacagacgggctttgctgt

SEQ ID NO: 948161 - DNA, 25 bp, Mus musculus
ggagcttcctttgacgaggattctg

SEQ ID NO: 948162 - DNA, 25 bp, Mus musculus
ggagcttcctttgaggaggattctg

SEQ ID NO: 948163 - DNA, 25 bp, Mus musculus
ggagcttcggcagcctgcattcacc

SEQ ID NO: 948164 - DNA, 25 bp, Mus musculus
ggagcttcggcagcgtgcattcacc

SEQ ID NO: 948165 - DNA, 25 bp, Mus musculus
ggagcttggcagaggccaatttgcc

SEQ ID NO: 948166 - DNA, 25 bp, Mus musculus
ggagcttggcagtggccaatttgcc

SEQ ID NO: 948167 - DNA, 25 bp, Mus musculus
ggagcttgtcagcacaggggaccaa

SEQ ID NO: 948168 - DNA, 25 bp, Mus musculus
ggagcttgtcaggacaggggaccaa

SEQ ID NO: 948169 - DNA, 25 bp, Mus musculus
ggagctttgaagatgggaaacctgt

SEQ ID NO: 948170 - DNA, 25 bp, Mus musculus
ggagctttgaagttgggaaacctgt

SEQ ID NO: 948171 - DNA, 25 bp, Mus musculus
ggagctttgccacgaatctggtctg

SEQ ID NO: 948172 - DNA, 25 bp, Mus musculus
ggagctttgccaggaatctggtctg

SEQ ID NO: 948173 - DNA, 25 bp, Mus musculus
ggagctttgtttattgccatctctg

SEQ ID NO: 948174 - DNA, 25 bp, Mus musculus
ggagctttgttttttgccatctctg

SEQ ID NO: 948175 - DNA, 25 bp, Mus musculus
ggagcttttagaccacaacgaagca

SEQ ID NO: 948176 - DNA, 25 bp, Mus musculus
ggagcttttagagcacaacgaagca

SEQ ID NO: 948177 - DNA, 25 bp, Mus musculus
ggagcttttgcacgtggctttgcag

SEQ ID NO: 948178 - DNA, 25 bp, Mus musculus
ggagcttttgcaggtggctttgcag

SEQ ID NO: 948179 - DNA, 25 bp, Mus musculus
ggaggaaaaagctccccacccccat

SEQ ID NO: 948180 - DNA, 25 bp, Mus musculus
ggaggaaaaagctcgccacccccat

SEQ ID NO: 948181 - DNA, 25 bp, Mus musculus
ggaggaaatggacgcaagaagacag

SEQ ID NO: 948182 - DNA, 25 bp, Mus musculus
ggaggaaatggaggcaagaagacag

SEQ ID NO: 948183 - DNA, 25 bp, Mus musculus
ggaggaacaggccgacatgctagat

SEQ ID NO: 948184 - DNA, 25 bp, Mus musculus
ggaggaacaggccgtcatgctagat

SEQ ID NO: 948185 - DNA, 25 bp, Mus musculus
ggaggaagacaacgacctgtatatc

SEQ ID NO: 948186 - DNA, 25 bp, Mus musculus
ggaggaagacaaggacctgtatatc

SEQ ID NO: 948187 - DNA, 25 bp, Mus musculus
ggaggaagccaacccctggggcttg

SEQ ID NO: 948188 - DNA, 25 bp, Mus musculus
ggaggaagccaagccctggggcttg

SEQ ID NO: 948189 - DNA, 25 bp, Mus musculus
ggaggaatttatgccattagttgga

SEQ ID NO: 948190 - DNA, 25 bp, Mus musculus
ggaggaatttatgcgattagttgga

SEQ ID NO: 948191 - DNA, 25 bp, Mus musculus
ggaggacaggaacagactcgcaaag

SEQ ID NO: 948192 - DNA, 25 bp, Mus musculus
ggaggacaggaagagactcgcaaag

SEQ ID NO: 948193 - DNA, 25 bp, Mus musculus
ggaggacaggcagtcgtccagagtc

SEQ ID NO: 948194 - DNA, 25 bp, Mus musculus
ggaggacaggcagtggtccagagtc

SEQ ID NO: 948195 - DNA, 25 bp, Mus musculus
ggaggaccactccccatgcaactcc

SEQ ID NO: 948196 - DNA, 25 bp, Mus musculus
ggaggaccactccccgaagatgcaa

SEQ ID NO: 948197 - DNA, 25 bp, Mus musculus
ggaggaccactcccgatgcaactcc

SEQ ID NO: 948198 - DNA, 25 bp, Mus musculus
ggaggaccactcccggaagatgcaa

SEQ ID NO: 948199 - DNA, 25 bp, Mus musculus
ggaggaccagcagggcactccttgc

SEQ ID NO: 948200 - DNA, 25 bp, Mus musculus
ggaggaccagcatttaagaagacca

SEQ ID NO: 948201 - DNA, 25 bp, Mus musculus
ggaggaccaggagggcactccttgc

SEQ ID NO: 948202 - DNA, 25 bp, Mus musculus
ggaggaccaggatttaagaagacca

SEQ ID NO: 948203 - DNA, 25 bp, Mus musculus
ggaggacctgtgtgcatattgatga

SEQ ID NO: 948204 - DNA, 25 bp, Mus musculus
ggaggacctgtgtggatattgatga

SEQ ID NO: 948205 - DNA, 25 bp, Mus musculus
ggaggacgagctgctgctggtgagt

SEQ ID NO: 948206 - DNA, 25 bp, Mus musculus
ggaggacgaggtgctgctggtgagt

SEQ ID NO: 948207 - DNA, 25 bp, Mus musculus
ggaggacgctgccgcccatcgtcgt

SEQ ID NO: 948208 - DNA, 25 bp, Mus musculus
ggaggacgctgccgcgtctcttcca

SEQ ID NO: 948209 - DNA, 25 bp, Mus musculus
ggaggacgctgccggccatcgtcgt

SEQ ID NO: 948210 - DNA, 25 bp, Mus musculus
ggaggacgctgccgggtctcttcca

SEQ ID NO: 948211 - DNA, 25 bp, Mus musculus
ggaggagaagcgaacgcaaggacac

SEQ ID NO: 948212 - DNA, 25 bp, Mus musculus
ggaggagaagctcctgttgagtcag

SEQ ID NO: 948213 - DNA, 25 bp, Mus musculus
ggaggagaaggccacgggccgcttt

SEQ ID NO: 948214 - DNA, 25 bp, Mus musculus
ggaggagaaggccaggggccgcttt

SEQ ID NO: 948215 - DNA, 25 bp, Mus musculus
ggaggagaagggaacgcaaggacac

SEQ ID NO: 948216 - DNA, 25 bp, Mus musculus
ggaggagaaggtcctgttgagtcag

SEQ ID NO: 948217 - DNA, 25 bp, Mus musculus
ggaggagaatataaaagaagatgga

SEQ ID NO: 948218 - DNA, 25 bp, Mus musculus
ggaggagaatttaaaagaagatgga

SEQ ID NO: 948219 - DNA, 25 bp, Mus musculus
ggaggagacaggcgtacctgtgggt

SEQ ID NO: 948220 - DNA, 25 bp, Mus musculus
ggaggagacaggggtacctgtgggt

SEQ ID NO: 948221 - DNA, 25 bp, Mus musculus
ggaggagcaaaccgaagcgagaaaa

SEQ ID NO: 948222 - DNA, 25 bp, Mus musculus
ggaggagcaaacggaagcgagaaaa

SEQ ID NO: 948223 - DNA, 25 bp, Mus musculus
ggaggagcagaaaagcaaaagaaaa

SEQ ID NO: 948224 - DNA, 25 bp, Mus musculus
ggaggagcagatattcagtgaactg

SEQ ID NO: 948225 - DNA, 25 bp, Mus musculus
ggaggagcagcattttggcagtgtg

SEQ ID NO: 948226 - DNA, 25 bp, Mus musculus
ggaggagcagcccgtgtatcttcga

SEQ ID NO: 948227 - DNA, 25 bp, Mus musculus
ggaggagcagccggtgtatcttcga

SEQ ID NO: 948228 - DNA, 25 bp, Mus musculus
ggaggagcagctgtccatcaatggc

SEQ ID NO: 948229 - DNA, 25 bp, Mus musculus
ggaggagcaggattttggcagtgtg

SEQ ID NO: 948230 - DNA, 25 bp, Mus musculus
ggaggagcaggtgtccatcaatggc

SEQ ID NO: 948231 - DNA, 25 bp, Mus musculus
ggaggagcagtaaagcaaaagaaaa

SEQ ID NO: 948232 - DNA, 25 bp, Mus musculus
ggaggagcagttattcagtgaactg

SEQ ID NO: 948233 - DNA, 25 bp, Mus musculus
ggaggagccaggcgccaagccacag

SEQ ID NO: 948234 - DNA, 25 bp, Mus musculus
ggaggagccaggggccaagccacag

SEQ ID NO: 948235 - DNA, 25 bp, Mus musculus
ggaggagctcagacatgccctggac

SEQ ID NO: 948236 - DNA, 25 bp, Mus musculus
ggaggagctcagtcatgccctggac

SEQ ID NO: 948237 - DNA, 25 bp, Mus musculus
ggaggagctgaacctcacatgtcaa

SEQ ID NO: 948238 - DNA, 25 bp, Mus musculus
ggaggagctgaagctcacatgtcaa

SEQ ID NO: 948239 - DNA, 25 bp, Mus musculus
ggaggaggaaaacgcatgaggatcg

SEQ ID NO: 948240 - DNA, 25 bp, Mus musculus
ggaggaggaaaaggcatgaggatcg

SEQ ID NO: 948241 - DNA, 25 bp, Mus musculus
ggaggaggagagtggcaacatggcc

SEQ ID NO: 948242 - DNA, 25 bp, Mus musculus
ggaggaggagccagtgaagaagcga

SEQ ID NO: 948243 - DNA, 25 bp, Mus musculus
ggaggaggaggcagtgaagaagcga

SEQ ID NO: 948244 - DNA, 25 bp, Mus musculus
ggaggaggagtgtggcaacatggcc

SEQ ID NO: 948245 - DNA, 25 bp, Mus musculus
ggaggaggcaagcagtgtcgggaac

SEQ ID NO: 948246 - DNA, 25 bp, Mus musculus
ggaggaggcaaggagtgtcgggaac

SEQ ID NO: 948247 - DNA, 25 bp, Mus musculus
ggaggaggccacagaaagctcctga

SEQ ID NO: 948248 - DNA, 25 bp, Mus musculus
ggaggaggccacagtaagctcctga

SEQ ID NO: 948249 - DNA, 25 bp, Mus musculus
ggaggaggcccacgcccttctcagt

SEQ ID NO: 948250 - DNA, 25 bp, Mus musculus
ggaggaggcccaggcccttctcagt

SEQ ID NO: 948251 - DNA, 25 bp, Mus musculus
ggaggagggcagcaatcccagccat

SEQ ID NO: 948252 - DNA, 25 bp, Mus musculus
ggaggagggcagcagaaccagacat

SEQ ID NO: 948253 - DNA, 25 bp, Mus musculus
ggaggagggcaggaatcccagccat

SEQ ID NO: 948254 - DNA, 25 bp, Mus musculus
ggaggagggcaggagaaccagacat

SEQ ID NO: 948255 - DNA, 25 bp, Mus musculus
ggaggagtgtaacacggcagaatgt

SEQ ID NO: 948256 - DNA, 25 bp, Mus musculus
ggaggagtgtaacagggcagaatgt

SEQ ID NO: 948257 - DNA, 25 bp, Mus musculus
ggaggagttgagataaaagaagatg

SEQ ID NO: 948258 - DNA, 25 bp, Mus musculus
ggaggagttgagttaaaagaagatg

SEQ ID NO: 948259 - DNA, 25 bp, Mus musculus
ggaggatacgacctctgccagagga

SEQ ID NO: 948260 - DNA, 25 bp, Mus musculus
ggaggatacgtcctctgccagagga

SEQ ID NO: 948261 - DNA, 25 bp, Mus musculus
ggaggatagaaccatcaggctgcag

SEQ ID NO: 948262 - DNA, 25 bp, Mus musculus
ggaggatagaaccgtgcgattgcaa

SEQ ID NO: 948263 - DNA, 25 bp, Mus musculus
ggaggatagaacgatcaggctgcag

SEQ ID NO: 948264 - DNA, 25 bp, Mus musculus
ggaggatagaacggtgcgattgcaa

SEQ ID NO: 948265 - DNA, 25 bp, Mus musculus
ggaggatcaagacgaaactgcagca

SEQ ID NO: 948266 - DNA, 25 bp, Mus musculus
ggaggatcaagacttgaaagcgctg

SEQ ID NO: 948267 - DNA, 25 bp, Mus musculus
ggaggatcaagaggaaactgcagca

SEQ ID NO: 948268 - DNA, 25 bp, Mus musculus
ggaggatcaagagttgaaagcgctg

SEQ ID NO: 948269 - DNA, 25 bp, Mus musculus
ggaggatgcgcggccgaaccgagca

SEQ ID NO: 948270 - DNA, 25 bp, Mus musculus
ggaggatgcgcggcggaaccgagca

SEQ ID NO: 948271 - DNA, 25 bp, Mus musculus
ggaggattacctgaacatgtttgtt

SEQ ID NO: 948272 - DNA, 25 bp, Mus musculus
ggaggattacgtgaacatgtttgtt

SEQ ID NO: 948273 - DNA, 25 bp, Mus musculus
ggaggatttgagccctacctaggac

SEQ ID NO: 948274 - DNA, 25 bp, Mus musculus
ggaggatttgaggcctacctaggac

SEQ ID NO: 948275 - DNA, 25 bp, Mus musculus
ggaggattttctcacggaggcgcct

SEQ ID NO: 948276 - DNA, 25 bp, Mus musculus
ggaggattttctcacgggccgatca

SEQ ID NO: 948277 - DNA, 25 bp, Mus musculus
ggaggattttctcagggaggcgcct

SEQ ID NO: 948278 - DNA, 25 bp, Mus musculus
ggaggattttctcaggggccgatca

SEQ ID NO: 948279 - DNA, 25 bp, Mus musculus
ggaggcaaagacaaagtactccaat

SEQ ID NO: 948280 - DNA, 25 bp, Mus musculus
ggaggcaaagacaatgtactccaat

SEQ ID NO: 948281 - DNA, 25 bp, Mus musculus
ggaggcaaagagaactctggttggc

SEQ ID NO: 948282 - DNA, 25 bp, Mus musculus
ggaggcaaagcatcgtaagagtggc

SEQ ID NO: 948283 - DNA, 25 bp, Mus musculus
ggaggcaaaggatcgtaagagtggc

SEQ ID NO: 948284 - DNA, 25 bp, Mus musculus
ggaggcaaagtgaactctggttggc

SEQ ID NO: 948285 - DNA, 25 bp, Mus musculus
ggaggcaagatgcctttgcggggcc

SEQ ID NO: 948286 - DNA, 25 bp, Mus musculus
ggaggcaagatggctttgcggggcc

SEQ ID NO: 948287 - DNA, 25 bp, Mus musculus
ggaggcacagctttacacgccgctg

SEQ ID NO: 948288 - DNA, 25 bp, Mus musculus
ggaggcacaggtttacacgccgctg

SEQ ID NO: 948289 - DNA, 25 bp, Mus musculus
ggaggcacctactcagctctcagaa

SEQ ID NO: 948290 - DNA, 25 bp, Mus musculus
ggaggcacctactctgctctcagaa

SEQ ID NO: 948291 - DNA, 25 bp, Mus musculus
ggaggcagaaaagacgtcaaaatgc

SEQ ID NO: 948292 - DNA, 25 bp, Mus musculus
ggaggcagaaaagaggtcaaaatgc

SEQ ID NO: 948293 - DNA, 25 bp, Mus musculus
ggaggcagagcctggccttgaactc

SEQ ID NO: 948294 - DNA, 25 bp, Mus musculus
ggaggcagaggacgtagaggaggct

SEQ ID NO: 948295 - DNA, 25 bp, Mus musculus
ggaggcagaggaggtagaggaggct

SEQ ID NO: 948296 - DNA, 25 bp, Mus musculus
ggaggcagaggctggccttgaactc

SEQ ID NO: 948297 - DNA, 25 bp, Mus musculus
ggaggcatagctcgtctgaagagcc

SEQ ID NO: 948298 - DNA, 25 bp, Mus musculus
ggaggcatagctggtctgaagagcc

SEQ ID NO: 948299 - DNA, 25 bp, Mus musculus
ggaggcattcggctgcgccaccaac

SEQ ID NO: 948300 - DNA, 25 bp, Mus musculus
ggaggcattcgggtgcgccaccaac

SEQ ID NO: 948301 - DNA, 25 bp, Mus musculus
ggaggcattgatcaagggccctgaa

SEQ ID NO: 948302 - DNA, 25 bp, Mus musculus
ggaggcattgatcatgggccctgaa

SEQ ID NO: 948303 - DNA, 25 bp, Mus musculus
ggaggccacagaaagctcctgagag

SEQ ID NO: 948304 - DNA, 25 bp, Mus musculus
ggaggccacagatagctcctgagag

SEQ ID NO: 948305 - DNA, 25 bp, Mus musculus
ggaggccacatcctcggagccttaa

SEQ ID NO: 948306 - DNA, 25 bp, Mus musculus
ggaggccacatcctgggagccttaa

SEQ ID NO: 948307 - DNA, 25 bp, Mus musculus
ggaggccagcaacgtgatggatgtg

SEQ ID NO: 948308 - DNA, 25 bp, Mus musculus
ggaggccagcaaggtgatggatgtg

SEQ ID NO: 948309 - DNA, 25 bp, Mus musculus
ggaggccatgagcaacaaggcgtgc

SEQ ID NO: 948310 - DNA, 25 bp, Mus musculus
ggaggccatgaggaacaaggcgtgc

SEQ ID NO: 948311 - DNA, 25 bp, Mus musculus
ggaggcccagccccttctcagtgga

SEQ ID NO: 948312 - DNA, 25 bp, Mus musculus
ggaggcccaggcccttctcagtgga

SEQ ID NO: 948313 - DNA, 25 bp, Mus musculus
ggaggccccagcccctggtattaat

SEQ ID NO: 948314 - DNA, 25 bp, Mus musculus
ggaggccccagcgcctggtattaat

SEQ ID NO: 948315 - DNA, 25 bp, Mus musculus
ggaggcccccagcattccccctctg

SEQ ID NO: 948316 - DNA, 25 bp, Mus musculus
ggaggcccccaggattccccctctg

SEQ ID NO: 948317 - DNA, 25 bp, Mus musculus
ggaggccgagaactactctcagaag

SEQ ID NO: 948318 - DNA, 25 bp, Mus musculus
ggaggccgagaagtactctcagaag

SEQ ID NO: 948319 - DNA, 25 bp, Mus musculus
ggaggccgagcacaaggagggagag

SEQ ID NO: 948320 - DNA, 25 bp, Mus musculus
ggaggccgagcagaaggagggagag

SEQ ID NO: 948321 - DNA, 25 bp, Mus musculus
ggaggccgagcctgagaatcaggct

SEQ ID NO: 948322 - DNA, 25 bp, Mus musculus
ggaggccgaggctgagaatcaggct

SEQ ID NO: 948323 - DNA, 25 bp, Mus musculus
ggaggccgcgagtaatgttcaagcc

SEQ ID NO: 948324 - DNA, 25 bp, Mus musculus
ggaggccgcgtgtaatgttcaagcc

SEQ ID NO: 948325 - DNA, 25 bp, Mus musculus
ggaggccggtcacgtgtccttgctg

SEQ ID NO: 948326 - DNA, 25 bp, Mus musculus
ggaggccggtcaggtgtccttgctg

SEQ ID NO: 948327 - DNA, 25 bp, Mus musculus
ggaggcctccacagacttcctacca

SEQ ID NO: 948328 - DNA, 25 bp, Mus musculus
ggaggcctccacagtcttcctacca

SEQ ID NO: 948329 - DNA, 25 bp, Mus musculus
ggaggcctgctgatgctcctgccag

SEQ ID NO: 948330 - DNA, 25 bp, Mus musculus
ggaggcctgctgttgctcctgccag

SEQ ID NO: 948331 - DNA, 25 bp, Mus musculus
ggaggcctttcacagcttcctggac

SEQ ID NO: 948332 - DNA, 25 bp, Mus musculus
ggaggcctttcagagcttcctggac

SEQ ID NO: 948333 - DNA, 25 bp, Mus musculus
ggaggcgcagagataaaggagagtg

SEQ ID NO: 948334 - DNA, 25 bp, Mus musculus
ggaggcgcagagttaaaggagagtg

SEQ ID NO: 948335 - DNA, 25 bp, Mus musculus
ggaggcggagaacctgtggtgaccc

SEQ ID NO: 948336 - DNA, 25 bp, Mus musculus
ggaggcggagaagctgtggtgaccc

SEQ ID NO: 948337 - DNA, 25 bp, Mus musculus
ggaggctacaagcttcgctatgcca

SEQ ID NO: 948338 - DNA, 25 bp, Mus musculus
ggaggctacaaggttcgctatgcca

SEQ ID NO: 948339 - DNA, 25 bp, Mus musculus
ggaggctataagctccccagggagg

SEQ ID NO: 948340 - DNA, 25 bp, Mus musculus
ggaggctataaggtccccagggagg

SEQ ID NO: 948341 - DNA, 25 bp, Mus musculus
ggaggctccgaggaacactcgggcc

SEQ ID NO: 948342 - DNA, 25 bp, Mus musculus
ggaggctccgtggaacactcgggcc

SEQ ID NO: 948343 - DNA, 25 bp, Mus musculus
ggaggctgacatgtccctgagcgga

SEQ ID NO: 948344 - DNA, 25 bp, Mus musculus
ggaggctgacatgtcgagcattggc

SEQ ID NO: 948345 - DNA, 25 bp, Mus musculus
ggaggctgacatgtgcctgagcgga

SEQ ID NO: 948346 - DNA, 25 bp, Mus musculus
ggaggctgacatgtggagcattggc

SEQ ID NO: 948347 - DNA, 25 bp, Mus musculus
ggaggctgagatcactggagattgc

SEQ ID NO: 948348 - DNA, 25 bp, Mus musculus
ggaggctgagttcactggagattgc

SEQ ID NO: 948349 - DNA, 25 bp, Mus musculus
ggaggctgccatcgtcactacgtcc

SEQ ID NO: 948350 - DNA, 25 bp, Mus musculus
ggaggctgccatggtcactacgtcc

SEQ ID NO: 948351 - DNA, 25 bp, Mus musculus
ggaggctgctcgcctggagaaagtg

SEQ ID NO: 948352 - DNA, 25 bp, Mus musculus
ggaggctgctcggctggagaaagtg

SEQ ID NO: 948353 - DNA, 25 bp, Mus musculus
ggaggctggagggaccttcctccat

SEQ ID NO: 948354 - DNA, 25 bp, Mus musculus
ggaggctggagggagcttcctccat

SEQ ID NO: 948355 - DNA, 25 bp, Mus musculus
ggaggctgtgcttgaatgtaattct

SEQ ID NO: 948356 - DNA, 25 bp, Mus musculus
ggaggctgtggttgaatgtaattct

SEQ ID NO: 948357 - DNA, 25 bp, Mus musculus
ggaggctttggacgtagaggaggct

SEQ ID NO: 948358 - DNA, 25 bp, Mus musculus
ggaggctttggaggtagaggaggct

SEQ ID NO: 948359 - DNA, 25 bp, Mus musculus
ggagggaagaaaattatgccaccct

SEQ ID NO: 948360 - DNA, 25 bp, Mus musculus
ggagggaagataattatgccaccct

SEQ ID NO: 948361 - DNA, 25 bp, Mus musculus
ggagggacagagacaggtttctgga

SEQ ID NO: 948362 - DNA, 25 bp, Mus musculus
ggagggacagcaactgctttgctct

SEQ ID NO: 948363 - DNA, 25 bp, Mus musculus
ggagggacagcagtgacactgtttg

SEQ ID NO: 948364 - DNA, 25 bp, Mus musculus
ggagggacagccatcaccccaatgc

SEQ ID NO: 948365 - DNA, 25 bp, Mus musculus
ggagggacaggaactgctttgctct

SEQ ID NO: 948366 - DNA, 25 bp, Mus musculus
ggagggacaggagtgacactgtttg

SEQ ID NO: 948367 - DNA, 25 bp, Mus musculus
ggagggacaggcatcaccccaatgc

SEQ ID NO: 948368 - DNA, 25 bp, Mus musculus
ggagggacagtgacaggtttctgga

SEQ ID NO: 948369 - DNA, 25 bp, Mus musculus
ggagggagacagaagcaggtggcag

SEQ ID NO: 948370 - DNA, 25 bp, Mus musculus
ggagggagacagaaggaggtggtgg

SEQ ID NO: 948371 - DNA, 25 bp, Mus musculus
ggagggagacagtagcaggtggcag

SEQ ID NO: 948372 - DNA, 25 bp, Mus musculus
ggagggagacagtaggaggtggtgg

SEQ ID NO: 948373 - DNA, 25 bp, Mus musculus
ggagggagagccaacttccatcgtc

SEQ ID NO: 948374 - DNA, 25 bp, Mus musculus
ggagggagagccaagttccatcgtc

SEQ ID NO: 948375 - DNA, 25 bp, Mus musculus
ggagggagctgctaccccttctctg

SEQ ID NO: 948376 - DNA, 25 bp, Mus musculus
ggagggagctgctagcccttctctg

SEQ ID NO: 948377 - DNA, 25 bp, Mus musculus
ggagggattgatgctgcacctcctg

SEQ ID NO: 948378 - DNA, 25 bp, Mus musculus
ggagggattgttgctgcacctcctg

SEQ ID NO: 948379 - DNA, 25 bp, Mus musculus
ggagggcaagcaagggaagcaggcc

SEQ ID NO: 948380 - DNA, 25 bp, Mus musculus
ggagggcaaggaagggaagcaggcc

SEQ ID NO: 948381 - DNA, 25 bp, Mus musculus
ggagggcaccagctcactacttcag

SEQ ID NO: 948382 - DNA, 25 bp, Mus musculus
ggagggcaccaggtcactacttcag

SEQ ID NO: 948383 - DNA, 25 bp, Mus musculus
ggagggcatgcaggtggaagattta

SEQ ID NO: 948384 - DNA, 25 bp, Mus musculus
ggagggcatgctggaagatttaaag

SEQ ID NO: 948385 - DNA, 25 bp, Mus musculus
ggagggcatggaggtggaagattta

SEQ ID NO: 948386 - DNA, 25 bp, Mus musculus
ggagggcatggtggaagatttaaag

SEQ ID NO: 948387 - DNA, 25 bp, Mus musculus
ggagggccacacaactcgcgagcac

SEQ ID NO: 948388 - DNA, 25 bp, Mus musculus
ggagggccacacaagtcgcgagcac

SEQ ID NO: 948389 - DNA, 25 bp, Mus musculus
ggagggccccagcacctctactgga

SEQ ID NO: 948390 - DNA, 25 bp, Mus musculus
ggagggccccagcagctctactgga

SEQ ID NO: 948391 - DNA, 25 bp, Mus musculus
ggagggcgagctgctcctaatggcc

SEQ ID NO: 948392 - DNA, 25 bp, Mus musculus
ggagggcgaggtgctcctaatggcc

SEQ ID NO: 948393 - DNA, 25 bp, Mus musculus
ggagggcgtgctcagtatcgacgga

SEQ ID NO: 948394 - DNA, 25 bp, Mus musculus
ggagggcgtggtcagtatcgacgga

SEQ ID NO: 948395 - DNA, 25 bp, Mus musculus
ggaggggctaagattggagggcagc

SEQ ID NO: 948396 - DNA, 25 bp, Mus musculus
ggaggggctaagtttggagggcagc

SEQ ID NO: 948397 - DNA, 25 bp, Mus musculus
ggaggggttggtcatggattcatgg

SEQ ID NO: 948398 - DNA, 25 bp, Mus musculus
ggaggggttggtgatggattcatgg

SEQ ID NO: 948399 - DNA, 25 bp, Mus musculus
ggagggtggctccgaaaaggcagat

SEQ ID NO: 948400 - DNA, 25 bp, Mus musculus
ggagggtggctcggaaaaggcagat

SEQ ID NO: 948401 - DNA, 25 bp, Mus musculus
ggaggtaatcgacaggctgagtaat

SEQ ID NO: 948402 - DNA, 25 bp, Mus musculus
ggaggtaatcgagaggctgagtaat

SEQ ID NO: 948403 - DNA, 25 bp, Mus musculus
ggaggtacagagagtgcaaacgcac

SEQ ID NO: 948404 - DNA, 25 bp, Mus musculus
ggaggtacagtgagtgcaaacgcac

SEQ ID NO: 948405 - DNA, 25 bp, Mus musculus
ggaggtacctgacacgggaactctg

SEQ ID NO: 948406 - DNA, 25 bp, Mus musculus
ggaggtacctgacaggggaactctg

SEQ ID NO: 948407 - DNA, 25 bp, Mus musculus
ggaggtagaggacaaatgtgcactg

SEQ ID NO: 948408 - DNA, 25 bp, Mus musculus
ggaggtagaggagaaatgtgcactg

SEQ ID NO: 948409 - DNA, 25 bp, Mus musculus
ggaggtataacgcccatatttctac

SEQ ID NO: 948410 - DNA, 25 bp, Mus musculus
ggaggtataacgccgatatttctac

SEQ ID NO: 948411 - DNA, 25 bp, Mus musculus
ggaggtcaacaacgtggctggaaac

SEQ ID NO: 948412 - DNA, 25 bp, Mus musculus
ggaggtcaacaactggctggaaact

SEQ ID NO: 948413 - DNA, 25 bp, Mus musculus
ggaggtcaacaaggtggctggaaac

SEQ ID NO: 948414 - DNA, 25 bp, Mus musculus
ggaggtcaacaagtggctggaaact

SEQ ID NO: 948415 - DNA, 25 bp, Mus musculus
ggaggtccagctgctcggcactgct

SEQ ID NO: 948416 - DNA, 25 bp, Mus musculus
ggaggtccagctgttcatgactgac

SEQ ID NO: 948417 - DNA, 25 bp, Mus musculus
ggaggtccaggtgctcggcactgct

SEQ ID NO: 948418 - DNA, 25 bp, Mus musculus
ggaggtccaggtgttcatgactgac

SEQ ID NO: 948419 - DNA, 25 bp, Mus musculus
ggaggtccggatgctgttgacggag

SEQ ID NO: 948420 - DNA, 25 bp, Mus musculus
ggaggtccggttgctgttgacggag

SEQ ID NO: 948421 - DNA, 25 bp, Mus musculus
ggaggtcctgcaagcacctggatga

SEQ ID NO: 948422 - DNA, 25 bp, Mus musculus
ggaggtcctgcaaggacctggatga

SEQ ID NO: 948423 - DNA, 25 bp, Mus musculus
ggaggtcggccacgtggttgcattt

SEQ ID NO: 948424 - DNA, 25 bp, Mus musculus
ggaggtcggccaggtggttgcattt

SEQ ID NO: 948425 - DNA, 25 bp, Mus musculus
ggaggtcttcaacgaaccagcacct

SEQ ID NO: 948426 - DNA, 25 bp, Mus musculus
ggaggtcttcaaggaaccagcacct

SEQ ID NO: 948427 - DNA, 25 bp, Mus musculus
ggaggtgaagcccaatacatatgaa

SEQ ID NO: 948428 - DNA, 25 bp, Mus musculus
ggaggtgaaggccaatacatatgaa

SEQ ID NO: 948429 - DNA, 25 bp, Mus musculus
ggaggtgacaaccaaaatatctgca

SEQ ID NO: 948430 - DNA, 25 bp, Mus musculus
ggaggtgacaacgaaaatatctgca

SEQ ID NO: 948431 - DNA, 25 bp, Mus musculus
ggaggtgcagaatgtggacgacgcg

SEQ ID NO: 948432 - DNA, 25 bp, Mus musculus
ggaggtgcagctgaagttgaccttc

SEQ ID NO: 948433 - DNA, 25 bp, Mus musculus
ggaggtgcaggtgaagttgaccttc

SEQ ID NO: 948434 - DNA, 25 bp, Mus musculus
ggaggtgcagtatgtggacgacgcg

SEQ ID NO: 948435 - DNA, 25 bp, Mus musculus
ggaggtgccacacccaccatgccaa

SEQ ID NO: 948436 - DNA, 25 bp, Mus musculus
ggaggtgccacagccaccatgccaa

SEQ ID NO: 948437 - DNA, 25 bp, Mus musculus
ggaggtgctgcacttacctaagttg

SEQ ID NO: 948438 - DNA, 25 bp, Mus musculus
ggaggtgctggacttacctaagttg

SEQ ID NO: 948439 - DNA, 25 bp, Mus musculus
ggaggtggagcacgaccacaggaga

SEQ ID NO: 948440 - DNA, 25 bp, Mus musculus
ggaggtggaggacgaccacaggaga

SEQ ID NO: 948441 - DNA, 25 bp, Mus musculus
ggaggtggcaagccctggcacaaga

SEQ ID NO: 948442 - DNA, 25 bp, Mus musculus
ggaggtggcaagctgcaaatagtct

SEQ ID NO: 948443 - DNA, 25 bp, Mus musculus
ggaggtggcaagctgcagataatta

SEQ ID NO: 948444 - DNA, 25 bp, Mus musculus
ggaggtggcaaggcctggcacaaga

SEQ ID NO: 948445 - DNA, 25 bp, Mus musculus
ggaggtggcaaggtgcaaatagtct

SEQ ID NO: 948446 - DNA, 25 bp, Mus musculus
ggaggtggcaaggtgcagataatta

SEQ ID NO: 948447 - DNA, 25 bp, Mus musculus
ggaggtggcaggcttaaggcagctt

SEQ ID NO: 948448 - DNA, 25 bp, Mus musculus
ggaggtggcagggttaaggcagctt

SEQ ID NO: 948449 - DNA, 25 bp, Mus musculus
ggaggtgtgaatatcgaccactcca

SEQ ID NO: 948450 - DNA, 25 bp, Mus musculus
ggaggtgtgaatatggaccactcca

SEQ ID NO: 948451 - DNA, 25 bp, Mus musculus
ggaggtgtggctgccagtggaatgg

SEQ ID NO: 948452 - DNA, 25 bp, Mus musculus
ggaggtgtgggtgccagtggaatgg

SEQ ID NO: 948453 - DNA, 25 bp, Mus musculus
ggaggtgttgatcttcttgtagaaa

SEQ ID NO: 948454 - DNA, 25 bp, Mus musculus
ggaggtgttgatgttcttgtagaaa

SEQ ID NO: 948455 - DNA, 25 bp, Mus musculus
ggaggttcgaagctcgatccgccag

SEQ ID NO: 948456 - DNA, 25 bp, Mus musculus
ggaggttcgaagctggatccgccag

SEQ ID NO: 948457 - DNA, 25 bp, Mus musculus
ggaggttctacagaataatcattgc

SEQ ID NO: 948458 - DNA, 25 bp, Mus musculus
ggaggttctacagattaatcattgc

SEQ ID NO: 948459 - DNA, 25 bp, Mus musculus
ggaggttggcggagcgctcactctt

SEQ ID NO: 948460 - DNA, 25 bp, Mus musculus
ggaggttggcggagctcactctttg

SEQ ID NO: 948461 - DNA, 25 bp, Mus musculus
ggaggttggcggagggctcactctt

SEQ ID NO: 948462 - DNA, 25 bp, Mus musculus
ggaggttggcggtgctcactctttg

SEQ ID NO: 948463 - DNA, 25 bp, Mus musculus
ggaggtttgccacctcctattggcc

SEQ ID NO: 948464 - DNA, 25 bp, Mus musculus
ggaggtttgccagctcctattggcc

SEQ ID NO: 948465 - DNA, 25 bp, Mus musculus
ggaggttttgttcgtgtgcaacaga

SEQ ID NO: 948466 - DNA, 25 bp, Mus musculus
ggaggttttgttggtgtgcaacaga

SEQ ID NO: 948467 - DNA, 25 bp, Mus musculus
ggagtaacgcagcaggaaaccttgg

SEQ ID NO: 948468 - DNA, 25 bp, Mus musculus
ggagtaacgcaggaggaaaccttgg

SEQ ID NO: 948469 - DNA, 25 bp, Mus musculus
ggagtaatcagagactgtcacgatg

SEQ ID NO: 948470 - DNA, 25 bp, Mus musculus
ggagtaatcagagagtgtcacgatg

SEQ ID NO: 948471 - DNA, 25 bp, Mus musculus
ggagtacaaaaacctgtgagtacca

SEQ ID NO: 948472 - DNA, 25 bp, Mus musculus
ggagtacaaaaacgtgcatccaagc

SEQ ID NO: 948473 - DNA, 25 bp, Mus musculus
ggagtacaaaaagctgtgagtacca

SEQ ID NO: 948474 - DNA, 25 bp, Mus musculus
ggagtacaaaaaggtgcatccaagc

SEQ ID NO: 948475 - DNA, 25 bp, Mus musculus
ggagtaccagcagaccctgagcaga

SEQ ID NO: 948476 - DNA, 25 bp, Mus musculus
ggagtaccagcaggagctggagttc

SEQ ID NO: 948477 - DNA, 25 bp, Mus musculus
ggagtaccaggagaccctgagcaga

SEQ ID NO: 948478 - DNA, 25 bp, Mus musculus
ggagtaccaggaggagctggagttc

SEQ ID NO: 948479 - DNA, 25 bp, Mus musculus
ggagtactgggaaacccggcgcagc

SEQ ID NO: 948480 - DNA, 25 bp, Mus musculus
ggagtactgggatacccggcgcagc

SEQ ID NO: 948481 - DNA, 25 bp, Mus musculus
ggagtagatttacatgccagcacct

SEQ ID NO: 948482 - DNA, 25 bp, Mus musculus
ggagtagatttagatgccagcacct

SEQ ID NO: 948483 - DNA, 25 bp, Mus musculus
ggagtagcagcaccttctgaccctt

SEQ ID NO: 948484 - DNA, 25 bp, Mus musculus
ggagtagcaggaccttctgaccctt

SEQ ID NO: 948485 - DNA, 25 bp, Mus musculus
ggagtatgccagctactacatgagg

SEQ ID NO: 948486 - DNA, 25 bp, Mus musculus
ggagtatgccaggtactacatgagg

SEQ ID NO: 948487 - DNA, 25 bp, Mus musculus
ggagtatgtgaagacctggttttgg

SEQ ID NO: 948488 - DNA, 25 bp, Mus musculus
ggagtatgtgaagacgtttgttgtc

SEQ ID NO: 948489 - DNA, 25 bp, Mus musculus
ggagtatgtgaagagctggttttgg

SEQ ID NO: 948490 - DNA, 25 bp, Mus musculus
ggagtatgtgaagaggtttgttgtc

SEQ ID NO: 948491 - DNA, 25 bp, Mus musculus
ggagtattaaagattgtcaaaagag

SEQ ID NO: 948492 - DNA, 25 bp, Mus musculus
ggagtattaaagtttgtcaaaagag

SEQ ID NO: 948493 - DNA, 25 bp, Mus musculus
ggagtattataagacgtactcacca

SEQ ID NO: 948494 - DNA, 25 bp, Mus musculus
ggagtattataagaggtactcacca

SEQ ID NO: 948495 - DNA, 25 bp, Mus musculus
ggagtattctggatcagtctcctct

SEQ ID NO: 948496 - DNA, 25 bp, Mus musculus
ggagtattctggttcagtctcctct

SEQ ID NO: 948497 - DNA, 25 bp, Mus musculus
ggagtcaatacacgtgtggcaaaac

SEQ ID NO: 948498 - DNA, 25 bp, Mus musculus
ggagtcaatacagggagaagctgac

SEQ ID NO: 948499 - DNA, 25 bp, Mus musculus
ggagtcaatacaggtgtggcaaaac

SEQ ID NO: 948500 - DNA, 25 bp, Mus musculus
ggagtcaatagagggagaagctgac

SEQ ID NO: 948501 - DNA, 25 bp, Mus musculus
ggagtcacctctctctggtagcagc

SEQ ID NO: 948502 - DNA, 25 bp, Mus musculus
ggagtcacctctgtctggtagcagc

SEQ ID NO: 948503 - DNA, 25 bp, Mus musculus
ggagtcactcaacgtctcgctctcg

SEQ ID NO: 948504 - DNA, 25 bp, Mus musculus
ggagtcactcaaggtctcgctctcg

SEQ ID NO: 948505 - DNA, 25 bp, Mus musculus
ggagtcagagcagtttgacaagaag

SEQ ID NO: 948506 - DNA, 25 bp, Mus musculus
ggagtcagaggagtttgacaagaag

SEQ ID NO: 948507 - DNA, 25 bp, Mus musculus
ggagtcagggcaaatgagcatctct

SEQ ID NO: 948508 - DNA, 25 bp, Mus musculus
ggagtcagggctcactaggattgtg

SEQ ID NO: 948509 - DNA, 25 bp, Mus musculus
ggagtcaggggaaatgagcatctct

SEQ ID NO: 948510 - DNA, 25 bp, Mus musculus
ggagtcaggggtcactaggattgtg

SEQ ID NO: 948511 - DNA, 25 bp, Mus musculus
ggagtcatcacacgtgtgacaccag

SEQ ID NO: 948512 - DNA, 25 bp, Mus musculus
ggagtcatcacaggtgtgacaccag

SEQ ID NO: 948513 - DNA, 25 bp, Mus musculus
ggagtccacagccaagggattctgc

SEQ ID NO: 948514 - DNA, 25 bp, Mus musculus
ggagtccacagccatgggattctgc

SEQ ID NO: 948515 - DNA, 25 bp, Mus musculus
ggagtccatccaggcctgtaaactt

SEQ ID NO: 948516 - DNA, 25 bp, Mus musculus
ggagtccatccagggctgtaaactt

SEQ ID NO: 948517 - DNA, 25 bp, Mus musculus
ggagtccatgagtaaagagctggcc

SEQ ID NO: 948518 - DNA, 25 bp, Mus musculus
ggagtccatgtgtaaagagctggcc

SEQ ID NO: 948519 - DNA, 25 bp, Mus musculus
ggagtcccagaaggaacggctgctg

SEQ ID NO: 948520 - DNA, 25 bp, Mus musculus
ggagtcccagtaggaacggctgctg

SEQ ID NO: 948521 - DNA, 25 bp, Mus musculus
ggagtccctagacgtgttggtggaa

SEQ ID NO: 948522 - DNA, 25 bp, Mus musculus
ggagtccctagaggtgttggtggaa

SEQ ID NO: 948523 - DNA, 25 bp, Mus musculus
ggagtccggcaacgagatgaagtct

SEQ ID NO: 948524 - DNA, 25 bp, Mus musculus
ggagtccggcaaggagatgaagtct

SEQ ID NO: 948525 - DNA, 25 bp, Mus musculus
ggagtcgactaccagacaaacccaa

SEQ ID NO: 948526 - DNA, 25 bp, Mus musculus
ggagtcgactacgagacaaacccaa

SEQ ID NO: 948527 - DNA, 25 bp, Mus musculus
ggagtcgccatgacaccccaggatg

SEQ ID NO: 948528 - DNA, 25 bp, Mus musculus
ggagtcgccatgcctacaacacagc

SEQ ID NO: 948529 - DNA, 25 bp, Mus musculus
ggagtcgccatggctacaacacagc

SEQ ID NO: 948530 - DNA, 25 bp, Mus musculus
ggagtcgccatgtcaccccaggatg

SEQ ID NO: 948531 - DNA, 25 bp, Mus musculus
ggagtcgtctgttaagagaccaatg

SEQ ID NO: 948532 - DNA, 25 bp, Mus musculus
ggagtcgtctgttatgagaccaatg

SEQ ID NO: 948533 - DNA, 25 bp, Mus musculus
ggagtcgttagccagagcacaaaca

SEQ ID NO: 948534 - DNA, 25 bp, Mus musculus
ggagtcgttagcgagagcacaaaca

SEQ ID NO: 948535 - DNA, 25 bp, Mus musculus
ggagtctcaaacaaaaggtgaccag

SEQ ID NO: 948536 - DNA, 25 bp, Mus musculus
ggagtctcaaacaataggtgaccag

SEQ ID NO: 948537 - DNA, 25 bp, Mus musculus
ggagtctccatttccgtttccagat

SEQ ID NO: 948538 - DNA, 25 bp, Mus musculus
ggagtctccatttcggtttccagat

SEQ ID NO: 948539 - DNA, 25 bp, Mus musculus
ggagtctccgcggccgagacccctg

SEQ ID NO: 948540 - DNA, 25 bp, Mus musculus
ggagtctccgcggcggagacccctg

SEQ ID NO: 948541 - DNA, 25 bp, Mus musculus
ggagtctcggaactgcatccaccgg

SEQ ID NO: 948542 - DNA, 25 bp, Mus musculus
ggagtctcggaagtgcatccaccgg

SEQ ID NO: 948543 - DNA, 25 bp, Mus musculus
ggagtctcttaacaatataaaagac

SEQ ID NO: 948544 - DNA, 25 bp, Mus musculus
ggagtctcttaagaatataaaagac

SEQ ID NO: 948545 - DNA, 25 bp, Mus musculus
ggagtctgagcgaaccttcagaagt

SEQ ID NO: 948546 - DNA, 25 bp, Mus musculus
ggagtctgagggaaccttcagaagt

SEQ ID NO: 948547 - DNA, 25 bp, Mus musculus
ggagtctgcaaccatgcttttcatt

SEQ ID NO: 948548 - DNA, 25 bp, Mus musculus
ggagtctgcaacgatgcttttcatt

SEQ ID NO: 948549 - DNA, 25 bp, Mus musculus
ggagtctgccgactggttggctgtg

SEQ ID NO: 948550 - DNA, 25 bp, Mus musculus
ggagtctgccgagtggttggctgtg

SEQ ID NO: 948551 - DNA, 25 bp, Mus musculus
ggagtctgtgaacagccacaatcat

SEQ ID NO: 948552 - DNA, 25 bp, Mus musculus
ggagtctgtgaacgagaagtttgag

SEQ ID NO: 948553 - DNA, 25 bp, Mus musculus
ggagtctgtgaagagccacaatcat

SEQ ID NO: 948554 - DNA, 25 bp, Mus musculus
ggagtctgtgaaggagaagtttgag

SEQ ID NO: 948555 - DNA, 25 bp, Mus musculus
ggagtcttcattcacgttttggcaa

SEQ ID NO: 948556 - DNA, 25 bp, Mus musculus
ggagtcttcattcaggttttggcaa

SEQ ID NO: 948557 - DNA, 25 bp, Mus musculus
ggagtcttgggcctcggcccatacc

SEQ ID NO: 948558 - DNA, 25 bp, Mus musculus
ggagtcttgggcctgggcccatacc

SEQ ID NO: 948559 - DNA, 25 bp, Mus musculus
ggagtctttgcgatagtaccaagac

SEQ ID NO: 948560 - DNA, 25 bp, Mus musculus
ggagtctttgcgattgtaccaagac

SEQ ID NO: 948561 - DNA, 25 bp, Mus musculus
ggagtgacatcctacacaacaacgg

SEQ ID NO: 948562 - DNA, 25 bp, Mus musculus
ggagtgacatcctagacaacaacgg

SEQ ID NO: 948563 - DNA, 25 bp, Mus musculus
ggagtgagagagcctgtgctgtgga

SEQ ID NO: 948564 - DNA, 25 bp, Mus musculus
ggagtgagagaggaggagcgctttt

SEQ ID NO: 948565 - DNA, 25 bp, Mus musculus
ggagtgagagctgggaagtcatcaa

SEQ ID NO: 948566 - DNA, 25 bp, Mus musculus
ggagtgagaggtgggaagtcatcaa

SEQ ID NO: 948567 - DNA, 25 bp, Mus musculus
ggagtgagagtgcctgtgctgtgga

SEQ ID NO: 948568 - DNA, 25 bp, Mus musculus
ggagtgagagtggaggagcgctttt

SEQ ID NO: 948569 - DNA, 25 bp, Mus musculus
ggagtgatcgccctgtggtcaggca

SEQ ID NO: 948570 - DNA, 25 bp, Mus musculus
ggagtgatcggcctgtggtcaggca

SEQ ID NO: 948571 - DNA, 25 bp, Mus musculus
ggagtgatggcttatggctatgaaa

SEQ ID NO: 948572 - DNA, 25 bp, Mus musculus
ggagtgatgggttatggctatgaaa

SEQ ID NO: 948573 - DNA, 25 bp, Mus musculus
ggagtgatttctcactggctgctgc

SEQ ID NO: 948574 - DNA, 25 bp, Mus musculus
ggagtgatttctgactggctgctgc

SEQ ID NO: 948575 - DNA, 25 bp, Mus musculus
ggagtgcaaacagactgacataatg

SEQ ID NO: 948576 - DNA, 25 bp, Mus musculus
ggagtgcaaacagagtgacataatg

SEQ ID NO: 948577 - DNA, 25 bp, Mus musculus
ggagtgcagcctcacccaagttgaa

SEQ ID NO: 948578 - DNA, 25 bp, Mus musculus
ggagtgcagcctcagccaagttgaa

SEQ ID NO: 948579 - DNA, 25 bp, Mus musculus
ggagtgcccactcacgctcctatta

SEQ ID NO: 948580 - DNA, 25 bp, Mus musculus
ggagtgcccactcaggctcctatta

SEQ ID NO: 948581 - DNA, 25 bp, Mus musculus
ggagtgcgcacacgcatcattggga

SEQ ID NO: 948582 - DNA, 25 bp, Mus musculus
ggagtgcgcacaggcatcattggga

SEQ ID NO: 948583 - DNA, 25 bp, Mus musculus
ggagtgcggaggccgggggcagaga

SEQ ID NO: 948584 - DNA, 25 bp, Mus musculus
ggagtgcggagggcgggggcagaga

SEQ ID NO: 948585 - DNA, 25 bp, Mus musculus
ggagtgctgaagatctgtgacttcg

SEQ ID NO: 948586 - DNA, 25 bp, Mus musculus
ggagtgctgaagttctgtgacttcg

SEQ ID NO: 948587 - DNA, 25 bp, Mus musculus
ggagtgcttggcgccaaaaggtgga

SEQ ID NO: 948588 - DNA, 25 bp, Mus musculus
ggagtgcttggcgccatatgctaat

SEQ ID NO: 948589 - DNA, 25 bp, Mus musculus
ggagtgcttggcgccgtgaaggcga

SEQ ID NO: 948590 - DNA, 25 bp, Mus musculus
ggagtgcttggcgcgaaaaggtgga

SEQ ID NO: 948591 - DNA, 25 bp, Mus musculus
ggagtgcttggcgcgatatgctaat

SEQ ID NO: 948592 - DNA, 25 bp, Mus musculus
ggagtgcttggcgcggtgaaggcga

SEQ ID NO: 948593 - DNA, 25 bp, Mus musculus
ggagtggcatgccacgtgccagtcc

SEQ ID NO: 948594 - DNA, 25 bp, Mus musculus
ggagtggcatgccaggtgccagtcc

SEQ ID NO: 948595 - DNA, 25 bp, Mus musculus
ggagtggcctcggtcattgaagtga

SEQ ID NO: 948596 - DNA, 25 bp, Mus musculus
ggagtggcctcggtgattgaagtga

SEQ ID NO: 948597 - DNA, 25 bp, Mus musculus
ggagtggtcaggcgatggcagtggc

SEQ ID NO: 948598 - DNA, 25 bp, Mus musculus
ggagtggtcaggggatggcagtggc

SEQ ID NO: 948599 - DNA, 25 bp, Mus musculus
ggagtggtgccacctgggggctcat

SEQ ID NO: 948600 - DNA, 25 bp, Mus musculus
ggagtggtgccagctgggggctcat

SEQ ID NO: 948601 - DNA, 25 bp, Mus musculus
ggagtgtaacagcgcagaatgtttg

SEQ ID NO: 948602 - DNA, 25 bp, Mus musculus
ggagtgtaacagggcagaatgtttg

SEQ ID NO: 948603 - DNA, 25 bp, Mus musculus
ggagtgtaagaggcggcccctgact

SEQ ID NO: 948604 - DNA, 25 bp, Mus musculus
ggagtgtaagtggcggcccctgact

SEQ ID NO: 948605 - DNA, 25 bp, Mus musculus
ggagtgtcagagcacgccaaccgag

SEQ ID NO: 948606 - DNA, 25 bp, Mus musculus
ggagtgtcagagcaggccaaccgag

SEQ ID NO: 948607 - DNA, 25 bp, Mus musculus
ggagtgtgggaaaatccacctagtg

SEQ ID NO: 948608 - DNA, 25 bp, Mus musculus
ggagtgtgggtaaatccacctagtg

SEQ ID NO: 948609 - DNA, 25 bp, Mus musculus
ggagtgtgtgcagccgggagagtta

SEQ ID NO: 948610 - DNA, 25 bp, Mus musculus
ggagtgtgtgcagcggggagagtta

SEQ ID NO: 948611 - DNA, 25 bp, Mus musculus
ggagtgttgtgacgagtccatgaag

SEQ ID NO: 948612 - DNA, 25 bp, Mus musculus
ggagtgttgtgaggagtccatgaag

SEQ ID NO: 948613 - DNA, 25 bp, Mus musculus
ggagttaagagacgtaatagaattg

SEQ ID NO: 948614 - DNA, 25 bp, Mus musculus
ggagttaagagaggtaatagaattg

SEQ ID NO: 948615 - DNA, 25 bp, Mus musculus
ggagttaatcttctctcctcgaaga

SEQ ID NO: 948616 - DNA, 25 bp, Mus musculus
ggagttaatcttctctcttctcaca

SEQ ID NO: 948617 - DNA, 25 bp, Mus musculus
ggagttaatcttctttgagtcttca

SEQ ID NO: 948618 - DNA, 25 bp, Mus musculus
ggagttaatcttgtctcctcgaaga

SEQ ID NO: 948619 - DNA, 25 bp, Mus musculus
ggagttaatcttgtctcttctcaca

SEQ ID NO: 948620 - DNA, 25 bp, Mus musculus
ggagttaatcttgtttgagtcttca

SEQ ID NO: 948621 - DNA, 25 bp, Mus musculus
ggagttagaaacaggtgagaactca

SEQ ID NO: 948622 - DNA, 25 bp, Mus musculus
ggagttagaatcaggtgagaactca

SEQ ID NO: 948623 - DNA, 25 bp, Mus musculus
ggagttagagctgaccatttgaaga

SEQ ID NO: 948624 - DNA, 25 bp, Mus musculus
ggagttagaggtgaccatttgaaga

SEQ ID NO: 948625 - DNA, 25 bp, Mus musculus
ggagttagccagaatggagaatgga

SEQ ID NO: 948626 - DNA, 25 bp, Mus musculus
ggagttagccagtatggagaatgga

SEQ ID NO: 948627 - DNA, 25 bp, Mus musculus
ggagttatagctatcagaagagatg

SEQ ID NO: 948628 - DNA, 25 bp, Mus musculus
ggagttataggtatcagaagagatg

SEQ ID NO: 948629 - DNA, 25 bp, Mus musculus
ggagttatttagacaagatcctgag

SEQ ID NO: 948630 - DNA, 25 bp, Mus musculus
ggagttatttagtcaagatcctgag

SEQ ID NO: 948631 - DNA, 25 bp, Mus musculus
ggagttcatcaacgagattggatac

SEQ ID NO: 948632 - DNA, 25 bp, Mus musculus
ggagttcatcaaggagattggatac

SEQ ID NO: 948633 - DNA, 25 bp, Mus musculus
ggagttcatgacaactgggccaatc

SEQ ID NO: 948634 - DNA, 25 bp, Mus musculus
ggagttcatgacaagtgggccaatc

SEQ ID NO: 948635 - DNA, 25 bp, Mus musculus
ggagttccaagatgactacttagtg

SEQ ID NO: 948636 - DNA, 25 bp, Mus musculus
ggagttccaagatgtctacttagtg

SEQ ID NO: 948637 - DNA, 25 bp, Mus musculus
ggagttccacggccacacggtgaat

SEQ ID NO: 948638 - DNA, 25 bp, Mus musculus
ggagttccacgggcacacggtgaat

SEQ ID NO: 948639 - DNA, 25 bp, Mus musculus
ggagttccagaactatgggcattag

SEQ ID NO: 948640 - DNA, 25 bp, Mus musculus
ggagttccagaagtatgggcattag

SEQ ID NO: 948641 - DNA, 25 bp, Mus musculus
ggagttccagagcttgttcaaacat

SEQ ID NO: 948642 - DNA, 25 bp, Mus musculus
ggagttccagaggttgttcaaacat

SEQ ID NO: 948643 - DNA, 25 bp, Mus musculus
ggagttcccatgttcttgctggttg

SEQ ID NO: 948644 - DNA, 25 bp, Mus musculus
ggagttcccatgttgttgctggttg

SEQ ID NO: 948645 - DNA, 25 bp, Mus musculus
ggagttcgaatacccgcatgtcatg

SEQ ID NO: 948646 - DNA, 25 bp, Mus musculus
ggagttcgaataccggcatgtcatg

SEQ ID NO: 948647 - DNA, 25 bp, Mus musculus
ggagttcgtcaaaagactggcaatg

SEQ ID NO: 948648 - DNA, 25 bp, Mus musculus
ggagttcgtcaatagactggcaatg

SEQ ID NO: 948649 - DNA, 25 bp, Mus musculus
ggagttgatgcaccccgtggctctt

SEQ ID NO: 948650 - DNA, 25 bp, Mus musculus
ggagttgatgcagcccgtggctctt

SEQ ID NO: 948651 - DNA, 25 bp, Mus musculus
ggagttgcagaagactcatgcagca

SEQ ID NO: 948652 - DNA, 25 bp, Mus musculus
ggagttgcagagaagactcatgcag

SEQ ID NO: 948653 - DNA, 25 bp, Mus musculus
ggagttgcagcacctgaaacagttt

SEQ ID NO: 948654 - DNA, 25 bp, Mus musculus
ggagttgcagcagaagactcatgca

SEQ ID NO: 948655 - DNA, 25 bp, Mus musculus
ggagttgcagcagctgaaacagttt

SEQ ID NO: 948656 - DNA, 25 bp, Mus musculus
ggagttgcaggagaagactcatgca

SEQ ID NO: 948657 - DNA, 25 bp, Mus musculus
ggagttgcagtagactcatgcagca

SEQ ID NO: 948658 - DNA, 25 bp, Mus musculus
ggagttgcagtgaagactcatgcag

SEQ ID NO: 948659 - DNA, 25 bp, Mus musculus
ggagttggaaatcgctttcttcgta

SEQ ID NO: 948660 - DNA, 25 bp, Mus musculus
ggagttggaaatggctttcttcgta

SEQ ID NO: 948661 - DNA, 25 bp, Mus musculus
ggagttggacattggtgcccaggga

SEQ ID NO: 948662 - DNA, 25 bp, Mus musculus
ggagttggactttggtgcccaggga

SEQ ID NO: 948663 - DNA, 25 bp, Mus musculus
ggagttggtaaaagtttatggagcc

SEQ ID NO: 948664 - DNA, 25 bp, Mus musculus
ggagttggtaaatgtttatggagcc

SEQ ID NO: 948665 - DNA, 25 bp, Mus musculus
ggagttggttcacgtggaacatcca

SEQ ID NO: 948666 - DNA, 25 bp, Mus musculus
ggagttggttcactatcctgtggaa

SEQ ID NO: 948667 - DNA, 25 bp, Mus musculus
ggagttggttcaggtggaacatcca

SEQ ID NO: 948668 - DNA, 25 bp, Mus musculus
ggagttggttcagtatcctgtggaa

SEQ ID NO: 948669 - DNA, 25 bp, Mus musculus
ggagttgtccaacgaatgtggcttc

SEQ ID NO: 948670 - DNA, 25 bp, Mus musculus
ggagttgtccaaggaatgtggcttc

SEQ ID NO: 948671 - DNA, 25 bp, Mus musculus
ggagttgtctctcatgcagcccttg

SEQ ID NO: 948672 - DNA, 25 bp, Mus musculus
ggagttgtctctgatgcagcccttg

SEQ ID NO: 948673 - DNA, 25 bp, Mus musculus
ggagtttcagcaactaatgaccatt

SEQ ID NO: 948674 - DNA, 25 bp, Mus musculus
ggagtttcaggaactaatgaccatt

SEQ ID NO: 948675 - DNA, 25 bp, Mus musculus
ggagtttcatcatgcgaaactgtga

SEQ ID NO: 948676 - DNA, 25 bp, Mus musculus
ggagtttcatcatgggaaactgtga

SEQ ID NO: 948677 - DNA, 25 bp, Mus musculus
ggagtttccacacgttgaagcttgc

SEQ ID NO: 948678 - DNA, 25 bp, Mus musculus
ggagtttccacaggttgaagcttgc

SEQ ID NO: 948679 - DNA, 25 bp, Mus musculus
ggagtttccttgcacggcctctatg

SEQ ID NO: 948680 - DNA, 25 bp, Mus musculus
ggagtttccttgcagggcctctatg

SEQ ID NO: 948681 - DNA, 25 bp, Mus musculus
ggagtttctgctcctacagaacctt

SEQ ID NO: 948682 - DNA, 25 bp, Mus musculus
ggagtttctggtcctacagaacctt

SEQ ID NO: 948683 - DNA, 25 bp, Mus musculus
ggagtttgagatcccactgagatgg

SEQ ID NO: 948684 - DNA, 25 bp, Mus musculus
ggagtttgagttcccactgagatgg

SEQ ID NO: 948685 - DNA, 25 bp, Mus musculus
ggagttttaggaaagatataccgca

SEQ ID NO: 948686 - DNA, 25 bp, Mus musculus
ggagttttaggatagatataccgca

SEQ ID NO: 948687 - DNA, 25 bp, Mus musculus
ggataaagaaaccactggtatagtg

SEQ ID NO: 948688 - DNA, 25 bp, Mus musculus
ggataaagaaacgactggtatagtg

SEQ ID NO: 948689 - DNA, 25 bp, Mus musculus
ggataacaagcatctgttcagcaag

SEQ ID NO: 948690 - DNA, 25 bp, Mus musculus
ggataacaaggatctgttcagcaag

SEQ ID NO: 948691 - DNA, 25 bp, Mus musculus
ggataacctgcaccacctatacaac

SEQ ID NO: 948692 - DNA, 25 bp, Mus musculus
ggataacctgcagcacctatacaac

SEQ ID NO: 948693 - DNA, 25 bp, Mus musculus
ggataactacaaagttcagctggcg

SEQ ID NO: 948694 - DNA, 25 bp, Mus musculus
ggataactacaatgttcagctggcg

SEQ ID NO: 948695 - DNA, 25 bp, Mus musculus
ggataactgggacgatgagccccaa

SEQ ID NO: 948696 - DNA, 25 bp, Mus musculus
ggataactgggaggatgagccccaa

SEQ ID NO: 948697 - DNA, 25 bp, Mus musculus
ggataagaccatcacattatgggac

SEQ ID NO: 948698 - DNA, 25 bp, Mus musculus
ggataagaccatcagattatgggac

SEQ ID NO: 948699 - DNA, 25 bp, Mus musculus
ggataagacgaacgttcttcagtgg

SEQ ID NO: 948700 - DNA, 25 bp, Mus musculus
ggataagacgaaggttcttcagtgg

SEQ ID NO: 948701 - DNA, 25 bp, Mus musculus
ggataagattgacaacctagctagc

SEQ ID NO: 948702 - DNA, 25 bp, Mus musculus
ggataagattgagaacctagctagc

SEQ ID NO: 948703 - DNA, 25 bp, Mus musculus
ggataatccacacaacctgccttca

SEQ ID NO: 948704 - DNA, 25 bp, Mus musculus
ggataatccacagaacctgccttca

SEQ ID NO: 948705 - DNA, 25 bp, Mus musculus
ggataattggcctgtggaagcagga

SEQ ID NO: 948706 - DNA, 25 bp, Mus musculus
ggataattgggctgtggaagcagga

SEQ ID NO: 948707 - DNA, 25 bp, Mus musculus
ggatacagagatacttcaccattgt

SEQ ID NO: 948708 - DNA, 25 bp, Mus musculus
ggatacagagattcttcaccattgt

SEQ ID NO: 948709 - DNA, 25 bp, Mus musculus
ggatacagtgcactgccatttttga

SEQ ID NO: 948710 - DNA, 25 bp, Mus musculus
ggatacagtggactgccatttttga

SEQ ID NO: 948711 - DNA, 25 bp, Mus musculus
ggataccagtggccttcccgaggag

SEQ ID NO: 948712 - DNA, 25 bp, Mus musculus
ggataccagtgggcttcccgaggag

SEQ ID NO: 948713 - DNA, 25 bp, Mus musculus
ggatacccaccccacggcaggaatg

SEQ ID NO: 948714 - DNA, 25 bp, Mus musculus
ggatacccaccccagggcaggaatg

SEQ ID NO: 948715 - DNA, 25 bp, Mus musculus
ggatacccagattgcagatggcgtc

SEQ ID NO: 948716 - DNA, 25 bp, Mus musculus
ggatacccagtttgcagatggcgtc

SEQ ID NO: 948717 - DNA, 25 bp, Mus musculus
ggataccctgatctaatcgttggat

SEQ ID NO: 948718 - DNA, 25 bp, Mus musculus
ggataccctgttctaatcgttggat

SEQ ID NO: 948719 - DNA, 25 bp, Mus musculus
ggataccgcaaactgcaacaggtga

SEQ ID NO: 948720 - DNA, 25 bp, Mus musculus
ggataccgcaaagtgcaacaggtga

SEQ ID NO: 948721 - DNA, 25 bp, Mus musculus
ggatacgaacgtcgatgaggctgta

SEQ ID NO: 948722 - DNA, 25 bp, Mus musculus
ggatacgaacgtggatgaggctgta

SEQ ID NO: 948723 - DNA, 25 bp, Mus musculus
ggatacgatgagcggatcctttcag

SEQ ID NO: 948724 - DNA, 25 bp, Mus musculus
ggatacgatgaggggatcctttcag

SEQ ID NO: 948725 - DNA, 25 bp, Mus musculus
ggatactacctgattactatagccc

SEQ ID NO: 948726 - DNA, 25 bp, Mus musculus
ggatactacctgtttactatagccc

SEQ ID NO: 948727 - DNA, 25 bp, Mus musculus
ggatactatcgccaaatacctggac

SEQ ID NO: 948728 - DNA, 25 bp, Mus musculus
ggatactatcgccatatacctggac

SEQ ID NO: 948729 - DNA, 25 bp, Mus musculus
ggatactatgaatataacaggcaat

SEQ ID NO: 948730 - DNA, 25 bp, Mus musculus
ggatactatgtatataacaggcaat

SEQ ID NO: 948731 - DNA, 25 bp, Mus musculus
ggatagaaccatcaggctgcagctg

SEQ ID NO: 948732 - DNA, 25 bp, Mus musculus
ggatagaaccctgcgattgcaatta

SEQ ID NO: 948733 - DNA, 25 bp, Mus musculus
ggatagaaccgtgcgattgcaatta

SEQ ID NO: 948734 - DNA, 25 bp, Mus musculus
ggatagaaccttcaggctgcagctg

SEQ ID NO: 948735 - DNA, 25 bp, Mus musculus
ggatagatatcccgaactatgtgct

SEQ ID NO: 948736 - DNA, 25 bp, Mus musculus
ggatagatatccggaactatgtgct

SEQ ID NO: 948737 - DNA, 25 bp, Mus musculus
ggatagtaagctgaacatcattccc

SEQ ID NO: 948738 - DNA, 25 bp, Mus musculus
ggatagtaaggtgaacatcattccc

SEQ ID NO: 948739 - DNA, 25 bp, Mus musculus
ggatagtgctgaagcggcatctgaa

SEQ ID NO: 948740 - DNA, 25 bp, Mus musculus
ggatagtgctgatgcggcatctgaa

SEQ ID NO: 948741 - DNA, 25 bp, Mus musculus
ggatatccgtggactgggtcacgcc

SEQ ID NO: 948742 - DNA, 25 bp, Mus musculus
ggatatccgtggtctgggtcacgcc

SEQ ID NO: 948743 - DNA, 25 bp, Mus musculus
ggatatccttaacgatcggggcttc

SEQ ID NO: 948744 - DNA, 25 bp, Mus musculus
ggatatccttaaggatcggggcttc

SEQ ID NO: 948745 - DNA, 25 bp, Mus musculus
ggatatcgacctgatcatgggtggc

SEQ ID NO: 948746 - DNA, 25 bp, Mus musculus
ggatatcgacgtgatcatgggtggc

SEQ ID NO: 948747 - DNA, 25 bp, Mus musculus
ggatatcgagcctgaagtccctgct

SEQ ID NO: 948748 - DNA, 25 bp, Mus musculus
ggatatcgaggctgaagtccctgct

SEQ ID NO: 948749 - DNA, 25 bp, Mus musculus
ggatatcttggaaacgttcacagag

SEQ ID NO: 948750 - DNA, 25 bp, Mus musculus
ggatatcttggaaaggttcacagag

SEQ ID NO: 948751 - DNA, 25 bp, Mus musculus
ggatatgaagcggctgaagaggagt

SEQ ID NO: 948752 - DNA, 25 bp, Mus musculus
ggatatgaaggggctgaagaggagt

SEQ ID NO: 948753 - DNA, 25 bp, Mus musculus
ggatatgacagaagtctgcgtggtg

SEQ ID NO: 948754 - DNA, 25 bp, Mus musculus
ggatatgacagatgtctgcgtggtg

SEQ ID NO: 948755 - DNA, 25 bp, Mus musculus
ggatatgacgatcccaagcggtact

SEQ ID NO: 948756 - DNA, 25 bp, Mus musculus
ggatatgacgatgccaagcggtact

SEQ ID NO: 948757 - DNA, 25 bp, Mus musculus
ggatatgagaagacaaactacaact

SEQ ID NO: 948758 - DNA, 25 bp, Mus musculus
ggatatgagaagtcaaactacaact

SEQ ID NO: 948759 - DNA, 25 bp, Mus musculus
ggatatgcagctgtgcccctggccg

SEQ ID NO: 948760 - DNA, 25 bp, Mus musculus
ggatatgcaggtgtgcccctggccg

SEQ ID NO: 948761 - DNA, 25 bp, Mus musculus
ggatatgttgatgtagccgttggtg

SEQ ID NO: 948762 - DNA, 25 bp, Mus musculus
ggatatgttgttgtagccgttggtg

SEQ ID NO: 948763 - DNA, 25 bp, Mus musculus
ggatattattccaggaggtgtccca

SEQ ID NO: 948764 - DNA, 25 bp, Mus musculus
ggatattattcctggaggtgtccca

SEQ ID NO: 948765 - DNA, 25 bp, Mus musculus
ggatattggacgagccatcctccag

SEQ ID NO: 948766 - DNA, 25 bp, Mus musculus
ggatattggacgtgccatcctccag

SEQ ID NO: 948767 - DNA, 25 bp, Mus musculus
ggatattttcagctgaaccagaaca

SEQ ID NO: 948768 - DNA, 25 bp, Mus musculus
ggatattttcaggtgaaccagaaca

SEQ ID NO: 948769 - DNA, 25 bp, Mus musculus
ggatcaaaagctccctggtatgatt

SEQ ID NO: 948770 - DNA, 25 bp, Mus musculus
ggatcaaaagctgcctggtatgatt

SEQ ID NO: 948771 - DNA, 25 bp, Mus musculus
ggatcaaagcctcggacgtatgtga

SEQ ID NO: 948772 - DNA, 25 bp, Mus musculus
ggatcaaagcctgggacgtatgtga

SEQ ID NO: 948773 - DNA, 25 bp, Mus musculus
ggatcaaaggtcaacacaatctgat

SEQ ID NO: 948774 - DNA, 25 bp, Mus musculus
ggatcaaaggtcaagacaatctgat

SEQ ID NO: 948775 - DNA, 25 bp, Mus musculus
ggatcaacaagacacgttgtcctcc

SEQ ID NO: 948776 - DNA, 25 bp, Mus musculus
ggatcaacaagacaggttgtcctcc

SEQ ID NO: 948777 - DNA, 25 bp, Mus musculus
ggatcaagagagctgacgtgttgct

SEQ ID NO: 948778 - DNA, 25 bp, Mus musculus
ggatcaagagaggtgacgtgttgct

SEQ ID NO: 948779 - DNA, 25 bp, Mus musculus
ggatcacagaagctccctagcagga

SEQ ID NO: 948780 - DNA, 25 bp, Mus musculus
ggatcacagaaggtccctagcagga

SEQ ID NO: 948781 - DNA, 25 bp, Mus musculus
ggatcagattcgagcgaaattcttt

SEQ ID NO: 948782 - DNA, 25 bp, Mus musculus
ggatcagattcgagggaaattcttt

SEQ ID NO: 948783 - DNA, 25 bp, Mus musculus
ggatcagtgtatcacgatgatgctg

SEQ ID NO: 948784 - DNA, 25 bp, Mus musculus
ggatcagtgtatcaggatgatgctg

SEQ ID NO: 948785 - DNA, 25 bp, Mus musculus
ggatccaacgacaatcagcgccttg

SEQ ID NO: 948786 - DNA, 25 bp, Mus musculus
ggatccaacgacattgatacactaa

SEQ ID NO: 948787 - DNA, 25 bp, Mus musculus
ggatccaacgactatcagcgccttg

SEQ ID NO: 948788 - DNA, 25 bp, Mus musculus
ggatccaacgactttgatacactaa

SEQ ID NO: 948789 - DNA, 25 bp, Mus musculus
ggatccaactcaaatattgatctgc

SEQ ID NO: 948790 - DNA, 25 bp, Mus musculus
ggatccaactcatatattgatctgc

SEQ ID NO: 948791 - DNA, 25 bp, Mus musculus
ggatccagggagcaaaggatatgtt

SEQ ID NO: 948792 - DNA, 25 bp, Mus musculus
ggatccagggaggaaaggatatgtt

SEQ ID NO: 948793 - DNA, 25 bp, Mus musculus
ggatcccaaattcacggagtggcac

SEQ ID NO: 948794 - DNA, 25 bp, Mus musculus
ggatcccaaattcagggagtggcac

SEQ ID NO: 948795 - DNA, 25 bp, Mus musculus
ggatcccactcatgccaagtatcac

SEQ ID NO: 948796 - DNA, 25 bp, Mus musculus
ggatcccactgatgccaagtatcac

SEQ ID NO: 948797 - DNA, 25 bp, Mus musculus
ggatcccagcgaaaagcccattgga

SEQ ID NO: 948798 - DNA, 25 bp, Mus musculus
ggatcccagcgataagcccattgga

SEQ ID NO: 948799 - DNA, 25 bp, Mus musculus
ggatccccagatctggaatggactc

SEQ ID NO: 948800 - DNA, 25 bp, Mus musculus
ggatccccagcctgcccttggggcc

SEQ ID NO: 948801 - DNA, 25 bp, Mus musculus
ggatccccaggctgcccttggggcc

SEQ ID NO: 948802 - DNA, 25 bp, Mus musculus
ggatccccagttctggaatggactc

SEQ ID NO: 948803 - DNA, 25 bp, Mus musculus
ggatcccctagacccccagaaactt

SEQ ID NO: 948804 - DNA, 25 bp, Mus musculus
ggatcccctagagccccagaaactt

SEQ ID NO: 948805 - DNA, 25 bp, Mus musculus
ggatccctggcctcgggcgatatgg

SEQ ID NO: 948806 - DNA, 25 bp, Mus musculus
ggatccctgggctcgggcgatatgg

SEQ ID NO: 948807 - DNA, 25 bp, Mus musculus
ggatccctttggctcctgcgcttca

SEQ ID NO: 948808 - DNA, 25 bp, Mus musculus
ggatccctttggcttcacactcgct

SEQ ID NO: 948809 - DNA, 25 bp, Mus musculus
ggatccctttgggtcctgcgcttca

SEQ ID NO: 948810 - DNA, 25 bp, Mus musculus
ggatccctttgggttcacactcgct

SEQ ID NO: 948811 - DNA, 25 bp, Mus musculus
ggatccgaccaccacgctacctcat

SEQ ID NO: 948812 - DNA, 25 bp, Mus musculus
ggatccgaccaccaggctacctcat

SEQ ID NO: 948813 - DNA, 25 bp, Mus musculus
ggatccgcaacacagcgtggtgatg

SEQ ID NO: 948814 - DNA, 25 bp, Mus musculus
ggatccgcaacaccgtggtgatgag

SEQ ID NO: 948815 - DNA, 25 bp, Mus musculus
ggatccgcaacagagcgtggtgatg

SEQ ID NO: 948816 - DNA, 25 bp, Mus musculus
ggatccgcaacagcgtggtgatgag

SEQ ID NO: 948817 - DNA, 25 bp, Mus musculus
ggatcctccagtctctccagaacaa

SEQ ID NO: 948818 - DNA, 25 bp, Mus musculus
ggatcctccagtgtctccagaacaa

SEQ ID NO: 948819 - DNA, 25 bp, Mus musculus
ggatcctccgagagttctgtccttg

SEQ ID NO: 948820 - DNA, 25 bp, Mus musculus
ggatcctccgagtgttctgtccttg

SEQ ID NO: 948821 - DNA, 25 bp, Mus musculus
ggatcctcgatacaccacagaactc

SEQ ID NO: 948822 - DNA, 25 bp, Mus musculus
ggatcctcgatacagcacagaactc

SEQ ID NO: 948823 - DNA, 25 bp, Mus musculus
ggatcctgagccacgctgttgcgct

SEQ ID NO: 948824 - DNA, 25 bp, Mus musculus
ggatcctgaggcacgctgttgcgct

SEQ ID NO: 948825 - DNA, 25 bp, Mus musculus
ggatcctgcagtcggtcctggtggt

SEQ ID NO: 948826 - DNA, 25 bp, Mus musculus
ggatcctgcagtgggtcctggtggt

SEQ ID NO: 948827 - DNA, 25 bp, Mus musculus
ggatcctggcctcacgtgacaacca

SEQ ID NO: 948828 - DNA, 25 bp, Mus musculus
ggatcctggcctcaggtgacaacca

SEQ ID NO: 948829 - DNA, 25 bp, Mus musculus
ggatcctgtgacaacgcctgaagaa

SEQ ID NO: 948830 - DNA, 25 bp, Mus musculus
ggatcctgtgacaaggcctgaagaa

SEQ ID NO: 948831 - DNA, 25 bp, Mus musculus
ggatcctgtgacaggcgactacgtg

SEQ ID NO: 948832 - DNA, 25 bp, Mus musculus
ggatcctgtgactggcgactacgtg

SEQ ID NO: 948833 - DNA, 25 bp, Mus musculus
ggatcgacatctgcaatgaagacat

SEQ ID NO: 948834 - DNA, 25 bp, Mus musculus
ggatcgacatgtgcaatgaagacat

SEQ ID NO: 948835 - DNA, 25 bp, Mus musculus
ggatcgactgctacatggacttctt

SEQ ID NO: 948836 - DNA, 25 bp, Mus musculus
ggatcgactggtacatggacttctt

SEQ ID NO: 948837 - DNA, 25 bp, Mus musculus
ggatcgagagaaagtgcaacagtat

SEQ ID NO: 948838 - DNA, 25 bp, Mus musculus
ggatcgagagccattcgaggagact

SEQ ID NO: 948839 - DNA, 25 bp, Mus musculus
ggatcgagagcgtctgtcctgtgca

SEQ ID NO: 948840 - DNA, 25 bp, Mus musculus
ggatcgagaggcattcgaggagact

SEQ ID NO: 948841 - DNA, 25 bp, Mus musculus
ggatcgagagggtctgtcctgtgca

SEQ ID NO: 948842 - DNA, 25 bp, Mus musculus
ggatcgagagtaagtgcaacagtat

SEQ ID NO: 948843 - DNA, 25 bp, Mus musculus
ggatcgagttaacgatctctatagt

SEQ ID NO: 948844 - DNA, 25 bp, Mus musculus
ggatcgagttaaggatctctatagt

SEQ ID NO: 948845 - DNA, 25 bp, Mus musculus
ggatcgatgcaaatcccaggaggca

SEQ ID NO: 948846 - DNA, 25 bp, Mus musculus
ggatcgatgcaattcccaggaggca

SEQ ID NO: 948847 - DNA, 25 bp, Mus musculus
ggatcgcctgcacagaggaagacga

SEQ ID NO: 948848 - DNA, 25 bp, Mus musculus
ggatcgcctgcacggtgagttggtg

SEQ ID NO: 948849 - DNA, 25 bp, Mus musculus
ggatcgcctgcagagaggaagacga

SEQ ID NO: 948850 - DNA, 25 bp, Mus musculus
ggatcgcctgcagggtgagttggtg

SEQ ID NO: 948851 - DNA, 25 bp, Mus musculus
ggatcgctcgacagacattgtgaaa

SEQ ID NO: 948852 - DNA, 25 bp, Mus musculus
ggatcgctcgtcagacattgtgaaa

SEQ ID NO: 948853 - DNA, 25 bp, Mus musculus
ggatcggagccgcaccagttgcccc

SEQ ID NO: 948854 - DNA, 25 bp, Mus musculus
ggatcggagccgcagcagttgcccc

SEQ ID NO: 948855 - DNA, 25 bp, Mus musculus
ggatcggcatagcctgcaggtgtat

SEQ ID NO: 948856 - DNA, 25 bp, Mus musculus
ggatcggcattgcctgcaggtgtat

SEQ ID NO: 948857 - DNA, 25 bp, Mus musculus
ggatcggcggatcattacagcatca

SEQ ID NO: 948858 - DNA, 25 bp, Mus musculus
ggatcggcggttcattacagcatca

SEQ ID NO: 948859 - DNA, 25 bp, Mus musculus
ggatcgggatgtggccccaactccc

SEQ ID NO: 948860 - DNA, 25 bp, Mus musculus
ggatcgggatgtgggcccaactccc

SEQ ID NO: 948861 - DNA, 25 bp, Mus musculus
ggatcggttacacacactgaccaga

SEQ ID NO: 948862 - DNA, 25 bp, Mus musculus
ggatcggttacagacactgaccaga

SEQ ID NO: 948863 - DNA, 25 bp, Mus musculus
ggatctacaaagaattatcaagaaa

SEQ ID NO: 948864 - DNA, 25 bp, Mus musculus
ggatctacaaagtattatcaagaaa

SEQ ID NO: 948865 - DNA, 25 bp, Mus musculus
ggatctactcctcacctggaatttt

SEQ ID NO: 948866 - DNA, 25 bp, Mus musculus
ggatctactcctcagctggaatttt

SEQ ID NO: 948867 - DNA, 25 bp, Mus musculus
ggatctactgagggcccagccacgg

SEQ ID NO: 948868 - DNA, 25 bp, Mus musculus
ggatctactgcttctgcagtacagc

SEQ ID NO: 948869 - DNA, 25 bp, Mus musculus
ggatctactggttctgcagtacagc

SEQ ID NO: 948870 - DNA, 25 bp, Mus musculus
ggatctactgtgggcccagccacgg

SEQ ID NO: 948871 - DNA, 25 bp, Mus musculus
ggatctagaaaactcaagagaagag

SEQ ID NO: 948872 - DNA, 25 bp, Mus musculus
ggatctagaaaagtcaagagaagag

SEQ ID NO: 948873 - DNA, 25 bp, Mus musculus
ggatctagtcccagatttgagtaac

SEQ ID NO: 948874 - DNA, 25 bp, Mus musculus
ggatctagtccctgatttgagtaac

SEQ ID NO: 948875 - DNA, 25 bp, Mus musculus
ggatctcacaaccggcaccaccaca

SEQ ID NO: 948876 - DNA, 25 bp, Mus musculus
ggatctcacaacgggcaccaccaca

SEQ ID NO: 948877 - DNA, 25 bp, Mus musculus
ggatctcaggccatgcccaagagaa

SEQ ID NO: 948878 - DNA, 25 bp, Mus musculus
ggatctcagggcatgcccaagagaa

SEQ ID NO: 948879 - DNA, 25 bp, Mus musculus
ggatctccttccaaagaggatttgt

SEQ ID NO: 948880 - DNA, 25 bp, Mus musculus
ggatctccttccaatgaggatttgt

SEQ ID NO: 948881 - DNA, 25 bp, Mus musculus
ggatctgaagaacgcgtatggcttt

SEQ ID NO: 948882 - DNA, 25 bp, Mus musculus
ggatctgaagaacgctctgttatgt

SEQ ID NO: 948883 - DNA, 25 bp, Mus musculus
ggatctgaagaacgggtatggcttt

SEQ ID NO: 948884 - DNA, 25 bp, Mus musculus
ggatctgaagaacggtctgttatgt

SEQ ID NO: 948885 - DNA, 25 bp, Mus musculus
ggatctgaataactgcggacctatg

SEQ ID NO: 948886 - DNA, 25 bp, Mus musculus
ggatctgaataagtgcggacctatg

SEQ ID NO: 948887 - DNA, 25 bp, Mus musculus
ggatctgcagaaattagtcttgaca

SEQ ID NO: 948888 - DNA, 25 bp, Mus musculus
ggatctgcagagctcagtcagaagg

SEQ ID NO: 948889 - DNA, 25 bp, Mus musculus
ggatctgcagaggtcagtcagaagg

SEQ ID NO: 948890 - DNA, 25 bp, Mus musculus
ggatctgcagtaattagtcttgaca

SEQ ID NO: 948891 - DNA, 25 bp, Mus musculus
ggatctgccactgtgcccctggatt

SEQ ID NO: 948892 - DNA, 25 bp, Mus musculus
ggatctgccagtgtgcccctggatt

SEQ ID NO: 948893 - DNA, 25 bp, Mus musculus
ggatctggcgacatcatatttgaag

SEQ ID NO: 948894 - DNA, 25 bp, Mus musculus
ggatctggcgacatgatatttgaag

SEQ ID NO: 948895 - DNA, 25 bp, Mus musculus
ggatctggtgaagacctacggacat

SEQ ID NO: 948896 - DNA, 25 bp, Mus musculus
ggatctggtgaagagctacggacat

SEQ ID NO: 948897 - DNA, 25 bp, Mus musculus
ggatctgttggctaatggcgatttg

SEQ ID NO: 948898 - DNA, 25 bp, Mus musculus
ggatctgttggctattggcgatttg

SEQ ID NO: 948899 - DNA, 25 bp, Mus musculus
ggatcttacccaaaccccacctgga

SEQ ID NO: 948900 - DNA, 25 bp, Mus musculus
ggatcttacccaaagcccacctgga

SEQ ID NO: 948901 - DNA, 25 bp, Mus musculus
ggatcttaggaactgtctctcttaa

SEQ ID NO: 948902 - DNA, 25 bp, Mus musculus
ggatcttaggaagtgtctctcttaa

SEQ ID NO: 948903 - DNA, 25 bp, Mus musculus
ggatcttcaacacaggtgtgtgatg

SEQ ID NO: 948904 - DNA, 25 bp, Mus musculus
ggatcttcaacactgtgtgatgtga

SEQ ID NO: 948905 - DNA, 25 bp, Mus musculus
ggatcttcaacagaggtgtgtgatg

SEQ ID NO: 948906 - DNA, 25 bp, Mus musculus
ggatcttcaacagtgtgtgatgtga

SEQ ID NO: 948907 - DNA, 25 bp, Mus musculus
ggatcttcgtactacaggctgctgt

SEQ ID NO: 948908 - DNA, 25 bp, Mus musculus
ggatcttcgtactacctcacttcat

SEQ ID NO: 948909 - DNA, 25 bp, Mus musculus
ggatcttcgtactacctcctggact

SEQ ID NO: 948910 - DNA, 25 bp, Mus musculus
ggatcttcgtactagaggctgctgt

SEQ ID NO: 948911 - DNA, 25 bp, Mus musculus
ggatcttcgtactagctcacttcat

SEQ ID NO: 948912 - DNA, 25 bp, Mus musculus
ggatcttcgtactagctcctggact

SEQ ID NO: 948913 - DNA, 25 bp, Mus musculus
ggatcttcttaacgagagcgattca

SEQ ID NO: 948914 - DNA, 25 bp, Mus musculus
ggatcttcttaaggagagcgattca

SEQ ID NO: 948915 - DNA, 25 bp, Mus musculus
ggatcttgcaacaccatctcggaag

SEQ ID NO: 948916 - DNA, 25 bp, Mus musculus
ggatcttgcaacagaatctgcctgt

SEQ ID NO: 948917 - DNA, 25 bp, Mus musculus
ggatcttgcaactccatctcggaag

SEQ ID NO: 948918 - DNA, 25 bp, Mus musculus
ggatcttgcaactgaatctgcctgt

SEQ ID NO: 948919 - DNA, 25 bp, Mus musculus
ggatctttgcagcttcctggtgtgc

SEQ ID NO: 948920 - DNA, 25 bp, Mus musculus
ggatctttgcaggttcctggtgtgc

SEQ ID NO: 948921 - DNA, 25 bp, Mus musculus
ggatgaaacgctgtcttcattgagg

SEQ ID NO: 948922 - DNA, 25 bp, Mus musculus
ggatgaaacgcttctgtgatgacat

SEQ ID NO: 948923 - DNA, 25 bp, Mus musculus
ggatgaaacggtgtcttcattgagg

SEQ ID NO: 948924 - DNA, 25 bp, Mus musculus
ggatgaaacggttctgtgatgacat

SEQ ID NO: 948925 - DNA, 25 bp, Mus musculus
ggatgaaagacgagtagacatggat

SEQ ID NO: 948926 - DNA, 25 bp, Mus musculus
ggatgaaagacgtgtagacatggat

SEQ ID NO: 948927 - DNA, 25 bp, Mus musculus
ggatgaacaagacctgtactaccaa

SEQ ID NO: 948928 - DNA, 25 bp, Mus musculus
ggatgaacaagagctgtactaccaa

SEQ ID NO: 948929 - DNA, 25 bp, Mus musculus
ggatgaacaatgtacatggtgtgca

SEQ ID NO: 948930 - DNA, 25 bp, Mus musculus
ggatgaacaatgtagatggtgtgca

SEQ ID NO: 948931 - DNA, 25 bp, Mus musculus
ggatgaactcaatccggacaaacct

SEQ ID NO: 948932 - DNA, 25 bp, Mus musculus
ggatgaactcaatcgggacaaacct

SEQ ID NO: 948933 - DNA, 25 bp, Mus musculus
ggatgaactgaagttccttcagctc

SEQ ID NO: 948934 - DNA, 25 bp, Mus musculus
ggatgaactgcgcacgttacatcca

SEQ ID NO: 948935 - DNA, 25 bp, Mus musculus
ggatgaactgcgcaggttacatcca

SEQ ID NO: 948936 - DNA, 25 bp, Mus musculus
ggatgaactgtagttccttcagctc

SEQ ID NO: 948937 - DNA, 25 bp, Mus musculus
ggatgaagcccacgctcatgcacag

SEQ ID NO: 948938 - DNA, 25 bp, Mus musculus
ggatgaagccgacgctcatgcacag

SEQ ID NO: 948939 - DNA, 25 bp, Mus musculus
ggatgaagctgaccaagatggcatt

SEQ ID NO: 948940 - DNA, 25 bp, Mus musculus
ggatgaagctgagcaagatggcatt

SEQ ID NO: 948941 - DNA, 25 bp, Mus musculus
ggatgaaggacaagaccctctggag

SEQ ID NO: 948942 - DNA, 25 bp, Mus musculus
ggatgaaggacatgaccctctggag

SEQ ID NO: 948943 - DNA, 25 bp, Mus musculus
ggatgaagtgctcgattatggctat

SEQ ID NO: 948944 - DNA, 25 bp, Mus musculus
ggatgaagtgctggattatggctat

SEQ ID NO: 948945 - DNA, 25 bp, Mus musculus
ggatgaatattgagttagaacacat

SEQ ID NO: 948946 - DNA, 25 bp, Mus musculus
ggatgaatattgtgttagaacacat

SEQ ID NO: 948947 - DNA, 25 bp, Mus musculus
ggatgaatttcagacggccttcagc

SEQ ID NO: 948948 - DNA, 25 bp, Mus musculus
ggatgaatttcagagggccttcagc

SEQ ID NO: 948949 - DNA, 25 bp, Mus musculus
ggatgacaagctgaaggagttgtgt

SEQ ID NO: 948950 - DNA, 25 bp, Mus musculus
ggatgacaaggtgaaggagttgtgt

SEQ ID NO: 948951 - DNA, 25 bp, Mus musculus
ggatgacaccacctgtcctgtgtgc

SEQ ID NO: 948952 - DNA, 25 bp, Mus musculus
ggatgacaccacgtgtcctgtgtgc

SEQ ID NO: 948953 - DNA, 25 bp, Mus musculus
ggatgaccagagagtgatgtggaga

SEQ ID NO: 948954 - DNA, 25 bp, Mus musculus
ggatgaccagagccccgggcctctg

SEQ ID NO: 948955 - DNA, 25 bp, Mus musculus
ggatgaccagaggcccgggcctctg

SEQ ID NO: 948956 - DNA, 25 bp, Mus musculus
ggatgaccagagtgtgatgtggaga

SEQ ID NO: 948957 - DNA, 25 bp, Mus musculus
ggatgaccagctggcgctgctcagg

SEQ ID NO: 948958 - DNA, 25 bp, Mus musculus
ggatgaccaggtggcgctgctcagg

SEQ ID NO: 948959 - DNA, 25 bp, Mus musculus
ggatgaccctagagtattatacgtg

SEQ ID NO: 948960 - DNA, 25 bp, Mus musculus
ggatgaccctagtgtattatacgtg

SEQ ID NO: 948961 - DNA, 25 bp, Mus musculus
ggatgaccctgacatcgtagctttc

SEQ ID NO: 948962 - DNA, 25 bp, Mus musculus
ggatgaccctgagatcgtagctttc

SEQ ID NO: 948963 - DNA, 25 bp, Mus musculus
ggatgacgaagtcaatcgcatgcac

SEQ ID NO: 948964 - DNA, 25 bp, Mus musculus
ggatgacgaagtgaatcgcatgcac

SEQ ID NO: 948965 - DNA, 25 bp, Mus musculus
ggatgacgctgaacacttgccccgc

SEQ ID NO: 948966 - DNA, 25 bp, Mus musculus
ggatgacgctgatcacttgccccgc

SEQ ID NO: 948967 - DNA, 25 bp, Mus musculus
ggatgactgaaaactacttaaaatt

SEQ ID NO: 948968 - DNA, 25 bp, Mus musculus
ggatgactgaaatctacttaaaatt

SEQ ID NO: 948969 - DNA, 25 bp, Mus musculus
ggatgactggagcgagtttcgaact

SEQ ID NO: 948970 - DNA, 25 bp, Mus musculus
ggatgactggagggagtttcgaact

SEQ ID NO: 948971 - DNA, 25 bp, Mus musculus
ggatgacttccgctgggctttgagt

SEQ ID NO: 948972 - DNA, 25 bp, Mus musculus
ggatgacttccggtgggctttgagt

SEQ ID NO: 948973 - DNA, 25 bp, Mus musculus
ggatgagaagaagaagctggcagag

SEQ ID NO: 948974 - DNA, 25 bp, Mus musculus
ggatgagaagaagatgctggcagag

SEQ ID NO: 948975 - DNA, 25 bp, Mus musculus
ggatgagagctacgcatatgttcta

SEQ ID NO: 948976 - DNA, 25 bp, Mus musculus
ggatgagagctacggatatgttcta

SEQ ID NO: 948977 - DNA, 25 bp, Mus musculus
ggatgagaggcaggagaagagacga

SEQ ID NO: 948978 - DNA, 25 bp, Mus musculus
ggatgagagggaggagaagagacga

SEQ ID NO: 948979 - DNA, 25 bp, Mus musculus
ggatgagagtaacatctcgttttat

SEQ ID NO: 948980 - DNA, 25 bp, Mus musculus
ggatgagagtaagatctcgttttat

SEQ ID NO: 948981 - DNA, 25 bp, Mus musculus
ggatgaggagaacaacgagaacgac

SEQ ID NO: 948982 - DNA, 25 bp, Mus musculus
ggatgaggagatcaaccgcatgcat

SEQ ID NO: 948983 - DNA, 25 bp, Mus musculus
ggatgaggagatgaaccgcatgcat

SEQ ID NO: 948984 - DNA, 25 bp, Mus musculus
ggatgaggagtacaacgagaacgac

SEQ ID NO: 948985 - DNA, 25 bp, Mus musculus
ggatgaggtcagatatgggggcttc

SEQ ID NO: 948986 - DNA, 25 bp, Mus musculus
ggatgaggtcagttatgggggcttc

SEQ ID NO: 948987 - DNA, 25 bp, Mus musculus
ggatgagtgttttactgcgagtcct

SEQ ID NO: 948988 - DNA, 25 bp, Mus musculus
ggatgagtgttttagtgcgagtcct

SEQ ID NO: 948989 - DNA, 25 bp, Mus musculus
ggatgagtttaacacacagagtgtg

SEQ ID NO: 948990 - DNA, 25 bp, Mus musculus
ggatgagtttaagacacagagtgtg

SEQ ID NO: 948991 - DNA, 25 bp, Mus musculus
ggatgataacacagaagtaatccct

SEQ ID NO: 948992 - DNA, 25 bp, Mus musculus
ggatgataacactgaagtaatccct

SEQ ID NO: 948993 - DNA, 25 bp, Mus musculus
ggatgatattggagatgtaaccatt

SEQ ID NO: 948994 - DNA, 25 bp, Mus musculus
ggatgatattggctttgatctgtgg

SEQ ID NO: 948995 - DNA, 25 bp, Mus musculus
ggatgatattgggtttgatctgtgg

SEQ ID NO: 948996 - DNA, 25 bp, Mus musculus
ggatgatattggtgatgtaaccatt

SEQ ID NO: 948997 - DNA, 25 bp, Mus musculus
ggatgatctacactactcgttatgg

SEQ ID NO: 948998 - DNA, 25 bp, Mus musculus
ggatgatctacagtactcgttatgg

SEQ ID NO: 948999 - DNA, 25 bp, Mus musculus
ggatgatgagcagatggggggtttg

SEQ ID NO: 949000 - DNA, 25 bp, Mus musculus
ggatgatgagcatgacgatgtggac

SEQ ID NO: 949001 - DNA, 25 bp, Mus musculus
ggatgatgaggagatggggggtttg

SEQ ID NO: 949002 - DNA, 25 bp, Mus musculus
ggatgatgaggatgacgatgtggac

SEQ ID NO: 949003 - DNA, 25 bp, Mus musculus
ggatgatgcactaaaaagaatctct

SEQ ID NO: 949004 - DNA, 25 bp, Mus musculus
ggatgatgcagtaaaaagaatctct

SEQ ID NO: 949005 - DNA, 25 bp, Mus musculus
ggatgcacagcagtatgagttcacc

SEQ ID NO: 949006 - DNA, 25 bp, Mus musculus
ggatgcacaggagtatgagttcacc

SEQ ID NO: 949007 - DNA, 25 bp, Mus musculus
ggatgcagtgctgaatgtgatgcag

SEQ ID NO: 949008 - DNA, 25 bp, Mus musculus
ggatgcagtggtgaatgtgatgcag

SEQ ID NO: 949009 - DNA, 25 bp, Mus musculus
ggatgcagtgtaaacattgcaaatt

SEQ ID NO: 949010 - DNA, 25 bp, Mus musculus
ggatgcagtgtaaagattgcaaatt

SEQ ID NO: 949011 - DNA, 25 bp, Mus musculus
ggatgccaataacgctgtggaagaa

SEQ ID NO: 949012 - DNA, 25 bp, Mus musculus
ggatgccaataaggctgtggaagaa

SEQ ID NO: 949013 - DNA, 25 bp, Mus musculus
ggatgccatattctttccatccttt

SEQ ID NO: 949014 - DNA, 25 bp, Mus musculus
ggatgccatattgtttccatccttt

SEQ ID NO: 949015 - DNA, 25 bp, Mus musculus
ggatgccatcagctctctggcttct

SEQ ID NO: 949016 - DNA, 25 bp, Mus musculus
ggatgccatcaggtctctggcttct

SEQ ID NO: 949017 - DNA, 25 bp, Mus musculus
ggatgccatgaatccaagcaaaaat

SEQ ID NO: 949018 - DNA, 25 bp, Mus musculus
ggatgccatggccaaaatccaagca

SEQ ID NO: 949019 - DNA, 25 bp, Mus musculus
ggatgccatggccataatccaagca

SEQ ID NO: 949020 - DNA, 25 bp, Mus musculus
ggatgccatgtatccaagcaaaaat

SEQ ID NO: 949021 - DNA, 25 bp, Mus musculus
ggatgcccagactcaacgcaaagac

SEQ ID NO: 949022 - DNA, 25 bp, Mus musculus
ggatgcccagtctcaacgcaaagac

SEQ ID NO: 949023 - DNA, 25 bp, Mus musculus
ggatgcccctaacacccacggtcag

SEQ ID NO: 949024 - DNA, 25 bp, Mus musculus
ggatgcccctaacagccacggtcag

SEQ ID NO: 949025 - DNA, 25 bp, Mus musculus
ggatgcctcggccgtgttcacctac

SEQ ID NO: 949026 - DNA, 25 bp, Mus musculus
ggatgcctcggcggtgttcacctac

SEQ ID NO: 949027 - DNA, 25 bp, Mus musculus
ggatgcctgctacttcccagcacag

SEQ ID NO: 949028 - DNA, 25 bp, Mus musculus
ggatgcctgctagttcccagcacag

SEQ ID NO: 949029 - DNA, 25 bp, Mus musculus
ggatgcgcggcccaaccgagcagct

SEQ ID NO: 949030 - DNA, 25 bp, Mus musculus
ggatgcgcggccgaaccgagcagct

SEQ ID NO: 949031 - DNA, 25 bp, Mus musculus
ggatgcgtctagctcttccaagttg

SEQ ID NO: 949032 - DNA, 25 bp, Mus musculus
ggatgcgtctaggtcttccaagttg

SEQ ID NO: 949033 - DNA, 25 bp, Mus musculus
ggatgctaaccactgctgcactagc

SEQ ID NO: 949034 - DNA, 25 bp, Mus musculus
ggatgctaaccagtgctgcactagc

SEQ ID NO: 949035 - DNA, 25 bp, Mus musculus
ggatgctacggacgtgccttagctg

SEQ ID NO: 949036 - DNA, 25 bp, Mus musculus
ggatgctacggaggtgccttagctg

SEQ ID NO: 949037 - DNA, 25 bp, Mus musculus
ggatgctactcacggccacgtggtg

SEQ ID NO: 949038 - DNA, 25 bp, Mus musculus
ggatgctactcacgggcagttggtg

SEQ ID NO: 949039 - DNA, 25 bp, Mus musculus
ggatgctactcagggccacgtggtg

SEQ ID NO: 949040 - DNA, 25 bp, Mus musculus
ggatgctactcaggggcagttggtg

SEQ ID NO: 949041 - DNA, 25 bp, Mus musculus
ggatgctatcccaatgtgtgcgacg

SEQ ID NO: 949042 - DNA, 25 bp, Mus musculus
ggatgctatcgcaatgtgtgcgacg

SEQ ID NO: 949043 - DNA, 25 bp, Mus musculus
ggatgctattaacagaggctatgat

SEQ ID NO: 949044 - DNA, 25 bp, Mus musculus
ggatgctattaagagaggctatgat

SEQ ID NO: 949045 - DNA, 25 bp, Mus musculus
ggatgctcaacgacagtgctatgct

SEQ ID NO: 949046 - DNA, 25 bp, Mus musculus
ggatgctcaaggacagtgctatgct

SEQ ID NO: 949047 - DNA, 25 bp, Mus musculus
ggatgctcagcgaggacccgtggag

SEQ ID NO: 949048 - DNA, 25 bp, Mus musculus
ggatgctcagggaggacccgtggag

SEQ ID NO: 949049 - DNA, 25 bp, Mus musculus
ggatgctgaaggaacgtgtgcgcct

SEQ ID NO: 949050 - DNA, 25 bp, Mus musculus
ggatgctgaaggaaggtgtgcgcct

SEQ ID NO: 949051 - DNA, 25 bp, Mus musculus
ggatgctgaagtcattcagcccctg

SEQ ID NO: 949052 - DNA, 25 bp, Mus musculus
ggatgctgaagtgattcagcccctg

SEQ ID NO: 949053 - DNA, 25 bp, Mus musculus
ggatgctgagatggtttttgatcat

SEQ ID NO: 949054 - DNA, 25 bp, Mus musculus
ggatgctgagcttggtgatggcacc

SEQ ID NO: 949055 - DNA, 25 bp, Mus musculus
ggatgctgaggttggtgatggcacc

SEQ ID NO: 949056 - DNA, 25 bp, Mus musculus
ggatgctgagttggtttttgatcat

SEQ ID NO: 949057 - DNA, 25 bp, Mus musculus
ggatgctgatggattctctgctctc

SEQ ID NO: 949058 - DNA, 25 bp, Mus musculus
ggatgctgatggtttctctgctctc

SEQ ID NO: 949059 - DNA, 25 bp, Mus musculus
ggatgctgattgcatttgctatcta

SEQ ID NO: 949060 - DNA, 25 bp, Mus musculus
ggatgctgattggatttgctatcta

SEQ ID NO: 949061 - DNA, 25 bp, Mus musculus
ggatgctgcgaacaatcatccagaa

SEQ ID NO: 949062 - DNA, 25 bp, Mus musculus
ggatgctgcgaagaatcatccagaa

SEQ ID NO: 949063 - DNA, 25 bp, Mus musculus
ggatgctggcagctatctgtgtgac

SEQ ID NO: 949064 - DNA, 25 bp, Mus musculus
ggatgctggcaggtatctgtgtgac

SEQ ID NO: 949065 - DNA, 25 bp, Mus musculus
ggatgctgtcggaggctacagatgt

SEQ ID NO: 949066 - DNA, 25 bp, Mus musculus
ggatgctgtcggtggctacagatgt

SEQ ID NO: 949067 - DNA, 25 bp, Mus musculus
ggatgctgtgagacatgcaagaaag

SEQ ID NO: 949068 - DNA, 25 bp, Mus musculus
ggatgctgtgagcacgacagaaaat

SEQ ID NO: 949069 - DNA, 25 bp, Mus musculus
ggatgctgtgaggacgacagaaaat

SEQ ID NO: 949070 - DNA, 25 bp, Mus musculus
ggatgctgtgagtcatgcaagaaag

SEQ ID NO: 949071 - DNA, 25 bp, Mus musculus
ggatgctgtgcatccttagcaaact

SEQ ID NO: 949072 - DNA, 25 bp, Mus musculus
ggatgctgtggatccttagcaaact

SEQ ID NO: 949073 - DNA, 25 bp, Mus musculus
ggatgcttatgaaagcctgtcatcc

SEQ ID NO: 949074 - DNA, 25 bp, Mus musculus
ggatgcttatgatagcctgtcatcc

SEQ ID NO: 949075 - DNA, 25 bp, Mus musculus
ggatggaagcagaactcttcctaat

SEQ ID NO: 949076 - DNA, 25 bp, Mus musculus
ggatggaagcagtactcttcctaat

SEQ ID NO: 949077 - DNA, 25 bp, Mus musculus
ggatggaaggcaagcacttgaagag

SEQ ID NO: 949078 - DNA, 25 bp, Mus musculus
ggatggaaggcatgcacttgaagag

SEQ ID NO: 949079 - DNA, 25 bp, Mus musculus
ggatggacagcaacacccaaggaat

SEQ ID NO: 949080 - DNA, 25 bp, Mus musculus
ggatggacagcagcaacacccaagg

SEQ ID NO: 949081 - DNA, 25 bp, Mus musculus
ggatggacaggaacacccaaggaat

SEQ ID NO: 949082 - DNA, 25 bp, Mus musculus
ggatggacaggagcaacacccaagg

SEQ ID NO: 949083 - DNA, 25 bp, Mus musculus
ggatggaccaagcggtaggtctggt

SEQ ID NO: 949084 - DNA, 25 bp, Mus musculus
ggatggaccaaggggtaggtctggt

SEQ ID NO: 949085 - DNA, 25 bp, Mus musculus
ggatggagacaccctgctccacctg

SEQ ID NO: 949086 - DNA, 25 bp, Mus musculus
ggatggagacacgctgctccacctg

SEQ ID NO: 949087 - DNA, 25 bp, Mus musculus
ggatggagagcgaagccttgctggc

SEQ ID NO: 949088 - DNA, 25 bp, Mus musculus
ggatggagagcttcgggcctgacac

SEQ ID NO: 949089 - DNA, 25 bp, Mus musculus
ggatggagagggaagccttgctggc

SEQ ID NO: 949090 - DNA, 25 bp, Mus musculus
ggatggagaggttcgggcctgacac

SEQ ID NO: 949091 - DNA, 25 bp, Mus musculus
ggatggagccaaacatttctcggga

SEQ ID NO: 949092 - DNA, 25 bp, Mus musculus
ggatggagccaaagaatgaataaaa

SEQ ID NO: 949093 - DNA, 25 bp, Mus musculus
ggatggagccaatcatttctcggga

SEQ ID NO: 949094 - DNA, 25 bp, Mus musculus
ggatggagccaatgaatgaataaaa

SEQ ID NO: 949095 - DNA, 25 bp, Mus musculus
ggatggcaagcacgtggagctggct

SEQ ID NO: 949096 - DNA, 25 bp, Mus musculus
ggatggcaagcaggtggagctggct

SEQ ID NO: 949097 - DNA, 25 bp, Mus musculus
ggatggcaatcgagagtgtggtaac

SEQ ID NO: 949098 - DNA, 25 bp, Mus musculus
ggatggcaatggagagtgtggtaac

SEQ ID NO: 949099 - DNA, 25 bp, Mus musculus
ggatggcactgattcgtgctgtcag

SEQ ID NO: 949100 - DNA, 25 bp, Mus musculus
ggatggcactgattggtgctgtcag

SEQ ID NO: 949101 - DNA, 25 bp, Mus musculus
ggatggcaggctatttatgagcctc

SEQ ID NO: 949102 - DNA, 25 bp, Mus musculus
ggatggcagggtatttatgagcctc

SEQ ID NO: 949103 - DNA, 25 bp, Mus musculus
ggatggccagacgtggggcctgtgc

SEQ ID NO: 949104 - DNA, 25 bp, Mus musculus
ggatggccagcgccccaatcctgaa

SEQ ID NO: 949105 - DNA, 25 bp, Mus musculus
ggatggccagggccccaatcctgaa

SEQ ID NO: 949106 - DNA, 25 bp, Mus musculus
ggatggccagtcgtggggcctgtgc

SEQ ID NO: 949107 - DNA, 25 bp, Mus musculus
ggatggcctcaatgcgtacaagtgt

SEQ ID NO: 949108 - DNA, 25 bp, Mus musculus
ggatggcctcaatgggtacaagtgt

SEQ ID NO: 949109 - DNA, 25 bp, Mus musculus
ggatgggaagcaagagataagaaga

SEQ ID NO: 949110 - DNA, 25 bp, Mus musculus
ggatgggaaggaagagataagaaga

SEQ ID NO: 949111 - DNA, 25 bp, Mus musculus
ggatgggcagctgacattcctgctg

SEQ ID NO: 949112 - DNA, 25 bp, Mus musculus
ggatgggcagctgacgtgtgacttt

SEQ ID NO: 949113 - DNA, 25 bp, Mus musculus
ggatgggcagctgagattcctgctg

SEQ ID NO: 949114 - DNA, 25 bp, Mus musculus
ggatgggcagctgaggtgtgacttt

SEQ ID NO: 949115 - DNA, 25 bp, Mus musculus
ggatggggcgcagccttgaggacca

SEQ ID NO: 949116 - DNA, 25 bp, Mus musculus
ggatggggcggagccttgaggacca

SEQ ID NO: 949117 - DNA, 25 bp, Mus musculus
ggatgggtccttactgtctgctaca

SEQ ID NO: 949118 - DNA, 25 bp, Mus musculus
ggatgggtcctttctgtctgctaca

SEQ ID NO: 949119 - DNA, 25 bp, Mus musculus
ggatggtatgctcatctttggtgtc

SEQ ID NO: 949120 - DNA, 25 bp, Mus musculus
ggatggtatggtcatctttggtgtc

SEQ ID NO: 949121 - DNA, 25 bp, Mus musculus
ggatggtgtagcacatttccttctg

SEQ ID NO: 949122 - DNA, 25 bp, Mus musculus
ggatggtgtagctcatttccttctg

SEQ ID NO: 949123 - DNA, 25 bp, Mus musculus
ggatgtaaagaacagcaaccttcca

SEQ ID NO: 949124 - DNA, 25 bp, Mus musculus
ggatgtaaagaagagcaaccttcca

SEQ ID NO: 949125 - DNA, 25 bp, Mus musculus
ggatgtaatggacgcgcattttgtt

SEQ ID NO: 949126 - DNA, 25 bp, Mus musculus
ggatgtaatggacgggcattttgtt

SEQ ID NO: 949127 - DNA, 25 bp, Mus musculus
ggatgtagagaacgccatcgcccac

SEQ ID NO: 949128 - DNA, 25 bp, Mus musculus
ggatgtagagaaggccatcgcccac

SEQ ID NO: 949129 - DNA, 25 bp, Mus musculus
ggatgtagatgaaacggctgcccca

SEQ ID NO: 949130 - DNA, 25 bp, Mus musculus
ggatgtagatgaaagggctgcccca

SEQ ID NO: 949131 - DNA, 25 bp, Mus musculus
ggatgtatccagcctcacccagact

SEQ ID NO: 949132 - DNA, 25 bp, Mus musculus
ggatgtatccaggctcacccagact

SEQ ID NO: 949133 - DNA, 25 bp, Mus musculus
ggatgtcaagatggtgaagaaagcc

SEQ ID NO: 949134 - DNA, 25 bp, Mus musculus
ggatgtcaagcacggtaatctcccc

SEQ ID NO: 949135 - DNA, 25 bp, Mus musculus
ggatgtcaagcagggtaatctcccc

SEQ ID NO: 949136 - DNA, 25 bp, Mus musculus
ggatgtcaagccggagaacctgctt

SEQ ID NO: 949137 - DNA, 25 bp, Mus musculus
ggatgtcaaggcggagaacctgctt

SEQ ID NO: 949138 - DNA, 25 bp, Mus musculus
ggatgtcaagttggtgaagaaagcc

SEQ ID NO: 949139 - DNA, 25 bp, Mus musculus
ggatgtcacacaatccaattcgctt

SEQ ID NO: 949140 - DNA, 25 bp, Mus musculus
ggatgtcacacaatgcaattcgctt

SEQ ID NO: 949141 - DNA, 25 bp, Mus musculus
ggatgtcacgaagttaaagtctgac

SEQ ID NO: 949142 - DNA, 25 bp, Mus musculus
ggatgtcacgtagttaaagtctgac

SEQ ID NO: 949143 - DNA, 25 bp, Mus musculus
ggatgtcagtcacgggacgtggaac

SEQ ID NO: 949144 - DNA, 25 bp, Mus musculus
ggatgtcagtcaggggacgtggaac

SEQ ID NO: 949145 - DNA, 25 bp, Mus musculus
ggatgtccagacaactacagggcaa

SEQ ID NO: 949146 - DNA, 25 bp, Mus musculus
ggatgtccagtcaactacagggcaa

SEQ ID NO: 949147 - DNA, 25 bp, Mus musculus
ggatgtcctcagccccctgagaccc

SEQ ID NO: 949148 - DNA, 25 bp, Mus musculus
ggatgtcctcaggcccctgagaccc

SEQ ID NO: 949149 - DNA, 25 bp, Mus musculus
ggatgtcgagctacggtcagaatag

SEQ ID NO: 949150 - DNA, 25 bp, Mus musculus
ggatgtcgaggtacggtcagaatag

SEQ ID NO: 949151 - DNA, 25 bp, Mus musculus
ggatgtcgtcaacgctattgtggta

SEQ ID NO: 949152 - DNA, 25 bp, Mus musculus
ggatgtcgtcaaggctattgtggta

SEQ ID NO: 949153 - DNA, 25 bp, Mus musculus
ggatgtctagaacctctaggaatga

SEQ ID NO: 949154 - DNA, 25 bp, Mus musculus
ggatgtctagaagctctaggaatga

SEQ ID NO: 949155 - DNA, 25 bp, Mus musculus
ggatgtctatgaacttgatcctaag

SEQ ID NO: 949156 - DNA, 25 bp, Mus musculus
ggatgtctatgatcttgatcctaag

SEQ ID NO: 949157 - DNA, 25 bp, Mus musculus
ggatgtgaccatcacgtactgcagg

SEQ ID NO: 949158 - DNA, 25 bp, Mus musculus
ggatgtgaccatcaggtactgcagg

SEQ ID NO: 949159 - DNA, 25 bp, Mus musculus
ggatgtgatgctctttctcatcatt

SEQ ID NO: 949160 - DNA, 25 bp, Mus musculus
ggatgtgatgctgccctactttgtc

SEQ ID NO: 949161 - DNA, 25 bp, Mus musculus
ggatgtgatggtctttctcatcatt

SEQ ID NO: 949162 - DNA, 25 bp, Mus musculus
ggatgtgatggtgccctactttgtc

SEQ ID NO: 949163 - DNA, 25 bp, Mus musculus
ggatgtgcagccaatgaagagagcc

SEQ ID NO: 949164 - DNA, 25 bp, Mus musculus
ggatgtgcaggcaatgaagagagcc

SEQ ID NO: 949165 - DNA, 25 bp, Mus musculus
ggatgtgccgccctggacagaagat

SEQ ID NO: 949166 - DNA, 25 bp, Mus musculus
ggatgtgccgccgtggacagaagat

SEQ ID NO: 949167 - DNA, 25 bp, Mus musculus
ggatgtggcagactgtccccacttc

SEQ ID NO: 949168 - DNA, 25 bp, Mus musculus
ggatgtggcagagtgtccccacttc

SEQ ID NO: 949169 - DNA, 25 bp, Mus musculus
ggatgtggtcaacgagcggatccgt

SEQ ID NO: 949170 - DNA, 25 bp, Mus musculus
ggatgtggtcaaggagcggatccgt

SEQ ID NO: 949171 - DNA, 25 bp, Mus musculus
ggatgtgtatggcgagaagaaacat

SEQ ID NO: 949172 - DNA, 25 bp, Mus musculus
ggatgtgtatggggagaagaaacat

SEQ ID NO: 949173 - DNA, 25 bp, Mus musculus
ggatgtgttcagaggaaagattaca

SEQ ID NO: 949174 - DNA, 25 bp, Mus musculus
ggatgtgttcagtggaaagattaca

SEQ ID NO: 949175 - DNA, 25 bp, Mus musculus
ggatgttaaaccatgggatgatgag

SEQ ID NO: 949176 - DNA, 25 bp, Mus musculus
ggatgttaaaccttgggatgatgag

SEQ ID NO: 949177 - DNA, 25 bp, Mus musculus
ggatgttaagctgcatggcggcctg

SEQ ID NO: 949178 - DNA, 25 bp, Mus musculus
ggatgttaaggtgcatggcggcctg

SEQ ID NO: 949179 - DNA, 25 bp, Mus musculus
ggatgttccaggcgaggaatggagt

SEQ ID NO: 949180 - DNA, 25 bp, Mus musculus
ggatgttccaggggaggaatggagt

SEQ ID NO: 949181 - DNA, 25 bp, Mus musculus
ggatgttccgctatctgccccaccc

SEQ ID NO: 949182 - DNA, 25 bp, Mus musculus
ggatgttccggtatctgccccaccc

SEQ ID NO: 949183 - DNA, 25 bp, Mus musculus
ggatgttctgtgcaatctgggtcgc

SEQ ID NO: 949184 - DNA, 25 bp, Mus musculus
ggatgttctgtgcattctgggtcgc

SEQ ID NO: 949185 - DNA, 25 bp, Mus musculus
ggatgttgagctgtctcaaaagccc

SEQ ID NO: 949186 - DNA, 25 bp, Mus musculus
ggatgttgaggtgtctcaaaagccc

SEQ ID NO: 949187 - DNA, 25 bp, Mus musculus
ggatgttggctgaaagtttgttaac

SEQ ID NO: 949188 - DNA, 25 bp, Mus musculus
ggatgttggctgaatgtttgttaac

SEQ ID NO: 949189 - DNA, 25 bp, Mus musculus
ggatgtttaacactattgcagaaac

SEQ ID NO: 949190 - DNA, 25 bp, Mus musculus
ggatgtttaacagtattgcagaaac

SEQ ID NO: 949191 - DNA, 25 bp, Mus musculus
ggatgtttgcagccgagctatagaa

SEQ ID NO: 949192 - DNA, 25 bp, Mus musculus
ggatgtttgcaggcgagctatagaa

SEQ ID NO: 949193 - DNA, 25 bp, Mus musculus
ggattaagcataaacggaggtgcag

SEQ ID NO: 949194 - DNA, 25 bp, Mus musculus
ggattaagcataaagggaggtgcag

SEQ ID NO: 949195 - DNA, 25 bp, Mus musculus
ggattataatgacgcaaagggtgtg

SEQ ID NO: 949196 - DNA, 25 bp, Mus musculus
ggattataatgaggcaaagggtgtg

SEQ ID NO: 949197 - DNA, 25 bp, Mus musculus
ggattatgagcaggcagacaatgat

SEQ ID NO: 949198 - DNA, 25 bp, Mus musculus
ggattatgaggaggcagacaatgat

SEQ ID NO: 949199 - DNA, 25 bp, Mus musculus
ggattattccagaacttccaggtgg

SEQ ID NO: 949200 - DNA, 25 bp, Mus musculus
ggattattccagtacttccaggtgg

SEQ ID NO: 949201 - DNA, 25 bp, Mus musculus
ggattattttgccacagactgtcac

SEQ ID NO: 949202 - DNA, 25 bp, Mus musculus
ggattattttgccagagactgtcac

SEQ ID NO: 949203 - DNA, 25 bp, Mus musculus
ggattcaaacagcacctacatcaga

SEQ ID NO: 949204 - DNA, 25 bp, Mus musculus
ggattcaaacaggacctacatcaga

SEQ ID NO: 949205 - DNA, 25 bp, Mus musculus
ggattcaaaccacgactgttcagtc

SEQ ID NO: 949206 - DNA, 25 bp, Mus musculus
ggattcaaaccaggactgttcagtc

SEQ ID NO: 949207 - DNA, 25 bp, Mus musculus
ggattcacacagattctggaacaag

SEQ ID NO: 949208 - DNA, 25 bp, Mus musculus
ggattcacacagtttctggaacaag

SEQ ID NO: 949209 - DNA, 25 bp, Mus musculus
ggattcactcagcgtgatgttgggc

SEQ ID NO: 949210 - DNA, 25 bp, Mus musculus
ggattcactcagggtgatgttgggc

SEQ ID NO: 949211 - DNA, 25 bp, Mus musculus
ggattcaggtgtcaaataatggtcc

SEQ ID NO: 949212 - DNA, 25 bp, Mus musculus
ggattcaggtgtcatataatggtcc

SEQ ID NO: 949213 - DNA, 25 bp, Mus musculus
ggattcatccacttcgtggagaatt

SEQ ID NO: 949214 - DNA, 25 bp, Mus musculus
ggattcatccacttggtggagaatt

SEQ ID NO: 949215 - DNA, 25 bp, Mus musculus
ggattcatggtactcctgtattttc

SEQ ID NO: 949216 - DNA, 25 bp, Mus musculus
ggattcatggtactgctgtattttc

SEQ ID NO: 949217 - DNA, 25 bp, Mus musculus
ggattcatgtgccacgctggatggc

SEQ ID NO: 949218 - DNA, 25 bp, Mus musculus
ggattcatgtgccacggtggtgact

SEQ ID NO: 949219 - DNA, 25 bp, Mus musculus
ggattcatgtgccaggctggatggc

SEQ ID NO: 949220 - DNA, 25 bp, Mus musculus
ggattcatgtgccagggtggtgact

SEQ ID NO: 949221 - DNA, 25 bp, Mus musculus
ggattccaacaacgcatttgtatcc

SEQ ID NO: 949222 - DNA, 25 bp, Mus musculus
ggattccaacaaggcatttgtatcc

SEQ ID NO: 949223 - DNA, 25 bp, Mus musculus
ggattccagccacaccagcggagtc

SEQ ID NO: 949224 - DNA, 25 bp, Mus musculus
ggattccagccagaccagcggagtc

SEQ ID NO: 949225 - DNA, 25 bp, Mus musculus
ggattccagggaggcgaagagtcat

SEQ ID NO: 949226 - DNA, 25 bp, Mus musculus
ggattccagggaggggaagagtcat

SEQ ID NO: 949227 - DNA, 25 bp, Mus musculus
ggattccctgggcccggcaagtcca

SEQ ID NO: 949228 - DNA, 25 bp, Mus musculus
ggattccctggggccggcaagtcca

SEQ ID NO: 949229 - DNA, 25 bp, Mus musculus
ggattccgcaggcgagaagaccacc

SEQ ID NO: 949230 - DNA, 25 bp, Mus musculus
ggattccgcaggggagaagaccacc

SEQ ID NO: 949231 - DNA, 25 bp, Mus musculus
ggattcctctagcagagattatttc

SEQ ID NO: 949232 - DNA, 25 bp, Mus musculus
ggattcctctaggagagattatttc

SEQ ID NO: 949233 - DNA, 25 bp, Mus musculus
ggattccttcacctcgtggaaaatt

SEQ ID NO: 949234 - DNA, 25 bp, Mus musculus
ggattccttcacctggtggaaaatt

SEQ ID NO: 949235 - DNA, 25 bp, Mus musculus
ggattcgcaacctgaccagtgcaca

SEQ ID NO: 949236 - DNA, 25 bp, Mus musculus
ggattcgcaagctgaccagtgcaca

SEQ ID NO: 949237 - DNA, 25 bp, Mus musculus
ggattctgacatagatggcgaggct

SEQ ID NO: 949238 - DNA, 25 bp, Mus musculus
ggattctgacatcctgcagagccta

SEQ ID NO: 949239 - DNA, 25 bp, Mus musculus
ggattctgacatgctgcagagccta

SEQ ID NO: 949240 - DNA, 25 bp, Mus musculus
ggattctgacattgatggcgaggct

SEQ ID NO: 949241 - DNA, 25 bp, Mus musculus
ggattcttccgccgaacaagtgcgg

SEQ ID NO: 949242 - DNA, 25 bp, Mus musculus
ggattcttccgcggaacaagtgcgg

SEQ ID NO: 949243 - DNA, 25 bp, Mus musculus
ggattgactttgaacaccactacgg

SEQ ID NO: 949244 - DNA, 25 bp, Mus musculus
ggattgactttgtacaccactacgg

SEQ ID NO: 949245 - DNA, 25 bp, Mus musculus
ggattgattgctacatggatttctt

SEQ ID NO: 949246 - DNA, 25 bp, Mus musculus
ggattgattggtacatggatttctt

SEQ ID NO: 949247 - DNA, 25 bp, Mus musculus
ggattgcagccacgtatggtgtgga

SEQ ID NO: 949248 - DNA, 25 bp, Mus musculus
ggattgcagccaggtatggtgtgga

SEQ ID NO: 949249 - DNA, 25 bp, Mus musculus
ggattgcattagcaaagaatgtttc

SEQ ID NO: 949250 - DNA, 25 bp, Mus musculus
ggattgcattaggaaagaatgtttc

SEQ ID NO: 949251 - DNA, 25 bp, Mus musculus
ggattgcgagcatcgccacgactcg

SEQ ID NO: 949252 - DNA, 25 bp, Mus musculus
ggattgcgaggatcgccacgactcg

SEQ ID NO: 949253 - DNA, 25 bp, Mus musculus
ggattggaactgctatgatgtcctg

SEQ ID NO: 949254 - DNA, 25 bp, Mus musculus
ggattggaactggtatgatgtcctg

SEQ ID NO: 949255 - DNA, 25 bp, Mus musculus
ggattggccgcctatggggcatgga

SEQ ID NO: 949256 - DNA, 25 bp, Mus musculus
ggattggccggctatggggcatgga

SEQ ID NO: 949257 - DNA, 25 bp, Mus musculus
ggattggtgaaaaacgagtctttgt

SEQ ID NO: 949258 - DNA, 25 bp, Mus musculus
ggattggtgaaaaaggagtctttgt

SEQ ID NO: 949259 - DNA, 25 bp, Mus musculus
ggattgtcgagggacctctccctac

SEQ ID NO: 949260 - DNA, 25 bp, Mus musculus
ggattgtcgagggagctctccctac

SEQ ID NO: 949261 - DNA, 25 bp, Mus musculus
ggatttaaccagagctgtctgtcta

SEQ ID NO: 949262 - DNA, 25 bp, Mus musculus
ggatttaaccagtgctgtctgtcta

SEQ ID NO: 949263 - DNA, 25 bp, Mus musculus
ggatttaagaatcaatgccccagtg

SEQ ID NO: 949264 - DNA, 25 bp, Mus musculus
ggatttaagaatgaatgccccagtg

SEQ ID NO: 949265 - DNA, 25 bp, Mus musculus
ggatttagtctgccgtgtgcagcct

SEQ ID NO: 949266 - DNA, 25 bp, Mus musculus
ggatttagtctggcgtgtgcagcct

SEQ ID NO: 949267 - DNA, 25 bp, Mus musculus
ggatttatccagctgtgaaattgaa

SEQ ID NO: 949268 - DNA, 25 bp, Mus musculus
ggatttatccaggtgtgaaattgaa

SEQ ID NO: 949269 - DNA, 25 bp, Mus musculus
ggatttatcccacgatctgcagcta

SEQ ID NO: 949270 - DNA, 25 bp, Mus musculus
ggatttatcccaggatctgcagcta

SEQ ID NO: 949271 - DNA, 25 bp, Mus musculus
ggatttatgacgactgatgctgctc

SEQ ID NO: 949272 - DNA, 25 bp, Mus musculus
ggatttatgacgtctgatgctgctc

SEQ ID NO: 949273 - DNA, 25 bp, Mus musculus
ggatttattactcgtgatcaagcga

SEQ ID NO: 949274 - DNA, 25 bp, Mus musculus
ggatttattactggtgatcaagcga

SEQ ID NO: 949275 - DNA, 25 bp, Mus musculus
ggatttcaagaccctagagtcttcc

SEQ ID NO: 949276 - DNA, 25 bp, Mus musculus
ggatttcaagtccctagagtcttcc

SEQ ID NO: 949277 - DNA, 25 bp, Mus musculus
ggatttgaatcacgtttgtgtcatt

SEQ ID NO: 949278 - DNA, 25 bp, Mus musculus
ggatttgaatgacgtttgtgtcatt

SEQ ID NO: 949279 - DNA, 25 bp, Mus musculus
ggatttgagtggaaagcgctcttcg

SEQ ID NO: 949280 - DNA, 25 bp, Mus musculus
ggatttgagtggaatgcgctcttcg

SEQ ID NO: 949281 - DNA, 25 bp, Mus musculus
ggatttggagactgtctccaaggag

SEQ ID NO: 949282 - DNA, 25 bp, Mus musculus
ggatttggagtctgtctccaaggag

SEQ ID NO: 949283 - DNA, 25 bp, Mus musculus
ggatttggggctgctgtaacagaag

SEQ ID NO: 949284 - DNA, 25 bp, Mus musculus
ggatttgggggtgctgtaacagaag

SEQ ID NO: 949285 - DNA, 25 bp, Mus musculus
ggatttgtcgccagagagacaagaa

SEQ ID NO: 949286 - DNA, 25 bp, Mus musculus
ggatttgtcggcagagagacaagaa

SEQ ID NO: 949287 - DNA, 25 bp, Mus musculus
ggatttgtctacaaccacaagcgct

SEQ ID NO: 949288 - DNA, 25 bp, Mus musculus
ggatttgtctacaagcacaagcgct

SEQ ID NO: 949289 - DNA, 25 bp, Mus musculus
ggattttaaagacttgattccagaa

SEQ ID NO: 949290 - DNA, 25 bp, Mus musculus
ggattttaaagagttgattccagaa

SEQ ID NO: 949291 - DNA, 25 bp, Mus musculus
ggattttaagctgagactgtggaga

SEQ ID NO: 949292 - DNA, 25 bp, Mus musculus
ggattttaaggtgagactgtggaga

SEQ ID NO: 949293 - DNA, 25 bp, Mus musculus
ggattttctcagcgaggcgccttgt

SEQ ID NO: 949294 - DNA, 25 bp, Mus musculus
ggattttctcagcggccgatcaaca

SEQ ID NO: 949295 - DNA, 25 bp, Mus musculus
ggattttctcagggaggcgccttgt

SEQ ID NO: 949296 - DNA, 25 bp, Mus musculus
ggattttctcaggggccgatcaaca

SEQ ID NO: 949297 - DNA, 25 bp, Mus musculus
ggattttctggaacagcctatatgc

SEQ ID NO: 949298 - DNA, 25 bp, Mus musculus
ggattttctggaactgcctatatgc

SEQ ID NO: 949299 - DNA, 25 bp, Mus musculus
ggattttgtggccactggggctgaa

SEQ ID NO: 949300 - DNA, 25 bp, Mus musculus
ggattttgtggccagtggggctgaa

SEQ ID NO: 949301 - DNA, 25 bp, Mus musculus
ggatttttaatgacactctttggtt

SEQ ID NO: 949302 - DNA, 25 bp, Mus musculus
ggatttttaatgactctctttggtt

SEQ ID NO: 949303 - DNA, 25 bp, Mus musculus
ggcaaaaaggcctcatcaaaggagg

SEQ ID NO: 949304 - DNA, 25 bp, Mus musculus
ggcaaaaagggctcatcaaaggagg

SEQ ID NO: 949305 - DNA, 25 bp, Mus musculus
ggcaaaaatggcacaaccgttcttg

SEQ ID NO: 949306 - DNA, 25 bp, Mus musculus
ggcaaaaatggcactaccgttcttg

SEQ ID NO: 949307 - DNA, 25 bp, Mus musculus
ggcaaaaccgaaagtgacagagact

SEQ ID NO: 949308 - DNA, 25 bp, Mus musculus
ggcaaaaccgtaagtgacagagact

SEQ ID NO: 949309 - DNA, 25 bp, Mus musculus
ggcaaaactcaaaccaacagaggcg

SEQ ID NO: 949310 - DNA, 25 bp, Mus musculus
ggcaaaactcaatccaacagaggcg

SEQ ID NO: 949311 - DNA, 25 bp, Mus musculus
ggcaaaactgagagaccttcagaat

SEQ ID NO: 949312 - DNA, 25 bp, Mus musculus
ggcaaaactgagtgaccttcagaat

SEQ ID NO: 949313 - DNA, 25 bp, Mus musculus
ggcaaaagagatatatccagtgatg

SEQ ID NO: 949314 - DNA, 25 bp, Mus musculus
ggcaaaagagttatatccagtgatg

SEQ ID NO: 949315 - DNA, 25 bp, Mus musculus
ggcaaaagatcccagtctaattgaa

SEQ ID NO: 949316 - DNA, 25 bp, Mus musculus
ggcaaaagatgccagtctaattgaa

SEQ ID NO: 949317 - DNA, 25 bp, Mus musculus
ggcaaaaggcagaacattgaggtag

SEQ ID NO: 949318 - DNA, 25 bp, Mus musculus
ggcaaaaggcagaagattgaggtag

SEQ ID NO: 949319 - DNA, 25 bp, Mus musculus
ggcaaaagtgtgcatgaactcttcc

SEQ ID NO: 949320 - DNA, 25 bp, Mus musculus
ggcaaaagtgtggatgaactcttcc

SEQ ID NO: 949321 - DNA, 25 bp, Mus musculus
ggcaaaatcactcataatccccagg

SEQ ID NO: 949322 - DNA, 25 bp, Mus musculus
ggcaaaatcagtcataatccccagg

SEQ ID NO: 949323 - DNA, 25 bp, Mus musculus
ggcaaaatctctgagaaggaccgaa

SEQ ID NO: 949324 - DNA, 25 bp, Mus musculus
ggcaaaatctgtgagaaggaccgaa

SEQ ID NO: 949325 - DNA, 25 bp, Mus musculus
ggcaaacaacagcgcagcagaagaa

SEQ ID NO: 949326 - DNA, 25 bp, Mus musculus
ggcaaacaacagcgtggcagacgaa

SEQ ID NO: 949327 - DNA, 25 bp, Mus musculus
ggcaaacaacagggcagcagaagaa

SEQ ID NO: 949328 - DNA, 25 bp, Mus musculus
ggcaaacaacagggtggcagacgaa

SEQ ID NO: 949329 - DNA, 25 bp, Mus musculus
ggcaaactgcttcacctccaagagg

SEQ ID NO: 949330 - DNA, 25 bp, Mus musculus
ggcaaactgcttcagctccaagagg

SEQ ID NO: 949331 - DNA, 25 bp, Mus musculus
ggcaaactgttcagcggtggaggga

SEQ ID NO: 949332 - DNA, 25 bp, Mus musculus
ggcaaactgttctgcggtggaggga

SEQ ID NO: 949333 - DNA, 25 bp, Mus musculus
ggcaaagaagcaagcatgattgatg

SEQ ID NO: 949334 - DNA, 25 bp, Mus musculus
ggcaaagaaggaagcatgattgatg

SEQ ID NO: 949335 - DNA, 25 bp, Mus musculus
ggcaaagacaaactactccaattat

SEQ ID NO: 949336 - DNA, 25 bp, Mus musculus
ggcaaagacaaagtactccaattat

SEQ ID NO: 949337 - DNA, 25 bp, Mus musculus
ggcaaagagtcacacatttacattg

SEQ ID NO: 949338 - DNA, 25 bp, Mus musculus
ggcaaagagtcagacatttacattg

SEQ ID NO: 949339 - DNA, 25 bp, Mus musculus
ggcaaagcaaaggacattctcctat

SEQ ID NO: 949340 - DNA, 25 bp, Mus musculus
ggcaaagcaagacattcgagtaaga

SEQ ID NO: 949341 - DNA, 25 bp, Mus musculus
ggcaaagcaagagattcgagtaaga

SEQ ID NO: 949342 - DNA, 25 bp, Mus musculus
ggcaaagcaatggacattctcctat

SEQ ID NO: 949343 - DNA, 25 bp, Mus musculus
ggcaaagctgcgagtgacagactgg

SEQ ID NO: 949344 - DNA, 25 bp, Mus musculus
ggcaaagctgcgtgtgacagactgg

SEQ ID NO: 949345 - DNA, 25 bp, Mus musculus
ggcaaagctttggacggctccactc

SEQ ID NO: 949346 - DNA, 25 bp, Mus musculus
ggcaaagctttggagggctccactc

SEQ ID NO: 949347 - DNA, 25 bp, Mus musculus
ggcaaaggccctggcgaatgtatca

SEQ ID NO: 949348 - DNA, 25 bp, Mus musculus
ggcaaaggccctggggaatgtatca

SEQ ID NO: 949349 - DNA, 25 bp, Mus musculus
ggcaaaggcgtcctgatccccactt

SEQ ID NO: 949350 - DNA, 25 bp, Mus musculus
ggcaaaggcgtcgtgatccccactt

SEQ ID NO: 949351 - DNA, 25 bp, Mus musculus
ggcaaagtttgaaaagctagctgcc

SEQ ID NO: 949352 - DNA, 25 bp, Mus musculus
ggcaaagtttgaaatgctagctgcc

SEQ ID NO: 949353 - DNA, 25 bp, Mus musculus
ggcaaatacgatacccgtctctgga

SEQ ID NO: 949354 - DNA, 25 bp, Mus musculus
ggcaaatacgttacccgtctctgga

SEQ ID NO: 949355 - DNA, 25 bp, Mus musculus
ggcaaatggaagcaaacttcatggc

SEQ ID NO: 949356 - DNA, 25 bp, Mus musculus
ggcaaatggaaggaaacttcatggc

SEQ ID NO: 949357 - DNA, 25 bp, Mus musculus
ggcaaatgtaaaaagacttgtaggg

SEQ ID NO: 949358 - DNA, 25 bp, Mus musculus
ggcaaatgtaaatagacttgtaggg

SEQ ID NO: 949359 - DNA, 25 bp, Mus musculus
ggcaaattagctctgactttgtgac

SEQ ID NO: 949360 - DNA, 25 bp, Mus musculus
ggcaaattaggtctgactttgtgac

SEQ ID NO: 949361 - DNA, 25 bp, Mus musculus
ggcaacaaataggagaggggtcaga

SEQ ID NO: 949362 - DNA, 25 bp, Mus musculus
ggcaacaaattggagaggggtcaga

SEQ ID NO: 949363 - DNA, 25 bp, Mus musculus
ggcaacaacgctctggtgcaagtgt

SEQ ID NO: 949364 - DNA, 25 bp, Mus musculus
ggcaacaacggtctggtgcaagtgt

SEQ ID NO: 949365 - DNA, 25 bp, Mus musculus
ggcaacaaggagcacatacagaaga

SEQ ID NO: 949366 - DNA, 25 bp, Mus musculus
ggcaacaaggagcagatacagaaga

SEQ ID NO: 949367 - DNA, 25 bp, Mus musculus
ggcaacacagatcgaggaagagcag

SEQ ID NO: 949368 - DNA, 25 bp, Mus musculus
ggcaacacagatggaggaagagcag

SEQ ID NO: 949369 - DNA, 25 bp, Mus musculus
ggcaacatcgcatggcacttccaaa

SEQ ID NO: 949370 - DNA, 25 bp, Mus musculus
ggcaacatcgctgtgggcaaatcca

SEQ ID NO: 949371 - DNA, 25 bp, Mus musculus
ggcaacatcggatggcacttccaaa

SEQ ID NO: 949372 - DNA, 25 bp, Mus musculus
ggcaacatcggtgtgggcaaatcca

SEQ ID NO: 949373 - DNA, 25 bp, Mus musculus
ggcaacattcagaacgctgctgaaa

SEQ ID NO: 949374 - DNA, 25 bp, Mus musculus
ggcaacattcagaaggctgctgaaa

SEQ ID NO: 949375 - DNA, 25 bp, Mus musculus
ggcaacattcctcctccacctcctg

SEQ ID NO: 949376 - DNA, 25 bp, Mus musculus
ggcaacattcctgctccacctcctg

SEQ ID NO: 949377 - DNA, 25 bp, Mus musculus
ggcaacatttgtgtcgtgaggctcc

SEQ ID NO: 949378 - DNA, 25 bp, Mus musculus
ggcaacatttgtgtggtgaggctcc

SEQ ID NO: 949379 - DNA, 25 bp, Mus musculus
ggcaaccagctacgcgtccagcggc

SEQ ID NO: 949380 - DNA, 25 bp, Mus musculus
ggcaaccagctacgggtccagcggc

SEQ ID NO: 949381 - DNA, 25 bp, Mus musculus
ggcaacccacgcaacatggctgcca

SEQ ID NO: 949382 - DNA, 25 bp, Mus musculus
ggcaacccacgcaagatggctgcca

SEQ ID NO: 949383 - DNA, 25 bp, Mus musculus
ggcaaccgtagtcacaatgagtctg

SEQ ID NO: 949384 - DNA, 25 bp, Mus musculus
ggcaaccgtagtcagaatgagtctg

SEQ ID NO: 949385 - DNA, 25 bp, Mus musculus
ggcaacctgaggctggccaggaaca

SEQ ID NO: 949386 - DNA, 25 bp, Mus musculus
ggcaacctgagggtggccaggaaca

SEQ ID NO: 949387 - DNA, 25 bp, Mus musculus
ggcaacctgtcacccctgctgtcca

SEQ ID NO: 949388 - DNA, 25 bp, Mus musculus
ggcaacctgtcagccctgctgtcca

SEQ ID NO: 949389 - DNA, 25 bp, Mus musculus
ggcaacgactagtcccgtggtcagg

SEQ ID NO: 949390 - DNA, 25 bp, Mus musculus
ggcaacgacttgtcccgtggtcagg

SEQ ID NO: 949391 - DNA, 25 bp, Mus musculus
ggcaacgccacgcgcaagctggtgt

SEQ ID NO: 949392 - DNA, 25 bp, Mus musculus
ggcaacgccacgggcaagctggtgt

SEQ ID NO: 949393 - DNA, 25 bp, Mus musculus
ggcaactaagcgcatgtgggagctg

SEQ ID NO: 949394 - DNA, 25 bp, Mus musculus
ggcaactaagcggatgtgggagctg

SEQ ID NO: 949395 - DNA, 25 bp, Mus musculus
ggcaactgtgtgcacatcaacgaat

SEQ ID NO: 949396 - DNA, 25 bp, Mus musculus
ggcaactgtgtggacatcaacgaat

SEQ ID NO: 949397 - DNA, 25 bp, Mus musculus
ggcaacttctctcgaaccaagcaac

SEQ ID NO: 949398 - DNA, 25 bp, Mus musculus
ggcaacttctctggaaccaagcaac

SEQ ID NO: 949399 - DNA, 25 bp, Mus musculus
ggcaactttcagagctgcttaagta

SEQ ID NO: 949400 - DNA, 25 bp, Mus musculus
ggcaactttcagtgctgcttaagta

SEQ ID NO: 949401 - DNA, 25 bp, Mus musculus
ggcaagacagattacaaaagaagac

SEQ ID NO: 949402 - DNA, 25 bp, Mus musculus
ggcaagacagtttacaaaagaagac

SEQ ID NO: 949403 - DNA, 25 bp, Mus musculus
ggcaagacgaagcaggcccagaaga

SEQ ID NO: 949404 - DNA, 25 bp, Mus musculus
ggcaagacgaaggaggcccagaaga

SEQ ID NO: 949405 - DNA, 25 bp, Mus musculus
ggcaagaggaagcctgttgtccctg

SEQ ID NO: 949406 - DNA, 25 bp, Mus musculus
ggcaagaggaaggctgttgtccctg

SEQ ID NO: 949407 - DNA, 25 bp, Mus musculus
ggcaagaggagccaagaatgtatca

SEQ ID NO: 949408 - DNA, 25 bp, Mus musculus
ggcaagaggagccatgaatgtatca

SEQ ID NO: 949409 - DNA, 25 bp, Mus musculus
ggcaagaggcgtgacgtgctttcag

SEQ ID NO: 949410 - DNA, 25 bp, Mus musculus
ggcaagaggcgtgaggtgctttcag

SEQ ID NO: 949411 - DNA, 25 bp, Mus musculus
ggcaagatcaaaccctcagcgttct

SEQ ID NO: 949412 - DNA, 25 bp, Mus musculus
ggcaagatcaaagcctcagcgttct

SEQ ID NO: 949413 - DNA, 25 bp, Mus musculus
ggcaagatctctcccaatccatagt

SEQ ID NO: 949414 - DNA, 25 bp, Mus musculus
ggcaagatctctgccaatccatagt

SEQ ID NO: 949415 - DNA, 25 bp, Mus musculus
ggcaagccccctgacgtgacaaacc

SEQ ID NO: 949416 - DNA, 25 bp, Mus musculus
ggcaagccccctgaggtgacaaacc

SEQ ID NO: 949417 - DNA, 25 bp, Mus musculus
ggcaagcccctgccgacacccatcg

SEQ ID NO: 949418 - DNA, 25 bp, Mus musculus
ggcaagcccctgcgacacctgcggc

SEQ ID NO: 949419 - DNA, 25 bp, Mus musculus
ggcaagcccctggcgacacccatcg

SEQ ID NO: 949420 - DNA, 25 bp, Mus musculus
ggcaagcccctgggacacctgcggc

SEQ ID NO: 949421 - DNA, 25 bp, Mus musculus
ggcaagccgaagcgcctggcgtatg

SEQ ID NO: 949422 - DNA, 25 bp, Mus musculus
ggcaagccgaagggcctggcgtatg

SEQ ID NO: 949423 - DNA, 25 bp, Mus musculus
ggcaagcgatgctccatgctttctt

SEQ ID NO: 949424 - DNA, 25 bp, Mus musculus
ggcaagcgatgctcgatgctttctt

SEQ ID NO: 949425 - DNA, 25 bp, Mus musculus
ggcaagcttcaacgacatccacacc

SEQ ID NO: 949426 - DNA, 25 bp, Mus musculus
ggcaagcttcaaggacatccacacc

SEQ ID NO: 949427 - DNA, 25 bp, Mus musculus
ggcaaggatggcaaaggagagtgtg

SEQ ID NO: 949428 - DNA, 25 bp, Mus musculus
ggcaaggatggcaatggagagtgtg

SEQ ID NO: 949429 - DNA, 25 bp, Mus musculus
ggcaaggcacctctcgtaccaacgc

SEQ ID NO: 949430 - DNA, 25 bp, Mus musculus
ggcaaggcacctctggtaccaacgc

SEQ ID NO: 949431 - DNA, 25 bp, Mus musculus
ggcaaggcggccctggtgatgtcgg

SEQ ID NO: 949432 - DNA, 25 bp, Mus musculus
ggcaaggcgggcctggtgatgtcgg

SEQ ID NO: 949433 - DNA, 25 bp, Mus musculus
ggcaagtgctcacgaagactcttca

SEQ ID NO: 949434 - DNA, 25 bp, Mus musculus
ggcaagtgctcacgaggccatgaca

SEQ ID NO: 949435 - DNA, 25 bp, Mus musculus
ggcaagtgctcaggaagactcttca

SEQ ID NO: 949436 - DNA, 25 bp, Mus musculus
ggcaagtgctcaggaggccatgaca

SEQ ID NO: 949437 - DNA, 25 bp, Mus musculus
ggcaagtggcatcgagatgttgcag

SEQ ID NO: 949438 - DNA, 25 bp, Mus musculus
ggcaagtggcatggagatgttgcag

SEQ ID NO: 949439 - DNA, 25 bp, Mus musculus
ggcaagtgtgaaccgtgtgctcctg

SEQ ID NO: 949440 - DNA, 25 bp, Mus musculus
ggcaagtgtgagcggatccggggtc

SEQ ID NO: 949441 - DNA, 25 bp, Mus musculus
ggcaagtgtgaggggatccggggtc

SEQ ID NO: 949442 - DNA, 25 bp, Mus musculus
ggcaagtgtgtaccgtgtgctcctg

SEQ ID NO: 949443 - DNA, 25 bp, Mus musculus
ggcaagtttgcgcctgccttaagtg

SEQ ID NO: 949444 - DNA, 25 bp, Mus musculus
ggcaagtttgggcctgccttaagtg

SEQ ID NO: 949445 - DNA, 25 bp, Mus musculus
ggcaataaataggagagaggtcaga

SEQ ID NO: 949446 - DNA, 25 bp, Mus musculus
ggcaataaattggagagaggtcaga

SEQ ID NO: 949447 - DNA, 25 bp, Mus musculus
ggcaatacagcccgcctggccatcc

SEQ ID NO: 949448 - DNA, 25 bp, Mus musculus
ggcaatacaggccgcctggccatcc

SEQ ID NO: 949449 - DNA, 25 bp, Mus musculus
ggcaatatgaaaaacctggagaact

SEQ ID NO: 949450 - DNA, 25 bp, Mus musculus
ggcaatatgaaaaagctggagaact

SEQ ID NO: 949451 - DNA, 25 bp, Mus musculus
ggcaatcaagagcatgaagagaaag

SEQ ID NO: 949452 - DNA, 25 bp, Mus musculus
ggcaatcaagaggatgaagagaaag

SEQ ID NO: 949453 - DNA, 25 bp, Mus musculus
ggcaatctagcttctttggtttcta

SEQ ID NO: 949454 - DNA, 25 bp, Mus musculus
ggcaatctaggttctttggtttcta

SEQ ID NO: 949455 - DNA, 25 bp, Mus musculus
ggcaatctgtcgcgggtggagggct

SEQ ID NO: 949456 - DNA, 25 bp, Mus musculus
ggcaatctgtcgggggtggagggct

SEQ ID NO: 949457 - DNA, 25 bp, Mus musculus
ggcaatgaccacctggaccagctga

SEQ ID NO: 949458 - DNA, 25 bp, Mus musculus
ggcaatgacctcctggaccagctga

SEQ ID NO: 949459 - DNA, 25 bp, Mus musculus
ggcaatgacgaaataaccccttcct

SEQ ID NO: 949460 - DNA, 25 bp, Mus musculus
ggcaatgacgtaataaccccttcct

SEQ ID NO: 949461 - DNA, 25 bp, Mus musculus
ggcaatgatgcaagcaattttggag

SEQ ID NO: 949462 - DNA, 25 bp, Mus musculus
ggcaatgatgctggctatggcggtt

SEQ ID NO: 949463 - DNA, 25 bp, Mus musculus
ggcaatgatgctggttatggaggag

SEQ ID NO: 949464 - DNA, 25 bp, Mus musculus
ggcaatgatggaagcaattttggag

SEQ ID NO: 949465 - DNA, 25 bp, Mus musculus
ggcaatgatggtggctatggcggtt

SEQ ID NO: 949466 - DNA, 25 bp, Mus musculus
ggcaatgatggtggttatggaggag

SEQ ID NO: 949467 - DNA, 25 bp, Mus musculus
ggcaatgcagagggaggagaagcag

SEQ ID NO: 949468 - DNA, 25 bp, Mus musculus
ggcaatgcagtgggaggagaagcag

SEQ ID NO: 949469 - DNA, 25 bp, Mus musculus
ggcaattacttgcacttggaaaaga

SEQ ID NO: 949470 - DNA, 25 bp, Mus musculus
ggcaattacttgcagttggaaaaga

SEQ ID NO: 949471 - DNA, 25 bp, Mus musculus
ggcaattgccaacgaactgaaatac

SEQ ID NO: 949472 - DNA, 25 bp, Mus musculus
ggcaattgccaaggaactgaaatac

SEQ ID NO: 949473 - DNA, 25 bp, Mus musculus
ggcaattgcgcttatcaatgtcaca

SEQ ID NO: 949474 - DNA, 25 bp, Mus musculus
ggcaattgcggttatcaatgtcaca

SEQ ID NO: 949475 - DNA, 25 bp, Mus musculus
ggcaattgtgagcatgagcccatgg

SEQ ID NO: 949476 - DNA, 25 bp, Mus musculus
ggcaattgtgaggatgagcccatgg

SEQ ID NO: 949477 - DNA, 25 bp, Mus musculus
ggcacaaatcaaaacgtgtgatcct

SEQ ID NO: 949478 - DNA, 25 bp, Mus musculus
ggcacaaatcaaaaggtgtgatcct

SEQ ID NO: 949479 - DNA, 25 bp, Mus musculus
ggcacaacagcacatcccagcatgg

SEQ ID NO: 949480 - DNA, 25 bp, Mus musculus
ggcacaacagcagatcccagcatgg

SEQ ID NO: 949481 - DNA, 25 bp, Mus musculus
ggcacaactataaacttgtggtgac

SEQ ID NO: 949482 - DNA, 25 bp, Mus musculus
ggcacaactataaagttgtggtgac

SEQ ID NO: 949483 - DNA, 25 bp, Mus musculus
ggcacaagagcacgccaggatctgt

SEQ ID NO: 949484 - DNA, 25 bp, Mus musculus
ggcacaagagcaggccaggatctgt

SEQ ID NO: 949485 - DNA, 25 bp, Mus musculus
ggcacaccatgacgctactcatctt

SEQ ID NO: 949486 - DNA, 25 bp, Mus musculus
ggcacaccatgaggctactcatctt

SEQ ID NO: 949487 - DNA, 25 bp, Mus musculus
ggcacacccatacacaaattagacg

SEQ ID NO: 949488 - DNA, 25 bp, Mus musculus
ggcacacccatacagaaattagacg

SEQ ID NO: 949489 - DNA, 25 bp, Mus musculus
ggcacactcgatctgatttgtactc

SEQ ID NO: 949490 - DNA, 25 bp, Mus musculus
ggcacactcgttctgatttgtactc

SEQ ID NO: 949491 - DNA, 25 bp, Mus musculus
ggcacagacatgatggtgggcattg

SEQ ID NO: 949492 - DNA, 25 bp, Mus musculus
ggcacagacatgttggtgggcattg

SEQ ID NO: 949493 - DNA, 25 bp, Mus musculus
ggcacagagattcacgttctcccct

SEQ ID NO: 949494 - DNA, 25 bp, Mus musculus
ggcacagagattcaggttctcccct

SEQ ID NO: 949495 - DNA, 25 bp, Mus musculus
ggcacagcagcacttgattgtggaa

SEQ ID NO: 949496 - DNA, 25 bp, Mus musculus
ggcacagcagcagttgattgtggaa

SEQ ID NO: 949497 - DNA, 25 bp, Mus musculus
ggcacagcctcacctgtgattgggc

SEQ ID NO: 949498 - DNA, 25 bp, Mus musculus
ggcacagcctcagctgtgattgggc

SEQ ID NO: 949499 - DNA, 25 bp, Mus musculus
ggcacaggagagggaggcctggagg

SEQ ID NO: 949500 - DNA, 25 bp, Mus musculus
ggcacaggagccctggaggagctgg

SEQ ID NO: 949501 - DNA, 25 bp, Mus musculus
ggcacaggaggcctggaggagctgg

SEQ ID NO: 949502 - DNA, 25 bp, Mus musculus
ggcacaggagtgggaggcctggagg

SEQ ID NO: 949503 - DNA, 25 bp, Mus musculus
ggcacaggcatgctggctgcttgtc

SEQ ID NO: 949504 - DNA, 25 bp, Mus musculus
ggcacaggcatggtggctgcttgtc

SEQ ID NO: 949505 - DNA, 25 bp, Mus musculus
ggcacagtgtcacttcctgtcagat

SEQ ID NO: 949506 - DNA, 25 bp, Mus musculus
ggcacagtgtcagttcctgtcagat

SEQ ID NO: 949507 - DNA, 25 bp, Mus musculus
ggcacatacccacgatcaaaaccct

SEQ ID NO: 949508 - DNA, 25 bp, Mus musculus
ggcacatacccacgttgctgccttg

SEQ ID NO: 949509 - DNA, 25 bp, Mus musculus
ggcacatacccaggatcaaaaccct

SEQ ID NO: 949510 - DNA, 25 bp, Mus musculus
ggcacatacccaggttgctgccttg

SEQ ID NO: 949511 - DNA, 25 bp, Mus musculus
ggcacatcagacccctatgtgaagg

SEQ ID NO: 949512 - DNA, 25 bp, Mus musculus
ggcacatcagtcccctatgtgaagg

SEQ ID NO: 949513 - DNA, 25 bp, Mus musculus
ggcacattgaagatgagtttgatgc

SEQ ID NO: 949514 - DNA, 25 bp, Mus musculus
ggcacattgaagttgagtttgatgc

SEQ ID NO: 949515 - DNA, 25 bp, Mus musculus
ggcacatttgatgtccatctggatt

SEQ ID NO: 949516 - DNA, 25 bp, Mus musculus
ggcacatttgttgtccatctggatt

SEQ ID NO: 949517 - DNA, 25 bp, Mus musculus
ggcaccaagatcaccggcgacccca

SEQ ID NO: 949518 - DNA, 25 bp, Mus musculus
ggcaccaagatcacgggcgacccca

SEQ ID NO: 949519 - DNA, 25 bp, Mus musculus
ggcaccaaggcgcacgatttctata

SEQ ID NO: 949520 - DNA, 25 bp, Mus musculus
ggcaccaaggcgcaggatttctata

SEQ ID NO: 949521 - DNA, 25 bp, Mus musculus
ggcaccagcgatgaggattttagtg

SEQ ID NO: 949522 - DNA, 25 bp, Mus musculus
ggcaccagcgttgaggattttagtg

SEQ ID NO: 949523 - DNA, 25 bp, Mus musculus
ggcaccatcaccaacctcctccaga

SEQ ID NO: 949524 - DNA, 25 bp, Mus musculus
ggcaccatcaccaagctcctccaga

SEQ ID NO: 949525 - DNA, 25 bp, Mus musculus
ggcaccatccgacagggaatgctgg

SEQ ID NO: 949526 - DNA, 25 bp, Mus musculus
ggcaccatccgagagggaatgctgg

SEQ ID NO: 949527 - DNA, 25 bp, Mus musculus
ggcacccaagagctcattggtgatt

SEQ ID NO: 949528 - DNA, 25 bp, Mus musculus
ggcacccaagaggctctgggctcgc

SEQ ID NO: 949529 - DNA, 25 bp, Mus musculus
ggcacccaagaggtcattggtgatt

SEQ ID NO: 949530 - DNA, 25 bp, Mus musculus
ggcacccaagtggctctgggctcgc

SEQ ID NO: 949531 - DNA, 25 bp, Mus musculus
ggcacccatgcctcaaactaccatc

SEQ ID NO: 949532 - DNA, 25 bp, Mus musculus
ggcacccatggctcaaactaccatc

SEQ ID NO: 949533 - DNA, 25 bp, Mus musculus
ggcacccctgagaacttggctccag

SEQ ID NO: 949534 - DNA, 25 bp, Mus musculus
ggcacccctgagtacttggctccag

SEQ ID NO: 949535 - DNA, 25 bp, Mus musculus
ggcaccctggtggcagaacgtgaaa

SEQ ID NO: 949536 - DNA, 25 bp, Mus musculus
ggcaccctggtggctgaacgtgaaa

SEQ ID NO: 949537 - DNA, 25 bp, Mus musculus
ggcaccgaagagagtgtgaacatgg

SEQ ID NO: 949538 - DNA, 25 bp, Mus musculus
ggcaccgaagagtgtgtgaacatgg

SEQ ID NO: 949539 - DNA, 25 bp, Mus musculus
ggcaccgctcagagactctgggagc

SEQ ID NO: 949540 - DNA, 25 bp, Mus musculus
ggcaccgctcagtgactctgggagc

SEQ ID NO: 949541 - DNA, 25 bp, Mus musculus
ggcaccgctggaaaagttattaagt

SEQ ID NO: 949542 - DNA, 25 bp, Mus musculus
ggcaccgctggaaatgttattaagt

SEQ ID NO: 949543 - DNA, 25 bp, Mus musculus
ggcacctacagtcacgtccagtgtc

SEQ ID NO: 949544 - DNA, 25 bp, Mus musculus
ggcacctacagtcaggtccagtgtc

SEQ ID NO: 949545 - DNA, 25 bp, Mus musculus
ggcacctactcaagctctcagaact

SEQ ID NO: 949546 - DNA, 25 bp, Mus musculus
ggcacctactcacctctcagaactg

SEQ ID NO: 949547 - DNA, 25 bp, Mus musculus
ggcacctactcagctctcagaactg

SEQ ID NO: 949548 - DNA, 25 bp, Mus musculus
ggcacctactcatgctctcagaact

SEQ ID NO: 949549 - DNA, 25 bp, Mus musculus
ggcacctctgcacgttcaggtctca

SEQ ID NO: 949550 - DNA, 25 bp, Mus musculus
ggcacctctgcaggttcaggtctca

SEQ ID NO: 949551 - DNA, 25 bp, Mus musculus
ggcacctctgctaccaacgcagaga

SEQ ID NO: 949552 - DNA, 25 bp, Mus musculus
ggcacctctggtaccaacgcagaga

SEQ ID NO: 949553 - DNA, 25 bp, Mus musculus
ggcacctggaagccctccccaggag

SEQ ID NO: 949554 - DNA, 25 bp, Mus musculus
ggcacctggaagctgtggtgtacct

SEQ ID NO: 949555 - DNA, 25 bp, Mus musculus
ggcacctggaaggcctccccaggag

SEQ ID NO: 949556 - DNA, 25 bp, Mus musculus
ggcacctggaaggtgtggtgtacct

SEQ ID NO: 949557 - DNA, 25 bp, Mus musculus
ggcacctggtcgcatacatcatctg

SEQ ID NO: 949558 - DNA, 25 bp, Mus musculus
ggcacctggtcggatacatcatctg

SEQ ID NO: 949559 - DNA, 25 bp, Mus musculus
ggcacctgtggaagtgctcggccct

SEQ ID NO: 949560 - DNA, 25 bp, Mus musculus
ggcacctgtggatgtgctcggccct

SEQ ID NO: 949561 - DNA, 25 bp, Mus musculus
ggcacctgttacctcggcccccaga

SEQ ID NO: 949562 - DNA, 25 bp, Mus musculus
ggcacctgttacctgggcccccaga

SEQ ID NO: 949563 - DNA, 25 bp, Mus musculus
ggcacctttgcctcagtggagcagt

SEQ ID NO: 949564 - DNA, 25 bp, Mus musculus
ggcacctttgcctctgtggagcagt

SEQ ID NO: 949565 - DNA, 25 bp, Mus musculus
ggcacgacgccacatcggaaggggg

SEQ ID NO: 949566 - DNA, 25 bp, Mus musculus
ggcacgacgccagatcggaaggggg

SEQ ID NO: 949567 - DNA, 25 bp, Mus musculus
ggcacgagagcaccctctcaaagat

SEQ ID NO: 949568 - DNA, 25 bp, Mus musculus
ggcacgagaggaccctctcaaagat

SEQ ID NO: 949569 - DNA, 25 bp, Mus musculus
ggcacgagcaagagtactgtttggc

SEQ ID NO: 949570 - DNA, 25 bp, Mus musculus
ggcacgagcaagtgtactgtttggc

SEQ ID NO: 949571 - DNA, 25 bp, Mus musculus
ggcacgcagacagacgtggacagtc

SEQ ID NO: 949572 - DNA, 25 bp, Mus musculus
ggcacgcagacagaggtggacagtc

SEQ ID NO: 949573 - DNA, 25 bp, Mus musculus
ggcacgcccagctccgataccgtgt

SEQ ID NO: 949574 - DNA, 25 bp, Mus musculus
ggcacgcccagctcggataccgtgt

SEQ ID NO: 949575 - DNA, 25 bp, Mus musculus
ggcacgcgactcaacgagggggcca

SEQ ID NO: 949576 - DNA, 25 bp, Mus musculus
ggcacgcgactcaaggagggggcca

SEQ ID NO: 949577 - DNA, 25 bp, Mus musculus
ggcacggcagaattcatgatcacac

SEQ ID NO: 949578 - DNA, 25 bp, Mus musculus
ggcacggcagcagtattcatgatca

SEQ ID NO: 949579 - DNA, 25 bp, Mus musculus
ggcacggcagcattcacagatggag

SEQ ID NO: 949580 - DNA, 25 bp, Mus musculus
ggcacggcaggagtattcatgatca

SEQ ID NO: 949581 - DNA, 25 bp, Mus musculus
ggcacggcaggattcacagatggag

SEQ ID NO: 949582 - DNA, 25 bp, Mus musculus
ggcacggcaggtaaacagtattcat

SEQ ID NO: 949583 - DNA, 25 bp, Mus musculus
ggcacggcaggtaatcagtattcat

SEQ ID NO: 949584 - DNA, 25 bp, Mus musculus
ggcacggcagtattcatgatcacac

SEQ ID NO: 949585 - DNA, 25 bp, Mus musculus
ggcacggccaggacagtatagtgga

SEQ ID NO: 949586 - DNA, 25 bp, Mus musculus
ggcacggccaggactgtatagtgga

SEQ ID NO: 949587 - DNA, 25 bp, Mus musculus
ggcacgggagaccgggtttgcacat

SEQ ID NO: 949588 - DNA, 25 bp, Mus musculus
ggcacgggagcctatgggaaggtgt

SEQ ID NO: 949589 - DNA, 25 bp, Mus musculus
ggcacgggaggctatgggaaggtgt

SEQ ID NO: 949590 - DNA, 25 bp, Mus musculus
ggcacgggagtccgggtttgcacat

SEQ ID NO: 949591 - DNA, 25 bp, Mus musculus
ggcacgtgaccgactccgggacgca

SEQ ID NO: 949592 - DNA, 25 bp, Mus musculus
ggcacgtgaccgtctccgggacgca

SEQ ID NO: 949593 - DNA, 25 bp, Mus musculus
ggcacgtgagctggtgatggagttt

SEQ ID NO: 949594 - DNA, 25 bp, Mus musculus
ggcacgtgaggtggtgatggagttt

SEQ ID NO: 949595 - DNA, 25 bp, Mus musculus
ggcactaacacaacctttagaagta

SEQ ID NO: 949596 - DNA, 25 bp, Mus musculus
ggcactaacagaacctttagaagta

SEQ ID NO: 949597 - DNA, 25 bp, Mus musculus
ggcactacagatgctcatgacatct

SEQ ID NO: 949598 - DNA, 25 bp, Mus musculus
ggcactacagttgctcatgacatct

SEQ ID NO: 949599 - DNA, 25 bp, Mus musculus
ggcactaccaacaacgactcagact

SEQ ID NO: 949600 - DNA, 25 bp, Mus musculus
ggcactaccaacaaggactcagact

SEQ ID NO: 949601 - DNA, 25 bp, Mus musculus
ggcactactgcagacgctgaagaga

SEQ ID NO: 949602 - DNA, 25 bp, Mus musculus
ggcactactgcagaggctgaagaga

SEQ ID NO: 949603 - DNA, 25 bp, Mus musculus
ggcactagatagagcagaagcattg

SEQ ID NO: 949604 - DNA, 25 bp, Mus musculus
ggcactagatagtgcagaagcattg

SEQ ID NO: 949605 - DNA, 25 bp, Mus musculus
ggcactcaagcactataagtcaagc

SEQ ID NO: 949606 - DNA, 25 bp, Mus musculus
ggcactcaaggactataagtcaagc

SEQ ID NO: 949607 - DNA, 25 bp, Mus musculus
ggcactcaggccatcgtccagagaa

SEQ ID NO: 949608 - DNA, 25 bp, Mus musculus
ggcactcaggccatggtccagagaa

SEQ ID NO: 949609 - DNA, 25 bp, Mus musculus
ggcactccagattctcctgctcagc

SEQ ID NO: 949610 - DNA, 25 bp, Mus musculus
ggcactccagtttctcctgctcagc

SEQ ID NO: 949611 - DNA, 25 bp, Mus musculus
ggcactcccatgcgttctccatatc

SEQ ID NO: 949612 - DNA, 25 bp, Mus musculus
ggcactcccatgggttctccatatc

SEQ ID NO: 949613 - DNA, 25 bp, Mus musculus
ggcactcctgactacgccccagatc

SEQ ID NO: 949614 - DNA, 25 bp, Mus musculus
ggcactcctgactaggccccagatc

SEQ ID NO: 949615 - DNA, 25 bp, Mus musculus
ggcactctcgagcaaatcatgaagg

SEQ ID NO: 949616 - DNA, 25 bp, Mus musculus
ggcactctcgaggaaatcatgaagg

SEQ ID NO: 949617 - DNA, 25 bp, Mus musculus
ggcactctttgacgaagaaatggac

SEQ ID NO: 949618 - DNA, 25 bp, Mus musculus
ggcactctttgaggaagaaatggac

SEQ ID NO: 949619 - DNA, 25 bp, Mus musculus
ggcactgagacacggctttctgagg

SEQ ID NO: 949620 - DNA, 25 bp, Mus musculus
ggcactgagacagggctttctgagg

SEQ ID NO: 949621 - DNA, 25 bp, Mus musculus
ggcactgcagagacaggtacttgga

SEQ ID NO: 949622 - DNA, 25 bp, Mus musculus
ggcactgcagagtcaggtacttgga

SEQ ID NO: 949623 - DNA, 25 bp, Mus musculus
ggcactgcggctacctggcgctggt

SEQ ID NO: 949624 - DNA, 25 bp, Mus musculus
ggcactgcgggtacctggcgctggt

SEQ ID NO: 949625 - DNA, 25 bp, Mus musculus
ggcactgcttaacctagatagacga

SEQ ID NO: 949626 - DNA, 25 bp, Mus musculus
ggcactgcttaagctagatagacga

SEQ ID NO: 949627 - DNA, 25 bp, Mus musculus
ggcactggacaacgacagcggccac

SEQ ID NO: 949628 - DNA, 25 bp, Mus musculus
ggcactggacaaggacagcggccac

SEQ ID NO: 949629 - DNA, 25 bp, Mus musculus
ggcactggagagctatcttcagaga

SEQ ID NO: 949630 - DNA, 25 bp, Mus musculus
ggcactggagaggtatcttcagaga

SEQ ID NO: 949631 - DNA, 25 bp, Mus musculus
ggcactggcacgaaatcctagtttc

SEQ ID NO: 949632 - DNA, 25 bp, Mus musculus
ggcactggcacgaattcctagtttc

SEQ ID NO: 949633 - DNA, 25 bp, Mus musculus
ggcactggccaaggccaagttcccc

SEQ ID NO: 949634 - DNA, 25 bp, Mus musculus
ggcactggccaagggcaagttcccc

SEQ ID NO: 949635 - DNA, 25 bp, Mus musculus
ggcactggtgcacattctgggcctc

SEQ ID NO: 949636 - DNA, 25 bp, Mus musculus
ggcactggtgcagattctgggcctc

SEQ ID NO: 949637 - DNA, 25 bp, Mus musculus
ggcactgtgaggatctttaactcag

SEQ ID NO: 949638 - DNA, 25 bp, Mus musculus
ggcactgtgaggttctttaactcag

SEQ ID NO: 949639 - DNA, 25 bp, Mus musculus
ggcactgttgtggcagaaaaggacc

SEQ ID NO: 949640 - DNA, 25 bp, Mus musculus
ggcactgttgtggctgaaaaggacc

SEQ ID NO: 949641 - DNA, 25 bp, Mus musculus
ggcacttctgatgttcagcaaaccc

SEQ ID NO: 949642 - DNA, 25 bp, Mus musculus
ggcacttctgttgttcagcaaaccc

SEQ ID NO: 949643 - DNA, 25 bp, Mus musculus
ggcactttagagcaaattatgaaag

SEQ ID NO: 949644 - DNA, 25 bp, Mus musculus
ggcactttagaggaaattatgaaag

SEQ ID NO: 949645 - DNA, 25 bp, Mus musculus
ggcactttccagacaaccaaggccg

SEQ ID NO: 949646 - DNA, 25 bp, Mus musculus
ggcactttccagtcaaccaaggccg

SEQ ID NO: 949647 - DNA, 25 bp, Mus musculus
ggcactttttgacgaagagatggac

SEQ ID NO: 949648 - DNA, 25 bp, Mus musculus
ggcactttttgaggaagagatggac

SEQ ID NO: 949649 - DNA, 25 bp, Mus musculus
ggcagaaaagagctcaaaatgcaga

SEQ ID NO: 949650 - DNA, 25 bp, Mus musculus
ggcagaaaagaggtcaaaatgcaga

SEQ ID NO: 949651 - DNA, 25 bp, Mus musculus
ggcagaaaagcctacagaagaagtt

SEQ ID NO: 949652 - DNA, 25 bp, Mus musculus
ggcagaaaaggctacagaagaagtt

SEQ ID NO: 949653 - DNA, 25 bp, Mus musculus
ggcagaaactggccagcaagcctgc

SEQ ID NO: 949654 - DNA, 25 bp, Mus musculus
ggcagaaactgggcagcaagcctgc

SEQ ID NO: 949655 - DNA, 25 bp, Mus musculus
ggcagaacgcagcctcaccctcgct

SEQ ID NO: 949656 - DNA, 25 bp, Mus musculus
ggcagaacgcaggctcaccctcgct

SEQ ID NO: 949657 - DNA, 25 bp, Mus musculus
ggcagaagccagcacatgtgttctg

SEQ ID NO: 949658 - DNA, 25 bp, Mus musculus
ggcagaagccagcagatgtgttctg

SEQ ID NO: 949659 - DNA, 25 bp, Mus musculus
ggcagaagccagcccctgacctcac

SEQ ID NO: 949660 - DNA, 25 bp, Mus musculus
ggcagaagccaggccctgacctcac

SEQ ID NO: 949661 - DNA, 25 bp, Mus musculus
ggcagaaggcaacgttcggctcctg

SEQ ID NO: 949662 - DNA, 25 bp, Mus musculus
ggcagaaggcaaggttcggctcctg

SEQ ID NO: 949663 - DNA, 25 bp, Mus musculus
ggcagaatgctacagtacagtgatg

SEQ ID NO: 949664 - DNA, 25 bp, Mus musculus
ggcagaatgctagagtacagtgatg

SEQ ID NO: 949665 - DNA, 25 bp, Mus musculus
ggcagacctaaccattcaggccaca

SEQ ID NO: 949666 - DNA, 25 bp, Mus musculus
ggcagacctaacgattcaggccaca

SEQ ID NO: 949667 - DNA, 25 bp, Mus musculus
ggcagacctcagaggcttggatgaa

SEQ ID NO: 949668 - DNA, 25 bp, Mus musculus
ggcagacctcagtggcttggatgaa

SEQ ID NO: 949669 - DNA, 25 bp, Mus musculus
ggcagactccagaatggagaagatg

SEQ ID NO: 949670 - DNA, 25 bp, Mus musculus
ggcagactccagtatggagaagatg

SEQ ID NO: 949671 - DNA, 25 bp, Mus musculus
ggcagactgcagattcaggtcagag

SEQ ID NO: 949672 - DNA, 25 bp, Mus musculus
ggcagactgcagcctaggatgtcag

SEQ ID NO: 949673 - DNA, 25 bp, Mus musculus
ggcagactgcaggctaggatgtcag

SEQ ID NO: 949674 - DNA, 25 bp, Mus musculus
ggcagactgcagtttcaggtcagag

SEQ ID NO: 949675 - DNA, 25 bp, Mus musculus
ggcagagaaaatgacttgccaaaag

SEQ ID NO: 949676 - DNA, 25 bp, Mus musculus
ggcagagaaaatgagttgccaaaag

SEQ ID NO: 949677 - DNA, 25 bp, Mus musculus
ggcagagaaatggacagaagcccgg

SEQ ID NO: 949678 - DNA, 25 bp, Mus musculus
ggcagagaaatggagagaagcccgg

SEQ ID NO: 949679 - DNA, 25 bp, Mus musculus
ggcagagaagcaacatggcttctgc

SEQ ID NO: 949680 - DNA, 25 bp, Mus musculus
ggcagagaagcaataccacatcaca

SEQ ID NO: 949681 - DNA, 25 bp, Mus musculus
ggcagagaagcaccggtacctggat

SEQ ID NO: 949682 - DNA, 25 bp, Mus musculus
ggcagagaagcagcggtacctggat

SEQ ID NO: 949683 - DNA, 25 bp, Mus musculus
ggcagagaaggaacatggcttctgc

SEQ ID NO: 949684 - DNA, 25 bp, Mus musculus
ggcagagaaggaataccacatcaca

SEQ ID NO: 949685 - DNA, 25 bp, Mus musculus
ggcagagaatttcacgaatagtggt

SEQ ID NO: 949686 - DNA, 25 bp, Mus musculus
ggcagagaatttcaggaatagtggt

SEQ ID NO: 949687 - DNA, 25 bp, Mus musculus
ggcagagacgcagggcatgctcaaa

SEQ ID NO: 949688 - DNA, 25 bp, Mus musculus
ggcagagacggagggcatgctcaaa

SEQ ID NO: 949689 - DNA, 25 bp, Mus musculus
ggcagagcaccgcattgattttgtc

SEQ ID NO: 949690 - DNA, 25 bp, Mus musculus
ggcagagcaccggattgattttgtc

SEQ ID NO: 949691 - DNA, 25 bp, Mus musculus
ggcagagcagaccattaagcaccta

SEQ ID NO: 949692 - DNA, 25 bp, Mus musculus
ggcagagcagtccattaagcaccta

SEQ ID NO: 949693 - DNA, 25 bp, Mus musculus
ggcagagccaagcacttacgcctgg

SEQ ID NO: 949694 - DNA, 25 bp, Mus musculus
ggcagagccaaggacttacgcctgg

SEQ ID NO: 949695 - DNA, 25 bp, Mus musculus
ggcagagcccttcacgaactctgcc

SEQ ID NO: 949696 - DNA, 25 bp, Mus musculus
ggcagagcccttcaggaactctgcc

SEQ ID NO: 949697 - DNA, 25 bp, Mus musculus
ggcagagcctcacaatctatcactg

SEQ ID NO: 949698 - DNA, 25 bp, Mus musculus
ggcagagcctcagaatctatcactg

SEQ ID NO: 949699 - DNA, 25 bp, Mus musculus
ggcagagcctgacatctggtggctc

SEQ ID NO: 949700 - DNA, 25 bp, Mus musculus
ggcagagcctgacgcccaggatggg

SEQ ID NO: 949701 - DNA, 25 bp, Mus musculus
ggcagagcctgagatctggtggctc

SEQ ID NO: 949702 - DNA, 25 bp, Mus musculus
ggcagagcctgaggcccaggatggg

SEQ ID NO: 949703 - DNA, 25 bp, Mus musculus
ggcagagctaaacggtttggatcca

SEQ ID NO: 949704 - DNA, 25 bp, Mus musculus
ggcagagctaaagggtttggatcca

SEQ ID NO: 949705 - DNA, 25 bp, Mus musculus
ggcagagctcagcatttctggtagg

SEQ ID NO: 949706 - DNA, 25 bp, Mus musculus
ggcagagctcaggatttctggtagg

SEQ ID NO: 949707 - DNA, 25 bp, Mus musculus
ggcagaggacaactcttcgttgagt

SEQ ID NO: 949708 - DNA, 25 bp, Mus musculus
ggcagaggacaagtcttcgttgagt

SEQ ID NO: 949709 - DNA, 25 bp, Mus musculus
ggcagaggagagcctgaacatctat

SEQ ID NO: 949710 - DNA, 25 bp, Mus musculus
ggcagaggagattaacaacatgaag

SEQ ID NO: 949711 - DNA, 25 bp, Mus musculus
ggcagaggagcctggaggagggacg

SEQ ID NO: 949712 - DNA, 25 bp, Mus musculus
ggcagaggagctagaggaggcttcc

SEQ ID NO: 949713 - DNA, 25 bp, Mus musculus
ggcagaggagctttccaagctagac

SEQ ID NO: 949714 - DNA, 25 bp, Mus musculus
ggcagaggaggctggaggagggacg

SEQ ID NO: 949715 - DNA, 25 bp, Mus musculus
ggcagaggaggtagaggaggcttcc

SEQ ID NO: 949716 - DNA, 25 bp, Mus musculus
ggcagaggaggtttccaagctagac

SEQ ID NO: 949717 - DNA, 25 bp, Mus musculus
ggcagaggagtgcctgaacatctat

SEQ ID NO: 949718 - DNA, 25 bp, Mus musculus
ggcagaggagtttaacaacatgaag

SEQ ID NO: 949719 - DNA, 25 bp, Mus musculus
ggcagaggcacacattcggtcattt

SEQ ID NO: 949720 - DNA, 25 bp, Mus musculus
ggcagaggcacagattcggtcattt

SEQ ID NO: 949721 - DNA, 25 bp, Mus musculus
ggcagaggcaccgccatgtgctggc

SEQ ID NO: 949722 - DNA, 25 bp, Mus musculus
ggcagaggcaccgccgaccgtctgg

SEQ ID NO: 949723 - DNA, 25 bp, Mus musculus
ggcagaggcaccgcgatgtgctggc

SEQ ID NO: 949724 - DNA, 25 bp, Mus musculus
ggcagaggcaccgcggaccgtctgg

SEQ ID NO: 949725 - DNA, 25 bp, Mus musculus
ggcagaggtaaacacaatagaatcc

SEQ ID NO: 949726 - DNA, 25 bp, Mus musculus
ggcagaggtaaacagaatagaatcc

SEQ ID NO: 949727 - DNA, 25 bp, Mus musculus
ggcagaggtgctgctctctgatcca

SEQ ID NO: 949728 - DNA, 25 bp, Mus musculus
ggcagaggtggtgctctctgatcca

SEQ ID NO: 949729 - DNA, 25 bp, Mus musculus
ggcagagtcctgcttgtgttagtct

SEQ ID NO: 949730 - DNA, 25 bp, Mus musculus
ggcagagtcctggttgtgttagtct

SEQ ID NO: 949731 - DNA, 25 bp, Mus musculus
ggcagagttaaactacatttctgga

SEQ ID NO: 949732 - DNA, 25 bp, Mus musculus
ggcagagttaaagtacatttctgga

SEQ ID NO: 949733 - DNA, 25 bp, Mus musculus
ggcagagttcaacgccagcctgtcc

SEQ ID NO: 949734 - DNA, 25 bp, Mus musculus
ggcagagttcaaggccagcctgtcc

SEQ ID NO: 949735 - DNA, 25 bp, Mus musculus
ggcagatcctctcatggagccagag

SEQ ID NO: 949736 - DNA, 25 bp, Mus musculus
ggcagatcctctgatggagccagag

SEQ ID NO: 949737 - DNA, 25 bp, Mus musculus
ggcagatctacgcttgttctcaaga

SEQ ID NO: 949738 - DNA, 25 bp, Mus musculus
ggcagatctacggttgttctcaaga

SEQ ID NO: 949739 - DNA, 25 bp, Mus musculus
ggcagatgaaacaaagtgctgctgc

SEQ ID NO: 949740 - DNA, 25 bp, Mus musculus
ggcagatgaaacaatgtgctgctgc

SEQ ID NO: 949741 - DNA, 25 bp, Mus musculus
ggcagatgacagcctgctcaggatc

SEQ ID NO: 949742 - DNA, 25 bp, Mus musculus
ggcagatgacaggctgctcaggatc

SEQ ID NO: 949743 - DNA, 25 bp, Mus musculus
ggcagatgcgcacgtcttgatttgg

SEQ ID NO: 949744 - DNA, 25 bp, Mus musculus
ggcagatgcgcaggtcttgatttgg

SEQ ID NO: 949745 - DNA, 25 bp, Mus musculus
ggcagcaccggaacatacatgcctg

SEQ ID NO: 949746 - DNA, 25 bp, Mus musculus
ggcagcaccggaacttacatgcctg

SEQ ID NO: 949747 - DNA, 25 bp, Mus musculus
ggcagcagacctcgaaagcaaagcc

SEQ ID NO: 949748 - DNA, 25 bp, Mus musculus
ggcagcagacctggaaagcaaagcc

SEQ ID NO: 949749 - DNA, 25 bp, Mus musculus
ggcagcagagaacaaagcccgctgg

SEQ ID NO: 949750 - DNA, 25 bp, Mus musculus
ggcagcagagaacggcggtgctggt

SEQ ID NO: 949751 - DNA, 25 bp, Mus musculus
ggcagcagagaagaaagcccgctgg

SEQ ID NO: 949752 - DNA, 25 bp, Mus musculus
ggcagcagagaagggcggtgctggt

SEQ ID NO: 949753 - DNA, 25 bp, Mus musculus
ggcagcagcgcaccctcaggctggc

SEQ ID NO: 949754 - DNA, 25 bp, Mus musculus
ggcagcagcgcagcctcaggctggc

SEQ ID NO: 949755 - DNA, 25 bp, Mus musculus
ggcagcagcgctcacggcgacgcag

SEQ ID NO: 949756 - DNA, 25 bp, Mus musculus
ggcagcagcgctcagggcgacgcag

SEQ ID NO: 949757 - DNA, 25 bp, Mus musculus
ggcagcagtacccgaagctgctcag

SEQ ID NO: 949758 - DNA, 25 bp, Mus musculus
ggcagcagtaccggaagctgctcag

SEQ ID NO: 949759 - DNA, 25 bp, Mus musculus
ggcagcatcccactcgaaagggcat

SEQ ID NO: 949760 - DNA, 25 bp, Mus musculus
ggcagcatcccactggaaagggcat

SEQ ID NO: 949761 - DNA, 25 bp, Mus musculus
ggcagccattgtcctggccttaggt

SEQ ID NO: 949762 - DNA, 25 bp, Mus musculus
ggcagccattgtgctggccttaggt

SEQ ID NO: 949763 - DNA, 25 bp, Mus musculus
ggcagcccacaacttaactggcctt

SEQ ID NO: 949764 - DNA, 25 bp, Mus musculus
ggcagcccacaagttaactggcctt

SEQ ID NO: 949765 - DNA, 25 bp, Mus musculus
ggcagcccagcgatgcagcgtcggc

SEQ ID NO: 949766 - DNA, 25 bp, Mus musculus
ggcagcccagggatgcagcgtcggc

SEQ ID NO: 949767 - DNA, 25 bp, Mus musculus
ggcagcccctcagactgaagttgct

SEQ ID NO: 949768 - DNA, 25 bp, Mus musculus
ggcagcccctcagcagactgaagtt

SEQ ID NO: 949769 - DNA, 25 bp, Mus musculus
ggcagcccctgagactgaagttgct

SEQ ID NO: 949770 - DNA, 25 bp, Mus musculus
ggcagcccctgagcagactgaagtt

SEQ ID NO: 949771 - DNA, 25 bp, Mus musculus
ggcagccgaccctgaagctgaggtg

SEQ ID NO: 949772 - DNA, 25 bp, Mus musculus
ggcagccgacgctgaagctgaggtg

SEQ ID NO: 949773 - DNA, 25 bp, Mus musculus
ggcagcctacccaacgaaactgcca

SEQ ID NO: 949774 - DNA, 25 bp, Mus musculus
ggcagcctacccaaggaaactgcca

SEQ ID NO: 949775 - DNA, 25 bp, Mus musculus
ggcagcctttagagtggcagtgtgt

SEQ ID NO: 949776 - DNA, 25 bp, Mus musculus
ggcagcctttagtgtggcagtgtgt

SEQ ID NO: 949777 - DNA, 25 bp, Mus musculus
ggcagcgacaaggcctttgcctctg

SEQ ID NO: 949778 - DNA, 25 bp, Mus musculus
ggcagcgacatggcctttgcctctg

SEQ ID NO: 949779 - DNA, 25 bp, Mus musculus
ggcagcgactttctgttccaggccc

SEQ ID NO: 949780 - DNA, 25 bp, Mus musculus
ggcagcgactttgtgttccaggccc

SEQ ID NO: 949781 - DNA, 25 bp, Mus musculus
ggcagcgagcgactggtgatcatgt

SEQ ID NO: 949782 - DNA, 25 bp, Mus musculus
ggcagcgagcgagtggtgatcatgt

SEQ ID NO: 949783 - DNA, 25 bp, Mus musculus
ggcagcgcggctgctgtatgctgta

SEQ ID NO: 949784 - DNA, 25 bp, Mus musculus
ggcagcgcgggtgctgtatgctgta

SEQ ID NO: 949785 - DNA, 25 bp, Mus musculus
ggcagcgtagagctttatgcagaga

SEQ ID NO: 949786 - DNA, 25 bp, Mus musculus
ggcagcgtagaggtttatgcagaga

SEQ ID NO: 949787 - DNA, 25 bp, Mus musculus
ggcagcgtcttccaaatatggcatg

SEQ ID NO: 949788 - DNA, 25 bp, Mus musculus
ggcagcgtcttccatatatggcatg

SEQ ID NO: 949789 - DNA, 25 bp, Mus musculus
ggcagctactcgcgacccgcaggag

SEQ ID NO: 949790 - DNA, 25 bp, Mus musculus
ggcagctactcgggacccgcaggag

SEQ ID NO: 949791 - DNA, 25 bp, Mus musculus
ggcagctagctgcatcaccgacaac

SEQ ID NO: 949792 - DNA, 25 bp, Mus musculus
ggcagctagctggatcaccgacaac

SEQ ID NO: 949793 - DNA, 25 bp, Mus musculus
ggcagctatgcgaaagagataccac

SEQ ID NO: 949794 - DNA, 25 bp, Mus musculus
ggcagctatgggaaagagataccac

SEQ ID NO: 949795 - DNA, 25 bp, Mus musculus
ggcagctcagcaaaataaaaaccaa

SEQ ID NO: 949796 - DNA, 25 bp, Mus musculus
ggcagctcagccctatgggctttct

SEQ ID NO: 949797 - DNA, 25 bp, Mus musculus
ggcagctcagcctcagggaagacca

SEQ ID NO: 949798 - DNA, 25 bp, Mus musculus
ggcagctcagctgcctggtcataga

SEQ ID NO: 949799 - DNA, 25 bp, Mus musculus
ggcagctcaggaaaataaaaaccaa

SEQ ID NO: 949800 - DNA, 25 bp, Mus musculus
ggcagctcaggcctatgggctttct

SEQ ID NO: 949801 - DNA, 25 bp, Mus musculus
ggcagctcaggctcagggaagacca

SEQ ID NO: 949802 - DNA, 25 bp, Mus musculus
ggcagctcaggtgcctggtcataga

SEQ ID NO: 949803 - DNA, 25 bp, Mus musculus
ggcagctcgacacatgccaaagtct

SEQ ID NO: 949804 - DNA, 25 bp, Mus musculus
ggcagctcgacacgtgcagggccct

SEQ ID NO: 949805 - DNA, 25 bp, Mus musculus
ggcagctcgacagatgccaaagtct

SEQ ID NO: 949806 - DNA, 25 bp, Mus musculus
ggcagctcgacaggtgcagggccct

SEQ ID NO: 949807 - DNA, 25 bp, Mus musculus
ggcagctgagagctttgccaaggag

SEQ ID NO: 949808 - DNA, 25 bp, Mus musculus
ggcagctgagaggtttgccaaggag

SEQ ID NO: 949809 - DNA, 25 bp, Mus musculus
ggcagctgagattcctgctgcttag

SEQ ID NO: 949810 - DNA, 25 bp, Mus musculus
ggcagctgagctgtgactttgaggt

SEQ ID NO: 949811 - DNA, 25 bp, Mus musculus
ggcagctgaggtgtgactttgaggt

SEQ ID NO: 949812 - DNA, 25 bp, Mus musculus
ggcagctgagtttcctgctgcttag

SEQ ID NO: 949813 - DNA, 25 bp, Mus musculus
ggcagctgcgatgaccttaaaagat

SEQ ID NO: 949814 - DNA, 25 bp, Mus musculus
ggcagctgcgatgagcttaaaagat

SEQ ID NO: 949815 - DNA, 25 bp, Mus musculus
ggcagctgtgaaaacggtcaagcag

SEQ ID NO: 949816 - DNA, 25 bp, Mus musculus
ggcagctgtgaaaagggtcaagcag

SEQ ID NO: 949817 - DNA, 25 bp, Mus musculus
ggcagcttcgccacatatttcatct

SEQ ID NO: 949818 - DNA, 25 bp, Mus musculus
ggcagcttcggcacatatttcatct

SEQ ID NO: 949819 - DNA, 25 bp, Mus musculus
ggcagctttggcaacgtgctgctgg

SEQ ID NO: 949820 - DNA, 25 bp, Mus musculus
ggcagctttggcaaggtgctgctgg

SEQ ID NO: 949821 - DNA, 25 bp, Mus musculus
ggcaggaacatcaacgtgggaagac

SEQ ID NO: 949822 - DNA, 25 bp, Mus musculus
ggcaggaacatcaaggtgggaagac

SEQ ID NO: 949823 - DNA, 25 bp, Mus musculus
ggcaggaactgtctggacgaccccc

SEQ ID NO: 949824 - DNA, 25 bp, Mus musculus
ggcaggaactgtgtggacgaccccc

SEQ ID NO: 949825 - DNA, 25 bp, Mus musculus
ggcaggaagaagcttgctcaggacc

SEQ ID NO: 949826 - DNA, 25 bp, Mus musculus
ggcaggaagaaggttgctcaggacc

SEQ ID NO: 949827 - DNA, 25 bp, Mus musculus
ggcaggacccacaggtgactcaggg

SEQ ID NO: 949828 - DNA, 25 bp, Mus musculus
ggcaggacccactggtgactcaggg

SEQ ID NO: 949829 - DNA, 25 bp, Mus musculus
ggcaggacgtcacacacagcgttca

SEQ ID NO: 949830 - DNA, 25 bp, Mus musculus
ggcaggacgtcagacacagcgttca

SEQ ID NO: 949831 - DNA, 25 bp, Mus musculus
ggcaggagacaacaacttcatcact

SEQ ID NO: 949832 - DNA, 25 bp, Mus musculus
ggcaggagacaagaacttcatcact

SEQ ID NO: 949833 - DNA, 25 bp, Mus musculus
ggcaggaggcagaaaggatgagcgc

SEQ ID NO: 949834 - DNA, 25 bp, Mus musculus
ggcaggaggcagctcattcattcaa

SEQ ID NO: 949835 - DNA, 25 bp, Mus musculus
ggcaggaggcaggtcattcattcaa

SEQ ID NO: 949836 - DNA, 25 bp, Mus musculus
ggcaggaggcagtaaggatgagcgc

SEQ ID NO: 949837 - DNA, 25 bp, Mus musculus
ggcaggaggccacagacaagaggac

SEQ ID NO: 949838 - DNA, 25 bp, Mus musculus
ggcaggaggccagagacaagaggac

SEQ ID NO: 949839 - DNA, 25 bp, Mus musculus
ggcaggaggctggacagtccttagc

SEQ ID NO: 949840 - DNA, 25 bp, Mus musculus
ggcaggaggctggagagtccttagc

SEQ ID NO: 949841 - DNA, 25 bp, Mus musculus
ggcaggatggaacgcacttgaagag

SEQ ID NO: 949842 - DNA, 25 bp, Mus musculus
ggcaggatggaaggcacttgaagag

SEQ ID NO: 949843 - DNA, 25 bp, Mus musculus
ggcaggatggtctccgacatcaaca

SEQ ID NO: 949844 - DNA, 25 bp, Mus musculus
ggcaggatggtctcggacatcaaca

SEQ ID NO: 949845 - DNA, 25 bp, Mus musculus
ggcaggattcaccttggtgaccaga

SEQ ID NO: 949846 - DNA, 25 bp, Mus musculus
ggcaggattcacgttggtgaccaga

SEQ ID NO: 949847 - DNA, 25 bp, Mus musculus
ggcaggatttcacgcaattacctcc

SEQ ID NO: 949848 - DNA, 25 bp, Mus musculus
ggcaggatttcaggcaattacctcc

SEQ ID NO: 949849 - DNA, 25 bp, Mus musculus
ggcaggcacagacatgagtcagtct

SEQ ID NO: 949850 - DNA, 25 bp, Mus musculus
ggcaggcacagagatgagtcagtct

SEQ ID NO: 949851 - DNA, 25 bp, Mus musculus
ggcaggcaccagactctggggtggc

SEQ ID NO: 949852 - DNA, 25 bp, Mus musculus
ggcaggcaccagtctctggggtggc

SEQ ID NO: 949853 - DNA, 25 bp, Mus musculus
ggcaggccacaacgtggcccaggag

SEQ ID NO: 949854 - DNA, 25 bp, Mus musculus
ggcaggccacaaggtggcccaggag

SEQ ID NO: 949855 - DNA, 25 bp, Mus musculus
ggcaggcctgaccagcttggtggca

SEQ ID NO: 949856 - DNA, 25 bp, Mus musculus
ggcaggcctgcccagcgcagactta

SEQ ID NO: 949857 - DNA, 25 bp, Mus musculus
ggcaggcctgcgcagacttaatgaa

SEQ ID NO: 949858 - DNA, 25 bp, Mus musculus
ggcaggcctggccagcgcagactta

SEQ ID NO: 949859 - DNA, 25 bp, Mus musculus
ggcaggcctgggcagacttaatgaa

SEQ ID NO: 949860 - DNA, 25 bp, Mus musculus
ggcaggcctgtccagcttggtggca

SEQ ID NO: 949861 - DNA, 25 bp, Mus musculus
ggcaggctcaggccaccccacatca

SEQ ID NO: 949862 - DNA, 25 bp, Mus musculus
ggcaggctcaggctaccgagtctat

SEQ ID NO: 949863 - DNA, 25 bp, Mus musculus
ggcaggctcagggcaccccacatca

SEQ ID NO: 949864 - DNA, 25 bp, Mus musculus
ggcaggctcagggtaccgagtctat

SEQ ID NO: 949865 - DNA, 25 bp, Mus musculus
ggcaggctgcagctaactagttctc

SEQ ID NO: 949866 - DNA, 25 bp, Mus musculus
ggcaggctgcaggtaactagttctc

SEQ ID NO: 949867 - DNA, 25 bp, Mus musculus
ggcagggactggcctgcaggtcctg

SEQ ID NO: 949868 - DNA, 25 bp, Mus musculus
ggcagggactgggctgcaggtcctg

SEQ ID NO: 949869 - DNA, 25 bp, Mus musculus
ggcagggatcagatgggactgagta

SEQ ID NO: 949870 - DNA, 25 bp, Mus musculus
ggcagggatcagttgggactgagta

SEQ ID NO: 949871 - DNA, 25 bp, Mus musculus
ggcagggggcggcatccagagcaac

SEQ ID NO: 949872 - DNA, 25 bp, Mus musculus
ggcagggggcgggatccagagcaac

SEQ ID NO: 949873 - DNA, 25 bp, Mus musculus
ggcagggtgtgacgtaaccatcctg

SEQ ID NO: 949874 - DNA, 25 bp, Mus musculus
ggcagggtgtgaggtaaccatcctg

SEQ ID NO: 949875 - DNA, 25 bp, Mus musculus
ggcaggtaatcagtattcatgatca

SEQ ID NO: 949876 - DNA, 25 bp, Mus musculus
ggcaggtaatgagtattcatgatca

SEQ ID NO: 949877 - DNA, 25 bp, Mus musculus
ggcaggtccaagccttgagattttt

SEQ ID NO: 949878 - DNA, 25 bp, Mus musculus
ggcaggtccaaggcttgagattttt

SEQ ID NO: 949879 - DNA, 25 bp, Mus musculus
ggcaggtgacagccatcgactgggc

SEQ ID NO: 949880 - DNA, 25 bp, Mus musculus
ggcaggtgacaggcatcgactgggc

SEQ ID NO: 949881 - DNA, 25 bp, Mus musculus
ggcaggttcgaacatgtctatcagc

SEQ ID NO: 949882 - DNA, 25 bp, Mus musculus
ggcaggttcgaagatgtctatcagc

SEQ ID NO: 949883 - DNA, 25 bp, Mus musculus
ggcagtagagacagatacagagttc

SEQ ID NO: 949884 - DNA, 25 bp, Mus musculus
ggcagtagagtcagatacagagttc

SEQ ID NO: 949885 - DNA, 25 bp, Mus musculus
ggcagtagccagcccatggaagtac

SEQ ID NO: 949886 - DNA, 25 bp, Mus musculus
ggcagtagccaggccatggaagtac

SEQ ID NO: 949887 - DNA, 25 bp, Mus musculus
ggcagtctctggcttcagacaatga

SEQ ID NO: 949888 - DNA, 25 bp, Mus musculus
ggcagtctctgggttcagacaatga

SEQ ID NO: 949889 - DNA, 25 bp, Mus musculus
ggcagtgaaacacctgggtgttaac

SEQ ID NO: 949890 - DNA, 25 bp, Mus musculus
ggcagtgaaacagctgggtgttaac

SEQ ID NO: 949891 - DNA, 25 bp, Mus musculus
ggcagtgaagcaccgtgcaggcagc

SEQ ID NO: 949892 - DNA, 25 bp, Mus musculus
ggcagtgaagccccttgctgctgga

SEQ ID NO: 949893 - DNA, 25 bp, Mus musculus
ggcagtgaaggaccgtgcaggcagc

SEQ ID NO: 949894 - DNA, 25 bp, Mus musculus
ggcagtgaaggcccttgctgctgga

SEQ ID NO: 949895 - DNA, 25 bp, Mus musculus
ggcagtgagccacatgccttctggg

SEQ ID NO: 949896 - DNA, 25 bp, Mus musculus
ggcagtgagccagatgccttctggg

SEQ ID NO: 949897 - DNA, 25 bp, Mus musculus
ggcagtgccagggacgtgtgaatga

SEQ ID NO: 949898 - DNA, 25 bp, Mus musculus
ggcagtgccagggaggtgtgaatga

SEQ ID NO: 949899 - DNA, 25 bp, Mus musculus
ggcagtgcctagatattgatgaatg

SEQ ID NO: 949900 - DNA, 25 bp, Mus musculus
ggcagtgcctagttattgatgaatg

SEQ ID NO: 949901 - DNA, 25 bp, Mus musculus
ggcagtggcgcacgatggcgcagaa

SEQ ID NO: 949902 - DNA, 25 bp, Mus musculus
ggcagtggcgcacttttactttcaa

SEQ ID NO: 949903 - DNA, 25 bp, Mus musculus
ggcagtggcgcaggatggcgcagaa

SEQ ID NO: 949904 - DNA, 25 bp, Mus musculus
ggcagtggcgcagttttactttcaa

SEQ ID NO: 949905 - DNA, 25 bp, Mus musculus
ggcagtggtggacgtcagagtcaga

SEQ ID NO: 949906 - DNA, 25 bp, Mus musculus
ggcagtggtggacgtcagggtagta

SEQ ID NO: 949907 - DNA, 25 bp, Mus musculus
ggcagtggtggaggtcagagtcaga

SEQ ID NO: 949908 - DNA, 25 bp, Mus musculus
ggcagtggtggaggtcagggtagta

SEQ ID NO: 949909 - DNA, 25 bp, Mus musculus
ggcagtgtgaagacattgacgagtg

SEQ ID NO: 949910 - DNA, 25 bp, Mus musculus
ggcagtgtgaagtcattgacgagtg

SEQ ID NO: 949911 - DNA, 25 bp, Mus musculus
ggcagtgtgaggacatggatgaatg

SEQ ID NO: 949912 - DNA, 25 bp, Mus musculus
ggcagtgtgaggtcatggatgaatg

SEQ ID NO: 949913 - DNA, 25 bp, Mus musculus
ggcagttcagcgaggaatcatgggt

SEQ ID NO: 949914 - DNA, 25 bp, Mus musculus
ggcagttcagggaggaatcatgggt

SEQ ID NO: 949915 - DNA, 25 bp, Mus musculus
ggcagtttagaaatgcacttagcga

SEQ ID NO: 949916 - DNA, 25 bp, Mus musculus
ggcagtttagtaatgcacttagcga

SEQ ID NO: 949917 - DNA, 25 bp, Mus musculus
ggcatacccgagataaagactattt

SEQ ID NO: 949918 - DNA, 25 bp, Mus musculus
ggcatacccgagttaaagactattt

SEQ ID NO: 949919 - DNA, 25 bp, Mus musculus
ggcatacctgcacacacatcgatga

SEQ ID NO: 949920 - DNA, 25 bp, Mus musculus
ggcatacctgcacagacatcgatga

SEQ ID NO: 949921 - DNA, 25 bp, Mus musculus
ggcatagacttcagcaataaagtgg

SEQ ID NO: 949922 - DNA, 25 bp, Mus musculus
ggcatagacttcaggaataaagtgg

SEQ ID NO: 949923 - DNA, 25 bp, Mus musculus
ggcatagctgctctgaagagccatc

SEQ ID NO: 949924 - DNA, 25 bp, Mus musculus
ggcatagctggtctgaagagccatc

SEQ ID NO: 949925 - DNA, 25 bp, Mus musculus
ggcatagttgatgtcatagagaaaa

SEQ ID NO: 949926 - DNA, 25 bp, Mus musculus
ggcatagttgatgtgatagagaaaa

SEQ ID NO: 949927 - DNA, 25 bp, Mus musculus
ggcatatcacagctattgactgggc

SEQ ID NO: 949928 - DNA, 25 bp, Mus musculus
ggcatatcacaggtattgactgggc

SEQ ID NO: 949929 - DNA, 25 bp, Mus musculus
ggcatatgcttccgagactcgggcg

SEQ ID NO: 949930 - DNA, 25 bp, Mus musculus
ggcatatgcttccttggggactgat

SEQ ID NO: 949931 - DNA, 25 bp, Mus musculus
ggcatatgcttcggagactcgggcg

SEQ ID NO: 949932 - DNA, 25 bp, Mus musculus
ggcatatgcttcgttggggactgat

SEQ ID NO: 949933 - DNA, 25 bp, Mus musculus
ggcatattggaaaacgtgttcatct

SEQ ID NO: 949934 - DNA, 25 bp, Mus musculus
ggcatattggaaaaggtgttcatct

SEQ ID NO: 949935 - DNA, 25 bp, Mus musculus
ggcatcaaggagcaggacatcaaca

SEQ ID NO: 949936 - DNA, 25 bp, Mus musculus
ggcatcaaggaggaggacatcaaca

SEQ ID NO: 949937 - DNA, 25 bp, Mus musculus
ggcatcaatgctcttttctactatt

SEQ ID NO: 949938 - DNA, 25 bp, Mus musculus
ggcatcaatgctgttttctactatt

SEQ ID NO: 949939 - DNA, 25 bp, Mus musculus
ggcatcacactacatctttccagtg

SEQ ID NO: 949940 - DNA, 25 bp, Mus musculus
ggcatcacactagatctttccagtg

SEQ ID NO: 949941 - DNA, 25 bp, Mus musculus
ggcatcacagacagtacaggctacc

SEQ ID NO: 949942 - DNA, 25 bp, Mus musculus
ggcatcacagtcagtacaggctacc

SEQ ID NO: 949943 - DNA, 25 bp, Mus musculus
ggcatcaccatgaacttctgagaca

SEQ ID NO: 949944 - DNA, 25 bp, Mus musculus
ggcatcaccatgaagttctgagaca

SEQ ID NO: 949945 - DNA, 25 bp, Mus musculus
ggcatcactgttgtcgactggccct

SEQ ID NO: 949946 - DNA, 25 bp, Mus musculus
ggcatcactgttgtggactggccct

SEQ ID NO: 949947 - DNA, 25 bp, Mus musculus
ggcatcagagagcgggaagctatgg

SEQ ID NO: 949948 - DNA, 25 bp, Mus musculus
ggcatcagagctgcccagcgggagg

SEQ ID NO: 949949 - DNA, 25 bp, Mus musculus
ggcatcagaggtgcccagcgggagg

SEQ ID NO: 949950 - DNA, 25 bp, Mus musculus
ggcatcagagtgcgggaagctatgg

SEQ ID NO: 949951 - DNA, 25 bp, Mus musculus
ggcatcagcagccacatcccagcca

SEQ ID NO: 949952 - DNA, 25 bp, Mus musculus
ggcatcagcagccagatcccagcca

SEQ ID NO: 949953 - DNA, 25 bp, Mus musculus
ggcatcatcctggtcttcctgctgg

SEQ ID NO: 949954 - DNA, 25 bp, Mus musculus
ggcatcatcctggtgttcctgctgg

SEQ ID NO: 949955 - DNA, 25 bp, Mus musculus
ggcatcatccttagcagggagaaga

SEQ ID NO: 949956 - DNA, 25 bp, Mus musculus
ggcatcatcctttgcagggagaaga

SEQ ID NO: 949957 - DNA, 25 bp, Mus musculus
ggcatcatcgtgcgcgatgagtcca

SEQ ID NO: 949958 - DNA, 25 bp, Mus musculus
ggcatcatcgtgcgggatgagtcca

SEQ ID NO: 949959 - DNA, 25 bp, Mus musculus
ggcatcatgcagaacgtggctggcg

SEQ ID NO: 949960 - DNA, 25 bp, Mus musculus
ggcatcatgcagaaggtggctggcg

SEQ ID NO: 949961 - DNA, 25 bp, Mus musculus
ggcatcattccacacctctgcgaag

SEQ ID NO: 949962 - DNA, 25 bp, Mus musculus
ggcatcattccacagctctgcgaag

SEQ ID NO: 949963 - DNA, 25 bp, Mus musculus
ggcatccacgagcagatgctgaagg

SEQ ID NO: 949964 - DNA, 25 bp, Mus musculus
ggcatccacgaggagatgctgaagg

SEQ ID NO: 949965 - DNA, 25 bp, Mus musculus
ggcatccagcagcgttttctggcta

SEQ ID NO: 949966 - DNA, 25 bp, Mus musculus
ggcatccagcagggttttctggcta

SEQ ID NO: 949967 - DNA, 25 bp, Mus musculus
ggcatccccaaacatctccctgaga

SEQ ID NO: 949968 - DNA, 25 bp, Mus musculus
ggcatccccaaagatctccctgaga

SEQ ID NO: 949969 - DNA, 25 bp, Mus musculus
ggcatcccctatcatcctatacact

SEQ ID NO: 949970 - DNA, 25 bp, Mus musculus
ggcatcccctatgatcctatacact

SEQ ID NO: 949971 - DNA, 25 bp, Mus musculus
ggcatccccttttacacaactgcca

SEQ ID NO: 949972 - DNA, 25 bp, Mus musculus
ggcatccccttttagacaactgcca

SEQ ID NO: 949973 - DNA, 25 bp, Mus musculus
ggcatcccgcagaccgtacctcctg

SEQ ID NO: 949974 - DNA, 25 bp, Mus musculus
ggcatcccgcagacggtacctcctg

SEQ ID NO: 949975 - DNA, 25 bp, Mus musculus
ggcatccgggagggccatgcagtgt

SEQ ID NO: 949976 - DNA, 25 bp, Mus musculus
ggcatccgggtgggccatgcagtgt

SEQ ID NO: 949977 - DNA, 25 bp, Mus musculus
ggcatccggtctcacctcttctata

SEQ ID NO: 949978 - DNA, 25 bp, Mus musculus
ggcatccggtgtcacctcttctata

SEQ ID NO: 949979 - DNA, 25 bp, Mus musculus
ggcatcctgaaacgggtgaaccttc

SEQ ID NO: 949980 - DNA, 25 bp, Mus musculus
ggcatcctgaaaggggtgaaccttc

SEQ ID NO: 949981 - DNA, 25 bp, Mus musculus
ggcatccttgcgccaccaattcatg

SEQ ID NO: 949982 - DNA, 25 bp, Mus musculus
ggcatccttgggccaccaattcatg

SEQ ID NO: 949983 - DNA, 25 bp, Mus musculus
ggcatcgacttcaacgacacagcag

SEQ ID NO: 949984 - DNA, 25 bp, Mus musculus
ggcatcgacttcaaggacacagcag

SEQ ID NO: 949985 - DNA, 25 bp, Mus musculus
ggcatcgcggagcatcggtcatggg

SEQ ID NO: 949986 - DNA, 25 bp, Mus musculus
ggcatcgcggaggatcggtcatggg

SEQ ID NO: 949987 - DNA, 25 bp, Mus musculus
ggcatcgtcaagatcgtcctctctg

SEQ ID NO: 949988 - DNA, 25 bp, Mus musculus
ggcatcgtcaagatggtcctctctg

SEQ ID NO: 949989 - DNA, 25 bp, Mus musculus
ggcatcgtcacacaatatgcttccc

SEQ ID NO: 949990 - DNA, 25 bp, Mus musculus
ggcatcgtcacagaatatgcttccc

SEQ ID NO: 949991 - DNA, 25 bp, Mus musculus
ggcatctcaaacttgagtatcactc

SEQ ID NO: 949992 - DNA, 25 bp, Mus musculus
ggcatctcaatcttgagtatcactc

SEQ ID NO: 949993 - DNA, 25 bp, Mus musculus
ggcatctcactgcaatgcctgtcac

SEQ ID NO: 949994 - DNA, 25 bp, Mus musculus
ggcatctcactgctggagctggcaa

SEQ ID NO: 949995 - DNA, 25 bp, Mus musculus
ggcatctcactggaatgcctgtcac

SEQ ID NO: 949996 - DNA, 25 bp, Mus musculus
ggcatctcactggtggagctggcaa

SEQ ID NO: 949997 - DNA, 25 bp, Mus musculus
ggcatctcagagctctctgcagacc

SEQ ID NO: 949998 - DNA, 25 bp, Mus musculus
ggcatctcagagctgtctgcagacc

SEQ ID NO: 949999 - DNA, 25 bp, Mus musculus
ggcatctctgcggcccacatgaatg

SEQ ID NO: 950000 - DNA, 25 bp, Mus musculus
ggcatctctggggcccacatgaatg

SEQ ID NO: 950001 - DNA, 25 bp, Mus musculus
ggcatctgcacacgtggccccaaag

SEQ ID NO: 950002 - DNA, 25 bp, Mus musculus
ggcatctgcacaggtggccccaaag

SEQ ID NO: 950003 - DNA, 25 bp, Mus musculus
ggcatctgttgtcctcaacttcatc

SEQ ID NO: 950004 - DNA, 25 bp, Mus musculus
ggcatctgttgtgctcaacttcatc

SEQ ID NO: 950005 - DNA, 25 bp, Mus musculus
ggcatcttggagaaagaggcctcag

SEQ ID NO: 950006 - DNA, 25 bp, Mus musculus
ggcatcttggagtaagaggcctcag

SEQ ID NO: 950007 - DNA, 25 bp, Mus musculus
ggcatctttgtgcacagtgtcatgc

SEQ ID NO: 950008 - DNA, 25 bp, Mus musculus
ggcatctttgtgcagagtgtcatgc

SEQ ID NO: 950009 - DNA, 25 bp, Mus musculus
ggcatgaaagcaggaagcggctgga

SEQ ID NO: 950010 - DNA, 25 bp, Mus musculus
ggcatgaaagccccagcttcggtca

SEQ ID NO: 950011 - DNA, 25 bp, Mus musculus
ggcatgaaagcctcagtgcagatgc

SEQ ID NO: 950012 - DNA, 25 bp, Mus musculus
ggcatgaaaggaggaagcggctgga

SEQ ID NO: 950013 - DNA, 25 bp, Mus musculus
ggcatgaaaggcccagcttcggtca

SEQ ID NO: 950014 - DNA, 25 bp, Mus musculus
ggcatgaaaggctcagtgcagatgc

SEQ ID NO: 950015 - DNA, 25 bp, Mus musculus
ggcatgaagctgagtgaagatggca

SEQ ID NO: 950016 - DNA, 25 bp, Mus musculus
ggcatgaagctgtgtgaagatggca

SEQ ID NO: 950017 - DNA, 25 bp, Mus musculus
ggcatgaattcacggatgacctgga

SEQ ID NO: 950018 - DNA, 25 bp, Mus musculus
ggcatgaattcagggatgacctgga

SEQ ID NO: 950019 - DNA, 25 bp, Mus musculus
ggcatgacagcagctggagaagctg

SEQ ID NO: 950020 - DNA, 25 bp, Mus musculus
ggcatgacaggagctggagaagctg

SEQ ID NO: 950021 - DNA, 25 bp, Mus musculus
ggcatgaggccacacttgtggatgc

SEQ ID NO: 950022 - DNA, 25 bp, Mus musculus
ggcatgaggccacagttgtggatgc

SEQ ID NO: 950023 - DNA, 25 bp, Mus musculus
ggcatgcaacatactgctggctgga

SEQ ID NO: 950024 - DNA, 25 bp, Mus musculus
ggcatgcaacattctgctggctgga

SEQ ID NO: 950025 - DNA, 25 bp, Mus musculus
ggcatgcaagcacgcatcttcgaaa

SEQ ID NO: 950026 - DNA, 25 bp, Mus musculus
ggcatgcaagcaggcatcttcgaaa

SEQ ID NO: 950027 - DNA, 25 bp, Mus musculus
ggcatgccagaacctgtaattgaat

SEQ ID NO: 950028 - DNA, 25 bp, Mus musculus
ggcatgccagcctatcaagtactag

SEQ ID NO: 950029 - DNA, 25 bp, Mus musculus
ggcatgccagctgccagtcccgagt

SEQ ID NO: 950030 - DNA, 25 bp, Mus musculus
ggcatgccaggctatcaagtactag

SEQ ID NO: 950031 - DNA, 25 bp, Mus musculus
ggcatgccaggtgccagtcccgagt

SEQ ID NO: 950032 - DNA, 25 bp, Mus musculus
ggcatgccagtacctgtaattgaat

SEQ ID NO: 950033 - DNA, 25 bp, Mus musculus
ggcatgcgagctctgctttgatctt

SEQ ID NO: 950034 - DNA, 25 bp, Mus musculus
ggcatgcgaggtctgctttgatctt

SEQ ID NO: 950035 - DNA, 25 bp, Mus musculus
ggcatgctggctatcatcattatga

SEQ ID NO: 950036 - DNA, 25 bp, Mus musculus
ggcatgctgggtatcatcattatga

SEQ ID NO: 950037 - DNA, 25 bp, Mus musculus
ggcatggaagatgaaagagaagatg

SEQ ID NO: 950038 - DNA, 25 bp, Mus musculus
ggcatggaagccaacgtgaaagccg

SEQ ID NO: 950039 - DNA, 25 bp, Mus musculus
ggcatggaagccaaggtgaaagccg

SEQ ID NO: 950040 - DNA, 25 bp, Mus musculus
ggcatggaagttgaaagagaagatg

SEQ ID NO: 950041 - DNA, 25 bp, Mus musculus
ggcatggagcaacttcattccctga

SEQ ID NO: 950042 - DNA, 25 bp, Mus musculus
ggcatggagcaagttcattccctga

SEQ ID NO: 950043 - DNA, 25 bp, Mus musculus
ggcatggatgatcggctgttttaca

SEQ ID NO: 950044 - DNA, 25 bp, Mus musculus
ggcatggatgttcggctgttttaca

SEQ ID NO: 950045 - DNA, 25 bp, Mus musculus
ggcatggccaagaatacctccggaa

SEQ ID NO: 950046 - DNA, 25 bp, Mus musculus
ggcatggccaagtatacctccggaa

SEQ ID NO: 950047 - DNA, 25 bp, Mus musculus
ggcatgggatatgacgtgcagcaga

SEQ ID NO: 950048 - DNA, 25 bp, Mus musculus
ggcatgggatatgaggtgcagcaga

SEQ ID NO: 950049 - DNA, 25 bp, Mus musculus
ggcatgggatggagagtctgtattg

SEQ ID NO: 950050 - DNA, 25 bp, Mus musculus
ggcatgggatggcggacagctgttg

SEQ ID NO: 950051 - DNA, 25 bp, Mus musculus
ggcatgggatgggggacagctgttg

SEQ ID NO: 950052 - DNA, 25 bp, Mus musculus
ggcatgggatggtgagtctgtattg

SEQ ID NO: 950053 - DNA, 25 bp, Mus musculus
ggcatgggctacatggcctcttcct

SEQ ID NO: 950054 - DNA, 25 bp, Mus musculus
ggcatgggctacttggcctcttcct

SEQ ID NO: 950055 - DNA, 25 bp, Mus musculus
ggcatgtacgctaacttgggtattg

SEQ ID NO: 950056 - DNA, 25 bp, Mus musculus
ggcatgtacggtaacttgggtattg

SEQ ID NO: 950057 - DNA, 25 bp, Mus musculus
ggcatgtgactcaacctcgtgtggc

SEQ ID NO: 950058 - DNA, 25 bp, Mus musculus
ggcatgtgactcaagctcgtgtggc

SEQ ID NO: 950059 - DNA, 25 bp, Mus musculus
ggcatgtggctccacatgaacgaac

SEQ ID NO: 950060 - DNA, 25 bp, Mus musculus
ggcatgtggctcgacatgaacgaac

SEQ ID NO: 950061 - DNA, 25 bp, Mus musculus
ggcatgttcaatctgaacctgttcc

SEQ ID NO: 950062 - DNA, 25 bp, Mus musculus
ggcatgttcaatgtgaacctgttcc

SEQ ID NO: 950063 - DNA, 25 bp, Mus musculus
ggcatgttcgagtggacaaatgtcg

SEQ ID NO: 950064 - DNA, 25 bp, Mus musculus
ggcatgttcgtgtggacaaatgtcg

SEQ ID NO: 950065 - DNA, 25 bp, Mus musculus
ggcatgtttacactggccggcctca

SEQ ID NO: 950066 - DNA, 25 bp, Mus musculus
ggcatgtttacacttaggtgacagc

SEQ ID NO: 950067 - DNA, 25 bp, Mus musculus
ggcatgtttacagtggccggcctca

SEQ ID NO: 950068 - DNA, 25 bp, Mus musculus
ggcatgtttacagttaggtgacagc

SEQ ID NO: 950069 - DNA, 25 bp, Mus musculus
ggcattcatgcgcaaagacgtgcga

SEQ ID NO: 950070 - DNA, 25 bp, Mus musculus
ggcattcatgcgcatgcgttttgac

SEQ ID NO: 950071 - DNA, 25 bp, Mus musculus
ggcattcatgcggaaagacgtgcga

SEQ ID NO: 950072 - DNA, 25 bp, Mus musculus
ggcattcatgcggatgcgttttgac

SEQ ID NO: 950073 - DNA, 25 bp, Mus musculus
ggcattgaactcagggtcacctcca

SEQ ID NO: 950074 - DNA, 25 bp, Mus musculus
ggcattgaactctgggtcacctcca

SEQ ID NO: 950075 - DNA, 25 bp, Mus musculus
ggcattgaggcaaacaacctagcca

SEQ ID NO: 950076 - DNA, 25 bp, Mus musculus
ggcattgaggcaaagaacctagcca

SEQ ID NO: 950077 - DNA, 25 bp, Mus musculus
ggcattgatcatcggccctgaagac

SEQ ID NO: 950078 - DNA, 25 bp, Mus musculus
ggcattgatcatgggccctgaagac

SEQ ID NO: 950079 - DNA, 25 bp, Mus musculus
ggcattgatccgatttggaacattg

SEQ ID NO: 950080 - DNA, 25 bp, Mus musculus
ggcattgatccgttttggaacattg

SEQ ID NO: 950081 - DNA, 25 bp, Mus musculus
ggcattgcccagaccgtgttcctgg

SEQ ID NO: 950082 - DNA, 25 bp, Mus musculus
ggcattgcccagctgaaaatccagg

SEQ ID NO: 950083 - DNA, 25 bp, Mus musculus
ggcattgcccaggtgaaaatccagg

SEQ ID NO: 950084 - DNA, 25 bp, Mus musculus
ggcattgcccagtccgtgttcctgg

SEQ ID NO: 950085 - DNA, 25 bp, Mus musculus
ggcattgtgcgcaacgtcaatgccg

SEQ ID NO: 950086 - DNA, 25 bp, Mus musculus
ggcattgtgcgcaaggtcaatgccg

SEQ ID NO: 950087 - DNA, 25 bp, Mus musculus
ggcatttactatcacggactcatgg

SEQ ID NO: 950088 - DNA, 25 bp, Mus musculus
ggcatttactatgacggactcatgg

SEQ ID NO: 950089 - DNA, 25 bp, Mus musculus
ggcattttaaagcacgcattagcta

SEQ ID NO: 950090 - DNA, 25 bp, Mus musculus
ggcattttaaagcaggcattagcta

SEQ ID NO: 950091 - DNA, 25 bp, Mus musculus
ggcatttttgcgtccccatggatgg

SEQ ID NO: 950092 - DNA, 25 bp, Mus musculus
ggcatttttgggtccccatggatgg

SEQ ID NO: 950093 - DNA, 25 bp, Mus musculus
ggccaaaaatctgcggaatgattgg

SEQ ID NO: 950094 - DNA, 25 bp, Mus musculus
ggccaaaaatgtgcggaatgattgg

SEQ ID NO: 950095 - DNA, 25 bp, Mus musculus
ggccaaaacgccatttgatgaggcg

SEQ ID NO: 950096 - DNA, 25 bp, Mus musculus
ggccaaaacggcatttgatgaggcg

SEQ ID NO: 950097 - DNA, 25 bp, Mus musculus
ggccaaaattaatgagaagatcttg

SEQ ID NO: 950098 - DNA, 25 bp, Mus musculus
ggccaaaattacctctgtgaagctg

SEQ ID NO: 950099 - DNA, 25 bp, Mus musculus
ggccaaaatttatgagaagatcttg

SEQ ID NO: 950100 - DNA, 25 bp, Mus musculus
ggccaaaatttcctctgtgaagctg

SEQ ID NO: 950101 - DNA, 25 bp, Mus musculus
ggccaaagacccaatcgtcaacgtg

SEQ ID NO: 950102 - DNA, 25 bp, Mus musculus
ggccaaagaccctatcgtcaacgtg

SEQ ID NO: 950103 - DNA, 25 bp, Mus musculus
ggccaaagcaaaaatgaggagtggg

SEQ ID NO: 950104 - DNA, 25 bp, Mus musculus
ggccaaagcaaatatgaggagtggg

SEQ ID NO: 950105 - DNA, 25 bp, Mus musculus
ggccaaagctgacaaggaagaagag

SEQ ID NO: 950106 - DNA, 25 bp, Mus musculus
ggccaaagctgagaaggaagaagag

SEQ ID NO: 950107 - DNA, 25 bp, Mus musculus
ggccaacaaacacgtgtgcaaaccg

SEQ ID NO: 950108 - DNA, 25 bp, Mus musculus
ggccaacaaacaggtgtgcaaaccg

SEQ ID NO: 950109 - DNA, 25 bp, Mus musculus
ggccaacactggctgctgggacctg

SEQ ID NO: 950110 - DNA, 25 bp, Mus musculus
ggccaacactgggtgctgggacctg

SEQ ID NO: 950111 - DNA, 25 bp, Mus musculus
ggccaaccagcgtttctctgtccag

SEQ ID NO: 950112 - DNA, 25 bp, Mus musculus
ggccaaccagctcaccgtgggtgtc

SEQ ID NO: 950113 - DNA, 25 bp, Mus musculus
ggccaaccagggtttctctgtccag

SEQ ID NO: 950114 - DNA, 25 bp, Mus musculus
ggccaaccaggtcaccgtgggtgtc

SEQ ID NO: 950115 - DNA, 25 bp, Mus musculus
ggccaacgtgaactagtacatgttt

SEQ ID NO: 950116 - DNA, 25 bp, Mus musculus
ggccaacgtgaacttgtacatgttt

SEQ ID NO: 950117 - DNA, 25 bp, Mus musculus
ggccaagaagttccaacctagatac

SEQ ID NO: 950118 - DNA, 25 bp, Mus musculus
ggccaagaagttccaagaccccaga

SEQ ID NO: 950119 - DNA, 25 bp, Mus musculus
ggccaagaagttcctacctagatac

SEQ ID NO: 950120 - DNA, 25 bp, Mus musculus
ggccaagaagttcctagaccccaga

SEQ ID NO: 950121 - DNA, 25 bp, Mus musculus
ggccaagacatacctcattctggag

SEQ ID NO: 950122 - DNA, 25 bp, Mus musculus
ggccaagacatactcttgccatgta

SEQ ID NO: 950123 - DNA, 25 bp, Mus musculus
ggccaagacatagctcattctggag

SEQ ID NO: 950124 - DNA, 25 bp, Mus musculus
ggccaagacatagtcttgccatgta

SEQ ID NO: 950125 - DNA, 25 bp, Mus musculus
ggccaagacccgcgatgagtatctt

SEQ ID NO: 950126 - DNA, 25 bp, Mus musculus
ggccaagacccgggatgagtatctt

SEQ ID NO: 950127 - DNA, 25 bp, Mus musculus
ggccaagagacccaagcagaggcac

SEQ ID NO: 950128 - DNA, 25 bp, Mus musculus
ggccaagagagccaagcagaggcac

SEQ ID NO: 950129 - DNA, 25 bp, Mus musculus
ggccaagagagccgaagctctgcag

SEQ ID NO: 950130 - DNA, 25 bp, Mus musculus
ggccaagagagcggaagctctgcag

SEQ ID NO: 950131 - DNA, 25 bp, Mus musculus
ggccaagcacacagatcctagtcac

SEQ ID NO: 950132 - DNA, 25 bp, Mus musculus
ggccaagcacacagttcctagtcac

SEQ ID NO: 950133 - DNA, 25 bp, Mus musculus
ggccaagcacagcaatgaaaggcct

SEQ ID NO: 950134 - DNA, 25 bp, Mus musculus
ggccaagcacaggaatgaaaggcct

SEQ ID NO: 950135 - DNA, 25 bp, Mus musculus
ggccaagcaccataaatacatggca

SEQ ID NO: 950136 - DNA, 25 bp, Mus musculus
ggccaagcacctggacgagaaaaga

SEQ ID NO: 950137 - DNA, 25 bp, Mus musculus
ggccaagcacgataaatacatggca

SEQ ID NO: 950138 - DNA, 25 bp, Mus musculus
ggccaagcacgtggacgagaaaaga

SEQ ID NO: 950139 - DNA, 25 bp, Mus musculus
ggccaagcagagcgccctggatctt

SEQ ID NO: 950140 - DNA, 25 bp, Mus musculus
ggccaagcagagggccctggatctt

SEQ ID NO: 950141 - DNA, 25 bp, Mus musculus
ggccaagcatacagagcctatcaga

SEQ ID NO: 950142 - DNA, 25 bp, Mus musculus
ggccaagcatacagtgcctatcaga

SEQ ID NO: 950143 - DNA, 25 bp, Mus musculus
ggccaagccaagctggtcctgaaga

SEQ ID NO: 950144 - DNA, 25 bp, Mus musculus
ggccaagccaaggtggtcctgaaga

SEQ ID NO: 950145 - DNA, 25 bp, Mus musculus
ggccaagccacgaagtattcagtac

SEQ ID NO: 950146 - DNA, 25 bp, Mus musculus
ggccaagccacgtagtattcagtac

SEQ ID NO: 950147 - DNA, 25 bp, Mus musculus
ggccaagccccacgagtcggtgaca

SEQ ID NO: 950148 - DNA, 25 bp, Mus musculus
ggccaagccccaggagtcggtgaca

SEQ ID NO: 950149 - DNA, 25 bp, Mus musculus
ggccaagctgcccctgcttgtcaac

SEQ ID NO: 950150 - DNA, 25 bp, Mus musculus
ggccaagctggccctgcttgtcaac

SEQ ID NO: 950151 - DNA, 25 bp, Mus musculus
ggccaaggagcccacgccggctcaa

SEQ ID NO: 950152 - DNA, 25 bp, Mus musculus
ggccaaggagcccaggccggctcaa

SEQ ID NO: 950153 - DNA, 25 bp, Mus musculus
ggccaaggccaccgagctctttgtt

SEQ ID NO: 950154 - DNA, 25 bp, Mus musculus
ggccaaggccacggagctctttgtt

SEQ ID NO: 950155 - DNA, 25 bp, Mus musculus
ggccaaggcgtgattaaggttgagg

SEQ ID NO: 950156 - DNA, 25 bp, Mus musculus
ggccaaggcgtgtttaaggttgagg

SEQ ID NO: 950157 - DNA, 25 bp, Mus musculus
ggccaagggcagcgtgtttaggaat

SEQ ID NO: 950158 - DNA, 25 bp, Mus musculus
ggccaagggcagggtgtttaggaat

SEQ ID NO: 950159 - DNA, 25 bp, Mus musculus
ggccaagtatctcacaaagacccaa

SEQ ID NO: 950160 - DNA, 25 bp, Mus musculus
ggccaagtatctcacattgaagacc

SEQ ID NO: 950161 - DNA, 25 bp, Mus musculus
ggccaagtatctcagaaagacccaa

SEQ ID NO: 950162 - DNA, 25 bp, Mus musculus
ggccaagtatctcagattgaagacc

SEQ ID NO: 950163 - DNA, 25 bp, Mus musculus
ggccaagtccccatctgtgacgctg

SEQ ID NO: 950164 - DNA, 25 bp, Mus musculus
ggccaagtccccatgtgtgacgctg

SEQ ID NO: 950165 - DNA, 25 bp, Mus musculus
ggccaagtctcgcgtggatgaaact

SEQ ID NO: 950166 - DNA, 25 bp, Mus musculus
ggccaagtctcgggtggatgaaact

SEQ ID NO: 950167 - DNA, 25 bp, Mus musculus
ggccaagtctgtgacgctgggaccc

SEQ ID NO: 950168 - DNA, 25 bp, Mus musculus
ggccaagtctgtgaggctgggaccc

SEQ ID NO: 950169 - DNA, 25 bp, Mus musculus
ggccaatgtgccaactcatgaagca

SEQ ID NO: 950170 - DNA, 25 bp, Mus musculus
ggccaatgtggcaactcatgaagca

SEQ ID NO: 950171 - DNA, 25 bp, Mus musculus
ggccaattccagctgatgcagggaa

SEQ ID NO: 950172 - DNA, 25 bp, Mus musculus
ggccaattccaggtgatgcagggaa

SEQ ID NO: 950173 - DNA, 25 bp, Mus musculus
ggccaattctggaccaccaaggcct

SEQ ID NO: 950174 - DNA, 25 bp, Mus musculus
ggccaattctggtccaccaaggcct

SEQ ID NO: 950175 - DNA, 25 bp, Mus musculus
ggccacaaatctgacgttccagaca

SEQ ID NO: 950176 - DNA, 25 bp, Mus musculus
ggccacaaatgtgacgttccagaca

SEQ ID NO: 950177 - DNA, 25 bp, Mus musculus
ggccacacagcggaatatgggtccc

SEQ ID NO: 950178 - DNA, 25 bp, Mus musculus
ggccacacaggggaatatgggtccc

SEQ ID NO: 950179 - DNA, 25 bp, Mus musculus
ggccacactgcacgccgctgtgagt

SEQ ID NO: 950180 - DNA, 25 bp, Mus musculus
ggccacactgctgctgtgacatgca

SEQ ID NO: 950181 - DNA, 25 bp, Mus musculus
ggccacactggacgccgctgtgagt

SEQ ID NO: 950182 - DNA, 25 bp, Mus musculus
ggccacactggtgctgtgacatgca

SEQ ID NO: 950183 - DNA, 25 bp, Mus musculus
ggccacagaaggcaaccgtgtgact

SEQ ID NO: 950184 - DNA, 25 bp, Mus musculus
ggccacagaagggaaccgtgtgact

SEQ ID NO: 950185 - DNA, 25 bp, Mus musculus
ggccacagagacactggagctccca

SEQ ID NO: 950186 - DNA, 25 bp, Mus musculus
ggccacagagtcactggagctccca

SEQ ID NO: 950187 - DNA, 25 bp, Mus musculus
ggccacagatcctgaagctgacgta

SEQ ID NO: 950188 - DNA, 25 bp, Mus musculus
ggccacagatgctgaagctgacgta

SEQ ID NO: 950189 - DNA, 25 bp, Mus musculus
ggccacaggatgcccaggcagactc

SEQ ID NO: 950190 - DNA, 25 bp, Mus musculus
ggccacaggatgcgcagactcagcc

SEQ ID NO: 950191 - DNA, 25 bp, Mus musculus
ggccacaggatggccaggcagactc

SEQ ID NO: 950192 - DNA, 25 bp, Mus musculus
ggccacaggatgggcagactcagcc

SEQ ID NO: 950193 - DNA, 25 bp, Mus musculus
ggccacagtcctcacggttcaagtt

SEQ ID NO: 950194 - DNA, 25 bp, Mus musculus
ggccacagtcctcagggttcaagtt

SEQ ID NO: 950195 - DNA, 25 bp, Mus musculus
ggccacagttcgcacatacactttt

SEQ ID NO: 950196 - DNA, 25 bp, Mus musculus
ggccacagttcgcacgaggcagagt

SEQ ID NO: 950197 - DNA, 25 bp, Mus musculus
ggccacagttcgcagatacactttt

SEQ ID NO: 950198 - DNA, 25 bp, Mus musculus
ggccacagttcgcaggaggcagagt

SEQ ID NO: 950199 - DNA, 25 bp, Mus musculus
ggccacatccagattgtgaagaggg

SEQ ID NO: 950200 - DNA, 25 bp, Mus musculus
ggccacatccagtttgtgaagaggg

SEQ ID NO: 950201 - DNA, 25 bp, Mus musculus
ggccacatcctgcgagccttaaacc

SEQ ID NO: 950202 - DNA, 25 bp, Mus musculus
ggccacatcctgggagccttaaacc

SEQ ID NO: 950203 - DNA, 25 bp, Mus musculus
ggccacattccccacaactgaaaat

SEQ ID NO: 950204 - DNA, 25 bp, Mus musculus
ggccacattccccagaactgaaaat

SEQ ID NO: 950205 - DNA, 25 bp, Mus musculus
ggccacattgattttcctcgcatct

SEQ ID NO: 950206 - DNA, 25 bp, Mus musculus
ggccacattgccctgtcagcctcaa

SEQ ID NO: 950207 - DNA, 25 bp, Mus musculus
ggccacattggcctgtcagcctcaa

SEQ ID NO: 950208 - DNA, 25 bp, Mus musculus
ggccacattgtttttcctcgcatct

SEQ ID NO: 950209 - DNA, 25 bp, Mus musculus
ggccaccagcagctgtctccctccc

SEQ ID NO: 950210 - DNA, 25 bp, Mus musculus
ggccaccagcaggtgtctccctccc

SEQ ID NO: 950211 - DNA, 25 bp, Mus musculus
ggccaccctgggcccgtcgggatgg

SEQ ID NO: 950212 - DNA, 25 bp, Mus musculus
ggccaccctggggccgtcgggatgg

SEQ ID NO: 950213 - DNA, 25 bp, Mus musculus
ggccaccgccgccgcatggatgggc

SEQ ID NO: 950214 - DNA, 25 bp, Mus musculus
ggccaccgccgcggcatggatgggc

SEQ ID NO: 950215 - DNA, 25 bp, Mus musculus
ggccaccggctggacgaacccatgc

SEQ ID NO: 950216 - DNA, 25 bp, Mus musculus
ggccaccggctggaggaacccatgc

SEQ ID NO: 950217 - DNA, 25 bp, Mus musculus
ggccaccgtggtctcggaagtggct

SEQ ID NO: 950218 - DNA, 25 bp, Mus musculus
ggccaccgtggtctgggaagtggct

SEQ ID NO: 950219 - DNA, 25 bp, Mus musculus
ggccacctatatttttatctttatt

SEQ ID NO: 950220 - DNA, 25 bp, Mus musculus
ggccacctatttttttatctttatt

SEQ ID NO: 950221 - DNA, 25 bp, Mus musculus
ggccacctctacaactgacatcttg

SEQ ID NO: 950222 - DNA, 25 bp, Mus musculus
ggccacctctacaagtgacatcttg

SEQ ID NO: 950223 - DNA, 25 bp, Mus musculus
ggccacggcatgcaggagaaggagg

SEQ ID NO: 950224 - DNA, 25 bp, Mus musculus
ggccacggcatggaggagaaggagg

SEQ ID NO: 950225 - DNA, 25 bp, Mus musculus
ggccactagtcggacgtgtatcgtt

SEQ ID NO: 950226 - DNA, 25 bp, Mus musculus
ggccactagtcggacttacagccgc

SEQ ID NO: 950227 - DNA, 25 bp, Mus musculus
ggccactagtcggaggtgtatcgtt

SEQ ID NO: 950228 - DNA, 25 bp, Mus musculus
ggccactagtcggagttacagccgc

SEQ ID NO: 950229 - DNA, 25 bp, Mus musculus
ggccactcagcatcggaacgtcaat

SEQ ID NO: 950230 - DNA, 25 bp, Mus musculus
ggccactcaggatcggaacgtcaat

SEQ ID NO: 950231 - DNA, 25 bp, Mus musculus
ggccactgccaacgccaccacatca

SEQ ID NO: 950232 - DNA, 25 bp, Mus musculus
ggccactgccaaggccaccacatca

SEQ ID NO: 950233 - DNA, 25 bp, Mus musculus
ggccactgtgccctcctgagtgaaa

SEQ ID NO: 950234 - DNA, 25 bp, Mus musculus
ggccactgtgctctctgtgatgagc

SEQ ID NO: 950235 - DNA, 25 bp, Mus musculus
ggccactgtggcctcctgagtgaaa

SEQ ID NO: 950236 - DNA, 25 bp, Mus musculus
ggccactgtggtctctgtgatgagc

SEQ ID NO: 950237 - DNA, 25 bp, Mus musculus
ggccacttaaagcgtgcctcagcca

SEQ ID NO: 950238 - DNA, 25 bp, Mus musculus
ggccacttaaagggtgcctcagcca

SEQ ID NO: 950239 - DNA, 25 bp, Mus musculus
ggccacttcgaaaacgctcgggatg

SEQ ID NO: 950240 - DNA, 25 bp, Mus musculus
ggccacttcgaaaaggctcgggatg

SEQ ID NO: 950241 - DNA, 25 bp, Mus musculus
ggccacttgaagctggacttcatgg

SEQ ID NO: 950242 - DNA, 25 bp, Mus musculus
ggccacttgaaggtggacttcatgg

SEQ ID NO: 950243 - DNA, 25 bp, Mus musculus
ggccacttgcagcacggtggtgctc

SEQ ID NO: 950244 - DNA, 25 bp, Mus musculus
ggccacttgcagcagggtggtgctc

SEQ ID NO: 950245 - DNA, 25 bp, Mus musculus
ggccagaaacagatctggagaattg

SEQ ID NO: 950246 - DNA, 25 bp, Mus musculus
ggccagaaacagttctggagaattg

SEQ ID NO: 950247 - DNA, 25 bp, Mus musculus
ggccagacagaccggtccacctcag

SEQ ID NO: 950248 - DNA, 25 bp, Mus musculus
ggccagacagacgggtccacctcag

SEQ ID NO: 950249 - DNA, 25 bp, Mus musculus
ggccagacctcgcgacagattgtga

SEQ ID NO: 950250 - DNA, 25 bp, Mus musculus
ggccagacctcgggacagattgtga

SEQ ID NO: 950251 - DNA, 25 bp, Mus musculus
ggccagactgctaacgcctccagtg

SEQ ID NO: 950252 - DNA, 25 bp, Mus musculus
ggccagactgctaaggcctccagtg

SEQ ID NO: 950253 - DNA, 25 bp, Mus musculus
ggccagagaactccttgaacagatg

SEQ ID NO: 950254 - DNA, 25 bp, Mus musculus
ggccagagaactgcttgaacagatg

SEQ ID NO: 950255 - DNA, 25 bp, Mus musculus
ggccagagagcccggggcccgccgc

SEQ ID NO: 950256 - DNA, 25 bp, Mus musculus
ggccagagaggccggggcccgccgc

SEQ ID NO: 950257 - DNA, 25 bp, Mus musculus
ggccagagcagacaggaggtggacc

SEQ ID NO: 950258 - DNA, 25 bp, Mus musculus
ggccagagcagagaggaggtggacc

SEQ ID NO: 950259 - DNA, 25 bp, Mus musculus
ggccagagcttctccgtgtggatca

SEQ ID NO: 950260 - DNA, 25 bp, Mus musculus
ggccagagcttctcggtgtggatca

SEQ ID NO: 950261 - DNA, 25 bp, Mus musculus
ggccagagtgcacgtgtggtttcag

SEQ ID NO: 950262 - DNA, 25 bp, Mus musculus
ggccagagtgcaggtgtggtttcag

SEQ ID NO: 950263 - DNA, 25 bp, Mus musculus
ggccagatccagcgctttgcagtcc

SEQ ID NO: 950264 - DNA, 25 bp, Mus musculus
ggccagatccagggctttgcagtcc

SEQ ID NO: 950265 - DNA, 25 bp, Mus musculus
ggccagatctgcagcaatgacctgg

SEQ ID NO: 950266 - DNA, 25 bp, Mus musculus
ggccagatctgcaggaatgacctgg

SEQ ID NO: 950267 - DNA, 25 bp, Mus musculus
ggccagattgctggaggttactgag

SEQ ID NO: 950268 - DNA, 25 bp, Mus musculus
ggccagattggtggaggttactgag

SEQ ID NO: 950269 - DNA, 25 bp, Mus musculus
ggccagcaagctgatggatgtggac

SEQ ID NO: 950270 - DNA, 25 bp, Mus musculus
ggccagcaaggtgatggatgtggac

SEQ ID NO: 950271 - DNA, 25 bp, Mus musculus
ggccagcaatgacgatgtgactaaa

SEQ ID NO: 950272 - DNA, 25 bp, Mus musculus
ggccagcaatgaggatgtgactaaa

SEQ ID NO: 950273 - DNA, 25 bp, Mus musculus
ggccagcaggctctcctgcaagcgc

SEQ ID NO: 950274 - DNA, 25 bp, Mus musculus
ggccagcagggtctcctgcaagcgc

SEQ ID NO: 950275 - DNA, 25 bp, Mus musculus
ggccagccagataagtacggtttct

SEQ ID NO: 950276 - DNA, 25 bp, Mus musculus
ggccagccagctatgcactcacacc

SEQ ID NO: 950277 - DNA, 25 bp, Mus musculus
ggccagccaggtatgcactcacacc

SEQ ID NO: 950278 - DNA, 25 bp, Mus musculus
ggccagccagttaagtacggtttct

SEQ ID NO: 950279 - DNA, 25 bp, Mus musculus
ggccagccggcctctactcctttgg

SEQ ID NO: 950280 - DNA, 25 bp, Mus musculus
ggccagccgggctctactcctttgg

SEQ ID NO: 950281 - DNA, 25 bp, Mus musculus
ggccagctcaagcagcattgcctga

SEQ ID NO: 950282 - DNA, 25 bp, Mus musculus
ggccagctcaaggagcattgcctga

SEQ ID NO: 950283 - DNA, 25 bp, Mus musculus
ggccagctgtatgacgacaaccacg

SEQ ID NO: 950284 - DNA, 25 bp, Mus musculus
ggccagctgtatgaggacaaccacg

SEQ ID NO: 950285 - DNA, 25 bp, Mus musculus
ggccaggacactatagtggagatcc

SEQ ID NO: 950286 - DNA, 25 bp, Mus musculus
ggccaggacagtatagtggagatcc

SEQ ID NO: 950287 - DNA, 25 bp, Mus musculus
ggccaggagcggatccactccctgg

SEQ ID NO: 950288 - DNA, 25 bp, Mus musculus
ggccaggagcggttccactccctgg

SEQ ID NO: 950289 - DNA, 25 bp, Mus musculus
ggccaggagcttcgtttgaaggaga

SEQ ID NO: 950290 - DNA, 25 bp, Mus musculus
ggccaggagcttggtttgaaggaga

SEQ ID NO: 950291 - DNA, 25 bp, Mus musculus
ggccaggaggctcttctggctatgt

SEQ ID NO: 950292 - DNA, 25 bp, Mus musculus
ggccaggaggctgttctggctatgt

SEQ ID NO: 950293 - DNA, 25 bp, Mus musculus
ggccaggatgaagccgacgctcatg

SEQ ID NO: 950294 - DNA, 25 bp, Mus musculus
ggccaggatgaagcggacgctcatg

SEQ ID NO: 950295 - DNA, 25 bp, Mus musculus
ggccaggatttgggcgtgctgtaac

SEQ ID NO: 950296 - DNA, 25 bp, Mus musculus
ggccaggatttgggggtgctgtaac

SEQ ID NO: 950297 - DNA, 25 bp, Mus musculus
ggccaggccactcacgatcggaacg

SEQ ID NO: 950298 - DNA, 25 bp, Mus musculus
ggccaggccactcaggatcggaacg

SEQ ID NO: 950299 - DNA, 25 bp, Mus musculus
ggccagggatctcatgcgggctcct

SEQ ID NO: 950300 - DNA, 25 bp, Mus musculus
ggccagggatctctctctccacccc

SEQ ID NO: 950301 - DNA, 25 bp, Mus musculus
ggccagggatctgatgcgggctcct

SEQ ID NO: 950302 - DNA, 25 bp, Mus musculus
ggccagggatctgtctctccacccc

SEQ ID NO: 950303 - DNA, 25 bp, Mus musculus
ggccagggctgacgcttgttccccc

SEQ ID NO: 950304 - DNA, 25 bp, Mus musculus
ggccagggctgaggcttgttccccc

SEQ ID NO: 950305 - DNA, 25 bp, Mus musculus
ggccaggttgagctctggagaattg

SEQ ID NO: 950306 - DNA, 25 bp, Mus musculus
ggccaggttgaggtctggagaattg

SEQ ID NO: 950307 - DNA, 25 bp, Mus musculus
ggccagtagattctgccttataggc

SEQ ID NO: 950308 - DNA, 25 bp, Mus musculus
ggccagtagattgtgccttataggc

SEQ ID NO: 950309 - DNA, 25 bp, Mus musculus
ggccagtatggacacacggactatt

SEQ ID NO: 950310 - DNA, 25 bp, Mus musculus
ggccagtatggacatcctcaccacg

SEQ ID NO: 950311 - DNA, 25 bp, Mus musculus
ggccagtatggagacacggactatt

SEQ ID NO: 950312 - DNA, 25 bp, Mus musculus
ggccagtatggagatcctcaccacg

SEQ ID NO: 950313 - DNA, 25 bp, Mus musculus
ggccagtcagaaaacagtttggtca

SEQ ID NO: 950314 - DNA, 25 bp, Mus musculus
ggccagtcagaatacagtttggtca

SEQ ID NO: 950315 - DNA, 25 bp, Mus musculus
ggccagtcctacagagtctacagct

SEQ ID NO: 950316 - DNA, 25 bp, Mus musculus
ggccagtcctacagtgtctacagct

SEQ ID NO: 950317 - DNA, 25 bp, Mus musculus
ggccagtgagaacggatattacttc

SEQ ID NO: 950318 - DNA, 25 bp, Mus musculus
ggccagtgagaagggatattacttc

SEQ ID NO: 950319 - DNA, 25 bp, Mus musculus
ggccagtgatcttctagagtggatt

SEQ ID NO: 950320 - DNA, 25 bp, Mus musculus
ggccagtgatgttctagagtggatt

SEQ ID NO: 950321 - DNA, 25 bp, Mus musculus
ggccagtttggggacattgaggcca

SEQ ID NO: 950322 - DNA, 25 bp, Mus musculus
ggccagtttggggagattgaggcca

SEQ ID NO: 950323 - DNA, 25 bp, Mus musculus
ggccataaccctctcagcctcatgt

SEQ ID NO: 950324 - DNA, 25 bp, Mus musculus
ggccataaccctctgagcctcatgt

SEQ ID NO: 950325 - DNA, 25 bp, Mus musculus
ggccatacagctcctgtccagagtg

SEQ ID NO: 950326 - DNA, 25 bp, Mus musculus
ggccatacagctcgtaaacaccaga

SEQ ID NO: 950327 - DNA, 25 bp, Mus musculus
ggccatacagctggtaaacaccaga

SEQ ID NO: 950328 - DNA, 25 bp, Mus musculus
ggccatacaggtcctgtccagagtg

SEQ ID NO: 950329 - DNA, 25 bp, Mus musculus
ggccatatcatctcagatggaggct

SEQ ID NO: 950330 - DNA, 25 bp, Mus musculus
ggccatatcatctctgatggaggct

SEQ ID NO: 950331 - DNA, 25 bp, Mus musculus
ggccatatgcagcacatttttatca

SEQ ID NO: 950332 - DNA, 25 bp, Mus musculus
ggccatatgcagcacgggggagcac

SEQ ID NO: 950333 - DNA, 25 bp, Mus musculus
ggccatatgcagcagatttttatca

SEQ ID NO: 950334 - DNA, 25 bp, Mus musculus
ggccatatgcagcaggggggagcac

SEQ ID NO: 950335 - DNA, 25 bp, Mus musculus
ggccatcaaacacgtagtgaagcat

SEQ ID NO: 950336 - DNA, 25 bp, Mus musculus
ggccatcaaacaggtagtgaagcat

SEQ ID NO: 950337 - DNA, 25 bp, Mus musculus
ggccatcaagaatgactctgtggtg

SEQ ID NO: 950338 - DNA, 25 bp, Mus musculus
ggccatcaagctgactcacaaagcc

SEQ ID NO: 950339 - DNA, 25 bp, Mus musculus
ggccatcaaggtgactcacaaagcc

SEQ ID NO: 950340 - DNA, 25 bp, Mus musculus
ggccatcaagtatgactctgtggtg

SEQ ID NO: 950341 - DNA, 25 bp, Mus musculus
ggccatcaccagcgtgtttccacag

SEQ ID NO: 950342 - DNA, 25 bp, Mus musculus
ggccatcaccagggtgtttccacag

SEQ ID NO: 950343 - DNA, 25 bp, Mus musculus
ggccatcctgtcccacttttccaca

SEQ ID NO: 950344 - DNA, 25 bp, Mus musculus
ggccatcctgtcgcacttttccaca

SEQ ID NO: 950345 - DNA, 25 bp, Mus musculus
ggccatctatgacgacaaagtgtat

SEQ ID NO: 950346 - DNA, 25 bp, Mus musculus
ggccatctatgaggacaaagtgtat

SEQ ID NO: 950347 - DNA, 25 bp, Mus musculus
ggccatcttcagagcctcaattgat

SEQ ID NO: 950348 - DNA, 25 bp, Mus musculus
ggccatcttcagtgcctcaattgat

SEQ ID NO: 950349 - DNA, 25 bp, Mus musculus
ggccatgaagaacaattgccagcca

SEQ ID NO: 950350 - DNA, 25 bp, Mus musculus
ggccatgaagaacatctttgatgat

SEQ ID NO: 950351 - DNA, 25 bp, Mus musculus
ggccatgaagaacgtgaccgagctg

SEQ ID NO: 950352 - DNA, 25 bp, Mus musculus
ggccatgaagaacttccacaggaga

SEQ ID NO: 950353 - DNA, 25 bp, Mus musculus
ggccatgaagaagaattgccagcca

SEQ ID NO: 950354 - DNA, 25 bp, Mus musculus
ggccatgaagaagatctttgatgat

SEQ ID NO: 950355 - DNA, 25 bp, Mus musculus
ggccatgaagaaggtgaccgagctg

SEQ ID NO: 950356 - DNA, 25 bp, Mus musculus
ggccatgaagaagttccacaggaga

SEQ ID NO: 950357 - DNA, 25 bp, Mus musculus
ggccatgaagcatgtctgctgtgac

SEQ ID NO: 950358 - DNA, 25 bp, Mus musculus
ggccatgaagccgggagaaaattat

SEQ ID NO: 950359 - DNA, 25 bp, Mus musculus
ggccatgaagccgggtgctacttct

SEQ ID NO: 950360 - DNA, 25 bp, Mus musculus
ggccatgaagcgagctggcacggac

SEQ ID NO: 950361 - DNA, 25 bp, Mus musculus
ggccatgaaggatgtctgctgtgac

SEQ ID NO: 950362 - DNA, 25 bp, Mus musculus
ggccatgaaggcgggagaaaattat

SEQ ID NO: 950363 - DNA, 25 bp, Mus musculus
ggccatgaaggcgggtgctacttct

SEQ ID NO: 950364 - DNA, 25 bp, Mus musculus
ggccatgaagggagctggcacggac

SEQ ID NO: 950365 - DNA, 25 bp, Mus musculus
ggccatgagagacatcccatggttt

SEQ ID NO: 950366 - DNA, 25 bp, Mus musculus
ggccatgagagacgactgcctccag

SEQ ID NO: 950367 - DNA, 25 bp, Mus musculus
ggccatgagagacgtatatgctatg

SEQ ID NO: 950368 - DNA, 25 bp, Mus musculus
ggccatgagagagatcccatggttt

SEQ ID NO: 950369 - DNA, 25 bp, Mus musculus
ggccatgagagaggactgcctccag

SEQ ID NO: 950370 - DNA, 25 bp, Mus musculus
ggccatgagagaggtatatgctatg

SEQ ID NO: 950371 - DNA, 25 bp, Mus musculus
ggccatgatgagtacctataccaga

SEQ ID NO: 950372 - DNA, 25 bp, Mus musculus
ggccatgatgtgtacctataccaga

SEQ ID NO: 950373 - DNA, 25 bp, Mus musculus
ggccatgcacccccaggacccccag

SEQ ID NO: 950374 - DNA, 25 bp, Mus musculus
ggccatgcacgcccaggacccccag

SEQ ID NO: 950375 - DNA, 25 bp, Mus musculus
ggccatgctcaacacacccaacaca

SEQ ID NO: 950376 - DNA, 25 bp, Mus musculus
ggccatgctcaagacacccaacaca

SEQ ID NO: 950377 - DNA, 25 bp, Mus musculus
ggccatgcttcacaggcttctggat

SEQ ID NO: 950378 - DNA, 25 bp, Mus musculus
ggccatgcttcagaggcttctggat

SEQ ID NO: 950379 - DNA, 25 bp, Mus musculus
ggccatggaacacgaggaagtgaac

SEQ ID NO: 950380 - DNA, 25 bp, Mus musculus
ggccatggaacaggaggaagtgaac

SEQ ID NO: 950381 - DNA, 25 bp, Mus musculus
ggccatggagcgaggcacagaccct

SEQ ID NO: 950382 - DNA, 25 bp, Mus musculus
ggccatggagggaggcacagaccct

SEQ ID NO: 950383 - DNA, 25 bp, Mus musculus
ggccatggagttaaccacggaaata

SEQ ID NO: 950384 - DNA, 25 bp, Mus musculus
ggccatggagttaactggctaaaag

SEQ ID NO: 950385 - DNA, 25 bp, Mus musculus
ggccatggagttaagcacggaaata

SEQ ID NO: 950386 - DNA, 25 bp, Mus musculus
ggccatggagttaagtggctaaaag

SEQ ID NO: 950387 - DNA, 25 bp, Mus musculus
ggccatggcgaacgcagggctgtct

SEQ ID NO: 950388 - DNA, 25 bp, Mus musculus
ggccatggcgaaggcagggctgtct

SEQ ID NO: 950389 - DNA, 25 bp, Mus musculus
ggccatgtcgaaagataacatggag

SEQ ID NO: 950390 - DNA, 25 bp, Mus musculus
ggccatgtcgtaagataacatggag

SEQ ID NO: 950391 - DNA, 25 bp, Mus musculus
ggccatgttactccacgaccacagg

SEQ ID NO: 950392 - DNA, 25 bp, Mus musculus
ggccatgttactgcacgaccacagg

SEQ ID NO: 950393 - DNA, 25 bp, Mus musculus
ggccattaagctgctggagtatgag

SEQ ID NO: 950394 - DNA, 25 bp, Mus musculus
ggccattaaggtgctggagtatgag

SEQ ID NO: 950395 - DNA, 25 bp, Mus musculus
ggccattacaccatggaacttcccc

SEQ ID NO: 950396 - DNA, 25 bp, Mus musculus
ggccattacaccttggaacttcccc

SEQ ID NO: 950397 - DNA, 25 bp, Mus musculus
ggccattatcaccaccttctgcaag

SEQ ID NO: 950398 - DNA, 25 bp, Mus musculus
ggccattatcaccagcttctgcaag

SEQ ID NO: 950399 - DNA, 25 bp, Mus musculus
ggccattcatctctcgtcttgacga

SEQ ID NO: 950400 - DNA, 25 bp, Mus musculus
ggccattcatctctggtcttgacga

SEQ ID NO: 950401 - DNA, 25 bp, Mus musculus
ggccattgagctgctgtctgatgag

SEQ ID NO: 950402 - DNA, 25 bp, Mus musculus
ggccattgaggtgctgtctgatgag

SEQ ID NO: 950403 - DNA, 25 bp, Mus musculus
ggccattgtcaacgaagaagagaca

SEQ ID NO: 950404 - DNA, 25 bp, Mus musculus
ggccattgtcaaggaagaagagaca

SEQ ID NO: 950405 - DNA, 25 bp, Mus musculus
ggccattttacacaatctgcaccat

SEQ ID NO: 950406 - DNA, 25 bp, Mus musculus
ggccattttacagaatctgcaccat

SEQ ID NO: 950407 - DNA, 25 bp, Mus musculus
ggcccaacaaagccagctgagatgc

SEQ ID NO: 950408 - DNA, 25 bp, Mus musculus
ggcccaacaaaggcagctgagatgc

SEQ ID NO: 950409 - DNA, 25 bp, Mus musculus
ggcccaagtcagcacttgcccaggc

SEQ ID NO: 950410 - DNA, 25 bp, Mus musculus
ggcccaagtcaggacttgcccaggc

SEQ ID NO: 950411 - DNA, 25 bp, Mus musculus
ggcccaatgtcgaatcctgtggcga

SEQ ID NO: 950412 - DNA, 25 bp, Mus musculus
ggcccaatgtggaatcctgtggcga

SEQ ID NO: 950413 - DNA, 25 bp, Mus musculus
ggcccacactggcccccactgggaa

SEQ ID NO: 950414 - DNA, 25 bp, Mus musculus
ggcccacactggccgccactgggaa

SEQ ID NO: 950415 - DNA, 25 bp, Mus musculus
ggcccacagtggatctcactgtgga

SEQ ID NO: 950416 - DNA, 25 bp, Mus musculus
ggcccacagtggcggctgaagaata

SEQ ID NO: 950417 - DNA, 25 bp, Mus musculus
ggcccacagtgggggctgaagaata

SEQ ID NO: 950418 - DNA, 25 bp, Mus musculus
ggcccacagtggttctcactgtgga

SEQ ID NO: 950419 - DNA, 25 bp, Mus musculus
ggcccaccagctcctcaaggggagc

SEQ ID NO: 950420 - DNA, 25 bp, Mus musculus
ggcccaccaggtcctcaaggggagc

SEQ ID NO: 950421 - DNA, 25 bp, Mus musculus
ggcccagaagcctgagaccgctgcc

SEQ ID NO: 950422 - DNA, 25 bp, Mus musculus
ggcccagaaggacatccttaagctg

SEQ ID NO: 950423 - DNA, 25 bp, Mus musculus
ggcccagaaggagatccttaagctg

SEQ ID NO: 950424 - DNA, 25 bp, Mus musculus
ggcccagaaggctgagaccgctgcc

SEQ ID NO: 950425 - DNA, 25 bp, Mus musculus
ggcccagagacccacaaagacctgg

SEQ ID NO: 950426 - DNA, 25 bp, Mus musculus
ggcccagagacccagaaagacctgg

SEQ ID NO: 950427 - DNA, 25 bp, Mus musculus
ggcccagctctgcgatgggttgaag

SEQ ID NO: 950428 - DNA, 25 bp, Mus musculus
ggcccagctctgcggagaactctga

SEQ ID NO: 950429 - DNA, 25 bp, Mus musculus
ggcccagctctgggatgggttgaag

SEQ ID NO: 950430 - DNA, 25 bp, Mus musculus
ggcccagctctggggagaactctga

SEQ ID NO: 950431 - DNA, 25 bp, Mus musculus
ggcccagctgctcacgagccgggct

SEQ ID NO: 950432 - DNA, 25 bp, Mus musculus
ggcccagctgctcaggagccgggct

SEQ ID NO: 950433 - DNA, 25 bp, Mus musculus
ggcccagctttccacgtgggatcga

SEQ ID NO: 950434 - DNA, 25 bp, Mus musculus
ggcccagctttccaggtgggatcga

SEQ ID NO: 950435 - DNA, 25 bp, Mus musculus
ggcccaggacagctggatcgccggg

SEQ ID NO: 950436 - DNA, 25 bp, Mus musculus
ggcccaggacaggtggatcgccggg

SEQ ID NO: 950437 - DNA, 25 bp, Mus musculus
ggcccaggcccaatattgtgatcac

SEQ ID NO: 950438 - DNA, 25 bp, Mus musculus
ggcccaggcccaccctgcaactccc

SEQ ID NO: 950439 - DNA, 25 bp, Mus musculus
ggcccaggcccagcctgcaactccc

SEQ ID NO: 950440 - DNA, 25 bp, Mus musculus
ggcccaggcccattattgtgatcac

SEQ ID NO: 950441 - DNA, 25 bp, Mus musculus
ggcccagggacacgtggtggagttt

SEQ ID NO: 950442 - DNA, 25 bp, Mus musculus
ggcccagggacaggtggtggagttt

SEQ ID NO: 950443 - DNA, 25 bp, Mus musculus
ggcccagtgcaccgtggaaaaagtc

SEQ ID NO: 950444 - DNA, 25 bp, Mus musculus
ggcccagtgcacggtggaaaaagtc

SEQ ID NO: 950445 - DNA, 25 bp, Mus musculus
ggcccagtgcagcaggccacgcggg

SEQ ID NO: 950446 - DNA, 25 bp, Mus musculus
ggcccagtgcagcgctgtagcatcc

SEQ ID NO: 950447 - DNA, 25 bp, Mus musculus
ggcccagtgcaggaggccacgcggg

SEQ ID NO: 950448 - DNA, 25 bp, Mus musculus
ggcccagtgcagggctgtagcatcc

SEQ ID NO: 950449 - DNA, 25 bp, Mus musculus
ggcccagtttagccagtcatggcca

SEQ ID NO: 950450 - DNA, 25 bp, Mus musculus
ggcccagtttaggcagtcatggcca

SEQ ID NO: 950451 - DNA, 25 bp, Mus musculus
ggcccatcccagcacgtcatgaccc

SEQ ID NO: 950452 - DNA, 25 bp, Mus musculus
ggcccatcccagcaggtcatgaccc

SEQ ID NO: 950453 - DNA, 25 bp, Mus musculus
ggcccatggccagccgttggatgaa

SEQ ID NO: 950454 - DNA, 25 bp, Mus musculus
ggcccatggccagcggttggatgaa

SEQ ID NO: 950455 - DNA, 25 bp, Mus musculus
ggcccatttacaacatgaatctgaa

SEQ ID NO: 950456 - DNA, 25 bp, Mus musculus
ggcccatttagaacatgaatctgaa

SEQ ID NO: 950457 - DNA, 25 bp, Mus musculus
ggccccaacagccggccacagattg

SEQ ID NO: 950458 - DNA, 25 bp, Mus musculus
ggccccaacagccggtctggaggag

SEQ ID NO: 950459 - DNA, 25 bp, Mus musculus
ggccccaacagcgggccacagattg

SEQ ID NO: 950460 - DNA, 25 bp, Mus musculus
ggccccaacagcgggtctggaggag

SEQ ID NO: 950461 - DNA, 25 bp, Mus musculus
ggccccaacgatagtagcccagcct

SEQ ID NO: 950462 - DNA, 25 bp, Mus musculus
ggccccaacgattgtagcccagcct

SEQ ID NO: 950463 - DNA, 25 bp, Mus musculus
ggccccaccgcaactgtagcatcct

SEQ ID NO: 950464 - DNA, 25 bp, Mus musculus
ggccccaccgcatctgtagcatcct

SEQ ID NO: 950465 - DNA, 25 bp, Mus musculus
ggccccactgcggccatgtaggagt

SEQ ID NO: 950466 - DNA, 25 bp, Mus musculus
ggccccactggggccatgtaggagt

SEQ ID NO: 950467 - DNA, 25 bp, Mus musculus
ggccccagcaggcacctgccagacc

SEQ ID NO: 950468 - DNA, 25 bp, Mus musculus
ggccccagcaggcagctgccagacc

SEQ ID NO: 950469 - DNA, 25 bp, Mus musculus
ggccccagcgcctggtattaatcct

SEQ ID NO: 950470 - DNA, 25 bp, Mus musculus
ggccccagcggctggtattaatcct

SEQ ID NO: 950471 - DNA, 25 bp, Mus musculus
ggccccagtgcacattaaggttgag

SEQ ID NO: 950472 - DNA, 25 bp, Mus musculus
ggccccagtgcagattaaggttgag

SEQ ID NO: 950473 - DNA, 25 bp, Mus musculus
ggccccagtgcgctctgtgtaccag

SEQ ID NO: 950474 - DNA, 25 bp, Mus musculus
ggccccagtgggctctgtgtaccag

SEQ ID NO: 950475 - DNA, 25 bp, Mus musculus
ggccccatcgcaagctcagaaccaa

SEQ ID NO: 950476 - DNA, 25 bp, Mus musculus
ggccccatcggaagctcagaaccaa

SEQ ID NO: 950477 - DNA, 25 bp, Mus musculus
ggcccccaagcccatgaagaagatg

SEQ ID NO: 950478 - DNA, 25 bp, Mus musculus
ggcccccaaggccatgaagaagatg

SEQ ID NO: 950479 - DNA, 25 bp, Mus musculus
ggcccccagtcacatctgtctcgag

SEQ ID NO: 950480 - DNA, 25 bp, Mus musculus
ggcccccagtcacgccggggctgtg

SEQ ID NO: 950481 - DNA, 25 bp, Mus musculus
ggcccccagtcagatctgtctcgag

SEQ ID NO: 950482 - DNA, 25 bp, Mus musculus
ggcccccagtcaggccggggctgtg

SEQ ID NO: 950483 - DNA, 25 bp, Mus musculus
ggcccccatgctggcccctgagaat

SEQ ID NO: 950484 - DNA, 25 bp, Mus musculus
ggcccccatgcttcagcatgggctc

SEQ ID NO: 950485 - DNA, 25 bp, Mus musculus
ggcccccatggtggcccctgagaat

SEQ ID NO: 950486 - DNA, 25 bp, Mus musculus
ggcccccatggttcagcatgggctc

SEQ ID NO: 950487 - DNA, 25 bp, Mus musculus
ggccccccagccagtgtgaccccac

SEQ ID NO: 950488 - DNA, 25 bp, Mus musculus
ggccccccagcctgtgtgaccccac

SEQ ID NO: 950489 - DNA, 25 bp, Mus musculus
ggccccgaacaacacacgagctaaa

SEQ ID NO: 950490 - DNA, 25 bp, Mus musculus
ggccccgaacaacacgtcttcacac

SEQ ID NO: 950491 - DNA, 25 bp, Mus musculus
ggccccgaacaacagacgagctaaa

SEQ ID NO: 950492 - DNA, 25 bp, Mus musculus
ggccccgaacaacaggtcttcacac

SEQ ID NO: 950493 - DNA, 25 bp, Mus musculus
ggccccgatcaacgtgggagatgcc

SEQ ID NO: 950494 - DNA, 25 bp, Mus musculus
ggccccgatcaaggtgggagatgcc

SEQ ID NO: 950495 - DNA, 25 bp, Mus musculus
ggccccgcagccacagccgccgtcc

SEQ ID NO: 950496 - DNA, 25 bp, Mus musculus
ggccccgcaggcacagccgccgtcc

SEQ ID NO: 950497 - DNA, 25 bp, Mus musculus
ggccccgcctccttcctacaggtac

SEQ ID NO: 950498 - DNA, 25 bp, Mus musculus
ggccccgcctccttgctacaggtac

SEQ ID NO: 950499 - DNA, 25 bp, Mus musculus
ggccccggcggagacatcgagttga

SEQ ID NO: 950500 - DNA, 25 bp, Mus musculus
ggccccggcggagagatcgagttga

SEQ ID NO: 950501 - DNA, 25 bp, Mus musculus
ggcccctaaagacgtgaacattgac

SEQ ID NO: 950502 - DNA, 25 bp, Mus musculus
ggcccctaaagaggtgaacattgac

SEQ ID NO: 950503 - DNA, 25 bp, Mus musculus
ggcccctgaagacgactgcattatc

SEQ ID NO: 950504 - DNA, 25 bp, Mus musculus
ggcccctgaagaggactgcattatc

SEQ ID NO: 950505 - DNA, 25 bp, Mus musculus
ggcccctgagctgctggaggacaac

SEQ ID NO: 950506 - DNA, 25 bp, Mus musculus
ggcccctgaggtgctggaggacaac

SEQ ID NO: 950507 - DNA, 25 bp, Mus musculus
ggccccttggcatcatgcaggctgt

SEQ ID NO: 950508 - DNA, 25 bp, Mus musculus
ggccccttgggatcatgcaggctgt

SEQ ID NO: 950509 - DNA, 25 bp, Mus musculus
ggcccctttagtgaccagtaccaga

SEQ ID NO: 950510 - DNA, 25 bp, Mus musculus
ggcccctttagtgactaccagaatg

SEQ ID NO: 950511 - DNA, 25 bp, Mus musculus
ggcccctttagtgagcagtaccaga

SEQ ID NO: 950512 - DNA, 25 bp, Mus musculus
ggcccctttagtgagtaccagaatg

SEQ ID NO: 950513 - DNA, 25 bp, Mus musculus
ggcccctttctgatccagccagatg

SEQ ID NO: 950514 - DNA, 25 bp, Mus musculus
ggcccctttctgttccagccagatg

SEQ ID NO: 950515 - DNA, 25 bp, Mus musculus
ggcccgacagatctctttggagtcg

SEQ ID NO: 950516 - DNA, 25 bp, Mus musculus
ggcccgacagttctctttggagtcg

SEQ ID NO: 950517 - DNA, 25 bp, Mus musculus
ggcccgaccgagccaagggctatga

SEQ ID NO: 950518 - DNA, 25 bp, Mus musculus
ggcccgaccgtgccaagggctatga

SEQ ID NO: 950519 - DNA, 25 bp, Mus musculus
ggcccgagaggttcctctgctttgc

SEQ ID NO: 950520 - DNA, 25 bp, Mus musculus
ggcccgagaggttcgtctgctttgc

SEQ ID NO: 950521 - DNA, 25 bp, Mus musculus
ggcccgcaaaagaagtctgtggacc

SEQ ID NO: 950522 - DNA, 25 bp, Mus musculus
ggcccgcaaaagtagtctgtggacc

SEQ ID NO: 950523 - DNA, 25 bp, Mus musculus
ggcccgcagtgtcagtgcctgctca

SEQ ID NO: 950524 - DNA, 25 bp, Mus musculus
ggcccgcagtgtgagtgcctgctca

SEQ ID NO: 950525 - DNA, 25 bp, Mus musculus
ggcccgctttgacggcctgaggaag

SEQ ID NO: 950526 - DNA, 25 bp, Mus musculus
ggcccgctttgagggcctgaggaag

SEQ ID NO: 950527 - DNA, 25 bp, Mus musculus
ggcccggctgctcacatgcccccac

SEQ ID NO: 950528 - DNA, 25 bp, Mus musculus
ggcccggctgctcagatgcccccac

SEQ ID NO: 950529 - DNA, 25 bp, Mus musculus
ggcccggcttcgagtatcctcagag

SEQ ID NO: 950530 - DNA, 25 bp, Mus musculus
ggcccggcttcgtgtatcctcagag

SEQ ID NO: 950531 - DNA, 25 bp, Mus musculus
ggcccgggagcacgctgaagctgag

SEQ ID NO: 950532 - DNA, 25 bp, Mus musculus
ggcccgggagcaggctgaagctgag

SEQ ID NO: 950533 - DNA, 25 bp, Mus musculus
ggccctaaagcggttggtgctatct

SEQ ID NO: 950534 - DNA, 25 bp, Mus musculus
ggccctaaaggggttggtgctatct

SEQ ID NO: 950535 - DNA, 25 bp, Mus musculus
ggccctacgcagctcccacagatac

SEQ ID NO: 950536 - DNA, 25 bp, Mus musculus
ggccctacgcagctcctgtccagag

SEQ ID NO: 950537 - DNA, 25 bp, Mus musculus
ggccctacgcaggtcccacagatac

SEQ ID NO: 950538 - DNA, 25 bp, Mus musculus
ggccctacgcaggtcctgtccagag

SEQ ID NO: 950539 - DNA, 25 bp, Mus musculus
ggccctagagctgccagagccactg

SEQ ID NO: 950540 - DNA, 25 bp, Mus musculus
ggccctagaggtgccagagccactg

SEQ ID NO: 950541 - DNA, 25 bp, Mus musculus
ggccctcacgctatatgctatgatg

SEQ ID NO: 950542 - DNA, 25 bp, Mus musculus
ggccctcacggtatatgctatgatg

SEQ ID NO: 950543 - DNA, 25 bp, Mus musculus
ggccctcagcttcaagcagcttata

SEQ ID NO: 950544 - DNA, 25 bp, Mus musculus
ggccctcagcttgaagcagcttata

SEQ ID NO: 950545 - DNA, 25 bp, Mus musculus
ggccctcagtggctcccacagatac

SEQ ID NO: 950546 - DNA, 25 bp, Mus musculus
ggccctcagtgggtcccacagatac

SEQ ID NO: 950547 - DNA, 25 bp, Mus musculus
ggccctcagttaatatgagaagtca

SEQ ID NO: 950548 - DNA, 25 bp, Mus musculus
ggccctcagttattatgagaagtca

SEQ ID NO: 950549 - DNA, 25 bp, Mus musculus
ggccctccagaacgccaagaaatat

SEQ ID NO: 950550 - DNA, 25 bp, Mus musculus
ggccctccagaaggccaagaaatat

SEQ ID NO: 950551 - DNA, 25 bp, Mus musculus
ggccctcgatgacatgtgatcttcg

SEQ ID NO: 950552 - DNA, 25 bp, Mus musculus
ggccctcgatgagatgtgatcttcg

SEQ ID NO: 950553 - DNA, 25 bp, Mus musculus
ggccctctacttcaagaagagaaca

SEQ ID NO: 950554 - DNA, 25 bp, Mus musculus
ggccctctacttcatgaagagaaca

SEQ ID NO: 950555 - DNA, 25 bp, Mus musculus
ggccctctccaacacatataacacc

SEQ ID NO: 950556 - DNA, 25 bp, Mus musculus
ggccctctccaagacatataacacc

SEQ ID NO: 950557 - DNA, 25 bp, Mus musculus
ggccctctctggaacagttcaagat

SEQ ID NO: 950558 - DNA, 25 bp, Mus musculus
ggccctctctggaagagttcaagat

SEQ ID NO: 950559 - DNA, 25 bp, Mus musculus
ggccctgagactcccagcaaattcc

SEQ ID NO: 950560 - DNA, 25 bp, Mus musculus
ggccctgagactgccagcaaattcc

SEQ ID NO: 950561 - DNA, 25 bp, Mus musculus
ggccctgcagatcaccagcaaaagt

SEQ ID NO: 950562 - DNA, 25 bp, Mus musculus
ggccctgcagcactgttcccgacgc

SEQ ID NO: 950563 - DNA, 25 bp, Mus musculus
ggccctgcagcagtgactagcacgg

SEQ ID NO: 950564 - DNA, 25 bp, Mus musculus
ggccctgcagccctcggtgtctcca

SEQ ID NO: 950565 - DNA, 25 bp, Mus musculus
ggccctgcaggactgttcccgacgc

SEQ ID NO: 950566 - DNA, 25 bp, Mus musculus
ggccctgcaggagtgactagcacgg

SEQ ID NO: 950567 - DNA, 25 bp, Mus musculus
ggccctgcaggcctcggtgtctcca

SEQ ID NO: 950568 - DNA, 25 bp, Mus musculus
ggccctgcagttcaccagcaaaagt

SEQ ID NO: 950569 - DNA, 25 bp, Mus musculus
ggccctgcccagagcctgaccccag

SEQ ID NO: 950570 - DNA, 25 bp, Mus musculus
ggccctgcccagatactccccccag

SEQ ID NO: 950571 - DNA, 25 bp, Mus musculus
ggccctgcccagtgcctgaccccag

SEQ ID NO: 950572 - DNA, 25 bp, Mus musculus
ggccctgcccagttactccccccag

SEQ ID NO: 950573 - DNA, 25 bp, Mus musculus
ggccctgccccacattgctgccaag

SEQ ID NO: 950574 - DNA, 25 bp, Mus musculus
ggccctgccccagattgctgccaag

SEQ ID NO: 950575 - DNA, 25 bp, Mus musculus
ggccctgcctgtcacgcttcctgcg

SEQ ID NO: 950576 - DNA, 25 bp, Mus musculus
ggccctgcctgtcaggcttcctgcg

SEQ ID NO: 950577 - DNA, 25 bp, Mus musculus
ggccctgccttgaacgtcatggcac

SEQ ID NO: 950578 - DNA, 25 bp, Mus musculus
ggccctgccttgaaggtcatggcac

SEQ ID NO: 950579 - DNA, 25 bp, Mus musculus
ggccctgcgccatgcagctgatctg

SEQ ID NO: 950580 - DNA, 25 bp, Mus musculus
ggccctgcgccatggagctgatctg

SEQ ID NO: 950581 - DNA, 25 bp, Mus musculus
ggccctggaacacgccgaatctggt

SEQ ID NO: 950582 - DNA, 25 bp, Mus musculus
ggccctggaacaggccgaatctggt

SEQ ID NO: 950583 - DNA, 25 bp, Mus musculus
ggccctggcagacgtcgcatctctc

SEQ ID NO: 950584 - DNA, 25 bp, Mus musculus
ggccctggcagaggtcgcatctctc

SEQ ID NO: 950585 - DNA, 25 bp, Mus musculus
ggccctgggcagcctgctggttgtc

SEQ ID NO: 950586 - DNA, 25 bp, Mus musculus
ggccctgggcaggctgctggttgtc

SEQ ID NO: 950587 - DNA, 25 bp, Mus musculus
ggccctggggctgggtccttggctg

SEQ ID NO: 950588 - DNA, 25 bp, Mus musculus
ggccctgggggtgggtccttggctg

SEQ ID NO: 950589 - DNA, 25 bp, Mus musculus
ggcccttacgacctgggctgacgcg

SEQ ID NO: 950590 - DNA, 25 bp, Mus musculus
ggcccttacgctcttggaaacatgt

SEQ ID NO: 950591 - DNA, 25 bp, Mus musculus
ggcccttacggtcttggaaacatgt

SEQ ID NO: 950592 - DNA, 25 bp, Mus musculus
ggcccttacgtcctgggctgacgcg

SEQ ID NO: 950593 - DNA, 25 bp, Mus musculus
ggcccttgccagcctttctgcagag

SEQ ID NO: 950594 - DNA, 25 bp, Mus musculus
ggcccttgccaggctttctgcagag

SEQ ID NO: 950595 - DNA, 25 bp, Mus musculus
ggccgaagctgacatactccatgtt

SEQ ID NO: 950596 - DNA, 25 bp, Mus musculus
ggccgaagctgagatactccatgtt

SEQ ID NO: 950597 - DNA, 25 bp, Mus musculus
ggccgaccagatgtgaggtgagatg

SEQ ID NO: 950598 - DNA, 25 bp, Mus musculus
ggccgaccagttgtgaggtgagatg

SEQ ID NO: 950599 - DNA, 25 bp, Mus musculus
ggccgagaagaactctcagaaggaa

SEQ ID NO: 950600 - DNA, 25 bp, Mus musculus
ggccgagaagtactctcagaaggaa

SEQ ID NO: 950601 - DNA, 25 bp, Mus musculus
ggccgagactttgtaatgtggaagt

SEQ ID NO: 950602 - DNA, 25 bp, Mus musculus
ggccgagactttgttatgtggaagt

SEQ ID NO: 950603 - DNA, 25 bp, Mus musculus
ggccgagatcgacgcatggtggagc

SEQ ID NO: 950604 - DNA, 25 bp, Mus musculus
ggccgagatcgaggcatggtggagc

SEQ ID NO: 950605 - DNA, 25 bp, Mus musculus
ggccgagcagaaggagggagagttc

SEQ ID NO: 950606 - DNA, 25 bp, Mus musculus
ggccgagcagtaggagggagagttc

SEQ ID NO: 950607 - DNA, 25 bp, Mus musculus
ggccgaggtccacttacaggaggtg

SEQ ID NO: 950608 - DNA, 25 bp, Mus musculus
ggccgaggtccagttacaggaggtg

SEQ ID NO: 950609 - DNA, 25 bp, Mus musculus
ggccgagtaccacagcccacagacg

SEQ ID NO: 950610 - DNA, 25 bp, Mus musculus
ggccgagtaccacgacctgacgttc

SEQ ID NO: 950611 - DNA, 25 bp, Mus musculus
ggccgagtaccagagcccacagacg

SEQ ID NO: 950612 - DNA, 25 bp, Mus musculus
ggccgagtaccaggacctgacgttc

SEQ ID NO: 950613 - DNA, 25 bp, Mus musculus
ggccgagtcgcgtctttcattcatc

SEQ ID NO: 950614 - DNA, 25 bp, Mus musculus
ggccgagtcgggtctttcattcatc

SEQ ID NO: 950615 - DNA, 25 bp, Mus musculus
ggccgagttcggactttctgcactg

SEQ ID NO: 950616 - DNA, 25 bp, Mus musculus
ggccgagttcggtctttctgcactg

SEQ ID NO: 950617 - DNA, 25 bp, Mus musculus
ggccgatgggctcgatgaagtgtcc

SEQ ID NO: 950618 - DNA, 25 bp, Mus musculus
ggccgatgggctggatgaagtgtcc

SEQ ID NO: 950619 - DNA, 25 bp, Mus musculus
ggccgcagcagcccagtttgatctg

SEQ ID NO: 950620 - DNA, 25 bp, Mus musculus
ggccgcagcagccctgtttgatctg

SEQ ID NO: 950621 - DNA, 25 bp, Mus musculus
ggccgccactattaaacctggtgat

SEQ ID NO: 950622 - DNA, 25 bp, Mus musculus
ggccgccactattatacctggtgat

SEQ ID NO: 950623 - DNA, 25 bp, Mus musculus
ggccgccatcatctctgccacaact

SEQ ID NO: 950624 - DNA, 25 bp, Mus musculus
ggccgccatcatgtctgccacaact

SEQ ID NO: 950625 - DNA, 25 bp, Mus musculus
ggccgccatccacacgttccgccag

SEQ ID NO: 950626 - DNA, 25 bp, Mus musculus
ggccgccatccacaggttccgccag

SEQ ID NO: 950627 - DNA, 25 bp, Mus musculus
ggccgccctcgggacattatcaaca

SEQ ID NO: 950628 - DNA, 25 bp, Mus musculus
ggccgccctcgggagattatcaaca

SEQ ID NO: 950629 - DNA, 25 bp, Mus musculus
ggccgccgccagctgtgcaacagaa

SEQ ID NO: 950630 - DNA, 25 bp, Mus musculus
ggccgccgccaggtgtgcaacagaa

SEQ ID NO: 950631 - DNA, 25 bp, Mus musculus
ggccgcctgtgccggaaggacctgt

SEQ ID NO: 950632 - DNA, 25 bp, Mus musculus
ggccgcctgtgcgggaaggacctgt

SEQ ID NO: 950633 - DNA, 25 bp, Mus musculus
ggccgcgaacaacaccccctctatg

SEQ ID NO: 950634 - DNA, 25 bp, Mus musculus
ggccgcgaacaagaccccctctatg

SEQ ID NO: 950635 - DNA, 25 bp, Mus musculus
ggccgcgacatgcactgtcctgtgc

SEQ ID NO: 950636 - DNA, 25 bp, Mus musculus
ggccgcgacatggactgtcctgtgc

SEQ ID NO: 950637 - DNA, 25 bp, Mus musculus
ggccgcgagacacggctgatgaagc

SEQ ID NO: 950638 - DNA, 25 bp, Mus musculus
ggccgcgagacagggctgatgaagc

SEQ ID NO: 950639 - DNA, 25 bp, Mus musculus
ggccgcgccatcactcggaacccac

SEQ ID NO: 950640 - DNA, 25 bp, Mus musculus
ggccgcgccatctctcggaacccac

SEQ ID NO: 950641 - DNA, 25 bp, Mus musculus
ggccgcgcgcggcgtgctgtgagtg

SEQ ID NO: 950642 - DNA, 25 bp, Mus musculus
ggccgcgcgcggggtgctgtgagtg

SEQ ID NO: 950643 - DNA, 25 bp, Mus musculus
ggccgcgcggccatcgagcagctga

SEQ ID NO: 950644 - DNA, 25 bp, Mus musculus
ggccgcgcggccatggagcagctga

SEQ ID NO: 950645 - DNA, 25 bp, Mus musculus
ggccgcggagctcacaggctctgtt

SEQ ID NO: 950646 - DNA, 25 bp, Mus musculus
ggccgcggaggtcacaggctctgtt

SEQ ID NO: 950647 - DNA, 25 bp, Mus musculus
ggccgcgggaaacagtccagcctct

SEQ ID NO: 950648 - DNA, 25 bp, Mus musculus
ggccgcgggaaacgataaagcatca

SEQ ID NO: 950649 - DNA, 25 bp, Mus musculus
ggccgcgggaaagagtccagcctct

SEQ ID NO: 950650 - DNA, 25 bp, Mus musculus
ggccgcgggaaaggataaagcatca

SEQ ID NO: 950651 - DNA, 25 bp, Mus musculus
ggccgcgtcatgggcgttaattcct

SEQ ID NO: 950652 - DNA, 25 bp, Mus musculus
ggccgcgtcatgggggttaattcct

SEQ ID NO: 950653 - DNA, 25 bp, Mus musculus
ggccgcgtccggctgatctctgggc

SEQ ID NO: 950654 - DNA, 25 bp, Mus musculus
ggccgcgtccgggtgatctctgggc

SEQ ID NO: 950655 - DNA, 25 bp, Mus musculus
ggccgctgtcaaaagtcttgcgctc

SEQ ID NO: 950656 - DNA, 25 bp, Mus musculus
ggccgctgtcaatagtcttgcgctc

SEQ ID NO: 950657 - DNA, 25 bp, Mus musculus
ggccgctgtctgagcgcaggctgtg

SEQ ID NO: 950658 - DNA, 25 bp, Mus musculus
ggccgctgtctgtgcgcaggctgtg

SEQ ID NO: 950659 - DNA, 25 bp, Mus musculus
ggccgcttcaaacatgtcctgttgc

SEQ ID NO: 950660 - DNA, 25 bp, Mus musculus
ggccgcttcaaagatgtcctgttgc

SEQ ID NO: 950661 - DNA, 25 bp, Mus musculus
ggccgcttgcggaggtttggattca

SEQ ID NO: 950662 - DNA, 25 bp, Mus musculus
ggccgcttgcggtggtttggattca

SEQ ID NO: 950663 - DNA, 25 bp, Mus musculus
ggccggcatgaacgtgcgggagctg

SEQ ID NO: 950664 - DNA, 25 bp, Mus musculus
ggccggcatgaaggtgcgggagctg

SEQ ID NO: 950665 - DNA, 25 bp, Mus musculus
ggccggccgaagcatcatctgtccc

SEQ ID NO: 950666 - DNA, 25 bp, Mus musculus
ggccggccgaagcttcttgattgtc

SEQ ID NO: 950667 - DNA, 25 bp, Mus musculus
ggccggccgaaggatcatctgtccc

SEQ ID NO: 950668 - DNA, 25 bp, Mus musculus
ggccggccgaaggttcttgattgtc

SEQ ID NO: 950669 - DNA, 25 bp, Mus musculus
ggccggcctccaacaacaaataaga

SEQ ID NO: 950670 - DNA, 25 bp, Mus musculus
ggccggcctccatcaacaaataaga

SEQ ID NO: 950671 - DNA, 25 bp, Mus musculus
ggccggcgggaacgttggctgctgg

SEQ ID NO: 950672 - DNA, 25 bp, Mus musculus
ggccggcgggaaggttggctgctgg

SEQ ID NO: 950673 - DNA, 25 bp, Mus musculus
ggccgggaagagactcgtgttcgct

SEQ ID NO: 950674 - DNA, 25 bp, Mus musculus
ggccgggaagtgactcgtgttcgct

SEQ ID NO: 950675 - DNA, 25 bp, Mus musculus
ggccgggctccacctcttcacttga

SEQ ID NO: 950676 - DNA, 25 bp, Mus musculus
ggccgggctccagctcttcacttga

SEQ ID NO: 950677 - DNA, 25 bp, Mus musculus
ggccggggcgagcttctctccacta

SEQ ID NO: 950678 - DNA, 25 bp, Mus musculus
ggccggggcgaggttctctccacta

SEQ ID NO: 950679 - DNA, 25 bp, Mus musculus
ggccggtcagctgtccttgctggtc

SEQ ID NO: 950680 - DNA, 25 bp, Mus musculus
ggccggtcaggtgtccttgctggtc

SEQ ID NO: 950681 - DNA, 25 bp, Mus musculus
ggccggtctctccttctcatcgcag

SEQ ID NO: 950682 - DNA, 25 bp, Mus musculus
ggccggtctctcgttctcatcgcag

SEQ ID NO: 950683 - DNA, 25 bp, Mus musculus
ggccggttccgacgtgtgtgaggac

SEQ ID NO: 950684 - DNA, 25 bp, Mus musculus
ggccggttccgaggtgtgtgaggac

SEQ ID NO: 950685 - DNA, 25 bp, Mus musculus
ggccgtaaatcgttcagactgggca

SEQ ID NO: 950686 - DNA, 25 bp, Mus musculus
ggccgtaaatggttcagactgggca

SEQ ID NO: 950687 - DNA, 25 bp, Mus musculus
ggccgtcatcagccctcctggacac

SEQ ID NO: 950688 - DNA, 25 bp, Mus musculus
ggccgtcatcaggcctcctggacac

SEQ ID NO: 950689 - DNA, 25 bp, Mus musculus
ggccgtccgaggatgtggatgagtg

SEQ ID NO: 950690 - DNA, 25 bp, Mus musculus
ggccgtccgaggttgtggatgagtg

SEQ ID NO: 950691 - DNA, 25 bp, Mus musculus
ggccgtcgcgcacacgattacatct

SEQ ID NO: 950692 - DNA, 25 bp, Mus musculus
ggccgtcgcgcacacgccctaccgt

SEQ ID NO: 950693 - DNA, 25 bp, Mus musculus
ggccgtcgcgcacaggattacatct

SEQ ID NO: 950694 - DNA, 25 bp, Mus musculus
ggccgtcgcgcacaggccctaccgt

SEQ ID NO: 950695 - DNA, 25 bp, Mus musculus
ggccgtcgtgtgcacgcagtcaggg

SEQ ID NO: 950696 - DNA, 25 bp, Mus musculus
ggccgtcgtgtgcaggcagtcaggg

SEQ ID NO: 950697 - DNA, 25 bp, Mus musculus
ggccgtgatgggaacgtatggatgt

SEQ ID NO: 950698 - DNA, 25 bp, Mus musculus
ggccgtgatgggaaggtatggatgt

SEQ ID NO: 950699 - DNA, 25 bp, Mus musculus
ggccgtgctcacagcctttgcaaat

SEQ ID NO: 950700 - DNA, 25 bp, Mus musculus
ggccgtgctcacaggctttgcaaat

SEQ ID NO: 950701 - DNA, 25 bp, Mus musculus
ggccgtgctgacctataccagattt

SEQ ID NO: 950702 - DNA, 25 bp, Mus musculus
ggccgtgctgtcctataccagattt

SEQ ID NO: 950703 - DNA, 25 bp, Mus musculus
ggccgttcttcataaaactctgaag

SEQ ID NO: 950704 - DNA, 25 bp, Mus musculus
ggccgttcttcatataactctgaag

SEQ ID NO: 950705 - DNA, 25 bp, Mus musculus
ggccgtttccaccgaagatgctacc

SEQ ID NO: 950706 - DNA, 25 bp, Mus musculus
ggccgtttccacggaagatgctacc

SEQ ID NO: 950707 - DNA, 25 bp, Mus musculus
ggcctaatgacactaattatgccac

SEQ ID NO: 950708 - DNA, 25 bp, Mus musculus
ggcctaatgacagtaattatgccac

SEQ ID NO: 950709 - DNA, 25 bp, Mus musculus
ggcctacaaacagctagtgactttt

SEQ ID NO: 950710 - DNA, 25 bp, Mus musculus
ggcctacaaagagctagtgactttt

SEQ ID NO: 950711 - DNA, 25 bp, Mus musculus
ggcctacagaagaggaggccactgg

SEQ ID NO: 950712 - DNA, 25 bp, Mus musculus
ggcctacagaagtggaggccactgg

SEQ ID NO: 950713 - DNA, 25 bp, Mus musculus
ggcctacaggacaaagtttccatcc

SEQ ID NO: 950714 - DNA, 25 bp, Mus musculus
ggcctacaggacaatgtttccatcc

SEQ ID NO: 950715 - DNA, 25 bp, Mus musculus
ggcctacagtattcagaggaaatat

SEQ ID NO: 950716 - DNA, 25 bp, Mus musculus
ggcctacagtattcagttacggtct

SEQ ID NO: 950717 - DNA, 25 bp, Mus musculus
ggcctacagtattcatgagaacctg

SEQ ID NO: 950718 - DNA, 25 bp, Mus musculus
ggcctacagtattctgaggaaatat

SEQ ID NO: 950719 - DNA, 25 bp, Mus musculus
ggcctacagtattctgttacggtct

SEQ ID NO: 950720 - DNA, 25 bp, Mus musculus
ggcctacagtattcttgagaacctg

SEQ ID NO: 950721 - DNA, 25 bp, Mus musculus
ggcctacctagccagtgcaccccca

SEQ ID NO: 950722 - DNA, 25 bp, Mus musculus
ggcctacctagcgagtgcaccccca

SEQ ID NO: 950723 - DNA, 25 bp, Mus musculus
ggcctactatccctatcagaagtgg

SEQ ID NO: 950724 - DNA, 25 bp, Mus musculus
ggcctactatgcctatcagaagtgg

SEQ ID NO: 950725 - DNA, 25 bp, Mus musculus
ggcctagaacaccgtctgcaaagaa

SEQ ID NO: 950726 - DNA, 25 bp, Mus musculus
ggcctagaacacggtctgcaaagaa

SEQ ID NO: 950727 - DNA, 25 bp, Mus musculus
ggcctagaagctgacggttcaagga

SEQ ID NO: 950728 - DNA, 25 bp, Mus musculus
ggcctagaagctgagggttcaagga

SEQ ID NO: 950729 - DNA, 25 bp, Mus musculus
ggcctagagagcaacttcattacag

SEQ ID NO: 950730 - DNA, 25 bp, Mus musculus
ggcctagagagcaagttcattacag

SEQ ID NO: 950731 - DNA, 25 bp, Mus musculus
ggcctagctcagcgttttatgagct

SEQ ID NO: 950732 - DNA, 25 bp, Mus musculus
ggcctagctcagggttttatgagct

SEQ ID NO: 950733 - DNA, 25 bp, Mus musculus
ggcctataagattcttgctcacctg

SEQ ID NO: 950734 - DNA, 25 bp, Mus musculus
ggcctataagtttcttgctcacctg

SEQ ID NO: 950735 - DNA, 25 bp, Mus musculus
ggcctatcagcgcgcttatccgctg

SEQ ID NO: 950736 - DNA, 25 bp, Mus musculus
ggcctatcagcgcgtcatagaagag

SEQ ID NO: 950737 - DNA, 25 bp, Mus musculus
ggcctatcagcgggcttatccgctg

SEQ ID NO: 950738 - DNA, 25 bp, Mus musculus
ggcctatcagcgggtcatagaagag

SEQ ID NO: 950739 - DNA, 25 bp, Mus musculus
ggcctatctaaacgacactcaccaa

SEQ ID NO: 950740 - DNA, 25 bp, Mus musculus
ggcctatctaaaggacactcaccaa

SEQ ID NO: 950741 - DNA, 25 bp, Mus musculus
ggcctatgaaggaggttccgagttg

SEQ ID NO: 950742 - DNA, 25 bp, Mus musculus
ggcctatgaaggtggttccgagttg

SEQ ID NO: 950743 - DNA, 25 bp, Mus musculus
ggcctattacatcccaacaattctc

SEQ ID NO: 950744 - DNA, 25 bp, Mus musculus
ggcctattacatcgatacatgggcg

SEQ ID NO: 950745 - DNA, 25 bp, Mus musculus
ggcctattacatgccaacaattctc

SEQ ID NO: 950746 - DNA, 25 bp, Mus musculus
ggcctattacatggatacatgggcg

SEQ ID NO: 950747 - DNA, 25 bp, Mus musculus
ggcctattgtggcttccactcgcaa

SEQ ID NO: 950748 - DNA, 25 bp, Mus musculus
ggcctattgtgggttccactcgcaa

SEQ ID NO: 950749 - DNA, 25 bp, Mus musculus
ggcctcaactataagtcttgcttcc

SEQ ID NO: 950750 - DNA, 25 bp, Mus musculus
ggcctcaactttaagtcttgcttcc

SEQ ID NO: 950751 - DNA, 25 bp, Mus musculus
ggcctcactgcgcacattccagcag

SEQ ID NO: 950752 - DNA, 25 bp, Mus musculus
ggcctcactgggcacattccagcag

SEQ ID NO: 950753 - DNA, 25 bp, Mus musculus
ggcctcagacatctcgctcagcatg

SEQ ID NO: 950754 - DNA, 25 bp, Mus musculus
ggcctcagacatctggctcagcatg

SEQ ID NO: 950755 - DNA, 25 bp, Mus musculus
ggcctcatagccaccgtggtcaccc

SEQ ID NO: 950756 - DNA, 25 bp, Mus musculus
ggcctcataggcaccgtggtcaccc

SEQ ID NO: 950757 - DNA, 25 bp, Mus musculus
ggcctcatcaagcacgttctctatg

SEQ ID NO: 950758 - DNA, 25 bp, Mus musculus
ggcctcatcaaggacgttctctatg

SEQ ID NO: 950759 - DNA, 25 bp, Mus musculus
ggcctcatgcctttcggcttggaag

SEQ ID NO: 950760 - DNA, 25 bp, Mus musculus
ggcctcatgcctttgggcttggaag

SEQ ID NO: 950761 - DNA, 25 bp, Mus musculus
ggcctcatggctgccggtttcctgt

SEQ ID NO: 950762 - DNA, 25 bp, Mus musculus
ggcctcatggctgcgggtttcctgt

SEQ ID NO: 950763 - DNA, 25 bp, Mus musculus
ggcctccacagacttcctaccaggt

SEQ ID NO: 950764 - DNA, 25 bp, Mus musculus
ggcctccacagagttcctaccaggt

SEQ ID NO: 950765 - DNA, 25 bp, Mus musculus
ggcctccatgtgcatataccgctgt

SEQ ID NO: 950766 - DNA, 25 bp, Mus musculus
ggcctccatgtgccatttggcacat

SEQ ID NO: 950767 - DNA, 25 bp, Mus musculus
ggcctccatgtggatataccgctgt

SEQ ID NO: 950768 - DNA, 25 bp, Mus musculus
ggcctccatgtggcatttggcacat

SEQ ID NO: 950769 - DNA, 25 bp, Mus musculus
ggcctcccagcagaaggagtgtcct

SEQ ID NO: 950770 - DNA, 25 bp, Mus musculus
ggcctcccagcagaaggcagcaagc

SEQ ID NO: 950771 - DNA, 25 bp, Mus musculus
ggcctcccagcagatggagtgtcct

SEQ ID NO: 950772 - DNA, 25 bp, Mus musculus
ggcctcccagcagatggcagcaagc

SEQ ID NO: 950773 - DNA, 25 bp, Mus musculus
ggcctccccacacggcgccatgact

SEQ ID NO: 950774 - DNA, 25 bp, Mus musculus
ggcctccccacagggcgccatgact

SEQ ID NO: 950775 - DNA, 25 bp, Mus musculus
ggcctccctctgatcgatgaggtga

SEQ ID NO: 950776 - DNA, 25 bp, Mus musculus
ggcctccctctgttcgatgaggtga

SEQ ID NO: 950777 - DNA, 25 bp, Mus musculus
ggcctccgctcacgaacgagttcaa

SEQ ID NO: 950778 - DNA, 25 bp, Mus musculus
ggcctccgctcacgtaaacagaatc

SEQ ID NO: 950779 - DNA, 25 bp, Mus musculus
ggcctccgctcaggaacgagttcaa

SEQ ID NO: 950780 - DNA, 25 bp, Mus musculus
ggcctccgctcaggtaaacagaatc

SEQ ID NO: 950781 - DNA, 25 bp, Mus musculus
ggcctccggcctcgaggatccgatt

SEQ ID NO: 950782 - DNA, 25 bp, Mus musculus
ggcctccggcctggaggatccgatt

SEQ ID NO: 950783 - DNA, 25 bp, Mus musculus
ggcctcctcaagctaaagaacgctt

SEQ ID NO: 950784 - DNA, 25 bp, Mus musculus
ggcctcctcaaggtaaagaacgctt

SEQ ID NO: 950785 - DNA, 25 bp, Mus musculus
ggcctcctcatccacggtcaaagtt

SEQ ID NO: 950786 - DNA, 25 bp, Mus musculus
ggcctcctcatccagggtcaaagtt

SEQ ID NO: 950787 - DNA, 25 bp, Mus musculus
ggcctcctctctagactcggcataa

SEQ ID NO: 950788 - DNA, 25 bp, Mus musculus
ggcctcctctcttgactcggcataa

SEQ ID NO: 950789 - DNA, 25 bp, Mus musculus
ggcctcctggccaggtggccattga

SEQ ID NO: 950790 - DNA, 25 bp, Mus musculus
ggcctcctggcctggtggccattga

SEQ ID NO: 950791 - DNA, 25 bp, Mus musculus
ggcctcgaaagactgctggaggccc

SEQ ID NO: 950792 - DNA, 25 bp, Mus musculus
ggcctcgaaagagtgctggaggccc

SEQ ID NO: 950793 - DNA, 25 bp, Mus musculus
ggcctcgcagagacctgatgtcctg

SEQ ID NO: 950794 - DNA, 25 bp, Mus musculus
ggcctcgcagtgacctgatgtcctg

SEQ ID NO: 950795 - DNA, 25 bp, Mus musculus
ggcctcgccaagagttcctccagca

SEQ ID NO: 950796 - DNA, 25 bp, Mus musculus
ggcctcgccaagctatgtggaccga

SEQ ID NO: 950797 - DNA, 25 bp, Mus musculus
ggcctcgccaaggtatgtggaccga

SEQ ID NO: 950798 - DNA, 25 bp, Mus musculus
ggcctcgccaagtgttcctccagca

SEQ ID NO: 950799 - DNA, 25 bp, Mus musculus
ggcctcgctggtcgctggaggggta

SEQ ID NO: 950800 - DNA, 25 bp, Mus musculus
ggcctcgctggtggctggaggggta

SEQ ID NO: 950801 - DNA, 25 bp, Mus musculus
ggcctcggtgattgaagtgagtgaa

SEQ ID NO: 950802 - DNA, 25 bp, Mus musculus
ggcctcggtgtttgaagtgagtgaa

SEQ ID NO: 950803 - DNA, 25 bp, Mus musculus
ggcctctaccggacacacctgctct

SEQ ID NO: 950804 - DNA, 25 bp, Mus musculus
ggcctctaccggtcacacctgctct

SEQ ID NO: 950805 - DNA, 25 bp, Mus musculus
ggcctctcaaagcacagtgaacttt

SEQ ID NO: 950806 - DNA, 25 bp, Mus musculus
ggcctctcaaaggacagtgaacttt

SEQ ID NO: 950807 - DNA, 25 bp, Mus musculus
ggcctctcagaacacaaaagagagc

SEQ ID NO: 950808 - DNA, 25 bp, Mus musculus
ggcctctcagaaccatcactatttc

SEQ ID NO: 950809 - DNA, 25 bp, Mus musculus
ggcctctcagaagacaaaagagagc

SEQ ID NO: 950810 - DNA, 25 bp, Mus musculus
ggcctctcagaagcatcactatttc

SEQ ID NO: 950811 - DNA, 25 bp, Mus musculus
ggcctctcatctcccacttcttcgc

SEQ ID NO: 950812 - DNA, 25 bp, Mus musculus
ggcctctcatctccgacttcttcgc

SEQ ID NO: 950813 - DNA, 25 bp, Mus musculus
ggcctctccttagtcgcgtgagtca

SEQ ID NO: 950814 - DNA, 25 bp, Mus musculus
ggcctctccttagtggcgtgagtca

SEQ ID NO: 950815 - DNA, 25 bp, Mus musculus
ggcctctgctccaccgtaaccatgt

SEQ ID NO: 950816 - DNA, 25 bp, Mus musculus
ggcctctgctccacggtaaccatgt

SEQ ID NO: 950817 - DNA, 25 bp, Mus musculus
ggcctctggagccgattcaaaaggt

SEQ ID NO: 950818 - DNA, 25 bp, Mus musculus
ggcctctggagccgtttcaaaaggt

SEQ ID NO: 950819 - DNA, 25 bp, Mus musculus
ggcctctggcagagcctgccccagt

SEQ ID NO: 950820 - DNA, 25 bp, Mus musculus
ggcctctggcagtgcctgccccagt

SEQ ID NO: 950821 - DNA, 25 bp, Mus musculus
ggcctcttgcctcctagcagccaca

SEQ ID NO: 950822 - DNA, 25 bp, Mus musculus
ggcctcttgcctgctagcagccaca

SEQ ID NO: 950823 - DNA, 25 bp, Mus musculus
ggcctgaaagcggctgtggtgtgtg

SEQ ID NO: 950824 - DNA, 25 bp, Mus musculus
ggcctgaaaggggctgtggtgtgtg

SEQ ID NO: 950825 - DNA, 25 bp, Mus musculus
ggcctgacactgactctcatggtac

SEQ ID NO: 950826 - DNA, 25 bp, Mus musculus
ggcctgacactgtctctcatggtac

SEQ ID NO: 950827 - DNA, 25 bp, Mus musculus
ggcctgaccccgctccactctagcc

SEQ ID NO: 950828 - DNA, 25 bp, Mus musculus
ggcctgacccggctccactctagcc

SEQ ID NO: 950829 - DNA, 25 bp, Mus musculus
ggcctgagagcctggtttccagcca

SEQ ID NO: 950830 - DNA, 25 bp, Mus musculus
ggcctgagaggctggtttccagcca

SEQ ID NO: 950831 - DNA, 25 bp, Mus musculus
ggcctgcagcagctgtctgtgagga

SEQ ID NO: 950832 - DNA, 25 bp, Mus musculus
ggcctgcagcaggtgtctgtgagga

SEQ ID NO: 950833 - DNA, 25 bp, Mus musculus
ggcctgccaccacgttacgtctgga

SEQ ID NO: 950834 - DNA, 25 bp, Mus musculus
ggcctgccaccaggttacgtctgga

SEQ ID NO: 950835 - DNA, 25 bp, Mus musculus
ggcctgccagagcgcctgtttgctg

SEQ ID NO: 950836 - DNA, 25 bp, Mus musculus
ggcctgccagagggcctgtttgctg

SEQ ID NO: 950837 - DNA, 25 bp, Mus musculus
ggcctgccccagcatcagaatggca

SEQ ID NO: 950838 - DNA, 25 bp, Mus musculus
ggcctgccccaggatcagaatggca

SEQ ID NO: 950839 - DNA, 25 bp, Mus musculus
ggcctgcccgaaagagtctaaagcg

SEQ ID NO: 950840 - DNA, 25 bp, Mus musculus
ggcctgcccgaaagtgtctaaagcg

SEQ ID NO: 950841 - DNA, 25 bp, Mus musculus
ggcctgccggaatgtttcagaagtg

SEQ ID NO: 950842 - DNA, 25 bp, Mus musculus
ggcctgccggtatgtttcagaagtg

SEQ ID NO: 950843 - DNA, 25 bp, Mus musculus
ggcctgcctcaccgtccgctatgtt

SEQ ID NO: 950844 - DNA, 25 bp, Mus musculus
ggcctgcctcacggtccgctatgtt

SEQ ID NO: 950845 - DNA, 25 bp, Mus musculus
ggcctgctacaacgtgcagcagaaa

SEQ ID NO: 950846 - DNA, 25 bp, Mus musculus
ggcctgctacaaggtgcagcagaaa

SEQ ID NO: 950847 - DNA, 25 bp, Mus musculus
ggcctgctcctcggagcggagctga

SEQ ID NO: 950848 - DNA, 25 bp, Mus musculus
ggcctgctcctcggtgcggagctga

SEQ ID NO: 950849 - DNA, 25 bp, Mus musculus
ggcctgctctcgagtgggcagtatc

SEQ ID NO: 950850 - DNA, 25 bp, Mus musculus
ggcctgctctcgtgtgggcagtatc

SEQ ID NO: 950851 - DNA, 25 bp, Mus musculus
ggcctgctgcatagtgttcttcgtg

SEQ ID NO: 950852 - DNA, 25 bp, Mus musculus
ggcctgctgcattgtgttcttcgtg

SEQ ID NO: 950853 - DNA, 25 bp, Mus musculus
ggcctgcttacacgaagccgagata

SEQ ID NO: 950854 - DNA, 25 bp, Mus musculus
ggcctgcttacaggaagccgagata

SEQ ID NO: 950855 - DNA, 25 bp, Mus musculus
ggcctgcttgaggtgtgcattttac

SEQ ID NO: 950856 - DNA, 25 bp, Mus musculus
ggcctgcttgtggtgtgcattttac

SEQ ID NO: 950857 - DNA, 25 bp, Mus musculus
ggcctggacctacaacaccacctct

SEQ ID NO: 950858 - DNA, 25 bp, Mus musculus
ggcctggacctacatcaccacctct

SEQ ID NO: 950859 - DNA, 25 bp, Mus musculus
ggcctggacgaaaaccacgagctgt

SEQ ID NO: 950860 - DNA, 25 bp, Mus musculus
ggcctggacgacgctgagcaggggt

SEQ ID NO: 950861 - DNA, 25 bp, Mus musculus
ggcctggacgtaaaccacgagctgt

SEQ ID NO: 950862 - DNA, 25 bp, Mus musculus
ggcctggacgtcgctgagcaggggt

SEQ ID NO: 950863 - DNA, 25 bp, Mus musculus
ggcctggagaaagacgctgccactc

SEQ ID NO: 950864 - DNA, 25 bp, Mus musculus
ggcctggagaaagacgtggaggtga

SEQ ID NO: 950865 - DNA, 25 bp, Mus musculus
ggcctggagaaagaggctgccactc

SEQ ID NO: 950866 - DNA, 25 bp, Mus musculus
ggcctggagaaagaggtggaggtga

SEQ ID NO: 950867 - DNA, 25 bp, Mus musculus
ggcctggagaagattgaacagcaac

SEQ ID NO: 950868 - DNA, 25 bp, Mus musculus
ggcctggagaagtttgaacagcaac

SEQ ID NO: 950869 - DNA, 25 bp, Mus musculus
ggcctggcagccccttttagctacc

SEQ ID NO: 950870 - DNA, 25 bp, Mus musculus
ggcctggcaggcccttttagctacc

SEQ ID NO: 950871 - DNA, 25 bp, Mus musculus
ggcctggcctacccggccaaggagg

SEQ ID NO: 950872 - DNA, 25 bp, Mus musculus
ggcctggcctacgcggccaaggagg

SEQ ID NO: 950873 - DNA, 25 bp, Mus musculus
ggcctggctgtgcgttacacagcct

SEQ ID NO: 950874 - DNA, 25 bp, Mus musculus
ggcctggctgtgggttacacagcct

SEQ ID NO: 950875 - DNA, 25 bp, Mus musculus
ggcctgtcatcctccaagccaagct

SEQ ID NO: 950876 - DNA, 25 bp, Mus musculus
ggcctgtcatcctcctgcctggctg

SEQ ID NO: 950877 - DNA, 25 bp, Mus musculus
ggcctgtcatcctcgaagccaagct

SEQ ID NO: 950878 - DNA, 25 bp, Mus musculus
ggcctgtcatcctcgtgcctggctg

SEQ ID NO: 950879 - DNA, 25 bp, Mus musculus
ggcctgtgagagagtggacattgac

SEQ ID NO: 950880 - DNA, 25 bp, Mus musculus
ggcctgtgagagtgtggacattgac

SEQ ID NO: 950881 - DNA, 25 bp, Mus musculus
ggcctgtgagcgtcaaagcttgcga

SEQ ID NO: 950882 - DNA, 25 bp, Mus musculus
ggcctgtgagggtcaaagcttgcga

SEQ ID NO: 950883 - DNA, 25 bp, Mus musculus
ggcctgtgccaacgtcgagtatgcc

SEQ ID NO: 950884 - DNA, 25 bp, Mus musculus
ggcctgtgccaaggtcgagtatgcc

SEQ ID NO: 950885 - DNA, 25 bp, Mus musculus
ggcctgtttgcacacgttgtgttgc

SEQ ID NO: 950886 - DNA, 25 bp, Mus musculus
ggcctgtttgcacaggttgtgttgc

SEQ ID NO: 950887 - DNA, 25 bp, Mus musculus
ggccttaaatcactgtcggtgacgt

SEQ ID NO: 950888 - DNA, 25 bp, Mus musculus
ggccttaaatcagtgtcggtgacgt

SEQ ID NO: 950889 - DNA, 25 bp, Mus musculus
ggccttaccatgagccctggggggc

SEQ ID NO: 950890 - DNA, 25 bp, Mus musculus
ggccttaccatgtgccctggggggc

SEQ ID NO: 950891 - DNA, 25 bp, Mus musculus
ggccttacccagagctcatctctcg

SEQ ID NO: 950892 - DNA, 25 bp, Mus musculus
ggccttacccagtgctcatctctcg

SEQ ID NO: 950893 - DNA, 25 bp, Mus musculus
ggccttagtctgctacatagcccat

SEQ ID NO: 950894 - DNA, 25 bp, Mus musculus
ggccttagtctggtacatagcccat

SEQ ID NO: 950895 - DNA, 25 bp, Mus musculus
ggccttcacaatctccagaactaca

SEQ ID NO: 950896 - DNA, 25 bp, Mus musculus
ggccttcacaatgtccagaactaca

SEQ ID NO: 950897 - DNA, 25 bp, Mus musculus
ggccttccagagtagaggcccggta

SEQ ID NO: 950898 - DNA, 25 bp, Mus musculus
ggccttccagctgaaagaggcccac

SEQ ID NO: 950899 - DNA, 25 bp, Mus musculus
ggccttccaggtgaaagaggcccac

SEQ ID NO: 950900 - DNA, 25 bp, Mus musculus
ggccttccagtgtagaggcccggta

SEQ ID NO: 950901 - DNA, 25 bp, Mus musculus
ggccttcctattcgccaacacatct

SEQ ID NO: 950902 - DNA, 25 bp, Mus musculus
ggccttcctattggccaacacatct

SEQ ID NO: 950903 - DNA, 25 bp, Mus musculus
ggccttcctgagcattatttgtatg

SEQ ID NO: 950904 - DNA, 25 bp, Mus musculus
ggccttcctgaggattatttgtatg

SEQ ID NO: 950905 - DNA, 25 bp, Mus musculus
ggccttcgcgtcaccgtcttgttgc

SEQ ID NO: 950906 - DNA, 25 bp, Mus musculus
ggccttcgcgtcacggtcttgttgc

SEQ ID NO: 950907 - DNA, 25 bp, Mus musculus
ggccttctacagcatgctggcccag

SEQ ID NO: 950908 - DNA, 25 bp, Mus musculus
ggccttctacaggatgctggcccag

SEQ ID NO: 950909 - DNA, 25 bp, Mus musculus
ggccttctggagcacatcttatact

SEQ ID NO: 950910 - DNA, 25 bp, Mus musculus
ggccttctggaggacatcttatact

SEQ ID NO: 950911 - DNA, 25 bp, Mus musculus
ggccttcttgagcgccttcttgaag

SEQ ID NO: 950912 - DNA, 25 bp, Mus musculus
ggccttcttgagctgaaaattgaga

SEQ ID NO: 950913 - DNA, 25 bp, Mus musculus
ggccttcttgagggccttcttgaag

SEQ ID NO: 950914 - DNA, 25 bp, Mus musculus
ggccttcttgaggtgaaaattgaga

SEQ ID NO: 950915 - DNA, 25 bp, Mus musculus
ggccttgacaatatcaacatgacac

SEQ ID NO: 950916 - DNA, 25 bp, Mus musculus
ggccttgacaatttcaacatgacac

SEQ ID NO: 950917 - DNA, 25 bp, Mus musculus
ggccttgacccatgctgccagtttg

SEQ ID NO: 950918 - DNA, 25 bp, Mus musculus
ggccttgacccatggtgccagtttg

SEQ ID NO: 950919 - DNA, 25 bp, Mus musculus
ggccttgacgagatgctgttggctg

SEQ ID NO: 950920 - DNA, 25 bp, Mus musculus
ggccttgacgagcggatgagagagt

SEQ ID NO: 950921 - DNA, 25 bp, Mus musculus
ggccttgacgaggggatgagagagt

SEQ ID NO: 950922 - DNA, 25 bp, Mus musculus
ggccttgacgagttgctgttggctg

SEQ ID NO: 950923 - DNA, 25 bp, Mus musculus
ggccttgcagaatttacatgagaaa

SEQ ID NO: 950924 - DNA, 25 bp, Mus musculus
ggccttgcagtatttacatgagaaa

SEQ ID NO: 950925 - DNA, 25 bp, Mus musculus
ggccttgcttcacgcgtctgtggag

SEQ ID NO: 950926 - DNA, 25 bp, Mus musculus
ggccttgcttcaggcgtctgtggag

SEQ ID NO: 950927 - DNA, 25 bp, Mus musculus
ggccttgggaagcctgctgatctgg

SEQ ID NO: 950928 - DNA, 25 bp, Mus musculus
ggccttgggaaggctgctgatctgg

SEQ ID NO: 950929 - DNA, 25 bp, Mus musculus
ggccttgtacagctatcacaaggct

SEQ ID NO: 950930 - DNA, 25 bp, Mus musculus
ggccttgtacaggtatcacaaggct

SEQ ID NO: 950931 - DNA, 25 bp, Mus musculus
ggcctttaagacatttggagaactg

SEQ ID NO: 950932 - DNA, 25 bp, Mus musculus
ggcctttaagtcatttggagaactg

SEQ ID NO: 950933 - DNA, 25 bp, Mus musculus
ggcctttactttcaacatcaaagtg

SEQ ID NO: 950934 - DNA, 25 bp, Mus musculus
ggcctttactttcatcatcaaagtg

SEQ ID NO: 950935 - DNA, 25 bp, Mus musculus
ggcctttcagacccctatgtgaaga

SEQ ID NO: 950936 - DNA, 25 bp, Mus musculus
ggcctttcagagacgaagagagtat

SEQ ID NO: 950937 - DNA, 25 bp, Mus musculus
ggcctttcagagcttcctggacgag

SEQ ID NO: 950938 - DNA, 25 bp, Mus musculus
ggcctttcagtcccctatgtgaaga

SEQ ID NO: 950939 - DNA, 25 bp, Mus musculus
ggcctttcagtgacgaagagagtat

SEQ ID NO: 950940 - DNA, 25 bp, Mus musculus
ggcctttcagtgcttcctggacgag

SEQ ID NO: 950941 - DNA, 25 bp, Mus musculus
ggcctttctgagcaactggtgttca

SEQ ID NO: 950942 - DNA, 25 bp, Mus musculus
ggcctttctgaggaactggtgttca

SEQ ID NO: 950943 - DNA, 25 bp, Mus musculus
ggccttttccagatggatgtccctg

SEQ ID NO: 950944 - DNA, 25 bp, Mus musculus
ggccttttccagttggatgtccctg

SEQ ID NO: 950945 - DNA, 25 bp, Mus musculus
ggccttttgaaggtcaattcttcaa

SEQ ID NO: 950946 - DNA, 25 bp, Mus musculus
ggccttttgaaggtgaattcttcaa

SEQ ID NO: 950947 - DNA, 25 bp, Mus musculus
ggcgaaagcgattggagcgcagtgc

SEQ ID NO: 950948 - DNA, 25 bp, Mus musculus
ggcgaaagcgtttggagcgcagtgc

SEQ ID NO: 950949 - DNA, 25 bp, Mus musculus
ggcgaaagttctaactgtctcctgt

SEQ ID NO: 950950 - DNA, 25 bp, Mus musculus
ggcgaaagttctaagtgtctcctgt

SEQ ID NO: 950951 - DNA, 25 bp, Mus musculus
ggcgaaccagctgatcaggtgtaag

SEQ ID NO: 950952 - DNA, 25 bp, Mus musculus
ggcgaaccaggtgatcaggtgtaag

SEQ ID NO: 950953 - DNA, 25 bp, Mus musculus
ggcgaatggtttttcgtctcagtgt

SEQ ID NO: 950954 - DNA, 25 bp, Mus musculus
ggcgaatggtttttggtctcagtgt

SEQ ID NO: 950955 - DNA, 25 bp, Mus musculus
ggcgacacattgcgagaggtgtgcg

SEQ ID NO: 950956 - DNA, 25 bp, Mus musculus
ggcgacacattgggagaggtgtgcg

SEQ ID NO: 950957 - DNA, 25 bp, Mus musculus
ggcgacagaacgcacatgtgaactt

SEQ ID NO: 950958 - DNA, 25 bp, Mus musculus
ggcgacagaacgcagatgtgaactt

SEQ ID NO: 950959 - DNA, 25 bp, Mus musculus
ggcgacagcaggaacacaggaagat

SEQ ID NO: 950960 - DNA, 25 bp, Mus musculus
ggcgacagcaggaacgaaagaaagg

SEQ ID NO: 950961 - DNA, 25 bp, Mus musculus
ggcgacagcaggaagacaggaagat

SEQ ID NO: 950962 - DNA, 25 bp, Mus musculus
ggcgacagcaggaaggaaagaaagg

SEQ ID NO: 950963 - DNA, 25 bp, Mus musculus
ggcgacagtgggcaaggctctggag

SEQ ID NO: 950964 - DNA, 25 bp, Mus musculus
ggcgacagtgggcatggctctggag

SEQ ID NO: 950965 - DNA, 25 bp, Mus musculus
ggcgaccgcaggagggcaggtgtgc

SEQ ID NO: 950966 - DNA, 25 bp, Mus musculus
ggcgaccgcaggtgggcaggtgtgc

SEQ ID NO: 950967 - DNA, 25 bp, Mus musculus
ggcgacctgtgcaacctcgcatccc

SEQ ID NO: 950968 - DNA, 25 bp, Mus musculus
ggcgacctgtgctacctcgcatccc

SEQ ID NO: 950969 - DNA, 25 bp, Mus musculus
ggcgaccttcagcgaaaatgccaag

SEQ ID NO: 950970 - DNA, 25 bp, Mus musculus
ggcgaccttcagggaaaatgccaag

SEQ ID NO: 950971 - DNA, 25 bp, Mus musculus
ggcgacggcgctatggtggattgtc

SEQ ID NO: 950972 - DNA, 25 bp, Mus musculus
ggcgacggcgctttggtggattgtc

SEQ ID NO: 950973 - DNA, 25 bp, Mus musculus
ggcgactcagccaccatgagccagg

SEQ ID NO: 950974 - DNA, 25 bp, Mus musculus
ggcgactcaggcaccatgagccagg

SEQ ID NO: 950975 - DNA, 25 bp, Mus musculus
ggcgactggccgccagaagcctcag

SEQ ID NO: 950976 - DNA, 25 bp, Mus musculus
ggcgactggccggcagaagcctcag

SEQ ID NO: 950977 - DNA, 25 bp, Mus musculus
ggcgagaaagatgagacggagtacg

SEQ ID NO: 950978 - DNA, 25 bp, Mus musculus
ggcgagaaagttgagacggagtacg

SEQ ID NO: 950979 - DNA, 25 bp, Mus musculus
ggcgagacccaaatcttggtgggct

SEQ ID NO: 950980 - DNA, 25 bp, Mus musculus
ggcgagacccaattcttggtgggct

SEQ ID NO: 950981 - DNA, 25 bp, Mus musculus
ggcgagacctctatggcctctctgt

SEQ ID NO: 950982 - DNA, 25 bp, Mus musculus
ggcgagacctctttggcctctctgt

SEQ ID NO: 950983 - DNA, 25 bp, Mus musculus
ggcgagagcaatgactgggaagtgg

SEQ ID NO: 950984 - DNA, 25 bp, Mus musculus
ggcgagagcaatgagtgggaagtgg

SEQ ID NO: 950985 - DNA, 25 bp, Mus musculus
ggcgagccccaacggcagccacaag

SEQ ID NO: 950986 - DNA, 25 bp, Mus musculus
ggcgagccccaagggcagccacaag

SEQ ID NO: 950987 - DNA, 25 bp, Mus musculus
ggcgagcccctccgtcttcaaagct

SEQ ID NO: 950988 - DNA, 25 bp, Mus musculus
ggcgagcccctcggtcttcaaagct

SEQ ID NO: 950989 - DNA, 25 bp, Mus musculus
ggcgagcggcatgacggtcgagagg

SEQ ID NO: 950990 - DNA, 25 bp, Mus musculus
ggcgagcggcatgagggtcgagagg

SEQ ID NO: 950991 - DNA, 25 bp, Mus musculus
ggcgaggccgatactccatgtttcc

SEQ ID NO: 950992 - DNA, 25 bp, Mus musculus
ggcgaggccgttactccatgtttcc

SEQ ID NO: 950993 - DNA, 25 bp, Mus musculus
ggcgagggtgagctgtgtgtgaaag

SEQ ID NO: 950994 - DNA, 25 bp, Mus musculus
ggcgagggtgaggtgtgtgtgaaag

SEQ ID NO: 950995 - DNA, 25 bp, Mus musculus
ggcgagtagcagcaataaacacgtt

SEQ ID NO: 950996 - DNA, 25 bp, Mus musculus
ggcgagtagcaggaataaacacgtt

SEQ ID NO: 950997 - DNA, 25 bp, Mus musculus
ggcgagttacagcagggaatcttga

SEQ ID NO: 950998 - DNA, 25 bp, Mus musculus
ggcgagttacaggagggaatcttga

SEQ ID NO: 950999 - DNA, 25 bp, Mus musculus
ggcgagtttgagaacgtatgcagca

SEQ ID NO: 951000 - DNA, 25 bp, Mus musculus
ggcgagtttgagaaggtatgcagca

SEQ ID NO: 951001 - DNA, 25 bp, Mus musculus
ggcgataaagggtcagaaaacgctt

SEQ ID NO: 951002 - DNA, 25 bp, Mus musculus
ggcgataaagggtctgaaaacgctt

SEQ ID NO: 951003 - DNA, 25 bp, Mus musculus
ggcgataaccggctctggtacatgg

SEQ ID NO: 951004 - DNA, 25 bp, Mus musculus
ggcgataaccgggtctggtacatgg

SEQ ID NO: 951005 - DNA, 25 bp, Mus musculus
ggcgatgtcaaacctgacaacgtgc

SEQ ID NO: 951006 - DNA, 25 bp, Mus musculus
ggcgatgtcaaagctgacaacgtgc

SEQ ID NO: 951007 - DNA, 25 bp, Mus musculus
ggcgattagacgtctgacatggctc

SEQ ID NO: 951008 - DNA, 25 bp, Mus musculus
ggcgattagactctgccttcagggt

SEQ ID NO: 951009 - DNA, 25 bp, Mus musculus
ggcgattagaggtctgacatggctc

SEQ ID NO: 951010 - DNA, 25 bp, Mus musculus
ggcgattagagtctgccttcagggt

SEQ ID NO: 951011 - DNA, 25 bp, Mus musculus
ggcgattctgagccactcctccaca

SEQ ID NO: 951012 - DNA, 25 bp, Mus musculus
ggcgattctgaggcactcctccaca

SEQ ID NO: 951013 - DNA, 25 bp, Mus musculus
ggcgcaagcaaacaaacatgctctg

SEQ ID NO: 951014 - DNA, 25 bp, Mus musculus
ggcgcaagcaaagaaacatgctctg

SEQ ID NO: 951015 - DNA, 25 bp, Mus musculus
ggcgcacaggctcacccgtggaagc

SEQ ID NO: 951016 - DNA, 25 bp, Mus musculus
ggcgcacaggctcagccgtggaagc

SEQ ID NO: 951017 - DNA, 25 bp, Mus musculus
ggcgcagaagcatcgccacgactcg

SEQ ID NO: 951018 - DNA, 25 bp, Mus musculus
ggcgcagaaggatcgccacgactcg

SEQ ID NO: 951019 - DNA, 25 bp, Mus musculus
ggcgcagaggcacataaaggagagt

SEQ ID NO: 951020 - DNA, 25 bp, Mus musculus
ggcgcagaggcagataaaggagagt

SEQ ID NO: 951021 - DNA, 25 bp, Mus musculus
ggcgcaggagctagtatgttcaaca

SEQ ID NO: 951022 - DNA, 25 bp, Mus musculus
ggcgcaggaggtagtatgttcaaca

SEQ ID NO: 951023 - DNA, 25 bp, Mus musculus
ggcgcagtcctcctttgaagacagc

SEQ ID NO: 951024 - DNA, 25 bp, Mus musculus
ggcgcagtcctcgtttgaagacagc

SEQ ID NO: 951025 - DNA, 25 bp, Mus musculus
ggcgcatctgccaaacgatgacggt

SEQ ID NO: 951026 - DNA, 25 bp, Mus musculus
ggcgcatctgcctaacgatgacggt

SEQ ID NO: 951027 - DNA, 25 bp, Mus musculus
ggcgccaaggatattgcgtccgacc

SEQ ID NO: 951028 - DNA, 25 bp, Mus musculus
ggcgccaaggattttgcgtccgacc

SEQ ID NO: 951029 - DNA, 25 bp, Mus musculus
ggcgccagaaagattgttctctggg

SEQ ID NO: 951030 - DNA, 25 bp, Mus musculus
ggcgccagaaagtttgttctctggg

SEQ ID NO: 951031 - DNA, 25 bp, Mus musculus
ggcgccagggcaaggaggtcagacc

SEQ ID NO: 951032 - DNA, 25 bp, Mus musculus
ggcgccagggcatggaggtcagacc

SEQ ID NO: 951033 - DNA, 25 bp, Mus musculus
ggcgccattgctcctgtgatggcct

SEQ ID NO: 951034 - DNA, 25 bp, Mus musculus
ggcgccattgctgctgtgatggcct

SEQ ID NO: 951035 - DNA, 25 bp, Mus musculus
ggcgcccatgcacatggcctctgca

SEQ ID NO: 951036 - DNA, 25 bp, Mus musculus
ggcgcccatgcagatggcctctgca

SEQ ID NO: 951037 - DNA, 25 bp, Mus musculus
ggcgccccacagcttgaggaggcac

SEQ ID NO: 951038 - DNA, 25 bp, Mus musculus
ggcgccccactgcttgaggaggcac

SEQ ID NO: 951039 - DNA, 25 bp, Mus musculus
ggcgccctgcataacgggtgtgtct

SEQ ID NO: 951040 - DNA, 25 bp, Mus musculus
ggcgccctgcataaggggtgtgtct

SEQ ID NO: 951041 - DNA, 25 bp, Mus musculus
ggcgccgatcagcttaaagatcgag

SEQ ID NO: 951042 - DNA, 25 bp, Mus musculus
ggcgccgatcaggttaaagatcgag

SEQ ID NO: 951043 - DNA, 25 bp, Mus musculus
ggcgcctactcacggctaacatcag

SEQ ID NO: 951044 - DNA, 25 bp, Mus musculus
ggcgcctactcagggctaacatcag

SEQ ID NO: 951045 - DNA, 25 bp, Mus musculus
ggcgcctcctcacggccgcaagctt

SEQ ID NO: 951046 - DNA, 25 bp, Mus musculus
ggcgcctcctcagggccgcaagctt

SEQ ID NO: 951047 - DNA, 25 bp, Mus musculus
ggcgcgcctcagagactgagcggct

SEQ ID NO: 951048 - DNA, 25 bp, Mus musculus
ggcgcgcctcagtgactgagcggct

SEQ ID NO: 951049 - DNA, 25 bp, Mus musculus
ggcgcgcgagaacctcgcgctgtat

SEQ ID NO: 951050 - DNA, 25 bp, Mus musculus
ggcgcgcgagaagctcgcgctgtat

SEQ ID NO: 951051 - DNA, 25 bp, Mus musculus
ggcgcgcgcgcagacctggtgagcc

SEQ ID NO: 951052 - DNA, 25 bp, Mus musculus
ggcgcgcgcggagacctggtgagcc

SEQ ID NO: 951053 - DNA, 25 bp, Mus musculus
ggcgcgcggacccacagtgcttggg

SEQ ID NO: 951054 - DNA, 25 bp, Mus musculus
ggcgcgcggacccagagtgcttggg

SEQ ID NO: 951055 - DNA, 25 bp, Mus musculus
ggcgcggcggcagccgctcccgttc

SEQ ID NO: 951056 - DNA, 25 bp, Mus musculus
ggcgcggcgggagccgctcccgttc

SEQ ID NO: 951057 - DNA, 25 bp, Mus musculus
ggcgcgggagacaccaggcttggcc

SEQ ID NO: 951058 - DNA, 25 bp, Mus musculus
ggcgcgggagctgctggagagtcag

SEQ ID NO: 951059 - DNA, 25 bp, Mus musculus
ggcgcgggaggtgctggagagtcag

SEQ ID NO: 951060 - DNA, 25 bp, Mus musculus
ggcgcgggagtcaccaggcttggcc

SEQ ID NO: 951061 - DNA, 25 bp, Mus musculus
ggcgcgggcagccgtaaaatgtcgg

SEQ ID NO: 951062 - DNA, 25 bp, Mus musculus
ggcgcgggcagcggtaaaatgtcgg

SEQ ID NO: 951063 - DNA, 25 bp, Mus musculus
ggcgcgggtagccaccgagcacctg

SEQ ID NO: 951064 - DNA, 25 bp, Mus musculus
ggcgcgggtagccagcgagcacctg

SEQ ID NO: 951065 - DNA, 25 bp, Mus musculus
ggcgcggtagcggtcaacgctgttg

SEQ ID NO: 951066 - DNA, 25 bp, Mus musculus
ggcgcggtagcggtcccttctctcc

SEQ ID NO: 951067 - DNA, 25 bp, Mus musculus
ggcgcggtagcggtcggtgtcaccg

SEQ ID NO: 951068 - DNA, 25 bp, Mus musculus
ggcgcggtagcggtctatgtgggat

SEQ ID NO: 951069 - DNA, 25 bp, Mus musculus
ggcgcggtagcggtgaacgctgttg

SEQ ID NO: 951070 - DNA, 25 bp, Mus musculus
ggcgcggtagcggtgccttctctcc

SEQ ID NO: 951071 - DNA, 25 bp, Mus musculus
ggcgcggtagcggtgggtgtcaccg

SEQ ID NO: 951072 - DNA, 25 bp, Mus musculus
ggcgcggtagcggtgtatgtgggat

SEQ ID NO: 951073 - DNA, 25 bp, Mus musculus
ggcgcggtcaagaaaggctctggag

SEQ ID NO: 951074 - DNA, 25 bp, Mus musculus
ggcgcggtcaagcatcatctgcttc

SEQ ID NO: 951075 - DNA, 25 bp, Mus musculus
ggcgcggtcaaggatcatctgcttc

SEQ ID NO: 951076 - DNA, 25 bp, Mus musculus
ggcgcggtcaagtaaggctctggag

SEQ ID NO: 951077 - DNA, 25 bp, Mus musculus
ggcgcgtgagacgcagaggcagggc

SEQ ID NO: 951078 - DNA, 25 bp, Mus musculus
ggcgcgtgagatgcccggaaccgac

SEQ ID NO: 951079 - DNA, 25 bp, Mus musculus
ggcgcgtgagtcgcagaggcagggc

SEQ ID NO: 951080 - DNA, 25 bp, Mus musculus
ggcgcgtgagttgcccggaaccgac

SEQ ID NO: 951081 - DNA, 25 bp, Mus musculus
ggcgcgtgcgattgagctgctgaaa

SEQ ID NO: 951082 - DNA, 25 bp, Mus musculus
ggcgcgtgcgtttgagctgctgaaa

SEQ ID NO: 951083 - DNA, 25 bp, Mus musculus
ggcgctaccttgcagcttcagtccc

SEQ ID NO: 951084 - DNA, 25 bp, Mus musculus
ggcgctaccttggagcttcagtccc

SEQ ID NO: 951085 - DNA, 25 bp, Mus musculus
ggcgctcaccctcattgactcgtgg

SEQ ID NO: 951086 - DNA, 25 bp, Mus musculus
ggcgctcaccctccgactactgtga

SEQ ID NO: 951087 - DNA, 25 bp, Mus musculus
ggcgctcaccctgattgactcgtgg

SEQ ID NO: 951088 - DNA, 25 bp, Mus musculus
ggcgctcaccctgcgactactgtga

SEQ ID NO: 951089 - DNA, 25 bp, Mus musculus
ggcgctccccgacgtgtgaatgagg

SEQ ID NO: 951090 - DNA, 25 bp, Mus musculus
ggcgctccccgaggtgtgaatgagg

SEQ ID NO: 951091 - DNA, 25 bp, Mus musculus
ggcgctccgccgattcctttgtgat

SEQ ID NO: 951092 - DNA, 25 bp, Mus musculus
ggcgctccgccgctgagcacgagcc

SEQ ID NO: 951093 - DNA, 25 bp, Mus musculus
ggcgctccgccggtgagcacgagcc

SEQ ID NO: 951094 - DNA, 25 bp, Mus musculus
ggcgctccgccgtttcctttgtgat

SEQ ID NO: 951095 - DNA, 25 bp, Mus musculus
ggcgctctctgacgaaatcaagaaa

SEQ ID NO: 951096 - DNA, 25 bp, Mus musculus
ggcgctctctgaggaaatcaagaaa

SEQ ID NO: 951097 - DNA, 25 bp, Mus musculus
ggcgctgccgcgagcagtatggcgt

SEQ ID NO: 951098 - DNA, 25 bp, Mus musculus
ggcgctgccgcgaggagtatggcgt

SEQ ID NO: 951099 - DNA, 25 bp, Mus musculus
ggcgctgtacgacgctccagcatac

SEQ ID NO: 951100 - DNA, 25 bp, Mus musculus
ggcgctgtacgaggctccagcatac

SEQ ID NO: 951101 - DNA, 25 bp, Mus musculus
ggcgctgtccagcgtcttcaaagct

SEQ ID NO: 951102 - DNA, 25 bp, Mus musculus
ggcgctgtccagggtcttcaaagct

SEQ ID NO: 951103 - DNA, 25 bp, Mus musculus
ggcgcttcctgtccctacagagact

SEQ ID NO: 951104 - DNA, 25 bp, Mus musculus
ggcgcttcctgtccgtacagagact

SEQ ID NO: 951105 - DNA, 25 bp, Mus musculus
ggcgcttggagaatggcagcagcag

SEQ ID NO: 951106 - DNA, 25 bp, Mus musculus
ggcgcttggagattggcagcagcag

SEQ ID NO: 951107 - DNA, 25 bp, Mus musculus
ggcgctttggcagccgatctccatc

SEQ ID NO: 951108 - DNA, 25 bp, Mus musculus
ggcgctttggcagcggatctccatc

SEQ ID NO: 951109 - DNA, 25 bp, Mus musculus
ggcggaaacctgctgctgatctttc

SEQ ID NO: 951110 - DNA, 25 bp, Mus musculus
ggcggaaacctggtgctgatctttc

SEQ ID NO: 951111 - DNA, 25 bp, Mus musculus
ggcggaacagctaattgctggcttt

SEQ ID NO: 951112 - DNA, 25 bp, Mus musculus
ggcggaacaggtaattgctggcttt

SEQ ID NO: 951113 - DNA, 25 bp, Mus musculus
ggcggaagcagagaaggcccagctg

SEQ ID NO: 951114 - DNA, 25 bp, Mus musculus
ggcggaagcagagatggcccagctg

SEQ ID NO: 951115 - DNA, 25 bp, Mus musculus
ggcggaagcggacaggtcatctcag

SEQ ID NO: 951116 - DNA, 25 bp, Mus musculus
ggcggaagcggagaggtcatctcag

SEQ ID NO: 951117 - DNA, 25 bp, Mus musculus
ggcggaatttccccatccgaggatg

SEQ ID NO: 951118 - DNA, 25 bp, Mus musculus
ggcggaatttccgcatccgaggatg

SEQ ID NO: 951119 - DNA, 25 bp, Mus musculus
ggcggacgcgctccgaggatctgga

SEQ ID NO: 951120 - DNA, 25 bp, Mus musculus
ggcggacgcgctgcgaggatctgga

SEQ ID NO: 951121 - DNA, 25 bp, Mus musculus
ggcggacttcagctgactcggactc

SEQ ID NO: 951122 - DNA, 25 bp, Mus musculus
ggcggacttcagctgattcacaaga

SEQ ID NO: 951123 - DNA, 25 bp, Mus musculus
ggcggacttcaggtgactcggactc

SEQ ID NO: 951124 - DNA, 25 bp, Mus musculus
ggcggacttcaggtgattcacaaga

SEQ ID NO: 951125 - DNA, 25 bp, Mus musculus
ggcggagaagaactctcaaaaagaa

SEQ ID NO: 951126 - DNA, 25 bp, Mus musculus
ggcggagaagctgacgacaagatct

SEQ ID NO: 951127 - DNA, 25 bp, Mus musculus
ggcggagaagctgaggacaagatct

SEQ ID NO: 951128 - DNA, 25 bp, Mus musculus
ggcggagaagctgtggtgaccctgg

SEQ ID NO: 951129 - DNA, 25 bp, Mus musculus
ggcggagaaggtgtggtgaccctgg

SEQ ID NO: 951130 - DNA, 25 bp, Mus musculus
ggcggagaagtactctcaaaaagaa

SEQ ID NO: 951131 - DNA, 25 bp, Mus musculus
ggcggagatggcccagtttgagcaa

SEQ ID NO: 951132 - DNA, 25 bp, Mus musculus
ggcggagatggccctgtttgagcaa

SEQ ID NO: 951133 - DNA, 25 bp, Mus musculus
ggcggagcagaaatagatgaagacc

SEQ ID NO: 951134 - DNA, 25 bp, Mus musculus
ggcggagcagattcggaggcgccgc

SEQ ID NO: 951135 - DNA, 25 bp, Mus musculus
ggcggagcagtaatagatgaagacc

SEQ ID NO: 951136 - DNA, 25 bp, Mus musculus
ggcggagcagtttcggaggcgccgc

SEQ ID NO: 951137 - DNA, 25 bp, Mus musculus
ggcggaggagggcaccagaaccaga

SEQ ID NO: 951138 - DNA, 25 bp, Mus musculus
ggcggaggagggcacgaatcccagc

SEQ ID NO: 951139 - DNA, 25 bp, Mus musculus
ggcggaggagggcagcagaaccaga

SEQ ID NO: 951140 - DNA, 25 bp, Mus musculus
ggcggaggagggcaggaatcccagc

SEQ ID NO: 951141 - DNA, 25 bp, Mus musculus
ggcggaggccgcctgtaatgttcaa

SEQ ID NO: 951142 - DNA, 25 bp, Mus musculus
ggcggaggccgcgtgtaatgttcaa

SEQ ID NO: 951143 - DNA, 25 bp, Mus musculus
ggcggaggcctgctcatgctcctgc

SEQ ID NO: 951144 - DNA, 25 bp, Mus musculus
ggcggaggcctgctgatgctcctgc

SEQ ID NO: 951145 - DNA, 25 bp, Mus musculus
ggcggaggtgcacgtgaagttgacc

SEQ ID NO: 951146 - DNA, 25 bp, Mus musculus
ggcggaggtgcaggtgaagttgacc

SEQ ID NO: 951147 - DNA, 25 bp, Mus musculus
ggcggagtggagctgtgaaattgag

SEQ ID NO: 951148 - DNA, 25 bp, Mus musculus
ggcggagtggaggtgtgaaattgag

SEQ ID NO: 951149 - DNA, 25 bp, Mus musculus
ggcggatggaccaacgggtaggtct

SEQ ID NO: 951150 - DNA, 25 bp, Mus musculus
ggcggatggaccaaggggtaggtct

SEQ ID NO: 951151 - DNA, 25 bp, Mus musculus
ggcggcaaagcaatggacattctcc

SEQ ID NO: 951152 - DNA, 25 bp, Mus musculus
ggcggcaaagcattggacattctcc

SEQ ID NO: 951153 - DNA, 25 bp, Mus musculus
ggcggcacagcttgctgcaggaatg

SEQ ID NO: 951154 - DNA, 25 bp, Mus musculus
ggcggcacaggttgctgcaggaatg

SEQ ID NO: 951155 - DNA, 25 bp, Mus musculus
ggcggcatctctcgggcccacatga

SEQ ID NO: 951156 - DNA, 25 bp, Mus musculus
ggcggcatctctggggcccacatga

SEQ ID NO: 951157 - DNA, 25 bp, Mus musculus
ggcggccagcagatcgtgtccagcc

SEQ ID NO: 951158 - DNA, 25 bp, Mus musculus
ggcggccagcagctactcctgagca

SEQ ID NO: 951159 - DNA, 25 bp, Mus musculus
ggcggccagcaggtactcctgagca

SEQ ID NO: 951160 - DNA, 25 bp, Mus musculus
ggcggccagcagttcgtgtccagcc

SEQ ID NO: 951161 - DNA, 25 bp, Mus musculus
ggcggcccagcgcggcaccttgcta

SEQ ID NO: 951162 - DNA, 25 bp, Mus musculus
ggcggcccagggcggcaccttgcta

SEQ ID NO: 951163 - DNA, 25 bp, Mus musculus
ggcggccgaccacatgtgaggtgag

SEQ ID NO: 951164 - DNA, 25 bp, Mus musculus
ggcggccgaccagatgtgaggtgag

SEQ ID NO: 951165 - DNA, 25 bp, Mus musculus
ggcggccggccgaacgatcatctgt

SEQ ID NO: 951166 - DNA, 25 bp, Mus musculus
ggcggccggccgaacgttcttgatt

SEQ ID NO: 951167 - DNA, 25 bp, Mus musculus
ggcggccggccgaaggatcatctgt

SEQ ID NO: 951168 - DNA, 25 bp, Mus musculus
ggcggccggccgaaggttcttgatt

SEQ ID NO: 951169 - DNA, 25 bp, Mus musculus
ggcggcgactggcccgcagaagcct

SEQ ID NO: 951170 - DNA, 25 bp, Mus musculus
ggcggcgactggccggcagaagcct

SEQ ID NO: 951171 - DNA, 25 bp, Mus musculus
ggcggcgagacccaaatcttggtgg

SEQ ID NO: 951172 - DNA, 25 bp, Mus musculus
ggcggcgagacccatatcttggtgg

SEQ ID NO: 951173 - DNA, 25 bp, Mus musculus
ggcggcgagccccaacggcagccac

SEQ ID NO: 951174 - DNA, 25 bp, Mus musculus
ggcggcgagccccatcggcagccac

SEQ ID NO: 951175 - DNA, 25 bp, Mus musculus
ggcggcgccgctgccaagtgctggt

SEQ ID NO: 951176 - DNA, 25 bp, Mus musculus
ggcggcgccggtgccaagtgctggt

SEQ ID NO: 951177 - DNA, 25 bp, Mus musculus
ggcggcgcgggacgtgctggagagt

SEQ ID NO: 951178 - DNA, 25 bp, Mus musculus
ggcggcgcgggaggtgctggagagt

SEQ ID NO: 951179 - DNA, 25 bp, Mus musculus
ggcggcggagcacaaatagatgaag

SEQ ID NO: 951180 - DNA, 25 bp, Mus musculus
ggcggcggagcacattcggaggcgc

SEQ ID NO: 951181 - DNA, 25 bp, Mus musculus
ggcggcggagcagaaatagatgaag

SEQ ID NO: 951182 - DNA, 25 bp, Mus musculus
ggcggcggagcagattcggaggcgc

SEQ ID NO: 951183 - DNA, 25 bp, Mus musculus
ggcggcgggagcgacggagcggaca

SEQ ID NO: 951184 - DNA, 25 bp, Mus musculus
ggcggcgggagcgagggagcggaca

SEQ ID NO: 951185 - DNA, 25 bp, Mus musculus
ggcggcggggagcacttgcactaag

SEQ ID NO: 951186 - DNA, 25 bp, Mus musculus
ggcggcggggaggacttgcactaag

SEQ ID NO: 951187 - DNA, 25 bp, Mus musculus
ggcggctacttcaacgcacatatta

SEQ ID NO: 951188 - DNA, 25 bp, Mus musculus
ggcggctacttcaaggcacatatta

SEQ ID NO: 951189 - DNA, 25 bp, Mus musculus
ggcggctcaccgcgtcgattctggc

SEQ ID NO: 951190 - DNA, 25 bp, Mus musculus
ggcggctcaccgggtcgattctggc

SEQ ID NO: 951191 - DNA, 25 bp, Mus musculus
ggcggctcagctgttatagactgca

SEQ ID NO: 951192 - DNA, 25 bp, Mus musculus
ggcggctcagctttctcccatttcc

SEQ ID NO: 951193 - DNA, 25 bp, Mus musculus
ggcggctcaggtgttatagactgca

SEQ ID NO: 951194 - DNA, 25 bp, Mus musculus
ggcggctcaggtttctcccatttcc

SEQ ID NO: 951195 - DNA, 25 bp, Mus musculus
ggcgggacccgacatccacgtgtcg

SEQ ID NO: 951196 - DNA, 25 bp, Mus musculus
ggcgggacccgacatcccactgaga

SEQ ID NO: 951197 - DNA, 25 bp, Mus musculus
ggcgggacccgaccagatcccactg

SEQ ID NO: 951198 - DNA, 25 bp, Mus musculus
ggcgggacccgacctgtgtctcttc

SEQ ID NO: 951199 - DNA, 25 bp, Mus musculus
ggcgggacccgagatccacgtgtcg

SEQ ID NO: 951200 - DNA, 25 bp, Mus musculus
ggcgggacccgagatcccactgaga

SEQ ID NO: 951201 - DNA, 25 bp, Mus musculus
ggcgggacccgagcagatcccactg

SEQ ID NO: 951202 - DNA, 25 bp, Mus musculus
ggcgggacccgagctgtgtctcttc

SEQ ID NO: 951203 - DNA, 25 bp, Mus musculus
ggcgggagcgagcgagcggacatgg

SEQ ID NO: 951204 - DNA, 25 bp, Mus musculus
ggcgggagcgagggagcggacatgg

SEQ ID NO: 951205 - DNA, 25 bp, Mus musculus
ggcgggatagctctggagcctggct

SEQ ID NO: 951206 - DNA, 25 bp, Mus musculus
ggcgggataggtctggagcctggct

SEQ ID NO: 951207 - DNA, 25 bp, Mus musculus
ggcgggccggactatgcaagctgcg

SEQ ID NO: 951208 - DNA, 25 bp, Mus musculus
ggcgggccggctttctgttgatgcc

SEQ ID NO: 951209 - DNA, 25 bp, Mus musculus
ggcgggccgggtttctgttgatgcc

SEQ ID NO: 951210 - DNA, 25 bp, Mus musculus
ggcgggccggtctatgcaagctgcg

SEQ ID NO: 951211 - DNA, 25 bp, Mus musculus
ggcgggcctgggaacggccccagtg

SEQ ID NO: 951212 - DNA, 25 bp, Mus musculus
ggcgggcctgggaagggccccagtg

SEQ ID NO: 951213 - DNA, 25 bp, Mus musculus
ggcgggcgagcacagcagacccagg

SEQ ID NO: 951214 - DNA, 25 bp, Mus musculus
ggcgggcgagcacagcctctggatg

SEQ ID NO: 951215 - DNA, 25 bp, Mus musculus
ggcgggcgagcaccctctggatgga

SEQ ID NO: 951216 - DNA, 25 bp, Mus musculus
ggcgggcgagcacgtggaagggact

SEQ ID NO: 951217 - DNA, 25 bp, Mus musculus
ggcgggcgagcagagcagacccagg

SEQ ID NO: 951218 - DNA, 25 bp, Mus musculus
ggcgggcgagcagagcctctggatg

SEQ ID NO: 951219 - DNA, 25 bp, Mus musculus
ggcgggcgagcagcctctggatgga

SEQ ID NO: 951220 - DNA, 25 bp, Mus musculus
ggcgggcgagcaggtggaagggact

SEQ ID NO: 951221 - DNA, 25 bp, Mus musculus
ggcgggcgctagctccgtctcccag

SEQ ID NO: 951222 - DNA, 25 bp, Mus musculus
ggcgggcgctaggtccgtctcccag

SEQ ID NO: 951223 - DNA, 25 bp, Mus musculus
ggcggggcgaggcccatactccatg

SEQ ID NO: 951224 - DNA, 25 bp, Mus musculus
ggcggggcgaggccgatactccatg

SEQ ID NO: 951225 - DNA, 25 bp, Mus musculus
ggcggggcgcagctgggcaccacaa

SEQ ID NO: 951226 - DNA, 25 bp, Mus musculus
ggcggggcgcaggtgggcaccacaa

SEQ ID NO: 951227 - DNA, 25 bp, Mus musculus
ggcgggtaggagccaagctgcagca

SEQ ID NO: 951228 - DNA, 25 bp, Mus musculus
ggcgggtaggaggcaagctgcagca

SEQ ID NO: 951229 - DNA, 25 bp, Mus musculus
ggcgggtcctgccttcttggcccag

SEQ ID NO: 951230 - DNA, 25 bp, Mus musculus
ggcgggtcctgcgttcttggcccag

SEQ ID NO: 951231 - DNA, 25 bp, Mus musculus
ggcgggtggatgcggaatctgtctg

SEQ ID NO: 951232 - DNA, 25 bp, Mus musculus
ggcgggtggatggggaatctgtctg

SEQ ID NO: 951233 - DNA, 25 bp, Mus musculus
ggcggtaggaagtgcagatatagat

SEQ ID NO: 951234 - DNA, 25 bp, Mus musculus
ggcggtaggaagtggagatatagat

SEQ ID NO: 951235 - DNA, 25 bp, Mus musculus
ggcggtgatgaacacaatagatgac

SEQ ID NO: 951236 - DNA, 25 bp, Mus musculus
ggcggtgatgaagacaatagatgac

SEQ ID NO: 951237 - DNA, 25 bp, Mus musculus
ggcggtgcagatcactgagaccttt

SEQ ID NO: 951238 - DNA, 25 bp, Mus musculus
ggcggtgcagttcactgagaccttt

SEQ ID NO: 951239 - DNA, 25 bp, Mus musculus
ggcggtggtagtcgtggctatggcg

SEQ ID NO: 951240 - DNA, 25 bp, Mus musculus
ggcggtggtagtggtggctatggcg

SEQ ID NO: 951241 - DNA, 25 bp, Mus musculus
ggcggtttatacccagtgtctgcag

SEQ ID NO: 951242 - DNA, 25 bp, Mus musculus
ggcggtttataccctgtgtctgcag

SEQ ID NO: 951243 - DNA, 25 bp, Mus musculus
ggcgtatttgggatctttcgctatg

SEQ ID NO: 951244 - DNA, 25 bp, Mus musculus
ggcgtatttgggatgtttcgctatg

SEQ ID NO: 951245 - DNA, 25 bp, Mus musculus
ggcgtcatcatgcctgtctccgaga

SEQ ID NO: 951246 - DNA, 25 bp, Mus musculus
ggcgtcatcatggctgtctccgaga

SEQ ID NO: 951247 - DNA, 25 bp, Mus musculus
ggcgtccaagcccatcagctccaga

SEQ ID NO: 951248 - DNA, 25 bp, Mus musculus
ggcgtccaagctcccagcagcaaag

SEQ ID NO: 951249 - DNA, 25 bp, Mus musculus
ggcgtccaaggccatcagctccaga

SEQ ID NO: 951250 - DNA, 25 bp, Mus musculus
ggcgtccaaggtcccagcagcaaag

SEQ ID NO: 951251 - DNA, 25 bp, Mus musculus
ggcgtcgctcactccatcaatgagc

SEQ ID NO: 951252 - DNA, 25 bp, Mus musculus
ggcgtcgctcactcgatcaatgagc

SEQ ID NO: 951253 - DNA, 25 bp, Mus musculus
ggcgtcgtgagagtcgcttggaaac

SEQ ID NO: 951254 - DNA, 25 bp, Mus musculus
ggcgtcgtgagagtggcttggaaac

SEQ ID NO: 951255 - DNA, 25 bp, Mus musculus
ggcgtctgcagacgaatctgggacc

SEQ ID NO: 951256 - DNA, 25 bp, Mus musculus
ggcgtctgcagaggaatctgggacc

SEQ ID NO: 951257 - DNA, 25 bp, Mus musculus
ggcgtctggcaccccaccagcagga

SEQ ID NO: 951258 - DNA, 25 bp, Mus musculus
ggcgtctggcacccgaccagcagga

SEQ ID NO: 951259 - DNA, 25 bp, Mus musculus
ggcgtctggtacctcatcatcaatg

SEQ ID NO: 951260 - DNA, 25 bp, Mus musculus
ggcgtctggtacctgatcatcaatg

SEQ ID NO: 951261 - DNA, 25 bp, Mus musculus
ggcgtcttagatgacgtggtctcca

SEQ ID NO: 951262 - DNA, 25 bp, Mus musculus
ggcgtcttagttgacgtggtctcca

SEQ ID NO: 951263 - DNA, 25 bp, Mus musculus
ggcgtgaggaggagcacgatgtgga

SEQ ID NO: 951264 - DNA, 25 bp, Mus musculus
ggcgtgaggaggaggacgatgtgga

SEQ ID NO: 951265 - DNA, 25 bp, Mus musculus
ggcgtgcctggacaataggtgctcc

SEQ ID NO: 951266 - DNA, 25 bp, Mus musculus
ggcgtgcctggacgtgctcctatgt

SEQ ID NO: 951267 - DNA, 25 bp, Mus musculus
ggcgtgcctggagaataggtgctcc

SEQ ID NO: 951268 - DNA, 25 bp, Mus musculus
ggcgtgcctggaggtgctcctatgt

SEQ ID NO: 951269 - DNA, 25 bp, Mus musculus
ggcgtgcgggaagccgcggcggccc

SEQ ID NO: 951270 - DNA, 25 bp, Mus musculus
ggcgtgcgggaagcggcggcggccc

SEQ ID NO: 951271 - DNA, 25 bp, Mus musculus
ggcgtgcgggtgagaacaacgtggg

SEQ ID NO: 951272 - DNA, 25 bp, Mus musculus
ggcgtgcgggtgtgaacaacgtggg

SEQ ID NO: 951273 - DNA, 25 bp, Mus musculus
ggcgtgctggggagctccaaggtgc

SEQ ID NO: 951274 - DNA, 25 bp, Mus musculus
ggcgtgctggggtgctccaaggtgc

SEQ ID NO: 951275 - DNA, 25 bp, Mus musculus
ggcgtggaagagctcagcagagcac

SEQ ID NO: 951276 - DNA, 25 bp, Mus musculus
ggcgtggaagagctcagggccaaaa

SEQ ID NO: 951277 - DNA, 25 bp, Mus musculus
ggcgtggaagaggtcagcagagcac

SEQ ID NO: 951278 - DNA, 25 bp, Mus musculus
ggcgtggaagaggtcagggccaaaa

SEQ ID NO: 951279 - DNA, 25 bp, Mus musculus
ggcgtggagggcaacgaagggaagc

SEQ ID NO: 951280 - DNA, 25 bp, Mus musculus
ggcgtggagggcaaggaagggaagc

SEQ ID NO: 951281 - DNA, 25 bp, Mus musculus
ggcgtggcaaaacccaaagtgacag

SEQ ID NO: 951282 - DNA, 25 bp, Mus musculus
ggcgtggcaaaaccgaaagtgacag

SEQ ID NO: 951283 - DNA, 25 bp, Mus musculus
ggcgtggtaaatcatgacggtacag

SEQ ID NO: 951284 - DNA, 25 bp, Mus musculus
ggcgtggtaaatgatgacggtacag

SEQ ID NO: 951285 - DNA, 25 bp, Mus musculus
ggcgtggtcccaccgggaggctcgt

SEQ ID NO: 951286 - DNA, 25 bp, Mus musculus
ggcgtggtcccagcgggaggctcgt

SEQ ID NO: 951287 - DNA, 25 bp, Mus musculus
ggcgtgtctggacattcgacttgaa

SEQ ID NO: 951288 - DNA, 25 bp, Mus musculus
ggcgtgtctggagattcgacttgaa

SEQ ID NO: 951289 - DNA, 25 bp, Mus musculus
ggcgttacagccttcagtctagacc

SEQ ID NO: 951290 - DNA, 25 bp, Mus musculus
ggcgttacaggcttcagtctagacc

SEQ ID NO: 951291 - DNA, 25 bp, Mus musculus
ggcgttccagaatgacgtgtatgaa

SEQ ID NO: 951292 - DNA, 25 bp, Mus musculus
ggcgttccagtatgacgtgtatgaa

SEQ ID NO: 951293 - DNA, 25 bp, Mus musculus
ggcgttctgatgacgttacagaagc

SEQ ID NO: 951294 - DNA, 25 bp, Mus musculus
ggcgttctgatgtcgttacagaagc

SEQ ID NO: 951295 - DNA, 25 bp, Mus musculus
ggcgttttagagaacaacgtgggca

SEQ ID NO: 951296 - DNA, 25 bp, Mus musculus
ggcgttttagtgaacaacgtgggca

SEQ ID NO: 951297 - DNA, 25 bp, Mus musculus
ggctaaagagatttgaaagtgacct

SEQ ID NO: 951298 - DNA, 25 bp, Mus musculus
ggctaaagagttttgaaagtgacct

SEQ ID NO: 951299 - DNA, 25 bp, Mus musculus
ggctaaatgatgcacagaacctctc

SEQ ID NO: 951300 - DNA, 25 bp, Mus musculus
ggctaaatgatgcagagaacctctc

SEQ ID NO: 951301 - DNA, 25 bp, Mus musculus
ggctaagggacacatggctatgaac

SEQ ID NO: 951302 - DNA, 25 bp, Mus musculus
ggctaagggacagatggctatgaac

SEQ ID NO: 951303 - DNA, 25 bp, Mus musculus
ggctaatcagcaagcagctagctga

SEQ ID NO: 951304 - DNA, 25 bp, Mus musculus
ggctaatcagcaaggagctagctga

SEQ ID NO: 951305 - DNA, 25 bp, Mus musculus
ggctaatgggaacagtacatctcgg

SEQ ID NO: 951306 - DNA, 25 bp, Mus musculus
ggctaatgggaagagtacatctcgg

SEQ ID NO: 951307 - DNA, 25 bp, Mus musculus
ggctacaaagaacccaagagatgaa

SEQ ID NO: 951308 - DNA, 25 bp, Mus musculus
ggctacaaagtacccaagagatgaa

SEQ ID NO: 951309 - DNA, 25 bp, Mus musculus
ggctacaagagcgaaatgaaattgt

SEQ ID NO: 951310 - DNA, 25 bp, Mus musculus
ggctacaagagcgatatgaaattgt

SEQ ID NO: 951311 - DNA, 25 bp, Mus musculus
ggctacaatgatgtcgccattgggg

SEQ ID NO: 951312 - DNA, 25 bp, Mus musculus
ggctacaatgttgtcgccattgggg

SEQ ID NO: 951313 - DNA, 25 bp, Mus musculus
ggctacacagcaagcatgtgtaacg

SEQ ID NO: 951314 - DNA, 25 bp, Mus musculus
ggctacacaggaagcatgtgtaacg

SEQ ID NO: 951315 - DNA, 25 bp, Mus musculus
ggctacagaggtcggcttactgtaa

SEQ ID NO: 951316 - DNA, 25 bp, Mus musculus
ggctacagaggtctccaacaggcca

SEQ ID NO: 951317 - DNA, 25 bp, Mus musculus
ggctacagaggtgggcttactgtaa

SEQ ID NO: 951318 - DNA, 25 bp, Mus musculus
ggctacagaggtgtccaacaggcca

SEQ ID NO: 951319 - DNA, 25 bp, Mus musculus
ggctacagtctacaaaactgctgct

SEQ ID NO: 951320 - DNA, 25 bp, Mus musculus
ggctacagtctagaaaactgctgct

SEQ ID NO: 951321 - DNA, 25 bp, Mus musculus
ggctacagtgatcacgttcagcgtc

SEQ ID NO: 951322 - DNA, 25 bp, Mus musculus
ggctacagtgatcaggttcagcgtc

SEQ ID NO: 951323 - DNA, 25 bp, Mus musculus
ggctacatcaaacaccaggtgtttg

SEQ ID NO: 951324 - DNA, 25 bp, Mus musculus
ggctacatcaaagaccaggtgtttg

SEQ ID NO: 951325 - DNA, 25 bp, Mus musculus
ggctacatcgatttgttttacaatg

SEQ ID NO: 951326 - DNA, 25 bp, Mus musculus
ggctacatcgttttgttttacaatg

SEQ ID NO: 951327 - DNA, 25 bp, Mus musculus
ggctacatggcgttgacctgtagtg

SEQ ID NO: 951328 - DNA, 25 bp, Mus musculus
ggctacatggggttgacctgtagtg

SEQ ID NO: 951329 - DNA, 25 bp, Mus musculus
ggctaccagaagaatgaagagtcac

SEQ ID NO: 951330 - DNA, 25 bp, Mus musculus
ggctaccagaagtatgaagagtcac

SEQ ID NO: 951331 - DNA, 25 bp, Mus musculus
ggctaccagccacacgagctcttag

SEQ ID NO: 951332 - DNA, 25 bp, Mus musculus
ggctaccagccacaggagctcttag

SEQ ID NO: 951333 - DNA, 25 bp, Mus musculus
ggctacctgcaccacagacggaaaa

SEQ ID NO: 951334 - DNA, 25 bp, Mus musculus
ggctacctgcaccacgattctaatc

SEQ ID NO: 951335 - DNA, 25 bp, Mus musculus
ggctacctgcaccagagacggaaaa

SEQ ID NO: 951336 - DNA, 25 bp, Mus musculus
ggctacctgcaccaggattctaatc

SEQ ID NO: 951337 - DNA, 25 bp, Mus musculus
ggctacgactacagtcagggtagta

SEQ ID NO: 951338 - DNA, 25 bp, Mus musculus
ggctacgactactgtcagggtagta

SEQ ID NO: 951339 - DNA, 25 bp, Mus musculus
ggctacgatgctatcgcactgggaa

SEQ ID NO: 951340 - DNA, 25 bp, Mus musculus
ggctacgatgctatggcactgggaa

SEQ ID NO: 951341 - DNA, 25 bp, Mus musculus
ggctacgcggagaacctcatcgatt

SEQ ID NO: 951342 - DNA, 25 bp, Mus musculus
ggctacgcggagaagctcatcgatt

SEQ ID NO: 951343 - DNA, 25 bp, Mus musculus
ggctacggagcctatggggcatgga

SEQ ID NO: 951344 - DNA, 25 bp, Mus musculus
ggctacggaggctatggggcatgga

SEQ ID NO: 951345 - DNA, 25 bp, Mus musculus
ggctacggcttcctgaccatggcag

SEQ ID NO: 951346 - DNA, 25 bp, Mus musculus
ggctacggcttcgtgaccatggcag

SEQ ID NO: 951347 - DNA, 25 bp, Mus musculus
ggctacgtcactccatggaacagcc

SEQ ID NO: 951348 - DNA, 25 bp, Mus musculus
ggctacgtcactccttggaacagcc

SEQ ID NO: 951349 - DNA, 25 bp, Mus musculus
ggctactacactagcgcccagtttg

SEQ ID NO: 951350 - DNA, 25 bp, Mus musculus
ggctactacactagggcccagtttg

SEQ ID NO: 951351 - DNA, 25 bp, Mus musculus
ggctactgtatgcccggagcacaga

SEQ ID NO: 951352 - DNA, 25 bp, Mus musculus
ggctactgtatgccgggagcacaga

SEQ ID NO: 951353 - DNA, 25 bp, Mus musculus
ggctacttcaagccacatattaagt

SEQ ID NO: 951354 - DNA, 25 bp, Mus musculus
ggctacttcaaggcacatattaagt

SEQ ID NO: 951355 - DNA, 25 bp, Mus musculus
ggctagatcacactcaagcaggtag

SEQ ID NO: 951356 - DNA, 25 bp, Mus musculus
ggctagatcacagtcaagcaggtag

SEQ ID NO: 951357 - DNA, 25 bp, Mus musculus
ggctagcctgctctggaagagtggg

SEQ ID NO: 951358 - DNA, 25 bp, Mus musculus
ggctagcctgctgtggaagagtggg

SEQ ID NO: 951359 - DNA, 25 bp, Mus musculus
ggctagctagttcacgcactggctc

SEQ ID NO: 951360 - DNA, 25 bp, Mus musculus
ggctagctagttcaggcactggctc

SEQ ID NO: 951361 - DNA, 25 bp, Mus musculus
ggctagtggatcatctctatgctat

SEQ ID NO: 951362 - DNA, 25 bp, Mus musculus
ggctagtggatcatgtctatgctat

SEQ ID NO: 951363 - DNA, 25 bp, Mus musculus
ggctataaaaagaagtaccagcagg

SEQ ID NO: 951364 - DNA, 25 bp, Mus musculus
ggctataaaaagtagtaccagcagg

SEQ ID NO: 951365 - DNA, 25 bp, Mus musculus
ggctataacacacgagtcatactac

SEQ ID NO: 951366 - DNA, 25 bp, Mus musculus
ggctataacacaggagtcatactac

SEQ ID NO: 951367 - DNA, 25 bp, Mus musculus
ggctataacgtctgcatactatcgt

SEQ ID NO: 951368 - DNA, 25 bp, Mus musculus
ggctataacgtctggatactatcgt

SEQ ID NO: 951369 - DNA, 25 bp, Mus musculus
ggctatactggtagctttgtatgta

SEQ ID NO: 951370 - DNA, 25 bp, Mus musculus
ggctatactggttgctttgtatgta

SEQ ID NO: 951371 - DNA, 25 bp, Mus musculus
ggctatagaaagcctgaaggcactg

SEQ ID NO: 951372 - DNA, 25 bp, Mus musculus
ggctatagaaagcgcgctttcgttg

SEQ ID NO: 951373 - DNA, 25 bp, Mus musculus
ggctatagaaaggctgaaggcactg

SEQ ID NO: 951374 - DNA, 25 bp, Mus musculus
ggctatagaaagggcgctttcgttg

SEQ ID NO: 951375 - DNA, 25 bp, Mus musculus
ggctatattcagcgctacaacaagg

SEQ ID NO: 951376 - DNA, 25 bp, Mus musculus
ggctatattcagctgacagacttcg

SEQ ID NO: 951377 - DNA, 25 bp, Mus musculus
ggctatattcagggctacaacaagg

SEQ ID NO: 951378 - DNA, 25 bp, Mus musculus
ggctatattcaggtgacagacttcg

SEQ ID NO: 951379 - DNA, 25 bp, Mus musculus
ggctatcaagctcgagcccatcaag

SEQ ID NO: 951380 - DNA, 25 bp, Mus musculus
ggctatcaagctggagcccatcaag

SEQ ID NO: 951381 - DNA, 25 bp, Mus musculus
ggctatcctgagcttgcaggtcagc

SEQ ID NO: 951382 - DNA, 25 bp, Mus musculus
ggctatcctgaggttgcaggtcagc

SEQ ID NO: 951383 - DNA, 25 bp, Mus musculus
ggctatctagagatgttcgttcacg

SEQ ID NO: 951384 - DNA, 25 bp, Mus musculus
ggctatctagagttgttcgttcacg

SEQ ID NO: 951385 - DNA, 25 bp, Mus musculus
ggctatgaaccactgggtgtctggc

SEQ ID NO: 951386 - DNA, 25 bp, Mus musculus
ggctatgaaccagtgggtgtctggc

SEQ ID NO: 951387 - DNA, 25 bp, Mus musculus
ggctatgacacacaggtaggtgaga

SEQ ID NO: 951388 - DNA, 25 bp, Mus musculus
ggctatgacacagaggtaggtgaga

SEQ ID NO: 951389 - DNA, 25 bp, Mus musculus
ggctatgcagatggctatgaacggc

SEQ ID NO: 951390 - DNA, 25 bp, Mus musculus
ggctatgcagttggctatgaacggc

SEQ ID NO: 951391 - DNA, 25 bp, Mus musculus
ggctatgccttcttcgtttgatatc

SEQ ID NO: 951392 - DNA, 25 bp, Mus musculus
ggctatgccttcttggtttgatatc

SEQ ID NO: 951393 - DNA, 25 bp, Mus musculus
ggctatggagacccaacaggagggc

SEQ ID NO: 951394 - DNA, 25 bp, Mus musculus
ggctatggagctggtgctgtccgcc

SEQ ID NO: 951395 - DNA, 25 bp, Mus musculus
ggctatggaggtggtgctgtccgcc

SEQ ID NO: 951396 - DNA, 25 bp, Mus musculus
ggctatggagtcccaacaggagggc

SEQ ID NO: 951397 - DNA, 25 bp, Mus musculus
ggctatggcaagctgttccaggtga

SEQ ID NO: 951398 - DNA, 25 bp, Mus musculus
ggctatggcaaggtgttccaggtga

SEQ ID NO: 951399 - DNA, 25 bp, Mus musculus
ggctatgtctgccactgtgccccag

SEQ ID NO: 951400 - DNA, 25 bp, Mus musculus
ggctatgtctgccagtgtgccccag

SEQ ID NO: 951401 - DNA, 25 bp, Mus musculus
ggctattttaagcgaataatgcagg

SEQ ID NO: 951402 - DNA, 25 bp, Mus musculus
ggctattttaagggaataatgcagg

SEQ ID NO: 951403 - DNA, 25 bp, Mus musculus
ggctcaaaatgtccctctcccagtg

SEQ ID NO: 951404 - DNA, 25 bp, Mus musculus
ggctcaaaatgtgcctctcccagtg

SEQ ID NO: 951405 - DNA, 25 bp, Mus musculus
ggctcaaactaactggcctgcttga

SEQ ID NO: 951406 - DNA, 25 bp, Mus musculus
ggctcaaactaagtggcctgcttga

SEQ ID NO: 951407 - DNA, 25 bp, Mus musculus
ggctcaaattctcacgacagcagcc

SEQ ID NO: 951408 - DNA, 25 bp, Mus musculus
ggctcaaattctcaggacagcagcc

SEQ ID NO: 951409 - DNA, 25 bp, Mus musculus
ggctcacacaagcacctcacccggt

SEQ ID NO: 951410 - DNA, 25 bp, Mus musculus
ggctcacacaaggacctcacccggt

SEQ ID NO: 951411 - DNA, 25 bp, Mus musculus
ggctcacagaagagagctgtgaatt

SEQ ID NO: 951412 - DNA, 25 bp, Mus musculus
ggctcacagaagatgtctccaaaat

SEQ ID NO: 951413 - DNA, 25 bp, Mus musculus
ggctcacagaagcctgttcatttag

SEQ ID NO: 951414 - DNA, 25 bp, Mus musculus
ggctcacagaaggctgttcatttag

SEQ ID NO: 951415 - DNA, 25 bp, Mus musculus
ggctcacagaagtgagctgtgaatt

SEQ ID NO: 951416 - DNA, 25 bp, Mus musculus
ggctcacagatgatgtctccaaaat

SEQ ID NO: 951417 - DNA, 25 bp, Mus musculus
ggctcaccggctcgattctggccgt

SEQ ID NO: 951418 - DNA, 25 bp, Mus musculus
ggctcaccgggtcgattctggccgt

SEQ ID NO: 951419 - DNA, 25 bp, Mus musculus
ggctcacgtcacgacggaccgtgaa

SEQ ID NO: 951420 - DNA, 25 bp, Mus musculus
ggctcacgtcacgagggaccgtgaa

SEQ ID NO: 951421 - DNA, 25 bp, Mus musculus
ggctcacgttccgaccccataagga

SEQ ID NO: 951422 - DNA, 25 bp, Mus musculus
ggctcacgttccgagcccataagga

SEQ ID NO: 951423 - DNA, 25 bp, Mus musculus
ggctcagcaaagccagctgagatgc

SEQ ID NO: 951424 - DNA, 25 bp, Mus musculus
ggctcagcaaaggcagctgagatgc

SEQ ID NO: 951425 - DNA, 25 bp, Mus musculus
ggctcagcagtgcctttgatgacat

SEQ ID NO: 951426 - DNA, 25 bp, Mus musculus
ggctcagcagtggctttgatgacat

SEQ ID NO: 951427 - DNA, 25 bp, Mus musculus
ggctcagcgacacattccggtattc

SEQ ID NO: 951428 - DNA, 25 bp, Mus musculus
ggctcagcgacagattccggtattc

SEQ ID NO: 951429 - DNA, 25 bp, Mus musculus
ggctcagctgctgcagttcgtactc

SEQ ID NO: 951430 - DNA, 25 bp, Mus musculus
ggctcagctggtgcagttcgtactc

SEQ ID NO: 951431 - DNA, 25 bp, Mus musculus
ggctcagtggatgagaccctttttg

SEQ ID NO: 951432 - DNA, 25 bp, Mus musculus
ggctcagtggatgttgacctcctgt

SEQ ID NO: 951433 - DNA, 25 bp, Mus musculus
ggctcagtggttgagaccctttttg

SEQ ID NO: 951434 - DNA, 25 bp, Mus musculus
ggctcagtggttgttgacctcctgt

SEQ ID NO: 951435 - DNA, 25 bp, Mus musculus
ggctcatcagatggcagttctgcaa

SEQ ID NO: 951436 - DNA, 25 bp, Mus musculus
ggctcatcagcaggactgacaaacg

SEQ ID NO: 951437 - DNA, 25 bp, Mus musculus
ggctcatcagctgaaaaatcacatg

SEQ ID NO: 951438 - DNA, 25 bp, Mus musculus
ggctcatcaggaggactgacaaacg

SEQ ID NO: 951439 - DNA, 25 bp, Mus musculus
ggctcatcaggtgaaaaatcacatg

SEQ ID NO: 951440 - DNA, 25 bp, Mus musculus
ggctcatcagttggcagttctgcaa

SEQ ID NO: 951441 - DNA, 25 bp, Mus musculus
ggctcatcctctcaatccaccatat

SEQ ID NO: 951442 - DNA, 25 bp, Mus musculus
ggctcatcctgtcaatccaccatat

SEQ ID NO: 951443 - DNA, 25 bp, Mus musculus
ggctcatggagtctatgctctaaaa

SEQ ID NO: 951444 - DNA, 25 bp, Mus musculus
ggctcatggagtctttgctctaaaa

SEQ ID NO: 951445 - DNA, 25 bp, Mus musculus
ggctccaaagcttctgaagacagcc

SEQ ID NO: 951446 - DNA, 25 bp, Mus musculus
ggctccaaaggttctgaagacagcc

SEQ ID NO: 951447 - DNA, 25 bp, Mus musculus
ggctccaaagtccgtttctgtatgc

SEQ ID NO: 951448 - DNA, 25 bp, Mus musculus
ggctccaaagtcggtttctgtatgc

SEQ ID NO: 951449 - DNA, 25 bp, Mus musculus
ggctccaacgaattgccggctgaag

SEQ ID NO: 951450 - DNA, 25 bp, Mus musculus
ggctccaacgtattgccggctgaag

SEQ ID NO: 951451 - DNA, 25 bp, Mus musculus
ggctccaactttcctcctgagactg

SEQ ID NO: 951452 - DNA, 25 bp, Mus musculus
ggctccaactttgctcctgagactg

SEQ ID NO: 951453 - DNA, 25 bp, Mus musculus
ggctccacagagcttggaaagctgg

SEQ ID NO: 951454 - DNA, 25 bp, Mus musculus
ggctccacagaggttggaaagctgg

SEQ ID NO: 951455 - DNA, 25 bp, Mus musculus
ggctccacggagcttggtcacctaa

SEQ ID NO: 951456 - DNA, 25 bp, Mus musculus
ggctccacggaggttggtcacctaa

SEQ ID NO: 951457 - DNA, 25 bp, Mus musculus
ggctccaggaagctggctgacggtc

SEQ ID NO: 951458 - DNA, 25 bp, Mus musculus
ggctccaggaaggtggctgacggtc

SEQ ID NO: 951459 - DNA, 25 bp, Mus musculus
ggctcccaaggacgcccccaagaag

SEQ ID NO: 951460 - DNA, 25 bp, Mus musculus
ggctcccaaggaggcccccaagaag

SEQ ID NO: 951461 - DNA, 25 bp, Mus musculus
ggctcccacagtgacacagtactat

SEQ ID NO: 951462 - DNA, 25 bp, Mus musculus
ggctcccacagtgagacagtactat

SEQ ID NO: 951463 - DNA, 25 bp, Mus musculus
ggctcccgagcacaaggagaagacg

SEQ ID NO: 951464 - DNA, 25 bp, Mus musculus
ggctcccgagcagaaggagaagacg

SEQ ID NO: 951465 - DNA, 25 bp, Mus musculus
ggctcccgccagagctcaggccctg

SEQ ID NO: 951466 - DNA, 25 bp, Mus musculus
ggctcccgccagcagaatggtgcca

SEQ ID NO: 951467 - DNA, 25 bp, Mus musculus
ggctcccgccagctcaaggtgatgc

SEQ ID NO: 951468 - DNA, 25 bp, Mus musculus
ggctcccgccaggagaatggtgcca

SEQ ID NO: 951469 - DNA, 25 bp, Mus musculus
ggctcccgccaggtcaaggtgatgc

SEQ ID NO: 951470 - DNA, 25 bp, Mus musculus
ggctcccgccagtgctcaggccctg

SEQ ID NO: 951471 - DNA, 25 bp, Mus musculus
ggctccctcccgatgagaagaagca

SEQ ID NO: 951472 - DNA, 25 bp, Mus musculus
ggctccctcccgcgatatttgcttg

SEQ ID NO: 951473 - DNA, 25 bp, Mus musculus
ggctccctcccgggatatttgcttg

SEQ ID NO: 951474 - DNA, 25 bp, Mus musculus
ggctccctcccgttgagaagaagca

SEQ ID NO: 951475 - DNA, 25 bp, Mus musculus
ggctccctgaggcgtacctcggaat

SEQ ID NO: 951476 - DNA, 25 bp, Mus musculus
ggctccctgaggggtacctcggaat

SEQ ID NO: 951477 - DNA, 25 bp, Mus musculus
ggctccctgcagcgtcccacaaaac

SEQ ID NO: 951478 - DNA, 25 bp, Mus musculus
ggctccctgcagggtcccacaaaac

SEQ ID NO: 951479 - DNA, 25 bp, Mus musculus
ggctccgactggaagaatgcctgtg

SEQ ID NO: 951480 - DNA, 25 bp, Mus musculus
ggctccgactggtagaatgcctgtg

SEQ ID NO: 951481 - DNA, 25 bp, Mus musculus
ggctccgcgggcagaggaaatataa

SEQ ID NO: 951482 - DNA, 25 bp, Mus musculus
ggctccgcgggctgaggaaatataa

SEQ ID NO: 951483 - DNA, 25 bp, Mus musculus
ggctccggcaggcaagcccagccct

SEQ ID NO: 951484 - DNA, 25 bp, Mus musculus
ggctccggcagggaagcccagccct

SEQ ID NO: 951485 - DNA, 25 bp, Mus musculus
ggctcctacctgaacagcaccaagc

SEQ ID NO: 951486 - DNA, 25 bp, Mus musculus
ggctcctacctgaagagcaccaagc

SEQ ID NO: 951487 - DNA, 25 bp, Mus musculus
ggctcctactggaacagccatgaag

SEQ ID NO: 951488 - DNA, 25 bp, Mus musculus
ggctcctactggaaccagagccatg

SEQ ID NO: 951489 - DNA, 25 bp, Mus musculus
ggctcctactggaacgtacccaggg

SEQ ID NO: 951490 - DNA, 25 bp, Mus musculus
ggctcctactggaagagccatgaag

SEQ ID NO: 951491 - DNA, 25 bp, Mus musculus
ggctcctactggaagcagagccatg

SEQ ID NO: 951492 - DNA, 25 bp, Mus musculus
ggctcctactggaaggtacccaggg

SEQ ID NO: 951493 - DNA, 25 bp, Mus musculus
ggctcctccatcttcgcatgtgctc

SEQ ID NO: 951494 - DNA, 25 bp, Mus musculus
ggctcctccatcttggcatgtgctc

SEQ ID NO: 951495 - DNA, 25 bp, Mus musculus
ggctcctgaagacgttggtggaggg

SEQ ID NO: 951496 - DNA, 25 bp, Mus musculus
ggctcctgaagaggttggtggaggg

SEQ ID NO: 951497 - DNA, 25 bp, Mus musculus
ggctcctgagccatggaggggtcta

SEQ ID NO: 951498 - DNA, 25 bp, Mus musculus
ggctcctgaggcatggaggggtcta

SEQ ID NO: 951499 - DNA, 25 bp, Mus musculus
ggctcctggacacgtggtggtcggg

SEQ ID NO: 951500 - DNA, 25 bp, Mus musculus
ggctcctggacaggtggtggtcggg

SEQ ID NO: 951501 - DNA, 25 bp, Mus musculus
ggctccttaccacgagatcgagact

SEQ ID NO: 951502 - DNA, 25 bp, Mus musculus
ggctccttaccaggagatcgagact

SEQ ID NO: 951503 - DNA, 25 bp, Mus musculus
ggctccttccagcgctttgtggtgg

SEQ ID NO: 951504 - DNA, 25 bp, Mus musculus
ggctccttccagggctttgtggtgg

SEQ ID NO: 951505 - DNA, 25 bp, Mus musculus
ggctccttgcagcatatctttaaat

SEQ ID NO: 951506 - DNA, 25 bp, Mus musculus
ggctccttgcaggatatctttaaat

SEQ ID NO: 951507 - DNA, 25 bp, Mus musculus
ggctcgaacaccagaagatgatgaa

SEQ ID NO: 951508 - DNA, 25 bp, Mus musculus
ggctcgaacagcagaagatgatgaa

SEQ ID NO: 951509 - DNA, 25 bp, Mus musculus
ggctcgagcagactccgtctcccag

SEQ ID NO: 951510 - DNA, 25 bp, Mus musculus
ggctcgagcagagtccgtctcccag

SEQ ID NO: 951511 - DNA, 25 bp, Mus musculus
ggctcgatactccatcctgcatgcc

SEQ ID NO: 951512 - DNA, 25 bp, Mus musculus
ggctcgatactcgatcctgcatgcc

SEQ ID NO: 951513 - DNA, 25 bp, Mus musculus
ggctcgcaacagcctagcagagatc

SEQ ID NO: 951514 - DNA, 25 bp, Mus musculus
ggctcgcaacaggctagcagagatc

SEQ ID NO: 951515 - DNA, 25 bp, Mus musculus
ggctcgcagaagctcaggtaccgga

SEQ ID NO: 951516 - DNA, 25 bp, Mus musculus
ggctcgcagaaggtcaggtaccgga

SEQ ID NO: 951517 - DNA, 25 bp, Mus musculus
ggctcgggacgcagtggatatggtt

SEQ ID NO: 951518 - DNA, 25 bp, Mus musculus
ggctcgggacgctgtggatatggtt

SEQ ID NO: 951519 - DNA, 25 bp, Mus musculus
ggctcgggttgacgctcgcctgtgc

SEQ ID NO: 951520 - DNA, 25 bp, Mus musculus
ggctcgggttgaggctcgcctgtgc

SEQ ID NO: 951521 - DNA, 25 bp, Mus musculus
ggctctacggctgacaccaggtcta

SEQ ID NO: 951522 - DNA, 25 bp, Mus musculus
ggctctacgggtgacaccaggtcta

SEQ ID NO: 951523 - DNA, 25 bp, Mus musculus
ggctctagagaacgagctagaagcg

SEQ ID NO: 951524 - DNA, 25 bp, Mus musculus
ggctctagagaaggagctagaagcg

SEQ ID NO: 951525 - DNA, 25 bp, Mus musculus
ggctctataatgcttaactttgtgc

SEQ ID NO: 951526 - DNA, 25 bp, Mus musculus
ggctctataatggttaactttgtgc

SEQ ID NO: 951527 - DNA, 25 bp, Mus musculus
ggctctatcgtgacttgtgggcaca

SEQ ID NO: 951528 - DNA, 25 bp, Mus musculus
ggctctatcgtgtcttgtgggcaca

SEQ ID NO: 951529 - DNA, 25 bp, Mus musculus
ggctctcaagcagaaaaatggctac

SEQ ID NO: 951530 - DNA, 25 bp, Mus musculus
ggctctcaagcaggccaaagcaaaa

SEQ ID NO: 951531 - DNA, 25 bp, Mus musculus
ggctctcaaggagaaaaatggctac

SEQ ID NO: 951532 - DNA, 25 bp, Mus musculus
ggctctcaaggaggccaaagcaaaa

SEQ ID NO: 951533 - DNA, 25 bp, Mus musculus
ggctctcagcagatcatcctctagg

SEQ ID NO: 951534 - DNA, 25 bp, Mus musculus
ggctctcagcagatgatcctctagg

SEQ ID NO: 951535 - DNA, 25 bp, Mus musculus
ggctctcattgacgcttatgtaaac

SEQ ID NO: 951536 - DNA, 25 bp, Mus musculus
ggctctcattgaggcttatgtaaac

SEQ ID NO: 951537 - DNA, 25 bp, Mus musculus
ggctctcctacactcggctcctcca

SEQ ID NO: 951538 - DNA, 25 bp, Mus musculus
ggctctcctacactgggctcctcca

SEQ ID NO: 951539 - DNA, 25 bp, Mus musculus
ggctctcctttcaacaattacaggc

SEQ ID NO: 951540 - DNA, 25 bp, Mus musculus
ggctctcctttcaagaattacaggc

SEQ ID NO: 951541 - DNA, 25 bp, Mus musculus
ggctctcttcttcgtgcccgtggtg

SEQ ID NO: 951542 - DNA, 25 bp, Mus musculus
ggctctcttcttggtgcccgtggtg

SEQ ID NO: 951543 - DNA, 25 bp, Mus musculus
ggctctgacacccgcaagtctatgc

SEQ ID NO: 951544 - DNA, 25 bp, Mus musculus
ggctctgacagccgcaagtctatgc

SEQ ID NO: 951545 - DNA, 25 bp, Mus musculus
ggctctgacgatgaagatgagtcaa

SEQ ID NO: 951546 - DNA, 25 bp, Mus musculus
ggctctgacgttgaagatgagtcaa

SEQ ID NO: 951547 - DNA, 25 bp, Mus musculus
ggctctgagacacggccatctccag

SEQ ID NO: 951548 - DNA, 25 bp, Mus musculus
ggctctgagacagggccatctccag

SEQ ID NO: 951549 - DNA, 25 bp, Mus musculus
ggctctgagaggcccctgcccggat

SEQ ID NO: 951550 - DNA, 25 bp, Mus musculus
ggctctgagagggccctgcccggat

SEQ ID NO: 951551 - DNA, 25 bp, Mus musculus
ggctctgagcagatctgaagatgaa

SEQ ID NO: 951552 - DNA, 25 bp, Mus musculus
ggctctgagcagttctgaagatgaa

SEQ ID NO: 951553 - DNA, 25 bp, Mus musculus
ggctctgcagataacactgtagctt

SEQ ID NO: 951554 - DNA, 25 bp, Mus musculus
ggctctgcagataagactgtagctt

SEQ ID NO: 951555 - DNA, 25 bp, Mus musculus
ggctctgcagatggagagcaaagcc

SEQ ID NO: 951556 - DNA, 25 bp, Mus musculus
ggctctgcagcaagcctgctgacag

SEQ ID NO: 951557 - DNA, 25 bp, Mus musculus
ggctctgcaggaagcctgctgacag

SEQ ID NO: 951558 - DNA, 25 bp, Mus musculus
ggctctgcagttggagagcaaagcc

SEQ ID NO: 951559 - DNA, 25 bp, Mus musculus
ggctctgctatcaacgtgcagagcc

SEQ ID NO: 951560 - DNA, 25 bp, Mus musculus
ggctctgctatcaaggtgcagagcc

SEQ ID NO: 951561 - DNA, 25 bp, Mus musculus
ggctctgctggacacccaatccatt

SEQ ID NO: 951562 - DNA, 25 bp, Mus musculus
ggctctgctggacagccaatccatt

SEQ ID NO: 951563 - DNA, 25 bp, Mus musculus
ggctctggagaacaagacttcacct

SEQ ID NO: 951564 - DNA, 25 bp, Mus musculus
ggctctggagaacatgacttcacct

SEQ ID NO: 951565 - DNA, 25 bp, Mus musculus
ggctctggagatggcaggttcagcg

SEQ ID NO: 951566 - DNA, 25 bp, Mus musculus
ggctctggagccttcattggttatg

SEQ ID NO: 951567 - DNA, 25 bp, Mus musculus
ggctctggaggcttcattggttatg

SEQ ID NO: 951568 - DNA, 25 bp, Mus musculus
ggctctggagttggcaggttcagcg

SEQ ID NO: 951569 - DNA, 25 bp, Mus musculus
ggctctggcacacccggagagaagc

SEQ ID NO: 951570 - DNA, 25 bp, Mus musculus
ggctctggcacacgtgctttgccag

SEQ ID NO: 951571 - DNA, 25 bp, Mus musculus
ggctctggcacagccggagagaagc

SEQ ID NO: 951572 - DNA, 25 bp, Mus musculus
ggctctggcacaggtgctttgccag

SEQ ID NO: 951573 - DNA, 25 bp, Mus musculus
ggctctggtcctggacgcagacgat

SEQ ID NO: 951574 - DNA, 25 bp, Mus musculus
ggctctggtcgtggacgcagacgat

SEQ ID NO: 951575 - DNA, 25 bp, Mus musculus
ggctctggtgtacacagggcggccc

SEQ ID NO: 951576 - DNA, 25 bp, Mus musculus
ggctctggtgtacagagggcggccc

SEQ ID NO: 951577 - DNA, 25 bp, Mus musculus
ggctctggtgtacccggaccagaat

SEQ ID NO: 951578 - DNA, 25 bp, Mus musculus
ggctctggtgtaccgggaccagaat

SEQ ID NO: 951579 - DNA, 25 bp, Mus musculus
ggctctgtagcacgtctagtgacag

SEQ ID NO: 951580 - DNA, 25 bp, Mus musculus
ggctctgtagcaggtctagtgacag

SEQ ID NO: 951581 - DNA, 25 bp, Mus musculus
ggctctgtagcttgtgaaccatggc

SEQ ID NO: 951582 - DNA, 25 bp, Mus musculus
ggctctgtaggttgtgaaccatggc

SEQ ID NO: 951583 - DNA, 25 bp, Mus musculus
ggctcttaagcttcgctatcctgac

SEQ ID NO: 951584 - DNA, 25 bp, Mus musculus
ggctcttaaggttcgctatcctgac

SEQ ID NO: 951585 - DNA, 25 bp, Mus musculus
ggctcttctgagctacctgaattca

SEQ ID NO: 951586 - DNA, 25 bp, Mus musculus
ggctcttctgaggtacctgaattca

SEQ ID NO: 951587 - DNA, 25 bp, Mus musculus
ggctcttgagcttttagaagaggag

SEQ ID NO: 951588 - DNA, 25 bp, Mus musculus
ggctcttgaggttttagaagaggag

SEQ ID NO: 951589 - DNA, 25 bp, Mus musculus
ggctctttctaactccccacctttg

SEQ ID NO: 951590 - DNA, 25 bp, Mus musculus
ggctctttctaactgcccacctttg

SEQ ID NO: 951591 - DNA, 25 bp, Mus musculus
ggctgaaaaagacctgcatgagaaa

SEQ ID NO: 951592 - DNA, 25 bp, Mus musculus
ggctgaaaaagagctgcatgagaaa

SEQ ID NO: 951593 - DNA, 25 bp, Mus musculus
ggctgaaaagcttctccatggtgat

SEQ ID NO: 951594 - DNA, 25 bp, Mus musculus
ggctgaaaaggttctccatggtgat

SEQ ID NO: 951595 - DNA, 25 bp, Mus musculus
ggctgaaccacatgtcagtgcctca

SEQ ID NO: 951596 - DNA, 25 bp, Mus musculus
ggctgaaccagatgtcagtgcctca

SEQ ID NO: 951597 - DNA, 25 bp, Mus musculus
ggctgaagagaatatccggtctctg

SEQ ID NO: 951598 - DNA, 25 bp, Mus musculus
ggctgaagagagatgacattacttg

SEQ ID NO: 951599 - DNA, 25 bp, Mus musculus
ggctgaagagatttgaaagtgacct

SEQ ID NO: 951600 - DNA, 25 bp, Mus musculus
ggctgaagagtatatccggtctctg

SEQ ID NO: 951601 - DNA, 25 bp, Mus musculus
ggctgaagagtgatgacattacttg

SEQ ID NO: 951602 - DNA, 25 bp, Mus musculus
ggctgaagagttttgaaagtgacct

SEQ ID NO: 951603 - DNA, 25 bp, Mus musculus
ggctgaagtgagagggcccagccac

SEQ ID NO: 951604 - DNA, 25 bp, Mus musculus
ggctgaagtgagcggggtccagcga

SEQ ID NO: 951605 - DNA, 25 bp, Mus musculus
ggctgaagtgaggggggtccagcga

SEQ ID NO: 951606 - DNA, 25 bp, Mus musculus
ggctgaagtgagtgggcccagccac

SEQ ID NO: 951607 - DNA, 25 bp, Mus musculus
ggctgaagttcacgaattttatggt

SEQ ID NO: 951608 - DNA, 25 bp, Mus musculus
ggctgaagttcaggaattttatggt

SEQ ID NO: 951609 - DNA, 25 bp, Mus musculus
ggctgacaaatgacacccagtcttc

SEQ ID NO: 951610 - DNA, 25 bp, Mus musculus
ggctgacaaatgactcccagtcttc

SEQ ID NO: 951611 - DNA, 25 bp, Mus musculus
ggctgacaagccccttttagctacc

SEQ ID NO: 951612 - DNA, 25 bp, Mus musculus
ggctgacaaggcccttttagctacc

SEQ ID NO: 951613 - DNA, 25 bp, Mus musculus
ggctgacacgctccgaggagacata

SEQ ID NO: 951614 - DNA, 25 bp, Mus musculus
ggctgacacgcttccaggtccgagg

SEQ ID NO: 951615 - DNA, 25 bp, Mus musculus
ggctgacacggtccgaggagacata

SEQ ID NO: 951616 - DNA, 25 bp, Mus musculus
ggctgacacggttccaggtccgagg

SEQ ID NO: 951617 - DNA, 25 bp, Mus musculus
ggctgacatccacaggctaaaggaa

SEQ ID NO: 951618 - DNA, 25 bp, Mus musculus
ggctgacatccagaggctaaaggaa

SEQ ID NO: 951619 - DNA, 25 bp, Mus musculus
ggctgacatgtgcagcattggcgtc

SEQ ID NO: 951620 - DNA, 25 bp, Mus musculus
ggctgacatgtgcctgagcggagcg

SEQ ID NO: 951621 - DNA, 25 bp, Mus musculus
ggctgacatgtggagcattggcgtc

SEQ ID NO: 951622 - DNA, 25 bp, Mus musculus
ggctgacatgtggctgagcggagcg

SEQ ID NO: 951623 - DNA, 25 bp, Mus musculus
ggctgaccagcatattttcaatgct

SEQ ID NO: 951624 - DNA, 25 bp, Mus musculus
ggctgaccaggatattttcaatgct

SEQ ID NO: 951625 - DNA, 25 bp, Mus musculus
ggctgacctgatgaacactctgaac

SEQ ID NO: 951626 - DNA, 25 bp, Mus musculus
ggctgacctgcaaatctggttcttg

SEQ ID NO: 951627 - DNA, 25 bp, Mus musculus
ggctgacctgcccctctgtcctgga

SEQ ID NO: 951628 - DNA, 25 bp, Mus musculus
ggctgacctggaaatctggttcttg

SEQ ID NO: 951629 - DNA, 25 bp, Mus musculus
ggctgacctggccctctgtcctgga

SEQ ID NO: 951630 - DNA, 25 bp, Mus musculus
ggctgacctgttgaacactctgaac

SEQ ID NO: 951631 - DNA, 25 bp, Mus musculus
ggctgactgcagatctgatttgtac

SEQ ID NO: 951632 - DNA, 25 bp, Mus musculus
ggctgactgcagttctgatttgtac

SEQ ID NO: 951633 - DNA, 25 bp, Mus musculus
ggctgagaaaccatacaattgtgga

SEQ ID NO: 951634 - DNA, 25 bp, Mus musculus
ggctgagaaaccttacaattgtgga

SEQ ID NO: 951635 - DNA, 25 bp, Mus musculus
ggctgagaacggctcgtcctctggc

SEQ ID NO: 951636 - DNA, 25 bp, Mus musculus
ggctgagaacgggtcgtcctctggc

SEQ ID NO: 951637 - DNA, 25 bp, Mus musculus
ggctgagaagaactctcagaaggaa

SEQ ID NO: 951638 - DNA, 25 bp, Mus musculus
ggctgagaagcccgctgtccctgag

SEQ ID NO: 951639 - DNA, 25 bp, Mus musculus
ggctgagaagccggctgtccctgag

SEQ ID NO: 951640 - DNA, 25 bp, Mus musculus
ggctgagaagtactctcagaaggaa

SEQ ID NO: 951641 - DNA, 25 bp, Mus musculus
ggctgagcagaacggccttcttgaa

SEQ ID NO: 951642 - DNA, 25 bp, Mus musculus
ggctgagcagaagggccttcttgaa

SEQ ID NO: 951643 - DNA, 25 bp, Mus musculus
ggctgagccgagagaagagccctgg

SEQ ID NO: 951644 - DNA, 25 bp, Mus musculus
ggctgagccgagtgaagagccctgg

SEQ ID NO: 951645 - DNA, 25 bp, Mus musculus
ggctgaggacctcctttcttatttg

SEQ ID NO: 951646 - DNA, 25 bp, Mus musculus
ggctgaggacctcggatgggtcccc

SEQ ID NO: 951647 - DNA, 25 bp, Mus musculus
ggctgaggacgtcctttcttatttg

SEQ ID NO: 951648 - DNA, 25 bp, Mus musculus
ggctgaggacgtcggatgggtcccc

SEQ ID NO: 951649 - DNA, 25 bp, Mus musculus
ggctgaggagcccaccatggcagaa

SEQ ID NO: 951650 - DNA, 25 bp, Mus musculus
ggctgaggagctggaggtccaggat

SEQ ID NO: 951651 - DNA, 25 bp, Mus musculus
ggctgaggaggccaccatggcagaa

SEQ ID NO: 951652 - DNA, 25 bp, Mus musculus
ggctgaggaggtggaggtccaggat

SEQ ID NO: 951653 - DNA, 25 bp, Mus musculus
ggctgaggccagctctcttaacctt

SEQ ID NO: 951654 - DNA, 25 bp, Mus musculus
ggctgaggccaggtctcttaacctt

SEQ ID NO: 951655 - DNA, 25 bp, Mus musculus
ggctgaggtgtccccacggatcttg

SEQ ID NO: 951656 - DNA, 25 bp, Mus musculus
ggctgaggtgtcccgacggatcttg

SEQ ID NO: 951657 - DNA, 25 bp, Mus musculus
ggctgagtacagcgcctcagaggga

SEQ ID NO: 951658 - DNA, 25 bp, Mus musculus
ggctgagtacagggcctcagaggga

SEQ ID NO: 951659 - DNA, 25 bp, Mus musculus
ggctgagtctctcccaataccagaa

SEQ ID NO: 951660 - DNA, 25 bp, Mus musculus
ggctgagtctctccgaataccagaa

SEQ ID NO: 951661 - DNA, 25 bp, Mus musculus
ggctgagttctgcctggatctgcag

SEQ ID NO: 951662 - DNA, 25 bp, Mus musculus
ggctgagttctggctggatctgcag

SEQ ID NO: 951663 - DNA, 25 bp, Mus musculus
ggctgatgacccagtcttatctcct

SEQ ID NO: 951664 - DNA, 25 bp, Mus musculus
ggctgatgaccctgtcttatctcct

SEQ ID NO: 951665 - DNA, 25 bp, Mus musculus
ggctgatgccaacaaacggccatcg

SEQ ID NO: 951666 - DNA, 25 bp, Mus musculus
ggctgatgccaagaaacggccatcg

SEQ ID NO: 951667 - DNA, 25 bp, Mus musculus
ggctgatgttgacgctttgttgacc

SEQ ID NO: 951668 - DNA, 25 bp, Mus musculus
ggctgatgttgaggctttgttgacc

SEQ ID NO: 951669 - DNA, 25 bp, Mus musculus
ggctgattccagatacttcctgcct

SEQ ID NO: 951670 - DNA, 25 bp, Mus musculus
ggctgattccagttacttcctgcct

SEQ ID NO: 951671 - DNA, 25 bp, Mus musculus
ggctgcaaagacctcttctccacac

SEQ ID NO: 951672 - DNA, 25 bp, Mus musculus
ggctgcaaagctttcttccgaagaa

SEQ ID NO: 951673 - DNA, 25 bp, Mus musculus
ggctgcaaaggtttcttccgaagaa

SEQ ID NO: 951674 - DNA, 25 bp, Mus musculus
ggctgcaaagtcctcttctccacac

SEQ ID NO: 951675 - DNA, 25 bp, Mus musculus
ggctgcaactttaacatggagccag

SEQ ID NO: 951676 - DNA, 25 bp, Mus musculus
ggctgcaactttaagatggagccag

SEQ ID NO: 951677 - DNA, 25 bp, Mus musculus
ggctgcacaaacgacctccttatgt

SEQ ID NO: 951678 - DNA, 25 bp, Mus musculus
ggctgcacaaacgagctccttatgt

SEQ ID NO: 951679 - DNA, 25 bp, Mus musculus
ggctgcacagcagcaacacgtcggg

SEQ ID NO: 951680 - DNA, 25 bp, Mus musculus
ggctgcacagcccatctctgagcga

SEQ ID NO: 951681 - DNA, 25 bp, Mus musculus
ggctgcacaggagcaacacgtcggg

SEQ ID NO: 951682 - DNA, 25 bp, Mus musculus
ggctgcacaggccatctctgagcga

SEQ ID NO: 951683 - DNA, 25 bp, Mus musculus
ggctgcaccatacgtttcatagctt

SEQ ID NO: 951684 - DNA, 25 bp, Mus musculus
ggctgcaccataggtttcatagctt

SEQ ID NO: 951685 - DNA, 25 bp, Mus musculus
ggctgcagagctatctgttcttgaa

SEQ ID NO: 951686 - DNA, 25 bp, Mus musculus
ggctgcagaggtatctgttcttgaa

SEQ ID NO: 951687 - DNA, 25 bp, Mus musculus
ggctgcaggcggcccaagatgtcca

SEQ ID NO: 951688 - DNA, 25 bp, Mus musculus
ggctgcaggcggcttgaagatgagc

SEQ ID NO: 951689 - DNA, 25 bp, Mus musculus
ggctgcaggcgggccaagatgtcca

SEQ ID NO: 951690 - DNA, 25 bp, Mus musculus
ggctgcaggcgggttgaagatgagc

SEQ ID NO: 951691 - DNA, 25 bp, Mus musculus
ggctgcagtcgtgacgtaccgaaag

SEQ ID NO: 951692 - DNA, 25 bp, Mus musculus
ggctgcagtcgtgaggtaccgaaag

SEQ ID NO: 951693 - DNA, 25 bp, Mus musculus
ggctgcatctctgaagaggacaact

SEQ ID NO: 951694 - DNA, 25 bp, Mus musculus
ggctgcatctgtgaagaggacaact

SEQ ID NO: 951695 - DNA, 25 bp, Mus musculus
ggctgccaagaactaccatgaggct

SEQ ID NO: 951696 - DNA, 25 bp, Mus musculus
ggctgccaagaagtaccatgaggct

SEQ ID NO: 951697 - DNA, 25 bp, Mus musculus
ggctgccaagagcccttcacagttg

SEQ ID NO: 951698 - DNA, 25 bp, Mus musculus
ggctgccaagtgcccttcacagttg

SEQ ID NO: 951699 - DNA, 25 bp, Mus musculus
ggctgccatgctcactacgtccatg

SEQ ID NO: 951700 - DNA, 25 bp, Mus musculus
ggctgccatggtcactacgtccatg

SEQ ID NO: 951701 - DNA, 25 bp, Mus musculus
ggctgcccaaagagcatgccaccag

SEQ ID NO: 951702 - DNA, 25 bp, Mus musculus
ggctgcccaaagagccccctcagag

SEQ ID NO: 951703 - DNA, 25 bp, Mus musculus
ggctgcccaaagcctgagacccacc

SEQ ID NO: 951704 - DNA, 25 bp, Mus musculus
ggctgcccaaaggctgagacccacc

SEQ ID NO: 951705 - DNA, 25 bp, Mus musculus
ggctgcccaaagtgcatgccaccag

SEQ ID NO: 951706 - DNA, 25 bp, Mus musculus
ggctgcccaaagtgccccctcagag

SEQ ID NO: 951707 - DNA, 25 bp, Mus musculus
ggctgcccggccctgactaccagaa

SEQ ID NO: 951708 - DNA, 25 bp, Mus musculus
ggctgcccgggcctgactaccagaa

SEQ ID NO: 951709 - DNA, 25 bp, Mus musculus
ggctgccgagatgtggacgagtgtg

SEQ ID NO: 951710 - DNA, 25 bp, Mus musculus
ggctgccgagttgtggacgagtgtg

SEQ ID NO: 951711 - DNA, 25 bp, Mus musculus
ggctgccgtaagaaattcatcctat

SEQ ID NO: 951712 - DNA, 25 bp, Mus musculus
ggctgccgtaagaatttcatcctat

SEQ ID NO: 951713 - DNA, 25 bp, Mus musculus
ggctgcgactgcaacgacttgtcct

SEQ ID NO: 951714 - DNA, 25 bp, Mus musculus
ggctgcgactgcaaggacttgtcct

SEQ ID NO: 951715 - DNA, 25 bp, Mus musculus
ggctgcgctgagcctccagccttcc

SEQ ID NO: 951716 - DNA, 25 bp, Mus musculus
ggctgcgctgaggctccagccttcc

SEQ ID NO: 951717 - DNA, 25 bp, Mus musculus
ggctgcgggccggccaaatggcaaa

SEQ ID NO: 951718 - DNA, 25 bp, Mus musculus
ggctgcgggccggcgaaatggcaaa

SEQ ID NO: 951719 - DNA, 25 bp, Mus musculus
ggctgcgtcaatctgacacagtgtg

SEQ ID NO: 951720 - DNA, 25 bp, Mus musculus
ggctgcgtcaatgtgacacagtgtg

SEQ ID NO: 951721 - DNA, 25 bp, Mus musculus
ggctgctactcacagtttgctaaag

SEQ ID NO: 951722 - DNA, 25 bp, Mus musculus
ggctgctactcagagtttgctaaag

SEQ ID NO: 951723 - DNA, 25 bp, Mus musculus
ggctgctcaagctccgtggcagggt

SEQ ID NO: 951724 - DNA, 25 bp, Mus musculus
ggctgctcaagctcggtggcagggt

SEQ ID NO: 951725 - DNA, 25 bp, Mus musculus
ggctgctcagatgcccccaccaccc

SEQ ID NO: 951726 - DNA, 25 bp, Mus musculus
ggctgctcagctcggcctgctgact

SEQ ID NO: 951727 - DNA, 25 bp, Mus musculus
ggctgctcaggtcggcctgctgact

SEQ ID NO: 951728 - DNA, 25 bp, Mus musculus
ggctgctcagttgcccccaccaccc

SEQ ID NO: 951729 - DNA, 25 bp, Mus musculus
ggctgctcatggaaacgtgtgccgt

SEQ ID NO: 951730 - DNA, 25 bp, Mus musculus
ggctgctcatggtaacgtgtgccgt

SEQ ID NO: 951731 - DNA, 25 bp, Mus musculus
ggctgctccagcacagctaccaacg

SEQ ID NO: 951732 - DNA, 25 bp, Mus musculus
ggctgctccagcactaccaacgtcc

SEQ ID NO: 951733 - DNA, 25 bp, Mus musculus
ggctgctccagctcagctaccaacg

SEQ ID NO: 951734 - DNA, 25 bp, Mus musculus
ggctgctccagctctaccaacgtcc

SEQ ID NO: 951735 - DNA, 25 bp, Mus musculus
ggctgctcccagcatggcggacaag

SEQ ID NO: 951736 - DNA, 25 bp, Mus musculus
ggctgctcccaggatggcggacaag

SEQ ID NO: 951737 - DNA, 25 bp, Mus musculus
ggctgctcggctggagaaagtgcac

SEQ ID NO: 951738 - DNA, 25 bp, Mus musculus
ggctgctcgggtggagaaagtgcac

SEQ ID NO: 951739 - DNA, 25 bp, Mus musculus
ggctgctgcgttcacaccccccaaa

SEQ ID NO: 951740 - DNA, 25 bp, Mus musculus
ggctgctgcgttcacaccctccaaa

SEQ ID NO: 951741 - DNA, 25 bp, Mus musculus
ggctgctgcgttcagaccccccaaa

SEQ ID NO: 951742 - DNA, 25 bp, Mus musculus
ggctgctgcgttcagaccctccaaa

SEQ ID NO: 951743 - DNA, 25 bp, Mus musculus
ggctgctgctctcgattaatgaaaa

SEQ ID NO: 951744 - DNA, 25 bp, Mus musculus
ggctgctgctctggattaatgaaaa

SEQ ID NO: 951745 - DNA, 25 bp, Mus musculus
ggctgctgctgccacataaagatag

SEQ ID NO: 951746 - DNA, 25 bp, Mus musculus
ggctgctgctgccagataaagatag

SEQ ID NO: 951747 - DNA, 25 bp, Mus musculus
ggctgctggcagctaccttggctgg

SEQ ID NO: 951748 - DNA, 25 bp, Mus musculus
ggctgctggcaggtaccttggctgg

SEQ ID NO: 951749 - DNA, 25 bp, Mus musculus
ggctgctggcctggagacagtggga

SEQ ID NO: 951750 - DNA, 25 bp, Mus musculus
ggctgctggcctggatgggacacta

SEQ ID NO: 951751 - DNA, 25 bp, Mus musculus
ggctgctggcctggtgacagtggga

SEQ ID NO: 951752 - DNA, 25 bp, Mus musculus
ggctgctggcctggttgggacacta

SEQ ID NO: 951753 - DNA, 25 bp, Mus musculus
ggctgctggtgagacgaagctttgt

SEQ ID NO: 951754 - DNA, 25 bp, Mus musculus
ggctgctggtgagaggaagctttgt

SEQ ID NO: 951755 - DNA, 25 bp, Mus musculus
ggctgctgtgtgcacgtgtgcggcg

SEQ ID NO: 951756 - DNA, 25 bp, Mus musculus
ggctgctgtgtgcaggtgtgcggcg

SEQ ID NO: 951757 - DNA, 25 bp, Mus musculus
ggctgcttcaagcacaccacccccg

SEQ ID NO: 951758 - DNA, 25 bp, Mus musculus
ggctgcttcaaggacaccacccccg

SEQ ID NO: 951759 - DNA, 25 bp, Mus musculus
ggctgcttccagccttttatttgtg

SEQ ID NO: 951760 - DNA, 25 bp, Mus musculus
ggctgcttccaggcttttatttgtg

SEQ ID NO: 951761 - DNA, 25 bp, Mus musculus
ggctggaaagcccaagaccaagggg

SEQ ID NO: 951762 - DNA, 25 bp, Mus musculus
ggctggaaaggccaagaccaagggg

SEQ ID NO: 951763 - DNA, 25 bp, Mus musculus
ggctggaatgcacataacaattgaa

SEQ ID NO: 951764 - DNA, 25 bp, Mus musculus
ggctggaatgcaccttgaaggtctt

SEQ ID NO: 951765 - DNA, 25 bp, Mus musculus
ggctggaatgcagataacaattgaa

SEQ ID NO: 951766 - DNA, 25 bp, Mus musculus
ggctggaatgcagcttgaaggtctt

SEQ ID NO: 951767 - DNA, 25 bp, Mus musculus
ggctggacagctaggtgtggaattt

SEQ ID NO: 951768 - DNA, 25 bp, Mus musculus
ggctggacagcttggtgtggaattt

SEQ ID NO: 951769 - DNA, 25 bp, Mus musculus
ggctggagggagcttcctccatgga

SEQ ID NO: 951770 - DNA, 25 bp, Mus musculus
ggctggagggaggttcctccatgga

SEQ ID NO: 951771 - DNA, 25 bp, Mus musculus
ggctggagggcatgccaacaaggag

SEQ ID NO: 951772 - DNA, 25 bp, Mus musculus
ggctggagggctgatggtaatgccc

SEQ ID NO: 951773 - DNA, 25 bp, Mus musculus
ggctggaggggatgccaacaaggag

SEQ ID NO: 951774 - DNA, 25 bp, Mus musculus
ggctggaggggtgatggtaatgccc

SEQ ID NO: 951775 - DNA, 25 bp, Mus musculus
ggctggatcagtctttctagatggc

SEQ ID NO: 951776 - DNA, 25 bp, Mus musculus
ggctggatcagtgtttctagatggc

SEQ ID NO: 951777 - DNA, 25 bp, Mus musculus
ggctggcaagctcaaacctgcgagg

SEQ ID NO: 951778 - DNA, 25 bp, Mus musculus
ggctggcaaggtcaaacctgcgagg

SEQ ID NO: 951779 - DNA, 25 bp, Mus musculus
ggctggcactgtgtcgatcaactgc

SEQ ID NO: 951780 - DNA, 25 bp, Mus musculus
ggctggcactgtgtggatcaactgc

SEQ ID NO: 951781 - DNA, 25 bp, Mus musculus
ggctggcaggaaccacacagagccc

SEQ ID NO: 951782 - DNA, 25 bp, Mus musculus
ggctggcaggagctcaccgagtctg

SEQ ID NO: 951783 - DNA, 25 bp, Mus musculus
ggctggcaggtaccacacagagccc

SEQ ID NO: 951784 - DNA, 25 bp, Mus musculus
ggctggcaggtgctcaccgagtctg

SEQ ID NO: 951785 - DNA, 25 bp, Mus musculus
ggctggcatgaaatcctggggcaga

SEQ ID NO: 951786 - DNA, 25 bp, Mus musculus
ggctggcatgaattcctggggcaga

SEQ ID NO: 951787 - DNA, 25 bp, Mus musculus
ggctggcccaatcactcagaagacc

SEQ ID NO: 951788 - DNA, 25 bp, Mus musculus
ggctggcccaatcagtcagaagacc

SEQ ID NO: 951789 - DNA, 25 bp, Mus musculus
ggctggccgccgcgccgtgtataag

SEQ ID NO: 951790 - DNA, 25 bp, Mus musculus
ggctggccgccgggccgtgtataag

SEQ ID NO: 951791 - DNA, 25 bp, Mus musculus
ggctggccggattggtggaggtagg

SEQ ID NO: 951792 - DNA, 25 bp, Mus musculus
ggctggccggtttggtggaggtagg

SEQ ID NO: 951793 - DNA, 25 bp, Mus musculus
ggctggcggtaacacagtactgttt

SEQ ID NO: 951794 - DNA, 25 bp, Mus musculus
ggctggcggtaacagagtactgttt

SEQ ID NO: 951795 - DNA, 25 bp, Mus musculus
ggctggctcagacgtgtctgcctta

SEQ ID NO: 951796 - DNA, 25 bp, Mus musculus
ggctggctcagaggtgtctgcctta

SEQ ID NO: 951797 - DNA, 25 bp, Mus musculus
ggctggctgacactcgcaccactcg

SEQ ID NO: 951798 - DNA, 25 bp, Mus musculus
ggctggctgacactggcaccactcg

SEQ ID NO: 951799 - DNA, 25 bp, Mus musculus
ggctggctggaagctgcctactgga

SEQ ID NO: 951800 - DNA, 25 bp, Mus musculus
ggctggctggctgcctactggacca

SEQ ID NO: 951801 - DNA, 25 bp, Mus musculus
ggctggctgggtgcctactggacca

SEQ ID NO: 951802 - DNA, 25 bp, Mus musculus
ggctggctggtagctgcctactgga

SEQ ID NO: 951803 - DNA, 25 bp, Mus musculus
ggctggcttacacacaaagcctatt

SEQ ID NO: 951804 - DNA, 25 bp, Mus musculus
ggctggcttacagacaaagcctatt

SEQ ID NO: 951805 - DNA, 25 bp, Mus musculus
ggctgggaagtgtccccagagaaac

SEQ ID NO: 951806 - DNA, 25 bp, Mus musculus
ggctgggaagtgtcccttccaacag

SEQ ID NO: 951807 - DNA, 25 bp, Mus musculus
ggctgggaagtgtcgccagagaaac

SEQ ID NO: 951808 - DNA, 25 bp, Mus musculus
ggctgggaagtgtcgcttccaacag

SEQ ID NO: 951809 - DNA, 25 bp, Mus musculus
ggctgggaccatcccgtccaagctc

SEQ ID NO: 951810 - DNA, 25 bp, Mus musculus
ggctgggaccatccggtccaagctc

SEQ ID NO: 951811 - DNA, 25 bp, Mus musculus
ggctgggaggtacacagagtgcaaa

SEQ ID NO: 951812 - DNA, 25 bp, Mus musculus
ggctgggaggtacagagagtgcaaa

SEQ ID NO: 951813 - DNA, 25 bp, Mus musculus
ggctgggatcatagtctgcgtggtg

SEQ ID NO: 951814 - DNA, 25 bp, Mus musculus
ggctgggatcattgtctgcgtggtg

SEQ ID NO: 951815 - DNA, 25 bp, Mus musculus
ggctgggcccagcaactgcatagga

SEQ ID NO: 951816 - DNA, 25 bp, Mus musculus
ggctgggcccaggaactgcatagga

SEQ ID NO: 951817 - DNA, 25 bp, Mus musculus
ggctggggacagatgtggctggtgg

SEQ ID NO: 951818 - DNA, 25 bp, Mus musculus
ggctggggacagttgtggctggtgg

SEQ ID NO: 951819 - DNA, 25 bp, Mus musculus
ggctggggtgcacaatttctgaagt

SEQ ID NO: 951820 - DNA, 25 bp, Mus musculus
ggctggggtgcagaatttctgaagt

SEQ ID NO: 951821 - DNA, 25 bp, Mus musculus
ggctgggtcggaagatttaggcccg

SEQ ID NO: 951822 - DNA, 25 bp, Mus musculus
ggctgggtcggaagttttaggcccg

SEQ ID NO: 951823 - DNA, 25 bp, Mus musculus
ggctggtacccgagctgatgtacct

SEQ ID NO: 951824 - DNA, 25 bp, Mus musculus
ggctggtacccgtgctgatgtacct

SEQ ID NO: 951825 - DNA, 25 bp, Mus musculus
ggctggtatctgaacacgctcatga

SEQ ID NO: 951826 - DNA, 25 bp, Mus musculus
ggctggtatctgaagacgctcatga

SEQ ID NO: 951827 - DNA, 25 bp, Mus musculus
ggctggtcagccgcgtgttccaaga

SEQ ID NO: 951828 - DNA, 25 bp, Mus musculus
ggctggtcaggcgcgtgttccaaga

SEQ ID NO: 951829 - DNA, 25 bp, Mus musculus
ggctgtatggcgatgagaatgaagt

SEQ ID NO: 951830 - DNA, 25 bp, Mus musculus
ggctgtatggcgccccgtgggacgt

SEQ ID NO: 951831 - DNA, 25 bp, Mus musculus
ggctgtatggcggcccgtgggacgt

SEQ ID NO: 951832 - DNA, 25 bp, Mus musculus
ggctgtatggcgttgagaatgaagt

SEQ ID NO: 951833 - DNA, 25 bp, Mus musculus
ggctgtatggctctgacagaagttg

SEQ ID NO: 951834 - DNA, 25 bp, Mus musculus
ggctgtatgggtctgacagaagttg

SEQ ID NO: 951835 - DNA, 25 bp, Mus musculus
ggctgtcaagagcttacgactcctc

SEQ ID NO: 951836 - DNA, 25 bp, Mus musculus
ggctgtcaagtgcttacgactcctc

SEQ ID NO: 951837 - DNA, 25 bp, Mus musculus
ggctgtcaccaacgaccccaactgg

SEQ ID NO: 951838 - DNA, 25 bp, Mus musculus
ggctgtcaccaaggaccccaactgg

SEQ ID NO: 951839 - DNA, 25 bp, Mus musculus
ggctgtcatagccacgttgcaaagg

SEQ ID NO: 951840 - DNA, 25 bp, Mus musculus
ggctgtcatagccaggttgcaaagg

SEQ ID NO: 951841 - DNA, 25 bp, Mus musculus
ggctgtccaacaggtgcgccaggag

SEQ ID NO: 951842 - DNA, 25 bp, Mus musculus
ggctgtccaagaggtgcgccaggag

SEQ ID NO: 951843 - DNA, 25 bp, Mus musculus
ggctgtcgcatccaagtcattgacc

SEQ ID NO: 951844 - DNA, 25 bp, Mus musculus
ggctgtcgcatccatgtcattgacc

SEQ ID NO: 951845 - DNA, 25 bp, Mus musculus
ggctgtctacaacgatggccgggcc

SEQ ID NO: 951846 - DNA, 25 bp, Mus musculus
ggctgtctacaaggatggccgggcc

SEQ ID NO: 951847 - DNA, 25 bp, Mus musculus
ggctgtctggcaaacacacagagca

SEQ ID NO: 951848 - DNA, 25 bp, Mus musculus
ggctgtctggcaaagacacagagca

SEQ ID NO: 951849 - DNA, 25 bp, Mus musculus
ggctgtgaagacgctgaaggacgcc

SEQ ID NO: 951850 - DNA, 25 bp, Mus musculus
ggctgtgaagccacccttgcctctc

SEQ ID NO: 951851 - DNA, 25 bp, Mus musculus
ggctgtgaagccaccttgtgggacc

SEQ ID NO: 951852 - DNA, 25 bp, Mus musculus
ggctgtgaagccacgcttgcctctc

SEQ ID NO: 951853 - DNA, 25 bp, Mus musculus
ggctgtgaagccacgttgtgggacc

SEQ ID NO: 951854 - DNA, 25 bp, Mus musculus
ggctgtgaagtcgctgaaggacgcc

SEQ ID NO: 951855 - DNA, 25 bp, Mus musculus
ggctgtgaatgaaataatagctact

SEQ ID NO: 951856 - DNA, 25 bp, Mus musculus
ggctgtgaatgatataatagctact

SEQ ID NO: 951857 - DNA, 25 bp, Mus musculus
ggctgtgaccgacatcaagatccac

SEQ ID NO: 951858 - DNA, 25 bp, Mus musculus
ggctgtgaccgacgttgaacatttc

SEQ ID NO: 951859 - DNA, 25 bp, Mus musculus
ggctgtgaccgagatcaagatccac

SEQ ID NO: 951860 - DNA, 25 bp, Mus musculus
ggctgtgaccgaggttgaacatttc

SEQ ID NO: 951861 - DNA, 25 bp, Mus musculus
ggctgtgacgagctgatattcagca

SEQ ID NO: 951862 - DNA, 25 bp, Mus musculus
ggctgtgacgaggtgatattcagca

SEQ ID NO: 951863 - DNA, 25 bp, Mus musculus
ggctgtgactttgcagtttcaccaa

SEQ ID NO: 951864 - DNA, 25 bp, Mus musculus
ggctgtgactttgctgtttcaccaa

SEQ ID NO: 951865 - DNA, 25 bp, Mus musculus
ggctgtgagccgctgatctctgggc

SEQ ID NO: 951866 - DNA, 25 bp, Mus musculus
ggctgtgagccggtgatctctgggc

SEQ ID NO: 951867 - DNA, 25 bp, Mus musculus
ggctgtgctctgcactgtgcaattt

SEQ ID NO: 951868 - DNA, 25 bp, Mus musculus
ggctgtgctctgcagtgtgcaattt

SEQ ID NO: 951869 - DNA, 25 bp, Mus musculus
ggctgtggagctgatgcctaagtct

SEQ ID NO: 951870 - DNA, 25 bp, Mus musculus
ggctgtggaggtgatgcctaagtct

SEQ ID NO: 951871 - DNA, 25 bp, Mus musculus
ggctgtggatattactgtgccactc

SEQ ID NO: 951872 - DNA, 25 bp, Mus musculus
ggctgtggatgtattactgtgccac

SEQ ID NO: 951873 - DNA, 25 bp, Mus musculus
ggctgtggatgttttactgtgccac

SEQ ID NO: 951874 - DNA, 25 bp, Mus musculus
ggctgtggattttactgtgccactc

SEQ ID NO: 951875 - DNA, 25 bp, Mus musculus
ggctgtggctttgtcggccctgtcg

SEQ ID NO: 951876 - DNA, 25 bp, Mus musculus
ggctgtggctttgtgggccctgtcg

SEQ ID NO: 951877 - DNA, 25 bp, Mus musculus
ggctgtgtgtcggacaggctggtcc

SEQ ID NO: 951878 - DNA, 25 bp, Mus musculus
ggctgtgtgtcggaccctccgaagt

SEQ ID NO: 951879 - DNA, 25 bp, Mus musculus
ggctgtgtgtcggagaggctggtcc

SEQ ID NO: 951880 - DNA, 25 bp, Mus musculus
ggctgtgtgtcggagcctccgaagt

SEQ ID NO: 951881 - DNA, 25 bp, Mus musculus
ggctgttacacgaaacaattcaaga

SEQ ID NO: 951882 - DNA, 25 bp, Mus musculus
ggctgttacacgtaacaattcaaga

SEQ ID NO: 951883 - DNA, 25 bp, Mus musculus
ggctgttattgaaacgtgacattcc

SEQ ID NO: 951884 - DNA, 25 bp, Mus musculus
ggctgttattgaaaggtgacattcc

SEQ ID NO: 951885 - DNA, 25 bp, Mus musculus
ggctgttcagaaggctgtgggctcc

SEQ ID NO: 951886 - DNA, 25 bp, Mus musculus
ggctgttcagctcctgctctccctc

SEQ ID NO: 951887 - DNA, 25 bp, Mus musculus
ggctgttcaggtcctgctctccctc

SEQ ID NO: 951888 - DNA, 25 bp, Mus musculus
ggctgttcagtaggctgtgggctcc

SEQ ID NO: 951889 - DNA, 25 bp, Mus musculus
ggctgttctaagacccacctgcctg

SEQ ID NO: 951890 - DNA, 25 bp, Mus musculus
ggctgttctaagtcccacctgcctg

SEQ ID NO: 951891 - DNA, 25 bp, Mus musculus
ggctgttgctgtgaacatgctcctt

SEQ ID NO: 951892 - DNA, 25 bp, Mus musculus
ggctgttgctgtgatcatgctcctt

SEQ ID NO: 951893 - DNA, 25 bp, Mus musculus
ggctgttggcagatctggcaggtga

SEQ ID NO: 951894 - DNA, 25 bp, Mus musculus
ggctgttggcagttctggcaggtga

SEQ ID NO: 951895 - DNA, 25 bp, Mus musculus
ggctgtttatcgatgaccaggaagt

SEQ ID NO: 951896 - DNA, 25 bp, Mus musculus
ggctgtttatggatgaccaggaagt

SEQ ID NO: 951897 - DNA, 25 bp, Mus musculus
ggctgtttccagcttgtccattggc

SEQ ID NO: 951898 - DNA, 25 bp, Mus musculus
ggctgtttcctgcttgtccattggc

SEQ ID NO: 951899 - DNA, 25 bp, Mus musculus
ggctgttttgcgcaaaacacggcat

SEQ ID NO: 951900 - DNA, 25 bp, Mus musculus
ggctgttttgcggaaaacacggcat

SEQ ID NO: 951901 - DNA, 25 bp, Mus musculus
ggcttaaaagccgaagaagcaggca

SEQ ID NO: 951902 - DNA, 25 bp, Mus musculus
ggcttaaaagctcgtgtggccagca

SEQ ID NO: 951903 - DNA, 25 bp, Mus musculus
ggcttaaaaggcgaagaagcaggca

SEQ ID NO: 951904 - DNA, 25 bp, Mus musculus
ggcttaaaaggtcgtgtggccagca

SEQ ID NO: 951905 - DNA, 25 bp, Mus musculus
ggcttaaagaggccttggggcatat

SEQ ID NO: 951906 - DNA, 25 bp, Mus musculus
ggcttaaagagggcttggggcatat

SEQ ID NO: 951907 - DNA, 25 bp, Mus musculus
ggcttaacagaaaacgagtgtgtga

SEQ ID NO: 951908 - DNA, 25 bp, Mus musculus
ggcttaacagaaaaggagtgtgtga

SEQ ID NO: 951909 - DNA, 25 bp, Mus musculus
ggcttaacagaacaggagtgtgtga

SEQ ID NO: 951910 - DNA, 25 bp, Mus musculus
ggcttaacagaagaggagtgtgtga

SEQ ID NO: 951911 - DNA, 25 bp, Mus musculus
ggcttaactgcttgcgttctccata

SEQ ID NO: 951912 - DNA, 25 bp, Mus musculus
ggcttaactgcttgggttctccata

SEQ ID NO: 951913 - DNA, 25 bp, Mus musculus
ggcttacagtggaatgggcctgctc

SEQ ID NO: 951914 - DNA, 25 bp, Mus musculus
ggcttacagtggcaagacatgggat

SEQ ID NO: 951915 - DNA, 25 bp, Mus musculus
ggcttacagtgggaagacatgggat

SEQ ID NO: 951916 - DNA, 25 bp, Mus musculus
ggcttacagtggtatgggcctgctc

SEQ ID NO: 951917 - DNA, 25 bp, Mus musculus
ggcttaccaagcctcgaatctggtg

SEQ ID NO: 951918 - DNA, 25 bp, Mus musculus
ggcttaccaagcctggaatctggtg

SEQ ID NO: 951919 - DNA, 25 bp, Mus musculus
ggcttatctgagctggggaaagatc

SEQ ID NO: 951920 - DNA, 25 bp, Mus musculus
ggcttatctgaggtggggaaagatc

SEQ ID NO: 951921 - DNA, 25 bp, Mus musculus
ggcttatctgatccctatgtaaaga

SEQ ID NO: 951922 - DNA, 25 bp, Mus musculus
ggcttatctgttccctatgtaaaga

SEQ ID NO: 951923 - DNA, 25 bp, Mus musculus
ggcttatgaacacatcaagcgggcc

SEQ ID NO: 951924 - DNA, 25 bp, Mus musculus
ggcttatgaacagatcaagcgggcc

SEQ ID NO: 951925 - DNA, 25 bp, Mus musculus
ggcttatgcccacctcatccttgga

SEQ ID NO: 951926 - DNA, 25 bp, Mus musculus
ggcttatgcccagctcatccttgga

SEQ ID NO: 951927 - DNA, 25 bp, Mus musculus
ggcttatgtccaccagatctccaag

SEQ ID NO: 951928 - DNA, 25 bp, Mus musculus
ggcttatgtccacctgatctccaag

SEQ ID NO: 951929 - DNA, 25 bp, Mus musculus
ggcttcaagagacacgcagagatgc

SEQ ID NO: 951930 - DNA, 25 bp, Mus musculus
ggcttcaagagacaggcagagatgc

SEQ ID NO: 951931 - DNA, 25 bp, Mus musculus
ggcttcaatatgcaatctttctgac

SEQ ID NO: 951932 - DNA, 25 bp, Mus musculus
ggcttcaatatggaatctttctgac

SEQ ID NO: 951933 - DNA, 25 bp, Mus musculus
ggcttcacagaacgcagaggtcatc

SEQ ID NO: 951934 - DNA, 25 bp, Mus musculus
ggcttcacagaaggcagaggtcatc

SEQ ID NO: 951935 - DNA, 25 bp, Mus musculus
ggcttcaccccacgtgaacaccttt

SEQ ID NO: 951936 - DNA, 25 bp, Mus musculus
ggcttcaccccacgtttgtatggag

SEQ ID NO: 951937 - DNA, 25 bp, Mus musculus
ggcttcaccccaggtgaacaccttt

SEQ ID NO: 951938 - DNA, 25 bp, Mus musculus
ggcttcaccccaggtttgtatggag

SEQ ID NO: 951939 - DNA, 25 bp, Mus musculus
ggcttcagtgcccctaattgccaga

SEQ ID NO: 951940 - DNA, 25 bp, Mus musculus
ggcttcagtggaccaaattttcagg

SEQ ID NO: 951941 - DNA, 25 bp, Mus musculus
ggcttcagtggacctaattttcagg

SEQ ID NO: 951942 - DNA, 25 bp, Mus musculus
ggcttcagtggccctaattgccaga

SEQ ID NO: 951943 - DNA, 25 bp, Mus musculus
ggcttcattggacgtttaggattag

SEQ ID NO: 951944 - DNA, 25 bp, Mus musculus
ggcttcattggaggtttaggattag

SEQ ID NO: 951945 - DNA, 25 bp, Mus musculus
ggcttccaacatactgcagggttgt

SEQ ID NO: 951946 - DNA, 25 bp, Mus musculus
ggcttccaacattctgcagggttgt

SEQ ID NO: 951947 - DNA, 25 bp, Mus musculus
ggcttcccaaaaatgtatccatcga

SEQ ID NO: 951948 - DNA, 25 bp, Mus musculus
ggcttcccaaaattgtatccatcga

SEQ ID NO: 951949 - DNA, 25 bp, Mus musculus
ggcttcccagatcaatgcactgatc

SEQ ID NO: 951950 - DNA, 25 bp, Mus musculus
ggcttcccagatgaatgcactgatc

SEQ ID NO: 951951 - DNA, 25 bp, Mus musculus
ggcttccctccgactcctctgcaag

SEQ ID NO: 951952 - DNA, 25 bp, Mus musculus
ggcttccctccgtctcctctgcaag

SEQ ID NO: 951953 - DNA, 25 bp, Mus musculus
ggcttccggaaaccaatttcctgcc

SEQ ID NO: 951954 - DNA, 25 bp, Mus musculus
ggcttccggaaagcaatttcctgcc

SEQ ID NO: 951955 - DNA, 25 bp, Mus musculus
ggcttccggaacggcctatggagtc

SEQ ID NO: 951956 - DNA, 25 bp, Mus musculus
ggcttccggaacgggctatggagtc

SEQ ID NO: 951957 - DNA, 25 bp, Mus musculus
ggcttccggaagcaactggtgagca

SEQ ID NO: 951958 - DNA, 25 bp, Mus musculus
ggcttccggaagccctctggattct

SEQ ID NO: 951959 - DNA, 25 bp, Mus musculus
ggcttccggaaggaactggtgagca

SEQ ID NO: 951960 - DNA, 25 bp, Mus musculus
ggcttccggaaggcctctggattct

SEQ ID NO: 951961 - DNA, 25 bp, Mus musculus
ggcttccgtatcaatttctgccaaa

SEQ ID NO: 951962 - DNA, 25 bp, Mus musculus
ggcttccgtatctatttctgccaaa

SEQ ID NO: 951963 - DNA, 25 bp, Mus musculus
ggcttcctacaacatggacgtggac

SEQ ID NO: 951964 - DNA, 25 bp, Mus musculus
ggcttcctacaagatggacgtggac

SEQ ID NO: 951965 - DNA, 25 bp, Mus musculus
ggcttcctgcctcgcacggcgcagg

SEQ ID NO: 951966 - DNA, 25 bp, Mus musculus
ggcttcctgcctggcacggcgcagg

SEQ ID NO: 951967 - DNA, 25 bp, Mus musculus
ggcttcctggatctccagaaggatg

SEQ ID NO: 951968 - DNA, 25 bp, Mus musculus
ggcttcctggatgacgcattcgtga

SEQ ID NO: 951969 - DNA, 25 bp, Mus musculus
ggcttcctggatgaggcattcgtga

SEQ ID NO: 951970 - DNA, 25 bp, Mus musculus
ggcttcctggatgtccagaaggatg

SEQ ID NO: 951971 - DNA, 25 bp, Mus musculus
ggcttcgcaatgcgcatcgcaggca

SEQ ID NO: 951972 - DNA, 25 bp, Mus musculus
ggcttcgcaatgggcatcgcaggca

SEQ ID NO: 951973 - DNA, 25 bp, Mus musculus
ggcttcgcctggcgatggaacaaaa

SEQ ID NO: 951974 - DNA, 25 bp, Mus musculus
ggcttcgcctggggatggaacaaaa

SEQ ID NO: 951975 - DNA, 25 bp, Mus musculus
ggcttcgcgcaccaccattctcgtg

SEQ ID NO: 951976 - DNA, 25 bp, Mus musculus
ggcttcgcgcaccagcattctcgtg

SEQ ID NO: 951977 - DNA, 25 bp, Mus musculus
ggcttcgggtgacaaggaagaggtt

SEQ ID NO: 951978 - DNA, 25 bp, Mus musculus
ggcttcgggtgagaaggaagaggtt

SEQ ID NO: 951979 - DNA, 25 bp, Mus musculus
ggcttcgtcggagacgtgctgaatg

SEQ ID NO: 951980 - DNA, 25 bp, Mus musculus
ggcttcgtcggagaggtgctgaatg

SEQ ID NO: 951981 - DNA, 25 bp, Mus musculus
ggcttctagacccacgagttttgct

SEQ ID NO: 951982 - DNA, 25 bp, Mus musculus
ggcttctagacccaggagttttgct

SEQ ID NO: 951983 - DNA, 25 bp, Mus musculus
ggcttctcagaactgtattcacaga

SEQ ID NO: 951984 - DNA, 25 bp, Mus musculus
ggcttctcagaagtgtattcacaga

SEQ ID NO: 951985 - DNA, 25 bp, Mus musculus
ggcttctccaccagtcctgagtccc

SEQ ID NO: 951986 - DNA, 25 bp, Mus musculus
ggcttctccacctgtcctgagtccc

SEQ ID NO: 951987 - DNA, 25 bp, Mus musculus
ggcttctccactccatttgctgaat

SEQ ID NO: 951988 - DNA, 25 bp, Mus musculus
ggcttctccactgcatttgctgaat

SEQ ID NO: 951989 - DNA, 25 bp, Mus musculus
ggcttctgagcacccagttctggag

SEQ ID NO: 951990 - DNA, 25 bp, Mus musculus
ggcttctgagcacgttctgaaggag

SEQ ID NO: 951991 - DNA, 25 bp, Mus musculus
ggcttctgagcacgttgccccgttg

SEQ ID NO: 951992 - DNA, 25 bp, Mus musculus
ggcttctgagcacttctggagccca

SEQ ID NO: 951993 - DNA, 25 bp, Mus musculus
ggcttctgagcagccagttctggag

SEQ ID NO: 951994 - DNA, 25 bp, Mus musculus
ggcttctgagcaggttctgaaggag

SEQ ID NO: 951995 - DNA, 25 bp, Mus musculus
ggcttctgagcaggttgccccgttg

SEQ ID NO: 951996 - DNA, 25 bp, Mus musculus
ggcttctgagcagttctggagccca

SEQ ID NO: 951997 - DNA, 25 bp, Mus musculus
ggcttcttatggctaccatcggttc

SEQ ID NO: 951998 - DNA, 25 bp, Mus musculus
ggcttcttatgggtaccatcggttc

SEQ ID NO: 951999 - DNA, 25 bp, Mus musculus
ggcttcttccagcccttcatgtcac

SEQ ID NO: 952000 - DNA, 25 bp, Mus musculus
ggcttcttccaggccttcatgtcac

SEQ ID NO: 952001 - DNA, 25 bp, Mus musculus
ggcttgaagcctactctgttagaag

SEQ ID NO: 952002 - DNA, 25 bp, Mus musculus
ggcttgaagccttctctgttagaag

SEQ ID NO: 952003 - DNA, 25 bp, Mus musculus
ggcttgatagtgagattggcagact

SEQ ID NO: 952004 - DNA, 25 bp, Mus musculus
ggcttgatagtgtgattggcagact

SEQ ID NO: 952005 - DNA, 25 bp, Mus musculus
ggcttgatgatacactgcatgtggt

SEQ ID NO: 952006 - DNA, 25 bp, Mus musculus
ggcttgatgatacagtgcatgtggt

SEQ ID NO: 952007 - DNA, 25 bp, Mus musculus
ggcttgcctgcaagccttctcattg

SEQ ID NO: 952008 - DNA, 25 bp, Mus musculus
ggcttgcctgcatgccttctcattg

SEQ ID NO: 952009 - DNA, 25 bp, Mus musculus
ggcttgcggctaagtagtgtgtgcc

SEQ ID NO: 952010 - DNA, 25 bp, Mus musculus
ggcttgcggctatgtagtgtgtgcc

SEQ ID NO: 952011 - DNA, 25 bp, Mus musculus
ggcttgctgaaaaacacaactggcc

SEQ ID NO: 952012 - DNA, 25 bp, Mus musculus
ggcttgctgaaaaagacaactggcc

SEQ ID NO: 952013 - DNA, 25 bp, Mus musculus
ggcttggaatgacactgcagatctt

SEQ ID NO: 952014 - DNA, 25 bp, Mus musculus
ggcttggaatgagactgcagatctt

SEQ ID NO: 952015 - DNA, 25 bp, Mus musculus
ggcttggactgtgacgcttctttgg

SEQ ID NO: 952016 - DNA, 25 bp, Mus musculus
ggcttggactgtgactaggcttctt

SEQ ID NO: 952017 - DNA, 25 bp, Mus musculus
ggcttggactgtgaggcttctttgg

SEQ ID NO: 952018 - DNA, 25 bp, Mus musculus
ggcttggactgtgagtaggcttctt

SEQ ID NO: 952019 - DNA, 25 bp, Mus musculus
ggcttggagcggattgggggcttgg

SEQ ID NO: 952020 - DNA, 25 bp, Mus musculus
ggcttggagcggtttgggggcttgg

SEQ ID NO: 952021 - DNA, 25 bp, Mus musculus
ggcttgtgagcgtgactacgggggc

SEQ ID NO: 952022 - DNA, 25 bp, Mus musculus
ggcttgtgagggtgactacgggggc

SEQ ID NO: 952023 - DNA, 25 bp, Mus musculus
ggcttgttagaggcactgtcaccgc

SEQ ID NO: 952024 - DNA, 25 bp, Mus musculus
ggcttgttagtggcactgtcaccgc

SEQ ID NO: 952025 - DNA, 25 bp, Mus musculus
ggctttagcaagagcatggtcaata

SEQ ID NO: 952026 - DNA, 25 bp, Mus musculus
ggctttagcaagccccgcggccatg

SEQ ID NO: 952027 - DNA, 25 bp, Mus musculus
ggctttagcaaggcccgcggccatg

SEQ ID NO: 952028 - DNA, 25 bp, Mus musculus
ggctttagcaagtgcatggtcaata

SEQ ID NO: 952029 - DNA, 25 bp, Mus musculus
ggctttcaagatgtggagctcctgg

SEQ ID NO: 952030 - DNA, 25 bp, Mus musculus
ggctttcaagcgaacaaagaatcgg

SEQ ID NO: 952031 - DNA, 25 bp, Mus musculus
ggctttcaagggaacaaagaatcgg

SEQ ID NO: 952032 - DNA, 25 bp, Mus musculus
ggctttcaagttgtggagctcctgg

SEQ ID NO: 952033 - DNA, 25 bp, Mus musculus
ggctttccagcaagatgtgagctta

SEQ ID NO: 952034 - DNA, 25 bp, Mus musculus
ggctttccagcatgatgtgagctta

SEQ ID NO: 952035 - DNA, 25 bp, Mus musculus
ggctttccagccatggccatgcaaa

SEQ ID NO: 952036 - DNA, 25 bp, Mus musculus
ggctttccagctccagcacctgcct

SEQ ID NO: 952037 - DNA, 25 bp, Mus musculus
ggctttccaggcatggccatgcaaa

SEQ ID NO: 952038 - DNA, 25 bp, Mus musculus
ggctttccaggtccagcacctgcct

SEQ ID NO: 952039 - DNA, 25 bp, Mus musculus
ggctttccccagcccctccatgatg

SEQ ID NO: 952040 - DNA, 25 bp, Mus musculus
ggctttccccaggccctccatgatg

SEQ ID NO: 952041 - DNA, 25 bp, Mus musculus
ggctttccttccagtaacgttcatg

SEQ ID NO: 952042 - DNA, 25 bp, Mus musculus
ggctttccttcctgtaacgttcatg

SEQ ID NO: 952043 - DNA, 25 bp, Mus musculus
ggctttctacaacggatttatcaaa

SEQ ID NO: 952044 - DNA, 25 bp, Mus musculus
ggctttctacaagggatttatcaaa

SEQ ID NO: 952045 - DNA, 25 bp, Mus musculus
ggctttctactccgcccatggtgcg

SEQ ID NO: 952046 - DNA, 25 bp, Mus musculus
ggctttctactccggccatggtgcg

SEQ ID NO: 952047 - DNA, 25 bp, Mus musculus
ggctttctatagagctgggctcgtc

SEQ ID NO: 952048 - DNA, 25 bp, Mus musculus
ggctttctatagtgctgggctcgtc

SEQ ID NO: 952049 - DNA, 25 bp, Mus musculus
ggctttctgccactgatttgagcaa

SEQ ID NO: 952050 - DNA, 25 bp, Mus musculus
ggctttctgccagtgatttgagcaa

SEQ ID NO: 952051 - DNA, 25 bp, Mus musculus
ggctttctggagcgagttggtggaa

SEQ ID NO: 952052 - DNA, 25 bp, Mus musculus
ggctttctggagggagttggtggaa

SEQ ID NO: 952053 - DNA, 25 bp, Mus musculus
ggctttgaaaccaacgcattctctg

SEQ ID NO: 952054 - DNA, 25 bp, Mus musculus
ggctttgaaaccaaggcattctctg

SEQ ID NO: 952055 - DNA, 25 bp, Mus musculus
ggctttgaagatattgctattggtg

SEQ ID NO: 952056 - DNA, 25 bp, Mus musculus
ggctttgaagttattgctattggtg

SEQ ID NO: 952057 - DNA, 25 bp, Mus musculus
ggctttgatgatctattggatgata

SEQ ID NO: 952058 - DNA, 25 bp, Mus musculus
ggctttgatgatcttttggatgata

SEQ ID NO: 952059 - DNA, 25 bp, Mus musculus
ggctttgccgcccaccaggtgccca

SEQ ID NO: 952060 - DNA, 25 bp, Mus musculus
ggctttgccgcccagcaggtgccca

SEQ ID NO: 952061 - DNA, 25 bp, Mus musculus
ggctttgctgaatgaagtaaactat

SEQ ID NO: 952062 - DNA, 25 bp, Mus musculus
ggctttgctgtatgaagtaaactat

SEQ ID NO: 952063 - DNA, 25 bp, Mus musculus
ggctttggagctagaggaggcttcc

SEQ ID NO: 952064 - DNA, 25 bp, Mus musculus
ggctttggagctcctgatggtttga

SEQ ID NO: 952065 - DNA, 25 bp, Mus musculus
ggctttggagctcggtgagctggta

SEQ ID NO: 952066 - DNA, 25 bp, Mus musculus
ggctttggaggtagaggaggcttcc

SEQ ID NO: 952067 - DNA, 25 bp, Mus musculus
ggctttggaggtcctgatggtttga

SEQ ID NO: 952068 - DNA, 25 bp, Mus musculus
ggctttggaggtcggtgagctggta

SEQ ID NO: 952069 - DNA, 25 bp, Mus musculus
ggctttggcactaacggccaggtcg

SEQ ID NO: 952070 - DNA, 25 bp, Mus musculus
ggctttggcagtaacggccaggtcg

SEQ ID NO: 952071 - DNA, 25 bp, Mus musculus
ggctttgggtcacatgatccctatt

SEQ ID NO: 952072 - DNA, 25 bp, Mus musculus
ggctttgggtcagatgatccctatt

SEQ ID NO: 952073 - DNA, 25 bp, Mus musculus
ggcttttcctgcaactgtgtggctg

SEQ ID NO: 952074 - DNA, 25 bp, Mus musculus
ggcttttcctgcaagtgtgtggctg

SEQ ID NO: 952075 - DNA, 25 bp, Mus musculus
ggcttttgcagacgtttcctggcag

SEQ ID NO: 952076 - DNA, 25 bp, Mus musculus
ggcttttgcagaggtttcctggcag

SEQ ID NO: 952077 - DNA, 25 bp, Mus musculus
ggcttttgccaaagagataccgatg

SEQ ID NO: 952078 - DNA, 25 bp, Mus musculus
ggcttttgccaaagtgataccgatg

SEQ ID NO: 952079 - DNA, 25 bp, Mus musculus
ggcttttggaagagaagtttggtga

SEQ ID NO: 952080 - DNA, 25 bp, Mus musculus
ggcttttggaagtgaagtttggtga

SEQ ID NO: 952081 - DNA, 25 bp, Mus musculus
ggctttttttggcccgacgagcaat

SEQ ID NO: 952082 - DNA, 25 bp, Mus musculus
ggctttttttggccggacgagcaat

SEQ ID NO: 952083 - DNA, 25 bp, Mus musculus
gggaaaactgtccggccaggtatca

SEQ ID NO: 952084 - DNA, 25 bp, Mus musculus
gggaaaactgtcgggccaggtatca

SEQ ID NO: 952085 - DNA, 25 bp, Mus musculus
gggaaaagagctcgattctaatccc

SEQ ID NO: 952086 - DNA, 25 bp, Mus musculus
gggaaaagagctggattctaatccc

SEQ ID NO: 952087 - DNA, 25 bp, Mus musculus
gggaaaagcacaggatggtagcagc

SEQ ID NO: 952088 - DNA, 25 bp, Mus musculus
gggaaaagcagaggatggtagcagc

SEQ ID NO: 952089 - DNA, 25 bp, Mus musculus
gggaaactggtacactacaatatct

SEQ ID NO: 952090 - DNA, 25 bp, Mus musculus
gggaaactggtacagtacaatatct

SEQ ID NO: 952091 - DNA, 25 bp, Mus musculus
gggaaagaagatgaaagcagaagtc

SEQ ID NO: 952092 - DNA, 25 bp, Mus musculus
gggaaagaagcttacccatgcagtt

SEQ ID NO: 952093 - DNA, 25 bp, Mus musculus
gggaaagaaggttacccatgcagtt

SEQ ID NO: 952094 - DNA, 25 bp, Mus musculus
gggaaagaagttgaaagcagaagtc

SEQ ID NO: 952095 - DNA, 25 bp, Mus musculus
gggaaagaccagcccatcattcttg

SEQ ID NO: 952096 - DNA, 25 bp, Mus musculus
gggaaagaccaggccatcattcttg

SEQ ID NO: 952097 - DNA, 25 bp, Mus musculus
gggaaagcaccgtgcgcgcagagtg

SEQ ID NO: 952098 - DNA, 25 bp, Mus musculus
gggaaagcaccgtgggcgcagagtg

SEQ ID NO: 952099 - DNA, 25 bp, Mus musculus
gggaaagcagatgatgctgcagccc

SEQ ID NO: 952100 - DNA, 25 bp, Mus musculus
gggaaagcagcttcgacttcatcta

SEQ ID NO: 952101 - DNA, 25 bp, Mus musculus
gggaaagcaggttcgacttcatcta

SEQ ID NO: 952102 - DNA, 25 bp, Mus musculus
gggaaagcagttgatgctgcagccc

SEQ ID NO: 952103 - DNA, 25 bp, Mus musculus
gggaaagccaagatgccagaccagt

SEQ ID NO: 952104 - DNA, 25 bp, Mus musculus
gggaaagccaagttgccagaccagt

SEQ ID NO: 952105 - DNA, 25 bp, Mus musculus
gggaaagcgagaagctagtcaagaa

SEQ ID NO: 952106 - DNA, 25 bp, Mus musculus
gggaaagcgagatgctagtcaagaa

SEQ ID NO: 952107 - DNA, 25 bp, Mus musculus
gggaaagctgatcaatgcacccttg

SEQ ID NO: 952108 - DNA, 25 bp, Mus musculus
gggaaagctgatgaatgcacccttg

SEQ ID NO: 952109 - DNA, 25 bp, Mus musculus
gggaaagctgctggaaagtgagacc

SEQ ID NO: 952110 - DNA, 25 bp, Mus musculus
gggaaagctggtggaaagtgagacc

SEQ ID NO: 952111 - DNA, 25 bp, Mus musculus
gggaaaggtgaacgctgctggttgt

SEQ ID NO: 952112 - DNA, 25 bp, Mus musculus
gggaaaggtgaaggctgctggttgt

SEQ ID NO: 952113 - DNA, 25 bp, Mus musculus
gggaaagtgaagcactttctcagat

SEQ ID NO: 952114 - DNA, 25 bp, Mus musculus
gggaaagtgaaggactttctcagat

SEQ ID NO: 952115 - DNA, 25 bp, Mus musculus
gggaaatggattctagtcctgttgt

SEQ ID NO: 952116 - DNA, 25 bp, Mus musculus
gggaaatggattcttgtcctgttgt

SEQ ID NO: 952117 - DNA, 25 bp, Mus musculus
gggaaattacagcctctgcaaagtt

SEQ ID NO: 952118 - DNA, 25 bp, Mus musculus
gggaaattacaggctctgcaaagtt

SEQ ID NO: 952119 - DNA, 25 bp, Mus musculus
gggaacaagctaaacgccatgagag

SEQ ID NO: 952120 - DNA, 25 bp, Mus musculus
gggaacaagctaaaggccatgagag

SEQ ID NO: 952121 - DNA, 25 bp, Mus musculus
gggaacacatcacggagagaccagc

SEQ ID NO: 952122 - DNA, 25 bp, Mus musculus
gggaacacatcagggagagaccagc

SEQ ID NO: 952123 - DNA, 25 bp, Mus musculus
gggaacagaacacgaaacaatggtc

SEQ ID NO: 952124 - DNA, 25 bp, Mus musculus
gggaacagaacaggaaacaatggtc

SEQ ID NO: 952125 - DNA, 25 bp, Mus musculus
gggaacagagcactctggggcctgg

SEQ ID NO: 952126 - DNA, 25 bp, Mus musculus
gggaacagaggactctggggcctgg

SEQ ID NO: 952127 - DNA, 25 bp, Mus musculus
gggaacagccttagctacatcaaaa

SEQ ID NO: 952128 - DNA, 25 bp, Mus musculus
gggaacagcctttgctacatcaaaa

SEQ ID NO: 952129 - DNA, 25 bp, Mus musculus
gggaacatgaagttcgtgagcccga

SEQ ID NO: 952130 - DNA, 25 bp, Mus musculus
gggaacatgaagttggtgagcccga

SEQ ID NO: 952131 - DNA, 25 bp, Mus musculus
gggaaccggcctgcagatgtgtatt

SEQ ID NO: 952132 - DNA, 25 bp, Mus musculus
gggaaccggcctgctgatgtgtatt

SEQ ID NO: 952133 - DNA, 25 bp, Mus musculus
gggaaccggcggcacgatgtgtgac

SEQ ID NO: 952134 - DNA, 25 bp, Mus musculus
gggaaccggcggcaggatgtgtgac

SEQ ID NO: 952135 - DNA, 25 bp, Mus musculus
gggaacgcatcgaattgacgacagt

SEQ ID NO: 952136 - DNA, 25 bp, Mus musculus
gggaacgcatcgtattgacgacagt

SEQ ID NO: 952137 - DNA, 25 bp, Mus musculus
gggaacgtactaaaactgtgcaggg

SEQ ID NO: 952138 - DNA, 25 bp, Mus musculus
gggaacgtactaaatctgtgcaggg

SEQ ID NO: 952139 - DNA, 25 bp, Mus musculus
gggaagaagactcacctctcatccg

SEQ ID NO: 952140 - DNA, 25 bp, Mus musculus
gggaagaagactcagctctcatccg

SEQ ID NO: 952141 - DNA, 25 bp, Mus musculus
gggaagactccaattcattgcttct

SEQ ID NO: 952142 - DNA, 25 bp, Mus musculus
gggaagactccatttcattgcttct

SEQ ID NO: 952143 - DNA, 25 bp, Mus musculus
gggaagaggtcaaacaggcgccagc

SEQ ID NO: 952144 - DNA, 25 bp, Mus musculus
gggaagaggtcaaagaggcgccagc

SEQ ID NO: 952145 - DNA, 25 bp, Mus musculus
gggaagagtgagtcctgagttgcat

SEQ ID NO: 952146 - DNA, 25 bp, Mus musculus
gggaagagtgccatgacaatgcagt

SEQ ID NO: 952147 - DNA, 25 bp, Mus musculus
gggaagagtggcatgacaatgcagt

SEQ ID NO: 952148 - DNA, 25 bp, Mus musculus
gggaagagtgtgtcctgagttgcat

SEQ ID NO: 952149 - DNA, 25 bp, Mus musculus
gggaagagtttaaacgttgacatga

SEQ ID NO: 952150 - DNA, 25 bp, Mus musculus
gggaagagtttaaaggttgacatga

SEQ ID NO: 952151 - DNA, 25 bp, Mus musculus
gggaagattcggatccctaccgtgg

SEQ ID NO: 952152 - DNA, 25 bp, Mus musculus
gggaagattcggttccctaccgtgg

SEQ ID NO: 952153 - DNA, 25 bp, Mus musculus
gggaagatttgacaaagaacgagtg

SEQ ID NO: 952154 - DNA, 25 bp, Mus musculus
gggaagatttgagaaagaacgagtg

SEQ ID NO: 952155 - DNA, 25 bp, Mus musculus
gggaagcctggcaacggctactgac

SEQ ID NO: 952156 - DNA, 25 bp, Mus musculus
gggaagcctggcaagggctactgac

SEQ ID NO: 952157 - DNA, 25 bp, Mus musculus
gggaagctggccttcaacctggact

SEQ ID NO: 952158 - DNA, 25 bp, Mus musculus
gggaagctgggcttcaacctggact

SEQ ID NO: 952159 - DNA, 25 bp, Mus musculus
gggaagctgtcaccattctgcctac

SEQ ID NO: 952160 - DNA, 25 bp, Mus musculus
gggaagctgtcacttctgagaagtc

SEQ ID NO: 952161 - DNA, 25 bp, Mus musculus
gggaagctgtcagcattctgcctac

SEQ ID NO: 952162 - DNA, 25 bp, Mus musculus
gggaagctgtcagttctgagaagtc

SEQ ID NO: 952163 - DNA, 25 bp, Mus musculus
gggaagctgtgaacttcaggaccat

SEQ ID NO: 952164 - DNA, 25 bp, Mus musculus
gggaagctgtgatcttcaggaccat

SEQ ID NO: 952165 - DNA, 25 bp, Mus musculus
gggaaggaagaagatcaggttttct

SEQ ID NO: 952166 - DNA, 25 bp, Mus musculus
gggaaggaagtagatcaggttttct

SEQ ID NO: 952167 - DNA, 25 bp, Mus musculus
gggaaggaagtcggcgagatcctgt

SEQ ID NO: 952168 - DNA, 25 bp, Mus musculus
gggaaggaagtcggggagatcctgt

SEQ ID NO: 952169 - DNA, 25 bp, Mus musculus
gggaaggacattggaaccgagtgca

SEQ ID NO: 952170 - DNA, 25 bp, Mus musculus
gggaaggacattggtaccgagtgca

SEQ ID NO: 952171 - DNA, 25 bp, Mus musculus
gggaaggaccacaaagatctggcta

SEQ ID NO: 952172 - DNA, 25 bp, Mus musculus
gggaaggaccactaagatctggcta

SEQ ID NO: 952173 - DNA, 25 bp, Mus musculus
gggaaggatgaacattcctatcaca

SEQ ID NO: 952174 - DNA, 25 bp, Mus musculus
gggaaggatgaagattcctatcaca

SEQ ID NO: 952175 - DNA, 25 bp, Mus musculus
gggaagggacggagtcagtgtgctg

SEQ ID NO: 952176 - DNA, 25 bp, Mus musculus
gggaagggacggtgtcagtgtgctg

SEQ ID NO: 952177 - DNA, 25 bp, Mus musculus
gggaaggtgaagaagcttggacagg

SEQ ID NO: 952178 - DNA, 25 bp, Mus musculus
gggaaggtgaagtagcttggacagg

SEQ ID NO: 952179 - DNA, 25 bp, Mus musculus
gggaagtatggatgcgtacctggaa

SEQ ID NO: 952180 - DNA, 25 bp, Mus musculus
gggaagtatggatgggtacctggaa

SEQ ID NO: 952181 - DNA, 25 bp, Mus musculus
gggaagtctcagctgtcggtgacgt

SEQ ID NO: 952182 - DNA, 25 bp, Mus musculus
gggaagtctcaggtgtcggtgacgt

SEQ ID NO: 952183 - DNA, 25 bp, Mus musculus
gggaagtggtctctatcttcctgac

SEQ ID NO: 952184 - DNA, 25 bp, Mus musculus
gggaagtggtctgtatcttcctgac

SEQ ID NO: 952185 - DNA, 25 bp, Mus musculus
gggaatagtctgagctgcgtacgac

SEQ ID NO: 952186 - DNA, 25 bp, Mus musculus
gggaatagtctgtgctgcgtacgac

SEQ ID NO: 952187 - DNA, 25 bp, Mus musculus
gggaatcatacaagacgcctttgac

SEQ ID NO: 952188 - DNA, 25 bp, Mus musculus
gggaatcatacatgacgcctttgac

SEQ ID NO: 952189 - DNA, 25 bp, Mus musculus
gggaatgaccctgactacatcgtca

SEQ ID NO: 952190 - DNA, 25 bp, Mus musculus
gggaatgaccgtgactacatcgtca

SEQ ID NO: 952191 - DNA, 25 bp, Mus musculus
gggaatgcacagcagagaaatgtca

SEQ ID NO: 952192 - DNA, 25 bp, Mus musculus
gggaatgcacagcagcagtgcacaa

SEQ ID NO: 952193 - DNA, 25 bp, Mus musculus
gggaatgcacagcagtgcacaaacg

SEQ ID NO: 952194 - DNA, 25 bp, Mus musculus
gggaatgcacaggagagaaatgtca

SEQ ID NO: 952195 - DNA, 25 bp, Mus musculus
gggaatgcacaggagcagtgcacaa

SEQ ID NO: 952196 - DNA, 25 bp, Mus musculus
gggaatgcacaggagtgcacaaacg

SEQ ID NO: 952197 - DNA, 25 bp, Mus musculus
gggaatgggagacatgcagaaagag

SEQ ID NO: 952198 - DNA, 25 bp, Mus musculus
gggaatgggagaccttttgcctacc

SEQ ID NO: 952199 - DNA, 25 bp, Mus musculus
gggaatgggagagatgcagaaagag

SEQ ID NO: 952200 - DNA, 25 bp, Mus musculus
gggaatgggagagcttttgcctacc

SEQ ID NO: 952201 - DNA, 25 bp, Mus musculus
gggaattataaaaacgcacagaaga

SEQ ID NO: 952202 - DNA, 25 bp, Mus musculus
gggaattataaaaaggcacagaaga

SEQ ID NO: 952203 - DNA, 25 bp, Mus musculus
gggaattcatatgactgtgatgagc

SEQ ID NO: 952204 - DNA, 25 bp, Mus musculus
gggaattcatctctgcccggacaaa

SEQ ID NO: 952205 - DNA, 25 bp, Mus musculus
gggaattcatgtctgcccggacaaa

SEQ ID NO: 952206 - DNA, 25 bp, Mus musculus
gggaattcatttgactgtgatgagc

SEQ ID NO: 952207 - DNA, 25 bp, Mus musculus
gggaattgcaaacatgtgtccaggt

SEQ ID NO: 952208 - DNA, 25 bp, Mus musculus
gggaattgcaaactgtactgggact

SEQ ID NO: 952209 - DNA, 25 bp, Mus musculus
gggaattgcaaagatgtgtccaggt

SEQ ID NO: 952210 - DNA, 25 bp, Mus musculus
gggaattgcaaagtgtactgggact

SEQ ID NO: 952211 - DNA, 25 bp, Mus musculus
gggaattgctcacgcgagagcaggc

SEQ ID NO: 952212 - DNA, 25 bp, Mus musculus
gggaattgctcaggcgagagcaggc

SEQ ID NO: 952213 - DNA, 25 bp, Mus musculus
gggaatttgcaaagcagctactgaa

SEQ ID NO: 952214 - DNA, 25 bp, Mus musculus
gggaatttgcaatgcagctactgaa

SEQ ID NO: 952215 - DNA, 25 bp, Mus musculus
gggacaaatagacgctacgagaact

SEQ ID NO: 952216 - DNA, 25 bp, Mus musculus
gggacaaatagaggctacgagaact

SEQ ID NO: 952217 - DNA, 25 bp, Mus musculus
gggacaacgaagctgaccccatctc

SEQ ID NO: 952218 - DNA, 25 bp, Mus musculus
gggacaacgaaggtgaccccatctc

SEQ ID NO: 952219 - DNA, 25 bp, Mus musculus
gggacaactgcttcggcccacaaca

SEQ ID NO: 952220 - DNA, 25 bp, Mus musculus
gggacaactggttcggcccacaaca

SEQ ID NO: 952221 - DNA, 25 bp, Mus musculus
gggacaagaatacacggaaaatgga

SEQ ID NO: 952222 - DNA, 25 bp, Mus musculus
gggacaagaatacagggaaaatgga

SEQ ID NO: 952223 - DNA, 25 bp, Mus musculus
gggacaagagcttgcctgcaggagg

SEQ ID NO: 952224 - DNA, 25 bp, Mus musculus
gggacaagaggttgcctgcaggagg

SEQ ID NO: 952225 - DNA, 25 bp, Mus musculus
gggacaatggggcacgtaaaattgt

SEQ ID NO: 952226 - DNA, 25 bp, Mus musculus
gggacaatggggcacgtgctgatac

SEQ ID NO: 952227 - DNA, 25 bp, Mus musculus
gggacaatggggcaggtaaaattgt

SEQ ID NO: 952228 - DNA, 25 bp, Mus musculus
gggacaatggggcaggtgctgatac

SEQ ID NO: 952229 - DNA, 25 bp, Mus musculus
gggacacacaagcaaaatatgctgt

SEQ ID NO: 952230 - DNA, 25 bp, Mus musculus
gggacacacatgcaaaatatgctgt

SEQ ID NO: 952231 - DNA, 25 bp, Mus musculus
gggacacagcagctcgaactcatta

SEQ ID NO: 952232 - DNA, 25 bp, Mus musculus
gggacacagcagctggaactcatta

SEQ ID NO: 952233 - DNA, 25 bp, Mus musculus
gggacacaggctgtacactgtgaga

SEQ ID NO: 952234 - DNA, 25 bp, Mus musculus
gggacacagggtgtacactgtgaga

SEQ ID NO: 952235 - DNA, 25 bp, Mus musculus
gggacacatgcacaaaagtaaagaa

SEQ ID NO: 952236 - DNA, 25 bp, Mus musculus
gggacacatgcacctggtgaatgag

SEQ ID NO: 952237 - DNA, 25 bp, Mus musculus
gggacacatgcacgcgcatacctct

SEQ ID NO: 952238 - DNA, 25 bp, Mus musculus
gggacacatgcagaaaagtaaagaa

SEQ ID NO: 952239 - DNA, 25 bp, Mus musculus
gggacacatgcagctggtgaatgag

SEQ ID NO: 952240 - DNA, 25 bp, Mus musculus
gggacacatgcaggcgcatacctct

SEQ ID NO: 952241 - DNA, 25 bp, Mus musculus
gggacagacagctacgacccagagg

SEQ ID NO: 952242 - DNA, 25 bp, Mus musculus
gggacagacagctaggacccagagg

SEQ ID NO: 952243 - DNA, 25 bp, Mus musculus
gggacagagcagaatttgatactag

SEQ ID NO: 952244 - DNA, 25 bp, Mus musculus
gggacagagcagcggtgctcttctc

SEQ ID NO: 952245 - DNA, 25 bp, Mus musculus
gggacagagcaggggtgctcttctc

SEQ ID NO: 952246 - DNA, 25 bp, Mus musculus
gggacagagcagtatttgatactag

SEQ ID NO: 952247 - DNA, 25 bp, Mus musculus
gggacagataagcagcgtgcttccg

SEQ ID NO: 952248 - DNA, 25 bp, Mus musculus
gggacagataaggagcgtgcttccg

SEQ ID NO: 952249 - DNA, 25 bp, Mus musculus
gggacagcacaaaagtctgcagaat

SEQ ID NO: 952250 - DNA, 25 bp, Mus musculus
gggacagcacaatagtctgcagaat

SEQ ID NO: 952251 - DNA, 25 bp, Mus musculus
gggacagcagcacgttcttcgtgga

SEQ ID NO: 952252 - DNA, 25 bp, Mus musculus
gggacagcagcaggttcttcgtgga

SEQ ID NO: 952253 - DNA, 25 bp, Mus musculus
gggacaggagccgtccagagatcac

SEQ ID NO: 952254 - DNA, 25 bp, Mus musculus
gggacaggaggcgtccagagatcac

SEQ ID NO: 952255 - DNA, 25 bp, Mus musculus
gggacagtgaaggacagtcttgatg

SEQ ID NO: 952256 - DNA, 25 bp, Mus musculus
gggacagtgaaggactagagtcttg

SEQ ID NO: 952257 - DNA, 25 bp, Mus musculus
gggacagtgaaggactcttgatgaa

SEQ ID NO: 952258 - DNA, 25 bp, Mus musculus
gggacagtgaaggagagtcttgatg

SEQ ID NO: 952259 - DNA, 25 bp, Mus musculus
gggacagtgaaggagtagagtcttg

SEQ ID NO: 952260 - DNA, 25 bp, Mus musculus
gggacagtgaaggagtcttgatgaa

SEQ ID NO: 952261 - DNA, 25 bp, Mus musculus
gggacagtgcaaccccctgtatgac

SEQ ID NO: 952262 - DNA, 25 bp, Mus musculus
gggacagtgcaagcccctgtatgac

SEQ ID NO: 952263 - DNA, 25 bp, Mus musculus
gggacataactccaccactgtcacc

SEQ ID NO: 952264 - DNA, 25 bp, Mus musculus
gggacataactccagcactgtcacc

SEQ ID NO: 952265 - DNA, 25 bp, Mus musculus
gggacatctccacggaagaggtgaa

SEQ ID NO: 952266 - DNA, 25 bp, Mus musculus
gggacatctccagggaagaggtgaa

SEQ ID NO: 952267 - DNA, 25 bp, Mus musculus
gggacatgatctgattaagacgcta

SEQ ID NO: 952268 - DNA, 25 bp, Mus musculus
gggacatgatgtgattaagacgcta

SEQ ID NO: 952269 - DNA, 25 bp, Mus musculus
gggacatgtgcaacttcttggtgaa

SEQ ID NO: 952270 - DNA, 25 bp, Mus musculus
gggacatgtgcatcttcttggtgaa

SEQ ID NO: 952271 - DNA, 25 bp, Mus musculus
gggacattaaacgaagaatccagtt

SEQ ID NO: 952272 - DNA, 25 bp, Mus musculus
gggacattaaacgatgaatccagtt

SEQ ID NO: 952273 - DNA, 25 bp, Mus musculus
gggaccaactcgctacctgagccca

SEQ ID NO: 952274 - DNA, 25 bp, Mus musculus
gggaccaactcggtacctgagccca

SEQ ID NO: 952275 - DNA, 25 bp, Mus musculus
gggaccactgagaggcctacgtgaa

SEQ ID NO: 952276 - DNA, 25 bp, Mus musculus
gggaccactgagcctgagcagatgg

SEQ ID NO: 952277 - DNA, 25 bp, Mus musculus
gggaccactgaggctgagcagatgg

SEQ ID NO: 952278 - DNA, 25 bp, Mus musculus
gggaccactgagtggcctacgtgaa

SEQ ID NO: 952279 - DNA, 25 bp, Mus musculus
gggaccagagaattggagttgacca

SEQ ID NO: 952280 - DNA, 25 bp, Mus musculus
gggaccagagtattggagttgacca

SEQ ID NO: 952281 - DNA, 25 bp, Mus musculus
gggaccagcaagctctggcgtggag

SEQ ID NO: 952282 - DNA, 25 bp, Mus musculus
gggaccagcaaggtctggcgtggag

SEQ ID NO: 952283 - DNA, 25 bp, Mus musculus
gggaccagtgattgacaggcgctgc

SEQ ID NO: 952284 - DNA, 25 bp, Mus musculus
gggaccagtgtttgacaggcgctgc

SEQ ID NO: 952285 - DNA, 25 bp, Mus musculus
gggaccataaagactaaggttgtgg

SEQ ID NO: 952286 - DNA, 25 bp, Mus musculus
gggaccataaagtctaaggttgtgg

SEQ ID NO: 952287 - DNA, 25 bp, Mus musculus
gggacccagaagatgatttttgatc

SEQ ID NO: 952288 - DNA, 25 bp, Mus musculus
gggacccagaagttgatttttgatc

SEQ ID NO: 952289 - DNA, 25 bp, Mus musculus
gggacccagcagctggacagtatct

SEQ ID NO: 952290 - DNA, 25 bp, Mus musculus
gggacccagcaggtggacagtatct

SEQ ID NO: 952291 - DNA, 25 bp, Mus musculus
gggacccagttgcttcatctggctc

SEQ ID NO: 952292 - DNA, 25 bp, Mus musculus
gggacccagttggttcatctggctc

SEQ ID NO: 952293 - DNA, 25 bp, Mus musculus
gggacccgagatccacgtgtcggaa

SEQ ID NO: 952294 - DNA, 25 bp, Mus musculus
gggacccgagatcccactgagatgg

SEQ ID NO: 952295 - DNA, 25 bp, Mus musculus
gggacccgagcagatcccactgaga

SEQ ID NO: 952296 - DNA, 25 bp, Mus musculus
gggacccgagctgtgtctcttcaga

SEQ ID NO: 952297 - DNA, 25 bp, Mus musculus
gggacccgaggagatcccactgaga

SEQ ID NO: 952298 - DNA, 25 bp, Mus musculus
gggacccgaggtgtgtctcttcaga

SEQ ID NO: 952299 - DNA, 25 bp, Mus musculus
gggacccgagttccacgtgtcggaa

SEQ ID NO: 952300 - DNA, 25 bp, Mus musculus
gggacccgagttcccactgagatgg

SEQ ID NO: 952301 - DNA, 25 bp, Mus musculus
gggaccgagtgacacgtggtcaaga

SEQ ID NO: 952302 - DNA, 25 bp, Mus musculus
gggaccgagtgacaggtggtcaaga

SEQ ID NO: 952303 - DNA, 25 bp, Mus musculus
gggaccgctcctcacgcaaacacta

SEQ ID NO: 952304 - DNA, 25 bp, Mus musculus
gggaccgctcctcaggcaaacacta

SEQ ID NO: 952305 - DNA, 25 bp, Mus musculus
gggacctcaacactgggcagctgat

SEQ ID NO: 952306 - DNA, 25 bp, Mus musculus
gggacctcaacagtgggcagctgat

SEQ ID NO: 952307 - DNA, 25 bp, Mus musculus
gggacctcagctcccggaacttgca

SEQ ID NO: 952308 - DNA, 25 bp, Mus musculus
gggacctcaggtcccggaacttgca

SEQ ID NO: 952309 - DNA, 25 bp, Mus musculus
gggacctgcactctcacgcggtgtt

SEQ ID NO: 952310 - DNA, 25 bp, Mus musculus
gggacctgcactgtcacgcggtgtt

SEQ ID NO: 952311 - DNA, 25 bp, Mus musculus
gggaccttcattcagaatggccaat

SEQ ID NO: 952312 - DNA, 25 bp, Mus musculus
gggaccttcattgagaatggccaat

SEQ ID NO: 952313 - DNA, 25 bp, Mus musculus
gggacgagaactacatggagttcct

SEQ ID NO: 952314 - DNA, 25 bp, Mus musculus
gggacgagaacttcatggagttcct

SEQ ID NO: 952315 - DNA, 25 bp, Mus musculus
gggacgcagcacgccatcaatgatg

SEQ ID NO: 952316 - DNA, 25 bp, Mus musculus
gggacgcagcacgccgtatgtgcag

SEQ ID NO: 952317 - DNA, 25 bp, Mus musculus
gggacgcagcacgcgatcaatgatg

SEQ ID NO: 952318 - DNA, 25 bp, Mus musculus
gggacgcagcacgcggtatgtgcag

SEQ ID NO: 952319 - DNA, 25 bp, Mus musculus
gggacgctgcgacgaagagccctgg

SEQ ID NO: 952320 - DNA, 25 bp, Mus musculus
gggacgctgcgaggaagagccctgg

SEQ ID NO: 952321 - DNA, 25 bp, Mus musculus
gggacggcactgcgcgtacctggcg

SEQ ID NO: 952322 - DNA, 25 bp, Mus musculus
gggacggcactgcgggtacctggcg

SEQ ID NO: 952323 - DNA, 25 bp, Mus musculus
gggacggtacctccattgtgcttct

SEQ ID NO: 952324 - DNA, 25 bp, Mus musculus
gggacggtacctgcattgtgcttct

SEQ ID NO: 952325 - DNA, 25 bp, Mus musculus
gggacgttccggaacctgcagcttc

SEQ ID NO: 952326 - DNA, 25 bp, Mus musculus
gggacgttccggaagctgcagcttc

SEQ ID NO: 952327 - DNA, 25 bp, Mus musculus
gggactaaagcggacagctgttgta

SEQ ID NO: 952328 - DNA, 25 bp, Mus musculus
gggactaaaggggacagctgttgta

SEQ ID NO: 952329 - DNA, 25 bp, Mus musculus
gggactaatgagaactttcaagttg

SEQ ID NO: 952330 - DNA, 25 bp, Mus musculus
gggactaatgagaagtttcaagttg

SEQ ID NO: 952331 - DNA, 25 bp, Mus musculus
gggactacagaggacaaggcgttgt

SEQ ID NO: 952332 - DNA, 25 bp, Mus musculus
gggactacagtggacaaggcgttgt

SEQ ID NO: 952333 - DNA, 25 bp, Mus musculus
gggactacgtcacgctgttcggcat

SEQ ID NO: 952334 - DNA, 25 bp, Mus musculus
gggactacgtcaggctgttcggcat

SEQ ID NO: 952335 - DNA, 25 bp, Mus musculus
gggactagccggcttattcgcaggt

SEQ ID NO: 952336 - DNA, 25 bp, Mus musculus
gggactagccgggttattcgcaggt

SEQ ID NO: 952337 - DNA, 25 bp, Mus musculus
gggactatgctggacataattatgt

SEQ ID NO: 952338 - DNA, 25 bp, Mus musculus
gggactatgctggagataattatgt

SEQ ID NO: 952339 - DNA, 25 bp, Mus musculus
gggactcagtgcaactacagagact

SEQ ID NO: 952340 - DNA, 25 bp, Mus musculus
gggactcagtgcaagtacagagact

SEQ ID NO: 952341 - DNA, 25 bp, Mus musculus
gggactcatgatcttccaaaggctg

SEQ ID NO: 952342 - DNA, 25 bp, Mus musculus
gggactcatgttcttccaaaggctg

SEQ ID NO: 952343 - DNA, 25 bp, Mus musculus
gggactcccaagaacagtgactggc

SEQ ID NO: 952344 - DNA, 25 bp, Mus musculus
gggactcccaagaagagtgactggc

SEQ ID NO: 952345 - DNA, 25 bp, Mus musculus
gggactcctatacgtcaccgtggag

SEQ ID NO: 952346 - DNA, 25 bp, Mus musculus
gggactcctataggtcaccgtggag

SEQ ID NO: 952347 - DNA, 25 bp, Mus musculus
gggactctgatgatgttcttggtca

SEQ ID NO: 952348 - DNA, 25 bp, Mus musculus
gggactctgatgttgttcttggtca

SEQ ID NO: 952349 - DNA, 25 bp, Mus musculus
gggactgcaagtagtgggcactaca

SEQ ID NO: 952350 - DNA, 25 bp, Mus musculus
gggactgcaagttgtgggcactaca

SEQ ID NO: 952351 - DNA, 25 bp, Mus musculus
gggactgcaatacctgtggggacca

SEQ ID NO: 952352 - DNA, 25 bp, Mus musculus
gggactgcaatagctgtggggacca

SEQ ID NO: 952353 - DNA, 25 bp, Mus musculus
gggactgcaccctgcggtaaaacat

SEQ ID NO: 952354 - DNA, 25 bp, Mus musculus
gggactgcaccctggggtaaaacat

SEQ ID NO: 952355 - DNA, 25 bp, Mus musculus
gggactgctgcgcccgctgctcagc

SEQ ID NO: 952356 - DNA, 25 bp, Mus musculus
gggactgctgggcccgctgctcagc

SEQ ID NO: 952357 - DNA, 25 bp, Mus musculus
gggactggaaagatggagccagcac

SEQ ID NO: 952358 - DNA, 25 bp, Mus musculus
gggactggaaagttggagccagcac

SEQ ID NO: 952359 - DNA, 25 bp, Mus musculus
gggactggagtgagcaaaatggcac

SEQ ID NO: 952360 - DNA, 25 bp, Mus musculus
gggactggagtgagcagaagaaaca

SEQ ID NO: 952361 - DNA, 25 bp, Mus musculus
gggactggagtgagctcaagggtct

SEQ ID NO: 952362 - DNA, 25 bp, Mus musculus
gggactggagtgaggaaaatggcac

SEQ ID NO: 952363 - DNA, 25 bp, Mus musculus
gggactggagtgaggagaagaaaca

SEQ ID NO: 952364 - DNA, 25 bp, Mus musculus
gggactggagtgaggtcaagggtct

SEQ ID NO: 952365 - DNA, 25 bp, Mus musculus
gggactggggtactcctgcaggtcc

SEQ ID NO: 952366 - DNA, 25 bp, Mus musculus
gggactggggtactgctgcaggtcc

SEQ ID NO: 952367 - DNA, 25 bp, Mus musculus
gggactggtcctcacgcattaacaa

SEQ ID NO: 952368 - DNA, 25 bp, Mus musculus
gggactggtcctcaggcattaacaa

SEQ ID NO: 952369 - DNA, 25 bp, Mus musculus
gggactggtgctcccgaacgagaag

SEQ ID NO: 952370 - DNA, 25 bp, Mus musculus
gggactggtgctccggaacgagaag

SEQ ID NO: 952371 - DNA, 25 bp, Mus musculus
gggactgtgaaacacacaagcagat

SEQ ID NO: 952372 - DNA, 25 bp, Mus musculus
gggactgtgaaacacggaagcagct

SEQ ID NO: 952373 - DNA, 25 bp, Mus musculus
gggactgtgaaacagacaagcagat

SEQ ID NO: 952374 - DNA, 25 bp, Mus musculus
gggactgtgaaacagggaagcagct

SEQ ID NO: 952375 - DNA, 25 bp, Mus musculus
gggactgtgaaatgggcctgctccg

SEQ ID NO: 952376 - DNA, 25 bp, Mus musculus
gggactgtgatatgggcctgctccg

SEQ ID NO: 952377 - DNA, 25 bp, Mus musculus
gggactgtgcagcttgaaaacgagg

SEQ ID NO: 952378 - DNA, 25 bp, Mus musculus
gggactgtgcaggttgaaaacgagg

SEQ ID NO: 952379 - DNA, 25 bp, Mus musculus
gggactgtgtgtgccttggagtttg

SEQ ID NO: 952380 - DNA, 25 bp, Mus musculus
gggactgtgtgtgcgttggagtttg

SEQ ID NO: 952381 - DNA, 25 bp, Mus musculus
gggacttcagctttgaaggacagca

SEQ ID NO: 952382 - DNA, 25 bp, Mus musculus
gggacttcaggcctttgaaggacag

SEQ ID NO: 952383 - DNA, 25 bp, Mus musculus
gggacttcaggcgtttgaaggacag

SEQ ID NO: 952384 - DNA, 25 bp, Mus musculus
gggacttcaggtttgaaggacagca

SEQ ID NO: 952385 - DNA, 25 bp, Mus musculus
gggacttgggcacggctgttctcag

SEQ ID NO: 952386 - DNA, 25 bp, Mus musculus
gggacttggggacggctgttctcag

SEQ ID NO: 952387 - DNA, 25 bp, Mus musculus
gggactttcaccagcgaagacagtg

SEQ ID NO: 952388 - DNA, 25 bp, Mus musculus
gggactttcaccagggaagacagtg

SEQ ID NO: 952389 - DNA, 25 bp, Mus musculus
gggagaaaagcgtgactgtgaggat

SEQ ID NO: 952390 - DNA, 25 bp, Mus musculus
gggagaaaagggtgactgtgaggat

SEQ ID NO: 952391 - DNA, 25 bp, Mus musculus
gggagaaagaagccatgtcatgttg

SEQ ID NO: 952392 - DNA, 25 bp, Mus musculus
gggagaaagaaggcatgtcatgttg

SEQ ID NO: 952393 - DNA, 25 bp, Mus musculus
gggagaacagatacaaaggatgggc

SEQ ID NO: 952394 - DNA, 25 bp, Mus musculus
gggagaacagatccgacgtatcctg

SEQ ID NO: 952395 - DNA, 25 bp, Mus musculus
gggagaacagttacaaaggatgggc

SEQ ID NO: 952396 - DNA, 25 bp, Mus musculus
gggagaacagttccgacgtatcctg

SEQ ID NO: 952397 - DNA, 25 bp, Mus musculus
gggagaactcgcaccagggtccacg

SEQ ID NO: 952398 - DNA, 25 bp, Mus musculus
gggagaactcgctccagggtccacg

SEQ ID NO: 952399 - DNA, 25 bp, Mus musculus
gggagaactttccacgtgtctcctg

SEQ ID NO: 952400 - DNA, 25 bp, Mus musculus
gggagaactttccaggtgtctcctg

SEQ ID NO: 952401 - DNA, 25 bp, Mus musculus
gggagaagaaagatgtaagtggcgc

SEQ ID NO: 952402 - DNA, 25 bp, Mus musculus
gggagaagaaagttgtaagtggcgc

SEQ ID NO: 952403 - DNA, 25 bp, Mus musculus
gggagaagagagcccttcgagataa

SEQ ID NO: 952404 - DNA, 25 bp, Mus musculus
gggagaagagaggccttcgagataa

SEQ ID NO: 952405 - DNA, 25 bp, Mus musculus
gggagaagagcgctcacagcccttg

SEQ ID NO: 952406 - DNA, 25 bp, Mus musculus
gggagaagagcggtcacagcccttg

SEQ ID NO: 952407 - DNA, 25 bp, Mus musculus
gggagaagagctatctgtatggccc

SEQ ID NO: 952408 - DNA, 25 bp, Mus musculus
gggagaagagctatgtgtatggccc

SEQ ID NO: 952409 - DNA, 25 bp, Mus musculus
gggagaagcaagcagagtacgagaa

SEQ ID NO: 952410 - DNA, 25 bp, Mus musculus
gggagaagcaaggagagtacgagaa

SEQ ID NO: 952411 - DNA, 25 bp, Mus musculus
gggagaagctctatcactttgtgaa

SEQ ID NO: 952412 - DNA, 25 bp, Mus musculus
gggagaagctctatgactttgtgaa

SEQ ID NO: 952413 - DNA, 25 bp, Mus musculus
gggagaaggaacatctttccagagt

SEQ ID NO: 952414 - DNA, 25 bp, Mus musculus
gggagaaggaacatgtttccagagt

SEQ ID NO: 952415 - DNA, 25 bp, Mus musculus
gggagaatacagcgattacagcaat

SEQ ID NO: 952416 - DNA, 25 bp, Mus musculus
gggagaatacagcgtctgttcacta

SEQ ID NO: 952417 - DNA, 25 bp, Mus musculus
gggagaatacagggattacagcaat

SEQ ID NO: 952418 - DNA, 25 bp, Mus musculus
gggagaatacagggtctgttcacta

SEQ ID NO: 952419 - DNA, 25 bp, Mus musculus
gggagaatggagcaagaagctttgc

SEQ ID NO: 952420 - DNA, 25 bp, Mus musculus
gggagaatggaggaagaagctttgc

SEQ ID NO: 952421 - DNA, 25 bp, Mus musculus
gggagacacgacttctgctttgtgg

SEQ ID NO: 952422 - DNA, 25 bp, Mus musculus
gggagacacgacttgtgctttgtgg

SEQ ID NO: 952423 - DNA, 25 bp, Mus musculus
gggagacagacgcattcaaggttcc

SEQ ID NO: 952424 - DNA, 25 bp, Mus musculus
gggagacagaggcattcaaggttcc

SEQ ID NO: 952425 - DNA, 25 bp, Mus musculus
gggagacctcaacgcttccaaggaa

SEQ ID NO: 952426 - DNA, 25 bp, Mus musculus
gggagacctcaaggcttccaaggaa

SEQ ID NO: 952427 - DNA, 25 bp, Mus musculus
gggagacgcacacgcatatctgctg

SEQ ID NO: 952428 - DNA, 25 bp, Mus musculus
gggagacgcacaggcatatctgctg

SEQ ID NO: 952429 - DNA, 25 bp, Mus musculus
gggagacgtgctactcagttcgtgt

SEQ ID NO: 952430 - DNA, 25 bp, Mus musculus
gggagacgtggtactcagttcgtgt

SEQ ID NO: 952431 - DNA, 25 bp, Mus musculus
gggagagagaggcgtggaagatgtc

SEQ ID NO: 952432 - DNA, 25 bp, Mus musculus
gggagagagaggggtggaagatgtc

SEQ ID NO: 952433 - DNA, 25 bp, Mus musculus
gggagagcagcaggtgtaaagaaac

SEQ ID NO: 952434 - DNA, 25 bp, Mus musculus
gggagagcagcgggaacttcattgc

SEQ ID NO: 952435 - DNA, 25 bp, Mus musculus
gggagagcaggaggtgtaaagaaac

SEQ ID NO: 952436 - DNA, 25 bp, Mus musculus
gggagagcagggggaacttcattgc

SEQ ID NO: 952437 - DNA, 25 bp, Mus musculus
gggagagccaagatccatcgtcaat

SEQ ID NO: 952438 - DNA, 25 bp, Mus musculus
gggagagccaagttccatcgtcaat

SEQ ID NO: 952439 - DNA, 25 bp, Mus musculus
gggagagcgcatcacctgcagttaa

SEQ ID NO: 952440 - DNA, 25 bp, Mus musculus
gggagagcgcatcagctgcagttaa

SEQ ID NO: 952441 - DNA, 25 bp, Mus musculus
gggagaggacgcctgagcatgccaa

SEQ ID NO: 952442 - DNA, 25 bp, Mus musculus
gggagaggacgcgtgagcatgccaa

SEQ ID NO: 952443 - DNA, 25 bp, Mus musculus
gggagaggccaaccacctgctcact

SEQ ID NO: 952444 - DNA, 25 bp, Mus musculus
gggagaggccaagcacctgctcact

SEQ ID NO: 952445 - DNA, 25 bp, Mus musculus
gggagaggtgaactgggatgccttc

SEQ ID NO: 952446 - DNA, 25 bp, Mus musculus
gggagaggtgaagtgggatgccttc

SEQ ID NO: 952447 - DNA, 25 bp, Mus musculus
gggagatacaggccatggatgggca

SEQ ID NO: 952448 - DNA, 25 bp, Mus musculus
gggagatacagggcatggatgggca

SEQ ID NO: 952449 - DNA, 25 bp, Mus musculus
gggagatcctccgacagttcaacca

SEQ ID NO: 952450 - DNA, 25 bp, Mus musculus
gggagatcctccgagagttcaacca

SEQ ID NO: 952451 - DNA, 25 bp, Mus musculus
gggagatctcaacttcccagtggga

SEQ ID NO: 952452 - DNA, 25 bp, Mus musculus
gggagatctcaagttcccagtggga

SEQ ID NO: 952453 - DNA, 25 bp, Mus musculus
gggagatgaagaaacggtccatctt

SEQ ID NO: 952454 - DNA, 25 bp, Mus musculus
gggagatgaagaaagggtccatctt

SEQ ID NO: 952455 - DNA, 25 bp, Mus musculus
gggagatggacgtcctggcaacaga

SEQ ID NO: 952456 - DNA, 25 bp, Mus musculus
gggagatggaggtcctggcaacaga

SEQ ID NO: 952457 - DNA, 25 bp, Mus musculus
gggagatggcagcgccggtggcgga

SEQ ID NO: 952458 - DNA, 25 bp, Mus musculus
gggagatggcagcggcggtggcgga

SEQ ID NO: 952459 - DNA, 25 bp, Mus musculus
gggagcaaagcgtgctgtggagatc

SEQ ID NO: 952460 - DNA, 25 bp, Mus musculus
gggagcaaagggtgctgtggagatc

SEQ ID NO: 952461 - DNA, 25 bp, Mus musculus
gggagcacagaacctttgacatgga

SEQ ID NO: 952462 - DNA, 25 bp, Mus musculus
gggagcacagctcatcctgtgctga

SEQ ID NO: 952463 - DNA, 25 bp, Mus musculus
gggagcacaggtcatcctgtgctga

SEQ ID NO: 952464 - DNA, 25 bp, Mus musculus
gggagcacagtacctttgacatgga

SEQ ID NO: 952465 - DNA, 25 bp, Mus musculus
gggagcagaccacgtgactggttat

SEQ ID NO: 952466 - DNA, 25 bp, Mus musculus
gggagcagaccactaggggcaagcg

SEQ ID NO: 952467 - DNA, 25 bp, Mus musculus
gggagcagaccaggtgactggttat

SEQ ID NO: 952468 - DNA, 25 bp, Mus musculus
gggagcagaccagtaggggcaagcg

SEQ ID NO: 952469 - DNA, 25 bp, Mus musculus
gggagcagagcaccttctgctggac

SEQ ID NO: 952470 - DNA, 25 bp, Mus musculus
gggagcagagcagcttctgctggac

SEQ ID NO: 952471 - DNA, 25 bp, Mus musculus
gggagcagagtacacgagacagaca

SEQ ID NO: 952472 - DNA, 25 bp, Mus musculus
gggagcagagtacaggagacagaca

SEQ ID NO: 952473 - DNA, 25 bp, Mus musculus
gggagcaggggggacatcgcatttt

SEQ ID NO: 952474 - DNA, 25 bp, Mus musculus
gggagcaggggggagatcgcatttt

SEQ ID NO: 952475 - DNA, 25 bp, Mus musculus
gggagccaagaactcatcctgcctc

SEQ ID NO: 952476 - DNA, 25 bp, Mus musculus
gggagccaagtactcatcctgcctc

SEQ ID NO: 952477 - DNA, 25 bp, Mus musculus
gggagccagcttcgtctgacagaag

SEQ ID NO: 952478 - DNA, 25 bp, Mus musculus
gggagccagcttggtctgacagaag

SEQ ID NO: 952479 - DNA, 25 bp, Mus musculus
gggagccctggacgagtctcagcta

SEQ ID NO: 952480 - DNA, 25 bp, Mus musculus
gggagccctggacgattaccaggca

SEQ ID NO: 952481 - DNA, 25 bp, Mus musculus
gggagccctggaggagtctcagcta

SEQ ID NO: 952482 - DNA, 25 bp, Mus musculus
gggagccctggaggattaccaggca

SEQ ID NO: 952483 - DNA, 25 bp, Mus musculus
gggagccgcaggctagaggcagtca

SEQ ID NO: 952484 - DNA, 25 bp, Mus musculus
gggagccgcagggtagaggcagtca

SEQ ID NO: 952485 - DNA, 25 bp, Mus musculus
gggagcgcccgacgccctgggacgg

SEQ ID NO: 952486 - DNA, 25 bp, Mus musculus
gggagcgcccgaggccctgggacgg

SEQ ID NO: 952487 - DNA, 25 bp, Mus musculus
gggagcggcggtcgtgtgccaagtg

SEQ ID NO: 952488 - DNA, 25 bp, Mus musculus
gggagcggcggtctgatccattgta

SEQ ID NO: 952489 - DNA, 25 bp, Mus musculus
gggagcggcggtggtgtgccaagtg

SEQ ID NO: 952490 - DNA, 25 bp, Mus musculus
gggagcggcggtgtgatccattgta

SEQ ID NO: 952491 - DNA, 25 bp, Mus musculus
gggagcgggagaagtatgacaacat

SEQ ID NO: 952492 - DNA, 25 bp, Mus musculus
gggagcgggagatgtatgacaacat

SEQ ID NO: 952493 - DNA, 25 bp, Mus musculus
gggagctacactccctatagggcag

SEQ ID NO: 952494 - DNA, 25 bp, Mus musculus
gggagctacactgcctatagggcag

SEQ ID NO: 952495 - DNA, 25 bp, Mus musculus
gggagctcacagcgtgtattttccc

SEQ ID NO: 952496 - DNA, 25 bp, Mus musculus
gggagctcacagggtgtattttccc

SEQ ID NO: 952497 - DNA, 25 bp, Mus musculus
gggagctgactgatatgtcttctat

SEQ ID NO: 952498 - DNA, 25 bp, Mus musculus
gggagctgactgatttgtcttctat

SEQ ID NO: 952499 - DNA, 25 bp, Mus musculus
gggagctgagggccacaaggattcc

SEQ ID NO: 952500 - DNA, 25 bp, Mus musculus
gggagctgagggcctcaaggattcc

SEQ ID NO: 952501 - DNA, 25 bp, Mus musculus
gggagctgctagcccttctctgagg

SEQ ID NO: 952502 - DNA, 25 bp, Mus musculus
gggagctgctaggccttctctgagg

SEQ ID NO: 952503 - DNA, 25 bp, Mus musculus
gggagctggagacgctgccttgggg

SEQ ID NO: 952504 - DNA, 25 bp, Mus musculus
gggagctggagaggctgccttgggg

SEQ ID NO: 952505 - DNA, 25 bp, Mus musculus
gggagctgggttcgctcccagcaat

SEQ ID NO: 952506 - DNA, 25 bp, Mus musculus
gggagctgggttcggtcccagcaat

SEQ ID NO: 952507 - DNA, 25 bp, Mus musculus
gggagctgtgtacatgtcaatgagt

SEQ ID NO: 952508 - DNA, 25 bp, Mus musculus
gggagctgtgtagatgtcaatgagt

SEQ ID NO: 952509 - DNA, 25 bp, Mus musculus
gggagcttcgcctacgaaagaatct

SEQ ID NO: 952510 - DNA, 25 bp, Mus musculus
gggagcttcgcctaggaaagaatct

SEQ ID NO: 952511 - DNA, 25 bp, Mus musculus
gggagcttgccaaacgcggagcgtt

SEQ ID NO: 952512 - DNA, 25 bp, Mus musculus
gggagcttgccatacgcggagcgtt

SEQ ID NO: 952513 - DNA, 25 bp, Mus musculus
gggagctttgaacatgggaaacctg

SEQ ID NO: 952514 - DNA, 25 bp, Mus musculus
gggagctttgaagatgggaaacctg

SEQ ID NO: 952515 - DNA, 25 bp, Mus musculus
gggaggagagctgacgcacctccaa

SEQ ID NO: 952516 - DNA, 25 bp, Mus musculus
gggaggagagctgaggcacctccaa

SEQ ID NO: 952517 - DNA, 25 bp, Mus musculus
gggaggagctcacacatgccctgga

SEQ ID NO: 952518 - DNA, 25 bp, Mus musculus
gggaggagctcagacatgccctgga

SEQ ID NO: 952519 - DNA, 25 bp, Mus musculus
gggaggaggaacgctatcaagcaga

SEQ ID NO: 952520 - DNA, 25 bp, Mus musculus
gggaggaggagacacatgtgaggtg

SEQ ID NO: 952521 - DNA, 25 bp, Mus musculus
gggaggaggagacacgaaggcgtag

SEQ ID NO: 952522 - DNA, 25 bp, Mus musculus
gggaggaggagacagatgtgaggtg

SEQ ID NO: 952523 - DNA, 25 bp, Mus musculus
gggaggaggagacaggaaggcgtag

SEQ ID NO: 952524 - DNA, 25 bp, Mus musculus
gggaggaggatcgctatcaagcaga

SEQ ID NO: 952525 - DNA, 25 bp, Mus musculus
gggaggaggcaaccagtgtcgggaa

SEQ ID NO: 952526 - DNA, 25 bp, Mus musculus
gggaggaggcaagcagtgtcgggaa

SEQ ID NO: 952527 - DNA, 25 bp, Mus musculus
gggaggcaggagcagtttcggacgt

SEQ ID NO: 952528 - DNA, 25 bp, Mus musculus
gggaggcaggaggagtttcggacgt

SEQ ID NO: 952529 - DNA, 25 bp, Mus musculus
gggaggccagttccagagggcagtg

SEQ ID NO: 952530 - DNA, 25 bp, Mus musculus
gggaggccagttcctgagggcagtg

SEQ ID NO: 952531 - DNA, 25 bp, Mus musculus
gggaggcgcagacataaaggagagt

SEQ ID NO: 952532 - DNA, 25 bp, Mus musculus
gggaggcgcagagataaaggagagt

SEQ ID NO: 952533 - DNA, 25 bp, Mus musculus
gggagggcaccacgtcactacttca

SEQ ID NO: 952534 - DNA, 25 bp, Mus musculus
gggagggcaccaggtcactacttca

SEQ ID NO: 952535 - DNA, 25 bp, Mus musculus
gggagggcatgaaacgctcagtgca

SEQ ID NO: 952536 - DNA, 25 bp, Mus musculus
gggagggcatgaaaggctcagtgca

SEQ ID NO: 952537 - DNA, 25 bp, Mus musculus
gggaggtacagacacgcctcctgct

SEQ ID NO: 952538 - DNA, 25 bp, Mus musculus
gggaggtacagacaggcctcctgct

SEQ ID NO: 952539 - DNA, 25 bp, Mus musculus
gggaggtgagcaggaagaagtgcta

SEQ ID NO: 952540 - DNA, 25 bp, Mus musculus
gggaggtgaggaggaagaagtgcta

SEQ ID NO: 952541 - DNA, 25 bp, Mus musculus
gggaggtggcaacccctggcacaag

SEQ ID NO: 952542 - DNA, 25 bp, Mus musculus
gggaggtggcaagccctggcacaag

SEQ ID NO: 952543 - DNA, 25 bp, Mus musculus
gggagtaaagcgacatctctacact

SEQ ID NO: 952544 - DNA, 25 bp, Mus musculus
gggagtaaagggacatctctacact

SEQ ID NO: 952545 - DNA, 25 bp, Mus musculus
gggagtactatgactcagtgtacac

SEQ ID NO: 952546 - DNA, 25 bp, Mus musculus
gggagtactatgtctcagtgtacac

SEQ ID NO: 952547 - DNA, 25 bp, Mus musculus
gggagtagagcaacattgaccatgt

SEQ ID NO: 952548 - DNA, 25 bp, Mus musculus
gggagtagaggaacattgaccatgt

SEQ ID NO: 952549 - DNA, 25 bp, Mus musculus
gggagtcacctgtacaatggtgccc

SEQ ID NO: 952550 - DNA, 25 bp, Mus musculus
gggagtcacctgtagaatggtgccc

SEQ ID NO: 952551 - DNA, 25 bp, Mus musculus
gggagtccagcctaagcttcagtga

SEQ ID NO: 952552 - DNA, 25 bp, Mus musculus
gggagtccaggctaagcttcagtga

SEQ ID NO: 952553 - DNA, 25 bp, Mus musculus
gggagtctgcaaccatgcttttcat

SEQ ID NO: 952554 - DNA, 25 bp, Mus musculus
gggagtctgcaagcatgcttttcat

SEQ ID NO: 952555 - DNA, 25 bp, Mus musculus
gggagtgccgagagaaggacccgaa

SEQ ID NO: 952556 - DNA, 25 bp, Mus musculus
gggagtgccgagtgaaggacccgaa

SEQ ID NO: 952557 - DNA, 25 bp, Mus musculus
gggagtgtgttgatgtgaacgagtg

SEQ ID NO: 952558 - DNA, 25 bp, Mus musculus
gggagtgtgttgttgtgaacgagtg

SEQ ID NO: 952559 - DNA, 25 bp, Mus musculus
gggagttcagcttcatgtggacaag

SEQ ID NO: 952560 - DNA, 25 bp, Mus musculus
gggagttcaggttcatgtggacaag

SEQ ID NO: 952561 - DNA, 25 bp, Mus musculus
gggagttccagaagtatgggcatta

SEQ ID NO: 952562 - DNA, 25 bp, Mus musculus
gggagttccagatgtatgggcatta

SEQ ID NO: 952563 - DNA, 25 bp, Mus musculus
gggagtttggagatgtgatgctggg

SEQ ID NO: 952564 - DNA, 25 bp, Mus musculus
gggagtttggagttgtgatgctggg

SEQ ID NO: 952565 - DNA, 25 bp, Mus musculus
gggataaagtagcacgacacagctt

SEQ ID NO: 952566 - DNA, 25 bp, Mus musculus
gggataaagtagcaggacacagctt

SEQ ID NO: 952567 - DNA, 25 bp, Mus musculus
gggataaagtctactggaattaatt

SEQ ID NO: 952568 - DNA, 25 bp, Mus musculus
gggataaagtgtactggaattaatt

SEQ ID NO: 952569 - DNA, 25 bp, Mus musculus
gggatacacagagaacaaaggctcc

SEQ ID NO: 952570 - DNA, 25 bp, Mus musculus
gggatacacagagaagtatagaaga

SEQ ID NO: 952571 - DNA, 25 bp, Mus musculus
gggatacacagagatcaaaggctcc

SEQ ID NO: 952572 - DNA, 25 bp, Mus musculus
gggatacacagagatgtatagaaga

SEQ ID NO: 952573 - DNA, 25 bp, Mus musculus
gggatacgatgacgggatcctttca

SEQ ID NO: 952574 - DNA, 25 bp, Mus musculus
gggatacgatgaggggatcctttca

SEQ ID NO: 952575 - DNA, 25 bp, Mus musculus
gggatagatccccacagactttgca

SEQ ID NO: 952576 - DNA, 25 bp, Mus musculus
gggatagatccccagagactttgca

SEQ ID NO: 952577 - DNA, 25 bp, Mus musculus
gggatatgagctgcagcagaaagat

SEQ ID NO: 952578 - DNA, 25 bp, Mus musculus
gggatatgaggtgcagcagaaagat

SEQ ID NO: 952579 - DNA, 25 bp, Mus musculus
gggatatgattccacatgcacgcca

SEQ ID NO: 952580 - DNA, 25 bp, Mus musculus
gggatatgattccacgctactagtc

SEQ ID NO: 952581 - DNA, 25 bp, Mus musculus
gggatatgattccagatgcacgcca

SEQ ID NO: 952582 - DNA, 25 bp, Mus musculus
gggatatgattccaggctactagtc

SEQ ID NO: 952583 - DNA, 25 bp, Mus musculus
gggatcaaacatatcctgagaaatc

SEQ ID NO: 952584 - DNA, 25 bp, Mus musculus
gggatcaaacatatcgcacttcttg

SEQ ID NO: 952585 - DNA, 25 bp, Mus musculus
gggatcaaacatatgctgagaaatc

SEQ ID NO: 952586 - DNA, 25 bp, Mus musculus
gggatcaaacatatggcacttcttg

SEQ ID NO: 952587 - DNA, 25 bp, Mus musculus
gggatcaacaagcaattcctcgatg

SEQ ID NO: 952588 - DNA, 25 bp, Mus musculus
gggatcaacaaggaattcctcgatg

SEQ ID NO: 952589 - DNA, 25 bp, Mus musculus
gggatcaatgctctgttctattact

SEQ ID NO: 952590 - DNA, 25 bp, Mus musculus
gggatcaatgctgtgttctattact

SEQ ID NO: 952591 - DNA, 25 bp, Mus musculus
gggatcacagcgattgaagacaagg

SEQ ID NO: 952592 - DNA, 25 bp, Mus musculus
gggatcacagctatatccattccaa

SEQ ID NO: 952593 - DNA, 25 bp, Mus musculus
gggatcacagggattgaagacaagg

SEQ ID NO: 952594 - DNA, 25 bp, Mus musculus
gggatcacaggtatatccattccaa

SEQ ID NO: 952595 - DNA, 25 bp, Mus musculus
gggatcagccagattttggatttgg

SEQ ID NO: 952596 - DNA, 25 bp, Mus musculus
gggatcagccagtttttggatttgg

SEQ ID NO: 952597 - DNA, 25 bp, Mus musculus
gggatcagcgtgcgagctccgcttt

SEQ ID NO: 952598 - DNA, 25 bp, Mus musculus
gggatcagcgtgggagctccgcttt

SEQ ID NO: 952599 - DNA, 25 bp, Mus musculus
gggatcaggagtataaggctcactt

SEQ ID NO: 952600 - DNA, 25 bp, Mus musculus
gggatcaggagtattaggctcactt

SEQ ID NO: 952601 - DNA, 25 bp, Mus musculus
gggatcatccacagcgacttaaaac

SEQ ID NO: 952602 - DNA, 25 bp, Mus musculus
gggatcatccacagggacttaaaac

SEQ ID NO: 952603 - DNA, 25 bp, Mus musculus
gggatcatgtcggtcacacagcaaa

SEQ ID NO: 952604 - DNA, 25 bp, Mus musculus
gggatcatgtgggtcacacagcaaa

SEQ ID NO: 952605 - DNA, 25 bp, Mus musculus
gggatcattccaagaagaagcccgg

SEQ ID NO: 952606 - DNA, 25 bp, Mus musculus
gggatcattccaagtagaagcccgg

SEQ ID NO: 952607 - DNA, 25 bp, Mus musculus
gggatccactcggacagcctgcgag

SEQ ID NO: 952608 - DNA, 25 bp, Mus musculus
gggatccactcggagagcctgcgag

SEQ ID NO: 952609 - DNA, 25 bp, Mus musculus
gggatcgggcagcttggtggaaagg

SEQ ID NO: 952610 - DNA, 25 bp, Mus musculus
gggatcgggcaggttggtggaaagg

SEQ ID NO: 952611 - DNA, 25 bp, Mus musculus
gggatcgtacccagatcgccctgag

SEQ ID NO: 952612 - DNA, 25 bp, Mus musculus
gggatcgtaccctgatcgccctgag

SEQ ID NO: 952613 - DNA, 25 bp, Mus musculus
gggatctcacaacgggcaccaccac

SEQ ID NO: 952614 - DNA, 25 bp, Mus musculus
gggatctcacaaggggcaccaccac

SEQ ID NO: 952615 - DNA, 25 bp, Mus musculus
gggatctcagagcgatttgacccat

SEQ ID NO: 952616 - DNA, 25 bp, Mus musculus
gggatctcagagggatttgacccat

SEQ ID NO: 952617 - DNA, 25 bp, Mus musculus
gggatctgcagacctcagtcagaag

SEQ ID NO: 952618 - DNA, 25 bp, Mus musculus
gggatctgcagagctcagtcagaag

SEQ ID NO: 952619 - DNA, 25 bp, Mus musculus
gggatctttgcaccttcctggtgtg

SEQ ID NO: 952620 - DNA, 25 bp, Mus musculus
gggatctttgcagcttcctggtgtg

SEQ ID NO: 952621 - DNA, 25 bp, Mus musculus
gggatgaactaatcatttttcctat

SEQ ID NO: 952622 - DNA, 25 bp, Mus musculus
gggatgaacttatcatttttcctat

SEQ ID NO: 952623 - DNA, 25 bp, Mus musculus
gggatgacaccacgtgtcctgtgtg

SEQ ID NO: 952624 - DNA, 25 bp, Mus musculus
gggatgacaccaggtgtcctgtgtg

SEQ ID NO: 952625 - DNA, 25 bp, Mus musculus
gggatgacgctgaacacttgccccg

SEQ ID NO: 952626 - DNA, 25 bp, Mus musculus
gggatgacgctgtacacttgccccg

SEQ ID NO: 952627 - DNA, 25 bp, Mus musculus
gggatgcccaagccatgaatgctgc

SEQ ID NO: 952628 - DNA, 25 bp, Mus musculus
gggatgcccaaggcatgaatgctgc

SEQ ID NO: 952629 - DNA, 25 bp, Mus musculus
gggatgctgaagagattcagcccct

SEQ ID NO: 952630 - DNA, 25 bp, Mus musculus
gggatgctgaagtgattcagcccct

SEQ ID NO: 952631 - DNA, 25 bp, Mus musculus
gggatggcagcctcaaagacttgga

SEQ ID NO: 952632 - DNA, 25 bp, Mus musculus
gggatggcaggctcaaagacttgga

SEQ ID NO: 952633 - DNA, 25 bp, Mus musculus
gggatggtcgagcacttgcactaag

SEQ ID NO: 952634 - DNA, 25 bp, Mus musculus
gggatggtcgaggacttgcactaag

SEQ ID NO: 952635 - DNA, 25 bp, Mus musculus
gggatgtgggcccaactcccatgta

SEQ ID NO: 952636 - DNA, 25 bp, Mus musculus
gggatgtggggccaactcccatgta

SEQ ID NO: 952637 - DNA, 25 bp, Mus musculus
gggattaaagatggcagactttctg

SEQ ID NO: 952638 - DNA, 25 bp, Mus musculus
gggattaaagttggcagactttctg

SEQ ID NO: 952639 - DNA, 25 bp, Mus musculus
gggattacagcggctgagatttatt

SEQ ID NO: 952640 - DNA, 25 bp, Mus musculus
gggattacagcttggcttcctgaag

SEQ ID NO: 952641 - DNA, 25 bp, Mus musculus
gggattacaggggctgagatttatt

SEQ ID NO: 952642 - DNA, 25 bp, Mus musculus
gggattacaggttggcttcctgaag

SEQ ID NO: 952643 - DNA, 25 bp, Mus musculus
gggattaccaagctgggcagccgaa

SEQ ID NO: 952644 - DNA, 25 bp, Mus musculus
gggattaccaaggtgggcagccgaa

SEQ ID NO: 952645 - DNA, 25 bp, Mus musculus
gggattagagcagttggaaccctgt

SEQ ID NO: 952646 - DNA, 25 bp, Mus musculus
gggattagaggagttggaaccctgt

SEQ ID NO: 952647 - DNA, 25 bp, Mus musculus
gggattatcatgcgtgccccttccg

SEQ ID NO: 952648 - DNA, 25 bp, Mus musculus
gggattatcatgggtgccccttccg

SEQ ID NO: 952649 - DNA, 25 bp, Mus musculus
gggattattatgctttctcccagat

SEQ ID NO: 952650 - DNA, 25 bp, Mus musculus
gggattattatggtttctcccagat

SEQ ID NO: 952651 - DNA, 25 bp, Mus musculus
gggattatttagcacaggtgatgaa

SEQ ID NO: 952652 - DNA, 25 bp, Mus musculus
gggattatttaggacaggtgatgaa

SEQ ID NO: 952653 - DNA, 25 bp, Mus musculus
gggattcagctcaacgctgtcaagt

SEQ ID NO: 952654 - DNA, 25 bp, Mus musculus
gggattcagctcaaggctgtcaagt

SEQ ID NO: 952655 - DNA, 25 bp, Mus musculus
gggattcatgctgtattttcatctg

SEQ ID NO: 952656 - DNA, 25 bp, Mus musculus
gggattcatggtgtattttcatctg

SEQ ID NO: 952657 - DNA, 25 bp, Mus musculus
gggattcctctacgagagattattt

SEQ ID NO: 952658 - DNA, 25 bp, Mus musculus
gggattcctctaggagagattattt

SEQ ID NO: 952659 - DNA, 25 bp, Mus musculus
gggattcttcagcacaggggatgaa

SEQ ID NO: 952660 - DNA, 25 bp, Mus musculus
gggattcttcaggacaggggatgaa

SEQ ID NO: 952661 - DNA, 25 bp, Mus musculus
gggattcttccgcggaacaagtgcg

SEQ ID NO: 952662 - DNA, 25 bp, Mus musculus
gggattcttccggggaacaagtgcg

SEQ ID NO: 952663 - DNA, 25 bp, Mus musculus
gggattgactttctacaccactacg

SEQ ID NO: 952664 - DNA, 25 bp, Mus musculus
gggattgactttgtacaccactacg

SEQ ID NO: 952665 - DNA, 25 bp, Mus musculus
gggattgcagatttcaaagatacat

SEQ ID NO: 952666 - DNA, 25 bp, Mus musculus
gggattgcagttttcaaagatacat

SEQ ID NO: 952667 - DNA, 25 bp, Mus musculus
gggatttagtctcgcgtgtgcagcc

SEQ ID NO: 952668 - DNA, 25 bp, Mus musculus
gggatttagtctggcgtgtgcagcc

SEQ ID NO: 952669 - DNA, 25 bp, Mus musculus
gggatttcctgattcttccccagaa

SEQ ID NO: 952670 - DNA, 25 bp, Mus musculus
gggatttcctgattgttccccagaa

SEQ ID NO: 952671 - DNA, 25 bp, Mus musculus
gggatttgcaggcaggaaaagcttt

SEQ ID NO: 952672 - DNA, 25 bp, Mus musculus
gggatttgcagggaggaaaagcttt

SEQ ID NO: 952673 - DNA, 25 bp, Mus musculus
gggcaaaactcaatccaacagaggc

SEQ ID NO: 952674 - DNA, 25 bp, Mus musculus
gggcaaaactcattccaacagaggc

SEQ ID NO: 952675 - DNA, 25 bp, Mus musculus
gggcaaaatgggcgagcaacctatc

SEQ ID NO: 952676 - DNA, 25 bp, Mus musculus
gggcaaaatgggggagcaacctatc

SEQ ID NO: 952677 - DNA, 25 bp, Mus musculus
gggcaaagagctgcgtgagcacatg

SEQ ID NO: 952678 - DNA, 25 bp, Mus musculus
gggcaaagaggtgcgtgagcacatg

SEQ ID NO: 952679 - DNA, 25 bp, Mus musculus
gggcaaagctgcctgtgacagactg

SEQ ID NO: 952680 - DNA, 25 bp, Mus musculus
gggcaaagctgcgtgtgacagactg

SEQ ID NO: 952681 - DNA, 25 bp, Mus musculus
gggcaagaagcatcctcctccttgc

SEQ ID NO: 952682 - DNA, 25 bp, Mus musculus
gggcaagaagctgggaatcctagat

SEQ ID NO: 952683 - DNA, 25 bp, Mus musculus
gggcaagaaggatcctcctccttgc

SEQ ID NO: 952684 - DNA, 25 bp, Mus musculus
gggcaagaaggtgggaatcctagat

SEQ ID NO: 952685 - DNA, 25 bp, Mus musculus
gggcaagacgaacgaggcccagaag

SEQ ID NO: 952686 - DNA, 25 bp, Mus musculus
gggcaagacgaaggaggcccagaag

SEQ ID NO: 952687 - DNA, 25 bp, Mus musculus
gggcaagcttcaaggacatccacac

SEQ ID NO: 952688 - DNA, 25 bp, Mus musculus
gggcaagcttcatggacatccacac

SEQ ID NO: 952689 - DNA, 25 bp, Mus musculus
gggcaagtgttgctgatccttgtct

SEQ ID NO: 952690 - DNA, 25 bp, Mus musculus
gggcaagtgttggtgatccttgtct

SEQ ID NO: 952691 - DNA, 25 bp, Mus musculus
gggcacacagcccagcggtgtgagg

SEQ ID NO: 952692 - DNA, 25 bp, Mus musculus
gggcacacaggccagcggtgtgagg

SEQ ID NO: 952693 - DNA, 25 bp, Mus musculus
gggcacagactcaacgctccttgtc

SEQ ID NO: 952694 - DNA, 25 bp, Mus musculus
gggcacagactcaaggctccttgtc

SEQ ID NO: 952695 - DNA, 25 bp, Mus musculus
gggcacagatggcgacagagagaag

SEQ ID NO: 952696 - DNA, 25 bp, Mus musculus
gggcacagatggggacagagagaag

SEQ ID NO: 952697 - DNA, 25 bp, Mus musculus
gggcacaggcatcgtggctgcttgt

SEQ ID NO: 952698 - DNA, 25 bp, Mus musculus
gggcacaggcatggtggctgcttgt

SEQ ID NO: 952699 - DNA, 25 bp, Mus musculus
gggcacatttttcgacatccgcaga

SEQ ID NO: 952700 - DNA, 25 bp, Mus musculus
gggcacatttttcgtcatccgcaga

SEQ ID NO: 952701 - DNA, 25 bp, Mus musculus
gggcaccaagatctccagccaacaa

SEQ ID NO: 952702 - DNA, 25 bp, Mus musculus
gggcaccaagcctgctttggcagga

SEQ ID NO: 952703 - DNA, 25 bp, Mus musculus
gggcaccaaggctgctttggcagga

SEQ ID NO: 952704 - DNA, 25 bp, Mus musculus
gggcaccaagttctccagccaacaa

SEQ ID NO: 952705 - DNA, 25 bp, Mus musculus
gggcaccgagacaaataatttagta

SEQ ID NO: 952706 - DNA, 25 bp, Mus musculus
gggcaccgagctctccagcagaagg

SEQ ID NO: 952707 - DNA, 25 bp, Mus musculus
gggcaccgaggtctccagcagaagg

SEQ ID NO: 952708 - DNA, 25 bp, Mus musculus
gggcaccgagtcaaataatttagta

SEQ ID NO: 952709 - DNA, 25 bp, Mus musculus
gggcaccgtcagcctcaagtccacc

SEQ ID NO: 952710 - DNA, 25 bp, Mus musculus
gggcaccgtcaggctcaagtccacc

SEQ ID NO: 952711 - DNA, 25 bp, Mus musculus
gggcacctggaacctgtggtgtacc

SEQ ID NO: 952712 - DNA, 25 bp, Mus musculus
gggcacctggaacgcctccccagga

SEQ ID NO: 952713 - DNA, 25 bp, Mus musculus
gggcacctggaagctgtggtgtacc

SEQ ID NO: 952714 - DNA, 25 bp, Mus musculus
gggcacctggaaggcctccccagga

SEQ ID NO: 952715 - DNA, 25 bp, Mus musculus
gggcacctggtccgatacatcatct

SEQ ID NO: 952716 - DNA, 25 bp, Mus musculus
gggcacctggtcggatacatcatct

SEQ ID NO: 952717 - DNA, 25 bp, Mus musculus
gggcacgtctgccactgcgaccagt

SEQ ID NO: 952718 - DNA, 25 bp, Mus musculus
gggcacgtctgccagtgcgaccagt

SEQ ID NO: 952719 - DNA, 25 bp, Mus musculus
gggcactctcgaccaaatcatgaag

SEQ ID NO: 952720 - DNA, 25 bp, Mus musculus
gggcactctcgagcaaatcatgaag

SEQ ID NO: 952721 - DNA, 25 bp, Mus musculus
gggcactgcagacacaggtacttgg

SEQ ID NO: 952722 - DNA, 25 bp, Mus musculus
gggcactgcagagacaggtacttgg

SEQ ID NO: 952723 - DNA, 25 bp, Mus musculus
gggcactggcagccctgtacggaga

SEQ ID NO: 952724 - DNA, 25 bp, Mus musculus
gggcactggcagcgctggtctacaa

SEQ ID NO: 952725 - DNA, 25 bp, Mus musculus
gggcactggcaggcctgtacggaga

SEQ ID NO: 952726 - DNA, 25 bp, Mus musculus
gggcactggcagggctggtctacaa

SEQ ID NO: 952727 - DNA, 25 bp, Mus musculus
gggcacttcgagaggttgcaggccc

SEQ ID NO: 952728 - DNA, 25 bp, Mus musculus
gggcacttcgagtggttgcaggccc

SEQ ID NO: 952729 - DNA, 25 bp, Mus musculus
gggcactttccactcaaccaaggcc

SEQ ID NO: 952730 - DNA, 25 bp, Mus musculus
gggcactttccagtcaaccaaggcc

SEQ ID NO: 952731 - DNA, 25 bp, Mus musculus
gggcagaaactgcccagcaagcctg

SEQ ID NO: 952732 - DNA, 25 bp, Mus musculus
gggcagaaactggccagcaagcctg

SEQ ID NO: 952733 - DNA, 25 bp, Mus musculus
gggcagaacgagcttgtgaaccatg

SEQ ID NO: 952734 - DNA, 25 bp, Mus musculus
gggcagaacgaggttgtgaaccatg

SEQ ID NO: 952735 - DNA, 25 bp, Mus musculus
gggcagaagccacgccctgacctca

SEQ ID NO: 952736 - DNA, 25 bp, Mus musculus
gggcagaagccaggccctgacctca

SEQ ID NO: 952737 - DNA, 25 bp, Mus musculus
gggcagagcaggcgcgactgtcctg

SEQ ID NO: 952738 - DNA, 25 bp, Mus musculus
gggcagagcaggcgggactgtcctg

SEQ ID NO: 952739 - DNA, 25 bp, Mus musculus
gggcagagccaaccacttacgcctg

SEQ ID NO: 952740 - DNA, 25 bp, Mus musculus
gggcagagccaagcacttacgcctg

SEQ ID NO: 952741 - DNA, 25 bp, Mus musculus
gggcagagctcacgatttctggtag

SEQ ID NO: 952742 - DNA, 25 bp, Mus musculus
gggcagagctcaggatttctggtag

SEQ ID NO: 952743 - DNA, 25 bp, Mus musculus
gggcagaggccgaacgtgatgtcct

SEQ ID NO: 952744 - DNA, 25 bp, Mus musculus
gggcagaggcggaacgtgatgtcct

SEQ ID NO: 952745 - DNA, 25 bp, Mus musculus
gggcagagggaacatcccaaccctt

SEQ ID NO: 952746 - DNA, 25 bp, Mus musculus
gggcagagggtacatcccaaccctt

SEQ ID NO: 952747 - DNA, 25 bp, Mus musculus
gggcagattcagcacagagctgatg

SEQ ID NO: 952748 - DNA, 25 bp, Mus musculus
gggcagattcagctgattctcgggc

SEQ ID NO: 952749 - DNA, 25 bp, Mus musculus
gggcagattcaggacagagctgatg

SEQ ID NO: 952750 - DNA, 25 bp, Mus musculus
gggcagattcaggtgattctcgggc

SEQ ID NO: 952751 - DNA, 25 bp, Mus musculus
gggcagcagaggcccccaactcctg

SEQ ID NO: 952752 - DNA, 25 bp, Mus musculus
gggcagcagagggccccaactcctg

SEQ ID NO: 952753 - DNA, 25 bp, Mus musculus
gggcagcagcaccacatttcaatgg

SEQ ID NO: 952754 - DNA, 25 bp, Mus musculus
gggcagcagcaccacggcctgtcca

SEQ ID NO: 952755 - DNA, 25 bp, Mus musculus
gggcagcagcaccagatttcaatgg

SEQ ID NO: 952756 - DNA, 25 bp, Mus musculus
gggcagcagcaccagggcctgtcca

SEQ ID NO: 952757 - DNA, 25 bp, Mus musculus
gggcagcagccaagcacacttagcc

SEQ ID NO: 952758 - DNA, 25 bp, Mus musculus
gggcagcagccaaggacacttagcc

SEQ ID NO: 952759 - DNA, 25 bp, Mus musculus
gggcagccagccaccacctaccctg

SEQ ID NO: 952760 - DNA, 25 bp, Mus musculus
gggcagccaggcaccacctaccctg

SEQ ID NO: 952761 - DNA, 25 bp, Mus musculus
gggcagcctatgaacattgaagaga

SEQ ID NO: 952762 - DNA, 25 bp, Mus musculus
gggcagcctatgaagattgaagaga

SEQ ID NO: 952763 - DNA, 25 bp, Mus musculus
gggcagccttactacgtcatgcaca

SEQ ID NO: 952764 - DNA, 25 bp, Mus musculus
gggcagccttactaggtcatgcaca

SEQ ID NO: 952765 - DNA, 25 bp, Mus musculus
gggcagcggtggcacaatgttggct

SEQ ID NO: 952766 - DNA, 25 bp, Mus musculus
gggcagcggtggcagaatgttggct

SEQ ID NO: 952767 - DNA, 25 bp, Mus musculus
gggcagctagctcgatcaccgacaa

SEQ ID NO: 952768 - DNA, 25 bp, Mus musculus
gggcagctagctggatcaccgacaa

SEQ ID NO: 952769 - DNA, 25 bp, Mus musculus
gggcagctcaaggacgctcaacgca

SEQ ID NO: 952770 - DNA, 25 bp, Mus musculus
gggcagctcaaggaggctcaacgca

SEQ ID NO: 952771 - DNA, 25 bp, Mus musculus
gggcagctgagacgtttgccaagga

SEQ ID NO: 952772 - DNA, 25 bp, Mus musculus
gggcagctgagaggtttgccaagga

SEQ ID NO: 952773 - DNA, 25 bp, Mus musculus
gggcaggaagaacgttgctcaggac

SEQ ID NO: 952774 - DNA, 25 bp, Mus musculus
gggcaggaagaaggttgctcaggac

SEQ ID NO: 952775 - DNA, 25 bp, Mus musculus
gggcaggatactatctatataacag

SEQ ID NO: 952776 - DNA, 25 bp, Mus musculus
gggcaggatactatgtatataacag

SEQ ID NO: 952777 - DNA, 25 bp, Mus musculus
gggcaggcagccactcccgagactc

SEQ ID NO: 952778 - DNA, 25 bp, Mus musculus
gggcaggcaggcactcccgagactc

SEQ ID NO: 952779 - DNA, 25 bp, Mus musculus
gggcaggccatcaacgtgactcaca

SEQ ID NO: 952780 - DNA, 25 bp, Mus musculus
gggcaggccatcaaggtgactcaca

SEQ ID NO: 952781 - DNA, 25 bp, Mus musculus
gggcaggcggctgattatagagcga

SEQ ID NO: 952782 - DNA, 25 bp, Mus musculus
gggcaggcgggtgattatagagcga

SEQ ID NO: 952783 - DNA, 25 bp, Mus musculus
gggcagggatcacatgggactgagt

SEQ ID NO: 952784 - DNA, 25 bp, Mus musculus
gggcagggatcagatgggactgagt

SEQ ID NO: 952785 - DNA, 25 bp, Mus musculus
gggcaggtagccaaccttgaggcgg

SEQ ID NO: 952786 - DNA, 25 bp, Mus musculus
gggcaggtagccaagcttgaggcgg

SEQ ID NO: 952787 - DNA, 25 bp, Mus musculus
gggcaggtgacacgcatcgactggg

SEQ ID NO: 952788 - DNA, 25 bp, Mus musculus
gggcaggtgacaggcatcgactggg

SEQ ID NO: 952789 - DNA, 25 bp, Mus musculus
gggcaggtggtgaccatctgggctt

SEQ ID NO: 952790 - DNA, 25 bp, Mus musculus
gggcaggtggtgacgatctgggctt

SEQ ID NO: 952791 - DNA, 25 bp, Mus musculus
gggcagtgcctacatattgatgaat

SEQ ID NO: 952792 - DNA, 25 bp, Mus musculus
gggcagtgcctagatattgatgaat

SEQ ID NO: 952793 - DNA, 25 bp, Mus musculus
gggcataaagcttacatatatggaa

SEQ ID NO: 952794 - DNA, 25 bp, Mus musculus
gggcataaaggttacatatatggaa

SEQ ID NO: 952795 - DNA, 25 bp, Mus musculus
gggcataatagcaacgattggagaa

SEQ ID NO: 952796 - DNA, 25 bp, Mus musculus
gggcataatagcaaggattggagaa

SEQ ID NO: 952797 - DNA, 25 bp, Mus musculus
gggcatactttatacgactcattct

SEQ ID NO: 952798 - DNA, 25 bp, Mus musculus
gggcatactttataggactcattct

SEQ ID NO: 952799 - DNA, 25 bp, Mus musculus
gggcatatcacacgtattgactggg

SEQ ID NO: 952800 - DNA, 25 bp, Mus musculus
gggcatatcacaggtattgactggg

SEQ ID NO: 952801 - DNA, 25 bp, Mus musculus
gggcatcaagaagtcaacaaaaggc

SEQ ID NO: 952802 - DNA, 25 bp, Mus musculus
gggcatcaagaattggctggatccc

SEQ ID NO: 952803 - DNA, 25 bp, Mus musculus
gggcatcaagctccggcaccagcag

SEQ ID NO: 952804 - DNA, 25 bp, Mus musculus
gggcatcaaggtccggcaccagcag

SEQ ID NO: 952805 - DNA, 25 bp, Mus musculus
gggcatcaagtagtcaacaaaaggc

SEQ ID NO: 952806 - DNA, 25 bp, Mus musculus
gggcatcaagtattggctggatccc

SEQ ID NO: 952807 - DNA, 25 bp, Mus musculus
gggcatccaggccaaattagaaaaa

SEQ ID NO: 952808 - DNA, 25 bp, Mus musculus
gggcatccaggccatattagaaaaa

SEQ ID NO: 952809 - DNA, 25 bp, Mus musculus
gggcatcctgtccccaaacaagcct

SEQ ID NO: 952810 - DNA, 25 bp, Mus musculus
gggcatcctgtcccgaaacaagcct

SEQ ID NO: 952811 - DNA, 25 bp, Mus musculus
gggcatctcactccaatgcctgtca

SEQ ID NO: 952812 - DNA, 25 bp, Mus musculus
gggcatctcactcgtggagctggca

SEQ ID NO: 952813 - DNA, 25 bp, Mus musculus
gggcatctcactgcaatgcctgtca

SEQ ID NO: 952814 - DNA, 25 bp, Mus musculus
gggcatctcactggtggagctggca

SEQ ID NO: 952815 - DNA, 25 bp, Mus musculus
gggcatcttggacaaagaggcctca

SEQ ID NO: 952816 - DNA, 25 bp, Mus musculus
gggcatcttggagaaagaggcctca

SEQ ID NO: 952817 - DNA, 25 bp, Mus musculus
gggcatgaagctcagtgaagatggc

SEQ ID NO: 952818 - DNA, 25 bp, Mus musculus
gggcatgaagctgagtgaagatggc

SEQ ID NO: 952819 - DNA, 25 bp, Mus musculus
gggcatgagagtcacgtttcccaac

SEQ ID NO: 952820 - DNA, 25 bp, Mus musculus
gggcatgagagtcaggtttcccaac

SEQ ID NO: 952821 - DNA, 25 bp, Mus musculus
gggcatgaggagaaccctatgggaa

SEQ ID NO: 952822 - DNA, 25 bp, Mus musculus
gggcatgaggagaagcctatgggaa

SEQ ID NO: 952823 - DNA, 25 bp, Mus musculus
gggcattaagataagggtgtggtgc

SEQ ID NO: 952824 - DNA, 25 bp, Mus musculus
gggcattaagctagataagggtgtg

SEQ ID NO: 952825 - DNA, 25 bp, Mus musculus
gggcattaaggtagataagggtgtg

SEQ ID NO: 952826 - DNA, 25 bp, Mus musculus
gggcattaagttaagggtgtggtgc

SEQ ID NO: 952827 - DNA, 25 bp, Mus musculus
gggcattatgaggtctcagaaatgc

SEQ ID NO: 952828 - DNA, 25 bp, Mus musculus
gggcattatgaggtgtcagaaatgc

SEQ ID NO: 952829 - DNA, 25 bp, Mus musculus
gggcattgcccacaccgtgttcctg

SEQ ID NO: 952830 - DNA, 25 bp, Mus musculus
gggcattgcccacgtgaaaatccag

SEQ ID NO: 952831 - DNA, 25 bp, Mus musculus
gggcattgcccagaccgtgttcctg

SEQ ID NO: 952832 - DNA, 25 bp, Mus musculus
gggcattgcccaggtgaaaatccag

SEQ ID NO: 952833 - DNA, 25 bp, Mus musculus
gggcattgggcatgaagctctcccc

SEQ ID NO: 952834 - DNA, 25 bp, Mus musculus
gggcattgggctggacagtgacacg

SEQ ID NO: 952835 - DNA, 25 bp, Mus musculus
gggcattggggatgaagctctcccc

SEQ ID NO: 952836 - DNA, 25 bp, Mus musculus
gggcattggggtggacagtgacacg

SEQ ID NO: 952837 - DNA, 25 bp, Mus musculus
gggcatttggcacacagcaggttcc

SEQ ID NO: 952838 - DNA, 25 bp, Mus musculus
gggcatttgggacacagcaggttcc

SEQ ID NO: 952839 - DNA, 25 bp, Mus musculus
gggccaagaaagatccgtcgtcagc

SEQ ID NO: 952840 - DNA, 25 bp, Mus musculus
gggccaagaaagttccgtcgtcagc

SEQ ID NO: 952841 - DNA, 25 bp, Mus musculus
gggccaaggatgctcggaagtccgt

SEQ ID NO: 952842 - DNA, 25 bp, Mus musculus
gggccaaggatgctgggaagtccgt

SEQ ID NO: 952843 - DNA, 25 bp, Mus musculus
gggccaaggcgtcattaaggttgag

SEQ ID NO: 952844 - DNA, 25 bp, Mus musculus
gggccaaggcgtgattaaggttgag

SEQ ID NO: 952845 - DNA, 25 bp, Mus musculus
gggccaagtacacactgtgtgattc

SEQ ID NO: 952846 - DNA, 25 bp, Mus musculus
gggccaagtacacagtgtgtgattc

SEQ ID NO: 952847 - DNA, 25 bp, Mus musculus
gggccaagttagcaccactccaggg

SEQ ID NO: 952848 - DNA, 25 bp, Mus musculus
gggccaagttagcagcactccaggg

SEQ ID NO: 952849 - DNA, 25 bp, Mus musculus
gggccaattctgcaccaccaaggcc

SEQ ID NO: 952850 - DNA, 25 bp, Mus musculus
gggccaattctggaccaccaaggcc

SEQ ID NO: 952851 - DNA, 25 bp, Mus musculus
gggccacacaagacgcgagcacagg

SEQ ID NO: 952852 - DNA, 25 bp, Mus musculus
gggccacacaagtcgcgagcacagg

SEQ ID NO: 952853 - DNA, 25 bp, Mus musculus
gggccacagaagccaaccgtgtgac

SEQ ID NO: 952854 - DNA, 25 bp, Mus musculus
gggccacagaaggcaaccgtgtgac

SEQ ID NO: 952855 - DNA, 25 bp, Mus musculus
gggccagaagcagctcccagcgagc

SEQ ID NO: 952856 - DNA, 25 bp, Mus musculus
gggccagaagctgatggtgcagggc

SEQ ID NO: 952857 - DNA, 25 bp, Mus musculus
gggccagaaggagctcccagcgagc

SEQ ID NO: 952858 - DNA, 25 bp, Mus musculus
gggccagaaggtgatggtgcagggc

SEQ ID NO: 952859 - DNA, 25 bp, Mus musculus
gggccagagacacacgaacctgagg

SEQ ID NO: 952860 - DNA, 25 bp, Mus musculus
gggccagagacacaggaacctgagg

SEQ ID NO: 952861 - DNA, 25 bp, Mus musculus
gggccagagcagcacggccctgttc

SEQ ID NO: 952862 - DNA, 25 bp, Mus musculus
gggccagagcagcagggccctgttc

SEQ ID NO: 952863 - DNA, 25 bp, Mus musculus
gggccagccatgctggctggggagt

SEQ ID NO: 952864 - DNA, 25 bp, Mus musculus
gggccagccatggtggctggggagt

SEQ ID NO: 952865 - DNA, 25 bp, Mus musculus
gggccagctcaacgagcattgcctg

SEQ ID NO: 952866 - DNA, 25 bp, Mus musculus
gggccagctcaaggagcattgcctg

SEQ ID NO: 952867 - DNA, 25 bp, Mus musculus
gggccagctccacgtcacaggatgc

SEQ ID NO: 952868 - DNA, 25 bp, Mus musculus
gggccagctccaggtcacaggatgc

SEQ ID NO: 952869 - DNA, 25 bp, Mus musculus
gggccaggacgctgctctgccatca

SEQ ID NO: 952870 - DNA, 25 bp, Mus musculus
gggccaggacgctggtctgccatca

SEQ ID NO: 952871 - DNA, 25 bp, Mus musculus
gggccaggatgctaagatggctggt

SEQ ID NO: 952872 - DNA, 25 bp, Mus musculus
gggccaggatgctatgatggctggt

SEQ ID NO: 952873 - DNA, 25 bp, Mus musculus
gggccagggatcactctctccaccc

SEQ ID NO: 952874 - DNA, 25 bp, Mus musculus
gggccagggatcagatgcgggctcc

SEQ ID NO: 952875 - DNA, 25 bp, Mus musculus
gggccagggatctctctctccaccc

SEQ ID NO: 952876 - DNA, 25 bp, Mus musculus
gggccagggatctgatgcgggctcc

SEQ ID NO: 952877 - DNA, 25 bp, Mus musculus
gggccagtcaggatcgtgaagcgca

SEQ ID NO: 952878 - DNA, 25 bp, Mus musculus
gggccagtcaggatggtgaagcgca

SEQ ID NO: 952879 - DNA, 25 bp, Mus musculus
gggccatcccaacacgtgatgaccc

SEQ ID NO: 952880 - DNA, 25 bp, Mus musculus
gggccatcccaacaggtgatgaccc

SEQ ID NO: 952881 - DNA, 25 bp, Mus musculus
gggccatcttggatcttctggacac

SEQ ID NO: 952882 - DNA, 25 bp, Mus musculus
gggccatcttggatgttctggacac

SEQ ID NO: 952883 - DNA, 25 bp, Mus musculus
gggccatggagctcattctacctcc

SEQ ID NO: 952884 - DNA, 25 bp, Mus musculus
gggccatggagctctttctacctcc

SEQ ID NO: 952885 - DNA, 25 bp, Mus musculus
gggccattcacacacgccgatacaa

SEQ ID NO: 952886 - DNA, 25 bp, Mus musculus
gggccattcacacaggccgatacaa

SEQ ID NO: 952887 - DNA, 25 bp, Mus musculus
gggcccaaagaagacacccatataa

SEQ ID NO: 952888 - DNA, 25 bp, Mus musculus
gggcccaaagaagagacccatataa

SEQ ID NO: 952889 - DNA, 25 bp, Mus musculus
gggcccaacaaacgcagctgagatg

SEQ ID NO: 952890 - DNA, 25 bp, Mus musculus
gggcccaacaaaggcagctgagatg

SEQ ID NO: 952891 - DNA, 25 bp, Mus musculus
gggcccacagtgcgggctgaagaat

SEQ ID NO: 952892 - DNA, 25 bp, Mus musculus
gggcccacagtgcttctcactgtgg

SEQ ID NO: 952893 - DNA, 25 bp, Mus musculus
gggcccacagtgggggctgaagaat

SEQ ID NO: 952894 - DNA, 25 bp, Mus musculus
gggcccacagtggttctcactgtgg

SEQ ID NO: 952895 - DNA, 25 bp, Mus musculus
gggcccaccaagctgcagctgaact

SEQ ID NO: 952896 - DNA, 25 bp, Mus musculus
gggcccaccaaggtgcagctgaact

SEQ ID NO: 952897 - DNA, 25 bp, Mus musculus
gggcccatctcccacactgataatg

SEQ ID NO: 952898 - DNA, 25 bp, Mus musculus
gggcccatctcccagactgataatg

SEQ ID NO: 952899 - DNA, 25 bp, Mus musculus
gggccccacgcatgctggtggactg

SEQ ID NO: 952900 - DNA, 25 bp, Mus musculus
gggccccacggatgctggtggactg

SEQ ID NO: 952901 - DNA, 25 bp, Mus musculus
gggccccagcagctctactggacag

SEQ ID NO: 952902 - DNA, 25 bp, Mus musculus
gggccccagcaggtctactggacag

SEQ ID NO: 952903 - DNA, 25 bp, Mus musculus
gggccccagctgattcagccatggc

SEQ ID NO: 952904 - DNA, 25 bp, Mus musculus
gggccccagctgtttcagccatggc

SEQ ID NO: 952905 - DNA, 25 bp, Mus musculus
gggcccgacagaatactcctaagac

SEQ ID NO: 952906 - DNA, 25 bp, Mus musculus
gggcccgacagaattctcctaagac

SEQ ID NO: 952907 - DNA, 25 bp, Mus musculus
gggcccgttcagcgctgggcttcaa

SEQ ID NO: 952908 - DNA, 25 bp, Mus musculus
gggcccgttcagggctgggcttcaa

SEQ ID NO: 952909 - DNA, 25 bp, Mus musculus
gggccctatcagaacaccatcgggg

SEQ ID NO: 952910 - DNA, 25 bp, Mus musculus
gggccctatcagaagaccatcgggg

SEQ ID NO: 952911 - DNA, 25 bp, Mus musculus
gggccctcagcaacaatggcccaag

SEQ ID NO: 952912 - DNA, 25 bp, Mus musculus
gggccctcaggaacaatggcccaag

SEQ ID NO: 952913 - DNA, 25 bp, Mus musculus
gggccctccgcgcagagcgccgacc

SEQ ID NO: 952914 - DNA, 25 bp, Mus musculus
gggccctccgggcagagcgccgacc

SEQ ID NO: 952915 - DNA, 25 bp, Mus musculus
gggccctcgatgagatgtgatcttc

SEQ ID NO: 952916 - DNA, 25 bp, Mus musculus
gggccctcgatgtgatgtgatcttc

SEQ ID NO: 952917 - DNA, 25 bp, Mus musculus
gggccctgtcgcctctctgccacaa

SEQ ID NO: 952918 - DNA, 25 bp, Mus musculus
gggccctgtcgcctgtctgccacaa

SEQ ID NO: 952919 - DNA, 25 bp, Mus musculus
gggcccttgatgtgaggcgtgtgtg

SEQ ID NO: 952920 - DNA, 25 bp, Mus musculus
gggcccttgatgtgtggcgtgtgtg

SEQ ID NO: 952921 - DNA, 25 bp, Mus musculus
gggccgcaagctcctggagctcctg

SEQ ID NO: 952922 - DNA, 25 bp, Mus musculus
gggccgcaaggtcctggagctcctg

SEQ ID NO: 952923 - DNA, 25 bp, Mus musculus
gggccgccgccacgtgtgcaacaga

SEQ ID NO: 952924 - DNA, 25 bp, Mus musculus
gggccgccgccaggtgtgcaacaga

SEQ ID NO: 952925 - DNA, 25 bp, Mus musculus
gggccgcgacatcgactgtcctgtg

SEQ ID NO: 952926 - DNA, 25 bp, Mus musculus
gggccgcgacatggactgtcctgtg

SEQ ID NO: 952927 - DNA, 25 bp, Mus musculus
gggccgcgctgggacgcatgtcatg

SEQ ID NO: 952928 - DNA, 25 bp, Mus musculus
gggccgcgctgggaggcatgtcatg

SEQ ID NO: 952929 - DNA, 25 bp, Mus musculus
gggccggactgagacaattctgagt

SEQ ID NO: 952930 - DNA, 25 bp, Mus musculus
gggccggactgagagaattctgagt

SEQ ID NO: 952931 - DNA, 25 bp, Mus musculus
gggccgggagagacttggtctttgt

SEQ ID NO: 952932 - DNA, 25 bp, Mus musculus
gggccgggagagtcttggtctttgt

SEQ ID NO: 952933 - DNA, 25 bp, Mus musculus
gggccgtccgagcatgtggatgagt

SEQ ID NO: 952934 - DNA, 25 bp, Mus musculus
gggccgtccgaggatgtggatgagt

SEQ ID NO: 952935 - DNA, 25 bp, Mus musculus
gggccgtcgtgtaggcgtctggaac

SEQ ID NO: 952936 - DNA, 25 bp, Mus musculus
gggccgtcgtgttggcgtctggaac

SEQ ID NO: 952937 - DNA, 25 bp, Mus musculus
gggccgtggaagagtgaagacacct

SEQ ID NO: 952938 - DNA, 25 bp, Mus musculus
gggccgtggaagtgtgaagacacct

SEQ ID NO: 952939 - DNA, 25 bp, Mus musculus
gggcctacagaacaggaggccactg

SEQ ID NO: 952940 - DNA, 25 bp, Mus musculus
gggcctacagaagaggaggccactg

SEQ ID NO: 952941 - DNA, 25 bp, Mus musculus
gggcctattgtgcgttccactcgca

SEQ ID NO: 952942 - DNA, 25 bp, Mus musculus
gggcctattgtgggttccactcgca

SEQ ID NO: 952943 - DNA, 25 bp, Mus musculus
gggcctccctctcatcgatgaggtg

SEQ ID NO: 952944 - DNA, 25 bp, Mus musculus
gggcctccctctgatcgatgaggtg

SEQ ID NO: 952945 - DNA, 25 bp, Mus musculus
gggcctccgtcccccacacacctgc

SEQ ID NO: 952946 - DNA, 25 bp, Mus musculus
gggcctccgtccccgacacacctgc

SEQ ID NO: 952947 - DNA, 25 bp, Mus musculus
gggcctcctctcatgactcggcata

SEQ ID NO: 952948 - DNA, 25 bp, Mus musculus
gggcctcctctcttgactcggcata

SEQ ID NO: 952949 - DNA, 25 bp, Mus musculus
gggcctcctgctccagtgactttcc

SEQ ID NO: 952950 - DNA, 25 bp, Mus musculus
gggcctcctgctcctgtgactttcc

SEQ ID NO: 952951 - DNA, 25 bp, Mus musculus
gggcctcctggccaggtggccattg

SEQ ID NO: 952952 - DNA, 25 bp, Mus musculus
gggcctcctggcgaggtggccattg

SEQ ID NO: 952953 - DNA, 25 bp, Mus musculus
gggcctcgtactcacaaacgaaagc

SEQ ID NO: 952954 - DNA, 25 bp, Mus musculus
gggcctcgtactcagaaacgaaagc

SEQ ID NO: 952955 - DNA, 25 bp, Mus musculus
gggcctctcaaacgacagtgaactt

SEQ ID NO: 952956 - DNA, 25 bp, Mus musculus
gggcctctcaaaggacagtgaactt

SEQ ID NO: 952957 - DNA, 25 bp, Mus musculus
gggcctctgtccagagtcacagcct

SEQ ID NO: 952958 - DNA, 25 bp, Mus musculus
gggcctctgtccagtgtcacagcct

SEQ ID NO: 952959 - DNA, 25 bp, Mus musculus
gggcctgattctgacgttctgctgt

SEQ ID NO: 952960 - DNA, 25 bp, Mus musculus
gggcctgattctgaggttctgctgt

SEQ ID NO: 952961 - DNA, 25 bp, Mus musculus
gggcctgcagcgccggctcccaggc

SEQ ID NO: 952962 - DNA, 25 bp, Mus musculus
gggcctgcagggccggctcccaggc

SEQ ID NO: 952963 - DNA, 25 bp, Mus musculus
gggcctggagatggatccagagacc

SEQ ID NO: 952964 - DNA, 25 bp, Mus musculus
gggcctggagcacatcatgttcatg

SEQ ID NO: 952965 - DNA, 25 bp, Mus musculus
gggcctggagctgtcgaaggtccaa

SEQ ID NO: 952966 - DNA, 25 bp, Mus musculus
gggcctggagctgtggaaggtccaa

SEQ ID NO: 952967 - DNA, 25 bp, Mus musculus
gggcctggaggacatcatgttcatg

SEQ ID NO: 952968 - DNA, 25 bp, Mus musculus
gggcctggagttggatccagagacc

SEQ ID NO: 952969 - DNA, 25 bp, Mus musculus
gggcctgggaagcgccccagtgctc

SEQ ID NO: 952970 - DNA, 25 bp, Mus musculus
gggcctgggaagggccccagtgctc

SEQ ID NO: 952971 - DNA, 25 bp, Mus musculus
gggcctgtcgtgatgtcaacgaatg

SEQ ID NO: 952972 - DNA, 25 bp, Mus musculus
gggcctgtcgtgttgtcaacgaatg

SEQ ID NO: 952973 - DNA, 25 bp, Mus musculus
gggcctgtgctggacgcttttggga

SEQ ID NO: 952974 - DNA, 25 bp, Mus musculus
gggcctgtgctggaggcttttggga

SEQ ID NO: 952975 - DNA, 25 bp, Mus musculus
gggccttaaatcagtgtcggtgacg

SEQ ID NO: 952976 - DNA, 25 bp, Mus musculus
gggccttaaatctgtgtcggtgacg

SEQ ID NO: 952977 - DNA, 25 bp, Mus musculus
gggccttcagatttgatgagatggc

SEQ ID NO: 952978 - DNA, 25 bp, Mus musculus
gggccttcagcaagatgctaccaag

SEQ ID NO: 952979 - DNA, 25 bp, Mus musculus
gggccttcaggaagatgctaccaag

SEQ ID NO: 952980 - DNA, 25 bp, Mus musculus
gggccttcagttttgatgagatggc

SEQ ID NO: 952981 - DNA, 25 bp, Mus musculus
gggccttccacgcagtagaggcccg

SEQ ID NO: 952982 - DNA, 25 bp, Mus musculus
gggccttccaggcagtagaggcccg

SEQ ID NO: 952983 - DNA, 25 bp, Mus musculus
gggccttctacacagcgtgggtttc

SEQ ID NO: 952984 - DNA, 25 bp, Mus musculus
gggccttctagacagcgtgggtttc

SEQ ID NO: 952985 - DNA, 25 bp, Mus musculus
gggccttgctgccacgtatgaatca

SEQ ID NO: 952986 - DNA, 25 bp, Mus musculus
gggccttgctgccaggtatgaatca

SEQ ID NO: 952987 - DNA, 25 bp, Mus musculus
gggccttgggcgcctgggctggtgc

SEQ ID NO: 952988 - DNA, 25 bp, Mus musculus
gggccttgggggcctgggctggtgc

SEQ ID NO: 952989 - DNA, 25 bp, Mus musculus
gggccttgtacacgtatcacaaggc

SEQ ID NO: 952990 - DNA, 25 bp, Mus musculus
gggccttgtacaggtatcacaaggc

SEQ ID NO: 952991 - DNA, 25 bp, Mus musculus
gggcctttgctgcggacagtaaatc

SEQ ID NO: 952992 - DNA, 25 bp, Mus musculus
gggcctttgctggggacagtaaatc

SEQ ID NO: 952993 - DNA, 25 bp, Mus musculus
gggcgaccgcagctgggcaggtgtg

SEQ ID NO: 952994 - DNA, 25 bp, Mus musculus
gggcgaccgcaggtgggcaggtgtg

SEQ ID NO: 952995 - DNA, 25 bp, Mus musculus
gggcgagagtggcctgtaaaaaatg

SEQ ID NO: 952996 - DNA, 25 bp, Mus musculus
gggcgagagtgggctgtaaaaaatg

SEQ ID NO: 952997 - DNA, 25 bp, Mus musculus
gggcgagcagagcagacccaggaga

SEQ ID NO: 952998 - DNA, 25 bp, Mus musculus
gggcgagcagagcctctggatggac

SEQ ID NO: 952999 - DNA, 25 bp, Mus musculus
gggcgagcagagctgcacccagtag

SEQ ID NO: 953000 - DNA, 25 bp, Mus musculus
gggcgagcagaggtgcacccagtag

SEQ ID NO: 953001 - DNA, 25 bp, Mus musculus
gggcgagcagcctctggatggaccc

SEQ ID NO: 953002 - DNA, 25 bp, Mus musculus
gggcgagcagctggaagggactcag

SEQ ID NO: 953003 - DNA, 25 bp, Mus musculus
gggcgagcaggctctggatggaccc

SEQ ID NO: 953004 - DNA, 25 bp, Mus musculus
gggcgagcaggtggaagggactcag

SEQ ID NO: 953005 - DNA, 25 bp, Mus musculus
gggcgagcagtgcagacccaggaga

SEQ ID NO: 953006 - DNA, 25 bp, Mus musculus
gggcgagcagtgcctctggatggac

SEQ ID NO: 953007 - DNA, 25 bp, Mus musculus
gggcgagctctgaacatagcagtgg

SEQ ID NO: 953008 - DNA, 25 bp, Mus musculus
gggcgagctctgaagatagcagtgg

SEQ ID NO: 953009 - DNA, 25 bp, Mus musculus
gggcgaggagagcccgttgtctgga

SEQ ID NO: 953010 - DNA, 25 bp, Mus musculus
gggcgaggagagccggttgtctgga

SEQ ID NO: 953011 - DNA, 25 bp, Mus musculus
gggcgaggaggagacgctgcgcctg

SEQ ID NO: 953012 - DNA, 25 bp, Mus musculus
gggcgaggaggagaggctgcgcctg

SEQ ID NO: 953013 - DNA, 25 bp, Mus musculus
gggcgagggtgacgtgtgtgtgaaa

SEQ ID NO: 953014 - DNA, 25 bp, Mus musculus
gggcgagggtgaggtgtgtgtgaaa

SEQ ID NO: 953015 - DNA, 25 bp, Mus musculus
gggcgagggtgatgcgagtgagcct

SEQ ID NO: 953016 - DNA, 25 bp, Mus musculus
gggcgagggtgatgggagtgagcct

SEQ ID NO: 953017 - DNA, 25 bp, Mus musculus
gggcgataaaggatcccttccctga

SEQ ID NO: 953018 - DNA, 25 bp, Mus musculus
gggcgataaaggttcccttccctga

SEQ ID NO: 953019 - DNA, 25 bp, Mus musculus
gggcgatgggccactggctccagca

SEQ ID NO: 953020 - DNA, 25 bp, Mus musculus
gggcgatggggcactggctccagca

SEQ ID NO: 953021 - DNA, 25 bp, Mus musculus
gggcgattctgacgcactcctccac

SEQ ID NO: 953022 - DNA, 25 bp, Mus musculus
gggcgattctgaggcactcctccac

SEQ ID NO: 953023 - DNA, 25 bp, Mus musculus
gggcgcacagccctgtgaagccaga

SEQ ID NO: 953024 - DNA, 25 bp, Mus musculus
gggcgcacagctctgctgtgccacc

SEQ ID NO: 953025 - DNA, 25 bp, Mus musculus
gggcgcacaggcctgtgaagccaga

SEQ ID NO: 953026 - DNA, 25 bp, Mus musculus
gggcgcacaggtctgctgtgccacc

SEQ ID NO: 953027 - DNA, 25 bp, Mus musculus
gggcgcaccaagcccatggtggcgt

SEQ ID NO: 953028 - DNA, 25 bp, Mus musculus
gggcgcaccaaggccatggtggcgt

SEQ ID NO: 953029 - DNA, 25 bp, Mus musculus
gggcgcaggatggacgagagagggc

SEQ ID NO: 953030 - DNA, 25 bp, Mus musculus
gggcgcaggatggaggagagagggc

SEQ ID NO: 953031 - DNA, 25 bp, Mus musculus
gggcgcatcgcagacttgacatcct

SEQ ID NO: 953032 - DNA, 25 bp, Mus musculus
gggcgcatcgcagagttgacatcct

SEQ ID NO: 953033 - DNA, 25 bp, Mus musculus
gggcgcatctgcctcaacgatgacg

SEQ ID NO: 953034 - DNA, 25 bp, Mus musculus
gggcgcatctgcctgaacgatgacg

SEQ ID NO: 953035 - DNA, 25 bp, Mus musculus
gggcgcccaggggacatgtatacca

SEQ ID NO: 953036 - DNA, 25 bp, Mus musculus
gggcgcccaggggagatgtatacca

SEQ ID NO: 953037 - DNA, 25 bp, Mus musculus
gggcgcctggtggacgacatggaaa

SEQ ID NO: 953038 - DNA, 25 bp, Mus musculus
gggcgcctggtggaggacatggaaa

SEQ ID NO: 953039 - DNA, 25 bp, Mus musculus
gggcgcgcagcatgcacctggccct

SEQ ID NO: 953040 - DNA, 25 bp, Mus musculus
gggcgcgcaggatgcacctggccct

SEQ ID NO: 953041 - DNA, 25 bp, Mus musculus
gggcgcgctaaaaaagcttgtttct

SEQ ID NO: 953042 - DNA, 25 bp, Mus musculus
gggcgcgctaaaaatgcttgtttct

SEQ ID NO: 953043 - DNA, 25 bp, Mus musculus
gggcgcggtcaacaaaggctctgga

SEQ ID NO: 953044 - DNA, 25 bp, Mus musculus
gggcgcggtcaacgatcatctgctt

SEQ ID NO: 953045 - DNA, 25 bp, Mus musculus
gggcgcggtcaagaaaggctctgga

SEQ ID NO: 953046 - DNA, 25 bp, Mus musculus
gggcgcggtcaaggatcatctgctt

SEQ ID NO: 953047 - DNA, 25 bp, Mus musculus
gggcggacttcacgtgactcggact

SEQ ID NO: 953048 - DNA, 25 bp, Mus musculus
gggcggacttcacgtgattcacaag

SEQ ID NO: 953049 - DNA, 25 bp, Mus musculus
gggcggacttcaggtgactcggact

SEQ ID NO: 953050 - DNA, 25 bp, Mus musculus
gggcggacttcaggtgattcacaag

SEQ ID NO: 953051 - DNA, 25 bp, Mus musculus
gggcggagaaagagctctccgagca

SEQ ID NO: 953052 - DNA, 25 bp, Mus musculus
gggcggagaaagctctccgagcaga

SEQ ID NO: 953053 - DNA, 25 bp, Mus musculus
gggcggagaaaggtctccgagcaga

SEQ ID NO: 953054 - DNA, 25 bp, Mus musculus
gggcggagaaagtgctctccgagca

SEQ ID NO: 953055 - DNA, 25 bp, Mus musculus
gggcggccgggagacaccctcagga

SEQ ID NO: 953056 - DNA, 25 bp, Mus musculus
gggcggccgggagacacgcagtgag

SEQ ID NO: 953057 - DNA, 25 bp, Mus musculus
gggcggccgggagagaccctcagga

SEQ ID NO: 953058 - DNA, 25 bp, Mus musculus
gggcggccgggagagacgcagtgag

SEQ ID NO: 953059 - DNA, 25 bp, Mus musculus
gggcggcgggctgacgttttgcctg

SEQ ID NO: 953060 - DNA, 25 bp, Mus musculus
gggcggcgggctgaggttttgcctg

SEQ ID NO: 953061 - DNA, 25 bp, Mus musculus
gggcggcggggacgacttgcactaa

SEQ ID NO: 953062 - DNA, 25 bp, Mus musculus
gggcggcggggaggacttgcactaa

SEQ ID NO: 953063 - DNA, 25 bp, Mus musculus
gggcggctcaagctggcccagctgc

SEQ ID NO: 953064 - DNA, 25 bp, Mus musculus
gggcggctcaaggtggcccagctgc

SEQ ID NO: 953065 - DNA, 25 bp, Mus musculus
gggcggtgctcgaaccatctacacc

SEQ ID NO: 953066 - DNA, 25 bp, Mus musculus
gggcggtgctcgaagcatctacacc

SEQ ID NO: 953067 - DNA, 25 bp, Mus musculus
gggcgtctcctgcacgtgaggagca

SEQ ID NO: 953068 - DNA, 25 bp, Mus musculus
gggcgtctcctgcaggtgaggagca

SEQ ID NO: 953069 - DNA, 25 bp, Mus musculus
gggcgtggaagacgtcagcagagca

SEQ ID NO: 953070 - DNA, 25 bp, Mus musculus
gggcgtggaagacgtcagggccaaa

SEQ ID NO: 953071 - DNA, 25 bp, Mus musculus
gggcgtggaagaggtcagcagagca

SEQ ID NO: 953072 - DNA, 25 bp, Mus musculus
gggcgtggaagaggtcagggccaaa

SEQ ID NO: 953073 - DNA, 25 bp, Mus musculus
gggcgttggacaaatggcagataca

SEQ ID NO: 953074 - DNA, 25 bp, Mus musculus
gggcgttggacatatggcagataca

SEQ ID NO: 953075 - DNA, 25 bp, Mus musculus
gggctacagtctagaaaactgctgc

SEQ ID NO: 953076 - DNA, 25 bp, Mus musculus
gggctacagtcttgaaaactgctgc

SEQ ID NO: 953077 - DNA, 25 bp, Mus musculus
gggctaccagaggttgtccccatca

SEQ ID NO: 953078 - DNA, 25 bp, Mus musculus
gggctaccagattttgttcggatcg

SEQ ID NO: 953079 - DNA, 25 bp, Mus musculus
gggctaccagtggttgtccccatca

SEQ ID NO: 953080 - DNA, 25 bp, Mus musculus
gggctaccagtttttgttcggatcg

SEQ ID NO: 953081 - DNA, 25 bp, Mus musculus
gggctactggagacatggaagcttt

SEQ ID NO: 953082 - DNA, 25 bp, Mus musculus
gggctactggtgacatggaagcttt

SEQ ID NO: 953083 - DNA, 25 bp, Mus musculus
gggctagagcataacgtttatctca

SEQ ID NO: 953084 - DNA, 25 bp, Mus musculus
gggctagagcataaggtttatctca

SEQ ID NO: 953085 - DNA, 25 bp, Mus musculus
gggctatatattatcggtgtgctgg

SEQ ID NO: 953086 - DNA, 25 bp, Mus musculus
gggctatatattatgggtgtgctgg

SEQ ID NO: 953087 - DNA, 25 bp, Mus musculus
gggctatattcacggctacaacaag

SEQ ID NO: 953088 - DNA, 25 bp, Mus musculus
gggctatattcacgtgacagacttc

SEQ ID NO: 953089 - DNA, 25 bp, Mus musculus
gggctatattcagggctacaacaag

SEQ ID NO: 953090 - DNA, 25 bp, Mus musculus
gggctatattcaggtgacagacttc

SEQ ID NO: 953091 - DNA, 25 bp, Mus musculus
gggctatctagacatgttcgttcac

SEQ ID NO: 953092 - DNA, 25 bp, Mus musculus
gggctatctagagatgttcgttcac

SEQ ID NO: 953093 - DNA, 25 bp, Mus musculus
gggctatgagatattactacaaacg

SEQ ID NO: 953094 - DNA, 25 bp, Mus musculus
gggctatgagttattactacaaacg

SEQ ID NO: 953095 - DNA, 25 bp, Mus musculus
gggctatggcaacgtgttccaggtg

SEQ ID NO: 953096 - DNA, 25 bp, Mus musculus
gggctatggcaaggtgttccaggtg

SEQ ID NO: 953097 - DNA, 25 bp, Mus musculus
gggctcaaccataagtcctgcttca

SEQ ID NO: 953098 - DNA, 25 bp, Mus musculus
gggctcaaccttaagtcctgcttca

SEQ ID NO: 953099 - DNA, 25 bp, Mus musculus
gggctcacacaacgacctcacccgg

SEQ ID NO: 953100 - DNA, 25 bp, Mus musculus
gggctcacacaaggacctcacccgg

SEQ ID NO: 953101 - DNA, 25 bp, Mus musculus
gggctcaccttgaaaatgaagtccc

SEQ ID NO: 953102 - DNA, 25 bp, Mus musculus
gggctcaccttgagttcgacttcca

SEQ ID NO: 953103 - DNA, 25 bp, Mus musculus
gggctcaccttgtaaatgaagtccc

SEQ ID NO: 953104 - DNA, 25 bp, Mus musculus
gggctcaccttgtgttcgacttcca

SEQ ID NO: 953105 - DNA, 25 bp, Mus musculus
gggctcagcaaacgcagctgagatg

SEQ ID NO: 953106 - DNA, 25 bp, Mus musculus
gggctcagcaaaggcagctgagatg

SEQ ID NO: 953107 - DNA, 25 bp, Mus musculus
gggctccagattcacgcgacaactg

SEQ ID NO: 953108 - DNA, 25 bp, Mus musculus
gggctccagattcaggcgacaactg

SEQ ID NO: 953109 - DNA, 25 bp, Mus musculus
gggctccagccacaccccaagccca

SEQ ID NO: 953110 - DNA, 25 bp, Mus musculus
gggctccagccacagcccaagccca

SEQ ID NO: 953111 - DNA, 25 bp, Mus musculus
gggctccagctcgacgtgacatgga

SEQ ID NO: 953112 - DNA, 25 bp, Mus musculus
gggctccagctcgaggtgacatgga

SEQ ID NO: 953113 - DNA, 25 bp, Mus musculus
gggctccggggacacgccttcccag

SEQ ID NO: 953114 - DNA, 25 bp, Mus musculus
gggctccggggacaggccttcccag

SEQ ID NO: 953115 - DNA, 25 bp, Mus musculus
gggctcctgcagcagggctgctggc

SEQ ID NO: 953116 - DNA, 25 bp, Mus musculus
gggctcctgcaggagggctgctggc

SEQ ID NO: 953117 - DNA, 25 bp, Mus musculus
gggctccttccacggctttgtggtg

SEQ ID NO: 953118 - DNA, 25 bp, Mus musculus
gggctccttccagggctttgtggtg

SEQ ID NO: 953119 - DNA, 25 bp, Mus musculus
gggctccttgcacgatatctttaaa

SEQ ID NO: 953120 - DNA, 25 bp, Mus musculus
gggctccttgcaggatatctttaaa

SEQ ID NO: 953121 - DNA, 25 bp, Mus musculus
gggctcgagtcaccctttgccatct

SEQ ID NO: 953122 - DNA, 25 bp, Mus musculus
gggctcgagtcaccgtttgccatct

SEQ ID NO: 953123 - DNA, 25 bp, Mus musculus
gggctcgcagcatccctgctgcctt

SEQ ID NO: 953124 - DNA, 25 bp, Mus musculus
gggctcgcaggatccctgctgcctt

SEQ ID NO: 953125 - DNA, 25 bp, Mus musculus
gggctcgcctgcaacgttcctgctg

SEQ ID NO: 953126 - DNA, 25 bp, Mus musculus
gggctcgcctgcaactgtctcactt

SEQ ID NO: 953127 - DNA, 25 bp, Mus musculus
gggctcgcctgcaaggttcctgctg

SEQ ID NO: 953128 - DNA, 25 bp, Mus musculus
gggctcgcctgcaagtgtctcactt

SEQ ID NO: 953129 - DNA, 25 bp, Mus musculus
gggctctccgaacctagctagcatc

SEQ ID NO: 953130 - DNA, 25 bp, Mus musculus
gggctctccgagaccgaagccccgc

SEQ ID NO: 953131 - DNA, 25 bp, Mus musculus
gggctctccgccgcatctcccaatt

SEQ ID NO: 953132 - DNA, 25 bp, Mus musculus
gggctctccggcgcatctcccaatt

SEQ ID NO: 953133 - DNA, 25 bp, Mus musculus
gggctctccgtacctagctagcatc

SEQ ID NO: 953134 - DNA, 25 bp, Mus musculus
gggctctccgtgaccgaagccccgc

SEQ ID NO: 953135 - DNA, 25 bp, Mus musculus
gggctctcgaagctgagacgaggga

SEQ ID NO: 953136 - DNA, 25 bp, Mus musculus
gggctctcgaaggtgagacgaggga

SEQ ID NO: 953137 - DNA, 25 bp, Mus musculus
gggctctgaaggctacaccatgagg

SEQ ID NO: 953138 - DNA, 25 bp, Mus musculus
gggctctgaaggctggaataagcag

SEQ ID NO: 953139 - DNA, 25 bp, Mus musculus
gggctctgaagggtacaccatgagg

SEQ ID NO: 953140 - DNA, 25 bp, Mus musculus
gggctctgaagggtggaataagcag

SEQ ID NO: 953141 - DNA, 25 bp, Mus musculus
gggctctgagagccccctgcccgga

SEQ ID NO: 953142 - DNA, 25 bp, Mus musculus
gggctctgagaggcccctgcccgga

SEQ ID NO: 953143 - DNA, 25 bp, Mus musculus
gggctctgtgcgggcagctggcatc

SEQ ID NO: 953144 - DNA, 25 bp, Mus musculus
gggctctgtgggggcagctggcatc

SEQ ID NO: 953145 - DNA, 25 bp, Mus musculus
gggctcttctgacgtacctgaattc

SEQ ID NO: 953146 - DNA, 25 bp, Mus musculus
gggctcttctgaggtacctgaattc

SEQ ID NO: 953147 - DNA, 25 bp, Mus musculus
gggctgacagatcaacttatgagac

SEQ ID NO: 953148 - DNA, 25 bp, Mus musculus
gggctgacagttcaacttatgagac

SEQ ID NO: 953149 - DNA, 25 bp, Mus musculus
gggctgattccacttacttcctgcc

SEQ ID NO: 953150 - DNA, 25 bp, Mus musculus
gggctgattccagttacttcctgcc

SEQ ID NO: 953151 - DNA, 25 bp, Mus musculus
gggctgcaagagggtgctgtacctg

SEQ ID NO: 953152 - DNA, 25 bp, Mus musculus
gggctgcaagtgggtgctgtacctg

SEQ ID NO: 953153 - DNA, 25 bp, Mus musculus
gggctgccagcagccgtggacgtgg

SEQ ID NO: 953154 - DNA, 25 bp, Mus musculus
gggctgccaggagccgtggacgtgg

SEQ ID NO: 953155 - DNA, 25 bp, Mus musculus
gggctgcccaaacagcatgccacca

SEQ ID NO: 953156 - DNA, 25 bp, Mus musculus
gggctgcccaaacagccccctcaga

SEQ ID NO: 953157 - DNA, 25 bp, Mus musculus
gggctgcccaaaccctgagacccac

SEQ ID NO: 953158 - DNA, 25 bp, Mus musculus
gggctgcccaaagagcatgccacca

SEQ ID NO: 953159 - DNA, 25 bp, Mus musculus
gggctgcccaaagagccccctcaga

SEQ ID NO: 953160 - DNA, 25 bp, Mus musculus
gggctgcccaaagcctgagacccac

SEQ ID NO: 953161 - DNA, 25 bp, Mus musculus
gggctgccgactaggatgaaggacg

SEQ ID NO: 953162 - DNA, 25 bp, Mus musculus
gggctgccgactcgtcaatatagac

SEQ ID NO: 953163 - DNA, 25 bp, Mus musculus
gggctgccgactggtcaatatagac

SEQ ID NO: 953164 - DNA, 25 bp, Mus musculus
gggctgccgacttggatgaaggacg

SEQ ID NO: 953165 - DNA, 25 bp, Mus musculus
gggctgcctcagcacggcttcccca

SEQ ID NO: 953166 - DNA, 25 bp, Mus musculus
gggctgcctcagcagggcttcccca

SEQ ID NO: 953167 - DNA, 25 bp, Mus musculus
gggctgcctcagctcgcatagggca

SEQ ID NO: 953168 - DNA, 25 bp, Mus musculus
gggctgcctcaggtcgcatagggca

SEQ ID NO: 953169 - DNA, 25 bp, Mus musculus
gggctgcgggcccgcaaatgcactt

SEQ ID NO: 953170 - DNA, 25 bp, Mus musculus
gggctgcgggcccgcgactgtgcag

SEQ ID NO: 953171 - DNA, 25 bp, Mus musculus
gggctgcgggcccggaaatgcactt

SEQ ID NO: 953172 - DNA, 25 bp, Mus musculus
gggctgcgggcccgggactgtgcag

SEQ ID NO: 953173 - DNA, 25 bp, Mus musculus
gggctgctcccaccatggcggacaa

SEQ ID NO: 953174 - DNA, 25 bp, Mus musculus
gggctgctcccagcatggcggacaa

SEQ ID NO: 953175 - DNA, 25 bp, Mus musculus
gggctgctctgacacgcgggagtgg

SEQ ID NO: 953176 - DNA, 25 bp, Mus musculus
gggctgctctgacaggcgggagtgg

SEQ ID NO: 953177 - DNA, 25 bp, Mus musculus
gggctgctgctcaggattaatgaaa

SEQ ID NO: 953178 - DNA, 25 bp, Mus musculus
gggctgctgctctggattaatgaaa

SEQ ID NO: 953179 - DNA, 25 bp, Mus musculus
gggctgctggaaagggataaacagc

SEQ ID NO: 953180 - DNA, 25 bp, Mus musculus
gggctgctggcacgtaccttggctg

SEQ ID NO: 953181 - DNA, 25 bp, Mus musculus
gggctgctggcaggtaccttggctg

SEQ ID NO: 953182 - DNA, 25 bp, Mus musculus
gggctgctggtaagggataaacagc

SEQ ID NO: 953183 - DNA, 25 bp, Mus musculus
gggctgcttcaagacgcttggcttt

SEQ ID NO: 953184 - DNA, 25 bp, Mus musculus
gggctgcttcaagaggcttggcttt

SEQ ID NO: 953185 - DNA, 25 bp, Mus musculus
gggctgctttacgacgtgctgaatg

SEQ ID NO: 953186 - DNA, 25 bp, Mus musculus
gggctgctttacgaggtgctgaatg

SEQ ID NO: 953187 - DNA, 25 bp, Mus musculus
gggctggaaaggaacaggagccgct

SEQ ID NO: 953188 - DNA, 25 bp, Mus musculus
gggctggaaaggaagaggagccgct

SEQ ID NO: 953189 - DNA, 25 bp, Mus musculus
gggctggagctgaggagattattgg

SEQ ID NO: 953190 - DNA, 25 bp, Mus musculus
gggctggagctgtggagattattgg

SEQ ID NO: 953191 - DNA, 25 bp, Mus musculus
gggctggccacactcgacgccgctg

SEQ ID NO: 953192 - DNA, 25 bp, Mus musculus
gggctggccacactggacgccgctg

SEQ ID NO: 953193 - DNA, 25 bp, Mus musculus
gggctggggaaggacggagtcacca

SEQ ID NO: 953194 - DNA, 25 bp, Mus musculus
gggctggggaaggagggagtcacca

SEQ ID NO: 953195 - DNA, 25 bp, Mus musculus
gggctggggacacatgtggctggtg

SEQ ID NO: 953196 - DNA, 25 bp, Mus musculus
gggctggggacagatgtggctggtg

SEQ ID NO: 953197 - DNA, 25 bp, Mus musculus
gggctggggcgcatctggttggctg

SEQ ID NO: 953198 - DNA, 25 bp, Mus musculus
gggctggggcgcatgtggttggctg

SEQ ID NO: 953199 - DNA, 25 bp, Mus musculus
gggctggtccttcacggcttgtacc

SEQ ID NO: 953200 - DNA, 25 bp, Mus musculus
gggctggtccttcagggcttgtacc

SEQ ID NO: 953201 - DNA, 25 bp, Mus musculus
gggcttaaagagcgcttggggcata

SEQ ID NO: 953202 - DNA, 25 bp, Mus musculus
gggcttaaagagggcttggggcata

SEQ ID NO: 953203 - DNA, 25 bp, Mus musculus
gggcttaccacgtgtccctggaatc

SEQ ID NO: 953204 - DNA, 25 bp, Mus musculus
gggcttaccaggtgtccctggaatc

SEQ ID NO: 953205 - DNA, 25 bp, Mus musculus
gggcttactcagcatgtcaatgggc

SEQ ID NO: 953206 - DNA, 25 bp, Mus musculus
gggcttactcaggatgtcaatgggc

SEQ ID NO: 953207 - DNA, 25 bp, Mus musculus
gggcttaggagccacaagctgactg

SEQ ID NO: 953208 - DNA, 25 bp, Mus musculus
gggcttaggagccacaaggaggctg

SEQ ID NO: 953209 - DNA, 25 bp, Mus musculus
gggcttaggagccacaggaagtcac

SEQ ID NO: 953210 - DNA, 25 bp, Mus musculus
gggcttaggagccagaagctgactg

SEQ ID NO: 953211 - DNA, 25 bp, Mus musculus
gggcttaggagccagaaggaggctg

SEQ ID NO: 953212 - DNA, 25 bp, Mus musculus
gggcttaggagccagaggaagtcac

SEQ ID NO: 953213 - DNA, 25 bp, Mus musculus
gggcttccagatcacacctgccatc

SEQ ID NO: 953214 - DNA, 25 bp, Mus musculus
gggcttccagttcacacctgccatc

SEQ ID NO: 953215 - DNA, 25 bp, Mus musculus
gggcttccgtcccttctctggttct

SEQ ID NO: 953216 - DNA, 25 bp, Mus musculus
gggcttccgtgccttctctggttct

SEQ ID NO: 953217 - DNA, 25 bp, Mus musculus
gggcttcgcaatcggcatcgcaggc

SEQ ID NO: 953218 - DNA, 25 bp, Mus musculus
gggcttcgcaatgggcatcgcaggc

SEQ ID NO: 953219 - DNA, 25 bp, Mus musculus
gggcttcttcagacgaacagtcagc

SEQ ID NO: 953220 - DNA, 25 bp, Mus musculus
gggcttcttcagagatactgtcagc

SEQ ID NO: 953221 - DNA, 25 bp, Mus musculus
gggcttcttcagtcgaacagtcagc

SEQ ID NO: 953222 - DNA, 25 bp, Mus musculus
gggcttcttcagtgatactgtcagc

SEQ ID NO: 953223 - DNA, 25 bp, Mus musculus
gggcttgaagccaactctgttagaa

SEQ ID NO: 953224 - DNA, 25 bp, Mus musculus
gggcttgaagcctactctgttagaa

SEQ ID NO: 953225 - DNA, 25 bp, Mus musculus
gggcttgaggaacacgaatggtaat

SEQ ID NO: 953226 - DNA, 25 bp, Mus musculus
gggcttgaggaacaggaatggtaat

SEQ ID NO: 953227 - DNA, 25 bp, Mus musculus
gggcttgcagaggcctacgtgaaga

SEQ ID NO: 953228 - DNA, 25 bp, Mus musculus
gggcttgcagcaggtggttgcattt

SEQ ID NO: 953229 - DNA, 25 bp, Mus musculus
gggcttgcagctggttgcattttgt

SEQ ID NO: 953230 - DNA, 25 bp, Mus musculus
gggcttgcaggaggtggttgcattt

SEQ ID NO: 953231 - DNA, 25 bp, Mus musculus
gggcttgcaggtggttgcattttgt

SEQ ID NO: 953232 - DNA, 25 bp, Mus musculus
gggcttgcagtggcctacgtgaaga

SEQ ID NO: 953233 - DNA, 25 bp, Mus musculus
gggcttgctgatctcctcttgcctc

SEQ ID NO: 953234 - DNA, 25 bp, Mus musculus
gggcttgctgttctcctcttgcctc

SEQ ID NO: 953235 - DNA, 25 bp, Mus musculus
gggcttggagcgctttgggggcttg

SEQ ID NO: 953236 - DNA, 25 bp, Mus musculus
gggcttggagcggtttgggggcttg

SEQ ID NO: 953237 - DNA, 25 bp, Mus musculus
gggcttgtcaatgacgcagaattcc

SEQ ID NO: 953238 - DNA, 25 bp, Mus musculus
gggcttgtcaatgaggcagaattcc

SEQ ID NO: 953239 - DNA, 25 bp, Mus musculus
gggctttagctccgcgactgtggag

SEQ ID NO: 953240 - DNA, 25 bp, Mus musculus
gggctttagctccgggactgtggag

SEQ ID NO: 953241 - DNA, 25 bp, Mus musculus
gggctttcagcgggactgcaggcca

SEQ ID NO: 953242 - DNA, 25 bp, Mus musculus
gggctttcagggggactgcaggcca

SEQ ID NO: 953243 - DNA, 25 bp, Mus musculus
gggctttctggacggagttggtgga

SEQ ID NO: 953244 - DNA, 25 bp, Mus musculus
gggctttctggagggagttggtgga

SEQ ID NO: 953245 - DNA, 25 bp, Mus musculus
ggggaaaatctttgatctcattgga

SEQ ID NO: 953246 - DNA, 25 bp, Mus musculus
ggggaaaatctttgttctcattgga

SEQ ID NO: 953247 - DNA, 25 bp, Mus musculus
ggggaaacagaggagcgagttgtgg

SEQ ID NO: 953248 - DNA, 25 bp, Mus musculus
ggggaaacagtggagcgagttgtgg

SEQ ID NO: 953249 - DNA, 25 bp, Mus musculus
ggggaaagagctagctgtgaagatc

SEQ ID NO: 953250 - DNA, 25 bp, Mus musculus
ggggaaagaggtagctgtgaagatc

SEQ ID NO: 953251 - DNA, 25 bp, Mus musculus
ggggaacatcagatcattcagtttc

SEQ ID NO: 953252 - DNA, 25 bp, Mus musculus
ggggaacatcagttcattcagtttc

SEQ ID NO: 953253 - DNA, 25 bp, Mus musculus
ggggaaccggcattcatgtccagct

SEQ ID NO: 953254 - DNA, 25 bp, Mus musculus
ggggaaccggcattgatgtccagct

SEQ ID NO: 953255 - DNA, 25 bp, Mus musculus
ggggaacctcagagggctgttgttg

SEQ ID NO: 953256 - DNA, 25 bp, Mus musculus
ggggaacctcagtgggctgttgttg

SEQ ID NO: 953257 - DNA, 25 bp, Mus musculus
ggggaacgtctcaacgctatgcttc

SEQ ID NO: 953258 - DNA, 25 bp, Mus musculus
ggggaacgtctcaaggctatgcttc

SEQ ID NO: 953259 - DNA, 25 bp, Mus musculus
ggggaactccgtctgagcggcctgt

SEQ ID NO: 953260 - DNA, 25 bp, Mus musculus
ggggaactccgtgtgagcggcctgt

SEQ ID NO: 953261 - DNA, 25 bp, Mus musculus
ggggaactgctgcttcctgagtgcg

SEQ ID NO: 953262 - DNA, 25 bp, Mus musculus
ggggaactgctggttcctgagtgcg

SEQ ID NO: 953263 - DNA, 25 bp, Mus musculus
ggggaacttctcatcattcaatgtc

SEQ ID NO: 953264 - DNA, 25 bp, Mus musculus
ggggaacttctcttcattcaatgtc

SEQ ID NO: 953265 - DNA, 25 bp, Mus musculus
ggggaagaagctggctgtgttctta

SEQ ID NO: 953266 - DNA, 25 bp, Mus musculus
ggggaagaaggtggctgtgttctta

SEQ ID NO: 953267 - DNA, 25 bp, Mus musculus
ggggaagaagtgtcatgcctttgct

SEQ ID NO: 953268 - DNA, 25 bp, Mus musculus
ggggaagaagtgtcttgcctttgct

SEQ ID NO: 953269 - DNA, 25 bp, Mus musculus
ggggaagactatcctagtacagccc

SEQ ID NO: 953270 - DNA, 25 bp, Mus musculus
ggggaagactttcctagtacagccc

SEQ ID NO: 953271 - DNA, 25 bp, Mus musculus
ggggaagattatgacggcggaggtt

SEQ ID NO: 953272 - DNA, 25 bp, Mus musculus
ggggaagattatgagggcggaggtt

SEQ ID NO: 953273 - DNA, 25 bp, Mus musculus
ggggaagcagatggagttccagaag

SEQ ID NO: 953274 - DNA, 25 bp, Mus musculus
ggggaagcagttggagttccagaag

SEQ ID NO: 953275 - DNA, 25 bp, Mus musculus
ggggaaggagcgagtcaccacctat

SEQ ID NO: 953276 - DNA, 25 bp, Mus musculus
ggggaaggagggagtcaccacctat

SEQ ID NO: 953277 - DNA, 25 bp, Mus musculus
ggggaagtatttctcgcctcggatt

SEQ ID NO: 953278 - DNA, 25 bp, Mus musculus
ggggaagtatttctggcctcggatt

SEQ ID NO: 953279 - DNA, 25 bp, Mus musculus
ggggaattcctcaacgcttttcatg

SEQ ID NO: 953280 - DNA, 25 bp, Mus musculus
ggggaattcctcaaggcttttcatg

SEQ ID NO: 953281 - DNA, 25 bp, Mus musculus
ggggacaaagctggaaatggtgtat

SEQ ID NO: 953282 - DNA, 25 bp, Mus musculus
ggggacaaaggtggaaatggtgtat

SEQ ID NO: 953283 - DNA, 25 bp, Mus musculus
ggggacaacgaacgtgaccccatct

SEQ ID NO: 953284 - DNA, 25 bp, Mus musculus
ggggacaacgaaggtgaccccatct

SEQ ID NO: 953285 - DNA, 25 bp, Mus musculus
ggggacagagcacaatttgatacta

SEQ ID NO: 953286 - DNA, 25 bp, Mus musculus
ggggacagagcacgggtgctcttct

SEQ ID NO: 953287 - DNA, 25 bp, Mus musculus
ggggacagagcagaatttgatacta

SEQ ID NO: 953288 - DNA, 25 bp, Mus musculus
ggggacagagcaggggtgctcttct

SEQ ID NO: 953289 - DNA, 25 bp, Mus musculus
ggggacagtctgcatcaactgctac

SEQ ID NO: 953290 - DNA, 25 bp, Mus musculus
ggggacagtctggatcaactgctac

SEQ ID NO: 953291 - DNA, 25 bp, Mus musculus
ggggacagtgccaacatttaaacga

SEQ ID NO: 953292 - DNA, 25 bp, Mus musculus
ggggacagtgccaacctgtgtgtca

SEQ ID NO: 953293 - DNA, 25 bp, Mus musculus
ggggacagtgccaacctttctacgt

SEQ ID NO: 953294 - DNA, 25 bp, Mus musculus
ggggacagtgccaagatttaaacga

SEQ ID NO: 953295 - DNA, 25 bp, Mus musculus
ggggacagtgccaagctgtgtgtca

SEQ ID NO: 953296 - DNA, 25 bp, Mus musculus
ggggacagtgccaagctttctacgt

SEQ ID NO: 953297 - DNA, 25 bp, Mus musculus
ggggaccaggaaatcacccctgaat

SEQ ID NO: 953298 - DNA, 25 bp, Mus musculus
ggggaccaggtaatcacccctgaat

SEQ ID NO: 953299 - DNA, 25 bp, Mus musculus
ggggaccataaactctaaggttgtg

SEQ ID NO: 953300 - DNA, 25 bp, Mus musculus
ggggaccataaagtctaaggttgtg

SEQ ID NO: 953301 - DNA, 25 bp, Mus musculus
ggggacccacagctgtggatcgacg

SEQ ID NO: 953302 - DNA, 25 bp, Mus musculus
ggggacccacaggtgtggatcgacg

SEQ ID NO: 953303 - DNA, 25 bp, Mus musculus
ggggacccagcccagagtcctacag

SEQ ID NO: 953304 - DNA, 25 bp, Mus musculus
ggggacccaggccagagtcctacag

SEQ ID NO: 953305 - DNA, 25 bp, Mus musculus
ggggacctcaagcagcgcgggctga

SEQ ID NO: 953306 - DNA, 25 bp, Mus musculus
ggggacctcaaggagcgcgggctga

SEQ ID NO: 953307 - DNA, 25 bp, Mus musculus
ggggacctcacaaggtctatatgga

SEQ ID NO: 953308 - DNA, 25 bp, Mus musculus
ggggacctcagaaggtctatatgga

SEQ ID NO: 953309 - DNA, 25 bp, Mus musculus
ggggacctgcacagtcacgcggtgt

SEQ ID NO: 953310 - DNA, 25 bp, Mus musculus
ggggacctgcactgtcacgcggtgt

SEQ ID NO: 953311 - DNA, 25 bp, Mus musculus
ggggacctggagacagccttccctc

SEQ ID NO: 953312 - DNA, 25 bp, Mus musculus
ggggacctggagtcagccttccctc

SEQ ID NO: 953313 - DNA, 25 bp, Mus musculus
ggggacgagaacaacatggagttcc

SEQ ID NO: 953314 - DNA, 25 bp, Mus musculus
ggggacgagaactacatggagttcc

SEQ ID NO: 953315 - DNA, 25 bp, Mus musculus
ggggacgtagtgaacgtggccctat

SEQ ID NO: 953316 - DNA, 25 bp, Mus musculus
ggggacgtagtgaaggtggccctat

SEQ ID NO: 953317 - DNA, 25 bp, Mus musculus
ggggactgagcgctcttgacgaagt

SEQ ID NO: 953318 - DNA, 25 bp, Mus musculus
ggggactgagcggtcttgacgaagt

SEQ ID NO: 953319 - DNA, 25 bp, Mus musculus
ggggactggaaacatggagccagca

SEQ ID NO: 953320 - DNA, 25 bp, Mus musculus
ggggactggaaagatggagccagca

SEQ ID NO: 953321 - DNA, 25 bp, Mus musculus
ggggactggacacctgggctgtccc

SEQ ID NO: 953322 - DNA, 25 bp, Mus musculus
ggggactggagacctgggctgtccc

SEQ ID NO: 953323 - DNA, 25 bp, Mus musculus
ggggagaagaaacatgtaagtggcg

SEQ ID NO: 953324 - DNA, 25 bp, Mus musculus
ggggagaagaaagatgtaagtggcg

SEQ ID NO: 953325 - DNA, 25 bp, Mus musculus
ggggagaagagaccccttcgagata

SEQ ID NO: 953326 - DNA, 25 bp, Mus musculus
ggggagaagagagcccttcgagata

SEQ ID NO: 953327 - DNA, 25 bp, Mus musculus
ggggagaagcagaccatggtgaatc

SEQ ID NO: 953328 - DNA, 25 bp, Mus musculus
ggggagaagcagtccatggtgaatc

SEQ ID NO: 953329 - DNA, 25 bp, Mus musculus
ggggagaagtcgctctttctgtgga

SEQ ID NO: 953330 - DNA, 25 bp, Mus musculus
ggggagaagtcggtctttctgtgga

SEQ ID NO: 953331 - DNA, 25 bp, Mus musculus
ggggagacactgtgcttacttggcc

SEQ ID NO: 953332 - DNA, 25 bp, Mus musculus
ggggagacactgtggttacttggcc

SEQ ID NO: 953333 - DNA, 25 bp, Mus musculus
ggggagagacagaggaaacaacgtt

SEQ ID NO: 953334 - DNA, 25 bp, Mus musculus
ggggagagacagtggaaacaacgtt

SEQ ID NO: 953335 - DNA, 25 bp, Mus musculus
ggggagagagagcggtggaagatgt

SEQ ID NO: 953336 - DNA, 25 bp, Mus musculus
ggggagagagaggggtggaagatgt

SEQ ID NO: 953337 - DNA, 25 bp, Mus musculus
ggggagagatcgacttccaggcctt

SEQ ID NO: 953338 - DNA, 25 bp, Mus musculus
ggggagagatggacttccaggcctt

SEQ ID NO: 953339 - DNA, 25 bp, Mus musculus
ggggagagcaagagcatattatcag

SEQ ID NO: 953340 - DNA, 25 bp, Mus musculus
ggggagagcaagagcgtttgttcct

SEQ ID NO: 953341 - DNA, 25 bp, Mus musculus
ggggagagcaagaggatattatcag

SEQ ID NO: 953342 - DNA, 25 bp, Mus musculus
ggggagagcaagagggtttgttcct

SEQ ID NO: 953343 - DNA, 25 bp, Mus musculus
ggggagcagcccaacgaggctccgc

SEQ ID NO: 953344 - DNA, 25 bp, Mus musculus
ggggagcagcccaaggaggctccgc

SEQ ID NO: 953345 - DNA, 25 bp, Mus musculus
ggggagcaggcagcggagggagcac

SEQ ID NO: 953346 - DNA, 25 bp, Mus musculus
ggggagcagggagcggagggagcac

SEQ ID NO: 953347 - DNA, 25 bp, Mus musculus
ggggagccacacatccatatcacaa

SEQ ID NO: 953348 - DNA, 25 bp, Mus musculus
ggggagccacacatgcatatcacaa

SEQ ID NO: 953349 - DNA, 25 bp, Mus musculus
ggggagcccacacacgttcactatc

SEQ ID NO: 953350 - DNA, 25 bp, Mus musculus
ggggagcccacacaggttcactatc

SEQ ID NO: 953351 - DNA, 25 bp, Mus musculus
ggggagcggagagccacatgtcctt

SEQ ID NO: 953352 - DNA, 25 bp, Mus musculus
ggggagcggagagcgacatgtcctt

SEQ ID NO: 953353 - DNA, 25 bp, Mus musculus
ggggagctggccccacagggcttgg

SEQ ID NO: 953354 - DNA, 25 bp, Mus musculus
ggggagctggctaagctggtgctgg

SEQ ID NO: 953355 - DNA, 25 bp, Mus musculus
ggggagctgggcccacagggcttgg

SEQ ID NO: 953356 - DNA, 25 bp, Mus musculus
ggggagctgggtaagctggtgctgg

SEQ ID NO: 953357 - DNA, 25 bp, Mus musculus
ggggaggaagcatgtaggatccatg

SEQ ID NO: 953358 - DNA, 25 bp, Mus musculus
ggggaggaagctgacctggctgcac

SEQ ID NO: 953359 - DNA, 25 bp, Mus musculus
ggggaggaaggatgtaggatccatg

SEQ ID NO: 953360 - DNA, 25 bp, Mus musculus
ggggaggaaggtgacctggctgcac

SEQ ID NO: 953361 - DNA, 25 bp, Mus musculus
ggggaggcagactgtggcctgcggc

SEQ ID NO: 953362 - DNA, 25 bp, Mus musculus
ggggaggcagctatggatgtattgt

SEQ ID NO: 953363 - DNA, 25 bp, Mus musculus
ggggaggcaggtatggatgtattgt

SEQ ID NO: 953364 - DNA, 25 bp, Mus musculus
ggggaggcagtctgtggcctgcggc

SEQ ID NO: 953365 - DNA, 25 bp, Mus musculus
ggggaggctttggacgtagaggagg

SEQ ID NO: 953366 - DNA, 25 bp, Mus musculus
ggggaggctttggaggtagaggagg

SEQ ID NO: 953367 - DNA, 25 bp, Mus musculus
ggggagggcgagctgctcctaatgg

SEQ ID NO: 953368 - DNA, 25 bp, Mus musculus
ggggagggcgaggtgctcctaatgg

SEQ ID NO: 953369 - DNA, 25 bp, Mus musculus
ggggagtttgagatcccactgagat

SEQ ID NO: 953370 - DNA, 25 bp, Mus musculus
ggggagtttgagttcccactgagat

SEQ ID NO: 953371 - DNA, 25 bp, Mus musculus
ggggagtttggacatgtgatgctgg

SEQ ID NO: 953372 - DNA, 25 bp, Mus musculus
ggggagtttggagatgtgatgctgg

SEQ ID NO: 953373 - DNA, 25 bp, Mus musculus
ggggataattggcctgtggaagcag

SEQ ID NO: 953374 - DNA, 25 bp, Mus musculus
ggggataattgggctgtggaagcag

SEQ ID NO: 953375 - DNA, 25 bp, Mus musculus
ggggatacagaacatctcccgggac

SEQ ID NO: 953376 - DNA, 25 bp, Mus musculus
ggggatacagctttggggcgatggt

SEQ ID NO: 953377 - DNA, 25 bp, Mus musculus
ggggatacaggtttggggcgatggt

SEQ ID NO: 953378 - DNA, 25 bp, Mus musculus
ggggatacagtacatctcccgggac

SEQ ID NO: 953379 - DNA, 25 bp, Mus musculus
ggggatcaacaaccaattcctcgat

SEQ ID NO: 953380 - DNA, 25 bp, Mus musculus
ggggatcaacaagcaattcctcgat

SEQ ID NO: 953381 - DNA, 25 bp, Mus musculus
ggggatcagccacattttggatttg

SEQ ID NO: 953382 - DNA, 25 bp, Mus musculus
ggggatcagccagattttggatttg

SEQ ID NO: 953383 - DNA, 25 bp, Mus musculus
ggggatcccgcgtgagccaggtttg

SEQ ID NO: 953384 - DNA, 25 bp, Mus musculus
ggggatcccgggtgagccaggtttg

SEQ ID NO: 953385 - DNA, 25 bp, Mus musculus
ggggatcctgcagtcggtcctggtg

SEQ ID NO: 953386 - DNA, 25 bp, Mus musculus
ggggatcctgcagtgggtcctggtg

SEQ ID NO: 953387 - DNA, 25 bp, Mus musculus
ggggatcgactgctacatggacttc

SEQ ID NO: 953388 - DNA, 25 bp, Mus musculus
ggggatcgactggtacatggacttc

SEQ ID NO: 953389 - DNA, 25 bp, Mus musculus
ggggatcgagagccattcgaggaga

SEQ ID NO: 953390 - DNA, 25 bp, Mus musculus
ggggatcgagaggcattcgaggaga

SEQ ID NO: 953391 - DNA, 25 bp, Mus musculus
ggggatgcccaacgcatgaatgctg

SEQ ID NO: 953392 - DNA, 25 bp, Mus musculus
ggggatgcccaaggcatgaatgctg

SEQ ID NO: 953393 - DNA, 25 bp, Mus musculus
ggggatgctgcgaacaatcatccag

SEQ ID NO: 953394 - DNA, 25 bp, Mus musculus
ggggatgctgcgaagaatcatccag

SEQ ID NO: 953395 - DNA, 25 bp, Mus musculus
ggggatggtcgacgacttgcactaa

SEQ ID NO: 953396 - DNA, 25 bp, Mus musculus
ggggatggtcgaggacttgcactaa

SEQ ID NO: 953397 - DNA, 25 bp, Mus musculus
ggggattatcatcggtgccccttcc

SEQ ID NO: 953398 - DNA, 25 bp, Mus musculus
ggggattatcatgggtgccccttcc

SEQ ID NO: 953399 - DNA, 25 bp, Mus musculus
ggggattatttaccacaggtgatga

SEQ ID NO: 953400 - DNA, 25 bp, Mus musculus
ggggattatttagcacaggtgatga

SEQ ID NO: 953401 - DNA, 25 bp, Mus musculus
ggggattcttcaccacaggggatga

SEQ ID NO: 953402 - DNA, 25 bp, Mus musculus
ggggattcttcagcacaggggatga

SEQ ID NO: 953403 - DNA, 25 bp, Mus musculus
ggggattgataatgagaagatcttg

SEQ ID NO: 953404 - DNA, 25 bp, Mus musculus
ggggattgattatgagaagatcttg

SEQ ID NO: 953405 - DNA, 25 bp, Mus musculus
ggggattgattgctacatggatttc

SEQ ID NO: 953406 - DNA, 25 bp, Mus musculus
ggggattgattggtacatggatttc

SEQ ID NO: 953407 - DNA, 25 bp, Mus musculus
ggggcaagtgttcgtgatccttgtc

SEQ ID NO: 953408 - DNA, 25 bp, Mus musculus
ggggcaagtgttggtgatccttgtc

SEQ ID NO: 953409 - DNA, 25 bp, Mus musculus
ggggcacagatgcggacagagagaa

SEQ ID NO: 953410 - DNA, 25 bp, Mus musculus
ggggcacagatggggacagagagaa

SEQ ID NO: 953411 - DNA, 25 bp, Mus musculus
ggggcacatcagacccctatgtgaa

SEQ ID NO: 953412 - DNA, 25 bp, Mus musculus
ggggcacatcagtcccctatgtgaa

SEQ ID NO: 953413 - DNA, 25 bp, Mus musculus
ggggcacgacgccacatcggaaggg

SEQ ID NO: 953414 - DNA, 25 bp, Mus musculus
ggggcacgacgccagatcggaaggg

SEQ ID NO: 953415 - DNA, 25 bp, Mus musculus
ggggcagaacgacgttgtgaaccat

SEQ ID NO: 953416 - DNA, 25 bp, Mus musculus
ggggcagaacgaggttgtgaaccat

SEQ ID NO: 953417 - DNA, 25 bp, Mus musculus
ggggcagaagagattgtggatggca

SEQ ID NO: 953418 - DNA, 25 bp, Mus musculus
ggggcagaagtgattgtggatggca

SEQ ID NO: 953419 - DNA, 25 bp, Mus musculus
ggggcagatcctctcatggagccag

SEQ ID NO: 953420 - DNA, 25 bp, Mus musculus
ggggcagatcctctgatggagccag

SEQ ID NO: 953421 - DNA, 25 bp, Mus musculus
ggggcagatgcgcacgtcttgattt

SEQ ID NO: 953422 - DNA, 25 bp, Mus musculus
ggggcagatgcgcaggtcttgattt

SEQ ID NO: 953423 - DNA, 25 bp, Mus musculus
ggggcagattcaccacagagctgat

SEQ ID NO: 953424 - DNA, 25 bp, Mus musculus
ggggcagattcacgtgattctcggg

SEQ ID NO: 953425 - DNA, 25 bp, Mus musculus
ggggcagattcagcacagagctgat

SEQ ID NO: 953426 - DNA, 25 bp, Mus musculus
ggggcagattcaggtgattctcggg

SEQ ID NO: 953427 - DNA, 25 bp, Mus musculus
ggggcagcagcttgtctttagcttc

SEQ ID NO: 953428 - DNA, 25 bp, Mus musculus
ggggcagcaggttgtctttagcttc

SEQ ID NO: 953429 - DNA, 25 bp, Mus musculus
ggggcagccattgtcctggccttag

SEQ ID NO: 953430 - DNA, 25 bp, Mus musculus
ggggcagccattgtgctggccttag

SEQ ID NO: 953431 - DNA, 25 bp, Mus musculus
ggggcaggatggaacgcacttgaag

SEQ ID NO: 953432 - DNA, 25 bp, Mus musculus
ggggcaggatggaaggcacttgaag

SEQ ID NO: 953433 - DNA, 25 bp, Mus musculus
ggggcagtttagaaatgcacttagc

SEQ ID NO: 953434 - DNA, 25 bp, Mus musculus
ggggcagtttagtaatgcacttagc

SEQ ID NO: 953435 - DNA, 25 bp, Mus musculus
ggggcagtttattcctgacattgtg

SEQ ID NO: 953436 - DNA, 25 bp, Mus musculus
ggggcagttttttcctgacattgtg

SEQ ID NO: 953437 - DNA, 25 bp, Mus musculus
ggggcatgagagtaatgttcaagcc

SEQ ID NO: 953438 - DNA, 25 bp, Mus musculus
ggggcatgagtgtaatgttcaagcc

SEQ ID NO: 953439 - DNA, 25 bp, Mus musculus
ggggcatgtttacactggccggcct

SEQ ID NO: 953440 - DNA, 25 bp, Mus musculus
ggggcatgtttacacttaggtgaca

SEQ ID NO: 953441 - DNA, 25 bp, Mus musculus
ggggcatgtttacagtggccggcct

SEQ ID NO: 953442 - DNA, 25 bp, Mus musculus
ggggcatgtttacagttaggtgaca

SEQ ID NO: 953443 - DNA, 25 bp, Mus musculus
ggggccaagaaacatccgtcgtcag

SEQ ID NO: 953444 - DNA, 25 bp, Mus musculus
ggggccaagaaagatccgtcgtcag

SEQ ID NO: 953445 - DNA, 25 bp, Mus musculus
ggggccagccatcgtggctggggag

SEQ ID NO: 953446 - DNA, 25 bp, Mus musculus
ggggccagccatggtggctggggag

SEQ ID NO: 953447 - DNA, 25 bp, Mus musculus
ggggccagctccaggtcacaggatg

SEQ ID NO: 953448 - DNA, 25 bp, Mus musculus
ggggccagctcctggtcacaggatg

SEQ ID NO: 953449 - DNA, 25 bp, Mus musculus
ggggccatgatgagtacctatacca

SEQ ID NO: 953450 - DNA, 25 bp, Mus musculus
ggggccatgatgtgtacctatacca

SEQ ID NO: 953451 - DNA, 25 bp, Mus musculus
ggggccattacaccatggaacttcc

SEQ ID NO: 953452 - DNA, 25 bp, Mus musculus
ggggccattacaccttggaacttcc

SEQ ID NO: 953453 - DNA, 25 bp, Mus musculus
ggggcccagaagcctgagaccgctg

SEQ ID NO: 953454 - DNA, 25 bp, Mus musculus
ggggcccagaaggctgagaccgctg

SEQ ID NO: 953455 - DNA, 25 bp, Mus musculus
ggggcccatttacaacatgaatctg

SEQ ID NO: 953456 - DNA, 25 bp, Mus musculus
ggggcccatttagaacatgaatctg

SEQ ID NO: 953457 - DNA, 25 bp, Mus musculus
ggggccccagctctttcagccatgg

SEQ ID NO: 953458 - DNA, 25 bp, Mus musculus
ggggccccagctgtttcagccatgg

SEQ ID NO: 953459 - DNA, 25 bp, Mus musculus
ggggccccatcgcaagctcagaacc

SEQ ID NO: 953460 - DNA, 25 bp, Mus musculus
ggggccccatcggaagctcagaacc

SEQ ID NO: 953461 - DNA, 25 bp, Mus musculus
ggggcccccatgctggcccctgaga

SEQ ID NO: 953462 - DNA, 25 bp, Mus musculus
ggggcccccatggtggcccctgaga

SEQ ID NO: 953463 - DNA, 25 bp, Mus musculus
ggggccccccctctctgtgacatgc

SEQ ID NO: 953464 - DNA, 25 bp, Mus musculus
ggggccccccgtctctgtgacatgc

SEQ ID NO: 953465 - DNA, 25 bp, Mus musculus
ggggccgatgggctcgatgaagtgt

SEQ ID NO: 953466 - DNA, 25 bp, Mus musculus
ggggccgatgggctggatgaagtgt

SEQ ID NO: 953467 - DNA, 25 bp, Mus musculus
ggggccgccgacctgtctcaactgc

SEQ ID NO: 953468 - DNA, 25 bp, Mus musculus
ggggccgccgagtcctgtctcaact

SEQ ID NO: 953469 - DNA, 25 bp, Mus musculus
ggggccgccgtcctgtctcaactgc

SEQ ID NO: 953470 - DNA, 25 bp, Mus musculus
ggggccgccgtgtcctgtctcaact

SEQ ID NO: 953471 - DNA, 25 bp, Mus musculus
ggggccgtggaacagtgaagacacc

SEQ ID NO: 953472 - DNA, 25 bp, Mus musculus
ggggccgtggaagagtgaagacacc

SEQ ID NO: 953473 - DNA, 25 bp, Mus musculus
ggggcctcagatcgaccaaaagcag

SEQ ID NO: 953474 - DNA, 25 bp, Mus musculus
ggggcctcagctggatgaaactcag

SEQ ID NO: 953475 - DNA, 25 bp, Mus musculus
ggggcctcaggtggatgaaactcag

SEQ ID NO: 953476 - DNA, 25 bp, Mus musculus
ggggcctcagttcgaccaaaagcag

SEQ ID NO: 953477 - DNA, 25 bp, Mus musculus
ggggcctcgaaagactgctggaggc

SEQ ID NO: 953478 - DNA, 25 bp, Mus musculus
ggggcctcgaaagagtgctggaggc

SEQ ID NO: 953479 - DNA, 25 bp, Mus musculus
ggggcctgtcgtcatgtcaacgaat

SEQ ID NO: 953480 - DNA, 25 bp, Mus musculus
ggggcctgtcgtgatgtcaacgaat

SEQ ID NO: 953481 - DNA, 25 bp, Mus musculus
ggggccttccagagtagaggcccgg

SEQ ID NO: 953482 - DNA, 25 bp, Mus musculus
ggggccttccagtgtagaggcccgg

SEQ ID NO: 953483 - DNA, 25 bp, Mus musculus
ggggcctttcagacccctatgtgaa

SEQ ID NO: 953484 - DNA, 25 bp, Mus musculus
ggggcctttcagtcccctatgtgaa

SEQ ID NO: 953485 - DNA, 25 bp, Mus musculus
ggggcgaaggcattacagtgtttct

SEQ ID NO: 953486 - DNA, 25 bp, Mus musculus
ggggcgaagggattacagtgtttct

SEQ ID NO: 953487 - DNA, 25 bp, Mus musculus
ggggcgagagtgcgctgtaaaaaat

SEQ ID NO: 953488 - DNA, 25 bp, Mus musculus
ggggcgagagtgggctgtaaaaaat

SEQ ID NO: 953489 - DNA, 25 bp, Mus musculus
ggggcgagcagacctgcacccagta

SEQ ID NO: 953490 - DNA, 25 bp, Mus musculus
ggggcgagcagagctgcacccagta

SEQ ID NO: 953491 - DNA, 25 bp, Mus musculus
ggggcgaggccgatactccatgttt

SEQ ID NO: 953492 - DNA, 25 bp, Mus musculus
ggggcgaggccgttactccatgttt

SEQ ID NO: 953493 - DNA, 25 bp, Mus musculus
ggggcgcagtcctcctttgaagaca

SEQ ID NO: 953494 - DNA, 25 bp, Mus musculus
ggggcgcagtcctcgtttgaagaca

SEQ ID NO: 953495 - DNA, 25 bp, Mus musculus
ggggcgcatgaggttggctggcagc

SEQ ID NO: 953496 - DNA, 25 bp, Mus musculus
ggggcgcatgtggttggctggcagc

SEQ ID NO: 953497 - DNA, 25 bp, Mus musculus
ggggcgcgggagacaccaggcttgg

SEQ ID NO: 953498 - DNA, 25 bp, Mus musculus
ggggcgcgggagtcaccaggcttgg

SEQ ID NO: 953499 - DNA, 25 bp, Mus musculus
ggggcgcgtgcgattgagctgctga

SEQ ID NO: 953500 - DNA, 25 bp, Mus musculus
ggggcgcgtgcgtttgagctgctga

SEQ ID NO: 953501 - DNA, 25 bp, Mus musculus
ggggcggaatttccccatccgagga

SEQ ID NO: 953502 - DNA, 25 bp, Mus musculus
ggggcggaatttccgcatccgagga

SEQ ID NO: 953503 - DNA, 25 bp, Mus musculus
ggggcgtgggattgaagtgagtgaa

SEQ ID NO: 953504 - DNA, 25 bp, Mus musculus
ggggcgtgggtttgaagtgagtgaa

SEQ ID NO: 953505 - DNA, 25 bp, Mus musculus
ggggcgtgtctggacattcgacttg

SEQ ID NO: 953506 - DNA, 25 bp, Mus musculus
ggggcgtgtctggagattcgacttg

SEQ ID NO: 953507 - DNA, 25 bp, Mus musculus
ggggctaagaatggagggcagccac

SEQ ID NO: 953508 - DNA, 25 bp, Mus musculus
ggggctaagattggagggcagccac

SEQ ID NO: 953509 - DNA, 25 bp, Mus musculus
ggggctaagggacacatggctatga

SEQ ID NO: 953510 - DNA, 25 bp, Mus musculus
ggggctaagggacagatggctatga

SEQ ID NO: 953511 - DNA, 25 bp, Mus musculus
ggggctacagcatcaaccacgaccc

SEQ ID NO: 953512 - DNA, 25 bp, Mus musculus
ggggctacaggatcaaccacgaccc

SEQ ID NO: 953513 - DNA, 25 bp, Mus musculus
ggggctataacacacgagtcatact

SEQ ID NO: 953514 - DNA, 25 bp, Mus musculus
ggggctataacacaggagtcatact

SEQ ID NO: 953515 - DNA, 25 bp, Mus musculus
ggggctatgcagatggctatgaacg

SEQ ID NO: 953516 - DNA, 25 bp, Mus musculus
ggggctatgcagttggctatgaacg

SEQ ID NO: 953517 - DNA, 25 bp, Mus musculus
ggggctcaagccagacacgctgaag

SEQ ID NO: 953518 - DNA, 25 bp, Mus musculus
ggggctcaaggcagacacgctgaag

SEQ ID NO: 953519 - DNA, 25 bp, Mus musculus
ggggctccaacgaattgccggctga

SEQ ID NO: 953520 - DNA, 25 bp, Mus musculus
ggggctccaacgtattgccggctga

SEQ ID NO: 953521 - DNA, 25 bp, Mus musculus
ggggctccctgcagcgtcccacaaa

SEQ ID NO: 953522 - DNA, 25 bp, Mus musculus
ggggctccctgcagggtcccacaaa

SEQ ID NO: 953523 - DNA, 25 bp, Mus musculus
ggggctcctgaagacgttggtggag

SEQ ID NO: 953524 - DNA, 25 bp, Mus musculus
ggggctcctgaagaggttggtggag

SEQ ID NO: 953525 - DNA, 25 bp, Mus musculus
ggggctcctgcacgagggctgctgg

SEQ ID NO: 953526 - DNA, 25 bp, Mus musculus
ggggctcctgcaggagggctgctgg

SEQ ID NO: 953527 - DNA, 25 bp, Mus musculus
ggggctcctggacacgtggtggtcg

SEQ ID NO: 953528 - DNA, 25 bp, Mus musculus
ggggctcctggacaggtggtggtcg

SEQ ID NO: 953529 - DNA, 25 bp, Mus musculus
ggggctctcgaacgtgagacgaggg

SEQ ID NO: 953530 - DNA, 25 bp, Mus musculus
ggggctctcgaaggtgagacgaggg

SEQ ID NO: 953531 - DNA, 25 bp, Mus musculus
ggggctgaagaatatccatgcggct

SEQ ID NO: 953532 - DNA, 25 bp, Mus musculus
ggggctgaagtatatccatgcggct

SEQ ID NO: 953533 - DNA, 25 bp, Mus musculus
ggggctgacgcacgagtccggctgc

SEQ ID NO: 953534 - DNA, 25 bp, Mus musculus
ggggctgacggacgagtccggctgc

SEQ ID NO: 953535 - DNA, 25 bp, Mus musculus
ggggctgagaaaccatacaattgtg

SEQ ID NO: 953536 - DNA, 25 bp, Mus musculus
ggggctgagaaaccttacaattgtg

SEQ ID NO: 953537 - DNA, 25 bp, Mus musculus
ggggctgcagcgggcacagcatgcg

SEQ ID NO: 953538 - DNA, 25 bp, Mus musculus
ggggctgcagctcacagcggagtga

SEQ ID NO: 953539 - DNA, 25 bp, Mus musculus
ggggctgcagggggcacagcatgcg

SEQ ID NO: 953540 - DNA, 25 bp, Mus musculus
ggggctgcaggtcacagcggagtga

SEQ ID NO: 953541 - DNA, 25 bp, Mus musculus
ggggctggagctcaggagattattg

SEQ ID NO: 953542 - DNA, 25 bp, Mus musculus
ggggctggagctgaggagattattg

SEQ ID NO: 953543 - DNA, 25 bp, Mus musculus
ggggctggcttacacacaaagccta

SEQ ID NO: 953544 - DNA, 25 bp, Mus musculus
ggggctggcttacagacaaagccta

SEQ ID NO: 953545 - DNA, 25 bp, Mus musculus
ggggctgtggatctttccagaacat

SEQ ID NO: 953546 - DNA, 25 bp, Mus musculus
ggggctgtggttctttccagaacat

SEQ ID NO: 953547 - DNA, 25 bp, Mus musculus
ggggcttactcacgatgtcaatggg

SEQ ID NO: 953548 - DNA, 25 bp, Mus musculus
ggggcttactcaggatgtcaatggg

SEQ ID NO: 953549 - DNA, 25 bp, Mus musculus
ggggcttcacagaacgcagaggtca

SEQ ID NO: 953550 - DNA, 25 bp, Mus musculus
ggggcttcacagaaggcagaggtca

SEQ ID NO: 953551 - DNA, 25 bp, Mus musculus
ggggcttgtgagcgtgactacgggg

SEQ ID NO: 953552 - DNA, 25 bp, Mus musculus
ggggcttgtgagggtgactacgggg

SEQ ID NO: 953553 - DNA, 25 bp, Mus musculus
ggggctttctacaacggatttatca

SEQ ID NO: 953554 - DNA, 25 bp, Mus musculus
ggggctttctacaagggatttatca

SEQ ID NO: 953555 - DNA, 25 bp, Mus musculus
gggggaaagcgagaagctagtcaag

SEQ ID NO: 953556 - DNA, 25 bp, Mus musculus
gggggaaagcgagatgctagtcaag

SEQ ID NO: 953557 - DNA, 25 bp, Mus musculus
gggggaaatgaggtgacagcagccc

SEQ ID NO: 953558 - DNA, 25 bp, Mus musculus
gggggaaatgtggtgacagcagccc

SEQ ID NO: 953559 - DNA, 25 bp, Mus musculus
gggggaacctcactgggctgttgtt

SEQ ID NO: 953560 - DNA, 25 bp, Mus musculus
gggggaacctcagtgggctgttgtt

SEQ ID NO: 953561 - DNA, 25 bp, Mus musculus
gggggaagtggtctctatcttcctg

SEQ ID NO: 953562 - DNA, 25 bp, Mus musculus
gggggaagtggtctgtatcttcctg

SEQ ID NO: 953563 - DNA, 25 bp, Mus musculus
gggggacaagagcttgcctgcagga

SEQ ID NO: 953564 - DNA, 25 bp, Mus musculus
gggggacaagaggttgcctgcagga

SEQ ID NO: 953565 - DNA, 25 bp, Mus musculus
gggggacacacaagcaaaatatgct

SEQ ID NO: 953566 - DNA, 25 bp, Mus musculus
gggggacacacatgcaaaatatgct

SEQ ID NO: 953567 - DNA, 25 bp, Mus musculus
gggggacacaggctgtacactgtga

SEQ ID NO: 953568 - DNA, 25 bp, Mus musculus
gggggacacagggtgtacactgtga

SEQ ID NO: 953569 - DNA, 25 bp, Mus musculus
gggggacatctccacggaagaggtg

SEQ ID NO: 953570 - DNA, 25 bp, Mus musculus
gggggacatctccagggaagaggtg

SEQ ID NO: 953571 - DNA, 25 bp, Mus musculus
gggggactgtgcagcttgaaaacga

SEQ ID NO: 953572 - DNA, 25 bp, Mus musculus
gggggactgtgcaggttgaaaacga

SEQ ID NO: 953573 - DNA, 25 bp, Mus musculus
gggggagccctggacgagtctcagc

SEQ ID NO: 953574 - DNA, 25 bp, Mus musculus
gggggagccctggacgattaccagg

SEQ ID NO: 953575 - DNA, 25 bp, Mus musculus
gggggagccctggaggagtctcagc

SEQ ID NO: 953576 - DNA, 25 bp, Mus musculus
gggggagccctggaggattaccagg

SEQ ID NO: 953577 - DNA, 25 bp, Mus musculus
gggggatgacgctgaacacttgccc

SEQ ID NO: 953578 - DNA, 25 bp, Mus musculus
gggggatgacgctgtacacttgccc

SEQ ID NO: 953579 - DNA, 25 bp, Mus musculus
gggggattgattcgtacatggattt

SEQ ID NO: 953580 - DNA, 25 bp, Mus musculus
gggggattgattggtacatggattt

SEQ ID NO: 953581 - DNA, 25 bp, Mus musculus
gggggcaagacgaacgaggcccaga

SEQ ID NO: 953582 - DNA, 25 bp, Mus musculus
gggggcaagacgaaggaggcccaga

SEQ ID NO: 953583 - DNA, 25 bp, Mus musculus
gggggcacatcacacccctatgtga

SEQ ID NO: 953584 - DNA, 25 bp, Mus musculus
gggggcacatcagacccctatgtga

SEQ ID NO: 953585 - DNA, 25 bp, Mus musculus
gggggcaccgagacaaataatttag

SEQ ID NO: 953586 - DNA, 25 bp, Mus musculus
gggggcaccgagctctccagcagaa

SEQ ID NO: 953587 - DNA, 25 bp, Mus musculus
gggggcaccgaggtctccagcagaa

SEQ ID NO: 953588 - DNA, 25 bp, Mus musculus
gggggcaccgagtcaaataatttag

SEQ ID NO: 953589 - DNA, 25 bp, Mus musculus
gggggcaggcagccactcccgagac

SEQ ID NO: 953590 - DNA, 25 bp, Mus musculus
gggggcaggcaggcactcccgagac

SEQ ID NO: 953591 - DNA, 25 bp, Mus musculus
gggggcatcaagctccggcaccagc

SEQ ID NO: 953592 - DNA, 25 bp, Mus musculus
gggggcatcaaggtccggcaccagc

SEQ ID NO: 953593 - DNA, 25 bp, Mus musculus
gggggcattgggctggacagtgaca

SEQ ID NO: 953594 - DNA, 25 bp, Mus musculus
gggggcattggggtggacagtgaca

SEQ ID NO: 953595 - DNA, 25 bp, Mus musculus
gggggccaagagctcaccgagtctg

SEQ ID NO: 953596 - DNA, 25 bp, Mus musculus
gggggccaagtgctcaccgagtctg

SEQ ID NO: 953597 - DNA, 25 bp, Mus musculus
gggggcccagaacgctgagaccgct

SEQ ID NO: 953598 - DNA, 25 bp, Mus musculus
gggggcccagaaggctgagaccgct

SEQ ID NO: 953599 - DNA, 25 bp, Mus musculus
gggggccctcgatgagatgtgatct

SEQ ID NO: 953600 - DNA, 25 bp, Mus musculus
gggggccctcgatgtgatgtgatct

SEQ ID NO: 953601 - DNA, 25 bp, Mus musculus
gggggcctctcaaacgacagtgaac

SEQ ID NO: 953602 - DNA, 25 bp, Mus musculus
gggggcctctcaaaggacagtgaac

SEQ ID NO: 953603 - DNA, 25 bp, Mus musculus
gggggcctttcacacccctatgtga

SEQ ID NO: 953604 - DNA, 25 bp, Mus musculus
gggggcctttcagacccctatgtga

SEQ ID NO: 953605 - DNA, 25 bp, Mus musculus
gggggcggacttcacgtgactcgga

SEQ ID NO: 953606 - DNA, 25 bp, Mus musculus
gggggcggacttcacgtgattcaca

SEQ ID NO: 953607 - DNA, 25 bp, Mus musculus
gggggcggacttcaggtgactcgga

SEQ ID NO: 953608 - DNA, 25 bp, Mus musculus
gggggcggacttcaggtgattcaca

SEQ ID NO: 953609 - DNA, 25 bp, Mus musculus
gggggcgtggaagacgtcagcagag

SEQ ID NO: 953610 - DNA, 25 bp, Mus musculus
gggggcgtggaagacgtcagggcca

SEQ ID NO: 953611 - DNA, 25 bp, Mus musculus
gggggcgtggaagaggtcagcagag

SEQ ID NO: 953612 - DNA, 25 bp, Mus musculus
gggggcgtggaagaggtcagggcca

SEQ ID NO: 953613 - DNA, 25 bp, Mus musculus
gggggctatggcaacgtgttccagg

SEQ ID NO: 953614 - DNA, 25 bp, Mus musculus
gggggctatggcaaggtgttccagg

SEQ ID NO: 953615 - DNA, 25 bp, Mus musculus
gggggcttgtgacggtgactacggg

SEQ ID NO: 953616 - DNA, 25 bp, Mus musculus
gggggcttgtgagggtgactacggg

SEQ ID NO: 953617 - DNA, 25 bp, Mus musculus
ggggggacagctatatggaaccatg

SEQ ID NO: 953618 - DNA, 25 bp, Mus musculus
ggggggacaggtatatggaaccatg

SEQ ID NO: 953619 - DNA, 25 bp, Mus musculus
ggggggccgtggaacagtgaagaca

SEQ ID NO: 953620 - DNA, 25 bp, Mus musculus
ggggggccgtggaagagtgaagaca

SEQ ID NO: 953621 - DNA, 25 bp, Mus musculus
ggggggctcctgcacgagggctgct

SEQ ID NO: 953622 - DNA, 25 bp, Mus musculus
ggggggctcctgcaggagggctgct

SEQ ID NO: 953623 - DNA, 25 bp, Mus musculus
ggggggctctcgaacgtgagacgag

SEQ ID NO: 953624 - DNA, 25 bp, Mus musculus
ggggggctctcgaaggtgagacgag

SEQ ID NO: 953625 - DNA, 25 bp, Mus musculus
gggggtaaatctgattagtgttaag

SEQ ID NO: 953626 - DNA, 25 bp, Mus musculus
gggggtaaatgtgattagtgttaag

SEQ ID NO: 953627 - DNA, 25 bp, Mus musculus
gggggtacagcagacgatgctttcg

SEQ ID NO: 953628 - DNA, 25 bp, Mus musculus
gggggtacagcagaggatgctttcg

SEQ ID NO: 953629 - DNA, 25 bp, Mus musculus
gggggtagtgatcacgagaataatg

SEQ ID NO: 953630 - DNA, 25 bp, Mus musculus
gggggtagtgatcaggagaataatg

SEQ ID NO: 953631 - DNA, 25 bp, Mus musculus
gggggtcccattcctctactgagga

SEQ ID NO: 953632 - DNA, 25 bp, Mus musculus
gggggtcccattgctctactgagga

SEQ ID NO: 953633 - DNA, 25 bp, Mus musculus
gggggtgccacgcacttgagcatcg

SEQ ID NO: 953634 - DNA, 25 bp, Mus musculus
gggggtgccacgctgaccatcgtca

SEQ ID NO: 953635 - DNA, 25 bp, Mus musculus
gggggtgccacggacttgagcatcg

SEQ ID NO: 953636 - DNA, 25 bp, Mus musculus
gggggtgccacggtgaccatcgtca

SEQ ID NO: 953637 - DNA, 25 bp, Mus musculus
gggggtttcaccgacgaatctggag

SEQ ID NO: 953638 - DNA, 25 bp, Mus musculus
gggggtttcaccgaggaatctggag

SEQ ID NO: 953639 - DNA, 25 bp, Mus musculus
ggggtaagcacacctctgcccaccc

SEQ ID NO: 953640 - DNA, 25 bp, Mus musculus
ggggtaagcacacgatcacgtggcc

SEQ ID NO: 953641 - DNA, 25 bp, Mus musculus
ggggtaagcacagctctgcccaccc

SEQ ID NO: 953642 - DNA, 25 bp, Mus musculus
ggggtaagcacaggatcacgtggcc

SEQ ID NO: 953643 - DNA, 25 bp, Mus musculus
ggggtaccagatcctacagtcatgg

SEQ ID NO: 953644 - DNA, 25 bp, Mus musculus
ggggtaccagttcctacagtcatgg

SEQ ID NO: 953645 - DNA, 25 bp, Mus musculus
ggggtactgccacggaatgaatttc

SEQ ID NO: 953646 - DNA, 25 bp, Mus musculus
ggggtactgccactgctgcgcacag

SEQ ID NO: 953647 - DNA, 25 bp, Mus musculus
ggggtactgccagggaatgaatttc

SEQ ID NO: 953648 - DNA, 25 bp, Mus musculus
ggggtactgccagtgctgcgcacag

SEQ ID NO: 953649 - DNA, 25 bp, Mus musculus
ggggtagtgcaacgtggagtgtcat

SEQ ID NO: 953650 - DNA, 25 bp, Mus musculus
ggggtagtgcaaggtggagtgtcat

SEQ ID NO: 953651 - DNA, 25 bp, Mus musculus
ggggtatggagacgtgtcatcaata

SEQ ID NO: 953652 - DNA, 25 bp, Mus musculus
ggggtatggagaggtgtcatcaata

SEQ ID NO: 953653 - DNA, 25 bp, Mus musculus
ggggtatgtgactgctgtgatggca

SEQ ID NO: 953654 - DNA, 25 bp, Mus musculus
ggggtatgtgtctgctgtgatggca

SEQ ID NO: 953655 - DNA, 25 bp, Mus musculus
ggggtcaaacctgaccgccagtgag

SEQ ID NO: 953656 - DNA, 25 bp, Mus musculus
ggggtcaaacgtgaccgccagtgag

SEQ ID NO: 953657 - DNA, 25 bp, Mus musculus
ggggtcactgccaatggagaggcca

SEQ ID NO: 953658 - DNA, 25 bp, Mus musculus
ggggtcactgcctatggagaggcca

SEQ ID NO: 953659 - DNA, 25 bp, Mus musculus
ggggtcaggcaacgcagtccctcga

SEQ ID NO: 953660 - DNA, 25 bp, Mus musculus
ggggtcaggcaaggcagtccctcga

SEQ ID NO: 953661 - DNA, 25 bp, Mus musculus
ggggtcatcactcgcttgggtctgg

SEQ ID NO: 953662 - DNA, 25 bp, Mus musculus
ggggtcatcactggcttgggtctgg

SEQ ID NO: 953663 - DNA, 25 bp, Mus musculus
ggggtcccaggcaaccctggaagag

SEQ ID NO: 953664 - DNA, 25 bp, Mus musculus
ggggtcccaggcaacggcagtgtat

SEQ ID NO: 953665 - DNA, 25 bp, Mus musculus
ggggtcccaggcaagcctggaagag

SEQ ID NO: 953666 - DNA, 25 bp, Mus musculus
ggggtcccaggcaagggcagtgtat

SEQ ID NO: 953667 - DNA, 25 bp, Mus musculus
ggggtcccattgctctactgaggaa

SEQ ID NO: 953668 - DNA, 25 bp, Mus musculus
ggggtcccattggtctactgaggaa

SEQ ID NO: 953669 - DNA, 25 bp, Mus musculus
ggggtcccatttcacgtgctggtgg

SEQ ID NO: 953670 - DNA, 25 bp, Mus musculus
ggggtcccatttcaggtgctggtgg

SEQ ID NO: 953671 - DNA, 25 bp, Mus musculus
ggggtccggatgcacatatttccgt

SEQ ID NO: 953672 - DNA, 25 bp, Mus musculus
ggggtccggatgcagatatttccgt

SEQ ID NO: 953673 - DNA, 25 bp, Mus musculus
ggggtcctccagcgctctttcaccg

SEQ ID NO: 953674 - DNA, 25 bp, Mus musculus
ggggtcctccagggctctttcaccg

SEQ ID NO: 953675 - DNA, 25 bp, Mus musculus
ggggtctgtgccaattctagctgga

SEQ ID NO: 953676 - DNA, 25 bp, Mus musculus
ggggtctgtggcaattctagctgga

SEQ ID NO: 953677 - DNA, 25 bp, Mus musculus
ggggtgaatccatccgtacaagcaa

SEQ ID NO: 953678 - DNA, 25 bp, Mus musculus
ggggtgaatccatcggtacaagcaa

SEQ ID NO: 953679 - DNA, 25 bp, Mus musculus
ggggtgaatcctcacctgcagagtc

SEQ ID NO: 953680 - DNA, 25 bp, Mus musculus
ggggtgaatcctcagctgcagagtc

SEQ ID NO: 953681 - DNA, 25 bp, Mus musculus
ggggtgccacggacttgagcatcga

SEQ ID NO: 953682 - DNA, 25 bp, Mus musculus
ggggtgccacggagaccatcgtcag

SEQ ID NO: 953683 - DNA, 25 bp, Mus musculus
ggggtgccacggtcttgagcatcga

SEQ ID NO: 953684 - DNA, 25 bp, Mus musculus
ggggtgccacggtgaccatcgtcag

SEQ ID NO: 953685 - DNA, 25 bp, Mus musculus
ggggtgcccattttcgtggtgagct

SEQ ID NO: 953686 - DNA, 25 bp, Mus musculus
ggggtgcccattttggtggtgagct

SEQ ID NO: 953687 - DNA, 25 bp, Mus musculus
ggggtgcccctgcacgacctcatgg

SEQ ID NO: 953688 - DNA, 25 bp, Mus musculus
ggggtgcccctgcaggacctcatgg

SEQ ID NO: 953689 - DNA, 25 bp, Mus musculus
ggggtgctgctccactactatggca

SEQ ID NO: 953690 - DNA, 25 bp, Mus musculus
ggggtgctgctccagtactatggca

SEQ ID NO: 953691 - DNA, 25 bp, Mus musculus
ggggtggaaaagcggagactgagag

SEQ ID NO: 953692 - DNA, 25 bp, Mus musculus
ggggtggaaatgcggagactgagag

SEQ ID NO: 953693 - DNA, 25 bp, Mus musculus
ggggtggagaccaacatccgactca

SEQ ID NO: 953694 - DNA, 25 bp, Mus musculus
ggggtggagaccaagatccgactca

SEQ ID NO: 953695 - DNA, 25 bp, Mus musculus
ggggtggcagctgtccagaatgtgg

SEQ ID NO: 953696 - DNA, 25 bp, Mus musculus
ggggtggcaggtgtccagaatgtgg

SEQ ID NO: 953697 - DNA, 25 bp, Mus musculus
ggggtggccaattggagaagctaac

SEQ ID NO: 953698 - DNA, 25 bp, Mus musculus
ggggtggccatttggagaagctaac

SEQ ID NO: 953699 - DNA, 25 bp, Mus musculus
ggggtgtctgcggctggattgccac

SEQ ID NO: 953700 - DNA, 25 bp, Mus musculus
ggggtgtctggggctggattgccac

SEQ ID NO: 953701 - DNA, 25 bp, Mus musculus
ggggtgtgagcactcgtgtcgtcag

SEQ ID NO: 953702 - DNA, 25 bp, Mus musculus
ggggtgtgagcactggtgtcgtcag

SEQ ID NO: 953703 - DNA, 25 bp, Mus musculus
ggggtgtgcacactgtttccctgtt

SEQ ID NO: 953704 - DNA, 25 bp, Mus musculus
ggggtgtgcacagtgtttccctgtt

SEQ ID NO: 953705 - DNA, 25 bp, Mus musculus
ggggttcatcctcactatgcggcgc

SEQ ID NO: 953706 - DNA, 25 bp, Mus musculus
ggggttcatcctcccagagactatg

SEQ ID NO: 953707 - DNA, 25 bp, Mus musculus
ggggttcatcctgactatgcggcgc

SEQ ID NO: 953708 - DNA, 25 bp, Mus musculus
ggggttcatcctgccagagactatg

SEQ ID NO: 953709 - DNA, 25 bp, Mus musculus
ggggttcctcaaacccaatggaagc

SEQ ID NO: 953710 - DNA, 25 bp, Mus musculus
ggggttcctcaatcccaatggaagc

SEQ ID NO: 953711 - DNA, 25 bp, Mus musculus
ggggttgcacagcatttccctagag

SEQ ID NO: 953712 - DNA, 25 bp, Mus musculus
ggggttgcacaggatttccctagag

SEQ ID NO: 953713 - DNA, 25 bp, Mus musculus
ggggttggtgatggattcatgggtg

SEQ ID NO: 953714 - DNA, 25 bp, Mus musculus
ggggttggtgttggattcatgggtg

SEQ ID NO: 953715 - DNA, 25 bp, Mus musculus
ggggtttcagccagaaaatgtaact

SEQ ID NO: 953716 - DNA, 25 bp, Mus musculus
ggggtttcagctctgcattacattt

SEQ ID NO: 953717 - DNA, 25 bp, Mus musculus
ggggtttcaggcagaaaatgtaact

SEQ ID NO: 953718 - DNA, 25 bp, Mus musculus
ggggtttcaggtctgcattacattt

SEQ ID NO: 953719 - DNA, 25 bp, Mus musculus
ggggtttgactcccacatccttgtg

SEQ ID NO: 953720 - DNA, 25 bp, Mus musculus
ggggtttgactcgcacatccttgtg

SEQ ID NO: 953721 - DNA, 25 bp, Mus musculus
ggggtttgccagaagagaaggagga

SEQ ID NO: 953722 - DNA, 25 bp, Mus musculus
ggggtttgcctgaagagaaggagga

SEQ ID NO: 953723 - DNA, 25 bp, Mus musculus
gggtaacactcctcaacacttagcc

SEQ ID NO: 953724 - DNA, 25 bp, Mus musculus
gggtaacactcctctacacttagcc

SEQ ID NO: 953725 - DNA, 25 bp, Mus musculus
gggtaagcacagcatcacgtggcca

SEQ ID NO: 953726 - DNA, 25 bp, Mus musculus
gggtaagcacagctctgcccacccc

SEQ ID NO: 953727 - DNA, 25 bp, Mus musculus
gggtaagcacaggatcacgtggcca

SEQ ID NO: 953728 - DNA, 25 bp, Mus musculus
gggtaagcacaggtctgcccacccc

SEQ ID NO: 953729 - DNA, 25 bp, Mus musculus
gggtacaatgctaccatcatgtgtt

SEQ ID NO: 953730 - DNA, 25 bp, Mus musculus
gggtacaatggtaccatcatgtgtt

SEQ ID NO: 953731 - DNA, 25 bp, Mus musculus
gggtacagcagacgatgctttcgca

SEQ ID NO: 953732 - DNA, 25 bp, Mus musculus
gggtacagcagaggatgctttcgca

SEQ ID NO: 953733 - DNA, 25 bp, Mus musculus
gggtaccacgggcacagacttaaag

SEQ ID NO: 953734 - DNA, 25 bp, Mus musculus
gggtaccacgggcagagacttaaag

SEQ ID NO: 953735 - DNA, 25 bp, Mus musculus
gggtactgccagagctgcgcacaga

SEQ ID NO: 953736 - DNA, 25 bp, Mus musculus
gggtactgccagcgaatgaatttca

SEQ ID NO: 953737 - DNA, 25 bp, Mus musculus
gggtactgccagggaatgaatttca

SEQ ID NO: 953738 - DNA, 25 bp, Mus musculus
gggtactgccagtgctgcgcacaga

SEQ ID NO: 953739 - DNA, 25 bp, Mus musculus
gggtagaaaaaacatgacctcaatg

SEQ ID NO: 953740 - DNA, 25 bp, Mus musculus
gggtagaaaaaagatgacctcaatg

SEQ ID NO: 953741 - DNA, 25 bp, Mus musculus
gggtagaccttgagtctagtgacaa

SEQ ID NO: 953742 - DNA, 25 bp, Mus musculus
gggtagaccttgtgtctagtgacaa

SEQ ID NO: 953743 - DNA, 25 bp, Mus musculus
gggtagccagcgagcacctgtgaca

SEQ ID NO: 953744 - DNA, 25 bp, Mus musculus
gggtagccagggagcacctgtgaca

SEQ ID NO: 953745 - DNA, 25 bp, Mus musculus
gggtagcctctgagcaaagatataa

SEQ ID NO: 953746 - DNA, 25 bp, Mus musculus
gggtagcctctgagcgaactacatg

SEQ ID NO: 953747 - DNA, 25 bp, Mus musculus
gggtagcctctgaggaaagatataa

SEQ ID NO: 953748 - DNA, 25 bp, Mus musculus
gggtagcctctgagggaactacatg

SEQ ID NO: 953749 - DNA, 25 bp, Mus musculus
gggtagtcactgactgtatccaggt

SEQ ID NO: 953750 - DNA, 25 bp, Mus musculus
gggtagtcactgtctgtatccaggt

SEQ ID NO: 953751 - DNA, 25 bp, Mus musculus
gggtagtgaccttccggaggatgca

SEQ ID NO: 953752 - DNA, 25 bp, Mus musculus
gggtagtgaccttcgggaggatgca

SEQ ID NO: 953753 - DNA, 25 bp, Mus musculus
gggtagtgatcacgagaataatgtt

SEQ ID NO: 953754 - DNA, 25 bp, Mus musculus
gggtagtgatcaggagaataatgtt

SEQ ID NO: 953755 - DNA, 25 bp, Mus musculus
gggtagtgcaagctggagtgtcatc

SEQ ID NO: 953756 - DNA, 25 bp, Mus musculus
gggtagtgcaaggtggagtgtcatc

SEQ ID NO: 953757 - DNA, 25 bp, Mus musculus
gggtataaagagcacgtccaagtcc

SEQ ID NO: 953758 - DNA, 25 bp, Mus musculus
gggtataaagaggacgtccaagtcc

SEQ ID NO: 953759 - DNA, 25 bp, Mus musculus
gggtataacaagacaacaatgcttc

SEQ ID NO: 953760 - DNA, 25 bp, Mus musculus
gggtataacaagactacaatgcttc

SEQ ID NO: 953761 - DNA, 25 bp, Mus musculus
gggtatcaaaatatgaaaaatacta

SEQ ID NO: 953762 - DNA, 25 bp, Mus musculus
gggtatcaaattatgaaaaatacta

SEQ ID NO: 953763 - DNA, 25 bp, Mus musculus
gggtatcaatggatttggacgcatt

SEQ ID NO: 953764 - DNA, 25 bp, Mus musculus
gggtatcaatggttttggacgcatt

SEQ ID NO: 953765 - DNA, 25 bp, Mus musculus
gggtatccagattgcaagaaggttc

SEQ ID NO: 953766 - DNA, 25 bp, Mus musculus
gggtatccagtttgcaagaaggttc

SEQ ID NO: 953767 - DNA, 25 bp, Mus musculus
gggtatcgccccctcgcaggtgatg

SEQ ID NO: 953768 - DNA, 25 bp, Mus musculus
gggtatcgccccctggcaggtgatg

SEQ ID NO: 953769 - DNA, 25 bp, Mus musculus
gggtatggagagctgtcatcaataa

SEQ ID NO: 953770 - DNA, 25 bp, Mus musculus
gggtatggagaggtgtcatcaataa

SEQ ID NO: 953771 - DNA, 25 bp, Mus musculus
gggtattcagctgttccagtcaagt

SEQ ID NO: 953772 - DNA, 25 bp, Mus musculus
gggtattcaggtgttccagtcaagt

SEQ ID NO: 953773 - DNA, 25 bp, Mus musculus
gggtcacaagaagccgtctcagtgc

SEQ ID NO: 953774 - DNA, 25 bp, Mus musculus
gggtcacaagctcaaagcaagtagg

SEQ ID NO: 953775 - DNA, 25 bp, Mus musculus
gggtcacaaggtcaaagcaagtagg

SEQ ID NO: 953776 - DNA, 25 bp, Mus musculus
gggtcacaagtagccgtctcagtgc

SEQ ID NO: 953777 - DNA, 25 bp, Mus musculus
gggtcactgccaatggagaggccag

SEQ ID NO: 953778 - DNA, 25 bp, Mus musculus
gggtcactgccattggagaggccag

SEQ ID NO: 953779 - DNA, 25 bp, Mus musculus
gggtcagaagcgtgagcgaggtccc

SEQ ID NO: 953780 - DNA, 25 bp, Mus musculus
gggtcagaagggtgagcgaggtccc

SEQ ID NO: 953781 - DNA, 25 bp, Mus musculus
gggtcaggcaagccagtccctcgag

SEQ ID NO: 953782 - DNA, 25 bp, Mus musculus
gggtcaggcaaggcagtccctcgag

SEQ ID NO: 953783 - DNA, 25 bp, Mus musculus
gggtcaggtgcaaaatggaacactg

SEQ ID NO: 953784 - DNA, 25 bp, Mus musculus
gggtcaggtgcaagtgcagaatgga

SEQ ID NO: 953785 - DNA, 25 bp, Mus musculus
gggtcaggtgcataatggaacactg

SEQ ID NO: 953786 - DNA, 25 bp, Mus musculus
gggtcaggtgcatgtgcagaatgga

SEQ ID NO: 953787 - DNA, 25 bp, Mus musculus
gggtcatcactgccttgggtctggc

SEQ ID NO: 953788 - DNA, 25 bp, Mus musculus
gggtcatcactggcttgggtctggc

SEQ ID NO: 953789 - DNA, 25 bp, Mus musculus
gggtcatcagcctgtctcaggaact

SEQ ID NO: 953790 - DNA, 25 bp, Mus musculus
gggtcatcaggctgtctcaggaact

SEQ ID NO: 953791 - DNA, 25 bp, Mus musculus
gggtcatccctaaacggaacatctg

SEQ ID NO: 953792 - DNA, 25 bp, Mus musculus
gggtcatccctaaacgtgtcataag

SEQ ID NO: 953793 - DNA, 25 bp, Mus musculus
gggtcatccctaaagggaacatctg

SEQ ID NO: 953794 - DNA, 25 bp, Mus musculus
gggtcatccctaaaggtgtcataag

SEQ ID NO: 953795 - DNA, 25 bp, Mus musculus
gggtcatggaaaaatgggcttaggt

SEQ ID NO: 953796 - DNA, 25 bp, Mus musculus
gggtcatggaaatatgggcttaggt

SEQ ID NO: 953797 - DNA, 25 bp, Mus musculus
gggtcccagaagcgtcagaaagcat

SEQ ID NO: 953798 - DNA, 25 bp, Mus musculus
gggtcccagaagggtcagaaagcat

SEQ ID NO: 953799 - DNA, 25 bp, Mus musculus
gggtccccgcggaccgcatggcagg

SEQ ID NO: 953800 - DNA, 25 bp, Mus musculus
gggtccccgcggacggcatggcagg

SEQ ID NO: 953801 - DNA, 25 bp, Mus musculus
gggtcccgagcacgtcaatgaccct

SEQ ID NO: 953802 - DNA, 25 bp, Mus musculus
gggtcccgagcaggtcaatgaccct

SEQ ID NO: 953803 - DNA, 25 bp, Mus musculus
gggtccctccagaaattcttgccat

SEQ ID NO: 953804 - DNA, 25 bp, Mus musculus
gggtccctccagaatttcttgccat

SEQ ID NO: 953805 - DNA, 25 bp, Mus musculus
gggtccgacaggatggaaagcctat

SEQ ID NO: 953806 - DNA, 25 bp, Mus musculus
gggtccgacaggttggaaagcctat

SEQ ID NO: 953807 - DNA, 25 bp, Mus musculus
gggtcctgcgatcttggcccagctg

SEQ ID NO: 953808 - DNA, 25 bp, Mus musculus
gggtcctgcgttcttggcccagctg

SEQ ID NO: 953809 - DNA, 25 bp, Mus musculus
gggtcctgctcaagtgccctatcgt

SEQ ID NO: 953810 - DNA, 25 bp, Mus musculus
gggtcctgctcatgtgccctatcgt

SEQ ID NO: 953811 - DNA, 25 bp, Mus musculus
gggtcctgtttaaccatcagcagtg

SEQ ID NO: 953812 - DNA, 25 bp, Mus musculus
gggtcctgtttaagagttcagatgc

SEQ ID NO: 953813 - DNA, 25 bp, Mus musculus
gggtcctgtttatccatcagcagtg

SEQ ID NO: 953814 - DNA, 25 bp, Mus musculus
gggtcctgtttatgagttcagatgc

SEQ ID NO: 953815 - DNA, 25 bp, Mus musculus
gggtcgaatctacacgggccgggct

SEQ ID NO: 953816 - DNA, 25 bp, Mus musculus
gggtcgaatctacaggggccgggct

SEQ ID NO: 953817 - DNA, 25 bp, Mus musculus
gggtcgagcctaaacaacatcaaac

SEQ ID NO: 953818 - DNA, 25 bp, Mus musculus
gggtcgagcctaaagaacatcaaac

SEQ ID NO: 953819 - DNA, 25 bp, Mus musculus
gggtcgatatcacgtgtcctggagc

SEQ ID NO: 953820 - DNA, 25 bp, Mus musculus
gggtcgatatcaggtgtcctggagc

SEQ ID NO: 953821 - DNA, 25 bp, Mus musculus
gggtcgcaggaggcatgcactatct

SEQ ID NO: 953822 - DNA, 25 bp, Mus musculus
gggtcgcaggtggcatgcactatct

SEQ ID NO: 953823 - DNA, 25 bp, Mus musculus
gggtcgccctcgcgttccagcagaa

SEQ ID NO: 953824 - DNA, 25 bp, Mus musculus
gggtcgccctcgggttccagcagaa

SEQ ID NO: 953825 - DNA, 25 bp, Mus musculus
gggtctatgttgccaatgttgcttg

SEQ ID NO: 953826 - DNA, 25 bp, Mus musculus
gggtctatgttggcaatgttgcttg

SEQ ID NO: 953827 - DNA, 25 bp, Mus musculus
gggtctcaagatgttgttgatgatg

SEQ ID NO: 953828 - DNA, 25 bp, Mus musculus
gggtctcaagttgttgttgatgatg

SEQ ID NO: 953829 - DNA, 25 bp, Mus musculus
gggtctctgcagagctatggggcat

SEQ ID NO: 953830 - DNA, 25 bp, Mus musculus
gggtctctgcagtgctatggggcat

SEQ ID NO: 953831 - DNA, 25 bp, Mus musculus
gggtctgcatctctcacctccggat

SEQ ID NO: 953832 - DNA, 25 bp, Mus musculus
gggtctgcatctctgacctccggat

SEQ ID NO: 953833 - DNA, 25 bp, Mus musculus
gggtctggatcacgtttaccactgc

SEQ ID NO: 953834 - DNA, 25 bp, Mus musculus
gggtctggatcaggtttaccactgc

SEQ ID NO: 953835 - DNA, 25 bp, Mus musculus
gggtctgtggatcatgaccacaagc

SEQ ID NO: 953836 - DNA, 25 bp, Mus musculus
gggtctgtggatgatgaccacaagc

SEQ ID NO: 953837 - DNA, 25 bp, Mus musculus
gggtcttcaccacactgataatatg

SEQ ID NO: 953838 - DNA, 25 bp, Mus musculus
gggtcttcaccacagtgataatatg

SEQ ID NO: 953839 - DNA, 25 bp, Mus musculus
gggtcttgggaacaaagacgatgct

SEQ ID NO: 953840 - DNA, 25 bp, Mus musculus
gggtcttgggaagaaagacgatgct

SEQ ID NO: 953841 - DNA, 25 bp, Mus musculus
gggtgaaagcttcacctctttccgg

SEQ ID NO: 953842 - DNA, 25 bp, Mus musculus
gggtgaaagcttcagctctttccgg

SEQ ID NO: 953843 - DNA, 25 bp, Mus musculus
gggtgaacagcgtgcctctggtgaa

SEQ ID NO: 953844 - DNA, 25 bp, Mus musculus
gggtgaacagggtgcctctggtgaa

SEQ ID NO: 953845 - DNA, 25 bp, Mus musculus
gggtgaaccgatacactgggaccta

SEQ ID NO: 953846 - DNA, 25 bp, Mus musculus
gggtgaaccgttacactgggaccta

SEQ ID NO: 953847 - DNA, 25 bp, Mus musculus
gggtgacaagcgtgactcagctgtg

SEQ ID NO: 953848 - DNA, 25 bp, Mus musculus
gggtgacaagggtgactcagctgtg

SEQ ID NO: 953849 - DNA, 25 bp, Mus musculus
gggtgacctgggatggattcatggg

SEQ ID NO: 953850 - DNA, 25 bp, Mus musculus
gggtgacctgggttggattcatggg

SEQ ID NO: 953851 - DNA, 25 bp, Mus musculus
gggtgaccttcgagatatgggacaa

SEQ ID NO: 953852 - DNA, 25 bp, Mus musculus
gggtgaccttggagatatgggacaa

SEQ ID NO: 953853 - DNA, 25 bp, Mus musculus
gggtgactctaaatctgcatttaag

SEQ ID NO: 953854 - DNA, 25 bp, Mus musculus
gggtgactctaattctgcatttaag

SEQ ID NO: 953855 - DNA, 25 bp, Mus musculus
gggtgagccgcgagccaaaggtgac

SEQ ID NO: 953856 - DNA, 25 bp, Mus musculus
gggtgagccgggagccaaaggtgac

SEQ ID NO: 953857 - DNA, 25 bp, Mus musculus
gggtgataataacgacaaccggatc

SEQ ID NO: 953858 - DNA, 25 bp, Mus musculus
gggtgataataactttctgagggtc

SEQ ID NO: 953859 - DNA, 25 bp, Mus musculus
gggtgataataaggacaaccggatc

SEQ ID NO: 953860 - DNA, 25 bp, Mus musculus
gggtgataataagtttctgagggtc

SEQ ID NO: 953861 - DNA, 25 bp, Mus musculus
gggtgatgactgcccagtgtttcca

SEQ ID NO: 953862 - DNA, 25 bp, Mus musculus
gggtgatgactggccagtgtttcca

SEQ ID NO: 953863 - DNA, 25 bp, Mus musculus
gggtgatgcaaatacgcagccgaga

SEQ ID NO: 953864 - DNA, 25 bp, Mus musculus
gggtgatgcaaataggcagccgaga

SEQ ID NO: 953865 - DNA, 25 bp, Mus musculus
gggtgatggtgacgtctagtgacag

SEQ ID NO: 953866 - DNA, 25 bp, Mus musculus
gggtgatggtgaggtctagtgacag

SEQ ID NO: 953867 - DNA, 25 bp, Mus musculus
gggtgcaggaaaacattgctgatag

SEQ ID NO: 953868 - DNA, 25 bp, Mus musculus
gggtgcaggaaaactttgctgatag

SEQ ID NO: 953869 - DNA, 25 bp, Mus musculus
gggtgcatgaaacgccgcaccatgt

SEQ ID NO: 953870 - DNA, 25 bp, Mus musculus
gggtgcatgaaaggccgcaccatgt

SEQ ID NO: 953871 - DNA, 25 bp, Mus musculus
gggtgccaagcgggagccaggcagt

SEQ ID NO: 953872 - DNA, 25 bp, Mus musculus
gggtgccaagggggagccaggcagt

SEQ ID NO: 953873 - DNA, 25 bp, Mus musculus
gggtgcccagcatcgatccgtatgg

SEQ ID NO: 953874 - DNA, 25 bp, Mus musculus
gggtgcccaggatcgatccgtatgg

SEQ ID NO: 953875 - DNA, 25 bp, Mus musculus
gggtgcccggcatgaaagtgggatc

SEQ ID NO: 953876 - DNA, 25 bp, Mus musculus
gggtgcccgggatgaaagtgggatc

SEQ ID NO: 953877 - DNA, 25 bp, Mus musculus
gggtgccctcaccactcaatccctg

SEQ ID NO: 953878 - DNA, 25 bp, Mus musculus
gggtgccctcaccagtcaatccctg

SEQ ID NO: 953879 - DNA, 25 bp, Mus musculus
gggtgcctacagagaagcggtcagc

SEQ ID NO: 953880 - DNA, 25 bp, Mus musculus
gggtgcctacagtgaagcggtcagc

SEQ ID NO: 953881 - DNA, 25 bp, Mus musculus
gggtgcgaagctaacagagagaaag

SEQ ID NO: 953882 - DNA, 25 bp, Mus musculus
gggtgcgaaggtaacagagagaaag

SEQ ID NO: 953883 - DNA, 25 bp, Mus musculus
gggtgcggagctcgctcatccgatc

SEQ ID NO: 953884 - DNA, 25 bp, Mus musculus
gggtgcggaggtcgctcatccgatc

SEQ ID NO: 953885 - DNA, 25 bp, Mus musculus
gggtgctgcccacggtccgggagag

SEQ ID NO: 953886 - DNA, 25 bp, Mus musculus
gggtgctgcccactagggtccggga

SEQ ID NO: 953887 - DNA, 25 bp, Mus musculus
gggtgctgcccagggtccgggagag

SEQ ID NO: 953888 - DNA, 25 bp, Mus musculus
gggtgctgcccagtagggtccggga

SEQ ID NO: 953889 - DNA, 25 bp, Mus musculus
gggtgctgtgcgcttctattccaag

SEQ ID NO: 953890 - DNA, 25 bp, Mus musculus
gggtgctgtgcggttctattccaag

SEQ ID NO: 953891 - DNA, 25 bp, Mus musculus
gggtggaaacaatgcccactttatc

SEQ ID NO: 953892 - DNA, 25 bp, Mus musculus
gggtggaaacaatggccactttatc

SEQ ID NO: 953893 - DNA, 25 bp, Mus musculus
gggtggaaacagcatgttctcacag

SEQ ID NO: 953894 - DNA, 25 bp, Mus musculus
gggtggaaacaggatgttctcacag

SEQ ID NO: 953895 - DNA, 25 bp, Mus musculus
gggtggaagaaacgcttggggcata

SEQ ID NO: 953896 - DNA, 25 bp, Mus musculus
gggtggaagaaaggcttggggcata

SEQ ID NO: 953897 - DNA, 25 bp, Mus musculus
gggtggacagctgagcaatgccagc

SEQ ID NO: 953898 - DNA, 25 bp, Mus musculus
gggtggacaggtgagcaatgccagc

SEQ ID NO: 953899 - DNA, 25 bp, Mus musculus
gggtggaggcagagtgcaaatagtc

SEQ ID NO: 953900 - DNA, 25 bp, Mus musculus
gggtggaggcagatgtctgctacag

SEQ ID NO: 953901 - DNA, 25 bp, Mus musculus
gggtggaggcagtgtgcaaatagtc

SEQ ID NO: 953902 - DNA, 25 bp, Mus musculus
gggtggaggcagttgtctgctacag

SEQ ID NO: 953903 - DNA, 25 bp, Mus musculus
gggtggagtctcaacgggatattgt

SEQ ID NO: 953904 - DNA, 25 bp, Mus musculus
gggtggagtctcaaggggatattgt

SEQ ID NO: 953905 - DNA, 25 bp, Mus musculus
gggtggcgggcccctccatgatgaa

SEQ ID NO: 953906 - DNA, 25 bp, Mus musculus
gggtggcggggccctccatgatgaa

SEQ ID NO: 953907 - DNA, 25 bp, Mus musculus
gggtggctcgcaaaaggcagatctc

SEQ ID NO: 953908 - DNA, 25 bp, Mus musculus
gggtggctcggaaaaggcagatctc

SEQ ID NO: 953909 - DNA, 25 bp, Mus musculus
gggtggctggagatgaattcagtca

SEQ ID NO: 953910 - DNA, 25 bp, Mus musculus
gggtggctggagttgaattcagtca

SEQ ID NO: 953911 - DNA, 25 bp, Mus musculus
gggtggctgtgccacgagtggaggg

SEQ ID NO: 953912 - DNA, 25 bp, Mus musculus
gggtggctgtgccaggagtggaggg

SEQ ID NO: 953913 - DNA, 25 bp, Mus musculus
gggtgggaagcccacatttgccatg

SEQ ID NO: 953914 - DNA, 25 bp, Mus musculus
gggtgggaagcccagatttgccatg

SEQ ID NO: 953915 - DNA, 25 bp, Mus musculus
gggtggtaaagactgacatcctgta

SEQ ID NO: 953916 - DNA, 25 bp, Mus musculus
gggtggtaaagagtgacatcctgta

SEQ ID NO: 953917 - DNA, 25 bp, Mus musculus
gggtggtcagcaaaatcatgtcagc

SEQ ID NO: 953918 - DNA, 25 bp, Mus musculus
gggtggtcagcaaggtctatatgga

SEQ ID NO: 953919 - DNA, 25 bp, Mus musculus
gggtggtcaggaaaatcatgtcagc

SEQ ID NO: 953920 - DNA, 25 bp, Mus musculus
gggtggtcaggaaggtctatatgga

SEQ ID NO: 953921 - DNA, 25 bp, Mus musculus
gggtggtccaagcgtcaagtatgga

SEQ ID NO: 953922 - DNA, 25 bp, Mus musculus
gggtggtccaagggtcaagtatgga

SEQ ID NO: 953923 - DNA, 25 bp, Mus musculus
gggtggttctgacccaacaggagca

SEQ ID NO: 953924 - DNA, 25 bp, Mus musculus
gggtggttctgagccaacaggagca

SEQ ID NO: 953925 - DNA, 25 bp, Mus musculus
gggtgtcaaccacgaacctggctca

SEQ ID NO: 953926 - DNA, 25 bp, Mus musculus
gggtgtcaaccaggaacctggctca

SEQ ID NO: 953927 - DNA, 25 bp, Mus musculus
gggtgtcagcggcaacagcagtggt

SEQ ID NO: 953928 - DNA, 25 bp, Mus musculus
gggtgtcagcgggaacagcagtggt

SEQ ID NO: 953929 - DNA, 25 bp, Mus musculus
gggtgtcattctctacatgatgctg

SEQ ID NO: 953930 - DNA, 25 bp, Mus musculus
gggtgtcattctgtacatgatgctg

SEQ ID NO: 953931 - DNA, 25 bp, Mus musculus
gggtgtccagacgctgcggccaggc

SEQ ID NO: 953932 - DNA, 25 bp, Mus musculus
gggtgtccagtcgctgcggccaggc

SEQ ID NO: 953933 - DNA, 25 bp, Mus musculus
gggtgtccctcacgtggccccttct

SEQ ID NO: 953934 - DNA, 25 bp, Mus musculus
gggtgtccctcactcgagccccgtt

SEQ ID NO: 953935 - DNA, 25 bp, Mus musculus
gggtgtccctcaggtggccccttct

SEQ ID NO: 953936 - DNA, 25 bp, Mus musculus
gggtgtccctcagtcgagccccgtt

SEQ ID NO: 953937 - DNA, 25 bp, Mus musculus
gggtgtccgagccacgacgagggat

SEQ ID NO: 953938 - DNA, 25 bp, Mus musculus
gggtgtccgagccaggacgagggat

SEQ ID NO: 953939 - DNA, 25 bp, Mus musculus
gggtgtcgcccacgtgaagatcatg

SEQ ID NO: 953940 - DNA, 25 bp, Mus musculus
gggtgtcgcccaggtgaagatcatg

SEQ ID NO: 953941 - DNA, 25 bp, Mus musculus
gggtgtcttccacatcctgctccgg

SEQ ID NO: 953942 - DNA, 25 bp, Mus musculus
gggtgtcttccagatcctgctccgg

SEQ ID NO: 953943 - DNA, 25 bp, Mus musculus
gggtgtgaggaggtggagcagcccc

SEQ ID NO: 953944 - DNA, 25 bp, Mus musculus
gggtgtgaggtggtggagcagcccc

SEQ ID NO: 953945 - DNA, 25 bp, Mus musculus
gggtgtgcataccggtcggttgtaa

SEQ ID NO: 953946 - DNA, 25 bp, Mus musculus
gggtgtgcatacgggtcggttgtaa

SEQ ID NO: 953947 - DNA, 25 bp, Mus musculus
gggtgtgtgacttaccccaggagtt

SEQ ID NO: 953948 - DNA, 25 bp, Mus musculus
gggtgtgtgacttacgtaggtgagc

SEQ ID NO: 953949 - DNA, 25 bp, Mus musculus
gggtgtgtgacttagcccaggagtt

SEQ ID NO: 953950 - DNA, 25 bp, Mus musculus
gggtgtgtgacttaggtaggtgagc

SEQ ID NO: 953951 - DNA, 25 bp, Mus musculus
gggtgtgtggcacgaaagaaatgct

SEQ ID NO: 953952 - DNA, 25 bp, Mus musculus
gggtgtgtggcaggaaagaaatgct

SEQ ID NO: 953953 - DNA, 25 bp, Mus musculus
gggtgttaagaacgaaatgatccgg

SEQ ID NO: 953954 - DNA, 25 bp, Mus musculus
gggtgttaagaaggaaatgatccgg

SEQ ID NO: 953955 - DNA, 25 bp, Mus musculus
gggtgttaccaacgctgcagagaag

SEQ ID NO: 953956 - DNA, 25 bp, Mus musculus
gggtgttaccaaggctgcagagaag

SEQ ID NO: 953957 - DNA, 25 bp, Mus musculus
gggtgttcaaagagaccttcagtcc

SEQ ID NO: 953958 - DNA, 25 bp, Mus musculus
gggtgttcaaagtgaccttcagtcc

SEQ ID NO: 953959 - DNA, 25 bp, Mus musculus
gggttcacacagcagtgccaggagg

SEQ ID NO: 953960 - DNA, 25 bp, Mus musculus
gggttcacacaggagtgccaggagg

SEQ ID NO: 953961 - DNA, 25 bp, Mus musculus
gggttcatcctgactatgcggcgca

SEQ ID NO: 953962 - DNA, 25 bp, Mus musculus
gggttcatcctgccagagactatgc

SEQ ID NO: 953963 - DNA, 25 bp, Mus musculus
gggttcatcctggcagagactatgc

SEQ ID NO: 953964 - DNA, 25 bp, Mus musculus
gggttcatcctgtctatgcggcgca

SEQ ID NO: 953965 - DNA, 25 bp, Mus musculus
gggttcccggaagacgctcccagat

SEQ ID NO: 953966 - DNA, 25 bp, Mus musculus
gggttcccggaagaggctcccagat

SEQ ID NO: 953967 - DNA, 25 bp, Mus musculus
gggttcctataatgcgcgcagagac

SEQ ID NO: 953968 - DNA, 25 bp, Mus musculus
gggttcctataatgggcgcagagac

SEQ ID NO: 953969 - DNA, 25 bp, Mus musculus
gggttcctcaatcccaatggaagca

SEQ ID NO: 953970 - DNA, 25 bp, Mus musculus
gggttcctcaatgccaatggaagca

SEQ ID NO: 953971 - DNA, 25 bp, Mus musculus
gggttcctcgcctcccaggagctca

SEQ ID NO: 953972 - DNA, 25 bp, Mus musculus
gggttcctcggctcccaggagctca

SEQ ID NO: 953973 - DNA, 25 bp, Mus musculus
gggttgctgtatttcgcaaatgtgg

SEQ ID NO: 953974 - DNA, 25 bp, Mus musculus
gggttgctgtatttggcaaatgtgg

SEQ ID NO: 953975 - DNA, 25 bp, Mus musculus
gggttgctgtcacggtcgaaattgg

SEQ ID NO: 953976 - DNA, 25 bp, Mus musculus
gggttgctgtcagggtcgaaattgg

SEQ ID NO: 953977 - DNA, 25 bp, Mus musculus
gggttggacaagcttgctgaagagt

SEQ ID NO: 953978 - DNA, 25 bp, Mus musculus
gggttggacaaggttgctgaagagt

SEQ ID NO: 953979 - DNA, 25 bp, Mus musculus
gggttggatatcgacgctgaagtcc

SEQ ID NO: 953980 - DNA, 25 bp, Mus musculus
gggttggatatcgaggctgaagtcc

SEQ ID NO: 953981 - DNA, 25 bp, Mus musculus
gggtttatgaagaggaagtcttcgg

SEQ ID NO: 953982 - DNA, 25 bp, Mus musculus
gggtttatgaagtggaagtcttcgg

SEQ ID NO: 953983 - DNA, 25 bp, Mus musculus
gggtttcaagacttgtgatggatga

SEQ ID NO: 953984 - DNA, 25 bp, Mus musculus
gggtttcaagtcttgtgatggatga

SEQ ID NO: 953985 - DNA, 25 bp, Mus musculus
gggtttcaccgacgaatctggagat

SEQ ID NO: 953986 - DNA, 25 bp, Mus musculus
gggtttcaccgaggaatctggagat

SEQ ID NO: 953987 - DNA, 25 bp, Mus musculus
gggtttgactcgcacatccttgtgg

SEQ ID NO: 953988 - DNA, 25 bp, Mus musculus
gggtttgactcggacatccttgtgg

SEQ ID NO: 953989 - DNA, 25 bp, Mus musculus
gggtttgccgcattatcacaaaatt

SEQ ID NO: 953990 - DNA, 25 bp, Mus musculus
gggtttgccggattatcacaaaatt

SEQ ID NO: 953991 - DNA, 25 bp, Mus musculus
gggtttgtcttgaacaacacccagt

SEQ ID NO: 953992 - DNA, 25 bp, Mus musculus
gggtttgtcttgaagaacacccagt

SEQ ID NO: 953993 - DNA, 25 bp, Mus musculus
gggttttcagcacactgccccattg

SEQ ID NO: 953994 - DNA, 25 bp, Mus musculus
gggttttcaggacactgccccattg

SEQ ID NO: 953995 - DNA, 25 bp, Mus musculus
gggttttgatagcaacgcagtaata

SEQ ID NO: 953996 - DNA, 25 bp, Mus musculus
gggttttgataggaacgcagtaata

SEQ ID NO: 953997 - DNA, 25 bp, Mus musculus
ggtaaaaatgcattagtcgtatcta

SEQ ID NO: 953998 - DNA, 25 bp, Mus musculus
ggtaaaaatggattagtcgtatcta

SEQ ID NO: 953999 - DNA, 25 bp, Mus musculus
ggtaaaagcgcagtcacaatgcagt

SEQ ID NO: 954000 - DNA, 25 bp, Mus musculus
ggtaaaagcggagtcacaatgcagt

SEQ ID NO: 954001 - DNA, 25 bp, Mus musculus
ggtaaaagtgatatagtcatagctg

SEQ ID NO: 954002 - DNA, 25 bp, Mus musculus
ggtaaaagtgttatagtcatagctg

SEQ ID NO: 954003 - DNA, 25 bp, Mus musculus
ggtaaagagaagagaattaattttg

SEQ ID NO: 954004 - DNA, 25 bp, Mus musculus
ggtaaagagaagtgaattaattttg

SEQ ID NO: 954005 - DNA, 25 bp, Mus musculus
ggtaaagcccataaccctcttggct

SEQ ID NO: 954006 - DNA, 25 bp, Mus musculus
ggtaaagcccataagcctcttggct

SEQ ID NO: 954007 - DNA, 25 bp, Mus musculus
ggtaaatgagatcatgattctggaa

SEQ ID NO: 954008 - DNA, 25 bp, Mus musculus
ggtaaatgagttcatgattctggaa

SEQ ID NO: 954009 - DNA, 25 bp, Mus musculus
ggtaacaacctccgcacagccgtga

SEQ ID NO: 954010 - DNA, 25 bp, Mus musculus
ggtaacaacctcggcacagccgtga

SEQ ID NO: 954011 - DNA, 25 bp, Mus musculus
ggtaacacagaagccaccatggggc

SEQ ID NO: 954012 - DNA, 25 bp, Mus musculus
ggtaacacagtagccaccatggggc

SEQ ID NO: 954013 - DNA, 25 bp, Mus musculus
ggtaaccagtccggcggtggagatg

SEQ ID NO: 954014 - DNA, 25 bp, Mus musculus
ggtaaccagtgcggcggtggagatg

SEQ ID NO: 954015 - DNA, 25 bp, Mus musculus
ggtaagaaggctcagcggaacctgc

SEQ ID NO: 954016 - DNA, 25 bp, Mus musculus
ggtaagaaggctgagcggaacctgc

SEQ ID NO: 954017 - DNA, 25 bp, Mus musculus
ggtaaggatggacatcccccaggtc

SEQ ID NO: 954018 - DNA, 25 bp, Mus musculus
ggtaaggatggagatcccccaggtc

SEQ ID NO: 954019 - DNA, 25 bp, Mus musculus
ggtaatagtgctgctttagccctgc

SEQ ID NO: 954020 - DNA, 25 bp, Mus musculus
ggtaatagtggtgctttagccctgc

SEQ ID NO: 954021 - DNA, 25 bp, Mus musculus
ggtaatcgagaggctgagtaatgaa

SEQ ID NO: 954022 - DNA, 25 bp, Mus musculus
ggtaatcgagtggctgagtaatgaa

SEQ ID NO: 954023 - DNA, 25 bp, Mus musculus
ggtaatgattcacatatcctgttag

SEQ ID NO: 954024 - DNA, 25 bp, Mus musculus
ggtaatgattcagatatcctgttag

SEQ ID NO: 954025 - DNA, 25 bp, Mus musculus
ggtacaccacgtccacctctgttac

SEQ ID NO: 954026 - DNA, 25 bp, Mus musculus
ggtacaccacgtgcacctctgttac

SEQ ID NO: 954027 - DNA, 25 bp, Mus musculus
ggtacagaccatattaaccagcttc

SEQ ID NO: 954028 - DNA, 25 bp, Mus musculus
ggtacagaccatattgatcagttga

SEQ ID NO: 954029 - DNA, 25 bp, Mus musculus
ggtacagaccttattaaccagcttc

SEQ ID NO: 954030 - DNA, 25 bp, Mus musculus
ggtacagaccttattgatcagttga

SEQ ID NO: 954031 - DNA, 25 bp, Mus musculus
ggtacagatcatattgatcagtgga

SEQ ID NO: 954032 - DNA, 25 bp, Mus musculus
ggtacagatcttattgatcagtgga

SEQ ID NO: 954033 - DNA, 25 bp, Mus musculus
ggtacagcacaaaaaaacccaagca

SEQ ID NO: 954034 - DNA, 25 bp, Mus musculus
ggtacagcacaataaaacccaagca

SEQ ID NO: 954035 - DNA, 25 bp, Mus musculus
ggtacagcagagcatgctttcgcag

SEQ ID NO: 954036 - DNA, 25 bp, Mus musculus
ggtacagcagaggatgctttcgcag

SEQ ID NO: 954037 - DNA, 25 bp, Mus musculus
ggtacaggagatatcagcaacaaaa

SEQ ID NO: 954038 - DNA, 25 bp, Mus musculus
ggtacaggagatatgagcaacaaaa

SEQ ID NO: 954039 - DNA, 25 bp, Mus musculus
ggtacaggctcacgaggcctttccc

SEQ ID NO: 954040 - DNA, 25 bp, Mus musculus
ggtacaggctcaggaggcctttccc

SEQ ID NO: 954041 - DNA, 25 bp, Mus musculus
ggtacagtgaccaccctggaccagc

SEQ ID NO: 954042 - DNA, 25 bp, Mus musculus
ggtacagtgaccacgctggaccagc

SEQ ID NO: 954043 - DNA, 25 bp, Mus musculus
ggtaccaatccaccatctggatctc

SEQ ID NO: 954044 - DNA, 25 bp, Mus musculus
ggtaccaatccagcatctggatctc

SEQ ID NO: 954045 - DNA, 25 bp, Mus musculus
ggtaccaggaagaatggacctgggc

SEQ ID NO: 954046 - DNA, 25 bp, Mus musculus
ggtaccaggaagtatggacctgggc

SEQ ID NO: 954047 - DNA, 25 bp, Mus musculus
ggtaccatacagaaatgcgatgaag

SEQ ID NO: 954048 - DNA, 25 bp, Mus musculus
ggtaccatacagtaatgcgatgaag

SEQ ID NO: 954049 - DNA, 25 bp, Mus musculus
ggtaccatcaaaaacgtggacagtg

SEQ ID NO: 954050 - DNA, 25 bp, Mus musculus
ggtaccatcaaaaaggtggacagtg

SEQ ID NO: 954051 - DNA, 25 bp, Mus musculus
ggtacccaggctgcaaatacctatt

SEQ ID NO: 954052 - DNA, 25 bp, Mus musculus
ggtacccagggtgcaaatacctatt

SEQ ID NO: 954053 - DNA, 25 bp, Mus musculus
ggtaccccaaaacagaatcgcacgt

SEQ ID NO: 954054 - DNA, 25 bp, Mus musculus
ggtaccccaaaagagaatcgcacgt

SEQ ID NO: 954055 - DNA, 25 bp, Mus musculus
ggtaccctggtgatcgagaaatgca

SEQ ID NO: 954056 - DNA, 25 bp, Mus musculus
ggtaccctggtgttcgagaaatgca

SEQ ID NO: 954057 - DNA, 25 bp, Mus musculus
ggtaccgcctctcgctcgatgagtc

SEQ ID NO: 954058 - DNA, 25 bp, Mus musculus
ggtaccgcctctggctcgatgagtc

SEQ ID NO: 954059 - DNA, 25 bp, Mus musculus
ggtacctgacagcggaactctgggc

SEQ ID NO: 954060 - DNA, 25 bp, Mus musculus
ggtacctgacaggggaactctgggc

SEQ ID NO: 954061 - DNA, 25 bp, Mus musculus
ggtacctgctggaacgagcagcggt

SEQ ID NO: 954062 - DNA, 25 bp, Mus musculus
ggtacctgctggaacgtgtgacccc

SEQ ID NO: 954063 - DNA, 25 bp, Mus musculus
ggtacctgctggaaggagcagcggt

SEQ ID NO: 954064 - DNA, 25 bp, Mus musculus
ggtacctgctggaaggtgtgacccc

SEQ ID NO: 954065 - DNA, 25 bp, Mus musculus
ggtacgaagcgccctttccgtcaga

SEQ ID NO: 954066 - DNA, 25 bp, Mus musculus
ggtacgaagcgcgctttccgtcaga

SEQ ID NO: 954067 - DNA, 25 bp, Mus musculus
ggtacgctgcgccaaattttcacct

SEQ ID NO: 954068 - DNA, 25 bp, Mus musculus
ggtacgctgcgccatattttcacct

SEQ ID NO: 954069 - DNA, 25 bp, Mus musculus
ggtactggcaagagagtgctaacag

SEQ ID NO: 954070 - DNA, 25 bp, Mus musculus
ggtactggcaagagtgtgctaacag

SEQ ID NO: 954071 - DNA, 25 bp, Mus musculus
ggtagaaaaaagatgacctcaatgc

SEQ ID NO: 954072 - DNA, 25 bp, Mus musculus
ggtagaaaaaagttgacctcaatgc

SEQ ID NO: 954073 - DNA, 25 bp, Mus musculus
ggtagaaggcaacgacctgagcaca

SEQ ID NO: 954074 - DNA, 25 bp, Mus musculus
ggtagaaggcaaggacctgagcaca

SEQ ID NO: 954075 - DNA, 25 bp, Mus musculus
ggtagactatgactccatcggccac

SEQ ID NO: 954076 - DNA, 25 bp, Mus musculus
ggtagactatgactgcatcggccac

SEQ ID NO: 954077 - DNA, 25 bp, Mus musculus
ggtagaggagaaatgtgcactgatg

SEQ ID NO: 954078 - DNA, 25 bp, Mus musculus
ggtagaggagtaatgtgcactgatg

SEQ ID NO: 954079 - DNA, 25 bp, Mus musculus
ggtagagtcacacaaatcactcaag

SEQ ID NO: 954080 - DNA, 25 bp, Mus musculus
ggtagagtcacagaaatcactcaag

SEQ ID NO: 954081 - DNA, 25 bp, Mus musculus
ggtagatttattaaccctctcagca

SEQ ID NO: 954082 - DNA, 25 bp, Mus musculus
ggtagatttattaagcctctcagca

SEQ ID NO: 954083 - DNA, 25 bp, Mus musculus
ggtagcaaagcgtgtggaatattat

SEQ ID NO: 954084 - DNA, 25 bp, Mus musculus
ggtagcaaagggtgtggaatattat

SEQ ID NO: 954085 - DNA, 25 bp, Mus musculus
ggtagcacagtacatctgttggaca

SEQ ID NO: 954086 - DNA, 25 bp, Mus musculus
ggtagcacagtagatctgttggaca

SEQ ID NO: 954087 - DNA, 25 bp, Mus musculus
ggtagccaagcttgaggcggccctg

SEQ ID NO: 954088 - DNA, 25 bp, Mus musculus
ggtagccaaggttgaggcggccctg

SEQ ID NO: 954089 - DNA, 25 bp, Mus musculus
ggtagcccagcccaccatggcagaa

SEQ ID NO: 954090 - DNA, 25 bp, Mus musculus
ggtagcccaggccaccatggcagaa

SEQ ID NO: 954091 - DNA, 25 bp, Mus musculus
ggtagcccccagctcaattcaccca

SEQ ID NO: 954092 - DNA, 25 bp, Mus musculus
ggtagcccccaggtcaattcaccca

SEQ ID NO: 954093 - DNA, 25 bp, Mus musculus
ggtagcggtgaacgctgttgctcag

SEQ ID NO: 954094 - DNA, 25 bp, Mus musculus
ggtagcggtgaatgtgggatccttt

SEQ ID NO: 954095 - DNA, 25 bp, Mus musculus
ggtagcggtgccttctctccgtgga

SEQ ID NO: 954096 - DNA, 25 bp, Mus musculus
ggtagcggtgcgtgtcaccgaaggc

SEQ ID NO: 954097 - DNA, 25 bp, Mus musculus
ggtagcggtggcttctctccgtgga

SEQ ID NO: 954098 - DNA, 25 bp, Mus musculus
ggtagcggtgggtgtcaccgaaggc

SEQ ID NO: 954099 - DNA, 25 bp, Mus musculus
ggtagcggtgtacgctgttgctcag

SEQ ID NO: 954100 - DNA, 25 bp, Mus musculus
ggtagcggtgtatgtgggatccttt

SEQ ID NO: 954101 - DNA, 25 bp, Mus musculus
ggtagctcagatctttggtttggac

SEQ ID NO: 954102 - DNA, 25 bp, Mus musculus
ggtagctcagttctttggtttggac

SEQ ID NO: 954103 - DNA, 25 bp, Mus musculus
ggtaggaagaagccattgctcctgt

SEQ ID NO: 954104 - DNA, 25 bp, Mus musculus
ggtaggaagaaggcattgctcctgt

SEQ ID NO: 954105 - DNA, 25 bp, Mus musculus
ggtaggaagtgcagatatagatgag

SEQ ID NO: 954106 - DNA, 25 bp, Mus musculus
ggtaggaagtgctgatatagatgag

SEQ ID NO: 954107 - DNA, 25 bp, Mus musculus
ggtaggcaaagacggacaactgatg

SEQ ID NO: 954108 - DNA, 25 bp, Mus musculus
ggtaggcaaagagggacaactgatg

SEQ ID NO: 954109 - DNA, 25 bp, Mus musculus
ggtagtgatcagcagaataatgttt

SEQ ID NO: 954110 - DNA, 25 bp, Mus musculus
ggtagtgatcaggagaataatgttt

SEQ ID NO: 954111 - DNA, 25 bp, Mus musculus
ggtataacgccgatatttctacctt

SEQ ID NO: 954112 - DNA, 25 bp, Mus musculus
ggtataacgccgttatttctacctt

SEQ ID NO: 954113 - DNA, 25 bp, Mus musculus
ggtataccccacaagccaagcgtcc

SEQ ID NO: 954114 - DNA, 25 bp, Mus musculus
ggtataccccactagccaagcgtcc

SEQ ID NO: 954115 - DNA, 25 bp, Mus musculus
ggtataggaagcagcctgatgcagt

SEQ ID NO: 954116 - DNA, 25 bp, Mus musculus
ggtataggaagctgcctgatgcagt

SEQ ID NO: 954117 - DNA, 25 bp, Mus musculus
ggtatatggatgctcatctttggtg

SEQ ID NO: 954118 - DNA, 25 bp, Mus musculus
ggtatatggatggtcatctttggtg

SEQ ID NO: 954119 - DNA, 25 bp, Mus musculus
ggtatattcaagcttggatggagta

SEQ ID NO: 954120 - DNA, 25 bp, Mus musculus
ggtatattcaaggttggatggagta

SEQ ID NO: 954121 - DNA, 25 bp, Mus musculus
ggtatcactgagagaggcagctgtg

SEQ ID NO: 954122 - DNA, 25 bp, Mus musculus
ggtatcactgtgagaggcagctgtg

SEQ ID NO: 954123 - DNA, 25 bp, Mus musculus
ggtatcattactcaaaatctttgga

SEQ ID NO: 954124 - DNA, 25 bp, Mus musculus
ggtatcattactgaaaatctttgga

SEQ ID NO: 954125 - DNA, 25 bp, Mus musculus
ggtatccatgcgcctgtgtggagat

SEQ ID NO: 954126 - DNA, 25 bp, Mus musculus
ggtatccatgcggctgtgtggagat

SEQ ID NO: 954127 - DNA, 25 bp, Mus musculus
ggtatcggattcacaaataaagtgg

SEQ ID NO: 954128 - DNA, 25 bp, Mus musculus
ggtatcggattcactaataaagtgg

SEQ ID NO: 954129 - DNA, 25 bp, Mus musculus
ggtatgagtgccccaggatgggtga

SEQ ID NO: 954130 - DNA, 25 bp, Mus musculus
ggtatgagtggcccaggatgggtga

SEQ ID NO: 954131 - DNA, 25 bp, Mus musculus
ggtatgccagcttatccagtcttgg

SEQ ID NO: 954132 - DNA, 25 bp, Mus musculus
ggtatgccaggttatccagtcttgg

SEQ ID NO: 954133 - DNA, 25 bp, Mus musculus
ggtattcatgcacgtccacgcctca

SEQ ID NO: 954134 - DNA, 25 bp, Mus musculus
ggtattcatgcaggtccacgcctca

SEQ ID NO: 954135 - DNA, 25 bp, Mus musculus
ggtattcctcagcttatggctatta

SEQ ID NO: 954136 - DNA, 25 bp, Mus musculus
ggtattcctcaggttatggctatta

SEQ ID NO: 954137 - DNA, 25 bp, Mus musculus
ggtattcttcggatcatatcaacaa

SEQ ID NO: 954138 - DNA, 25 bp, Mus musculus
ggtattcttcggatgatatcaacaa

SEQ ID NO: 954139 - DNA, 25 bp, Mus musculus
ggtattgctgcacggagtgtcaagt

SEQ ID NO: 954140 - DNA, 25 bp, Mus musculus
ggtattgctgcagggagtgtcaagt

SEQ ID NO: 954141 - DNA, 25 bp, Mus musculus
ggtatttgagagctagtgatttaat

SEQ ID NO: 954142 - DNA, 25 bp, Mus musculus
ggtatttgagaggtagtgatttaat

SEQ ID NO: 954143 - DNA, 25 bp, Mus musculus
ggtatttggagacacaaaagccacc

SEQ ID NO: 954144 - DNA, 25 bp, Mus musculus
ggtatttggagacagaaaagccacc

SEQ ID NO: 954145 - DNA, 25 bp, Mus musculus
ggtatttttttgaacattggacctg

SEQ ID NO: 954146 - DNA, 25 bp, Mus musculus
ggtatttttttgaagattggacctg

SEQ ID NO: 954147 - DNA, 25 bp, Mus musculus
ggtcaaaacctgaacgaactgagag

SEQ ID NO: 954148 - DNA, 25 bp, Mus musculus
ggtcaaaacctgaaggaactgagag

SEQ ID NO: 954149 - DNA, 25 bp, Mus musculus
ggtcaaagaccccaagaggaggatg

SEQ ID NO: 954150 - DNA, 25 bp, Mus musculus
ggtcaaagaccccatgaggaggatg

SEQ ID NO: 954151 - DNA, 25 bp, Mus musculus
ggtcaaagagaacgaagctatagtg

SEQ ID NO: 954152 - DNA, 25 bp, Mus musculus
ggtcaaagagaaggaagctatagtg

SEQ ID NO: 954153 - DNA, 25 bp, Mus musculus
ggtcaacaagctggctggaaacttc

SEQ ID NO: 954154 - DNA, 25 bp, Mus musculus
ggtcaacaagcttggacttttcaca

SEQ ID NO: 954155 - DNA, 25 bp, Mus musculus
ggtcaacaaggtggctggaaacttc

SEQ ID NO: 954156 - DNA, 25 bp, Mus musculus
ggtcaacaaggttggacttttcaca

SEQ ID NO: 954157 - DNA, 25 bp, Mus musculus
ggtcaacacaaaacacagatactga

SEQ ID NO: 954158 - DNA, 25 bp, Mus musculus
ggtcaacacataacacagatactga

SEQ ID NO: 954159 - DNA, 25 bp, Mus musculus
ggtcaaccagcgaaaatgccaagtg

SEQ ID NO: 954160 - DNA, 25 bp, Mus musculus
ggtcaaccagggaaaatgccaagtg

SEQ ID NO: 954161 - DNA, 25 bp, Mus musculus
ggtcaacttacacataccatggcaa

SEQ ID NO: 954162 - DNA, 25 bp, Mus musculus
ggtcaacttacagataccatggcaa

SEQ ID NO: 954163 - DNA, 25 bp, Mus musculus
ggtcaagaacagcatgggtacacaa

SEQ ID NO: 954164 - DNA, 25 bp, Mus musculus
ggtcaagaacaggatgggtacacaa

SEQ ID NO: 954165 - DNA, 25 bp, Mus musculus
ggtcaagaaccgcctcctgtccaaa

SEQ ID NO: 954166 - DNA, 25 bp, Mus musculus
ggtcaagaaccggctcctgtccaaa

SEQ ID NO: 954167 - DNA, 25 bp, Mus musculus
ggtcaagatccgcaacgtcacttcc

SEQ ID NO: 954168 - DNA, 25 bp, Mus musculus
ggtcaagatccggaacgtcacttcc

SEQ ID NO: 954169 - DNA, 25 bp, Mus musculus
ggtcaagcagaaccaacagaaagct

SEQ ID NO: 954170 - DNA, 25 bp, Mus musculus
ggtcaagcagaagcaacagaaagct

SEQ ID NO: 954171 - DNA, 25 bp, Mus musculus
ggtcaaggaaatcgtggctgcgttg

SEQ ID NO: 954172 - DNA, 25 bp, Mus musculus
ggtcaaggaaatggtggctgcgttg

SEQ ID NO: 954173 - DNA, 25 bp, Mus musculus
ggtcaaggcaccaatgaggaaacaa

SEQ ID NO: 954174 - DNA, 25 bp, Mus musculus
ggtcaaggcagcaatgaggaaacaa

SEQ ID NO: 954175 - DNA, 25 bp, Mus musculus
ggtcaaggcgcagccagatgttaaa

SEQ ID NO: 954176 - DNA, 25 bp, Mus musculus
ggtcaaggcggagccagatgttaaa

SEQ ID NO: 954177 - DNA, 25 bp, Mus musculus
ggtcaataagcctgtggctctggat

SEQ ID NO: 954178 - DNA, 25 bp, Mus musculus
ggtcaataaggctgtggctctggat

SEQ ID NO: 954179 - DNA, 25 bp, Mus musculus
ggtcaatcatttctatgtttgaccg

SEQ ID NO: 954180 - DNA, 25 bp, Mus musculus
ggtcaatcatttgtatgtttgaccg

SEQ ID NO: 954181 - DNA, 25 bp, Mus musculus
ggtcaatgagaaacctttgaaggac

SEQ ID NO: 954182 - DNA, 25 bp, Mus musculus
ggtcaatgagtaacctttgaaggac

SEQ ID NO: 954183 - DNA, 25 bp, Mus musculus
ggtcaatgggaactcattcagctgg

SEQ ID NO: 954184 - DNA, 25 bp, Mus musculus
ggtcaatgggaagtcattcagctgg

SEQ ID NO: 954185 - DNA, 25 bp, Mus musculus
ggtcacacaaagaaacaggtatgtg

SEQ ID NO: 954186 - DNA, 25 bp, Mus musculus
ggtcacacaaagctatgtgatgata

SEQ ID NO: 954187 - DNA, 25 bp, Mus musculus
ggtcacacaaaggtatgtgatgata

SEQ ID NO: 954188 - DNA, 25 bp, Mus musculus
ggtcacacaaagtaacaggtatgtg

SEQ ID NO: 954189 - DNA, 25 bp, Mus musculus
ggtcacacagatacttgttgccttg

SEQ ID NO: 954190 - DNA, 25 bp, Mus musculus
ggtcacacagttacttgttgccttg

SEQ ID NO: 954191 - DNA, 25 bp, Mus musculus
ggtcacagagatctttcagaaaccc

SEQ ID NO: 954192 - DNA, 25 bp, Mus musculus
ggtcacagagttctttcagaaaccc

SEQ ID NO: 954193 - DNA, 25 bp, Mus musculus
ggtcacatagcgccgaggccgttca

SEQ ID NO: 954194 - DNA, 25 bp, Mus musculus
ggtcacatagggccgaggccgttca

SEQ ID NO: 954195 - DNA, 25 bp, Mus musculus
ggtcaccgggaaaacacctattcag

SEQ ID NO: 954196 - DNA, 25 bp, Mus musculus
ggtcaccgggaaaagacctattcag

SEQ ID NO: 954197 - DNA, 25 bp, Mus musculus
ggtcacctatgacaatgatgtcaga

SEQ ID NO: 954198 - DNA, 25 bp, Mus musculus
ggtcacctatgagaatgatgtcaga

SEQ ID NO: 954199 - DNA, 25 bp, Mus musculus
ggtcacctgcagatactttatgcat

SEQ ID NO: 954200 - DNA, 25 bp, Mus musculus
ggtcacctgcagctattttatgcat

SEQ ID NO: 954201 - DNA, 25 bp, Mus musculus
ggtcacctgcaggtattttatgcat

SEQ ID NO: 954202 - DNA, 25 bp, Mus musculus
ggtcacctgcagttactttatgcat

SEQ ID NO: 954203 - DNA, 25 bp, Mus musculus
ggtcacctttgacgtgaagtcagag

SEQ ID NO: 954204 - DNA, 25 bp, Mus musculus
ggtcacctttgaggtgaagtcagag

SEQ ID NO: 954205 - DNA, 25 bp, Mus musculus
ggtcactatgagtgaaacatctttc

SEQ ID NO: 954206 - DNA, 25 bp, Mus musculus
ggtcactatgctgataaagttacaa

SEQ ID NO: 954207 - DNA, 25 bp, Mus musculus
ggtcactatggtgataaagttacaa

SEQ ID NO: 954208 - DNA, 25 bp, Mus musculus
ggtcactatgtgtgaaacatctttc

SEQ ID NO: 954209 - DNA, 25 bp, Mus musculus
ggtcactgaacacgttgctccagga

SEQ ID NO: 954210 - DNA, 25 bp, Mus musculus
ggtcactgaacaggttgctccagga

SEQ ID NO: 954211 - DNA, 25 bp, Mus musculus
ggtcactgtgactccagctccgtcc

SEQ ID NO: 954212 - DNA, 25 bp, Mus musculus
ggtcactgtgcacctcattctcttt

SEQ ID NO: 954213 - DNA, 25 bp, Mus musculus
ggtcactgtgcacttccgctcgctg

SEQ ID NO: 954214 - DNA, 25 bp, Mus musculus
ggtcactgtgcagctcattctcttt

SEQ ID NO: 954215 - DNA, 25 bp, Mus musculus
ggtcactgtgcagttccgctcgctg

SEQ ID NO: 954216 - DNA, 25 bp, Mus musculus
ggtcactgtgtctccagctccgtcc

SEQ ID NO: 954217 - DNA, 25 bp, Mus musculus
ggtcacttcaacacacacagcttga

SEQ ID NO: 954218 - DNA, 25 bp, Mus musculus
ggtcacttcatcacacacagcttga

SEQ ID NO: 954219 - DNA, 25 bp, Mus musculus
ggtcacttgggcatcatccagagca

SEQ ID NO: 954220 - DNA, 25 bp, Mus musculus
ggtcacttgggcatcctttggtggc

SEQ ID NO: 954221 - DNA, 25 bp, Mus musculus
ggtcacttgggcatgatccagagca

SEQ ID NO: 954222 - DNA, 25 bp, Mus musculus
ggtcacttgggcatgctttggtggc

SEQ ID NO: 954223 - DNA, 25 bp, Mus musculus
ggtcacttttgaaacagtggagcag

SEQ ID NO: 954224 - DNA, 25 bp, Mus musculus
ggtcacttttgaaagagtggagcag

SEQ ID NO: 954225 - DNA, 25 bp, Mus musculus
ggtcagattgaacgtcagatgtacc

SEQ ID NO: 954226 - DNA, 25 bp, Mus musculus
ggtcagattgaaggtcagatgtacc

SEQ ID NO: 954227 - DNA, 25 bp, Mus musculus
ggtcagcaagaatgcctttgtgtgc

SEQ ID NO: 954228 - DNA, 25 bp, Mus musculus
ggtcagcaagtatgcctttgtgtgc

SEQ ID NO: 954229 - DNA, 25 bp, Mus musculus
ggtcagccaaatagaggatgccatg

SEQ ID NO: 954230 - DNA, 25 bp, Mus musculus
ggtcagccaaatcgtgttgtgtgaa

SEQ ID NO: 954231 - DNA, 25 bp, Mus musculus
ggtcagccaaatctctttctgtaac

SEQ ID NO: 954232 - DNA, 25 bp, Mus musculus
ggtcagccaaatggtgttgtgtgaa

SEQ ID NO: 954233 - DNA, 25 bp, Mus musculus
ggtcagccaaatgtctttctgtaac

SEQ ID NO: 954234 - DNA, 25 bp, Mus musculus
ggtcagccaaattgaggatgccatg

SEQ ID NO: 954235 - DNA, 25 bp, Mus musculus
ggtcagccagagccaagctgtggat

SEQ ID NO: 954236 - DNA, 25 bp, Mus musculus
ggtcagccagtgccaagctgtggat

SEQ ID NO: 954237 - DNA, 25 bp, Mus musculus
ggtcagcgagctattgaagcccctg

SEQ ID NO: 954238 - DNA, 25 bp, Mus musculus
ggtcagcgaggtattgaagcccctg

SEQ ID NO: 954239 - DNA, 25 bp, Mus musculus
ggtcaggatccccacgctgcccttg

SEQ ID NO: 954240 - DNA, 25 bp, Mus musculus
ggtcaggatccccaggctgcccttg

SEQ ID NO: 954241 - DNA, 25 bp, Mus musculus
ggtcaggatggccactcgtggggcc

SEQ ID NO: 954242 - DNA, 25 bp, Mus musculus
ggtcaggatggccagtcgtggggcc

SEQ ID NO: 954243 - DNA, 25 bp, Mus musculus
ggtcaggggattgaatatgagaaga

SEQ ID NO: 954244 - DNA, 25 bp, Mus musculus
ggtcaggggattgattatgagaaga

SEQ ID NO: 954245 - DNA, 25 bp, Mus musculus
ggtcaggtgcaaaatggaacactgt

SEQ ID NO: 954246 - DNA, 25 bp, Mus musculus
ggtcaggtgcaactgcagaatggaa

SEQ ID NO: 954247 - DNA, 25 bp, Mus musculus
ggtcaggtgcaagtgcagaatggaa

SEQ ID NO: 954248 - DNA, 25 bp, Mus musculus
ggtcaggtgcaatatggaacactgt

SEQ ID NO: 954249 - DNA, 25 bp, Mus musculus
ggtcagtcctggcctgggccgtcgg

SEQ ID NO: 954250 - DNA, 25 bp, Mus musculus
ggtcagtcctgggctgggccgtcgg

SEQ ID NO: 954251 - DNA, 25 bp, Mus musculus
ggtcagtttatcaaagtcatgtagg

SEQ ID NO: 954252 - DNA, 25 bp, Mus musculus
ggtcagtttatcaatgtcatgtagg

SEQ ID NO: 954253 - DNA, 25 bp, Mus musculus
ggtcataagttgccatatgtctgga

SEQ ID NO: 954254 - DNA, 25 bp, Mus musculus
ggtcataagttggcatatgtctgga

SEQ ID NO: 954255 - DNA, 25 bp, Mus musculus
ggtcatcaagcgtcacagtaaatcc

SEQ ID NO: 954256 - DNA, 25 bp, Mus musculus
ggtcatcaagggtcacagtaaatcc

SEQ ID NO: 954257 - DNA, 25 bp, Mus musculus
ggtcatcagcaaccccctgcctggc

SEQ ID NO: 954258 - DNA, 25 bp, Mus musculus
ggtcatcagcaagcccctgcctggc

SEQ ID NO: 954259 - DNA, 25 bp, Mus musculus
ggtcatcgacggccacaacgacttg

SEQ ID NO: 954260 - DNA, 25 bp, Mus musculus
ggtcatcgacgggcacaacgacttg

SEQ ID NO: 954261 - DNA, 25 bp, Mus musculus
ggtcatcgagctcctcagtcaggag

SEQ ID NO: 954262 - DNA, 25 bp, Mus musculus
ggtcatcgaggtcctcagtcaggag

SEQ ID NO: 954263 - DNA, 25 bp, Mus musculus
ggtcatcggcaacctaatccagtgc

SEQ ID NO: 954264 - DNA, 25 bp, Mus musculus
ggtcatcggcaagctaatccagtgc

SEQ ID NO: 954265 - DNA, 25 bp, Mus musculus
ggtcatcggtaaatcgcaccggcac

SEQ ID NO: 954266 - DNA, 25 bp, Mus musculus
ggtcatcggtaattcgcaccggcac

SEQ ID NO: 954267 - DNA, 25 bp, Mus musculus
ggtcatctgtaccccgttcatcagc

SEQ ID NO: 954268 - DNA, 25 bp, Mus musculus
ggtcatctgtacccggttcatcagc

SEQ ID NO: 954269 - DNA, 25 bp, Mus musculus
ggtcatgaagaagcagaattctaaa

SEQ ID NO: 954270 - DNA, 25 bp, Mus musculus
ggtcatgaagacatgtttaaaaagg

SEQ ID NO: 954271 - DNA, 25 bp, Mus musculus
ggtcatgaagtagcagaattctaaa

SEQ ID NO: 954272 - DNA, 25 bp, Mus musculus
ggtcatgaagtcatgtttaaaaagg

SEQ ID NO: 954273 - DNA, 25 bp, Mus musculus
ggtcatgcccttgacatccagaaga

SEQ ID NO: 954274 - DNA, 25 bp, Mus musculus
ggtcatgcccttgagatccagaaga

SEQ ID NO: 954275 - DNA, 25 bp, Mus musculus
ggtcatggaaatatgggcttaggtc

SEQ ID NO: 954276 - DNA, 25 bp, Mus musculus
ggtcatggaaatttgggcttaggtc

SEQ ID NO: 954277 - DNA, 25 bp, Mus musculus
ggtcatggacgtattaaagcctctg

SEQ ID NO: 954278 - DNA, 25 bp, Mus musculus
ggtcatggacgttttaaagcctctg

SEQ ID NO: 954279 - DNA, 25 bp, Mus musculus
ggtccaagaggaaacacaaagtcag

SEQ ID NO: 954280 - DNA, 25 bp, Mus musculus
ggtccaagaggaaacacagctacaa

SEQ ID NO: 954281 - DNA, 25 bp, Mus musculus
ggtccaagaggaaacgtaccagcag

SEQ ID NO: 954282 - DNA, 25 bp, Mus musculus
ggtccaagaggaaagacaaagtcag

SEQ ID NO: 954283 - DNA, 25 bp, Mus musculus
ggtccaagaggaaagacagctacaa

SEQ ID NO: 954284 - DNA, 25 bp, Mus musculus
ggtccaagaggaaaggtaccagcag

SEQ ID NO: 954285 - DNA, 25 bp, Mus musculus
ggtccaagctgtaacgtgctcgtcc

SEQ ID NO: 954286 - DNA, 25 bp, Mus musculus
ggtccaagctgtaaggtgctcgtcc

SEQ ID NO: 954287 - DNA, 25 bp, Mus musculus
ggtccaatgtggcaacatcagttat

SEQ ID NO: 954288 - DNA, 25 bp, Mus musculus
ggtccaatgtgggaacatcagttat

SEQ ID NO: 954289 - DNA, 25 bp, Mus musculus
ggtccacagcagcattccccctctg

SEQ ID NO: 954290 - DNA, 25 bp, Mus musculus
ggtccacagcaggattccccctctg

SEQ ID NO: 954291 - DNA, 25 bp, Mus musculus
ggtccagactgcatccctctgaggg

SEQ ID NO: 954292 - DNA, 25 bp, Mus musculus
ggtccagactgcatcgaactacatg

SEQ ID NO: 954293 - DNA, 25 bp, Mus musculus
ggtccagactgcatcggtagcctct

SEQ ID NO: 954294 - DNA, 25 bp, Mus musculus
ggtccagactgcatgcctctgaggg

SEQ ID NO: 954295 - DNA, 25 bp, Mus musculus
ggtccagactgcatggaactacatg

SEQ ID NO: 954296 - DNA, 25 bp, Mus musculus
ggtccagactgcatgggtagcctct

SEQ ID NO: 954297 - DNA, 25 bp, Mus musculus
ggtccagcagatcaaagaggaaatc

SEQ ID NO: 954298 - DNA, 25 bp, Mus musculus
ggtccagcagttcaaagaggaaatc

SEQ ID NO: 954299 - DNA, 25 bp, Mus musculus
ggtccagctttaatcccaccaccac

SEQ ID NO: 954300 - DNA, 25 bp, Mus musculus
ggtccagctttaatgccaccaccac

SEQ ID NO: 954301 - DNA, 25 bp, Mus musculus
ggtccaggagattgtgccttctgaa

SEQ ID NO: 954302 - DNA, 25 bp, Mus musculus
ggtccaggagtttgtgccttctgaa

SEQ ID NO: 954303 - DNA, 25 bp, Mus musculus
ggtcccagctggcgtcggagcttcc

SEQ ID NO: 954304 - DNA, 25 bp, Mus musculus
ggtcccagctggggtcggagcttcc

SEQ ID NO: 954305 - DNA, 25 bp, Mus musculus
ggtcccagcttcaacggtacacggt

SEQ ID NO: 954306 - DNA, 25 bp, Mus musculus
ggtcccagcttcaagggtacacggt

SEQ ID NO: 954307 - DNA, 25 bp, Mus musculus
ggtcccaggcaaccctggaagagtt

SEQ ID NO: 954308 - DNA, 25 bp, Mus musculus
ggtcccaggcaacggcagtgtatgg

SEQ ID NO: 954309 - DNA, 25 bp, Mus musculus
ggtcccaggcaagcctggaagagtt

SEQ ID NO: 954310 - DNA, 25 bp, Mus musculus
ggtcccaggcaagggcagtgtatgg

SEQ ID NO: 954311 - DNA, 25 bp, Mus musculus
ggtcccattgctctactgaggaact

SEQ ID NO: 954312 - DNA, 25 bp, Mus musculus
ggtcccattggtctactgaggaact

SEQ ID NO: 954313 - DNA, 25 bp, Mus musculus
ggtcccatttcacgtgctggtggca

SEQ ID NO: 954314 - DNA, 25 bp, Mus musculus
ggtcccatttcaggtgctggtggca

SEQ ID NO: 954315 - DNA, 25 bp, Mus musculus
ggtcccgaagcagctatgatgacca

SEQ ID NO: 954316 - DNA, 25 bp, Mus musculus
ggtcccgaagctatgatgaccattc

SEQ ID NO: 954317 - DNA, 25 bp, Mus musculus
ggtcccgaaggagctatgatgacca

SEQ ID NO: 954318 - DNA, 25 bp, Mus musculus
ggtcccgaaggtatgatgaccattc

SEQ ID NO: 954319 - DNA, 25 bp, Mus musculus
ggtcccgagaaacattccagagtca

SEQ ID NO: 954320 - DNA, 25 bp, Mus musculus
ggtcccgagaaagattccagagtca

SEQ ID NO: 954321 - DNA, 25 bp, Mus musculus
ggtcccgagcagctcaatgaccctg

SEQ ID NO: 954322 - DNA, 25 bp, Mus musculus
ggtcccgagcaggtcaatgaccctg

SEQ ID NO: 954323 - DNA, 25 bp, Mus musculus
ggtcccgagccagacgagtactttt

SEQ ID NO: 954324 - DNA, 25 bp, Mus musculus
ggtcccgagccagaggagtactttt

SEQ ID NO: 954325 - DNA, 25 bp, Mus musculus
ggtccctctgtgcccaacatctcat

SEQ ID NO: 954326 - DNA, 25 bp, Mus musculus
ggtccctctgtgccgaacatctcat

SEQ ID NO: 954327 - DNA, 25 bp, Mus musculus
ggtcccttaactgaagtgccggtga

SEQ ID NO: 954328 - DNA, 25 bp, Mus musculus
ggtcccttaactgatgtgccggtga

SEQ ID NO: 954329 - DNA, 25 bp, Mus musculus
ggtccgagaggaaccgcgcgagaac

SEQ ID NO: 954330 - DNA, 25 bp, Mus musculus
ggtccgagaggaacggcgcgagaac

SEQ ID NO: 954331 - DNA, 25 bp, Mus musculus
ggtccgcaaaggcatgccattccgc

SEQ ID NO: 954332 - DNA, 25 bp, Mus musculus
ggtccgcaaagggatgccattccgc

SEQ ID NO: 954333 - DNA, 25 bp, Mus musculus
ggtccgccagatcttcattcacaag

SEQ ID NO: 954334 - DNA, 25 bp, Mus musculus
ggtccgccagttcttcattcacaag

SEQ ID NO: 954335 - DNA, 25 bp, Mus musculus
ggtccggagttcctgcctccggagc

SEQ ID NO: 954336 - DNA, 25 bp, Mus musculus
ggtccggagttcgtgcctccggagc

SEQ ID NO: 954337 - DNA, 25 bp, Mus musculus
ggtccggatgcacatatttccgtga

SEQ ID NO: 954338 - DNA, 25 bp, Mus musculus
ggtccggatgcagatatttccgtga

SEQ ID NO: 954339 - DNA, 25 bp, Mus musculus
ggtccgtcagatgacccctaggacc

SEQ ID NO: 954340 - DNA, 25 bp, Mus musculus
ggtccgtcagatgagccctaggacc

SEQ ID NO: 954341 - DNA, 25 bp, Mus musculus
ggtcctcaatgtcgcggacatcggg

SEQ ID NO: 954342 - DNA, 25 bp, Mus musculus
ggtcctcaatgtcggggacatcggg

SEQ ID NO: 954343 - DNA, 25 bp, Mus musculus
ggtcctccagatcatggagctttgt

SEQ ID NO: 954344 - DNA, 25 bp, Mus musculus
ggtcctccagcgctctttcaccgtg

SEQ ID NO: 954345 - DNA, 25 bp, Mus musculus
ggtcctccagggctctttcaccgtg

SEQ ID NO: 954346 - DNA, 25 bp, Mus musculus
ggtcctccagttcatggagctttgt

SEQ ID NO: 954347 - DNA, 25 bp, Mus musculus
ggtcctctctgctgcgggcagctca

SEQ ID NO: 954348 - DNA, 25 bp, Mus musculus
ggtcctctctgctgggggcagctca

SEQ ID NO: 954349 - DNA, 25 bp, Mus musculus
ggtcctgaagcactcggggataaat

SEQ ID NO: 954350 - DNA, 25 bp, Mus musculus
ggtcctgaaggactcggggataaat

SEQ ID NO: 954351 - DNA, 25 bp, Mus musculus
ggtcctgacagctgcgatctccatc

SEQ ID NO: 954352 - DNA, 25 bp, Mus musculus
ggtcctgacagctgggatctccatc

SEQ ID NO: 954353 - DNA, 25 bp, Mus musculus
ggtcctgcaaggacctggatgagtg

SEQ ID NO: 954354 - DNA, 25 bp, Mus musculus
ggtcctgcaaggtcctggatgagtg

SEQ ID NO: 954355 - DNA, 25 bp, Mus musculus
ggtcctgctcaactgccctatcgtg

SEQ ID NO: 954356 - DNA, 25 bp, Mus musculus
ggtcctgctcaagtgccctatcgtg

SEQ ID NO: 954357 - DNA, 25 bp, Mus musculus
ggtcctggcctgctgtgcatcggcc

SEQ ID NO: 954358 - DNA, 25 bp, Mus musculus
ggtcctggcctggtgtgcatcggcc

SEQ ID NO: 954359 - DNA, 25 bp, Mus musculus
ggtcctgtttaacagttcagatgcc

SEQ ID NO: 954360 - DNA, 25 bp, Mus musculus
ggtcctgtttaaccatcagcagtgt

SEQ ID NO: 954361 - DNA, 25 bp, Mus musculus
ggtcctgtttaagagttcagatgcc

SEQ ID NO: 954362 - DNA, 25 bp, Mus musculus
ggtcctgtttaagcatcagcagtgt

SEQ ID NO: 954363 - DNA, 25 bp, Mus musculus
ggtccttcagcgcttgtaccagctg

SEQ ID NO: 954364 - DNA, 25 bp, Mus musculus
ggtccttcagggcttgtaccagctg

SEQ ID NO: 954365 - DNA, 25 bp, Mus musculus
ggtcctttgacgacatcgctgaagg

SEQ ID NO: 954366 - DNA, 25 bp, Mus musculus
ggtcctttgacgtcatcgctgaagg

SEQ ID NO: 954367 - DNA, 25 bp, Mus musculus
ggtccttttaaacgctgcttccatg

SEQ ID NO: 954368 - DNA, 25 bp, Mus musculus
ggtccttttaaaggctgcttccatg

SEQ ID NO: 954369 - DNA, 25 bp, Mus musculus
ggtcgaagcgctcgctcatcgtggg

SEQ ID NO: 954370 - DNA, 25 bp, Mus musculus
ggtcgaagcgctggctcatcgtggg

SEQ ID NO: 954371 - DNA, 25 bp, Mus musculus
ggtcgagaccctctaccactccctc

SEQ ID NO: 954372 - DNA, 25 bp, Mus musculus
ggtcgagaccctgtaccactccctc

SEQ ID NO: 954373 - DNA, 25 bp, Mus musculus
ggtcgagagattcataatcatgatg

SEQ ID NO: 954374 - DNA, 25 bp, Mus musculus
ggtcgagagattgataatcatgatg

SEQ ID NO: 954375 - DNA, 25 bp, Mus musculus
ggtcgagtgacccgaatctgtgggc

SEQ ID NO: 954376 - DNA, 25 bp, Mus musculus
ggtcgagtgaccggaatctgtgggc

SEQ ID NO: 954377 - DNA, 25 bp, Mus musculus
ggtcgatatcagctgtcctggagcc

SEQ ID NO: 954378 - DNA, 25 bp, Mus musculus
ggtcgatatcaggtgtcctggagcc

SEQ ID NO: 954379 - DNA, 25 bp, Mus musculus
ggtcgatgtgcgcccagacccttcc

SEQ ID NO: 954380 - DNA, 25 bp, Mus musculus
ggtcgatgtgggcccagacccttcc

SEQ ID NO: 954381 - DNA, 25 bp, Mus musculus
ggtcgccctcggcttccagcagaag

SEQ ID NO: 954382 - DNA, 25 bp, Mus musculus
ggtcgccctcgggttccagcagaag

SEQ ID NO: 954383 - DNA, 25 bp, Mus musculus
ggtcgcggtcaatgctcagcaagat

SEQ ID NO: 954384 - DNA, 25 bp, Mus musculus
ggtcgcggtcaatggtcagcaagat

SEQ ID NO: 954385 - DNA, 25 bp, Mus musculus
ggtcgctcagcacatcagcaacttc

SEQ ID NO: 954386 - DNA, 25 bp, Mus musculus
ggtcgctcagccttgcagatgggtc

SEQ ID NO: 954387 - DNA, 25 bp, Mus musculus
ggtcgctcaggacatcagcaacttc

SEQ ID NO: 954388 - DNA, 25 bp, Mus musculus
ggtcgctcaggcttgcagatgggtc

SEQ ID NO: 954389 - DNA, 25 bp, Mus musculus
ggtcgctcggagatcgcttttgtgg

SEQ ID NO: 954390 - DNA, 25 bp, Mus musculus
ggtcgctcggagatcgtatacttga

SEQ ID NO: 954391 - DNA, 25 bp, Mus musculus
ggtcgctcggagatggcttttgtgg

SEQ ID NO: 954392 - DNA, 25 bp, Mus musculus
ggtcgctcggagatggtatacttga

SEQ ID NO: 954393 - DNA, 25 bp, Mus musculus
ggtcggaagaattaggcccgcagaa

SEQ ID NO: 954394 - DNA, 25 bp, Mus musculus
ggtcggaagatttaggcccgcagaa

SEQ ID NO: 954395 - DNA, 25 bp, Mus musculus
ggtcggacaacctctactccaggga

SEQ ID NO: 954396 - DNA, 25 bp, Mus musculus
ggtcggacaacgaaacacagagaga

SEQ ID NO: 954397 - DNA, 25 bp, Mus musculus
ggtcggacaagctctactccaggga

SEQ ID NO: 954398 - DNA, 25 bp, Mus musculus
ggtcggacaaggaaacacagagaga

SEQ ID NO: 954399 - DNA, 25 bp, Mus musculus
ggtcggaggagtcgtgtggaaggca

SEQ ID NO: 954400 - DNA, 25 bp, Mus musculus
ggtcggaggagtggtgtggaaggca

SEQ ID NO: 954401 - DNA, 25 bp, Mus musculus
ggtcggatggaaaaccacctggatg

SEQ ID NO: 954402 - DNA, 25 bp, Mus musculus
ggtcggatggaaaagcacctggatg

SEQ ID NO: 954403 - DNA, 25 bp, Mus musculus
ggtcggccagctggttgcattttgt

SEQ ID NO: 954404 - DNA, 25 bp, Mus musculus
ggtcggccaggtggttgcattttgt

SEQ ID NO: 954405 - DNA, 25 bp, Mus musculus
ggtcggctttgcaacgatggagtca

SEQ ID NO: 954406 - DNA, 25 bp, Mus musculus
ggtcggctttgcaaggatggagtca

SEQ ID NO: 954407 - DNA, 25 bp, Mus musculus
ggtcgggtggctgtttgcagacaaa

SEQ ID NO: 954408 - DNA, 25 bp, Mus musculus
ggtcgggtgggtgtttgcagacaaa

SEQ ID NO: 954409 - DNA, 25 bp, Mus musculus
ggtcgtggactgatgcacagatcca

SEQ ID NO: 954410 - DNA, 25 bp, Mus musculus
ggtcgtggactgttgcacagatcca

SEQ ID NO: 954411 - DNA, 25 bp, Mus musculus
ggtcgtgttaaacccatcttcggag

SEQ ID NO: 954412 - DNA, 25 bp, Mus musculus
ggtcgtgttaaaccgatcttcggag

SEQ ID NO: 954413 - DNA, 25 bp, Mus musculus
ggtctaaagaatcagaagtactccc

SEQ ID NO: 954414 - DNA, 25 bp, Mus musculus
ggtctaaagattcagaagtactccc

SEQ ID NO: 954415 - DNA, 25 bp, Mus musculus
ggtctaccacagagaaaggcccgct

SEQ ID NO: 954416 - DNA, 25 bp, Mus musculus
ggtctaccacagtgaaaggcccgct

SEQ ID NO: 954417 - DNA, 25 bp, Mus musculus
ggtctatgagctaattatagatatt

SEQ ID NO: 954418 - DNA, 25 bp, Mus musculus
ggtctatgaggtaattatagatatt

SEQ ID NO: 954419 - DNA, 25 bp, Mus musculus
ggtctcaactgccacaaccttgtgc

SEQ ID NO: 954420 - DNA, 25 bp, Mus musculus
ggtctcaactgccagaaccttgtgc

SEQ ID NO: 954421 - DNA, 25 bp, Mus musculus
ggtctcacgcgacacgaagacagct

SEQ ID NO: 954422 - DNA, 25 bp, Mus musculus
ggtctcacgcgagacgaagacagct

SEQ ID NO: 954423 - DNA, 25 bp, Mus musculus
ggtctccagaagctagtgtctcgct

SEQ ID NO: 954424 - DNA, 25 bp, Mus musculus
ggtctccagaaggtagtgtctcgct

SEQ ID NO: 954425 - DNA, 25 bp, Mus musculus
ggtctcccagctgacccaggccctg

SEQ ID NO: 954426 - DNA, 25 bp, Mus musculus
ggtctcccaggtgacccaggccctg

SEQ ID NO: 954427 - DNA, 25 bp, Mus musculus
ggtctcccttaatgctgtctccaag

SEQ ID NO: 954428 - DNA, 25 bp, Mus musculus
ggtctcccttaatggtgtctccaag

SEQ ID NO: 954429 - DNA, 25 bp, Mus musculus
ggtctcctaaagcaactgaaccatc

SEQ ID NO: 954430 - DNA, 25 bp, Mus musculus
ggtctcctaaaggaactgaaccatc

SEQ ID NO: 954431 - DNA, 25 bp, Mus musculus
ggtctccttcctcacctactgtgac

SEQ ID NO: 954432 - DNA, 25 bp, Mus musculus
ggtctccttcctcagctactgtgac

SEQ ID NO: 954433 - DNA, 25 bp, Mus musculus
ggtctcgaagagagagacgacaaag

SEQ ID NO: 954434 - DNA, 25 bp, Mus musculus
ggtctcgaagagtgagacgacaaag

SEQ ID NO: 954435 - DNA, 25 bp, Mus musculus
ggtctcgatccacgtcaggttccca

SEQ ID NO: 954436 - DNA, 25 bp, Mus musculus
ggtctcgatccaggtcaggttccca

SEQ ID NO: 954437 - DNA, 25 bp, Mus musculus
ggtctcgttcttcactgaggatgcc

SEQ ID NO: 954438 - DNA, 25 bp, Mus musculus
ggtctcgttcttcagtgaggatgcc

SEQ ID NO: 954439 - DNA, 25 bp, Mus musculus
ggtctctactgcctacaagaagact

SEQ ID NO: 954440 - DNA, 25 bp, Mus musculus
ggtctctactgcctatgtgaaaacg

SEQ ID NO: 954441 - DNA, 25 bp, Mus musculus
ggtctctactgcgtacaagaagact

SEQ ID NO: 954442 - DNA, 25 bp, Mus musculus
ggtctctactgcgtatgtgaaaacg

SEQ ID NO: 954443 - DNA, 25 bp, Mus musculus
ggtctctgagaggaggtgaagccgg

SEQ ID NO: 954444 - DNA, 25 bp, Mus musculus
ggtctctgagtggaggtgaagccgg

SEQ ID NO: 954445 - DNA, 25 bp, Mus musculus
ggtctctgcagtcctatggggcatg

SEQ ID NO: 954446 - DNA, 25 bp, Mus musculus
ggtctctgcagtgctatggggcatg

SEQ ID NO: 954447 - DNA, 25 bp, Mus musculus
ggtctctgggctgacgaaattcaag

SEQ ID NO: 954448 - DNA, 25 bp, Mus musculus
ggtctctgggctgaggaaattcaag

SEQ ID NO: 954449 - DNA, 25 bp, Mus musculus
ggtctcttccttacacatgatgaag

SEQ ID NO: 954450 - DNA, 25 bp, Mus musculus
ggtctcttcctttcacatgatgaag

SEQ ID NO: 954451 - DNA, 25 bp, Mus musculus
ggtctcttctcccacgcaccaggtg

SEQ ID NO: 954452 - DNA, 25 bp, Mus musculus
ggtctcttctcccaggcaccaggtg

SEQ ID NO: 954453 - DNA, 25 bp, Mus musculus
ggtctgaccctgaacacacaacagg

SEQ ID NO: 954454 - DNA, 25 bp, Mus musculus
ggtctgaccctgaagacacaacagg

SEQ ID NO: 954455 - DNA, 25 bp, Mus musculus
ggtctgagcaggactcggaacccac

SEQ ID NO: 954456 - DNA, 25 bp, Mus musculus
ggtctgagcaggtctcggaacccac

SEQ ID NO: 954457 - DNA, 25 bp, Mus musculus
ggtctgcccgcgaagtgtggcctga

SEQ ID NO: 954458 - DNA, 25 bp, Mus musculus
ggtctgcccgggaagtgtggcctga

SEQ ID NO: 954459 - DNA, 25 bp, Mus musculus
ggtctgcgtctaaacgcttcgagta

SEQ ID NO: 954460 - DNA, 25 bp, Mus musculus
ggtctgcgtctaaaggcttcgagta

SEQ ID NO: 954461 - DNA, 25 bp, Mus musculus
ggtctgctggacgcctttagaacag

SEQ ID NO: 954462 - DNA, 25 bp, Mus musculus
ggtctgctggcaagcggaacaggaa

SEQ ID NO: 954463 - DNA, 25 bp, Mus musculus
ggtctgctgggaagcggaacaggaa

SEQ ID NO: 954464 - DNA, 25 bp, Mus musculus
ggtctgctggtcgcctttagaacag

SEQ ID NO: 954465 - DNA, 25 bp, Mus musculus
ggtctggaaatgccgtgatgagagg

SEQ ID NO: 954466 - DNA, 25 bp, Mus musculus
ggtctggaaatggcgtgatgagagg

SEQ ID NO: 954467 - DNA, 25 bp, Mus musculus
ggtctggagaagattgggacttggg

SEQ ID NO: 954468 - DNA, 25 bp, Mus musculus
ggtctggagaagtttgggacttggg

SEQ ID NO: 954469 - DNA, 25 bp, Mus musculus
ggtctggatcagctttaccactgct

SEQ ID NO: 954470 - DNA, 25 bp, Mus musculus
ggtctggatcaggtttaccactgct

SEQ ID NO: 954471 - DNA, 25 bp, Mus musculus
ggtctggatcgagacaaagtgcaac

SEQ ID NO: 954472 - DNA, 25 bp, Mus musculus
ggtctggatcgagacggtctgtcct

SEQ ID NO: 954473 - DNA, 25 bp, Mus musculus
ggtctggatcgagagaaagtgcaac

SEQ ID NO: 954474 - DNA, 25 bp, Mus musculus
ggtctggatcgagagggtctgtcct

SEQ ID NO: 954475 - DNA, 25 bp, Mus musculus
ggtctgggcgatggcgcactggctc

SEQ ID NO: 954476 - DNA, 25 bp, Mus musculus
ggtctgggcgatggggcactggctc

SEQ ID NO: 954477 - DNA, 25 bp, Mus musculus
ggtctgtcctgaaacccagagaccc

SEQ ID NO: 954478 - DNA, 25 bp, Mus musculus
ggtctgtcctgaaactaggcttctt

SEQ ID NO: 954479 - DNA, 25 bp, Mus musculus
ggtctgtcctgaaactctcagagga

SEQ ID NO: 954480 - DNA, 25 bp, Mus musculus
ggtctgtcctgaaagccagagaccc

SEQ ID NO: 954481 - DNA, 25 bp, Mus musculus
ggtctgtcctgaaagtaggcttctt

SEQ ID NO: 954482 - DNA, 25 bp, Mus musculus
ggtctgtcctgaaagtctcagagga

SEQ ID NO: 954483 - DNA, 25 bp, Mus musculus
ggtctgtggatgatgaccacaagcc

SEQ ID NO: 954484 - DNA, 25 bp, Mus musculus
ggtctgtggatgttgaccacaagcc

SEQ ID NO: 954485 - DNA, 25 bp, Mus musculus
ggtcttaaggaacgccaagattgta

SEQ ID NO: 954486 - DNA, 25 bp, Mus musculus
ggtcttaaggaaggccaagattgta

SEQ ID NO: 954487 - DNA, 25 bp, Mus musculus
ggtcttcaaagtcacaagtaaagcc

SEQ ID NO: 954488 - DNA, 25 bp, Mus musculus
ggtcttcaaagtcagaagtaaagcc

SEQ ID NO: 954489 - DNA, 25 bp, Mus musculus
ggtcttcaagcaaccagcacctgtt

SEQ ID NO: 954490 - DNA, 25 bp, Mus musculus
ggtcttcaaggaaccagcacctgtt

SEQ ID NO: 954491 - DNA, 25 bp, Mus musculus
ggtcttcagagagacgtaccgaccc

SEQ ID NO: 954492 - DNA, 25 bp, Mus musculus
ggtcttcagagagactctttctgca

SEQ ID NO: 954493 - DNA, 25 bp, Mus musculus
ggtcttcagagagaggtaccgaccc

SEQ ID NO: 954494 - DNA, 25 bp, Mus musculus
ggtcttcagagagagtctttctgca

SEQ ID NO: 954495 - DNA, 25 bp, Mus musculus
ggtcttcagccctcaaatggaccaa

SEQ ID NO: 954496 - DNA, 25 bp, Mus musculus
ggtcttcagccctctaatggaccaa

SEQ ID NO: 954497 - DNA, 25 bp, Mus musculus
ggtcttcctatcaaacaagattaaa

SEQ ID NO: 954498 - DNA, 25 bp, Mus musculus
ggtcttcctatctaacaagattaaa

SEQ ID NO: 954499 - DNA, 25 bp, Mus musculus
ggtcttcgtggacattgatgagaat

SEQ ID NO: 954500 - DNA, 25 bp, Mus musculus
ggtcttcgtggagattgatgagaat

SEQ ID NO: 954501 - DNA, 25 bp, Mus musculus
ggtcttctgacccacactaccttgt

SEQ ID NO: 954502 - DNA, 25 bp, Mus musculus
ggtcttctgacccagactaccttgt

SEQ ID NO: 954503 - DNA, 25 bp, Mus musculus
ggtcttgccaagatgtgaacgagtg

SEQ ID NO: 954504 - DNA, 25 bp, Mus musculus
ggtcttgccaagttgtgaacgagtg

SEQ ID NO: 954505 - DNA, 25 bp, Mus musculus
ggtcttgccacctgagaaagcttct

SEQ ID NO: 954506 - DNA, 25 bp, Mus musculus
ggtcttgccagctgagaaagcttct

SEQ ID NO: 954507 - DNA, 25 bp, Mus musculus
ggtcttgcctttcgtcacctagaga

SEQ ID NO: 954508 - DNA, 25 bp, Mus musculus
ggtcttgcctttggtcacctagaga

SEQ ID NO: 954509 - DNA, 25 bp, Mus musculus
ggtcttgggaagaaagacgatgctc

SEQ ID NO: 954510 - DNA, 25 bp, Mus musculus
ggtcttgggaagtaagacgatgctc

SEQ ID NO: 954511 - DNA, 25 bp, Mus musculus
ggtctttcaacaaatgctgtccatg

SEQ ID NO: 954512 - DNA, 25 bp, Mus musculus
ggtctttcaagaaatgctgtccatg

SEQ ID NO: 954513 - DNA, 25 bp, Mus musculus
ggtctttctgcacgagcccaccaca

SEQ ID NO: 954514 - DNA, 25 bp, Mus musculus
ggtctttctggacgagcccaccaca

SEQ ID NO: 954515 - DNA, 25 bp, Mus musculus
ggtctttgagcacgtcagattgctg

SEQ ID NO: 954516 - DNA, 25 bp, Mus musculus
ggtctttgagcaggtcagattgctg

SEQ ID NO: 954517 - DNA, 25 bp, Mus musculus
ggtcttttcataatcaatggtagcc

SEQ ID NO: 954518 - DNA, 25 bp, Mus musculus
ggtcttttcataatgaatggtagcc

SEQ ID NO: 954519 - DNA, 25 bp, Mus musculus
ggtctttttgctaaagtacctgttt

SEQ ID NO: 954520 - DNA, 25 bp, Mus musculus
ggtctttttgctaatgtacctgttt

SEQ ID NO: 954521 - DNA, 25 bp, Mus musculus
ggtgaaaaagcagtctttgttgctg

SEQ ID NO: 954522 - DNA, 25 bp, Mus musculus
ggtgaaaaaggagtctttgttgctg

SEQ ID NO: 954523 - DNA, 25 bp, Mus musculus
ggtgaaaatgcttgcgtcaccagtg

SEQ ID NO: 954524 - DNA, 25 bp, Mus musculus
ggtgaaaatgcttgggtcaccagtg

SEQ ID NO: 954525 - DNA, 25 bp, Mus musculus
ggtgaaatagattatgaagcaattg

SEQ ID NO: 954526 - DNA, 25 bp, Mus musculus
ggtgaaatagtttatgaagcaattg

SEQ ID NO: 954527 - DNA, 25 bp, Mus musculus
ggtgaacatgggcccaatgaagctg

SEQ ID NO: 954528 - DNA, 25 bp, Mus musculus
ggtgaacatgggccgaatgaagctg

SEQ ID NO: 954529 - DNA, 25 bp, Mus musculus
ggtgaagaagaagctgactgcggag

SEQ ID NO: 954530 - DNA, 25 bp, Mus musculus
ggtgaagaagcttcattatgatgga

SEQ ID NO: 954531 - DNA, 25 bp, Mus musculus
ggtgaagaaggttcattatgatgga

SEQ ID NO: 954532 - DNA, 25 bp, Mus musculus
ggtgaagaagtagctgactgcggag

SEQ ID NO: 954533 - DNA, 25 bp, Mus musculus
ggtgaagagcagctatctcagacga

SEQ ID NO: 954534 - DNA, 25 bp, Mus musculus
ggtgaagagcaggtatctcagacga

SEQ ID NO: 954535 - DNA, 25 bp, Mus musculus
ggtgaagagctgctatatccagagc

SEQ ID NO: 954536 - DNA, 25 bp, Mus musculus
ggtgaagagctggtatatccagagc

SEQ ID NO: 954537 - DNA, 25 bp, Mus musculus
ggtgaagcagaatgatatggaacct

SEQ ID NO: 954538 - DNA, 25 bp, Mus musculus
ggtgaagcagcagtggcatgactac

SEQ ID NO: 954539 - DNA, 25 bp, Mus musculus
ggtgaagcaggagtggcatgactac

SEQ ID NO: 954540 - DNA, 25 bp, Mus musculus
ggtgaagcagtatgatatggaacct

SEQ ID NO: 954541 - DNA, 25 bp, Mus musculus
ggtgaagcttcacatctgggacact

SEQ ID NO: 954542 - DNA, 25 bp, Mus musculus
ggtgaagcttcagatctgggacact

SEQ ID NO: 954543 - DNA, 25 bp, Mus musculus
ggtgaaggacaaccaccccgagctc

SEQ ID NO: 954544 - DNA, 25 bp, Mus musculus
ggtgaaggacaagcaccccgagctc

SEQ ID NO: 954545 - DNA, 25 bp, Mus musculus
ggtgaatactaccacgagagcaatg

SEQ ID NO: 954546 - DNA, 25 bp, Mus musculus
ggtgaatactaccaggagagcaatg

SEQ ID NO: 954547 - DNA, 25 bp, Mus musculus
ggtgaatccatccgtacaagcaata

SEQ ID NO: 954548 - DNA, 25 bp, Mus musculus
ggtgaatccatcggtacaagcaata

SEQ ID NO: 954549 - DNA, 25 bp, Mus musculus
ggtgaatcctcacctgcagagtcca

SEQ ID NO: 954550 - DNA, 25 bp, Mus musculus
ggtgaatcctcagctgcagagtcca

SEQ ID NO: 954551 - DNA, 25 bp, Mus musculus
ggtgaatgcacacacgtggacgaat

SEQ ID NO: 954552 - DNA, 25 bp, Mus musculus
ggtgaatgcacagacgtggacgaat

SEQ ID NO: 954553 - DNA, 25 bp, Mus musculus
ggtgacaaaatacgaatgatcgaga

SEQ ID NO: 954554 - DNA, 25 bp, Mus musculus
ggtgacaaaataggaatgatcgaga

SEQ ID NO: 954555 - DNA, 25 bp, Mus musculus
ggtgacaacgaaaatatctgcagaa

SEQ ID NO: 954556 - DNA, 25 bp, Mus musculus
ggtgacaacgtaaatatctgcagaa

SEQ ID NO: 954557 - DNA, 25 bp, Mus musculus
ggtgacaagaaaaaaatcgctgtag

SEQ ID NO: 954558 - DNA, 25 bp, Mus musculus
ggtgacaagaaaaatatcgctgtag

SEQ ID NO: 954559 - DNA, 25 bp, Mus musculus
ggtgacacggagtgcgagacttctt

SEQ ID NO: 954560 - DNA, 25 bp, Mus musculus
ggtgacacggagtgggagacttctt

SEQ ID NO: 954561 - DNA, 25 bp, Mus musculus
ggtgacactctgagcatcctggcca

SEQ ID NO: 954562 - DNA, 25 bp, Mus musculus
ggtgacactctgaggatcctggcca

SEQ ID NO: 954563 - DNA, 25 bp, Mus musculus
ggtgacatactccacaagctgtccg

SEQ ID NO: 954564 - DNA, 25 bp, Mus musculus
ggtgacatactccagaagctgtccg

SEQ ID NO: 954565 - DNA, 25 bp, Mus musculus
ggtgacatatttacagtgctggtgg

SEQ ID NO: 954566 - DNA, 25 bp, Mus musculus
ggtgacatatttactgtgctggtgg

SEQ ID NO: 954567 - DNA, 25 bp, Mus musculus
ggtgaccaagcccaaagctggccag

SEQ ID NO: 954568 - DNA, 25 bp, Mus musculus
ggtgaccaagcgacgtgcaatcttt

SEQ ID NO: 954569 - DNA, 25 bp, Mus musculus
ggtgaccaaggccaaagctggccag

SEQ ID NO: 954570 - DNA, 25 bp, Mus musculus
ggtgaccaagggacgtgcaatcttt

SEQ ID NO: 954571 - DNA, 25 bp, Mus musculus
ggtgacccgcaaccatcactgccga

SEQ ID NO: 954572 - DNA, 25 bp, Mus musculus
ggtgacccgcaagcatcactgccga

SEQ ID NO: 954573 - DNA, 25 bp, Mus musculus
ggtgacgcaaaacgccaaatcatgg

SEQ ID NO: 954574 - DNA, 25 bp, Mus musculus
ggtgacgcaaaaggccaaatcatgg

SEQ ID NO: 954575 - DNA, 25 bp, Mus musculus
ggtgacgcacagcttctccacaaag

SEQ ID NO: 954576 - DNA, 25 bp, Mus musculus
ggtgacgcacaggttctccacaaag

SEQ ID NO: 954577 - DNA, 25 bp, Mus musculus
ggtgacgcgacacaaaccgcccaga

SEQ ID NO: 954578 - DNA, 25 bp, Mus musculus
ggtgacgcgacaccacaccacatgt

SEQ ID NO: 954579 - DNA, 25 bp, Mus musculus
ggtgacgcgacagaaaccgcccaga

SEQ ID NO: 954580 - DNA, 25 bp, Mus musculus
ggtgacgcgacagcacaccacatgt

SEQ ID NO: 954581 - DNA, 25 bp, Mus musculus
ggtgacggagcgtggcatgtatgtg

SEQ ID NO: 954582 - DNA, 25 bp, Mus musculus
ggtgacggagggtggcatgtatgtg

SEQ ID NO: 954583 - DNA, 25 bp, Mus musculus
ggtgacgtcagaccacctcgtgctg

SEQ ID NO: 954584 - DNA, 25 bp, Mus musculus
ggtgacgtcagacctcctcgtgctg

SEQ ID NO: 954585 - DNA, 25 bp, Mus musculus
ggtgactgcggcccaaccatgaagg

SEQ ID NO: 954586 - DNA, 25 bp, Mus musculus
ggtgactgcggcgcaaccatgaagg

SEQ ID NO: 954587 - DNA, 25 bp, Mus musculus
ggtgactgtgtttgcgtttccacag

SEQ ID NO: 954588 - DNA, 25 bp, Mus musculus
ggtgactgtgtttgggtttccacag

SEQ ID NO: 954589 - DNA, 25 bp, Mus musculus
ggtgagaggaagacactgcagcttc

SEQ ID NO: 954590 - DNA, 25 bp, Mus musculus
ggtgagaggaagactctgcagcttc

SEQ ID NO: 954591 - DNA, 25 bp, Mus musculus
ggtgagccagctcccaggacctctc

SEQ ID NO: 954592 - DNA, 25 bp, Mus musculus
ggtgagccaggtcccaggacctctc

SEQ ID NO: 954593 - DNA, 25 bp, Mus musculus
ggtgagcggtgagccacatgtcctt

SEQ ID NO: 954594 - DNA, 25 bp, Mus musculus
ggtgagcggtgagcgacatgtcctt

SEQ ID NO: 954595 - DNA, 25 bp, Mus musculus
ggtgagcgtgcacaacccgggaacc

SEQ ID NO: 954596 - DNA, 25 bp, Mus musculus
ggtgagcgtgcagaacccgggaacc

SEQ ID NO: 954597 - DNA, 25 bp, Mus musculus
ggtgaggatggacaccaacacccaa

SEQ ID NO: 954598 - DNA, 25 bp, Mus musculus
ggtgaggatggacaccagcaacacc

SEQ ID NO: 954599 - DNA, 25 bp, Mus musculus
ggtgaggatggacagcaacacccaa

SEQ ID NO: 954600 - DNA, 25 bp, Mus musculus
ggtgaggatggacagcagcaacacc

SEQ ID NO: 954601 - DNA, 25 bp, Mus musculus
ggtgaggcaggtcgagggagctctc

SEQ ID NO: 954602 - DNA, 25 bp, Mus musculus
ggtgaggcaggtggagggagctctc

SEQ ID NO: 954603 - DNA, 25 bp, Mus musculus
ggtgagtgctccagtaagcccagag

SEQ ID NO: 954604 - DNA, 25 bp, Mus musculus
ggtgagtgctgcagtaagcccagag

SEQ ID NO: 954605 - DNA, 25 bp, Mus musculus
ggtgataataagattctgagggtca

SEQ ID NO: 954606 - DNA, 25 bp, Mus musculus
ggtgataataagcacaaccggatcc

SEQ ID NO: 954607 - DNA, 25 bp, Mus musculus
ggtgataataaggacaaccggatcc

SEQ ID NO: 954608 - DNA, 25 bp, Mus musculus
ggtgataataagtttctgagggtca

SEQ ID NO: 954609 - DNA, 25 bp, Mus musculus
ggtgatatttctgacgctgttatcc

SEQ ID NO: 954610 - DNA, 25 bp, Mus musculus
ggtgatatttctgaggctgttatcc

SEQ ID NO: 954611 - DNA, 25 bp, Mus musculus
ggtgatccagcttttgtggtctttg

SEQ ID NO: 954612 - DNA, 25 bp, Mus musculus
ggtgatccaggttttgtggtctttg

SEQ ID NO: 954613 - DNA, 25 bp, Mus musculus
ggtgatcccgatgaagagagcaggg

SEQ ID NO: 954614 - DNA, 25 bp, Mus musculus
ggtgatcccgttgaagagagcaggg

SEQ ID NO: 954615 - DNA, 25 bp, Mus musculus
ggtgatcgtaggcactgggctcatt

SEQ ID NO: 954616 - DNA, 25 bp, Mus musculus
ggtgatcgtaggcagtgggctcatt

SEQ ID NO: 954617 - DNA, 25 bp, Mus musculus
ggtgatcttgatcgctccaccaagg

SEQ ID NO: 954618 - DNA, 25 bp, Mus musculus
ggtgatcttgatggctccaccaagg

SEQ ID NO: 954619 - DNA, 25 bp, Mus musculus
ggtgatgaaaacaacatggaatttc

SEQ ID NO: 954620 - DNA, 25 bp, Mus musculus
ggtgatgaaaactacatggaatttc

SEQ ID NO: 954621 - DNA, 25 bp, Mus musculus
ggtgatgaagacaatagatgacttg

SEQ ID NO: 954622 - DNA, 25 bp, Mus musculus
ggtgatgaagtcaatagatgacttg

SEQ ID NO: 954623 - DNA, 25 bp, Mus musculus
ggtgatgacgatggcacctgtgacg

SEQ ID NO: 954624 - DNA, 25 bp, Mus musculus
ggtgatgacgttggcacctgtgacg

SEQ ID NO: 954625 - DNA, 25 bp, Mus musculus
ggtgatgactcagcttctaaggagc

SEQ ID NO: 954626 - DNA, 25 bp, Mus musculus
ggtgatgactcttgctttcactacc

SEQ ID NO: 954627 - DNA, 25 bp, Mus musculus
ggtgatgactgagcttctaaggagc

SEQ ID NO: 954628 - DNA, 25 bp, Mus musculus
ggtgatgactgttgctttcactacc

SEQ ID NO: 954629 - DNA, 25 bp, Mus musculus
ggtgatgcgcaacggctacgagggc

SEQ ID NO: 954630 - DNA, 25 bp, Mus musculus
ggtgatgcgcaacgtatgaatgctg

SEQ ID NO: 954631 - DNA, 25 bp, Mus musculus
ggtgatgcgcaagggctacgagggc

SEQ ID NO: 954632 - DNA, 25 bp, Mus musculus
ggtgatgcgcaaggtatgaatgctg

SEQ ID NO: 954633 - DNA, 25 bp, Mus musculus
ggtgatgctgcacaagtgggagaaa

SEQ ID NO: 954634 - DNA, 25 bp, Mus musculus
ggtgatgctggacaagtgggagaaa

SEQ ID NO: 954635 - DNA, 25 bp, Mus musculus
ggtgatggagagcaaggaggagagg

SEQ ID NO: 954636 - DNA, 25 bp, Mus musculus
ggtgatggagaggaaggaggagagg

SEQ ID NO: 954637 - DNA, 25 bp, Mus musculus
ggtgatggtgagctctagtgacagg

SEQ ID NO: 954638 - DNA, 25 bp, Mus musculus
ggtgatggtgaggtctagtgacagg

SEQ ID NO: 954639 - DNA, 25 bp, Mus musculus
ggtgatgtccggctagccaaggtct

SEQ ID NO: 954640 - DNA, 25 bp, Mus musculus
ggtgatgtccgggtagccaaggtct

SEQ ID NO: 954641 - DNA, 25 bp, Mus musculus
ggtgattctcttcccattcattgac

SEQ ID NO: 954642 - DNA, 25 bp, Mus musculus
ggtgattctcttcgattgttcatca

SEQ ID NO: 954643 - DNA, 25 bp, Mus musculus
ggtgattctcttgccattcattgac

SEQ ID NO: 954644 - DNA, 25 bp, Mus musculus
ggtgattctcttggattgttcatca

SEQ ID NO: 954645 - DNA, 25 bp, Mus musculus
ggtgattcttcacgctgaaaaagaa

SEQ ID NO: 954646 - DNA, 25 bp, Mus musculus
ggtgattcttcaggctgaaaaagaa

SEQ ID NO: 954647 - DNA, 25 bp, Mus musculus
ggtgattgcgcacgccttcagaagt

SEQ ID NO: 954648 - DNA, 25 bp, Mus musculus
ggtgattgcgcaggccttcagaagt

SEQ ID NO: 954649 - DNA, 25 bp, Mus musculus
ggtgatttctcaaacgtgtgtgtgc

SEQ ID NO: 954650 - DNA, 25 bp, Mus musculus
ggtgatttctcaaaggtgtgtgtgc

SEQ ID NO: 954651 - DNA, 25 bp, Mus musculus
ggtgcaaaagctaccagcaaggtga

SEQ ID NO: 954652 - DNA, 25 bp, Mus musculus
ggtgcaaaaggtaccagcaaggtga

SEQ ID NO: 954653 - DNA, 25 bp, Mus musculus
ggtgcaagacaacgctttggatgcc

SEQ ID NO: 954654 - DNA, 25 bp, Mus musculus
ggtgcaagacaaggctttggatgcc

SEQ ID NO: 954655 - DNA, 25 bp, Mus musculus
ggtgcaagagaactgaacatcgtgg

SEQ ID NO: 954656 - DNA, 25 bp, Mus musculus
ggtgcaagagagtgtccaagcacga

SEQ ID NO: 954657 - DNA, 25 bp, Mus musculus
ggtgcaagagcgatacccctgaaac

SEQ ID NO: 954658 - DNA, 25 bp, Mus musculus
ggtgcaagagctagaactgaacatc

SEQ ID NO: 954659 - DNA, 25 bp, Mus musculus
ggtgcaagaggcaacacctggggat

SEQ ID NO: 954660 - DNA, 25 bp, Mus musculus
ggtgcaagaggcaagacctggggat

SEQ ID NO: 954661 - DNA, 25 bp, Mus musculus
ggtgcaagagggatacccctgaaac

SEQ ID NO: 954662 - DNA, 25 bp, Mus musculus
ggtgcaagaggtagaactgaacatc

SEQ ID NO: 954663 - DNA, 25 bp, Mus musculus
ggtgcaagagtactgaacatcgtgg

SEQ ID NO: 954664 - DNA, 25 bp, Mus musculus
ggtgcaagagtgtgtccaagcacga

SEQ ID NO: 954665 - DNA, 25 bp, Mus musculus
ggtgcaagagttcaacaagtttgat

SEQ ID NO: 954666 - DNA, 25 bp, Mus musculus
ggtgcaagagttcaatttgatctct

SEQ ID NO: 954667 - DNA, 25 bp, Mus musculus
ggtgcaagagttcatcaagtttgat

SEQ ID NO: 954668 - DNA, 25 bp, Mus musculus
ggtgcaagagttcattttgatctct

SEQ ID NO: 954669 - DNA, 25 bp, Mus musculus
ggtgcaagtaatcccacagggccac

SEQ ID NO: 954670 - DNA, 25 bp, Mus musculus
ggtgcaagtattcccacagggccac

SEQ ID NO: 954671 - DNA, 25 bp, Mus musculus
ggtgcacagcagctactaccgcatt

SEQ ID NO: 954672 - DNA, 25 bp, Mus musculus
ggtgcacagcaggtactaccgcatt

SEQ ID NO: 954673 - DNA, 25 bp, Mus musculus
ggtgcacatggaccagttggaggtg

SEQ ID NO: 954674 - DNA, 25 bp, Mus musculus
ggtgcacatggacctgttggaggtg

SEQ ID NO: 954675 - DNA, 25 bp, Mus musculus
ggtgcacttcagaaggcccgagaca

SEQ ID NO: 954676 - DNA, 25 bp, Mus musculus
ggtgcacttcagtaggcccgagaca

SEQ ID NO: 954677 - DNA, 25 bp, Mus musculus
ggtgcagacctcaccgacacactgg

SEQ ID NO: 954678 - DNA, 25 bp, Mus musculus
ggtgcagacctcaccttcctcacag

SEQ ID NO: 954679 - DNA, 25 bp, Mus musculus
ggtgcagacctcacggacacactgg

SEQ ID NO: 954680 - DNA, 25 bp, Mus musculus
ggtgcagacctcacgttcctcacag

SEQ ID NO: 954681 - DNA, 25 bp, Mus musculus
ggtgcagactaaatgatcagaggca

SEQ ID NO: 954682 - DNA, 25 bp, Mus musculus
ggtgcagacttaatgatcagaggca

SEQ ID NO: 954683 - DNA, 25 bp, Mus musculus
ggtgcagctatgcctgggttgcggc

SEQ ID NO: 954684 - DNA, 25 bp, Mus musculus
ggtgcagctatggctgggttgcggc

SEQ ID NO: 954685 - DNA, 25 bp, Mus musculus
ggtgcaggactgcgctacacagaga

SEQ ID NO: 954686 - DNA, 25 bp, Mus musculus
ggtgcaggactgcgctacgcagatc

SEQ ID NO: 954687 - DNA, 25 bp, Mus musculus
ggtgcaggactgggctacacagaga

SEQ ID NO: 954688 - DNA, 25 bp, Mus musculus
ggtgcaggactgggctacgcagatc

SEQ ID NO: 954689 - DNA, 25 bp, Mus musculus
ggtgcaggatcgacagagacctact

SEQ ID NO: 954690 - DNA, 25 bp, Mus musculus
ggtgcaggatcgactgagacctact

SEQ ID NO: 954691 - DNA, 25 bp, Mus musculus
ggtgcagggacctgatcacacgaat

SEQ ID NO: 954692 - DNA, 25 bp, Mus musculus
ggtgcagggagctgatcacacgaat

SEQ ID NO: 954693 - DNA, 25 bp, Mus musculus
ggtgcaggggagtgccccagagaac

SEQ ID NO: 954694 - DNA, 25 bp, Mus musculus
ggtgcaggggcaacagctgtgccaa

SEQ ID NO: 954695 - DNA, 25 bp, Mus musculus
ggtgcagggggaacagctgtgccaa

SEQ ID NO: 954696 - DNA, 25 bp, Mus musculus
ggtgcaggggtgtgccccagagaac

SEQ ID NO: 954697 - DNA, 25 bp, Mus musculus
ggtgcagtacaaagagtacttttga

SEQ ID NO: 954698 - DNA, 25 bp, Mus musculus
ggtgcagtacaatgagtacttttga

SEQ ID NO: 954699 - DNA, 25 bp, Mus musculus
ggtgcatacaagcaacatgctgcct

SEQ ID NO: 954700 - DNA, 25 bp, Mus musculus
ggtgcatacaagcttagcagaggcc

SEQ ID NO: 954701 - DNA, 25 bp, Mus musculus
ggtgcatacaaggaacatgctgcct

SEQ ID NO: 954702 - DNA, 25 bp, Mus musculus
ggtgcatacaaggttagcagaggcc

SEQ ID NO: 954703 - DNA, 25 bp, Mus musculus
ggtgcatgaaagcccgcaccatgta

SEQ ID NO: 954704 - DNA, 25 bp, Mus musculus
ggtgcatgaaaggccgcaccatgta

SEQ ID NO: 954705 - DNA, 25 bp, Mus musculus
ggtgccaaagcacttagttggtcga

SEQ ID NO: 954706 - DNA, 25 bp, Mus musculus
ggtgccaaaggacttagttggtcga

SEQ ID NO: 954707 - DNA, 25 bp, Mus musculus
ggtgccaaggcgcccacagaaccat

SEQ ID NO: 954708 - DNA, 25 bp, Mus musculus
ggtgccaaggcggccacagaaccat

SEQ ID NO: 954709 - DNA, 25 bp, Mus musculus
ggtgccacagccaccatgccaatca

SEQ ID NO: 954710 - DNA, 25 bp, Mus musculus
ggtgccacaggcaccatgccaatca

SEQ ID NO: 954711 - DNA, 25 bp, Mus musculus
ggtgccacgagcaacaaagcaaagg

SEQ ID NO: 954712 - DNA, 25 bp, Mus musculus
ggtgccacgagcaagaaagcaaagg

SEQ ID NO: 954713 - DNA, 25 bp, Mus musculus
ggtgccacggacttgagcatcgatg

SEQ ID NO: 954714 - DNA, 25 bp, Mus musculus
ggtgccacggagaccatcgtcagtg

SEQ ID NO: 954715 - DNA, 25 bp, Mus musculus
ggtgccacggtcttgagcatcgatg

SEQ ID NO: 954716 - DNA, 25 bp, Mus musculus
ggtgccacggtgaccatcgtcagtg

SEQ ID NO: 954717 - DNA, 25 bp, Mus musculus
ggtgccagctcaaacctgtgtgtca

SEQ ID NO: 954718 - DNA, 25 bp, Mus musculus
ggtgccagctcaaagctgtgtgtca

SEQ ID NO: 954719 - DNA, 25 bp, Mus musculus
ggtgcccatggacgtcctgtccaga

SEQ ID NO: 954720 - DNA, 25 bp, Mus musculus
ggtgcccatggaggtcctgtccaga

SEQ ID NO: 954721 - DNA, 25 bp, Mus musculus
ggtgcccattttcgtggtgagcttc

SEQ ID NO: 954722 - DNA, 25 bp, Mus musculus
ggtgcccattttggtggtgagcttc

SEQ ID NO: 954723 - DNA, 25 bp, Mus musculus
ggtgccccaagaagaggacgctcgc

SEQ ID NO: 954724 - DNA, 25 bp, Mus musculus
ggtgccccaagatgaggacgctcgc

SEQ ID NO: 954725 - DNA, 25 bp, Mus musculus
ggtgcccctgcacgacctcatggtc

SEQ ID NO: 954726 - DNA, 25 bp, Mus musculus
ggtgcccctgcaggacctcatggtc

SEQ ID NO: 954727 - DNA, 25 bp, Mus musculus
ggtgcccgagcagccgatgtcctgg

SEQ ID NO: 954728 - DNA, 25 bp, Mus musculus
ggtgcccgagccgatgtcctggtgt

SEQ ID NO: 954729 - DNA, 25 bp, Mus musculus
ggtgcccgaggagccgatgtcctgg

SEQ ID NO: 954730 - DNA, 25 bp, Mus musculus
ggtgcccgaggcgatgtcctggtgt

SEQ ID NO: 954731 - DNA, 25 bp, Mus musculus
ggtgcccgttgaccaagtggccagc

SEQ ID NO: 954732 - DNA, 25 bp, Mus musculus
ggtgcccgttgacgaagcaagtggc

SEQ ID NO: 954733 - DNA, 25 bp, Mus musculus
ggtgcccgttgagcaagtggccagc

SEQ ID NO: 954734 - DNA, 25 bp, Mus musculus
ggtgcccgttgaggaagcaagtggc

SEQ ID NO: 954735 - DNA, 25 bp, Mus musculus
ggtgccctccagcccagctccacca

SEQ ID NO: 954736 - DNA, 25 bp, Mus musculus
ggtgccctccagctccaccaccccc

SEQ ID NO: 954737 - DNA, 25 bp, Mus musculus
ggtgccctccaggccagctccacca

SEQ ID NO: 954738 - DNA, 25 bp, Mus musculus
ggtgccctccaggtccaccaccccc

SEQ ID NO: 954739 - DNA, 25 bp, Mus musculus
ggtgccctggccaacgtcctggaca

SEQ ID NO: 954740 - DNA, 25 bp, Mus musculus
ggtgccctggccaaggtcctggaca

SEQ ID NO: 954741 - DNA, 25 bp, Mus musculus
ggtgccgtccagcgatgcagcctct

SEQ ID NO: 954742 - DNA, 25 bp, Mus musculus
ggtgccgtccagggatgcagcctct

SEQ ID NO: 954743 - DNA, 25 bp, Mus musculus
ggtgcctccaagcgttcccgtgaga

SEQ ID NO: 954744 - DNA, 25 bp, Mus musculus
ggtgcctccaagggttcccgtgaga

SEQ ID NO: 954745 - DNA, 25 bp, Mus musculus
ggtgcctcggagcacagcgatcagc

SEQ ID NO: 954746 - DNA, 25 bp, Mus musculus
ggtgcctcggagcagagcgatcagc

SEQ ID NO: 954747 - DNA, 25 bp, Mus musculus
ggtgcctcggcccaccacagccccc

SEQ ID NO: 954748 - DNA, 25 bp, Mus musculus
ggtgcctcggcccagcacagccccc

SEQ ID NO: 954749 - DNA, 25 bp, Mus musculus
ggtgcctggacacaaatatcttgag

SEQ ID NO: 954750 - DNA, 25 bp, Mus musculus
ggtgcctggacagaaatatcttgag

SEQ ID NO: 954751 - DNA, 25 bp, Mus musculus
ggtgccttcttcatcgatgaggatg

SEQ ID NO: 954752 - DNA, 25 bp, Mus musculus
ggtgccttcttcatggatgaggatg

SEQ ID NO: 954753 - DNA, 25 bp, Mus musculus
ggtgcgagtcctaaggaaccagact

SEQ ID NO: 954754 - DNA, 25 bp, Mus musculus
ggtgcgagtcctagaaccagactag

SEQ ID NO: 954755 - DNA, 25 bp, Mus musculus
ggtgcgagtccttaggaaccagact

SEQ ID NO: 954756 - DNA, 25 bp, Mus musculus
ggtgcgagtccttgaaccagactag

SEQ ID NO: 954757 - DNA, 25 bp, Mus musculus
ggtgcgatggctcctatgacatggt

SEQ ID NO: 954758 - DNA, 25 bp, Mus musculus
ggtgcgatggctgctatgacatggt

SEQ ID NO: 954759 - DNA, 25 bp, Mus musculus
ggtgcgccgaggcctaaagaccaag

SEQ ID NO: 954760 - DNA, 25 bp, Mus musculus
ggtgcgccgagggctaaagaccaag

SEQ ID NO: 954761 - DNA, 25 bp, Mus musculus
ggtgcggtggttcacctgaccccat

SEQ ID NO: 954762 - DNA, 25 bp, Mus musculus
ggtgcggtggttcagctgaccccat

SEQ ID NO: 954763 - DNA, 25 bp, Mus musculus
ggtgctacagctcctagggaagaac

SEQ ID NO: 954764 - DNA, 25 bp, Mus musculus
ggtgctacaggtcctagggaagaac

SEQ ID NO: 954765 - DNA, 25 bp, Mus musculus
ggtgctagcccacccagattaggaa

SEQ ID NO: 954766 - DNA, 25 bp, Mus musculus
ggtgctagcccaccgagattaggaa

SEQ ID NO: 954767 - DNA, 25 bp, Mus musculus
ggtgctcaatcacggaatggagatc

SEQ ID NO: 954768 - DNA, 25 bp, Mus musculus
ggtgctcaatcagggaatggagatc

SEQ ID NO: 954769 - DNA, 25 bp, Mus musculus
ggtgctccagcccatccagaaggga

SEQ ID NO: 954770 - DNA, 25 bp, Mus musculus
ggtgctccaggccatccagaaggga

SEQ ID NO: 954771 - DNA, 25 bp, Mus musculus
ggtgctcctggcatcgtacttttct

SEQ ID NO: 954772 - DNA, 25 bp, Mus musculus
ggtgctcctggcatggtacttttct

SEQ ID NO: 954773 - DNA, 25 bp, Mus musculus
ggtgctgccaccagatttgccagcg

SEQ ID NO: 954774 - DNA, 25 bp, Mus musculus
ggtgctgccaccagttttgccagcg

SEQ ID NO: 954775 - DNA, 25 bp, Mus musculus
ggtgctgcccagaagggtccgggag

SEQ ID NO: 954776 - DNA, 25 bp, Mus musculus
ggtgctgcccagcgtccgggagagt

SEQ ID NO: 954777 - DNA, 25 bp, Mus musculus
ggtgctgcccagggtccgggagagt

SEQ ID NO: 954778 - DNA, 25 bp, Mus musculus
ggtgctgcccagtagggtccgggag

SEQ ID NO: 954779 - DNA, 25 bp, Mus musculus
ggtgctgcccatcgcactggagctc

SEQ ID NO: 954780 - DNA, 25 bp, Mus musculus
ggtgctgcccatggcactggagctc

SEQ ID NO: 954781 - DNA, 25 bp, Mus musculus
ggtgctgctaatcacggtcagatct

SEQ ID NO: 954782 - DNA, 25 bp, Mus musculus
ggtgctgctaatcagggtcagatct

SEQ ID NO: 954783 - DNA, 25 bp, Mus musculus
ggtgctgctagacacgcttgtgttg

SEQ ID NO: 954784 - DNA, 25 bp, Mus musculus
ggtgctgctagacaggcttgtgttg

SEQ ID NO: 954785 - DNA, 25 bp, Mus musculus
ggtgctgctcaacgctcccccggct

SEQ ID NO: 954786 - DNA, 25 bp, Mus musculus
ggtgctgctcaaggctcccccggct

SEQ ID NO: 954787 - DNA, 25 bp, Mus musculus
ggtgctgctccactactatggcatg

SEQ ID NO: 954788 - DNA, 25 bp, Mus musculus
ggtgctgctccagtactatggcatg

SEQ ID NO: 954789 - DNA, 25 bp, Mus musculus
ggtgctgctgaacaacaatgacgga

SEQ ID NO: 954790 - DNA, 25 bp, Mus musculus
ggtgctgctgaacatcaatgacgga

SEQ ID NO: 954791 - DNA, 25 bp, Mus musculus
ggtgctggagataaaggcagatgtc

SEQ ID NO: 954792 - DNA, 25 bp, Mus musculus
ggtgctggagctgtcctgtccatgg

SEQ ID NO: 954793 - DNA, 25 bp, Mus musculus
ggtgctggaggtgtcctgtccatgg

SEQ ID NO: 954794 - DNA, 25 bp, Mus musculus
ggtgctggagttaaaggcagatgtc

SEQ ID NO: 954795 - DNA, 25 bp, Mus musculus
ggtgctggcccgcttgcagttgctg

SEQ ID NO: 954796 - DNA, 25 bp, Mus musculus
ggtgctggcccggttgcagttgctg

SEQ ID NO: 954797 - DNA, 25 bp, Mus musculus
ggtgctgtcgactctggccaacatg

SEQ ID NO: 954798 - DNA, 25 bp, Mus musculus
ggtgctgtcgtctctggccaacatg

SEQ ID NO: 954799 - DNA, 25 bp, Mus musculus
ggtgcttcagcactttgtgaagaaa

SEQ ID NO: 954800 - DNA, 25 bp, Mus musculus
ggtgcttcagcagtttgtgaagaaa

SEQ ID NO: 954801 - DNA, 25 bp, Mus musculus
ggtgcttcagcggctgacgttcacc

SEQ ID NO: 954802 - DNA, 25 bp, Mus musculus
ggtgcttcaggggctgacgttcacc

SEQ ID NO: 954803 - DNA, 25 bp, Mus musculus
ggtggaaacttggaccaggcaccgc

SEQ ID NO: 954804 - DNA, 25 bp, Mus musculus
ggtggaaacttggagcaggcaccgc

SEQ ID NO: 954805 - DNA, 25 bp, Mus musculus
ggtggaaagcaaccagaacacagaa

SEQ ID NO: 954806 - DNA, 25 bp, Mus musculus
ggtggaaagcaagcagaacacagaa

SEQ ID NO: 954807 - DNA, 25 bp, Mus musculus
ggtggaaatcctgtcgtgggagcat

SEQ ID NO: 954808 - DNA, 25 bp, Mus musculus
ggtggaaatcctgtggtgggagcat

SEQ ID NO: 954809 - DNA, 25 bp, Mus musculus
ggtggaaatttgcgagcttggataa

SEQ ID NO: 954810 - DNA, 25 bp, Mus musculus
ggtggaaatttgggagcttggataa

SEQ ID NO: 954811 - DNA, 25 bp, Mus musculus
ggtggaagaaagccttggggcatat

SEQ ID NO: 954812 - DNA, 25 bp, Mus musculus
ggtggaagaaaggcttggggcatat

SEQ ID NO: 954813 - DNA, 25 bp, Mus musculus
ggtggaagagcagacaagtttccta

SEQ ID NO: 954814 - DNA, 25 bp, Mus musculus
ggtggaagaggagacaagtttccta

SEQ ID NO: 954815 - DNA, 25 bp, Mus musculus
ggtggaagccgacgttagcaacatt

SEQ ID NO: 954816 - DNA, 25 bp, Mus musculus
ggtggaagccgaggttagcaacatt

SEQ ID NO: 954817 - DNA, 25 bp, Mus musculus
ggtggaagtgcacgagaagtccagc

SEQ ID NO: 954818 - DNA, 25 bp, Mus musculus
ggtggaagtgcaggagaagtccagc

SEQ ID NO: 954819 - DNA, 25 bp, Mus musculus
ggtggacaaatccaggtggctcctc

SEQ ID NO: 954820 - DNA, 25 bp, Mus musculus
ggtggacaaatcctcgtggctcctc

SEQ ID NO: 954821 - DNA, 25 bp, Mus musculus
ggtggacaaatcctggtggctcctc

SEQ ID NO: 954822 - DNA, 25 bp, Mus musculus
ggtggacaaatcgaggtggctcctc

SEQ ID NO: 954823 - DNA, 25 bp, Mus musculus
ggtggacacagcaacagatttagtt

SEQ ID NO: 954824 - DNA, 25 bp, Mus musculus
ggtggacacagcaagagatttagtt

SEQ ID NO: 954825 - DNA, 25 bp, Mus musculus
ggtggacagattgcagtttttgatg

SEQ ID NO: 954826 - DNA, 25 bp, Mus musculus
ggtggacagattgctgtttttgatg

SEQ ID NO: 954827 - DNA, 25 bp, Mus musculus
ggtggacagcatctcaatggaatta

SEQ ID NO: 954828 - DNA, 25 bp, Mus musculus
ggtggacagcatgtcaatggaatta

SEQ ID NO: 954829 - DNA, 25 bp, Mus musculus
ggtggacggcaggacgtggtagatt

SEQ ID NO: 954830 - DNA, 25 bp, Mus musculus
ggtggacggcaggaggtggtagatt

SEQ ID NO: 954831 - DNA, 25 bp, Mus musculus
ggtggacggccacggaagtctcgtg

SEQ ID NO: 954832 - DNA, 25 bp, Mus musculus
ggtggacggccagggaagtctcgtg

SEQ ID NO: 954833 - DNA, 25 bp, Mus musculus
ggtggacggggacgtgctgaggact

SEQ ID NO: 954834 - DNA, 25 bp, Mus musculus
ggtggacggggaggtgctgaggact

SEQ ID NO: 954835 - DNA, 25 bp, Mus musculus
ggtggactccctggaagccatgacc

SEQ ID NO: 954836 - DNA, 25 bp, Mus musculus
ggtggactccctggtagccatgacc

SEQ ID NO: 954837 - DNA, 25 bp, Mus musculus
ggtggactgtcacactgctgggctg

SEQ ID NO: 954838 - DNA, 25 bp, Mus musculus
ggtggactgtcacgattctctttca

SEQ ID NO: 954839 - DNA, 25 bp, Mus musculus
ggtggactgtcagactgctgggctg

SEQ ID NO: 954840 - DNA, 25 bp, Mus musculus
ggtggactgtcaggattctctttca

SEQ ID NO: 954841 - DNA, 25 bp, Mus musculus
ggtggagaagcccaaggggaatcct

SEQ ID NO: 954842 - DNA, 25 bp, Mus musculus
ggtggagaagccttactgctcccac

SEQ ID NO: 954843 - DNA, 25 bp, Mus musculus
ggtggagaaggccaaggggaatcct

SEQ ID NO: 954844 - DNA, 25 bp, Mus musculus
ggtggagaaggcttactgctcccac

SEQ ID NO: 954845 - DNA, 25 bp, Mus musculus
ggtggagaatttctcaaagtgcaac

SEQ ID NO: 954846 - DNA, 25 bp, Mus musculus
ggtggagaatttctgaaagtgcaac

SEQ ID NO: 954847 - DNA, 25 bp, Mus musculus
ggtggagacacacaccactgaggaa

SEQ ID NO: 954848 - DNA, 25 bp, Mus musculus
ggtggagacacacacgctgttccgg

SEQ ID NO: 954849 - DNA, 25 bp, Mus musculus
ggtggagacacagaccactgaggaa

SEQ ID NO: 954850 - DNA, 25 bp, Mus musculus
ggtggagacacagacgctgttccgg

SEQ ID NO: 954851 - DNA, 25 bp, Mus musculus
ggtggagaccaacatccgactcagt

SEQ ID NO: 954852 - DNA, 25 bp, Mus musculus
ggtggagaccaagatccgactcagt

SEQ ID NO: 954853 - DNA, 25 bp, Mus musculus
ggtggagaccagcatgattgggctg

SEQ ID NO: 954854 - DNA, 25 bp, Mus musculus
ggtggagaccaggatgattgggctg

SEQ ID NO: 954855 - DNA, 25 bp, Mus musculus
ggtggagacgccttgtccggatgtc

SEQ ID NO: 954856 - DNA, 25 bp, Mus musculus
ggtggagacggcttgtccggatgtc

SEQ ID NO: 954857 - DNA, 25 bp, Mus musculus
ggtggagaggaaaccatcctggggc

SEQ ID NO: 954858 - DNA, 25 bp, Mus musculus
ggtggagaggaaacgatcctggggc

SEQ ID NO: 954859 - DNA, 25 bp, Mus musculus
ggtggagatgcacgacagtgacata

SEQ ID NO: 954860 - DNA, 25 bp, Mus musculus
ggtggagatgcttgaaaatgatatt

SEQ ID NO: 954861 - DNA, 25 bp, Mus musculus
ggtggagatggacgacagtgacata

SEQ ID NO: 954862 - DNA, 25 bp, Mus musculus
ggtggagatggttgaaaatgatatt

SEQ ID NO: 954863 - DNA, 25 bp, Mus musculus
ggtggagcagaccggtcgaggcgag

SEQ ID NO: 954864 - DNA, 25 bp, Mus musculus
ggtggagcagacgggtcgaggcgag

SEQ ID NO: 954865 - DNA, 25 bp, Mus musculus
ggtggagcaggacaagctggcctca

SEQ ID NO: 954866 - DNA, 25 bp, Mus musculus
ggtggagcaggacaagtttgcacac

SEQ ID NO: 954867 - DNA, 25 bp, Mus musculus
ggtggagcaggacatgctggcctca

SEQ ID NO: 954868 - DNA, 25 bp, Mus musculus
ggtggagcaggacatgtttgcacac

SEQ ID NO: 954869 - DNA, 25 bp, Mus musculus
ggtggagcccaactttcagccatgg

SEQ ID NO: 954870 - DNA, 25 bp, Mus musculus
ggtggagcccaagtttcagccatgg

SEQ ID NO: 954871 - DNA, 25 bp, Mus musculus
ggtggagctgcacggatacaaactg

SEQ ID NO: 954872 - DNA, 25 bp, Mus musculus
ggtggagctgcagggatacaaactg

SEQ ID NO: 954873 - DNA, 25 bp, Mus musculus
ggtggaggaggaaaaggcatgagga

SEQ ID NO: 954874 - DNA, 25 bp, Mus musculus
ggtggaggaggaaatggcatgagga

SEQ ID NO: 954875 - DNA, 25 bp, Mus musculus
ggtggaggcagtagtctgctacaga

SEQ ID NO: 954876 - DNA, 25 bp, Mus musculus
ggtggaggcagtctgcaaatagtct

SEQ ID NO: 954877 - DNA, 25 bp, Mus musculus
ggtggaggcagtgtgcaaatagtct

SEQ ID NO: 954878 - DNA, 25 bp, Mus musculus
ggtggaggcagttgtctgctacaga

SEQ ID NO: 954879 - DNA, 25 bp, Mus musculus
ggtggagtattctgcttcagtctcc

SEQ ID NO: 954880 - DNA, 25 bp, Mus musculus
ggtggagtattctggttcagtctcc

SEQ ID NO: 954881 - DNA, 25 bp, Mus musculus
ggtggatctgaataagtgcggacct

SEQ ID NO: 954882 - DNA, 25 bp, Mus musculus
ggtggatctgaatatgtgcggacct

SEQ ID NO: 954883 - DNA, 25 bp, Mus musculus
ggtggatgaggtcacatatgggggc

SEQ ID NO: 954884 - DNA, 25 bp, Mus musculus
ggtggatgaggtcagatatgggggc

SEQ ID NO: 954885 - DNA, 25 bp, Mus musculus
ggtggatgtgcacgcaatgaagaga

SEQ ID NO: 954886 - DNA, 25 bp, Mus musculus
ggtggatgtgcaggcaatgaagaga

SEQ ID NO: 954887 - DNA, 25 bp, Mus musculus
ggtggattggaactcgtatgatgtc

SEQ ID NO: 954888 - DNA, 25 bp, Mus musculus
ggtggattggaactggtatgatgtc

SEQ ID NO: 954889 - DNA, 25 bp, Mus musculus
ggtggcaaagaaccagcattttgac

SEQ ID NO: 954890 - DNA, 25 bp, Mus musculus
ggtggcaaagtaccagcattttgac

SEQ ID NO: 954891 - DNA, 25 bp, Mus musculus
ggtggcaatcaagacgatgaagaga

SEQ ID NO: 954892 - DNA, 25 bp, Mus musculus
ggtggcaatcaagaggatgaagaga

SEQ ID NO: 954893 - DNA, 25 bp, Mus musculus
ggtggcacgtgacgtggtgatggag

SEQ ID NO: 954894 - DNA, 25 bp, Mus musculus
ggtggcacgtgaggtggtgatggag

SEQ ID NO: 954895 - DNA, 25 bp, Mus musculus
ggtggcagatgacacgctgctcagg

SEQ ID NO: 954896 - DNA, 25 bp, Mus musculus
ggtggcagatgacaggctgctcagg

SEQ ID NO: 954897 - DNA, 25 bp, Mus musculus
ggtggcagggataaggcagcttctg

SEQ ID NO: 954898 - DNA, 25 bp, Mus musculus
ggtggcagggttaaggcagcttctg

SEQ ID NO: 954899 - DNA, 25 bp, Mus musculus
ggtggcagttcacggaggaatcatg

SEQ ID NO: 954900 - DNA, 25 bp, Mus musculus
ggtggcagttcagggaggaatcatg

SEQ ID NO: 954901 - DNA, 25 bp, Mus musculus
ggtggccacgatgctgtatactggc

SEQ ID NO: 954902 - DNA, 25 bp, Mus musculus
ggtggccacgttgctgtatactggc

SEQ ID NO: 954903 - DNA, 25 bp, Mus musculus
ggtggccatgctctgggaaggcccc

SEQ ID NO: 954904 - DNA, 25 bp, Mus musculus
ggtggccatggtctgggaaggcccc

SEQ ID NO: 954905 - DNA, 25 bp, Mus musculus
ggtggccgacagagtgcttgggatc

SEQ ID NO: 954906 - DNA, 25 bp, Mus musculus
ggtggccgacagtgtgcttgggatc

SEQ ID NO: 954907 - DNA, 25 bp, Mus musculus
ggtggcgtagccctgggctgcttct

SEQ ID NO: 954908 - DNA, 25 bp, Mus musculus
ggtggcgtaggcctgggctgcttct

SEQ ID NO: 954909 - DNA, 25 bp, Mus musculus
ggtggctcaatgatccttccttcat

SEQ ID NO: 954910 - DNA, 25 bp, Mus musculus
ggtggctcaatgttccttccttcat

SEQ ID NO: 954911 - DNA, 25 bp, Mus musculus
ggtggctgcccgccatgactgctgc

SEQ ID NO: 954912 - DNA, 25 bp, Mus musculus
ggtggctgccggccatgactgctgc

SEQ ID NO: 954913 - DNA, 25 bp, Mus musculus
ggtggctgtgaacacgctgaaggac

SEQ ID NO: 954914 - DNA, 25 bp, Mus musculus
ggtggctgtgaagacgctgaaggac

SEQ ID NO: 954915 - DNA, 25 bp, Mus musculus
ggtggctgttttgcccaaaacacgg

SEQ ID NO: 954916 - DNA, 25 bp, Mus musculus
ggtggctgttttgcgcaaaacacgg

SEQ ID NO: 954917 - DNA, 25 bp, Mus musculus
ggtggcttatctcatccctatgtaa

SEQ ID NO: 954918 - DNA, 25 bp, Mus musculus
ggtggcttatctgatccctatgtaa

SEQ ID NO: 954919 - DNA, 25 bp, Mus musculus
ggtggcttgttactggcactgtcac

SEQ ID NO: 954920 - DNA, 25 bp, Mus musculus
ggtggcttgttagtggcactgtcac

SEQ ID NO: 954921 - DNA, 25 bp, Mus musculus
ggtggctttgagccctacgagggtg

SEQ ID NO: 954922 - DNA, 25 bp, Mus musculus
ggtggctttgaggcctacgagggtg

SEQ ID NO: 954923 - DNA, 25 bp, Mus musculus
ggtgggagccaccgtggagttcaca

SEQ ID NO: 954924 - DNA, 25 bp, Mus musculus
ggtgggagccacggtggagttcaca

SEQ ID NO: 954925 - DNA, 25 bp, Mus musculus
ggtgggaggcaggacgagtttcgga

SEQ ID NO: 954926 - DNA, 25 bp, Mus musculus
ggtgggaggcaggaggagtttcgga

SEQ ID NO: 954927 - DNA, 25 bp, Mus musculus
ggtgggagtactatcactcagtgta

SEQ ID NO: 954928 - DNA, 25 bp, Mus musculus
ggtgggagtactatgactcagtgta

SEQ ID NO: 954929 - DNA, 25 bp, Mus musculus
ggtgggcaggcttcattctgacatt

SEQ ID NO: 954930 - DNA, 25 bp, Mus musculus
ggtgggcagggttcattctgacatt

SEQ ID NO: 954931 - DNA, 25 bp, Mus musculus
ggtgggctaccacattttgttcgga

SEQ ID NO: 954932 - DNA, 25 bp, Mus musculus
ggtgggctaccactggttgtcccca

SEQ ID NO: 954933 - DNA, 25 bp, Mus musculus
ggtgggctaccagattttgttcgga

SEQ ID NO: 954934 - DNA, 25 bp, Mus musculus
ggtgggctaccagtggttgtcccca

SEQ ID NO: 954935 - DNA, 25 bp, Mus musculus
ggtgggcttccgagccttctctggt

SEQ ID NO: 954936 - DNA, 25 bp, Mus musculus
ggtgggcttccgtgccttctctggt

SEQ ID NO: 954937 - DNA, 25 bp, Mus musculus
ggtggggatccgcacacagctgagt

SEQ ID NO: 954938 - DNA, 25 bp, Mus musculus
ggtggggatccggacacagctgagt

SEQ ID NO: 954939 - DNA, 25 bp, Mus musculus
ggtggggccgagcaaccatgaaggt

SEQ ID NO: 954940 - DNA, 25 bp, Mus musculus
ggtggggccgaggaaccatgaaggt

SEQ ID NO: 954941 - DNA, 25 bp, Mus musculus
ggtggggctatgcacatggctatga

SEQ ID NO: 954942 - DNA, 25 bp, Mus musculus
ggtggggctatgcagatggctatga

SEQ ID NO: 954943 - DNA, 25 bp, Mus musculus
ggtggggtcctccacggctctttca

SEQ ID NO: 954944 - DNA, 25 bp, Mus musculus
ggtggggtcctccagggctctttca

SEQ ID NO: 954945 - DNA, 25 bp, Mus musculus
ggtgggtttcagactttgaatacct

SEQ ID NO: 954946 - DNA, 25 bp, Mus musculus
ggtgggtttcagtctttgaatacct

SEQ ID NO: 954947 - DNA, 25 bp, Mus musculus
ggtggtaaagagagacatcctgtat

SEQ ID NO: 954948 - DNA, 25 bp, Mus musculus
ggtggtaaagagtgacatcctgtat

SEQ ID NO: 954949 - DNA, 25 bp, Mus musculus
ggtggtagtgctggctatggcggtt

SEQ ID NO: 954950 - DNA, 25 bp, Mus musculus
ggtggtagtggtggctatggcggtt

SEQ ID NO: 954951 - DNA, 25 bp, Mus musculus
ggtggtccagcaatggcctgccaat

SEQ ID NO: 954952 - DNA, 25 bp, Mus musculus
ggtggtccaggaatggcctgccaat

SEQ ID NO: 954953 - DNA, 25 bp, Mus musculus
ggtggtccccgactttgcaaatgca

SEQ ID NO: 954954 - DNA, 25 bp, Mus musculus
ggtggtccccgagtttgcaaatgca

SEQ ID NO: 954955 - DNA, 25 bp, Mus musculus
ggtggtcctgggcccatcagctcca

SEQ ID NO: 954956 - DNA, 25 bp, Mus musculus
ggtggtcctgggctacaatggtgct

SEQ ID NO: 954957 - DNA, 25 bp, Mus musculus
ggtggtcctggggccatcagctcca

SEQ ID NO: 954958 - DNA, 25 bp, Mus musculus
ggtggtcctggggtacaatggtgct

SEQ ID NO: 954959 - DNA, 25 bp, Mus musculus
ggtggtgaagctcattgcacagcac

SEQ ID NO: 954960 - DNA, 25 bp, Mus musculus
ggtggtgaaggtcattgcacagcac

SEQ ID NO: 954961 - DNA, 25 bp, Mus musculus
ggtggtgacgatctgggcttcagga

SEQ ID NO: 954962 - DNA, 25 bp, Mus musculus
ggtggtgacgttctgggcttcagga

SEQ ID NO: 954963 - DNA, 25 bp, Mus musculus
ggtggtgatcagcgaccagtaccgg

SEQ ID NO: 954964 - DNA, 25 bp, Mus musculus
ggtggtgatctgcgaccagtaccgg

SEQ ID NO: 954965 - DNA, 25 bp, Mus musculus
ggtggtgcagcagatcccccaagag

SEQ ID NO: 954966 - DNA, 25 bp, Mus musculus
ggtggtgcaggagatcccccaagag

SEQ ID NO: 954967 - DNA, 25 bp, Mus musculus
ggtggtgccctccacctccaccacc

SEQ ID NO: 954968 - DNA, 25 bp, Mus musculus
ggtggtgccctccacgccagctcca

SEQ ID NO: 954969 - DNA, 25 bp, Mus musculus
ggtggtgccctccagctccaccacc

SEQ ID NO: 954970 - DNA, 25 bp, Mus musculus
ggtggtgccctccaggccagctcca

SEQ ID NO: 954971 - DNA, 25 bp, Mus musculus
ggtggtggagaacgcttactgctcc

SEQ ID NO: 954972 - DNA, 25 bp, Mus musculus
ggtggtggagaaggcttactgctcc

SEQ ID NO: 954973 - DNA, 25 bp, Mus musculus
ggtggtggagatcgttgaaaatgat

SEQ ID NO: 954974 - DNA, 25 bp, Mus musculus
ggtggtggagatggttgaaaatgat

SEQ ID NO: 954975 - DNA, 25 bp, Mus musculus
ggtggtggagtgcacctgtcaagcc

SEQ ID NO: 954976 - DNA, 25 bp, Mus musculus
ggtggtggagtggacctgtcaagcc

SEQ ID NO: 954977 - DNA, 25 bp, Mus musculus
ggtggttatctgcgtatcctagaat

SEQ ID NO: 954978 - DNA, 25 bp, Mus musculus
ggtggttatctgggtatcctagaat

SEQ ID NO: 954979 - DNA, 25 bp, Mus musculus
ggtggttcagctgaccccatattta

SEQ ID NO: 954980 - DNA, 25 bp, Mus musculus
ggtggttcaggtgaccccatattta

SEQ ID NO: 954981 - DNA, 25 bp, Mus musculus
ggtggttctgaaacgaagtgagaag

SEQ ID NO: 954982 - DNA, 25 bp, Mus musculus
ggtggttctgagccaacaggagcag

SEQ ID NO: 954983 - DNA, 25 bp, Mus musculus
ggtggttctgaggcaacaggagcag

SEQ ID NO: 954984 - DNA, 25 bp, Mus musculus
ggtggttctgtaacgaagtgagaag

SEQ ID NO: 954985 - DNA, 25 bp, Mus musculus
ggtggttgcaagaaactagtaaaga

SEQ ID NO: 954986 - DNA, 25 bp, Mus musculus
ggtggttgcaagtaactagtaaaga

SEQ ID NO: 954987 - DNA, 25 bp, Mus musculus
ggtggtttcctgcctggtcctggct

SEQ ID NO: 954988 - DNA, 25 bp, Mus musculus
ggtggtttcctggctggtcctggct

SEQ ID NO: 954989 - DNA, 25 bp, Mus musculus
ggtgtacaagatacttgggggcttt

SEQ ID NO: 954990 - DNA, 25 bp, Mus musculus
ggtgtacaagttacttgggggcttt

SEQ ID NO: 954991 - DNA, 25 bp, Mus musculus
ggtgtacaatgaaaatcttgttcat

SEQ ID NO: 954992 - DNA, 25 bp, Mus musculus
ggtgtacaatgacaaacatattcaa

SEQ ID NO: 954993 - DNA, 25 bp, Mus musculus
ggtgtacaatgagaaacatattcaa

SEQ ID NO: 954994 - DNA, 25 bp, Mus musculus
ggtgtacaatgataatcttgttcat

SEQ ID NO: 954995 - DNA, 25 bp, Mus musculus
ggtgtatgaaagcctgtcagccgga

SEQ ID NO: 954996 - DNA, 25 bp, Mus musculus
ggtgtatgaaaggctgtcagccgga

SEQ ID NO: 954997 - DNA, 25 bp, Mus musculus
ggtgtcaaccagcaacctggctcac

SEQ ID NO: 954998 - DNA, 25 bp, Mus musculus
ggtgtcaaccaggaacctggctcac

SEQ ID NO: 954999 - DNA, 25 bp, Mus musculus
ggtgtcacaagaaacaagagccaag

SEQ ID NO: 955000 - DNA, 25 bp, Mus musculus
ggtgtcacaagaaagaagagccaag

SEQ ID NO: 955001 - DNA, 25 bp, Mus musculus
ggtgtcagagaacgaagcagcggtg

SEQ ID NO: 955002 - DNA, 25 bp, Mus musculus
ggtgtcagagaactatccctgggag

SEQ ID NO: 955003 - DNA, 25 bp, Mus musculus
ggtgtcagagaaggaagcagcggtg

SEQ ID NO: 955004 - DNA, 25 bp, Mus musculus
ggtgtcagagaagtatccctgggag

SEQ ID NO: 955005 - DNA, 25 bp, Mus musculus
ggtgtcagcgggaacagcagtggtg

SEQ ID NO: 955006 - DNA, 25 bp, Mus musculus
ggtgtcagcgggtacagcagtggtg

SEQ ID NO: 955007 - DNA, 25 bp, Mus musculus
ggtgtcagctgccaacggacaaggc

SEQ ID NO: 955008 - DNA, 25 bp, Mus musculus
ggtgtcagctgccatcggacaaggc

SEQ ID NO: 955009 - DNA, 25 bp, Mus musculus
ggtgtcatccacagaatcctagact

SEQ ID NO: 955010 - DNA, 25 bp, Mus musculus
ggtgtcatccacagagacttgaagc

SEQ ID NO: 955011 - DNA, 25 bp, Mus musculus
ggtgtcatccacagtatcctagact

SEQ ID NO: 955012 - DNA, 25 bp, Mus musculus
ggtgtcatccacagtgacttgaagc

SEQ ID NO: 955013 - DNA, 25 bp, Mus musculus
ggtgtcatcgcgcgactcagtcttg

SEQ ID NO: 955014 - DNA, 25 bp, Mus musculus
ggtgtcatcgcgggactcagtcttg

SEQ ID NO: 955015 - DNA, 25 bp, Mus musculus
ggtgtcattctgaacatgatgctgt

SEQ ID NO: 955016 - DNA, 25 bp, Mus musculus
ggtgtcattctgtacatgatgctgt

SEQ ID NO: 955017 - DNA, 25 bp, Mus musculus
ggtgtccaccaaaacgaggatactc

SEQ ID NO: 955018 - DNA, 25 bp, Mus musculus
ggtgtccaccaaaaggaggatactc

SEQ ID NO: 955019 - DNA, 25 bp, Mus musculus
ggtgtccagagacttgtgtggccat

SEQ ID NO: 955020 - DNA, 25 bp, Mus musculus
ggtgtccagagagttgtgtggccat

SEQ ID NO: 955021 - DNA, 25 bp, Mus musculus
ggtgtccaggaaaacctctggattt

SEQ ID NO: 955022 - DNA, 25 bp, Mus musculus
ggtgtccaggaatacctctggattt

SEQ ID NO: 955023 - DNA, 25 bp, Mus musculus
ggtgtccatttccacttctctaccc

SEQ ID NO: 955024 - DNA, 25 bp, Mus musculus
ggtgtccatttcgacttctctaccc

SEQ ID NO: 955025 - DNA, 25 bp, Mus musculus
ggtgtccccaagctctgcatcctga

SEQ ID NO: 955026 - DNA, 25 bp, Mus musculus
ggtgtccccaaggtctgcatcctga

SEQ ID NO: 955027 - DNA, 25 bp, Mus musculus
ggtgtccctcagacgagccccgttg

SEQ ID NO: 955028 - DNA, 25 bp, Mus musculus
ggtgtccctcagctggccccttctg

SEQ ID NO: 955029 - DNA, 25 bp, Mus musculus
ggtgtccctcaggtggccccttctg

SEQ ID NO: 955030 - DNA, 25 bp, Mus musculus
ggtgtccctcagtcgagccccgttg

SEQ ID NO: 955031 - DNA, 25 bp, Mus musculus
ggtgtccgagagtcctgcaggtctt

SEQ ID NO: 955032 - DNA, 25 bp, Mus musculus
ggtgtccgagatgcatgctgttctg

SEQ ID NO: 955033 - DNA, 25 bp, Mus musculus
ggtgtccgagctcttcagattacaa

SEQ ID NO: 955034 - DNA, 25 bp, Mus musculus
ggtgtccgaggtcttcagattacaa

SEQ ID NO: 955035 - DNA, 25 bp, Mus musculus
ggtgtccgagtgtcctgcaggtctt

SEQ ID NO: 955036 - DNA, 25 bp, Mus musculus
ggtgtccgagttgcatgctgttctg

SEQ ID NO: 955037 - DNA, 25 bp, Mus musculus
ggtgtcctagcccacagaaggaccc

SEQ ID NO: 955038 - DNA, 25 bp, Mus musculus
ggtgtcctaggccacagaaggaccc

SEQ ID NO: 955039 - DNA, 25 bp, Mus musculus
ggtgtccttcactcaagcccatcca

SEQ ID NO: 955040 - DNA, 25 bp, Mus musculus
ggtgtccttcactctagcccatcca

SEQ ID NO: 955041 - DNA, 25 bp, Mus musculus
ggtgtcgatatgcaaaggcgccgat

SEQ ID NO: 955042 - DNA, 25 bp, Mus musculus
ggtgtcgatatggaaaggcgccgat

SEQ ID NO: 955043 - DNA, 25 bp, Mus musculus
ggtgtcgcccagctgaagatcatga

SEQ ID NO: 955044 - DNA, 25 bp, Mus musculus
ggtgtcgcccaggtgaagatcatga

SEQ ID NO: 955045 - DNA, 25 bp, Mus musculus
ggtgtcgcggagcacggagacgggt

SEQ ID NO: 955046 - DNA, 25 bp, Mus musculus
ggtgtcgcggtgcacggagacgggt

SEQ ID NO: 955047 - DNA, 25 bp, Mus musculus
ggtgtctcggccttctgggccttct

SEQ ID NO: 955048 - DNA, 25 bp, Mus musculus
ggtgtctcgggcttctgggccttct

SEQ ID NO: 955049 - DNA, 25 bp, Mus musculus
ggtgtctctgcgggccacatcaacc

SEQ ID NO: 955050 - DNA, 25 bp, Mus musculus
ggtgtctctgggggccacatcaacc

SEQ ID NO: 955051 - DNA, 25 bp, Mus musculus
ggtgtctgtgagctctgtcagcagc

SEQ ID NO: 955052 - DNA, 25 bp, Mus musculus
ggtgtctgtgaggtctgtcagcagc

SEQ ID NO: 955053 - DNA, 25 bp, Mus musculus
ggtgtcttccagatcctgctccgga

SEQ ID NO: 955054 - DNA, 25 bp, Mus musculus
ggtgtcttccagttcctgctccgga

SEQ ID NO: 955055 - DNA, 25 bp, Mus musculus
ggtgtcttcctgcataacctgtgga

SEQ ID NO: 955056 - DNA, 25 bp, Mus musculus
ggtgtcttcctggataacctgtgga

SEQ ID NO: 955057 - DNA, 25 bp, Mus musculus
ggtgtgaatatgcaccactccacaa

SEQ ID NO: 955058 - DNA, 25 bp, Mus musculus
ggtgtgaatatggaccactccacaa

SEQ ID NO: 955059 - DNA, 25 bp, Mus musculus
ggtgtgactgagatggccgccccat

SEQ ID NO: 955060 - DNA, 25 bp, Mus musculus
ggtgtgactgagttggccgccccat

SEQ ID NO: 955061 - DNA, 25 bp, Mus musculus
ggtgtgagcactcgtgtcgtcagcc

SEQ ID NO: 955062 - DNA, 25 bp, Mus musculus
ggtgtgagcactggtgtcgtcagcc

SEQ ID NO: 955063 - DNA, 25 bp, Mus musculus
ggtgtgcaagcaggggtggctgtga

SEQ ID NO: 955064 - DNA, 25 bp, Mus musculus
ggtgtgcaaggaggggtggctgtga

SEQ ID NO: 955065 - DNA, 25 bp, Mus musculus
ggtgtgcacactgtttccctgttta

SEQ ID NO: 955066 - DNA, 25 bp, Mus musculus
ggtgtgcacagtgtttccctgttta

SEQ ID NO: 955067 - DNA, 25 bp, Mus musculus
ggtgtgcatacccgtcggttgtaat

SEQ ID NO: 955068 - DNA, 25 bp, Mus musculus
ggtgtgcataccggtcggttgtaat

SEQ ID NO: 955069 - DNA, 25 bp, Mus musculus
ggtgtgcgaccacatctgctgctta

SEQ ID NO: 955070 - DNA, 25 bp, Mus musculus
ggtgtgcgaccacgtgtctgcctgt

SEQ ID NO: 955071 - DNA, 25 bp, Mus musculus
ggtgtgcgaccagatctgctgctta

SEQ ID NO: 955072 - DNA, 25 bp, Mus musculus
ggtgtgcgaccaggtgtctgcctgt

SEQ ID NO: 955073 - DNA, 25 bp, Mus musculus
ggtgtgcgcatactgcctcgacttc

SEQ ID NO: 955074 - DNA, 25 bp, Mus musculus
ggtgtgcgcatagtgcctcgacttc

SEQ ID NO: 955075 - DNA, 25 bp, Mus musculus
ggtgtgctccagcctggacagtatg

SEQ ID NO: 955076 - DNA, 25 bp, Mus musculus
ggtgtgctccaggctggacagtatg

SEQ ID NO: 955077 - DNA, 25 bp, Mus musculus
ggtgtggaagagatgaaccggacaa

SEQ ID NO: 955078 - DNA, 25 bp, Mus musculus
ggtgtggaagagttgaaccggacaa

SEQ ID NO: 955079 - DNA, 25 bp, Mus musculus
ggtgtgggacaacgttttgagcatt

SEQ ID NO: 955080 - DNA, 25 bp, Mus musculus
ggtgtgggacaaggttttgagcatt

SEQ ID NO: 955081 - DNA, 25 bp, Mus musculus
ggtgtggtctcgccggcccttcgga

SEQ ID NO: 955082 - DNA, 25 bp, Mus musculus
ggtgtggtctcggcggcccttcgga

SEQ ID NO: 955083 - DNA, 25 bp, Mus musculus
ggtgtggtggcccgttggagcctct

SEQ ID NO: 955084 - DNA, 25 bp, Mus musculus
ggtgtggtggccggttggagcctct

SEQ ID NO: 955085 - DNA, 25 bp, Mus musculus
ggtgtgtccattcgggaagacgggc

SEQ ID NO: 955086 - DNA, 25 bp, Mus musculus
ggtgtgtccattggggaagacgggc

SEQ ID NO: 955087 - DNA, 25 bp, Mus musculus
ggtgtgtggcagcaaagaaatgctg

SEQ ID NO: 955088 - DNA, 25 bp, Mus musculus
ggtgtgtggcaggaaagaaatgctg

SEQ ID NO: 955089 - DNA, 25 bp, Mus musculus
ggtgtgtttgagcagatttctaata

SEQ ID NO: 955090 - DNA, 25 bp, Mus musculus
ggtgtgtttgaggagatttctaata

SEQ ID NO: 955091 - DNA, 25 bp, Mus musculus
ggtgttaagaagcaaatgatccggc

SEQ ID NO: 955092 - DNA, 25 bp, Mus musculus
ggtgttaagaaggaaatgatccggc

SEQ ID NO: 955093 - DNA, 25 bp, Mus musculus
ggtgttaccaagcctgcagagaagc

SEQ ID NO: 955094 - DNA, 25 bp, Mus musculus
ggtgttaccaaggctgcagagaagc

SEQ ID NO: 955095 - DNA, 25 bp, Mus musculus
ggtgttattgcaccattcatggcat

SEQ ID NO: 955096 - DNA, 25 bp, Mus musculus
ggtgttattgcagcattcatggcat

SEQ ID NO: 955097 - DNA, 25 bp, Mus musculus
ggtgttcaatctcaccagggacaac

SEQ ID NO: 955098 - DNA, 25 bp, Mus musculus
ggtgttcaatgtcaccagggacaac

SEQ ID NO: 955099 - DNA, 25 bp, Mus musculus
ggtgttccagcagcgcatcaactgt

SEQ ID NO: 955100 - DNA, 25 bp, Mus musculus
ggtgttccagctaggtgcatgagcc

SEQ ID NO: 955101 - DNA, 25 bp, Mus musculus
ggtgttccaggagcgcatcaactgt

SEQ ID NO: 955102 - DNA, 25 bp, Mus musculus
ggtgttccaggtaggtgcatgagcc

SEQ ID NO: 955103 - DNA, 25 bp, Mus musculus
ggtgttccgagaaacgtgataattg

SEQ ID NO: 955104 - DNA, 25 bp, Mus musculus
ggtgttccgagaaaggtgataattg

SEQ ID NO: 955105 - DNA, 25 bp, Mus musculus
ggtgttcgagcactctgccgctatc

SEQ ID NO: 955106 - DNA, 25 bp, Mus musculus
ggtgttcgaggactctgccgctatc

SEQ ID NO: 955107 - DNA, 25 bp, Mus musculus
ggtgttcgtgcgctcttttgatgga

SEQ ID NO: 955108 - DNA, 25 bp, Mus musculus
ggtgttcgtgcggtcttttgatgga

SEQ ID NO: 955109 - DNA, 25 bp, Mus musculus
ggtgttgcagacaaatgggtcggcg

SEQ ID NO: 955110 - DNA, 25 bp, Mus musculus
ggtgttgcagtcaaatgggtcggcg

SEQ ID NO: 955111 - DNA, 25 bp, Mus musculus
ggtgttggagactgaatgccagcac

SEQ ID NO: 955112 - DNA, 25 bp, Mus musculus
ggtgttggagcaagtaaagctctac

SEQ ID NO: 955113 - DNA, 25 bp, Mus musculus
ggtgttggagcagactgaatgccag

SEQ ID NO: 955114 - DNA, 25 bp, Mus musculus
ggtgttggagcccctgggaacaagc

SEQ ID NO: 955115 - DNA, 25 bp, Mus musculus
ggtgttggagctctgtgatacatgg

SEQ ID NO: 955116 - DNA, 25 bp, Mus musculus
ggtgttggaggaagtaaagctctac

SEQ ID NO: 955117 - DNA, 25 bp, Mus musculus
ggtgttggaggagactgaatgccag

SEQ ID NO: 955118 - DNA, 25 bp, Mus musculus
ggtgttggaggccctgggaacaagc

SEQ ID NO: 955119 - DNA, 25 bp, Mus musculus
ggtgttggaggtctgtgatacatgg

SEQ ID NO: 955120 - DNA, 25 bp, Mus musculus
ggtgttggagtctgaatgccagcac

SEQ ID NO: 955121 - DNA, 25 bp, Mus musculus
ggtgttggcttgtgctctatgttca

SEQ ID NO: 955122 - DNA, 25 bp, Mus musculus
ggtgttggcttgtggtctatgttca

SEQ ID NO: 955123 - DNA, 25 bp, Mus musculus
ggtgttgtcctgccagatggaagta

SEQ ID NO: 955124 - DNA, 25 bp, Mus musculus
ggtgttgtcctggcagatggaagta

SEQ ID NO: 955125 - DNA, 25 bp, Mus musculus
ggttaaccatgacccggaactgtgg

SEQ ID NO: 955126 - DNA, 25 bp, Mus musculus
ggttaaccatgaccgggaactgtgg

SEQ ID NO: 955127 - DNA, 25 bp, Mus musculus
ggttaagcctgtgtcgagtggtttt

SEQ ID NO: 955128 - DNA, 25 bp, Mus musculus
ggttaagcctgtgtggagtggtttt

SEQ ID NO: 955129 - DNA, 25 bp, Mus musculus
ggttaaggttgcaaccttgctggtg

SEQ ID NO: 955130 - DNA, 25 bp, Mus musculus
ggttaaggttgcaagcttgctggtg

SEQ ID NO: 955131 - DNA, 25 bp, Mus musculus
ggttacaaaaagatgttcgcagatg

SEQ ID NO: 955132 - DNA, 25 bp, Mus musculus
ggttacaaaaagttgttcgcagatg

SEQ ID NO: 955133 - DNA, 25 bp, Mus musculus
ggttacactgcgtggagttccagaa

SEQ ID NO: 955134 - DNA, 25 bp, Mus musculus
ggttacactgggtggagttccagaa

SEQ ID NO: 955135 - DNA, 25 bp, Mus musculus
ggttacctaagagacgtgagcgctt

SEQ ID NO: 955136 - DNA, 25 bp, Mus musculus
ggttacctaagagaggtgagcgctt

SEQ ID NO: 955137 - DNA, 25 bp, Mus musculus
ggttacgaagtgatgggagtctgat

SEQ ID NO: 955138 - DNA, 25 bp, Mus musculus
ggttacgaagtgttgggagtctgat

SEQ ID NO: 955139 - DNA, 25 bp, Mus musculus
ggttacgatgaacactgccaaagtg

SEQ ID NO: 955140 - DNA, 25 bp, Mus musculus
ggttacgatgaacgctgtcatggta

SEQ ID NO: 955141 - DNA, 25 bp, Mus musculus
ggttacgatgaagactgccaaagtg

SEQ ID NO: 955142 - DNA, 25 bp, Mus musculus
ggttacgatgaaggctgtcatggta

SEQ ID NO: 955143 - DNA, 25 bp, Mus musculus
ggttactgcagtccatgagtcgggt

SEQ ID NO: 955144 - DNA, 25 bp, Mus musculus
ggttactgcagtgcatgagtcgggt

SEQ ID NO: 955145 - DNA, 25 bp, Mus musculus
ggttagacttggatccttgggatgc

SEQ ID NO: 955146 - DNA, 25 bp, Mus musculus
ggttagacttggatgcttgggatgc

SEQ ID NO: 955147 - DNA, 25 bp, Mus musculus
ggttagtggaagaaagcacattgta

SEQ ID NO: 955148 - DNA, 25 bp, Mus musculus
ggttagtggaagaatgcacattgta

SEQ ID NO: 955149 - DNA, 25 bp, Mus musculus
ggttataagagccagaggaggggaa

SEQ ID NO: 955150 - DNA, 25 bp, Mus musculus
ggttataagagcgagaggaggggaa

SEQ ID NO: 955151 - DNA, 25 bp, Mus musculus
ggttatcctatgcacactcatgaac

SEQ ID NO: 955152 - DNA, 25 bp, Mus musculus
ggttatcctatgcagactcatgaac

SEQ ID NO: 955153 - DNA, 25 bp, Mus musculus
ggttatctggctatcctagaatgga

SEQ ID NO: 955154 - DNA, 25 bp, Mus musculus
ggttatctgggtatcctagaatgga

SEQ ID NO: 955155 - DNA, 25 bp, Mus musculus
ggttatgaagctccccggatccctc

SEQ ID NO: 955156 - DNA, 25 bp, Mus musculus
ggttatgaaggtccccggatccctc

SEQ ID NO: 955157 - DNA, 25 bp, Mus musculus
ggttatgggaatgacagcgtcttcg

SEQ ID NO: 955158 - DNA, 25 bp, Mus musculus
ggttatgggaatgagagcgtcttcg

SEQ ID NO: 955159 - DNA, 25 bp, Mus musculus
ggttatggggccaccagctgcatcc

SEQ ID NO: 955160 - DNA, 25 bp, Mus musculus
ggttatgggggcaccagctgcatcc

SEQ ID NO: 955161 - DNA, 25 bp, Mus musculus
ggttattctcagcacgatgcccagg

SEQ ID NO: 955162 - DNA, 25 bp, Mus musculus
ggttattctcagcaggatgcccagg

SEQ ID NO: 955163 - DNA, 25 bp, Mus musculus
ggttattgatttccccccatcaaga

SEQ ID NO: 955164 - DNA, 25 bp, Mus musculus
ggttattgatttgcccccatcaaga

SEQ ID NO: 955165 - DNA, 25 bp, Mus musculus
ggttattgggattgagtgttccagt

SEQ ID NO: 955166 - DNA, 25 bp, Mus musculus
ggttattgggtttgagtgttccagt

SEQ ID NO: 955167 - DNA, 25 bp, Mus musculus
ggttcaacaaagcaattgaaatgca

SEQ ID NO: 955168 - DNA, 25 bp, Mus musculus
ggttcaacaaaggaattgaaatgca

SEQ ID NO: 955169 - DNA, 25 bp, Mus musculus
ggttcactgcagcgctgggattggc

SEQ ID NO: 955170 - DNA, 25 bp, Mus musculus
ggttcactgcagggctgggattggc

SEQ ID NO: 955171 - DNA, 25 bp, Mus musculus
ggttcagcctatctcgctctcaggc

SEQ ID NO: 955172 - DNA, 25 bp, Mus musculus
ggttcagcctatctggctctcaggc

SEQ ID NO: 955173 - DNA, 25 bp, Mus musculus
ggttcagcttcccacacatttcagc

SEQ ID NO: 955174 - DNA, 25 bp, Mus musculus
ggttcagcttcccagacatttcagc

SEQ ID NO: 955175 - DNA, 25 bp, Mus musculus
ggttcaggaaaataccttggaactt

SEQ ID NO: 955176 - DNA, 25 bp, Mus musculus
ggttcaggaaaatagcttggaactt

SEQ ID NO: 955177 - DNA, 25 bp, Mus musculus
ggttcccaatgaactgattggctgt

SEQ ID NO: 955178 - DNA, 25 bp, Mus musculus
ggttcccaatgaaggcagcaagatc

SEQ ID NO: 955179 - DNA, 25 bp, Mus musculus
ggttcccaatgatctgattggctgt

SEQ ID NO: 955180 - DNA, 25 bp, Mus musculus
ggttcccaatgatggcagcaagatc

SEQ ID NO: 955181 - DNA, 25 bp, Mus musculus
ggttcccgctgacacgtaggcaatt

SEQ ID NO: 955182 - DNA, 25 bp, Mus musculus
ggttcccgctgacctcccgccatcc

SEQ ID NO: 955183 - DNA, 25 bp, Mus musculus
ggttcccgctgagacgtaggcaatt

SEQ ID NO: 955184 - DNA, 25 bp, Mus musculus
ggttcccgctgagctcccgccatcc

SEQ ID NO: 955185 - DNA, 25 bp, Mus musculus
ggttccctagaacttgtgctgcccc

SEQ ID NO: 955186 - DNA, 25 bp, Mus musculus
ggttccctagaagttgtgctgcccc

SEQ ID NO: 955187 - DNA, 25 bp, Mus musculus
ggttccctgtaagcacatcgagaac

SEQ ID NO: 955188 - DNA, 25 bp, Mus musculus
ggttccctgtcacatcgagaaccat

SEQ ID NO: 955189 - DNA, 25 bp, Mus musculus
ggttccctgtgacatcgagaaccat

SEQ ID NO: 955190 - DNA, 25 bp, Mus musculus
ggttccctgttagcacatcgagaac

SEQ ID NO: 955191 - DNA, 25 bp, Mus musculus
ggttccggcgacatcgctaaacgca

SEQ ID NO: 955192 - DNA, 25 bp, Mus musculus
ggttccggcgacatggctaaacgca

SEQ ID NO: 955193 - DNA, 25 bp, Mus musculus
ggttcctacattcttttgtctgtga

SEQ ID NO: 955194 - DNA, 25 bp, Mus musculus
ggttcctacattgttttgtctgtga

SEQ ID NO: 955195 - DNA, 25 bp, Mus musculus
ggttcctagtgtcacataagttctg

SEQ ID NO: 955196 - DNA, 25 bp, Mus musculus
ggttcctagtgtcagataagttctg

SEQ ID NO: 955197 - DNA, 25 bp, Mus musculus
ggttcctctgcgcttcgtgctggct

SEQ ID NO: 955198 - DNA, 25 bp, Mus musculus
ggttcctctgggcttcgtgctggct

SEQ ID NO: 955199 - DNA, 25 bp, Mus musculus
ggttcctggcttgcacaccggggcc

SEQ ID NO: 955200 - DNA, 25 bp, Mus musculus
ggttcctggcttgcagtgtgcctgc

SEQ ID NO: 955201 - DNA, 25 bp, Mus musculus
ggttcctggcttgctcaccggggcc

SEQ ID NO: 955202 - DNA, 25 bp, Mus musculus
ggttcctggcttgctgtgtgcctgc

SEQ ID NO: 955203 - DNA, 25 bp, Mus musculus
ggttcctgtgcacttctgtggccct

SEQ ID NO: 955204 - DNA, 25 bp, Mus musculus
ggttcctgtgcagttctgtggccct

SEQ ID NO: 955205 - DNA, 25 bp, Mus musculus
ggttccttccagcgcctggtggtag

SEQ ID NO: 955206 - DNA, 25 bp, Mus musculus
ggttccttccagggcctggtggtag

SEQ ID NO: 955207 - DNA, 25 bp, Mus musculus
ggttcgaagctccatccgccaggtg

SEQ ID NO: 955208 - DNA, 25 bp, Mus musculus
ggttcgaagctcgatccgccaggtg

SEQ ID NO: 955209 - DNA, 25 bp, Mus musculus
ggttcgacatttttcgtgtgggaag

SEQ ID NO: 955210 - DNA, 25 bp, Mus musculus
ggttcgacatttttggtgtgggaag

SEQ ID NO: 955211 - DNA, 25 bp, Mus musculus
ggttcgtgggagcaccttccttcgg

SEQ ID NO: 955212 - DNA, 25 bp, Mus musculus
ggttcgtgggagcagcttccttcgg

SEQ ID NO: 955213 - DNA, 25 bp, Mus musculus
ggttctacagaaaaatcattgcctt

SEQ ID NO: 955214 - DNA, 25 bp, Mus musculus
ggttctacagaataatcattgcctt

SEQ ID NO: 955215 - DNA, 25 bp, Mus musculus
ggttctcaacccaatcagtattttc

SEQ ID NO: 955216 - DNA, 25 bp, Mus musculus
ggttctcaaccctatcagtattttc

SEQ ID NO: 955217 - DNA, 25 bp, Mus musculus
ggttctcaagcacagtgacctgctg

SEQ ID NO: 955218 - DNA, 25 bp, Mus musculus
ggttctcaaggacagtgacctgctg

SEQ ID NO: 955219 - DNA, 25 bp, Mus musculus
ggttctctgtaacttctccctgttc

SEQ ID NO: 955220 - DNA, 25 bp, Mus musculus
ggttctctgtaagttctccctgttc

SEQ ID NO: 955221 - DNA, 25 bp, Mus musculus
ggttctgcagagcaacagctgtgcc

SEQ ID NO: 955222 - DNA, 25 bp, Mus musculus
ggttctgcagaggaacagctgtgcc

SEQ ID NO: 955223 - DNA, 25 bp, Mus musculus
ggttctgctcagaggtcgagtactc

SEQ ID NO: 955224 - DNA, 25 bp, Mus musculus
ggttctgctcagtggtcgagtactc

SEQ ID NO: 955225 - DNA, 25 bp, Mus musculus
ggttctgctgactcagtgccatttc

SEQ ID NO: 955226 - DNA, 25 bp, Mus musculus
ggttctgctgcagagacagcactag

SEQ ID NO: 955227 - DNA, 25 bp, Mus musculus
ggttctgctgcgccactgccggtgg

SEQ ID NO: 955228 - DNA, 25 bp, Mus musculus
ggttctgctggagagacagcactag

SEQ ID NO: 955229 - DNA, 25 bp, Mus musculus
ggttctgctgggccactgccggtgg

SEQ ID NO: 955230 - DNA, 25 bp, Mus musculus
ggttctgctgtctcagtgccatttc

SEQ ID NO: 955231 - DNA, 25 bp, Mus musculus
ggttctggataacggtggtaaatct

SEQ ID NO: 955232 - DNA, 25 bp, Mus musculus
ggttctggataagggtggtaaatct

SEQ ID NO: 955233 - DNA, 25 bp, Mus musculus
ggttctggcgcgattcctctgcgtg

SEQ ID NO: 955234 - DNA, 25 bp, Mus musculus
ggttctggcgctccggcactcagca

SEQ ID NO: 955235 - DNA, 25 bp, Mus musculus
ggttctggcgggattcctctgcgtg

SEQ ID NO: 955236 - DNA, 25 bp, Mus musculus
ggttctggcggtccggcactcagca

SEQ ID NO: 955237 - DNA, 25 bp, Mus musculus
ggttctgggaagagcgaaatcaaag

SEQ ID NO: 955238 - DNA, 25 bp, Mus musculus
ggttctgggaagtgcgaaatcaaag

SEQ ID NO: 955239 - DNA, 25 bp, Mus musculus
ggttctgtaacattcttcccacaga

SEQ ID NO: 955240 - DNA, 25 bp, Mus musculus
ggttctgtaacattgttcccacaga

SEQ ID NO: 955241 - DNA, 25 bp, Mus musculus
ggttcttcagctcctggagaaagcc

SEQ ID NO: 955242 - DNA, 25 bp, Mus musculus
ggttcttcaggtcctggagaaagcc

SEQ ID NO: 955243 - DNA, 25 bp, Mus musculus
ggttcttgtttgatactttatgcat

SEQ ID NO: 955244 - DNA, 25 bp, Mus musculus
ggttcttgtttgttactttatgcat

SEQ ID NO: 955245 - DNA, 25 bp, Mus musculus
ggttctttggctctgtatgagaagg

SEQ ID NO: 955246 - DNA, 25 bp, Mus musculus
ggttctttgggtctgtatgagaagg

SEQ ID NO: 955247 - DNA, 25 bp, Mus musculus
ggttgaagagcatgaagctggaggc

SEQ ID NO: 955248 - DNA, 25 bp, Mus musculus
ggttgaagaggatgaagctggaggc

SEQ ID NO: 955249 - DNA, 25 bp, Mus musculus
ggttgacatctgctcctttggggtg

SEQ ID NO: 955250 - DNA, 25 bp, Mus musculus
ggttgacatctggtcctttggggtg

SEQ ID NO: 955251 - DNA, 25 bp, Mus musculus
ggttgaccatcaccggctctccggt

SEQ ID NO: 955252 - DNA, 25 bp, Mus musculus
ggttgaccatcagcggctctccggt

SEQ ID NO: 955253 - DNA, 25 bp, Mus musculus
ggttgacccttccgttgatgttctt

SEQ ID NO: 955254 - DNA, 25 bp, Mus musculus
ggttgacccttcggttgatgttctt

SEQ ID NO: 955255 - DNA, 25 bp, Mus musculus
ggttgagcaacaaaatcttgctagt

SEQ ID NO: 955256 - DNA, 25 bp, Mus musculus
ggttgagcaagaaaatcttgctagt

SEQ ID NO: 955257 - DNA, 25 bp, Mus musculus
ggttgcaattgcaacatcaagtcct

SEQ ID NO: 955258 - DNA, 25 bp, Mus musculus
ggttgcaattgcaagatcaagtcct

SEQ ID NO: 955259 - DNA, 25 bp, Mus musculus
ggttgcacagcatttccctagagat

SEQ ID NO: 955260 - DNA, 25 bp, Mus musculus
ggttgcacaggatttccctagagat

SEQ ID NO: 955261 - DNA, 25 bp, Mus musculus
ggttgccaccaacacctgtacatgg

SEQ ID NO: 955262 - DNA, 25 bp, Mus musculus
ggttgccaccaagacctgtacatgg

SEQ ID NO: 955263 - DNA, 25 bp, Mus musculus
ggttgccatacacgtgtctaggagc

SEQ ID NO: 955264 - DNA, 25 bp, Mus musculus
ggttgccatacaggtgtctaggagc

SEQ ID NO: 955265 - DNA, 25 bp, Mus musculus
ggttgcccagctgctgggcttggag

SEQ ID NO: 955266 - DNA, 25 bp, Mus musculus
ggttgcccaggtgctgggcttggag

SEQ ID NO: 955267 - DNA, 25 bp, Mus musculus
ggttgcggcgccaacatccccagct

SEQ ID NO: 955268 - DNA, 25 bp, Mus musculus
ggttgcggcgccaagatccccagct

SEQ ID NO: 955269 - DNA, 25 bp, Mus musculus
ggttgctcaaacatgtgaggaacta

SEQ ID NO: 955270 - DNA, 25 bp, Mus musculus
ggttgctcaatcatgtgaggaacta

SEQ ID NO: 955271 - DNA, 25 bp, Mus musculus
ggttgctgagatcaaggcccagctg

SEQ ID NO: 955272 - DNA, 25 bp, Mus musculus
ggttgctgagatcatggcccagctg

SEQ ID NO: 955273 - DNA, 25 bp, Mus musculus
ggttgctgtcagcgtcgaaattggg

SEQ ID NO: 955274 - DNA, 25 bp, Mus musculus
ggttgctgtcagggtcgaaattggg

SEQ ID NO: 955275 - DNA, 25 bp, Mus musculus
ggttgcttctggcgtcacaggatgc

SEQ ID NO: 955276 - DNA, 25 bp, Mus musculus
ggttgcttctggggtcacaggatgc

SEQ ID NO: 955277 - DNA, 25 bp, Mus musculus
ggttggagagagtgtgaacatggct

SEQ ID NO: 955278 - DNA, 25 bp, Mus musculus
ggttggagagtgtgtgaacatggct

SEQ ID NO: 955279 - DNA, 25 bp, Mus musculus
ggttggagatgaagtggtgttgata

SEQ ID NO: 955280 - DNA, 25 bp, Mus musculus
ggttggagatgatgtggtgttgata

SEQ ID NO: 955281 - DNA, 25 bp, Mus musculus
ggttggagcagcctcgggaatctat

SEQ ID NO: 955282 - DNA, 25 bp, Mus musculus
ggttggagcagcctggggaatctat

SEQ ID NO: 955283 - DNA, 25 bp, Mus musculus
ggttggcaataacctgagccagctc

SEQ ID NO: 955284 - DNA, 25 bp, Mus musculus
ggttggcaataactattacaactgg

SEQ ID NO: 955285 - DNA, 25 bp, Mus musculus
ggttggcaataagctgagccagctc

SEQ ID NO: 955286 - DNA, 25 bp, Mus musculus
ggttggcaataagtattacaactgg

SEQ ID NO: 955287 - DNA, 25 bp, Mus musculus
ggttggcggacctcactctttgacg

SEQ ID NO: 955288 - DNA, 25 bp, Mus musculus
ggttggcggagacagtacccagtat

SEQ ID NO: 955289 - DNA, 25 bp, Mus musculus
ggttggcggagagagtacccagtat

SEQ ID NO: 955290 - DNA, 25 bp, Mus musculus
ggttggcggagccctcactctttga

SEQ ID NO: 955291 - DNA, 25 bp, Mus musculus
ggttggcggagcgctcactctttga

SEQ ID NO: 955292 - DNA, 25 bp, Mus musculus
ggttggcggagctcactctttgacg

SEQ ID NO: 955293 - DNA, 25 bp, Mus musculus
ggttgggcagcggcccatgaagagg

SEQ ID NO: 955294 - DNA, 25 bp, Mus musculus
ggttgggcaggggcccatgaagagg

SEQ ID NO: 955295 - DNA, 25 bp, Mus musculus
ggttgtaccgaacgcactacacgct

SEQ ID NO: 955296 - DNA, 25 bp, Mus musculus
ggttgtaccgaaggcactacacgct

SEQ ID NO: 955297 - DNA, 25 bp, Mus musculus
ggttgtagagctagagctgagtgtg

SEQ ID NO: 955298 - DNA, 25 bp, Mus musculus
ggttgtagaggtagagctgagtgtg

SEQ ID NO: 955299 - DNA, 25 bp, Mus musculus
ggttgtcatgaatcacggtgatcgt

SEQ ID NO: 955300 - DNA, 25 bp, Mus musculus
ggttgtcatgtatcacggtgatcgt

SEQ ID NO: 955301 - DNA, 25 bp, Mus musculus
ggttgtcgtcgtcaccttgacaaaa

SEQ ID NO: 955302 - DNA, 25 bp, Mus musculus
ggttgtcgtcgtcagcttgacaaaa

SEQ ID NO: 955303 - DNA, 25 bp, Mus musculus
ggttgtctggaggacctgccgggga

SEQ ID NO: 955304 - DNA, 25 bp, Mus musculus
ggttgtctggaggagctgccgggga

SEQ ID NO: 955305 - DNA, 25 bp, Mus musculus
ggttgtgaagcgagtgagaaaaatc

SEQ ID NO: 955306 - DNA, 25 bp, Mus musculus
ggttgtgaagggagtgagaaaaatc

SEQ ID NO: 955307 - DNA, 25 bp, Mus musculus
ggttgtgatgcgaggctcctatgat

SEQ ID NO: 955308 - DNA, 25 bp, Mus musculus
ggttgtgatgcgcggctcctatgat

SEQ ID NO: 955309 - DNA, 25 bp, Mus musculus
ggttgtgatgggaggctcctatgat

SEQ ID NO: 955310 - DNA, 25 bp, Mus musculus
ggttgtgatgggcggctcctatgat

SEQ ID NO: 955311 - DNA, 25 bp, Mus musculus
ggttgtgcagctggagcagatagac

SEQ ID NO: 955312 - DNA, 25 bp, Mus musculus
ggttgtgcaggtggagcagatagac

SEQ ID NO: 955313 - DNA, 25 bp, Mus musculus
ggttgtggatcacacctgcgaccga

SEQ ID NO: 955314 - DNA, 25 bp, Mus musculus
ggttgtggatcacagctgcgaccga

SEQ ID NO: 955315 - DNA, 25 bp, Mus musculus
ggttgtggcacgcctgagtcttttc

SEQ ID NO: 955316 - DNA, 25 bp, Mus musculus
ggttgtggcaggcctgagtcttttc

SEQ ID NO: 955317 - DNA, 25 bp, Mus musculus
ggttgttactaacaccaagttcaat

SEQ ID NO: 955318 - DNA, 25 bp, Mus musculus
ggttgttactaacagcaagttcaat

SEQ ID NO: 955319 - DNA, 25 bp, Mus musculus
ggttgttcgacgatccatcctcagt

SEQ ID NO: 955320 - DNA, 25 bp, Mus musculus
ggttgttcgacgttccatcctcagt

SEQ ID NO: 955321 - DNA, 25 bp, Mus musculus
ggtttagaagacagcgtggaagatg

SEQ ID NO: 955322 - DNA, 25 bp, Mus musculus
ggtttagaagtcagcgtggaagatg

SEQ ID NO: 955323 - DNA, 25 bp, Mus musculus
ggtttataagaacgagctgcaccgc

SEQ ID NO: 955324 - DNA, 25 bp, Mus musculus
ggtttataagaaggagctgcaccgc

SEQ ID NO: 955325 - DNA, 25 bp, Mus musculus
ggtttataccctctgtctgcagtgc

SEQ ID NO: 955326 - DNA, 25 bp, Mus musculus
ggtttataccctgtgtctgcagtgc

SEQ ID NO: 955327 - DNA, 25 bp, Mus musculus
ggtttatatgcattcacatcattgg

SEQ ID NO: 955328 - DNA, 25 bp, Mus musculus
ggtttatatgcttgtgggctttttg

SEQ ID NO: 955329 - DNA, 25 bp, Mus musculus
ggtttatatggattcacatcattgg

SEQ ID NO: 955330 - DNA, 25 bp, Mus musculus
ggtttatatggttgtgggctttttg

SEQ ID NO: 955331 - DNA, 25 bp, Mus musculus
ggtttatcaaaacacttccaactga

SEQ ID NO: 955332 - DNA, 25 bp, Mus musculus
ggtttatcaaaagacttccaactga

SEQ ID NO: 955333 - DNA, 25 bp, Mus musculus
ggtttcacagctcaactttgtgagg

SEQ ID NO: 955334 - DNA, 25 bp, Mus musculus
ggtttcacaggtcaactttgtgagg

SEQ ID NO: 955335 - DNA, 25 bp, Mus musculus
ggtttcaccgagcaatctggagatg

SEQ ID NO: 955336 - DNA, 25 bp, Mus musculus
ggtttcaccgaggaatctggagatg

SEQ ID NO: 955337 - DNA, 25 bp, Mus musculus
ggtttcagaacacagggcaatgcga

SEQ ID NO: 955338 - DNA, 25 bp, Mus musculus
ggtttcagaacagagggcaatgcga

SEQ ID NO: 955339 - DNA, 25 bp, Mus musculus
ggtttcagagcaggcctttcccagg

SEQ ID NO: 955340 - DNA, 25 bp, Mus musculus
ggtttcagaggaggcctttcccagg

SEQ ID NO: 955341 - DNA, 25 bp, Mus musculus
ggtttcagataaatggaggatagac

SEQ ID NO: 955342 - DNA, 25 bp, Mus musculus
ggtttcagataaatgggccattgac

SEQ ID NO: 955343 - DNA, 25 bp, Mus musculus
ggtttcagataattggaggatagac

SEQ ID NO: 955344 - DNA, 25 bp, Mus musculus
ggtttcagataattgggccattgac

SEQ ID NO: 955345 - DNA, 25 bp, Mus musculus
ggtttcatcagccacgagccagtcc

SEQ ID NO: 955346 - DNA, 25 bp, Mus musculus
ggtttcatcagccaggagccagtcc

SEQ ID NO: 955347 - DNA, 25 bp, Mus musculus
ggtttccaagctgtgagtacttgct

SEQ ID NO: 955348 - DNA, 25 bp, Mus musculus
ggtttccaaggtgtgagtacttgct

SEQ ID NO: 955349 - DNA, 25 bp, Mus musculus
ggtttcccggctatgcatggaccat

SEQ ID NO: 955350 - DNA, 25 bp, Mus musculus
ggtttcccgggtatgcatggaccat

SEQ ID NO: 955351 - DNA, 25 bp, Mus musculus
ggtttccgctgacaaaattgaagat

SEQ ID NO: 955352 - DNA, 25 bp, Mus musculus
ggtttccgctgacataattgaagat

SEQ ID NO: 955353 - DNA, 25 bp, Mus musculus
ggtttcctggctggtcctggctgag

SEQ ID NO: 955354 - DNA, 25 bp, Mus musculus
ggtttcctgggtggtcctggctgag

SEQ ID NO: 955355 - DNA, 25 bp, Mus musculus
ggtttctcagacccctatgtgaagg

SEQ ID NO: 955356 - DNA, 25 bp, Mus musculus
ggtttctcagtcccctatgtgaagg

SEQ ID NO: 955357 - DNA, 25 bp, Mus musculus
ggtttctgcgggcacgtggtgctga

SEQ ID NO: 955358 - DNA, 25 bp, Mus musculus
ggtttctgcgggcaggtggtgctga

SEQ ID NO: 955359 - DNA, 25 bp, Mus musculus
ggtttgatataaaaacaatggcagg

SEQ ID NO: 955360 - DNA, 25 bp, Mus musculus
ggtttgatataaaatcaatggcagg

SEQ ID NO: 955361 - DNA, 25 bp, Mus musculus
ggtttgcatgactgacatgctccgg

SEQ ID NO: 955362 - DNA, 25 bp, Mus musculus
ggtttgcatgtctgacatgctccgg

SEQ ID NO: 955363 - DNA, 25 bp, Mus musculus
ggtttgccagaacgaacctgaatga

SEQ ID NO: 955364 - DNA, 25 bp, Mus musculus
ggtttgccagaaggaacctgaatga

SEQ ID NO: 955365 - DNA, 25 bp, Mus musculus
ggtttgccagcgaaaatcatagtga

SEQ ID NO: 955366 - DNA, 25 bp, Mus musculus
ggtttgccagctcctattggccagc

SEQ ID NO: 955367 - DNA, 25 bp, Mus musculus
ggtttgccagctcggatgatgagca

SEQ ID NO: 955368 - DNA, 25 bp, Mus musculus
ggtttgccagggaaaatcatagtga

SEQ ID NO: 955369 - DNA, 25 bp, Mus musculus
ggtttgccaggtcctattggccagc

SEQ ID NO: 955370 - DNA, 25 bp, Mus musculus
ggtttgccaggtcggatgatgagca

SEQ ID NO: 955371 - DNA, 25 bp, Mus musculus
ggtttggaacagcacttgcaaactc

SEQ ID NO: 955372 - DNA, 25 bp, Mus musculus
ggtttggaacagcagttgcaaactc

SEQ ID NO: 955373 - DNA, 25 bp, Mus musculus
ggtttggtaaaacccatggccatgc

SEQ ID NO: 955374 - DNA, 25 bp, Mus musculus
ggtttggtaaaagccatggccatgc

SEQ ID NO: 955375 - DNA, 25 bp, Mus musculus
ggtttgttcgtggacgtggagccta

SEQ ID NO: 955376 - DNA, 25 bp, Mus musculus
ggtttgttcgtggaggtggagccta

SEQ ID NO: 955377 - DNA, 25 bp, Mus musculus
ggttttagctatcaaaagtgggaga

SEQ ID NO: 955378 - DNA, 25 bp, Mus musculus
ggttttagctatgaaaagtgggaga

SEQ ID NO: 955379 - DNA, 25 bp, Mus musculus
ggttttatcgaatatgagaaggccc

SEQ ID NO: 955380 - DNA, 25 bp, Mus musculus
ggttttatcgtatatgagaaggccc

SEQ ID NO: 955381 - DNA, 25 bp, Mus musculus
ggttttcatccacgtggatcgcact

SEQ ID NO: 955382 - DNA, 25 bp, Mus musculus
ggttttcatccaggtggatcgcact

SEQ ID NO: 955383 - DNA, 25 bp, Mus musculus
ggttttgataggaacgcagtaatag

SEQ ID NO: 955384 - DNA, 25 bp, Mus musculus
ggttttgataggtacgcagtaatag

SEQ ID NO: 955385 - DNA, 25 bp, Mus musculus
ggttttggagcctgataagctggca

SEQ ID NO: 955386 - DNA, 25 bp, Mus musculus
ggttttggaggctgataagctggca

SEQ ID NO: 955387 - DNA, 25 bp, Mus musculus
ggttttgttgctgtgcaacagaaga

SEQ ID NO: 955388 - DNA, 25 bp, Mus musculus
ggttttgttggtgtgcaacagaaga

SEQ ID NO: 955389 - DNA, 25 bp, Mus musculus
gtaaaaatggaacgaaatgcaagtc

SEQ ID NO: 955390 - DNA, 25 bp, Mus musculus
gtaaaaatggaaggaaatgcaagtc

SEQ ID NO: 955391 - DNA, 25 bp, Mus musculus
gtaaaatatccgatgcccgggtagt

SEQ ID NO: 955392 - DNA, 25 bp, Mus musculus
gtaaaatatcggatgcccgggtagt

SEQ ID NO: 955393 - DNA, 25 bp, Mus musculus
gtaaaatgaaagaaacagcgcattc

SEQ ID NO: 955394 - DNA, 25 bp, Mus musculus
gtaaaatgaaagtaacagcgcattc

SEQ ID NO: 955395 - DNA, 25 bp, Mus musculus
gtaaacaaacagcatcttcctaatg

SEQ ID NO: 955396 - DNA, 25 bp, Mus musculus
gtaaacaaacaggatcttcctaatg

SEQ ID NO: 955397 - DNA, 25 bp, Mus musculus
gtaaacaaagaccacatcgccaagg

SEQ ID NO: 955398 - DNA, 25 bp, Mus musculus
gtaaacaaagaccagatcgccaagg

SEQ ID NO: 955399 - DNA, 25 bp, Mus musculus
gtaaagaaagatcacgaaaagactg

SEQ ID NO: 955400 - DNA, 25 bp, Mus musculus
gtaaagaaagatcacgcgagtacta

SEQ ID NO: 955401 - DNA, 25 bp, Mus musculus
gtaaagaaagatcaggaaaagactg

SEQ ID NO: 955402 - DNA, 25 bp, Mus musculus
gtaaagaaagatcaggcgagtacta

SEQ ID NO: 955403 - DNA, 25 bp, Mus musculus
gtaaagaatgaacgaataacagcct

SEQ ID NO: 955404 - DNA, 25 bp, Mus musculus
gtaaagaatgaaggaataacagcct

SEQ ID NO: 955405 - DNA, 25 bp, Mus musculus
gtaaagacagcacagccccccagcg

SEQ ID NO: 955406 - DNA, 25 bp, Mus musculus
gtaaagacagcctaaccatgccagg

SEQ ID NO: 955407 - DNA, 25 bp, Mus musculus
gtaaagacaggacagccccccagcg

SEQ ID NO: 955408 - DNA, 25 bp, Mus musculus
gtaaagacaggctaaccatgccagg

SEQ ID NO: 955409 - DNA, 25 bp, Mus musculus
gtaaagactgtgatccccagcagat

SEQ ID NO: 955410 - DNA, 25 bp, Mus musculus
gtaaagactgtgatgcccagcagat

SEQ ID NO: 955411 - DNA, 25 bp, Mus musculus
gtaaagagaagacaattaattttgc

SEQ ID NO: 955412 - DNA, 25 bp, Mus musculus
gtaaagagaagagaattaattttgc

SEQ ID NO: 955413 - DNA, 25 bp, Mus musculus
gtaaagcaagagcaccagaagtgcc

SEQ ID NO: 955414 - DNA, 25 bp, Mus musculus
gtaaagcaagcctgtggctctggat

SEQ ID NO: 955415 - DNA, 25 bp, Mus musculus
gtaaagcaaggctgtggctctggat

SEQ ID NO: 955416 - DNA, 25 bp, Mus musculus
gtaaagcaagtgcaccagaagtgcc

SEQ ID NO: 955417 - DNA, 25 bp, Mus musculus
gtaaagcacaggaacatccatctgt

SEQ ID NO: 955418 - DNA, 25 bp, Mus musculus
gtaaagcacaggaagatccatctgt

SEQ ID NO: 955419 - DNA, 25 bp, Mus musculus
gtaaataatcaaagatcttgttttt

SEQ ID NO: 955420 - DNA, 25 bp, Mus musculus
gtaaataatcaaagttcttgttttt

SEQ ID NO: 955421 - DNA, 25 bp, Mus musculus
gtaaatgagtttcacgatagtgatg

SEQ ID NO: 955422 - DNA, 25 bp, Mus musculus
gtaaatgagtttcaggatagtgatg

SEQ ID NO: 955423 - DNA, 25 bp, Mus musculus
gtaaattctcacaacatagtactgg

SEQ ID NO: 955424 - DNA, 25 bp, Mus musculus
gtaaattctcacaagatagtactgg

SEQ ID NO: 955425 - DNA, 25 bp, Mus musculus
gtaacaacctcgccacagccgtgac

SEQ ID NO: 955426 - DNA, 25 bp, Mus musculus
gtaacaacctcggcacagccgtgac

SEQ ID NO: 955427 - DNA, 25 bp, Mus musculus
gtaacacagtccaacgtcacacggt

SEQ ID NO: 955428 - DNA, 25 bp, Mus musculus
gtaacacagtccaaggtcacacggt

SEQ ID NO: 955429 - DNA, 25 bp, Mus musculus
gtaacactcctcaacacttagcctg

SEQ ID NO: 955430 - DNA, 25 bp, Mus musculus
gtaacactcctctacacttagcctg

SEQ ID NO: 955431 - DNA, 25 bp, Mus musculus
gtaacagaggcttcccatctcctgc

SEQ ID NO: 955432 - DNA, 25 bp, Mus musculus
gtaacagaggctttgaagatcaagg

SEQ ID NO: 955433 - DNA, 25 bp, Mus musculus
gtaacagagggttcccatctcctgc

SEQ ID NO: 955434 - DNA, 25 bp, Mus musculus
gtaacagagggtttgaagatcaagg

SEQ ID NO: 955435 - DNA, 25 bp, Mus musculus
gtaacagcagataccagctcttcca

SEQ ID NO: 955436 - DNA, 25 bp, Mus musculus
gtaacagcagttaccagctcttcca

SEQ ID NO: 955437 - DNA, 25 bp, Mus musculus
gtaaccaaagatgtcgcactggctg

SEQ ID NO: 955438 - DNA, 25 bp, Mus musculus
gtaaccaaagttgtcgcactggctg

SEQ ID NO: 955439 - DNA, 25 bp, Mus musculus
gtaaccgtccttggaagatccgcca

SEQ ID NO: 955440 - DNA, 25 bp, Mus musculus
gtaaccgtccttggtagatccgcca

SEQ ID NO: 955441 - DNA, 25 bp, Mus musculus
gtaacgaccaagacccaaatggaac

SEQ ID NO: 955442 - DNA, 25 bp, Mus musculus
gtaacgaccaagacgcaaatggaac

SEQ ID NO: 955443 - DNA, 25 bp, Mus musculus
gtaacgtgcaagcaagccagcattt

SEQ ID NO: 955444 - DNA, 25 bp, Mus musculus
gtaacgtgcaaggaagccagcattt

SEQ ID NO: 955445 - DNA, 25 bp, Mus musculus
gtaactcaccctcacggaagtgatt

SEQ ID NO: 955446 - DNA, 25 bp, Mus musculus
gtaactcaccctcagggaagtgatt

SEQ ID NO: 955447 - DNA, 25 bp, Mus musculus
gtaactgcagagaaattaatagact

SEQ ID NO: 955448 - DNA, 25 bp, Mus musculus
gtaactgcagtgaaattaatagact

SEQ ID NO: 955449 - DNA, 25 bp, Mus musculus
gtaagaaggctcagcggaacctgcc

SEQ ID NO: 955450 - DNA, 25 bp, Mus musculus
gtaagaaggctctgcggaacctgcc

SEQ ID NO: 955451 - DNA, 25 bp, Mus musculus
gtaagacaaacccacctggagaaga

SEQ ID NO: 955452 - DNA, 25 bp, Mus musculus
gtaagacaaagccacctggagaaga

SEQ ID NO: 955453 - DNA, 25 bp, Mus musculus
gtaagacatacacgctggacgaaga

SEQ ID NO: 955454 - DNA, 25 bp, Mus musculus
gtaagacatacaggctggacgaaga

SEQ ID NO: 955455 - DNA, 25 bp, Mus musculus
gtaagcacagcatcacgtggccact

SEQ ID NO: 955456 - DNA, 25 bp, Mus musculus
gtaagcacagctctgcccaccccac

SEQ ID NO: 955457 - DNA, 25 bp, Mus musculus
gtaagcacaggatcacgtggccact

SEQ ID NO: 955458 - DNA, 25 bp, Mus musculus
gtaagcacaggtctgcccaccccac

SEQ ID NO: 955459 - DNA, 25 bp, Mus musculus
gtaagccgagatctctagcctccaa

SEQ ID NO: 955460 - DNA, 25 bp, Mus musculus
gtaagccgagttctctagcctccaa

SEQ ID NO: 955461 - DNA, 25 bp, Mus musculus
gtaagcctgagtgacgatcatggct

SEQ ID NO: 955462 - DNA, 25 bp, Mus musculus
gtaagcctgagtgaggatcatggct

SEQ ID NO: 955463 - DNA, 25 bp, Mus musculus
gtaaggagtgcaaaacaacctgcca

SEQ ID NO: 955464 - DNA, 25 bp, Mus musculus
gtaaggagtgcaaatcaacctgcca

SEQ ID NO: 955465 - DNA, 25 bp, Mus musculus
gtaaggatggagatcccccaggtcc

SEQ ID NO: 955466 - DNA, 25 bp, Mus musculus
gtaaggatggagttcccccaggtcc

SEQ ID NO: 955467 - DNA, 25 bp, Mus musculus
gtaaggtaactgcacagaaattaat

SEQ ID NO: 955468 - DNA, 25 bp, Mus musculus
gtaaggtaactgcagagaaattaat

SEQ ID NO: 955469 - DNA, 25 bp, Mus musculus
gtaaggtaagatctcaagcatacac

SEQ ID NO: 955470 - DNA, 25 bp, Mus musculus
gtaaggtaagttctcaagcatacac

SEQ ID NO: 955471 - DNA, 25 bp, Mus musculus
gtaaggttcccacgatcaccgacaa

SEQ ID NO: 955472 - DNA, 25 bp, Mus musculus
gtaaggttcccaggatcaccgacaa

SEQ ID NO: 955473 - DNA, 25 bp, Mus musculus
gtaagtacagatgatacactaaaga

SEQ ID NO: 955474 - DNA, 25 bp, Mus musculus
gtaagtacagttgatacactaaaga

SEQ ID NO: 955475 - DNA, 25 bp, Mus musculus
gtaagtaccgagagctgcttttgat

SEQ ID NO: 955476 - DNA, 25 bp, Mus musculus
gtaagtaccgagtgctgcttttgat

SEQ ID NO: 955477 - DNA, 25 bp, Mus musculus
gtaagtccagatctgatttgtactc

SEQ ID NO: 955478 - DNA, 25 bp, Mus musculus
gtaagtccagttctgatttgtactc

SEQ ID NO: 955479 - DNA, 25 bp, Mus musculus
gtaataataaaaagcatgatgcgaa

SEQ ID NO: 955480 - DNA, 25 bp, Mus musculus
gtaataataaaaaggatgatgcgaa

SEQ ID NO: 955481 - DNA, 25 bp, Mus musculus
gtaatagggacgcgtctgcctgaat

SEQ ID NO: 955482 - DNA, 25 bp, Mus musculus
gtaatagggacgggtctgcctgaat

SEQ ID NO: 955483 - DNA, 25 bp, Mus musculus
gtaatagtgaagcagagccatgaag

SEQ ID NO: 955484 - DNA, 25 bp, Mus musculus
gtaatagtgaaggagagccatgaag

SEQ ID NO: 955485 - DNA, 25 bp, Mus musculus
gtaatcaagagaacttctcggacct

SEQ ID NO: 955486 - DNA, 25 bp, Mus musculus
gtaatcaagagatcttctcggacct

SEQ ID NO: 955487 - DNA, 25 bp, Mus musculus
gtaatcagagagagtcacgatgtct

SEQ ID NO: 955488 - DNA, 25 bp, Mus musculus
gtaatcagagagtgtcacgatgtct

SEQ ID NO: 955489 - DNA, 25 bp, Mus musculus
gtaatctcggattgtaagggccaag

SEQ ID NO: 955490 - DNA, 25 bp, Mus musculus
gtaatctcggtttgtaagggccaag

SEQ ID NO: 955491 - DNA, 25 bp, Mus musculus
gtaatgaaggaaaatatctgcagaa

SEQ ID NO: 955492 - DNA, 25 bp, Mus musculus
gtaatgaaggtaaatatctgcagaa

SEQ ID NO: 955493 - DNA, 25 bp, Mus musculus
gtaatgattcagatatcctgttaga

SEQ ID NO: 955494 - DNA, 25 bp, Mus musculus
gtaatgattcagttatcctgttaga

SEQ ID NO: 955495 - DNA, 25 bp, Mus musculus
gtaattggctagctttgagatttct

SEQ ID NO: 955496 - DNA, 25 bp, Mus musculus
gtaattggctaggtttgagatttct

SEQ ID NO: 955497 - DNA, 25 bp, Mus musculus
gtacaaaaagctacgtcatcaccaa

SEQ ID NO: 955498 - DNA, 25 bp, Mus musculus
gtacaaaaagctgcatccaagcaga

SEQ ID NO: 955499 - DNA, 25 bp, Mus musculus
gtacaaaaagctgtgagtaccagag

SEQ ID NO: 955500 - DNA, 25 bp, Mus musculus
gtacaaaaaggtacgtcatcaccaa

SEQ ID NO: 955501 - DNA, 25 bp, Mus musculus
gtacaaaaaggtgcatccaagcaga

SEQ ID NO: 955502 - DNA, 25 bp, Mus musculus
gtacaaaaaggtgtgagtaccagag

SEQ ID NO: 955503 - DNA, 25 bp, Mus musculus
gtacaaaagtttatcaattcccatc

SEQ ID NO: 955504 - DNA, 25 bp, Mus musculus
gtacaaaagtttatgaattcccatc

SEQ ID NO: 955505 - DNA, 25 bp, Mus musculus
gtacaacaacataacgtgcttcaag

SEQ ID NO: 955506 - DNA, 25 bp, Mus musculus
gtacaacaacataaggtgcttcaag

SEQ ID NO: 955507 - DNA, 25 bp, Mus musculus
gtacaagacaaaaaagatgacctcc

SEQ ID NO: 955508 - DNA, 25 bp, Mus musculus
gtacaagacaaataagatgacctcc

SEQ ID NO: 955509 - DNA, 25 bp, Mus musculus
gtacaagcagcccacagaaggaccc

SEQ ID NO: 955510 - DNA, 25 bp, Mus musculus
gtacaagcaggccacagaaggaccc

SEQ ID NO: 955511 - DNA, 25 bp, Mus musculus
gtacaaggaaagagaggatggagag

SEQ ID NO: 955512 - DNA, 25 bp, Mus musculus
gtacaaggaaagtgaggatggagag

SEQ ID NO: 955513 - DNA, 25 bp, Mus musculus
gtacaagtcctgaacacaacagaca

SEQ ID NO: 955514 - DNA, 25 bp, Mus musculus
gtacaagtcctgaagacaacagaca

SEQ ID NO: 955515 - DNA, 25 bp, Mus musculus
gtacaatatgcacaatctcatgacc

SEQ ID NO: 955516 - DNA, 25 bp, Mus musculus
gtacaatatgcagaatctcatgacc

SEQ ID NO: 955517 - DNA, 25 bp, Mus musculus
gtacaattgcaccgtagtgcagtac

SEQ ID NO: 955518 - DNA, 25 bp, Mus musculus
gtacaattgcacggtagtgcagtac

SEQ ID NO: 955519 - DNA, 25 bp, Mus musculus
gtacacacaaaacacgctggccttg

SEQ ID NO: 955520 - DNA, 25 bp, Mus musculus
gtacacacaaaacaggctggccttg

SEQ ID NO: 955521 - DNA, 25 bp, Mus musculus
gtacacacctgaacctgatatctgt

SEQ ID NO: 955522 - DNA, 25 bp, Mus musculus
gtacacacctgaacgtgatatctgt

SEQ ID NO: 955523 - DNA, 25 bp, Mus musculus
gtacacagtgagagttcgatgccca

SEQ ID NO: 955524 - DNA, 25 bp, Mus musculus
gtacacagtgagtgttcgatgccca

SEQ ID NO: 955525 - DNA, 25 bp, Mus musculus
gtacacatacagcagagaagaaatt

SEQ ID NO: 955526 - DNA, 25 bp, Mus musculus
gtacacatacaggagagaagaaatt

SEQ ID NO: 955527 - DNA, 25 bp, Mus musculus
gtacaccacgtgcacctctgttacc

SEQ ID NO: 955528 - DNA, 25 bp, Mus musculus
gtacaccacgtggacctctgttacc

SEQ ID NO: 955529 - DNA, 25 bp, Mus musculus
gtacaccctcaacattgtagaagaa

SEQ ID NO: 955530 - DNA, 25 bp, Mus musculus
gtacaccctcaagattgtagaagaa

SEQ ID NO: 955531 - DNA, 25 bp, Mus musculus
gtacaccttccacgacttcacggag

SEQ ID NO: 955532 - DNA, 25 bp, Mus musculus
gtacaccttccaggacttcacggag

SEQ ID NO: 955533 - DNA, 25 bp, Mus musculus
gtacacgaccgtcggtggtatgaag

SEQ ID NO: 955534 - DNA, 25 bp, Mus musculus
gtacacgaccgtgggtggtatgaag

SEQ ID NO: 955535 - DNA, 25 bp, Mus musculus
gtacacggtccacgatgagagtcat

SEQ ID NO: 955536 - DNA, 25 bp, Mus musculus
gtacacggtccaggatgagagtcat

SEQ ID NO: 955537 - DNA, 25 bp, Mus musculus
gtacactaaagtagagactcagggt

SEQ ID NO: 955538 - DNA, 25 bp, Mus musculus
gtacactaaagtagtgactcagggt

SEQ ID NO: 955539 - DNA, 25 bp, Mus musculus
gtacactttgtcatgtagatgccgg

SEQ ID NO: 955540 - DNA, 25 bp, Mus musculus
gtacactttgtcgcaatgtagatgc

SEQ ID NO: 955541 - DNA, 25 bp, Mus musculus
gtacactttgtcgcagaagatgtag

SEQ ID NO: 955542 - DNA, 25 bp, Mus musculus
gtacactttgtcgctatgtagatgc

SEQ ID NO: 955543 - DNA, 25 bp, Mus musculus
gtacactttgtcgctgaagatgtag

SEQ ID NO: 955544 - DNA, 25 bp, Mus musculus
gtacactttgtcttgtagatgccgg

SEQ ID NO: 955545 - DNA, 25 bp, Mus musculus
gtacagaagcagattaagcacatga

SEQ ID NO: 955546 - DNA, 25 bp, Mus musculus
gtacagaagcagtttaagcacatga

SEQ ID NO: 955547 - DNA, 25 bp, Mus musculus
gtacagacagccctcctgcttctga

SEQ ID NO: 955548 - DNA, 25 bp, Mus musculus
gtacagacaggcctcctgcttctga

SEQ ID NO: 955549 - DNA, 25 bp, Mus musculus
gtacagacttctgcaaattcatcaa

SEQ ID NO: 955550 - DNA, 25 bp, Mus musculus
gtacagacttctgctaattcatcaa

SEQ ID NO: 955551 - DNA, 25 bp, Mus musculus
gtacagagaccacgtctttggccag

SEQ ID NO: 955552 - DNA, 25 bp, Mus musculus
gtacagagaccaggtctttggccag

SEQ ID NO: 955553 - DNA, 25 bp, Mus musculus
gtacagagcaaacgtggagaacgag

SEQ ID NO: 955554 - DNA, 25 bp, Mus musculus
gtacagagcaaaggtggagaacgag

SEQ ID NO: 955555 - DNA, 25 bp, Mus musculus
gtacagcaaacacatgcgtgtacat

SEQ ID NO: 955556 - DNA, 25 bp, Mus musculus
gtacagcaaacacccatttcgtaga

SEQ ID NO: 955557 - DNA, 25 bp, Mus musculus
gtacagcaaacagatgcgtgtacat

SEQ ID NO: 955558 - DNA, 25 bp, Mus musculus
gtacagcaaacagccatttcgtaga

SEQ ID NO: 955559 - DNA, 25 bp, Mus musculus
gtacagcacaataaaacccaagcaa

SEQ ID NO: 955560 - DNA, 25 bp, Mus musculus
gtacagcacaattaaacccaagcaa

SEQ ID NO: 955561 - DNA, 25 bp, Mus musculus
gtacagcacaggataccagtgcaga

SEQ ID NO: 955562 - DNA, 25 bp, Mus musculus
gtacagcacaggatgctggttgttg

SEQ ID NO: 955563 - DNA, 25 bp, Mus musculus
gtacagcacaggctaaataaaacgg

SEQ ID NO: 955564 - DNA, 25 bp, Mus musculus
gtacagcacagggtaaataaaacgg

SEQ ID NO: 955565 - DNA, 25 bp, Mus musculus
gtacagcacaggttaccagtgcaga

SEQ ID NO: 955566 - DNA, 25 bp, Mus musculus
gtacagcacaggttgctggttgttg

SEQ ID NO: 955567 - DNA, 25 bp, Mus musculus
gtacagccagctgaccgagctgaac

SEQ ID NO: 955568 - DNA, 25 bp, Mus musculus
gtacagccaggtgaccgagctgaac

SEQ ID NO: 955569 - DNA, 25 bp, Mus musculus
gtacagcctaagcacgttctatttc

SEQ ID NO: 955570 - DNA, 25 bp, Mus musculus
gtacagcctaagcaggttctatttc

SEQ ID NO: 955571 - DNA, 25 bp, Mus musculus
gtacagcctatgctcgggaggagtt

SEQ ID NO: 955572 - DNA, 25 bp, Mus musculus
gtacagcctatggtcgggaggagtt

SEQ ID NO: 955573 - DNA, 25 bp, Mus musculus
gtacagcctcacaatagaacagttg

SEQ ID NO: 955574 - DNA, 25 bp, Mus musculus
gtacagcctcactatagaacagttg

SEQ ID NO: 955575 - DNA, 25 bp, Mus musculus
gtacagcgcactgacggcccaggag

SEQ ID NO: 955576 - DNA, 25 bp, Mus musculus
gtacagcgcactgagggcccaggag

SEQ ID NO: 955577 - DNA, 25 bp, Mus musculus
gtacaggaaaaccacgttgctggtg

SEQ ID NO: 955578 - DNA, 25 bp, Mus musculus
gtacaggaaaaccaggttgctggtg

SEQ ID NO: 955579 - DNA, 25 bp, Mus musculus
gtacaggcacagatgctgatatgtg

SEQ ID NO: 955580 - DNA, 25 bp, Mus musculus
gtacaggcacagttgctgatatgtg

SEQ ID NO: 955581 - DNA, 25 bp, Mus musculus
gtacaggcagccaaaggctcggggt

SEQ ID NO: 955582 - DNA, 25 bp, Mus musculus
gtacaggcaggcaaaggctcggggt

SEQ ID NO: 955583 - DNA, 25 bp, Mus musculus
gtacaggcccagctccccatcatcc

SEQ ID NO: 955584 - DNA, 25 bp, Mus musculus
gtacaggcccaggtccccatcatcc

SEQ ID NO: 955585 - DNA, 25 bp, Mus musculus
gtacaggctcagcaggcctttccca

SEQ ID NO: 955586 - DNA, 25 bp, Mus musculus
gtacaggctcaggaggcctttccca

SEQ ID NO: 955587 - DNA, 25 bp, Mus musculus
gtacaggttccacttctcttgctac

SEQ ID NO: 955588 - DNA, 25 bp, Mus musculus
gtacaggttccagttctcttgctac

SEQ ID NO: 955589 - DNA, 25 bp, Mus musculus
gtacagtgacagctatatctttgca

SEQ ID NO: 955590 - DNA, 25 bp, Mus musculus
gtacagtgacaggtatatctttgca

SEQ ID NO: 955591 - DNA, 25 bp, Mus musculus
gtacatatgagtcgaacaccaaaca

SEQ ID NO: 955592 - DNA, 25 bp, Mus musculus
gtacatatgagtggaacaccaaaca

SEQ ID NO: 955593 - DNA, 25 bp, Mus musculus
gtacatcaagcgcgccaacagcctc

SEQ ID NO: 955594 - DNA, 25 bp, Mus musculus
gtacatcaagcgggccaacagcctc

SEQ ID NO: 955595 - DNA, 25 bp, Mus musculus
gtacatccagagccatataagtgaa

SEQ ID NO: 955596 - DNA, 25 bp, Mus musculus
gtacatccagtgccatataagtgaa

SEQ ID NO: 955597 - DNA, 25 bp, Mus musculus
gtacatctatcacccatggcgagtg

SEQ ID NO: 955598 - DNA, 25 bp, Mus musculus
gtacatctatcagccatggcgagtg

SEQ ID NO: 955599 - DNA, 25 bp, Mus musculus
gtacatctcgctacgaataagtaag

SEQ ID NO: 955600 - DNA, 25 bp, Mus musculus
gtacatctcggtacgaataagtaag

SEQ ID NO: 955601 - DNA, 25 bp, Mus musculus
gtacatctggcacacaagctgattg

SEQ ID NO: 955602 - DNA, 25 bp, Mus musculus
gtacatctggcacagaagctgattg

SEQ ID NO: 955603 - DNA, 25 bp, Mus musculus
gtacatctggcacggccgccacgca

SEQ ID NO: 955604 - DNA, 25 bp, Mus musculus
gtacatctggcagggccgccacgca

SEQ ID NO: 955605 - DNA, 25 bp, Mus musculus
gtacatgcagcacattcaagtcaat

SEQ ID NO: 955606 - DNA, 25 bp, Mus musculus
gtacatgcagcagattcaagtcaat

SEQ ID NO: 955607 - DNA, 25 bp, Mus musculus
gtacatggaggacgtgcggcggcag

SEQ ID NO: 955608 - DNA, 25 bp, Mus musculus
gtacatggaggaggtgcggcggcag

SEQ ID NO: 955609 - DNA, 25 bp, Mus musculus
gtacatggccaacgggagtttggtg

SEQ ID NO: 955610 - DNA, 25 bp, Mus musculus
gtacatggccaaggggagtttggtg

SEQ ID NO: 955611 - DNA, 25 bp, Mus musculus
gtacatgtatatcacacactgtcct

SEQ ID NO: 955612 - DNA, 25 bp, Mus musculus
gtacatgtatatcagacactgtcct

SEQ ID NO: 955613 - DNA, 25 bp, Mus musculus
gtacatgtggattctcctgtactgc

SEQ ID NO: 955614 - DNA, 25 bp, Mus musculus
gtacatgtggtttctcctgtactgc

SEQ ID NO: 955615 - DNA, 25 bp, Mus musculus
gtacattattgacgccactgcagat

SEQ ID NO: 955616 - DNA, 25 bp, Mus musculus
gtacattattgaggccactgcagat

SEQ ID NO: 955617 - DNA, 25 bp, Mus musculus
gtacattccctgcttgttcagtggg

SEQ ID NO: 955618 - DNA, 25 bp, Mus musculus
gtacattccctggttgttcagtggg

SEQ ID NO: 955619 - DNA, 25 bp, Mus musculus
gtacatttcaagagttttccagaaa

SEQ ID NO: 955620 - DNA, 25 bp, Mus musculus
gtacatttcaagtgttttccagaaa

SEQ ID NO: 955621 - DNA, 25 bp, Mus musculus
gtaccaaacgcttcgacagtgaaaa

SEQ ID NO: 955622 - DNA, 25 bp, Mus musculus
gtaccaaacggttcgacagtgaaaa

SEQ ID NO: 955623 - DNA, 25 bp, Mus musculus
gtaccaacaacaccaggtggtgaag

SEQ ID NO: 955624 - DNA, 25 bp, Mus musculus
gtaccaacaagaccaggtggtgaag

SEQ ID NO: 955625 - DNA, 25 bp, Mus musculus
gtaccaagagccatgcgagaatggc

SEQ ID NO: 955626 - DNA, 25 bp, Mus musculus
gtaccaagaggcatgcgagaatggc

SEQ ID NO: 955627 - DNA, 25 bp, Mus musculus
gtaccaatccagcatctggatctct

SEQ ID NO: 955628 - DNA, 25 bp, Mus musculus
gtaccaatccaggatctggatctct

SEQ ID NO: 955629 - DNA, 25 bp, Mus musculus
gtaccaatgagcagtacatgatgat

SEQ ID NO: 955630 - DNA, 25 bp, Mus musculus
gtaccaatgagctgtacatgatgat

SEQ ID NO: 955631 - DNA, 25 bp, Mus musculus
gtaccaatgtcctgatttcagagtg

SEQ ID NO: 955632 - DNA, 25 bp, Mus musculus
gtaccaatgtcctgttttcagagtg

SEQ ID NO: 955633 - DNA, 25 bp, Mus musculus
gtaccacaagcctggacacttttcc

SEQ ID NO: 955634 - DNA, 25 bp, Mus musculus
gtaccacaaggctggacacttttcc

SEQ ID NO: 955635 - DNA, 25 bp, Mus musculus
gtaccacgggcacagacttaaagtt

SEQ ID NO: 955636 - DNA, 25 bp, Mus musculus
gtaccacgggcagagacttaaagtt

SEQ ID NO: 955637 - DNA, 25 bp, Mus musculus
gtaccagaaatacgagcagttgacc

SEQ ID NO: 955638 - DNA, 25 bp, Mus musculus
gtaccagaaataggagcagttgacc

SEQ ID NO: 955639 - DNA, 25 bp, Mus musculus
gtaccagaccaactttgagacactc

SEQ ID NO: 955640 - DNA, 25 bp, Mus musculus
gtaccagaccaagtttgagacactc

SEQ ID NO: 955641 - DNA, 25 bp, Mus musculus
gtaccagatgaaatcgcagaatcct

SEQ ID NO: 955642 - DNA, 25 bp, Mus musculus
gtaccagatgaattcgcagaatcct

SEQ ID NO: 955643 - DNA, 25 bp, Mus musculus
gtaccagcagatggcccccagcacc

SEQ ID NO: 955644 - DNA, 25 bp, Mus musculus
gtaccagcagttggcccccagcacc

SEQ ID NO: 955645 - DNA, 25 bp, Mus musculus
gtaccaggaagtatggacctgggca

SEQ ID NO: 955646 - DNA, 25 bp, Mus musculus
gtaccaggaagtttggacctgggca

SEQ ID NO: 955647 - DNA, 25 bp, Mus musculus
gtaccaggagaacgatgccctgcaa

SEQ ID NO: 955648 - DNA, 25 bp, Mus musculus
gtaccaggagaaggatgccctgcaa

SEQ ID NO: 955649 - DNA, 25 bp, Mus musculus
gtaccaggagctgaaggtgcctgtt

SEQ ID NO: 955650 - DNA, 25 bp, Mus musculus
gtaccaggaggtgaaggtgcctgtt

SEQ ID NO: 955651 - DNA, 25 bp, Mus musculus
gtaccaggccaacgagaacgatttc

SEQ ID NO: 955652 - DNA, 25 bp, Mus musculus
gtaccaggccaaggagaacgatttc

SEQ ID NO: 955653 - DNA, 25 bp, Mus musculus
gtaccagtggaaatcccactgctga

SEQ ID NO: 955654 - DNA, 25 bp, Mus musculus
gtaccagtggaaatgccactgctga

SEQ ID NO: 955655 - DNA, 25 bp, Mus musculus
gtaccatgtgcacgacccaaggctg

SEQ ID NO: 955656 - DNA, 25 bp, Mus musculus
gtaccatgtgcaggacccaaggctg

SEQ ID NO: 955657 - DNA, 25 bp, Mus musculus
gtaccccaaaagagaatcgcacgtc

SEQ ID NO: 955658 - DNA, 25 bp, Mus musculus
gtaccccaaaagtgaatcgcacgtc

SEQ ID NO: 955659 - DNA, 25 bp, Mus musculus
gtaccccgaaagagctcctgggctc

SEQ ID NO: 955660 - DNA, 25 bp, Mus musculus
gtaccccgaaagtgctcctgggctc

SEQ ID NO: 955661 - DNA, 25 bp, Mus musculus
gtaccctgaaagagttaaacatctt

SEQ ID NO: 955662 - DNA, 25 bp, Mus musculus
gtaccctgaaagtgttaaacatctt

SEQ ID NO: 955663 - DNA, 25 bp, Mus musculus
gtacccttgctgcaatgaagctgat

SEQ ID NO: 955664 - DNA, 25 bp, Mus musculus
gtacccttgctggaatgaagctgat

SEQ ID NO: 955665 - DNA, 25 bp, Mus musculus
gtaccgagtgcagctggctgagaag

SEQ ID NO: 955666 - DNA, 25 bp, Mus musculus
gtaccgagtggagctggctgagaag

SEQ ID NO: 955667 - DNA, 25 bp, Mus musculus
gtaccgcctctccctcgatgagtct

SEQ ID NO: 955668 - DNA, 25 bp, Mus musculus
gtaccgcctctcgctcgatgagtct

SEQ ID NO: 955669 - DNA, 25 bp, Mus musculus
gtaccgctctgacgtcccgcccact

SEQ ID NO: 955670 - DNA, 25 bp, Mus musculus
gtaccgctctgaggtcccgcccact

SEQ ID NO: 955671 - DNA, 25 bp, Mus musculus
gtacctaccactgagaggtcgtgag

SEQ ID NO: 955672 - DNA, 25 bp, Mus musculus
gtacctaccagtgagaggtcgtgag

SEQ ID NO: 955673 - DNA, 25 bp, Mus musculus
gtacctccacgacgcgagcctgtca

SEQ ID NO: 955674 - DNA, 25 bp, Mus musculus
gtacctccacgaggcgagcctgtca

SEQ ID NO: 955675 - DNA, 25 bp, Mus musculus
gtacctctggccatcttctccgtgc

SEQ ID NO: 955676 - DNA, 25 bp, Mus musculus
gtacctctgggcatcttctccgtgc

SEQ ID NO: 955677 - DNA, 25 bp, Mus musculus
gtacctgaagaccaaggcactgagg

SEQ ID NO: 955678 - DNA, 25 bp, Mus musculus
gtacctgaagctcgcgtatgtgtcc

SEQ ID NO: 955679 - DNA, 25 bp, Mus musculus
gtacctgaagctcgggtatgtgtcc

SEQ ID NO: 955680 - DNA, 25 bp, Mus musculus
gtacctgaagtccaaggcactgagg

SEQ ID NO: 955681 - DNA, 25 bp, Mus musculus
gtacctgcacagcatatatgtgcct

SEQ ID NO: 955682 - DNA, 25 bp, Mus musculus
gtacctgcacaggatatatgtgcct

SEQ ID NO: 955683 - DNA, 25 bp, Mus musculus
gtacctgccgcccacatagaggtgc

SEQ ID NO: 955684 - DNA, 25 bp, Mus musculus
gtacctgccgcccagatagaggtgc

SEQ ID NO: 955685 - DNA, 25 bp, Mus musculus
gtacctggagattatctcagaaatt

SEQ ID NO: 955686 - DNA, 25 bp, Mus musculus
gtacctggagtttatctcagaaatt

SEQ ID NO: 955687 - DNA, 25 bp, Mus musculus
gtaccttggaaccacacgggcatgc

SEQ ID NO: 955688 - DNA, 25 bp, Mus musculus
gtaccttggaaccagacgggcatgc

SEQ ID NO: 955689 - DNA, 25 bp, Mus musculus
gtacgaagcgccctttccgtcagaa

SEQ ID NO: 955690 - DNA, 25 bp, Mus musculus
gtacgaagcgccgtttccgtcagaa

SEQ ID NO: 955691 - DNA, 25 bp, Mus musculus
gtacgacaaaccagacgtcatagtt

SEQ ID NO: 955692 - DNA, 25 bp, Mus musculus
gtacgacaaagcagacgtcatagtt

SEQ ID NO: 955693 - DNA, 25 bp, Mus musculus
gtacgacctgagctcccagaagcca

SEQ ID NO: 955694 - DNA, 25 bp, Mus musculus
gtacgacctgaggtcccagaagcca

SEQ ID NO: 955695 - DNA, 25 bp, Mus musculus
gtacgagacttgcgaggatgacctg

SEQ ID NO: 955696 - DNA, 25 bp, Mus musculus
gtacgagacttgggaggatgacctg

SEQ ID NO: 955697 - DNA, 25 bp, Mus musculus
gtacgagtttcataccctggagatt

SEQ ID NO: 955698 - DNA, 25 bp, Mus musculus
gtacgagtttcatagcctggagatt

SEQ ID NO: 955699 - DNA, 25 bp, Mus musculus
gtacgcattgcgtgaagaaaagttc

SEQ ID NO: 955700 - DNA, 25 bp, Mus musculus
gtacgcattgggtgaagaaaagttc

SEQ ID NO: 955701 - DNA, 25 bp, Mus musculus
gtacggaaggtcaacaagtttgagc

SEQ ID NO: 955702 - DNA, 25 bp, Mus musculus
gtacggaaggtcaagaagtttgagc

SEQ ID NO: 955703 - DNA, 25 bp, Mus musculus
gtacggacatctgcacctgggaact

SEQ ID NO: 955704 - DNA, 25 bp, Mus musculus
gtacggacatgtgcacctgggaact

SEQ ID NO: 955705 - DNA, 25 bp, Mus musculus
gtacggccgcagcaccatggcactg

SEQ ID NO: 955706 - DNA, 25 bp, Mus musculus
gtacggccgcaggaccatggcactg

SEQ ID NO: 955707 - DNA, 25 bp, Mus musculus
gtacgggacaagcaagctgttcggg

SEQ ID NO: 955708 - DNA, 25 bp, Mus musculus
gtacgggacaagcaaggaagctgtt

SEQ ID NO: 955709 - DNA, 25 bp, Mus musculus
gtacgggacaaggaagctgttcggg

SEQ ID NO: 955710 - DNA, 25 bp, Mus musculus
gtacgggacaaggaaggaagctgtt

SEQ ID NO: 955711 - DNA, 25 bp, Mus musculus
gtacggtgttcacggactgctgacc

SEQ ID NO: 955712 - DNA, 25 bp, Mus musculus
gtacggtgttcacgtcactgcaaga

SEQ ID NO: 955713 - DNA, 25 bp, Mus musculus
gtacggtgttcagggactgctgacc

SEQ ID NO: 955714 - DNA, 25 bp, Mus musculus
gtacggtgttcaggtcactgcaaga

SEQ ID NO: 955715 - DNA, 25 bp, Mus musculus
gtactacatgcaatacttagctgcc

SEQ ID NO: 955716 - DNA, 25 bp, Mus musculus
gtactacatgcaattcttagctgcc

SEQ ID NO: 955717 - DNA, 25 bp, Mus musculus
gtactactcgtccacctcaagtctc

SEQ ID NO: 955718 - DNA, 25 bp, Mus musculus
gtactactcgtccagctcaagtctc

SEQ ID NO: 955719 - DNA, 25 bp, Mus musculus
gtactatctgacaagcacaaacggg

SEQ ID NO: 955720 - DNA, 25 bp, Mus musculus
gtactatctgacagaagtggtcctt

SEQ ID NO: 955721 - DNA, 25 bp, Mus musculus
gtactatctgactagcacaaacggg

SEQ ID NO: 955722 - DNA, 25 bp, Mus musculus
gtactatctgactgaagtggtcctt

SEQ ID NO: 955723 - DNA, 25 bp, Mus musculus
gtactatgggcatgtctgtgttaga

SEQ ID NO: 955724 - DNA, 25 bp, Mus musculus
gtactatggggatgtctgtgttaga

SEQ ID NO: 955725 - DNA, 25 bp, Mus musculus
gtactcaaggagaatctgggagcag

SEQ ID NO: 955726 - DNA, 25 bp, Mus musculus
gtactcaaggtgaatctgggagcag

SEQ ID NO: 955727 - DNA, 25 bp, Mus musculus
gtactcacagagcggtccaacctta

SEQ ID NO: 955728 - DNA, 25 bp, Mus musculus
gtactcacagcgcatgactacatca

SEQ ID NO: 955729 - DNA, 25 bp, Mus musculus
gtactcacagggcatgactacatca

SEQ ID NO: 955730 - DNA, 25 bp, Mus musculus
gtactcacagtgcggtccaacctta

SEQ ID NO: 955731 - DNA, 25 bp, Mus musculus
gtactcatacaccaccaactctgat

SEQ ID NO: 955732 - DNA, 25 bp, Mus musculus
gtactcatacaccagcaactctgat

SEQ ID NO: 955733 - DNA, 25 bp, Mus musculus
gtactcccaccgatgagctgtgact

SEQ ID NO: 955734 - DNA, 25 bp, Mus musculus
gtactcccaccgttgagctgtgact

SEQ ID NO: 955735 - DNA, 25 bp, Mus musculus
gtactccctgtgccagcctttaatg

SEQ ID NO: 955736 - DNA, 25 bp, Mus musculus
gtactccctgtgcctgcctttaatg

SEQ ID NO: 955737 - DNA, 25 bp, Mus musculus
gtactcctgcagctttagccgacaa

SEQ ID NO: 955738 - DNA, 25 bp, Mus musculus
gtactcctgcaggtttagccgacaa

SEQ ID NO: 955739 - DNA, 25 bp, Mus musculus
gtactcgatggccgagaggtgtctg

SEQ ID NO: 955740 - DNA, 25 bp, Mus musculus
gtactcgatggcggagaggtgtctg

SEQ ID NO: 955741 - DNA, 25 bp, Mus musculus
gtactctgccctagtccgtggggcc

SEQ ID NO: 955742 - DNA, 25 bp, Mus musculus
gtactctgcccttgtccgtggggcc

SEQ ID NO: 955743 - DNA, 25 bp, Mus musculus
gtactctgctgccgccttttctcct

SEQ ID NO: 955744 - DNA, 25 bp, Mus musculus
gtactctgctgccgcgtcagcacct

SEQ ID NO: 955745 - DNA, 25 bp, Mus musculus
gtactctgctgccggcttttctcct

SEQ ID NO: 955746 - DNA, 25 bp, Mus musculus
gtactctgctgccgggtcagcacct

SEQ ID NO: 955747 - DNA, 25 bp, Mus musculus
gtactctggacacaaaggaattcag

SEQ ID NO: 955748 - DNA, 25 bp, Mus musculus
gtactctggacagaaaggaattcag

SEQ ID NO: 955749 - DNA, 25 bp, Mus musculus
gtactgaagcagctatgtttgcaat

SEQ ID NO: 955750 - DNA, 25 bp, Mus musculus
gtactgaagcaggtatgtttgcaat

SEQ ID NO: 955751 - DNA, 25 bp, Mus musculus
gtactgagagctcctgcttcaatgg

SEQ ID NO: 955752 - DNA, 25 bp, Mus musculus
gtactgagaggtcctgcttcaatgg

SEQ ID NO: 955753 - DNA, 25 bp, Mus musculus
gtactgcacacacgagagcctgtct

SEQ ID NO: 955754 - DNA, 25 bp, Mus musculus
gtactgcacacaggagagcctgtct

SEQ ID NO: 955755 - DNA, 25 bp, Mus musculus
gtactgcagctggtcaagaacacaa

SEQ ID NO: 955756 - DNA, 25 bp, Mus musculus
gtactgcagctggtgaagaacacaa

SEQ ID NO: 955757 - DNA, 25 bp, Mus musculus
gtactgccagagctgcgcacagaaa

SEQ ID NO: 955758 - DNA, 25 bp, Mus musculus
gtactgccagcgaatgaatttcata

SEQ ID NO: 955759 - DNA, 25 bp, Mus musculus
gtactgccagggaatgaatttcata

SEQ ID NO: 955760 - DNA, 25 bp, Mus musculus
gtactgccagtccgaagatcttaga

SEQ ID NO: 955761 - DNA, 25 bp, Mus musculus
gtactgccagtcggaagatcttaga

SEQ ID NO: 955762 - DNA, 25 bp, Mus musculus
gtactgccagtgctgcgcacagaaa

SEQ ID NO: 955763 - DNA, 25 bp, Mus musculus
gtactggagaagatatttccgagag

SEQ ID NO: 955764 - DNA, 25 bp, Mus musculus
gtactggagaagttatttccgagag

SEQ ID NO: 955765 - DNA, 25 bp, Mus musculus
gtactggagaataacgtttgtgaga

SEQ ID NO: 955766 - DNA, 25 bp, Mus musculus
gtactggagaataaggtttgtgaga

SEQ ID NO: 955767 - DNA, 25 bp, Mus musculus
gtactgggagctcatctatgaggac

SEQ ID NO: 955768 - DNA, 25 bp, Mus musculus
gtactgggaggtcatctatgaggac

SEQ ID NO: 955769 - DNA, 25 bp, Mus musculus
gtactgggatacccggcgcagcatg

SEQ ID NO: 955770 - DNA, 25 bp, Mus musculus
gtactgggattaaacatggcagact

SEQ ID NO: 955771 - DNA, 25 bp, Mus musculus
gtactgggattaaagatggcagact

SEQ ID NO: 955772 - DNA, 25 bp, Mus musculus
gtactgggattacacgggctgagat

SEQ ID NO: 955773 - DNA, 25 bp, Mus musculus
gtactgggattacaggggctgagat

SEQ ID NO: 955774 - DNA, 25 bp, Mus musculus
gtactgggattcccggcgcagcatg

SEQ ID NO: 955775 - DNA, 25 bp, Mus musculus
gtacttagaccacgacctgtatgcg

SEQ ID NO: 955776 - DNA, 25 bp, Mus musculus
gtacttagaccaggacctgtatgcg

SEQ ID NO: 955777 - DNA, 25 bp, Mus musculus
gtacttagacctcgagtggaccgac

SEQ ID NO: 955778 - DNA, 25 bp, Mus musculus
gtacttagacctggagtggaccgac

SEQ ID NO: 955779 - DNA, 25 bp, Mus musculus
gtacttcaagcgaggcaagtacacg

SEQ ID NO: 955780 - DNA, 25 bp, Mus musculus
gtacttcaagggaggcaagtacacg

SEQ ID NO: 955781 - DNA, 25 bp, Mus musculus
gtacttcctgctgggtgcaggggcc

SEQ ID NO: 955782 - DNA, 25 bp, Mus musculus
gtacttcctggtgggtgcaggggcc

SEQ ID NO: 955783 - DNA, 25 bp, Mus musculus
gtacttcctgtccacagagaacatt

SEQ ID NO: 955784 - DNA, 25 bp, Mus musculus
gtacttcctgtccacgagagaacac

SEQ ID NO: 955785 - DNA, 25 bp, Mus musculus
gtacttcctgtccagagagaacatt

SEQ ID NO: 955786 - DNA, 25 bp, Mus musculus
gtacttcctgtccaggagagaacac

SEQ ID NO: 955787 - DNA, 25 bp, Mus musculus
gtacttgctcaccggaattccagga

SEQ ID NO: 955788 - DNA, 25 bp, Mus musculus
gtacttgctcacgggaattccagga

SEQ ID NO: 955789 - DNA, 25 bp, Mus musculus
gtacttggagcacagcaagatcttg

SEQ ID NO: 955790 - DNA, 25 bp, Mus musculus
gtacttggaggacagcaagatcttg

SEQ ID NO: 955791 - DNA, 25 bp, Mus musculus
gtacttgtgcccatctcagcagtca

SEQ ID NO: 955792 - DNA, 25 bp, Mus musculus
gtacttgtgcccatgtcagcagtca

SEQ ID NO: 955793 - DNA, 25 bp, Mus musculus
gtactttgtgcacgtcccagccagc

SEQ ID NO: 955794 - DNA, 25 bp, Mus musculus
gtactttgtgcactggctcgtgggt

SEQ ID NO: 955795 - DNA, 25 bp, Mus musculus
gtactttgtgcaggtcccagccagc

SEQ ID NO: 955796 - DNA, 25 bp, Mus musculus
gtactttgtgcagtggctcgtgggt

SEQ ID NO: 955797 - DNA, 25 bp, Mus musculus
gtacttttggggcagctgaagaaga

SEQ ID NO: 955798 - DNA, 25 bp, Mus musculus
gtacttttgggggagctgaagaaga

SEQ ID NO: 955799 - DNA, 25 bp, Mus musculus
gtagaaaaaacacacagtgatgtga

SEQ ID NO: 955800 - DNA, 25 bp, Mus musculus
gtagaaaaaacagacagtgatgtga

SEQ ID NO: 955801 - DNA, 25 bp, Mus musculus
gtagaaaacgaaggtggcaagtggg

SEQ ID NO: 955802 - DNA, 25 bp, Mus musculus
gtagaaaacgctggcaagtgggaga

SEQ ID NO: 955803 - DNA, 25 bp, Mus musculus
gtagaaaacggtggcaagtgggaga

SEQ ID NO: 955804 - DNA, 25 bp, Mus musculus
gtagaaaacgtaggtggcaagtggg

SEQ ID NO: 955805 - DNA, 25 bp, Mus musculus
gtagaaagtcttcacttgaatggcg

SEQ ID NO: 955806 - DNA, 25 bp, Mus musculus
gtagaaagtcttcagttgaatggcg

SEQ ID NO: 955807 - DNA, 25 bp, Mus musculus
gtagaaataacccatgacgaacagt

SEQ ID NO: 955808 - DNA, 25 bp, Mus musculus
gtagaaataaccgatgacgaacagt

SEQ ID NO: 955809 - DNA, 25 bp, Mus musculus
gtagaacaagaatcatctcagagtt

SEQ ID NO: 955810 - DNA, 25 bp, Mus musculus
gtagaacaagagactaagtctggct

SEQ ID NO: 955811 - DNA, 25 bp, Mus musculus
gtagaacaagtatcatctcagagtt

SEQ ID NO: 955812 - DNA, 25 bp, Mus musculus
gtagaacaagtgactaagtctggct

SEQ ID NO: 955813 - DNA, 25 bp, Mus musculus
gtagaactccgacacgtttgtcaag

SEQ ID NO: 955814 - DNA, 25 bp, Mus musculus
gtagaactccgacaggtttgtcaag

SEQ ID NO: 955815 - DNA, 25 bp, Mus musculus
gtagaagagatggacttttttggac

SEQ ID NO: 955816 - DNA, 25 bp, Mus musculus
gtagaagagatggagttttttggac

SEQ ID NO: 955817 - DNA, 25 bp, Mus musculus
gtagaagcgctgcaaaatcttaaaa

SEQ ID NO: 955818 - DNA, 25 bp, Mus musculus
gtagaagcgctggaaaatcttaaaa

SEQ ID NO: 955819 - DNA, 25 bp, Mus musculus
gtagaagctgctgggatgcaggcac

SEQ ID NO: 955820 - DNA, 25 bp, Mus musculus
gtagaagctggtgggatgcaggcac

SEQ ID NO: 955821 - DNA, 25 bp, Mus musculus
gtagaaggcaagcacctgagcacag

SEQ ID NO: 955822 - DNA, 25 bp, Mus musculus
gtagaaggcaaggacctgagcacag

SEQ ID NO: 955823 - DNA, 25 bp, Mus musculus
gtagaagtggagattgaaggtgatg

SEQ ID NO: 955824 - DNA, 25 bp, Mus musculus
gtagaagtggtgattgaaggtgatg

SEQ ID NO: 955825 - DNA, 25 bp, Mus musculus
gtagaattcctccacgagtacatca

SEQ ID NO: 955826 - DNA, 25 bp, Mus musculus
gtagaattcctccaggagtacatca

SEQ ID NO: 955827 - DNA, 25 bp, Mus musculus
gtagacacttgtcgaaggaatctgc

SEQ ID NO: 955828 - DNA, 25 bp, Mus musculus
gtagacacttgtggaaggaatctgc

SEQ ID NO: 955829 - DNA, 25 bp, Mus musculus
gtagacctgaagctgtcccccttgt

SEQ ID NO: 955830 - DNA, 25 bp, Mus musculus
gtagacctgaaggtgtcccccttgt

SEQ ID NO: 955831 - DNA, 25 bp, Mus musculus
gtagaccttgagtctagtgacaatg

SEQ ID NO: 955832 - DNA, 25 bp, Mus musculus
gtagaccttgtgtctagtgacaatg

SEQ ID NO: 955833 - DNA, 25 bp, Mus musculus
gtagactccgagcgacatctctaca

SEQ ID NO: 955834 - DNA, 25 bp, Mus musculus
gtagactccgagggacatctctaca

SEQ ID NO: 955835 - DNA, 25 bp, Mus musculus
gtagagaactcaaagaaccaccacg

SEQ ID NO: 955836 - DNA, 25 bp, Mus musculus
gtagagaactcatagaaccaccacg

SEQ ID NO: 955837 - DNA, 25 bp, Mus musculus
gtagagaatgcgggtttccgcttcc

SEQ ID NO: 955838 - DNA, 25 bp, Mus musculus
gtagagaatgggggtttccgcttcc

SEQ ID NO: 955839 - DNA, 25 bp, Mus musculus
gtagagacgccacttctacctccag

SEQ ID NO: 955840 - DNA, 25 bp, Mus musculus
gtagagacgccagttctacctccag

SEQ ID NO: 955841 - DNA, 25 bp, Mus musculus
gtagagagcgcacactttccagagt

SEQ ID NO: 955842 - DNA, 25 bp, Mus musculus
gtagagagcgcacagtttccagagt

SEQ ID NO: 955843 - DNA, 25 bp, Mus musculus
gtagagaggcgacggttgtgagccc

SEQ ID NO: 955844 - DNA, 25 bp, Mus musculus
gtagagaggcgagggttgtgagccc

SEQ ID NO: 955845 - DNA, 25 bp, Mus musculus
gtagagccagcaagtccacatgcga

SEQ ID NO: 955846 - DNA, 25 bp, Mus musculus
gtagagccagccttgccatctccaa

SEQ ID NO: 955847 - DNA, 25 bp, Mus musculus
gtagagccaggaagtccacatgcga

SEQ ID NO: 955848 - DNA, 25 bp, Mus musculus
gtagagccaggcttgccatctccaa

SEQ ID NO: 955849 - DNA, 25 bp, Mus musculus
gtagagcgaatgatgaaggatgtct

SEQ ID NO: 955850 - DNA, 25 bp, Mus musculus
gtagagcgaatgttgaaggatgtct

SEQ ID NO: 955851 - DNA, 25 bp, Mus musculus
gtagagctatctaataatctggagg

SEQ ID NO: 955852 - DNA, 25 bp, Mus musculus
gtagagctatcttataatctggagg

SEQ ID NO: 955853 - DNA, 25 bp, Mus musculus
gtagaggactgtaatgaaagagaag

SEQ ID NO: 955854 - DNA, 25 bp, Mus musculus
gtagaggactgttatgaaagagaag

SEQ ID NO: 955855 - DNA, 25 bp, Mus musculus
gtagaggagattgacgaccttgttg

SEQ ID NO: 955856 - DNA, 25 bp, Mus musculus
gtagaggagattgaggaccttgttg

SEQ ID NO: 955857 - DNA, 25 bp, Mus musculus
gtagagtattttaacgcatacatta

SEQ ID NO: 955858 - DNA, 25 bp, Mus musculus
gtagagtattttaaggcatacatta

SEQ ID NO: 955859 - DNA, 25 bp, Mus musculus
gtagagtcacagaaatcactcaagg

SEQ ID NO: 955860 - DNA, 25 bp, Mus musculus
gtagagtcacagtaatcactcaagg

SEQ ID NO: 955861 - DNA, 25 bp, Mus musculus
gtagatctgacactacccaaggttg

SEQ ID NO: 955862 - DNA, 25 bp, Mus musculus
gtagatctgacagtacccaaggttg

SEQ ID NO: 955863 - DNA, 25 bp, Mus musculus
gtagatgaccatgactcgcttgccc

SEQ ID NO: 955864 - DNA, 25 bp, Mus musculus
gtagatgaccatgagtcgcttgccc

SEQ ID NO: 955865 - DNA, 25 bp, Mus musculus
gtagatgcagaccgtccagactgtg

SEQ ID NO: 955866 - DNA, 25 bp, Mus musculus
gtagatgcagcagatcccccaagag

SEQ ID NO: 955867 - DNA, 25 bp, Mus musculus
gtagatgcaggagatcccccaagag

SEQ ID NO: 955868 - DNA, 25 bp, Mus musculus
gtagatgcagtccgtccagactgtg

SEQ ID NO: 955869 - DNA, 25 bp, Mus musculus
gtagattacgctcacaacaactacc

SEQ ID NO: 955870 - DNA, 25 bp, Mus musculus
gtagattacggtcacaacaactacc

SEQ ID NO: 955871 - DNA, 25 bp, Mus musculus
gtagatttagatgccagcacctgga

SEQ ID NO: 955872 - DNA, 25 bp, Mus musculus
gtagatttagttgccagcacctgga

SEQ ID NO: 955873 - DNA, 25 bp, Mus musculus
gtagcaacaacctacctaaaaagtc

SEQ ID NO: 955874 - DNA, 25 bp, Mus musculus
gtagcaacaagctacctaaaaagtc

SEQ ID NO: 955875 - DNA, 25 bp, Mus musculus
gtagcacagtagatctgttggacag

SEQ ID NO: 955876 - DNA, 25 bp, Mus musculus
gtagcacagtagttctgttggacag

SEQ ID NO: 955877 - DNA, 25 bp, Mus musculus
gtagcagtaatacgaaagccgcaaa

SEQ ID NO: 955878 - DNA, 25 bp, Mus musculus
gtagcagtaataggaaagccgcaaa

SEQ ID NO: 955879 - DNA, 25 bp, Mus musculus
gtagcagtggtgattgatccaacca

SEQ ID NO: 955880 - DNA, 25 bp, Mus musculus
gtagcagtggtgtttgatccaacca

SEQ ID NO: 955881 - DNA, 25 bp, Mus musculus
gtagcagttcgcagaacagaaactg

SEQ ID NO: 955882 - DNA, 25 bp, Mus musculus
gtagcagttcgcagtacagaaactg

SEQ ID NO: 955883 - DNA, 25 bp, Mus musculus
gtagcatggttcaacatgaagtgtc

SEQ ID NO: 955884 - DNA, 25 bp, Mus musculus
gtagcatggttcaagatgaagtgtc

SEQ ID NO: 955885 - DNA, 25 bp, Mus musculus
gtagcattcatttaaggatccagaa

SEQ ID NO: 955886 - DNA, 25 bp, Mus musculus
gtagcattcatttatggatccagaa

SEQ ID NO: 955887 - DNA, 25 bp, Mus musculus
gtagccaaagcgatgcattacttac

SEQ ID NO: 955888 - DNA, 25 bp, Mus musculus
gtagccaaagggatgcattacttac

SEQ ID NO: 955889 - DNA, 25 bp, Mus musculus
gtagccaacatcaaagtgtgctccc

SEQ ID NO: 955890 - DNA, 25 bp, Mus musculus
gtagccaacatcaatgtgtgctccc

SEQ ID NO: 955891 - DNA, 25 bp, Mus musculus
gtagccaattacagaatctgggagc

SEQ ID NO: 955892 - DNA, 25 bp, Mus musculus
gtagccaattactgaatctgggagc

SEQ ID NO: 955893 - DNA, 25 bp, Mus musculus
gtagcctacgtgagaacaggctggc

SEQ ID NO: 955894 - DNA, 25 bp, Mus musculus
gtagcctacgtgtgaacaggctggc

SEQ ID NO: 955895 - DNA, 25 bp, Mus musculus
gtagcctcagagatgctggagtgtc

SEQ ID NO: 955896 - DNA, 25 bp, Mus musculus
gtagcctcagagttgctggagtgtc

SEQ ID NO: 955897 - DNA, 25 bp, Mus musculus
gtagcctcagcatgcctggtgtgca

SEQ ID NO: 955898 - DNA, 25 bp, Mus musculus
gtagcctcaggatgcctggtgtgca

SEQ ID NO: 955899 - DNA, 25 bp, Mus musculus
gtagcctccaccagcggcacgttag

SEQ ID NO: 955900 - DNA, 25 bp, Mus musculus
gtagcctccaccaggggcacgttag

SEQ ID NO: 955901 - DNA, 25 bp, Mus musculus
gtagcctctgagcaaagatataaaa

SEQ ID NO: 955902 - DNA, 25 bp, Mus musculus
gtagcctctgagcgaactacatgaa

SEQ ID NO: 955903 - DNA, 25 bp, Mus musculus
gtagcctctgaggaaagatataaaa

SEQ ID NO: 955904 - DNA, 25 bp, Mus musculus
gtagcctctgagggaactacatgaa

SEQ ID NO: 955905 - DNA, 25 bp, Mus musculus
gtagcctgaaagaacccgagctgtc

SEQ ID NO: 955906 - DNA, 25 bp, Mus musculus
gtagcctgaaagtacccgagctgtc

SEQ ID NO: 955907 - DNA, 25 bp, Mus musculus
gtagcgaatcagaacaaacagaatc

SEQ ID NO: 955908 - DNA, 25 bp, Mus musculus
gtagcgaatcagtacaaacagaatc

SEQ ID NO: 955909 - DNA, 25 bp, Mus musculus
gtagcgcctcccccggagcccgcac

SEQ ID NO: 955910 - DNA, 25 bp, Mus musculus
gtagcgcctcccgcggagcccgcac

SEQ ID NO: 955911 - DNA, 25 bp, Mus musculus
gtagctaaagcagttcatactgtta

SEQ ID NO: 955912 - DNA, 25 bp, Mus musculus
gtagctaaaggagttcatactgtta

SEQ ID NO: 955913 - DNA, 25 bp, Mus musculus
gtagctccagcacacgctcggctga

SEQ ID NO: 955914 - DNA, 25 bp, Mus musculus
gtagctccagcacaggctcggctga

SEQ ID NO: 955915 - DNA, 25 bp, Mus musculus
gtagctgtcattatcatctttgaga

SEQ ID NO: 955916 - DNA, 25 bp, Mus musculus
gtagctgtcattatgatctttgaga

SEQ ID NO: 955917 - DNA, 25 bp, Mus musculus
gtagcttcaaaacggaccgagctcc

SEQ ID NO: 955918 - DNA, 25 bp, Mus musculus
gtagcttcaaaagggaccgagctcc

SEQ ID NO: 955919 - DNA, 25 bp, Mus musculus
gtagcttcacagcgtgcctggtcca

SEQ ID NO: 955920 - DNA, 25 bp, Mus musculus
gtagcttcacagggtgcctggtcca

SEQ ID NO: 955921 - DNA, 25 bp, Mus musculus
gtagcttccaagaaccccaagatcc

SEQ ID NO: 955922 - DNA, 25 bp, Mus musculus
gtagcttccaagtaccccaagatcc

SEQ ID NO: 955923 - DNA, 25 bp, Mus musculus
gtaggaagaaagatgcttctgatga

SEQ ID NO: 955924 - DNA, 25 bp, Mus musculus
gtaggaagaaagttgcttctgatga

SEQ ID NO: 955925 - DNA, 25 bp, Mus musculus
gtaggaagaactccctctcgtgacc

SEQ ID NO: 955926 - DNA, 25 bp, Mus musculus
gtaggaagaagtccctctcgtgacc

SEQ ID NO: 955927 - DNA, 25 bp, Mus musculus
gtaggaagggaggtgctgatcggcg

SEQ ID NO: 955928 - DNA, 25 bp, Mus musculus
gtaggaagggtggtgctgatcggcg

SEQ ID NO: 955929 - DNA, 25 bp, Mus musculus
gtaggaagtgccaacatatagatga

SEQ ID NO: 955930 - DNA, 25 bp, Mus musculus
gtaggaagtgccaagatatagatga

SEQ ID NO: 955931 - DNA, 25 bp, Mus musculus
gtaggagaagctgtgggcagaagaa

SEQ ID NO: 955932 - DNA, 25 bp, Mus musculus
gtaggagaaggtgtgggcagaagaa

SEQ ID NO: 955933 - DNA, 25 bp, Mus musculus
gtaggagctttgttatttgccatct

SEQ ID NO: 955934 - DNA, 25 bp, Mus musculus
gtaggagctttgttttttgccatct

SEQ ID NO: 955935 - DNA, 25 bp, Mus musculus
gtaggcaaagagcgacaactgatgg

SEQ ID NO: 955936 - DNA, 25 bp, Mus musculus
gtaggcaaagagggacaactgatgg

SEQ ID NO: 955937 - DNA, 25 bp, Mus musculus
gtaggcctcaacaataagtcttgct

SEQ ID NO: 955938 - DNA, 25 bp, Mus musculus
gtaggcctcaactataagtcttgct

SEQ ID NO: 955939 - DNA, 25 bp, Mus musculus
gtagggaccgagaggccgagcacgg

SEQ ID NO: 955940 - DNA, 25 bp, Mus musculus
gtagggaccgagcccgagcacggct

SEQ ID NO: 955941 - DNA, 25 bp, Mus musculus
gtagggaccgaggccgagcacggct

SEQ ID NO: 955942 - DNA, 25 bp, Mus musculus
gtagggaccgagtggccgagcacgg

SEQ ID NO: 955943 - DNA, 25 bp, Mus musculus
gtagggtggcggcgccctccatgat

SEQ ID NO: 955944 - DNA, 25 bp, Mus musculus
gtagggtggcggggccctccatgat

SEQ ID NO: 955945 - DNA, 25 bp, Mus musculus
gtagtactagatgccaaatccgagt

SEQ ID NO: 955946 - DNA, 25 bp, Mus musculus
gtagtactagttgccaaatccgagt

SEQ ID NO: 955947 - DNA, 25 bp, Mus musculus
gtagtagcgaatcactacaaacaga

SEQ ID NO: 955948 - DNA, 25 bp, Mus musculus
gtagtagcgaatcagtacaaacaga

SEQ ID NO: 955949 - DNA, 25 bp, Mus musculus
gtagtcaaggccaacaaagtattat

SEQ ID NO: 955950 - DNA, 25 bp, Mus musculus
gtagtcaaggccaagaaagtattat

SEQ ID NO: 955951 - DNA, 25 bp, Mus musculus
gtagtcactgactgtatccaggtgg

SEQ ID NO: 955952 - DNA, 25 bp, Mus musculus
gtagtcactgtctgtatccaggtgg

SEQ ID NO: 955953 - DNA, 25 bp, Mus musculus
gtagtcagtaagctgtggtgtacct

SEQ ID NO: 955954 - DNA, 25 bp, Mus musculus
gtagtcagtaaggtgtggtgtacct

SEQ ID NO: 955955 - DNA, 25 bp, Mus musculus
gtagtccaacagagaatgaagcact

SEQ ID NO: 955956 - DNA, 25 bp, Mus musculus
gtagtccaacagtgaatgaagcact

SEQ ID NO: 955957 - DNA, 25 bp, Mus musculus
gtagtccaagagattagaattttag

SEQ ID NO: 955958 - DNA, 25 bp, Mus musculus
gtagtccaagatgcctttgagtgtg

SEQ ID NO: 955959 - DNA, 25 bp, Mus musculus
gtagtccaagtgattagaattttag

SEQ ID NO: 955960 - DNA, 25 bp, Mus musculus
gtagtccaagttgcctttgagtgtg

SEQ ID NO: 955961 - DNA, 25 bp, Mus musculus
gtagtgaaagctgccgaggatgtgt

SEQ ID NO: 955962 - DNA, 25 bp, Mus musculus
gtagtgaaaggtgccgaggatgtgt

SEQ ID NO: 955963 - DNA, 25 bp, Mus musculus
gtagtgacagcacactactggacac

SEQ ID NO: 955964 - DNA, 25 bp, Mus musculus
gtagtgacaggacactactggacac

SEQ ID NO: 955965 - DNA, 25 bp, Mus musculus
gtagtgaccttccggaggatgcaac

SEQ ID NO: 955966 - DNA, 25 bp, Mus musculus
gtagtgaccttcgggaggatgcaac

SEQ ID NO: 955967 - DNA, 25 bp, Mus musculus
gtagtgattgtaagaatgaagatat

SEQ ID NO: 955968 - DNA, 25 bp, Mus musculus
gtagtgattgtaatctactttttta

SEQ ID NO: 955969 - DNA, 25 bp, Mus musculus
gtagtgattgtatgaatgaagatat

SEQ ID NO: 955970 - DNA, 25 bp, Mus musculus
gtagtgattgtattctactttttta

SEQ ID NO: 955971 - DNA, 25 bp, Mus musculus
gtagtgcaagctggagtgtcatctt

SEQ ID NO: 955972 - DNA, 25 bp, Mus musculus
gtagtgcaaggtggagtgtcatctt

SEQ ID NO: 955973 - DNA, 25 bp, Mus musculus
gtagtggaagaagaatgactgtcac

SEQ ID NO: 955974 - DNA, 25 bp, Mus musculus
gtagtggaagagaaatcactgtcac

SEQ ID NO: 955975 - DNA, 25 bp, Mus musculus
gtagtggaagtagaatgactgtcac

SEQ ID NO: 955976 - DNA, 25 bp, Mus musculus
gtagtggaagtgaaatcactgtcac

SEQ ID NO: 955977 - DNA, 25 bp, Mus musculus
gtagtggatcagccactggcccagt

SEQ ID NO: 955978 - DNA, 25 bp, Mus musculus
gtagtggatcaggcactggcccagt

SEQ ID NO: 955979 - DNA, 25 bp, Mus musculus
gtagttaatggacgtgttccctggc

SEQ ID NO: 955980 - DNA, 25 bp, Mus musculus
gtagttaatggaggtgttccctggc

SEQ ID NO: 955981 - DNA, 25 bp, Mus musculus
gtagtttccttgcacatatactgct

SEQ ID NO: 955982 - DNA, 25 bp, Mus musculus
gtagtttccttgcacgtccattcac

SEQ ID NO: 955983 - DNA, 25 bp, Mus musculus
gtagtttccttgcagatatactgct

SEQ ID NO: 955984 - DNA, 25 bp, Mus musculus
gtagtttccttgcaggtccattcac

SEQ ID NO: 955985 - DNA, 25 bp, Mus musculus
gtataaacactgaaaaggatctccc

SEQ ID NO: 955986 - DNA, 25 bp, Mus musculus
gtataaacactgcaacttagcagga

SEQ ID NO: 955987 - DNA, 25 bp, Mus musculus
gtataaacactggaacttagcagga

SEQ ID NO: 955988 - DNA, 25 bp, Mus musculus
gtataaacactgtaaaggatctccc

SEQ ID NO: 955989 - DNA, 25 bp, Mus musculus
gtataaagagcacgtccaagtccat

SEQ ID NO: 955990 - DNA, 25 bp, Mus musculus
gtataaagaggacgtccaagtccat

SEQ ID NO: 955991 - DNA, 25 bp, Mus musculus
gtataaatgagtctgctattgatag

SEQ ID NO: 955992 - DNA, 25 bp, Mus musculus
gtataaatgagtgtgctattgatag

SEQ ID NO: 955993 - DNA, 25 bp, Mus musculus
gtataacaagacaacaatgcttctc

SEQ ID NO: 955994 - DNA, 25 bp, Mus musculus
gtataacaagactacaatgcttctc

SEQ ID NO: 955995 - DNA, 25 bp, Mus musculus
gtataacaagcattctcaaagctgg

SEQ ID NO: 955996 - DNA, 25 bp, Mus musculus
gtataacaaggattctcaaagctgg

SEQ ID NO: 955997 - DNA, 25 bp, Mus musculus
gtataactcgtacacggactgtatg

SEQ ID NO: 955998 - DNA, 25 bp, Mus musculus
gtataactcgtacagggactgtatg

SEQ ID NO: 955999 - DNA, 25 bp, Mus musculus
gtataagctgatgacacacatggcc

SEQ ID NO: 956000 - DNA, 25 bp, Mus musculus
gtataagctgatgagacacatggcc

SEQ ID NO: 956001 - DNA, 25 bp, Mus musculus
gtataattcacacaactgggaagca

SEQ ID NO: 956002 - DNA, 25 bp, Mus musculus
gtataattcacagaactgggaagca

SEQ ID NO: 956003 - DNA, 25 bp, Mus musculus
gtatacaaatcgcgtagataaagtg

SEQ ID NO: 956004 - DNA, 25 bp, Mus musculus
gtatacaaatcgggtagataaagtg

SEQ ID NO: 956005 - DNA, 25 bp, Mus musculus
gtatacaataagctgtcatccttta

SEQ ID NO: 956006 - DNA, 25 bp, Mus musculus
gtatacaataaggtgtcatccttta

SEQ ID NO: 956007 - DNA, 25 bp, Mus musculus
gtatacacagctgtgttgttcgctc

SEQ ID NO: 956008 - DNA, 25 bp, Mus musculus
gtatacacaggtgtgttgttcgctc

SEQ ID NO: 956009 - DNA, 25 bp, Mus musculus
gtatacagagcagcattccggctgg

SEQ ID NO: 956010 - DNA, 25 bp, Mus musculus
gtatacagaggagcattccggctgg

SEQ ID NO: 956011 - DNA, 25 bp, Mus musculus
gtataccccactagccaagcgtcct

SEQ ID NO: 956012 - DNA, 25 bp, Mus musculus
gtataccccacttgccaagcgtcct

SEQ ID NO: 956013 - DNA, 25 bp, Mus musculus
gtatactttgtgaaaatcctgagtc

SEQ ID NO: 956014 - DNA, 25 bp, Mus musculus
gtatactttgtgaatatcctgagtc

SEQ ID NO: 956015 - DNA, 25 bp, Mus musculus
gtatagatgtaggcaaaagaaagaa

SEQ ID NO: 956016 - DNA, 25 bp, Mus musculus
gtatagatgttggcaaaagaaagaa

SEQ ID NO: 956017 - DNA, 25 bp, Mus musculus
gtatagcgccaactctggagaggtg

SEQ ID NO: 956018 - DNA, 25 bp, Mus musculus
gtatagcgccaagtctggagaggtg

SEQ ID NO: 956019 - DNA, 25 bp, Mus musculus
gtataggaagcaccctgatgcagtc

SEQ ID NO: 956020 - DNA, 25 bp, Mus musculus
gtataggaagcagcctgatgcagtc

SEQ ID NO: 956021 - DNA, 25 bp, Mus musculus
gtatatactcaacgtatcgcagggt

SEQ ID NO: 956022 - DNA, 25 bp, Mus musculus
gtatatactcaaggtatcgcagggt

SEQ ID NO: 956023 - DNA, 25 bp, Mus musculus
gtatatccagctcgtctaccttcac

SEQ ID NO: 956024 - DNA, 25 bp, Mus musculus
gtatatccaggtcgtctaccttcac

SEQ ID NO: 956025 - DNA, 25 bp, Mus musculus
gtatatgtgctacgcaccagccccc

SEQ ID NO: 956026 - DNA, 25 bp, Mus musculus
gtatatgtgctaggcaccagccccc

SEQ ID NO: 956027 - DNA, 25 bp, Mus musculus
gtatcaactgagtaaggagaagctg

SEQ ID NO: 956028 - DNA, 25 bp, Mus musculus
gtatcaactgcaagtttcaggaaaa

SEQ ID NO: 956029 - DNA, 25 bp, Mus musculus
gtatcaactgcatgtttcaggaaaa

SEQ ID NO: 956030 - DNA, 25 bp, Mus musculus
gtatcaactgtgtaaggagaagctg

SEQ ID NO: 956031 - DNA, 25 bp, Mus musculus
gtatcaatggatttggacgcattgg

SEQ ID NO: 956032 - DNA, 25 bp, Mus musculus
gtatcaatggttttggacgcattgg

SEQ ID NO: 956033 - DNA, 25 bp, Mus musculus
gtatcacaacaacattgaggaagac

SEQ ID NO: 956034 - DNA, 25 bp, Mus musculus
gtatcacaacaacgcccatctgctc

SEQ ID NO: 956035 - DNA, 25 bp, Mus musculus
gtatcacaacaagattgaggaagac

SEQ ID NO: 956036 - DNA, 25 bp, Mus musculus
gtatcacaacaaggcccatctgctc

SEQ ID NO: 956037 - DNA, 25 bp, Mus musculus
gtatcacaccatagatgaccactgt

SEQ ID NO: 956038 - DNA, 25 bp, Mus musculus
gtatcacaccattgatgaccactgt

SEQ ID NO: 956039 - DNA, 25 bp, Mus musculus
gtatcagatgcacgttgcgttacag

SEQ ID NO: 956040 - DNA, 25 bp, Mus musculus
gtatcagatgcaggttgcgttacag

SEQ ID NO: 956041 - DNA, 25 bp, Mus musculus
gtatcatacaccctcgaggcgtaag

SEQ ID NO: 956042 - DNA, 25 bp, Mus musculus
gtatcatacaccctggaggcgtaag

SEQ ID NO: 956043 - DNA, 25 bp, Mus musculus
gtatcatcaaaaacaacattttcta

SEQ ID NO: 956044 - DNA, 25 bp, Mus musculus
gtatcatcaaaatcaacattttcta

SEQ ID NO: 956045 - DNA, 25 bp, Mus musculus
gtatcatcggagatttggaccaatc

SEQ ID NO: 956046 - DNA, 25 bp, Mus musculus
gtatcatcggagttttggaccaatc

SEQ ID NO: 956047 - DNA, 25 bp, Mus musculus
gtatcatctcaactgtttcacatgt

SEQ ID NO: 956048 - DNA, 25 bp, Mus musculus
gtatcatctcaagtgtttcacatgt

SEQ ID NO: 956049 - DNA, 25 bp, Mus musculus
gtatcatgaactcagcctcagcatc

SEQ ID NO: 956050 - DNA, 25 bp, Mus musculus
gtatcatgaactgagcctcagcatc

SEQ ID NO: 956051 - DNA, 25 bp, Mus musculus
gtatcatgtcaaacacctggtcacc

SEQ ID NO: 956052 - DNA, 25 bp, Mus musculus
gtatcatgtcaatcacctggtcacc

SEQ ID NO: 956053 - DNA, 25 bp, Mus musculus
gtatcattacagaatttgcaaagtc

SEQ ID NO: 956054 - DNA, 25 bp, Mus musculus
gtatcattacagtatttgcaaagtc

SEQ ID NO: 956055 - DNA, 25 bp, Mus musculus
gtatcattactgaaaatctttggag

SEQ ID NO: 956056 - DNA, 25 bp, Mus musculus
gtatcattactgtaaatctttggag

SEQ ID NO: 956057 - DNA, 25 bp, Mus musculus
gtatccatggagctattcctccacg

SEQ ID NO: 956058 - DNA, 25 bp, Mus musculus
gtatccatggaggtattcctccacg

SEQ ID NO: 956059 - DNA, 25 bp, Mus musculus
gtatccctgcccacacggaggagtt

SEQ ID NO: 956060 - DNA, 25 bp, Mus musculus
gtatccctgccctcacggaggagtt

SEQ ID NO: 956061 - DNA, 25 bp, Mus musculus
gtatcgacagatctgtaagcatcag

SEQ ID NO: 956062 - DNA, 25 bp, Mus musculus
gtatcgacagttctgtaagcatcag

SEQ ID NO: 956063 - DNA, 25 bp, Mus musculus
gtatcgccccctcgcaggtgatgct

SEQ ID NO: 956064 - DNA, 25 bp, Mus musculus
gtatcgccccctggcaggtgatgct

SEQ ID NO: 956065 - DNA, 25 bp, Mus musculus
gtatcggaagcttgtgtcggcagtt

SEQ ID NO: 956066 - DNA, 25 bp, Mus musculus
gtatcggaaggttgtgtcggcagtt

SEQ ID NO: 956067 - DNA, 25 bp, Mus musculus
gtatctcatcctctatgcagcctgg

SEQ ID NO: 956068 - DNA, 25 bp, Mus musculus
gtatctcatcctgtatgcagcctgg

SEQ ID NO: 956069 - DNA, 25 bp, Mus musculus
gtatctctctctctggaggtgaagc

SEQ ID NO: 956070 - DNA, 25 bp, Mus musculus
gtatctctctctgtggaggtgaagc

SEQ ID NO: 956071 - DNA, 25 bp, Mus musculus
gtatctctttcacgtagagcttgag

SEQ ID NO: 956072 - DNA, 25 bp, Mus musculus
gtatctctttcactatcctgtgcgt

SEQ ID NO: 956073 - DNA, 25 bp, Mus musculus
gtatctctttcaggtagagcttgag

SEQ ID NO: 956074 - DNA, 25 bp, Mus musculus
gtatctctttcagtatcctgtgcgt

SEQ ID NO: 956075 - DNA, 25 bp, Mus musculus
gtatctgaagacgctcatgatccgt

SEQ ID NO: 956076 - DNA, 25 bp, Mus musculus
gtatctgaagtcgctcatgatccgt

SEQ ID NO: 956077 - DNA, 25 bp, Mus musculus
gtatctgcatcccaactcatattcc

SEQ ID NO: 956078 - DNA, 25 bp, Mus musculus
gtatctgcatccgaactcatattcc

SEQ ID NO: 956079 - DNA, 25 bp, Mus musculus
gtatctgcctaccacgtgcagagcc

SEQ ID NO: 956080 - DNA, 25 bp, Mus musculus
gtatctgcctaccacgtggcaaagg

SEQ ID NO: 956081 - DNA, 25 bp, Mus musculus
gtatctgcctaccaggtgcagagcc

SEQ ID NO: 956082 - DNA, 25 bp, Mus musculus
gtatctgcctaccaggtggcaaagg

SEQ ID NO: 956083 - DNA, 25 bp, Mus musculus
gtatctggctctgtctgtccaccat

SEQ ID NO: 956084 - DNA, 25 bp, Mus musculus
gtatctggctctgtgtgtccaccat

SEQ ID NO: 956085 - DNA, 25 bp, Mus musculus
gtatctggtgctctaccttcaggcc

SEQ ID NO: 956086 - DNA, 25 bp, Mus musculus
gtatctggtggtctaccttcaggcc

SEQ ID NO: 956087 - DNA, 25 bp, Mus musculus
gtatcttaagcaactccaggatggc

SEQ ID NO: 956088 - DNA, 25 bp, Mus musculus
gtatcttaagctttcaggcacagaa

SEQ ID NO: 956089 - DNA, 25 bp, Mus musculus
gtatcttaaggaactccaggatggc

SEQ ID NO: 956090 - DNA, 25 bp, Mus musculus
gtatcttaaggtttcaggcacagaa

SEQ ID NO: 956091 - DNA, 25 bp, Mus musculus
gtatcttgagatgaactacagggaa

SEQ ID NO: 956092 - DNA, 25 bp, Mus musculus
gtatcttgagttgaactacagggaa

SEQ ID NO: 956093 - DNA, 25 bp, Mus musculus
gtatgaaaaaacagaagtgagctct

SEQ ID NO: 956094 - DNA, 25 bp, Mus musculus
gtatgaaaaaactgaagtgagctct

SEQ ID NO: 956095 - DNA, 25 bp, Mus musculus
gtatgaacatttaacagtgaatgcc

SEQ ID NO: 956096 - DNA, 25 bp, Mus musculus
gtatgaacatttaacgcaattctgc

SEQ ID NO: 956097 - DNA, 25 bp, Mus musculus
gtatgaacatttaagagtgaatgcc

SEQ ID NO: 956098 - DNA, 25 bp, Mus musculus
gtatgaacatttaaggcaattctgc

SEQ ID NO: 956099 - DNA, 25 bp, Mus musculus
gtatgaagagcctggagtcaaagga

SEQ ID NO: 956100 - DNA, 25 bp, Mus musculus
gtatgaagagctggcccgtaagctg

SEQ ID NO: 956101 - DNA, 25 bp, Mus musculus
gtatgaagagctggctcgtaagttg

SEQ ID NO: 956102 - DNA, 25 bp, Mus musculus
gtatgaagaggctggagtcaaagga

SEQ ID NO: 956103 - DNA, 25 bp, Mus musculus
gtatgaagaggtggcccgtaagctg

SEQ ID NO: 956104 - DNA, 25 bp, Mus musculus
gtatgaagaggtggctcgtaagttg

SEQ ID NO: 956105 - DNA, 25 bp, Mus musculus
gtatgaagttcacgaaggatttggc

SEQ ID NO: 956106 - DNA, 25 bp, Mus musculus
gtatgaagttcaggaaggatttggc

SEQ ID NO: 956107 - DNA, 25 bp, Mus musculus
gtatgaatatagatttttaaataat

SEQ ID NO: 956108 - DNA, 25 bp, Mus musculus
gtatgaatatagttttttaaataat

SEQ ID NO: 956109 - DNA, 25 bp, Mus musculus
gtatgaccagaattatcccatccat

SEQ ID NO: 956110 - DNA, 25 bp, Mus musculus
gtatgaccagtattatcccatccat

SEQ ID NO: 956111 - DNA, 25 bp, Mus musculus
gtatgacctcaacggctctctagtg

SEQ ID NO: 956112 - DNA, 25 bp, Mus musculus
gtatgacctcaagggctctctagtg

SEQ ID NO: 956113 - DNA, 25 bp, Mus musculus
gtatgagaagaacctgagcccacct

SEQ ID NO: 956114 - DNA, 25 bp, Mus musculus
gtatgagaagaagctgagcccacct

SEQ ID NO: 956115 - DNA, 25 bp, Mus musculus
gtatgagaagcatattgctgcctac

SEQ ID NO: 956116 - DNA, 25 bp, Mus musculus
gtatgagaagcatgttgctgactat

SEQ ID NO: 956117 - DNA, 25 bp, Mus musculus
gtatgagaaggatattgctgcctac

SEQ ID NO: 956118 - DNA, 25 bp, Mus musculus
gtatgagaaggatgttgctgactat

SEQ ID NO: 956119 - DNA, 25 bp, Mus musculus
gtatgagattagcaattgttggcca

SEQ ID NO: 956120 - DNA, 25 bp, Mus musculus
gtatgagattaggaattgttggcca

SEQ ID NO: 956121 - DNA, 25 bp, Mus musculus
gtatgagcagcgcatccttgagaac

SEQ ID NO: 956122 - DNA, 25 bp, Mus musculus
gtatgagcagggcatccttgagaac

SEQ ID NO: 956123 - DNA, 25 bp, Mus musculus
gtatgagtcccgcaccctttggaag

SEQ ID NO: 956124 - DNA, 25 bp, Mus musculus
gtatgagtcccgcagcctttggaag

SEQ ID NO: 956125 - DNA, 25 bp, Mus musculus
gtatgatgagattgtagaagactat

SEQ ID NO: 956126 - DNA, 25 bp, Mus musculus
gtatgatgagtttgtagaagactat

SEQ ID NO: 956127 - DNA, 25 bp, Mus musculus
gtatgatgcccacgacttagaagag

SEQ ID NO: 956128 - DNA, 25 bp, Mus musculus
gtatgatgcccactcttaccatgag

SEQ ID NO: 956129 - DNA, 25 bp, Mus musculus
gtatgatgcccaggacttagaagag

SEQ ID NO: 956130 - DNA, 25 bp, Mus musculus
gtatgatgcccagtcttaccatgag

SEQ ID NO: 956131 - DNA, 25 bp, Mus musculus
gtatgatgctgacagaatggtcaag

SEQ ID NO: 956132 - DNA, 25 bp, Mus musculus
gtatgatgctgagagaatggtcaag

SEQ ID NO: 956133 - DNA, 25 bp, Mus musculus
gtatgcatctgacagatcggtcggc

SEQ ID NO: 956134 - DNA, 25 bp, Mus musculus
gtatgcatctgacgaagagatcggt

SEQ ID NO: 956135 - DNA, 25 bp, Mus musculus
gtatgcatctgagagatcggtcggc

SEQ ID NO: 956136 - DNA, 25 bp, Mus musculus
gtatgcatctgaggaagagatcggt

SEQ ID NO: 956137 - DNA, 25 bp, Mus musculus
gtatgccaaggacaatggtaccaag

SEQ ID NO: 956138 - DNA, 25 bp, Mus musculus
gtatgccaaggagaatggtaccaag

SEQ ID NO: 956139 - DNA, 25 bp, Mus musculus
gtatgccacatcctctgccaataac

SEQ ID NO: 956140 - DNA, 25 bp, Mus musculus
gtatgccacatcctgtgccaataac

SEQ ID NO: 956141 - DNA, 25 bp, Mus musculus
gtatgctctggacgtgatggagtct

SEQ ID NO: 956142 - DNA, 25 bp, Mus musculus
gtatgctctggaggtgatggagtct

SEQ ID NO: 956143 - DNA, 25 bp, Mus musculus
gtatgctgtcagatccccctgtttg

SEQ ID NO: 956144 - DNA, 25 bp, Mus musculus
gtatgctgtcagttccccctgtttg

SEQ ID NO: 956145 - DNA, 25 bp, Mus musculus
gtatggaaagatggcctctgcacaa

SEQ ID NO: 956146 - DNA, 25 bp, Mus musculus
gtatggaaagcacccaacagtagta

SEQ ID NO: 956147 - DNA, 25 bp, Mus musculus
gtatggaaaggacccaacagtagta

SEQ ID NO: 956148 - DNA, 25 bp, Mus musculus
gtatggaaagttggcctctgcacaa

SEQ ID NO: 956149 - DNA, 25 bp, Mus musculus
gtatggaagtacccagaaatcctgg

SEQ ID NO: 956150 - DNA, 25 bp, Mus musculus
gtatggaagttcccagaaatcctgg

SEQ ID NO: 956151 - DNA, 25 bp, Mus musculus
gtatggagagcatcgagattgacca

SEQ ID NO: 956152 - DNA, 25 bp, Mus musculus
gtatggagagctgtcatcaataaac

SEQ ID NO: 956153 - DNA, 25 bp, Mus musculus
gtatggagaggatcgagattgacca

SEQ ID NO: 956154 - DNA, 25 bp, Mus musculus
gtatggagaggtgtcatcaataaac

SEQ ID NO: 956155 - DNA, 25 bp, Mus musculus
gtatggatcacaaaaactaacacag

SEQ ID NO: 956156 - DNA, 25 bp, Mus musculus
gtatggatcagaaaaactaacacag

SEQ ID NO: 956157 - DNA, 25 bp, Mus musculus
gtatggatggctacctggaatggaa

SEQ ID NO: 956158 - DNA, 25 bp, Mus musculus
gtatggatgggtacctggaatggaa

SEQ ID NO: 956159 - DNA, 25 bp, Mus musculus
gtatggcacgaatgaggaagagtgg

SEQ ID NO: 956160 - DNA, 25 bp, Mus musculus
gtatggcacgtatgaggaagagtgg

SEQ ID NO: 956161 - DNA, 25 bp, Mus musculus
gtatggcatcaccggagacaatgtc

SEQ ID NO: 956162 - DNA, 25 bp, Mus musculus
gtatggcatcacgggagacaatgtc

SEQ ID NO: 956163 - DNA, 25 bp, Mus musculus
gtatggccaggacgtatatgacacg

SEQ ID NO: 956164 - DNA, 25 bp, Mus musculus
gtatggccaggaggtatatgacacg

SEQ ID NO: 956165 - DNA, 25 bp, Mus musculus
gtatgggctaaagacatttgaaagt

SEQ ID NO: 956166 - DNA, 25 bp, Mus musculus
gtatgggctaaagagatttgaaagt

SEQ ID NO: 956167 - DNA, 25 bp, Mus musculus
gtatgggctgaagacatttgaaagt

SEQ ID NO: 956168 - DNA, 25 bp, Mus musculus
gtatgggctgaagagatttgaaagt

SEQ ID NO: 956169 - DNA, 25 bp, Mus musculus
gtatgggggcagctggctttgtggc

SEQ ID NO: 956170 - DNA, 25 bp, Mus musculus
gtatgggggcaggtggctttgtggc

SEQ ID NO: 956171 - DNA, 25 bp, Mus musculus
gtatggtggaaacgatccagtttgt

SEQ ID NO: 956172 - DNA, 25 bp, Mus musculus
gtatggtggaaaggatccagtttgt

SEQ ID NO: 956173 - DNA, 25 bp, Mus musculus
gtatgtaagattctcggctctggta

SEQ ID NO: 956174 - DNA, 25 bp, Mus musculus
gtatgtaagattctgggctctggta

SEQ ID NO: 956175 - DNA, 25 bp, Mus musculus
gtatgtatacagctttgttaactga

SEQ ID NO: 956176 - DNA, 25 bp, Mus musculus
gtatgtatacaggtttgttaactga

SEQ ID NO: 956177 - DNA, 25 bp, Mus musculus
gtatgtcatcctcacacaacattgt

SEQ ID NO: 956178 - DNA, 25 bp, Mus musculus
gtatgtcatcctcacgcacaccaag

SEQ ID NO: 956179 - DNA, 25 bp, Mus musculus
gtatgtcatcctcacgcagtgccct

SEQ ID NO: 956180 - DNA, 25 bp, Mus musculus
gtatgtcatcctcagacaacattgt

SEQ ID NO: 956181 - DNA, 25 bp, Mus musculus
gtatgtcatcctcaggcacaccaag

SEQ ID NO: 956182 - DNA, 25 bp, Mus musculus
gtatgtcatcctcaggcagtgccct

SEQ ID NO: 956183 - DNA, 25 bp, Mus musculus
gtatgtgaagagctggttttggggt

SEQ ID NO: 956184 - DNA, 25 bp, Mus musculus
gtatgtgaagagctttgttgtctca

SEQ ID NO: 956185 - DNA, 25 bp, Mus musculus
gtatgtgaagaggtggttttggggt

SEQ ID NO: 956186 - DNA, 25 bp, Mus musculus
gtatgtgaagaggtttgttgtctca

SEQ ID NO: 956187 - DNA, 25 bp, Mus musculus
gtatgtgagcagattttctcctcaa

SEQ ID NO: 956188 - DNA, 25 bp, Mus musculus
gtatgtgagcagtttttctcctcaa

SEQ ID NO: 956189 - DNA, 25 bp, Mus musculus
gtatgttcagccatatcctccttat

SEQ ID NO: 956190 - DNA, 25 bp, Mus musculus
gtatgttcaggcatatcctccttat

SEQ ID NO: 956191 - DNA, 25 bp, Mus musculus
gtatgttgcgcatgctatgggtcct

SEQ ID NO: 956192 - DNA, 25 bp, Mus musculus
gtatgttgcggatgctatgggtcct

SEQ ID NO: 956193 - DNA, 25 bp, Mus musculus
gtattaacagctgctaaagttagag

SEQ ID NO: 956194 - DNA, 25 bp, Mus musculus
gtattaacaggtgctaaagttagag

SEQ ID NO: 956195 - DNA, 25 bp, Mus musculus
gtattaattacacttctccaagcca

SEQ ID NO: 956196 - DNA, 25 bp, Mus musculus
gtattaattacagttctccaagcca

SEQ ID NO: 956197 - DNA, 25 bp, Mus musculus
gtattaattagacgaggttcgcctt

SEQ ID NO: 956198 - DNA, 25 bp, Mus musculus
gtattaattagaggaggttcgcctt

SEQ ID NO: 956199 - DNA, 25 bp, Mus musculus
gtattactgaagcttaaaaagcaag

SEQ ID NO: 956200 - DNA, 25 bp, Mus musculus
gtattactgaaggttaaaaagcaag

SEQ ID NO: 956201 - DNA, 25 bp, Mus musculus
gtattagtgcttaacctagggaaca

SEQ ID NO: 956202 - DNA, 25 bp, Mus musculus
gtattagtgcttaagctagggaaca

SEQ ID NO: 956203 - DNA, 25 bp, Mus musculus
gtattataagagctactcaccagat

SEQ ID NO: 956204 - DNA, 25 bp, Mus musculus
gtattataagaggtactcaccagat

SEQ ID NO: 956205 - DNA, 25 bp, Mus musculus
gtattatatgcaatatcaagctgca

SEQ ID NO: 956206 - DNA, 25 bp, Mus musculus
gtattatatgcaatttcaagctgca

SEQ ID NO: 956207 - DNA, 25 bp, Mus musculus
gtattatctgcaaatcagattgtgt

SEQ ID NO: 956208 - DNA, 25 bp, Mus musculus
gtattatctgcatatcagattgtgt

SEQ ID NO: 956209 - DNA, 25 bp, Mus musculus
gtattcaaccccttctttgagatga

SEQ ID NO: 956210 - DNA, 25 bp, Mus musculus
gtattcaaccgcttctttgagatga

SEQ ID NO: 956211 - DNA, 25 bp, Mus musculus
gtattcagccatggcgtatggctcc

SEQ ID NO: 956212 - DNA, 25 bp, Mus musculus
gtattcagccatggggtatggctcc

SEQ ID NO: 956213 - DNA, 25 bp, Mus musculus
gtattcatgcagctccacgcctcaa

SEQ ID NO: 956214 - DNA, 25 bp, Mus musculus
gtattcatgcaggtccacgcctcaa

SEQ ID NO: 956215 - DNA, 25 bp, Mus musculus
gtattcctgaaaatcatactgtgga

SEQ ID NO: 956216 - DNA, 25 bp, Mus musculus
gtattcctgaaaatgatactgtgga

SEQ ID NO: 956217 - DNA, 25 bp, Mus musculus
gtattcggggaaaaccattcggact

SEQ ID NO: 956218 - DNA, 25 bp, Mus musculus
gtattcggggaaaagcattcggact

SEQ ID NO: 956219 - DNA, 25 bp, Mus musculus
gtattcggtgccaaatgggaagatc

SEQ ID NO: 956220 - DNA, 25 bp, Mus musculus
gtattcggtgcctaatgggaagatc

SEQ ID NO: 956221 - DNA, 25 bp, Mus musculus
gtattctgcaaaaccttatgcacac

SEQ ID NO: 956222 - DNA, 25 bp, Mus musculus
gtattctgcaaacttcaagcacaaa

SEQ ID NO: 956223 - DNA, 25 bp, Mus musculus
gtattctgcaaagttcaagcacaaa

SEQ ID NO: 956224 - DNA, 25 bp, Mus musculus
gtattctgcaaatccttatgcacac

SEQ ID NO: 956225 - DNA, 25 bp, Mus musculus
gtattgaacaagaaaatgttatcaa

SEQ ID NO: 956226 - DNA, 25 bp, Mus musculus
gtattgaacaagtaaatgttatcaa

SEQ ID NO: 956227 - DNA, 25 bp, Mus musculus
gtattgcaaccacccgagaagaggc

SEQ ID NO: 956228 - DNA, 25 bp, Mus musculus
gtattgcaaccaccggagaagaggc

SEQ ID NO: 956229 - DNA, 25 bp, Mus musculus
gtattgcactcccactacatccgga

SEQ ID NO: 956230 - DNA, 25 bp, Mus musculus
gtattgcactccgactacatccgga

SEQ ID NO: 956231 - DNA, 25 bp, Mus musculus
gtattgctgcagcgagtgtcaagtc

SEQ ID NO: 956232 - DNA, 25 bp, Mus musculus
gtattgctgcagggagtgtcaagtc

SEQ ID NO: 956233 - DNA, 25 bp, Mus musculus
gtattggaagatcacgtcgctttgg

SEQ ID NO: 956234 - DNA, 25 bp, Mus musculus
gtattggaagatcaggtcgctttgg

SEQ ID NO: 956235 - DNA, 25 bp, Mus musculus
gtattgtatacacacgtgtgttgtt

SEQ ID NO: 956236 - DNA, 25 bp, Mus musculus
gtattgtatacacaggtgtgttgtt

SEQ ID NO: 956237 - DNA, 25 bp, Mus musculus
gtatttatcgcctgagcagcagact

SEQ ID NO: 956238 - DNA, 25 bp, Mus musculus
gtatttatcggctgagcagcagact

SEQ ID NO: 956239 - DNA, 25 bp, Mus musculus
gtatttcatggagacacgtgacact

SEQ ID NO: 956240 - DNA, 25 bp, Mus musculus
gtatttcatggagacggaggggcgg

SEQ ID NO: 956241 - DNA, 25 bp, Mus musculus
gtatttcatggagagacgtgacact

SEQ ID NO: 956242 - DNA, 25 bp, Mus musculus
gtatttcatggagagggaggggcgg

SEQ ID NO: 956243 - DNA, 25 bp, Mus musculus
gtatttccaaatgcagaccacatat

SEQ ID NO: 956244 - DNA, 25 bp, Mus musculus
gtatttccaattgcagaccacatat

SEQ ID NO: 956245 - DNA, 25 bp, Mus musculus
gtatttcccacacgcctatatgaac

SEQ ID NO: 956246 - DNA, 25 bp, Mus musculus
gtatttcccacaggcctatatgaac

SEQ ID NO: 956247 - DNA, 25 bp, Mus musculus
gtatttcccactgacgccaatgtgc

SEQ ID NO: 956248 - DNA, 25 bp, Mus musculus
gtatttcccactgaggccaatgtgc

SEQ ID NO: 956249 - DNA, 25 bp, Mus musculus
gtatttccccaagaatggggatcct

SEQ ID NO: 956250 - DNA, 25 bp, Mus musculus
gtatttccccaagattggggatcct

SEQ ID NO: 956251 - DNA, 25 bp, Mus musculus
gtatttgagaggaagtgatttaata

SEQ ID NO: 956252 - DNA, 25 bp, Mus musculus
gtatttgagaggtagtgatttaata

SEQ ID NO: 956253 - DNA, 25 bp, Mus musculus
gtatttgggatgattcgctatgcag

SEQ ID NO: 956254 - DNA, 25 bp, Mus musculus
gtatttgggatgtttcgctatgcag

SEQ ID NO: 956255 - DNA, 25 bp, Mus musculus
gtatttgttcaaccagctgtttgga

SEQ ID NO: 956256 - DNA, 25 bp, Mus musculus
gtatttgttcaagcagctgtttgga

SEQ ID NO: 956257 - DNA, 25 bp, Mus musculus
gtattttaagccatacattaaaata

SEQ ID NO: 956258 - DNA, 25 bp, Mus musculus
gtattttaaggcatacattaaaata

SEQ ID NO: 956259 - DNA, 25 bp, Mus musculus
gtattttctcagctgtgcatgtagc

SEQ ID NO: 956260 - DNA, 25 bp, Mus musculus
gtattttctcaggtgtgcatgtagc

SEQ ID NO: 956261 - DNA, 25 bp, Mus musculus
gtatttttagcctgttcatttagaa

SEQ ID NO: 956262 - DNA, 25 bp, Mus musculus
gtatttttaggctgttcatttagaa

SEQ ID NO: 956263 - DNA, 25 bp, Mus musculus
gtcaaactggagcaaagcacagaca

SEQ ID NO: 956264 - DNA, 25 bp, Mus musculus
gtcaaactggaggaaagcacagaca

SEQ ID NO: 956265 - DNA, 25 bp, Mus musculus
gtcaaacttcagagtgaatgccatc

SEQ ID NO: 956266 - DNA, 25 bp, Mus musculus
gtcaaacttcagtgtgaatgccatc

SEQ ID NO: 956267 - DNA, 25 bp, Mus musculus
gtcaaagagaagcaagctatagtga

SEQ ID NO: 956268 - DNA, 25 bp, Mus musculus
gtcaaagagaaggaagctatagtga

SEQ ID NO: 956269 - DNA, 25 bp, Mus musculus
gtcaaagatcaaatatcatgtagaa

SEQ ID NO: 956270 - DNA, 25 bp, Mus musculus
gtcaaagatcaattatcatgtagaa

SEQ ID NO: 956271 - DNA, 25 bp, Mus musculus
gtcaaagattccttctggccgtata

SEQ ID NO: 956272 - DNA, 25 bp, Mus musculus
gtcaaagattccttgtggccgtata

SEQ ID NO: 956273 - DNA, 25 bp, Mus musculus
gtcaaagtcattcttgatattccag

SEQ ID NO: 956274 - DNA, 25 bp, Mus musculus
gtcaaagtcattgttgatattccag

SEQ ID NO: 956275 - DNA, 25 bp, Mus musculus
gtcaaatcagagaagggaatacacc

SEQ ID NO: 956276 - DNA, 25 bp, Mus musculus
gtcaaatcagagtagggaatacacc

SEQ ID NO: 956277 - DNA, 25 bp, Mus musculus
gtcaaatgatccagacatgcggtgg

SEQ ID NO: 956278 - DNA, 25 bp, Mus musculus
gtcaaatgatcctgacatgcggtgg

SEQ ID NO: 956279 - DNA, 25 bp, Mus musculus
gtcaacaatgaaaaacttcagaagc

SEQ ID NO: 956280 - DNA, 25 bp, Mus musculus
gtcaacaatgaaaatcttcagaagc

SEQ ID NO: 956281 - DNA, 25 bp, Mus musculus
gtcaacacccggcgctccttccagt

SEQ ID NO: 956282 - DNA, 25 bp, Mus musculus
gtcaacacccggggctccttccagt

SEQ ID NO: 956283 - DNA, 25 bp, Mus musculus
gtcaacatcaagacagctgaggccc

SEQ ID NO: 956284 - DNA, 25 bp, Mus musculus
gtcaacatcaagtcagctgaggccc

SEQ ID NO: 956285 - DNA, 25 bp, Mus musculus
gtcaacatgaatgtcaccgagataa

SEQ ID NO: 956286 - DNA, 25 bp, Mus musculus
gtcaacatgaatgtgaccgagataa

SEQ ID NO: 956287 - DNA, 25 bp, Mus musculus
gtcaaccagacgctggatttctggg

SEQ ID NO: 956288 - DNA, 25 bp, Mus musculus
gtcaaccagacggtggatttctggg

SEQ ID NO: 956289 - DNA, 25 bp, Mus musculus
gtcaaccctccacaaagccatcgat

SEQ ID NO: 956290 - DNA, 25 bp, Mus musculus
gtcaaccctccagaaagccatcgat

SEQ ID NO: 956291 - DNA, 25 bp, Mus musculus
gtcaaccctgaacatattgtgaaca

SEQ ID NO: 956292 - DNA, 25 bp, Mus musculus
gtcaaccctgaagatattgtgaaca

SEQ ID NO: 956293 - DNA, 25 bp, Mus musculus
gtcaacctggctgtcggtggtgaga

SEQ ID NO: 956294 - DNA, 25 bp, Mus musculus
gtcaacctggctgtgggtggtgaga

SEQ ID NO: 956295 - DNA, 25 bp, Mus musculus
gtcaaccttacacgcagctgcacag

SEQ ID NO: 956296 - DNA, 25 bp, Mus musculus
gtcaaccttacaggcagctgcacag

SEQ ID NO: 956297 - DNA, 25 bp, Mus musculus
gtcaacgatgagatttttgtgcttg

SEQ ID NO: 956298 - DNA, 25 bp, Mus musculus
gtcaacgatgagttttttgtgcttg

SEQ ID NO: 956299 - DNA, 25 bp, Mus musculus
gtcaacgggggagacctcttcttcc

SEQ ID NO: 956300 - DNA, 25 bp, Mus musculus
gtcaacgggggagagctcttcttcc

SEQ ID NO: 956301 - DNA, 25 bp, Mus musculus
gtcaactatgaacaattcgtacaga

SEQ ID NO: 956302 - DNA, 25 bp, Mus musculus
gtcaactatgaagaattcgtacaga

SEQ ID NO: 956303 - DNA, 25 bp, Mus musculus
gtcaactgcccttctcgaacctgcc

SEQ ID NO: 956304 - DNA, 25 bp, Mus musculus
gtcaactgccgttctcgaacctgcc

SEQ ID NO: 956305 - DNA, 25 bp, Mus musculus
gtcaagaaagcacatctgatttgaa

SEQ ID NO: 956306 - DNA, 25 bp, Mus musculus
gtcaagaaagcctgtaccccagtag

SEQ ID NO: 956307 - DNA, 25 bp, Mus musculus
gtcaagaaaggacatctgatttgaa

SEQ ID NO: 956308 - DNA, 25 bp, Mus musculus
gtcaagaaaggctgtaccccagtag

SEQ ID NO: 956309 - DNA, 25 bp, Mus musculus
gtcaagaacaagccccagtctgtgc

SEQ ID NO: 956310 - DNA, 25 bp, Mus musculus
gtcaagaacaaggcccagtctgtgc

SEQ ID NO: 956311 - DNA, 25 bp, Mus musculus
gtcaagaaccggctcctgtccaaat

SEQ ID NO: 956312 - DNA, 25 bp, Mus musculus
gtcaagaaccgggtcctgtccaaat

SEQ ID NO: 956313 - DNA, 25 bp, Mus musculus
gtcaagaagctgcctaagaagtacg

SEQ ID NO: 956314 - DNA, 25 bp, Mus musculus
gtcaagaagctggctaagaagtacg

SEQ ID NO: 956315 - DNA, 25 bp, Mus musculus
gtcaagacgcagaagccgtttacaa

SEQ ID NO: 956316 - DNA, 25 bp, Mus musculus
gtcaagacgcagccgtttacaagct

SEQ ID NO: 956317 - DNA, 25 bp, Mus musculus
gtcaagacgcaggcgtttacaagct

SEQ ID NO: 956318 - DNA, 25 bp, Mus musculus
gtcaagacgcagtagccgtttacaa

SEQ ID NO: 956319 - DNA, 25 bp, Mus musculus
gtcaagagcaagaagaagcagacca

SEQ ID NO: 956320 - DNA, 25 bp, Mus musculus
gtcaagagcaagattggcgccgagt

SEQ ID NO: 956321 - DNA, 25 bp, Mus musculus
gtcaagagcaagtagaagcagacca

SEQ ID NO: 956322 - DNA, 25 bp, Mus musculus
gtcaagagcaagtttggcgccgagt

SEQ ID NO: 956323 - DNA, 25 bp, Mus musculus
gtcaagagctccggctctgaagtgt

SEQ ID NO: 956324 - DNA, 25 bp, Mus musculus
gtcaagagctccgggtctgaagtgt

SEQ ID NO: 956325 - DNA, 25 bp, Mus musculus
gtcaagatccaacatgctcaccggc

SEQ ID NO: 956326 - DNA, 25 bp, Mus musculus
gtcaagatccaagatgctcaccggc

SEQ ID NO: 956327 - DNA, 25 bp, Mus musculus
gtcaagatccggaacgtcacttcca

SEQ ID NO: 956328 - DNA, 25 bp, Mus musculus
gtcaagatccggtacgtcacttcca

SEQ ID NO: 956329 - DNA, 25 bp, Mus musculus
gtcaagatcttaccttcagttacta

SEQ ID NO: 956330 - DNA, 25 bp, Mus musculus
gtcaagatcttagcttcagttacta

SEQ ID NO: 956331 - DNA, 25 bp, Mus musculus
gtcaagcacgggccgggggcagaga

SEQ ID NO: 956332 - DNA, 25 bp, Mus musculus
gtcaagcacggggcgggggcagaga

SEQ ID NO: 956333 - DNA, 25 bp, Mus musculus
gtcaagcagaagcaacagaaagctg

SEQ ID NO: 956334 - DNA, 25 bp, Mus musculus
gtcaagcagaaggaacagaaagctg

SEQ ID NO: 956335 - DNA, 25 bp, Mus musculus
gtcaagctcatgcacgatgatctac

SEQ ID NO: 956336 - DNA, 25 bp, Mus musculus
gtcaagctcatgcaggatgatctac

SEQ ID NO: 956337 - DNA, 25 bp, Mus musculus
gtcaagcttgccacactcgaagact

SEQ ID NO: 956338 - DNA, 25 bp, Mus musculus
gtcaagcttgcctcactcgaagact

SEQ ID NO: 956339 - DNA, 25 bp, Mus musculus
gtcaaggaaatgctggctgcgttga

SEQ ID NO: 956340 - DNA, 25 bp, Mus musculus
gtcaaggaaatggtggctgcgttga

SEQ ID NO: 956341 - DNA, 25 bp, Mus musculus
gtcaaggccaagaaagtattatgag

SEQ ID NO: 956342 - DNA, 25 bp, Mus musculus
gtcaaggccaagtaagtattatgag

SEQ ID NO: 956343 - DNA, 25 bp, Mus musculus
gtcaagtacaaacagcttgtagcca

SEQ ID NO: 956344 - DNA, 25 bp, Mus musculus
gtcaagtacaaagagcttgtagcca

SEQ ID NO: 956345 - DNA, 25 bp, Mus musculus
gtcaagtacctggactttatctcag

SEQ ID NO: 956346 - DNA, 25 bp, Mus musculus
gtcaagtacctggagtttatctcag

SEQ ID NO: 956347 - DNA, 25 bp, Mus musculus
gtcaagttcaccaacatatttatca

SEQ ID NO: 956348 - DNA, 25 bp, Mus musculus
gtcaagttcaccaagatatttatca

SEQ ID NO: 956349 - DNA, 25 bp, Mus musculus
gtcaatacagctgtggcaaaacatg

SEQ ID NO: 956350 - DNA, 25 bp, Mus musculus
gtcaatacaggtgtggcaaaacatg

SEQ ID NO: 956351 - DNA, 25 bp, Mus musculus
gtcaatagataaaggtatatttgtt

SEQ ID NO: 956352 - DNA, 25 bp, Mus musculus
gtcaatagataatggtatatttgtt

SEQ ID NO: 956353 - DNA, 25 bp, Mus musculus
gtcaatagtgcccgaaactgctatg

SEQ ID NO: 956354 - DNA, 25 bp, Mus musculus
gtcaatagtgccggaaactgctatg

SEQ ID NO: 956355 - DNA, 25 bp, Mus musculus
gtcaatgatgcccacaaggtgaccg

SEQ ID NO: 956356 - DNA, 25 bp, Mus musculus
gtcaatgatgcccagaaggtgaccg

SEQ ID NO: 956357 - DNA, 25 bp, Mus musculus
gtcaatgggaagacattcagctggt

SEQ ID NO: 956358 - DNA, 25 bp, Mus musculus
gtcaatgggaagtcattcagctggt

SEQ ID NO: 956359 - DNA, 25 bp, Mus musculus
gtcaatggttcgccaactgaatgga

SEQ ID NO: 956360 - DNA, 25 bp, Mus musculus
gtcaatggttcggcaactgaatgga

SEQ ID NO: 956361 - DNA, 25 bp, Mus musculus
gtcaatgtctcacatgcactcccat

SEQ ID NO: 956362 - DNA, 25 bp, Mus musculus
gtcaatgtctcagatgcactcccat

SEQ ID NO: 956363 - DNA, 25 bp, Mus musculus
gtcaatgttacagacgccgacagca

SEQ ID NO: 956364 - DNA, 25 bp, Mus musculus
gtcaatgttacagaggccgacagca

SEQ ID NO: 956365 - DNA, 25 bp, Mus musculus
gtcaattatgaacagtttgtacaga

SEQ ID NO: 956366 - DNA, 25 bp, Mus musculus
gtcaattatgaagagtttgtacaga

SEQ ID NO: 956367 - DNA, 25 bp, Mus musculus
gtcaattgttgaaaagatccaagca

SEQ ID NO: 956368 - DNA, 25 bp, Mus musculus
gtcaattgttgaaatgatccaagca

SEQ ID NO: 956369 - DNA, 25 bp, Mus musculus
gtcaatttggagaacgtacattatt

SEQ ID NO: 956370 - DNA, 25 bp, Mus musculus
gtcaatttggagaaggtacattatt

SEQ ID NO: 956371 - DNA, 25 bp, Mus musculus
gtcacaaacacccacgtcattgatg

SEQ ID NO: 956372 - DNA, 25 bp, Mus musculus
gtcacaaacacccaggtcattgatg

SEQ ID NO: 956373 - DNA, 25 bp, Mus musculus
gtcacaagaaagaagagccaagtgg

SEQ ID NO: 956374 - DNA, 25 bp, Mus musculus
gtcacaagaaagtagagccaagtgg

SEQ ID NO: 956375 - DNA, 25 bp, Mus musculus
gtcacactcttcaacgtaaagtgga

SEQ ID NO: 956376 - DNA, 25 bp, Mus musculus
gtcacactcttcaaggtaaagtgga

SEQ ID NO: 956377 - DNA, 25 bp, Mus musculus
gtcacagagaaccagaaaacagcgg

SEQ ID NO: 956378 - DNA, 25 bp, Mus musculus
gtcacagagaacgagaaaacagcgg

SEQ ID NO: 956379 - DNA, 25 bp, Mus musculus
gtcacagagcagatttaataaccca

SEQ ID NO: 956380 - DNA, 25 bp, Mus musculus
gtcacagagcagttttaataaccca

SEQ ID NO: 956381 - DNA, 25 bp, Mus musculus
gtcacagattggcacgaagatcaaa

SEQ ID NO: 956382 - DNA, 25 bp, Mus musculus
gtcacagattggcaggaagatcaaa

SEQ ID NO: 956383 - DNA, 25 bp, Mus musculus
gtcacagcagtacacccagtctgag

SEQ ID NO: 956384 - DNA, 25 bp, Mus musculus
gtcacagcagtacagccagtctgag

SEQ ID NO: 956385 - DNA, 25 bp, Mus musculus
gtcacagcggagcatgcaagacgtc

SEQ ID NO: 956386 - DNA, 25 bp, Mus musculus
gtcacagcggaggatgcaagacgtc

SEQ ID NO: 956387 - DNA, 25 bp, Mus musculus
gtcacagctgtctactccccatgga

SEQ ID NO: 956388 - DNA, 25 bp, Mus musculus
gtcacagctgtctagtccccatgga

SEQ ID NO: 956389 - DNA, 25 bp, Mus musculus
gtcacaggaacatcctgactttata

SEQ ID NO: 956390 - DNA, 25 bp, Mus musculus
gtcacaggaacatcgtgactttata

SEQ ID NO: 956391 - DNA, 25 bp, Mus musculus
gtcacaggagcatcagcagcaggtc

SEQ ID NO: 956392 - DNA, 25 bp, Mus musculus
gtcacaggaggatcagcagcaggtc

SEQ ID NO: 956393 - DNA, 25 bp, Mus musculus
gtcacagtacaacaggcttgccaag

SEQ ID NO: 956394 - DNA, 25 bp, Mus musculus
gtcacagtacaagaggcttgccaag

SEQ ID NO: 956395 - DNA, 25 bp, Mus musculus
gtcacagtagaacagcctccacgct

SEQ ID NO: 956396 - DNA, 25 bp, Mus musculus
gtcacagtagaagagcctccacgct

SEQ ID NO: 956397 - DNA, 25 bp, Mus musculus
gtcacagtgaatcaccctcaccttc

SEQ ID NO: 956398 - DNA, 25 bp, Mus musculus
gtcacagtgaatcagcctcaccttc

SEQ ID NO: 956399 - DNA, 25 bp, Mus musculus
gtcacatacctccccggaggacatc

SEQ ID NO: 956400 - DNA, 25 bp, Mus musculus
gtcacatacctcgccggaggacatc

SEQ ID NO: 956401 - DNA, 25 bp, Mus musculus
gtcacatccatgcaaagaaaggaga

SEQ ID NO: 956402 - DNA, 25 bp, Mus musculus
gtcacatccatgctcctattaaact

SEQ ID NO: 956403 - DNA, 25 bp, Mus musculus
gtcacatccatggaaagaaaggaga

SEQ ID NO: 956404 - DNA, 25 bp, Mus musculus
gtcacatccatggtcctattaaact

SEQ ID NO: 956405 - DNA, 25 bp, Mus musculus
gtcaccaactcacctctctgctctc

SEQ ID NO: 956406 - DNA, 25 bp, Mus musculus
gtcaccaactcagctctctgctctc

SEQ ID NO: 956407 - DNA, 25 bp, Mus musculus
gtcaccacaccacacgcggtgtcta

SEQ ID NO: 956408 - DNA, 25 bp, Mus musculus
gtcaccacaccacaggcggtgtcta

SEQ ID NO: 956409 - DNA, 25 bp, Mus musculus
gtcaccagagagcacatgtccagcc

SEQ ID NO: 956410 - DNA, 25 bp, Mus musculus
gtcaccagagaggacatgtccagcc

SEQ ID NO: 956411 - DNA, 25 bp, Mus musculus
gtcaccagtgaacaatttgacaaat

SEQ ID NO: 956412 - DNA, 25 bp, Mus musculus
gtcaccagtgaagaatttgacaaat

SEQ ID NO: 956413 - DNA, 25 bp, Mus musculus
gtcaccagttcgagcgggctgaaga

SEQ ID NO: 956414 - DNA, 25 bp, Mus musculus
gtcaccagttcgagggggctgaaga

SEQ ID NO: 956415 - DNA, 25 bp, Mus musculus
gtcaccatgcccctggctagagatc

SEQ ID NO: 956416 - DNA, 25 bp, Mus musculus
gtcaccatgcccgtggctagagatc

SEQ ID NO: 956417 - DNA, 25 bp, Mus musculus
gtcacccacaccaatgagaggtatg

SEQ ID NO: 956418 - DNA, 25 bp, Mus musculus
gtcacccacagcaatgagaggtatg

SEQ ID NO: 956419 - DNA, 25 bp, Mus musculus
gtcaccccaatagacataatgcagg

SEQ ID NO: 956420 - DNA, 25 bp, Mus musculus
gtcaccccaatagacatggcttgcc

SEQ ID NO: 956421 - DNA, 25 bp, Mus musculus
gtcaccccaatagagataatgcagg

SEQ ID NO: 956422 - DNA, 25 bp, Mus musculus
gtcaccccaatagagatggcttgcc

SEQ ID NO: 956423 - DNA, 25 bp, Mus musculus
gtcacccgactcctcagagactcta

SEQ ID NO: 956424 - DNA, 25 bp, Mus musculus
gtcacccgactcgtcagagactcta

SEQ ID NO: 956425 - DNA, 25 bp, Mus musculus
gtcacccgcatccactgcagcgagg

SEQ ID NO: 956426 - DNA, 25 bp, Mus musculus
gtcacccgcatccagtgcagcgagg

SEQ ID NO: 956427 - DNA, 25 bp, Mus musculus
gtcaccctggggaacttatatgaag

SEQ ID NO: 956428 - DNA, 25 bp, Mus musculus
gtcaccctggggaagttatatgaag

SEQ ID NO: 956429 - DNA, 25 bp, Mus musculus
gtcaccgaggagcttccacaactca

SEQ ID NO: 956430 - DNA, 25 bp, Mus musculus
gtcaccgaggaggttccacaactca

SEQ ID NO: 956431 - DNA, 25 bp, Mus musculus
gtcaccgccagaagttttggccact

SEQ ID NO: 956432 - DNA, 25 bp, Mus musculus
gtcaccgccagatgttttggccact

SEQ ID NO: 956433 - DNA, 25 bp, Mus musculus
gtcaccgccaggatcaaacccatcc

SEQ ID NO: 956434 - DNA, 25 bp, Mus musculus
gtcaccgccaggatgaaacccatcc

SEQ ID NO: 956435 - DNA, 25 bp, Mus musculus
gtcaccgctgcaccctgtaaatgaa

SEQ ID NO: 956436 - DNA, 25 bp, Mus musculus
gtcaccgctgcagcctgtaaatgaa

SEQ ID NO: 956437 - DNA, 25 bp, Mus musculus
gtcacctatgagaatgatgtcagaa

SEQ ID NO: 956438 - DNA, 25 bp, Mus musculus
gtcacctatgagtatgatgtcagaa

SEQ ID NO: 956439 - DNA, 25 bp, Mus musculus
gtcacctatgatcaggactaccagc

SEQ ID NO: 956440 - DNA, 25 bp, Mus musculus
gtcacctatgatcgacaagaagctg

SEQ ID NO: 956441 - DNA, 25 bp, Mus musculus
gtcacctatgatgaggactaccagc

SEQ ID NO: 956442 - DNA, 25 bp, Mus musculus
gtcacctatgatggacaagaagctg

SEQ ID NO: 956443 - DNA, 25 bp, Mus musculus
gtcacctccactgaccacctgggac

SEQ ID NO: 956444 - DNA, 25 bp, Mus musculus
gtcacctccagtgaccacctgggac

SEQ ID NO: 956445 - DNA, 25 bp, Mus musculus
gtcacctgatctaacgagattacct

SEQ ID NO: 956446 - DNA, 25 bp, Mus musculus
gtcacctgatctaaggagattacct

SEQ ID NO: 956447 - DNA, 25 bp, Mus musculus
gtcacctggagacaatacgcatgga

SEQ ID NO: 956448 - DNA, 25 bp, Mus musculus
gtcacctggagacattacgcatgga

SEQ ID NO: 956449 - DNA, 25 bp, Mus musculus
gtcaccttccagttcagtcacctga

SEQ ID NO: 956450 - DNA, 25 bp, Mus musculus
gtcaccttccagttccagagtcacc

SEQ ID NO: 956451 - DNA, 25 bp, Mus musculus
gtcaccttccagttgagtcacctga

SEQ ID NO: 956452 - DNA, 25 bp, Mus musculus
gtcaccttccagttgcagagtcacc

SEQ ID NO: 956453 - DNA, 25 bp, Mus musculus
gtcaccttctcgcgcagtgttctgc

SEQ ID NO: 956454 - DNA, 25 bp, Mus musculus
gtcaccttctcgggcagtgttctgc

SEQ ID NO: 956455 - DNA, 25 bp, Mus musculus
gtcacctttgagctgaagtcagagt

SEQ ID NO: 956456 - DNA, 25 bp, Mus musculus
gtcacctttgaggtgaagtcagagt

SEQ ID NO: 956457 - DNA, 25 bp, Mus musculus
gtcacgctacggaatgaagctaccc

SEQ ID NO: 956458 - DNA, 25 bp, Mus musculus
gtcacgctacggtatgaagctaccc

SEQ ID NO: 956459 - DNA, 25 bp, Mus musculus
gtcacggagaagagctggagtggca

SEQ ID NO: 956460 - DNA, 25 bp, Mus musculus
gtcacggagaagtgctggagtggca

SEQ ID NO: 956461 - DNA, 25 bp, Mus musculus
gtcacggccaatgtcgcaactcatg

SEQ ID NO: 956462 - DNA, 25 bp, Mus musculus
gtcacggccaatgtggcaactcatg

SEQ ID NO: 956463 - DNA, 25 bp, Mus musculus
gtcactatcgtgaacgtgcacagga

SEQ ID NO: 956464 - DNA, 25 bp, Mus musculus
gtcactatcgtgaaggtgcacagga

SEQ ID NO: 956465 - DNA, 25 bp, Mus musculus
gtcactcaagagcctcatccccgac

SEQ ID NO: 956466 - DNA, 25 bp, Mus musculus
gtcactcaagctctcgctctcgaag

SEQ ID NO: 956467 - DNA, 25 bp, Mus musculus
gtcactcaaggtctcgctctcgaag

SEQ ID NO: 956468 - DNA, 25 bp, Mus musculus
gtcactcaagtgcctcatccccgac

SEQ ID NO: 956469 - DNA, 25 bp, Mus musculus
gtcactgaacagcttgctccaggac

SEQ ID NO: 956470 - DNA, 25 bp, Mus musculus
gtcactgaacaggttgctccaggac

SEQ ID NO: 956471 - DNA, 25 bp, Mus musculus
gtcactgaagcttctgggtgagctg

SEQ ID NO: 956472 - DNA, 25 bp, Mus musculus
gtcactgaaggttctgggtgagctg

SEQ ID NO: 956473 - DNA, 25 bp, Mus musculus
gtcactgatcgaagagctaatggag

SEQ ID NO: 956474 - DNA, 25 bp, Mus musculus
gtcactgatcgatgagctaatggag

SEQ ID NO: 956475 - DNA, 25 bp, Mus musculus
gtcactgcagcccacagccccattc

SEQ ID NO: 956476 - DNA, 25 bp, Mus musculus
gtcactgcagcgacggctccgggtg

SEQ ID NO: 956477 - DNA, 25 bp, Mus musculus
gtcactgcagcgctgctgtggctgg

SEQ ID NO: 956478 - DNA, 25 bp, Mus musculus
gtcactgcagcggtgctgtggctgg

SEQ ID NO: 956479 - DNA, 25 bp, Mus musculus
gtcactgcagcgtcggctccgggtg

SEQ ID NO: 956480 - DNA, 25 bp, Mus musculus
gtcactgcaggccacagccccattc

SEQ ID NO: 956481 - DNA, 25 bp, Mus musculus
gtcactgccaatggagaggccagaa

SEQ ID NO: 956482 - DNA, 25 bp, Mus musculus
gtcactgccacccgaaggtaagtgc

SEQ ID NO: 956483 - DNA, 25 bp, Mus musculus
gtcactgccaccggaaggtaagtgc

SEQ ID NO: 956484 - DNA, 25 bp, Mus musculus
gtcactgccattggagaggccagaa

SEQ ID NO: 956485 - DNA, 25 bp, Mus musculus
gtcactgcgccacacgaaagcactg

SEQ ID NO: 956486 - DNA, 25 bp, Mus musculus
gtcactgcgccacaggaaagcactg

SEQ ID NO: 956487 - DNA, 25 bp, Mus musculus
gtcactgtactcaacactgcaggcg

SEQ ID NO: 956488 - DNA, 25 bp, Mus musculus
gtcactgtactcaactcctggatca

SEQ ID NO: 956489 - DNA, 25 bp, Mus musculus
gtcactgtactcaagactgcaggcg

SEQ ID NO: 956490 - DNA, 25 bp, Mus musculus
gtcactgtactcaagtcctggatca

SEQ ID NO: 956491 - DNA, 25 bp, Mus musculus
gtcactgtgcagatccgctcgctgt

SEQ ID NO: 956492 - DNA, 25 bp, Mus musculus
gtcactgtgcagctcattctctttg

SEQ ID NO: 956493 - DNA, 25 bp, Mus musculus
gtcactgtgcaggtcattctctttg

SEQ ID NO: 956494 - DNA, 25 bp, Mus musculus
gtcactgtgcagttccgctcgctgt

SEQ ID NO: 956495 - DNA, 25 bp, Mus musculus
gtcactgtgctccgaatcccacaga

SEQ ID NO: 956496 - DNA, 25 bp, Mus musculus
gtcactgtgctcggaatcccacaga

SEQ ID NO: 956497 - DNA, 25 bp, Mus musculus
gtcacttggtcacgtactggatctc

SEQ ID NO: 956498 - DNA, 25 bp, Mus musculus
gtcacttggtcaggtactggatctc

SEQ ID NO: 956499 - DNA, 25 bp, Mus musculus
gtcactttatagaacttcacctcag

SEQ ID NO: 956500 - DNA, 25 bp, Mus musculus
gtcactttatagtacttcacctcag

SEQ ID NO: 956501 - DNA, 25 bp, Mus musculus
gtcagaaaagccgagtcttcagtag

SEQ ID NO: 956502 - DNA, 25 bp, Mus musculus
gtcagaaaaggcgagtcttcagtag

SEQ ID NO: 956503 - DNA, 25 bp, Mus musculus
gtcagaaagaagaggaaaccagagg

SEQ ID NO: 956504 - DNA, 25 bp, Mus musculus
gtcagaaagaagtggaaaccagagg

SEQ ID NO: 956505 - DNA, 25 bp, Mus musculus
gtcagaaagactctactgtatactc

SEQ ID NO: 956506 - DNA, 25 bp, Mus musculus
gtcagaaagagtctactgtatactc

SEQ ID NO: 956507 - DNA, 25 bp, Mus musculus
gtcagaacaaatcgtgaaagagatc

SEQ ID NO: 956508 - DNA, 25 bp, Mus musculus
gtcagaacaaatggtgaaagagatc

SEQ ID NO: 956509 - DNA, 25 bp, Mus musculus
gtcagaactacaaacgctgtttgga

SEQ ID NO: 956510 - DNA, 25 bp, Mus musculus
gtcagaactacatacgctgtttgga

SEQ ID NO: 956511 - DNA, 25 bp, Mus musculus
gtcagaagacatcaagtgctgtaac

SEQ ID NO: 956512 - DNA, 25 bp, Mus musculus
gtcagaagacatcatgtgctgtaac

SEQ ID NO: 956513 - DNA, 25 bp, Mus musculus
gtcagaagagaagacgccagcaaaa

SEQ ID NO: 956514 - DNA, 25 bp, Mus musculus
gtcagaagagcagtccaaaatcgac

SEQ ID NO: 956515 - DNA, 25 bp, Mus musculus
gtcagaagaggagtccaaaatcgac

SEQ ID NO: 956516 - DNA, 25 bp, Mus musculus
gtcagaagagtagacgccagcaaaa

SEQ ID NO: 956517 - DNA, 25 bp, Mus musculus
gtcagaatctctgaccttcgttgcc

SEQ ID NO: 956518 - DNA, 25 bp, Mus musculus
gtcagaatctctgagcttcgttgcc

SEQ ID NO: 956519 - DNA, 25 bp, Mus musculus
gtcagacacaagcttcatcacgagg

SEQ ID NO: 956520 - DNA, 25 bp, Mus musculus
gtcagacacaaggttcatcacgagg

SEQ ID NO: 956521 - DNA, 25 bp, Mus musculus
gtcagacacccaggcaacttctcca

SEQ ID NO: 956522 - DNA, 25 bp, Mus musculus
gtcagacacccagggaacttctcca

SEQ ID NO: 956523 - DNA, 25 bp, Mus musculus
gtcagagaagaatccctgggaggaa

SEQ ID NO: 956524 - DNA, 25 bp, Mus musculus
gtcagagaagcaagcagcggtggcg

SEQ ID NO: 956525 - DNA, 25 bp, Mus musculus
gtcagagaaggaagcagcggtggcg

SEQ ID NO: 956526 - DNA, 25 bp, Mus musculus
gtcagagaagtatccctgggaggaa

SEQ ID NO: 956527 - DNA, 25 bp, Mus musculus
gtcagagagacttgcccacctcttg

SEQ ID NO: 956528 - DNA, 25 bp, Mus musculus
gtcagagagagttgcccacctcttg

SEQ ID NO: 956529 - DNA, 25 bp, Mus musculus
gtcagagagatgcacgtaacccctc

SEQ ID NO: 956530 - DNA, 25 bp, Mus musculus
gtcagagagatgcactatgacttct

SEQ ID NO: 956531 - DNA, 25 bp, Mus musculus
gtcagagagatgcaggtaacccctc

SEQ ID NO: 956532 - DNA, 25 bp, Mus musculus
gtcagagagatgcagtatgacttct

SEQ ID NO: 956533 - DNA, 25 bp, Mus musculus
gtcagagatcagcaagccaagctgt

SEQ ID NO: 956534 - DNA, 25 bp, Mus musculus
gtcagagatcagccaagctgtctga

SEQ ID NO: 956535 - DNA, 25 bp, Mus musculus
gtcagagatcaggaagccaagctgt

SEQ ID NO: 956536 - DNA, 25 bp, Mus musculus
gtcagagatcaggcaagctgtctga

SEQ ID NO: 956537 - DNA, 25 bp, Mus musculus
gtcagagcagcccaaccgagcaatc

SEQ ID NO: 956538 - DNA, 25 bp, Mus musculus
gtcagagcaggccaaccgagcaatc

SEQ ID NO: 956539 - DNA, 25 bp, Mus musculus
gtcagagctgctgctgtgagtgctt

SEQ ID NO: 956540 - DNA, 25 bp, Mus musculus
gtcagagctggtgctgtgagtgctt

SEQ ID NO: 956541 - DNA, 25 bp, Mus musculus
gtcagaggagcaaagggcatcagcc

SEQ ID NO: 956542 - DNA, 25 bp, Mus musculus
gtcagaggagctggagcctactacc

SEQ ID NO: 956543 - DNA, 25 bp, Mus musculus
gtcagaggaggaaagggcatcagcc

SEQ ID NO: 956544 - DNA, 25 bp, Mus musculus
gtcagaggaggtggagcctactacc

SEQ ID NO: 956545 - DNA, 25 bp, Mus musculus
gtcagaggccaacgatgctggggct

SEQ ID NO: 956546 - DNA, 25 bp, Mus musculus
gtcagaggccaaggatgctggggct

SEQ ID NO: 956547 - DNA, 25 bp, Mus musculus
gtcagagtatgacaaaataaaggac

SEQ ID NO: 956548 - DNA, 25 bp, Mus musculus
gtcagagtatgacaggctgttatgt

SEQ ID NO: 956549 - DNA, 25 bp, Mus musculus
gtcagagtatgacgaagaagattcc

SEQ ID NO: 956550 - DNA, 25 bp, Mus musculus
gtcagagtatgactttctcctcatc

SEQ ID NO: 956551 - DNA, 25 bp, Mus musculus
gtcagagtatgagaaaataaaggac

SEQ ID NO: 956552 - DNA, 25 bp, Mus musculus
gtcagagtatgagaggctgttatgt

SEQ ID NO: 956553 - DNA, 25 bp, Mus musculus
gtcagagtatgaggaagaagattcc

SEQ ID NO: 956554 - DNA, 25 bp, Mus musculus
gtcagagtatgagtttctcctcatc

SEQ ID NO: 956555 - DNA, 25 bp, Mus musculus
gtcagagtgtgacgccggcgtgtct

SEQ ID NO: 956556 - DNA, 25 bp, Mus musculus
gtcagagtgtgaggccggcgtgtct

SEQ ID NO: 956557 - DNA, 25 bp, Mus musculus
gtcagagttcaacgtgatggtgaac

SEQ ID NO: 956558 - DNA, 25 bp, Mus musculus
gtcagagttcaaggtgatggtgaac

SEQ ID NO: 956559 - DNA, 25 bp, Mus musculus
gtcagataatcactccaaacctctg

SEQ ID NO: 956560 - DNA, 25 bp, Mus musculus
gtcagataatcagtccaaacctctg

SEQ ID NO: 956561 - DNA, 25 bp, Mus musculus
gtcagatcagctttggactccttcc

SEQ ID NO: 956562 - DNA, 25 bp, Mus musculus
gtcagatcaggtttggactccttcc

SEQ ID NO: 956563 - DNA, 25 bp, Mus musculus
gtcagatgagccctaggaccatgaa

SEQ ID NO: 956564 - DNA, 25 bp, Mus musculus
gtcagatgaggcctaggaccatgaa

SEQ ID NO: 956565 - DNA, 25 bp, Mus musculus
gtcagattgaagctcagatgtacca

SEQ ID NO: 956566 - DNA, 25 bp, Mus musculus
gtcagattgaaggtcagatgtacca

SEQ ID NO: 956567 - DNA, 25 bp, Mus musculus
gtcagattggttgtcgccatctttt

SEQ ID NO: 956568 - DNA, 25 bp, Mus musculus
gtcagattggttgtggccatctttt

SEQ ID NO: 956569 - DNA, 25 bp, Mus musculus
gtcagcaatgcggctggagagatgg

SEQ ID NO: 956570 - DNA, 25 bp, Mus musculus
gtcagcaatgcgttcagacctcgaa

SEQ ID NO: 956571 - DNA, 25 bp, Mus musculus
gtcagcaatggggctggagagatgg

SEQ ID NO: 956572 - DNA, 25 bp, Mus musculus
gtcagcaatgggttcagacctcgaa

SEQ ID NO: 956573 - DNA, 25 bp, Mus musculus
gtcagcacatccaaaaacccacctg

SEQ ID NO: 956574 - DNA, 25 bp, Mus musculus
gtcagcacatccaataacccacctg

SEQ ID NO: 956575 - DNA, 25 bp, Mus musculus
gtcagcactgtgcctgccagggcca

SEQ ID NO: 956576 - DNA, 25 bp, Mus musculus
gtcagcactgtggctgccagggcca

SEQ ID NO: 956577 - DNA, 25 bp, Mus musculus
gtcagcagcgagcacatgtctcatt

SEQ ID NO: 956578 - DNA, 25 bp, Mus musculus
gtcagcagcgagcagatgtctcatt

SEQ ID NO: 956579 - DNA, 25 bp, Mus musculus
gtcagcaggaagaatggaagcttct

SEQ ID NO: 956580 - DNA, 25 bp, Mus musculus
gtcagcaggaagcgcatccagtatg

SEQ ID NO: 956581 - DNA, 25 bp, Mus musculus
gtcagcaggaagggcatccagtatg

SEQ ID NO: 956582 - DNA, 25 bp, Mus musculus
gtcagcaggaagtatggaagcttct

SEQ ID NO: 956583 - DNA, 25 bp, Mus musculus
gtcagcatagcacagtaagtcacag

SEQ ID NO: 956584 - DNA, 25 bp, Mus musculus
gtcagcatagcagagtaagtcacag

SEQ ID NO: 956585 - DNA, 25 bp, Mus musculus
gtcagcatctcccacgtaaatcaca

SEQ ID NO: 956586 - DNA, 25 bp, Mus musculus
gtcagcatctcccaggtaaatcaca

SEQ ID NO: 956587 - DNA, 25 bp, Mus musculus
gtcagccaagatgtccagagctgaa

SEQ ID NO: 956588 - DNA, 25 bp, Mus musculus
gtcagccaagttgtccagagctgaa

SEQ ID NO: 956589 - DNA, 25 bp, Mus musculus
gtcagcccagctgctgtgagtggct

SEQ ID NO: 956590 - DNA, 25 bp, Mus musculus
gtcagcccaggtgctgtgagtggct

SEQ ID NO: 956591 - DNA, 25 bp, Mus musculus
gtcagctgacaaagtgtcctcgcat

SEQ ID NO: 956592 - DNA, 25 bp, Mus musculus
gtcagctgacaatgtgtcctcgcat

SEQ ID NO: 956593 - DNA, 25 bp, Mus musculus
gtcagctgccatcggacaaggctgt

SEQ ID NO: 956594 - DNA, 25 bp, Mus musculus
gtcagctgccatgggacaaggctgt

SEQ ID NO: 956595 - DNA, 25 bp, Mus musculus
gtcagctttatcaacgagaagaaat

SEQ ID NO: 956596 - DNA, 25 bp, Mus musculus
gtcagctttatcaaggagaagaaat

SEQ ID NO: 956597 - DNA, 25 bp, Mus musculus
gtcaggaaacagcacattcctcaga

SEQ ID NO: 956598 - DNA, 25 bp, Mus musculus
gtcaggaaacagcacggaaggatct

SEQ ID NO: 956599 - DNA, 25 bp, Mus musculus
gtcaggaaacagcagattcctcaga

SEQ ID NO: 956600 - DNA, 25 bp, Mus musculus
gtcaggaaacagcagggaaggatct

SEQ ID NO: 956601 - DNA, 25 bp, Mus musculus
gtcaggactgagcgagaaggatgac

SEQ ID NO: 956602 - DNA, 25 bp, Mus musculus
gtcaggactgagggagaaggatgac

SEQ ID NO: 956603 - DNA, 25 bp, Mus musculus
gtcaggcaagccagtccctcgagag

SEQ ID NO: 956604 - DNA, 25 bp, Mus musculus
gtcaggcaaggcagtccctcgagag

SEQ ID NO: 956605 - DNA, 25 bp, Mus musculus
gtcaggccaagacatgcccggaacc

SEQ ID NO: 956606 - DNA, 25 bp, Mus musculus
gtcaggccaagagatgcccggaacc

SEQ ID NO: 956607 - DNA, 25 bp, Mus musculus
gtcaggcgcgaggacctccagaaat

SEQ ID NO: 956608 - DNA, 25 bp, Mus musculus
gtcaggcgcgaggagctccagaaat

SEQ ID NO: 956609 - DNA, 25 bp, Mus musculus
gtcaggctcacactctgctcctggc

SEQ ID NO: 956610 - DNA, 25 bp, Mus musculus
gtcaggctcacagtctgctcctggc

SEQ ID NO: 956611 - DNA, 25 bp, Mus musculus
gtcaggggctttcacggggactgca

SEQ ID NO: 956612 - DNA, 25 bp, Mus musculus
gtcaggggctttcagggggactgca

SEQ ID NO: 956613 - DNA, 25 bp, Mus musculus
gtcaggttctagatatgtgctgact

SEQ ID NO: 956614 - DNA, 25 bp, Mus musculus
gtcaggttctagttatgtgctgact

SEQ ID NO: 956615 - DNA, 25 bp, Mus musculus
gtcagtacgacaactgcctgaccta

SEQ ID NO: 956616 - DNA, 25 bp, Mus musculus
gtcagtacgagaactgcctgaccta

SEQ ID NO: 956617 - DNA, 25 bp, Mus musculus
gtcagtatcagacgtaatatcgggg

SEQ ID NO: 956618 - DNA, 25 bp, Mus musculus
gtcagtatcagaggtaatatcgggg

SEQ ID NO: 956619 - DNA, 25 bp, Mus musculus
gtcagtcactgctacgtatggcact

SEQ ID NO: 956620 - DNA, 25 bp, Mus musculus
gtcagtcactgctaggtatggcact

SEQ ID NO: 956621 - DNA, 25 bp, Mus musculus
gtcagtcatgatttctttcaacatg

SEQ ID NO: 956622 - DNA, 25 bp, Mus musculus
gtcagtcatgttttctttcaacatg

SEQ ID NO: 956623 - DNA, 25 bp, Mus musculus
gtcagtcctatgccagtaccagtga

SEQ ID NO: 956624 - DNA, 25 bp, Mus musculus
gtcagtcctatggcagtaccagtga

SEQ ID NO: 956625 - DNA, 25 bp, Mus musculus
gtcagtcgctgccacgggggcaaca

SEQ ID NO: 956626 - DNA, 25 bp, Mus musculus
gtcagtcgctgccaggggggcaaca

SEQ ID NO: 956627 - DNA, 25 bp, Mus musculus
gtcagtcttcagcagatgaagcctt

SEQ ID NO: 956628 - DNA, 25 bp, Mus musculus
gtcagtcttcaggagatgaagcctt

SEQ ID NO: 956629 - DNA, 25 bp, Mus musculus
gtcagtgccccaaacgcttcaacgg

SEQ ID NO: 956630 - DNA, 25 bp, Mus musculus
gtcagtgccccaaaggcttcaacgg

SEQ ID NO: 956631 - DNA, 25 bp, Mus musculus
gtcagtggaagcaactgtgaaatca

SEQ ID NO: 956632 - DNA, 25 bp, Mus musculus
gtcagtggaagcaagtgtgaaatca

SEQ ID NO: 956633 - DNA, 25 bp, Mus musculus
gtcagtggcaatatcatgccaaccc

SEQ ID NO: 956634 - DNA, 25 bp, Mus musculus
gtcagtggcaatatgatgccaaccc

SEQ ID NO: 956635 - DNA, 25 bp, Mus musculus
gtcagttcccaacttatttcacagc

SEQ ID NO: 956636 - DNA, 25 bp, Mus musculus
gtcagttcccaagttatttcacagc

SEQ ID NO: 956637 - DNA, 25 bp, Mus musculus
gtcagttgttcgatcgaaatgtgaa

SEQ ID NO: 956638 - DNA, 25 bp, Mus musculus
gtcagttgttggatcgaaatgtgaa

SEQ ID NO: 956639 - DNA, 25 bp, Mus musculus
gtcagtttataacgtcccctttgct

SEQ ID NO: 956640 - DNA, 25 bp, Mus musculus
gtcagtttataaggtcccctttgct

SEQ ID NO: 956641 - DNA, 25 bp, Mus musculus
gtcagtttgtagatgtttgcataga

SEQ ID NO: 956642 - DNA, 25 bp, Mus musculus
gtcagtttgtagttgtttgcataga

SEQ ID NO: 956643 - DNA, 25 bp, Mus musculus
gtcataattgtcttcatatggacga

SEQ ID NO: 956644 - DNA, 25 bp, Mus musculus
gtcataattgtcttgatatggacga

SEQ ID NO: 956645 - DNA, 25 bp, Mus musculus
gtcatacagattttcggaacatcaa

SEQ ID NO: 956646 - DNA, 25 bp, Mus musculus
gtcatacagattttgggaacatcaa

SEQ ID NO: 956647 - DNA, 25 bp, Mus musculus
gtcatacaggagatcgatgtgtact

SEQ ID NO: 956648 - DNA, 25 bp, Mus musculus
gtcatacaggagttcgatgtgtact

SEQ ID NO: 956649 - DNA, 25 bp, Mus musculus
gtcatagaaaagaactttcagccaa

SEQ ID NO: 956650 - DNA, 25 bp, Mus musculus
gtcatagaaaagtactttcagccaa

SEQ ID NO: 956651 - DNA, 25 bp, Mus musculus
gtcatagcacagatcctggccggct

SEQ ID NO: 956652 - DNA, 25 bp, Mus musculus
gtcatagcacagttcctggccggct

SEQ ID NO: 956653 - DNA, 25 bp, Mus musculus
gtcatagcatcacgcactgttgtag

SEQ ID NO: 956654 - DNA, 25 bp, Mus musculus
gtcatagcatcaggcactgttgtag

SEQ ID NO: 956655 - DNA, 25 bp, Mus musculus
gtcatagtactacattcatcccagg

SEQ ID NO: 956656 - DNA, 25 bp, Mus musculus
gtcatagtactagattcatcccagg

SEQ ID NO: 956657 - DNA, 25 bp, Mus musculus
gtcatcaacaagcagactagggtcc

SEQ ID NO: 956658 - DNA, 25 bp, Mus musculus
gtcatcaacaaggagactagggtcc

SEQ ID NO: 956659 - DNA, 25 bp, Mus musculus
gtcatcaacacacactttcctgccc

SEQ ID NO: 956660 - DNA, 25 bp, Mus musculus
gtcatcaacacagactttcctgccc

SEQ ID NO: 956661 - DNA, 25 bp, Mus musculus
gtcatcaaccagcatggcgaggaga

SEQ ID NO: 956662 - DNA, 25 bp, Mus musculus
gtcatcaaccaggatggcgaggaga

SEQ ID NO: 956663 - DNA, 25 bp, Mus musculus
gtcatcaatcagcctggagacacca

SEQ ID NO: 956664 - DNA, 25 bp, Mus musculus
gtcatcaatcaggctggagacacca

SEQ ID NO: 956665 - DNA, 25 bp, Mus musculus
gtcatcacagacaccctctctccag

SEQ ID NO: 956666 - DNA, 25 bp, Mus musculus
gtcatcacagattctttaagatttc

SEQ ID NO: 956667 - DNA, 25 bp, Mus musculus
gtcatcacagctgtgacaccagccc

SEQ ID NO: 956668 - DNA, 25 bp, Mus musculus
gtcatcacagcttagcgctctgtgg

SEQ ID NO: 956669 - DNA, 25 bp, Mus musculus
gtcatcacaggtgtgacaccagccc

SEQ ID NO: 956670 - DNA, 25 bp, Mus musculus
gtcatcacaggttagcgctctgtgg

SEQ ID NO: 956671 - DNA, 25 bp, Mus musculus
gtcatcacagtcaccctctctccag

SEQ ID NO: 956672 - DNA, 25 bp, Mus musculus
gtcatcacagtttctttaagatttc

SEQ ID NO: 956673 - DNA, 25 bp, Mus musculus
gtcatcaccacaccgcctgcgaccc

SEQ ID NO: 956674 - DNA, 25 bp, Mus musculus
gtcatcaccacagcgcctgcgaccc

SEQ ID NO: 956675 - DNA, 25 bp, Mus musculus
gtcatcaccaggaacgcctatggag

SEQ ID NO: 956676 - DNA, 25 bp, Mus musculus
gtcatcaccaggaaggcctatggag

SEQ ID NO: 956677 - DNA, 25 bp, Mus musculus
gtcatcactgcacctccagtgacca

SEQ ID NO: 956678 - DNA, 25 bp, Mus musculus
gtcatcactgcacttctgatcttcc

SEQ ID NO: 956679 - DNA, 25 bp, Mus musculus
gtcatcactgcagctccagtgacca

SEQ ID NO: 956680 - DNA, 25 bp, Mus musculus
gtcatcactgcagttctgatcttcc

SEQ ID NO: 956681 - DNA, 25 bp, Mus musculus
gtcatcactgccttgggtctggctc

SEQ ID NO: 956682 - DNA, 25 bp, Mus musculus
gtcatcactggcttgggtctggctc

SEQ ID NO: 956683 - DNA, 25 bp, Mus musculus
gtcatcagcaagcccctgcctggcc

SEQ ID NO: 956684 - DNA, 25 bp, Mus musculus
gtcatcagcaaggccctgcctggcc

SEQ ID NO: 956685 - DNA, 25 bp, Mus musculus
gtcatcagcttacactccttcgccc

SEQ ID NO: 956686 - DNA, 25 bp, Mus musculus
gtcatcagcttagactccttcgccc

SEQ ID NO: 956687 - DNA, 25 bp, Mus musculus
gtcatcataacacgtcactgccagg

SEQ ID NO: 956688 - DNA, 25 bp, Mus musculus
gtcatcataacaggtcactgccagg

SEQ ID NO: 956689 - DNA, 25 bp, Mus musculus
gtcatcatgagcaactcagccagtg

SEQ ID NO: 956690 - DNA, 25 bp, Mus musculus
gtcatcatgagctactcagccagtg

SEQ ID NO: 956691 - DNA, 25 bp, Mus musculus
gtcatccacagaatcctagactttg

SEQ ID NO: 956692 - DNA, 25 bp, Mus musculus
gtcatccacagacacttgaagcctg

SEQ ID NO: 956693 - DNA, 25 bp, Mus musculus
gtcatccacagagacttgaagcctg

SEQ ID NO: 956694 - DNA, 25 bp, Mus musculus
gtcatccacagattcctagactttg

SEQ ID NO: 956695 - DNA, 25 bp, Mus musculus
gtcatccacattgacagcaccaaga

SEQ ID NO: 956696 - DNA, 25 bp, Mus musculus
gtcatccacattgagagcaccaaga

SEQ ID NO: 956697 - DNA, 25 bp, Mus musculus
gtcatccaccagcctggaaatggaa

SEQ ID NO: 956698 - DNA, 25 bp, Mus musculus
gtcatccaccaggctggaaatggaa

SEQ ID NO: 956699 - DNA, 25 bp, Mus musculus
gtcatccaggacacctttctgtgtt

SEQ ID NO: 956700 - DNA, 25 bp, Mus musculus
gtcatccaggacacgtttctgtgtt

SEQ ID NO: 956701 - DNA, 25 bp, Mus musculus
gtcatccattaccacgtgcctcgca

SEQ ID NO: 956702 - DNA, 25 bp, Mus musculus
gtcatccattaccaggtgcctcgca

SEQ ID NO: 956703 - DNA, 25 bp, Mus musculus
gtcatccccgatcatcatcccctct

SEQ ID NO: 956704 - DNA, 25 bp, Mus musculus
gtcatccccgatgatcatcccctct

SEQ ID NO: 956705 - DNA, 25 bp, Mus musculus
gtcatccctaaacggaacatctgtg

SEQ ID NO: 956706 - DNA, 25 bp, Mus musculus
gtcatccctaaacgtgtcataagcc

SEQ ID NO: 956707 - DNA, 25 bp, Mus musculus
gtcatccctaaagggaacatctgtg

SEQ ID NO: 956708 - DNA, 25 bp, Mus musculus
gtcatccctaaaggtgtcataagcc

SEQ ID NO: 956709 - DNA, 25 bp, Mus musculus
gtcatccggaagctggcaaaaacgc

SEQ ID NO: 956710 - DNA, 25 bp, Mus musculus
gtcatccggaaggtggcaaaaacgc

SEQ ID NO: 956711 - DNA, 25 bp, Mus musculus
gtcatcctacaccgcatcgacggtc

SEQ ID NO: 956712 - DNA, 25 bp, Mus musculus
gtcatcctacacggcatcgacggtc

SEQ ID NO: 956713 - DNA, 25 bp, Mus musculus
gtcatcctcgaagccaagctggata

SEQ ID NO: 956714 - DNA, 25 bp, Mus musculus
gtcatcctcgagcctggctgcttgg

SEQ ID NO: 956715 - DNA, 25 bp, Mus musculus
gtcatcctcgtagccaagctggata

SEQ ID NO: 956716 - DNA, 25 bp, Mus musculus
gtcatcctcgtgcctggctgcttgg

SEQ ID NO: 956717 - DNA, 25 bp, Mus musculus
gtcatcctcttcaatgcggcaggcc

SEQ ID NO: 956718 - DNA, 25 bp, Mus musculus
gtcatcctcttcagagcattccggc

SEQ ID NO: 956719 - DNA, 25 bp, Mus musculus
gtcatcctcttctatgcggcaggcc

SEQ ID NO: 956720 - DNA, 25 bp, Mus musculus
gtcatcctcttctgagcattccggc

SEQ ID NO: 956721 - DNA, 25 bp, Mus musculus
gtcatcctggagttgggctggtcac

SEQ ID NO: 956722 - DNA, 25 bp, Mus musculus
gtcatcctggtgttgggctggtcac

SEQ ID NO: 956723 - DNA, 25 bp, Mus musculus
gtcatcctgtgacttgggtgcaaag

SEQ ID NO: 956724 - DNA, 25 bp, Mus musculus
gtcatcctgtgagttgggtgcaaag

SEQ ID NO: 956725 - DNA, 25 bp, Mus musculus
gtcatccttcgacgatgtctcggaa

SEQ ID NO: 956726 - DNA, 25 bp, Mus musculus
gtcatccttcgacgcttgctttgct

SEQ ID NO: 956727 - DNA, 25 bp, Mus musculus
gtcatccttcgaggatgtctcggaa

SEQ ID NO: 956728 - DNA, 25 bp, Mus musculus
gtcatccttcgaggcttgctttgct

SEQ ID NO: 956729 - DNA, 25 bp, Mus musculus
gtcatcgcggcactcagtcttgcag

SEQ ID NO: 956730 - DNA, 25 bp, Mus musculus
gtcatcgcgggactcagtcttgcag

SEQ ID NO: 956731 - DNA, 25 bp, Mus musculus
gtcatcggcaagatctacctgtcct

SEQ ID NO: 956732 - DNA, 25 bp, Mus musculus
gtcatcggcaagctaatccagtgcc

SEQ ID NO: 956733 - DNA, 25 bp, Mus musculus
gtcatcggcaaggtaatccagtgcc

SEQ ID NO: 956734 - DNA, 25 bp, Mus musculus
gtcatcggcaagttctacctgtcct

SEQ ID NO: 956735 - DNA, 25 bp, Mus musculus
gtcatcggcggcgactagccgctgc

SEQ ID NO: 956736 - DNA, 25 bp, Mus musculus
gtcatcggcggcgagtagccgctgc

SEQ ID NO: 956737 - DNA, 25 bp, Mus musculus
gtcatcgggctgcacatgggcacca

SEQ ID NO: 956738 - DNA, 25 bp, Mus musculus
gtcatcgggctgcagatgggcacca

SEQ ID NO: 956739 - DNA, 25 bp, Mus musculus
gtcatcgtcgccaacgatgaggttg

SEQ ID NO: 956740 - DNA, 25 bp, Mus musculus
gtcatcgtcgccaaggatgaggttg

SEQ ID NO: 956741 - DNA, 25 bp, Mus musculus
gtcatctaagacatctacagccacc

SEQ ID NO: 956742 - DNA, 25 bp, Mus musculus
gtcatctaagtcatctacagccacc

SEQ ID NO: 956743 - DNA, 25 bp, Mus musculus
gtcatctatgagctgatccagacag

SEQ ID NO: 956744 - DNA, 25 bp, Mus musculus
gtcatctatgtgctgatccagacag

SEQ ID NO: 956745 - DNA, 25 bp, Mus musculus
gtcatctatttccacggcttccgag

SEQ ID NO: 956746 - DNA, 25 bp, Mus musculus
gtcatctatttccagggcttccgag

SEQ ID NO: 956747 - DNA, 25 bp, Mus musculus
gtcatctcccagcgactgcgcagct

SEQ ID NO: 956748 - DNA, 25 bp, Mus musculus
gtcatctcccagggactgcgcagct

SEQ ID NO: 956749 - DNA, 25 bp, Mus musculus
gtcatctgacaacacccaagagaaa

SEQ ID NO: 956750 - DNA, 25 bp, Mus musculus
gtcatctgacaacacgtcaccttcg

SEQ ID NO: 956751 - DNA, 25 bp, Mus musculus
gtcatctgacaacagccaagagaaa

SEQ ID NO: 956752 - DNA, 25 bp, Mus musculus
gtcatctgacaacaggtcaccttcg

SEQ ID NO: 956753 - DNA, 25 bp, Mus musculus
gtcatctgcgaacacgactccttct

SEQ ID NO: 956754 - DNA, 25 bp, Mus musculus
gtcatctgcgtacacgactccttct

SEQ ID NO: 956755 - DNA, 25 bp, Mus musculus
gtcatgaacatacgcccttctgagt

SEQ ID NO: 956756 - DNA, 25 bp, Mus musculus
gtcatgaacataggcccttctgagt

SEQ ID NO: 956757 - DNA, 25 bp, Mus musculus
gtcatgacacagactagaggaaatg

SEQ ID NO: 956758 - DNA, 25 bp, Mus musculus
gtcatgacacagtctagaggaaatg

SEQ ID NO: 956759 - DNA, 25 bp, Mus musculus
gtcatgaccaaacgcttggacacca

SEQ ID NO: 956760 - DNA, 25 bp, Mus musculus
gtcatgaccaaaggcttggacacca

SEQ ID NO: 956761 - DNA, 25 bp, Mus musculus
gtcatgactgccatttgcttcacac

SEQ ID NO: 956762 - DNA, 25 bp, Mus musculus
gtcatgactgcggtgatctgctttg

SEQ ID NO: 956763 - DNA, 25 bp, Mus musculus
gtcatgactggcatttgcttcacac

SEQ ID NO: 956764 - DNA, 25 bp, Mus musculus
gtcatgactggggtgatctgctttg

SEQ ID NO: 956765 - DNA, 25 bp, Mus musculus
gtcatgagtccaaggagtctctcgc

SEQ ID NO: 956766 - DNA, 25 bp, Mus musculus
gtcatgagtcgaaggagtctctcgc

SEQ ID NO: 956767 - DNA, 25 bp, Mus musculus
gtcatgcaattgcacggacggaatc

SEQ ID NO: 956768 - DNA, 25 bp, Mus musculus
gtcatgcaattgcagggacggaatc

SEQ ID NO: 956769 - DNA, 25 bp, Mus musculus
gtcatgcacaagatccggccacaca

SEQ ID NO: 956770 - DNA, 25 bp, Mus musculus
gtcatgcacaagttccggccacaca

SEQ ID NO: 956771 - DNA, 25 bp, Mus musculus
gtcatgccacagcactacctgtgct

SEQ ID NO: 956772 - DNA, 25 bp, Mus musculus
gtcatgccacaggactacctgtgct

SEQ ID NO: 956773 - DNA, 25 bp, Mus musculus
gtcatggacaatcactgcactgtcc

SEQ ID NO: 956774 - DNA, 25 bp, Mus musculus
gtcatggacaatcagtgcactgtcc

SEQ ID NO: 956775 - DNA, 25 bp, Mus musculus
gtcatggactttaacgacacttgga

SEQ ID NO: 956776 - DNA, 25 bp, Mus musculus
gtcatggactttaaggacacttgga

SEQ ID NO: 956777 - DNA, 25 bp, Mus musculus
gtcatggatgacaacgtgaaggagt

SEQ ID NO: 956778 - DNA, 25 bp, Mus musculus
gtcatggatgacaaggtgaaggagt

SEQ ID NO: 956779 - DNA, 25 bp, Mus musculus
gtcatgggagcaaacggtgctgtgg

SEQ ID NO: 956780 - DNA, 25 bp, Mus musculus
gtcatgggagcaaagggtgctgtgg

SEQ ID NO: 956781 - DNA, 25 bp, Mus musculus
gtcatgggcccgattgacgacagtg

SEQ ID NO: 956782 - DNA, 25 bp, Mus musculus
gtcatgggcccgtttgacgacagtg

SEQ ID NO: 956783 - DNA, 25 bp, Mus musculus
gtcatggtgaccaacgccaaagctg

SEQ ID NO: 956784 - DNA, 25 bp, Mus musculus
gtcatggtgaccaaggccaaagctg

SEQ ID NO: 956785 - DNA, 25 bp, Mus musculus
gtcatggtgtgacgggtcccacaga

SEQ ID NO: 956786 - DNA, 25 bp, Mus musculus
gtcatggtgtgaggggtcccacaga

SEQ ID NO: 956787 - DNA, 25 bp, Mus musculus
gtcatgtatgtacgactcacagatt

SEQ ID NO: 956788 - DNA, 25 bp, Mus musculus
gtcatgtatgtaggactcacagatt

SEQ ID NO: 956789 - DNA, 25 bp, Mus musculus
gtcatgtcctacacctccctcccag

SEQ ID NO: 956790 - DNA, 25 bp, Mus musculus
gtcatgtcctacacgtccctcccag

SEQ ID NO: 956791 - DNA, 25 bp, Mus musculus
gtcatgtttaagcttggtgaagatc

SEQ ID NO: 956792 - DNA, 25 bp, Mus musculus
gtcatgtttaaggttggtgaagatc

SEQ ID NO: 956793 - DNA, 25 bp, Mus musculus
gtcattaatcaaaacggcatcgatc

SEQ ID NO: 956794 - DNA, 25 bp, Mus musculus
gtcattaatcaaaagggcatcgatc

SEQ ID NO: 956795 - DNA, 25 bp, Mus musculus
gtcattaatccacgatccacagggt

SEQ ID NO: 956796 - DNA, 25 bp, Mus musculus
gtcattaatccaggatccacagggt

SEQ ID NO: 956797 - DNA, 25 bp, Mus musculus
gtcattagagctttggccaagtcag

SEQ ID NO: 956798 - DNA, 25 bp, Mus musculus
gtcattagaggtttggccaagtcag

SEQ ID NO: 956799 - DNA, 25 bp, Mus musculus
gtcattatcaagagccctacctcag

SEQ ID NO: 956800 - DNA, 25 bp, Mus musculus
gtcattatcaagtgccctacctcag

SEQ ID NO: 956801 - DNA, 25 bp, Mus musculus
gtcattcagatgattaaagaagtcc

SEQ ID NO: 956802 - DNA, 25 bp, Mus musculus
gtcattcagatgtttaaagaagtcc

SEQ ID NO: 956803 - DNA, 25 bp, Mus musculus
gtcattcataaacattgaggaagac

SEQ ID NO: 956804 - DNA, 25 bp, Mus musculus
gtcattcataaagattgaggaagac

SEQ ID NO: 956805 - DNA, 25 bp, Mus musculus
gtcattccaccccacactctgcaga

SEQ ID NO: 956806 - DNA, 25 bp, Mus musculus
gtcattccaccccagactctgcaga

SEQ ID NO: 956807 - DNA, 25 bp, Mus musculus
gtcattccagaggatgaagagtgtt

SEQ ID NO: 956808 - DNA, 25 bp, Mus musculus
gtcattccagtggatgaagagtgtt

SEQ ID NO: 956809 - DNA, 25 bp, Mus musculus
gtcattccgatgcaatacctccatg

SEQ ID NO: 956810 - DNA, 25 bp, Mus musculus
gtcattccgatggaatacctccatg

SEQ ID NO: 956811 - DNA, 25 bp, Mus musculus
gtcattcgcaaacgacccatttcga

SEQ ID NO: 956812 - DNA, 25 bp, Mus musculus
gtcattcgcaaaggacccatttcga

SEQ ID NO: 956813 - DNA, 25 bp, Mus musculus
gtcattcttctgctcatcgttgtgc

SEQ ID NO: 956814 - DNA, 25 bp, Mus musculus
gtcattcttctggtcatcgttgtgc

SEQ ID NO: 956815 - DNA, 25 bp, Mus musculus
gtcattgagaagagccccaagccag

SEQ ID NO: 956816 - DNA, 25 bp, Mus musculus
gtcattgagaagtgccccaagccag

SEQ ID NO: 956817 - DNA, 25 bp, Mus musculus
gtcattggcttgaacgatgctcaga

SEQ ID NO: 956818 - DNA, 25 bp, Mus musculus
gtcattggcttgaaggatgctcaga

SEQ ID NO: 956819 - DNA, 25 bp, Mus musculus
gtcattggggcacgttcctttggag

SEQ ID NO: 956820 - DNA, 25 bp, Mus musculus
gtcattggggcaggttcctttggag

SEQ ID NO: 956821 - DNA, 25 bp, Mus musculus
gtcattgtgcttcatgttcaaatag

SEQ ID NO: 956822 - DNA, 25 bp, Mus musculus
gtcattgtgcttcgtgcctttattg

SEQ ID NO: 956823 - DNA, 25 bp, Mus musculus
gtcattgtgcttgatgttcaaatag

SEQ ID NO: 956824 - DNA, 25 bp, Mus musculus
gtcattgtgcttggtgcctttattg

SEQ ID NO: 956825 - DNA, 25 bp, Mus musculus
gtcatttcagcggagcgtttgccta

SEQ ID NO: 956826 - DNA, 25 bp, Mus musculus
gtcatttcaggggagcgtttgccta

SEQ ID NO: 956827 - DNA, 25 bp, Mus musculus
gtcattttcatgatcacaaaatttg

SEQ ID NO: 956828 - DNA, 25 bp, Mus musculus
gtcattttcatgttcacaaaatttg

SEQ ID NO: 956829 - DNA, 25 bp, Mus musculus
gtcattttgaaacatgtccttcaag

SEQ ID NO: 956830 - DNA, 25 bp, Mus musculus
gtcattttgaaagatgtccttcaag

SEQ ID NO: 956831 - DNA, 25 bp, Mus musculus
gtccaaagccctcgatttcatcaag

SEQ ID NO: 956832 - DNA, 25 bp, Mus musculus
gtccaaagccctggatttcatcaag

SEQ ID NO: 956833 - DNA, 25 bp, Mus musculus
gtccaacaaacaagtttgcacggat

SEQ ID NO: 956834 - DNA, 25 bp, Mus musculus
gtccaacaaacatgtttgcacggat

SEQ ID NO: 956835 - DNA, 25 bp, Mus musculus
gtccaacgagcaccagtccatgggc

SEQ ID NO: 956836 - DNA, 25 bp, Mus musculus
gtccaacgaggaccagtccatgggc

SEQ ID NO: 956837 - DNA, 25 bp, Mus musculus
gtccaagagtgacgccaggcccgag

SEQ ID NO: 956838 - DNA, 25 bp, Mus musculus
gtccaagagtgaggccaggcccgag

SEQ ID NO: 956839 - DNA, 25 bp, Mus musculus
gtccaaggcccacgtggtgaccata

SEQ ID NO: 956840 - DNA, 25 bp, Mus musculus
gtccaaggcccaggtggtgaccata

SEQ ID NO: 956841 - DNA, 25 bp, Mus musculus
gtccaagtataacgtggctctcgag

SEQ ID NO: 956842 - DNA, 25 bp, Mus musculus
gtccaagtataaggtggctctcgag

SEQ ID NO: 956843 - DNA, 25 bp, Mus musculus
gtccaagtctcacgtggaggacccc

SEQ ID NO: 956844 - DNA, 25 bp, Mus musculus
gtccaagtctcaggtggaggacccc

SEQ ID NO: 956845 - DNA, 25 bp, Mus musculus
gtccaatatcatcgggggatatccc

SEQ ID NO: 956846 - DNA, 25 bp, Mus musculus
gtccaatatcatggggggatatccc

SEQ ID NO: 956847 - DNA, 25 bp, Mus musculus
gtccaatttcgggaattaaatccag

SEQ ID NO: 956848 - DNA, 25 bp, Mus musculus
gtccaatttcgggatttaaatccag

SEQ ID NO: 956849 - DNA, 25 bp, Mus musculus
gtccacacagctttatgaagctgat

SEQ ID NO: 956850 - DNA, 25 bp, Mus musculus
gtccacacaggtttatgaagctgat

SEQ ID NO: 956851 - DNA, 25 bp, Mus musculus
gtccacacagtggacgattaccagg

SEQ ID NO: 956852 - DNA, 25 bp, Mus musculus
gtccacacagtggaggattaccagg

SEQ ID NO: 956853 - DNA, 25 bp, Mus musculus
gtccacaccgggacaaccatcatgg

SEQ ID NO: 956854 - DNA, 25 bp, Mus musculus
gtccacaccgggtcaaccatcatgg

SEQ ID NO: 956855 - DNA, 25 bp, Mus musculus
gtccacactacacgctccttcctga

SEQ ID NO: 956856 - DNA, 25 bp, Mus musculus
gtccacactacacgtctgtaactgg

SEQ ID NO: 956857 - DNA, 25 bp, Mus musculus
gtccacactacaggctccttcctga

SEQ ID NO: 956858 - DNA, 25 bp, Mus musculus
gtccacactacaggtctgtaactgg

SEQ ID NO: 956859 - DNA, 25 bp, Mus musculus
gtccacagatgtcgggaacagtgct

SEQ ID NO: 956860 - DNA, 25 bp, Mus musculus
gtccacagatgtggggaacagtgct

SEQ ID NO: 956861 - DNA, 25 bp, Mus musculus
gtccacagccatcggattctgcttc

SEQ ID NO: 956862 - DNA, 25 bp, Mus musculus
gtccacagccatgggattctgcttc

SEQ ID NO: 956863 - DNA, 25 bp, Mus musculus
gtccacatgccacgggatgcccctt

SEQ ID NO: 956864 - DNA, 25 bp, Mus musculus
gtccacatgccaggggatgcccctt

SEQ ID NO: 956865 - DNA, 25 bp, Mus musculus
gtccacatgcccctgtgatgccagt

SEQ ID NO: 956866 - DNA, 25 bp, Mus musculus
gtccacatgcgcctgtgatgccagt

SEQ ID NO: 956867 - DNA, 25 bp, Mus musculus
gtccacatttgacaacggccggttt

SEQ ID NO: 956868 - DNA, 25 bp, Mus musculus
gtccacatttgactgtgaagtgagg

SEQ ID NO: 956869 - DNA, 25 bp, Mus musculus
gtccacatttgagaacggccggttt

SEQ ID NO: 956870 - DNA, 25 bp, Mus musculus
gtccacatttgagtgtgaagtgagg

SEQ ID NO: 956871 - DNA, 25 bp, Mus musculus
gtccaccaaaagcaggatactccca

SEQ ID NO: 956872 - DNA, 25 bp, Mus musculus
gtccaccaaaaggaggatactccca

SEQ ID NO: 956873 - DNA, 25 bp, Mus musculus
gtccaccaacatctcatttacaaat

SEQ ID NO: 956874 - DNA, 25 bp, Mus musculus
gtccaccaacttctcatttacaaat

SEQ ID NO: 956875 - DNA, 25 bp, Mus musculus
gtccaccacgagcatctccaagatg

SEQ ID NO: 956876 - DNA, 25 bp, Mus musculus
gtccaccacgaggatctccaagatg

SEQ ID NO: 956877 - DNA, 25 bp, Mus musculus
gtccactctgtcaacgcccgagacc

SEQ ID NO: 956878 - DNA, 25 bp, Mus musculus
gtccactctgtcaaggcccgagacc

SEQ ID NO: 956879 - DNA, 25 bp, Mus musculus
gtccactgcattcaacagcgtctgt

SEQ ID NO: 956880 - DNA, 25 bp, Mus musculus
gtccactgcattgaacagcgtctgt

SEQ ID NO: 956881 - DNA, 25 bp, Mus musculus
gtccagaccaagcgtacagcctgtt

SEQ ID NO: 956882 - DNA, 25 bp, Mus musculus
gtccagaccaagggtacagcctgtt

SEQ ID NO: 956883 - DNA, 25 bp, Mus musculus
gtccagactcggcgccctgttctcc

SEQ ID NO: 956884 - DNA, 25 bp, Mus musculus
gtccagactcggggccctgttctcc

SEQ ID NO: 956885 - DNA, 25 bp, Mus musculus
gtccagagagatgtgtggccatcat

SEQ ID NO: 956886 - DNA, 25 bp, Mus musculus
gtccagagagttgtgtggccatcat

SEQ ID NO: 956887 - DNA, 25 bp, Mus musculus
gtccagagcaagcttgctcttctgg

SEQ ID NO: 956888 - DNA, 25 bp, Mus musculus
gtccagagcaaggttgctcttctgg

SEQ ID NO: 956889 - DNA, 25 bp, Mus musculus
gtccagagttggctcacagcctcta

SEQ ID NO: 956890 - DNA, 25 bp, Mus musculus
gtccagagttgggtcacagcctcta

SEQ ID NO: 956891 - DNA, 25 bp, Mus musculus
gtccagatcctgaacactgctggag

SEQ ID NO: 956892 - DNA, 25 bp, Mus musculus
gtccagatcctgaaccattcgggaa

SEQ ID NO: 956893 - DNA, 25 bp, Mus musculus
gtccagatcctgaagactgctggag

SEQ ID NO: 956894 - DNA, 25 bp, Mus musculus
gtccagatcctgaagcattcgggaa

SEQ ID NO: 956895 - DNA, 25 bp, Mus musculus
gtccagatgcaacgagtggggaata

SEQ ID NO: 956896 - DNA, 25 bp, Mus musculus
gtccagatgcaaggagtggggaata

SEQ ID NO: 956897 - DNA, 25 bp, Mus musculus
gtccagatggcgaaagatgccaccc

SEQ ID NO: 956898 - DNA, 25 bp, Mus musculus
gtccagatggggaaagatgccaccc

SEQ ID NO: 956899 - DNA, 25 bp, Mus musculus
gtccagcaggccagggagggattgg

SEQ ID NO: 956900 - DNA, 25 bp, Mus musculus
gtccagcagggcagggagggattgg

SEQ ID NO: 956901 - DNA, 25 bp, Mus musculus
gtccagccacaaaaagatcaggatt

SEQ ID NO: 956902 - DNA, 25 bp, Mus musculus
gtccagccacaaaatgatcaggatt

SEQ ID NO: 956903 - DNA, 25 bp, Mus musculus
gtccagccgtcacgtaaaaactggt

SEQ ID NO: 956904 - DNA, 25 bp, Mus musculus
gtccagccgtcaggtaaaaactggt

SEQ ID NO: 956905 - DNA, 25 bp, Mus musculus
gtccagcgaacaatgctcattcatt

SEQ ID NO: 956906 - DNA, 25 bp, Mus musculus
gtccagcgaacattgctcattcatt

SEQ ID NO: 956907 - DNA, 25 bp, Mus musculus
gtccagcgtgcgcccctccagcagc

SEQ ID NO: 956908 - DNA, 25 bp, Mus musculus
gtccagcgtgggcccctccagcagc

SEQ ID NO: 956909 - DNA, 25 bp, Mus musculus
gtccaggatatgaactcttcgtacc

SEQ ID NO: 956910 - DNA, 25 bp, Mus musculus
gtccaggatatgtactcttcgtacc

SEQ ID NO: 956911 - DNA, 25 bp, Mus musculus
gtccaggtgcttcacgggctgacgt

SEQ ID NO: 956912 - DNA, 25 bp, Mus musculus
gtccaggtgcttcaggggctgacgt

SEQ ID NO: 956913 - DNA, 25 bp, Mus musculus
gtccagtacagccacgtgaccgagc

SEQ ID NO: 956914 - DNA, 25 bp, Mus musculus
gtccagtacagccaggtgaccgagc

SEQ ID NO: 956915 - DNA, 25 bp, Mus musculus
gtccatattgccaggtacaccatta

SEQ ID NO: 956916 - DNA, 25 bp, Mus musculus
gtccatattgcctggtacaccatta

SEQ ID NO: 956917 - DNA, 25 bp, Mus musculus
gtccatccaggcctgtaaacttgca

SEQ ID NO: 956918 - DNA, 25 bp, Mus musculus
gtccatccaggcgtgtaaacttgca

SEQ ID NO: 956919 - DNA, 25 bp, Mus musculus
gtccatctgcagcggaaggaggaat

SEQ ID NO: 956920 - DNA, 25 bp, Mus musculus
gtccatctgcaggggaaggaggaat

SEQ ID NO: 956921 - DNA, 25 bp, Mus musculus
gtccatgaacatatcccgtactctt

SEQ ID NO: 956922 - DNA, 25 bp, Mus musculus
gtccatgaacatcggtccaggagtg

SEQ ID NO: 956923 - DNA, 25 bp, Mus musculus
gtccatgaacatgggtccaggagtg

SEQ ID NO: 956924 - DNA, 25 bp, Mus musculus
gtccatgaacatttcccgtactctt

SEQ ID NO: 956925 - DNA, 25 bp, Mus musculus
gtccatgaaggacgatcaggttatc

SEQ ID NO: 956926 - DNA, 25 bp, Mus musculus
gtccatgaaggaggatcaggttatc

SEQ ID NO: 956927 - DNA, 25 bp, Mus musculus
gtccatgacccaaatgcgactgtag

SEQ ID NO: 956928 - DNA, 25 bp, Mus musculus
gtccatgaccgaaatgcgactgtag

SEQ ID NO: 956929 - DNA, 25 bp, Mus musculus
gtccatgagatgcattctgacgttg

SEQ ID NO: 956930 - DNA, 25 bp, Mus musculus
gtccatgagatgcgcgttatgctct

SEQ ID NO: 956931 - DNA, 25 bp, Mus musculus
gtccatgagatgcggcaggcgttat

SEQ ID NO: 956932 - DNA, 25 bp, Mus musculus
gtccatgagatggattctgacgttg

SEQ ID NO: 956933 - DNA, 25 bp, Mus musculus
gtccatgagatgggcgttatgctct

SEQ ID NO: 956934 - DNA, 25 bp, Mus musculus
gtccatgagatggggcaggcgttat

SEQ ID NO: 956935 - DNA, 25 bp, Mus musculus
gtccatgattcacaacttaataaag

SEQ ID NO: 956936 - DNA, 25 bp, Mus musculus
gtccatgattcagaacttaataaag

SEQ ID NO: 956937 - DNA, 25 bp, Mus musculus
gtccatggagagattgatcctgtta

SEQ ID NO: 956938 - DNA, 25 bp, Mus musculus
gtccatggagagtttgatcctgtta

SEQ ID NO: 956939 - DNA, 25 bp, Mus musculus
gtccatgtgaacagcgacacgctgg

SEQ ID NO: 956940 - DNA, 25 bp, Mus musculus
gtccatgtgaacagggacacgctgg

SEQ ID NO: 956941 - DNA, 25 bp, Mus musculus
gtccattgcaaacgctgggatcatc

SEQ ID NO: 956942 - DNA, 25 bp, Mus musculus
gtccattgcaaaggctgggatcatc

SEQ ID NO: 956943 - DNA, 25 bp, Mus musculus
gtccatttcgacttctctacccagg

SEQ ID NO: 956944 - DNA, 25 bp, Mus musculus
gtccatttcgtcttctctacccagg

SEQ ID NO: 956945 - DNA, 25 bp, Mus musculus
gtccatttgaaaatcatgccagaat

SEQ ID NO: 956946 - DNA, 25 bp, Mus musculus
gtccatttgaaaatgatgccagaat

SEQ ID NO: 956947 - DNA, 25 bp, Mus musculus
gtcccaaaggagtcctgcaggtctt

SEQ ID NO: 956948 - DNA, 25 bp, Mus musculus
gtcccaaaggatgcatgctgttctg

SEQ ID NO: 956949 - DNA, 25 bp, Mus musculus
gtcccaaaggctcttcagattacaa

SEQ ID NO: 956950 - DNA, 25 bp, Mus musculus
gtcccaaagggtcttcagattacaa

SEQ ID NO: 956951 - DNA, 25 bp, Mus musculus
gtcccaaaggtgtcctgcaggtctt

SEQ ID NO: 956952 - DNA, 25 bp, Mus musculus
gtcccaaaggttgcatgctgttctg

SEQ ID NO: 956953 - DNA, 25 bp, Mus musculus
gtcccaagaaacatccactgataaa

SEQ ID NO: 956954 - DNA, 25 bp, Mus musculus
gtcccaagaaacatcggattactgc

SEQ ID NO: 956955 - DNA, 25 bp, Mus musculus
gtcccaagaaacatgcactgataaa

SEQ ID NO: 956956 - DNA, 25 bp, Mus musculus
gtcccaagaaacatgggattactgc

SEQ ID NO: 956957 - DNA, 25 bp, Mus musculus
gtcccaagctatcgttctttggctc

SEQ ID NO: 956958 - DNA, 25 bp, Mus musculus
gtcccaagctatggttctttggctc

SEQ ID NO: 956959 - DNA, 25 bp, Mus musculus
gtcccacattccttgcccttcaaag

SEQ ID NO: 956960 - DNA, 25 bp, Mus musculus
gtcccacattgcttgcccttcaaag

SEQ ID NO: 956961 - DNA, 25 bp, Mus musculus
gtcccagaagcgtcagaaagcatgg

SEQ ID NO: 956962 - DNA, 25 bp, Mus musculus
gtcccagaagggtcagaaagcatgg

SEQ ID NO: 956963 - DNA, 25 bp, Mus musculus
gtcccagacaggccccatcagtctc

SEQ ID NO: 956964 - DNA, 25 bp, Mus musculus
gtcccagacagggcccatcagtctc

SEQ ID NO: 956965 - DNA, 25 bp, Mus musculus
gtcccagcagagtgatggttgccca

SEQ ID NO: 956966 - DNA, 25 bp, Mus musculus
gtcccagcagcacatggatttgatt

SEQ ID NO: 956967 - DNA, 25 bp, Mus musculus
gtcccagcaggacatggatttgatt

SEQ ID NO: 956968 - DNA, 25 bp, Mus musculus
gtcccagcagtgtgatggttgccca

SEQ ID NO: 956969 - DNA, 25 bp, Mus musculus
gtcccagctgagactggctggtgga

SEQ ID NO: 956970 - DNA, 25 bp, Mus musculus
gtcccagctgagtctggctggtgga

SEQ ID NO: 956971 - DNA, 25 bp, Mus musculus
gtcccaggacaaaaacctcagcgag

SEQ ID NO: 956972 - DNA, 25 bp, Mus musculus
gtcccaggacaataacctcagcgag

SEQ ID NO: 956973 - DNA, 25 bp, Mus musculus
gtcccaggcaagcctggaagagttg

SEQ ID NO: 956974 - DNA, 25 bp, Mus musculus
gtcccaggcaagcgcagtgtatggg

SEQ ID NO: 956975 - DNA, 25 bp, Mus musculus
gtcccaggcaaggctggaagagttg

SEQ ID NO: 956976 - DNA, 25 bp, Mus musculus
gtcccaggcaagggcagtgtatggg

SEQ ID NO: 956977 - DNA, 25 bp, Mus musculus
gtcccatctgcccctgaaaggacct

SEQ ID NO: 956978 - DNA, 25 bp, Mus musculus
gtcccatctggccctgaaaggacct

SEQ ID NO: 956979 - DNA, 25 bp, Mus musculus
gtcccatgcgtcaggaaatgtgttt

SEQ ID NO: 956980 - DNA, 25 bp, Mus musculus
gtcccatgcgtctggaaatgtgttt

SEQ ID NO: 956981 - DNA, 25 bp, Mus musculus
gtcccatttcagctgctggtggcaa

SEQ ID NO: 956982 - DNA, 25 bp, Mus musculus
gtcccatttcaggtgctggtggcaa

SEQ ID NO: 956983 - DNA, 25 bp, Mus musculus
gtccccaaagcatgataatgaagat

SEQ ID NO: 956984 - DNA, 25 bp, Mus musculus
gtccccaaaggatgataatgaagat

SEQ ID NO: 956985 - DNA, 25 bp, Mus musculus
gtccccaacacacatgatgaggaca

SEQ ID NO: 956986 - DNA, 25 bp, Mus musculus
gtccccaacacagatgatgaggaca

SEQ ID NO: 956987 - DNA, 25 bp, Mus musculus
gtccccagtcaacacttcagctgaa

SEQ ID NO: 956988 - DNA, 25 bp, Mus musculus
gtccccagtcaagacttcagctgaa

SEQ ID NO: 956989 - DNA, 25 bp, Mus musculus
gtcccccagccccaccagcctggta

SEQ ID NO: 956990 - DNA, 25 bp, Mus musculus
gtcccccagccccactccttcaggc

SEQ ID NO: 956991 - DNA, 25 bp, Mus musculus
gtcccccagccccagcagcctggta

SEQ ID NO: 956992 - DNA, 25 bp, Mus musculus
gtcccccagccccagtccttcaggc

SEQ ID NO: 956993 - DNA, 25 bp, Mus musculus
gtcccccatgagcaagcagagttct

SEQ ID NO: 956994 - DNA, 25 bp, Mus musculus
gtcccccatgcgcacctccagacct

SEQ ID NO: 956995 - DNA, 25 bp, Mus musculus
gtcccccatgcgcagctccagacct

SEQ ID NO: 956996 - DNA, 25 bp, Mus musculus
gtcccccatgtgcaagcagagttct

SEQ ID NO: 956997 - DNA, 25 bp, Mus musculus
gtccccgcggaccgcactgagagta

SEQ ID NO: 956998 - DNA, 25 bp, Mus musculus
gtccccgcggaccgcatggcaggac

SEQ ID NO: 956999 - DNA, 25 bp, Mus musculus
gtccccgcggacggcactgagagta

SEQ ID NO: 957000 - DNA, 25 bp, Mus musculus
gtccccgcggacggcatggcaggac

SEQ ID NO: 957001 - DNA, 25 bp, Mus musculus
gtcccctcagcatcgccacgactcg

SEQ ID NO: 957002 - DNA, 25 bp, Mus musculus
gtcccctcaggatcgccacgactcg

SEQ ID NO: 957003 - DNA, 25 bp, Mus musculus
gtcccctctgctctttggattctgc

SEQ ID NO: 957004 - DNA, 25 bp, Mus musculus
gtcccctctggtctttggattctgc

SEQ ID NO: 957005 - DNA, 25 bp, Mus musculus
gtcccctgcccgcaattctgatcaa

SEQ ID NO: 957006 - DNA, 25 bp, Mus musculus
gtcccctgcccggaattctgatcaa

SEQ ID NO: 957007 - DNA, 25 bp, Mus musculus
gtcccctgggagagcttacttttct

SEQ ID NO: 957008 - DNA, 25 bp, Mus musculus
gtcccctgggagtgcttacttttct

SEQ ID NO: 957009 - DNA, 25 bp, Mus musculus
gtcccgagaaagattccagagtcag

SEQ ID NO: 957010 - DNA, 25 bp, Mus musculus
gtcccgagaaagtttccagagtcag

SEQ ID NO: 957011 - DNA, 25 bp, Mus musculus
gtcccgatgaagaactaagtggaaa

SEQ ID NO: 957012 - DNA, 25 bp, Mus musculus
gtcccgatgaagaatggataacgac

SEQ ID NO: 957013 - DNA, 25 bp, Mus musculus
gtcccgatgaagtactaagtggaaa

SEQ ID NO: 957014 - DNA, 25 bp, Mus musculus
gtcccgatgaagtatggataacgac

SEQ ID NO: 957015 - DNA, 25 bp, Mus musculus
gtccctaacgagcaagacaattgcc

SEQ ID NO: 957016 - DNA, 25 bp, Mus musculus
gtccctaacgagcatgacaattgcc

SEQ ID NO: 957017 - DNA, 25 bp, Mus musculus
gtccctagagctgttggtggaatga

SEQ ID NO: 957018 - DNA, 25 bp, Mus musculus
gtccctagaggtgttggtggaatga

SEQ ID NO: 957019 - DNA, 25 bp, Mus musculus
gtccctaggggacctcatcaatatc

SEQ ID NO: 957020 - DNA, 25 bp, Mus musculus
gtccctaggggagctcatcaatatc

SEQ ID NO: 957021 - DNA, 25 bp, Mus musculus
gtccctatccacagtgaacggaggt

SEQ ID NO: 957022 - DNA, 25 bp, Mus musculus
gtccctatccactgtgaacggaggt

SEQ ID NO: 957023 - DNA, 25 bp, Mus musculus
gtccctccagaaattcttgccatgc

SEQ ID NO: 957024 - DNA, 25 bp, Mus musculus
gtccctccagaatttcttgccatgc

SEQ ID NO: 957025 - DNA, 25 bp, Mus musculus
gtccctccccagcaacattgaccat

SEQ ID NO: 957026 - DNA, 25 bp, Mus musculus
gtccctccccagcaatctactctcc

SEQ ID NO: 957027 - DNA, 25 bp, Mus musculus
gtccctccccaggaacattgaccat

SEQ ID NO: 957028 - DNA, 25 bp, Mus musculus
gtccctccccaggaatctactctcc

SEQ ID NO: 957029 - DNA, 25 bp, Mus musculus
gtccctgatccgctatgtggagaac

SEQ ID NO: 957030 - DNA, 25 bp, Mus musculus
gtccctgatccggtatgtggagaac

SEQ ID NO: 957031 - DNA, 25 bp, Mus musculus
gtccctgcagatggatcctgagtac

SEQ ID NO: 957032 - DNA, 25 bp, Mus musculus
gtccctgcagttggatcctgagtac

SEQ ID NO: 957033 - DNA, 25 bp, Mus musculus
gtccctgcatggcgcgctttgggaa

SEQ ID NO: 957034 - DNA, 25 bp, Mus musculus
gtccctgcatggggcgctttgggaa

SEQ ID NO: 957035 - DNA, 25 bp, Mus musculus
gtccctgcggcaccctgctgggatt

SEQ ID NO: 957036 - DNA, 25 bp, Mus musculus
gtccctgcgggaccctgctgggatt

SEQ ID NO: 957037 - DNA, 25 bp, Mus musculus
gtccctggagcgtggctataacctc

SEQ ID NO: 957038 - DNA, 25 bp, Mus musculus
gtccctggagggtggctataacctc

SEQ ID NO: 957039 - DNA, 25 bp, Mus musculus
gtccctggcggtacacaagagcaag

SEQ ID NO: 957040 - DNA, 25 bp, Mus musculus
gtccctggcggttcacaagagcaag

SEQ ID NO: 957041 - DNA, 25 bp, Mus musculus
gtccctgggtgtcaaaccggacttg

SEQ ID NO: 957042 - DNA, 25 bp, Mus musculus
gtccctgggtgtgaaaccggacttg

SEQ ID NO: 957043 - DNA, 25 bp, Mus musculus
gtccctggtgatcggtacgaggaac

SEQ ID NO: 957044 - DNA, 25 bp, Mus musculus
gtccctggtgatgggtacgaggaac

SEQ ID NO: 957045 - DNA, 25 bp, Mus musculus
gtccctgtcggccgctggcagggat

SEQ ID NO: 957046 - DNA, 25 bp, Mus musculus
gtccctgtcggcggctggcagggat

SEQ ID NO: 957047 - DNA, 25 bp, Mus musculus
gtccctgtctgtcgccaggagggcc

SEQ ID NO: 957048 - DNA, 25 bp, Mus musculus
gtccctgtctgtggccaggagggcc

SEQ ID NO: 957049 - DNA, 25 bp, Mus musculus
gtccctgttttcaaccctgcagaaa

SEQ ID NO: 957050 - DNA, 25 bp, Mus musculus
gtccctgttttctaccctgcagaaa

SEQ ID NO: 957051 - DNA, 25 bp, Mus musculus
gtcccttggattcaccagtgcactc

SEQ ID NO: 957052 - DNA, 25 bp, Mus musculus
gtcccttggattcagcagtgcactc

SEQ ID NO: 957053 - DNA, 25 bp, Mus musculus
gtccgaaggatcaaccttctttacc

SEQ ID NO: 957054 - DNA, 25 bp, Mus musculus
gtccgaaggatcaagcttctttacc

SEQ ID NO: 957055 - DNA, 25 bp, Mus musculus
gtccgacagcagcaggtgttcatgt

SEQ ID NO: 957056 - DNA, 25 bp, Mus musculus
gtccgacagcaggaggtgttcatgt

SEQ ID NO: 957057 - DNA, 25 bp, Mus musculus
gtccgacaggatggaaagcctatct

SEQ ID NO: 957058 - DNA, 25 bp, Mus musculus
gtccgacaggttggaaagcctatct

SEQ ID NO: 957059 - DNA, 25 bp, Mus musculus
gtccgaccccaagacttccgatgcc

SEQ ID NO: 957060 - DNA, 25 bp, Mus musculus
gtccgaccccaagagttccgatgcc

SEQ ID NO: 957061 - DNA, 25 bp, Mus musculus
gtccgagaagaacaaggaggagagg

SEQ ID NO: 957062 - DNA, 25 bp, Mus musculus
gtccgagaagaacgaggagaggtac

SEQ ID NO: 957063 - DNA, 25 bp, Mus musculus
gtccgagaagaagaaggaggagagg

SEQ ID NO: 957064 - DNA, 25 bp, Mus musculus
gtccgagaagaaggaggagaggtac

SEQ ID NO: 957065 - DNA, 25 bp, Mus musculus
gtccgagaagctgagattgccattc

SEQ ID NO: 957066 - DNA, 25 bp, Mus musculus
gtccgagaaggtgagattgccattc

SEQ ID NO: 957067 - DNA, 25 bp, Mus musculus
gtccgagacatgcagatcgagggcg

SEQ ID NO: 957068 - DNA, 25 bp, Mus musculus
gtccgagacatggagatcgagggcg

SEQ ID NO: 957069 - DNA, 25 bp, Mus musculus
gtccgagagaagacacagctggtat

SEQ ID NO: 957070 - DNA, 25 bp, Mus musculus
gtccgagagaagaccaccaaggcct

SEQ ID NO: 957071 - DNA, 25 bp, Mus musculus
gtccgagagaagctgggtgacatca

SEQ ID NO: 957072 - DNA, 25 bp, Mus musculus
gtccgagagaaggtgggtgacatca

SEQ ID NO: 957073 - DNA, 25 bp, Mus musculus
gtccgagagaagtcacagctggtat

SEQ ID NO: 957074 - DNA, 25 bp, Mus musculus
gtccgagagaagtccaccaaggcct

SEQ ID NO: 957075 - DNA, 25 bp, Mus musculus
gtccgcaaagggatgccattccgcc

SEQ ID NO: 957076 - DNA, 25 bp, Mus musculus
gtccgcaaagggttgccattccgcc

SEQ ID NO: 957077 - DNA, 25 bp, Mus musculus
gtccgcccttctagagtggcccgtg

SEQ ID NO: 957078 - DNA, 25 bp, Mus musculus
gtccgcccttctagtgtggcccgtg

SEQ ID NO: 957079 - DNA, 25 bp, Mus musculus
gtccgcgactccagtgtatagaaaa

SEQ ID NO: 957080 - DNA, 25 bp, Mus musculus
gtccgcgactcctgtgtatagaaaa

SEQ ID NO: 957081 - DNA, 25 bp, Mus musculus
gtccgcgcttgcgacgtgataggaa

SEQ ID NO: 957082 - DNA, 25 bp, Mus musculus
gtccgcgcttgcgaggtgataggaa

SEQ ID NO: 957083 - DNA, 25 bp, Mus musculus
gtccgctccagtgccactttactgg

SEQ ID NO: 957084 - DNA, 25 bp, Mus musculus
gtccgctccagtgcgactttactgg

SEQ ID NO: 957085 - DNA, 25 bp, Mus musculus
gtccgctgagcacgtatgtgtgtgg

SEQ ID NO: 957086 - DNA, 25 bp, Mus musculus
gtccgctgagcaggtatgtgtgtgg

SEQ ID NO: 957087 - DNA, 25 bp, Mus musculus
gtccgcttccagctcccgatgcccg

SEQ ID NO: 957088 - DNA, 25 bp, Mus musculus
gtccgcttccaggtcccgatgcccg

SEQ ID NO: 957089 - DNA, 25 bp, Mus musculus
gtccgctttcagcaggacattattt

SEQ ID NO: 957090 - DNA, 25 bp, Mus musculus
gtccgctttcaggaggacattattt

SEQ ID NO: 957091 - DNA, 25 bp, Mus musculus
gtccggaaagaacacgttcagcaaa

SEQ ID NO: 957092 - DNA, 25 bp, Mus musculus
gtccggaaagaacaggttcagcaaa

SEQ ID NO: 957093 - DNA, 25 bp, Mus musculus
gtccggacctggcacgggactgtca

SEQ ID NO: 957094 - DNA, 25 bp, Mus musculus
gtccggacctggcaggggactgtca

SEQ ID NO: 957095 - DNA, 25 bp, Mus musculus
gtccggagttcgagcctccggagcc

SEQ ID NO: 957096 - DNA, 25 bp, Mus musculus
gtccggagttcgtgcctccggagcc

SEQ ID NO: 957097 - DNA, 25 bp, Mus musculus
gtccggatgcagatatttccgtgag

SEQ ID NO: 957098 - DNA, 25 bp, Mus musculus
gtccggatgcagttatttccgtgag

SEQ ID NO: 957099 - DNA, 25 bp, Mus musculus
gtccggcaagcagatgaagtctcgg

SEQ ID NO: 957100 - DNA, 25 bp, Mus musculus
gtccggcaaggagatgaagtctcgg

SEQ ID NO: 957101 - DNA, 25 bp, Mus musculus
gtccggcaggctcacctgcaggctg

SEQ ID NO: 957102 - DNA, 25 bp, Mus musculus
gtccggcaggctcagctgcaggctg

SEQ ID NO: 957103 - DNA, 25 bp, Mus musculus
gtccggctagggtacgttgttcctg

SEQ ID NO: 957104 - DNA, 25 bp, Mus musculus
gtccggctagggtaggttgttcctg

SEQ ID NO: 957105 - DNA, 25 bp, Mus musculus
gtccgggcggtgcacttcactgaga

SEQ ID NO: 957106 - DNA, 25 bp, Mus musculus
gtccgggcggtgcagttcactgaga

SEQ ID NO: 957107 - DNA, 25 bp, Mus musculus
gtccggggacgacatgatttttgat

SEQ ID NO: 957108 - DNA, 25 bp, Mus musculus
gtccggggacgagatgatttttgat

SEQ ID NO: 957109 - DNA, 25 bp, Mus musculus
gtccgtccagagccagtgcttgagg

SEQ ID NO: 957110 - DNA, 25 bp, Mus musculus
gtccgtccagagcctgtgcttgagg

SEQ ID NO: 957111 - DNA, 25 bp, Mus musculus
gtccgtcccctacgccatccaagag

SEQ ID NO: 957112 - DNA, 25 bp, Mus musculus
gtccgtcccctaggccatccaagag

SEQ ID NO: 957113 - DNA, 25 bp, Mus musculus
gtccgtgatcagaattgcatttgta

SEQ ID NO: 957114 - DNA, 25 bp, Mus musculus
gtccgtgatcagatccgtatctact

SEQ ID NO: 957115 - DNA, 25 bp, Mus musculus
gtccgtgatcagtattgcatttgta

SEQ ID NO: 957116 - DNA, 25 bp, Mus musculus
gtccgtgatcagttccgtatctact

SEQ ID NO: 957117 - DNA, 25 bp, Mus musculus
gtccgtgccccttctgtacttcacc

SEQ ID NO: 957118 - DNA, 25 bp, Mus musculus
gtccgtgcccgttctgtacttcacc

SEQ ID NO: 957119 - DNA, 25 bp, Mus musculus
gtccgtggagcttgtcagagaattc

SEQ ID NO: 957120 - DNA, 25 bp, Mus musculus
gtccgtggaggttgtcagagaattc

SEQ ID NO: 957121 - DNA, 25 bp, Mus musculus
gtccgtgtgcagcatgttcattctg

SEQ ID NO: 957122 - DNA, 25 bp, Mus musculus
gtccgtgtgcaggatgttcattctg

SEQ ID NO: 957123 - DNA, 25 bp, Mus musculus
gtccgtgtggagcacgttggatgga

SEQ ID NO: 957124 - DNA, 25 bp, Mus musculus
gtccgtgtggagcaggttggatgga

SEQ ID NO: 957125 - DNA, 25 bp, Mus musculus
gtccgtgttaagattttggccacag

SEQ ID NO: 957126 - DNA, 25 bp, Mus musculus
gtccgtgttaagtttttggccacag

SEQ ID NO: 957127 - DNA, 25 bp, Mus musculus
gtcctaaactagaccttcaatgact

SEQ ID NO: 957128 - DNA, 25 bp, Mus musculus
gtcctaaacttgaccttcaatgact

SEQ ID NO: 957129 - DNA, 25 bp, Mus musculus
gtcctaagaaaccatcaagaagcgt

SEQ ID NO: 957130 - DNA, 25 bp, Mus musculus
gtcctaagaaacccaggctccagct

SEQ ID NO: 957131 - DNA, 25 bp, Mus musculus
gtcctaagaaacgatcaagaagcgt

SEQ ID NO: 957132 - DNA, 25 bp, Mus musculus
gtcctaagaaacgcaggctccagct

SEQ ID NO: 957133 - DNA, 25 bp, Mus musculus
gtcctacacaagaccattctggttg

SEQ ID NO: 957134 - DNA, 25 bp, Mus musculus
gtcctacacaagtccattctggttg

SEQ ID NO: 957135 - DNA, 25 bp, Mus musculus
gtcctacaccagcgactttgactgc

SEQ ID NO: 957136 - DNA, 25 bp, Mus musculus
gtcctacaccagggactttgactgc

SEQ ID NO: 957137 - DNA, 25 bp, Mus musculus
gtcctacacgaccctcccagctgcc

SEQ ID NO: 957138 - DNA, 25 bp, Mus musculus
gtcctacacgtccctcccagctgcc

SEQ ID NO: 957139 - DNA, 25 bp, Mus musculus
gtcctacagcaacgcatcgtcaagt

SEQ ID NO: 957140 - DNA, 25 bp, Mus musculus
gtcctacagcaaggcatcgtcaagt

SEQ ID NO: 957141 - DNA, 25 bp, Mus musculus
gtcctacagcgtcaccaaccgtgtc

SEQ ID NO: 957142 - DNA, 25 bp, Mus musculus
gtcctacagcgtcagcaaccgtgtc

SEQ ID NO: 957143 - DNA, 25 bp, Mus musculus
gtcctacagtctctacagctacctg

SEQ ID NO: 957144 - DNA, 25 bp, Mus musculus
gtcctacagtgtctacagctacctg

SEQ ID NO: 957145 - DNA, 25 bp, Mus musculus
gtcctacagttgcacgcatcccaca

SEQ ID NO: 957146 - DNA, 25 bp, Mus musculus
gtcctacagttgcaggcatcccaca

SEQ ID NO: 957147 - DNA, 25 bp, Mus musculus
gtcctagaagcagatgcgattcagg

SEQ ID NO: 957148 - DNA, 25 bp, Mus musculus
gtcctagaaggagatgcgattcagg

SEQ ID NO: 957149 - DNA, 25 bp, Mus musculus
gtcctagacaagcggccctctctga

SEQ ID NO: 957150 - DNA, 25 bp, Mus musculus
gtcctagacaaggggccctctctga

SEQ ID NO: 957151 - DNA, 25 bp, Mus musculus
gtcctagcagattgtccttctgaag

SEQ ID NO: 957152 - DNA, 25 bp, Mus musculus
gtcctagcagtttgtccttctgaag

SEQ ID NO: 957153 - DNA, 25 bp, Mus musculus
gtcctatgaaattttattgcatgaa

SEQ ID NO: 957154 - DNA, 25 bp, Mus musculus
gtcctatgaatttttattgcatgaa

SEQ ID NO: 957155 - DNA, 25 bp, Mus musculus
gtcctcaaagagatctttgcaaagg

SEQ ID NO: 957156 - DNA, 25 bp, Mus musculus
gtcctcaaagctggccagagccggg

SEQ ID NO: 957157 - DNA, 25 bp, Mus musculus
gtcctcaaaggtggccagagccggg

SEQ ID NO: 957158 - DNA, 25 bp, Mus musculus
gtcctcaaagtgatctttgcaaagg

SEQ ID NO: 957159 - DNA, 25 bp, Mus musculus
gtcctcaacaagctgactgtattca

SEQ ID NO: 957160 - DNA, 25 bp, Mus musculus
gtcctcaacaaggtgactgtattca

SEQ ID NO: 957161 - DNA, 25 bp, Mus musculus
gtcctcaacacacaccctgctctcg

SEQ ID NO: 957162 - DNA, 25 bp, Mus musculus
gtcctcaacacagaccctgctctcg

SEQ ID NO: 957163 - DNA, 25 bp, Mus musculus
gtcctcaactccaccctgaagagct

SEQ ID NO: 957164 - DNA, 25 bp, Mus musculus
gtcctcaactccacgctgaagagct

SEQ ID NO: 957165 - DNA, 25 bp, Mus musculus
gtcctcaagaggaacgcagtagagt

SEQ ID NO: 957166 - DNA, 25 bp, Mus musculus
gtcctcaagaggaacgccgaggatg

SEQ ID NO: 957167 - DNA, 25 bp, Mus musculus
gtcctcaagaggaaggcagtagagt

SEQ ID NO: 957168 - DNA, 25 bp, Mus musculus
gtcctcaagaggaaggccgaggatg

SEQ ID NO: 957169 - DNA, 25 bp, Mus musculus
gtcctcagactccataaaacgttta

SEQ ID NO: 957170 - DNA, 25 bp, Mus musculus
gtcctcagactcgataaaacgttta

SEQ ID NO: 957171 - DNA, 25 bp, Mus musculus
gtcctcagagcccagttgttgctgt

SEQ ID NO: 957172 - DNA, 25 bp, Mus musculus
gtcctcagaggccagttgttgctgt

SEQ ID NO: 957173 - DNA, 25 bp, Mus musculus
gtcctcagggagagcctgcacttct

SEQ ID NO: 957174 - DNA, 25 bp, Mus musculus
gtcctcagggagtgcctgcacttct

SEQ ID NO: 957175 - DNA, 25 bp, Mus musculus
gtcctcatcaactgcacaggagagg

SEQ ID NO: 957176 - DNA, 25 bp, Mus musculus
gtcctcatcaactggacaggagagg

SEQ ID NO: 957177 - DNA, 25 bp, Mus musculus
gtcctcatggaacgcgcccctcgga

SEQ ID NO: 957178 - DNA, 25 bp, Mus musculus
gtcctcatggaaggcgcccctcgga

SEQ ID NO: 957179 - DNA, 25 bp, Mus musculus
gtcctcatttatcatcccataaaaa

SEQ ID NO: 957180 - DNA, 25 bp, Mus musculus
gtcctcatttatgatcccataaaaa

SEQ ID NO: 957181 - DNA, 25 bp, Mus musculus
gtcctccgcgaaaatgaccatggat

SEQ ID NO: 957182 - DNA, 25 bp, Mus musculus
gtcctccgcgtaaatgaccatggat

SEQ ID NO: 957183 - DNA, 25 bp, Mus musculus
gtcctcctagaacggcctcctcaca

SEQ ID NO: 957184 - DNA, 25 bp, Mus musculus
gtcctcctagaagggcctcctcaca

SEQ ID NO: 957185 - DNA, 25 bp, Mus musculus
gtcctcggagcagtatatatcctgg

SEQ ID NO: 957186 - DNA, 25 bp, Mus musculus
gtcctcggaggagtatatatcctgg

SEQ ID NO: 957187 - DNA, 25 bp, Mus musculus
gtcctcgggactcagcctgatgtaa

SEQ ID NO: 957188 - DNA, 25 bp, Mus musculus
gtcctcgggactgagcctgatgtaa

SEQ ID NO: 957189 - DNA, 25 bp, Mus musculus
gtcctcggggcacaaaatatctgca

SEQ ID NO: 957190 - DNA, 25 bp, Mus musculus
gtcctcggggcacatcgtaatgtaa

SEQ ID NO: 957191 - DNA, 25 bp, Mus musculus
gtcctcggggcagaaaatatctgca

SEQ ID NO: 957192 - DNA, 25 bp, Mus musculus
gtcctcggggcagatcgtaatgtaa

SEQ ID NO: 957193 - DNA, 25 bp, Mus musculus
gtcctctacaagctcggcttcttca

SEQ ID NO: 957194 - DNA, 25 bp, Mus musculus
gtcctctacaaggtcggcttcttca

SEQ ID NO: 957195 - DNA, 25 bp, Mus musculus
gtcctctatgaacactggaccacgc

SEQ ID NO: 957196 - DNA, 25 bp, Mus musculus
gtcctctatgaagactggaccacgc

SEQ ID NO: 957197 - DNA, 25 bp, Mus musculus
gtcctctcgcagaaatagtagacgt

SEQ ID NO: 957198 - DNA, 25 bp, Mus musculus
gtcctctcgcagtaatagtagacgt

SEQ ID NO: 957199 - DNA, 25 bp, Mus musculus
gtcctctgacccactcttggaactg

SEQ ID NO: 957200 - DNA, 25 bp, Mus musculus
gtcctctgaccctctcttggaactg

SEQ ID NO: 957201 - DNA, 25 bp, Mus musculus
gtcctgaaagaaggcttctttggct

SEQ ID NO: 957202 - DNA, 25 bp, Mus musculus
gtcctgaaagactcagaggagcagt

SEQ ID NO: 957203 - DNA, 25 bp, Mus musculus
gtcctgaaagccagagacccgccca

SEQ ID NO: 957204 - DNA, 25 bp, Mus musculus
gtcctgaaaggcagagacccgccca

SEQ ID NO: 957205 - DNA, 25 bp, Mus musculus
gtcctgaaagtaggcttctttggct

SEQ ID NO: 957206 - DNA, 25 bp, Mus musculus
gtcctgaaagtctcagaggagcagt

SEQ ID NO: 957207 - DNA, 25 bp, Mus musculus
gtcctgaagaagctggccgagatcc

SEQ ID NO: 957208 - DNA, 25 bp, Mus musculus
gtcctgaagaaggtggccgagatcc

SEQ ID NO: 957209 - DNA, 25 bp, Mus musculus
gtcctgacaccacgctcaggacatg

SEQ ID NO: 957210 - DNA, 25 bp, Mus musculus
gtcctgacaccaggctcaggacatg

SEQ ID NO: 957211 - DNA, 25 bp, Mus musculus
gtcctgacttgagacgcccaggatg

SEQ ID NO: 957212 - DNA, 25 bp, Mus musculus
gtcctgacttgagaggcccaggatg

SEQ ID NO: 957213 - DNA, 25 bp, Mus musculus
gtcctgcatctgattggagagtacc

SEQ ID NO: 957214 - DNA, 25 bp, Mus musculus
gtcctgcatctgtttggagagtacc

SEQ ID NO: 957215 - DNA, 25 bp, Mus musculus
gtcctgcctctgcgcggaaaaactg

SEQ ID NO: 957216 - DNA, 25 bp, Mus musculus
gtcctgcctctgcgttaacaatcaa

SEQ ID NO: 957217 - DNA, 25 bp, Mus musculus
gtcctgcctctgggcggaaaaactg

SEQ ID NO: 957218 - DNA, 25 bp, Mus musculus
gtcctgcctctgggttaacaatcaa

SEQ ID NO: 957219 - DNA, 25 bp, Mus musculus
gtcctgcgctctttgagcgctgccg

SEQ ID NO: 957220 - DNA, 25 bp, Mus musculus
gtcctgcgctgtttgagcgctgccg

SEQ ID NO: 957221 - DNA, 25 bp, Mus musculus
gtcctgctcgagcctatgaactctt

SEQ ID NO: 957222 - DNA, 25 bp, Mus musculus
gtcctgctcgaggctatgaactctt

SEQ ID NO: 957223 - DNA, 25 bp, Mus musculus
gtcctgctgtcccacgtgctcctgg

SEQ ID NO: 957224 - DNA, 25 bp, Mus musculus
gtcctgctgtcccaggtgctcctgg

SEQ ID NO: 957225 - DNA, 25 bp, Mus musculus
gtcctgcttactgacaaactcaagc

SEQ ID NO: 957226 - DNA, 25 bp, Mus musculus
gtcctgcttactgagaaactcaagc

SEQ ID NO: 957227 - DNA, 25 bp, Mus musculus
gtcctggacaagatcctggaccaga

SEQ ID NO: 957228 - DNA, 25 bp, Mus musculus
gtcctggacaagatgctggaccaga

SEQ ID NO: 957229 - DNA, 25 bp, Mus musculus
gtcctggcacagagaacctgtgctc

SEQ ID NO: 957230 - DNA, 25 bp, Mus musculus
gtcctggcacagctacaaagtgaaa

SEQ ID NO: 957231 - DNA, 25 bp, Mus musculus
gtcctggcacaggtacaaagtgaaa

SEQ ID NO: 957232 - DNA, 25 bp, Mus musculus
gtcctggcacagtgaacctgtgctc

SEQ ID NO: 957233 - DNA, 25 bp, Mus musculus
gtcctggccgccaagttgaagttca

SEQ ID NO: 957234 - DNA, 25 bp, Mus musculus
gtcctggccggcaagttgaagttca

SEQ ID NO: 957235 - DNA, 25 bp, Mus musculus
gtcctggcctcacgagacaacaatc

SEQ ID NO: 957236 - DNA, 25 bp, Mus musculus
gtcctggcctcaggagacaacaatc

SEQ ID NO: 957237 - DNA, 25 bp, Mus musculus
gtcctgggaaagctgtggtatctct

SEQ ID NO: 957238 - DNA, 25 bp, Mus musculus
gtcctgggaaaggtgtggtatctct

SEQ ID NO: 957239 - DNA, 25 bp, Mus musculus
gtcctggtttcacacgtcaactttg

SEQ ID NO: 957240 - DNA, 25 bp, Mus musculus
gtcctggtttcacaggtcaactttg

SEQ ID NO: 957241 - DNA, 25 bp, Mus musculus
gtcctgtaagctggtctgtgatgag

SEQ ID NO: 957242 - DNA, 25 bp, Mus musculus
gtcctgtaaggtggtctgtgatgag

SEQ ID NO: 957243 - DNA, 25 bp, Mus musculus
gtcctgtcagcacttctggggatgg

SEQ ID NO: 957244 - DNA, 25 bp, Mus musculus
gtcctgtcagctttggccacagtgg

SEQ ID NO: 957245 - DNA, 25 bp, Mus musculus
gtcctgtcaggacttctggggatgg

SEQ ID NO: 957246 - DNA, 25 bp, Mus musculus
gtcctgtcaggtttggccacagtgg

SEQ ID NO: 957247 - DNA, 25 bp, Mus musculus
gtcctgtccacacacgtttatgaag

SEQ ID NO: 957248 - DNA, 25 bp, Mus musculus
gtcctgtccacacaggtttatgaag

SEQ ID NO: 957249 - DNA, 25 bp, Mus musculus
gtcctgtcctcacggaccgcagcag

SEQ ID NO: 957250 - DNA, 25 bp, Mus musculus
gtcctgtcctcacggccttcaggga

SEQ ID NO: 957251 - DNA, 25 bp, Mus musculus
gtcctgtcctcagggaccgcagcag

SEQ ID NO: 957252 - DNA, 25 bp, Mus musculus
gtcctgtcctcagggccttcaggga

SEQ ID NO: 957253 - DNA, 25 bp, Mus musculus
gtcctgtgccagcaaagcactgcca

SEQ ID NO: 957254 - DNA, 25 bp, Mus musculus
gtcctgtgccagccaaggtgaccca

SEQ ID NO: 957255 - DNA, 25 bp, Mus musculus
gtcctgtgccaggaaagcactgcca

SEQ ID NO: 957256 - DNA, 25 bp, Mus musculus
gtcctgtgccaggcaaggtgaccca

SEQ ID NO: 957257 - DNA, 25 bp, Mus musculus
gtcctgttcggacgtctcatcggct

SEQ ID NO: 957258 - DNA, 25 bp, Mus musculus
gtcctgttcggaggtctcatcggct

SEQ ID NO: 957259 - DNA, 25 bp, Mus musculus
gtcctgtttggtcacgtggtacgtg

SEQ ID NO: 957260 - DNA, 25 bp, Mus musculus
gtcctgtttggtcaggtggtacgtg

SEQ ID NO: 957261 - DNA, 25 bp, Mus musculus
gtccttatctgtaacaactgcttta

SEQ ID NO: 957262 - DNA, 25 bp, Mus musculus
gtccttatctgtaagaactgcttta

SEQ ID NO: 957263 - DNA, 25 bp, Mus musculus
gtccttatgactggcaaatgcaaat

SEQ ID NO: 957264 - DNA, 25 bp, Mus musculus
gtccttatgagtggcaaatgcaaat

SEQ ID NO: 957265 - DNA, 25 bp, Mus musculus
gtccttatggagactctgacacagt

SEQ ID NO: 957266 - DNA, 25 bp, Mus musculus
gtccttatggagtctctgacacagt

SEQ ID NO: 957267 - DNA, 25 bp, Mus musculus
gtccttcactctagcccatccagtc

SEQ ID NO: 957268 - DNA, 25 bp, Mus musculus
gtccttcactcttgcccatccagtc

SEQ ID NO: 957269 - DNA, 25 bp, Mus musculus
gtccttcagacctcacctgagatgg

SEQ ID NO: 957270 - DNA, 25 bp, Mus musculus
gtccttcagacctctcctgagatgg

SEQ ID NO: 957271 - DNA, 25 bp, Mus musculus
gtccttccacttccagtgcttctgc

SEQ ID NO: 957272 - DNA, 25 bp, Mus musculus
gtccttccacttcctgtgcttctgc

SEQ ID NO: 957273 - DNA, 25 bp, Mus musculus
gtccttcctgctgactctgaacaat

SEQ ID NO: 957274 - DNA, 25 bp, Mus musculus
gtccttcctggtgactctgaacaat

SEQ ID NO: 957275 - DNA, 25 bp, Mus musculus
gtccttctagcacgcctgcctactt

SEQ ID NO: 957276 - DNA, 25 bp, Mus musculus
gtccttctagcaggcctgcctactt

SEQ ID NO: 957277 - DNA, 25 bp, Mus musculus
gtccttctccagcaccaagagccag

SEQ ID NO: 957278 - DNA, 25 bp, Mus musculus
gtccttctccagcacgacccaacct

SEQ ID NO: 957279 - DNA, 25 bp, Mus musculus
gtccttctccagcagcaagagccag

SEQ ID NO: 957280 - DNA, 25 bp, Mus musculus
gtccttctccagcaggacccaacct

SEQ ID NO: 957281 - DNA, 25 bp, Mus musculus
gtccttgagtggcgactgtcagggc

SEQ ID NO: 957282 - DNA, 25 bp, Mus musculus
gtccttgagtggggactgtcagggc

SEQ ID NO: 957283 - DNA, 25 bp, Mus musculus
gtccttggctggcgaaaaaatggct

SEQ ID NO: 957284 - DNA, 25 bp, Mus musculus
gtccttggctggcgacagaaaaatg

SEQ ID NO: 957285 - DNA, 25 bp, Mus musculus
gtccttggctggcgtaaaaatggct

SEQ ID NO: 957286 - DNA, 25 bp, Mus musculus
gtccttggctggcgtcagaaaaatg

SEQ ID NO: 957287 - DNA, 25 bp, Mus musculus
gtccttgtcccaccccaagatggat

SEQ ID NO: 957288 - DNA, 25 bp, Mus musculus
gtccttgtcccagcccaagatggat

SEQ ID NO: 957289 - DNA, 25 bp, Mus musculus
gtcctttcagccccggttcgctgag

SEQ ID NO: 957290 - DNA, 25 bp, Mus musculus
gtcctttcaggcccggttcgctgag

SEQ ID NO: 957291 - DNA, 25 bp, Mus musculus
gtcctttccgcgatgcagctcagtc

SEQ ID NO: 957292 - DNA, 25 bp, Mus musculus
gtcctttccgggatgcagctcagtc

SEQ ID NO: 957293 - DNA, 25 bp, Mus musculus
gtcctttctggaaacaatatccagt

SEQ ID NO: 957294 - DNA, 25 bp, Mus musculus
gtcctttctggaaagaatatccagt

SEQ ID NO: 957295 - DNA, 25 bp, Mus musculus
gtcctttgacgacatcgctgaaggc

SEQ ID NO: 957296 - DNA, 25 bp, Mus musculus
gtcctttgacgagatcgctgaaggc

SEQ ID NO: 957297 - DNA, 25 bp, Mus musculus
gtcctttgagctgactgcatttgca

SEQ ID NO: 957298 - DNA, 25 bp, Mus musculus
gtcctttgaggtgactgcatttgca

SEQ ID NO: 957299 - DNA, 25 bp, Mus musculus
gtcctttggtgtcccatattcccac

SEQ ID NO: 957300 - DNA, 25 bp, Mus musculus
gtcctttggtgtgccatattcccac

SEQ ID NO: 957301 - DNA, 25 bp, Mus musculus
gtcctttgtatcagtcctggaaaga

SEQ ID NO: 957302 - DNA, 25 bp, Mus musculus
gtcctttgtatctgtcctggaaaga

SEQ ID NO: 957303 - DNA, 25 bp, Mus musculus
gtcctttgttctctcgcattggcta

SEQ ID NO: 957304 - DNA, 25 bp, Mus musculus
gtcctttgttctctggcattggcta

SEQ ID NO: 957305 - DNA, 25 bp, Mus musculus
gtccttttaaagcctgcttccatgt

SEQ ID NO: 957306 - DNA, 25 bp, Mus musculus
gtccttttaaaggctgcttccatgt

SEQ ID NO: 957307 - DNA, 25 bp, Mus musculus
gtcgaaatgaaacttccagcaatga

SEQ ID NO: 957308 - DNA, 25 bp, Mus musculus
gtcgaaatgaaagttccagcaatga

SEQ ID NO: 957309 - DNA, 25 bp, Mus musculus
gtcgaagcgctgcctcatcgtgggg

SEQ ID NO: 957310 - DNA, 25 bp, Mus musculus
gtcgaagcgctggctcatcgtgggg

SEQ ID NO: 957311 - DNA, 25 bp, Mus musculus
gtcgaaggagaccaagagatgagac

SEQ ID NO: 957312 - DNA, 25 bp, Mus musculus
gtcgaaggagacgaagagatgagac

SEQ ID NO: 957313 - DNA, 25 bp, Mus musculus
gtcgaatctacacgggccgggctag

SEQ ID NO: 957314 - DNA, 25 bp, Mus musculus
gtcgaatctacaggggccgggctag

SEQ ID NO: 957315 - DNA, 25 bp, Mus musculus
gtcgactacgagacaaacccaaatt

SEQ ID NO: 957316 - DNA, 25 bp, Mus musculus
gtcgactacgtgacaaacccaaatt

SEQ ID NO: 957317 - DNA, 25 bp, Mus musculus
gtcgactctgagaggtttggatttt

SEQ ID NO: 957318 - DNA, 25 bp, Mus musculus
gtcgactctgagtggtttggatttt

SEQ ID NO: 957319 - DNA, 25 bp, Mus musculus
gtcgactcttgccacggagacagtg

SEQ ID NO: 957320 - DNA, 25 bp, Mus musculus
gtcgactcttgccagggagacagtg

SEQ ID NO: 957321 - DNA, 25 bp, Mus musculus
gtcgactggaaaaacgacaggtgca

SEQ ID NO: 957322 - DNA, 25 bp, Mus musculus
gtcgactggaaaaacgataggtgcg

SEQ ID NO: 957323 - DNA, 25 bp, Mus musculus
gtcgactggaaaaaggacaggtgca

SEQ ID NO: 957324 - DNA, 25 bp, Mus musculus
gtcgactggaaaaaggataggtgcg

SEQ ID NO: 957325 - DNA, 25 bp, Mus musculus
gtcgagagattgataatcatgatgc

SEQ ID NO: 957326 - DNA, 25 bp, Mus musculus
gtcgagagattgttaatcatgatgc

SEQ ID NO: 957327 - DNA, 25 bp, Mus musculus
gtcgagcatctactaacggctggcc

SEQ ID NO: 957328 - DNA, 25 bp, Mus musculus
gtcgagcatctactacagctgcgtg

SEQ ID NO: 957329 - DNA, 25 bp, Mus musculus
gtcgagcatctacttacggctggcc

SEQ ID NO: 957330 - DNA, 25 bp, Mus musculus
gtcgagcatctacttcagctgcgtg

SEQ ID NO: 957331 - DNA, 25 bp, Mus musculus
gtcgagcctaaacaacatcaaactg

SEQ ID NO: 957332 - DNA, 25 bp, Mus musculus
gtcgagcctaaagaacatcaaactg

SEQ ID NO: 957333 - DNA, 25 bp, Mus musculus
gtcgaggcccggcggctggatattg

SEQ ID NO: 957334 - DNA, 25 bp, Mus musculus
gtcgaggcccgggggctggatattg

SEQ ID NO: 957335 - DNA, 25 bp, Mus musculus
gtcgagggagctctccctactctgt

SEQ ID NO: 957336 - DNA, 25 bp, Mus musculus
gtcgagggaggtctccctactctgt

SEQ ID NO: 957337 - DNA, 25 bp, Mus musculus
gtcgagtgaccgcaatctgtgggct

SEQ ID NO: 957338 - DNA, 25 bp, Mus musculus
gtcgagtgaccggaatctgtgggct

SEQ ID NO: 957339 - DNA, 25 bp, Mus musculus
gtcgagtggaaagcacaatccacat

SEQ ID NO: 957340 - DNA, 25 bp, Mus musculus
gtcgagtggatagcacaatccacat

SEQ ID NO: 957341 - DNA, 25 bp, Mus musculus
gtcgatcaagaccacgccctggctt

SEQ ID NO: 957342 - DNA, 25 bp, Mus musculus
gtcgatcaagaccaggccctggctt

SEQ ID NO: 957343 - DNA, 25 bp, Mus musculus
gtcgatgctagcagaggcggcggaa

SEQ ID NO: 957344 - DNA, 25 bp, Mus musculus
gtcgatgctagcagtggcggcggaa

SEQ ID NO: 957345 - DNA, 25 bp, Mus musculus
gtcgatgtgtctcacgtgatccgca

SEQ ID NO: 957346 - DNA, 25 bp, Mus musculus
gtcgatgtgtctcaggtgatccgca

SEQ ID NO: 957347 - DNA, 25 bp, Mus musculus
gtcgattatcagcctttgaaccagt

SEQ ID NO: 957348 - DNA, 25 bp, Mus musculus
gtcgattatcaggctttgaaccagt

SEQ ID NO: 957349 - DNA, 25 bp, Mus musculus
gtcgcacgagagctgcctgtagctg

SEQ ID NO: 957350 - DNA, 25 bp, Mus musculus
gtcgcacgagctggactcacattat

SEQ ID NO: 957351 - DNA, 25 bp, Mus musculus
gtcgcacgaggtggactcacattat

SEQ ID NO: 957352 - DNA, 25 bp, Mus musculus
gtcgcacgagtgctgcctgtagctg

SEQ ID NO: 957353 - DNA, 25 bp, Mus musculus
gtcgccatggatgagccttcccttc

SEQ ID NO: 957354 - DNA, 25 bp, Mus musculus
gtcgccatggttgagccttcccttc

SEQ ID NO: 957355 - DNA, 25 bp, Mus musculus
gtcgccattgcatcatctgtcccta

SEQ ID NO: 957356 - DNA, 25 bp, Mus musculus
gtcgccattggatcatctgtcccta

SEQ ID NO: 957357 - DNA, 25 bp, Mus musculus
gtcgcccaggagcacgtgtagctac

SEQ ID NO: 957358 - DNA, 25 bp, Mus musculus
gtcgcccaggagcaggtgtagctac

SEQ ID NO: 957359 - DNA, 25 bp, Mus musculus
gtcgcccctgaacatggagagaaga

SEQ ID NO: 957360 - DNA, 25 bp, Mus musculus
gtcgcccctgaagatggagagaaga

SEQ ID NO: 957361 - DNA, 25 bp, Mus musculus
gtcgccgccacacagttctgtcctt

SEQ ID NO: 957362 - DNA, 25 bp, Mus musculus
gtcgccgccacagagttctgtcctt

SEQ ID NO: 957363 - DNA, 25 bp, Mus musculus
gtcgccggagcacacagagctgcag

SEQ ID NO: 957364 - DNA, 25 bp, Mus musculus
gtcgccggaggacacagagctgcag

SEQ ID NO: 957365 - DNA, 25 bp, Mus musculus
gtcgccgtgccgcgcgagaggaaaa

SEQ ID NO: 957366 - DNA, 25 bp, Mus musculus
gtcgccgtgccgcgcgtgtgccagg

SEQ ID NO: 957367 - DNA, 25 bp, Mus musculus
gtcgccgtgccgcgggagaggaaaa

SEQ ID NO: 957368 - DNA, 25 bp, Mus musculus
gtcgccgtgccgcgggtgtgccagg

SEQ ID NO: 957369 - DNA, 25 bp, Mus musculus
gtcgcctttgtctgcaagcggcctc

SEQ ID NO: 957370 - DNA, 25 bp, Mus musculus
gtcgcctttgtctggaagcggcctc

SEQ ID NO: 957371 - DNA, 25 bp, Mus musculus
gtcgcgatatgcactgaaccacccg

SEQ ID NO: 957372 - DNA, 25 bp, Mus musculus
gtcgcgatatgctctgaaccacccg

SEQ ID NO: 957373 - DNA, 25 bp, Mus musculus
gtcgcgcagcagcatggctgacctg

SEQ ID NO: 957374 - DNA, 25 bp, Mus musculus
gtcgcgcagcaggatggctgacctg

SEQ ID NO: 957375 - DNA, 25 bp, Mus musculus
gtcgcgctcaaccacgtggatgtgt

SEQ ID NO: 957376 - DNA, 25 bp, Mus musculus
gtcgcgctcaaccaggtggatgtgt

SEQ ID NO: 957377 - DNA, 25 bp, Mus musculus
gtcgcggccatgaaccatgtctgct

SEQ ID NO: 957378 - DNA, 25 bp, Mus musculus
gtcgcggccatgaacgcgggtgcta

SEQ ID NO: 957379 - DNA, 25 bp, Mus musculus
gtcgcggccatgaagcatgtctgct

SEQ ID NO: 957380 - DNA, 25 bp, Mus musculus
gtcgcggccatgaaggcgggtgcta

SEQ ID NO: 957381 - DNA, 25 bp, Mus musculus
gtcgcggccgcatggcggacaagga

SEQ ID NO: 957382 - DNA, 25 bp, Mus musculus
gtcgcggccggatggcggacaagga

SEQ ID NO: 957383 - DNA, 25 bp, Mus musculus
gtcgctcactcgatcaatgagctca

SEQ ID NO: 957384 - DNA, 25 bp, Mus musculus
gtcgctcactcgttcaatgagctca

SEQ ID NO: 957385 - DNA, 25 bp, Mus musculus
gtcgctcctatgccatgtgggcaca

SEQ ID NO: 957386 - DNA, 25 bp, Mus musculus
gtcgctcctatggcatgtgggcaca

SEQ ID NO: 957387 - DNA, 25 bp, Mus musculus
gtcgctgacccacgtcaaggagctg

SEQ ID NO: 957388 - DNA, 25 bp, Mus musculus
gtcgctgacccaggtcaaggagctg

SEQ ID NO: 957389 - DNA, 25 bp, Mus musculus
gtcgctgatcttctcccacacatgc

SEQ ID NO: 957390 - DNA, 25 bp, Mus musculus
gtcgctgatcttgtcccacacatgc

SEQ ID NO: 957391 - DNA, 25 bp, Mus musculus
gtcgcttcagcctttaccctccggt

SEQ ID NO: 957392 - DNA, 25 bp, Mus musculus
gtcgcttcaggctttaccctccggt

SEQ ID NO: 957393 - DNA, 25 bp, Mus musculus
gtcggaagcaccctggaacaccagg

SEQ ID NO: 957394 - DNA, 25 bp, Mus musculus
gtcggaagcaccgtggaacaccagg

SEQ ID NO: 957395 - DNA, 25 bp, Mus musculus
gtcggaccatagcggcctgcaatct

SEQ ID NO: 957396 - DNA, 25 bp, Mus musculus
gtcggaccataggggcctgcaatct

SEQ ID NO: 957397 - DNA, 25 bp, Mus musculus
gtcggacggctgcccggttgtgagc

SEQ ID NO: 957398 - DNA, 25 bp, Mus musculus
gtcggacggctgccgggttgtgagc

SEQ ID NO: 957399 - DNA, 25 bp, Mus musculus
gtcggacgtgcatccagacatgtgc

SEQ ID NO: 957400 - DNA, 25 bp, Mus musculus
gtcggacgtgcatcgagacatgtgc

SEQ ID NO: 957401 - DNA, 25 bp, Mus musculus
gtcggagcagctcaaaagcttgaag

SEQ ID NO: 957402 - DNA, 25 bp, Mus musculus
gtcggagcagctgaaaagcttgaag

SEQ ID NO: 957403 - DNA, 25 bp, Mus musculus
gtcggaggagtgctgtggaaggcag

SEQ ID NO: 957404 - DNA, 25 bp, Mus musculus
gtcggaggagtggtgtggaaggcag

SEQ ID NO: 957405 - DNA, 25 bp, Mus musculus
gtcggaggccagatctggtccgcat

SEQ ID NO: 957406 - DNA, 25 bp, Mus musculus
gtcggaggccagttctggtccgcat

SEQ ID NO: 957407 - DNA, 25 bp, Mus musculus
gtcggaggctccctggaacactcgg

SEQ ID NO: 957408 - DNA, 25 bp, Mus musculus
gtcggaggctccgtggaacactcgg

SEQ ID NO: 957409 - DNA, 25 bp, Mus musculus
gtcggcaatacacgccgcctggcca

SEQ ID NO: 957410 - DNA, 25 bp, Mus musculus
gtcggcaatacaggccgcctggcca

SEQ ID NO: 957411 - DNA, 25 bp, Mus musculus
gtcggcacattgaacatgagtttga

SEQ ID NO: 957412 - DNA, 25 bp, Mus musculus
gtcggcacattgaagatgagtttga

SEQ ID NO: 957413 - DNA, 25 bp, Mus musculus
gtcggcatgttcaaagtgaacctgt

SEQ ID NO: 957414 - DNA, 25 bp, Mus musculus
gtcggcatgttcaatgtgaacctgt

SEQ ID NO: 957415 - DNA, 25 bp, Mus musculus
gtcggccaagccaacgtggtcctga

SEQ ID NO: 957416 - DNA, 25 bp, Mus musculus
gtcggccaagccaaggtggtcctga

SEQ ID NO: 957417 - DNA, 25 bp, Mus musculus
gtcggcctgcagattcaggcctgtc

SEQ ID NO: 957418 - DNA, 25 bp, Mus musculus
gtcggcctgcagccctgtcgagggg

SEQ ID NO: 957419 - DNA, 25 bp, Mus musculus
gtcggcctgcagctgcggacctatg

SEQ ID NO: 957420 - DNA, 25 bp, Mus musculus
gtcggcctgcaggcctgtcgagggg

SEQ ID NO: 957421 - DNA, 25 bp, Mus musculus
gtcggcctgcaggtgcggacctatg

SEQ ID NO: 957422 - DNA, 25 bp, Mus musculus
gtcggcctgcagtttcaggcctgtc

SEQ ID NO: 957423 - DNA, 25 bp, Mus musculus
gtcggcggaacacgtaattgctggc

SEQ ID NO: 957424 - DNA, 25 bp, Mus musculus
gtcggcggaacaggtaattgctggc

SEQ ID NO: 957425 - DNA, 25 bp, Mus musculus
gtcggcggccagcacatcgtgtcca

SEQ ID NO: 957426 - DNA, 25 bp, Mus musculus
gtcggcggccagcacgtactcctga

SEQ ID NO: 957427 - DNA, 25 bp, Mus musculus
gtcggcggccagcagatcgtgtcca

SEQ ID NO: 957428 - DNA, 25 bp, Mus musculus
gtcggcggccagcaggtactcctga

SEQ ID NO: 957429 - DNA, 25 bp, Mus musculus
gtcggctgaaaacgttctccatggt

SEQ ID NO: 957430 - DNA, 25 bp, Mus musculus
gtcggctgaaaaggttctccatggt

SEQ ID NO: 957431 - DNA, 25 bp, Mus musculus
gtcggctgagagccaggctgtcaat

SEQ ID NO: 957432 - DNA, 25 bp, Mus musculus
gtcggctgagaggcaggctgtcaat

SEQ ID NO: 957433 - DNA, 25 bp, Mus musculus
gtcggctgctcatgcaaacgtgtgc

SEQ ID NO: 957434 - DNA, 25 bp, Mus musculus
gtcggctgctcatggaaacgtgtgc

SEQ ID NO: 957435 - DNA, 25 bp, Mus musculus
gtcgggagtgccgacagaaggaccc

SEQ ID NO: 957436 - DNA, 25 bp, Mus musculus
gtcgggagtgccgagagaaggaccc

SEQ ID NO: 957437 - DNA, 25 bp, Mus musculus
gtcgggccagctacatccaatgtgc

SEQ ID NO: 957438 - DNA, 25 bp, Mus musculus
gtcgggccaggtacatccaatgtgc

SEQ ID NO: 957439 - DNA, 25 bp, Mus musculus
gtcggggacagtctcgatcaactgc

SEQ ID NO: 957440 - DNA, 25 bp, Mus musculus
gtcggggacagtctggatcaactgc

SEQ ID NO: 957441 - DNA, 25 bp, Mus musculus
gtcggggctgctcaggacaaagagg

SEQ ID NO: 957442 - DNA, 25 bp, Mus musculus
gtcggggctggtcaggacaaagagg

SEQ ID NO: 957443 - DNA, 25 bp, Mus musculus
gtcggggtctgtcgcaattctagct

SEQ ID NO: 957444 - DNA, 25 bp, Mus musculus
gtcggggtctgtggcaattctagct

SEQ ID NO: 957445 - DNA, 25 bp, Mus musculus
gtcgggtctatgttcgcaatgttgc

SEQ ID NO: 957446 - DNA, 25 bp, Mus musculus
gtcgggtctatgttggcaatgttgc

SEQ ID NO: 957447 - DNA, 25 bp, Mus musculus
gtcggtcacatgcaaagagcaaccc

SEQ ID NO: 957448 - DNA, 25 bp, Mus musculus
gtcggtcacatggaaagagcaaccc

SEQ ID NO: 957449 - DNA, 25 bp, Mus musculus
gtcggtgctgcccttcccagaacgc

SEQ ID NO: 957450 - DNA, 25 bp, Mus musculus
gtcggtgctgcgatccggaggaagg

SEQ ID NO: 957451 - DNA, 25 bp, Mus musculus
gtcggtgctggccttcccagaacgc

SEQ ID NO: 957452 - DNA, 25 bp, Mus musculus
gtcggtgctgggatccggaggaagg

SEQ ID NO: 957453 - DNA, 25 bp, Mus musculus
gtcgtatcatcaaaaacaacatttt

SEQ ID NO: 957454 - DNA, 25 bp, Mus musculus
gtcgtatcatcaaatacaacatttt

SEQ ID NO: 957455 - DNA, 25 bp, Mus musculus
gtcgtcattgatacttgccgagacc

SEQ ID NO: 957456 - DNA, 25 bp, Mus musculus
gtcgtcattgattcttgccgagacc

SEQ ID NO: 957457 - DNA, 25 bp, Mus musculus
gtcgtccctgcgcgaccctgctggg

SEQ ID NO: 957458 - DNA, 25 bp, Mus musculus
gtcgtccctgcgggaccctgctggg

SEQ ID NO: 957459 - DNA, 25 bp, Mus musculus
gtcgtcctcgggacagagcctgatg

SEQ ID NO: 957460 - DNA, 25 bp, Mus musculus
gtcgtcctcgggactgagcctgatg

SEQ ID NO: 957461 - DNA, 25 bp, Mus musculus
gtcgtctccagaaaagaaatctgct

SEQ ID NO: 957462 - DNA, 25 bp, Mus musculus
gtcgtctccagaaatgaaatctgct

SEQ ID NO: 957463 - DNA, 25 bp, Mus musculus
gtcgtctgttatcagaccaatgtct

SEQ ID NO: 957464 - DNA, 25 bp, Mus musculus
gtcgtctgttatgagaccaatgtct

SEQ ID NO: 957465 - DNA, 25 bp, Mus musculus
gtcgtgagagtgccttggaaacacc

SEQ ID NO: 957466 - DNA, 25 bp, Mus musculus
gtcgtgagagtggcttggaaacacc

SEQ ID NO: 957467 - DNA, 25 bp, Mus musculus
gtcgtgatcaagaataagacctgga

SEQ ID NO: 957468 - DNA, 25 bp, Mus musculus
gtcgtgatcaagtataagacctgga

SEQ ID NO: 957469 - DNA, 25 bp, Mus musculus
gtcgtgcaagagcattttgcggaaa

SEQ ID NO: 957470 - DNA, 25 bp, Mus musculus
gtcgtgcaagtgcattttgcggaaa

SEQ ID NO: 957471 - DNA, 25 bp, Mus musculus
gtcgtgcatgcacatggatgatgta

SEQ ID NO: 957472 - DNA, 25 bp, Mus musculus
gtcgtgcatgcagatggatgatgta

SEQ ID NO: 957473 - DNA, 25 bp, Mus musculus
gtcgtgcttgcagaccttgtgactg

SEQ ID NO: 957474 - DNA, 25 bp, Mus musculus
gtcgtgcttgcagagcttgtgactg

SEQ ID NO: 957475 - DNA, 25 bp, Mus musculus
gtcgtggactgtagcacagatccag

SEQ ID NO: 957476 - DNA, 25 bp, Mus musculus
gtcgtggactgttgcacagatccag

SEQ ID NO: 957477 - DNA, 25 bp, Mus musculus
gtcgtggtcactcgcgccaatagcg

SEQ ID NO: 957478 - DNA, 25 bp, Mus musculus
gtcgtggtcactggcgccaatagcg

SEQ ID NO: 957479 - DNA, 25 bp, Mus musculus
gtcgtgtcttggctcttctccatcg

SEQ ID NO: 957480 - DNA, 25 bp, Mus musculus
gtcgtgtcttgggtcttctccatcg

SEQ ID NO: 957481 - DNA, 25 bp, Mus musculus
gtcgttagcgagagcacaaacatgt

SEQ ID NO: 957482 - DNA, 25 bp, Mus musculus
gtcgttagcgtgagcacaaacatgt

SEQ ID NO: 957483 - DNA, 25 bp, Mus musculus
gtcgttgtggcaatctgctacacca

SEQ ID NO: 957484 - DNA, 25 bp, Mus musculus
gtcgttgtgggaatctgctacacca

SEQ ID NO: 957485 - DNA, 25 bp, Mus musculus
gtctaaagaaagataagatcagcat

SEQ ID NO: 957486 - DNA, 25 bp, Mus musculus
gtctaaagaaagatcagcatccggg

SEQ ID NO: 957487 - DNA, 25 bp, Mus musculus
gtctaaagaaagttaagatcagcat

SEQ ID NO: 957488 - DNA, 25 bp, Mus musculus
gtctaaagaaagttcagcatccggg

SEQ ID NO: 957489 - DNA, 25 bp, Mus musculus
gtctaaagagaactccaacttctcc

SEQ ID NO: 957490 - DNA, 25 bp, Mus musculus
gtctaaagagaagtccaacttctcc

SEQ ID NO: 957491 - DNA, 25 bp, Mus musculus
gtctaacctcagagtcactgcaaag

SEQ ID NO: 957492 - DNA, 25 bp, Mus musculus
gtctaacctcagtgtcactgcaaag

SEQ ID NO: 957493 - DNA, 25 bp, Mus musculus
gtctaactttaaccacatgtactgg

SEQ ID NO: 957494 - DNA, 25 bp, Mus musculus
gtctaactttaagcacatgtactgg

SEQ ID NO: 957495 - DNA, 25 bp, Mus musculus
gtctaaggaggacaacatttcagag

SEQ ID NO: 957496 - DNA, 25 bp, Mus musculus
gtctaaggaggagaacatttcagag

SEQ ID NO: 957497 - DNA, 25 bp, Mus musculus
gtctaaggcagacctgctgctgtcc

SEQ ID NO: 957498 - DNA, 25 bp, Mus musculus
gtctaaggcagagctgctgctgtcc

SEQ ID NO: 957499 - DNA, 25 bp, Mus musculus
gtctaagtccgactctcccaaggag

SEQ ID NO: 957500 - DNA, 25 bp, Mus musculus
gtctaagtccgagtctcccaaggag

SEQ ID NO: 957501 - DNA, 25 bp, Mus musculus
gtctacaaccagcgcgtgaatggga

SEQ ID NO: 957502 - DNA, 25 bp, Mus musculus
gtctacaaccagcgggtgaatggga

SEQ ID NO: 957503 - DNA, 25 bp, Mus musculus
gtctacagctcacccgaatttcaca

SEQ ID NO: 957504 - DNA, 25 bp, Mus musculus
gtctacagctcagccgaatttcaca

SEQ ID NO: 957505 - DNA, 25 bp, Mus musculus
gtctaccagatgctaccgggctcct

SEQ ID NO: 957506 - DNA, 25 bp, Mus musculus
gtctaccagatggtaccgggctcct

SEQ ID NO: 957507 - DNA, 25 bp, Mus musculus
gtctacctgcagcagaccccatgtt

SEQ ID NO: 957508 - DNA, 25 bp, Mus musculus
gtctacctgcagcatcgaatcctgg

SEQ ID NO: 957509 - DNA, 25 bp, Mus musculus
gtctacctgcaggagaccccatgtt

SEQ ID NO: 957510 - DNA, 25 bp, Mus musculus
gtctacctgcaggatcgaatcctgg

SEQ ID NO: 957511 - DNA, 25 bp, Mus musculus
gtctacctgtcagccgtttgtggag

SEQ ID NO: 957512 - DNA, 25 bp, Mus musculus
gtctacctgtcagcggtttgtggag

SEQ ID NO: 957513 - DNA, 25 bp, Mus musculus
gtctacgatacacggtcgagatggg

SEQ ID NO: 957514 - DNA, 25 bp, Mus musculus
gtctacgatacagggtcgagatggg

SEQ ID NO: 957515 - DNA, 25 bp, Mus musculus
gtctacgcacagaacggatacctgg

SEQ ID NO: 957516 - DNA, 25 bp, Mus musculus
gtctacgcacagaagggatacctgg

SEQ ID NO: 957517 - DNA, 25 bp, Mus musculus
gtctacggcggactggaacactcgg

SEQ ID NO: 957518 - DNA, 25 bp, Mus musculus
gtctacggcggagtggaacactcgg

SEQ ID NO: 957519 - DNA, 25 bp, Mus musculus
gtctactacacactccccttggttc

SEQ ID NO: 957520 - DNA, 25 bp, Mus musculus
gtctactacacagtccccttggttc

SEQ ID NO: 957521 - DNA, 25 bp, Mus musculus
gtctactatcaccattgtggctgag

SEQ ID NO: 957522 - DNA, 25 bp, Mus musculus
gtctactatcacgattgtggctgag

SEQ ID NO: 957523 - DNA, 25 bp, Mus musculus
gtctactccatcatttgtagggatc

SEQ ID NO: 957524 - DNA, 25 bp, Mus musculus
gtctactccatcttttgtagggatc

SEQ ID NO: 957525 - DNA, 25 bp, Mus musculus
gtctactgcaagcgaccttctatgc

SEQ ID NO: 957526 - DNA, 25 bp, Mus musculus
gtctactgcaagggaccttctatgc

SEQ ID NO: 957527 - DNA, 25 bp, Mus musculus
gtctacttaacaatacaacacactc

SEQ ID NO: 957528 - DNA, 25 bp, Mus musculus
gtctacttaacattacaacacactc

SEQ ID NO: 957529 - DNA, 25 bp, Mus musculus
gtctacttacagaggtgactccggg

SEQ ID NO: 957530 - DNA, 25 bp, Mus musculus
gtctacttacagtggtgactccggg

SEQ ID NO: 957531 - DNA, 25 bp, Mus musculus
gtctataaatttccaagagccagag

SEQ ID NO: 957532 - DNA, 25 bp, Mus musculus
gtctataaatttgcaagagccagag

SEQ ID NO: 957533 - DNA, 25 bp, Mus musculus
gtctatgacccacgcagtgatccag

SEQ ID NO: 957534 - DNA, 25 bp, Mus musculus
gtctatgacccaggcagtgatccag

SEQ ID NO: 957535 - DNA, 25 bp, Mus musculus
gtctatgacttgcccggttttctcg

SEQ ID NO: 957536 - DNA, 25 bp, Mus musculus
gtctatgacttggccggttttctcg

SEQ ID NO: 957537 - DNA, 25 bp, Mus musculus
gtctatgagaagcgatgtaatcggc

SEQ ID NO: 957538 - DNA, 25 bp, Mus musculus
gtctatgagaagggatgtaatcggc

SEQ ID NO: 957539 - DNA, 25 bp, Mus musculus
gtctatgcaaaacgtataaatcctc

SEQ ID NO: 957540 - DNA, 25 bp, Mus musculus
gtctatgcaaaactgcttcaccgat

SEQ ID NO: 957541 - DNA, 25 bp, Mus musculus
gtctatgcaaaaggtataaatcctc

SEQ ID NO: 957542 - DNA, 25 bp, Mus musculus
gtctatgcaaaagtgcttcaccgat

SEQ ID NO: 957543 - DNA, 25 bp, Mus musculus
gtctatgcttcacgcaacagctgag

SEQ ID NO: 957544 - DNA, 25 bp, Mus musculus
gtctatgcttcaggcaacagctgag

SEQ ID NO: 957545 - DNA, 25 bp, Mus musculus
gtctatggctacaaatctctgcttt

SEQ ID NO: 957546 - DNA, 25 bp, Mus musculus
gtctatggctacaattctctgcttt

SEQ ID NO: 957547 - DNA, 25 bp, Mus musculus
gtctatgttgccaatgttgcttgga

SEQ ID NO: 957548 - DNA, 25 bp, Mus musculus
gtctatgttggcaatgttgcttgga

SEQ ID NO: 957549 - DNA, 25 bp, Mus musculus
gtctattataaactgatttcatcag

SEQ ID NO: 957550 - DNA, 25 bp, Mus musculus
gtctattataaagtgatttcatcag

SEQ ID NO: 957551 - DNA, 25 bp, Mus musculus
gtctattatcagcacctgaacacag

SEQ ID NO: 957552 - DNA, 25 bp, Mus musculus
gtctattatcagcagctgaacacag

SEQ ID NO: 957553 - DNA, 25 bp, Mus musculus
gtctattgagataaaagccagagtt

SEQ ID NO: 957554 - DNA, 25 bp, Mus musculus
gtctattgagataatagccagagtt

SEQ ID NO: 957555 - DNA, 25 bp, Mus musculus
gtctcaaacaataggtgaccagtgt

SEQ ID NO: 957556 - DNA, 25 bp, Mus musculus
gtctcaaacaattggtgaccagtgt

SEQ ID NO: 957557 - DNA, 25 bp, Mus musculus
gtctcaacaaaacggctctactaca

SEQ ID NO: 957558 - DNA, 25 bp, Mus musculus
gtctcaacaaaagggctctactaca

SEQ ID NO: 957559 - DNA, 25 bp, Mus musculus
gtctcaacctggataccatggcctg

SEQ ID NO: 957560 - DNA, 25 bp, Mus musculus
gtctcaacctggttaccatggcctg

SEQ ID NO: 957561 - DNA, 25 bp, Mus musculus
gtctcaagagaacattctcagcgac

SEQ ID NO: 957562 - DNA, 25 bp, Mus musculus
gtctcaagagaagattctcagcgac

SEQ ID NO: 957563 - DNA, 25 bp, Mus musculus
gtctcaaggcaacataggaaaaatt

SEQ ID NO: 957564 - DNA, 25 bp, Mus musculus
gtctcaaggcaagataggaaaaatt

SEQ ID NO: 957565 - DNA, 25 bp, Mus musculus
gtctcaattcttatattgtccccat

SEQ ID NO: 957566 - DNA, 25 bp, Mus musculus
gtctcaattcttttattgtccccat

SEQ ID NO: 957567 - DNA, 25 bp, Mus musculus
gtctcacgagcaccatgacttcttc

SEQ ID NO: 957568 - DNA, 25 bp, Mus musculus
gtctcacgaggaccatgacttcttc

SEQ ID NO: 957569 - DNA, 25 bp, Mus musculus
gtctcacgcgagacgaagacagctc

SEQ ID NO: 957570 - DNA, 25 bp, Mus musculus
gtctcacgcgagtcgaagacagctc

SEQ ID NO: 957571 - DNA, 25 bp, Mus musculus
gtctcactctacaaccaatgctgtg

SEQ ID NO: 957572 - DNA, 25 bp, Mus musculus
gtctcactctacaagcaatgctgtg

SEQ ID NO: 957573 - DNA, 25 bp, Mus musculus
gtctcagaagcttttccaaggctgt

SEQ ID NO: 957574 - DNA, 25 bp, Mus musculus
gtctcagaaggactccaactgcctg

SEQ ID NO: 957575 - DNA, 25 bp, Mus musculus
gtctcagaaggactgcaactgcctg

SEQ ID NO: 957576 - DNA, 25 bp, Mus musculus
gtctcagaaggttttccaaggctgt

SEQ ID NO: 957577 - DNA, 25 bp, Mus musculus
gtctcagaggatagctctctacagg

SEQ ID NO: 957578 - DNA, 25 bp, Mus musculus
gtctcagaggttagctctctacagg

SEQ ID NO: 957579 - DNA, 25 bp, Mus musculus
gtctcaggagaacacatggcctcct

SEQ ID NO: 957580 - DNA, 25 bp, Mus musculus
gtctcaggagaacagatggcctcct

SEQ ID NO: 957581 - DNA, 25 bp, Mus musculus
gtctcaggattggaagatcgaagcc

SEQ ID NO: 957582 - DNA, 25 bp, Mus musculus
gtctcaggattggatgatcgaagcc

SEQ ID NO: 957583 - DNA, 25 bp, Mus musculus
gtctccaagaatcgtcctggcactg

SEQ ID NO: 957584 - DNA, 25 bp, Mus musculus
gtctccaagaatggtcctggcactg

SEQ ID NO: 957585 - DNA, 25 bp, Mus musculus
gtctccacccttgactcaagtccat

SEQ ID NO: 957586 - DNA, 25 bp, Mus musculus
gtctccacccttgagtcaagtccat

SEQ ID NO: 957587 - DNA, 25 bp, Mus musculus
gtctccactgcaaggaccgctactc

SEQ ID NO: 957588 - DNA, 25 bp, Mus musculus
gtctccactgcatggaccgctactc

SEQ ID NO: 957589 - DNA, 25 bp, Mus musculus
gtctccagaaatcaaatctgctcca

SEQ ID NO: 957590 - DNA, 25 bp, Mus musculus
gtctccagaaatgaaatctgctcca

SEQ ID NO: 957591 - DNA, 25 bp, Mus musculus
gtctccagacatcgagacaacagct

SEQ ID NO: 957592 - DNA, 25 bp, Mus musculus
gtctccagacatggagacaacagct

SEQ ID NO: 957593 - DNA, 25 bp, Mus musculus
gtctccaggaaacatattctgaaag

SEQ ID NO: 957594 - DNA, 25 bp, Mus musculus
gtctccaggaaagatattctgaaag

SEQ ID NO: 957595 - DNA, 25 bp, Mus musculus
gtctccaggaacctcgtcacacacc

SEQ ID NO: 957596 - DNA, 25 bp, Mus musculus
gtctccaggaacctggtcacacacc

SEQ ID NO: 957597 - DNA, 25 bp, Mus musculus
gtctccagggagaccaaggaggcgt

SEQ ID NO: 957598 - DNA, 25 bp, Mus musculus
gtctccagggagacgaaggaggcgt

SEQ ID NO: 957599 - DNA, 25 bp, Mus musculus
gtctccagttatcgttctccagggc

SEQ ID NO: 957600 - DNA, 25 bp, Mus musculus
gtctccagttatggttctccagggc

SEQ ID NO: 957601 - DNA, 25 bp, Mus musculus
gtctccatgcagctagtgcatatgg

SEQ ID NO: 957602 - DNA, 25 bp, Mus musculus
gtctccatgcaggtagtgcatatgg

SEQ ID NO: 957603 - DNA, 25 bp, Mus musculus
gtctccatttcgctttccagattca

SEQ ID NO: 957604 - DNA, 25 bp, Mus musculus
gtctccatttcggtttccagattca

SEQ ID NO: 957605 - DNA, 25 bp, Mus musculus
gtctcccagatcctacagaaccttg

SEQ ID NO: 957606 - DNA, 25 bp, Mus musculus
gtctcccagatcgtacagaaccttg

SEQ ID NO: 957607 - DNA, 25 bp, Mus musculus
gtctccgcggcgcagacccctgtgc

SEQ ID NO: 957608 - DNA, 25 bp, Mus musculus
gtctccgcggcggagacccctgtgc

SEQ ID NO: 957609 - DNA, 25 bp, Mus musculus
gtctcctagtgaccttgtccaggtg

SEQ ID NO: 957610 - DNA, 25 bp, Mus musculus
gtctcctagtgagcttgtccaggtg

SEQ ID NO: 957611 - DNA, 25 bp, Mus musculus
gtctcctcagagagtcagtccttcc

SEQ ID NO: 957612 - DNA, 25 bp, Mus musculus
gtctcctcagagtctgcgagaaatc

SEQ ID NO: 957613 - DNA, 25 bp, Mus musculus
gtctcctcagccaaaacaacagccc

SEQ ID NO: 957614 - DNA, 25 bp, Mus musculus
gtctcctcagccaaaacgacacccc

SEQ ID NO: 957615 - DNA, 25 bp, Mus musculus
gtctcctcaggcaaaacaacagccc

SEQ ID NO: 957616 - DNA, 25 bp, Mus musculus
gtctcctcaggcaaaacgacacccc

SEQ ID NO: 957617 - DNA, 25 bp, Mus musculus
gtctcctcagtgagtcagtccttcc

SEQ ID NO: 957618 - DNA, 25 bp, Mus musculus
gtctcctcagtgtctgcgagaaatc

SEQ ID NO: 957619 - DNA, 25 bp, Mus musculus
gtctcctccaaaacctcaggctggc

SEQ ID NO: 957620 - DNA, 25 bp, Mus musculus
gtctcctccaaatcctcaggctggc

SEQ ID NO: 957621 - DNA, 25 bp, Mus musculus
gtctcctcccagagccctggggggc

SEQ ID NO: 957622 - DNA, 25 bp, Mus musculus
gtctcctcccagtgccctggggggc

SEQ ID NO: 957623 - DNA, 25 bp, Mus musculus
gtctcctccggcatgttggaggtga

SEQ ID NO: 957624 - DNA, 25 bp, Mus musculus
gtctcctccggcttgttggaggtga

SEQ ID NO: 957625 - DNA, 25 bp, Mus musculus
gtctcctgataacacgtacctgtat

SEQ ID NO: 957626 - DNA, 25 bp, Mus musculus
gtctcctgataacaggtacctgtat

SEQ ID NO: 957627 - DNA, 25 bp, Mus musculus
gtctcctgccacaatcaaaaccaag

SEQ ID NO: 957628 - DNA, 25 bp, Mus musculus
gtctcctgccactatcaaaaccaag

SEQ ID NO: 957629 - DNA, 25 bp, Mus musculus
gtctcctgctcacattttgatccga
